United States Patent 7,888,497 (BIOINFORMATICALLY DETECTABLE GROUP OF NOVEL REGULATORY OLIGONUCLEOTIDES AND USES THEREOF) - sequence listing, part 52

SEQ ID NO: 2180985 - DNA, 16 bp, Homo sapiens
aaataaagtaaattga

SEQ ID NO: 2180986 - DNA, 13 bp, Homo sapiens
aaataatattgat

SEQ ID NO: 2180987 - DNA, 16 bp, Homo sapiens
aaataatcttagaaca

SEQ ID NO: 2180988 - DNA, 17 bp, Homo sapiens
aaatacaattcaaacaa

SEQ ID NO: 2180989 - DNA, 19 bp, Homo sapiens
aaatacaattcaaacaatt

SEQ ID NO: 2180990 - DNA, 17 bp, Homo sapiens
aaatactgtacatagat

SEQ ID NO: 2180991 - DNA, 23 bp, Homo sapiens
aaatactgtacatagatgtatca

SEQ ID NO: 2180992 - DNA, 14 bp, Homo sapiens
aaatacttaataaa

SEQ ID NO: 2180993 - DNA, 13 bp, Homo sapiens
aaatacttcaaat

SEQ ID NO: 2180994 - DNA, 18 bp, Homo sapiens
aaatagtgtgtccatgca

SEQ ID NO: 2180995 - DNA, 14 bp, Homo sapiens
aaatatattttctt

SEQ ID NO: 2180996 - DNA, 14 bp, Homo sapiens
aaatatcactttgt

SEQ ID NO: 2180997 - DNA, 20 bp, Homo sapiens
aaatatctacctgccctctc

SEQ ID NO: 2180998 - DNA, 16 bp, Homo sapiens
aaatatgtgattatca

SEQ ID NO: 2180999 - DNA, 19 bp, Homo sapiens
aaatatgtgattatcattt

SEQ ID NO: 2181000 - DNA, 13 bp, Homo sapiens
aaatatttcttaa

SEQ ID NO: 2181001 - DNA, 20 bp, Homo sapiens
aaatatttcttaagtataaa

SEQ ID NO: 2181002 - DNA, 14 bp, Homo sapiens
aaatcacatttcca

SEQ ID NO: 2181003 - DNA, 18 bp, Homo sapiens
aaatcagttttgtgtaca

SEQ ID NO: 2181004 - DNA, 17 bp, Homo sapiens
aaatcatgttttgatga

SEQ ID NO: 2181005 - DNA, 13 bp, Homo sapiens
aaatcctttcata

SEQ ID NO: 2181006 - DNA, 20 bp, Homo sapiens
aaatctcctctttgtgaaat

SEQ ID NO: 2181007 - DNA, 16 bp, Homo sapiens
aaatgggactgatgtc

SEQ ID NO: 2181008 - DNA, 22 bp, Homo sapiens
aaattaataaatcatgttttga

SEQ ID NO: 2181009 - DNA, 17 bp, Homo sapiens
aaattaatttgttaatt

SEQ ID NO: 2181010 - DNA, 18 bp, Homo sapiens
aaattaatttgttaatta

SEQ ID NO: 2181011 - DNA, 16 bp, Homo sapiens
aaattagatgactgaa

SEQ ID NO: 2181012 - DNA, 22 bp, Homo sapiens
aaattagtgtacctattaaaag

SEQ ID NO: 2181013 - DNA, 13 bp, Homo sapiens
aaattcattccat

SEQ ID NO: 2181014 - DNA, 15 bp, Homo sapiens
aaattcattccattt

SEQ ID NO: 2181015 - DNA, 16 bp, Homo sapiens
aaattccacccctcct

SEQ ID NO: 2181016 - DNA, 17 bp, Homo sapiens
aaattccacccctcctt

SEQ ID NO: 2181017 - DNA, 20 bp, Homo sapiens
aaattgaaatgggaacaata

SEQ ID NO: 2181018 - DNA, 23 bp, Homo sapiens
aaattgaggttgttcaaagttta

SEQ ID NO: 2181019 - DNA, 16 bp, Homo sapiens
aaattgatgggtgggc

SEQ ID NO: 2181020 - DNA, 11 bp, Homo sapiens
aaccaagctgt

SEQ ID NO: 2181021 - DNA, 15 bp, Homo sapiens
aaccacgcctcttga

SEQ ID NO: 2181022 - DNA, 12 bp, Homo sapiens
aaccactgtaca

SEQ ID NO: 2181023 - DNA, 14 bp, Homo sapiens
aaccactgtacata

SEQ ID NO: 2181024 - DNA, 22 bp, Homo sapiens
aaccaggagcattttgtgtctt

SEQ ID NO: 2181025 - DNA, 17 bp, Homo sapiens
aaccagggcaccaagcc

SEQ ID NO: 2181026 - DNA, 14 bp, Homo sapiens
aaccatgaaaaaat

SEQ ID NO: 2181027 - DNA, 14 bp, Homo sapiens
aaccatgaactcag

SEQ ID NO: 2181028 - DNA, 11 bp, Homo sapiens
aacccacactg

SEQ ID NO: 2181029 - DNA, 14 bp, Homo sapiens
aacccagcatgtac

SEQ ID NO: 2181030 - DNA, 15 bp, Homo sapiens
aacccagcatgtaca

SEQ ID NO: 2181031 - DNA, 16 bp, Homo sapiens
aacccagcatgtacaa

SEQ ID NO: 2181032 - DNA, 13 bp, Homo sapiens
aacccaggagcat

SEQ ID NO: 2181033 - DNA, 20 bp, Homo sapiens
aacccaggagcatccacctc

SEQ ID NO: 2181034 - DNA, 22 bp, Homo sapiens
aacccaggagcatccacctcct

SEQ ID NO: 2181035 - DNA, 20 bp, Homo sapiens
aacccatttgccatgctgct

SEQ ID NO: 2181036 - DNA, 21 bp, Homo sapiens
aacccatttgccatgctgcta

SEQ ID NO: 2181037 - DNA, 20 bp, Homo sapiens
aaccccgtctgctcctccct

SEQ ID NO: 2181038 - DNA, 21 bp, Homo sapiens
aaccctctcaggtgaccaaaa

SEQ ID NO: 2181039 - DNA, 19 bp, Homo sapiens
aaccctgaggtatctgtgt

SEQ ID NO: 2181040 - DNA, 14 bp, Homo sapiens
aacccttctcttct

SEQ ID NO: 2181041 - DNA, 15 bp, Homo sapiens
aaccgctacaagagg

SEQ ID NO: 2181042 - DNA, 20 bp, Homo sapiens
aacctactgaggagcaaagc

SEQ ID NO: 2181043 - DNA, 20 bp, Homo sapiens
aacctacttgtaaacttgaa

SEQ ID NO: 2181044 - DNA, 17 bp, Homo sapiens
aacctggaccaaagctg

SEQ ID NO: 2181045 - DNA, 18 bp, Homo sapiens
aacctggaccaaagctga

SEQ ID NO: 2181046 - DNA, 13 bp, Homo sapiens
aacctggtggctg

SEQ ID NO: 2181047 - DNA, 15 bp, Homo sapiens
aacctggtggctgga

SEQ ID NO: 2181048 - DNA, 13 bp, Homo sapiens
aaccttcaaagct

SEQ ID NO: 2181049 - DNA, 21 bp, Homo sapiens
aaccttcctgtcttcatcctt

SEQ ID NO: 2181050 - DNA, 15 bp, Homo sapiens
aacctttaaaaatgt

SEQ ID NO: 2181051 - DNA, 19 bp, Homo sapiens
aacctttaaaaatgtataa

SEQ ID NO: 2181052 - DNA, 22 bp, Homo sapiens
aacctttaaaaatgtataatga

SEQ ID NO: 2181053 - DNA, 13 bp, Homo sapiens
aacctttccattt

SEQ ID NO: 2181054 - DNA, 18 bp, Homo sapiens
aacgtatcacctttccca

SEQ ID NO: 2181055 - DNA, 22 bp, Homo sapiens
aacgtgagagaaagagagaagc

SEQ ID NO: 2181056 - DNA, 13 bp, Homo sapiens
aacgtgccctctg

SEQ ID NO: 2181057 - DNA, 15 bp, Homo sapiens
aacgttccacaacag

SEQ ID NO: 2181058 - DNA, 19 bp, Homo sapiens
aactaattttaaagtaaaa

SEQ ID NO: 2181059 - DNA, 23 bp, Homo sapiens
aactagagcagccctggagtcat

SEQ ID NO: 2181060 - DNA, 20 bp, Homo sapiens
aactagtggtggctctgaga

SEQ ID NO: 2181061 - DNA, 16 bp, Homo sapiens
aactcatactgtgctg

SEQ ID NO: 2181062 - DNA, 21 bp, Homo sapiens
aactcatcgttctaaaatcaa

SEQ ID NO: 2181063 - DNA, 21 bp, Homo sapiens
aactcgaatcactcatttatt

SEQ ID NO: 2181064 - DNA, 23 bp, Homo sapiens
aactctatgggtatcaaacagct

SEQ ID NO: 2181065 - DNA, 13 bp, Homo sapiens
aactctcaggact

SEQ ID NO: 2181066 - DNA, 20 bp, Homo sapiens
aactctccttttccttacca

SEQ ID NO: 2181067 - DNA, 15 bp, Homo sapiens
aactctgcccaccct

SEQ ID NO: 2181068 - DNA, 19 bp, Homo sapiens
aactctggctccttctcca

SEQ ID NO: 2181069 - DNA, 13 bp, Homo sapiens
aactcttcatctt

SEQ ID NO: 2181070 - DNA, 22 bp, Homo sapiens
aactgaccctcccttcctgtcc

SEQ ID NO: 2181071 - DNA, 19 bp, Homo sapiens
aactgagtagcagaaaaca

SEQ ID NO: 2181072 - DNA, 20 bp, Homo sapiens
aactgatcatttgcagctgc

SEQ ID NO: 2181073 - DNA, 21 bp, Homo sapiens
aactgatcatttgcagctgct

SEQ ID NO: 2181074 - DNA, 18 bp, Homo sapiens
aactgcattctataataa

SEQ ID NO: 2181075 - DNA, 19 bp, Homo sapiens
aactgctaaatactgtaca

SEQ ID NO: 2181076 - DNA, 13 bp, Homo sapiens
aactgctgcccca

SEQ ID NO: 2181077 - DNA, 18 bp, Homo sapiens
aactggcttctgcttgtc

SEQ ID NO: 2181078 - DNA, 13 bp, Homo sapiens
aactgtatttgaa

SEQ ID NO: 2181079 - DNA, 15 bp, Homo sapiens
aactgtgtcacgcag

SEQ ID NO: 2181080 - DNA, 13 bp, Homo sapiens
aactgttgttgaa

SEQ ID NO: 2181081 - DNA, 13 bp, Homo sapiens
aactgttgtttga

SEQ ID NO: 2181082 - DNA, 15 bp, Homo sapiens
aactgtttccctgct

SEQ ID NO: 2181083 - DNA, 18 bp, Homo sapiens
aactgtttccctgctgaa

SEQ ID NO: 2181084 - DNA, 19 bp, Homo sapiens
aacttaaatgttattatct

SEQ ID NO: 2181085 - DNA, 15 bp, Homo sapiens
aacttggttcccaga

SEQ ID NO: 2181086 - DNA, 20 bp, Homo sapiens
aacttggttcccagaaaaca

SEQ ID NO: 2181087 - DNA, 19 bp, Homo sapiens
aacttgtgcttttgcaaaa

SEQ ID NO: 2181088 - DNA, 16 bp, Homo sapiens
aactttagaaataaga

SEQ ID NO: 2181089 - DNA, 19 bp, Homo sapiens
aactttggagaactcattt

SEQ ID NO: 2181090 - DNA, 15 bp, Homo sapiens
aagaaaattgccaaa

SEQ ID NO: 2181091 - DNA, 18 bp, Homo sapiens
aagaaaattgccaaaata

SEQ ID NO: 2181092 - DNA, 12 bp, Homo sapiens
aagaaacattta

SEQ ID NO: 2181093 - DNA, 16 bp, Homo sapiens
aagaaacatttatctt

SEQ ID NO: 2181094 - DNA, 21 bp, Homo sapiens
aagaaaccatttttaatgaga

SEQ ID NO: 2181095 - DNA, 15 bp, Homo sapiens
aagaaattccctgga

SEQ ID NO: 2181096 - DNA, 14 bp, Homo sapiens
aagaacaaaactgt

SEQ ID NO: 2181097 - DNA, 12 bp, Homo sapiens
aagaacatgtta

SEQ ID NO: 2181098 - DNA, 14 bp, Homo sapiens
agccttgcccagca

SEQ ID NO: 2181099 - DNA, 21 bp, Homo sapiens
agccttgcgcaaaacccagaa

SEQ ID NO: 2181100 - DNA, 14 bp, Homo sapiens
agcgactctcctgc

SEQ ID NO: 2181101 - DNA, 21 bp, Homo sapiens
agcgactctcctgcctcagcc

SEQ ID NO: 2181102 - DNA, 20 bp, Homo sapiens
agcgatccctcccctcagcc

SEQ ID NO: 2181103 - DNA, 21 bp, Homo sapiens
agcgatgatgtccccttccct

SEQ ID NO: 2181104 - DNA, 21 bp, Homo sapiens
agcgcaaagtgctagccactg

SEQ ID NO: 2181105 - DNA, 23 bp, Homo sapiens
agcgcacttgatggtcaggaagt

SEQ ID NO: 2181106 - DNA, 14 bp, Homo sapiens
agcggccgcctgtc

SEQ ID NO: 2181107 - DNA, 13 bp, Homo sapiens
agcgggcggaggg

SEQ ID NO: 2181108 - DNA, 18 bp, Homo sapiens
agcgggtctagtggaaag

SEQ ID NO: 2181109 - DNA, 19 bp, Homo sapiens
agcggtggaaggagcctgc

SEQ ID NO: 2181110 - DNA, 20 bp, Homo sapiens
agcggtggaaggagcctgcg

SEQ ID NO: 2181111 - DNA, 16 bp, Homo sapiens
agcggttgtaaataca

SEQ ID NO: 2181112 - DNA, 13 bp, Homo sapiens
agctacttgggcc

SEQ ID NO: 2181113 - DNA, 15 bp, Homo sapiens
agctacttgggccat

SEQ ID NO: 2181114 - DNA, 19 bp, Homo sapiens
agctagagaggggcctctg

SEQ ID NO: 2181115 - DNA, 15 bp, Homo sapiens
agctagagcttcaag

SEQ ID NO: 2181116 - DNA, 17 bp, Homo sapiens
agctagctcccctcctc

SEQ ID NO: 2181117 - DNA, 18 bp, Homo sapiens
agctaggccccagaggcc

SEQ ID NO: 2181118 - DNA, 23 bp, Homo sapiens
agctaggccccagaggccctgga

SEQ ID NO: 2181119 - DNA, 22 bp, Homo sapiens
agctataaagcagtatttttct

SEQ ID NO: 2181120 - DNA, 18 bp, Homo sapiens
agctatacctcacaataa

SEQ ID NO: 2181121 - DNA, 15 bp, Homo sapiens
agctattaagaaaat

SEQ ID NO: 2181122 - DNA, 11 bp, Homo sapiens
agctattcttt

SEQ ID NO: 2181123 - DNA, 16 bp, Homo sapiens
agctcacggcagcctc

SEQ ID NO: 2181124 - DNA, 17 bp, Homo sapiens
agctcagccccagccca

SEQ ID NO: 2181125 - DNA, 18 bp, Homo sapiens
agctcagccccagcccag

SEQ ID NO: 2181126 - DNA, 16 bp, Homo sapiens
agctcagtttggctgt

SEQ ID NO: 2181127 - DNA, 23 bp, Homo sapiens
agctcagtttggctgtaatttaa

SEQ ID NO: 2181128 - DNA, 16 bp, Homo sapiens
agctccacaagagaga

SEQ ID NO: 2181129 - DNA, 13 bp, Homo sapiens
agctcccctcctc

SEQ ID NO: 2181130 - DNA, 19 bp, Homo sapiens
agctcccctcctctcccct

SEQ ID NO: 2181131 - DNA, 17 bp, Homo sapiens
agctccgcctggcaccc

SEQ ID NO: 2181132 - DNA, 20 bp, Homo sapiens
agctccttgtgagtgtgtgc

SEQ ID NO: 2181133 - DNA, 12 bp, Homo sapiens
agctctggagaa

SEQ ID NO: 2181134 - DNA, 14 bp, Homo sapiens
agctctggagccac

SEQ ID NO: 2181135 - DNA, 16 bp, Homo sapiens
agctctggagccacct

SEQ ID NO: 2181136 - DNA, 12 bp, Homo sapiens
agctctggtggg

SEQ ID NO: 2181137 - DNA, 21 bp, Homo sapiens
agctcttagtcctccctgctc

SEQ ID NO: 2181138 - DNA, 18 bp, Homo sapiens
agctcttctcctcagctt

SEQ ID NO: 2181139 - DNA, 15 bp, Homo sapiens
agctgaacctgttca

SEQ ID NO: 2181140 - DNA, 14 bp, Homo sapiens
agctgaagacaaac

SEQ ID NO: 2181141 - DNA, 16 bp, Homo sapiens
agctgacgaggctggg

SEQ ID NO: 2181142 - DNA, 20 bp, Homo sapiens
agctgacgaggctgggccaa

SEQ ID NO: 2181143 - DNA, 20 bp, Homo sapiens
agctgacttggttctgaagc

SEQ ID NO: 2181144 - DNA, 14 bp, Homo sapiens
agctgagctggcct

SEQ ID NO: 2181145 - DNA, 21 bp, Homo sapiens
agctgatttggtcaccttcct

SEQ ID NO: 2181146 - DNA, 15 bp, Homo sapiens
agctgcaggtgccca

SEQ ID NO: 2181147 - DNA, 22 bp, Homo sapiens
agctgccagtggggtcgtgagg

SEQ ID NO: 2181148 - DNA, 13 bp, Homo sapiens
agctgcctaagag

SEQ ID NO: 2181149 - DNA, 18 bp, Homo sapiens
agctgcctccctgtccac

SEQ ID NO: 2181150 - DNA, 13 bp, Homo sapiens
agctgcctggatg

SEQ ID NO: 2181151 - DNA, 17 bp, Homo sapiens
agctgcctggatgagaa

SEQ ID NO: 2181152 - DNA, 18 bp, Homo sapiens
agctgctccgaggaccca

SEQ ID NO: 2181153 - DNA, 20 bp, Homo sapiens
agctgctccgaggacccagg

SEQ ID NO: 2181154 - DNA, 18 bp, Homo sapiens
agctgctctgcccagagc

SEQ ID NO: 2181155 - DNA, 21 bp, Homo sapiens
agctgctctgcccagagctgg

SEQ ID NO: 2181156 - DNA, 15 bp, Homo sapiens
agctggagatactga

SEQ ID NO: 2181157 - DNA, 17 bp, Homo sapiens
agctggagatactgatt

SEQ ID NO: 2181158 - DNA, 14 bp, Homo sapiens
agctggccgggttg

SEQ ID NO: 2181159 - DNA, 22 bp, Homo sapiens
agctggccgggttggaggcctc

SEQ ID NO: 2181160 - DNA, 15 bp, Homo sapiens
agctggcctcacctg

SEQ ID NO: 2181161 - DNA, 16 bp, Homo sapiens
agctggcggaacctgg

SEQ ID NO: 2181162 - DNA, 19 bp, Homo sapiens
agctggcggaacctggctg

SEQ ID NO: 2181163 - DNA, 20 bp, Homo sapiens
agctgggcaaacccttctct

SEQ ID NO: 2181164 - DNA, 16 bp, Homo sapiens
agctggggcccctcgg

SEQ ID NO: 2181165 - DNA, 18 bp, Homo sapiens
agctggggcccctcggct

SEQ ID NO: 2181166 - DNA, 14 bp, Homo sapiens
agctgtaaaccaga

SEQ ID NO: 2181167 - DNA, 16 bp, Homo sapiens
agctgtaaaccagaga

SEQ ID NO: 2181168 - DNA, 17 bp, Homo sapiens
agctgtaaaccagagag

SEQ ID NO: 2181169 - DNA, 19 bp, Homo sapiens
agctgtccctgcagggcca

SEQ ID NO: 2181170 - DNA, 13 bp, Homo sapiens
agctgtgaaattg

SEQ ID NO: 2181171 - DNA, 21 bp, Homo sapiens
agctgtttctaaacagttgag

SEQ ID NO: 2181172 - DNA, 18 bp, Homo sapiens
agcttacaggaagctttt

SEQ ID NO: 2181173 - DNA, 19 bp, Homo sapiens
agcttccgctttgaaagaa

SEQ ID NO: 2181174 - DNA, 13 bp, Homo sapiens
agcttcctgtttc

SEQ ID NO: 2181175 - DNA, 15 bp, Homo sapiens
agcttcctgtttcta

SEQ ID NO: 2181176 - DNA, 18 bp, Homo sapiens
agcttcctgtttctaagt

SEQ ID NO: 2181177 - DNA, 19 bp, Homo sapiens
agcttgcttcattgggctg

SEQ ID NO: 2181178 - DNA, 18 bp, Homo sapiens
agcttgtacacatataca

SEQ ID NO: 2181179 - DNA, 15 bp, Homo sapiens
agctttcctgggtga

SEQ ID NO: 2181180 - DNA, 21 bp, Homo sapiens
agctttctctgcttcagcttg

SEQ ID NO: 2181181 - DNA, 21 bp, Homo sapiens
agctttggacacacacagctt

SEQ ID NO: 2181182 - DNA, 23 bp, Homo sapiens
agctttggacacacacagcttct

SEQ ID NO: 2181183 - DNA, 14 bp, Homo sapiens
agctttggacgcac

SEQ ID NO: 2181184 - DNA, 18 bp, Homo sapiens
agcttttagtacccacct

SEQ ID NO: 2181185 - DNA, 19 bp, Homo sapiens
aggaaacaaccatgtcatt

SEQ ID NO: 2181186 - DNA, 20 bp, Homo sapiens
aggaaactttttccaccttt

SEQ ID NO: 2181187 - DNA, 19 bp, Homo sapiens
aggaaagaagggggccctg

SEQ ID NO: 2181188 - DNA, 20 bp, Homo sapiens
aggaaagaagggggccctgc

SEQ ID NO: 2181189 - DNA, 22 bp, Homo sapiens
aggaaagaagggggccctgcta

SEQ ID NO: 2181190 - DNA, 16 bp, Homo sapiens
aggaaataaaattaat

SEQ ID NO: 2181191 - DNA, 17 bp, Homo sapiens
aggaagaacttgaagtg

SEQ ID NO: 2181192 - DNA, 21 bp, Homo sapiens
aggaagatcactttgctctga

SEQ ID NO: 2181193 - DNA, 12 bp, Homo sapiens
aggaagcacaag

SEQ ID NO: 2181194 - DNA, 18 bp, Homo sapiens
aggaagcacaagaagtgg

SEQ ID NO: 2181195 - DNA, 21 bp, Homo sapiens
aggaagcacaagaagtgggag

SEQ ID NO: 2181196 - DNA, 20 bp, Homo sapiens
aggaagccgcctagtgcaga

SEQ ID NO: 2181197 - DNA, 19 bp, Homo sapiens
aggaagctccagtcctgct

SEQ ID NO: 2181198 - DNA, 22 bp, Homo sapiens
aggaagctttctctgcttcagc

SEQ ID NO: 2181199 - DNA, 15 bp, Homo sapiens
aggaagtagcaggcc

SEQ ID NO: 2181200 - DNA, 19 bp, Homo sapiens
aggaattggggtttctggt

SEQ ID NO: 2181201 - DNA, 12 bp, Homo sapiens
aggacagctgca

SEQ ID NO: 2181202 - DNA, 14 bp, Homo sapiens
aggacagctgcagg

SEQ ID NO: 2181203 - DNA, 18 bp, Homo sapiens
aggacaggaccctcagga

SEQ ID NO: 2181204 - DNA, 16 bp, Homo sapiens
aggacatgttcccttc

SEQ ID NO: 2181205 - DNA, 14 bp, Homo sapiens
aggacccaggaaag

SEQ ID NO: 2181206 - DNA, 13 bp, Homo sapiens
aggaccctcagga

SEQ ID NO: 2181207 - DNA, 14 bp, Homo sapiens
aggactgacctgcc

SEQ ID NO: 2181208 - DNA, 18 bp, Homo sapiens
aggactgacctgcccctg

SEQ ID NO: 2181209 - DNA, 18 bp, Homo sapiens
aggacttaagacaaatgg

SEQ ID NO: 2181210 - DNA, 15 bp, Homo sapiens
aggacttgtgcctct

SEQ ID NO: 2181211 - DNA, 13 bp, Homo sapiens
aggactttgtaca

SEQ ID NO: 2181212 - DNA, 14 bp, Homo sapiens
aggagacttgtaca

SEQ ID NO: 2181213 - DNA, 15 bp, Homo sapiens
aggagacttgtacag

SEQ ID NO: 2181214 - DNA, 18 bp, Homo sapiens
aggagagaatgagagagt

SEQ ID NO: 2181215 - DNA, 12 bp, Homo sapiens
aggagagagacc

SEQ ID NO: 2181216 - DNA, 16 bp, Homo sapiens
aggagagagaccccgc

SEQ ID NO: 2181217 - DNA, 18 bp, Homo sapiens
aggagagagcttcctgtt

SEQ ID NO: 2181218 - DNA, 18 bp, Homo sapiens
aggagattaacacactga

SEQ ID NO: 2181219 - DNA, 21 bp, Homo sapiens
aggagattaacacactgaacc

SEQ ID NO: 2181220 - DNA, 12 bp, Homo sapiens
aggagcaaagca

SEQ ID NO: 2181221 - DNA, 15 bp, Homo sapiens
aggagcaaagcagca

SEQ ID NO: 2181222 - DNA, 16 bp, Homo sapiens
aggagcatccacctcc

SEQ ID NO: 2181223 - DNA, 16 bp, Homo sapiens
agggtagggggcctga

SEQ ID NO: 2181224 - DNA, 18 bp, Homo sapiens
agggtctttgtgtgctgt

SEQ ID NO: 2181225 - DNA, 23 bp, Homo sapiens
agggttctgcttttaagtttttc

SEQ ID NO: 2181226 - DNA, 18 bp, Homo sapiens
agggttgatatattcttt

SEQ ID NO: 2181227 - DNA, 17 bp, Homo sapiens
aggtaaagggacactgg

SEQ ID NO: 2181228 - DNA, 18 bp, Homo sapiens
aggtaaagggacactgga

SEQ ID NO: 2181229 - DNA, 18 bp, Homo sapiens
aggtacagtaaaacaatt

SEQ ID NO: 2181230 - DNA, 13 bp, Homo sapiens
aggtattgcaagg

SEQ ID NO: 2181231 - DNA, 19 bp, Homo sapiens
aggtcccgagccccctgtc

SEQ ID NO: 2181232 - DNA, 20 bp, Homo sapiens
aggtcccgagccccctgtcc

SEQ ID NO: 2181233 - DNA, 14 bp, Homo sapiens
aggtcgggctcagc

SEQ ID NO: 2181234 - DNA, 18 bp, Homo sapiens
aggtcgggctcagctctg

SEQ ID NO: 2181235 - DNA, 22 bp, Homo sapiens
aggtctccaggggcctgcagaa

SEQ ID NO: 2181236 - DNA, 12 bp, Homo sapiens
aggtctcttccc

SEQ ID NO: 2181237 - DNA, 13 bp, Homo sapiens
aggtctcttcccc

SEQ ID NO: 2181238 - DNA, 18 bp, Homo sapiens
aggtctgggagaggcaga

SEQ ID NO: 2181239 - DNA, 19 bp, Homo sapiens
aggtctgggagaggcagag

SEQ ID NO: 2181240 - DNA, 20 bp, Homo sapiens
aggtgaccaaaatccccttc

SEQ ID NO: 2181241 - DNA, 15 bp, Homo sapiens
aggtgagggatgcca

SEQ ID NO: 2181242 - DNA, 12 bp, Homo sapiens
aggtgccaccac

SEQ ID NO: 2181243 - DNA, 19 bp, Homo sapiens
aggtgccaccaccctgccc

SEQ ID NO: 2181244 - DNA, 18 bp, Homo sapiens
aggtgctgaactgtgcat

SEQ ID NO: 2181245 - DNA, 19 bp, Homo sapiens
aggtggggaagagagcctg

SEQ ID NO: 2181246 - DNA, 20 bp, Homo sapiens
aggtgggggttggctgggta

SEQ ID NO: 2181247 - DNA, 20 bp, Homo sapiens
aggtggggtgaagctgggga

SEQ ID NO: 2181248 - DNA, 16 bp, Homo sapiens
aggtgtccccagccca

SEQ ID NO: 2181249 - DNA, 13 bp, Homo sapiens
aggtgtttgggat

SEQ ID NO: 2181250 - DNA, 20 bp, Homo sapiens
aggttccccaagggccctgg

SEQ ID NO: 2181251 - DNA, 21 bp, Homo sapiens
aggttccccaagggccctggc

SEQ ID NO: 2181252 - DNA, 23 bp, Homo sapiens
aggttccccaagggccctggcac

SEQ ID NO: 2181253 - DNA, 17 bp, Homo sapiens
aggttctgtctgtgcca

SEQ ID NO: 2181254 - DNA, 17 bp, Homo sapiens
aggttggaactgctgcc

SEQ ID NO: 2181255 - DNA, 19 bp, Homo sapiens
aggttggaactgctgccat

SEQ ID NO: 2181256 - DNA, 18 bp, Homo sapiens
aggttggaagctagctcc

SEQ ID NO: 2181257 - DNA, 17 bp, Homo sapiens
aggtttcactgttcatg

SEQ ID NO: 2181258 - DNA, 16 bp, Homo sapiens
aggtttcgttgcatgg

SEQ ID NO: 2181259 - DNA, 18 bp, Homo sapiens
agtaaagtacaagctgta

SEQ ID NO: 2181260 - DNA, 19 bp, Homo sapiens
agtaaattagtaatgtact

SEQ ID NO: 2181261 - DNA, 17 bp, Homo sapiens
agtaacagggccttgct

SEQ ID NO: 2181262 - DNA, 16 bp, Homo sapiens
agtaagaccggaagct

SEQ ID NO: 2181263 - DNA, 18 bp, Homo sapiens
agtaagcacctttagaat

SEQ ID NO: 2181264 - DNA, 15 bp, Homo sapiens
agtaaggcagctctg

SEQ ID NO: 2181265 - DNA, 20 bp, Homo sapiens
agtaataaaacccagcatgt

SEQ ID NO: 2181266 - DNA, 12 bp, Homo sapiens
agtacagctatt

SEQ ID NO: 2181267 - DNA, 13 bp, Homo sapiens
agtactgcaaaat

SEQ ID NO: 2181268 - DNA, 14 bp, Homo sapiens
agtagaataaaaac

SEQ ID NO: 2181269 - DNA, 21 bp, Homo sapiens
agtagcagaaaacagaggcca

SEQ ID NO: 2181270 - DNA, 17 bp, Homo sapiens
agtagctcattcttgtg

SEQ ID NO: 2181271 - DNA, 20 bp, Homo sapiens
agtaggttggaagctagctc

SEQ ID NO: 2181272 - DNA, 18 bp, Homo sapiens
agtatattcaaaaattat

SEQ ID NO: 2181273 - DNA, 21 bp, Homo sapiens
agtatgagtgcaagcaaagca

SEQ ID NO: 2181274 - DNA, 16 bp, Homo sapiens
agtatgcatgcagtct

SEQ ID NO: 2181275 - DNA, 20 bp, Homo sapiens
agtatgtgtctagcaaagcc

SEQ ID NO: 2181276 - DNA, 22 bp, Homo sapiens
agtatgtgtctagcaaagccac

SEQ ID NO: 2181277 - DNA, 22 bp, Homo sapiens
agtcaagattcccggctggact

SEQ ID NO: 2181278 - DNA, 20 bp, Homo sapiens
agtcacagtggggttttttt

SEQ ID NO: 2181279 - DNA, 13 bp, Homo sapiens
agtcatgaagctc

SEQ ID NO: 2181280 - DNA, 19 bp, Homo sapiens
agtcatgacatttctcaaa

SEQ ID NO: 2181281 - DNA, 20 bp, Homo sapiens
agtcatgacatttctcaaag

SEQ ID NO: 2181282 - DNA, 22 bp, Homo sapiens
agtcatggcattcgcagtgccc

SEQ ID NO: 2181283 - DNA, 13 bp, Homo sapiens
agtccactgggga

SEQ ID NO: 2181284 - DNA, 21 bp, Homo sapiens
agtccaggtcgggctcagctc

SEQ ID NO: 2181285 - DNA, 22 bp, Homo sapiens
agtcccaatttaagagtcctga

SEQ ID NO: 2181286 - DNA, 20 bp, Homo sapiens
agtcccaccggttgcttctg

SEQ ID NO: 2181287 - DNA, 12 bp, Homo sapiens
agtccctgcccc

SEQ ID NO: 2181288 - DNA, 19 bp, Homo sapiens
agtcccttccacaccccca

SEQ ID NO: 2181289 - DNA, 14 bp, Homo sapiens
agtcccttccaggc

SEQ ID NO: 2181290 - DNA, 20 bp, Homo sapiens
agtcctcaaggggccatcct

SEQ ID NO: 2181291 - DNA, 16 bp, Homo sapiens
agtcctccctgctcag

SEQ ID NO: 2181292 - DNA, 20 bp, Homo sapiens
agtcctgaggcagaacctgg

SEQ ID NO: 2181293 - DNA, 13 bp, Homo sapiens
agtcggccaggta

SEQ ID NO: 2181294 - DNA, 14 bp, Homo sapiens
agtctcactcccct

SEQ ID NO: 2181295 - DNA, 14 bp, Homo sapiens
agtctcactctgtt

SEQ ID NO: 2181296 - DNA, 16 bp, Homo sapiens
agtctctccctggggt

SEQ ID NO: 2181297 - DNA, 21 bp, Homo sapiens
agtctctccctggggtttttt

SEQ ID NO: 2181298 - DNA, 16 bp, Homo sapiens
agtctgctttctctac

SEQ ID NO: 2181299 - DNA, 23 bp, Homo sapiens
agtctgtgcctggagctcctggg

SEQ ID NO: 2181300 - DNA, 19 bp, Homo sapiens
agtcttccatcagcagtga

SEQ ID NO: 2181301 - DNA, 18 bp, Homo sapiens
agtcttccctagggctgg

SEQ ID NO: 2181302 - DNA, 18 bp, Homo sapiens
agtctttagctatctgtt

SEQ ID NO: 2181303 - DNA, 20 bp, Homo sapiens
agtgaaataatattgatttc

SEQ ID NO: 2181304 - DNA, 16 bp, Homo sapiens
agtgaagcaaaaacta

SEQ ID NO: 2181305 - DNA, 16 bp, Homo sapiens
agtgaagtatgcacta

SEQ ID NO: 2181306 - DNA, 22 bp, Homo sapiens
agtgaatacatggtagcagggt

SEQ ID NO: 2181307 - DNA, 18 bp, Homo sapiens
agtgagcaaacctgcccc

SEQ ID NO: 2181308 - DNA, 12 bp, Homo sapiens
agtgagcatgct

SEQ ID NO: 2181309 - DNA, 16 bp, Homo sapiens
agtgagctctatgggc

SEQ ID NO: 2181310 - DNA, 23 bp, Homo sapiens
agtgagtgcaaaaagctgagtat

SEQ ID NO: 2181311 - DNA, 18 bp, Homo sapiens
agtgatgattgtaagtcc

SEQ ID NO: 2181312 - DNA, 12 bp, Homo sapiens
agtgatggcatt

SEQ ID NO: 2181313 - DNA, 13 bp, Homo sapiens
agtgatggcatta

SEQ ID NO: 2181314 - DNA, 21 bp, Homo sapiens
agtgcaaagctgcttgaatca

SEQ ID NO: 2181315 - DNA, 18 bp, Homo sapiens
agtgcaaagtgccctcat

SEQ ID NO: 2181316 - DNA, 16 bp, Homo sapiens
agtgcaatttcttctg

SEQ ID NO: 2181317 - DNA, 20 bp, Homo sapiens
agtgcaatttcttctgtagc

SEQ ID NO: 2181318 - DNA, 23 bp, Homo sapiens
agtgcagtggtgcgatcatggct

SEQ ID NO: 2181319 - DNA, 22 bp, Homo sapiens
agtgcccagtgatggcattact

SEQ ID NO: 2181320 - DNA, 14 bp, Homo sapiens
agtgccccacctgc

SEQ ID NO: 2181321 - DNA, 15 bp, Homo sapiens
agtgccccacctgcc

SEQ ID NO: 2181322 - DNA, 23 bp, Homo sapiens
agtgccccacctgccactaggct

SEQ ID NO: 2181323 - DNA, 11 bp, Homo sapiens
agtgccctcat

SEQ ID NO: 2181324 - DNA, 14 bp, Homo sapiens
agtgcctttcccca

SEQ ID NO: 2181325 - DNA, 15 bp, Homo sapiens
agtgctcagttccaa

SEQ ID NO: 2181326 - DNA, 20 bp, Homo sapiens
agtgctgagattacaggtgt

SEQ ID NO: 2181327 - DNA, 18 bp, Homo sapiens
agtgctgtcttgatgact

SEQ ID NO: 2181328 - DNA, 23 bp, Homo sapiens
agtgctgtcttgatgactgctga

SEQ ID NO: 2181329 - DNA, 14 bp, Homo sapiens
agtggactgtgtcc

SEQ ID NO: 2181330 - DNA, 12 bp, Homo sapiens
agtggagaaatg

SEQ ID NO: 2181331 - DNA, 11 bp, Homo sapiens
agtggaggcat

SEQ ID NO: 2181332 - DNA, 15 bp, Homo sapiens
agtggaggcattgtt

SEQ ID NO: 2181333 - DNA, 18 bp, Homo sapiens
agtggcatctgaaaacaa

SEQ ID NO: 2181334 - DNA, 19 bp, Homo sapiens
agtggcatctgaaaacaat

SEQ ID NO: 2181335 - DNA, 17 bp, Homo sapiens
agtggccagaccagagc

SEQ ID NO: 2181336 - DNA, 22 bp, Homo sapiens
agtgggaagcccatcctgacca

SEQ ID NO: 2181337 - DNA, 15 bp, Homo sapiens
agtgggagtgggaga

SEQ ID NO: 2181338 - DNA, 19 bp, Homo sapiens
agtgggagtgggagaggaa

SEQ ID NO: 2181339 - DNA, 18 bp, Homo sapiens
agtgggccccgggctgga

SEQ ID NO: 2181340 - DNA, 19 bp, Homo sapiens
agtgggccccgggctggag

SEQ ID NO: 2181341 - DNA, 17 bp, Homo sapiens
agtggggtttttttgtc

SEQ ID NO: 2181342 - DNA, 20 bp, Homo sapiens
agtgggtgagaaattttagt

SEQ ID NO: 2181343 - DNA, 16 bp, Homo sapiens
agtgtagccccaagaa

SEQ ID NO: 2181344 - DNA, 22 bp, Homo sapiens
agtgtagccccaagaaggctgg

SEQ ID NO: 2181345 - DNA, 16 bp, Homo sapiens
agtgtctacatgtgcc

SEQ ID NO: 2181346 - DNA, 21 bp, Homo sapiens
agtgtgacgggggttggggtg

SEQ ID NO: 2181347 - DNA, 14 bp, Homo sapiens
agtgtgccaccctc

SEQ ID NO: 2181348 - DNA, 15 bp, Homo sapiens
agtgtgccaccctct

SEQ ID NO: 2181349 - DNA, 18 bp, Homo sapiens
agtgtgccaccctctgca

SEQ ID NO: 2181350 - DNA, 22 bp, Homo sapiens
agtgtgccaccctctgcagggc

SEQ ID NO: 2181351 - DNA, 19 bp, Homo sapiens
agtgtgtcctgtgtaaatt

SEQ ID NO: 2181352 - DNA, 13 bp, Homo sapiens
agtgtgtctcctg

SEQ ID NO: 2181353 - DNA, 15 bp, Homo sapiens
agtgtgtctcctgca

SEQ ID NO: 2181354 - DNA, 15 bp, Homo sapiens
agtgtgtttgtgagt

SEQ ID NO: 2181355 - DNA, 15 bp, Homo sapiens
agtgtgttttggtat

SEQ ID NO: 2181356 - DNA, 17 bp, Homo sapiens
agtgttttgtacttgtt

SEQ ID NO: 2181357 - DNA, 23 bp, Homo sapiens
agttaaagagcagcctggctaac

SEQ ID NO: 2181358 - DNA, 20 bp, Homo sapiens
agttaaggtgtgcagtgttt

SEQ ID NO: 2181359 - DNA, 16 bp, Homo sapiens
agttactatcctggct

SEQ ID NO: 2181360 - DNA, 16 bp, Homo sapiens
agttagataaaaataa

SEQ ID NO: 2181361 - DNA, 16 bp, Homo sapiens
agttcatgttgctcag

SEQ ID NO: 2181362 - DNA, 15 bp, Homo sapiens
agttccaatgtgccc

SEQ ID NO: 2181363 - DNA, 19 bp, Homo sapiens
agttccctcagtgtgaagc

SEQ ID NO: 2181364 - DNA, 21 bp, Homo sapiens
agttccctcagtgtgaagcct

SEQ ID NO: 2181365 - DNA, 18 bp, Homo sapiens
agttctatccccaagctg

SEQ ID NO: 2181366 - DNA, 22 bp, Homo sapiens
agttctgatgtcttagtgactt

SEQ ID NO: 2181367 - DNA, 15 bp, Homo sapiens
agttgaataatttgt

SEQ ID NO: 2181368 - DNA, 13 bp, Homo sapiens
agttgaggggctt

SEQ ID NO: 2181369 - DNA, 18 bp, Homo sapiens
agttgaggggcttccctc

SEQ ID NO: 2181370 - DNA, 22 bp, Homo sapiens
agttgaggggcttccctctgct

SEQ ID NO: 2181371 - DNA, 19 bp, Homo sapiens
agttgataacccctcttag

SEQ ID NO: 2181372 - DNA, 17 bp, Homo sapiens
agttgataggagacttg

SEQ ID NO: 2181373 - DNA, 19 bp, Homo sapiens
agttgataggagacttgta

SEQ ID NO: 2181374 - DNA, 21 bp, Homo sapiens
agttgatctgaaattcctctg

SEQ ID NO: 2181375 - DNA, 15 bp, Homo sapiens
agttgctgtgcccca

SEQ ID NO: 2181376 - DNA, 23 bp, Homo sapiens
agttgtatttaacagaaattgta

SEQ ID NO: 2181377 - DNA, 19 bp, Homo sapiens
agtttccagctaagcctga

SEQ ID NO: 2181378 - DNA, 11 bp, Homo sapiens
agtttctgttg

SEQ ID NO: 2181379 - DNA, 15 bp, Homo sapiens
agtttcttctaaaga

SEQ ID NO: 2181380 - DNA, 18 bp, Homo sapiens
agtttggctgtaatttaa

SEQ ID NO: 2181381 - DNA, 22 bp, Homo sapiens
agtttgtttcttgtgtgttttt

SEQ ID NO: 2181382 - DNA, 22 bp, Homo sapiens
agtttgtttttgtttggtataa

SEQ ID NO: 2181383 - DNA, 22 bp, Homo sapiens
agttttaacctcaggttccaaa

SEQ ID NO: 2181384 - DNA, 14 bp, Homo sapiens
agttttatgtttct

SEQ ID NO: 2181385 - DNA, 15 bp, Homo sapiens
agttttgctccttct

SEQ ID NO: 2181386 - DNA, 13 bp, Homo sapiens
agtttttacagtg

SEQ ID NO: 2181387 - DNA, 14 bp, Homo sapiens
agtttttacagtgt

SEQ ID NO: 2181388 - DNA, 18 bp, Homo sapiens
agtttttatgagaaactt

SEQ ID NO: 2181389 - DNA, 19 bp, Homo sapiens
agtttttgccattataatt

SEQ ID NO: 2181390 - DNA, 16 bp, Homo sapiens
ataaaacccagcatgt

SEQ ID NO: 2181391 - DNA, 20 bp, Homo sapiens
ataaaacccagcatgtacaa

SEQ ID NO: 2181392 - DNA, 16 bp, Homo sapiens
ataaaattaatgaaga

SEQ ID NO: 2181393 - DNA, 18 bp, Homo sapiens
ataaaattcattccattt

SEQ ID NO: 2181394 - DNA, 14 bp, Homo sapiens
ataaactacaaaaa

SEQ ID NO: 2181395 - DNA, 17 bp, Homo sapiens
ataaagccttttaaatc

SEQ ID NO: 2181396 - DNA, 18 bp, Homo sapiens
ataaaggtttacagtgaa

SEQ ID NO: 2181397 - DNA, 13 bp, Homo sapiens
ataaaggtttcgt

SEQ ID NO: 2181398 - DNA, 15 bp, Homo sapiens
ataaagtactgcaaa

SEQ ID NO: 2181399 - DNA, 11 bp, Homo sapiens
ataaagttaaa

SEQ ID NO: 2181400 - DNA, 21 bp, Homo sapiens
ataaagttacaccgttgttgt

SEQ ID NO: 2181401 - DNA, 13 bp, Homo sapiens
ataaagttattaa

SEQ ID NO: 2181402 - DNA, 12 bp, Homo sapiens
ataaatatgtga

SEQ ID NO: 2181403 - DNA, 22 bp, Homo sapiens
ataaatggtgagaattaaaata

SEQ ID NO: 2181404 - DNA, 15 bp, Homo sapiens
ataaattaatttgac

SEQ ID NO: 2181405 - DNA, 12 bp, Homo sapiens
ataaattatgaa

SEQ ID NO: 2181406 - DNA, 23 bp, Homo sapiens
ataacaccaagagtagcaccttc

SEQ ID NO: 2181407 - DNA, 18 bp, Homo sapiens
ataactgtatttgaaata

SEQ ID NO: 2181408 - DNA, 23 bp, Homo sapiens
ataacttcagatacttgtgaaca

SEQ ID NO: 2181409 - DNA, 18 bp, Homo sapiens
ataagactactattcctt

SEQ ID NO: 2181410 - DNA, 14 bp, Homo sapiens
ataagactgtcatg

SEQ ID NO: 2181411 - DNA, 17 bp, Homo sapiens
ataagctagaaaaatta

SEQ ID NO: 2181412 - DNA, 15 bp, Homo sapiens
ataaggattctgaag

SEQ ID NO: 2181413 - DNA, 21 bp, Homo sapiens
ataatacttaaaaatatgtga

SEQ ID NO: 2181414 - DNA, 21 bp, Homo sapiens
ataatagttcaggatttggtt

SEQ ID NO: 2181415 - DNA, 23 bp, Homo sapiens
ataatcattttagaattaaaatt

SEQ ID NO: 2181416 - DNA, 21 bp, Homo sapiens
ataatgacgtattgtgaaatt

SEQ ID NO: 2181417 - DNA, 22 bp, Homo sapiens
ataatgacgtattgtgaaattt

SEQ ID NO: 2181418 - DNA, 15 bp, Homo sapiens
ataatgacttttaaa

SEQ ID NO: 2181419 - DNA, 16 bp, Homo sapiens
ataatggttactcatt

SEQ ID NO: 2181420 - DNA, 15 bp, Homo sapiens
ataatgtagtgcagt

SEQ ID NO: 2181421 - DNA, 18 bp, Homo sapiens
ataatgtcattaatatat

SEQ ID NO: 2181422 - DNA, 17 bp, Homo sapiens
ataattaaagaaaattg

SEQ ID NO: 2181423 - DNA, 18 bp, Homo sapiens
ataattaaagaaaattgc

SEQ ID NO: 2181424 - DNA, 20 bp, Homo sapiens
ataattaaagaaaattgcca

SEQ ID NO: 2181425 - DNA, 23 bp, Homo sapiens
ataattaaagaaaattgccaaaa

SEQ ID NO: 2181426 - DNA, 15 bp, Homo sapiens
ataattatataactg

SEQ ID NO: 2181427 - DNA, 17 bp, Homo sapiens
ataattatataactgta

SEQ ID NO: 2181428 - DNA, 20 bp, Homo sapiens
ataattgtggagaggagaga

SEQ ID NO: 2181429 - DNA, 15 bp, Homo sapiens
ataattgttctcaga

SEQ ID NO: 2181430 - DNA, 10 bp, Homo sapiens
ataatttatc

SEQ ID NO: 2181431 - DNA, 17 bp, Homo sapiens
ataatttgcataaaggg

SEQ ID NO: 2181432 - DNA, 17 bp, Homo sapiens
ataattttttagttaaa

SEQ ID NO: 2181433 - DNA, 22 bp, Homo sapiens
ataattttttagttaaaatcta

SEQ ID NO: 2181434 - DNA, 15 bp, Homo sapiens
atacaaaaaaaagtg

SEQ ID NO: 2181435 - DNA, 14 bp, Homo sapiens
atacaaaaagccaa

SEQ ID NO: 2181436 - DNA, 12 bp, Homo sapiens
atacaatattgc

SEQ ID NO: 2181437 - DNA, 20 bp, Homo sapiens
atacaattcaaacaattcaa

SEQ ID NO: 2181438 - DNA, 17 bp, Homo sapiens
atacacaggtgagaaag

SEQ ID NO: 2181439 - DNA, 15 bp, Homo sapiens
atacgtatacaataa

SEQ ID NO: 2181440 - DNA, 13 bp, Homo sapiens
atactaaatatga

SEQ ID NO: 2181441 - DNA, 18 bp, Homo sapiens
atactaaatatgaaattt

SEQ ID NO: 2181442 - DNA, 20 bp, Homo sapiens
atactaaatatgaaatttta

SEQ ID NO: 2181443 - DNA, 14 bp, Homo sapiens
atactaataaaata

SEQ ID NO: 2181444 - DNA, 22 bp, Homo sapiens
atactaggttaacatttgtaat

SEQ ID NO: 2181445 - DNA, 23 bp, Homo sapiens
atactcctgcccatgatccattc

SEQ ID NO: 2181446 - DNA, 23 bp, Homo sapiens
atactcgtttttataaactacaa

SEQ ID NO: 2181447 - DNA, 14 bp, Homo sapiens
atactctgtctccc

SEQ ID NO: 2181448 - DNA, 16 bp, Homo sapiens
atactgattattgagt

SEQ ID NO: 2181449 - DNA, 22 bp, Homo sapiens
atactgtacatagatgtatcat

SEQ ID NO: 2181450 - DNA, 14 bp, Homo sapiens
atactgtctaagaa

SEQ ID NO: 2181451 - DNA, 20 bp, Homo sapiens
atactgtctaagaataatga

SEQ ID NO: 2181452 - DNA, 16 bp, Homo sapiens
atactgtgctggagcc

SEQ ID NO: 2181453 - DNA, 19 bp, Homo sapiens
atacttaaaaatatgtgag

SEQ ID NO: 2181454 - DNA, 17 bp, Homo sapiens
atacttatgttgtattg

SEQ ID NO: 2181455 - DNA, 12 bp, Homo sapiens
atacttgagaaa

SEQ ID NO: 2181456 - DNA, 16 bp, Homo sapiens
atacttgagtgtgcaa

SEQ ID NO: 2181457 - DNA, 13 bp, Homo sapiens
atacttgtgaaca

SEQ ID NO: 2181458 - DNA, 21 bp, Homo sapiens
atactttgaacacaaagcctg

SEQ ID NO: 2181459 - DNA, 13 bp, Homo sapiens
atagaaccatgaa

SEQ ID NO: 2181460 - DNA, 14 bp, Homo sapiens
atagatgccctgct

SEQ ID NO: 2181461 - DNA, 14 bp, Homo sapiens
atagattctttatt

SEQ ID NO: 2181462 - DNA, 21 bp, Homo sapiens
atagcatatattcatacctgt

SEQ ID NO: 2181463 - DNA, 22 bp, Homo sapiens
atagcatatattcatacctgtt

SEQ ID NO: 2181464 - DNA, 13 bp, Homo sapiens
atagccatttgcc

SEQ ID NO: 2181465 - DNA, 14 bp, Homo sapiens
atagccatttgccc

SEQ ID NO: 2181466 - DNA, 14 bp, Homo sapiens
ataggaaataaaat

SEQ ID NO: 2181467 - DNA, 13 bp, Homo sapiens
ataggcaattaga

SEQ ID NO: 2181468 - DNA, 13 bp, Homo sapiens
atagtaaatggta

SEQ ID NO: 2181469 - DNA, 14 bp, Homo sapiens
atagtacctttgct

SEQ ID NO: 2181470 - DNA, 14 bp, Homo sapiens
atagtgtgtccatg

SEQ ID NO: 2181471 - DNA, 14 bp, Homo sapiens
atagttcaggattt

SEQ ID NO: 2181472 - DNA, 22 bp, Homo sapiens
atataaatatattttctttcta

SEQ ID NO: 2181473 - DNA, 16 bp, Homo sapiens
atataaatggaatcac

SEQ ID NO: 2181474 - DNA, 15 bp, Homo sapiens
atataatacttaaaa

SEQ ID NO: 2181475 - DNA, 13 bp, Homo sapiens
atatacatatgat

SEQ ID NO: 2181476 - DNA, 22 bp, Homo sapiens
atatatcctgaaagcattattt

SEQ ID NO: 2181477 - DNA, 17 bp, Homo sapiens
atatatgatttgcatgt

SEQ ID NO: 2181478 - DNA, 14 bp, Homo sapiens
atatattattataa

SEQ ID NO: 2181479 - DNA, 18 bp, Homo sapiens
atatattattataatctt

SEQ ID NO: 2181480 - DNA, 18 bp, Homo sapiens
atatattctttccatgca

SEQ ID NO: 2181481 - DNA, 11 bp, Homo sapiens
atatcactttg

SEQ ID NO: 2181482 - DNA, 13 bp, Homo sapiens
atatcactttgta

SEQ ID NO: 2181483 - DNA, 18 bp, Homo sapiens
atatcctcagatatattt

SEQ ID NO: 2181484 - DNA, 22 bp, Homo sapiens
atatctacctgccctctctcag

SEQ ID NO: 2181485 - DNA, 19 bp, Homo sapiens
atatctggcctctgctttc

SEQ ID NO: 2181486 - DNA, 14 bp, Homo sapiens
atatgactaattca

SEQ ID NO: 2181487 - DNA, 22 bp, Homo sapiens
atatgagatgtagcaaattcca

SEQ ID NO: 2181488 - DNA, 15 bp, Homo sapiens
atatgatttgcatgt

SEQ ID NO: 2181489 - DNA, 21 bp, Homo sapiens
atatgatttgcatgtgtaaat

SEQ ID NO: 2181490 - DNA, 15 bp, Homo sapiens
atatggaattttgca

SEQ ID NO: 2181491 - DNA, 19 bp, Homo sapiens
atatggaattttgcaaaga

SEQ ID NO: 2181492 - DNA, 22 bp, Homo sapiens
atatgtaaacagtgagaaaaga

SEQ ID NO: 2181493 - DNA, 17 bp, Homo sapiens
atatgtagccagacagt

SEQ ID NO: 2181494 - DNA, 13 bp, Homo sapiens
atatgtcctattc

SEQ ID NO: 2181495 - DNA, 18 bp, Homo sapiens
atatgtcctattcattca

SEQ ID NO: 2181496 - DNA, 19 bp, Homo sapiens
atatgtgagcatgaaacta

SEQ ID NO: 2181497 - DNA, 15 bp, Homo sapiens
atatgtgattatcat

SEQ ID NO: 2181498 - DNA, 17 bp, Homo sapiens
atatgtgattatcattt

SEQ ID NO: 2181499 - DNA, 16 bp, Homo sapiens
atattaaaaattaatt

SEQ ID NO: 2181500 - DNA, 22 bp, Homo sapiens
atattaaaaattaattctttat

SEQ ID NO: 2181501 - DNA, 18 bp, Homo sapiens
atattaaaatcacaaact

SEQ ID NO: 2181502 - DNA, 19 bp, Homo sapiens
atattaaaggtgaaaattg

SEQ ID NO: 2181503 - DNA, 18 bp, Homo sapiens
atattaaataaatgtgca

SEQ ID NO: 2181504 - DNA, 19 bp, Homo sapiens
atattaagtaatttcccca

SEQ ID NO: 2181505 - DNA, 16 bp, Homo sapiens
atattaatataagttt

SEQ ID NO: 2181506 - DNA, 19 bp, Homo sapiens
atattaatataagtttctt

SEQ ID NO: 2181507 - DNA, 12 bp, Homo sapiens
atattaatttat

SEQ ID NO: 2181508 - DNA, 14 bp, Homo sapiens
atattcatacctgt

SEQ ID NO: 2181509 - DNA, 14 bp, Homo sapiens
atattgataataaa

SEQ ID NO: 2181510 - DNA, 13 bp, Homo sapiens
atattggtgtgaa

SEQ ID NO: 2181511 - DNA, 23 bp, Homo sapiens
atatttaacgaatttaaaaagct

SEQ ID NO: 2181512 - DNA, 15 bp, Homo sapiens
atatttataattaaa

SEQ ID NO: 2181513 - DNA, 21 bp, Homo sapiens
atatttataattaaagaaaat

SEQ ID NO: 2181514 - DNA, 20 bp, Homo sapiens
atatttcagtgatttttagt

SEQ ID NO: 2181515 - DNA, 18 bp, Homo sapiens
atatttgtctcattttgt

SEQ ID NO: 2181516 - DNA, 13 bp, Homo sapiens
atatttgtgtaaa

SEQ ID NO: 2181517 - DNA, 15 bp, Homo sapiens
atattttatttttat

SEQ ID NO: 2181518 - DNA, 21 bp, Homo sapiens
atcaaaatctgtagagcaggg

SEQ ID NO: 2181519 - DNA, 14 bp, Homo sapiens
atcaaagctacctt

SEQ ID NO: 2181520 - DNA, 19 bp, Homo sapiens
atcaacactgcagcatttt

SEQ ID NO: 2181521 - DNA, 17 bp, Homo sapiens
atcaagtgcacctacac

SEQ ID NO: 2181522 - DNA, 13 bp, Homo sapiens
atcaatactttga

SEQ ID NO: 2181523 - DNA, 15 bp, Homo sapiens
atcaattctctatca

SEQ ID NO: 2181524 - DNA, 18 bp, Homo sapiens
atcacaaactcatccatt

SEQ ID NO: 2181525 - DNA, 16 bp, Homo sapiens
atcacaccactgtact

SEQ ID NO: 2181526 - DNA, 14 bp, Homo sapiens
atcacctgtcatca

SEQ ID NO: 2181527 - DNA, 18 bp, Homo sapiens
atcactcatttatttcca

SEQ ID NO: 2181528 - DNA, 16 bp, Homo sapiens
atcactttgtattctc

SEQ ID NO: 2181529 - DNA, 18 bp, Homo sapiens
atcagaacattcagctct

SEQ ID NO: 2181530 - DNA, 22 bp, Homo sapiens
atcagaacattcagctctggag

SEQ ID NO: 2181531 - DNA, 15 bp, Homo sapiens
atcagcagtgattga

SEQ ID NO: 2181532 - DNA, 20 bp, Homo sapiens
atcagcctggggcctgggga

SEQ ID NO: 2181533 - DNA, 18 bp, Homo sapiens
atcaggaggagattaaca

SEQ ID NO: 2181534 - DNA, 20 bp, Homo sapiens
atcaggaggagattaacaca

SEQ ID NO: 2181535 - DNA, 20 bp, Homo sapiens
atcagtgagctcaggagaga

SEQ ID NO: 2181536 - DNA, 17 bp, Homo sapiens
atcagttttgtgtacag

SEQ ID NO: 2181537 - DNA, 22 bp, Homo sapiens
atcagttttgtgtacagtatgt

SEQ ID NO: 2181538 - DNA, 23 bp, Homo sapiens
atcagttttgtgtacagtatgtg

SEQ ID NO: 2181539 - DNA, 19 bp, Homo sapiens
atcatgttaatcctagctg

SEQ ID NO: 2181540 - DNA, 23 bp, Homo sapiens
atcatgttttgatgagaaaaaac

SEQ ID NO: 2181541 - DNA, 19 bp, Homo sapiens
atcattggtatctgatatc

SEQ ID NO: 2181542 - DNA, 14 bp, Homo sapiens
atccacaggattcc

SEQ ID NO: 2181543 - DNA, 14 bp, Homo sapiens
atccaccagtgtgt

SEQ ID NO: 2181544 - DNA, 10 bp, Homo sapiens
atccacctcc

SEQ ID NO: 2181545 - DNA, 15 bp, Homo sapiens
atccacctccttctc

SEQ ID NO: 2181546 - DNA, 15 bp, Homo sapiens
atcccaacagccaag

SEQ ID NO: 2181547 - DNA, 19 bp, Homo sapiens
atcccaattcatttcatct

SEQ ID NO: 2181548 - DNA, 12 bp, Homo sapiens
atcccactccta

SEQ ID NO: 2181549 - DNA, 15 bp, Homo sapiens
atcccatctcacttt

SEQ ID NO: 2181550 - DNA, 12 bp, Homo sapiens
atccccaagctg

SEQ ID NO: 2181551 - DNA, 13 bp, Homo sapiens
atccccgctggct

SEQ ID NO: 2181552 - DNA, 20 bp, Homo sapiens
atcccgtgcaaaacatgcta

SEQ ID NO: 2181553 - DNA, 15 bp, Homo sapiens
atccctgcacacggc

SEQ ID NO: 2181554 - DNA, 22 bp, Homo sapiens
atccctgcacacggcacagagc

SEQ ID NO: 2181555 - DNA, 19 bp, Homo sapiens
atcctaagttacctttcta

SEQ ID NO: 2181556 - DNA, 11 bp, Homo sapiens
atcctacagta

SEQ ID NO: 2181557 - DNA, 14 bp, Homo sapiens
atcctagctgtgtg

SEQ ID NO: 2181558 - DNA, 12 bp, Homo sapiens
atcctgctgccg

SEQ ID NO: 2181559 - DNA, 11 bp, Homo sapiens
atcctgctggg

SEQ ID NO: 2181560 - DNA, 18 bp, Homo sapiens
atcctggctttgcccaac

SEQ ID NO: 2181561 - DNA, 16 bp, Homo sapiens
atcctgtcaatgtttg

SEQ ID NO: 2181562 - DNA, 18 bp, Homo sapiens
atcctgtcaatgtttgct

SEQ ID NO: 2181563 - DNA, 21 bp, Homo sapiens
atccttgttttgtgacatttt

SEQ ID NO: 2181564 - DNA, 15 bp, Homo sapiens
atcgaggctgtgtgt

SEQ ID NO: 2181565 - DNA, 21 bp, Homo sapiens
atcgctgtccaagtgtttctt

SEQ ID NO: 2181566 - DNA, 22 bp, Homo sapiens
atcggacctcagtttctgttgt

SEQ ID NO: 2181567 - DNA, 14 bp, Homo sapiens
atcggggtggcaga

SEQ ID NO: 2181568 - DNA, 14 bp, Homo sapiens
atcggtcctgtctc

SEQ ID NO: 2181569 - DNA, 21 bp, Homo sapiens
atcggtgctgtcagccctgct

SEQ ID NO: 2181570 - DNA, 22 bp, Homo sapiens
atctaaatattgatttctgcct

SEQ ID NO: 2181571 - DNA, 17 bp, Homo sapiens
atctaccccttacttat

SEQ ID NO: 2181572 - DNA, 14 bp, Homo sapiens
atctacctgccctc

SEQ ID NO: 2181573 - DNA, 16 bp, Homo sapiens
atctacctgccctctc

SEQ ID NO: 2181574 - DNA, 19 bp, Homo sapiens
atctacctgccctctctca

SEQ ID NO: 2181575 - DNA, 18 bp, Homo sapiens
atctagagcttgatgcca

SEQ ID NO: 2181576 - DNA, 20 bp, Homo sapiens
atctatatagtacctttgct

SEQ ID NO: 2181577 - DNA, 13 bp, Homo sapiens
atctatcacctgt

SEQ ID NO: 2181578 - DNA, 14 bp, Homo sapiens
atctatcacctgtc

SEQ ID NO: 2181579 - DNA, 15 bp, Homo sapiens
atctatcacctgtca

SEQ ID NO: 2181580 - DNA, 15 bp, Homo sapiens
atctcagctcactgc

SEQ ID NO: 2181581 - DNA, 13 bp, Homo sapiens
atctccaaagctt

SEQ ID NO: 2181582 - DNA, 16 bp, Homo sapiens
atctcctctttgtgaa

SEQ ID NO: 2181583 - DNA, 16 bp, Homo sapiens
atctctgaacttcagc

SEQ ID NO: 2181584 - DNA, 15 bp, Homo sapiens
atctctggagtgtgt

SEQ ID NO: 2181585 - DNA, 18 bp, Homo sapiens
atctctgttctgctccca

SEQ ID NO: 2181586 - DNA, 23 bp, Homo sapiens
atctgaatatatgatttgcatgt

SEQ ID NO: 2181587 - DNA, 16 bp, Homo sapiens
atctgactgccaagcc

SEQ ID NO: 2181588 - DNA, 17 bp, Homo sapiens
atctgactgccaagcca

SEQ ID NO: 2181589 - DNA, 13 bp, Homo sapiens
atctgcagtcact

SEQ ID NO: 2181590 - DNA, 14 bp, Homo sapiens
atctgcccctccct

SEQ ID NO: 2181591 - DNA, 15 bp, Homo sapiens
atctgccttgctgca

SEQ ID NO: 2181592 - DNA, 20 bp, Homo sapiens
atctgggaactcccaagaac

SEQ ID NO: 2181593 - DNA, 17 bp, Homo sapiens
atctgtttgcttctaaa

SEQ ID NO: 2181594 - DNA, 19 bp, Homo sapiens
atcttcttaacagtttagt

SEQ ID NO: 2181595 - DNA, 18 bp, Homo sapiens
atctttccttgtctctca

SEQ ID NO: 2181596 - DNA, 19 bp, Homo sapiens
atctttccttgtctctcat

SEQ ID NO: 2181597 - DNA, 21 bp, Homo sapiens
atcttttaattgtttccagga

SEQ ID NO: 2181598 - DNA, 16 bp, Homo sapiens
atcttttgggaagcca

SEQ ID NO: 2181599 - DNA, 21 bp, Homo sapiens
atgaaaaatagtgtgtccatg

SEQ ID NO: 2181600 - DNA, 19 bp, Homo sapiens
atgaaaaccaccctatcat

SEQ ID NO: 2181601 - DNA, 18 bp, Homo sapiens
atgaaaatgatgtagaca

SEQ ID NO: 2181602 - DNA, 18 bp, Homo sapiens
atgaaagctatgaatgtt

SEQ ID NO: 2181603 - DNA, 22 bp, Homo sapiens
atgaaagtgcaaagtgccctca

SEQ ID NO: 2181604 - DNA, 13 bp, Homo sapiens
atgaatattgtaa

SEQ ID NO: 2181605 - DNA, 16 bp, Homo sapiens
atgaatcttatgcaaa

SEQ ID NO: 2181606 - DNA, 20 bp, Homo sapiens
atgacaagcaaggtttctgg

SEQ ID NO: 2181607 - DNA, 18 bp, Homo sapiens
atgacatgaacaatgtgt

SEQ ID NO: 2181608 - DNA, 22 bp, Homo sapiens
atgactcagcagaacaccgcgt

SEQ ID NO: 2181609 - DNA, 18 bp, Homo sapiens
atgacttttaaaatttgt

SEQ ID NO: 2181610 - DNA, 21 bp, Homo sapiens
atgacttttaaaatttgtaga

SEQ ID NO: 2181611 - DNA, 21 bp, Homo sapiens
atgagaaacttaaatgttatt

SEQ ID NO: 2181612 - DNA, 22 bp, Homo sapiens
atgagaatgaccctgtcaagct

SEQ ID NO: 2181613 - DNA, 18 bp, Homo sapiens
atgagaattcagctgccc

SEQ ID NO: 2181614 - DNA, 19 bp, Homo sapiens
atgagaattcagctgcccc

SEQ ID NO: 2181615 - DNA, 13 bp, Homo sapiens
atgagagcccctt

SEQ ID NO: 2181616 - DNA, 22 bp, Homo sapiens
atgaggaggcagaaagcagagg

SEQ ID NO: 2181617 - DNA, 20 bp, Homo sapiens
atgaggcacgcctgccttct

SEQ ID NO: 2181618 - DNA, 16 bp, Homo sapiens
atgagggtgttttttt

SEQ ID NO: 2181619 - DNA, 17 bp, Homo sapiens
atgagtgcaagcaaagc

SEQ ID NO: 2181620 - DNA, 14 bp, Homo sapiens
atgatactgacttt

SEQ ID NO: 2181621 - DNA, 17 bp, Homo sapiens
atgatactgtctaagaa

SEQ ID NO: 2181622 - DNA, 22 bp, Homo sapiens
atgatactgtctaagaataatg

SEQ ID NO: 2181623 - DNA, 15 bp, Homo sapiens
atgatcaacaattta

SEQ ID NO: 2181624 - DNA, 21 bp, Homo sapiens
atgatgtgtttaaactgagta

SEQ ID NO: 2181625 - DNA, 17 bp, Homo sapiens
atgatttgcatgtgtaa

SEQ ID NO: 2181626 - DNA, 15 bp, Homo sapiens
atgcacctataaata

SEQ ID NO: 2181627 - DNA, 20 bp, Homo sapiens
atgcactaatcaatactttg

SEQ ID NO: 2181628 - DNA, 18 bp, Homo sapiens
atgcagagacagctgttt

SEQ ID NO: 2181629 - DNA, 15 bp, Homo sapiens
atgcagatgccagag

SEQ ID NO: 2181630 - DNA, 18 bp, Homo sapiens
atgcagtgcccctagctt

SEQ ID NO: 2181631 - DNA, 15 bp, Homo sapiens
atgcagttattagaa

SEQ ID NO: 2181632 - DNA, 23 bp, Homo sapiens
atgcagttattagaacttagttt

SEQ ID NO: 2181633 - DNA, 15 bp, Homo sapiens
atgcataaaatatat

SEQ ID NO: 2181634 - DNA, 19 bp, Homo sapiens
atgcatgcttctttataaa

SEQ ID NO: 2181635 - DNA, 20 bp, Homo sapiens
atgcatttaaactcatttga

SEQ ID NO: 2181636 - DNA, 14 bp, Homo sapiens
atgccacctgcagc

SEQ ID NO: 2181637 - DNA, 14 bp, Homo sapiens
atgcctccctgacc

SEQ ID NO: 2181638 - DNA, 15 bp, Homo sapiens
atgcctcctctgtcc

SEQ ID NO: 2181639 - DNA, 22 bp, Homo sapiens
atgccttatatttgtccaacaa

SEQ ID NO: 2181640 - DNA, 12 bp, Homo sapiens
atgccttatgta

SEQ ID NO: 2181641 - DNA, 15 bp, Homo sapiens
atgccttatgtaatt

SEQ ID NO: 2181642 - DNA, 17 bp, Homo sapiens
atgccttctagattcac

SEQ ID NO: 2181643 - DNA, 15 bp, Homo sapiens
atgcggatcctgctg

SEQ ID NO: 2181644 - DNA, 12 bp, Homo sapiens
atgctcacctga

SEQ ID NO: 2181645 - DNA, 18 bp, Homo sapiens
atgctgaaaacacagaga

SEQ ID NO: 2181646 - DNA, 18 bp, Homo sapiens
atgctggacaggtctggg

SEQ ID NO: 2181647 - DNA, 11 bp, Homo sapiens
atgctggagcg

SEQ ID NO: 2181648 - DNA, 19 bp, Homo sapiens
atgctgggattacaggcgt

SEQ ID NO: 2181649 - DNA, 15 bp, Homo sapiens
atgcttactcttgct

SEQ ID NO: 2181650 - DNA, 16 bp, Homo sapiens
atgcttataagcaaca

SEQ ID NO: 2181651 - DNA, 22 bp, Homo sapiens
atgctttctgaactcgcttctc

SEQ ID NO: 2181652 - DNA, 22 bp, Homo sapiens
atggaaaagtcttcaagggctg

SEQ ID NO: 2181653 - DNA, 22 bp, Homo sapiens
atggaaatagctacagctgtgt

SEQ ID NO: 2181654 - DNA, 16 bp, Homo sapiens
atggaactcgcccccc

SEQ ID NO: 2181655 - DNA, 16 bp, Homo sapiens
atggactattgcaata

SEQ ID NO: 2181656 - DNA, 14 bp, Homo sapiens
atggagctagagag

SEQ ID NO: 2181657 - DNA, 17 bp, Homo sapiens
atggagtagacccctgg

SEQ ID NO: 2181658 - DNA, 22 bp, Homo sapiens
atggagtagacccctggctggt

SEQ ID NO: 2181659 - DNA, 15 bp, Homo sapiens
atggatggggcccag

SEQ ID NO: 2181660 - DNA, 19 bp, Homo sapiens
atggatttggactcgaaat

SEQ ID NO: 2181661 - DNA, 15 bp, Homo sapiens
atggcagtgggagac

SEQ ID NO: 2181662 - DNA, 14 bp, Homo sapiens
atggcatattgata

SEQ ID NO: 2181663 - DNA, 21 bp, Homo sapiens
atggcatattgataataaaat

SEQ ID NO: 2181664 - DNA, 13 bp, Homo sapiens
atggcattactct

SEQ ID NO: 2181665 - DNA, 15 bp, Homo sapiens
atggcattactctgc

SEQ ID NO: 2181666 - DNA, 17 bp, Homo sapiens
atggctaaggcaccagc

SEQ ID NO: 2181667 - DNA, 19 bp, Homo sapiens
atggctcactatggtgcca

SEQ ID NO: 2181668 - DNA, 23 bp, Homo sapiens
atggcttaaaaatacttaataaa

SEQ ID NO: 2181669 - DNA, 12 bp, Homo sapiens
atgggagccaga

SEQ ID NO: 2181670 - DNA, 18 bp, Homo sapiens
atgggagtaagagcaaat

SEQ ID NO: 2181671 - DNA, 23 bp, Homo sapiens
atggggacagactgaagacagag

SEQ ID NO: 2181672 - DNA, 17 bp, Homo sapiens
atggggccacagccaga

SEQ ID NO: 2181673 - DNA, 21 bp, Homo sapiens
atgggggtgcaggcagccttg

SEQ ID NO: 2181674 - DNA, 15 bp, Homo sapiens
atgggtaattcaaga

SEQ ID NO: 2181675 - DNA, 15 bp, Homo sapiens
atgggtagcttctga

SEQ ID NO: 2181676 - DNA, 22 bp, Homo sapiens
atggtcaggaagtttgcagata

SEQ ID NO: 2181677 - DNA, 23 bp, Homo sapiens
atggtcgagaaagaggcaccagg

SEQ ID NO: 2181678 - DNA, 12 bp, Homo sapiens
atggtgcctctg

SEQ ID NO: 2181679 - DNA, 15 bp, Homo sapiens
atggtgcctctggag

SEQ ID NO: 2181680 - DNA, 22 bp, Homo sapiens
atggtggcgctttctcctgtgc

SEQ ID NO: 2181681 - DNA, 15 bp, Homo sapiens
atggttactcatttt

SEQ ID NO: 2181682 - DNA, 18 bp, Homo sapiens
atggttctggctgtttga

SEQ ID NO: 2181683 - DNA, 13 bp, Homo sapiens
atgtaaccaagct

SEQ ID NO: 2181684 - DNA, 14 bp, Homo sapiens
atgtaacttcctct

SEQ ID NO: 2181685 - DNA, 17 bp, Homo sapiens
atgtaataatcatttta

SEQ ID NO: 2181686 - DNA, 18 bp, Homo sapiens
atgtaataatcattttag

SEQ ID NO: 2181687 - DNA, 12 bp, Homo sapiens
atgtaatttcag

SEQ ID NO: 2181688 - DNA, 18 bp, Homo sapiens
atgtacaaaagtaccata

SEQ ID NO: 2181689 - DNA, 18 bp, Homo sapiens
atgtagaagagggagaag

SEQ ID NO: 2181690 - DNA, 19 bp, Homo sapiens
atgtagaagagggagaagg

SEQ ID NO: 2181691 - DNA, 20 bp, Homo sapiens
atgtagaagagggagaagga

SEQ ID NO: 2181692 - DNA, 21 bp, Homo sapiens
atgtagaagagggagaaggag

SEQ ID NO: 2181693 - DNA, 20 bp, Homo sapiens
atgtagcaaattccaataca

SEQ ID NO: 2181694 - DNA, 16 bp, Homo sapiens
atgtagccatgggacc

SEQ ID NO: 2181695 - DNA, 12 bp, Homo sapiens
atgtagtgcagt

SEQ ID NO: 2181696 - DNA, 13 bp, Homo sapiens
atgtatattactg

SEQ ID NO: 2181697 - DNA, 12 bp, Homo sapiens
atgtatgtgtag

SEQ ID NO: 2181698 - DNA, 13 bp, Homo sapiens
atgtatgtgtagt

SEQ ID NO: 2181699 - DNA, 15 bp, Homo sapiens
atgtattttaaaata

SEQ ID NO: 2181700 - DNA, 15 bp, Homo sapiens
atgtcattaatatat

SEQ ID NO: 2181701 - DNA, 16 bp, Homo sapiens
atgtcatttcagaagt

SEQ ID NO: 2181702 - DNA, 17 bp, Homo sapiens
atgtcatttcagaagtt

SEQ ID NO: 2181703 - DNA, 21 bp, Homo sapiens
atgtcattttgtttataatat

SEQ ID NO: 2181704 - DNA, 17 bp, Homo sapiens
atgtcccccacctcttt

SEQ ID NO: 2181705 - DNA, 21 bp, Homo sapiens
atgtcccccacctcttttcct

SEQ ID NO: 2181706 - DNA, 16 bp, Homo sapiens
atgtctgtctacagga

SEQ ID NO: 2181707 - DNA, 16 bp, Homo sapiens
atgtgattatcattta

SEQ ID NO: 2181708 - DNA, 21 bp, Homo sapiens
atgtgcagggtgggctggtga

SEQ ID NO: 2181709 - DNA, 18 bp, Homo sapiens
atgtgcccagtcatgaca

SEQ ID NO: 2181710 - DNA, 14 bp, Homo sapiens
atgtgctgctgtgg

SEQ ID NO: 2181711 - DNA, 16 bp, Homo sapiens
atgtgctgctgtggca

SEQ ID NO: 2181712 - DNA, 23 bp, Homo sapiens
atgtggagcacaaaagcctctca

SEQ ID NO: 2181713 - DNA, 18 bp, Homo sapiens
atgtgtctagcaaagcca

SEQ ID NO: 2181714 - DNA, 21 bp, Homo sapiens
atgtgtttataattgttatac

SEQ ID NO: 2181715 - DNA, 22 bp, Homo sapiens
atgttggttttttagtgcaatt

SEQ ID NO: 2181716 - DNA, 16 bp, Homo sapiens
atgtttcaccaaggaa

SEQ ID NO: 2181717 - DNA, 16 bp, Homo sapiens
atgtttgcattaaatg

SEQ ID NO: 2181718 - DNA, 13 bp, Homo sapiens
atgtttgtcattt

SEQ ID NO: 2181719 - DNA, 14 bp, Homo sapiens
atgtttgtgcatgt

SEQ ID NO: 2181720 - DNA, 21 bp, Homo sapiens
attaaaaacacctaagtgact

SEQ ID NO: 2181721 - DNA, 14 bp, Homo sapiens
attaaaaattaatt

SEQ ID NO: 2181722 - DNA, 21 bp, Homo sapiens
atttattattaaatcagtttt

SEQ ID NO: 2181723 - DNA, 14 bp, Homo sapiens
atttattcattcag

SEQ ID NO: 2181724 - DNA, 17 bp, Homo sapiens
atttattctacttttaa

SEQ ID NO: 2181725 - DNA, 12 bp, Homo sapiens
atttatttccat

SEQ ID NO: 2181726 - DNA, 14 bp, Homo sapiens
atttatttccatat

SEQ ID NO: 2181727 - DNA, 12 bp, Homo sapiens
atttatttggag

SEQ ID NO: 2181728 - DNA, 22 bp, Homo sapiens
atttatttggagtggaggcatt

SEQ ID NO: 2181729 - DNA, 23 bp, Homo sapiens
atttatttggagtggaggcattg

SEQ ID NO: 2181730 - DNA, 21 bp, Homo sapiens
atttcaaatctgtaattacca

SEQ ID NO: 2181731 - DNA, 21 bp, Homo sapiens
atttcactgacactgcgaact

SEQ ID NO: 2181732 - DNA, 16 bp, Homo sapiens
atttcagttacttacc

SEQ ID NO: 2181733 - DNA, 17 bp, Homo sapiens
atttcatataaatggaa

SEQ ID NO: 2181734 - DNA, 19 bp, Homo sapiens
atttccagggcagcagccg

SEQ ID NO: 2181735 - DNA, 20 bp, Homo sapiens
atttccccactctgagtgaa

SEQ ID NO: 2181736 - DNA, 20 bp, Homo sapiens
atttcccctcccgtcttcct

SEQ ID NO: 2181737 - DNA, 16 bp, Homo sapiens
atttcggtgcttccct

SEQ ID NO: 2181738 - DNA, 15 bp, Homo sapiens
atttctatggcatat

SEQ ID NO: 2181739 - DNA, 15 bp, Homo sapiens
atttctcaaagtttt

SEQ ID NO: 2181740 - DNA, 15 bp, Homo sapiens
atttctcccttcaat

SEQ ID NO: 2181741 - DNA, 22 bp, Homo sapiens
atttctgccctcagcttcaaat

SEQ ID NO: 2181742 - DNA, 23 bp, Homo sapiens
atttctgccctcagcttcaaata

SEQ ID NO: 2181743 - DNA, 16 bp, Homo sapiens
atttctgccttccttg

SEQ ID NO: 2181744 - DNA, 20 bp, Homo sapiens
atttgaaactgctaattaca

SEQ ID NO: 2181745 - DNA, 16 bp, Homo sapiens
atttgaaataagaatt

SEQ ID NO: 2181746 - DNA, 13 bp, Homo sapiens
atttgcagctgct

SEQ ID NO: 2181747 - DNA, 16 bp, Homo sapiens
atttgcatgtgtaaat

SEQ ID NO: 2181748 - DNA, 11 bp, Homo sapiens
atttgccccaa

SEQ ID NO: 2181749 - DNA, 14 bp, Homo sapiens
atttggaatcatat

SEQ ID NO: 2181750 - DNA, 15 bp, Homo sapiens
atttggaatcatatg

SEQ ID NO: 2181751 - DNA, 13 bp, Homo sapiens
atttggagtggag

SEQ ID NO: 2181752 - DNA, 14 bp, Homo sapiens
atttggagtggagg

SEQ ID NO: 2181753 - DNA, 15 bp, Homo sapiens
atttgggactgtctt

SEQ ID NO: 2181754 - DNA, 15 bp, Homo sapiens
atttgggtttttaag

SEQ ID NO: 2181755 - DNA, 17 bp, Homo sapiens
atttggtcaccttcctc

SEQ ID NO: 2181756 - DNA, 17 bp, Homo sapiens
atttggtctgcctctga

SEQ ID NO: 2181757 - DNA, 16 bp, Homo sapiens
atttggtttttctctt

SEQ ID NO: 2181758 - DNA, 17 bp, Homo sapiens
atttggtttttctcttt

SEQ ID NO: 2181759 - DNA, 17 bp, Homo sapiens
atttgtcctgcagagct

SEQ ID NO: 2181760 - DNA, 15 bp, Homo sapiens
atttgtctcattttg

SEQ ID NO: 2181761 - DNA, 22 bp, Homo sapiens
atttgtctcattttgtatgtat

SEQ ID NO: 2181762 - DNA, 13 bp, Homo sapiens
atttgttaattaa

SEQ ID NO: 2181763 - DNA, 17 bp, Homo sapiens
attttaaaacatggcaa

SEQ ID NO: 2181764 - DNA, 12 bp, Homo sapiens
attttacaaaaa

SEQ ID NO: 2181765 - DNA, 18 bp, Homo sapiens
attttaccattttgcgat

SEQ ID NO: 2181766 - DNA, 16 bp, Homo sapiens
attttacgttttagaa

SEQ ID NO: 2181767 - DNA, 18 bp, Homo sapiens
attttacgttttagaaaa

SEQ ID NO: 2181768 - DNA, 13 bp, Homo sapiens
attttagaagagg

SEQ ID NO: 2181769 - DNA, 18 bp, Homo sapiens
attttcaacaacatcaga

SEQ ID NO: 2181770 - DNA, 18 bp, Homo sapiens
attttcacttttaaacta

SEQ ID NO: 2181771 - DNA, 13 bp, Homo sapiens
attttccctgcta

SEQ ID NO: 2181772 - DNA, 21 bp, Homo sapiens
attttctaccactggtgtaaa

SEQ ID NO: 2181773 - DNA, 18 bp, Homo sapiens
attttctagaatactaat

SEQ ID NO: 2181774 - DNA, 21 bp, Homo sapiens
attttctagaatactaataaa

SEQ ID NO: 2181775 - DNA, 18 bp, Homo sapiens
attttctgagtagcatat

SEQ ID NO: 2181776 - DNA, 21 bp, Homo sapiens
attttctttttgtaattagta

SEQ ID NO: 2181777 - DNA, 18 bp, Homo sapiens
attttgactgtgatttat

SEQ ID NO: 2181778 - DNA, 13 bp, Homo sapiens
attttgcaaagat

SEQ ID NO: 2181779 - DNA, 21 bp, Homo sapiens
attttgcaaagatttaatctg

SEQ ID NO: 2181780 - DNA, 15 bp, Homo sapiens
attttgcgatgtgtt

SEQ ID NO: 2181781 - DNA, 18 bp, Homo sapiens
attttggacgtgtgagga

SEQ ID NO: 2181782 - DNA, 15 bp, Homo sapiens
attttgtatgtatgt

SEQ ID NO: 2181783 - DNA, 16 bp, Homo sapiens
attttgtggcttcaat

SEQ ID NO: 2181784 - DNA, 13 bp, Homo sapiens
attttgtgtctta

SEQ ID NO: 2181785 - DNA, 18 bp, Homo sapiens
attttgttaagaatttca

SEQ ID NO: 2181786 - DNA, 19 bp, Homo sapiens
attttgttaagaatttcaa

SEQ ID NO: 2181787 - DNA, 16 bp, Homo sapiens
atttttagtaaccttt

SEQ ID NO: 2181788 - DNA, 20 bp, Homo sapiens
atttttcaatagcacatatg

SEQ ID NO: 2181789 - DNA, 24 bp, Homo sapiens
atttttctatgaaagctatgaatg

SEQ ID NO: 2181790 - DNA, 21 bp, Homo sapiens
attttttttctgaacaaaagc

SEQ ID NO: 2181791 - DNA, 16 bp, Homo sapiens
caaaaacatggccaca

SEQ ID NO: 2181792 - DNA, 20 bp, Homo sapiens
caaaaagaaagctgtgaaat

SEQ ID NO: 2181793 - DNA, 13 bp, Homo sapiens
caaaaatgtgcct

SEQ ID NO: 2181794 - DNA, 23 bp, Homo sapiens
caaaaattcacaagctgcctccc

SEQ ID NO: 2181795 - DNA, 16 bp, Homo sapiens
caaaaccaagccttgg

SEQ ID NO: 2181796 - DNA, 22 bp, Homo sapiens
caaaactggaactgttgttgaa

SEQ ID NO: 2181797 - DNA, 19 bp, Homo sapiens
caaaaggaaacctctgact

SEQ ID NO: 2181798 - DNA, 22 bp, Homo sapiens
caaaaggaaacctctgacttgc

SEQ ID NO: 2181799 - DNA, 20 bp, Homo sapiens
caaaaggagaagaggaacat

SEQ ID NO: 2181800 - DNA, 21 bp, Homo sapiens
caaaaggcagtggggctgggg

SEQ ID NO: 2181801 - DNA, 17 bp, Homo sapiens
caaaatactacacatcc

SEQ ID NO: 2181802 - DNA, 17 bp, Homo sapiens
caaaatcagtgatggga

SEQ ID NO: 2181803 - DNA, 15 bp, Homo sapiens
caaaatgacctggtg

SEQ ID NO: 2181804 - DNA, 17 bp, Homo sapiens
caaaatgcttttgtgtc

SEQ ID NO: 2181805 - DNA, 16 bp, Homo sapiens
caaaatgtgaactgac

SEQ ID NO: 2181806 - DNA, 12 bp, Homo sapiens
caaaatgttaat

SEQ ID NO: 2181807 - DNA, 12 bp, Homo sapiens
caaaattgagca

SEQ ID NO: 2181808 - DNA, 12 bp, Homo sapiens
caaacaattcaa

SEQ ID NO: 2181809 - DNA, 20 bp, Homo sapiens
caaacaattcaatcaaagct

SEQ ID NO: 2181810 - DNA, 22 bp, Homo sapiens
caaacaattcaatcaaagctac

SEQ ID NO: 2181811 - DNA, 14 bp, Homo sapiens
caaacaccatcttc

SEQ ID NO: 2181812 - DNA, 16 bp, Homo sapiens
caaacagctcaggctg

SEQ ID NO: 2181813 - DNA, 14 bp, Homo sapiens
caaaccactgtaca

SEQ ID NO: 2181814 - DNA, 19 bp, Homo sapiens
caaaccaggagcattttgt

SEQ ID NO: 2181815 - DNA, 18 bp, Homo sapiens
caaacctctccttcctca

SEQ ID NO: 2181816 - DNA, 13 bp, Homo sapiens
caaacctgcccca

SEQ ID NO: 2181817 - DNA, 21 bp, Homo sapiens
caaactatattttaataattt

SEQ ID NO: 2181818 - DNA, 14 bp, Homo sapiens
caaactcatccatt

SEQ ID NO: 2181819 - DNA, 23 bp, Homo sapiens
caaactgtgggtattgttaatat

SEQ ID NO: 2181820 - DNA, 15 bp, Homo sapiens
caaagaatgccttga

SEQ ID NO: 2181821 - DNA, 15 bp, Homo sapiens
caaagacctcccaag

SEQ ID NO: 2181822 - DNA, 18 bp, Homo sapiens
caaagaggtgactgggcc

SEQ ID NO: 2181823 - DNA, 17 bp, Homo sapiens
caaagcaagctcttctc

SEQ ID NO: 2181824 - DNA, 12 bp, Homo sapiens
caaagcagaact

SEQ ID NO: 2181825 - DNA, 14 bp, Homo sapiens
caaagctacctttt

SEQ ID NO: 2181826 - DNA, 22 bp, Homo sapiens
caaagctgaagccgccaggacc

SEQ ID NO: 2181827 - DNA, 22 bp, Homo sapiens
caaagctgacgaggctgggcca

SEQ ID NO: 2181828 - DNA, 16 bp, Homo sapiens
caaagctttcctggag

SEQ ID NO: 2181829 - DNA, 17 bp, Homo sapiens
caaagcttttgtaaaat

SEQ ID NO: 2181830 - DNA, 18 bp, Homo sapiens
caaaggactgacctgccc

SEQ ID NO: 2181831 - DNA, 18 bp, Homo sapiens
caaaggtgattttcctgt

SEQ ID NO: 2181832 - DNA, 16 bp, Homo sapiens
caaagtgcaaagctgc

SEQ ID NO: 2181833 - DNA, 17 bp, Homo sapiens
caaagtgcaaagctgct

SEQ ID NO: 2181834 - DNA, 19 bp, Homo sapiens
caaagtgctagccactgga

SEQ ID NO: 2181835 - DNA, 19 bp, Homo sapiens
caaagtgctgagattacag

SEQ ID NO: 2181836 - DNA, 21 bp, Homo sapiens
caaatctcctctttgtgaaat

SEQ ID NO: 2181837 - DNA, 20 bp, Homo sapiens
caaatcttcaaggtgtaaaa

SEQ ID NO: 2181838 - DNA, 21 bp, Homo sapiens
caaatcttcaaggtgtaaaat

SEQ ID NO: 2181839 - DNA, 22 bp, Homo sapiens
caaatgagatgtatgcccaaag

SEQ ID NO: 2181840 - DNA, 19 bp, Homo sapiens
caaatgcaaaaactctttg

SEQ ID NO: 2181841 - DNA, 20 bp, Homo sapiens
caaatgccaggacagctgca

SEQ ID NO: 2181842 - DNA, 21 bp, Homo sapiens
caaatgccaggacagctgcag

SEQ ID NO: 2181843 - DNA, 19 bp, Homo sapiens
caaatgggactgatgtcat

SEQ ID NO: 2181844 - DNA, 20 bp, Homo sapiens
caaatgtgtactttattgat

SEQ ID NO: 2181845 - DNA, 21 bp, Homo sapiens
caaattccacccctccttccc

SEQ ID NO: 2181846 - DNA, 20 bp, Homo sapiens
caaattgatgggtgggctag

SEQ ID NO: 2181847 - DNA, 18 bp, Homo sapiens
aggagcattttgtgtctt

SEQ ID NO: 2181848 - DNA, 13 bp, Homo sapiens
aggagcctgcggc

SEQ ID NO: 2181849 - DNA, 18 bp, Homo sapiens
aggagcctgcggctgctg

SEQ ID NO: 2181850 - DNA, 21 bp, Homo sapiens
aggagcctgcggctgctggca

SEQ ID NO: 2181851 - DNA, 12 bp, Homo sapiens
aggagcctgtgc

SEQ ID NO: 2181852 - DNA, 22 bp, Homo sapiens
aggagcctgtgcgtcccagctg

SEQ ID NO: 2181853 - DNA, 23 bp, Homo sapiens
aggagcctgtgcgtcccagctga

SEQ ID NO: 2181854 - DNA, 20 bp, Homo sapiens
aggagcttacctcccacctt

SEQ ID NO: 2181855 - DNA, 22 bp, Homo sapiens
aggagttaaagagcagcctggc

SEQ ID NO: 2181856 - DNA, 15 bp, Homo sapiens
aggatatactgcagc

SEQ ID NO: 2181857 - DNA, 15 bp, Homo sapiens
aggatatcttctcca

SEQ ID NO: 2181858 - DNA, 20 bp, Homo sapiens
aggatgggcataagcaaact

SEQ ID NO: 2181859 - DNA, 16 bp, Homo sapiens
aggatgtggatggagg

SEQ ID NO: 2181860 - DNA, 22 bp, Homo sapiens
aggatgtggatggaggtgatga

SEQ ID NO: 2181861 - DNA, 21 bp, Homo sapiens
aggattaagttcgaggtggct

SEQ ID NO: 2181862 - DNA, 20 bp, Homo sapiens
aggatttggtttttctcttt

SEQ ID NO: 2181863 - DNA, 17 bp, Homo sapiens
aggcaactattaataat

SEQ ID NO: 2181864 - DNA, 14 bp, Homo sapiens
aggcaagctggcag

SEQ ID NO: 2181865 - DNA, 15 bp, Homo sapiens
aggcaagctggcagg

SEQ ID NO: 2181866 - DNA, 15 bp, Homo sapiens
aggcaaggctgccgg

SEQ ID NO: 2181867 - DNA, 19 bp, Homo sapiens
aggcaatgactgcgcagag

SEQ ID NO: 2181868 - DNA, 20 bp, Homo sapiens
aggcaatgactgcgcagagt

SEQ ID NO: 2181869 - DNA, 20 bp, Homo sapiens
aggcacagccggggcctgcc

SEQ ID NO: 2181870 - DNA, 18 bp, Homo sapiens
aggcacagtaagcatgct

SEQ ID NO: 2181871 - DNA, 12 bp, Homo sapiens
aggcaccaggaa

SEQ ID NO: 2181872 - DNA, 17 bp, Homo sapiens
aggcaccattcaggaac

SEQ ID NO: 2181873 - DNA, 17 bp, Homo sapiens
aggcagaaagcagaggc

SEQ ID NO: 2181874 - DNA, 19 bp, Homo sapiens
aggcagaaagcagaggctg

SEQ ID NO: 2181875 - DNA, 14 bp, Homo sapiens
aggcagaaccctgg

SEQ ID NO: 2181876 - DNA, 16 bp, Homo sapiens
aggcagacgatgtcaa

SEQ ID NO: 2181877 - DNA, 24 bp, Homo sapiens
aggcagagtgccccacctgccact

SEQ ID NO: 2181878 - DNA, 16 bp, Homo sapiens
aggcagctctgtcgtg

SEQ ID NO: 2181879 - DNA, 16 bp, Homo sapiens
aggcaggattgaaaat

SEQ ID NO: 2181880 - DNA, 12 bp, Homo sapiens
aggcaggggctg

SEQ ID NO: 2181881 - DNA, 21 bp, Homo sapiens
aggcaggggctgggcagaggg

SEQ ID NO: 2181882 - DNA, 14 bp, Homo sapiens
aggcagtggcagca

SEQ ID NO: 2181883 - DNA, 14 bp, Homo sapiens
aggcagtggcaggg

SEQ ID NO: 2181884 - DNA, 20 bp, Homo sapiens
aggcagtggcaggggagcag

SEQ ID NO: 2181885 - DNA, 15 bp, Homo sapiens
aggcattaaatgcaa

SEQ ID NO: 2181886 - DNA, 21 bp, Homo sapiens
aggcattaaatgcaaaaatat

SEQ ID NO: 2181887 - DNA, 19 bp, Homo sapiens
aggccacactttctgggaa

SEQ ID NO: 2181888 - DNA, 20 bp, Homo sapiens
aggccacactttctgggaaa

SEQ ID NO: 2181889 - DNA, 11 bp, Homo sapiens
aggccacctgc

SEQ ID NO: 2181890 - DNA, 15 bp, Homo sapiens
aggccacgggggagg

SEQ ID NO: 2181891 - DNA, 15 bp, Homo sapiens
aggcccagcagagcc

SEQ ID NO: 2181892 - DNA, 16 bp, Homo sapiens
aggcccagcagagccg

SEQ ID NO: 2181893 - DNA, 23 bp, Homo sapiens
aggcccagcagagccgttcctgg

SEQ ID NO: 2181894 - DNA, 14 bp, Homo sapiens
aggccccagaggcc

SEQ ID NO: 2181895 - DNA, 15 bp, Homo sapiens
aggccccagaggccc

SEQ ID NO: 2181896 - DNA, 16 bp, Homo sapiens
aggccccagaggccct

SEQ ID NO: 2181897 - DNA, 19 bp, Homo sapiens
aggccccagaggccctgga

SEQ ID NO: 2181898 - DNA, 21 bp, Homo sapiens
aggccccagaggccctggagg

SEQ ID NO: 2181899 - DNA, 14 bp, Homo sapiens
aggccccctttcta

SEQ ID NO: 2181900 - DNA, 17 bp, Homo sapiens
aggcccttttctggctc

SEQ ID NO: 2181901 - DNA, 19 bp, Homo sapiens
aggcccttttctggctcct

SEQ ID NO: 2181902 - DNA, 13 bp, Homo sapiens
aggccgaggcagg

SEQ ID NO: 2181903 - DNA, 13 bp, Homo sapiens
aggccgcccacct

SEQ ID NO: 2181904 - DNA, 22 bp, Homo sapiens
aggccgcccacctgcatcagcc

SEQ ID NO: 2181905 - DNA, 15 bp, Homo sapiens
aggccgctgctgacc

SEQ ID NO: 2181906 - DNA, 20 bp, Homo sapiens
aggccgtgtccccttgttct

SEQ ID NO: 2181907 - DNA, 17 bp, Homo sapiens
aggcctagtcagccaca

SEQ ID NO: 2181908 - DNA, 20 bp, Homo sapiens
aggcctagtcagccacatgg

SEQ ID NO: 2181909 - DNA, 14 bp, Homo sapiens
aggcctcaccctgc

SEQ ID NO: 2181910 - DNA, 17 bp, Homo sapiens
aggcctcaccctgcttg

SEQ ID NO: 2181911 - DNA, 15 bp, Homo sapiens
aggcctcttgctggt

SEQ ID NO: 2181912 - DNA, 22 bp, Homo sapiens
aggcctcttgctggtgcacatg

SEQ ID NO: 2181913 - DNA, 23 bp, Homo sapiens
aggcctgtccctggccatctctg

SEQ ID NO: 2181914 - DNA, 12 bp, Homo sapiens
aggcgaagctga

SEQ ID NO: 2181915 - DNA, 23 bp, Homo sapiens
aggcgcggttcaggtcagggcta

SEQ ID NO: 2181916 - DNA, 18 bp, Homo sapiens
aggctctgaaagctgctt

SEQ ID NO: 2181917 - DNA, 19 bp, Homo sapiens
aggctgccggctgcaccct

SEQ ID NO: 2181918 - DNA, 12 bp, Homo sapiens
aggctgggccaa

SEQ ID NO: 2181919 - DNA, 13 bp, Homo sapiens
aggctgggccaag

SEQ ID NO: 2181920 - DNA, 13 bp, Homo sapiens
aggctgggcccag

SEQ ID NO: 2181921 - DNA, 14 bp, Homo sapiens
aggctgggcccaga

SEQ ID NO: 2181922 - DNA, 22 bp, Homo sapiens
aggctgggcccagaggcacagc

SEQ ID NO: 2181923 - DNA, 14 bp, Homo sapiens
aggctgggtgccca

SEQ ID NO: 2181924 - DNA, 15 bp, Homo sapiens
aggctgggtgcccac

SEQ ID NO: 2181925 - DNA, 16 bp, Homo sapiens
aggctgggtgcccaca

SEQ ID NO: 2181926 - DNA, 17 bp, Homo sapiens
aggctgtttttgggtgc

SEQ ID NO: 2181927 - DNA, 15 bp, Homo sapiens
agggaaacgtgccct

SEQ ID NO: 2181928 - DNA, 16 bp, Homo sapiens
agggaagatctaacat

SEQ ID NO: 2181929 - DNA, 20 bp, Homo sapiens
agggaagcatagagaacggg

SEQ ID NO: 2181930 - DNA, 16 bp, Homo sapiens
agggaaggccacctgc

SEQ ID NO: 2181931 - DNA, 21 bp, Homo sapiens
agggacagcgggtaaaaagag

SEQ ID NO: 2181932 - DNA, 9 bp, Homo sapiens
agggagaag

SEQ ID NO: 2181933 - DNA, 21 bp, Homo sapiens
agggagaaggagaggctctga

SEQ ID NO: 2181934 - DNA, 16 bp, Homo sapiens
agggagggtcagtgcc

SEQ ID NO: 2181935 - DNA, 21 bp, Homo sapiens
agggatgcggatcctgctggg

SEQ ID NO: 2181936 - DNA, 23 bp, Homo sapiens
agggatgcggatcctgctggggc

SEQ ID NO: 2181937 - DNA, 22 bp, Homo sapiens
agggatgctatctcgctagcca

SEQ ID NO: 2181938 - DNA, 23 bp, Homo sapiens
agggatgctatctcgctagccat

SEQ ID NO: 2181939 - DNA, 12 bp, Homo sapiens
agggcaaagctg

SEQ ID NO: 2181940 - DNA, 13 bp, Homo sapiens
agggcaaagctga

SEQ ID NO: 2181941 - DNA, 13 bp, Homo sapiens
agggcagcagccg

SEQ ID NO: 2181942 - DNA, 17 bp, Homo sapiens
agggcagcctgtgggag

SEQ ID NO: 2181943 - DNA, 19 bp, Homo sapiens
agggcagcctgtgggagaa

SEQ ID NO: 2181944 - DNA, 21 bp, Homo sapiens
agggcagcctgtgggagaagg

SEQ ID NO: 2181945 - DNA, 13 bp, Homo sapiens
agggcattggcca

SEQ ID NO: 2181946 - DNA, 23 bp, Homo sapiens
agggccatctgactgccaagcca

SEQ ID NO: 2181947 - DNA, 17 bp, Homo sapiens
agggccctctgaggctc

SEQ ID NO: 2181948 - DNA, 22 bp, Homo sapiens
agggccctctgaggctcagccc

SEQ ID NO: 2181949 - DNA, 20 bp, Homo sapiens
agggccctctggggctcagc

SEQ ID NO: 2181950 - DNA, 14 bp, Homo sapiens
agggcctgactttt

SEQ ID NO: 2181951 - DNA, 21 bp, Homo sapiens
agggctatggatggggcccag

SEQ ID NO: 2181952 - DNA, 16 bp, Homo sapiens
agggcttcagatattt

SEQ ID NO: 2181953 - DNA, 14 bp, Homo sapiens
aggggaatttcagg

SEQ ID NO: 2181954 - DNA, 17 bp, Homo sapiens
aggggacgcctgtgtca

SEQ ID NO: 2181955 - DNA, 17 bp, Homo sapiens
aggggagaggaagcaca

SEQ ID NO: 2181956 - DNA, 16 bp, Homo sapiens
aggggaggagcctgtg

SEQ ID NO: 2181957 - DNA, 17 bp, Homo sapiens
aggggatccagccactt

SEQ ID NO: 2181958 - DNA, 12 bp, Homo sapiens
aggggcaggagc

SEQ ID NO: 2181959 - DNA, 20 bp, Homo sapiens
aggggcaggagctcagatga

SEQ ID NO: 2181960 - DNA, 13 bp, Homo sapiens
aggggcagggaag

SEQ ID NO: 2181961 - DNA, 22 bp, Homo sapiens
aggggcctctggctgcctggcc

SEQ ID NO: 2181962 - DNA, 18 bp, Homo sapiens
aggggctggactggctgt

SEQ ID NO: 2181963 - DNA, 16 bp, Homo sapiens
aggggctgggcagagg

SEQ ID NO: 2181964 - DNA, 23 bp, Homo sapiens
aggggctgggcagaggggagagg

SEQ ID NO: 2181965 - DNA, 10 bp, Homo sapiens
aggggctggt

SEQ ID NO: 2181966 - DNA, 16 bp, Homo sapiens
aggggcttccctctgc

SEQ ID NO: 2181967 - DNA, 19 bp, Homo sapiens
aggggcttccctctgctcc

SEQ ID NO: 2181968 - DNA, 12 bp, Homo sapiens
agggggccctgc

SEQ ID NO: 2181969 - DNA, 15 bp, Homo sapiens
agggggccctgctac

SEQ ID NO: 2181970 - DNA, 17 bp, Homo sapiens
agggggcctgagttgag

SEQ ID NO: 2181971 - DNA, 15 bp, Homo sapiens
agggtagggggcctg

SEQ ID NO: 2181972 - DNA, 16 bp, Homo sapiens
cagctaaagaggtggg

SEQ ID NO: 2181973 - DNA, 20 bp, Homo sapiens
cagctataacagtagggatg

SEQ ID NO: 2181974 - DNA, 18 bp, Homo sapiens
cagctatacctcattcac

SEQ ID NO: 2181975 - DNA, 19 bp, Homo sapiens
cagctattaagaaaatcac

SEQ ID NO: 2181976 - DNA, 16 bp, Homo sapiens
cagctcacggcagcct

SEQ ID NO: 2181977 - DNA, 17 bp, Homo sapiens
cagctcactgcaacctc

SEQ ID NO: 2181978 - DNA, 13 bp, Homo sapiens
cagctcagccagt

SEQ ID NO: 2181979 - DNA, 16 bp, Homo sapiens
cagctccgcctggcac

SEQ ID NO: 2181980 - DNA, 19 bp, Homo sapiens
cagctccgcctggcaccca

SEQ ID NO: 2181981 - DNA, 13 bp, Homo sapiens
cagctctggctca

SEQ ID NO: 2181982 - DNA, 15 bp, Homo sapiens
cagctgaaggcagtg

SEQ ID NO: 2181983 - DNA, 17 bp, Homo sapiens
cagctgaaggcagtggc

SEQ ID NO: 2181984 - DNA, 18 bp, Homo sapiens
cagctgaaggcagtggca

SEQ ID NO: 2181985 - DNA, 17 bp, Homo sapiens
cagctgctcctcgcagt

SEQ ID NO: 2181986 - DNA, 11 bp, Homo sapiens
cagctgctctg

SEQ ID NO: 2181987 - DNA, 12 bp, Homo sapiens
cagctgctctgc

SEQ ID NO: 2181988 - DNA, 16 bp, Homo sapiens
cagctgctctgcccag

SEQ ID NO: 2181989 - DNA, 17 bp, Homo sapiens
cagctgctctgcccaga

SEQ ID NO: 2181990 - DNA, 19 bp, Homo sapiens
cagctgctctgcccagagc

SEQ ID NO: 2181991 - DNA, 20 bp, Homo sapiens
cagctgctctgcccagagct

SEQ ID NO: 2181992 - DNA, 21 bp, Homo sapiens
cagctgctctgcccagagctg

SEQ ID NO: 2181993 - DNA, 23 bp, Homo sapiens
cagctgctctgcccagagctggg

SEQ ID NO: 2181994 - DNA, 21 bp, Homo sapiens
cagctggcggaacctggctgc

SEQ ID NO: 2181995 - DNA, 18 bp, Homo sapiens
cagctggggcccctcggc

SEQ ID NO: 2181996 - DNA, 23 bp, Homo sapiens
cagctgtggtgaggttgggcagc

SEQ ID NO: 2181997 - DNA, 22 bp, Homo sapiens
cagctgtgtcccttcctgcttt

SEQ ID NO: 2181998 - DNA, 18 bp, Homo sapiens
cagcttggggcagccatt

SEQ ID NO: 2181999 - DNA, 22 bp, Homo sapiens
cagctttactgccttcctcctt

SEQ ID NO: 2182000 - DNA, 13 bp, Homo sapiens
cagctttcctggg

SEQ ID NO: 2182001 - DNA, 20 bp, Homo sapiens
cagcttttagtacccacctg

SEQ ID NO: 2182002 - DNA, 16 bp, Homo sapiens
caggaaagtggccaag

SEQ ID NO: 2182003 - DNA, 13 bp, Homo sapiens
caggaacctggac

SEQ ID NO: 2182004 - DNA, 21 bp, Homo sapiens
caggaagccgcctagtgcaga

SEQ ID NO: 2182005 - DNA, 15 bp, Homo sapiens
caggaagccgtcctg

SEQ ID NO: 2182006 - DNA, 15 bp, Homo sapiens
caggaaggggctgga

SEQ ID NO: 2182007 - DNA, 12 bp, Homo sapiens
caggacagctgc

SEQ ID NO: 2182008 - DNA, 14 bp, Homo sapiens
caggaccctcagga

SEQ ID NO: 2182009 - DNA, 15 bp, Homo sapiens
caggaccctcaggaa

SEQ ID NO: 2182010 - DNA, 15 bp, Homo sapiens
caggaccgccaaaga

SEQ ID NO: 2182011 - DNA, 19 bp, Homo sapiens
caggacgatttcactgaca

SEQ ID NO: 2182012 - DNA, 13 bp, Homo sapiens
caggacttgaatt

SEQ ID NO: 2182013 - DNA, 18 bp, Homo sapiens
caggagcattttgtgtct

SEQ ID NO: 2182014 - DNA, 17 bp, Homo sapiens
caggaggagggcgcatg

SEQ ID NO: 2182015 - DNA, 22 bp, Homo sapiens
caggaggagggcgcatgtgtgt

SEQ ID NO: 2182016 - DNA, 23 bp, Homo sapiens
caggaggagggcgcatgtgtgta

SEQ ID NO: 2182017 - DNA, 13 bp, Homo sapiens
caggcagccttga

SEQ ID NO: 2182018 - DNA, 15 bp, Homo sapiens
caggccactgacctc

SEQ ID NO: 2182019 - DNA, 15 bp, Homo sapiens
caggccatcagaggc

SEQ ID NO: 2182020 - DNA, 21 bp, Homo sapiens
caggcccagtccactggggag

SEQ ID NO: 2182021 - DNA, 13 bp, Homo sapiens
caggcctttccta

SEQ ID NO: 2182022 - DNA, 14 bp, Homo sapiens
caggctctgcacag

SEQ ID NO: 2182023 - DNA, 18 bp, Homo sapiens
caggctgagtgcactggc

SEQ ID NO: 2182024 - DNA, 20 bp, Homo sapiens
caggctggtcttgaactcct

SEQ ID NO: 2182025 - DNA, 18 bp, Homo sapiens
caggctgtttttgggtgc

SEQ ID NO: 2182026 - DNA, 21 bp, Homo sapiens
cagggaaggacaggaccctca

SEQ ID NO: 2182027 - DNA, 15 bp, Homo sapiens
cagggaatatatatt

SEQ ID NO: 2182028 - DNA, 13 bp, Homo sapiens
cagggaggcacca

SEQ ID NO: 2182029 - DNA, 22 bp, Homo sapiens
cagggaggcaccattcaggaac

SEQ ID NO: 2182030 - DNA, 19 bp, Homo sapiens
cagggatggggccacagcc

SEQ ID NO: 2182031 - DNA, 19 bp, Homo sapiens
cagggcaccaagcccacag

SEQ ID NO: 2182032 - DNA, 18 bp, Homo sapiens
cagggcagcctgtgggag

SEQ ID NO: 2182033 - DNA, 19 bp, Homo sapiens
cagggcagcctgtgggaga

SEQ ID NO: 2182034 - DNA, 22 bp, Homo sapiens
cagggcagcctgtgggagaagg

SEQ ID NO: 2182035 - DNA, 14 bp, Homo sapiens
cagggcccaggtga

SEQ ID NO: 2182036 - DNA, 15 bp, Homo sapiens
cagggccttgctaat

SEQ ID NO: 2182037 - DNA, 13 bp, Homo sapiens
caggggctgggca

SEQ ID NO: 2182038 - DNA, 21 bp, Homo sapiens
cagggggtggagagaccagcc

SEQ ID NO: 2182039 - DNA, 14 bp, Homo sapiens
cagggtcctgctat

SEQ ID NO: 2182040 - DNA, 13 bp, Homo sapiens
cagggtctcccta

SEQ ID NO: 2182041 - DNA, 21 bp, Homo sapiens
cagggtctccctatgttgccc

SEQ ID NO: 2182042 - DNA, 12 bp, Homo sapiens
cagggtgaggtg

SEQ ID NO: 2182043 - DNA, 16 bp, Homo sapiens
cagggttttatctctg

SEQ ID NO: 2182044 - DNA, 17 bp, Homo sapiens
cagggttttttggccta

SEQ ID NO: 2182045 - DNA, 19 bp, Homo sapiens
caggtaaacagaaatcctt

SEQ ID NO: 2182046 - DNA, 13 bp, Homo sapiens
caggtcagggcta

SEQ ID NO: 2182047 - DNA, 18 bp, Homo sapiens
caggtcccgagccccctg

SEQ ID NO: 2182048 - DNA, 21 bp, Homo sapiens
caggtcccgagccccctgtcc

SEQ ID NO: 2182049 - DNA, 22 bp, Homo sapiens
caggtcccgagccccctgtcct

SEQ ID NO: 2182050 - DNA, 17 bp, Homo sapiens
caggtcgggctcagctc

SEQ ID NO: 2182051 - DNA, 18 bp, Homo sapiens
caggtctgggagaggcag

SEQ ID NO: 2182052 - DNA, 20 bp, Homo sapiens
caggtcttaatcagttagat

SEQ ID NO: 2182053 - DNA, 22 bp, Homo sapiens
caggtgcccattagcaacgcct

SEQ ID NO: 2182054 - DNA, 19 bp, Homo sapiens
caggtgtccccagcccact

SEQ ID NO: 2182055 - DNA, 15 bp, Homo sapiens
caggtgtgagccacc

SEQ ID NO: 2182056 - DNA, 16 bp, Homo sapiens
caggtgtgagccacca

SEQ ID NO: 2182057 - DNA, 15 bp, Homo sapiens
caggtgtgagccact

SEQ ID NO: 2182058 - DNA, 20 bp, Homo sapiens
caggttccccaagggccctg

SEQ ID NO: 2182059 - DNA, 21 bp, Homo sapiens
caggttctggttagctcagcc

SEQ ID NO: 2182060 - DNA, 15 bp, Homo sapiens
caggttggaggccct

SEQ ID NO: 2182061 - DNA, 20 bp, Homo sapiens
cagtaacagggccttgctaa

SEQ ID NO: 2182062 - DNA, 22 bp, Homo sapiens
cagtaagaccggaagctcctgg

SEQ ID NO: 2182063 - DNA, 19 bp, Homo sapiens
cagtaaggcagctctgtcg

SEQ ID NO: 2182064 - DNA, 18 bp, Homo sapiens
cagtacagctatttctca

SEQ ID NO: 2182065 - DNA, 18 bp, Homo sapiens
cagtaggctcaactaggg

SEQ ID NO: 2182066 - DNA, 15 bp, Homo sapiens
cagtagttactgctg

SEQ ID NO: 2182067 - DNA, 17 bp, Homo sapiens
cagtatcctgaaacagt

SEQ ID NO: 2182068 - DNA, 22 bp, Homo sapiens
cagtatcctgaaacagtgtttg

SEQ ID NO: 2182069 - DNA, 14 bp, Homo sapiens
cagtatgtgtctag

SEQ ID NO: 2182070 - DNA, 22 bp, Homo sapiens
cagtatgtgtctagcaaagcca

SEQ ID NO: 2182071 - DNA, 16 bp, Homo sapiens
cagtattttccctgct

SEQ ID NO: 2182072 - DNA, 21 bp, Homo sapiens
cagtcacagtggggttttttt

SEQ ID NO: 2182073 - DNA, 14 bp, Homo sapiens
cagtcacccctgtc

SEQ ID NO: 2182074 - DNA, 23 bp, Homo sapiens
cagtcatttttgtttctacctcc

SEQ ID NO: 2182075 - DNA, 15 bp, Homo sapiens
cagtccactggggag

SEQ ID NO: 2182076 - DNA, 22 bp, Homo sapiens
cagtccactggggagtgctgga

SEQ ID NO: 2182077 - DNA, 22 bp, Homo sapiens
cagtccagttttgtgtgcttta

SEQ ID NO: 2182078 - DNA, 13 bp, Homo sapiens
cagtcctgctctc

SEQ ID NO: 2182079 - DNA, 17 bp, Homo sapiens
cagtcctgctctctacc

SEQ ID NO: 2182080 - DNA, 22 bp, Homo sapiens
cagtcctgctctctacccagcc

SEQ ID NO: 2182081 - DNA, 23 bp, Homo sapiens
cagtcctgctctctacccagccc

SEQ ID NO: 2182082 - DNA, 22 bp, Homo sapiens
cagtctctcttacccttctgtg

SEQ ID NO: 2182083 - DNA, 16 bp, Homo sapiens
cagtctgctttctcta

SEQ ID NO: 2182084 - DNA, 22 bp, Homo sapiens
cagtcttccctagggctgggtg

SEQ ID NO: 2182085 - DNA, 14 bp, Homo sapiens
cagtcttgtactgt

SEQ ID NO: 2182086 - DNA, 14 bp, Homo sapiens
cagtgaataaaagg

SEQ ID NO: 2182087 - DNA, 17 bp, Homo sapiens
cagtgactcctgctggt

SEQ ID NO: 2182088 - DNA, 20 bp, Homo sapiens
cagtgactcctgctggtacc

SEQ ID NO: 2182089 - DNA, 23 bp, Homo sapiens
cagtgagacagccggatcttgga

SEQ ID NO: 2182090 - DNA, 12 bp, Homo sapiens
cagtgatggcat

SEQ ID NO: 2182091 - DNA, 14 bp, Homo sapiens
cagtgatgggagta

SEQ ID NO: 2182092 - DNA, 21 bp, Homo sapiens
cagtgatttttagtaaccttt

SEQ ID NO: 2182093 - DNA, 22 bp, Homo sapiens
cagtgccaataaaatttaggaa

SEQ ID NO: 2182094 - DNA, 14 bp, Homo sapiens
cagtgcccctagct

SEQ ID NO: 2182095 - DNA, 22 bp, Homo sapiens
cagtgccttcaacaacgtgaga

SEQ ID NO: 2182096 - DNA, 12 bp, Homo sapiens
attaaaaattga

SEQ ID NO: 2182097 - DNA, 15 bp, Homo sapiens
attaaaaattgaaaa

SEQ ID NO: 2182098 - DNA, 22 bp, Homo sapiens
attaaaataaaacgttatctca

SEQ ID NO: 2182099 - DNA, 17 bp, Homo sapiens
attaaacctttccattt

SEQ ID NO: 2182100 - DNA, 24 bp, Homo sapiens
attaaacctttccattttacgttt

SEQ ID NO: 2182101 - DNA, 12 bp, Homo sapiens
attaaacttgaa

SEQ ID NO: 2182102 - DNA, 19 bp, Homo sapiens
attaaagaaaattgccaaa

SEQ ID NO: 2182103 - DNA, 20 bp, Homo sapiens
attaaagaaaattgccaaaa

SEQ ID NO: 2182104 - DNA, 16 bp, Homo sapiens
attaaatcagttttgt

SEQ ID NO: 2182105 - DNA, 19 bp, Homo sapiens
attaaatcagttttgtgta

SEQ ID NO: 2182106 - DNA, 17 bp, Homo sapiens
attaacctacttgtaaa

SEQ ID NO: 2182107 - DNA, 23 bp, Homo sapiens
attaacctacttgtaaacttgaa

SEQ ID NO: 2182108 - DNA, 19 bp, Homo sapiens
attaactgaattctgaact

SEQ ID NO: 2182109 - DNA, 22 bp, Homo sapiens
attaagttgttgaaagtaagtt

SEQ ID NO: 2182110 - DNA, 18 bp, Homo sapiens
attaatataagtttcttt

SEQ ID NO: 2182111 - DNA, 15 bp, Homo sapiens
attaatgtagataaa

SEQ ID NO: 2182112 - DNA, 21 bp, Homo sapiens
attaatgtaggtttagatata

SEQ ID NO: 2182113 - DNA, 12 bp, Homo sapiens
attaattcttta

SEQ ID NO: 2182114 - DNA, 15 bp, Homo sapiens
attaatttatatttg

SEQ ID NO: 2182115 - DNA, 14 bp, Homo sapiens
attaatttgaccat

SEQ ID NO: 2182116 - DNA, 18 bp, Homo sapiens
attaatttgttaattaaa

SEQ ID NO: 2182117 - DNA, 23 bp, Homo sapiens
attaatttgttaattaaatattt

SEQ ID NO: 2182118 - DNA, 22 bp, Homo sapiens
attacaaaatgacattttgcca

SEQ ID NO: 2182119 - DNA, 16 bp, Homo sapiens
attacaagtttcagta

SEQ ID NO: 2182120 - DNA, 23 bp, Homo sapiens
attacaagtttcagtaatagctg

SEQ ID NO: 2182121 - DNA, 20 bp, Homo sapiens
attacacacgtgtgatgtat

SEQ ID NO: 2182122 - DNA, 11 bp, Homo sapiens
attactctgca

SEQ ID NO: 2182123 - DNA, 15 bp, Homo sapiens
attactctgcactat

SEQ ID NO: 2182124 - DNA, 16 bp, Homo sapiens
attactctttgctttg

SEQ ID NO: 2182125 - DNA, 18 bp, Homo sapiens
attactctttgctttgta

SEQ ID NO: 2182126 - DNA, 22 bp, Homo sapiens
attactgtttgtcttctcccca

SEQ ID NO: 2182127 - DNA, 23 bp, Homo sapiens
attactgtttgtcttctccccag

SEQ ID NO: 2182128 - DNA, 15 bp, Homo sapiens
attagatgactgaat

SEQ ID NO: 2182129 - DNA, 13 bp, Homo sapiens
attagattagaaa

SEQ ID NO: 2182130 - DNA, 21 bp, Homo sapiens
attagtgaagtatgcactaat

SEQ ID NO: 2182131 - DNA, 13 bp, Homo sapiens
attatacaaaaaa

SEQ ID NO: 2182132 - DNA, 19 bp, Homo sapiens
attatacgtatgcattttt

SEQ ID NO: 2182133 - DNA, 14 bp, Homo sapiens
attatctgggctta

SEQ ID NO: 2182134 - DNA, 20 bp, Homo sapiens
attattatcttcttaacagt

SEQ ID NO: 2182135 - DNA, 16 bp, Homo sapiens
attattcatagctgta

SEQ ID NO: 2182136 - DNA, 20 bp, Homo sapiens
attattgagttctgaagtag

SEQ ID NO: 2182137 - DNA, 18 bp, Homo sapiens
attattggacttccattt

SEQ ID NO: 2182138 - DNA, 19 bp, Homo sapiens
attcaaaaacatggccaca

SEQ ID NO: 2182139 - DNA, 18 bp, Homo sapiens
attcaaaaattatatttt

SEQ ID NO: 2182140 - DNA, 20 bp, Homo sapiens
attcaaaaattatattttga

SEQ ID NO: 2182141 - DNA, 22 bp, Homo sapiens
attcaaaaattatattttgaac

SEQ ID NO: 2182142 - DNA, 22 bp, Homo sapiens
attcacaatggattatacaaaa

SEQ ID NO: 2182143 - DNA, 18 bp, Homo sapiens
attcacagctccttgtga

SEQ ID NO: 2182144 - DNA, 18 bp, Homo sapiens
attcactcagcatcccca

SEQ ID NO: 2182145 - DNA, 18 bp, Homo sapiens
attcactctcccagaggc

SEQ ID NO: 2182146 - DNA, 11 bp, Homo sapiens
attcagacatc

SEQ ID NO: 2182147 - DNA, 15 bp, Homo sapiens
attcagacatctgag

SEQ ID NO: 2182148 - DNA, 20 bp, Homo sapiens
attcagtgcattttcaacat

SEQ ID NO: 2182149 - DNA, 16 bp, Homo sapiens
attcagtgccttcaac

SEQ ID NO: 2182150 - DNA, 19 bp, Homo sapiens
attcatagctgtatatttg

SEQ ID NO: 2182151 - DNA, 20 bp, Homo sapiens
attcattcacaatggattat

SEQ ID NO: 2182152 - DNA, 12 bp, Homo sapiens
attccaatattt

SEQ ID NO: 2182153 - DNA, 19 bp, Homo sapiens
attccaatatttataatta

SEQ ID NO: 2182154 - DNA, 22 bp, Homo sapiens
attccaatatttataattaaag

SEQ ID NO: 2182155 - DNA, 20 bp, Homo sapiens
attccagatctgcagtcact

SEQ ID NO: 2182156 - DNA, 11 bp, Homo sapiens
attccatctcc

SEQ ID NO: 2182157 - DNA, 12 bp, Homo sapiens
attccatctcct

SEQ ID NO: 2182158 - DNA, 22 bp, Homo sapiens
attccattgaccttaatttctt

SEQ ID NO: 2182159 - DNA, 20 bp, Homo sapiens
attccatttctctccaacat

SEQ ID NO: 2182160 - DNA, 15 bp, Homo sapiens
attcccagaggtggg

SEQ ID NO: 2182161 - DNA, 21 bp, Homo sapiens
attcccatggtagactgtgac

SEQ ID NO: 2182162 - DNA, 18 bp, Homo sapiens
attccccttcccttattt

SEQ ID NO: 2182163 - DNA, 14 bp, Homo sapiens
attccctggaccag

SEQ ID NO: 2182164 - DNA, 19 bp, Homo sapiens
attccctggaccagatgct

SEQ ID NO: 2182165 - DNA, 22 bp, Homo sapiens
attctctctgaacacacattgc

SEQ ID NO: 2182166 - DNA, 20 bp, Homo sapiens
attctctgtccagggcttca

SEQ ID NO: 2182167 - DNA, 14 bp, Homo sapiens
attctcttgaataa

SEQ ID NO: 2182168 - DNA, 13 bp, Homo sapiens
attctgaagtttt

SEQ ID NO: 2182169 - DNA, 23 bp, Homo sapiens
attctgaatttgtagacatactt

SEQ ID NO: 2182170 - DNA, 23 bp, Homo sapiens
attctggcctagtcccttccaca

SEQ ID NO: 2182171 - DNA, 14 bp, Homo sapiens
attctgggcaaata

SEQ ID NO: 2182172 - DNA, 16 bp, Homo sapiens
attctgggcaaataga

SEQ ID NO: 2182173 - DNA, 17 bp, Homo sapiens
attctggtcacattcca

SEQ ID NO: 2182174 - DNA, 22 bp, Homo sapiens
attcttgattttcaagctttca

SEQ ID NO: 2182175 - DNA, 21 bp, Homo sapiens
attctttaattgttgctttta

SEQ ID NO: 2182176 - DNA, 15 bp, Homo sapiens
attctttatcacatg

SEQ ID NO: 2182177 - DNA, 13 bp, Homo sapiens
attctttgagaag

SEQ ID NO: 2182178 - DNA, 18 bp, Homo sapiens
attgaagtatctgtacct

SEQ ID NO: 2182179 - DNA, 18 bp, Homo sapiens
attgacaaggtagacatg

SEQ ID NO: 2182180 - DNA, 21 bp, Homo sapiens
attgacaaggtagacatggat

SEQ ID NO: 2182181 - DNA, 15 bp, Homo sapiens
attgaccttaatttc

SEQ ID NO: 2182182 - DNA, 23 bp, Homo sapiens
attgaccttaatttcttgggaaa

SEQ ID NO: 2182183 - DNA, 23 bp, Homo sapiens
attgagagagaagtcggccaggt

SEQ ID NO: 2182184 - DNA, 14 bp, Homo sapiens
attgagttctgaag

SEQ ID NO: 2182185 - DNA, 20 bp, Homo sapiens
attgatttctgccttccttg

SEQ ID NO: 2182186 - DNA, 21 bp, Homo sapiens
attgatttctgccttccttgc

SEQ ID NO: 2182187 - DNA, 22 bp, Homo sapiens
attgcaagtgaaataatattga

SEQ ID NO: 2182188 - DNA, 13 bp, Homo sapiens
attgccaaaatat

SEQ ID NO: 2182189 - DNA, 16 bp, Homo sapiens
attgcttaaacaaaac

SEQ ID NO: 2182190 - DNA, 14 bp, Homo sapiens
attggacttccatt

SEQ ID NO: 2182191 - DNA, 15 bp, Homo sapiens
attggacttccattt

SEQ ID NO: 2182192 - DNA, 17 bp, Homo sapiens
attggacttccatttgg

SEQ ID NO: 2182193 - DNA, 15 bp, Homo sapiens
attgggctgcaggct

SEQ ID NO: 2182194 - DNA, 18 bp, Homo sapiens
attgtaagtcccatgaat

SEQ ID NO: 2182195 - DNA, 21 bp, Homo sapiens
attgtaagtcccatgaataca

SEQ ID NO: 2182196 - DNA, 13 bp, Homo sapiens
attgtatattgta

SEQ ID NO: 2182197 - DNA, 18 bp, Homo sapiens
attgtctgaaattttcta

SEQ ID NO: 2182198 - DNA, 14 bp, Homo sapiens
attgtgaaatttgt

SEQ ID NO: 2182199 - DNA, 17 bp, Homo sapiens
attgtgaaatttgttaa

SEQ ID NO: 2182200 - DNA, 11 bp, Homo sapiens
attgtgacagc

SEQ ID NO: 2182201 - DNA, 12 bp, Homo sapiens
attgtgcatgca

SEQ ID NO: 2182202 - DNA, 18 bp, Homo sapiens
attgtgtgtcacaaagct

SEQ ID NO: 2182203 - DNA, 17 bp, Homo sapiens
attgttctcagaatccc

SEQ ID NO: 2182204 - DNA, 14 bp, Homo sapiens
atttaaaaaaaaac

SEQ ID NO: 2182205 - DNA, 23 bp, Homo sapiens
atttaaagacaaagacattattt

SEQ ID NO: 2182206 - DNA, 12 bp, Homo sapiens
atttaaagctgt

SEQ ID NO: 2182207 - DNA, 18 bp, Homo sapiens
atttaacagaaattgtat

SEQ ID NO: 2182208 - DNA, 14 bp, Homo sapiens
atttaatgtagcca

SEQ ID NO: 2182209 - DNA, 14 bp, Homo sapiens
atttaatttgttgt

SEQ ID NO: 2182210 - DNA, 17 bp, Homo sapiens
atttaatttttacatga

SEQ ID NO: 2182211 - DNA, 19 bp, Homo sapiens
atttaatttttacatgacc

SEQ ID NO: 2182212 - DNA, 18 bp, Homo sapiens
atttacaagactaacctt

SEQ ID NO: 2182213 - DNA, 23 bp, Homo sapiens
atttacacaaaaagaaagctgtg

SEQ ID NO: 2182214 - DNA, 11 bp, Homo sapiens
atttacagaaa

SEQ ID NO: 2182215 - DNA, 15 bp, Homo sapiens
atttacatttaatag

SEQ ID NO: 2182216 - DNA, 15 bp, Homo sapiens
atttagtaaaaataa

SEQ ID NO: 2182217 - DNA, 18 bp, Homo sapiens
atttagtacatccagaaa

SEQ ID NO: 2182218 - DNA, 21 bp, Homo sapiens
atttataacaatgttaaatgc

SEQ ID NO: 2182219 - DNA, 22 bp, Homo sapiens
atttataattaaagaaaattgc

SEQ ID NO: 2182220 - DNA, 19 bp, Homo sapiens
caaatttcatctttccaaa

SEQ ID NO: 2182221 - DNA, 18 bp, Homo sapiens
caacaacgtgagagaaag

SEQ ID NO: 2182222 - DNA, 19 bp, Homo sapiens
caacaacgtgagagaaaga

SEQ ID NO: 2182223 - DNA, 23 bp, Homo sapiens
caacaacgtgagagaaagagaga

SEQ ID NO: 2182224 - DNA, 19 bp, Homo sapiens
caacaactgtcagaataaa

SEQ ID NO: 2182225 - DNA, 14 bp, Homo sapiens
caacaataaaaaaa

SEQ ID NO: 2182226 - DNA, 16 bp, Homo sapiens
caacacaaggtgggca

SEQ ID NO: 2182227 - DNA, 21 bp, Homo sapiens
caacacaatctttccttgtct

SEQ ID NO: 2182228 - DNA, 15 bp, Homo sapiens
caacacttcagactg

SEQ ID NO: 2182229 - DNA, 14 bp, Homo sapiens
caacagccaagacc

SEQ ID NO: 2182230 - DNA, 19 bp, Homo sapiens
caacataaaacaaaaccaa

SEQ ID NO: 2182231 - DNA, 17 bp, Homo sapiens
caacatgaattaagaac

SEQ ID NO: 2182232 - DNA, 15 bp, Homo sapiens
caaccacctctggcc

SEQ ID NO: 2182233 - DNA, 18 bp, Homo sapiens
caaccacctctggccctg

SEQ ID NO: 2182234 - DNA, 14 bp, Homo sapiens
caaccatgtcattt

SEQ ID NO: 2182235 - DNA, 18 bp, Homo sapiens
caaccctgaggtatctgt

SEQ ID NO: 2182236 - DNA, 14 bp, Homo sapiens
caacctcagcaacc

SEQ ID NO: 2182237 - DNA, 20 bp, Homo sapiens
caacctgcttttttctgttt

SEQ ID NO: 2182238 - DNA, 16 bp, Homo sapiens
caacgcctgccttctg

SEQ ID NO: 2182239 - DNA, 17 bp, Homo sapiens
caacgtgagagaaagag

SEQ ID NO: 2182240 - DNA, 20 bp, Homo sapiens
caacgtgagagaaagagaga

SEQ ID NO: 2182241 - DNA, 21 bp, Homo sapiens
caacgtgagagaaagagagaa

SEQ ID NO: 2182242 - DNA, 22 bp, Homo sapiens
caactcctggagatttcagtta

SEQ ID NO: 2182243 - DNA, 15 bp, Homo sapiens
caactgatatacttg

SEQ ID NO: 2182244 - DNA, 15 bp, Homo sapiens
caactgctctcaaaa

SEQ ID NO: 2182245 - DNA, 14 bp, Homo sapiens
caactgctgcccca

SEQ ID NO: 2182246 - DNA, 21 bp, Homo sapiens
caacttttagtgggtgagaaa

SEQ ID NO: 2182247 - DNA, 13 bp, Homo sapiens
caagaacagcagg

SEQ ID NO: 2182248 - DNA, 14 bp, Homo sapiens
caagaacagcaggc

SEQ ID NO: 2182249 - DNA, 21 bp, Homo sapiens
caagaacagcaggcccaccta

SEQ ID NO: 2182250 - DNA, 13 bp, Homo sapiens
caagaaggctggg

SEQ ID NO: 2182251 - DNA, 14 bp, Homo sapiens
caagaaggctgggg

SEQ ID NO: 2182252 - DNA, 13 bp, Homo sapiens
caagacctgactc

SEQ ID NO: 2182253 - DNA, 13 bp, Homo sapiens
caagacgaggggc

SEQ ID NO: 2182254 - DNA, 20 bp, Homo sapiens
caagactgactggcaccaac

SEQ ID NO: 2182255 - DNA, 13 bp, Homo sapiens
caagagggcaaag

SEQ ID NO: 2182256 - DNA, 14 bp, Homo sapiens
caagagggcaaagc

SEQ ID NO: 2182257 - DNA, 15 bp, Homo sapiens
caagagggcaaagct

SEQ ID NO: 2182258 - DNA, 20 bp, Homo sapiens
caagagggcaaagctgattt

SEQ ID NO: 2182259 - DNA, 15 bp, Homo sapiens
caagatacacttgta

SEQ ID NO: 2182260 - DNA, 20 bp, Homo sapiens
caagatacacttgtaaataa

SEQ ID NO: 2182261 - DNA, 13 bp, Homo sapiens
caagcaacaagcc

SEQ ID NO: 2182262 - DNA, 18 bp, Homo sapiens
caagcaggctcaacataa

SEQ ID NO: 2182263 - DNA, 21 bp, Homo sapiens
caagcatttaatgtagccatg

SEQ ID NO: 2182264 - DNA, 23 bp, Homo sapiens
caagccagggatggggccacagc

SEQ ID NO: 2182265 - DNA, 24 bp, Homo sapiens
caagccagggatggggccacagcc

SEQ ID NO: 2182266 - DNA, 13 bp, Homo sapiens
caagcctggtctc

SEQ ID NO: 2182267 - DNA, 17 bp, Homo sapiens
caagcctggtctcctcc

SEQ ID NO: 2182268 - DNA, 22 bp, Homo sapiens
caagcgactctcctgcctcagc

SEQ ID NO: 2182269 - DNA, 20 bp, Homo sapiens
caagctaggccccagaggcc

SEQ ID NO: 2182270 - DNA, 21 bp, Homo sapiens
caagctaggccccagaggccc

SEQ ID NO: 2182271 - DNA, 14 bp, Homo sapiens
caagctcttctcct

SEQ ID NO: 2182272 - DNA, 19 bp, Homo sapiens
caagctgcctccctgtcca

SEQ ID NO: 2182273 - DNA, 20 bp, Homo sapiens
caagctgtacccttgagacc

SEQ ID NO: 2182274 - DNA, 15 bp, Homo sapiens
caagctgtccctgca

SEQ ID NO: 2182275 - DNA, 15 bp, Homo sapiens
caaggactttgtaca

SEQ ID NO: 2182276 - DNA, 16 bp, Homo sapiens
caaggactttgtacat

SEQ ID NO: 2182277 - DNA, 16 bp, Homo sapiens
caaggatatactgcag

SEQ ID NO: 2182278 - DNA, 18 bp, Homo sapiens
caaggatatactgcagct

SEQ ID NO: 2182279 - DNA, 15 bp, Homo sapiens
caaggattcaatgca

SEQ ID NO: 2182280 - DNA, 18 bp, Homo sapiens
caaggcaaggggtgcctg

SEQ ID NO: 2182281 - DNA, 20 bp, Homo sapiens
caaggcaaggggtgcctggg

SEQ ID NO: 2182282 - DNA, 19 bp, Homo sapiens
caaggcaggcctttcctac

SEQ ID NO: 2182283 - DNA, 15 bp, Homo sapiens
caaggccgcccacct

SEQ ID NO: 2182284 - DNA, 23 bp, Homo sapiens
caaggccgcccacctgcatcagc

SEQ ID NO: 2182285 - DNA, 14 bp, Homo sapiens
caaggcctatgcca

SEQ ID NO: 2182286 - DNA, 15 bp, Homo sapiens
caaggcctatgccac

SEQ ID NO: 2182287 - DNA, 22 bp, Homo sapiens
caaggcctatgccacctgcagc

SEQ ID NO: 2182288 - DNA, 23 bp, Homo sapiens
caaggcctatgccacctgcagcg

SEQ ID NO: 2182289 - DNA, 14 bp, Homo sapiens
caaggcctgtccct

SEQ ID NO: 2182290 - DNA, 16 bp, Homo sapiens
caaggcctgtccctgg

SEQ ID NO: 2182291 - DNA, 17 bp, Homo sapiens
caaggcctgtccctggc

SEQ ID NO: 2182292 - DNA, 16 bp, Homo sapiens
caaggctgccggctgc

SEQ ID NO: 2182293 - DNA, 14 bp, Homo sapiens
caagggccctggca

SEQ ID NO: 2182294 - DNA, 18 bp, Homo sapiens
caagggccctggcacccc

SEQ ID NO: 2182295 - DNA, 19 bp, Homo sapiens
caagggctgcttcaaactc

SEQ ID NO: 2182296 - DNA, 15 bp, Homo sapiens
caaggggtgcctggg

SEQ ID NO: 2182297 - DNA, 18 bp, Homo sapiens
caagggtaaacaagcctg

SEQ ID NO: 2182298 - DNA, 14 bp, Homo sapiens
caaggtcaggaggc

SEQ ID NO: 2182299 - DNA, 19 bp, Homo sapiens
caaggtgagggatgccata

SEQ ID NO: 2182300 - DNA, 20 bp, Homo sapiens
caaggtgccaccaccctgcc

SEQ ID NO: 2182301 - DNA, 21 bp, Homo sapiens
caaggtgccaccaccctgccc

SEQ ID NO: 2182302 - DNA, 21 bp, Homo sapiens
caaggtgggcagggaggcacc

SEQ ID NO: 2182303 - DNA, 15 bp, Homo sapiens
caagtcatttttgtt

SEQ ID NO: 2182304 - DNA, 12 bp, Homo sapiens
caagtctgtgaa

SEQ ID NO: 2182305 - DNA, 14 bp, Homo sapiens
caagtctgtgcctg

SEQ ID NO: 2182306 - DNA, 17 bp, Homo sapiens
caagtctgtgcctggag

SEQ ID NO: 2182307 - DNA, 13 bp, Homo sapiens
caagtcttcctga

SEQ ID NO: 2182308 - DNA, 14 bp, Homo sapiens
caagtggacggcag

SEQ ID NO: 2182309 - DNA, 15 bp, Homo sapiens
caagtgtttcttgtt

SEQ ID NO: 2182310 - DNA, 20 bp, Homo sapiens
caagtttactcaaccctctc

SEQ ID NO: 2182311 - DNA, 16 bp, Homo sapiens
caagtttcagtaatag

SEQ ID NO: 2182312 - DNA, 21 bp, Homo sapiens
caagtttcagtaatagctgaa

SEQ ID NO: 2182313 - DNA, 21 bp, Homo sapiens
caatacattattggacttcca

SEQ ID NO: 2182314 - DNA, 19 bp, Homo sapiens
caatacggaacactgtcaa

SEQ ID NO: 2182315 - DNA, 23 bp, Homo sapiens
caatatggtgtcttgatatattt

SEQ ID NO: 2182316 - DNA, 15 bp, Homo sapiens
caatatttataatta

SEQ ID NO: 2182317 - DNA, 22 bp, Homo sapiens
caatatttataattaaagaaaa

SEQ ID NO: 2182318 - DNA, 12 bp, Homo sapiens
caatcaaagcta

SEQ ID NO: 2182319 - DNA, 15 bp, Homo sapiens
caatcaaagctacct

SEQ ID NO: 2182320 - DNA, 18 bp, Homo sapiens
caatcacttgaaagtgaa

SEQ ID NO: 2182321 - DNA, 13 bp, Homo sapiens
caatcctcaccta

SEQ ID NO: 2182322 - DNA, 14 bp, Homo sapiens
caatcgttctgtgt

SEQ ID NO: 2182323 - DNA, 15 bp, Homo sapiens
caatctctgttctgc

SEQ ID NO: 2182324 - DNA, 19 bp, Homo sapiens
caatgcagatgccagagca

SEQ ID NO: 2182325 - DNA, 16 bp, Homo sapiens
caatgtgcccagtcat

SEQ ID NO: 2182326 - DNA, 17 bp, Homo sapiens
caatgtgcccagtcatg

SEQ ID NO: 2182327 - DNA, 12 bp, Homo sapiens
caattattttgg

SEQ ID NO: 2182328 - DNA, 14 bp, Homo sapiens
caattcaatcaaag

SEQ ID NO: 2182329 - DNA, 16 bp, Homo sapiens
caattcaatcaaagct

SEQ ID NO: 2182330 - DNA, 14 bp, Homo sapiens
caatttctccccag

SEQ ID NO: 2182331 - DNA, 15 bp, Homo sapiens
caatttctccccagg

SEQ ID NO: 2182332 - DNA, 17 bp, Homo sapiens
caatttcttctgtagct

SEQ ID NO: 2182333 - DNA, 17 bp, Homo sapiens
caatttgggtcccagct

SEQ ID NO: 2182334 - DNA, 23 bp, Homo sapiens
caattttctaccactggtgtaaa

SEQ ID NO: 2182335 - DNA, 19 bp, Homo sapiens
cacaaaaagaaagctgtga

SEQ ID NO: 2182336 - DNA, 23 bp, Homo sapiens
cacaaaaagagaagctgtgtctt

SEQ ID NO: 2182337 - DNA, 12 bp, Homo sapiens
cacaaagctaaa

SEQ ID NO: 2182338 - DNA, 13 bp, Homo sapiens
cacaacaccagga

SEQ ID NO: 2182339 - DNA, 15 bp, Homo sapiens
cacaacaccaggact

SEQ ID NO: 2182340 - DNA, 14 bp, Homo sapiens
cacaagctgcctcc

SEQ ID NO: 2182341 - DNA, 15 bp, Homo sapiens
cacaagctgcctccc

SEQ ID NO: 2182342 - DNA, 17 bp, Homo sapiens
cacaagctgtccctgca

SEQ ID NO: 2182343 - DNA, 20 bp, Homo sapiens
cacaagctgtccctgcaggg

SEQ ID NO: 2182344 - DNA, 17 bp, Homo sapiens
cacacaacaccaggact

SEQ ID NO: 2182345 - DNA, 22 bp, Homo sapiens
cacacacggttttggcagctga

SEQ ID NO: 2182346 - DNA, 15 bp, Homo sapiens
cacacagactatttt

SEQ ID NO: 2182347 - DNA, 15 bp, Homo sapiens
cacacggcacagagc

SEQ ID NO: 2182348 - DNA, 20 bp, Homo sapiens
cacacgtgtgatgtatgttg

SEQ ID NO: 2182349 - DNA, 13 bp, Homo sapiens
cacactagccttc

SEQ ID NO: 2182350 - DNA, 23 bp, Homo sapiens
cacactcttcagtgactcctgct

SEQ ID NO: 2182351 - DNA, 17 bp, Homo sapiens
cacactgcaacaggaac

SEQ ID NO: 2182352 - DNA, 13 bp, Homo sapiens
cacactttctggg

SEQ ID NO: 2182353 - DNA, 14 bp, Homo sapiens
cacagacaagcagc

SEQ ID NO: 2182354 - DNA, 15 bp, Homo sapiens
cacagacaagcagcc

SEQ ID NO: 2182355 - DNA, 19 bp, Homo sapiens
cacagacaagcagcccttg

SEQ ID NO: 2182356 - DNA, 22 bp, Homo sapiens
cacagacaagcagcccttgctt

SEQ ID NO: 2182357 - DNA, 14 bp, Homo sapiens
cacagactattttt

SEQ ID NO: 2182358 - DNA, 17 bp, Homo sapiens
cacagacttcacacagc

SEQ ID NO: 2182359 - DNA, 21 bp, Homo sapiens
cacagacttcacacagcacct

SEQ ID NO: 2182360 - DNA, 17 bp, Homo sapiens
cacagaggcagtggcag

SEQ ID NO: 2182361 - DNA, 18 bp, Homo sapiens
cacagaggcagtggcagc

SEQ ID NO: 2182362 - DNA, 18 bp, Homo sapiens
cacagagggctgtgtctt

SEQ ID NO: 2182363 - DNA, 20 bp, Homo sapiens
cacagagtggagccctcagt

SEQ ID NO: 2182364 - DNA, 16 bp, Homo sapiens
cacagccagaaccccg

SEQ ID NO: 2182365 - DNA, 13 bp, Homo sapiens
cacagccatccca

SEQ ID NO: 2182366 - DNA, 16 bp, Homo sapiens
cacagccatcccagcc

SEQ ID NO: 2182367 - DNA, 19 bp, Homo sapiens
cacagccatcccagccttg

SEQ ID NO: 2182368 - DNA, 17 bp, Homo sapiens
cacagcccgcatgcagc

SEQ ID NO: 2182369 - DNA, 18 bp, Homo sapiens
cacagcccgcatgcagca

SEQ ID NO: 2182370 - DNA, 21 bp, Homo sapiens
cacagcctgtcttcagatcct

SEQ ID NO: 2182371 - DNA, 15 bp, Homo sapiens
cacagcgagaaaact

SEQ ID NO: 2182372 - DNA, 13 bp, Homo sapiens
cacagctcacggc

SEQ ID NO: 2182373 - DNA, 14 bp, Homo sapiens
cacagctcacggca

SEQ ID NO: 2182374 - DNA, 20 bp, Homo sapiens
cacagctcacggcagcctca

SEQ ID NO: 2182375 - DNA, 15 bp, Homo sapiens
cacagcttggggcca

SEQ ID NO: 2182376 - DNA, 23 bp, Homo sapiens
cacagcttttagtacccacctga

SEQ ID NO: 2182377 - DNA, 23 bp, Homo sapiens
cacaggacgatttcactgacact

SEQ ID NO: 2182378 - DNA, 20 bp, Homo sapiens
cacaggcaatgactgcgcag

SEQ ID NO: 2182379 - DNA, 13 bp, Homo sapiens
cacagggccctct

SEQ ID NO: 2182380 - DNA, 14 bp, Homo sapiens
cacaggtgtcccca

SEQ ID NO: 2182381 - DNA, 17 bp, Homo sapiens
cacagtctctccctggg

SEQ ID NO: 2182382 - DNA, 23 bp, Homo sapiens
cacataatttgcataaagggccc

SEQ ID NO: 2182383 - DNA, 21 bp, Homo sapiens
cacatccaacatttcctcagg

SEQ ID NO: 2182384 - DNA, 15 bp, Homo sapiens
cacatccaactcctg

SEQ ID NO: 2182385 - DNA, 19 bp, Homo sapiens
cacatgacatttgtcctgc

SEQ ID NO: 2182386 - DNA, 14 bp, Homo sapiens
cacatgctggacag

SEQ ID NO: 2182387 - DNA, 23 bp, Homo sapiens
cacatgctggacaggtctgggag

SEQ ID NO: 2182388 - DNA, 20 bp, Homo sapiens
caccaccccccactctgtgc

SEQ ID NO: 2182389 - DNA, 12 bp, Homo sapiens
caccaccctgcc

SEQ ID NO: 2182390 - DNA, 22 bp, Homo sapiens
caccaccctgccccccctaaga

SEQ ID NO: 2182391 - DNA, 14 bp, Homo sapiens
caccagcagcagaa

SEQ ID NO: 2182392 - DNA, 14 bp, Homo sapiens
caccaggggaggag

SEQ ID NO: 2182393 - DNA, 17 bp, Homo sapiens
caccaggggaggagcct

SEQ ID NO: 2182394 - DNA, 18 bp, Homo sapiens
caccaggggaggagcctg

SEQ ID NO: 2182395 - DNA, 21 bp, Homo sapiens
caccatgcagtgcccctagct

SEQ ID NO: 2182396 - DNA, 22 bp, Homo sapiens
caccatgcagtgcccctagctt

SEQ ID NO: 2182397 - DNA, 22 bp, Homo sapiens
caccattcaggaacctggacca

SEQ ID NO: 2182398 - DNA, 15 bp, Homo sapiens
cacccaggctggagt

SEQ ID NO: 2182399 - DNA, 21 bp, Homo sapiens
cacccccacaagctgtccctg

SEQ ID NO: 2182400 - DNA, 14 bp, Homo sapiens
cacccccacccctt

SEQ ID NO: 2182401 - DNA, 13 bp, Homo sapiens
cacccctccttcc

SEQ ID NO: 2182402 - DNA, 21 bp, Homo sapiens
caccccttggaggagagagac

SEQ ID NO: 2182403 - DNA, 16 bp, Homo sapiens
cacccgccttggcctc

SEQ ID NO: 2182404 - DNA, 18 bp, Homo sapiens
cacccgccttggcctccc

SEQ ID NO: 2182405 - DNA, 20 bp, Homo sapiens
cacccggctcgtgtatttat

SEQ ID NO: 2182406 - DNA, 22 bp, Homo sapiens
cacccgtcttcaatctctgttc

SEQ ID NO: 2182407 - DNA, 16 bp, Homo sapiens
cacccgttaatttaaa

SEQ ID NO: 2182408 - DNA, 14 bp, Homo sapiens
cacccgtttccaag

SEQ ID NO: 2182409 - DNA, 16 bp, Homo sapiens
caccctaactgagctg

SEQ ID NO: 2182410 - DNA, 12 bp, Homo sapiens
caccctcagctg

SEQ ID NO: 2182411 - DNA, 16 bp, Homo sapiens
caccctcctgtaccgt

SEQ ID NO: 2182412 - DNA, 17 bp, Homo sapiens
caccctctgcagggcag

SEQ ID NO: 2182413 - DNA, 21 bp, Homo sapiens
caccctgccccccctaagaga

SEQ ID NO: 2182414 - DNA, 18 bp, Homo sapiens
caccctgcttggggcctg

SEQ ID NO: 2182415 - DNA, 19 bp, Homo sapiens
caccctgcttggggcctgg

SEQ ID NO: 2182416 - DNA, 17 bp, Homo sapiens
caccggttgcttctggg

SEQ ID NO: 2182417 - DNA, 18 bp, Homo sapiens
caccggttgcttctggga

SEQ ID NO: 2182418 - DNA, 19 bp, Homo sapiens
caccggttgcttctgggaa

SEQ ID NO: 2182419 - DNA, 19 bp, Homo sapiens
caccgtaaagtgagcatgc

SEQ ID NO: 2182420 - DNA, 20 bp, Homo sapiens
cacctaagggctaaggcctc

SEQ ID NO: 2182421 - DNA, 12 bp, Homo sapiens
cacctcagagcc

SEQ ID NO: 2182422 - DNA, 13 bp, Homo sapiens
cacctcagagccc

SEQ ID NO: 2182423 - DNA, 16 bp, Homo sapiens
cacctcagagccccgc

SEQ ID NO: 2182424 - DNA, 10 bp, Homo sapiens
cacctgagct

SEQ ID NO: 2182425 - DNA, 20 bp, Homo sapiens
cacctgcacagggccctctg

SEQ ID NO: 2182426 - DNA, 14 bp, Homo sapiens
cacctgcagcgtct

SEQ ID NO: 2182427 - DNA, 20 bp, Homo sapiens
cacctgcatcagcctctggc

SEQ ID NO: 2182428 - DNA, 18 bp, Homo sapiens
cacctgccactaggctgg

SEQ ID NO: 2182429 - DNA, 16 bp, Homo sapiens
cacctgcgcagggccc

SEQ ID NO: 2182430 - DNA, 20 bp, Homo sapiens
cacctgcgcagggccctctg

SEQ ID NO: 2182431 - DNA, 16 bp, Homo sapiens
cacctgtgcagggccc

SEQ ID NO: 2182432 - DNA, 20 bp, Homo sapiens
caccttgcactattggactt

SEQ ID NO: 2182433 - DNA, 14 bp, Homo sapiens
cacctttagaatat

SEQ ID NO: 2182434 - DNA, 17 bp, Homo sapiens
cacctttagaatattaa

SEQ ID NO: 2182435 - DNA, 11 bp, Homo sapiens
cacctttccca

SEQ ID NO: 2182436 - DNA, 23 bp, Homo sapiens
cacgacttcttcggaggtggcag

SEQ ID NO: 2182437 - DNA, 20 bp, Homo sapiens
cacgctgccatttccctgaa

SEQ ID NO: 2182438 - DNA, 23 bp, Homo sapiens
cacgctgccatttccctgaacag

SEQ ID NO: 2182439 - DNA, 19 bp, Homo sapiens
cacgcttgacaggacagca

SEQ ID NO: 2182440 - DNA, 13 bp, Homo sapiens
cacggcacagagc

SEQ ID NO: 2182441 - DNA, 15 bp, Homo sapiens
cacggccactgcagt

SEQ ID NO: 2182442 - DNA, 18 bp, Homo sapiens
cacggttttggcagctga

SEQ ID NO: 2182443 - DNA, 16 bp, Homo sapiens
cacgtgtgatgtatgt

SEQ ID NO: 2182444 - DNA, 19 bp, Homo sapiens
cactagcctccctctcctc

SEQ ID NO: 2182445 - DNA, 21 bp, Homo sapiens
cactagccttcttttgtactt

SEQ ID NO: 2182446 - DNA, 14 bp, Homo sapiens
cactaggctgggtg

SEQ ID NO: 2182447 - DNA, 18 bp, Homo sapiens
cactaggctgggtgccca

SEQ ID NO: 2182448 - DNA, 21 bp, Homo sapiens
cactagtctgtgtgctgtggt

SEQ ID NO: 2182449 - DNA, 13 bp, Homo sapiens
cactatggtgcca

SEQ ID NO: 2182450 - DNA, 13 bp, Homo sapiens
cactcagaattat

SEQ ID NO: 2182451 - DNA, 20 bp, Homo sapiens
cactcatcactaaacagaga

SEQ ID NO: 2182452 - DNA, 17 bp, Homo sapiens
cactcctaggacatgtt

SEQ ID NO: 2182453 - DNA, 16 bp, Homo sapiens
cactctcccagaggct

SEQ ID NO: 2182454 - DNA, 21 bp, Homo sapiens
cactcttcagtgactcctgct

SEQ ID NO: 2182455 - DNA, 22 bp, Homo sapiens
cactcttcagtgactcctgctg

SEQ ID NO: 2182456 - DNA, 16 bp, Homo sapiens
cactgaagtgaataca

SEQ ID NO: 2182457 - DNA, 20 bp, Homo sapiens
cactgaagtgaatacatggt

SEQ ID NO: 2182458 - DNA, 17 bp, Homo sapiens
cactgcaaataaagcct

SEQ ID NO: 2182459 - DNA, 15 bp, Homo sapiens
cactgcaacaggaac

SEQ ID NO: 2182460 - DNA, 21 bp, Homo sapiens
cactgcaacctccacctccca

SEQ ID NO: 2182461 - DNA, 22 bp, Homo sapiens
cactgcagcctcgaactcctgg

SEQ ID NO: 2182462 - DNA, 18 bp, Homo sapiens
cactgcagtcacccctgt

SEQ ID NO: 2182463 - DNA, 16 bp, Homo sapiens
cactggcaggatcaca

SEQ ID NO: 2182464 - DNA, 18 bp, Homo sapiens
cactggcaggatcacagc

SEQ ID NO: 2182465 - DNA, 19 bp, Homo sapiens
cactggcaggatcacagct

SEQ ID NO: 2182466 - DNA, 16 bp, Homo sapiens
cactggggagtgctgg

SEQ ID NO: 2182467 - DNA, 20 bp, Homo sapiens
cactggtcatcagtattgtg

SEQ ID NO: 2182468 - DNA, 11 bp, Homo sapiens
cactgtacata

SEQ ID NO: 2182469 - DNA, 15 bp, Homo sapiens
cactgtttggatatg

SEQ ID NO: 2182470 - DNA, 13 bp, Homo sapiens
cacttaacctgct

SEQ ID NO: 2182471 - DNA, 14 bp, Homo sapiens
cacttaacctgctt

SEQ ID NO: 2182472 - DNA, 13 bp, Homo sapiens
cacttatttccat

SEQ ID NO: 2182473 - DNA, 13 bp, Homo sapiens
cacttatttctaa

SEQ ID NO: 2182474 - DNA, 15 bp, Homo sapiens
cacttatttctaaat

SEQ ID NO: 2182475 - DNA, 14 bp, Homo sapiens
cacttccccctctt

SEQ ID NO: 2182476 - DNA, 23 bp, Homo sapiens
cacttcgtgggatctgcccctcc

SEQ ID NO: 2182477 - DNA, 22 bp, Homo sapiens
cacttgtgtttgtatataaatg

SEQ ID NO: 2182478 - DNA, 23 bp, Homo sapiens
cacttgtgtttgtatataaatgg

SEQ ID NO: 2182479 - DNA, 23 bp, Homo sapiens
cactttgacacaaggtgtaacta

SEQ ID NO: 2182480 - DNA, 13 bp, Homo sapiens
cactttgctctga

SEQ ID NO: 2182481 - DNA, 19 bp, Homo sapiens
cactttggggaactcaaag

SEQ ID NO: 2182482 - DNA, 16 bp, Homo sapiens
cactttggtattcaat

SEQ ID NO: 2182483 - DNA, 13 bp, Homo sapiens
cactttgtattct

SEQ ID NO: 2182484 - DNA, 14 bp, Homo sapiens
cactttgtattctc

SEQ ID NO: 2182485 - DNA, 19 bp, Homo sapiens
cactttgtattctctgtcc

SEQ ID NO: 2182486 - DNA, 14 bp, Homo sapiens
cagaaaacaaatct

SEQ ID NO: 2182487 - DNA, 17 bp, Homo sapiens
cagaaaacaaatcttca

SEQ ID NO: 2182488 - DNA, 15 bp, Homo sapiens
cagaaagcagaggct

SEQ ID NO: 2182489 - DNA, 22 bp, Homo sapiens
cagaaagcagaggctggcctca

SEQ ID NO: 2182490 - DNA, 15 bp, Homo sapiens
cagaaatcccagttc

SEQ ID NO: 2182491 - DNA, 23 bp, Homo sapiens
cagaaatcccagttcatgttgct

SEQ ID NO: 2182492 - DNA, 16 bp, Homo sapiens
cagaaattgtatattg

SEQ ID NO: 2182493 - DNA, 19 bp, Homo sapiens
cagaaattgtatattgtaa

SEQ ID NO: 2182494 - DNA, 21 bp, Homo sapiens
cagaaattgtatattgtaatt

SEQ ID NO: 2182495 - DNA, 22 bp, Homo sapiens
cagaaattgtatattgtaattt

SEQ ID NO: 2182496 - DNA, 22 bp, Homo sapiens
cagaacagttaagcagccgcca

SEQ ID NO: 2182497 - DNA, 17 bp, Homo sapiens
cagaacattcagctctg

SEQ ID NO: 2182498 - DNA, 22 bp, Homo sapiens
cagaacattcagctctggagaa

SEQ ID NO: 2182499 - DNA, 18 bp, Homo sapiens
cagaacctggtggctgga

SEQ ID NO: 2182500 - DNA, 23 bp, Homo sapiens
cagaactgctaaatactgtacat

SEQ ID NO: 2182501 - DNA, 12 bp, Homo sapiens
cagaagagaatc

SEQ ID NO: 2182502 - DNA, 14 bp, Homo sapiens
cagaagatgtattc

SEQ ID NO: 2182503 - DNA, 20 bp, Homo sapiens
cagaagatgtattcagagcc

SEQ ID NO: 2182504 - DNA, 18 bp, Homo sapiens
cagaagttagtttgtata

SEQ ID NO: 2182505 - DNA, 15 bp, Homo sapiens
cagaataaagaacat

SEQ ID NO: 2182506 - DNA, 18 bp, Homo sapiens
cagaatcccttaacagtt

SEQ ID NO: 2182507 - DNA, 13 bp, Homo sapiens
cagaccagagctc

SEQ ID NO: 2182508 - DNA, 13 bp, Homo sapiens
cagacccctggga

SEQ ID NO: 2182509 - DNA, 17 bp, Homo sapiens
cagacccctgggagctt

SEQ ID NO: 2182510 - DNA, 13 bp, Homo sapiens
cagacctgggact

SEQ ID NO: 2182511 - DNA, 16 bp, Homo sapiens
cagacctgggacttta

SEQ ID NO: 2182512 - DNA, 19 bp, Homo sapiens
cagacggcccgccgtgcct

SEQ ID NO: 2182513 - DNA, 15 bp, Homo sapiens
cagactatttttaga

SEQ ID NO: 2182514 - DNA, 19 bp, Homo sapiens
cagactcatacagaaggtg

SEQ ID NO: 2182515 - DNA, 21 bp, Homo sapiens
cagactcatacagaaggtggg

SEQ ID NO: 2182516 - DNA, 15 bp, Homo sapiens
cagacttcacacagc

SEQ ID NO: 2182517 - DNA, 16 bp, Homo sapiens
cagagaaaagcttgga

SEQ ID NO: 2182518 - DNA, 20 bp, Homo sapiens
cagagactggggcctggact

SEQ ID NO: 2182519 - DNA, 15 bp, Homo sapiens
cagagcatccgtctc

SEQ ID NO: 2182520 - DNA, 20 bp, Homo sapiens
cagagccgttcctgggactg

SEQ ID NO: 2182521 - DNA, 16 bp, Homo sapiens
cagagctacttgggcc

SEQ ID NO: 2182522 - DNA, 15 bp, Homo sapiens
cagagctctggagcc

SEQ ID NO: 2182523 - DNA, 12 bp, Homo sapiens
cagagctgggtg

SEQ ID NO: 2182524 - DNA, 21 bp, Homo sapiens
cagaggcacagccggggcctg

SEQ ID NO: 2182525 - DNA, 18 bp, Homo sapiens
cagaggcagaaccctggt

SEQ ID NO: 2182526 - DNA, 23 bp, Homo sapiens
cagaggcctagtcagccacatgg

SEQ ID NO: 2182527 - DNA, 13 bp, Homo sapiens
cagaggctcctgg

SEQ ID NO: 2182528 - DNA, 14 bp, Homo sapiens
cagaggctcctgga

SEQ ID NO: 2182529 - DNA, 13 bp, Homo sapiens
cagaggggagagg

SEQ ID NO: 2182530 - DNA, 23 bp, Homo sapiens
cagaggtatcctctttttgctcc

SEQ ID NO: 2182531 - DNA, 19 bp, Homo sapiens
cagaggtgggaggcccctg

SEQ ID NO: 2182532 - DNA, 22 bp, Homo sapiens
cagaggtgggaggcccctggtg

SEQ ID NO: 2182533 - DNA, 20 bp, Homo sapiens
cagaggtggggaagagagcc

SEQ ID NO: 2182534 - DNA, 16 bp, Homo sapiens
cagagtatgagtgcaa

SEQ ID NO: 2182535 - DNA, 17 bp, Homo sapiens
cagagtatgagtgcaag

SEQ ID NO: 2182536 - DNA, 18 bp, Homo sapiens
cagagtatgagtgcaagc

SEQ ID NO: 2182537 - DNA, 15 bp, Homo sapiens
cagatacttcagctt

SEQ ID NO: 2182538 - DNA, 12 bp, Homo sapiens
cagatcctgctg

SEQ ID NO: 2182539 - DNA, 16 bp, Homo sapiens
cagatcctgctgccgc

SEQ ID NO: 2182540 - DNA, 19 bp, Homo sapiens
cagatctaccccttactta

SEQ ID NO: 2182541 - DNA, 14 bp, Homo sapiens
cagatctccaaagc

SEQ ID NO: 2182542 - DNA, 14 bp, Homo sapiens
cagatgccagagca

SEQ ID NO: 2182543 - DNA, 20 bp, Homo sapiens
cagatgcctcctctgtcctc

SEQ ID NO: 2182544 - DNA, 14 bp, Homo sapiens
cagatgccttctag

SEQ ID NO: 2182545 - DNA, 23 bp, Homo sapiens
cagatgttggtcttggtcatttg

SEQ ID NO: 2182546 - DNA, 13 bp, Homo sapiens
cagattctcttga

SEQ ID NO: 2182547 - DNA, 14 bp, Homo sapiens
cagattctcttgaa

SEQ ID NO: 2182548 - DNA, 22 bp, Homo sapiens
cagcaaatgcaaaaactctttg

SEQ ID NO: 2182549 - DNA, 18 bp, Homo sapiens
cagcaacctgtaagactg

SEQ ID NO: 2182550 - DNA, 19 bp, Homo sapiens
cagcagagccgttcctggg

SEQ ID NO: 2182551 - DNA, 14 bp, Homo sapiens
cagcagctccgcct

SEQ ID NO: 2182552 - DNA, 19 bp, Homo sapiens
cagcagctccgcctggcac

SEQ ID NO: 2182553 - DNA, 14 bp, Homo sapiens
cagcaggcccacct

SEQ ID NO: 2182554 - DNA, 20 bp, Homo sapiens
cagcagtgtttaaaaaatga

SEQ ID NO: 2182555 - DNA, 19 bp, Homo sapiens
cagcagttgattcttgtat

SEQ ID NO: 2182556 - DNA, 18 bp, Homo sapiens
cagcagtttcccagaata

SEQ ID NO: 2182557 - DNA, 20 bp, Homo sapiens
cagcagtttgagcttgctgg

SEQ ID NO: 2182558 - DNA, 17 bp, Homo sapiens
cagcatgactggacagc

SEQ ID NO: 2182559 - DNA, 17 bp, Homo sapiens
cagccacagacccctgg

SEQ ID NO: 2182560 - DNA, 15 bp, Homo sapiens
cagccacatgggaaa

SEQ ID NO: 2182561 - DNA, 19 bp, Homo sapiens
cagccaccctaactgagct

SEQ ID NO: 2182562 - DNA, 20 bp, Homo sapiens
cagccaccctaactgagctg

SEQ ID NO: 2182563 - DNA, 19 bp, Homo sapiens
cagccattggcctctgtct

SEQ ID NO: 2182564 - DNA, 15 bp, Homo sapiens
cagcccactggatca

SEQ ID NO: 2182565 - DNA, 20 bp, Homo sapiens
cagcccactggatcagaaag

SEQ ID NO: 2182566 - DNA, 17 bp, Homo sapiens
cagcccagctgctctgc

SEQ ID NO: 2182567 - DNA, 18 bp, Homo sapiens
cagcccagctgctctgcc

SEQ ID NO: 2182568 - DNA, 17 bp, Homo sapiens
cagcccatcttgcctcc

SEQ ID NO: 2182569 - DNA, 12 bp, Homo sapiens
cagccccagccc

SEQ ID NO: 2182570 - DNA, 15 bp, Homo sapiens
cagccccagcccagc

SEQ ID NO: 2182571 - DNA, 15 bp, Homo sapiens
cagcccgcatgcagc

SEQ ID NO: 2182572 - DNA, 21 bp, Homo sapiens
cagcccgcatgcagcagcttg

SEQ ID NO: 2182573 - DNA, 23 bp, Homo sapiens
cagcccgcatgcagcagcttgct

SEQ ID NO: 2182574 - DNA, 16 bp, Homo sapiens
cagccctaggctaccc

SEQ ID NO: 2182575 - DNA, 13 bp, Homo sapiens
cagccctgagcta

SEQ ID NO: 2182576 - DNA, 17 bp, Homo sapiens
cagccctgagctggcct

SEQ ID NO: 2182577 - DNA, 22 bp, Homo sapiens
cagccctgagctggcctcacct

SEQ ID NO: 2182578 - DNA, 23 bp, Homo sapiens
cagccctgagctggcctcacctg

SEQ ID NO: 2182579 - DNA, 13 bp, Homo sapiens
cagccgccacatc

SEQ ID NO: 2182580 - DNA, 23 bp, Homo sapiens
cagccgccacatccccgctggct

SEQ ID NO: 2182581 - DNA, 19 bp, Homo sapiens
cagccggatcttggagaca

SEQ ID NO: 2182582 - DNA, 17 bp, Homo sapiens
cagccggggaagacttg

SEQ ID NO: 2182583 - DNA, 18 bp, Homo sapiens
cagcctcaacctccctgg

SEQ ID NO: 2182584 - DNA, 21 bp, Homo sapiens
cagcctcaataagccttgtcg

SEQ ID NO: 2182585 - DNA, 12 bp, Homo sapiens
cagcctcctgag

SEQ ID NO: 2182586 - DNA, 14 bp, Homo sapiens
cagcctcctgagta

SEQ ID NO: 2182587 - DNA, 18 bp, Homo sapiens
cagcctcgaactcctggg

SEQ ID NO: 2182588 - DNA, 15 bp, Homo sapiens
cagcctctagggacc

SEQ ID NO: 2182589 - DNA, 13 bp, Homo sapiens
cagccttgaccac

SEQ ID NO: 2182590 - DNA, 15 bp, Homo sapiens
cagcgggtaaaaaga

SEQ ID NO: 2182591 - DNA, 19 bp, Homo sapiens
cagcggtggaaggagcctg

SEQ ID NO: 2182592 - DNA, 16 bp, Homo sapiens
cagcgtctgagcggcc

SEQ ID NO: 2182593 - DNA, 15 bp, Homo sapiens
cagctaaagaggtgg

SEQ ID NO: 2182594 - DNA, 12 bp, Homo sapiens
ccatgctgctat

SEQ ID NO: 2182595 - DNA, 20 bp, Homo sapiens
ccatggctaaggcaccagcc

SEQ ID NO: 2182596 - DNA, 21 bp, Homo sapiens
ccatgggaccaaacctagccc

SEQ ID NO: 2182597 - DNA, 14 bp, Homo sapiens
ccatggtgcctctg

SEQ ID NO: 2182598 - DNA, 17 bp, Homo sapiens
ccatgtagaagagggag

SEQ ID NO: 2182599 - DNA, 20 bp, Homo sapiens
ccatgtagaagagggagaag

SEQ ID NO: 2182600 - DNA, 15 bp, Homo sapiens
ccatgtagccaccca

SEQ ID NO: 2182601 - DNA, 15 bp, Homo sapiens
ccatgtgctgctgtg

SEQ ID NO: 2182602 - DNA, 15 bp, Homo sapiens
ccattaattaatgag

SEQ ID NO: 2182603 - DNA, 23 bp, Homo sapiens
ccattagaagatattagtcttgg

SEQ ID NO: 2182604 - DNA, 19 bp, Homo sapiens
ccattagcaacgcctgcct

SEQ ID NO: 2182605 - DNA, 21 bp, Homo sapiens
ccattcaggaacctggaccaa

SEQ ID NO: 2182606 - DNA, 19 bp, Homo sapiens
ccattgaccttaatttctt

SEQ ID NO: 2182607 - DNA, 13 bp, Homo sapiens
ccatttcttccca

SEQ ID NO: 2182608 - DNA, 15 bp, Homo sapiens
ccatttcttcccaag

SEQ ID NO: 2182609 - DNA, 17 bp, Homo sapiens
ccatttgccatgctgct

SEQ ID NO: 2182610 - DNA, 16 bp, Homo sapiens
ccatttggaatcatat

SEQ ID NO: 2182611 - DNA, 19 bp, Homo sapiens
ccattttacgttttagaaa

SEQ ID NO: 2182612 - DNA, 15 bp, Homo sapiens
cccaaagagctgcct

SEQ ID NO: 2182613 - DNA, 21 bp, Homo sapiens
cccaaaggaagctttctctgc

SEQ ID NO: 2182614 - DNA, 14 bp, Homo sapiens
cccaacaaacttta

SEQ ID NO: 2182615 - DNA, 22 bp, Homo sapiens
cccaacaggtgctgaactgtgc

SEQ ID NO: 2182616 - DNA, 12 bp, Homo sapiens
cccaacctcagc

SEQ ID NO: 2182617 - DNA, 13 bp, Homo sapiens
cccaacctcagca

SEQ ID NO: 2182618 - DNA, 15 bp, Homo sapiens
cccaacttaagttta

SEQ ID NO: 2182619 - DNA, 16 bp, Homo sapiens
cccaagaaggctgggg

SEQ ID NO: 2182620 - DNA, 11 bp, Homo sapiens
cccaagctgga

SEQ ID NO: 2182621 - DNA, 19 bp, Homo sapiens
cccaagctggagtgcagtg

SEQ ID NO: 2182622 - DNA, 22 bp, Homo sapiens
cccaagctggagtgcagtggtg

SEQ ID NO: 2182623 - DNA, 11 bp, Homo sapiens
cccaagctggc

SEQ ID NO: 2182624 - DNA, 23 bp, Homo sapiens
cccaaggcaaggggtgcctggga

SEQ ID NO: 2182625 - DNA, 21 bp, Homo sapiens
cccaagtccaggtcgggctca

SEQ ID NO: 2182626 - DNA, 11 bp, Homo sapiens
cccaatcactg

SEQ ID NO: 2182627 - DNA, 16 bp, Homo sapiens
cccacaagctgtccct

SEQ ID NO: 2182628 - DNA, 17 bp, Homo sapiens
cccacaagctgtccctg

SEQ ID NO: 2182629 - DNA, 22 bp, Homo sapiens
cccacaagctgtccctgcaggg

SEQ ID NO: 2182630 - DNA, 14 bp, Homo sapiens
cccacagcccgcat

SEQ ID NO: 2182631 - DNA, 13 bp, Homo sapiens
cccacagggcctg

SEQ ID NO: 2182632 - DNA, 16 bp, Homo sapiens
cccacagggcctgact

SEQ ID NO: 2182633 - DNA, 22 bp, Homo sapiens
cccacaggtgtccccagcccac

SEQ ID NO: 2182634 - DNA, 22 bp, Homo sapiens
cccaccccgggctctcctgccc

SEQ ID NO: 2182635 - DNA, 21 bp, Homo sapiens
cccacccgtcttcaatctctg

SEQ ID NO: 2182636 - DNA, 17 bp, Homo sapiens
cccaccggttgcttctg

SEQ ID NO: 2182637 - DNA, 23 bp, Homo sapiens
cccaccggttgcttctgggaagg

SEQ ID NO: 2182638 - DNA, 21 bp, Homo sapiens
cccacctcaaatgggtctggg

SEQ ID NO: 2182639 - DNA, 12 bp, Homo sapiens
cccacctgagct

SEQ ID NO: 2182640 - DNA, 13 bp, Homo sapiens
cccacctgagctt

SEQ ID NO: 2182641 - DNA, 13 bp, Homo sapiens
cccacctgcatca

SEQ ID NO: 2182642 - DNA, 19 bp, Homo sapiens
cccacctgcatcagcctct

SEQ ID NO: 2182643 - DNA, 21 bp, Homo sapiens
cccacctgccactaggctggg

SEQ ID NO: 2182644 - DNA, 23 bp, Homo sapiens
cccacctgccactaggctgggtg

SEQ ID NO: 2182645 - DNA, 12 bp, Homo sapiens
cccacctttggt

SEQ ID NO: 2182646 - DNA, 14 bp, Homo sapiens
cccacggccactgc

SEQ ID NO: 2182647 - DNA, 15 bp, Homo sapiens
cccacggccactgca

SEQ ID NO: 2182648 - DNA, 14 bp, Homo sapiens
cccactcacagaga

SEQ ID NO: 2182649 - DNA, 19 bp, Homo sapiens
cccactcctaggacatgtt

SEQ ID NO: 2182650 - DNA, 14 bp, Homo sapiens
cccagagctgggtg

SEQ ID NO: 2182651 - DNA, 18 bp, Homo sapiens
cccagagctgggtgagtg

SEQ ID NO: 2182652 - DNA, 18 bp, Homo sapiens
cccagaggcacagccggg

SEQ ID NO: 2182653 - DNA, 15 bp, Homo sapiens
cccagaggccctgga

SEQ ID NO: 2182654 - DNA, 23 bp, Homo sapiens
cccttttgtgggtttctctgtgc

SEQ ID NO: 2182655 - DNA, 18 bp, Homo sapiens
ccgagccccctgtccttc

SEQ ID NO: 2182656 - DNA, 17 bp, Homo sapiens
ccgagccctacttccag

SEQ ID NO: 2182657 - DNA, 13 bp, Homo sapiens
ccgaggacccagg

SEQ ID NO: 2182658 - DNA, 17 bp, Homo sapiens
ccgaggcaggggctggg

SEQ ID NO: 2182659 - DNA, 20 bp, Homo sapiens
ccgagtagttgggattacag

SEQ ID NO: 2182660 - DNA, 21 bp, Homo sapiens
ccgagtggatagatgccctgc

SEQ ID NO: 2182661 - DNA, 13 bp, Homo sapiens
ccgcacccggctc

SEQ ID NO: 2182662 - DNA, 18 bp, Homo sapiens
ccgcactagcctccctct

SEQ ID NO: 2182663 - DNA, 13 bp, Homo sapiens
ccgcccacctgca

SEQ ID NO: 2182664 - DNA, 12 bp, Homo sapiens
ccgccctctgcc

SEQ ID NO: 2182665 - DNA, 17 bp, Homo sapiens
ccgccctgatttgctgt

SEQ ID NO: 2182666 - DNA, 19 bp, Homo sapiens
ccgccctgatttgctgttt

SEQ ID NO: 2182667 - DNA, 15 bp, Homo sapiens
ccgccgtgcctgcat

SEQ ID NO: 2182668 - DNA, 13 bp, Homo sapiens
ccgcctgtccttg

SEQ ID NO: 2182669 - DNA, 16 bp, Homo sapiens
ccgccttggcctccca

SEQ ID NO: 2182670 - DNA, 15 bp, Homo sapiens
ccgcttccctaccca

SEQ ID NO: 2182671 - DNA, 20 bp, Homo sapiens
ccgcttccctacccacaggg

SEQ ID NO: 2182672 - DNA, 17 bp, Homo sapiens
ccgctttgaaagaagca

SEQ ID NO: 2182673 - DNA, 15 bp, Homo sapiens
ccggatcttggagac

SEQ ID NO: 2182674 - DNA, 20 bp, Homo sapiens
ccggattccggccctggctg

SEQ ID NO: 2182675 - DNA, 19 bp, Homo sapiens
ccggccggagaacatctgc

SEQ ID NO: 2182676 - DNA, 12 bp, Homo sapiens
ccggcctggacc

SEQ ID NO: 2182677 - DNA, 16 bp, Homo sapiens
ccggctcgtgtattta

SEQ ID NO: 2182678 - DNA, 18 bp, Homo sapiens
ccggctcgtgtatttatt

SEQ ID NO: 2182679 - DNA, 13 bp, Homo sapiens
ccggctggacttt

SEQ ID NO: 2182680 - DNA, 13 bp, Homo sapiens
ccgggctggagaa

SEQ ID NO: 2182681 - DNA, 16 bp, Homo sapiens
ccgggctggagaaaga

SEQ ID NO: 2182682 - DNA, 23 bp, Homo sapiens
ccgggctggagaaagagctgcct

SEQ ID NO: 2182683 - DNA, 17 bp, Homo sapiens
ccggggcctgcctagca

SEQ ID NO: 2182684 - DNA, 21 bp, Homo sapiens
ccgggggtgggggcctgctgt

SEQ ID NO: 2182685 - DNA, 18 bp, Homo sapiens
ccgggttggaggcctcac

SEQ ID NO: 2182686 - DNA, 19 bp, Homo sapiens
ccgggttggaggcctcacc

SEQ ID NO: 2182687 - DNA, 22 bp, Homo sapiens
ccgggttggaggcctcaccctg

SEQ ID NO: 2182688 - DNA, 24 bp, Homo sapiens
ccgggttggaggcctcaccctgct

SEQ ID NO: 2182689 - DNA, 21 bp, Homo sapiens
ccggtgcccacctaagggcta

SEQ ID NO: 2182690 - DNA, 18 bp, Homo sapiens
ccgtaaagtgagcatgct

SEQ ID NO: 2182691 - DNA, 14 bp, Homo sapiens
ccgtagagaatgtg

SEQ ID NO: 2182692 - DNA, 21 bp, Homo sapiens
ccgtcttcaatctctgttctg

SEQ ID NO: 2182693 - DNA, 21 bp, Homo sapiens
ccgtgtccccttgttctaatg

SEQ ID NO: 2182694 - DNA, 18 bp, Homo sapiens
cctaaggggagctacagc

SEQ ID NO: 2182695 - DNA, 17 bp, Homo sapiens
cctaagttacctttcta

SEQ ID NO: 2182696 - DNA, 15 bp, Homo sapiens
cctacaccaactgct

SEQ ID NO: 2182697 - DNA, 15 bp, Homo sapiens
cctacagggggtgga

SEQ ID NO: 2182698 - DNA, 14 bp, Homo sapiens
cctacccacagggc

SEQ ID NO: 2182699 - DNA, 21 bp, Homo sapiens
cctacccccttgtctgctgct

SEQ ID NO: 2182700 - DNA, 19 bp, Homo sapiens
cctactgaggagcaaagca

SEQ ID NO: 2182701 - DNA, 12 bp, Homo sapiens
cctacttctcca

SEQ ID NO: 2182702 - DNA, 19 bp, Homo sapiens
cctacttctccagcctaga

SEQ ID NO: 2182703 - DNA, 19 bp, Homo sapiens
cctacttgtaaacttgaaa

SEQ ID NO: 2182704 - DNA, 15 bp, Homo sapiens
cctagcttagagcct

SEQ ID NO: 2182705 - DNA, 20 bp, Homo sapiens
cctaggcgcggttcaggtca

SEQ ID NO: 2182706 - DNA, 19 bp, Homo sapiens
cctagggttttctatttct

SEQ ID NO: 2182707 - DNA, 13 bp, Homo sapiens
cctataatgctgg

SEQ ID NO: 2182708 - DNA, 15 bp, Homo sapiens
cctatcatcagttag

SEQ ID NO: 2182709 - DNA, 18 bp, Homo sapiens
cctatgccacctgcagcg

SEQ ID NO: 2182710 - DNA, 16 bp, Homo sapiens
cctatgttgcccaggc

SEQ ID NO: 2182711 - DNA, 19 bp, Homo sapiens
cctattaaaagttgcaaag

SEQ ID NO: 2182712 - DNA, 19 bp, Homo sapiens
cctcaaatgggtctggggg

SEQ ID NO: 2182713 - DNA, 22 bp, Homo sapiens
cctcaacctccctggctcaagc

SEQ ID NO: 2182714 - DNA, 16 bp, Homo sapiens
cctcaataagccttgt

SEQ ID NO: 2182715 - DNA, 20 bp, Homo sapiens
cctcaattccccctggccac

SEQ ID NO: 2182716 - DNA, 18 bp, Homo sapiens
cctcacccaaaagaatta

SEQ ID NO: 2182717 - DNA, 13 bp, Homo sapiens
cctcaccctgctt

SEQ ID NO: 2182718 - DNA, 16 bp, Homo sapiens
cctcacctaacagtta

SEQ ID NO: 2182719 - DNA, 21 bp, Homo sapiens
cctcacctttcccacagtctc

SEQ ID NO: 2182720 - DNA, 21 bp, Homo sapiens
cctcagctggcggaacctggc

SEQ ID NO: 2182721 - DNA, 22 bp, Homo sapiens
cctcagctggcggaacctggct

SEQ ID NO: 2182722 - DNA, 17 bp, Homo sapiens
cctcagcttcaaataaa

SEQ ID NO: 2182723 - DNA, 15 bp, Homo sapiens
cctcaggctctgcac

SEQ ID NO: 2182724 - DNA, 19 bp, Homo sapiens
cctcaggctctgcacagac

SEQ ID NO: 2182725 - DNA, 13 bp, Homo sapiens
cctcagtttctgt

SEQ ID NO: 2182726 - DNA, 22 bp, Homo sapiens
cctcattactttaccaccccca

SEQ ID NO: 2182727 - DNA, 14 bp, Homo sapiens
cctcattcttctct

SEQ ID NO: 2182728 - DNA, 16 bp, Homo sapiens
cctccagttctgatga

SEQ ID NO: 2182729 - DNA, 17 bp, Homo sapiens
cctccatgtagaagagg

SEQ ID NO: 2182730 - DNA, 15 bp, Homo sapiens
cctcccctcagcctc

SEQ ID NO: 2182731 - DNA, 13 bp, Homo sapiens
cctccctcctgcc

SEQ ID NO: 2182732 - DNA, 14 bp, Homo sapiens
cctccctcctgcct

SEQ ID NO: 2182733 - DNA, 15 bp, Homo sapiens
cctccctctcctctg

SEQ ID NO: 2182734 - DNA, 17 bp, Homo sapiens
cctccctgaccctgcag

SEQ ID NO: 2182735 - DNA, 12 bp, Homo sapiens
cctccctgctca

SEQ ID NO: 2182736 - DNA, 16 bp, Homo sapiens
cctccctgctcagctg

SEQ ID NO: 2182737 - DNA, 17 bp, Homo sapiens
cctccctttttccttgt

SEQ ID NO: 2182738 - DNA, 19 bp, Homo sapiens
cctccggggctcagccctg

SEQ ID NO: 2182739 - DNA, 12 bp, Homo sapiens
cctcctcccctg

SEQ ID NO: 2182740 - DNA, 15 bp, Homo sapiens
cctcctccctttttc

SEQ ID NO: 2182741 - DNA, 13 bp, Homo sapiens
cctcctctctgct

SEQ ID NO: 2182742 - DNA, 14 bp, Homo sapiens
cctcctctctgctg

SEQ ID NO: 2182743 - DNA, 15 bp, Homo sapiens
cctcctgagtagctg

SEQ ID NO: 2182744 - DNA, 15 bp, Homo sapiens
cctccttagaaaaga

SEQ ID NO: 2182745 - DNA, 17 bp, Homo sapiens
cctccttctctgtctca

SEQ ID NO: 2182746 - DNA, 22 bp, Homo sapiens
cctccttctctgtctcatgtgt

SEQ ID NO: 2182747 - DNA, 23 bp, Homo sapiens
cctccttctctgtctcatgtgtg

SEQ ID NO: 2182748 - DNA, 15 bp, Homo sapiens
cctcgaactcctggg

SEQ ID NO: 2182749 - DNA, 14 bp, Homo sapiens
cctcgctcccttca

SEQ ID NO: 2182750 - DNA, 21 bp, Homo sapiens
cctcgttaacacatggcttcc

SEQ ID NO: 2182751 - DNA, 15 bp, Homo sapiens
cctctaatgctcacg

SEQ ID NO: 2182752 - DNA, 22 bp, Homo sapiens
cctctaatgctcacgctcccaa

SEQ ID NO: 2182753 - DNA, 12 bp, Homo sapiens
cctctagggacc

SEQ ID NO: 2182754 - DNA, 18 bp, Homo sapiens
cctctagggacccctcct

SEQ ID NO: 2182755 - DNA, 13 bp, Homo sapiens
cctctatttatta

SEQ ID NO: 2182756 - DNA, 21 bp, Homo sapiens
cctctatttattagccaactg

SEQ ID NO: 2182757 - DNA, 21 bp, Homo sapiens
cctctcagagctacttgggcc

SEQ ID NO: 2182758 - DNA, 22 bp, Homo sapiens
cctctcagagctacttgggcca

SEQ ID NO: 2182759 - DNA, 23 bp, Homo sapiens
cctctcccctaccactgtcttct

SEQ ID NO: 2182760 - DNA, 16 bp, Homo sapiens
cctctctcagttattc

SEQ ID NO: 2182761 - DNA, 14 bp, Homo sapiens
cctctgaggctcag

SEQ ID NO: 2182762 - DNA, 17 bp, Homo sapiens
cctctgaggctcagccc

SEQ ID NO: 2182763 - DNA, 19 bp, Homo sapiens
cctctgaggctcagccctg

SEQ ID NO: 2182764 - DNA, 21 bp, Homo sapiens
cctctgaggctcagccctgag

SEQ ID NO: 2182765 - DNA, 22 bp, Homo sapiens
cctctgaggctcagccctgagc

SEQ ID NO: 2182766 - DNA, 23 bp, Homo sapiens
cctctgaggctcagccctgagct

SEQ ID NO: 2182767 - DNA, 14 bp, Homo sapiens
cctctgatttcaca

SEQ ID NO: 2182768 - DNA, 11 bp, Homo sapiens
cctctgctcca

SEQ ID NO: 2182769 - DNA, 19 bp, Homo sapiens
cctctgctggccgggcaca

SEQ ID NO: 2182770 - DNA, 22 bp, Homo sapiens
cctctgctggccgggcacagct

SEQ ID NO: 2182771 - DNA, 23 bp, Homo sapiens
cctctgctggccgggcacagctg

SEQ ID NO: 2182772 - DNA, 15 bp, Homo sapiens
cctctggaggcctct

SEQ ID NO: 2182773 - DNA, 18 bp, Homo sapiens
cctctggaggcctctggg

SEQ ID NO: 2182774 - DNA, 19 bp, Homo sapiens
cctctggaggcctctgggc

SEQ ID NO: 2182775 - DNA, 12 bp, Homo sapiens
cctctggccaga

SEQ ID NO: 2182776 - DNA, 17 bp, Homo sapiens
cagtgcctttccccatt

SEQ ID NO: 2182777 - DNA, 20 bp, Homo sapiens
cagtgcttttaagtgaaaat

SEQ ID NO: 2182778 - DNA, 14 bp, Homo sapiens
cagtggcaggggag

SEQ ID NO: 2182779 - DNA, 13 bp, Homo sapiens
cagtggcctggct

SEQ ID NO: 2182780 - DNA, 16 bp, Homo sapiens
cagtgggagactaaga

SEQ ID NO: 2182781 - DNA, 14 bp, Homo sapiens
cagtggggctgggg

SEQ ID NO: 2182782 - DNA, 21 bp, Homo sapiens
cagtggtgcgatcatggctca

SEQ ID NO: 2182783 - DNA, 14 bp, Homo sapiens
cagtggttgcctgg

SEQ ID NO: 2182784 - DNA, 21 bp, Homo sapiens
cagtgtagccccaagaaggct

SEQ ID NO: 2182785 - DNA, 22 bp, Homo sapiens
cagtgtagccccaagaaggctg

SEQ ID NO: 2182786 - DNA, 11 bp, Homo sapiens
cagtgtgaagc

SEQ ID NO: 2182787 - DNA, 16 bp, Homo sapiens
cagtgtgaagcctgtc

SEQ ID NO: 2182788 - DNA, 11 bp, Homo sapiens
cagtgtgccac

SEQ ID NO: 2182789 - DNA, 14 bp, Homo sapiens
cagtgtgtctcctg

SEQ ID NO: 2182790 - DNA, 17 bp, Homo sapiens
cagtgtgtctcctgcat

SEQ ID NO: 2182791 - DNA, 20 bp, Homo sapiens
cagttacagggcccaggtga

SEQ ID NO: 2182792 - DNA, 15 bp, Homo sapiens
cagttactgttcatg

SEQ ID NO: 2182793 - DNA, 16 bp, Homo sapiens
cagttacttacctgca

SEQ ID NO: 2182794 - DNA, 17 bp, Homo sapiens
cagttagagatgcctcc

SEQ ID NO: 2182795 - DNA, 16 bp, Homo sapiens
cagttattcagattga

SEQ ID NO: 2182796 - DNA, 19 bp, Homo sapiens
cagttattcagattgacaa

SEQ ID NO: 2182797 - DNA, 14 bp, Homo sapiens
cagttcaataacaa

SEQ ID NO: 2182798 - DNA, 19 bp, Homo sapiens
cagttcatgttgctcagaa

SEQ ID NO: 2182799 - DNA, 20 bp, Homo sapiens
cagttcatgttgctcagaag

SEQ ID NO: 2182800 - DNA, 14 bp, Homo sapiens
cagttctctttgta

SEQ ID NO: 2182801 - DNA, 20 bp, Homo sapiens
cagttctgcactttgacaca

SEQ ID NO: 2182802 - DNA, 15 bp, Homo sapiens
cagttgactggcttt

SEQ ID NO: 2182803 - DNA, 15 bp, Homo sapiens
cagttgctaaatttg

SEQ ID NO: 2182804 - DNA, 18 bp, Homo sapiens
cagttgtatttaacagaa

SEQ ID NO: 2182805 - DNA, 17 bp, Homo sapiens
cagtttctgttgtttct

SEQ ID NO: 2182806 - DNA, 19 bp, Homo sapiens
cagtttggctgtaatttaa

SEQ ID NO: 2182807 - DNA, 18 bp, Homo sapiens
cagttttgtgtacagtat

SEQ ID NO: 2182808 - DNA, 19 bp, Homo sapiens
cagttttgtgtacagtatg

SEQ ID NO: 2182809 - DNA, 22 bp, Homo sapiens
cagttttgtgtacagtatgtgt

SEQ ID NO: 2182810 - DNA, 21 bp, Homo sapiens
cataaaacaaaaccaagcctt

SEQ ID NO: 2182811 - DNA, 19 bp, Homo sapiens
cataaacagcatggaaaag

SEQ ID NO: 2182812 - DNA, 21 bp, Homo sapiens
cataacataagctagaaaaat

SEQ ID NO: 2182813 - DNA, 19 bp, Homo sapiens
cataagctagaaaaattag

SEQ ID NO: 2182814 - DNA, 17 bp, Homo sapiens
catacagagtgggcccc

SEQ ID NO: 2182815 - DNA, 20 bp, Homo sapiens
cataccttgagaccaagccg

SEQ ID NO: 2182816 - DNA, 18 bp, Homo sapiens
catagatgtatcattaat

SEQ ID NO: 2182817 - DNA, 21 bp, Homo sapiens
catagatgtatcattaatgta

SEQ ID NO: 2182818 - DNA, 17 bp, Homo sapiens
catagcaggaaatgtag

SEQ ID NO: 2182819 - DNA, 20 bp, Homo sapiens
catagctcctgctccacagc

SEQ ID NO: 2182820 - DNA, 22 bp, Homo sapiens
cataggattaagttcgaggtgg

SEQ ID NO: 2182821 - DNA, 20 bp, Homo sapiens
catatccatgttgctgactt

SEQ ID NO: 2182822 - DNA, 16 bp, Homo sapiens
catatgatcaaatact

SEQ ID NO: 2182823 - DNA, 17 bp, Homo sapiens
catattaaaatcacaaa

SEQ ID NO: 2182824 - DNA, 20 bp, Homo sapiens
catattgataataaaattca

SEQ ID NO: 2182825 - DNA, 18 bp, Homo sapiens
catatttcagtgattttt

SEQ ID NO: 2182826 - DNA, 19 bp, Homo sapiens
catcaaacctactataaaa

SEQ ID NO: 2182827 - DNA, 13 bp, Homo sapiens
catcactcccctc

SEQ ID NO: 2182828 - DNA, 13 bp, Homo sapiens
catcactcggctg

SEQ ID NO: 2182829 - DNA, 14 bp, Homo sapiens
catcagcagtgatt

SEQ ID NO: 2182830 - DNA, 15 bp, Homo sapiens
catcagcctctggcc

SEQ ID NO: 2182831 - DNA, 17 bp, Homo sapiens
catcagcctctggccag

SEQ ID NO: 2182832 - DNA, 18 bp, Homo sapiens
catcagcctctggccaga

SEQ ID NO: 2182833 - DNA, 16 bp, Homo sapiens
catcagtattgtgtaa

SEQ ID NO: 2182834 - DNA, 22 bp, Homo sapiens
catccaactcctggagatttca

SEQ ID NO: 2182835 - DNA, 15 bp, Homo sapiens
catccaactgagaaa

SEQ ID NO: 2182836 - DNA, 13 bp, Homo sapiens
catccacaggatt

SEQ ID NO: 2182837 - DNA, 15 bp, Homo sapiens
catccacaggattcc

SEQ ID NO: 2182838 - DNA, 15 bp, Homo sapiens
catccaccagtgtgt

SEQ ID NO: 2182839 - DNA, 17 bp, Homo sapiens
catccagccgtgctgag

SEQ ID NO: 2182840 - DNA, 17 bp, Homo sapiens
catccaggatggctgca

SEQ ID NO: 2182841 - DNA, 14 bp, Homo sapiens
catcccaacagcca

SEQ ID NO: 2182842 - DNA, 15 bp, Homo sapiens
catccccctccttgc

SEQ ID NO: 2182843 - DNA, 16 bp, Homo sapiens
catccccgctggctgg

SEQ ID NO: 2182844 - DNA, 20 bp, Homo sapiens
catcccgtgcaaaacatgct

SEQ ID NO: 2182845 - DNA, 21 bp, Homo sapiens
catcccgtgcaaaacatgcta

SEQ ID NO: 2182846 - DNA, 12 bp, Homo sapiens
catccctgccaa

SEQ ID NO: 2182847 - DNA, 15 bp, Homo sapiens
catccgtctcccctc

SEQ ID NO: 2182848 - DNA, 16 bp, Homo sapiens
catcctgtacaagtgc

SEQ ID NO: 2182849 - DNA, 13 bp, Homo sapiens
catcgttctaaaa

SEQ ID NO: 2182850 - DNA, 12 bp, Homo sapiens
catctaattcaa

SEQ ID NO: 2182851 - DNA, 17 bp, Homo sapiens
catctcactttaataat

SEQ ID NO: 2182852 - DNA, 23 bp, Homo sapiens
catctccctcgaacccacactgc

SEQ ID NO: 2182853 - DNA, 16 bp, Homo sapiens
catctgactgccaagc

SEQ ID NO: 2182854 - DNA, 21 bp, Homo sapiens
ccaaggcctatgccacctgca

SEQ ID NO: 2182855 - DNA, 23 bp, Homo sapiens
ccaaggcctatgccacctgcagc

SEQ ID NO: 2182856 - DNA, 13 bp, Homo sapiens
ccaagggccctgg

SEQ ID NO: 2182857 - DNA, 21 bp, Homo sapiens
ccaagggccctggcaccccca

SEQ ID NO: 2182858 - DNA, 18 bp, Homo sapiens
ccaagggccgactaagag

SEQ ID NO: 2182859 - DNA, 16 bp, Homo sapiens
ccaaggtcaggaggcc

SEQ ID NO: 2182860 - DNA, 15 bp, Homo sapiens
ccaaggtgccaccac

SEQ ID NO: 2182861 - DNA, 22 bp, Homo sapiens
ccaagtaacaatgcatgctttg

SEQ ID NO: 2182862 - DNA, 22 bp, Homo sapiens
ccaagtccaggtcgggctcagc

SEQ ID NO: 2182863 - DNA, 16 bp, Homo sapiens
ccaagtctcaggagga

SEQ ID NO: 2182864 - DNA, 15 bp, Homo sapiens
ccaagtgtttcttgt

SEQ ID NO: 2182865 - DNA, 17 bp, Homo sapiens
ccaagtttactcaaccc

SEQ ID NO: 2182866 - DNA, 14 bp, Homo sapiens
ccaatatttataat

SEQ ID NO: 2182867 - DNA, 12 bp, Homo sapiens
ccaatgtgaaga

SEQ ID NO: 2182868 - DNA, 14 bp, Homo sapiens
ccaattcatttcat

SEQ ID NO: 2182869 - DNA, 12 bp, Homo sapiens
ccacaagagaga

SEQ ID NO: 2182870 - DNA, 18 bp, Homo sapiens
ccacaagctgtccctgca

SEQ ID NO: 2182871 - DNA, 19 bp, Homo sapiens
ccacaagctgtccctgcag

SEQ ID NO: 2182872 - DNA, 21 bp, Homo sapiens
ccacaagctgtccctgcaggg

SEQ ID NO: 2182873 - DNA, 13 bp, Homo sapiens
ccacaagtgtcta

SEQ ID NO: 2182874 - DNA, 13 bp, Homo sapiens
ccacacagcctgt

SEQ ID NO: 2182875 - DNA, 15 bp, Homo sapiens
ccacacagcctgtct

SEQ ID NO: 2182876 - DNA, 16 bp, Homo sapiens
ccacacccagcctctg

SEQ ID NO: 2182877 - DNA, 20 bp, Homo sapiens
ccacacccccaccccttgct

SEQ ID NO: 2182878 - DNA, 17 bp, Homo sapiens
ccacagacccctgggag

SEQ ID NO: 2182879 - DNA, 23 bp, Homo sapiens
ccacagccagaaccccgagccct

SEQ ID NO: 2182880 - DNA, 13 bp, Homo sapiens
ccacaggaagccg

SEQ ID NO: 2182881 - DNA, 22 bp, Homo sapiens
ccacaggaataatagttcagga

SEQ ID NO: 2182882 - DNA, 21 bp, Homo sapiens
ccacagggcctgacttttaca

SEQ ID NO: 2182883 - DNA, 22 bp, Homo sapiens
ccacagggcctgacttttacag

SEQ ID NO: 2182884 - DNA, 15 bp, Homo sapiens
ccacaggtgtcccca

SEQ ID NO: 2182885 - DNA, 16 bp, Homo sapiens
ccacaggtgtccccag

SEQ ID NO: 2182886 - DNA, 18 bp, Homo sapiens
ccacagtctctccctggg

SEQ ID NO: 2182887 - DNA, 15 bp, Homo sapiens
ccaccaacaaatata

SEQ ID NO: 2182888 - DNA, 19 bp, Homo sapiens
ccaccaacataaaacaaaa

SEQ ID NO: 2182889 - DNA, 14 bp, Homo sapiens
ccaccaagggcctc

SEQ ID NO: 2182890 - DNA, 13 bp, Homo sapiens
ccaccacaaaaag

SEQ ID NO: 2182891 - DNA, 16 bp, Homo sapiens
ccaccaccattctcct

SEQ ID NO: 2182892 - DNA, 14 bp, Homo sapiens
ccaccaccctgccc

SEQ ID NO: 2182893 - DNA, 23 bp, Homo sapiens
ccaccatggctaaggcaccagcc

SEQ ID NO: 2182894 - DNA, 15 bp, Homo sapiens
ccaccatttcttctg

SEQ ID NO: 2182895 - DNA, 15 bp, Homo sapiens
ccacccacttccctg

SEQ ID NO: 2182896 - DNA, 15 bp, Homo sapiens
ccacccctccccact

SEQ ID NO: 2182897 - DNA, 20 bp, Homo sapiens
ccaccccttgctctcaaccc

SEQ ID NO: 2182898 - DNA, 19 bp, Homo sapiens
ccaccccttggaggagaga

SEQ ID NO: 2182899 - DNA, 22 bp, Homo sapiens
ccaccccttggaggagagagac

SEQ ID NO: 2182900 - DNA, 23 bp, Homo sapiens
ccacccgtttccaagcctgggcc

SEQ ID NO: 2182901 - DNA, 11 bp, Homo sapiens
ccaccctctgc

SEQ ID NO: 2182902 - DNA, 19 bp, Homo sapiens
ccaccctctgcagggcagc

SEQ ID NO: 2182903 - DNA, 21 bp, Homo sapiens
ccaccctctgcagggcagcct

SEQ ID NO: 2182904 - DNA, 15 bp, Homo sapiens
ccaccctgagccggc

SEQ ID NO: 2182905 - DNA, 21 bp, Homo sapiens
ccaccctgagccggccccagg

SEQ ID NO: 2182906 - DNA, 17 bp, Homo sapiens
ccaccggttgcttctgg

SEQ ID NO: 2182907 - DNA, 21 bp, Homo sapiens
ctcctgattgctctggaagcc

SEQ ID NO: 2182908 - DNA, 14 bp, Homo sapiens
ctcctgccgggcag

SEQ ID NO: 2182909 - DNA, 15 bp, Homo sapiens
ctcctgcctcagcct

SEQ ID NO: 2182910 - DNA, 13 bp, Homo sapiens
ctcctggagccag

SEQ ID NO: 2182911 - DNA, 15 bp, Homo sapiens
ctcctgggctcaagc

SEQ ID NO: 2182912 - DNA, 22 bp, Homo sapiens
ctcctgtccaaagtagggatgc

SEQ ID NO: 2182913 - DNA, 17 bp, Homo sapiens
ctcctgtcttggcctcc

SEQ ID NO: 2182914 - DNA, 18 bp, Homo sapiens
ctccttccaactgctgcc

SEQ ID NO: 2182915 - DNA, 20 bp, Homo sapiens
ctccttccctggtccagatt

SEQ ID NO: 2182916 - DNA, 10 bp, Homo sapiens
ctccttcctc

SEQ ID NO: 2182917 - DNA, 20 bp, Homo sapiens
ctccttcgctttcctgagcc

SEQ ID NO: 2182918 - DNA, 17 bp, Homo sapiens
ctccttgccgctgggag

SEQ ID NO: 2182919 - DNA, 19 bp, Homo sapiens
ctccttgccgctgggagag

SEQ ID NO: 2182920 - DNA, 15 bp, Homo sapiens
ctcctttaattgtaa

SEQ ID NO: 2182921 - DNA, 17 bp, Homo sapiens
ctccttttatgctcacc

SEQ ID NO: 2182922 - DNA, 20 bp, Homo sapiens
ctccttttatgctcacctga

SEQ ID NO: 2182923 - DNA, 16 bp, Homo sapiens
ctccttttccttacca

SEQ ID NO: 2182924 - DNA, 14 bp, Homo sapiens
ctcgcttctctgtg

SEQ ID NO: 2182925 - DNA, 17 bp, Homo sapiens
ctcggctgtggagaaca

SEQ ID NO: 2182926 - DNA, 22 bp, Homo sapiens
ctcggctttggctcgggacttc

SEQ ID NO: 2182927 - DNA, 20 bp, Homo sapiens
ctcgtgaggggcaagctagg

SEQ ID NO: 2182928 - DNA, 15 bp, Homo sapiens
ctcgtgggctctggc

SEQ ID NO: 2182929 - DNA, 14 bp, Homo sapiens
ctctaagcacacgg

SEQ ID NO: 2182930 - DNA, 12 bp, Homo sapiens
ctctacccagcc

SEQ ID NO: 2182931 - DNA, 14 bp, Homo sapiens
ctctacccagccca

SEQ ID NO: 2182932 - DNA, 19 bp, Homo sapiens
ctctagggaaggccacctg

SEQ ID NO: 2182933 - DNA, 20 bp, Homo sapiens
ctctagggaaggccacctgc

SEQ ID NO: 2182934 - DNA, 18 bp, Homo sapiens
ctctagggacccctcctc

SEQ ID NO: 2182935 - DNA, 20 bp, Homo sapiens
ctctatgggtatcaaacagc

SEQ ID NO: 2182936 - DNA, 20 bp, Homo sapiens
ctctatttattagccaactg

SEQ ID NO: 2182937 - DNA, 20 bp, Homo sapiens
ctctccagtgtgtgtaacag

SEQ ID NO: 2182938 - DNA, 14 bp, Homo sapiens
ctctcccagaggct

SEQ ID NO: 2182939 - DNA, 17 bp, Homo sapiens
ctctcctctgtccccat

SEQ ID NO: 2182940 - DNA, 18 bp, Homo sapiens
ctctcctgcctcagcctc

SEQ ID NO: 2182941 - DNA, 17 bp, Homo sapiens
ctctctacccagcccat

SEQ ID NO: 2182942 - DNA, 17 bp, Homo sapiens
ctctctgaacacacatt

SEQ ID NO: 2182943 - DNA, 18 bp, Homo sapiens
ctctcttgctttgttctt

SEQ ID NO: 2182944 - DNA, 16 bp, Homo sapiens
ctctgaaagctgcttc

SEQ ID NO: 2182945 - DNA, 17 bp, Homo sapiens
ctctgaaagctgcttct

SEQ ID NO: 2182946 - DNA, 18 bp, Homo sapiens
ctctgaaagctgcttctg

SEQ ID NO: 2182947 - DNA, 19 bp, Homo sapiens
ctctgaacttcagctagag

SEQ ID NO: 2182948 - DNA, 15 bp, Homo sapiens
ctctgagccactgga

SEQ ID NO: 2182949 - DNA, 22 bp, Homo sapiens
ctctgcacagacaagcagccct

SEQ ID NO: 2182950 - DNA, 16 bp, Homo sapiens
ctctgcactatagcca

SEQ ID NO: 2182951 - DNA, 16 bp, Homo sapiens
ctctgcagggcagcct

SEQ ID NO: 2182952 - DNA, 19 bp, Homo sapiens
ctctgcagggcagcctgtg

SEQ ID NO: 2182953 - DNA, 17 bp, Homo sapiens
ctctgcccccagctgct

SEQ ID NO: 2182954 - DNA, 15 bp, Homo sapiens
ctctgctgggtttcc

SEQ ID NO: 2182955 - DNA, 12 bp, Homo sapiens
ctctggaaaaat

SEQ ID NO: 2182956 - DNA, 15 bp, Homo sapiens
ctctggaagcctgct

SEQ ID NO: 2182957 - DNA, 17 bp, Homo sapiens
ctctggaagcctgctga

SEQ ID NO: 2182958 - DNA, 17 bp, Homo sapiens
ctctggagaacagtggt

SEQ ID NO: 2182959 - DNA, 16 bp, Homo sapiens
ctctggagccacctgt

SEQ ID NO: 2182960 - DNA, 15 bp, Homo sapiens
ctctggaggcctctg

SEQ ID NO: 2182961 - DNA, 16 bp, Homo sapiens
ctctggccagacggcc

SEQ ID NO: 2182962 - DNA, 11 bp, Homo sapiens
ctctggccctg

SEQ ID NO: 2182963 - DNA, 18 bp, Homo sapiens
ctctggctcacagactgg

SEQ ID NO: 2182964 - DNA, 13 bp, Homo sapiens
ctctggctccctg

SEQ ID NO: 2182965 - DNA, 14 bp, Homo sapiens
ctctggctccctgg

SEQ ID NO: 2182966 - DNA, 12 bp, Homo sapiens
ctctggctgcct

SEQ ID NO: 2182967 - DNA, 15 bp, Homo sapiens
ctctggctgcctggc

SEQ ID NO: 2182968 - DNA, 20 bp, Homo sapiens
ctctggctgcctggcccagg

SEQ ID NO: 2182969 - DNA, 17 bp, Homo sapiens
ctctggggctcagccct

SEQ ID NO: 2182970 - DNA, 22 bp, Homo sapiens
ctctggggctcagccctgagct

SEQ ID NO: 2182971 - DNA, 14 bp, Homo sapiens
ctctgtagaattta

SEQ ID NO: 2182972 - DNA, 17 bp, Homo sapiens
ctctgtcacgttctgga

SEQ ID NO: 2182973 - DNA, 21 bp, Homo sapiens
ctctgtcacgttctggaacat

SEQ ID NO: 2182974 - DNA, 15 bp, Homo sapiens
ctctgtccagggctt

SEQ ID NO: 2182975 - DNA, 22 bp, Homo sapiens
ctctgtctaccatctccctcga

SEQ ID NO: 2182976 - DNA, 19 bp, Homo sapiens
ctctgtgctgcatcccacc

SEQ ID NO: 2182977 - DNA, 16 bp, Homo sapiens
ctcttacccttctgtg

SEQ ID NO: 2182978 - DNA, 20 bp, Homo sapiens
ctcttacccttctgtgccca

SEQ ID NO: 2182979 - DNA, 19 bp, Homo sapiens
ctcttagcttacaggaagc

SEQ ID NO: 2182980 - DNA, 23 bp, Homo sapiens
ctcttccaagtggacggcagacc

SEQ ID NO: 2182981 - DNA, 12 bp, Homo sapiens
ctcttcccctct

SEQ ID NO: 2182982 - DNA, 24 bp, Homo sapiens
ctcttcccctctaatgctcacgct

SEQ ID NO: 2182983 - DNA, 16 bp, Homo sapiens
ctcttcccctctcaga

SEQ ID NO: 2182984 - DNA, 14 bp, Homo sapiens
ctcttcttctgaag

SEQ ID NO: 2182985 - DNA, 15 bp, Homo sapiens
ctcttcttctgaaga

SEQ ID NO: 2182986 - DNA, 14 bp, Homo sapiens
ctcttgaccaggct

SEQ ID NO: 2182987 - DNA, 15 bp, Homo sapiens
ctcttgaccaggctg

SEQ ID NO: 2182988 - DNA, 23 bp, Homo sapiens
ctcttgtagccagaattctggac

SEQ ID NO: 2182989 - DNA, 23 bp, Homo sapiens
ctctttgaactccgctgccttcc

SEQ ID NO: 2182990 - DNA, 22 bp, Homo sapiens
ctctttgtaaggacttgtgcct

SEQ ID NO: 2182991 - DNA, 21 bp, Homo sapiens
ctcttttgagactttgcccag

SEQ ID NO: 2182992 - DNA, 15 bp, Homo sapiens
ctctttttttaaaaa

SEQ ID NO: 2182993 - DNA, 21 bp, Homo sapiens
ctctttttttaaaaagttgat

SEQ ID NO: 2182994 - DNA, 17 bp, Homo sapiens
ctgaaagctgcttctgg

SEQ ID NO: 2182995 - DNA, 14 bp, Homo sapiens
ctgaaattttctag

SEQ ID NO: 2182996 - DNA, 13 bp, Homo sapiens
ctgaacacacatt

SEQ ID NO: 2182997 - DNA, 14 bp, Homo sapiens
ctgaacagatacat

SEQ ID NO: 2182998 - DNA, 22 bp, Homo sapiens
ctgaacagcagaaacccatgtg

SEQ ID NO: 2182999 - DNA, 14 bp, Homo sapiens
ctgaacatttttaa

SEQ ID NO: 2183000 - DNA, 22 bp, Homo sapiens
ctgaaccgctacaagagggcaa

SEQ ID NO: 2183001 - DNA, 20 bp, Homo sapiens
ctgaagccatgtagccaccc

SEQ ID NO: 2183002 - DNA, 22 bp, Homo sapiens
ctgaaggcagtggcaggggagc

SEQ ID NO: 2183003 - DNA, 21 bp, Homo sapiens
ctgaaggttggaactgctgcc

SEQ ID NO: 2183004 - DNA, 21 bp, Homo sapiens
ctgaagtctcaagaactgcca

SEQ ID NO: 2183005 - DNA, 22 bp, Homo sapiens
ctgaagtgccagatcaaaattg

SEQ ID NO: 2183006 - DNA, 21 bp, Homo sapiens
ctgaatatatgatttgcatgt

SEQ ID NO: 2183007 - DNA, 20 bp, Homo sapiens
ctgaatgcctcgctcccttc

SEQ ID NO: 2183008 - DNA, 21 bp, Homo sapiens
ctgaatgggagccagaattca

SEQ ID NO: 2183009 - DNA, 13 bp, Homo sapiens
ctgaatttctatg

SEQ ID NO: 2183010 - DNA, 23 bp, Homo sapiens
ctgaatttctatggcatattgat

SEQ ID NO: 2183011 - DNA, 19 bp, Homo sapiens
ctgacactgcgaactctca

SEQ ID NO: 2183012 - DNA, 22 bp, Homo sapiens
ctgacactgcgaactctcagga

SEQ ID NO: 2183013 - DNA, 17 bp, Homo sapiens
ctgaccccgacctcaga

SEQ ID NO: 2183014 - DNA, 13 bp, Homo sapiens
ctgaccctgcaga

SEQ ID NO: 2183015 - DNA, 21 bp, Homo sapiens
ctgacctgcccctgccgcctg

SEQ ID NO: 2183016 - DNA, 19 bp, Homo sapiens
ctgacgaggctgggccaag

SEQ ID NO: 2183017 - DNA, 20 bp, Homo sapiens
ctgacgaggctgggccaagc

SEQ ID NO: 2183018 - DNA, 15 bp, Homo sapiens
ctgactcaggcatca

SEQ ID NO: 2183019 - DNA, 21 bp, Homo sapiens
ctgactcccaaagagctgcct

SEQ ID NO: 2183020 - DNA, 23 bp, Homo sapiens
ctgactcccaaagagctgcctaa

SEQ ID NO: 2183021 - DNA, 14 bp, Homo sapiens
ctgactgccaagcc

SEQ ID NO: 2183022 - DNA, 20 bp, Homo sapiens
ctgactgccaagccagattc

SEQ ID NO: 2183023 - DNA, 17 bp, Homo sapiens
ctgactggcaccaacac

SEQ ID NO: 2183024 - DNA, 16 bp, Homo sapiens
ctgacttggttctgaa

SEQ ID NO: 2183025 - DNA, 19 bp, Homo sapiens
ctgacttggttctgaagcc

SEQ ID NO: 2183026 - DNA, 21 bp, Homo sapiens
ctgacttggttctgaagccat

SEQ ID NO: 2183027 - DNA, 19 bp, Homo sapiens
ctgagaaaacgaaactgct

SEQ ID NO: 2183028 - DNA, 23 bp, Homo sapiens
ctgagaacagatctccaaagctt

SEQ ID NO: 2183029 - DNA, 16 bp, Homo sapiens
ctgagaaggggaggac

SEQ ID NO: 2183030 - DNA, 18 bp, Homo sapiens
ctgagaaggggaggacct

SEQ ID NO: 2183031 - DNA, 13 bp, Homo sapiens
cgtagagaatgtg

SEQ ID NO: 2183032 - DNA, 22 bp, Homo sapiens
cgtatttatttttttattcttc

SEQ ID NO: 2183033 - DNA, 20 bp, Homo sapiens
cgtccacccgtttccaagcc

SEQ ID NO: 2183034 - DNA, 23 bp, Homo sapiens
cgtctgtgattgccatttcttcc

SEQ ID NO: 2183035 - DNA, 16 bp, Homo sapiens
cgtcttcaatctctgt

SEQ ID NO: 2183036 - DNA, 22 bp, Homo sapiens
cgtgacccacccgccttggcct

SEQ ID NO: 2183037 - DNA, 23 bp, Homo sapiens
cgtgactgtattatacatgggta

SEQ ID NO: 2183038 - DNA, 19 bp, Homo sapiens
cgtgagagcccaatcactg

SEQ ID NO: 2183039 - DNA, 19 bp, Homo sapiens
cgtgagcagtgtgtctcct

SEQ ID NO: 2183040 - DNA, 18 bp, Homo sapiens
cgtgagctacatgtgtaa

SEQ ID NO: 2183041 - DNA, 18 bp, Homo sapiens
cgtgcaaaacatgctacc

SEQ ID NO: 2183042 - DNA, 21 bp, Homo sapiens
cgtgcaacgtgtaacttgtgc

SEQ ID NO: 2183043 - DNA, 13 bp, Homo sapiens
cgtgctggagagt

SEQ ID NO: 2183044 - DNA, 15 bp, Homo sapiens
cgtgctggagagtag

SEQ ID NO: 2183045 - DNA, 19 bp, Homo sapiens
cgtggagccacaggcagac

SEQ ID NO: 2183046 - DNA, 17 bp, Homo sapiens
cgtggcaaaatccctct

SEQ ID NO: 2183047 - DNA, 16 bp, Homo sapiens
cgtgggctctggctcc

SEQ ID NO: 2183048 - DNA, 20 bp, Homo sapiens
cgtgggctctggctccctgg

SEQ ID NO: 2183049 - DNA, 18 bp, Homo sapiens
cgtggggggagctctggt

SEQ ID NO: 2183050 - DNA, 14 bp, Homo sapiens
cgtgtaacttgtgc

SEQ ID NO: 2183051 - DNA, 19 bp, Homo sapiens
cgtgtgcaacaggtaaaca

SEQ ID NO: 2183052 - DNA, 11 bp, Homo sapiens
cgttaatttaa

SEQ ID NO: 2183053 - DNA, 18 bp, Homo sapiens
cgttctcttctctcttca

SEQ ID NO: 2183054 - DNA, 15 bp, Homo sapiens
cgttttatcaaaggc

SEQ ID NO: 2183055 - DNA, 15 bp, Homo sapiens
ctaaaccaaaacaga

SEQ ID NO: 2183056 - DNA, 19 bp, Homo sapiens
ctaaaccatctatgtgaat

SEQ ID NO: 2183057 - DNA, 20 bp, Homo sapiens
ctaaagaggaagccttgccc

SEQ ID NO: 2183058 - DNA, 20 bp, Homo sapiens
ctaaagaggtggggtgaagc

SEQ ID NO: 2183059 - DNA, 23 bp, Homo sapiens
ctaaagaggtggggtgaagctgg

SEQ ID NO: 2183060 - DNA, 15 bp, Homo sapiens
ctaaatatgaaattt

SEQ ID NO: 2183061 - DNA, 15 bp, Homo sapiens
ctaaattaacctaaa

SEQ ID NO: 2183062 - DNA, 17 bp, Homo sapiens
ctaaattgaaacctgga

SEQ ID NO: 2183063 - DNA, 19 bp, Homo sapiens
ctaacactagtctgtgtgc

SEQ ID NO: 2183064 - DNA, 15 bp, Homo sapiens
ctaacaggggctggt

SEQ ID NO: 2183065 - DNA, 13 bp, Homo sapiens
ctaaccccgtctg

SEQ ID NO: 2183066 - DNA, 21 bp, Homo sapiens
ctaactagagcagccctggag

SEQ ID NO: 2183067 - DNA, 20 bp, Homo sapiens
ctaactcatactgtgctgga

SEQ ID NO: 2183068 - DNA, 15 bp, Homo sapiens
ctaagggaagaactc

SEQ ID NO: 2183069 - DNA, 14 bp, Homo sapiens
ctaagtgactacca

SEQ ID NO: 2183070 - DNA, 20 bp, Homo sapiens
ctaataaagttaaattgcac

SEQ ID NO: 2183071 - DNA, 22 bp, Homo sapiens
ctaatgctgcacaccagttact

SEQ ID NO: 2183072 - DNA, 24 bp, Homo sapiens
ctaatgctgcacaccagttactgt

SEQ ID NO: 2183073 - DNA, 17 bp, Homo sapiens
ctaatgtaacttcctct

SEQ ID NO: 2183074 - DNA, 23 bp, Homo sapiens
ctacaactgatcatttgcagctg

SEQ ID NO: 2183075 - DNA, 15 bp, Homo sapiens
ctacagggtgtctgt

SEQ ID NO: 2183076 - DNA, 22 bp, Homo sapiens
ctaccactggtgtaaaaaacaa

SEQ ID NO: 2183077 - DNA, 16 bp, Homo sapiens
ctaccacttatttcta

SEQ ID NO: 2183078 - DNA, 13 bp, Homo sapiens
ctaccatctccct

SEQ ID NO: 2183079 - DNA, 13 bp, Homo sapiens
ctacccacagggc

SEQ ID NO: 2183080 - DNA, 16 bp, Homo sapiens
ctaccccaattccttg

SEQ ID NO: 2183081 - DNA, 17 bp, Homo sapiens
ctaccccaattccttgt

SEQ ID NO: 2183082 - DNA, 16 bp, Homo sapiens
ctacccccttgtctgc

SEQ ID NO: 2183083 - DNA, 21 bp, Homo sapiens
ctacccccttgtctgctgctc

SEQ ID NO: 2183084 - DNA, 17 bp, Homo sapiens
ctacccttgccaaggcc

SEQ ID NO: 2183085 - DNA, 16 bp, Homo sapiens
ctacctgatcccactc

SEQ ID NO: 2183086 - DNA, 14 bp, Homo sapiens
ctacctgccctctc

SEQ ID NO: 2183087 - DNA, 19 bp, Homo sapiens
ctacctgccctctctcagt

SEQ ID NO: 2183088 - DNA, 14 bp, Homo sapiens
ctacctgtaacttt

SEQ ID NO: 2183089 - DNA, 17 bp, Homo sapiens
ctacctgtgaatcatat

SEQ ID NO: 2183090 - DNA, 15 bp, Homo sapiens
ctaccttcaaagctg

SEQ ID NO: 2183091 - DNA, 18 bp, Homo sapiens
ctaccttttttttacgga

SEQ ID NO: 2183092 - DNA, 17 bp, Homo sapiens
ctacgcccttcctgtgc

SEQ ID NO: 2183093 - DNA, 19 bp, Homo sapiens
ctactatttttctttccaa

SEQ ID NO: 2183094 - DNA, 23 bp, Homo sapiens
ctactcaccttgaacaccacgct

SEQ ID NO: 2183095 - DNA, 22 bp, Homo sapiens
ctagaaagcatccattaattaa

SEQ ID NO: 2183096 - DNA, 21 bp, Homo sapiens
ctagaatatcctacttctcca

SEQ ID NO: 2183097 - DNA, 15 bp, Homo sapiens
ctagaccatttttaa

SEQ ID NO: 2183098 - DNA, 20 bp, Homo sapiens
ctagagaggggcctctggct

SEQ ID NO: 2183099 - DNA, 22 bp, Homo sapiens
ctagagaggggcctctggctgc

SEQ ID NO: 2183100 - DNA, 23 bp, Homo sapiens
ctagagcttcaagtctgtgcctg

SEQ ID NO: 2183101 - DNA, 13 bp, Homo sapiens
ctagccatatatt

SEQ ID NO: 2183102 - DNA, 13 bp, Homo sapiens
ctagcctccctct

SEQ ID NO: 2183103 - DNA, 22 bp, Homo sapiens
ctagcctccctctcctctgtcc

SEQ ID NO: 2183104 - DNA, 14 bp, Homo sapiens
ctagctcccctcct

SEQ ID NO: 2183105 - DNA, 15 bp, Homo sapiens
ctagctcccctcctc

SEQ ID NO: 2183106 - DNA, 16 bp, Homo sapiens
ctaggacatgttccct

SEQ ID NO: 2183107 - DNA, 15 bp, Homo sapiens
ctaggatatcttctc

SEQ ID NO: 2183108 - DNA, 18 bp, Homo sapiens
ctaggcacctctgtgctg

SEQ ID NO: 2183109 - DNA, 21 bp, Homo sapiens
ctaggccccagaggccctgga

SEQ ID NO: 2183110 - DNA, 17 bp, Homo sapiens
ctaggctgggtgcccac

SEQ ID NO: 2183111 - DNA, 22 bp, Homo sapiens
ctaggctgggtgcccacagccc

SEQ ID NO: 2183112 - DNA, 11 bp, Homo sapiens
ctagggaagaa

SEQ ID NO: 2183113 - DNA, 20 bp, Homo sapiens
ctagggaaggccacctgcag

SEQ ID NO: 2183114 - DNA, 22 bp, Homo sapiens
ctaggtcaaggcctgtccctgg

SEQ ID NO: 2183115 - DNA, 15 bp, Homo sapiens
ccagcctctagggac

SEQ ID NO: 2183116 - DNA, 20 bp, Homo sapiens
ccagcctctagggacccctc

SEQ ID NO: 2183117 - DNA, 18 bp, Homo sapiens
ccagccttggcatctaga

SEQ ID NO: 2183118 - DNA, 12 bp, Homo sapiens
ccagcctttctt

SEQ ID NO: 2183119 - DNA, 14 bp, Homo sapiens
ccagcctttcttcc

SEQ ID NO: 2183120 - DNA, 15 bp, Homo sapiens
ccagctgaaggcagt

SEQ ID NO: 2183121 - DNA, 16 bp, Homo sapiens
ccagctgctcctcgca

SEQ ID NO: 2183122 - DNA, 20 bp, Homo sapiens
ccagctgctcctcgcagttc

SEQ ID NO: 2183123 - DNA, 13 bp, Homo sapiens
ccagctgctctgc

SEQ ID NO: 2183124 - DNA, 14 bp, Homo sapiens
ccagctgctctgcc

SEQ ID NO: 2183125 - DNA, 16 bp, Homo sapiens
ccagctggggcccctc

SEQ ID NO: 2183126 - DNA, 22 bp, Homo sapiens
ccagctgttctgtcccttggag

SEQ ID NO: 2183127 - DNA, 19 bp, Homo sapiens
ccaggaacagcaaatgcaa

SEQ ID NO: 2183128 - DNA, 18 bp, Homo sapiens
ccaggaaggggctggact

SEQ ID NO: 2183129 - DNA, 22 bp, Homo sapiens
ccaggacacaacgctgctgcct

SEQ ID NO: 2183130 - DNA, 13 bp, Homo sapiens
ccaggacagctgc

SEQ ID NO: 2183131 - DNA, 16 bp, Homo sapiens
ccaggacagctgcagg

SEQ ID NO: 2183132 - DNA, 18 bp, Homo sapiens
ccaggagcattttgtgtc

SEQ ID NO: 2183133 - DNA, 20 bp, Homo sapiens
ccaggagcattttgtgtctt

SEQ ID NO: 2183134 - DNA, 15 bp, Homo sapiens
ccaggccactgacct

SEQ ID NO: 2183135 - DNA, 14 bp, Homo sapiens
ccaggccatcagag

SEQ ID NO: 2183136 - DNA, 23 bp, Homo sapiens
ccaggcccagtccactggggagt

SEQ ID NO: 2183137 - DNA, 18 bp, Homo sapiens
ccaggctcgtggactgag

SEQ ID NO: 2183138 - DNA, 21 bp, Homo sapiens
ccaggctcgtggactgagtgg

SEQ ID NO: 2183139 - DNA, 19 bp, Homo sapiens
ccaggctgcggtgggcagc

SEQ ID NO: 2183140 - DNA, 21 bp, Homo sapiens
ccaggctggtcttgaactcct

SEQ ID NO: 2183141 - DNA, 18 bp, Homo sapiens
ccagggatggggccacag

SEQ ID NO: 2183142 - DNA, 19 bp, Homo sapiens
ccagggatggggccacagc

SEQ ID NO: 2183143 - DNA, 16 bp, Homo sapiens
ccaggggcctgcagaa

SEQ ID NO: 2183144 - DNA, 22 bp, Homo sapiens
ccaggggctttggtggcccctc

SEQ ID NO: 2183145 - DNA, 23 bp, Homo sapiens
ccaggggctttggtggcccctcc

SEQ ID NO: 2183146 - DNA, 20 bp, Homo sapiens
ccagggtaggcaaggctgcc

SEQ ID NO: 2183147 - DNA, 16 bp, Homo sapiens
ccagggtcctgtgcct

SEQ ID NO: 2183148 - DNA, 18 bp, Homo sapiens
ccaggtcgggctcagctc

SEQ ID NO: 2183149 - DNA, 20 bp, Homo sapiens
ccaggttggaggccctaggc

SEQ ID NO: 2183150 - DNA, 17 bp, Homo sapiens
ccagtaaggcagctctg

SEQ ID NO: 2183151 - DNA, 15 bp, Homo sapiens
ccagtatcctgaaac

SEQ ID NO: 2183152 - DNA, 21 bp, Homo sapiens
ccagtccactggggagtgctg

SEQ ID NO: 2183153 - DNA, 14 bp, Homo sapiens
ccagtcctgctctc

SEQ ID NO: 2183154 - DNA, 15 bp, Homo sapiens
ccagtcctgctctct

SEQ ID NO: 2183155 - DNA, 13 bp, Homo sapiens
ccagtgatggcat

SEQ ID NO: 2183156 - DNA, 17 bp, Homo sapiens
ccagtgatggcattact

SEQ ID NO: 2183157 - DNA, 23 bp, Homo sapiens
ccagtgatggcattactctgcac

SEQ ID NO: 2183158 - DNA, 10 bp, Homo sapiens
ccagtttctt

SEQ ID NO: 2183159 - DNA, 13 bp, Homo sapiens
ccataccttgaga

SEQ ID NO: 2183160 - DNA, 17 bp, Homo sapiens
ccatactctgtctccct

SEQ ID NO: 2183161 - DNA, 16 bp, Homo sapiens
ccatagctcctgctcc

SEQ ID NO: 2183162 - DNA, 13 bp, Homo sapiens
ccatcactcggct

SEQ ID NO: 2183163 - DNA, 21 bp, Homo sapiens
ccatcactcggctgtggagaa

SEQ ID NO: 2183164 - DNA, 13 bp, Homo sapiens
ccatcagcagtga

SEQ ID NO: 2183165 - DNA, 14 bp, Homo sapiens
ccatcccagccttg

SEQ ID NO: 2183166 - DNA, 14 bp, Homo sapiens
ccatcccgtttaga

SEQ ID NO: 2183167 - DNA, 12 bp, Homo sapiens
ccatcctgacca

SEQ ID NO: 2183168 - DNA, 16 bp, Homo sapiens
ccatctccttgtcttt

SEQ ID NO: 2183169 - DNA, 21 bp, Homo sapiens
ccatctgactgccaagccaga

SEQ ID NO: 2183170 - DNA, 17 bp, Homo sapiens
ccatcttggccaggctg

SEQ ID NO: 2183171 - DNA, 18 bp, Homo sapiens
ccatcttggccaggctgg

SEQ ID NO: 2183172 - DNA, 20 bp, Homo sapiens
ccatcttggccaggctggtc

SEQ ID NO: 2183173 - DNA, 20 bp, Homo sapiens
ccatgagaacaaaacctctt

SEQ ID NO: 2183174 - DNA, 18 bp, Homo sapiens
ctgtaccgtcgacaagaa

SEQ ID NO: 2183175 - DNA, 21 bp, Homo sapiens
ctgtactaggattagaaaatt

SEQ ID NO: 2183176 - DNA, 20 bp, Homo sapiens
ctgtagcctgcgtcatggct

SEQ ID NO: 2183177 - DNA, 15 bp, Homo sapiens
ctgtagctattcttt

SEQ ID NO: 2183178 - DNA, 20 bp, Homo sapiens
ctgtattaactgaattctga

SEQ ID NO: 2183179 - DNA, 18 bp, Homo sapiens
ctgtattttttttttcca

SEQ ID NO: 2183180 - DNA, 20 bp, Homo sapiens
ctgtattttttttttccatt

SEQ ID NO: 2183181 - DNA, 16 bp, Homo sapiens
ctgtcaatggactgca

SEQ ID NO: 2183182 - DNA, 17 bp, Homo sapiens
ctgtcaatggactgcac

SEQ ID NO: 2183183 - DNA, 20 bp, Homo sapiens
ctgtcaatggactgcacctt

SEQ ID NO: 2183184 - DNA, 14 bp, Homo sapiens
ctgtcacccaggct

SEQ ID NO: 2183185 - DNA, 15 bp, Homo sapiens
ctgtcagaataaaga

SEQ ID NO: 2183186 - DNA, 17 bp, Homo sapiens
ctgtccaagtgtttctt

SEQ ID NO: 2183187 - DNA, 21 bp, Homo sapiens
ctgtccaagtgtttcttgtta

SEQ ID NO: 2183188 - DNA, 12 bp, Homo sapiens
ctgtccagggct

SEQ ID NO: 2183189 - DNA, 15 bp, Homo sapiens
ctgtccagggcttca

SEQ ID NO: 2183190 - DNA, 13 bp, Homo sapiens
ctgtccccatagc

SEQ ID NO: 2183191 - DNA, 12 bp, Homo sapiens
ctgtccctgcag

SEQ ID NO: 2183192 - DNA, 13 bp, Homo sapiens
ctgtccctgcagg

SEQ ID NO: 2183193 - DNA, 18 bp, Homo sapiens
ctgtccctggccatctct

SEQ ID NO: 2183194 - DNA, 16 bp, Homo sapiens
ctgtccttcccacggc

SEQ ID NO: 2183195 - DNA, 20 bp, Homo sapiens
ctgtccttcccacggccact

SEQ ID NO: 2183196 - DNA, 22 bp, Homo sapiens
ctgtcctttccagtggcctggc

SEQ ID NO: 2183197 - DNA, 17 bp, Homo sapiens
ctgtcgtggtagcagat

SEQ ID NO: 2183198 - DNA, 15 bp, Homo sapiens
ctgtctaccatctcc

SEQ ID NO: 2183199 - DNA, 15 bp, Homo sapiens
ctgtctcccctctgc

SEQ ID NO: 2183200 - DNA, 12 bp, Homo sapiens
ctgtctctcttg

SEQ ID NO: 2183201 - DNA, 21 bp, Homo sapiens
ctgtctctcttgctttgttct

SEQ ID NO: 2183202 - DNA, 16 bp, Homo sapiens
ctgtctgcgccgctgt

SEQ ID NO: 2183203 - DNA, 20 bp, Homo sapiens
ctgtctgcgccgctgtgctg

SEQ ID NO: 2183204 - DNA, 12 bp, Homo sapiens
ctgtctggccca

SEQ ID NO: 2183205 - DNA, 16 bp, Homo sapiens
ctgtctggcccaaagg

SEQ ID NO: 2183206 - DNA, 19 bp, Homo sapiens
ctgtcttcagatcctgctg

SEQ ID NO: 2183207 - DNA, 19 bp, Homo sapiens
ctgtcttccaggcccagtc

SEQ ID NO: 2183208 - DNA, 21 bp, Homo sapiens
ctgtcttcttcagggtcctga

SEQ ID NO: 2183209 - DNA, 18 bp, Homo sapiens
ctgtcttgatgactgctg

SEQ ID NO: 2183210 - DNA, 16 bp, Homo sapiens
ctgtcttggcctccca

SEQ ID NO: 2183211 - DNA, 18 bp, Homo sapiens
ctgtctttaaaagtcatt

SEQ ID NO: 2183212 - DNA, 22 bp, Homo sapiens
ctgtgaaagtctcctgtatcat

SEQ ID NO: 2183213 - DNA, 17 bp, Homo sapiens
ctgtgacacagctgagc

SEQ ID NO: 2183214 - DNA, 18 bp, Homo sapiens
ctgtgacctaagaacaaa

SEQ ID NO: 2183215 - DNA, 12 bp, Homo sapiens
ctgtgattaatt

SEQ ID NO: 2183216 - DNA, 14 bp, Homo sapiens
ctgtgattaattat

SEQ ID NO: 2183217 - DNA, 15 bp, Homo sapiens
ctgtgattaattatt

SEQ ID NO: 2183218 - DNA, 19 bp, Homo sapiens
ctgtgattgccatttcttc

SEQ ID NO: 2183219 - DNA, 18 bp, Homo sapiens
ctgtgatttatttggagt

SEQ ID NO: 2183220 - DNA, 19 bp, Homo sapiens
ctgtgcatcaaccaggaag

SEQ ID NO: 2183221 - DNA, 22 bp, Homo sapiens
ctgtgcatcaaccaggaagagt

SEQ ID NO: 2183222 - DNA, 21 bp, Homo sapiens
ctgtgcccagcagtttcccag

SEQ ID NO: 2183223 - DNA, 12 bp, Homo sapiens
ctgtgcccagct

SEQ ID NO: 2183224 - DNA, 16 bp, Homo sapiens
ctgtgcccagctcagt

SEQ ID NO: 2183225 - DNA, 22 bp, Homo sapiens
ctgtgcccttgctgggtccagg

SEQ ID NO: 2183226 - DNA, 19 bp, Homo sapiens
ctgtgcctgaccttgagga

SEQ ID NO: 2183227 - DNA, 14 bp, Homo sapiens
ctgtgcctggagct

SEQ ID NO: 2183228 - DNA, 18 bp, Homo sapiens
ctgtgcctggagctcctg

SEQ ID NO: 2183229 - DNA, 16 bp, Homo sapiens
ctgtgcgtcccagctg

SEQ ID NO: 2183230 - DNA, 23 bp, Homo sapiens
ctgtgcgtcccagctgaaggcag

SEQ ID NO: 2183231 - DNA, 16 bp, Homo sapiens
ctgtgctgttgtctgc

SEQ ID NO: 2183232 - DNA, 14 bp, Homo sapiens
ctgtggaggtggct

SEQ ID NO: 2183233 - DNA, 17 bp, Homo sapiens
ctgtggccagttgacat

SEQ ID NO: 2183234 - DNA, 21 bp, Homo sapiens
ctgtggcgatatgagagggat

SEQ ID NO: 2183235 - DNA, 15 bp, Homo sapiens
ctgtggttcctgggg

SEQ ID NO: 2183236 - DNA, 23 bp, Homo sapiens
ctgtgtattaaacctttccattt

SEQ ID NO: 2183237 - DNA, 17 bp, Homo sapiens
ctgtgtcacgagccctt

SEQ ID NO: 2183238 - DNA, 21 bp, Homo sapiens
ctgtgtcacgcaggctgagtg

SEQ ID NO: 2183239 - DNA, 20 bp, Homo sapiens
ctgtgtctttagacaaccct

SEQ ID NO: 2183240 - DNA, 18 bp, Homo sapiens
ctgtgtgcagtctctctt

SEQ ID NO: 2183241 - DNA, 14 bp, Homo sapiens
ctgtgtgtccgtca

SEQ ID NO: 2183242 - DNA, 15 bp, Homo sapiens
ctgtgttacaatcgt

SEQ ID NO: 2183243 - DNA, 21 bp, Homo sapiens
ctgttacattctaagtgtgtt

SEQ ID NO: 2183244 - DNA, 16 bp, Homo sapiens
ctgttcagtaacaggg

SEQ ID NO: 2183245 - DNA, 17 bp, Homo sapiens
ctgttcccctcacccaa

SEQ ID NO: 2183246 - DNA, 19 bp, Homo sapiens
ctgttgcaaactcagcctc

SEQ ID NO: 2183247 - DNA, 20 bp, Homo sapiens
ctgttgtctgccgtgagagc

SEQ ID NO: 2183248 - DNA, 22 bp, Homo sapiens
ctgttgttcagaagttgttagt

SEQ ID NO: 2183249 - DNA, 17 bp, Homo sapiens
ctgttgttgttaatttt

SEQ ID NO: 2183250 - DNA, 17 bp, Homo sapiens
ctgttgtttgatgtgta

SEQ ID NO: 2183251 - DNA, 14 bp, Homo sapiens
ctgtttccttctct

SEQ ID NO: 2183252 - DNA, 13 bp, Homo sapiens
ctgtttgaaaaac

SEQ ID NO: 2183253 - DNA, 23 bp, Homo sapiens
ctgtttgaaaaacctgttctggt

SEQ ID NO: 2183254 - DNA, 13 bp, Homo sapiens
ctgtttgcttcta

SEQ ID NO: 2183255 - DNA, 16 bp, Homo sapiens
ctgtttgtcttctccc

SEQ ID NO: 2183256 - DNA, 22 bp, Homo sapiens
ctgttttattgagttctgaagg

SEQ ID NO: 2183257 - DNA, 19 bp, Homo sapiens
cttaaactgaaagctttaa

SEQ ID NO: 2183258 - DNA, 14 bp, Homo sapiens
cttaaagtcagtaa

SEQ ID NO: 2183259 - DNA, 16 bp, Homo sapiens
cttaaatgttattatc

SEQ ID NO: 2183260 - DNA, 14 bp, Homo sapiens
cttaacctgctttt

SEQ ID NO: 2183261 - DNA, 19 bp, Homo sapiens
cttaactacttatctctaa

SEQ ID NO: 2183262 - DNA, 12 bp, Homo sapiens
cttaatgctgaa

SEQ ID NO: 2183263 - DNA, 17 bp, Homo sapiens
cttacacttactgttgt

SEQ ID NO: 2183264 - DNA, 13 bp, Homo sapiens
cttacccttctgt

SEQ ID NO: 2183265 - DNA, 22 bp, Homo sapiens
cttagaacagatggctgtgaaa

SEQ ID NO: 2183266 - DNA, 23 bp, Homo sapiens
cttagaacagatggctgtgaaaa

SEQ ID NO: 2183267 - DNA, 16 bp, Homo sapiens
cttagagcctccctca

SEQ ID NO: 2183268 - DNA, 17 bp, Homo sapiens
cttagagcctccctcaa

SEQ ID NO: 2183269 - DNA, 15 bp, Homo sapiens
cttagagtcatgagt

SEQ ID NO: 2183270 - DNA, 22 bp, Homo sapiens
cttagattatgttcaatgaata

SEQ ID NO: 2183271 - DNA, 17 bp, Homo sapiens
cttagcagcttctgtcc

SEQ ID NO: 2183272 - DNA, 14 bp, Homo sapiens
cttagggcaggaaa

SEQ ID NO: 2183273 - DNA, 17 bp, Homo sapiens
cttaggtgaaggcagaa

SEQ ID NO: 2183274 - DNA, 18 bp, Homo sapiens
cttaggtgaaggcagaag

SEQ ID NO: 2183275 - DNA, 21 bp, Homo sapiens
cttagtcctccctgctcagct

SEQ ID NO: 2183276 - DNA, 19 bp, Homo sapiens
cttagttctgtatataaat

SEQ ID NO: 2183277 - DNA, 13 bp, Homo sapiens
cttagttttgttc

SEQ ID NO: 2183278 - DNA, 17 bp, Homo sapiens
cttataagcaacatgaa

SEQ ID NO: 2183279 - DNA, 20 bp, Homo sapiens
cttatagtacctcactgcac

SEQ ID NO: 2183280 - DNA, 21 bp, Homo sapiens
cttatatctggcctctgcttt

SEQ ID NO: 2183281 - DNA, 22 bp, Homo sapiens
cttattcaaagatgataattta

SEQ ID NO: 2183282 - DNA, 13 bp, Homo sapiens
cttatttttactt

SEQ ID NO: 2183283 - DNA, 22 bp, Homo sapiens
cttatttttatttatttttgta

SEQ ID NO: 2183284 - DNA, 23 bp, Homo sapiens
cttatttttatttatttttgtac

SEQ ID NO: 2183285 - DNA, 14 bp, Homo sapiens
cttcaaaatcagtg

SEQ ID NO: 2183286 - DNA, 15 bp, Homo sapiens
cttcaaaatcagtga

SEQ ID NO: 2183287 - DNA, 22 bp, Homo sapiens
cttcaacaacgtgagagaaaga

SEQ ID NO: 2183288 - DNA, 17 bp, Homo sapiens
cttcaagggctgcttca

SEQ ID NO: 2183289 - DNA, 15 bp, Homo sapiens
cttcaagtctgtgcc

SEQ ID NO: 2183290 - DNA, 12 bp, Homo sapiens
cttcaatacaaa

SEQ ID NO: 2183291 - DNA, 22 bp, Homo sapiens
cttcaatacccaaatcctctcc

SEQ ID NO: 2183292 - DNA, 13 bp, Homo sapiens
cttcaatctctgg

SEQ ID NO: 2183293 - DNA, 14 bp, Homo sapiens
cttcaatctctgtt

SEQ ID NO: 2183294 - DNA, 22 bp, Homo sapiens
cttcacacagcacctcctctct

SEQ ID NO: 2183295 - DNA, 16 bp, Homo sapiens
cttcagactgcaagtg

SEQ ID NO: 2183296 - DNA, 14 bp, Homo sapiens
cttcagatattttg

SEQ ID NO: 2183297 - DNA, 18 bp, Homo sapiens
cttcagatcctgctgccg

SEQ ID NO: 2183298 - DNA, 14 bp, Homo sapiens
cttcagtgactcct

SEQ ID NO: 2183299 - DNA, 15 bp, Homo sapiens
cttcatattaatata

SEQ ID NO: 2183300 - DNA, 20 bp, Homo sapiens
cttcattctaaaccaaaaca

SEQ ID NO: 2183301 - DNA, 15 bp, Homo sapiens
cttcatttattttga

SEQ ID NO: 2183302 - DNA, 14 bp, Homo sapiens
cttccaactgctgc

SEQ ID NO: 2183303 - DNA, 16 bp, Homo sapiens
cttccaagaaaaataa

SEQ ID NO: 2183304 - DNA, 16 bp, Homo sapiens
cttccaagacctgact

SEQ ID NO: 2183305 - DNA, 17 bp, Homo sapiens
cttccaagacctgactc

SEQ ID NO: 2183306 - DNA, 22 bp, Homo sapiens
cttccaagtggacggcagacct

SEQ ID NO: 2183307 - DNA, 23 bp, Homo sapiens
cttccacacccccaccccttgct

SEQ ID NO: 2183308 - DNA, 14 bp, Homo sapiens
cttccacagcaaat

SEQ ID NO: 2183309 - DNA, 22 bp, Homo sapiens
cttccacagcaaatgagatgta

SEQ ID NO: 2183310 - DNA, 19 bp, Homo sapiens
cttccagtatcctgaaaca

SEQ ID NO: 2183311 - DNA, 21 bp, Homo sapiens
cttccagtatcctgaaacagt

SEQ ID NO: 2183312 - DNA, 13 bp, Homo sapiens
cttccatcagcag

SEQ ID NO: 2183313 - DNA, 15 bp, Homo sapiens
cttccatcagcagtg

SEQ ID NO: 2183314 - DNA, 23 bp, Homo sapiens
cttccatcagcagtgattgaagt

SEQ ID NO: 2183315 - DNA, 14 bp, Homo sapiens
cttccattaatttt

SEQ ID NO: 2183316 - DNA, 19 bp, Homo sapiens
cttcccacggccactgcag

SEQ ID NO: 2183317 - DNA, 14 bp, Homo sapiens
cttccctacccaca

SEQ ID NO: 2183318 - DNA, 18 bp, Homo sapiens
cttccctacccacagggc

SEQ ID NO: 2183319 - DNA, 20 bp, Homo sapiens
cttccctaggcacctctgtg

SEQ ID NO: 2183320 - DNA, 17 bp, Homo sapiens
cttccctagggctgggt

SEQ ID NO: 2183321 - DNA, 18 bp, Homo sapiens
cttccctagggctgggtg

SEQ ID NO: 2183322 - DNA, 12 bp, Homo sapiens
cttccctctgct

SEQ ID NO: 2183323 - DNA, 15 bp, Homo sapiens
cttccctctgctcca

SEQ ID NO: 2183324 - DNA, 18 bp, Homo sapiens
cttccctggtccagattg

SEQ ID NO: 2183325 - DNA, 17 bp, Homo sapiens
cttccgctttgaaagaa

SEQ ID NO: 2183326 - DNA, 19 bp, Homo sapiens
cttccgctttgaaagaagc

SEQ ID NO: 2183327 - DNA, 14 bp, Homo sapiens
cttcctgtccgccc

SEQ ID NO: 2183328 - DNA, 22 bp, Homo sapiens
cttcctgtccgccctcttcccc

SEQ ID NO: 2183329 - DNA, 17 bp, Homo sapiens
cttcctgtctggcccaa

SEQ ID NO: 2183330 - DNA, 19 bp, Homo sapiens
cttcggaggaggtggacat

SEQ ID NO: 2183331 - DNA, 13 bp, Homo sapiens
cttcggaggtggc

SEQ ID NO: 2183332 - DNA, 17 bp, Homo sapiens
cttcgtaacttcatatt

SEQ ID NO: 2183333 - DNA, 23 bp, Homo sapiens
cttctaaaggtttcactgttcat

SEQ ID NO: 2183334 - DNA, 13 bp, Homo sapiens
cttctcatcactc

SEQ ID NO: 2183335 - DNA, 18 bp, Homo sapiens
cttctcctcttgtagcca

SEQ ID NO: 2183336 - DNA, 20 bp, Homo sapiens
cttctccttccaactgctgc

SEQ ID NO: 2183337 - DNA, 13 bp, Homo sapiens
cttctctcccaca

SEQ ID NO: 2183338 - DNA, 21 bp, Homo sapiens
cttctctcccacacaagcagt

SEQ ID NO: 2183339 - DNA, 14 bp, Homo sapiens
cttctctcttcaat

SEQ ID NO: 2183340 - DNA, 20 bp, Homo sapiens
cttctctcttcaatctctgg

SEQ ID NO: 2183341 - DNA, 14 bp, Homo sapiens
cttctgacctcagc

SEQ ID NO: 2183342 - DNA, 15 bp, Homo sapiens
cttctgtgcccagct

SEQ ID NO: 2183343 - DNA, 22 bp, Homo sapiens
cttctttgactataacaaaatc

SEQ ID NO: 2183344 - DNA, 21 bp, Homo sapiens
cttgaaacttggttcccagaa

SEQ ID NO: 2183345 - DNA, 15 bp, Homo sapiens
cttgaacaccacgct

SEQ ID NO: 2183346 - DNA, 14 bp, Homo sapiens
cttgaaccttcaaa

SEQ ID NO: 2183347 - DNA, 14 bp, Homo sapiens
cttgaactcctaga

SEQ ID NO: 2183348 - DNA, 22 bp, Homo sapiens
cttgaagtgaacaaatttcaaa

SEQ ID NO: 2183349 - DNA, 16 bp, Homo sapiens
cttgaagtgagaagat

SEQ ID NO: 2183350 - DNA, 22 bp, Homo sapiens
cttgacgcgtggtcacaggacg

SEQ ID NO: 2183351 - DNA, 13 bp, Homo sapiens
cttgagaagacat

SEQ ID NO: 2183352 - DNA, 19 bp, Homo sapiens
cttgagacctggaaccaga

SEQ ID NO: 2183353 - DNA, 17 bp, Homo sapiens
cttgagagcgctggcct

SEQ ID NO: 2183354 - DNA, 23 bp, Homo sapiens
cttgagctcttcatttattttga

SEQ ID NO: 2183355 - DNA, 19 bp, Homo sapiens
cttgaggcttctgcttcca

SEQ ID NO: 2183356 - DNA, 13 bp, Homo sapiens
cttgagtgtgcaa

SEQ ID NO: 2183357 - DNA, 17 bp, Homo sapiens
cttgatgactgctgatt

SEQ ID NO: 2183358 - DNA, 22 bp, Homo sapiens
cttgatgccagtaggctcaact

SEQ ID NO: 2183359 - DNA, 21 bp, Homo sapiens
cttgatgtcttgagagcgctg

SEQ ID NO: 2183360 - DNA, 19 bp, Homo sapiens
cttgattttcaagctttca

SEQ ID NO: 2183361 - DNA, 21 bp, Homo sapiens
cttgattttcaagctttcaaa

SEQ ID NO: 2183362 - DNA, 18 bp, Homo sapiens
cttgcagagaagccttgg

SEQ ID NO: 2183363 - DNA, 22 bp, Homo sapiens
cttgcagtatgatggcaggaga

SEQ ID NO: 2183364 - DNA, 13 bp, Homo sapiens
cttgccaaggccg

SEQ ID NO: 2183365 - DNA, 18 bp, Homo sapiens
cttgccaaggccgcccac

SEQ ID NO: 2183366 - DNA, 13 bp, Homo sapiens
cttgccgctggga

SEQ ID NO: 2183367 - DNA, 15 bp, Homo sapiens
cttgccgctgggaga

SEQ ID NO: 2183368 - DNA, 17 bp, Homo sapiens
cttgccgctgggagagc

SEQ ID NO: 2183369 - DNA, 16 bp, Homo sapiens
cttgctgcacctgagg

SEQ ID NO: 2183370 - DNA, 21 bp, Homo sapiens
cttgctgcacctgaggcccag

SEQ ID NO: 2183371 - DNA, 14 bp, Homo sapiens
cttggaggagagag

SEQ ID NO: 2183372 - DNA, 18 bp, Homo sapiens
cttggaggagagagaccc

SEQ ID NO: 2183373 - DNA, 19 bp, Homo sapiens
cttggaggagagagacccc

SEQ ID NO: 2183374 - DNA, 22 bp, Homo sapiens
cttggccaaaacaggctcaggc

SEQ ID NO: 2183375 - DNA, 14 bp, Homo sapiens
cttggcctcccaaa

SEQ ID NO: 2183376 - DNA, 15 bp, Homo sapiens
cttggcctcccaaag

SEQ ID NO: 2183377 - DNA, 23 bp, Homo sapiens
cttggcctcccaaagtgctggga

SEQ ID NO: 2183378 - DNA, 13 bp, Homo sapiens
cttgggaaaatat

SEQ ID NO: 2183379 - DNA, 17 bp, Homo sapiens
cttgggccatagctcct

SEQ ID NO: 2183380 - DNA, 20 bp, Homo sapiens
cttgggcctcaggctctgca

SEQ ID NO: 2183381 - DNA, 13 bp, Homo sapiens
cttggggccatcg

SEQ ID NO: 2183382 - DNA, 12 bp, Homo sapiens
cttggggcctgg

SEQ ID NO: 2183383 - DNA, 18 bp, Homo sapiens
cttggttcccagaaaaca

SEQ ID NO: 2183384 - DNA, 14 bp, Homo sapiens
cttggttctgaagc

SEQ ID NO: 2183385 - DNA, 17 bp, Homo sapiens
cttgtaaacctggaggg

SEQ ID NO: 2183386 - DNA, 16 bp, Homo sapiens
cttgtacagacatgtg

SEQ ID NO: 2183387 - DNA, 22 bp, Homo sapiens
cttgtacagttgactggctttc

SEQ ID NO: 2183388 - DNA, 15 bp, Homo sapiens
cttgtactgtgacct

SEQ ID NO: 2183389 - DNA, 16 bp, Homo sapiens
cttgtactgtgaccta

SEQ ID NO: 2183390 - DNA, 23 bp, Homo sapiens
cttgtactgtgacctaagaacaa

SEQ ID NO: 2183391 - DNA, 10 bp, Homo sapiens
cttgtagcca

SEQ ID NO: 2183392 - DNA, 13 bp, Homo sapiens
cttgtccccacac

SEQ ID NO: 2183393 - DNA, 14 bp, Homo sapiens
cttgtccccacact

SEQ ID NO: 2183394 - DNA, 17 bp, Homo sapiens
cttgtgaacatgcctta

SEQ ID NO: 2183395 - DNA, 16 bp, Homo sapiens
cttgtgatctgggaac

SEQ ID NO: 2183396 - DNA, 17 bp, Homo sapiens
cttgtgcattgtgtgtc

SEQ ID NO: 2183397 - DNA, 13 bp, Homo sapiens
cttgtgtttgtat

SEQ ID NO: 2183398 - DNA, 16 bp, Homo sapiens
cttgttcttttctggt

SEQ ID NO: 2183399 - DNA, 12 bp, Homo sapiens
ctttaaaaatgt

SEQ ID NO: 2183400 - DNA, 14 bp, Homo sapiens
ctttaaaaatgtat

SEQ ID NO: 2183401 - DNA, 18 bp, Homo sapiens
ctttaattgttgctttta

SEQ ID NO: 2183402 - DNA, 17 bp, Homo sapiens
ctttaccacccccacac

SEQ ID NO: 2183403 - DNA, 13 bp, Homo sapiens
ctttagaatatta

SEQ ID NO: 2183404 - DNA, 19 bp, Homo sapiens
ctttagaatattaaaaatt

SEQ ID NO: 2183405 - DNA, 14 bp, Homo sapiens
ctttatcaaaatgg

SEQ ID NO: 2183406 - DNA, 20 bp, Homo sapiens
ctttatccaggggcttcacc

SEQ ID NO: 2183407 - DNA, 14 bp, Homo sapiens
ctttattagtgaag

SEQ ID NO: 2183408 - DNA, 15 bp, Homo sapiens
ctttattagtttaaa

SEQ ID NO: 2183409 - DNA, 21 bp, Homo sapiens
ctttattctttaattgttgct

SEQ ID NO: 2183410 - DNA, 21 bp, Homo sapiens
ctttcataaagcaccagcagt

SEQ ID NO: 2183411 - DNA, 19 bp, Homo sapiens
ctttcatctaaattactga

SEQ ID NO: 2183412 - DNA, 15 bp, Homo sapiens
ctttccagaatgcaa

SEQ ID NO: 2183413 - DNA, 19 bp, Homo sapiens
ctttcccaacacttcagac

SEQ ID NO: 2183414 - DNA, 13 bp, Homo sapiens
ctttccttgtctc

SEQ ID NO: 2183415 - DNA, 17 bp, Homo sapiens
ctttccttgtctctcat

SEQ ID NO: 2183416 - DNA, 20 bp, Homo sapiens
ctttccttgtctctcattct

SEQ ID NO: 2183417 - DNA, 23 bp, Homo sapiens
ctttctaaatctctatctcttta

SEQ ID NO: 2183418 - DNA, 19 bp, Homo sapiens
ctttctacagtattatgta

SEQ ID NO: 2183419 - DNA, 13 bp, Homo sapiens
ctttctatctaat

SEQ ID NO: 2183420 - DNA, 15 bp, Homo sapiens
ctttctcctgtgccc

SEQ ID NO: 2183421 - DNA, 15 bp, Homo sapiens
ctttctcttctctgt

SEQ ID NO: 2183422 - DNA, 18 bp, Homo sapiens
ctttctttttctgtctct

SEQ ID NO: 2183423 - DNA, 12 bp, Homo sapiens
ctttgaaagaag

SEQ ID NO: 2183424 - DNA, 20 bp, Homo sapiens
ctttgaaagaagcaagacac

SEQ ID NO: 2183425 - DNA, 20 bp, Homo sapiens
ctttgactataacaaaatct

SEQ ID NO: 2183426 - DNA, 23 bp, Homo sapiens
ctttgatgattgccaacagtggc

SEQ ID NO: 2183427 - DNA, 15 bp, Homo sapiens
ctttgcagacctggg

SEQ ID NO: 2183428 - DNA, 18 bp, Homo sapiens
ctttgcagacctgggact

SEQ ID NO: 2183429 - DNA, 19 bp, Homo sapiens
ctttgcagacctgggactt

SEQ ID NO: 2183430 - DNA, 21 bp, Homo sapiens
ctttgcagacctgggacttta

SEQ ID NO: 2183431 - DNA, 17 bp, Homo sapiens
ctttgcccaacctcagc

SEQ ID NO: 2183432 - DNA, 22 bp, Homo sapiens
ctttgcccagggtcctgtgcct

SEQ ID NO: 2183433 - DNA, 18 bp, Homo sapiens
ctttgctcccagtttctt

SEQ ID NO: 2183434 - DNA, 16 bp, Homo sapiens
ctttggacgcacacag

SEQ ID NO: 2183435 - DNA, 17 bp, Homo sapiens
ctttggacgcacacagc

SEQ ID NO: 2183436 - DNA, 18 bp, Homo sapiens
ctttggacgcacacagct

SEQ ID NO: 2183437 - DNA, 19 bp, Homo sapiens
ctttggagaactcatttca

SEQ ID NO: 2183438 - DNA, 21 bp, Homo sapiens
ctttggagaactcatttcaag

SEQ ID NO: 2183439 - DNA, 14 bp, Homo sapiens
ctttgtaaggactt

SEQ ID NO: 2183440 - DNA, 20 bp, Homo sapiens
ctttgtaaggacttgtgcct

SEQ ID NO: 2183441 - DNA, 22 bp, Homo sapiens
ctttgtaagtaaactgccctgt

SEQ ID NO: 2183442 - DNA, 23 bp, Homo sapiens
ctttgtatgatgaaaagaatgtg

SEQ ID NO: 2183443 - DNA, 14 bp, Homo sapiens
ctttgtattctctg

SEQ ID NO: 2183444 - DNA, 14 bp, Homo sapiens
ctttgtcccacagc

SEQ ID NO: 2183445 - DNA, 16 bp, Homo sapiens
ctttgtcccacagctt

SEQ ID NO: 2183446 - DNA, 13 bp, Homo sapiens
ctttgttccactg

SEQ ID NO: 2183447 - DNA, 22 bp, Homo sapiens
cttttaaactactatttttctt

SEQ ID NO: 2183448 - DNA, 19 bp, Homo sapiens
cttttaaactggagaggct

SEQ ID NO: 2183449 - DNA, 18 bp, Homo sapiens
cttttaagtttttctctt

SEQ ID NO: 2183450 - DNA, 24 bp, Homo sapiens
cttttaatgatactgtctaagaat

SEQ ID NO: 2183451 - DNA, 15 bp, Homo sapiens
cttttacagcttttc

SEQ ID NO: 2183452 - DNA, 19 bp, Homo sapiens
cttttacagcttttctctt

SEQ ID NO: 2183453 - DNA, 19 bp, Homo sapiens
cttttagacagtggtaaat

SEQ ID NO: 2183454 - DNA, 15 bp, Homo sapiens
cttttagtacccacc

SEQ ID NO: 2183455 - DNA, 16 bp, Homo sapiens
cttttagtacccacct

SEQ ID NO: 2183456 - DNA, 17 bp, Homo sapiens
cttttagtacccacctg

SEQ ID NO: 2183457 - DNA, 21 bp, Homo sapiens
cttttcattctggatgggctt

SEQ ID NO: 2183458 - DNA, 13 bp, Homo sapiens
cttttctgtttga

SEQ ID NO: 2183459 - DNA, 19 bp, Homo sapiens
cttttgaactcacgagcct

SEQ ID NO: 2183460 - DNA, 18 bp, Homo sapiens
cttttgaataatgtagtg

SEQ ID NO: 2183461 - DNA, 17 bp, Homo sapiens
cttttgaccccttcctg

SEQ ID NO: 2183462 - DNA, 16 bp, Homo sapiens
cttttgcaaccaggaa

SEQ ID NO: 2183463 - DNA, 18 bp, Homo sapiens
cttttgcagcttccttcc

SEQ ID NO: 2183464 - DNA, 18 bp, Homo sapiens
cttttgcccgttgaggta

SEQ ID NO: 2183465 - DNA, 17 bp, Homo sapiens
cttttgtacccaatact

SEQ ID NO: 2183466 - DNA, 22 bp, Homo sapiens
cttttttttacggaattccaat

SEQ ID NO: 2183467 - DNA, 23 bp, Homo sapiens
cttttttttacggaattccaata

SEQ ID NO: 2183468 - DNA, 13 bp, Homo sapiens
gaaaaaaaaagaa

SEQ ID NO: 2183469 - DNA, 19 bp, Homo sapiens
gaaaaaaaaagaataatga

SEQ ID NO: 2183470 - DNA, 21 bp, Homo sapiens
gaaaaaagatttttaaaatga

SEQ ID NO: 2183471 - DNA, 20 bp, Homo sapiens
gaaaaattagatgactgaat

SEQ ID NO: 2183472 - DNA, 15 bp, Homo sapiens
gaaaacacatttctg

SEQ ID NO: 2183473 - DNA, 22 bp, Homo sapiens
gaaaacagaggccacactttct

SEQ ID NO: 2183474 - DNA, 19 bp, Homo sapiens
gaaaacatgtatgtttgct

SEQ ID NO: 2183475 - DNA, 16 bp, Homo sapiens
gaaaacccaagttttt

SEQ ID NO: 2183476 - DNA, 19 bp, Homo sapiens
gaaaacccaagtttttaat

SEQ ID NO: 2183477 - DNA, 21 bp, Homo sapiens
gaaaacgtatcacctttccca

SEQ ID NO: 2183478 - DNA, 13 bp, Homo sapiens
gaaaagaaaggct

SEQ ID NO: 2183479 - DNA, 16 bp, Homo sapiens
gaaaagattgcaaagg

SEQ ID NO: 2183480 - DNA, 17 bp, Homo sapiens
gaaaagtgttccttgct

SEQ ID NO: 2183481 - DNA, 16 bp, Homo sapiens
gaaaattgccaaaata

SEQ ID NO: 2183482 - DNA, 20 bp, Homo sapiens
gaaaattgccaaaatatatt

SEQ ID NO: 2183483 - DNA, 13 bp, Homo sapiens
gaaaattttatgt

SEQ ID NO: 2183484 - DNA, 16 bp, Homo sapiens
gaaacagctcagccag

SEQ ID NO: 2183485 - DNA, 15 bp, Homo sapiens
gaaacgtgccctctg

SEQ ID NO: 2183486 - DNA, 15 bp, Homo sapiens
gaaactgttggttga

SEQ ID NO: 2183487 - DNA, 22 bp, Homo sapiens
gaaacttcaagcaccagggaag

SEQ ID NO: 2183488 - DNA, 16 bp, Homo sapiens
gaaagaagggggccct

SEQ ID NO: 2183489 - DNA, 23 bp, Homo sapiens
gaaagaagggggccctgctacct

SEQ ID NO: 2183490 - DNA, 20 bp, Homo sapiens
gaaagaattgatcagaatcc

SEQ ID NO: 2183491 - DNA, 18 bp, Homo sapiens
gaaagagagaagccagcc

SEQ ID NO: 2183492 - DNA, 16 bp, Homo sapiens
gaaagaggcaccagga

SEQ ID NO: 2183493 - DNA, 20 bp, Homo sapiens
gaaagaggcaccaggaagcc

SEQ ID NO: 2183494 - DNA, 19 bp, Homo sapiens
gaaagaggttttcacaaat

SEQ ID NO: 2183495 - DNA, 20 bp, Homo sapiens
gaaagaggttttcacaaatg

SEQ ID NO: 2183496 - DNA, 24 bp, Homo sapiens
gaaagcatccattaattaatgaga

SEQ ID NO: 2183497 - DNA, 15 bp, Homo sapiens
gaaagctatgaatgt

SEQ ID NO: 2183498 - DNA, 19 bp, Homo sapiens
gaaagctgcttctggggga

SEQ ID NO: 2183499 - DNA, 20 bp, Homo sapiens
gaaagctgcttctgggggat

SEQ ID NO: 2183500 - DNA, 23 bp, Homo sapiens
gaaagctgcttctgggggatttc

SEQ ID NO: 2183501 - DNA, 14 bp, Homo sapiens
gaaagctgtgaaat

SEQ ID NO: 2183502 - DNA, 15 bp, Homo sapiens
gaaagctgtgaaatt

SEQ ID NO: 2183503 - DNA, 21 bp, Homo sapiens
gaaagctgtgaaattgaagtc

SEQ ID NO: 2183504 - DNA, 15 bp, Homo sapiens
gaaaggctaaacact

SEQ ID NO: 2183505 - DNA, 10 bp, Homo sapiens
gaaatagcta

SEQ ID NO: 2183506 - DNA, 12 bp, Homo sapiens
gaaatccagatc

SEQ ID NO: 2183507 - DNA, 15 bp, Homo sapiens
gaaatgggaacaata

SEQ ID NO: 2183508 - DNA, 16 bp, Homo sapiens
gaaattaaaattgcca

SEQ ID NO: 2183509 - DNA, 19 bp, Homo sapiens
gaaattacaagtttcagta

SEQ ID NO: 2183510 - DNA, 20 bp, Homo sapiens
gaaattacaagtttcagtaa

SEQ ID NO: 2183511 - DNA, 15 bp, Homo sapiens
gaaattagaagagcc

SEQ ID NO: 2183512 - DNA, 16 bp, Homo sapiens
gaaattagaagagcct

SEQ ID NO: 2183513 - DNA, 13 bp, Homo sapiens
gaaattgtatatt

SEQ ID NO: 2183514 - DNA, 19 bp, Homo sapiens
gaaattgtatattgtaatt

SEQ ID NO: 2183515 - DNA, 13 bp, Homo sapiens
gaaatttgttaat

SEQ ID NO: 2183516 - DNA, 19 bp, Homo sapiens
gaacaaaagcaggttttta

SEQ ID NO: 2183517 - DNA, 12 bp, Homo sapiens
gaacacacattg

SEQ ID NO: 2183518 - DNA, 22 bp, Homo sapiens
gaacaccacgcttgacaggaca

SEQ ID NO: 2183519 - DNA, 14 bp, Homo sapiens
gaacagatggctgt

SEQ ID NO: 2183520 - DNA, 16 bp, Homo sapiens
gaacagatggctgtga

SEQ ID NO: 2183521 - DNA, 22 bp, Homo sapiens
gaacagcagaaacccatgtgca

SEQ ID NO: 2183522 - DNA, 16 bp, Homo sapiens
gaacagttaagcagcc

SEQ ID NO: 2183523 - DNA, 20 bp, Homo sapiens
gaacagttaagcagccgcca

SEQ ID NO: 2183524 - DNA, 21 bp, Homo sapiens
gaacagttaagcagccgccac

SEQ ID NO: 2183525 - DNA, 21 bp, Homo sapiens
gaacatctgccttgctgcacc

SEQ ID NO: 2183526 - DNA, 19 bp, Homo sapiens
gaacattcagctctggaga

SEQ ID NO: 2183527 - DNA, 20 bp, Homo sapiens
gaacattcagctctggagaa

SEQ ID NO: 2183528 - DNA, 22 bp, Homo sapiens
gaacattcagctctggagaaca

SEQ ID NO: 2183529 - DNA, 17 bp, Homo sapiens
gaacctggaccaaagct

SEQ ID NO: 2183530 - DNA, 18 bp, Homo sapiens
gaacctggaccaaagctg

SEQ ID NO: 2183531 - DNA, 12 bp, Homo sapiens
gaacctggctgc

SEQ ID NO: 2183532 - DNA, 20 bp, Homo sapiens
gaacctggtggctggaggca

SEQ ID NO: 2183533 - DNA, 17 bp, Homo sapiens
gaactagtggtggctct

SEQ ID NO: 2183534 - DNA, 17 bp, Homo sapiens
gaactcacgagccttgc

SEQ ID NO: 2183535 - DNA, 13 bp, Homo sapiens
gaactcatttcaa

SEQ ID NO: 2183536 - DNA, 21 bp, Homo sapiens
gaactcccaagaacagcaggc

SEQ ID NO: 2183537 - DNA, 16 bp, Homo sapiens
gaactcctagactcaa

SEQ ID NO: 2183538 - DNA, 11 bp, Homo sapiens
gaactcctggg

SEQ ID NO: 2183539 - DNA, 14 bp, Homo sapiens
gaactcctgggctc

SEQ ID NO: 2183540 - DNA, 23 bp, Homo sapiens
gaactctcctatctgaacctact

SEQ ID NO: 2183541 - DNA, 22 bp, Homo sapiens
gaactcttcctggaatgcattc

SEQ ID NO: 2183542 - DNA, 22 bp, Homo sapiens
gaactgctaaatactgtacata

SEQ ID NO: 2183543 - DNA, 18 bp, Homo sapiens
gaactgtgcatcaaccag

SEQ ID NO: 2183544 - DNA, 22 bp, Homo sapiens
gaagaactctctagttccctca

SEQ ID NO: 2183545 - DNA, 16 bp, Homo sapiens
gaagaacttgaagtga

SEQ ID NO: 2183546 - DNA, 17 bp, Homo sapiens
gaagaatataatgggaa

SEQ ID NO: 2183547 - DNA, 16 bp, Homo sapiens
gaagagaatcaaggcc

SEQ ID NO: 2183548 - DNA, 13 bp, Homo sapiens
gaagagagcctgc

SEQ ID NO: 2183549 - DNA, 13 bp, Homo sapiens
gaagagggagaag

SEQ ID NO: 2183550 - DNA, 19 bp, Homo sapiens
gaagagggagaaggagagg

SEQ ID NO: 2183551 - DNA, 14 bp, Homo sapiens
gaagatcagaacat

SEQ ID NO: 2183552 - DNA, 21 bp, Homo sapiens
gaagatgtattcagagccacc

SEQ ID NO: 2183553 - DNA, 18 bp, Homo sapiens
gaagccacgtgctggaga

SEQ ID NO: 2183554 - DNA, 10 bp, Homo sapiens
gaagccagcc

SEQ ID NO: 2183555 - DNA, 11 bp, Homo sapiens
gaagccagcca

SEQ ID NO: 2183556 - DNA, 12 bp, Homo sapiens
gaagccagccac

SEQ ID NO: 2183557 - DNA, 18 bp, Homo sapiens
gaagccagccacagaccc

SEQ ID NO: 2183558 - DNA, 22 bp, Homo sapiens
gaagccagccacagacccctgg

SEQ ID NO: 2183559 - DNA, 19 bp, Homo sapiens
gaagcccatcctgaccagc

SEQ ID NO: 2183560 - DNA, 16 bp, Homo sapiens
gaagccgccaggaccg

SEQ ID NO: 2183561 - DNA, 23 bp, Homo sapiens
gaagccgccaggaccgccaaaga

SEQ ID NO: 2183562 - DNA, 12 bp, Homo sapiens
gaagcctgctga

SEQ ID NO: 2183563 - DNA, 17 bp, Homo sapiens
gaagctagctcccctcc

SEQ ID NO: 2183564 - DNA, 19 bp, Homo sapiens
gaagctagctcccctcctc

SEQ ID NO: 2183565 - DNA, 13 bp, Homo sapiens
gaagctcacgcct

SEQ ID NO: 2183566 - DNA, 19 bp, Homo sapiens
gaagctcagtttggctgta

SEQ ID NO: 2183567 - DNA, 11 bp, Homo sapiens
gaagctccagt

SEQ ID NO: 2183568 - DNA, 12 bp, Homo sapiens
gaagctcctggt

SEQ ID NO: 2183569 - DNA, 11 bp, Homo sapiens
gaagctgggga

SEQ ID NO: 2183570 - DNA, 17 bp, Homo sapiens
gaagctggggacagctt

SEQ ID NO: 2183571 - DNA, 18 bp, Homo sapiens
gaagctgttttgagccag

SEQ ID NO: 2183572 - DNA, 21 bp, Homo sapiens
gaagctttctctgcttcagct

SEQ ID NO: 2183573 - DNA, 22 bp, Homo sapiens
gaaggaaagaagggggccctgc

SEQ ID NO: 2183574 - DNA, 12 bp, Homo sapiens
gaaggagcctgc

SEQ ID NO: 2183575 - DNA, 18 bp, Homo sapiens
gaaggcaagctggcagga

SEQ ID NO: 2183576 - DNA, 21 bp, Homo sapiens
gaaggcaagctggcaggaggg

SEQ ID NO: 2183577 - DNA, 13 bp, Homo sapiens
gaaggcagtggca

SEQ ID NO: 2183578 - DNA, 21 bp, Homo sapiens
gaaggcagtggcaggggagca

SEQ ID NO: 2183579 - DNA, 22 bp, Homo sapiens
gaaggcagtggcaggggagcag

SEQ ID NO: 2183580 - DNA, 17 bp, Homo sapiens
gaaggccacctgcaggt

SEQ ID NO: 2183581 - DNA, 23 bp, Homo sapiens
gaaggcccctctccgcaaggtgg

SEQ ID NO: 2183582 - DNA, 14 bp, Homo sapiens
gaagggggccctgc

SEQ ID NO: 2183583 - DNA, 15 bp, Homo sapiens
gaaggtcacagaagt

SEQ ID NO: 2183584 - DNA, 16 bp, Homo sapiens
gaagtatctgtacctg

SEQ ID NO: 2183585 - DNA, 13 bp, Homo sapiens
gaagtatgcacta

SEQ ID NO: 2183586 - DNA, 18 bp, Homo sapiens
gaagtcggccaggtagga

SEQ ID NO: 2183587 - DNA, 22 bp, Homo sapiens
gaagtcttccatcagcagtgat

SEQ ID NO: 2183588 - DNA, 23 bp, Homo sapiens
gaagtgggagtgggagaggaagc

SEQ ID NO: 2183589 - DNA, 13 bp, Homo sapiens
gaagtgtgttttg

SEQ ID NO: 2183590 - DNA, 12 bp, Homo sapiens
gaagttgttagt

SEQ ID NO: 2183591 - DNA, 12 bp, Homo sapiens
gaataaaaggat

SEQ ID NO: 2183592 - DNA, 13 bp, Homo sapiens
gaataaagaacat

SEQ ID NO: 2183593 - DNA, 22 bp, Homo sapiens
gaataatgacgtattgtgaaat

SEQ ID NO: 2183594 - DNA, 13 bp, Homo sapiens
gaataatgtagtg

SEQ ID NO: 2183595 - DNA, 14 bp, Homo sapiens
gaataatgtagtgc

SEQ ID NO: 2183596 - DNA, 23 bp, Homo sapiens
gaatactaataaaatacatacta

SEQ ID NO: 2183597 - DNA, 13 bp, Homo sapiens
gaatagaataaat

SEQ ID NO: 2183598 - DNA, 14 bp, Homo sapiens
gaatagcagtttca

SEQ ID NO: 2183599 - DNA, 21 bp, Homo sapiens
gaatcactcatttatttccat

SEQ ID NO: 2183600 - DNA, 22 bp, Homo sapiens
gaatcaggaggagattaacaca

SEQ ID NO: 2183601 - DNA, 16 bp, Homo sapiens
gaatcccttaacagtt

SEQ ID NO: 2183602 - DNA, 21 bp, Homo sapiens
gaatcccttaacagttgtatt

SEQ ID NO: 2183603 - DNA, 15 bp, Homo sapiens
gaatcggtgctgtca

SEQ ID NO: 2183604 - DNA, 16 bp, Homo sapiens
gaatgcctcgctccct

SEQ ID NO: 2183605 - DNA, 20 bp, Homo sapiens
gaatgcctcgctcccttcaa

SEQ ID NO: 2183606 - DNA, 21 bp, Homo sapiens
gaatgcctcgctcccttcaag

SEQ ID NO: 2183607 - DNA, 16 bp, Homo sapiens
gaatggaaacttggaa

SEQ ID NO: 2183608 - DNA, 23 bp, Homo sapiens
gaatgtagaagtggcatctgaaa

SEQ ID NO: 2183609 - DNA, 15 bp, Homo sapiens
gaatgtccccttagg

SEQ ID NO: 2183610 - DNA, 11 bp, Homo sapiens
gaattaaaata

SEQ ID NO: 2183611 - DNA, 12 bp, Homo sapiens
gaattaaaattt

SEQ ID NO: 2183612 - DNA, 13 bp, Homo sapiens
gaattaaaattta

SEQ ID NO: 2183613 - DNA, 14 bp, Homo sapiens
gaattcagtgcctt

SEQ ID NO: 2183614 - DNA, 17 bp, Homo sapiens
gaattcagtgccttcaa

SEQ ID NO: 2183615 - DNA, 14 bp, Homo sapiens
gaattccaatattt

SEQ ID NO: 2183616 - DNA, 16 bp, Homo sapiens
gaattgatcagaatcc

SEQ ID NO: 2183617 - DNA, 17 bp, Homo sapiens
gaattttctaaaagcca

SEQ ID NO: 2183618 - DNA, 16 bp, Homo sapiens
gacaaaccactgtaca

SEQ ID NO: 2183619 - DNA, 15 bp, Homo sapiens
gacaaatgggactga

SEQ ID NO: 2183620 - DNA, 16 bp, Homo sapiens
gacaaatgggactgat

SEQ ID NO: 2183621 - DNA, 21 bp, Homo sapiens
gacaaccctgaggtatctgtg

SEQ ID NO: 2183622 - DNA, 16 bp, Homo sapiens
gacaatgcagatgcca

SEQ ID NO: 2183623 - DNA, 21 bp, Homo sapiens
gacacaaaggacaaaaatata

SEQ ID NO: 2183624 - DNA, 21 bp, Homo sapiens
gacacagagtggagccctcag

SEQ ID NO: 2183625 - DNA, 13 bp, Homo sapiens
gacacctcagagc

SEQ ID NO: 2183626 - DNA, 19 bp, Homo sapiens
gacagccggatcttggaga

SEQ ID NO: 2183627 - DNA, 21 bp, Homo sapiens
gacagcgggtaaaaagagaag

SEQ ID NO: 2183628 - DNA, 15 bp, Homo sapiens
gacagctttcctggg

SEQ ID NO: 2183629 - DNA, 15 bp, Homo sapiens
gacaggaccctcagg

SEQ ID NO: 2183630 - DNA, 18 bp, Homo sapiens
gacatccaggatggctgc

SEQ ID NO: 2183631 - DNA, 22 bp, Homo sapiens
gacatgtgctctggggaattct

SEQ ID NO: 2183632 - DNA, 20 bp, Homo sapiens
gacatttcatataaatggaa

SEQ ID NO: 2183633 - DNA, 20 bp, Homo sapiens
gacatttgtcctgcagagct

SEQ ID NO: 2183634 - DNA, 22 bp, Homo sapiens
gacatttgtcctgcagagctgg

SEQ ID NO: 2183635 - DNA, 23 bp, Homo sapiens
gacatttgtcctgcagagctggg

SEQ ID NO: 2183636 - DNA, 15 bp, Homo sapiens
gacattttgccaaaa

SEQ ID NO: 2183637 - DNA, 17 bp, Homo sapiens
gacattttgccaaaatt

SEQ ID NO: 2183638 - DNA, 13 bp, Homo sapiens
gaccaaaatcccc

SEQ ID NO: 2183639 - DNA, 17 bp, Homo sapiens
gaccaaaatccccttct

SEQ ID NO: 2183640 - DNA, 16 bp, Homo sapiens
gaccaagccggtgccc

SEQ ID NO: 2183641 - DNA, 15 bp, Homo sapiens
gaccagagctctgga

SEQ ID NO: 2183642 - DNA, 21 bp, Homo sapiens
gaccagaggtgggaggcccct

SEQ ID NO: 2183643 - DNA, 15 bp, Homo sapiens
gaccagcactgaccc

SEQ ID NO: 2183644 - DNA, 12 bp, Homo sapiens
gaccagcctttc

SEQ ID NO: 2183645 - DNA, 16 bp, Homo sapiens
gaccagcctttcttcc

SEQ ID NO: 2183646 - DNA, 14 bp, Homo sapiens
gaccagtttcttaa

SEQ ID NO: 2183647 - DNA, 13 bp, Homo sapiens
gaccagtttcttt

SEQ ID NO: 2183648 - DNA, 20 bp, Homo sapiens
gaccccgcacccggctcgtg

SEQ ID NO: 2183649 - DNA, 13 bp, Homo sapiens
gacccctgggagc

SEQ ID NO: 2183650 - DNA, 13 bp, Homo sapiens
gaccccttcctgt

SEQ ID NO: 2183651 - DNA, 22 bp, Homo sapiens
gacccggcccccgccctctgcc

SEQ ID NO: 2183652 - DNA, 17 bp, Homo sapiens
gaccctatgaccaaaac

SEQ ID NO: 2183653 - DNA, 22 bp, Homo sapiens
gaccctcaggaattcagtgcct

SEQ ID NO: 2183654 - DNA, 11 bp, Homo sapiens
gaccctccctt

SEQ ID NO: 2183655 - DNA, 22 bp, Homo sapiens
gaccctcgagattaacggtgct

SEQ ID NO: 2183656 - DNA, 12 bp, Homo sapiens
gaccggcctgga

SEQ ID NO: 2183657 - DNA, 19 bp, Homo sapiens
gacctaaaatttgccctcc

SEQ ID NO: 2183658 - DNA, 18 bp, Homo sapiens
gacctaggatatcttctc

SEQ ID NO: 2183659 - DNA, 22 bp, Homo sapiens
gacctcaaaataagccatgctg

SEQ ID NO: 2183660 - DNA, 17 bp, Homo sapiens
gacctcagtttctgttg

SEQ ID NO: 2183661 - DNA, 10 bp, Homo sapiens
gacctctggg

SEQ ID NO: 2183662 - DNA, 14 bp, Homo sapiens
gacctggaaccaga

SEQ ID NO: 2183663 - DNA, 16 bp, Homo sapiens
gaccttcaccaaacat

SEQ ID NO: 2183664 - DNA, 18 bp, Homo sapiens
gaccttctcttagattat

SEQ ID NO: 2183665 - DNA, 21 bp, Homo sapiens
gaccttgatgtcttgagagcg

SEQ ID NO: 2183666 - DNA, 21 bp, Homo sapiens
gacgaggggcagggaaggaca

SEQ ID NO: 2183667 - DNA, 18 bp, Homo sapiens
gacgctaataaaaattta

SEQ ID NO: 2183668 - DNA, 20 bp, Homo sapiens
gacgggggttggggtggggc

SEQ ID NO: 2183669 - DNA, 10 bp, Homo sapiens
gactaacctt

SEQ ID NO: 2183670 - DNA, 23 bp, Homo sapiens
gactaagagaagttgtaaagtat

SEQ ID NO: 2183671 - DNA, 19 bp, Homo sapiens
gactcccaaagagctgcct

SEQ ID NO: 2183672 - DNA, 17 bp, Homo sapiens
gactcctgctggtacct

SEQ ID NO: 2183673 - DNA, 19 bp, Homo sapiens
gactcctgctggtacctgc

SEQ ID NO: 2183674 - DNA, 19 bp, Homo sapiens
ctgctggccgggcacagct

SEQ ID NO: 2183675 - DNA, 21 bp, Homo sapiens
ctgctggccgggcacagctgt

SEQ ID NO: 2183676 - DNA, 21 bp, Homo sapiens
ctgctgggtttccacacagcc

SEQ ID NO: 2183677 - DNA, 22 bp, Homo sapiens
ctgctgggtttccacacagcct

SEQ ID NO: 2183678 - DNA, 15 bp, Homo sapiens
ctgctggtacctgcc

SEQ ID NO: 2183679 - DNA, 18 bp, Homo sapiens
ctgctggtacctgccctc

SEQ ID NO: 2183680 - DNA, 17 bp, Homo sapiens
ctgctggtcttatcctg

SEQ ID NO: 2183681 - DNA, 19 bp, Homo sapiens
ctgctggttttggtttcca

SEQ ID NO: 2183682 - DNA, 23 bp, Homo sapiens
ctgctgtcagaccttcttccaca

SEQ ID NO: 2183683 - DNA, 19 bp, Homo sapiens
ctgctgtgggtcagtgtgc

SEQ ID NO: 2183684 - DNA, 14 bp, Homo sapiens
ctgcttctggggga

SEQ ID NO: 2183685 - DNA, 23 bp, Homo sapiens
ctggaaatgcatgacttccctcc

SEQ ID NO: 2183686 - DNA, 16 bp, Homo sapiens
ctggaagcctgctgat

SEQ ID NO: 2183687 - DNA, 16 bp, Homo sapiens
ctggaatgcattcact

SEQ ID NO: 2183688 - DNA, 12 bp, Homo sapiens
ctggaatttatt

SEQ ID NO: 2183689 - DNA, 21 bp, Homo sapiens
ctggacagcggttgtaaatac

SEQ ID NO: 2183690 - DNA, 16 bp, Homo sapiens
ctggacaggtctggga

SEQ ID NO: 2183691 - DNA, 14 bp, Homo sapiens
ctggacatattccc

SEQ ID NO: 2183692 - DNA, 21 bp, Homo sapiens
ctggacatgagagccccttgg

SEQ ID NO: 2183693 - DNA, 20 bp, Homo sapiens
ctggacatttcatataaatg

SEQ ID NO: 2183694 - DNA, 13 bp, Homo sapiens
ctggaccaaagct

SEQ ID NO: 2183695 - DNA, 14 bp, Homo sapiens
ctggaccaaagctg

SEQ ID NO: 2183696 - DNA, 12 bp, Homo sapiens
ctggagaaagag

SEQ ID NO: 2183697 - DNA, 14 bp, Homo sapiens
ctggagaacagtgg

SEQ ID NO: 2183698 - DNA, 16 bp, Homo sapiens
ctggagagtctcactc

SEQ ID NO: 2183699 - DNA, 22 bp, Homo sapiens
ctggagccacctgtcccacctc

SEQ ID NO: 2183700 - DNA, 23 bp, Homo sapiens
ctggagccacctgtcccacctca

SEQ ID NO: 2183701 - DNA, 18 bp, Homo sapiens
ctggagctcctgggaagg

SEQ ID NO: 2183702 - DNA, 18 bp, Homo sapiens
ctggaggcattcccagag

SEQ ID NO: 2183703 - DNA, 21 bp, Homo sapiens
ctggaggcattcccagaggtg

SEQ ID NO: 2183704 - DNA, 22 bp, Homo sapiens
ctggaggcattcccagaggtgg

SEQ ID NO: 2183705 - DNA, 15 bp, Homo sapiens
ctggaggtctccagg

SEQ ID NO: 2183706 - DNA, 23 bp, Homo sapiens
ctggaggtctccaggggcctgca

SEQ ID NO: 2183707 - DNA, 14 bp, Homo sapiens
ctggatgagaaaca

SEQ ID NO: 2183708 - DNA, 15 bp, Homo sapiens
ctggatgagaaacag

SEQ ID NO: 2183709 - DNA, 19 bp, Homo sapiens
ctggcaaggactttgtaca

SEQ ID NO: 2183710 - DNA, 16 bp, Homo sapiens
ctggcacagacttcac

SEQ ID NO: 2183711 - DNA, 12 bp, Homo sapiens
ctggcaccaaca

SEQ ID NO: 2183712 - DNA, 19 bp, Homo sapiens
ctggcaggagggtggcact

SEQ ID NO: 2183713 - DNA, 14 bp, Homo sapiens
ctggcaggatcaca

SEQ ID NO: 2183714 - DNA, 15 bp, Homo sapiens
ctggcaggatcacag

SEQ ID NO: 2183715 - DNA, 17 bp, Homo sapiens
ctggcaggatcacagct

SEQ ID NO: 2183716 - DNA, 19 bp, Homo sapiens
ctggcaggatcacagctca

SEQ ID NO: 2183717 - DNA, 14 bp, Homo sapiens
ctggcatctctgga

SEQ ID NO: 2183718 - DNA, 17 bp, Homo sapiens
ctggcatctctggagtg

SEQ ID NO: 2183719 - DNA, 13 bp, Homo sapiens
ctggccaccaccc

SEQ ID NO: 2183720 - DNA, 20 bp, Homo sapiens
ctggccaccaccccccactc

SEQ ID NO: 2183721 - DNA, 13 bp, Homo sapiens
ctggccatctctg

SEQ ID NO: 2183722 - DNA, 12 bp, Homo sapiens
ctggccctgttg

SEQ ID NO: 2183723 - DNA, 13 bp, Homo sapiens
ctggccctgttgt

SEQ ID NO: 2183724 - DNA, 20 bp, Homo sapiens
ctggccgggttggaggcctc

SEQ ID NO: 2183725 - DNA, 23 bp, Homo sapiens
ctggcctagtcccttccacaccc

SEQ ID NO: 2183726 - DNA, 12 bp, Homo sapiens
ctggcctcagac

SEQ ID NO: 2183727 - DNA, 12 bp, Homo sapiens
ctggcctcttcc

SEQ ID NO: 2183728 - DNA, 22 bp, Homo sapiens
ctggcctcttcctccctccctg

SEQ ID NO: 2183729 - DNA, 18 bp, Homo sapiens
ctggcggaacctggctgc

SEQ ID NO: 2183730 - DNA, 19 bp, Homo sapiens
ctggcggaacctggctgcg

SEQ ID NO: 2183731 - DNA, 19 bp, Homo sapiens
ctggcgtggggggagctct

SEQ ID NO: 2183732 - DNA, 22 bp, Homo sapiens
ctggcgtggggggagctctggt

SEQ ID NO: 2183733 - DNA, 18 bp, Homo sapiens
ctggctcacagactggag

SEQ ID NO: 2183734 - DNA, 16 bp, Homo sapiens
ctggctccctgggacc

SEQ ID NO: 2183735 - DNA, 13 bp, Homo sapiens
ctggctcctgtgt

SEQ ID NO: 2183736 - DNA, 16 bp, Homo sapiens
ctggctgcctggccca

SEQ ID NO: 2183737 - DNA, 15 bp, Homo sapiens
ctggctttgcccaac

SEQ ID NO: 2183738 - DNA, 19 bp, Homo sapiens
ctggctttgcccaacctca

SEQ ID NO: 2183739 - DNA, 21 bp, Homo sapiens
ctggctttgcccaacctcagc

SEQ ID NO: 2183740 - DNA, 22 bp, Homo sapiens
ctggctttgcccaacctcagca

SEQ ID NO: 2183741 - DNA, 19 bp, Homo sapiens
ctggctttgtcccacagct

SEQ ID NO: 2183742 - DNA, 19 bp, Homo sapiens
ctgggaaccttcctgtctt

SEQ ID NO: 2183743 - DNA, 19 bp, Homo sapiens
ctgggagagccaaggccta

SEQ ID NO: 2183744 - DNA, 23 bp, Homo sapiens
ctgggagaggcagagtgccccac

SEQ ID NO: 2183745 - DNA, 21 bp, Homo sapiens
ctgggcaaggtgagggatgcc

SEQ ID NO: 2183746 - DNA, 15 bp, Homo sapiens
ctgggcactcctccc

SEQ ID NO: 2183747 - DNA, 12 bp, Homo sapiens
ctgggcactttt

SEQ ID NO: 2183748 - DNA, 15 bp, Homo sapiens
ctgggcagaggggag

SEQ ID NO: 2183749 - DNA, 18 bp, Homo sapiens
ctgggcagaggggagagg

SEQ ID NO: 2183750 - DNA, 21 bp, Homo sapiens
ctgggcagaggggagaggaag

SEQ ID NO: 2183751 - DNA, 24 bp, Homo sapiens
ctgggcctcctctaacaggggctg

SEQ ID NO: 2183752 - DNA, 20 bp, Homo sapiens
ctgggcttatatctggcctc

SEQ ID NO: 2183753 - DNA, 20 bp, Homo sapiens
ctggggacagctttcctggg

SEQ ID NO: 2183754 - DNA, 20 bp, Homo sapiens
ctggggatgtaaccaagctg

SEQ ID NO: 2183755 - DNA, 15 bp, Homo sapiens
ctggggccccaccgt

SEQ ID NO: 2183756 - DNA, 13 bp, Homo sapiens
ctggggcctggac

SEQ ID NO: 2183757 - DNA, 15 bp, Homo sapiens
ctggggcctggactg

SEQ ID NO: 2183758 - DNA, 13 bp, Homo sapiens
ctggggctcagcc

SEQ ID NO: 2183759 - DNA, 14 bp, Homo sapiens
ctggggctcagccc

SEQ ID NO: 2183760 - DNA, 16 bp, Homo sapiens
ctgggggcctcactcc

SEQ ID NO: 2183761 - DNA, 21 bp, Homo sapiens
ctggggggaaggcgatgtggt

SEQ ID NO: 2183762 - DNA, 16 bp, Homo sapiens
ctgggggtcaggaggc

SEQ ID NO: 2183763 - DNA, 15 bp, Homo sapiens
ctgggggtgccaacc

SEQ ID NO: 2183764 - DNA, 14 bp, Homo sapiens
ctggggtgccctcc

SEQ ID NO: 2183765 - DNA, 21 bp, Homo sapiens
ctggggtgccctccactgccc

SEQ ID NO: 2183766 - DNA, 23 bp, Homo sapiens
ctggggtgccctccactgccctc

SEQ ID NO: 2183767 - DNA, 15 bp, Homo sapiens
ctggggtttttttca

SEQ ID NO: 2183768 - DNA, 20 bp, Homo sapiens
ctgggtaggttctgaacagc

SEQ ID NO: 2183769 - DNA, 22 bp, Homo sapiens
ctgggtcaaagtggtacaggaa

SEQ ID NO: 2183770 - DNA, 19 bp, Homo sapiens
ctgggtgtattaggactgg

SEQ ID NO: 2183771 - DNA, 17 bp, Homo sapiens
ctgggtttccacacagc

SEQ ID NO: 2183772 - DNA, 22 bp, Homo sapiens
ctgggtttccacacagcctgtc

SEQ ID NO: 2183773 - DNA, 13 bp, Homo sapiens
ctggtacctgccc

SEQ ID NO: 2183774 - DNA, 14 bp, Homo sapiens
ctggtacctgccct

SEQ ID NO: 2183775 - DNA, 16 bp, Homo sapiens
ctggtacctgccctct

SEQ ID NO: 2183776 - DNA, 23 bp, Homo sapiens
ctggtaggaagaggtaccacagg

SEQ ID NO: 2183777 - DNA, 14 bp, Homo sapiens
ctggtaggttctgt

SEQ ID NO: 2183778 - DNA, 22 bp, Homo sapiens
ctggtctcctcccaaaatacta

SEQ ID NO: 2183779 - DNA, 22 bp, Homo sapiens
ctggtggcatggaagagggagg

SEQ ID NO: 2183780 - DNA, 16 bp, Homo sapiens
ctggtggctggaggca

SEQ ID NO: 2183781 - DNA, 21 bp, Homo sapiens
ctggtgggcaccaagagccaa

SEQ ID NO: 2183782 - DNA, 15 bp, Homo sapiens
ctggttagctcagcc

SEQ ID NO: 2183783 - DNA, 22 bp, Homo sapiens
ctggttgccacatcttagcaag

SEQ ID NO: 2183784 - DNA, 13 bp, Homo sapiens
ctggttggaggcc

SEQ ID NO: 2183785 - DNA, 14 bp, Homo sapiens
ctgtaactgcatta

SEQ ID NO: 2183786 - DNA, 22 bp, Homo sapiens
ctgtacatatatatgccttatg

SEQ ID NO: 2183787 - DNA, 19 bp, Homo sapiens
gaggagagaatgagagagt

SEQ ID NO: 2183788 - DNA, 21 bp, Homo sapiens
gaggagcctgtgcgtcccagc

SEQ ID NO: 2183789 - DNA, 22 bp, Homo sapiens
gaggagcctgtgcgtcccagct

SEQ ID NO: 2183790 - DNA, 18 bp, Homo sapiens
gaggcagaaagcagaggc

SEQ ID NO: 2183791 - DNA, 21 bp, Homo sapiens
gaggcagaaagcagaggctgg

SEQ ID NO: 2183792 - DNA, 14 bp, Homo sapiens
gaggcagaacctgg

SEQ ID NO: 2183793 - DNA, 15 bp, Homo sapiens
gaggcaggggctggg

SEQ ID NO: 2183794 - DNA, 14 bp, Homo sapiens
gaggcagtggcagc

SEQ ID NO: 2183795 - DNA, 19 bp, Homo sapiens
gaggcattcccagaggtgg

SEQ ID NO: 2183796 - DNA, 19 bp, Homo sapiens
gaggccacactttctggga

SEQ ID NO: 2183797 - DNA, 10 bp, Homo sapiens
gaggccacgg

SEQ ID NO: 2183798 - DNA, 20 bp, Homo sapiens
gaggcccagcagagccgttc

SEQ ID NO: 2183799 - DNA, 13 bp, Homo sapiens
gaggccctaggcg

SEQ ID NO: 2183800 - DNA, 16 bp, Homo sapiens
cctggaccagatgctg

SEQ ID NO: 2183801 - DNA, 20 bp, Homo sapiens
cctggatgagaaacagctca

SEQ ID NO: 2183802 - DNA, 23 bp, Homo sapiens
cctggatgggggtgcaggcagcc

SEQ ID NO: 2183803 - DNA, 17 bp, Homo sapiens
cctggccaccacccccc

SEQ ID NO: 2183804 - DNA, 21 bp, Homo sapiens
cctggccaccaccccccactc

SEQ ID NO: 2183805 - DNA, 13 bp, Homo sapiens
cctggccatctct

SEQ ID NO: 2183806 - DNA, 13 bp, Homo sapiens
cctggcccaggga

SEQ ID NO: 2183807 - DNA, 15 bp, Homo sapiens
cctggcgcctggcag

SEQ ID NO: 2183808 - DNA, 19 bp, Homo sapiens
cctggctgcgaactgtgca

SEQ ID NO: 2183809 - DNA, 20 bp, Homo sapiens
cctggctgcgaactgtgcag

SEQ ID NO: 2183810 - DNA, 13 bp, Homo sapiens
cctgggaatttca

SEQ ID NO: 2183811 - DNA, 14 bp, Homo sapiens
cctgggaatttcag

SEQ ID NO: 2183812 - DNA, 21 bp, Homo sapiens
cctgggcaaatgaatggctca

SEQ ID NO: 2183813 - DNA, 23 bp, Homo sapiens
cctgggctcaagcaatcctcctg

SEQ ID NO: 2183814 - DNA, 19 bp, Homo sapiens
cctggggatgtaaccaagc

SEQ ID NO: 2183815 - DNA, 13 bp, Homo sapiens
cctggggtgggga

SEQ ID NO: 2183816 - DNA, 24 bp, Homo sapiens
cctggggtggggaggcagagggtc

SEQ ID NO: 2183817 - DNA, 23 bp, Homo sapiens
cctgggtcaaagtggtacaggaa

SEQ ID NO: 2183818 - DNA, 14 bp, Homo sapiens
cctggtccagattg

SEQ ID NO: 2183819 - DNA, 21 bp, Homo sapiens
cctggtgaggaagctccagtc

SEQ ID NO: 2183820 - DNA, 19 bp, Homo sapiens
cctggtggcatggaagagg

SEQ ID NO: 2183821 - DNA, 13 bp, Homo sapiens
cctggtggctgga

SEQ ID NO: 2183822 - DNA, 19 bp, Homo sapiens
cctgtccaggatcaaaaga

SEQ ID NO: 2183823 - DNA, 12 bp, Homo sapiens
cctgtcccacct

SEQ ID NO: 2183824 - DNA, 13 bp, Homo sapiens
cctgtcccacctc

SEQ ID NO: 2183825 - DNA, 14 bp, Homo sapiens
cctgtccctggcca

SEQ ID NO: 2183826 - DNA, 15 bp, Homo sapiens
cctgtccctggccat

SEQ ID NO: 2183827 - DNA, 15 bp, Homo sapiens
cctgtccgccctctt

SEQ ID NO: 2183828 - DNA, 20 bp, Homo sapiens
cctgtcctcccacccctccc

SEQ ID NO: 2183829 - DNA, 22 bp, Homo sapiens
cctgtccttcccacggccactg

SEQ ID NO: 2183830 - DNA, 23 bp, Homo sapiens
cctgtctaggtcagtacccacct

SEQ ID NO: 2183831 - DNA, 15 bp, Homo sapiens
cctgtctcccctctg

SEQ ID NO: 2183832 - DNA, 20 bp, Homo sapiens
cctgtctgcgccgctgtgct

SEQ ID NO: 2183833 - DNA, 21 bp, Homo sapiens
cctgtctgcgccgctgtgctg

SEQ ID NO: 2183834 - DNA, 16 bp, Homo sapiens
cctgtcttcagatcct

SEQ ID NO: 2183835 - DNA, 15 bp, Homo sapiens
cctgtcttggcctcc

SEQ ID NO: 2183836 - DNA, 17 bp, Homo sapiens
cctgtgaatcatatgtt

SEQ ID NO: 2183837 - DNA, 18 bp, Homo sapiens
cctgtgcccttgctgggt

SEQ ID NO: 2183838 - DNA, 12 bp, Homo sapiens
cctgtgggagaa

SEQ ID NO: 2183839 - DNA, 17 bp, Homo sapiens
cctgtgtattaaacctt

SEQ ID NO: 2183840 - DNA, 23 bp, Homo sapiens
cctgtgtccacatctaacaaagt

SEQ ID NO: 2183841 - DNA, 15 bp, Homo sapiens
cctgttcaaaatgtt

SEQ ID NO: 2183842 - DNA, 19 bp, Homo sapiens
cctgttcttgggcctcagg

SEQ ID NO: 2183843 - DNA, 23 bp, Homo sapiens
cctgttcttgggcctcaggctct

SEQ ID NO: 2183844 - DNA, 11 bp, Homo sapiens
cctgtttctaa

SEQ ID NO: 2183845 - DNA, 23 bp, Homo sapiens
cctgttttattgagttctgaagg

SEQ ID NO: 2183846 - DNA, 20 bp, Homo sapiens
ccttaaaaattagaacttga

SEQ ID NO: 2183847 - DNA, 22 bp, Homo sapiens
ccttaaagtcagtaacttaccc

SEQ ID NO: 2183848 - DNA, 17 bp, Homo sapiens
ccttaacagttgtattt

SEQ ID NO: 2183849 - DNA, 14 bp, Homo sapiens
gcattactctgcac

SEQ ID NO: 2183850 - DNA, 15 bp, Homo sapiens
gcattattttttgtt

SEQ ID NO: 2183851 - DNA, 22 bp, Homo sapiens
gcattcgcagcagctccgcctg

SEQ ID NO: 2183852 - DNA, 22 bp, Homo sapiens
gcattcgcagtgcccagtgatg

SEQ ID NO: 2183853 - DNA, 16 bp, Homo sapiens
gcattgtaaacataaa

SEQ ID NO: 2183854 - DNA, 19 bp, Homo sapiens
gcatttaatgtagccatgg

SEQ ID NO: 2183855 - DNA, 22 bp, Homo sapiens
gcattttctgggttctgggtgg

SEQ ID NO: 2183856 - DNA, 14 bp, Homo sapiens
gcattttgtgtctt

SEQ ID NO: 2183857 - DNA, 13 bp, Homo sapiens
gccaaaatatatt

SEQ ID NO: 2183858 - DNA, 21 bp, Homo sapiens
gccaaagacctcccaagctgt

SEQ ID NO: 2183859 - DNA, 14 bp, Homo sapiens
gccaactaatttta

SEQ ID NO: 2183860 - DNA, 19 bp, Homo sapiens
gccaacttttagtgggtga

SEQ ID NO: 2183861 - DNA, 15 bp, Homo sapiens
gccaagaactctggg

SEQ ID NO: 2183862 - DNA, 17 bp, Homo sapiens
gccaagaactctgggca

SEQ ID NO: 2183863 - DNA, 15 bp, Homo sapiens
gccaagaagcagtgg

SEQ ID NO: 2183864 - DNA, 19 bp, Homo sapiens
gccaagaagcagtggcctt

SEQ ID NO: 2183865 - DNA, 20 bp, Homo sapiens
gccaagaccatttcacagaa

SEQ ID NO: 2183866 - DNA, 22 bp, Homo sapiens
gccaagcatttaatgtagccat

SEQ ID NO: 2183867 - DNA, 20 bp, Homo sapiens
gccaagccagattctcttga

SEQ ID NO: 2183868 - DNA, 14 bp, Homo sapiens
gccaaggtgccacc

SEQ ID NO: 2183869 - DNA, 22 bp, Homo sapiens
gccaaggtgccaccaccctgcc

SEQ ID NO: 2183870 - DNA, 17 bp, Homo sapiens
gccaatggaacctcctt

SEQ ID NO: 2183871 - DNA, 20 bp, Homo sapiens
gccaatggaacctcctttct

SEQ ID NO: 2183872 - DNA, 16 bp, Homo sapiens
gccacagccagaaccc

SEQ ID NO: 2183873 - DNA, 15 bp, Homo sapiens
gccaccaagggcctc

SEQ ID NO: 2183874 - DNA, 20 bp, Homo sapiens
gccaccacacccagcctctg

SEQ ID NO: 2183875 - DNA, 15 bp, Homo sapiens
gccaccacactcagc

SEQ ID NO: 2183876 - DNA, 13 bp, Homo sapiens
gccaccacccccc

SEQ ID NO: 2183877 - DNA, 13 bp, Homo sapiens
gccaccaccctgc

SEQ ID NO: 2183878 - DNA, 19 bp, Homo sapiens
gccaccctaactgagctgc

SEQ ID NO: 2183879 - DNA, 20 bp, Homo sapiens
gccaccctaactgagctgcc

SEQ ID NO: 2183880 - DNA, 13 bp, Homo sapiens
gccaccctctgca

SEQ ID NO: 2183881 - DNA, 20 bp, Homo sapiens
gccaccctctgcagggcagc

SEQ ID NO: 2183882 - DNA, 19 bp, Homo sapiens
gccacctgtcccacctcaa

SEQ ID NO: 2183883 - DNA, 20 bp, Homo sapiens
gccacggcctggctggtggg

SEQ ID NO: 2183884 - DNA, 12 bp, Homo sapiens
gccacgggggag

SEQ ID NO: 2183885 - DNA, 18 bp, Homo sapiens
gccacgtgctggagagta

SEQ ID NO: 2183886 - DNA, 14 bp, Homo sapiens
gccactaggctggg

SEQ ID NO: 2183887 - DNA, 20 bp, Homo sapiens
gccactaggctgggtgccca

SEQ ID NO: 2183888 - DNA, 16 bp, Homo sapiens
gccactgacctcccac

SEQ ID NO: 2183889 - DNA, 16 bp, Homo sapiens
gccactgtgcccagca

SEQ ID NO: 2183890 - DNA, 22 bp, Homo sapiens
gccactgttttgttggcccaca

SEQ ID NO: 2183891 - DNA, 15 bp, Homo sapiens
gccagaaccccgagc

SEQ ID NO: 2183892 - DNA, 14 bp, Homo sapiens
gccagaccagagct

SEQ ID NO: 2183893 - DNA, 13 bp, Homo sapiens
gccagattctctt

SEQ ID NO: 2183894 - DNA, 16 bp, Homo sapiens
gccagattctcttgaa

SEQ ID NO: 2183895 - DNA, 17 bp, Homo sapiens
gccagcatttcctcagt

SEQ ID NO: 2183896 - DNA, 15 bp, Homo sapiens
gccagccacagaccc

SEQ ID NO: 2183897 - DNA, 20 bp, Homo sapiens
gccagccacagacccctggg

SEQ ID NO: 2183898 - DNA, 21 bp, Homo sapiens
gccagccacagacccctggga

SEQ ID NO: 2183899 - DNA, 16 bp, Homo sapiens
gccagccctaggctac

SEQ ID NO: 2183900 - DNA, 19 bp, Homo sapiens
gccagccctaggctaccct

SEQ ID NO: 2183901 - DNA, 17 bp, Homo sapiens
gccagcggcatatactt

SEQ ID NO: 2183902 - DNA, 23 bp, Homo sapiens
gccaggacagctgcaggtgccca

SEQ ID NO: 2183903 - DNA, 14 bp, Homo sapiens
gccaggctgcggtg

SEQ ID NO: 2183904 - DNA, 19 bp, Homo sapiens
gccagggatggggccacag

SEQ ID NO: 2183905 - DNA, 20 bp, Homo sapiens
gccagggatggggccacagc

SEQ ID NO: 2183906 - DNA, 21 bp, Homo sapiens
gccagggatggggccacagcc

SEQ ID NO: 2183907 - DNA, 19 bp, Homo sapiens
gccagggttttttggccta

SEQ ID NO: 2183908 - DNA, 19 bp, Homo sapiens
gccagtaaggcagctctgt

SEQ ID NO: 2183909 - DNA, 21 bp, Homo sapiens
gccagtggggatgaggtcacc

SEQ ID NO: 2183910 - DNA, 20 bp, Homo sapiens
gccataaaatctcacgctgc

SEQ ID NO: 2183911 - DNA, 17 bp, Homo sapiens
gccatcccagccttggc

SEQ ID NO: 2183912 - DNA, 17 bp, Homo sapiens
gccatgattttggccac

SEQ ID NO: 2183913 - DNA, 12 bp, Homo sapiens
gccatgctgcta

SEQ ID NO: 2183914 - DNA, 20 bp, Homo sapiens
gccatgctgctatgaagact

SEQ ID NO: 2183915 - DNA, 17 bp, Homo sapiens
gccatgggaccaaacct

SEQ ID NO: 2183916 - DNA, 17 bp, Homo sapiens
gccattggcctctgtct

SEQ ID NO: 2183917 - DNA, 14 bp, Homo sapiens
gccatttccctgaa

SEQ ID NO: 2183918 - DNA, 14 bp, Homo sapiens
gccatttgccccaa

SEQ ID NO: 2183919 - DNA, 14 bp, Homo sapiens
gcccaatcactgcc

SEQ ID NO: 2183920 - DNA, 15 bp, Homo sapiens
gcccacctaccttca

SEQ ID NO: 2183921 - DNA, 13 bp, Homo sapiens
gcccagagctggg

SEQ ID NO: 2183922 - DNA, 14 bp, Homo sapiens
gcccagaggcacag

SEQ ID NO: 2183923 - DNA, 19 bp, Homo sapiens
gcccagaggcacagccggg

SEQ ID NO: 2183924 - DNA, 14 bp, Homo sapiens
gcccagcagagccg

SEQ ID NO: 2183925 - DNA, 12 bp, Homo sapiens
gcccagcccagc

SEQ ID NO: 2183926 - DNA, 11 bp, Homo sapiens
gcccagctgct

SEQ ID NO: 2183927 - DNA, 15 bp, Homo sapiens
gcccagctgctctgc

SEQ ID NO: 2183928 - DNA, 16 bp, Homo sapiens
gcccagctgctctgcc

SEQ ID NO: 2183929 - DNA, 19 bp, Homo sapiens
gcccagctgctctgcccag

SEQ ID NO: 2183930 - DNA, 14 bp, Homo sapiens
gcccagctggggcc

SEQ ID NO: 2183931 - DNA, 22 bp, Homo sapiens
gcccagctggggcccctcggct

SEQ ID NO: 2183932 - DNA, 20 bp, Homo sapiens
gcccaggctggagtgcagtg

SEQ ID NO: 2183933 - DNA, 15 bp, Homo sapiens
gcccagggtcctgtg

SEQ ID NO: 2183934 - DNA, 16 bp, Homo sapiens
gcccagggtcctgtgc

SEQ ID NO: 2183935 - DNA, 23 bp, Homo sapiens
gcccagtgatggcattactctgc

SEQ ID NO: 2183936 - DNA, 17 bp, Homo sapiens
gcccatcactcggctgt

SEQ ID NO: 2183937 - DNA, 19 bp, Homo sapiens
gcccattagcaacgcctgc

SEQ ID NO: 2183938 - DNA, 12 bp, Homo sapiens
gccccagaggcc

SEQ ID NO: 2183939 - DNA, 15 bp, Homo sapiens
gccccagaggccctg

SEQ ID NO: 2183940 - DNA, 16 bp, Homo sapiens
gccccagaggccctgg

SEQ ID NO: 2183941 - DNA, 20 bp, Homo sapiens
gccccagaggccctggaggt

SEQ ID NO: 2183942 - DNA, 19 bp, Homo sapiens
gccccaggctcgtggactg

SEQ ID NO: 2183943 - DNA, 15 bp, Homo sapiens
gcccccactcagcat

SEQ ID NO: 2183944 - DNA, 14 bp, Homo sapiens
gcccccgccctctg

SEQ ID NO: 2183945 - DNA, 15 bp, Homo sapiens
gcccccgctcatggg

SEQ ID NO: 2183946 - DNA, 16 bp, Homo sapiens
gcccccgctcatgggc

SEQ ID NO: 2183947 - DNA, 13 bp, Homo sapiens
gccccctgtcctt

SEQ ID NO: 2183948 - DNA, 16 bp, Homo sapiens
gccccgggctggagaa

SEQ ID NO: 2183949 - DNA, 19 bp, Homo sapiens
gcccctgccgcctgtgccc

SEQ ID NO: 2183950 - DNA, 11 bp, Homo sapiens
gcccctggtgg

SEQ ID NO: 2183951 - DNA, 15 bp, Homo sapiens
gcccgccctccctcc

SEQ ID NO: 2183952 - DNA, 18 bp, Homo sapiens
gcccggaagttgctgtgc

SEQ ID NO: 2183953 - DNA, 14 bp, Homo sapiens
gccctaggctaccc

SEQ ID NO: 2183954 - DNA, 23 bp, Homo sapiens
gccctccactgccctctgttcag

SEQ ID NO: 2183955 - DNA, 15 bp, Homo sapiens
gccctctatttatta

SEQ ID NO: 2183956 - DNA, 14 bp, Homo sapiens
gccctctgaggctc

SEQ ID NO: 2183957 - DNA, 16 bp, Homo sapiens
gccctctgaggctcag

SEQ ID NO: 2183958 - DNA, 15 bp, Homo sapiens
gccctctgcccccag

SEQ ID NO: 2183959 - DNA, 16 bp, Homo sapiens
gccctctggggctcag

SEQ ID NO: 2183960 - DNA, 21 bp, Homo sapiens
gccctctggggctcagccctg

SEQ ID NO: 2183961 - DNA, 17 bp, Homo sapiens
gccctgatttgctgttt

SEQ ID NO: 2183962 - DNA, 23 bp, Homo sapiens
gccctgccctcctgcccgccctc

SEQ ID NO: 2183963 - DNA, 10 bp, Homo sapiens
gccctgctac

SEQ ID NO: 2183964 - DNA, 13 bp, Homo sapiens
gccctgctacctg

SEQ ID NO: 2183965 - DNA, 19 bp, Homo sapiens
gccctggaggccgctgctg

SEQ ID NO: 2183966 - DNA, 14 bp, Homo sapiens
gccctggaggtctc

SEQ ID NO: 2183967 - DNA, 20 bp, Homo sapiens
gccctggagtcatgccaagc

SEQ ID NO: 2183968 - DNA, 22 bp, Homo sapiens
gcccttcttttgaccccttcct

SEQ ID NO: 2183969 - DNA, 13 bp, Homo sapiens
gcccttgctgggt

SEQ ID NO: 2183970 - DNA, 22 bp, Homo sapiens
gcccttgctgggtccagggtag

SEQ ID NO: 2183971 - DNA, 18 bp, Homo sapiens
gcccttttctggctcctg

SEQ ID NO: 2183972 - DNA, 18 bp, Homo sapiens
gccgaggcaggggctggg

SEQ ID NO: 2183973 - DNA, 21 bp, Homo sapiens
gccgagtggatagatgccctg

SEQ ID NO: 2183974 - DNA, 19 bp, Homo sapiens
tttccttgtccccacactc

SEQ ID NO: 2183975 - DNA, 14 bp, Homo sapiens
tttccttgtctctc

SEQ ID NO: 2183976 - DNA, 22 bp, Homo sapiens
tttctaaaagccataatccagt

SEQ ID NO: 2183977 - DNA, 14 bp, Homo sapiens
tttctacaactgat

SEQ ID NO: 2183978 - DNA, 23 bp, Homo sapiens
tttctaggtcaaggcctgtccct

SEQ ID NO: 2183979 - DNA, 14 bp, Homo sapiens
tttctagtttgttt

SEQ ID NO: 2183980 - DNA, 18 bp, Homo sapiens
tttctagtttgtttagtt

SEQ ID NO: 2183981 - DNA, 21 bp, Homo sapiens
tttctattcagcaaaagttaa

SEQ ID NO: 2183982 - DNA, 22 bp, Homo sapiens
tttctcaaagtttttacagtgt

SEQ ID NO: 2183983 - DNA, 19 bp, Homo sapiens
tttctcctttaattgtaaa

SEQ ID NO: 2183984 - DNA, 14 bp, Homo sapiens
tttctctgcttcag

SEQ ID NO: 2183985 - DNA, 16 bp, Homo sapiens
tttctctgtgctctga

SEQ ID NO: 2183986 - DNA, 17 bp, Homo sapiens
tttctcttaacttaatt

SEQ ID NO: 2183987 - DNA, 17 bp, Homo sapiens
tttctctttttttaaaa

SEQ ID NO: 2183988 - DNA, 20 bp, Homo sapiens
tttctgccttccttgctaat

SEQ ID NO: 2183989 - DNA, 16 bp, Homo sapiens
tttctggctcctgtgt

SEQ ID NO: 2183990 - DNA, 17 bp, Homo sapiens
tttctggtaggttctgt

SEQ ID NO: 2183991 - DNA, 18 bp, Homo sapiens
tttctggtgcctatttat

SEQ ID NO: 2183992 - DNA, 20 bp, Homo sapiens
tttcttaatgctatttgcca

SEQ ID NO: 2183993 - DNA, 15 bp, Homo sapiens
tttcttccttcaaat

SEQ ID NO: 2183994 - DNA, 18 bp, Homo sapiens
tttcttgggaaacttcta

SEQ ID NO: 2183995 - DNA, 19 bp, Homo sapiens
tttcttgtaaacctggagg

SEQ ID NO: 2183996 - DNA, 18 bp, Homo sapiens
tttgaaagaagcaagaca

SEQ ID NO: 2183997 - DNA, 18 bp, Homo sapiens
tttgaactccgctgcctt

SEQ ID NO: 2183998 - DNA, 14 bp, Homo sapiens
tttgaccagtttct

SEQ ID NO: 2183999 - DNA, 15 bp, Homo sapiens
tttgaccccttcctg

SEQ ID NO: 2184000 - DNA, 16 bp, Homo sapiens
tttgaccccttcctgt

SEQ ID NO: 2184001 - DNA, 20 bp, Homo sapiens
tttgaccccttcctgtctgg

SEQ ID NO: 2184002 - DNA, 22 bp, Homo sapiens
tttgagtcccttccaggccatc

SEQ ID NO: 2184003 - DNA, 17 bp, Homo sapiens
tttgatatttgtgtaaa

SEQ ID NO: 2184004 - DNA, 20 bp, Homo sapiens
tttgattttttgctgcagac

SEQ ID NO: 2184005 - DNA, 21 bp, Homo sapiens
tttgcaaaggagacttaattt

SEQ ID NO: 2184006 - DNA, 14 bp, Homo sapiens
tttgcaaccaggaa

SEQ ID NO: 2184007 - DNA, 21 bp, Homo sapiens
tttgcacgaattttaaaacat

SEQ ID NO: 2184008 - DNA, 22 bp, Homo sapiens
tttgcacgaattttaaaacatg

SEQ ID NO: 2184009 - DNA, 16 bp, Homo sapiens
tttgcagacctgggac

SEQ ID NO: 2184010 - DNA, 19 bp, Homo sapiens
tttgcagcagcaagtacaa

SEQ ID NO: 2184011 - DNA, 13 bp, Homo sapiens
tttgcagctgctg

SEQ ID NO: 2184012 - DNA, 14 bp, Homo sapiens
tttgcagctgctgg

SEQ ID NO: 2184013 - DNA, 15 bp, Homo sapiens
tttgcagctgctggt

SEQ ID NO: 2184014 - DNA, 17 bp, Homo sapiens
tttgcgatgtgttttat

SEQ ID NO: 2184015 - DNA, 18 bp, Homo sapiens
tttgctatcatatattat

SEQ ID NO: 2184016 - DNA, 13 bp, Homo sapiens
tttgctcccagtt

SEQ ID NO: 2184017 - DNA, 21 bp, Homo sapiens
tttgctcccccattttaactt

SEQ ID NO: 2184018 - DNA, 18 bp, Homo sapiens
tttgcttgtactgggaca

SEQ ID NO: 2184019 - DNA, 13 bp, Homo sapiens
tttggactcgaaa

SEQ ID NO: 2184020 - DNA, 19 bp, Homo sapiens
tttggccgttttgtgaaga

SEQ ID NO: 2184021 - DNA, 21 bp, Homo sapiens
tttggccgttttgtgaagaaa

SEQ ID NO: 2184022 - DNA, 15 bp, Homo sapiens
tttggctgtaattta

SEQ ID NO: 2184023 - DNA, 14 bp, Homo sapiens
tttggggaactcaa

SEQ ID NO: 2184024 - DNA, 20 bp, Homo sapiens
tttggggggttttcttgcct

SEQ ID NO: 2184025 - DNA, 19 bp, Homo sapiens
tttgggttttttaattgag

SEQ ID NO: 2184026 - DNA, 18 bp, Homo sapiens
tttggtggcccctcccca

SEQ ID NO: 2184027 - DNA, 12 bp, Homo sapiens
tttggtttccac

SEQ ID NO: 2184028 - DNA, 19 bp, Homo sapiens
tttgtaatttttttctagt

SEQ ID NO: 2184029 - DNA, 14 bp, Homo sapiens
tttgtagtttgtat

SEQ ID NO: 2184030 - DNA, 16 bp, Homo sapiens
tttgtatataaatggt

SEQ ID NO: 2184031 - DNA, 13 bp, Homo sapiens
tttgtatgatgta

SEQ ID NO: 2184032 - DNA, 16 bp, Homo sapiens
tttgtcccacagcttg

SEQ ID NO: 2184033 - DNA, 21 bp, Homo sapiens
tttgtctcattttgtatgtat

SEQ ID NO: 2184034 - DNA, 21 bp, Homo sapiens
tttgtgcatgtatattactga

SEQ ID NO: 2184035 - DNA, 16 bp, Homo sapiens
tttgtgtacagtatgt

SEQ ID NO: 2184036 - DNA, 13 bp, Homo sapiens
tttgttaatatat

SEQ ID NO: 2184037 - DNA, 17 bp, Homo sapiens
tttgttgctgttgttca

SEQ ID NO: 2184038 - DNA, 15 bp, Homo sapiens
tttgtttctacctcc

SEQ ID NO: 2184039 - DNA, 11 bp, Homo sapiens
tttgtttgttt

SEQ ID NO: 2184040 - DNA, 20 bp, Homo sapiens
tttgttttaaggaaaaaaga

SEQ ID NO: 2184041 - DNA, 23 bp, Homo sapiens
tttgttttttttttaaaaaagac

SEQ ID NO: 2184042 - DNA, 16 bp, Homo sapiens
ttttaaaaaatgcaga

SEQ ID NO: 2184043 - DNA, 19 bp, Homo sapiens
ttttacagtgtatctcgaa

SEQ ID NO: 2184044 - DNA, 15 bp, Homo sapiens
ttttacggaattcca

SEQ ID NO: 2184045 - DNA, 18 bp, Homo sapiens
ttttaggtctcttcccct

SEQ ID NO: 2184046 - DNA, 17 bp, Homo sapiens
ttttagtaacctttaaa

SEQ ID NO: 2184047 - DNA, 20 bp, Homo sapiens
ttttatgtggtggtttctat

SEQ ID NO: 2184048 - DNA, 14 bp, Homo sapiens
ttttattttaaatt

SEQ ID NO: 2184049 - DNA, 17 bp, Homo sapiens
ttttccaaaaacaaagt

SEQ ID NO: 2184050 - DNA, 22 bp, Homo sapiens
ttttccaaaggaagtgctaatg

SEQ ID NO: 2184051 - DNA, 16 bp, Homo sapiens
ttttcccatttaaaaa

SEQ ID NO: 2184052 - DNA, 16 bp, Homo sapiens
ttttccttgtccccac

SEQ ID NO: 2184053 - DNA, 16 bp, Homo sapiens
ttttctaaaagccata

SEQ ID NO: 2184054 - DNA, 23 bp, Homo sapiens
ttttctacagccagtaaggcagc

SEQ ID NO: 2184055 - DNA, 12 bp, Homo sapiens
ttttctgtctct

SEQ ID NO: 2184056 - DNA, 19 bp, Homo sapiens
ttttcttttgaataatgta

SEQ ID NO: 2184057 - DNA, 16 bp, Homo sapiens
ttttgaataatgtagt

SEQ ID NO: 2184058 - DNA, 16 bp, Homo sapiens
ttttgaccagtttctt

SEQ ID NO: 2184059 - DNA, 16 bp, Homo sapiens
ttttgcaaaagaagtt

SEQ ID NO: 2184060 - DNA, 19 bp, Homo sapiens
ttttgcaaagatttaatct

SEQ ID NO: 2184061 - DNA, 19 bp, Homo sapiens
ttttgctccttctgtgttt

SEQ ID NO: 2184062 - DNA, 17 bp, Homo sapiens
ttttggaaactgttggt

SEQ ID NO: 2184063 - DNA, 13 bp, Homo sapiens
ttttggtttctta

SEQ ID NO: 2184064 - DNA, 12 bp, Homo sapiens
ttttgtactgtg

SEQ ID NO: 2184065 - DNA, 16 bp, Homo sapiens
ttttgtactgtgctga

SEQ ID NO: 2184066 - DNA, 22 bp, Homo sapiens
ttttgtggcttcaatctacgat

SEQ ID NO: 2184067 - DNA, 16 bp, Homo sapiens
ttttgtgtacagtatg

SEQ ID NO: 2184068 - DNA, 18 bp, Homo sapiens
ttttgtgtcttaagaaaa

SEQ ID NO: 2184069 - DNA, 15 bp, Homo sapiens
ttttgttccaacagt

SEQ ID NO: 2184070 - DNA, 16 bp, Homo sapiens
ttttgttttaaggaaa

SEQ ID NO: 2184071 - DNA, 23 bp, Homo sapiens
ttttgttttttttttaaaaaaga

SEQ ID NO: 2184072 - DNA, 13 bp, Homo sapiens
tttttaaaaaaga

SEQ ID NO: 2184073 - DNA, 18 bp, Homo sapiens
tttttaaaaaagacattt

SEQ ID NO: 2184074 - DNA, 22 bp, Homo sapiens
tttttaaaaaagacatttaaag

SEQ ID NO: 2184075 - DNA, 15 bp, Homo sapiens
tttttaaaaaatgca

SEQ ID NO: 2184076 - DNA, 20 bp, Homo sapiens
tttttaaatgtcagttgaaa

SEQ ID NO: 2184077 - DNA, 16 bp, Homo sapiens
tttttaagaatttatt

SEQ ID NO: 2184078 - DNA, 19 bp, Homo sapiens
tttttaagcaactggaaaa

SEQ ID NO: 2184079 - DNA, 14 bp, Homo sapiens
tttttacggaattc

SEQ ID NO: 2184080 - DNA, 12 bp, Homo sapiens
tttttagtttgt

SEQ ID NO: 2184081 - DNA, 14 bp, Homo sapiens
tttttatagaagtg

SEQ ID NO: 2184082 - DNA, 15 bp, Homo sapiens
tttttcaataaagta

SEQ ID NO: 2184083 - DNA, 14 bp, Homo sapiens
tttttctttccaag

SEQ ID NO: 2184084 - DNA, 9 bp, Homo sapiens
tttttggaa

SEQ ID NO: 2184085 - DNA, 14 bp, Homo sapiens
tttttggtttctta

SEQ ID NO: 2184086 - DNA, 22 bp, Homo sapiens
ttttttacggaattccaatatt

SEQ ID NO: 2184087 - DNA, 12 bp, Homo sapiens
ttttttggccta

SEQ ID NO: 2184088 - DNA, 20 bp, Homo sapiens
ttgggaaaatatcactttgt

SEQ ID NO: 2184089 - DNA, 13 bp, Homo sapiens
ttgggaaaccaag

SEQ ID NO: 2184090 - DNA, 15 bp, Homo sapiens
ttgggaagccaggaa

SEQ ID NO: 2184091 - DNA, 19 bp, Homo sapiens
ttgggaccttgcgtgaaga

SEQ ID NO: 2184092 - DNA, 13 bp, Homo sapiens
ttgggagttttta

SEQ ID NO: 2184093 - DNA, 15 bp, Homo sapiens
ttgggattacaggtg

SEQ ID NO: 2184094 - DNA, 20 bp, Homo sapiens
ttgggcctcaggctctgcac

SEQ ID NO: 2184095 - DNA, 20 bp, Homo sapiens
ttgggtgcaagagggagcac

SEQ ID NO: 2184096 - DNA, 15 bp, Homo sapiens
ttggtattcaatttg

SEQ ID NO: 2184097 - DNA, 23 bp, Homo sapiens
ttggtcatttgccaactaatttt

SEQ ID NO: 2184098 - DNA, 21 bp, Homo sapiens
ttggtcctaagtccctgcccc

SEQ ID NO: 2184099 - DNA, 21 bp, Homo sapiens
ttggtgtgaatgctgtacctt

SEQ ID NO: 2184100 - DNA, 22 bp, Homo sapiens
ttggttaatcacttaacctgct

SEQ ID NO: 2184101 - DNA, 12 bp, Homo sapiens
ttggttcccaga

SEQ ID NO: 2184102 - DNA, 16 bp, Homo sapiens
ttggttttgtttctga

SEQ ID NO: 2184103 - DNA, 15 bp, Homo sapiens
ttgtaaacttgaaag

SEQ ID NO: 2184104 - DNA, 15 bp, Homo sapiens
ttgtaaatacaattc

SEQ ID NO: 2184105 - DNA, 16 bp, Homo sapiens
ttgtaaatacaattca

SEQ ID NO: 2184106 - DNA, 13 bp, Homo sapiens
ttgtaaggacttg

SEQ ID NO: 2184107 - DNA, 16 bp, Homo sapiens
ttgtaaggtattgcaa

SEQ ID NO: 2184108 - DNA, 17 bp, Homo sapiens
ttgtacacatatacata

SEQ ID NO: 2184109 - DNA, 21 bp, Homo sapiens
ttgtacacatatacatatgat

SEQ ID NO: 2184110 - DNA, 14 bp, Homo sapiens
ttgtaccaaagctg

SEQ ID NO: 2184111 - DNA, 14 bp, Homo sapiens
ttgtactgtgctga

SEQ ID NO: 2184112 - DNA, 16 bp, Homo sapiens
ttgtactgtgctgatt

SEQ ID NO: 2184113 - DNA, 17 bp, Homo sapiens
ttgtacttttcattctg

SEQ ID NO: 2184114 - DNA, 23 bp, Homo sapiens
ttgtaggaaaagctgttcccatg

SEQ ID NO: 2184115 - DNA, 14 bp, Homo sapiens
ttgtatataaatgg

SEQ ID NO: 2184116 - DNA, 17 bp, Homo sapiens
ttgtatttaacagaaat

SEQ ID NO: 2184117 - DNA, 22 bp, Homo sapiens
ttgtatttaacagaaattgtat

SEQ ID NO: 2184118 - DNA, 17 bp, Homo sapiens
ttgtcaagacagtgtca

SEQ ID NO: 2184119 - DNA, 22 bp, Homo sapiens
ttgtcactcaacaaaagtgctt

SEQ ID NO: 2184120 - DNA, 23 bp, Homo sapiens
ttgtcatccacacaacaccagga

SEQ ID NO: 2184121 - DNA, 18 bp, Homo sapiens
ttgtccaacaactgtcag

SEQ ID NO: 2184122 - DNA, 13 bp, Homo sapiens
ttgtcccacagct

SEQ ID NO: 2184123 - DNA, 15 bp, Homo sapiens
ttgtccccacactcc

SEQ ID NO: 2184124 - DNA, 16 bp, Homo sapiens
ttgtcctatgggagtc

SEQ ID NO: 2184125 - DNA, 16 bp, Homo sapiens
ttgtctcattttgtat

SEQ ID NO: 2184126 - DNA, 17 bp, Homo sapiens
ttgtctcgaaataattt

SEQ ID NO: 2184127 - DNA, 12 bp, Homo sapiens
ttgtctgctgct

SEQ ID NO: 2184128 - DNA, 13 bp, Homo sapiens
ttgtctgctgctc

SEQ ID NO: 2184129 - DNA, 15 bp, Homo sapiens
ttgtcttctccccag

SEQ ID NO: 2184130 - DNA, 14 bp, Homo sapiens
ttgtgaaatttgtt

SEQ ID NO: 2184131 - DNA, 23 bp, Homo sapiens
ttgtgaaatttgttaatatatat

SEQ ID NO: 2184132 - DNA, 19 bp, Homo sapiens
ttgtgaaggaaaaacatgc

SEQ ID NO: 2184133 - DNA, 15 bp, Homo sapiens
ttgtgagtatgtgtg

SEQ ID NO: 2184134 - DNA, 16 bp, Homo sapiens
ttgtgagtatgtgtgg

SEQ ID NO: 2184135 - DNA, 18 bp, Homo sapiens
ttgtgggtttctctgtgc

SEQ ID NO: 2184136 - DNA, 21 bp, Homo sapiens
ttgtgtatcttcgtaacttca

SEQ ID NO: 2184137 - DNA, 22 bp, Homo sapiens
ttgtgtatcttcgtaacttcat

SEQ ID NO: 2184138 - DNA, 14 bp, Homo sapiens
ttgtgtttgtatat

SEQ ID NO: 2184139 - DNA, 19 bp, Homo sapiens
ttgttaatatatataatac

SEQ ID NO: 2184140 - DNA, 16 bp, Homo sapiens
ttgttctcagaatccc

SEQ ID NO: 2184141 - DNA, 14 bp, Homo sapiens
ttgttctttatttg

SEQ ID NO: 2184142 - DNA, 13 bp, Homo sapiens
ttgtttgatgtgt

SEQ ID NO: 2184143 - DNA, 15 bp, Homo sapiens
ttgttttaaggaaaa

SEQ ID NO: 2184144 - DNA, 10 bp, Homo sapiens
ttgttttgtt

SEQ ID NO: 2184145 - DNA, 19 bp, Homo sapiens
tttaaaaaatgagcttcca

SEQ ID NO: 2184146 - DNA, 14 bp, Homo sapiens
tttaaaaatgtata

SEQ ID NO: 2184147 - DNA, 20 bp, Homo sapiens
tttaaactactatttttctt

SEQ ID NO: 2184148 - DNA, 18 bp, Homo sapiens
tttaaatgtcagttgaaa

SEQ ID NO: 2184149 - DNA, 15 bp, Homo sapiens
tttaaattattatct

SEQ ID NO: 2184150 - DNA, 21 bp, Homo sapiens
tttaaattattatcttcttaa

SEQ ID NO: 2184151 - DNA, 12 bp, Homo sapiens
tttaacagaaat

SEQ ID NO: 2184152 - DNA, 19 bp, Homo sapiens
tttaacagaaattgtatat

SEQ ID NO: 2184153 - DNA, 22 bp, Homo sapiens
tttaacctcaggttccaaattc

SEQ ID NO: 2184154 - DNA, 14 bp, Homo sapiens
tttaactgcattct

SEQ ID NO: 2184155 - DNA, 22 bp, Homo sapiens
tttaacttgaaaagattgcaaa

SEQ ID NO: 2184156 - DNA, 19 bp, Homo sapiens
tttaagaaaaacatgtcat

SEQ ID NO: 2184157 - DNA, 20 bp, Homo sapiens
tttaagaaaaacatgtcatg

SEQ ID NO: 2184158 - DNA, 17 bp, Homo sapiens
tttaagaatttattatt

SEQ ID NO: 2184159 - DNA, 23 bp, Homo sapiens
tttaaggaaaaaagatttttaaa

SEQ ID NO: 2184160 - DNA, 17 bp, Homo sapiens
tttaataccaccaacaa

SEQ ID NO: 2184161 - DNA, 15 bp, Homo sapiens
tttaatcgtttttgt

SEQ ID NO: 2184162 - DNA, 12 bp, Homo sapiens
tttaattgtaaa

SEQ ID NO: 2184163 - DNA, 15 bp, Homo sapiens
tttaattgtaaagta

SEQ ID NO: 2184164 - DNA, 20 bp, Homo sapiens
tttacaaaatacaaaaaagt

SEQ ID NO: 2184165 - DNA, 16 bp, Homo sapiens
tttacagcttttctct

SEQ ID NO: 2184166 - DNA, 18 bp, Homo sapiens
tttacatcttttgggaag

SEQ ID NO: 2184167 - DNA, 18 bp, Homo sapiens
tttaccacccccacacct

SEQ ID NO: 2184168 - DNA, 15 bp, Homo sapiens
tttacgttttagaaa

SEQ ID NO: 2184169 - DNA, 19 bp, Homo sapiens
tttagaaaacccaagtttt

SEQ ID NO: 2184170 - DNA, 16 bp, Homo sapiens
tttagaaaattttatg

SEQ ID NO: 2184171 - DNA, 21 bp, Homo sapiens
tttagaatattaaaaattaat

SEQ ID NO: 2184172 - DNA, 19 bp, Homo sapiens
tttaggtctcttcccctct

SEQ ID NO: 2184173 - DNA, 13 bp, Homo sapiens
tttaggtgtcttt

SEQ ID NO: 2184174 - DNA, 12 bp, Homo sapiens
tttagtgcaatt

SEQ ID NO: 2184175 - DNA, 11 bp, Homo sapiens
tttagtttgtt

SEQ ID NO: 2184176 - DNA, 15 bp, Homo sapiens
tttataaatatgtga

SEQ ID NO: 2184177 - DNA, 15 bp, Homo sapiens
tttataacaatgtta

SEQ ID NO: 2184178 - DNA, 16 bp, Homo sapiens
tttataattaaagaaa

SEQ ID NO: 2184179 - DNA, 21 bp, Homo sapiens
tttataattaaagaaaattgc

SEQ ID NO: 2184180 - DNA, 21 bp, Homo sapiens
tttatatttaatttttacatg

SEQ ID NO: 2184181 - DNA, 14 bp, Homo sapiens
tttatgagaaactt

SEQ ID NO: 2184182 - DNA, 15 bp, Homo sapiens
tttatgcagagacag

SEQ ID NO: 2184183 - DNA, 16 bp, Homo sapiens
tttatgctcaatccat

SEQ ID NO: 2184184 - DNA, 17 bp, Homo sapiens
tttatgctcacctgaca

SEQ ID NO: 2184185 - DNA, 18 bp, Homo sapiens
tttatgtattttaaaata

SEQ ID NO: 2184186 - DNA, 16 bp, Homo sapiens
tttattagtttaaaaa

SEQ ID NO: 2184187 - DNA, 16 bp, Homo sapiens
tttattattactgttt

SEQ ID NO: 2184188 - DNA, 17 bp, Homo sapiens
tttattcattcagtgag

SEQ ID NO: 2184189 - DNA, 16 bp, Homo sapiens
tttattctttaattgt

SEQ ID NO: 2184190 - DNA, 13 bp, Homo sapiens
tttcaacattgat

SEQ ID NO: 2184191 - DNA, 12 bp, Homo sapiens
tttcaacttcaa

SEQ ID NO: 2184192 - DNA, 15 bp, Homo sapiens
tttcaatagcacata

SEQ ID NO: 2184193 - DNA, 12 bp, Homo sapiens
tttcaatatcaa

SEQ ID NO: 2184194 - DNA, 21 bp, Homo sapiens
tttcactgaagtgaatacatg

SEQ ID NO: 2184195 - DNA, 23 bp, Homo sapiens
tttcagaagttagtttgtatata

SEQ ID NO: 2184196 - DNA, 16 bp, Homo sapiens
tttcagacaaattact

SEQ ID NO: 2184197 - DNA, 12 bp, Homo sapiens
tttcagatgcaa

SEQ ID NO: 2184198 - DNA, 13 bp, Homo sapiens
tttcagctggaga

SEQ ID NO: 2184199 - DNA, 19 bp, Homo sapiens
tttcagctggagatactga

SEQ ID NO: 2184200 - DNA, 11 bp, Homo sapiens
tttcagtaata

SEQ ID NO: 2184201 - DNA, 16 bp, Homo sapiens
tttcagtaatagctga

SEQ ID NO: 2184202 - DNA, 20 bp, Homo sapiens
tttcagtaatagctgaacct

SEQ ID NO: 2184203 - DNA, 15 bp, Homo sapiens
tttcagttacttacc

SEQ ID NO: 2184204 - DNA, 23 bp, Homo sapiens
tttccaaaaacaaagtgcaaagc

SEQ ID NO: 2184205 - DNA, 23 bp, Homo sapiens
tttccaagcctgggccactggca

SEQ ID NO: 2184206 - DNA, 15 bp, Homo sapiens
tttccaccaaattct

SEQ ID NO: 2184207 - DNA, 15 bp, Homo sapiens
tttcccacagtctct

SEQ ID NO: 2184208 - DNA, 21 bp, Homo sapiens
tttcccaccaatcctcaccta

SEQ ID NO: 2184209 - DNA, 12 bp, Homo sapiens
tttccctgctga

SEQ ID NO: 2184210 - DNA, 16 bp, Homo sapiens
tttccctgctgaatgc

SEQ ID NO: 2184211 - DNA, 21 bp, Homo sapiens
tttccctggtgcctctcactt

SEQ ID NO: 2184212 - DNA, 21 bp, Homo sapiens
tttccggccaaggtgccacca

SEQ ID NO: 2184213 - DNA, 14 bp, Homo sapiens
tttccttaccatac

SEQ ID NO: 2184214 - DNA, 13 bp, Homo sapiens
ttcttaacagttt

SEQ ID NO: 2184215 - DNA, 15 bp, Homo sapiens
ttcttaacatagcca

SEQ ID NO: 2184216 - DNA, 14 bp, Homo sapiens
ttcttcctttggta

SEQ ID NO: 2184217 - DNA, 16 bp, Homo sapiens
ttcttctattgtgctt

SEQ ID NO: 2184218 - DNA, 17 bp, Homo sapiens
ttcttgagatctgctga

SEQ ID NO: 2184219 - DNA, 15 bp, Homo sapiens
ttcttgattttcaag

SEQ ID NO: 2184220 - DNA, 14 bp, Homo sapiens
ttcttggtatgatc

SEQ ID NO: 2184221 - DNA, 16 bp, Homo sapiens
ttcttggtatgatcat

SEQ ID NO: 2184222 - DNA, 13 bp, Homo sapiens
ttctttctagttt

SEQ ID NO: 2184223 - DNA, 14 bp, Homo sapiens
ttcttttcttttgt

SEQ ID NO: 2184224 - DNA, 13 bp, Homo sapiens
ttcttttggaaag

SEQ ID NO: 2184225 - DNA, 22 bp, Homo sapiens
ttgaaaaaagaaattccctgga

SEQ ID NO: 2184226 - DNA, 20 bp, Homo sapiens
ttgaaacttggttcccagaa

SEQ ID NO: 2184227 - DNA, 23 bp, Homo sapiens
ttgaaagtggggtgttgaagacc

SEQ ID NO: 2184228 - DNA, 13 bp, Homo sapiens
ttgaaatgtaatt

SEQ ID NO: 2184229 - DNA, 11 bp, Homo sapiens
ttgaaattaaa

SEQ ID NO: 2184230 - DNA, 21 bp, Homo sapiens
ttgaacaactcgaatcactca

SEQ ID NO: 2184231 - DNA, 17 bp, Homo sapiens
ttgaataaagtattcta

SEQ ID NO: 2184232 - DNA, 21 bp, Homo sapiens
ttgaataggcattaaatgcaa

SEQ ID NO: 2184233 - DNA, 20 bp, Homo sapiens
ttgaatgaaacaagcaggtg

SEQ ID NO: 2184234 - DNA, 22 bp, Homo sapiens
ttgacaccagctgttctgtccc

SEQ ID NO: 2184235 - DNA, 18 bp, Homo sapiens
ttgacatctaattcaaga

SEQ ID NO: 2184236 - DNA, 18 bp, Homo sapiens
ttgactggctttcctctc

SEQ ID NO: 2184237 - DNA, 17 bp, Homo sapiens
ttgagagcgctggcctc

SEQ ID NO: 2184238 - DNA, 22 bp, Homo sapiens
ttgagatctgctgacagatgtt

SEQ ID NO: 2184239 - DNA, 22 bp, Homo sapiens
ttgagcgctatgggtgttaacg

SEQ ID NO: 2184240 - DNA, 18 bp, Homo sapiens
ttgaggttgttcaaagtt

SEQ ID NO: 2184241 - DNA, 18 bp, Homo sapiens
ttgagtattacacattaa

SEQ ID NO: 2184242 - DNA, 15 bp, Homo sapiens
ttgagtcccttccag

SEQ ID NO: 2184243 - DNA, 14 bp, Homo sapiens
ttgataataaaatt

SEQ ID NO: 2184244 - DNA, 18 bp, Homo sapiens
ttgataataaaattcatt

SEQ ID NO: 2184245 - DNA, 15 bp, Homo sapiens
ttgatatattctttc

SEQ ID NO: 2184246 - DNA, 22 bp, Homo sapiens
ttgatatattctttccatgcag

SEQ ID NO: 2184247 - DNA, 16 bp, Homo sapiens
ttgattccattttaag

SEQ ID NO: 2184248 - DNA, 14 bp, Homo sapiens
ttgattttctttct

SEQ ID NO: 2184249 - DNA, 17 bp, Homo sapiens
ttgcaagtgaaataata

SEQ ID NO: 2184250 - DNA, 16 bp, Homo sapiens
ttgcagacctgggact

SEQ ID NO: 2184251 - DNA, 18 bp, Homo sapiens
ttgcagacctgggacttt

SEQ ID NO: 2184252 - DNA, 18 bp, Homo sapiens
ttgcagagaagccttggt

SEQ ID NO: 2184253 - DNA, 13 bp, Homo sapiens
ttgcagctgctgg

SEQ ID NO: 2184254 - DNA, 18 bp, Homo sapiens
ttgccaaggccgcccacc

SEQ ID NO: 2184255 - DNA, 16 bp, Homo sapiens
ttgccattataatttt

SEQ ID NO: 2184256 - DNA, 15 bp, Homo sapiens
ttgcccaacctcagc

SEQ ID NO: 2184257 - DNA, 12 bp, Homo sapiens
ttgccgctggga

SEQ ID NO: 2184258 - DNA, 24 bp, Homo sapiens
ttgccgctgggagagccaaggcct

SEQ ID NO: 2184259 - DNA, 20 bp, Homo sapiens
ttgcctccatggtgcctctg

SEQ ID NO: 2184260 - DNA, 20 bp, Homo sapiens
ttgcggaactcttcctggaa

SEQ ID NO: 2184261 - DNA, 23 bp, Homo sapiens
ttgcgtgtctgtttccttctctt

SEQ ID NO: 2184262 - DNA, 21 bp, Homo sapiens
ttgctaaaaatagtggccaga

SEQ ID NO: 2184263 - DNA, 16 bp, Homo sapiens
ttgctcagaagagaat

SEQ ID NO: 2184264 - DNA, 20 bp, Homo sapiens
ttgctcccccattttaactt

SEQ ID NO: 2184265 - DNA, 20 bp, Homo sapiens
ttgctctggaagcctgctga

SEQ ID NO: 2184266 - DNA, 19 bp, Homo sapiens
ttgctggaatctactagaa

SEQ ID NO: 2184267 - DNA, 14 bp, Homo sapiens
ttgctgggtccagg

SEQ ID NO: 2184268 - DNA, 20 bp, Homo sapiens
ttgctgtgaattagctcact

SEQ ID NO: 2184269 - DNA, 19 bp, Homo sapiens
ttgcttctgggaaggggtt

SEQ ID NO: 2184270 - DNA, 19 bp, Homo sapiens
ttggaaataggcaattaga

SEQ ID NO: 2184271 - DNA, 21 bp, Homo sapiens
ttggaagctagctcccctcct

SEQ ID NO: 2184272 - DNA, 22 bp, Homo sapiens
ttggaagctagctcccctcctc

SEQ ID NO: 2184273 - DNA, 15 bp, Homo sapiens
ttggacacacacagc

SEQ ID NO: 2184274 - DNA, 17 bp, Homo sapiens
ttggacacacacagctt

SEQ ID NO: 2184275 - DNA, 16 bp, Homo sapiens
ttggacgcacacagct

SEQ ID NO: 2184276 - DNA, 17 bp, Homo sapiens
ttggacgcacacagctt

SEQ ID NO: 2184277 - DNA, 19 bp, Homo sapiens
ttggactcgaaattagaag

SEQ ID NO: 2184278 - DNA, 18 bp, Homo sapiens
ttggagaactcatttcaa

SEQ ID NO: 2184279 - DNA, 16 bp, Homo sapiens
ttggagacaattacaa

SEQ ID NO: 2184280 - DNA, 13 bp, Homo sapiens
ttggaggagagag

SEQ ID NO: 2184281 - DNA, 22 bp, Homo sapiens
ttggatctatcacctgtcatca

SEQ ID NO: 2184282 - DNA, 16 bp, Homo sapiens
ttggcaattcttcttc

SEQ ID NO: 2184283 - DNA, 11 bp, Homo sapiens
ttggcagctga

SEQ ID NO: 2184284 - DNA, 13 bp, Homo sapiens
ttggcctctgtct

SEQ ID NO: 2184285 - DNA, 21 bp, Homo sapiens
ttggctggtgccgaagtgttt

SEQ ID NO: 2184286 - DNA, 16 bp, Homo sapiens
gcaaacccttctcttc

SEQ ID NO: 2184287 - DNA, 23 bp, Homo sapiens
gcaaacccttctcttctcccccc

SEQ ID NO: 2184288 - DNA, 13 bp, Homo sapiens
gcaaacctctcct

SEQ ID NO: 2184289 - DNA, 19 bp, Homo sapiens
gcaaacctctccttcctca

SEQ ID NO: 2184290 - DNA, 17 bp, Homo sapiens
gcaaacctgccccatcc

SEQ ID NO: 2184291 - DNA, 14 bp, Homo sapiens
gcaaagctgatttt

SEQ ID NO: 2184292 - DNA, 15 bp, Homo sapiens
gcaaagtgccctcat

SEQ ID NO: 2184293 - DNA, 18 bp, Homo sapiens
gcaaagtgctagccactg

SEQ ID NO: 2184294 - DNA, 21 bp, Homo sapiens
gcaaagtgctagccactggaa

SEQ ID NO: 2184295 - DNA, 14 bp, Homo sapiens
gcaaataaagcctt

SEQ ID NO: 2184296 - DNA, 21 bp, Homo sapiens
gcaaatagattcttaaagtgg

SEQ ID NO: 2184297 - DNA, 17 bp, Homo sapiens
gcaaattccacccctcc

SEQ ID NO: 2184298 - DNA, 19 bp, Homo sapiens
gcaaattccacccctcctt

SEQ ID NO: 2184299 - DNA, 22 bp, Homo sapiens
gcaaattccacccctccttccc

SEQ ID NO: 2184300 - DNA, 20 bp, Homo sapiens
gcaaatttcatctttccaaa

SEQ ID NO: 2184301 - DNA, 15 bp, Homo sapiens
gcaaccaggaacagc

SEQ ID NO: 2184302 - DNA, 20 bp, Homo sapiens
gcaaccaggaacagcaaatg

SEQ ID NO: 2184303 - DNA, 18 bp, Homo sapiens
gcaactggaaaagtgttc

SEQ ID NO: 2184304 - DNA, 16 bp, Homo sapiens
gcaagacgccctctcg

SEQ ID NO: 2184305 - DNA, 15 bp, Homo sapiens
gcaagctcttctcct

SEQ ID NO: 2184306 - DNA, 19 bp, Homo sapiens
gcaaggactttgtacattt

SEQ ID NO: 2184307 - DNA, 16 bp, Homo sapiens
gcaaggctgccggctg

SEQ ID NO: 2184308 - DNA, 17 bp, Homo sapiens
gcaaggctgccggctgc

SEQ ID NO: 2184309 - DNA, 12 bp, Homo sapiens
gcaatcctcctg

SEQ ID NO: 2184310 - DNA, 21 bp, Homo sapiens
gcaatctattaatagctgcct

SEQ ID NO: 2184311 - DNA, 11 bp, Homo sapiens
gcacaaagatg

SEQ ID NO: 2184312 - DNA, 20 bp, Homo sapiens
gcacacacactagccttctt

SEQ ID NO: 2184313 - DNA, 18 bp, Homo sapiens
gcacacacggttttggca

SEQ ID NO: 2184314 - DNA, 23 bp, Homo sapiens
gcacacagcttttagtacccacc

SEQ ID NO: 2184315 - DNA, 23 bp, Homo sapiens
gcacagccggggcctgcctagca

SEQ ID NO: 2184316 - DNA, 21 bp, Homo sapiens
gcacagggccctctgaggctc

SEQ ID NO: 2184317 - DNA, 16 bp, Homo sapiens
gcacagtaagcatgct

SEQ ID NO: 2184318 - DNA, 13 bp, Homo sapiens
gcacataatttgc

SEQ ID NO: 2184319 - DNA, 23 bp, Homo sapiens
gcacatatggaattttgcaaaga

SEQ ID NO: 2184320 - DNA, 23 bp, Homo sapiens
gcacatgacatttgtcctgcaga

SEQ ID NO: 2184321 - DNA, 21 bp, Homo sapiens
gcacatgcactactgaaattt

SEQ ID NO: 2184322 - DNA, 20 bp, Homo sapiens
gcaccaaaccctgtcctccc

SEQ ID NO: 2184323 - DNA, 13 bp, Homo sapiens
gcaccaagcccac

SEQ ID NO: 2184324 - DNA, 14 bp, Homo sapiens
gcaccaagcccaca

SEQ ID NO: 2184325 - DNA, 17 bp, Homo sapiens
gcaccaagcccacaggt

SEQ ID NO: 2184326 - DNA, 14 bp, Homo sapiens
gcaccaggaagccg

SEQ ID NO: 2184327 - DNA, 18 bp, Homo sapiens
gcaccaggaagccgtcct

SEQ ID NO: 2184328 - DNA, 16 bp, Homo sapiens
gcaccattcaggaacc

SEQ ID NO: 2184329 - DNA, 18 bp, Homo sapiens
gcacctcctctctgctgg

SEQ ID NO: 2184330 - DNA, 20 bp, Homo sapiens
gcacctcctctctgctgggt

SEQ ID NO: 2184331 - DNA, 23 bp, Homo sapiens
gcaccttgtgaaggaaaaacatg

SEQ ID NO: 2184332 - DNA, 15 bp, Homo sapiens
gcacgcctgccttct

SEQ ID NO: 2184333 - DNA, 22 bp, Homo sapiens
gcacgtatttatttataagttt

SEQ ID NO: 2184334 - DNA, 21 bp, Homo sapiens
gcactagcctccctctcctct

SEQ ID NO: 2184335 - DNA, 22 bp, Homo sapiens
gcactagcctccctctcctctg

SEQ ID NO: 2184336 - DNA, 13 bp, Homo sapiens
gcagaaagcagag

SEQ ID NO: 2184337 - DNA, 17 bp, Homo sapiens
gcagaaagggagcagag

SEQ ID NO: 2184338 - DNA, 20 bp, Homo sapiens
gcagaacagttaagcagccg

SEQ ID NO: 2184339 - DNA, 13 bp, Homo sapiens
gcagaacctggtg

SEQ ID NO: 2184340 - DNA, 15 bp, Homo sapiens
gcagaacctggtggc

SEQ ID NO: 2184341 - DNA, 22 bp, Homo sapiens
gcagaaggaaagaagggggccc

SEQ ID NO: 2184342 - DNA, 18 bp, Homo sapiens
gcagagccgttcctggga

SEQ ID NO: 2184343 - DNA, 20 bp, Homo sapiens
gcagagccgttcctgggact

SEQ ID NO: 2184344 - DNA, 12 bp, Homo sapiens
gcagaggctggc

SEQ ID NO: 2184345 - DNA, 17 bp, Homo sapiens
gcagaggctggcctcag

SEQ ID NO: 2184346 - DNA, 19 bp, Homo sapiens
gcagaggctggcctcagac

SEQ ID NO: 2184347 - DNA, 16 bp, Homo sapiens
gcagaggggagaggaa

SEQ ID NO: 2184348 - DNA, 18 bp, Homo sapiens
gcagagggtcactttaca

SEQ ID NO: 2184349 - DNA, 21 bp, Homo sapiens
gcagagtgccccacctgccac

SEQ ID NO: 2184350 - DNA, 14 bp, Homo sapiens
gcagcagctccgcc

SEQ ID NO: 2184351 - DNA, 15 bp, Homo sapiens
gcagcagctccgcct

SEQ ID NO: 2184352 - DNA, 18 bp, Homo sapiens
gcagcagctccgcctggc

SEQ ID NO: 2184353 - DNA, 21 bp, Homo sapiens
gcagcagctccgcctggcacc

SEQ ID NO: 2184354 - DNA, 18 bp, Homo sapiens
gcagcctcgaactcctgg

SEQ ID NO: 2184355 - DNA, 19 bp, Homo sapiens
gcagcctcgaactcctggg

SEQ ID NO: 2184356 - DNA, 17 bp, Homo sapiens
gcagcctgtgggagaag

SEQ ID NO: 2184357 - DNA, 19 bp, Homo sapiens
gcagcggtggaaggagcct

SEQ ID NO: 2184358 - DNA, 22 bp, Homo sapiens
gcagcggtggaaggagcctgcg

SEQ ID NO: 2184359 - DNA, 19 bp, Homo sapiens
gcagctccgcctggcaccc

SEQ ID NO: 2184360 - DNA, 20 bp, Homo sapiens
gcagctccgcctggcaccca

SEQ ID NO: 2184361 - DNA, 14 bp, Homo sapiens
gcagctctgtcgtg

SEQ ID NO: 2184362 - DNA, 23 bp, Homo sapiens
gcagctgacttggttctgaagcc

SEQ ID NO: 2184363 - DNA, 23 bp, Homo sapiens
gcagcttccttccaagtcttcct

SEQ ID NO: 2184364 - DNA, 23 bp, Homo sapiens
gcagctttactgccttcctcctt

SEQ ID NO: 2184365 - DNA, 17 bp, Homo sapiens
gcaggagaatcagcctg

SEQ ID NO: 2184366 - DNA, 14 bp, Homo sapiens
gcaggagctcagat

SEQ ID NO: 2184367 - DNA, 18 bp, Homo sapiens
gcaggagctcagatgaag

SEQ ID NO: 2184368 - DNA, 14 bp, Homo sapiens
gcaggagggtggca

SEQ ID NO: 2184369 - DNA, 15 bp, Homo sapiens
gcaggagggtggcac

SEQ ID NO: 2184370 - DNA, 16 bp, Homo sapiens
gcaggagggtggcact

SEQ ID NO: 2184371 - DNA, 17 bp, Homo sapiens
gcaggcaccagcagcag

SEQ ID NO: 2184372 - DNA, 16 bp, Homo sapiens
gcaggcagccttgacc

SEQ ID NO: 2184373 - DNA, 12 bp, Homo sapiens
gcaggcccagct

SEQ ID NO: 2184374 - DNA, 13 bp, Homo sapiens
gcaggcccagctg

SEQ ID NO: 2184375 - DNA, 12 bp, Homo sapiens
gcagggcagcct

SEQ ID NO: 2184376 - DNA, 14 bp, Homo sapiens
gcagggcagcctgt

SEQ ID NO: 2184377 - DNA, 16 bp, Homo sapiens
gcagggcagcctgtgg

SEQ ID NO: 2184378 - DNA, 23 bp, Homo sapiens
gcagggcagcctgtgggagaagg

SEQ ID NO: 2184379 - DNA, 24 bp, Homo sapiens
gcagggccctctggggctcagccc

SEQ ID NO: 2184380 - DNA, 12 bp, Homo sapiens
gcaggggctggg

SEQ ID NO: 2184381 - DNA, 16 bp, Homo sapiens
gcaggggctgggcaga

SEQ ID NO: 2184382 - DNA, 21 bp, Homo sapiens
gcaggggctgggcagagggga

SEQ ID NO: 2184383 - DNA, 20 bp, Homo sapiens
gcagggtcttcctgcagtgc

SEQ ID NO: 2184384 - DNA, 18 bp, Homo sapiens
gcagggtctttgtgtgct

SEQ ID NO: 2184385 - DNA, 22 bp, Homo sapiens
taacaccaagcacgtatttatt

SEQ ID NO: 2184386 - DNA, 23 bp, Homo sapiens
taacactagtctgtgtgctgtgg

SEQ ID NO: 2184387 - DNA, 15 bp, Homo sapiens
taacagaaattgtat

SEQ ID NO: 2184388 - DNA, 18 bp, Homo sapiens
taacagggccttgctaat

SEQ ID NO: 2184389 - DNA, 18 bp, Homo sapiens
taacagttgtatttaaca

SEQ ID NO: 2184390 - DNA, 16 bp, Homo sapiens
taacataatttttgtt

SEQ ID NO: 2184391 - DNA, 18 bp, Homo sapiens
taacatttgagtcccttc

SEQ ID NO: 2184392 - DNA, 13 bp, Homo sapiens
taacctacctgtg

SEQ ID NO: 2184393 - DNA, 16 bp, Homo sapiens
taacctgatgctaatt

SEQ ID NO: 2184394 - DNA, 18 bp, Homo sapiens
taacctttaaaaatgtat

SEQ ID NO: 2184395 - DNA, 16 bp, Homo sapiens
taactctgcccaccct

SEQ ID NO: 2184396 - DNA, 17 bp, Homo sapiens
taactgaccctcccttc

SEQ ID NO: 2184397 - DNA, 17 bp, Homo sapiens
taacttacccttaggga

SEQ ID NO: 2184398 - DNA, 15 bp, Homo sapiens
taacttcatattaat

SEQ ID NO: 2184399 - DNA, 23 bp, Homo sapiens
taacttcatattaatataagttt

SEQ ID NO: 2184400 - DNA, 13 bp, Homo sapiens
taacttcctctta

SEQ ID NO: 2184401 - DNA, 11 bp, Homo sapiens
taacttgaaaa

SEQ ID NO: 2184402 - DNA, 13 bp, Homo sapiens
taacttgaaaaga

SEQ ID NO: 2184403 - DNA, 20 bp, Homo sapiens
taacttgaaaagattgcaaa

SEQ ID NO: 2184404 - DNA, 19 bp, Homo sapiens
taagaaaaacatgtcatgt

SEQ ID NO: 2184405 - DNA, 13 bp, Homo sapiens
taagaatttcaat

SEQ ID NO: 2184406 - DNA, 15 bp, Homo sapiens
taagacaaatgggac

SEQ ID NO: 2184407 - DNA, 15 bp, Homo sapiens
taagagaagttgtaa

SEQ ID NO: 2184408 - DNA, 20 bp, Homo sapiens
taagagacacatacagagtg

SEQ ID NO: 2184409 - DNA, 21 bp, Homo sapiens
taagcaacatgaattaagaac

SEQ ID NO: 2184410 - DNA, 13 bp, Homo sapiens
taagcattttcta

SEQ ID NO: 2184411 - DNA, 12 bp, Homo sapiens
taagccttgtcg

SEQ ID NO: 2184412 - DNA, 22 bp, Homo sapiens
taaggacttgtgcctcttggga

SEQ ID NO: 2184413 - DNA, 19 bp, Homo sapiens
taaggattctgaagtttta

SEQ ID NO: 2184414 - DNA, 17 bp, Homo sapiens
taagtccctgccccctc

SEQ ID NO: 2184415 - DNA, 22 bp, Homo sapiens
taagtccctgccccctcccctt

SEQ ID NO: 2184416 - DNA, 23 bp, Homo sapiens
taagtccctgccccctccccttc

SEQ ID NO: 2184417 - DNA, 19 bp, Homo sapiens
taagtcctctaaacacact

SEQ ID NO: 2184418 - DNA, 14 bp, Homo sapiens
taagtgcttttaaa

SEQ ID NO: 2184419 - DNA, 20 bp, Homo sapiens
taagtggctgtgattaatta

SEQ ID NO: 2184420 - DNA, 16 bp, Homo sapiens
taagttgttgaaagta

SEQ ID NO: 2184421 - DNA, 22 bp, Homo sapiens
taagttgttttcccatttaaaa

SEQ ID NO: 2184422 - DNA, 14 bp, Homo sapiens
taagtttctttaga

SEQ ID NO: 2184423 - DNA, 16 bp, Homo sapiens
taagtttctttagaaa

SEQ ID NO: 2184424 - DNA, 17 bp, Homo sapiens
taataatggttactcat

SEQ ID NO: 2184425 - DNA, 17 bp, Homo sapiens
taataccaccaacaaat

SEQ ID NO: 2184426 - DNA, 14 bp, Homo sapiens
taatacttaaaaat

SEQ ID NO: 2184427 - DNA, 20 bp, Homo sapiens
taatacttaaaaatatgtga

SEQ ID NO: 2184428 - DNA, 14 bp, Homo sapiens
taatagctgaacct

SEQ ID NO: 2184429 - DNA, 14 bp, Homo sapiens
taatattaatttat

SEQ ID NO: 2184430 - DNA, 23 bp, Homo sapiens
taatattaccgtggtttatgaac

SEQ ID NO: 2184431 - DNA, 22 bp, Homo sapiens
taatcaatactttgaacacaaa

SEQ ID NO: 2184432 - DNA, 13 bp, Homo sapiens
taatccctgcttt

SEQ ID NO: 2184433 - DNA, 16 bp, Homo sapiens
taatcgtttttgtttt

SEQ ID NO: 2184434 - DNA, 23 bp, Homo sapiens
taatgaaataaatcatgttaatc

SEQ ID NO: 2184435 - DNA, 16 bp, Homo sapiens
taatgatactgtctaa

SEQ ID NO: 2184436 - DNA, 20 bp, Homo sapiens
taatgccaagggtaaacaag

SEQ ID NO: 2184437 - DNA, 23 bp, Homo sapiens
taatgggcctatttgacttctga

SEQ ID NO: 2184438 - DNA, 16 bp, Homo sapiens
taatgtagataaagca

SEQ ID NO: 2184439 - DNA, 14 bp, Homo sapiens
taatgtagccatgg

SEQ ID NO: 2184440 - DNA, 15 bp, Homo sapiens
taatgtagtgcagtc

SEQ ID NO: 2184441 - DNA, 23 bp, Homo sapiens
taatgtgtatgtctggtaaatag

SEQ ID NO: 2184442 - DNA, 18 bp, Homo sapiens
taatgttacatagtaaat

SEQ ID NO: 2184443 - DNA, 15 bp, Homo sapiens
taattaaagaaaatt

SEQ ID NO: 2184444 - DNA, 17 bp, Homo sapiens
taattaaagaaaattgc

SEQ ID NO: 2184445 - DNA, 21 bp, Homo sapiens
taattaaagaaaattgccaaa

SEQ ID NO: 2184446 - DNA, 23 bp, Homo sapiens
taattaaagaaaattgccaaaat

SEQ ID NO: 2184447 - DNA, 21 bp, Homo sapiens
taattaccatacataaactgt

SEQ ID NO: 2184448 - DNA, 22 bp, Homo sapiens
taattgtaaagtaaaagctata

SEQ ID NO: 2184449 - DNA, 16 bp, Homo sapiens
taattgtggagaggag

SEQ ID NO: 2184450 - DNA, 12 bp, Homo sapiens
taattgttatac

SEQ ID NO: 2184451 - DNA, 15 bp, Homo sapiens
taattgttatacatt

SEQ ID NO: 2184452 - DNA, 18 bp, Homo sapiens
taattgttatacattttt

SEQ ID NO: 2184453 - DNA, 22 bp, Homo sapiens
taattgttatacatttttaatt

SEQ ID NO: 2184454 - DNA, 17 bp, Homo sapiens
taattgttctcagaatc

SEQ ID NO: 2184455 - DNA, 17 bp, Homo sapiens
taatttaaagctgtttc

SEQ ID NO: 2184456 - DNA, 20 bp, Homo sapiens
taatttcaaatctgtaatta

SEQ ID NO: 2184457 - DNA, 19 bp, Homo sapiens
taattttaaagtaaaaggc

SEQ ID NO: 2184458 - DNA, 14 bp, Homo sapiens
taatttttacatga

SEQ ID NO: 2184459 - DNA, 18 bp, Homo sapiens
taattttttagttaaaat

SEQ ID NO: 2184460 - DNA, 15 bp, Homo sapiens
taatttttttctagt

SEQ ID NO: 2184461 - DNA, 19 bp, Homo sapiens
tacaaaaactttttgttgt

SEQ ID NO: 2184462 - DNA, 16 bp, Homo sapiens
tacaagagggcaaagc

SEQ ID NO: 2184463 - DNA, 18 bp, Homo sapiens
tacaagagggcaaagctg

SEQ ID NO: 2184464 - DNA, 21 bp, Homo sapiens
tacaagagggcaaagctgatt

SEQ ID NO: 2184465 - DNA, 15 bp, Homo sapiens
tacaagagtctgtat

SEQ ID NO: 2184466 - DNA, 19 bp, Homo sapiens
tacaaggcaggcctttcct

SEQ ID NO: 2184467 - DNA, 22 bp, Homo sapiens
tacaagtgctcagttccaatgt

SEQ ID NO: 2184468 - DNA, 12 bp, Homo sapiens
tacaagtttcag

SEQ ID NO: 2184469 - DNA, 17 bp, Homo sapiens
tacaagtttcagtaata

SEQ ID NO: 2184470 - DNA, 21 bp, Homo sapiens
tacaataccgtaacaatgttt

SEQ ID NO: 2184471 - DNA, 22 bp, Homo sapiens
tacaataggatttaatttgttg

SEQ ID NO: 2184472 - DNA, 11 bp, Homo sapiens
tacaatattgc

SEQ ID NO: 2184473 - DNA, 20 bp, Homo sapiens
tacaattcaaacaattcaat

SEQ ID NO: 2184474 - DNA, 22 bp, Homo sapiens
tacacaactccactgtctttaa

SEQ ID NO: 2184475 - DNA, 22 bp, Homo sapiens
tacacaagactttccccatact

SEQ ID NO: 2184476 - DNA, 20 bp, Homo sapiens
tacacacgtgtgatgtatgt

SEQ ID NO: 2184477 - DNA, 14 bp, Homo sapiens
tacacattaaagta

SEQ ID NO: 2184478 - DNA, 14 bp, Homo sapiens
tacacccatgcaca

SEQ ID NO: 2184479 - DNA, 16 bp, Homo sapiens
tacacccatgcacaga

SEQ ID NO: 2184480 - DNA, 19 bp, Homo sapiens
tacacccatgcacagaaca

SEQ ID NO: 2184481 - DNA, 12 bp, Homo sapiens
tacacctaactc

SEQ ID NO: 2184482 - DNA, 14 bp, Homo sapiens
tacactcattgaaa

SEQ ID NO: 2184483 - DNA, 19 bp, Homo sapiens
tacactcattgaaatgtaa

SEQ ID NO: 2184484 - DNA, 21 bp, Homo sapiens
tacacttactgttgtcctatg

SEQ ID NO: 2184485 - DNA, 17 bp, Homo sapiens
tacagaggattctgtct

SEQ ID NO: 2184486 - DNA, 13 bp, Homo sapiens
tacagagtgggcc

SEQ ID NO: 2184487 - DNA, 23 bp, Homo sapiens
tacagccctggaggccgctgctg

SEQ ID NO: 2184488 - DNA, 15 bp, Homo sapiens
tacagcttttctctt

SEQ ID NO: 2184489 - DNA, 17 bp, Homo sapiens
tacaggtgactgccacc

SEQ ID NO: 2184490 - DNA, 16 bp, Homo sapiens
tacaggtgtgagccac

SEQ ID NO: 2184491 - DNA, 20 bp, Homo sapiens
tacagtacaatcagcagtct

SEQ ID NO: 2184492 - DNA, 13 bp, Homo sapiens
tacagtatgtgtc

SEQ ID NO: 2184493 - DNA, 14 bp, Homo sapiens
tacagtatgtgtct

SEQ ID NO: 2184494 - DNA, 22 bp, Homo sapiens
tacagttgactggctttcctct

SEQ ID NO: 2184495 - DNA, 13 bp, Homo sapiens
tacataacttcag

SEQ ID NO: 2184496 - DNA, 16 bp, Homo sapiens
tacatactatagattc

SEQ ID NO: 2184497 - DNA, 18 bp, Homo sapiens
tacatagagagagacagt

SEQ ID NO: 2184498 - DNA, 18 bp, Homo sapiens
tacatagatgtatcatta

SEQ ID NO: 2184499 - DNA, 17 bp, Homo sapiens
tacatgggtagcttctg

SEQ ID NO: 2184500 - DNA, 16 bp, Homo sapiens
tacatggtagcagggt

SEQ ID NO: 2184501 - DNA, 15 bp, Homo sapiens
tacattattggactt

SEQ ID NO: 2184502 - DNA, 11 bp, Homo sapiens
taccaaagctg

SEQ ID NO: 2184503 - DNA, 15 bp, Homo sapiens
taccaccaacaaata

SEQ ID NO: 2184504 - DNA, 20 bp, Homo sapiens
taccactggtgtaaaaaaca

SEQ ID NO: 2184505 - DNA, 15 bp, Homo sapiens
taccagatcactcaa

SEQ ID NO: 2184506 - DNA, 22 bp, Homo sapiens
taccattttgcgatgtgtttta

SEQ ID NO: 2184507 - DNA, 13 bp, Homo sapiens
tatttttcctcaa

SEQ ID NO: 2184508 - DNA, 12 bp, Homo sapiens
tatttttcttga

SEQ ID NO: 2184509 - DNA, 17 bp, Homo sapiens
tatttttgtactgtgct

SEQ ID NO: 2184510 - DNA, 14 bp, Homo sapiens
tatttttttattct

SEQ ID NO: 2184511 - DNA, 16 bp, Homo sapiens
tcaaaaacaaactagg

SEQ ID NO: 2184512 - DNA, 12 bp, Homo sapiens
tcaaaaatcatt

SEQ ID NO: 2184513 - DNA, 20 bp, Homo sapiens
tcaaaaatcattaacacttt

SEQ ID NO: 2184514 - DNA, 19 bp, Homo sapiens
tcaaaacagtcatattttt

SEQ ID NO: 2184515 - DNA, 20 bp, Homo sapiens
tcaaaataagccatgctgct

SEQ ID NO: 2184516 - DNA, 23 bp, Homo sapiens
tcaaaatggtttattttaggaaa

SEQ ID NO: 2184517 - DNA, 21 bp, Homo sapiens
tcaaaatgttaataaaggttt

SEQ ID NO: 2184518 - DNA, 19 bp, Homo sapiens
tcaaaccctgtttacggta

SEQ ID NO: 2184519 - DNA, 15 bp, Homo sapiens
tcaaagatgataatt

SEQ ID NO: 2184520 - DNA, 17 bp, Homo sapiens
tcaaagctgaagccgcc

SEQ ID NO: 2184521 - DNA, 20 bp, Homo sapiens
tcaaaggagcgagcatgtcg

SEQ ID NO: 2184522 - DNA, 14 bp, Homo sapiens
tcaaaggccccctt

SEQ ID NO: 2184523 - DNA, 17 bp, Homo sapiens
tcaaatacttcaaatca

SEQ ID NO: 2184524 - DNA, 21 bp, Homo sapiens
tcaacaagatttcttaatgct

SEQ ID NO: 2184525 - DNA, 15 bp, Homo sapiens
tcaacataacataag

SEQ ID NO: 2184526 - DNA, 18 bp, Homo sapiens
tcaacatggaaaaatcct

SEQ ID NO: 2184527 - DNA, 13 bp, Homo sapiens
tcaaccaggaaga

SEQ ID NO: 2184528 - DNA, 13 bp, Homo sapiens
tcaacctccctgg

SEQ ID NO: 2184529 - DNA, 20 bp, Homo sapiens
tcaaccttgtgtgagtgtga

SEQ ID NO: 2184530 - DNA, 16 bp, Homo sapiens
tcaagacgaggggcag

SEQ ID NO: 2184531 - DNA, 17 bp, Homo sapiens
tcaagacgaggggcagg

SEQ ID NO: 2184532 - DNA, 20 bp, Homo sapiens
tcaagacgaggggcagggaa

SEQ ID NO: 2184533 - DNA, 22 bp, Homo sapiens
tcaagattcccggctggacttt

SEQ ID NO: 2184534 - DNA, 13 bp, Homo sapiens
tcaagcactgaca

SEQ ID NO: 2184535 - DNA, 17 bp, Homo sapiens
tcaagctttcaaatcct

SEQ ID NO: 2184536 - DNA, 18 bp, Homo sapiens
tcaaggcctgtccctggc

SEQ ID NO: 2184537 - DNA, 17 bp, Homo sapiens
tcaagggactgggggtg

SEQ ID NO: 2184538 - DNA, 20 bp, Homo sapiens
tcaagggactgggggtgcca

SEQ ID NO: 2184539 - DNA, 16 bp, Homo sapiens
tcaaggtgtaaaatat

SEQ ID NO: 2184540 - DNA, 11 bp, Homo sapiens
tcaagtctgtg

SEQ ID NO: 2184541 - DNA, 21 bp, Homo sapiens
tcaagtctgtgcctggagctc

SEQ ID NO: 2184542 - DNA, 18 bp, Homo sapiens
tcaagtgcacctacacca

SEQ ID NO: 2184543 - DNA, 17 bp, Homo sapiens
tcaataaaatgcactga

SEQ ID NO: 2184544 - DNA, 17 bp, Homo sapiens
tcaatactttgaacaca

SEQ ID NO: 2184545 - DNA, 18 bp, Homo sapiens
tcaatactttgaacacaa

SEQ ID NO: 2184546 - DNA, 11 bp, Homo sapiens
tcaatatcaag

SEQ ID NO: 2184547 - DNA, 12 bp, Homo sapiens
tcaatcaaagct

SEQ ID NO: 2184548 - DNA, 19 bp, Homo sapiens
tcaatcaaagctacctttt

SEQ ID NO: 2184549 - DNA, 22 bp, Homo sapiens
tcaatcacaaaagtatattcaa

SEQ ID NO: 2184550 - DNA, 14 bp, Homo sapiens
tcaatgaatattgt

SEQ ID NO: 2184551 - DNA, 15 bp, Homo sapiens
tcaatttgattctat

SEQ ID NO: 2184552 - DNA, 22 bp, Homo sapiens
tcaattttcttcacactatcaa

SEQ ID NO: 2184553 - DNA, 20 bp, Homo sapiens
tcacaaaagtatattcaaaa

SEQ ID NO: 2184554 - DNA, 19 bp, Homo sapiens
tcacaaagctaaatacatg

SEQ ID NO: 2184555 - DNA, 15 bp, Homo sapiens
tcacaagctgcctcc

SEQ ID NO: 2184556 - DNA, 24 bp, Homo sapiens
tcacacagcacctcctctctgctg

SEQ ID NO: 2184557 - DNA, 15 bp, Homo sapiens
tcacacctagcgtca

SEQ ID NO: 2184558 - DNA, 23 bp, Homo sapiens
tcacactcttcagtgactcctgc

SEQ ID NO: 2184559 - DNA, 11 bp, Homo sapiens
tcacactttgc

SEQ ID NO: 2184560 - DNA, 13 bp, Homo sapiens
tcacagaggcagt

SEQ ID NO: 2184561 - DNA, 13 bp, Homo sapiens
tcacatgctggac

SEQ ID NO: 2184562 - DNA, 13 bp, Homo sapiens
tcaccctcagctg

SEQ ID NO: 2184563 - DNA, 15 bp, Homo sapiens
tcaccctcagctggc

SEQ ID NO: 2184564 - DNA, 20 bp, Homo sapiens
tcaccctgcttggggcctgg

SEQ ID NO: 2184565 - DNA, 23 bp, Homo sapiens
tcaccgagaggaaaaaggcttct

SEQ ID NO: 2184566 - DNA, 18 bp, Homo sapiens
tcacctgacattaattat

SEQ ID NO: 2184567 - DNA, 18 bp, Homo sapiens
tcacctgcgcagggccct

SEQ ID NO: 2184568 - DNA, 13 bp, Homo sapiens
tcacctgtcatca

SEQ ID NO: 2184569 - DNA, 14 bp, Homo sapiens
tcacgcctgtaatc

SEQ ID NO: 2184570 - DNA, 17 bp, Homo sapiens
tcacggcagcctcaacc

SEQ ID NO: 2184571 - DNA, 13 bp, Homo sapiens
tcactcccctcca

SEQ ID NO: 2184572 - DNA, 16 bp, Homo sapiens
tcactcccctcctttc

SEQ ID NO: 2184573 - DNA, 17 bp, Homo sapiens
tcactcccctcctttcc

SEQ ID NO: 2184574 - DNA, 15 bp, Homo sapiens
tcactccgcaaatat

SEQ ID NO: 2184575 - DNA, 16 bp, Homo sapiens
tcactcggctgtggag

SEQ ID NO: 2184576 - DNA, 19 bp, Homo sapiens
tcactgaagtgaatacatg

SEQ ID NO: 2184577 - DNA, 21 bp, Homo sapiens
tcactgaagtgaatacatggt

SEQ ID NO: 2184578 - DNA, 22 bp, Homo sapiens
tcactgacactgcgaactctca

SEQ ID NO: 2184579 - DNA, 17 bp, Homo sapiens
tcactgcctatacccct

SEQ ID NO: 2184580 - DNA, 20 bp, Homo sapiens
tcacttggtgatatgtccta

SEQ ID NO: 2184581 - DNA, 13 bp, Homo sapiens
tcacttgtgtttg

SEQ ID NO: 2184582 - DNA, 20 bp, Homo sapiens
tcacttgtgtttgtatataa

SEQ ID NO: 2184583 - DNA, 18 bp, Homo sapiens
tcagaacattcagctctg

SEQ ID NO: 2184584 - DNA, 19 bp, Homo sapiens
tcagaacattcagctctgg

SEQ ID NO: 2184585 - DNA, 21 bp, Homo sapiens
tcagaacattcagctctggag

SEQ ID NO: 2184586 - DNA, 15 bp, Homo sapiens
tcagaataaagaaca

SEQ ID NO: 2184587 - DNA, 15 bp, Homo sapiens
tcagaccttcttcca

SEQ ID NO: 2184588 - DNA, 15 bp, Homo sapiens
tcagataatcggtgc

SEQ ID NO: 2184589 - DNA, 16 bp, Homo sapiens
tcagatattttgcacg

SEQ ID NO: 2184590 - DNA, 20 bp, Homo sapiens
tcagatcctgctgccgcgtg

SEQ ID NO: 2184591 - DNA, 15 bp, Homo sapiens
tcagatgttggtctt

SEQ ID NO: 2184592 - DNA, 16 bp, Homo sapiens
tcagattgacaaggta

SEQ ID NO: 2184593 - DNA, 20 bp, Homo sapiens
tcagcaaaagttaatattca

SEQ ID NO: 2184594 - DNA, 12 bp, Homo sapiens
tcagcagtctag

SEQ ID NO: 2184595 - DNA, 18 bp, Homo sapiens
tcagcagtgattgaagta

SEQ ID NO: 2184596 - DNA, 23 bp, Homo sapiens
tcagcagtgattgaagtatctgt

SEQ ID NO: 2184597 - DNA, 14 bp, Homo sapiens
tcagccccagccca

SEQ ID NO: 2184598 - DNA, 15 bp, Homo sapiens
tcagccccagcccag

SEQ ID NO: 2184599 - DNA, 17 bp, Homo sapiens
tcagccccagcccagcc

SEQ ID NO: 2184600 - DNA, 17 bp, Homo sapiens
tcagccgaattgtggtg

SEQ ID NO: 2184601 - DNA, 13 bp, Homo sapiens
tcagcctctggcc

SEQ ID NO: 2184602 - DNA, 14 bp, Homo sapiens
tcagcctctggcca

SEQ ID NO: 2184603 - DNA, 17 bp, Homo sapiens
tcagctctggagaacag

SEQ ID NO: 2184604 - DNA, 14 bp, Homo sapiens
tcagctctggctca

SEQ ID NO: 2184605 - DNA, 20 bp, Homo sapiens
tcagctctggctcacagact

SEQ ID NO: 2184606 - DNA, 12 bp, Homo sapiens
tcagctgccccc

SEQ ID NO: 2184607 - DNA, 16 bp, Homo sapiens
tcagctgcccccgctc

SEQ ID NO: 2184608 - DNA, 21 bp, Homo sapiens
tcagctgcccccgctcatggg

SEQ ID NO: 2184609 - DNA, 22 bp, Homo sapiens
tcagctggcggaacctggctgc

SEQ ID NO: 2184610 - DNA, 23 bp, Homo sapiens
tcagctggcggaacctggctgcg

SEQ ID NO: 2184611 - DNA, 15 bp, Homo sapiens
tcagcttcaaataaa

SEQ ID NO: 2184612 - DNA, 13 bp, Homo sapiens
tcaggaacctgga

SEQ ID NO: 2184613 - DNA, 15 bp, Homo sapiens
tcaggaacctggacc

SEQ ID NO: 2184614 - DNA, 22 bp, Homo sapiens
tcaggaacctggaccaaagctg

SEQ ID NO: 2184615 - DNA, 15 bp, Homo sapiens
tcaggaattcagtgc

SEQ ID NO: 2184616 - DNA, 18 bp, Homo sapiens
tcaggaggccgttgcaga

SEQ ID NO: 2184617 - DNA, 18 bp, Homo sapiens
tcaggaggtactgtgagg

SEQ ID NO: 2184618 - DNA, 18 bp, Homo sapiens
tcaggatttggtttttct

SEQ ID NO: 2184619 - DNA, 11 bp, Homo sapiens
tcaggctctgc

SEQ ID NO: 2184620 - DNA, 23 bp, Homo sapiens
tcaggtcagggctatggatgggg

SEQ ID NO: 2184621 - DNA, 22 bp, Homo sapiens
tcaggtgaccaaaatccccttc

SEQ ID NO: 2184622 - DNA, 15 bp, Homo sapiens
tcagtaacagggcct

SEQ ID NO: 2184623 - DNA, 15 bp, Homo sapiens
tcagtaatagctgaa

SEQ ID NO: 2184624 - DNA, 18 bp, Homo sapiens
tcagtacccacctgagct

SEQ ID NO: 2184625 - DNA, 22 bp, Homo sapiens
tcagtacccacctgagctttgg

SEQ ID NO: 2184626 - DNA, 16 bp, Homo sapiens
tcagtgactcctgctg

SEQ ID NO: 2184627 - DNA, 22 bp, Homo sapiens
tcagtgactcctgctggtacct

SEQ ID NO: 2184628 - DNA, 14 bp, Homo sapiens
tcagtgatgggagt

SEQ ID NO: 2184629 - DNA, 13 bp, Homo sapiens
aagcctgctgatt

SEQ ID NO: 2184630 - DNA, 14 bp, Homo sapiens
aagcctgctgattt

SEQ ID NO: 2184631 - DNA, 22 bp, Homo sapiens
aagcctggtctcctcccaaaat

SEQ ID NO: 2184632 - DNA, 19 bp, Homo sapiens
aagcctgtcgtgttctctc

SEQ ID NO: 2184633 - DNA, 21 bp, Homo sapiens
aagcgatccctcccctcagcc

SEQ ID NO: 2184634 - DNA, 15 bp, Homo sapiens
aagctagctcccctc

SEQ ID NO: 2184635 - DNA, 18 bp, Homo sapiens
aagctagctcccctcctc

SEQ ID NO: 2184636 - DNA, 15 bp, Homo sapiens
aagctaggccccaga

SEQ ID NO: 2184637 - DNA, 20 bp, Homo sapiens
aagctaggccccagaggccc

SEQ ID NO: 2184638 - DNA, 13 bp, Homo sapiens
aagctataaagca

SEQ ID NO: 2184639 - DNA, 18 bp, Homo sapiens
aagctatgaatgttacta

SEQ ID NO: 2184640 - DNA, 14 bp, Homo sapiens
aagctgcctccctg

SEQ ID NO: 2184641 - DNA, 19 bp, Homo sapiens
aagctgcctccctgtccac

SEQ ID NO: 2184642 - DNA, 14 bp, Homo sapiens
aagctgcttctggg

SEQ ID NO: 2184643 - DNA, 15 bp, Homo sapiens
aagctggggacagct

SEQ ID NO: 2184644 - DNA, 16 bp, Homo sapiens
aagctggggacagctt

SEQ ID NO: 2184645 - DNA, 12 bp, Homo sapiens
aagctgtttcta

SEQ ID NO: 2184646 - DNA, 16 bp, Homo sapiens
aaggaaaaaagatttt

SEQ ID NO: 2184647 - DNA, 16 bp, Homo sapiens
aaggaaaaacatgctt

SEQ ID NO: 2184648 - DNA, 13 bp, Homo sapiens
aaggaaagaaggg

SEQ ID NO: 2184649 - DNA, 19 bp, Homo sapiens
aaggaagctttctctgctt

SEQ ID NO: 2184650 - DNA, 13 bp, Homo sapiens
aaggacaggaccc

SEQ ID NO: 2184651 - DNA, 15 bp, Homo sapiens
aaggacatttgggac

SEQ ID NO: 2184652 - DNA, 18 bp, Homo sapiens
aaggagacttaatttcaa

SEQ ID NO: 2184653 - DNA, 11 bp, Homo sapiens
aaggagcctgc

SEQ ID NO: 2184654 - DNA, 18 bp, Homo sapiens
aaggattctgaagtttta

SEQ ID NO: 2184655 - DNA, 15 bp, Homo sapiens
aaggcactgcacata

SEQ ID NO: 2184656 - DNA, 21 bp, Homo sapiens
aaggcactgcacataatttgc

SEQ ID NO: 2184657 - DNA, 16 bp, Homo sapiens
aaggcaggcatatcaa

SEQ ID NO: 2184658 - DNA, 19 bp, Homo sapiens
aaggcaggcctttcctaca

SEQ ID NO: 2184659 - DNA, 18 bp, Homo sapiens
aaggcagtggcaggggag

SEQ ID NO: 2184660 - DNA, 16 bp, Homo sapiens
aaggccgcccacctgc

SEQ ID NO: 2184661 - DNA, 22 bp, Homo sapiens
aaggccggcagcgggcggaggg

SEQ ID NO: 2184662 - DNA, 14 bp, Homo sapiens
aaggcctcttgctg

SEQ ID NO: 2184663 - DNA, 19 bp, Homo sapiens
aaggcctcttgctggtgca

SEQ ID NO: 2184664 - DNA, 14 bp, Homo sapiens
aaggctgccggctg

SEQ ID NO: 2184665 - DNA, 16 bp, Homo sapiens
aagggccctggcaccc

SEQ ID NO: 2184666 - DNA, 14 bp, Homo sapiens
aagggccttctcca

SEQ ID NO: 2184667 - DNA, 19 bp, Homo sapiens
aaggggaggacctctgggc

SEQ ID NO: 2184668 - DNA, 14 bp, Homo sapiens
aaggggtttctaac

SEQ ID NO: 2184669 - DNA, 14 bp, Homo sapiens
aaggtcaaaaacaa

SEQ ID NO: 2184670 - DNA, 18 bp, Homo sapiens
aaggtcaaaaacaaacta

SEQ ID NO: 2184671 - DNA, 20 bp, Homo sapiens
aaggtgaaaattgtataaat

SEQ ID NO: 2184672 - DNA, 21 bp, Homo sapiens
aaggtgccaccaccctgcccc

SEQ ID NO: 2184673 - DNA, 23 bp, Homo sapiens
aaggtgtaaaatatctacctgcc

SEQ ID NO: 2184674 - DNA, 18 bp, Homo sapiens
aaggttggaactgctgcc

SEQ ID NO: 2184675 - DNA, 23 bp, Homo sapiens
aaggttggaactgctgccatgat

SEQ ID NO: 2184676 - DNA, 16 bp, Homo sapiens
aaggtttcactgttca

SEQ ID NO: 2184677 - DNA, 17 bp, Homo sapiens
aaggtttcactgttcat

SEQ ID NO: 2184678 - DNA, 17 bp, Homo sapiens
aagtaccatagaacaga

SEQ ID NO: 2184679 - DNA, 18 bp, Homo sapiens
aagtagcaggcccagctg

SEQ ID NO: 2184680 - DNA, 20 bp, Homo sapiens
aagtagggatgcggatcctg

SEQ ID NO: 2184681 - DNA, 14 bp, Homo sapiens
aagtataaacctta

SEQ ID NO: 2184682 - DNA, 19 bp, Homo sapiens
aagtatattcaaaaattat

SEQ ID NO: 2184683 - DNA, 22 bp, Homo sapiens
aagtatgcactaatcaatactt

SEQ ID NO: 2184684 - DNA, 14 bp, Homo sapiens
aagtccctgccccc

SEQ ID NO: 2184685 - DNA, 16 bp, Homo sapiens
aagtcctctaaacaca

SEQ ID NO: 2184686 - DNA, 18 bp, Homo sapiens
aagtcctctaaacacact

SEQ ID NO: 2184687 - DNA, 13 bp, Homo sapiens
aagtcggccaggt

SEQ ID NO: 2184688 - DNA, 22 bp, Homo sapiens
aagtctgtgcctggagctcctg

SEQ ID NO: 2184689 - DNA, 23 bp, Homo sapiens
aagtctgtgcctggagctcctgg

SEQ ID NO: 2184690 - DNA, 23 bp, Homo sapiens
aagtctttagtgttcaaatactt

SEQ ID NO: 2184691 - DNA, 14 bp, Homo sapiens
aagtgaaaatggtc

SEQ ID NO: 2184692 - DNA, 14 bp, Homo sapiens
aagtgaaataatat

SEQ ID NO: 2184693 - DNA, 17 bp, Homo sapiens
aagtgaaataatattga

SEQ ID NO: 2184694 - DNA, 20 bp, Homo sapiens
aagtgaacaatcagcggcat

SEQ ID NO: 2184695 - DNA, 20 bp, Homo sapiens
aagtgactaccacttatttc

SEQ ID NO: 2184696 - DNA, 22 bp, Homo sapiens
aagtgactaccacttatttcta

SEQ ID NO: 2184697 - DNA, 18 bp, Homo sapiens
aagtgagcaaacctgccc

SEQ ID NO: 2184698 - DNA, 22 bp, Homo sapiens
aagtgcaaagctgcttgaatca

SEQ ID NO: 2184699 - DNA, 21 bp, Homo sapiens
aagtgctagccactggaaatg

SEQ ID NO: 2184700 - DNA, 13 bp, Homo sapiens
acctttagaatat

SEQ ID NO: 2184701 - DNA, 17 bp, Homo sapiens
acctttcccacagtctc

SEQ ID NO: 2184702 - DNA, 15 bp, Homo sapiens
acctttctgaatgga

SEQ ID NO: 2184703 - DNA, 14 bp, Homo sapiens
accttttttttacg

SEQ ID NO: 2184704 - DNA, 16 bp, Homo sapiens
accttttttttacgga

SEQ ID NO: 2184705 - DNA, 17 bp, Homo sapiens
accttttttttacggaa

SEQ ID NO: 2184706 - DNA, 18 bp, Homo sapiens
accttttttttacggaat

SEQ ID NO: 2184707 - DNA, 15 bp, Homo sapiens
acgacctacattaat

SEQ ID NO: 2184708 - DNA, 20 bp, Homo sapiens
acgagcccttttagatgctt

SEQ ID NO: 2184709 - DNA, 19 bp, Homo sapiens
acgagggatgtggagcaca

SEQ ID NO: 2184710 - DNA, 19 bp, Homo sapiens
acgcaaacctctccttcct

SEQ ID NO: 2184711 - DNA, 20 bp, Homo sapiens
acgcaaacctctccttcctc

SEQ ID NO: 2184712 - DNA, 15 bp, Homo sapiens
acgcaggctgagtgc

SEQ ID NO: 2184713 - DNA, 16 bp, Homo sapiens
acgcctcttgaccagg

SEQ ID NO: 2184714 - DNA, 21 bp, Homo sapiens
acgcttgacaggacagcatgg

SEQ ID NO: 2184715 - DNA, 15 bp, Homo sapiens
acggaacactgtcaa

SEQ ID NO: 2184716 - DNA, 11 bp, Homo sapiens
acggaattcca

SEQ ID NO: 2184717 - DNA, 23 bp, Homo sapiens
acggcagcctcaacctccctggc

SEQ ID NO: 2184718 - DNA, 19 bp, Homo sapiens
acggcccgccgtgcctgca

SEQ ID NO: 2184719 - DNA, 18 bp, Homo sapiens
acggcctatgagatgaaa

SEQ ID NO: 2184720 - DNA, 23 bp, Homo sapiens
acggctgttcccctcacccaaaa

SEQ ID NO: 2184721 - DNA, 22 bp, Homo sapiens
acgggaggaatcttttactgtg

SEQ ID NO: 2184722 - DNA, 22 bp, Homo sapiens
acgggagtggccatctggaaat

SEQ ID NO: 2184723 - DNA, 18 bp, Homo sapiens
acgggggttggggtgggg

SEQ ID NO: 2184724 - DNA, 18 bp, Homo sapiens
acggtggtgcatgcctgt

SEQ ID NO: 2184725 - DNA, 17 bp, Homo sapiens
acggttttggcagctga

SEQ ID NO: 2184726 - DNA, 17 bp, Homo sapiens
acgtatcacctttccca

SEQ ID NO: 2184727 - DNA, 21 bp, Homo sapiens
acgtatgcatttttttagttt

SEQ ID NO: 2184728 - DNA, 19 bp, Homo sapiens
acgtccacccgtttccaag

SEQ ID NO: 2184729 - DNA, 23 bp, Homo sapiens
acgtgagagaaagagagaagcca

SEQ ID NO: 2184730 - DNA, 15 bp, Homo sapiens
acgtgctggagagta

SEQ ID NO: 2184731 - DNA, 14 bp, Homo sapiens
acgtgtaacttgtg

SEQ ID NO: 2184732 - DNA, 13 bp, Homo sapiens
acgtgtgatgtat

SEQ ID NO: 2184733 - DNA, 14 bp, Homo sapiens
acgttatctcattg

SEQ ID NO: 2184734 - DNA, 23 bp, Homo sapiens
acgttatctcattgcaaaaatat

SEQ ID NO: 2184735 - DNA, 18 bp, Homo sapiens
acgtttagtaactgtttt

SEQ ID NO: 2184736 - DNA, 12 bp, Homo sapiens
acgttttagaaa

SEQ ID NO: 2184737 - DNA, 18 bp, Homo sapiens
acgttttagaaaatttta

SEQ ID NO: 2184738 - DNA, 17 bp, Homo sapiens
actaagagaagttgtaa

SEQ ID NO: 2184739 - DNA, 23 bp, Homo sapiens
actaagggggtgaccatgcaatt

SEQ ID NO: 2184740 - DNA, 12 bp, Homo sapiens
actaataaaata

SEQ ID NO: 2184741 - DNA, 16 bp, Homo sapiens
actaataaaatacata

SEQ ID NO: 2184742 - DNA, 15 bp, Homo sapiens
actacagaggattct

SEQ ID NO: 2184743 - DNA, 13 bp, Homo sapiens
actactgaaattt

SEQ ID NO: 2184744 - DNA, 15 bp, Homo sapiens
actacttatctctaa

SEQ ID NO: 2184745 - DNA, 16 bp, Homo sapiens
actagaccatttttaa

SEQ ID NO: 2184746 - DNA, 21 bp, Homo sapiens
actagcctccctctcctctgt

SEQ ID NO: 2184747 - DNA, 21 bp, Homo sapiens
actagccttcttttgtacttt

SEQ ID NO: 2184748 - DNA, 17 bp, Homo sapiens
actaggattagaaaatt

SEQ ID NO: 2184749 - DNA, 19 bp, Homo sapiens
actaggctgggtgcccaca

SEQ ID NO: 2184750 - DNA, 21 bp, Homo sapiens
actagggaagaaagcagaaca

SEQ ID NO: 2184751 - DNA, 14 bp, Homo sapiens
actagtctgtgtgc

SEQ ID NO: 2184752 - DNA, 13 bp, Homo sapiens
actataacaaaat

SEQ ID NO: 2184753 - DNA, 18 bp, Homo sapiens
actatagattctttatta

SEQ ID NO: 2184754 - DNA, 21 bp, Homo sapiens
actatgctattaaaaaaaaag

SEQ ID NO: 2184755 - DNA, 20 bp, Homo sapiens
actatggtgccaatggaacc

SEQ ID NO: 2184756 - DNA, 19 bp, Homo sapiens
actattgcttaaacaaaac

SEQ ID NO: 2184757 - DNA, 14 bp, Homo sapiens
actattgtagagtg

SEQ ID NO: 2184758 - DNA, 22 bp, Homo sapiens
agctacactcattgaaatgtaa

SEQ ID NO: 2184759 - DNA, 14 bp, Homo sapiens
agctacagccagcg

SEQ ID NO: 2184760 - DNA, 14 bp, Homo sapiens
agctacttgggcca

SEQ ID NO: 2184761 - DNA, 22 bp, Homo sapiens
agctacttgggccatagctcct

SEQ ID NO: 2184762 - DNA, 22 bp, Homo sapiens
agctagagaggggcctctggct

SEQ ID NO: 2184763 - DNA, 23 bp, Homo sapiens
agctagagaggggcctctggctg

SEQ ID NO: 2184764 - DNA, 14 bp, Homo sapiens
agctagctcccctc

SEQ ID NO: 2184765 - DNA, 21 bp, Homo sapiens
agctagctcccctcctctccc

SEQ ID NO: 2184766 - DNA, 22 bp, Homo sapiens
agctatacctcattcacagctc

SEQ ID NO: 2184767 - DNA, 12 bp, Homo sapiens
agctcacggcag

SEQ ID NO: 2184768 - DNA, 15 bp, Homo sapiens
agctcagccccagcc

SEQ ID NO: 2184769 - DNA, 13 bp, Homo sapiens
agctcaggagaga

SEQ ID NO: 2184770 - DNA, 22 bp, Homo sapiens
agctcagtcttccctagggctg

SEQ ID NO: 2184771 - DNA, 14 bp, Homo sapiens
agctccacaagaga

SEQ ID NO: 2184772 - DNA, 14 bp, Homo sapiens
agctccagtcctgc

SEQ ID NO: 2184773 - DNA, 15 bp, Homo sapiens
agctccagtcctgct

SEQ ID NO: 2184774 - DNA, 14 bp, Homo sapiens
agctccgcctggca

SEQ ID NO: 2184775 - DNA, 15 bp, Homo sapiens
agctctggctcacag

SEQ ID NO: 2184776 - DNA, 20 bp, Homo sapiens
agctctggctcacagactgg

SEQ ID NO: 2184777 - DNA, 16 bp, Homo sapiens
agctcttagtcctccc

SEQ ID NO: 2184778 - DNA, 22 bp, Homo sapiens
agctcttagtcctccctgctca

SEQ ID NO: 2184779 - DNA, 14 bp, Homo sapiens
agctcttctcctca

SEQ ID NO: 2184780 - DNA, 16 bp, Homo sapiens
agctcttgtacagaca

SEQ ID NO: 2184781 - DNA, 13 bp, Homo sapiens
agctgaagacaaa

SEQ ID NO: 2184782 - DNA, 12 bp, Homo sapiens
agctgaaggcag

SEQ ID NO: 2184783 - DNA, 17 bp, Homo sapiens
agctgacgaggctgggc

SEQ ID NO: 2184784 - DNA, 18 bp, Homo sapiens
agctgcccccgctcatgg

SEQ ID NO: 2184785 - DNA, 19 bp, Homo sapiens
agctgcccccgctcatggg

SEQ ID NO: 2184786 - DNA, 16 bp, Homo sapiens
agctgctggttttggt

SEQ ID NO: 2184787 - DNA, 20 bp, Homo sapiens
agctgcttctgggggatttc

SEQ ID NO: 2184788 - DNA, 15 bp, Homo sapiens
agctggcaggagggt

SEQ ID NO: 2184789 - DNA, 17 bp, Homo sapiens
agctggcaggagggtgg

SEQ ID NO: 2184790 - DNA, 16 bp, Homo sapiens
agctggcctcacctgg

SEQ ID NO: 2184791 - DNA, 15 bp, Homo sapiens
agctggcggaacctg

SEQ ID NO: 2184792 - DNA, 21 bp, Homo sapiens
agctgggcaaacccttctctt

SEQ ID NO: 2184793 - DNA, 11 bp, Homo sapiens
agctggggaca

SEQ ID NO: 2184794 - DNA, 18 bp, Homo sapiens
agctggtttttcccacca

SEQ ID NO: 2184795 - DNA, 19 bp, Homo sapiens
agctgtatatttgaaactg

SEQ ID NO: 2184796 - DNA, 13 bp, Homo sapiens
agctgtatgtact

SEQ ID NO: 2184797 - DNA, 13 bp, Homo sapiens
agctgtccctgca

SEQ ID NO: 2184798 - DNA, 14 bp, Homo sapiens
aggcattaaatgca

SEQ ID NO: 2184799 - DNA, 17 bp, Homo sapiens
aggcattaaatgcaaaa

SEQ ID NO: 2184800 - DNA, 18 bp, Homo sapiens
aggcattaaatgcaaaaa

SEQ ID NO: 2184801 - DNA, 22 bp, Homo sapiens
aggccacgggggaggccgaggc

SEQ ID NO: 2184802 - DNA, 20 bp, Homo sapiens
aggccacttagtcgtctttt

SEQ ID NO: 2184803 - DNA, 13 bp, Homo sapiens
aggcccagctggg

SEQ ID NO: 2184804 - DNA, 17 bp, Homo sapiens
aggccccagaggccctg

SEQ ID NO: 2184805 - DNA, 14 bp, Homo sapiens
aggcccctggtggc

SEQ ID NO: 2184806 - DNA, 12 bp, Homo sapiens
aggccctggagg

SEQ ID NO: 2184807 - DNA, 13 bp, Homo sapiens
aggccctggaggt

SEQ ID NO: 2184808 - DNA, 20 bp, Homo sapiens
aggccctggaggtctccagg

SEQ ID NO: 2184809 - DNA, 16 bp, Homo sapiens
aggcccttttctggct

SEQ ID NO: 2184810 - DNA, 18 bp, Homo sapiens
aggcccttttctggctcc

SEQ ID NO: 2184811 - DNA, 21 bp, Homo sapiens
aggcccttttctggctcctgt

SEQ ID NO: 2184812 - DNA, 22 bp, Homo sapiens
aggcccttttctggctcctgtg

SEQ ID NO: 2184813 - DNA, 16 bp, Homo sapiens
aggccggcagcgggcg

SEQ ID NO: 2184814 - DNA, 15 bp, Homo sapiens
aggcctcaccctgct

SEQ ID NO: 2184815 - DNA, 18 bp, Homo sapiens
aggcctcaccctgcttgg

SEQ ID NO: 2184816 - DNA, 18 bp, Homo sapiens
aggcctctgggcctcctc

SEQ ID NO: 2184817 - DNA, 15 bp, Homo sapiens
aggcctgacctcaag

SEQ ID NO: 2184818 - DNA, 22 bp, Homo sapiens
aggcctgtccctggccatctct

SEQ ID NO: 2184819 - DNA, 22 bp, Homo sapiens
aggcgatgtggtgaccccaccc

SEQ ID NO: 2184820 - DNA, 16 bp, Homo sapiens
aggctcaactagggag

SEQ ID NO: 2184821 - DNA, 18 bp, Homo sapiens
aggctcagccctgagctg

SEQ ID NO: 2184822 - DNA, 22 bp, Homo sapiens
aggctctgcacagacaagcagc

SEQ ID NO: 2184823 - DNA, 23 bp, Homo sapiens
aggctctgcacagacaagcagcc

SEQ ID NO: 2184824 - DNA, 23 bp, Homo sapiens
aggctggagtgatctcagctcac

SEQ ID NO: 2184825 - DNA, 13 bp, Homo sapiens
aggctggcctcag

SEQ ID NO: 2184826 - DNA, 14 bp, Homo sapiens
aggctggcctcaga

SEQ ID NO: 2184827 - DNA, 15 bp, Homo sapiens
aggctggcctcagac

SEQ ID NO: 2184828 - DNA, 16 bp, Homo sapiens
aggctgggcccagagg

SEQ ID NO: 2184829 - DNA, 17 bp, Homo sapiens
aggctgggcccagaggc

SEQ ID NO: 2184830 - DNA, 15 bp, Homo sapiens
aaaaacaaagtgcaa

SEQ ID NO: 2184831 - DNA, 11 bp, Homo sapiens
aaaaacatgct

SEQ ID NO: 2184832 - DNA, 16 bp, Homo sapiens
aaaaacatgcttaagg

SEQ ID NO: 2184833 - DNA, 13 bp, Homo sapiens
aaaaacatgtcat

SEQ ID NO: 2184834 - DNA, 16 bp, Homo sapiens
aaaaacttttttggaa

SEQ ID NO: 2184835 - DNA, 19 bp, Homo sapiens
aaaaagaaagctgtgaaat

SEQ ID NO: 2184836 - DNA, 16 bp, Homo sapiens
aaaaataaaaatggaa

SEQ ID NO: 2184837 - DNA, 16 bp, Homo sapiens
aaaaataaaatgcatt

SEQ ID NO: 2184838 - DNA, 13 bp, Homo sapiens
aaaaataaaatgt

SEQ ID NO: 2184839 - DNA, 12 bp, Homo sapiens
aaaaatataaag

SEQ ID NO: 2184840 - DNA, 23 bp, Homo sapiens
aaaaatgagcttccattaatttt

SEQ ID NO: 2184841 - DNA, 15 bp, Homo sapiens
aaaaattaattcttt

SEQ ID NO: 2184842 - DNA, 19 bp, Homo sapiens
aaaacaaagtgcaaagctg

SEQ ID NO: 2184843 - DNA, 15 bp, Homo sapiens
aaaacacaaatgtgt

SEQ ID NO: 2184844 - DNA, 22 bp, Homo sapiens
aaaacagaggccacactttctg

SEQ ID NO: 2184845 - DNA, 19 bp, Homo sapiens
aaaacatgtatgtttgctc

SEQ ID NO: 2184846 - DNA, 12 bp, Homo sapiens
aaaacatgtcat

SEQ ID NO: 2184847 - DNA, 16 bp, Homo sapiens
aaaacccagcatgtac

SEQ ID NO: 2184848 - DNA, 19 bp, Homo sapiens
aaaacccagcatgtacaaa

SEQ ID NO: 2184849 - DNA, 21 bp, Homo sapiens
aaaacttcattctaaaccaaa

SEQ ID NO: 2184850 - DNA, 17 bp, Homo sapiens
aaaactttttgttgttt

SEQ ID NO: 2184851 - DNA, 13 bp, Homo sapiens
aaaagattgcaaa

SEQ ID NO: 2184852 - DNA, 19 bp, Homo sapiens
aaaagccaacaaaccaaga

SEQ ID NO: 2184853 - DNA, 17 bp, Homo sapiens
aaaagctataaagcagt

SEQ ID NO: 2184854 - DNA, 12 bp, Homo sapiens
aaaagctgttcc

SEQ ID NO: 2184855 - DNA, 20 bp, Homo sapiens
aaaagtatattcaaaaatta

SEQ ID NO: 2184856 - DNA, 22 bp, Homo sapiens
aaaagtatattcaaaaattata

SEQ ID NO: 2184857 - DNA, 15 bp, Homo sapiens
aaaagtcattcaaga

SEQ ID NO: 2184858 - DNA, 23 bp, Homo sapiens
aaaagtcttcaagggctgcttca

SEQ ID NO: 2184859 - DNA, 14 bp, Homo sapiens
aaaataaatcaagg

SEQ ID NO: 2184860 - DNA, 12 bp, Homo sapiens
aaaataagggcc

SEQ ID NO: 2184861 - DNA, 15 bp, Homo sapiens
aaaatacatactata

SEQ ID NO: 2184862 - DNA, 19 bp, Homo sapiens
aaaataggttttccctgtt

SEQ ID NO: 2184863 - DNA, 17 bp, Homo sapiens
aaaatattggctgattt

SEQ ID NO: 2184864 - DNA, 22 bp, Homo sapiens
aaaatcatgcttataagcaaca

SEQ ID NO: 2184865 - DNA, 14 bp, Homo sapiens
aaaatccaatgctt

SEQ ID NO: 2184866 - DNA, 14 bp, Homo sapiens
aaaatgtataatga

SEQ ID NO: 2184867 - DNA, 15 bp, Homo sapiens
aaaatgttaataaag

SEQ ID NO: 2184868 - DNA, 13 bp, Homo sapiens
aaaattagaactt

SEQ ID NO: 2184869 - DNA, 12 bp, Homo sapiens
aaaattgtataa

SEQ ID NO: 2184870 - DNA, 17 bp, Homo sapiens
aaaattgttacccattt

SEQ ID NO: 2184871 - DNA, 21 bp, Homo sapiens
aaaattgttacccatttgaaa

SEQ ID NO: 2184872 - DNA, 16 bp, Homo sapiens
aaaatttgccctccca

SEQ ID NO: 2184873 - DNA, 22 bp, Homo sapiens
aaaattttctttcaacatttct

SEQ ID NO: 2184874 - DNA, 14 bp, Homo sapiens
aaacaaaactggaa

SEQ ID NO: 2184875 - DNA, 13 bp, Homo sapiens
aaacaaagtgcaa

SEQ ID NO: 2184876 - DNA, 15 bp, Homo sapiens
aaacaaagtgcaaag

SEQ ID NO: 2184877 - DNA, 16 bp, Homo sapiens
aaacaaagtgcaaagc

SEQ ID NO: 2184878 - DNA, 20 bp, Homo sapiens
aaacaaagtgcaaagctgct

SEQ ID NO: 2184879 - DNA, 17 bp, Homo sapiens
aaacaacgcaaacctct

SEQ ID NO: 2184880 - DNA, 18 bp, Homo sapiens
aaacaattcaatcaaagc

SEQ ID NO: 2184881 - DNA, 21 bp, Homo sapiens
aaacaattcaatcaaagctac

SEQ ID NO: 2184882 - DNA, 13 bp, Homo sapiens
aaacaccatcttc

SEQ ID NO: 2184883 - DNA, 22 bp, Homo sapiens
aaacacctaagtgactaccact

SEQ ID NO: 2184884 - DNA, 20 bp, Homo sapiens
aaacactacctcttttgaga

SEQ ID NO: 2184885 - DNA, 17 bp, Homo sapiens
aaacagctcagccagtg

SEQ ID NO: 2184886 - DNA, 12 bp, Homo sapiens
aaacagtgtttg

SEQ ID NO: 2184887 - DNA, 13 bp, Homo sapiens
aaacatgtcatgt

SEQ ID NO: 2184888 - DNA, 23 bp, Homo sapiens
aaacattcaaaaacatggccaca

SEQ ID NO: 2184889 - DNA, 11 bp, Homo sapiens
aaaccaaaaca

SEQ ID NO: 2184890 - DNA, 13 bp, Homo sapiens
aaaccaagactaa

SEQ ID NO: 2184891 - DNA, 14 bp, Homo sapiens
aaaccactgtacat

SEQ ID NO: 2184892 - DNA, 16 bp, Homo sapiens
aaacccagcatgtaca

SEQ ID NO: 2184893 - DNA, 14 bp, Homo sapiens
aaacccatcttcat

SEQ ID NO: 2184894 - DNA, 17 bp, Homo sapiens
aaacccttctcttctcc

SEQ ID NO: 2184895 - DNA, 20 bp, Homo sapiens
aaacctcttctgtatttttt

SEQ ID NO: 2184896 - DNA, 15 bp, Homo sapiens
aaacctttattcttt

SEQ ID NO: 2184897 - DNA, 17 bp, Homo sapiens
aaactaaactacagaaa

SEQ ID NO: 2184898 - DNA, 20 bp, Homo sapiens
aaactcatcgttctaaaatc

SEQ ID NO: 2184899 - DNA, 20 bp, Homo sapiens
aaactctccttttccttacc

SEQ ID NO: 2184900 - DNA, 16 bp, Homo sapiens
aaactgctaattacac

SEQ ID NO: 2184901 - DNA, 20 bp, Homo sapiens
aaactggagaggctaacctc

SEQ ID NO: 2184902 - DNA, 16 bp, Homo sapiens
aaacttcaagcaccag

SEQ ID NO: 2184903 - DNA, 16 bp, Homo sapiens
aaacttctagcttgga

SEQ ID NO: 2184904 - DNA, 13 bp, Homo sapiens
aaacttgagtttg

SEQ ID NO: 2184905 - DNA, 17 bp, Homo sapiens
aaagaaaagacaaatgg

SEQ ID NO: 2184906 - DNA, 18 bp, Homo sapiens
aaagaaaattgccaaaat

SEQ ID NO: 2184907 - DNA, 19 bp, Homo sapiens
aaagaaaattgccaaaata

SEQ ID NO: 2184908 - DNA, 14 bp, Homo sapiens
aaagaacattctaa

SEQ ID NO: 2184909 - DNA, 18 bp, Homo sapiens
aaagaacccatttgccat

SEQ ID NO: 2184910 - DNA, 24 bp, Homo sapiens
aaagaacccatttgccatgctgct

SEQ ID NO: 2184911 - DNA, 12 bp, Homo sapiens
aaagaagcaaga

SEQ ID NO: 2184912 - DNA, 23 bp, Homo sapiens
aaagaattgatcagaatcccaaa

SEQ ID NO: 2184913 - DNA, 22 bp, Homo sapiens
aaagacgctaataaaaatttat

SEQ ID NO: 2184914 - DNA, 23 bp, Homo sapiens
aaagacgctaataaaaatttatt

SEQ ID NO: 2184915 - DNA, 13 bp, Homo sapiens
aaagactttctaa

SEQ ID NO: 2184916 - DNA, 14 bp, Homo sapiens
aaagagagaagcca

SEQ ID NO: 2184917 - DNA, 16 bp, Homo sapiens
aaagagagaagccagc

SEQ ID NO: 2184918 - DNA, 11 bp, Homo sapiens
aaagagctgcc

SEQ ID NO: 2184919 - DNA, 16 bp, Homo sapiens
aaagaggaagccttgc

SEQ ID NO: 2184920 - DNA, 19 bp, Homo sapiens
aaagaggcaccaggaagcc

SEQ ID NO: 2184921 - DNA, 14 bp, Homo sapiens
aaagattgcaaagg

SEQ ID NO: 2184922 - DNA, 22 bp, Homo sapiens
aaagattgcaaagggacattga

SEQ ID NO: 2184923 - DNA, 23 bp, Homo sapiens
aaagattgcaaagggacattgaa

SEQ ID NO: 2184924 - DNA, 18 bp, Homo sapiens
aaagcacaaacttctgta

SEQ ID NO: 2184925 - DNA, 15 bp, Homo sapiens
aaagcattatttttt

SEQ ID NO: 2184926 - DNA, 17 bp, Homo sapiens
aaagcctgtgttactga

SEQ ID NO: 2184927 - DNA, 21 bp, Homo sapiens
aaagccttagggcaggaaaga

SEQ ID NO: 2184928 - DNA, 20 bp, Homo sapiens
aaagctataaagcagtattt

SEQ ID NO: 2184929 - DNA, 17 bp, Homo sapiens
aaagctgacgaggctgg

SEQ ID NO: 2184930 - DNA, 14 bp, Homo sapiens
aaagctgcttgaat

SEQ ID NO: 2184931 - DNA, 15 bp, Homo sapiens
aaagctgcttgaatc

SEQ ID NO: 2184932 - DNA, 17 bp, Homo sapiens
aaagctgtttctaaaca

SEQ ID NO: 2184933 - DNA, 14 bp, Homo sapiens
aaagctttcctgga

SEQ ID NO: 2184934 - DNA, 16 bp, Homo sapiens
aaagcttttgtaaaat

SEQ ID NO: 2184935 - DNA, 13 bp, Homo sapiens
aaaggcttctcca

SEQ ID NO: 2184936 - DNA, 14 bp, Homo sapiens
aaaggcttctccac

SEQ ID NO: 2184937 - DNA, 22 bp, Homo sapiens
aaagggagcagagaaggccagg

SEQ ID NO: 2184938 - DNA, 17 bp, Homo sapiens
aaaggtccttgacttga

SEQ ID NO: 2184939 - DNA, 14 bp, Homo sapiens
aaaggtgattttcc

SEQ ID NO: 2184940 - DNA, 15 bp, Homo sapiens
aaaggtttacagtga

SEQ ID NO: 2184941 - DNA, 19 bp, Homo sapiens
aaagtaccatagaacagaa

SEQ ID NO: 2184942 - DNA, 18 bp, Homo sapiens
aaagtagggatgcggatc

SEQ ID NO: 2184943 - DNA, 14 bp, Homo sapiens
aaagtctcctgtat

SEQ ID NO: 2184944 - DNA, 17 bp, Homo sapiens
aaagtctcctgtatcat

SEQ ID NO: 2184945 - DNA, 17 bp, Homo sapiens
aaagtcttcaagggctg

SEQ ID NO: 2184946 - DNA, 15 bp, Homo sapiens
aaggcaccagccggg

SEQ ID NO: 2184947 - DNA, 21 bp, Homo sapiens
aaggcagtggcaggggagcag

SEQ ID NO: 2184948 - DNA, 12 bp, Homo sapiens
aaggccacctgc

SEQ ID NO: 2184949 - DNA, 18 bp, Homo sapiens
aaggccaggggcttttgc

SEQ ID NO: 2184950 - DNA, 13 bp, Homo sapiens
aaggccgcccacc

SEQ ID NO: 2184951 - DNA, 15 bp, Homo sapiens
aaggccgcccacctg

SEQ ID NO: 2184952 - DNA, 21 bp, Homo sapiens
aaggcctatgccacctgcagc

SEQ ID NO: 2184953 - DNA, 17 bp, Homo sapiens
aatgagagagtgtggaa

SEQ ID NO: 2184954 - DNA, 20 bp, Homo sapiens
aatgatactgtctaagaata

SEQ ID NO: 2184955 - DNA, 19 bp, Homo sapiens
aatgatagtgttttgtact

SEQ ID NO: 2184956 - DNA, 21 bp, Homo sapiens
aatgatagtgttttgtacttg

SEQ ID NO: 2184957 - DNA, 13 bp, Homo sapiens
aatgatgtagaca

SEQ ID NO: 2184958 - DNA, 22 bp, Homo sapiens
aatgcaattgtcttgtaccttg

SEQ ID NO: 2184959 - DNA, 20 bp, Homo sapiens
aatgcatgctttggaaattt

SEQ ID NO: 2184960 - DNA, 18 bp, Homo sapiens
aatgccaggacagctgca

SEQ ID NO: 2184961 - DNA, 23 bp, Homo sapiens
aatgctgcacaccagttactgtt

SEQ ID NO: 2184962 - DNA, 23 bp, Homo sapiens
aatggagtagacccctggctggt

SEQ ID NO: 2184963 - DNA, 12 bp, Homo sapiens
aatggccctgtt

SEQ ID NO: 2184964 - DNA, 23 bp, Homo sapiens
aatggctcgtgggctctggctcc

SEQ ID NO: 2184965 - DNA, 20 bp, Homo sapiens
aatgggactgatgtcatctt

SEQ ID NO: 2184966 - DNA, 16 bp, Homo sapiens
aatgtgcccagtcatg

SEQ ID NO: 2184967 - DNA, 21 bp, Homo sapiens
aatgttacatagtaaatggta

SEQ ID NO: 2184968 - DNA, 21 bp, Homo sapiens
aattaaaaacacctaagtgac

SEQ ID NO: 2184969 - DNA, 18 bp, Homo sapiens
aattaaagaaaattgcca

SEQ ID NO: 2184970 - DNA, 21 bp, Homo sapiens
aattaaagaaaattgccaaaa

SEQ ID NO: 2184971 - DNA, 23 bp, Homo sapiens
aattaattctttatcacatgttg

SEQ ID NO: 2184972 - DNA, 17 bp, Homo sapiens
aattaatttgttaatta

SEQ ID NO: 2184973 - DNA, 19 bp, Homo sapiens
aattaatttgttaattaaa

SEQ ID NO: 2184974 - DNA, 14 bp, Homo sapiens
aattacaagtttca

SEQ ID NO: 2184975 - DNA, 15 bp, Homo sapiens
aattagaacttgaat

SEQ ID NO: 2184976 - DNA, 14 bp, Homo sapiens
aattatataactgt

SEQ ID NO: 2184977 - DNA, 17 bp, Homo sapiens
aattatataactgtatt

SEQ ID NO: 2184978 - DNA, 13 bp, Homo sapiens
aattatattttga

SEQ ID NO: 2184979 - DNA, 23 bp, Homo sapiens
aattatattttgaacaactcgaa

SEQ ID NO: 2184980 - DNA, 22 bp, Homo sapiens
aattattttctttttgtaatta

SEQ ID NO: 2184981 - DNA, 17 bp, Homo sapiens
aattcaaacaattcaat

SEQ ID NO: 2184982 - DNA, 15 bp, Homo sapiens
aattcaatcaaagct

SEQ ID NO: 2184983 - DNA, 15 bp, Homo sapiens
aattcacaagctgcc

SEQ ID NO: 2184984 - DNA, 16 bp, Homo sapiens
aattcagacatctgag

SEQ ID NO: 2184985 - DNA, 21 bp, Homo sapiens
aattcagacatctgaggtttt

SEQ ID NO: 2184986 - DNA, 13 bp, Homo sapiens
aattcagctgccc

SEQ ID NO: 2184987 - DNA, 13 bp, Homo sapiens
aattcattccatt

SEQ ID NO: 2184988 - DNA, 14 bp, Homo sapiens
aattcattccattt

SEQ ID NO: 2184989 - DNA, 15 bp, Homo sapiens
aattcattccatttg

SEQ ID NO: 2184990 - DNA, 19 bp, Homo sapiens
aattccaatatttataatt

SEQ ID NO: 2184991 - DNA, 21 bp, Homo sapiens
aattccaatatttataattaa

SEQ ID NO: 2184992 - DNA, 15 bp, Homo sapiens
aattccacccctcct

SEQ ID NO: 2184993 - DNA, 19 bp, Homo sapiens
aattccccttcccttattt

SEQ ID NO: 2184994 - DNA, 19 bp, Homo sapiens
aattctttatcacatgttg

SEQ ID NO: 2184995 - DNA, 20 bp, Homo sapiens
aattgaaatgggaacaatat

SEQ ID NO: 2184996 - DNA, 13 bp, Homo sapiens
aattgcctttgag

SEQ ID NO: 2184997 - DNA, 19 bp, Homo sapiens
aattgctaaatataaaaac

SEQ ID NO: 2184998 - DNA, 12 bp, Homo sapiens
aattgtgacagc

SEQ ID NO: 2184999 - DNA, 13 bp, Homo sapiens
aattgtggagagg

SEQ ID NO: 2185000 - DNA, 19 bp, Homo sapiens
aattgtggagaggagagaa

SEQ ID NO: 2185001 - DNA, 17 bp, Homo sapiens
aatttatcaaaaaacaa

SEQ ID NO: 2185002 - DNA, 23 bp, Homo sapiens
aatttatgcagagacagctgttt

SEQ ID NO: 2185003 - DNA, 13 bp, Homo sapiens
aatttattatgtg

SEQ ID NO: 2185004 - DNA, 22 bp, Homo sapiens
aatttattattaaatcagtttt

SEQ ID NO: 2185005 - DNA, 19 bp, Homo sapiens
aatttattctacttttaaa

SEQ ID NO: 2185006 - DNA, 17 bp, Homo sapiens
aatttcaaatctgtaat

SEQ ID NO: 2185007 - DNA, 19 bp, Homo sapiens
aatttctccccagggtgga

SEQ ID NO: 2185008 - DNA, 16 bp, Homo sapiens
aatttctctcaatttg

SEQ ID NO: 2185009 - DNA, 15 bp, Homo sapiens
aatttgccctcccat

SEQ ID NO: 2185010 - DNA, 16 bp, Homo sapiens
aatttggtctgcctct

SEQ ID NO: 2185011 - DNA, 18 bp, Homo sapiens
aattttaaagtaaaaggc

SEQ ID NO: 2185012 - DNA, 13 bp, Homo sapiens
aattttacaaaaa

SEQ ID NO: 2185013 - DNA, 17 bp, Homo sapiens
aattttctagaatacta

SEQ ID NO: 2185014 - DNA, 13 bp, Homo sapiens
aattttgaccata

SEQ ID NO: 2185015 - DNA, 18 bp, Homo sapiens
aattttgttaagaatttc

SEQ ID NO: 2185016 - DNA, 15 bp, Homo sapiens
aatttttacatgacc

SEQ ID NO: 2185017 - DNA, 20 bp, Homo sapiens
aattttttttctgaacaaaa

SEQ ID NO: 2185018 - DNA, 22 bp, Homo sapiens
aattttttttctgaacaaaagc

SEQ ID NO: 2185019 - DNA, 17 bp, Homo sapiens
acaaaaccaagccttgg

SEQ ID NO: 2185020 - DNA, 19 bp, Homo sapiens
acaaaactgtaactgcatt

SEQ ID NO: 2185021 - DNA, 16 bp, Homo sapiens
acaaaagtaccataga

SEQ ID NO: 2185022 - DNA, 17 bp, Homo sapiens
acaaaagtaccatagaa

SEQ ID NO: 2185023 - DNA, 23 bp, Homo sapiens
acaaaagtatattcaaaaattat

SEQ ID NO: 2185024 - DNA, 17 bp, Homo sapiens
acaaacaccatcttcag

SEQ ID NO: 2185025 - DNA, 16 bp, Homo sapiens
acaaaccactgtacat

SEQ ID NO: 2185026 - DNA, 16 bp, Homo sapiens
acaaagtcatgaagct

SEQ ID NO: 2185027 - DNA, 18 bp, Homo sapiens
acaaagtgcaaagctgct

SEQ ID NO: 2185028 - DNA, 19 bp, Homo sapiens
acaaatagtgctaataaag

SEQ ID NO: 2185029 - DNA, 18 bp, Homo sapiens
acaaatgggactgatgtc

SEQ ID NO: 2185030 - DNA, 21 bp, Homo sapiens
acaaatgggactgatgtcatc

SEQ ID NO: 2185031 - DNA, 15 bp, Homo sapiens
acaacaccaggactt

SEQ ID NO: 2185032 - DNA, 20 bp, Homo sapiens
acaacatcagaaagaattga

SEQ ID NO: 2185033 - DNA, 22 bp, Homo sapiens
acaaccatgtcatttcagaagt

SEQ ID NO: 2185034 - DNA, 22 bp, Homo sapiens
acaacgcaaacctctccttcct

SEQ ID NO: 2185035 - DNA, 18 bp, Homo sapiens
acaactgatcatttgcag

SEQ ID NO: 2185036 - DNA, 21 bp, Homo sapiens
acaactgatcatttgcagctg

SEQ ID NO: 2185037 - DNA, 21 bp, Homo sapiens
acaagaagtgggagtgggaga

SEQ ID NO: 2185038 - DNA, 13 bp, Homo sapiens
acaagaatgtccc

SEQ ID NO: 2185039 - DNA, 16 bp, Homo sapiens
acaagagggcaaagct

SEQ ID NO: 2185040 - DNA, 18 bp, Homo sapiens
acaagagggcaaagctga

SEQ ID NO: 2185041 - DNA, 13 bp, Homo sapiens
acaagctgcctcc

SEQ ID NO: 2185042 - DNA, 18 bp, Homo sapiens
acaagctgtccctgcagg

SEQ ID NO: 2185043 - DNA, 16 bp, Homo sapiens
acaaggcaggcctttc

SEQ ID NO: 2185044 - DNA, 14 bp, Homo sapiens
acaaggtgggcagg

SEQ ID NO: 2185045 - DNA, 15 bp, Homo sapiens
acaaggtgggcaggg

SEQ ID NO: 2185046 - DNA, 17 bp, Homo sapiens
acaagtgctcagttcca

SEQ ID NO: 2185047 - DNA, 12 bp, Homo sapiens
acaagtgtctaa

SEQ ID NO: 2185048 - DNA, 22 bp, Homo sapiens
acaagtttcagtaatagctgaa

SEQ ID NO: 2185049 - DNA, 13 bp, Homo sapiens
acaataaataata

SEQ ID NO: 2185050 - DNA, 18 bp, Homo sapiens
acaataccagatcactca

SEQ ID NO: 2185051 - DNA, 11 bp, Homo sapiens
acaatatcaat

SEQ ID NO: 2185052 - DNA, 16 bp, Homo sapiens
acaatatcaatatggt

SEQ ID NO: 2185053 - DNA, 13 bp, Homo sapiens
acaatctgtaatt

SEQ ID NO: 2185054 - DNA, 21 bp, Homo sapiens
acctgcatgtgttgtacaata

SEQ ID NO: 2185055 - DNA, 13 bp, Homo sapiens
acctgccccatcc

SEQ ID NO: 2185056 - DNA, 14 bp, Homo sapiens
acctgccccatccc

SEQ ID NO: 2185057 - DNA, 17 bp, Homo sapiens
acctgccccgtagagaa

SEQ ID NO: 2185058 - DNA, 18 bp, Homo sapiens
acctgccccgtagagaat

SEQ ID NO: 2185059 - DNA, 19 bp, Homo sapiens
acctgccccgtagagaatg

SEQ ID NO: 2185060 - DNA, 17 bp, Homo sapiens
acctgcccctgccgcct

SEQ ID NO: 2185061 - DNA, 18 bp, Homo sapiens
acctgccctctatttatt

SEQ ID NO: 2185062 - DNA, 23 bp, Homo sapiens
acctgccctctatttattagcca

SEQ ID NO: 2185063 - DNA, 23 bp, Homo sapiens
acctgcgcagggccctctggggc

SEQ ID NO: 2185064 - DNA, 15 bp, Homo sapiens
acctggaaccagagc

SEQ ID NO: 2185065 - DNA, 10 bp, Homo sapiens
acctggaggg

SEQ ID NO: 2185066 - DNA, 18 bp, Homo sapiens
acctggagggttgatata

SEQ ID NO: 2185067 - DNA, 20 bp, Homo sapiens
acctggctgcgaactgtgca

SEQ ID NO: 2185068 - DNA, 21 bp, Homo sapiens
acctggctgcgaactgtgcag

SEQ ID NO: 2185069 - DNA, 14 bp, Homo sapiens
acctggtggctgga

SEQ ID NO: 2185070 - DNA, 18 bp, Homo sapiens
acctggtggctggaggca

SEQ ID NO: 2185071 - DNA, 14 bp, Homo sapiens
acctgtaacttttt

SEQ ID NO: 2185072 - DNA, 15 bp, Homo sapiens
acctgtcccacctca

SEQ ID NO: 2185073 - DNA, 21 bp, Homo sapiens
acctgttcttgggcctcaggc

SEQ ID NO: 2185074 - DNA, 11 bp, Homo sapiens
accttaatttc

SEQ ID NO: 2185075 - DNA, 17 bp, Homo sapiens
accttcaaagcttttgt

SEQ ID NO: 2185076 - DNA, 23 bp, Homo sapiens
accttcaaagcttttgtaaaata

SEQ ID NO: 2185077 - DNA, 20 bp, Homo sapiens
accttctaatccatgtgctg

SEQ ID NO: 2185078 - DNA, 16 bp, Homo sapiens
accttgatgtcttgag

SEQ ID NO: 2185079 - DNA, 20 bp, Homo sapiens
accttggccctacagccctg

SEQ ID NO: 2185080 - DNA, 12 bp, Homo sapiens
accttgtgaagg

SEQ ID NO: 2185081 - DNA, 20 bp, Homo sapiens
accttgtgaaggaaaaacat

SEQ ID NO: 2185082 - DNA, 17 bp, Homo sapiens
accttgtgtgagtgtga

SEQ ID NO: 2185083 - DNA, 16 bp, Homo sapiens
acctttaaaaatgtat

SEQ ID NO: 2185084 - DNA, 17 bp, Homo sapiens
acctttagaatattaaa

SEQ ID NO: 2185085 - DNA, 14 bp, Homo sapiens
acctttattcttta

SEQ ID NO: 2185086 - DNA, 19 bp, Homo sapiens
accttttttttacggaatt

SEQ ID NO: 2185087 - DNA, 20 bp, Homo sapiens
acgaattttaaaacatggca

SEQ ID NO: 2185088 - DNA, 21 bp, Homo sapiens
acgacttcttcggaggtggca

SEQ ID NO: 2185089 - DNA, 23 bp, Homo sapiens
acgacttcttcggaggtggcagc

SEQ ID NO: 2185090 - DNA, 19 bp, Homo sapiens
acgaggggcagggaaggac

SEQ ID NO: 2185091 - DNA, 17 bp, Homo sapiens
acgatttcactgacact

SEQ ID NO: 2185092 - DNA, 12 bp, Homo sapiens
acgcacacagct

SEQ ID NO: 2185093 - DNA, 13 bp, Homo sapiens
acgcacacagctt

SEQ ID NO: 2185094 - DNA, 13 bp, Homo sapiens
acgcctgtgtcac

SEQ ID NO: 2185095 - DNA, 17 bp, Homo sapiens
acgcgtcttgccttgtc

SEQ ID NO: 2185096 - DNA, 22 bp, Homo sapiens
acgctgccatttccctgaacag

SEQ ID NO: 2185097 - DNA, 23 bp, Homo sapiens
acgctgccatttccctgaacaga

SEQ ID NO: 2185098 - DNA, 21 bp, Homo sapiens
acggccactgcagtcacccct

SEQ ID NO: 2185099 - DNA, 20 bp, Homo sapiens
acggcccgccgtgcctgcat

SEQ ID NO: 2185100 - DNA, 17 bp, Homo sapiens
acggcctggctggtggg

SEQ ID NO: 2185101 - DNA, 22 bp, Homo sapiens
acggcctggctggtgggaaggc

SEQ ID NO: 2185102 - DNA, 23 bp, Homo sapiens
acggcctggctggtgggaaggcc

SEQ ID NO: 2185103 - DNA, 20 bp, Homo sapiens
acggctaccacactcatggg

SEQ ID NO: 2185104 - DNA, 21 bp, Homo sapiens
acggctgttcccctcacccaa

SEQ ID NO: 2185105 - DNA, 22 bp, Homo sapiens
acggctgttcccctcacccaaa

SEQ ID NO: 2185106 - DNA, 22 bp, Homo sapiens
acgggatggttctggctgtttg

SEQ ID NO: 2185107 - DNA, 18 bp, Homo sapiens
acggggagtgagactcct

SEQ ID NO: 2185108 - DNA, 16 bp, Homo sapiens
acggtacttggtaaga

SEQ ID NO: 2185109 - DNA, 18 bp, Homo sapiens
acggtggctcacgcctgt

SEQ ID NO: 2185110 - DNA, 15 bp, Homo sapiens
acgtatgcatttttt

SEQ ID NO: 2185111 - DNA, 15 bp, Homo sapiens
acgtgagagaaagag

SEQ ID NO: 2185112 - DNA, 19 bp, Homo sapiens
acgtgagagaaagagagaa

SEQ ID NO: 2185113 - DNA, 22 bp, Homo sapiens
acgtgagagaaagagagaagcc

SEQ ID NO: 2185114 - DNA, 13 bp, Homo sapiens
acgtgctggagag

SEQ ID NO: 2185115 - DNA, 21 bp, Homo sapiens
acgtggcctcgtgaggggcaa

SEQ ID NO: 2185116 - DNA, 17 bp, Homo sapiens
actaaactacattataa

SEQ ID NO: 2185117 - DNA, 13 bp, Homo sapiens
actaaatatgaaa

SEQ ID NO: 2185118 - DNA, 16 bp, Homo sapiens
actaaatatgaaattt

SEQ ID NO: 2185119 - DNA, 17 bp, Homo sapiens
actaaatatgaaatttt

SEQ ID NO: 2185120 - DNA, 23 bp, Homo sapiens
actaactagagcagccctggagt

SEQ ID NO: 2185121 - DNA, 13 bp, Homo sapiens
actaataaaatac

SEQ ID NO: 2185122 - DNA, 21 bp, Homo sapiens
actaataaaatacatactata

SEQ ID NO: 2185123 - DNA, 14 bp, Homo sapiens
actaatcaatactt

SEQ ID NO: 2185124 - DNA, 21 bp, Homo sapiens
actaattttaaagtaaaaggc

SEQ ID NO: 2185125 - DNA, 14 bp, Homo sapiens
actactatttttct

SEQ ID NO: 2185126 - DNA, 21 bp, Homo sapiens
actacttatctctaaaccatc

SEQ ID NO: 2185127 - DNA, 19 bp, Homo sapiens
actagagcagccctggagt

SEQ ID NO: 2185128 - DNA, 13 bp, Homo sapiens
actagcctccctc

SEQ ID NO: 2185129 - DNA, 12 bp, Homo sapiens
actaggctgggt

SEQ ID NO: 2185130 - DNA, 13 bp, Homo sapiens
actaggctgggtg

SEQ ID NO: 2185131 - DNA, 20 bp, Homo sapiens
actaggctgggtgcccacag

SEQ ID NO: 2185132 - DNA, 21 bp, Homo sapiens
actaggctgggtgcccacagc

SEQ ID NO: 2185133 - DNA, 23 bp, Homo sapiens
actaggctgggtgcccacagccc

SEQ ID NO: 2185134 - DNA, 23 bp, Homo sapiens
actatatttaataccaccaacaa

SEQ ID NO: 2185135 - DNA, 14 bp, Homo sapiens
actatcaacactgc

SEQ ID NO: 2185136 - DNA, 19 bp, Homo sapiens
actatgagaatgtagaagt

SEQ ID NO: 2185137 - DNA, 18 bp, Homo sapiens
actatgcacctataaata

SEQ ID NO: 2185138 - DNA, 19 bp, Homo sapiens
actatgcacctataaatac

SEQ ID NO: 2185139 - DNA, 14 bp, Homo sapiens
actatggtgccaat

SEQ ID NO: 2185140 - DNA, 21 bp, Homo sapiens
actatggtgccaatggaacct

SEQ ID NO: 2185141 - DNA, 22 bp, Homo sapiens
actattccattgaccttaattt

SEQ ID NO: 2185142 - DNA, 15 bp, Homo sapiens
actcaaaaaggtgtg

SEQ ID NO: 2185143 - DNA, 20 bp, Homo sapiens
actcaaagcaagctcttctc

SEQ ID NO: 2185144 - DNA, 16 bp, Homo sapiens
actcacagtgctttta

SEQ ID NO: 2185145 - DNA, 14 bp, Homo sapiens
actcaccttgaaca

SEQ ID NO: 2185146 - DNA, 14 bp, Homo sapiens
actcagcatcccca

SEQ ID NO: 2185147 - DNA, 22 bp, Homo sapiens
actcagcctcaataagccttgt

SEQ ID NO: 2185148 - DNA, 19 bp, Homo sapiens
actcatactgtgctggagc

SEQ ID NO: 2185149 - DNA, 20 bp, Homo sapiens
actcatactgtgctggagcc

SEQ ID NO: 2185150 - DNA, 23 bp, Homo sapiens
actcatactgtgctggagccact

SEQ ID NO: 2185151 - DNA, 12 bp, Homo sapiens
actcatccatta

SEQ ID NO: 2185152 - DNA, 13 bp, Homo sapiens
actcatccattaa

SEQ ID NO: 2185153 - DNA, 16 bp, Homo sapiens
actcatcgttctaaaa

SEQ ID NO: 2185154 - DNA, 21 bp, Homo sapiens
actcatcgttctaaaatcaag

SEQ ID NO: 2185155 - DNA, 18 bp, Homo sapiens
actcattaatttctctca

SEQ ID NO: 2185156 - DNA, 15 bp, Homo sapiens
actcattgaaatgta

SEQ ID NO: 2185157 - DNA, 17 bp, Homo sapiens
actcattgaaatgtaat

SEQ ID NO: 2185158 - DNA, 19 bp, Homo sapiens
actcatttcaagttatgat

SEQ ID NO: 2185159 - DNA, 17 bp, Homo sapiens
actccactgtctttaaa

SEQ ID NO: 2185160 - DNA, 20 bp, Homo sapiens
actccaggaaggggctggac

SEQ ID NO: 2185161 - DNA, 19 bp, Homo sapiens
actcccaagaacagcaggc

SEQ ID NO: 2185162 - DNA, 22 bp, Homo sapiens
actcccaagaacagcaggccca

SEQ ID NO: 2185163 - DNA, 22 bp, Homo sapiens
actccggattccggccctggct

SEQ ID NO: 2185164 - DNA, 18 bp, Homo sapiens
actcctacacctaactca

SEQ ID NO: 2185165 - DNA, 22 bp, Homo sapiens
actcctgattgctctggaagcc

SEQ ID NO: 2185166 - DNA, 23 bp, Homo sapiens
actctatgggtatcaaacagctc

SEQ ID NO: 2185167 - DNA, 20 bp, Homo sapiens
actctcccagaggctcctgg

SEQ ID NO: 2185168 - DNA, 14 bp, Homo sapiens
actctcctgcctca

SEQ ID NO: 2185169 - DNA, 17 bp, Homo sapiens
agaaattccctggacca

SEQ ID NO: 2185170 - DNA, 19 bp, Homo sapiens
agaacaaaacctcttctgt

SEQ ID NO: 2185171 - DNA, 18 bp, Homo sapiens
agaacaaagaccaatgtg

SEQ ID NO: 2185172 - DNA, 23 bp, Homo sapiens
agaacaaagaccaatgtgaagac

SEQ ID NO: 2185173 - DNA, 18 bp, Homo sapiens
agaacagatggctgtgaa

SEQ ID NO: 2185174 - DNA, 19 bp, Homo sapiens
agaacagtggttgcctggg

SEQ ID NO: 2185175 - DNA, 22 bp, Homo sapiens
agaacagtggttgcctgggggc

SEQ ID NO: 2185176 - DNA, 17 bp, Homo sapiens
agaacagttaagcagcc

SEQ ID NO: 2185177 - DNA, 21 bp, Homo sapiens
agaacagttaagcagccgcca

SEQ ID NO: 2185178 - DNA, 17 bp, Homo sapiens
agaacatctgccttgct

SEQ ID NO: 2185179 - DNA, 19 bp, Homo sapiens
agaacatctgccttgctgc

SEQ ID NO: 2185180 - DNA, 18 bp, Homo sapiens
agaacattcagctctgga

SEQ ID NO: 2185181 - DNA, 19 bp, Homo sapiens
agaacattcagctctggag

SEQ ID NO: 2185182 - DNA, 13 bp, Homo sapiens
agaaccatctttg

SEQ ID NO: 2185183 - DNA, 12 bp, Homo sapiens
agaactcatttc

SEQ ID NO: 2185184 - DNA, 14 bp, Homo sapiens
agaactcatttcaa

SEQ ID NO: 2185185 - DNA, 16 bp, Homo sapiens
agaactcatttcaagt

SEQ ID NO: 2185186 - DNA, 13 bp, Homo sapiens
agaactctgggca

SEQ ID NO: 2185187 - DNA, 23 bp, Homo sapiens
agaactgctaaatactgtacata

SEQ ID NO: 2185188 - DNA, 15 bp, Homo sapiens
agaacttagttttgt

SEQ ID NO: 2185189 - DNA, 18 bp, Homo sapiens
agaagagggagaaggaga

SEQ ID NO: 2185190 - DNA, 20 bp, Homo sapiens
agaagagggagaaggagagg

SEQ ID NO: 2185191 - DNA, 22 bp, Homo sapiens
agaagagggagaaggagaggct

SEQ ID NO: 2185192 - DNA, 15 bp, Homo sapiens
agaagagtccaggaa

SEQ ID NO: 2185193 - DNA, 17 bp, Homo sapiens
agaagcagccataaaac

SEQ ID NO: 2185194 - DNA, 14 bp, Homo sapiens
agaagccagccaca

SEQ ID NO: 2185195 - DNA, 15 bp, Homo sapiens
agaagcctagaaaag

SEQ ID NO: 2185196 - DNA, 22 bp, Homo sapiens
agaagctatggaaccagcagtt

SEQ ID NO: 2185197 - DNA, 21 bp, Homo sapiens
agaaggcaagctggcaggagg

SEQ ID NO: 2185198 - DNA, 17 bp, Homo sapiens
agaagtggcatctgaaa

SEQ ID NO: 2185199 - DNA, 20 bp, Homo sapiens
agaagtggtgttttttttcc

SEQ ID NO: 2185200 - DNA, 18 bp, Homo sapiens
agaagttagtttgtatat

SEQ ID NO: 2185201 - DNA, 21 bp, Homo sapiens
agaagttgtaaagtatgtatt

SEQ ID NO: 2185202 - DNA, 15 bp, Homo sapiens
agaataaatacaata

SEQ ID NO: 2185203 - DNA, 20 bp, Homo sapiens
agaatactaataaaatacat

SEQ ID NO: 2185204 - DNA, 15 bp, Homo sapiens
agaatataatgggaa

SEQ ID NO: 2185205 - DNA, 19 bp, Homo sapiens
agaatatcctacttctcca

SEQ ID NO: 2185206 - DNA, 23 bp, Homo sapiens
agaatcccatggatgtttcttct

SEQ ID NO: 2185207 - DNA, 16 bp, Homo sapiens
agaatgagagagtgtg

SEQ ID NO: 2185208 - DNA, 17 bp, Homo sapiens
agaatgtagaagtggca

SEQ ID NO: 2185209 - DNA, 13 bp, Homo sapiens
agaattaaaataa

SEQ ID NO: 2185210 - DNA, 13 bp, Homo sapiens
agaattcagacat

SEQ ID NO: 2185211 - DNA, 13 bp, Homo sapiens
agaattcagctgc

SEQ ID NO: 2185212 - DNA, 14 bp, Homo sapiens
agaattcagctgcc

SEQ ID NO: 2185213 - DNA, 15 bp, Homo sapiens
agaattcagctgccc

SEQ ID NO: 2185214 - DNA, 15 bp, Homo sapiens
agaattgatcagaat

SEQ ID NO: 2185215 - DNA, 19 bp, Homo sapiens
agacaaaccactgtacata

SEQ ID NO: 2185216 - DNA, 21 bp, Homo sapiens
agacaaaccactgtacatata

SEQ ID NO: 2185217 - DNA, 16 bp, Homo sapiens
agacaaagacattatt

SEQ ID NO: 2185218 - DNA, 15 bp, Homo sapiens
agacaaatgggactg

SEQ ID NO: 2185219 - DNA, 16 bp, Homo sapiens
agacaaatgggactga

SEQ ID NO: 2185220 - DNA, 19 bp, Homo sapiens
agacaaatgggactgatgt

SEQ ID NO: 2185221 - DNA, 16 bp, Homo sapiens
agacaatgcagatgcc

SEQ ID NO: 2185222 - DNA, 16 bp, Homo sapiens
agacacacttaactac

SEQ ID NO: 2185223 - DNA, 14 bp, Homo sapiens
ttaaaaatgtataa

SEQ ID NO: 2185224 - DNA, 18 bp, Homo sapiens
ttaaaaattaattcttta

SEQ ID NO: 2185225 - DNA, 16 bp, Homo sapiens
ttaaaacaaattaaaa

SEQ ID NO: 2185226 - DNA, 18 bp, Homo sapiens
ttaaaacaaattaaaaac

SEQ ID NO: 2185227 - DNA, 20 bp, Homo sapiens
ttaaaataatttatcaaaaa

SEQ ID NO: 2185228 - DNA, 13 bp, Homo sapiens
ttaaaatttcact

SEQ ID NO: 2185229 - DNA, 14 bp, Homo sapiens
ttaaaatttgtaga

SEQ ID NO: 2185230 - DNA, 22 bp, Homo sapiens
ttaaaccgtgattcttgaaagg

SEQ ID NO: 2185231 - DNA, 13 bp, Homo sapiens
ttaaacctttcca

SEQ ID NO: 2185232 - DNA, 16 bp, Homo sapiens
ttaaactgaaagcttt

SEQ ID NO: 2185233 - DNA, 13 bp, Homo sapiens
ttaaagaaaattg

SEQ ID NO: 2185234 - DNA, 17 bp, Homo sapiens
ttaaagaaaattgccaa

SEQ ID NO: 2185235 - DNA, 19 bp, Homo sapiens
ttaaagaaaattgccaaaa

SEQ ID NO: 2185236 - DNA, 22 bp, Homo sapiens
ttaaagtggctttcaacttcaa

SEQ ID NO: 2185237 - DNA, 13 bp, Homo sapiens
ttaaatgcaaaaa

SEQ ID NO: 2185238 - DNA, 16 bp, Homo sapiens
ttaaatgcaaaaatat

SEQ ID NO: 2185239 - DNA, 19 bp, Homo sapiens
ttaacatatattgttattt

SEQ ID NO: 2185240 - DNA, 18 bp, Homo sapiens
ttaacctcaggttccaaa

SEQ ID NO: 2185241 - DNA, 23 bp, Homo sapiens
ttaacttgaaaagattgcaaagg

SEQ ID NO: 2185242 - DNA, 16 bp, Homo sapiens
ttaagaaaaacatgtc

SEQ ID NO: 2185243 - DNA, 18 bp, Homo sapiens
ttaagacaaatgggactg

SEQ ID NO: 2185244 - DNA, 22 bp, Homo sapiens
ttaagacaaatgggactgatgt

SEQ ID NO: 2185245 - DNA, 23 bp, Homo sapiens
ttaagagtcctgaggcagaacct

SEQ ID NO: 2185246 - DNA, 16 bp, Homo sapiens
ttaaggaaaaaaaacg

SEQ ID NO: 2185247 - DNA, 23 bp, Homo sapiens
ttaaggtgtgcagtgtttttcct

SEQ ID NO: 2185248 - DNA, 22 bp, Homo sapiens
ttaagtaatttccccactctga

SEQ ID NO: 2185249 - DNA, 20 bp, Homo sapiens
ttaagtggctgtgattaatt

SEQ ID NO: 2185250 - DNA, 20 bp, Homo sapiens
ttaataatggttactcattt

SEQ ID NO: 2185251 - DNA, 21 bp, Homo sapiens
ttaataccaccaacaaatata

SEQ ID NO: 2185252 - DNA, 22 bp, Homo sapiens
ttaatatatataatacttaaaa

SEQ ID NO: 2185253 - DNA, 20 bp, Homo sapiens
ttaatatgtatttgttgaaa

SEQ ID NO: 2185254 - DNA, 15 bp, Homo sapiens
ttaatattaatttat

SEQ ID NO: 2185255 - DNA, 20 bp, Homo sapiens
ttaatgtagataaagcactg

SEQ ID NO: 2185256 - DNA, 15 bp, Homo sapiens
ttaatgtagccatgg

SEQ ID NO: 2185257 - DNA, 19 bp, Homo sapiens
ttaatgtgtatttactgta

SEQ ID NO: 2185258 - DNA, 22 bp, Homo sapiens
ttaatgtgtatttactgtacta

SEQ ID NO: 2185259 - DNA, 23 bp, Homo sapiens
ttaattctttatcacatgttgtc

SEQ ID NO: 2185260 - DNA, 15 bp, Homo sapiens
ttaattgtaaagtaa

SEQ ID NO: 2185261 - DNA, 12 bp, Homo sapiens
ttaatttgttgt

SEQ ID NO: 2185262 - DNA, 23 bp, Homo sapiens
ttaattttgttaagaatttcaat

SEQ ID NO: 2185263 - DNA, 20 bp, Homo sapiens
ttacaaggcaggcctttcct

SEQ ID NO: 2185264 - DNA, 22 bp, Homo sapiens
ttacaaggcaggcctttcctac

SEQ ID NO: 2185265 - DNA, 23 bp, Homo sapiens
ttacaaggcaggcctttcctaca

SEQ ID NO: 2185266 - DNA, 23 bp, Homo sapiens
ttacacattaaagtaaagtacaa

SEQ ID NO: 2185267 - DNA, 15 bp, Homo sapiens
ttacacccatgcaca

SEQ ID NO: 2185268 - DNA, 16 bp, Homo sapiens
ttacagggcccaggtg

SEQ ID NO: 2185269 - DNA, 13 bp, Homo sapiens
ttacagtgtatct

SEQ ID NO: 2185270 - DNA, 22 bp, Homo sapiens
ttacagtgtatctcgaagtctt

SEQ ID NO: 2185271 - DNA, 13 bp, Homo sapiens
ttacataggatta

SEQ ID NO: 2185272 - DNA, 13 bp, Homo sapiens
ttaccacccccac

SEQ ID NO: 2185273 - DNA, 22 bp, Homo sapiens
ttaccattttgcgatgtgtttt

SEQ ID NO: 2185274 - DNA, 22 bp, Homo sapiens
ttaccgtcacactcttcagtga

SEQ ID NO: 2185275 - DNA, 15 bp, Homo sapiens
ttacctgcatgtgtt

SEQ ID NO: 2185276 - DNA, 22 bp, Homo sapiens
ttacctgcatgtgttgtacaat

SEQ ID NO: 2185277 - DNA, 15 bp, Homo sapiens
ttactgtggaggtgg

SEQ ID NO: 2185278 - DNA, 20 bp, Homo sapiens
ttactttaccacccccacac

SEQ ID NO: 2185279 - DNA, 17 bp, Homo sapiens
ttagaaaccatgaaaaa

SEQ ID NO: 2185280 - DNA, 18 bp, Homo sapiens
ttagaaagactttctaaa

SEQ ID NO: 2185281 - DNA, 15 bp, Homo sapiens
ttagaaattacaagt

SEQ ID NO: 2185282 - DNA, 22 bp, Homo sapiens
ttagaaattacaagtttcagta

SEQ ID NO: 2185283 - DNA, 18 bp, Homo sapiens
ttagaacagatggctgtg

SEQ ID NO: 2185284 - DNA, 17 bp, Homo sapiens
ttagaagctcacgcctt

SEQ ID NO: 2185285 - DNA, 12 bp, Homo sapiens
ttagatgcttag

SEQ ID NO: 2185286 - DNA, 22 bp, Homo sapiens
ttagattagaaagactttctaa

SEQ ID NO: 2185287 - DNA, 22 bp, Homo sapiens
ttagccaactgtttccctgctg

SEQ ID NO: 2185288 - DNA, 17 bp, Homo sapiens
ttagcccccacccactt

SEQ ID NO: 2185289 - DNA, 12 bp, Homo sapiens
ttagctcagccc

SEQ ID NO: 2185290 - DNA, 12 bp, Homo sapiens
ttaggctgggcc

SEQ ID NO: 2185291 - DNA, 16 bp, Homo sapiens
ttaggctgggcccaga

SEQ ID NO: 2185292 - DNA, 15 bp, Homo sapiens
ttaggtgtcttttaa

SEQ ID NO: 2185293 - DNA, 21 bp, Homo sapiens
ttagtaataaaacccagcatg

SEQ ID NO: 2185294 - DNA, 14 bp, Homo sapiens
ttagtacccacctg

SEQ ID NO: 2185295 - DNA, 18 bp, Homo sapiens
ttagtacccacctgagct

SEQ ID NO: 2185296 - DNA, 16 bp, Homo sapiens
ttagtcctccctgctc

SEQ ID NO: 2185297 - DNA, 17 bp, Homo sapiens
ttagtcctccctgctca

SEQ ID NO: 2185298 - DNA, 23 bp, Homo sapiens
ttagtgaagtatgcactaatcaa

SEQ ID NO: 2185299 - DNA, 20 bp, Homo sapiens
ttagtgacttagttcttaga

SEQ ID NO: 2185300 - DNA, 13 bp, Homo sapiens
ttagtgatttgct

SEQ ID NO: 2185301 - DNA, 14 bp, Homo sapiens
ttagtgatttgcta

SEQ ID NO: 2185302 - DNA, 20 bp, Homo sapiens
ttagtgcaatttcttctgta

SEQ ID NO: 2185303 - DNA, 12 bp, Homo sapiens
ttagtgttcaaa

SEQ ID NO: 2185304 - DNA, 19 bp, Homo sapiens
ttagttaaaatctattttg

SEQ ID NO: 2185305 - DNA, 14 bp, Homo sapiens
ttagtttgaaacag

SEQ ID NO: 2185306 - DNA, 16 bp, Homo sapiens
ttataagcaacatgaa

SEQ ID NO: 2185307 - DNA, 20 bp, Homo sapiens
ttataagcaacatgaattaa

SEQ ID NO: 2185308 - DNA, 18 bp, Homo sapiens
ttataatcttataattgt

SEQ ID NO: 2185309 - DNA, 22 bp, Homo sapiens
ttataattaaagaaaattgcca

SEQ ID NO: 2185310 - DNA, 16 bp, Homo sapiens
ttatataactgtattt

SEQ ID NO: 2185311 - DNA, 22 bp, Homo sapiens
ttatataactgtatttgaaata

SEQ ID NO: 2185312 - DNA, 19 bp, Homo sapiens
ttatcaggggaatttcagg

SEQ ID NO: 2185313 - DNA, 22 bp, Homo sapiens
ttatcatttatttttaaaataa

SEQ ID NO: 2185314 - DNA, 12 bp, Homo sapiens
ttatctgggctt

SEQ ID NO: 2185315 - DNA, 14 bp, Homo sapiens
ttatgaatattaaa

SEQ ID NO: 2185316 - DNA, 16 bp, Homo sapiens
ttatgaatattaaagg

SEQ ID NO: 2185317 - DNA, 22 bp, Homo sapiens
ttatgagaaacttaaatgttat

SEQ ID NO: 2185318 - DNA, 17 bp, Homo sapiens
ttatgcagctgttctgg

SEQ ID NO: 2185319 - DNA, 11 bp, Homo sapiens
ttatgctcacc

SEQ ID NO: 2185320 - DNA, 17 bp, Homo sapiens
ttatgctcacctgacat

SEQ ID NO: 2185321 - DNA, 14 bp, Homo sapiens
ttatgtgactgctt

SEQ ID NO: 2185322 - DNA, 19 bp, Homo sapiens
ttattaaatcagttttgtg

SEQ ID NO: 2185323 - DNA, 23 bp, Homo sapiens
ttattaaatcagttttgtgtaca

SEQ ID NO: 2185324 - DNA, 17 bp, Homo sapiens
ttattaacatatattgt

SEQ ID NO: 2185325 - DNA, 20 bp, Homo sapiens
ttattagtgaagtatgcact

SEQ ID NO: 2185326 - DNA, 21 bp, Homo sapiens
ttattataatcttataattgt

SEQ ID NO: 2185327 - DNA, 13 bp, Homo sapiens
ttattctttgaga

SEQ ID NO: 2185328 - DNA, 19 bp, Homo sapiens
ttattgagcccaaaaacaa

SEQ ID NO: 2185329 - DNA, 15 bp, Homo sapiens
ttattgagttctgaa

SEQ ID NO: 2185330 - DNA, 14 bp, Homo sapiens
ttattgattttctt

SEQ ID NO: 2185331 - DNA, 17 bp, Homo sapiens
ttattgtaccaaagctg

SEQ ID NO: 2185332 - DNA, 16 bp, Homo sapiens
ttattgttttattgta

SEQ ID NO: 2185333 - DNA, 13 bp, Homo sapiens
ttatttacattta

SEQ ID NO: 2185334 - DNA, 16 bp, Homo sapiens
ttatttacatttaata

SEQ ID NO: 2185335 - DNA, 16 bp, Homo sapiens
ttatttaggctttgta

SEQ ID NO: 2185336 - DNA, 16 bp, Homo sapiens
ttatttccatattaaa

SEQ ID NO: 2185337 - DNA, 12 bp, Homo sapiens
ttatttctaaat

SEQ ID NO: 2185338 - DNA, 15 bp, Homo sapiens
ttatttctaaatcct

SEQ ID NO: 2185339 - DNA, 20 bp, Homo sapiens
ttatttgtttatatttaatt

SEQ ID NO: 2185340 - DNA, 11 bp, Homo sapiens
ttatttttgta

SEQ ID NO: 2185341 - DNA, 17 bp, Homo sapiens
ttatttttgtactgtgc

SEQ ID NO: 2185342 - DNA, 17 bp, Homo sapiens
ttatttttttattcttc

SEQ ID NO: 2185343 - DNA, 17 bp, Homo sapiens
ttcaaaaattatatttt

SEQ ID NO: 2185344 - DNA, 22 bp, Homo sapiens
ttcaaaatcagtgatgggagta

SEQ ID NO: 2185345 - DNA, 20 bp, Homo sapiens
ttcaaacaattcaatcaaag

SEQ ID NO: 2185346 - DNA, 16 bp, Homo sapiens
ttcaaagatgataatt

SEQ ID NO: 2185347 - DNA, 21 bp, Homo sapiens
ttcaaagatgataatttagtg

SEQ ID NO: 2185348 - DNA, 14 bp, Homo sapiens
ttcaaatacttcaa

SEQ ID NO: 2185349 - DNA, 19 bp, Homo sapiens
ttcaaatacttcaaatcat

SEQ ID NO: 2185350 - DNA, 16 bp, Homo sapiens
ttcaaatcctgccact

SEQ ID NO: 2185351 - DNA, 18 bp, Homo sapiens
ttcaacattgatttttga

SEQ ID NO: 2185352 - DNA, 21 bp, Homo sapiens
ttcaaggatatactgcagctt

SEQ ID NO: 2185353 - DNA, 20 bp, Homo sapiens
ttcaataaaatgcactgacc

SEQ ID NO: 2185354 - DNA, 21 bp, Homo sapiens
ttcaataaaatgcactgacca

SEQ ID NO: 2185355 - DNA, 19 bp, Homo sapiens
ttcaataaagtactgcaaa

SEQ ID NO: 2185356 - DNA, 21 bp, Homo sapiens
ttcaataaagtactgcaaaat

SEQ ID NO: 2185357 - DNA, 23 bp, Homo sapiens
ttcaataaagtactgcaaaatgc

SEQ ID NO: 2185358 - DNA, 16 bp, Homo sapiens
ttcaatacaaaaagcc

SEQ ID NO: 2185359 - DNA, 13 bp, Homo sapiens
ttcaatctctgtt

SEQ ID NO: 2185360 - DNA, 13 bp, Homo sapiens
ttcacaagctgcc

SEQ ID NO: 2185361 - DNA, 18 bp, Homo sapiens
ttcacaagctgcctccct

SEQ ID NO: 2185362 - DNA, 17 bp, Homo sapiens
ttcactaaagtgtcatc

SEQ ID NO: 2185363 - DNA, 20 bp, Homo sapiens
ttcactaggctcgtgtttgc

SEQ ID NO: 2185364 - DNA, 15 bp, Homo sapiens
ttcactcagaattat

SEQ ID NO: 2185365 - DNA, 18 bp, Homo sapiens
ttcactcagaattattca

SEQ ID NO: 2185366 - DNA, 12 bp, Homo sapiens
ttcactgacact

SEQ ID NO: 2185367 - DNA, 21 bp, Homo sapiens
ttcactgccaacttttagtgg

SEQ ID NO: 2185368 - DNA, 15 bp, Homo sapiens
ttcacttttaaacta

SEQ ID NO: 2185369 - DNA, 20 bp, Homo sapiens
ttcagaagttagtttgtata

SEQ ID NO: 2185370 - DNA, 13 bp, Homo sapiens
ttcagaagttgtt

SEQ ID NO: 2185371 - DNA, 15 bp, Homo sapiens
ttcagaatatattga

SEQ ID NO: 2185372 - DNA, 20 bp, Homo sapiens
ttcagacatctgaggtttta

SEQ ID NO: 2185373 - DNA, 16 bp, Homo sapiens
ttcagatattttgcac

SEQ ID NO: 2185374 - DNA, 12 bp, Homo sapiens
ttcagctgcccc

SEQ ID NO: 2185375 - DNA, 23 bp, Homo sapiens
ttcagctgcccccgctcatgggc

SEQ ID NO: 2185376 - DNA, 21 bp, Homo sapiens
ttcagctgtatgaaagggacg

SEQ ID NO: 2185377 - DNA, 17 bp, Homo sapiens
ttcaggaacctggacca

SEQ ID NO: 2185378 - DNA, 22 bp, Homo sapiens
ttcaggaacctggaccaaagct

SEQ ID NO: 2185379 - DNA, 23 bp, Homo sapiens
ttcaggatttggtttttctcttt

SEQ ID NO: 2185380 - DNA, 15 bp, Homo sapiens
ttcaggtcagggcta

SEQ ID NO: 2185381 - DNA, 14 bp, Homo sapiens
ttcagtaatagctg

SEQ ID NO: 2185382 - DNA, 16 bp, Homo sapiens
ttcagtaatagctgaa

SEQ ID NO: 2185383 - DNA, 19 bp, Homo sapiens
ttcagtaatagctgaacct

SEQ ID NO: 2185384 - DNA, 16 bp, Homo sapiens
ttcagtgactcctgct

SEQ ID NO: 2185385 - DNA, 11 bp, Homo sapiens
ttcataaagca

SEQ ID NO: 2185386 - DNA, 14 bp, Homo sapiens
ttcatactgaatga

SEQ ID NO: 2185387 - DNA, 13 bp, Homo sapiens
ttcatataaatgg

SEQ ID NO: 2185388 - DNA, 13 bp, Homo sapiens
ttcatccttagca

SEQ ID NO: 2185389 - DNA, 20 bp, Homo sapiens
ttcatggatagctcagaggt

SEQ ID NO: 2185390 - DNA, 23 bp, Homo sapiens
ttcatggcacccgggaatgactt

SEQ ID NO: 2185391 - DNA, 14 bp, Homo sapiens
ttcattccatttgc

SEQ ID NO: 2185392 - DNA, 16 bp, Homo sapiens
ttcattctaaaccaaa

SEQ ID NO: 2185393 - DNA, 13 bp, Homo sapiens
ttcattgggctgt

SEQ ID NO: 2185394 - DNA, 13 bp, Homo sapiens
ttcatttcatcta

SEQ ID NO: 2185395 - DNA, 20 bp, Homo sapiens
ttccaaaaacaaagtgcaaa

SEQ ID NO: 2185396 - DNA, 23 bp, Homo sapiens
ttccaaaaacaaagtgcaaagct

SEQ ID NO: 2185397 - DNA, 19 bp, Homo sapiens
ttccaacaggcacctctaa

SEQ ID NO: 2185398 - DNA, 16 bp, Homo sapiens
ttccaactgctgcccc

SEQ ID NO: 2185399 - DNA, 16 bp, Homo sapiens
ttccaagacctgactc

SEQ ID NO: 2185400 - DNA, 21 bp, Homo sapiens
ttccaagcctgggccactggc

SEQ ID NO: 2185401 - DNA, 22 bp, Homo sapiens
ttccaagcctgggccactggca

SEQ ID NO: 2185402 - DNA, 23 bp, Homo sapiens
ttccaatatttataattaaagaa

SEQ ID NO: 2185403 - DNA, 18 bp, Homo sapiens
ttccacacagcctgtctt

SEQ ID NO: 2185404 - DNA, 16 bp, Homo sapiens
ttccacacccccaccc

SEQ ID NO: 2185405 - DNA, 21 bp, Homo sapiens
ttccactgcaaataaagcctt

SEQ ID NO: 2185406 - DNA, 23 bp, Homo sapiens
ttccactgcaaataaagcctttt

SEQ ID NO: 2185407 - DNA, 18 bp, Homo sapiens
ttccacttgattttgcaa

SEQ ID NO: 2185408 - DNA, 19 bp, Homo sapiens
ttccagctaagcctgatga

SEQ ID NO: 2185409 - DNA, 12 bp, Homo sapiens
ttccagcttccc

SEQ ID NO: 2185410 - DNA, 23 bp, Homo sapiens
ttccaggttctggttagctcagc

SEQ ID NO: 2185411 - DNA, 17 bp, Homo sapiens
ttccagtatcctgaaac

SEQ ID NO: 2185412 - DNA, 12 bp, Homo sapiens
ttccatattaaa

SEQ ID NO: 2185413 - DNA, 18 bp, Homo sapiens
ttccatattaaaatcaca

SEQ ID NO: 2185414 - DNA, 22 bp, Homo sapiens
ttccatcctgtacaagtgctca

SEQ ID NO: 2185415 - DNA, 19 bp, Homo sapiens
ttccattgaccttaatttc

SEQ ID NO: 2185416 - DNA, 23 bp, Homo sapiens
ttccattgaccttaatttcttgg

SEQ ID NO: 2185417 - DNA, 13 bp, Homo sapiens
ttccatttgctga

SEQ ID NO: 2185418 - DNA, 16 bp, Homo sapiens
ttcccaccaatcctca

SEQ ID NO: 2185419 - DNA, 12 bp, Homo sapiens
ttcccagaaaac

SEQ ID NO: 2185420 - DNA, 19 bp, Homo sapiens
ttcccatggtagactgtga

SEQ ID NO: 2185421 - DNA, 20 bp, Homo sapiens
ttcccatggtagactgtgac

SEQ ID NO: 2185422 - DNA, 17 bp, Homo sapiens
ttccccaagggccctgg

SEQ ID NO: 2185423 - DNA, 19 bp, Homo sapiens
ttccccctcttcttctgaa

SEQ ID NO: 2185424 - DNA, 17 bp, Homo sapiens
ttccctacccacagggc

SEQ ID NO: 2185425 - DNA, 16 bp, Homo sapiens
ttccctcatgttctca

SEQ ID NO: 2185426 - DNA, 13 bp, Homo sapiens
ttccctgaacaga

SEQ ID NO: 2185427 - DNA, 12 bp, Homo sapiens
ttccctgctgaa

SEQ ID NO: 2185428 - DNA, 11 bp, Homo sapiens
ttccctggacc

SEQ ID NO: 2185429 - DNA, 12 bp, Homo sapiens
ttccctggacca

SEQ ID NO: 2185430 - DNA, 18 bp, Homo sapiens
ttcccttatttttattta

SEQ ID NO: 2185431 - DNA, 21 bp, Homo sapiens
ttcctagttttatgtttcttg

SEQ ID NO: 2185432 - DNA, 22 bp, Homo sapiens
ttcctcatttcttgaggcttct

SEQ ID NO: 2185433 - DNA, 13 bp, Homo sapiens
ttcctccatggcc

SEQ ID NO: 2185434 - DNA, 19 bp, Homo sapiens
ttcctggagagtctcactc

SEQ ID NO: 2185435 - DNA, 22 bp, Homo sapiens
ttcctggggtgccctccactgc

SEQ ID NO: 2185436 - DNA, 14 bp, Homo sapiens
ttcctgtgtccaca

SEQ ID NO: 2185437 - DNA, 12 bp, Homo sapiens
ttcctgtttcta

SEQ ID NO: 2185438 - DNA, 18 bp, Homo sapiens
ttcctttttaggtacagt

SEQ ID NO: 2185439 - DNA, 18 bp, Homo sapiens
ttcgcagcagctccgcct

SEQ ID NO: 2185440 - DNA, 17 bp, Homo sapiens
ttcgcagtgcccagtga

SEQ ID NO: 2185441 - DNA, 12 bp, Homo sapiens
ttcggaggaggt

SEQ ID NO: 2185442 - DNA, 21 bp, Homo sapiens
ttcggcattggttccctttgc

SEQ ID NO: 2185443 - DNA, 12 bp, Homo sapiens
ttcggtgcttcc

SEQ ID NO: 2185444 - DNA, 13 bp, Homo sapiens
ttcggtgcttccc

SEQ ID NO: 2185445 - DNA, 21 bp, Homo sapiens
ttcgtaacttcatattaatat

SEQ ID NO: 2185446 - DNA, 18 bp, Homo sapiens
ttctaaaaagatgtaata

SEQ ID NO: 2185447 - DNA, 14 bp, Homo sapiens
ttctaatccatgtg

SEQ ID NO: 2185448 - DNA, 22 bp, Homo sapiens
ttctaatgctgcacaccagtta

SEQ ID NO: 2185449 - DNA, 17 bp, Homo sapiens
ttctaccactggtgtaa

SEQ ID NO: 2185450 - DNA, 12 bp, Homo sapiens
ttctacctccca

SEQ ID NO: 2185451 - DNA, 13 bp, Homo sapiens
ttctacctcccag

SEQ ID NO: 2185452 - DNA, 14 bp, Homo sapiens
ttctacctcccaga

SEQ ID NO: 2185453 - DNA, 19 bp, Homo sapiens
ttctagaatactaataaaa

SEQ ID NO: 2185454 - DNA, 16 bp, Homo sapiens
ttctatccccaagctg

SEQ ID NO: 2185455 - DNA, 22 bp, Homo sapiens
ttctatgaaagctatgaatgtt

SEQ ID NO: 2185456 - DNA, 16 bp, Homo sapiens
ttctattcagcaaaag

SEQ ID NO: 2185457 - DNA, 12 bp, Homo sapiens
ttctatttcttt

SEQ ID NO: 2185458 - DNA, 20 bp, Homo sapiens
ttctattttgcaaacactgt

SEQ ID NO: 2185459 - DNA, 18 bp, Homo sapiens
ttctcaagcactgacact

SEQ ID NO: 2185460 - DNA, 21 bp, Homo sapiens
ttctcatagcaggaaatgtag

SEQ ID NO: 2185461 - DNA, 20 bp, Homo sapiens
ttctctcaatttgggtccca

SEQ ID NO: 2185462 - DNA, 13 bp, Homo sapiens
ttctctcccacac

SEQ ID NO: 2185463 - DNA, 22 bp, Homo sapiens
ttctctcccacacaagcagtct

SEQ ID NO: 2185464 - DNA, 12 bp, Homo sapiens
ttctctgcttca

SEQ ID NO: 2185465 - DNA, 12 bp, Homo sapiens
ttctctgtccag

SEQ ID NO: 2185466 - DNA, 21 bp, Homo sapiens
ttctctgtccagggcttcaga

SEQ ID NO: 2185467 - DNA, 21 bp, Homo sapiens
ttctctgtgctctgaatggga

SEQ ID NO: 2185468 - DNA, 14 bp, Homo sapiens
ttctcttaacttaa

SEQ ID NO: 2185469 - DNA, 19 bp, Homo sapiens
ttctctttgtaaggacttg

SEQ ID NO: 2185470 - DNA, 23 bp, Homo sapiens
ttctgaaggttggaactgctgcc

SEQ ID NO: 2185471 - DNA, 17 bp, Homo sapiens
ttctgaagtctcaagaa

SEQ ID NO: 2185472 - DNA, 13 bp, Homo sapiens
tggaccaaagctg

SEQ ID NO: 2185473 - DNA, 15 bp, Homo sapiens
tggactattgcaata

SEQ ID NO: 2185474 - DNA, 17 bp, Homo sapiens
tggactgagtgggaagc

SEQ ID NO: 2185475 - DNA, 23 bp, Homo sapiens
tggactggctgtcctttccagtg

SEQ ID NO: 2185476 - DNA, 19 bp, Homo sapiens
tggacttttgcagcttcct

SEQ ID NO: 2185477 - DNA, 19 bp, Homo sapiens
tggagaaagagctgcctgg

SEQ ID NO: 2185478 - DNA, 20 bp, Homo sapiens
tggagaacagtggttgcctg

SEQ ID NO: 2185479 - DNA, 17 bp, Homo sapiens
tggagaactcatttcaa

SEQ ID NO: 2185480 - DNA, 21 bp, Homo sapiens
tggagagaccagcctttcttc

SEQ ID NO: 2185481 - DNA, 13 bp, Homo sapiens
tggagaggagaga

SEQ ID NO: 2185482 - DNA, 23 bp, Homo sapiens
tggagaggagagaatgagagagt

SEQ ID NO: 2185483 - DNA, 14 bp, Homo sapiens
tggagccacaggca

SEQ ID NO: 2185484 - DNA, 17 bp, Homo sapiens
tggagccacctgtccca

SEQ ID NO: 2185485 - DNA, 22 bp, Homo sapiens
tggagccacctgtcccacctca

SEQ ID NO: 2185486 - DNA, 14 bp, Homo sapiens
tggaggagagagac

SEQ ID NO: 2185487 - DNA, 16 bp, Homo sapiens
tggaggagagagaccc

SEQ ID NO: 2185488 - DNA, 19 bp, Homo sapiens
tggaggcattcccagaggt

SEQ ID NO: 2185489 - DNA, 20 bp, Homo sapiens
tggaggcattcccagaggtg

SEQ ID NO: 2185490 - DNA, 13 bp, Homo sapiens
tggaggcattgtt

SEQ ID NO: 2185491 - DNA, 14 bp, Homo sapiens
tggaggcattgttt

SEQ ID NO: 2185492 - DNA, 15 bp, Homo sapiens
tggaggcccttttct

SEQ ID NO: 2185493 - DNA, 15 bp, Homo sapiens
tggaggccgctgctg

SEQ ID NO: 2185494 - DNA, 17 bp, Homo sapiens
tggaggcctcaccctgc

SEQ ID NO: 2185495 - DNA, 17 bp, Homo sapiens
tggagtggaggcattgt

SEQ ID NO: 2185496 - DNA, 23 bp, Homo sapiens
tggagttattcactctcccagag

SEQ ID NO: 2185497 - DNA, 14 bp, Homo sapiens
tggatagatgccct

SEQ ID NO: 2185498 - DNA, 22 bp, Homo sapiens
tggatcaaaatctgtagagcag

SEQ ID NO: 2185499 - DNA, 20 bp, Homo sapiens
tggatcccaattcatttcat

SEQ ID NO: 2185500 - DNA, 18 bp, Homo sapiens
tggatctatcacctgtca

SEQ ID NO: 2185501 - DNA, 21 bp, Homo sapiens
tggatgagaaacagctcagcc

SEQ ID NO: 2185502 - DNA, 17 bp, Homo sapiens
tggatggaggtgatgaa

SEQ ID NO: 2185503 - DNA, 16 bp, Homo sapiens
tggatgtttcttcttt

SEQ ID NO: 2185504 - DNA, 14 bp, Homo sapiens
tggattcccctgga

SEQ ID NO: 2185505 - DNA, 19 bp, Homo sapiens
tggcaaggactttgtacat

SEQ ID NO: 2185506 - DNA, 13 bp, Homo sapiens
tggcaataaatgg

SEQ ID NO: 2185507 - DNA, 22 bp, Homo sapiens
tggcagaaatcccagttcatgt

SEQ ID NO: 2185508 - DNA, 14 bp, Homo sapiens
tggcaggagaatca

SEQ ID NO: 2185509 - DNA, 19 bp, Homo sapiens
tggcaggagaatcagcctg

SEQ ID NO: 2185510 - DNA, 14 bp, Homo sapiens
tggcagtgggagac

SEQ ID NO: 2185511 - DNA, 16 bp, Homo sapiens
tggcatattgataata

SEQ ID NO: 2185512 - DNA, 18 bp, Homo sapiens
tggcatctctggagtgtg

SEQ ID NO: 2185513 - DNA, 19 bp, Homo sapiens
tggcatctctggagtgtgt

SEQ ID NO: 2185514 - DNA, 21 bp, Homo sapiens
tggccaagaagcagtggcctt

SEQ ID NO: 2185515 - DNA, 23 bp, Homo sapiens
tggccaccaccccccactctgtg

SEQ ID NO: 2185516 - DNA, 19 bp, Homo sapiens
tggccactttgcagacctg

SEQ ID NO: 2185517 - DNA, 22 bp, Homo sapiens
tggccactttgcagacctggga

SEQ ID NO: 2185518 - DNA, 23 bp, Homo sapiens
tggccagacggcccgccgtgcct

SEQ ID NO: 2185519 - DNA, 17 bp, Homo sapiens
tggccattctattgtgg

SEQ ID NO: 2185520 - DNA, 14 bp, Homo sapiens
tggcccagggagga

SEQ ID NO: 2185521 - DNA, 23 bp, Homo sapiens
tggcccctccccaactccttcct

SEQ ID NO: 2185522 - DNA, 14 bp, Homo sapiens
tggccgatgagctg

SEQ ID NO: 2185523 - DNA, 22 bp, Homo sapiens
tggccgggggtgggggcctgct

SEQ ID NO: 2185524 - DNA, 20 bp, Homo sapiens
tggccgggttggaggcctca

SEQ ID NO: 2185525 - DNA, 22 bp, Homo sapiens
tggcctcattactttaccaccc

SEQ ID NO: 2185526 - DNA, 15 bp, Homo sapiens
tggcctccagaggag

SEQ ID NO: 2185527 - DNA, 18 bp, Homo sapiens
tggccttacaataccgta

SEQ ID NO: 2185528 - DNA, 16 bp, Homo sapiens
tggcggggatcagaac

SEQ ID NO: 2185529 - DNA, 15 bp, Homo sapiens
tggctcactgcagcc

SEQ ID NO: 2185530 - DNA, 16 bp, Homo sapiens
tggctccgctgtgtgg

SEQ ID NO: 2185531 - DNA, 15 bp, Homo sapiens
tggctcgtgggctct

SEQ ID NO: 2185532 - DNA, 15 bp, Homo sapiens
tggctctgagaaggg

SEQ ID NO: 2185533 - DNA, 21 bp, Homo sapiens
tggctgcctggcccagggagg

SEQ ID NO: 2185534 - DNA, 19 bp, Homo sapiens
tggctggaggcattcccag

SEQ ID NO: 2185535 - DNA, 21 bp, Homo sapiens
tggctggtgggaaggccggca

SEQ ID NO: 2185536 - DNA, 23 bp, Homo sapiens
tggctgtaaaaacacaaatgtgt

SEQ ID NO: 2185537 - DNA, 15 bp, Homo sapiens
tggctgtaatttaat

SEQ ID NO: 2185538 - DNA, 17 bp, Homo sapiens
tggctgtgattaattat

SEQ ID NO: 2185539 - DNA, 22 bp, Homo sapiens
tggcttcaatctacgatgttaa

SEQ ID NO: 2185540 - DNA, 18 bp, Homo sapiens
tggcttctgcttgtcatc

SEQ ID NO: 2185541 - DNA, 13 bp, Homo sapiens
tggcttgaacctt

SEQ ID NO: 2185542 - DNA, 20 bp, Homo sapiens
tggctttgcccaacctcagc

SEQ ID NO: 2185543 - DNA, 17 bp, Homo sapiens
tggctttgtcccacagc

SEQ ID NO: 2185544 - DNA, 18 bp, Homo sapiens
tgggaaaatatcactttg

SEQ ID NO: 2185545 - DNA, 16 bp, Homo sapiens
tgggaaccttcctgtc

SEQ ID NO: 2185546 - DNA, 17 bp, Homo sapiens
tgggaaggccggcagcg

SEQ ID NO: 2185547 - DNA, 21 bp, Homo sapiens
tgggaatttcagctggagata

SEQ ID NO: 2185548 - DNA, 11 bp, Homo sapiens
tgggactgatg

SEQ ID NO: 2185549 - DNA, 16 bp, Homo sapiens
tgggactgatgtcatc

SEQ ID NO: 2185550 - DNA, 21 bp, Homo sapiens
tgggactgatgtcatcttgag

SEQ ID NO: 2185551 - DNA, 16 bp, Homo sapiens
tgggagaagggacagc

SEQ ID NO: 2185552 - DNA, 16 bp, Homo sapiens
tgggagaggcagagtg

SEQ ID NO: 2185553 - DNA, 17 bp, Homo sapiens
tgggagagggagcaagc

SEQ ID NO: 2185554 - DNA, 18 bp, Homo sapiens
tgggagagggagcaagcc

SEQ ID NO: 2185555 - DNA, 17 bp, Homo sapiens
tgggaggcccctggtgg

SEQ ID NO: 2185556 - DNA, 12 bp, Homo sapiens
tgggagtgggag

SEQ ID NO: 2185557 - DNA, 15 bp, Homo sapiens
tgggagtgggagagg

SEQ ID NO: 2185558 - DNA, 17 bp, Homo sapiens
tgggagtgggagaggaa

SEQ ID NO: 2185559 - DNA, 15 bp, Homo sapiens
tgggatatgacaagc

SEQ ID NO: 2185560 - DNA, 17 bp, Homo sapiens
ttctgaagttttatttt

SEQ ID NO: 2185561 - DNA, 20 bp, Homo sapiens
ttctgaagttttattttaaa

SEQ ID NO: 2185562 - DNA, 13 bp, Homo sapiens
ttctgacctcagc

SEQ ID NO: 2185563 - DNA, 15 bp, Homo sapiens
ttctgacctcagcat

SEQ ID NO: 2185564 - DNA, 20 bp, Homo sapiens
ttctgaggaggaaataaatt

SEQ ID NO: 2185565 - DNA, 21 bp, Homo sapiens
ttctgccctcagcttcaaata

SEQ ID NO: 2185566 - DNA, 23 bp, Homo sapiens
ttctgccctcagcttcaaataaa

SEQ ID NO: 2185567 - DNA, 15 bp, Homo sapiens
ttctgcttgtcatcc

SEQ ID NO: 2185568 - DNA, 16 bp, Homo sapiens
ttctgcttttaagttt

SEQ ID NO: 2185569 - DNA, 17 bp, Homo sapiens
ttctgcttttaagtttt

SEQ ID NO: 2185570 - DNA, 13 bp, Homo sapiens
ttctggctcctgt

SEQ ID NO: 2185571 - DNA, 15 bp, Homo sapiens
ttctggctgtttgag

SEQ ID NO: 2185572 - DNA, 17 bp, Homo sapiens
ttctgggcaaggtgagg

SEQ ID NO: 2185573 - DNA, 23 bp, Homo sapiens
ttctgggggatttcaagggactg

SEQ ID NO: 2185574 - DNA, 18 bp, Homo sapiens
ttctgggtggttgccctt

SEQ ID NO: 2185575 - DNA, 17 bp, Homo sapiens
ttctgggttctgggtgg

SEQ ID NO: 2185576 - DNA, 17 bp, Homo sapiens
ttctggtagctccacaa

SEQ ID NO: 2185577 - DNA, 14 bp, Homo sapiens
ttctggtaggttct

SEQ ID NO: 2185578 - DNA, 21 bp, Homo sapiens
ttctggtaggttctgtctgtg

SEQ ID NO: 2185579 - DNA, 15 bp, Homo sapiens
ttctggttagctcag

SEQ ID NO: 2185580 - DNA, 19 bp, Homo sapiens
ttctgtcctcttctgtgag

SEQ ID NO: 2185581 - DNA, 13 bp, Homo sapiens
ttctgttgtttct

SEQ ID NO: 2185582 - DNA, 19 bp, Homo sapiens
ttcttaagtataaacctta

SEQ ID NO: 2185583 - DNA, 14 bp, Homo sapiens
ttcttattcaaaga

SEQ ID NO: 2185584 - DNA, 13 bp, Homo sapiens
ttcttctgaagat

SEQ ID NO: 2185585 - DNA, 16 bp, Homo sapiens
ttcttctgcacaaaga

SEQ ID NO: 2185586 - DNA, 16 bp, Homo sapiens
ttcttgggaaaatatc

SEQ ID NO: 2185587 - DNA, 22 bp, Homo sapiens
ttcttgggaaaatatcactttg

SEQ ID NO: 2185588 - DNA, 16 bp, Homo sapiens
ttctttatcacatgtt

SEQ ID NO: 2185589 - DNA, 16 bp, Homo sapiens
ttctttccaagtcatt

SEQ ID NO: 2185590 - DNA, 16 bp, Homo sapiens
ttctttccggccaagg

SEQ ID NO: 2185591 - DNA, 22 bp, Homo sapiens
ttctttgaccaaactgtgggta

SEQ ID NO: 2185592 - DNA, 12 bp, Homo sapiens
ttctttgagaag

SEQ ID NO: 2185593 - DNA, 18 bp, Homo sapiens
ttctttgtttttagagac

SEQ ID NO: 2185594 - DNA, 14 bp, Homo sapiens
ttcttttatgtggt

SEQ ID NO: 2185595 - DNA, 19 bp, Homo sapiens
ttcttttgaccccttcctg

SEQ ID NO: 2185596 - DNA, 14 bp, Homo sapiens
ttcttttgtacttt

SEQ ID NO: 2185597 - DNA, 15 bp, Homo sapiens
ttctttttctgtctc

SEQ ID NO: 2185598 - DNA, 15 bp, Homo sapiens
ttgaaaagattgcaa

SEQ ID NO: 2185599 - DNA, 16 bp, Homo sapiens
ttgaaaagattgcaaa

SEQ ID NO: 2185600 - DNA, 18 bp, Homo sapiens
ttgaaaagattgcaaagg

SEQ ID NO: 2185601 - DNA, 16 bp, Homo sapiens
ttgaaaatgtccagga

SEQ ID NO: 2185602 - DNA, 21 bp, Homo sapiens
ttgaaataagaattcagacat

SEQ ID NO: 2185603 - DNA, 16 bp, Homo sapiens
ttgaaatgtaatttca

SEQ ID NO: 2185604 - DNA, 15 bp, Homo sapiens
ttgaacaactcgaat

SEQ ID NO: 2185605 - DNA, 15 bp, Homo sapiens
ttgaactcacgagcc

SEQ ID NO: 2185606 - DNA, 18 bp, Homo sapiens
tttgtaatttttttctag

SEQ ID NO: 2185607 - DNA, 17 bp, Homo sapiens
tttgtagggttctgctt

SEQ ID NO: 2185608 - DNA, 15 bp, Homo sapiens
tttgtatgtatgtgt

SEQ ID NO: 2185609 - DNA, 18 bp, Homo sapiens
tttgtccaacaactgtca

SEQ ID NO: 2185610 - DNA, 20 bp, Homo sapiens
tttgtctcattttgtatgta

SEQ ID NO: 2185611 - DNA, 23 bp, Homo sapiens
tttgtctcattttgtatgtatgt

SEQ ID NO: 2185612 - DNA, 13 bp, Homo sapiens
tttgtgagtatgt

SEQ ID NO: 2185613 - DNA, 15 bp, Homo sapiens
tttgtggttgcatgt

SEQ ID NO: 2185614 - DNA, 11 bp, Homo sapiens
tttgtgtaaag

SEQ ID NO: 2185615 - DNA, 21 bp, Homo sapiens
tttgtgtacagtatgtgtcta

SEQ ID NO: 2185616 - DNA, 12 bp, Homo sapiens
tttgtgtgctgt

SEQ ID NO: 2185617 - DNA, 14 bp, Homo sapiens
tttgtgtgctgtgg

SEQ ID NO: 2185618 - DNA, 14 bp, Homo sapiens
tttgttaattaaat

SEQ ID NO: 2185619 - DNA, 20 bp, Homo sapiens
tttgttaattaaatatttct

SEQ ID NO: 2185620 - DNA, 15 bp, Homo sapiens
tttgttctttatttg

SEQ ID NO: 2185621 - DNA, 16 bp, Homo sapiens
ttttaaaaagttgata

SEQ ID NO: 2185622 - DNA, 12 bp, Homo sapiens
ttttaaaacatg

SEQ ID NO: 2185623 - DNA, 13 bp, Homo sapiens
ttttaaaacatgg

SEQ ID NO: 2185624 - DNA, 15 bp, Homo sapiens
ttttaaaacatggca

SEQ ID NO: 2185625 - DNA, 17 bp, Homo sapiens
ttttaaattattatctt

SEQ ID NO: 2185626 - DNA, 23 bp, Homo sapiens
ttttaacttgaaaagattgcaaa

SEQ ID NO: 2185627 - DNA, 17 bp, Homo sapiens
ttttaagaaaaacatgt

SEQ ID NO: 2185628 - DNA, 22 bp, Homo sapiens
ttttaatcgtttttgttttaag

SEQ ID NO: 2185629 - DNA, 22 bp, Homo sapiens
ttttaatgatactgtctaagaa

SEQ ID NO: 2185630 - DNA, 12 bp, Homo sapiens
ttttacagtgta

SEQ ID NO: 2185631 - DNA, 13 bp, Homo sapiens
ttttacatgacca

SEQ ID NO: 2185632 - DNA, 21 bp, Homo sapiens
ttttaccattttgcgatgtgt

SEQ ID NO: 2185633 - DNA, 20 bp, Homo sapiens
ttttacctgggatatgacaa

SEQ ID NO: 2185634 - DNA, 14 bp, Homo sapiens
ttttacggaattcc

SEQ ID NO: 2185635 - DNA, 17 bp, Homo sapiens
ttttacggaattccaat

SEQ ID NO: 2185636 - DNA, 21 bp, Homo sapiens
gttgtaaagtatgtattattt

SEQ ID NO: 2185637 - DNA, 12 bp, Homo sapiens
gttgtacacttg

SEQ ID NO: 2185638 - DNA, 15 bp, Homo sapiens
gttgtctaaaaataa

SEQ ID NO: 2185639 - DNA, 19 bp, Homo sapiens
gttgtgtaggcaccacctc

SEQ ID NO: 2185640 - DNA, 15 bp, Homo sapiens
gttgttagtgatttg

SEQ ID NO: 2185641 - DNA, 15 bp, Homo sapiens
gttgtttgatgtgta

SEQ ID NO: 2185642 - DNA, 23 bp, Homo sapiens
gttgttttcccatttaaaaatat

SEQ ID NO: 2185643 - DNA, 22 bp, Homo sapiens
gtttagaaattacaagtttcag

SEQ ID NO: 2185644 - DNA, 23 bp, Homo sapiens
gtttatgtaactatcaaatggtt

SEQ ID NO: 2185645 - DNA, 18 bp, Homo sapiens
gtttcagtaatagctgaa

SEQ ID NO: 2185646 - DNA, 15 bp, Homo sapiens
gtttccaagcctggg

SEQ ID NO: 2185647 - DNA, 22 bp, Homo sapiens
gtttccagctaagcctgatgat

SEQ ID NO: 2185648 - DNA, 14 bp, Homo sapiens
gtttccttctcttt

SEQ ID NO: 2185649 - DNA, 17 bp, Homo sapiens
gtttctggttggaggcc

SEQ ID NO: 2185650 - DNA, 15 bp, Homo sapiens
gtttgagattctcaa

SEQ ID NO: 2185651 - DNA, 19 bp, Homo sapiens
gtttgcttctaaaggtttc

SEQ ID NO: 2185652 - DNA, 19 bp, Homo sapiens
gtttgctttgctttgtagg

SEQ ID NO: 2185653 - DNA, 15 bp, Homo sapiens
gtttgtcttctcccc

SEQ ID NO: 2185654 - DNA, 21 bp, Homo sapiens
gttttaacctcaggttccaaa

SEQ ID NO: 2185655 - DNA, 19 bp, Homo sapiens
gttttaaggaaaaaagatt

SEQ ID NO: 2185656 - DNA, 20 bp, Homo sapiens
gttttacatcttttgggaag

SEQ ID NO: 2185657 - DNA, 17 bp, Homo sapiens
gttttatctctgtctac

SEQ ID NO: 2185658 - DNA, 14 bp, Homo sapiens
gttttatgtttctt

SEQ ID NO: 2185659 - DNA, 22 bp, Homo sapiens
gttttattcacttgtgtttgta

SEQ ID NO: 2185660 - DNA, 20 bp, Homo sapiens
gttttattgagttctgaagg

SEQ ID NO: 2185661 - DNA, 17 bp, Homo sapiens
gttttgatgagaaaaaa

SEQ ID NO: 2185662 - DNA, 13 bp, Homo sapiens
gtttttacagtgt

SEQ ID NO: 2185663 - DNA, 20 bp, Homo sapiens
gtttttcaatgtgttctttg

SEQ ID NO: 2185664 - DNA, 19 bp, Homo sapiens
gtttttgggtgcaagaggg

SEQ ID NO: 2185665 - DNA, 22 bp, Homo sapiens
gttttttagtgcaatttcttct

SEQ ID NO: 2185666 - DNA, 13 bp, Homo sapiens
gtttttttgtctt

SEQ ID NO: 2185667 - DNA, 15 bp, Homo sapiens
taaaaaatgcagaat

SEQ ID NO: 2185668 - DNA, 15 bp, Homo sapiens
taaaaacacctaagt

SEQ ID NO: 2185669 - DNA, 17 bp, Homo sapiens
taaaaataaaaatggaa

SEQ ID NO: 2185670 - DNA, 15 bp, Homo sapiens
taaaaatacttaata

SEQ ID NO: 2185671 - DNA, 14 bp, Homo sapiens
taaaaatatgtgag

SEQ ID NO: 2185672 - DNA, 20 bp, Homo sapiens
taaaaatatgtgagcatgaa

SEQ ID NO: 2185673 - DNA, 12 bp, Homo sapiens
taaaaattgaaa

SEQ ID NO: 2185674 - DNA, 20 bp, Homo sapiens
taaaacatggcaataaatgg

SEQ ID NO: 2185675 - DNA, 14 bp, Homo sapiens
taaaaccaccaaag

SEQ ID NO: 2185676 - DNA, 19 bp, Homo sapiens
taaaacccacaagtgtcta

SEQ ID NO: 2185677 - DNA, 17 bp, Homo sapiens
taaaacccagcatgtac

SEQ ID NO: 2185678 - DNA, 19 bp, Homo sapiens
taaaacccagcatgtacaa

SEQ ID NO: 2185679 - DNA, 13 bp, Homo sapiens
taaaactctcctt

SEQ ID NO: 2185680 - DNA, 18 bp, Homo sapiens
taaaagccataatccagt

SEQ ID NO: 2185681 - DNA, 17 bp, Homo sapiens
taaaagttttaacctca

SEQ ID NO: 2185682 - DNA, 19 bp, Homo sapiens
taaaataattatataactg

SEQ ID NO: 2185683 - DNA, 20 bp, Homo sapiens
taaaataattatataactgt

SEQ ID NO: 2185684 - DNA, 19 bp, Homo sapiens
taaaataatttatcaaaaa

SEQ ID NO: 2185685 - DNA, 15 bp, Homo sapiens
taaaatatctacctg

SEQ ID NO: 2185686 - DNA, 17 bp, Homo sapiens
taaaatcaagtgcacct

SEQ ID NO: 2185687 - DNA, 20 bp, Homo sapiens
taaaatctcacgctgccatt

SEQ ID NO: 2185688 - DNA, 12 bp, Homo sapiens
taaaatgaatct

SEQ ID NO: 2185689 - DNA, 13 bp, Homo sapiens
taaaatgcattta

SEQ ID NO: 2185690 - DNA, 15 bp, Homo sapiens
taaaattcattccat

SEQ ID NO: 2185691 - DNA, 23 bp, Homo sapiens
taaaatttattctacttttaaat

SEQ ID NO: 2185692 - DNA, 21 bp, Homo sapiens
taaaatttgccctcccatccc

SEQ ID NO: 2185693 - DNA, 17 bp, Homo sapiens
taaaatttgtagaattg

SEQ ID NO: 2185694 - DNA, 21 bp, Homo sapiens
taaaccaaacggaactcttca

SEQ ID NO: 2185695 - DNA, 13 bp, Homo sapiens
taaaccttatgaa

SEQ ID NO: 2185696 - DNA, 23 bp, Homo sapiens
taaacctttccattttacgtttt

SEQ ID NO: 2185697 - DNA, 23 bp, Homo sapiens
taaacttgcaatgaaaagaaaat

SEQ ID NO: 2185698 - DNA, 16 bp, Homo sapiens
taaagaaaattgccaa

SEQ ID NO: 2185699 - DNA, 20 bp, Homo sapiens
taaagaaaattgccaaaata

SEQ ID NO: 2185700 - DNA, 17 bp, Homo sapiens
taaagaggaagccttgc

SEQ ID NO: 2185701 - DNA, 15 bp, Homo sapiens
taaagcacattttaa

SEQ ID NO: 2185702 - DNA, 21 bp, Homo sapiens
taaagccagcatttcctcagt

SEQ ID NO: 2185703 - DNA, 19 bp, Homo sapiens
taaagccttttaaatcatc

SEQ ID NO: 2185704 - DNA, 19 bp, Homo sapiens
taaagtatgcatgcagtct

SEQ ID NO: 2185705 - DNA, 15 bp, Homo sapiens
tgagattctcaaagg

SEQ ID NO: 2185706 - DNA, 17 bp, Homo sapiens
tgagcagtgtgtctcct

SEQ ID NO: 2185707 - DNA, 14 bp, Homo sapiens
tgagccactggagg

SEQ ID NO: 2185708 - DNA, 21 bp, Homo sapiens
tgagcggccgcctgtccttgg

SEQ ID NO: 2185709 - DNA, 14 bp, Homo sapiens
tgagctacatgtgt

SEQ ID NO: 2185710 - DNA, 22 bp, Homo sapiens
tgagctagtgtcacctgcacag

SEQ ID NO: 2185711 - DNA, 16 bp, Homo sapiens
tgagctgaagacaaac

SEQ ID NO: 2185712 - DNA, 15 bp, Homo sapiens
tgagcttgctggaga

SEQ ID NO: 2185713 - DNA, 21 bp, Homo sapiens
tgagctttggacacacacagc

SEQ ID NO: 2185714 - DNA, 23 bp, Homo sapiens
tgagctttggacacacacagctt

SEQ ID NO: 2185715 - DNA, 23 bp, Homo sapiens
tgagctttggacgcacacagctt

SEQ ID NO: 2185716 - DNA, 23 bp, Homo sapiens
tgaggaggcagaaagcagaggct

SEQ ID NO: 2185717 - DNA, 14 bp, Homo sapiens
tgaggcccagcaga

SEQ ID NO: 2185718 - DNA, 17 bp, Homo sapiens
tgaggcccagcagagcc

SEQ ID NO: 2185719 - DNA, 16 bp, Homo sapiens
tgagggacgaggtcaa

SEQ ID NO: 2185720 - DNA, 21 bp, Homo sapiens
tgagggatgccataccttgag

SEQ ID NO: 2185721 - DNA, 22 bp, Homo sapiens
tgaggggcttccctctgctcca

SEQ ID NO: 2185722 - DNA, 14 bp, Homo sapiens
tgagggtcctgctg

SEQ ID NO: 2185723 - DNA, 13 bp, Homo sapiens
tgagggtgttttt

SEQ ID NO: 2185724 - DNA, 21 bp, Homo sapiens
tgaggtagaggggaaggaaat

SEQ ID NO: 2185725 - DNA, 22 bp, Homo sapiens
tgaggtcaccaggggaggagcc

SEQ ID NO: 2185726 - DNA, 17 bp, Homo sapiens
tgaggtgcttgccccca

SEQ ID NO: 2185727 - DNA, 12 bp, Homo sapiens
tgagtagcatat

SEQ ID NO: 2185728 - DNA, 13 bp, Homo sapiens
tgagtagctgaga

SEQ ID NO: 2185729 - DNA, 13 bp, Homo sapiens
tgagtatgtgtgg

SEQ ID NO: 2185730 - DNA, 20 bp, Homo sapiens
tgagtcagtcagcgagtgct

SEQ ID NO: 2185731 - DNA, 14 bp, Homo sapiens
tgagtgaagcaaaa

SEQ ID NO: 2185732 - DNA, 17 bp, Homo sapiens
tgagtgcaagcaaagca

SEQ ID NO: 2185733 - DNA, 19 bp, Homo sapiens
tgagtgcaagcaaagcaga

SEQ ID NO: 2185734 - DNA, 14 bp, Homo sapiens
tgagtgggaagccc

SEQ ID NO: 2185735 - DNA, 21 bp, Homo sapiens
tgagtggggagacacctcaga

SEQ ID NO: 2185736 - DNA, 20 bp, Homo sapiens
tgagtttgtttcttgtgtgt

SEQ ID NO: 2185737 - DNA, 16 bp, Homo sapiens
tgataataaaattcat

SEQ ID NO: 2185738 - DNA, 17 bp, Homo sapiens
tgataataaaattcatt

SEQ ID NO: 2185739 - DNA, 21 bp, Homo sapiens
tgataataaaattcattccat

SEQ ID NO: 2185740 - DNA, 14 bp, Homo sapiens
tgatactgtctaag

SEQ ID NO: 2185741 - DNA, 16 bp, Homo sapiens
tgataggagacttgta

SEQ ID NO: 2185742 - DNA, 18 bp, Homo sapiens
tgatagtgttttgtactt

SEQ ID NO: 2185743 - DNA, 17 bp, Homo sapiens
tgatatattctttccat

SEQ ID NO: 2185744 - DNA, 21 bp, Homo sapiens
tgatatattctttccatgcag

SEQ ID NO: 2185745 - DNA, 19 bp, Homo sapiens
tgatatctgtttgcttcta

SEQ ID NO: 2185746 - DNA, 16 bp, Homo sapiens
tgatatgactaattca

SEQ ID NO: 2185747 - DNA, 15 bp, Homo sapiens
tgatatttgtgtaaa

SEQ ID NO: 2185748 - DNA, 19 bp, Homo sapiens
tgatcaacaatttaatgta

SEQ ID NO: 2185749 - DNA, 16 bp, Homo sapiens
tgatcatttgcagctg

SEQ ID NO: 2185750 - DNA, 17 bp, Homo sapiens
tgatcatttgcagctgc

SEQ ID NO: 2185751 - DNA, 18 bp, Homo sapiens
tgatcatttgcagctgct

SEQ ID NO: 2185752 - DNA, 11 bp, Homo sapiens
tgatctgggaa

SEQ ID NO: 2185753 - DNA, 16 bp, Homo sapiens
tgatgattgccaacag

SEQ ID NO: 2185754 - DNA, 15 bp, Homo sapiens
tgatggaagggcctt

SEQ ID NO: 2185755 - DNA, 19 bp, Homo sapiens
tgatggcattactctgcac

SEQ ID NO: 2185756 - DNA, 21 bp, Homo sapiens
tgatgtattagtagagcaacc

SEQ ID NO: 2185757 - DNA, 15 bp, Homo sapiens
tgatgtcttgagagc

SEQ ID NO: 2185758 - DNA, 19 bp, Homo sapiens
tgatgtcttgagagcgctg

SEQ ID NO: 2185759 - DNA, 15 bp, Homo sapiens
tgattactctttgct

SEQ ID NO: 2185760 - DNA, 16 bp, Homo sapiens
tgattactctttgctt

SEQ ID NO: 2185761 - DNA, 21 bp, Homo sapiens
tgattactctttgctttgtag

SEQ ID NO: 2185762 - DNA, 13 bp, Homo sapiens
tgattatcattta

SEQ ID NO: 2185763 - DNA, 17 bp, Homo sapiens
tgattatcatttatttt

SEQ ID NO: 2185764 - DNA, 20 bp, Homo sapiens
tgattcaataaaatgcactg

SEQ ID NO: 2185765 - DNA, 21 bp, Homo sapiens
tgattcaataaaatgcactga

SEQ ID NO: 2185766 - DNA, 18 bp, Homo sapiens
tgattcagtgcattttca

SEQ ID NO: 2185767 - DNA, 20 bp, Homo sapiens
tgattgaacgttctcaaacc

SEQ ID NO: 2185768 - DNA, 19 bp, Homo sapiens
tgattgcagttatttcaaa

SEQ ID NO: 2185769 - DNA, 20 bp, Homo sapiens
tgattgccatttcttcccaa

SEQ ID NO: 2185770 - DNA, 16 bp, Homo sapiens
tgatttctacaactga

SEQ ID NO: 2185771 - DNA, 17 bp, Homo sapiens
tgatttctgccttcctt

SEQ ID NO: 2185772 - DNA, 17 bp, Homo sapiens
tgatttggtcaccttcc

SEQ ID NO: 2185773 - DNA, 13 bp, Homo sapiens
tgattttctttct

SEQ ID NO: 2185774 - DNA, 21 bp, Homo sapiens
tgattttttttttaacttgaa

SEQ ID NO: 2185775 - DNA, 11 bp, Homo sapiens
tgcaaagctgc

SEQ ID NO: 2185776 - DNA, 14 bp, Homo sapiens
tgcaaagtgccctc

SEQ ID NO: 2185777 - DNA, 15 bp, Homo sapiens
tgcaaagtgccctca

SEQ ID NO: 2185778 - DNA, 19 bp, Homo sapiens
tgcaaagtggaattaaagg

SEQ ID NO: 2185779 - DNA, 16 bp, Homo sapiens
tgcaaataaagccttt

SEQ ID NO: 2185780 - DNA, 19 bp, Homo sapiens
tgcaaataaagccttttaa

SEQ ID NO: 2185781 - DNA, 23 bp, Homo sapiens
tgcaagagggagcacgtgactgt

SEQ ID NO: 2185782 - DNA, 12 bp, Homo sapiens
tgcaaggtcact

SEQ ID NO: 2185783 - DNA, 13 bp, Homo sapiens
tgcaagtgaaata

SEQ ID NO: 2185784 - DNA, 20 bp, Homo sapiens
tgcaagtgagcaaacctgcc

SEQ ID NO: 2185785 - DNA, 18 bp, Homo sapiens
tgcaatacatttcttcct

SEQ ID NO: 2185786 - DNA, 14 bp, Homo sapiens
tgcaatttcttctg

SEQ ID NO: 2185787 - DNA, 20 bp, Homo sapiens
tgcaatttcttctgtagcta

SEQ ID NO: 2185788 - DNA, 22 bp, Homo sapiens
tgcacacacggttttggcagct

SEQ ID NO: 2185789 - DNA, 18 bp, Homo sapiens
tgcacacggcacagagca

SEQ ID NO: 2185790 - DNA, 16 bp, Homo sapiens
tgcacagaacaagcca

SEQ ID NO: 2185791 - DNA, 15 bp, Homo sapiens
tgcacagggctgcaa

SEQ ID NO: 2185792 - DNA, 17 bp, Homo sapiens
tgcacataatttgcata

SEQ ID NO: 2185793 - DNA, 18 bp, Homo sapiens
tgcaccctgtatggagct

SEQ ID NO: 2185794 - DNA, 19 bp, Homo sapiens
tgcaccttgtgaaggaaaa

SEQ ID NO: 2185795 - DNA, 14 bp, Homo sapiens
tgcagacctgggac

SEQ ID NO: 2185796 - DNA, 12 bp, Homo sapiens
tgcagagctggg

SEQ ID NO: 2185797 - DNA, 11 bp, Homo sapiens
tgcagatgcca

SEQ ID NO: 2185798 - DNA, 15 bp, Homo sapiens
tgcagatgccagagc

SEQ ID NO: 2185799 - DNA, 17 bp, Homo sapiens
tgcagcagcaagtacaa

SEQ ID NO: 2185800 - DNA, 16 bp, Homo sapiens
tgcagcagcttgctgc

SEQ ID NO: 2185801 - DNA, 20 bp, Homo sapiens
tgcagcctcgaactcctggg

SEQ ID NO: 2185802 - DNA, 22 bp, Homo sapiens
tgcagcctcgaactcctgggct

SEQ ID NO: 2185803 - DNA, 19 bp, Homo sapiens
tgcagcggtggaaggagcc

SEQ ID NO: 2185804 - DNA, 14 bp, Homo sapiens
tgcagctgctggtt

SEQ ID NO: 2185805 - DNA, 14 bp, Homo sapiens
tgcaggcagccttg

SEQ ID NO: 2185806 - DNA, 15 bp, Homo sapiens
tgcaggcagccttga

SEQ ID NO: 2185807 - DNA, 13 bp, Homo sapiens
tgcagggcagcct

SEQ ID NO: 2185808 - DNA, 21 bp, Homo sapiens
tgcagggcagcctgtgggaga

SEQ ID NO: 2185809 - DNA, 12 bp, Homo sapiens
tgcaggtgccca

SEQ ID NO: 2185810 - DNA, 20 bp, Homo sapiens
tgcagtcacccctgtctgcg

SEQ ID NO: 2185811 - DNA, 19 bp, Homo sapiens
tgcagtcaccctgtggcaa

SEQ ID NO: 2185812 - DNA, 16 bp, Homo sapiens
tgcagtgcctttcccc

SEQ ID NO: 2185813 - DNA, 15 bp, Homo sapiens
tgcagtgtttttcct

SEQ ID NO: 2185814 - DNA, 20 bp, Homo sapiens
tgcagttcatactgaatgac

SEQ ID NO: 2185815 - DNA, 20 bp, Homo sapiens
tgcatcagcctctggccaga

SEQ ID NO: 2185816 - DNA, 14 bp, Homo sapiens
tgcatgacttccct

SEQ ID NO: 2185817 - DNA, 15 bp, Homo sapiens
tgcatgcagtcttgt

SEQ ID NO: 2185818 - DNA, 21 bp, Homo sapiens
tgcatgtctgttttaaaaaaa

SEQ ID NO: 2185819 - DNA, 22 bp, Homo sapiens
tgcatgtgtaaatctgaaaaac

SEQ ID NO: 2185820 - DNA, 16 bp, Homo sapiens
tgcattcactcagcat

SEQ ID NO: 2185821 - DNA, 15 bp, Homo sapiens
tgcattgtgtgtcac

SEQ ID NO: 2185822 - DNA, 16 bp, Homo sapiens
tgcattgtgtgtcaca

SEQ ID NO: 2185823 - DNA, 16 bp, Homo sapiens
tgcattttctgggttc

SEQ ID NO: 2185824 - DNA, 23 bp, Homo sapiens
tgccaaagtgtctacatgtgcca

SEQ ID NO: 2185825 - DNA, 14 bp, Homo sapiens
tgccaacagtggct

SEQ ID NO: 2185826 - DNA, 18 bp, Homo sapiens
tgccaagaactctgggca

SEQ ID NO: 2185827 - DNA, 13 bp, Homo sapiens
tgccaagccagat

SEQ ID NO: 2185828 - DNA, 18 bp, Homo sapiens
tgccaagtaacaatgcat

SEQ ID NO: 2185829 - DNA, 16 bp, Homo sapiens
tgccaccctctgcagg

SEQ ID NO: 2185830 - DNA, 13 bp, Homo sapiens
tgccacctgcagc

SEQ ID NO: 2185831 - DNA, 15 bp, Homo sapiens
tgccacctgcagcgt

SEQ ID NO: 2185832 - DNA, 22 bp, Homo sapiens
tgccactaggctgggtgcccac

SEQ ID NO: 2185833 - DNA, 20 bp, Homo sapiens
tgccagagcaaagggccagg

SEQ ID NO: 2185834 - DNA, 15 bp, Homo sapiens
tgccataccttgaga

SEQ ID NO: 2185835 - DNA, 16 bp, Homo sapiens
tgccataccttgagac

SEQ ID NO: 2185836 - DNA, 15 bp, Homo sapiens
tgccatttcttccca

SEQ ID NO: 2185837 - DNA, 17 bp, Homo sapiens
tgccatttcttcccaag

SEQ ID NO: 2185838 - DNA, 19 bp, Homo sapiens
tgccatttcttcccaaggc

SEQ ID NO: 2185839 - DNA, 13 bp, Homo sapiens
tgcccaacctcag

SEQ ID NO: 2185840 - DNA, 15 bp, Homo sapiens
tgcccaacctcagca

SEQ ID NO: 2185841 - DNA, 13 bp, Homo sapiens
tgcccaccctcct

SEQ ID NO: 2185842 - DNA, 13 bp, Homo sapiens
tgcccagagctgg

SEQ ID NO: 2185843 - DNA, 17 bp, Homo sapiens
tgggggcctgctgtggg

SEQ ID NO: 2185844 - DNA, 18 bp, Homo sapiens
tgggggcctgctgtgggt

SEQ ID NO: 2185845 - DNA, 20 bp, Homo sapiens
tggggggatttggctggtgc

SEQ ID NO: 2185846 - DNA, 13 bp, Homo sapiens
tgggggtctggga

SEQ ID NO: 2185847 - DNA, 18 bp, Homo sapiens
tgggggtctgggaggcag

SEQ ID NO: 2185848 - DNA, 19 bp, Homo sapiens
tgggggtctgggaggcagg

SEQ ID NO: 2185849 - DNA, 20 bp, Homo sapiens
tgggggtctgggaggcaggt

SEQ ID NO: 2185850 - DNA, 23 bp, Homo sapiens
tgggggtgccaaccacctctggc

SEQ ID NO: 2185851 - DNA, 21 bp, Homo sapiens
tgggggtgtcacagaggcagt

SEQ ID NO: 2185852 - DNA, 15 bp, Homo sapiens
tgggggttggctggg

SEQ ID NO: 2185853 - DNA, 16 bp, Homo sapiens
tgggggttggctgggt

SEQ ID NO: 2185854 - DNA, 15 bp, Homo sapiens
tggggtgttgaagac

SEQ ID NO: 2185855 - DNA, 19 bp, Homo sapiens
tgggtaggttctgaacagc

SEQ ID NO: 2185856 - DNA, 15 bp, Homo sapiens
tgggtgagtttttct

SEQ ID NO: 2185857 - DNA, 20 bp, Homo sapiens
tgggtgtattaggactggct

SEQ ID NO: 2185858 - DNA, 17 bp, Homo sapiens
tgggtttctctgtgctc

SEQ ID NO: 2185859 - DNA, 16 bp, Homo sapiens
tggtaagggccaagtc

SEQ ID NO: 2185860 - DNA, 13 bp, Homo sapiens
tggtacaggaagg

SEQ ID NO: 2185861 - DNA, 20 bp, Homo sapiens
tggtacaggaaggcttgcag

SEQ ID NO: 2185862 - DNA, 21 bp, Homo sapiens
tggtacaggaaggcttgcagt

SEQ ID NO: 2185863 - DNA, 14 bp, Homo sapiens
tggtataaattaat

SEQ ID NO: 2185864 - DNA, 20 bp, Homo sapiens
tggtattggccgatgagctg

SEQ ID NO: 2185865 - DNA, 22 bp, Homo sapiens
tggtattggccgatgagctggt

SEQ ID NO: 2185866 - DNA, 13 bp, Homo sapiens
tggtatttaacag

SEQ ID NO: 2185867 - DNA, 19 bp, Homo sapiens
tggtccccaaaacactgtc

SEQ ID NO: 2185868 - DNA, 14 bp, Homo sapiens
tggtcctaagtccc

SEQ ID NO: 2185869 - DNA, 19 bp, Homo sapiens
tggtcctctgatttcacat

SEQ ID NO: 2185870 - DNA, 13 bp, Homo sapiens
tggtctatttctc

SEQ ID NO: 2185871 - DNA, 19 bp, Homo sapiens
tggtctgcctctgagccac

SEQ ID NO: 2185872 - DNA, 18 bp, Homo sapiens
tggtctttgggataacct

SEQ ID NO: 2185873 - DNA, 15 bp, Homo sapiens
tggtgaccagtttct

SEQ ID NO: 2185874 - DNA, 17 bp, Homo sapiens
tggtgaccagtttctta

SEQ ID NO: 2185875 - DNA, 14 bp, Homo sapiens
tggtgagaattaaa

SEQ ID NO: 2185876 - DNA, 22 bp, Homo sapiens
tggtgagaattaaaataaaacg

SEQ ID NO: 2185877 - DNA, 23 bp, Homo sapiens
tggtgagaattaaaataaaacgt

SEQ ID NO: 2185878 - DNA, 14 bp, Homo sapiens
tggtgaggaagctc

SEQ ID NO: 2185879 - DNA, 16 bp, Homo sapiens
tggtgaggaagctcca

SEQ ID NO: 2185880 - DNA, 19 bp, Homo sapiens
tggtgatcgcacaaggaca

SEQ ID NO: 2185881 - DNA, 22 bp, Homo sapiens
tggtgcctatttattcattcag

SEQ ID NO: 2185882 - DNA, 21 bp, Homo sapiens
tggtgcctctggaggcctctg

SEQ ID NO: 2185883 - DNA, 23 bp, Homo sapiens
tggtgggaaaatgtcccccacct

SEQ ID NO: 2185884 - DNA, 23 bp, Homo sapiens
tggtgggaaggccggcagcgggc

SEQ ID NO: 2185885 - DNA, 14 bp, Homo sapiens
tggtgtaaaaaaca

SEQ ID NO: 2185886 - DNA, 20 bp, Homo sapiens
tggtgtcatgaggaaaaaaa

SEQ ID NO: 2185887 - DNA, 22 bp, Homo sapiens
tggtgtcatgaggaaaaaaaat

SEQ ID NO: 2185888 - DNA, 16 bp, Homo sapiens
tggtgtccttctcctc

SEQ ID NO: 2185889 - DNA, 17 bp, Homo sapiens
tggtgtccttctcctct

SEQ ID NO: 2185890 - DNA, 15 bp, Homo sapiens
tggtgttttttttcc

SEQ ID NO: 2185891 - DNA, 19 bp, Homo sapiens
tggttagctcagccccagc

SEQ ID NO: 2185892 - DNA, 21 bp, Homo sapiens
tggttagctcagccccagccc

SEQ ID NO: 2185893 - DNA, 23 bp, Homo sapiens
tggttagctcagccccagcccag

SEQ ID NO: 2185894 - DNA, 21 bp, Homo sapiens
tggttccctttgctccacccc

SEQ ID NO: 2185895 - DNA, 23 bp, Homo sapiens
tggttccctttgctccaccccac

SEQ ID NO: 2185896 - DNA, 22 bp, Homo sapiens
tggttcttttaccccacgaaga

SEQ ID NO: 2185897 - DNA, 13 bp, Homo sapiens
tggttgcctgggg

SEQ ID NO: 2185898 - DNA, 15 bp, Homo sapiens
tggtttctatacatg

SEQ ID NO: 2185899 - DNA, 11 bp, Homo sapiens
tggtttcttat

SEQ ID NO: 2185900 - DNA, 20 bp, Homo sapiens
tggttttattctttgagaag

SEQ ID NO: 2185901 - DNA, 16 bp, Homo sapiens
tgtaaaataaaaccac

SEQ ID NO: 2185902 - DNA, 14 bp, Homo sapiens
tgtaaacttgaaag

SEQ ID NO: 2185903 - DNA, 12 bp, Homo sapiens
tgtaaatacaat

SEQ ID NO: 2185904 - DNA, 17 bp, Homo sapiens
tgtaaatacaattcaaa

SEQ ID NO: 2185905 - DNA, 19 bp, Homo sapiens
tgtaaatacaattcaaaca

SEQ ID NO: 2185906 - DNA, 21 bp, Homo sapiens
tgtaaatacaattcaaacaat

SEQ ID NO: 2185907 - DNA, 17 bp, Homo sapiens
tgtaaggacttgtgcct

SEQ ID NO: 2185908 - DNA, 15 bp, Homo sapiens
tgtaaggtattgcaa

SEQ ID NO: 2185909 - DNA, 17 bp, Homo sapiens
tgtaagtaaactgccct

SEQ ID NO: 2185910 - DNA, 18 bp, Homo sapiens
tgtaagtaaactgccctg

SEQ ID NO: 2185911 - DNA, 14 bp, Homo sapiens
tgtaataatcattt

SEQ ID NO: 2185912 - DNA, 23 bp, Homo sapiens
tgtaatgaaaatgatgtagacat

SEQ ID NO: 2185913 - DNA, 16 bp, Homo sapiens
tgtaatgtgtatgtct

SEQ ID NO: 2185914 - DNA, 17 bp, Homo sapiens
tgtacaataccagatca

SEQ ID NO: 2185915 - DNA, 22 bp, Homo sapiens
tgtacaataccagatcactcaa

SEQ ID NO: 2185916 - DNA, 15 bp, Homo sapiens
tgtacacatatacat

SEQ ID NO: 2185917 - DNA, 22 bp, Homo sapiens
tgtacatagatgtatcattaat

SEQ ID NO: 2185918 - DNA, 20 bp, Homo sapiens
tgtaccgtcgacaagaatgt

SEQ ID NO: 2185919 - DNA, 15 bp, Homo sapiens
tgtactattgcttaa

SEQ ID NO: 2185920 - DNA, 21 bp, Homo sapiens
tgtactattgcttaaacaaaa

SEQ ID NO: 2185921 - DNA, 13 bp, Homo sapiens
tgtagaagaggga

SEQ ID NO: 2185922 - DNA, 16 bp, Homo sapiens
tgtagaagagggagaa

SEQ ID NO: 2185923 - DNA, 18 bp, Homo sapiens
tgtagaagagggagaagg

SEQ ID NO: 2185924 - DNA, 22 bp, Homo sapiens
tgtagaagtggcatctgaaaac

SEQ ID NO: 2185925 - DNA, 23 bp, Homo sapiens
tgtagaagtggcatctgaaaaca

SEQ ID NO: 2185926 - DNA, 20 bp, Homo sapiens
tgtagacatacttgtacgct

SEQ ID NO: 2185927 - DNA, 17 bp, Homo sapiens
tgtagcaaattccaata

SEQ ID NO: 2185928 - DNA, 22 bp, Homo sapiens
tgtagcaaattccaatacatta

SEQ ID NO: 2185929 - DNA, 14 bp, Homo sapiens
tgtagccagacagt

SEQ ID NO: 2185930 - DNA, 16 bp, Homo sapiens
tgtagctattctttga

SEQ ID NO: 2185931 - DNA, 20 bp, Homo sapiens
tgtagctcttagtcctccct

SEQ ID NO: 2185932 - DNA, 21 bp, Homo sapiens
tgtagggttctgcttttaagt

SEQ ID NO: 2185933 - DNA, 21 bp, Homo sapiens
tgtagtatactttcatctaaa

SEQ ID NO: 2185934 - DNA, 16 bp, Homo sapiens
tgtagtgtgtttgtga

SEQ ID NO: 2185935 - DNA, 22 bp, Homo sapiens
tgtatataaaattagattagaa

SEQ ID NO: 2185936 - DNA, 12 bp, Homo sapiens
tgtatataaata

SEQ ID NO: 2185937 - DNA, 20 bp, Homo sapiens
tgtatataaatatattttct

SEQ ID NO: 2185938 - DNA, 14 bp, Homo sapiens
tgtatattgtaatt

SEQ ID NO: 2185939 - DNA, 16 bp, Homo sapiens
tgtatatttgaaactg

SEQ ID NO: 2185940 - DNA, 22 bp, Homo sapiens
tgtatcaccctcagctggcgga

SEQ ID NO: 2185941 - DNA, 20 bp, Homo sapiens
tgtatcagaaatgaaacaga

SEQ ID NO: 2185942 - DNA, 20 bp, Homo sapiens
tgtatctcgaagtcttccat

SEQ ID NO: 2185943 - DNA, 13 bp, Homo sapiens
tgtatgtatgtgt

SEQ ID NO: 2185944 - DNA, 11 bp, Homo sapiens
tgtatgtgttt

SEQ ID NO: 2185945 - DNA, 22 bp, Homo sapiens
tgtattaaacctttccatttta

SEQ ID NO: 2185946 - DNA, 18 bp, Homo sapiens
tgtattaacctacctgtg

SEQ ID NO: 2185947 - DNA, 13 bp, Homo sapiens
tgtattcagagcc

SEQ ID NO: 2185948 - DNA, 14 bp, Homo sapiens
tgtattcagagcca

SEQ ID NO: 2185949 - DNA, 20 bp, Homo sapiens
tgtattctctgtccagggct

SEQ ID NO: 2185950 - DNA, 21 bp, Homo sapiens
tgtattctctgtccagggctt

SEQ ID NO: 2185951 - DNA, 21 bp, Homo sapiens
tgtatttaacagaaattgtat

SEQ ID NO: 2185952 - DNA, 19 bp, Homo sapiens
tgtcaaccttgtgtgagtg

SEQ ID NO: 2185953 - DNA, 21 bp, Homo sapiens
tgtcaaccttgtgtgagtgtg

SEQ ID NO: 2185954 - DNA, 19 bp, Homo sapiens
tgtcacaaagctaaataca

SEQ ID NO: 2185955 - DNA, 13 bp, Homo sapiens
tgtcacagaggca

SEQ ID NO: 2185956 - DNA, 13 bp, Homo sapiens
tgtcacgagccct

SEQ ID NO: 2185957 - DNA, 15 bp, Homo sapiens
tgtcacgttctggaa

SEQ ID NO: 2185958 - DNA, 21 bp, Homo sapiens
tgtcagaataaagaacattct

SEQ ID NO: 2185959 - DNA, 14 bp, Homo sapiens
tgtcataaagttga

SEQ ID NO: 2185960 - DNA, 15 bp, Homo sapiens
tgtcataaagttgac

SEQ ID NO: 2185961 - DNA, 21 bp, Homo sapiens
tgtcatccacacaacaccagg

SEQ ID NO: 2185962 - DNA, 22 bp, Homo sapiens
tgtcatccacacaacaccagga

SEQ ID NO: 2185963 - DNA, 21 bp, Homo sapiens
tgtccacatctaacaaagtca

SEQ ID NO: 2185964 - DNA, 17 bp, Homo sapiens
tgtccacccccgcctcc

SEQ ID NO: 2185965 - DNA, 14 bp, Homo sapiens
tgtccaggatcaaa

SEQ ID NO: 2185966 - DNA, 13 bp, Homo sapiens
tgtcccacagctt

SEQ ID NO: 2185967 - DNA, 14 bp, Homo sapiens
tgtcccacagcttg

SEQ ID NO: 2185968 - DNA, 11 bp, Homo sapiens
tgtccccacac

SEQ ID NO: 2185969 - DNA, 14 bp, Homo sapiens
tgtccccagcccac

SEQ ID NO: 2185970 - DNA, 16 bp, Homo sapiens
tgtccccagcccactg

SEQ ID NO: 2185971 - DNA, 13 bp, Homo sapiens
tgtccccatagct

SEQ ID NO: 2185972 - DNA, 14 bp, Homo sapiens
tgtccccatagctg

SEQ ID NO: 2185973 - DNA, 13 bp, Homo sapiens
tgtcccccacctc

SEQ ID NO: 2185974 - DNA, 21 bp, Homo sapiens
tgtcccccacctcttttccta

SEQ ID NO: 2185975 - DNA, 15 bp, Homo sapiens
tgtccctggccatct

SEQ ID NO: 2185976 - DNA, 17 bp, Homo sapiens
tgtccctggccatctct

SEQ ID NO: 2185977 - DNA, 16 bp, Homo sapiens
tgtcctcattcttctc

SEQ ID NO: 2185978 - DNA, 14 bp, Homo sapiens
tgtcctgcagagct

SEQ ID NO: 2185979 - DNA, 19 bp, Homo sapiens
tgtcctgcagagctggggg

SEQ ID NO: 2185980 - DNA, 12 bp, Homo sapiens
tgtccttctcct

SEQ ID NO: 2185981 - DNA, 22 bp, Homo sapiens
tgtccttctcctcttgtagcca

SEQ ID NO: 2185982 - DNA, 22 bp, Homo sapiens
tgtctaaaaataaaatgcattt

SEQ ID NO: 2185983 - DNA, 20 bp, Homo sapiens
tgtctaaaatacttgagaaa

SEQ ID NO: 2185984 - DNA, 15 bp, Homo sapiens
tgtctacatgtgcca

SEQ ID NO: 2185985 - DNA, 16 bp, Homo sapiens
tgtctaccatctccct

SEQ ID NO: 2185986 - DNA, 22 bp, Homo sapiens
tgtctagcaaagccaccaaggg

SEQ ID NO: 2185987 - DNA, 13 bp, Homo sapiens
tgtctctcattct

SEQ ID NO: 2185988 - DNA, 10 bp, Homo sapiens
tgtctctctt

SEQ ID NO: 2185989 - DNA, 13 bp, Homo sapiens
tgtctgaaatttt

SEQ ID NO: 2185990 - DNA, 17 bp, Homo sapiens
tgtctgcgccgctgtgc

SEQ ID NO: 2185991 - DNA, 14 bp, Homo sapiens
tgtctggcaaggac

SEQ ID NO: 2185992 - DNA, 21 bp, Homo sapiens
tgtcttcatccttagcaacag

SEQ ID NO: 2185993 - DNA, 16 bp, Homo sapiens
tgtcttccaggcccag

SEQ ID NO: 2185994 - DNA, 16 bp, Homo sapiens
tgtcttggcctcccaa

SEQ ID NO: 2185995 - DNA, 20 bp, Homo sapiens
tgtgaacataggtgtgcttc

SEQ ID NO: 2185996 - DNA, 15 bp, Homo sapiens
tgtgaagaaacattt

SEQ ID NO: 2185997 - DNA, 20 bp, Homo sapiens
tgtgaagaaacatttatctt

SEQ ID NO: 2185998 - DNA, 18 bp, Homo sapiens
tgtgaaggaaaaacatgc

SEQ ID NO: 2185999 - DNA, 16 bp, Homo sapiens
tgtgaatgctgtacct

SEQ ID NO: 2186000 - DNA, 23 bp, Homo sapiens
tgtgagccactgtgcccagcagt

SEQ ID NO: 2186001 - DNA, 20 bp, Homo sapiens
tgtgatgtatgttggttttt

SEQ ID NO: 2186002 - DNA, 15 bp, Homo sapiens
tgtgattatcattta

SEQ ID NO: 2186003 - DNA, 17 bp, Homo sapiens
tgtgattatcatttatt

SEQ ID NO: 2186004 - DNA, 22 bp, Homo sapiens
tgtgcagggccctctggggctc

SEQ ID NO: 2186005 - DNA, 20 bp, Homo sapiens
tgtgcatgcaaaccaggagc

SEQ ID NO: 2186006 - DNA, 16 bp, Homo sapiens
tgtgccaccctctgca

SEQ ID NO: 2186007 - DNA, 17 bp, Homo sapiens
tgtgccaccctctgcag

SEQ ID NO: 2186008 - DNA, 18 bp, Homo sapiens
tgtgccaccctctgcagg

SEQ ID NO: 2186009 - DNA, 20 bp, Homo sapiens
tgtgcccacccgtcttcaat

SEQ ID NO: 2186010 - DNA, 22 bp, Homo sapiens
tgtgcccagcagtttcccagaa

SEQ ID NO: 2186011 - DNA, 12 bp, Homo sapiens
tgtgcccagctc

SEQ ID NO: 2186012 - DNA, 15 bp, Homo sapiens
tgtgcccagctcagt

SEQ ID NO: 2186013 - DNA, 16 bp, Homo sapiens
tgtgcccagctcagtc

SEQ ID NO: 2186014 - DNA, 15 bp, Homo sapiens
tgtgcccttgctggg

SEQ ID NO: 2186015 - DNA, 18 bp, Homo sapiens
tgtgcctcttgggagacg

SEQ ID NO: 2186016 - DNA, 17 bp, Homo sapiens
tgtgcctggagctcctg

SEQ ID NO: 2186017 - DNA, 18 bp, Homo sapiens
tgtgcctggagctcctgg

SEQ ID NO: 2186018 - DNA, 15 bp, Homo sapiens
tgtgcgtcccagctg

SEQ ID NO: 2186019 - DNA, 23 bp, Homo sapiens
tgtgcgtcccagctgaaggcagt

SEQ ID NO: 2186020 - DNA, 20 bp, Homo sapiens
tgtgctgattcaataaaatg

SEQ ID NO: 2186021 - DNA, 14 bp, Homo sapiens
tgtgctgcatccca

SEQ ID NO: 2186022 - DNA, 18 bp, Homo sapiens
tgtgctgctgtggcatca

SEQ ID NO: 2186023 - DNA, 13 bp, Homo sapiens
tgtgctggagcca

SEQ ID NO: 2186024 - DNA, 15 bp, Homo sapiens
tgtgctggagccact

SEQ ID NO: 2186025 - DNA, 20 bp, Homo sapiens
tgtgctggagccactaacta

SEQ ID NO: 2186026 - DNA, 17 bp, Homo sapiens
tgtgctgtggttcctgg

SEQ ID NO: 2186027 - DNA, 15 bp, Homo sapiens
tgtggagaggagaga

SEQ ID NO: 2186028 - DNA, 17 bp, Homo sapiens
tgtggagaggagagaat

SEQ ID NO: 2186029 - DNA, 19 bp, Homo sapiens
tgtggagaggagagaatga

SEQ ID NO: 2186030 - DNA, 20 bp, Homo sapiens
tgtggagcacaaaagcctct

SEQ ID NO: 2186031 - DNA, 14 bp, Homo sapiens
tgtggagttattca

SEQ ID NO: 2186032 - DNA, 17 bp, Homo sapiens
tgtgggagaagggacag

SEQ ID NO: 2186033 - DNA, 16 bp, Homo sapiens
tgtgggggtctgggag

SEQ ID NO: 2186034 - DNA, 18 bp, Homo sapiens
tgtgggggtctgggaggc

SEQ ID NO: 2186035 - DNA, 15 bp, Homo sapiens
tgtggtggtttctat

SEQ ID NO: 2186036 - DNA, 19 bp, Homo sapiens
tgtgtaaagtatgcatgca

SEQ ID NO: 2186037 - DNA, 22 bp, Homo sapiens
tgtgtaggcaccacctctgtca

SEQ ID NO: 2186038 - DNA, 20 bp, Homo sapiens
tgtgtatattgtaacgttaa

SEQ ID NO: 2186039 - DNA, 14 bp, Homo sapiens
tgtgtatgtctggt

SEQ ID NO: 2186040 - DNA, 14 bp, Homo sapiens
tgtgtcacaaagct

SEQ ID NO: 2186041 - DNA, 18 bp, Homo sapiens
tgtgtcacgcaggctgag

SEQ ID NO: 2186042 - DNA, 18 bp, Homo sapiens
tgtgtgctcttcttcttt

SEQ ID NO: 2186043 - DNA, 22 bp, Homo sapiens
tgtgtgggggtctgggaggcag

SEQ ID NO: 2186044 - DNA, 21 bp, Homo sapiens
tgtgtgtatcaccctcagctg

SEQ ID NO: 2186045 - DNA, 12 bp, Homo sapiens
tgtgtgtcacaa

SEQ ID NO: 2186046 - DNA, 16 bp, Homo sapiens
tgtgtgtttttataga

SEQ ID NO: 2186047 - DNA, 12 bp, Homo sapiens
tgtgttactgat

SEQ ID NO: 2186048 - DNA, 21 bp, Homo sapiens
tgtgttcgtggagccacaggc

SEQ ID NO: 2186049 - DNA, 22 bp, Homo sapiens
tgtgtttgtatataaatggtga

SEQ ID NO: 2186050 - DNA, 17 bp, Homo sapiens
tgttaaaacaaattaaa

SEQ ID NO: 2186051 - DNA, 21 bp, Homo sapiens
tgttaaaacaaattaaaaaca

SEQ ID NO: 2186052 - DNA, 16 bp, Homo sapiens
tgttaacgtgcatgag

SEQ ID NO: 2186053 - DNA, 23 bp, Homo sapiens
tgttaatattaatttatatttgt

SEQ ID NO: 2186054 - DNA, 14 bp, Homo sapiens
tgttaatcctagct

SEQ ID NO: 2186055 - DNA, 20 bp, Homo sapiens
tgttagttttgctccttctg

SEQ ID NO: 2186056 - DNA, 16 bp, Homo sapiens
tgttataatttgcaca

SEQ ID NO: 2186057 - DNA, 14 bp, Homo sapiens
tgttcaaaatgtta

SEQ ID NO: 2186058 - DNA, 17 bp, Homo sapiens
tgttcaaaatgttaata

SEQ ID NO: 2186059 - DNA, 19 bp, Homo sapiens
tgttcaaaatgttaataaa

SEQ ID NO: 2186060 - DNA, 16 bp, Homo sapiens
tgttcaaatacttcaa

SEQ ID NO: 2186061 - DNA, 12 bp, Homo sapiens
tgttcactgtga

SEQ ID NO: 2186062 - DNA, 22 bp, Homo sapiens
tgttcagtaacagggccttgct

SEQ ID NO: 2186063 - DNA, 23 bp, Homo sapiens
tgttcatgttagttttgctcctt

SEQ ID NO: 2186064 - DNA, 18 bp, Homo sapiens
tgttccatcctgtacaag

SEQ ID NO: 2186065 - DNA, 15 bp, Homo sapiens
tgttccttttattta

SEQ ID NO: 2186066 - DNA, 14 bp, Homo sapiens
tgttcttttctggt

SEQ ID NO: 2186067 - DNA, 22 bp, Homo sapiens
tgttgatacacaggtgagaaag

SEQ ID NO: 2186068 - DNA, 18 bp, Homo sapiens
tgttgcaaattccacccc

SEQ ID NO: 2186069 - DNA, 21 bp, Homo sapiens
tgttgctgttgttgttaattt

SEQ ID NO: 2186070 - DNA, 17 bp, Homo sapiens
tgttgttcagaagttgt

SEQ ID NO: 2186071 - DNA, 14 bp, Homo sapiens
tgtttccctgctga

SEQ ID NO: 2186072 - DNA, 22 bp, Homo sapiens
tgtttctgagacggagtctcag

SEQ ID NO: 2186073 - DNA, 23 bp, Homo sapiens
tgtttcttgggaaaatatcactt

SEQ ID NO: 2186074 - DNA, 18 bp, Homo sapiens
tgtttgagattctcaaag

SEQ ID NO: 2186075 - DNA, 16 bp, Homo sapiens
tgtttgatgtgtatgt

SEQ ID NO: 2186076 - DNA, 18 bp, Homo sapiens
tgtttgatgtgtatgtgt

SEQ ID NO: 2186077 - DNA, 16 bp, Homo sapiens
tgtttgtatataaatg

SEQ ID NO: 2186078 - DNA, 20 bp, Homo sapiens
tgttttgatgagaaaaaact

SEQ ID NO: 2186079 - DNA, 13 bp, Homo sapiens
tgttttgtgactt

SEQ ID NO: 2186080 - DNA, 18 bp, Homo sapiens
tgtttttaagaaaaacat

SEQ ID NO: 2186081 - DNA, 23 bp, Homo sapiens
tgtttttaagaaaaacatgtcat

SEQ ID NO: 2186082 - DNA, 15 bp, Homo sapiens
tgtttttatagaagt

SEQ ID NO: 2186083 - DNA, 10 bp, Homo sapiens
tgtttttggg

SEQ ID NO: 2186084 - DNA, 16 bp, Homo sapiens
tgtttttggtttctta

SEQ ID NO: 2186085 - DNA, 15 bp, Homo sapiens
tgttttttttttaaa

SEQ ID NO: 2186086 - DNA, 14 bp, Homo sapiens
ttaaaaaaaaacat

SEQ ID NO: 2186087 - DNA, 18 bp, Homo sapiens
ttaaaaaagacatttaaa

SEQ ID NO: 2186088 - DNA, 14 bp, Homo sapiens
ttaaaaacacctaa

SEQ ID NO: 2186089 - DNA, 17 bp, Homo sapiens
ttaaaaagctaatgaca

SEQ ID NO: 2186090 - DNA, 12 bp, Homo sapiens
ttaaaaatgtat

SEQ ID NO: 2186091 - DNA, 21 bp, Homo sapiens
cagcatttcggtgcttccctt

SEQ ID NO: 2186092 - DNA, 13 bp, Homo sapiens
cagccacagaccc

SEQ ID NO: 2186093 - DNA, 18 bp, Homo sapiens
cagccacttccccctctt

SEQ ID NO: 2186094 - DNA, 20 bp, Homo sapiens
cagccagtaaggcagctctg

SEQ ID NO: 2186095 - DNA, 23 bp, Homo sapiens
cagccagtaaggcagctctgtcg

SEQ ID NO: 2186096 - DNA, 14 bp, Homo sapiens
cagcccagcccagc

SEQ ID NO: 2186097 - DNA, 11 bp, Homo sapiens
cagcccagctg

SEQ ID NO: 2186098 - DNA, 19 bp, Homo sapiens
cagcccagctgctctgccc

SEQ ID NO: 2186099 - DNA, 21 bp, Homo sapiens
cagcccagctgctctgcccag

SEQ ID NO: 2186100 - DNA, 14 bp, Homo sapiens
cagcccatcttgcc

SEQ ID NO: 2186101 - DNA, 18 bp, Homo sapiens
cagcccatcttgcctcca

SEQ ID NO: 2186102 - DNA, 13 bp, Homo sapiens
cagccccagccca

SEQ ID NO: 2186103 - DNA, 14 bp, Homo sapiens
cagccccagcccag

SEQ ID NO: 2186104 - DNA, 21 bp, Homo sapiens
cagccccagcccagcccagct

SEQ ID NO: 2186105 - DNA, 12 bp, Homo sapiens
cagccctaggct

SEQ ID NO: 2186106 - DNA, 23 bp, Homo sapiens
cagccctgagctggcgtcacctg

SEQ ID NO: 2186107 - DNA, 23 bp, Homo sapiens
cagccctgagttggcatcacctg

SEQ ID NO: 2186108 - DNA, 17 bp, Homo sapiens
cagccggatcttggaga

SEQ ID NO: 2186109 - DNA, 22 bp, Homo sapiens
cagccggatcttggagacaatt

SEQ ID NO: 2186110 - DNA, 14 bp, Homo sapiens
cagccggggaagac

SEQ ID NO: 2186111 - DNA, 16 bp, Homo sapiens
cagccggggcctgcct

SEQ ID NO: 2186112 - DNA, 17 bp, Homo sapiens
cagccggggcctgccta

SEQ ID NO: 2186113 - DNA, 18 bp, Homo sapiens
cagccggggcctgcctag

SEQ ID NO: 2186114 - DNA, 19 bp, Homo sapiens
cagccggggcctgcctagc

SEQ ID NO: 2186115 - DNA, 17 bp, Homo sapiens
cagccgtgctgagcaca

SEQ ID NO: 2186116 - DNA, 20 bp, Homo sapiens
cagcctcaacctccctggct

SEQ ID NO: 2186117 - DNA, 21 bp, Homo sapiens
cagcctcaacctccctggctc

SEQ ID NO: 2186118 - DNA, 12 bp, Homo sapiens
cagcctcccgag

SEQ ID NO: 2186119 - DNA, 15 bp, Homo sapiens
cagcctcctgagtag

SEQ ID NO: 2186120 - DNA, 17 bp, Homo sapiens
cagcctcgaactcctgg

SEQ ID NO: 2186121 - DNA, 23 bp, Homo sapiens
cagcctcgaactcctgggctcaa

SEQ ID NO: 2186122 - DNA, 19 bp, Homo sapiens
cagcctctagggacccctc

SEQ ID NO: 2186123 - DNA, 20 bp, Homo sapiens
cagcctctagggacccctcc

SEQ ID NO: 2186124 - DNA, 21 bp, Homo sapiens
cagcctctagggacccctcct

SEQ ID NO: 2186125 - DNA, 14 bp, Homo sapiens
cagcctctggccag

SEQ ID NO: 2186126 - DNA, 15 bp, Homo sapiens
cagcctgtcttcaga

SEQ ID NO: 2186127 - DNA, 22 bp, Homo sapiens
cagcctgtcttcagatcctgct

SEQ ID NO: 2186128 - DNA, 19 bp, Homo sapiens
catgcagttattagaactt

SEQ ID NO: 2186129 - DNA, 22 bp, Homo sapiens
catgctacctgatcccactcct

SEQ ID NO: 2186130 - DNA, 19 bp, Homo sapiens
catgctgctatgaagacta

SEQ ID NO: 2186131 - DNA, 14 bp, Homo sapiens
catgctgctttgca

SEQ ID NO: 2186132 - DNA, 15 bp, Homo sapiens
catgctgctttgcac

SEQ ID NO: 2186133 - DNA, 21 bp, Homo sapiens
catgcttaagggggtgtaatg

SEQ ID NO: 2186134 - DNA, 19 bp, Homo sapiens
catggaaaaatcctgtcat

SEQ ID NO: 2186135 - DNA, 18 bp, Homo sapiens
catggaagagggagggtc

SEQ ID NO: 2186136 - DNA, 14 bp, Homo sapiens
catggaagggaaga

SEQ ID NO: 2186137 - DNA, 16 bp, Homo sapiens
catggatttgatgaaa

SEQ ID NO: 2186138 - DNA, 22 bp, Homo sapiens
catggctaaggcaccagccggg

SEQ ID NO: 2186139 - DNA, 17 bp, Homo sapiens
catggctcaaggattca

SEQ ID NO: 2186140 - DNA, 16 bp, Homo sapiens
catgggtagcttctga

SEQ ID NO: 2186141 - DNA, 19 bp, Homo sapiens
catgggtagcttctgacct

SEQ ID NO: 2186142 - DNA, 22 bp, Homo sapiens
catgggtagcttctgacctcag

SEQ ID NO: 2186143 - DNA, 22 bp, Homo sapiens
catggtagcagggtctttgtgt

SEQ ID NO: 2186144 - DNA, 14 bp, Homo sapiens
catggtcacagaga

SEQ ID NO: 2186145 - DNA, 14 bp, Homo sapiens
catggtgcctctgg

SEQ ID NO: 2186146 - DNA, 15 bp, Homo sapiens
catggtgcctctgga

SEQ ID NO: 2186147 - DNA, 18 bp, Homo sapiens
catgtagaagagggagaa

SEQ ID NO: 2186148 - DNA, 16 bp, Homo sapiens
catgtagccacccaac

SEQ ID NO: 2186149 - DNA, 17 bp, Homo sapiens
catgtagccacccaact

SEQ ID NO: 2186150 - DNA, 22 bp, Homo sapiens
catgtaggttgtctaaaaataa

SEQ ID NO: 2186151 - DNA, 22 bp, Homo sapiens
catgtcatgtaggttgtctaaa

SEQ ID NO: 2186152 - DNA, 20 bp, Homo sapiens
catgtgtgctcttcttcttt

SEQ ID NO: 2186153 - DNA, 21 bp, Homo sapiens
catgtgtgtatcaccctcagc

SEQ ID NO: 2186154 - DNA, 15 bp, Homo sapiens
catgttacgtgtgca

SEQ ID NO: 2186155 - DNA, 19 bp, Homo sapiens
catgttacgtgtgcaacag

SEQ ID NO: 2186156 - DNA, 20 bp, Homo sapiens
catgttttgatgagaaaaaa

SEQ ID NO: 2186157 - DNA, 15 bp, Homo sapiens
cattaacacttttta

SEQ ID NO: 2186158 - DNA, 21 bp, Homo sapiens
cattaatgtagataaagcact

SEQ ID NO: 2186159 - DNA, 22 bp, Homo sapiens
cattacagtgtaaaaattcaga

SEQ ID NO: 2186160 - DNA, 14 bp, Homo sapiens
cattataattttga

SEQ ID NO: 2186161 - DNA, 19 bp, Homo sapiens
cattattggacttccattt

SEQ ID NO: 2186162 - DNA, 12 bp, Homo sapiens
cattcaggaacc

SEQ ID NO: 2186163 - DNA, 16 bp, Homo sapiens
cattcagtgagacaca

SEQ ID NO: 2186164 - DNA, 15 bp, Homo sapiens
cattccaaatcatac

SEQ ID NO: 2186165 - DNA, 18 bp, Homo sapiens
cattccctacaattcaca

SEQ ID NO: 2186166 - DNA, 21 bp, Homo sapiens
cattcctgatggaattgttat

SEQ ID NO: 2186167 - DNA, 17 bp, Homo sapiens
cattctaaaccaaaaca

SEQ ID NO: 2186168 - DNA, 17 bp, Homo sapiens
cattcttctctcccaca

SEQ ID NO: 2186169 - DNA, 21 bp, Homo sapiens
cattgaaacttgagtttgttt

SEQ ID NO: 2186170 - DNA, 19 bp, Homo sapiens
cattgaaatgtaatttcag

SEQ ID NO: 2186171 - DNA, 19 bp, Homo sapiens
cattgaatctgtatggcta

SEQ ID NO: 2186172 - DNA, 17 bp, Homo sapiens
cattgaccttaatttct

SEQ ID NO: 2186173 - DNA, 18 bp, Homo sapiens
cattgcaaaaatatttta

SEQ ID NO: 2186174 - DNA, 18 bp, Homo sapiens
catttaaactcatttgag

SEQ ID NO: 2186175 - DNA, 14 bp, Homo sapiens
catttatctttgta

SEQ ID NO: 2186176 - DNA, 19 bp, Homo sapiens
catttatttccatattaaa

SEQ ID NO: 2186177 - DNA, 20 bp, Homo sapiens
catttatttccatattaaaa

SEQ ID NO: 2186178 - DNA, 20 bp, Homo sapiens
catttatttttaaaataatt

SEQ ID NO: 2186179 - DNA, 16 bp, Homo sapiens
catttcacagaaaaca

SEQ ID NO: 2186180 - DNA, 21 bp, Homo sapiens
catttcagaagttagtttgta

SEQ ID NO: 2186181 - DNA, 23 bp, Homo sapiens
catttcagaagttagtttgtata

SEQ ID NO: 2186182 - DNA, 15 bp, Homo sapiens
catttcatataaatg

SEQ ID NO: 2186183 - DNA, 20 bp, Homo sapiens
catttcatctactacagggt

SEQ ID NO: 2186184 - DNA, 16 bp, Homo sapiens
catttcccctcccgtc

SEQ ID NO: 2186185 - DNA, 21 bp, Homo sapiens
catttcggtgcttccctttca

SEQ ID NO: 2186186 - DNA, 16 bp, Homo sapiens
catttctcaaagtttt

SEQ ID NO: 2186187 - DNA, 20 bp, Homo sapiens
catttctcaaagtttttaca

SEQ ID NO: 2186188 - DNA, 12 bp, Homo sapiens
catttcttccca

SEQ ID NO: 2186189 - DNA, 20 bp, Homo sapiens
catttgcttgtactgggaca

SEQ ID NO: 2186190 - DNA, 17 bp, Homo sapiens
catttgggactgtcttg

SEQ ID NO: 2186191 - DNA, 15 bp, Homo sapiens
catttgtcctgcaga

SEQ ID NO: 2186192 - DNA, 18 bp, Homo sapiens
catttgtcctgcagagct

SEQ ID NO: 2186193 - DNA, 21 bp, Homo sapiens
catttgtcctgcagagctggg

SEQ ID NO: 2186194 - DNA, 18 bp, Homo sapiens
cattttacgttttagaaa

SEQ ID NO: 2186195 - DNA, 19 bp, Homo sapiens
cattttagaattaaaattt

SEQ ID NO: 2186196 - DNA, 22 bp, Homo sapiens
cattttatcaggggaatttcag

SEQ ID NO: 2186197 - DNA, 22 bp, Homo sapiens
cattttcaacattgatttttga

SEQ ID NO: 2186198 - DNA, 13 bp, Homo sapiens
cattttgtatgta

SEQ ID NO: 2186199 - DNA, 13 bp, Homo sapiens
cattttgtgtctt

SEQ ID NO: 2186200 - DNA, 21 bp, Homo sapiens
cattttgtgtcttaagaaaaa

SEQ ID NO: 2186201 - DNA, 13 bp, Homo sapiens
catttttaagaat

SEQ ID NO: 2186202 - DNA, 13 bp, Homo sapiens
catttttaatgag

SEQ ID NO: 2186203 - DNA, 22 bp, Homo sapiens
catttttcaataaagtactgca

SEQ ID NO: 2186204 - DNA, 17 bp, Homo sapiens
catttttcaatagcaca

SEQ ID NO: 2186205 - DNA, 22 bp, Homo sapiens
catttttgtttctacctcccag

SEQ ID NO: 2186206 - DNA, 23 bp, Homo sapiens
catttttgtttttggtttcttat

SEQ ID NO: 2186207 - DNA, 23 bp, Homo sapiens
ccaaaaacaaagtgcaaagctgc

SEQ ID NO: 2186208 - DNA, 20 bp, Homo sapiens
ccaaaccctgtcctcccacc

SEQ ID NO: 2186209 - DNA, 14 bp, Homo sapiens
ccaaacctagcccc

SEQ ID NO: 2186210 - DNA, 16 bp, Homo sapiens
ccaaagacctcccaag

SEQ ID NO: 2186211 - DNA, 12 bp, Homo sapiens
ccaaagagctgc

SEQ ID NO: 2186212 - DNA, 11 bp, Homo sapiens
ccaacaggcac

SEQ ID NO: 2186213 - DNA, 20 bp, Homo sapiens
ccaactgtttccctgctgaa

SEQ ID NO: 2186214 - DNA, 11 bp, Homo sapiens
ccaagaaaaat

SEQ ID NO: 2186215 - DNA, 15 bp, Homo sapiens
ccaagaactctgggc

SEQ ID NO: 2186216 - DNA, 15 bp, Homo sapiens
ccaagacctgactca

SEQ ID NO: 2186217 - DNA, 23 bp, Homo sapiens
ccaagcatttaatgtagccatgg

SEQ ID NO: 2186218 - DNA, 13 bp, Homo sapiens
ccaagcctggtct

SEQ ID NO: 2186219 - DNA, 11 bp, Homo sapiens
ccaagccttgg

SEQ ID NO: 2186220 - DNA, 20 bp, Homo sapiens
ccaaggcctatgccacctgc

SEQ ID NO: 2186221 - DNA, 16 bp, Homo sapiens
ccaagggccctggcac

SEQ ID NO: 2186222 - DNA, 12 bp, Homo sapiens
ccaagtcccacc

SEQ ID NO: 2186223 - DNA, 13 bp, Homo sapiens
ccaagtcttcctg

SEQ ID NO: 2186224 - DNA, 13 bp, Homo sapiens
ccaatacattatt

SEQ ID NO: 2186225 - DNA, 19 bp, Homo sapiens
ccaatcactgagtttgtgg

SEQ ID NO: 2186226 - DNA, 15 bp, Homo sapiens
ccaatgcttctgcat

SEQ ID NO: 2186227 - DNA, 23 bp, Homo sapiens
ccaatggagtagacccctggctg

SEQ ID NO: 2186228 - DNA, 17 bp, Homo sapiens
ccaattcatttcatcta

SEQ ID NO: 2186229 - DNA, 12 bp, Homo sapiens
ccaattccttgt

SEQ ID NO: 2186230 - DNA, 19 bp, Homo sapiens
ccacaaaaagagaagctgt

SEQ ID NO: 2186231 - DNA, 16 bp, Homo sapiens
ccacaagctgtccctg

SEQ ID NO: 2186232 - DNA, 20 bp, Homo sapiens
ccacacaacaccaggactta

SEQ ID NO: 2186233 - DNA, 13 bp, Homo sapiens
ccacacccccacc

SEQ ID NO: 2186234 - DNA, 15 bp, Homo sapiens
ccacacccccacccc

SEQ ID NO: 2186235 - DNA, 14 bp, Homo sapiens
ccacactgcaacag

SEQ ID NO: 2186236 - DNA, 18 bp, Homo sapiens
ccacagaaaccctgtttt

SEQ ID NO: 2186237 - DNA, 16 bp, Homo sapiens
ccacagacccctggga

SEQ ID NO: 2186238 - DNA, 18 bp, Homo sapiens
ccacagacccctgggagc

SEQ ID NO: 2186239 - DNA, 20 bp, Homo sapiens
ccacagccatcccagccttg

SEQ ID NO: 2186240 - DNA, 23 bp, Homo sapiens
ccacaggaagccgcctagtgcag

SEQ ID NO: 2186241 - DNA, 11 bp, Homo sapiens
ccacagggcct

SEQ ID NO: 2186242 - DNA, 21 bp, Homo sapiens
ccacaggtgtccccagcccac

SEQ ID NO: 2186243 - DNA, 22 bp, Homo sapiens
ccacatccaacatttcctcagg

SEQ ID NO: 2186244 - DNA, 23 bp, Homo sapiens
ccacatccaacatttcctcaggc

SEQ ID NO: 2186245 - DNA, 21 bp, Homo sapiens
ccacatccccgctggctgggg

SEQ ID NO: 2186246 - DNA, 23 bp, Homo sapiens
ccacatttgctgctacttttcct

SEQ ID NO: 2186247 - DNA, 15 bp, Homo sapiens
ccaccaagggcctca

SEQ ID NO: 2186248 - DNA, 15 bp, Homo sapiens
ccaccaatcctcacc

SEQ ID NO: 2186249 - DNA, 17 bp, Homo sapiens
ccaccaatcctcaccta

SEQ ID NO: 2186250 - DNA, 19 bp, Homo sapiens
ccaccacaaaaagagaagc

SEQ ID NO: 2186251 - DNA, 14 bp, Homo sapiens
ccaccacactcagc

SEQ ID NO: 2186252 - DNA, 16 bp, Homo sapiens
ccaccaccccccactc

SEQ ID NO: 2186253 - DNA, 16 bp, Homo sapiens
ccaccccttggaggag

SEQ ID NO: 2186254 - DNA, 20 bp, Homo sapiens
ccaccccttggaggagagag

SEQ ID NO: 2186255 - DNA, 15 bp, Homo sapiens
ccacccgtcttcaat

SEQ ID NO: 2186256 - DNA, 21 bp, Homo sapiens
ccacccgtcttcaatctctgt

SEQ ID NO: 2186257 - DNA, 20 bp, Homo sapiens
ccacccgtttccaagcctgg

SEQ ID NO: 2186258 - DNA, 18 bp, Homo sapiens
ccaccctctgcagggcag

SEQ ID NO: 2186259 - DNA, 20 bp, Homo sapiens
ccaccctctgcagggcagcc

SEQ ID NO: 2186260 - DNA, 13 bp, Homo sapiens
ccaccctgagccg

SEQ ID NO: 2186261 - DNA, 22 bp, Homo sapiens
ccaccctgagccggccccaggc

SEQ ID NO: 2186262 - DNA, 21 bp, Homo sapiens
ccaccctgccccccctaagag

SEQ ID NO: 2186263 - DNA, 18 bp, Homo sapiens
ccaccggttgcttctggg

SEQ ID NO: 2186264 - DNA, 23 bp, Homo sapiens
ccacctaagggctaaggcctctt

SEQ ID NO: 2186265 - DNA, 18 bp, Homo sapiens
ccacctctggccctgttg

SEQ ID NO: 2186266 - DNA, 20 bp, Homo sapiens
ccacctgagctttggacaca

SEQ ID NO: 2186267 - DNA, 15 bp, Homo sapiens
ccacctgcagcgtct

SEQ ID NO: 2186268 - DNA, 13 bp, Homo sapiens
ccacctgcatcag

SEQ ID NO: 2186269 - DNA, 15 bp, Homo sapiens
ccacctgcatcagcc

SEQ ID NO: 2186270 - DNA, 21 bp, Homo sapiens
ccacctgcatcagcctctggc

SEQ ID NO: 2186271 - DNA, 20 bp, Homo sapiens
ccacctgccactaggctggg

SEQ ID NO: 2186272 - DNA, 12 bp, Homo sapiens
ccacctgtccca

SEQ ID NO: 2186273 - DNA, 14 bp, Homo sapiens
ccacctgtcccacc

SEQ ID NO: 2186274 - DNA, 16 bp, Homo sapiens
ccacctgtcccacctc

SEQ ID NO: 2186275 - DNA, 22 bp, Homo sapiens
ccaccttaccctactggctgta

SEQ ID NO: 2186276 - DNA, 21 bp, Homo sapiens
ccaccttgcactattggactt

SEQ ID NO: 2186277 - DNA, 17 bp, Homo sapiens
ccacgggggaggccgag

SEQ ID NO: 2186278 - DNA, 23 bp, Homo sapiens
ccacgggggaggccgaggcaggg

SEQ ID NO: 2186279 - DNA, 11 bp, Homo sapiens
ccactaactag

SEQ ID NO: 2186280 - DNA, 22 bp, Homo sapiens
ccactaactagagcagccctgg

SEQ ID NO: 2186281 - DNA, 11 bp, Homo sapiens
ccactcagcat

SEQ ID NO: 2186282 - DNA, 23 bp, Homo sapiens
ccactccggattccggccctggc

SEQ ID NO: 2186283 - DNA, 19 bp, Homo sapiens
ccactgcaaataaagcctt

SEQ ID NO: 2186284 - DNA, 13 bp, Homo sapiens
ccactgcagtcac

SEQ ID NO: 2186285 - DNA, 14 bp, Homo sapiens
ccactgccctctgt

SEQ ID NO: 2186286 - DNA, 17 bp, Homo sapiens
ccactggatcagaaaga

SEQ ID NO: 2186287 - DNA, 15 bp, Homo sapiens
ccactggcatctctg

SEQ ID NO: 2186288 - DNA, 13 bp, Homo sapiens
ccacttatttcta

SEQ ID NO: 2186289 - DNA, 14 bp, Homo sapiens
ccacttatttctaa

SEQ ID NO: 2186290 - DNA, 14 bp, Homo sapiens
ccacttccctgggc

SEQ ID NO: 2186291 - DNA, 23 bp, Homo sapiens
ccactttgcagacctgggacttt

SEQ ID NO: 2186292 - DNA, 14 bp, Homo sapiens
ccagaaccccgagc

SEQ ID NO: 2186293 - DNA, 23 bp, Homo sapiens
ccagaagatgtattcagagccac

SEQ ID NO: 2186294 - DNA, 18 bp, Homo sapiens
ccagagcaaagggccagg

SEQ ID NO: 2186295 - DNA, 16 bp, Homo sapiens
ccagagctctggagcc

SEQ ID NO: 2186296 - DNA, 15 bp, Homo sapiens
ccagagctgggtgag

SEQ ID NO: 2186297 - DNA, 23 bp, Homo sapiens
ccagaggaggggtggtgtccttc

SEQ ID NO: 2186298 - DNA, 17 bp, Homo sapiens
ccagaggcacagccggg

SEQ ID NO: 2186299 - DNA, 21 bp, Homo sapiens
ccagaggcacagccggggcct

SEQ ID NO: 2186300 - DNA, 18 bp, Homo sapiens
ccagaggcagaaccctgg

SEQ ID NO: 2186301 - DNA, 15 bp, Homo sapiens
ccagaggccctggag

SEQ ID NO: 2186302 - DNA, 23 bp, Homo sapiens
ccagaggccctggaggtctccag

SEQ ID NO: 2186303 - DNA, 10 bp, Homo sapiens
ccagaggctc

SEQ ID NO: 2186304 - DNA, 18 bp, Homo sapiens
ccagaggctcctggagcc

SEQ ID NO: 2186305 - DNA, 19 bp, Homo sapiens
ccagaggctcctggagcca

SEQ ID NO: 2186306 - DNA, 20 bp, Homo sapiens
ccagaggtgggaggcccctg

SEQ ID NO: 2186307 - DNA, 13 bp, Homo sapiens
ccagaggtgggga

SEQ ID NO: 2186308 - DNA, 20 bp, Homo sapiens
ccagagtatgagtgcaagca

SEQ ID NO: 2186309 - DNA, 12 bp, Homo sapiens
ccagatcaaaat

SEQ ID NO: 2186310 - DNA, 19 bp, Homo sapiens
ccagatgcctcctctgtcc

SEQ ID NO: 2186311 - DNA, 15 bp, Homo sapiens
ccagattctcttgaa

SEQ ID NO: 2186312 - DNA, 20 bp, Homo sapiens
ccagcagagccgttcctggg

SEQ ID NO: 2186313 - DNA, 20 bp, Homo sapiens
ccagcagtgtttaaaaaatg

SEQ ID NO: 2186314 - DNA, 17 bp, Homo sapiens
ccagcagtttcccagaa

SEQ ID NO: 2186315 - DNA, 15 bp, Homo sapiens
ccagccacagacccc

SEQ ID NO: 2186316 - DNA, 15 bp, Homo sapiens
ccagcccagcccagc

SEQ ID NO: 2186317 - DNA, 18 bp, Homo sapiens
ccagcccagctgctctgc

SEQ ID NO: 2186318 - DNA, 23 bp, Homo sapiens
ccagcccagctgctctgcccaga

SEQ ID NO: 2186319 - DNA, 17 bp, Homo sapiens
ccagccctaggctaccc

SEQ ID NO: 2186320 - DNA, 18 bp, Homo sapiens
ccagccctaggctaccct

SEQ ID NO: 2186321 - DNA, 18 bp, Homo sapiens
ccagctcagtcttcccta

SEQ ID NO: 2186322 - DNA, 19 bp, Homo sapiens
ccagctgaaggcagtggca

SEQ ID NO: 2186323 - DNA, 22 bp, Homo sapiens
ccagctgctccgaggacccagg

SEQ ID NO: 2186324 - DNA, 12 bp, Homo sapiens
ccagctgctcct

SEQ ID NO: 2186325 - DNA, 15 bp, Homo sapiens
ccagctgctctgccc

SEQ ID NO: 2186326 - DNA, 17 bp, Homo sapiens
ccagctgctctgcccag

SEQ ID NO: 2186327 - DNA, 18 bp, Homo sapiens
ccagctgctctgcccaga

SEQ ID NO: 2186328 - DNA, 21 bp, Homo sapiens
ccagctgctctgcccagagct

SEQ ID NO: 2186329 - DNA, 22 bp, Homo sapiens
ccagctgctctgcccagagctg

SEQ ID NO: 2186330 - DNA, 23 bp, Homo sapiens
ccagctgctctgcccagagctgg

SEQ ID NO: 2186331 - DNA, 10 bp, Homo sapiens
ccagcttccc

SEQ ID NO: 2186332 - DNA, 15 bp, Homo sapiens
ccaggacagctgcag

SEQ ID NO: 2186333 - DNA, 18 bp, Homo sapiens
ccaggacagctgcaggtg

SEQ ID NO: 2186334 - DNA, 22 bp, Homo sapiens
ccaggacagctgcaggtgccca

SEQ ID NO: 2186335 - DNA, 19 bp, Homo sapiens
ccaggagcattttgtgtct

SEQ ID NO: 2186336 - DNA, 24 bp, Homo sapiens
ccaggctgcggtgggcagccatga

SEQ ID NO: 2186337 - DNA, 12 bp, Homo sapiens
ccaggctggtct

SEQ ID NO: 2186338 - DNA, 19 bp, Homo sapiens
ccagggcaccaagcccaca

SEQ ID NO: 2186339 - DNA, 17 bp, Homo sapiens
ccaggggaggagcctgt

SEQ ID NO: 2186340 - DNA, 13 bp, Homo sapiens
ccaggggcctgca

SEQ ID NO: 2186341 - DNA, 22 bp, Homo sapiens
ccagggtaggcaaggctgccgg

SEQ ID NO: 2186342 - DNA, 14 bp, Homo sapiens
ccagggtcctgtgc

SEQ ID NO: 2186343 - DNA, 15 bp, Homo sapiens
ccagggtcctgtgcc

SEQ ID NO: 2186344 - DNA, 21 bp, Homo sapiens
ccaggtaggatgaacacaggc

SEQ ID NO: 2186345 - DNA, 17 bp, Homo sapiens
ccaggtcgggctcagct

SEQ ID NO: 2186346 - DNA, 14 bp, Homo sapiens
ccaggttggaggcc

SEQ ID NO: 2186347 - DNA, 20 bp, Homo sapiens
ccagtaaggcagctctgtcg

SEQ ID NO: 2186348 - DNA, 17 bp, Homo sapiens
ccagtatcctgaaacag

SEQ ID NO: 2186349 - DNA, 13 bp, Homo sapiens
ccagtcctgctct

SEQ ID NO: 2186350 - DNA, 15 bp, Homo sapiens
ccagtctgaacctga

SEQ ID NO: 2186351 - DNA, 19 bp, Homo sapiens
ccagtgatggcattactct

SEQ ID NO: 2186352 - DNA, 16 bp, Homo sapiens
ccagtggcctggctcc

SEQ ID NO: 2186353 - DNA, 16 bp, Homo sapiens
ccagttctctttgtaa

SEQ ID NO: 2186354 - DNA, 21 bp, Homo sapiens
ccagttgacatccaggatggc

SEQ ID NO: 2186355 - DNA, 20 bp, Homo sapiens
ccagtttcttaaactgaaag

SEQ ID NO: 2186356 - DNA, 23 bp, Homo sapiens
ccataaaatctcacgctgccatt

SEQ ID NO: 2186357 - DNA, 16 bp, Homo sapiens
ccatactctgtctccc

SEQ ID NO: 2186358 - DNA, 12 bp, Homo sapiens
ccatagaacaga

SEQ ID NO: 2186359 - DNA, 19 bp, Homo sapiens
ccatagctcctgctccaca

SEQ ID NO: 2186360 - DNA, 19 bp, Homo sapiens
ccatagctggtttttccca

SEQ ID NO: 2186361 - DNA, 21 bp, Homo sapiens
ccatatccatgttgctgactt

SEQ ID NO: 2186362 - DNA, 14 bp, Homo sapiens
ccatattaaaatca

SEQ ID NO: 2186363 - DNA, 14 bp, Homo sapiens
ccatcagcagtgat

SEQ ID NO: 2186364 - DNA, 15 bp, Homo sapiens
ccatcagcagtgatt

SEQ ID NO: 2186365 - DNA, 15 bp, Homo sapiens
ccatcccagccttgg

SEQ ID NO: 2186366 - DNA, 17 bp, Homo sapiens
ccatcctgtcccaccat

SEQ ID NO: 2186367 - DNA, 12 bp, Homo sapiens
ccatctggaaat

SEQ ID NO: 2186368 - DNA, 20 bp, Homo sapiens
ccatctggaaatccagctgg

SEQ ID NO: 2186369 - DNA, 13 bp, Homo sapiens
ccatcttgcctcc

SEQ ID NO: 2186370 - DNA, 14 bp, Homo sapiens
ccatcttggccagg

SEQ ID NO: 2186371 - DNA, 17 bp, Homo sapiens
ccatgatccattccctt

SEQ ID NO: 2186372 - DNA, 16 bp, Homo sapiens
ccatgattttggccac

SEQ ID NO: 2186373 - DNA, 17 bp, Homo sapiens
ccatgattttggccact

SEQ ID NO: 2186374 - DNA, 23 bp, Homo sapiens
ccatgattttggccactttgcag

SEQ ID NO: 2186375 - DNA, 17 bp, Homo sapiens
ccatgctgctatgaaga

SEQ ID NO: 2186376 - DNA, 16 bp, Homo sapiens
ccatggtagactgtga

SEQ ID NO: 2186377 - DNA, 17 bp, Homo sapiens
cagggttttatctctgt

SEQ ID NO: 2186378 - DNA, 16 bp, Homo sapiens
cagggttttttggcct

SEQ ID NO: 2186379 - DNA, 21 bp, Homo sapiens
caggtaggatgaacacaggca

SEQ ID NO: 2186380 - DNA, 20 bp, Homo sapiens
caggtcattttttttttctg

SEQ ID NO: 2186381 - DNA, 19 bp, Homo sapiens
caggtcgggctcagctctg

SEQ ID NO: 2186382 - DNA, 22 bp, Homo sapiens
caggtcgggctcagctctggct

SEQ ID NO: 2186383 - DNA, 13 bp, Homo sapiens
caggtgagaaagg

SEQ ID NO: 2186384 - DNA, 15 bp, Homo sapiens
caggtgtccccagcc

SEQ ID NO: 2186385 - DNA, 14 bp, Homo sapiens
caggttccccaagg

SEQ ID NO: 2186386 - DNA, 20 bp, Homo sapiens
caggttctggttagctcagc

SEQ ID NO: 2186387 - DNA, 18 bp, Homo sapiens
cagtaacagggccttgct

SEQ ID NO: 2186388 - DNA, 21 bp, Homo sapiens
cagtaagaccggaagctcctg

SEQ ID NO: 2186389 - DNA, 23 bp, Homo sapiens
cagtaagaccggaagctcctggt

SEQ ID NO: 2186390 - DNA, 12 bp, Homo sapiens
cagtaaggcagc

SEQ ID NO: 2186391 - DNA, 14 bp, Homo sapiens
cagtaatagctgaa

SEQ ID NO: 2186392 - DNA, 17 bp, Homo sapiens
cagtaatagctgaacct

SEQ ID NO: 2186393 - DNA, 15 bp, Homo sapiens
cagtacaatcagcag

SEQ ID NO: 2186394 - DNA, 13 bp, Homo sapiens
cagtacccacctg

SEQ ID NO: 2186395 - DNA, 14 bp, Homo sapiens
cagtacccacctga

SEQ ID NO: 2186396 - DNA, 16 bp, Homo sapiens
cagtacccacctgagc

SEQ ID NO: 2186397 - DNA, 18 bp, Homo sapiens
cagtagttactgctgttt

SEQ ID NO: 2186398 - DNA, 11 bp, Homo sapiens
cagtatgtgtc

SEQ ID NO: 2186399 - DNA, 16 bp, Homo sapiens
cagtattgtgtaaagg

SEQ ID NO: 2186400 - DNA, 15 bp, Homo sapiens
cagtcacccctgtct

SEQ ID NO: 2186401 - DNA, 15 bp, Homo sapiens
cagtcaccctgtggc

SEQ ID NO: 2186402 - DNA, 16 bp, Homo sapiens
cagtccgctcttccaa

SEQ ID NO: 2186403 - DNA, 14 bp, Homo sapiens
cagtcctgctctct

SEQ ID NO: 2186404 - DNA, 17 bp, Homo sapiens
cagtctctccctggggt

SEQ ID NO: 2186405 - DNA, 23 bp, Homo sapiens
cagtcttccctagggctgggtgt

SEQ ID NO: 2186406 - DNA, 16 bp, Homo sapiens
cagtcttgtactgtga

SEQ ID NO: 2186407 - DNA, 16 bp, Homo sapiens
ccatggtgcctctgga

SEQ ID NO: 2186408 - DNA, 16 bp, Homo sapiens
ccatgtagccacccaa

SEQ ID NO: 2186409 - DNA, 22 bp, Homo sapiens
ccatgtccaaacccatcttcat

SEQ ID NO: 2186410 - DNA, 23 bp, Homo sapiens
ccattaatgtagataaagcactg

SEQ ID NO: 2186411 - DNA, 16 bp, Homo sapiens
cgggcaggtgaccgcc

SEQ ID NO: 2186412 - DNA, 22 bp, Homo sapiens
cgggcggaggggatccagccac

SEQ ID NO: 2186413 - DNA, 15 bp, Homo sapiens
cgggctctcctgccc

SEQ ID NO: 2186414 - DNA, 12 bp, Homo sapiens
cgggctggagaa

SEQ ID NO: 2186415 - DNA, 15 bp, Homo sapiens
cgggctggagaaaga

SEQ ID NO: 2186416 - DNA, 18 bp, Homo sapiens
cgggctggagaaagagct

SEQ ID NO: 2186417 - DNA, 22 bp, Homo sapiens
cgggctggagaaagagctgcct

SEQ ID NO: 2186418 - DNA, 12 bp, Homo sapiens
cggggagtgaga

SEQ ID NO: 2186419 - DNA, 14 bp, Homo sapiens
cggggccagaggca

SEQ ID NO: 2186420 - DNA, 15 bp, Homo sapiens
cggggctcagccctg

SEQ ID NO: 2186421 - DNA, 22 bp, Homo sapiens
cggggcttcaccatcttggcca

SEQ ID NO: 2186422 - DNA, 18 bp, Homo sapiens
cgggggaggccgaggcag

SEQ ID NO: 2186423 - DNA, 16 bp, Homo sapiens
cgggtctagtggaaag

SEQ ID NO: 2186424 - DNA, 23 bp, Homo sapiens
cggtcaataattgtggagaggag

SEQ ID NO: 2186425 - DNA, 23 bp, Homo sapiens
cggtgcagcggtggaaggagcct

SEQ ID NO: 2186426 - DNA, 12 bp, Homo sapiens
cggtgcccacct

SEQ ID NO: 2186427 - DNA, 22 bp, Homo sapiens
cggtggctaaaggtcccaaggc

SEQ ID NO: 2186428 - DNA, 16 bp, Homo sapiens
cggttcaggtcagggc

SEQ ID NO: 2186429 - DNA, 16 bp, Homo sapiens
cgtagagaatgtgtgt

SEQ ID NO: 2186430 - DNA, 16 bp, Homo sapiens
cgtatcacctttccca

SEQ ID NO: 2186431 - DNA, 15 bp, Homo sapiens
cgtattgtgaaattt

SEQ ID NO: 2186432 - DNA, 22 bp, Homo sapiens
cgtccacccgtttccaagcctg

SEQ ID NO: 2186433 - DNA, 19 bp, Homo sapiens
cgtcccagctgaaggcagt

SEQ ID NO: 2186434 - DNA, 22 bp, Homo sapiens
cgtctgagcggccgcctgtcct

SEQ ID NO: 2186435 - DNA, 17 bp, Homo sapiens
cgtcttcaatctctgtt

SEQ ID NO: 2186436 - DNA, 13 bp, Homo sapiens
cgtcttcctcctc

SEQ ID NO: 2186437 - DNA, 18 bp, Homo sapiens
cgtgagagaaagagagaa

SEQ ID NO: 2186438 - DNA, 21 bp, Homo sapiens
cgtgagagaaagagagaagcc

SEQ ID NO: 2186439 - DNA, 22 bp, Homo sapiens
cgtgaggggcaagctaggcccc

SEQ ID NO: 2186440 - DNA, 10 bp, Homo sapiens
cgtgccctct

SEQ ID NO: 2186441 - DNA, 12 bp, Homo sapiens
cgtgccctctgt

SEQ ID NO: 2186442 - DNA, 15 bp, Homo sapiens
cgtggactgagtggg

SEQ ID NO: 2186443 - DNA, 12 bp, Homo sapiens
cgtggagccaca

SEQ ID NO: 2186444 - DNA, 13 bp, Homo sapiens
cgtggagccacag

SEQ ID NO: 2186445 - DNA, 17 bp, Homo sapiens
cgtggagccacaggcag

SEQ ID NO: 2186446 - DNA, 18 bp, Homo sapiens
cgtggagccacaggcaga

SEQ ID NO: 2186447 - DNA, 20 bp, Homo sapiens
cgtggagccacaggcagacg

SEQ ID NO: 2186448 - DNA, 19 bp, Homo sapiens
cgtggcctcgtgaggggca

SEQ ID NO: 2186449 - DNA, 23 bp, Homo sapiens
cgtggcctcgtgaggggcaagct

SEQ ID NO: 2186450 - DNA, 11 bp, Homo sapiens
cgtgggctctg

SEQ ID NO: 2186451 - DNA, 15 bp, Homo sapiens
cgtgtgatgtatgtt

SEQ ID NO: 2186452 - DNA, 20 bp, Homo sapiens
cgttaacacatggcttccta

SEQ ID NO: 2186453 - DNA, 16 bp, Homo sapiens
cgttatctcattgcaa

SEQ ID NO: 2186454 - DNA, 20 bp, Homo sapiens
cgttgcatccacaggattcc

SEQ ID NO: 2186455 - DNA, 13 bp, Homo sapiens
cgttgtgggcagg

SEQ ID NO: 2186456 - DNA, 15 bp, Homo sapiens
ctaaaaagatgtaat

SEQ ID NO: 2186457 - DNA, 22 bp, Homo sapiens
ctaaaaataaaatgcatttaaa

SEQ ID NO: 2186458 - DNA, 18 bp, Homo sapiens
ctaaaaatagtggccaga

SEQ ID NO: 2186459 - DNA, 18 bp, Homo sapiens
ctaaaatacttgagaaat

SEQ ID NO: 2186460 - DNA, 21 bp, Homo sapiens
ctaaaatcaagtgcacctaca

SEQ ID NO: 2186461 - DNA, 21 bp, Homo sapiens
ctaaaatttgccctcccatcc

SEQ ID NO: 2186462 - DNA, 13 bp, Homo sapiens
ctaaaccaaaaca

SEQ ID NO: 2186463 - DNA, 19 bp, Homo sapiens
ctaaagaggaagccttgcc

SEQ ID NO: 2186464 - DNA, 16 bp, Homo sapiens
ctaaagcagtttttaa

SEQ ID NO: 2186465 - DNA, 22 bp, Homo sapiens
ctaaagtgtcatccaccagtgt

SEQ ID NO: 2186466 - DNA, 14 bp, Homo sapiens
ctaaatactgtaca

SEQ ID NO: 2186467 - DNA, 20 bp, Homo sapiens
ctaactagagcagccctgga

SEQ ID NO: 2186468 - DNA, 19 bp, Homo sapiens
ctaactctgcccaccctcc

SEQ ID NO: 2186469 - DNA, 21 bp, Homo sapiens
ctaagagacacatacagagtg

SEQ ID NO: 2186470 - DNA, 21 bp, Homo sapiens
ctaaggcctcttgctggtgca

SEQ ID NO: 2186471 - DNA, 15 bp, Homo sapiens
ctaagtccctgcccc

SEQ ID NO: 2186472 - DNA, 16 bp, Homo sapiens
ctaagtccctgccccc

SEQ ID NO: 2186473 - DNA, 17 bp, Homo sapiens
ctaagtccctgccccct

SEQ ID NO: 2186474 - DNA, 18 bp, Homo sapiens
ctaatccatgtgctgctg

SEQ ID NO: 2186475 - DNA, 19 bp, Homo sapiens
ctaattttaaagtaaaagg

SEQ ID NO: 2186476 - DNA, 19 bp, Homo sapiens
ctacaagagggcaaagctg

SEQ ID NO: 2186477 - DNA, 20 bp, Homo sapiens
ctacactcattgaaatgtaa

SEQ ID NO: 2186478 - DNA, 16 bp, Homo sapiens
ctacaggtgagtgcca

SEQ ID NO: 2186479 - DNA, 23 bp, Homo sapiens
ctaccactggtgtaaaaaacaaa

SEQ ID NO: 2186480 - DNA, 18 bp, Homo sapiens
ctaccactgtcttcttca

SEQ ID NO: 2186481 - DNA, 19 bp, Homo sapiens
ctaccacttatttctaaat

SEQ ID NO: 2186482 - DNA, 11 bp, Homo sapiens
ctaccatctcc

SEQ ID NO: 2186483 - DNA, 18 bp, Homo sapiens
ctaccatttcagatgcaa

SEQ ID NO: 2186484 - DNA, 14 bp, Homo sapiens
ctacccacagggcc

SEQ ID NO: 2186485 - DNA, 20 bp, Homo sapiens
ctacccacagggcctgactt

SEQ ID NO: 2186486 - DNA, 13 bp, Homo sapiens
ctacccagcccat

SEQ ID NO: 2186487 - DNA, 21 bp, Homo sapiens
ctaccccccgtctcctgccgg

SEQ ID NO: 2186488 - DNA, 20 bp, Homo sapiens
ctacccccttgtctgctgct

SEQ ID NO: 2186489 - DNA, 15 bp, Homo sapiens
ctacccttgccaagg

SEQ ID NO: 2186490 - DNA, 20 bp, Homo sapiens
ctaccgatttcagcacatgc

SEQ ID NO: 2186491 - DNA, 23 bp, Homo sapiens
ctacctcttttgagactttgccc

SEQ ID NO: 2186492 - DNA, 12 bp, Homo sapiens
ctacctgccctc

SEQ ID NO: 2186493 - DNA, 17 bp, Homo sapiens
ctacctgccctctctca

SEQ ID NO: 2186494 - DNA, 21 bp, Homo sapiens
ctaccttttttttacggaatt

SEQ ID NO: 2186495 - DNA, 13 bp, Homo sapiens
ctactatttttct

SEQ ID NO: 2186496 - DNA, 18 bp, Homo sapiens
ctactgaggagcaaagca

SEQ ID NO: 2186497 - DNA, 15 bp, Homo sapiens
ctactggtaggaaga

SEQ ID NO: 2186498 - DNA, 13 bp, Homo sapiens
ctacttgggccat

SEQ ID NO: 2186499 - DNA, 17 bp, Homo sapiens
ctagaatactaataaaa

SEQ ID NO: 2186500 - DNA, 15 bp, Homo sapiens
ctagagcagccctgg

SEQ ID NO: 2186501 - DNA, 22 bp, Homo sapiens
ctagatgagaattcagctgccc

SEQ ID NO: 2186502 - DNA, 15 bp, Homo sapiens
ctagccactggaaat

SEQ ID NO: 2186503 - DNA, 13 bp, Homo sapiens
ctagctcccctcc

SEQ ID NO: 2186504 - DNA, 16 bp, Homo sapiens
ctagctcccctcctct

SEQ ID NO: 2186505 - DNA, 21 bp, Homo sapiens
ctagctcccctcctctcccct

SEQ ID NO: 2186506 - DNA, 12 bp, Homo sapiens
ctagctgtgtgc

SEQ ID NO: 2186507 - DNA, 20 bp, Homo sapiens
ctagcttagagcctccctca

SEQ ID NO: 2186508 - DNA, 22 bp, Homo sapiens
ctagcttagagcctccctcaat

SEQ ID NO: 2186509 - DNA, 14 bp, Homo sapiens
ctaggattagaaaa

SEQ ID NO: 2186510 - DNA, 16 bp, Homo sapiens
ctaggcacctctgtgc

SEQ ID NO: 2186511 - DNA, 17 bp, Homo sapiens
ctaggcacctctgtgct

SEQ ID NO: 2186512 - DNA, 20 bp, Homo sapiens
ctaggcagttagagatgcct

SEQ ID NO: 2186513 - DNA, 22 bp, Homo sapiens
ctaggcagttagagatgcctcc

SEQ ID NO: 2186514 - DNA, 23 bp, Homo sapiens
ctaggcagttagagatgcctccc

SEQ ID NO: 2186515 - DNA, 15 bp, Homo sapiens
ctaggccccagaggc

SEQ ID NO: 2186516 - DNA, 21 bp, Homo sapiens
ctaggctacccttgccaaggc

SEQ ID NO: 2186517 - DNA, 13 bp, Homo sapiens
ctaggctgggtgc

SEQ ID NO: 2186518 - DNA, 19 bp, Homo sapiens
ctaggctgggtgcccacag

SEQ ID NO: 2186519 - DNA, 20 bp, Homo sapiens
ctagggaagaaagcagaaca

SEQ ID NO: 2186520 - DNA, 21 bp, Homo sapiens
ctagggaaggccacctgcagg

SEQ ID NO: 2186521 - DNA, 14 bp, Homo sapiens
ctagggctgggtgt

SEQ ID NO: 2186522 - DNA, 19 bp, Homo sapiens
ctaggtcagtacccacctg

SEQ ID NO: 2186523 - DNA, 20 bp, Homo sapiens
ctaggtcagtacccacctga

SEQ ID NO: 2186524 - DNA, 22 bp, Homo sapiens
ctaggtcagtacccacctgagc

SEQ ID NO: 2186525 - DNA, 13 bp, Homo sapiens
ctagtctgtgtgc

SEQ ID NO: 2186526 - DNA, 14 bp, Homo sapiens
ctagtctgtgtgct

SEQ ID NO: 2186527 - DNA, 13 bp, Homo sapiens
ctagtgtcacctg

SEQ ID NO: 2186528 - DNA, 17 bp, Homo sapiens
ctagtgtcacctgcaca

SEQ ID NO: 2186529 - DNA, 14 bp, Homo sapiens
ctatagccatttgc

SEQ ID NO: 2186530 - DNA, 21 bp, Homo sapiens
ctatatttaataccaccaaca

SEQ ID NO: 2186531 - DNA, 22 bp, Homo sapiens
ctatatttaataccaccaacaa

SEQ ID NO: 2186532 - DNA, 11 bp, Homo sapiens
ctatcacctgt

SEQ ID NO: 2186533 - DNA, 12 bp, Homo sapiens
ctatcacctgtc

SEQ ID NO: 2186534 - DNA, 15 bp, Homo sapiens
ctatccccaagctgg

SEQ ID NO: 2186535 - DNA, 13 bp, Homo sapiens
ctatcctggcttt

SEQ ID NO: 2186536 - DNA, 13 bp, Homo sapiens
cctcccctcagcc

SEQ ID NO: 2186537 - DNA, 14 bp, Homo sapiens
cctcccctgccctc

SEQ ID NO: 2186538 - DNA, 17 bp, Homo sapiens
cctccctcccctgccct

SEQ ID NO: 2186539 - DNA, 15 bp, Homo sapiens
cctccctccctgcag

SEQ ID NO: 2186540 - DNA, 13 bp, Homo sapiens
cctccctctcctc

SEQ ID NO: 2186541 - DNA, 13 bp, Homo sapiens
cctccctgcaggg

SEQ ID NO: 2186542 - DNA, 17 bp, Homo sapiens
ctcctgctggtacctgc

SEQ ID NO: 2186543 - DNA, 18 bp, Homo sapiens
ctcctggagatttcagtt

SEQ ID NO: 2186544 - DNA, 12 bp, Homo sapiens
ctcctgggaagg

SEQ ID NO: 2186545 - DNA, 22 bp, Homo sapiens
ctcctgggaaggctactcacct

SEQ ID NO: 2186546 - DNA, 14 bp, Homo sapiens
ctcctgggctcaag

SEQ ID NO: 2186547 - DNA, 22 bp, Homo sapiens
ctcctggtatgggtttctccca

SEQ ID NO: 2186548 - DNA, 22 bp, Homo sapiens
ctccttagaaaagactgacctt

SEQ ID NO: 2186549 - DNA, 16 bp, Homo sapiens
ctccttccctggtcca

SEQ ID NO: 2186550 - DNA, 16 bp, Homo sapiens
ctccttctctgtctca

SEQ ID NO: 2186551 - DNA, 18 bp, Homo sapiens
ctccttgccgctgggaga

SEQ ID NO: 2186552 - DNA, 13 bp, Homo sapiens
ctcctttaattgt

SEQ ID NO: 2186553 - DNA, 16 bp, Homo sapiens
ctcctttctcttctct

SEQ ID NO: 2186554 - DNA, 14 bp, Homo sapiens
ctcgaactcctggg

SEQ ID NO: 2186555 - DNA, 15 bp, Homo sapiens
ctcgaactcctgggc

SEQ ID NO: 2186556 - DNA, 21 bp, Homo sapiens
ctcgaagtcttccatcagcag

SEQ ID NO: 2186557 - DNA, 19 bp, Homo sapiens
ctcgcaggggcgctggctg

SEQ ID NO: 2186558 - DNA, 13 bp, Homo sapiens
ctcgctcccttca

SEQ ID NO: 2186559 - DNA, 13 bp, Homo sapiens
ctcgcttctctgt

SEQ ID NO: 2186560 - DNA, 14 bp, Homo sapiens
ctcggccccgtctc

SEQ ID NO: 2186561 - DNA, 19 bp, Homo sapiens
ctcggggcctgtgccgcac

SEQ ID NO: 2186562 - DNA, 14 bp, Homo sapiens
ctcgtgggctctgg

SEQ ID NO: 2186563 - DNA, 18 bp, Homo sapiens
ctcgtgggctctggctcc

SEQ ID NO: 2186564 - DNA, 20 bp, Homo sapiens
ctcgtgggctctggctccct

SEQ ID NO: 2186565 - DNA, 17 bp, Homo sapiens
ctctaatgtaacttcct

SEQ ID NO: 2186566 - DNA, 21 bp, Homo sapiens
ctctaatgtaacttcctctta

SEQ ID NO: 2186567 - DNA, 17 bp, Homo sapiens
ctctacccagcccatct

SEQ ID NO: 2186568 - DNA, 21 bp, Homo sapiens
ctctagggaaggccacctgca

SEQ ID NO: 2186569 - DNA, 20 bp, Homo sapiens
ctctatctctttatatatgt

SEQ ID NO: 2186570 - DNA, 13 bp, Homo sapiens
ctctattctgtag

SEQ ID NO: 2186571 - DNA, 16 bp, Homo sapiens
ctctatttattagcca

SEQ ID NO: 2186572 - DNA, 19 bp, Homo sapiens
ctctcaatttgggtcccag

SEQ ID NO: 2186573 - DNA, 15 bp, Homo sapiens
ctctcattctctttc

SEQ ID NO: 2186574 - DNA, 22 bp, Homo sapiens
ctctcattctctttctttttct

SEQ ID NO: 2186575 - DNA, 22 bp, Homo sapiens
ctctccaacatgaaggatcaaa

SEQ ID NO: 2186576 - DNA, 13 bp, Homo sapiens
ctctccagctata

SEQ ID NO: 2186577 - DNA, 20 bp, Homo sapiens
ctctcccacacaagcagtct

SEQ ID NO: 2186578 - DNA, 15 bp, Homo sapiens
ctctccttcctcaga

SEQ ID NO: 2186579 - DNA, 20 bp, Homo sapiens
ctctccttttccttaccata

SEQ ID NO: 2186580 - DNA, 12 bp, Homo sapiens
ctctctgaacac

SEQ ID NO: 2186581 - DNA, 15 bp, Homo sapiens
ctctcttacccttct

SEQ ID NO: 2186582 - DNA, 18 bp, Homo sapiens
ctctcttacccttctgtg

SEQ ID NO: 2186583 - DNA, 19 bp, Homo sapiens
ctctcttacccttctgtgc

SEQ ID NO: 2186584 - DNA, 22 bp, Homo sapiens
ctctcttacccttctgtgccca

SEQ ID NO: 2186585 - DNA, 17 bp, Homo sapiens
ctctcttcaatctctgg

SEQ ID NO: 2186586 - DNA, 13 bp, Homo sapiens
ctctgactcccaa

SEQ ID NO: 2186587 - DNA, 21 bp, Homo sapiens
ctctgactcccaaagagctgc

SEQ ID NO: 2186588 - DNA, 13 bp, Homo sapiens
ctctgaggctcag

SEQ ID NO: 2186589 - DNA, 18 bp, Homo sapiens
ctctgaggctcagccctg

SEQ ID NO: 2186590 - DNA, 21 bp, Homo sapiens
ctctgaggctcagccctgagc

SEQ ID NO: 2186591 - DNA, 14 bp, Homo sapiens
ctctgcccaccctc

SEQ ID NO: 2186592 - DNA, 15 bp, Homo sapiens
ctctgcccagagctg

SEQ ID NO: 2186593 - DNA, 19 bp, Homo sapiens
ctctgcccagagctgggtg

SEQ ID NO: 2186594 - DNA, 20 bp, Homo sapiens
ctctgcccagagctgggtga

SEQ ID NO: 2186595 - DNA, 18 bp, Homo sapiens
ctctgcccccagctgctc

SEQ ID NO: 2186596 - DNA, 21 bp, Homo sapiens
ctctgcccccagctgctcctc

SEQ ID NO: 2186597 - DNA, 21 bp, Homo sapiens
ctctgctggccgggcacagct

SEQ ID NO: 2186598 - DNA, 22 bp, Homo sapiens
ctctgctgggtttccacacagc

SEQ ID NO: 2186599 - DNA, 15 bp, Homo sapiens
ctctgcttcagcttg

SEQ ID NO: 2186600 - DNA, 14 bp, Homo sapiens
ctctggagccacct

SEQ ID NO: 2186601 - DNA, 20 bp, Homo sapiens
ctctggagccacctgtccca

SEQ ID NO: 2186602 - DNA, 13 bp, Homo sapiens
ctctggaggcctc

SEQ ID NO: 2186603 - DNA, 16 bp, Homo sapiens
ctctggaggcctctgg

SEQ ID NO: 2186604 - DNA, 20 bp, Homo sapiens
ctctggaggcctctgggcct

SEQ ID NO: 2186605 - DNA, 13 bp, Homo sapiens
ctctggagtgtgt

SEQ ID NO: 2186606 - DNA, 16 bp, Homo sapiens
ctctggcccacacaga

SEQ ID NO: 2186607 - DNA, 14 bp, Homo sapiens
ctctggccctgttg

SEQ ID NO: 2186608 - DNA, 22 bp, Homo sapiens
ctctggctcacagactggagac

SEQ ID NO: 2186609 - DNA, 15 bp, Homo sapiens
ctctggggctcagcc

SEQ ID NO: 2186610 - DNA, 17 bp, Homo sapiens
ctctggtgggaaaatgt

SEQ ID NO: 2186611 - DNA, 14 bp, Homo sapiens
ctctgtccagggct

SEQ ID NO: 2186612 - DNA, 18 bp, Homo sapiens
ctctgtccagggcttcag

SEQ ID NO: 2186613 - DNA, 23 bp, Homo sapiens
ctctgtctcatgtgtgctcttct

SEQ ID NO: 2186614 - DNA, 14 bp, Homo sapiens
ctctgtgactgatg

SEQ ID NO: 2186615 - DNA, 10 bp, Homo sapiens
ctctgtgctc

SEQ ID NO: 2186616 - DNA, 21 bp, Homo sapiens
ctctgtgctgcatcccaccag

SEQ ID NO: 2186617 - DNA, 21 bp, Homo sapiens
ctctgttcagtaacagggcct

SEQ ID NO: 2186618 - DNA, 22 bp, Homo sapiens
ctctgttctgctcccagatgcc

SEQ ID NO: 2186619 - DNA, 15 bp, Homo sapiens
ctcttacccttctgt

SEQ ID NO: 2186620 - DNA, 14 bp, Homo sapiens
ctgcccagagctgg

SEQ ID NO: 2186621 - DNA, 18 bp, Homo sapiens
ctgcccagagctgggtga

SEQ ID NO: 2186622 - DNA, 19 bp, Homo sapiens
ctgccccaaaggaagcttt

SEQ ID NO: 2186623 - DNA, 13 bp, Homo sapiens
ctgcccccagctg

SEQ ID NO: 2186624 - DNA, 16 bp, Homo sapiens
ctgcccccagctgctc

SEQ ID NO: 2186625 - DNA, 23 bp, Homo sapiens
ctgcccccagctgctcctcgcag

SEQ ID NO: 2186626 - DNA, 20 bp, Homo sapiens
ctgccccccctaagagacac

SEQ ID NO: 2186627 - DNA, 17 bp, Homo sapiens
ctgccccctccccttca

SEQ ID NO: 2186628 - DNA, 18 bp, Homo sapiens
ctgccccctccccttcac

SEQ ID NO: 2186629 - DNA, 11 bp, Homo sapiens
ctgcccctccc

SEQ ID NO: 2186630 - DNA, 21 bp, Homo sapiens
ctgcccctgccgcctgtgccc

SEQ ID NO: 2186631 - DNA, 22 bp, Homo sapiens
ctgccctaactctgcccaccct

SEQ ID NO: 2186632 - DNA, 15 bp, Homo sapiens
ctgccctctatttat

SEQ ID NO: 2186633 - DNA, 15 bp, Homo sapiens
ctgccctctctcagt

SEQ ID NO: 2186634 - DNA, 20 bp, Homo sapiens
ctgccctctctcagttattc

SEQ ID NO: 2186635 - DNA, 13 bp, Homo sapiens
ctgccctctgttc

SEQ ID NO: 2186636 - DNA, 19 bp, Homo sapiens
ctgccctctgttcagtaac

SEQ ID NO: 2186637 - DNA, 16 bp, Homo sapiens
ctgccctgccctcctg

SEQ ID NO: 2186638 - DNA, 12 bp, Homo sapiens
ctgccctgtcta

SEQ ID NO: 2186639 - DNA, 18 bp, Homo sapiens
ctgccgtgagagcccaat

SEQ ID NO: 2186640 - DNA, 23 bp, Homo sapiens
ctgccgtgagagcccaatcactg

SEQ ID NO: 2186641 - DNA, 14 bp, Homo sapiens
ctgcctcagcctcc

SEQ ID NO: 2186642 - DNA, 18 bp, Homo sapiens
ctgcctcagcctcccgag

SEQ ID NO: 2186643 - DNA, 19 bp, Homo sapiens
ctgcctctgagccactgga

SEQ ID NO: 2186644 - DNA, 22 bp, Homo sapiens
ctgcctgctttgtgcagggtcc

SEQ ID NO: 2186645 - DNA, 19 bp, Homo sapiens
ctgcctggatgagaaacag

SEQ ID NO: 2186646 - DNA, 14 bp, Homo sapiens
ctgccttcctcctt

SEQ ID NO: 2186647 - DNA, 15 bp, Homo sapiens
ctgccttcctcctta

SEQ ID NO: 2186648 - DNA, 21 bp, Homo sapiens
ctgccttccttagcagcttct

SEQ ID NO: 2186649 - DNA, 14 bp, Homo sapiens
ctgccttctgggca

SEQ ID NO: 2186650 - DNA, 15 bp, Homo sapiens
ctgccttctgggcaa

SEQ ID NO: 2186651 - DNA, 21 bp, Homo sapiens
ctgcctttgttcactgtgagt

SEQ ID NO: 2186652 - DNA, 14 bp, Homo sapiens
ctgcgaactgtgca

SEQ ID NO: 2186653 - DNA, 14 bp, Homo sapiens
ctgcgcagctcctt

SEQ ID NO: 2186654 - DNA, 17 bp, Homo sapiens
ctgcgcagggccctctg

SEQ ID NO: 2186655 - DNA, 12 bp, Homo sapiens
ctgcgcagggct

SEQ ID NO: 2186656 - DNA, 21 bp, Homo sapiens
ctgcggctgctggcacagact

SEQ ID NO: 2186657 - DNA, 13 bp, Homo sapiens
ctgcggtgggcag

SEQ ID NO: 2186658 - DNA, 16 bp, Homo sapiens
ctgcggtgggcagcca

SEQ ID NO: 2186659 - DNA, 17 bp, Homo sapiens
ctgcggtgggcagccat

SEQ ID NO: 2186660 - DNA, 18 bp, Homo sapiens
ctgcgtcatggctcaagg

SEQ ID NO: 2186661 - DNA, 21 bp, Homo sapiens
ctgctacctgttcttgggcct

SEQ ID NO: 2186662 - DNA, 18 bp, Homo sapiens
ctgctataaagttaaagt

SEQ ID NO: 2186663 - DNA, 21 bp, Homo sapiens
ctgctatttcccaagctggag

SEQ ID NO: 2186664 - DNA, 23 bp, Homo sapiens
ctgctatttcccaagctggagtg

SEQ ID NO: 2186665 - DNA, 24 bp, Homo sapiens
ctgctatttcccaagctggagtgc

SEQ ID NO: 2186666 - DNA, 13 bp, Homo sapiens
ctgctcagctggc

SEQ ID NO: 2186667 - DNA, 16 bp, Homo sapiens
ctgctcagctggccgg

SEQ ID NO: 2186668 - DNA, 14 bp, Homo sapiens
ctgctctctaccca

SEQ ID NO: 2186669 - DNA, 20 bp, Homo sapiens
ctgctctctacccagcccat

SEQ ID NO: 2186670 - DNA, 23 bp, Homo sapiens
ctgctctgcccagagctgggtga

SEQ ID NO: 2186671 - DNA, 23 bp, Homo sapiens
ctgctgaatgcctcgctcccttc

SEQ ID NO: 2186672 - DNA, 23 bp, Homo sapiens
ctgctgccatgattttggccact

SEQ ID NO: 2186673 - DNA, 17 bp, Homo sapiens
ctgctggccgggcacag

SEQ ID NO: 2186674 - DNA, 19 bp, Homo sapiens
ctggctgggggcctcactc

SEQ ID NO: 2186675 - DNA, 14 bp, Homo sapiens
ctggcttgaacctt

SEQ ID NO: 2186676 - DNA, 14 bp, Homo sapiens
ctggctttgtccca

SEQ ID NO: 2186677 - DNA, 15 bp, Homo sapiens
ctggctttgtcccac

SEQ ID NO: 2186678 - DNA, 20 bp, Homo sapiens
ctggctttgtcccacagctt

SEQ ID NO: 2186679 - DNA, 18 bp, Homo sapiens
ctgggaactcccaagaac

SEQ ID NO: 2186680 - DNA, 21 bp, Homo sapiens
ctgggaactcccaagaacagc

SEQ ID NO: 2186681 - DNA, 20 bp, Homo sapiens
ctgggagagccaaggcctat

SEQ ID NO: 2186682 - DNA, 23 bp, Homo sapiens
ctgggagagccaaggcctatgcc

SEQ ID NO: 2186683 - DNA, 12 bp, Homo sapiens
ctgggaggcagg

SEQ ID NO: 2186684 - DNA, 13 bp, Homo sapiens
ctgggaggcaggt

SEQ ID NO: 2186685 - DNA, 14 bp, Homo sapiens
ctgggaggcaggtc

SEQ ID NO: 2186686 - DNA, 16 bp, Homo sapiens
ctgggattacaggtgt

SEQ ID NO: 2186687 - DNA, 18 bp, Homo sapiens
ctgggcaaacccttctct

SEQ ID NO: 2186688 - DNA, 20 bp, Homo sapiens
ctgggcaaacccttctcttc

SEQ ID NO: 2186689 - DNA, 15 bp, Homo sapiens
ctgggcaaggtgagg

SEQ ID NO: 2186690 - DNA, 11 bp, Homo sapiens
ctgggcagagg

SEQ ID NO: 2186691 - DNA, 14 bp, Homo sapiens
ctgggcagagggga

SEQ ID NO: 2186692 - DNA, 23 bp, Homo sapiens
ctgggcagaggggagaggaagca

SEQ ID NO: 2186693 - DNA, 16 bp, Homo sapiens
ctgggccactggcatc

SEQ ID NO: 2186694 - DNA, 17 bp, Homo sapiens
ctgggccactggcatct

SEQ ID NO: 2186695 - DNA, 21 bp, Homo sapiens
ctgggcccagaggcacagccg

SEQ ID NO: 2186696 - DNA, 22 bp, Homo sapiens
ctgggcccagaggcacagccgg

SEQ ID NO: 2186697 - DNA, 23 bp, Homo sapiens
ctgggccccaggcaccccctggc

SEQ ID NO: 2186698 - DNA, 16 bp, Homo sapiens
ctgggcctcctctaac

SEQ ID NO: 2186699 - DNA, 23 bp, Homo sapiens
ctgggcctcctctaacaggggct

SEQ ID NO: 2186700 - DNA, 24 bp, Homo sapiens
ctgggctcaagcaatcctcctgag

SEQ ID NO: 2186701 - DNA, 22 bp, Homo sapiens
ctgggcttatatctggcctctg

SEQ ID NO: 2186702 - DNA, 20 bp, Homo sapiens
ctgggctttgattccatctc

SEQ ID NO: 2186703 - DNA, 21 bp, Homo sapiens
ctggggacagctttcctgggt

SEQ ID NO: 2186704 - DNA, 16 bp, Homo sapiens
ctggggaggacaaagg

SEQ ID NO: 2186705 - DNA, 15 bp, Homo sapiens
ctggggagtgctgga

SEQ ID NO: 2186706 - DNA, 21 bp, Homo sapiens
ctggggctcagccctgagctg

SEQ ID NO: 2186707 - DNA, 18 bp, Homo sapiens
ctggggctgcgcagggct

SEQ ID NO: 2186708 - DNA, 12 bp, Homo sapiens
ctgggggcctca

SEQ ID NO: 2186709 - DNA, 19 bp, Homo sapiens
ctggggtgccctccactgc

SEQ ID NO: 2186710 - DNA, 23 bp, Homo sapiens
ctgggtaggttctgaacagcaga

SEQ ID NO: 2186711 - DNA, 23 bp, Homo sapiens
ctgggtgcccacagcccgcatgc

SEQ ID NO: 2186712 - DNA, 14 bp, Homo sapiens
ctgggtggctcagc

SEQ ID NO: 2186713 - DNA, 16 bp, Homo sapiens
ctgggttctgggtggt

SEQ ID NO: 2186714 - DNA, 21 bp, Homo sapiens
ctggtacctgccctctattta

SEQ ID NO: 2186715 - DNA, 17 bp, Homo sapiens
ctggtaggttctgtctg

SEQ ID NO: 2186716 - DNA, 18 bp, Homo sapiens
ctggtaggttctgtctgt

SEQ ID NO: 2186717 - DNA, 19 bp, Homo sapiens
ctggtcatcagtattgtgt

SEQ ID NO: 2186718 - DNA, 14 bp, Homo sapiens
ctggtctcctccca

SEQ ID NO: 2186719 - DNA, 18 bp, Homo sapiens
ctggtgaccggcctggac

SEQ ID NO: 2186720 - DNA, 13 bp, Homo sapiens
ctggtgaggaagc

SEQ ID NO: 2186721 - DNA, 17 bp, Homo sapiens
ctggtgcacatgacatt

SEQ ID NO: 2186722 - DNA, 21 bp, Homo sapiens
ctggtgccgaagtgtttctga

SEQ ID NO: 2186723 - DNA, 15 bp, Homo sapiens
ctggtgggaaaatgt

SEQ ID NO: 2186724 - DNA, 14 bp, Homo sapiens
ctggttagctcagc

SEQ ID NO: 2186725 - DNA, 21 bp, Homo sapiens
ctggttagctcagccccagcc

SEQ ID NO: 2186726 - DNA, 23 bp, Homo sapiens
ctggttagctcagccccagccca

SEQ ID NO: 2186727 - DNA, 16 bp, Homo sapiens
ctggttccttaagtgg

SEQ ID NO: 2186728 - DNA, 15 bp, Homo sapiens
ctggttggaggccct

SEQ ID NO: 2186729 - DNA, 17 bp, Homo sapiens
ctggtttgtatgatgta

SEQ ID NO: 2186730 - DNA, 20 bp, Homo sapiens
ctgtaacgggtcgtgctcat

SEQ ID NO: 2186731 - DNA, 16 bp, Homo sapiens
ctgtaaggaagaggga

SEQ ID NO: 2186732 - DNA, 19 bp, Homo sapiens
ctgtacatagatgtatcat

SEQ ID NO: 2186733 - DNA, 22 bp, Homo sapiens
ctgtaccgtcgacaagaatgtc

SEQ ID NO: 2186734 - DNA, 21 bp, Homo sapiens
ctgtatcagaaatgaaacaga

SEQ ID NO: 2186735 - DNA, 15 bp, Homo sapiens
gaagttagtttgtat

SEQ ID NO: 2186736 - DNA, 15 bp, Homo sapiens
gaagttgttagtgat

SEQ ID NO: 2186737 - DNA, 15 bp, Homo sapiens
gaataaagtattcta

SEQ ID NO: 2186738 - DNA, 14 bp, Homo sapiens
gaatactaataaaa

SEQ ID NO: 2186739 - DNA, 19 bp, Homo sapiens
gaatactttgagtaaactt

SEQ ID NO: 2186740 - DNA, 14 bp, Homo sapiens
gaataggcattaaa

SEQ ID NO: 2186741 - DNA, 19 bp, Homo sapiens
gaataggcattaaatgcaa

SEQ ID NO: 2186742 - DNA, 21 bp, Homo sapiens
gaataggcattaaatgcaaaa

SEQ ID NO: 2186743 - DNA, 15 bp, Homo sapiens
gaatattaaaaatta

SEQ ID NO: 2186744 - DNA, 16 bp, Homo sapiens
gaatattaaaaattaa

SEQ ID NO: 2186745 - DNA, 16 bp, Homo sapiens
gaatcaagtctgtgaa

SEQ ID NO: 2186746 - DNA, 22 bp, Homo sapiens
gaatcccatggatgtttcttct

SEQ ID NO: 2186747 - DNA, 22 bp, Homo sapiens
gaatcttttactgtggaggtgg

SEQ ID NO: 2186748 - DNA, 15 bp, Homo sapiens
gaatgaatacagcat

SEQ ID NO: 2186749 - DNA, 18 bp, Homo sapiens
gaatgagagagtgtggaa

SEQ ID NO: 2186750 - DNA, 14 bp, Homo sapiens
gaatgggagccaga

SEQ ID NO: 2186751 - DNA, 14 bp, Homo sapiens
gaatggggacctgg

SEQ ID NO: 2186752 - DNA, 15 bp, Homo sapiens
gaattaaaataaaac

SEQ ID NO: 2186753 - DNA, 11 bp, Homo sapiens
gaattaaaatt

SEQ ID NO: 2186754 - DNA, 22 bp, Homo sapiens
gaattatcatcccaacagccaa

SEQ ID NO: 2186755 - DNA, 17 bp, Homo sapiens
gaattcactaggaggtc

SEQ ID NO: 2186756 - DNA, 13 bp, Homo sapiens
gaattccaatatt

SEQ ID NO: 2186757 - DNA, 20 bp, Homo sapiens
gaattccaatatttataatt

SEQ ID NO: 2186758 - DNA, 13 bp, Homo sapiens
gaattctgaactt

SEQ ID NO: 2186759 - DNA, 19 bp, Homo sapiens
gaattctggacaacccaag

SEQ ID NO: 2186760 - DNA, 11 bp, Homo sapiens
gaatttattat

SEQ ID NO: 2186761 - DNA, 10 bp, Homo sapiens
gaatttcagg

SEQ ID NO: 2186762 - DNA, 18 bp, Homo sapiens
gaattttaaaacatggca

SEQ ID NO: 2186763 - DNA, 23 bp, Homo sapiens
gacaaaaatataaagttattaat

SEQ ID NO: 2186764 - DNA, 20 bp, Homo sapiens
gacaaaaggaaacctctgac

SEQ ID NO: 2186765 - DNA, 19 bp, Homo sapiens
gacaaaccactgtacatat

SEQ ID NO: 2186766 - DNA, 14 bp, Homo sapiens
gagaagccagccac

SEQ ID NO: 2186767 - DNA, 22 bp, Homo sapiens
gagaagcctgggtggctcagca

SEQ ID NO: 2186768 - DNA, 12 bp, Homo sapiens
gagaaggagagg

SEQ ID NO: 2186769 - DNA, 17 bp, Homo sapiens
gagaaggcaagctggca

SEQ ID NO: 2186770 - DNA, 16 bp, Homo sapiens
gagaagggcttttctt

SEQ ID NO: 2186771 - DNA, 17 bp, Homo sapiens
gagaagtcggccaggta

SEQ ID NO: 2186772 - DNA, 17 bp, Homo sapiens
gagaatagcagtttcac

SEQ ID NO: 2186773 - DNA, 15 bp, Homo sapiens
gagaatattaattgt

SEQ ID NO: 2186774 - DNA, 18 bp, Homo sapiens
gagaatgaccctgtcaag

SEQ ID NO: 2186775 - DNA, 13 bp, Homo sapiens
gagaattaaaata

SEQ ID NO: 2186776 - DNA, 16 bp, Homo sapiens
gagaattcagctgccc

SEQ ID NO: 2186777 - DNA, 18 bp, Homo sapiens
gagacaatgcagatgcca

SEQ ID NO: 2186778 - DNA, 21 bp, Homo sapiens
gagacaatgcagatgccagag

SEQ ID NO: 2186779 - DNA, 18 bp, Homo sapiens
gagacacatacagagtgg

SEQ ID NO: 2186780 - DNA, 12 bp, Homo sapiens
gagacacctcag

SEQ ID NO: 2186781 - DNA, 16 bp, Homo sapiens
gagacacctcagagcc

SEQ ID NO: 2186782 - DNA, 18 bp, Homo sapiens
gagaccaagccggtgccc

SEQ ID NO: 2186783 - DNA, 14 bp, Homo sapiens
gagaccagcctttc

SEQ ID NO: 2186784 - DNA, 15 bp, Homo sapiens
gagaccagcctttct

SEQ ID NO: 2186785 - DNA, 16 bp, Homo sapiens
gagaccagcctttctt

SEQ ID NO: 2186786 - DNA, 19 bp, Homo sapiens
gagaccccgcacccggctc

SEQ ID NO: 2186787 - DNA, 19 bp, Homo sapiens
gagacctggaaccagagcc

SEQ ID NO: 2186788 - DNA, 16 bp, Homo sapiens
gcacctcctctctgct

SEQ ID NO: 2186789 - DNA, 17 bp, Homo sapiens
gcacctcctctctgctg

SEQ ID NO: 2186790 - DNA, 12 bp, Homo sapiens
gcacctgaggcc

SEQ ID NO: 2186791 - DNA, 13 bp, Homo sapiens
gcacctgaggccc

SEQ ID NO: 2186792 - DNA, 21 bp, Homo sapiens
gcacctgaggcccagcagagc

SEQ ID NO: 2186793 - DNA, 20 bp, Homo sapiens
gctggagtgcagtggtgcga

SEQ ID NO: 2186794 - DNA, 15 bp, Homo sapiens
gctggccgggcacag

SEQ ID NO: 2186795 - DNA, 18 bp, Homo sapiens
gctggccgggcacagctg

SEQ ID NO: 2186796 - DNA, 21 bp, Homo sapiens
gctggccgggttggaggcctc

SEQ ID NO: 2186797 - DNA, 15 bp, Homo sapiens
gctggcggaacctgg

SEQ ID NO: 2186798 - DNA, 17 bp, Homo sapiens
gctggcggaacctggct

SEQ ID NO: 2186799 - DNA, 18 bp, Homo sapiens
gctggcggaacctggctg

SEQ ID NO: 2186800 - DNA, 15 bp, Homo sapiens
gctggcgtcacctgt

SEQ ID NO: 2186801 - DNA, 17 bp, Homo sapiens
gctgggactacaggtgc

SEQ ID NO: 2186802 - DNA, 12 bp, Homo sapiens
gctgggagagcc

SEQ ID NO: 2186803 - DNA, 13 bp, Homo sapiens
gctgggagagcca

SEQ ID NO: 2186804 - DNA, 13 bp, Homo sapiens
gctgggcagaggg

SEQ ID NO: 2186805 - DNA, 17 bp, Homo sapiens
gctgggcagaggggaga

SEQ ID NO: 2186806 - DNA, 12 bp, Homo sapiens
gctgggcccaga

SEQ ID NO: 2186807 - DNA, 16 bp, Homo sapiens
aaagtgtattgcaagt

SEQ ID NO: 2186808 - DNA, 20 bp, Homo sapiens
aaagtgtattgcaagtgaaa

SEQ ID NO: 2186809 - DNA, 20 bp, Homo sapiens
aaagtgtcatccaccagtgt

SEQ ID NO: 2186810 - DNA, 12 bp, Homo sapiens
aaagtgttcctt

SEQ ID NO: 2186811 - DNA, 22 bp, Homo sapiens
aaagttgataggagacttgtac

SEQ ID NO: 2186812 - DNA, 16 bp, Homo sapiens
aaagttttaacctcag

SEQ ID NO: 2186813 - DNA, 16 bp, Homo sapiens
aaagtttttacagtgt

SEQ ID NO: 2186814 - DNA, 18 bp, Homo sapiens
aaataaaacgttatctca

SEQ ID NO: 2186815 - DNA, 13 bp, Homo sapiens
aaataaagccttt

SEQ ID NO: 2186816 - DNA, 13 bp, Homo sapiens
aaataatttatca

SEQ ID NO: 2186817 - DNA, 21 bp, Homo sapiens
aaatactgtacatagatgtat

SEQ ID NO: 2186818 - DNA, 17 bp, Homo sapiens
aaatacttgagaaattt

SEQ ID NO: 2186819 - DNA, 14 bp, Homo sapiens
aaatagctacagct

SEQ ID NO: 2186820 - DNA, 19 bp, Homo sapiens
aaatatatatgtagccaga

SEQ ID NO: 2186821 - DNA, 16 bp, Homo sapiens
aaatatcactttgtat

SEQ ID NO: 2186822 - DNA, 21 bp, Homo sapiens
aaatatcctccactttcagga

SEQ ID NO: 2186823 - DNA, 18 bp, Homo sapiens
aaatatctacctgccctc

SEQ ID NO: 2186824 - DNA, 20 bp, Homo sapiens
aaatatgtgattatcattta

SEQ ID NO: 2186825 - DNA, 14 bp, Homo sapiens
aaatatttaacgaa

SEQ ID NO: 2186826 - DNA, 12 bp, Homo sapiens
aaatatttctta

SEQ ID NO: 2186827 - DNA, 15 bp, Homo sapiens
aaatcacaaactcat

SEQ ID NO: 2186828 - DNA, 18 bp, Homo sapiens
aaatcacaaactcatcca

SEQ ID NO: 2186829 - DNA, 13 bp, Homo sapiens
aaatcagttttgt

SEQ ID NO: 2186830 - DNA, 15 bp, Homo sapiens
aaatcagttttgtgt

SEQ ID NO: 2186831 - DNA, 16 bp, Homo sapiens
aaatcagttttgtgta

SEQ ID NO: 2186832 - DNA, 16 bp, Homo sapiens
aaatcccagttcatgt

SEQ ID NO: 2186833 - DNA, 16 bp, Homo sapiens
aaatcccatctgcatt

SEQ ID NO: 2186834 - DNA, 17 bp, Homo sapiens
aaatgacggctaccaca

SEQ ID NO: 2186835 - DNA, 13 bp, Homo sapiens
aaatgcatttttt

SEQ ID NO: 2186836 - DNA, 22 bp, Homo sapiens
aaatgcttctaaatatgaagga

SEQ ID NO: 2186837 - DNA, 15 bp, Homo sapiens
aaatggaacattaac

SEQ ID NO: 2186838 - DNA, 13 bp, Homo sapiens
aaatggccctgtt

SEQ ID NO: 2186839 - DNA, 21 bp, Homo sapiens
aaatgggactgatgtcatctt

SEQ ID NO: 2186840 - DNA, 19 bp, Homo sapiens
aaatgtcccccacctcttt

SEQ ID NO: 2186841 - DNA, 21 bp, Homo sapiens
aaatgtgaatggaaacttgga

SEQ ID NO: 2186842 - DNA, 13 bp, Homo sapiens
aaattaattcttt

SEQ ID NO: 2186843 - DNA, 23 bp, Homo sapiens
aaattaatttgttaattaaatat

SEQ ID NO: 2186844 - DNA, 15 bp, Homo sapiens
aaattacaagtttca

SEQ ID NO: 2186845 - DNA, 16 bp, Homo sapiens
aaattacacccatgca

SEQ ID NO: 2186846 - DNA, 13 bp, Homo sapiens
aaattagaacttg

SEQ ID NO: 2186847 - DNA, 16 bp, Homo sapiens
aaattagtaatgtact

SEQ ID NO: 2186848 - DNA, 13 bp, Homo sapiens
aaattccaataca

SEQ ID NO: 2186849 - DNA, 20 bp, Homo sapiens
aaattccctggaccagatgc

SEQ ID NO: 2186850 - DNA, 17 bp, Homo sapiens
aaattgaaaactttgga

SEQ ID NO: 2186851 - DNA, 17 bp, Homo sapiens
aaattgcacgtgcaata

SEQ ID NO: 2186852 - DNA, 18 bp, Homo sapiens
aaattgccaaaatatatt

SEQ ID NO: 2186853 - DNA, 16 bp, Homo sapiens
aaattgtagcgtttcc

SEQ ID NO: 2186854 - DNA, 13 bp, Homo sapiens
aaattgtatattg

SEQ ID NO: 2186855 - DNA, 19 bp, Homo sapiens
aaattgtatattgtaattt

SEQ ID NO: 2186856 - DNA, 16 bp, Homo sapiens
aaattgttacccattt

SEQ ID NO: 2186857 - DNA, 20 bp, Homo sapiens
aaattgttacccatttgaaa

SEQ ID NO: 2186858 - DNA, 20 bp, Homo sapiens
aaatttattctacttttaaa

SEQ ID NO: 2186859 - DNA, 18 bp, Homo sapiens
aaatttcatctttccaaa

SEQ ID NO: 2186860 - DNA, 18 bp, Homo sapiens
aaatttgtggttgcatgt

SEQ ID NO: 2186861 - DNA, 14 bp, Homo sapiens
aaattttaaaggaa

SEQ ID NO: 2186862 - DNA, 19 bp, Homo sapiens
aaattttctagaatactaa

SEQ ID NO: 2186863 - DNA, 13 bp, Homo sapiens
aacaaagtgcaaa

SEQ ID NO: 2186864 - DNA, 20 bp, Homo sapiens
aacaactcgaatcactcatt

SEQ ID NO: 2186865 - DNA, 23 bp, Homo sapiens
aacaagtctttagtgttcaaata

SEQ ID NO: 2186866 - DNA, 18 bp, Homo sapiens
aacaattcaatcaaagct

SEQ ID NO: 2186867 - DNA, 22 bp, Homo sapiens
aacaattcaatcaaagctacct

SEQ ID NO: 2186868 - DNA, 12 bp, Homo sapiens
aacacactgaac

SEQ ID NO: 2186869 - DNA, 12 bp, Homo sapiens
aacaccaggact

SEQ ID NO: 2186870 - DNA, 22 bp, Homo sapiens
aacaccaggacttaagacaaat

SEQ ID NO: 2186871 - DNA, 15 bp, Homo sapiens
aacacctaagtgact

SEQ ID NO: 2186872 - DNA, 18 bp, Homo sapiens
aacactacctcttttgag

SEQ ID NO: 2186873 - DNA, 19 bp, Homo sapiens
aacactatgtaaatgtgaa

SEQ ID NO: 2186874 - DNA, 18 bp, Homo sapiens
aacagaaattgtatattg

SEQ ID NO: 2186875 - DNA, 22 bp, Homo sapiens
aacagaactgctaaatactgta

SEQ ID NO: 2186876 - DNA, 23 bp, Homo sapiens
aacagaactgctaaatactgtac

SEQ ID NO: 2186877 - DNA, 18 bp, Homo sapiens
aacagagtggattgggct

SEQ ID NO: 2186878 - DNA, 20 bp, Homo sapiens
aacagagtggattgggctgc

SEQ ID NO: 2186879 - DNA, 18 bp, Homo sapiens
aacagatctccaaagctt

SEQ ID NO: 2186880 - DNA, 20 bp, Homo sapiens
aacagatctccaaagctttc

SEQ ID NO: 2186881 - DNA, 13 bp, Homo sapiens
aacagattctcca

SEQ ID NO: 2186882 - DNA, 13 bp, Homo sapiens
aacagcaggccca

SEQ ID NO: 2186883 - DNA, 13 bp, Homo sapiens
aacagcatggaaa

SEQ ID NO: 2186884 - DNA, 23 bp, Homo sapiens
aacagccgagtggatagatgccc

SEQ ID NO: 2186885 - DNA, 11 bp, Homo sapiens
aacagctcagc

SEQ ID NO: 2186886 - DNA, 14 bp, Homo sapiens
aacagctcagccag

SEQ ID NO: 2186887 - DNA, 18 bp, Homo sapiens
aacagctcagccagtggg

SEQ ID NO: 2186888 - DNA, 14 bp, Homo sapiens
aacagctcaggctg

SEQ ID NO: 2186889 - DNA, 22 bp, Homo sapiens
aacagtgagaaaagaaaggcta

SEQ ID NO: 2186890 - DNA, 19 bp, Homo sapiens
aacagttaagcagccgcca

SEQ ID NO: 2186891 - DNA, 20 bp, Homo sapiens
aacatagtaacgtgttactg

SEQ ID NO: 2186892 - DNA, 23 bp, Homo sapiens
aacatggccacatccaacatttc

SEQ ID NO: 2186893 - DNA, 21 bp, Homo sapiens
aacattcaaaaacatggccac

SEQ ID NO: 2186894 - DNA, 16 bp, Homo sapiens
aacattcagctctgga

SEQ ID NO: 2186895 - DNA, 17 bp, Homo sapiens
aacattcagctctggag

SEQ ID NO: 2186896 - DNA, 19 bp, Homo sapiens
aacattcagctctggagaa

SEQ ID NO: 2186897 - DNA, 14 bp, Homo sapiens
aacatttatctttg

SEQ ID NO: 2186898 - DNA, 13 bp, Homo sapiens
aacatttcttgaa

SEQ ID NO: 2186899 - DNA, 23 bp, Homo sapiens
aacatttgtaatttttttctagt

SEQ ID NO: 2186900 - DNA, 11 bp, Homo sapiens
aaccaaaacag

SEQ ID NO: 2186901 - DNA, 17 bp, Homo sapiens
aaccacctctggccctg

SEQ ID NO: 2186902 - DNA, 23 bp, Homo sapiens
aaccacctctggccctgttgtgg

SEQ ID NO: 2186903 - DNA, 13 bp, Homo sapiens
aaccactgtacat

SEQ ID NO: 2186904 - DNA, 16 bp, Homo sapiens
aaccactgtacatata

SEQ ID NO: 2186905 - DNA, 15 bp, Homo sapiens
aaccagaataaaata

SEQ ID NO: 2186906 - DNA, 22 bp, Homo sapiens
aaccagggcaccaagcccacag

SEQ ID NO: 2186907 - DNA, 17 bp, Homo sapiens
aacccattaatcttttg

SEQ ID NO: 2186908 - DNA, 19 bp, Homo sapiens
aacccatttgccatgctgc

SEQ ID NO: 2186909 - DNA, 17 bp, Homo sapiens
aaccctgaggtatctgt

SEQ ID NO: 2186910 - DNA, 20 bp, Homo sapiens
aaccctttcttcaatacaaa

SEQ ID NO: 2186911 - DNA, 20 bp, Homo sapiens
aaccgctacaagagggcaaa

SEQ ID NO: 2186912 - DNA, 18 bp, Homo sapiens
aacctaaaacaatctgta

SEQ ID NO: 2186913 - DNA, 12 bp, Homo sapiens
aacctactgagg

SEQ ID NO: 2186914 - DNA, 21 bp, Homo sapiens
aacctacttgtaaacttgaaa

SEQ ID NO: 2186915 - DNA, 22 bp, Homo sapiens
aacctaggatggatagaaggaa

SEQ ID NO: 2186916 - DNA, 21 bp, Homo sapiens
aacctagggttttctatttct

SEQ ID NO: 2186917 - DNA, 15 bp, Homo sapiens
aacctcagcaacctg

SEQ ID NO: 2186918 - DNA, 16 bp, Homo sapiens
aacctcaggttccaaa

SEQ ID NO: 2186919 - DNA, 17 bp, Homo sapiens
aacctcctttctcttct

SEQ ID NO: 2186920 - DNA, 19 bp, Homo sapiens
aacctcctttctcttctct

SEQ ID NO: 2186921 - DNA, 15 bp, Homo sapiens
aacctctccttcctc

SEQ ID NO: 2186922 - DNA, 16 bp, Homo sapiens
aacctcttctgtattt

SEQ ID NO: 2186923 - DNA, 13 bp, Homo sapiens
aacctgcttttgt

SEQ ID NO: 2186924 - DNA, 12 bp, Homo sapiens
aacctttaaaaa

SEQ ID NO: 2186925 - DNA, 20 bp, Homo sapiens
aacctttaaaaatgtataat

SEQ ID NO: 2186926 - DNA, 15 bp, Homo sapiens
aacctttccatttta

SEQ ID NO: 2186927 - DNA, 16 bp, Homo sapiens
aacgcaaacctctcct

SEQ ID NO: 2186928 - DNA, 12 bp, Homo sapiens
aaaaaacaagtc

SEQ ID NO: 2186929 - DNA, 11 bp, Homo sapiens
aaaaacatgtc

SEQ ID NO: 2186930 - DNA, 20 bp, Homo sapiens
aaaaagatgttcagtcattt

SEQ ID NO: 2186931 - DNA, 11 bp, Homo sapiens
aaaaataaatc

SEQ ID NO: 2186932 - DNA, 15 bp, Homo sapiens
aaaaataaatcaagg

SEQ ID NO: 2186933 - DNA, 13 bp, Homo sapiens
aagtatctgtacc

SEQ ID NO: 2186934 - DNA, 18 bp, Homo sapiens
aagtatggcagtgggaga

SEQ ID NO: 2186935 - DNA, 21 bp, Homo sapiens
aagtcatgaagctcagtttgg

SEQ ID NO: 2186936 - DNA, 20 bp, Homo sapiens
aagtcccaccggttgcttct

SEQ ID NO: 2186937 - DNA, 11 bp, Homo sapiens
aagtccctgcc

SEQ ID NO: 2186938 - DNA, 18 bp, Homo sapiens
aagtctgtgcctggagct

SEQ ID NO: 2186939 - DNA, 19 bp, Homo sapiens
aagtctttagtgttcaaat

SEQ ID NO: 2186940 - DNA, 19 bp, Homo sapiens
aagtgagcaaacctgcccc

SEQ ID NO: 2186941 - DNA, 12 bp, Homo sapiens
aagtgcaaagct

SEQ ID NO: 2186942 - DNA, 14 bp, Homo sapiens
aagtgcaaagctgc

SEQ ID NO: 2186943 - DNA, 15 bp, Homo sapiens
aagtgcaaagctgct

SEQ ID NO: 2186944 - DNA, 23 bp, Homo sapiens
aagtgcacctacaccaactgctc

SEQ ID NO: 2186945 - DNA, 20 bp, Homo sapiens
aagtgccagatcaaaattgt

SEQ ID NO: 2186946 - DNA, 23 bp, Homo sapiens
aagtgcttttaaactggagaggc

SEQ ID NO: 2186947 - DNA, 18 bp, Homo sapiens
aagtggaattaaaggaat

SEQ ID NO: 2186948 - DNA, 17 bp, Homo sapiens
aagtgggagtgggagag

SEQ ID NO: 2186949 - DNA, 14 bp, Homo sapiens
aagtggtacaggaa

SEQ ID NO: 2186950 - DNA, 18 bp, Homo sapiens
aagtgtctacatgtgcca

SEQ ID NO: 2186951 - DNA, 14 bp, Homo sapiens
aagtgttccttgct

SEQ ID NO: 2186952 - DNA, 22 bp, Homo sapiens
aagttaaagtcacacatttcta

SEQ ID NO: 2186953 - DNA, 16 bp, Homo sapiens
aagttactatcctggc

SEQ ID NO: 2186954 - DNA, 18 bp, Homo sapiens
aagttactatcctggctt

SEQ ID NO: 2186955 - DNA, 23 bp, Homo sapiens
aagttagtttgtatatattatta

SEQ ID NO: 2186956 - DNA, 21 bp, Homo sapiens
aagtttcagtaatagctgaac

SEQ ID NO: 2186957 - DNA, 15 bp, Homo sapiens
aagtttctttagaaa

SEQ ID NO: 2186958 - DNA, 17 bp, Homo sapiens
aagtttttctctttttc

SEQ ID NO: 2186959 - DNA, 18 bp, Homo sapiens
aagtttttgccattataa

SEQ ID NO: 2186960 - DNA, 22 bp, Homo sapiens
aagtttttgccattataatttt

SEQ ID NO: 2186961 - DNA, 20 bp, Homo sapiens
aataaaacccagcatgtaca

SEQ ID NO: 2186962 - DNA, 17 bp, Homo sapiens
aataaaattcattccat

SEQ ID NO: 2186963 - DNA, 18 bp, Homo sapiens
aataaaattcattccatt

SEQ ID NO: 2186964 - DNA, 22 bp, Homo sapiens
aataaaattcattccatttgct

SEQ ID NO: 2186965 - DNA, 12 bp, Homo sapiens
aataaagccttt

SEQ ID NO: 2186966 - DNA, 20 bp, Homo sapiens
aataaaggtttcgttgcatg

SEQ ID NO: 2186967 - DNA, 16 bp, Homo sapiens
aataaagtactgcaaa

SEQ ID NO: 2186968 - DNA, 14 bp, Homo sapiens
aataaatctgccat

SEQ ID NO: 2186969 - DNA, 23 bp, Homo sapiens
aataatgacgtattgtgaaattt

SEQ ID NO: 2186970 - DNA, 20 bp, Homo sapiens
aataatggttactcatttta

SEQ ID NO: 2186971 - DNA, 17 bp, Homo sapiens
aataattgtggagagga

SEQ ID NO: 2186972 - DNA, 21 bp, Homo sapiens
aataattttttagttaaaatc

SEQ ID NO: 2186973 - DNA, 21 bp, Homo sapiens
aatacaaaaaattagccgagc

SEQ ID NO: 2186974 - DNA, 15 bp, Homo sapiens
aatacaaaaagccaa

SEQ ID NO: 2186975 - DNA, 17 bp, Homo sapiens
aatacaattcaaacaat

SEQ ID NO: 2186976 - DNA, 22 bp, Homo sapiens
aatacaattcaaacaattcaat

SEQ ID NO: 2186977 - DNA, 17 bp, Homo sapiens
aatacattaacaagctc

SEQ ID NO: 2186978 - DNA, 18 bp, Homo sapiens
aataccaccaacaaatat

SEQ ID NO: 2186979 - DNA, 19 bp, Homo sapiens
aataccaccaacaaatata

SEQ ID NO: 2186980 - DNA, 13 bp, Homo sapiens
aatactaataaaa

SEQ ID NO: 2186981 - DNA, 15 bp, Homo sapiens
aatactgtacataga

SEQ ID NO: 2186982 - DNA, 13 bp, Homo sapiens
aatacttaataaa

SEQ ID NO: 2186983 - DNA, 15 bp, Homo sapiens
aatacttgagaaatt

SEQ ID NO: 2186984 - DNA, 15 bp, Homo sapiens
aatagaataaataca

SEQ ID NO: 2186985 - DNA, 18 bp, Homo sapiens
aatagaataaatacaata

SEQ ID NO: 2186986 - DNA, 15 bp, Homo sapiens
aatagctacagctgt

SEQ ID NO: 2186987 - DNA, 12 bp, Homo sapiens
aatagctgaacc

SEQ ID NO: 2186988 - DNA, 22 bp, Homo sapiens
aatagctgaacctgttcaaaat

SEQ ID NO: 2186989 - DNA, 18 bp, Homo sapiens
aatagcttgtacacatat

SEQ ID NO: 2186990 - DNA, 16 bp, Homo sapiens
aataggcattaaatgc

SEQ ID NO: 2186991 - DNA, 20 bp, Homo sapiens
aataggcattaaatgcaaaa

SEQ ID NO: 2186992 - DNA, 23 bp, Homo sapiens
aataggttttccctgttctggac

SEQ ID NO: 2186993 - DNA, 16 bp, Homo sapiens
aatagtggccagacca

SEQ ID NO: 2186994 - DNA, 14 bp, Homo sapiens
aatataagtttctt

SEQ ID NO: 2186995 - DNA, 13 bp, Homo sapiens
aatatatataata

SEQ ID NO: 2186996 - DNA, 14 bp, Homo sapiens
aatatcaaaaggaa

SEQ ID NO: 2186997 - DNA, 20 bp, Homo sapiens
aatatcactttgtattctct

SEQ ID NO: 2186998 - DNA, 11 bp, Homo sapiens
aatatgaaatt

SEQ ID NO: 2186999 - DNA, 21 bp, Homo sapiens
aatatgaaattttaccatttt

SEQ ID NO: 2187000 - DNA, 14 bp, Homo sapiens
aatattaaaaatta

SEQ ID NO: 2187001 - DNA, 13 bp, Homo sapiens
aatattaatttat

SEQ ID NO: 2187002 - DNA, 18 bp, Homo sapiens
aatattaatttatatttg

SEQ ID NO: 2187003 - DNA, 19 bp, Homo sapiens
aatatttataattaaagaa

SEQ ID NO: 2187004 - DNA, 18 bp, Homo sapiens
aatcaagtctgtgaaagt

SEQ ID NO: 2187005 - DNA, 21 bp, Homo sapiens
aatcaatactttgaacacaaa

SEQ ID NO: 2187006 - DNA, 22 bp, Homo sapiens
aatcaatcacttgaaagtgaac

SEQ ID NO: 2187007 - DNA, 16 bp, Homo sapiens
aatcacaaaagtatat

SEQ ID NO: 2187008 - DNA, 21 bp, Homo sapiens
aatcaggcatttttccaaagg

SEQ ID NO: 2187009 - DNA, 16 bp, Homo sapiens
aatcagtgtagcccca

SEQ ID NO: 2187010 - DNA, 17 bp, Homo sapiens
aatcagtgtagccccaa

SEQ ID NO: 2187011 - DNA, 19 bp, Homo sapiens
aatcagttttgtgtacagt

SEQ ID NO: 2187012 - DNA, 21 bp, Homo sapiens
aatcattttagaattaaaatt

SEQ ID NO: 2187013 - DNA, 15 bp, Homo sapiens
aatccatgtgctgct

SEQ ID NO: 2187014 - DNA, 18 bp, Homo sapiens
aatccccttctcatcact

SEQ ID NO: 2187015 - DNA, 18 bp, Homo sapiens
aatcccttaacagttgta

SEQ ID NO: 2187016 - DNA, 15 bp, Homo sapiens
aatcctgccactgtt

SEQ ID NO: 2187017 - DNA, 17 bp, Homo sapiens
aatcctgccactgtttt

SEQ ID NO: 2187018 - DNA, 16 bp, Homo sapiens
aatcgaggctgtgtgt

SEQ ID NO: 2187019 - DNA, 19 bp, Homo sapiens
aatctcctctttgtgaaat

SEQ ID NO: 2187020 - DNA, 14 bp, Homo sapiens
aatctctgttctgc

SEQ ID NO: 2187021 - DNA, 21 bp, Homo sapiens
aatctctgttctgctcccaga

SEQ ID NO: 2187022 - DNA, 17 bp, Homo sapiens
aatctgattttcaaaaa

SEQ ID NO: 2187023 - DNA, 21 bp, Homo sapiens
aatctgccatttcaaatttct

SEQ ID NO: 2187024 - DNA, 14 bp, Homo sapiens
aatcttataattgt

SEQ ID NO: 2187025 - DNA, 19 bp, Homo sapiens
aatcttcaaggtgtaaaat

SEQ ID NO: 2187026 - DNA, 21 bp, Homo sapiens
aatcttcaaggtgtaaaatat

SEQ ID NO: 2187027 - DNA, 14 bp, Homo sapiens
aatgaagaatggtg

SEQ ID NO: 2187028 - DNA, 14 bp, Homo sapiens
aatgaccctgtcaa

SEQ ID NO: 2187029 - DNA, 15 bp, Homo sapiens
aatgaccctgtcaag

SEQ ID NO: 2187030 - DNA, 22 bp, Homo sapiens
aatgacggctaccacactcatg

SEQ ID NO: 2187031 - DNA, 20 bp, Homo sapiens
aatgacgtattgtgaaattt

SEQ ID NO: 2187032 - DNA, 23 bp, Homo sapiens
aatgacgtattgtgaaatttgtt

SEQ ID NO: 2187033 - DNA, 18 bp, Homo sapiens
aatgagacttgttttccc

SEQ ID NO: 2187034 - DNA, 21 bp, Homo sapiens
aatgatactgtctaagaataa

SEQ ID NO: 2187035 - DNA, 15 bp, Homo sapiens
aatgatgtagacatt

SEQ ID NO: 2187036 - DNA, 12 bp, Homo sapiens
aatgcatttaaa

SEQ ID NO: 2187037 - DNA, 20 bp, Homo sapiens
aatgcatttaaactcatttg

SEQ ID NO: 2187038 - DNA, 21 bp, Homo sapiens
aatgcatttaaactcatttga

SEQ ID NO: 2187039 - DNA, 22 bp, Homo sapiens
aatgcccttacacttactgttg

SEQ ID NO: 2187040 - DNA, 22 bp, Homo sapiens
aatggaacctcctttctcttct

SEQ ID NO: 2187041 - DNA, 13 bp, Homo sapiens
aatggactgcacc

SEQ ID NO: 2187042 - DNA, 19 bp, Homo sapiens
aatggagtagacccctggc

SEQ ID NO: 2187043 - DNA, 21 bp, Homo sapiens
aatggagtagacccctggctg

SEQ ID NO: 2187044 - DNA, 18 bp, Homo sapiens
aatggctcgtgggctctg

SEQ ID NO: 2187045 - DNA, 21 bp, Homo sapiens
aatggctcgtgggctctggct

SEQ ID NO: 2187046 - DNA, 18 bp, Homo sapiens
aatgggactgatgtcatc

SEQ ID NO: 2187047 - DNA, 13 bp, Homo sapiens
aatgtagccatgg

SEQ ID NO: 2187048 - DNA, 23 bp, Homo sapiens
aatgtcccccacctcttttccta

SEQ ID NO: 2187049 - DNA, 12 bp, Homo sapiens
aatgtgaagaca

SEQ ID NO: 2187050 - DNA, 15 bp, Homo sapiens
aatgtgtatgtctgg

SEQ ID NO: 2187051 - DNA, 14 bp, Homo sapiens
aatgttaaatgcaa

SEQ ID NO: 2187052 - DNA, 13 bp, Homo sapiens
aatgttaataaag

SEQ ID NO: 2187053 - DNA, 15 bp, Homo sapiens
aatgttaataaaggt

SEQ ID NO: 2187054 - DNA, 22 bp, Homo sapiens
aatgtttgctttacgtattttg

SEQ ID NO: 2187055 - DNA, 15 bp, Homo sapiens
actaataaaatacat

SEQ ID NO: 2187056 - DNA, 16 bp, Homo sapiens
actaatcaatactttg

SEQ ID NO: 2187057 - DNA, 23 bp, Homo sapiens
actaattcagggaatatatattt

SEQ ID NO: 2187058 - DNA, 22 bp, Homo sapiens
actacagggtgaggtgcttgcc

SEQ ID NO: 2187059 - DNA, 17 bp, Homo sapiens
actacaggtgagtgcca

SEQ ID NO: 2187060 - DNA, 18 bp, Homo sapiens
actaccacttatttctaa

SEQ ID NO: 2187061 - DNA, 19 bp, Homo sapiens
actactatttttctttcca

SEQ ID NO: 2187062 - DNA, 19 bp, Homo sapiens
actagaccatttttaaatg

SEQ ID NO: 2187063 - DNA, 23 bp, Homo sapiens
actagcctccctctcctctgtcc

SEQ ID NO: 2187064 - DNA, 21 bp, Homo sapiens
actaggcagttagagatgcct

SEQ ID NO: 2187065 - DNA, 14 bp, Homo sapiens
actaggctgggtgc

SEQ ID NO: 2187066 - DNA, 22 bp, Homo sapiens
actaggctgggtgcccacagcc

SEQ ID NO: 2187067 - DNA, 17 bp, Homo sapiens
actatagccatttgccc

SEQ ID NO: 2187068 - DNA, 17 bp, Homo sapiens
actatttttctttccaa

SEQ ID NO: 2187069 - DNA, 13 bp, Homo sapiens
actcaaaggactg

SEQ ID NO: 2187070 - DNA, 15 bp, Homo sapiens
actcaaccctctcag

SEQ ID NO: 2187071 - DNA, 16 bp, Homo sapiens
actcaatttctcccca

SEQ ID NO: 2187072 - DNA, 18 bp, Homo sapiens
actcacagagacacaggg

SEQ ID NO: 2187073 - DNA, 18 bp, Homo sapiens
actcacatgctggacagg

SEQ ID NO: 2187074 - DNA, 20 bp, Homo sapiens
actcagctattaagaaaatc

SEQ ID NO: 2187075 - DNA, 17 bp, Homo sapiens
actcatactgtgctgga

SEQ ID NO: 2187076 - DNA, 17 bp, Homo sapiens
actcattaatttctctc

SEQ ID NO: 2187077 - DNA, 16 bp, Homo sapiens
actcattgaaatgtaa

SEQ ID NO: 2187078 - DNA, 19 bp, Homo sapiens
actcatttatttccatatt

SEQ ID NO: 2187079 - DNA, 22 bp, Homo sapiens
actcatttatttccatattaaa

SEQ ID NO: 2187080 - DNA, 19 bp, Homo sapiens
actccaggaaggggctgga

SEQ ID NO: 2187081 - DNA, 13 bp, Homo sapiens
actcccaaagagc

SEQ ID NO: 2187082 - DNA, 18 bp, Homo sapiens
actcccaaagagctgcct

SEQ ID NO: 2187083 - DNA, 19 bp, Homo sapiens
actcccaaagagctgccta

SEQ ID NO: 2187084 - DNA, 11 bp, Homo sapiens
actcccctcca

SEQ ID NO: 2187085 - DNA, 14 bp, Homo sapiens
actccgcaaatatc

SEQ ID NO: 2187086 - DNA, 16 bp, Homo sapiens
actcctacacctaact

SEQ ID NO: 2187087 - DNA, 16 bp, Homo sapiens
actcctgattgctctg

SEQ ID NO: 2187088 - DNA, 23 bp, Homo sapiens
actcctgattgctctggaagcct

SEQ ID NO: 2187089 - DNA, 13 bp, Homo sapiens
actcctgctggta

SEQ ID NO: 2187090 - DNA, 18 bp, Homo sapiens
actcctgctggtacctgc

SEQ ID NO: 2187091 - DNA, 15 bp, Homo sapiens
actcctgggctcaag

SEQ ID NO: 2187092 - DNA, 21 bp, Homo sapiens
actctcccagaggctcctgga

SEQ ID NO: 2187093 - DNA, 22 bp, Homo sapiens
actctctagttccctcagtgtg

SEQ ID NO: 2187094 - DNA, 14 bp, Homo sapiens
actctgcccaccct

SEQ ID NO: 2187095 - DNA, 12 bp, Homo sapiens
actctttgagag

SEQ ID NO: 2187096 - DNA, 21 bp, Homo sapiens
actctttgctttgtagtttgc

SEQ ID NO: 2187097 - DNA, 23 bp, Homo sapiens
actctttgctttgtagtttgctt

SEQ ID NO: 2187098 - DNA, 13 bp, Homo sapiens
actgaaatttaca

SEQ ID NO: 2187099 - DNA, 19 bp, Homo sapiens
actgaaccgctacaagagg

SEQ ID NO: 2187100 - DNA, 20 bp, Homo sapiens
actgaagtgaatacatggta

SEQ ID NO: 2187101 - DNA, 18 bp, Homo sapiens
actgaccctcccttcctg

SEQ ID NO: 2187102 - DNA, 13 bp, Homo sapiens
actgagtgggaag

SEQ ID NO: 2187103 - DNA, 14 bp, Homo sapiens
actgagtgggaagc

SEQ ID NO: 2187104 - DNA, 15 bp, Homo sapiens
actgagtgggaagcc

SEQ ID NO: 2187105 - DNA, 21 bp, Homo sapiens
actgatatacttgagtgtgca

SEQ ID NO: 2187106 - DNA, 23 bp, Homo sapiens
actgatatacttgagtgtgcaag

SEQ ID NO: 2187107 - DNA, 19 bp, Homo sapiens
actgatcatttgcagctgc

SEQ ID NO: 2187108 - DNA, 22 bp, Homo sapiens
actgatttacaagactaacctt

SEQ ID NO: 2187109 - DNA, 14 bp, Homo sapiens
actgattttatgga

SEQ ID NO: 2187110 - DNA, 20 bp, Homo sapiens
actgcacataatttgcataa

SEQ ID NO: 2187111 - DNA, 14 bp, Homo sapiens
actgcaccttgtga

SEQ ID NO: 2187112 - DNA, 14 bp, Homo sapiens
actgccaagccaga

SEQ ID NO: 2187113 - DNA, 18 bp, Homo sapiens
actgccagaagtgtgttt

SEQ ID NO: 2187114 - DNA, 21 bp, Homo sapiens
actgccctctgttcagtaaca

SEQ ID NO: 2187115 - DNA, 17 bp, Homo sapiens
actgcctatacccctca

SEQ ID NO: 2187116 - DNA, 17 bp, Homo sapiens
actgcctggcctggcac

SEQ ID NO: 2187117 - DNA, 14 bp, Homo sapiens
actgcgaactctca

SEQ ID NO: 2187118 - DNA, 17 bp, Homo sapiens
actgctaaatactgtac

SEQ ID NO: 2187119 - DNA, 20 bp, Homo sapiens
actgctaaatactgtacata

SEQ ID NO: 2187120 - DNA, 19 bp, Homo sapiens
actgctgccccaaaggaag

SEQ ID NO: 2187121 - DNA, 13 bp, Homo sapiens
actggacagcggt

SEQ ID NO: 2187122 - DNA, 21 bp, Homo sapiens
actggagacaatgcagatgcc

SEQ ID NO: 2187123 - DNA, 21 bp, Homo sapiens
actggcaggatcacagctcac

SEQ ID NO: 2187124 - DNA, 10 bp, Homo sapiens
actggctgta

SEQ ID NO: 2187125 - DNA, 20 bp, Homo sapiens
actggcttctgcttgtcatc

SEQ ID NO: 2187126 - DNA, 19 bp, Homo sapiens
actggctttgtcccacagc

SEQ ID NO: 2187127 - DNA, 20 bp, Homo sapiens
actggctttgtcccacagct

SEQ ID NO: 2187128 - DNA, 22 bp, Homo sapiens
actggctttgtcccacagcttg

SEQ ID NO: 2187129 - DNA, 21 bp, Homo sapiens
actgggggtgccaaccacctc

SEQ ID NO: 2187130 - DNA, 21 bp, Homo sapiens
actggtttgtatgatgtatta

SEQ ID NO: 2187131 - DNA, 22 bp, Homo sapiens
actggtttgtatgatgtattag

SEQ ID NO: 2187132 - DNA, 12 bp, Homo sapiens
actgtacataga

SEQ ID NO: 2187133 - DNA, 17 bp, Homo sapiens
actgtactccagcctgg

SEQ ID NO: 2187134 - DNA, 19 bp, Homo sapiens
actgtcagaataaagaaca

SEQ ID NO: 2187135 - DNA, 14 bp, Homo sapiens
actgtctaagaata

SEQ ID NO: 2187136 - DNA, 22 bp, Homo sapiens
actgtctaagaataatgacgta

SEQ ID NO: 2187137 - DNA, 17 bp, Homo sapiens
actgtgacctaagaaca

SEQ ID NO: 2187138 - DNA, 15 bp, Homo sapiens
actgtgagttctgat

SEQ ID NO: 2187139 - DNA, 16 bp, Homo sapiens
actgtgattactcttt

SEQ ID NO: 2187140 - DNA, 22 bp, Homo sapiens
actgtgattactctttgctttg

SEQ ID NO: 2187141 - DNA, 12 bp, Homo sapiens
actgtgctgatt

SEQ ID NO: 2187142 - DNA, 17 bp, Homo sapiens
actgttgagaaaaaaga

SEQ ID NO: 2187143 - DNA, 14 bp, Homo sapiens
actgtttccacatt

SEQ ID NO: 2187144 - DNA, 14 bp, Homo sapiens
actgtttccctgct

SEQ ID NO: 2187145 - DNA, 15 bp, Homo sapiens
actgtttccctgctg

SEQ ID NO: 2187146 - DNA, 18 bp, Homo sapiens
actgtttgtcttctcccc

SEQ ID NO: 2187147 - DNA, 15 bp, Homo sapiens
acttaaatgttatta

SEQ ID NO: 2187148 - DNA, 18 bp, Homo sapiens
acttaaatgttattatct

SEQ ID NO: 2187149 - DNA, 13 bp, Homo sapiens
acttaacctgctt

SEQ ID NO: 2187150 - DNA, 14 bp, Homo sapiens
acttaagacaaatg

SEQ ID NO: 2187151 - DNA, 23 bp, Homo sapiens
acttaagacaaatgggactgatg

SEQ ID NO: 2187152 - DNA, 12 bp, Homo sapiens
acttaatttcaa

SEQ ID NO: 2187153 - DNA, 24 bp, Homo sapiens
acttactgttgtcctatgggagtc

SEQ ID NO: 2187154 - DNA, 22 bp, Homo sapiens
acttcattctaaaccaaaacag

SEQ ID NO: 2187155 - DNA, 12 bp, Homo sapiens
acttccatttgg

SEQ ID NO: 2187156 - DNA, 20 bp, Homo sapiens
acttccatttggaatcatat

SEQ ID NO: 2187157 - DNA, 22 bp, Homo sapiens
acttccatttggaatcatatgg

SEQ ID NO: 2187158 - DNA, 14 bp, Homo sapiens
acttccctgggcaa

SEQ ID NO: 2187159 - DNA, 22 bp, Homo sapiens
acttcctcttaggatgtttcac

SEQ ID NO: 2187160 - DNA, 15 bp, Homo sapiens
acttcgtaagaacat

SEQ ID NO: 2187161 - DNA, 19 bp, Homo sapiens
acttcgtaagaacatgtta

SEQ ID NO: 2187162 - DNA, 23 bp, Homo sapiens
acttctgtaacgggtcgtgctca

SEQ ID NO: 2187163 - DNA, 12 bp, Homo sapiens
acttgaaaagat

SEQ ID NO: 2187164 - DNA, 18 bp, Homo sapiens
acttgaaaagattgcaaa

SEQ ID NO: 2187165 - DNA, 20 bp, Homo sapiens
acttgaaaagattgcaaagg

SEQ ID NO: 2187166 - DNA, 22 bp, Homo sapiens
acttgaaacttggttcccagaa

SEQ ID NO: 2187167 - DNA, 12 bp, Homo sapiens
acttgagaaatt

SEQ ID NO: 2187168 - DNA, 22 bp, Homo sapiens
acttgggagagggagcaagcct

SEQ ID NO: 2187169 - DNA, 16 bp, Homo sapiens
acttggtaagagggag

SEQ ID NO: 2187170 - DNA, 14 bp, Homo sapiens
acttggttcccaga

SEQ ID NO: 2187171 - DNA, 15 bp, Homo sapiens
acttggttctgaagc

SEQ ID NO: 2187172 - DNA, 12 bp, Homo sapiens
acttgtacagtt

SEQ ID NO: 2187173 - DNA, 21 bp, Homo sapiens
acttgtacagttgactggctt

SEQ ID NO: 2187174 - DNA, 20 bp, Homo sapiens
acttgtgcctcttgggagac

SEQ ID NO: 2187175 - DNA, 12 bp, Homo sapiens
actttaataata

SEQ ID NO: 2187176 - DNA, 22 bp, Homo sapiens
actttagggctaaccagttctc

SEQ ID NO: 2187177 - DNA, 24 bp, Homo sapiens
agagcaacccattaatcttttgta

SEQ ID NO: 2187178 - DNA, 12 bp, Homo sapiens
agagcagcctgg

SEQ ID NO: 2187179 - DNA, 19 bp, Homo sapiens
agagcatccgtctcccctc

SEQ ID NO: 2187180 - DNA, 24 bp, Homo sapiens
agagccaaggcctatgccacctgc

SEQ ID NO: 2187181 - DNA, 19 bp, Homo sapiens
agagcccaatcactgccta

SEQ ID NO: 2187182 - DNA, 14 bp, Homo sapiens
agagccgttcctgg

SEQ ID NO: 2187183 - DNA, 22 bp, Homo sapiens
agagcctccctcaattccccct

SEQ ID NO: 2187184 - DNA, 20 bp, Homo sapiens
agagcctgcccggccggaga

SEQ ID NO: 2187185 - DNA, 21 bp, Homo sapiens
agagctacttgggccatagct

SEQ ID NO: 2187186 - DNA, 18 bp, Homo sapiens
agagctctggagccacct

SEQ ID NO: 2187187 - DNA, 22 bp, Homo sapiens
agagctctggagccacctgtcc

SEQ ID NO: 2187188 - DNA, 11 bp, Homo sapiens
agagctgcctg

SEQ ID NO: 2187189 - DNA, 16 bp, Homo sapiens
agagctgcctggatga

SEQ ID NO: 2187190 - DNA, 12 bp, Homo sapiens
agagctgggtga

SEQ ID NO: 2187191 - DNA, 17 bp, Homo sapiens
agagcttgatgccagta

SEQ ID NO: 2187192 - DNA, 20 bp, Homo sapiens
agaggaagcacaagaagtgg

SEQ ID NO: 2187193 - DNA, 11 bp, Homo sapiens
agaggagagaa

SEQ ID NO: 2187194 - DNA, 20 bp, Homo sapiens
agaggagagaatgagagagt

SEQ ID NO: 2187195 - DNA, 21 bp, Homo sapiens
agaggagagaatgagagagtg

SEQ ID NO: 2187196 - DNA, 11 bp, Homo sapiens
agaggcaccag

SEQ ID NO: 2187197 - DNA, 17 bp, Homo sapiens
agaggcaccaggaagcc

SEQ ID NO: 2187198 - DNA, 15 bp, Homo sapiens
agaggcagaaccctg

SEQ ID NO: 2187199 - DNA, 12 bp, Homo sapiens
agaggccctgga

SEQ ID NO: 2187200 - DNA, 23 bp, Homo sapiens
agaggccctggaggtctccaggg

SEQ ID NO: 2187201 - DNA, 20 bp, Homo sapiens
agaggctaacctcaaaatat

SEQ ID NO: 2187202 - DNA, 11 bp, Homo sapiens
agaggctcctg

SEQ ID NO: 2187203 - DNA, 15 bp, Homo sapiens
agaggctcctggagc

SEQ ID NO: 2187204 - DNA, 16 bp, Homo sapiens
agaggctcctggagcc

SEQ ID NO: 2187205 - DNA, 20 bp, Homo sapiens
agagggaaacgtgccctctg

SEQ ID NO: 2187206 - DNA, 22 bp, Homo sapiens
agagggagaaggagaggctctg

SEQ ID NO: 2187207 - DNA, 23 bp, Homo sapiens
agagggagccggtttgggagaga

SEQ ID NO: 2187208 - DNA, 13 bp, Homo sapiens
agaggggagagga

SEQ ID NO: 2187209 - DNA, 19 bp, Homo sapiens
agaggggcctctggctgcc

SEQ ID NO: 2187210 - DNA, 15 bp, Homo sapiens
agaggtatcctcttt

SEQ ID NO: 2187211 - DNA, 19 bp, Homo sapiens
agaggtatcctctttttgc

SEQ ID NO: 2187212 - DNA, 20 bp, Homo sapiens
agaggtgggaggcccctggt

SEQ ID NO: 2187213 - DNA, 18 bp, Homo sapiens
agaggtggggaagagagc

SEQ ID NO: 2187214 - DNA, 19 bp, Homo sapiens
agaggtggggaagagagcc

SEQ ID NO: 2187215 - DNA, 22 bp, Homo sapiens
agaggtggggaagagagcctgc

SEQ ID NO: 2187216 - DNA, 23 bp, Homo sapiens
agagtaagcacctttagaatatt

SEQ ID NO: 2187217 - DNA, 12 bp, Homo sapiens
agagtcatgagt

SEQ ID NO: 2187218 - DNA, 13 bp, Homo sapiens
agagtgccccacc

SEQ ID NO: 2187219 - DNA, 16 bp, Homo sapiens
agagtgccccacctgc

SEQ ID NO: 2187220 - DNA, 18 bp, Homo sapiens
agagtgccccacctgcca

SEQ ID NO: 2187221 - DNA, 20 bp, Homo sapiens
agagtgggccccgggctgga

SEQ ID NO: 2187222 - DNA, 22 bp, Homo sapiens
agagttcagtaagaccggaagc

SEQ ID NO: 2187223 - DNA, 21 bp, Homo sapiens
agagttctatccccaagctgg

SEQ ID NO: 2187224 - DNA, 20 bp, Homo sapiens
agataaagcactgtttggat

SEQ ID NO: 2187225 - DNA, 18 bp, Homo sapiens
agatacagtgaaatcttt

SEQ ID NO: 2187226 - DNA, 20 bp, Homo sapiens
agatactgattattgagttc

SEQ ID NO: 2187227 - DNA, 12 bp, Homo sapiens
agatacttcagc

SEQ ID NO: 2187228 - DNA, 20 bp, Homo sapiens
agatacttcagctttgtgta

SEQ ID NO: 2187229 - DNA, 16 bp, Homo sapiens
agatacttcctgccct

SEQ ID NO: 2187230 - DNA, 15 bp, Homo sapiens
agatataactgtaca

SEQ ID NO: 2187231 - DNA, 17 bp, Homo sapiens
agatcaacaataaaaaa

SEQ ID NO: 2187232 - DNA, 14 bp, Homo sapiens
agatcagaacattc

SEQ ID NO: 2187233 - DNA, 18 bp, Homo sapiens
agatcagaacattcagct

SEQ ID NO: 2187234 - DNA, 21 bp, Homo sapiens
agatcagaacattcagctctg

SEQ ID NO: 2187235 - DNA, 13 bp, Homo sapiens
agatccccgccac

SEQ ID NO: 2187236 - DNA, 11 bp, Homo sapiens
agatcctgctg

SEQ ID NO: 2187237 - DNA, 14 bp, Homo sapiens
agatcctgctgccg

SEQ ID NO: 2187238 - DNA, 19 bp, Homo sapiens
agatcggggccagaggcag

SEQ ID NO: 2187239 - DNA, 14 bp, Homo sapiens
agatctccaaagct

SEQ ID NO: 2187240 - DNA, 18 bp, Homo sapiens
agatgaaattcaaataac

SEQ ID NO: 2187241 - DNA, 24 bp, Homo sapiens
agatgactgaatttctatggcata

SEQ ID NO: 2187242 - DNA, 21 bp, Homo sapiens
agatgcttaggtgaaggcaga

SEQ ID NO: 2187243 - DNA, 17 bp, Homo sapiens
agatgtatcattaatgt

SEQ ID NO: 2187244 - DNA, 18 bp, Homo sapiens
agatgttccatcctgtac

SEQ ID NO: 2187245 - DNA, 15 bp, Homo sapiens
agatgttggtcttgg

SEQ ID NO: 2187246 - DNA, 23 bp, Homo sapiens
agatgttggtcttggtcatttgc

SEQ ID NO: 2187247 - DNA, 21 bp, Homo sapiens
agattcactgtcttttgattc

SEQ ID NO: 2187248 - DNA, 20 bp, Homo sapiens
agattcccggctggactttt

SEQ ID NO: 2187249 - DNA, 14 bp, Homo sapiens
agattgacaaggta

SEQ ID NO: 2187250 - DNA, 21 bp, Homo sapiens
agattgcaaagggacattgaa

SEQ ID NO: 2187251 - DNA, 20 bp, Homo sapiens
agattgtgtctggtcgtttg

SEQ ID NO: 2187252 - DNA, 22 bp, Homo sapiens
agcaaagggtctgtggccagtt

SEQ ID NO: 2187253 - DNA, 19 bp, Homo sapiens
agcaaatgagatgtatgcc

SEQ ID NO: 2187254 - DNA, 21 bp, Homo sapiens
agcaaatgagatgtatgccca

SEQ ID NO: 2187255 - DNA, 12 bp, Homo sapiens
agcaaatttcat

SEQ ID NO: 2187256 - DNA, 12 bp, Homo sapiens
agcaacatgaat

SEQ ID NO: 2187257 - DNA, 20 bp, Homo sapiens
agcaacgcctgccttctggg

SEQ ID NO: 2187258 - DNA, 22 bp, Homo sapiens
agcaacgcctgccttctgggca

SEQ ID NO: 2187259 - DNA, 14 bp, Homo sapiens
agcaactggaaaag

SEQ ID NO: 2187260 - DNA, 22 bp, Homo sapiens
agcaagacacgtggcctcgtga

SEQ ID NO: 2187261 - DNA, 14 bp, Homo sapiens
agcaatatcaaaag

SEQ ID NO: 2187262 - DNA, 17 bp, Homo sapiens
agcaatcatttcccctc

SEQ ID NO: 2187263 - DNA, 19 bp, Homo sapiens
agcaatcatttcccctccc

SEQ ID NO: 2187264 - DNA, 17 bp, Homo sapiens
agcaatcctcctgagtg

SEQ ID NO: 2187265 - DNA, 16 bp, Homo sapiens
agcacaaacttctgta

SEQ ID NO: 2187266 - DNA, 14 bp, Homo sapiens
agcacaagaagtgg

SEQ ID NO: 2187267 - DNA, 18 bp, Homo sapiens
agcacaagaagtgggagt

SEQ ID NO: 2187268 - DNA, 15 bp, Homo sapiens
agcacatagatgtct

SEQ ID NO: 2187269 - DNA, 16 bp, Homo sapiens
agcacatatggaattt

SEQ ID NO: 2187270 - DNA, 18 bp, Homo sapiens
agcacatgcactactgaa

SEQ ID NO: 2187271 - DNA, 23 bp, Homo sapiens
agcaccaaaaaactaaagcagtt

SEQ ID NO: 2187272 - DNA, 13 bp, Homo sapiens
agcaccagcagtg

SEQ ID NO: 2187273 - DNA, 19 bp, Homo sapiens
agcacctcctctctgctgg

SEQ ID NO: 2187274 - DNA, 15 bp, Homo sapiens
agcagagccgttcct

SEQ ID NO: 2187275 - DNA, 16 bp, Homo sapiens
agcagccctggagtca

SEQ ID NO: 2187276 - DNA, 13 bp, Homo sapiens
agcagcccttgct

SEQ ID NO: 2187277 - DNA, 16 bp, Homo sapiens
agcagctccgcctggc

SEQ ID NO: 2187278 - DNA, 15 bp, Homo sapiens
agcagcttgctgcac

SEQ ID NO: 2187279 - DNA, 13 bp, Homo sapiens
agcaggcccagct

SEQ ID NO: 2187280 - DNA, 18 bp, Homo sapiens
agcaggttccccaagggc

SEQ ID NO: 2187281 - DNA, 21 bp, Homo sapiens
agcaggttccccaagggccct

SEQ ID NO: 2187282 - DNA, 22 bp, Homo sapiens
agcaggttccccaagggccctg

SEQ ID NO: 2187283 - DNA, 12 bp, Homo sapiens
agcagtggcctt

SEQ ID NO: 2187284 - DNA, 20 bp, Homo sapiens
agcagtgtttaaaaaatgag

SEQ ID NO: 2187285 - DNA, 15 bp, Homo sapiens
agcagtttcccagaa

SEQ ID NO: 2187286 - DNA, 17 bp, Homo sapiens
agcagtttgagcttgct

SEQ ID NO: 2187287 - DNA, 20 bp, Homo sapiens
agcatatattcatacctgtt

SEQ ID NO: 2187288 - DNA, 15 bp, Homo sapiens
agcatccacctcctt

SEQ ID NO: 2187289 - DNA, 18 bp, Homo sapiens
agcatccacctccttctc

SEQ ID NO: 2187290 - DNA, 17 bp, Homo sapiens
agcatggtgcatgccgc

SEQ ID NO: 2187291 - DNA, 11 bp, Homo sapiens
agcatgtacaa

SEQ ID NO: 2187292 - DNA, 20 bp, Homo sapiens
agcatgtttggcctatttca

SEQ ID NO: 2187293 - DNA, 23 bp, Homo sapiens
agcatttagcttgttccactgca

SEQ ID NO: 2187294 - DNA, 18 bp, Homo sapiens
agcattttctacacagcg

SEQ ID NO: 2187295 - DNA, 15 bp, Homo sapiens
agcattttgtgtctt

SEQ ID NO: 2187296 - DNA, 23 bp, Homo sapiens
agcattttgtgtcttaagaaaaa

SEQ ID NO: 2187297 - DNA, 21 bp, Homo sapiens
agccaagacccaacaggtgct

SEQ ID NO: 2187298 - DNA, 17 bp, Homo sapiens
agtccaggtcgggctca

SEQ ID NO: 2187299 - DNA, 18 bp, Homo sapiens
agtccaggtcgggctcag

SEQ ID NO: 2187300 - DNA, 15 bp, Homo sapiens
agtcctccctgctca

SEQ ID NO: 2187301 - DNA, 19 bp, Homo sapiens
agtcctccctgctcagctg

SEQ ID NO: 2187302 - DNA, 21 bp, Homo sapiens
agtcctccctgctcagctggc

SEQ ID NO: 2187303 - DNA, 14 bp, Homo sapiens
agtcctgctctcta

SEQ ID NO: 2187304 - DNA, 20 bp, Homo sapiens
agtcctgctctctacccagc

SEQ ID NO: 2187305 - DNA, 15 bp, Homo sapiens
agtctcaggaggagg

SEQ ID NO: 2187306 - DNA, 14 bp, Homo sapiens
agtctcctgtatca

SEQ ID NO: 2187307 - DNA, 16 bp, Homo sapiens
agtctcctgtatcatt

SEQ ID NO: 2187308 - DNA, 15 bp, Homo sapiens
agtctctccctgggg

SEQ ID NO: 2187309 - DNA, 18 bp, Homo sapiens
agtctgtcacccaggctg

SEQ ID NO: 2187310 - DNA, 17 bp, Homo sapiens
agtctgtgcctggagct

SEQ ID NO: 2187311 - DNA, 22 bp, Homo sapiens
agtctgtgcctggagctcctgg

SEQ ID NO: 2187312 - DNA, 21 bp, Homo sapiens
agtctgtgtgctgtggttcct

SEQ ID NO: 2187313 - DNA, 23 bp, Homo sapiens
agtctgtgtgctgtggttcctgg

SEQ ID NO: 2187314 - DNA, 16 bp, Homo sapiens
agtcttcaagggctgc

SEQ ID NO: 2187315 - DNA, 17 bp, Homo sapiens
agtcttccatcagcagt

SEQ ID NO: 2187316 - DNA, 17 bp, Homo sapiens
agtcttccctagggctg

SEQ ID NO: 2187317 - DNA, 17 bp, Homo sapiens
agtcttggggcaggatg

SEQ ID NO: 2187318 - DNA, 17 bp, Homo sapiens
agtgaacaaatttcaaa

SEQ ID NO: 2187319 - DNA, 23 bp, Homo sapiens
agtgaagtatgcactaatcaata

SEQ ID NO: 2187320 - DNA, 21 bp, Homo sapiens
agtgactaccacttatttcta

SEQ ID NO: 2187321 - DNA, 22 bp, Homo sapiens
agtgactaccacttatttctaa

SEQ ID NO: 2187322 - DNA, 15 bp, Homo sapiens
agtgactcctgctgg

SEQ ID NO: 2187323 - DNA, 16 bp, Homo sapiens
agtgactcctgctggt

SEQ ID NO: 2187324 - DNA, 20 bp, Homo sapiens
agtgacttagttcttagaag

SEQ ID NO: 2187325 - DNA, 13 bp, Homo sapiens
agtgagacacaga

SEQ ID NO: 2187326 - DNA, 24 bp, Homo sapiens
agtgagcttgtaattgcaccactg

SEQ ID NO: 2187327 - DNA, 11 bp, Homo sapiens
agtgatggcat

SEQ ID NO: 2187328 - DNA, 22 bp, Homo sapiens
agtgatggcattactctgcact

SEQ ID NO: 2187329 - DNA, 12 bp, Homo sapiens
agtgatgggagt

SEQ ID NO: 2187330 - DNA, 19 bp, Homo sapiens
agtgatttgctatcatata

SEQ ID NO: 2187331 - DNA, 22 bp, Homo sapiens
agtgatttgctatcatatatta

SEQ ID NO: 2187332 - DNA, 23 bp, Homo sapiens
agtgatttttagtaacctttaaa

SEQ ID NO: 2187333 - DNA, 11 bp, Homo sapiens
agtgcaaagct

SEQ ID NO: 2187334 - DNA, 12 bp, Homo sapiens
agtgcaaagctg

SEQ ID NO: 2187335 - DNA, 16 bp, Homo sapiens
agtgcaagcaaagcag

SEQ ID NO: 2187336 - DNA, 18 bp, Homo sapiens
agtgccaccacactcagc

SEQ ID NO: 2187337 - DNA, 10 bp, Homo sapiens
agtgccaggc

SEQ ID NO: 2187338 - DNA, 20 bp, Homo sapiens
agtgcccagtgatggcatta

SEQ ID NO: 2187339 - DNA, 13 bp, Homo sapiens
agtgccccacctg

SEQ ID NO: 2187340 - DNA, 17 bp, Homo sapiens
agtgccccacctgccac

SEQ ID NO: 2187341 - DNA, 16 bp, Homo sapiens
agtgctcagttccaat

SEQ ID NO: 2187342 - DNA, 18 bp, Homo sapiens
agtgctgagattacaggt

SEQ ID NO: 2187343 - DNA, 18 bp, Homo sapiens
agtgctggaatggggacc

SEQ ID NO: 2187344 - DNA, 18 bp, Homo sapiens
agtggaaagattgtgtct

SEQ ID NO: 2187345 - DNA, 13 bp, Homo sapiens
agtggagccctca

SEQ ID NO: 2187346 - DNA, 15 bp, Homo sapiens
agtggatagatgccc

SEQ ID NO: 2187347 - DNA, 11 bp, Homo sapiens
agtggccagac

SEQ ID NO: 2187348 - DNA, 21 bp, Homo sapiens
agtggccagaccagagctctg

SEQ ID NO: 2187349 - DNA, 22 bp, Homo sapiens
agtggccagaccagagctctgg

SEQ ID NO: 2187350 - DNA, 23 bp, Homo sapiens
agtggcctggctccgctgtgtgg

SEQ ID NO: 2187351 - DNA, 16 bp, Homo sapiens
agtggctcatgcctgt

SEQ ID NO: 2187352 - DNA, 17 bp, Homo sapiens
agtgggaagcccatcct

SEQ ID NO: 2187353 - DNA, 21 bp, Homo sapiens
agtgggaagcccatcctgacc

SEQ ID NO: 2187354 - DNA, 11 bp, Homo sapiens
agtgggagagg

SEQ ID NO: 2187355 - DNA, 13 bp, Homo sapiens
agtgggagaggaa

SEQ ID NO: 2187356 - DNA, 14 bp, Homo sapiens
agtgggagaggaag

SEQ ID NO: 2187357 - DNA, 17 bp, Homo sapiens
agtgggagtgggagagg

SEQ ID NO: 2187358 - DNA, 21 bp, Homo sapiens
agtggggatgaggtcaccagg

SEQ ID NO: 2187359 - DNA, 12 bp, Homo sapiens
agtggggctggg

SEQ ID NO: 2187360 - DNA, 17 bp, Homo sapiens
agtggggtcgtgaggca

SEQ ID NO: 2187361 - DNA, 13 bp, Homo sapiens
agtgggtgagaaa

SEQ ID NO: 2187362 - DNA, 15 bp, Homo sapiens
agtgggtgagaaatt

SEQ ID NO: 2187363 - DNA, 14 bp, Homo sapiens
agtggtggctctga

SEQ ID NO: 2187364 - DNA, 15 bp, Homo sapiens
agtggttgcctgggg

SEQ ID NO: 2187365 - DNA, 13 bp, Homo sapiens
agtggtttgcttt

SEQ ID NO: 2187366 - DNA, 18 bp, Homo sapiens
agtgtcatccaccagtgt

SEQ ID NO: 2187367 - DNA, 18 bp, Homo sapiens
agtgtgcaagcaaagaac

SEQ ID NO: 2187368 - DNA, 19 bp, Homo sapiens
agtgtgcaagcaaagaacc

SEQ ID NO: 2187369 - DNA, 20 bp, Homo sapiens
agtgtgtcctgtgtaaatta

SEQ ID NO: 2187370 - DNA, 21 bp, Homo sapiens
agtgtgtgggggtctgggagg

SEQ ID NO: 2187371 - DNA, 17 bp, Homo sapiens
agtgtgtttgtgagtat

SEQ ID NO: 2187372 - DNA, 20 bp, Homo sapiens
agtgtgtttgtgagtatgtg

SEQ ID NO: 2187373 - DNA, 10 bp, Homo sapiens
agttaaaatc

SEQ ID NO: 2187374 - DNA, 15 bp, Homo sapiens
agttactatcctggc

SEQ ID NO: 2187375 - DNA, 17 bp, Homo sapiens
agttactatcctggctt

SEQ ID NO: 2187376 - DNA, 14 bp, Homo sapiens
agttactgttcatg

SEQ ID NO: 2187377 - DNA, 15 bp, Homo sapiens
agttactgttcatgg

SEQ ID NO: 2187378 - DNA, 14 bp, Homo sapiens
agttagagatgcct

SEQ ID NO: 2187379 - DNA, 18 bp, Homo sapiens
agttagagatgcctccct

SEQ ID NO: 2187380 - DNA, 21 bp, Homo sapiens
agttagataaaaataaaatgt

SEQ ID NO: 2187381 - DNA, 15 bp, Homo sapiens
agttagtttgtatat

SEQ ID NO: 2187382 - DNA, 22 bp, Homo sapiens
agttagtttgtatatattatta

SEQ ID NO: 2187383 - DNA, 21 bp, Homo sapiens
agttatgattcagtgcatttt

SEQ ID NO: 2187384 - DNA, 23 bp, Homo sapiens
agttatgattcagtgcattttca

SEQ ID NO: 2187385 - DNA, 12 bp, Homo sapiens
agttattaatag

SEQ ID NO: 2187386 - DNA, 23 bp, Homo sapiens
agttattagaacttagttttgtt

SEQ ID NO: 2187387 - DNA, 13 bp, Homo sapiens
agttcaataacaa

SEQ ID NO: 2187388 - DNA, 20 bp, Homo sapiens
agttcagtaagaccggaagc

SEQ ID NO: 2187389 - DNA, 21 bp, Homo sapiens
agttctaaaaagatgtaataa

SEQ ID NO: 2187390 - DNA, 18 bp, Homo sapiens
agttgactggctttcctc

SEQ ID NO: 2187391 - DNA, 17 bp, Homo sapiens
agttgagacgctgttgc

SEQ ID NO: 2187392 - DNA, 20 bp, Homo sapiens
agttgcaaagtggaattaaa

SEQ ID NO: 2187393 - DNA, 19 bp, Homo sapiens
agttggcgttgtgggcagg

SEQ ID NO: 2187394 - DNA, 19 bp, Homo sapiens
agttgggattacaggtgac

SEQ ID NO: 2187395 - DNA, 13 bp, Homo sapiens
agttgtaaagtat

SEQ ID NO: 2187396 - DNA, 14 bp, Homo sapiens
agttgtaatgtgta

SEQ ID NO: 2187397 - DNA, 19 bp, Homo sapiens
agttgtatataaaattaga

SEQ ID NO: 2187398 - DNA, 21 bp, Homo sapiens
agttgtatataaaattagatt

SEQ ID NO: 2187399 - DNA, 16 bp, Homo sapiens
agttgttagtgatttg

SEQ ID NO: 2187400 - DNA, 20 bp, Homo sapiens
agttgttagtgatttgctat

SEQ ID NO: 2187401 - DNA, 16 bp, Homo sapiens
agtttagaaattacaa

SEQ ID NO: 2187402 - DNA, 19 bp, Homo sapiens
agtttagaaattacaagtt

SEQ ID NO: 2187403 - DNA, 23 bp, Homo sapiens
agtttagaaattacaagtttcag

SEQ ID NO: 2187404 - DNA, 13 bp, Homo sapiens
agtttcagtaata

SEQ ID NO: 2187405 - DNA, 17 bp, Homo sapiens
agtttcagtaatagctg

SEQ ID NO: 2187406 - DNA, 19 bp, Homo sapiens
agtttcagtaatagctgaa

SEQ ID NO: 2187407 - DNA, 14 bp, Homo sapiens
agtttcttctaaag

SEQ ID NO: 2187408 - DNA, 20 bp, Homo sapiens
agtttgctaagtaaattagt

SEQ ID NO: 2187409 - DNA, 12 bp, Homo sapiens
agtttgtattaa

SEQ ID NO: 2187410 - DNA, 14 bp, Homo sapiens
agtttgtttagtta

SEQ ID NO: 2187411 - DNA, 21 bp, Homo sapiens
agtttgtttcttgtgtgtttt

SEQ ID NO: 2187412 - DNA, 14 bp, Homo sapiens
agttttattttaaa

SEQ ID NO: 2187413 - DNA, 17 bp, Homo sapiens
agttttattttaaatta

SEQ ID NO: 2187414 - DNA, 21 bp, Homo sapiens
agttttccatggtcacagaga

SEQ ID NO: 2187415 - DNA, 17 bp, Homo sapiens
agttttgtgtacagtat

SEQ ID NO: 2187416 - DNA, 21 bp, Homo sapiens
agttttgtgtacagtatgtgt

SEQ ID NO: 2187417 - DNA, 16 bp, Homo sapiens
agtttttacagtgtat

SEQ ID NO: 2187418 - DNA, 21 bp, Homo sapiens
ataaaaggatatcatcttgag

SEQ ID NO: 2187419 - DNA, 15 bp, Homo sapiens
ataaaatccaatgct

SEQ ID NO: 2187420 - DNA, 14 bp, Homo sapiens
attcattcagtgag

SEQ ID NO: 2187421 - DNA, 13 bp, Homo sapiens
attcattccattt

SEQ ID NO: 2187422 - DNA, 20 bp, Homo sapiens
attccaatacattattggac

SEQ ID NO: 2187423 - DNA, 17 bp, Homo sapiens
attccaatatttataat

SEQ ID NO: 2187424 - DNA, 18 bp, Homo sapiens
attccaatatttataatt

SEQ ID NO: 2187425 - DNA, 23 bp, Homo sapiens
attccaatatttataattaaaga

SEQ ID NO: 2187426 - DNA, 12 bp, Homo sapiens
attccagttgcg

SEQ ID NO: 2187427 - DNA, 15 bp, Homo sapiens
attccatttctctcc

SEQ ID NO: 2187428 - DNA, 14 bp, Homo sapiens
attccattttaagt

SEQ ID NO: 2187429 - DNA, 16 bp, Homo sapiens
attcccggctggactt

SEQ ID NO: 2187430 - DNA, 15 bp, Homo sapiens
attccggccctggct

SEQ ID NO: 2187431 - DNA, 16 bp, Homo sapiens
attccggccctggctg

SEQ ID NO: 2187432 - DNA, 23 bp, Homo sapiens
attcctaggcaactattaataat

SEQ ID NO: 2187433 - DNA, 22 bp, Homo sapiens
attccttagaggaagaatataa

SEQ ID NO: 2187434 - DNA, 22 bp, Homo sapiens
attcgcagcagctccgcctggc

SEQ ID NO: 2187435 - DNA, 21 bp, Homo sapiens
attcgcagtgcccagtgatgg

SEQ ID NO: 2187436 - DNA, 17 bp, Homo sapiens
attctcaaaggagcgag

SEQ ID NO: 2187437 - DNA, 12 bp, Homo sapiens
attctccttccc

SEQ ID NO: 2187438 - DNA, 23 bp, Homo sapiens
attctctccagtgtgtgtaacag

SEQ ID NO: 2187439 - DNA, 16 bp, Homo sapiens
attctctgtccagggc

SEQ ID NO: 2187440 - DNA, 18 bp, Homo sapiens
attctctgtccagggctt

SEQ ID NO: 2187441 - DNA, 20 bp, Homo sapiens
attctctttctttttctgtc

SEQ ID NO: 2187442 - DNA, 17 bp, Homo sapiens
attctggcctagtccct

SEQ ID NO: 2187443 - DNA, 20 bp, Homo sapiens
attctgtcttccaggcccag

SEQ ID NO: 2187444 - DNA, 19 bp, Homo sapiens
attcttcggaggaggtgga

SEQ ID NO: 2187445 - DNA, 21 bp, Homo sapiens
attcttcggaggaggtggaca

SEQ ID NO: 2187446 - DNA, 16 bp, Homo sapiens
attcttgattttcaag

SEQ ID NO: 2187447 - DNA, 22 bp, Homo sapiens
attcttgtattcctgattaacc

SEQ ID NO: 2187448 - DNA, 18 bp, Homo sapiens
attctttccatgcagtta

SEQ ID NO: 2187449 - DNA, 20 bp, Homo sapiens
attgaaagtggggtgttgaa

SEQ ID NO: 2187450 - DNA, 18 bp, Homo sapiens
attgaaatgtaatttcag

SEQ ID NO: 2187451 - DNA, 19 bp, Homo sapiens
attgaataggcattaaatg

SEQ ID NO: 2187452 - DNA, 18 bp, Homo sapiens
attgagttctgaaggttg

SEQ ID NO: 2187453 - DNA, 14 bp, Homo sapiens
attgataataaaat

SEQ ID NO: 2187454 - DNA, 18 bp, Homo sapiens
attgatgggtgggctagt

SEQ ID NO: 2187455 - DNA, 12 bp, Homo sapiens
attgatttctgc

SEQ ID NO: 2187456 - DNA, 14 bp, Homo sapiens
attgccaaaatata

SEQ ID NO: 2187457 - DNA, 15 bp, Homo sapiens
attgccatttcttcc

SEQ ID NO: 2187458 - DNA, 19 bp, Homo sapiens
attgccatttcttcccaag

SEQ ID NO: 2187459 - DNA, 22 bp, Homo sapiens
attgcctttggcaattcttctt

SEQ ID NO: 2187460 - DNA, 19 bp, Homo sapiens
attgcgtgaccctatgacc

SEQ ID NO: 2187461 - DNA, 22 bp, Homo sapiens
attggccattctattgtggcaa

SEQ ID NO: 2187462 - DNA, 18 bp, Homo sapiens
attggggtttctggttgg

SEQ ID NO: 2187463 - DNA, 23 bp, Homo sapiens
attggggtttctggttggaggcc

SEQ ID NO: 2187464 - DNA, 21 bp, Homo sapiens
attggtgtgaatgctgtacct

SEQ ID NO: 2187465 - DNA, 16 bp, Homo sapiens
attgtaccaaagctgt

SEQ ID NO: 2187466 - DNA, 23 bp, Homo sapiens
attgtaccaaagctgtttttata

SEQ ID NO: 2187467 - DNA, 15 bp, Homo sapiens
attgtatattgtaat

SEQ ID NO: 2187468 - DNA, 18 bp, Homo sapiens
attgtggagaggagagaa

SEQ ID NO: 2187469 - DNA, 16 bp, Homo sapiens
attgtgtaaaggaaca

SEQ ID NO: 2187470 - DNA, 20 bp, Homo sapiens
attgttaatattaatttata

SEQ ID NO: 2187471 - DNA, 19 bp, Homo sapiens
atttaaaaatatctgaata

SEQ ID NO: 2187472 - DNA, 20 bp, Homo sapiens
atttaacagaaattgtatat

SEQ ID NO: 2187473 - DNA, 12 bp, Homo sapiens
atttactgtact

SEQ ID NO: 2187474 - DNA, 17 bp, Homo sapiens
atttactgtactaatta

SEQ ID NO: 2187475 - DNA, 13 bp, Homo sapiens
atttataattaaa

SEQ ID NO: 2187476 - DNA, 14 bp, Homo sapiens
atttataattaaag

SEQ ID NO: 2187477 - DNA, 17 bp, Homo sapiens
atttataattaaagaaa

SEQ ID NO: 2187478 - DNA, 23 bp, Homo sapiens
atttataattaaagaaaattgcc

SEQ ID NO: 2187479 - DNA, 14 bp, Homo sapiens
atttatatttgtct

SEQ ID NO: 2187480 - DNA, 22 bp, Homo sapiens
atttatgcagagacagctgttt

SEQ ID NO: 2187481 - DNA, 15 bp, Homo sapiens
atttattagccaact

SEQ ID NO: 2187482 - DNA, 16 bp, Homo sapiens
atttattagccaactg

SEQ ID NO: 2187483 - DNA, 13 bp, Homo sapiens
atttattcattca

SEQ ID NO: 2187484 - DNA, 18 bp, Homo sapiens
atttattctacttttaaa

SEQ ID NO: 2187485 - DNA, 13 bp, Homo sapiens
atttatttggagt

SEQ ID NO: 2187486 - DNA, 21 bp, Homo sapiens
atttattttcttttttgataa

SEQ ID NO: 2187487 - DNA, 20 bp, Homo sapiens
atttattttgactgtgattt

SEQ ID NO: 2187488 - DNA, 20 bp, Homo sapiens
atttattttgtaattaactg

SEQ ID NO: 2187489 - DNA, 24 bp, Homo sapiens
atttatttttaaaataatttatca

SEQ ID NO: 2187490 - DNA, 17 bp, Homo sapiens
atttatttttgtactgt

SEQ ID NO: 2187491 - DNA, 14 bp, Homo sapiens
atttcaaaatctta

SEQ ID NO: 2187492 - DNA, 13 bp, Homo sapiens
atttcaatatcaa

SEQ ID NO: 2187493 - DNA, 22 bp, Homo sapiens
atttcagctggagatactgatt

SEQ ID NO: 2187494 - DNA, 24 bp, Homo sapiens
atttcagttctaaaaagatgtaat

SEQ ID NO: 2187495 - DNA, 18 bp, Homo sapiens
atttccagggcagcagcc

SEQ ID NO: 2187496 - DNA, 13 bp, Homo sapiens
atttccatattaa

SEQ ID NO: 2187497 - DNA, 14 bp, Homo sapiens
atttccatattaaa

SEQ ID NO: 2187498 - DNA, 15 bp, Homo sapiens
atttccctgaacaga

SEQ ID NO: 2187499 - DNA, 17 bp, Homo sapiens
atttctaaatcctcact

SEQ ID NO: 2187500 - DNA, 18 bp, Homo sapiens
atttctaaatcctcacta

SEQ ID NO: 2187501 - DNA, 16 bp, Homo sapiens
atttctatggcatatt

SEQ ID NO: 2187502 - DNA, 13 bp, Homo sapiens
atttctcaaagtt

SEQ ID NO: 2187503 - DNA, 15 bp, Homo sapiens
atttctctcaatttg

SEQ ID NO: 2187504 - DNA, 20 bp, Homo sapiens
atttcttaagtataaacctt

SEQ ID NO: 2187505 - DNA, 13 bp, Homo sapiens
atttcttctgtag

SEQ ID NO: 2187506 - DNA, 19 bp, Homo sapiens
atttcttggtatgatcatt

SEQ ID NO: 2187507 - DNA, 17 bp, Homo sapiens
atttgaaactgctaatt

SEQ ID NO: 2187508 - DNA, 22 bp, Homo sapiens
atttgaagaaggaggaatttta

SEQ ID NO: 2187509 - DNA, 15 bp, Homo sapiens
atttgacttctgagt

SEQ ID NO: 2187510 - DNA, 20 bp, Homo sapiens
atttgattctatgactgaag

SEQ ID NO: 2187511 - DNA, 14 bp, Homo sapiens
atttgcagctgctg

SEQ ID NO: 2187512 - DNA, 15 bp, Homo sapiens
atttgcagctgctgg

SEQ ID NO: 2187513 - DNA, 17 bp, Homo sapiens
atttgcagctgctggtt

SEQ ID NO: 2187514 - DNA, 22 bp, Homo sapiens
atttgcatgtgtaaatctgaaa

SEQ ID NO: 2187515 - DNA, 15 bp, Homo sapiens
atttgccaactaatt

SEQ ID NO: 2187516 - DNA, 16 bp, Homo sapiens
atttgccatgctgcta

SEQ ID NO: 2187517 - DNA, 23 bp, Homo sapiens
atttgccccaacttaagtttaga

SEQ ID NO: 2187518 - DNA, 14 bp, Homo sapiens
atttgccctcccat

SEQ ID NO: 2187519 - DNA, 18 bp, Homo sapiens
atttgctgattgtctgaa

SEQ ID NO: 2187520 - DNA, 16 bp, Homo sapiens
atttggagtggaggca

SEQ ID NO: 2187521 - DNA, 21 bp, Homo sapiens
atttggagtggaggcattgtt

SEQ ID NO: 2187522 - DNA, 20 bp, Homo sapiens
atttgtaatttttttctagt

SEQ ID NO: 2187523 - DNA, 13 bp, Homo sapiens
atttgtctcattt

SEQ ID NO: 2187524 - DNA, 18 bp, Homo sapiens
atttgtctcattttgtat

SEQ ID NO: 2187525 - DNA, 24 bp, Homo sapiens
atttgtggcccaagcctggtctcc

SEQ ID NO: 2187526 - DNA, 17 bp, Homo sapiens
atttgtggttgcatgtc

SEQ ID NO: 2187527 - DNA, 13 bp, Homo sapiens
atttgttaatata

SEQ ID NO: 2187528 - DNA, 15 bp, Homo sapiens
atttgttaatatata

SEQ ID NO: 2187529 - DNA, 21 bp, Homo sapiens
atttgttaatatatataatac

SEQ ID NO: 2187530 - DNA, 17 bp, Homo sapiens
atttgtttatatttaat

SEQ ID NO: 2187531 - DNA, 13 bp, Homo sapiens
attttaaagtaaa

SEQ ID NO: 2187532 - DNA, 14 bp, Homo sapiens
attttaagcatttt

SEQ ID NO: 2187533 - DNA, 21 bp, Homo sapiens
attttacctgggatatgacaa

SEQ ID NO: 2187534 - DNA, 16 bp, Homo sapiens
attttagaattaaaat

SEQ ID NO: 2187535 - DNA, 21 bp, Homo sapiens
attttatgtattttaaaataa

SEQ ID NO: 2187536 - DNA, 17 bp, Homo sapiens
attttatgtgactgctt

SEQ ID NO: 2187537 - DNA, 13 bp, Homo sapiens
attttcaaaaatc

SEQ ID NO: 2187538 - DNA, 14 bp, Homo sapiens
attttcacttttaa

SEQ ID NO: 2187539 - DNA, 17 bp, Homo sapiens
attttctgagtagcata

SEQ ID NO: 2187540 - DNA, 20 bp, Homo sapiens
attttctgggttctgggtgg

SEQ ID NO: 2187541 - DNA, 17 bp, Homo sapiens
attttctttctagtttg

SEQ ID NO: 2187542 - DNA, 15 bp, Homo sapiens
cagcagtttcccaga

SEQ ID NO: 2187543 - DNA, 16 bp, Homo sapiens
cagcagtttcccagaa

SEQ ID NO: 2187544 - DNA, 18 bp, Homo sapiens
cagcatgactggacagcg

SEQ ID NO: 2187545 - DNA, 15 bp, Homo sapiens
cagcatttcctcagt

SEQ ID NO: 2187546 - DNA, 22 bp, Homo sapiens
cagcatttcctcagtctccctt

SEQ ID NO: 2187547 - DNA, 15 bp, Homo sapiens
cagccacagacccct

SEQ ID NO: 2187548 - DNA, 22 bp, Homo sapiens
cagccacagacccctgggagct

SEQ ID NO: 2187549 - DNA, 12 bp, Homo sapiens
cagccagcggca

SEQ ID NO: 2187550 - DNA, 19 bp, Homo sapiens
cagccagcggcatatactt

SEQ ID NO: 2187551 - DNA, 20 bp, Homo sapiens
cagccattggcctctgtctc

SEQ ID NO: 2187552 - DNA, 15 bp, Homo sapiens
cagcccagcccagct

SEQ ID NO: 2187553 - DNA, 18 bp, Homo sapiens
cagcccagcccagctgct

SEQ ID NO: 2187554 - DNA, 16 bp, Homo sapiens
cagcccagctgctctg

SEQ ID NO: 2187555 - DNA, 23 bp, Homo sapiens
cagcccagctgctctgcccagag

SEQ ID NO: 2187556 - DNA, 16 bp, Homo sapiens
cagccccagcccagcc

SEQ ID NO: 2187557 - DNA, 23 bp, Homo sapiens
cagccctaggctacccttgccaa

SEQ ID NO: 2187558 - DNA, 22 bp, Homo sapiens
cagccctgagctagtgtcacct

SEQ ID NO: 2187559 - DNA, 23 bp, Homo sapiens
cagccctgagctagtgtcacctg

SEQ ID NO: 2187560 - DNA, 20 bp, Homo sapiens
cagccctggagtcatgccaa

SEQ ID NO: 2187561 - DNA, 21 bp, Homo sapiens
cagccgagtggatagatgccc

SEQ ID NO: 2187562 - DNA, 16 bp, Homo sapiens
cagccggatcttggag

SEQ ID NO: 2187563 - DNA, 15 bp, Homo sapiens
cagccggggcctgcc

SEQ ID NO: 2187564 - DNA, 20 bp, Homo sapiens
cagccggggcctgcctagca

SEQ ID NO: 2187565 - DNA, 17 bp, Homo sapiens
cagcctcaacctccctg

SEQ ID NO: 2187566 - DNA, 22 bp, Homo sapiens
cagcctcaacctccctggctca

SEQ ID NO: 2187567 - DNA, 18 bp, Homo sapiens
cagcctcaataagccttg

SEQ ID NO: 2187568 - DNA, 19 bp, Homo sapiens
cagcctcaataagccttgt

SEQ ID NO: 2187569 - DNA, 14 bp, Homo sapiens
cagcctcccaaagt

SEQ ID NO: 2187570 - DNA, 20 bp, Homo sapiens
cagcctcgaactcctgggct

SEQ ID NO: 2187571 - DNA, 22 bp, Homo sapiens
cagcctcgaactcctgggctca

SEQ ID NO: 2187572 - DNA, 14 bp, Homo sapiens
cagcctctagggac

SEQ ID NO: 2187573 - DNA, 16 bp, Homo sapiens
cagcctctggccagac

SEQ ID NO: 2187574 - DNA, 22 bp, Homo sapiens
cagcctgagcaagacgccctct

SEQ ID NO: 2187575 - DNA, 14 bp, Homo sapiens
cagcctgtgggaga

SEQ ID NO: 2187576 - DNA, 19 bp, Homo sapiens
cagcctgtgggagaaggga

SEQ ID NO: 2187577 - DNA, 22 bp, Homo sapiens
cagcggcatatacttgtttttg

SEQ ID NO: 2187578 - DNA, 23 bp, Homo sapiens
cagcgggcggaggggatccagcc

SEQ ID NO: 2187579 - DNA, 18 bp, Homo sapiens
cagcggtggaaggagcct

SEQ ID NO: 2187580 - DNA, 19 bp, Homo sapiens
cagcggttgtaaatacaat

SEQ ID NO: 2187581 - DNA, 20 bp, Homo sapiens
cagcgtctgagcggccgcct

SEQ ID NO: 2187582 - DNA, 17 bp, Homo sapiens
cagctaagcctgatgat

SEQ ID NO: 2187583 - DNA, 14 bp, Homo sapiens
cagctaattctact

SEQ ID NO: 2187584 - DNA, 13 bp, Homo sapiens
cagctagagcttc

SEQ ID NO: 2187585 - DNA, 17 bp, Homo sapiens
cagctcacggcagcctc

SEQ ID NO: 2187586 - DNA, 19 bp, Homo sapiens
cagctcacggcagcctcaa

SEQ ID NO: 2187587 - DNA, 16 bp, Homo sapiens
cagctcagtcttccct

SEQ ID NO: 2187588 - DNA, 12 bp, Homo sapiens
cagctccttccc

SEQ ID NO: 2187589 - DNA, 11 bp, Homo sapiens
cagctctggag

SEQ ID NO: 2187590 - DNA, 17 bp, Homo sapiens
cagctctggagaacagt

SEQ ID NO: 2187591 - DNA, 17 bp, Homo sapiens
cagctctggctcacaga

SEQ ID NO: 2187592 - DNA, 22 bp, Homo sapiens
cagctgaacagtgttggctttc

SEQ ID NO: 2187593 - DNA, 13 bp, Homo sapiens
cagctgcaggtgc

SEQ ID NO: 2187594 - DNA, 20 bp, Homo sapiens
cagctgcccccgctcatggg

SEQ ID NO: 2187595 - DNA, 11 bp, Homo sapiens
cagctgctcct

SEQ ID NO: 2187596 - DNA, 20 bp, Homo sapiens
cagctgctcctcgcagttcg

SEQ ID NO: 2187597 - DNA, 18 bp, Homo sapiens
cagctgctctgcccagag

SEQ ID NO: 2187598 - DNA, 22 bp, Homo sapiens
cagctgctctgcccagagctgg

SEQ ID NO: 2187599 - DNA, 22 bp, Homo sapiens
cagctggccgggttggaggcct

SEQ ID NO: 2187600 - DNA, 16 bp, Homo sapiens
cagctggggcccctcg

SEQ ID NO: 2187601 - DNA, 18 bp, Homo sapiens
cagctggttatccaaatc

SEQ ID NO: 2187602 - DNA, 20 bp, Homo sapiens
cagctgttctgtcccttgga

SEQ ID NO: 2187603 - DNA, 13 bp, Homo sapiens
cagcttcaaataa

SEQ ID NO: 2187604 - DNA, 23 bp, Homo sapiens
cagcttccacaaacaccatcttc

SEQ ID NO: 2187605 - DNA, 13 bp, Homo sapiens
cagcttgctgcac

SEQ ID NO: 2187606 - DNA, 22 bp, Homo sapiens
cagcttttagtacccacctgag

SEQ ID NO: 2187607 - DNA, 17 bp, Homo sapiens
caggaaagcgtttggaa

SEQ ID NO: 2187608 - DNA, 15 bp, Homo sapiens
caggaacctggacca

SEQ ID NO: 2187609 - DNA, 21 bp, Homo sapiens
caggaacctggaccaaagctg

SEQ ID NO: 2187610 - DNA, 22 bp, Homo sapiens
caggaagggtcaaaacatttta

SEQ ID NO: 2187611 - DNA, 15 bp, Homo sapiens
caggaattcagtgcc

SEQ ID NO: 2187612 - DNA, 16 bp, Homo sapiens
caggaattcagtgcct

SEQ ID NO: 2187613 - DNA, 21 bp, Homo sapiens
caggacacaacgctgctgcct

SEQ ID NO: 2187614 - DNA, 13 bp, Homo sapiens
caggacagctgca

SEQ ID NO: 2187615 - DNA, 22 bp, Homo sapiens
caggacctaggatatcttctcc

SEQ ID NO: 2187616 - DNA, 18 bp, Homo sapiens
caggactcttgtgaaaag

SEQ ID NO: 2187617 - DNA, 19 bp, Homo sapiens
caggacttaagacaaatgg

SEQ ID NO: 2187618 - DNA, 21 bp, Homo sapiens
caggacttaagacaaatggga

SEQ ID NO: 2187619 - DNA, 23 bp, Homo sapiens
caggacttaagacaaatgggact

SEQ ID NO: 2187620 - DNA, 19 bp, Homo sapiens
caggagagagcttcctgtt

SEQ ID NO: 2187621 - DNA, 22 bp, Homo sapiens
caggaggagattaacacactga

SEQ ID NO: 2187622 - DNA, 23 bp, Homo sapiens
caggaggagattaacacactgaa

SEQ ID NO: 2187623 - DNA, 16 bp, Homo sapiens
caggagggtggcactt

SEQ ID NO: 2187624 - DNA, 21 bp, Homo sapiens
caggaggtactgtgaggaaga

SEQ ID NO: 2187625 - DNA, 13 bp, Homo sapiens
caggatcacagct

SEQ ID NO: 2187626 - DNA, 23 bp, Homo sapiens
caggattccagttgcgtgtctgt

SEQ ID NO: 2187627 - DNA, 12 bp, Homo sapiens
caggattgagca

SEQ ID NO: 2187628 - DNA, 14 bp, Homo sapiens
caggatttggtttt

SEQ ID NO: 2187629 - DNA, 21 bp, Homo sapiens
caggatttggtttttctcttt

SEQ ID NO: 2187630 - DNA, 18 bp, Homo sapiens
caggcaccagcagcagaa

SEQ ID NO: 2187631 - DNA, 22 bp, Homo sapiens
caggcacctctaatcagacctt

SEQ ID NO: 2187632 - DNA, 19 bp, Homo sapiens
caggcatttttccaaagga

SEQ ID NO: 2187633 - DNA, 13 bp, Homo sapiens
caggccactgacc

SEQ ID NO: 2187634 - DNA, 14 bp, Homo sapiens
caggccactgacct

SEQ ID NO: 2187635 - DNA, 16 bp, Homo sapiens
caggccactgacctcc

SEQ ID NO: 2187636 - DNA, 17 bp, Homo sapiens
caggctcaacataacat

SEQ ID NO: 2187637 - DNA, 21 bp, Homo sapiens
caggctcgtggactgagtggg

SEQ ID NO: 2187638 - DNA, 11 bp, Homo sapiens
caggctctgca

SEQ ID NO: 2187639 - DNA, 21 bp, Homo sapiens
caggctctgcacagacaagca

SEQ ID NO: 2187640 - DNA, 16 bp, Homo sapiens
caggctgcctcccttg

SEQ ID NO: 2187641 - DNA, 21 bp, Homo sapiens
caggctgcggtgggcagccat

SEQ ID NO: 2187642 - DNA, 16 bp, Homo sapiens
cagggaaggacaggac

SEQ ID NO: 2187643 - DNA, 18 bp, Homo sapiens
cagggaatatatattttt

SEQ ID NO: 2187644 - DNA, 24 bp, Homo sapiens
cagggaggcaccattcaggaacct

SEQ ID NO: 2187645 - DNA, 19 bp, Homo sapiens
cagggatgctatctcgcta

SEQ ID NO: 2187646 - DNA, 17 bp, Homo sapiens
cagggatggggccacag

SEQ ID NO: 2187647 - DNA, 16 bp, Homo sapiens
cagggcaccaagccca

SEQ ID NO: 2187648 - DNA, 14 bp, Homo sapiens
cagggcagcagccg

SEQ ID NO: 2187649 - DNA, 13 bp, Homo sapiens
cagggcagcctgt

SEQ ID NO: 2187650 - DNA, 23 bp, Homo sapiens
cagggcagcctgtgggagaaggg

SEQ ID NO: 2187651 - DNA, 18 bp, Homo sapiens
cagggccatctgactgcc

SEQ ID NO: 2187652 - DNA, 23 bp, Homo sapiens
cagggccatctgactgccaagcc

SEQ ID NO: 2187653 - DNA, 20 bp, Homo sapiens
cagggcctgacttttacagc

SEQ ID NO: 2187654 - DNA, 13 bp, Homo sapiens
caggggaggagcc

SEQ ID NO: 2187655 - DNA, 15 bp, Homo sapiens
caggggaggagcctg

SEQ ID NO: 2187656 - DNA, 15 bp, Homo sapiens
caggggcgctggctg

SEQ ID NO: 2187657 - DNA, 16 bp, Homo sapiens
caggggctgggcagag

SEQ ID NO: 2187658 - DNA, 20 bp, Homo sapiens
caggggctgggcagagggga

SEQ ID NO: 2187659 - DNA, 21 bp, Homo sapiens
caggggctttggtggcccctc

SEQ ID NO: 2187660 - DNA, 17 bp, Homo sapiens
caggggttccagcttcc

SEQ ID NO: 2187661 - DNA, 19 bp, Homo sapiens
cagggtagaaaaaggagct

SEQ ID NO: 2187662 - DNA, 18 bp, Homo sapiens
cagggtagggggcctgag

SEQ ID NO: 2187663 - DNA, 15 bp, Homo sapiens
ccattataattttga

SEQ ID NO: 2187664 - DNA, 12 bp, Homo sapiens
ccattcaggaac

SEQ ID NO: 2187665 - DNA, 12 bp, Homo sapiens
ccatttgctgat

SEQ ID NO: 2187666 - DNA, 18 bp, Homo sapiens
ccattttgcgatgtgttt

SEQ ID NO: 2187667 - DNA, 21 bp, Homo sapiens
ccatttttttcactcagaatt

SEQ ID NO: 2187668 - DNA, 23 bp, Homo sapiens
cccaaaggaagctttctctgctt

SEQ ID NO: 2187669 - DNA, 20 bp, Homo sapiens
cccaaagtgctgagattaca

SEQ ID NO: 2187670 - DNA, 18 bp, Homo sapiens
cccaacacaaggtgggca

SEQ ID NO: 2187671 - DNA, 23 bp, Homo sapiens
cccaactactattgtagagtggt

SEQ ID NO: 2187672 - DNA, 14 bp, Homo sapiens
cccaagaacagcag

SEQ ID NO: 2187673 - DNA, 23 bp, Homo sapiens
cccaagaacagcaggcccaccta

SEQ ID NO: 2187674 - DNA, 14 bp, Homo sapiens
cccaagaaggctgg

SEQ ID NO: 2187675 - DNA, 18 bp, Homo sapiens
cccaagcctggtctcctc

SEQ ID NO: 2187676 - DNA, 22 bp, Homo sapiens
cccaaggcaaggggtgcctggg

SEQ ID NO: 2187677 - DNA, 13 bp, Homo sapiens
cccaagggccctg

SEQ ID NO: 2187678 - DNA, 23 bp, Homo sapiens
cccaatgcacagggctgcaacac

SEQ ID NO: 2187679 - DNA, 13 bp, Homo sapiens
cccaattcatttc

SEQ ID NO: 2187680 - DNA, 17 bp, Homo sapiens
cccaatttaagagtcct

SEQ ID NO: 2187681 - DNA, 22 bp, Homo sapiens
cccaatttaagagtcctgaggc

SEQ ID NO: 2187682 - DNA, 19 bp, Homo sapiens
cccacaagctgtccctgca

SEQ ID NO: 2187683 - DNA, 21 bp, Homo sapiens
cccacaagctgtccctgcagg

SEQ ID NO: 2187684 - DNA, 14 bp, Homo sapiens
cccacactcctaca

SEQ ID NO: 2187685 - DNA, 21 bp, Homo sapiens
cccaccccgggctctcctgcc

SEQ ID NO: 2187686 - DNA, 17 bp, Homo sapiens
cccacccgttaatttaa

SEQ ID NO: 2187687 - DNA, 20 bp, Homo sapiens
cccaccggttgcttctggga

SEQ ID NO: 2187688 - DNA, 24 bp, Homo sapiens
cccacctgcatcagcctctggcca

SEQ ID NO: 2187689 - DNA, 13 bp, Homo sapiens
cccactcagcatt

SEQ ID NO: 2187690 - DNA, 22 bp, Homo sapiens
cccactcagcatttcggtgctt

SEQ ID NO: 2187691 - DNA, 15 bp, Homo sapiens
cccacttccctgggc

SEQ ID NO: 2187692 - DNA, 22 bp, Homo sapiens
cccagaagatgtattcagagcc

SEQ ID NO: 2187693 - DNA, 10 bp, Homo sapiens
cccagaggca

SEQ ID NO: 2187694 - DNA, 15 bp, Homo sapiens
cccagaggcacagcc

SEQ ID NO: 2187695 - DNA, 16 bp, Homo sapiens
cccagaggcacagccg

SEQ ID NO: 2187696 - DNA, 12 bp, Homo sapiens
cccagaggccct

SEQ ID NO: 2187697 - DNA, 14 bp, Homo sapiens
cccagaggccctgg

SEQ ID NO: 2187698 - DNA, 14 bp, Homo sapiens
cccagaggctcctg

SEQ ID NO: 2187699 - DNA, 19 bp, Homo sapiens
cccagaggctcctggagcc

SEQ ID NO: 2187700 - DNA, 15 bp, Homo sapiens
cccagaggtggggaa

SEQ ID NO: 2187701 - DNA, 12 bp, Homo sapiens
cccagcccagct

SEQ ID NO: 2187702 - DNA, 16 bp, Homo sapiens
cccagcccagctgctc

SEQ ID NO: 2187703 - DNA, 16 bp, Homo sapiens
cccagcccatcttgcc

SEQ ID NO: 2187704 - DNA, 21 bp, Homo sapiens
cccagcccatcttgcctccat

SEQ ID NO: 2187705 - DNA, 21 bp, Homo sapiens
cccagccttggcatctagagc

SEQ ID NO: 2187706 - DNA, 18 bp, Homo sapiens
cccagctcagtcttccct

SEQ ID NO: 2187707 - DNA, 14 bp, Homo sapiens
cccagctgaaggca

SEQ ID NO: 2187708 - DNA, 17 bp, Homo sapiens
cccagctgctcctcgca

SEQ ID NO: 2187709 - DNA, 12 bp, Homo sapiens
cccagctgctct

SEQ ID NO: 2187710 - DNA, 14 bp, Homo sapiens
cccagctgctctgc

SEQ ID NO: 2187711 - DNA, 20 bp, Homo sapiens
cccagctgctctgcccagag

SEQ ID NO: 2187712 - DNA, 22 bp, Homo sapiens
cccagctggggcccctcggcta

SEQ ID NO: 2187713 - DNA, 19 bp, Homo sapiens
cccaggaaaggcaggattg

SEQ ID NO: 2187714 - DNA, 22 bp, Homo sapiens
cccaggagcatccacctccttc

SEQ ID NO: 2187715 - DNA, 13 bp, Homo sapiens
cccaggggctttg

SEQ ID NO: 2187716 - DNA, 17 bp, Homo sapiens
cccagggtcctgtgcct

SEQ ID NO: 2187717 - DNA, 13 bp, Homo sapiens
cccaggttggagg

SEQ ID NO: 2187718 - DNA, 12 bp, Homo sapiens
cccagttcatgt

SEQ ID NO: 2187719 - DNA, 16 bp, Homo sapiens
cccagttctctaggga

SEQ ID NO: 2187720 - DNA, 15 bp, Homo sapiens
cccatcctgaccagc

SEQ ID NO: 2187721 - DNA, 12 bp, Homo sapiens
cccatctcactt

SEQ ID NO: 2187722 - DNA, 17 bp, Homo sapiens
cccatggtagactgtga

SEQ ID NO: 2187723 - DNA, 18 bp, Homo sapiens
cccatttgccatgctgct

SEQ ID NO: 2187724 - DNA, 12 bp, Homo sapiens
cccattttaaat

SEQ ID NO: 2187725 - DNA, 17 bp, Homo sapiens
ccccaactccttcctct

SEQ ID NO: 2187726 - DNA, 14 bp, Homo sapiens
ccccaagaaggctg

SEQ ID NO: 2187727 - DNA, 15 bp, Homo sapiens
ccccaagggccctgg

SEQ ID NO: 2187728 - DNA, 14 bp, Homo sapiens
ccccaattccttgt

SEQ ID NO: 2187729 - DNA, 18 bp, Homo sapiens
ccccacaagctgtccctg

SEQ ID NO: 2187730 - DNA, 13 bp, Homo sapiens
ccccaccccttgc

SEQ ID NO: 2187731 - DNA, 17 bp, Homo sapiens
ccccacccgttaattta

SEQ ID NO: 2187732 - DNA, 17 bp, Homo sapiens
ccccacctgccactagg

SEQ ID NO: 2187733 - DNA, 17 bp, Homo sapiens
ccccagaggccctggag

SEQ ID NO: 2187734 - DNA, 11 bp, Homo sapiens
ccccagcccac

SEQ ID NO: 2187735 - DNA, 18 bp, Homo sapiens
ccccagcccactggatca

SEQ ID NO: 2187736 - DNA, 12 bp, Homo sapiens
ccccagcccagc

SEQ ID NO: 2187737 - DNA, 18 bp, Homo sapiens
ccccagcccagcccagct

SEQ ID NO: 2187738 - DNA, 19 bp, Homo sapiens
ccccagctgctcctcgcag

SEQ ID NO: 2187739 - DNA, 19 bp, Homo sapiens
ccccatagcaaagggtctg

SEQ ID NO: 2187740 - DNA, 19 bp, Homo sapiens
ccccatcaggactcttgtg

SEQ ID NO: 2187741 - DNA, 16 bp, Homo sapiens
ccccgcaaaacccact

SEQ ID NO: 2187742 - DNA, 15 bp, Homo sapiens
ccccgcacccggctc

SEQ ID NO: 2187743 - DNA, 16 bp, Homo sapiens
ccccgctcatgggccc

SEQ ID NO: 2187744 - DNA, 15 bp, Homo sapiens
ccccgggctctcctg

SEQ ID NO: 2187745 - DNA, 15 bp, Homo sapiens
ccccgggctggagaa

SEQ ID NO: 2187746 - DNA, 18 bp, Homo sapiens
ccccgggctggagaaaga

SEQ ID NO: 2187747 - DNA, 15 bp, Homo sapiens
cccctaccactgtct

SEQ ID NO: 2187748 - DNA, 23 bp, Homo sapiens
cccctacccccttgtctgctgct

SEQ ID NO: 2187749 - DNA, 21 bp, Homo sapiens
cccctagcttagagcctccct

SEQ ID NO: 2187750 - DNA, 22 bp, Homo sapiens
cccctcctccctttttccttgt

SEQ ID NO: 2187751 - DNA, 23 bp, Homo sapiens
cccctcttcttctgaagatcaga

SEQ ID NO: 2187752 - DNA, 18 bp, Homo sapiens
cccctgccgcctgtgccc

SEQ ID NO: 2187753 - DNA, 11 bp, Homo sapiens
cccctggcttg

SEQ ID NO: 2187754 - DNA, 19 bp, Homo sapiens
ccccttcctgtctggccca

SEQ ID NO: 2187755 - DNA, 21 bp, Homo sapiens
ccccttggaggagagagaccc

SEQ ID NO: 2187756 - DNA, 22 bp, Homo sapiens
ccccttggaggagagagacccc

SEQ ID NO: 2187757 - DNA, 14 bp, Homo sapiens
ccccttgtctgctg

SEQ ID NO: 2187758 - DNA, 15 bp, Homo sapiens
ccccttgtctgctgc

SEQ ID NO: 2187759 - DNA, 20 bp, Homo sapiens
ccccttttgtgggtttctct

SEQ ID NO: 2187760 - DNA, 22 bp, Homo sapiens
ccccttttgtgggtttctctgt

SEQ ID NO: 2187761 - DNA, 23 bp, Homo sapiens
ccccttttgtgggtttctctgtg

SEQ ID NO: 2187762 - DNA, 16 bp, Homo sapiens
cccgcatgcagcagct

SEQ ID NO: 2187763 - DNA, 20 bp, Homo sapiens
cccgcatgcagcagcttgct

SEQ ID NO: 2187764 - DNA, 14 bp, Homo sapiens
cccgcattggtggc

SEQ ID NO: 2187765 - DNA, 17 bp, Homo sapiens
cccgcccttcttttgac

SEQ ID NO: 2187766 - DNA, 20 bp, Homo sapiens
cccgctcatgggcccctctg

SEQ ID NO: 2187767 - DNA, 22 bp, Homo sapiens
cccgctggctgggggcctcact

SEQ ID NO: 2187768 - DNA, 20 bp, Homo sapiens
cccggcccccgccctctgcc

SEQ ID NO: 2187769 - DNA, 19 bp, Homo sapiens
cccggctcgtgtatttatt

SEQ ID NO: 2187770 - DNA, 13 bp, Homo sapiens
cccggctggactt

SEQ ID NO: 2187771 - DNA, 21 bp, Homo sapiens
cccgggctggagaaagagctg

SEQ ID NO: 2187772 - DNA, 14 bp, Homo sapiens
cccgtagagaatgt

SEQ ID NO: 2187773 - DNA, 16 bp, Homo sapiens
cccgttaatttaaagc

SEQ ID NO: 2187774 - DNA, 12 bp, Homo sapiens
cccgtttccaag

SEQ ID NO: 2187775 - DNA, 19 bp, Homo sapiens
ccctaactctgcccaccct

SEQ ID NO: 2187776 - DNA, 22 bp, Homo sapiens
ccctacccacagggcctgactt

SEQ ID NO: 2187777 - DNA, 22 bp, Homo sapiens
ccctacccccttgtctgctgct

SEQ ID NO: 2187778 - DNA, 13 bp, Homo sapiens
ccctactggctgt

SEQ ID NO: 2187779 - DNA, 14 bp, Homo sapiens
ccctactggctgta

SEQ ID NO: 2187780 - DNA, 22 bp, Homo sapiens
ccctagcttagagcctccctca

SEQ ID NO: 2187781 - DNA, 14 bp, Homo sapiens
ccctaggcgcggtt

SEQ ID NO: 2187782 - DNA, 15 bp, Homo sapiens
ccctaggcgcggttc

SEQ ID NO: 2187783 - DNA, 23 bp, Homo sapiens
ccctcacactttgccatttgctt

SEQ ID NO: 2187784 - DNA, 12 bp, Homo sapiens
ccctcagcctcc

SEQ ID NO: 2187785 - DNA, 19 bp, Homo sapiens
cggctcgtgtatttattac

SEQ ID NO: 2187786 - DNA, 19 bp, Homo sapiens
cggctgctggcacagactt

SEQ ID NO: 2187787 - DNA, 20 bp, Homo sapiens
cggctggacttttgcagctt

SEQ ID NO: 2187788 - DNA, 18 bp, Homo sapiens
cgggaccaccctgagccg

SEQ ID NO: 2187789 - DNA, 22 bp, Homo sapiens
cgggaggccacgggggaggccg

SEQ ID NO: 2187790 - DNA, 18 bp, Homo sapiens
cgggagtggccatctgga

SEQ ID NO: 2187791 - DNA, 15 bp, Homo sapiens
cgggctcagctctgg

SEQ ID NO: 2187792 - DNA, 14 bp, Homo sapiens
cgggctggagaaag

SEQ ID NO: 2187793 - DNA, 22 bp, Homo sapiens
cggggctgcggcgccaccgagc

SEQ ID NO: 2187794 - DNA, 20 bp, Homo sapiens
cgggggaggccgaggcaggg

SEQ ID NO: 2187795 - DNA, 20 bp, Homo sapiens
cgggggtgggggcctgctgt

SEQ ID NO: 2187796 - DNA, 17 bp, Homo sapiens
cgggtaaaaagagaagg

SEQ ID NO: 2187797 - DNA, 15 bp, Homo sapiens
cgggttggaggcctc

SEQ ID NO: 2187798 - DNA, 16 bp, Homo sapiens
cgggttggaggcctca

SEQ ID NO: 2187799 - DNA, 17 bp, Homo sapiens
cgggttggaggcctcac

SEQ ID NO: 2187800 - DNA, 20 bp, Homo sapiens
cggtacttggtaagagggag

SEQ ID NO: 2187801 - DNA, 14 bp, Homo sapiens
cggtcaataattgt

SEQ ID NO: 2187802 - DNA, 21 bp, Homo sapiens
cggtctaaagtgagctctatg

SEQ ID NO: 2187803 - DNA, 14 bp, Homo sapiens
cggtgcagcggtgg

SEQ ID NO: 2187804 - DNA, 17 bp, Homo sapiens
cggtgcagcggtggaag

SEQ ID NO: 2187805 - DNA, 22 bp, Homo sapiens
cggtgcagcggtggaaggagcc

SEQ ID NO: 2187806 - DNA, 15 bp, Homo sapiens
cggtggaaggagcct

SEQ ID NO: 2187807 - DNA, 18 bp, Homo sapiens
cggtggaaggagcctgcg

SEQ ID NO: 2187808 - DNA, 13 bp, Homo sapiens
cggtggctaaagg

SEQ ID NO: 2187809 - DNA, 15 bp, Homo sapiens
cggtgggcagccatg

SEQ ID NO: 2187810 - DNA, 18 bp, Homo sapiens
cggttcaggtcagggcta

SEQ ID NO: 2187811 - DNA, 15 bp, Homo sapiens
cggttgcttctggga

SEQ ID NO: 2187812 - DNA, 20 bp, Homo sapiens
cggttggagcctgctctttg

SEQ ID NO: 2187813 - DNA, 19 bp, Homo sapiens
cgtattgtgaaatttgtta

SEQ ID NO: 2187814 - DNA, 15 bp, Homo sapiens
cgtcagtattttccc

SEQ ID NO: 2187815 - DNA, 20 bp, Homo sapiens
cgtcatggctcaaggattca

SEQ ID NO: 2187816 - DNA, 18 bp, Homo sapiens
cgtccacccgtttccaag

SEQ ID NO: 2187817 - DNA, 21 bp, Homo sapiens
cgtctcctgccgggcaggtcc

SEQ ID NO: 2187818 - DNA, 19 bp, Homo sapiens
cgtctcgaagcagtattct

SEQ ID NO: 2187819 - DNA, 17 bp, Homo sapiens
cgtctgagcggccgcct

SEQ ID NO: 2187820 - DNA, 12 bp, Homo sapiens
cgtcttcctcct

SEQ ID NO: 2187821 - DNA, 15 bp, Homo sapiens
cgtgaagagcagtga

SEQ ID NO: 2187822 - DNA, 17 bp, Homo sapiens
cgtgaccctatgaccaa

SEQ ID NO: 2187823 - DNA, 17 bp, Homo sapiens
cgtgagagaaagagaga

SEQ ID NO: 2187824 - DNA, 20 bp, Homo sapiens
cgtgagagaaagagagaagc

SEQ ID NO: 2187825 - DNA, 22 bp, Homo sapiens
cgtgagagaaagagagaagcca

SEQ ID NO: 2187826 - DNA, 12 bp, Homo sapiens
cgtgaggggcaa

SEQ ID NO: 2187827 - DNA, 20 bp, Homo sapiens
cgtgaggggcaagctaggcc

SEQ ID NO: 2187828 - DNA, 14 bp, Homo sapiens
cgtgattcttgaaa

SEQ ID NO: 2187829 - DNA, 20 bp, Homo sapiens
cgtgattggtaactgcctgg

SEQ ID NO: 2187830 - DNA, 22 bp, Homo sapiens
cgtgcctgcattcgcagcagct

SEQ ID NO: 2187831 - DNA, 16 bp, Homo sapiens
cgtgcgaccagaggtg

SEQ ID NO: 2187832 - DNA, 17 bp, Homo sapiens
cgtgcgaccagaggtgg

SEQ ID NO: 2187833 - DNA, 12 bp, Homo sapiens
cgtgctggagag

SEQ ID NO: 2187834 - DNA, 19 bp, Homo sapiens
cgtggactgagtgggaagc

SEQ ID NO: 2187835 - DNA, 21 bp, Homo sapiens
cgtggactgagtgggaagccc

SEQ ID NO: 2187836 - DNA, 21 bp, Homo sapiens
cgtggcctcgtgaggggcaag

SEQ ID NO: 2187837 - DNA, 13 bp, Homo sapiens
cgtgggctctggc

SEQ ID NO: 2187838 - DNA, 18 bp, Homo sapiens
cgtgggctctggctccct

SEQ ID NO: 2187839 - DNA, 14 bp, Homo sapiens
cgtgttgagattac

SEQ ID NO: 2187840 - DNA, 22 bp, Homo sapiens
cgttaatttaaagctgtttcta

SEQ ID NO: 2187841 - DNA, 22 bp, Homo sapiens
cgttatctcattgcaaaaatat

SEQ ID NO: 2187842 - DNA, 17 bp, Homo sapiens
cgttcctgggactgtca

SEQ ID NO: 2187843 - DNA, 19 bp, Homo sapiens
cgttcctgggactgtcaga

SEQ ID NO: 2187844 - DNA, 12 bp, Homo sapiens
cgttgcatggta

SEQ ID NO: 2187845 - DNA, 16 bp, Homo sapiens
cgttgtgggcaggcta

SEQ ID NO: 2187846 - DNA, 10 bp, Homo sapiens
cgtttccaag

SEQ ID NO: 2187847 - DNA, 19 bp, Homo sapiens
ctaaaatacttgagaaatt

SEQ ID NO: 2187848 - DNA, 21 bp, Homo sapiens
ctaaacagagaaaagcttgga

SEQ ID NO: 2187849 - DNA, 15 bp, Homo sapiens
ctaaactacattata

SEQ ID NO: 2187850 - DNA, 23 bp, Homo sapiens
ctaaagaggaagccttgcccagc

SEQ ID NO: 2187851 - DNA, 22 bp, Homo sapiens
ctaaagaggtggggtgaagctg

SEQ ID NO: 2187852 - DNA, 20 bp, Homo sapiens
ctaaaggtcccaaggcaagg

SEQ ID NO: 2187853 - DNA, 18 bp, Homo sapiens
ctaaatactgtacataga

SEQ ID NO: 2187854 - DNA, 19 bp, Homo sapiens
ctaacaggggctggtgggc

SEQ ID NO: 2187855 - DNA, 19 bp, Homo sapiens
ctaaccccgtctgctcctc

SEQ ID NO: 2187856 - DNA, 13 bp, Homo sapiens
ctaacctcaaaat

SEQ ID NO: 2187857 - DNA, 15 bp, Homo sapiens
ctaactcacctaact

SEQ ID NO: 2187858 - DNA, 18 bp, Homo sapiens
ctaactctgcccaccctc

SEQ ID NO: 2187859 - DNA, 15 bp, Homo sapiens
ctaactgagctgcca

SEQ ID NO: 2187860 - DNA, 13 bp, Homo sapiens
ctaagaacaaaac

SEQ ID NO: 2187861 - DNA, 13 bp, Homo sapiens
ctaagaataatga

SEQ ID NO: 2187862 - DNA, 21 bp, Homo sapiens
ctaagagaagttgtaaagtat

SEQ ID NO: 2187863 - DNA, 22 bp, Homo sapiens
ctaagatgtattaacctacctg

SEQ ID NO: 2187864 - DNA, 21 bp, Homo sapiens
ctaagcatacgtatacaataa

SEQ ID NO: 2187865 - DNA, 19 bp, Homo sapiens
ctaaggcctcttgctggtg

SEQ ID NO: 2187866 - DNA, 20 bp, Homo sapiens
ctaaggcctcttgctggtgc

SEQ ID NO: 2187867 - DNA, 14 bp, Homo sapiens
ctaataaaatacat

SEQ ID NO: 2187868 - DNA, 15 bp, Homo sapiens
ctaataaaatacata

SEQ ID NO: 2187869 - DNA, 23 bp, Homo sapiens
ctaatgacaattttgagaaaagg

SEQ ID NO: 2187870 - DNA, 13 bp, Homo sapiens
ctaatgctgcaca

SEQ ID NO: 2187871 - DNA, 20 bp, Homo sapiens
ctaatttttattaatttgta

SEQ ID NO: 2187872 - DNA, 17 bp, Homo sapiens
ctaattttttgtgtttt

SEQ ID NO: 2187873 - DNA, 16 bp, Homo sapiens
ctacaagagggcaaag

SEQ ID NO: 2187874 - DNA, 20 bp, Homo sapiens
ctacaagagggcaaagctga

SEQ ID NO: 2187875 - DNA, 14 bp, Homo sapiens
ctacacctaactca

SEQ ID NO: 2187876 - DNA, 14 bp, Homo sapiens
ctacagaggattct

SEQ ID NO: 2187877 - DNA, 19 bp, Homo sapiens
ctacagcaccttaaaaatt

SEQ ID NO: 2187878 - DNA, 23 bp, Homo sapiens
ctacagcaccttaaaaattagaa

SEQ ID NO: 2187879 - DNA, 12 bp, Homo sapiens
ctacagccagcg

SEQ ID NO: 2187880 - DNA, 17 bp, Homo sapiens
ctacagccctggaggcc

SEQ ID NO: 2187881 - DNA, 18 bp, Homo sapiens
ctacaggtgagtgccacc

SEQ ID NO: 2187882 - DNA, 21 bp, Homo sapiens
ctaccactggtgtaaaaaaca

SEQ ID NO: 2187883 - DNA, 15 bp, Homo sapiens
ctacccacagggcct

SEQ ID NO: 2187884 - DNA, 22 bp, Homo sapiens
ctacccacagggcctgactttt

SEQ ID NO: 2187885 - DNA, 12 bp, Homo sapiens
ctacccagccca

SEQ ID NO: 2187886 - DNA, 15 bp, Homo sapiens
ctacccagcccatct

SEQ ID NO: 2187887 - DNA, 18 bp, Homo sapiens
ctaccccccgtctcctgc

SEQ ID NO: 2187888 - DNA, 20 bp, Homo sapiens
ctacccttgccaaggccgcc

SEQ ID NO: 2187889 - DNA, 17 bp, Homo sapiens
ctacctcttttgagact

SEQ ID NO: 2187890 - DNA, 15 bp, Homo sapiens
ctacctgatcccact

SEQ ID NO: 2187891 - DNA, 17 bp, Homo sapiens
ctacctgatcccactcc

SEQ ID NO: 2187892 - DNA, 13 bp, Homo sapiens
ctacctgccctct

SEQ ID NO: 2187893 - DNA, 16 bp, Homo sapiens
ctacctgccctctctc

SEQ ID NO: 2187894 - DNA, 21 bp, Homo sapiens
ctacctgccctctctcagtta

SEQ ID NO: 2187895 - DNA, 16 bp, Homo sapiens
ctaccttcaaagctga

SEQ ID NO: 2187896 - DNA, 19 bp, Homo sapiens
ctaccttttttttacggaa

SEQ ID NO: 2187897 - DNA, 18 bp, Homo sapiens
ctactaagtctgtgtcct

SEQ ID NO: 2187898 - DNA, 11 bp, Homo sapiens
ctactggctgt

SEQ ID NO: 2187899 - DNA, 13 bp, Homo sapiens
ctacttgtaaact

SEQ ID NO: 2187900 - DNA, 15 bp, Homo sapiens
ctacttgtaaacttg

SEQ ID NO: 2187901 - DNA, 18 bp, Homo sapiens
ctacttgtaaacttgaaa

SEQ ID NO: 2187902 - DNA, 15 bp, Homo sapiens
ctagaaaagaagcag

SEQ ID NO: 2187903 - DNA, 20 bp, Homo sapiens
ctagaatactaataaaatac

SEQ ID NO: 2187904 - DNA, 20 bp, Homo sapiens
ctagaatatcctacttctcc

SEQ ID NO: 2187905 - DNA, 23 bp, Homo sapiens
ctagagaggggcctctggctgcc

SEQ ID NO: 2187906 - DNA, 17 bp, Homo sapiens
ctagagcagccctggag

SEQ ID NO: 2187907 - DNA, 12 bp, Homo sapiens
ctctgaggctca

SEQ ID NO: 2187908 - DNA, 16 bp, Homo sapiens
ctctgaggctcagccc

SEQ ID NO: 2187909 - DNA, 17 bp, Homo sapiens
ctctgaggctcagccct

SEQ ID NO: 2187910 - DNA, 17 bp, Homo sapiens
ctctgcacagacaagca

SEQ ID NO: 2187911 - DNA, 23 bp, Homo sapiens
ctctgcagggcagcctgtgggag

SEQ ID NO: 2187912 - DNA, 17 bp, Homo sapiens
ctctgcccaccctcctg

SEQ ID NO: 2187913 - DNA, 13 bp, Homo sapiens
ctctgcccagagc

SEQ ID NO: 2187914 - DNA, 14 bp, Homo sapiens
ctctgcccagagct

SEQ ID NO: 2187915 - DNA, 17 bp, Homo sapiens
ctctgcccagagctggg

SEQ ID NO: 2187916 - DNA, 16 bp, Homo sapiens
ctctgccgataacctg

SEQ ID NO: 2187917 - DNA, 22 bp, Homo sapiens
ctctgcctttgttcactgtgag

SEQ ID NO: 2187918 - DNA, 16 bp, Homo sapiens
ctctggaagcctgctg

SEQ ID NO: 2187919 - DNA, 21 bp, Homo sapiens
ctctggaagcctgctgatttc

SEQ ID NO: 2187920 - DNA, 13 bp, Homo sapiens
ctctggagaacag

SEQ ID NO: 2187921 - DNA, 18 bp, Homo sapiens
ctctggagaacagtggtt

SEQ ID NO: 2187922 - DNA, 15 bp, Homo sapiens
ctctggagccacctg

SEQ ID NO: 2187923 - DNA, 17 bp, Homo sapiens
ctctggaggcctctggg

SEQ ID NO: 2187924 - DNA, 10 bp, Homo sapiens
ctctgggctt

SEQ ID NO: 2187925 - DNA, 22 bp, Homo sapiens
ctctgggctttgattccatctc

SEQ ID NO: 2187926 - DNA, 23 bp, Homo sapiens
ctctgggctttgattccatctcc

SEQ ID NO: 2187927 - DNA, 21 bp, Homo sapiens
ctctggggctcagccctgagc

SEQ ID NO: 2187928 - DNA, 10 bp, Homo sapiens
ctctggtggg

SEQ ID NO: 2187929 - DNA, 14 bp, Homo sapiens
ctctggtgggaaaa

SEQ ID NO: 2187930 - DNA, 13 bp, Homo sapiens
ctctgtccagggc

SEQ ID NO: 2187931 - DNA, 16 bp, Homo sapiens
ctctgtccagggcttc

SEQ ID NO: 2187932 - DNA, 19 bp, Homo sapiens
ctctgtccagggcttcaga

SEQ ID NO: 2187933 - DNA, 15 bp, Homo sapiens
ctctgtctaccatct

SEQ ID NO: 2187934 - DNA, 16 bp, Homo sapiens
ctctgtctaccatctc

SEQ ID NO: 2187935 - DNA, 20 bp, Homo sapiens
ctctgtctaccatctccctc

SEQ ID NO: 2187936 - DNA, 21 bp, Homo sapiens
ctctgtctaccatctccctcg

SEQ ID NO: 2187937 - DNA, 14 bp, Homo sapiens
ctctgttcagtaac

SEQ ID NO: 2187938 - DNA, 19 bp, Homo sapiens
ctcttacccttctgtgccc

SEQ ID NO: 2187939 - DNA, 18 bp, Homo sapiens
ctcttcagtgactcctgc

SEQ ID NO: 2187940 - DNA, 20 bp, Homo sapiens
ctcttcagtgactcctgctg

SEQ ID NO: 2187941 - DNA, 21 bp, Homo sapiens
ctcttcagtgactcctgctgg

SEQ ID NO: 2187942 - DNA, 22 bp, Homo sapiens
ctcttcagtgactcctgctggt

SEQ ID NO: 2187943 - DNA, 23 bp, Homo sapiens
ctcttcagtgactcctgctggta

SEQ ID NO: 2187944 - DNA, 15 bp, Homo sapiens
ctcttcctccctccc

SEQ ID NO: 2187945 - DNA, 14 bp, Homo sapiens
ctcttcttctttct

SEQ ID NO: 2187946 - DNA, 22 bp, Homo sapiens
ctcttgaataaagtattctagt

SEQ ID NO: 2187947 - DNA, 15 bp, Homo sapiens
ctcttgcagagaagc

SEQ ID NO: 2187948 - DNA, 20 bp, Homo sapiens
ctctttctttttctgtctct

SEQ ID NO: 2187949 - DNA, 23 bp, Homo sapiens
ctctttctttttctgtctctctt

SEQ ID NO: 2187950 - DNA, 17 bp, Homo sapiens
ctctttttcttgtaaac

SEQ ID NO: 2187951 - DNA, 20 bp, Homo sapiens
ctgaaagcattattttttgt

SEQ ID NO: 2187952 - DNA, 14 bp, Homo sapiens
ctgaaagctgcttc

SEQ ID NO: 2187953 - DNA, 12 bp, Homo sapiens
ctgaacaaaagc

SEQ ID NO: 2187954 - DNA, 15 bp, Homo sapiens
ctgaacaaaagcagg

SEQ ID NO: 2187955 - DNA, 21 bp, Homo sapiens
ctgaacaaaagcaggttttta

SEQ ID NO: 2187956 - DNA, 15 bp, Homo sapiens
ctgaacatttttaaa

SEQ ID NO: 2187957 - DNA, 19 bp, Homo sapiens
ctgaaccgctacaagaggg

SEQ ID NO: 2187958 - DNA, 20 bp, Homo sapiens
ctgaactcgcttctctgtga

SEQ ID NO: 2187959 - DNA, 20 bp, Homo sapiens
ctgaactgtgcatcaaccag

SEQ ID NO: 2187960 - DNA, 21 bp, Homo sapiens
ctgaagccatgtagccaccca

SEQ ID NO: 2187961 - DNA, 18 bp, Homo sapiens
ctgaagccgccaggaccg

SEQ ID NO: 2187962 - DNA, 21 bp, Homo sapiens
ctgaaggcagtggcaggggag

SEQ ID NO: 2187963 - DNA, 23 bp, Homo sapiens
ctgaaggttggaactgctgccat

SEQ ID NO: 2187964 - DNA, 20 bp, Homo sapiens
ctgaagtgccagatcaaaat

SEQ ID NO: 2187965 - DNA, 18 bp, Homo sapiens
ctgaatgcctcgctccct

SEQ ID NO: 2187966 - DNA, 18 bp, Homo sapiens
ctgaatttctatggcata

SEQ ID NO: 2187967 - DNA, 22 bp, Homo sapiens
ctgacaaagtcatgaagctcag

SEQ ID NO: 2187968 - DNA, 13 bp, Homo sapiens
ctgaccagctgct

SEQ ID NO: 2187969 - DNA, 18 bp, Homo sapiens
ctgaccctgcagagatgc

SEQ ID NO: 2187970 - DNA, 20 bp, Homo sapiens
ctgacctcaagcaaccatga

SEQ ID NO: 2187971 - DNA, 11 bp, Homo sapiens
ctgacctcagc

SEQ ID NO: 2187972 - DNA, 17 bp, Homo sapiens
ctgacctcccactttgg

SEQ ID NO: 2187973 - DNA, 14 bp, Homo sapiens
ctgacgaggctggg

SEQ ID NO: 2187974 - DNA, 17 bp, Homo sapiens
ctgacgaggctgggcca

SEQ ID NO: 2187975 - DNA, 21 bp, Homo sapiens
ctgacgaggctgggccaagcc

SEQ ID NO: 2187976 - DNA, 22 bp, Homo sapiens
ctgactcccaaagagctgccta

SEQ ID NO: 2187977 - DNA, 17 bp, Homo sapiens
ctgacttggttctgaag

SEQ ID NO: 2187978 - DNA, 15 bp, Homo sapiens
ctgacttttacagct

SEQ ID NO: 2187979 - DNA, 17 bp, Homo sapiens
ctgacttttacagcttt

SEQ ID NO: 2187980 - DNA, 19 bp, Homo sapiens
ctgacttttacagcttttc

SEQ ID NO: 2187981 - DNA, 16 bp, Homo sapiens
ctgagaccttgatgag

SEQ ID NO: 2187982 - DNA, 15 bp, Homo sapiens
ctgagactacaggtg

SEQ ID NO: 2187983 - DNA, 18 bp, Homo sapiens
ctgagattacaggtgtga

SEQ ID NO: 2187984 - DNA, 18 bp, Homo sapiens
ctgagcaagacgccctct

SEQ ID NO: 2187985 - DNA, 20 bp, Homo sapiens
ctgagcaagacgccctctcg

SEQ ID NO: 2187986 - DNA, 21 bp, Homo sapiens
ctgagcacacaacaggctgtg

SEQ ID NO: 2187987 - DNA, 23 bp, Homo sapiens
ctgagcaggggaacaaaataagg

SEQ ID NO: 2187988 - DNA, 23 bp, Homo sapiens
ctgagccggccccaggctcgtgg

SEQ ID NO: 2187989 - DNA, 20 bp, Homo sapiens
ctgagctggcctcacctggg

SEQ ID NO: 2187990 - DNA, 21 bp, Homo sapiens
ctgagctttggacacacacag

SEQ ID NO: 2187991 - DNA, 14 bp, Homo sapiens
ctgaggagcaaagc

SEQ ID NO: 2187992 - DNA, 18 bp, Homo sapiens
ctgaggcagaacctggtg

SEQ ID NO: 2187993 - DNA, 13 bp, Homo sapiens
ctgaggtatctgt

SEQ ID NO: 2187994 - DNA, 16 bp, Homo sapiens
ctgagtagcagaaaac

SEQ ID NO: 2187995 - DNA, 19 bp, Homo sapiens
ctgagtgaagcaaaaacta

SEQ ID NO: 2187996 - DNA, 20 bp, Homo sapiens
ctgagtgaagcaaaaactac

SEQ ID NO: 2187997 - DNA, 21 bp, Homo sapiens
ctgagttgaggggcttccctc

SEQ ID NO: 2187998 - DNA, 18 bp, Homo sapiens
ctgagttggcatcacctg

SEQ ID NO: 2187999 - DNA, 22 bp, Homo sapiens
ctgagtttgtggtgatcgcaca

SEQ ID NO: 2188000 - DNA, 13 bp, Homo sapiens
ctgataaaaatga

SEQ ID NO: 2188001 - DNA, 21 bp, Homo sapiens
ctgatatacttgagtgtgcaa

SEQ ID NO: 2188002 - DNA, 22 bp, Homo sapiens
ctgatatctgtttgcttctaaa

SEQ ID NO: 2188003 - DNA, 17 bp, Homo sapiens
ctgatcatttgcagctg

SEQ ID NO: 2188004 - DNA, 17 bp, Homo sapiens
ctgatcccactcctagg

SEQ ID NO: 2188005 - DNA, 15 bp, Homo sapiens
ctgatgatggaaggg

SEQ ID NO: 2188006 - DNA, 16 bp, Homo sapiens
ctgatgctaattttca

SEQ ID NO: 2188007 - DNA, 16 bp, Homo sapiens
ctgatgtcatcttgag

SEQ ID NO: 2188008 - DNA, 17 bp, Homo sapiens
ctgatgtcatcttgagc

SEQ ID NO: 2188009 - DNA, 18 bp, Homo sapiens
ctgatgttaggctgggcc

SEQ ID NO: 2188010 - DNA, 22 bp, Homo sapiens
ctgatgttaggctgggcccaga

SEQ ID NO: 2188011 - DNA, 22 bp, Homo sapiens
ctgattaacctacttgtaaact

SEQ ID NO: 2188012 - DNA, 20 bp, Homo sapiens
ctgattcaataaaatgcact

SEQ ID NO: 2188013 - DNA, 14 bp, Homo sapiens
ctgatttgctgttt

SEQ ID NO: 2188014 - DNA, 18 bp, Homo sapiens
ctgattttttttttaact

SEQ ID NO: 2188015 - DNA, 23 bp, Homo sapiens
ctgattttttttttaacttgaaa

SEQ ID NO: 2188016 - DNA, 14 bp, Homo sapiens
ctgcaaataaagcc

SEQ ID NO: 2188017 - DNA, 16 bp, Homo sapiens
ctgcaaataaagcctt

SEQ ID NO: 2188018 - DNA, 22 bp, Homo sapiens
ctgcaagtgagcaaacctgccc

SEQ ID NO: 2188019 - DNA, 16 bp, Homo sapiens
ctgcacagggccctct

SEQ ID NO: 2188020 - DNA, 21 bp, Homo sapiens
ctgcactatagccatttgccc

SEQ ID NO: 2188021 - DNA, 13 bp, Homo sapiens
ctgcagaaggaaa

SEQ ID NO: 2188022 - DNA, 14 bp, Homo sapiens
ctgcagaaggaaag

SEQ ID NO: 2188023 - DNA, 17 bp, Homo sapiens
ctgcagaaggaaagaag

SEQ ID NO: 2188024 - DNA, 22 bp, Homo sapiens
ctgcagaaggaaagaagggggc

SEQ ID NO: 2188025 - DNA, 23 bp, Homo sapiens
ctgcagaaggaaagaagggggcc

SEQ ID NO: 2188026 - DNA, 20 bp, Homo sapiens
ctgcagcctcgaactcctgg

SEQ ID NO: 2188027 - DNA, 14 bp, Homo sapiens
ctgcagggcagcct

SEQ ID NO: 2188028 - DNA, 14 bp, Homo sapiens
cttctcctcagctt

SEQ ID NO: 2188029 - DNA, 13 bp, Homo sapiens
cttctctgtctca

SEQ ID NO: 2188030 - DNA, 21 bp, Homo sapiens
cttctctgttccattgaatct

SEQ ID NO: 2188031 - DNA, 13 bp, Homo sapiens
cttctcttagatt

SEQ ID NO: 2188032 - DNA, 23 bp, Homo sapiens
cttctcttagattatgttcaatg

SEQ ID NO: 2188033 - DNA, 19 bp, Homo sapiens
cttctgaagatcagaacat

SEQ ID NO: 2188034 - DNA, 21 bp, Homo sapiens
cttctgaagatggaaggcctt

SEQ ID NO: 2188035 - DNA, 18 bp, Homo sapiens
cttctgcacaaagatgtc

SEQ ID NO: 2188036 - DNA, 19 bp, Homo sapiens
cttctggttttcgaagact

SEQ ID NO: 2188037 - DNA, 21 bp, Homo sapiens
cttctgtaacgggtcgtgctc

SEQ ID NO: 2188038 - DNA, 21 bp, Homo sapiens
cttctgtcctcttctgtgagt

SEQ ID NO: 2188039 - DNA, 12 bp, Homo sapiens
cttctgtgccca

SEQ ID NO: 2188040 - DNA, 18 bp, Homo sapiens
cttctgtgcccagctcag

SEQ ID NO: 2188041 - DNA, 20 bp, Homo sapiens
cttcttttgaccccttcctg

SEQ ID NO: 2188042 - DNA, 14 bp, Homo sapiens
cttcttttggaaag

SEQ ID NO: 2188043 - DNA, 15 bp, Homo sapiens
cttgaaaagattgca

SEQ ID NO: 2188044 - DNA, 19 bp, Homo sapiens
cttgaaaagattgcaaagg

SEQ ID NO: 2188045 - DNA, 19 bp, Homo sapiens
cttgaaacttggttcccag

SEQ ID NO: 2188046 - DNA, 23 bp, Homo sapiens
cttgaaagaaaggggcaggagct

SEQ ID NO: 2188047 - DNA, 15 bp, Homo sapiens
cttgaactcctgacc

SEQ ID NO: 2188048 - DNA, 21 bp, Homo sapiens
cttgaatcaggaggagattaa

SEQ ID NO: 2188049 - DNA, 20 bp, Homo sapiens
cttgacgcgtggtcacagga

SEQ ID NO: 2188050 - DNA, 10 bp, Homo sapiens
cttgagaaat

SEQ ID NO: 2188051 - DNA, 21 bp, Homo sapiens
cttgagaccaagccggtgccc

SEQ ID NO: 2188052 - DNA, 19 bp, Homo sapiens
cttgagagcgctggcctct

SEQ ID NO: 2188053 - DNA, 22 bp, Homo sapiens
cttgagtgtgcaagcaaagaac

SEQ ID NO: 2188054 - DNA, 22 bp, Homo sapiens
cttgagtttgtttcttgtgtgt

SEQ ID NO: 2188055 - DNA, 19 bp, Homo sapiens
cttgatatatttataaata

SEQ ID NO: 2188056 - DNA, 21 bp, Homo sapiens
cttgatatatttataaatatg

SEQ ID NO: 2188057 - DNA, 18 bp, Homo sapiens
cttgatatgactaattca

SEQ ID NO: 2188058 - DNA, 14 bp, Homo sapiens
cttgatgactgctg

SEQ ID NO: 2188059 - DNA, 15 bp, Homo sapiens
cttgatgactgctga

SEQ ID NO: 2188060 - DNA, 16 bp, Homo sapiens
cttgatgactgctgat

SEQ ID NO: 2188061 - DNA, 18 bp, Homo sapiens
cttgatgactgctgattt

SEQ ID NO: 2188062 - DNA, 20 bp, Homo sapiens
cttgcagagaagccttggta

SEQ ID NO: 2188063 - DNA, 20 bp, Homo sapiens
cttgcccacttctccttcgc

SEQ ID NO: 2188064 - DNA, 17 bp, Homo sapiens
cttgcccagcaaggacc

SEQ ID NO: 2188065 - DNA, 14 bp, Homo sapiens
cttgccgctgggag

SEQ ID NO: 2188066 - DNA, 19 bp, Homo sapiens
cttgccgctgggagagcca

SEQ ID NO: 2188067 - DNA, 17 bp, Homo sapiens
cttgcctccatggtgcc

SEQ ID NO: 2188068 - DNA, 22 bp, Homo sapiens
cttgcctccatggtgcctctgg

SEQ ID NO: 2188069 - DNA, 19 bp, Homo sapiens
cttgccttatctgttcctt

SEQ ID NO: 2188070 - DNA, 13 bp, Homo sapiens
cttgctgcacctg

SEQ ID NO: 2188071 - DNA, 21 bp, Homo sapiens
cttggcctcccaaagtgctga

SEQ ID NO: 2188072 - DNA, 16 bp, Homo sapiens
cttggctcgttctctt

SEQ ID NO: 2188073 - DNA, 20 bp, Homo sapiens
cttgggaaaatatcactttg

SEQ ID NO: 2188074 - DNA, 21 bp, Homo sapiens
cttgggagagggagcaagcct

SEQ ID NO: 2188075 - DNA, 18 bp, Homo sapiens
cttgggcctcaggctctg

SEQ ID NO: 2188076 - DNA, 19 bp, Homo sapiens
cttgggcctcaggctctgc

SEQ ID NO: 2188077 - DNA, 22 bp, Homo sapiens
cttggggcagccattggcctct

SEQ ID NO: 2188078 - DNA, 14 bp, Homo sapiens
cttggggcctggcg

SEQ ID NO: 2188079 - DNA, 16 bp, Homo sapiens
cttggggcctggcgtg

SEQ ID NO: 2188080 - DNA, 14 bp, Homo sapiens
cttgggttcctttt

SEQ ID NO: 2188081 - DNA, 17 bp, Homo sapiens
cttggtaagagggagcc

SEQ ID NO: 2188082 - DNA, 23 bp, Homo sapiens
cttggtaagagggagccggtttg

SEQ ID NO: 2188083 - DNA, 14 bp, Homo sapiens
cttggttcccagaa

SEQ ID NO: 2188084 - DNA, 15 bp, Homo sapiens
cttggttgtctggca

SEQ ID NO: 2188085 - DNA, 15 bp, Homo sapiens
cttgtaaacctggag

SEQ ID NO: 2188086 - DNA, 20 bp, Homo sapiens
cttgtaccttgagttgagta

SEQ ID NO: 2188087 - DNA, 13 bp, Homo sapiens
cttgtactgggac

SEQ ID NO: 2188088 - DNA, 22 bp, Homo sapiens
cttgtactgtgacctaagaaca

SEQ ID NO: 2188089 - DNA, 17 bp, Homo sapiens
cttgtagaggagcaggg

SEQ ID NO: 2188090 - DNA, 15 bp, Homo sapiens
cttgtcagaaacact

SEQ ID NO: 2188091 - DNA, 15 bp, Homo sapiens
cttgtcatccacaca

SEQ ID NO: 2188092 - DNA, 21 bp, Homo sapiens
cttgtcatccacacaacacca

SEQ ID NO: 2188093 - DNA, 18 bp, Homo sapiens
cttgtccccacactccta

SEQ ID NO: 2188094 - DNA, 23 bp, Homo sapiens
cttgtcccccgtgatctcccctc

SEQ ID NO: 2188095 - DNA, 21 bp, Homo sapiens
cttgtctctcattctctttct

SEQ ID NO: 2188096 - DNA, 22 bp, Homo sapiens
cttgtctctcattctctttctt

SEQ ID NO: 2188097 - DNA, 13 bp, Homo sapiens
cttgtctgctgct

SEQ ID NO: 2188098 - DNA, 14 bp, Homo sapiens
cttgtctgctgctc

SEQ ID NO: 2188099 - DNA, 15 bp, Homo sapiens
cttgtgatctgggaa

SEQ ID NO: 2188100 - DNA, 19 bp, Homo sapiens
cttgtgcattgtgtgtcac

SEQ ID NO: 2188101 - DNA, 15 bp, Homo sapiens
cttgtgtgagtgtga

SEQ ID NO: 2188102 - DNA, 17 bp, Homo sapiens
ctttaatacaaaaagca

SEQ ID NO: 2188103 - DNA, 20 bp, Homo sapiens
ctttaattgttgcttttacg

SEQ ID NO: 2188104 - DNA, 14 bp, Homo sapiens
ctttaccaccccca

SEQ ID NO: 2188105 - DNA, 16 bp, Homo sapiens
ctttaccacccccaca

SEQ ID NO: 2188106 - DNA, 13 bp, Homo sapiens
ctttacgtatttt

SEQ ID NO: 2188107 - DNA, 18 bp, Homo sapiens
ctttagaatattaaaaat

SEQ ID NO: 2188108 - DNA, 21 bp, Homo sapiens
ctttagggactcaatttctcc

SEQ ID NO: 2188109 - DNA, 23 bp, Homo sapiens
ctttagggactcaatttctcccc

SEQ ID NO: 2188110 - DNA, 18 bp, Homo sapiens
ctttagtgttcaaatact

SEQ ID NO: 2188111 - DNA, 11 bp, Homo sapiens
ctttattcttt

SEQ ID NO: 2188112 - DNA, 12 bp, Homo sapiens
ctttattcttta

SEQ ID NO: 2188113 - DNA, 15 bp, Homo sapiens
ctttattctttaatt

SEQ ID NO: 2188114 - DNA, 19 bp, Homo sapiens
ctttattgattttctttct

SEQ ID NO: 2188115 - DNA, 15 bp, Homo sapiens
ctttcactgaagtga

SEQ ID NO: 2188116 - DNA, 19 bp, Homo sapiens
ctttcactgaagtgaatac

SEQ ID NO: 2188117 - DNA, 21 bp, Homo sapiens
ctttcccaacacttcagactg

SEQ ID NO: 2188118 - DNA, 23 bp, Homo sapiens
ctttcccacagtctctccctggg

SEQ ID NO: 2188119 - DNA, 18 bp, Homo sapiens
ctttccccatactctgtc

SEQ ID NO: 2188120 - DNA, 22 bp, Homo sapiens
ctttccggccaaggtgccacca

SEQ ID NO: 2188121 - DNA, 13 bp, Homo sapiens
ctttcctgggtga

SEQ ID NO: 2188122 - DNA, 17 bp, Homo sapiens
ctttcctgggtgagttt

SEQ ID NO: 2188123 - DNA, 13 bp, Homo sapiens
ctttctagtttgt

SEQ ID NO: 2188124 - DNA, 14 bp, Homo sapiens
ctttctatctaatt

SEQ ID NO: 2188125 - DNA, 18 bp, Homo sapiens
ctttctatctaattttta

SEQ ID NO: 2188126 - DNA, 12 bp, Homo sapiens
ctttctcctgtg

SEQ ID NO: 2188127 - DNA, 13 bp, Homo sapiens
ctttctcctgtgc

SEQ ID NO: 2188128 - DNA, 21 bp, Homo sapiens
ctttctctgcttcagcttgct

SEQ ID NO: 2188129 - DNA, 22 bp, Homo sapiens
ctttctgacaataaataatatt

SEQ ID NO: 2188130 - DNA, 22 bp, Homo sapiens
ctttcttcaatacaaaaagcca

SEQ ID NO: 2188131 - DNA, 17 bp, Homo sapiens
ctttctttttctgtctc

SEQ ID NO: 2188132 - DNA, 19 bp, Homo sapiens
ctttctttttctgtctctc

SEQ ID NO: 2188133 - DNA, 17 bp, Homo sapiens
ctttgaaagaagcaaga

SEQ ID NO: 2188134 - DNA, 19 bp, Homo sapiens
ctttgaccaaactgtgggt

SEQ ID NO: 2188135 - DNA, 16 bp, Homo sapiens
ctttgcagacctggga

SEQ ID NO: 2188136 - DNA, 20 bp, Homo sapiens
ctttgcagacctgggacttt

SEQ ID NO: 2188137 - DNA, 22 bp, Homo sapiens
ctttgcagacctgggactttag

SEQ ID NO: 2188138 - DNA, 15 bp, Homo sapiens
ctttgcccaacctca

SEQ ID NO: 2188139 - DNA, 18 bp, Homo sapiens
ctttgctccaccccactc

SEQ ID NO: 2188140 - DNA, 11 bp, Homo sapiens
ctttgctctga

SEQ ID NO: 2188141 - DNA, 12 bp, Homo sapiens
ctttgctttgta

SEQ ID NO: 2188142 - DNA, 14 bp, Homo sapiens
ctttgctttgtagt

SEQ ID NO: 2188143 - DNA, 21 bp, Homo sapiens
ctttggacacacacagcttct

SEQ ID NO: 2188144 - DNA, 15 bp, Homo sapiens
ctttggctcgggact

SEQ ID NO: 2188145 - DNA, 23 bp, Homo sapiens
ctttggtggcccctccccaactc

SEQ ID NO: 2188146 - DNA, 16 bp, Homo sapiens
ctttgtaaggacttgt

SEQ ID NO: 2188147 - DNA, 21 bp, Homo sapiens
ctttgtaaggacttgtgcctc

SEQ ID NO: 2188148 - DNA, 21 bp, Homo sapiens
ctttgtaagtaaactgccctg

SEQ ID NO: 2188149 - DNA, 16 bp, Homo sapiens
gcaaagggacattgaa

SEQ ID NO: 2188150 - DNA, 17 bp, Homo sapiens
gcaaagggacattgaag

SEQ ID NO: 2188151 - DNA, 16 bp, Homo sapiens
gcaaagggccaggaag

SEQ ID NO: 2188152 - DNA, 18 bp, Homo sapiens
gcaaagggtctgtggcca

SEQ ID NO: 2188153 - DNA, 14 bp, Homo sapiens
gcaaagtgccctca

SEQ ID NO: 2188154 - DNA, 15 bp, Homo sapiens
gcaaagtgctagcca

SEQ ID NO: 2188155 - DNA, 15 bp, Homo sapiens
gcaaataaagccttt

SEQ ID NO: 2188156 - DNA, 16 bp, Homo sapiens
gcaaataaagcctttt

SEQ ID NO: 2188157 - DNA, 19 bp, Homo sapiens
gcaaataaagccttttaaa

SEQ ID NO: 2188158 - DNA, 15 bp, Homo sapiens
gcaaatatgtttgca

SEQ ID NO: 2188159 - DNA, 21 bp, Homo sapiens
gcaaatgccaggacagctgca

SEQ ID NO: 2188160 - DNA, 23 bp, Homo sapiens
gcaaatgccaggacagctgcagg

SEQ ID NO: 2188161 - DNA, 21 bp, Homo sapiens
gcaaattccacccctccttcc

SEQ ID NO: 2188162 - DNA, 16 bp, Homo sapiens
gcaaatttcatctttc

SEQ ID NO: 2188163 - DNA, 15 bp, Homo sapiens
gcaacaaaggatttg

SEQ ID NO: 2188164 - DNA, 17 bp, Homo sapiens
gcaaccaggaacagcaa

SEQ ID NO: 2188165 - DNA, 19 bp, Homo sapiens
gcaacctccacctcccagg

SEQ ID NO: 2188166 - DNA, 15 bp, Homo sapiens
gcaactattaataat

SEQ ID NO: 2188167 - DNA, 12 bp, Homo sapiens
gcaagcaaagca

SEQ ID NO: 2188168 - DNA, 21 bp, Homo sapiens
gcaagctaggccccagaggcc

SEQ ID NO: 2188169 - DNA, 21 bp, Homo sapiens
gcaagctccgcctcctgggtt

SEQ ID NO: 2188170 - DNA, 13 bp, Homo sapiens
gcaagctggcagg

SEQ ID NO: 2188171 - DNA, 17 bp, Homo sapiens
gcaagctggcaggaggg

SEQ ID NO: 2188172 - DNA, 17 bp, Homo sapiens
gcaaggaccagtgagac

SEQ ID NO: 2188173 - DNA, 14 bp, Homo sapiens
gcaaggactttgta

SEQ ID NO: 2188174 - DNA, 12 bp, Homo sapiens
gcaaggctgccg

SEQ ID NO: 2188175 - DNA, 14 bp, Homo sapiens
gcaaggggtgcctg

SEQ ID NO: 2188176 - DNA, 14 bp, Homo sapiens
gcaatatcaaaagg

SEQ ID NO: 2188177 - DNA, 17 bp, Homo sapiens
gcaatcacttttggaca

SEQ ID NO: 2188178 - DNA, 13 bp, Homo sapiens
gcaatcctcctga

SEQ ID NO: 2188179 - DNA, 20 bp, Homo sapiens
gcacacaacaggctgtgtgt

SEQ ID NO: 2188180 - DNA, 18 bp, Homo sapiens
gcacacacactagccttc

SEQ ID NO: 2188181 - DNA, 23 bp, Homo sapiens
gcacacacggttttggcagctga

SEQ ID NO: 2188182 - DNA, 17 bp, Homo sapiens
gcacaccagttactgtt

SEQ ID NO: 2188183 - DNA, 15 bp, Homo sapiens
gcacagaacaagcca

SEQ ID NO: 2188184 - DNA, 16 bp, Homo sapiens
gcacagacaagcagcc

SEQ ID NO: 2188185 - DNA, 18 bp, Homo sapiens
gcacagacaagcagccct

SEQ ID NO: 2188186 - DNA, 22 bp, Homo sapiens
gcacagacaagcagcccttgct

SEQ ID NO: 2188187 - DNA, 23 bp, Homo sapiens
gcacagagcatccgtctcccctc

SEQ ID NO: 2188188 - DNA, 12 bp, Homo sapiens
gcacagctgtgg

SEQ ID NO: 2188189 - DNA, 17 bp, Homo sapiens
gcaccaagagccaatgg

SEQ ID NO: 2188190 - DNA, 16 bp, Homo sapiens
gcaccaagcccacagg

SEQ ID NO: 2188191 - DNA, 17 bp, Homo sapiens
gcaccagccggggaaga

SEQ ID NO: 2188192 - DNA, 13 bp, Homo sapiens
gcaccaggaagcc

SEQ ID NO: 2188193 - DNA, 22 bp, Homo sapiens
gcaccattcaggaacctggacc

SEQ ID NO: 2188194 - DNA, 23 bp, Homo sapiens
gcacccccacaagctgtccctgc

SEQ ID NO: 2188195 - DNA, 23 bp, Homo sapiens
gcacctataaatactaaatatga

SEQ ID NO: 2188196 - DNA, 15 bp, Homo sapiens
gcacctcctctctgc

SEQ ID NO: 2188197 - DNA, 19 bp, Homo sapiens
gcacctcctctctgctggg

SEQ ID NO: 2188198 - DNA, 13 bp, Homo sapiens
gcacctctgtgct

SEQ ID NO: 2188199 - DNA, 14 bp, Homo sapiens
gcacctctgtgctg

SEQ ID NO: 2188200 - DNA, 23 bp, Homo sapiens
gcacctgaggcccagcagagccg

SEQ ID NO: 2188201 - DNA, 22 bp, Homo sapiens
gcaccttgtgaaggaaaaacat

SEQ ID NO: 2188202 - DNA, 15 bp, Homo sapiens
gcacctttagaatat

SEQ ID NO: 2188203 - DNA, 16 bp, Homo sapiens
gcactagcctccctct

SEQ ID NO: 2188204 - DNA, 19 bp, Homo sapiens
gcactagcctccctctcct

SEQ ID NO: 2188205 - DNA, 20 bp, Homo sapiens
gcactatagccatttgcccc

SEQ ID NO: 2188206 - DNA, 14 bp, Homo sapiens
gcactattggactt

SEQ ID NO: 2188207 - DNA, 15 bp, Homo sapiens
gcactattggacttt

SEQ ID NO: 2188208 - DNA, 13 bp, Homo sapiens
gcactcacatgct

SEQ ID NO: 2188209 - DNA, 12 bp, Homo sapiens
gcagaaaacaga

SEQ ID NO: 2188210 - DNA, 17 bp, Homo sapiens
gcagaaagcagaggctg

SEQ ID NO: 2188211 - DNA, 20 bp, Homo sapiens
gcagaaatcccagttcatgt

SEQ ID NO: 2188212 - DNA, 14 bp, Homo sapiens
gcagaaccctggtg

SEQ ID NO: 2188213 - DNA, 14 bp, Homo sapiens
gcagaacctggtgg

SEQ ID NO: 2188214 - DNA, 16 bp, Homo sapiens
gcagaacctggtggct

SEQ ID NO: 2188215 - DNA, 15 bp, Homo sapiens
gcagaaggaaagaag

SEQ ID NO: 2188216 - DNA, 23 bp, Homo sapiens
gcagaaggaaagaagggggccct

SEQ ID NO: 2188217 - DNA, 23 bp, Homo sapiens
gcagaattttatgtgactgcttt

SEQ ID NO: 2188218 - DNA, 22 bp, Homo sapiens
gcagacagtccttaatgctgaa

SEQ ID NO: 2188219 - DNA, 14 bp, Homo sapiens
gcagagaagccttg

SEQ ID NO: 2188220 - DNA, 16 bp, Homo sapiens
gcagagaagccttggt

SEQ ID NO: 2188221 - DNA, 16 bp, Homo sapiens
gcagagccgttcctgg

SEQ ID NO: 2188222 - DNA, 17 bp, Homo sapiens
gcagagccgttcctggg

SEQ ID NO: 2188223 - DNA, 15 bp, Homo sapiens
gcagaggccacagga

SEQ ID NO: 2188224 - DNA, 18 bp, Homo sapiens
gcagaggctggcctcaga

SEQ ID NO: 2188225 - DNA, 14 bp, Homo sapiens
gcagaggggagagg

SEQ ID NO: 2188226 - DNA, 18 bp, Homo sapiens
gcagaggggagaggaagc

SEQ ID NO: 2188227 - DNA, 14 bp, Homo sapiens
gcagatgccagagc

SEQ ID NO: 2188228 - DNA, 17 bp, Homo sapiens
gcagatgcctgcagtgc

SEQ ID NO: 2188229 - DNA, 20 bp, Homo sapiens
gcagcagcaagtacaaaagg

SEQ ID NO: 2188230 - DNA, 13 bp, Homo sapiens
gcagcctgtggga

SEQ ID NO: 2188231 - DNA, 15 bp, Homo sapiens
gcagcctgtgggaga

SEQ ID NO: 2188232 - DNA, 16 bp, Homo sapiens
gcagcctgtgggagaa

SEQ ID NO: 2188233 - DNA, 19 bp, Homo sapiens
gcagcctgtgggagaaggg

SEQ ID NO: 2188234 - DNA, 20 bp, Homo sapiens
gcagcctgtgggagaaggga

SEQ ID NO: 2188235 - DNA, 14 bp, Homo sapiens
gcagcgggcggagg

SEQ ID NO: 2188236 - DNA, 15 bp, Homo sapiens
gcagcgggcggaggg

SEQ ID NO: 2188237 - DNA, 21 bp, Homo sapiens
gcagcggtggaaggagcctgc

SEQ ID NO: 2188238 - DNA, 22 bp, Homo sapiens
gcagcgtctgagcggccgcctg

SEQ ID NO: 2188239 - DNA, 16 bp, Homo sapiens
gcagctccgcctggca

SEQ ID NO: 2188240 - DNA, 16 bp, Homo sapiens
gcagcttctgtcctct

SEQ ID NO: 2188241 - DNA, 15 bp, Homo sapiens
gcagcttgctgcacc

SEQ ID NO: 2188242 - DNA, 13 bp, Homo sapiens
gcaggagctcaga

SEQ ID NO: 2188243 - DNA, 16 bp, Homo sapiens
gcaggagctcagatga

SEQ ID NO: 2188244 - DNA, 13 bp, Homo sapiens
gcaggagggtggc

SEQ ID NO: 2188245 - DNA, 17 bp, Homo sapiens
gcaggagggtggcactt

SEQ ID NO: 2188246 - DNA, 22 bp, Homo sapiens
gcaggcatatcaacttgaggcc

SEQ ID NO: 2188247 - DNA, 12 bp, Homo sapiens
gcaggcccacct

SEQ ID NO: 2188248 - DNA, 17 bp, Homo sapiens
gcaggcccagctggggc

SEQ ID NO: 2188249 - DNA, 14 bp, Homo sapiens
gcaggcctttccta

SEQ ID NO: 2188250 - DNA, 16 bp, Homo sapiens
gcaggcctttcctaca

SEQ ID NO: 2188251 - DNA, 13 bp, Homo sapiens
gcagggaaggaca

SEQ ID NO: 2188252 - DNA, 21 bp, Homo sapiens
gcagggaaggacaggaccctc

SEQ ID NO: 2188253 - DNA, 15 bp, Homo sapiens
gcagggcagcctgtg

SEQ ID NO: 2188254 - DNA, 21 bp, Homo sapiens
gcagggcagcctgtgggagaa

SEQ ID NO: 2188255 - DNA, 15 bp, Homo sapiens
gcaggggctgggcag

SEQ ID NO: 2188256 - DNA, 14 bp, Homo sapiens
gcagggtcttcctg

SEQ ID NO: 2188257 - DNA, 23 bp, Homo sapiens
gcaggtcccgagccccctgtcct

SEQ ID NO: 2188258 - DNA, 14 bp, Homo sapiens
gcaggttccccaag

SEQ ID NO: 2188259 - DNA, 20 bp, Homo sapiens
gcaggttccccaagggccct

SEQ ID NO: 2188260 - DNA, 21 bp, Homo sapiens
gcaggttccccaagggccctg

SEQ ID NO: 2188261 - DNA, 19 bp, Homo sapiens
gcaggttctcagctgggct

SEQ ID NO: 2188262 - DNA, 19 bp, Homo sapiens
gcaggttgatcagtgagct

SEQ ID NO: 2188263 - DNA, 17 bp, Homo sapiens
gcagtatgatggcagga

SEQ ID NO: 2188264 - DNA, 17 bp, Homo sapiens
gcagtcacccctgtctg

SEQ ID NO: 2188265 - DNA, 15 bp, Homo sapiens
gcagtctctcttacc

SEQ ID NO: 2188266 - DNA, 19 bp, Homo sapiens
gcagtgagcagggttcctg

SEQ ID NO: 2188267 - DNA, 21 bp, Homo sapiens
gcagtgcccagtgatggcatt

SEQ ID NO: 2188268 - DNA, 23 bp, Homo sapiens
gcagtgcccctagcttagagcct

SEQ ID NO: 2188269 - DNA, 14 bp, Homo sapiens
gcagtggcagcaac

SEQ ID NO: 2188270 - DNA, 18 bp, Homo sapiens
gcagtggcaggggagcag

SEQ ID NO: 2188271 - DNA, 11 bp, Homo sapiens
ggagcaaagca

SEQ ID NO: 2188272 - DNA, 14 bp, Homo sapiens
ggagcagagaaggc

SEQ ID NO: 2188273 - DNA, 18 bp, Homo sapiens
ggagcaggttccccaagg

SEQ ID NO: 2188274 - DNA, 18 bp, Homo sapiens
ggagcatccacctccttc

SEQ ID NO: 2188275 - DNA, 16 bp, Homo sapiens
ggagcattttgtgtct

SEQ ID NO: 2188276 - DNA, 14 bp, Homo sapiens
ggagccagccaccc

SEQ ID NO: 2188277 - DNA, 15 bp, Homo sapiens
ggagcctgcggctgc

SEQ ID NO: 2188278 - DNA, 22 bp, Homo sapiens
ggagcgagcatgtcgtggacac

SEQ ID NO: 2188279 - DNA, 18 bp, Homo sapiens
ggagcgggcccgccaccc

SEQ ID NO: 2188280 - DNA, 14 bp, Homo sapiens
ggagctcctgggaa

SEQ ID NO: 2188281 - DNA, 13 bp, Homo sapiens
ggaggaattttct

SEQ ID NO: 2188282 - DNA, 12 bp, Homo sapiens
ggaggagagaga

SEQ ID NO: 2188283 - DNA, 13 bp, Homo sapiens
ggaggagagagac

SEQ ID NO: 2188284 - DNA, 10 bp, Homo sapiens
ggaggcaggt

SEQ ID NO: 2188285 - DNA, 16 bp, Homo sapiens
ggaggccacgggggag

SEQ ID NO: 2188286 - DNA, 17 bp, Homo sapiens
ggaggccacgggggagg

SEQ ID NO: 2188287 - DNA, 18 bp, Homo sapiens
ggaggccacgggggaggc

SEQ ID NO: 2188288 - DNA, 18 bp, Homo sapiens
ggaggcccttttctggct

SEQ ID NO: 2188289 - DNA, 14 bp, Homo sapiens
ggaggccgaggcag

SEQ ID NO: 2188290 - DNA, 20 bp, Homo sapiens
ggagggcgcatgtgtgtatc

SEQ ID NO: 2188291 - DNA, 13 bp, Homo sapiens
ggaggtctccagg

SEQ ID NO: 2188292 - DNA, 12 bp, Homo sapiens
ggagtggaggca

SEQ ID NO: 2188293 - DNA, 24 bp, Homo sapiens
ggagtgggagaggaagccacgtgc

SEQ ID NO: 2188294 - DNA, 13 bp, Homo sapiens
ggagtgtgtgggg

SEQ ID NO: 2188295 - DNA, 19 bp, Homo sapiens
ggagtgtgtgggggtctgg

SEQ ID NO: 2188296 - DNA, 21 bp, Homo sapiens
ggagtgtgtgggggtctggga

SEQ ID NO: 2188297 - DNA, 14 bp, Homo sapiens
ggataatgtcatta

SEQ ID NO: 2188298 - DNA, 20 bp, Homo sapiens
ggataatgtcattaatatat

SEQ ID NO: 2188299 - DNA, 14 bp, Homo sapiens
ggatagtagatctg

SEQ ID NO: 2188300 - DNA, 14 bp, Homo sapiens
ggatatactgcagc

SEQ ID NO: 2188301 - DNA, 12 bp, Homo sapiens
ggatccagccac

SEQ ID NO: 2188302 - DNA, 14 bp, Homo sapiens
ggatctgcccctcc

SEQ ID NO: 2188303 - DNA, 20 bp, Homo sapiens
ggatctgcccctccctgctt

SEQ ID NO: 2188304 - DNA, 13 bp, Homo sapiens
ggatgtttcttct

SEQ ID NO: 2188305 - DNA, 18 bp, Homo sapiens
ggatgtttcttctttgac

SEQ ID NO: 2188306 - DNA, 16 bp, Homo sapiens
ggattcccctggacat

SEQ ID NO: 2188307 - DNA, 19 bp, Homo sapiens
ggattccggccctggctgg

SEQ ID NO: 2188308 - DNA, 17 bp, Homo sapiens
ggattctgtcttccagg

SEQ ID NO: 2188309 - DNA, 13 bp, Homo sapiens
ggatttaatttgt

SEQ ID NO: 2188310 - DNA, 16 bp, Homo sapiens
ggatttcaagggactg

SEQ ID NO: 2188311 - DNA, 17 bp, Homo sapiens
ggatttcaagggactgg

SEQ ID NO: 2188312 - DNA, 23 bp, Homo sapiens
ggatttggactcgaaattagaag

SEQ ID NO: 2188313 - DNA, 13 bp, Homo sapiens
ggattttgtggct

SEQ ID NO: 2188314 - DNA, 16 bp, Homo sapiens
ggcaaacccttctctt

SEQ ID NO: 2188315 - DNA, 11 bp, Homo sapiens
ggcaaagctga

SEQ ID NO: 2188316 - DNA, 17 bp, Homo sapiens
ggcaaagctgatttttt

SEQ ID NO: 2188317 - DNA, 19 bp, Homo sapiens
ggcaagctaggccccagag

SEQ ID NO: 2188318 - DNA, 21 bp, Homo sapiens
ggcaagctaggccccagaggc

SEQ ID NO: 2188319 - DNA, 18 bp, Homo sapiens
ggcaaggactttgtacat

SEQ ID NO: 2188320 - DNA, 11 bp, Homo sapiens
ggcaataaatg

SEQ ID NO: 2188321 - DNA, 23 bp, Homo sapiens
ggcaataaatggctcgtgggctc

SEQ ID NO: 2188322 - DNA, 20 bp, Homo sapiens
ggcacagccggggcctgcct

SEQ ID NO: 2188323 - DNA, 12 bp, Homo sapiens
ggcacagctgtg

SEQ ID NO: 2188324 - DNA, 20 bp, Homo sapiens
ggcacccccacaagctgtcc

SEQ ID NO: 2188325 - DNA, 24 bp, Homo sapiens
ggcacccccacaagctgtccctgc

SEQ ID NO: 2188326 - DNA, 16 bp, Homo sapiens
ggcaccgttatccctg

SEQ ID NO: 2188327 - DNA, 20 bp, Homo sapiens
ggcaccgttatccctgcaca

SEQ ID NO: 2188328 - DNA, 17 bp, Homo sapiens
ggcagaaagcagaggct

SEQ ID NO: 2188329 - DNA, 19 bp, Homo sapiens
ggcagaaatcccagttcat

SEQ ID NO: 2188330 - DNA, 16 bp, Homo sapiens
ggcagaacctggtggc

SEQ ID NO: 2188331 - DNA, 17 bp, Homo sapiens
ggcagaggggagaggaa

SEQ ID NO: 2188332 - DNA, 22 bp, Homo sapiens
ggcagagtgccccacctgccac

SEQ ID NO: 2188333 - DNA, 21 bp, Homo sapiens
ggcagcaacaaaggatttgaa

SEQ ID NO: 2188334 - DNA, 13 bp, Homo sapiens
ggcagcgggcgga

SEQ ID NO: 2188335 - DNA, 23 bp, Homo sapiens
ggcagcgggcggaggggatccag

SEQ ID NO: 2188336 - DNA, 13 bp, Homo sapiens
ggcaggcctttcc

SEQ ID NO: 2188337 - DNA, 15 bp, Homo sapiens
ggcaggcctttccta

SEQ ID NO: 2188338 - DNA, 13 bp, Homo sapiens
ggcaggggagcag

SEQ ID NO: 2188339 - DNA, 17 bp, Homo sapiens
ggcaggggctgggcaga

SEQ ID NO: 2188340 - DNA, 19 bp, Homo sapiens
ggcaggggctgggcagagg

SEQ ID NO: 2188341 - DNA, 20 bp, Homo sapiens
ggcagggttttatctctgtc

SEQ ID NO: 2188342 - DNA, 18 bp, Homo sapiens
ggcaggtcccgagccccc

SEQ ID NO: 2188343 - DNA, 19 bp, Homo sapiens
ggcaggttgatcagtgagc

SEQ ID NO: 2188344 - DNA, 16 bp, Homo sapiens
ggcagtccgtgggacg

SEQ ID NO: 2188345 - DNA, 13 bp, Homo sapiens
ggcagtggcagca

SEQ ID NO: 2188346 - DNA, 15 bp, Homo sapiens
ggcagtggggctggg

SEQ ID NO: 2188347 - DNA, 18 bp, Homo sapiens
ggcagtggggctgggggt

SEQ ID NO: 2188348 - DNA, 17 bp, Homo sapiens
ggcagttagagatgcct

SEQ ID NO: 2188349 - DNA, 20 bp, Homo sapiens
ggcagttagagatgcctccc

SEQ ID NO: 2188350 - DNA, 16 bp, Homo sapiens
ggcatctctggagtgt

SEQ ID NO: 2188351 - DNA, 16 bp, Homo sapiens
ggcatctgaaaacaat

SEQ ID NO: 2188352 - DNA, 15 bp, Homo sapiens
ggccaagaagcagtg

SEQ ID NO: 2188353 - DNA, 14 bp, Homo sapiens
ggccaagtcccacc

SEQ ID NO: 2188354 - DNA, 11 bp, Homo sapiens
ggccacctgca

SEQ ID NO: 2188355 - DNA, 23 bp, Homo sapiens
ggccacgggggaggccgaggcag

SEQ ID NO: 2188356 - DNA, 17 bp, Homo sapiens
ggccactgcagtcaccc

SEQ ID NO: 2188357 - DNA, 21 bp, Homo sapiens
ggccactgcagtcacccctgt

SEQ ID NO: 2188358 - DNA, 22 bp, Homo sapiens
ggccactggcatctctggagtg

SEQ ID NO: 2188359 - DNA, 20 bp, Homo sapiens
ggccacttagtcgtcttttt

SEQ ID NO: 2188360 - DNA, 14 bp, Homo sapiens
ggccagaccagagc

SEQ ID NO: 2188361 - DNA, 16 bp, Homo sapiens
ggcccagaggcacagc

SEQ ID NO: 2188362 - DNA, 17 bp, Homo sapiens
ggcccagaggcacagcc

SEQ ID NO: 2188363 - DNA, 13 bp, Homo sapiens
ggcccagcagagc

SEQ ID NO: 2188364 - DNA, 15 bp, Homo sapiens
ggcccagcagagccg

SEQ ID NO: 2188365 - DNA, 19 bp, Homo sapiens
ggcccatcactcggctgtg

SEQ ID NO: 2188366 - DNA, 20 bp, Homo sapiens
ggcccatcactcggctgtgg

SEQ ID NO: 2188367 - DNA, 23 bp, Homo sapiens
ggcccatcactcggctgtggaga

SEQ ID NO: 2188368 - DNA, 12 bp, Homo sapiens
ggccccagaggc

SEQ ID NO: 2188369 - DNA, 15 bp, Homo sapiens
ggccccagaggccct

SEQ ID NO: 2188370 - DNA, 16 bp, Homo sapiens
ggccccagaggccctg

SEQ ID NO: 2188371 - DNA, 17 bp, Homo sapiens
ggccccagaggccctgg

SEQ ID NO: 2188372 - DNA, 19 bp, Homo sapiens
ggccccagaggccctggag

SEQ ID NO: 2188373 - DNA, 15 bp, Homo sapiens
ggcccccgccctctg

SEQ ID NO: 2188374 - DNA, 17 bp, Homo sapiens
ggcccccgccctctgcc

SEQ ID NO: 2188375 - DNA, 19 bp, Homo sapiens
ggccccctttctatgttca

SEQ ID NO: 2188376 - DNA, 17 bp, Homo sapiens
ggccccgggctggagaa

SEQ ID NO: 2188377 - DNA, 17 bp, Homo sapiens
ggccccgtctcctgagg

SEQ ID NO: 2188378 - DNA, 23 bp, Homo sapiens
ggccccgtctcctgagggtcctg

SEQ ID NO: 2188379 - DNA, 13 bp, Homo sapiens
ggcccctggtggc

SEQ ID NO: 2188380 - DNA, 16 bp, Homo sapiens
ggcccgccgtgcctgc

SEQ ID NO: 2188381 - DNA, 19 bp, Homo sapiens
ggcccgccgtgcctgcatt

SEQ ID NO: 2188382 - DNA, 18 bp, Homo sapiens
ggcccggaagttgctgtg

SEQ ID NO: 2188383 - DNA, 23 bp, Homo sapiens
ggccctctggggctcagccctga

SEQ ID NO: 2188384 - DNA, 9 bp, Homo sapiens
ggccctgct

SEQ ID NO: 2188385 - DNA, 10 bp, Homo sapiens
ggccctgcta

SEQ ID NO: 2188386 - DNA, 14 bp, Homo sapiens
ggccctgctacctg

SEQ ID NO: 2188387 - DNA, 12 bp, Homo sapiens
ggccctggaggt

SEQ ID NO: 2188388 - DNA, 16 bp, Homo sapiens
ggccctggcaccccca

SEQ ID NO: 2188389 - DNA, 22 bp, Homo sapiens
ggccctggcacccccacaagct

SEQ ID NO: 2188390 - DNA, 11 bp, Homo sapiens
ggccctggctg

SEQ ID NO: 2188391 - DNA, 21 bp, Homo sapiens
ggccctggctggggacttggc

SEQ ID NO: 2188392 - DNA, 15 bp, Homo sapiens
ggccctgttgtgggg

SEQ ID NO: 2188393 - DNA, 17 bp, Homo sapiens
ggccctgttgtgggggt

SEQ ID NO: 2188394 - DNA, 16 bp, Homo sapiens
gtgactcctgctggta

SEQ ID NO: 2188395 - DNA, 22 bp, Homo sapiens
gtgactcctgctggtacctgcc

SEQ ID NO: 2188396 - DNA, 18 bp, Homo sapiens
gtgactgcttttttgcct

SEQ ID NO: 2188397 - DNA, 21 bp, Homo sapiens
gtgagacacagagtggagccc

SEQ ID NO: 2188398 - DNA, 14 bp, Homo sapiens
gtgagagaaagaga

SEQ ID NO: 2188399 - DNA, 18 bp, Homo sapiens
gtgagcaaacctgcccca

SEQ ID NO: 2188400 - DNA, 12 bp, Homo sapiens
gtgagcagtgtg

SEQ ID NO: 2188401 - DNA, 14 bp, Homo sapiens
gtgagccactgtgc

SEQ ID NO: 2188402 - DNA, 17 bp, Homo sapiens
gtgaggggcaagctagg

SEQ ID NO: 2188403 - DNA, 16 bp, Homo sapiens
gtgaggttgggcagct

SEQ ID NO: 2188404 - DNA, 12 bp, Homo sapiens
gtgagtatgtgt

SEQ ID NO: 2188405 - DNA, 16 bp, Homo sapiens
gtgatctcccctcaca

SEQ ID NO: 2188406 - DNA, 15 bp, Homo sapiens
gtgattatcatttat

SEQ ID NO: 2188407 - DNA, 14 bp, Homo sapiens
gtgatttatttgga

SEQ ID NO: 2188408 - DNA, 16 bp, Homo sapiens
gtgatttatttggagt

SEQ ID NO: 2188409 - DNA, 21 bp, Homo sapiens
gtgatttatttggagtggagg

SEQ ID NO: 2188410 - DNA, 15 bp, Homo sapiens
gtgcaagcaaagaac

SEQ ID NO: 2188411 - DNA, 15 bp, Homo sapiens
gtgcaatttcttctg

SEQ ID NO: 2188412 - DNA, 19 bp, Homo sapiens
gtgcagagaggttgtgaaa

SEQ ID NO: 2188413 - DNA, 18 bp, Homo sapiens
gtgcattgtaaacataaa

SEQ ID NO: 2188414 - DNA, 11 bp, Homo sapiens
gtgcattgtgt

SEQ ID NO: 2188415 - DNA, 16 bp, Homo sapiens
gtgccaaccacctctg

SEQ ID NO: 2188416 - DNA, 18 bp, Homo sapiens
gtgccaaccacctctggc

SEQ ID NO: 2188417 - DNA, 18 bp, Homo sapiens
gtgccaccctctgcaggg

SEQ ID NO: 2188418 - DNA, 22 bp, Homo sapiens
gtgccaccctctgcagggcagc

SEQ ID NO: 2188419 - DNA, 14 bp, Homo sapiens
gtgccctccactgc

SEQ ID NO: 2188420 - DNA, 20 bp, Homo sapiens
gtgcctatttattcattcag

SEQ ID NO: 2188421 - DNA, 22 bp, Homo sapiens
gtgcctctggaggcctctgggc

SEQ ID NO: 2188422 - DNA, 19 bp, Homo sapiens
gtgcctggagctcctggga

SEQ ID NO: 2188423 - DNA, 15 bp, Homo sapiens
gtgccttaaaaataa

SEQ ID NO: 2188424 - DNA, 23 bp, Homo sapiens
gtgcctttccccattcattcctg

SEQ ID NO: 2188425 - DNA, 13 bp, Homo sapiens
gtgcgtcccagct

SEQ ID NO: 2188426 - DNA, 21 bp, Homo sapiens
gtgctctgaatgggagccaga

SEQ ID NO: 2188427 - DNA, 17 bp, Homo sapiens
gtgctcttcttctttct

SEQ ID NO: 2188428 - DNA, 15 bp, Homo sapiens
gtgctgagcacacaa

SEQ ID NO: 2188429 - DNA, 20 bp, Homo sapiens
gtgctgagcacacaacaggc

SEQ ID NO: 2188430 - DNA, 21 bp, Homo sapiens
gtgctgagcacacaacaggct

SEQ ID NO: 2188431 - DNA, 19 bp, Homo sapiens
gtgctggaatggggacctg

SEQ ID NO: 2188432 - DNA, 20 bp, Homo sapiens
gtgctttctatctaattttt

SEQ ID NO: 2188433 - DNA, 15 bp, Homo sapiens
gtgcttttaaactgg

SEQ ID NO: 2188434 - DNA, 16 bp, Homo sapiens
gtggaaagattgtgtc

SEQ ID NO: 2188435 - DNA, 15 bp, Homo sapiens
gtggaaggagcctgc

SEQ ID NO: 2188436 - DNA, 17 bp, Homo sapiens
gtggactgagtgggaag

SEQ ID NO: 2188437 - DNA, 20 bp, Homo sapiens
gtggactgagtgggaagccc

SEQ ID NO: 2188438 - DNA, 13 bp, Homo sapiens
gtggactgtgtcc

SEQ ID NO: 2188439 - DNA, 11 bp, Homo sapiens
gtggagaaatg

SEQ ID NO: 2188440 - DNA, 13 bp, Homo sapiens
gtggagaaatgga

SEQ ID NO: 2188441 - DNA, 12 bp, Homo sapiens
gtggagagacca

SEQ ID NO: 2188442 - DNA, 20 bp, Homo sapiens
gtggagagaccagcctttct

SEQ ID NO: 2188443 - DNA, 11 bp, Homo sapiens
gtggagaggag

SEQ ID NO: 2188444 - DNA, 21 bp, Homo sapiens
gtggagcacaaaagcctctca

SEQ ID NO: 2188445 - DNA, 13 bp, Homo sapiens
gtggagccacagg

SEQ ID NO: 2188446 - DNA, 16 bp, Homo sapiens
gtggagccacaggcag

SEQ ID NO: 2188447 - DNA, 20 bp, Homo sapiens
gtggagccacaggcagacga

SEQ ID NO: 2188448 - DNA, 15 bp, Homo sapiens
gtggaggcattgttt

SEQ ID NO: 2188449 - DNA, 12 bp, Homo sapiens
gtggaggtggct

SEQ ID NO: 2188450 - DNA, 16 bp, Homo sapiens
gtggaggttgcagtga

SEQ ID NO: 2188451 - DNA, 20 bp, Homo sapiens
gtggatagatgccctgctag

SEQ ID NO: 2188452 - DNA, 18 bp, Homo sapiens
gtggcagaaatcccagtt

SEQ ID NO: 2188453 - DNA, 14 bp, Homo sapiens
gtggcatggaagag

SEQ ID NO: 2188454 - DNA, 23 bp, Homo sapiens
gtggccaagaagcagtggcctta

SEQ ID NO: 2188455 - DNA, 17 bp, Homo sapiens
gtggccagaccagagct

SEQ ID NO: 2188456 - DNA, 15 bp, Homo sapiens
gtggccagttgacat

SEQ ID NO: 2188457 - DNA, 13 bp, Homo sapiens
gtggcctggctcc

SEQ ID NO: 2188458 - DNA, 21 bp, Homo sapiens
gtggcgctttctcctgtgccc

SEQ ID NO: 2188459 - DNA, 13 bp, Homo sapiens
gtggctggaggca

SEQ ID NO: 2188460 - DNA, 13 bp, Homo sapiens
gtggctgtgatta

SEQ ID NO: 2188461 - DNA, 17 bp, Homo sapiens
gtgggagaagggacagc

SEQ ID NO: 2188462 - DNA, 10 bp, Homo sapiens
gtgggagagg

SEQ ID NO: 2188463 - DNA, 14 bp, Homo sapiens
gtgggaggcccctg

SEQ ID NO: 2188464 - DNA, 17 bp, Homo sapiens
gtgggaggcccctggtg

SEQ ID NO: 2188465 - DNA, 18 bp, Homo sapiens
gtgggagtgggagaggaa

SEQ ID NO: 2188466 - DNA, 18 bp, Homo sapiens
gtgggatctgcccctccc

SEQ ID NO: 2188467 - DNA, 21 bp, Homo sapiens
gtgggcaggggttccagcttc

SEQ ID NO: 2188468 - DNA, 15 bp, Homo sapiens
gtggggaagagagcc

SEQ ID NO: 2188469 - DNA, 19 bp, Homo sapiens
gtggggagacacctcagag

SEQ ID NO: 2188470 - DNA, 13 bp, Homo sapiens
gtgggggcctgct

SEQ ID NO: 2188471 - DNA, 15 bp, Homo sapiens
gtgggggtctgggag

SEQ ID NO: 2188472 - DNA, 21 bp, Homo sapiens
gtgggggtctgggaggcaggt

SEQ ID NO: 2188473 - DNA, 17 bp, Homo sapiens
gtggggtgaagctgggg

SEQ ID NO: 2188474 - DNA, 17 bp, Homo sapiens
gtggtgtccttctcctc

SEQ ID NO: 2188475 - DNA, 19 bp, Homo sapiens
gtgtaaaaaacaaacattt

SEQ ID NO: 2188476 - DNA, 15 bp, Homo sapiens
gtgtagccccaagaa

SEQ ID NO: 2188477 - DNA, 22 bp, Homo sapiens
gtgtatgtgtttataattgtta

SEQ ID NO: 2188478 - DNA, 14 bp, Homo sapiens
gtgtattaaacctt

SEQ ID NO: 2188479 - DNA, 12 bp, Homo sapiens
gtgtcacaaagc

SEQ ID NO: 2188480 - DNA, 18 bp, Homo sapiens
gtgtcacaaagctaaata

SEQ ID NO: 2188481 - DNA, 15 bp, Homo sapiens
gtgtcacagaggcag

SEQ ID NO: 2188482 - DNA, 15 bp, Homo sapiens
gtgtccccagcccac

SEQ ID NO: 2188483 - DNA, 22 bp, Homo sapiens
gtgtccccagcccactggatca

SEQ ID NO: 2188484 - DNA, 14 bp, Homo sapiens
gtgtccttctcctc

SEQ ID NO: 2188485 - DNA, 23 bp, Homo sapiens
gtgtccttctcctcttgtagcca

SEQ ID NO: 2188486 - DNA, 15 bp, Homo sapiens
gtgtctagcaaagcc

SEQ ID NO: 2188487 - DNA, 19 bp, Homo sapiens
gtgtctagcaaagccacca

SEQ ID NO: 2188488 - DNA, 16 bp, Homo sapiens
gtgtctcctgcatgca

SEQ ID NO: 2188489 - DNA, 21 bp, Homo sapiens
gtgtcttaagaaaaataatct

SEQ ID NO: 2188490 - DNA, 15 bp, Homo sapiens
gtgtcttttaatgat

SEQ ID NO: 2188491 - DNA, 14 bp, Homo sapiens
gtgtgaatgctgta

SEQ ID NO: 2188492 - DNA, 16 bp, Homo sapiens
gtgtgcattgctgtga

SEQ ID NO: 2188493 - DNA, 17 bp, Homo sapiens
gtgtgccaccctctgca

SEQ ID NO: 2188494 - DNA, 20 bp, Homo sapiens
gtgtgccaccctctgcaggg

SEQ ID NO: 2188495 - DNA, 23 bp, Homo sapiens
gtgtgggggtctgggaggcaggt

SEQ ID NO: 2188496 - DNA, 19 bp, Homo sapiens
gtgtgtctcctgcatgcag

SEQ ID NO: 2188497 - DNA, 12 bp, Homo sapiens
gtgttaacgtgc

SEQ ID NO: 2188498 - DNA, 15 bp, Homo sapiens
gtgttcagattgtaa

SEQ ID NO: 2188499 - DNA, 21 bp, Homo sapiens
gtgttcgtggagccacaggca

SEQ ID NO: 2188500 - DNA, 22 bp, Homo sapiens
gtgtttttacaaaatacaaaaa

SEQ ID NO: 2188501 - DNA, 20 bp, Homo sapiens
gttaaattgcacgtgcaata

SEQ ID NO: 2188502 - DNA, 19 bp, Homo sapiens
gttaacacatggcttccta

SEQ ID NO: 2188503 - DNA, 19 bp, Homo sapiens
gttaagcagccgccacatc

SEQ ID NO: 2188504 - DNA, 18 bp, Homo sapiens
gttaagtcaattctgtta

SEQ ID NO: 2188505 - DNA, 15 bp, Homo sapiens
gttaatattaattta

SEQ ID NO: 2188506 - DNA, 19 bp, Homo sapiens
gttaatcacttaacctgct

SEQ ID NO: 2188507 - DNA, 18 bp, Homo sapiens
gttaattaaatatttctt

SEQ ID NO: 2188508 - DNA, 19 bp, Homo sapiens
gttaattggttaatcactt

SEQ ID NO: 2188509 - DNA, 19 bp, Homo sapiens
gttacagggcccaggtgag

SEQ ID NO: 2188510 - DNA, 16 bp, Homo sapiens
gttacgtgtgcaacag

SEQ ID NO: 2188511 - DNA, 15 bp, Homo sapiens
gttactatcctggct

SEQ ID NO: 2188512 - DNA, 16 bp, Homo sapiens
gttactcattttatca

SEQ ID NO: 2188513 - DNA, 17 bp, Homo sapiens
gttactgggtaggttct

SEQ ID NO: 2188514 - DNA, 18 bp, Homo sapiens
gttagagatgcctccctg

SEQ ID NO: 2188515 - DNA, 22 bp, Homo sapiens
gttaggattaggtttagaatca

SEQ ID NO: 2188516 - DNA, 13 bp, Homo sapiens
gttaggctgggcc

SEQ ID NO: 2188517 - DNA, 15 bp, Homo sapiens
tggccgggggtgggg

SEQ ID NO: 2188518 - DNA, 20 bp, Homo sapiens
tggccgggggtgggggcctg

SEQ ID NO: 2188519 - DNA, 22 bp, Homo sapiens
tggccgggttggaggcctcacc

SEQ ID NO: 2188520 - DNA, 23 bp, Homo sapiens
tggccgggttggaggcctcaccc

SEQ ID NO: 2188521 - DNA, 22 bp, Homo sapiens
tggcctcacctgggttccccac

SEQ ID NO: 2188522 - DNA, 21 bp, Homo sapiens
tggcctcgtgaggggcaagct

SEQ ID NO: 2188523 - DNA, 12 bp, Homo sapiens
tggcctctgctt

SEQ ID NO: 2188524 - DNA, 14 bp, Homo sapiens
tggcctggctccgc

SEQ ID NO: 2188525 - DNA, 17 bp, Homo sapiens
tggcgctttctcctgtg

SEQ ID NO: 2188526 - DNA, 16 bp, Homo sapiens
tggcggaacctggctg

SEQ ID NO: 2188527 - DNA, 17 bp, Homo sapiens
tggcggaacctggctgc

SEQ ID NO: 2188528 - DNA, 14 bp, Homo sapiens
tggctaaaggtccc

SEQ ID NO: 2188529 - DNA, 14 bp, Homo sapiens
tggctaaggcacca

SEQ ID NO: 2188530 - DNA, 16 bp, Homo sapiens
tggctaccgatttcag

SEQ ID NO: 2188531 - DNA, 20 bp, Homo sapiens
tggctagaatatcctacttc

SEQ ID NO: 2188532 - DNA, 15 bp, Homo sapiens
tggctcaaggattca

SEQ ID NO: 2188533 - DNA, 18 bp, Homo sapiens
tggctcacagactggaga

SEQ ID NO: 2188534 - DNA, 18 bp, Homo sapiens
tggctcactatggtgcca

SEQ ID NO: 2188535 - DNA, 13 bp, Homo sapiens
tggctcactgcag

SEQ ID NO: 2188536 - DNA, 16 bp, Homo sapiens
tggctcactgcagcct

SEQ ID NO: 2188537 - DNA, 18 bp, Homo sapiens
tggctcactgcagcctcg

SEQ ID NO: 2188538 - DNA, 12 bp, Homo sapiens
tggctcgtgggc

SEQ ID NO: 2188539 - DNA, 13 bp, Homo sapiens
tggctcgtgggct

SEQ ID NO: 2188540 - DNA, 17 bp, Homo sapiens
tggctcgtgggctctgg

SEQ ID NO: 2188541 - DNA, 21 bp, Homo sapiens
tggctcgtgggctctggctcc

SEQ ID NO: 2188542 - DNA, 13 bp, Homo sapiens
tggctctgagaag

SEQ ID NO: 2188543 - DNA, 23 bp, Homo sapiens
tggctcttgccttatctgttcct

SEQ ID NO: 2188544 - DNA, 17 bp, Homo sapiens
tggctgcgaactgtgca

SEQ ID NO: 2188545 - DNA, 20 bp, Homo sapiens
tggctgcgaactgtgcagtt

SEQ ID NO: 2188546 - DNA, 23 bp, Homo sapiens
tggctggtcacgacttcttcgga

SEQ ID NO: 2188547 - DNA, 16 bp, Homo sapiens
tggctggtgggaaggc

SEQ ID NO: 2188548 - DNA, 17 bp, Homo sapiens
tggctggtgggaaggcc

SEQ ID NO: 2188549 - DNA, 22 bp, Homo sapiens
tggcttaaaaatacttaataaa

SEQ ID NO: 2188550 - DNA, 16 bp, Homo sapiens
tggcttcctaaatggc

SEQ ID NO: 2188551 - DNA, 17 bp, Homo sapiens
tggcttctgcttgtcat

SEQ ID NO: 2188552 - DNA, 18 bp, Homo sapiens
tggcttgtgatctgggaa

SEQ ID NO: 2188553 - DNA, 22 bp, Homo sapiens
tggctttgcccaacctcagcaa

SEQ ID NO: 2188554 - DNA, 13 bp, Homo sapiens
tgggaaaatgtcc

SEQ ID NO: 2188555 - DNA, 21 bp, Homo sapiens
tgggaacaatatcaatatggt

SEQ ID NO: 2188556 - DNA, 17 bp, Homo sapiens
tgggaccaaacctagcc

SEQ ID NO: 2188557 - DNA, 15 bp, Homo sapiens
tgggactgatgtcat

SEQ ID NO: 2188558 - DNA, 14 bp, Homo sapiens
tgggagaagggaca

SEQ ID NO: 2188559 - DNA, 18 bp, Homo sapiens
tgggagagaccattgcat

SEQ ID NO: 2188560 - DNA, 12 bp, Homo sapiens
tgggagccagaa

SEQ ID NO: 2188561 - DNA, 11 bp, Homo sapiens
tgggaggcagg

SEQ ID NO: 2188562 - DNA, 19 bp, Homo sapiens
tgggaggcccctggtggca

SEQ ID NO: 2188563 - DNA, 13 bp, Homo sapiens
tgggatatgacaa

SEQ ID NO: 2188564 - DNA, 21 bp, Homo sapiens
tgggatccgcatccagccgtg

SEQ ID NO: 2188565 - DNA, 13 bp, Homo sapiens
tgggatctgcccc

SEQ ID NO: 2188566 - DNA, 18 bp, Homo sapiens
tgggcaaacccttctctt

SEQ ID NO: 2188567 - DNA, 21 bp, Homo sapiens
tgggcaaacccttctcttctc

SEQ ID NO: 2188568 - DNA, 22 bp, Homo sapiens
tgggcaaggtgagggatgccat

SEQ ID NO: 2188569 - DNA, 15 bp, Homo sapiens
tgggcagatctaccc

SEQ ID NO: 2188570 - DNA, 17 bp, Homo sapiens
tgggcccagaggcacag

SEQ ID NO: 2188571 - DNA, 18 bp, Homo sapiens
tgggccctgcctctgttt

SEQ ID NO: 2188572 - DNA, 13 bp, Homo sapiens
tgggctctggctc

SEQ ID NO: 2188573 - DNA, 13 bp, Homo sapiens
tgggcttatatct

SEQ ID NO: 2188574 - DNA, 21 bp, Homo sapiens
tgggcttatatctggcctctg

SEQ ID NO: 2188575 - DNA, 14 bp, Homo sapiens
tggggaagagagcc

SEQ ID NO: 2188576 - DNA, 15 bp, Homo sapiens
tggggaagagagcct

SEQ ID NO: 2188577 - DNA, 14 bp, Homo sapiens
tggggacctggggt

SEQ ID NO: 2188578 - DNA, 17 bp, Homo sapiens
tggggagacacctcaga

SEQ ID NO: 2188579 - DNA, 15 bp, Homo sapiens
tggggaggcagaggg

SEQ ID NO: 2188580 - DNA, 17 bp, Homo sapiens
tggggcccaggggcttt

SEQ ID NO: 2188581 - DNA, 19 bp, Homo sapiens
tggggccgccacggcctgg

SEQ ID NO: 2188582 - DNA, 21 bp, Homo sapiens
tgggggcctcactccaggaag

SEQ ID NO: 2188583 - DNA, 15 bp, Homo sapiens
tgggggtctgggagg

SEQ ID NO: 2188584 - DNA, 16 bp, Homo sapiens
tgggggtctgggaggc

SEQ ID NO: 2188585 - DNA, 16 bp, Homo sapiens
tgggggtgcaggcagc

SEQ ID NO: 2188586 - DNA, 13 bp, Homo sapiens
tggggtgaagctg

SEQ ID NO: 2188587 - DNA, 15 bp, Homo sapiens
tggggtggggcggga

SEQ ID NO: 2188588 - DNA, 21 bp, Homo sapiens
tgggtagcttctgacctcagc

SEQ ID NO: 2188589 - DNA, 23 bp, Homo sapiens
tgggtcaaagtggtacaggaagg

SEQ ID NO: 2188590 - DNA, 16 bp, Homo sapiens
tgggtcagtgtgccac

SEQ ID NO: 2188591 - DNA, 12 bp, Homo sapiens
tgggtcccagct

SEQ ID NO: 2188592 - DNA, 15 bp, Homo sapiens
tgggtgcccacagcc

SEQ ID NO: 2188593 - DNA, 21 bp, Homo sapiens
tgggtttctctgtgctctgaa

SEQ ID NO: 2188594 - DNA, 18 bp, Homo sapiens
tggtaaatatagaaccat

SEQ ID NO: 2188595 - DNA, 13 bp, Homo sapiens
tggtacctgccct

SEQ ID NO: 2188596 - DNA, 18 bp, Homo sapiens
tggtagcagggtctttgt

SEQ ID NO: 2188597 - DNA, 14 bp, Homo sapiens
tggtaggttctgtc

SEQ ID NO: 2188598 - DNA, 14 bp, Homo sapiens
tggtcacattccat

SEQ ID NO: 2188599 - DNA, 19 bp, Homo sapiens
tggtcaccttcctctgcct

SEQ ID NO: 2188600 - DNA, 21 bp, Homo sapiens
tggtcatttgccaactaattt

SEQ ID NO: 2188601 - DNA, 20 bp, Homo sapiens
tggtccccaaaacactgtct

SEQ ID NO: 2188602 - DNA, 19 bp, Homo sapiens
tggtcctaagtccctgccc

SEQ ID NO: 2188603 - DNA, 18 bp, Homo sapiens
tggtcttggtcatttgcc

SEQ ID NO: 2188604 - DNA, 15 bp, Homo sapiens
tggtgaagtttgtca

SEQ ID NO: 2188605 - DNA, 22 bp, Homo sapiens
tggtgaccagtttcttaaactg

SEQ ID NO: 2188606 - DNA, 17 bp, Homo sapiens
tggtgagaattaaaata

SEQ ID NO: 2188607 - DNA, 20 bp, Homo sapiens
tggtgccaatggaacctcct

SEQ ID NO: 2188608 - DNA, 22 bp, Homo sapiens
tggtgccaatggaacctccttt

SEQ ID NO: 2188609 - DNA, 22 bp, Homo sapiens
tggtgcccagactcaaggcctc

SEQ ID NO: 2188610 - DNA, 22 bp, Homo sapiens
tggtggcgctttctcctgtgcc

SEQ ID NO: 2188611 - DNA, 13 bp, Homo sapiens
tggtggctggagg

SEQ ID NO: 2188612 - DNA, 15 bp, Homo sapiens
tggttagctcagccc

SEQ ID NO: 2188613 - DNA, 20 bp, Homo sapiens
tggttagctcagccccagcc

SEQ ID NO: 2188614 - DNA, 22 bp, Homo sapiens
tggttagctcagccccagccca

SEQ ID NO: 2188615 - DNA, 19 bp, Homo sapiens
tggttccagatacttcagc

SEQ ID NO: 2188616 - DNA, 21 bp, Homo sapiens
tggttccttaagtggctgtga

SEQ ID NO: 2188617 - DNA, 20 bp, Homo sapiens
tggttgaaggtcacagaagt

SEQ ID NO: 2188618 - DNA, 12 bp, Homo sapiens
tggttgcctggg

SEQ ID NO: 2188619 - DNA, 13 bp, Homo sapiens
tggttggaggccc

SEQ ID NO: 2188620 - DNA, 12 bp, Homo sapiens
tggtttataatc

SEQ ID NO: 2188621 - DNA, 16 bp, Homo sapiens
tggtttcttattcaaa

SEQ ID NO: 2188622 - DNA, 18 bp, Homo sapiens
tggtttcttattcaaaga

SEQ ID NO: 2188623 - DNA, 21 bp, Homo sapiens
tggtttgactcattaatttct

SEQ ID NO: 2188624 - DNA, 15 bp, Homo sapiens
tggttttggtttcca

SEQ ID NO: 2188625 - DNA, 16 bp, Homo sapiens
tgtaaaaaacaaacat

SEQ ID NO: 2188626 - DNA, 22 bp, Homo sapiens
tgtaaaaacacaaatgtgtact

SEQ ID NO: 2188627 - DNA, 15 bp, Homo sapiens
tgtaaacttgggttt

SEQ ID NO: 2188628 - DNA, 12 bp, Homo sapiens
tgtaaagtatgc

SEQ ID NO: 2188629 - DNA, 23 bp, Homo sapiens
tgtaactagaccatttttaaatg

SEQ ID NO: 2188630 - DNA, 13 bp, Homo sapiens
tgtaacttcctct

SEQ ID NO: 2188631 - DNA, 13 bp, Homo sapiens
tgtaacttgtgct

SEQ ID NO: 2188632 - DNA, 22 bp, Homo sapiens
tgtaagaagctaaaatgaaaaa

SEQ ID NO: 2188633 - DNA, 14 bp, Homo sapiens
tgtaaggaagaggg

SEQ ID NO: 2188634 - DNA, 17 bp, Homo sapiens
tgtacaagtgctcagtt

SEQ ID NO: 2188635 - DNA, 22 bp, Homo sapiens
tgtacaggctaggaagaacttg

SEQ ID NO: 2188636 - DNA, 13 bp, Homo sapiens
tgtacagtatgtg

SEQ ID NO: 2188637 - DNA, 15 bp, Homo sapiens
tgtacagtatgtgtc

SEQ ID NO: 2188638 - DNA, 16 bp, Homo sapiens
tgtacagtatgtgtct

SEQ ID NO: 2188639 - DNA, 13 bp, Homo sapiens
ttctgaacaaaag

SEQ ID NO: 2188640 - DNA, 19 bp, Homo sapiens
ttctgaagccatgtagcca

SEQ ID NO: 2188641 - DNA, 22 bp, Homo sapiens
ttctgaagccatgtagccaccc

SEQ ID NO: 2188642 - DNA, 18 bp, Homo sapiens
ttctgaaggttggaactg

SEQ ID NO: 2188643 - DNA, 21 bp, Homo sapiens
ttctgaagttttattttaaat

SEQ ID NO: 2188644 - DNA, 13 bp, Homo sapiens
ttctgaatggaaa

SEQ ID NO: 2188645 - DNA, 18 bp, Homo sapiens
ttctgacaataaataata

SEQ ID NO: 2188646 - DNA, 11 bp, Homo sapiens
ttctgccttcc

SEQ ID NO: 2188647 - DNA, 14 bp, Homo sapiens
ttctgcttttaagt

SEQ ID NO: 2188648 - DNA, 18 bp, Homo sapiens
ttctggctcctgtgtgga

SEQ ID NO: 2188649 - DNA, 15 bp, Homo sapiens
ttctggggccccacc

SEQ ID NO: 2188650 - DNA, 15 bp, Homo sapiens
ttctggtaggttctg

SEQ ID NO: 2188651 - DNA, 11 bp, Homo sapiens
ttctggtcaca

SEQ ID NO: 2188652 - DNA, 19 bp, Homo sapiens
ttctggtgcctatttattc

SEQ ID NO: 2188653 - DNA, 22 bp, Homo sapiens
ttctggttagctcagccccagc

SEQ ID NO: 2188654 - DNA, 22 bp, Homo sapiens
ttctgtcattcccctcttttgt

SEQ ID NO: 2188655 - DNA, 14 bp, Homo sapiens
ttctgtctctcttg

SEQ ID NO: 2188656 - DNA, 14 bp, Homo sapiens
ttctgtgcccagct

SEQ ID NO: 2188657 - DNA, 16 bp, Homo sapiens
ttcttcggaggtggca

SEQ ID NO: 2188658 - DNA, 22 bp, Homo sapiens
ttcttgaaaggtgtaggtttga

SEQ ID NO: 2188659 - DNA, 22 bp, Homo sapiens
ttcttgatgatcctcaaggaaa

SEQ ID NO: 2188660 - DNA, 11 bp, Homo sapiens
ttcttgtgtgt

SEQ ID NO: 2188661 - DNA, 12 bp, Homo sapiens
ttctttagaaaa

SEQ ID NO: 2188662 - DNA, 13 bp, Homo sapiens
ttctttagaaaac

SEQ ID NO: 2188663 - DNA, 15 bp, Homo sapiens
ttctttccatgcagt

SEQ ID NO: 2188664 - DNA, 18 bp, Homo sapiens
ttctttgaccaaactgtg

SEQ ID NO: 2188665 - DNA, 22 bp, Homo sapiens
ttcttttaccccacgaagacat

SEQ ID NO: 2188666 - DNA, 18 bp, Homo sapiens
ttcttttgaccccttcct

SEQ ID NO: 2188667 - DNA, 19 bp, Homo sapiens
ttgaaaagattgcaaaggg

SEQ ID NO: 2188668 - DNA, 15 bp, Homo sapiens
ttgaaagaagcaaga

SEQ ID NO: 2188669 - DNA, 16 bp, Homo sapiens
ttgaaataagaattca

SEQ ID NO: 2188670 - DNA, 17 bp, Homo sapiens
ttgaaatgggaacaata

SEQ ID NO: 2188671 - DNA, 19 bp, Homo sapiens
ttgaaatgtaatttcagtt

SEQ ID NO: 2188672 - DNA, 20 bp, Homo sapiens
ttgaaattaaaattgccaga

SEQ ID NO: 2188673 - DNA, 18 bp, Homo sapiens
ttgaactcacgagccttg

SEQ ID NO: 2188674 - DNA, 21 bp, Homo sapiens
ttgaagtgaacaaatttcaaa

SEQ ID NO: 2188675 - DNA, 14 bp, Homo sapiens
ttgaataatgtagt

SEQ ID NO: 2188676 - DNA, 12 bp, Homo sapiens
ttgaataatttg

SEQ ID NO: 2188677 - DNA, 13 bp, Homo sapiens
ttgaatactttga

SEQ ID NO: 2188678 - DNA, 19 bp, Homo sapiens
ttgaataggaaataaaatt

SEQ ID NO: 2188679 - DNA, 20 bp, Homo sapiens
ttgaataggaaataaaatta

SEQ ID NO: 2188680 - DNA, 20 bp, Homo sapiens
ttgaataggcattaaatgca

SEQ ID NO: 2188681 - DNA, 18 bp, Homo sapiens
ttgacaaggtagacatgg

SEQ ID NO: 2188682 - DNA, 14 bp, Homo sapiens
ttgaccaaactgtg

SEQ ID NO: 2188683 - DNA, 14 bp, Homo sapiens
ttgaccagtttctt

SEQ ID NO: 2188684 - DNA, 13 bp, Homo sapiens
ttgaccccttcct

SEQ ID NO: 2188685 - DNA, 12 bp, Homo sapiens
ttgactggcttt

SEQ ID NO: 2188686 - DNA, 14 bp, Homo sapiens
ttgactgtgattta

SEQ ID NO: 2188687 - DNA, 19 bp, Homo sapiens
ttgactgtggctcttgcct

SEQ ID NO: 2188688 - DNA, 15 bp, Homo sapiens
ttgagaaaaggtttg

SEQ ID NO: 2188689 - DNA, 14 bp, Homo sapiens
ttgaggccaggagt

SEQ ID NO: 2188690 - DNA, 21 bp, Homo sapiens
ttgagtgtgcaagcaaagaac

SEQ ID NO: 2188691 - DNA, 21 bp, Homo sapiens
ttgataacaccaagagtagca

SEQ ID NO: 2188692 - DNA, 20 bp, Homo sapiens
ttgatacacaggtgagaaag

SEQ ID NO: 2188693 - DNA, 19 bp, Homo sapiens
ttgatatgactaattcagg

SEQ ID NO: 2188694 - DNA, 17 bp, Homo sapiens
ttgatatttgtgtaaag

SEQ ID NO: 2188695 - DNA, 21 bp, Homo sapiens
ttgatgattgccaacagtggc

SEQ ID NO: 2188696 - DNA, 19 bp, Homo sapiens
ttgatggtcaggaagtttg

SEQ ID NO: 2188697 - DNA, 19 bp, Homo sapiens
ttgatgtgtatgtgtttat

SEQ ID NO: 2188698 - DNA, 20 bp, Homo sapiens
ttgattttcaagctttcaaa

SEQ ID NO: 2188699 - DNA, 13 bp, Homo sapiens
ttgcaaagggaca

SEQ ID NO: 2188700 - DNA, 19 bp, Homo sapiens
ttgcaaagtggaattaaag

SEQ ID NO: 2188701 - DNA, 23 bp, Homo sapiens
ttgcaaatgcccttacacttact

SEQ ID NO: 2188702 - DNA, 22 bp, Homo sapiens
ttgcaagtgaaataatattgat

SEQ ID NO: 2188703 - DNA, 21 bp, Homo sapiens
ttgcactggtcatcagtattg

SEQ ID NO: 2188704 - DNA, 23 bp, Homo sapiens
ttgcagacagtccttaatgctga

SEQ ID NO: 2188705 - DNA, 12 bp, Homo sapiens
ttgcagacctgg

SEQ ID NO: 2188706 - DNA, 17 bp, Homo sapiens
ttgcagacctgggactt

SEQ ID NO: 2188707 - DNA, 19 bp, Homo sapiens
ttgcagacctgggacttta

SEQ ID NO: 2188708 - DNA, 20 bp, Homo sapiens
ttgcagacctgggactttag

SEQ ID NO: 2188709 - DNA, 21 bp, Homo sapiens
ttgcagctgctggttttggtt

SEQ ID NO: 2188710 - DNA, 12 bp, Homo sapiens
ttgcagcttcct

SEQ ID NO: 2188711 - DNA, 23 bp, Homo sapiens
ttgcatcccaaaccacgcctctt

SEQ ID NO: 2188712 - DNA, 22 bp, Homo sapiens
ttgcatcgctgtccaagtgttt

SEQ ID NO: 2188713 - DNA, 14 bp, Homo sapiens
ttgccatgctgcta

SEQ ID NO: 2188714 - DNA, 14 bp, Homo sapiens
ttgccatttcttcc

SEQ ID NO: 2188715 - DNA, 16 bp, Homo sapiens
ttgccatttcttccca

SEQ ID NO: 2188716 - DNA, 17 bp, Homo sapiens
ttgcccaacctcagcaa

SEQ ID NO: 2188717 - DNA, 20 bp, Homo sapiens
ttgcccagggtcctgtgcct

SEQ ID NO: 2188718 - DNA, 14 bp, Homo sapiens
ttgccccagtgtgg

SEQ ID NO: 2188719 - DNA, 18 bp, Homo sapiens
ttgcctccatggtgcctc

SEQ ID NO: 2188720 - DNA, 14 bp, Homo sapiens
ttgcctttgaggtt

SEQ ID NO: 2188721 - DNA, 18 bp, Homo sapiens
ttgcgtgtctgtttcctt

SEQ ID NO: 2188722 - DNA, 19 bp, Homo sapiens
ttgctatcatatattataa

SEQ ID NO: 2188723 - DNA, 16 bp, Homo sapiens
ttgctccaccccactc

SEQ ID NO: 2188724 - DNA, 17 bp, Homo sapiens
ttgctccaccccactca

SEQ ID NO: 2188725 - DNA, 17 bp, Homo sapiens
ttgctctatatgtaata

SEQ ID NO: 2188726 - DNA, 21 bp, Homo sapiens
ttgctctggaagcctgctgat

SEQ ID NO: 2188727 - DNA, 22 bp, Homo sapiens
ttgctcttgcagagaagccttg

SEQ ID NO: 2188728 - DNA, 22 bp, Homo sapiens
ttgctgttgttcagaagttgtt

SEQ ID NO: 2188729 - DNA, 16 bp, Homo sapiens
ttgcttgggttccttt

SEQ ID NO: 2188730 - DNA, 17 bp, Homo sapiens
ttgcttgtactgggaca

SEQ ID NO: 2188731 - DNA, 18 bp, Homo sapiens
ttgctttgtagtttgctt

SEQ ID NO: 2188732 - DNA, 22 bp, Homo sapiens
ttggaaactgttggttgagata

SEQ ID NO: 2188733 - DNA, 16 bp, Homo sapiens
ttggaaatttggaaga

SEQ ID NO: 2188734 - DNA, 16 bp, Homo sapiens
ttggagtggaggcatt

SEQ ID NO: 2188735 - DNA, 12 bp, Homo sapiens
ttggcagctgac

SEQ ID NO: 2188736 - DNA, 14 bp, Homo sapiens
ttggcatcacctgc

SEQ ID NO: 2188737 - DNA, 21 bp, Homo sapiens
ttggccactttgcagacctgg

SEQ ID NO: 2188738 - DNA, 13 bp, Homo sapiens
ttggcctatttca

SEQ ID NO: 2188739 - DNA, 15 bp, Homo sapiens
ttggctcgggacttc

SEQ ID NO: 2188740 - DNA, 21 bp, Homo sapiens
ttggctcgggacttcaaaatc

SEQ ID NO: 2188741 - DNA, 17 bp, Homo sapiens
ttggcttgtgatctggg

SEQ ID NO: 2188742 - DNA, 15 bp, Homo sapiens
ttgggaaacttctag

SEQ ID NO: 2188743 - DNA, 14 bp, Homo sapiens
ttgggactgtcttg

SEQ ID NO: 2188744 - DNA, 19 bp, Homo sapiens
ttgggactgtcttgagaaa

SEQ ID NO: 2188745 - DNA, 17 bp, Homo sapiens
ttggggaactcaaagga

SEQ ID NO: 2188746 - DNA, 19 bp, Homo sapiens
ttggggtggggcgggaggc

SEQ ID NO: 2188747 - DNA, 14 bp, Homo sapiens
ttggtaagagggag

SEQ ID NO: 2188748 - DNA, 17 bp, Homo sapiens
ttggtattcaatttgat

SEQ ID NO: 2188749 - DNA, 12 bp, Homo sapiens
ttggtcatttgc

SEQ ID NO: 2188750 - DNA, 17 bp, Homo sapiens
ttggtcctctgatttca

SEQ ID NO: 2188751 - DNA, 20 bp, Homo sapiens
ttggtgaccagtttcttaaa

SEQ ID NO: 2188752 - DNA, 15 bp, Homo sapiens
ttgtaaacctggagg

SEQ ID NO: 2188753 - DNA, 13 bp, Homo sapiens
ttgtaaatacaat

SEQ ID NO: 2188754 - DNA, 13 bp, Homo sapiens
ttgtaattaactg

SEQ ID NO: 2188755 - DNA, 18 bp, Homo sapiens
ttgtacacatatacatat

SEQ ID NO: 2188756 - DNA, 15 bp, Homo sapiens
ttgtaccaaagctgt

SEQ ID NO: 2188757 - DNA, 12 bp, Homo sapiens
ttgtactgggac

SEQ ID NO: 2188758 - DNA, 18 bp, Homo sapiens
ttgtacttgttcttttct

SEQ ID NO: 2188759 - DNA, 21 bp, Homo sapiens
ttgtagctcttagtcctccct

SEQ ID NO: 2188760 - DNA, 19 bp, Homo sapiens
ttgtatatattattataat

SEQ ID NO: 2188761 - DNA, 10 bp, Homo sapiens
aaaaaaagaa

SEQ ID NO: 2188762 - DNA, 12 bp, Homo sapiens
aaaaacatgctt

SEQ ID NO: 2188763 - DNA, 13 bp, Homo sapiens
aaaaactaaagca

SEQ ID NO: 2188764 - DNA, 14 bp, Homo sapiens
aaaaactttttgtt

SEQ ID NO: 2188765 - DNA, 16 bp, Homo sapiens
aaaaagatttttaaaa

SEQ ID NO: 2188766 - DNA, 17 bp, Homo sapiens
aaaaaggtgtgtcaaag

SEQ ID NO: 2188767 - DNA, 13 bp, Homo sapiens
aaaaataaatcaa

SEQ ID NO: 2188768 - DNA, 17 bp, Homo sapiens
aaaaatatctgaatata

SEQ ID NO: 2188769 - DNA, 14 bp, Homo sapiens
aaaaattaattctt

SEQ ID NO: 2188770 - DNA, 14 bp, Homo sapiens
aaaaattatatttt

SEQ ID NO: 2188771 - DNA, 20 bp, Homo sapiens
aaaacaaaaccaagccttgg

SEQ ID NO: 2188772 - DNA, 12 bp, Homo sapiens
aaaacaaagtgc

SEQ ID NO: 2188773 - DNA, 16 bp, Homo sapiens
aaaactaaagcagttt

SEQ ID NO: 2188774 - DNA, 12 bp, Homo sapiens
aaaactctttga

SEQ ID NO: 2188775 - DNA, 20 bp, Homo sapiens
aaaacttcgtaagaacatgt

SEQ ID NO: 2188776 - DNA, 16 bp, Homo sapiens
aatggggacctggggt

SEQ ID NO: 2188777 - DNA, 17 bp, Homo sapiens
aatggtgagaattaaaa

SEQ ID NO: 2188778 - DNA, 18 bp, Homo sapiens
aatggtgagaattaaaat

SEQ ID NO: 2188779 - DNA, 10 bp, Homo sapiens
aatggtgcct

SEQ ID NO: 2188780 - DNA, 18 bp, Homo sapiens
aatgtgccatttttttca

SEQ ID NO: 2188781 - DNA, 20 bp, Homo sapiens
aatgtgcccagtcatgacat

SEQ ID NO: 2188782 - DNA, 21 bp, Homo sapiens
aatgtgcccagtcatgacatt

SEQ ID NO: 2188783 - DNA, 14 bp, Homo sapiens
aatgtgtatgtctg

SEQ ID NO: 2188784 - DNA, 21 bp, Homo sapiens
aatgtgtatttactgtactaa

SEQ ID NO: 2188785 - DNA, 16 bp, Homo sapiens
aatgttaataaaggtt

SEQ ID NO: 2188786 - DNA, 17 bp, Homo sapiens
aatgttaataaaggttt

SEQ ID NO: 2188787 - DNA, 14 bp, Homo sapiens
aatgttttaaactc

SEQ ID NO: 2188788 - DNA, 13 bp, Homo sapiens
aattaaaatttat

SEQ ID NO: 2188789 - DNA, 13 bp, Homo sapiens
aattaaagaaaat

SEQ ID NO: 2188790 - DNA, 23 bp, Homo sapiens
aattaaagaaaattgccaaaata

SEQ ID NO: 2188791 - DNA, 21 bp, Homo sapiens
aattaataaatcatgttttga

SEQ ID NO: 2188792 - DNA, 15 bp, Homo sapiens
aattacaagtttcag

SEQ ID NO: 2188793 - DNA, 16 bp, Homo sapiens
aattacaagtttcagt

SEQ ID NO: 2188794 - DNA, 17 bp, Homo sapiens
aattacaagtttcagta

SEQ ID NO: 2188795 - DNA, 19 bp, Homo sapiens
aattacaagtttcagtaat

SEQ ID NO: 2188796 - DNA, 16 bp, Homo sapiens
aattactgataaaaat

SEQ ID NO: 2188797 - DNA, 19 bp, Homo sapiens
aattactttgattccattt

SEQ ID NO: 2188798 - DNA, 20 bp, Homo sapiens
aattagaacttgaatacttt

SEQ ID NO: 2188799 - DNA, 14 bp, Homo sapiens
aattagattagaaa

SEQ ID NO: 2188800 - DNA, 18 bp, Homo sapiens
aattagattagaaagact

SEQ ID NO: 2188801 - DNA, 14 bp, Homo sapiens
aattagtaataaaa

SEQ ID NO: 2188802 - DNA, 19 bp, Homo sapiens
aattatataactgtatttg

SEQ ID NO: 2188803 - DNA, 14 bp, Homo sapiens
aattatattttgaa

SEQ ID NO: 2188804 - DNA, 18 bp, Homo sapiens
aattatgctgtgaatttt

SEQ ID NO: 2188805 - DNA, 23 bp, Homo sapiens
aattattatcttcttaacagttt

SEQ ID NO: 2188806 - DNA, 19 bp, Homo sapiens
aattattttggatctatca

SEQ ID NO: 2188807 - DNA, 20 bp, Homo sapiens
aattcaaacaattcaatcaa

SEQ ID NO: 2188808 - DNA, 22 bp, Homo sapiens
aattcaaacaattcaatcaaag

SEQ ID NO: 2188809 - DNA, 13 bp, Homo sapiens
aattcaacaagat

SEQ ID NO: 2188810 - DNA, 16 bp, Homo sapiens
aattcaatcaaagcta

SEQ ID NO: 2188811 - DNA, 16 bp, Homo sapiens
aattcacaagctgcct

SEQ ID NO: 2188812 - DNA, 18 bp, Homo sapiens
aattcacatccccaaagg

SEQ ID NO: 2188813 - DNA, 16 bp, Homo sapiens
aattcagtgccttcaa

SEQ ID NO: 2188814 - DNA, 20 bp, Homo sapiens
aattccaatatttataatta

SEQ ID NO: 2188815 - DNA, 18 bp, Homo sapiens
aattgaaaactttggaga

SEQ ID NO: 2188816 - DNA, 19 bp, Homo sapiens
aattgaagtcccaatttaa

SEQ ID NO: 2188817 - DNA, 14 bp, Homo sapiens
aattgcacgtgcaa

SEQ ID NO: 2188818 - DNA, 14 bp, Homo sapiens
aattgccaaaatat

SEQ ID NO: 2188819 - DNA, 16 bp, Homo sapiens
aattggttaatcactt

SEQ ID NO: 2188820 - DNA, 14 bp, Homo sapiens
aattgtatattgta

SEQ ID NO: 2188821 - DNA, 23 bp, Homo sapiens
aattgtgtcatgattaatgtgta

SEQ ID NO: 2188822 - DNA, 19 bp, Homo sapiens
aatttaaaataattatata

SEQ ID NO: 2188823 - DNA, 16 bp, Homo sapiens
aatttatatttgtctc

SEQ ID NO: 2188824 - DNA, 18 bp, Homo sapiens
aatttattatgtggctaa

SEQ ID NO: 2188825 - DNA, 21 bp, Homo sapiens
aatttattgtaccaaagctgt

SEQ ID NO: 2188826 - DNA, 22 bp, Homo sapiens
aatttcagctggagatactgat

SEQ ID NO: 2188827 - DNA, 17 bp, Homo sapiens
aatttcatctttccaaa

SEQ ID NO: 2188828 - DNA, 11 bp, Homo sapiens
aatttctcccc

SEQ ID NO: 2188829 - DNA, 17 bp, Homo sapiens
aatttgggtcccagcta

SEQ ID NO: 2188830 - DNA, 13 bp, Homo sapiens
aatttgtagaatt

SEQ ID NO: 2188831 - DNA, 16 bp, Homo sapiens
aatttgttaatatata

SEQ ID NO: 2188832 - DNA, 13 bp, Homo sapiens
aattttatgtatt

SEQ ID NO: 2188833 - DNA, 21 bp, Homo sapiens
aattttgttaagaatttcaat

SEQ ID NO: 2188834 - DNA, 14 bp, Homo sapiens
aatttttttctagt

SEQ ID NO: 2188835 - DNA, 16 bp, Homo sapiens
acaaaagtatattcaa

SEQ ID NO: 2188836 - DNA, 21 bp, Homo sapiens
acaaaatgacattttgccaaa

SEQ ID NO: 2188837 - DNA, 15 bp, Homo sapiens
acaaaccactgtaca

SEQ ID NO: 2188838 - DNA, 18 bp, Homo sapiens
acaaaccactgtacatat

SEQ ID NO: 2188839 - DNA, 20 bp, Homo sapiens
acaaagctaaatacatggaa

SEQ ID NO: 2188840 - DNA, 14 bp, Homo sapiens
acaaaggacaaaaa

SEQ ID NO: 2188841 - DNA, 19 bp, Homo sapiens
acaaaggtgattttcctgt

SEQ ID NO: 2188842 - DNA, 17 bp, Homo sapiens
acaaatagtgctaataa

SEQ ID NO: 2188843 - DNA, 18 bp, Homo sapiens
acaaatcttcaaggtgta

SEQ ID NO: 2188844 - DNA, 13 bp, Homo sapiens
acaaatgggactg

SEQ ID NO: 2188845 - DNA, 13 bp, Homo sapiens
acaaatgtgtact

SEQ ID NO: 2188846 - DNA, 12 bp, Homo sapiens
acaacaccagga

SEQ ID NO: 2188847 - DNA, 13 bp, Homo sapiens
acaacaccaggac

SEQ ID NO: 2188848 - DNA, 14 bp, Homo sapiens
acaacaccaggact

SEQ ID NO: 2188849 - DNA, 16 bp, Homo sapiens
acaacaggctgtgtgt

SEQ ID NO: 2188850 - DNA, 14 bp, Homo sapiens
acaaccatgtcatt

SEQ ID NO: 2188851 - DNA, 16 bp, Homo sapiens
acaacgtgagagaaag

SEQ ID NO: 2188852 - DNA, 14 bp, Homo sapiens
acaactccactgtc

SEQ ID NO: 2188853 - DNA, 23 bp, Homo sapiens
acaactgatcatttgcagctgct

SEQ ID NO: 2188854 - DNA, 20 bp, Homo sapiens
acaactgtcagaataaagaa

SEQ ID NO: 2188855 - DNA, 22 bp, Homo sapiens
acaactgtcagaataaagaaca

SEQ ID NO: 2188856 - DNA, 11 bp, Homo sapiens
acaagaatgtc

SEQ ID NO: 2188857 - DNA, 15 bp, Homo sapiens
acaagagggcaaagc

SEQ ID NO: 2188858 - DNA, 19 bp, Homo sapiens
acaagagggcaaagctgat

SEQ ID NO: 2188859 - DNA, 14 bp, Homo sapiens
acaagcagcccttg

SEQ ID NO: 2188860 - DNA, 17 bp, Homo sapiens
acaagctgtccctgcag

SEQ ID NO: 2188861 - DNA, 19 bp, Homo sapiens
acaagctgtccctgcaggg

SEQ ID NO: 2188862 - DNA, 19 bp, Homo sapiens
acaaggcaggcctttccta

SEQ ID NO: 2188863 - DNA, 21 bp, Homo sapiens
acaaggcaggcctttcctaca

SEQ ID NO: 2188864 - DNA, 15 bp, Homo sapiens
acaaggtagacatgg

SEQ ID NO: 2188865 - DNA, 16 bp, Homo sapiens
acaataagaatgaatc

SEQ ID NO: 2188866 - DNA, 21 bp, Homo sapiens
acaatctttccttgtctctca

SEQ ID NO: 2188867 - DNA, 15 bp, Homo sapiens
acaatgcagatgcca

SEQ ID NO: 2188868 - DNA, 17 bp, Homo sapiens
acaatgcatgctttgga

SEQ ID NO: 2188869 - DNA, 18 bp, Homo sapiens
acaattcaatcaaagcta

SEQ ID NO: 2188870 - DNA, 19 bp, Homo sapiens
acaattcaatcaaagctac

SEQ ID NO: 2188871 - DNA, 16 bp, Homo sapiens
acacaaaaagaaagct

SEQ ID NO: 2188872 - DNA, 22 bp, Homo sapiens
acacaaagcctgtgttactgat

SEQ ID NO: 2188873 - DNA, 20 bp, Homo sapiens
acacaaaggacaaaaatata

SEQ ID NO: 2188874 - DNA, 14 bp, Homo sapiens
acacaatctttcct

SEQ ID NO: 2188875 - DNA, 19 bp, Homo sapiens
acacaatctttccttgtct

SEQ ID NO: 2188876 - DNA, 20 bp, Homo sapiens
acacagagtggagccctcag

SEQ ID NO: 2188877 - DNA, 17 bp, Homo sapiens
acacagcctgtcttcag

SEQ ID NO: 2188878 - DNA, 22 bp, Homo sapiens
acacagcctgtcttcagatcct

SEQ ID NO: 2188879 - DNA, 23 bp, Homo sapiens
acacagcttttagtacccacctg

SEQ ID NO: 2188880 - DNA, 14 bp, Homo sapiens
acacaggtgagaaa

SEQ ID NO: 2188881 - DNA, 12 bp, Homo sapiens
acaccaggactt

SEQ ID NO: 2188882 - DNA, 14 bp, Homo sapiens
acacccagcctctg

SEQ ID NO: 2188883 - DNA, 16 bp, Homo sapiens
acacccagcctctgta

SEQ ID NO: 2188884 - DNA, 18 bp, Homo sapiens
acacctcagagccccgca

SEQ ID NO: 2188885 - DNA, 23 bp, Homo sapiens
acacgtggcctcgtgaggggcaa

SEQ ID NO: 2188886 - DNA, 15 bp, Homo sapiens
acacgtgtgatgtat

SEQ ID NO: 2188887 - DNA, 15 bp, Homo sapiens
acactagtctgtgtg

SEQ ID NO: 2188888 - DNA, 19 bp, Homo sapiens
acactcttcagtgactcct

SEQ ID NO: 2188889 - DNA, 21 bp, Homo sapiens
acactcttcagtgactcctgc

SEQ ID NO: 2188890 - DNA, 16 bp, Homo sapiens
acactgccagaagtgt

SEQ ID NO: 2188891 - DNA, 21 bp, Homo sapiens
acactgccagaagtgtgtttt

SEQ ID NO: 2188892 - DNA, 16 bp, Homo sapiens
acactgcgaactctca

SEQ ID NO: 2188893 - DNA, 13 bp, Homo sapiens
acacttcagactg

SEQ ID NO: 2188894 - DNA, 13 bp, Homo sapiens
acactttctggga

SEQ ID NO: 2188895 - DNA, 22 bp, Homo sapiens
acactttgccatttgcttgtac

SEQ ID NO: 2188896 - DNA, 16 bp, Homo sapiens
acagaaaacattgact

SEQ ID NO: 2188897 - DNA, 16 bp, Homo sapiens
acagaaattgtatatt

SEQ ID NO: 2188898 - DNA, 21 bp, Homo sapiens
acgggggaggccgaggcaggg

SEQ ID NO: 2188899 - DNA, 21 bp, Homo sapiens
acggtacttggtaagagggag

SEQ ID NO: 2188900 - DNA, 18 bp, Homo sapiens
acggtgatattgtgcatg

SEQ ID NO: 2188901 - DNA, 20 bp, Homo sapiens
acggtgatattgtgcatgca

SEQ ID NO: 2188902 - DNA, 22 bp, Homo sapiens
acggtggtccccaaaacactgt

SEQ ID NO: 2188903 - DNA, 19 bp, Homo sapiens
acgtaaagaaaatcataaa

SEQ ID NO: 2188904 - DNA, 15 bp, Homo sapiens
acgtgtgatgtatgt

SEQ ID NO: 2188905 - DNA, 16 bp, Homo sapiens
acgtgtgatgtatgtt

SEQ ID NO: 2188906 - DNA, 21 bp, Homo sapiens
acgttctggaacattctgtca

SEQ ID NO: 2188907 - DNA, 17 bp, Homo sapiens
acgttttagaaaatttt

SEQ ID NO: 2188908 - DNA, 19 bp, Homo sapiens
acgttttagaaaattttat

SEQ ID NO: 2188909 - DNA, 13 bp, Homo sapiens
actaactagagca

SEQ ID NO: 2188910 - DNA, 15 bp, Homo sapiens
actaatcaatacttt

SEQ ID NO: 2188911 - DNA, 21 bp, Homo sapiens
actaattgtaaggtattgcaa

SEQ ID NO: 2188912 - DNA, 22 bp, Homo sapiens
actaattgtaaggtattgcaag

SEQ ID NO: 2188913 - DNA, 14 bp, Homo sapiens
actacctcttttga

SEQ ID NO: 2188914 - DNA, 20 bp, Homo sapiens
actactatttttctttccaa

SEQ ID NO: 2188915 - DNA, 16 bp, Homo sapiens
actagagcagccctgg

SEQ ID NO: 2188916 - DNA, 21 bp, Homo sapiens
actagagcagccctggagtca

SEQ ID NO: 2188917 - DNA, 15 bp, Homo sapiens
actagcctccctctc

SEQ ID NO: 2188918 - DNA, 15 bp, Homo sapiens
actagtctgtgtgct

SEQ ID NO: 2188919 - DNA, 13 bp, Homo sapiens
actatagccattt

SEQ ID NO: 2188920 - DNA, 14 bp, Homo sapiens
actatagccatttg

SEQ ID NO: 2188921 - DNA, 22 bp, Homo sapiens
actatatttaataccaccaaca

SEQ ID NO: 2188922 - DNA, 18 bp, Homo sapiens
actatcaacactgcagca

SEQ ID NO: 2188923 - DNA, 13 bp, Homo sapiens
actatcctggctt

SEQ ID NO: 2188924 - DNA, 13 bp, Homo sapiens
actcaaacacaga

SEQ ID NO: 2188925 - DNA, 20 bp, Homo sapiens
actcaaagttaacctacctg

SEQ ID NO: 2188926 - DNA, 13 bp, Homo sapiens
actcaaccctctc

SEQ ID NO: 2188927 - DNA, 13 bp, Homo sapiens
actcaaggcctcc

SEQ ID NO: 2188928 - DNA, 14 bp, Homo sapiens
actcaatttctccc

SEQ ID NO: 2188929 - DNA, 17 bp, Homo sapiens
actcacagagacacagg

SEQ ID NO: 2188930 - DNA, 16 bp, Homo sapiens
actcacatgctggaca

SEQ ID NO: 2188931 - DNA, 21 bp, Homo sapiens
actcaccttgaacaccacgct

SEQ ID NO: 2188932 - DNA, 22 bp, Homo sapiens
actcacgggaggaatcttttac

SEQ ID NO: 2188933 - DNA, 17 bp, Homo sapiens
actcagaattattcata

SEQ ID NO: 2188934 - DNA, 21 bp, Homo sapiens
actcatactgtgctggagcca

SEQ ID NO: 2188935 - DNA, 13 bp, Homo sapiens
actcattaatttc

SEQ ID NO: 2188936 - DNA, 16 bp, Homo sapiens
actcattaatttctct

SEQ ID NO: 2188937 - DNA, 16 bp, Homo sapiens
actcatttatttccat

SEQ ID NO: 2188938 - DNA, 14 bp, Homo sapiens
actccactgtcttt

SEQ ID NO: 2188939 - DNA, 15 bp, Homo sapiens
actcccaaagagctg

SEQ ID NO: 2188940 - DNA, 14 bp, Homo sapiens
actcccaagaacag

SEQ ID NO: 2188941 - DNA, 17 bp, Homo sapiens
actcccaagaacagcag

SEQ ID NO: 2188942 - DNA, 17 bp, Homo sapiens
actcctacacctaactc

SEQ ID NO: 2188943 - DNA, 16 bp, Homo sapiens
actcctgctggtacct

SEQ ID NO: 2188944 - DNA, 22 bp, Homo sapiens
actcctgctggtacctgccctc

SEQ ID NO: 2188945 - DNA, 11 bp, Homo sapiens
actccttcctc

SEQ ID NO: 2188946 - DNA, 14 bp, Homo sapiens
actccttcctcttt

SEQ ID NO: 2188947 - DNA, 18 bp, Homo sapiens
actccttcctctttgctt

SEQ ID NO: 2188948 - DNA, 16 bp, Homo sapiens
actcgcttctctgtga

SEQ ID NO: 2188949 - DNA, 13 bp, Homo sapiens
actcgtttttata

SEQ ID NO: 2188950 - DNA, 19 bp, Homo sapiens
actctcccagaggctcctg

SEQ ID NO: 2188951 - DNA, 17 bp, Homo sapiens
actctcctgcctcagcc

SEQ ID NO: 2188952 - DNA, 12 bp, Homo sapiens
actctctagttc

SEQ ID NO: 2188953 - DNA, 19 bp, Homo sapiens
actctgcactatagccatt

SEQ ID NO: 2188954 - DNA, 15 bp, Homo sapiens
actgaagtgaataca

SEQ ID NO: 2188955 - DNA, 17 bp, Homo sapiens
actgaagtgaatacatg

SEQ ID NO: 2188956 - DNA, 18 bp, Homo sapiens
actgaagtgaatacatgg

SEQ ID NO: 2188957 - DNA, 23 bp, Homo sapiens
actgacacaaaggacaaaaatat

SEQ ID NO: 2188958 - DNA, 20 bp, Homo sapiens
actgacactgcgaactctca

SEQ ID NO: 2188959 - DNA, 18 bp, Homo sapiens
actgactggcaccaacac

SEQ ID NO: 2188960 - DNA, 21 bp, Homo sapiens
actgactggcaccaacacttt

SEQ ID NO: 2188961 - DNA, 23 bp, Homo sapiens
actgagaaaacgaaactgctcta

SEQ ID NO: 2188962 - DNA, 16 bp, Homo sapiens
actgagctgccagtgg

SEQ ID NO: 2188963 - DNA, 17 bp, Homo sapiens
actgagtagcagaaaac

SEQ ID NO: 2188964 - DNA, 13 bp, Homo sapiens
actgagtttgtgg

SEQ ID NO: 2188965 - DNA, 22 bp, Homo sapiens
actgatcatttgcagctgctgg

SEQ ID NO: 2188966 - DNA, 13 bp, Homo sapiens
actgatgtcatct

SEQ ID NO: 2188967 - DNA, 16 bp, Homo sapiens
actgatgttaggctgg

SEQ ID NO: 2188968 - DNA, 21 bp, Homo sapiens
actgatgttaggctgggccca

SEQ ID NO: 2188969 - DNA, 16 bp, Homo sapiens
actgcaaataaagcct

SEQ ID NO: 2188970 - DNA, 11 bp, Homo sapiens
actgcaacagg

SEQ ID NO: 2188971 - DNA, 15 bp, Homo sapiens
actgcaacaggaact

SEQ ID NO: 2188972 - DNA, 16 bp, Homo sapiens
actgcacataatttgc

SEQ ID NO: 2188973 - DNA, 16 bp, Homo sapiens
actgcaccttgtgaag

SEQ ID NO: 2188974 - DNA, 17 bp, Homo sapiens
actgcactccagcctgg

SEQ ID NO: 2188975 - DNA, 18 bp, Homo sapiens
actgcagcattttgctgc

SEQ ID NO: 2188976 - DNA, 21 bp, Homo sapiens
actgcagcattttgctgcttt

SEQ ID NO: 2188977 - DNA, 19 bp, Homo sapiens
actgcagtcacccctgtct

SEQ ID NO: 2188978 - DNA, 20 bp, Homo sapiens
actgcagtcacccctgtctg

SEQ ID NO: 2188979 - DNA, 15 bp, Homo sapiens
actgccaagccagat

SEQ ID NO: 2188980 - DNA, 20 bp, Homo sapiens
actgccataaaatctcacgc

SEQ ID NO: 2188981 - DNA, 12 bp, Homo sapiens
actgccctctgt

SEQ ID NO: 2188982 - DNA, 15 bp, Homo sapiens
actgccttcctcctt

SEQ ID NO: 2188983 - DNA, 19 bp, Homo sapiens
actgctaaatactgtacat

SEQ ID NO: 2188984 - DNA, 22 bp, Homo sapiens
actgctaaatactgtacataga

SEQ ID NO: 2188985 - DNA, 21 bp, Homo sapiens
actgctaattacacacgtgtg

SEQ ID NO: 2188986 - DNA, 12 bp, Homo sapiens
actgctgcccca

SEQ ID NO: 2188987 - DNA, 22 bp, Homo sapiens
actgctgccccaaaggaagctt

SEQ ID NO: 2188988 - DNA, 14 bp, Homo sapiens
actgctttatccag

SEQ ID NO: 2188989 - DNA, 17 bp, Homo sapiens
actggaaatgcatgact

SEQ ID NO: 2188990 - DNA, 12 bp, Homo sapiens
actggagaggct

SEQ ID NO: 2188991 - DNA, 19 bp, Homo sapiens
actggcttctgcttgtcat

SEQ ID NO: 2188992 - DNA, 16 bp, Homo sapiens
actggctttgtcccac

SEQ ID NO: 2188993 - DNA, 21 bp, Homo sapiens
actggctttgtcccacagctt

SEQ ID NO: 2188994 - DNA, 15 bp, Homo sapiens
actggggagtgctgg

SEQ ID NO: 2188995 - DNA, 16 bp, Homo sapiens
actgggtaggttctga

SEQ ID NO: 2188996 - DNA, 17 bp, Homo sapiens
actggtcatcagtattg

SEQ ID NO: 2188997 - DNA, 16 bp, Homo sapiens
actggtgtaaaaaaca

SEQ ID NO: 2188998 - DNA, 21 bp, Homo sapiens
actggtgtaaaaaacaaacat

SEQ ID NO: 2188999 - DNA, 23 bp, Homo sapiens
actggttccttaagtggctgtga

SEQ ID NO: 2189000 - DNA, 17 bp, Homo sapiens
actgtacatagatgtat

SEQ ID NO: 2189001 - DNA, 20 bp, Homo sapiens
actgtacatagatgtatcat

SEQ ID NO: 2189002 - DNA, 18 bp, Homo sapiens
actgtcagaataaagaac

SEQ ID NO: 2189003 - DNA, 20 bp, Homo sapiens
actgtcagaataaagaacat

SEQ ID NO: 2189004 - DNA, 21 bp, Homo sapiens
actgtcagaataaagaacatt

SEQ ID NO: 2189005 - DNA, 21 bp, Homo sapiens
actgtcgcatctttttaacat

SEQ ID NO: 2189006 - DNA, 19 bp, Homo sapiens
actgtgacctaagaacaaa

SEQ ID NO: 2189007 - DNA, 19 bp, Homo sapiens
actgtgattactctttgct

SEQ ID NO: 2189008 - DNA, 20 bp, Homo sapiens
actgtgattactctttgctt

SEQ ID NO: 2189009 - DNA, 17 bp, Homo sapiens
actgtgatttatttgga

SEQ ID NO: 2189010 - DNA, 23 bp, Homo sapiens
actgtgatttatttggagtggag

SEQ ID NO: 2189011 - DNA, 12 bp, Homo sapiens
actgtgcccagc

SEQ ID NO: 2189012 - DNA, 23 bp, Homo sapiens
actgtgcccagcagtttcccaga

SEQ ID NO: 2189013 - DNA, 21 bp, Homo sapiens
actgtgctgattcaataaaat

SEQ ID NO: 2189014 - DNA, 15 bp, Homo sapiens
actgtgctggagcca

SEQ ID NO: 2189015 - DNA, 18 bp, Homo sapiens
actgtgctggagccacta

SEQ ID NO: 2189016 - DNA, 22 bp, Homo sapiens
actgtgctggagccactaacta

SEQ ID NO: 2189017 - DNA, 16 bp, Homo sapiens
actgtggctcttgcct

SEQ ID NO: 2189018 - DNA, 20 bp, Homo sapiens
actgttcatgaatacgtaaa

SEQ ID NO: 2189019 - DNA, 15 bp, Homo sapiens
actgtttgtcttctc

SEQ ID NO: 2189020 - DNA, 23 bp, Homo sapiens
agctcctgctccacagccatccc

SEQ ID NO: 2189021 - DNA, 16 bp, Homo sapiens
agctcctgggaaggct

SEQ ID NO: 2189022 - DNA, 23 bp, Homo sapiens
agctcctgggaaggctactcacc

SEQ ID NO: 2189023 - DNA, 13 bp, Homo sapiens
agctccttcccta

SEQ ID NO: 2189024 - DNA, 17 bp, Homo sapiens
agctctggagccacctg

SEQ ID NO: 2189025 - DNA, 19 bp, Homo sapiens
agctctggctcacagactg

SEQ ID NO: 2189026 - DNA, 21 bp, Homo sapiens
agctctgtcgtggtagcagat

SEQ ID NO: 2189027 - DNA, 19 bp, Homo sapiens
agctcttagtcctccctgc

SEQ ID NO: 2189028 - DNA, 20 bp, Homo sapiens
agctcttagtcctccctgct

SEQ ID NO: 2189029 - DNA, 24 bp, Homo sapiens
agctgaacagtgttggctttcatg

SEQ ID NO: 2189030 - DNA, 14 bp, Homo sapiens
agctgaagccgcca

SEQ ID NO: 2189031 - DNA, 19 bp, Homo sapiens
agctgaaggcagtggcagg

SEQ ID NO: 2189032 - DNA, 18 bp, Homo sapiens
agctgacgaggctgggcc

SEQ ID NO: 2189033 - DNA, 19 bp, Homo sapiens
agctgacgaggctgggcca

SEQ ID NO: 2189034 - DNA, 16 bp, Homo sapiens
agctgagactacaggt

SEQ ID NO: 2189035 - DNA, 18 bp, Homo sapiens
agctgatttggtcacctt

SEQ ID NO: 2189036 - DNA, 21 bp, Homo sapiens
agctgattttttttttaactt

SEQ ID NO: 2189037 - DNA, 15 bp, Homo sapiens
agctgcctggatgag

SEQ ID NO: 2189038 - DNA, 22 bp, Homo sapiens
agctgctccgaggacccaggaa

SEQ ID NO: 2189039 - DNA, 13 bp, Homo sapiens
agctgctctgccc

SEQ ID NO: 2189040 - DNA, 14 bp, Homo sapiens
agctgctctgccca

SEQ ID NO: 2189041 - DNA, 15 bp, Homo sapiens
agctgctctgcccag

SEQ ID NO: 2189042 - DNA, 17 bp, Homo sapiens
agctgctctgcccagag

SEQ ID NO: 2189043 - DNA, 19 bp, Homo sapiens
agctgctctgcccagagct

SEQ ID NO: 2189044 - DNA, 16 bp, Homo sapiens
agctggagatactgat

SEQ ID NO: 2189045 - DNA, 21 bp, Homo sapiens
agctggcaggagggtggcact

SEQ ID NO: 2189046 - DNA, 23 bp, Homo sapiens
agctggccgggttggaggcctca

SEQ ID NO: 2189047 - DNA, 18 bp, Homo sapiens
agctggcggaacctggct

SEQ ID NO: 2189048 - DNA, 20 bp, Homo sapiens
agctggcggaacctggctgc

SEQ ID NO: 2189049 - DNA, 21 bp, Homo sapiens
agctggcggaacctggctgcg

SEQ ID NO: 2189050 - DNA, 23 bp, Homo sapiens
agctggcggaacctggctgcgaa

SEQ ID NO: 2189051 - DNA, 16 bp, Homo sapiens
agctggcgtcacctgt

SEQ ID NO: 2189052 - DNA, 13 bp, Homo sapiens
agctggggcccct

SEQ ID NO: 2189053 - DNA, 16 bp, Homo sapiens
agctggggggaaggcg

SEQ ID NO: 2189054 - DNA, 16 bp, Homo sapiens
agctgtacccttgaga

SEQ ID NO: 2189055 - DNA, 17 bp, Homo sapiens
agctgtatgaaagggac

SEQ ID NO: 2189056 - DNA, 15 bp, Homo sapiens
agctgtatgtacttc

SEQ ID NO: 2189057 - DNA, 16 bp, Homo sapiens
agctgtccctgcaggg

SEQ ID NO: 2189058 - DNA, 18 bp, Homo sapiens
agctgtgaaattgaagtc

SEQ ID NO: 2189059 - DNA, 13 bp, Homo sapiens
agcttacaggaag

SEQ ID NO: 2189060 - DNA, 17 bp, Homo sapiens
agcttcaagtctgtgcc

SEQ ID NO: 2189061 - DNA, 24 bp, Homo sapiens
agcttcaagtctgtgcctggagct

SEQ ID NO: 2189062 - DNA, 14 bp, Homo sapiens
agcttccgctttga

SEQ ID NO: 2189063 - DNA, 23 bp, Homo sapiens
agcttccgctttgaaagaagcaa

SEQ ID NO: 2189064 - DNA, 14 bp, Homo sapiens
agcttcctgtttct

SEQ ID NO: 2189065 - DNA, 23 bp, Homo sapiens
agcttctagtgatttctggggcc

SEQ ID NO: 2189066 - DNA, 16 bp, Homo sapiens
agcttgtacacatata

SEQ ID NO: 2189067 - DNA, 14 bp, Homo sapiens
agctttaatgttac

SEQ ID NO: 2189068 - DNA, 14 bp, Homo sapiens
agctttcctgggtg

SEQ ID NO: 2189069 - DNA, 18 bp, Homo sapiens
agctttctctgcttcagc

SEQ ID NO: 2189070 - DNA, 19 bp, Homo sapiens
agctttctctgcttcagct

SEQ ID NO: 2189071 - DNA, 12 bp, Homo sapiens
agctttggacac

SEQ ID NO: 2189072 - DNA, 20 bp, Homo sapiens
agctttggacgcacacagct

SEQ ID NO: 2189073 - DNA, 23 bp, Homo sapiens
agcttttagtacccacctgagct

SEQ ID NO: 2189074 - DNA, 14 bp, Homo sapiens
agctttttgtatta

SEQ ID NO: 2189075 - DNA, 19 bp, Homo sapiens
aggaaacctctgacttgct

SEQ ID NO: 2189076 - DNA, 16 bp, Homo sapiens
aggaaagaagggggcc

SEQ ID NO: 2189077 - DNA, 16 bp, Homo sapiens
aggaaagcgtttggaa

SEQ ID NO: 2189078 - DNA, 19 bp, Homo sapiens
aggaaatctcctcttttgt

SEQ ID NO: 2189079 - DNA, 19 bp, Homo sapiens
aggaagaacttgaagtgaa

SEQ ID NO: 2189080 - DNA, 14 bp, Homo sapiens
aggaagccacgtgc

SEQ ID NO: 2189081 - DNA, 22 bp, Homo sapiens
aggaagccacgtgctggagagt

SEQ ID NO: 2189082 - DNA, 19 bp, Homo sapiens
aggaagccgcctagtgcag

SEQ ID NO: 2189083 - DNA, 14 bp, Homo sapiens
aggaagccgtcctg

SEQ ID NO: 2189084 - DNA, 13 bp, Homo sapiens
aggaagctttctc

SEQ ID NO: 2189085 - DNA, 20 bp, Homo sapiens
aggaagctttctctgcttca

SEQ ID NO: 2189086 - DNA, 21 bp, Homo sapiens
aggaagctttctctgcttcag

SEQ ID NO: 2189087 - DNA, 12 bp, Homo sapiens
aggaaggggctg

SEQ ID NO: 2189088 - DNA, 14 bp, Homo sapiens
aggaaggggctgga

SEQ ID NO: 2189089 - DNA, 23 bp, Homo sapiens
aggaaggggctggactggctgtc

SEQ ID NO: 2189090 - DNA, 17 bp, Homo sapiens
aggaagtagcaggccca

SEQ ID NO: 2189091 - DNA, 16 bp, Homo sapiens
aggaagtgctaatggg

SEQ ID NO: 2189092 - DNA, 15 bp, Homo sapiens
aggaattcagtgcct

SEQ ID NO: 2189093 - DNA, 15 bp, Homo sapiens
aggacaaaaatataa

SEQ ID NO: 2189094 - DNA, 20 bp, Homo sapiens
aggacagctgcaggtgccca

SEQ ID NO: 2189095 - DNA, 21 bp, Homo sapiens
aggacagctgcaggtgcccat

SEQ ID NO: 2189096 - DNA, 19 bp, Homo sapiens
aggacaggaccctcaggaa

SEQ ID NO: 2189097 - DNA, 17 bp, Homo sapiens
aggaccctcaggaattc

SEQ ID NO: 2189098 - DNA, 16 bp, Homo sapiens
aggaccgccaaagaat

SEQ ID NO: 2189099 - DNA, 11 bp, Homo sapiens
aggacctctgg

SEQ ID NO: 2189100 - DNA, 15 bp, Homo sapiens
aggacctgacacaat

SEQ ID NO: 2189101 - DNA, 20 bp, Homo sapiens
aggacgatttcactgacact

SEQ ID NO: 2189102 - DNA, 23 bp, Homo sapiens
aggacttaagacaaatgggactg

SEQ ID NO: 2189103 - DNA, 22 bp, Homo sapiens
aggacttgtgcctcttgggaga

SEQ ID NO: 2189104 - DNA, 23 bp, Homo sapiens
aggacttgtgcctcttgggagac

SEQ ID NO: 2189105 - DNA, 18 bp, Homo sapiens
aggagaagaggaacatcc

SEQ ID NO: 2189106 - DNA, 15 bp, Homo sapiens
aggagacttaatttc

SEQ ID NO: 2189107 - DNA, 14 bp, Homo sapiens
aggagagaatgaga

SEQ ID NO: 2189108 - DNA, 22 bp, Homo sapiens
aggagagaatgagagagtgtgg

SEQ ID NO: 2189109 - DNA, 16 bp, Homo sapiens
aggagattaacacact

SEQ ID NO: 2189110 - DNA, 13 bp, Homo sapiens
aggagcaaagcag

SEQ ID NO: 2189111 - DNA, 14 bp, Homo sapiens
aggagcctgcggct

SEQ ID NO: 2189112 - DNA, 20 bp, Homo sapiens
aggagcctgcggctgctggc

SEQ ID NO: 2189113 - DNA, 20 bp, Homo sapiens
aggagcctgtgcgtcccagc

SEQ ID NO: 2189114 - DNA, 21 bp, Homo sapiens
aggagcctgtgcgtcccagct

SEQ ID NO: 2189115 - DNA, 14 bp, Homo sapiens
aggagcgagcatgt

SEQ ID NO: 2189116 - DNA, 14 bp, Homo sapiens
aggagggtggcact

SEQ ID NO: 2189117 - DNA, 15 bp, Homo sapiens
aggagggtgggaagg

SEQ ID NO: 2189118 - DNA, 18 bp, Homo sapiens
aggatatcatcttgagta

SEQ ID NO: 2189119 - DNA, 15 bp, Homo sapiens
aggatgaacacaggc

SEQ ID NO: 2189120 - DNA, 14 bp, Homo sapiens
aggattagaaaatt

SEQ ID NO: 2189121 - DNA, 18 bp, Homo sapiens
aggatttggtttttctct

SEQ ID NO: 2189122 - DNA, 18 bp, Homo sapiens
aggcaagctggcaggagg

SEQ ID NO: 2189123 - DNA, 22 bp, Homo sapiens
aggcaagctggcaggagggtgg

SEQ ID NO: 2189124 - DNA, 13 bp, Homo sapiens
aggcaaggctgcc

SEQ ID NO: 2189125 - DNA, 18 bp, Homo sapiens
aggcaaggggtgcctggg

SEQ ID NO: 2189126 - DNA, 19 bp, Homo sapiens
aggcaccacctctgtcacg

SEQ ID NO: 2189127 - DNA, 11 bp, Homo sapiens
aggcaccagga

SEQ ID NO: 2189128 - DNA, 13 bp, Homo sapiens
aggcaccaggaag

SEQ ID NO: 2189129 - DNA, 14 bp, Homo sapiens
aggcaccaggaagc

SEQ ID NO: 2189130 - DNA, 19 bp, Homo sapiens
aggcaccattcaggaacct

SEQ ID NO: 2189131 - DNA, 22 bp, Homo sapiens
aggcagaaccctggtgaggaag

SEQ ID NO: 2189132 - DNA, 21 bp, Homo sapiens
aggcagaacctggtggctgga

SEQ ID NO: 2189133 - DNA, 21 bp, Homo sapiens
aggcagagtgccccacctgcc

SEQ ID NO: 2189134 - DNA, 22 bp, Homo sapiens
aggcagagtgccccacctgcca

SEQ ID NO: 2189135 - DNA, 17 bp, Homo sapiens
aggcaggggctgggcag

SEQ ID NO: 2189136 - DNA, 18 bp, Homo sapiens
aggcaggggctgggcaga

SEQ ID NO: 2189137 - DNA, 17 bp, Homo sapiens
aggcagtggcaggggag

SEQ ID NO: 2189138 - DNA, 19 bp, Homo sapiens
aggccaaagacctcccaag

SEQ ID NO: 2189139 - DNA, 13 bp, Homo sapiens
aggccaggggctt

SEQ ID NO: 2189140 - DNA, 16 bp, Homo sapiens
aggccaggggcttttg

SEQ ID NO: 2189141 - DNA, 21 bp, Homo sapiens
atccccaaaggtcaaaaacaa

SEQ ID NO: 2189142 - DNA, 16 bp, Homo sapiens
atccccgctggctggg

SEQ ID NO: 2189143 - DNA, 21 bp, Homo sapiens
atccccttctcatcactcccc

SEQ ID NO: 2189144 - DNA, 19 bp, Homo sapiens
atccctacagggtgtctgt

SEQ ID NO: 2189145 - DNA, 22 bp, Homo sapiens
atccctcccctcagcctcctga

SEQ ID NO: 2189146 - DNA, 21 bp, Homo sapiens
atccctctggcccacacagat

SEQ ID NO: 2189147 - DNA, 11 bp, Homo sapiens
atccctgccaa

SEQ ID NO: 2189148 - DNA, 17 bp, Homo sapiens
atccctgccaagaactc

SEQ ID NO: 2189149 - DNA, 22 bp, Homo sapiens
atccgcatccagccgtgctgag

SEQ ID NO: 2189150 - DNA, 14 bp, Homo sapiens
atcctacagtacaa

SEQ ID NO: 2189151 - DNA, 15 bp, Homo sapiens
atcctacagtacaat

SEQ ID NO: 2189152 - DNA, 19 bp, Homo sapiens
atcctagctgtgtgcagtc

SEQ ID NO: 2189153 - DNA, 22 bp, Homo sapiens
atcctccctacttccaagaaaa

SEQ ID NO: 2189154 - DNA, 20 bp, Homo sapiens
atcctgtacaagtgctcagt

SEQ ID NO: 2189155 - DNA, 19 bp, Homo sapiens
atcctgtgacccctcccca

SEQ ID NO: 2189156 - DNA, 13 bp, Homo sapiens
atcctttcataaa

SEQ ID NO: 2189157 - DNA, 18 bp, Homo sapiens
atcgttctaaaatcaagt

SEQ ID NO: 2189158 - DNA, 16 bp, Homo sapiens
atctaatttttattaa

SEQ ID NO: 2189159 - DNA, 20 bp, Homo sapiens
atctacctgccctctctcag

SEQ ID NO: 2189160 - DNA, 21 bp, Homo sapiens
atctacctgccctctctcagt

SEQ ID NO: 2189161 - DNA, 19 bp, Homo sapiens
atctactagaaccttctaa

SEQ ID NO: 2189162 - DNA, 13 bp, Homo sapiens
atctatgtgaata

SEQ ID NO: 2189163 - DNA, 21 bp, Homo sapiens
atctcaacatggaaaaatcct

SEQ ID NO: 2189164 - DNA, 22 bp, Homo sapiens
atctcattgcaaaaatatttta

SEQ ID NO: 2189165 - DNA, 22 bp, Homo sapiens
atctccaaagctttcctggaga

SEQ ID NO: 2189166 - DNA, 22 bp, Homo sapiens
atctccctcgaacccacactgc

SEQ ID NO: 2189167 - DNA, 18 bp, Homo sapiens
atctcctctttgtgaaat

SEQ ID NO: 2189168 - DNA, 14 bp, Homo sapiens
atctcctcttttgt

SEQ ID NO: 2189169 - DNA, 16 bp, Homo sapiens
atctccttgtcttttt

SEQ ID NO: 2189170 - DNA, 22 bp, Homo sapiens
atctccttttatgctcacctga

SEQ ID NO: 2189171 - DNA, 17 bp, Homo sapiens
atctcgaagtcttccat

SEQ ID NO: 2189172 - DNA, 17 bp, Homo sapiens
atctctgtctaccatct

SEQ ID NO: 2189173 - DNA, 20 bp, Homo sapiens
atctctgtctaccatctccc

SEQ ID NO: 2189174 - DNA, 14 bp, Homo sapiens
atctgacaaagtca

SEQ ID NO: 2189175 - DNA, 12 bp, Homo sapiens
atctgactgcca

SEQ ID NO: 2189176 - DNA, 15 bp, Homo sapiens
atctgactgccaagc

SEQ ID NO: 2189177 - DNA, 18 bp, Homo sapiens
atctgactgccaagccag

SEQ ID NO: 2189178 - DNA, 16 bp, Homo sapiens
atctgcagtcacttcg

SEQ ID NO: 2189179 - DNA, 12 bp, Homo sapiens
atctgcccctcc

SEQ ID NO: 2189180 - DNA, 21 bp, Homo sapiens
atctgctgacagatgttccat

SEQ ID NO: 2189181 - DNA, 16 bp, Homo sapiens
atctgtttgcttctaa

SEQ ID NO: 2189182 - DNA, 21 bp, Homo sapiens
atcttagttctgtatataaat

SEQ ID NO: 2189183 - DNA, 16 bp, Homo sapiens
atcttataattgttct

SEQ ID NO: 2189184 - DNA, 19 bp, Homo sapiens
atcttcaaggtgtaaaata

SEQ ID NO: 2189185 - DNA, 16 bp, Homo sapiens
atcttcgtaacttcat

SEQ ID NO: 2189186 - DNA, 11 bp, Homo sapiens
atcttcttaac

SEQ ID NO: 2189187 - DNA, 16 bp, Homo sapiens
atcttggagacaatta

SEQ ID NO: 2189188 - DNA, 13 bp, Homo sapiens
atcttttactgtg

SEQ ID NO: 2189189 - DNA, 15 bp, Homo sapiens
atcttttactgtgga

SEQ ID NO: 2189190 - DNA, 21 bp, Homo sapiens
atgaaaatgatgtagacattt

SEQ ID NO: 2189191 - DNA, 19 bp, Homo sapiens
atgaaataaatcatgttaa

SEQ ID NO: 2189192 - DNA, 18 bp, Homo sapiens
atgaagactacttttaga

SEQ ID NO: 2189193 - DNA, 20 bp, Homo sapiens
atgaatacgtaaactgcgta

SEQ ID NO: 2189194 - DNA, 19 bp, Homo sapiens
atgacatttgtcctgcaga

SEQ ID NO: 2189195 - DNA, 21 bp, Homo sapiens
atgacatttgtcctgcagagc

SEQ ID NO: 2189196 - DNA, 21 bp, Homo sapiens
atgaccagaaaacaaatcttc

SEQ ID NO: 2189197 - DNA, 22 bp, Homo sapiens
atgacccggcccccgccctctg

SEQ ID NO: 2189198 - DNA, 19 bp, Homo sapiens
atgacgtattgtgaaattt

SEQ ID NO: 2189199 - DNA, 15 bp, Homo sapiens
atgactgaatttcta

SEQ ID NO: 2189200 - DNA, 20 bp, Homo sapiens
atgactggacagcggttgta

SEQ ID NO: 2189201 - DNA, 14 bp, Homo sapiens
atgagaaaaaacta

SEQ ID NO: 2189202 - DNA, 20 bp, Homo sapiens
atgagaaacagctcagccag

SEQ ID NO: 2189203 - DNA, 18 bp, Homo sapiens
atgagacaggacctagga

SEQ ID NO: 2189204 - DNA, 20 bp, Homo sapiens
atgagacaggacctaggata

SEQ ID NO: 2189205 - DNA, 21 bp, Homo sapiens
atgagatgtatgcccaaagac

SEQ ID NO: 2189206 - DNA, 18 bp, Homo sapiens
atgaggggaaaacatgta

SEQ ID NO: 2189207 - DNA, 18 bp, Homo sapiens
atgaggtcaccaggggag

SEQ ID NO: 2189208 - DNA, 22 bp, Homo sapiens
atgaggtcaccaggggaggagc

SEQ ID NO: 2189209 - DNA, 13 bp, Homo sapiens
atgatcctcaagg

SEQ ID NO: 2189210 - DNA, 22 bp, Homo sapiens
atgatggaagggccttctccac

SEQ ID NO: 2189211 - DNA, 14 bp, Homo sapiens
atgattaatgtgta

SEQ ID NO: 2189212 - DNA, 16 bp, Homo sapiens
atgattcagtgcattt

SEQ ID NO: 2189213 - DNA, 20 bp, Homo sapiens
atgattcagtgcattttcaa

SEQ ID NO: 2189214 - DNA, 17 bp, Homo sapiens
atgattgccaacagtgg

SEQ ID NO: 2189215 - DNA, 13 bp, Homo sapiens
atgatttgcatgt

SEQ ID NO: 2189216 - DNA, 21 bp, Homo sapiens
atgcactaatcaatactttga

SEQ ID NO: 2189217 - DNA, 12 bp, Homo sapiens
atgcagatgcca

SEQ ID NO: 2189218 - DNA, 11 bp, Homo sapiens
atgcagcagct

SEQ ID NO: 2189219 - DNA, 19 bp, Homo sapiens
atgcagcagcttgctgcac

SEQ ID NO: 2189220 - DNA, 17 bp, Homo sapiens
atgcagtgcctttcccc

SEQ ID NO: 2189221 - DNA, 15 bp, Homo sapiens
atgcatgctttggaa

SEQ ID NO: 2189222 - DNA, 16 bp, Homo sapiens
atgcatgctttggaaa

SEQ ID NO: 2189223 - DNA, 16 bp, Homo sapiens
atgcatttttttagtt

SEQ ID NO: 2189224 - DNA, 21 bp, Homo sapiens
atgccaagtaacaatgcatgc

SEQ ID NO: 2189225 - DNA, 17 bp, Homo sapiens
atgccaggacagctgca

SEQ ID NO: 2189226 - DNA, 16 bp, Homo sapiens
atgccataccttgaga

SEQ ID NO: 2189227 - DNA, 23 bp, Homo sapiens
atgccatttgcacttacacaaga

SEQ ID NO: 2189228 - DNA, 18 bp, Homo sapiens
atgcctccctgaccctgc

SEQ ID NO: 2189229 - DNA, 23 bp, Homo sapiens
atgcctcctctgtcctcattctt

SEQ ID NO: 2189230 - DNA, 14 bp, Homo sapiens
atgcggatcctgct

SEQ ID NO: 2189231 - DNA, 18 bp, Homo sapiens
atgctatctcgctagcca

SEQ ID NO: 2189232 - DNA, 21 bp, Homo sapiens
atgctatctcgctagccatat

SEQ ID NO: 2189233 - DNA, 15 bp, Homo sapiens
atgctcacctgacat

SEQ ID NO: 2189234 - DNA, 23 bp, Homo sapiens
atgctggacaggtctgggagagg

SEQ ID NO: 2189235 - DNA, 13 bp, Homo sapiens
atggaacctcctt

SEQ ID NO: 2189236 - DNA, 17 bp, Homo sapiens
atggaattttgcaaaga

SEQ ID NO: 2189237 - DNA, 19 bp, Homo sapiens
atggaattttgcaaagatt

SEQ ID NO: 2189238 - DNA, 18 bp, Homo sapiens
atggaggtgatgaaaacc

SEQ ID NO: 2189239 - DNA, 18 bp, Homo sapiens
atggagtagacccctggc

SEQ ID NO: 2189240 - DNA, 21 bp, Homo sapiens
atggagtagacccctggctgg

SEQ ID NO: 2189241 - DNA, 18 bp, Homo sapiens
atggatcccaattcattt

SEQ ID NO: 2189242 - DNA, 20 bp, Homo sapiens
atggatggggcccaggggct

SEQ ID NO: 2189243 - DNA, 15 bp, Homo sapiens
atggatgtttcttct

SEQ ID NO: 2189244 - DNA, 21 bp, Homo sapiens
atggcaggagaatcagcctgg

SEQ ID NO: 2189245 - DNA, 17 bp, Homo sapiens
atggcctccagaggagg

SEQ ID NO: 2189246 - DNA, 15 bp, Homo sapiens
atggctcaaggattc

SEQ ID NO: 2189247 - DNA, 16 bp, Homo sapiens
atggctcactgcagcc

SEQ ID NO: 2189248 - DNA, 19 bp, Homo sapiens
atggctcactgcagcctcg

SEQ ID NO: 2189249 - DNA, 16 bp, Homo sapiens
atggctcgtgggctct

SEQ ID NO: 2189250 - DNA, 17 bp, Homo sapiens
atggctcgtgggctctg

SEQ ID NO: 2189251 - DNA, 14 bp, Homo sapiens
atggctgtgaaaat

SEQ ID NO: 2189252 - DNA, 18 bp, Homo sapiens
atggctgtgaaaattaca

SEQ ID NO: 2189253 - DNA, 20 bp, Homo sapiens
atggctgtgaaaattacacc

SEQ ID NO: 2189254 - DNA, 19 bp, Homo sapiens
atgggactgatgtcatctt

SEQ ID NO: 2189255 - DNA, 14 bp, Homo sapiens
atggggacctgggg

SEQ ID NO: 2189256 - DNA, 12 bp, Homo sapiens
atggggccacag

SEQ ID NO: 2189257 - DNA, 22 bp, Homo sapiens
atgggggtgcaggcagccttga

SEQ ID NO: 2189258 - DNA, 22 bp, Homo sapiens
atgggtgttaacgtgcatgagg

SEQ ID NO: 2189259 - DNA, 15 bp, Homo sapiens
atggtagactgtgac

SEQ ID NO: 2189260 - DNA, 23 bp, Homo sapiens
atggtcctcacaagcctcttctg

SEQ ID NO: 2189261 - DNA, 14 bp, Homo sapiens
atggtgagaattaa

SEQ ID NO: 2189262 - DNA, 20 bp, Homo sapiens
cacaactaataggacctcaa

SEQ ID NO: 2189263 - DNA, 22 bp, Homo sapiens
cacaactccactgtctttaaaa

SEQ ID NO: 2189264 - DNA, 14 bp, Homo sapiens
cacaagaagtggga

SEQ ID NO: 2189265 - DNA, 22 bp, Homo sapiens
cacaagaagtgggagtgggaga

SEQ ID NO: 2189266 - DNA, 23 bp, Homo sapiens
cacaagaagtgggagtgggagag

SEQ ID NO: 2189267 - DNA, 18 bp, Homo sapiens
cacaagcctcttctgaag

SEQ ID NO: 2189268 - DNA, 12 bp, Homo sapiens
cacaagctgcct

SEQ ID NO: 2189269 - DNA, 15 bp, Homo sapiens
cacaaggtgggcagg

SEQ ID NO: 2189270 - DNA, 18 bp, Homo sapiens
cacaatctttccttgtct

SEQ ID NO: 2189271 - DNA, 12 bp, Homo sapiens
cacacaagcagt

SEQ ID NO: 2189272 - DNA, 11 bp, Homo sapiens
cacacacagct

SEQ ID NO: 2189273 - DNA, 12 bp, Homo sapiens
cacacacagctt

SEQ ID NO: 2189274 - DNA, 22 bp, Homo sapiens
cacacagcttttagtacccacc

SEQ ID NO: 2189275 - DNA, 13 bp, Homo sapiens
cacacccagcctc

SEQ ID NO: 2189276 - DNA, 23 bp, Homo sapiens
cacacccccaccccttgctctca

SEQ ID NO: 2189277 - DNA, 20 bp, Homo sapiens
cacacggttttggcagctga

SEQ ID NO: 2189278 - DNA, 18 bp, Homo sapiens
cacacgtgtgatgtatgt

SEQ ID NO: 2189279 - DNA, 18 bp, Homo sapiens
cacactgaaccgctacaa

SEQ ID NO: 2189280 - DNA, 17 bp, Homo sapiens
cacagacaagcagccct

SEQ ID NO: 2189281 - DNA, 16 bp, Homo sapiens
cacagacccctgggag

SEQ ID NO: 2189282 - DNA, 14 bp, Homo sapiens
cacagagacacagg

SEQ ID NO: 2189283 - DNA, 22 bp, Homo sapiens
cacagagcatccgtctcccctc

SEQ ID NO: 2189284 - DNA, 12 bp, Homo sapiens
cacagaggcagt

SEQ ID NO: 2189285 - DNA, 17 bp, Homo sapiens
cacagagggctgtgtct

SEQ ID NO: 2189286 - DNA, 21 bp, Homo sapiens
cacagcacctcctctctgctg

SEQ ID NO: 2189287 - DNA, 19 bp, Homo sapiens
cacagccagaaccccgagc

SEQ ID NO: 2189288 - DNA, 22 bp, Homo sapiens
cacagccatcccagccttggca

SEQ ID NO: 2189289 - DNA, 15 bp, Homo sapiens
cacagcccgcatgca

SEQ ID NO: 2189290 - DNA, 21 bp, Homo sapiens
cacagcccgcatgcagcagct

SEQ ID NO: 2189291 - DNA, 23 bp, Homo sapiens
cacagcccgcatgcagcagcttg

SEQ ID NO: 2189292 - DNA, 18 bp, Homo sapiens
cacagccggggcctgcct

SEQ ID NO: 2189293 - DNA, 20 bp, Homo sapiens
cacagccggggcctgcctag

SEQ ID NO: 2189294 - DNA, 22 bp, Homo sapiens
cacagccggggcctgcctagca

SEQ ID NO: 2189295 - DNA, 15 bp, Homo sapiens
cacagctcacggcag

SEQ ID NO: 2189296 - DNA, 21 bp, Homo sapiens
cacagcttttagtacccacct

SEQ ID NO: 2189297 - DNA, 22 bp, Homo sapiens
cacaggcaatgactgcgcagag

SEQ ID NO: 2189298 - DNA, 15 bp, Homo sapiens
cacagggcctgactt

SEQ ID NO: 2189299 - DNA, 14 bp, Homo sapiens
cacataatttgcat

SEQ ID NO: 2189300 - DNA, 12 bp, Homo sapiens
cacattaaagta

SEQ ID NO: 2189301 - DNA, 17 bp, Homo sapiens
caccaacataaaacaaa

SEQ ID NO: 2189302 - DNA, 18 bp, Homo sapiens
caccaagagtagcacctt

SEQ ID NO: 2189303 - DNA, 16 bp, Homo sapiens
caccaccccccactct

SEQ ID NO: 2189304 - DNA, 18 bp, Homo sapiens
caccaccccccactctgt

SEQ ID NO: 2189305 - DNA, 22 bp, Homo sapiens
caccagctgttctgtcccttgg

SEQ ID NO: 2189306 - DNA, 13 bp, Homo sapiens
caccaggaagccg

SEQ ID NO: 2189307 - DNA, 21 bp, Homo sapiens
caccaggacttaagacaaatg

SEQ ID NO: 2189308 - DNA, 13 bp, Homo sapiens
caccagggaagat

SEQ ID NO: 2189309 - DNA, 15 bp, Homo sapiens
caccaggggaggagc

SEQ ID NO: 2189310 - DNA, 16 bp, Homo sapiens
cacccatgcacagaac

SEQ ID NO: 2189311 - DNA, 14 bp, Homo sapiens
caccccactcacag

SEQ ID NO: 2189312 - DNA, 16 bp, Homo sapiens
caccccccactctgtg

SEQ ID NO: 2189313 - DNA, 17 bp, Homo sapiens
caccccgggctctcctg

SEQ ID NO: 2189314 - DNA, 14 bp, Homo sapiens
cacccctccttccc

SEQ ID NO: 2189315 - DNA, 15 bp, Homo sapiens
cacccctccttccct

SEQ ID NO: 2189316 - DNA, 19 bp, Homo sapiens
cacccctccttccctggtc

SEQ ID NO: 2189317 - DNA, 20 bp, Homo sapiens
cacccctccttccctggtcc

SEQ ID NO: 2189318 - DNA, 20 bp, Homo sapiens
cacccctgtctgcgccgctg

SEQ ID NO: 2189319 - DNA, 19 bp, Homo sapiens
caccccttgctctcaaccc

SEQ ID NO: 2189320 - DNA, 19 bp, Homo sapiens
caccccttggaggagagag

SEQ ID NO: 2189321 - DNA, 21 bp, Homo sapiens
cacccgccttggcctcccaaa

SEQ ID NO: 2189322 - DNA, 20 bp, Homo sapiens
cacccgtcttcaatctctgt

SEQ ID NO: 2189323 - DNA, 21 bp, Homo sapiens
cacccgtcttcaatctctgtt

SEQ ID NO: 2189324 - DNA, 16 bp, Homo sapiens
cacccgtttccaagcc

SEQ ID NO: 2189325 - DNA, 19 bp, Homo sapiens
cacccgtttccaagcctgg

SEQ ID NO: 2189326 - DNA, 22 bp, Homo sapiens
cacccgtttccaagcctgggcc

SEQ ID NO: 2189327 - DNA, 15 bp, Homo sapiens
caccctcagctggcg

SEQ ID NO: 2189328 - DNA, 13 bp, Homo sapiens
caccctctgcagg

SEQ ID NO: 2189329 - DNA, 15 bp, Homo sapiens
caccctctgcagggc

SEQ ID NO: 2189330 - DNA, 20 bp, Homo sapiens
caccctctgcagggcagcct

SEQ ID NO: 2189331 - DNA, 22 bp, Homo sapiens
caccctgccccccctaagagac

SEQ ID NO: 2189332 - DNA, 22 bp, Homo sapiens
caccgagaggaaaaaggcttct

SEQ ID NO: 2189333 - DNA, 11 bp, Homo sapiens
cacctaagtga

SEQ ID NO: 2189334 - DNA, 12 bp, Homo sapiens
cacctaagtgac

SEQ ID NO: 2189335 - DNA, 15 bp, Homo sapiens
cacctcagagccccg

SEQ ID NO: 2189336 - DNA, 15 bp, Homo sapiens
cacctcctctctgct

SEQ ID NO: 2189337 - DNA, 18 bp, Homo sapiens
cacctctggccctgttgt

SEQ ID NO: 2189338 - DNA, 14 bp, Homo sapiens
cacctcttttccta

SEQ ID NO: 2189339 - DNA, 14 bp, Homo sapiens
cacctgagctttgg

SEQ ID NO: 2189340 - DNA, 16 bp, Homo sapiens
cacctgcacagggccc

SEQ ID NO: 2189341 - DNA, 17 bp, Homo sapiens
cacctgcagcgtctgag

SEQ ID NO: 2189342 - DNA, 18 bp, Homo sapiens
cacctgcagcgtctgagc

SEQ ID NO: 2189343 - DNA, 14 bp, Homo sapiens
cacctgcatcagcc

SEQ ID NO: 2189344 - DNA, 21 bp, Homo sapiens
cacctgccactaggctgggtg

SEQ ID NO: 2189345 - DNA, 18 bp, Homo sapiens
cacctgccccgtagagaa

SEQ ID NO: 2189346 - DNA, 20 bp, Homo sapiens
caccttaccctactggctgt

SEQ ID NO: 2189347 - DNA, 23 bp, Homo sapiens
caccttaccctactggctgtaaa

SEQ ID NO: 2189348 - DNA, 21 bp, Homo sapiens
cacgaattttaaaacatggca

SEQ ID NO: 2189349 - DNA, 11 bp, Homo sapiens
cacggcacaga

SEQ ID NO: 2189350 - DNA, 16 bp, Homo sapiens
cacggcagcctcaacc

SEQ ID NO: 2189351 - DNA, 14 bp, Homo sapiens
cacggcctggctgg

SEQ ID NO: 2189352 - DNA, 23 bp, Homo sapiens
cacgggaggaatcttttactgtg

SEQ ID NO: 2189353 - DNA, 21 bp, Homo sapiens
cacgggggaggccgaggcagg

SEQ ID NO: 2189354 - DNA, 22 bp, Homo sapiens
cacgggggaggccgaggcaggg

SEQ ID NO: 2189355 - DNA, 15 bp, Homo sapiens
cacgtgctggagagt

SEQ ID NO: 2189356 - DNA, 13 bp, Homo sapiens
cactaatcaatac

SEQ ID NO: 2189357 - DNA, 14 bp, Homo sapiens
cactaatcaatact

SEQ ID NO: 2189358 - DNA, 23 bp, Homo sapiens
cactaattgtaaggtattgcaag

SEQ ID NO: 2189359 - DNA, 16 bp, Homo sapiens
cactacagaggattct

SEQ ID NO: 2189360 - DNA, 23 bp, Homo sapiens
cactaggctgggtgcccacagcc

SEQ ID NO: 2189361 - DNA, 15 bp, Homo sapiens
cactatggtgccaat

SEQ ID NO: 2189362 - DNA, 22 bp, Homo sapiens
cactcaagcaacaagcctcaaa

SEQ ID NO: 2189363 - DNA, 23 bp, Homo sapiens
cactcagcatttcggtgcttccc

SEQ ID NO: 2189364 - DNA, 17 bp, Homo sapiens
cactcagctatacctca

SEQ ID NO: 2189365 - DNA, 17 bp, Homo sapiens
cactcattgaaatgtaa

SEQ ID NO: 2189366 - DNA, 16 bp, Homo sapiens
cactcatttatttcca

SEQ ID NO: 2189367 - DNA, 23 bp, Homo sapiens
cactccggattccggccctggct

SEQ ID NO: 2189368 - DNA, 24 bp, Homo sapiens
cactccggattccggccctggctg

SEQ ID NO: 2189369 - DNA, 13 bp, Homo sapiens
cactccttgtccc

SEQ ID NO: 2189370 - DNA, 14 bp, Homo sapiens
cactccttgtcccc

SEQ ID NO: 2189371 - DNA, 12 bp, Homo sapiens
cactctcccaga

SEQ ID NO: 2189372 - DNA, 24 bp, Homo sapiens
cactctcccagaggctcctggagc

SEQ ID NO: 2189373 - DNA, 19 bp, Homo sapiens
cactctgagtgaatacttt

SEQ ID NO: 2189374 - DNA, 17 bp, Homo sapiens
cactcttcagtgactcc

SEQ ID NO: 2189375 - DNA, 22 bp, Homo sapiens
cactgaaccgctacaagagggc

SEQ ID NO: 2189376 - DNA, 18 bp, Homo sapiens
cactgcaaataaagcctt

SEQ ID NO: 2189377 - DNA, 19 bp, Homo sapiens
cactgcaaataaagccttt

SEQ ID NO: 2189378 - DNA, 16 bp, Homo sapiens
cactgcacataatttg

SEQ ID NO: 2189379 - DNA, 13 bp, Homo sapiens
cactgcagcctcg

SEQ ID NO: 2189380 - DNA, 14 bp, Homo sapiens
cactgcagcctcga

SEQ ID NO: 2189381 - DNA, 22 bp, Homo sapiens
cactgcagtcacccctgtctgc

SEQ ID NO: 2189382 - DNA, 20 bp, Homo sapiens
cactgccagaagtgtgtttt

SEQ ID NO: 2189383 - DNA, 20 bp, Homo sapiens
catgtaggttgtctaaaaat

SEQ ID NO: 2189384 - DNA, 21 bp, Homo sapiens
catgtcatgtaggttgtctaa

SEQ ID NO: 2189385 - DNA, 16 bp, Homo sapiens
catgttaatcctagct

SEQ ID NO: 2189386 - DNA, 21 bp, Homo sapiens
catgttagttttgctccttct

SEQ ID NO: 2189387 - DNA, 14 bp, Homo sapiens
catgttgctcagaa

SEQ ID NO: 2189388 - DNA, 14 bp, Homo sapiens
cattaaatgctttg

SEQ ID NO: 2189389 - DNA, 15 bp, Homo sapiens
cattaatttctctca

SEQ ID NO: 2189390 - DNA, 13 bp, Homo sapiens
cattactctgcac

SEQ ID NO: 2189391 - DNA, 14 bp, Homo sapiens
cattactctgcact

SEQ ID NO: 2189392 - DNA, 23 bp, Homo sapiens
cattactctgcactatagccatt

SEQ ID NO: 2189393 - DNA, 21 bp, Homo sapiens
cattactttaccacccccaca

SEQ ID NO: 2189394 - DNA, 17 bp, Homo sapiens
cattagcaacgcctgcc

SEQ ID NO: 2189395 - DNA, 18 bp, Homo sapiens
cattagcaacgcctgcct

SEQ ID NO: 2189396 - DNA, 16 bp, Homo sapiens
cattagtaaaacacaa

SEQ ID NO: 2189397 - DNA, 14 bp, Homo sapiens
cattataaaagatc

SEQ ID NO: 2189398 - DNA, 22 bp, Homo sapiens
cattataattttgaccataaat

SEQ ID NO: 2189399 - DNA, 16 bp, Homo sapiens
cattattttttgttga

SEQ ID NO: 2189400 - DNA, 20 bp, Homo sapiens
cattcaaaaacatggccaca

SEQ ID NO: 2189401 - DNA, 15 bp, Homo sapiens
cattcagctctggag

SEQ ID NO: 2189402 - DNA, 20 bp, Homo sapiens
cattcagtgagacacagagt

SEQ ID NO: 2189403 - DNA, 12 bp, Homo sapiens
cattccatttgc

SEQ ID NO: 2189404 - DNA, 24 bp, Homo sapiens
cattcctgatggaattgttatact

SEQ ID NO: 2189405 - DNA, 23 bp, Homo sapiens
cattcgcagcagctccgcctggc

SEQ ID NO: 2189406 - DNA, 15 bp, Homo sapiens
cattctaaaccaaaa

SEQ ID NO: 2189407 - DNA, 19 bp, Homo sapiens
cattctaaaccaaaacaga

SEQ ID NO: 2189408 - DNA, 15 bp, Homo sapiens
cattctgagcagggg

SEQ ID NO: 2189409 - DNA, 21 bp, Homo sapiens
cattctggatgggcttggcca

SEQ ID NO: 2189410 - DNA, 14 bp, Homo sapiens
cattctgtcatcac

SEQ ID NO: 2189411 - DNA, 18 bp, Homo sapiens
cattgaagtgtttaaaag

SEQ ID NO: 2189412 - DNA, 22 bp, Homo sapiens
cattgctgtgaattagctcact

SEQ ID NO: 2189413 - DNA, 14 bp, Homo sapiens
cattggcctctgtc

SEQ ID NO: 2189414 - DNA, 13 bp, Homo sapiens
cattgtgtgtcac

SEQ ID NO: 2189415 - DNA, 20 bp, Homo sapiens
catttaatgtagccatggga

SEQ ID NO: 2189416 - DNA, 21 bp, Homo sapiens
catttagcttgttccactgca

SEQ ID NO: 2189417 - DNA, 21 bp, Homo sapiens
catttatttccatattaaaat

SEQ ID NO: 2189418 - DNA, 13 bp, Homo sapiens
catttattttgac

SEQ ID NO: 2189419 - DNA, 13 bp, Homo sapiens
catttcagaagtt

SEQ ID NO: 2189420 - DNA, 14 bp, Homo sapiens
catttcttcccaag

SEQ ID NO: 2189421 - DNA, 15 bp, Homo sapiens
catttgcagctgctg

SEQ ID NO: 2189422 - DNA, 16 bp, Homo sapiens
catttgcagctgctgg

SEQ ID NO: 2189423 - DNA, 17 bp, Homo sapiens
catttgcagctgctggt

SEQ ID NO: 2189424 - DNA, 18 bp, Homo sapiens
catttgcagctgctggtt

SEQ ID NO: 2189425 - DNA, 17 bp, Homo sapiens
catttgccaactaattt

SEQ ID NO: 2189426 - DNA, 23 bp, Homo sapiens
catttgtaatttttttctagttg

SEQ ID NO: 2189427 - DNA, 19 bp, Homo sapiens
catttgtcctgcagagctg

SEQ ID NO: 2189428 - DNA, 12 bp, Homo sapiens
cattttaacttg

SEQ ID NO: 2189429 - DNA, 19 bp, Homo sapiens
cattttaacttgccacatc

SEQ ID NO: 2189430 - DNA, 22 bp, Homo sapiens
cattttaagtggagacatattt

SEQ ID NO: 2189431 - DNA, 17 bp, Homo sapiens
cattttacgttttagaa

SEQ ID NO: 2189432 - DNA, 16 bp, Homo sapiens
cattttcacttttaaa

SEQ ID NO: 2189433 - DNA, 16 bp, Homo sapiens
cattttgcgatgtgtt

SEQ ID NO: 2189434 - DNA, 17 bp, Homo sapiens
cattttgcgatgtgttt

SEQ ID NO: 2189435 - DNA, 18 bp, Homo sapiens
cattttgcgatgtgtttt

SEQ ID NO: 2189436 - DNA, 16 bp, Homo sapiens
cattttgtatgtatgt

SEQ ID NO: 2189437 - DNA, 18 bp, Homo sapiens
cattttgtatgtatgtgt

SEQ ID NO: 2189438 - DNA, 19 bp, Homo sapiens
cattttgtatgtatgtgta

SEQ ID NO: 2189439 - DNA, 11 bp, Homo sapiens
cattttgtgtc

SEQ ID NO: 2189440 - DNA, 22 bp, Homo sapiens
cattttgtgtcttaagaaaaat

SEQ ID NO: 2189441 - DNA, 13 bp, Homo sapiens
catttttcaataa

SEQ ID NO: 2189442 - DNA, 23 bp, Homo sapiens
catttttgtttctacctcccaga

SEQ ID NO: 2189443 - DNA, 22 bp, Homo sapiens
catttttgtttttggtttctta

SEQ ID NO: 2189444 - DNA, 20 bp, Homo sapiens
ccaaaaacaaagtgcaaagc

SEQ ID NO: 2189445 - DNA, 22 bp, Homo sapiens
ccaaaaacaaagtgcaaagctg

SEQ ID NO: 2189446 - DNA, 16 bp, Homo sapiens
ccaaaatccccttctc

SEQ ID NO: 2189447 - DNA, 16 bp, Homo sapiens
ccaaacccatcttcat

SEQ ID NO: 2189448 - DNA, 16 bp, Homo sapiens
ccaaagagctgcctaa

SEQ ID NO: 2189449 - DNA, 19 bp, Homo sapiens
ccaaaggaagtagcaggcc

SEQ ID NO: 2189450 - DNA, 14 bp, Homo sapiens
ccaaattgatgggt

SEQ ID NO: 2189451 - DNA, 20 bp, Homo sapiens
ccaacacaaggtgggcaggg

SEQ ID NO: 2189452 - DNA, 21 bp, Homo sapiens
ccaacacaatctttccttgtc

SEQ ID NO: 2189453 - DNA, 18 bp, Homo sapiens
ccaacaggcacctctaat

SEQ ID NO: 2189454 - DNA, 22 bp, Homo sapiens
ccaacaggcacctctaatcaga

SEQ ID NO: 2189455 - DNA, 23 bp, Homo sapiens
ccaacataaaacaaaaccaagcc

SEQ ID NO: 2189456 - DNA, 15 bp, Homo sapiens
ccaacatttcctcag

SEQ ID NO: 2189457 - DNA, 23 bp, Homo sapiens
ccaaccacctctggccctgttgt

SEQ ID NO: 2189458 - DNA, 13 bp, Homo sapiens
ccaactccttcct

SEQ ID NO: 2189459 - DNA, 14 bp, Homo sapiens
ccaactgctgcccc

SEQ ID NO: 2189460 - DNA, 16 bp, Homo sapiens
ccaagaactctgggca

SEQ ID NO: 2189461 - DNA, 14 bp, Homo sapiens
ccaagccagattct

SEQ ID NO: 2189462 - DNA, 22 bp, Homo sapiens
ccaagccagggatggggccaca

SEQ ID NO: 2189463 - DNA, 22 bp, Homo sapiens
ccaagcccacaggtgtccccag

SEQ ID NO: 2189464 - DNA, 15 bp, Homo sapiens
ccaagcctggtctcc

SEQ ID NO: 2189465 - DNA, 12 bp, Homo sapiens
ccaagccttggc

SEQ ID NO: 2189466 - DNA, 16 bp, Homo sapiens
ccaagctgtatgtact

SEQ ID NO: 2189467 - DNA, 22 bp, Homo sapiens
ccaagctgtatgtacttccagt

SEQ ID NO: 2189468 - DNA, 21 bp, Homo sapiens
ccaaggcaaggggtgcctggg

SEQ ID NO: 2189469 - DNA, 17 bp, Homo sapiens
ccaaggccgcccacctg

SEQ ID NO: 2189470 - DNA, 22 bp, Homo sapiens
ccaagggccctggcacccccac

SEQ ID NO: 2189471 - DNA, 16 bp, Homo sapiens
ccaagtcatttttgtt

SEQ ID NO: 2189472 - DNA, 18 bp, Homo sapiens
ccaagtctctgggcccca

SEQ ID NO: 2189473 - DNA, 14 bp, Homo sapiens
ccaagtcttcctga

SEQ ID NO: 2189474 - DNA, 13 bp, Homo sapiens
ccaagtgtttctt

SEQ ID NO: 2189475 - DNA, 16 bp, Homo sapiens
ccaatatttataatta

SEQ ID NO: 2189476 - DNA, 19 bp, Homo sapiens
ccaatatttataattaaag

SEQ ID NO: 2189477 - DNA, 22 bp, Homo sapiens
ccaatatttataattaaagaaa

SEQ ID NO: 2189478 - DNA, 23 bp, Homo sapiens
ccaatatttataattaaagaaaa

SEQ ID NO: 2189479 - DNA, 17 bp, Homo sapiens
ccaatggaacctccttt

SEQ ID NO: 2189480 - DNA, 18 bp, Homo sapiens
ccaatggaacctcctttc

SEQ ID NO: 2189481 - DNA, 19 bp, Homo sapiens
ccaatggaacctcctttct

SEQ ID NO: 2189482 - DNA, 20 bp, Homo sapiens
ccaatggagtagacccctgg

SEQ ID NO: 2189483 - DNA, 14 bp, Homo sapiens
ccaatgtgaagaca

SEQ ID NO: 2189484 - DNA, 14 bp, Homo sapiens
ccaatgtgcccagt

SEQ ID NO: 2189485 - DNA, 14 bp, Homo sapiens
ccacaaaaataaaa

SEQ ID NO: 2189486 - DNA, 15 bp, Homo sapiens
ccacaagagagatga

SEQ ID NO: 2189487 - DNA, 15 bp, Homo sapiens
ccacaagctgtccct

SEQ ID NO: 2189488 - DNA, 17 bp, Homo sapiens
ccacaagctgtccctgc

SEQ ID NO: 2189489 - DNA, 22 bp, Homo sapiens
ccacaagctgtccctgcagggc

SEQ ID NO: 2189490 - DNA, 17 bp, Homo sapiens
ccacacaacaccaggac

SEQ ID NO: 2189491 - DNA, 15 bp, Homo sapiens
ccacacccagcctct

SEQ ID NO: 2189492 - DNA, 14 bp, Homo sapiens
ccacagacccctgg

SEQ ID NO: 2189493 - DNA, 18 bp, Homo sapiens
ccacagagggctgtgtct

SEQ ID NO: 2189494 - DNA, 19 bp, Homo sapiens
ccacagcttggggccatcg

SEQ ID NO: 2189495 - DNA, 18 bp, Homo sapiens
ccacaggattccagttgc

SEQ ID NO: 2189496 - DNA, 15 bp, Homo sapiens
ccacagggcctgact

SEQ ID NO: 2189497 - DNA, 18 bp, Homo sapiens
ccacatccaacatttcct

SEQ ID NO: 2189498 - DNA, 19 bp, Homo sapiens
ccacatcccagtcacagtg

SEQ ID NO: 2189499 - DNA, 14 bp, Homo sapiens
ccaccaaagtcctg

SEQ ID NO: 2189500 - DNA, 14 bp, Homo sapiens
ccaccacacccagc

SEQ ID NO: 2189501 - DNA, 22 bp, Homo sapiens
ccaccatggctaaggcaccagc

SEQ ID NO: 2189502 - DNA, 14 bp, Homo sapiens
ccacccccacacct

SEQ ID NO: 2189503 - DNA, 18 bp, Homo sapiens
ccaccccgggctctcctg

SEQ ID NO: 2189504 - DNA, 20 bp, Homo sapiens
ccaccccgggctctcctgcc

SEQ ID NO: 2189505 - DNA, 14 bp, Homo sapiens
cgaggctgggccaa

SEQ ID NO: 2189506 - DNA, 18 bp, Homo sapiens
cgaggctgggccaagcca

SEQ ID NO: 2189507 - DNA, 15 bp, Homo sapiens
cgaggggcagggaag

SEQ ID NO: 2189508 - DNA, 19 bp, Homo sapiens
cgagtagttgggattacag

SEQ ID NO: 2189509 - DNA, 23 bp, Homo sapiens
cgagtggatagatgccctgctag

SEQ ID NO: 2189510 - DNA, 19 bp, Homo sapiens
cgatcatggctcactgcag

SEQ ID NO: 2189511 - DNA, 18 bp, Homo sapiens
cgatccctcccctcagcc

SEQ ID NO: 2189512 - DNA, 22 bp, Homo sapiens
cgatccctcccctcagcctcct

SEQ ID NO: 2189513 - DNA, 21 bp, Homo sapiens
cgatgtcaaccttgtgtgagt

SEQ ID NO: 2189514 - DNA, 13 bp, Homo sapiens
cgatgtgttttat

SEQ ID NO: 2189515 - DNA, 19 bp, Homo sapiens
cgcaaacctctccttcctc

SEQ ID NO: 2189516 - DNA, 12 bp, Homo sapiens
cgcacacagctt

SEQ ID NO: 2189517 - DNA, 20 bp, Homo sapiens
cgcagagactggggcctgga

SEQ ID NO: 2189518 - DNA, 14 bp, Homo sapiens
cgcagggccctctg

SEQ ID NO: 2189519 - DNA, 13 bp, Homo sapiens
cgcatgcagcagc

SEQ ID NO: 2189520 - DNA, 14 bp, Homo sapiens
cgcatgcagcagct

SEQ ID NO: 2189521 - DNA, 14 bp, Homo sapiens
cgccacggcctggc

SEQ ID NO: 2189522 - DNA, 12 bp, Homo sapiens
cgcccacctgca

SEQ ID NO: 2189523 - DNA, 13 bp, Homo sapiens
cgccctcttcccc

SEQ ID NO: 2189524 - DNA, 14 bp, Homo sapiens
cgcccttcctgtgc

SEQ ID NO: 2189525 - DNA, 17 bp, Homo sapiens
cgcctcttgaccaggct

SEQ ID NO: 2189526 - DNA, 15 bp, Homo sapiens
cgcctgccttctggg

SEQ ID NO: 2189527 - DNA, 16 bp, Homo sapiens
cgcctgccttctgggc

SEQ ID NO: 2189528 - DNA, 15 bp, Homo sapiens
cgcctggcacccact

SEQ ID NO: 2189529 - DNA, 15 bp, Homo sapiens
cgccttggcctccca

SEQ ID NO: 2189530 - DNA, 16 bp, Homo sapiens
cgcgtgcgaccagagg

SEQ ID NO: 2189531 - DNA, 22 bp, Homo sapiens
cgctacaagagggcaaagctga

SEQ ID NO: 2189532 - DNA, 20 bp, Homo sapiens
cgctcatgggcccctctgac

SEQ ID NO: 2189533 - DNA, 22 bp, Homo sapiens
cgctcatgggcccctctgactc

SEQ ID NO: 2189534 - DNA, 17 bp, Homo sapiens
cgctgatattaagtaat

SEQ ID NO: 2189535 - DNA, 21 bp, Homo sapiens
cgctgccatttccctgaacag

SEQ ID NO: 2189536 - DNA, 14 bp, Homo sapiens
cgctgggagagcca

SEQ ID NO: 2189537 - DNA, 22 bp, Homo sapiens
cgcttcaaggatatactgcagc

SEQ ID NO: 2189538 - DNA, 12 bp, Homo sapiens
cgcttctctgtg

SEQ ID NO: 2189539 - DNA, 14 bp, Homo sapiens
cgctttgaaagaag

SEQ ID NO: 2189540 - DNA, 16 bp, Homo sapiens
cgctttgaaagaagca

SEQ ID NO: 2189541 - DNA, 11 bp, Homo sapiens
cggaattccaa

SEQ ID NO: 2189542 - DNA, 19 bp, Homo sapiens
cggagaacatctgccttgc

SEQ ID NO: 2189543 - DNA, 12 bp, Homo sapiens
cggagctcctgt

SEQ ID NO: 2189544 - DNA, 15 bp, Homo sapiens
cggaggggatccagc

SEQ ID NO: 2189545 - DNA, 13 bp, Homo sapiens
cggatcctgctgg

SEQ ID NO: 2189546 - DNA, 14 bp, Homo sapiens
cggatcctgctggg

SEQ ID NO: 2189547 - DNA, 17 bp, Homo sapiens
cggattccggccctggc

SEQ ID NO: 2189548 - DNA, 19 bp, Homo sapiens
cggattccggccctggctg

SEQ ID NO: 2189549 - DNA, 11 bp, Homo sapiens
cggcacagagc

SEQ ID NO: 2189550 - DNA, 21 bp, Homo sapiens
cggcagcctcaacctccctgg

SEQ ID NO: 2189551 - DNA, 22 bp, Homo sapiens
cggcagcctcaacctccctggc

SEQ ID NO: 2189552 - DNA, 15 bp, Homo sapiens
cggcagcgggcggag

SEQ ID NO: 2189553 - DNA, 14 bp, Homo sapiens
cggccaaggtgcca

SEQ ID NO: 2189554 - DNA, 13 bp, Homo sapiens
cggccactgcagt

SEQ ID NO: 2189555 - DNA, 14 bp, Homo sapiens
cggccactgcagtc

SEQ ID NO: 2189556 - DNA, 18 bp, Homo sapiens
cggcccccgccctctgcc

SEQ ID NO: 2189557 - DNA, 21 bp, Homo sapiens
cggcccccgccctctgccccc

SEQ ID NO: 2189558 - DNA, 22 bp, Homo sapiens
cggccctggctggggacttggc

SEQ ID NO: 2189559 - DNA, 14 bp, Homo sapiens
cggccgcctgtcct

SEQ ID NO: 2189560 - DNA, 15 bp, Homo sapiens
cggccgcctgtcctt

SEQ ID NO: 2189561 - DNA, 20 bp, Homo sapiens
cggctcgtgtatttattacc

SEQ ID NO: 2189562 - DNA, 23 bp, Homo sapiens
cggctgcaccctgtatggagcta

SEQ ID NO: 2189563 - DNA, 18 bp, Homo sapiens
cggctgctggcacagact

SEQ ID NO: 2189564 - DNA, 20 bp, Homo sapiens
cgggaggccacgggggaggc

SEQ ID NO: 2189565 - DNA, 23 bp, Homo sapiens
cgggcaggtgaccgcccgcctct

SEQ ID NO: 2189566 - DNA, 23 bp, Homo sapiens
cgggcggaggggatccagccact

SEQ ID NO: 2189567 - DNA, 13 bp, Homo sapiens
cgggctggagaaa

SEQ ID NO: 2189568 - DNA, 19 bp, Homo sapiens
cggggagtgagactcctga

SEQ ID NO: 2189569 - DNA, 13 bp, Homo sapiens
cggggccagaggc

SEQ ID NO: 2189570 - DNA, 15 bp, Homo sapiens
cggggcctgcctagc

SEQ ID NO: 2189571 - DNA, 16 bp, Homo sapiens
cggggcctgcctagca

SEQ ID NO: 2189572 - DNA, 12 bp, Homo sapiens
cggggctcagcc

SEQ ID NO: 2189573 - DNA, 13 bp, Homo sapiens
cggggctcagccc

SEQ ID NO: 2189574 - DNA, 19 bp, Homo sapiens
cgggggaggccgaggcagg

SEQ ID NO: 2189575 - DNA, 19 bp, Homo sapiens
cgggttggaggcctcaccc

SEQ ID NO: 2189576 - DNA, 22 bp, Homo sapiens
cgggttggaggcctcaccctgc

SEQ ID NO: 2189577 - DNA, 19 bp, Homo sapiens
cggtcaataattgtggaga

SEQ ID NO: 2189578 - DNA, 21 bp, Homo sapiens
cggtgcagcggtggaaggagc

SEQ ID NO: 2189579 - DNA, 16 bp, Homo sapiens
cggtggaaggagcctg

SEQ ID NO: 2189580 - DNA, 19 bp, Homo sapiens
cggtggaaggagcctgcgg

SEQ ID NO: 2189581 - DNA, 17 bp, Homo sapiens
cggttcaggtcagggct

SEQ ID NO: 2189582 - DNA, 15 bp, Homo sapiens
cggttgtaaatacaa

SEQ ID NO: 2189583 - DNA, 14 bp, Homo sapiens
cggtttgggagaga

SEQ ID NO: 2189584 - DNA, 17 bp, Homo sapiens
cggttttggcagctgac

SEQ ID NO: 2189585 - DNA, 19 bp, Homo sapiens
cgtatgcatttttttagtt

SEQ ID NO: 2189586 - DNA, 20 bp, Homo sapiens
cgtattgtgaaatttgttaa

SEQ ID NO: 2189587 - DNA, 15 bp, Homo sapiens
cgtcacactcttcag

SEQ ID NO: 2189588 - DNA, 13 bp, Homo sapiens
cgtctgagcggcc

SEQ ID NO: 2189589 - DNA, 23 bp, Homo sapiens
cgtctgagcggccgcctgtcctt

SEQ ID NO: 2189590 - DNA, 18 bp, Homo sapiens
cgtctgctcctccctccc

SEQ ID NO: 2189591 - DNA, 19 bp, Homo sapiens
cgtcttcaatctctgttct

SEQ ID NO: 2189592 - DNA, 16 bp, Homo sapiens
cgtgaagagcagtgag

SEQ ID NO: 2189593 - DNA, 14 bp, Homo sapiens
cgtgagagaaagag

SEQ ID NO: 2189594 - DNA, 23 bp, Homo sapiens
cgtgagagaaagagagaagccag

SEQ ID NO: 2189595 - DNA, 14 bp, Homo sapiens
cgtgagagcccaat

SEQ ID NO: 2189596 - DNA, 21 bp, Homo sapiens
cgtgagagcccaatcactgcc

SEQ ID NO: 2189597 - DNA, 19 bp, Homo sapiens
cgtgaggggcaagctaggc

SEQ ID NO: 2189598 - DNA, 15 bp, Homo sapiens
cgtgatctcccctca

SEQ ID NO: 2189599 - DNA, 14 bp, Homo sapiens
cgtgggctctggct

SEQ ID NO: 2189600 - DNA, 15 bp, Homo sapiens
cgtgggctctggctc

SEQ ID NO: 2189601 - DNA, 17 bp, Homo sapiens
cgtgggctctggctccc

SEQ ID NO: 2189602 - DNA, 16 bp, Homo sapiens
cgtggggggagctctg

SEQ ID NO: 2189603 - DNA, 17 bp, Homo sapiens
cgtgtatttattaccgt

SEQ ID NO: 2189604 - DNA, 21 bp, Homo sapiens
cgtgttctctccccttgcact

SEQ ID NO: 2189605 - DNA, 18 bp, Homo sapiens
cgttcctgggactgtcag

SEQ ID NO: 2189606 - DNA, 20 bp, Homo sapiens
cgttgaatgagtgtgttttg

SEQ ID NO: 2189607 - DNA, 20 bp, Homo sapiens
cgttggtgaccagtttctta

SEQ ID NO: 2189608 - DNA, 19 bp, Homo sapiens
cgtttgatttcaaagcaag

SEQ ID NO: 2189609 - DNA, 20 bp, Homo sapiens
ctaaaaataaaatgcattta

SEQ ID NO: 2189610 - DNA, 15 bp, Homo sapiens
ctaaaaatcaatcac

SEQ ID NO: 2189611 - DNA, 17 bp, Homo sapiens
ctaaaatacttgagaaa

SEQ ID NO: 2189612 - DNA, 12 bp, Homo sapiens
ctaaaatcaagt

SEQ ID NO: 2189613 - DNA, 16 bp, Homo sapiens
ctaaaatcaagtgcac

SEQ ID NO: 2189614 - DNA, 23 bp, Homo sapiens
ctaaaatttgccctcccatcccg

SEQ ID NO: 2189615 - DNA, 14 bp, Homo sapiens
ctaaagaggaagcc

SEQ ID NO: 2189616 - DNA, 12 bp, Homo sapiens
ctaaagccagca

SEQ ID NO: 2189617 - DNA, 15 bp, Homo sapiens
ctaaagtgagctcta

SEQ ID NO: 2189618 - DNA, 15 bp, Homo sapiens
ctaaatactgtacat

SEQ ID NO: 2189619 - DNA, 16 bp, Homo sapiens
ctaaatactgtacata

SEQ ID NO: 2189620 - DNA, 23 bp, Homo sapiens
ctaaatcctcactatttttttgt

SEQ ID NO: 2189621 - DNA, 20 bp, Homo sapiens
ctaacaggggctggtgggca

SEQ ID NO: 2189622 - DNA, 19 bp, Homo sapiens
ctaaccagttctctttgta

SEQ ID NO: 2189623 - DNA, 17 bp, Homo sapiens
ctaactcatactgtgct

SEQ ID NO: 2189624 - DNA, 16 bp, Homo sapiens
ctaactctgcccaccc

SEQ ID NO: 2189625 - DNA, 14 bp, Homo sapiens
ctaactgagctgcc

SEQ ID NO: 2189626 - DNA, 16 bp, Homo sapiens
ctaactgagctgccag

SEQ ID NO: 2189627 - DNA, 23 bp, Homo sapiens
ctaaggaagatcactttgctctg

SEQ ID NO: 2189628 - DNA, 17 bp, Homo sapiens
ctggccgggcacagctg

SEQ ID NO: 2189629 - DNA, 21 bp, Homo sapiens
ctggccgggttggaggcctca

SEQ ID NO: 2189630 - DNA, 18 bp, Homo sapiens
ctggcctcacctgggttc

SEQ ID NO: 2189631 - DNA, 14 bp, Homo sapiens
ctggcctctgcttt

SEQ ID NO: 2189632 - DNA, 14 bp, Homo sapiens
ctggcctcttcctc

SEQ ID NO: 2189633 - DNA, 16 bp, Homo sapiens
ctggcgtcacctgtgc

SEQ ID NO: 2189634 - DNA, 20 bp, Homo sapiens
ctggcgtggggggagctctg

SEQ ID NO: 2189635 - DNA, 12 bp, Homo sapiens
ctggctcacaga

SEQ ID NO: 2189636 - DNA, 19 bp, Homo sapiens
ctggctcacagactggaga

SEQ ID NO: 2189637 - DNA, 16 bp, Homo sapiens
ctggctccgctgtgtg

SEQ ID NO: 2189638 - DNA, 15 bp, Homo sapiens
ctggctgcctggccc

SEQ ID NO: 2189639 - DNA, 18 bp, Homo sapiens
ctggctgcgaactgtgca

SEQ ID NO: 2189640 - DNA, 20 bp, Homo sapiens
ctggctggggacttggccgc

SEQ ID NO: 2189641 - DNA, 16 bp, Homo sapiens
ctggctgggggcctca

SEQ ID NO: 2189642 - DNA, 12 bp, Homo sapiens
ctggctgtttga

SEQ ID NO: 2189643 - DNA, 18 bp, Homo sapiens
ctggcttctgcttgtcat

SEQ ID NO: 2189644 - DNA, 21 bp, Homo sapiens
ctggctttgtcccacagcttg

SEQ ID NO: 2189645 - DNA, 22 bp, Homo sapiens
ctgggaaggctactcaccttga

SEQ ID NO: 2189646 - DNA, 12 bp, Homo sapiens
ctgggaaggggt

SEQ ID NO: 2189647 - DNA, 16 bp, Homo sapiens
ctgggagagccaaggc

SEQ ID NO: 2189648 - DNA, 17 bp, Homo sapiens
ctgggagaggcagagtg

SEQ ID NO: 2189649 - DNA, 24 bp, Homo sapiens
ctgggagaggcagagtgccccacc

SEQ ID NO: 2189650 - DNA, 22 bp, Homo sapiens
ctgggaggcaggtcccgagccc

SEQ ID NO: 2189651 - DNA, 15 bp, Homo sapiens
ctgggattacaggtg

SEQ ID NO: 2189652 - DNA, 23 bp, Homo sapiens
ctgggattacaggtgtgagccac

SEQ ID NO: 2189653 - DNA, 19 bp, Homo sapiens
ctgggcaaacccttctctt

SEQ ID NO: 2189654 - DNA, 19 bp, Homo sapiens
ctgggccaagccagggatg

SEQ ID NO: 2189655 - DNA, 14 bp, Homo sapiens
ctgggccactggca

SEQ ID NO: 2189656 - DNA, 15 bp, Homo sapiens
ctgggcccagaggca

SEQ ID NO: 2189657 - DNA, 18 bp, Homo sapiens
ctgggcccagaggcacag

SEQ ID NO: 2189658 - DNA, 15 bp, Homo sapiens
ctgggccccaggcac

SEQ ID NO: 2189659 - DNA, 19 bp, Homo sapiens
ctggggacagctttcctgg

SEQ ID NO: 2189660 - DNA, 13 bp, Homo sapiens
ctggggagtgctg

SEQ ID NO: 2189661 - DNA, 13 bp, Homo sapiens
ctggggccccacc

SEQ ID NO: 2189662 - DNA, 16 bp, Homo sapiens
ctggggcccctcggct

SEQ ID NO: 2189663 - DNA, 21 bp, Homo sapiens
ctggggccgccacggcctggc

SEQ ID NO: 2189664 - DNA, 16 bp, Homo sapiens
ctggggcggtcaataa

SEQ ID NO: 2189665 - DNA, 19 bp, Homo sapiens
ctgggggatttcaagggac

SEQ ID NO: 2189666 - DNA, 14 bp, Homo sapiens
ctgggggcctcact

SEQ ID NO: 2189667 - DNA, 20 bp, Homo sapiens
ctgggggcttttgccactcc

SEQ ID NO: 2189668 - DNA, 17 bp, Homo sapiens
ctggggtggggaggcag

SEQ ID NO: 2189669 - DNA, 16 bp, Homo sapiens
ctgggtacgagggatg

SEQ ID NO: 2189670 - DNA, 18 bp, Homo sapiens
ctgggtgagtggggagac

SEQ ID NO: 2189671 - DNA, 18 bp, Homo sapiens
ctgggtgagtttttcttt

SEQ ID NO: 2189672 - DNA, 12 bp, Homo sapiens
ctgggtgcccac

SEQ ID NO: 2189673 - DNA, 13 bp, Homo sapiens
ctgggtgcccaca

SEQ ID NO: 2189674 - DNA, 14 bp, Homo sapiens
ctgggtgcccacag

SEQ ID NO: 2189675 - DNA, 15 bp, Homo sapiens
ctgggtgcccacagc

SEQ ID NO: 2189676 - DNA, 16 bp, Homo sapiens
ctgggtggttgccctt

SEQ ID NO: 2189677 - DNA, 23 bp, Homo sapiens
ctgggttccccaccccgggctct

SEQ ID NO: 2189678 - DNA, 19 bp, Homo sapiens
ctgggtttccacacagcct

SEQ ID NO: 2189679 - DNA, 20 bp, Homo sapiens
ctgggtttccacacagcctg

SEQ ID NO: 2189680 - DNA, 17 bp, Homo sapiens
ctggtaggaagaggtac

SEQ ID NO: 2189681 - DNA, 22 bp, Homo sapiens
ctggtcatcagtattgtgtaaa

SEQ ID NO: 2189682 - DNA, 19 bp, Homo sapiens
ctggtgaccggcctggacc

SEQ ID NO: 2189683 - DNA, 19 bp, Homo sapiens
ctggtgaggaagctccagt

SEQ ID NO: 2189684 - DNA, 20 bp, Homo sapiens
ctggtgccgaagtgtttctg

SEQ ID NO: 2189685 - DNA, 17 bp, Homo sapiens
ctggtgcctatttattc

SEQ ID NO: 2189686 - DNA, 19 bp, Homo sapiens
ctggtgcctctcacttcgt

SEQ ID NO: 2189687 - DNA, 23 bp, Homo sapiens
ctggtgtaaaaaacaaacatttg

SEQ ID NO: 2189688 - DNA, 22 bp, Homo sapiens
ctggttagctcagccccagccc

SEQ ID NO: 2189689 - DNA, 16 bp, Homo sapiens
ctggttcctcctggta

SEQ ID NO: 2189690 - DNA, 14 bp, Homo sapiens
ctggttttggtttc

SEQ ID NO: 2189691 - DNA, 16 bp, Homo sapiens
ctggttttggtttcca

SEQ ID NO: 2189692 - DNA, 22 bp, Homo sapiens
ctgtaactgcattagaaaccat

SEQ ID NO: 2189693 - DNA, 15 bp, Homo sapiens
ctgtaatttaattcc

SEQ ID NO: 2189694 - DNA, 22 bp, Homo sapiens
ctgtagagcagggcaagtaaca

SEQ ID NO: 2189695 - DNA, 23 bp, Homo sapiens
ctgtatatttgaaactgctaatt

SEQ ID NO: 2189696 - DNA, 15 bp, Homo sapiens
ctgtatcagaaatga

SEQ ID NO: 2189697 - DNA, 17 bp, Homo sapiens
ctgtcacccaggctgga

SEQ ID NO: 2189698 - DNA, 21 bp, Homo sapiens
ctgtcacccaggctggagtga

SEQ ID NO: 2189699 - DNA, 18 bp, Homo sapiens
ctgtcagaataaagaaca

SEQ ID NO: 2189700 - DNA, 20 bp, Homo sapiens
ctgtcagaccttcttccaca

SEQ ID NO: 2189701 - DNA, 21 bp, Homo sapiens
ctgtcagaccttcttccacag

SEQ ID NO: 2189702 - DNA, 22 bp, Homo sapiens
ctgtcagtgggcctcatggtaa

SEQ ID NO: 2189703 - DNA, 19 bp, Homo sapiens
ctgtccaagtgtttcttgt

SEQ ID NO: 2189704 - DNA, 16 bp, Homo sapiens
ctgtccagggcttcag

SEQ ID NO: 2189705 - DNA, 17 bp, Homo sapiens
ctgtccagggcttcaga

SEQ ID NO: 2189706 - DNA, 13 bp, Homo sapiens
ctgtcccacctca

SEQ ID NO: 2189707 - DNA, 17 bp, Homo sapiens
ctgtccctggccatctc

SEQ ID NO: 2189708 - DNA, 22 bp, Homo sapiens
ctgtcctcccacccctccccac

SEQ ID NO: 2189709 - DNA, 19 bp, Homo sapiens
ctgtccttcccacggccac

SEQ ID NO: 2189710 - DNA, 23 bp, Homo sapiens
ctgtccttcccacggccactgca

SEQ ID NO: 2189711 - DNA, 14 bp, Homo sapiens
ctgtctaagaataa

SEQ ID NO: 2189712 - DNA, 13 bp, Homo sapiens
ctgtctaccatct

SEQ ID NO: 2189713 - DNA, 22 bp, Homo sapiens
ctgtctaggtcagtacccacct

SEQ ID NO: 2189714 - DNA, 15 bp, Homo sapiens
ctgtctctcttgctt

SEQ ID NO: 2189715 - DNA, 19 bp, Homo sapiens
ctgtctctcttgctttgtt

SEQ ID NO: 2189716 - DNA, 20 bp, Homo sapiens
ctgtctctcttgctttgttc

SEQ ID NO: 2189717 - DNA, 20 bp, Homo sapiens
ctgtcttcagatcctgctgc

SEQ ID NO: 2189718 - DNA, 21 bp, Homo sapiens
ctgtcttcagatcctgctgcc

SEQ ID NO: 2189719 - DNA, 19 bp, Homo sapiens
ctgtcttgatgactgctga

SEQ ID NO: 2189720 - DNA, 13 bp, Homo sapiens
ctgtcttggcctc

SEQ ID NO: 2189721 - DNA, 15 bp, Homo sapiens
ctgtcttttgattct

SEQ ID NO: 2189722 - DNA, 21 bp, Homo sapiens
ctgtgaaagtctcctgtatca

SEQ ID NO: 2189723 - DNA, 16 bp, Homo sapiens
ctgtgacacagctgag

SEQ ID NO: 2189724 - DNA, 19 bp, Homo sapiens
ctgtgattaattattgaaa

SEQ ID NO: 2189725 - DNA, 17 bp, Homo sapiens
ctgtgatttatttggag

SEQ ID NO: 2189726 - DNA, 17 bp, Homo sapiens
ctgtgcagggccctctg

SEQ ID NO: 2189727 - DNA, 15 bp, Homo sapiens
ctgtgccaagggcag

SEQ ID NO: 2189728 - DNA, 11 bp, Homo sapiens
ctgtgcccagc

SEQ ID NO: 2189729 - DNA, 20 bp, Homo sapiens
ctgtgccccatcagcagctt

SEQ ID NO: 2189730 - DNA, 21 bp, Homo sapiens
ctgtgcccttgctgggtccag

SEQ ID NO: 2189731 - DNA, 13 bp, Homo sapiens
ctgtgcctggagc

SEQ ID NO: 2189732 - DNA, 19 bp, Homo sapiens
ctgtgcctggagctcctgg

SEQ ID NO: 2189733 - DNA, 20 bp, Homo sapiens
ctgtgcctggagctcctggg

SEQ ID NO: 2189734 - DNA, 14 bp, Homo sapiens
ctgtgcgtcccagc

SEQ ID NO: 2189735 - DNA, 19 bp, Homo sapiens
ctgtgcgtcccagctgaag

SEQ ID NO: 2189736 - DNA, 12 bp, Homo sapiens
ctgtgctctgaa

SEQ ID NO: 2189737 - DNA, 21 bp, Homo sapiens
ctgtgctggagccactaacta

SEQ ID NO: 2189738 - DNA, 17 bp, Homo sapiens
ctgtgctgttgtctgcc

SEQ ID NO: 2189739 - DNA, 18 bp, Homo sapiens
ctgtgggagaagggacag

SEQ ID NO: 2189740 - DNA, 21 bp, Homo sapiens
ctgtggggggtaatccctgct

SEQ ID NO: 2189741 - DNA, 14 bp, Homo sapiens
ctgtgggtattgtt

SEQ ID NO: 2189742 - DNA, 19 bp, Homo sapiens
ctgtggtgaggttgggcag

SEQ ID NO: 2189743 - DNA, 21 bp, Homo sapiens
ctgtggttcctggggtgccct

SEQ ID NO: 2189744 - DNA, 22 bp, Homo sapiens
ctgtgtcacgcaggctgagtgc

SEQ ID NO: 2189745 - DNA, 22 bp, Homo sapiens
ctgtgtccacatctaacaaagt

SEQ ID NO: 2189746 - DNA, 17 bp, Homo sapiens
ctgtgtttgatatttgt

SEQ ID NO: 2189747 - DNA, 22 bp, Homo sapiens
ctgtgtttgatatttgtgtaaa

SEQ ID NO: 2189748 - DNA, 14 bp, Homo sapiens
ctgttctggtagct

SEQ ID NO: 2189749 - DNA, 23 bp, Homo sapiens
gaaaacttcgtaagaacatgtta

SEQ ID NO: 2189750 - DNA, 12 bp, Homo sapiens
gaaaagactgac

SEQ ID NO: 2189751 - DNA, 13 bp, Homo sapiens
gaaaagattgcaa

SEQ ID NO: 2189752 - DNA, 15 bp, Homo sapiens
gaaaagattgcaaag

SEQ ID NO: 2189753 - DNA, 13 bp, Homo sapiens
gaaaaggtccttg

SEQ ID NO: 2189754 - DNA, 18 bp, Homo sapiens
gaaaaggttaaatacctg

SEQ ID NO: 2189755 - DNA, 15 bp, Homo sapiens
gaaaagtgttccttg

SEQ ID NO: 2189756 - DNA, 14 bp, Homo sapiens
gaaaatggaacatt

SEQ ID NO: 2189757 - DNA, 21 bp, Homo sapiens
gaaaatgtgccatttttttca

SEQ ID NO: 2189758 - DNA, 13 bp, Homo sapiens
gaaaattgccaaa

SEQ ID NO: 2189759 - DNA, 14 bp, Homo sapiens
gaaaattgccaaaa

SEQ ID NO: 2189760 - DNA, 17 bp, Homo sapiens
gaaaattgccaaaatat

SEQ ID NO: 2189761 - DNA, 18 bp, Homo sapiens
gaaaattgccaaaatata

SEQ ID NO: 2189762 - DNA, 16 bp, Homo sapiens
gaaacaaccatgtcat

SEQ ID NO: 2189763 - DNA, 12 bp, Homo sapiens
gaaacagctcag

SEQ ID NO: 2189764 - DNA, 17 bp, Homo sapiens
gaaacagctcagccagt

SEQ ID NO: 2189765 - DNA, 13 bp, Homo sapiens
gaaacatttatct

SEQ ID NO: 2189766 - DNA, 14 bp, Homo sapiens
gaaaccctgtttta

SEQ ID NO: 2189767 - DNA, 16 bp, Homo sapiens
gaaacctctgacttgc

SEQ ID NO: 2189768 - DNA, 18 bp, Homo sapiens
gaaactgctaattacaca

SEQ ID NO: 2189769 - DNA, 21 bp, Homo sapiens
gaaacttaaatgttattatct

SEQ ID NO: 2189770 - DNA, 21 bp, Homo sapiens
gaaacttgagtttgtttcttg

SEQ ID NO: 2189771 - DNA, 17 bp, Homo sapiens
gaaacttggttcccaga

SEQ ID NO: 2189772 - DNA, 16 bp, Homo sapiens
gaaagaagcaagacac

SEQ ID NO: 2189773 - DNA, 17 bp, Homo sapiens
gaaagaagggggccctg

SEQ ID NO: 2189774 - DNA, 16 bp, Homo sapiens
gaaagagagaagccag

SEQ ID NO: 2189775 - DNA, 20 bp, Homo sapiens
gaaagagagaagccagccac

SEQ ID NO: 2189776 - DNA, 19 bp, Homo sapiens
gaaagagctgcctggatga

SEQ ID NO: 2189777 - DNA, 15 bp, Homo sapiens
gaaagattgtgtctg

SEQ ID NO: 2189778 - DNA, 22 bp, Homo sapiens
gaaagcaagaccttgattgcac

SEQ ID NO: 2189779 - DNA, 16 bp, Homo sapiens
gaaagctgtgaaattg

SEQ ID NO: 2189780 - DNA, 16 bp, Homo sapiens
gaaagtccattgatgt

SEQ ID NO: 2189781 - DNA, 17 bp, Homo sapiens
gaaagtccattgatgtc

SEQ ID NO: 2189782 - DNA, 23 bp, Homo sapiens
gaaataattttttagttaaaatc

SEQ ID NO: 2189783 - DNA, 19 bp, Homo sapiens
gaaatcctttcataaagca

SEQ ID NO: 2189784 - DNA, 21 bp, Homo sapiens
gaaatgggaacaatatcaata

SEQ ID NO: 2189785 - DNA, 22 bp, Homo sapiens
gaaatgggaacaatatcaatat

SEQ ID NO: 2189786 - DNA, 16 bp, Homo sapiens
gaaattacaagtttca

SEQ ID NO: 2189787 - DNA, 21 bp, Homo sapiens
gaaattacaagtttcagtaat

SEQ ID NO: 2189788 - DNA, 19 bp, Homo sapiens
gaaatttgtggttgcatgt

SEQ ID NO: 2189789 - DNA, 14 bp, Homo sapiens
gaaatttgttaata

SEQ ID NO: 2189790 - DNA, 17 bp, Homo sapiens
gaaatttgttaatatat

SEQ ID NO: 2189791 - DNA, 19 bp, Homo sapiens
gaaattttaaaggaagaaa

SEQ ID NO: 2189792 - DNA, 18 bp, Homo sapiens
gaacaaagaccaatgtga

SEQ ID NO: 2189793 - DNA, 18 bp, Homo sapiens
gaacaatatcaatatggt

SEQ ID NO: 2189794 - DNA, 15 bp, Homo sapiens
gaacagcagaaaccc

SEQ ID NO: 2189795 - DNA, 20 bp, Homo sapiens
gaacagcaggcccacctacc

SEQ ID NO: 2189796 - DNA, 15 bp, Homo sapiens
gaacagtggttgcct

SEQ ID NO: 2189797 - DNA, 18 bp, Homo sapiens
gaacagtggttgcctggg

SEQ ID NO: 2189798 - DNA, 17 bp, Homo sapiens
gaacatccgttgaatga

SEQ ID NO: 2189799 - DNA, 12 bp, Homo sapiens
gaaccagagcca

SEQ ID NO: 2189800 - DNA, 13 bp, Homo sapiens
gaacccacactgc

SEQ ID NO: 2189801 - DNA, 22 bp, Homo sapiens
gaacctactgaggagcaaagca

SEQ ID NO: 2189802 - DNA, 13 bp, Homo sapiens
gaacctcctttct

SEQ ID NO: 2189803 - DNA, 13 bp, Homo sapiens
gaacctggctgcg

SEQ ID NO: 2189804 - DNA, 21 bp, Homo sapiens
gaacctggctgcgaactgtgc

SEQ ID NO: 2189805 - DNA, 19 bp, Homo sapiens
gaaccttgtagaggagcag

SEQ ID NO: 2189806 - DNA, 19 bp, Homo sapiens
gaactcaaaggactgacct

SEQ ID NO: 2189807 - DNA, 20 bp, Homo sapiens
gaactcgcttctctgtgact

SEQ ID NO: 2189808 - DNA, 12 bp, Homo sapiens
gaactctcagga

SEQ ID NO: 2189809 - DNA, 15 bp, Homo sapiens
gaactcttcctggaa

SEQ ID NO: 2189810 - DNA, 21 bp, Homo sapiens
gaactgctgccatgattttgg

SEQ ID NO: 2189811 - DNA, 16 bp, Homo sapiens
gaacttggtagttcat

SEQ ID NO: 2189812 - DNA, 16 bp, Homo sapiens
gaagaaacatttatct

SEQ ID NO: 2189813 - DNA, 20 bp, Homo sapiens
gaagaaaccatttttaatga

SEQ ID NO: 2189814 - DNA, 23 bp, Homo sapiens
gaagaacttgaagtgaacaaatt

SEQ ID NO: 2189815 - DNA, 18 bp, Homo sapiens
gaagacaaaccactgtac

SEQ ID NO: 2189816 - DNA, 21 bp, Homo sapiens
gaagacaaaccactgtacata

SEQ ID NO: 2189817 - DNA, 16 bp, Homo sapiens
gaagactacttttaga

SEQ ID NO: 2189818 - DNA, 17 bp, Homo sapiens
gaagagaatcaaggccg

SEQ ID NO: 2189819 - DNA, 12 bp, Homo sapiens
gaagagggagaa

SEQ ID NO: 2189820 - DNA, 15 bp, Homo sapiens
gaagagggagaagga

SEQ ID NO: 2189821 - DNA, 13 bp, Homo sapiens
gaagagtcatttt

SEQ ID NO: 2189822 - DNA, 23 bp, Homo sapiens
gaagatggttttattctttgaga

SEQ ID NO: 2189823 - DNA, 19 bp, Homo sapiens
gaagatgtattcagagcca

SEQ ID NO: 2189824 - DNA, 16 bp, Homo sapiens
gaagcaaatatgtttg

SEQ ID NO: 2189825 - DNA, 18 bp, Homo sapiens
gaagcaagacacgtggcc

SEQ ID NO: 2189826 - DNA, 14 bp, Homo sapiens
gaagcagtggcctt

SEQ ID NO: 2189827 - DNA, 17 bp, Homo sapiens
gaagccacgtgctggag

SEQ ID NO: 2189828 - DNA, 17 bp, Homo sapiens
gaagccagccacagacc

SEQ ID NO: 2189829 - DNA, 16 bp, Homo sapiens
gaagctagctcccctc

SEQ ID NO: 2189830 - DNA, 20 bp, Homo sapiens
gaagctccagtcctgctctc

SEQ ID NO: 2189831 - DNA, 13 bp, Homo sapiens
gaagctcctggta

SEQ ID NO: 2189832 - DNA, 21 bp, Homo sapiens
gaagctggggacagctttcct

SEQ ID NO: 2189833 - DNA, 20 bp, Homo sapiens
gaagctttctctgcttcagc

SEQ ID NO: 2189834 - DNA, 17 bp, Homo sapiens
gaaggaaaaacatgctt

SEQ ID NO: 2189835 - DNA, 19 bp, Homo sapiens
gaaggagcctgcggctgct

SEQ ID NO: 2189836 - DNA, 22 bp, Homo sapiens
gaaggagcctgcggctgctggc

SEQ ID NO: 2189837 - DNA, 23 bp, Homo sapiens
gaaggagcctgcggctgctggca

SEQ ID NO: 2189838 - DNA, 15 bp, Homo sapiens
gaaggcaagctggca

SEQ ID NO: 2189839 - DNA, 19 bp, Homo sapiens
gaaggcagtggcaggggag

SEQ ID NO: 2189840 - DNA, 13 bp, Homo sapiens
gaaggccacctgc

SEQ ID NO: 2189841 - DNA, 19 bp, Homo sapiens
gaaggcgatgtggtgaccc

SEQ ID NO: 2189842 - DNA, 15 bp, Homo sapiens
gaagggaagaaaagg

SEQ ID NO: 2189843 - DNA, 22 bp, Homo sapiens
gaaggggaggacctctgggctt

SEQ ID NO: 2189844 - DNA, 15 bp, Homo sapiens
gaagggggccctgct

SEQ ID NO: 2189845 - DNA, 14 bp, Homo sapiens
gaaggtcacagaag

SEQ ID NO: 2189846 - DNA, 23 bp, Homo sapiens
gaaggtgggggttggctgggtac

SEQ ID NO: 2189847 - DNA, 23 bp, Homo sapiens
gaagtcccaatttaagagtcctg

SEQ ID NO: 2189848 - DNA, 16 bp, Homo sapiens
gaagtcttccatcagc

SEQ ID NO: 2189849 - DNA, 19 bp, Homo sapiens
gaagtcttccatcagcagt

SEQ ID NO: 2189850 - DNA, 23 bp, Homo sapiens
gaagtgaatacatggtagcaggg

SEQ ID NO: 2189851 - DNA, 17 bp, Homo sapiens
gaagtgatgattgtaag

SEQ ID NO: 2189852 - DNA, 16 bp, Homo sapiens
gaagtgggagtgggag

SEQ ID NO: 2189853 - DNA, 16 bp, Homo sapiens
gaagtggtgttttttt

SEQ ID NO: 2189854 - DNA, 19 bp, Homo sapiens
gaagtgtttaaaagagcca

SEQ ID NO: 2189855 - DNA, 17 bp, Homo sapiens
gaagttagtttgtatat

SEQ ID NO: 2189856 - DNA, 19 bp, Homo sapiens
gaatacatggtagcagggt

SEQ ID NO: 2189857 - DNA, 15 bp, Homo sapiens
gaatactaataaaat

SEQ ID NO: 2189858 - DNA, 18 bp, Homo sapiens
gaatactaataaaataca

SEQ ID NO: 2189859 - DNA, 17 bp, Homo sapiens
gaatactttgagtaaac

SEQ ID NO: 2189860 - DNA, 14 bp, Homo sapiens
gaatagaataaata

SEQ ID NO: 2189861 - DNA, 16 bp, Homo sapiens
gaatagaataaataca

SEQ ID NO: 2189862 - DNA, 20 bp, Homo sapiens
gaatagcttgtacacatata

SEQ ID NO: 2189863 - DNA, 17 bp, Homo sapiens
gaataggaaataaaatt

SEQ ID NO: 2189864 - DNA, 23 bp, Homo sapiens
gaatattaaaaattaattcttta

SEQ ID NO: 2189865 - DNA, 16 bp, Homo sapiens
gaatcactcatttatt

SEQ ID NO: 2189866 - DNA, 19 bp, Homo sapiens
gaatcccttaacagttgta

SEQ ID NO: 2189867 - DNA, 21 bp, Homo sapiens
gaatcggtgctgtcagccctg

SEQ ID NO: 2189868 - DNA, 19 bp, Homo sapiens
gaatgaagataagtaattt

SEQ ID NO: 2189869 - DNA, 12 bp, Homo sapiens
gaatgagagagt

SEQ ID NO: 2189870 - DNA, 13 bp, Homo sapiens
gaatgagagagtg

SEQ ID NO: 2189871 - DNA, 17 bp, Homo sapiens
gccaggaccgccaaaga

SEQ ID NO: 2189872 - DNA, 21 bp, Homo sapiens
gccaggctgcggtgggcagcc

SEQ ID NO: 2189873 - DNA, 22 bp, Homo sapiens
gccaggtaggatgaacacaggc

SEQ ID NO: 2189874 - DNA, 16 bp, Homo sapiens
gccataccttgagacc

SEQ ID NO: 2189875 - DNA, 15 bp, Homo sapiens
gccatagctcctgct

SEQ ID NO: 2189876 - DNA, 19 bp, Homo sapiens
gccatatattttctgagta

SEQ ID NO: 2189877 - DNA, 16 bp, Homo sapiens
gccatcccagccttgg

SEQ ID NO: 2189878 - DNA, 12 bp, Homo sapiens
gccatcctgtcc

SEQ ID NO: 2189879 - DNA, 17 bp, Homo sapiens
gccatctgactgccaag

SEQ ID NO: 2189880 - DNA, 13 bp, Homo sapiens
gccatctggaaat

SEQ ID NO: 2189881 - DNA, 15 bp, Homo sapiens
gccatgattttggcc

SEQ ID NO: 2189882 - DNA, 18 bp, Homo sapiens
gccatgattttggccact

SEQ ID NO: 2189883 - DNA, 21 bp, Homo sapiens
gccatgattttggccactttg

SEQ ID NO: 2189884 - DNA, 21 bp, Homo sapiens
gccatgctgctttgcacacac

SEQ ID NO: 2189885 - DNA, 22 bp, Homo sapiens
gccatgtccaaacccatcttca

SEQ ID NO: 2189886 - DNA, 16 bp, Homo sapiens
gccattataattttga

SEQ ID NO: 2189887 - DNA, 16 bp, Homo sapiens
gccattggcctctgtc

SEQ ID NO: 2189888 - DNA, 23 bp, Homo sapiens
gcccaaaggaagtagcaggccca

SEQ ID NO: 2189889 - DNA, 13 bp, Homo sapiens
gcccaacctcagc

SEQ ID NO: 2189890 - DNA, 15 bp, Homo sapiens
gcccaatcactgcct

SEQ ID NO: 2189891 - DNA, 22 bp, Homo sapiens
gcccacaggtgtccccagccca

SEQ ID NO: 2189892 - DNA, 23 bp, Homo sapiens
gcccacccgtcttcaatctctgt

SEQ ID NO: 2189893 - DNA, 17 bp, Homo sapiens
gcccaccctcctgtacc

SEQ ID NO: 2189894 - DNA, 23 bp, Homo sapiens
gcccacctaagggctaaggcctc

SEQ ID NO: 2189895 - DNA, 22 bp, Homo sapiens
gcccacctgcatcagcctctgg

SEQ ID NO: 2189896 - DNA, 23 bp, Homo sapiens
gcccacctgcatcagcctctggc

SEQ ID NO: 2189897 - DNA, 13 bp, Homo sapiens
gcccactggatca

SEQ ID NO: 2189898 - DNA, 18 bp, Homo sapiens
gcccacttctccttcgct

SEQ ID NO: 2189899 - DNA, 23 bp, Homo sapiens
gcccacttctccttcgctttcct

SEQ ID NO: 2189900 - DNA, 15 bp, Homo sapiens
gcccagagctgggtg

SEQ ID NO: 2189901 - DNA, 16 bp, Homo sapiens
gcccagagctgggtga

SEQ ID NO: 2189902 - DNA, 19 bp, Homo sapiens
gcccagcaaggaccagtga

SEQ ID NO: 2189903 - DNA, 15 bp, Homo sapiens
gcccagcagagccgt

SEQ ID NO: 2189904 - DNA, 18 bp, Homo sapiens
gcccagcagtttcccaga

SEQ ID NO: 2189905 - DNA, 13 bp, Homo sapiens
gcccagcccagct

SEQ ID NO: 2189906 - DNA, 12 bp, Homo sapiens
gcccagctcagt

SEQ ID NO: 2189907 - DNA, 14 bp, Homo sapiens
gcccagtccactgg

SEQ ID NO: 2189908 - DNA, 15 bp, Homo sapiens
gcccagtccactggg

SEQ ID NO: 2189909 - DNA, 15 bp, Homo sapiens
gcccagtgatggcat

SEQ ID NO: 2189910 - DNA, 21 bp, Homo sapiens
gcccatcactcggctgtggag

SEQ ID NO: 2189911 - DNA, 16 bp, Homo sapiens
gcccatcctgaccagc

SEQ ID NO: 2189912 - DNA, 16 bp, Homo sapiens
gcccatcttgcctcca

SEQ ID NO: 2189913 - DNA, 15 bp, Homo sapiens
gccccaaaggaagct

SEQ ID NO: 2189914 - DNA, 12 bp, Homo sapiens
gccccacctgcc

SEQ ID NO: 2189915 - DNA, 15 bp, Homo sapiens
gccccacctgccact

SEQ ID NO: 2189916 - DNA, 17 bp, Homo sapiens
gccccacctgccactag

SEQ ID NO: 2189917 - DNA, 13 bp, Homo sapiens
gccccagaggccc

SEQ ID NO: 2189918 - DNA, 19 bp, Homo sapiens
gccccagaggccctggagg

SEQ ID NO: 2189919 - DNA, 22 bp, Homo sapiens
gccccagaggccctggaggtct

SEQ ID NO: 2189920 - DNA, 19 bp, Homo sapiens
gccccatcagcagcttgac

SEQ ID NO: 2189921 - DNA, 17 bp, Homo sapiens
gcccccacccacttccc

SEQ ID NO: 2189922 - DNA, 16 bp, Homo sapiens
gcccccagctgctcct

SEQ ID NO: 2189923 - DNA, 13 bp, Homo sapiens
gccccccctaaga

SEQ ID NO: 2189924 - DNA, 19 bp, Homo sapiens
gccccgggctggagaaaga

SEQ ID NO: 2189925 - DNA, 22 bp, Homo sapiens
gccccgggctggagaaagagct

SEQ ID NO: 2189926 - DNA, 21 bp, Homo sapiens
gccccgtctcctgagggtcct

SEQ ID NO: 2189927 - DNA, 13 bp, Homo sapiens
gcccctcggctac

SEQ ID NO: 2189928 - DNA, 17 bp, Homo sapiens
gcccctcggctaccccc

SEQ ID NO: 2189929 - DNA, 12 bp, Homo sapiens
gcccctggtggc

SEQ ID NO: 2189930 - DNA, 17 bp, Homo sapiens
gccccttagcccccacc

SEQ ID NO: 2189931 - DNA, 16 bp, Homo sapiens
gcccgcatgcagcagc

SEQ ID NO: 2189932 - DNA, 17 bp, Homo sapiens
gcccgcatgcagcagct

SEQ ID NO: 2189933 - DNA, 20 bp, Homo sapiens
gcccgccctccctcctgcct

SEQ ID NO: 2189934 - DNA, 17 bp, Homo sapiens
gcccgccgtgcctgcat

SEQ ID NO: 2189935 - DNA, 18 bp, Homo sapiens
gcccgccgtgcctgcatt

SEQ ID NO: 2189936 - DNA, 13 bp, Homo sapiens
gcccggccggaga

SEQ ID NO: 2189937 - DNA, 13 bp, Homo sapiens
gccctacagccct

SEQ ID NO: 2189938 - DNA, 15 bp, Homo sapiens
gccctaggctaccct

SEQ ID NO: 2189939 - DNA, 13 bp, Homo sapiens
gccctccactgcc

SEQ ID NO: 2189940 - DNA, 15 bp, Homo sapiens
gccctccactgccct

SEQ ID NO: 2189941 - DNA, 16 bp, Homo sapiens
gccctccactgccctc

SEQ ID NO: 2189942 - DNA, 16 bp, Homo sapiens
gccctcctgcccgccc

SEQ ID NO: 2189943 - DNA, 17 bp, Homo sapiens
gccctctatttattagc

SEQ ID NO: 2189944 - DNA, 22 bp, Homo sapiens
gccctctatttattagccaact

SEQ ID NO: 2189945 - DNA, 21 bp, Homo sapiens
gccctcttcccctctaatgct

SEQ ID NO: 2189946 - DNA, 21 bp, Homo sapiens
gccctgagctagtgtcacctg

SEQ ID NO: 2189947 - DNA, 23 bp, Homo sapiens
gccctgagctagtgtcacctgca

SEQ ID NO: 2189948 - DNA, 22 bp, Homo sapiens
gccctgagctggcctcacctgg

SEQ ID NO: 2189949 - DNA, 22 bp, Homo sapiens
gccctgagctggcgtcacctgt

SEQ ID NO: 2189950 - DNA, 9 bp, Homo sapiens
gccctgcta

SEQ ID NO: 2189951 - DNA, 23 bp, Homo sapiens
gccctgctgtcagaccttcttcc

SEQ ID NO: 2189952 - DNA, 18 bp, Homo sapiens
gccctggaggtctccagg

SEQ ID NO: 2189953 - DNA, 19 bp, Homo sapiens
gccctggaggtctccaggg

SEQ ID NO: 2189954 - DNA, 18 bp, Homo sapiens
gccctggctggggacttg

SEQ ID NO: 2189955 - DNA, 23 bp, Homo sapiens
gccctgttgtgggggtgtcacag

SEQ ID NO: 2189956 - DNA, 20 bp, Homo sapiens
gcccttcttttgaccccttc

SEQ ID NO: 2189957 - DNA, 22 bp, Homo sapiens
gcccttgctttcggagctcctg

SEQ ID NO: 2189958 - DNA, 15 bp, Homo sapiens
gcccttttctggctc

SEQ ID NO: 2189959 - DNA, 17 bp, Homo sapiens
gcccttttctggctcct

SEQ ID NO: 2189960 - DNA, 14 bp, Homo sapiens
gccgaattgtggtg

SEQ ID NO: 2189961 - DNA, 20 bp, Homo sapiens
gccgagatcggggtggcaga

SEQ ID NO: 2189962 - DNA, 12 bp, Homo sapiens
gccgaggcaggg

SEQ ID NO: 2189963 - DNA, 13 bp, Homo sapiens
gccgatgagctgg

SEQ ID NO: 2189964 - DNA, 17 bp, Homo sapiens
gccgccacggcctggct

SEQ ID NO: 2189965 - DNA, 20 bp, Homo sapiens
gccgccaggaccgccaaaga

SEQ ID NO: 2189966 - DNA, 13 bp, Homo sapiens
gccgcccacctgc

SEQ ID NO: 2189967 - DNA, 17 bp, Homo sapiens
gccgcctgtgcccttgc

SEQ ID NO: 2189968 - DNA, 22 bp, Homo sapiens
gccgcctgtgcccttgctgggt

SEQ ID NO: 2189969 - DNA, 13 bp, Homo sapiens
gccgctgggagag

SEQ ID NO: 2189970 - DNA, 15 bp, Homo sapiens
gccgctgggagagcc

SEQ ID NO: 2189971 - DNA, 17 bp, Homo sapiens
gccgctgggagagccaa

SEQ ID NO: 2189972 - DNA, 21 bp, Homo sapiens
gccgcttccctacccacaggg

SEQ ID NO: 2189973 - DNA, 23 bp, Homo sapiens
gccgcttccctacccacagggcc

SEQ ID NO: 2189974 - DNA, 23 bp, Homo sapiens
gccggagaacatctgccttgctg

SEQ ID NO: 2189975 - DNA, 22 bp, Homo sapiens
gccggcagcgggcggaggggat

SEQ ID NO: 2189976 - DNA, 12 bp, Homo sapiens
gccggccccagg

SEQ ID NO: 2189977 - DNA, 23 bp, Homo sapiens
gccggggaagacttgaaagaaag

SEQ ID NO: 2189978 - DNA, 17 bp, Homo sapiens
gccggggcctgcctagc

SEQ ID NO: 2189979 - DNA, 21 bp, Homo sapiens
gccgggggtgggggcctgctg

SEQ ID NO: 2189980 - DNA, 18 bp, Homo sapiens
gccgggttggaggcctca

SEQ ID NO: 2189981 - DNA, 19 bp, Homo sapiens
gccgggttggaggcctcac

SEQ ID NO: 2189982 - DNA, 17 bp, Homo sapiens
gccgtgctgagcacaca

SEQ ID NO: 2189983 - DNA, 14 bp, Homo sapiens
gccgtgtccccttg

SEQ ID NO: 2189984 - DNA, 14 bp, Homo sapiens
gccgttgcagacat

SEQ ID NO: 2189985 - DNA, 18 bp, Homo sapiens
gcctagcactcacatgct

SEQ ID NO: 2189986 - DNA, 22 bp, Homo sapiens
gcctagtcagccacatgggaaa

SEQ ID NO: 2189987 - DNA, 19 bp, Homo sapiens
gcctagtcccttccacacc

SEQ ID NO: 2189988 - DNA, 16 bp, Homo sapiens
gcctatgccacctgca

SEQ ID NO: 2189989 - DNA, 13 bp, Homo sapiens
gcctcagcctccc

SEQ ID NO: 2189990 - DNA, 12 bp, Homo sapiens
gcctcaggctct

SEQ ID NO: 2189991 - DNA, 21 bp, Homo sapiens
gcctcaggctctgcacagaca

SEQ ID NO: 2189992 - DNA, 14 bp, Homo sapiens
gcctccagaggagg

SEQ ID NO: 2189993 - DNA, 22 bp, Homo sapiens
ggcaccaaaccctgtcctccca

SEQ ID NO: 2189994 - DNA, 18 bp, Homo sapiens
ggcaccgttatccctgca

SEQ ID NO: 2189995 - DNA, 14 bp, Homo sapiens
ggcagaacctggtg

SEQ ID NO: 2189996 - DNA, 24 bp, Homo sapiens
ggcagaacctggtggctggaggca

SEQ ID NO: 2189997 - DNA, 12 bp, Homo sapiens
ggcagcctgtgg

SEQ ID NO: 2189998 - DNA, 18 bp, Homo sapiens
ggcagcctgtgggagaag

SEQ ID NO: 2189999 - DNA, 16 bp, Homo sapiens
ggcagggaaggacagg

SEQ ID NO: 2190000 - DNA, 18 bp, Homo sapiens
ggcagggaaggacaggac

SEQ ID NO: 2190001 - DNA, 21 bp, Homo sapiens
ggcagggaaggacaggaccct

SEQ ID NO: 2190002 - DNA, 14 bp, Homo sapiens
ggcaggggctgggc

SEQ ID NO: 2190003 - DNA, 15 bp, Homo sapiens
ggcagtccgtgggac

SEQ ID NO: 2190004 - DNA, 13 bp, Homo sapiens
ggcagtgggagac

SEQ ID NO: 2190005 - DNA, 13 bp, Homo sapiens
ggcagtggggctg

SEQ ID NO: 2190006 - DNA, 22 bp, Homo sapiens
ggcatctctggagtgtgtgggg

SEQ ID NO: 2190007 - DNA, 16 bp, Homo sapiens
ggcattaaatgcaaaa

SEQ ID NO: 2190008 - DNA, 17 bp, Homo sapiens
ggcattactctgcacta

SEQ ID NO: 2190009 - DNA, 22 bp, Homo sapiens
ggcattcccagaggtggggaag

SEQ ID NO: 2190010 - DNA, 19 bp, Homo sapiens
ggcattcgcagtgcccagt

SEQ ID NO: 2190011 - DNA, 20 bp, Homo sapiens
ggcattggttccctttgctc

SEQ ID NO: 2190012 - DNA, 16 bp, Homo sapiens
ggccaaggtgccacca

SEQ ID NO: 2190013 - DNA, 16 bp, Homo sapiens
ggccaagtcccaccgg

SEQ ID NO: 2190014 - DNA, 12 bp, Homo sapiens
ggccacagccag

SEQ ID NO: 2190015 - DNA, 13 bp, Homo sapiens
ggccacagccaga

SEQ ID NO: 2190016 - DNA, 17 bp, Homo sapiens
ggccacagccagaaccc

SEQ ID NO: 2190017 - DNA, 20 bp, Homo sapiens
ggccacatccaacatttcct

SEQ ID NO: 2190018 - DNA, 14 bp, Homo sapiens
ggccaccacccccc

SEQ ID NO: 2190019 - DNA, 10 bp, Homo sapiens
ggccacctgc

SEQ ID NO: 2190020 - DNA, 14 bp, Homo sapiens
ggccacgggggagg

SEQ ID NO: 2190021 - DNA, 13 bp, Homo sapiens
ggccactgacctc

SEQ ID NO: 2190022 - DNA, 13 bp, Homo sapiens
ggccactgcagtc

SEQ ID NO: 2190023 - DNA, 15 bp, Homo sapiens
ggccagaccagagct

SEQ ID NO: 2190024 - DNA, 18 bp, Homo sapiens
ggccagaccagagctctg

SEQ ID NO: 2190025 - DNA, 23 bp, Homo sapiens
ggccagaccagagctctggagcc

SEQ ID NO: 2190026 - DNA, 19 bp, Homo sapiens
ggccagaggcagaaccctg

SEQ ID NO: 2190027 - DNA, 20 bp, Homo sapiens
ggccattctattgtggcaag

SEQ ID NO: 2190028 - DNA, 12 bp, Homo sapiens
ggcccagaggca

SEQ ID NO: 2190029 - DNA, 14 bp, Homo sapiens
ggcccagaggcaca

SEQ ID NO: 2190030 - DNA, 13 bp, Homo sapiens
ggcccaggggctt

SEQ ID NO: 2190031 - DNA, 20 bp, Homo sapiens
ggcccagtccactggggagt

SEQ ID NO: 2190032 - DNA, 13 bp, Homo sapiens
ggccccagaggcc

SEQ ID NO: 2190033 - DNA, 21 bp, Homo sapiens
ggccccagaggccctggaggt

SEQ ID NO: 2190034 - DNA, 18 bp, Homo sapiens
ggcccccgccctctgccc

SEQ ID NO: 2190035 - DNA, 14 bp, Homo sapiens
ggccccgggctgga

SEQ ID NO: 2190036 - DNA, 16 bp, Homo sapiens
ggccccgggctggaga

SEQ ID NO: 2190037 - DNA, 18 bp, Homo sapiens
ggccccgggctggagaaa

SEQ ID NO: 2190038 - DNA, 22 bp, Homo sapiens
ggcccctccccaactccttcct

SEQ ID NO: 2190039 - DNA, 23 bp, Homo sapiens
ggcccctccccaactccttcctc

SEQ ID NO: 2190040 - DNA, 13 bp, Homo sapiens
ggccctacagccc

SEQ ID NO: 2190041 - DNA, 14 bp, Homo sapiens
ggccctctgaggct

SEQ ID NO: 2190042 - DNA, 13 bp, Homo sapiens
ggccctgcctctg

SEQ ID NO: 2190043 - DNA, 19 bp, Homo sapiens
ggccctggaggtctccagg

SEQ ID NO: 2190044 - DNA, 12 bp, Homo sapiens
ggccgaggcagg

SEQ ID NO: 2190045 - DNA, 22 bp, Homo sapiens
ggccgaggcaggggctgggcag

SEQ ID NO: 2190046 - DNA, 13 bp, Homo sapiens
ggccgcctgtcct

SEQ ID NO: 2190047 - DNA, 14 bp, Homo sapiens
ggccgcctgtcctt

SEQ ID NO: 2190048 - DNA, 23 bp, Homo sapiens
ggccgggggtgggggcctgctgt

SEQ ID NO: 2190049 - DNA, 20 bp, Homo sapiens
ggccgggttggaggcctcac

SEQ ID NO: 2190050 - DNA, 19 bp, Homo sapiens
ggccggttaacatctttta

SEQ ID NO: 2190051 - DNA, 15 bp, Homo sapiens
ggcctagtcagccac

SEQ ID NO: 2190052 - DNA, 18 bp, Homo sapiens
ggcctatgccacctgcag

SEQ ID NO: 2190053 - DNA, 12 bp, Homo sapiens
ggcctcaccctg

SEQ ID NO: 2190054 - DNA, 14 bp, Homo sapiens
ggcctcaccctgct

SEQ ID NO: 2190055 - DNA, 23 bp, Homo sapiens
ggcctcaccctgcttggggcctg

SEQ ID NO: 2190056 - DNA, 15 bp, Homo sapiens
ggcctcactccagga

SEQ ID NO: 2190057 - DNA, 14 bp, Homo sapiens
ggcctcaggctctg

SEQ ID NO: 2190058 - DNA, 17 bp, Homo sapiens
ggcctcattactttacc

SEQ ID NO: 2190059 - DNA, 21 bp, Homo sapiens
ggcctcctctaacaggggctg

SEQ ID NO: 2190060 - DNA, 16 bp, Homo sapiens
ggcctcgtgaggggca

SEQ ID NO: 2190061 - DNA, 23 bp, Homo sapiens
ggcctcttcctccctccctgcag

SEQ ID NO: 2190062 - DNA, 17 bp, Homo sapiens
ggcctcttgctggtgca

SEQ ID NO: 2190063 - DNA, 14 bp, Homo sapiens
ggcctgcaggggcc

SEQ ID NO: 2190064 - DNA, 15 bp, Homo sapiens
ggcctgctgtgggtc

SEQ ID NO: 2190065 - DNA, 12 bp, Homo sapiens
ggcctggctccg

SEQ ID NO: 2190066 - DNA, 14 bp, Homo sapiens
ggcctggctccgct

SEQ ID NO: 2190067 - DNA, 14 bp, Homo sapiens
ggcctggctggtgg

SEQ ID NO: 2190068 - DNA, 21 bp, Homo sapiens
ggcctgtccctggccatctct

SEQ ID NO: 2190069 - DNA, 19 bp, Homo sapiens
ggcgaggcgaagctgagcg

SEQ ID NO: 2190070 - DNA, 16 bp, Homo sapiens
ggcggaacctggctgc

SEQ ID NO: 2190071 - DNA, 20 bp, Homo sapiens
ggcggaggggatccagccac

SEQ ID NO: 2190072 - DNA, 22 bp, Homo sapiens
ggcgggaggccacgggggaggc

SEQ ID NO: 2190073 - DNA, 22 bp, Homo sapiens
ggcggtcaataattgtggagag

SEQ ID NO: 2190074 - DNA, 22 bp, Homo sapiens
ggcgtactatttttattgagcc

SEQ ID NO: 2190075 - DNA, 16 bp, Homo sapiens
ggcgttgtgggcaggc

SEQ ID NO: 2190076 - DNA, 18 bp, Homo sapiens
ggctagaatatcctactt

SEQ ID NO: 2190077 - DNA, 22 bp, Homo sapiens
ggctatggattttctaaggaag

SEQ ID NO: 2190078 - DNA, 17 bp, Homo sapiens
ggctcactatggtgcca

SEQ ID NO: 2190079 - DNA, 14 bp, Homo sapiens
ggctcactgcagcc

SEQ ID NO: 2190080 - DNA, 14 bp, Homo sapiens
ggctcagccctgag

SEQ ID NO: 2190081 - DNA, 16 bp, Homo sapiens
ggctcagccctgagct

SEQ ID NO: 2190082 - DNA, 13 bp, Homo sapiens
ggctcagctctgg

SEQ ID NO: 2190083 - DNA, 14 bp, Homo sapiens
ggctcagctctggc

SEQ ID NO: 2190084 - DNA, 18 bp, Homo sapiens
ggctcagctctggctcac

SEQ ID NO: 2190085 - DNA, 15 bp, Homo sapiens
ggctcgtgggctctg

SEQ ID NO: 2190086 - DNA, 14 bp, Homo sapiens
ggctctggctccct

SEQ ID NO: 2190087 - DNA, 16 bp, Homo sapiens
ggctctggctccctgg

SEQ ID NO: 2190088 - DNA, 20 bp, Homo sapiens
ggctgcaccctgtatggagc

SEQ ID NO: 2190089 - DNA, 21 bp, Homo sapiens
ggctgcactcaagaccctcga

SEQ ID NO: 2190090 - DNA, 15 bp, Homo sapiens
ggctgcctggcccag

SEQ ID NO: 2190091 - DNA, 17 bp, Homo sapiens
ggctgcgaactgtgcag

SEQ ID NO: 2190092 - DNA, 11 bp, Homo sapiens
ggctgctggca

SEQ ID NO: 2190093 - DNA, 23 bp, Homo sapiens
ggctggagaaagagctgcctgga

SEQ ID NO: 2190094 - DNA, 16 bp, Homo sapiens
ggctgggcagagggga

SEQ ID NO: 2190095 - DNA, 18 bp, Homo sapiens
ggctgggccaagccaggg

SEQ ID NO: 2190096 - DNA, 22 bp, Homo sapiens
ggctgggccaagccagggatgg

SEQ ID NO: 2190097 - DNA, 13 bp, Homo sapiens
ggctgggcccaga

SEQ ID NO: 2190098 - DNA, 17 bp, Homo sapiens
ggctggtgaaggcccct

SEQ ID NO: 2190099 - DNA, 15 bp, Homo sapiens
ggctggtgggcacca

SEQ ID NO: 2190100 - DNA, 14 bp, Homo sapiens
ggctgtaaaaacac

SEQ ID NO: 2190101 - DNA, 13 bp, Homo sapiens
ggctgtcctttcc

SEQ ID NO: 2190102 - DNA, 23 bp, Homo sapiens
ggctgtgaaaattacacccatgc

SEQ ID NO: 2190103 - DNA, 22 bp, Homo sapiens
ggcttggccaaaacaggctcag

SEQ ID NO: 2190104 - DNA, 20 bp, Homo sapiens
ggctttcatgaggaggcaga

SEQ ID NO: 2190105 - DNA, 15 bp, Homo sapiens
ggctttgtcccacag

SEQ ID NO: 2190106 - DNA, 21 bp, Homo sapiens
ggcttttccttatttttactt

SEQ ID NO: 2190107 - DNA, 22 bp, Homo sapiens
gggaactcccaagaacagcagg

SEQ ID NO: 2190108 - DNA, 22 bp, Homo sapiens
gggaaggccggcagcgggcgga

SEQ ID NO: 2190109 - DNA, 20 bp, Homo sapiens
gggacagctttcctgggtga

SEQ ID NO: 2190110 - DNA, 19 bp, Homo sapiens
gggaccaccctgagccggc

SEQ ID NO: 2190111 - DNA, 21 bp, Homo sapiens
gggactgatgtcatcttgagc

SEQ ID NO: 2190112 - DNA, 17 bp, Homo sapiens
gggagaaggagaggctc

SEQ ID NO: 2190113 - DNA, 15 bp, Homo sapiens
gggagaagggacagc

SEQ ID NO: 2190114 - DNA, 13 bp, Homo sapiens
gggagaggaagca

SEQ ID NO: 2190115 - DNA, 23 bp, Homo sapiens
gtggccagttgacatccaggatg

SEQ ID NO: 2190116 - DNA, 22 bp, Homo sapiens
gtggcccaagcctggtctcctc

SEQ ID NO: 2190117 - DNA, 16 bp, Homo sapiens
gtggccgggggtgggg

SEQ ID NO: 2190118 - DNA, 19 bp, Homo sapiens
gtggcctggctccgctgtg

SEQ ID NO: 2190119 - DNA, 22 bp, Homo sapiens
gtggcgccagccctaggctacc

SEQ ID NO: 2190120 - DNA, 23 bp, Homo sapiens
gtggctaaaggtcccaaggcaag

SEQ ID NO: 2190121 - DNA, 13 bp, Homo sapiens
gtggctaaagtgc

SEQ ID NO: 2190122 - DNA, 24 bp, Homo sapiens
gtggctaccgatttcagcacatgc

SEQ ID NO: 2190123 - DNA, 21 bp, Homo sapiens
gtgggaagcccatcctgacca

SEQ ID NO: 2190124 - DNA, 20 bp, Homo sapiens
gtgggacgggatggttctgg

SEQ ID NO: 2190125 - DNA, 13 bp, Homo sapiens
gtgggagaaggga

SEQ ID NO: 2190126 - DNA, 12 bp, Homo sapiens
gtgggagaggaa

SEQ ID NO: 2190127 - DNA, 17 bp, Homo sapiens
gtgggagaggaagccac

SEQ ID NO: 2190128 - DNA, 16 bp, Homo sapiens
gtgggagtgggagagg

SEQ ID NO: 2190129 - DNA, 17 bp, Homo sapiens
gtgggccccgggctgga

SEQ ID NO: 2190130 - DNA, 20 bp, Homo sapiens
gtgggccccgggctggagaa

SEQ ID NO: 2190131 - DNA, 14 bp, Homo sapiens
gtggggaagagagc

SEQ ID NO: 2190132 - DNA, 17 bp, Homo sapiens
gtggggaagagagcctg

SEQ ID NO: 2190133 - DNA, 20 bp, Homo sapiens
gtggggagacacctcagagc

SEQ ID NO: 2190134 - DNA, 22 bp, Homo sapiens
gtggggagacacctcagagccc

SEQ ID NO: 2190135 - DNA, 16 bp, Homo sapiens
gtggggaggcagaggg

SEQ ID NO: 2190136 - DNA, 13 bp, Homo sapiens
gtggggcgggagg

SEQ ID NO: 2190137 - DNA, 14 bp, Homo sapiens
gtgggggcctgctg

SEQ ID NO: 2190138 - DNA, 15 bp, Homo sapiens
gtgggggcctgctgt

SEQ ID NO: 2190139 - DNA, 14 bp, Homo sapiens
gtgggggtctggga

SEQ ID NO: 2190140 - DNA, 16 bp, Homo sapiens
gtgggggtctgggagg

SEQ ID NO: 2190141 - DNA, 16 bp, Homo sapiens
gtgggggttggctggg

SEQ ID NO: 2190142 - DNA, 19 bp, Homo sapiens
gtgggggttggctgggtac

SEQ ID NO: 2190143 - DNA, 13 bp, Homo sapiens
gtgggtcagtgtg

SEQ ID NO: 2190144 - DNA, 15 bp, Homo sapiens
gtgggtttctctgtg

SEQ ID NO: 2190145 - DNA, 23 bp, Homo sapiens
gtggtattggccgatgagctggt

SEQ ID NO: 2190146 - DNA, 16 bp, Homo sapiens
gtggtccccaaaacac

SEQ ID NO: 2190147 - DNA, 13 bp, Homo sapiens
gtggtctatttct

SEQ ID NO: 2190148 - DNA, 12 bp, Homo sapiens
gtggtggctctg

SEQ ID NO: 2190149 - DNA, 12 bp, Homo sapiens
gtggtgtttttt

SEQ ID NO: 2190150 - DNA, 14 bp, Homo sapiens
gtgtacagtatgtg

SEQ ID NO: 2190151 - DNA, 20 bp, Homo sapiens
gtgtacagtatgtgtctagc

SEQ ID NO: 2190152 - DNA, 13 bp, Homo sapiens
gtgtatgtgttta

SEQ ID NO: 2190153 - DNA, 17 bp, Homo sapiens
gtgtatttactgtacta

SEQ ID NO: 2190154 - DNA, 14 bp, Homo sapiens
gtgtctcctgcatg

SEQ ID NO: 2190155 - DNA, 20 bp, Homo sapiens
gtgtctggtcgtttgaccac

SEQ ID NO: 2190156 - DNA, 20 bp, Homo sapiens
gtgtcttttaatgatactgt

SEQ ID NO: 2190157 - DNA, 13 bp, Homo sapiens
gtgtgagtgtgac

SEQ ID NO: 2190158 - DNA, 22 bp, Homo sapiens
gtgtgccaccctctgcagggca

SEQ ID NO: 2190159 - DNA, 17 bp, Homo sapiens
gtgtgctcttcttcttt

SEQ ID NO: 2190160 - DNA, 22 bp, Homo sapiens
gtgtgtatcaccctcagctggc

SEQ ID NO: 2190161 - DNA, 21 bp, Homo sapiens
gtgtgtcacaaagctaaatac

SEQ ID NO: 2190162 - DNA, 16 bp, Homo sapiens
gtgtgtctcctgcatg

SEQ ID NO: 2190163 - DNA, 14 bp, Homo sapiens
gtgtgttttggtat

SEQ ID NO: 2190164 - DNA, 23 bp, Homo sapiens
gtgttacaatcgttctgtgtttg

SEQ ID NO: 2190165 - DNA, 16 bp, Homo sapiens
gtgttcgtggagccac

SEQ ID NO: 2190166 - DNA, 22 bp, Homo sapiens
gtgttctttgttccactggaaa

SEQ ID NO: 2190167 - DNA, 21 bp, Homo sapiens
gtgttggcttgtgatctggga

SEQ ID NO: 2190168 - DNA, 18 bp, Homo sapiens
gtgtttataattgttata

SEQ ID NO: 2190169 - DNA, 14 bp, Homo sapiens
gtgttttattcact

SEQ ID NO: 2190170 - DNA, 20 bp, Homo sapiens
gttaaaacaaattaaaaaca

SEQ ID NO: 2190171 - DNA, 14 bp, Homo sapiens
gttaagaatttcaa

SEQ ID NO: 2190172 - DNA, 23 bp, Homo sapiens
gttaatattaatttatatttgtc

SEQ ID NO: 2190173 - DNA, 20 bp, Homo sapiens
gttaatgaatagaataaata

SEQ ID NO: 2190174 - DNA, 14 bp, Homo sapiens
gttacagggcccag

SEQ ID NO: 2190175 - DNA, 23 bp, Homo sapiens
gttacctttctaggtcaaggcct

SEQ ID NO: 2190176 - DNA, 13 bp, Homo sapiens
gttagagatgcct

SEQ ID NO: 2190177 - DNA, 23 bp, Homo sapiens
gttagctcagccccagcccagcc

SEQ ID NO: 2190178 - DNA, 19 bp, Homo sapiens
gttaggattaggtttagaa

SEQ ID NO: 2190179 - DNA, 16 bp, Homo sapiens
gttaggctgggcccag

SEQ ID NO: 2190180 - DNA, 15 bp, Homo sapiens
gttagtgatttgcta

SEQ ID NO: 2190181 - DNA, 16 bp, Homo sapiens
gttagtttgtatatat

SEQ ID NO: 2190182 - DNA, 17 bp, Homo sapiens
gttagtttgtatatatt

SEQ ID NO: 2190183 - DNA, 14 bp, Homo sapiens
gttattagaactta

SEQ ID NO: 2190184 - DNA, 19 bp, Homo sapiens
gttcaaaatgttaataaag

SEQ ID NO: 2190185 - DNA, 12 bp, Homo sapiens
gttcactgtgag

SEQ ID NO: 2190186 - DNA, 21 bp, Homo sapiens
gttcaggatttggtttttctc

SEQ ID NO: 2190187 - DNA, 22 bp, Homo sapiens
gttccactgcaaataaagcctt

SEQ ID NO: 2190188 - DNA, 12 bp, Homo sapiens
gttccactggaa

SEQ ID NO: 2190189 - DNA, 19 bp, Homo sapiens
gttccagatacttcagctt

SEQ ID NO: 2190190 - DNA, 19 bp, Homo sapiens
gttccccaccccgggctct

SEQ ID NO: 2190191 - DNA, 20 bp, Homo sapiens
gttccttttatttataacaa

SEQ ID NO: 2190192 - DNA, 15 bp, Homo sapiens
gttctcaaaccctgt

SEQ ID NO: 2190193 - DNA, 23 bp, Homo sapiens
gttctcagaatcccttaacagtt

SEQ ID NO: 2190194 - DNA, 20 bp, Homo sapiens
gttctgaagccatgtagcca

SEQ ID NO: 2190195 - DNA, 14 bp, Homo sapiens
gttctgatgtctta

SEQ ID NO: 2190196 - DNA, 21 bp, Homo sapiens
gttctgctcccagatgccttc

SEQ ID NO: 2190197 - DNA, 15 bp, Homo sapiens
gttctgcttttaagt

SEQ ID NO: 2190198 - DNA, 16 bp, Homo sapiens
gttctgcttttaagtt

SEQ ID NO: 2190199 - DNA, 23 bp, Homo sapiens
gttctggttagctcagccccagc

SEQ ID NO: 2190200 - DNA, 16 bp, Homo sapiens
gttctgtatataaata

SEQ ID NO: 2190201 - DNA, 22 bp, Homo sapiens
gttcttgggcctcaggctctgc

SEQ ID NO: 2190202 - DNA, 15 bp, Homo sapiens
gttctttccggccaa

SEQ ID NO: 2190203 - DNA, 14 bp, Homo sapiens
gttgaataatttgt

SEQ ID NO: 2190204 - DNA, 18 bp, Homo sapiens
gttgagaaaaaagaccct

SEQ ID NO: 2190205 - DNA, 16 bp, Homo sapiens
gttgagaatgcagtga

SEQ ID NO: 2190206 - DNA, 19 bp, Homo sapiens
gttgagattacgctgcctt

SEQ ID NO: 2190207 - DNA, 20 bp, Homo sapiens
gttgaggggcttccctctgc

SEQ ID NO: 2190208 - DNA, 21 bp, Homo sapiens
gttgatacacaggtgagaaag

SEQ ID NO: 2190209 - DNA, 15 bp, Homo sapiens
gttgcaaactcagcc

SEQ ID NO: 2190210 - DNA, 11 bp, Homo sapiens
gttgcatggta

SEQ ID NO: 2190211 - DNA, 21 bp, Homo sapiens
gttgctgtgccccatcagcag

SEQ ID NO: 2190212 - DNA, 13 bp, Homo sapiens
gttgcttctggga

SEQ ID NO: 2190213 - DNA, 12 bp, Homo sapiens
gttgcttttacg

SEQ ID NO: 2190214 - DNA, 15 bp, Homo sapiens
gttggaactgctgcc

SEQ ID NO: 2190215 - DNA, 12 bp, Homo sapiens
gttggggtgggg

SEQ ID NO: 2190216 - DNA, 18 bp, Homo sapiens
gttgtaaatacaattcaa

SEQ ID NO: 2190217 - DNA, 18 bp, Homo sapiens
gttgtacacttgggtgaa

SEQ ID NO: 2190218 - DNA, 13 bp, Homo sapiens
gttgtctgccgtg

SEQ ID NO: 2190219 - DNA, 14 bp, Homo sapiens
gttgtctggcaagg

SEQ ID NO: 2190220 - DNA, 16 bp, Homo sapiens
gttgtctggcaaggac

SEQ ID NO: 2190221 - DNA, 21 bp, Homo sapiens
gttgttcagaagttgttagtg

SEQ ID NO: 2190222 - DNA, 21 bp, Homo sapiens
gttgtttcttttatgtggtgg

SEQ ID NO: 2190223 - DNA, 14 bp, Homo sapiens
gttgtttgatgtgt

SEQ ID NO: 2190224 - DNA, 19 bp, Homo sapiens
gtttacggtacttggtaag

SEQ ID NO: 2190225 - DNA, 19 bp, Homo sapiens
gtttagaaattacaagttt

SEQ ID NO: 2190226 - DNA, 23 bp, Homo sapiens
gtttataatctgacaaagtcatg

SEQ ID NO: 2190227 - DNA, 21 bp, Homo sapiens
gtttataattgttatacattt

SEQ ID NO: 2190228 - DNA, 15 bp, Homo sapiens
gtttcactgttcatg

SEQ ID NO: 2190229 - DNA, 21 bp, Homo sapiens
gtttcagtaatagctgaacct

SEQ ID NO: 2190230 - DNA, 16 bp, Homo sapiens
gtttccaagcctgggc

SEQ ID NO: 2190231 - DNA, 24 bp, Homo sapiens
gtttccaagcctgggccactggca

SEQ ID NO: 2190232 - DNA, 19 bp, Homo sapiens
gtttccagctaagcctgat

SEQ ID NO: 2190233 - DNA, 13 bp, Homo sapiens
gtttccctgctga

SEQ ID NO: 2190234 - DNA, 14 bp, Homo sapiens
gtttccctgctgaa

SEQ ID NO: 2190235 - DNA, 16 bp, Homo sapiens
gtttcgttgcatggta

SEQ ID NO: 2190236 - DNA, 14 bp, Homo sapiens
gtttctctgtgctc

SEQ ID NO: 2190237 - DNA, 18 bp, Homo sapiens
tatttttttgttgctgtt

SEQ ID NO: 2190238 - DNA, 15 bp, Homo sapiens
tattttttttaactg

SEQ ID NO: 2190239 - DNA, 21 bp, Homo sapiens
tattttttttttccattagta

SEQ ID NO: 2190240 - DNA, 21 bp, Homo sapiens
tcaaaagaagcctagaaaaga

SEQ ID NO: 2190241 - DNA, 21 bp, Homo sapiens
tcaaacaattcaatcaaagct

SEQ ID NO: 2190242 - DNA, 17 bp, Homo sapiens
tcaaagattttacctgg

SEQ ID NO: 2190243 - DNA, 22 bp, Homo sapiens
tcaaagcaagctcttctcctca

SEQ ID NO: 2190244 - DNA, 15 bp, Homo sapiens
tcaaagctacctttt

SEQ ID NO: 2190245 - DNA, 19 bp, Homo sapiens
tcaaagcttttgtaaaata

SEQ ID NO: 2190246 - DNA, 17 bp, Homo sapiens
tcaaagtggtacaggaa

SEQ ID NO: 2190247 - DNA, 18 bp, Homo sapiens
tcaaagtggtacaggaag

SEQ ID NO: 2190248 - DNA, 18 bp, Homo sapiens
tcaaagtttttacagtgt

SEQ ID NO: 2190249 - DNA, 18 bp, Homo sapiens
tcaaatacttcaaatcat

SEQ ID NO: 2190250 - DNA, 19 bp, Homo sapiens
tcaaatacttcaaatcata

SEQ ID NO: 2190251 - DNA, 18 bp, Homo sapiens
tcaaccctctcaggtgac

SEQ ID NO: 2190252 - DNA, 23 bp, Homo sapiens
tcaacctaaaacaatctgtaatt

SEQ ID NO: 2190253 - DNA, 22 bp, Homo sapiens
tcaagactgactggcaccaaca

SEQ ID NO: 2190254 - DNA, 23 bp, Homo sapiens
tcaagactgactggcaccaacac

SEQ ID NO: 2190255 - DNA, 14 bp, Homo sapiens
tcaagcaatcctcc

SEQ ID NO: 2190256 - DNA, 16 bp, Homo sapiens
tcaagcaatcctcctg

SEQ ID NO: 2190257 - DNA, 18 bp, Homo sapiens
tcaagcaatcctcctgag

SEQ ID NO: 2190258 - DNA, 14 bp, Homo sapiens
tcaagcaccaggga

SEQ ID NO: 2190259 - DNA, 19 bp, Homo sapiens
tcaaggatatactgcagct

SEQ ID NO: 2190260 - DNA, 23 bp, Homo sapiens
tcaaggattcaatgcatttttaa

SEQ ID NO: 2190261 - DNA, 12 bp, Homo sapiens
tcaaggccgtgt

SEQ ID NO: 2190262 - DNA, 21 bp, Homo sapiens
tcaaggccgtgtccccttgtt

SEQ ID NO: 2190263 - DNA, 12 bp, Homo sapiens
tcaagtctgtga

SEQ ID NO: 2190264 - DNA, 20 bp, Homo sapiens
tcaagtctgtgcctggagct

SEQ ID NO: 2190265 - DNA, 22 bp, Homo sapiens
tcaataaagtactgcaaaatgc

SEQ ID NO: 2190266 - DNA, 19 bp, Homo sapiens
tcaataattgtggagagga

SEQ ID NO: 2190267 - DNA, 21 bp, Homo sapiens
tcaataattgtggagaggaga

SEQ ID NO: 2190268 - DNA, 22 bp, Homo sapiens
tcaataattgtggagaggagag

SEQ ID NO: 2190269 - DNA, 13 bp, Homo sapiens
tcaatcaaagcta

SEQ ID NO: 2190270 - DNA, 14 bp, Homo sapiens
tcaatcaaagctac

SEQ ID NO: 2190271 - DNA, 18 bp, Homo sapiens
tcaatcaaagctaccttt

SEQ ID NO: 2190272 - DNA, 21 bp, Homo sapiens
tcaatctaggcgaggcgaagc

SEQ ID NO: 2190273 - DNA, 11 bp, Homo sapiens
tcaatctctgt

SEQ ID NO: 2190274 - DNA, 12 bp, Homo sapiens
tcaatctctgtt

SEQ ID NO: 2190275 - DNA, 15 bp, Homo sapiens
tcaatctctgttctg

SEQ ID NO: 2190276 - DNA, 16 bp, Homo sapiens
tcaatctctgttctgc

SEQ ID NO: 2190277 - DNA, 19 bp, Homo sapiens
tcaatggactgcaccttgt

SEQ ID NO: 2190278 - DNA, 14 bp, Homo sapiens
tcaatttctcccca

SEQ ID NO: 2190279 - DNA, 15 bp, Homo sapiens
tcaatttctccccag

SEQ ID NO: 2190280 - DNA, 14 bp, Homo sapiens
tcaattttttttct

SEQ ID NO: 2190281 - DNA, 17 bp, Homo sapiens
tcacaaagctaaataca

SEQ ID NO: 2190282 - DNA, 18 bp, Homo sapiens
tcacaaagctaaatacat

SEQ ID NO: 2190283 - DNA, 17 bp, Homo sapiens
tcacaagcctcttctga

SEQ ID NO: 2190284 - DNA, 13 bp, Homo sapiens
tcacaagctgcct

SEQ ID NO: 2190285 - DNA, 16 bp, Homo sapiens
tcacaagctgcctccc

SEQ ID NO: 2190286 - DNA, 23 bp, Homo sapiens
tcacaagctgcctccctgtccac

SEQ ID NO: 2190287 - DNA, 21 bp, Homo sapiens
tcacacagcacctcctctctg

SEQ ID NO: 2190288 - DNA, 18 bp, Homo sapiens
tcacaccataactaggta

SEQ ID NO: 2190289 - DNA, 12 bp, Homo sapiens
tcacagaggcag

SEQ ID NO: 2190290 - DNA, 16 bp, Homo sapiens
tcacagaggcagtggc

SEQ ID NO: 2190291 - DNA, 23 bp, Homo sapiens
tcacagtggggtttttttgtctt

SEQ ID NO: 2190292 - DNA, 14 bp, Homo sapiens
tcacatgctggaca

SEQ ID NO: 2190293 - DNA, 17 bp, Homo sapiens
tcacattccatttctct

SEQ ID NO: 2190294 - DNA, 11 bp, Homo sapiens
tcaccaaggaa

SEQ ID NO: 2190295 - DNA, 14 bp, Homo sapiens
tcaccaaggaaata

SEQ ID NO: 2190296 - DNA, 17 bp, Homo sapiens
tcaccaggggaggagcc

SEQ ID NO: 2190297 - DNA, 16 bp, Homo sapiens
tcacccaggctggagt

SEQ ID NO: 2190298 - DNA, 19 bp, Homo sapiens
tcaccctgcttggggcctg

SEQ ID NO: 2190299 - DNA, 23 bp, Homo sapiens
tcacctgccccgtagagaatgtg

SEQ ID NO: 2190300 - DNA, 20 bp, Homo sapiens
tcacctgcgcagggccctct

SEQ ID NO: 2190301 - DNA, 20 bp, Homo sapiens
tcacctgtgcagggccctct

SEQ ID NO: 2190302 - DNA, 15 bp, Homo sapiens
tcacctttcccagat

SEQ ID NO: 2190303 - DNA, 23 bp, Homo sapiens
tcactatggtgccaatggaacct

SEQ ID NO: 2190304 - DNA, 23 bp, Homo sapiens
tcactccaggaaggggctggact

SEQ ID NO: 2190305 - DNA, 19 bp, Homo sapiens
tcactcggctgtggagaac

SEQ ID NO: 2190306 - DNA, 23 bp, Homo sapiens
tcactcggctttggctcgggact

SEQ ID NO: 2190307 - DNA, 15 bp, Homo sapiens
tcactgcaacctcca

SEQ ID NO: 2190308 - DNA, 14 bp, Homo sapiens
tcactgcagcctcg

SEQ ID NO: 2190309 - DNA, 15 bp, Homo sapiens
tcactgcagcctcga

SEQ ID NO: 2190310 - DNA, 16 bp, Homo sapiens
tcactgtgagttctga

SEQ ID NO: 2190311 - DNA, 17 bp, Homo sapiens
tcacttaaatgttacca

SEQ ID NO: 2190312 - DNA, 13 bp, Homo sapiens
tcactttgcgtgt

SEQ ID NO: 2190313 - DNA, 20 bp, Homo sapiens
tcactttgtattctctgtcc

SEQ ID NO: 2190314 - DNA, 20 bp, Homo sapiens
tcagaacattcagctctgga

SEQ ID NO: 2190315 - DNA, 23 bp, Homo sapiens
tcagaacattcagctctggagaa

SEQ ID NO: 2190316 - DNA, 16 bp, Homo sapiens
tcagaataaagaacat

SEQ ID NO: 2190317 - DNA, 19 bp, Homo sapiens
tcagaatagtgatgtgttc

SEQ ID NO: 2190318 - DNA, 17 bp, Homo sapiens
tcagagctacttgggcc

SEQ ID NO: 2190319 - DNA, 19 bp, Homo sapiens
tcagataatcggtgcagcg

SEQ ID NO: 2190320 - DNA, 16 bp, Homo sapiens
tcagatacttgtgaac

SEQ ID NO: 2190321 - DNA, 16 bp, Homo sapiens
tcagatcctgctgccg

SEQ ID NO: 2190322 - DNA, 21 bp, Homo sapiens
tcagcacatgcactactgaaa

SEQ ID NO: 2190323 - DNA, 18 bp, Homo sapiens
tcagcatcctccacgggc

SEQ ID NO: 2190324 - DNA, 18 bp, Homo sapiens
tcagccagtggggatgag

SEQ ID NO: 2190325 - DNA, 14 bp, Homo sapiens
tcagccctgagctg

SEQ ID NO: 2190326 - DNA, 15 bp, Homo sapiens
tcagccctgagctgg

SEQ ID NO: 2190327 - DNA, 20 bp, Homo sapiens
tcagcctccagagtagctgg

SEQ ID NO: 2190328 - DNA, 15 bp, Homo sapiens
tcagcctctggccag

SEQ ID NO: 2190329 - DNA, 16 bp, Homo sapiens
tcagctattaagaaaa

SEQ ID NO: 2190330 - DNA, 13 bp, Homo sapiens
tcagctctggaga

SEQ ID NO: 2190331 - DNA, 16 bp, Homo sapiens
tcagctctggagaaca

SEQ ID NO: 2190332 - DNA, 21 bp, Homo sapiens
tcagctcttgtacagacatgt

SEQ ID NO: 2190333 - DNA, 22 bp, Homo sapiens
tcaggaaaggaagatgtaagaa

SEQ ID NO: 2190334 - DNA, 17 bp, Homo sapiens
tcaggaacctggaccaa

SEQ ID NO: 2190335 - DNA, 23 bp, Homo sapiens
tcaggaacctggaccaaagctga

SEQ ID NO: 2190336 - DNA, 20 bp, Homo sapiens
tcaggagagagcttcctgtt

SEQ ID NO: 2190337 - DNA, 21 bp, Homo sapiens
tcaggaggagattaacacact

SEQ ID NO: 2190338 - DNA, 13 bp, Homo sapiens
tcaggaggagggc

SEQ ID NO: 2190339 - DNA, 23 bp, Homo sapiens
tcaggaggagggcgcatgtgtgt

SEQ ID NO: 2190340 - DNA, 20 bp, Homo sapiens
tcaggatttggtttttctct

SEQ ID NO: 2190341 - DNA, 13 bp, Homo sapiens
tcaggttccaaat

SEQ ID NO: 2190342 - DNA, 21 bp, Homo sapiens
tcagtaacttacccttaggga

SEQ ID NO: 2190343 - DNA, 21 bp, Homo sapiens
tcagtattgtgtaaaggaaca

SEQ ID NO: 2190344 - DNA, 15 bp, Homo sapiens
tcagtctgctttctc

SEQ ID NO: 2190345 - DNA, 17 bp, Homo sapiens
tcagtgactcctgctgg

SEQ ID NO: 2190346 - DNA, 12 bp, Homo sapiens
tcagtgatggga

SEQ ID NO: 2190347 - DNA, 15 bp, Homo sapiens
tcagtgatgggagta

SEQ ID NO: 2190348 - DNA, 15 bp, Homo sapiens
tcagtgcattttcaa

SEQ ID NO: 2190349 - DNA, 21 bp, Homo sapiens
tcagtgccaagtctcaggagg

SEQ ID NO: 2190350 - DNA, 15 bp, Homo sapiens
tcagtgtagccccaa

SEQ ID NO: 2190351 - DNA, 12 bp, Homo sapiens
tcagtgtgaagc

SEQ ID NO: 2190352 - DNA, 13 bp, Homo sapiens
tcagtgtgccacc

SEQ ID NO: 2190353 - DNA, 19 bp, Homo sapiens
tcagtgtgccaccctctgc

SEQ ID NO: 2190354 - DNA, 22 bp, Homo sapiens
tcagtgtgccaccctctgcagg

SEQ ID NO: 2190355 - DNA, 20 bp, Homo sapiens
tcagttagataaaaataaaa

SEQ ID NO: 2190356 - DNA, 20 bp, Homo sapiens
tcagttttgtgtacagtatg

SEQ ID NO: 2190357 - DNA, 16 bp, Homo sapiens
tcatatcaagaaattg

SEQ ID NO: 2190358 - DNA, 21 bp, Homo sapiens
tgactcctgctggtacctgcc

SEQ ID NO: 2190359 - DNA, 17 bp, Homo sapiens
tgactgaatttctatgg

SEQ ID NO: 2190360 - DNA, 17 bp, Homo sapiens
tgactgccaagccagat

SEQ ID NO: 2190361 - DNA, 12 bp, Homo sapiens
tgactggacagc

SEQ ID NO: 2190362 - DNA, 15 bp, Homo sapiens
tgactggcaccaaca

SEQ ID NO: 2190363 - DNA, 19 bp, Homo sapiens
tgactggcaccaacacttt

SEQ ID NO: 2190364 - DNA, 16 bp, Homo sapiens
tgacttccctccaccc

SEQ ID NO: 2190365 - DNA, 22 bp, Homo sapiens
tgacttggttctgaagccatgt

SEQ ID NO: 2190366 - DNA, 15 bp, Homo sapiens
tgacttttaaaattt

SEQ ID NO: 2190367 - DNA, 22 bp, Homo sapiens
tgagaacagatctccaaagctt

SEQ ID NO: 2190368 - DNA, 22 bp, Homo sapiens
tgagaatgaccctgtcaagctt

SEQ ID NO: 2190369 - DNA, 15 bp, Homo sapiens
tgagaattaaaataa

SEQ ID NO: 2190370 - DNA, 18 bp, Homo sapiens
tgagaattaaaataaaac

SEQ ID NO: 2190371 - DNA, 16 bp, Homo sapiens
tgagaattcagctgcc

SEQ ID NO: 2190372 - DNA, 15 bp, Homo sapiens
tgagacctggaacca

SEQ ID NO: 2190373 - DNA, 18 bp, Homo sapiens
tgagacctggaaccagag

SEQ ID NO: 2190374 - DNA, 15 bp, Homo sapiens
tgagaccttgatgag

SEQ ID NO: 2190375 - DNA, 23 bp, Homo sapiens
tgagactcctgattgctctggaa

SEQ ID NO: 2190376 - DNA, 11 bp, Homo sapiens
tgagagagtgt

SEQ ID NO: 2190377 - DNA, 15 bp, Homo sapiens
tgagagccccttggt

SEQ ID NO: 2190378 - DNA, 14 bp, Homo sapiens
tgagagcgctggcc

SEQ ID NO: 2190379 - DNA, 20 bp, Homo sapiens
tgagagggatgcagtgcctt

SEQ ID NO: 2190380 - DNA, 16 bp, Homo sapiens
tgagcaaacctgcccc

SEQ ID NO: 2190381 - DNA, 18 bp, Homo sapiens
tgagcaaacctgccccat

SEQ ID NO: 2190382 - DNA, 19 bp, Homo sapiens
tgagcaaacctgccccatc

SEQ ID NO: 2190383 - DNA, 17 bp, Homo sapiens
tgagcaagacgccctct

SEQ ID NO: 2190384 - DNA, 17 bp, Homo sapiens
tgagcacacaacaggct

SEQ ID NO: 2190385 - DNA, 15 bp, Homo sapiens
tgagcagtgtgtctc

SEQ ID NO: 2190386 - DNA, 18 bp, Homo sapiens
tgagcagtgtgtctcctg

SEQ ID NO: 2190387 - DNA, 18 bp, Homo sapiens
tgagccaccacacccagc

SEQ ID NO: 2190388 - DNA, 17 bp, Homo sapiens
tgagccactgtgcccag

SEQ ID NO: 2190389 - DNA, 15 bp, Homo sapiens
tgagctgaagacaaa

SEQ ID NO: 2190390 - DNA, 19 bp, Homo sapiens
tgagctggcctcacctggg

SEQ ID NO: 2190391 - DNA, 22 bp, Homo sapiens
tgagctggcctcacctgggttc

SEQ ID NO: 2190392 - DNA, 17 bp, Homo sapiens
tgagcttgctggagagt

SEQ ID NO: 2190393 - DNA, 15 bp, Homo sapiens
tgagctttggacaca

SEQ ID NO: 2190394 - DNA, 22 bp, Homo sapiens
tgagctttggacacacacagct

SEQ ID NO: 2190395 - DNA, 19 bp, Homo sapiens
tgaggaagctccagtcctg

SEQ ID NO: 2190396 - DNA, 23 bp, Homo sapiens
tgaggaagctccagtcctgctct

SEQ ID NO: 2190397 - DNA, 16 bp, Homo sapiens
tgaggagcaaagcagc

SEQ ID NO: 2190398 - DNA, 24 bp, Homo sapiens
tgaggaggcagaaagcagaggctg

SEQ ID NO: 2190399 - DNA, 16 bp, Homo sapiens
tgaggagtcttgtgtg

SEQ ID NO: 2190400 - DNA, 17 bp, Homo sapiens
tgaggcagaacctggtg

SEQ ID NO: 2190401 - DNA, 19 bp, Homo sapiens
tgaggcagaacctggtggc

SEQ ID NO: 2190402 - DNA, 23 bp, Homo sapiens
tgaggcagaacctggtggctgga

SEQ ID NO: 2190403 - DNA, 17 bp, Homo sapiens
tgaggctcagccctgag

SEQ ID NO: 2190404 - DNA, 19 bp, Homo sapiens
tgaggctcagccctgagct

SEQ ID NO: 2190405 - DNA, 20 bp, Homo sapiens
tgaggctcagccctgagctg

SEQ ID NO: 2190406 - DNA, 14 bp, Homo sapiens
tgaggggcttccct

SEQ ID NO: 2190407 - DNA, 18 bp, Homo sapiens
tgaggggcttccctctgc

SEQ ID NO: 2190408 - DNA, 15 bp, Homo sapiens
tgaggtatctgtgtt

SEQ ID NO: 2190409 - DNA, 17 bp, Homo sapiens
tgaggtcaccaggggag

SEQ ID NO: 2190410 - DNA, 16 bp, Homo sapiens
tgaggttgttcaaagt

SEQ ID NO: 2190411 - DNA, 22 bp, Homo sapiens
tgaggttttatttcatttttca

SEQ ID NO: 2190412 - DNA, 16 bp, Homo sapiens
tgagtattacacatta

SEQ ID NO: 2190413 - DNA, 14 bp, Homo sapiens
tgagtcccttccag

SEQ ID NO: 2190414 - DNA, 16 bp, Homo sapiens
tgagtcccttccaggc

SEQ ID NO: 2190415 - DNA, 13 bp, Homo sapiens
tgagtgggaagcc

SEQ ID NO: 2190416 - DNA, 19 bp, Homo sapiens
tgagtggggagacacctca

SEQ ID NO: 2190417 - DNA, 21 bp, Homo sapiens
tgagtgtgcaagcaaagaacc

SEQ ID NO: 2190418 - DNA, 23 bp, Homo sapiens
tgataaacagttgaataatttgt

SEQ ID NO: 2190419 - DNA, 19 bp, Homo sapiens
tgatacacaggtgagaaag

SEQ ID NO: 2190420 - DNA, 17 bp, Homo sapiens
tgatactgtctaagaat

SEQ ID NO: 2190421 - DNA, 13 bp, Homo sapiens
tgatatattcttt

SEQ ID NO: 2190422 - DNA, 22 bp, Homo sapiens
tgatatattctttccatgcagt

SEQ ID NO: 2190423 - DNA, 22 bp, Homo sapiens
tgatatatttataaatatgtga

SEQ ID NO: 2190424 - DNA, 13 bp, Homo sapiens
tgatatttgtgta

SEQ ID NO: 2190425 - DNA, 16 bp, Homo sapiens
tgatatttgtgtaaag

SEQ ID NO: 2190426 - DNA, 22 bp, Homo sapiens
tgatcagtgagctcaggagaga

SEQ ID NO: 2190427 - DNA, 19 bp, Homo sapiens
tgatcatttgcagctgctg

SEQ ID NO: 2190428 - DNA, 20 bp, Homo sapiens
tgatcctcctgtcttggcct

SEQ ID NO: 2190429 - DNA, 22 bp, Homo sapiens
tgatctgggaactcccaagaac

SEQ ID NO: 2190430 - DNA, 13 bp, Homo sapiens
tgatctttgcaaa

SEQ ID NO: 2190431 - DNA, 22 bp, Homo sapiens
tgatgaatttggtctgcctctg

SEQ ID NO: 2190432 - DNA, 16 bp, Homo sapiens
tgatgactgctgattt

SEQ ID NO: 2190433 - DNA, 14 bp, Homo sapiens
tgatgatggaaggg

SEQ ID NO: 2190434 - DNA, 22 bp, Homo sapiens
tgatgatgtgtttaaactgagt

SEQ ID NO: 2190435 - DNA, 16 bp, Homo sapiens
tgatggggtttagcaa

SEQ ID NO: 2190436 - DNA, 16 bp, Homo sapiens
tgatgtagacatttta

SEQ ID NO: 2190437 - DNA, 11 bp, Homo sapiens
tgatgtcatct

SEQ ID NO: 2190438 - DNA, 16 bp, Homo sapiens
tgatgtcatcttgagc

SEQ ID NO: 2190439 - DNA, 20 bp, Homo sapiens
tgatgtcttgagagcgctgg

SEQ ID NO: 2190440 - DNA, 14 bp, Homo sapiens
tgatgtgtatgtgt

SEQ ID NO: 2190441 - DNA, 17 bp, Homo sapiens
tgatgttaggctgggcc

SEQ ID NO: 2190442 - DNA, 19 bp, Homo sapiens
tgattcaataaaatgcact

SEQ ID NO: 2190443 - DNA, 16 bp, Homo sapiens
tgattccatctccttg

SEQ ID NO: 2190444 - DNA, 21 bp, Homo sapiens
tgattcttgattttcaagctt

SEQ ID NO: 2190445 - DNA, 14 bp, Homo sapiens
tgattgccaacagt

SEQ ID NO: 2190446 - DNA, 18 bp, Homo sapiens
tgattgccatttcttccc

SEQ ID NO: 2190447 - DNA, 22 bp, Homo sapiens
tgattgctctggaagcctgctg

SEQ ID NO: 2190448 - DNA, 12 bp, Homo sapiens
tgatttgcatgt

SEQ ID NO: 2190449 - DNA, 22 bp, Homo sapiens
tgatttggccgttttgtgaaga

SEQ ID NO: 2190450 - DNA, 21 bp, Homo sapiens
tgattttggccactttgcaga

SEQ ID NO: 2190451 - DNA, 19 bp, Homo sapiens
tgattttttttttaacttg

SEQ ID NO: 2190452 - DNA, 17 bp, Homo sapiens
tgcaaaagaagttgatc

SEQ ID NO: 2190453 - DNA, 18 bp, Homo sapiens
tgcaaaagaagttgatct

SEQ ID NO: 2190454 - DNA, 22 bp, Homo sapiens
tgcaaacactgtgattactctt

SEQ ID NO: 2190455 - DNA, 15 bp, Homo sapiens
tgcaaagggacattg

SEQ ID NO: 2190456 - DNA, 16 bp, Homo sapiens
tgcaaagtgccctcat

SEQ ID NO: 2190457 - DNA, 15 bp, Homo sapiens
tgcaacgtgtaactt

SEQ ID NO: 2190458 - DNA, 15 bp, Homo sapiens
tgcaagcaaagcaga

SEQ ID NO: 2190459 - DNA, 21 bp, Homo sapiens
tgcaaggccttgaagacatga

SEQ ID NO: 2190460 - DNA, 16 bp, Homo sapiens
tgcaagtgaaataata

SEQ ID NO: 2190461 - DNA, 17 bp, Homo sapiens
tgcaagtgaaataatat

SEQ ID NO: 2190462 - DNA, 22 bp, Homo sapiens
tgcaagtgagcaaacctgcccc

SEQ ID NO: 2190463 - DNA, 20 bp, Homo sapiens
tgcaatacatttcttccttc

SEQ ID NO: 2190464 - DNA, 21 bp, Homo sapiens
tgcaatacggaacactgtcaa

SEQ ID NO: 2190465 - DNA, 16 bp, Homo sapiens
tgcaatgaaaagaaaa

SEQ ID NO: 2190466 - DNA, 16 bp, Homo sapiens
tgcaatttcttctgta

SEQ ID NO: 2190467 - DNA, 17 bp, Homo sapiens
tgcacaccagttactgt

SEQ ID NO: 2190468 - DNA, 18 bp, Homo sapiens
tgcacaccagttactgtt

SEQ ID NO: 2190469 - DNA, 23 bp, Homo sapiens
tgcacaccagttactgttcatgg

SEQ ID NO: 2190470 - DNA, 13 bp, Homo sapiens
tgcacagacaagc

SEQ ID NO: 2190471 - DNA, 17 bp, Homo sapiens
tgcacaggaaataagcc

SEQ ID NO: 2190472 - DNA, 16 bp, Homo sapiens
tgcacagggccctctg

SEQ ID NO: 2190473 - DNA, 21 bp, Homo sapiens
tgcacagggccctctgaggct

SEQ ID NO: 2190474 - DNA, 14 bp, Homo sapiens
tgcacctataaata

SEQ ID NO: 2190475 - DNA, 16 bp, Homo sapiens
tgcactatagccattt

SEQ ID NO: 2190476 - DNA, 14 bp, Homo sapiens
tgcactcaagaccc

SEQ ID NO: 2190477 - DNA, 14 bp, Homo sapiens
tgcagaaggaaaga

SEQ ID NO: 2190478 - DNA, 16 bp, Homo sapiens
tgcagatgccagagca

SEQ ID NO: 2190479 - DNA, 13 bp, Homo sapiens
tgttcagaagttg

SEQ ID NO: 2190480 - DNA, 21 bp, Homo sapiens
tgttcagaagttgttagtgat

SEQ ID NO: 2190481 - DNA, 19 bp, Homo sapiens
tgttccaacagttaaactt

SEQ ID NO: 2190482 - DNA, 20 bp, Homo sapiens
tgttccaacagttaaacttg

SEQ ID NO: 2190483 - DNA, 23 bp, Homo sapiens
tgttccaacagttaaacttgcaa

SEQ ID NO: 2190484 - DNA, 21 bp, Homo sapiens
tgttccactgcaaataaagcc

SEQ ID NO: 2190485 - DNA, 23 bp, Homo sapiens
tgttccactgcaaataaagcctt

SEQ ID NO: 2190486 - DNA, 14 bp, Homo sapiens
tgttcccatgtcta

SEQ ID NO: 2190487 - DNA, 20 bp, Homo sapiens
tgttcctttttaggtacagt

SEQ ID NO: 2190488 - DNA, 15 bp, Homo sapiens
tgttcttttctggta

SEQ ID NO: 2190489 - DNA, 23 bp, Homo sapiens
tgttcttttctggtaggttctgt

SEQ ID NO: 2190490 - DNA, 14 bp, Homo sapiens
tgttgcccaggctg

SEQ ID NO: 2190491 - DNA, 13 bp, Homo sapiens
tgttgcttttacg

SEQ ID NO: 2190492 - DNA, 23 bp, Homo sapiens
tgttggtgcgaaagtaaaaacac

SEQ ID NO: 2190493 - DNA, 16 bp, Homo sapiens
tgttgtttcttttatg

SEQ ID NO: 2190494 - DNA, 15 bp, Homo sapiens
tgttgtttgatgtgt

SEQ ID NO: 2190495 - DNA, 17 bp, Homo sapiens
tgtttctaaacagttga

SEQ ID NO: 2190496 - DNA, 20 bp, Homo sapiens
tgtttctaagtggcctgcag

SEQ ID NO: 2190497 - DNA, 17 bp, Homo sapiens
tgtttgatatttgtgta

SEQ ID NO: 2190498 - DNA, 19 bp, Homo sapiens
tgtttgatatttgtgtaaa

SEQ ID NO: 2190499 - DNA, 13 bp, Homo sapiens
tgtttggtataaa

SEQ ID NO: 2190500 - DNA, 15 bp, Homo sapiens
tgtttgtatataaat

SEQ ID NO: 2190501 - DNA, 15 bp, Homo sapiens
tgtttgtcattttga

SEQ ID NO: 2190502 - DNA, 16 bp, Homo sapiens
tgtttgtcttctcccc

SEQ ID NO: 2190503 - DNA, 15 bp, Homo sapiens
tgtttgtgagtatgt

SEQ ID NO: 2190504 - DNA, 16 bp, Homo sapiens
tgtttgtgagtatgtg

SEQ ID NO: 2190505 - DNA, 17 bp, Homo sapiens
tgtttgtgagtatgtgt

SEQ ID NO: 2190506 - DNA, 14 bp, Homo sapiens
tgttttgttggccc

SEQ ID NO: 2190507 - DNA, 15 bp, Homo sapiens
tgtttttaagaaaaa

SEQ ID NO: 2190508 - DNA, 18 bp, Homo sapiens
tgtttttcctgtgtatta

SEQ ID NO: 2190509 - DNA, 14 bp, Homo sapiens
ttaaaaatatgtga

SEQ ID NO: 2190510 - DNA, 16 bp, Homo sapiens
ttaaaaattaattctt

SEQ ID NO: 2190511 - DNA, 15 bp, Homo sapiens
ttaaaacaaattaaa

SEQ ID NO: 2190512 - DNA, 13 bp, Homo sapiens
ttaaaataaaacg

SEQ ID NO: 2190513 - DNA, 20 bp, Homo sapiens
ttaaaccaaacggaactctt

SEQ ID NO: 2190514 - DNA, 23 bp, Homo sapiens
ttaaactactatttttctttcca

SEQ ID NO: 2190515 - DNA, 22 bp, Homo sapiens
ttaaactgaaagctttaatgtt

SEQ ID NO: 2190516 - DNA, 15 bp, Homo sapiens
ttaaagaaaattgcc

SEQ ID NO: 2190517 - DNA, 18 bp, Homo sapiens
ttaaagaaaattgccaaa

SEQ ID NO: 2190518 - DNA, 23 bp, Homo sapiens
ttaaagaaaattgccaaaatata

SEQ ID NO: 2190519 - DNA, 21 bp, Homo sapiens
ttaaagctgtttctaaacagt

SEQ ID NO: 2190520 - DNA, 22 bp, Homo sapiens
ttaaagtaaaaggcactgcaca

SEQ ID NO: 2190521 - DNA, 20 bp, Homo sapiens
ttaaagtcacacatttctat

SEQ ID NO: 2190522 - DNA, 14 bp, Homo sapiens
ttaaataaattatg

SEQ ID NO: 2190523 - DNA, 20 bp, Homo sapiens
ttaaatcagttttgtgtaca

SEQ ID NO: 2190524 - DNA, 15 bp, Homo sapiens
ttaaatgaaaaaaga

SEQ ID NO: 2190525 - DNA, 21 bp, Homo sapiens
ttaaattattatcttcttaac

SEQ ID NO: 2190526 - DNA, 18 bp, Homo sapiens
ttaacacatggcttccta

SEQ ID NO: 2190527 - DNA, 15 bp, Homo sapiens
ttaacagaaattgta

SEQ ID NO: 2190528 - DNA, 16 bp, Homo sapiens
ttaacagaaattgtat

SEQ ID NO: 2190529 - DNA, 17 bp, Homo sapiens
ttaacagaaattgtata

SEQ ID NO: 2190530 - DNA, 16 bp, Homo sapiens
ttaacatatattgtta

SEQ ID NO: 2190531 - DNA, 17 bp, Homo sapiens
ttaacctacctgtgaat

SEQ ID NO: 2190532 - DNA, 15 bp, Homo sapiens
ttaagaaaaacatgt

SEQ ID NO: 2190533 - DNA, 14 bp, Homo sapiens
ttaagaactatatt

SEQ ID NO: 2190534 - DNA, 13 bp, Homo sapiens
ttaagacaaatgg

SEQ ID NO: 2190535 - DNA, 14 bp, Homo sapiens
ttaagacaaatggg

SEQ ID NO: 2190536 - DNA, 16 bp, Homo sapiens
ttaagcaactggaaaa

SEQ ID NO: 2190537 - DNA, 22 bp, Homo sapiens
ttaagcaactggaaaagtgttc

SEQ ID NO: 2190538 - DNA, 19 bp, Homo sapiens
ttaagggggtgtaatgaaa

SEQ ID NO: 2190539 - DNA, 14 bp, Homo sapiens
ttaagttgttgaaa

SEQ ID NO: 2190540 - DNA, 17 bp, Homo sapiens
ttaagttgttgaaagta

SEQ ID NO: 2190541 - DNA, 12 bp, Homo sapiens
ttaagtttagaa

SEQ ID NO: 2190542 - DNA, 20 bp, Homo sapiens
ttaagtttttctctttttca

SEQ ID NO: 2190543 - DNA, 13 bp, Homo sapiens
ttaataaaggttt

SEQ ID NO: 2190544 - DNA, 22 bp, Homo sapiens
ttaataaaggtttcgttgcatg

SEQ ID NO: 2190545 - DNA, 13 bp, Homo sapiens
ttaataataaaaa

SEQ ID NO: 2190546 - DNA, 13 bp, Homo sapiens
ttaatatatataa

SEQ ID NO: 2190547 - DNA, 14 bp, Homo sapiens
ttaatattaattta

SEQ ID NO: 2190548 - DNA, 20 bp, Homo sapiens
ttaatgatactgtctaagaa

SEQ ID NO: 2190549 - DNA, 14 bp, Homo sapiens
ttaatgtagataaa

SEQ ID NO: 2190550 - DNA, 18 bp, Homo sapiens
ttaatgtagataaagcac

SEQ ID NO: 2190551 - DNA, 12 bp, Homo sapiens
ttaattaaatat

SEQ ID NO: 2190552 - DNA, 14 bp, Homo sapiens
ttaatttatatttg

SEQ ID NO: 2190553 - DNA, 16 bp, Homo sapiens
ttacaagtttcagtaa

SEQ ID NO: 2190554 - DNA, 19 bp, Homo sapiens
ttacaagtttcagtaatag

SEQ ID NO: 2190555 - DNA, 15 bp, Homo sapiens
ttacaatcgttctgt

SEQ ID NO: 2190556 - DNA, 21 bp, Homo sapiens
ttacacacgtgtgatgtatgt

SEQ ID NO: 2190557 - DNA, 14 bp, Homo sapiens
ttacacccatgcac

SEQ ID NO: 2190558 - DNA, 15 bp, Homo sapiens
ttacagcttttctct

SEQ ID NO: 2190559 - DNA, 16 bp, Homo sapiens
ttacaggtgtgagcca

SEQ ID NO: 2190560 - DNA, 16 bp, Homo sapiens
ttacatgaccagaaaa

SEQ ID NO: 2190561 - DNA, 17 bp, Homo sapiens
ttaccctactggctgta

SEQ ID NO: 2190562 - DNA, 12 bp, Homo sapiens
ttacccttctgt

SEQ ID NO: 2190563 - DNA, 17 bp, Homo sapiens
ttacccttctgtgccca

SEQ ID NO: 2190564 - DNA, 21 bp, Homo sapiens
ttacctgcatgtgttgtacaa

SEQ ID NO: 2190565 - DNA, 13 bp, Homo sapiens
ttacctgcttctg

SEQ ID NO: 2190566 - DNA, 16 bp, Homo sapiens
ttacctgcttctggtt

SEQ ID NO: 2190567 - DNA, 12 bp, Homo sapiens
ttacggaattcc

SEQ ID NO: 2190568 - DNA, 13 bp, Homo sapiens
ttacggaattcca

SEQ ID NO: 2190569 - DNA, 14 bp, Homo sapiens
ttacggaattccaa

SEQ ID NO: 2190570 - DNA, 15 bp, Homo sapiens
ttacggaattccaat

SEQ ID NO: 2190571 - DNA, 16 bp, Homo sapiens
ttacggaattccaata

SEQ ID NO: 2190572 - DNA, 15 bp, Homo sapiens
ttacgtgtgcaacag

SEQ ID NO: 2190573 - DNA, 23 bp, Homo sapiens
ttactacacagtttggttacagg

SEQ ID NO: 2190574 - DNA, 18 bp, Homo sapiens
ttactgccttcctcctta

SEQ ID NO: 2190575 - DNA, 11 bp, Homo sapiens
ttacttacctg

SEQ ID NO: 2190576 - DNA, 13 bp, Homo sapiens
ttacttacctgca

SEQ ID NO: 2190577 - DNA, 15 bp, Homo sapiens
ttacttgtatgtagc

SEQ ID NO: 2190578 - DNA, 17 bp, Homo sapiens
ttagaaagactttctaa

SEQ ID NO: 2190579 - DNA, 12 bp, Homo sapiens
ttagaaattaca

SEQ ID NO: 2190580 - DNA, 17 bp, Homo sapiens
ttagaaattacaagttt

SEQ ID NO: 2190581 - DNA, 23 bp, Homo sapiens
ttagaagatattagtcttggggc

SEQ ID NO: 2190582 - DNA, 18 bp, Homo sapiens
ttagaatcaagtctgtga

SEQ ID NO: 2190583 - DNA, 20 bp, Homo sapiens
ttagaatcaagtctgtgaaa

SEQ ID NO: 2190584 - DNA, 13 bp, Homo sapiens
ttagagcctccct

SEQ ID NO: 2190585 - DNA, 23 bp, Homo sapiens
ttagatcaacaataaaaaaaaac

SEQ ID NO: 2190586 - DNA, 14 bp, Homo sapiens
ttagatgactgaat

SEQ ID NO: 2190587 - DNA, 23 bp, Homo sapiens
ttagatgcttaggtgaaggcaga

SEQ ID NO: 2190588 - DNA, 20 bp, Homo sapiens
ttagccaactgtttccctgc

SEQ ID NO: 2190589 - DNA, 21 bp, Homo sapiens
ttagccaactgtttccctgct

SEQ ID NO: 2190590 - DNA, 13 bp, Homo sapiens
ttagctcagcccc

SEQ ID NO: 2190591 - DNA, 20 bp, Homo sapiens
ttagcttgttcacactttgc

SEQ ID NO: 2190592 - DNA, 15 bp, Homo sapiens
ttaggcactgcttta

SEQ ID NO: 2190593 - DNA, 23 bp, Homo sapiens
ttagggactcaatttctccccag

SEQ ID NO: 2190594 - DNA, 20 bp, Homo sapiens
ttagggctaaccagttctct

SEQ ID NO: 2190595 - DNA, 18 bp, Homo sapiens
ttaggtacagtaaaacaa

SEQ ID NO: 2190596 - DNA, 18 bp, Homo sapiens
ttagtaaaaataaatcaa

SEQ ID NO: 2190597 - DNA, 20 bp, Homo sapiens
ttagtaacctttaaaaatgt

SEQ ID NO: 2190598 - DNA, 23 bp, Homo sapiens
ttagtaacctttaaaaatgtata

SEQ ID NO: 2190599 - DNA, 22 bp, Homo sapiens
ttagtcccacctcttacttcct

SEQ ID NO: 2190600 - DNA, 12 bp, Homo sapiens
ttagtgccaggc

SEQ ID NO: 2190601 - DNA, 18 bp, Homo sapiens
ttagtgggtgagaaattt

SEQ ID NO: 2190602 - DNA, 20 bp, Homo sapiens
tttgcgtgtgtcataaagtt

SEQ ID NO: 2190603 - DNA, 19 bp, Homo sapiens
tttgctccaccccactcac

SEQ ID NO: 2190604 - DNA, 18 bp, Homo sapiens
tttggctgtaatttaatt

SEQ ID NO: 2190605 - DNA, 15 bp, Homo sapiens
tttgggagtttttat

SEQ ID NO: 2190606 - DNA, 23 bp, Homo sapiens
tttgggagtttttatgagaaact

SEQ ID NO: 2190607 - DNA, 14 bp, Homo sapiens
tttggtataaatta

SEQ ID NO: 2190608 - DNA, 18 bp, Homo sapiens
tttgtacatttgggagtt

SEQ ID NO: 2190609 - DNA, 14 bp, Homo sapiens
tttgtactgtgctg

SEQ ID NO: 2190610 - DNA, 15 bp, Homo sapiens
tttgtactgtgctga

SEQ ID NO: 2190611 - DNA, 16 bp, Homo sapiens
tttgtattaaacttga

SEQ ID NO: 2190612 - DNA, 14 bp, Homo sapiens
tttgtcactcggct

SEQ ID NO: 2190613 - DNA, 16 bp, Homo sapiens
tttgtcttctccccag

SEQ ID NO: 2190614 - DNA, 15 bp, Homo sapiens
tttgtctttctattc

SEQ ID NO: 2190615 - DNA, 15 bp, Homo sapiens
tttgtgaagaaacat

SEQ ID NO: 2190616 - DNA, 19 bp, Homo sapiens
tttgtgggtttctctgtgc

SEQ ID NO: 2190617 - DNA, 20 bp, Homo sapiens
tttgtgggtttctctgtgct

SEQ ID NO: 2190618 - DNA, 17 bp, Homo sapiens
tttgtgtacagtatgtg

SEQ ID NO: 2190619 - DNA, 22 bp, Homo sapiens
tttgttaatatatataatactt

SEQ ID NO: 2190620 - DNA, 18 bp, Homo sapiens
tttgtttggtataaatta

SEQ ID NO: 2190621 - DNA, 15 bp, Homo sapiens
ttttaaaataattta

SEQ ID NO: 2190622 - DNA, 23 bp, Homo sapiens
ttttaaaatgaatcttatgcaaa

SEQ ID NO: 2190623 - DNA, 12 bp, Homo sapiens
ttttaaatcatc

SEQ ID NO: 2190624 - DNA, 20 bp, Homo sapiens
ttttaacatagtaacgtgtt

SEQ ID NO: 2190625 - DNA, 13 bp, Homo sapiens
ttttaacttgaaa

SEQ ID NO: 2190626 - DNA, 22 bp, Homo sapiens
ttttaacttgaaaagattgcaa

SEQ ID NO: 2190627 - DNA, 19 bp, Homo sapiens
ttttaagaaaaacatgtca

SEQ ID NO: 2190628 - DNA, 22 bp, Homo sapiens
ttttaagaaaaacatgtcatgt

SEQ ID NO: 2190629 - DNA, 13 bp, Homo sapiens
ttttacagtgtat

SEQ ID NO: 2190630 - DNA, 22 bp, Homo sapiens
ttttaccattttgcgatgtgtt

SEQ ID NO: 2190631 - DNA, 19 bp, Homo sapiens
ttttacctgggatatgaca

SEQ ID NO: 2190632 - DNA, 18 bp, Homo sapiens
ttttacggaattccaata

SEQ ID NO: 2190633 - DNA, 20 bp, Homo sapiens
ttttagaaaattttatgtat

SEQ ID NO: 2190634 - DNA, 15 bp, Homo sapiens
ttttagtacccacct

SEQ ID NO: 2190635 - DNA, 16 bp, Homo sapiens
ttttattattactgtt

SEQ ID NO: 2190636 - DNA, 23 bp, Homo sapiens
ttttctagaatactaataaaata

SEQ ID NO: 2190637 - DNA, 14 bp, Homo sapiens
ttttctgaacaaaa

SEQ ID NO: 2190638 - DNA, 21 bp, Homo sapiens
ttttgcaaccaggaacagcaa

SEQ ID NO: 2190639 - DNA, 19 bp, Homo sapiens
ttttgcagcttccttccaa

SEQ ID NO: 2190640 - DNA, 14 bp, Homo sapiens
ttttgcgatgtgtt

SEQ ID NO: 2190641 - DNA, 13 bp, Homo sapiens
ttttggcagctga

SEQ ID NO: 2190642 - DNA, 21 bp, Homo sapiens
ttttggggaactgttgtttga

SEQ ID NO: 2190643 - DNA, 12 bp, Homo sapiens
ttttgtaacttg

SEQ ID NO: 2190644 - DNA, 16 bp, Homo sapiens
ttttgtacataacttc

SEQ ID NO: 2190645 - DNA, 23 bp, Homo sapiens
ttttgtctttctattcagcaaaa

SEQ ID NO: 2190646 - DNA, 22 bp, Homo sapiens
ttttgtgggtttctctgtgctc

SEQ ID NO: 2190647 - DNA, 11 bp, Homo sapiens
ttttgtgtctt

SEQ ID NO: 2190648 - DNA, 15 bp, Homo sapiens
ttttgtgtcttaaga

SEQ ID NO: 2190649 - DNA, 13 bp, Homo sapiens
ttttgttgctgtt

SEQ ID NO: 2190650 - DNA, 13 bp, Homo sapiens
ttttgttgtttat

SEQ ID NO: 2190651 - DNA, 21 bp, Homo sapiens
ttttgttttaaggaaaaaaga

SEQ ID NO: 2190652 - DNA, 21 bp, Homo sapiens
tttttaacatagtaacgtgtt

SEQ ID NO: 2190653 - DNA, 17 bp, Homo sapiens
tttttaactgcattcta

SEQ ID NO: 2190654 - DNA, 15 bp, Homo sapiens
tttttacatattaaa

SEQ ID NO: 2190655 - DNA, 20 bp, Homo sapiens
tttttacggaattccaatat

SEQ ID NO: 2190656 - DNA, 18 bp, Homo sapiens
tttttataaactacaaaa

SEQ ID NO: 2190657 - DNA, 17 bp, Homo sapiens
tttttccaaaaacaaag

SEQ ID NO: 2190658 - DNA, 17 bp, Homo sapiens
tttttcctgtgtattaa

SEQ ID NO: 2190659 - DNA, 13 bp, Homo sapiens
tttttgaccagtt

SEQ ID NO: 2190660 - DNA, 16 bp, Homo sapiens
tttttgaccagtttct

SEQ ID NO: 2190661 - DNA, 18 bp, Homo sapiens
tttttgaccagtttcttt

SEQ ID NO: 2190662 - DNA, 15 bp, Homo sapiens
tttttggaaactgtt

SEQ ID NO: 2190663 - DNA, 22 bp, Homo sapiens
tttttggaggggtttatgctca

SEQ ID NO: 2190664 - DNA, 19 bp, Homo sapiens
ttttttaagcaactggaaa

SEQ ID NO: 2190665 - DNA, 13 bp, Homo sapiens
ttttttacggaat

SEQ ID NO: 2190666 - DNA, 17 bp, Homo sapiens
ttttttacggaattcca

SEQ ID NO: 2190667 - DNA, 14 bp, Homo sapiens
tttttttgttttgt

SEQ ID NO: 2190668 - DNA, 15 bp, Homo sapiens
aaattgtatattgta

SEQ ID NO: 2190669 - DNA, 19 bp, Homo sapiens
aaattgttacccatttgaa

SEQ ID NO: 2190670 - DNA, 14 bp, Homo sapiens
aaatttctatcatt

SEQ ID NO: 2190671 - DNA, 11 bp, Homo sapiens
aaatttgtaga

SEQ ID NO: 2190672 - DNA, 17 bp, Homo sapiens
aaatttgttaatatata

SEQ ID NO: 2190673 - DNA, 20 bp, Homo sapiens
aacaaagaccaatgtgaaga

SEQ ID NO: 2190674 - DNA, 13 bp, Homo sapiens
aacaaatcttcaa

SEQ ID NO: 2190675 - DNA, 22 bp, Homo sapiens
aacaaatcttcaaggtgtaaaa

SEQ ID NO: 2190676 - DNA, 12 bp, Homo sapiens
aacaaattaaaa

SEQ ID NO: 2190677 - DNA, 14 bp, Homo sapiens
aacaaattaaaaac

SEQ ID NO: 2190678 - DNA, 20 bp, Homo sapiens
aacaaattaaaaacacctaa

SEQ ID NO: 2190679 - DNA, 15 bp, Homo sapiens
aacaacgtgagagaa

SEQ ID NO: 2190680 - DNA, 23 bp, Homo sapiens
aacaacgtgagagaaagagagaa

SEQ ID NO: 2190681 - DNA, 17 bp, Homo sapiens
aacaagtctttagtgtt

SEQ ID NO: 2190682 - DNA, 19 bp, Homo sapiens
aacaatgcatgctttggaa

SEQ ID NO: 2190683 - DNA, 19 bp, Homo sapiens
aacaattcaatcaaagcta

SEQ ID NO: 2190684 - DNA, 21 bp, Homo sapiens
aacaattcaatcaaagctacc

SEQ ID NO: 2190685 - DNA, 15 bp, Homo sapiens
aacaattgtgacagc

SEQ ID NO: 2190686 - DNA, 17 bp, Homo sapiens
aacacaaatgtgtactt

SEQ ID NO: 2190687 - DNA, 13 bp, Homo sapiens
aacaccaggactt

SEQ ID NO: 2190688 - DNA, 11 bp, Homo sapiens
aacactttggt

SEQ ID NO: 2190689 - DNA, 19 bp, Homo sapiens
aacagaaattgtatattgt

SEQ ID NO: 2190690 - DNA, 16 bp, Homo sapiens
aacagatggctgtgaa

SEQ ID NO: 2190691 - DNA, 17 bp, Homo sapiens
aacagatggctgtgaaa

SEQ ID NO: 2190692 - DNA, 17 bp, Homo sapiens
aacagcaggcccaccta

SEQ ID NO: 2190693 - DNA, 15 bp, Homo sapiens
aacaggggctggtgg

SEQ ID NO: 2190694 - DNA, 14 bp, Homo sapiens
aacaggtaaacaga

SEQ ID NO: 2190695 - DNA, 17 bp, Homo sapiens
aacagtggttgcctggg

SEQ ID NO: 2190696 - DNA, 19 bp, Homo sapiens
aacagtggttgcctggggg

SEQ ID NO: 2190697 - DNA, 17 bp, Homo sapiens
aacagttaaacttgcaa

SEQ ID NO: 2190698 - DNA, 18 bp, Homo sapiens
aacagttgagtttcttct

SEQ ID NO: 2190699 - DNA, 20 bp, Homo sapiens
aacagttgtatttaacagaa

SEQ ID NO: 2190700 - DNA, 23 bp, Homo sapiens
aacagttgtatttaacagaaatt

SEQ ID NO: 2190701 - DNA, 21 bp, Homo sapiens
aacataaaacaaaaccaagcc

SEQ ID NO: 2190702 - DNA, 15 bp, Homo sapiens
aacataaacagcatg

SEQ ID NO: 2190703 - DNA, 14 bp, Homo sapiens
aacataagctagaa

SEQ ID NO: 2190704 - DNA, 16 bp, Homo sapiens
aacatctctgttgaag

SEQ ID NO: 2190705 - DNA, 18 bp, Homo sapiens
aacatgaaggatcaaaaa

SEQ ID NO: 2190706 - DNA, 12 bp, Homo sapiens
aacatggccaca

SEQ ID NO: 2190707 - DNA, 18 bp, Homo sapiens
aacattcagctctggaga

SEQ ID NO: 2190708 - DNA, 14 bp, Homo sapiens
aacatttcttgaag

SEQ ID NO: 2190709 - DNA, 13 bp, Homo sapiens
aaccaagccttgg

SEQ ID NO: 2190710 - DNA, 21 bp, Homo sapiens
agatgaaccaagtgtctaaaa

SEQ ID NO: 2190711 - DNA, 17 bp, Homo sapiens
agatgactgaatttcta

SEQ ID NO: 2190712 - DNA, 17 bp, Homo sapiens
agatgagaattcagctg

SEQ ID NO: 2190713 - DNA, 13 bp, Homo sapiens
agatgccagagca

SEQ ID NO: 2190714 - DNA, 13 bp, Homo sapiens
agatgcctccctg

SEQ ID NO: 2190715 - DNA, 22 bp, Homo sapiens
agatgcctccctgaccctgcag

SEQ ID NO: 2190716 - DNA, 23 bp, Homo sapiens
agatgcctccctgaccctgcaga

SEQ ID NO: 2190717 - DNA, 13 bp, Homo sapiens
agatgccttctag

SEQ ID NO: 2190718 - DNA, 15 bp, Homo sapiens
agatggaaggccttt

SEQ ID NO: 2190719 - DNA, 13 bp, Homo sapiens
agatggctgtgaa

SEQ ID NO: 2190720 - DNA, 21 bp, Homo sapiens
agatggctgtgaaaattacac

SEQ ID NO: 2190721 - DNA, 16 bp, Homo sapiens
agatgtattcagagcc

SEQ ID NO: 2190722 - DNA, 17 bp, Homo sapiens
agatgtattcagagcca

SEQ ID NO: 2190723 - DNA, 16 bp, Homo sapiens
agattaaactgagtga

SEQ ID NO: 2190724 - DNA, 19 bp, Homo sapiens
agattcccggctggacttt

SEQ ID NO: 2190725 - DNA, 13 bp, Homo sapiens
agattctcttgaa

SEQ ID NO: 2190726 - DNA, 14 bp, Homo sapiens
agattctttattag

SEQ ID NO: 2190727 - DNA, 13 bp, Homo sapiens
agattgcaaaggg

SEQ ID NO: 2190728 - DNA, 14 bp, Homo sapiens
agattgtagctctt

SEQ ID NO: 2190729 - DNA, 20 bp, Homo sapiens
agatttaatctgccaagggc

SEQ ID NO: 2190730 - DNA, 21 bp, Homo sapiens
agattttacctgggatatgac

SEQ ID NO: 2190731 - DNA, 14 bp, Homo sapiens
agcaaacctgcccc

SEQ ID NO: 2190732 - DNA, 14 bp, Homo sapiens
agcaaatgcaaaaa

SEQ ID NO: 2190733 - DNA, 18 bp, Homo sapiens
agcaaattccaatacatt

SEQ ID NO: 2190734 - DNA, 14 bp, Homo sapiens
agcaacgcctgcct

SEQ ID NO: 2190735 - DNA, 18 bp, Homo sapiens
agcaacgcctgccttctg

SEQ ID NO: 2190736 - DNA, 21 bp, Homo sapiens
agcaacgcctgccttctgggc

SEQ ID NO: 2190737 - DNA, 13 bp, Homo sapiens
agcaactggaaaa

SEQ ID NO: 2190738 - DNA, 22 bp, Homo sapiens
agcaactggaaaagtgttcctt

SEQ ID NO: 2190739 - DNA, 17 bp, Homo sapiens
agcaagacacgtggcct

SEQ ID NO: 2190740 - DNA, 20 bp, Homo sapiens
agcaaggaccagtgagacag

SEQ ID NO: 2190741 - DNA, 14 bp, Homo sapiens
agcaaggtttctgg

SEQ ID NO: 2190742 - DNA, 20 bp, Homo sapiens
agcaatctgtgtactgaaca

SEQ ID NO: 2190743 - DNA, 15 bp, Homo sapiens
agcaattctcctaag

SEQ ID NO: 2190744 - DNA, 19 bp, Homo sapiens
agcacatgcactactgaaa

SEQ ID NO: 2190745 - DNA, 15 bp, Homo sapiens
agcacctcctctctg

SEQ ID NO: 2190746 - DNA, 13 bp, Homo sapiens
agcacctttagaa

SEQ ID NO: 2190747 - DNA, 14 bp, Homo sapiens
agcactcacatgct

SEQ ID NO: 2190748 - DNA, 20 bp, Homo sapiens
agcagaaaacagaggccaca

SEQ ID NO: 2190749 - DNA, 18 bp, Homo sapiens
agcagaaacccatgtgca

SEQ ID NO: 2190750 - DNA, 16 bp, Homo sapiens
agcagagccgttcctg

SEQ ID NO: 2190751 - DNA, 17 bp, Homo sapiens
agcagccctggagtcat

SEQ ID NO: 2190752 - DNA, 12 bp, Homo sapiens
agcagcccttgc

SEQ ID NO: 2190753 - DNA, 15 bp, Homo sapiens
agcagctccgcctgg

SEQ ID NO: 2190754 - DNA, 22 bp, Homo sapiens
agcagcttctgtcctcttctgt

SEQ ID NO: 2190755 - DNA, 18 bp, Homo sapiens
agcaggcaccagcagcag

SEQ ID NO: 2190756 - DNA, 20 bp, Homo sapiens
agcaggcaccagcagcagaa

SEQ ID NO: 2190757 - DNA, 15 bp, Homo sapiens
agcaggcccagctgg

SEQ ID NO: 2190758 - DNA, 18 bp, Homo sapiens
agcaggggaacaaaataa

SEQ ID NO: 2190759 - DNA, 21 bp, Homo sapiens
agcagtgattgaagtatctgt

SEQ ID NO: 2190760 - DNA, 15 bp, Homo sapiens
agcagtgtttaaaaa

SEQ ID NO: 2190761 - DNA, 17 bp, Homo sapiens
agcagtgtttaaaaaat

SEQ ID NO: 2190762 - DNA, 14 bp, Homo sapiens
agcagtttcactgc

SEQ ID NO: 2190763 - DNA, 17 bp, Homo sapiens
agcatccacctccttct

SEQ ID NO: 2190764 - DNA, 20 bp, Homo sapiens
agcatccacctccttctctg

SEQ ID NO: 2190765 - DNA, 17 bp, Homo sapiens
agcatccgtctcccctc

SEQ ID NO: 2190766 - DNA, 21 bp, Homo sapiens
agcattattttttgttgaata

SEQ ID NO: 2190767 - DNA, 17 bp, Homo sapiens
agcatttaatgtagcca

SEQ ID NO: 2190768 - DNA, 14 bp, Homo sapiens
agcatttacagaaa

SEQ ID NO: 2190769 - DNA, 14 bp, Homo sapiens
agcattttgtgtct

SEQ ID NO: 2190770 - DNA, 17 bp, Homo sapiens
agccaactgtttccctg

SEQ ID NO: 2190771 - DNA, 20 bp, Homo sapiens
agccaaggcctatgccacct

SEQ ID NO: 2190772 - DNA, 22 bp, Homo sapiens
agccaaggcctatgccacctgc

SEQ ID NO: 2190773 - DNA, 21 bp, Homo sapiens
agccacatgggaaacttccaa

SEQ ID NO: 2190774 - DNA, 17 bp, Homo sapiens
agccacgtgctggagag

SEQ ID NO: 2190775 - DNA, 15 bp, Homo sapiens
agccacgttggtggt

SEQ ID NO: 2190776 - DNA, 20 bp, Homo sapiens
agccacgttggtggtattgg

SEQ ID NO: 2190777 - DNA, 14 bp, Homo sapiens
agccactaactaga

SEQ ID NO: 2190778 - DNA, 16 bp, Homo sapiens
agccacttccccctct

SEQ ID NO: 2190779 - DNA, 20 bp, Homo sapiens
agccagattctcttgaataa

SEQ ID NO: 2190780 - DNA, 20 bp, Homo sapiens
agccagccacagacccctgg

SEQ ID NO: 2190781 - DNA, 20 bp, Homo sapiens
agccatatattttctgagta

SEQ ID NO: 2190782 - DNA, 15 bp, Homo sapiens
agccatgggaccaaa

SEQ ID NO: 2190783 - DNA, 18 bp, Homo sapiens
agccattggcctctgtct

SEQ ID NO: 2190784 - DNA, 19 bp, Homo sapiens
agccatttgccccaactta

SEQ ID NO: 2190785 - DNA, 23 bp, Homo sapiens
agccatttgccccaacttaagtt

SEQ ID NO: 2190786 - DNA, 19 bp, Homo sapiens
agcccacaggtgtccccag

SEQ ID NO: 2190787 - DNA, 14 bp, Homo sapiens
agcccagcccagct

SEQ ID NO: 2190788 - DNA, 15 bp, Homo sapiens
agcccagcccagctg

SEQ ID NO: 2190789 - DNA, 16 bp, Homo sapiens
agcccagcccagctgc

SEQ ID NO: 2190790 - DNA, 18 bp, Homo sapiens
agcccagcccagctgctc

SEQ ID NO: 2190791 - DNA, 19 bp, Homo sapiens
agcccagctgctctgccca

SEQ ID NO: 2190792 - DNA, 20 bp, Homo sapiens
agcccagctgctctgcccag

SEQ ID NO: 2190793 - DNA, 23 bp, Homo sapiens
agcccagctgctctgcccagagc

SEQ ID NO: 2190794 - DNA, 15 bp, Homo sapiens
agcccatcctgacca

SEQ ID NO: 2190795 - DNA, 16 bp, Homo sapiens
agcccatcctgaccag

SEQ ID NO: 2190796 - DNA, 16 bp, Homo sapiens
agccccaagaaggctg

SEQ ID NO: 2190797 - DNA, 17 bp, Homo sapiens
agccccaagaaggctgg

SEQ ID NO: 2190798 - DNA, 17 bp, Homo sapiens
agccccagcccagccca

SEQ ID NO: 2190799 - DNA, 14 bp, Homo sapiens
agccccctgtcctt

SEQ ID NO: 2190800 - DNA, 15 bp, Homo sapiens
agccccctgtccttc

SEQ ID NO: 2190801 - DNA, 14 bp, Homo sapiens
agccccttagcccc

SEQ ID NO: 2190802 - DNA, 14 bp, Homo sapiens
agcccgcatgcagc

SEQ ID NO: 2190803 - DNA, 21 bp, Homo sapiens
agcccgcatgcagcagcttgc

SEQ ID NO: 2190804 - DNA, 22 bp, Homo sapiens
agccctgagttggcatcacctg

SEQ ID NO: 2190805 - DNA, 21 bp, Homo sapiens
agccgagatcggggtggcaga

SEQ ID NO: 2190806 - DNA, 22 bp, Homo sapiens
agccgagatcggggtggcagaa

SEQ ID NO: 2190807 - DNA, 18 bp, Homo sapiens
agccggggcctgcctagc

SEQ ID NO: 2190808 - DNA, 17 bp, Homo sapiens
agccggtttgggagaga

SEQ ID NO: 2190809 - DNA, 13 bp, Homo sapiens
agccgtcctggcg

SEQ ID NO: 2190810 - DNA, 16 bp, Homo sapiens
agccgttcctgggact

SEQ ID NO: 2190811 - DNA, 17 bp, Homo sapiens
agcctcaacctccctgg

SEQ ID NO: 2190812 - DNA, 21 bp, Homo sapiens
agcctcaacctccctggctca

SEQ ID NO: 2190813 - DNA, 21 bp, Homo sapiens
agcctccctctcctctgtccc

SEQ ID NO: 2190814 - DNA, 15 bp, Homo sapiens
agcctcgaactcctg

SEQ ID NO: 2190815 - DNA, 17 bp, Homo sapiens
agcctcgaactcctggg

SEQ ID NO: 2190816 - DNA, 19 bp, Homo sapiens
agcctcgaactcctgggct

SEQ ID NO: 2190817 - DNA, 13 bp, Homo sapiens
agcctcttctgaa

SEQ ID NO: 2190818 - DNA, 20 bp, Homo sapiens
agcctgatttaggcactgct

SEQ ID NO: 2190819 - DNA, 14 bp, Homo sapiens
agcctgcggctgct

SEQ ID NO: 2190820 - DNA, 16 bp, Homo sapiens
agcctgcggctgctgg

SEQ ID NO: 2190821 - DNA, 15 bp, Homo sapiens
agcctgggccactgg

SEQ ID NO: 2190822 - DNA, 16 bp, Homo sapiens
agcctgggccactggc

SEQ ID NO: 2190823 - DNA, 19 bp, Homo sapiens
agcctgggccactggcatc

SEQ ID NO: 2190824 - DNA, 21 bp, Homo sapiens
agcctggggcctggggatgta

SEQ ID NO: 2190825 - DNA, 15 bp, Homo sapiens
agcctggtctcctcc

SEQ ID NO: 2190826 - DNA, 14 bp, Homo sapiens
agcctgtcttcaga

SEQ ID NO: 2190827 - DNA, 19 bp, Homo sapiens
agcctgtcttcagatcctg

SEQ ID NO: 2190828 - DNA, 22 bp, Homo sapiens
agcctgtcttcagatcctgctg

SEQ ID NO: 2190829 - DNA, 23 bp, Homo sapiens
agcctgtcttcagatcctgctgc

SEQ ID NO: 2190830 - DNA, 17 bp, Homo sapiens
agcctgtgcgtcccagc

SEQ ID NO: 2190831 - DNA, 23 bp, Homo sapiens
agcctgtgcgtcccagctgaagg

SEQ ID NO: 2190832 - DNA, 15 bp, Homo sapiens
agcctgtgggagaag

SEQ ID NO: 2190833 - DNA, 19 bp, Homo sapiens
agccttcctccatggccca

SEQ ID NO: 2190834 - DNA, 20 bp, Homo sapiens
agccttcttttgtacttttc

SEQ ID NO: 2190835 - DNA, 20 bp, Homo sapiens
agaatcccttaacagttgta

SEQ ID NO: 2190836 - DNA, 17 bp, Homo sapiens
agaatgaccctgtcaag

SEQ ID NO: 2190837 - DNA, 18 bp, Homo sapiens
agaatgaccctgtcaagc

SEQ ID NO: 2190838 - DNA, 21 bp, Homo sapiens
agaatgggtaattcaagaggc

SEQ ID NO: 2190839 - DNA, 21 bp, Homo sapiens
agaatggtgccaccactcaag

SEQ ID NO: 2190840 - DNA, 17 bp, Homo sapiens
agaatgtccccttaggt

SEQ ID NO: 2190841 - DNA, 12 bp, Homo sapiens
agaattaaaata

SEQ ID NO: 2190842 - DNA, 15 bp, Homo sapiens
agaattaaaatttat

SEQ ID NO: 2190843 - DNA, 18 bp, Homo sapiens
agaattattcatagctgt

SEQ ID NO: 2190844 - DNA, 16 bp, Homo sapiens
agaattcagctgcccc

SEQ ID NO: 2190845 - DNA, 16 bp, Homo sapiens
agaattgaagaaaatc

SEQ ID NO: 2190846 - DNA, 14 bp, Homo sapiens
agacaaaccactgt

SEQ ID NO: 2190847 - DNA, 14 bp, Homo sapiens
agacaaatgggact

SEQ ID NO: 2190848 - DNA, 13 bp, Homo sapiens
agacaagcagccc

SEQ ID NO: 2190849 - DNA, 19 bp, Homo sapiens
agacaagcagcccttgctt

SEQ ID NO: 2190850 - DNA, 22 bp, Homo sapiens
agacaatgcagatgccagagca

SEQ ID NO: 2190851 - DNA, 15 bp, Homo sapiens
agacacctcagagcc

SEQ ID NO: 2190852 - DNA, 17 bp, Homo sapiens
agacacgtggcctcgtg

SEQ ID NO: 2190853 - DNA, 18 bp, Homo sapiens
agacagctgtttgaattg

SEQ ID NO: 2190854 - DNA, 15 bp, Homo sapiens
agacagggtcctgct

SEQ ID NO: 2190855 - DNA, 16 bp, Homo sapiens
agacagggtcctgcta

SEQ ID NO: 2190856 - DNA, 20 bp, Homo sapiens
agacagtccttaatgctgaa

SEQ ID NO: 2190857 - DNA, 23 bp, Homo sapiens
agacagttttccaaactgtgtca

SEQ ID NO: 2190858 - DNA, 14 bp, Homo sapiens
agacatatttcagt

SEQ ID NO: 2190859 - DNA, 21 bp, Homo sapiens
agacatatttcagtgattttt

SEQ ID NO: 2190860 - DNA, 19 bp, Homo sapiens
agacatccccctccttgcc

SEQ ID NO: 2190861 - DNA, 19 bp, Homo sapiens
agacatctgaggttttatt

SEQ ID NO: 2190862 - DNA, 14 bp, Homo sapiens
agacatttaaagac

SEQ ID NO: 2190863 - DNA, 15 bp, Homo sapiens
agaccaatgtgaaga

SEQ ID NO: 2190864 - DNA, 12 bp, Homo sapiens
agaccagagctc

SEQ ID NO: 2190865 - DNA, 15 bp, Homo sapiens
agaccagagctctgg

SEQ ID NO: 2190866 - DNA, 17 bp, Homo sapiens
agaccagcctttcttcc

SEQ ID NO: 2190867 - DNA, 23 bp, Homo sapiens
agaccatttcacagaaaacattg

SEQ ID NO: 2190868 - DNA, 16 bp, Homo sapiens
agaccatttttaaatg

SEQ ID NO: 2190869 - DNA, 17 bp, Homo sapiens
agaccccgcacccggct

SEQ ID NO: 2190870 - DNA, 18 bp, Homo sapiens
agaccccgcacccggctc

SEQ ID NO: 2190871 - DNA, 12 bp, Homo sapiens
agacccctggct

SEQ ID NO: 2190872 - DNA, 13 bp, Homo sapiens
agacccctggctg

SEQ ID NO: 2190873 - DNA, 12 bp, Homo sapiens
agaccggaagct

SEQ ID NO: 2190874 - DNA, 13 bp, Homo sapiens
agacctgggactt

SEQ ID NO: 2190875 - DNA, 15 bp, Homo sapiens
agaccttcttccaca

SEQ ID NO: 2190876 - DNA, 15 bp, Homo sapiens
agacggggagtgaga

SEQ ID NO: 2190877 - DNA, 21 bp, Homo sapiens
agactatttttagattttctt

SEQ ID NO: 2190878 - DNA, 15 bp, Homo sapiens
agactggggcctgga

SEQ ID NO: 2190879 - DNA, 16 bp, Homo sapiens
agacttaatttcaaat

SEQ ID NO: 2190880 - DNA, 18 bp, Homo sapiens
agactttccccatactct

SEQ ID NO: 2190881 - DNA, 15 bp, Homo sapiens
agagaaagagagaag

SEQ ID NO: 2190882 - DNA, 17 bp, Homo sapiens
agagaaagagagaagcc

SEQ ID NO: 2190883 - DNA, 20 bp, Homo sapiens
agagaaagagagaagccagc

SEQ ID NO: 2190884 - DNA, 13 bp, Homo sapiens
agagaactagtgg

SEQ ID NO: 2190885 - DNA, 13 bp, Homo sapiens
agagaagccagcc

SEQ ID NO: 2190886 - DNA, 15 bp, Homo sapiens
agagaagccagccac

SEQ ID NO: 2190887 - DNA, 16 bp, Homo sapiens
agagaagccagccaca

SEQ ID NO: 2190888 - DNA, 12 bp, Homo sapiens
agagaatgtgtg

SEQ ID NO: 2190889 - DNA, 17 bp, Homo sapiens
agagacacatacagagt

SEQ ID NO: 2190890 - DNA, 15 bp, Homo sapiens
agagaccagcctttc

SEQ ID NO: 2190891 - DNA, 15 bp, Homo sapiens
agagaccccgcaccc

SEQ ID NO: 2190892 - DNA, 22 bp, Homo sapiens
agagagaccccgcacccggctc

SEQ ID NO: 2190893 - DNA, 13 bp, Homo sapiens
agagatgcctccc

SEQ ID NO: 2190894 - DNA, 15 bp, Homo sapiens
agagcaaagggccag

SEQ ID NO: 2190895 - DNA, 16 bp, Homo sapiens
agagcaaagggccagg

SEQ ID NO: 2190896 - DNA, 23 bp, Homo sapiens
agagcaaatttcatctttccaaa

SEQ ID NO: 2190897 - DNA, 22 bp, Homo sapiens
agagcaggcaccagcagcagaa

SEQ ID NO: 2190898 - DNA, 15 bp, Homo sapiens
agagcatccgtctcc

SEQ ID NO: 2190899 - DNA, 16 bp, Homo sapiens
agagccaaggcctatg

SEQ ID NO: 2190900 - DNA, 23 bp, Homo sapiens
agagccaatggagtagacccctg

SEQ ID NO: 2190901 - DNA, 23 bp, Homo sapiens
agagccacccaggccactgacct

SEQ ID NO: 2190902 - DNA, 15 bp, Homo sapiens
agagcccaatcactg

SEQ ID NO: 2190903 - DNA, 17 bp, Homo sapiens
agagcccaatcactgcc

SEQ ID NO: 2190904 - DNA, 21 bp, Homo sapiens
agagccccgcaaaacccactg

SEQ ID NO: 2190905 - DNA, 15 bp, Homo sapiens
agagccgttcctggg

SEQ ID NO: 2190906 - DNA, 16 bp, Homo sapiens
agagccgttcctggga

SEQ ID NO: 2190907 - DNA, 10 bp, Homo sapiens
agagcctgcc

SEQ ID NO: 2190908 - DNA, 14 bp, Homo sapiens
agagcgctggcctc

SEQ ID NO: 2190909 - DNA, 14 bp, Homo sapiens
agagctctggagcc

SEQ ID NO: 2190910 - DNA, 13 bp, Homo sapiens
agagctgcctgga

SEQ ID NO: 2190911 - DNA, 14 bp, Homo sapiens
agagctgcctggat

SEQ ID NO: 2190912 - DNA, 15 bp, Homo sapiens
agagctgcctggatg

SEQ ID NO: 2190913 - DNA, 17 bp, Homo sapiens
agagctgcctggatgag

SEQ ID NO: 2190914 - DNA, 19 bp, Homo sapiens
agagctgcctggatgagaa

SEQ ID NO: 2190915 - DNA, 18 bp, Homo sapiens
agaggagagaatgagaga

SEQ ID NO: 2190916 - DNA, 22 bp, Homo sapiens
agaggagagaatgagagagtgt

SEQ ID NO: 2190917 - DNA, 15 bp, Homo sapiens
agaggattctgtctt

SEQ ID NO: 2190918 - DNA, 13 bp, Homo sapiens
agaggcaccagga

SEQ ID NO: 2190919 - DNA, 14 bp, Homo sapiens
agaggcaccaggaa

SEQ ID NO: 2190920 - DNA, 16 bp, Homo sapiens
agaggcagaaccctgg

SEQ ID NO: 2190921 - DNA, 22 bp, Homo sapiens
agaggcagagtgccccacctgc

SEQ ID NO: 2190922 - DNA, 17 bp, Homo sapiens
agaggcagtggcagcaa

SEQ ID NO: 2190923 - DNA, 14 bp, Homo sapiens
agaggccacaggaa

SEQ ID NO: 2190924 - DNA, 15 bp, Homo sapiens
agaggccctggaggt

SEQ ID NO: 2190925 - DNA, 16 bp, Homo sapiens
agaggccctggaggtc

SEQ ID NO: 2190926 - DNA, 22 bp, Homo sapiens
agaggccctggaggtctccagg

SEQ ID NO: 2190927 - DNA, 12 bp, Homo sapiens
agaggctcctgg

SEQ ID NO: 2190928 - DNA, 17 bp, Homo sapiens
agaggctcctggagcca

SEQ ID NO: 2190929 - DNA, 18 bp, Homo sapiens
agaggctcctggagccag

SEQ ID NO: 2190930 - DNA, 22 bp, Homo sapiens
agaggctctgaaagctgcttct

SEQ ID NO: 2190931 - DNA, 17 bp, Homo sapiens
agagggagaaggagagg

SEQ ID NO: 2190932 - DNA, 14 bp, Homo sapiens
agagggagcaagcc

SEQ ID NO: 2190933 - DNA, 12 bp, Homo sapiens
agaggggagagg

SEQ ID NO: 2190934 - DNA, 13 bp, Homo sapiens
agaggggcctctg

SEQ ID NO: 2190935 - DNA, 23 bp, Homo sapiens
agaggtgggaggcccctggtggc

SEQ ID NO: 2190936 - DNA, 19 bp, Homo sapiens
agaggtggggtgaagctgg

SEQ ID NO: 2190937 - DNA, 20 bp, Homo sapiens
agaggtggggtgaagctggg

SEQ ID NO: 2190938 - DNA, 13 bp, Homo sapiens
agaggttgtgaaa

SEQ ID NO: 2190939 - DNA, 18 bp, Homo sapiens
agaggttttcacaaatgt

SEQ ID NO: 2190940 - DNA, 13 bp, Homo sapiens
agagtccaggaag

SEQ ID NO: 2190941 - DNA, 20 bp, Homo sapiens
agagtcctgaggcagaacct

SEQ ID NO: 2190942 - DNA, 22 bp, Homo sapiens
agagtcctgaggcagaacctgg

SEQ ID NO: 2190943 - DNA, 18 bp, Homo sapiens
agagtctcactcccctcc

SEQ ID NO: 2190944 - DNA, 22 bp, Homo sapiens
agagtctttgtaagtaaactgc

SEQ ID NO: 2190945 - DNA, 18 bp, Homo sapiens
agagtgggccccgggctg

SEQ ID NO: 2190946 - DNA, 22 bp, Homo sapiens
agagtgggccccgggctggaga

SEQ ID NO: 2190947 - DNA, 18 bp, Homo sapiens
agagtggtctatttctcc

SEQ ID NO: 2190948 - DNA, 17 bp, Homo sapiens
agatacacttgtaaata

SEQ ID NO: 2190949 - DNA, 18 bp, Homo sapiens
agatagttggttctttta

SEQ ID NO: 2190950 - DNA, 17 bp, Homo sapiens
agatatataactttaga

SEQ ID NO: 2190951 - DNA, 23 bp, Homo sapiens
agatattaaaaattgaaaacttt

SEQ ID NO: 2190952 - DNA, 13 bp, Homo sapiens
agatattttgcac

SEQ ID NO: 2190953 - DNA, 20 bp, Homo sapiens
agatcagaacattcagctct

SEQ ID NO: 2190954 - DNA, 22 bp, Homo sapiens
agatcagaacattcagctctgg

SEQ ID NO: 2190955 - DNA, 14 bp, Homo sapiens
agatcggggccaga

SEQ ID NO: 2190956 - DNA, 17 bp, Homo sapiens
agatcggggccagaggc

SEQ ID NO: 2190957 - DNA, 21 bp, Homo sapiens
agatctcaacatggaaaaatc

SEQ ID NO: 2190958 - DNA, 23 bp, Homo sapiens
agatctcaacatggaaaaatcct

SEQ ID NO: 2190959 - DNA, 22 bp, Homo sapiens
agatctccaaagctttcctgga

SEQ ID NO: 2190960 - DNA, 12 bp, Homo sapiens
actgtatttgaa

SEQ ID NO: 2190961 - DNA, 20 bp, Homo sapiens
actgtcaatggactgcacct

SEQ ID NO: 2190962 - DNA, 16 bp, Homo sapiens
actgtcttcttcaggg

SEQ ID NO: 2190963 - DNA, 17 bp, Homo sapiens
actgtgacacagctgag

SEQ ID NO: 2190964 - DNA, 20 bp, Homo sapiens
actgtgacacagctgagctg

SEQ ID NO: 2190965 - DNA, 18 bp, Homo sapiens
actgtgaggaagagcagg

SEQ ID NO: 2190966 - DNA, 13 bp, Homo sapiens
actgtgatttatt

SEQ ID NO: 2190967 - DNA, 21 bp, Homo sapiens
actgtgcatcaaccaggaaga

SEQ ID NO: 2190968 - DNA, 21 bp, Homo sapiens
actgtgcccagcagtttccca

SEQ ID NO: 2190969 - DNA, 22 bp, Homo sapiens
actgtgcccagcagtttcccag

SEQ ID NO: 2190970 - DNA, 9 bp, Homo sapiens
actgtgctg

SEQ ID NO: 2190971 - DNA, 15 bp, Homo sapiens
actgtggaggtggct

SEQ ID NO: 2190972 - DNA, 22 bp, Homo sapiens
actgtggctcttgccttatctg

SEQ ID NO: 2190973 - DNA, 18 bp, Homo sapiens
actgttgtttgatgtgta

SEQ ID NO: 2190974 - DNA, 21 bp, Homo sapiens
actgttgtttgatgtgtatgt

SEQ ID NO: 2190975 - DNA, 16 bp, Homo sapiens
actgtttccctgctga

SEQ ID NO: 2190976 - DNA, 17 bp, Homo sapiens
actgtttccctgctgaa

SEQ ID NO: 2190977 - DNA, 20 bp, Homo sapiens
acttaagacaaatgggactg

SEQ ID NO: 2190978 - DNA, 11 bp, Homo sapiens
acttacctgca

SEQ ID NO: 2190979 - DNA, 20 bp, Homo sapiens
acttatctctaaaccatcta

SEQ ID NO: 2190980 - DNA, 16 bp, Homo sapiens
acttcaaaatcagtga

SEQ ID NO: 2190981 - DNA, 15 bp, Homo sapiens
acttcaaatcatatc

SEQ ID NO: 2190982 - DNA, 21 bp, Homo sapiens
acttcacacagcacctcctct

SEQ ID NO: 2190983 - DNA, 21 bp, Homo sapiens
acttcacagagactctgtcct

SEQ ID NO: 2190984 - DNA, 18 bp, Homo sapiens
acttcagatacttgtgaa

SEQ ID NO: 2190985 - DNA, 23 bp, Homo sapiens
acttcattctaaaccaaaacaga

SEQ ID NO: 2190986 - DNA, 17 bp, Homo sapiens
acttccaagaaaaataa

SEQ ID NO: 2190987 - DNA, 22 bp, Homo sapiens
acttccaagacctgactcaggc

SEQ ID NO: 2190988 - DNA, 11 bp, Homo sapiens
acttccatttg

SEQ ID NO: 2190989 - DNA, 13 bp, Homo sapiens
acttccctgggca

SEQ ID NO: 2190990 - DNA, 17 bp, Homo sapiens
acttcgtggatgacctc

SEQ ID NO: 2190991 - DNA, 23 bp, Homo sapiens
acttcgtgggatctgcccctccc

SEQ ID NO: 2190992 - DNA, 23 bp, Homo sapiens
acttgaaaagattgcaaagggac

SEQ ID NO: 2190993 - DNA, 14 bp, Homo sapiens
acttgagtgtgcaa

SEQ ID NO: 2190994 - DNA, 14 bp, Homo sapiens
acttgagtttgttt

SEQ ID NO: 2190995 - DNA, 21 bp, Homo sapiens
acttgatatgactaattcagg

SEQ ID NO: 2190996 - DNA, 18 bp, Homo sapiens
acttgggccatagctcct

SEQ ID NO: 2190997 - DNA, 13 bp, Homo sapiens
acttggttcccag

SEQ ID NO: 2190998 - DNA, 22 bp, Homo sapiens
acttgtacgctcacttgcccca

SEQ ID NO: 2190999 - DNA, 17 bp, Homo sapiens
acttgtgtttgtatata

SEQ ID NO: 2191000 - DNA, 20 bp, Homo sapiens
acttgtgtttgtatataaat

SEQ ID NO: 2191001 - DNA, 17 bp, Homo sapiens
acttgttcttttctggt

SEQ ID NO: 2191002 - DNA, 11 bp, Homo sapiens
actttaataat

SEQ ID NO: 2191003 - DNA, 22 bp, Homo sapiens
actttaataataaaaatcatgc

SEQ ID NO: 2191004 - DNA, 15 bp, Homo sapiens
actttaccaccccca

SEQ ID NO: 2191005 - DNA, 20 bp, Homo sapiens
actttattgattttctttct

SEQ ID NO: 2191006 - DNA, 19 bp, Homo sapiens
actttccccatactctgtc

SEQ ID NO: 2191007 - DNA, 22 bp, Homo sapiens
actttgcccagggtcctgtgcc

SEQ ID NO: 2191008 - DNA, 16 bp, Homo sapiens
actttgccctatgaca

SEQ ID NO: 2191009 - DNA, 18 bp, Homo sapiens
actttggagaactcattt

SEQ ID NO: 2191010 - DNA, 21 bp, Homo sapiens
actttggtattcaatttgatt

SEQ ID NO: 2191011 - DNA, 20 bp, Homo sapiens
actttgtattctctgtccag

SEQ ID NO: 2191012 - DNA, 21 bp, Homo sapiens
actttgtgtctctgttgtcta

SEQ ID NO: 2191013 - DNA, 15 bp, Homo sapiens
acttttaaaatttgt

SEQ ID NO: 2191014 - DNA, 21 bp, Homo sapiens
acttttacagcttttctcttt

SEQ ID NO: 2191015 - DNA, 16 bp, Homo sapiens
acttttgcagcttcct

SEQ ID NO: 2191016 - DNA, 20 bp, Homo sapiens
acttttgtgacccactaatt

SEQ ID NO: 2191017 - DNA, 12 bp, Homo sapiens
acttttttggaa

SEQ ID NO: 2191018 - DNA, 12 bp, Homo sapiens
agaaaaacatgt

SEQ ID NO: 2191019 - DNA, 14 bp, Homo sapiens
agaaaaacatgtca

SEQ ID NO: 2191020 - DNA, 15 bp, Homo sapiens
agaaaagactgacct

SEQ ID NO: 2191021 - DNA, 14 bp, Homo sapiens
agaaaattgccaaa

SEQ ID NO: 2191022 - DNA, 15 bp, Homo sapiens
agaaaattgccaaaa

SEQ ID NO: 2191023 - DNA, 20 bp, Homo sapiens
agaaaattgccaaaatatat

SEQ ID NO: 2191024 - DNA, 14 bp, Homo sapiens
agaaacagctcagc

SEQ ID NO: 2191025 - DNA, 17 bp, Homo sapiens
agaaacagctcagccag

SEQ ID NO: 2191026 - DNA, 18 bp, Homo sapiens
agaaacagctcagccagt

SEQ ID NO: 2191027 - DNA, 18 bp, Homo sapiens
agaaacttaaatgttatt

SEQ ID NO: 2191028 - DNA, 22 bp, Homo sapiens
agaaagagagaagccagccaca

SEQ ID NO: 2191029 - DNA, 14 bp, Homo sapiens
agaaagagctgcct

SEQ ID NO: 2191030 - DNA, 15 bp, Homo sapiens
agaaagagctgcctg

SEQ ID NO: 2191031 - DNA, 19 bp, Homo sapiens
agaaagagctgcctggatg

SEQ ID NO: 2191032 - DNA, 23 bp, Homo sapiens
agaaagcagaggctggcctcaga

SEQ ID NO: 2191033 - DNA, 14 bp, Homo sapiens
agaaagctgtgaaa

SEQ ID NO: 2191034 - DNA, 18 bp, Homo sapiens
agaaagctgtgaaattga

SEQ ID NO: 2191035 - DNA, 17 bp, Homo sapiens
agaaaggggcaggagct

SEQ ID NO: 2191036 - DNA, 22 bp, Homo sapiens
agaaagttgtgtaggcaccacc

SEQ ID NO: 2191037 - DNA, 20 bp, Homo sapiens
agaaatcctttcataaagca

SEQ ID NO: 2191038 - DNA, 14 bp, Homo sapiens
agaaattacaagtt

SEQ ID NO: 2191039 - DNA, 16 bp, Homo sapiens
agaaattgtatattgt

SEQ ID NO: 2191040 - DNA, 20 bp, Homo sapiens
agaacaaaacctcttctgta

SEQ ID NO: 2191041 - DNA, 18 bp, Homo sapiens
agaacagatctccaaagc

SEQ ID NO: 2191042 - DNA, 20 bp, Homo sapiens
agaacagatctccaaagctt

SEQ ID NO: 2191043 - DNA, 16 bp, Homo sapiens
agaacagatggctgtg

SEQ ID NO: 2191044 - DNA, 20 bp, Homo sapiens
agaacagatggctgtgaaaa

SEQ ID NO: 2191045 - DNA, 18 bp, Homo sapiens
agaacagcaggcccacct

SEQ ID NO: 2191046 - DNA, 19 bp, Homo sapiens
agaacagcaggcccaccta

SEQ ID NO: 2191047 - DNA, 13 bp, Homo sapiens
agaacagggatgc

SEQ ID NO: 2191048 - DNA, 20 bp, Homo sapiens
agaacagttaagcagccgcc

SEQ ID NO: 2191049 - DNA, 15 bp, Homo sapiens
agaacattcagctct

SEQ ID NO: 2191050 - DNA, 21 bp, Homo sapiens
agaacattcagctctggagaa

SEQ ID NO: 2191051 - DNA, 22 bp, Homo sapiens
agaacattcagctctggagaac

SEQ ID NO: 2191052 - DNA, 22 bp, Homo sapiens
agaaccctggtgaggaagctcc

SEQ ID NO: 2191053 - DNA, 14 bp, Homo sapiens
agaacctggtggct

SEQ ID NO: 2191054 - DNA, 16 bp, Homo sapiens
agaacctggtggctgg

SEQ ID NO: 2191055 - DNA, 22 bp, Homo sapiens
agaactagtggtggctctgaga

SEQ ID NO: 2191056 - DNA, 17 bp, Homo sapiens
agaactgatgacactga

SEQ ID NO: 2191057 - DNA, 21 bp, Homo sapiens
agaactgctaaatactgtaca

SEQ ID NO: 2191058 - DNA, 22 bp, Homo sapiens
agaactgctaaatactgtacat

SEQ ID NO: 2191059 - DNA, 14 bp, Homo sapiens
agaacttagttttg

SEQ ID NO: 2191060 - DNA, 13 bp, Homo sapiens
agaagagggagaa

SEQ ID NO: 2191061 - DNA, 16 bp, Homo sapiens
agaagagggagaagga

SEQ ID NO: 2191062 - DNA, 21 bp, Homo sapiens
agaagagggagaaggagaggc

SEQ ID NO: 2191063 - DNA, 18 bp, Homo sapiens
agaagccagccacagacc

SEQ ID NO: 2191064 - DNA, 14 bp, Homo sapiens
agaagcctgggtgg

SEQ ID NO: 2191065 - DNA, 16 bp, Homo sapiens
agaaggctggggctat

SEQ ID NO: 2191066 - DNA, 14 bp, Homo sapiens
agaagggggccctg

SEQ ID NO: 2191067 - DNA, 17 bp, Homo sapiens
agaagggggccctgcta

SEQ ID NO: 2191068 - DNA, 18 bp, Homo sapiens
agaagggggccctgctac

SEQ ID NO: 2191069 - DNA, 20 bp, Homo sapiens
agaagggggccctgctacct

SEQ ID NO: 2191070 - DNA, 23 bp, Homo sapiens
agaaggtgggggttggctgggta

SEQ ID NO: 2191071 - DNA, 15 bp, Homo sapiens
agaagtcggccaggt

SEQ ID NO: 2191072 - DNA, 19 bp, Homo sapiens
agaagtgggagtgggagag

SEQ ID NO: 2191073 - DNA, 20 bp, Homo sapiens
agaagtgggagtgggagagg

SEQ ID NO: 2191074 - DNA, 15 bp, Homo sapiens
agaagtggtgttttt

SEQ ID NO: 2191075 - DNA, 14 bp, Homo sapiens
agaagtgtgttttg

SEQ ID NO: 2191076 - DNA, 15 bp, Homo sapiens
agaagttagtttgta

SEQ ID NO: 2191077 - DNA, 20 bp, Homo sapiens
agaagttgttagtgatttgc

SEQ ID NO: 2191078 - DNA, 22 bp, Homo sapiens
agaataaatacaatattgcatt

SEQ ID NO: 2191079 - DNA, 20 bp, Homo sapiens
agaataatgacgtattgtga

SEQ ID NO: 2191080 - DNA, 15 bp, Homo sapiens
agaatactaataaaa

SEQ ID NO: 2191081 - DNA, 14 bp, Homo sapiens
agaatattaaaaat

SEQ ID NO: 2191082 - DNA, 15 bp, Homo sapiens
agaatattaaaaatt

SEQ ID NO: 2191083 - DNA, 16 bp, Homo sapiens
agaatcaagtctgtga

SEQ ID NO: 2191084 - DNA, 16 bp, Homo sapiens
tgtccctgcagggcca

SEQ ID NO: 2191085 - DNA, 21 bp, Homo sapiens
tgtccctgcagggccatctga

SEQ ID NO: 2191086 - DNA, 17 bp, Homo sapiens
tgtcctcccacccctcc

SEQ ID NO: 2191087 - DNA, 19 bp, Homo sapiens
tgtcctcttctgtgagtca

SEQ ID NO: 2191088 - DNA, 15 bp, Homo sapiens
tgtcctgcagagctg

SEQ ID NO: 2191089 - DNA, 16 bp, Homo sapiens
tgtcctgcagagctgg

SEQ ID NO: 2191090 - DNA, 23 bp, Homo sapiens
tgtccttcccacggccactgcag

SEQ ID NO: 2191091 - DNA, 11 bp, Homo sapiens
tgtccttctcc

SEQ ID NO: 2191092 - DNA, 13 bp, Homo sapiens
tgtccttctcctc

SEQ ID NO: 2191093 - DNA, 20 bp, Homo sapiens
tgtcgttgactttagggact

SEQ ID NO: 2191094 - DNA, 23 bp, Homo sapiens
tgtctaaaataggttttccctgt

SEQ ID NO: 2191095 - DNA, 13 bp, Homo sapiens
tgtctaacaggac

SEQ ID NO: 2191096 - DNA, 20 bp, Homo sapiens
tgtctccctataatgctgga

SEQ ID NO: 2191097 - DNA, 11 bp, Homo sapiens
tgtctcctgca

SEQ ID NO: 2191098 - DNA, 20 bp, Homo sapiens
tgtctcgaaataatttttta

SEQ ID NO: 2191099 - DNA, 15 bp, Homo sapiens
tgtctgaaattttct

SEQ ID NO: 2191100 - DNA, 22 bp, Homo sapiens
tgtctgaaattttctagaatac

SEQ ID NO: 2191101 - DNA, 12 bp, Homo sapiens
tgtctgatattg

SEQ ID NO: 2191102 - DNA, 21 bp, Homo sapiens
tgtctgtgaacataggtgtgc

SEQ ID NO: 2191103 - DNA, 15 bp, Homo sapiens
tgtctgtttccttct

SEQ ID NO: 2191104 - DNA, 17 bp, Homo sapiens
tgtcttgatatatttat

SEQ ID NO: 2191105 - DNA, 23 bp, Homo sapiens
tgtcttttaatgatactgtctaa

SEQ ID NO: 2191106 - DNA, 14 bp, Homo sapiens
tgtgaaatttgtta

SEQ ID NO: 2191107 - DNA, 22 bp, Homo sapiens
tgtgaagcctgtcgtgttctct

SEQ ID NO: 2191108 - DNA, 22 bp, Homo sapiens
tgtgaatgctgtacctttctga

SEQ ID NO: 2191109 - DNA, 15 bp, Homo sapiens
tgtgacctaagaaca

SEQ ID NO: 2191110 - DNA, 16 bp, Homo sapiens
tgtgacctaagaacaa

SEQ ID NO: 2191111 - DNA, 19 bp, Homo sapiens
tgtgacgggggttggggtg

SEQ ID NO: 2191112 - DNA, 23 bp, Homo sapiens
tgtgactgatgttaggctgggcc

SEQ ID NO: 2191113 - DNA, 15 bp, Homo sapiens
tgtgacttttagaca

SEQ ID NO: 2191114 - DNA, 17 bp, Homo sapiens
tgtgagcatgaaactat

SEQ ID NO: 2191115 - DNA, 13 bp, Homo sapiens
tgtgatgtatgtt

SEQ ID NO: 2191116 - DNA, 22 bp, Homo sapiens
tgtgattactctttgctttgta

SEQ ID NO: 2191117 - DNA, 16 bp, Homo sapiens
tgtgattattctgtat

SEQ ID NO: 2191118 - DNA, 22 bp, Homo sapiens
tgtgcagggtcctccggggctc

SEQ ID NO: 2191119 - DNA, 14 bp, Homo sapiens
tgtgcattgctgtg

SEQ ID NO: 2191120 - DNA, 13 bp, Homo sapiens
tgtgccaccctct

SEQ ID NO: 2191121 - DNA, 22 bp, Homo sapiens
tgtgcccacccgtcttcaatct

SEQ ID NO: 2191122 - DNA, 21 bp, Homo sapiens
tgtgcccagcagtttcccaga

SEQ ID NO: 2191123 - DNA, 20 bp, Homo sapiens
tgtgcccagtcatgacattt

SEQ ID NO: 2191124 - DNA, 22 bp, Homo sapiens
tgtgcccgcctctccacgcact

SEQ ID NO: 2191125 - DNA, 14 bp, Homo sapiens
tgtgcccttgctgg

SEQ ID NO: 2191126 - DNA, 22 bp, Homo sapiens
tgtgcctcattaagaggcaggt

SEQ ID NO: 2191127 - DNA, 22 bp, Homo sapiens
tgtgctctgaatgggagccaga

SEQ ID NO: 2191128 - DNA, 22 bp, Homo sapiens
tgtgctgattcaataaaatgca

SEQ ID NO: 2191129 - DNA, 14 bp, Homo sapiens
tgtgctggagccac

SEQ ID NO: 2191130 - DNA, 22 bp, Homo sapiens
tgtgctttctatctaattttta

SEQ ID NO: 2191131 - DNA, 17 bp, Homo sapiens
tgtggaaaaaaaaagaa

SEQ ID NO: 2191132 - DNA, 14 bp, Homo sapiens
tgtggagaggagag

SEQ ID NO: 2191133 - DNA, 14 bp, Homo sapiens
tgtggaggtggctg

SEQ ID NO: 2191134 - DNA, 21 bp, Homo sapiens
tgtggatgatttttttgaact

SEQ ID NO: 2191135 - DNA, 16 bp, Homo sapiens
tgtgggagaagggaca

SEQ ID NO: 2191136 - DNA, 21 bp, Homo sapiens
tggagaaagagctgcctggat

SEQ ID NO: 2191137 - DNA, 21 bp, Homo sapiens
tggagaacagtggttgcctgg

SEQ ID NO: 2191138 - DNA, 22 bp, Homo sapiens
tggagaacagtggttgcctggg

SEQ ID NO: 2191139 - DNA, 13 bp, Homo sapiens
tggagacaatgca

SEQ ID NO: 2191140 - DNA, 21 bp, Homo sapiens
tggagaggagagaatgagaga

SEQ ID NO: 2191141 - DNA, 13 bp, Homo sapiens
tggagagtagaca

SEQ ID NO: 2191142 - DNA, 11 bp, Homo sapiens
tggagccacag

SEQ ID NO: 2191143 - DNA, 17 bp, Homo sapiens
tggagccacaggcagac

SEQ ID NO: 2191144 - DNA, 16 bp, Homo sapiens
tggagccactaactag

SEQ ID NO: 2191145 - DNA, 22 bp, Homo sapiens
tggagctacactcattgaaatg

SEQ ID NO: 2191146 - DNA, 20 bp, Homo sapiens
tggagctcctgggaaggcta

SEQ ID NO: 2191147 - DNA, 22 bp, Homo sapiens
tggaggcattcccagaggtggg

SEQ ID NO: 2191148 - DNA, 20 bp, Homo sapiens
tggaggcccttttctggctc

SEQ ID NO: 2191149 - DNA, 19 bp, Homo sapiens
tggaggccgctgctgacca

SEQ ID NO: 2191150 - DNA, 14 bp, Homo sapiens
tggaggcctcaccc

SEQ ID NO: 2191151 - DNA, 14 bp, Homo sapiens
tggaggcctctggg

SEQ ID NO: 2191152 - DNA, 15 bp, Homo sapiens
tggaggcctctgggc

SEQ ID NO: 2191153 - DNA, 16 bp, Homo sapiens
tggaggcctctgggcc

SEQ ID NO: 2191154 - DNA, 18 bp, Homo sapiens
tggaggtctccaggggcc

SEQ ID NO: 2191155 - DNA, 18 bp, Homo sapiens
tggagtagacccctggct

SEQ ID NO: 2191156 - DNA, 19 bp, Homo sapiens
tggagtgatctcagctcac

SEQ ID NO: 2191157 - DNA, 13 bp, Homo sapiens
tggagtggaggca

SEQ ID NO: 2191158 - DNA, 16 bp, Homo sapiens
tggagtggaggcattg

SEQ ID NO: 2191159 - DNA, 13 bp, Homo sapiens
tggatagatgccc

SEQ ID NO: 2191160 - DNA, 16 bp, Homo sapiens
tggatagtagatctgt

SEQ ID NO: 2191161 - DNA, 24 bp, Homo sapiens
tggatcaaaatctgtagagcaggg

SEQ ID NO: 2191162 - DNA, 20 bp, Homo sapiens
tggatctatcacctgtcatc

SEQ ID NO: 2191163 - DNA, 21 bp, Homo sapiens
tggatctatcacctgtcatca

SEQ ID NO: 2191164 - DNA, 18 bp, Homo sapiens
tggatgagaaacagctca

SEQ ID NO: 2191165 - DNA, 20 bp, Homo sapiens
tggatgggggtgcaggcagc

SEQ ID NO: 2191166 - DNA, 14 bp, Homo sapiens
tggattatacaaaa

SEQ ID NO: 2191167 - DNA, 14 bp, Homo sapiens
tggattgggctgca

SEQ ID NO: 2191168 - DNA, 20 bp, Homo sapiens
tggcaaggactttgtacatt

SEQ ID NO: 2191169 - DNA, 21 bp, Homo sapiens
tggcaaggactttgtacattt

SEQ ID NO: 2191170 - DNA, 13 bp, Homo sapiens
tggcaggagggtg

SEQ ID NO: 2191171 - DNA, 15 bp, Homo sapiens
tggcaggggagcagg

SEQ ID NO: 2191172 - DNA, 19 bp, Homo sapiens
tggcatctttggaggaatt

SEQ ID NO: 2191173 - DNA, 15 bp, Homo sapiens
tggccaaaacaggct

SEQ ID NO: 2191174 - DNA, 13 bp, Homo sapiens
tggccaagaagca

SEQ ID NO: 2191175 - DNA, 13 bp, Homo sapiens
tggccaccacccc

SEQ ID NO: 2191176 - DNA, 15 bp, Homo sapiens
tggccaccacccccc

SEQ ID NO: 2191177 - DNA, 18 bp, Homo sapiens
tggccaccaccccccact

SEQ ID NO: 2191178 - DNA, 20 bp, Homo sapiens
tggccactatcacatatgct

SEQ ID NO: 2191179 - DNA, 20 bp, Homo sapiens
tggccactttgcagacctgg

SEQ ID NO: 2191180 - DNA, 21 bp, Homo sapiens
tggccactttgcagacctggg

SEQ ID NO: 2191181 - DNA, 23 bp, Homo sapiens
tggccactttgcagacctgggac

SEQ ID NO: 2191182 - DNA, 20 bp, Homo sapiens
tggccagaccagagctctgg

SEQ ID NO: 2191183 - DNA, 23 bp, Homo sapiens
tggccagaccagagctctggagc

SEQ ID NO: 2191184 - DNA, 11 bp, Homo sapiens
tggccatctct

SEQ ID NO: 2191185 - DNA, 22 bp, Homo sapiens
tggcccatcactcggctgtgga

SEQ ID NO: 2191186 - DNA, 15 bp, Homo sapiens
tggccgatgagctgg

SEQ ID NO: 2191187 - DNA, 16 bp, Homo sapiens
tggccgatgagctggt

SEQ ID NO: 2191188 - DNA, 20 bp, Homo sapiens
tggccgcttccctacccaca

SEQ ID NO: 2191189 - DNA, 22 bp, Homo sapiens
tggccgcttccctacccacagg

SEQ ID NO: 2191190 - DNA, 16 bp, Homo sapiens
tggccgggcacagctg

SEQ ID NO: 2191191 - DNA, 19 bp, Homo sapiens
tggccgggcacagctgtgg

SEQ ID NO: 2191192 - DNA, 21 bp, Homo sapiens
tggccgggttggaggcctcac

SEQ ID NO: 2191193 - DNA, 15 bp, Homo sapiens
tggcctaaagccagc

SEQ ID NO: 2191194 - DNA, 23 bp, Homo sapiens
tggcctattttggacgtgtgagg

SEQ ID NO: 2191195 - DNA, 14 bp, Homo sapiens
tggcctctgctttc

SEQ ID NO: 2191196 - DNA, 22 bp, Homo sapiens
tggcctcttcctccctccctgc

SEQ ID NO: 2191197 - DNA, 18 bp, Homo sapiens
tggcgatatgagagggat

SEQ ID NO: 2191198 - DNA, 17 bp, Homo sapiens
tggctcacagactggag

SEQ ID NO: 2191199 - DNA, 18 bp, Homo sapiens
tggctcacgcctgtaatc

SEQ ID NO: 2191200 - DNA, 21 bp, Homo sapiens
tggctcactatggtgccaatg

SEQ ID NO: 2191201 - DNA, 17 bp, Homo sapiens
tggctcactgcagcctc

SEQ ID NO: 2191202 - DNA, 15 bp, Homo sapiens
tggctcagcatcctc

SEQ ID NO: 2191203 - DNA, 18 bp, Homo sapiens
tggctcagcatcctccac

SEQ ID NO: 2191204 - DNA, 14 bp, Homo sapiens
tggctcctgtgtgg

SEQ ID NO: 2191205 - DNA, 16 bp, Homo sapiens
tggctcgtgggctctg

SEQ ID NO: 2191206 - DNA, 19 bp, Homo sapiens
tggctcgtgggctctggct

SEQ ID NO: 2191207 - DNA, 20 bp, Homo sapiens
tggctcgtgggctctggctc

SEQ ID NO: 2191208 - DNA, 21 bp, Homo sapiens
tggctgatttagaccaaaaga

SEQ ID NO: 2191209 - DNA, 16 bp, Homo sapiens
tggctgcaagcgcact

SEQ ID NO: 2191210 - DNA, 16 bp, Homo sapiens
tggctgcctggcccag

SEQ ID NO: 2191211 - DNA, 17 bp, Homo sapiens
tggctgcctggcccagg

SEQ ID NO: 2191212 - DNA, 15 bp, Homo sapiens
tggctggggacttgg

SEQ ID NO: 2191213 - DNA, 21 bp, Homo sapiens
tggctggggacttggccgctt

SEQ ID NO: 2191214 - DNA, 23 bp, Homo sapiens
tggctggtgccgaagtgtttctg

SEQ ID NO: 2191215 - DNA, 14 bp, Homo sapiens
tggctgtaatttaa

SEQ ID NO: 2191216 - DNA, 21 bp, Homo sapiens
tggctgtaatttaattcccct

SEQ ID NO: 2191217 - DNA, 20 bp, Homo sapiens
tggcttcaatctacgatgtt

SEQ ID NO: 2191218 - DNA, 15 bp, Homo sapiens
tggcttcctaaatgg

SEQ ID NO: 2191219 - DNA, 16 bp, Homo sapiens
tggcttctgcttgtca

SEQ ID NO: 2191220 - DNA, 21 bp, Homo sapiens
tggcttctgcttgtcatccac

SEQ ID NO: 2191221 - DNA, 17 bp, Homo sapiens
tggcttcttttggaaag

SEQ ID NO: 2191222 - DNA, 23 bp, Homo sapiens
tggctttgcccaacctcagcaac

SEQ ID NO: 2191223 - DNA, 13 bp, Homo sapiens
tgggaaaaaaaga

SEQ ID NO: 2191224 - DNA, 23 bp, Homo sapiens
tgggaaaatgtcccccacctctt

SEQ ID NO: 2191225 - DNA, 17 bp, Homo sapiens
tgggaaatttgggtttt

SEQ ID NO: 2191226 - DNA, 17 bp, Homo sapiens
tgggaactcccaagaac

SEQ ID NO: 2191227 - DNA, 22 bp, Homo sapiens
tgggaactcccaagaacagcag

SEQ ID NO: 2191228 - DNA, 24 bp, Homo sapiens
tgggaagccaggaaagcgtttgga

SEQ ID NO: 2191229 - DNA, 22 bp, Homo sapiens
tgggaagcccatcctgaccagc

SEQ ID NO: 2191230 - DNA, 16 bp, Homo sapiens
tgggaccaaacctagc

SEQ ID NO: 2191231 - DNA, 23 bp, Homo sapiens
tgggacgggatggttctggctgt

SEQ ID NO: 2191232 - DNA, 18 bp, Homo sapiens
tgggactgatgtcatctt

SEQ ID NO: 2191233 - DNA, 16 bp, Homo sapiens
tgggactgtcttgaga

SEQ ID NO: 2191234 - DNA, 18 bp, Homo sapiens
tgggactgtcttgagaaa

SEQ ID NO: 2191235 - DNA, 12 bp, Homo sapiens
tgggagaggaag

SEQ ID NO: 2191236 - DNA, 14 bp, Homo sapiens
tgggagaggaagcc

SEQ ID NO: 2191237 - DNA, 15 bp, Homo sapiens
tgggagaggaagcca

SEQ ID NO: 2191238 - DNA, 13 bp, Homo sapiens
tgggagagggagc

SEQ ID NO: 2191239 - DNA, 18 bp, Homo sapiens
tgggagcttccgctttga

SEQ ID NO: 2191240 - DNA, 18 bp, Homo sapiens
tgggaggcccctggtggc

SEQ ID NO: 2191241 - DNA, 23 bp, Homo sapiens
tgggatccgcatccagccgtgct

SEQ ID NO: 2191242 - DNA, 12 bp, Homo sapiens
tgggattacagg

SEQ ID NO: 2191243 - DNA, 22 bp, Homo sapiens
tgggattacaggtgactgccac

SEQ ID NO: 2191244 - DNA, 21 bp, Homo sapiens
tgggcacccagcctctaggga

SEQ ID NO: 2191245 - DNA, 22 bp, Homo sapiens
tgggcagaggggagaggaagca

SEQ ID NO: 2191246 - DNA, 22 bp, Homo sapiens
tgggcagatctaccccttactt

SEQ ID NO: 2191247 - DNA, 17 bp, Homo sapiens
tgggcagggaggcacca

SEQ ID NO: 2191248 - DNA, 15 bp, Homo sapiens
tgggcataagcaaac

SEQ ID NO: 2191249 - DNA, 19 bp, Homo sapiens
tgggccaagccagggatgg

SEQ ID NO: 2191250 - DNA, 18 bp, Homo sapiens
tgggcccagaggcacagc

SEQ ID NO: 2191251 - DNA, 14 bp, Homo sapiens
tgggccccaggcac

SEQ ID NO: 2191252 - DNA, 15 bp, Homo sapiens
tgggccccaggcacc

SEQ ID NO: 2191253 - DNA, 17 bp, Homo sapiens
tgggccccgggctggag

SEQ ID NO: 2191254 - DNA, 18 bp, Homo sapiens
tgggccccgggctggaga

SEQ ID NO: 2191255 - DNA, 23 bp, Homo sapiens
tgggccccgggctggagaaagag

SEQ ID NO: 2191256 - DNA, 16 bp, Homo sapiens
tgggcctcaggctctg

SEQ ID NO: 2191257 - DNA, 18 bp, Homo sapiens
tgggcctcaggctctgca

SEQ ID NO: 2191258 - DNA, 21 bp, Homo sapiens
tgggctgttttagtgccaggc

SEQ ID NO: 2191259 - DNA, 20 bp, Homo sapiens
tgggctttgattccatctcc

SEQ ID NO: 2191260 - DNA, 23 bp, Homo sapiens
tgggctttgattccatctccttg

SEQ ID NO: 2191261 - DNA, 20 bp, Homo sapiens
tggggacagctttcctgggt

SEQ ID NO: 2191262 - DNA, 14 bp, Homo sapiens
tggggatgtaacca

SEQ ID NO: 2191263 - DNA, 21 bp, Homo sapiens
tggggatgtaaccaagctgta

SEQ ID NO: 2191264 - DNA, 15 bp, Homo sapiens
tggggccacagccag

SEQ ID NO: 2191265 - DNA, 16 bp, Homo sapiens
tggggccacagccaga

SEQ ID NO: 2191266 - DNA, 20 bp, Homo sapiens
tggggccgccacggcctggc

SEQ ID NO: 2191267 - DNA, 17 bp, Homo sapiens
tggggcctggactggac

SEQ ID NO: 2191268 - DNA, 19 bp, Homo sapiens
tggggctcagccctgagct

SEQ ID NO: 2191269 - DNA, 11 bp, Homo sapiens
tggggctgggg

SEQ ID NO: 2191270 - DNA, 20 bp, Homo sapiens
tgggggtgtcacagaggcag

SEQ ID NO: 2191271 - DNA, 19 bp, Homo sapiens
tggggtgccctccactgcc

SEQ ID NO: 2191272 - DNA, 17 bp, Homo sapiens
tgggtaattcaagaggc

SEQ ID NO: 2191273 - DNA, 17 bp, Homo sapiens
tgggtatcaaacagctc

SEQ ID NO: 2191274 - DNA, 20 bp, Homo sapiens
tgggtatcaaacagctcagg

SEQ ID NO: 2191275 - DNA, 12 bp, Homo sapiens
tgggtgagaaat

SEQ ID NO: 2191276 - DNA, 14 bp, Homo sapiens
tgggtgagaaattt

SEQ ID NO: 2191277 - DNA, 17 bp, Homo sapiens
tgggtgagaaattttag

SEQ ID NO: 2191278 - DNA, 19 bp, Homo sapiens
tgggtgagaaattttagtt

SEQ ID NO: 2191279 - DNA, 18 bp, Homo sapiens
tgggtgcccacagcccgc

SEQ ID NO: 2191280 - DNA, 17 bp, Homo sapiens
tgggttttttaattgag

SEQ ID NO: 2191281 - DNA, 21 bp, Homo sapiens
tggtaagagtcacaatttgca

SEQ ID NO: 2191282 - DNA, 13 bp, Homo sapiens
tggtattcaattt

SEQ ID NO: 2191283 - DNA, 14 bp, Homo sapiens
tggtcacagagaac

SEQ ID NO: 2191284 - DNA, 13 bp, Homo sapiens
tggtcaccttcct

SEQ ID NO: 2191285 - DNA, 13 bp, Homo sapiens
tggtcatttgcca

SEQ ID NO: 2191286 - DNA, 13 bp, Homo sapiens
tggtccagattgt

SEQ ID NO: 2191287 - DNA, 20 bp, Homo sapiens
tggtcctaagtccctgcccc

SEQ ID NO: 2191288 - DNA, 23 bp, Homo sapiens
tggtcgagaaagaggcaccagga

SEQ ID NO: 2191289 - DNA, 19 bp, Homo sapiens
tggtgaccagtttcttaaa

SEQ ID NO: 2191290 - DNA, 19 bp, Homo sapiens
tggtgcacatgacatttgt

SEQ ID NO: 2191291 - DNA, 21 bp, Homo sapiens
tggtgcagatgcctgcagtgc

SEQ ID NO: 2191292 - DNA, 17 bp, Homo sapiens
tggtgccaatggaacct

SEQ ID NO: 2191293 - DNA, 11 bp, Homo sapiens
tggtgccttca

SEQ ID NO: 2191294 - DNA, 15 bp, Homo sapiens
tggtggcccctcccc

SEQ ID NO: 2191295 - DNA, 23 bp, Homo sapiens
tggtggcgctttctcctgtgccc

SEQ ID NO: 2191296 - DNA, 14 bp, Homo sapiens
tggtgggaaaatgt

SEQ ID NO: 2191297 - DNA, 18 bp, Homo sapiens
tggtggtttctatacatg

SEQ ID NO: 2191298 - DNA, 17 bp, Homo sapiens
tgccctccactgccctc

SEQ ID NO: 2191299 - DNA, 19 bp, Homo sapiens
tgccctccactgccctctg

SEQ ID NO: 2191300 - DNA, 14 bp, Homo sapiens
tgcccttgctgggt

SEQ ID NO: 2191301 - DNA, 12 bp, Homo sapiens
tgccgaagtgtt

SEQ ID NO: 2191302 - DNA, 14 bp, Homo sapiens
tgccgaagtgtttc

SEQ ID NO: 2191303 - DNA, 20 bp, Homo sapiens
tgccgcgtgcgaccagaggt

SEQ ID NO: 2191304 - DNA, 13 bp, Homo sapiens
tgccgctgggaga

SEQ ID NO: 2191305 - DNA, 22 bp, Homo sapiens
tgccgctgggagagccaaggcc

SEQ ID NO: 2191306 - DNA, 19 bp, Homo sapiens
tgcctagcactcacatgct

SEQ ID NO: 2191307 - DNA, 17 bp, Homo sapiens
tgcctatttattcattc

SEQ ID NO: 2191308 - DNA, 18 bp, Homo sapiens
tgcctatttattcattca

SEQ ID NO: 2191309 - DNA, 19 bp, Homo sapiens
tgcctatttattcattcag

SEQ ID NO: 2191310 - DNA, 14 bp, Homo sapiens
tgcctcagcctccc

SEQ ID NO: 2191311 - DNA, 15 bp, Homo sapiens
tgcctcagcctcccg

SEQ ID NO: 2191312 - DNA, 15 bp, Homo sapiens
tgcctccatggtgcc

SEQ ID NO: 2191313 - DNA, 20 bp, Homo sapiens
tgcctccatggtgcctctgg

SEQ ID NO: 2191314 - DNA, 20 bp, Homo sapiens
tgcctccctgaccctgcaga

SEQ ID NO: 2191315 - DNA, 15 bp, Homo sapiens
tgcctcctctgtcct

SEQ ID NO: 2191316 - DNA, 14 bp, Homo sapiens
tgcctcttgggaga

SEQ ID NO: 2191317 - DNA, 16 bp, Homo sapiens
tgcctgcgcagctcct

SEQ ID NO: 2191318 - DNA, 16 bp, Homo sapiens
tgcctggagctcctgg

SEQ ID NO: 2191319 - DNA, 17 bp, Homo sapiens
tgcctggagctcctggg

SEQ ID NO: 2191320 - DNA, 18 bp, Homo sapiens
tgcctggatgggggtgca

SEQ ID NO: 2191321 - DNA, 16 bp, Homo sapiens
tgccttatctgttcct

SEQ ID NO: 2191322 - DNA, 11 bp, Homo sapiens
tgcctttcccc

SEQ ID NO: 2191323 - DNA, 14 bp, Homo sapiens
tgcctttccccatt

SEQ ID NO: 2191324 - DNA, 22 bp, Homo sapiens
tgcgaccagaggtgggaggccc

SEQ ID NO: 2191325 - DNA, 23 bp, Homo sapiens
tgcgatcatggctcactgcagcc

SEQ ID NO: 2191326 - DNA, 11 bp, Homo sapiens
tgcgatgtgtt

SEQ ID NO: 2191327 - DNA, 17 bp, Homo sapiens
tgcgcaaaacccagaag

SEQ ID NO: 2191328 - DNA, 15 bp, Homo sapiens
tgcgcagctccttcc

SEQ ID NO: 2191329 - DNA, 18 bp, Homo sapiens
tgcgccgctgtgctgttg

SEQ ID NO: 2191330 - DNA, 11 bp, Homo sapiens
tgcggctgctg

SEQ ID NO: 2191331 - DNA, 20 bp, Homo sapiens
tctgttaaaactcaaggctt

SEQ ID NO: 2191332 - DNA, 16 bp, Homo sapiens
tctgttacattctaag

SEQ ID NO: 2191333 - DNA, 22 bp, Homo sapiens
tctgttcagtaacagggccttg

SEQ ID NO: 2191334 - DNA, 16 bp, Homo sapiens
tctgttctgctcccag

SEQ ID NO: 2191335 - DNA, 18 bp, Homo sapiens
tctgttctgctcccagat

SEQ ID NO: 2191336 - DNA, 22 bp, Homo sapiens
tctgttctgctcccagatgcct

SEQ ID NO: 2191337 - DNA, 14 bp, Homo sapiens
tctgtttgaaaaac

SEQ ID NO: 2191338 - DNA, 22 bp, Homo sapiens
tctgtttgaaaaacctgttctg

SEQ ID NO: 2191339 - DNA, 14 bp, Homo sapiens
tctgtttgacaaac

SEQ ID NO: 2191340 - DNA, 18 bp, Homo sapiens
tcttacccttctgtgccc

SEQ ID NO: 2191341 - DNA, 20 bp, Homo sapiens
tcttacccttctgtgcccag

SEQ ID NO: 2191342 - DNA, 22 bp, Homo sapiens
tcttacccttctgtgcccagct

SEQ ID NO: 2191343 - DNA, 23 bp, Homo sapiens
tcttagaacagatggctgtgaaa

SEQ ID NO: 2191344 - DNA, 16 bp, Homo sapiens
tcttagcttacaggaa

SEQ ID NO: 2191345 - DNA, 20 bp, Homo sapiens
tcttaggatgtttcaccaag

SEQ ID NO: 2191346 - DNA, 13 bp, Homo sapiens
tcttcaagggctg

SEQ ID NO: 2191347 - DNA, 17 bp, Homo sapiens
tcttcaagggctgcttc

SEQ ID NO: 2191348 - DNA, 18 bp, Homo sapiens
tcttcaagggctgcttca

SEQ ID NO: 2191349 - DNA, 13 bp, Homo sapiens
tcttcaatctctg

SEQ ID NO: 2191350 - DNA, 15 bp, Homo sapiens
tcttcaatctctgtt

SEQ ID NO: 2191351 - DNA, 19 bp, Homo sapiens
tcttcaatctctgttctgc

SEQ ID NO: 2191352 - DNA, 17 bp, Homo sapiens
tcttcagatcctgctgc

SEQ ID NO: 2191353 - DNA, 17 bp, Homo sapiens
tcttcagtgactcctgc

SEQ ID NO: 2191354 - DNA, 20 bp, Homo sapiens
tcttcagtgactcctgctgg

SEQ ID NO: 2191355 - DNA, 13 bp, Homo sapiens
tcttccacagcaa

SEQ ID NO: 2191356 - DNA, 14 bp, Homo sapiens
tcttccatcagcag

SEQ ID NO: 2191357 - DNA, 19 bp, Homo sapiens
tcttcccaaggccagtctg

SEQ ID NO: 2191358 - DNA, 16 bp, Homo sapiens
tcttcctcctcccctg

SEQ ID NO: 2191359 - DNA, 17 bp, Homo sapiens
tcttcctcctcccctgg

SEQ ID NO: 2191360 - DNA, 13 bp, Homo sapiens
tcttcggaggtgg

SEQ ID NO: 2191361 - DNA, 15 bp, Homo sapiens
tcttctattgtgctt

SEQ ID NO: 2191362 - DNA, 18 bp, Homo sapiens
tcttctgaagatcagaac

SEQ ID NO: 2191363 - DNA, 20 bp, Homo sapiens
tcttctgaagatcagaacat

SEQ ID NO: 2191364 - DNA, 14 bp, Homo sapiens
tcttctgtagctat

SEQ ID NO: 2191365 - DNA, 14 bp, Homo sapiens
tcttgaactcctga

SEQ ID NO: 2191366 - DNA, 21 bp, Homo sapiens
tcttgaataaagtattctagt

SEQ ID NO: 2191367 - DNA, 14 bp, Homo sapiens
tcttggcctcccaa

SEQ ID NO: 2191368 - DNA, 20 bp, Homo sapiens
tcttgggcctcaggctctgc

SEQ ID NO: 2191369 - DNA, 19 bp, Homo sapiens
tcttggggggatttggctg

SEQ ID NO: 2191370 - DNA, 18 bp, Homo sapiens
tcttgtaaacctggaggg

SEQ ID NO: 2191371 - DNA, 12 bp, Homo sapiens
tcttgtgtgttt

SEQ ID NO: 2191372 - DNA, 22 bp, Homo sapiens
tctttagcagatattaaaaatt

SEQ ID NO: 2191373 - DNA, 17 bp, Homo sapiens
tctttagtgttcaaata

SEQ ID NO: 2191374 - DNA, 19 bp, Homo sapiens
tctttagtgttcaaatact

SEQ ID NO: 2191375 - DNA, 21 bp, Homo sapiens
tctttccaaattgatgggtgg

SEQ ID NO: 2191376 - DNA, 22 bp, Homo sapiens
tctttccaaattgatgggtggg

SEQ ID NO: 2191377 - DNA, 16 bp, Homo sapiens
tctttccatgcagtta

SEQ ID NO: 2191378 - DNA, 13 bp, Homo sapiens
tctttccttgtct

SEQ ID NO: 2191379 - DNA, 15 bp, Homo sapiens
tctttccttgtctct

SEQ ID NO: 2191380 - DNA, 17 bp, Homo sapiens
tctttccttgtctctca

SEQ ID NO: 2191381 - DNA, 18 bp, Homo sapiens
tctttccttgtctctcat

SEQ ID NO: 2191382 - DNA, 15 bp, Homo sapiens
tctttctagtttgtt

SEQ ID NO: 2191383 - DNA, 20 bp, Homo sapiens
tctttgaactccgctgcctt

SEQ ID NO: 2191384 - DNA, 22 bp, Homo sapiens
tctttgaactccgctgccttcc

SEQ ID NO: 2191385 - DNA, 16 bp, Homo sapiens
tctttgaccaaactgt

SEQ ID NO: 2191386 - DNA, 17 bp, Homo sapiens
tctttgagtcaagtcaa

SEQ ID NO: 2191387 - DNA, 15 bp, Homo sapiens
tctttgctttgtagt

SEQ ID NO: 2191388 - DNA, 18 bp, Homo sapiens
tctttgtaaggacttgtg

SEQ ID NO: 2191389 - DNA, 21 bp, Homo sapiens
tctttgtaagtaaactgccct

SEQ ID NO: 2191390 - DNA, 13 bp, Homo sapiens
tctttgtgtgctg

SEQ ID NO: 2191391 - DNA, 20 bp, Homo sapiens
tcttttactgtggaggtggc

SEQ ID NO: 2191392 - DNA, 17 bp, Homo sapiens
tcttttcctagttttat

SEQ ID NO: 2191393 - DNA, 11 bp, Homo sapiens
tcttttgtagt

SEQ ID NO: 2191394 - DNA, 15 bp, Homo sapiens
tctttttctgtctct

SEQ ID NO: 2191395 - DNA, 13 bp, Homo sapiens
tctttttttaaaa

SEQ ID NO: 2191396 - DNA, 20 bp, Homo sapiens
tctttttttaaaaagttgat

SEQ ID NO: 2191397 - DNA, 19 bp, Homo sapiens
tctttttttagggagaagg

SEQ ID NO: 2191398 - DNA, 21 bp, Homo sapiens
tgaaaaaagaaattccctgga

SEQ ID NO: 2191399 - DNA, 20 bp, Homo sapiens
tgaaaaatagtgtgtccatg

SEQ ID NO: 2191400 - DNA, 21 bp, Homo sapiens
tgaaaactttggagaactcat

SEQ ID NO: 2191401 - DNA, 18 bp, Homo sapiens
tgaaaagacgctaataaa

SEQ ID NO: 2191402 - DNA, 16 bp, Homo sapiens
tgaaaagattgcaaag

SEQ ID NO: 2191403 - DNA, 16 bp, Homo sapiens
tgaaaatgtccaggaa

SEQ ID NO: 2191404 - DNA, 19 bp, Homo sapiens
tgaaaattgtataaattac

SEQ ID NO: 2191405 - DNA, 11 bp, Homo sapiens
tgaaagaagca

SEQ ID NO: 2191406 - DNA, 12 bp, Homo sapiens
tgaaagaagcaa

SEQ ID NO: 2191407 - DNA, 17 bp, Homo sapiens
tgaaagctatgaatgtt

SEQ ID NO: 2191408 - DNA, 20 bp, Homo sapiens
tgaaataagaattcagacat

SEQ ID NO: 2191409 - DNA, 20 bp, Homo sapiens
tgaaatcccatctgcatttg

SEQ ID NO: 2191410 - DNA, 14 bp, Homo sapiens
tgaaatttgttaat

SEQ ID NO: 2191411 - DNA, 12 bp, Homo sapiens
tgaaattttcta

SEQ ID NO: 2191412 - DNA, 22 bp, Homo sapiens
tgaacaaaagcaggtttttata

SEQ ID NO: 2191413 - DNA, 14 bp, Homo sapiens
tgaacaaatttcaa

SEQ ID NO: 2191414 - DNA, 20 bp, Homo sapiens
tgaacaactcgaatcactca

SEQ ID NO: 2191415 - DNA, 15 bp, Homo sapiens
tgaacacaggcaatg

SEQ ID NO: 2191416 - DNA, 20 bp, Homo sapiens
tgaacatgccttatatttgt

SEQ ID NO: 2191417 - DNA, 18 bp, Homo sapiens
tgaactcacgagccttgc

SEQ ID NO: 2191418 - DNA, 16 bp, Homo sapiens
tgaactgcacaatgca

SEQ ID NO: 2191419 - DNA, 18 bp, Homo sapiens
tgaacttcagctagagct

SEQ ID NO: 2191420 - DNA, 21 bp, Homo sapiens
tgaagacaaaccactgtacat

SEQ ID NO: 2191421 - DNA, 22 bp, Homo sapiens
tgaagacactacagaggattct

SEQ ID NO: 2191422 - DNA, 17 bp, Homo sapiens
tgaagccatgtagccac

SEQ ID NO: 2191423 - DNA, 21 bp, Homo sapiens
tgaagccatgtagccacccaa

SEQ ID NO: 2191424 - DNA, 22 bp, Homo sapiens
tgaagcctgtcgtgttctctcc

SEQ ID NO: 2191425 - DNA, 19 bp, Homo sapiens
tgaagctcagtttggctgt

SEQ ID NO: 2191426 - DNA, 20 bp, Homo sapiens
tgaaggaaaaacatgcttaa

SEQ ID NO: 2191427 - DNA, 16 bp, Homo sapiens
tgaaggtaaagggaca

SEQ ID NO: 2191428 - DNA, 22 bp, Homo sapiens
tgaaggttggaactgctgccat

SEQ ID NO: 2191429 - DNA, 21 bp, Homo sapiens
tgaagtactggaatttattat

SEQ ID NO: 2191430 - DNA, 20 bp, Homo sapiens
tgaagtcccaatttaagagt

SEQ ID NO: 2191431 - DNA, 14 bp, Homo sapiens
tgaagtgaatacat

SEQ ID NO: 2191432 - DNA, 17 bp, Homo sapiens
tgaataatgtagtgcag

SEQ ID NO: 2191433 - DNA, 15 bp, Homo sapiens
tgaataggcattaaa

SEQ ID NO: 2191434 - DNA, 17 bp, Homo sapiens
tgaatatatgatttgca

SEQ ID NO: 2191435 - DNA, 20 bp, Homo sapiens
tgaatatttgtaaaaataat

SEQ ID NO: 2191436 - DNA, 23 bp, Homo sapiens
tgaatcaggaggagattaacaca

SEQ ID NO: 2191437 - DNA, 15 bp, Homo sapiens
tgaatctcagaaaat

SEQ ID NO: 2191438 - DNA, 22 bp, Homo sapiens
tgaatctgcattttctgggttc

SEQ ID NO: 2191439 - DNA, 19 bp, Homo sapiens
tgaatggactcatcttagt

SEQ ID NO: 2191440 - DNA, 14 bp, Homo sapiens
tgaattagctcact

SEQ ID NO: 2191441 - DNA, 12 bp, Homo sapiens
tgaatttctatg

SEQ ID NO: 2191442 - DNA, 17 bp, Homo sapiens
tgacaaacctctaaccc

SEQ ID NO: 2191443 - DNA, 18 bp, Homo sapiens
tgacaaagtcatgaagct

SEQ ID NO: 2191444 - DNA, 17 bp, Homo sapiens
tgacaaggtagacatgg

SEQ ID NO: 2191445 - DNA, 18 bp, Homo sapiens
tgacatttgtcctgcaga

SEQ ID NO: 2191446 - DNA, 21 bp, Homo sapiens
tgacatttgtcctgcagagct

SEQ ID NO: 2191447 - DNA, 18 bp, Homo sapiens
tgaccaaaatccccttct

SEQ ID NO: 2191448 - DNA, 15 bp, Homo sapiens
tgaccaaactgtggg

SEQ ID NO: 2191449 - DNA, 16 bp, Homo sapiens
tgaccacggctgttcc

SEQ ID NO: 2191450 - DNA, 18 bp, Homo sapiens
tgaccacttgatatgact

SEQ ID NO: 2191451 - DNA, 22 bp, Homo sapiens
tgaccagaaaacaaatcttcaa

SEQ ID NO: 2191452 - DNA, 13 bp, Homo sapiens
tgaccagtttctt

SEQ ID NO: 2191453 - DNA, 14 bp, Homo sapiens
tgaccagtttctta

SEQ ID NO: 2191454 - DNA, 14 bp, Homo sapiens
tgaccagtttcttt

SEQ ID NO: 2191455 - DNA, 19 bp, Homo sapiens
tctacagccagtaaggcag

SEQ ID NO: 2191456 - DNA, 14 bp, Homo sapiens
tctacatgtgccac

SEQ ID NO: 2191457 - DNA, 19 bp, Homo sapiens
tctaccactggtgtaaaaa

SEQ ID NO: 2191458 - DNA, 23 bp, Homo sapiens
tctaccactggtgtaaaaaacaa

SEQ ID NO: 2191459 - DNA, 13 bp, Homo sapiens
tctacccagccca

SEQ ID NO: 2191460 - DNA, 16 bp, Homo sapiens
tctacccagcccatct

SEQ ID NO: 2191461 - DNA, 15 bp, Homo sapiens
tctaccccttactta

SEQ ID NO: 2191462 - DNA, 14 bp, Homo sapiens
tctacctgccctct

SEQ ID NO: 2191463 - DNA, 18 bp, Homo sapiens
tctagaatactaataaaa

SEQ ID NO: 2191464 - DNA, 17 bp, Homo sapiens
tctagagcttgatgcca

SEQ ID NO: 2191465 - DNA, 21 bp, Homo sapiens
tctaggcgaggcgaagctgag

SEQ ID NO: 2191466 - DNA, 22 bp, Homo sapiens
tctagggaaggccacctgcagg

SEQ ID NO: 2191467 - DNA, 15 bp, Homo sapiens
tctagggacccctcc

SEQ ID NO: 2191468 - DNA, 16 bp, Homo sapiens
tctagggacccctcct

SEQ ID NO: 2191469 - DNA, 20 bp, Homo sapiens
tctaggtcaaggcctgtccc

SEQ ID NO: 2191470 - DNA, 23 bp, Homo sapiens
tctagtgataagaattcttaaca

SEQ ID NO: 2191471 - DNA, 21 bp, Homo sapiens
tctagttccctcagtgtgaag

SEQ ID NO: 2191472 - DNA, 13 bp, Homo sapiens
tctagttgtaatg

SEQ ID NO: 2191473 - DNA, 11 bp, Homo sapiens
tctatcacctg

SEQ ID NO: 2191474 - DNA, 18 bp, Homo sapiens
tctatcacctgtcatcat

SEQ ID NO: 2191475 - DNA, 15 bp, Homo sapiens
tctatccccaagctg

SEQ ID NO: 2191476 - DNA, 14 bp, Homo sapiens
tctatctaattttt

SEQ ID NO: 2191477 - DNA, 19 bp, Homo sapiens
tctatgactgaagtactgg

SEQ ID NO: 2191478 - DNA, 22 bp, Homo sapiens
tctatggcatattgataataaa

SEQ ID NO: 2191479 - DNA, 22 bp, Homo sapiens
tctatgggtatcaaacagctca

SEQ ID NO: 2191480 - DNA, 12 bp, Homo sapiens
tctattgtgctt

SEQ ID NO: 2191481 - DNA, 16 bp, Homo sapiens
tctattttgtctgata

SEQ ID NO: 2191482 - DNA, 16 bp, Homo sapiens
tctcaaaggagcgagc

SEQ ID NO: 2191483 - DNA, 19 bp, Homo sapiens
tctcaaagtttttacagtg

SEQ ID NO: 2191484 - DNA, 21 bp, Homo sapiens
tctcaaagtttttacagtgta

SEQ ID NO: 2191485 - DNA, 17 bp, Homo sapiens
tctcaacccaggagcat

SEQ ID NO: 2191486 - DNA, 15 bp, Homo sapiens
tctcactcccctcct

SEQ ID NO: 2191487 - DNA, 21 bp, Homo sapiens
tctcactttaataataaaaat

SEQ ID NO: 2191488 - DNA, 19 bp, Homo sapiens
tctcagagctacttgggcc

SEQ ID NO: 2191489 - DNA, 21 bp, Homo sapiens
tctcagagctacttgggccat

SEQ ID NO: 2191490 - DNA, 22 bp, Homo sapiens
tctcagctcactgcaacctcca

SEQ ID NO: 2191491 - DNA, 18 bp, Homo sapiens
tctcatgtttgtgcatgt

SEQ ID NO: 2191492 - DNA, 16 bp, Homo sapiens
tctcattctctttctt

SEQ ID NO: 2191493 - DNA, 17 bp, Homo sapiens
tctccaggggcctgcag

SEQ ID NO: 2191494 - DNA, 23 bp, Homo sapiens
tctccaggggcctgcagaaggaa

SEQ ID NO: 2191495 - DNA, 13 bp, Homo sapiens
tctcccagaggct

SEQ ID NO: 2191496 - DNA, 14 bp, Homo sapiens
tctcccagaggctc

SEQ ID NO: 2191497 - DNA, 20 bp, Homo sapiens
tctcccagaggctcctggag

SEQ ID NO: 2191498 - DNA, 22 bp, Homo sapiens
tctcccagaggctcctggagcc

SEQ ID NO: 2191499 - DNA, 23 bp, Homo sapiens
tctcccctcgttaacacatggct

SEQ ID NO: 2191500 - DNA, 12 bp, Homo sapiens
tctcccctctgc

SEQ ID NO: 2191501 - DNA, 13 bp, Homo sapiens
tctcccctctgct

SEQ ID NO: 2191502 - DNA, 19 bp, Homo sapiens
tctccctcgaacccacact

SEQ ID NO: 2191503 - DNA, 15 bp, Homo sapiens
tctcctcagcttggg

SEQ ID NO: 2191504 - DNA, 19 bp, Homo sapiens
tctcctgagggtcctgctg

SEQ ID NO: 2191505 - DNA, 21 bp, Homo sapiens
tctccttccaactgctgcccc

SEQ ID NO: 2191506 - DNA, 21 bp, Homo sapiens
tctccttcgctttcctgagcc

SEQ ID NO: 2191507 - DNA, 17 bp, Homo sapiens
tctccttttccttacca

SEQ ID NO: 2191508 - DNA, 16 bp, Homo sapiens
tctcggggcctgtgcc

SEQ ID NO: 2191509 - DNA, 20 bp, Homo sapiens
tctctacagcaccttaaaaa

SEQ ID NO: 2191510 - DNA, 20 bp, Homo sapiens
tctctacccagcccatcttg

SEQ ID NO: 2191511 - DNA, 16 bp, Homo sapiens
tctctagggaaggcca

SEQ ID NO: 2191512 - DNA, 21 bp, Homo sapiens
tctctagggaaggccacctgc

SEQ ID NO: 2191513 - DNA, 19 bp, Homo sapiens
tctctatctctttatatat

SEQ ID NO: 2191514 - DNA, 21 bp, Homo sapiens
tctctcaatttgggtcccagc

SEQ ID NO: 2191515 - DNA, 21 bp, Homo sapiens
tctctcccacacaagcagtct

SEQ ID NO: 2191516 - DNA, 21 bp, Homo sapiens
tctctccccttgcactggtca

SEQ ID NO: 2191517 - DNA, 13 bp, Homo sapiens
tctctcttaccct

SEQ ID NO: 2191518 - DNA, 11 bp, Homo sapiens
tctctgcttca

SEQ ID NO: 2191519 - DNA, 17 bp, Homo sapiens
tctctgtctaccatctc

SEQ ID NO: 2191520 - DNA, 18 bp, Homo sapiens
tctcttacccttctgtgc

SEQ ID NO: 2191521 - DNA, 23 bp, Homo sapiens
tctcttacccttctgtgcccagc

SEQ ID NO: 2191522 - DNA, 15 bp, Homo sapiens
tctcttcccctctca

SEQ ID NO: 2191523 - DNA, 23 bp, Homo sapiens
tctctttttcttgtaaacctgga

SEQ ID NO: 2191524 - DNA, 16 bp, Homo sapiens
tctgaaaacaattggt

SEQ ID NO: 2191525 - DNA, 13 bp, Homo sapiens
tctgaagatcaga

SEQ ID NO: 2191526 - DNA, 19 bp, Homo sapiens
tctgaagatcagaacattc

SEQ ID NO: 2191527 - DNA, 22 bp, Homo sapiens
tctgaagccatgtagccaccca

SEQ ID NO: 2191528 - DNA, 23 bp, Homo sapiens
tctgaaggttggaactgctgcca

SEQ ID NO: 2191529 - DNA, 22 bp, Homo sapiens
tctgaagtagagtgttggaaat

SEQ ID NO: 2191530 - DNA, 22 bp, Homo sapiens
tctgaatatatgatttgcatgt

SEQ ID NO: 2191531 - DNA, 22 bp, Homo sapiens
tctgaatgggagccagaattca

SEQ ID NO: 2191532 - DNA, 16 bp, Homo sapiens
tctgacaaagtcatga

SEQ ID NO: 2191533 - DNA, 13 bp, Homo sapiens
tctgacctcagca

SEQ ID NO: 2191534 - DNA, 13 bp, Homo sapiens
tctgactgccaag

SEQ ID NO: 2191535 - DNA, 19 bp, Homo sapiens
tctgactgccaagccagat

SEQ ID NO: 2191536 - DNA, 17 bp, Homo sapiens
tctgaggctcagccctg

SEQ ID NO: 2191537 - DNA, 16 bp, Homo sapiens
tctgagtggtggtctt

SEQ ID NO: 2191538 - DNA, 16 bp, Homo sapiens
tctgatttcacatatt

SEQ ID NO: 2191539 - DNA, 16 bp, Homo sapiens
tctgcattttctgggt

SEQ ID NO: 2191540 - DNA, 18 bp, Homo sapiens
tctgcccaccctcctgta

SEQ ID NO: 2191541 - DNA, 16 bp, Homo sapiens
tctgcccagagctggg

SEQ ID NO: 2191542 - DNA, 19 bp, Homo sapiens
tctgcccagagctgggtga

SEQ ID NO: 2191543 - DNA, 12 bp, Homo sapiens
tctgcccctccc

SEQ ID NO: 2191544 - DNA, 15 bp, Homo sapiens
tctgcccctccctgc

SEQ ID NO: 2191545 - DNA, 18 bp, Homo sapiens
tctgcccctccctgcttc

SEQ ID NO: 2191546 - DNA, 16 bp, Homo sapiens
tctgctcctccctccc

SEQ ID NO: 2191547 - DNA, 14 bp, Homo sapiens
tctgctgctcccag

SEQ ID NO: 2191548 - DNA, 15 bp, Homo sapiens
tctgctgggtttcca

SEQ ID NO: 2191549 - DNA, 13 bp, Homo sapiens
tctgcttgtcatc

SEQ ID NO: 2191550 - DNA, 13 bp, Homo sapiens
tctgcttttaagt

SEQ ID NO: 2191551 - DNA, 13 bp, Homo sapiens
tctggagccacct

SEQ ID NO: 2191552 - DNA, 19 bp, Homo sapiens
tctggagccacctgtccca

SEQ ID NO: 2191553 - DNA, 18 bp, Homo sapiens
tctggatgggcttggcca

SEQ ID NO: 2191554 - DNA, 18 bp, Homo sapiens
tctggcaaggactttgta

SEQ ID NO: 2191555 - DNA, 18 bp, Homo sapiens
tctggccctgttgtgggg

SEQ ID NO: 2191556 - DNA, 21 bp, Homo sapiens
tctggccctgttgtgggggtg

SEQ ID NO: 2191557 - DNA, 18 bp, Homo sapiens
tctggcctagtcccttcc

SEQ ID NO: 2191558 - DNA, 15 bp, Homo sapiens
tctggctccctggga

SEQ ID NO: 2191559 - DNA, 13 bp, Homo sapiens
tctgggaggcagg

SEQ ID NO: 2191560 - DNA, 16 bp, Homo sapiens
tctgggccccaggcac

SEQ ID NO: 2191561 - DNA, 15 bp, Homo sapiens
tctggggaattctga

SEQ ID NO: 2191562 - DNA, 16 bp, Homo sapiens
tctgggtggttgccct

SEQ ID NO: 2191563 - DNA, 19 bp, Homo sapiens
tctgggtggttgcccttca

SEQ ID NO: 2191564 - DNA, 15 bp, Homo sapiens
tctgggttctgggtg

SEQ ID NO: 2191565 - DNA, 15 bp, Homo sapiens
tctggtaggttctgt

SEQ ID NO: 2191566 - DNA, 19 bp, Homo sapiens
tctggtaggttctgtctgt

SEQ ID NO: 2191567 - DNA, 15 bp, Homo sapiens
tccctcccctgccct

SEQ ID NO: 2191568 - DNA, 13 bp, Homo sapiens
tccctccctgcag

SEQ ID NO: 2191569 - DNA, 15 bp, Homo sapiens
tccctccctgcaggg

SEQ ID NO: 2191570 - DNA, 18 bp, Homo sapiens
tccctccctgcagggtag

SEQ ID NO: 2191571 - DNA, 20 bp, Homo sapiens
tccctcgaacccacactgca

SEQ ID NO: 2191572 - DNA, 15 bp, Homo sapiens
tccctctcctctgtc

SEQ ID NO: 2191573 - DNA, 11 bp, Homo sapiens
tccctgcaggg

SEQ ID NO: 2191574 - DNA, 14 bp, Homo sapiens
tccctgcagggcca

SEQ ID NO: 2191575 - DNA, 20 bp, Homo sapiens
tccctgccaagaactctggg

SEQ ID NO: 2191576 - DNA, 23 bp, Homo sapiens
tccctgctaggggttttaggtct

SEQ ID NO: 2191577 - DNA, 18 bp, Homo sapiens
tccctgctcagctggccg

SEQ ID NO: 2191578 - DNA, 14 bp, Homo sapiens
tccctgctgaatgc

SEQ ID NO: 2191579 - DNA, 11 bp, Homo sapiens
tccctggacca

SEQ ID NO: 2191580 - DNA, 17 bp, Homo sapiens
tccctggaccagatgct

SEQ ID NO: 2191581 - DNA, 19 bp, Homo sapiens
tccctggaccagatgctga

SEQ ID NO: 2191582 - DNA, 18 bp, Homo sapiens
tccctggggtttttttca

SEQ ID NO: 2191583 - DNA, 16 bp, Homo sapiens
tccctggtccagattg

SEQ ID NO: 2191584 - DNA, 13 bp, Homo sapiens
tccctgtccaccc

SEQ ID NO: 2191585 - DNA, 16 bp, Homo sapiens
tcccttaacagttgta

SEQ ID NO: 2191586 - DNA, 20 bp, Homo sapiens
tcccttaacagttgtattta

SEQ ID NO: 2191587 - DNA, 22 bp, Homo sapiens
tcccttaacagttgtatttaac

SEQ ID NO: 2191588 - DNA, 12 bp, Homo sapiens
tcccttggagct

SEQ ID NO: 2191589 - DNA, 14 bp, Homo sapiens
tccctttgctccac

SEQ ID NO: 2191590 - DNA, 15 bp, Homo sapiens
tccctttgctccacc

SEQ ID NO: 2191591 - DNA, 19 bp, Homo sapiens
tccctttgctccaccccac

SEQ ID NO: 2191592 - DNA, 21 bp, Homo sapiens
tccgcatccagccgtgctgag

SEQ ID NO: 2191593 - DNA, 16 bp, Homo sapiens
tccgccagacctcaac

SEQ ID NO: 2191594 - DNA, 18 bp, Homo sapiens
tccgcctggcacccactc

SEQ ID NO: 2191595 - DNA, 18 bp, Homo sapiens
tccgctttgaaagaagca

SEQ ID NO: 2191596 - DNA, 21 bp, Homo sapiens
tccgctttgaaagaagcaaga

SEQ ID NO: 2191597 - DNA, 18 bp, Homo sapiens
tccggattccggccctgg

SEQ ID NO: 2191598 - DNA, 14 bp, Homo sapiens
tccggccctggctg

SEQ ID NO: 2191599 - DNA, 17 bp, Homo sapiens
tccggggctcagccctg

SEQ ID NO: 2191600 - DNA, 18 bp, Homo sapiens
tcctaaatggccctgttt

SEQ ID NO: 2191601 - DNA, 13 bp, Homo sapiens
tcctacagtacaa

SEQ ID NO: 2191602 - DNA, 16 bp, Homo sapiens
tcctacagtacaatca

SEQ ID NO: 2191603 - DNA, 15 bp, Homo sapiens
tcctagctgtgtgca

SEQ ID NO: 2191604 - DNA, 20 bp, Homo sapiens
tcctattctgggcaaataga

SEQ ID NO: 2191605 - DNA, 13 bp, Homo sapiens
tcctcacaagcct

SEQ ID NO: 2191606 - DNA, 20 bp, Homo sapiens
tcctcacaagcctcttctga

SEQ ID NO: 2191607 - DNA, 21 bp, Homo sapiens
tcctcccctggcaactgctga

SEQ ID NO: 2191608 - DNA, 16 bp, Homo sapiens
tcctccctacttccaa

SEQ ID NO: 2191609 - DNA, 17 bp, Homo sapiens
tcctccctccctgcagg

SEQ ID NO: 2191610 - DNA, 18 bp, Homo sapiens
tcctccctccctgcaggg

SEQ ID NO: 2191611 - DNA, 14 bp, Homo sapiens
tcctccctgctcag

SEQ ID NO: 2191612 - DNA, 19 bp, Homo sapiens
tcctccctttttccttgtc

SEQ ID NO: 2191613 - DNA, 14 bp, Homo sapiens
tcctcctcccctgg

SEQ ID NO: 2191614 - DNA, 23 bp, Homo sapiens
tcctcctgagtgatcccatttct

SEQ ID NO: 2191615 - DNA, 21 bp, Homo sapiens
tcctctaacaggggctggtgg

SEQ ID NO: 2191616 - DNA, 11 bp, Homo sapiens
tcctctcccct

SEQ ID NO: 2191617 - DNA, 12 bp, Homo sapiens
tcctctctgctg

SEQ ID NO: 2191618 - DNA, 20 bp, Homo sapiens
tcctctctgctgggtttcca

SEQ ID NO: 2191619 - DNA, 18 bp, Homo sapiens
tcctgaggcagaacctgg

SEQ ID NO: 2191620 - DNA, 16 bp, Homo sapiens
tcctgagggtcctgct

SEQ ID NO: 2191621 - DNA, 21 bp, Homo sapiens
tcctgatggaattgttatact

SEQ ID NO: 2191622 - DNA, 13 bp, Homo sapiens
tcctgattgctct

SEQ ID NO: 2191623 - DNA, 18 bp, Homo sapiens
tcctgattgctctggaag

SEQ ID NO: 2191624 - DNA, 20 bp, Homo sapiens
tcctgattgctctggaagcc

SEQ ID NO: 2191625 - DNA, 13 bp, Homo sapiens
tcctgccactgtt

SEQ ID NO: 2191626 - DNA, 22 bp, Homo sapiens
tcctgctatttcccaagctgga

SEQ ID NO: 2191627 - DNA, 17 bp, Homo sapiens
tcctgctctctacccag

SEQ ID NO: 2191628 - DNA, 22 bp, Homo sapiens
tcctgctctctacccagcccat

SEQ ID NO: 2191629 - DNA, 10 bp, Homo sapiens
tcctgctggg

SEQ ID NO: 2191630 - DNA, 17 bp, Homo sapiens
tcctgctggggccgcca

SEQ ID NO: 2191631 - DNA, 19 bp, Homo sapiens
tcctggagagtctcactcc

SEQ ID NO: 2191632 - DNA, 17 bp, Homo sapiens
tcctggctttgcccaac

SEQ ID NO: 2191633 - DNA, 19 bp, Homo sapiens
tcctggggtgccctccact

SEQ ID NO: 2191634 - DNA, 22 bp, Homo sapiens
tcctggggtgccctccactgcc

SEQ ID NO: 2191635 - DNA, 16 bp, Homo sapiens
tcctgtcccaccatgc

SEQ ID NO: 2191636 - DNA, 19 bp, Homo sapiens
tcctgtccgccctcttccc

SEQ ID NO: 2191637 - DNA, 11 bp, Homo sapiens
tcctgtctccc

SEQ ID NO: 2191638 - DNA, 17 bp, Homo sapiens
tcctgtctcccctctgc

SEQ ID NO: 2191639 - DNA, 14 bp, Homo sapiens
tcctgtctggccca

SEQ ID NO: 2191640 - DNA, 21 bp, Homo sapiens
tcctgtgtccacatctaacaa

SEQ ID NO: 2191641 - DNA, 11 bp, Homo sapiens
tcctgtttcta

SEQ ID NO: 2191642 - DNA, 14 bp, Homo sapiens
tcctgtttctaagt

SEQ ID NO: 2191643 - DNA, 13 bp, Homo sapiens
tccttagaaaaga

SEQ ID NO: 2191644 - DNA, 13 bp, Homo sapiens
tccttagaggaag

SEQ ID NO: 2191645 - DNA, 16 bp, Homo sapiens
tccttagcaacagccg

SEQ ID NO: 2191646 - DNA, 23 bp, Homo sapiens
tccttatcctacagtacaatcag

SEQ ID NO: 2191647 - DNA, 16 bp, Homo sapiens
tccttcctctttgctt

SEQ ID NO: 2191648 - DNA, 16 bp, Homo sapiens
tccttctcctcttgta

SEQ ID NO: 2191649 - DNA, 20 bp, Homo sapiens
tccttctcctcttgtagcca

SEQ ID NO: 2191650 - DNA, 22 bp, Homo sapiens
tccttggtggccgggggtgggg

SEQ ID NO: 2191651 - DNA, 18 bp, Homo sapiens
tccttgtccccacactcc

SEQ ID NO: 2191652 - DNA, 19 bp, Homo sapiens
tccttgtccccacactcct

SEQ ID NO: 2191653 - DNA, 21 bp, Homo sapiens
tcctttccagtggcctggctc

SEQ ID NO: 2191654 - DNA, 16 bp, Homo sapiens
tccttttatttataac

SEQ ID NO: 2191655 - DNA, 13 bp, Homo sapiens
tcctttttataac

SEQ ID NO: 2191656 - DNA, 16 bp, Homo sapiens
tcctttttcacgttta

SEQ ID NO: 2191657 - DNA, 13 bp, Homo sapiens
tcgaacccacact

SEQ ID NO: 2191658 - DNA, 17 bp, Homo sapiens
tcgaacccacactgcaa

SEQ ID NO: 2191659 - DNA, 16 bp, Homo sapiens
tcgaactcctgggctc

SEQ ID NO: 2191660 - DNA, 14 bp, Homo sapiens
tcgaagtcttccat

SEQ ID NO: 2191661 - DNA, 14 bp, Homo sapiens
tcgacaagaatgtc

SEQ ID NO: 2191662 - DNA, 17 bp, Homo sapiens
tcgactttgtgtctctg

SEQ ID NO: 2191663 - DNA, 19 bp, Homo sapiens
tcgagaaagaggcaccagg

SEQ ID NO: 2191664 - DNA, 13 bp, Homo sapiens
tcgaggctgtgtg

SEQ ID NO: 2191665 - DNA, 22 bp, Homo sapiens
tcgatggtggcgctttctcctg

SEQ ID NO: 2191666 - DNA, 22 bp, Homo sapiens
tcgcagcagctccgcctggcac

SEQ ID NO: 2191667 - DNA, 18 bp, Homo sapiens
tcgcagtgcccagtgatg

SEQ ID NO: 2191668 - DNA, 21 bp, Homo sapiens
tcgcagtgcccagtgatggca

SEQ ID NO: 2191669 - DNA, 18 bp, Homo sapiens
tcggacctcagtttctgt

SEQ ID NO: 2191670 - DNA, 13 bp, Homo sapiens
tcgggacttcaaa

SEQ ID NO: 2191671 - DNA, 16 bp, Homo sapiens
tcgggctcagctctgg

SEQ ID NO: 2191672 - DNA, 17 bp, Homo sapiens
tcgggctcagctctggc

SEQ ID NO: 2191673 - DNA, 14 bp, Homo sapiens
tcggtcctgtctcc

SEQ ID NO: 2191674 - DNA, 23 bp, Homo sapiens
tcggtgcagcggtggaaggagcc

SEQ ID NO: 2191675 - DNA, 13 bp, Homo sapiens
tcgtgaggggcaa

SEQ ID NO: 2191676 - DNA, 18 bp, Homo sapiens
tcgtggacacacacagac

SEQ ID NO: 2191677 - DNA, 20 bp, Homo sapiens
tcgtggactgagtgggaagc

SEQ ID NO: 2191678 - DNA, 16 bp, Homo sapiens
tcgtggagccacaggc

SEQ ID NO: 2191679 - DNA, 18 bp, Homo sapiens
tcgtggagccacaggcag

SEQ ID NO: 2191680 - DNA, 20 bp, Homo sapiens
tcgtgggatctgcccctccc

SEQ ID NO: 2191681 - DNA, 16 bp, Homo sapiens
tcgtgggctctggctc

SEQ ID NO: 2191682 - DNA, 17 bp, Homo sapiens
tcgtgggctctggctcc

SEQ ID NO: 2191683 - DNA, 19 bp, Homo sapiens
tcgtgggctctggctccct

SEQ ID NO: 2191684 - DNA, 19 bp, Homo sapiens
tcgttaatatcgctgatat

SEQ ID NO: 2191685 - DNA, 15 bp, Homo sapiens
tcgttctaaaatcaa

SEQ ID NO: 2191686 - DNA, 17 bp, Homo sapiens
tcgttgactttagggac

SEQ ID NO: 2191687 - DNA, 22 bp, Homo sapiens
tctaaaccatctatgtgaatat

SEQ ID NO: 2191688 - DNA, 24 bp, Homo sapiens
tctaacaggggctggtgggcacca

SEQ ID NO: 2191689 - DNA, 22 bp, Homo sapiens
tctaaggaagatcactttgctc

SEQ ID NO: 2191690 - DNA, 19 bp, Homo sapiens
tctaagtggcctgcagggg

SEQ ID NO: 2191691 - DNA, 20 bp, Homo sapiens
tctaatgtaacttcctctta

SEQ ID NO: 2191692 - DNA, 18 bp, Homo sapiens
gtggaaggagcctgcggc

SEQ ID NO: 2191693 - DNA, 23 bp, Homo sapiens
gtggaaggagcctgcggctgctg

SEQ ID NO: 2191694 - DNA, 15 bp, Homo sapiens
gtggagaggagagaa

SEQ ID NO: 2191695 - DNA, 15 bp, Homo sapiens
gtggagattggatca

SEQ ID NO: 2191696 - DNA, 19 bp, Homo sapiens
gtggagccacaggcagacg

SEQ ID NO: 2191697 - DNA, 15 bp, Homo sapiens
gtggattttgtggct

SEQ ID NO: 2191698 - DNA, 21 bp, Homo sapiens
gtggcagaaatcccagttcat

SEQ ID NO: 2191699 - DNA, 22 bp, Homo sapiens
gtggcagcaacaaaggatttga

SEQ ID NO: 2191700 - DNA, 19 bp, Homo sapiens
gtggcagcaacggcacagc

SEQ ID NO: 2191701 - DNA, 15 bp, Homo sapiens
gtggcaggggagcag

SEQ ID NO: 2191702 - DNA, 18 bp, Homo sapiens
gtggcagttacagggccc

SEQ ID NO: 2191703 - DNA, 15 bp, Homo sapiens
gtggccaagaagcag

SEQ ID NO: 2191704 - DNA, 21 bp, Homo sapiens
gtggccagaccagagctctgg

SEQ ID NO: 2191705 - DNA, 13 bp, Homo sapiens
gtggccatctgga

SEQ ID NO: 2191706 - DNA, 16 bp, Homo sapiens
gtggccatctggaaat

SEQ ID NO: 2191707 - DNA, 21 bp, Homo sapiens
gtggccgggggtgggggcctg

SEQ ID NO: 2191708 - DNA, 22 bp, Homo sapiens
gtgggaaaatgtcccccacctc

SEQ ID NO: 2191709 - DNA, 20 bp, Homo sapiens
gtgggaagcccatcctgacc

SEQ ID NO: 2191710 - DNA, 14 bp, Homo sapiens
gtgggagaggaagc

SEQ ID NO: 2191711 - DNA, 18 bp, Homo sapiens
gtgggaggcccctggtgg

SEQ ID NO: 2191712 - DNA, 12 bp, Homo sapiens
gtgggagtggga

SEQ ID NO: 2191713 - DNA, 15 bp, Homo sapiens
gtgggagtgggagag

SEQ ID NO: 2191714 - DNA, 17 bp, Homo sapiens
gtgggagtgggagagga

SEQ ID NO: 2191715 - DNA, 19 bp, Homo sapiens
gtgggagtgggagaggaag

SEQ ID NO: 2191716 - DNA, 15 bp, Homo sapiens
gtgggccccgggctg

SEQ ID NO: 2191717 - DNA, 21 bp, Homo sapiens
gtgggccccgggctggagaaa

SEQ ID NO: 2191718 - DNA, 19 bp, Homo sapiens
gtggggaagagagcctgcc

SEQ ID NO: 2191719 - DNA, 18 bp, Homo sapiens
gtggggagacacctcaga

SEQ ID NO: 2191720 - DNA, 11 bp, Homo sapiens
gtggggctggg

SEQ ID NO: 2191721 - DNA, 19 bp, Homo sapiens
gtgggggtctgggaggcag

SEQ ID NO: 2191722 - DNA, 23 bp, Homo sapiens
gtccttaatgctgaaaacacaga

SEQ ID NO: 2191723 - DNA, 19 bp, Homo sapiens
gtccttcccacggccactg

SEQ ID NO: 2191724 - DNA, 12 bp, Homo sapiens
gtccttctcctc

SEQ ID NO: 2191725 - DNA, 22 bp, Homo sapiens
gtccttggtggccgggggtggg

SEQ ID NO: 2191726 - DNA, 23 bp, Homo sapiens
gtccttggtggccgggggtgggg

SEQ ID NO: 2191727 - DNA, 15 bp, Homo sapiens
gtcgacaagaatgtc

SEQ ID NO: 2191728 - DNA, 22 bp, Homo sapiens
gtcgagaaagaggcaccaggaa

SEQ ID NO: 2191729 - DNA, 20 bp, Homo sapiens
gtcgcccaggctggagtgca

SEQ ID NO: 2191730 - DNA, 19 bp, Homo sapiens
gtcgttgactttagggact

SEQ ID NO: 2191731 - DNA, 21 bp, Homo sapiens
gtctaaaaataaaatgcattt

SEQ ID NO: 2191732 - DNA, 22 bp, Homo sapiens
gtctaaaaataaaatgcattta

SEQ ID NO: 2191733 - DNA, 20 bp, Homo sapiens
gtctaaaatacttgagaaat

SEQ ID NO: 2191734 - DNA, 21 bp, Homo sapiens
gtctaaaatacttgagaaatt

SEQ ID NO: 2191735 - DNA, 22 bp, Homo sapiens
gtctaggtcagtacccacctga

SEQ ID NO: 2191736 - DNA, 22 bp, Homo sapiens
gtctatgacatgaacaatgtgt

SEQ ID NO: 2191737 - DNA, 19 bp, Homo sapiens
gtctcattttgtatgtatg

SEQ ID NO: 2191738 - DNA, 22 bp, Homo sapiens
gtctcattttgtatgtatgtgt

SEQ ID NO: 2191739 - DNA, 23 bp, Homo sapiens
gtctcattttgtatgtatgtgta

SEQ ID NO: 2191740 - DNA, 14 bp, Homo sapiens
gtctccaggggcct

SEQ ID NO: 2191741 - DNA, 18 bp, Homo sapiens
gtctccaggggcctgcag

SEQ ID NO: 2191742 - DNA, 19 bp, Homo sapiens
gtctcccctctgctggccg

SEQ ID NO: 2191743 - DNA, 22 bp, Homo sapiens
gtctccctataatgctggagcg

SEQ ID NO: 2191744 - DNA, 12 bp, Homo sapiens
gtctcctgaggg

SEQ ID NO: 2191745 - DNA, 14 bp, Homo sapiens
gtctcctgcatgca

SEQ ID NO: 2191746 - DNA, 18 bp, Homo sapiens
gtctctcattctctttct

SEQ ID NO: 2191747 - DNA, 19 bp, Homo sapiens
gtctctcattctctttctt

SEQ ID NO: 2191748 - DNA, 13 bp, Homo sapiens
gtctctccctggg

SEQ ID NO: 2191749 - DNA, 20 bp, Homo sapiens
gtctctcttgctttgttctt

SEQ ID NO: 2191750 - DNA, 17 bp, Homo sapiens
gtctctgggccccaggc

SEQ ID NO: 2191751 - DNA, 19 bp, Homo sapiens
gtctgcctctgagccactg

SEQ ID NO: 2191752 - DNA, 14 bp, Homo sapiens
gtctgcgccgctgt

SEQ ID NO: 2191753 - DNA, 18 bp, Homo sapiens
gtctgcgccgctgtgctg

SEQ ID NO: 2191754 - DNA, 14 bp, Homo sapiens
gtctgctcctccct

SEQ ID NO: 2191755 - DNA, 16 bp, Homo sapiens
gtctgctcctccctcc

SEQ ID NO: 2191756 - DNA, 10 bp, Homo sapiens
gtctgctgct

SEQ ID NO: 2191757 - DNA, 20 bp, Homo sapiens
tcaagtgatcctcctgtctt

SEQ ID NO: 2191758 - DNA, 20 bp, Homo sapiens
tcaataattgtggagaggag

SEQ ID NO: 2191759 - DNA, 20 bp, Homo sapiens
tcaatactttgaacacaaag

SEQ ID NO: 2191760 - DNA, 22 bp, Homo sapiens
tcaatatggtgtcttgatatat

SEQ ID NO: 2191761 - DNA, 19 bp, Homo sapiens
tcaatcacttgaaagtgaa

SEQ ID NO: 2191762 - DNA, 13 bp, Homo sapiens
tcaatcctgtcaa

SEQ ID NO: 2191763 - DNA, 14 bp, Homo sapiens
tcaatcctgtcaat

SEQ ID NO: 2191764 - DNA, 11 bp, Homo sapiens
tcaatctctgg

SEQ ID NO: 2191765 - DNA, 19 bp, Homo sapiens
tcaatctctgttctgctcc

SEQ ID NO: 2191766 - DNA, 22 bp, Homo sapiens
tcaattccccctggccaccacc

SEQ ID NO: 2191767 - DNA, 18 bp, Homo sapiens
tcaatttgggtcccagct

SEQ ID NO: 2191768 - DNA, 18 bp, Homo sapiens
tcacaaaagtatattcaa

SEQ ID NO: 2191769 - DNA, 12 bp, Homo sapiens
tcacaagctgcc

SEQ ID NO: 2191770 - DNA, 22 bp, Homo sapiens
tcacaagctgcctccctgtcca

SEQ ID NO: 2191771 - DNA, 22 bp, Homo sapiens
tcacaatggattatacaaaaaa

SEQ ID NO: 2191772 - DNA, 15 bp, Homo sapiens
tcacaccactgtact

SEQ ID NO: 2191773 - DNA, 18 bp, Homo sapiens
tcacagaagtagtggttt

SEQ ID NO: 2191774 - DNA, 16 bp, Homo sapiens
tcacagactggagaca

SEQ ID NO: 2191775 - DNA, 15 bp, Homo sapiens
tcacagagacacagg

SEQ ID NO: 2191776 - DNA, 22 bp, Homo sapiens
tcacagagacacagggcatcca

SEQ ID NO: 2191777 - DNA, 20 bp, Homo sapiens
tcacagaggcagtggcagca

SEQ ID NO: 2191778 - DNA, 21 bp, Homo sapiens
tcacagctcacggcagcctca

SEQ ID NO: 2191779 - DNA, 22 bp, Homo sapiens
tcacaggacgatttcactgaca

SEQ ID NO: 2191780 - DNA, 16 bp, Homo sapiens
tcacagtgcttttaag

SEQ ID NO: 2191781 - DNA, 18 bp, Homo sapiens
tcacatccccaaaggtca

SEQ ID NO: 2191782 - DNA, 19 bp, Homo sapiens
tcacatttccagggcagca

SEQ ID NO: 2191783 - DNA, 14 bp, Homo sapiens
tcaccaggggagga

SEQ ID NO: 2191784 - DNA, 18 bp, Homo sapiens
tcaccaggggaggagcct

SEQ ID NO: 2191785 - DNA, 19 bp, Homo sapiens
tcaccaggggaggagcctg

SEQ ID NO: 2191786 - DNA, 15 bp, Homo sapiens
tcaccatcttggcca

SEQ ID NO: 2191787 - DNA, 12 bp, Homo sapiens
tcacccctgtct

SEQ ID NO: 2191788 - DNA, 13 bp, Homo sapiens
tcacccctgtctg

SEQ ID NO: 2191789 - DNA, 17 bp, Homo sapiens
tcaccctcagctggcgg

SEQ ID NO: 2191790 - DNA, 12 bp, Homo sapiens
tcaccctgcttg

SEQ ID NO: 2191791 - DNA, 18 bp, Homo sapiens
tcaccctgcttggggcct

SEQ ID NO: 2191792 - DNA, 21 bp, Homo sapiens
tcaccctgcttggggcctggc

SEQ ID NO: 2191793 - DNA, 14 bp, Homo sapiens
tcacctaactcata

SEQ ID NO: 2191794 - DNA, 22 bp, Homo sapiens
tcacctaactcatactgtgctg

SEQ ID NO: 2191795 - DNA, 12 bp, Homo sapiens
tcacctcctaat

SEQ ID NO: 2191796 - DNA, 20 bp, Homo sapiens
tcacctgcacagggccctct

SEQ ID NO: 2191797 - DNA, 21 bp, Homo sapiens
tcacctgcacagggccctctg

SEQ ID NO: 2191798 - DNA, 19 bp, Homo sapiens
tcacctgccccgtagagaa

SEQ ID NO: 2191799 - DNA, 20 bp, Homo sapiens
tcacctgccccgtagagaat

SEQ ID NO: 2191800 - DNA, 22 bp, Homo sapiens
tcacctgccccgtagagaatgt

SEQ ID NO: 2191801 - DNA, 21 bp, Homo sapiens
tcacctgcgcagggccctctg

SEQ ID NO: 2191802 - DNA, 22 bp, Homo sapiens
tcacctgcgcagggccctctgg

SEQ ID NO: 2191803 - DNA, 21 bp, Homo sapiens
tcacctgtgcagggccctctg

SEQ ID NO: 2191804 - DNA, 22 bp, Homo sapiens
tcacctgtgcagggccctctgg

SEQ ID NO: 2191805 - DNA, 15 bp, Homo sapiens
tcactaaagtgtcat

SEQ ID NO: 2191806 - DNA, 21 bp, Homo sapiens
tcactaggctcgtgtttgcta

SEQ ID NO: 2191807 - DNA, 23 bp, Homo sapiens
tcactataggtcatacaatccat

SEQ ID NO: 2191808 - DNA, 14 bp, Homo sapiens
tcactatggtgcca

SEQ ID NO: 2191809 - DNA, 19 bp, Homo sapiens
tcactatggtgccaatgga

SEQ ID NO: 2191810 - DNA, 23 bp, Homo sapiens
tcactcaaaaaggtgtgtcaaag

SEQ ID NO: 2191811 - DNA, 14 bp, Homo sapiens
tcactcggctgtgg

SEQ ID NO: 2191812 - DNA, 23 bp, Homo sapiens
tcactgaaacttcaagcaccagg

SEQ ID NO: 2191813 - DNA, 15 bp, Homo sapiens
tcactgaagtgaata

SEQ ID NO: 2191814 - DNA, 22 bp, Homo sapiens
tcactgcaacctccacctccca

SEQ ID NO: 2191815 - DNA, 23 bp, Homo sapiens
tcactgcaacctccacctcccag

SEQ ID NO: 2191816 - DNA, 21 bp, Homo sapiens
tcactgtcttttgattcttga

SEQ ID NO: 2191817 - DNA, 22 bp, Homo sapiens
tcactgtgagttctgatgtctt

SEQ ID NO: 2191818 - DNA, 14 bp, Homo sapiens
tcactgttcatgaa

SEQ ID NO: 2191819 - DNA, 16 bp, Homo sapiens
tcacttgtgtttgtat

SEQ ID NO: 2191820 - DNA, 16 bp, Homo sapiens
tcactttaataataaa

SEQ ID NO: 2191821 - DNA, 18 bp, Homo sapiens
tcactttgcgtgtgtcat

SEQ ID NO: 2191822 - DNA, 14 bp, Homo sapiens
tcactttgctctga

SEQ ID NO: 2191823 - DNA, 14 bp, Homo sapiens
tcactttgtattct

SEQ ID NO: 2191824 - DNA, 22 bp, Homo sapiens
tcactttgtattctctgtccag

SEQ ID NO: 2191825 - DNA, 17 bp, Homo sapiens
tcagaacattcagctct

SEQ ID NO: 2191826 - DNA, 22 bp, Homo sapiens
tcagaacattcagctctggaga

SEQ ID NO: 2191827 - DNA, 18 bp, Homo sapiens
tcagaatcccttaacagt

SEQ ID NO: 2191828 - DNA, 13 bp, Homo sapiens
tcagacaaattac

SEQ ID NO: 2191829 - DNA, 22 bp, Homo sapiens
tcagacatctgaggttttattt

SEQ ID NO: 2191830 - DNA, 14 bp, Homo sapiens
tcagaccttttctt

SEQ ID NO: 2191831 - DNA, 16 bp, Homo sapiens
tcagagctacttgggc

SEQ ID NO: 2191832 - DNA, 15 bp, Homo sapiens
tcagatacttgtgaa

SEQ ID NO: 2191833 - DNA, 18 bp, Homo sapiens
tcagatacttgtgaacat

SEQ ID NO: 2191834 - DNA, 13 bp, Homo sapiens
tcagatcctgctg

SEQ ID NO: 2191835 - DNA, 17 bp, Homo sapiens
tcagatcctgctgccgc

SEQ ID NO: 2191836 - DNA, 22 bp, Homo sapiens
tcagattgacaaggtagacatg

SEQ ID NO: 2191837 - DNA, 14 bp, Homo sapiens
tcagcacatgcact

SEQ ID NO: 2191838 - DNA, 22 bp, Homo sapiens
tcagcaggttggcttttttccc

SEQ ID NO: 2191839 - DNA, 15 bp, Homo sapiens
tcagccagccccatc

SEQ ID NO: 2191840 - DNA, 12 bp, Homo sapiens
tcagccccagcc

SEQ ID NO: 2191841 - DNA, 15 bp, Homo sapiens
tcagccctgctgtca

SEQ ID NO: 2191842 - DNA, 23 bp, Homo sapiens
tcagccgaattgtggtgtcttac

SEQ ID NO: 2191843 - DNA, 14 bp, Homo sapiens
tcagctctggagaa

SEQ ID NO: 2191844 - DNA, 13 bp, Homo sapiens
tcaggaattcagt

SEQ ID NO: 2191845 - DNA, 19 bp, Homo sapiens
tcaggagagagcttcctgt

SEQ ID NO: 2191846 - DNA, 21 bp, Homo sapiens
tcaggatttggtttttctctt

SEQ ID NO: 2191847 - DNA, 22 bp, Homo sapiens
tcaggatttggtttttctcttt

SEQ ID NO: 2191848 - DNA, 19 bp, Homo sapiens
tcaggccaaagacctccca

SEQ ID NO: 2191849 - DNA, 17 bp, Homo sapiens
tcaggctctgcacagac

SEQ ID NO: 2191850 - DNA, 22 bp, Homo sapiens
tcaggctctgcacagacaagca

SEQ ID NO: 2191851 - DNA, 16 bp, Homo sapiens
tcaggggaatttcagg

SEQ ID NO: 2191852 - DNA, 13 bp, Homo sapiens
tcagtacccacct

SEQ ID NO: 2191853 - DNA, 12 bp, Homo sapiens
tcagtattgtgt

SEQ ID NO: 2191854 - DNA, 14 bp, Homo sapiens
tcagtgactcctgc

SEQ ID NO: 2191855 - DNA, 15 bp, Homo sapiens
tcagtgactcctgct

SEQ ID NO: 2191856 - DNA, 18 bp, Homo sapiens
tcagtgactcctgctggt

SEQ ID NO: 2191857 - DNA, 14 bp, Homo sapiens
tcagtgagacacag

SEQ ID NO: 2191858 - DNA, 14 bp, Homo sapiens
tcagtgcattttca

SEQ ID NO: 2191859 - DNA, 17 bp, Homo sapiens
tcagtgcattttcaaca

SEQ ID NO: 2191860 - DNA, 19 bp, Homo sapiens
tcagtgtagccccaagaag

SEQ ID NO: 2191861 - DNA, 15 bp, Homo sapiens
tcagtgtgaagcctg

SEQ ID NO: 2191862 - DNA, 20 bp, Homo sapiens
tcagtgtgccaccctctgca

SEQ ID NO: 2191863 - DNA, 24 bp, Homo sapiens
tcagtgtgccaccctctgcagggc

SEQ ID NO: 2191864 - DNA, 22 bp, Homo sapiens
tcagttaggattaggtttagaa

SEQ ID NO: 2191865 - DNA, 14 bp, Homo sapiens
tcagttattcagat

SEQ ID NO: 2191866 - DNA, 14 bp, Homo sapiens
tcagtttctgttgt

SEQ ID NO: 2191867 - DNA, 23 bp, Homo sapiens
tcagttttgtgtacagtatgtgt

SEQ ID NO: 2191868 - DNA, 11 bp, Homo sapiens
tcatacctgtt

SEQ ID NO: 2191869 - DNA, 20 bp, Homo sapiens
tcatactcacgggaggaatc

SEQ ID NO: 2191870 - DNA, 18 bp, Homo sapiens
tcatagcaggaaatgtag

SEQ ID NO: 2191871 - DNA, 19 bp, Homo sapiens
gttgctgttgttcagaagt

SEQ ID NO: 2191872 - DNA, 14 bp, Homo sapiens
gttggaactgctgc

SEQ ID NO: 2191873 - DNA, 16 bp, Homo sapiens
gttggaactgctgcca

SEQ ID NO: 2191874 - DNA, 22 bp, Homo sapiens
gttggaagctagctcccctcct

SEQ ID NO: 2191875 - DNA, 14 bp, Homo sapiens
gttggaggcctcac

SEQ ID NO: 2191876 - DNA, 20 bp, Homo sapiens
gttggaggcctcaccctgct

SEQ ID NO: 2191877 - DNA, 17 bp, Homo sapiens
gttgggattacaggtga

SEQ ID NO: 2191878 - DNA, 15 bp, Homo sapiens
gttgtaaatacaatt

SEQ ID NO: 2191879 - DNA, 16 bp, Homo sapiens
gttgtaaatacaattc

SEQ ID NO: 2191880 - DNA, 16 bp, Homo sapiens
gttgtatttaacagaa

SEQ ID NO: 2191881 - DNA, 15 bp, Homo sapiens
gttgtcctatgggag

SEQ ID NO: 2191882 - DNA, 16 bp, Homo sapiens
gttgttgttttacatc

SEQ ID NO: 2191883 - DNA, 23 bp, Homo sapiens
gtttaaactgagtagcagaaaac

SEQ ID NO: 2191884 - DNA, 19 bp, Homo sapiens
gtttacagtgaataaaagg

SEQ ID NO: 2191885 - DNA, 16 bp, Homo sapiens
gtttagaaattacaag

SEQ ID NO: 2191886 - DNA, 17 bp, Homo sapiens
gtttagaaattacaagt

SEQ ID NO: 2191887 - DNA, 21 bp, Homo sapiens
gtttagaatcaagtctgtgaa

SEQ ID NO: 2191888 - DNA, 16 bp, Homo sapiens
gtttcagtaatagctg

SEQ ID NO: 2191889 - DNA, 21 bp, Homo sapiens
gtttccaagcctgggccactg

SEQ ID NO: 2191890 - DNA, 23 bp, Homo sapiens
gtttccaagcctgggccactggc

SEQ ID NO: 2191891 - DNA, 15 bp, Homo sapiens
gtttccacacagcct

SEQ ID NO: 2191892 - DNA, 11 bp, Homo sapiens
gtttccctgct

SEQ ID NO: 2191893 - DNA, 23 bp, Homo sapiens
gtttctaacactagtctgtgtgc

SEQ ID NO: 2191894 - DNA, 15 bp, Homo sapiens
gtttctacctcccag

SEQ ID NO: 2191895 - DNA, 16 bp, Homo sapiens
gtttctacctcccaga

SEQ ID NO: 2191896 - DNA, 14 bp, Homo sapiens
gtttctcccagttc

SEQ ID NO: 2191897 - DNA, 15 bp, Homo sapiens
gtttcttgggaaaat

SEQ ID NO: 2191898 - DNA, 17 bp, Homo sapiens
gtttcttgtgtgttttt

SEQ ID NO: 2191899 - DNA, 19 bp, Homo sapiens
gtttgatatttgtgtaaag

SEQ ID NO: 2191900 - DNA, 20 bp, Homo sapiens
gtttgcagcagcaagtacaa

SEQ ID NO: 2191901 - DNA, 11 bp, Homo sapiens
gtttggctgta

SEQ ID NO: 2191902 - DNA, 13 bp, Homo sapiens
gtttgggagagac

SEQ ID NO: 2191903 - DNA, 21 bp, Homo sapiens
gtttgggagagaccattgcat

SEQ ID NO: 2191904 - DNA, 16 bp, Homo sapiens
gtttgtatttttagta

SEQ ID NO: 2191905 - DNA, 14 bp, Homo sapiens
gtttgtttcttgtg

SEQ ID NO: 2191906 - DNA, 12 bp, Homo sapiens
gtttgtttttgg

SEQ ID NO: 2191907 - DNA, 20 bp, Homo sapiens
gttttaccaagtgctgtctt

SEQ ID NO: 2191908 - DNA, 17 bp, Homo sapiens
gttttagtgccaggctg

SEQ ID NO: 2191909 - DNA, 13 bp, Homo sapiens
gttttatgtttct

SEQ ID NO: 2191910 - DNA, 16 bp, Homo sapiens
gttttattttaaatta

SEQ ID NO: 2191911 - DNA, 23 bp, Homo sapiens
gttttctcaacaaatggaatgcc

SEQ ID NO: 2191912 - DNA, 17 bp, Homo sapiens
gtttttaagaaaaacat

SEQ ID NO: 2191913 - DNA, 22 bp, Homo sapiens
gtttttaagaaaaacatgtcat

SEQ ID NO: 2191914 - DNA, 23 bp, Homo sapiens
gtttttaagaaaaacatgtcatg

SEQ ID NO: 2191915 - DNA, 19 bp, Homo sapiens
gtttttaatcgtttttgtt

SEQ ID NO: 2191916 - DNA, 16 bp, Homo sapiens
gtttttataaactaca

SEQ ID NO: 2191917 - DNA, 17 bp, Homo sapiens
gtttttatgagaaactt

SEQ ID NO: 2191918 - DNA, 15 bp, Homo sapiens
gtttttggtttctta

SEQ ID NO: 2191919 - DNA, 14 bp, Homo sapiens
gtttttgttttaag

SEQ ID NO: 2191920 - DNA, 16 bp, Homo sapiens
gtttttgttttaagga

SEQ ID NO: 2191921 - DNA, 15 bp, Homo sapiens
gttttttttttaaaa

SEQ ID NO: 2191922 - DNA, 14 bp, Homo sapiens
taaaaaacattcaa

SEQ ID NO: 2191923 - DNA, 20 bp, Homo sapiens
taaaaacacaaatgtgtact

SEQ ID NO: 2191924 - DNA, 18 bp, Homo sapiens
taaaaacacctaagtgac

SEQ ID NO: 2191925 - DNA, 19 bp, Homo sapiens
taaaaataaaatgcattta

SEQ ID NO: 2191926 - DNA, 15 bp, Homo sapiens
taaaaataaaatgta

SEQ ID NO: 2191927 - DNA, 16 bp, Homo sapiens
taaaaatatgtgagca

SEQ ID NO: 2191928 - DNA, 19 bp, Homo sapiens
taaaaatatgtgagcatga

SEQ ID NO: 2191929 - DNA, 16 bp, Homo sapiens
taaaaatgatattgct

SEQ ID NO: 2191930 - DNA, 12 bp, Homo sapiens
taaaaatgtata

SEQ ID NO: 2191931 - DNA, 15 bp, Homo sapiens
taaaaattaattctt

SEQ ID NO: 2191932 - DNA, 18 bp, Homo sapiens
taaaaattaattctttat

SEQ ID NO: 2191933 - DNA, 15 bp, Homo sapiens
taaaacccagcatgt

SEQ ID NO: 2191934 - DNA, 23 bp, Homo sapiens
taaaactctccttttccttacca

SEQ ID NO: 2191935 - DNA, 19 bp, Homo sapiens
taaaagacaagcactttgg

SEQ ID NO: 2191936 - DNA, 18 bp, Homo sapiens
taaaagagccatgtccaa

SEQ ID NO: 2191937 - DNA, 14 bp, Homo sapiens
taaaatacatacta

SEQ ID NO: 2191938 - DNA, 21 bp, Homo sapiens
taaaatcacaaactcatccat

SEQ ID NO: 2191939 - DNA, 15 bp, Homo sapiens
taaaatcatgttttt

SEQ ID NO: 2191940 - DNA, 13 bp, Homo sapiens
taaaatgcactga

SEQ ID NO: 2191941 - DNA, 17 bp, Homo sapiens
taaaatttattctactt

SEQ ID NO: 2191942 - DNA, 22 bp, Homo sapiens
taaaatttattctacttttaaa

SEQ ID NO: 2191943 - DNA, 16 bp, Homo sapiens
taaaatttgccctccc

SEQ ID NO: 2191944 - DNA, 23 bp, Homo sapiens
taaacagtgagaaaagaaaggct

SEQ ID NO: 2191945 - DNA, 12 bp, Homo sapiens
taaacctggagg

SEQ ID NO: 2191946 - DNA, 13 bp, Homo sapiens
taaacctttccat

SEQ ID NO: 2191947 - DNA, 19 bp, Homo sapiens
taaactactatttttcttt

SEQ ID NO: 2191948 - DNA, 21 bp, Homo sapiens
taaactgagtagcagaaaaca

SEQ ID NO: 2191949 - DNA, 15 bp, Homo sapiens
taaactgccctgtct

SEQ ID NO: 2191950 - DNA, 17 bp, Homo sapiens
taaactgctattacttt

SEQ ID NO: 2191951 - DNA, 19 bp, Homo sapiens
taaagaaaattgccaaaat

SEQ ID NO: 2191952 - DNA, 22 bp, Homo sapiens
taaagaggaagccttgcccagc

SEQ ID NO: 2191953 - DNA, 19 bp, Homo sapiens
taaagcaccagcagtgttt

SEQ ID NO: 2191954 - DNA, 21 bp, Homo sapiens
taaagcaccagcagtgtttaa

SEQ ID NO: 2191955 - DNA, 13 bp, Homo sapiens
taaagcagtattt

SEQ ID NO: 2191956 - DNA, 14 bp, Homo sapiens
taaagcagtatttt

SEQ ID NO: 2191957 - DNA, 15 bp, Homo sapiens
taaagctgtttctaa

SEQ ID NO: 2191958 - DNA, 15 bp, Homo sapiens
taaagggacactgga

SEQ ID NO: 2191959 - DNA, 17 bp, Homo sapiens
taaaggtttacagtgaa

SEQ ID NO: 2191960 - DNA, 16 bp, Homo sapiens
taaagtaaattgaaat

SEQ ID NO: 2191961 - DNA, 15 bp, Homo sapiens
taaatacaatattgc

SEQ ID NO: 2191962 - DNA, 16 bp, Homo sapiens
taaatactaaatatga

SEQ ID NO: 2191963 - DNA, 15 bp, Homo sapiens
taaatactgtacata

SEQ ID NO: 2191964 - DNA, 16 bp, Homo sapiens
taaatactgtacatag

SEQ ID NO: 2191965 - DNA, 17 bp, Homo sapiens
taaatactgtacataga

SEQ ID NO: 2191966 - DNA, 18 bp, Homo sapiens
taaatactgtacatagat

SEQ ID NO: 2191967 - DNA, 13 bp, Homo sapiens
taaatatgaaatt

SEQ ID NO: 2191968 - DNA, 12 bp, Homo sapiens
taaatatttctt

SEQ ID NO: 2191969 - DNA, 14 bp, Homo sapiens
taaatcagttttgt

SEQ ID NO: 2191970 - DNA, 15 bp, Homo sapiens
taaatcatgttttga

SEQ ID NO: 2191971 - DNA, 20 bp, Homo sapiens
taaatctctatctctttata

SEQ ID NO: 2191972 - DNA, 22 bp, Homo sapiens
taaatgctttgattgttcatat

SEQ ID NO: 2191973 - DNA, 14 bp, Homo sapiens
taaatggaatcaca

SEQ ID NO: 2191974 - DNA, 11 bp, Homo sapiens
taaatgggcac

SEQ ID NO: 2191975 - DNA, 20 bp, Homo sapiens
taaatgtgaatggaaacttg

SEQ ID NO: 2191976 - DNA, 19 bp, Homo sapiens
taaattatgaatattaaag

SEQ ID NO: 2191977 - DNA, 17 bp, Homo sapiens
taaattattatcttctt

SEQ ID NO: 2191978 - DNA, 22 bp, Homo sapiens
taaattattatcttcttaacag

SEQ ID NO: 2191979 - DNA, 21 bp, Homo sapiens
taaattgaaatgggaacaata

SEQ ID NO: 2191980 - DNA, 17 bp, Homo sapiens
taacaatgttaaatgca

SEQ ID NO: 2191981 - DNA, 22 bp, Homo sapiens
taacacatggcttcctaaatgg

SEQ ID NO: 2191982 - DNA, 22 bp, Homo sapiens
taacaccaagagtagcaccttc

SEQ ID NO: 2191983 - DNA, 17 bp, Homo sapiens
taacactagtctgtgtg

SEQ ID NO: 2191984 - DNA, 17 bp, Homo sapiens
taacagaaattgtatat

SEQ ID NO: 2191985 - DNA, 22 bp, Homo sapiens
taacagaaattgtatattgtaa

SEQ ID NO: 2191986 - DNA, 15 bp, Homo sapiens
taacagggccttgct

SEQ ID NO: 2191987 - DNA, 16 bp, Homo sapiens
taacagggccttgcta

SEQ ID NO: 2191988 - DNA, 23 bp, Homo sapiens
taacataagctagaaaaattaga

SEQ ID NO: 2191989 - DNA, 22 bp, Homo sapiens
taacatagtaacgtgttactgg

SEQ ID NO: 2191990 - DNA, 11 bp, Homo sapiens
taacatctttt

SEQ ID NO: 2191991 - DNA, 21 bp, Homo sapiens
taaccagggcaccaagcccac

SEQ ID NO: 2191992 - DNA, 23 bp, Homo sapiens
taaccccgtctgctcctccctcc

SEQ ID NO: 2191993 - DNA, 20 bp, Homo sapiens
taacctaaaaatcaatcact

SEQ ID NO: 2191994 - DNA, 21 bp, Homo sapiens
taacctacttgtaaacttgaa

SEQ ID NO: 2191995 - DNA, 20 bp, Homo sapiens
taacctttaaaaatgtataa

SEQ ID NO: 2191996 - DNA, 21 bp, Homo sapiens
taacgtgttactggaaaaatt

SEQ ID NO: 2191997 - DNA, 18 bp, Homo sapiens
taactagagcagccctgg

SEQ ID NO: 2191998 - DNA, 22 bp, Homo sapiens
taactagagcagccctggagtc

SEQ ID NO: 2191999 - DNA, 17 bp, Homo sapiens
taactctgcccaccctc

SEQ ID NO: 2192000 - DNA, 18 bp, Homo sapiens
taactctgcccaccctcc

SEQ ID NO: 2192001 - DNA, 17 bp, Homo sapiens
taactgcattagaaacc

SEQ ID NO: 2192002 - DNA, 20 bp, Homo sapiens
taactgcattagaaaccatg

SEQ ID NO: 2192003 - DNA, 22 bp, Homo sapiens
taactgcattagaaaccatgaa

SEQ ID NO: 2192004 - DNA, 16 bp, Homo sapiens
taactgcattctataa

SEQ ID NO: 2192005 - DNA, 21 bp, Homo sapiens
taactggcttctgcttgtcat

SEQ ID NO: 2192006 - DNA, 22 bp, Homo sapiens
taactgtatttgaaataagaat

SEQ ID NO: 2192007 - DNA, 19 bp, Homo sapiens
taacttgaaaagattgcaa

SEQ ID NO: 2192008 - DNA, 23 bp, Homo sapiens
taacttgatggcttaaaaatact

SEQ ID NO: 2192009 - DNA, 12 bp, Homo sapiens
taagaaaaacat

SEQ ID NO: 2192010 - DNA, 15 bp, Homo sapiens
taagaaaaacatgtc

SEQ ID NO: 2192011 - DNA, 13 bp, Homo sapiens
taagaacatgtta

SEQ ID NO: 2192012 - DNA, 23 bp, Homo sapiens
taagaataatgacgtattgtgaa

SEQ ID NO: 2192013 - DNA, 15 bp, Homo sapiens
taagaattcagacat

SEQ ID NO: 2192014 - DNA, 22 bp, Homo sapiens
taagacaaatgggactgatgtc

SEQ ID NO: 2192015 - DNA, 16 bp, Homo sapiens
taagaccggaagctcc

SEQ ID NO: 2192016 - DNA, 22 bp, Homo sapiens
taagaggcaggtcttaatcagt

SEQ ID NO: 2192017 - DNA, 18 bp, Homo sapiens
tacctgtgttcagattgt

SEQ ID NO: 2192018 - DNA, 14 bp, Homo sapiens
taccttcaaagctg

SEQ ID NO: 2192019 - DNA, 21 bp, Homo sapiens
taccttgagttgagtattaca

SEQ ID NO: 2192020 - DNA, 21 bp, Homo sapiens
tacctttctgacaataaataa

SEQ ID NO: 2192021 - DNA, 23 bp, Homo sapiens
taccttttttttacggaattcca

SEQ ID NO: 2192022 - DNA, 15 bp, Homo sapiens
tacgatgttaaaaca

SEQ ID NO: 2192023 - DNA, 15 bp, Homo sapiens
tacggaattccaata

SEQ ID NO: 2192024 - DNA, 19 bp, Homo sapiens
tacggaattccaatattta

SEQ ID NO: 2192025 - DNA, 14 bp, Homo sapiens
tacggtgatattgt

SEQ ID NO: 2192026 - DNA, 21 bp, Homo sapiens
tacgtatgcatttttttagtt

SEQ ID NO: 2192027 - DNA, 17 bp, Homo sapiens
tactaaatatgaaattt

SEQ ID NO: 2192028 - DNA, 16 bp, Homo sapiens
tactagaaccttctaa

SEQ ID NO: 2192029 - DNA, 24 bp, Homo sapiens
tactcaccttgaacaccacgcttg

SEQ ID NO: 2192030 - DNA, 13 bp, Homo sapiens
tactcgtttttat

SEQ ID NO: 2192031 - DNA, 13 bp, Homo sapiens
tactctactgata

SEQ ID NO: 2192032 - DNA, 13 bp, Homo sapiens
tactctgtctccc

SEQ ID NO: 2192033 - DNA, 22 bp, Homo sapiens
tactgattattgagttctgaag

SEQ ID NO: 2192034 - DNA, 17 bp, Homo sapiens
tactgtacatagatgta

SEQ ID NO: 2192035 - DNA, 19 bp, Homo sapiens
tactgttgagaaaaaagac

SEQ ID NO: 2192036 - DNA, 14 bp, Homo sapiens
tacttccaagaaaa

SEQ ID NO: 2192037 - DNA, 17 bp, Homo sapiens
tacttgtaaacttgaaa

SEQ ID NO: 2192038 - DNA, 15 bp, Homo sapiens
tactttaccaccccc

SEQ ID NO: 2192039 - DNA, 19 bp, Homo sapiens
tacttttaaataaattatg

SEQ ID NO: 2192040 - DNA, 21 bp, Homo sapiens
tactttttatgggttttgctt

SEQ ID NO: 2192041 - DNA, 17 bp, Homo sapiens
tagaaaacccaagtttt

SEQ ID NO: 2192042 - DNA, 20 bp, Homo sapiens
tagaaagactttctaaatct

SEQ ID NO: 2192043 - DNA, 13 bp, Homo sapiens
tagaaattacaag

SEQ ID NO: 2192044 - DNA, 16 bp, Homo sapiens
tagaaattacaagttt

SEQ ID NO: 2192045 - DNA, 16 bp, Homo sapiens
tagaacttagttttgt

SEQ ID NO: 2192046 - DNA, 17 bp, Homo sapiens
tagaacttagttttgtt

SEQ ID NO: 2192047 - DNA, 18 bp, Homo sapiens
tagaagagggagaaggag

SEQ ID NO: 2192048 - DNA, 22 bp, Homo sapiens
tagaagagggagaaggagaggc

SEQ ID NO: 2192049 - DNA, 22 bp, Homo sapiens
tagaagtggtgttttttttcca

SEQ ID NO: 2192050 - DNA, 23 bp, Homo sapiens
tagaagtggtgttttttttccaa

SEQ ID NO: 2192051 - DNA, 18 bp, Homo sapiens
tagaatactaataaaata

SEQ ID NO: 2192052 - DNA, 19 bp, Homo sapiens
tagaatactaataaaatac

SEQ ID NO: 2192053 - DNA, 18 bp, Homo sapiens
tagaatattaaaaattaa

SEQ ID NO: 2192054 - DNA, 15 bp, Homo sapiens
tagaatcaagtctgt

SEQ ID NO: 2192055 - DNA, 13 bp, Homo sapiens
tagaattaaaatt

SEQ ID NO: 2192056 - DNA, 16 bp, Homo sapiens
tagacattttaagcat

SEQ ID NO: 2192057 - DNA, 21 bp, Homo sapiens
tagagaaaatggaacattaac

SEQ ID NO: 2192058 - DNA, 22 bp, Homo sapiens
tagagatctcagccctaaacct

SEQ ID NO: 2192059 - DNA, 13 bp, Homo sapiens
tagagatgcctcc

SEQ ID NO: 2192060 - DNA, 14 bp, Homo sapiens
tagagatgcctccc

SEQ ID NO: 2192061 - DNA, 19 bp, Homo sapiens
tagagcagccctggagtca

SEQ ID NO: 2192062 - DNA, 16 bp, Homo sapiens
tagaggggaaggaaat

SEQ ID NO: 2192063 - DNA, 19 bp, Homo sapiens
tagagtggtctatttctcc

SEQ ID NO: 2192064 - DNA, 14 bp, Homo sapiens
tagatatataactt

SEQ ID NO: 2192065 - DNA, 22 bp, Homo sapiens
tagatcaacaataaaaaaaaac

SEQ ID NO: 2192066 - DNA, 14 bp, Homo sapiens
tagatctgtggcga

SEQ ID NO: 2192067 - DNA, 19 bp, Homo sapiens
tagatgactgaatttctat

SEQ ID NO: 2192068 - DNA, 20 bp, Homo sapiens
tagcaaattccaatacatta

SEQ ID NO: 2192069 - DNA, 15 bp, Homo sapiens
tagcaatatcaaaag

SEQ ID NO: 2192070 - DNA, 15 bp, Homo sapiens
tagcactcacatgct

SEQ ID NO: 2192071 - DNA, 20 bp, Homo sapiens
tagcagatattaaaaattga

SEQ ID NO: 2192072 - DNA, 23 bp, Homo sapiens
tagcagcttctgtcctcttctgt

SEQ ID NO: 2192073 - DNA, 18 bp, Homo sapiens
tagcaggaaaaggtcctt

SEQ ID NO: 2192074 - DNA, 22 bp, Homo sapiens
tagcagggtctttgtgtgctgt

SEQ ID NO: 2192075 - DNA, 18 bp, Homo sapiens
tagccccaagaaggctgg

SEQ ID NO: 2192076 - DNA, 18 bp, Homo sapiens
tagcccccacccacttcc

SEQ ID NO: 2192077 - DNA, 16 bp, Homo sapiens
tagcctccctctcctc

SEQ ID NO: 2192078 - DNA, 19 bp, Homo sapiens
tagctggtttttcccacca

SEQ ID NO: 2192079 - DNA, 15 bp, Homo sapiens
tagcttacaggaagc

SEQ ID NO: 2192080 - DNA, 19 bp, Homo sapiens
tagcttagagcctccctca

SEQ ID NO: 2192081 - DNA, 17 bp, Homo sapiens
tagcttatacaattcag

SEQ ID NO: 2192082 - DNA, 22 bp, Homo sapiens
tagcttatacaattcagagaat

SEQ ID NO: 2192083 - DNA, 13 bp, Homo sapiens
tagcttctgacct

SEQ ID NO: 2192084 - DNA, 20 bp, Homo sapiens
taggaaaagctgttcccatg

SEQ ID NO: 2192085 - DNA, 19 bp, Homo sapiens
taggaaactttttccacct

SEQ ID NO: 2192086 - DNA, 16 bp, Homo sapiens
taggaagaacttgaag

SEQ ID NO: 2192087 - DNA, 20 bp, Homo sapiens
taggacatgttcccttctcc

SEQ ID NO: 2192088 - DNA, 17 bp, Homo sapiens
taggcacctctgtgctg

SEQ ID NO: 2192089 - DNA, 22 bp, Homo sapiens
taggcagcctgctataaagtta

SEQ ID NO: 2192090 - DNA, 19 bp, Homo sapiens
taggccccagaggccctgg

SEQ ID NO: 2192091 - DNA, 17 bp, Homo sapiens
taggctacccttgccaa

SEQ ID NO: 2192092 - DNA, 17 bp, Homo sapiens
taggctgggcccagagg

SEQ ID NO: 2192093 - DNA, 20 bp, Homo sapiens
tagggactcaatttctcccc

SEQ ID NO: 2192094 - DNA, 11 bp, Homo sapiens
tagggagaagg

SEQ ID NO: 2192095 - DNA, 22 bp, Homo sapiens
tagggatgcggatcctgctggg

SEQ ID NO: 2192096 - DNA, 11 bp, Homo sapiens
tagggctgggt

SEQ ID NO: 2192097 - DNA, 21 bp, Homo sapiens
taggtcaaggcctgtccctgg

SEQ ID NO: 2192098 - DNA, 22 bp, Homo sapiens
taggtcagtacccacctgagct

SEQ ID NO: 2192099 - DNA, 23 bp, Homo sapiens
taggtcagtacccacctgagctt

SEQ ID NO: 2192100 - DNA, 14 bp, Homo sapiens
taggtctcttcccc

SEQ ID NO: 2192101 - DNA, 14 bp, Homo sapiens
taggttctgtctgt

SEQ ID NO: 2192102 - DNA, 23 bp, Homo sapiens
taggtttagaatcaagtctgtga

SEQ ID NO: 2192103 - DNA, 16 bp, Homo sapiens
tagtaacctttaaaaa

SEQ ID NO: 2192104 - DNA, 21 bp, Homo sapiens
tagtaacgtgttactggaaaa

SEQ ID NO: 2192105 - DNA, 14 bp, Homo sapiens
tagtacctttgctc

SEQ ID NO: 2192106 - DNA, 13 bp, Homo sapiens
tagtgatttgcta

SEQ ID NO: 2192107 - DNA, 18 bp, Homo sapiens
tagtgcagagaggttgtg

SEQ ID NO: 2192108 - DNA, 11 bp, Homo sapiens
tagtgccaggc

SEQ ID NO: 2192109 - DNA, 15 bp, Homo sapiens
tagtggaaagattgt

SEQ ID NO: 2192110 - DNA, 17 bp, Homo sapiens
tagtggtggctctgaga

SEQ ID NO: 2192111 - DNA, 13 bp, Homo sapiens
tagtgtcacctgc

SEQ ID NO: 2192112 - DNA, 13 bp, Homo sapiens
tagtgtgtccatg

SEQ ID NO: 2192113 - DNA, 19 bp, Homo sapiens
tagttgggattacaggtga

SEQ ID NO: 2192114 - DNA, 16 bp, Homo sapiens
tagttttatgtttctt

SEQ ID NO: 2192115 - DNA, 22 bp, Homo sapiens
tagttttgctccttctgtgttt

SEQ ID NO: 2192116 - DNA, 23 bp, Homo sapiens
tataaatactaaatatgaaattt

SEQ ID NO: 2192117 - DNA, 13 bp, Homo sapiens
tataaatggtgag

SEQ ID NO: 2192118 - DNA, 15 bp, Homo sapiens
tataaatggtgagaa

SEQ ID NO: 2192119 - DNA, 18 bp, Homo sapiens
tataaatggtgagaatta

SEQ ID NO: 2192120 - DNA, 22 bp, Homo sapiens
tataaatggtgagaattaaaat

SEQ ID NO: 2192121 - DNA, 20 bp, Homo sapiens
tataacaatgttaaatgcaa

SEQ ID NO: 2192122 - DNA, 13 bp, Homo sapiens
tataactgtattt

SEQ ID NO: 2192123 - DNA, 23 bp, Homo sapiens
tataactgtatttgaaataagaa

SEQ ID NO: 2192124 - DNA, 19 bp, Homo sapiens
tataagactactattcctt

SEQ ID NO: 2192125 - DNA, 17 bp, Homo sapiens
tataatacttaaaaata

SEQ ID NO: 2192126 - DNA, 15 bp, Homo sapiens
tataatattgcagtt

SEQ ID NO: 2192127 - DNA, 23 bp, Homo sapiens
tataatattgcagttcatactga

SEQ ID NO: 2192128 - DNA, 16 bp, Homo sapiens
tataatcttataattg

SEQ ID NO: 2192129 - DNA, 17 bp, Homo sapiens
tataatcttataattgt

SEQ ID NO: 2192130 - DNA, 18 bp, Homo sapiens
tataatgacttttaaaat

SEQ ID NO: 2192131 - DNA, 20 bp, Homo sapiens
tataatgacttttaaaattt

SEQ ID NO: 2192132 - DNA, 23 bp, Homo sapiens
tataatgacttttaaaatttgta

SEQ ID NO: 2192133 - DNA, 17 bp, Homo sapiens
tataattgttatacatt

SEQ ID NO: 2192134 - DNA, 18 bp, Homo sapiens
tataattttattgctgga

SEQ ID NO: 2192135 - DNA, 16 bp, Homo sapiens
tatacatatgatcaaa

SEQ ID NO: 2192136 - DNA, 18 bp, Homo sapiens
tatacatgaatcatagcc

SEQ ID NO: 2192137 - DNA, 14 bp, Homo sapiens
tatactgcagcttt

SEQ ID NO: 2192138 - DNA, 13 bp, Homo sapiens
tatacttgagtgt

SEQ ID NO: 2192139 - DNA, 17 bp, Homo sapiens
tatagaagtggtgtttt

SEQ ID NO: 2192140 - DNA, 23 bp, Homo sapiens
tatagattctttattagtgaagt

SEQ ID NO: 2192141 - DNA, 18 bp, Homo sapiens
tatagcaatatcaaaagg

SEQ ID NO: 2192142 - DNA, 18 bp, Homo sapiens
tatagccatttgccccaa

SEQ ID NO: 2192143 - DNA, 17 bp, Homo sapiens
tatagttaatgttaaaa

SEQ ID NO: 2192144 - DNA, 16 bp, Homo sapiens
tatataaatatatttt

SEQ ID NO: 2192145 - DNA, 12 bp, Homo sapiens
tatataaatggt

SEQ ID NO: 2192146 - DNA, 13 bp, Homo sapiens
tatataaatggtg

SEQ ID NO: 2192147 - DNA, 16 bp, Homo sapiens
tatataactttagaaa

SEQ ID NO: 2192148 - DNA, 18 bp, Homo sapiens
tatataactttagaaata

SEQ ID NO: 2192149 - DNA, 18 bp, Homo sapiens
tatatatgccttatgtaa

SEQ ID NO: 2192150 - DNA, 18 bp, Homo sapiens
tatatgtagccagacagt

SEQ ID NO: 2192151 - DNA, 21 bp, Homo sapiens
tatatgtagccagacagttta

SEQ ID NO: 2192152 - DNA, 15 bp, Homo sapiens
tatatgtcctattca

SEQ ID NO: 2192153 - DNA, 14 bp, Homo sapiens
tatatttgaaactg

SEQ ID NO: 2192154 - DNA, 20 bp, Homo sapiens
tatatttgaaactgctaatt

SEQ ID NO: 2192155 - DNA, 19 bp, Homo sapiens
tatcaaaaaacaagtcttt

SEQ ID NO: 2192156 - DNA, 15 bp, Homo sapiens
tatcaaacagctcag

SEQ ID NO: 2192157 - DNA, 23 bp, Homo sapiens
tatcaagactgactggcaccaac

SEQ ID NO: 2192158 - DNA, 22 bp, Homo sapiens
tatcaatatggtgtcttgatat

SEQ ID NO: 2192159 - DNA, 15 bp, Homo sapiens
tatcaccctcagctg

SEQ ID NO: 2192160 - DNA, 18 bp, Homo sapiens
tatcactttgtattctct

SEQ ID NO: 2192161 - DNA, 19 bp, Homo sapiens
tatcatcccaacagccaag

SEQ ID NO: 2192162 - DNA, 14 bp, Homo sapiens
tatctacctgccct

SEQ ID NO: 2192163 - DNA, 16 bp, Homo sapiens
tatctacctgccctct

SEQ ID NO: 2192164 - DNA, 21 bp, Homo sapiens
tatctacctgccctctctcag

SEQ ID NO: 2192165 - DNA, 22 bp, Homo sapiens
tatctcgaagtcttccatcagc

SEQ ID NO: 2192166 - DNA, 20 bp, Homo sapiens
tatctctgtctaccatctcc

SEQ ID NO: 2192167 - DNA, 14 bp, Homo sapiens
tatctgtgttacaa

SEQ ID NO: 2192168 - DNA, 14 bp, Homo sapiens
tatgaatgttacta

SEQ ID NO: 2192169 - DNA, 20 bp, Homo sapiens
tatgagaatgaccctgtcaa

SEQ ID NO: 2192170 - DNA, 21 bp, Homo sapiens
tatgagaatgaccctgtcaag

SEQ ID NO: 2192171 - DNA, 14 bp, Homo sapiens
tatgatcaaatact

SEQ ID NO: 2192172 - DNA, 16 bp, Homo sapiens
tatgatttgcatgtgt

SEQ ID NO: 2192173 - DNA, 14 bp, Homo sapiens
tatgcaaaactttt

SEQ ID NO: 2192174 - DNA, 16 bp, Homo sapiens
tatgcacctataaata

SEQ ID NO: 2192175 - DNA, 17 bp, Homo sapiens
tatgcatgcagtcttgt

SEQ ID NO: 2192176 - DNA, 17 bp, Homo sapiens
tatgcatttttttagtt

SEQ ID NO: 2192177 - DNA, 19 bp, Homo sapiens
tatggagtagcaaaggact

SEQ ID NO: 2192178 - DNA, 19 bp, Homo sapiens
tatggattttctaaggaag

SEQ ID NO: 2192179 - DNA, 17 bp, Homo sapiens
tatggctagaatatcct

SEQ ID NO: 2192180 - DNA, 21 bp, Homo sapiens
tatggctagaatatcctactt

SEQ ID NO: 2192181 - DNA, 16 bp, Homo sapiens
tatgtagccagacagt

SEQ ID NO: 2192182 - DNA, 18 bp, Homo sapiens
tatgtcctattcattcac

SEQ ID NO: 2192183 - DNA, 14 bp, Homo sapiens
tatgtgagcatgaa

SEQ ID NO: 2192184 - DNA, 19 bp, Homo sapiens
tatgttcaatgaatattgt

SEQ ID NO: 2192185 - DNA, 23 bp, Homo sapiens
tatgttcaatgaatattgtaaat

SEQ ID NO: 2192186 - DNA, 20 bp, Homo sapiens
tatgttcatgagtcttgtaa

SEQ ID NO: 2192187 - DNA, 12 bp, Homo sapiens
tatgtttgcatt

SEQ ID NO: 2192188 - DNA, 20 bp, Homo sapiens
tattaaaaattaattcttta

SEQ ID NO: 2192189 - DNA, 21 bp, Homo sapiens
tattaaaaattaattctttat

SEQ ID NO: 2192190 - DNA, 12 bp, Homo sapiens
tattaaacttga

SEQ ID NO: 2192191 - DNA, 13 bp, Homo sapiens
tattaaacttgaa

SEQ ID NO: 2192192 - DNA, 16 bp, Homo sapiens
tattaacctacctgtg

SEQ ID NO: 2192193 - DNA, 11 bp, Homo sapiens
tattaatttat

SEQ ID NO: 2192194 - DNA, 19 bp, Homo sapiens
tattaatttatatttgtct

SEQ ID NO: 2192195 - DNA, 16 bp, Homo sapiens
tattagtcttggggca

SEQ ID NO: 2192196 - DNA, 14 bp, Homo sapiens
tattataatcttat

SEQ ID NO: 2192197 - DNA, 19 bp, Homo sapiens
tattataatcttataattg

SEQ ID NO: 2192198 - DNA, 17 bp, Homo sapiens
tattcaaaaattatatt

SEQ ID NO: 2192199 - DNA, 20 bp, Homo sapiens
tattcaaaaattatattttg

SEQ ID NO: 2192200 - DNA, 14 bp, Homo sapiens
tattcaaagatgat

SEQ ID NO: 2192201 - DNA, 18 bp, Homo sapiens
tattcaaagatgataatt

SEQ ID NO: 2192202 - DNA, 14 bp, Homo sapiens
tattcatagctgta

SEQ ID NO: 2192203 - DNA, 14 bp, Homo sapiens
tattcattcacaat

SEQ ID NO: 2192204 - DNA, 21 bp, Homo sapiens
tattcccatggtagactgtga

SEQ ID NO: 2192205 - DNA, 18 bp, Homo sapiens
tattctaacctactaagt

SEQ ID NO: 2192206 - DNA, 14 bp, Homo sapiens
tattctagtgataa

SEQ ID NO: 2192207 - DNA, 19 bp, Homo sapiens
tattctttaattgttgctt

SEQ ID NO: 2192208 - DNA, 15 bp, Homo sapiens
tattctttccatgca

SEQ ID NO: 2192209 - DNA, 18 bp, Homo sapiens
tattctttccatgcagtt

SEQ ID NO: 2192210 - DNA, 19 bp, Homo sapiens
tattctttgaccaaactgt

SEQ ID NO: 2192211 - DNA, 20 bp, Homo sapiens
tattctttgaccaaactgtg

SEQ ID NO: 2192212 - DNA, 23 bp, Homo sapiens
tattctttgaccaaactgtgggt

SEQ ID NO: 2192213 - DNA, 16 bp, Homo sapiens
tattgattttctttct

SEQ ID NO: 2192214 - DNA, 20 bp, Homo sapiens
tattgcaagtgaaataatat

SEQ ID NO: 2192215 - DNA, 13 bp, Homo sapiens
tattgcttaaaca

SEQ ID NO: 2192216 - DNA, 19 bp, Homo sapiens
tattggacttccatttgga

SEQ ID NO: 2192217 - DNA, 19 bp, Homo sapiens
tattggccgatgagctggt

SEQ ID NO: 2192218 - DNA, 13 bp, Homo sapiens
tattgttaatatt

SEQ ID NO: 2192219 - DNA, 22 bp, Homo sapiens
tatttaaaaaaaaacattcaaa

SEQ ID NO: 2192220 - DNA, 19 bp, Homo sapiens
tatttaataccaccaacaa

SEQ ID NO: 2192221 - DNA, 21 bp, Homo sapiens
tatttaatttttacatgacca

SEQ ID NO: 2192222 - DNA, 13 bp, Homo sapiens
tatttactgtact

SEQ ID NO: 2192223 - DNA, 16 bp, Homo sapiens
tatttagtaaaaataa

SEQ ID NO: 2192224 - DNA, 18 bp, Homo sapiens
tatttagtaaaaataaat

SEQ ID NO: 2192225 - DNA, 15 bp, Homo sapiens
tatttataattaaag

SEQ ID NO: 2192226 - DNA, 21 bp, Homo sapiens
tatttcagtgatttttagtaa

SEQ ID NO: 2192227 - DNA, 15 bp, Homo sapiens
tatttccatattaaa

SEQ ID NO: 2192228 - DNA, 22 bp, Homo sapiens
tatttccatattaaaatcacaa

SEQ ID NO: 2192229 - DNA, 14 bp, Homo sapiens
tatttgtaaaaata

SEQ ID NO: 2192230 - DNA, 22 bp, Homo sapiens
tattttctgagtagcatatata

SEQ ID NO: 2192231 - DNA, 12 bp, Homo sapiens
tattttgcaaac

SEQ ID NO: 2192232 - DNA, 16 bp, Homo sapiens
tatttttttattcttc

SEQ ID NO: 2192233 - DNA, 16 bp, Homo sapiens
tatttttttgttgctg

SEQ ID NO: 2192234 - DNA, 17 bp, Homo sapiens
tatttttttgttgctgt

SEQ ID NO: 2192235 - DNA, 20 bp, Homo sapiens
tattttttttttccattagt

SEQ ID NO: 2192236 - DNA, 16 bp, Homo sapiens
tcaaaaacatggccac

SEQ ID NO: 2192237 - DNA, 18 bp, Homo sapiens
tcaaaaaggtgtgtcaaa

SEQ ID NO: 2192238 - DNA, 19 bp, Homo sapiens
tcaaaatattttttttaac

SEQ ID NO: 2192239 - DNA, 20 bp, Homo sapiens
tcaaaatgttaataaaggtt

SEQ ID NO: 2192240 - DNA, 18 bp, Homo sapiens
tcaaacaattcaatcaaa

SEQ ID NO: 2192241 - DNA, 17 bp, Homo sapiens
tcaaagattctgcattt

SEQ ID NO: 2192242 - DNA, 16 bp, Homo sapiens
tcaaagattttacctg

SEQ ID NO: 2192243 - DNA, 13 bp, Homo sapiens
tcaaagctacctt

SEQ ID NO: 2192244 - DNA, 19 bp, Homo sapiens
tcaaagtggtacaggaagg

SEQ ID NO: 2192245 - DNA, 19 bp, Homo sapiens
tcaaagtttttacagtgta

SEQ ID NO: 2192246 - DNA, 19 bp, Homo sapiens
tcaaatcctgccactgttt

SEQ ID NO: 2192247 - DNA, 14 bp, Homo sapiens
ggtgggggcctgct

SEQ ID NO: 2192248 - DNA, 15 bp, Homo sapiens
ggtgggggcctgctg

SEQ ID NO: 2192249 - DNA, 17 bp, Homo sapiens
ggtgtcacagaggcagt

SEQ ID NO: 2192250 - DNA, 14 bp, Homo sapiens
ggtgtccttctcct

SEQ ID NO: 2192251 - DNA, 24 bp, Homo sapiens
ggtgtcttttaatgatactgtcta

SEQ ID NO: 2192252 - DNA, 19 bp, Homo sapiens
ggtgtgaatgctgtacctt

SEQ ID NO: 2192253 - DNA, 20 bp, Homo sapiens
ggtgtgagccactgtgccca

SEQ ID NO: 2192254 - DNA, 16 bp, Homo sapiens
ggttcaggtcagggct

SEQ ID NO: 2192255 - DNA, 14 bp, Homo sapiens
ggttccagcttccc

SEQ ID NO: 2192256 - DNA, 16 bp, Homo sapiens
ggttccttaagtggct

SEQ ID NO: 2192257 - DNA, 12 bp, Homo sapiens
ggttctgaagcc

SEQ ID NO: 2192258 - DNA, 12 bp, Homo sapiens
ggttctgggtgg

SEQ ID NO: 2192259 - DNA, 22 bp, Homo sapiens
ggttctggttagctcagcccca

SEQ ID NO: 2192260 - DNA, 13 bp, Homo sapiens
ggttggggtgggg

SEQ ID NO: 2192261 - DNA, 14 bp, Homo sapiens
ggtttctctgtgct

SEQ ID NO: 2192262 - DNA, 15 bp, Homo sapiens
ggtttgggagagacc

SEQ ID NO: 2192263 - DNA, 21 bp, Homo sapiens
ggttttaggtctcttcccctc

SEQ ID NO: 2192264 - DNA, 19 bp, Homo sapiens
ggttttattctttgagaag

SEQ ID NO: 2192265 - DNA, 22 bp, Homo sapiens
gtaaacagaaatcctttcataa

SEQ ID NO: 2192266 - DNA, 18 bp, Homo sapiens
gtaaacagtgagaaaaga

SEQ ID NO: 2192267 - DNA, 17 bp, Homo sapiens
gtaaagtatgtattatt

SEQ ID NO: 2192268 - DNA, 23 bp, Homo sapiens
gtaaagtatgtattatttacatt

SEQ ID NO: 2192269 - DNA, 18 bp, Homo sapiens
gtaaatatagaaccatga

SEQ ID NO: 2192270 - DNA, 12 bp, Homo sapiens
gtaaatctgaaa

SEQ ID NO: 2192271 - DNA, 19 bp, Homo sapiens
gtaactagaccatttttaa

SEQ ID NO: 2192272 - DNA, 19 bp, Homo sapiens
gtaagaccggaagctcctg

SEQ ID NO: 2192273 - DNA, 11 bp, Homo sapiens
gtaagagggag

SEQ ID NO: 2192274 - DNA, 15 bp, Homo sapiens
gtaaggacttgtgcc

SEQ ID NO: 2192275 - DNA, 16 bp, Homo sapiens
gtaaggacttgtgcct

SEQ ID NO: 2192276 - DNA, 14 bp, Homo sapiens
gtaataaaacccag

SEQ ID NO: 2192277 - DNA, 20 bp, Homo sapiens
gtaatgtgtatgtctggtaa

SEQ ID NO: 2192278 - DNA, 15 bp, Homo sapiens
gtaattcaagaggcc

SEQ ID NO: 2192279 - DNA, 19 bp, Homo sapiens
gtaatttaattccccttcc

SEQ ID NO: 2192280 - DNA, 13 bp, Homo sapiens
gtaatttcagttc

SEQ ID NO: 2192281 - DNA, 15 bp, Homo sapiens
gtacaaaagtaccat

SEQ ID NO: 2192282 - DNA, 22 bp, Homo sapiens
gtacacatatacatatgatcaa

SEQ ID NO: 2192283 - DNA, 15 bp, Homo sapiens
gtacagttgactggc

SEQ ID NO: 2192284 - DNA, 22 bp, Homo sapiens
gtacatttgggagtttttatga

SEQ ID NO: 2192285 - DNA, 16 bp, Homo sapiens
gtacctattaaaagtt

SEQ ID NO: 2192286 - DNA, 19 bp, Homo sapiens
gtacctgcccccactcagc

SEQ ID NO: 2192287 - DNA, 21 bp, Homo sapiens
gtacctgcccccactcagcat

SEQ ID NO: 2192288 - DNA, 14 bp, Homo sapiens
gtacctttctgaca

SEQ ID NO: 2192289 - DNA, 20 bp, Homo sapiens
gtactgtgacctaagaacaa

SEQ ID NO: 2192290 - DNA, 17 bp, Homo sapiens
gggagcttccgctttga

SEQ ID NO: 2192291 - DNA, 20 bp, Homo sapiens
gggaggaatcttttactgtg

SEQ ID NO: 2192292 - DNA, 22 bp, Homo sapiens
gggaggaatcttttactgtgga

SEQ ID NO: 2192293 - DNA, 23 bp, Homo sapiens
gggaggagcctgtgcgtcccagc

SEQ ID NO: 2192294 - DNA, 17 bp, Homo sapiens
gggaggccaaggcaggc

SEQ ID NO: 2192295 - DNA, 15 bp, Homo sapiens
gggaggccgaggcag

SEQ ID NO: 2192296 - DNA, 13 bp, Homo sapiens
gggagtgggagag

SEQ ID NO: 2192297 - DNA, 16 bp, Homo sapiens
gggagtgggagaggaa

SEQ ID NO: 2192298 - DNA, 17 bp, Homo sapiens
gggagtgggagaggaag

SEQ ID NO: 2192299 - DNA, 13 bp, Homo sapiens
gggatccagccac

SEQ ID NO: 2192300 - DNA, 15 bp, Homo sapiens
gggatctgcccctcc

SEQ ID NO: 2192301 - DNA, 21 bp, Homo sapiens
gggatgctatctcgctagcca

SEQ ID NO: 2192302 - DNA, 23 bp, Homo sapiens
gggcaagctaggccccagaggcc

SEQ ID NO: 2192303 - DNA, 18 bp, Homo sapiens
gggcacttttgaactcac

SEQ ID NO: 2192304 - DNA, 23 bp, Homo sapiens
gggcagaggggagaggaagcaca

SEQ ID NO: 2192305 - DNA, 16 bp, Homo sapiens
gggcagcctgtgggag

SEQ ID NO: 2192306 - DNA, 17 bp, Homo sapiens
gggcagcctgtgggaga

SEQ ID NO: 2192307 - DNA, 18 bp, Homo sapiens
gggcagcctgtgggagaa

SEQ ID NO: 2192308 - DNA, 22 bp, Homo sapiens
gggcagggaaggacaggaccct

SEQ ID NO: 2192309 - DNA, 14 bp, Homo sapiens
gggccacagccaga

SEQ ID NO: 2192310 - DNA, 17 bp, Homo sapiens
gggccccgggctggaga

SEQ ID NO: 2192311 - DNA, 13 bp, Homo sapiens
gggcccgccaccc

SEQ ID NO: 2192312 - DNA, 14 bp, Homo sapiens
gggccgccacggcc

SEQ ID NO: 2192313 - DNA, 19 bp, Homo sapiens
gggccgccacggcctggct

SEQ ID NO: 2192314 - DNA, 16 bp, Homo sapiens
gggcctcaggctctgc

SEQ ID NO: 2192315 - DNA, 17 bp, Homo sapiens
gggcctcaggctctgca

SEQ ID NO: 2192316 - DNA, 18 bp, Homo sapiens
gggcctcaggctctgcac

SEQ ID NO: 2192317 - DNA, 22 bp, Homo sapiens
gggcggtcaataattgtggaga

SEQ ID NO: 2192318 - DNA, 20 bp, Homo sapiens
gggctaaggcctcttgctgg

SEQ ID NO: 2192319 - DNA, 14 bp, Homo sapiens
gggctctcctgccc

SEQ ID NO: 2192320 - DNA, 17 bp, Homo sapiens
gggctggactggctgtc

SEQ ID NO: 2192321 - DNA, 16 bp, Homo sapiens
gggctggagaaagagc

SEQ ID NO: 2192322 - DNA, 20 bp, Homo sapiens
gggctggagaaagagctgcc

SEQ ID NO: 2192323 - DNA, 23 bp, Homo sapiens
gggctgggcagaggggagaggaa

SEQ ID NO: 2192324 - DNA, 14 bp, Homo sapiens
gggcttccctctgc

SEQ ID NO: 2192325 - DNA, 11 bp, Homo sapiens
ggggaactcaa

SEQ ID NO: 2192326 - DNA, 13 bp, Homo sapiens
ggggaagagagcc

SEQ ID NO: 2192327 - DNA, 16 bp, Homo sapiens
ggggaagagagcctgc

SEQ ID NO: 2192328 - DNA, 12 bp, Homo sapiens
ggggagctctgg

SEQ ID NO: 2192329 - DNA, 12 bp, Homo sapiens
ggggaggagcct

SEQ ID NO: 2192330 - DNA, 15 bp, Homo sapiens
ggggatccagccact

SEQ ID NO: 2192331 - DNA, 17 bp, Homo sapiens
ggggatccagccacttc

SEQ ID NO: 2192332 - DNA, 11 bp, Homo sapiens
ggggccctgct

SEQ ID NO: 2192333 - DNA, 13 bp, Homo sapiens
ggggccctgctac

SEQ ID NO: 2192334 - DNA, 20 bp, Homo sapiens
ggggcctgcagaaggaaaga

SEQ ID NO: 2192335 - DNA, 21 bp, Homo sapiens
ggggcctgcagaaggaaagaa

SEQ ID NO: 2192336 - DNA, 11 bp, Homo sapiens
ggggcctggcg

SEQ ID NO: 2192337 - DNA, 18 bp, Homo sapiens
ggggctcagccctgagct

SEQ ID NO: 2192338 - DNA, 18 bp, Homo sapiens
gggggaggccgaggcagg

SEQ ID NO: 2192339 - DNA, 13 bp, Homo sapiens
gggggcctgctgt

SEQ ID NO: 2192340 - DNA, 18 bp, Homo sapiens
gggggtcaggaggcaggg

SEQ ID NO: 2192341 - DNA, 13 bp, Homo sapiens
ggcagctctgtcg

SEQ ID NO: 2192342 - DNA, 14 bp, Homo sapiens
ggcaggagctcaga

SEQ ID NO: 2192343 - DNA, 14 bp, Homo sapiens
ggcaggagggtggc

SEQ ID NO: 2192344 - DNA, 17 bp, Homo sapiens
ggcaggatcacagctca

SEQ ID NO: 2192345 - DNA, 14 bp, Homo sapiens
ggcaggcctttcct

SEQ ID NO: 2192346 - DNA, 17 bp, Homo sapiens
ggcagggaaggacagga

SEQ ID NO: 2192347 - DNA, 16 bp, Homo sapiens
ggcaggggctgggcag

SEQ ID NO: 2192348 - DNA, 18 bp, Homo sapiens
ggcaggggctgggcagag

SEQ ID NO: 2192349 - DNA, 19 bp, Homo sapiens
ggcaggggttccagcttcc

SEQ ID NO: 2192350 - DNA, 20 bp, Homo sapiens
ggcaggtcccgagccccctg

SEQ ID NO: 2192351 - DNA, 17 bp, Homo sapiens
ggcagtggcaggggagc

SEQ ID NO: 2192352 - DNA, 15 bp, Homo sapiens
ggcatctctggagtg

SEQ ID NO: 2192353 - DNA, 13 bp, Homo sapiens
ggcatctgaaaac

SEQ ID NO: 2192354 - DNA, 15 bp, Homo sapiens
ggcattactctgcac

SEQ ID NO: 2192355 - DNA, 16 bp, Homo sapiens
ggcattactctgcact

SEQ ID NO: 2192356 - DNA, 18 bp, Homo sapiens
ggcattcccagaggtggg

SEQ ID NO: 2192357 - DNA, 14 bp, Homo sapiens
ggcatttttccaaa

SEQ ID NO: 2192358 - DNA, 18 bp, Homo sapiens
ggccaaagacctcccaag

SEQ ID NO: 2192359 - DNA, 17 bp, Homo sapiens
ggccaccaccccccact

SEQ ID NO: 2192360 - DNA, 18 bp, Homo sapiens
ggccaccaccccccactc

SEQ ID NO: 2192361 - DNA, 12 bp, Homo sapiens
ggccacctgcag

SEQ ID NO: 2192362 - DNA, 14 bp, Homo sapiens
ggccacctgcaggt

SEQ ID NO: 2192363 - DNA, 14 bp, Homo sapiens
ggccactggcatct

SEQ ID NO: 2192364 - DNA, 17 bp, Homo sapiens
ggccactttgcagacct

SEQ ID NO: 2192365 - DNA, 22 bp, Homo sapiens
ggccactttgcagacctgggac

SEQ ID NO: 2192366 - DNA, 16 bp, Homo sapiens
ggccagaccagagctc

SEQ ID NO: 2192367 - DNA, 17 bp, Homo sapiens
ggccagaggcagaaccc

SEQ ID NO: 2192368 - DNA, 18 bp, Homo sapiens
ggccagtctgaacctgag

SEQ ID NO: 2192369 - DNA, 17 bp, Homo sapiens
ggccatagctcctgctc

SEQ ID NO: 2192370 - DNA, 15 bp, Homo sapiens
ggccatcctgtccca

SEQ ID NO: 2192371 - DNA, 14 bp, Homo sapiens
ggccatcggtcctg

SEQ ID NO: 2192372 - DNA, 22 bp, Homo sapiens
ggccatcggtcctgtctcccct

SEQ ID NO: 2192373 - DNA, 21 bp, Homo sapiens
ggccatctctgaacttcagct

SEQ ID NO: 2192374 - DNA, 22 bp, Homo sapiens
ggccatctgactgccaagccag

SEQ ID NO: 2192375 - DNA, 21 bp, Homo sapiens
ggccatctggaaatccagctg

SEQ ID NO: 2192376 - DNA, 14 bp, Homo sapiens
ggcccagcagagcc

SEQ ID NO: 2192377 - DNA, 15 bp, Homo sapiens
ggcccaggggctttg

SEQ ID NO: 2192378 - DNA, 14 bp, Homo sapiens
ggccccagaggccc

SEQ ID NO: 2192379 - DNA, 22 bp, Homo sapiens
ggccccatgagggtgttttttt

SEQ ID NO: 2192380 - DNA, 16 bp, Homo sapiens
ggccccgtctcctgag

SEQ ID NO: 2192381 - DNA, 12 bp, Homo sapiens
ggcccctcccca

SEQ ID NO: 2192382 - DNA, 22 bp, Homo sapiens
ggccctctgaggctcagccctg

SEQ ID NO: 2192383 - DNA, 23 bp, Homo sapiens
ggccctctgaggctcagccctga

SEQ ID NO: 2192384 - DNA, 20 bp, Homo sapiens
ggccctctggggctcagccc

SEQ ID NO: 2192385 - DNA, 12 bp, Homo sapiens
ggccctggctgg

SEQ ID NO: 2192386 - DNA, 14 bp, Homo sapiens
ggcccttttctggc

SEQ ID NO: 2192387 - DNA, 19 bp, Homo sapiens
ggcccttttctggctcctg

SEQ ID NO: 2192388 - DNA, 17 bp, Homo sapiens
ggccgaggcaggggctg

SEQ ID NO: 2192389 - DNA, 14 bp, Homo sapiens
ggccgatgagctgg

SEQ ID NO: 2192390 - DNA, 13 bp, Homo sapiens
ggccgcccacctg

SEQ ID NO: 2192391 - DNA, 16 bp, Homo sapiens
ggccgcccacctgcat

SEQ ID NO: 2192392 - DNA, 21 bp, Homo sapiens
ggccgcccacctgcatcagcc

SEQ ID NO: 2192393 - DNA, 15 bp, Homo sapiens
ggccgcctgtccttg

SEQ ID NO: 2192394 - DNA, 21 bp, Homo sapiens
ggccgctgctgaccagcactg

SEQ ID NO: 2192395 - DNA, 18 bp, Homo sapiens
ggccgcttccctacccac

SEQ ID NO: 2192396 - DNA, 18 bp, Homo sapiens
ggccggagaacatctgcc

SEQ ID NO: 2192397 - DNA, 15 bp, Homo sapiens
ggccgggggtggggg

SEQ ID NO: 2192398 - DNA, 19 bp, Homo sapiens
ggccgggggtgggggcctg

SEQ ID NO: 2192399 - DNA, 15 bp, Homo sapiens
ggcctaaagccagca

SEQ ID NO: 2192400 - DNA, 12 bp, Homo sapiens
ggcctcacctgg

SEQ ID NO: 2192401 - DNA, 17 bp, Homo sapiens
ggcctcaggctctgcac

SEQ ID NO: 2192402 - DNA, 15 bp, Homo sapiens
ggcctcctctaacag

SEQ ID NO: 2192403 - DNA, 23 bp, Homo sapiens
ggcctcctctaacaggggctggt

SEQ ID NO: 2192404 - DNA, 15 bp, Homo sapiens
ggcctctggctgcct

SEQ ID NO: 2192405 - DNA, 17 bp, Homo sapiens
ggcctctggctgcctgg

SEQ ID NO: 2192406 - DNA, 16 bp, Homo sapiens
ggcctcttcctccctc

SEQ ID NO: 2192407 - DNA, 18 bp, Homo sapiens
ggcctcttgctggtgcac

SEQ ID NO: 2192408 - DNA, 20 bp, Homo sapiens
ggcctgcagaaggaaagaag

SEQ ID NO: 2192409 - DNA, 17 bp, Homo sapiens
ggcctgcctagcactca

SEQ ID NO: 2192410 - DNA, 12 bp, Homo sapiens
ggcctgctgtgg

SEQ ID NO: 2192411 - DNA, 23 bp, Homo sapiens
ggcctggggatgtaaccaagctg

SEQ ID NO: 2192412 - DNA, 17 bp, Homo sapiens
ggccttattgcatccca

SEQ ID NO: 2192413 - DNA, 21 bp, Homo sapiens
ggcgaggcgaagctgagcggg

SEQ ID NO: 2192414 - DNA, 12 bp, Homo sapiens
ggcgcggttcag

SEQ ID NO: 2192415 - DNA, 21 bp, Homo sapiens
ggcgcggttcaggtcagggct

SEQ ID NO: 2192416 - DNA, 22 bp, Homo sapiens
ggcgcggttcaggtcagggcta

SEQ ID NO: 2192417 - DNA, 16 bp, Homo sapiens
ggcgctggctgcactc

SEQ ID NO: 2192418 - DNA, 14 bp, Homo sapiens
ggcggaacctggct

SEQ ID NO: 2192419 - DNA, 15 bp, Homo sapiens
ggcggaacctggctg

SEQ ID NO: 2192420 - DNA, 16 bp, Homo sapiens
ggctaaggcaccagcc

SEQ ID NO: 2192421 - DNA, 22 bp, Homo sapiens
ggctatcggagcagttcaataa

SEQ ID NO: 2192422 - DNA, 15 bp, Homo sapiens
ggctatttaccaggg

SEQ ID NO: 2192423 - DNA, 14 bp, Homo sapiens
ggctcaaggattca

SEQ ID NO: 2192424 - DNA, 14 bp, Homo sapiens
ggctcagcatcctc

SEQ ID NO: 2192425 - DNA, 16 bp, Homo sapiens
ggctcagcatcctcca

SEQ ID NO: 2192426 - DNA, 21 bp, Homo sapiens
ggctcagctctggctcacaga

SEQ ID NO: 2192427 - DNA, 15 bp, Homo sapiens
ggctccgctgtgtgg

SEQ ID NO: 2192428 - DNA, 13 bp, Homo sapiens
ggctcctggagcc

SEQ ID NO: 2192429 - DNA, 23 bp, Homo sapiens
ggctcgtggactgagtgggaagc

SEQ ID NO: 2192430 - DNA, 15 bp, Homo sapiens
ggctcgttctcttct

SEQ ID NO: 2192431 - DNA, 23 bp, Homo sapiens
ggctctcctgccctgccctcctg

SEQ ID NO: 2192432 - DNA, 16 bp, Homo sapiens
ggctctgaaagctgct

SEQ ID NO: 2192433 - DNA, 21 bp, Homo sapiens
ggctctgaaagctgcttctgg

SEQ ID NO: 2192434 - DNA, 13 bp, Homo sapiens
ggctctgagaagg

SEQ ID NO: 2192435 - DNA, 12 bp, Homo sapiens
ggctctggctcc

SEQ ID NO: 2192436 - DNA, 23 bp, Homo sapiens
ggctcttgccttatctgttcctt

SEQ ID NO: 2192437 - DNA, 16 bp, Homo sapiens
ggctgcggtgggcagc

SEQ ID NO: 2192438 - DNA, 21 bp, Homo sapiens
ggctggacttttgcagcttcc

SEQ ID NO: 2192439 - DNA, 17 bp, Homo sapiens
ggctggaggcattccca

SEQ ID NO: 2192440 - DNA, 15 bp, Homo sapiens
ggctgggcccagagg

SEQ ID NO: 2192441 - DNA, 15 bp, Homo sapiens
ggctggggacttggc

SEQ ID NO: 2192442 - DNA, 21 bp, Homo sapiens
ggctgggtgcccacagcccgc

SEQ ID NO: 2192443 - DNA, 22 bp, Homo sapiens
ggctgggtgcccacagcccgca

SEQ ID NO: 2192444 - DNA, 19 bp, Homo sapiens
ggctgttttagtgccaggc

SEQ ID NO: 2192445 - DNA, 21 bp, Homo sapiens
ggctgttttagtgccaggctg

SEQ ID NO: 2192446 - DNA, 16 bp, Homo sapiens
ggctgtttttgggtgc

SEQ ID NO: 2192447 - DNA, 18 bp, Homo sapiens
ggcttcagatattttgca

SEQ ID NO: 2192448 - DNA, 14 bp, Homo sapiens
ggcttccctctgct

SEQ ID NO: 2192449 - DNA, 15 bp, Homo sapiens
ggcttccctctgctc

SEQ ID NO: 2192450 - DNA, 15 bp, Homo sapiens
ggctttggtggcccc

SEQ ID NO: 2192451 - DNA, 16 bp, Homo sapiens
ggctttgtcccacagc

SEQ ID NO: 2192452 - DNA, 18 bp, Homo sapiens
ggctttgtcccacagctt

SEQ ID NO: 2192453 - DNA, 14 bp, Homo sapiens
gggaaatggtgcct

SEQ ID NO: 2192454 - DNA, 16 bp, Homo sapiens
gggaagagagcctgcc

SEQ ID NO: 2192455 - DNA, 18 bp, Homo sapiens
gggaagcccatcctgacc

SEQ ID NO: 2192456 - DNA, 13 bp, Homo sapiens
gggaaggacagga

SEQ ID NO: 2192457 - DNA, 18 bp, Homo sapiens
gggaaggccacctgcagg

SEQ ID NO: 2192458 - DNA, 13 bp, Homo sapiens
gggacccctcctc

SEQ ID NO: 2192459 - DNA, 15 bp, Homo sapiens
gggacgcctgtgtca

SEQ ID NO: 2192460 - DNA, 20 bp, Homo sapiens
gggactcaatttctccccag

SEQ ID NO: 2192461 - DNA, 16 bp, Homo sapiens
gggactgatgtcatct

SEQ ID NO: 2192462 - DNA, 24 bp, Homo sapiens
gggacttcaaaatcagtgatggga

SEQ ID NO: 2192463 - DNA, 15 bp, Homo sapiens
gggagacacctcaga

SEQ ID NO: 2192464 - DNA, 17 bp, Homo sapiens
gggagacacctcagagc

SEQ ID NO: 2192465 - DNA, 14 bp, Homo sapiens
gggagaggaagcca

SEQ ID NO: 2192466 - DNA, 17 bp, Homo sapiens
gggagctacagccagcg

SEQ ID NO: 2192467 - DNA, 18 bp, Homo sapiens
ggaagccacgtgctggag

SEQ ID NO: 2192468 - DNA, 14 bp, Homo sapiens
ggaagcccatcctg

SEQ ID NO: 2192469 - DNA, 14 bp, Homo sapiens
ggaagccttgccca

SEQ ID NO: 2192470 - DNA, 17 bp, Homo sapiens
ggaagctagctcccctc

SEQ ID NO: 2192471 - DNA, 19 bp, Homo sapiens
ggaagctagctcccctcct

SEQ ID NO: 2192472 - DNA, 21 bp, Homo sapiens
ggaagctagctcccctcctct

SEQ ID NO: 2192473 - DNA, 13 bp, Homo sapiens
ggaagctcctggt

SEQ ID NO: 2192474 - DNA, 21 bp, Homo sapiens
ggaaggacaggaccctcagga

SEQ ID NO: 2192475 - DNA, 17 bp, Homo sapiens
ggaaggagcctgcggct

SEQ ID NO: 2192476 - DNA, 14 bp, Homo sapiens
ggaaggaggtgcct

SEQ ID NO: 2192477 - DNA, 14 bp, Homo sapiens
ggaaggccacctgc

SEQ ID NO: 2192478 - DNA, 17 bp, Homo sapiens
ggaaggccacctgcagg

SEQ ID NO: 2192479 - DNA, 18 bp, Homo sapiens
ggaaggccacctgcaggt

SEQ ID NO: 2192480 - DNA, 14 bp, Homo sapiens
ggaagttgctgtgc

SEQ ID NO: 2192481 - DNA, 18 bp, Homo sapiens
ggaatcgaggctgtgtgt

SEQ ID NO: 2192482 - DNA, 15 bp, Homo sapiens
ggaattcagtgcctt

SEQ ID NO: 2192483 - DNA, 18 bp, Homo sapiens
ggaattccaatatttata

SEQ ID NO: 2192484 - DNA, 23 bp, Homo sapiens
ggaattccaatatttataattaa

SEQ ID NO: 2192485 - DNA, 17 bp, Homo sapiens
ggacagcggttgtaaat

SEQ ID NO: 2192486 - DNA, 22 bp, Homo sapiens
ggacagcggttgtaaatacaat

SEQ ID NO: 2192487 - DNA, 11 bp, Homo sapiens
ggacagctgca

SEQ ID NO: 2192488 - DNA, 17 bp, Homo sapiens
ggacagctttcctgggt

SEQ ID NO: 2192489 - DNA, 23 bp, Homo sapiens
ggacaggaccctcaggaattcag

SEQ ID NO: 2192490 - DNA, 20 bp, Homo sapiens
ggacaggtctgggagaggca

SEQ ID NO: 2192491 - DNA, 21 bp, Homo sapiens
ggacatgttcccttctccttc

SEQ ID NO: 2192492 - DNA, 22 bp, Homo sapiens
ggacattgttctttccggccaa

SEQ ID NO: 2192493 - DNA, 19 bp, Homo sapiens
ggacatttgggactgtctt

SEQ ID NO: 2192494 - DNA, 13 bp, Homo sapiens
ggaccaaagctga

SEQ ID NO: 2192495 - DNA, 15 bp, Homo sapiens
ggaccaccctgagcc

SEQ ID NO: 2192496 - DNA, 18 bp, Homo sapiens
ggaccaccctgagccggc

SEQ ID NO: 2192497 - DNA, 12 bp, Homo sapiens
ggaccagatgct

SEQ ID NO: 2192498 - DNA, 16 bp, Homo sapiens
ggacccctcctccctt

SEQ ID NO: 2192499 - DNA, 20 bp, Homo sapiens
ggacctaggatatcttctcc

SEQ ID NO: 2192500 - DNA, 18 bp, Homo sapiens
ggacctcagtttctgttg

SEQ ID NO: 2192501 - DNA, 20 bp, Homo sapiens
ggaccttgcgtgaagagcag

SEQ ID NO: 2192502 - DNA, 23 bp, Homo sapiens
ggacttgtgcctcttgggagacg

SEQ ID NO: 2192503 - DNA, 12 bp, Homo sapiens
ggactttgtaca

SEQ ID NO: 2192504 - DNA, 19 bp, Homo sapiens
ggacttttgcagcttcctt

SEQ ID NO: 2192505 - DNA, 22 bp, Homo sapiens
ggagaaagagctgcctggatga

SEQ ID NO: 2192506 - DNA, 21 bp, Homo sapiens
ggagaacagtggttgcctggg

SEQ ID NO: 2192507 - DNA, 22 bp, Homo sapiens
ggagaacagtggttgcctgggg

SEQ ID NO: 2192508 - DNA, 18 bp, Homo sapiens
ggagaacatctgccttgc

SEQ ID NO: 2192509 - DNA, 15 bp, Homo sapiens
ggagaagggacagcg

SEQ ID NO: 2192510 - DNA, 12 bp, Homo sapiens
ggagaagggctt

SEQ ID NO: 2192511 - DNA, 23 bp, Homo sapiens
ggagacaatgcagatgccagagc

SEQ ID NO: 2192512 - DNA, 23 bp, Homo sapiens
ggagacgtccacccgtttccaag

SEQ ID NO: 2192513 - DNA, 21 bp, Homo sapiens
ggagagaatgagagagtgtgg

SEQ ID NO: 2192514 - DNA, 22 bp, Homo sapiens
ggagagaatgagagagtgtgga

SEQ ID NO: 2192515 - DNA, 17 bp, Homo sapiens
ggagagaccagcctttc

SEQ ID NO: 2192516 - DNA, 12 bp, Homo sapiens
ggagaggaagca

SEQ ID NO: 2192517 - DNA, 20 bp, Homo sapiens
ggagaggaagccacgtgctg

SEQ ID NO: 2192518 - DNA, 12 bp, Homo sapiens
ggagaggagaga

SEQ ID NO: 2192519 - DNA, 17 bp, Homo sapiens
ggagaggagagaatgag

SEQ ID NO: 2192520 - DNA, 23 bp, Homo sapiens
ggagagggaaacgtgccctctgt

SEQ ID NO: 2192521 - DNA, 13 bp, Homo sapiens
ggagcaagccttc

SEQ ID NO: 2192522 - DNA, 18 bp, Homo sapiens
ggagcacaaaagcctctc

SEQ ID NO: 2192523 - DNA, 24 bp, Homo sapiens
ggagcaggttccccaagggccctg

SEQ ID NO: 2192524 - DNA, 17 bp, Homo sapiens
ggagcatccacctcctt

SEQ ID NO: 2192525 - DNA, 19 bp, Homo sapiens
ggagcatccacctccttct

SEQ ID NO: 2192526 - DNA, 22 bp, Homo sapiens
ggagcatccacctccttctctg

SEQ ID NO: 2192527 - DNA, 17 bp, Homo sapiens
ggagcattttgtgtctt

SEQ ID NO: 2192528 - DNA, 23 bp, Homo sapiens
ggagcattttgtgtcttaagaaa

SEQ ID NO: 2192529 - DNA, 16 bp, Homo sapiens
ggagccacctgtccca

SEQ ID NO: 2192530 - DNA, 14 bp, Homo sapiens
ggagcctgcggctg

SEQ ID NO: 2192531 - DNA, 20 bp, Homo sapiens
ggagcctgcggctgctggca

SEQ ID NO: 2192532 - DNA, 22 bp, Homo sapiens
ggagcctgcggctgctggcaca

SEQ ID NO: 2192533 - DNA, 22 bp, Homo sapiens
ggagcctgtgcgtcccagctga

SEQ ID NO: 2192534 - DNA, 23 bp, Homo sapiens
ggagctagagaggggcctctggc

SEQ ID NO: 2192535 - DNA, 12 bp, Homo sapiens
ggagctcctggg

SEQ ID NO: 2192536 - DNA, 19 bp, Homo sapiens
ggaggagagagaccccgca

SEQ ID NO: 2192537 - DNA, 16 bp, Homo sapiens
ggaggccgaggcaggg

SEQ ID NO: 2192538 - DNA, 21 bp, Homo sapiens
ggaggccgaggcaggggctgg

SEQ ID NO: 2192539 - DNA, 23 bp, Homo sapiens
ggaggccgaggcaggggctgggc

SEQ ID NO: 2192540 - DNA, 14 bp, Homo sapiens
ggaggcctcaccct

SEQ ID NO: 2192541 - DNA, 21 bp, Homo sapiens
ggaggcctcaccctgcttggg

SEQ ID NO: 2192542 - DNA, 14 bp, Homo sapiens
ggagggtgggaagg

SEQ ID NO: 2192543 - DNA, 21 bp, Homo sapiens
ggaggtctccaggggcctgca

SEQ ID NO: 2192544 - DNA, 22 bp, Homo sapiens
ggaggtctccaggggcctgcag

SEQ ID NO: 2192545 - DNA, 22 bp, Homo sapiens
ggagtgctggaatggggacctg

SEQ ID NO: 2192546 - DNA, 11 bp, Homo sapiens
ggagtggaggc

SEQ ID NO: 2192547 - DNA, 17 bp, Homo sapiens
ggagtgggagaggaagc

SEQ ID NO: 2192548 - DNA, 23 bp, Homo sapiens
ggagtgtgtgggggtctgggagg

SEQ ID NO: 2192549 - DNA, 15 bp, Homo sapiens
ggataaaaagatgtt

SEQ ID NO: 2192550 - DNA, 15 bp, Homo sapiens
ggatctgcccctccc

SEQ ID NO: 2192551 - DNA, 17 bp, Homo sapiens
ggatgagaaacagctca

SEQ ID NO: 2192552 - DNA, 21 bp, Homo sapiens
ggatgcggatcctgctggggc

SEQ ID NO: 2192553 - DNA, 20 bp, Homo sapiens
ggatgggggaaatggtgcct

SEQ ID NO: 2192554 - DNA, 17 bp, Homo sapiens
ggatgggggtgcaggca

SEQ ID NO: 2192555 - DNA, 20 bp, Homo sapiens
ggattcataatcacaaatat

SEQ ID NO: 2192556 - DNA, 21 bp, Homo sapiens
ggattctggcctagtcccttc

SEQ ID NO: 2192557 - DNA, 19 bp, Homo sapiens
ggattgaaaatgtccagga

SEQ ID NO: 2192558 - DNA, 20 bp, Homo sapiens
ggatttcactgtgttagcca

SEQ ID NO: 2192559 - DNA, 16 bp, Homo sapiens
ggcaactattaataat

SEQ ID NO: 2192560 - DNA, 15 bp, Homo sapiens
ggcaagctggcagga

SEQ ID NO: 2192561 - DNA, 18 bp, Homo sapiens
ggcaaggctgccggctgc

SEQ ID NO: 2192562 - DNA, 15 bp, Homo sapiens
ggcaaggggtgcctg

SEQ ID NO: 2192563 - DNA, 20 bp, Homo sapiens
ggcaataaatggctcgtggg

SEQ ID NO: 2192564 - DNA, 19 bp, Homo sapiens
ggcaatgactgcgcagagt

SEQ ID NO: 2192565 - DNA, 16 bp, Homo sapiens
ggcaattcttcttctc

SEQ ID NO: 2192566 - DNA, 16 bp, Homo sapiens
ggcaccaagcccacag

SEQ ID NO: 2192567 - DNA, 13 bp, Homo sapiens
ggcaccacctctg

SEQ ID NO: 2192568 - DNA, 13 bp, Homo sapiens
ggcaccagcagca

SEQ ID NO: 2192569 - DNA, 18 bp, Homo sapiens
ggcaccagccggggaaga

SEQ ID NO: 2192570 - DNA, 14 bp, Homo sapiens
ggcaccaggaagcc

SEQ ID NO: 2192571 - DNA, 19 bp, Homo sapiens
ggcaccattcaggaacctg

SEQ ID NO: 2192572 - DNA, 22 bp, Homo sapiens
ggcacccactccggattccggc

SEQ ID NO: 2192573 - DNA, 20 bp, Homo sapiens
ggcacctctaatcagacctt

SEQ ID NO: 2192574 - DNA, 14 bp, Homo sapiens
ggcacctctgtgct

SEQ ID NO: 2192575 - DNA, 23 bp, Homo sapiens
ggcactgcacataatttgcataa

SEQ ID NO: 2192576 - DNA, 22 bp, Homo sapiens
ggcactgctttatccaggggct

SEQ ID NO: 2192577 - DNA, 22 bp, Homo sapiens
ggcacttcgtggatgacctcct

SEQ ID NO: 2192578 - DNA, 23 bp, Homo sapiens
ggcagaaatcccagttcatgttg

SEQ ID NO: 2192579 - DNA, 14 bp, Homo sapiens
ggcagaaccctggt

SEQ ID NO: 2192580 - DNA, 13 bp, Homo sapiens
ggcagaggggaga

SEQ ID NO: 2192581 - DNA, 15 bp, Homo sapiens
ggcagaggggagagg

SEQ ID NO: 2192582 - DNA, 16 bp, Homo sapiens
ggcagagtgccccacc

SEQ ID NO: 2192583 - DNA, 21 bp, Homo sapiens
ggcagagtgccccacctgcca

SEQ ID NO: 2192584 - DNA, 11 bp, Homo sapiens
ggcagcagccg

SEQ ID NO: 2192585 - DNA, 17 bp, Homo sapiens
ggcagccattggcctct

SEQ ID NO: 2192586 - DNA, 22 bp, Homo sapiens
ggcagcctcaacctccctggct

SEQ ID NO: 2192587 - DNA, 14 bp, Homo sapiens
ggcagcctgtggga

SEQ ID NO: 2192588 - DNA, 16 bp, Homo sapiens
ggcagcctgtgggaga

SEQ ID NO: 2192589 - DNA, 17 bp, Homo sapiens
ggcagcctgtgggagaa

SEQ ID NO: 2192590 - DNA, 21 bp, Homo sapiens
ctgagaaggggaggacctctg

SEQ ID NO: 2192591 - DNA, 20 bp, Homo sapiens
ctgagactacaggtgagtgc

SEQ ID NO: 2192592 - DNA, 13 bp, Homo sapiens
ctgagattacagg

SEQ ID NO: 2192593 - DNA, 17 bp, Homo sapiens
ctgagcacacaacaggc

SEQ ID NO: 2192594 - DNA, 14 bp, Homo sapiens
ctgagcggccgcct

SEQ ID NO: 2192595 - DNA, 21 bp, Homo sapiens
ctgagcggccgcctgtccttg

SEQ ID NO: 2192596 - DNA, 19 bp, Homo sapiens
ctgagctagtgtcacctgc

SEQ ID NO: 2192597 - DNA, 13 bp, Homo sapiens
ctgagctggccta

SEQ ID NO: 2192598 - DNA, 22 bp, Homo sapiens
ctgagctttggacacacacagc

SEQ ID NO: 2192599 - DNA, 21 bp, Homo sapiens
ctgagctttggacgcacacag

SEQ ID NO: 2192600 - DNA, 16 bp, Homo sapiens
ctgaggaaacaaaaag

SEQ ID NO: 2192601 - DNA, 20 bp, Homo sapiens
ctgaggcagaacctggtggc

SEQ ID NO: 2192602 - DNA, 21 bp, Homo sapiens
ctgaggcagaacctggtggct

SEQ ID NO: 2192603 - DNA, 22 bp, Homo sapiens
ctgaggcagaacctggtggctg

SEQ ID NO: 2192604 - DNA, 17 bp, Homo sapiens
ctgaggcccagcagagc

SEQ ID NO: 2192605 - DNA, 14 bp, Homo sapiens
ctgaggctcagccc

SEQ ID NO: 2192606 - DNA, 20 bp, Homo sapiens
ctgaggctcagccctgagct

SEQ ID NO: 2192607 - DNA, 16 bp, Homo sapiens
ctgaggtatctgtgtt

SEQ ID NO: 2192608 - DNA, 18 bp, Homo sapiens
ctgaggtatctgtgttac

SEQ ID NO: 2192609 - DNA, 17 bp, Homo sapiens
ctgagtagcagaaaaca

SEQ ID NO: 2192610 - DNA, 12 bp, Homo sapiens
ctgagtgaagca

SEQ ID NO: 2192611 - DNA, 16 bp, Homo sapiens
ctgagtgaatactttg

SEQ ID NO: 2192612 - DNA, 17 bp, Homo sapiens
ctgagtgggaagcccat

SEQ ID NO: 2192613 - DNA, 21 bp, Homo sapiens
ctgagttggcgttgtgggcag

SEQ ID NO: 2192614 - DNA, 22 bp, Homo sapiens
ctgagttggcgttgtgggcagg

SEQ ID NO: 2192615 - DNA, 20 bp, Homo sapiens
ctgatattggtgtgaatgct

SEQ ID NO: 2192616 - DNA, 19 bp, Homo sapiens
ctgatcatttgcagctgct

SEQ ID NO: 2192617 - DNA, 21 bp, Homo sapiens
ctgatcatttgcagctgctgg

SEQ ID NO: 2192618 - DNA, 15 bp, Homo sapiens
ctgatcccactccta

SEQ ID NO: 2192619 - DNA, 16 bp, Homo sapiens
ctgatcccactcctag

SEQ ID NO: 2192620 - DNA, 14 bp, Homo sapiens
ctgatctttgcaaa

SEQ ID NO: 2192621 - DNA, 11 bp, Homo sapiens
ctgatgtcatc

SEQ ID NO: 2192622 - DNA, 14 bp, Homo sapiens
ctgatgtcatcttg

SEQ ID NO: 2192623 - DNA, 15 bp, Homo sapiens
ctgatgtcttagtga

SEQ ID NO: 2192624 - DNA, 15 bp, Homo sapiens
ctgatgttaggctgg

SEQ ID NO: 2192625 - DNA, 21 bp, Homo sapiens
ctgattcaataaaatgcactg

SEQ ID NO: 2192626 - DNA, 22 bp, Homo sapiens
ctgattcaataaaatgcactga

SEQ ID NO: 2192627 - DNA, 21 bp, Homo sapiens
ctgatttacaagactaacctt

SEQ ID NO: 2192628 - DNA, 20 bp, Homo sapiens
ctgatttggccgttttgtga

SEQ ID NO: 2192629 - DNA, 17 bp, Homo sapiens
ctgattttttttttaac

SEQ ID NO: 2192630 - DNA, 17 bp, Homo sapiens
ctgcaaataaagccttt

SEQ ID NO: 2192631 - DNA, 21 bp, Homo sapiens
ctgcaacctccacctcccagg

SEQ ID NO: 2192632 - DNA, 22 bp, Homo sapiens
ctgcaacctccacctcccaggt

SEQ ID NO: 2192633 - DNA, 18 bp, Homo sapiens
ctgcacaatgcattgaac

SEQ ID NO: 2192634 - DNA, 16 bp, Homo sapiens
ctgcacacggcacaga

SEQ ID NO: 2192635 - DNA, 18 bp, Homo sapiens
ctgcacagacaagcagcc

SEQ ID NO: 2192636 - DNA, 22 bp, Homo sapiens
ctgcacagacaagcagcccttg

SEQ ID NO: 2192637 - DNA, 17 bp, Homo sapiens
ctgcacataatttgcat

SEQ ID NO: 2192638 - DNA, 22 bp, Homo sapiens
ctgcacataatttgcataaagg

SEQ ID NO: 2192639 - DNA, 19 bp, Homo sapiens
ctgcaccctgtatggagct

SEQ ID NO: 2192640 - DNA, 14 bp, Homo sapiens
ctgcacctgaggcc

SEQ ID NO: 2192641 - DNA, 12 bp, Homo sapiens
ctgcagagctgg

SEQ ID NO: 2192642 - DNA, 13 bp, Homo sapiens
ctgcagagctggg

SEQ ID NO: 2192643 - DNA, 16 bp, Homo sapiens
ctgcagggcagcctgt

SEQ ID NO: 2192644 - DNA, 20 bp, Homo sapiens
ctgcagggcagcctgtggga

SEQ ID NO: 2192645 - DNA, 23 bp, Homo sapiens
ctgcagggcagcctgtgggagaa

SEQ ID NO: 2192646 - DNA, 15 bp, Homo sapiens
ctgcagggccatctg

SEQ ID NO: 2192647 - DNA, 22 bp, Homo sapiens
ctgcagggccatctgactgcca

SEQ ID NO: 2192648 - DNA, 23 bp, Homo sapiens
ctgcagggccatctgactgccaa

SEQ ID NO: 2192649 - DNA, 16 bp, Homo sapiens
ctgcagtcacccctgt

SEQ ID NO: 2192650 - DNA, 20 bp, Homo sapiens
ctgcagtcacccctgtctgc

SEQ ID NO: 2192651 - DNA, 22 bp, Homo sapiens
ctgcagtcacttcgtgggatct

SEQ ID NO: 2192652 - DNA, 16 bp, Homo sapiens
ctgcagtgcctggaaa

SEQ ID NO: 2192653 - DNA, 17 bp, Homo sapiens
ctgcatcagcctctggc

SEQ ID NO: 2192654 - DNA, 18 bp, Homo sapiens
ctgcatcagcctctggcc

SEQ ID NO: 2192655 - DNA, 19 bp, Homo sapiens
ctgcatcagcctctggcca

SEQ ID NO: 2192656 - DNA, 15 bp, Homo sapiens
ctgcatgcagaaagg

SEQ ID NO: 2192657 - DNA, 15 bp, Homo sapiens
ctgccaacttttagt

SEQ ID NO: 2192658 - DNA, 17 bp, Homo sapiens
ctgccaagccagattct

SEQ ID NO: 2192659 - DNA, 22 bp, Homo sapiens
ctgccactaggctgggtgccca

SEQ ID NO: 2192660 - DNA, 13 bp, Homo sapiens
ctgccagaagtgt

SEQ ID NO: 2192661 - DNA, 21 bp, Homo sapiens
ctgccagaagtgtgttttggt

SEQ ID NO: 2192662 - DNA, 20 bp, Homo sapiens
ctgccataaaatctcacgct

SEQ ID NO: 2192663 - DNA, 21 bp, Homo sapiens
ctgccataaaatctcacgctg

SEQ ID NO: 2192664 - DNA, 18 bp, Homo sapiens
ctgccatgattttggcca

SEQ ID NO: 2192665 - DNA, 19 bp, Homo sapiens
ctgccatgattttggccac

SEQ ID NO: 2192666 - DNA, 16 bp, Homo sapiens
ctgccatttccctgaa

SEQ ID NO: 2192667 - DNA, 19 bp, Homo sapiens
ctgcccaccctcctgtacc

SEQ ID NO: 2192668 - DNA, 17 bp, Homo sapiens
ctgcccagagctgggtg

SEQ ID NO: 2192669 - DNA, 17 bp, Homo sapiens
ctgcccccactcagcat

SEQ ID NO: 2192670 - DNA, 21 bp, Homo sapiens
ctgcccccagctgctcctcgc

SEQ ID NO: 2192671 - DNA, 24 bp, Homo sapiens
ctgcccccagctgctcctcgcagt

SEQ ID NO: 2192672 - DNA, 15 bp, Homo sapiens
ctgccccccctaaga

SEQ ID NO: 2192673 - DNA, 23 bp, Homo sapiens
ctgccccctccccttcacaccat

SEQ ID NO: 2192674 - DNA, 19 bp, Homo sapiens
ctgccccgtagagaatgtg

SEQ ID NO: 2192675 - DNA, 17 bp, Homo sapiens
ctgcccgccctccctcc

SEQ ID NO: 2192676 - DNA, 20 bp, Homo sapiens
ctgccctctatttattagcc

SEQ ID NO: 2192677 - DNA, 13 bp, Homo sapiens
ctgccctctctca

SEQ ID NO: 2192678 - DNA, 22 bp, Homo sapiens
ctgccctctctcagttattcag

SEQ ID NO: 2192679 - DNA, 18 bp, Homo sapiens
ctgccctgccctcctgcc

SEQ ID NO: 2192680 - DNA, 15 bp, Homo sapiens
ctgccgtgagagccc

SEQ ID NO: 2192681 - DNA, 22 bp, Homo sapiens
ctgccgtgagagcccaatcact

SEQ ID NO: 2192682 - DNA, 15 bp, Homo sapiens
ctgcctaagaggcaa

SEQ ID NO: 2192683 - DNA, 23 bp, Homo sapiens
ctgcctagcactcacatgctgga

SEQ ID NO: 2192684 - DNA, 15 bp, Homo sapiens
ctgcctcagcctccc

SEQ ID NO: 2192685 - DNA, 21 bp, Homo sapiens
ctgcctcccttgtggcagcaa

SEQ ID NO: 2192686 - DNA, 20 bp, Homo sapiens
ctgcctctgtttgacaaacc

SEQ ID NO: 2192687 - DNA, 11 bp, Homo sapiens
ctgcctggccc

SEQ ID NO: 2192688 - DNA, 12 bp, Homo sapiens
ctgcctggccca

SEQ ID NO: 2192689 - DNA, 13 bp, Homo sapiens
ctgcctggcccag

SEQ ID NO: 2192690 - DNA, 18 bp, Homo sapiens
ctgccttccttagcagct

SEQ ID NO: 2192691 - DNA, 12 bp, Homo sapiens
ctgccttccttg

SEQ ID NO: 2192692 - DNA, 14 bp, Homo sapiens
ctgccttccttgct

SEQ ID NO: 2192693 - DNA, 15 bp, Homo sapiens
ctgccttccttgcta

SEQ ID NO: 2192694 - DNA, 16 bp, Homo sapiens
ctgcgaactctcagga

SEQ ID NO: 2192695 - DNA, 16 bp, Homo sapiens
ctgcgagggccggtgc

SEQ ID NO: 2192696 - DNA, 18 bp, Homo sapiens
ctgcgcagctccttccct

SEQ ID NO: 2192697 - DNA, 13 bp, Homo sapiens
ctgcggctgctgg

SEQ ID NO: 2192698 - DNA, 14 bp, Homo sapiens
ctgcggctgctggc

SEQ ID NO: 2192699 - DNA, 14 bp, Homo sapiens
ctgcggtgggcagc

SEQ ID NO: 2192700 - DNA, 23 bp, Homo sapiens
ctgcgtcatggctcaaggattca

SEQ ID NO: 2192701 - DNA, 18 bp, Homo sapiens
ctgctaaatactgtacat

SEQ ID NO: 2192702 - DNA, 21 bp, Homo sapiens
ctgctaaatactgtacataga

SEQ ID NO: 2192703 - DNA, 13 bp, Homo sapiens
ctgctacctgttc

SEQ ID NO: 2192704 - DNA, 13 bp, Homo sapiens
ctgctatttccca

SEQ ID NO: 2192705 - DNA, 15 bp, Homo sapiens
ctgctcagctggccg

SEQ ID NO: 2192706 - DNA, 19 bp, Homo sapiens
ctgctccacagccatccca

SEQ ID NO: 2192707 - DNA, 17 bp, Homo sapiens
ctgctcccagatgcctt

SEQ ID NO: 2192708 - DNA, 19 bp, Homo sapiens
ctgctcccagatgccttct

SEQ ID NO: 2192709 - DNA, 13 bp, Homo sapiens
ctgctcctccctc

SEQ ID NO: 2192710 - DNA, 13 bp, Homo sapiens
ctgctcctcgcag

SEQ ID NO: 2192711 - DNA, 14 bp, Homo sapiens
ctgctcctcgcagt

SEQ ID NO: 2192712 - DNA, 15 bp, Homo sapiens
ctgctctcaaaatgt

SEQ ID NO: 2192713 - DNA, 11 bp, Homo sapiens
ctgctctgccc

SEQ ID NO: 2192714 - DNA, 20 bp, Homo sapiens
ctaggtcaattttttttctg

SEQ ID NO: 2192715 - DNA, 21 bp, Homo sapiens
ctaggtcaattttttttctga

SEQ ID NO: 2192716 - DNA, 18 bp, Homo sapiens
ctagtctgtgtgctgtgg

SEQ ID NO: 2192717 - DNA, 17 bp, Homo sapiens
ctagtgatttctggggc

SEQ ID NO: 2192718 - DNA, 12 bp, Homo sapiens
ctagtggtggct

SEQ ID NO: 2192719 - DNA, 14 bp, Homo sapiens
ctagtgtcacctgc

SEQ ID NO: 2192720 - DNA, 24 bp, Homo sapiens
ctagttccctcagtgtgaagcctg

SEQ ID NO: 2192721 - DNA, 19 bp, Homo sapiens
ctataggtcatacaatcca

SEQ ID NO: 2192722 - DNA, 16 bp, Homo sapiens
ctatcacctgtcatca

SEQ ID NO: 2192723 - DNA, 14 bp, Homo sapiens
ctatccccaagctg

SEQ ID NO: 2192724 - DNA, 12 bp, Homo sapiens
ctatcctggctt

SEQ ID NO: 2192725 - DNA, 22 bp, Homo sapiens
ctatcctggctttgcccaacct

SEQ ID NO: 2192726 - DNA, 21 bp, Homo sapiens
ctatctaatttttattaattt

SEQ ID NO: 2192727 - DNA, 20 bp, Homo sapiens
ctatgaaagctatgaatgtt

SEQ ID NO: 2192728 - DNA, 19 bp, Homo sapiens
ctatgcacctataaatact

SEQ ID NO: 2192729 - DNA, 16 bp, Homo sapiens
ctatgccacctgcagc

SEQ ID NO: 2192730 - DNA, 15 bp, Homo sapiens
ctatggtgccaatgg

SEQ ID NO: 2192731 - DNA, 15 bp, Homo sapiens
ctatttcccaagctg

SEQ ID NO: 2192732 - DNA, 18 bp, Homo sapiens
ctatttttttgttgctgt

SEQ ID NO: 2192733 - DNA, 22 bp, Homo sapiens
ctcaaaataagccatgctgctt

SEQ ID NO: 2192734 - DNA, 15 bp, Homo sapiens
ctcaaaccctgttta

SEQ ID NO: 2192735 - DNA, 19 bp, Homo sapiens
ctcaaagtttttacagtgt

SEQ ID NO: 2192736 - DNA, 16 bp, Homo sapiens
ctcaagaactgccata

SEQ ID NO: 2192737 - DNA, 21 bp, Homo sapiens
ctcaagcaatcctcctgagtg

SEQ ID NO: 2192738 - DNA, 14 bp, Homo sapiens
ctcaataagccttg

SEQ ID NO: 2192739 - DNA, 23 bp, Homo sapiens
ctcaattattttgcattttttct

SEQ ID NO: 2192740 - DNA, 13 bp, Homo sapiens
ctcaatttctccc

SEQ ID NO: 2192741 - DNA, 16 bp, Homo sapiens
ctcaatttctccccag

SEQ ID NO: 2192742 - DNA, 23 bp, Homo sapiens
ctcacagactggagacaatgcag

SEQ ID NO: 2192743 - DNA, 15 bp, Homo sapiens
ctcacatgctggaca

SEQ ID NO: 2192744 - DNA, 13 bp, Homo sapiens
ctcacccaaaaga

SEQ ID NO: 2192745 - DNA, 13 bp, Homo sapiens
ctcaccctgcttg

SEQ ID NO: 2192746 - DNA, 14 bp, Homo sapiens
ctcaccctgcttgg

SEQ ID NO: 2192747 - DNA, 20 bp, Homo sapiens
ctcaccttgaacaccacgct

SEQ ID NO: 2192748 - DNA, 20 bp, Homo sapiens
ctcacctttcccacagtctc

SEQ ID NO: 2192749 - DNA, 20 bp, Homo sapiens
ctcacgctcccaacacaagg

SEQ ID NO: 2192750 - DNA, 15 bp, Homo sapiens
ctcacggcagcctca

SEQ ID NO: 2192751 - DNA, 17 bp, Homo sapiens
ctcactatggtgccaat

SEQ ID NO: 2192752 - DNA, 23 bp, Homo sapiens
ctcactatggtgccaatggaacc

SEQ ID NO: 2192753 - DNA, 16 bp, Homo sapiens
ctcactgcagcctcga

SEQ ID NO: 2192754 - DNA, 14 bp, Homo sapiens
ctcagagccccgca

SEQ ID NO: 2192755 - DNA, 19 bp, Homo sapiens
ctcagagctacttgggcca

SEQ ID NO: 2192756 - DNA, 11 bp, Homo sapiens
ctcagccccag

SEQ ID NO: 2192757 - DNA, 15 bp, Homo sapiens
ctcagccccagccca

SEQ ID NO: 2192758 - DNA, 18 bp, Homo sapiens
ctcagccccagcccagcc

SEQ ID NO: 2192759 - DNA, 13 bp, Homo sapiens
ctcagccctgagc

SEQ ID NO: 2192760 - DNA, 23 bp, Homo sapiens
ctcagcctcctgagtagctgaga

SEQ ID NO: 2192761 - DNA, 18 bp, Homo sapiens
ctcagctattaagaaaat

SEQ ID NO: 2192762 - DNA, 21 bp, Homo sapiens
ctcagctcactgcaacctcca

SEQ ID NO: 2192763 - DNA, 14 bp, Homo sapiens
ctcagctctggctc

SEQ ID NO: 2192764 - DNA, 15 bp, Homo sapiens
ctcagctctggctca

SEQ ID NO: 2192765 - DNA, 19 bp, Homo sapiens
ctcagctctggctcacaga

SEQ ID NO: 2192766 - DNA, 13 bp, Homo sapiens
ctcagctggccgg

SEQ ID NO: 2192767 - DNA, 13 bp, Homo sapiens
ctcagctggcgga

SEQ ID NO: 2192768 - DNA, 19 bp, Homo sapiens
ctcagctggcggaacctgg

SEQ ID NO: 2192769 - DNA, 21 bp, Homo sapiens
ctcagctggcggaacctggct

SEQ ID NO: 2192770 - DNA, 23 bp, Homo sapiens
ctcagctggcggaacctggctgc

SEQ ID NO: 2192771 - DNA, 21 bp, Homo sapiens
ctcaggaattcagtgccttca

SEQ ID NO: 2192772 - DNA, 18 bp, Homo sapiens
ctcaggcaattccttttg

SEQ ID NO: 2192773 - DNA, 21 bp, Homo sapiens
ctcaggccaaagacctcccaa

SEQ ID NO: 2192774 - DNA, 20 bp, Homo sapiens
ctcaggctgtttttgggtgc

SEQ ID NO: 2192775 - DNA, 18 bp, Homo sapiens
ctcagtctgctttctcta

SEQ ID NO: 2192776 - DNA, 22 bp, Homo sapiens
ctcagtctgtcacccaggctgg

SEQ ID NO: 2192777 - DNA, 18 bp, Homo sapiens
ctcagtgtgaagcctgtc

SEQ ID NO: 2192778 - DNA, 19 bp, Homo sapiens
ctcagtgtgaagcctgtcg

SEQ ID NO: 2192779 - DNA, 21 bp, Homo sapiens
ctcagtttggctgtaatttaa

SEQ ID NO: 2192780 - DNA, 13 bp, Homo sapiens
ctcatactgtgct

SEQ ID NO: 2192781 - DNA, 10 bp, Homo sapiens
ctcatcacta

SEQ ID NO: 2192782 - DNA, 19 bp, Homo sapiens
ctcatccattaatgtagat

SEQ ID NO: 2192783 - DNA, 17 bp, Homo sapiens
ctcatcgttctaaaatc

SEQ ID NO: 2192784 - DNA, 12 bp, Homo sapiens
ctcatgggcccc

SEQ ID NO: 2192785 - DNA, 16 bp, Homo sapiens
ctcatgggcccctctg

SEQ ID NO: 2192786 - DNA, 20 bp, Homo sapiens
ctcatgggcccctctgactc

SEQ ID NO: 2192787 - DNA, 17 bp, Homo sapiens
ctcattctctttctttt

SEQ ID NO: 2192788 - DNA, 17 bp, Homo sapiens
ctcatttatttccatat

SEQ ID NO: 2192789 - DNA, 21 bp, Homo sapiens
ctcattttgtatgtatgtgta

SEQ ID NO: 2192790 - DNA, 23 bp, Homo sapiens
ctccaaagaggtgactgggccct

SEQ ID NO: 2192791 - DNA, 14 bp, Homo sapiens
ctccacaagagaga

SEQ ID NO: 2192792 - DNA, 20 bp, Homo sapiens
ctccacaagagagatgatac

SEQ ID NO: 2192793 - DNA, 17 bp, Homo sapiens
ctccacagaaaccctgt

SEQ ID NO: 2192794 - DNA, 18 bp, Homo sapiens
ctccacagaaaccctgtt

SEQ ID NO: 2192795 - DNA, 23 bp, Homo sapiens
ctccacagccatcccagccttgg

SEQ ID NO: 2192796 - DNA, 18 bp, Homo sapiens
ctccaccccactcacaga

SEQ ID NO: 2192797 - DNA, 20 bp, Homo sapiens
ctccaccccactcacagaga

SEQ ID NO: 2192798 - DNA, 16 bp, Homo sapiens
ctccacgggctgcgcc

SEQ ID NO: 2192799 - DNA, 15 bp, Homo sapiens
ctccactgccctctg

SEQ ID NO: 2192800 - DNA, 15 bp, Homo sapiens
ctccaggaaggggct

SEQ ID NO: 2192801 - DNA, 16 bp, Homo sapiens
ctccaggaaggggctg

SEQ ID NO: 2192802 - DNA, 17 bp, Homo sapiens
ctccaggggcctgcaga

SEQ ID NO: 2192803 - DNA, 13 bp, Homo sapiens
ctccatggcccat

SEQ ID NO: 2192804 - DNA, 16 bp, Homo sapiens
ctccatggtgcctctg

SEQ ID NO: 2192805 - DNA, 13 bp, Homo sapiens
ctcccaaaatact

SEQ ID NO: 2192806 - DNA, 17 bp, Homo sapiens
ctcccaaagagctgcct

SEQ ID NO: 2192807 - DNA, 20 bp, Homo sapiens
ctcccaagctgtatgtactt

SEQ ID NO: 2192808 - DNA, 18 bp, Homo sapiens
ctcccagaggctcctgga

SEQ ID NO: 2192809 - DNA, 21 bp, Homo sapiens
ctcccagaggctcctggagcc

SEQ ID NO: 2192810 - DNA, 17 bp, Homo sapiens
ctcccagctctaaaatt

SEQ ID NO: 2192811 - DNA, 21 bp, Homo sapiens
ctcccagttctctagggaagg

SEQ ID NO: 2192812 - DNA, 21 bp, Homo sapiens
ctccccaaattgccctgttgc

SEQ ID NO: 2192813 - DNA, 13 bp, Homo sapiens
ctcccctctgctg

SEQ ID NO: 2192814 - DNA, 13 bp, Homo sapiens
ctcccgtcttcct

SEQ ID NO: 2192815 - DNA, 15 bp, Homo sapiens
ctccctacttccaag

SEQ ID NO: 2192816 - DNA, 17 bp, Homo sapiens
ctccctataatgctgga

SEQ ID NO: 2192817 - DNA, 17 bp, Homo sapiens
ctccctcaattccccct

SEQ ID NO: 2192818 - DNA, 15 bp, Homo sapiens
ctccctccctgcagg

SEQ ID NO: 2192819 - DNA, 15 bp, Homo sapiens
ctccctcctgcctgc

SEQ ID NO: 2192820 - DNA, 17 bp, Homo sapiens
ctccctctcctctgtcc

SEQ ID NO: 2192821 - DNA, 12 bp, Homo sapiens
ctccctgctcag

SEQ ID NO: 2192822 - DNA, 14 bp, Homo sapiens
ctccctgtccaccc

SEQ ID NO: 2192823 - DNA, 18 bp, Homo sapiens
ctcccttcaatcctgtca

SEQ ID NO: 2192824 - DNA, 20 bp, Homo sapiens
ctccctttttccttgtcccc

SEQ ID NO: 2192825 - DNA, 21 bp, Homo sapiens
ctccctttttccttgtcccca

SEQ ID NO: 2192826 - DNA, 17 bp, Homo sapiens
ctccgaggacccaggaa

SEQ ID NO: 2192827 - DNA, 18 bp, Homo sapiens
ctccgctgtgtggatggg

SEQ ID NO: 2192828 - DNA, 22 bp, Homo sapiens
ctccggattccggccctggctg

SEQ ID NO: 2192829 - DNA, 16 bp, Homo sapiens
ctcctacacctaactc

SEQ ID NO: 2192830 - DNA, 19 bp, Homo sapiens
ctcctaggacatgttccct

SEQ ID NO: 2192831 - DNA, 14 bp, Homo sapiens
ctcctcagcttggg

SEQ ID NO: 2192832 - DNA, 13 bp, Homo sapiens
ctcctcctccagt

SEQ ID NO: 2192833 - DNA, 17 bp, Homo sapiens
ctcctctaacaggggct

SEQ ID NO: 2192834 - DNA, 13 bp, Homo sapiens
ctcctctctgctg

SEQ ID NO: 2192835 - DNA, 22 bp, Homo sapiens
ctcctctgtccccatagctggt

SEQ ID NO: 2192836 - DNA, 11 bp, Homo sapiens
ctcctcttgta

SEQ ID NO: 2192837 - DNA, 15 bp, Homo sapiens
ctcctcttgtagcca

SEQ ID NO: 2192838 - DNA, 16 bp, Homo sapiens
ctcctgattgctctgg

SEQ ID NO: 2192839 - DNA, 20 bp, Homo sapiens
cgctgttgcaaattccaccc

SEQ ID NO: 2192840 - DNA, 10 bp, Homo sapiens
cgctttctcc

SEQ ID NO: 2192841 - DNA, 17 bp, Homo sapiens
cgctttgaaagaagcaa

SEQ ID NO: 2192842 - DNA, 14 bp, Homo sapiens
cggaacctggctgc

SEQ ID NO: 2192843 - DNA, 14 bp, Homo sapiens
cggaagctcctggt

SEQ ID NO: 2192844 - DNA, 15 bp, Homo sapiens
cggaagctcctggta

SEQ ID NO: 2192845 - DNA, 16 bp, Homo sapiens
cggaattccaatattt

SEQ ID NO: 2192846 - DNA, 21 bp, Homo sapiens
cggagaacatctgccttgctg

SEQ ID NO: 2192847 - DNA, 13 bp, Homo sapiens
cggaggaggtgga

SEQ ID NO: 2192848 - DNA, 18 bp, Homo sapiens
cggaggggatccagccac

SEQ ID NO: 2192849 - DNA, 19 bp, Homo sapiens
cggaggggatccagccact

SEQ ID NO: 2192850 - DNA, 12 bp, Homo sapiens
cggatcctgctg

SEQ ID NO: 2192851 - DNA, 22 bp, Homo sapiens
cggcaccaaaccctgtcctccc

SEQ ID NO: 2192852 - DNA, 14 bp, Homo sapiens
cggcagcgggcgga

SEQ ID NO: 2192853 - DNA, 17 bp, Homo sapiens
cggccaaggtgccacca

SEQ ID NO: 2192854 - DNA, 11 bp, Homo sapiens
cggccactgca

SEQ ID NO: 2192855 - DNA, 16 bp, Homo sapiens
cggcctggctggtggg

SEQ ID NO: 2192856 - DNA, 14 bp, Homo sapiens
cggctcgtgtattt

SEQ ID NO: 2192857 - DNA, 19 bp, Homo sapiens
cggctgcaccctgtatgga

SEQ ID NO: 2192858 - DNA, 13 bp, Homo sapiens
cggctgctggcac

SEQ ID NO: 2192859 - DNA, 22 bp, Homo sapiens
cgggaggaatcttttactgtgg

SEQ ID NO: 2192860 - DNA, 23 bp, Homo sapiens
cgggaggccacgggggaggccga

SEQ ID NO: 2192861 - DNA, 21 bp, Homo sapiens
cgggagtggccatctggaaat

SEQ ID NO: 2192862 - DNA, 16 bp, Homo sapiens
cgggatggttctggct

SEQ ID NO: 2192863 - DNA, 14 bp, Homo sapiens
cgggcacagctgtg

SEQ ID NO: 2192864 - DNA, 18 bp, Homo sapiens
cgggcacagctgtggtga

SEQ ID NO: 2192865 - DNA, 21 bp, Homo sapiens
cgggcggaggggatccagcca

SEQ ID NO: 2192866 - DNA, 14 bp, Homo sapiens
cgggctcagctctg

SEQ ID NO: 2192867 - DNA, 11 bp, Homo sapiens
cggggcttcac

SEQ ID NO: 2192868 - DNA, 12 bp, Homo sapiens
cggggcttcacc

SEQ ID NO: 2192869 - DNA, 21 bp, Homo sapiens
cggtcaataattgtggagagg

SEQ ID NO: 2192870 - DNA, 22 bp, Homo sapiens
cggtcaataattgtggagagga

SEQ ID NO: 2192871 - DNA, 11 bp, Homo sapiens
cggtcctgtct

SEQ ID NO: 2192872 - DNA, 15 bp, Homo sapiens
cggtcctgtctcccc

SEQ ID NO: 2192873 - DNA, 23 bp, Homo sapiens
cggtgcttccctttcactgaagt

SEQ ID NO: 2192874 - DNA, 17 bp, Homo sapiens
cggtggaaggagcctgc

SEQ ID NO: 2192875 - DNA, 20 bp, Homo sapiens
cggtggctcacgcctgtaat

SEQ ID NO: 2192876 - DNA, 14 bp, Homo sapiens
cggtgggcagccat

SEQ ID NO: 2192877 - DNA, 21 bp, Homo sapiens
cggttaattggttaatcactt

SEQ ID NO: 2192878 - DNA, 20 bp, Homo sapiens
cggttgtggtgaagtttgtc

SEQ ID NO: 2192879 - DNA, 19 bp, Homo sapiens
catctgactgccaagccag

SEQ ID NO: 2192880 - DNA, 20 bp, Homo sapiens
catctgactgccaagccaga

SEQ ID NO: 2192881 - DNA, 15 bp, Homo sapiens
catctgccttgctgc

SEQ ID NO: 2192882 - DNA, 13 bp, Homo sapiens
catcttgcctcca

SEQ ID NO: 2192883 - DNA, 20 bp, Homo sapiens
catctttccaaattgatggg

SEQ ID NO: 2192884 - DNA, 17 bp, Homo sapiens
catgaagctcagtttgg

SEQ ID NO: 2192885 - DNA, 21 bp, Homo sapiens
catgaagctcagtttggctgt

SEQ ID NO: 2192886 - DNA, 20 bp, Homo sapiens
catgacatttgtcctgcaga

SEQ ID NO: 2192887 - DNA, 16 bp, Homo sapiens
catgacttccctccac

SEQ ID NO: 2192888 - DNA, 15 bp, Homo sapiens
catgagggtgttttt

SEQ ID NO: 2192889 - DNA, 17 bp, Homo sapiens
catgcaaaccaggagca

SEQ ID NO: 2192890 - DNA, 18 bp, Homo sapiens
catgcacagaacaagcca

SEQ ID NO: 2192891 - DNA, 17 bp, Homo sapiens
catgcactactgaaatt

SEQ ID NO: 2192892 - DNA, 12 bp, Homo sapiens
catgcagcagct

SEQ ID NO: 2192893 - DNA, 16 bp, Homo sapiens
catgcagcagcttgct

SEQ ID NO: 2192894 - DNA, 17 bp, Homo sapiens
catgcagcagcttgctg

SEQ ID NO: 2192895 - DNA, 22 bp, Homo sapiens
catgctgctatgaagactactt

SEQ ID NO: 2192896 - DNA, 22 bp, Homo sapiens
catgctggacaggtctgggaga

SEQ ID NO: 2192897 - DNA, 16 bp, Homo sapiens
catgctttggaaattt

SEQ ID NO: 2192898 - DNA, 19 bp, Homo sapiens
catggatagctcagaggta

SEQ ID NO: 2192899 - DNA, 16 bp, Homo sapiens
catggatgtttcttct

SEQ ID NO: 2192900 - DNA, 19 bp, Homo sapiens
catggcccatcactcggct

SEQ ID NO: 2192901 - DNA, 23 bp, Homo sapiens
catggcccatcactcggctgtgg

SEQ ID NO: 2192902 - DNA, 16 bp, Homo sapiens
catggctcaaggattc

SEQ ID NO: 2192903 - DNA, 16 bp, Homo sapiens
catggctcactgcagc

SEQ ID NO: 2192904 - DNA, 23 bp, Homo sapiens
catggctctgaactgcacaatgc

SEQ ID NO: 2192905 - DNA, 16 bp, Homo sapiens
catggcttcctaaatg

SEQ ID NO: 2192906 - DNA, 14 bp, Homo sapiens
catgggcccctctg

SEQ ID NO: 2192907 - DNA, 16 bp, Homo sapiens
catgggcccctctgac

SEQ ID NO: 2192908 - DNA, 19 bp, Homo sapiens
catggtaagagtcacaatt

SEQ ID NO: 2192909 - DNA, 15 bp, Homo sapiens
catggtagactgtga

SEQ ID NO: 2192910 - DNA, 21 bp, Homo sapiens
catgtagaagagggagaagga

SEQ ID NO: 2192911 - DNA, 21 bp, Homo sapiens
catgtagccacccaactttgt

SEQ ID NO: 2192912 - DNA, 10 bp, Homo sapiens
catgtcatgt

SEQ ID NO: 2192913 - DNA, 19 bp, Homo sapiens
catgtccaaacccatcttc

SEQ ID NO: 2192914 - DNA, 15 bp, Homo sapiens
catgtgctgctgtgg

SEQ ID NO: 2192915 - DNA, 17 bp, Homo sapiens
catgtgtgctcttcttc

SEQ ID NO: 2192916 - DNA, 22 bp, Homo sapiens
catgttaatcctagctgtgtgc

SEQ ID NO: 2192917 - DNA, 17 bp, Homo sapiens
catgttacgtgtgcaac

SEQ ID NO: 2192918 - DNA, 16 bp, Homo sapiens
catgttcccttctcct

SEQ ID NO: 2192919 - DNA, 16 bp, Homo sapiens
catgttctcatgtttg

SEQ ID NO: 2192920 - DNA, 13 bp, Homo sapiens
catgttgctgact

SEQ ID NO: 2192921 - DNA, 14 bp, Homo sapiens
cattaaatgcaaaa

SEQ ID NO: 2192922 - DNA, 19 bp, Homo sapiens
cattaatgtaggtttagat

SEQ ID NO: 2192923 - DNA, 21 bp, Homo sapiens
cattaatttatgcagagacag

SEQ ID NO: 2192924 - DNA, 21 bp, Homo sapiens
cattaatttctctcaatttgg

SEQ ID NO: 2192925 - DNA, 18 bp, Homo sapiens
cattacagtgtaaaaatt

SEQ ID NO: 2192926 - DNA, 23 bp, Homo sapiens
cattactttaccacccccacacc

SEQ ID NO: 2192927 - DNA, 13 bp, Homo sapiens
cattataattttg

SEQ ID NO: 2192928 - DNA, 23 bp, Homo sapiens
cattattacgtggcaaaatccct

SEQ ID NO: 2192929 - DNA, 17 bp, Homo sapiens
cattattttttgttgaa

SEQ ID NO: 2192930 - DNA, 14 bp, Homo sapiens
cattcagctctgga

SEQ ID NO: 2192931 - DNA, 17 bp, Homo sapiens
cattcagctctggagaa

SEQ ID NO: 2192932 - DNA, 21 bp, Homo sapiens
cattcagctctggagaacagt

SEQ ID NO: 2192933 - DNA, 15 bp, Homo sapiens
cattcaggaacctgg

SEQ ID NO: 2192934 - DNA, 11 bp, Homo sapiens
cattcccagag

SEQ ID NO: 2192935 - DNA, 18 bp, Homo sapiens
cattctctttctttttct

SEQ ID NO: 2192936 - DNA, 19 bp, Homo sapiens
cattgaaacttgagtttgt

SEQ ID NO: 2192937 - DNA, 19 bp, Homo sapiens
cattgaagtgtttaaaaga

SEQ ID NO: 2192938 - DNA, 16 bp, Homo sapiens
cattggagtcctggtt

SEQ ID NO: 2192939 - DNA, 22 bp, Homo sapiens
cattggttccctttgctccacc

SEQ ID NO: 2192940 - DNA, 21 bp, Homo sapiens
cattgtttttaagaaaaacat

SEQ ID NO: 2192941 - DNA, 22 bp, Homo sapiens
catttaatgtagccatgggacc

SEQ ID NO: 2192942 - DNA, 24 bp, Homo sapiens
catttaatgtagccatgggaccaa

SEQ ID NO: 2192943 - DNA, 18 bp, Homo sapiens
catttatttccatattaa

SEQ ID NO: 2192944 - DNA, 18 bp, Homo sapiens
catttcatataaatggaa

SEQ ID NO: 2192945 - DNA, 12 bp, Homo sapiens
catttcccctcc

SEQ ID NO: 2192946 - DNA, 21 bp, Homo sapiens
catttcccctcccgtcttcct

SEQ ID NO: 2192947 - DNA, 22 bp, Homo sapiens
catttcggaagtggtggggact

SEQ ID NO: 2192948 - DNA, 17 bp, Homo sapiens
catttcttggtatgatc

SEQ ID NO: 2192949 - DNA, 14 bp, Homo sapiens
catttgcagctgct

SEQ ID NO: 2192950 - DNA, 21 bp, Homo sapiens
catttgccaactaattttaaa

SEQ ID NO: 2192951 - DNA, 17 bp, Homo sapiens
catttgccatgctgcta

SEQ ID NO: 2192952 - DNA, 18 bp, Homo sapiens
catttgcttgtactggga

SEQ ID NO: 2192953 - DNA, 15 bp, Homo sapiens
catttggaatgaata

SEQ ID NO: 2192954 - DNA, 17 bp, Homo sapiens
cattttaacttgccaca

SEQ ID NO: 2192955 - DNA, 17 bp, Homo sapiens
cattttagaattaaaat

SEQ ID NO: 2192956 - DNA, 15 bp, Homo sapiens
cattttgccaaaatt

SEQ ID NO: 2192957 - DNA, 20 bp, Homo sapiens
cattttgccaaaattattaa

SEQ ID NO: 2192958 - DNA, 14 bp, Homo sapiens
cattttgtatgtat

SEQ ID NO: 2192959 - DNA, 15 bp, Homo sapiens
cattttgtatgtatg

SEQ ID NO: 2192960 - DNA, 22 bp, Homo sapiens
catttttaaatgtcagttgaaa

SEQ ID NO: 2192961 - DNA, 16 bp, Homo sapiens
catttttttagtttgt

SEQ ID NO: 2192962 - DNA, 19 bp, Homo sapiens
catttttttcactcagaat

SEQ ID NO: 2192963 - DNA, 20 bp, Homo sapiens
ccaaaatactacacatccaa

SEQ ID NO: 2192964 - DNA, 18 bp, Homo sapiens
ccaaaccctgtcctccca

SEQ ID NO: 2192965 - DNA, 19 bp, Homo sapiens
ccaaacggaactcttcatc

SEQ ID NO: 2192966 - DNA, 14 bp, Homo sapiens
ccaaagagctgcct

SEQ ID NO: 2192967 - DNA, 15 bp, Homo sapiens
ccaaagagctgccta

SEQ ID NO: 2192968 - DNA, 18 bp, Homo sapiens
ccaaaggtcaaaaacaaa

SEQ ID NO: 2192969 - DNA, 22 bp, Homo sapiens
ccaaagtgctgagattacaggt

SEQ ID NO: 2192970 - DNA, 18 bp, Homo sapiens
ccaaatcctctccagcta

SEQ ID NO: 2192971 - DNA, 18 bp, Homo sapiens
ccaaattgatgggtgggc

SEQ ID NO: 2192972 - DNA, 18 bp, Homo sapiens
ccaaattgccctgttgcc

SEQ ID NO: 2192973 - DNA, 17 bp, Homo sapiens
ccaacacaatctttcct

SEQ ID NO: 2192974 - DNA, 22 bp, Homo sapiens
ccaacacaatctttccttgtct

SEQ ID NO: 2192975 - DNA, 22 bp, Homo sapiens
ccaacaggtgctgaactgtgca

SEQ ID NO: 2192976 - DNA, 23 bp, Homo sapiens
ccaacaggtgctgaactgtgcat

SEQ ID NO: 2192977 - DNA, 18 bp, Homo sapiens
ccaaccacctctggccct

SEQ ID NO: 2192978 - DNA, 15 bp, Homo sapiens
ccaaccagaataaaa

SEQ ID NO: 2192979 - DNA, 12 bp, Homo sapiens
ccaacctcagca

SEQ ID NO: 2192980 - DNA, 18 bp, Homo sapiens
ccaactcctggagatttc

SEQ ID NO: 2192981 - DNA, 12 bp, Homo sapiens
ccaactccttcc

SEQ ID NO: 2192982 - DNA, 14 bp, Homo sapiens
ccaactccttcctc

SEQ ID NO: 2192983 - DNA, 22 bp, Homo sapiens
ccaactgagaaaacgaaactgc

SEQ ID NO: 2192984 - DNA, 17 bp, Homo sapiens
ccaactgtttccctgct

SEQ ID NO: 2192985 - DNA, 18 bp, Homo sapiens
ccaactgtttccctgctg

SEQ ID NO: 2192986 - DNA, 18 bp, Homo sapiens
ccaacttaagtttagaaa

SEQ ID NO: 2192987 - DNA, 21 bp, Homo sapiens
ccaagaaaaataattaaaaaa

SEQ ID NO: 2192988 - DNA, 14 bp, Homo sapiens
ccaagaagcagtgg

SEQ ID NO: 2192989 - DNA, 19 bp, Homo sapiens
ccaagccagattctcttga

SEQ ID NO: 2192990 - DNA, 20 bp, Homo sapiens
ccaagccagattctcttgaa

SEQ ID NO: 2192991 - DNA, 23 bp, Homo sapiens
ccaagccagggatggggccacag

SEQ ID NO: 2192992 - DNA, 15 bp, Homo sapiens
ccaagccggtgccca

SEQ ID NO: 2192993 - DNA, 16 bp, Homo sapiens
ccaagcctgggccact

SEQ ID NO: 2192994 - DNA, 17 bp, Homo sapiens
ccaagcctgggccactg

SEQ ID NO: 2192995 - DNA, 19 bp, Homo sapiens
ccaagctgtacccttgaga

SEQ ID NO: 2192996 - DNA, 15 bp, Homo sapiens
ccaaggccgcccacc

SEQ ID NO: 2192997 - DNA, 19 bp, Homo sapiens
ccacctaccttcaaagctg

SEQ ID NO: 2192998 - DNA, 12 bp, Homo sapiens
ccacctccttct

SEQ ID NO: 2192999 - DNA, 14 bp, Homo sapiens
ccacctcttttcct

SEQ ID NO: 2193000 - DNA, 15 bp, Homo sapiens
ccacctcttttccta

SEQ ID NO: 2193001 - DNA, 13 bp, Homo sapiens
ccacctgcagcgt

SEQ ID NO: 2193002 - DNA, 14 bp, Homo sapiens
ccacctgccactag

SEQ ID NO: 2193003 - DNA, 23 bp, Homo sapiens
ccacctgccactaggctgggtgc

SEQ ID NO: 2193004 - DNA, 18 bp, Homo sapiens
ccacctgtcccacctcaa

SEQ ID NO: 2193005 - DNA, 12 bp, Homo sapiens
ccacggcctggc

SEQ ID NO: 2193006 - DNA, 19 bp, Homo sapiens
ccacggcctggctggtggg

SEQ ID NO: 2193007 - DNA, 22 bp, Homo sapiens
ccacgggctgcgccgtctgctc

SEQ ID NO: 2193008 - DNA, 13 bp, Homo sapiens
ccacgggggaggc

SEQ ID NO: 2193009 - DNA, 14 bp, Homo sapiens
ccacgtgctggaga

SEQ ID NO: 2193010 - DNA, 16 bp, Homo sapiens
ccacgtgctggagagt

SEQ ID NO: 2193011 - DNA, 17 bp, Homo sapiens
ccacgtgctggagagta

SEQ ID NO: 2193012 - DNA, 23 bp, Homo sapiens
ccactaattgtaaggtattgcaa

SEQ ID NO: 2193013 - DNA, 14 bp, Homo sapiens
ccactaggctgggt

SEQ ID NO: 2193014 - DNA, 21 bp, Homo sapiens
ccactccggattccggccctg

SEQ ID NO: 2193015 - DNA, 13 bp, Homo sapiens
ccactccttgtcc

SEQ ID NO: 2193016 - DNA, 17 bp, Homo sapiens
ccactctgagtgaatac

SEQ ID NO: 2193017 - DNA, 16 bp, Homo sapiens
ccactgcaaataaagc

SEQ ID NO: 2193018 - DNA, 20 bp, Homo sapiens
ccactgcaaataaagccttt

SEQ ID NO: 2193019 - DNA, 20 bp, Homo sapiens
ccactgcagtcacccctgtc

SEQ ID NO: 2193020 - DNA, 23 bp, Homo sapiens
ccactgcagtcacccctgtctgc

SEQ ID NO: 2193021 - DNA, 13 bp, Homo sapiens
ccactggcatctc

SEQ ID NO: 2193022 - DNA, 14 bp, Homo sapiens
ccactggcatctct

SEQ ID NO: 2193023 - DNA, 18 bp, Homo sapiens
ccactggcatctctggag

SEQ ID NO: 2193024 - DNA, 20 bp, Homo sapiens
ccactggcatctctggagtg

SEQ ID NO: 2193025 - DNA, 14 bp, Homo sapiens
ccactgtacatata

SEQ ID NO: 2193026 - DNA, 16 bp, Homo sapiens
ccactgtgcccagcag

SEQ ID NO: 2193027 - DNA, 21 bp, Homo sapiens
ccactgttttgttggcccaca

SEQ ID NO: 2193028 - DNA, 17 bp, Homo sapiens
ccacttatttccatgga

SEQ ID NO: 2193029 - DNA, 23 bp, Homo sapiens
ccacttgatatgactaattcagg

SEQ ID NO: 2193030 - DNA, 23 bp, Homo sapiens
ccagaaagttgtgtaggcaccac

SEQ ID NO: 2193031 - DNA, 21 bp, Homo sapiens
ccagaagatgtattcagagcc

SEQ ID NO: 2193032 - DNA, 22 bp, Homo sapiens
ccagaagatgtattcagagcca

SEQ ID NO: 2193033 - DNA, 22 bp, Homo sapiens
ccagacagtttatgagaatgac

SEQ ID NO: 2193034 - DNA, 14 bp, Homo sapiens
ccagaccagagctc

SEQ ID NO: 2193035 - DNA, 16 bp, Homo sapiens
ccagaccagagctctg

SEQ ID NO: 2193036 - DNA, 13 bp, Homo sapiens
ccagagctctgga

SEQ ID NO: 2193037 - DNA, 22 bp, Homo sapiens
ccagagctctggagccacctgt

SEQ ID NO: 2193038 - DNA, 13 bp, Homo sapiens
ccagaggcacagc

SEQ ID NO: 2193039 - DNA, 17 bp, Homo sapiens
ccagaggcagaaccctg

SEQ ID NO: 2193040 - DNA, 12 bp, Homo sapiens
ccagaggccctg

SEQ ID NO: 2193041 - DNA, 17 bp, Homo sapiens
ccagaggccctggaggt

SEQ ID NO: 2193042 - DNA, 14 bp, Homo sapiens
ccagaggctcctgg

SEQ ID NO: 2193043 - DNA, 15 bp, Homo sapiens
ccagaggctcctgga

SEQ ID NO: 2193044 - DNA, 16 bp, Homo sapiens
ccagaggtgggaggcc

SEQ ID NO: 2193045 - DNA, 15 bp, Homo sapiens
ccagaggtggggaag

SEQ ID NO: 2193046 - DNA, 23 bp, Homo sapiens
ccagaggtggggaagagagcctg

SEQ ID NO: 2193047 - DNA, 13 bp, Homo sapiens
ccagatcactcaa

SEQ ID NO: 2193048 - DNA, 16 bp, Homo sapiens
ccagatgccttctaga

SEQ ID NO: 2193049 - DNA, 13 bp, Homo sapiens
ccagattgtagct

SEQ ID NO: 2193050 - DNA, 16 bp, Homo sapiens
ccagattgtagctctt

SEQ ID NO: 2193051 - DNA, 13 bp, Homo sapiens
ccagcactgaccc

SEQ ID NO: 2193052 - DNA, 10 bp, Homo sapiens
ccagccacag

SEQ ID NO: 2193053 - DNA, 18 bp, Homo sapiens
ccagccacagacccctgg

SEQ ID NO: 2193054 - DNA, 19 bp, Homo sapiens
ccagccacagacccctggg

SEQ ID NO: 2193055 - DNA, 20 bp, Homo sapiens
ccagccacagacccctggga

SEQ ID NO: 2193056 - DNA, 22 bp, Homo sapiens
ccagccacagacccctgggagc

SEQ ID NO: 2193057 - DNA, 23 bp, Homo sapiens
ccagccacagacccctgggagct

SEQ ID NO: 2193058 - DNA, 21 bp, Homo sapiens
ccagccaccctaactgagctg

SEQ ID NO: 2193059 - DNA, 12 bp, Homo sapiens
ccagcccactgg

SEQ ID NO: 2193060 - DNA, 16 bp, Homo sapiens
ccagcccagctgctct

SEQ ID NO: 2193061 - DNA, 19 bp, Homo sapiens
ccagcccagctgctctgcc

SEQ ID NO: 2193062 - DNA, 18 bp, Homo sapiens
ccagcccatcttgcctcc

SEQ ID NO: 2193063 - DNA, 20 bp, Homo sapiens
cccagaggctcctggagcca

SEQ ID NO: 2193064 - DNA, 23 bp, Homo sapiens
cccagaggtggggaagagagcct

SEQ ID NO: 2193065 - DNA, 12 bp, Homo sapiens
cccagcagagcc

SEQ ID NO: 2193066 - DNA, 17 bp, Homo sapiens
cccagcagtttcccaga

SEQ ID NO: 2193067 - DNA, 22 bp, Homo sapiens
cccagcccagctgctctgccca

SEQ ID NO: 2193068 - DNA, 13 bp, Homo sapiens
cccagcccatctt

SEQ ID NO: 2193069 - DNA, 18 bp, Homo sapiens
cccagctaaagaggtggg

SEQ ID NO: 2193070 - DNA, 19 bp, Homo sapiens
cccagctgctctgcccaga

SEQ ID NO: 2193071 - DNA, 18 bp, Homo sapiens
cccaggagcatccacctc

SEQ ID NO: 2193072 - DNA, 19 bp, Homo sapiens
cccaggcaccccctggctt

SEQ ID NO: 2193073 - DNA, 19 bp, Homo sapiens
cccaggctggagtgcagtg

SEQ ID NO: 2193074 - DNA, 14 bp, Homo sapiens
cccagggtcctgtg

SEQ ID NO: 2193075 - DNA, 15 bp, Homo sapiens
cccaggttggaggcc

SEQ ID NO: 2193076 - DNA, 23 bp, Homo sapiens
cccagttctctagggaaggccac

SEQ ID NO: 2193077 - DNA, 18 bp, Homo sapiens
cccatactctgtctccct

SEQ ID NO: 2193078 - DNA, 21 bp, Homo sapiens
cccatagcaaagggtctgtgg

SEQ ID NO: 2193079 - DNA, 15 bp, Homo sapiens
cccatcagcagcttg

SEQ ID NO: 2193080 - DNA, 19 bp, Homo sapiens
cccatcaggactcttgtga

SEQ ID NO: 2193081 - DNA, 20 bp, Homo sapiens
cccatcttcatggatagctc

SEQ ID NO: 2193082 - DNA, 18 bp, Homo sapiens
cccatggatgtttcttct

SEQ ID NO: 2193083 - DNA, 19 bp, Homo sapiens
cccattctctccagtgtgt

SEQ ID NO: 2193084 - DNA, 23 bp, Homo sapiens
ccccaaaggaagctttctctgct

SEQ ID NO: 2193085 - DNA, 16 bp, Homo sapiens
ccccaagaaggctggg

SEQ ID NO: 2193086 - DNA, 11 bp, Homo sapiens
ccccaagctgg

SEQ ID NO: 2193087 - DNA, 13 bp, Homo sapiens
ccccaagggccct

SEQ ID NO: 2193088 - DNA, 18 bp, Homo sapiens
ccccaagggccctggcac

SEQ ID NO: 2193089 - DNA, 20 bp, Homo sapiens
ccccaagggccctggcaccc

SEQ ID NO: 2193090 - DNA, 20 bp, Homo sapiens
ccccaccccgggctctcctg

SEQ ID NO: 2193091 - DNA, 15 bp, Homo sapiens
ccccaccccttgctc

SEQ ID NO: 2193092 - DNA, 17 bp, Homo sapiens
ccccacctcttttccta

SEQ ID NO: 2193093 - DNA, 22 bp, Homo sapiens
ccccacctgccactaggctggg

SEQ ID NO: 2193094 - DNA, 21 bp, Homo sapiens
ccccactcacagagacacagg

SEQ ID NO: 2193095 - DNA, 12 bp, Homo sapiens
ccccagaggccc

SEQ ID NO: 2193096 - DNA, 14 bp, Homo sapiens
ccccagaggccctg

SEQ ID NO: 2193097 - DNA, 18 bp, Homo sapiens
ccccagaggccctggagg

SEQ ID NO: 2193098 - DNA, 17 bp, Homo sapiens
ccccagcccagcccagc

SEQ ID NO: 2193099 - DNA, 21 bp, Homo sapiens
cccccgtctcctgccgggcag

SEQ ID NO: 2193100 - DNA, 19 bp, Homo sapiens
ccccctcttcttctgaaga

SEQ ID NO: 2193101 - DNA, 21 bp, Homo sapiens
ccccctgtccttcccacggcc

SEQ ID NO: 2193102 - DNA, 15 bp, Homo sapiens
cccccttgtctgctg

SEQ ID NO: 2193103 - DNA, 14 bp, Homo sapiens
ccccgccctctgcc

SEQ ID NO: 2193104 - DNA, 23 bp, Homo sapiens
ccccgctcatgggcccctctgac

SEQ ID NO: 2193105 - DNA, 22 bp, Homo sapiens
ccccgggctggagaaagagctg

SEQ ID NO: 2193106 - DNA, 13 bp, Homo sapiens
cccctcagcctcc

SEQ ID NO: 2193107 - DNA, 19 bp, Homo sapiens
cccctctaatgctcacgct

SEQ ID NO: 2193108 - DNA, 12 bp, Homo sapiens
cccctctgctgg

SEQ ID NO: 2193109 - DNA, 13 bp, Homo sapiens
cccctctgctggc

SEQ ID NO: 2193110 - DNA, 13 bp, Homo sapiens
cccctgccgcctg

SEQ ID NO: 2193111 - DNA, 19 bp, Homo sapiens
cccctgtctgcgccgctgt

SEQ ID NO: 2193112 - DNA, 12 bp, Homo sapiens
ccccttcctgtc

SEQ ID NO: 2193113 - DNA, 16 bp, Homo sapiens
ccccttgtctgctgct

SEQ ID NO: 2193114 - DNA, 18 bp, Homo sapiens
cccgagccccctgtcctt

SEQ ID NO: 2193115 - DNA, 23 bp, Homo sapiens
cccgagtagttgggattacaggt

SEQ ID NO: 2193116 - DNA, 19 bp, Homo sapiens
cccgcatgcagcagcttgc

SEQ ID NO: 2193117 - DNA, 13 bp, Homo sapiens
cccgccctctgcc

SEQ ID NO: 2193118 - DNA, 13 bp, Homo sapiens
cccgccgtgcctg

SEQ ID NO: 2193119 - DNA, 18 bp, Homo sapiens
cccgggctctcctgccct

SEQ ID NO: 2193120 - DNA, 14 bp, Homo sapiens
cccgggctggagaa

SEQ ID NO: 2193121 - DNA, 19 bp, Homo sapiens
cccgtagagaatgtgtgta

SEQ ID NO: 2193122 - DNA, 20 bp, Homo sapiens
cccgtctgctcctccctccc

SEQ ID NO: 2193123 - DNA, 19 bp, Homo sapiens
cccgtcttcaatctctgtt

SEQ ID NO: 2193124 - DNA, 16 bp, Homo sapiens
cccgtgcaaaacatgc

SEQ ID NO: 2193125 - DNA, 13 bp, Homo sapiens
ccctacagccctg

SEQ ID NO: 2193126 - DNA, 20 bp, Homo sapiens
ccctaccactgtcttcttca

SEQ ID NO: 2193127 - DNA, 15 bp, Homo sapiens
ccctacccacagggc

SEQ ID NO: 2193128 - DNA, 20 bp, Homo sapiens
ccctacccacagggcctgac

SEQ ID NO: 2193129 - DNA, 17 bp, Homo sapiens
ccctaggcacctctgtg

SEQ ID NO: 2193130 - DNA, 15 bp, Homo sapiens
ccctagggctgggtg

SEQ ID NO: 2193131 - DNA, 16 bp, Homo sapiens
ccctagggctgggtgt

SEQ ID NO: 2193132 - DNA, 16 bp, Homo sapiens
ccctcagctggcggaa

SEQ ID NO: 2193133 - DNA, 18 bp, Homo sapiens
ccctcagcttcaaataaa

SEQ ID NO: 2193134 - DNA, 21 bp, Homo sapiens
ccctcaggaattcagtgcctt

SEQ ID NO: 2193135 - DNA, 16 bp, Homo sapiens
ccctcatgttctcatg

SEQ ID NO: 2193136 - DNA, 13 bp, Homo sapiens
ccctccactgccc

SEQ ID NO: 2193137 - DNA, 14 bp, Homo sapiens
ccctccctcctgcc

SEQ ID NO: 2193138 - DNA, 12 bp, Homo sapiens
ccctccctgcag

SEQ ID NO: 2193139 - DNA, 17 bp, Homo sapiens
ccctccctgcagggtag

SEQ ID NO: 2193140 - DNA, 23 bp, Homo sapiens
ccctcctccctttttccttgtcc

SEQ ID NO: 2193141 - DNA, 15 bp, Homo sapiens
ccctcctgcctgcgc

SEQ ID NO: 2193142 - DNA, 23 bp, Homo sapiens
ccctcctgcctgcgcagctcctt

SEQ ID NO: 2193143 - DNA, 20 bp, Homo sapiens
ccctccttgccgctgggaga

SEQ ID NO: 2193144 - DNA, 13 bp, Homo sapiens
ccctcctttccca

SEQ ID NO: 2193145 - DNA, 20 bp, Homo sapiens
ccctcctttcccaacacttc

SEQ ID NO: 2193146 - DNA, 20 bp, Homo sapiens
ccctctatttattagccaac

SEQ ID NO: 2193147 - DNA, 14 bp, Homo sapiens
ccctctctttgagt

SEQ ID NO: 2193148 - DNA, 18 bp, Homo sapiens
ccctctgaggctcagccc

SEQ ID NO: 2193149 - DNA, 20 bp, Homo sapiens
ccctgagctagtgtcacctg

SEQ ID NO: 2193150 - DNA, 19 bp, Homo sapiens
ccctgagctggcctcacct

SEQ ID NO: 2193151 - DNA, 18 bp, Homo sapiens
ccctgaggtatctgtgtt

SEQ ID NO: 2193152 - DNA, 15 bp, Homo sapiens
ccctgatttgctgtt

SEQ ID NO: 2193153 - DNA, 13 bp, Homo sapiens
ccctgcagggcca

SEQ ID NO: 2193154 - DNA, 21 bp, Homo sapiens
ccctgccccccctaagagaca

SEQ ID NO: 2193155 - DNA, 13 bp, Homo sapiens
ccctgccctcctg

SEQ ID NO: 2193156 - DNA, 16 bp, Homo sapiens
ccctgctacctgttct

SEQ ID NO: 2193157 - DNA, 17 bp, Homo sapiens
ccctgctacctgttctt

SEQ ID NO: 2193158 - DNA, 22 bp, Homo sapiens
ccctgctagatgagaattcagc

SEQ ID NO: 2193159 - DNA, 18 bp, Homo sapiens
ccctgctcagctggccgg

SEQ ID NO: 2193160 - DNA, 11 bp, Homo sapiens
ccctgctgaat

SEQ ID NO: 2193161 - DNA, 13 bp, Homo sapiens
ccctgctgaatgc

SEQ ID NO: 2193162 - DNA, 17 bp, Homo sapiens
ccctgcttggggcctgg

SEQ ID NO: 2193163 - DNA, 17 bp, Homo sapiens
ccctggaggtctccagg

SEQ ID NO: 2193164 - DNA, 21 bp, Homo sapiens
ccctggaggtctccaggggcc

SEQ ID NO: 2193165 - DNA, 10 bp, Homo sapiens
ccctggcttg

SEQ ID NO: 2193166 - DNA, 23 bp, Homo sapiens
ccctggcttgaaccttcaaagct

SEQ ID NO: 2193167 - DNA, 23 bp, Homo sapiens
ccctgtccttcccacggccactg

SEQ ID NO: 2193168 - DNA, 23 bp, Homo sapiens
ccctgtctaggtcagtacccacc

SEQ ID NO: 2193169 - DNA, 18 bp, Homo sapiens
ccctgtggcaaatgccag

SEQ ID NO: 2193170 - DNA, 23 bp, Homo sapiens
ccctgtggcaaatgccaggacag

SEQ ID NO: 2193171 - DNA, 14 bp, Homo sapiens
cccttacacttact

SEQ ID NO: 2193172 - DNA, 19 bp, Homo sapiens
cccttagcccccacccact

SEQ ID NO: 2193173 - DNA, 21 bp, Homo sapiens
cccttagcccccacccacttc

SEQ ID NO: 2193174 - DNA, 19 bp, Homo sapiens
cccttcacaccataactag

SEQ ID NO: 2193175 - DNA, 23 bp, Homo sapiens
cccttccaggccatcagaggcct

SEQ ID NO: 2193176 - DNA, 17 bp, Homo sapiens
cccttcctgtccgccct

SEQ ID NO: 2193177 - DNA, 16 bp, Homo sapiens
cccttcctgtgcctgt

SEQ ID NO: 2193178 - DNA, 15 bp, Homo sapiens
cccttctccttccaa

SEQ ID NO: 2193179 - DNA, 16 bp, Homo sapiens
cccttctgtgcccagc

SEQ ID NO: 2193180 - DNA, 20 bp, Homo sapiens
cccttctgtgcccagctcag

SEQ ID NO: 2193181 - DNA, 14 bp, Homo sapiens
cccttggaggagag

SEQ ID NO: 2193182 - DNA, 17 bp, Homo sapiens
cccttggaggagagaga

SEQ ID NO: 2193183 - DNA, 22 bp, Homo sapiens
cccttggaggagagagaccccg

SEQ ID NO: 2193184 - DNA, 13 bp, Homo sapiens
ccctttgctccac

SEQ ID NO: 2193185 - DNA, 13 bp, Homo sapiens
cctctggctgcct

SEQ ID NO: 2193186 - DNA, 16 bp, Homo sapiens
cctctggggctcagcc

SEQ ID NO: 2193187 - DNA, 17 bp, Homo sapiens
cctctggggctcagccc

SEQ ID NO: 2193188 - DNA, 22 bp, Homo sapiens
cctctggggctcagccctgagc

SEQ ID NO: 2193189 - DNA, 14 bp, Homo sapiens
cctcttgaccaggc

SEQ ID NO: 2193190 - DNA, 15 bp, Homo sapiens
cctcttgaccaggct

SEQ ID NO: 2193191 - DNA, 20 bp, Homo sapiens
cctcttgaccaggctgcctc

SEQ ID NO: 2193192 - DNA, 13 bp, Homo sapiens
cctcttgctggtg

SEQ ID NO: 2193193 - DNA, 13 bp, Homo sapiens
cctcttgtagcca

SEQ ID NO: 2193194 - DNA, 20 bp, Homo sapiens
cctgaccagctgctccgagg

SEQ ID NO: 2193195 - DNA, 14 bp, Homo sapiens
cctgaccctgcaga

SEQ ID NO: 2193196 - DNA, 23 bp, Homo sapiens
cctgaccttgaggagtcttgtgt

SEQ ID NO: 2193197 - DNA, 15 bp, Homo sapiens
cctgagccctaaaca

SEQ ID NO: 2193198 - DNA, 16 bp, Homo sapiens
cctgagccggccccag

SEQ ID NO: 2193199 - DNA, 20 bp, Homo sapiens
cctgagctggcgtcacctgt

SEQ ID NO: 2193200 - DNA, 15 bp, Homo sapiens
cctgagctttggacg

SEQ ID NO: 2193201 - DNA, 18 bp, Homo sapiens
cctgagctttggacgcac

SEQ ID NO: 2193202 - DNA, 22 bp, Homo sapiens
cctgagctttggacgcacacag

SEQ ID NO: 2193203 - DNA, 15 bp, Homo sapiens
cctgaggcagaacct

SEQ ID NO: 2193204 - DNA, 21 bp, Homo sapiens
cctgaggcagaacctggtggc

SEQ ID NO: 2193205 - DNA, 18 bp, Homo sapiens
cctgaggcccagcagagc

SEQ ID NO: 2193206 - DNA, 20 bp, Homo sapiens
cctgaggcccagcagagccg

SEQ ID NO: 2193207 - DNA, 19 bp, Homo sapiens
cctgagtgatcccatttct

SEQ ID NO: 2193208 - DNA, 20 bp, Homo sapiens
cctgagttggcatcacctgc

SEQ ID NO: 2193209 - DNA, 22 bp, Homo sapiens
cctgagttggcatcacctgcgc

SEQ ID NO: 2193210 - DNA, 18 bp, Homo sapiens
cctgatcccactcctagg

SEQ ID NO: 2193211 - DNA, 17 bp, Homo sapiens
cctgatgctaattttca

SEQ ID NO: 2193212 - DNA, 18 bp, Homo sapiens
cctgattgctctggaagc

SEQ ID NO: 2193213 - DNA, 16 bp, Homo sapiens
cctgatttgctgtttt

SEQ ID NO: 2193214 - DNA, 18 bp, Homo sapiens
cctgcacagggccctctg

SEQ ID NO: 2193215 - DNA, 23 bp, Homo sapiens
cctgcacagggccctctgaggct

SEQ ID NO: 2193216 - DNA, 17 bp, Homo sapiens
cctgcagaaggaaagaa

SEQ ID NO: 2193217 - DNA, 18 bp, Homo sapiens
cctgcagaaggaaagaag

SEQ ID NO: 2193218 - DNA, 13 bp, Homo sapiens
cctgcagagctgg

SEQ ID NO: 2193219 - DNA, 14 bp, Homo sapiens
cctgcagagctggg

SEQ ID NO: 2193220 - DNA, 16 bp, Homo sapiens
cctgcagagctggggg

SEQ ID NO: 2193221 - DNA, 15 bp, Homo sapiens
cctgcagggccatct

SEQ ID NO: 2193222 - DNA, 21 bp, Homo sapiens
cctgcagggccatctgactgc

SEQ ID NO: 2193223 - DNA, 23 bp, Homo sapiens
cctgcagggtagggggcctgagt

SEQ ID NO: 2193224 - DNA, 17 bp, Homo sapiens
cctgcatcagcctctgg

SEQ ID NO: 2193225 - DNA, 18 bp, Homo sapiens
cctgcatcagcctctggc

SEQ ID NO: 2193226 - DNA, 20 bp, Homo sapiens
cctgccactaggctgggtgc

SEQ ID NO: 2193227 - DNA, 20 bp, Homo sapiens
cctgccccccctaagagaca

SEQ ID NO: 2193228 - DNA, 12 bp, Homo sapiens
cctgccctcctg

SEQ ID NO: 2193229 - DNA, 15 bp, Homo sapiens
cctgccctctctcag

SEQ ID NO: 2193230 - DNA, 20 bp, Homo sapiens
cctgcctagcactcacatgc

SEQ ID NO: 2193231 - DNA, 21 bp, Homo sapiens
cctgcctagcactcacatgct

SEQ ID NO: 2193232 - DNA, 14 bp, Homo sapiens
cctgcctctgtttg

SEQ ID NO: 2193233 - DNA, 13 bp, Homo sapiens
cctgccttctggg

SEQ ID NO: 2193234 - DNA, 23 bp, Homo sapiens
cctgcgcagggccctctggggct

SEQ ID NO: 2193235 - DNA, 16 bp, Homo sapiens
cctgcggctgctggca

SEQ ID NO: 2193236 - DNA, 21 bp, Homo sapiens
cctgcggctgctggcacagac

SEQ ID NO: 2193237 - DNA, 20 bp, Homo sapiens
cctgctatttcccaagctgg

SEQ ID NO: 2193238 - DNA, 17 bp, Homo sapiens
cctgctcagctggccgg

SEQ ID NO: 2193239 - DNA, 12 bp, Homo sapiens
cctgctgaatgc

SEQ ID NO: 2193240 - DNA, 13 bp, Homo sapiens
cctgctgaatgcc

SEQ ID NO: 2193241 - DNA, 23 bp, Homo sapiens
cctgctgaatgcctcgctccctt

SEQ ID NO: 2193242 - DNA, 20 bp, Homo sapiens
cctgctggggccgccacggc

SEQ ID NO: 2193243 - DNA, 17 bp, Homo sapiens
cctgctggtacctgccc

SEQ ID NO: 2193244 - DNA, 18 bp, Homo sapiens
cctgctggtacctgccct

SEQ ID NO: 2193245 - DNA, 21 bp, Homo sapiens
cctgctggtgaccggcctgga

SEQ ID NO: 2193246 - DNA, 22 bp, Homo sapiens
cctgctggtgaccggcctggac

SEQ ID NO: 2193247 - DNA, 21 bp, Homo sapiens
cctgctgtcagaccttcttcc

SEQ ID NO: 2193248 - DNA, 16 bp, Homo sapiens
cctgctgtgggtcagt

SEQ ID NO: 2193249 - DNA, 15 bp, Homo sapiens
cctgcttggggcctg

SEQ ID NO: 2193250 - DNA, 15 bp, Homo sapiens
cctggaaccagagcc

SEQ ID NO: 2193251 - DNA, 22 bp, Homo sapiens
cctggaatcgaggctgtgtgtc

SEQ ID NO: 2193252 - DNA, 16 bp, Homo sapiens
cctggacatattccca

SEQ ID NO: 2193253 - DNA, 14 bp, Homo sapiens
cctggaccaaagct

SEQ ID NO: 2193254 - DNA, 16 bp, Homo sapiens
cctggaccaaagctga

SEQ ID NO: 2193255 - DNA, 12 bp, Homo sapiens
gaggccctggag

SEQ ID NO: 2193256 - DNA, 19 bp, Homo sapiens
gaggccctggaggtctcca

SEQ ID NO: 2193257 - DNA, 21 bp, Homo sapiens
gaggccctggaggtctccagg

SEQ ID NO: 2193258 - DNA, 22 bp, Homo sapiens
gaggccctggaggtctccaggg

SEQ ID NO: 2193259 - DNA, 16 bp, Homo sapiens
gaggcccttttctggc

SEQ ID NO: 2193260 - DNA, 17 bp, Homo sapiens
gaggcccttttctggct

SEQ ID NO: 2193261 - DNA, 18 bp, Homo sapiens
gaggcccttttctggctc

SEQ ID NO: 2193262 - DNA, 21 bp, Homo sapiens
gaggcccttttctggctcctg

SEQ ID NO: 2193263 - DNA, 16 bp, Homo sapiens
gaggccgaggcagggg

SEQ ID NO: 2193264 - DNA, 18 bp, Homo sapiens
gaggccgaggcaggggct

SEQ ID NO: 2193265 - DNA, 21 bp, Homo sapiens
gaggcctagtcagccacatgg

SEQ ID NO: 2193266 - DNA, 16 bp, Homo sapiens
gaggcctcaccctgct

SEQ ID NO: 2193267 - DNA, 21 bp, Homo sapiens
gaggcctcaccctgcttgggg

SEQ ID NO: 2193268 - DNA, 13 bp, Homo sapiens
gaggcctctgggc

SEQ ID NO: 2193269 - DNA, 18 bp, Homo sapiens
gaggcgaagctgagcggg

SEQ ID NO: 2193270 - DNA, 17 bp, Homo sapiens
gaggctcctggagccag

SEQ ID NO: 2193271 - DNA, 21 bp, Homo sapiens
gaggctgggccaagccaggga

SEQ ID NO: 2193272 - DNA, 23 bp, Homo sapiens
gaggctgggccaagccagggatg

SEQ ID NO: 2193273 - DNA, 18 bp, Homo sapiens
gagggagaaggagaggct

SEQ ID NO: 2193274 - DNA, 23 bp, Homo sapiens
gagggatgcagtgcctttcccca

SEQ ID NO: 2193275 - DNA, 21 bp, Homo sapiens
gagggatgccataccttgaga

SEQ ID NO: 2193276 - DNA, 17 bp, Homo sapiens
gagggcaaagctgattt

SEQ ID NO: 2193277 - DNA, 17 bp, Homo sapiens
gaggggacgcctgtgtc

SEQ ID NO: 2193278 - DNA, 13 bp, Homo sapiens
gaggggagaggaa

SEQ ID NO: 2193279 - DNA, 16 bp, Homo sapiens
gaggggcctctggctg

SEQ ID NO: 2193280 - DNA, 21 bp, Homo sapiens
gaggggcctctggctgcctgg

SEQ ID NO: 2193281 - DNA, 21 bp, Homo sapiens
gagggtaggagggtgggaagg

SEQ ID NO: 2193282 - DNA, 13 bp, Homo sapiens
gagggtgggaagg

SEQ ID NO: 2193283 - DNA, 16 bp, Homo sapiens
gaggtcaccaggggag

SEQ ID NO: 2193284 - DNA, 17 bp, Homo sapiens
gaggtctccaggggcct

SEQ ID NO: 2193285 - DNA, 23 bp, Homo sapiens
gaggtctgagtggtggtctttgg

SEQ ID NO: 2193286 - DNA, 21 bp, Homo sapiens
gaggtgggaggcccctggtgg

SEQ ID NO: 2193287 - DNA, 19 bp, Homo sapiens
gaggtggggaagagagcct

SEQ ID NO: 2193288 - DNA, 12 bp, Homo sapiens
gaggttgaggct

SEQ ID NO: 2193289 - DNA, 17 bp, Homo sapiens
gaggtttagctgcagga

SEQ ID NO: 2193290 - DNA, 17 bp, Homo sapiens
gagtagacccctggctg

SEQ ID NO: 2193291 - DNA, 24 bp, Homo sapiens
gagtagttgggattacaggtgact

SEQ ID NO: 2193292 - DNA, 15 bp, Homo sapiens
gagtatgagtgcaag

SEQ ID NO: 2193293 - DNA, 10 bp, Homo sapiens
gagtatgtgt

SEQ ID NO: 2193294 - DNA, 14 bp, Homo sapiens
gagtcccttccagg

SEQ ID NO: 2193295 - DNA, 22 bp, Homo sapiens
gagtcccttccaggccatcaga

SEQ ID NO: 2193296 - DNA, 18 bp, Homo sapiens
gagtcctgaggcagaacc

SEQ ID NO: 2193297 - DNA, 21 bp, Homo sapiens
gagtgatctcagctcactgca

SEQ ID NO: 2193298 - DNA, 23 bp, Homo sapiens
gagtgatctcagctcactgcaac

SEQ ID NO: 2193299 - DNA, 16 bp, Homo sapiens
gagtgcaagcaaagca

SEQ ID NO: 2193300 - DNA, 18 bp, Homo sapiens
gagtggatagatgccctg

SEQ ID NO: 2193301 - DNA, 12 bp, Homo sapiens
gagtgggaagcc

SEQ ID NO: 2193302 - DNA, 22 bp, Homo sapiens
gagtgggccccgggctggagaa

SEQ ID NO: 2193303 - DNA, 22 bp, Homo sapiens
gagtgtgacgggggttggggtg

SEQ ID NO: 2193304 - DNA, 11 bp, Homo sapiens
gagtgtgtgca

SEQ ID NO: 2193305 - DNA, 12 bp, Homo sapiens
gagtgtgtgggg

SEQ ID NO: 2193306 - DNA, 18 bp, Homo sapiens
gagttgaggggcttccct

SEQ ID NO: 2193307 - DNA, 21 bp, Homo sapiens
gagttgaggggcttccctctg

SEQ ID NO: 2193308 - DNA, 23 bp, Homo sapiens
gagttggcgttgtgggcaggcta

SEQ ID NO: 2193309 - DNA, 20 bp, Homo sapiens
gagtttgtttcttgtgtgtt

SEQ ID NO: 2193310 - DNA, 15 bp, Homo sapiens
gataaggcctgtggg

SEQ ID NO: 2193311 - DNA, 16 bp, Homo sapiens
gataataaaattcatt

SEQ ID NO: 2193312 - DNA, 22 bp, Homo sapiens
gataatttagtggattaaccag

SEQ ID NO: 2193313 - DNA, 23 bp, Homo sapiens
gataatttattgtaccaaagctg

SEQ ID NO: 2193314 - DNA, 18 bp, Homo sapiens
gatacacaggtgagaaag

SEQ ID NO: 2193315 - DNA, 22 bp, Homo sapiens
gatagcatatattcatacctgt

SEQ ID NO: 2193316 - DNA, 15 bp, Homo sapiens
gataggagacttgta

SEQ ID NO: 2193317 - DNA, 17 bp, Homo sapiens
gatagtgttttgtactt

SEQ ID NO: 2193318 - DNA, 17 bp, Homo sapiens
gatatgactaattcagg

SEQ ID NO: 2193319 - DNA, 12 bp, Homo sapiens
gatattgtgcat

SEQ ID NO: 2193320 - DNA, 17 bp, Homo sapiens
gatattgttttgtgact

SEQ ID NO: 2193321 - DNA, 22 bp, Homo sapiens
gatcagaacattcagctctgga

SEQ ID NO: 2193322 - DNA, 16 bp, Homo sapiens
gatcatggctcactgc

SEQ ID NO: 2193323 - DNA, 20 bp, Homo sapiens
gatcgcacaaggacatttgg

SEQ ID NO: 2193324 - DNA, 13 bp, Homo sapiens
gatctccaaagct

SEQ ID NO: 2193325 - DNA, 12 bp, Homo sapiens
gatctcccctca

SEQ ID NO: 2193326 - DNA, 21 bp, Homo sapiens
gatctgctgacagatgttcca

SEQ ID NO: 2193327 - DNA, 13 bp, Homo sapiens
gatcttggagaca

SEQ ID NO: 2193328 - DNA, 16 bp, Homo sapiens
gatcttggagacaatt

SEQ ID NO: 2193329 - DNA, 21 bp, Homo sapiens
gatcttggagacaattacaag

SEQ ID NO: 2193330 - DNA, 14 bp, Homo sapiens
gatgaaccaagtgt

SEQ ID NO: 2193331 - DNA, 21 bp, Homo sapiens
gatgaatttggtctgcctctg

SEQ ID NO: 2193332 - DNA, 22 bp, Homo sapiens
gatgacctccttagaaaagact

SEQ ID NO: 2193333 - DNA, 16 bp, Homo sapiens
gatgactgaatttcta

SEQ ID NO: 2193334 - DNA, 13 bp, Homo sapiens
gatgagaaaaaac

SEQ ID NO: 2193335 - DNA, 13 bp, Homo sapiens
gatgagaaacagc

SEQ ID NO: 2193336 - DNA, 17 bp, Homo sapiens
gatgagaaacagctcag

SEQ ID NO: 2193337 - DNA, 19 bp, Homo sapiens
gatgagaaacagctcagcc

SEQ ID NO: 2193338 - DNA, 20 bp, Homo sapiens
gatgagaattcagctgcccc

SEQ ID NO: 2193339 - DNA, 11 bp, Homo sapiens
gatgagctggt

SEQ ID NO: 2193340 - DNA, 20 bp, Homo sapiens
gatgaggtcaccaggggagg

SEQ ID NO: 2193341 - DNA, 12 bp, Homo sapiens
gatgccctgcta

SEQ ID NO: 2193342 - DNA, 23 bp, Homo sapiens
gatgctggaaatatgaaatgtat

SEQ ID NO: 2193343 - DNA, 20 bp, Homo sapiens
gatggggagatcggggccag

SEQ ID NO: 2193344 - DNA, 14 bp, Homo sapiens
gatggggccacagc

SEQ ID NO: 2193345 - DNA, 20 bp, Homo sapiens
gatgggggtgcaggcagcct

SEQ ID NO: 2193346 - DNA, 10 bp, Homo sapiens
gatgggtggg

SEQ ID NO: 2193347 - DNA, 13 bp, Homo sapiens
gatgtatgcccaa

SEQ ID NO: 2193348 - DNA, 19 bp, Homo sapiens
gatgtattaacctacctgt

SEQ ID NO: 2193349 - DNA, 20 bp, Homo sapiens
gatgtattaacctacctgtg

SEQ ID NO: 2193350 - DNA, 13 bp, Homo sapiens
gatgtcatcttga

SEQ ID NO: 2193351 - DNA, 19 bp, Homo sapiens
gatgtcttagtgacttagt

SEQ ID NO: 2193352 - DNA, 15 bp, Homo sapiens
gatgtcttgagagcg

SEQ ID NO: 2193353 - DNA, 15 bp, Homo sapiens
gatgtgtatgtgttt

SEQ ID NO: 2193354 - DNA, 13 bp, Homo sapiens
gattaacacactg

SEQ ID NO: 2193355 - DNA, 23 bp, Homo sapiens
gattaacggtgctaaccccgtct

SEQ ID NO: 2193356 - DNA, 23 bp, Homo sapiens
gattaatgtgtatttactgtact

SEQ ID NO: 2193357 - DNA, 15 bp, Homo sapiens
gattacaggtgactg

SEQ ID NO: 2193358 - DNA, 15 bp, Homo sapiens
gattatacaaaaaaa

SEQ ID NO: 2193359 - DNA, 23 bp, Homo sapiens
gattatcatttatttttaaaata

SEQ ID NO: 2193360 - DNA, 14 bp, Homo sapiens
gattccatctcctt

SEQ ID NO: 2193361 - DNA, 19 bp, Homo sapiens
gattccatctccttgtctt

SEQ ID NO: 2193362 - DNA, 17 bp, Homo sapiens
gattcgaaggatgaaga

SEQ ID NO: 2193363 - DNA, 18 bp, Homo sapiens
gattctcaaaggagcgag

SEQ ID NO: 2193364 - DNA, 23 bp, Homo sapiens
gattctgtcttccaggcccagtc

SEQ ID NO: 2193365 - DNA, 21 bp, Homo sapiens
gattcttttttcttccccctc

SEQ ID NO: 2193366 - DNA, 18 bp, Homo sapiens
gattgcaaagggacattg

SEQ ID NO: 2193367 - DNA, 18 bp, Homo sapiens
gattgctctggaagcctg

SEQ ID NO: 2193368 - DNA, 20 bp, Homo sapiens
gatttaatttgttgttaata

SEQ ID NO: 2193369 - DNA, 20 bp, Homo sapiens
gatttatttggagtggaggc

SEQ ID NO: 2193370 - DNA, 17 bp, Homo sapiens
gatttcaagggactggg

SEQ ID NO: 2193371 - DNA, 18 bp, Homo sapiens
gatttcagcacatgcact

SEQ ID NO: 2193372 - DNA, 17 bp, Homo sapiens
gatttctgccttccttg

SEQ ID NO: 2193373 - DNA, 15 bp, Homo sapiens
gatttgaaacttggt

SEQ ID NO: 2193374 - DNA, 11 bp, Homo sapiens
gatttgcatgt

SEQ ID NO: 2193375 - DNA, 11 bp, Homo sapiens
gatttgctgtt

SEQ ID NO: 2193376 - DNA, 17 bp, Homo sapiens
gattttcttttgccttt

SEQ ID NO: 2193377 - DNA, 21 bp, Homo sapiens
gattttttttttaacttgaaa

SEQ ID NO: 2193378 - DNA, 18 bp, Homo sapiens
gcaaaagaagttgatctg

SEQ ID NO: 2193379 - DNA, 21 bp, Homo sapiens
gcaggtcactgaaacttcaag

SEQ ID NO: 2193380 - DNA, 22 bp, Homo sapiens
gcagtctctcttacccttctgt

SEQ ID NO: 2193381 - DNA, 21 bp, Homo sapiens
gcagtgagcagggttcctgtg

SEQ ID NO: 2193382 - DNA, 22 bp, Homo sapiens
gcagtgcccagtgatggcatta

SEQ ID NO: 2193383 - DNA, 17 bp, Homo sapiens
gcagtgcctttccccat

SEQ ID NO: 2193384 - DNA, 16 bp, Homo sapiens
gcagtggactgtgtcc

SEQ ID NO: 2193385 - DNA, 17 bp, Homo sapiens
gcagtggactgtgtccc

SEQ ID NO: 2193386 - DNA, 21 bp, Homo sapiens
gcagtggtgcgatcatggctc

SEQ ID NO: 2193387 - DNA, 16 bp, Homo sapiens
gcagtgtgtctcctgc

SEQ ID NO: 2193388 - DNA, 18 bp, Homo sapiens
gcagtgtgtctcctgcat

SEQ ID NO: 2193389 - DNA, 18 bp, Homo sapiens
gcagtgtttaaaaaatga

SEQ ID NO: 2193390 - DNA, 19 bp, Homo sapiens
gcagttagagatgcctccc

SEQ ID NO: 2193391 - DNA, 16 bp, Homo sapiens
gcagttcatactgaat

SEQ ID NO: 2193392 - DNA, 19 bp, Homo sapiens
gcagttcatactgaatgac

SEQ ID NO: 2193393 - DNA, 13 bp, Homo sapiens
gcagtttcccaga

SEQ ID NO: 2193394 - DNA, 14 bp, Homo sapiens
gcagtttcccagaa

SEQ ID NO: 2193395 - DNA, 19 bp, Homo sapiens
gcatatattcatacctgtt

SEQ ID NO: 2193396 - DNA, 18 bp, Homo sapiens
gcatcattccaccatggc

SEQ ID NO: 2193397 - DNA, 15 bp, Homo sapiens
gcatccacctccttc

SEQ ID NO: 2193398 - DNA, 22 bp, Homo sapiens
gcatgcaaaatatacactcatc

SEQ ID NO: 2193399 - DNA, 14 bp, Homo sapiens
gcatgcagaaaggg

SEQ ID NO: 2193400 - DNA, 19 bp, Homo sapiens
gcatgcagtcttgtactgt

SEQ ID NO: 2193401 - DNA, 22 bp, Homo sapiens
gcatgctttggaaatttggaag

SEQ ID NO: 2193402 - DNA, 19 bp, Homo sapiens
gcatgtacaaaagtaccat

SEQ ID NO: 2193403 - DNA, 13 bp, Homo sapiens
gcattactctgca

SEQ ID NO: 2193404 - DNA, 19 bp, Homo sapiens
gactgaccttgatgtcttg

SEQ ID NO: 2193405 - DNA, 15 bp, Homo sapiens
gactgagtgggaagc

SEQ ID NO: 2193406 - DNA, 22 bp, Homo sapiens
gactgagtgggaagcccatcct

SEQ ID NO: 2193407 - DNA, 14 bp, Homo sapiens
gactgatgtcatct

SEQ ID NO: 2193408 - DNA, 15 bp, Homo sapiens
gactgatgtcatctt

SEQ ID NO: 2193409 - DNA, 17 bp, Homo sapiens
gactgcaagtgagcaaa

SEQ ID NO: 2193410 - DNA, 21 bp, Homo sapiens
gactgcaagtgagcaaacctg

SEQ ID NO: 2193411 - DNA, 13 bp, Homo sapiens
gactgcaccttgt

SEQ ID NO: 2193412 - DNA, 13 bp, Homo sapiens
gactgccaagcca

SEQ ID NO: 2193413 - DNA, 20 bp, Homo sapiens
gactgccaagccagattctc

SEQ ID NO: 2193414 - DNA, 14 bp, Homo sapiens
gactggcaccaaca

SEQ ID NO: 2193415 - DNA, 22 bp, Homo sapiens
gactgggggtgccaaccacctc

SEQ ID NO: 2193416 - DNA, 21 bp, Homo sapiens
gactgtgatttatttggagtg

SEQ ID NO: 2193417 - DNA, 13 bp, Homo sapiens
gacttccatttgg

SEQ ID NO: 2193418 - DNA, 19 bp, Homo sapiens
gacttcttcggaggtggca

SEQ ID NO: 2193419 - DNA, 21 bp, Homo sapiens
gacttgaattcaaagcatgtc

SEQ ID NO: 2193420 - DNA, 21 bp, Homo sapiens
gacttggccgcttccctaccc

SEQ ID NO: 2193421 - DNA, 22 bp, Homo sapiens
gacttggccgcttccctaccca

SEQ ID NO: 2193422 - DNA, 20 bp, Homo sapiens
gacttgggagagggagcaag

SEQ ID NO: 2193423 - DNA, 14 bp, Homo sapiens
gacttgtgcctctt

SEQ ID NO: 2193424 - DNA, 16 bp, Homo sapiens
gacttgtgcctcttgg

SEQ ID NO: 2193425 - DNA, 22 bp, Homo sapiens
gactttgcccagggtcctgtgc

SEQ ID NO: 2193426 - DNA, 19 bp, Homo sapiens
gacttttacagcttttctc

SEQ ID NO: 2193427 - DNA, 23 bp, Homo sapiens
gagaaaacttcgtaagaacatgt

SEQ ID NO: 2193428 - DNA, 14 bp, Homo sapiens
gagaaacagctcag

SEQ ID NO: 2193429 - DNA, 15 bp, Homo sapiens
gagaaacagctcagc

SEQ ID NO: 2193430 - DNA, 18 bp, Homo sapiens
gagaaagagagaagccag

SEQ ID NO: 2193431 - DNA, 15 bp, Homo sapiens
gagaaagagctgcct

SEQ ID NO: 2193432 - DNA, 17 bp, Homo sapiens
gagaaagagctgcctgg

SEQ ID NO: 2193433 - DNA, 21 bp, Homo sapiens
gagaaagttactgttaagggt

SEQ ID NO: 2193434 - DNA, 20 bp, Homo sapiens
gagaacagatctccaaagct

SEQ ID NO: 2193435 - DNA, 13 bp, Homo sapiens
gagaacagtggtt

SEQ ID NO: 2193436 - DNA, 20 bp, Homo sapiens
gagaacatctgccttgctgc

SEQ ID NO: 2193437 - DNA, 22 bp, Homo sapiens
gagaacatctgccttgctgcac

SEQ ID NO: 2193438 - DNA, 13 bp, Homo sapiens
gagaagccagcca

SEQ ID NO: 2193439 - DNA, 19 bp, Homo sapiens
gagaagccagccacagacc

SEQ ID NO: 2193440 - DNA, 15 bp, Homo sapiens
gagaaggagaggctc

SEQ ID NO: 2193441 - DNA, 18 bp, Homo sapiens
gagaaggagaggctctga

SEQ ID NO: 2193442 - DNA, 18 bp, Homo sapiens
gagaaggcaagctggcag

SEQ ID NO: 2193443 - DNA, 15 bp, Homo sapiens
gagaagtcggccagg

SEQ ID NO: 2193444 - DNA, 19 bp, Homo sapiens
gagaatgagagagtgtgga

SEQ ID NO: 2193445 - DNA, 23 bp, Homo sapiens
gagaatgggtaattcaagaggcc

SEQ ID NO: 2193446 - DNA, 12 bp, Homo sapiens
gagaattaaaat

SEQ ID NO: 2193447 - DNA, 18 bp, Homo sapiens
gagaattcagctgccccc

SEQ ID NO: 2193448 - DNA, 17 bp, Homo sapiens
gagacaatgcagatgcc

SEQ ID NO: 2193449 - DNA, 23 bp, Homo sapiens
gagacaatgcagatgccagagca

SEQ ID NO: 2193450 - DNA, 21 bp, Homo sapiens
gagacacatacagagtgggcc

SEQ ID NO: 2193451 - DNA, 13 bp, Homo sapiens
gagacacctcaga

SEQ ID NO: 2193452 - DNA, 21 bp, Homo sapiens
gagacacctcagagccccgca

SEQ ID NO: 2193453 - DNA, 20 bp, Homo sapiens
gagacagccggatcttggag

SEQ ID NO: 2193454 - DNA, 17 bp, Homo sapiens
gagaccaagccggtgcc

SEQ ID NO: 2193455 - DNA, 18 bp, Homo sapiens
gagaccagcctttcttcc

SEQ ID NO: 2193456 - DNA, 16 bp, Homo sapiens
gagaccccgcacccgg

SEQ ID NO: 2193457 - DNA, 18 bp, Homo sapiens
gagaccccgcacccggct

SEQ ID NO: 2193458 - DNA, 18 bp, Homo sapiens
gagagaaagagagaagcc

SEQ ID NO: 2193459 - DNA, 20 bp, Homo sapiens
gagagaaagagagaagccag

SEQ ID NO: 2193460 - DNA, 15 bp, Homo sapiens
gagagaacagggatg

SEQ ID NO: 2193461 - DNA, 15 bp, Homo sapiens
gagagaagccagcca

SEQ ID NO: 2193462 - DNA, 17 bp, Homo sapiens
gagagaagccagccaca

SEQ ID NO: 2193463 - DNA, 18 bp, Homo sapiens
gagagaagccagccacag

SEQ ID NO: 2193464 - DNA, 19 bp, Homo sapiens
gagagaccccgcacccggc

SEQ ID NO: 2193465 - DNA, 21 bp, Homo sapiens
gagagaccccgcacccggctc

SEQ ID NO: 2193466 - DNA, 20 bp, Homo sapiens
gagagccaaggcctatgcca

SEQ ID NO: 2193467 - DNA, 15 bp, Homo sapiens
gagaggaaaaaggct

SEQ ID NO: 2193468 - DNA, 13 bp, Homo sapiens
gagaggagagaat

SEQ ID NO: 2193469 - DNA, 18 bp, Homo sapiens
gagagggaaacgtgccct

SEQ ID NO: 2193470 - DNA, 21 bp, Homo sapiens
gagaggggcctctggctgcct

SEQ ID NO: 2193471 - DNA, 19 bp, Homo sapiens
gagatagttggttctttta

SEQ ID NO: 2193472 - DNA, 16 bp, Homo sapiens
gagatcggggccagag

SEQ ID NO: 2193473 - DNA, 17 bp, Homo sapiens
gagatcggggtggcaga

SEQ ID NO: 2193474 - DNA, 12 bp, Homo sapiens
gagatgcctccc

SEQ ID NO: 2193475 - DNA, 14 bp, Homo sapiens
gagcaaacctgccc

SEQ ID NO: 2193476 - DNA, 22 bp, Homo sapiens
gagcaaatttcatctttccaaa

SEQ ID NO: 2193477 - DNA, 18 bp, Homo sapiens
gagcacaaaagcctctca

SEQ ID NO: 2193478 - DNA, 20 bp, Homo sapiens
gagcacacaacaggctgtgt

SEQ ID NO: 2193479 - DNA, 21 bp, Homo sapiens
gagcaggttccccaagggccc

SEQ ID NO: 2193480 - DNA, 14 bp, Homo sapiens
gagcatccacctcc

SEQ ID NO: 2193481 - DNA, 18 bp, Homo sapiens
gagcatccacctccttct

SEQ ID NO: 2193482 - DNA, 13 bp, Homo sapiens
gagccaaggccta

SEQ ID NO: 2193483 - DNA, 22 bp, Homo sapiens
gagccaatggagtagacccctg

SEQ ID NO: 2193484 - DNA, 14 bp, Homo sapiens
gagccacaggcaga

SEQ ID NO: 2193485 - DNA, 15 bp, Homo sapiens
gagccaccacaccca

SEQ ID NO: 2193486 - DNA, 19 bp, Homo sapiens
gagccaccacacccagcct

SEQ ID NO: 2193487 - DNA, 18 bp, Homo sapiens
gagccacccaggccactg

SEQ ID NO: 2193488 - DNA, 21 bp, Homo sapiens
gagccagggttttttggccta

SEQ ID NO: 2193489 - DNA, 15 bp, Homo sapiens
gagccccctgtcctt

SEQ ID NO: 2193490 - DNA, 14 bp, Homo sapiens
gagccgttcctggg

SEQ ID NO: 2193491 - DNA, 21 bp, Homo sapiens
gagcctccctcaattccccct

SEQ ID NO: 2193492 - DNA, 18 bp, Homo sapiens
gagcctgcccggccggag

SEQ ID NO: 2193493 - DNA, 15 bp, Homo sapiens
gagcctgcggctgct

SEQ ID NO: 2193494 - DNA, 18 bp, Homo sapiens
gagcctgtgcgtcccagc

SEQ ID NO: 2193495 - DNA, 19 bp, Homo sapiens
gagcctgtgcgtcccagct

SEQ ID NO: 2193496 - DNA, 14 bp, Homo sapiens
gagcgctggcctct

SEQ ID NO: 2193497 - DNA, 12 bp, Homo sapiens
gagcggccgcct

SEQ ID NO: 2193498 - DNA, 20 bp, Homo sapiens
gagctacttgggccatagct

SEQ ID NO: 2193499 - DNA, 23 bp, Homo sapiens
gagctagagaggggcctctggct

SEQ ID NO: 2193500 - DNA, 14 bp, Homo sapiens
gagctagtgtcacc

SEQ ID NO: 2193501 - DNA, 13 bp, Homo sapiens
gagctcaggagag

SEQ ID NO: 2193502 - DNA, 19 bp, Homo sapiens
gagctctatgggcagatct

SEQ ID NO: 2193503 - DNA, 17 bp, Homo sapiens
gagctctggagccacct

SEQ ID NO: 2193504 - DNA, 17 bp, Homo sapiens
gagctgcctaagaggca

SEQ ID NO: 2193505 - DNA, 12 bp, Homo sapiens
gagctgcctgga

SEQ ID NO: 2193506 - DNA, 21 bp, Homo sapiens
gagctggcctattttggacgt

SEQ ID NO: 2193507 - DNA, 14 bp, Homo sapiens
gagctggcgtcacc

SEQ ID NO: 2193508 - DNA, 22 bp, Homo sapiens
gagcttcaagtctgtgcctgga

SEQ ID NO: 2193509 - DNA, 20 bp, Homo sapiens
gagcttgctggagagtggca

SEQ ID NO: 2193510 - DNA, 14 bp, Homo sapiens
gagctttggacaca

SEQ ID NO: 2193511 - DNA, 21 bp, Homo sapiens
gaggaagcacaagaagtggga

SEQ ID NO: 2193512 - DNA, 18 bp, Homo sapiens
gaggaatcttttactgtg

SEQ ID NO: 2193513 - DNA, 18 bp, Homo sapiens
gaggaattggggtttctg

SEQ ID NO: 2193514 - DNA, 20 bp, Homo sapiens
gaggacccaggaaaggcagg

SEQ ID NO: 2193515 - DNA, 14 bp, Homo sapiens
ccttaagtggctgt

SEQ ID NO: 2193516 - DNA, 13 bp, Homo sapiens
ccttacacttact

SEQ ID NO: 2193517 - DNA, 19 bp, Homo sapiens
ccttaccataccactttga

SEQ ID NO: 2193518 - DNA, 18 bp, Homo sapiens
ccttaccctactggctgt

SEQ ID NO: 2193519 - DNA, 14 bp, Homo sapiens
ccttagcagcttct

SEQ ID NO: 2193520 - DNA, 17 bp, Homo sapiens
ccttagcagcttctgtc

SEQ ID NO: 2193521 - DNA, 22 bp, Homo sapiens
ccttatggatttggactcgaaa

SEQ ID NO: 2193522 - DNA, 19 bp, Homo sapiens
ccttatttttatttatttt

SEQ ID NO: 2193523 - DNA, 13 bp, Homo sapiens
ccttcccacggcc

SEQ ID NO: 2193524 - DNA, 18 bp, Homo sapiens
ccttcccacggccactgc

SEQ ID NO: 2193525 - DNA, 12 bp, Homo sapiens
ccttcctcctta

SEQ ID NO: 2193526 - DNA, 22 bp, Homo sapiens
ccttcctctgcctttgttcact

SEQ ID NO: 2193527 - DNA, 18 bp, Homo sapiens
ccttctagattcactgtc

SEQ ID NO: 2193528 - DNA, 12 bp, Homo sapiens
ccttctcctctt

SEQ ID NO: 2193529 - DNA, 17 bp, Homo sapiens
ccttctctgtctcatgt

SEQ ID NO: 2193530 - DNA, 21 bp, Homo sapiens
ccttctgtgcccagctcagtc

SEQ ID NO: 2193531 - DNA, 21 bp, Homo sapiens
ccttcttttgaccccttcctg

SEQ ID NO: 2193532 - DNA, 18 bp, Homo sapiens
ccttgaggagtcttgtgt

SEQ ID NO: 2193533 - DNA, 16 bp, Homo sapiens
ccttgccaaggccgcc

SEQ ID NO: 2193534 - DNA, 19 bp, Homo sapiens
ccttgccaaggccgcccac

SEQ ID NO: 2193535 - DNA, 22 bp, Homo sapiens
ccttgccaaggccgcccacctg

SEQ ID NO: 2193536 - DNA, 21 bp, Homo sapiens
ccttgctgggtccagggtagg

SEQ ID NO: 2193537 - DNA, 20 bp, Homo sapiens
ccttgctttcggagctcctg

SEQ ID NO: 2193538 - DNA, 19 bp, Homo sapiens
ccttgtagaggagcagggt

SEQ ID NO: 2193539 - DNA, 16 bp, Homo sapiens
ccttgtccccacactc

SEQ ID NO: 2193540 - DNA, 22 bp, Homo sapiens
ccttgtgaaggaaaaacatgct

SEQ ID NO: 2193541 - DNA, 20 bp, Homo sapiens
ccttgttttgtgacattttt

SEQ ID NO: 2193542 - DNA, 16 bp, Homo sapiens
cctttaaaaatgtata

SEQ ID NO: 2193543 - DNA, 12 bp, Homo sapiens
cctttattcttt

SEQ ID NO: 2193544 - DNA, 14 bp, Homo sapiens
cctttctatgttca

SEQ ID NO: 2193545 - DNA, 19 bp, Homo sapiens
cctttgctccaccccactc

SEQ ID NO: 2193546 - DNA, 20 bp, Homo sapiens
cctttgctccaccccactca

SEQ ID NO: 2193547 - DNA, 16 bp, Homo sapiens
ccttttctggctcctg

SEQ ID NO: 2193548 - DNA, 14 bp, Homo sapiens
cctttttccttgtc

SEQ ID NO: 2193549 - DNA, 19 bp, Homo sapiens
cctttttttttgttttgtt

SEQ ID NO: 2193550 - DNA, 13 bp, Homo sapiens
cgaaactgctcta

SEQ ID NO: 2193551 - DNA, 12 bp, Homo sapiens
cgaagctgagcg

SEQ ID NO: 2193552 - DNA, 22 bp, Homo sapiens
cgaagtcttccatcagcagtga

SEQ ID NO: 2193553 - DNA, 13 bp, Homo sapiens
cgacaagaatgtc

SEQ ID NO: 2193554 - DNA, 14 bp, Homo sapiens
cgactctcctgcct

SEQ ID NO: 2193555 - DNA, 19 bp, Homo sapiens
cgagaaagaggcaccagga

SEQ ID NO: 2193556 - DNA, 18 bp, Homo sapiens
cgagatcggggtggcaga

SEQ ID NO: 2193557 - DNA, 19 bp, Homo sapiens
cgagatcggggtggcagaa

SEQ ID NO: 2193558 - DNA, 15 bp, Homo sapiens
cgagccccctgtcct

SEQ ID NO: 2193559 - DNA, 17 bp, Homo sapiens
cgagccccctgtccttc

SEQ ID NO: 2193560 - DNA, 13 bp, Homo sapiens
cgaggctgggcca

SEQ ID NO: 2193561 - DNA, 17 bp, Homo sapiens
cgaggctgggccaagcc

SEQ ID NO: 2193562 - DNA, 18 bp, Homo sapiens
cgagggccgaggagcgcc

SEQ ID NO: 2193563 - DNA, 13 bp, Homo sapiens
cgaggggcaggga

SEQ ID NO: 2193564 - DNA, 14 bp, Homo sapiens
cgaggtcaaggaga

SEQ ID NO: 2193565 - DNA, 20 bp, Homo sapiens
cgagtggatagatgccctgc

SEQ ID NO: 2193566 - DNA, 21 bp, Homo sapiens
cgagtggatagatgccctgct

SEQ ID NO: 2193567 - DNA, 22 bp, Homo sapiens
cgagtggatagatgccctgcta

SEQ ID NO: 2193568 - DNA, 21 bp, Homo sapiens
cgatcatggctcactgcagcc

SEQ ID NO: 2193569 - DNA, 23 bp, Homo sapiens
cgatcatggctcactgcagcctc

SEQ ID NO: 2193570 - DNA, 22 bp, Homo sapiens
cgcagagactggggcctggact

SEQ ID NO: 2193571 - DNA, 14 bp, Homo sapiens
cgcagctccttccc

SEQ ID NO: 2193572 - DNA, 13 bp, Homo sapiens
cgcagggccctct

SEQ ID NO: 2193573 - DNA, 17 bp, Homo sapiens
cgcagtgcccagtgatg

SEQ ID NO: 2193574 - DNA, 15 bp, Homo sapiens
cgcatccagccgtgc

SEQ ID NO: 2193575 - DNA, 23 bp, Homo sapiens
cgccacatccccgctggctgggg

SEQ ID NO: 2193576 - DNA, 16 bp, Homo sapiens
cgccacggcctggctg

SEQ ID NO: 2193577 - DNA, 19 bp, Homo sapiens
cgccacggcctggctggtg

SEQ ID NO: 2193578 - DNA, 17 bp, Homo sapiens
cgcccgggtccgggcag

SEQ ID NO: 2193579 - DNA, 13 bp, Homo sapiens
cgccctccctcct

SEQ ID NO: 2193580 - DNA, 19 bp, Homo sapiens
cgccctcttcccctctaat

SEQ ID NO: 2193581 - DNA, 21 bp, Homo sapiens
cgcctggcagtccgtgggacg

SEQ ID NO: 2193582 - DNA, 12 bp, Homo sapiens
cgcctgtccttg

SEQ ID NO: 2193583 - DNA, 23 bp, Homo sapiens
cgcctgtgcccttgctgggtcca

SEQ ID NO: 2193584 - DNA, 19 bp, Homo sapiens
cgcggttcaggtcagggct

SEQ ID NO: 2193585 - DNA, 20 bp, Homo sapiens
cgcggttcaggtcagggcta

SEQ ID NO: 2193586 - DNA, 21 bp, Homo sapiens
cgctacaagagggcaaagctg

SEQ ID NO: 2193587 - DNA, 13 bp, Homo sapiens
cgctggctgcact

SEQ ID NO: 2193588 - DNA, 14 bp, Homo sapiens
cgctggctgggggc

SEQ ID NO: 2193589 - DNA, 18 bp, Homo sapiens
cgctgggcggtgcggagc

SEQ ID NO: 2193590 - DNA, 15 bp, Homo sapiens
ctgctctgcccagag

SEQ ID NO: 2193591 - DNA, 17 bp, Homo sapiens
ctgctctgcccagagct

SEQ ID NO: 2193592 - DNA, 18 bp, Homo sapiens
ctgctctgcccagagctg

SEQ ID NO: 2193593 - DNA, 21 bp, Homo sapiens
ctgctctgcccagagctgggt

SEQ ID NO: 2193594 - DNA, 14 bp, Homo sapiens
ctgctctttgaact

SEQ ID NO: 2193595 - DNA, 16 bp, Homo sapiens
ctgctgaatgcctcgc

SEQ ID NO: 2193596 - DNA, 19 bp, Homo sapiens
ctgctgacagatgttccat

SEQ ID NO: 2193597 - DNA, 13 bp, Homo sapiens
ctgctgatttcta

SEQ ID NO: 2193598 - DNA, 21 bp, Homo sapiens
ctgctgccatgattttggcca

SEQ ID NO: 2193599 - DNA, 16 bp, Homo sapiens
ctgctgccccaaagga

SEQ ID NO: 2193600 - DNA, 16 bp, Homo sapiens
ctgctggccgggcaca

SEQ ID NO: 2193601 - DNA, 22 bp, Homo sapiens
gctcccttcaagacgaggggca

SEQ ID NO: 2193602 - DNA, 19 bp, Homo sapiens
gctccgcctggcacccact

SEQ ID NO: 2193603 - DNA, 14 bp, Homo sapiens
gctccgctgtgtgg

SEQ ID NO: 2193604 - DNA, 12 bp, Homo sapiens
gctcctccctcc

SEQ ID NO: 2193605 - DNA, 17 bp, Homo sapiens
gctcctgctccacagcc

SEQ ID NO: 2193606 - DNA, 20 bp, Homo sapiens
gctcctgctccacagccatc

SEQ ID NO: 2193607 - DNA, 11 bp, Homo sapiens
gctcctggagc

SEQ ID NO: 2193608 - DNA, 13 bp, Homo sapiens
gctcctggagcca

SEQ ID NO: 2193609 - DNA, 15 bp, Homo sapiens
gctcctggagccagc

SEQ ID NO: 2193610 - DNA, 19 bp, Homo sapiens
gctcctggagccagccacc

SEQ ID NO: 2193611 - DNA, 12 bp, Homo sapiens
gctcctgggaag

SEQ ID NO: 2193612 - DNA, 22 bp, Homo sapiens
gctcctgggaaggctactcacc

SEQ ID NO: 2193613 - DNA, 22 bp, Homo sapiens
gctcctggtatgggtttctccc

SEQ ID NO: 2193614 - DNA, 13 bp, Homo sapiens
gctcgtgggctct

SEQ ID NO: 2193615 - DNA, 14 bp, Homo sapiens
gctctatttattaa

SEQ ID NO: 2193616 - DNA, 13 bp, Homo sapiens
gctctctacccag

SEQ ID NO: 2193617 - DNA, 17 bp, Homo sapiens
gctctctacccagccca

SEQ ID NO: 2193618 - DNA, 18 bp, Homo sapiens
gctctgaaagctgcttct

SEQ ID NO: 2193619 - DNA, 13 bp, Homo sapiens
gctctgcacagac

SEQ ID NO: 2193620 - DNA, 22 bp, Homo sapiens
gctctgcacagacaagcagccc

SEQ ID NO: 2193621 - DNA, 23 bp, Homo sapiens
gctctgcacagacaagcagccct

SEQ ID NO: 2193622 - DNA, 13 bp, Homo sapiens
gctctgcccagag

SEQ ID NO: 2193623 - DNA, 20 bp, Homo sapiens
gctctgcccagagctgggtg

SEQ ID NO: 2193624 - DNA, 13 bp, Homo sapiens
gctctggaagcct

SEQ ID NO: 2193625 - DNA, 14 bp, Homo sapiens
gctctggaagcctg

SEQ ID NO: 2193626 - DNA, 15 bp, Homo sapiens
gctctggaagcctgc

SEQ ID NO: 2193627 - DNA, 20 bp, Homo sapiens
gctctggagccacctgtccc

SEQ ID NO: 2193628 - DNA, 15 bp, Homo sapiens
gctctggctcacaga

SEQ ID NO: 2193629 - DNA, 22 bp, Homo sapiens
gctctggctcacagactggaga

SEQ ID NO: 2193630 - DNA, 11 bp, Homo sapiens
gctctggctcc

SEQ ID NO: 2193631 - DNA, 15 bp, Homo sapiens
gctctggctccctgg

SEQ ID NO: 2193632 - DNA, 15 bp, Homo sapiens
gctctggtgggaaaa

SEQ ID NO: 2193633 - DNA, 16 bp, Homo sapiens
gctctggtgggaaaat

SEQ ID NO: 2193634 - DNA, 18 bp, Homo sapiens
gctctggtgggaaaatgt

SEQ ID NO: 2193635 - DNA, 16 bp, Homo sapiens
gctcttagtcctccct

SEQ ID NO: 2193636 - DNA, 21 bp, Homo sapiens
gctcttagtcctccctgctca

SEQ ID NO: 2193637 - DNA, 18 bp, Homo sapiens
gctcttctcctcagcttg

SEQ ID NO: 2193638 - DNA, 15 bp, Homo sapiens
gctcttgcagagaag

SEQ ID NO: 2193639 - DNA, 18 bp, Homo sapiens
gctcttgcagagaagcct

SEQ ID NO: 2193640 - DNA, 22 bp, Homo sapiens
gctcttgccttatctgttcctt

SEQ ID NO: 2193641 - DNA, 23 bp, Homo sapiens
gctgaactgtgcatcaaccagga

SEQ ID NO: 2193642 - DNA, 15 bp, Homo sapiens
gctgaaggcagtggc

SEQ ID NO: 2193643 - DNA, 16 bp, Homo sapiens
gctgacagatgttcca

SEQ ID NO: 2193644 - DNA, 19 bp, Homo sapiens
gctgatagcatatattcat

SEQ ID NO: 2193645 - DNA, 21 bp, Homo sapiens
gctgatttggtcaccttcctc

SEQ ID NO: 2193646 - DNA, 23 bp, Homo sapiens
gctgattttttttttaacttgaa

SEQ ID NO: 2193647 - DNA, 20 bp, Homo sapiens
gctgcacaccagttactgtt

SEQ ID NO: 2193648 - DNA, 13 bp, Homo sapiens
gctgcacctgagg

SEQ ID NO: 2193649 - DNA, 14 bp, Homo sapiens
gctgcatcccacca

SEQ ID NO: 2193650 - DNA, 16 bp, Homo sapiens
gctgcatccgtgagca

SEQ ID NO: 2193651 - DNA, 19 bp, Homo sapiens
gctgccgcgtgcgaccaga

SEQ ID NO: 2193652 - DNA, 14 bp, Homo sapiens
gctgccggctgcac

SEQ ID NO: 2193653 - DNA, 15 bp, Homo sapiens
gctgccggctgcacc

SEQ ID NO: 2193654 - DNA, 12 bp, Homo sapiens
gctgcctccctg

SEQ ID NO: 2193655 - DNA, 15 bp, Homo sapiens
gctgcgaactgtgca

SEQ ID NO: 2193656 - DNA, 20 bp, Homo sapiens
gctgctccgaggacccagga

SEQ ID NO: 2193657 - DNA, 13 bp, Homo sapiens
gctgctcctcgca

SEQ ID NO: 2193658 - DNA, 15 bp, Homo sapiens
gctgctctgcccaga

SEQ ID NO: 2193659 - DNA, 21 bp, Homo sapiens
gctgctctgcccagagctggg

SEQ ID NO: 2193660 - DNA, 21 bp, Homo sapiens
gctgctgaccagcactgaccc

SEQ ID NO: 2193661 - DNA, 22 bp, Homo sapiens
gctgctgaccagcactgacccc

SEQ ID NO: 2193662 - DNA, 16 bp, Homo sapiens
gctgctggcacagact

SEQ ID NO: 2193663 - DNA, 20 bp, Homo sapiens
gctgctggttttggtttcca

SEQ ID NO: 2193664 - DNA, 15 bp, Homo sapiens
gctgctgtggcatca

SEQ ID NO: 2193665 - DNA, 15 bp, Homo sapiens
gctgcttctggggga

SEQ ID NO: 2193666 - DNA, 19 bp, Homo sapiens
gctggaatggggacctggg

SEQ ID NO: 2193667 - DNA, 14 bp, Homo sapiens
gctggacaggtctg

SEQ ID NO: 2193668 - DNA, 13 bp, Homo sapiens
gctggagaaagag

SEQ ID NO: 2193669 - DNA, 16 bp, Homo sapiens
gctggagccactaact

SEQ ID NO: 2193670 - DNA, 19 bp, Homo sapiens
gctggccgggcacagctgt

SEQ ID NO: 2193671 - DNA, 12 bp, Homo sapiens
gctggcctcaga

SEQ ID NO: 2193672 - DNA, 20 bp, Homo sapiens
gctggcggaacctggctgcg

SEQ ID NO: 2193673 - DNA, 17 bp, Homo sapiens
gctggcgtcacctgtgc

SEQ ID NO: 2193674 - DNA, 11 bp, Homo sapiens
gctggctgggg

SEQ ID NO: 2193675 - DNA, 10 bp, Homo sapiens
gctgggagag

SEQ ID NO: 2193676 - DNA, 14 bp, Homo sapiens
gctgggagagccaa

SEQ ID NO: 2193677 - DNA, 16 bp, Homo sapiens
gctgggattacaggtg

SEQ ID NO: 2193678 - DNA, 20 bp, Homo sapiens
gctgggcagaggggagagga

SEQ ID NO: 2193679 - DNA, 13 bp, Homo sapiens
gctgggcccagag

SEQ ID NO: 2193680 - DNA, 16 bp, Homo sapiens
gctgggcccagaggca

SEQ ID NO: 2193681 - DNA, 18 bp, Homo sapiens
gctgggtttccacacagc

SEQ ID NO: 2193682 - DNA, 21 bp, Homo sapiens
gctgggtttccacacagcctg

SEQ ID NO: 2193683 - DNA, 15 bp, Homo sapiens
gctggtaagggccaa

SEQ ID NO: 2193684 - DNA, 12 bp, Homo sapiens
gctggtgggaag

SEQ ID NO: 2193685 - DNA, 15 bp, Homo sapiens
gctggtgggcaccaa

SEQ ID NO: 2193686 - DNA, 21 bp, Homo sapiens
gctgtaaaaacacaaatgtgt

SEQ ID NO: 2193687 - DNA, 11 bp, Homo sapiens
gctgtccctgc

SEQ ID NO: 2193688 - DNA, 16 bp, Homo sapiens
gctgtgaaaattacac

SEQ ID NO: 2193689 - DNA, 21 bp, Homo sapiens
gctgtggattttgtggcttca

SEQ ID NO: 2193690 - DNA, 15 bp, Homo sapiens
gctgtgggtcagtgt

SEQ ID NO: 2193691 - DNA, 23 bp, Homo sapiens
gctgtgggtcagtgtgccaccct

SEQ ID NO: 2193692 - DNA, 13 bp, Homo sapiens
gctgttgttcaga

SEQ ID NO: 2193693 - DNA, 18 bp, Homo sapiens
gctgttttagtgccaggc

SEQ ID NO: 2193694 - DNA, 16 bp, Homo sapiens
gcttagagcctccctc

SEQ ID NO: 2193695 - DNA, 18 bp, Homo sapiens
gcttcaagtctgtgcctg

SEQ ID NO: 2193696 - DNA, 14 bp, Homo sapiens
gcttcccaaataca

SEQ ID NO: 2193697 - DNA, 12 bp, Homo sapiens
gcttccctctgc

SEQ ID NO: 2193698 - DNA, 18 bp, Homo sapiens
gcttccgctttgaaagaa

SEQ ID NO: 2193699 - DNA, 22 bp, Homo sapiens
gcttccgctttgaaagaagcaa

SEQ ID NO: 2193700 - DNA, 16 bp, Homo sapiens
gcttctgacctcagca

SEQ ID NO: 2193701 - DNA, 12 bp, Homo sapiens
gcttctgggaag

SEQ ID NO: 2193702 - DNA, 23 bp, Homo sapiens
gcttgacgcgtggtcacaggacg

SEQ ID NO: 2193703 - DNA, 21 bp, Homo sapiens
gcttgctggagagtggcatca

SEQ ID NO: 2193704 - DNA, 14 bp, Homo sapiens
gcttgtactgggac

SEQ ID NO: 2193705 - DNA, 22 bp, Homo sapiens
gcttgtcatccacacaacacca

SEQ ID NO: 2193706 - DNA, 13 bp, Homo sapiens
gctttactgcctt

SEQ ID NO: 2193707 - DNA, 13 bp, Homo sapiens
gctttcctgagcc

SEQ ID NO: 2193708 - DNA, 19 bp, Homo sapiens
gctttctcctttaattgta

SEQ ID NO: 2193709 - DNA, 20 bp, Homo sapiens
gctttctctgcttcagcttg

SEQ ID NO: 2193710 - DNA, 15 bp, Homo sapiens
gctttgaaagaagca

SEQ ID NO: 2193711 - DNA, 19 bp, Homo sapiens
gctttgaaagaagcaagac

SEQ ID NO: 2193712 - DNA, 17 bp, Homo sapiens
gctttgattccatctcc

SEQ ID NO: 2193713 - DNA, 18 bp, Homo sapiens
gctttgcccaacctcagc

SEQ ID NO: 2193714 - DNA, 19 bp, Homo sapiens
gctttggacacacacagct

SEQ ID NO: 2193715 - DNA, 22 bp, Homo sapiens
gctttggacacacacagcttct

SEQ ID NO: 2193716 - DNA, 18 bp, Homo sapiens
gctttggacgcacacagc

SEQ ID NO: 2193717 - DNA, 12 bp, Homo sapiens
gctttgtcccac

SEQ ID NO: 2193718 - DNA, 20 bp, Homo sapiens
gcttttaaactggagaggct

SEQ ID NO: 2193719 - DNA, 14 bp, Homo sapiens
gcttttagtaccca

SEQ ID NO: 2193720 - DNA, 16 bp, Homo sapiens
gctttttgtgtttttt

SEQ ID NO: 2193721 - DNA, 13 bp, Homo sapiens
ggaaaaaggcttc

SEQ ID NO: 2193722 - DNA, 22 bp, Homo sapiens
ggaaaatgtcccccacctcttt

SEQ ID NO: 2193723 - DNA, 16 bp, Homo sapiens
ggaaagattgtgtctg

SEQ ID NO: 2193724 - DNA, 18 bp, Homo sapiens
ggaacctggaccaaagct

SEQ ID NO: 2193725 - DNA, 20 bp, Homo sapiens
ggaagagggagggtcagtgc

SEQ ID NO: 2193726 - DNA, 22 bp, Homo sapiens
ggaagagggagggtcagtgcca

SEQ ID NO: 2193727 - DNA, 14 bp, Homo sapiens
gccgatgagctggt

SEQ ID NO: 2193728 - DNA, 16 bp, Homo sapiens
gccgcccacctgcatc

SEQ ID NO: 2193729 - DNA, 20 bp, Homo sapiens
gccgcccacctgcatcagcc

SEQ ID NO: 2193730 - DNA, 14 bp, Homo sapiens
gccgcctagtgcag

SEQ ID NO: 2193731 - DNA, 16 bp, Homo sapiens
gccgctgggagagcca

SEQ ID NO: 2193732 - DNA, 23 bp, Homo sapiens
gccgggggtgggggcctgctgtg

SEQ ID NO: 2193733 - DNA, 17 bp, Homo sapiens
gccggtttgggagagac

SEQ ID NO: 2193734 - DNA, 23 bp, Homo sapiens
gcctaaagccagcatttcctcag

SEQ ID NO: 2193735 - DNA, 17 bp, Homo sapiens
gcctagcactcacatgc

SEQ ID NO: 2193736 - DNA, 23 bp, Homo sapiens
gcctagcactcacatgctggaca

SEQ ID NO: 2193737 - DNA, 19 bp, Homo sapiens
gcctatgccacctgcagcg

SEQ ID NO: 2193738 - DNA, 19 bp, Homo sapiens
gcctatttattcattcagt

SEQ ID NO: 2193739 - DNA, 18 bp, Homo sapiens
gcctcaataagccttgtc

SEQ ID NO: 2193740 - DNA, 20 bp, Homo sapiens
gcctcaccctgcttggggcc

SEQ ID NO: 2193741 - DNA, 23 bp, Homo sapiens
gcctcacctgggttccccacccc

SEQ ID NO: 2193742 - DNA, 21 bp, Homo sapiens
gcctcacctttcccacagtct

SEQ ID NO: 2193743 - DNA, 16 bp, Homo sapiens
gcctcactccaggaag

SEQ ID NO: 2193744 - DNA, 16 bp, Homo sapiens
gcctcagactcataca

SEQ ID NO: 2193745 - DNA, 16 bp, Homo sapiens
gcctcagcctcccgag

SEQ ID NO: 2193746 - DNA, 14 bp, Homo sapiens
gcctcaggctctgc

SEQ ID NO: 2193747 - DNA, 21 bp, Homo sapiens
gcctcattactttaccacccc

SEQ ID NO: 2193748 - DNA, 20 bp, Homo sapiens
gcctcctctaacaggggctg

SEQ ID NO: 2193749 - DNA, 22 bp, Homo sapiens
gcctcctctaacaggggctggt

SEQ ID NO: 2193750 - DNA, 20 bp, Homo sapiens
gcctcgaactcctgggctca

SEQ ID NO: 2193751 - DNA, 15 bp, Homo sapiens
gcctcgctcccttca

SEQ ID NO: 2193752 - DNA, 14 bp, Homo sapiens
gcctcgtgaggggc

SEQ ID NO: 2193753 - DNA, 15 bp, Homo sapiens
gcctcgtgaggggca

SEQ ID NO: 2193754 - DNA, 17 bp, Homo sapiens
gcctctagggacccctc

SEQ ID NO: 2193755 - DNA, 18 bp, Homo sapiens
gcctctagggacccctcc

SEQ ID NO: 2193756 - DNA, 17 bp, Homo sapiens
gcctctggaggcctctg

SEQ ID NO: 2193757 - DNA, 19 bp, Homo sapiens
gcctctggaggcctctggg

SEQ ID NO: 2193758 - DNA, 15 bp, Homo sapiens
gcctctggctgcctg

SEQ ID NO: 2193759 - DNA, 17 bp, Homo sapiens
gcctctggctgcctggc

SEQ ID NO: 2193760 - DNA, 20 bp, Homo sapiens
gcctctggctgcctggccca

SEQ ID NO: 2193761 - DNA, 22 bp, Homo sapiens
gcctcttcctccctccctgcag

SEQ ID NO: 2193762 - DNA, 23 bp, Homo sapiens
gcctcttcctccctccctgcagg

SEQ ID NO: 2193763 - DNA, 14 bp, Homo sapiens
gcctcttgaccagg

SEQ ID NO: 2193764 - DNA, 16 bp, Homo sapiens
gcctcttgaccaggct

SEQ ID NO: 2193765 - DNA, 17 bp, Homo sapiens
gcctcttgaccaggctg

SEQ ID NO: 2193766 - DNA, 15 bp, Homo sapiens
gcctcttgctggtgc

SEQ ID NO: 2193767 - DNA, 16 bp, Homo sapiens
gcctcttgctggtgca

SEQ ID NO: 2193768 - DNA, 16 bp, Homo sapiens
gcctcttgggagacgt

SEQ ID NO: 2193769 - DNA, 13 bp, Homo sapiens
gcctgaccttgag

SEQ ID NO: 2193770 - DNA, 15 bp, Homo sapiens
gcctgagttgagggg

SEQ ID NO: 2193771 - DNA, 11 bp, Homo sapiens
gcctgcagaag

SEQ ID NO: 2193772 - DNA, 18 bp, Homo sapiens
gcctgcgcagctccttcc

SEQ ID NO: 2193773 - DNA, 12 bp, Homo sapiens
gcctggagctcc

SEQ ID NO: 2193774 - DNA, 22 bp, Homo sapiens
gcctggatgagaaacagctcag

SEQ ID NO: 2193775 - DNA, 23 bp, Homo sapiens
gcctggatgggggtgcaggcagc

SEQ ID NO: 2193776 - DNA, 20 bp, Homo sapiens
gcctggcagtccgtgggacg

SEQ ID NO: 2193777 - DNA, 19 bp, Homo sapiens
gcctgggccactggcatct

SEQ ID NO: 2193778 - DNA, 21 bp, Homo sapiens
gcctggggatgtaaccaagct

SEQ ID NO: 2193779 - DNA, 15 bp, Homo sapiens
gcctgtcgtgttctc

SEQ ID NO: 2193780 - DNA, 19 bp, Homo sapiens
gcctgtgcgtcccagctga

SEQ ID NO: 2193781 - DNA, 22 bp, Homo sapiens
gcctgtgggagaagggacagcg

SEQ ID NO: 2193782 - DNA, 22 bp, Homo sapiens
gccttcaacaacgtgagagaaa

SEQ ID NO: 2193783 - DNA, 18 bp, Homo sapiens
gccttcctccatggccca

SEQ ID NO: 2193784 - DNA, 20 bp, Homo sapiens
gccttcctccatggcccatc

SEQ ID NO: 2193785 - DNA, 11 bp, Homo sapiens
gccttccttgc

SEQ ID NO: 2193786 - DNA, 17 bp, Homo sapiens
gccttctagattcactg

SEQ ID NO: 2193787 - DNA, 14 bp, Homo sapiens
gccttggcctccca

SEQ ID NO: 2193788 - DNA, 17 bp, Homo sapiens
gcctttgttcactgtga

SEQ ID NO: 2193789 - DNA, 18 bp, Homo sapiens
gccttttgcaaccaggaa

SEQ ID NO: 2193790 - DNA, 15 bp, Homo sapiens
gcgaagctgagcggg

SEQ ID NO: 2193791 - DNA, 20 bp, Homo sapiens
gcgactctcctgcctcagcc

SEQ ID NO: 2193792 - DNA, 22 bp, Homo sapiens
gcgactctcctgcctcagcctc

SEQ ID NO: 2193793 - DNA, 15 bp, Homo sapiens
gcgaggcgaagctga

SEQ ID NO: 2193794 - DNA, 18 bp, Homo sapiens
gcgaggcgaagctgagcg

SEQ ID NO: 2193795 - DNA, 18 bp, Homo sapiens
gcgatcatggctcactgc

SEQ ID NO: 2193796 - DNA, 10 bp, Homo sapiens
gcgatgtgtt

SEQ ID NO: 2193797 - DNA, 13 bp, Homo sapiens
gcgatgtgtttta

SEQ ID NO: 2193798 - DNA, 15 bp, Homo sapiens
gcgcagctccttccc

SEQ ID NO: 2193799 - DNA, 16 bp, Homo sapiens
gcgctttctcctgtgc

SEQ ID NO: 2193800 - DNA, 15 bp, Homo sapiens
gcggaacctggctgc

SEQ ID NO: 2193801 - DNA, 17 bp, Homo sapiens
gcggaggggatccagcc

SEQ ID NO: 2193802 - DNA, 20 bp, Homo sapiens
gcggaggggatccagccact

SEQ ID NO: 2193803 - DNA, 15 bp, Homo sapiens
gcggccgcctgtcct

SEQ ID NO: 2193804 - DNA, 21 bp, Homo sapiens
gcggttgtaaatacaattcaa

SEQ ID NO: 2193805 - DNA, 23 bp, Homo sapiens
gcggttgtaaatacaattcaaac

SEQ ID NO: 2193806 - DNA, 12 bp, Homo sapiens
gcgtaggagaga

SEQ ID NO: 2193807 - DNA, 15 bp, Homo sapiens
gcgtgcgaccagagg

SEQ ID NO: 2193808 - DNA, 16 bp, Homo sapiens
gcgtgtctgtttcctt

SEQ ID NO: 2193809 - DNA, 14 bp, Homo sapiens
gctaaagaggtggg

SEQ ID NO: 2193810 - DNA, 23 bp, Homo sapiens
gctaaagaggtggggtgaagctg

SEQ ID NO: 2193811 - DNA, 13 bp, Homo sapiens
gctaataaaaatt

SEQ ID NO: 2193812 - DNA, 12 bp, Homo sapiens
gctaataaagtt

SEQ ID NO: 2193813 - DNA, 23 bp, Homo sapiens
gctaatggatgtagccagggact

SEQ ID NO: 2193814 - DNA, 21 bp, Homo sapiens
gctaattacacacgtgtgatg

SEQ ID NO: 2193815 - DNA, 15 bp, Homo sapiens
gctacaagagggcaa

SEQ ID NO: 2193816 - DNA, 19 bp, Homo sapiens
gctacaagagggcaaagct

SEQ ID NO: 2193817 - DNA, 20 bp, Homo sapiens
gctacaagagggcaaagctg

SEQ ID NO: 2193818 - DNA, 22 bp, Homo sapiens
gctacaagagggcaaagctgat

SEQ ID NO: 2193819 - DNA, 19 bp, Homo sapiens
gctaccccccgtctcctgc

SEQ ID NO: 2193820 - DNA, 20 bp, Homo sapiens
gctaccccccgtctcctgcc

SEQ ID NO: 2193821 - DNA, 18 bp, Homo sapiens
gctacttgggccatagct

SEQ ID NO: 2193822 - DNA, 13 bp, Homo sapiens
gctagaaaaatta

SEQ ID NO: 2193823 - DNA, 22 bp, Homo sapiens
gctagagaggggcctctggctg

SEQ ID NO: 2193824 - DNA, 22 bp, Homo sapiens
gctagagcttcaagtctgtgcc

SEQ ID NO: 2193825 - DNA, 22 bp, Homo sapiens
gctagatgagaattcagctgcc

SEQ ID NO: 2193826 - DNA, 15 bp, Homo sapiens
gctagccactggaaa

SEQ ID NO: 2193827 - DNA, 21 bp, Homo sapiens
gctagctcccctcctctcccc

SEQ ID NO: 2193828 - DNA, 22 bp, Homo sapiens
gctagctcccctcctctcccct

SEQ ID NO: 2193829 - DNA, 17 bp, Homo sapiens
gctaggccccagaggcc

SEQ ID NO: 2193830 - DNA, 15 bp, Homo sapiens
gctagtgtcacctgc

SEQ ID NO: 2193831 - DNA, 18 bp, Homo sapiens
gctcaagcaatcctcctg

SEQ ID NO: 2193832 - DNA, 12 bp, Homo sapiens
gctcacgcctta

SEQ ID NO: 2193833 - DNA, 12 bp, Homo sapiens
gctcacggcagc

SEQ ID NO: 2193834 - DNA, 16 bp, Homo sapiens
gctcactatggtgcca

SEQ ID NO: 2193835 - DNA, 18 bp, Homo sapiens
gctcactatggtgccaat

SEQ ID NO: 2193836 - DNA, 13 bp, Homo sapiens
gctcactgcagcc

SEQ ID NO: 2193837 - DNA, 12 bp, Homo sapiens
gctcagccccag

SEQ ID NO: 2193838 - DNA, 17 bp, Homo sapiens
gctcagccccagcccag

SEQ ID NO: 2193839 - DNA, 19 bp, Homo sapiens
gctcagccctgagctggcg

SEQ ID NO: 2193840 - DNA, 12 bp, Homo sapiens
gctcagctctgg

SEQ ID NO: 2193841 - DNA, 13 bp, Homo sapiens
gctcagctctggc

SEQ ID NO: 2193842 - DNA, 15 bp, Homo sapiens
gctcagctctggctc

SEQ ID NO: 2193843 - DNA, 13 bp, Homo sapiens
gctcaggagagag

SEQ ID NO: 2193844 - DNA, 13 bp, Homo sapiens
gctcagtttggct

SEQ ID NO: 2193845 - DNA, 16 bp, Homo sapiens
gctcagtttggctgta

SEQ ID NO: 2193846 - DNA, 22 bp, Homo sapiens
gctcatgggcccctctgactcc

SEQ ID NO: 2193847 - DNA, 14 bp, Homo sapiens
gctccacaagagag

SEQ ID NO: 2193848 - DNA, 16 bp, Homo sapiens
gctccacagccatccc

SEQ ID NO: 2193849 - DNA, 15 bp, Homo sapiens
gctccaccccactca

SEQ ID NO: 2193850 - DNA, 14 bp, Homo sapiens
gctccagtcctgct

SEQ ID NO: 2193851 - DNA, 21 bp, Homo sapiens
gctccagtcctgctctctacc

SEQ ID NO: 2193852 - DNA, 23 bp, Homo sapiens
tacccaatacttatgttgtattg

SEQ ID NO: 2193853 - DNA, 14 bp, Homo sapiens
tacccacagggcct

SEQ ID NO: 2193854 - DNA, 19 bp, Homo sapiens
tacccacagggcctgactt

SEQ ID NO: 2193855 - DNA, 23 bp, Homo sapiens
tacccacctgagctttggacgca

SEQ ID NO: 2193856 - DNA, 13 bp, Homo sapiens
tacccagcccatc

SEQ ID NO: 2193857 - DNA, 16 bp, Homo sapiens
taccccaattccttgt

SEQ ID NO: 2193858 - DNA, 14 bp, Homo sapiens
taccccccgtctcc

SEQ ID NO: 2193859 - DNA, 19 bp, Homo sapiens
tacccccttgtctgctgct

SEQ ID NO: 2193860 - DNA, 15 bp, Homo sapiens
taccctactggctgt

SEQ ID NO: 2193861 - DNA, 18 bp, Homo sapiens
tacccttgagacctggaa

SEQ ID NO: 2193862 - DNA, 23 bp, Homo sapiens
tacccttgagacctggaaccaga

SEQ ID NO: 2193863 - DNA, 15 bp, Homo sapiens
tacccttgccaaggc

SEQ ID NO: 2193864 - DNA, 20 bp, Homo sapiens
taccgtaacaatgtttgtca

SEQ ID NO: 2193865 - DNA, 13 bp, Homo sapiens
tacctcccacctt

SEQ ID NO: 2193866 - DNA, 20 bp, Homo sapiens
tacctgcatgtgttgtacaa

SEQ ID NO: 2193867 - DNA, 21 bp, Homo sapiens
tacctgcatgtgttgtacaat

SEQ ID NO: 2193868 - DNA, 20 bp, Homo sapiens
tacctgcccccactcagcat

SEQ ID NO: 2193869 - DNA, 21 bp, Homo sapiens
tacctgcccccactcagcatt

SEQ ID NO: 2193870 - DNA, 16 bp, Homo sapiens
tacctgccctctctca

SEQ ID NO: 2193871 - DNA, 22 bp, Homo sapiens
tacctgtgaatcatatgttgta

SEQ ID NO: 2193872 - DNA, 15 bp, Homo sapiens
taccttcaaagctga

SEQ ID NO: 2193873 - DNA, 16 bp, Homo sapiens
tacctttgctcttgca

SEQ ID NO: 2193874 - DNA, 14 bp, Homo sapiens
tacggaattccaat

SEQ ID NO: 2193875 - DNA, 16 bp, Homo sapiens
tacggaattccaatat

SEQ ID NO: 2193876 - DNA, 22 bp, Homo sapiens
tacggtgatattgtgcatgcaa

SEQ ID NO: 2193877 - DNA, 14 bp, Homo sapiens
tactaaatatgaaa

SEQ ID NO: 2193878 - DNA, 15 bp, Homo sapiens
tactaataaaataca

SEQ ID NO: 2193879 - DNA, 18 bp, Homo sapiens
tactaggattagaaaatt

SEQ ID NO: 2193880 - DNA, 17 bp, Homo sapiens
tactatagattctttat

SEQ ID NO: 2193881 - DNA, 18 bp, Homo sapiens
tactatttttctttccaa

SEQ ID NO: 2193882 - DNA, 12 bp, Homo sapiens
tactctgtctcc

SEQ ID NO: 2193883 - DNA, 16 bp, Homo sapiens
tactctttgctttgta

SEQ ID NO: 2193884 - DNA, 14 bp, Homo sapiens
tactgactttttaa

SEQ ID NO: 2193885 - DNA, 19 bp, Homo sapiens
tactgccttcctccttatc

SEQ ID NO: 2193886 - DNA, 14 bp, Homo sapiens
tactggaatttatt

SEQ ID NO: 2193887 - DNA, 21 bp, Homo sapiens
tactgggtaggttctgaacag

SEQ ID NO: 2193888 - DNA, 19 bp, Homo sapiens
tactgtgacctaagaacaa

SEQ ID NO: 2193889 - DNA, 15 bp, Homo sapiens
tactgtgctggagcc

SEQ ID NO: 2193890 - DNA, 16 bp, Homo sapiens
tactgtgctggagcca

SEQ ID NO: 2193891 - DNA, 12 bp, Homo sapiens
tactgttcatgg

SEQ ID NO: 2193892 - DNA, 17 bp, Homo sapiens
tactgttgtcctatggg

SEQ ID NO: 2193893 - DNA, 20 bp, Homo sapiens
tactgtttgtcttctcccca

SEQ ID NO: 2193894 - DNA, 15 bp, Homo sapiens
tacttaaaaatatgt

SEQ ID NO: 2193895 - DNA, 11 bp, Homo sapiens
tacttaataaa

SEQ ID NO: 2193896 - DNA, 12 bp, Homo sapiens
tacttgagaaat

SEQ ID NO: 2193897 - DNA, 19 bp, Homo sapiens
tacttgggccatagctcct

SEQ ID NO: 2193898 - DNA, 16 bp, Homo sapiens
tacttgtaaacttgaa

SEQ ID NO: 2193899 - DNA, 17 bp, Homo sapiens
tacttgtgaacatgcct

SEQ ID NO: 2193900 - DNA, 17 bp, Homo sapiens
tacttgttcttttctgg

SEQ ID NO: 2193901 - DNA, 22 bp, Homo sapiens
tactttcatctaaattactgat

SEQ ID NO: 2193902 - DNA, 16 bp, Homo sapiens
tactttgagtaaactt

SEQ ID NO: 2193903 - DNA, 21 bp, Homo sapiens
tagaaaattttatgtatttta

SEQ ID NO: 2193904 - DNA, 23 bp, Homo sapiens
tagaaagcatccattaattaatg

SEQ ID NO: 2193905 - DNA, 16 bp, Homo sapiens
tagaagatcctacccc

SEQ ID NO: 2193906 - DNA, 22 bp, Homo sapiens
tagaatactaataaaatacata

SEQ ID NO: 2193907 - DNA, 16 bp, Homo sapiens
tagaatatcctacttc

SEQ ID NO: 2193908 - DNA, 13 bp, Homo sapiens
tagaatattaaaa

SEQ ID NO: 2193909 - DNA, 20 bp, Homo sapiens
tagacatccccctccttgcc

SEQ ID NO: 2193910 - DNA, 22 bp, Homo sapiens
tagactcaagtgatcctcctgt

SEQ ID NO: 2193911 - DNA, 20 bp, Homo sapiens
tagagaaaatggaacattaa

SEQ ID NO: 2193912 - DNA, 22 bp, Homo sapiens
tagaggggaaggaaatctcctc

SEQ ID NO: 2193913 - DNA, 14 bp, Homo sapiens
tagatataactgta

SEQ ID NO: 2193914 - DNA, 19 bp, Homo sapiens
tagatattgttttgtgact

SEQ ID NO: 2193915 - DNA, 17 bp, Homo sapiens
tagatcaacaataaaaa

SEQ ID NO: 2193916 - DNA, 20 bp, Homo sapiens
tagatgagaattcagctgcc

SEQ ID NO: 2193917 - DNA, 15 bp, Homo sapiens
tagatgccctgctag

SEQ ID NO: 2193918 - DNA, 15 bp, Homo sapiens
tagatgtatcattaa

SEQ ID NO: 2193919 - DNA, 12 bp, Homo sapiens
tagattctttat

SEQ ID NO: 2193920 - DNA, 18 bp, Homo sapiens
tagattctttattagtga

SEQ ID NO: 2193921 - DNA, 14 bp, Homo sapiens
tagcaaattccaat

SEQ ID NO: 2193922 - DNA, 17 bp, Homo sapiens
tagcactcacatgctgg

SEQ ID NO: 2193923 - DNA, 19 bp, Homo sapiens
tagcagaaaacagaggcca

SEQ ID NO: 2193924 - DNA, 15 bp, Homo sapiens
tagcagatattaaaa

SEQ ID NO: 2193925 - DNA, 21 bp, Homo sapiens
tagcatatattcatacctgtt

SEQ ID NO: 2193926 - DNA, 13 bp, Homo sapiens
tagccatgggacc

SEQ ID NO: 2193927 - DNA, 15 bp, Homo sapiens
tagccatttgcccca

SEQ ID NO: 2193928 - DNA, 19 bp, Homo sapiens
tagccccaagaaggctggg

SEQ ID NO: 2193929 - DNA, 20 bp, Homo sapiens
tagccccaagaaggctgggg

SEQ ID NO: 2193930 - DNA, 18 bp, Homo sapiens
tagccccttagcccccac

SEQ ID NO: 2193931 - DNA, 20 bp, Homo sapiens
tagctcagccccagcccagc

SEQ ID NO: 2193932 - DNA, 13 bp, Homo sapiens
tagctcccctcct

SEQ ID NO: 2193933 - DNA, 19 bp, Homo sapiens
tagctgagactacaggtga

SEQ ID NO: 2193934 - DNA, 17 bp, Homo sapiens
tagcttagagcctccct

SEQ ID NO: 2193935 - DNA, 17 bp, Homo sapiens
tagcttctgacctcagc

SEQ ID NO: 2193936 - DNA, 19 bp, Homo sapiens
tagcttctgacctcagcat

SEQ ID NO: 2193937 - DNA, 17 bp, Homo sapiens
tagcttgtacacatata

SEQ ID NO: 2193938 - DNA, 19 bp, Homo sapiens
taggaaatggtttccatct

SEQ ID NO: 2193939 - DNA, 23 bp, Homo sapiens
taggacatgttcccttctccttc

SEQ ID NO: 2193940 - DNA, 16 bp, Homo sapiens
taggagggtgggaagg

SEQ ID NO: 2193941 - DNA, 18 bp, Homo sapiens
taggatggatagaaggaa

SEQ ID NO: 2193942 - DNA, 18 bp, Homo sapiens
taggcagttagagatgcc

SEQ ID NO: 2193943 - DNA, 22 bp, Homo sapiens
taggcagttagagatgcctccc

SEQ ID NO: 2193944 - DNA, 24 bp, Homo sapiens
taggcagttagagatgcctccctg

SEQ ID NO: 2193945 - DNA, 16 bp, Homo sapiens
taggcattaaatgcaa

SEQ ID NO: 2193946 - DNA, 17 bp, Homo sapiens
taggcattaaatgcaaa

SEQ ID NO: 2193947 - DNA, 14 bp, Homo sapiens
taggccccagaggc

SEQ ID NO: 2193948 - DNA, 16 bp, Homo sapiens
taggccccagaggccc

SEQ ID NO: 2193949 - DNA, 16 bp, Homo sapiens
taggctgggcccagag

SEQ ID NO: 2193950 - DNA, 15 bp, Homo sapiens
tagggacccctcctc

SEQ ID NO: 2193951 - DNA, 16 bp, Homo sapiens
tagggacccctcctcc

SEQ ID NO: 2193952 - DNA, 14 bp, Homo sapiens
tagggatgagtacc

SEQ ID NO: 2193953 - DNA, 19 bp, Homo sapiens
tagggttctgcttttaagt

SEQ ID NO: 2193954 - DNA, 18 bp, Homo sapiens
taggtcagtacccacctg

SEQ ID NO: 2193955 - DNA, 17 bp, Homo sapiens
taggtcgcgctcttgca

SEQ ID NO: 2193956 - DNA, 15 bp, Homo sapiens
taggtgaaggcagaa

SEQ ID NO: 2193957 - DNA, 14 bp, Homo sapiens
taggttctgaacag

SEQ ID NO: 2193958 - DNA, 15 bp, Homo sapiens
taggttgtctaaaaa

SEQ ID NO: 2193959 - DNA, 16 bp, Homo sapiens
taggttgtctaaaaat

SEQ ID NO: 2193960 - DNA, 13 bp, Homo sapiens
taggttttccctg

SEQ ID NO: 2193961 - DNA, 15 bp, Homo sapiens
taggttttccctgtt

SEQ ID NO: 2193962 - DNA, 14 bp, Homo sapiens
tagtaaaaataaat

SEQ ID NO: 2193963 - DNA, 13 bp, Homo sapiens
tagtacccacctg

SEQ ID NO: 2193964 - DNA, 22 bp, Homo sapiens
tagtccaaattatttttacgta

SEQ ID NO: 2193965 - DNA, 17 bp, Homo sapiens
tagtcccttccacaccc

SEQ ID NO: 2193966 - DNA, 17 bp, Homo sapiens
tagtctgtgtgctgtgg

SEQ ID NO: 2193967 - DNA, 16 bp, Homo sapiens
tagtgcaatttcttct

SEQ ID NO: 2193968 - DNA, 22 bp, Homo sapiens
tagtgcaatttcttctgtagct

SEQ ID NO: 2193969 - DNA, 16 bp, Homo sapiens
tagtgcagagaggttg

SEQ ID NO: 2193970 - DNA, 19 bp, Homo sapiens
tagtggaaagattgtgtct

SEQ ID NO: 2193971 - DNA, 16 bp, Homo sapiens
tagtggccagaccaga

SEQ ID NO: 2193972 - DNA, 14 bp, Homo sapiens
tagtggtttgcttt

SEQ ID NO: 2193973 - DNA, 20 bp, Homo sapiens
tagtgtacctattaaaagtt

SEQ ID NO: 2193974 - DNA, 13 bp, Homo sapiens
tcagttattcaga

SEQ ID NO: 2193975 - DNA, 23 bp, Homo sapiens
tcagtttgcagcagcaagtacaa

SEQ ID NO: 2193976 - DNA, 14 bp, Homo sapiens
tcagtttggctgta

SEQ ID NO: 2193977 - DNA, 17 bp, Homo sapiens
tcagtttggctgtaatt

SEQ ID NO: 2193978 - DNA, 21 bp, Homo sapiens
tcagtttggctgtaatttaat

SEQ ID NO: 2193979 - DNA, 13 bp, Homo sapiens
tcagttttgtgta

SEQ ID NO: 2193980 - DNA, 21 bp, Homo sapiens
tcagttttgtgtacagtatgt

SEQ ID NO: 2193981 - DNA, 19 bp, Homo sapiens
tcatacctgttgtacactt

SEQ ID NO: 2193982 - DNA, 17 bp, Homo sapiens
tcatactgtgctggagc

SEQ ID NO: 2193983 - DNA, 18 bp, Homo sapiens
tcatactgtgctggagcc

SEQ ID NO: 2193984 - DNA, 14 bp, Homo sapiens
tcatagctgtatat

SEQ ID NO: 2193985 - DNA, 20 bp, Homo sapiens
tcatatgggatactgctggt

SEQ ID NO: 2193986 - DNA, 21 bp, Homo sapiens
tcatatttttagatacagtga

SEQ ID NO: 2193987 - DNA, 17 bp, Homo sapiens
tcatcaattctctatca

SEQ ID NO: 2193988 - DNA, 15 bp, Homo sapiens
tcatcactcccctcc

SEQ ID NO: 2193989 - DNA, 15 bp, Homo sapiens
tcatcagtattgtgt

SEQ ID NO: 2193990 - DNA, 19 bp, Homo sapiens
tcatcagtattgtgtaaag

SEQ ID NO: 2193991 - DNA, 15 bp, Homo sapiens
tcatcttagttctgt

SEQ ID NO: 2193992 - DNA, 18 bp, Homo sapiens
tcatgacatttctcaaag

SEQ ID NO: 2193993 - DNA, 19 bp, Homo sapiens
tcatgacatttctcaaagt

SEQ ID NO: 2193994 - DNA, 21 bp, Homo sapiens
tcatgccaagcatttaatgta

SEQ ID NO: 2193995 - DNA, 14 bp, Homo sapiens
tcatgcctgtaatc

SEQ ID NO: 2193996 - DNA, 21 bp, Homo sapiens
tcatgcttataagcaacatga

SEQ ID NO: 2193997 - DNA, 18 bp, Homo sapiens
tcatgttaatcctagctg

SEQ ID NO: 2193998 - DNA, 16 bp, Homo sapiens
tcatgttttgatgaga

SEQ ID NO: 2193999 - DNA, 21 bp, Homo sapiens
tcatgttttgatgagaaaaaa

SEQ ID NO: 2194000 - DNA, 20 bp, Homo sapiens
tcattactttaccaccccca

SEQ ID NO: 2194001 - DNA, 11 bp, Homo sapiens
tcattctcttt

SEQ ID NO: 2194002 - DNA, 23 bp, Homo sapiens
tcattgaaatgtaatttcagttc

SEQ ID NO: 2194003 - DNA, 20 bp, Homo sapiens
tcatttcaagttatgattca

SEQ ID NO: 2194004 - DNA, 17 bp, Homo sapiens
tcatttcatctactaca

SEQ ID NO: 2194005 - DNA, 16 bp, Homo sapiens
tcatttgcagctgctg

SEQ ID NO: 2194006 - DNA, 23 bp, Homo sapiens
tcattttatcaggggaatttcag

SEQ ID NO: 2194007 - DNA, 20 bp, Homo sapiens
tcatttttgtttctacctcc

SEQ ID NO: 2194008 - DNA, 21 bp, Homo sapiens
tccaaaaacaaagtgcaaagc

SEQ ID NO: 2194009 - DNA, 22 bp, Homo sapiens
tccaaaaacaaagtgcaaagct

SEQ ID NO: 2194010 - DNA, 15 bp, Homo sapiens
tccaaacccatcttc

SEQ ID NO: 2194011 - DNA, 19 bp, Homo sapiens
tccaaactgtgtcacgcag

SEQ ID NO: 2194012 - DNA, 19 bp, Homo sapiens
tccaaagctttcctggaga

SEQ ID NO: 2194013 - DNA, 15 bp, Homo sapiens
tccaaattgatgggt

SEQ ID NO: 2194014 - DNA, 11 bp, Homo sapiens
tccaacatgaa

SEQ ID NO: 2194015 - DNA, 18 bp, Homo sapiens
tccaagtcatttttgttt

SEQ ID NO: 2194016 - DNA, 18 bp, Homo sapiens
tccaagtggacggcagac

SEQ ID NO: 2194017 - DNA, 14 bp, Homo sapiens
tccaagtgtttctt

SEQ ID NO: 2194018 - DNA, 21 bp, Homo sapiens
tccaagtttactcaaccctct

SEQ ID NO: 2194019 - DNA, 19 bp, Homo sapiens
tccaatgcttctgcatact

SEQ ID NO: 2194020 - DNA, 17 bp, Homo sapiens
tccaatgtgcccagtca

SEQ ID NO: 2194021 - DNA, 15 bp, Homo sapiens
tccacacaacaccag

SEQ ID NO: 2194022 - DNA, 19 bp, Homo sapiens
tccacacaacaccaggact

SEQ ID NO: 2194023 - DNA, 14 bp, Homo sapiens
tccacagccatccc

SEQ ID NO: 2194024 - DNA, 15 bp, Homo sapiens
tccacagccatccca

SEQ ID NO: 2194025 - DNA, 17 bp, Homo sapiens
tccacatctaacaaagt

SEQ ID NO: 2194026 - DNA, 18 bp, Homo sapiens
tccacccccgcctccctc

SEQ ID NO: 2194027 - DNA, 21 bp, Homo sapiens
tccacccctccttccctggtc

SEQ ID NO: 2194028 - DNA, 16 bp, Homo sapiens
tccacccgtttccaag

SEQ ID NO: 2194029 - DNA, 18 bp, Homo sapiens
tccacccgtttccaagcc

SEQ ID NO: 2194030 - DNA, 19 bp, Homo sapiens
tccacctttctgaatggaa

SEQ ID NO: 2194031 - DNA, 22 bp, Homo sapiens
tccactgcaaataaagcctttt

SEQ ID NO: 2194032 - DNA, 12 bp, Homo sapiens
tccactgccctc

SEQ ID NO: 2194033 - DNA, 15 bp, Homo sapiens
tccactgccctctgt

SEQ ID NO: 2194034 - DNA, 19 bp, Homo sapiens
tccactgtctttaaaagtc

SEQ ID NO: 2194035 - DNA, 21 bp, Homo sapiens
tccactgtctttaaaagtcat

SEQ ID NO: 2194036 - DNA, 9 bp, Homo sapiens
tccagccac

SEQ ID NO: 2194037 - DNA, 21 bp, Homo sapiens
tccagccacttccccctcttc

SEQ ID NO: 2194038 - DNA, 15 bp, Homo sapiens
tccaggatggctgca

SEQ ID NO: 2194039 - DNA, 14 bp, Homo sapiens
tccagggcagcagc

SEQ ID NO: 2194040 - DNA, 13 bp, Homo sapiens
tccagggcttcag

SEQ ID NO: 2194041 - DNA, 15 bp, Homo sapiens
tccaggggcttcacc

SEQ ID NO: 2194042 - DNA, 18 bp, Homo sapiens
tccagggtaggcaaggct

SEQ ID NO: 2194043 - DNA, 19 bp, Homo sapiens
tccaggtcgggctcagctc

SEQ ID NO: 2194044 - DNA, 19 bp, Homo sapiens
tccagtatcctgaaacagt

SEQ ID NO: 2194045 - DNA, 13 bp, Homo sapiens
tccagtcctgctc

SEQ ID NO: 2194046 - DNA, 15 bp, Homo sapiens
tccagtcctgctctc

SEQ ID NO: 2194047 - DNA, 20 bp, Homo sapiens
tccagtggcctggctccgct

SEQ ID NO: 2194048 - DNA, 23 bp, Homo sapiens
tccagtggcctggctccgctgtg

SEQ ID NO: 2194049 - DNA, 15 bp, Homo sapiens
tccagttctgatgag

SEQ ID NO: 2194050 - DNA, 17 bp, Homo sapiens
tccagttctgatgaggc

SEQ ID NO: 2194051 - DNA, 15 bp, Homo sapiens
tccagttgcgtgtct

SEQ ID NO: 2194052 - DNA, 14 bp, Homo sapiens
tccatcagcagtga

SEQ ID NO: 2194053 - DNA, 23 bp, Homo sapiens
tccatcctgtacaagtgctcagt

SEQ ID NO: 2194054 - DNA, 20 bp, Homo sapiens
tccatgcagttattagaact

SEQ ID NO: 2194055 - DNA, 13 bp, Homo sapiens
tccattaattaat

SEQ ID NO: 2194056 - DNA, 19 bp, Homo sapiens
tccatttgctgattgtctg

SEQ ID NO: 2194057 - DNA, 20 bp, Homo sapiens
tccattttacgttttagaaa

SEQ ID NO: 2194058 - DNA, 20 bp, Homo sapiens
tcccaaaccacgcctcttga

SEQ ID NO: 2194059 - DNA, 13 bp, Homo sapiens
tcccaaagagctg

SEQ ID NO: 2194060 - DNA, 16 bp, Homo sapiens
tcccaaagagctgcct

SEQ ID NO: 2194061 - DNA, 20 bp, Homo sapiens
tcccaaagtgctgagattac

SEQ ID NO: 2194062 - DNA, 21 bp, Homo sapiens
tcccaacacaaggtgggcagg

SEQ ID NO: 2194063 - DNA, 22 bp, Homo sapiens
tcccaagaacagcaggcccacc

SEQ ID NO: 2194064 - DNA, 23 bp, Homo sapiens
tcccaagaacagcaggcccacct

SEQ ID NO: 2194065 - DNA, 15 bp, Homo sapiens
tcccaattcatttca

SEQ ID NO: 2194066 - DNA, 16 bp, Homo sapiens
tcccaccagcctgagc

SEQ ID NO: 2194067 - DNA, 18 bp, Homo sapiens
tcccaccggttgcttctg

SEQ ID NO: 2194068 - DNA, 14 bp, Homo sapiens
tcccactcctagga

SEQ ID NO: 2194069 - DNA, 21 bp, Homo sapiens
tcccagaggctcctggagcca

SEQ ID NO: 2194070 - DNA, 13 bp, Homo sapiens
tcccagaggtggg

SEQ ID NO: 2194071 - DNA, 22 bp, Homo sapiens
tcccagaggtggggaagagagc

SEQ ID NO: 2194072 - DNA, 19 bp, Homo sapiens
tcccagctgaaggcagtgg

SEQ ID NO: 2194073 - DNA, 17 bp, Homo sapiens
tcccaggttggaggccc

SEQ ID NO: 2194074 - DNA, 17 bp, Homo sapiens
tcccagttctctaggga

SEQ ID NO: 2194075 - DNA, 17 bp, Homo sapiens
tcccatggtagactgtg

SEQ ID NO: 2194076 - DNA, 20 bp, Homo sapiens
tcccatggtagactgtgaca

SEQ ID NO: 2194077 - DNA, 23 bp, Homo sapiens
tcccatggtagactgtgacacag

SEQ ID NO: 2194078 - DNA, 21 bp, Homo sapiens
tccccaaattgccctgttgcc

SEQ ID NO: 2194079 - DNA, 20 bp, Homo sapiens
tccccaagggccctggcacc

SEQ ID NO: 2194080 - DNA, 13 bp, Homo sapiens
tccccagcccact

SEQ ID NO: 2194081 - DNA, 17 bp, Homo sapiens
tccccatactctgtctc

SEQ ID NO: 2194082 - DNA, 15 bp, Homo sapiens
tccccgcccttcttt

SEQ ID NO: 2194083 - DNA, 15 bp, Homo sapiens
tccccgctggctggg

SEQ ID NO: 2194084 - DNA, 14 bp, Homo sapiens
tcccctcacccaaa

SEQ ID NO: 2194085 - DNA, 20 bp, Homo sapiens
tcccctcccgtcttcctcct

SEQ ID NO: 2194086 - DNA, 15 bp, Homo sapiens
tcccctctgctggcc

SEQ ID NO: 2194087 - DNA, 21 bp, Homo sapiens
tccccttgcactggtcatcag

SEQ ID NO: 2194088 - DNA, 18 bp, Homo sapiens
tccctaggcacctctgtg

SEQ ID NO: 2194089 - DNA, 14 bp, Homo sapiens
tccctagggctggg

SEQ ID NO: 2194090 - DNA, 16 bp, Homo sapiens
tccctcaattccccct

SEQ ID NO: 2194091 - DNA, 13 bp, Homo sapiens
tccctcccctgcc

SEQ ID NO: 2194092 - DNA, 17 bp, Homo sapiens
tccctcccctgccctcg

SEQ ID NO: 2194093 - DNA, 17 bp, Homo sapiens
tccctcccgcagagact

SEQ ID NO: 2194094 - DNA, 13 bp, Homo sapiens
tccctctgctcca

SEQ ID NO: 2194095 - DNA, 14 bp, Homo sapiens
tccctgaccctgca

SEQ ID NO: 2194096 - DNA, 21 bp, Homo sapiens
tctagaatactaataaaatac

SEQ ID NO: 2194097 - DNA, 22 bp, Homo sapiens
tctaggcgaggcgaagctgagc

SEQ ID NO: 2194098 - DNA, 23 bp, Homo sapiens
tctagggaaggccacctgcaggt

SEQ ID NO: 2194099 - DNA, 17 bp, Homo sapiens
tctagggacccctcctc

SEQ ID NO: 2194100 - DNA, 20 bp, Homo sapiens
tctagggacccctcctccct

SEQ ID NO: 2194101 - DNA, 18 bp, Homo sapiens
tctaggtcagtacccacc

SEQ ID NO: 2194102 - DNA, 21 bp, Homo sapiens
tctagtggaaagattgtgtct

SEQ ID NO: 2194103 - DNA, 13 bp, Homo sapiens
tctatcacctgtc

SEQ ID NO: 2194104 - DNA, 22 bp, Homo sapiens
tctatcatgttgaagtcaaatt

SEQ ID NO: 2194105 - DNA, 15 bp, Homo sapiens
tctatctaattttta

SEQ ID NO: 2194106 - DNA, 16 bp, Homo sapiens
tctatgtgaatatttg

SEQ ID NO: 2194107 - DNA, 12 bp, Homo sapiens
tctatttattag

SEQ ID NO: 2194108 - DNA, 20 bp, Homo sapiens
tctcaaagtttttacagtgt

SEQ ID NO: 2194109 - DNA, 14 bp, Homo sapiens
tctcaacatggaaa

SEQ ID NO: 2194110 - DNA, 18 bp, Homo sapiens
tctcaacatggaaaaatc

SEQ ID NO: 2194111 - DNA, 14 bp, Homo sapiens
tctcacgctgccat

SEQ ID NO: 2194112 - DNA, 12 bp, Homo sapiens
tctcagaatccc

SEQ ID NO: 2194113 - DNA, 20 bp, Homo sapiens
tctcagagctacttgggcca

SEQ ID NO: 2194114 - DNA, 14 bp, Homo sapiens
tctcaggaggaggg

SEQ ID NO: 2194115 - DNA, 19 bp, Homo sapiens
tctcagtctgtcacccagg

SEQ ID NO: 2194116 - DNA, 12 bp, Homo sapiens
tctcattctctt

SEQ ID NO: 2194117 - DNA, 15 bp, Homo sapiens
tctcattttgtatgt

SEQ ID NO: 2194118 - DNA, 22 bp, Homo sapiens
tctcattttgtatgtatgtgta

SEQ ID NO: 2194119 - DNA, 12 bp, Homo sapiens
tctccaaagctt

SEQ ID NO: 2194120 - DNA, 16 bp, Homo sapiens
tctccacaacctcctc

SEQ ID NO: 2194121 - DNA, 19 bp, Homo sapiens
tctccaggggcctgcagaa

SEQ ID NO: 2194122 - DNA, 20 bp, Homo sapiens
tctccccagggttcagtcct

SEQ ID NO: 2194123 - DNA, 21 bp, Homo sapiens
tctccctataatgctggagcg

SEQ ID NO: 2194124 - DNA, 13 bp, Homo sapiens
tctccgtatttat

SEQ ID NO: 2194125 - DNA, 13 bp, Homo sapiens
tctcctgcatgca

SEQ ID NO: 2194126 - DNA, 16 bp, Homo sapiens
tctcctgccctgccct

SEQ ID NO: 2194127 - DNA, 16 bp, Homo sapiens
tctcctgcctcagcct

SEQ ID NO: 2194128 - DNA, 11 bp, Homo sapiens
tctcctgtgcc

SEQ ID NO: 2194129 - DNA, 12 bp, Homo sapiens
tctcctgtgccc

SEQ ID NO: 2194130 - DNA, 22 bp, Homo sapiens
tctccttccaactgctgcccca

SEQ ID NO: 2194131 - DNA, 13 bp, Homo sapiens
tctccttcctcag

SEQ ID NO: 2194132 - DNA, 17 bp, Homo sapiens
tctccttcctcagaata

SEQ ID NO: 2194133 - DNA, 19 bp, Homo sapiens
tctctagggaaggccacct

SEQ ID NO: 2194134 - DNA, 20 bp, Homo sapiens
tctctagggaaggccacctg

SEQ ID NO: 2194135 - DNA, 14 bp, Homo sapiens
tctctagttccctc

SEQ ID NO: 2194136 - DNA, 16 bp, Homo sapiens
tctctcaatttgggtc

SEQ ID NO: 2194137 - DNA, 14 bp, Homo sapiens
tctctcattctctt

SEQ ID NO: 2194138 - DNA, 18 bp, Homo sapiens
tctctcccacacaagcag

SEQ ID NO: 2194139 - DNA, 18 bp, Homo sapiens
tctctccccttgcactgg

SEQ ID NO: 2194140 - DNA, 12 bp, Homo sapiens
tctctcttcaat

SEQ ID NO: 2194141 - DNA, 15 bp, Homo sapiens
tctctgaacttcagc

SEQ ID NO: 2194142 - DNA, 23 bp, Homo sapiens
tctctgctgggtttccacacagc

SEQ ID NO: 2194143 - DNA, 14 bp, Homo sapiens
tctctgcttcagct

SEQ ID NO: 2194144 - DNA, 14 bp, Homo sapiens
tctctgtccagggc

SEQ ID NO: 2194145 - DNA, 16 bp, Homo sapiens
tctctgtccagggctt

SEQ ID NO: 2194146 - DNA, 21 bp, Homo sapiens
tctctgttccattgaatctgt

SEQ ID NO: 2194147 - DNA, 21 bp, Homo sapiens
tctcttacccttctgtgccca

SEQ ID NO: 2194148 - DNA, 14 bp, Homo sapiens
tctcttcaatctct

SEQ ID NO: 2194149 - DNA, 16 bp, Homo sapiens
tctcttcaatctctgg

SEQ ID NO: 2194150 - DNA, 14 bp, Homo sapiens
tctcttcccctctc

SEQ ID NO: 2194151 - DNA, 14 bp, Homo sapiens
tctcttctctcttc

SEQ ID NO: 2194152 - DNA, 23 bp, Homo sapiens
tctcttgaataaagtattctagt

SEQ ID NO: 2194153 - DNA, 14 bp, Homo sapiens
tctcttgctttgtt

SEQ ID NO: 2194154 - DNA, 20 bp, Homo sapiens
tctctttctccgtatttatt

SEQ ID NO: 2194155 - DNA, 21 bp, Homo sapiens
tctctttctttttctgtctct

SEQ ID NO: 2194156 - DNA, 22 bp, Homo sapiens
tctctttgtaaggacttgtgcc

SEQ ID NO: 2194157 - DNA, 16 bp, Homo sapiens
tctctttttcttgtaa

SEQ ID NO: 2194158 - DNA, 24 bp, Homo sapiens
tctctttttttaaaaagttgatag

SEQ ID NO: 2194159 - DNA, 20 bp, Homo sapiens
tctgaaagctgcttctgggg

SEQ ID NO: 2194160 - DNA, 15 bp, Homo sapiens
tctgaacaaaagcag

SEQ ID NO: 2194161 - DNA, 12 bp, Homo sapiens
tctgaactgcac

SEQ ID NO: 2194162 - DNA, 23 bp, Homo sapiens
tctgaagatcagaacattcagct

SEQ ID NO: 2194163 - DNA, 21 bp, Homo sapiens
tctgaagccatgtagccaccc

SEQ ID NO: 2194164 - DNA, 23 bp, Homo sapiens
tctgaaggtaaagggacactgga

SEQ ID NO: 2194165 - DNA, 22 bp, Homo sapiens
tctgaagttttattttaaatta

SEQ ID NO: 2194166 - DNA, 23 bp, Homo sapiens
tctgaatgggagccagaattcac

SEQ ID NO: 2194167 - DNA, 23 bp, Homo sapiens
tctgactgccaagccagattctc

SEQ ID NO: 2194168 - DNA, 23 bp, Homo sapiens
tctgagaaggggaggacctctgg

SEQ ID NO: 2194169 - DNA, 18 bp, Homo sapiens
tctgagcggccgcctgtc

SEQ ID NO: 2194170 - DNA, 20 bp, Homo sapiens
tctgagcggccgcctgtcct

SEQ ID NO: 2194171 - DNA, 21 bp, Homo sapiens
tctgagcggccgcctgtcctt

SEQ ID NO: 2194172 - DNA, 22 bp, Homo sapiens
tctgagcggccgcctgtccttg

SEQ ID NO: 2194173 - DNA, 23 bp, Homo sapiens
tctgaggaggaaataaattgcag

SEQ ID NO: 2194174 - DNA, 15 bp, Homo sapiens
tctgaggctcagccc

SEQ ID NO: 2194175 - DNA, 15 bp, Homo sapiens
tctgaggttttattt

SEQ ID NO: 2194176 - DNA, 21 bp, Homo sapiens
tctgcacagacaagcagccct

SEQ ID NO: 2194177 - DNA, 12 bp, Homo sapiens
tctgcagggcag

SEQ ID NO: 2194178 - DNA, 14 bp, Homo sapiens
tctgcagggcagcc

SEQ ID NO: 2194179 - DNA, 16 bp, Homo sapiens
tctgcagggcagcctg

SEQ ID NO: 2194180 - DNA, 13 bp, Homo sapiens
tctgcccagagct

SEQ ID NO: 2194181 - DNA, 18 bp, Homo sapiens
tctgcccagagctgggtg

SEQ ID NO: 2194182 - DNA, 13 bp, Homo sapiens
tctgccttccttg

SEQ ID NO: 2194183 - DNA, 22 bp, Homo sapiens
tctgccttgctgcacctgaggc

SEQ ID NO: 2194184 - DNA, 21 bp, Homo sapiens
tctgcctttgttcactgtgag

SEQ ID NO: 2194185 - DNA, 13 bp, Homo sapiens
tctgcgccgctgt

SEQ ID NO: 2194186 - DNA, 14 bp, Homo sapiens
tctgcttgtcatcc

SEQ ID NO: 2194187 - DNA, 17 bp, Homo sapiens
tctgctttctcctttaa

SEQ ID NO: 2194188 - DNA, 13 bp, Homo sapiens
tctgctttctcta

SEQ ID NO: 2194189 - DNA, 19 bp, Homo sapiens
tctggaaatccagctggtt

SEQ ID NO: 2194190 - DNA, 17 bp, Homo sapiens
tctggaagcctgctgat

SEQ ID NO: 2194191 - DNA, 20 bp, Homo sapiens
tctggagccacctgtcccac

SEQ ID NO: 2194192 - DNA, 14 bp, Homo sapiens
tctggaggcctctg

SEQ ID NO: 2194193 - DNA, 19 bp, Homo sapiens
tctggccagacggcccgcc

SEQ ID NO: 2194194 - DNA, 13 bp, Homo sapiens
tctggccctgttg

SEQ ID NO: 2194195 - DNA, 12 bp, Homo sapiens
tctggctcctgt

SEQ ID NO: 2194196 - DNA, 18 bp, Homo sapiens
tctggctgcctggcccag

SEQ ID NO: 2194197 - DNA, 15 bp, Homo sapiens
tctgggaactcccaa

SEQ ID NO: 2194198 - DNA, 22 bp, Homo sapiens
tctgggcaaggtgagggatgcc

SEQ ID NO: 2194199 - DNA, 22 bp, Homo sapiens
tctgggctttgattccatctcc

SEQ ID NO: 2194200 - DNA, 16 bp, Homo sapiens
tctggttagctcagcc

SEQ ID NO: 2194201 - DNA, 17 bp, Homo sapiens
tctggttagctcagccc

SEQ ID NO: 2194202 - DNA, 18 bp, Homo sapiens
tctggttagctcagcccc

SEQ ID NO: 2194203 - DNA, 15 bp, Homo sapiens
tctgtcatcaccccg

SEQ ID NO: 2194204 - DNA, 12 bp, Homo sapiens
tctgtccagggc

SEQ ID NO: 2194205 - DNA, 19 bp, Homo sapiens
tctgtccagggcttcagat

SEQ ID NO: 2194206 - DNA, 16 bp, Homo sapiens
tctgtctaccatctcc

SEQ ID NO: 2194207 - DNA, 22 bp, Homo sapiens
tctgtctccctataatgctgga

SEQ ID NO: 2194208 - DNA, 12 bp, Homo sapiens
tctgtctctctt

SEQ ID NO: 2194209 - DNA, 18 bp, Homo sapiens
tctgtctctcttgctttg

SEQ ID NO: 2194210 - DNA, 21 bp, Homo sapiens
tctgtgaaagtctcctgtatc

SEQ ID NO: 2194211 - DNA, 22 bp, Homo sapiens
tctgtgaaagtctcctgtatca

SEQ ID NO: 2194212 - DNA, 23 bp, Homo sapiens
tctgtgattgccatttcttccca

SEQ ID NO: 2194213 - DNA, 13 bp, Homo sapiens
tctgtgcccagct

SEQ ID NO: 2194214 - DNA, 21 bp, Homo sapiens
tctgtgcctggagctcctggg

SEQ ID NO: 2194215 - DNA, 22 bp, Homo sapiens
tctgtggcgatatgagagggat

SEQ ID NO: 2194216 - DNA, 14 bp, Homo sapiens
tctgtgtgctgtgg

SEQ ID NO: 2194217 - DNA, 23 bp, Homo sapiens
tctgtgttacaatcgttctgtgt

SEQ ID NO: 2194218 - DNA, 23 bp, Homo sapiens
acagatggctgtgaaaattacac

SEQ ID NO: 2194219 - DNA, 14 bp, Homo sapiens
acagatgttccatc

SEQ ID NO: 2194220 - DNA, 19 bp, Homo sapiens
acagcacctcctctctgct

SEQ ID NO: 2194221 - DNA, 19 bp, Homo sapiens
acagcaggcccacctacct

SEQ ID NO: 2194222 - DNA, 22 bp, Homo sapiens
acagcagtttgagcttgctgga

SEQ ID NO: 2194223 - DNA, 23 bp, Homo sapiens
acagcagtttgagcttgctggag

SEQ ID NO: 2194224 - DNA, 20 bp, Homo sapiens
acagccagtaaggcagctct

SEQ ID NO: 2194225 - DNA, 22 bp, Homo sapiens
acagcccgcatgcagcagcttg

SEQ ID NO: 2194226 - DNA, 22 bp, Homo sapiens
acagccgagtggatagatgccc

SEQ ID NO: 2194227 - DNA, 18 bp, Homo sapiens
acagccggatcttggaga

SEQ ID NO: 2194228 - DNA, 18 bp, Homo sapiens
acagccggggcctgccta

SEQ ID NO: 2194229 - DNA, 16 bp, Homo sapiens
acagcctgtcttcaga

SEQ ID NO: 2194230 - DNA, 21 bp, Homo sapiens
acagcgagaaaacttcgtaag

SEQ ID NO: 2194231 - DNA, 15 bp, Homo sapiens
acagcggttgtaaat

SEQ ID NO: 2194232 - DNA, 16 bp, Homo sapiens
acagcggttgtaaata

SEQ ID NO: 2194233 - DNA, 19 bp, Homo sapiens
acagcggttgtaaatacaa

SEQ ID NO: 2194234 - DNA, 21 bp, Homo sapiens
acagctcacggcagcctcaac

SEQ ID NO: 2194235 - DNA, 13 bp, Homo sapiens
acagctcagccag

SEQ ID NO: 2194236 - DNA, 20 bp, Homo sapiens
acagctcagccagtggggat

SEQ ID NO: 2194237 - DNA, 13 bp, Homo sapiens
acagctcaggctg

SEQ ID NO: 2194238 - DNA, 17 bp, Homo sapiens
acagctttcctgggtga

SEQ ID NO: 2194239 - DNA, 22 bp, Homo sapiens
acaggaagccgcctagtgcaga

SEQ ID NO: 2194240 - DNA, 13 bp, Homo sapiens
acaggaccctcag

SEQ ID NO: 2194241 - DNA, 19 bp, Homo sapiens
acaggcacctctaatcaga

SEQ ID NO: 2194242 - DNA, 16 bp, Homo sapiens
acaggccccttttgtg

SEQ ID NO: 2194243 - DNA, 18 bp, Homo sapiens
acaggctaggaagaactt

SEQ ID NO: 2194244 - DNA, 20 bp, Homo sapiens
acagggacacagtctggtgc

SEQ ID NO: 2194245 - DNA, 13 bp, Homo sapiens
acagggccctctg

SEQ ID NO: 2194246 - DNA, 14 bp, Homo sapiens
acagggcctgactt

SEQ ID NO: 2194247 - DNA, 17 bp, Homo sapiens
acaggtgtccccagccc

SEQ ID NO: 2194248 - DNA, 14 bp, Homo sapiens
acagtaagcatgct

SEQ ID NO: 2194249 - DNA, 15 bp, Homo sapiens
acagtaagcatgctg

SEQ ID NO: 2194250 - DNA, 11 bp, Homo sapiens
acagtacaatc

SEQ ID NO: 2194251 - DNA, 14 bp, Homo sapiens
acagtatgtgtcta

SEQ ID NO: 2194252 - DNA, 23 bp, Homo sapiens
acagtatgtgtctagcaaagcca

SEQ ID NO: 2194253 - DNA, 16 bp, Homo sapiens
acagtggggttttttt

SEQ ID NO: 2194254 - DNA, 22 bp, Homo sapiens
acagtggtaaatatagaaccat

SEQ ID NO: 2194255 - DNA, 12 bp, Homo sapiens
acagttgtattt

SEQ ID NO: 2194256 - DNA, 18 bp, Homo sapiens
acagttgtatttaacaga

SEQ ID NO: 2194257 - DNA, 22 bp, Homo sapiens
acagttgtatttaacagaaatt

SEQ ID NO: 2194258 - DNA, 22 bp, Homo sapiens
acataacataagctagaaaaat

SEQ ID NO: 2194259 - DNA, 18 bp, Homo sapiens
acataatttgcataaagg

SEQ ID NO: 2194260 - DNA, 19 bp, Homo sapiens
acatagatgtatcattaat

SEQ ID NO: 2194261 - DNA, 13 bp, Homo sapiens
acatatatatgcc

SEQ ID NO: 2194262 - DNA, 21 bp, Homo sapiens
acatatatatgccttatgtaa

SEQ ID NO: 2194263 - DNA, 22 bp, Homo sapiens
acatattcccatggtagactgt

SEQ ID NO: 2194264 - DNA, 16 bp, Homo sapiens
acatccccgctggctg

SEQ ID NO: 2194265 - DNA, 16 bp, Homo sapiens
acatctgccttgctgc

SEQ ID NO: 2194266 - DNA, 22 bp, Homo sapiens
acatcttagcaagcaccaaaaa

SEQ ID NO: 2194267 - DNA, 16 bp, Homo sapiens
acatgaacaatgtgtg

SEQ ID NO: 2194268 - DNA, 16 bp, Homo sapiens
acatgacatttgtcct

SEQ ID NO: 2194269 - DNA, 15 bp, Homo sapiens
acatgaccagaaaac

SEQ ID NO: 2194270 - DNA, 18 bp, Homo sapiens
acatgcactactgaaatt

SEQ ID NO: 2194271 - DNA, 18 bp, Homo sapiens
acatgctggacaggtctg

SEQ ID NO: 2194272 - DNA, 15 bp, Homo sapiens
acatggtagcagggt

SEQ ID NO: 2194273 - DNA, 11 bp, Homo sapiens
acatgtcatgt

SEQ ID NO: 2194274 - DNA, 23 bp, Homo sapiens
acattcaagattaaactgagtga

SEQ ID NO: 2194275 - DNA, 13 bp, Homo sapiens
acattcagctctg

SEQ ID NO: 2194276 - DNA, 17 bp, Homo sapiens
acattcagctctggaga

SEQ ID NO: 2194277 - DNA, 18 bp, Homo sapiens
acattcagctctggagaa

SEQ ID NO: 2194278 - DNA, 15 bp, Homo sapiens
acattctgctcccag

SEQ ID NO: 2194279 - DNA, 17 bp, Homo sapiens
acattctgtcatcaccc

SEQ ID NO: 2194280 - DNA, 14 bp, Homo sapiens
acatttatctttgt

SEQ ID NO: 2194281 - DNA, 18 bp, Homo sapiens
acatttcatataaatgga

SEQ ID NO: 2194282 - DNA, 16 bp, Homo sapiens
acatttgagtcccttc

SEQ ID NO: 2194283 - DNA, 20 bp, Homo sapiens
acatttgggagtttttatga

SEQ ID NO: 2194284 - DNA, 21 bp, Homo sapiens
acatttgggagtttttatgag

SEQ ID NO: 2194285 - DNA, 16 bp, Homo sapiens
acatttgtcctgcaga

SEQ ID NO: 2194286 - DNA, 19 bp, Homo sapiens
acatttgtcctgcagagct

SEQ ID NO: 2194287 - DNA, 14 bp, Homo sapiens
acatttttcaataa

SEQ ID NO: 2194288 - DNA, 15 bp, Homo sapiens
acatttttcaataaa

SEQ ID NO: 2194289 - DNA, 18 bp, Homo sapiens
accaaaaaactaaagcag

SEQ ID NO: 2194290 - DNA, 23 bp, Homo sapiens
accaaagctgacgaggctgggcc

SEQ ID NO: 2194291 - DNA, 11 bp, Homo sapiens
accaaagctgt

SEQ ID NO: 2194292 - DNA, 15 bp, Homo sapiens
accaaagctgttttt

SEQ ID NO: 2194293 - DNA, 18 bp, Homo sapiens
accaactgctctcaaaat

SEQ ID NO: 2194294 - DNA, 19 bp, Homo sapiens
accaagagtagcaccttca

SEQ ID NO: 2194295 - DNA, 12 bp, Homo sapiens
accaagccttgg

SEQ ID NO: 2194296 - DNA, 15 bp, Homo sapiens
accaaggtgcactga

SEQ ID NO: 2194297 - DNA, 14 bp, Homo sapiens
accaatgtgaagac

SEQ ID NO: 2194298 - DNA, 15 bp, Homo sapiens
accacactcagctaa

SEQ ID NO: 2194299 - DNA, 15 bp, Homo sapiens
accaccccccactct

SEQ ID NO: 2194300 - DNA, 13 bp, Homo sapiens
accaccctgagcc

SEQ ID NO: 2194301 - DNA, 21 bp, Homo sapiens
accaccctgccccccctaaga

SEQ ID NO: 2194302 - DNA, 14 bp, Homo sapiens
accacctctgtcac

SEQ ID NO: 2194303 - DNA, 19 bp, Homo sapiens
accacgcccagctaatttt

SEQ ID NO: 2194304 - DNA, 20 bp, Homo sapiens
accacgcttgacaggacagc

SEQ ID NO: 2194305 - DNA, 19 bp, Homo sapiens
accactggtgtaaaaaaca

SEQ ID NO: 2194306 - DNA, 20 bp, Homo sapiens
accactggtgtaaaaaacaa

SEQ ID NO: 2194307 - DNA, 15 bp, Homo sapiens
accactgtcttcttc

SEQ ID NO: 2194308 - DNA, 17 bp, Homo sapiens
accagaaaacaaatctt

SEQ ID NO: 2194309 - DNA, 16 bp, Homo sapiens
accagcagtgtttaaa

SEQ ID NO: 2194310 - DNA, 13 bp, Homo sapiens
accagcctttctt

SEQ ID NO: 2194311 - DNA, 14 bp, Homo sapiens
accagcctttcttc

SEQ ID NO: 2194312 - DNA, 13 bp, Homo sapiens
accagttactgtt

SEQ ID NO: 2194313 - DNA, 19 bp, Homo sapiens
accagttctctttgtaagg

SEQ ID NO: 2194314 - DNA, 17 bp, Homo sapiens
accagtttcttaaactg

SEQ ID NO: 2194315 - DNA, 19 bp, Homo sapiens
accatgaattctggtcaca

SEQ ID NO: 2194316 - DNA, 21 bp, Homo sapiens
accatggctaaggcaccagcc

SEQ ID NO: 2194317 - DNA, 16 bp, Homo sapiens
accatgtcatcttttt

SEQ ID NO: 2194318 - DNA, 18 bp, Homo sapiens
accattttgcgatgtgtt

SEQ ID NO: 2194319 - DNA, 15 bp, Homo sapiens
acccagcatgtacaa

SEQ ID NO: 2194320 - DNA, 23 bp, Homo sapiens
acccaggagcatccacctccttc

SEQ ID NO: 2194321 - DNA, 19 bp, Homo sapiens
acccatttgccatgctgct

SEQ ID NO: 2194322 - DNA, 16 bp, Homo sapiens
accccactcacagaga

SEQ ID NO: 2194323 - DNA, 21 bp, Homo sapiens
acccccacaagctgtccctgc

SEQ ID NO: 2194324 - DNA, 20 bp, Homo sapiens
acccccacccgttaatttaa

SEQ ID NO: 2194325 - DNA, 18 bp, Homo sapiens
accccccgtctcctgccg

SEQ ID NO: 2194326 - DNA, 22 bp, Homo sapiens
accccctggcttgaaccttcaa

SEQ ID NO: 2194327 - DNA, 19 bp, Homo sapiens
acccccttgtctgctgctc

SEQ ID NO: 2194328 - DNA, 14 bp, Homo sapiens
accccgagccctac

SEQ ID NO: 2194329 - DNA, 16 bp, Homo sapiens
accccgcacccggctc

SEQ ID NO: 2194330 - DNA, 15 bp, Homo sapiens
accccgtctgctcct

SEQ ID NO: 2194331 - DNA, 18 bp, Homo sapiens
accccgtgaagcaatcat

SEQ ID NO: 2194332 - DNA, 13 bp, Homo sapiens
acccctccccact

SEQ ID NO: 2194333 - DNA, 22 bp, Homo sapiens
acccctccttccctggtccaga

SEQ ID NO: 2194334 - DNA, 15 bp, Homo sapiens
accccttcctgtctg

SEQ ID NO: 2194335 - DNA, 18 bp, Homo sapiens
accccttcctgtctggcc

SEQ ID NO: 2194336 - DNA, 19 bp, Homo sapiens
accccttcctgtctggccc

SEQ ID NO: 2194337 - DNA, 19 bp, Homo sapiens
accccttggaggagagaga

SEQ ID NO: 2194338 - DNA, 21 bp, Homo sapiens
accccttggaggagagagacc

SEQ ID NO: 2194339 - DNA, 19 bp, Homo sapiens
acccggcccccgccctctg

SEQ ID NO: 2194340 - DNA, 19 bp, Homo sapiens
agccaactgtttccctgct

SEQ ID NO: 2194341 - DNA, 21 bp, Homo sapiens
agccaactgtttccctgctga

SEQ ID NO: 2194342 - DNA, 23 bp, Homo sapiens
agccaactgtttccctgctgaat

SEQ ID NO: 2194343 - DNA, 15 bp, Homo sapiens
agccacagacccctg

SEQ ID NO: 2194344 - DNA, 18 bp, Homo sapiens
agccacagacccctggga

SEQ ID NO: 2194345 - DNA, 19 bp, Homo sapiens
agccacagacccctgggag

SEQ ID NO: 2194346 - DNA, 13 bp, Homo sapiens
agccacaggcaga

SEQ ID NO: 2194347 - DNA, 14 bp, Homo sapiens
agccacaggcagac

SEQ ID NO: 2194348 - DNA, 16 bp, Homo sapiens
agccaccaagggcctc

SEQ ID NO: 2194349 - DNA, 20 bp, Homo sapiens
agccaccaagggcctcacct

SEQ ID NO: 2194350 - DNA, 19 bp, Homo sapiens
agccaccacacccagcctc

SEQ ID NO: 2194351 - DNA, 23 bp, Homo sapiens
agccaccctaactgagctgccag

SEQ ID NO: 2194352 - DNA, 15 bp, Homo sapiens
agccacctgtcccac

SEQ ID NO: 2194353 - DNA, 13 bp, Homo sapiens
agccactggaaat

SEQ ID NO: 2194354 - DNA, 21 bp, Homo sapiens
agccactggaggaagctgttt

SEQ ID NO: 2194355 - DNA, 19 bp, Homo sapiens
agccacttatttccatgga

SEQ ID NO: 2194356 - DNA, 22 bp, Homo sapiens
agccacttccccctcttcttct

SEQ ID NO: 2194357 - DNA, 16 bp, Homo sapiens
agccagaaccccgagc

SEQ ID NO: 2194358 - DNA, 23 bp, Homo sapiens
agccagaattcactaggaggtca

SEQ ID NO: 2194359 - DNA, 16 bp, Homo sapiens
agccagattctcttga

SEQ ID NO: 2194360 - DNA, 17 bp, Homo sapiens
agccagattctcttgaa

SEQ ID NO: 2194361 - DNA, 17 bp, Homo sapiens
agccagcatttcctcag

SEQ ID NO: 2194362 - DNA, 21 bp, Homo sapiens
agccagcatttcctcagtctc

SEQ ID NO: 2194363 - DNA, 9 bp, Homo sapiens
agccagcca

SEQ ID NO: 2194364 - DNA, 18 bp, Homo sapiens
agccagccaccctaactg

SEQ ID NO: 2194365 - DNA, 23 bp, Homo sapiens
agccagccaccctaactgagctg

SEQ ID NO: 2194366 - DNA, 21 bp, Homo sapiens
agccatgctgctttgcacaca

SEQ ID NO: 2194367 - DNA, 12 bp, Homo sapiens
agccatgggacc

SEQ ID NO: 2194368 - DNA, 16 bp, Homo sapiens
agccatgggaccaaac

SEQ ID NO: 2194369 - DNA, 17 bp, Homo sapiens
agccatgggaccaaacc

SEQ ID NO: 2194370 - DNA, 17 bp, Homo sapiens
agcccaatcactgccta

SEQ ID NO: 2194371 - DNA, 14 bp, Homo sapiens
agcccactggatca

SEQ ID NO: 2194372 - DNA, 12 bp, Homo sapiens
agcccagctgct

SEQ ID NO: 2194373 - DNA, 21 bp, Homo sapiens
agcccagctgctctgcccaga

SEQ ID NO: 2194374 - DNA, 22 bp, Homo sapiens
agcccagctgctctgcccagag

SEQ ID NO: 2194375 - DNA, 14 bp, Homo sapiens
agcccatcctgacc

SEQ ID NO: 2194376 - DNA, 23 bp, Homo sapiens
agcccatcctgaccagctgctcc

SEQ ID NO: 2194377 - DNA, 17 bp, Homo sapiens
agcccatcttgcctcca

SEQ ID NO: 2194378 - DNA, 18 bp, Homo sapiens
agccccaagaaggctggg

SEQ ID NO: 2194379 - DNA, 14 bp, Homo sapiens
agccccagcccagc

SEQ ID NO: 2194380 - DNA, 22 bp, Homo sapiens
agccctgagctagtgtcacctg

SEQ ID NO: 2194381 - DNA, 19 bp, Homo sapiens
agccctggagtcatgccaa

SEQ ID NO: 2194382 - DNA, 14 bp, Homo sapiens
agccgccaggaccg

SEQ ID NO: 2194383 - DNA, 15 bp, Homo sapiens
agccggggcctgcct

SEQ ID NO: 2194384 - DNA, 19 bp, Homo sapiens
agccggggcctgcctagca

SEQ ID NO: 2194385 - DNA, 19 bp, Homo sapiens
agccggtttgggagagacc

SEQ ID NO: 2194386 - DNA, 12 bp, Homo sapiens
agccgtcctggc

SEQ ID NO: 2194387 - DNA, 13 bp, Homo sapiens
agccgttcctggg

SEQ ID NO: 2194388 - DNA, 20 bp, Homo sapiens
agcctcaataagccttgtcg

SEQ ID NO: 2194389 - DNA, 12 bp, Homo sapiens
agcctccctctc

SEQ ID NO: 2194390 - DNA, 15 bp, Homo sapiens
agcctccctctcctc

SEQ ID NO: 2194391 - DNA, 22 bp, Homo sapiens
agcctctagggacccctcctcc

SEQ ID NO: 2194392 - DNA, 13 bp, Homo sapiens
agcctctggccag

SEQ ID NO: 2194393 - DNA, 18 bp, Homo sapiens
agcctgcccggccggaga

SEQ ID NO: 2194394 - DNA, 17 bp, Homo sapiens
agcctgctctttgaact

SEQ ID NO: 2194395 - DNA, 23 bp, Homo sapiens
agcctggccggttaacatctttt

SEQ ID NO: 2194396 - DNA, 13 bp, Homo sapiens
agcctgggccact

SEQ ID NO: 2194397 - DNA, 14 bp, Homo sapiens
agcctgggccactg

SEQ ID NO: 2194398 - DNA, 22 bp, Homo sapiens
agcctgggccactggcatctct

SEQ ID NO: 2194399 - DNA, 17 bp, Homo sapiens
agcctggggcctgggga

SEQ ID NO: 2194400 - DNA, 14 bp, Homo sapiens
agcctgtgggagaa

SEQ ID NO: 2194401 - DNA, 16 bp, Homo sapiens
agcctgtgggagaagg

SEQ ID NO: 2194402 - DNA, 22 bp, Homo sapiens
agccttggctcgttctcttctc

SEQ ID NO: 2194403 - DNA, 12 bp, Homo sapiens
agcctttcttcc

SEQ ID NO: 2194404 - DNA, 19 bp, Homo sapiens
agccttttattaacatata

SEQ ID NO: 2194405 - DNA, 18 bp, Homo sapiens
agcgactctcctgcctca

SEQ ID NO: 2194406 - DNA, 19 bp, Homo sapiens
agcgatccctcccctcagc

SEQ ID NO: 2194407 - DNA, 22 bp, Homo sapiens
agcgcaaagtgctagccactgg

SEQ ID NO: 2194408 - DNA, 18 bp, Homo sapiens
agcgctatgggtgttaac

SEQ ID NO: 2194409 - DNA, 12 bp, Homo sapiens
agcgctggcctc

SEQ ID NO: 2194410 - DNA, 13 bp, Homo sapiens
agcgctggcctct

SEQ ID NO: 2194411 - DNA, 16 bp, Homo sapiens
agcgctggcctcttcc

SEQ ID NO: 2194412 - DNA, 18 bp, Homo sapiens
agcggccgcctgtccttg

SEQ ID NO: 2194413 - DNA, 17 bp, Homo sapiens
agcgggtaaaaagagaa

SEQ ID NO: 2194414 - DNA, 18 bp, Homo sapiens
agcggtggaaggagcctg

SEQ ID NO: 2194415 - DNA, 23 bp, Homo sapiens
agctaaagaggtggggtgaagct

SEQ ID NO: 2194416 - DNA, 21 bp, Homo sapiens
agctaattctactcacagtgc

SEQ ID NO: 2194417 - DNA, 14 bp, Homo sapiens
aaggctggggctat

SEQ ID NO: 2194418 - DNA, 13 bp, Homo sapiens
aaggcttctccac

SEQ ID NO: 2194419 - DNA, 12 bp, Homo sapiens
aaggcttgcagt

SEQ ID NO: 2194420 - DNA, 21 bp, Homo sapiens
aaggcttttgatccttttgag

SEQ ID NO: 2194421 - DNA, 13 bp, Homo sapiens
aagggacattgaa

SEQ ID NO: 2194422 - DNA, 22 bp, Homo sapiens
aagggacggttgtggtgaagtt

SEQ ID NO: 2194423 - DNA, 16 bp, Homo sapiens
aagggagcagagaagg

SEQ ID NO: 2194424 - DNA, 17 bp, Homo sapiens
aagggccctggcacccc

SEQ ID NO: 2194425 - DNA, 22 bp, Homo sapiens
aagggctaaggcctcttgctgg

SEQ ID NO: 2194426 - DNA, 14 bp, Homo sapiens
aagggcttttcttt

SEQ ID NO: 2194427 - DNA, 12 bp, Homo sapiens
aagggggccctg

SEQ ID NO: 2194428 - DNA, 13 bp, Homo sapiens
aagggggccctgc

SEQ ID NO: 2194429 - DNA, 14 bp, Homo sapiens
aagggggccctgct

SEQ ID NO: 2194430 - DNA, 13 bp, Homo sapiens
aaggtattgcaag

SEQ ID NO: 2194431 - DNA, 17 bp, Homo sapiens
aaggtgcactgagaagc

SEQ ID NO: 2194432 - DNA, 17 bp, Homo sapiens
aaggttggaactgctgc

SEQ ID NO: 2194433 - DNA, 19 bp, Homo sapiens
aaggttggaactgctgcca

SEQ ID NO: 2194434 - DNA, 19 bp, Homo sapiens
aagtaatttccccactctg

SEQ ID NO: 2194435 - DNA, 18 bp, Homo sapiens
aagtactgcaaaatgctt

SEQ ID NO: 2194436 - DNA, 17 bp, Homo sapiens
aagtactggaatttatt

SEQ ID NO: 2194437 - DNA, 15 bp, Homo sapiens
aagtagaataaaaac

SEQ ID NO: 2194438 - DNA, 18 bp, Homo sapiens
aagtatattcaaaaatta

SEQ ID NO: 2194439 - DNA, 15 bp, Homo sapiens
aagtatctgtacctg

SEQ ID NO: 2194440 - DNA, 16 bp, Homo sapiens
aagtatgcactaatca

SEQ ID NO: 2194441 - DNA, 21 bp, Homo sapiens
aagtatgtattatttacattt

SEQ ID NO: 2194442 - DNA, 13 bp, Homo sapiens
aagtattgaaagt

SEQ ID NO: 2194443 - DNA, 13 bp, Homo sapiens
aagtcatgaagct

SEQ ID NO: 2194444 - DNA, 14 bp, Homo sapiens
aagtcatgaagctc

SEQ ID NO: 2194445 - DNA, 12 bp, Homo sapiens
aagtcatttttg

SEQ ID NO: 2194446 - DNA, 17 bp, Homo sapiens
aagtccctgccccctcc

SEQ ID NO: 2194447 - DNA, 15 bp, Homo sapiens
aagtctgtgcctgga

SEQ ID NO: 2194448 - DNA, 17 bp, Homo sapiens
aagtcttcaagggctgc

SEQ ID NO: 2194449 - DNA, 21 bp, Homo sapiens
aagtcttcaagggctgcttca

SEQ ID NO: 2194450 - DNA, 22 bp, Homo sapiens
aagtcttccatcagcagtgatt

SEQ ID NO: 2194451 - DNA, 16 bp, Homo sapiens
aagtgaacaaatttca

SEQ ID NO: 2194452 - DNA, 15 bp, Homo sapiens
aagtgagcaaacctg

SEQ ID NO: 2194453 - DNA, 13 bp, Homo sapiens
aagtgcaaagctg

SEQ ID NO: 2194454 - DNA, 16 bp, Homo sapiens
aagtgcaaagctgctt

SEQ ID NO: 2194455 - DNA, 11 bp, Homo sapiens
aagtgctggga

SEQ ID NO: 2194456 - DNA, 15 bp, Homo sapiens
aagtggctgtgatta

SEQ ID NO: 2194457 - DNA, 21 bp, Homo sapiens
aagtgggagtgggagaggaag

SEQ ID NO: 2194458 - DNA, 23 bp, Homo sapiens
aagtgggagtgggagaggaagcc

SEQ ID NO: 2194459 - DNA, 14 bp, Homo sapiens
aagtggggtgttga

SEQ ID NO: 2194460 - DNA, 15 bp, Homo sapiens
aagtggggtgttgaa

SEQ ID NO: 2194461 - DNA, 13 bp, Homo sapiens
aagtggtgttttt

SEQ ID NO: 2194462 - DNA, 20 bp, Homo sapiens
aagtgtattgcaagtgaaat

SEQ ID NO: 2194463 - DNA, 17 bp, Homo sapiens
aagtgtttaaaagagcc

SEQ ID NO: 2194464 - DNA, 13 bp, Homo sapiens
aagttcatgtcta

SEQ ID NO: 2194465 - DNA, 19 bp, Homo sapiens
aagttgataggagacttgt

SEQ ID NO: 2194466 - DNA, 20 bp, Homo sapiens
aagttgataggagacttgta

SEQ ID NO: 2194467 - DNA, 19 bp, Homo sapiens
aagttgcaaagtggaatta

SEQ ID NO: 2194468 - DNA, 14 bp, Homo sapiens
aagttgtaaagtat

SEQ ID NO: 2194469 - DNA, 21 bp, Homo sapiens
aagttgttagtgatttgctat

SEQ ID NO: 2194470 - DNA, 14 bp, Homo sapiens
aataaaattaatga

SEQ ID NO: 2194471 - DNA, 13 bp, Homo sapiens
aataaaattcatt

SEQ ID NO: 2194472 - DNA, 13 bp, Homo sapiens
aataaagaacatt

SEQ ID NO: 2194473 - DNA, 16 bp, Homo sapiens
aataaagccttttaaa

SEQ ID NO: 2194474 - DNA, 15 bp, Homo sapiens
aataaagtaaattga

SEQ ID NO: 2194475 - DNA, 14 bp, Homo sapiens
aataaagtattcta

SEQ ID NO: 2194476 - DNA, 21 bp, Homo sapiens
aataaagttaaattgcacgtg

SEQ ID NO: 2194477 - DNA, 21 bp, Homo sapiens
aataatagttcaggatttggt

SEQ ID NO: 2194478 - DNA, 14 bp, Homo sapiens
aataatattgattt

SEQ ID NO: 2194479 - DNA, 21 bp, Homo sapiens
aataatgacgtattgtgaaat

SEQ ID NO: 2194480 - DNA, 20 bp, Homo sapiens
aataattgtggagaggagag

SEQ ID NO: 2194481 - DNA, 13 bp, Homo sapiens
aatacaattcaaa

SEQ ID NO: 2194482 - DNA, 16 bp, Homo sapiens
aatacattaacaagct

SEQ ID NO: 2194483 - DNA, 13 bp, Homo sapiens
aataccaccaaca

SEQ ID NO: 2194484 - DNA, 14 bp, Homo sapiens
aataccaccaacaa

SEQ ID NO: 2194485 - DNA, 17 bp, Homo sapiens
aataccaccaacaaata

SEQ ID NO: 2194486 - DNA, 17 bp, Homo sapiens
aatactaaatatgaaat

SEQ ID NO: 2194487 - DNA, 19 bp, Homo sapiens
aatactaaatatgaaattt

SEQ ID NO: 2194488 - DNA, 12 bp, Homo sapiens
aatactgtacat

SEQ ID NO: 2194489 - DNA, 22 bp, Homo sapiens
aatactgtacatagatgtatca

SEQ ID NO: 2194490 - DNA, 18 bp, Homo sapiens
aatacttatgttgtattg

SEQ ID NO: 2194491 - DNA, 14 bp, Homo sapiens
aatagattcttaaa

SEQ ID NO: 2194492 - DNA, 20 bp, Homo sapiens
aatagctatcctaaatttga

SEQ ID NO: 2194493 - DNA, 21 bp, Homo sapiens
aatagcttgtacacatataca

SEQ ID NO: 2194494 - DNA, 15 bp, Homo sapiens
aatataagtttcttt

SEQ ID NO: 2194495 - DNA, 12 bp, Homo sapiens
aatatatataat

SEQ ID NO: 2194496 - DNA, 16 bp, Homo sapiens
aatatattgaataggc

SEQ ID NO: 2194497 - DNA, 19 bp, Homo sapiens
aatatattgaataggcatt

SEQ ID NO: 2194498 - DNA, 19 bp, Homo sapiens
aatatcctccactttcagg

SEQ ID NO: 2194499 - DNA, 19 bp, Homo sapiens
aatatctacctgccctctc

SEQ ID NO: 2194500 - DNA, 18 bp, Homo sapiens
aatatgtgagcatgaaac

SEQ ID NO: 2194501 - DNA, 13 bp, Homo sapiens
aatatgtgattat

SEQ ID NO: 2194502 - DNA, 15 bp, Homo sapiens
aatattaaaaattaa

SEQ ID NO: 2194503 - DNA, 20 bp, Homo sapiens
aatattaaaaattaattctt

SEQ ID NO: 2194504 - DNA, 23 bp, Homo sapiens
aatattaaaaattaattctttat

SEQ ID NO: 2194505 - DNA, 12 bp, Homo sapiens
aatattaattta

SEQ ID NO: 2194506 - DNA, 20 bp, Homo sapiens
aatattaatttatatttgtc

SEQ ID NO: 2194507 - DNA, 21 bp, Homo sapiens
aatattaatttatatttgtct

SEQ ID NO: 2194508 - DNA, 20 bp, Homo sapiens
aatattgatttctgccttcc

SEQ ID NO: 2194509 - DNA, 17 bp, Homo sapiens
aatattttttttaactg

SEQ ID NO: 2194510 - DNA, 20 bp, Homo sapiens
aatcaagtctgtgaaagtct

SEQ ID NO: 2194511 - DNA, 14 bp, Homo sapiens
aatcaagtgcacct

SEQ ID NO: 2194512 - DNA, 13 bp, Homo sapiens
aatcaatactttg

SEQ ID NO: 2194513 - DNA, 14 bp, Homo sapiens
aatcaatactttga

SEQ ID NO: 2194514 - DNA, 17 bp, Homo sapiens
aatcacaaaagtatatt

SEQ ID NO: 2194515 - DNA, 20 bp, Homo sapiens
aatcactcatttatttccat

SEQ ID NO: 2194516 - DNA, 15 bp, Homo sapiens
aatcactgagtttgt

SEQ ID NO: 2194517 - DNA, 12 bp, Homo sapiens
aatcacttttgg

SEQ ID NO: 2194518 - DNA, 19 bp, Homo sapiens
aatcaggaggagattaaca

SEQ ID NO: 2194519 - DNA, 17 bp, Homo sapiens
aatcagtgatgggagta

SEQ ID NO: 2194520 - DNA, 15 bp, Homo sapiens
aatcagttttgtgta

SEQ ID NO: 2194521 - DNA, 14 bp, Homo sapiens
aatcattttagaat

SEQ ID NO: 2194522 - DNA, 18 bp, Homo sapiens
aatcattttagaattaaa

SEQ ID NO: 2194523 - DNA, 13 bp, Homo sapiens
aatcccagttcat

SEQ ID NO: 2194524 - DNA, 22 bp, Homo sapiens
aatccctctggcccacacagat

SEQ ID NO: 2194525 - DNA, 13 bp, Homo sapiens
aatccctgctttt

SEQ ID NO: 2194526 - DNA, 14 bp, Homo sapiens
aatccctgcttttt

SEQ ID NO: 2194527 - DNA, 22 bp, Homo sapiens
aatccctgctttttgtgttttt

SEQ ID NO: 2194528 - DNA, 14 bp, Homo sapiens
acacccccacccct

SEQ ID NO: 2194529 - DNA, 22 bp, Homo sapiens
acacctaagtgactaccactta

SEQ ID NO: 2194530 - DNA, 10 bp, Homo sapiens
acacctcaga

SEQ ID NO: 2194531 - DNA, 12 bp, Homo sapiens
acacctcagagc

SEQ ID NO: 2194532 - DNA, 20 bp, Homo sapiens
acacggttttggcagctgac

SEQ ID NO: 2194533 - DNA, 15 bp, Homo sapiens
acactacctcttttg

SEQ ID NO: 2194534 - DNA, 21 bp, Homo sapiens
acactacctcttttgagactt

SEQ ID NO: 2194535 - DNA, 20 bp, Homo sapiens
acactagtctgtgtgctgtg

SEQ ID NO: 2194536 - DNA, 18 bp, Homo sapiens
acactcattgaaatgtaa

SEQ ID NO: 2194537 - DNA, 13 bp, Homo sapiens
acactcttcagtg

SEQ ID NO: 2194538 - DNA, 22 bp, Homo sapiens
acactcttcagtgactcctgct

SEQ ID NO: 2194539 - DNA, 15 bp, Homo sapiens
acactgcgaactctc

SEQ ID NO: 2194540 - DNA, 14 bp, Homo sapiens
acactgtctgcata

SEQ ID NO: 2194541 - DNA, 23 bp, Homo sapiens
acactgtgattactctttgcttt

SEQ ID NO: 2194542 - DNA, 21 bp, Homo sapiens
acactttgccatttgcttgta

SEQ ID NO: 2194543 - DNA, 22 bp, Homo sapiens
acactttggtattcaatttgat

SEQ ID NO: 2194544 - DNA, 20 bp, Homo sapiens
acagaagtagtggtttgctt

SEQ ID NO: 2194545 - DNA, 23 bp, Homo sapiens
acagaagtagtggtttgctttga

SEQ ID NO: 2194546 - DNA, 13 bp, Homo sapiens
acagacaagcagc

SEQ ID NO: 2194547 - DNA, 17 bp, Homo sapiens
acagactatttttagat

SEQ ID NO: 2194548 - DNA, 18 bp, Homo sapiens
acagactggagacaatgc

SEQ ID NO: 2194549 - DNA, 17 bp, Homo sapiens
acagaggcagtggcagc

SEQ ID NO: 2194550 - DNA, 19 bp, Homo sapiens
acagagtgggccccgggct

SEQ ID NO: 2194551 - DNA, 16 bp, Homo sapiens
acagatggctgtgaaa

SEQ ID NO: 2194552 - DNA, 21 bp, Homo sapiens
acagatggctgtgaaaattac

SEQ ID NO: 2194553 - DNA, 22 bp, Homo sapiens
acagatgttccatcctgtacaa

SEQ ID NO: 2194554 - DNA, 22 bp, Homo sapiens
acagcacctcctctctgctggg

SEQ ID NO: 2194555 - DNA, 15 bp, Homo sapiens
acagcaggcccacct

SEQ ID NO: 2194556 - DNA, 21 bp, Homo sapiens
acagcatgactggacagcggt

SEQ ID NO: 2194557 - DNA, 22 bp, Homo sapiens
acagcatgactggacagcggtt

SEQ ID NO: 2194558 - DNA, 15 bp, Homo sapiens
acagcccgcatgcag

SEQ ID NO: 2194559 - DNA, 20 bp, Homo sapiens
acagcccgcatgcagcagct

SEQ ID NO: 2194560 - DNA, 23 bp, Homo sapiens
acagccggatcttggagacaatt

SEQ ID NO: 2194561 - DNA, 12 bp, Homo sapiens
acagcctgtctt

SEQ ID NO: 2194562 - DNA, 20 bp, Homo sapiens
acagcctgtcttcagatcct

SEQ ID NO: 2194563 - DNA, 12 bp, Homo sapiens
acagcgagaaaa

SEQ ID NO: 2194564 - DNA, 21 bp, Homo sapiens
acagcggttgtaaatacaatt

SEQ ID NO: 2194565 - DNA, 14 bp, Homo sapiens
acagctcagccagt

SEQ ID NO: 2194566 - DNA, 21 bp, Homo sapiens
acagctcagccagtggggatg

SEQ ID NO: 2194567 - DNA, 23 bp, Homo sapiens
acagctccttgtgagtgtgtgca

SEQ ID NO: 2194568 - DNA, 23 bp, Homo sapiens
acagctgtggtgaggttgggcag

SEQ ID NO: 2194569 - DNA, 20 bp, Homo sapiens
acagctgtttgaattggacc

SEQ ID NO: 2194570 - DNA, 19 bp, Homo sapiens
acagcttttagtacccacc

SEQ ID NO: 2194571 - DNA, 21 bp, Homo sapiens
acagcttttagtacccacctg

SEQ ID NO: 2194572 - DNA, 22 bp, Homo sapiens
acaggacagcatggtgcatgcc

SEQ ID NO: 2194573 - DNA, 14 bp, Homo sapiens
acaggaccctcagg

SEQ ID NO: 2194574 - DNA, 16 bp, Homo sapiens
acaggaccctcaggaa

SEQ ID NO: 2194575 - DNA, 23 bp, Homo sapiens
acaggattccagttgcgtgtctg

SEQ ID NO: 2194576 - DNA, 13 bp, Homo sapiens
acagggcctgact

SEQ ID NO: 2194577 - DNA, 19 bp, Homo sapiens
acaggggctggtgggcacc

SEQ ID NO: 2194578 - DNA, 14 bp, Homo sapiens
acagggtcctgcta

SEQ ID NO: 2194579 - DNA, 19 bp, Homo sapiens
acaggtaaacagaaatcct

SEQ ID NO: 2194580 - DNA, 19 bp, Homo sapiens
acaggtctgggagaggcag

SEQ ID NO: 2194581 - DNA, 14 bp, Homo sapiens
acaggtgagtgcca

SEQ ID NO: 2194582 - DNA, 14 bp, Homo sapiens
acagtcatattttt

SEQ ID NO: 2194583 - DNA, 21 bp, Homo sapiens
acagtccagttttgtgtgctt

SEQ ID NO: 2194584 - DNA, 15 bp, Homo sapiens
acagtgaataaaagg

SEQ ID NO: 2194585 - DNA, 21 bp, Homo sapiens
acagtgcttttaagtgaaaat

SEQ ID NO: 2194586 - DNA, 15 bp, Homo sapiens
acagtggttgcctgg

SEQ ID NO: 2194587 - DNA, 17 bp, Homo sapiens
acagtgtttggtgacat

SEQ ID NO: 2194588 - DNA, 15 bp, Homo sapiens
acagttaaacttgca

SEQ ID NO: 2194589 - DNA, 18 bp, Homo sapiens
acagttaaacttgcaatg

SEQ ID NO: 2194590 - DNA, 21 bp, Homo sapiens
acagttgactggctttcctct

SEQ ID NO: 2194591 - DNA, 12 bp, Homo sapiens
acataaaacaaa

SEQ ID NO: 2194592 - DNA, 18 bp, Homo sapiens
acataaaacaaaaccaag

SEQ ID NO: 2194593 - DNA, 17 bp, Homo sapiens
acataagctagaaaaat

SEQ ID NO: 2194594 - DNA, 11 bp, Homo sapiens
acataatttgc

SEQ ID NO: 2194595 - DNA, 15 bp, Homo sapiens
acataatttgcataa

SEQ ID NO: 2194596 - DNA, 22 bp, Homo sapiens
acataatttgcataaagggccc

SEQ ID NO: 2194597 - DNA, 19 bp, Homo sapiens
acatacatagagagagaca

SEQ ID NO: 2194598 - DNA, 23 bp, Homo sapiens
acatacttcatcgcagtggactg

SEQ ID NO: 2194599 - DNA, 18 bp, Homo sapiens
acatagatgtatcattaa

SEQ ID NO: 2194600 - DNA, 21 bp, Homo sapiens
acatagatgtatcattaatgt

SEQ ID NO: 2194601 - DNA, 15 bp, Homo sapiens
acataggtgtgcttc

SEQ ID NO: 2194602 - DNA, 21 bp, Homo sapiens
acatatacatatgatcaaata

SEQ ID NO: 2194603 - DNA, 17 bp, Homo sapiens
acatatggaattttgca

SEQ ID NO: 2194604 - DNA, 21 bp, Homo sapiens
acatccaacatttcctcaggc

SEQ ID NO: 2194605 - DNA, 13 bp, Homo sapiens
acatccccaaagg

SEQ ID NO: 2194606 - DNA, 17 bp, Homo sapiens
acatccccgctggctgg

SEQ ID NO: 2194607 - DNA, 15 bp, Homo sapiens
acatctgccttgctg

SEQ ID NO: 2194608 - DNA, 23 bp, Homo sapiens
acatgcactactgaaatttacac

SEQ ID NO: 2194609 - DNA, 21 bp, Homo sapiens
acatgctacctgatcccactc

SEQ ID NO: 2194610 - DNA, 20 bp, Homo sapiens
acatgcttaagggggtgtaa

SEQ ID NO: 2194611 - DNA, 14 bp, Homo sapiens
acatggaagggaag

SEQ ID NO: 2194612 - DNA, 19 bp, Homo sapiens
acatgtatgtttgctcctg

SEQ ID NO: 2194613 - DNA, 17 bp, Homo sapiens
acatgtgctctggggaa

SEQ ID NO: 2194614 - DNA, 23 bp, Homo sapiens
acatgtgctctggggaattctga

SEQ ID NO: 2194615 - DNA, 17 bp, Homo sapiens
acattaatttatgcaga

SEQ ID NO: 2194616 - DNA, 14 bp, Homo sapiens
acatttcctcaggc

SEQ ID NO: 2194617 - DNA, 12 bp, Homo sapiens
acatttctcaaa

SEQ ID NO: 2194618 - DNA, 14 bp, Homo sapiens
acattttgccaaaa

SEQ ID NO: 2194619 - DNA, 15 bp, Homo sapiens
acatttttaaaaaat

SEQ ID NO: 2194620 - DNA, 23 bp, Homo sapiens
actgtaactgcattagaaaccat

SEQ ID NO: 2194621 - DNA, 23 bp, Homo sapiens
actgtatttgaaataagaattca

SEQ ID NO: 2194622 - DNA, 14 bp, Homo sapiens
actgtcttgagaaa

SEQ ID NO: 2194623 - DNA, 18 bp, Homo sapiens
actgtgacctaagaacaa

SEQ ID NO: 2194624 - DNA, 12 bp, Homo sapiens
actgtgcagtta

SEQ ID NO: 2194625 - DNA, 17 bp, Homo sapiens
actgtgcatcaaccagg

SEQ ID NO: 2194626 - DNA, 21 bp, Homo sapiens
actgtgctggagccactaact

SEQ ID NO: 2194627 - DNA, 14 bp, Homo sapiens
actgtggaggtggc

SEQ ID NO: 2194628 - DNA, 20 bp, Homo sapiens
actgtttgtcttctccccag

SEQ ID NO: 2194629 - DNA, 15 bp, Homo sapiens
acttaaaaatatgtg

SEQ ID NO: 2194630 - DNA, 14 bp, Homo sapiens
acttaaatgttacc

SEQ ID NO: 2194631 - DNA, 15 bp, Homo sapiens
acttaagacaaatgg

SEQ ID NO: 2194632 - DNA, 17 bp, Homo sapiens
acttaagacaaatggga

SEQ ID NO: 2194633 - DNA, 22 bp, Homo sapiens
acttaagacaaatgggactgat

SEQ ID NO: 2194634 - DNA, 19 bp, Homo sapiens
acttcaaaatcagtgatgg

SEQ ID NO: 2194635 - DNA, 15 bp, Homo sapiens
acttcacacagcacc

SEQ ID NO: 2194636 - DNA, 18 bp, Homo sapiens
acttcactaaagtgtcat

SEQ ID NO: 2194637 - DNA, 22 bp, Homo sapiens
acttcagatacttgtgaacatg

SEQ ID NO: 2194638 - DNA, 15 bp, Homo sapiens
acttcagctttgtgt

SEQ ID NO: 2194639 - DNA, 19 bp, Homo sapiens
acttcattctaaaccaaaa

SEQ ID NO: 2194640 - DNA, 19 bp, Homo sapiens
acttccccctcttcttctg

SEQ ID NO: 2194641 - DNA, 13 bp, Homo sapiens
acttcgtgggatc

SEQ ID NO: 2194642 - DNA, 22 bp, Homo sapiens
acttcgtgggatctgcccctcc

SEQ ID NO: 2194643 - DNA, 13 bp, Homo sapiens
acttctccagcct

SEQ ID NO: 2194644 - DNA, 15 bp, Homo sapiens
acttctccagcctag

SEQ ID NO: 2194645 - DNA, 15 bp, Homo sapiens
acttgaaaagattgc

SEQ ID NO: 2194646 - DNA, 16 bp, Homo sapiens
acttgaaaagattgca

SEQ ID NO: 2194647 - DNA, 19 bp, Homo sapiens
acttgaaaagattgcaaag

SEQ ID NO: 2194648 - DNA, 22 bp, Homo sapiens
acttgaagtgaacaaatttcaa

SEQ ID NO: 2194649 - DNA, 18 bp, Homo sapiens
acttgcaatgaaaagaaa

SEQ ID NO: 2194650 - DNA, 15 bp, Homo sapiens
acttgccacatccca

SEQ ID NO: 2194651 - DNA, 17 bp, Homo sapiens
acttggccgcttcccta

SEQ ID NO: 2194652 - DNA, 17 bp, Homo sapiens
acttgggccatagctcc

SEQ ID NO: 2194653 - DNA, 20 bp, Homo sapiens
acttggtagttcataaaggt

SEQ ID NO: 2194654 - DNA, 16 bp, Homo sapiens
acttggttctgaagcc

SEQ ID NO: 2194655 - DNA, 15 bp, Homo sapiens
acttgtaaacttgaa

SEQ ID NO: 2194656 - DNA, 17 bp, Homo sapiens
acttgtaaacttgaaag

SEQ ID NO: 2194657 - DNA, 15 bp, Homo sapiens
acttgtacagttgac

SEQ ID NO: 2194658 - DNA, 14 bp, Homo sapiens
acttgtgcttttgc

SEQ ID NO: 2194659 - DNA, 13 bp, Homo sapiens
acttgttttcccc

SEQ ID NO: 2194660 - DNA, 19 bp, Homo sapiens
actttaatggtagcatgtt

SEQ ID NO: 2194661 - DNA, 16 bp, Homo sapiens
actttaccacccccac

SEQ ID NO: 2194662 - DNA, 20 bp, Homo sapiens
actttcatctaaattactga

SEQ ID NO: 2194663 - DNA, 22 bp, Homo sapiens
actttccccatactctgtctcc

SEQ ID NO: 2194664 - DNA, 21 bp, Homo sapiens
actttgcccagggtcctgtgc

SEQ ID NO: 2194665 - DNA, 14 bp, Homo sapiens
actttggaaggagg

SEQ ID NO: 2194666 - DNA, 20 bp, Homo sapiens
actttggagaactcatttca

SEQ ID NO: 2194667 - DNA, 21 bp, Homo sapiens
actttggagaactcatttcaa

SEQ ID NO: 2194668 - DNA, 14 bp, Homo sapiens
actttgtattctct

SEQ ID NO: 2194669 - DNA, 18 bp, Homo sapiens
acttttaaaatttgtaga

SEQ ID NO: 2194670 - DNA, 22 bp, Homo sapiens
acttttaaataaattatgaata

SEQ ID NO: 2194671 - DNA, 23 bp, Homo sapiens
actttttatgggttttgcttaaa

SEQ ID NO: 2194672 - DNA, 16 bp, Homo sapiens
agaaaaacatgtcatg

SEQ ID NO: 2194673 - DNA, 17 bp, Homo sapiens
agaaaacccaagttttt

SEQ ID NO: 2194674 - DNA, 13 bp, Homo sapiens
agaaaagcttgga

SEQ ID NO: 2194675 - DNA, 18 bp, Homo sapiens
agaaaattgccaaaatat

SEQ ID NO: 2194676 - DNA, 17 bp, Homo sapiens
agaaacatttatctttg

SEQ ID NO: 2194677 - DNA, 17 bp, Homo sapiens
agaaacttaaatgttat

SEQ ID NO: 2194678 - DNA, 18 bp, Homo sapiens
agaaagagagaagccagc

SEQ ID NO: 2194679 - DNA, 19 bp, Homo sapiens
agaaagagagaagccagcc

SEQ ID NO: 2194680 - DNA, 20 bp, Homo sapiens
agaaagagctgcctggatga

SEQ ID NO: 2194681 - DNA, 13 bp, Homo sapiens
agaaagctgtgaa

SEQ ID NO: 2194682 - DNA, 15 bp, Homo sapiens
agaaagctgtgaaat

SEQ ID NO: 2194683 - DNA, 18 bp, Homo sapiens
agaaagggagcagagaag

SEQ ID NO: 2194684 - DNA, 21 bp, Homo sapiens
agaaaggggcaggagctcaga

SEQ ID NO: 2194685 - DNA, 21 bp, Homo sapiens
agaaatgccaaaaatgtgcct

SEQ ID NO: 2194686 - DNA, 15 bp, Homo sapiens
agaaattacaagttt

SEQ ID NO: 2194687 - DNA, 19 bp, Homo sapiens
agaaattacaagtttcagt

SEQ ID NO: 2194688 - DNA, 21 bp, Homo sapiens
agaaattacaagtttcagtaa

SEQ ID NO: 2194689 - DNA, 14 bp, Homo sapiens
agaaattccctgga

SEQ ID NO: 2194690 - DNA, 15 bp, Homo sapiens
agagggagcaagcct

SEQ ID NO: 2194691 - DNA, 18 bp, Homo sapiens
agagggagcaagccttcc

SEQ ID NO: 2194692 - DNA, 17 bp, Homo sapiens
agagggatgcagtgcct

SEQ ID NO: 2194693 - DNA, 13 bp, Homo sapiens
agagggcaaagct

SEQ ID NO: 2194694 - DNA, 14 bp, Homo sapiens
agagggcaaagctg

SEQ ID NO: 2194695 - DNA, 15 bp, Homo sapiens
agaggggagaggaag

SEQ ID NO: 2194696 - DNA, 22 bp, Homo sapiens
agaggtgggaggcccctggtgg

SEQ ID NO: 2194697 - DNA, 20 bp, Homo sapiens
agaggtggggaagagagcct

SEQ ID NO: 2194698 - DNA, 23 bp, Homo sapiens
agaggtggggaagagagcctgcc

SEQ ID NO: 2194699 - DNA, 17 bp, Homo sapiens
agaggtggggtgaagct

SEQ ID NO: 2194700 - DNA, 18 bp, Homo sapiens
agaggtggggtgaagctg

SEQ ID NO: 2194701 - DNA, 21 bp, Homo sapiens
agagtaagcacctttagaata

SEQ ID NO: 2194702 - DNA, 18 bp, Homo sapiens
agagtagcaccttcagaa

SEQ ID NO: 2194703 - DNA, 12 bp, Homo sapiens
agagtccaggaa

SEQ ID NO: 2194704 - DNA, 14 bp, Homo sapiens
agagtcctgaggca

SEQ ID NO: 2194705 - DNA, 19 bp, Homo sapiens
agagtgccccacctgccac

SEQ ID NO: 2194706 - DNA, 17 bp, Homo sapiens
agagtggagactctgtt

SEQ ID NO: 2194707 - DNA, 17 bp, Homo sapiens
agagtggagccctcagt

SEQ ID NO: 2194708 - DNA, 14 bp, Homo sapiens
agagtgggccccgg

SEQ ID NO: 2194709 - DNA, 17 bp, Homo sapiens
agagtgggccccgggct

SEQ ID NO: 2194710 - DNA, 23 bp, Homo sapiens
agagtgggccccgggctggagaa

SEQ ID NO: 2194711 - DNA, 21 bp, Homo sapiens
agagtgtggaaaaaaaaagaa

SEQ ID NO: 2194712 - DNA, 17 bp, Homo sapiens
agagttatttaggcttt

SEQ ID NO: 2194713 - DNA, 18 bp, Homo sapiens
agataaaaataaaatgta

SEQ ID NO: 2194714 - DNA, 18 bp, Homo sapiens
agataagtaatttacctg

SEQ ID NO: 2194715 - DNA, 14 bp, Homo sapiens
agatcactttgctc

SEQ ID NO: 2194716 - DNA, 17 bp, Homo sapiens
agatcagaacattcagc

SEQ ID NO: 2194717 - DNA, 22 bp, Homo sapiens
agatcctaccccaattccttgt

SEQ ID NO: 2194718 - DNA, 12 bp, Homo sapiens
agatcctgctgc

SEQ ID NO: 2194719 - DNA, 15 bp, Homo sapiens
agatcggggccagag

SEQ ID NO: 2194720 - DNA, 13 bp, Homo sapiens
agatctccaaagc

SEQ ID NO: 2194721 - DNA, 15 bp, Homo sapiens
agatctccaaagctt

SEQ ID NO: 2194722 - DNA, 21 bp, Homo sapiens
agatctccaaagctttcctgg

SEQ ID NO: 2194723 - DNA, 19 bp, Homo sapiens
agatgagaattcagctgcc

SEQ ID NO: 2194724 - DNA, 14 bp, Homo sapiens
agatgccctgctag

SEQ ID NO: 2194725 - DNA, 21 bp, Homo sapiens
agatgcctccctgaccctgca

SEQ ID NO: 2194726 - DNA, 21 bp, Homo sapiens
agatgccttctagattcactg

SEQ ID NO: 2194727 - DNA, 14 bp, Homo sapiens
agatggctgtgaaa

SEQ ID NO: 2194728 - DNA, 17 bp, Homo sapiens
agatggctgtgaaaatt

SEQ ID NO: 2194729 - DNA, 17 bp, Homo sapiens
agatgttcagtcatttt

SEQ ID NO: 2194730 - DNA, 19 bp, Homo sapiens
agattatgttcaatgaata

SEQ ID NO: 2194731 - DNA, 17 bp, Homo sapiens
agattcccggctggact

SEQ ID NO: 2194732 - DNA, 13 bp, Homo sapiens
agattctcaaagg

SEQ ID NO: 2194733 - DNA, 16 bp, Homo sapiens
agattctcttgaataa

SEQ ID NO: 2194734 - DNA, 12 bp, Homo sapiens
agattgacaagg

SEQ ID NO: 2194735 - DNA, 12 bp, Homo sapiens
agattgtgtctg

SEQ ID NO: 2194736 - DNA, 22 bp, Homo sapiens
agattttcttttgccttttgca

SEQ ID NO: 2194737 - DNA, 21 bp, Homo sapiens
agatttttaaaatgaatctta

SEQ ID NO: 2194738 - DNA, 19 bp, Homo sapiens
agcaaaagttaatattcag

SEQ ID NO: 2194739 - DNA, 15 bp, Homo sapiens
agcaaacctgcccca

SEQ ID NO: 2194740 - DNA, 13 bp, Homo sapiens
agcaaactatatt

SEQ ID NO: 2194741 - DNA, 14 bp, Homo sapiens
agcaaattccaata

SEQ ID NO: 2194742 - DNA, 20 bp, Homo sapiens
agcaaatttcatctttccaa

SEQ ID NO: 2194743 - DNA, 21 bp, Homo sapiens
agcaaatttcatctttccaaa

SEQ ID NO: 2194744 - DNA, 19 bp, Homo sapiens
agcaacaaaggatttgaaa

SEQ ID NO: 2194745 - DNA, 19 bp, Homo sapiens
agcaactggaaaagtgttc

SEQ ID NO: 2194746 - DNA, 18 bp, Homo sapiens
agcaactttgatggaaga

SEQ ID NO: 2194747 - DNA, 13 bp, Homo sapiens
agcaagccttcct

SEQ ID NO: 2194748 - DNA, 15 bp, Homo sapiens
agcaagctcttctcc

SEQ ID NO: 2194749 - DNA, 16 bp, Homo sapiens
agcaagctcttctcct

SEQ ID NO: 2194750 - DNA, 14 bp, Homo sapiens
agcaatcctcctga

SEQ ID NO: 2194751 - DNA, 22 bp, Homo sapiens
agcacaagaagtgggagtggga

SEQ ID NO: 2194752 - DNA, 21 bp, Homo sapiens
accatctatgtgaatatttgt

SEQ ID NO: 2194753 - DNA, 23 bp, Homo sapiens
accatcttcagctgtatgaaagg

SEQ ID NO: 2194754 - DNA, 18 bp, Homo sapiens
accatcttggccaggctg

SEQ ID NO: 2194755 - DNA, 10 bp, Homo sapiens
accatctttg

SEQ ID NO: 2194756 - DNA, 18 bp, Homo sapiens
accatgtcatttcagaag

SEQ ID NO: 2194757 - DNA, 13 bp, Homo sapiens
accattctccttc

SEQ ID NO: 2194758 - DNA, 19 bp, Homo sapiens
accattttgcgatgtgttt

SEQ ID NO: 2194759 - DNA, 15 bp, Homo sapiens
accatttttaatgag

SEQ ID NO: 2194760 - DNA, 22 bp, Homo sapiens
acccaaaagctcagccagcccc

SEQ ID NO: 2194761 - DNA, 17 bp, Homo sapiens
acccaaatcctctccag

SEQ ID NO: 2194762 - DNA, 13 bp, Homo sapiens
acccacagggcct

SEQ ID NO: 2194763 - DNA, 14 bp, Homo sapiens
acccacagggcctg

SEQ ID NO: 2194764 - DNA, 18 bp, Homo sapiens
acccacagggcctgactt

SEQ ID NO: 2194765 - DNA, 13 bp, Homo sapiens
acccacctgagct

SEQ ID NO: 2194766 - DNA, 14 bp, Homo sapiens
acccacctgagctt

SEQ ID NO: 2194767 - DNA, 23 bp, Homo sapiens
acccactaattgtaaggtattgc

SEQ ID NO: 2194768 - DNA, 23 bp, Homo sapiens
acccactccggattccggccctg

SEQ ID NO: 2194769 - DNA, 23 bp, Homo sapiens
acccagaagatgtattcagagcc

SEQ ID NO: 2194770 - DNA, 22 bp, Homo sapiens
acccatttgccatgctgctatg

SEQ ID NO: 2194771 - DNA, 17 bp, Homo sapiens
accccaattccttgtag

SEQ ID NO: 2194772 - DNA, 20 bp, Homo sapiens
acccccacaagctgtccctg

SEQ ID NO: 2194773 - DNA, 16 bp, Homo sapiens
acccccaccccttgct

SEQ ID NO: 2194774 - DNA, 19 bp, Homo sapiens
acccccacccgttaattta

SEQ ID NO: 2194775 - DNA, 16 bp, Homo sapiens
accccccactctgtgc

SEQ ID NO: 2194776 - DNA, 19 bp, Homo sapiens
accccccactctgtgcctg

SEQ ID NO: 2194777 - DNA, 15 bp, Homo sapiens
accccctccccgccc

SEQ ID NO: 2194778 - DNA, 21 bp, Homo sapiens
accccctccccgcccttcttt

SEQ ID NO: 2194779 - DNA, 17 bp, Homo sapiens
acccccttgtctgctgc

SEQ ID NO: 2194780 - DNA, 13 bp, Homo sapiens
accccgagcccta

SEQ ID NO: 2194781 - DNA, 15 bp, Homo sapiens
accccgcacccggct

SEQ ID NO: 2194782 - DNA, 23 bp, Homo sapiens
acccctcttagcttacaggaagc

SEQ ID NO: 2194783 - DNA, 13 bp, Homo sapiens
acccctggctggt

SEQ ID NO: 2194784 - DNA, 21 bp, Homo sapiens
acccctgtctgcgccgctgtg

SEQ ID NO: 2194785 - DNA, 14 bp, Homo sapiens
accccttcctgtct

SEQ ID NO: 2194786 - DNA, 20 bp, Homo sapiens
accccttcctgtctggccca

SEQ ID NO: 2194787 - DNA, 18 bp, Homo sapiens
accccttggaggagagag

SEQ ID NO: 2194788 - DNA, 20 bp, Homo sapiens
accccttggaggagagagac

SEQ ID NO: 2194789 - DNA, 17 bp, Homo sapiens
acccgccttggcctccc

SEQ ID NO: 2194790 - DNA, 19 bp, Homo sapiens
acccgtcttcaatctctgt

SEQ ID NO: 2194791 - DNA, 13 bp, Homo sapiens
acccgtttccaag

SEQ ID NO: 2194792 - DNA, 14 bp, Homo sapiens
accctatcatcagt

SEQ ID NO: 2194793 - DNA, 14 bp, Homo sapiens
accctctgcagggc

SEQ ID NO: 2194794 - DNA, 16 bp, Homo sapiens
accctgaggtatctgt

SEQ ID NO: 2194795 - DNA, 20 bp, Homo sapiens
accctgaggtatctgtgtta

SEQ ID NO: 2194796 - DNA, 20 bp, Homo sapiens
accctgccccccctaagaga

SEQ ID NO: 2194797 - DNA, 19 bp, Homo sapiens
accctgcttggggcctggc

SEQ ID NO: 2194798 - DNA, 22 bp, Homo sapiens
accctgttttattgagttctga

SEQ ID NO: 2194799 - DNA, 16 bp, Homo sapiens
acccttctgtgcccag

SEQ ID NO: 2194800 - DNA, 23 bp, Homo sapiens
acccttgccaaggccgcccacct

SEQ ID NO: 2194801 - DNA, 14 bp, Homo sapiens
accctttcttcaat

SEQ ID NO: 2194802 - DNA, 20 bp, Homo sapiens
accgacatttttcaataaag

SEQ ID NO: 2194803 - DNA, 19 bp, Homo sapiens
accgatttcagcacatgca

SEQ ID NO: 2194804 - DNA, 12 bp, Homo sapiens
accggcctggac

SEQ ID NO: 2194805 - DNA, 14 bp, Homo sapiens
accggcctggacct

SEQ ID NO: 2194806 - DNA, 15 bp, Homo sapiens
accggttgcttctgg

SEQ ID NO: 2194807 - DNA, 17 bp, Homo sapiens
accgtcacactcttcag

SEQ ID NO: 2194808 - DNA, 13 bp, Homo sapiens
accgttgttgttt

SEQ ID NO: 2194809 - DNA, 17 bp, Homo sapiens
acctaaaaatcaatcac

SEQ ID NO: 2194810 - DNA, 22 bp, Homo sapiens
acctaaaatttgccctcccatc

SEQ ID NO: 2194811 - DNA, 13 bp, Homo sapiens
acctaagaacaaa

SEQ ID NO: 2194812 - DNA, 19 bp, Homo sapiens
acctaagggctaaggcctc

SEQ ID NO: 2194813 - DNA, 11 bp, Homo sapiens
acctacctgtg

SEQ ID NO: 2194814 - DNA, 20 bp, Homo sapiens
acctacttgtaaacttgaaa

SEQ ID NO: 2194815 - DNA, 23 bp, Homo sapiens
acctataaatactaaatatgaaa

SEQ ID NO: 2194816 - DNA, 15 bp, Homo sapiens
acctattaaaagttg

SEQ ID NO: 2194817 - DNA, 16 bp, Homo sapiens
acctcagagccccgca

SEQ ID NO: 2194818 - DNA, 14 bp, Homo sapiens
acctcagtttctgt

SEQ ID NO: 2194819 - DNA, 12 bp, Homo sapiens
acctcccacctt

SEQ ID NO: 2194820 - DNA, 16 bp, Homo sapiens
acctcccacctttggt

SEQ ID NO: 2194821 - DNA, 15 bp, Homo sapiens
acctcctctctgctg

SEQ ID NO: 2194822 - DNA, 12 bp, Homo sapiens
acctccttctct

SEQ ID NO: 2194823 - DNA, 16 bp, Homo sapiens
acctcctttctcttct

SEQ ID NO: 2194824 - DNA, 17 bp, Homo sapiens
acctcctttctcttctc

SEQ ID NO: 2194825 - DNA, 20 bp, Homo sapiens
acctcctttctcttctctgt

SEQ ID NO: 2194826 - DNA, 10 bp, Homo sapiens
acctctgggc

SEQ ID NO: 2194827 - DNA, 20 bp, Homo sapiens
acctctgtcacgttctggaa

SEQ ID NO: 2194828 - DNA, 20 bp, Homo sapiens
acctcttttgagactttgcc

SEQ ID NO: 2194829 - DNA, 23 bp, Homo sapiens
acctgagctttggacgcacacag

SEQ ID NO: 2194830 - DNA, 21 bp, Homo sapiens
acctgaggcccagcagagccg

SEQ ID NO: 2194831 - DNA, 15 bp, Homo sapiens
acctgatcccactcc

SEQ ID NO: 2194832 - DNA, 20 bp, Homo sapiens
acctgcacagggccctctga

SEQ ID NO: 2194833 - DNA, 19 bp, Homo sapiens
acctgcatcagcctctggc

SEQ ID NO: 2194834 - DNA, 20 bp, Homo sapiens
acctgcatcagcctctggcc

SEQ ID NO: 2194835 - DNA, 21 bp, Homo sapiens
acctgcatcagcctctggcca

SEQ ID NO: 2194836 - DNA, 20 bp, Homo sapiens
acctgcatgtgttgtacaat

SEQ ID NO: 2194837 - DNA, 19 bp, Homo sapiens
actctcctgcctcagcctc

SEQ ID NO: 2194838 - DNA, 20 bp, Homo sapiens
actctctagttccctcagtg

SEQ ID NO: 2194839 - DNA, 16 bp, Homo sapiens
actctgcccaccctcc

SEQ ID NO: 2194840 - DNA, 20 bp, Homo sapiens
actctgggcacttttgaact

SEQ ID NO: 2194841 - DNA, 21 bp, Homo sapiens
actctgggcacttttgaactc

SEQ ID NO: 2194842 - DNA, 20 bp, Homo sapiens
actcttcagtgactcctgct

SEQ ID NO: 2194843 - DNA, 23 bp, Homo sapiens
actcttcagtgactcctgctggt

SEQ ID NO: 2194844 - DNA, 16 bp, Homo sapiens
actctttgctttgtag

SEQ ID NO: 2194845 - DNA, 17 bp, Homo sapiens
actctttgctttgtagt

SEQ ID NO: 2194846 - DNA, 18 bp, Homo sapiens
actctttgctttgtagtt

SEQ ID NO: 2194847 - DNA, 12 bp, Homo sapiens
actgaaatttac

SEQ ID NO: 2194848 - DNA, 13 bp, Homo sapiens
actgaagtgaata

SEQ ID NO: 2194849 - DNA, 19 bp, Homo sapiens
actgaagtgaatacatggt

SEQ ID NO: 2194850 - DNA, 19 bp, Homo sapiens
actgaatttctatggcata

SEQ ID NO: 2194851 - DNA, 17 bp, Homo sapiens
actgaccggaggcaaaa

SEQ ID NO: 2194852 - DNA, 13 bp, Homo sapiens
actgacctgcccc

SEQ ID NO: 2194853 - DNA, 16 bp, Homo sapiens
actgagtgggaagccc

SEQ ID NO: 2194854 - DNA, 18 bp, Homo sapiens
actgataaaaatgatatt

SEQ ID NO: 2194855 - DNA, 20 bp, Homo sapiens
actgatcatttgcagctgct

SEQ ID NO: 2194856 - DNA, 14 bp, Homo sapiens
actgatctttgcaa

SEQ ID NO: 2194857 - DNA, 15 bp, Homo sapiens
actgatgtcatcttg

SEQ ID NO: 2194858 - DNA, 19 bp, Homo sapiens
actgatgtcatcttgagct

SEQ ID NO: 2194859 - DNA, 19 bp, Homo sapiens
actgatgttaggctgggcc

SEQ ID NO: 2194860 - DNA, 22 bp, Homo sapiens
actgatgttaggctgggcccag

SEQ ID NO: 2194861 - DNA, 23 bp, Homo sapiens
actgatgttaggctgggcccaga

SEQ ID NO: 2194862 - DNA, 15 bp, Homo sapiens
actgcaaataaagcc

SEQ ID NO: 2194863 - DNA, 17 bp, Homo sapiens
actgcaaataaagcctt

SEQ ID NO: 2194864 - DNA, 22 bp, Homo sapiens
actgcaacctccacctcccagg

SEQ ID NO: 2194865 - DNA, 20 bp, Homo sapiens
actgcaagtgagcaaacctg

SEQ ID NO: 2194866 - DNA, 21 bp, Homo sapiens
actgcagcctcgaactcctgg

SEQ ID NO: 2194867 - DNA, 17 bp, Homo sapiens
actgcagtcacccctgt

SEQ ID NO: 2194868 - DNA, 18 bp, Homo sapiens
actgcagtcacccctgtc

SEQ ID NO: 2194869 - DNA, 16 bp, Homo sapiens
actgcattagaaacca

SEQ ID NO: 2194870 - DNA, 18 bp, Homo sapiens
actgccaagccagattct

SEQ ID NO: 2194871 - DNA, 22 bp, Homo sapiens
actgccaagccagattctcttg

SEQ ID NO: 2194872 - DNA, 19 bp, Homo sapiens
actgccataaaatctcacg

SEQ ID NO: 2194873 - DNA, 14 bp, Homo sapiens
actgccctctgttc

SEQ ID NO: 2194874 - DNA, 13 bp, Homo sapiens
actgccctgtcta

SEQ ID NO: 2194875 - DNA, 16 bp, Homo sapiens
actgcctggcctggca

SEQ ID NO: 2194876 - DNA, 14 bp, Homo sapiens
actgctctcaaaat

SEQ ID NO: 2194877 - DNA, 18 bp, Homo sapiens
actggagacaatgcagat

SEQ ID NO: 2194878 - DNA, 17 bp, Homo sapiens
actggatccagaagcta

SEQ ID NO: 2194879 - DNA, 17 bp, Homo sapiens
actggcatctctggagt

SEQ ID NO: 2194880 - DNA, 16 bp, Homo sapiens
actggctgtcctttcc

SEQ ID NO: 2194881 - DNA, 13 bp, Homo sapiens
actggggctgcgc

SEQ ID NO: 2194882 - DNA, 21 bp, Homo sapiens
actgggtaggttctgaacagc

SEQ ID NO: 2194883 - DNA, 13 bp, Homo sapiens
actgtaactgcat

SEQ ID NO: 2194884 - DNA, 17 bp, Homo sapiens
atattaaaggtgaaaat

SEQ ID NO: 2194885 - DNA, 20 bp, Homo sapiens
atattaaaggtgaaaattgt

SEQ ID NO: 2194886 - DNA, 15 bp, Homo sapiens
atattaaataaatgt

SEQ ID NO: 2194887 - DNA, 22 bp, Homo sapiens
atattaatataagtttctttag

SEQ ID NO: 2194888 - DNA, 20 bp, Homo sapiens
atattacaggggcttgaaca

SEQ ID NO: 2194889 - DNA, 16 bp, Homo sapiens
atattctttccatgca

SEQ ID NO: 2194890 - DNA, 19 bp, Homo sapiens
atattgataataaaattca

SEQ ID NO: 2194891 - DNA, 20 bp, Homo sapiens
atattgataataaaattcat

SEQ ID NO: 2194892 - DNA, 14 bp, Homo sapiens
atattgatttctgc

SEQ ID NO: 2194893 - DNA, 16 bp, Homo sapiens
atattgatttctgcct

SEQ ID NO: 2194894 - DNA, 22 bp, Homo sapiens
atattgatttctgccttccttg

SEQ ID NO: 2194895 - DNA, 22 bp, Homo sapiens
atattgcagttcatactgaatg

SEQ ID NO: 2194896 - DNA, 20 bp, Homo sapiens
atattgctctatatgtaata

SEQ ID NO: 2194897 - DNA, 23 bp, Homo sapiens
atattggtgtgaatgctgtacct

SEQ ID NO: 2194898 - DNA, 13 bp, Homo sapiens
atatttataatta

SEQ ID NO: 2194899 - DNA, 14 bp, Homo sapiens
atatttataattaa

SEQ ID NO: 2194900 - DNA, 22 bp, Homo sapiens
atatttataattaaagaaaatt

SEQ ID NO: 2194901 - DNA, 23 bp, Homo sapiens
atatttataattaaagaaaattg

SEQ ID NO: 2194902 - DNA, 22 bp, Homo sapiens
atatttcagtgatttttagtaa

SEQ ID NO: 2194903 - DNA, 12 bp, Homo sapiens
atatttcttaag

SEQ ID NO: 2194904 - DNA, 24 bp, Homo sapiens
atatttgtctcattttgtatgtat

SEQ ID NO: 2194905 - DNA, 11 bp, Homo sapiens
atatttgtgta

SEQ ID NO: 2194906 - DNA, 19 bp, Homo sapiens
atattttctgagtagcata

SEQ ID NO: 2194907 - DNA, 18 bp, Homo sapiens
atatttttcctcaaagat

SEQ ID NO: 2194908 - DNA, 22 bp, Homo sapiens
atattttttttaactgcattct

SEQ ID NO: 2194909 - DNA, 13 bp, Homo sapiens
atcaaaaaacaag

SEQ ID NO: 2194910 - DNA, 19 bp, Homo sapiens
atcaaaaaatgtttttcaa

SEQ ID NO: 2194911 - DNA, 23 bp, Homo sapiens
atcaaaattgttacccatttgaa

SEQ ID NO: 2194912 - DNA, 14 bp, Homo sapiens
atcaaacagctcag

SEQ ID NO: 2194913 - DNA, 12 bp, Homo sapiens
atcaagaaattg

SEQ ID NO: 2194914 - DNA, 14 bp, Homo sapiens
atcaagtgcaccta

SEQ ID NO: 2194915 - DNA, 21 bp, Homo sapiens
atcacaaaagtatattcaaaa

SEQ ID NO: 2194916 - DNA, 14 bp, Homo sapiens
atcacagctcacgg

SEQ ID NO: 2194917 - DNA, 20 bp, Homo sapiens
atcacagctcacggcagcct

SEQ ID NO: 2194918 - DNA, 12 bp, Homo sapiens
atcactcccctc

SEQ ID NO: 2194919 - DNA, 12 bp, Homo sapiens
atcactttgctc

SEQ ID NO: 2194920 - DNA, 15 bp, Homo sapiens
atcactttgctctga

SEQ ID NO: 2194921 - DNA, 19 bp, Homo sapiens
atcagaacattcagctctg

SEQ ID NO: 2194922 - DNA, 20 bp, Homo sapiens
atcagaacattcagctctgg

SEQ ID NO: 2194923 - DNA, 21 bp, Homo sapiens
atcagaacattcagctctgga

SEQ ID NO: 2194924 - DNA, 23 bp, Homo sapiens
atcagaacattcagctctggaga

SEQ ID NO: 2194925 - DNA, 11 bp, Homo sapiens
atcagcagtga

SEQ ID NO: 2194926 - DNA, 12 bp, Homo sapiens
atcagcagtgat

SEQ ID NO: 2194927 - DNA, 14 bp, Homo sapiens
atcagcctctggcc

SEQ ID NO: 2194928 - DNA, 16 bp, Homo sapiens
atcagcctctggccag

SEQ ID NO: 2194929 - DNA, 22 bp, Homo sapiens
atcaggaaaggaagatgtaaga

SEQ ID NO: 2194930 - DNA, 17 bp, Homo sapiens
atcaggggaatttcagg

SEQ ID NO: 2194931 - DNA, 14 bp, Homo sapiens
atcagtattgtgta

SEQ ID NO: 2194932 - DNA, 15 bp, Homo sapiens
atcagtgatgggagt

SEQ ID NO: 2194933 - DNA, 18 bp, Homo sapiens
atcagttttgtgtacagt

SEQ ID NO: 2194934 - DNA, 23 bp, Homo sapiens
atcataactggcttctgcttgtc

SEQ ID NO: 2194935 - DNA, 18 bp, Homo sapiens
atcatcccaacagccaag

SEQ ID NO: 2194936 - DNA, 20 bp, Homo sapiens
atcatggctcactgcagcct

SEQ ID NO: 2194937 - DNA, 21 bp, Homo sapiens
atcattaatgtaggtttagat

SEQ ID NO: 2194938 - DNA, 20 bp, Homo sapiens
atcattggtatctgatatct

SEQ ID NO: 2194939 - DNA, 21 bp, Homo sapiens
atcatttatttttaaaataat

SEQ ID NO: 2194940 - DNA, 17 bp, Homo sapiens
atcattttagaattaaa

SEQ ID NO: 2194941 - DNA, 10 bp, Homo sapiens
atccagccac

SEQ ID NO: 2194942 - DNA, 19 bp, Homo sapiens
atccagccacttccccctc

SEQ ID NO: 2194943 - DNA, 17 bp, Homo sapiens
atccatgtgctgctgtg

SEQ ID NO: 2194944 - DNA, 19 bp, Homo sapiens
atccatgtgctgctgtggc

SEQ ID NO: 2194945 - DNA, 13 bp, Homo sapiens
atccattaattaa

SEQ ID NO: 2194946 - DNA, 15 bp, Homo sapiens
atcccagccttggca

SEQ ID NO: 2194947 - DNA, 23 bp, Homo sapiens
atcccagtcacagtggggttttt

SEQ ID NO: 2194948 - DNA, 14 bp, Homo sapiens
atcccagttcatgt

SEQ ID NO: 2194949 - DNA, 18 bp, Homo sapiens
atcccagttcatgttgct

SEQ ID NO: 2194950 - DNA, 14 bp, Homo sapiens
atccccctccttgc

SEQ ID NO: 2194951 - DNA, 16 bp, Homo sapiens
atccctcccctcagcc

SEQ ID NO: 2194952 - DNA, 17 bp, Homo sapiens
atccctcccctcagcct

SEQ ID NO: 2194953 - DNA, 20 bp, Homo sapiens
atccctcccctcagcctcct

SEQ ID NO: 2194954 - DNA, 14 bp, Homo sapiens
atccctgccaagaa

SEQ ID NO: 2194955 - DNA, 22 bp, Homo sapiens
atccctgccaagaactctgggc

SEQ ID NO: 2194956 - DNA, 22 bp, Homo sapiens
atccgtgagcagtgtgtctcct

SEQ ID NO: 2194957 - DNA, 22 bp, Homo sapiens
atcctaaggggagctacagcca

SEQ ID NO: 2194958 - DNA, 17 bp, Homo sapiens
atcctacagtacaatca

SEQ ID NO: 2194959 - DNA, 21 bp, Homo sapiens
atcctaccccaattccttgta

SEQ ID NO: 2194960 - DNA, 14 bp, Homo sapiens
atcctacttctcca

SEQ ID NO: 2194961 - DNA, 23 bp, Homo sapiens
atcctccctacttccaagaaaaa

SEQ ID NO: 2194962 - DNA, 12 bp, Homo sapiens
atcctcctgtct

SEQ ID NO: 2194963 - DNA, 17 bp, Homo sapiens
atcctgaaacagtgttt

SEQ ID NO: 2194964 - DNA, 24 bp, Homo sapiens
atcctgaccagctgctccgaggac

SEQ ID NO: 2194965 - DNA, 11 bp, Homo sapiens
atcctgctgcc

SEQ ID NO: 2194966 - DNA, 23 bp, Homo sapiens
atcctgctggggccgccacggcc

SEQ ID NO: 2194967 - DNA, 16 bp, Homo sapiens
atcctggctttgccca

SEQ ID NO: 2194968 - DNA, 17 bp, Homo sapiens
atcctgtacaagtgctc

SEQ ID NO: 2194969 - DNA, 15 bp, Homo sapiens
atccttagcaacagc

SEQ ID NO: 2194970 - DNA, 18 bp, Homo sapiens
atccttgatgatgtgttt

SEQ ID NO: 2194971 - DNA, 23 bp, Homo sapiens
atcgctgtccaagtgtttcttgt

SEQ ID NO: 2194972 - DNA, 19 bp, Homo sapiens
atcggacctcagtttctgt

SEQ ID NO: 2194973 - DNA, 15 bp, Homo sapiens
atctacctgccctct

SEQ ID NO: 2194974 - DNA, 15 bp, Homo sapiens
atctacgatgttaaa

SEQ ID NO: 2194975 - DNA, 14 bp, Homo sapiens
atctactagaacct

SEQ ID NO: 2194976 - DNA, 17 bp, Homo sapiens
agtttagaaattacaag

SEQ ID NO: 2194977 - DNA, 20 bp, Homo sapiens
agtttagaaattacaagttt

SEQ ID NO: 2194978 - DNA, 21 bp, Homo sapiens
agtttcagtaatagctgaacc

SEQ ID NO: 2194979 - DNA, 23 bp, Homo sapiens
agtttcagtaatagctgaacctg

SEQ ID NO: 2194980 - DNA, 11 bp, Homo sapiens
agtttcccaga

SEQ ID NO: 2194981 - DNA, 17 bp, Homo sapiens
agtttctgttgtttctt

SEQ ID NO: 2194982 - DNA, 21 bp, Homo sapiens
agtttctgttgtttcttttat

SEQ ID NO: 2194983 - DNA, 23 bp, Homo sapiens
agtttcttaaactgaaagcttta

SEQ ID NO: 2194984 - DNA, 19 bp, Homo sapiens
agtttgtattaaacttgaa

SEQ ID NO: 2194985 - DNA, 12 bp, Homo sapiens
agtttgtggtga

SEQ ID NO: 2194986 - DNA, 16 bp, Homo sapiens
agttttgtgtacagta

SEQ ID NO: 2194987 - DNA, 14 bp, Homo sapiens
ataaaaatggaatt

SEQ ID NO: 2194988 - DNA, 22 bp, Homo sapiens
ataaaacaaaaccaagccttgg

SEQ ID NO: 2194989 - DNA, 18 bp, Homo sapiens
ataaaacgttatctcatt

SEQ ID NO: 2194990 - DNA, 17 bp, Homo sapiens
ataaaatgcactgacca

SEQ ID NO: 2194991 - DNA, 16 bp, Homo sapiens
ataaaattcattccat

SEQ ID NO: 2194992 - DNA, 14 bp, Homo sapiens
ataaaccttatgaa

SEQ ID NO: 2194993 - DNA, 20 bp, Homo sapiens
ataaagcaccagcagtgttt

SEQ ID NO: 2194994 - DNA, 16 bp, Homo sapiens
ataaagcagtattttt

SEQ ID NO: 2194995 - DNA, 15 bp, Homo sapiens
ataaagccttttaaa

SEQ ID NO: 2194996 - DNA, 20 bp, Homo sapiens
ataaagccttttaaatcatc

SEQ ID NO: 2194997 - DNA, 21 bp, Homo sapiens
ataaaggtttcgttgcatggt

SEQ ID NO: 2194998 - DNA, 17 bp, Homo sapiens
ataaagttattaatagc

SEQ ID NO: 2194999 - DNA, 12 bp, Homo sapiens
ataaatacaata

SEQ ID NO: 2195000 - DNA, 17 bp, Homo sapiens
ataaatactaaatatga

SEQ ID NO: 2195001 - DNA, 21 bp, Homo sapiens
ataaatactaaatatgaaatt

SEQ ID NO: 2195002 - DNA, 20 bp, Homo sapiens
ataaatatattttctttcta

SEQ ID NO: 2195003 - DNA, 14 bp, Homo sapiens
ataaatatgtgatt

SEQ ID NO: 2195004 - DNA, 20 bp, Homo sapiens
ataaatatgtgattatcatt

SEQ ID NO: 2195005 - DNA, 17 bp, Homo sapiens
ataaatctgccatttca

SEQ ID NO: 2195006 - DNA, 14 bp, Homo sapiens
ataaattaatttgt

SEQ ID NO: 2195007 - DNA, 22 bp, Homo sapiens
ataaattactttgattccattt

SEQ ID NO: 2195008 - DNA, 18 bp, Homo sapiens
ataacaatgttaaatgca

SEQ ID NO: 2195009 - DNA, 22 bp, Homo sapiens
ataacataagctagaaaaatta

SEQ ID NO: 2195010 - DNA, 16 bp, Homo sapiens
ataactttagaaataa

SEQ ID NO: 2195011 - DNA, 19 bp, Homo sapiens
ataactttagaaataagaa

SEQ ID NO: 2195012 - DNA, 15 bp, Homo sapiens
ataagatttttaggt

SEQ ID NO: 2195013 - DNA, 13 bp, Homo sapiens
ataagccatgctg

SEQ ID NO: 2195014 - DNA, 19 bp, Homo sapiens
ataaggattctgaagtttt

SEQ ID NO: 2195015 - DNA, 12 bp, Homo sapiens
ataataaaattc

SEQ ID NO: 2195016 - DNA, 13 bp, Homo sapiens
ataataaaattca

SEQ ID NO: 2195017 - DNA, 15 bp, Homo sapiens
ataataaaattcatt

SEQ ID NO: 2195018 - DNA, 21 bp, Homo sapiens
ataataaaattcattccattt

SEQ ID NO: 2195019 - DNA, 15 bp, Homo sapiens
ataatattgatttct

SEQ ID NO: 2195020 - DNA, 14 bp, Homo sapiens
ataatcattttaga

SEQ ID NO: 2195021 - DNA, 16 bp, Homo sapiens
ataatcattttagaat

SEQ ID NO: 2195022 - DNA, 17 bp, Homo sapiens
ataattaaaaaaaaaac

SEQ ID NO: 2195023 - DNA, 21 bp, Homo sapiens
ataattaaagaaaattgccaa

SEQ ID NO: 2195024 - DNA, 22 bp, Homo sapiens
ataattaaagaaaattgccaaa

SEQ ID NO: 2195025 - DNA, 19 bp, Homo sapiens
ataattatataactgtatt

SEQ ID NO: 2195026 - DNA, 16 bp, Homo sapiens
ataattgtggagagga

SEQ ID NO: 2195027 - DNA, 21 bp, Homo sapiens
ataatttattgtaccaaagct

SEQ ID NO: 2195028 - DNA, 23 bp, Homo sapiens
ataatttattgtaccaaagctgt

SEQ ID NO: 2195029 - DNA, 15 bp, Homo sapiens
ataatttgcataaag

SEQ ID NO: 2195030 - DNA, 17 bp, Homo sapiens
ataattttattgctgga

SEQ ID NO: 2195031 - DNA, 20 bp, Homo sapiens
ataattttttagttaaaatc

SEQ ID NO: 2195032 - DNA, 23 bp, Homo sapiens
atacaaaaagccaacaaaccaag

SEQ ID NO: 2195033 - DNA, 16 bp, Homo sapiens
atacacttgtaaataa

SEQ ID NO: 2195034 - DNA, 14 bp, Homo sapiens
atacataaactgtc

SEQ ID NO: 2195035 - DNA, 19 bp, Homo sapiens
atacatatgatcaaatact

SEQ ID NO: 2195036 - DNA, 15 bp, Homo sapiens
atacatggtagcagg

SEQ ID NO: 2195037 - DNA, 14 bp, Homo sapiens
atacattaacaagc

SEQ ID NO: 2195038 - DNA, 20 bp, Homo sapiens
ataccactttgacacgcttc

SEQ ID NO: 2195039 - DNA, 14 bp, Homo sapiens
atacccaaatcctc

SEQ ID NO: 2195040 - DNA, 17 bp, Homo sapiens
atacggaacactgtcaa

SEQ ID NO: 2195041 - DNA, 21 bp, Homo sapiens
atacgtatgcatttttttagt

SEQ ID NO: 2195042 - DNA, 13 bp, Homo sapiens
atactaataaaat

SEQ ID NO: 2195043 - DNA, 19 bp, Homo sapiens
atactaataaaatacatac

SEQ ID NO: 2195044 - DNA, 13 bp, Homo sapiens
atactatagattc

SEQ ID NO: 2195045 - DNA, 18 bp, Homo sapiens
atactatagattctttat

SEQ ID NO: 2195046 - DNA, 12 bp, Homo sapiens
atactgtacata

SEQ ID NO: 2195047 - DNA, 14 bp, Homo sapiens
atactgtacataga

SEQ ID NO: 2195048 - DNA, 15 bp, Homo sapiens
atactgtacatagat

SEQ ID NO: 2195049 - DNA, 16 bp, Homo sapiens
atactgtctaagaata

SEQ ID NO: 2195050 - DNA, 17 bp, Homo sapiens
atactgtgctggagcca

SEQ ID NO: 2195051 - DNA, 14 bp, Homo sapiens
atacttcaaatcat

SEQ ID NO: 2195052 - DNA, 20 bp, Homo sapiens
atacttcagctttgtgtatc

SEQ ID NO: 2195053 - DNA, 13 bp, Homo sapiens
atacttgagaaat

SEQ ID NO: 2195054 - DNA, 15 bp, Homo sapiens
atacttgagaaattt

SEQ ID NO: 2195055 - DNA, 14 bp, Homo sapiens
atactttgagtaaa

SEQ ID NO: 2195056 - DNA, 11 bp, Homo sapiens
atagaagtggt

SEQ ID NO: 2195057 - DNA, 19 bp, Homo sapiens
atagaagtggtgttttttt

SEQ ID NO: 2195058 - DNA, 17 bp, Homo sapiens
atagatgtaatctgatt

SEQ ID NO: 2195059 - DNA, 17 bp, Homo sapiens
atagccatttgccccaa

SEQ ID NO: 2195060 - DNA, 13 bp, Homo sapiens
atagctacagctg

SEQ ID NO: 2195061 - DNA, 14 bp, Homo sapiens
atagctacagctgt

SEQ ID NO: 2195062 - DNA, 20 bp, Homo sapiens
atagctcctgctccacagcc

SEQ ID NO: 2195063 - DNA, 15 bp, Homo sapiens
atagctgtatatttg

SEQ ID NO: 2195064 - DNA, 23 bp, Homo sapiens
atagcttgtacacatatacatat

SEQ ID NO: 2195065 - DNA, 16 bp, Homo sapiens
ataggagacttgtaca

SEQ ID NO: 2195066 - DNA, 21 bp, Homo sapiens
atagtggccagaccagagctc

SEQ ID NO: 2195067 - DNA, 13 bp, Homo sapiens
atagttcaggatt

SEQ ID NO: 2195068 - DNA, 17 bp, Homo sapiens
atataaatatattttct

SEQ ID NO: 2195069 - DNA, 17 bp, Homo sapiens
atataaatggaatcaca

SEQ ID NO: 2195070 - DNA, 18 bp, Homo sapiens
atataactttagaaataa

SEQ ID NO: 2195071 - DNA, 18 bp, Homo sapiens
atataagtttctttagaa

SEQ ID NO: 2195072 - DNA, 17 bp, Homo sapiens
atatagtacctttgctc

SEQ ID NO: 2195073 - DNA, 14 bp, Homo sapiens
atatatatttttct

SEQ ID NO: 2195074 - DNA, 17 bp, Homo sapiens
atatatcctgaaagcat

SEQ ID NO: 2195075 - DNA, 19 bp, Homo sapiens
atatatcctgaaagcatta

SEQ ID NO: 2195076 - DNA, 20 bp, Homo sapiens
atatatgtagccagacagtt

SEQ ID NO: 2195077 - DNA, 18 bp, Homo sapiens
atatatgtcctattcatt

SEQ ID NO: 2195078 - DNA, 19 bp, Homo sapiens
atatatgtcctattcattc

SEQ ID NO: 2195079 - DNA, 16 bp, Homo sapiens
atatattattataatc

SEQ ID NO: 2195080 - DNA, 17 bp, Homo sapiens
atatattcatacctgtt

SEQ ID NO: 2195081 - DNA, 19 bp, Homo sapiens
atatattcatacctgttgt

SEQ ID NO: 2195082 - DNA, 11 bp, Homo sapiens
atatattcttt

SEQ ID NO: 2195083 - DNA, 16 bp, Homo sapiens
atatatttaaatgcaa

SEQ ID NO: 2195084 - DNA, 18 bp, Homo sapiens
atatatttataaatatgt

SEQ ID NO: 2195085 - DNA, 16 bp, Homo sapiens
atatattttctttcta

SEQ ID NO: 2195086 - DNA, 23 bp, Homo sapiens
atatcaatatggtgtcttgatat

SEQ ID NO: 2195087 - DNA, 22 bp, Homo sapiens
atatcactttgtattctctgtc

SEQ ID NO: 2195088 - DNA, 16 bp, Homo sapiens
atatcctacttctcca

SEQ ID NO: 2195089 - DNA, 12 bp, Homo sapiens
atatctgaatat

SEQ ID NO: 2195090 - DNA, 13 bp, Homo sapiens
atatctggcctct

SEQ ID NO: 2195091 - DNA, 17 bp, Homo sapiens
atatctgtttgcttcta

SEQ ID NO: 2195092 - DNA, 13 bp, Homo sapiens
atatgaaggagag

SEQ ID NO: 2195093 - DNA, 16 bp, Homo sapiens
atatgactaattcagg

SEQ ID NO: 2195094 - DNA, 13 bp, Homo sapiens
atatgagagggat

SEQ ID NO: 2195095 - DNA, 18 bp, Homo sapiens
atatgtagccagacagtt

SEQ ID NO: 2195096 - DNA, 18 bp, Homo sapiens
atatgtgattatcattta

SEQ ID NO: 2195097 - DNA, 19 bp, Homo sapiens
atattaaaaattaattctt

SEQ ID NO: 2195098 - DNA, 21 bp, Homo sapiens
atattaaaaattaattcttta

SEQ ID NO: 2195099 - DNA, 12 bp, Homo sapiens
atattaaaatca

SEQ ID NO: 2195100 - DNA, 15 bp, Homo sapiens
atattaaaatcacaa

SEQ ID NO: 2195101 - DNA, 14 bp, Homo sapiens
atgaacaatgtgtg

SEQ ID NO: 2195102 - DNA, 14 bp, Homo sapiens
atgaagctcagttt

SEQ ID NO: 2195103 - DNA, 15 bp, Homo sapiens
atgaatacagcattt

SEQ ID NO: 2195104 - DNA, 21 bp, Homo sapiens
atgaatcttatgcaaaacttt

SEQ ID NO: 2195105 - DNA, 18 bp, Homo sapiens
atgaatggactcatctta

SEQ ID NO: 2195106 - DNA, 19 bp, Homo sapiens
atgaatttggtctgcctct

SEQ ID NO: 2195107 - DNA, 21 bp, Homo sapiens
atgacactgagaacagatctc

SEQ ID NO: 2195108 - DNA, 15 bp, Homo sapiens
atgacatttctcaaa

SEQ ID NO: 2195109 - DNA, 22 bp, Homo sapiens
atgacatttgtcctgcagagct

SEQ ID NO: 2195110 - DNA, 17 bp, Homo sapiens
atgacattttgccaaaa

SEQ ID NO: 2195111 - DNA, 23 bp, Homo sapiens
atgacccggcccccgccctctgc

SEQ ID NO: 2195112 - DNA, 14 bp, Homo sapiens
atgactaattcagg

SEQ ID NO: 2195113 - DNA, 22 bp, Homo sapiens
atgactaattcagggaatatat

SEQ ID NO: 2195114 - DNA, 14 bp, Homo sapiens
atgactgctgattt

SEQ ID NO: 2195115 - DNA, 11 bp, Homo sapiens
atgagaaaaaa

SEQ ID NO: 2195116 - DNA, 22 bp, Homo sapiens
atgagaaacagctcagccagtg

SEQ ID NO: 2195117 - DNA, 11 bp, Homo sapiens
atgagaaactt

SEQ ID NO: 2195118 - DNA, 20 bp, Homo sapiens
atgagaaacttaaatgttat

SEQ ID NO: 2195119 - DNA, 19 bp, Homo sapiens
atgagaatgaccctgtcaa

SEQ ID NO: 2195120 - DNA, 14 bp, Homo sapiens
atgagagagtgtgg

SEQ ID NO: 2195121 - DNA, 22 bp, Homo sapiens
atgagatgaaaatatttaacga

SEQ ID NO: 2195122 - DNA, 14 bp, Homo sapiens
atgaggtcaccagg

SEQ ID NO: 2195123 - DNA, 18 bp, Homo sapiens
atgagtgcaagcaaagca

SEQ ID NO: 2195124 - DNA, 20 bp, Homo sapiens
atgagtttccagctaagcct

SEQ ID NO: 2195125 - DNA, 17 bp, Homo sapiens
atgcaaaaactctttga

SEQ ID NO: 2195126 - DNA, 14 bp, Homo sapiens
atgcaccattagaa

SEQ ID NO: 2195127 - DNA, 16 bp, Homo sapiens
atgcacctataaatac

SEQ ID NO: 2195128 - DNA, 13 bp, Homo sapiens
atgcagcagcttg

SEQ ID NO: 2195129 - DNA, 20 bp, Homo sapiens
atgcagttattagaacttag

SEQ ID NO: 2195130 - DNA, 21 bp, Homo sapiens
atgcatgacttccctccaccc

SEQ ID NO: 2195131 - DNA, 20 bp, Homo sapiens
atgcatttttttagtttgtt

SEQ ID NO: 2195132 - DNA, 15 bp, Homo sapiens
atgccacctgcagcg

SEQ ID NO: 2195133 - DNA, 20 bp, Homo sapiens
atgccagagcaaagggccag

SEQ ID NO: 2195134 - DNA, 14 bp, Homo sapiens
atgccaggacagct

SEQ ID NO: 2195135 - DNA, 16 bp, Homo sapiens
atgccaggacagctgc

SEQ ID NO: 2195136 - DNA, 20 bp, Homo sapiens
atgccaggacagctgcaggt

SEQ ID NO: 2195137 - DNA, 22 bp, Homo sapiens
atgccctgctagatgagaattc

SEQ ID NO: 2195138 - DNA, 16 bp, Homo sapiens
atgcctcgctcccttc

SEQ ID NO: 2195139 - DNA, 16 bp, Homo sapiens
atgcggatcctgctgg

SEQ ID NO: 2195140 - DNA, 17 bp, Homo sapiens
atgcggatcctgctggg

SEQ ID NO: 2195141 - DNA, 22 bp, Homo sapiens
atgctgcacaccagttactgtt

SEQ ID NO: 2195142 - DNA, 15 bp, Homo sapiens
atgctgctttgcaca

SEQ ID NO: 2195143 - DNA, 14 bp, Homo sapiens
atgctggagcggct

SEQ ID NO: 2195144 - DNA, 17 bp, Homo sapiens
atgcttaggtgaaggca

SEQ ID NO: 2195145 - DNA, 21 bp, Homo sapiens
atggaaaagtcttcaagggct

SEQ ID NO: 2195146 - DNA, 21 bp, Homo sapiens
atggaacctcctttctcttct

SEQ ID NO: 2195147 - DNA, 19 bp, Homo sapiens
atggaagggccttctccac

SEQ ID NO: 2195148 - DNA, 16 bp, Homo sapiens
atggatgtttcttctt

SEQ ID NO: 2195149 - DNA, 14 bp, Homo sapiens
atggcattactctg

SEQ ID NO: 2195150 - DNA, 17 bp, Homo sapiens
atggcattactctgcac

SEQ ID NO: 2195151 - DNA, 17 bp, Homo sapiens
atggccacatccaacat

SEQ ID NO: 2195152 - DNA, 18 bp, Homo sapiens
atggctaaggcaccagcc

SEQ ID NO: 2195153 - DNA, 21 bp, Homo sapiens
atggctatcatcaaaagtgta

SEQ ID NO: 2195154 - DNA, 18 bp, Homo sapiens
atggctcactatggtgcc

SEQ ID NO: 2195155 - DNA, 20 bp, Homo sapiens
atggctcactgcagcctcga

SEQ ID NO: 2195156 - DNA, 20 bp, Homo sapiens
atggctcgtgggctctggct

SEQ ID NO: 2195157 - DNA, 22 bp, Homo sapiens
atggctcgtgggctctggctcc

SEQ ID NO: 2195158 - DNA, 17 bp, Homo sapiens
atggctctgaactgcac

SEQ ID NO: 2195159 - DNA, 16 bp, Homo sapiens
atggcttaaaaatact

SEQ ID NO: 2195160 - DNA, 18 bp, Homo sapiens
atgggaaacttccaagac

SEQ ID NO: 2195161 - DNA, 12 bp, Homo sapiens
atgggactgatg

SEQ ID NO: 2195162 - DNA, 18 bp, Homo sapiens
atgggactgatgtcatct

SEQ ID NO: 2195163 - DNA, 20 bp, Homo sapiens
atggggagatcggggccaga

SEQ ID NO: 2195164 - DNA, 13 bp, Homo sapiens
atggggccacagc

SEQ ID NO: 2195165 - DNA, 18 bp, Homo sapiens
atgggggaaatggtgcct

SEQ ID NO: 2195166 - DNA, 17 bp, Homo sapiens
atgggggtgcaggcagc

SEQ ID NO: 2195167 - DNA, 23 bp, Homo sapiens
atgggtagcttctgacctcagca

SEQ ID NO: 2195168 - DNA, 14 bp, Homo sapiens
atgggttttgctta

SEQ ID NO: 2195169 - DNA, 17 bp, Homo sapiens
atggtaagagtcacaat

SEQ ID NO: 2195170 - DNA, 17 bp, Homo sapiens
atggtaggaagggatgt

SEQ ID NO: 2195171 - DNA, 17 bp, Homo sapiens
atggtgagaattaaaat

SEQ ID NO: 2195172 - DNA, 19 bp, Homo sapiens
atggtgagaattaaaataa

SEQ ID NO: 2195173 - DNA, 21 bp, Homo sapiens
atggtggcgctttctcctgtg

SEQ ID NO: 2195174 - DNA, 23 bp, Homo sapiens
atggtggcgctttctcctgtgcc

SEQ ID NO: 2195175 - DNA, 20 bp, Homo sapiens
atggttttattctttgagaa

SEQ ID NO: 2195176 - DNA, 13 bp, Homo sapiens
atgtaaacagtga

SEQ ID NO: 2195177 - DNA, 14 bp, Homo sapiens
atgtaaacagtgag

SEQ ID NO: 2195178 - DNA, 16 bp, Homo sapiens
atgtaaccaagctgta

SEQ ID NO: 2195179 - DNA, 13 bp, Homo sapiens
atgtaataatcat

SEQ ID NO: 2195180 - DNA, 17 bp, Homo sapiens
atgtacaaaagtaccat

SEQ ID NO: 2195181 - DNA, 12 bp, Homo sapiens
atgtagaagagg

SEQ ID NO: 2195182 - DNA, 16 bp, Homo sapiens
atgtagaagagggaga

SEQ ID NO: 2195183 - DNA, 16 bp, Homo sapiens
atgtagataaagcact

SEQ ID NO: 2195184 - DNA, 18 bp, Homo sapiens
atgtagcaaattccaata

SEQ ID NO: 2195185 - DNA, 22 bp, Homo sapiens
atgtagcaaattccaatacatt

SEQ ID NO: 2195186 - DNA, 14 bp, Homo sapiens
attgatgggtgggc

SEQ ID NO: 2195187 - DNA, 14 bp, Homo sapiens
attgattttctttc

SEQ ID NO: 2195188 - DNA, 19 bp, Homo sapiens
attgcaaagggacattgaa

SEQ ID NO: 2195189 - DNA, 18 bp, Homo sapiens
attgcagttcatactgaa

SEQ ID NO: 2195190 - DNA, 16 bp, Homo sapiens
attgccaaaatatatt

SEQ ID NO: 2195191 - DNA, 16 bp, Homo sapiens
attgccaacagtggct

SEQ ID NO: 2195192 - DNA, 23 bp, Homo sapiens
attgctctggaagcctgctgatt

SEQ ID NO: 2195193 - DNA, 13 bp, Homo sapiens
attggacttccat

SEQ ID NO: 2195194 - DNA, 18 bp, Homo sapiens
attggccgatgagctggt

SEQ ID NO: 2195195 - DNA, 16 bp, Homo sapiens
attggtaactgcctgg

SEQ ID NO: 2195196 - DNA, 22 bp, Homo sapiens
attggtaactgcctggcctggc

SEQ ID NO: 2195197 - DNA, 12 bp, Homo sapiens
attggtcaattc

SEQ ID NO: 2195198 - DNA, 15 bp, Homo sapiens
attggttaatcactt

SEQ ID NO: 2195199 - DNA, 12 bp, Homo sapiens
attgtaaagtaa

SEQ ID NO: 2195200 - DNA, 18 bp, Homo sapiens
attgtaacgttaaatgaa

SEQ ID NO: 2195201 - DNA, 17 bp, Homo sapiens
attgtaaggtattgcaa

SEQ ID NO: 2195202 - DNA, 17 bp, Homo sapiens
attgtaccaaagctgtt

SEQ ID NO: 2195203 - DNA, 13 bp, Homo sapiens
attgtataaatta

SEQ ID NO: 2195204 - DNA, 21 bp, Homo sapiens
attgtctgaaattttctagaa

SEQ ID NO: 2195205 - DNA, 15 bp, Homo sapiens
attgtgaaatttgtt

SEQ ID NO: 2195206 - DNA, 20 bp, Homo sapiens
attgtgaaatttgttaatat

SEQ ID NO: 2195207 - DNA, 14 bp, Homo sapiens
attgtgctttctat

SEQ ID NO: 2195208 - DNA, 18 bp, Homo sapiens
attgttacccatttgaaa

SEQ ID NO: 2195209 - DNA, 20 bp, Homo sapiens
attgtttttaagaaaaacat

SEQ ID NO: 2195210 - DNA, 22 bp, Homo sapiens
attgtttttaagaaaaacatgt

SEQ ID NO: 2195211 - DNA, 18 bp, Homo sapiens
atttaaaaagctaatgac

SEQ ID NO: 2195212 - DNA, 18 bp, Homo sapiens
atttaaagacaaagacat

SEQ ID NO: 2195213 - DNA, 16 bp, Homo sapiens
atttaacagaaattgt

SEQ ID NO: 2195214 - DNA, 17 bp, Homo sapiens
atttaacagaaattgta

SEQ ID NO: 2195215 - DNA, 22 bp, Homo sapiens
atttaacagaaattgtatattg

SEQ ID NO: 2195216 - DNA, 13 bp, Homo sapiens
atttaagagtcct

SEQ ID NO: 2195217 - DNA, 15 bp, Homo sapiens
atttaagagtcctga

SEQ ID NO: 2195218 - DNA, 16 bp, Homo sapiens
atttataaatatgtga

SEQ ID NO: 2195219 - DNA, 15 bp, Homo sapiens
atttataattaaaga

SEQ ID NO: 2195220 - DNA, 16 bp, Homo sapiens
atttataattaaagaa

SEQ ID NO: 2195221 - DNA, 19 bp, Homo sapiens
atttatatttgtctcattt

SEQ ID NO: 2195222 - DNA, 15 bp, Homo sapiens
atttatcaaaaaaca

SEQ ID NO: 2195223 - DNA, 16 bp, Homo sapiens
atttatgcagagacag

SEQ ID NO: 2195224 - DNA, 18 bp, Homo sapiens
atttattattaaatcagt

SEQ ID NO: 2195225 - DNA, 19 bp, Homo sapiens
atttattgtaccaaagctg

SEQ ID NO: 2195226 - DNA, 15 bp, Homo sapiens
atttatttataagtt

SEQ ID NO: 2195227 - DNA, 20 bp, Homo sapiens
atttatttccatattaaaat

SEQ ID NO: 2195228 - DNA, 22 bp, Homo sapiens
atttatttccatattaaaatca

SEQ ID NO: 2195229 - DNA, 21 bp, Homo sapiens
atttatttttaaaataattta

SEQ ID NO: 2195230 - DNA, 19 bp, Homo sapiens
atttatttttttattcttc

SEQ ID NO: 2195231 - DNA, 14 bp, Homo sapiens
atttcaaatctgta

SEQ ID NO: 2195232 - DNA, 15 bp, Homo sapiens
atttcaaatctgtaa

SEQ ID NO: 2195233 - DNA, 19 bp, Homo sapiens
atttcagaagttagtttgt

SEQ ID NO: 2195234 - DNA, 11 bp, Homo sapiens
caaaacactgt

SEQ ID NO: 2195235 - DNA, 11 bp, Homo sapiens
caaaagcctct

SEQ ID NO: 2195236 - DNA, 19 bp, Homo sapiens
caaaaggcagtggggctgg

SEQ ID NO: 2195237 - DNA, 22 bp, Homo sapiens
caaaagtatattcaaaaattat

SEQ ID NO: 2195238 - DNA, 21 bp, Homo sapiens
caaaataagccatgctgcttt

SEQ ID NO: 2195239 - DNA, 18 bp, Homo sapiens
caaaatacagcactttga

SEQ ID NO: 2195240 - DNA, 16 bp, Homo sapiens
caaaatggtttatttt

SEQ ID NO: 2195241 - DNA, 21 bp, Homo sapiens
caaaatggtttattttaggaa

SEQ ID NO: 2195242 - DNA, 20 bp, Homo sapiens
caaaatgttaataaaggttt

SEQ ID NO: 2195243 - DNA, 21 bp, Homo sapiens
caaacaattcaatcaaagcta

SEQ ID NO: 2195244 - DNA, 23 bp, Homo sapiens
caaacaattcaatcaaagctacc

SEQ ID NO: 2195245 - DNA, 22 bp, Homo sapiens
caaaccacgcctcttgaccagg

SEQ ID NO: 2195246 - DNA, 18 bp, Homo sapiens
caaaccactgtacatata

SEQ ID NO: 2195247 - DNA, 22 bp, Homo sapiens
caaaccaggagcattttgtgtc

SEQ ID NO: 2195248 - DNA, 15 bp, Homo sapiens
caaacccttctcttc

SEQ ID NO: 2195249 - DNA, 20 bp, Homo sapiens
caaactgtgtcacgcaggct

SEQ ID NO: 2195250 - DNA, 22 bp, Homo sapiens
caaactgtgtcacgcaggctga

SEQ ID NO: 2195251 - DNA, 18 bp, Homo sapiens
caaagaccaatgtgaaga

SEQ ID NO: 2195252 - DNA, 13 bp, Homo sapiens
caaagatgataat

SEQ ID NO: 2195253 - DNA, 13 bp, Homo sapiens
caaagatttaatc

SEQ ID NO: 2195254 - DNA, 16 bp, Homo sapiens
caaagatttaatctgc

SEQ ID NO: 2195255 - DNA, 16 bp, Homo sapiens
caaagctaaatacatg

SEQ ID NO: 2195256 - DNA, 18 bp, Homo sapiens
caaagctaaatacatgga

SEQ ID NO: 2195257 - DNA, 21 bp, Homo sapiens
caaagctaaatacatggaaat

SEQ ID NO: 2195258 - DNA, 21 bp, Homo sapiens
caaagctgattttttttttaa

SEQ ID NO: 2195259 - DNA, 14 bp, Homo sapiens
caaagctgcttgaa

SEQ ID NO: 2195260 - DNA, 16 bp, Homo sapiens
caaagctgcttgaatc

SEQ ID NO: 2195261 - DNA, 20 bp, Homo sapiens
caaaggaagctttctctgct

SEQ ID NO: 2195262 - DNA, 17 bp, Homo sapiens
caaaggactgacctgcc

SEQ ID NO: 2195263 - DNA, 12 bp, Homo sapiens
caaagggccagg

SEQ ID NO: 2195264 - DNA, 17 bp, Homo sapiens
caaaggtcaaaaacaaa

SEQ ID NO: 2195265 - DNA, 19 bp, Homo sapiens
caaaggttactgttgagaa

SEQ ID NO: 2195266 - DNA, 13 bp, Homo sapiens
caaagtgcaaagc

SEQ ID NO: 2195267 - DNA, 14 bp, Homo sapiens
caaagtgcaaagct

SEQ ID NO: 2195268 - DNA, 19 bp, Homo sapiens
caaagtgcaaagctgcttg

SEQ ID NO: 2195269 - DNA, 14 bp, Homo sapiens
caaagtgccctcat

SEQ ID NO: 2195270 - DNA, 21 bp, Homo sapiens
caaagtgctgagattacaggt

SEQ ID NO: 2195271 - DNA, 21 bp, Homo sapiens
caaagtgctgggattacaggt

SEQ ID NO: 2195272 - DNA, 20 bp, Homo sapiens
caaagtgtctacatgtgcca

SEQ ID NO: 2195273 - DNA, 20 bp, Homo sapiens
caaagttaacctacctgtaa

SEQ ID NO: 2195274 - DNA, 19 bp, Homo sapiens
caaagtttttacagtgtat

SEQ ID NO: 2195275 - DNA, 21 bp, Homo sapiens
caaagtttttacagtgtatct

SEQ ID NO: 2195276 - DNA, 12 bp, Homo sapiens
caaataaagcct

SEQ ID NO: 2195277 - DNA, 17 bp, Homo sapiens
caaataaagccttttaa

SEQ ID NO: 2195278 - DNA, 23 bp, Homo sapiens
caaataaagccttttaaatcatc

SEQ ID NO: 2195279 - DNA, 13 bp, Homo sapiens
caaataaagtaaa

SEQ ID NO: 2195280 - DNA, 20 bp, Homo sapiens
caaatatcctccactttcag

SEQ ID NO: 2195281 - DNA, 22 bp, Homo sapiens
caaatcctaaggggagctacag

SEQ ID NO: 2195282 - DNA, 20 bp, Homo sapiens
caaatcctccctacttccaa

SEQ ID NO: 2195283 - DNA, 13 bp, Homo sapiens
caaatcctctcca

SEQ ID NO: 2195284 - DNA, 14 bp, Homo sapiens
caaatctgtaatta

SEQ ID NO: 2195285 - DNA, 12 bp, Homo sapiens
caaatcttcaag

SEQ ID NO: 2195286 - DNA, 21 bp, Homo sapiens
caaatgcaaaaactctttgag

SEQ ID NO: 2195287 - DNA, 18 bp, Homo sapiens
caaatgggactgatgtca

SEQ ID NO: 2195288 - DNA, 20 bp, Homo sapiens
caaatgggactgatgtcatc

SEQ ID NO: 2195289 - DNA, 23 bp, Homo sapiens
caaatggttccagatacttcagc

SEQ ID NO: 2195290 - DNA, 22 bp, Homo sapiens
caaatgtggcaattattttgga

SEQ ID NO: 2195291 - DNA, 23 bp, Homo sapiens
caaattccacccctccttccctg

SEQ ID NO: 2195292 - DNA, 22 bp, Homo sapiens
caacaacgtgagagaaagagag

SEQ ID NO: 2195293 - DNA, 22 bp, Homo sapiens
caacaccaggacttaagacaaa

SEQ ID NO: 2195294 - DNA, 18 bp, Homo sapiens
caacactgccagaagtgt

SEQ ID NO: 2195295 - DNA, 22 bp, Homo sapiens
caacactgccagaagtgtgttt

SEQ ID NO: 2195296 - DNA, 14 bp, Homo sapiens
caacaggaactgtg

SEQ ID NO: 2195297 - DNA, 21 bp, Homo sapiens
caacaggctgtgtgtggaaat

SEQ ID NO: 2195298 - DNA, 18 bp, Homo sapiens
caacagggtttttttcca

SEQ ID NO: 2195299 - DNA, 21 bp, Homo sapiens
caacataaaacaaaaccaagc

SEQ ID NO: 2195300 - DNA, 22 bp, Homo sapiens
caacataaaacaaaaccaagcc

SEQ ID NO: 2195301 - DNA, 23 bp, Homo sapiens
caacatttcctcaggcaattcct

SEQ ID NO: 2195302 - DNA, 14 bp, Homo sapiens
caaccacctctggc

SEQ ID NO: 2195303 - DNA, 16 bp, Homo sapiens
caaccacctctggccc

SEQ ID NO: 2195304 - DNA, 12 bp, Homo sapiens
caaccaggaaga

SEQ ID NO: 2195305 - DNA, 13 bp, Homo sapiens
caacccaagtctc

SEQ ID NO: 2195306 - DNA, 22 bp, Homo sapiens
caacccattaatcttttgtagt

SEQ ID NO: 2195307 - DNA, 11 bp, Homo sapiens
caacctcagca

SEQ ID NO: 2195308 - DNA, 15 bp, Homo sapiens
caacctccacctccc

SEQ ID NO: 2195309 - DNA, 18 bp, Homo sapiens
caacctccacctcccagg

SEQ ID NO: 2195310 - DNA, 20 bp, Homo sapiens
caacctccacctcccaggtt

SEQ ID NO: 2195311 - DNA, 19 bp, Homo sapiens
caacctccctggctcaagc

SEQ ID NO: 2195312 - DNA, 18 bp, Homo sapiens
caacgctgctgcctgctt

SEQ ID NO: 2195313 - DNA, 15 bp, Homo sapiens
caacgtgagagaaag

SEQ ID NO: 2195314 - DNA, 18 bp, Homo sapiens
caacgtgagagaaagaga

SEQ ID NO: 2195315 - DNA, 23 bp, Homo sapiens
caacgtgagagaaagagagaagc

SEQ ID NO: 2195316 - DNA, 22 bp, Homo sapiens
caactaattttaaagtaaaagg

SEQ ID NO: 2195317 - DNA, 14 bp, Homo sapiens
caactccttcctct

SEQ ID NO: 2195318 - DNA, 15 bp, Homo sapiens
caactccttcctctt

SEQ ID NO: 2195319 - DNA, 22 bp, Homo sapiens
caactcgaatcactcatttatt

SEQ ID NO: 2195320 - DNA, 21 bp, Homo sapiens
caactgctgccccaaaggaag

SEQ ID NO: 2195321 - DNA, 15 bp, Homo sapiens
caacttaagtttaga

SEQ ID NO: 2195322 - DNA, 13 bp, Homo sapiens
caagaactctggg

SEQ ID NO: 2195323 - DNA, 13 bp, Homo sapiens
caagaagcagtgg

SEQ ID NO: 2195324 - DNA, 18 bp, Homo sapiens
caagaagcagtggcctta

SEQ ID NO: 2195325 - DNA, 20 bp, Homo sapiens
caagaagtgggagtgggaga

SEQ ID NO: 2195326 - DNA, 16 bp, Homo sapiens
caagacacgtggcctc

SEQ ID NO: 2195327 - DNA, 19 bp, Homo sapiens
caagacagtgtcatggtgc

SEQ ID NO: 2195328 - DNA, 14 bp, Homo sapiens
caagacgaggggca

SEQ ID NO: 2195329 - DNA, 15 bp, Homo sapiens
caagacgaggggcag

SEQ ID NO: 2195330 - DNA, 17 bp, Homo sapiens
caagacgaggggcaggg

SEQ ID NO: 2195331 - DNA, 20 bp, Homo sapiens
caagacgaggggcagggaag

SEQ ID NO: 2195332 - DNA, 22 bp, Homo sapiens
caagacgaggggcagggaagga

SEQ ID NO: 2195333 - DNA, 17 bp, Homo sapiens
caagagggcaaagctga

SEQ ID NO: 2195334 - DNA, 17 bp, Homo sapiens
caagagtagcaccttca

SEQ ID NO: 2195335 - DNA, 18 bp, Homo sapiens
caagagtagcaccttcag

SEQ ID NO: 2195336 - DNA, 20 bp, Homo sapiens
caagattcccggctggactt

SEQ ID NO: 2195337 - DNA, 12 bp, Homo sapiens
caagcaaagcag

SEQ ID NO: 2195338 - DNA, 14 bp, Homo sapiens
caagcagcccttgc

SEQ ID NO: 2195339 - DNA, 19 bp, Homo sapiens
caagccagattctcttgaa

SEQ ID NO: 2195340 - DNA, 22 bp, Homo sapiens
caagccagggatggggccacag

SEQ ID NO: 2195341 - DNA, 15 bp, Homo sapiens
caagccggtgcccac

SEQ ID NO: 2195342 - DNA, 16 bp, Homo sapiens
caagccggtgcccacc

SEQ ID NO: 2195343 - DNA, 14 bp, Homo sapiens
caagcctcttctga

SEQ ID NO: 2195344 - DNA, 16 bp, Homo sapiens
caagcctcttctgaag

SEQ ID NO: 2195345 - DNA, 22 bp, Homo sapiens
caagcctgatttaggcactgct

SEQ ID NO: 2195346 - DNA, 22 bp, Homo sapiens
caagcctgggccactggcatct

SEQ ID NO: 2195347 - DNA, 12 bp, Homo sapiens
caagcctggtct

SEQ ID NO: 2195348 - DNA, 19 bp, Homo sapiens
caagcctggtctcctccca

SEQ ID NO: 2195349 - DNA, 17 bp, Homo sapiens
caagctaggccccagag

SEQ ID NO: 2195350 - DNA, 13 bp, Homo sapiens
caagctcttctcc

SEQ ID NO: 2195351 - DNA, 15 bp, Homo sapiens
caagctcttctcctc

SEQ ID NO: 2195352 - DNA, 17 bp, Homo sapiens
caagctcttctcctcag

SEQ ID NO: 2195353 - DNA, 23 bp, Homo sapiens
caagctcttctcctcagcttggg

SEQ ID NO: 2195354 - DNA, 13 bp, Homo sapiens
caagctgcctccc

SEQ ID NO: 2195355 - DNA, 21 bp, Homo sapiens
caagctggccactatcacata

SEQ ID NO: 2195356 - DNA, 19 bp, Homo sapiens
caagctgtccctgcagggc

SEQ ID NO: 2195357 - DNA, 17 bp, Homo sapiens
caaggcaggcctttcct

SEQ ID NO: 2195358 - DNA, 16 bp, Homo sapiens
caaggccgcccacctg

SEQ ID NO: 2195359 - DNA, 18 bp, Homo sapiens
caaggccgcccacctgca

SEQ ID NO: 2195360 - DNA, 13 bp, Homo sapiens
caaggcctatgcc

SEQ ID NO: 2195361 - DNA, 16 bp, Homo sapiens
caaggcctatgccacc

SEQ ID NO: 2195362 - DNA, 18 bp, Homo sapiens
caaggcctatgccacctg

SEQ ID NO: 2195363 - DNA, 13 bp, Homo sapiens
caagggcaggttg

SEQ ID NO: 2195364 - DNA, 22 bp, Homo sapiens
caagggcaggttgatcagtgag

SEQ ID NO: 2195365 - DNA, 12 bp, Homo sapiens
caagggccctgg

SEQ ID NO: 2195366 - DNA, 15 bp, Homo sapiens
caagggccctggcac

SEQ ID NO: 2195367 - DNA, 12 bp, Homo sapiens
caagtcattttt

SEQ ID NO: 2195368 - DNA, 15 bp, Homo sapiens
caagtctcaggagga

SEQ ID NO: 2195369 - DNA, 11 bp, Homo sapiens
caagtctgtga

SEQ ID NO: 2195370 - DNA, 16 bp, Homo sapiens
caagtctgtgcctgga

SEQ ID NO: 2195371 - DNA, 18 bp, Homo sapiens
caagtctgtgcctggagc

SEQ ID NO: 2195372 - DNA, 20 bp, Homo sapiens
caagtgaaataatattgatt

SEQ ID NO: 2195373 - DNA, 16 bp, Homo sapiens
caagtgagcaaacctg

SEQ ID NO: 2195374 - DNA, 19 bp, Homo sapiens
caagtgagcaaacctgccc

SEQ ID NO: 2195375 - DNA, 20 bp, Homo sapiens
caagtgagcaaacctgcccc

SEQ ID NO: 2195376 - DNA, 18 bp, Homo sapiens
caagtgatcctcctgtct

SEQ ID NO: 2195377 - DNA, 20 bp, Homo sapiens
caagtgctcagttccaatgt

SEQ ID NO: 2195378 - DNA, 17 bp, Homo sapiens
caagtttcagtaatagc

SEQ ID NO: 2195379 - DNA, 16 bp, Homo sapiens
caataaagtactgcaa

SEQ ID NO: 2195380 - DNA, 17 bp, Homo sapiens
caataaagtactgcaaa

SEQ ID NO: 2195381 - DNA, 22 bp, Homo sapiens
caataaatggctcgtgggctct

SEQ ID NO: 2195382 - DNA, 12 bp, Homo sapiens
caataagccttg

SEQ ID NO: 2195383 - DNA, 15 bp, Homo sapiens
caataattgtggaga

SEQ ID NO: 2195384 - DNA, 20 bp, Homo sapiens
caatacatttacagcaatct

SEQ ID NO: 2195385 - DNA, 17 bp, Homo sapiens
caataccagatcactca

SEQ ID NO: 2195386 - DNA, 18 bp, Homo sapiens
caataccagatcactcaa

SEQ ID NO: 2195387 - DNA, 20 bp, Homo sapiens
caatacccaaatcctctcca

SEQ ID NO: 2195388 - DNA, 22 bp, Homo sapiens
caatacccaaatcctctccagc

SEQ ID NO: 2195389 - DNA, 23 bp, Homo sapiens
caatacccaaatcctctccagct

SEQ ID NO: 2195390 - DNA, 20 bp, Homo sapiens
caatatttataattaaagaa

SEQ ID NO: 2195391 - DNA, 21 bp, Homo sapiens
caatatttataattaaagaaa

SEQ ID NO: 2195392 - DNA, 11 bp, Homo sapiens
caatcaaagct

SEQ ID NO: 2195393 - DNA, 14 bp, Homo sapiens
caatcaaagctacc

SEQ ID NO: 2195394 - DNA, 17 bp, Homo sapiens
caatcaaagctaccttt

SEQ ID NO: 2195395 - DNA, 16 bp, Homo sapiens
caatcactgagtttgt

SEQ ID NO: 2195396 - DNA, 15 bp, Homo sapiens
caatcatttcccctc

SEQ ID NO: 2195397 - DNA, 13 bp, Homo sapiens
caatcctcctgag

SEQ ID NO: 2195398 - DNA, 15 bp, Homo sapiens
caatcctgtcaatgt

SEQ ID NO: 2195399 - DNA, 22 bp, Homo sapiens
caatctattaatagctgcctta

SEQ ID NO: 2195400 - DNA, 10 bp, Homo sapiens
caatctctgg

SEQ ID NO: 2195401 - DNA, 14 bp, Homo sapiens
caatctctgttctg

SEQ ID NO: 2195402 - DNA, 22 bp, Homo sapiens
caatgaaaagaaaatgtgccat

SEQ ID NO: 2195403 - DNA, 22 bp, Homo sapiens
caatgactgcgcagagtggatt

SEQ ID NO: 2195404 - DNA, 16 bp, Homo sapiens
caatgcagatgccaga

SEQ ID NO: 2195405 - DNA, 18 bp, Homo sapiens
caatgcatgctttggaaa

SEQ ID NO: 2195406 - DNA, 14 bp, Homo sapiens
caatgcatttttaa

SEQ ID NO: 2195407 - DNA, 14 bp, Homo sapiens
caatggaacctcct

SEQ ID NO: 2195408 - DNA, 16 bp, Homo sapiens
caatggaacctccttt

SEQ ID NO: 2195409 - DNA, 22 bp, Homo sapiens
caatggagtagacccctggctg

SEQ ID NO: 2195410 - DNA, 23 bp, Homo sapiens
caatggagtagacccctggctgg

SEQ ID NO: 2195411 - DNA, 18 bp, Homo sapiens
caatggattatacaaaaa

SEQ ID NO: 2195412 - DNA, 21 bp, Homo sapiens
caatgtgaagacactacagag

SEQ ID NO: 2195413 - DNA, 12 bp, Homo sapiens
cacagctgtggt

SEQ ID NO: 2195414 - DNA, 22 bp, Homo sapiens
cacagctgtggtgaggttgggc

SEQ ID NO: 2195415 - DNA, 12 bp, Homo sapiens
cacagcttgggg

SEQ ID NO: 2195416 - DNA, 18 bp, Homo sapiens
cacagcttggggccatcg

SEQ ID NO: 2195417 - DNA, 20 bp, Homo sapiens
cacagggcatccaactgaga

SEQ ID NO: 2195418 - DNA, 14 bp, Homo sapiens
cacagggccctctg

SEQ ID NO: 2195419 - DNA, 13 bp, Homo sapiens
cacagggcctgac

SEQ ID NO: 2195420 - DNA, 18 bp, Homo sapiens
cacagggcctgactttta

SEQ ID NO: 2195421 - DNA, 19 bp, Homo sapiens
cacagggcctgacttttac

SEQ ID NO: 2195422 - DNA, 21 bp, Homo sapiens
cacagggcctgacttttacag

SEQ ID NO: 2195423 - DNA, 20 bp, Homo sapiens
cacaggtgtccccagcccac

SEQ ID NO: 2195424 - DNA, 15 bp, Homo sapiens
cacagtaagcatgct

SEQ ID NO: 2195425 - DNA, 19 bp, Homo sapiens
cacagtctctccctggggt

SEQ ID NO: 2195426 - DNA, 15 bp, Homo sapiens
cacatccccaaaggt

SEQ ID NO: 2195427 - DNA, 16 bp, Homo sapiens
cacatccccgctggct

SEQ ID NO: 2195428 - DNA, 18 bp, Homo sapiens
cacatccccgctggctgg

SEQ ID NO: 2195429 - DNA, 19 bp, Homo sapiens
cacatgctggacaggtctg

SEQ ID NO: 2195430 - DNA, 13 bp, Homo sapiens
cacatggcttcct

SEQ ID NO: 2195431 - DNA, 18 bp, Homo sapiens
cacatggcttcctaaatg

SEQ ID NO: 2195432 - DNA, 13 bp, Homo sapiens
cacattaaagtaa

SEQ ID NO: 2195433 - DNA, 21 bp, Homo sapiens
cacatttccagggcagcagcc

SEQ ID NO: 2195434 - DNA, 17 bp, Homo sapiens
caccaactgctctcaaa

SEQ ID NO: 2195435 - DNA, 23 bp, Homo sapiens
caccaagcccacaggtgtcccca

SEQ ID NO: 2195436 - DNA, 17 bp, Homo sapiens
caccacaaaaagagaag

SEQ ID NO: 2195437 - DNA, 16 bp, Homo sapiens
caccacacccagcctc

SEQ ID NO: 2195438 - DNA, 13 bp, Homo sapiens
caccacactcagc

SEQ ID NO: 2195439 - DNA, 15 bp, Homo sapiens
caccaccccccactc

SEQ ID NO: 2195440 - DNA, 13 bp, Homo sapiens
caccagcctgagc

SEQ ID NO: 2195441 - DNA, 20 bp, Homo sapiens
caccaggggaggagcctgtg

SEQ ID NO: 2195442 - DNA, 14 bp, Homo sapiens
caccagttactgtt

SEQ ID NO: 2195443 - DNA, 15 bp, Homo sapiens
caccattcaggaacc

SEQ ID NO: 2195444 - DNA, 20 bp, Homo sapiens
caccatttcttctgcacaaa

SEQ ID NO: 2195445 - DNA, 17 bp, Homo sapiens
caccccactcacagaga

SEQ ID NO: 2195446 - DNA, 23 bp, Homo sapiens
cacccccacaagctgtccctgca

SEQ ID NO: 2195447 - DNA, 20 bp, Homo sapiens
caccccgggctctcctgccc

SEQ ID NO: 2195448 - DNA, 21 bp, Homo sapiens
caccccgggctctcctgccct

SEQ ID NO: 2195449 - DNA, 14 bp, Homo sapiens
cacccctccccact

SEQ ID NO: 2195450 - DNA, 22 bp, Homo sapiens
caccccttggaggagagagacc

SEQ ID NO: 2195451 - DNA, 14 bp, Homo sapiens
cacccgtcttcaat

SEQ ID NO: 2195452 - DNA, 21 bp, Homo sapiens
caccctaactgagctgccagt

SEQ ID NO: 2195453 - DNA, 14 bp, Homo sapiens
caccctcagctggc

SEQ ID NO: 2195454 - DNA, 12 bp, Homo sapiens
caccctgagccg

SEQ ID NO: 2195455 - DNA, 12 bp, Homo sapiens
caccctgccccc

SEQ ID NO: 2195456 - DNA, 21 bp, Homo sapiens
caccctgcttggggcctggcg

SEQ ID NO: 2195457 - DNA, 17 bp, Homo sapiens
caccctgtatggagcta

SEQ ID NO: 2195458 - DNA, 12 bp, Homo sapiens
caccctgtggca

SEQ ID NO: 2195459 - DNA, 19 bp, Homo sapiens
cacctaccttcaaagctga

SEQ ID NO: 2195460 - DNA, 21 bp, Homo sapiens
cacctataaatactaaatatg

SEQ ID NO: 2195461 - DNA, 22 bp, Homo sapiens
cacctataaatactaaatatga

SEQ ID NO: 2195462 - DNA, 13 bp, Homo sapiens
cacctctggccct

SEQ ID NO: 2195463 - DNA, 13 bp, Homo sapiens
cacctctgtgctg

SEQ ID NO: 2195464 - DNA, 12 bp, Homo sapiens
cacctcttttcc

SEQ ID NO: 2195465 - DNA, 15 bp, Homo sapiens
cacctcttttcctag

SEQ ID NO: 2195466 - DNA, 18 bp, Homo sapiens
cacctgagctttggacac

SEQ ID NO: 2195467 - DNA, 20 bp, Homo sapiens
cacctgagctttggacgcac

SEQ ID NO: 2195468 - DNA, 14 bp, Homo sapiens
cacctgaggcccag

SEQ ID NO: 2195469 - DNA, 22 bp, Homo sapiens
cacctgaggcccagcagagccg

SEQ ID NO: 2195470 - DNA, 14 bp, Homo sapiens
cacctgcaggtcac

SEQ ID NO: 2195471 - DNA, 17 bp, Homo sapiens
cacctgcatcagcctct

SEQ ID NO: 2195472 - DNA, 18 bp, Homo sapiens
cacctgcatcagcctctg

SEQ ID NO: 2195473 - DNA, 22 bp, Homo sapiens
cacctgcatcagcctctggcca

SEQ ID NO: 2195474 - DNA, 17 bp, Homo sapiens
cacctgggttccccacc

SEQ ID NO: 2195475 - DNA, 13 bp, Homo sapiens
cacctgtcccacc

SEQ ID NO: 2195476 - DNA, 15 bp, Homo sapiens
cacctgtcccacctc

SEQ ID NO: 2195477 - DNA, 16 bp, Homo sapiens
cacctgtcccacctca

SEQ ID NO: 2195478 - DNA, 17 bp, Homo sapiens
cacctgtgcagggccct

SEQ ID NO: 2195479 - DNA, 18 bp, Homo sapiens
caccttaccctactggct

SEQ ID NO: 2195480 - DNA, 19 bp, Homo sapiens
caccttaccctactggctg

SEQ ID NO: 2195481 - DNA, 21 bp, Homo sapiens
caccttaccctactggctgta

SEQ ID NO: 2195482 - DNA, 18 bp, Homo sapiens
caccttgaacaccacgct

SEQ ID NO: 2195483 - DNA, 22 bp, Homo sapiens
cacctttagaatattaaaaatt

SEQ ID NO: 2195484 - DNA, 14 bp, Homo sapiens
cacgagccttgcgc

SEQ ID NO: 2195485 - DNA, 12 bp, Homo sapiens
cacttgtgtttg

SEQ ID NO: 2195486 - DNA, 17 bp, Homo sapiens
cactttaataataaaaa

SEQ ID NO: 2195487 - DNA, 17 bp, Homo sapiens
cactttgcagacctggg

SEQ ID NO: 2195488 - DNA, 13 bp, Homo sapiens
cacttttaaacta

SEQ ID NO: 2195489 - DNA, 23 bp, Homo sapiens
cagaaaacaaatcttcaaggtgt

SEQ ID NO: 2195490 - DNA, 20 bp, Homo sapiens
cagaaagcagaggctggcct

SEQ ID NO: 2195491 - DNA, 22 bp, Homo sapiens
cagaaagggagcagagaaggcc

SEQ ID NO: 2195492 - DNA, 16 bp, Homo sapiens
cagaaatcccagttca

SEQ ID NO: 2195493 - DNA, 17 bp, Homo sapiens
cagaaatcccagttcat

SEQ ID NO: 2195494 - DNA, 21 bp, Homo sapiens
cagaaatgaaacagaccctca

SEQ ID NO: 2195495 - DNA, 13 bp, Homo sapiens
cagaaattgtata

SEQ ID NO: 2195496 - DNA, 14 bp, Homo sapiens
cagaaattgtatat

SEQ ID NO: 2195497 - DNA, 19 bp, Homo sapiens
cagaacagttaagcagccg

SEQ ID NO: 2195498 - DNA, 18 bp, Homo sapiens
cagaacattcagctctgg

SEQ ID NO: 2195499 - DNA, 22 bp, Homo sapiens
cagaaccctggtgaggaagctc

SEQ ID NO: 2195500 - DNA, 22 bp, Homo sapiens
cagaagaaataattgtgtcatg

SEQ ID NO: 2195501 - DNA, 22 bp, Homo sapiens
cagaagatgtattcagagccac

SEQ ID NO: 2195502 - DNA, 14 bp, Homo sapiens
cagaaggaaagaag

SEQ ID NO: 2195503 - DNA, 23 bp, Homo sapiens
cagaagttgttagtgatttgcta

SEQ ID NO: 2195504 - DNA, 14 bp, Homo sapiens
cagaataaagaaca

SEQ ID NO: 2195505 - DNA, 21 bp, Homo sapiens
cagaatcccaaataaaaccca

SEQ ID NO: 2195506 - DNA, 12 bp, Homo sapiens
cagacaagcagc

SEQ ID NO: 2195507 - DNA, 17 bp, Homo sapiens
cagacaagcagcccttg

SEQ ID NO: 2195508 - DNA, 19 bp, Homo sapiens
cagacaagcagcccttgct

SEQ ID NO: 2195509 - DNA, 20 bp, Homo sapiens
cagacatctgaggttttatt

SEQ ID NO: 2195510 - DNA, 14 bp, Homo sapiens
cagacccctgggag

SEQ ID NO: 2195511 - DNA, 14 bp, Homo sapiens
cagacctgggactt

SEQ ID NO: 2195512 - DNA, 18 bp, Homo sapiens
cagacggcccgccgtgcc

SEQ ID NO: 2195513 - DNA, 20 bp, Homo sapiens
cagactatttttagattttc

SEQ ID NO: 2195514 - DNA, 22 bp, Homo sapiens
cagactatttttagattttctt

SEQ ID NO: 2195515 - DNA, 16 bp, Homo sapiens
cagactcatacagaag

SEQ ID NO: 2195516 - DNA, 22 bp, Homo sapiens
cagacttcacacagcacctcct

SEQ ID NO: 2195517 - DNA, 18 bp, Homo sapiens
cagagaaggccaggggct

SEQ ID NO: 2195518 - DNA, 19 bp, Homo sapiens
cagagaatgggtaattcaa

SEQ ID NO: 2195519 - DNA, 17 bp, Homo sapiens
cagagcaaagggccagg

SEQ ID NO: 2195520 - DNA, 17 bp, Homo sapiens
cagagctacttgggcca

SEQ ID NO: 2195521 - DNA, 21 bp, Homo sapiens
cagagctctggagccacctgt

SEQ ID NO: 2195522 - DNA, 15 bp, Homo sapiens
cagaggcagtggcag

SEQ ID NO: 2195523 - DNA, 13 bp, Homo sapiens
cagaggccctgga

SEQ ID NO: 2195524 - DNA, 20 bp, Homo sapiens
cagaggcctagtcagccaca

SEQ ID NO: 2195525 - DNA, 21 bp, Homo sapiens
cagaggctcctggagccagcc

SEQ ID NO: 2195526 - DNA, 14 bp, Homo sapiens
cagaggctggcctc

SEQ ID NO: 2195527 - DNA, 15 bp, Homo sapiens
cagaggctggcctca

SEQ ID NO: 2195528 - DNA, 16 bp, Homo sapiens
cagaggctggcctcag

SEQ ID NO: 2195529 - DNA, 17 bp, Homo sapiens
cagaggctggcctcaga

SEQ ID NO: 2195530 - DNA, 14 bp, Homo sapiens
cagagggctgtgtc

SEQ ID NO: 2195531 - DNA, 15 bp, Homo sapiens
cagaggggagaggaa

SEQ ID NO: 2195532 - DNA, 16 bp, Homo sapiens
cagaggggagaggaag

SEQ ID NO: 2195533 - DNA, 19 bp, Homo sapiens
cagaggtggggaagagagc

SEQ ID NO: 2195534 - DNA, 21 bp, Homo sapiens
cagaggtggggaagagagcct

SEQ ID NO: 2195535 - DNA, 12 bp, Homo sapiens
cagagtgcccca

SEQ ID NO: 2195536 - DNA, 14 bp, Homo sapiens
cagagtgccccacc

SEQ ID NO: 2195537 - DNA, 15 bp, Homo sapiens
cagagtgccccacct

SEQ ID NO: 2195538 - DNA, 16 bp, Homo sapiens
cagagtgccccacctg

SEQ ID NO: 2195539 - DNA, 21 bp, Homo sapiens
cagagtgccccacctgccact

SEQ ID NO: 2195540 - DNA, 18 bp, Homo sapiens
cagagtggagccctcagt

SEQ ID NO: 2195541 - DNA, 21 bp, Homo sapiens
cagagtgggccccgggctgga

SEQ ID NO: 2195542 - DNA, 22 bp, Homo sapiens
cagagtgggccccgggctggag

SEQ ID NO: 2195543 - DNA, 18 bp, Homo sapiens
cagatacttgtgaacatg

SEQ ID NO: 2195544 - DNA, 13 bp, Homo sapiens
cagatcctgctgc

SEQ ID NO: 2195545 - DNA, 16 bp, Homo sapiens
cagatctccaaagctt

SEQ ID NO: 2195546 - DNA, 15 bp, Homo sapiens
cagatggctgtgaaa

SEQ ID NO: 2195547 - DNA, 17 bp, Homo sapiens
cagattctccacggtgg

SEQ ID NO: 2195548 - DNA, 19 bp, Homo sapiens
cagcaacctgtaagactga

SEQ ID NO: 2195549 - DNA, 20 bp, Homo sapiens
cagcaacggcacagctaatt

SEQ ID NO: 2195550 - DNA, 21 bp, Homo sapiens
cagcaaggaccagtgagacag

SEQ ID NO: 2195551 - DNA, 18 bp, Homo sapiens
cagcacctcctctctgct

SEQ ID NO: 2195552 - DNA, 21 bp, Homo sapiens
cagcacctcctctctgctggg

SEQ ID NO: 2195553 - DNA, 22 bp, Homo sapiens
cagcacctcctctctgctgggt

SEQ ID NO: 2195554 - DNA, 18 bp, Homo sapiens
cagcacttgcttgcggaa

SEQ ID NO: 2195555 - DNA, 14 bp, Homo sapiens
cagcagcaagtaca

SEQ ID NO: 2195556 - DNA, 16 bp, Homo sapiens
cagcagctccgcctgg

SEQ ID NO: 2195557 - DNA, 17 bp, Homo sapiens
cagcagctccgcctggc

SEQ ID NO: 2195558 - DNA, 18 bp, Homo sapiens
cagcagctccgcctggca

SEQ ID NO: 2195559 - DNA, 13 bp, Homo sapiens
cagcaggcccacc

SEQ ID NO: 2195560 - DNA, 18 bp, Homo sapiens
cagcaggcccacctacct

SEQ ID NO: 2195561 - DNA, 14 bp, Homo sapiens
cagcagtttcccag

SEQ ID NO: 2195562 - DNA, 19 bp, Homo sapiens
cagcatgactggacagcgg

SEQ ID NO: 2195563 - DNA, 16 bp, Homo sapiens
cagcatggtgcatgcc

SEQ ID NO: 2195564 - DNA, 14 bp, Homo sapiens
cagcatttacagaa

SEQ ID NO: 2195565 - DNA, 23 bp, Homo sapiens
ccattacagtgtaaaaattcaga

SEQ ID NO: 2195566 - DNA, 15 bp, Homo sapiens
ccattcaggaacctg

SEQ ID NO: 2195567 - DNA, 17 bp, Homo sapiens
ccattcaggaacctgga

SEQ ID NO: 2195568 - DNA, 12 bp, Homo sapiens
ccatttcacaga

SEQ ID NO: 2195569 - DNA, 13 bp, Homo sapiens
ccatttcacagaa

SEQ ID NO: 2195570 - DNA, 13 bp, Homo sapiens
ccatttccctgaa

SEQ ID NO: 2195571 - DNA, 14 bp, Homo sapiens
ccatttccctgaac

SEQ ID NO: 2195572 - DNA, 18 bp, Homo sapiens
ccatttgccatgctgcta

SEQ ID NO: 2195573 - DNA, 13 bp, Homo sapiens
ccatttgccccaa

SEQ ID NO: 2195574 - DNA, 14 bp, Homo sapiens
ccattttaaattga

SEQ ID NO: 2195575 - DNA, 15 bp, Homo sapiens
ccatttttaatgaga

SEQ ID NO: 2195576 - DNA, 20 bp, Homo sapiens
cccaaagtgctaagattaca

SEQ ID NO: 2195577 - DNA, 17 bp, Homo sapiens
cccaacacaatctttcc

SEQ ID NO: 2195578 - DNA, 14 bp, Homo sapiens
cccaagggccctgg

SEQ ID NO: 2195579 - DNA, 15 bp, Homo sapiens
cccaagggccctggc

SEQ ID NO: 2195580 - DNA, 16 bp, Homo sapiens
cccaagggccctggca

SEQ ID NO: 2195581 - DNA, 21 bp, Homo sapiens
cccaagtctctgggccccagg

SEQ ID NO: 2195582 - DNA, 18 bp, Homo sapiens
cccacaagctgtccctgc

SEQ ID NO: 2195583 - DNA, 18 bp, Homo sapiens
cccacagggcctgacttt

SEQ ID NO: 2195584 - DNA, 13 bp, Homo sapiens
cccaccctcctgt

SEQ ID NO: 2195585 - DNA, 18 bp, Homo sapiens
cccaccggttgcttctgg

SEQ ID NO: 2195586 - DNA, 22 bp, Homo sapiens
cccaccgtaaagtgagcatgct

SEQ ID NO: 2195587 - DNA, 14 bp, Homo sapiens
cccacctaccttca

SEQ ID NO: 2195588 - DNA, 13 bp, Homo sapiens
cccacctcttttc

SEQ ID NO: 2195589 - DNA, 16 bp, Homo sapiens
cccacctcttttccta

SEQ ID NO: 2195590 - DNA, 21 bp, Homo sapiens
cccacctgcatcagcctctgg

SEQ ID NO: 2195591 - DNA, 13 bp, Homo sapiens
cccacggccactg

SEQ ID NO: 2195592 - DNA, 20 bp, Homo sapiens
cccacggccactgcagtcac

SEQ ID NO: 2195593 - DNA, 23 bp, Homo sapiens
cccacttctccttcgctttcctg

SEQ ID NO: 2195594 - DNA, 14 bp, Homo sapiens
cccactttggggaa

SEQ ID NO: 2195595 - DNA, 13 bp, Homo sapiens
cccagaggccctg

SEQ ID NO: 2195596 - DNA, 16 bp, Homo sapiens
cccagaggccctggag

SEQ ID NO: 2195597 - DNA, 17 bp, Homo sapiens
cccagaggccctggagg

SEQ ID NO: 2195598 - DNA, 15 bp, Homo sapiens
cccagaggctcctgg

SEQ ID NO: 2195599 - DNA, 17 bp, Homo sapiens
cccagaggctcctggag

SEQ ID NO: 2195600 - DNA, 21 bp, Homo sapiens
cccagaggctcctggagccag

SEQ ID NO: 2195601 - DNA, 21 bp, Homo sapiens
cccagatgcctcctctgtcct

SEQ ID NO: 2195602 - DNA, 18 bp, Homo sapiens
cccagcagtttcccagaa

SEQ ID NO: 2195603 - DNA, 13 bp, Homo sapiens
cccagcatgtaca

SEQ ID NO: 2195604 - DNA, 18 bp, Homo sapiens
cccagcccagctgctctg

SEQ ID NO: 2195605 - DNA, 15 bp, Homo sapiens
cccagcctctaggga

SEQ ID NO: 2195606 - DNA, 20 bp, Homo sapiens
cccagctaaagaggtggggt

SEQ ID NO: 2195607 - DNA, 17 bp, Homo sapiens
cccagctgaaggcagtg

SEQ ID NO: 2195608 - DNA, 13 bp, Homo sapiens
cccagctgctctg

SEQ ID NO: 2195609 - DNA, 18 bp, Homo sapiens
cccagctgctctgcccag

SEQ ID NO: 2195610 - DNA, 18 bp, Homo sapiens
cccaggggctttggtggc

SEQ ID NO: 2195611 - DNA, 16 bp, Homo sapiens
cccagggtcctgtgcc

SEQ ID NO: 2195612 - DNA, 18 bp, Homo sapiens
cccagggttcagtcctca

SEQ ID NO: 2195613 - DNA, 17 bp, Homo sapiens
cccaggttggaggccct

SEQ ID NO: 2195614 - DNA, 17 bp, Homo sapiens
cccagtccactggggag

SEQ ID NO: 2195615 - DNA, 22 bp, Homo sapiens
cccagtccactggggagtgctg

SEQ ID NO: 2195616 - DNA, 15 bp, Homo sapiens
cccagtgatggcatt

SEQ ID NO: 2195617 - DNA, 17 bp, Homo sapiens
cccatcaggactcttgt

SEQ ID NO: 2195618 - DNA, 15 bp, Homo sapiens
cccatcttgcctcca

SEQ ID NO: 2195619 - DNA, 19 bp, Homo sapiens
cccatgagggtgttttttt

SEQ ID NO: 2195620 - DNA, 12 bp, Homo sapiens
cccattttaact

SEQ ID NO: 2195621 - DNA, 14 bp, Homo sapiens
cccattttaacttg

SEQ ID NO: 2195622 - DNA, 23 bp, Homo sapiens
ccccaaccgtgcaacgtgtaact

SEQ ID NO: 2195623 - DNA, 18 bp, Homo sapiens
ccccaagaaggctggggc

SEQ ID NO: 2195624 - DNA, 16 bp, Homo sapiens
ccccaagggccctggc

SEQ ID NO: 2195625 - DNA, 15 bp, Homo sapiens
ccccaattccttgta

SEQ ID NO: 2195626 - DNA, 19 bp, Homo sapiens
ccccacaagctgtccctgc

SEQ ID NO: 2195627 - DNA, 20 bp, Homo sapiens
ccccacaagctgtccctgca

SEQ ID NO: 2195628 - DNA, 22 bp, Homo sapiens
ccccacaagctgtccctgcagg

SEQ ID NO: 2195629 - DNA, 12 bp, Homo sapiens
ccccacactcct

SEQ ID NO: 2195630 - DNA, 14 bp, Homo sapiens
ccccacctcttttc

SEQ ID NO: 2195631 - DNA, 11 bp, Homo sapiens
ccccacctgcc

SEQ ID NO: 2195632 - DNA, 12 bp, Homo sapiens
ccccactctgtg

SEQ ID NO: 2195633 - DNA, 15 bp, Homo sapiens
ccccagaggccctgg

SEQ ID NO: 2195634 - DNA, 16 bp, Homo sapiens
ccccagaggccctgga

SEQ ID NO: 2195635 - DNA, 18 bp, Homo sapiens
ccccaggctcgtggactg

SEQ ID NO: 2195636 - DNA, 15 bp, Homo sapiens
ccccatactctgtct

SEQ ID NO: 2195637 - DNA, 13 bp, Homo sapiens
cccccacccactt

SEQ ID NO: 2195638 - DNA, 13 bp, Homo sapiens
ccccccactctgt

SEQ ID NO: 2195639 - DNA, 13 bp, Homo sapiens
cccccgccctctg

SEQ ID NO: 2195640 - DNA, 15 bp, Homo sapiens
cccccgccctctgcc

SEQ ID NO: 2195641 - DNA, 13 bp, Homo sapiens
ccccctaagagac

SEQ ID NO: 2195642 - DNA, 14 bp, Homo sapiens
ccccgagccctact

SEQ ID NO: 2195643 - DNA, 13 bp, Homo sapiens
ccccgccctctgc

SEQ ID NO: 2195644 - DNA, 20 bp, Homo sapiens
cccctaccactgtcttcttc

SEQ ID NO: 2195645 - DNA, 19 bp, Homo sapiens
cccctcccgtcttcctcct

SEQ ID NO: 2195646 - DNA, 14 bp, Homo sapiens
cccctccctgcttc

SEQ ID NO: 2195647 - DNA, 20 bp, Homo sapiens
cccctccttccctggtccag

SEQ ID NO: 2195648 - DNA, 21 bp, Homo sapiens
cccctccttgccgctgggaga

SEQ ID NO: 2195649 - DNA, 14 bp, Homo sapiens
cccctctgctggcc

SEQ ID NO: 2195650 - DNA, 22 bp, Homo sapiens
cccctcttagcttacaggaagc

SEQ ID NO: 2195651 - DNA, 17 bp, Homo sapiens
cccctgccgcctgtgcc

SEQ ID NO: 2195652 - DNA, 11 bp, Homo sapiens
cccctggtggc

SEQ ID NO: 2195653 - DNA, 20 bp, Homo sapiens
cccctgtccttcccacggcc

SEQ ID NO: 2195654 - DNA, 23 bp, Homo sapiens
cccctgtctgcgccgctgtgctg

SEQ ID NO: 2195655 - DNA, 18 bp, Homo sapiens
ccccttcacaccataact

SEQ ID NO: 2195656 - DNA, 15 bp, Homo sapiens
ccccttcctgtctgg

SEQ ID NO: 2195657 - DNA, 13 bp, Homo sapiens
ccccttttctgtt

SEQ ID NO: 2195658 - DNA, 17 bp, Homo sapiens
cccgagccccctgtcct

SEQ ID NO: 2195659 - DNA, 15 bp, Homo sapiens
cccgccgtgcctgca

SEQ ID NO: 2195660 - DNA, 17 bp, Homo sapiens
cccgccttggcctccca

SEQ ID NO: 2195661 - DNA, 12 bp, Homo sapiens
cccggccggaga

SEQ ID NO: 2195662 - DNA, 13 bp, Homo sapiens
cccgggctggaga

SEQ ID NO: 2195663 - DNA, 23 bp, Homo sapiens
cccgtctcctgagggtcctgctg

SEQ ID NO: 2195664 - DNA, 13 bp, Homo sapiens
cccgtctcctgcc

SEQ ID NO: 2195665 - DNA, 13 bp, Homo sapiens
cccgtcttcctcc

SEQ ID NO: 2195666 - DNA, 22 bp, Homo sapiens
cccgttaatttaaagctgtttc

SEQ ID NO: 2195667 - DNA, 20 bp, Homo sapiens
ccctaactctgcccaccctc

SEQ ID NO: 2195668 - DNA, 23 bp, Homo sapiens
ccctaactgagctgccagtgggg

SEQ ID NO: 2195669 - DNA, 12 bp, Homo sapiens
ccctactggctg

SEQ ID NO: 2195670 - DNA, 17 bp, Homo sapiens
ccctagggctgggtgta

SEQ ID NO: 2195671 - DNA, 19 bp, Homo sapiens
ccctcaattccccctggcc

SEQ ID NO: 2195672 - DNA, 18 bp, Homo sapiens
ccctcatcacacgtcaca

SEQ ID NO: 2195673 - DNA, 14 bp, Homo sapiens
ccctccactgccct

SEQ ID NO: 2195674 - DNA, 15 bp, Homo sapiens
ccctccactgccctc

SEQ ID NO: 2195675 - DNA, 21 bp, Homo sapiens
ccctccatgtagaagagggag

SEQ ID NO: 2195676 - DNA, 20 bp, Homo sapiens
ccctccccaactccttcctc

SEQ ID NO: 2195677 - DNA, 14 bp, Homo sapiens
ccctccctgcttca

SEQ ID NO: 2195678 - DNA, 15 bp, Homo sapiens
ccctccttccctggt

SEQ ID NO: 2195679 - DNA, 12 bp, Homo sapiens
ccctccttgccg

SEQ ID NO: 2195680 - DNA, 19 bp, Homo sapiens
ccctccttgccgctgggag

SEQ ID NO: 2195681 - DNA, 13 bp, Homo sapiens
ccctcggctaccc

SEQ ID NO: 2195682 - DNA, 12 bp, Homo sapiens
ccctctgcaggg

SEQ ID NO: 2195683 - DNA, 18 bp, Homo sapiens
ccctctgcccccagctgc

SEQ ID NO: 2195684 - DNA, 23 bp, Homo sapiens
ccctctgctggccgggcacagct

SEQ ID NO: 2195685 - DNA, 15 bp, Homo sapiens
ccctctggggctcag

SEQ ID NO: 2195686 - DNA, 19 bp, Homo sapiens
ccctctggggctcagccct

SEQ ID NO: 2195687 - DNA, 14 bp, Homo sapiens
cctccctgctcagc

SEQ ID NO: 2195688 - DNA, 15 bp, Homo sapiens
cctccctgctcagct

SEQ ID NO: 2195689 - DNA, 18 bp, Homo sapiens
cctccctggctcaagcga

SEQ ID NO: 2195690 - DNA, 14 bp, Homo sapiens
cctccctgtccacc

SEQ ID NO: 2195691 - DNA, 15 bp, Homo sapiens
cctccctgtccaccc

SEQ ID NO: 2195692 - DNA, 19 bp, Homo sapiens
cctccctttttccttgtcc

SEQ ID NO: 2195693 - DNA, 15 bp, Homo sapiens
cctcctcccctggca

SEQ ID NO: 2195694 - DNA, 17 bp, Homo sapiens
cctcctccctttttcct

SEQ ID NO: 2195695 - DNA, 18 bp, Homo sapiens
cctcctgcccgccctccc

SEQ ID NO: 2195696 - DNA, 24 bp, Homo sapiens
cctcctgcctgcgcagctccttcc

SEQ ID NO: 2195697 - DNA, 20 bp, Homo sapiens
cctcctgtcttggcctccca

SEQ ID NO: 2195698 - DNA, 14 bp, Homo sapiens
cctccttgccgctg

SEQ ID NO: 2195699 - DNA, 20 bp, Homo sapiens
cctccttgccgctgggagag

SEQ ID NO: 2195700 - DNA, 12 bp, Homo sapiens
cctcctttccca

SEQ ID NO: 2195701 - DNA, 20 bp, Homo sapiens
cctcctttctcttctctgtt

SEQ ID NO: 2195702 - DNA, 15 bp, Homo sapiens
cctcgaacccacact

SEQ ID NO: 2195703 - DNA, 21 bp, Homo sapiens
cctcgaacccacactgcaaca

SEQ ID NO: 2195704 - DNA, 23 bp, Homo sapiens
cctcgaacccacactgcaacagg

SEQ ID NO: 2195705 - DNA, 16 bp, Homo sapiens
cctcgaactcctgggc

SEQ ID NO: 2195706 - DNA, 15 bp, Homo sapiens
cctcgctcccttcaa

SEQ ID NO: 2195707 - DNA, 18 bp, Homo sapiens
cctctaacaggggctggt

SEQ ID NO: 2195708 - DNA, 19 bp, Homo sapiens
cctctagggacccctcctc

SEQ ID NO: 2195709 - DNA, 20 bp, Homo sapiens
cctctagggacccctcctcc

SEQ ID NO: 2195710 - DNA, 14 bp, Homo sapiens
cctctcagagctac

SEQ ID NO: 2195711 - DNA, 23 bp, Homo sapiens
cctctcagagctacttgggccat

SEQ ID NO: 2195712 - DNA, 18 bp, Homo sapiens
cctctcaggtgaccaaaa

SEQ ID NO: 2195713 - DNA, 18 bp, Homo sapiens
cctctcccctaccactgt

SEQ ID NO: 2195714 - DNA, 22 bp, Homo sapiens
cctctcctctgtccccatagct

SEQ ID NO: 2195715 - DNA, 12 bp, Homo sapiens
cctctccttcct

SEQ ID NO: 2195716 - DNA, 16 bp, Homo sapiens
cctctccttcctcaga

SEQ ID NO: 2195717 - DNA, 14 bp, Homo sapiens
cctctctgctgggt

SEQ ID NO: 2195718 - DNA, 19 bp, Homo sapiens
cctctctgctgggtttcca

SEQ ID NO: 2195719 - DNA, 14 bp, Homo sapiens
cctctgactcccaa

SEQ ID NO: 2195720 - DNA, 15 bp, Homo sapiens
cctctgcagggcagc

SEQ ID NO: 2195721 - DNA, 18 bp, Homo sapiens
cctctgcagggcagcctg

SEQ ID NO: 2195722 - DNA, 21 bp, Homo sapiens
cctctggaggcctctgggcct

SEQ ID NO: 2195723 - DNA, 14 bp, Homo sapiens
cctctggctgcctg

SEQ ID NO: 2195724 - DNA, 20 bp, Homo sapiens
cctctggctgcctggcccag

SEQ ID NO: 2195725 - DNA, 19 bp, Homo sapiens
cctctggggctcagccctg

SEQ ID NO: 2195726 - DNA, 22 bp, Homo sapiens
cctctgtcacgttctggaacat

SEQ ID NO: 2195727 - DNA, 19 bp, Homo sapiens
cctctgtgctgcatcccac

SEQ ID NO: 2195728 - DNA, 22 bp, Homo sapiens
cctcttcctccctccctgcagg

SEQ ID NO: 2195729 - DNA, 13 bp, Homo sapiens
cctcttcttctga

SEQ ID NO: 2195730 - DNA, 12 bp, Homo sapiens
cctcttttccta

SEQ ID NO: 2195731 - DNA, 22 bp, Homo sapiens
cctgaccagctgctccgaggac

SEQ ID NO: 2195732 - DNA, 18 bp, Homo sapiens
cctgacctcaagcaacca

SEQ ID NO: 2195733 - DNA, 22 bp, Homo sapiens
cctgaccttgaggagtcttgtg

SEQ ID NO: 2195734 - DNA, 16 bp, Homo sapiens
cctgactcaggcatca

SEQ ID NO: 2195735 - DNA, 14 bp, Homo sapiens
cctgacttttacag

SEQ ID NO: 2195736 - DNA, 19 bp, Homo sapiens
cctgacttttacagctttt

SEQ ID NO: 2195737 - DNA, 20 bp, Homo sapiens
cctgagctagtgtcacctgc

SEQ ID NO: 2195738 - DNA, 14 bp, Homo sapiens
cctgagctggcctc

SEQ ID NO: 2195739 - DNA, 15 bp, Homo sapiens
cctgagctttggaca

SEQ ID NO: 2195740 - DNA, 17 bp, Homo sapiens
cctgagctttggacaca

SEQ ID NO: 2195741 - DNA, 23 bp, Homo sapiens
cctgagctttggacacacacagc

SEQ ID NO: 2195742 - DNA, 17 bp, Homo sapiens
cctgaggtatctgtgtt

SEQ ID NO: 2195743 - DNA, 22 bp, Homo sapiens
cctgagtagctgagactacagg

SEQ ID NO: 2195744 - DNA, 22 bp, Homo sapiens
cctgagttggcgttgtgggcag

SEQ ID NO: 2195745 - DNA, 14 bp, Homo sapiens
cctgatcccactcc

SEQ ID NO: 2195746 - DNA, 23 bp, Homo sapiens
cctgattgctctggaagcctgct

SEQ ID NO: 2195747 - DNA, 14 bp, Homo sapiens
cctgatttgctgtt

SEQ ID NO: 2195748 - DNA, 23 bp, Homo sapiens
cctgcacacggcacagagcatcc

SEQ ID NO: 2195749 - DNA, 11 bp, Homo sapiens
cctgcagagct

SEQ ID NO: 2195750 - DNA, 14 bp, Homo sapiens
cctgcagggtaggg

SEQ ID NO: 2195751 - DNA, 20 bp, Homo sapiens
cctgcatcagcctctggcca

SEQ ID NO: 2195752 - DNA, 12 bp, Homo sapiens
cctgcatgcaga

SEQ ID NO: 2195753 - DNA, 13 bp, Homo sapiens
cctgcatgtgtat

SEQ ID NO: 2195754 - DNA, 18 bp, Homo sapiens
cctgcatgtgttgtacaa

SEQ ID NO: 2195755 - DNA, 18 bp, Homo sapiens
cctgcattcgcagcagct

SEQ ID NO: 2195756 - DNA, 23 bp, Homo sapiens
cctgcattcgcagcagctccgcc

SEQ ID NO: 2195757 - DNA, 14 bp, Homo sapiens
cctgccaagaactc

SEQ ID NO: 2195758 - DNA, 18 bp, Homo sapiens
cctgccaagaactctggg

SEQ ID NO: 2195759 - DNA, 12 bp, Homo sapiens
cctgccactgtt

SEQ ID NO: 2195760 - DNA, 22 bp, Homo sapiens
cctgccccccctaagagacaca

SEQ ID NO: 2195761 - DNA, 16 bp, Homo sapiens
cctgcccggccggaga

SEQ ID NO: 2195762 - DNA, 15 bp, Homo sapiens
cctgccctctattta

SEQ ID NO: 2195763 - DNA, 17 bp, Homo sapiens
cctgccctctatttatt

SEQ ID NO: 2195764 - DNA, 16 bp, Homo sapiens
cctgccgggcaggtcc

SEQ ID NO: 2195765 - DNA, 23 bp, Homo sapiens
cctgccgggcaggtcccaggttg

SEQ ID NO: 2195766 - DNA, 15 bp, Homo sapiens
cctgcctagcactca

SEQ ID NO: 2195767 - DNA, 12 bp, Homo sapiens
cctgcctcagcc

SEQ ID NO: 2195768 - DNA, 18 bp, Homo sapiens
cctgcgcagggccctctg

SEQ ID NO: 2195769 - DNA, 19 bp, Homo sapiens
cctgcgcagggccctctgg

SEQ ID NO: 2195770 - DNA, 18 bp, Homo sapiens
cctgcggctgctggcaca

SEQ ID NO: 2195771 - DNA, 23 bp, Homo sapiens
cctgctagatgagaattcagctg

SEQ ID NO: 2195772 - DNA, 14 bp, Homo sapiens
cctgctatttccca

SEQ ID NO: 2195773 - DNA, 14 bp, Homo sapiens
cctgctcagctggc

SEQ ID NO: 2195774 - DNA, 14 bp, Homo sapiens
cctgctctctaccc

SEQ ID NO: 2195775 - DNA, 20 bp, Homo sapiens
cctgctctctacccagccca

SEQ ID NO: 2195776 - DNA, 21 bp, Homo sapiens
cctgctctctacccagcccat

SEQ ID NO: 2195777 - DNA, 15 bp, Homo sapiens
cctgctggtacctgc

SEQ ID NO: 2195778 - DNA, 19 bp, Homo sapiens
cctgctggtacctgccctc

SEQ ID NO: 2195779 - DNA, 19 bp, Homo sapiens
cctgctgtgggtcagtgtg

SEQ ID NO: 2195780 - DNA, 17 bp, Homo sapiens
cctggagagtctcactc

SEQ ID NO: 2195781 - DNA, 15 bp, Homo sapiens
cctggagctcctggg

SEQ ID NO: 2195782 - DNA, 23 bp, Homo sapiens
cctggagggttgatatattcttt

SEQ ID NO: 2195783 - DNA, 16 bp, Homo sapiens
cctggaggtctccagg

SEQ ID NO: 2195784 - DNA, 21 bp, Homo sapiens
cctggatgagaaacagctcag

SEQ ID NO: 2195785 - DNA, 22 bp, Homo sapiens
cctggatgagaaacagctcagc

SEQ ID NO: 2195786 - DNA, 22 bp, Homo sapiens
cctggatgggggtgcaggcagc

SEQ ID NO: 2195787 - DNA, 15 bp, Homo sapiens
cctggcaactgctga

SEQ ID NO: 2195788 - DNA, 17 bp, Homo sapiens
cctggcaactgctgatc

SEQ ID NO: 2195789 - DNA, 20 bp, Homo sapiens
cctggcgtggggggagctct

SEQ ID NO: 2195790 - DNA, 12 bp, Homo sapiens
cctggctccgct

SEQ ID NO: 2195791 - DNA, 22 bp, Homo sapiens
cctggctgcgaactgtgcagtt

SEQ ID NO: 2195792 - DNA, 16 bp, Homo sapiens
cctggctggggacttg

SEQ ID NO: 2195793 - DNA, 15 bp, Homo sapiens
cctggctttgcccaa

SEQ ID NO: 2195794 - DNA, 16 bp, Homo sapiens
cctggctttgcccaac

SEQ ID NO: 2195795 - DNA, 21 bp, Homo sapiens
cctggctttgcccaacctcag

SEQ ID NO: 2195796 - DNA, 22 bp, Homo sapiens
cctggctttgcccaacctcagc

SEQ ID NO: 2195797 - DNA, 14 bp, Homo sapiens
cctgggaccccctc

SEQ ID NO: 2195798 - DNA, 23 bp, Homo sapiens
cctgggcaaatgaatggctcact

SEQ ID NO: 2195799 - DNA, 14 bp, Homo sapiens
cctgggccactggc

SEQ ID NO: 2195800 - DNA, 19 bp, Homo sapiens
cctgggggcttttgccact

SEQ ID NO: 2195801 - DNA, 15 bp, Homo sapiens
cctggggtgccctcc

SEQ ID NO: 2195802 - DNA, 15 bp, Homo sapiens
cctggggtggggagg

SEQ ID NO: 2195803 - DNA, 13 bp, Homo sapiens
cctgggtggctca

SEQ ID NO: 2195804 - DNA, 18 bp, Homo sapiens
cctgggtggctcagcatc

SEQ ID NO: 2195805 - DNA, 21 bp, Homo sapiens
cctggtatgggtttctcccag

SEQ ID NO: 2195806 - DNA, 20 bp, Homo sapiens
cctggtgaggaagctccagt

SEQ ID NO: 2195807 - DNA, 22 bp, Homo sapiens
cctgtactaggattagaaaatt

SEQ ID NO: 2195808 - DNA, 19 bp, Homo sapiens
cctgtcatggctctgaact

SEQ ID NO: 2195809 - DNA, 22 bp, Homo sapiens
cctgtccacccccgcctccctc

SEQ ID NO: 2195810 - DNA, 14 bp, Homo sapiens
cctgtcccacctca

SEQ ID NO: 2195811 - DNA, 19 bp, Homo sapiens
cctgtccgccctcttcccc

SEQ ID NO: 2195812 - DNA, 22 bp, Homo sapiens
cctgtccgccctcttcccctct

SEQ ID NO: 2195813 - DNA, 17 bp, Homo sapiens
cctgtctcccctctgct

SEQ ID NO: 2195814 - DNA, 19 bp, Homo sapiens
cctgtctcccctctgctgg

SEQ ID NO: 2195815 - DNA, 21 bp, Homo sapiens
cctgtcttcagatcctgctgc

SEQ ID NO: 2195816 - DNA, 22 bp, Homo sapiens
cctgtcttcagatcctgctgcc

SEQ ID NO: 2195817 - DNA, 17 bp, Homo sapiens
cctgtcttggcctccca

SEQ ID NO: 2195818 - DNA, 18 bp, Homo sapiens
cctgtgcagggccctctg

SEQ ID NO: 2195819 - DNA, 23 bp, Homo sapiens
cctgtgcagggccctctggggct

SEQ ID NO: 2195820 - DNA, 16 bp, Homo sapiens
cctgtgcccacccgtc

SEQ ID NO: 2195821 - DNA, 18 bp, Homo sapiens
cctgtgcgtcccagctga

SEQ ID NO: 2195822 - DNA, 14 bp, Homo sapiens
cctgtgggagaagg

SEQ ID NO: 2195823 - DNA, 12 bp, Homo sapiens
cctgtgtccaca

SEQ ID NO: 2195824 - DNA, 18 bp, Homo sapiens
cctgttctggtagctcca

SEQ ID NO: 2195825 - DNA, 23 bp, Homo sapiens
cctgtttacggtacttggtaaga

SEQ ID NO: 2195826 - DNA, 18 bp, Homo sapiens
ccttaaaaattagaactt

SEQ ID NO: 2195827 - DNA, 16 bp, Homo sapiens
ccttacacttactgtt

SEQ ID NO: 2195828 - DNA, 19 bp, Homo sapiens
ccttagaaaagactgacct

SEQ ID NO: 2195829 - DNA, 20 bp, Homo sapiens
ccttagaaaagactgacctt

SEQ ID NO: 2195830 - DNA, 17 bp, Homo sapiens
ccttagcaacagccgag

SEQ ID NO: 2195831 - DNA, 18 bp, Homo sapiens
ccttagcccccacccact

SEQ ID NO: 2195832 - DNA, 21 bp, Homo sapiens
ccttattggttgaaggtcaca

SEQ ID NO: 2195833 - DNA, 17 bp, Homo sapiens
ccttcaaatcctgccac

SEQ ID NO: 2195834 - DNA, 18 bp, Homo sapiens
ccttcacaccataactag

SEQ ID NO: 2195835 - DNA, 16 bp, Homo sapiens
ccttccaactgctgcc

SEQ ID NO: 2195836 - DNA, 17 bp, Homo sapiens
ccttccaactgctgccc

SEQ ID NO: 2195837 - DNA, 13 bp, Homo sapiens
ccttccaggccat

SEQ ID NO: 2195838 - DNA, 15 bp, Homo sapiens
ccttcctgtctggcc

SEQ ID NO: 2195839 - DNA, 16 bp, Homo sapiens
ccttcctgtctggccc

SEQ ID NO: 2195840 - DNA, 12 bp, Homo sapiens
ccttctccacag

SEQ ID NO: 2195841 - DNA, 10 bp, Homo sapiens
ccttctcctc

SEQ ID NO: 2195842 - DNA, 17 bp, Homo sapiens
ccttctccttccaactg

SEQ ID NO: 2195843 - DNA, 18 bp, Homo sapiens
ccttctccttccaactgc

SEQ ID NO: 2195844 - DNA, 16 bp, Homo sapiens
ccttctgtgcccagct

SEQ ID NO: 2195845 - DNA, 21 bp, Homo sapiens
ccttgagttgagtattacaca

SEQ ID NO: 2195846 - DNA, 22 bp, Homo sapiens
ccttgatgtcttgagagcgctg

SEQ ID NO: 2195847 - DNA, 20 bp, Homo sapiens
ccttgcactattggactttg

SEQ ID NO: 2195848 - DNA, 23 bp, Homo sapiens
ccttgccgctgggagagccaagg

SEQ ID NO: 2195849 - DNA, 15 bp, Homo sapiens
ccttgctttcggagc

SEQ ID NO: 2195850 - DNA, 21 bp, Homo sapiens
ccttgctttcggagctcctgt

SEQ ID NO: 2195851 - DNA, 18 bp, Homo sapiens
ccttggaggagagagacc

SEQ ID NO: 2195852 - DNA, 15 bp, Homo sapiens
ccttggccctacagc

SEQ ID NO: 2195853 - DNA, 17 bp, Homo sapiens
ccttggccctacagccc

SEQ ID NO: 2195854 - DNA, 19 bp, Homo sapiens
ccttggccctacagccctg

SEQ ID NO: 2195855 - DNA, 13 bp, Homo sapiens
ccttgtctctcat

SEQ ID NO: 2195856 - DNA, 15 bp, Homo sapiens
cctttagaatattaa

SEQ ID NO: 2195857 - DNA, 22 bp, Homo sapiens
cctttcccaacacttcagactg

SEQ ID NO: 2195858 - DNA, 16 bp, Homo sapiens
cctttcccacagtctc

SEQ ID NO: 2195859 - DNA, 23 bp, Homo sapiens
cctttccccattcattcctgatg

SEQ ID NO: 2195860 - DNA, 17 bp, Homo sapiens
cctttctcttctctgtt

SEQ ID NO: 2195861 - DNA, 14 bp, Homo sapiens
cctttgctccaccc

SEQ ID NO: 2195862 - DNA, 14 bp, Homo sapiens
cctttgctcttgca

SEQ ID NO: 2195863 - DNA, 20 bp, Homo sapiens
ccttttattaacatatattg

SEQ ID NO: 2195864 - DNA, 14 bp, Homo sapiens
ccttttatttataa

SEQ ID NO: 2195865 - DNA, 15 bp, Homo sapiens
cctttttcacgttta

SEQ ID NO: 2195866 - DNA, 18 bp, Homo sapiens
cgaacccacactgcaaca

SEQ ID NO: 2195867 - DNA, 12 bp, Homo sapiens
cgaactgtgcag

SEQ ID NO: 2195868 - DNA, 16 bp, Homo sapiens
cgaagtcttccatcag

SEQ ID NO: 2195869 - DNA, 14 bp, Homo sapiens
cgaattttaaaaca

SEQ ID NO: 2195870 - DNA, 17 bp, Homo sapiens
cgactctcctgcctcag

SEQ ID NO: 2195871 - DNA, 24 bp, Homo sapiens
cgagaaaacttcgtaagaacatgt

SEQ ID NO: 2195872 - DNA, 17 bp, Homo sapiens
cgagaaagaggcaccag

SEQ ID NO: 2195873 - DNA, 16 bp, Homo sapiens
cgagccctacttccag

SEQ ID NO: 2195874 - DNA, 16 bp, Homo sapiens
cgaggcaggggctggg

SEQ ID NO: 2195875 - DNA, 19 bp, Homo sapiens
cgaggcaggggctgggcag

SEQ ID NO: 2195876 - DNA, 20 bp, Homo sapiens
cgaggcaggggctgggcaga

SEQ ID NO: 2195877 - DNA, 17 bp, Homo sapiens
cgagggatgtggagcac

SEQ ID NO: 2195878 - DNA, 12 bp, Homo sapiens
cgaggggcaggg

SEQ ID NO: 2195879 - DNA, 17 bp, Homo sapiens
cgagtggatagatgccc

SEQ ID NO: 2195880 - DNA, 20 bp, Homo sapiens
cgatcatggctcactgcagc

SEQ ID NO: 2195881 - DNA, 21 bp, Homo sapiens
cgatgttaaaacaaattaaaa

SEQ ID NO: 2195882 - DNA, 19 bp, Homo sapiens
cgatttcagcacatgcact

SEQ ID NO: 2195883 - DNA, 18 bp, Homo sapiens
cgcaaacctctccttcct

SEQ ID NO: 2195884 - DNA, 17 bp, Homo sapiens
cgcactagcctccctct

SEQ ID NO: 2195885 - DNA, 18 bp, Homo sapiens
cgcactagcctccctctc

SEQ ID NO: 2195886 - DNA, 14 bp, Homo sapiens
cgcaggctgagtgc

SEQ ID NO: 2195887 - DNA, 20 bp, Homo sapiens
cgcaggggcgctggctgcac

SEQ ID NO: 2195888 - DNA, 15 bp, Homo sapiens
cgcagtgcccagtga

SEQ ID NO: 2195889 - DNA, 20 bp, Homo sapiens
cgcagtgcccagtgatggca

SEQ ID NO: 2195890 - DNA, 16 bp, Homo sapiens
cgcagtggactgtgtc

SEQ ID NO: 2195891 - DNA, 17 bp, Homo sapiens
cgccacccttgcccact

SEQ ID NO: 2195892 - DNA, 18 bp, Homo sapiens
cgccaggaccgccaaaga

SEQ ID NO: 2195893 - DNA, 20 bp, Homo sapiens
cgccaggaccgccaaagaat

SEQ ID NO: 2195894 - DNA, 15 bp, Homo sapiens
cgcccacctgcatca

SEQ ID NO: 2195895 - DNA, 16 bp, Homo sapiens
cgcccacctgcatcag

SEQ ID NO: 2195896 - DNA, 18 bp, Homo sapiens
cgcccacctgcatcagcc

SEQ ID NO: 2195897 - DNA, 22 bp, Homo sapiens
cgcccccctacccccttgtctg

SEQ ID NO: 2195898 - DNA, 11 bp, Homo sapiens
cgccctctgcc

SEQ ID NO: 2195899 - DNA, 15 bp, Homo sapiens
cgccctctgccccca

SEQ ID NO: 2195900 - DNA, 15 bp, Homo sapiens
cgccctgatttgctg

SEQ ID NO: 2195901 - DNA, 20 bp, Homo sapiens
cgcctccctcccctgccctc

SEQ ID NO: 2195902 - DNA, 17 bp, Homo sapiens
cgcctgtgcccttgctg

SEQ ID NO: 2195903 - DNA, 20 bp, Homo sapiens
cgcctgtgcccttgctgggt

SEQ ID NO: 2195904 - DNA, 13 bp, Homo sapiens
cgccttggcctcc

SEQ ID NO: 2195905 - DNA, 14 bp, Homo sapiens
cgcggttcaggtca

SEQ ID NO: 2195906 - DNA, 17 bp, Homo sapiens
cgcgtggtcacaggacg

SEQ ID NO: 2195907 - DNA, 17 bp, Homo sapiens
cgctgccatttccctga

SEQ ID NO: 2195908 - DNA, 18 bp, Homo sapiens
cgctgccatttccctgaa

SEQ ID NO: 2195909 - DNA, 12 bp, Homo sapiens
cgctgggagagc

SEQ ID NO: 2195910 - DNA, 13 bp, Homo sapiens
cgctgggagagcc

SEQ ID NO: 2195911 - DNA, 14 bp, Homo sapiens
cgctttcctgagcc

SEQ ID NO: 2195912 - DNA, 15 bp, Homo sapiens
cgctttctcctgtgc

SEQ ID NO: 2195913 - DNA, 15 bp, Homo sapiens
cggaagtggtgggga

SEQ ID NO: 2195914 - DNA, 17 bp, Homo sapiens
cggaagtggtggggact

SEQ ID NO: 2195915 - DNA, 15 bp, Homo sapiens
cggagaacatctgcc

SEQ ID NO: 2195916 - DNA, 12 bp, Homo sapiens
cggaggaggtgg

SEQ ID NO: 2195917 - DNA, 21 bp, Homo sapiens
cggaggcaaaaggcagtgggg

SEQ ID NO: 2195918 - DNA, 17 bp, Homo sapiens
cggaggggatccagcca

SEQ ID NO: 2195919 - DNA, 13 bp, Homo sapiens
cggaggtggcagc

SEQ ID NO: 2195920 - DNA, 16 bp, Homo sapiens
cggagtctcagtctgt

SEQ ID NO: 2195921 - DNA, 15 bp, Homo sapiens
cggatctgttgcaaa

SEQ ID NO: 2195922 - DNA, 20 bp, Homo sapiens
cggattccggccctggctgg

SEQ ID NO: 2195923 - DNA, 20 bp, Homo sapiens
cggcagcctcaacctccctg

SEQ ID NO: 2195924 - DNA, 23 bp, Homo sapiens
cggcattggttccctttgctcca

SEQ ID NO: 2195925 - DNA, 20 bp, Homo sapiens
cggccaaggtgccaccaccc

SEQ ID NO: 2195926 - DNA, 19 bp, Homo sapiens
cggcccgccgtgcctgcat

SEQ ID NO: 2195927 - DNA, 12 bp, Homo sapiens
cggccctggctg

SEQ ID NO: 2195928 - DNA, 14 bp, Homo sapiens
cggcgactcggccc

SEQ ID NO: 2195929 - DNA, 21 bp, Homo sapiens
cggctaccccccgtctcctgc

SEQ ID NO: 2195930 - DNA, 21 bp, Homo sapiens
cggctcgtgtatttattaccg

SEQ ID NO: 2195931 - DNA, 23 bp, Homo sapiens
cggctggacttttgcagcttcct

SEQ ID NO: 2195932 - DNA, 16 bp, Homo sapiens
cgggaccaccctgagc

SEQ ID NO: 2195933 - DNA, 17 bp, Homo sapiens
cgggaccaccctgagcc

SEQ ID NO: 2195934 - DNA, 13 bp, Homo sapiens
cgggagtggccat

SEQ ID NO: 2195935 - DNA, 14 bp, Homo sapiens
cgggagtggccatc

SEQ ID NO: 2195936 - DNA, 19 bp, Homo sapiens
ctatcctggctttgcccaa

SEQ ID NO: 2195937 - DNA, 14 bp, Homo sapiens
ctatgaccaaaact

SEQ ID NO: 2195938 - DNA, 17 bp, Homo sapiens
ctatgcacctataaata

SEQ ID NO: 2195939 - DNA, 18 bp, Homo sapiens
ctatgcacctataaatac

SEQ ID NO: 2195940 - DNA, 13 bp, Homo sapiens
ctatgccacctgc

SEQ ID NO: 2195941 - DNA, 15 bp, Homo sapiens
ctatgccacctgcag

SEQ ID NO: 2195942 - DNA, 20 bp, Homo sapiens
ctatgccacctgcagcgtct

SEQ ID NO: 2195943 - DNA, 21 bp, Homo sapiens
ctatgctattaaaaaaaaaga

SEQ ID NO: 2195944 - DNA, 22 bp, Homo sapiens
ctatgggtatcaaacagctcag

SEQ ID NO: 2195945 - DNA, 14 bp, Homo sapiens
ctatgggtgttaac

SEQ ID NO: 2195946 - DNA, 18 bp, Homo sapiens
ctatgttgcccaggctgg

SEQ ID NO: 2195947 - DNA, 20 bp, Homo sapiens
ctatgttgcccaggctggtc

SEQ ID NO: 2195948 - DNA, 13 bp, Homo sapiens
ctattaaaagttg

SEQ ID NO: 2195949 - DNA, 23 bp, Homo sapiens
ctattccattgaccttaatttct

SEQ ID NO: 2195950 - DNA, 16 bp, Homo sapiens
ctatttattagccaac

SEQ ID NO: 2195951 - DNA, 17 bp, Homo sapiens
ctatttctcccttcaat

SEQ ID NO: 2195952 - DNA, 17 bp, Homo sapiens
ctcaaaccctgtttacg

SEQ ID NO: 2195953 - DNA, 18 bp, Homo sapiens
ctcaaagcaagctcttct

SEQ ID NO: 2195954 - DNA, 19 bp, Homo sapiens
ctcaaagcaagctcttctc

SEQ ID NO: 2195955 - DNA, 12 bp, Homo sapiens
ctcaaaggactg

SEQ ID NO: 2195956 - DNA, 16 bp, Homo sapiens
ctcaaaggactgacct

SEQ ID NO: 2195957 - DNA, 17 bp, Homo sapiens
ctcaaagttaacctacc

SEQ ID NO: 2195958 - DNA, 20 bp, Homo sapiens
ctcaaagtttttacagtgta

SEQ ID NO: 2195959 - DNA, 13 bp, Homo sapiens
ctcaaccctctca

SEQ ID NO: 2195960 - DNA, 17 bp, Homo sapiens
ctcaacctccctggctc

SEQ ID NO: 2195961 - DNA, 21 bp, Homo sapiens
ctcaagaccctcgagattaac

SEQ ID NO: 2195962 - DNA, 17 bp, Homo sapiens
ctcaagcaatcctcctg

SEQ ID NO: 2195963 - DNA, 12 bp, Homo sapiens
ctcaaggattca

SEQ ID NO: 2195964 - DNA, 20 bp, Homo sapiens
ctcaaggggccatcctgtcc

SEQ ID NO: 2195965 - DNA, 23 bp, Homo sapiens
ctcaaggggccatcctgtcccac

SEQ ID NO: 2195966 - DNA, 15 bp, Homo sapiens
ctcaataagccttgt

SEQ ID NO: 2195967 - DNA, 14 bp, Homo sapiens
ctcaatccatgttc

SEQ ID NO: 2195968 - DNA, 15 bp, Homo sapiens
ctcaatccatgttct

SEQ ID NO: 2195969 - DNA, 15 bp, Homo sapiens
ctcaatttctcccca

SEQ ID NO: 2195970 - DNA, 22 bp, Homo sapiens
ctcacatgctggacaggtctgg

SEQ ID NO: 2195971 - DNA, 23 bp, Homo sapiens
ctcaccctgcttggggcctggcg

SEQ ID NO: 2195972 - DNA, 17 bp, Homo sapiens
ctcacctaactcatact

SEQ ID NO: 2195973 - DNA, 16 bp, Homo sapiens
ctcacggcagcctcaa

SEQ ID NO: 2195974 - DNA, 15 bp, Homo sapiens
ctcactatggtgcca

SEQ ID NO: 2195975 - DNA, 21 bp, Homo sapiens
ctcactccaggaaggggctgg

SEQ ID NO: 2195976 - DNA, 20 bp, Homo sapiens
ctcactcccctcctttccca

SEQ ID NO: 2195977 - DNA, 22 bp, Homo sapiens
ctcactcccctcctttcccaac

SEQ ID NO: 2195978 - DNA, 15 bp, Homo sapiens
ctcactgcagcctcg

SEQ ID NO: 2195979 - DNA, 17 bp, Homo sapiens
ctcagactcatacagaa

SEQ ID NO: 2195980 - DNA, 18 bp, Homo sapiens
ctcagagctacttgggcc

SEQ ID NO: 2195981 - DNA, 14 bp, Homo sapiens
ctcagccctgagct

SEQ ID NO: 2195982 - DNA, 17 bp, Homo sapiens
ctcagccctgagttggc

SEQ ID NO: 2195983 - DNA, 20 bp, Homo sapiens
ctcagcctcaataagccttg

SEQ ID NO: 2195984 - DNA, 18 bp, Homo sapiens
ctcagcctccagagtagc

SEQ ID NO: 2195985 - DNA, 13 bp, Homo sapiens
ctcagctcactgc

SEQ ID NO: 2195986 - DNA, 14 bp, Homo sapiens
ctcagctcactgca

SEQ ID NO: 2195987 - DNA, 12 bp, Homo sapiens
ctcagctggccg

SEQ ID NO: 2195988 - DNA, 18 bp, Homo sapiens
ctcagctggcggaacctg

SEQ ID NO: 2195989 - DNA, 20 bp, Homo sapiens
ctcagcttggggcagccatt

SEQ ID NO: 2195990 - DNA, 19 bp, Homo sapiens
ctcaggaattcagtgcctt

SEQ ID NO: 2195991 - DNA, 12 bp, Homo sapiens
ctcaggaggagg

SEQ ID NO: 2195992 - DNA, 11 bp, Homo sapiens
ctcaggctctg

SEQ ID NO: 2195993 - DNA, 12 bp, Homo sapiens
ctcaggctctgc

SEQ ID NO: 2195994 - DNA, 14 bp, Homo sapiens
ctcaggctctgcac

SEQ ID NO: 2195995 - DNA, 14 bp, Homo sapiens
ctcagtctcccttt

SEQ ID NO: 2195996 - DNA, 22 bp, Homo sapiens
ctcagtcttccctagggctggg

SEQ ID NO: 2195997 - DNA, 14 bp, Homo sapiens
ctcagtgtgaagcc

SEQ ID NO: 2195998 - DNA, 15 bp, Homo sapiens
ctcagtgtgaagcct

SEQ ID NO: 2195999 - DNA, 13 bp, Homo sapiens
ctcagttattcag

SEQ ID NO: 2196000 - DNA, 18 bp, Homo sapiens
ctcatcactaaacagaga

SEQ ID NO: 2196001 - DNA, 15 bp, Homo sapiens
ctcatcactcccctc

SEQ ID NO: 2196002 - DNA, 23 bp, Homo sapiens
ctcatccattaatgtagataaag

SEQ ID NO: 2196003 - DNA, 18 bp, Homo sapiens
ctcatcttagttctgtat

SEQ ID NO: 2196004 - DNA, 15 bp, Homo sapiens
ctcatgggcccctct

SEQ ID NO: 2196005 - DNA, 17 bp, Homo sapiens
ctcatgggcccctctga

SEQ ID NO: 2196006 - DNA, 15 bp, Homo sapiens
ctcatgttctcatgt

SEQ ID NO: 2196007 - DNA, 23 bp, Homo sapiens
ctcattctctttctttttctgtc

SEQ ID NO: 2196008 - DNA, 22 bp, Homo sapiens
ctcattgaaatgtaatttcagt

SEQ ID NO: 2196009 - DNA, 23 bp, Homo sapiens
ctcattgaaatgtaatttcagtt

SEQ ID NO: 2196010 - DNA, 15 bp, Homo sapiens
ctcattttgtatgta

SEQ ID NO: 2196011 - DNA, 12 bp, Homo sapiens
ctccaccccact

SEQ ID NO: 2196012 - DNA, 15 bp, Homo sapiens
ctccaccccactcac

SEQ ID NO: 2196013 - DNA, 22 bp, Homo sapiens
ctccacggtggtccccaaaaca

SEQ ID NO: 2196014 - DNA, 12 bp, Homo sapiens
ctccactgccct

SEQ ID NO: 2196015 - DNA, 20 bp, Homo sapiens
ctccaggaaggggctggact

SEQ ID NO: 2196016 - DNA, 16 bp, Homo sapiens
ctccaggggcctgcag

SEQ ID NO: 2196017 - DNA, 18 bp, Homo sapiens
ctccaggggcctgcagaa

SEQ ID NO: 2196018 - DNA, 21 bp, Homo sapiens
ctccaggggcctgcagaagga

SEQ ID NO: 2196019 - DNA, 17 bp, Homo sapiens
ctccagtcctgctctct

SEQ ID NO: 2196020 - DNA, 22 bp, Homo sapiens
ctccagtcctgctctctaccca

SEQ ID NO: 2196021 - DNA, 23 bp, Homo sapiens
ctccatggcccatcactcggctg

SEQ ID NO: 2196022 - DNA, 24 bp, Homo sapiens
ctccatggcccatcactcggctgt

SEQ ID NO: 2196023 - DNA, 22 bp, Homo sapiens
ctcttacccttctgtgcccagc

SEQ ID NO: 2196024 - DNA, 23 bp, Homo sapiens
ctcttacccttctgtgcccagct

SEQ ID NO: 2196025 - DNA, 16 bp, Homo sapiens
ctcttagcttacagga

SEQ ID NO: 2196026 - DNA, 17 bp, Homo sapiens
ctcttagtcctccctgc

SEQ ID NO: 2196027 - DNA, 15 bp, Homo sapiens
ctcttcaatctctgg

SEQ ID NO: 2196028 - DNA, 16 bp, Homo sapiens
ctcttcaatctctgga

SEQ ID NO: 2196029 - DNA, 17 bp, Homo sapiens
ctcttcatttattttga

SEQ ID NO: 2196030 - DNA, 20 bp, Homo sapiens
ctcttcctggaatgcattca

SEQ ID NO: 2196031 - DNA, 13 bp, Homo sapiens
ctcttctcccccc

SEQ ID NO: 2196032 - DNA, 15 bp, Homo sapiens
ctcttctcctcagct

SEQ ID NO: 2196033 - DNA, 22 bp, Homo sapiens
ctcttctgtattttttttttcc

SEQ ID NO: 2196034 - DNA, 19 bp, Homo sapiens
ctcttgaccaggctgcctc

SEQ ID NO: 2196035 - DNA, 23 bp, Homo sapiens
ctcttgcacacacggttttggca

SEQ ID NO: 2196036 - DNA, 20 bp, Homo sapiens
ctcttgggagacgtccaccc

SEQ ID NO: 2196037 - DNA, 13 bp, Homo sapiens
ctctttatatatg

SEQ ID NO: 2196038 - DNA, 13 bp, Homo sapiens
ctctttgtgaaat

SEQ ID NO: 2196039 - DNA, 16 bp, Homo sapiens
ctcttttcctagtttt

SEQ ID NO: 2196040 - DNA, 22 bp, Homo sapiens
ctctttttttaaaaagttgata

SEQ ID NO: 2196041 - DNA, 20 bp, Homo sapiens
ctgaaacttcaagcaccagg

SEQ ID NO: 2196042 - DNA, 23 bp, Homo sapiens
ctgaactgcacaatgcattgaac

SEQ ID NO: 2196043 - DNA, 13 bp, Homo sapiens
ctgaacttcagct

SEQ ID NO: 2196044 - DNA, 15 bp, Homo sapiens
ctgaacttttcagga

SEQ ID NO: 2196045 - DNA, 20 bp, Homo sapiens
ctgaagacaaaccactgtac

SEQ ID NO: 2196046 - DNA, 22 bp, Homo sapiens
ctgaagacaaaccactgtacat

SEQ ID NO: 2196047 - DNA, 14 bp, Homo sapiens
ctgaagcaacactg

SEQ ID NO: 2196048 - DNA, 22 bp, Homo sapiens
ctgaagccatgtagccacccaa

SEQ ID NO: 2196049 - DNA, 12 bp, Homo sapiens
ctgaagccgcca

SEQ ID NO: 2196050 - DNA, 17 bp, Homo sapiens
ctgaaggcagtggcagg

SEQ ID NO: 2196051 - DNA, 20 bp, Homo sapiens
ctgaagtctcaagaactgcc

SEQ ID NO: 2196052 - DNA, 18 bp, Homo sapiens
ctgaagtgaatacatggt

SEQ ID NO: 2196053 - DNA, 21 bp, Homo sapiens
ctgaatgcctcgctcccttca

SEQ ID NO: 2196054 - DNA, 23 bp, Homo sapiens
ctgaatgcctcgctcccttcaag

SEQ ID NO: 2196055 - DNA, 15 bp, Homo sapiens
ctgaattctgaactt

SEQ ID NO: 2196056 - DNA, 19 bp, Homo sapiens
ctgacaaagtcatgaagct

SEQ ID NO: 2196057 - DNA, 16 bp, Homo sapiens
ctgaccagctgctccg

SEQ ID NO: 2196058 - DNA, 19 bp, Homo sapiens
ctgaccagctgctccgagg

SEQ ID NO: 2196059 - DNA, 16 bp, Homo sapiens
ctgacgaggctgggcc

SEQ ID NO: 2196060 - DNA, 18 bp, Homo sapiens
ctgactcccaaagagctg

SEQ ID NO: 2196061 - DNA, 19 bp, Homo sapiens
ctgactcccaaagagctgc

SEQ ID NO: 2196062 - DNA, 20 bp, Homo sapiens
ctgactcccaaagagctgcc

SEQ ID NO: 2196063 - DNA, 16 bp, Homo sapiens
ctgactgccaagccag

SEQ ID NO: 2196064 - DNA, 22 bp, Homo sapiens
ctgagaaaacgaaactgctcta

SEQ ID NO: 2196065 - DNA, 23 bp, Homo sapiens
ctgagaaggggaggacctctggg

SEQ ID NO: 2196066 - DNA, 22 bp, Homo sapiens
ctgagactacaggtgagtgcca

SEQ ID NO: 2196067 - DNA, 15 bp, Homo sapiens
ctgagattacaggtg

SEQ ID NO: 2196068 - DNA, 13 bp, Homo sapiens
ctgagccactgga

SEQ ID NO: 2196069 - DNA, 12 bp, Homo sapiens
ccctgaccctgc

SEQ ID NO: 2196070 - DNA, 15 bp, Homo sapiens
ccctgaccctgcaga

SEQ ID NO: 2196071 - DNA, 17 bp, Homo sapiens
ccctgagctagtgtcac

SEQ ID NO: 2196072 - DNA, 16 bp, Homo sapiens
ccctgagctggcctca

SEQ ID NO: 2196073 - DNA, 20 bp, Homo sapiens
ccctgcagagatgcggtggc

SEQ ID NO: 2196074 - DNA, 21 bp, Homo sapiens
ccctgccaagaactctgggca

SEQ ID NO: 2196075 - DNA, 23 bp, Homo sapiens
ccctgccccctccccttcacacc

SEQ ID NO: 2196076 - DNA, 13 bp, Homo sapiens
ccctgcctctgtt

SEQ ID NO: 2196077 - DNA, 12 bp, Homo sapiens
ccctgctcagct

SEQ ID NO: 2196078 - DNA, 15 bp, Homo sapiens
ccctgctcagctggc

SEQ ID NO: 2196079 - DNA, 19 bp, Homo sapiens
ccctgcttggggcctggcg

SEQ ID NO: 2196080 - DNA, 22 bp, Homo sapiens
ccctggaatcgaggctgtgtgt

SEQ ID NO: 2196081 - DNA, 18 bp, Homo sapiens
ccctggagtcatgccaag

SEQ ID NO: 2196082 - DNA, 14 bp, Homo sapiens
ccctggccatctct

SEQ ID NO: 2196083 - DNA, 20 bp, Homo sapiens
ccctggctggtaagggccaa

SEQ ID NO: 2196084 - DNA, 22 bp, Homo sapiens
ccctggctggtaagggccaagt

SEQ ID NO: 2196085 - DNA, 12 bp, Homo sapiens
ccctgttctgga

SEQ ID NO: 2196086 - DNA, 14 bp, Homo sapiens
cccttccaggccat

SEQ ID NO: 2196087 - DNA, 18 bp, Homo sapiens
cccttcctgtctggccca

SEQ ID NO: 2196088 - DNA, 22 bp, Homo sapiens
cccttcttttgaccccttcctg

SEQ ID NO: 2196089 - DNA, 13 bp, Homo sapiens
cccttgccaaggc

SEQ ID NO: 2196090 - DNA, 17 bp, Homo sapiens
cccttgctgggtccagg

SEQ ID NO: 2196091 - DNA, 19 bp, Homo sapiens
cccttgctgggtccagggt

SEQ ID NO: 2196092 - DNA, 21 bp, Homo sapiens
cccttggaggagagagacccc

SEQ ID NO: 2196093 - DNA, 21 bp, Homo sapiens
cccttggtgccacagagggct

SEQ ID NO: 2196094 - DNA, 12 bp, Homo sapiens
cccttgtgcatt

SEQ ID NO: 2196095 - DNA, 19 bp, Homo sapiens
cccttgttctaatgctgca

SEQ ID NO: 2196096 - DNA, 13 bp, Homo sapiens
cccttttctggct

SEQ ID NO: 2196097 - DNA, 21 bp, Homo sapiens
cccttttgtgggtttctctgt

SEQ ID NO: 2196098 - DNA, 22 bp, Homo sapiens
cccttttgtgggtttctctgtg

SEQ ID NO: 2196099 - DNA, 15 bp, Homo sapiens
ccgacctcagagagt

SEQ ID NO: 2196100 - DNA, 14 bp, Homo sapiens
ccgagccccctgtc

SEQ ID NO: 2196101 - DNA, 15 bp, Homo sapiens
ccgagccccctgtcc

SEQ ID NO: 2196102 - DNA, 17 bp, Homo sapiens
ccgagccccctgtcctt

SEQ ID NO: 2196103 - DNA, 21 bp, Homo sapiens
ccgaggcaggggctgggcaga

SEQ ID NO: 2196104 - DNA, 22 bp, Homo sapiens
ccgaggcaggggctgggcagag

SEQ ID NO: 2196105 - DNA, 22 bp, Homo sapiens
ccgagtggatagatgccctgct

SEQ ID NO: 2196106 - DNA, 22 bp, Homo sapiens
ccgcagagactggggcctggac

SEQ ID NO: 2196107 - DNA, 20 bp, Homo sapiens
ccgcatgcagcagcttgctg

SEQ ID NO: 2196108 - DNA, 14 bp, Homo sapiens
ccgcattggtggct

SEQ ID NO: 2196109 - DNA, 11 bp, Homo sapiens
ccgcctgtcct

SEQ ID NO: 2196110 - DNA, 12 bp, Homo sapiens
ccgcctgtcctt

SEQ ID NO: 2196111 - DNA, 22 bp, Homo sapiens
ccgcctgtgcccttgctgggtc

SEQ ID NO: 2196112 - DNA, 13 bp, Homo sapiens
ccgccttggcctc

SEQ ID NO: 2196113 - DNA, 12 bp, Homo sapiens
ccgctggctggg

SEQ ID NO: 2196114 - DNA, 22 bp, Homo sapiens
ccgctggctgggggcctcactc

SEQ ID NO: 2196115 - DNA, 13 bp, Homo sapiens
ccgctgggagagc

SEQ ID NO: 2196116 - DNA, 15 bp, Homo sapiens
ccggaagctcctggt

SEQ ID NO: 2196117 - DNA, 22 bp, Homo sapiens
ccggagaacatctgccttgctg

SEQ ID NO: 2196118 - DNA, 18 bp, Homo sapiens
ccggattccggccctggc

SEQ ID NO: 2196119 - DNA, 15 bp, Homo sapiens
ccggcagcgggcgga

SEQ ID NO: 2196120 - DNA, 20 bp, Homo sapiens
ccggcagcgggcggagggga

SEQ ID NO: 2196121 - DNA, 19 bp, Homo sapiens
ccggcccccgccctctgcc

SEQ ID NO: 2196122 - DNA, 13 bp, Homo sapiens
ccggccctggctg

SEQ ID NO: 2196123 - DNA, 17 bp, Homo sapiens
ccggccctggctgggga

SEQ ID NO: 2196124 - DNA, 22 bp, Homo sapiens
ccggctcgtgtatttattaccg

SEQ ID NO: 2196125 - DNA, 15 bp, Homo sapiens
ccggctggacttttg

SEQ ID NO: 2196126 - DNA, 17 bp, Homo sapiens
ccgggcacagctgtggt

SEQ ID NO: 2196127 - DNA, 16 bp, Homo sapiens
ccgggctctcctgccc

SEQ ID NO: 2196128 - DNA, 23 bp, Homo sapiens
ccgggctctcctgccctgccctc

SEQ ID NO: 2196129 - DNA, 12 bp, Homo sapiens
ccgggctggaga

SEQ ID NO: 2196130 - DNA, 17 bp, Homo sapiens
ccgggctggagaaagag

SEQ ID NO: 2196131 - DNA, 14 bp, Homo sapiens
ccggggctcagccc

SEQ ID NO: 2196132 - DNA, 19 bp, Homo sapiens
ccgggggtgggggcctgct

SEQ ID NO: 2196133 - DNA, 20 bp, Homo sapiens
ccgggggtgggggcctgctg

SEQ ID NO: 2196134 - DNA, 17 bp, Homo sapiens
ccgggttggaggcctca

SEQ ID NO: 2196135 - DNA, 15 bp, Homo sapiens
ccggttgcttctggg

SEQ ID NO: 2196136 - DNA, 17 bp, Homo sapiens
ccggttgcttctgggaa

SEQ ID NO: 2196137 - DNA, 23 bp, Homo sapiens
ccgtaaagtgagcatgctttctg

SEQ ID NO: 2196138 - DNA, 12 bp, Homo sapiens
ccgtatttattt

SEQ ID NO: 2196139 - DNA, 18 bp, Homo sapiens
ccgtctgctcctccctcc

SEQ ID NO: 2196140 - DNA, 17 bp, Homo sapiens
ccgtcttcaatctctgt

SEQ ID NO: 2196141 - DNA, 13 bp, Homo sapiens
ccgttaatttaaa

SEQ ID NO: 2196142 - DNA, 12 bp, Homo sapiens
ccgttcctggga

SEQ ID NO: 2196143 - DNA, 13 bp, Homo sapiens
ccgttcctgggac

SEQ ID NO: 2196144 - DNA, 14 bp, Homo sapiens
ccgtttccaagcct

SEQ ID NO: 2196145 - DNA, 19 bp, Homo sapiens
cctaaaagttttaacctca

SEQ ID NO: 2196146 - DNA, 15 bp, Homo sapiens
cctaactcatactgt

SEQ ID NO: 2196147 - DNA, 18 bp, Homo sapiens
cctaactctgcccaccct

SEQ ID NO: 2196148 - DNA, 23 bp, Homo sapiens
cctaagggctaaggcctcttgct

SEQ ID NO: 2196149 - DNA, 16 bp, Homo sapiens
cctaagtccctgcccc

SEQ ID NO: 2196150 - DNA, 19 bp, Homo sapiens
cctaatagccttttgtaac

SEQ ID NO: 2196151 - DNA, 18 bp, Homo sapiens
cctacagggggtggagag

SEQ ID NO: 2196152 - DNA, 13 bp, Homo sapiens
cctacagtacaat

SEQ ID NO: 2196153 - DNA, 18 bp, Homo sapiens
cctaccccaattccttgt

SEQ ID NO: 2196154 - DNA, 14 bp, Homo sapiens
cctacctgtgaatc

SEQ ID NO: 2196155 - DNA, 15 bp, Homo sapiens
cctaccttcaaagct

SEQ ID NO: 2196156 - DNA, 16 bp, Homo sapiens
cctaccttcaaagctg

SEQ ID NO: 2196157 - DNA, 20 bp, Homo sapiens
cctactgaggagcaaagcag

SEQ ID NO: 2196158 - DNA, 12 bp, Homo sapiens
cctactggctgt

SEQ ID NO: 2196159 - DNA, 18 bp, Homo sapiens
cctacttccaagaaaaat

SEQ ID NO: 2196160 - DNA, 17 bp, Homo sapiens
cctacttccaggttctg

SEQ ID NO: 2196161 - DNA, 20 bp, Homo sapiens
cctacttgtaaacttgaaag

SEQ ID NO: 2196162 - DNA, 11 bp, Homo sapiens
cctagctgtgt

SEQ ID NO: 2196163 - DNA, 13 bp, Homo sapiens
cctagctgtgtgc

SEQ ID NO: 2196164 - DNA, 13 bp, Homo sapiens
cctagggctgggt

SEQ ID NO: 2196165 - DNA, 14 bp, Homo sapiens
cctagtcagccaca

SEQ ID NO: 2196166 - DNA, 19 bp, Homo sapiens
cctagtcccttccacaccc

SEQ ID NO: 2196167 - DNA, 14 bp, Homo sapiens
cctagtgcagagag

SEQ ID NO: 2196168 - DNA, 15 bp, Homo sapiens
cctatattggctaaa

SEQ ID NO: 2196169 - DNA, 17 bp, Homo sapiens
cctatatttttcctcaa

SEQ ID NO: 2196170 - DNA, 16 bp, Homo sapiens
cctatgccacctgcag

SEQ ID NO: 2196171 - DNA, 17 bp, Homo sapiens
cctatgccacctgcagc

SEQ ID NO: 2196172 - DNA, 15 bp, Homo sapiens
cctatgttgcccagg

SEQ ID NO: 2196173 - DNA, 18 bp, Homo sapiens
cctatgttgcccaggctg

SEQ ID NO: 2196174 - DNA, 17 bp, Homo sapiens
cctatttattcattcag

SEQ ID NO: 2196175 - DNA, 18 bp, Homo sapiens
cctatttcattgtggcct

SEQ ID NO: 2196176 - DNA, 18 bp, Homo sapiens
cctcaataagccttgtcg

SEQ ID NO: 2196177 - DNA, 15 bp, Homo sapiens
cctcacaagcctctt

SEQ ID NO: 2196178 - DNA, 20 bp, Homo sapiens
cctcacctgggttccccacc

SEQ ID NO: 2196179 - DNA, 15 bp, Homo sapiens
cctcagcctcctgag

SEQ ID NO: 2196180 - DNA, 10 bp, Homo sapiens
cctcaggaat

SEQ ID NO: 2196181 - DNA, 13 bp, Homo sapiens
cctcaggctctgc

SEQ ID NO: 2196182 - DNA, 15 bp, Homo sapiens
cctcagtgtgaagcc

SEQ ID NO: 2196183 - DNA, 16 bp, Homo sapiens
cctcagtgtgaagcct

SEQ ID NO: 2196184 - DNA, 23 bp, Homo sapiens
cctcatcacacgtcacaatgtcc

SEQ ID NO: 2196185 - DNA, 13 bp, Homo sapiens
cctccactgccct

SEQ ID NO: 2196186 - DNA, 14 bp, Homo sapiens
cctccactgccctc

SEQ ID NO: 2196187 - DNA, 19 bp, Homo sapiens
cctccagttctgatgaggc

SEQ ID NO: 2196188 - DNA, 23 bp, Homo sapiens
cctccatgtagaagagggagaag

SEQ ID NO: 2196189 - DNA, 18 bp, Homo sapiens
ctgctggccgggcacagc

SEQ ID NO: 2196190 - DNA, 14 bp, Homo sapiens
ctgctgggtttcca

SEQ ID NO: 2196191 - DNA, 20 bp, Homo sapiens
ctgctgggtttccacacagc

SEQ ID NO: 2196192 - DNA, 23 bp, Homo sapiens
ctgctgggtttccacacagcctg

SEQ ID NO: 2196193 - DNA, 19 bp, Homo sapiens
ctgctggtacctgccctct

SEQ ID NO: 2196194 - DNA, 14 bp, Homo sapiens
ctgctgtcagacct

SEQ ID NO: 2196195 - DNA, 23 bp, Homo sapiens
ctgctgtggcatcaggaaaggaa

SEQ ID NO: 2196196 - DNA, 15 bp, Homo sapiens
ctgcttcagcttgct

SEQ ID NO: 2196197 - DNA, 12 bp, Homo sapiens
ctgcttctgggg

SEQ ID NO: 2196198 - DNA, 13 bp, Homo sapiens
ctgcttgaatcag

SEQ ID NO: 2196199 - DNA, 16 bp, Homo sapiens
ctgcttggggcctggc

SEQ ID NO: 2196200 - DNA, 19 bp, Homo sapiens
ctgcttggggcctggcgtg

SEQ ID NO: 2196201 - DNA, 14 bp, Homo sapiens
ctgctttctccttt

SEQ ID NO: 2196202 - DNA, 14 bp, Homo sapiens
ctggaagcctgctg

SEQ ID NO: 2196203 - DNA, 19 bp, Homo sapiens
ctggaatggggacctgggg

SEQ ID NO: 2196204 - DNA, 20 bp, Homo sapiens
ctggaatggggacctggggt

SEQ ID NO: 2196205 - DNA, 15 bp, Homo sapiens
ctggacagcggttgt

SEQ ID NO: 2196206 - DNA, 19 bp, Homo sapiens
ctggacagcggttgtaaat

SEQ ID NO: 2196207 - DNA, 20 bp, Homo sapiens
ctggacagcggttgtaaata

SEQ ID NO: 2196208 - DNA, 13 bp, Homo sapiens
ctggacaggtctg

SEQ ID NO: 2196209 - DNA, 15 bp, Homo sapiens
ctggacaggtctggg

SEQ ID NO: 2196210 - DNA, 22 bp, Homo sapiens
ctggaccttggccctacagccc

SEQ ID NO: 2196211 - DNA, 19 bp, Homo sapiens
ctggacttttgcagcttcc

SEQ ID NO: 2196212 - DNA, 14 bp, Homo sapiens
ctggagaaagagct

SEQ ID NO: 2196213 - DNA, 16 bp, Homo sapiens
ctggagaaagagctgc

SEQ ID NO: 2196214 - DNA, 19 bp, Homo sapiens
ctggagaaagagctgcctg

SEQ ID NO: 2196215 - DNA, 22 bp, Homo sapiens
ctggagaaagagctgcctggat

SEQ ID NO: 2196216 - DNA, 20 bp, Homo sapiens
ctggagacaatgcagatgcc

SEQ ID NO: 2196217 - DNA, 13 bp, Homo sapiens
ctggagccacctg

SEQ ID NO: 2196218 - DNA, 15 bp, Homo sapiens
ctggagccacctgtc

SEQ ID NO: 2196219 - DNA, 18 bp, Homo sapiens
ctggagccacctgtccca

SEQ ID NO: 2196220 - DNA, 21 bp, Homo sapiens
ctggagccacctgtcccacct

SEQ ID NO: 2196221 - DNA, 15 bp, Homo sapiens
ctggagccactaact

SEQ ID NO: 2196222 - DNA, 18 bp, Homo sapiens
ctggagccactaactaga

SEQ ID NO: 2196223 - DNA, 22 bp, Homo sapiens
ctggagccagccaccctaactg

SEQ ID NO: 2196224 - DNA, 23 bp, Homo sapiens
ctggaggcattcccagaggtggg

SEQ ID NO: 2196225 - DNA, 13 bp, Homo sapiens
ctggaggcctctg

SEQ ID NO: 2196226 - DNA, 16 bp, Homo sapiens
ctggaggcctctgggc

SEQ ID NO: 2196227 - DNA, 18 bp, Homo sapiens
ctggaggcctctgggcct

SEQ ID NO: 2196228 - DNA, 22 bp, Homo sapiens
ctggaggcctctgggcctcctc

SEQ ID NO: 2196229 - DNA, 24 bp, Homo sapiens
ctggaggtctccaggggcctgcag

SEQ ID NO: 2196230 - DNA, 16 bp, Homo sapiens
ctggatgagaaacagc

SEQ ID NO: 2196231 - DNA, 20 bp, Homo sapiens
ctggatgagaaacagctcag

SEQ ID NO: 2196232 - DNA, 21 bp, Homo sapiens
ctggatgagaaacagctcagc

SEQ ID NO: 2196233 - DNA, 21 bp, Homo sapiens
ctggcaccgttatccctgcac

SEQ ID NO: 2196234 - DNA, 16 bp, Homo sapiens
ctggcagtccgtggga

SEQ ID NO: 2196235 - DNA, 19 bp, Homo sapiens
ctggcagtccgtgggacgg

SEQ ID NO: 2196236 - DNA, 16 bp, Homo sapiens
ctggcatctctggagt

SEQ ID NO: 2196237 - DNA, 16 bp, Homo sapiens
ctggccaccacccccc

SEQ ID NO: 2196238 - DNA, 22 bp, Homo sapiens
ctggccatctctgaacttcagc

SEQ ID NO: 2196239 - DNA, 15 bp, Homo sapiens
ctggccctgttgtgg

SEQ ID NO: 2196240 - DNA, 14 bp, Homo sapiens
ctggccgggcacag

SEQ ID NO: 2196241 - DNA, 20 bp, Homo sapiens
ctggccgggcacagctgtgg

SEQ ID NO: 2196242 - DNA, 22 bp, Homo sapiens
ctggccgggttggaggcctcac

SEQ ID NO: 2196243 - DNA, 20 bp, Homo sapiens
ctggccggttaacatctttt

SEQ ID NO: 2196244 - DNA, 21 bp, Homo sapiens
ctggcctcagactcatacaga

SEQ ID NO: 2196245 - DNA, 15 bp, Homo sapiens
ctggcctctgctttc

SEQ ID NO: 2196246 - DNA, 16 bp, Homo sapiens
ctggcggaacctggct

SEQ ID NO: 2196247 - DNA, 14 bp, Homo sapiens
ctggcgtcacctgt

SEQ ID NO: 2196248 - DNA, 11 bp, Homo sapiens
ctggctcctgt

SEQ ID NO: 2196249 - DNA, 11 bp, Homo sapiens
ctggctgcctg

SEQ ID NO: 2196250 - DNA, 13 bp, Homo sapiens
ctggctgcctggc

SEQ ID NO: 2196251 - DNA, 15 bp, Homo sapiens
ctggctggggacttg

SEQ ID NO: 2196252 - DNA, 14 bp, Homo sapiens
ctgtatcatttctt

SEQ ID NO: 2196253 - DNA, 24 bp, Homo sapiens
ctgtatgtacttccagtatcctga

SEQ ID NO: 2196254 - DNA, 19 bp, Homo sapiens
ctgtatttagtaaaaataa

SEQ ID NO: 2196255 - DNA, 16 bp, Homo sapiens
ctgtcaagcttcatta

SEQ ID NO: 2196256 - DNA, 21 bp, Homo sapiens
ctgtcaatggactgcaccttg

SEQ ID NO: 2196257 - DNA, 17 bp, Homo sapiens
ctgtcagaataaagaac

SEQ ID NO: 2196258 - DNA, 19 bp, Homo sapiens
ctgtcagaataaagaacat

SEQ ID NO: 2196259 - DNA, 21 bp, Homo sapiens
ctgtcagataatcggtgcagc

SEQ ID NO: 2196260 - DNA, 21 bp, Homo sapiens
ctgtcatggctctgaactgca

SEQ ID NO: 2196261 - DNA, 19 bp, Homo sapiens
ctgtcccaccatgcagtgc

SEQ ID NO: 2196262 - DNA, 14 bp, Homo sapiens
ctgtccctgcaggg

SEQ ID NO: 2196263 - DNA, 16 bp, Homo sapiens
ctgtccctggccatct

SEQ ID NO: 2196264 - DNA, 13 bp, Homo sapiens
ctgtcccttggag

SEQ ID NO: 2196265 - DNA, 17 bp, Homo sapiens
ctgtccgccctcttccc

SEQ ID NO: 2196266 - DNA, 22 bp, Homo sapiens
ctgtcctcattcttctctccca

SEQ ID NO: 2196267 - DNA, 11 bp, Homo sapiens
ctgtcctccca

SEQ ID NO: 2196268 - DNA, 17 bp, Homo sapiens
ctgtcctcttctgtgag

SEQ ID NO: 2196269 - DNA, 17 bp, Homo sapiens
ctgtccttcccacggcc

SEQ ID NO: 2196270 - DNA, 21 bp, Homo sapiens
ctgtctaggtcagtacccacc

SEQ ID NO: 2196271 - DNA, 23 bp, Homo sapiens
ctgtctaggtcagtacccacctg

SEQ ID NO: 2196272 - DNA, 20 bp, Homo sapiens
ctgtctccctataatgctgg

SEQ ID NO: 2196273 - DNA, 18 bp, Homo sapiens
ctgtctgcgccgctgtgc

SEQ ID NO: 2196274 - DNA, 15 bp, Homo sapiens
ctgtcttccaggccc

SEQ ID NO: 2196275 - DNA, 18 bp, Homo sapiens
ctgtcttggcctcccaaa

SEQ ID NO: 2196276 - DNA, 16 bp, Homo sapiens
ctgtctttaaaagtca

SEQ ID NO: 2196277 - DNA, 21 bp, Homo sapiens
ctgtgaaaattacacccatgc

SEQ ID NO: 2196278 - DNA, 18 bp, Homo sapiens
ctgtgaaagtctcctgta

SEQ ID NO: 2196279 - DNA, 13 bp, Homo sapiens
ctgtgacaaaatg

SEQ ID NO: 2196280 - DNA, 15 bp, Homo sapiens
ctgtgacctaagaac

SEQ ID NO: 2196281 - DNA, 16 bp, Homo sapiens
ctgtgacctaagaaca

SEQ ID NO: 2196282 - DNA, 17 bp, Homo sapiens
ctgtgacctaagaacaa

SEQ ID NO: 2196283 - DNA, 22 bp, Homo sapiens
ctgtgactgatgttaggctggg

SEQ ID NO: 2196284 - DNA, 15 bp, Homo sapiens
ctgtgattactcttt

SEQ ID NO: 2196285 - DNA, 20 bp, Homo sapiens
ctgtgattgccatttcttcc

SEQ ID NO: 2196286 - DNA, 21 bp, Homo sapiens
ctgtgatttatttggagtgga

SEQ ID NO: 2196287 - DNA, 22 bp, Homo sapiens
ctgtgatttatttggagtggag

SEQ ID NO: 2196288 - DNA, 23 bp, Homo sapiens
ctgtgatttatttggagtggagg

SEQ ID NO: 2196289 - DNA, 20 bp, Homo sapiens
ctgtgcatcaaccaggaaga

SEQ ID NO: 2196290 - DNA, 16 bp, Homo sapiens
ctgtgccaagggcagg

SEQ ID NO: 2196291 - DNA, 22 bp, Homo sapiens
ctgtgcccagcagtttcccaga

SEQ ID NO: 2196292 - DNA, 13 bp, Homo sapiens
ctgtgcccagctc

SEQ ID NO: 2196293 - DNA, 14 bp, Homo sapiens
ctgtgcccagctca

SEQ ID NO: 2196294 - DNA, 19 bp, Homo sapiens
ctgtgcccagctcagtctt

SEQ ID NO: 2196295 - DNA, 23 bp, Homo sapiens
ctgtgccccatcagcagcttgac

SEQ ID NO: 2196296 - DNA, 14 bp, Homo sapiens
ctgtgcccttgctg

SEQ ID NO: 2196297 - DNA, 16 bp, Homo sapiens
ctgtgcccttgctggg

SEQ ID NO: 2196298 - DNA, 22 bp, Homo sapiens
ctgtgccgcactagcctccctc

SEQ ID NO: 2196299 - DNA, 17 bp, Homo sapiens
ctgtgcctggagctcct

SEQ ID NO: 2196300 - DNA, 17 bp, Homo sapiens
ctgtgcgtcccagctga

SEQ ID NO: 2196301 - DNA, 16 bp, Homo sapiens
ctgtgctggagccact

SEQ ID NO: 2196302 - DNA, 13 bp, Homo sapiens
ctgtgctgttgtc

SEQ ID NO: 2196303 - DNA, 15 bp, Homo sapiens
ctgtggctcttgcct

SEQ ID NO: 2196304 - DNA, 16 bp, Homo sapiens
ctgtgggagaagggac

SEQ ID NO: 2196305 - DNA, 22 bp, Homo sapiens
ctgtgggagaagggacagcggg

SEQ ID NO: 2196306 - DNA, 11 bp, Homo sapiens
ctgtgtcttta

SEQ ID NO: 2196307 - DNA, 22 bp, Homo sapiens
gagacgtccacccgtttccaag

SEQ ID NO: 2196308 - DNA, 14 bp, Homo sapiens
gagactttgcccag

SEQ ID NO: 2196309 - DNA, 13 bp, Homo sapiens
gagagaaagagag

SEQ ID NO: 2196310 - DNA, 17 bp, Homo sapiens
gagagaaagagagaagc

SEQ ID NO: 2196311 - DNA, 14 bp, Homo sapiens
gagagaagccagcc

SEQ ID NO: 2196312 - DNA, 18 bp, Homo sapiens
gagagaagtcggccaggt

SEQ ID NO: 2196313 - DNA, 21 bp, Homo sapiens
gagagagcttcctgtttctaa

SEQ ID NO: 2196314 - DNA, 14 bp, Homo sapiens
gagagagtgtggaa

SEQ ID NO: 2196315 - DNA, 11 bp, Homo sapiens
gagagcctgcc

SEQ ID NO: 2196316 - DNA, 15 bp, Homo sapiens
gagagcttcctgttt

SEQ ID NO: 2196317 - DNA, 19 bp, Homo sapiens
gagaggaagccacgtgctg

SEQ ID NO: 2196318 - DNA, 16 bp, Homo sapiens
gagaggcagagtgccc

SEQ ID NO: 2196319 - DNA, 23 bp, Homo sapiens
gagaggctctgaaagctgcttct

SEQ ID NO: 2196320 - DNA, 16 bp, Homo sapiens
gagagggagcaagcct

SEQ ID NO: 2196321 - DNA, 18 bp, Homo sapiens
gagagggagcaagccttc

SEQ ID NO: 2196322 - DNA, 19 bp, Homo sapiens
gagaggggcctctggctgc

SEQ ID NO: 2196323 - DNA, 21 bp, Homo sapiens
gagagtggcatcatggggaca

SEQ ID NO: 2196324 - DNA, 21 bp, Homo sapiens
gagatcggggtggcagaaatc

SEQ ID NO: 2196325 - DNA, 22 bp, Homo sapiens
gagattaacacactgaaccgct

SEQ ID NO: 2196326 - DNA, 14 bp, Homo sapiens
gagattacaggtgt

SEQ ID NO: 2196327 - DNA, 13 bp, Homo sapiens
gagatttcagtta

SEQ ID NO: 2196328 - DNA, 13 bp, Homo sapiens
gagcaaacctgcc

SEQ ID NO: 2196329 - DNA, 22 bp, Homo sapiens
gagcaagaccctgtcttaaaaa

SEQ ID NO: 2196330 - DNA, 12 bp, Homo sapiens
gagcagagaagg

SEQ ID NO: 2196331 - DNA, 17 bp, Homo sapiens
gagcagagaaggccagg

SEQ ID NO: 2196332 - DNA, 16 bp, Homo sapiens
gagcagccctggagtc

SEQ ID NO: 2196333 - DNA, 20 bp, Homo sapiens
gagcaggttccccaagggcc

SEQ ID NO: 2196334 - DNA, 23 bp, Homo sapiens
gagcaggttccccaagggccctg

SEQ ID NO: 2196335 - DNA, 14 bp, Homo sapiens
gagcagttcaataa

SEQ ID NO: 2196336 - DNA, 17 bp, Homo sapiens
gagcatccacctccttc

SEQ ID NO: 2196337 - DNA, 18 bp, Homo sapiens
gagccactgtgcccagca

SEQ ID NO: 2196338 - DNA, 16 bp, Homo sapiens
gagccagaattcacta

SEQ ID NO: 2196339 - DNA, 14 bp, Homo sapiens
gagccccctgtcct

SEQ ID NO: 2196340 - DNA, 16 bp, Homo sapiens
gagccccctgtccttc

SEQ ID NO: 2196341 - DNA, 18 bp, Homo sapiens
gagccctaaacacacgcg

SEQ ID NO: 2196342 - DNA, 16 bp, Homo sapiens
gagccggccccaggct

SEQ ID NO: 2196343 - DNA, 23 bp, Homo sapiens
gagccggccccaggctcgtggac

SEQ ID NO: 2196344 - DNA, 17 bp, Homo sapiens
gagccggtttgggagag

SEQ ID NO: 2196345 - DNA, 20 bp, Homo sapiens
gagccggtttgggagagacc

SEQ ID NO: 2196346 - DNA, 13 bp, Homo sapiens
gagccgttcctgg

SEQ ID NO: 2196347 - DNA, 20 bp, Homo sapiens
gagcctccctcaattccccc

SEQ ID NO: 2196348 - DNA, 16 bp, Homo sapiens
gagcctgcggctgctg

SEQ ID NO: 2196349 - DNA, 17 bp, Homo sapiens
gagcgctggcctcttcc

SEQ ID NO: 2196350 - DNA, 18 bp, Homo sapiens
gagcggccgcctgtcctt

SEQ ID NO: 2196351 - DNA, 19 bp, Homo sapiens
gagcgggcccgccaccctt

SEQ ID NO: 2196352 - DNA, 23 bp, Homo sapiens
gagctacactcattgaaatgtaa

SEQ ID NO: 2196353 - DNA, 15 bp, Homo sapiens
gagctacagccagcg

SEQ ID NO: 2196354 - DNA, 18 bp, Homo sapiens
gagctagagaggggcctc

SEQ ID NO: 2196355 - DNA, 19 bp, Homo sapiens
gagctagagaggggcctct

SEQ ID NO: 2196356 - DNA, 13 bp, Homo sapiens
gagctcctgggaa

SEQ ID NO: 2196357 - DNA, 20 bp, Homo sapiens
gagctctggagccacctgtc

SEQ ID NO: 2196358 - DNA, 19 bp, Homo sapiens
gagctgcctaagaggcaat

SEQ ID NO: 2196359 - DNA, 11 bp, Homo sapiens
gagctgcctgg

SEQ ID NO: 2196360 - DNA, 13 bp, Homo sapiens
gagcttacctccc

SEQ ID NO: 2196361 - DNA, 16 bp, Homo sapiens
gagcttcctgtttcta

SEQ ID NO: 2196362 - DNA, 14 bp, Homo sapiens
gagcttgctggaga

SEQ ID NO: 2196363 - DNA, 21 bp, Homo sapiens
gagctttggacacacacagct

SEQ ID NO: 2196364 - DNA, 18 bp, Homo sapiens
gagctttggacgcacaca

SEQ ID NO: 2196365 - DNA, 13 bp, Homo sapiens
gaggacctctggg

SEQ ID NO: 2196366 - DNA, 14 bp, Homo sapiens
gaggacctctgggc

SEQ ID NO: 2196367 - DNA, 15 bp, Homo sapiens
gaggacctctgggct

SEQ ID NO: 2196368 - DNA, 12 bp, Homo sapiens
gaggagagagac

SEQ ID NO: 2196369 - DNA, 15 bp, Homo sapiens
gaggagagagacccc

SEQ ID NO: 2196370 - DNA, 21 bp, Homo sapiens
gaggagggcgcatgtgtgtat

SEQ ID NO: 2196371 - DNA, 12 bp, Homo sapiens
gaggattctgtc

SEQ ID NO: 2196372 - DNA, 20 bp, Homo sapiens
gaggattctgtcttccaggc

SEQ ID NO: 2196373 - DNA, 17 bp, Homo sapiens
gaggcaccaggaagccg

SEQ ID NO: 2196374 - DNA, 19 bp, Homo sapiens
gaggcagaaagcagaggct

SEQ ID NO: 2196375 - DNA, 20 bp, Homo sapiens
gaggcagaaagcagaggctg

SEQ ID NO: 2196376 - DNA, 23 bp, Homo sapiens
gaggcagaaagcagaggctggcc

SEQ ID NO: 2196377 - DNA, 22 bp, Homo sapiens
gaggcagaacctggtggctgga

SEQ ID NO: 2196378 - DNA, 22 bp, Homo sapiens
gaggcagagtgccccacctgcc

SEQ ID NO: 2196379 - DNA, 20 bp, Homo sapiens
gaggcaggggctgggcagag

SEQ ID NO: 2196380 - DNA, 16 bp, Homo sapiens
gaggcaggtcccgagc

SEQ ID NO: 2196381 - DNA, 15 bp, Homo sapiens
gaggccacactttct

SEQ ID NO: 2196382 - DNA, 16 bp, Homo sapiens
gaggccacgggggagg

SEQ ID NO: 2196383 - DNA, 15 bp, Homo sapiens
gaggcccagcagagc

SEQ ID NO: 2196384 - DNA, 16 bp, Homo sapiens
gaggcccagcagagcc

SEQ ID NO: 2196385 - DNA, 17 bp, Homo sapiens
gaggcccagcagagccg

SEQ ID NO: 2196386 - DNA, 13 bp, Homo sapiens
gaggccgaggcag

SEQ ID NO: 2196387 - DNA, 14 bp, Homo sapiens
gaggcctcaccctg

SEQ ID NO: 2196388 - DNA, 15 bp, Homo sapiens
gaggcctcaccctgc

SEQ ID NO: 2196389 - DNA, 18 bp, Homo sapiens
gaggcctcaccctgcttg

SEQ ID NO: 2196390 - DNA, 12 bp, Homo sapiens
gaggctcagccc

SEQ ID NO: 2196391 - DNA, 12 bp, Homo sapiens
gaggctcctgga

SEQ ID NO: 2196392 - DNA, 13 bp, Homo sapiens
gaggctcctggag

SEQ ID NO: 2196393 - DNA, 14 bp, Homo sapiens
gaggctcctggagc

SEQ ID NO: 2196394 - DNA, 17 bp, Homo sapiens
gaggctgggccaagcca

SEQ ID NO: 2196395 - DNA, 12 bp, Homo sapiens
gagggagaagga

SEQ ID NO: 2196396 - DNA, 19 bp, Homo sapiens
gagggagaaggagaggctc

SEQ ID NO: 2196397 - DNA, 22 bp, Homo sapiens
gagggagaaggagaggctctga

SEQ ID NO: 2196398 - DNA, 14 bp, Homo sapiens
gagggagcaagcct

SEQ ID NO: 2196399 - DNA, 19 bp, Homo sapiens
gagggagccggtttgggag

SEQ ID NO: 2196400 - DNA, 20 bp, Homo sapiens
gagggagccggtttgggaga

SEQ ID NO: 2196401 - DNA, 18 bp, Homo sapiens
gagggcgcatgtgtgtat

SEQ ID NO: 2196402 - DNA, 14 bp, Homo sapiens
gaggggagaggaag

SEQ ID NO: 2196403 - DNA, 15 bp, Homo sapiens
gaggggagaggaagc

SEQ ID NO: 2196404 - DNA, 17 bp, Homo sapiens
gaggggatccagccact

SEQ ID NO: 2196405 - DNA, 16 bp, Homo sapiens
gaggggcaagctaggc

SEQ ID NO: 2196406 - DNA, 20 bp, Homo sapiens
gaggggcagggaaggacagg

SEQ ID NO: 2196407 - DNA, 22 bp, Homo sapiens
gagggtggcacttcgtggatga

SEQ ID NO: 2196408 - DNA, 19 bp, Homo sapiens
gaggtaccacaggaagccg

SEQ ID NO: 2196409 - DNA, 15 bp, Homo sapiens
gaggtcaccagggga

SEQ ID NO: 2196410 - DNA, 20 bp, Homo sapiens
gaggtcaccaggggaggagc

SEQ ID NO: 2196411 - DNA, 16 bp, Homo sapiens
ggaggcccctggtggc

SEQ ID NO: 2196412 - DNA, 23 bp, Homo sapiens
ggaggcccttttctggctcctgt

SEQ ID NO: 2196413 - DNA, 15 bp, Homo sapiens
ggaggccgaggcagg

SEQ ID NO: 2196414 - DNA, 13 bp, Homo sapiens
ggaggcctctggg

SEQ ID NO: 2196415 - DNA, 12 bp, Homo sapiens
ggagggtcagtg

SEQ ID NO: 2196416 - DNA, 20 bp, Homo sapiens
ggaggttgagaatgcagtga

SEQ ID NO: 2196417 - DNA, 20 bp, Homo sapiens
ggagtagacccctggctggt

SEQ ID NO: 2196418 - DNA, 13 bp, Homo sapiens
ggagtggaggcat

SEQ ID NO: 2196419 - DNA, 17 bp, Homo sapiens
ggagtggaggcattgtt

SEQ ID NO: 2196420 - DNA, 15 bp, Homo sapiens
ggagtgtgtgggggt

SEQ ID NO: 2196421 - DNA, 22 bp, Homo sapiens
ggagttattcactctcccagag

SEQ ID NO: 2196422 - DNA, 18 bp, Homo sapiens
ggagtttttatgagaaac

SEQ ID NO: 2196423 - DNA, 15 bp, Homo sapiens
ggatagatgccctgc

SEQ ID NO: 2196424 - DNA, 13 bp, Homo sapiens
ggatccagccact

SEQ ID NO: 2196425 - DNA, 21 bp, Homo sapiens
ggatccagccacttccccctc

SEQ ID NO: 2196426 - DNA, 23 bp, Homo sapiens
ggatccagccacttccccctctt

SEQ ID NO: 2196427 - DNA, 21 bp, Homo sapiens
ggatccgcatccagccgtgct

SEQ ID NO: 2196428 - DNA, 17 bp, Homo sapiens
ggatctgcccctccctg

SEQ ID NO: 2196429 - DNA, 20 bp, Homo sapiens
ggatgaagacgaagaagcaa

SEQ ID NO: 2196430 - DNA, 13 bp, Homo sapiens
ggatgagaaacag

SEQ ID NO: 2196431 - DNA, 19 bp, Homo sapiens
ggatgagaaacagctcagc

SEQ ID NO: 2196432 - DNA, 21 bp, Homo sapiens
ggatgagaaacagctcagcca

SEQ ID NO: 2196433 - DNA, 22 bp, Homo sapiens
ggatgagaaacagctcagccag

SEQ ID NO: 2196434 - DNA, 19 bp, Homo sapiens
ggatgaggtcaccagggga

SEQ ID NO: 2196435 - DNA, 19 bp, Homo sapiens
ggatgcagtgcctttcccc

SEQ ID NO: 2196436 - DNA, 18 bp, Homo sapiens
ggatgcggatcctgctgg

SEQ ID NO: 2196437 - DNA, 20 bp, Homo sapiens
ggatgcggatcctgctgggg

SEQ ID NO: 2196438 - DNA, 18 bp, Homo sapiens
ggatggggcccaggggct

SEQ ID NO: 2196439 - DNA, 15 bp, Homo sapiens
ggatgtaaccaagct

SEQ ID NO: 2196440 - DNA, 16 bp, Homo sapiens
ggattccggccctggc

SEQ ID NO: 2196441 - DNA, 17 bp, Homo sapiens
ggattccggccctggct

SEQ ID NO: 2196442 - DNA, 18 bp, Homo sapiens
ggattccggccctggctg

SEQ ID NO: 2196443 - DNA, 22 bp, Homo sapiens
ggattccggccctggctgggga

SEQ ID NO: 2196444 - DNA, 22 bp, Homo sapiens
ggattctgaagttttattttaa

SEQ ID NO: 2196445 - DNA, 19 bp, Homo sapiens
ggcaaatgccaggacagct

SEQ ID NO: 2196446 - DNA, 22 bp, Homo sapiens
ggcaaatgccaggacagctgca

SEQ ID NO: 2196447 - DNA, 23 bp, Homo sapiens
ggcaagctaggccccagaggccc

SEQ ID NO: 2196448 - DNA, 14 bp, Homo sapiens
ggcaagctggcagg

SEQ ID NO: 2196449 - DNA, 16 bp, Homo sapiens
ggcaagctggcaggag

SEQ ID NO: 2196450 - DNA, 21 bp, Homo sapiens
ggcaccaaaccctgtcctccc

SEQ ID NO: 2196451 - DNA, 15 bp, Homo sapiens
ggcaccaggaagccg

SEQ ID NO: 2196452 - DNA, 17 bp, Homo sapiens
ggcacccccacaagctg

SEQ ID NO: 2196453 - DNA, 23 bp, Homo sapiens
ggcacccccacaagctgtccctg

SEQ ID NO: 2196454 - DNA, 15 bp, Homo sapiens
ggcaccgttatccct

SEQ ID NO: 2196455 - DNA, 23 bp, Homo sapiens
ggcacttttgaactcacgagcct

SEQ ID NO: 2196456 - DNA, 18 bp, Homo sapiens
ggcagaaagcagaggctg

SEQ ID NO: 2196457 - DNA, 19 bp, Homo sapiens
ggcagaaagcagaggctgg

SEQ ID NO: 2196458 - DNA, 15 bp, Homo sapiens
ggcagaaccctggtg

SEQ ID NO: 2196459 - DNA, 15 bp, Homo sapiens
ggcagaacctggtgg

SEQ ID NO: 2196460 - DNA, 14 bp, Homo sapiens
ggcagaggggagag

SEQ ID NO: 2196461 - DNA, 16 bp, Homo sapiens
ggcagaggggagagga

SEQ ID NO: 2196462 - DNA, 18 bp, Homo sapiens
ggcagaggggagaggaag

SEQ ID NO: 2196463 - DNA, 19 bp, Homo sapiens
ggcagaggggagaggaagc

SEQ ID NO: 2196464 - DNA, 20 bp, Homo sapiens
ggcagaggggagaggaagca

SEQ ID NO: 2196465 - DNA, 14 bp, Homo sapiens
ggcagccatgagaa

SEQ ID NO: 2196466 - DNA, 21 bp, Homo sapiens
ggcagccattggcctctgtct

SEQ ID NO: 2196467 - DNA, 11 bp, Homo sapiens
ggcagcctcaa

SEQ ID NO: 2196468 - DNA, 15 bp, Homo sapiens
ggcagcctcaacctc

SEQ ID NO: 2196469 - DNA, 15 bp, Homo sapiens
ggcagcctgtgggag

SEQ ID NO: 2196470 - DNA, 21 bp, Homo sapiens
ggcagcctgtgggagaaggga

SEQ ID NO: 2196471 - DNA, 19 bp, Homo sapiens
ggcaggagaatcagcctgg

SEQ ID NO: 2196472 - DNA, 13 bp, Homo sapiens
ggcaggagctcag

SEQ ID NO: 2196473 - DNA, 15 bp, Homo sapiens
ggcaggagctcagat

SEQ ID NO: 2196474 - DNA, 16 bp, Homo sapiens
ggcaggagggtggcac

SEQ ID NO: 2196475 - DNA, 15 bp, Homo sapiens
ggcagggaggcacca

SEQ ID NO: 2196476 - DNA, 13 bp, Homo sapiens
ggcaggggctggg

SEQ ID NO: 2196477 - DNA, 19 bp, Homo sapiens
ggcaggtcccgagccccct

SEQ ID NO: 2196478 - DNA, 21 bp, Homo sapiens
ggcaggtcccgagccccctgt

SEQ ID NO: 2196479 - DNA, 14 bp, Homo sapiens
ggcaggttgatcag

SEQ ID NO: 2196480 - DNA, 12 bp, Homo sapiens
ggcatcacctgc

SEQ ID NO: 2196481 - DNA, 15 bp, Homo sapiens
ggcatcaggaaagga

SEQ ID NO: 2196482 - DNA, 21 bp, Homo sapiens
ggcatctagagcttgatgcca

SEQ ID NO: 2196483 - DNA, 22 bp, Homo sapiens
ggcatctagagcttgatgccag

SEQ ID NO: 2196484 - DNA, 18 bp, Homo sapiens
ggcatggaagagggaggg

SEQ ID NO: 2196485 - DNA, 15 bp, Homo sapiens
ggcattaaatgcaaa

SEQ ID NO: 2196486 - DNA, 13 bp, Homo sapiens
ggcattcccagag

SEQ ID NO: 2196487 - DNA, 18 bp, Homo sapiens
ggcattcgcagtgcccag

SEQ ID NO: 2196488 - DNA, 21 bp, Homo sapiens
ggcattttaatctaagtggtt

SEQ ID NO: 2196489 - DNA, 15 bp, Homo sapiens
ggccaaagacctccc

SEQ ID NO: 2196490 - DNA, 12 bp, Homo sapiens
ggccaaggtgcc

SEQ ID NO: 2196491 - DNA, 18 bp, Homo sapiens
ggccacatccaacatttc

SEQ ID NO: 2196492 - DNA, 13 bp, Homo sapiens
ggccacctgcagg

SEQ ID NO: 2196493 - DNA, 20 bp, Homo sapiens
ggccactgcagtcacccctg

SEQ ID NO: 2196494 - DNA, 24 bp, Homo sapiens
ggccactgcagtcacccctgtctg

SEQ ID NO: 2196495 - DNA, 19 bp, Homo sapiens
ggccactttgcagacctgg

SEQ ID NO: 2196496 - DNA, 19 bp, Homo sapiens
ggccagaccagagctctgg

SEQ ID NO: 2196497 - DNA, 17 bp, Homo sapiens
ggccatcggtcctgtct

SEQ ID NO: 2196498 - DNA, 21 bp, Homo sapiens
ggccatctgactgccaagcca

SEQ ID NO: 2196499 - DNA, 23 bp, Homo sapiens
ggccatctgactgccaagccaga

SEQ ID NO: 2196500 - DNA, 24 bp, Homo sapiens
ggcccaaaggaagtagcaggccca

SEQ ID NO: 2196501 - DNA, 21 bp, Homo sapiens
ggcccacctaccttcaaagct

SEQ ID NO: 2196502 - DNA, 22 bp, Homo sapiens
ggcccacctaccttcaaagctg

SEQ ID NO: 2196503 - DNA, 23 bp, Homo sapiens
ggcccagcagagccgttcctggg

SEQ ID NO: 2196504 - DNA, 12 bp, Homo sapiens
ggcccagctggg

SEQ ID NO: 2196505 - DNA, 18 bp, Homo sapiens
ggccccagaggccctgga

SEQ ID NO: 2196506 - DNA, 11 bp, Homo sapiens
gggccctgcta

SEQ ID NO: 2196507 - DNA, 14 bp, Homo sapiens
gggccgactaagag

SEQ ID NO: 2196508 - DNA, 18 bp, Homo sapiens
gggccgccacggcctggc

SEQ ID NO: 2196509 - DNA, 21 bp, Homo sapiens
gggccgccacggcctggctgg

SEQ ID NO: 2196510 - DNA, 16 bp, Homo sapiens
gggcctcacctttccc

SEQ ID NO: 2196511 - DNA, 21 bp, Homo sapiens
gggcctcacctttcccacagt

SEQ ID NO: 2196512 - DNA, 23 bp, Homo sapiens
gggcctcacctttcccacagtct

SEQ ID NO: 2196513 - DNA, 14 bp, Homo sapiens
gggcctcaggctct

SEQ ID NO: 2196514 - DNA, 20 bp, Homo sapiens
gggcctcaggctctgcacag

SEQ ID NO: 2196515 - DNA, 19 bp, Homo sapiens
gggcctctggctgcctggc

SEQ ID NO: 2196516 - DNA, 23 bp, Homo sapiens
gggcctgcctagcactcacatgc

SEQ ID NO: 2196517 - DNA, 15 bp, Homo sapiens
gggcctgctgtgggt

SEQ ID NO: 2196518 - DNA, 14 bp, Homo sapiens
gggctaaccagttc

SEQ ID NO: 2196519 - DNA, 22 bp, Homo sapiens
gggctaaggcctcttgctggtg

SEQ ID NO: 2196520 - DNA, 21 bp, Homo sapiens
gggctagtaataaaatattta

SEQ ID NO: 2196521 - DNA, 15 bp, Homo sapiens
gggctcagccctgag

SEQ ID NO: 2196522 - DNA, 18 bp, Homo sapiens
gggctcagctctggctca

SEQ ID NO: 2196523 - DNA, 23 bp, Homo sapiens
gggctcagctctggctcacagac

SEQ ID NO: 2196524 - DNA, 11 bp, Homo sapiens
gggctctcctg

SEQ ID NO: 2196525 - DNA, 17 bp, Homo sapiens
gggctctggctccctgg

SEQ ID NO: 2196526 - DNA, 19 bp, Homo sapiens
gggctggagaaagagctgc

SEQ ID NO: 2196527 - DNA, 21 bp, Homo sapiens
gggctggagaaagagctgcct

SEQ ID NO: 2196528 - DNA, 23 bp, Homo sapiens
gggctggagaaagagctgcctgg

SEQ ID NO: 2196529 - DNA, 15 bp, Homo sapiens
gggctgggcagaggg

SEQ ID NO: 2196530 - DNA, 21 bp, Homo sapiens
gggctgggcagaggggagagg

SEQ ID NO: 2196531 - DNA, 14 bp, Homo sapiens
gggcttcagatatt

SEQ ID NO: 2196532 - DNA, 20 bp, Homo sapiens
gggctttgattccatctcct

SEQ ID NO: 2196533 - DNA, 14 bp, Homo sapiens
ggggaagagagcct

SEQ ID NO: 2196534 - DNA, 17 bp, Homo sapiens
ggggagacacctcagag

SEQ ID NO: 2196535 - DNA, 13 bp, Homo sapiens
ggggagaggaagc

SEQ ID NO: 2196536 - DNA, 13 bp, Homo sapiens
ggggatccagcca

SEQ ID NO: 2196537 - DNA, 18 bp, Homo sapiens
ggggcagggaaggacagg

SEQ ID NO: 2196538 - DNA, 10 bp, Homo sapiens
ggggccctgc

SEQ ID NO: 2196539 - DNA, 13 bp, Homo sapiens
ggggcctctggct

SEQ ID NO: 2196540 - DNA, 15 bp, Homo sapiens
ggggcctgcagaagg

SEQ ID NO: 2196541 - DNA, 14 bp, Homo sapiens
ggggctcagccctg

SEQ ID NO: 2196542 - DNA, 13 bp, Homo sapiens
gcctgtccctggc

SEQ ID NO: 2196543 - DNA, 21 bp, Homo sapiens
gcctgtccctggccatctctg

SEQ ID NO: 2196544 - DNA, 17 bp, Homo sapiens
gcctgtcgtgttctctc

SEQ ID NO: 2196545 - DNA, 13 bp, Homo sapiens
gcctgtgcccttg

SEQ ID NO: 2196546 - DNA, 22 bp, Homo sapiens
gcctgtgcccttgctgggtcca

SEQ ID NO: 2196547 - DNA, 14 bp, Homo sapiens
gcctgtgggagaag

SEQ ID NO: 2196548 - DNA, 18 bp, Homo sapiens
gccttatggatttggact

SEQ ID NO: 2196549 - DNA, 21 bp, Homo sapiens
gccttcaacaacgtgagagaa

SEQ ID NO: 2196550 - DNA, 21 bp, Homo sapiens
gccttctagattcactgtctt

SEQ ID NO: 2196551 - DNA, 16 bp, Homo sapiens
gccttgcccagcaagg

SEQ ID NO: 2196552 - DNA, 17 bp, Homo sapiens
gccttggcctcccaaag

SEQ ID NO: 2196553 - DNA, 17 bp, Homo sapiens
gccttggctcgttctct

SEQ ID NO: 2196554 - DNA, 16 bp, Homo sapiens
gcgaactctcaggact

SEQ ID NO: 2196555 - DNA, 17 bp, Homo sapiens
gcgaactctcaggacta

SEQ ID NO: 2196556 - DNA, 15 bp, Homo sapiens
gcgaccagaggtggg

SEQ ID NO: 2196557 - DNA, 21 bp, Homo sapiens
gcgaccagaggtgggaggccc

SEQ ID NO: 2196558 - DNA, 20 bp, Homo sapiens
gcgatcatggctcactgcag

SEQ ID NO: 2196559 - DNA, 22 bp, Homo sapiens
gcgatcatggctcactgcagcc

SEQ ID NO: 2196560 - DNA, 21 bp, Homo sapiens
gcgatccctcccctcagcctc

SEQ ID NO: 2196561 - DNA, 24 bp, Homo sapiens
gcgatccctcccctcagcctcctg

SEQ ID NO: 2196562 - DNA, 14 bp, Homo sapiens
gcgcagctccttcc

SEQ ID NO: 2196563 - DNA, 18 bp, Homo sapiens
gcgccagccctaggctac

SEQ ID NO: 2196564 - DNA, 21 bp, Homo sapiens
gcggaggggatccagccactt

SEQ ID NO: 2196565 - DNA, 14 bp, Homo sapiens
gcggatcctgctgg

SEQ ID NO: 2196566 - DNA, 15 bp, Homo sapiens
gcggctgctggcaca

SEQ ID NO: 2196567 - DNA, 23 bp, Homo sapiens
gcgggcggaggggatccagccac

SEQ ID NO: 2196568 - DNA, 17 bp, Homo sapiens
gcgggtaaaaagagaag

SEQ ID NO: 2196569 - DNA, 17 bp, Homo sapiens
gcggtggaaggagcctg

SEQ ID NO: 2196570 - DNA, 19 bp, Homo sapiens
gcggtggaaggagcctgcg

SEQ ID NO: 2196571 - DNA, 13 bp, Homo sapiens
gcggttgtaaata

SEQ ID NO: 2196572 - DNA, 15 bp, Homo sapiens
gcggttgtaaataca

SEQ ID NO: 2196573 - DNA, 22 bp, Homo sapiens
gcgtcacctgtgcagggccctc

SEQ ID NO: 2196574 - DNA, 21 bp, Homo sapiens
gcgtcatggctcaaggattca

SEQ ID NO: 2196575 - DNA, 12 bp, Homo sapiens
gcgtcccagctg

SEQ ID NO: 2196576 - DNA, 14 bp, Homo sapiens
gcgtcccagctgaa

SEQ ID NO: 2196577 - DNA, 22 bp, Homo sapiens
gcgtctgagcggccgcctgtcc

SEQ ID NO: 2196578 - DNA, 16 bp, Homo sapiens
gctaaagaggtggggt

SEQ ID NO: 2196579 - DNA, 22 bp, Homo sapiens
gctaaagaggtggggtgaagct

SEQ ID NO: 2196580 - DNA, 13 bp, Homo sapiens
gctaaatttgtgt

SEQ ID NO: 2196581 - DNA, 18 bp, Homo sapiens
gctaaccagttctctttg

SEQ ID NO: 2196582 - DNA, 16 bp, Homo sapiens
gctaagcctgatgatg

SEQ ID NO: 2196583 - DNA, 21 bp, Homo sapiens
gctaaggcctcttgctggtgc

SEQ ID NO: 2196584 - DNA, 19 bp, Homo sapiens
gctacaaatagtgctaata

SEQ ID NO: 2196585 - DNA, 16 bp, Homo sapiens
gctacccttgccaagg

SEQ ID NO: 2196586 - DNA, 17 bp, Homo sapiens
gctacccttgccaaggc

SEQ ID NO: 2196587 - DNA, 21 bp, Homo sapiens
gctataaagcagtatttttct

SEQ ID NO: 2196588 - DNA, 18 bp, Homo sapiens
gctataacagtagggatg

SEQ ID NO: 2196589 - DNA, 16 bp, Homo sapiens
gctatgaatgttacta

SEQ ID NO: 2196590 - DNA, 21 bp, Homo sapiens
gctatttcccaagctggagtg

SEQ ID NO: 2196591 - DNA, 23 bp, Homo sapiens
gctcaagcaatcctcctgagtga

SEQ ID NO: 2196592 - DNA, 22 bp, Homo sapiens
gctcagaagagaatcaaggccg

SEQ ID NO: 2196593 - DNA, 16 bp, Homo sapiens
gctcagccctgagctg

SEQ ID NO: 2196594 - DNA, 19 bp, Homo sapiens
gctcagccctgagctggcc

SEQ ID NO: 2196595 - DNA, 14 bp, Homo sapiens
gctcagctctggct

SEQ ID NO: 2196596 - DNA, 16 bp, Homo sapiens
gctcagctctggctca

SEQ ID NO: 2196597 - DNA, 20 bp, Homo sapiens
gctcagctctggctcacaga

SEQ ID NO: 2196598 - DNA, 23 bp, Homo sapiens
gctcagtcttccctagggctggg

SEQ ID NO: 2196599 - DNA, 22 bp, Homo sapiens
gctcattcttgtgacttacagt

SEQ ID NO: 2196600 - DNA, 20 bp, Homo sapiens
gctccaccccactcacagag

SEQ ID NO: 2196601 - DNA, 17 bp, Homo sapiens
gctccagtcctgctctc

SEQ ID NO: 2196602 - DNA, 13 bp, Homo sapiens
gctcccctcctct

SEQ ID NO: 2196603 - DNA, 18 bp, Homo sapiens
gctcccctcctctcccct

SEQ ID NO: 2196604 - DNA, 13 bp, Homo sapiens
gctccctgggacc

SEQ ID NO: 2196605 - DNA, 13 bp, Homo sapiens
gctccgcctggca

SEQ ID NO: 2196606 - DNA, 16 bp, Homo sapiens
gctcctgttgttactg

SEQ ID NO: 2196607 - DNA, 16 bp, Homo sapiens
gctcgtgggctctggc

SEQ ID NO: 2196608 - DNA, 19 bp, Homo sapiens
gctctcaacccaggagcat

SEQ ID NO: 2196609 - DNA, 12 bp, Homo sapiens
gctctcctgccc

SEQ ID NO: 2196610 - DNA, 18 bp, Homo sapiens
gctctcctgccctgccct

SEQ ID NO: 2196611 - DNA, 15 bp, Homo sapiens
gctctgaaagctgct

SEQ ID NO: 2196612 - DNA, 17 bp, Homo sapiens
gctctgaaagctgcttc

SEQ ID NO: 2196613 - DNA, 19 bp, Homo sapiens
gctctgaaagctgcttctg

SEQ ID NO: 2196614 - DNA, 17 bp, Homo sapiens
gctctgaactgcacaat

SEQ ID NO: 2196615 - DNA, 19 bp, Homo sapiens
gctctgaatgggagccaga

SEQ ID NO: 2196616 - DNA, 15 bp, Homo sapiens
gctctgcccagagct

SEQ ID NO: 2196617 - DNA, 16 bp, Homo sapiens
gctctgcccagagctg

SEQ ID NO: 2196618 - DNA, 21 bp, Homo sapiens
gctctgcccagagctgggtga

SEQ ID NO: 2196619 - DNA, 12 bp, Homo sapiens
gctctggaagcc

SEQ ID NO: 2196620 - DNA, 16 bp, Homo sapiens
gctctggaagcctgct

SEQ ID NO: 2196621 - DNA, 18 bp, Homo sapiens
gctctggaagcctgctga

SEQ ID NO: 2196622 - DNA, 20 bp, Homo sapiens
gctctggaagcctgctgatt

SEQ ID NO: 2196623 - DNA, 11 bp, Homo sapiens
gctctggagaa

SEQ ID NO: 2196624 - DNA, 15 bp, Homo sapiens
gctctggagccacct

SEQ ID NO: 2196625 - DNA, 23 bp, Homo sapiens
gctctggagccacctgtcccacc

SEQ ID NO: 2196626 - DNA, 14 bp, Homo sapiens
gctctggctccctg

SEQ ID NO: 2196627 - DNA, 19 bp, Homo sapiens
gctcttagtcctccctgct

SEQ ID NO: 2196628 - DNA, 22 bp, Homo sapiens
gctcttagtcctccctgctcag

SEQ ID NO: 2196629 - DNA, 14 bp, Homo sapiens
gctgaaagagaaaa

SEQ ID NO: 2196630 - DNA, 18 bp, Homo sapiens
gctgaagacaaaccactg

SEQ ID NO: 2196631 - DNA, 22 bp, Homo sapiens
gctgaagacaaaccactgtaca

SEQ ID NO: 2196632 - DNA, 19 bp, Homo sapiens
gctgaagccgccaggaccg

SEQ ID NO: 2196633 - DNA, 18 bp, Homo sapiens
gctgaaggcagtggcagg

SEQ ID NO: 2196634 - DNA, 14 bp, Homo sapiens
gctgacgaggctgg

SEQ ID NO: 2196635 - DNA, 19 bp, Homo sapiens
gctgacttggttctgaagc

SEQ ID NO: 2196636 - DNA, 14 bp, Homo sapiens
gctgagactacagg

SEQ ID NO: 2196637 - DNA, 17 bp, Homo sapiens
gctgagactacaggtga

SEQ ID NO: 2196638 - DNA, 20 bp, Homo sapiens
gctgattttttttttaactt

SEQ ID NO: 2196639 - DNA, 19 bp, Homo sapiens
gctgcatcccaccagcctg

SEQ ID NO: 2196640 - DNA, 21 bp, Homo sapiens
gctgccatgattttggccact

SEQ ID NO: 2196641 - DNA, 19 bp, Homo sapiens
gctgcctccctgtccaccc

SEQ ID NO: 2196642 - DNA, 15 bp, Homo sapiens
gctgcctggcccagg

SEQ ID NO: 2196643 - DNA, 12 bp, Homo sapiens
gctgccttcctt

SEQ ID NO: 2196644 - DNA, 14 bp, Homo sapiens
gctgctctgcccag

SEQ ID NO: 2196645 - DNA, 18 bp, Homo sapiens
gctgctctgcccagagct

SEQ ID NO: 2196646 - DNA, 19 bp, Homo sapiens
gctggacttttgcagcttc

SEQ ID NO: 2196647 - DNA, 21 bp, Homo sapiens
gctggacttttgcagcttcct

SEQ ID NO: 2196648 - DNA, 12 bp, Homo sapiens
gctggagaaaga

SEQ ID NO: 2196649 - DNA, 16 bp, Homo sapiens
gctggagaaagagctg

SEQ ID NO: 2196650 - DNA, 18 bp, Homo sapiens
gctggagaaagagctgcc

SEQ ID NO: 2196651 - DNA, 16 bp, Homo sapiens
gctggagatactgatt

SEQ ID NO: 2196652 - DNA, 14 bp, Homo sapiens
gctggagtgcagtg

SEQ ID NO: 2196653 - DNA, 14 bp, Homo sapiens
ggggctgggcagag

SEQ ID NO: 2196654 - DNA, 17 bp, Homo sapiens
ggggctttggtggcccc

SEQ ID NO: 2196655 - DNA, 21 bp, Homo sapiens
gggggcctgagttgaggggct

SEQ ID NO: 2196656 - DNA, 15 bp, Homo sapiens
gggggcctgctgtgg

SEQ ID NO: 2196657 - DNA, 13 bp, Homo sapiens
ggggggagctctg

SEQ ID NO: 2196658 - DNA, 21 bp, Homo sapiens
gggggtgccaaccacctctgg

SEQ ID NO: 2196659 - DNA, 12 bp, Homo sapiens
ggggtctgggag

SEQ ID NO: 2196660 - DNA, 20 bp, Homo sapiens
ggggtttctggttggaggcc

SEQ ID NO: 2196661 - DNA, 18 bp, Homo sapiens
gggtaaaaagagaaggca

SEQ ID NO: 2196662 - DNA, 19 bp, Homo sapiens
gggtagcttctgacctcag

SEQ ID NO: 2196663 - DNA, 15 bp, Homo sapiens
gggtagggggcctga

SEQ ID NO: 2196664 - DNA, 12 bp, Homo sapiens
gggtcagtgtgc

SEQ ID NO: 2196665 - DNA, 21 bp, Homo sapiens
gggtcccagctaaagaggtgg

SEQ ID NO: 2196666 - DNA, 13 bp, Homo sapiens
gggtcctgtgcct

SEQ ID NO: 2196667 - DNA, 14 bp, Homo sapiens
gggtctgtggccag

SEQ ID NO: 2196668 - DNA, 17 bp, Homo sapiens
gggtcttcctgcagtgc

SEQ ID NO: 2196669 - DNA, 13 bp, Homo sapiens
gggtgaagctggg

SEQ ID NO: 2196670 - DNA, 18 bp, Homo sapiens
gggtgccaaccacctctg

SEQ ID NO: 2196671 - DNA, 18 bp, Homo sapiens
gggtgccctccactgccc

SEQ ID NO: 2196672 - DNA, 20 bp, Homo sapiens
gggtgccctccactgccctc

SEQ ID NO: 2196673 - DNA, 14 bp, Homo sapiens
gggtggggaggcag

SEQ ID NO: 2196674 - DNA, 16 bp, Homo sapiens
gggtgggggcctgctg

SEQ ID NO: 2196675 - DNA, 17 bp, Homo sapiens
gggttggaggcctcacc

SEQ ID NO: 2196676 - DNA, 15 bp, Homo sapiens
gggtttccacacagc

SEQ ID NO: 2196677 - DNA, 15 bp, Homo sapiens
ggtaaaaagagaagg

SEQ ID NO: 2196678 - DNA, 20 bp, Homo sapiens
ggtaaaaagagaaggcaagc

SEQ ID NO: 2196679 - DNA, 12 bp, Homo sapiens
ggtaagagggag

SEQ ID NO: 2196680 - DNA, 13 bp, Homo sapiens
ggtacctgccctc

SEQ ID NO: 2196681 - DNA, 16 bp, Homo sapiens
ggtaggcaaggctgcc

SEQ ID NO: 2196682 - DNA, 23 bp, Homo sapiens
ggtagttttccatggtcacagag

SEQ ID NO: 2196683 - DNA, 12 bp, Homo sapiens
ggtatgatcatt

SEQ ID NO: 2196684 - DNA, 22 bp, Homo sapiens
ggtatgcactggttccttaagt

SEQ ID NO: 2196685 - DNA, 21 bp, Homo sapiens
ggtattggccgatgagctggt

SEQ ID NO: 2196686 - DNA, 11 bp, Homo sapiens
ggtcaaggcct

SEQ ID NO: 2196687 - DNA, 18 bp, Homo sapiens
ggtcaaggcctgtccctg

SEQ ID NO: 2196688 - DNA, 16 bp, Homo sapiens
ggtcaataattgtgga

SEQ ID NO: 2196689 - DNA, 14 bp, Homo sapiens
ggtcaccaggggag

SEQ ID NO: 2196690 - DNA, 16 bp, Homo sapiens
ggtcaggtcatttttt

SEQ ID NO: 2196691 - DNA, 21 bp, Homo sapiens
ggtccagagtatgagtgcaag

SEQ ID NO: 2196692 - DNA, 19 bp, Homo sapiens
ggtcctaagtccctgcccc

SEQ ID NO: 2196693 - DNA, 22 bp, Homo sapiens
ggtcctgctatttcccaagctg

SEQ ID NO: 2196694 - DNA, 13 bp, Homo sapiens
ggtcctgtctccc

SEQ ID NO: 2196695 - DNA, 21 bp, Homo sapiens
ggtcctgtctcccctctgctg

SEQ ID NO: 2196696 - DNA, 23 bp, Homo sapiens
ggtcctgtctcccctctgctggc

SEQ ID NO: 2196697 - DNA, 13 bp, Homo sapiens
ggtctccaggggc

SEQ ID NO: 2196698 - DNA, 18 bp, Homo sapiens
ggtctccaggggcctgca

SEQ ID NO: 2196699 - DNA, 21 bp, Homo sapiens
ggtctccaggggcctgcagaa

SEQ ID NO: 2196700 - DNA, 15 bp, Homo sapiens
ggtctgggaggcagg

SEQ ID NO: 2196701 - DNA, 14 bp, Homo sapiens
ggtctgtggccagt

SEQ ID NO: 2196702 - DNA, 14 bp, Homo sapiens
ggtgaagctgggga

SEQ ID NO: 2196703 - DNA, 17 bp, Homo sapiens
ggtgaggaagctccagt

SEQ ID NO: 2196704 - DNA, 23 bp, Homo sapiens
ggtgagtggggagacacctcaga

SEQ ID NO: 2196705 - DNA, 18 bp, Homo sapiens
ggtgattttcctgtgtcc

SEQ ID NO: 2196706 - DNA, 15 bp, Homo sapiens
ggtgcaagagggagc

SEQ ID NO: 2196707 - DNA, 19 bp, Homo sapiens
ggtgcagcggtggaaggag

SEQ ID NO: 2196708 - DNA, 22 bp, Homo sapiens
ggtgcagcggtggaaggagcct

SEQ ID NO: 2196709 - DNA, 23 bp, Homo sapiens
ggtgcagcggtggaaggagcctg

SEQ ID NO: 2196710 - DNA, 17 bp, Homo sapiens
ggtgcaggcagccttga

SEQ ID NO: 2196711 - DNA, 18 bp, Homo sapiens
ggtgcatgccgctgcatc

SEQ ID NO: 2196712 - DNA, 22 bp, Homo sapiens
ggtgccaaccacctctggccct

SEQ ID NO: 2196713 - DNA, 23 bp, Homo sapiens
ggtgccaaccacctctggccctg

SEQ ID NO: 2196714 - DNA, 22 bp, Homo sapiens
ggtgccacagagggctgtgtct

SEQ ID NO: 2196715 - DNA, 15 bp, Homo sapiens
ggtgccaccaccctg

SEQ ID NO: 2196716 - DNA, 21 bp, Homo sapiens
ggtgccaccaccctgcccccc

SEQ ID NO: 2196717 - DNA, 13 bp, Homo sapiens
ggtgccctccact

SEQ ID NO: 2196718 - DNA, 13 bp, Homo sapiens
ggtggaaggagcc

SEQ ID NO: 2196719 - DNA, 21 bp, Homo sapiens
ggtggcatggaagagggaggg

SEQ ID NO: 2196720 - DNA, 22 bp, Homo sapiens
ggtggcgctttctcctgtgccc

SEQ ID NO: 2196721 - DNA, 24 bp, Homo sapiens
ggtgggaggcccctggtggcatgg

SEQ ID NO: 2196722 - DNA, 19 bp, Homo sapiens
ggtggggaagagagcctgc

SEQ ID NO: 2196723 - DNA, 12 bp, Homo sapiens
ggtggggcggga

SEQ ID NO: 2196724 - DNA, 13 bp, Homo sapiens
ggtgggggcctgc

SEQ ID NO: 2196725 - DNA, 21 bp, Homo sapiens
ggtgggggcctgctgtgggtc

SEQ ID NO: 2196726 - DNA, 23 bp, Homo sapiens
ggtggtattggccgatgagctgg

SEQ ID NO: 2196727 - DNA, 17 bp, Homo sapiens
ggtgtccccagcccact

SEQ ID NO: 2196728 - DNA, 22 bp, Homo sapiens
ggttagctcagccccagcccag

SEQ ID NO: 2196729 - DNA, 10 bp, Homo sapiens
ggttcccaga

SEQ ID NO: 2196730 - DNA, 11 bp, Homo sapiens
ggttcccagaa

SEQ ID NO: 2196731 - DNA, 13 bp, Homo sapiens
ggttctgaacagc

SEQ ID NO: 2196732 - DNA, 19 bp, Homo sapiens
ggttctgaacagcagaaac

SEQ ID NO: 2196733 - DNA, 12 bp, Homo sapiens
ggttctgtctgt

SEQ ID NO: 2196734 - DNA, 22 bp, Homo sapiens
gtcctgctctctacccagccca

SEQ ID NO: 2196735 - DNA, 16 bp, Homo sapiens
gtccttcccacggcca

SEQ ID NO: 2196736 - DNA, 22 bp, Homo sapiens
gtccttcccacggccactgcag

SEQ ID NO: 2196737 - DNA, 16 bp, Homo sapiens
gtccttctcctcttgt

SEQ ID NO: 2196738 - DNA, 15 bp, Homo sapiens
gtcctttccagtggc

SEQ ID NO: 2196739 - DNA, 23 bp, Homo sapiens
gtcgtggacacacacagactatt

SEQ ID NO: 2196740 - DNA, 20 bp, Homo sapiens
gtctagtggaaagattgtgt

SEQ ID NO: 2196741 - DNA, 11 bp, Homo sapiens
gtctcatgtgt

SEQ ID NO: 2196742 - DNA, 17 bp, Homo sapiens
gtctcattttgtatgta

SEQ ID NO: 2196743 - DNA, 19 bp, Homo sapiens
gtctccaggggcctgcaga

SEQ ID NO: 2196744 - DNA, 15 bp, Homo sapiens
gtctcccctctgctg

SEQ ID NO: 2196745 - DNA, 17 bp, Homo sapiens
gtctcccctctgctggc

SEQ ID NO: 2196746 - DNA, 15 bp, Homo sapiens
gtctcctgtatcatt

SEQ ID NO: 2196747 - DNA, 18 bp, Homo sapiens
gtctcctgtatcatttct

SEQ ID NO: 2196748 - DNA, 15 bp, Homo sapiens
gtctctccctggggt

SEQ ID NO: 2196749 - DNA, 16 bp, Homo sapiens
gtctgagcggccgcct

SEQ ID NO: 2196750 - DNA, 21 bp, Homo sapiens
gtctgagcggccgcctgtcct

SEQ ID NO: 2196751 - DNA, 22 bp, Homo sapiens
gtctgagcggccgcctgtcctt

SEQ ID NO: 2196752 - DNA, 15 bp, Homo sapiens
gtctgatattggtgt

SEQ ID NO: 2196753 - DNA, 15 bp, Homo sapiens
gtctgccgtgagagc

SEQ ID NO: 2196754 - DNA, 14 bp, Homo sapiens
gtctgctgctccca

SEQ ID NO: 2196755 - DNA, 16 bp, Homo sapiens
gtctgggagaggcaga

SEQ ID NO: 2196756 - DNA, 22 bp, Homo sapiens
gtctgtattcctgatatgccta

SEQ ID NO: 2196757 - DNA, 14 bp, Homo sapiens
gtctgtgattgcca

SEQ ID NO: 2196758 - DNA, 18 bp, Homo sapiens
gtctgtggccagttgaca

SEQ ID NO: 2196759 - DNA, 17 bp, Homo sapiens
gtctgtgtgctgtggtt

SEQ ID NO: 2196760 - DNA, 18 bp, Homo sapiens
gtctgtttccttctcttt

SEQ ID NO: 2196761 - DNA, 14 bp, Homo sapiens
gtcttcaagggctg

SEQ ID NO: 2196762 - DNA, 17 bp, Homo sapiens
gtcttcagatcctgctg

SEQ ID NO: 2196763 - DNA, 19 bp, Homo sapiens
gtcttcagatcctgctgcc

SEQ ID NO: 2196764 - DNA, 20 bp, Homo sapiens
gtcttcagatcctgctgccg

SEQ ID NO: 2196765 - DNA, 16 bp, Homo sapiens
gtcttccctagggctg

SEQ ID NO: 2196766 - DNA, 14 bp, Homo sapiens
gtcttcctcctccc

SEQ ID NO: 2196767 - DNA, 16 bp, Homo sapiens
gtcttcctcctcccct

SEQ ID NO: 2196768 - DNA, 16 bp, Homo sapiens
gtcttgagaaaacaga

SEQ ID NO: 2196769 - DNA, 19 bp, Homo sapiens
gtcttgagagcgctggcct

SEQ ID NO: 2196770 - DNA, 21 bp, Homo sapiens
gtcttgagagcgctggcctct

SEQ ID NO: 2196771 - DNA, 12 bp, Homo sapiens
gtcttggcctcc

SEQ ID NO: 2196772 - DNA, 15 bp, Homo sapiens
gtcttgtactgtgac

SEQ ID NO: 2196773 - DNA, 16 bp, Homo sapiens
gtctttgtgtgctgtg

SEQ ID NO: 2196774 - DNA, 24 bp, Homo sapiens
gtcttttaatgatactgtctaaga

SEQ ID NO: 2196775 - DNA, 22 bp, Homo sapiens
gtgaaaagtatggcagtgggag

SEQ ID NO: 2196776 - DNA, 20 bp, Homo sapiens
gtgaaaccccatctctacta

SEQ ID NO: 2196777 - DNA, 13 bp, Homo sapiens
gtgaaatttgtta

SEQ ID NO: 2196778 - DNA, 15 bp, Homo sapiens
gtgaaatttgttaat

SEQ ID NO: 2196779 - DNA, 23 bp, Homo sapiens
gtgaagacactacagaggattct

SEQ ID NO: 2196780 - DNA, 12 bp, Homo sapiens
gtgaagctgggg

SEQ ID NO: 2196781 - DNA, 16 bp, Homo sapiens
gtgaaggaaaaacatg

SEQ ID NO: 2196782 - DNA, 13 bp, Homo sapiens
gtgaatacatggt

SEQ ID NO: 2196783 - DNA, 21 bp, Homo sapiens
gtgaatatttgtaaaaataat

SEQ ID NO: 2196784 - DNA, 14 bp, Homo sapiens
gtgaccagtttctt

SEQ ID NO: 2196785 - DNA, 20 bp, Homo sapiens
gtgacccacccgccttggcc

SEQ ID NO: 2196786 - DNA, 22 bp, Homo sapiens
gtgactaccacttatttctaaa

SEQ ID NO: 2196787 - DNA, 16 bp, Homo sapiens
gtggagaacaaagacc

SEQ ID NO: 2196788 - DNA, 18 bp, Homo sapiens
gtggagaggagagaatga

SEQ ID NO: 2196789 - DNA, 23 bp, Homo sapiens
gtggagttattcactctcccaga

SEQ ID NO: 2196790 - DNA, 21 bp, Homo sapiens
gtggatagatgccctgctaga

SEQ ID NO: 2196791 - DNA, 15 bp, Homo sapiens
gtggattaaaggcaa

SEQ ID NO: 2196792 - DNA, 19 bp, Homo sapiens
gtggattgggctgcaggct

SEQ ID NO: 2196793 - DNA, 16 bp, Homo sapiens
gtggcacttcgtggat

SEQ ID NO: 2196794 - DNA, 23 bp, Homo sapiens
gtggcacttcgtggatgacctcc

SEQ ID NO: 2196795 - DNA, 16 bp, Homo sapiens
gtggcaggggagcagg

SEQ ID NO: 2196796 - DNA, 15 bp, Homo sapiens
gtggccagaccagag

SEQ ID NO: 2196797 - DNA, 14 bp, Homo sapiens
gtggcgctttctcc

SEQ ID NO: 2196798 - DNA, 22 bp, Homo sapiens
gtggcgctttctcctgtgccca

SEQ ID NO: 2196799 - DNA, 21 bp, Homo sapiens
gtggctaaaggtcccaaggca

SEQ ID NO: 2196800 - DNA, 20 bp, Homo sapiens
gtggctaaagtgctctattt

SEQ ID NO: 2196801 - DNA, 16 bp, Homo sapiens
gtggctctgagaaggg

SEQ ID NO: 2196802 - DNA, 15 bp, Homo sapiens
gtgggagaagggaca

SEQ ID NO: 2196803 - DNA, 16 bp, Homo sapiens
gtgggagaggaagcca

SEQ ID NO: 2196804 - DNA, 19 bp, Homo sapiens
gtgggatctgcccctccct

SEQ ID NO: 2196805 - DNA, 17 bp, Homo sapiens
gtgggcaccaagagcca

SEQ ID NO: 2196806 - DNA, 14 bp, Homo sapiens
gtgggctctggctc

SEQ ID NO: 2196807 - DNA, 15 bp, Homo sapiens
gtgggctctggctcc

SEQ ID NO: 2196808 - DNA, 19 bp, Homo sapiens
gtgggctctggctccctgg

SEQ ID NO: 2196809 - DNA, 12 bp, Homo sapiens
gtggggctgggg

SEQ ID NO: 2196810 - DNA, 18 bp, Homo sapiens
gtgggggcctgctgtggg

SEQ ID NO: 2196811 - DNA, 20 bp, Homo sapiens
gtgggggtctgggaggcagg

SEQ ID NO: 2196812 - DNA, 21 bp, Homo sapiens
gtgggggtgtcacagaggcag

SEQ ID NO: 2196813 - DNA, 14 bp, Homo sapiens
gtggggtgaagctg

SEQ ID NO: 2196814 - DNA, 15 bp, Homo sapiens
gtggggtgaagctgg

SEQ ID NO: 2196815 - DNA, 19 bp, Homo sapiens
gtgggtcagtgtgccaccc

SEQ ID NO: 2196816 - DNA, 22 bp, Homo sapiens
gtggtattggccgatgagctgg

SEQ ID NO: 2196817 - DNA, 15 bp, Homo sapiens
gtggtggctctgaga

SEQ ID NO: 2196818 - DNA, 18 bp, Homo sapiens
gtggtgtccttctcctct

SEQ ID NO: 2196819 - DNA, 12 bp, Homo sapiens
gtggttgcatgt

SEQ ID NO: 2196820 - DNA, 13 bp, Homo sapiens
gtggtttctatac

SEQ ID NO: 2196821 - DNA, 20 bp, Homo sapiens
gtgtaaatctgaaaaactaa

SEQ ID NO: 2196822 - DNA, 22 bp, Homo sapiens
gtgtacaggctaggaagaactt

SEQ ID NO: 2196823 - DNA, 13 bp, Homo sapiens
gtgtacagtatgt

SEQ ID NO: 2196824 - DNA, 15 bp, Homo sapiens
gtgtacagtatgtgt

SEQ ID NO: 2196825 - DNA, 18 bp, Homo sapiens
gtgtacagtatgtgtcta

SEQ ID NO: 2196826 - DNA, 20 bp, Homo sapiens
gtgtcatgaggaaaaaaaat

SEQ ID NO: 2196827 - DNA, 12 bp, Homo sapiens
gtgtccccagcc

SEQ ID NO: 2196828 - DNA, 15 bp, Homo sapiens
gtgtccttctcctct

SEQ ID NO: 2196829 - DNA, 20 bp, Homo sapiens
gtgtctaaaatacttgagaa

SEQ ID NO: 2196830 - DNA, 15 bp, Homo sapiens
gtgtctaccttgtta

SEQ ID NO: 2196831 - DNA, 16 bp, Homo sapiens
gtgtctagcaaagcca

SEQ ID NO: 2196832 - DNA, 23 bp, Homo sapiens
gtgtctcctgcatgcagaaaggg

SEQ ID NO: 2196833 - DNA, 15 bp, Homo sapiens
gtgtcttactagaaa

SEQ ID NO: 2196834 - DNA, 17 bp, Homo sapiens
gtgtcttgatatattta

SEQ ID NO: 2196835 - DNA, 17 bp, Homo sapiens
gtgtgaatgctgtacct

SEQ ID NO: 2196836 - DNA, 23 bp, Homo sapiens
gtgtgagtgtgacgggggttggg

SEQ ID NO: 2196837 - DNA, 14 bp, Homo sapiens
gtgtgatgtatgtt

SEQ ID NO: 2196838 - DNA, 17 bp, Homo sapiens
gtgtgcagtgtttttcc

SEQ ID NO: 2196839 - DNA, 13 bp, Homo sapiens
gtgtgccaccctc

SEQ ID NO: 2196840 - DNA, 17 bp, Homo sapiens
gtgtgggggtctgggag

SEQ ID NO: 2196841 - DNA, 12 bp, Homo sapiens
gtgtgtttttat

SEQ ID NO: 2196842 - DNA, 18 bp, Homo sapiens
gtgttactggaaaaatta

SEQ ID NO: 2196843 - DNA, 22 bp, Homo sapiens
gtgttctctccccttgcactgg

SEQ ID NO: 2196844 - DNA, 22 bp, Homo sapiens
gtgttggcttgtgatctgggaa

SEQ ID NO: 2196845 - DNA, 12 bp, Homo sapiens
gtgttgtacaat

SEQ ID NO: 2196846 - DNA, 15 bp, Homo sapiens
gtgtttaaaaaatga

SEQ ID NO: 2196847 - DNA, 20 bp, Homo sapiens
gtgtttgatatttgtgtaaa

SEQ ID NO: 2196848 - DNA, 21 bp, Homo sapiens
aactttggagaactcatttca

SEQ ID NO: 2196849 - DNA, 13 bp, Homo sapiens
aagaaaaacatgt

SEQ ID NO: 2196850 - DNA, 19 bp, Homo sapiens
aagaaaaacatgtcatgta

SEQ ID NO: 2196851 - DNA, 9 bp, Homo sapiens
aagaaaaat

SEQ ID NO: 2196852 - DNA, 12 bp, Homo sapiens
aagaaaattgcc

SEQ ID NO: 2196853 - DNA, 15 bp, Homo sapiens
aagaaacatttatct

SEQ ID NO: 2196854 - DNA, 15 bp, Homo sapiens
aagaaagctgtgaaa

SEQ ID NO: 2196855 - DNA, 18 bp, Homo sapiens
aagaaaggggcaggagct

SEQ ID NO: 2196856 - DNA, 14 bp, Homo sapiens
aagaactctgggca

SEQ ID NO: 2196857 - DNA, 22 bp, Homo sapiens
aagaagcagtggccttattgca

SEQ ID NO: 2196858 - DNA, 19 bp, Homo sapiens
aagaagctaaaatgaaaaa

SEQ ID NO: 2196859 - DNA, 12 bp, Homo sapiens
aagaaggctggg

SEQ ID NO: 2196860 - DNA, 23 bp, Homo sapiens
aagaagtgggagtgggagaggaa

SEQ ID NO: 2196861 - DNA, 14 bp, Homo sapiens
aagacaaatgggac

SEQ ID NO: 2196862 - DNA, 22 bp, Homo sapiens
aagacacgtggcctcgtgaggg

SEQ ID NO: 2196863 - DNA, 13 bp, Homo sapiens
aagacactacaga

SEQ ID NO: 2196864 - DNA, 13 bp, Homo sapiens
aagacatcaagat

SEQ ID NO: 2196865 - DNA, 20 bp, Homo sapiens
aagaccaatgtgaagacact

SEQ ID NO: 2196866 - DNA, 13 bp, Homo sapiens
aagaccagcctgg

SEQ ID NO: 2196867 - DNA, 22 bp, Homo sapiens
aagacgaagaagcaagggagga

SEQ ID NO: 2196868 - DNA, 23 bp, Homo sapiens
aagacgaggggcagggaaggaca

SEQ ID NO: 2196869 - DNA, 13 bp, Homo sapiens
aagacgccctctc

SEQ ID NO: 2196870 - DNA, 12 bp, Homo sapiens
aagactaacctt

SEQ ID NO: 2196871 - DNA, 15 bp, Homo sapiens
aagactaacctttgt

SEQ ID NO: 2196872 - DNA, 19 bp, Homo sapiens
aagagagaagagtccagga

SEQ ID NO: 2196873 - DNA, 13 bp, Homo sapiens
aagagagaagcca

SEQ ID NO: 2196874 - DNA, 20 bp, Homo sapiens
aagagagaagccagccacag

SEQ ID NO: 2196875 - DNA, 12 bp, Homo sapiens
aagagagcctgc

SEQ ID NO: 2196876 - DNA, 16 bp, Homo sapiens
aagaggaagccttgcc

SEQ ID NO: 2196877 - DNA, 21 bp, Homo sapiens
aagagggagccggtttgggag

SEQ ID NO: 2196878 - DNA, 13 bp, Homo sapiens
aagagggcaaagc

SEQ ID NO: 2196879 - DNA, 15 bp, Homo sapiens
aagagggcaaagctg

SEQ ID NO: 2196880 - DNA, 16 bp, Homo sapiens
aagagggcaaagctga

SEQ ID NO: 2196881 - DNA, 13 bp, Homo sapiens
aagagtcattttc

SEQ ID NO: 2196882 - DNA, 12 bp, Homo sapiens
aagagtcctgag

SEQ ID NO: 2196883 - DNA, 20 bp, Homo sapiens
aagagtcctgaggcagaacc

SEQ ID NO: 2196884 - DNA, 20 bp, Homo sapiens
aagagttctatccccaagct

SEQ ID NO: 2196885 - DNA, 19 bp, Homo sapiens
aagatacacttgtaaataa

SEQ ID NO: 2196886 - DNA, 22 bp, Homo sapiens
aagatcagaacattcagctctg

SEQ ID NO: 2196887 - DNA, 22 bp, Homo sapiens
aagatgtaataatcattttaga

SEQ ID NO: 2196888 - DNA, 23 bp, Homo sapiens
aagatgtattaacctacctgtga

SEQ ID NO: 2196889 - DNA, 17 bp, Homo sapiens
aagatgtattcagagcc

SEQ ID NO: 2196890 - DNA, 20 bp, Homo sapiens
aagattcccggctggacttt

SEQ ID NO: 2196891 - DNA, 13 bp, Homo sapiens
aagattgcaaagg

SEQ ID NO: 2196892 - DNA, 17 bp, Homo sapiens
aagatttttaaaatgaa

SEQ ID NO: 2196893 - DNA, 20 bp, Homo sapiens
aagcaacatgaattaagaac

SEQ ID NO: 2196894 - DNA, 15 bp, Homo sapiens
aagcaagctcttctc

SEQ ID NO: 2196895 - DNA, 18 bp, Homo sapiens
aagcagaggctggcctca

SEQ ID NO: 2196896 - DNA, 14 bp, Homo sapiens
aagcagcccttgct

SEQ ID NO: 2196897 - DNA, 13 bp, Homo sapiens
aagcatagagaac

SEQ ID NO: 2196898 - DNA, 14 bp, Homo sapiens
aagccacgtgctgg

SEQ ID NO: 2196899 - DNA, 19 bp, Homo sapiens
aagccacgtgctggagagt

SEQ ID NO: 2196900 - DNA, 20 bp, Homo sapiens
aagccagaatattctaacct

SEQ ID NO: 2196901 - DNA, 19 bp, Homo sapiens
aagccagcatttcctcagt

SEQ ID NO: 2196902 - DNA, 11 bp, Homo sapiens
aagccagccac

SEQ ID NO: 2196903 - DNA, 23 bp, Homo sapiens
aagccagccacagacccctggga

SEQ ID NO: 2196904 - DNA, 14 bp, Homo sapiens
aagcccatcctgac

SEQ ID NO: 2196905 - DNA, 16 bp, Homo sapiens
aagcccatcctgacca

SEQ ID NO: 2196906 - DNA, 15 bp, Homo sapiens
aagccgccaggaccg

SEQ ID NO: 2196907 - DNA, 13 bp, Homo sapiens
aagccggtgccca

SEQ ID NO: 2196908 - DNA, 20 bp, Homo sapiens
aagcctgctgatttctacaa

SEQ ID NO: 2196909 - DNA, 15 bp, Homo sapiens
aagcctgggccactg

SEQ ID NO: 2196910 - DNA, 16 bp, Homo sapiens
aagcctgggccactgg

SEQ ID NO: 2196911 - DNA, 21 bp, Homo sapiens
aagccttgcccagcaaggacc

SEQ ID NO: 2196912 - DNA, 22 bp, Homo sapiens
aagcgactctcctgcctcagcc

SEQ ID NO: 2196913 - DNA, 17 bp, Homo sapiens
aagctaaaatgaaaaat

SEQ ID NO: 2196914 - DNA, 23 bp, Homo sapiens
aagctaccttttttttacggaat

SEQ ID NO: 2196915 - DNA, 19 bp, Homo sapiens
aagctagctcccctcctct

SEQ ID NO: 2196916 - DNA, 20 bp, Homo sapiens
aagctagctcccctcctctc

SEQ ID NO: 2196917 - DNA, 19 bp, Homo sapiens
aagctaggccccagaggcc

SEQ ID NO: 2196918 - DNA, 22 bp, Homo sapiens
aagctaggccccagaggccctg

SEQ ID NO: 2196919 - DNA, 21 bp, Homo sapiens
aagctcagtttggctgtaatt

SEQ ID NO: 2196920 - DNA, 18 bp, Homo sapiens
aagctccagtcctgctct

SEQ ID NO: 2196921 - DNA, 20 bp, Homo sapiens
aagctgagcgggtctagtgg

SEQ ID NO: 2196922 - DNA, 17 bp, Homo sapiens
aagctgcctccctgtcc

SEQ ID NO: 2196923 - DNA, 15 bp, Homo sapiens
aagctgtatgtactt

SEQ ID NO: 2196924 - DNA, 23 bp, Homo sapiens
aagctgtatgtacttccagtatc

SEQ ID NO: 2196925 - DNA, 14 bp, Homo sapiens
aagctgtccctgca

SEQ ID NO: 2196926 - DNA, 17 bp, Homo sapiens
aagctgtccctgcaggg

SEQ ID NO: 2196927 - DNA, 20 bp, Homo sapiens
aagctgtccctgcagggcca

SEQ ID NO: 2196928 - DNA, 21 bp, Homo sapiens
aagctttcagtattagtgatg

SEQ ID NO: 2196929 - DNA, 13 bp, Homo sapiens
aagctttcctgga

SEQ ID NO: 2196930 - DNA, 17 bp, Homo sapiens
aagctttctctgcttca

SEQ ID NO: 2196931 - DNA, 23 bp, Homo sapiens
aagctttctctgcttcagcttgc

SEQ ID NO: 2196932 - DNA, 20 bp, Homo sapiens
aaggaaacaaccatgtcatt

SEQ ID NO: 2196933 - DNA, 20 bp, Homo sapiens
aaggaaagaagggggccctg

SEQ ID NO: 2196934 - DNA, 20 bp, Homo sapiens
aaggaaatctcctcttttgt

SEQ ID NO: 2196935 - DNA, 15 bp, Homo sapiens
aaggacaggaccctc

SEQ ID NO: 2196936 - DNA, 18 bp, Homo sapiens
aaggacaggaccctcagg

SEQ ID NO: 2196937 - DNA, 16 bp, Homo sapiens
aaggaccagtgagaca

SEQ ID NO: 2196938 - DNA, 23 bp, Homo sapiens
aaggacttgtgcctcttgggaga

SEQ ID NO: 2196939 - DNA, 21 bp, Homo sapiens
aaggagaggctctgaaagctg

SEQ ID NO: 2196940 - DNA, 18 bp, Homo sapiens
aaggagcctgcggctgct

SEQ ID NO: 2196941 - DNA, 19 bp, Homo sapiens
aaggagcctgcggctgctg

SEQ ID NO: 2196942 - DNA, 21 bp, Homo sapiens
aaggagcttacctcccacctt

SEQ ID NO: 2196943 - DNA, 16 bp, Homo sapiens
aaggatatactgcagc

SEQ ID NO: 2196944 - DNA, 20 bp, Homo sapiens
aaggattctgaagttttatt

SEQ ID NO: 2196945 - DNA, 15 bp, Homo sapiens
aaggcagctctgtcg

SEQ ID NO: 2196946 - DNA, 16 bp, Homo sapiens
aaggcagtggcagggg

SEQ ID NO: 2196947 - DNA, 14 bp, Homo sapiens
aaggccacctgcag

SEQ ID NO: 2196948 - DNA, 13 bp, Homo sapiens
aaggccccctttc

SEQ ID NO: 2196949 - DNA, 15 bp, Homo sapiens
aaggcctcttgctgg

SEQ ID NO: 2196950 - DNA, 19 bp, Homo sapiens
aaggctatcggagcagttc

SEQ ID NO: 2196951 - DNA, 23 bp, Homo sapiens
aagggacactggatccagaagct

SEQ ID NO: 2196952 - DNA, 15 bp, Homo sapiens
aagggacattgaagt

SEQ ID NO: 2196953 - DNA, 17 bp, Homo sapiens
aagggacattgaagtgt

SEQ ID NO: 2196954 - DNA, 23 bp, Homo sapiens
aagggcattggccattctattgt

SEQ ID NO: 2196955 - DNA, 12 bp, Homo sapiens
aagggccctggc

SEQ ID NO: 2196956 - DNA, 19 bp, Homo sapiens
aagggcctcacctttccca

SEQ ID NO: 2196957 - DNA, 13 bp, Homo sapiens
aaggggccatcct

SEQ ID NO: 2196958 - DNA, 18 bp, Homo sapiens
aagggggtgaccatgcaa

SEQ ID NO: 2196959 - DNA, 16 bp, Homo sapiens
aagggtctgtggccag

SEQ ID NO: 2196960 - DNA, 23 bp, Homo sapiens
aaggtattgcaaggtcactttgc

SEQ ID NO: 2196961 - DNA, 17 bp, Homo sapiens
aaggtcacagaagtagt

SEQ ID NO: 2196962 - DNA, 17 bp, Homo sapiens
aaggtgtaaaatatcta

SEQ ID NO: 2196963 - DNA, 21 bp, Homo sapiens
aaggttggaactgctgccatg

SEQ ID NO: 2196964 - DNA, 11 bp, Homo sapiens
aagtaaaaaca

SEQ ID NO: 2196965 - DNA, 13 bp, Homo sapiens
aagtaaactgccc

SEQ ID NO: 2196966 - DNA, 14 bp, Homo sapiens
aagtaaattgaaat

SEQ ID NO: 2196967 - DNA, 21 bp, Homo sapiens
aagtaccatagaacagaactg

SEQ ID NO: 2196968 - DNA, 15 bp, Homo sapiens
aagtactggaattta

SEQ ID NO: 2196969 - DNA, 17 bp, Homo sapiens
aagtagggatgcggatc

SEQ ID NO: 2196970 - DNA, 21 bp, Homo sapiens
accattttgcgatgtgtttta

SEQ ID NO: 2196971 - DNA, 21 bp, Homo sapiens
acccaaaagctcagccagccc

SEQ ID NO: 2196972 - DNA, 22 bp, Homo sapiens
acccaacaggtgctgaactgtg

SEQ ID NO: 2196973 - DNA, 15 bp, Homo sapiens
acccaataattctgt

SEQ ID NO: 2196974 - DNA, 19 bp, Homo sapiens
acccacactgcaacaggaa

SEQ ID NO: 2196975 - DNA, 22 bp, Homo sapiens
acccacagggcctgacttttac

SEQ ID NO: 2196976 - DNA, 20 bp, Homo sapiens
acccacccgccttggcctcc

SEQ ID NO: 2196977 - DNA, 12 bp, Homo sapiens
acccacctgagc

SEQ ID NO: 2196978 - DNA, 16 bp, Homo sapiens
acccacctgagctttg

SEQ ID NO: 2196979 - DNA, 18 bp, Homo sapiens
acccacctgagctttgga

SEQ ID NO: 2196980 - DNA, 23 bp, Homo sapiens
acccagcctctgtagttcttttt

SEQ ID NO: 2196981 - DNA, 22 bp, Homo sapiens
acccaggagcatccacctcctt

SEQ ID NO: 2196982 - DNA, 17 bp, Homo sapiens
acccaggccactgacct

SEQ ID NO: 2196983 - DNA, 14 bp, Homo sapiens
acccatgcacagaa

SEQ ID NO: 2196984 - DNA, 16 bp, Homo sapiens
acccatttgccatgct

SEQ ID NO: 2196985 - DNA, 20 bp, Homo sapiens
acccatttgccatgctgcta

SEQ ID NO: 2196986 - DNA, 19 bp, Homo sapiens
accccaccacaaaaagaga

SEQ ID NO: 2196987 - DNA, 22 bp, Homo sapiens
acccccacaagctgtccctgca

SEQ ID NO: 2196988 - DNA, 13 bp, Homo sapiens
accccctggcttg

SEQ ID NO: 2196989 - DNA, 15 bp, Homo sapiens
acccctcctcccttt

SEQ ID NO: 2196990 - DNA, 18 bp, Homo sapiens
acccctcctccctttttc

SEQ ID NO: 2196991 - DNA, 13 bp, Homo sapiens
acccctccttccc

SEQ ID NO: 2196992 - DNA, 11 bp, Homo sapiens
acccctggctg

SEQ ID NO: 2196993 - DNA, 17 bp, Homo sapiens
accccttcctgtctggc

SEQ ID NO: 2196994 - DNA, 16 bp, Homo sapiens
acccgccttggcctcc

SEQ ID NO: 2196995 - DNA, 14 bp, Homo sapiens
acccgttaatttaa

SEQ ID NO: 2196996 - DNA, 19 bp, Homo sapiens
acccgttaatttaaagctg

SEQ ID NO: 2196997 - DNA, 15 bp, Homo sapiens
acccgtttccaagcc

SEQ ID NO: 2196998 - DNA, 14 bp, Homo sapiens
accctaactgagct

SEQ ID NO: 2196999 - DNA, 13 bp, Homo sapiens
accctctgcaggg

SEQ ID NO: 2197000 - DNA, 16 bp, Homo sapiens
accctctgcagggcag

SEQ ID NO: 2197001 - DNA, 12 bp, Homo sapiens
accctgagccgg

SEQ ID NO: 2197002 - DNA, 22 bp, Homo sapiens
accctgaggtatctgtgttaca

SEQ ID NO: 2197003 - DNA, 22 bp, Homo sapiens
accctgccccccctaagagaca

SEQ ID NO: 2197004 - DNA, 17 bp, Homo sapiens
accctgcttggggcctg

SEQ ID NO: 2197005 - DNA, 15 bp, Homo sapiens
accctgtatggagct

SEQ ID NO: 2197006 - DNA, 14 bp, Homo sapiens
accctgtcctccca

SEQ ID NO: 2197007 - DNA, 14 bp, Homo sapiens
acccttctgtgccc

SEQ ID NO: 2197008 - DNA, 15 bp, Homo sapiens
accgacatttttcaa

SEQ ID NO: 2197009 - DNA, 23 bp, Homo sapiens
accgatttcagcacatgcactac

SEQ ID NO: 2197010 - DNA, 16 bp, Homo sapiens
accgcccgcctctgtc

SEQ ID NO: 2197011 - DNA, 15 bp, Homo sapiens
accggaagctcctgg

SEQ ID NO: 2197012 - DNA, 17 bp, Homo sapiens
accggaagctcctggta

SEQ ID NO: 2197013 - DNA, 11 bp, Homo sapiens
accggcctgga

SEQ ID NO: 2197014 - DNA, 15 bp, Homo sapiens
accgtcgacaagaat

SEQ ID NO: 2197015 - DNA, 21 bp, Homo sapiens
acctaactcacctaactcata

SEQ ID NO: 2197016 - DNA, 14 bp, Homo sapiens
acctaagtgactac

SEQ ID NO: 2197017 - DNA, 20 bp, Homo sapiens
acctactgaggagcaaagca

SEQ ID NO: 2197018 - DNA, 21 bp, Homo sapiens
acctagggttttctatttctt

SEQ ID NO: 2197019 - DNA, 14 bp, Homo sapiens
acctataaatacta

SEQ ID NO: 2197020 - DNA, 15 bp, Homo sapiens
acctcaggttccaaa

SEQ ID NO: 2197021 - DNA, 15 bp, Homo sapiens
acctcagtttctgtt

SEQ ID NO: 2197022 - DNA, 22 bp, Homo sapiens
acctcagtttctgttgtttctt

SEQ ID NO: 2197023 - DNA, 15 bp, Homo sapiens
acctcccacctttgg

SEQ ID NO: 2197024 - DNA, 12 bp, Homo sapiens
acctctccttcc

SEQ ID NO: 2197025 - DNA, 15 bp, Homo sapiens
acctctggccctgtt

SEQ ID NO: 2197026 - DNA, 17 bp, Homo sapiens
acctgactcaggcatca

SEQ ID NO: 2197027 - DNA, 13 bp, Homo sapiens
acctgagctttgg

SEQ ID NO: 2197028 - DNA, 14 bp, Homo sapiens
acctgagctttgga

SEQ ID NO: 2197029 - DNA, 15 bp, Homo sapiens
acctgaggcccagca

SEQ ID NO: 2197030 - DNA, 19 bp, Homo sapiens
acctgatgctaattttcag

SEQ ID NO: 2197031 - DNA, 15 bp, Homo sapiens
acctgcatcagcctc

SEQ ID NO: 2197032 - DNA, 22 bp, Homo sapiens
acctgcatcagcctctggccag

SEQ ID NO: 2197033 - DNA, 23 bp, Homo sapiens
acctgcatcagcctctggccaga

SEQ ID NO: 2197034 - DNA, 21 bp, Homo sapiens
acctgccactaggctgggtgc

SEQ ID NO: 2197035 - DNA, 17 bp, Homo sapiens
acctgcccccactcagc

SEQ ID NO: 2197036 - DNA, 12 bp, Homo sapiens
acctgccctcta

SEQ ID NO: 2197037 - DNA, 15 bp, Homo sapiens
acctgccctctctca

SEQ ID NO: 2197038 - DNA, 16 bp, Homo sapiens
acctgccctctctcag

SEQ ID NO: 2197039 - DNA, 20 bp, Homo sapiens
acctgcgcagggccctctgg

SEQ ID NO: 2197040 - DNA, 17 bp, Homo sapiens
acctggaaccagagcca

SEQ ID NO: 2197041 - DNA, 19 bp, Homo sapiens
acctggaattgtggggcaa

SEQ ID NO: 2197042 - DNA, 15 bp, Homo sapiens
acctgggaatttcag

SEQ ID NO: 2197043 - DNA, 15 bp, Homo sapiens
acctgggatatgaca

SEQ ID NO: 2197044 - DNA, 19 bp, Homo sapiens
acctgggatatgacaagca

SEQ ID NO: 2197045 - DNA, 16 bp, Homo sapiens
acctgggttccccacc

SEQ ID NO: 2197046 - DNA, 22 bp, Homo sapiens
acctgggttccccaccccgggc

SEQ ID NO: 2197047 - DNA, 16 bp, Homo sapiens
acctggtggctggagg

SEQ ID NO: 2197048 - DNA, 19 bp, Homo sapiens
acctgtgcagggccctctg

SEQ ID NO: 2197049 - DNA, 20 bp, Homo sapiens
acctgtgcagggccctctgg

SEQ ID NO: 2197050 - DNA, 18 bp, Homo sapiens
acctgttcaaaatgttaa

SEQ ID NO: 2197051 - DNA, 20 bp, Homo sapiens
acctgttcaaaatgttaata

SEQ ID NO: 2197052 - DNA, 22 bp, Homo sapiens
acctgttctggtagctccacaa

SEQ ID NO: 2197053 - DNA, 15 bp, Homo sapiens
accttaaaaattaga

SEQ ID NO: 2197054 - DNA, 14 bp, Homo sapiens
accttcaaagctga

SEQ ID NO: 2197055 - DNA, 13 bp, Homo sapiens
accttcctgtctt

SEQ ID NO: 2197056 - DNA, 11 bp, Homo sapiens
accttgaaatc

SEQ ID NO: 2197057 - DNA, 15 bp, Homo sapiens
accttgattgcacca

SEQ ID NO: 2197058 - DNA, 20 bp, Homo sapiens
accttgcactattggacttt

SEQ ID NO: 2197059 - DNA, 15 bp, Homo sapiens
accttgttattaact

SEQ ID NO: 2197060 - DNA, 14 bp, Homo sapiens
acctttctgaatgg

SEQ ID NO: 2197061 - DNA, 21 bp, Homo sapiens
accttttttttacggaattcc

SEQ ID NO: 2197062 - DNA, 14 bp, Homo sapiens
acgaggctgggcca

SEQ ID NO: 2197063 - DNA, 22 bp, Homo sapiens
acgatgtcaaccttgtgtgagt

SEQ ID NO: 2197064 - DNA, 22 bp, Homo sapiens
acgatgttaaaacaaattaaaa

SEQ ID NO: 2197065 - DNA, 23 bp, Homo sapiens
acgcaggctgagtgcactggcag

SEQ ID NO: 2197066 - DNA, 18 bp, Homo sapiens
acgctgccatttccctga

SEQ ID NO: 2197067 - DNA, 18 bp, Homo sapiens
acgcttgacaggacagca

SEQ ID NO: 2197068 - DNA, 11 bp, Homo sapiens
acggaactctt

SEQ ID NO: 2197069 - DNA, 13 bp, Homo sapiens
acggaattccaat

SEQ ID NO: 2197070 - DNA, 17 bp, Homo sapiens
acggaattccaatattt

SEQ ID NO: 2197071 - DNA, 15 bp, Homo sapiens
acggcagcctcaacc

SEQ ID NO: 2197072 - DNA, 12 bp, Homo sapiens
acggccactgca

SEQ ID NO: 2197073 - DNA, 12 bp, Homo sapiens
acggcctggctg

SEQ ID NO: 2197074 - DNA, 16 bp, Homo sapiens
acgggagtggccatct

SEQ ID NO: 2197075 - DNA, 18 bp, Homo sapiens
acgggagtggccatctgg

SEQ ID NO: 2197076 - DNA, 16 bp, Homo sapiens
acggtgatattgtgca

SEQ ID NO: 2197077 - DNA, 13 bp, Homo sapiens
acgtatacaataa

SEQ ID NO: 2197078 - DNA, 17 bp, Homo sapiens
acgtattgtgaaatttg

SEQ ID NO: 2197079 - DNA, 18 bp, Homo sapiens
acgtccacccgtttccaa

SEQ ID NO: 2197080 - DNA, 14 bp, Homo sapiens
acgtgagagaaaga

SEQ ID NO: 2197081 - DNA, 18 bp, Homo sapiens
acgtgagagaaagagaga

SEQ ID NO: 2197082 - DNA, 20 bp, Homo sapiens
acgtgagagaaagagagaag

SEQ ID NO: 2197083 - DNA, 21 bp, Homo sapiens
acgtgagagaaagagagaagc

SEQ ID NO: 2197084 - DNA, 20 bp, Homo sapiens
acgtgagctacatgtgtaag

SEQ ID NO: 2197085 - DNA, 14 bp, Homo sapiens
acgtgctggagagt

SEQ ID NO: 2197086 - DNA, 12 bp, Homo sapiens
acgtgtgaggat

SEQ ID NO: 2197087 - DNA, 14 bp, Homo sapiens
acgtttgttcccca

SEQ ID NO: 2197088 - DNA, 21 bp, Homo sapiens
acgtttgttccccttttctgt

SEQ ID NO: 2197089 - DNA, 15 bp, Homo sapiens
actaaactacagaaa

SEQ ID NO: 2197090 - DNA, 17 bp, Homo sapiens
actaaagcagtttttaa

SEQ ID NO: 2197091 - DNA, 12 bp, Homo sapiens
actaactagagc

SEQ ID NO: 2197092 - DNA, 16 bp, Homo sapiens
actaagagaagttgta

SEQ ID NO: 2197093 - DNA, 16 bp, Homo sapiens
agctggcaggagggtg

SEQ ID NO: 2197094 - DNA, 23 bp, Homo sapiens
agctggggacagctttcctgggt

SEQ ID NO: 2197095 - DNA, 23 bp, Homo sapiens
agctggggcccctcggctacccc

SEQ ID NO: 2197096 - DNA, 22 bp, Homo sapiens
agctgggtgagtggggagacac

SEQ ID NO: 2197097 - DNA, 23 bp, Homo sapiens
agctgtatatttgaaactgctaa

SEQ ID NO: 2197098 - DNA, 12 bp, Homo sapiens
agctgtccctgc

SEQ ID NO: 2197099 - DNA, 14 bp, Homo sapiens
agctgtccctgcag

SEQ ID NO: 2197100 - DNA, 15 bp, Homo sapiens
agctgtccctgcagg

SEQ ID NO: 2197101 - DNA, 20 bp, Homo sapiens
agctgtccctgcagggccat

SEQ ID NO: 2197102 - DNA, 11 bp, Homo sapiens
agctgtgaaat

SEQ ID NO: 2197103 - DNA, 15 bp, Homo sapiens
agctgtgaaattgaa

SEQ ID NO: 2197104 - DNA, 20 bp, Homo sapiens
agctgttctgtcccttggag

SEQ ID NO: 2197105 - DNA, 22 bp, Homo sapiens
agctgttctgtcccttggagct

SEQ ID NO: 2197106 - DNA, 14 bp, Homo sapiens
agcttaataatggt

SEQ ID NO: 2197107 - DNA, 15 bp, Homo sapiens
agcttagagcctccc

SEQ ID NO: 2197108 - DNA, 21 bp, Homo sapiens
agcttcaagtctgtgcctgga

SEQ ID NO: 2197109 - DNA, 22 bp, Homo sapiens
agcttccgctttgaaagaagca

SEQ ID NO: 2197110 - DNA, 15 bp, Homo sapiens
agcttctgacctcag

SEQ ID NO: 2197111 - DNA, 16 bp, Homo sapiens
agcttctgacctcagc

SEQ ID NO: 2197112 - DNA, 18 bp, Homo sapiens
agcttctgacctcagcat

SEQ ID NO: 2197113 - DNA, 16 bp, Homo sapiens
agcttgctgcacccca

SEQ ID NO: 2197114 - DNA, 20 bp, Homo sapiens
agcttgctgcaccccaagtc

SEQ ID NO: 2197115 - DNA, 20 bp, Homo sapiens
agcttgctggagagtggcat

SEQ ID NO: 2197116 - DNA, 13 bp, Homo sapiens
agctttcctgggt

SEQ ID NO: 2197117 - DNA, 13 bp, Homo sapiens
agctttctctgct

SEQ ID NO: 2197118 - DNA, 15 bp, Homo sapiens
agctttctctgcttc

SEQ ID NO: 2197119 - DNA, 14 bp, Homo sapiens
agctttggacacac

SEQ ID NO: 2197120 - DNA, 20 bp, Homo sapiens
agctttggacacacacagct

SEQ ID NO: 2197121 - DNA, 19 bp, Homo sapiens
agctttggacgcacacagc

SEQ ID NO: 2197122 - DNA, 13 bp, Homo sapiens
aggaaaaaaaacg

SEQ ID NO: 2197123 - DNA, 17 bp, Homo sapiens
aggaaaaacatgcttaa

SEQ ID NO: 2197124 - DNA, 15 bp, Homo sapiens
aggaaataagccgag

SEQ ID NO: 2197125 - DNA, 22 bp, Homo sapiens
aggaaatattgagagagaagtc

SEQ ID NO: 2197126 - DNA, 15 bp, Homo sapiens
aggaaatctcctctt

SEQ ID NO: 2197127 - DNA, 21 bp, Homo sapiens
aggaaatggtttccatctgta

SEQ ID NO: 2197128 - DNA, 13 bp, Homo sapiens
aggaacctggacc

SEQ ID NO: 2197129 - DNA, 19 bp, Homo sapiens
aggaacctggaccaaagct

SEQ ID NO: 2197130 - DNA, 20 bp, Homo sapiens
aggaacctggaccaaagctg

SEQ ID NO: 2197131 - DNA, 19 bp, Homo sapiens
aggaagaatataatgggaa

SEQ ID NO: 2197132 - DNA, 18 bp, Homo sapiens
aggaagatcactttgctc

SEQ ID NO: 2197133 - DNA, 20 bp, Homo sapiens
aggaagatcactttgctctg

SEQ ID NO: 2197134 - DNA, 20 bp, Homo sapiens
aggaagccacgtgctggaga

SEQ ID NO: 2197135 - DNA, 22 bp, Homo sapiens
aggaagctccagtcctgctctc

SEQ ID NO: 2197136 - DNA, 18 bp, Homo sapiens
aggaagctttctctgctt

SEQ ID NO: 2197137 - DNA, 19 bp, Homo sapiens
aggaagctttctctgcttc

SEQ ID NO: 2197138 - DNA, 16 bp, Homo sapiens
aggaaggggctggact

SEQ ID NO: 2197139 - DNA, 17 bp, Homo sapiens
aggaaggggctggactg

SEQ ID NO: 2197140 - DNA, 16 bp, Homo sapiens
aggaatcttttactgt

SEQ ID NO: 2197141 - DNA, 21 bp, Homo sapiens
aggaatcttttactgtggagg

SEQ ID NO: 2197142 - DNA, 16 bp, Homo sapiens
aggaattcagtgcctt

SEQ ID NO: 2197143 - DNA, 14 bp, Homo sapiens
aggaattttctaaa

SEQ ID NO: 2197144 - DNA, 18 bp, Homo sapiens
aggacagctgcaggtgcc

SEQ ID NO: 2197145 - DNA, 19 bp, Homo sapiens
aggacagctgcaggtgccc

SEQ ID NO: 2197146 - DNA, 17 bp, Homo sapiens
aggacaggaccctcagg

SEQ ID NO: 2197147 - DNA, 20 bp, Homo sapiens
aggacaggaccctcaggaat

SEQ ID NO: 2197148 - DNA, 21 bp, Homo sapiens
aggaccctcaggaattcagtg

SEQ ID NO: 2197149 - DNA, 12 bp, Homo sapiens
aggacctctggg

SEQ ID NO: 2197150 - DNA, 13 bp, Homo sapiens
aggacctctgggc

SEQ ID NO: 2197151 - DNA, 16 bp, Homo sapiens
aggacttgtgcctctt

SEQ ID NO: 2197152 - DNA, 14 bp, Homo sapiens
aggagagagacccc

SEQ ID NO: 2197153 - DNA, 17 bp, Homo sapiens
aggagcattttgtgtct

SEQ ID NO: 2197154 - DNA, 19 bp, Homo sapiens
aggagcctgcggctgctgg

SEQ ID NO: 2197155 - DNA, 13 bp, Homo sapiens
aggagcctgtgcg

SEQ ID NO: 2197156 - DNA, 17 bp, Homo sapiens
aggagcttacctcccac

SEQ ID NO: 2197157 - DNA, 14 bp, Homo sapiens
aggaggcagaaagc

SEQ ID NO: 2197158 - DNA, 20 bp, Homo sapiens
aggagttaaagagcagcctg

SEQ ID NO: 2197159 - DNA, 23 bp, Homo sapiens
aggatatgttcacacctagcgtc

SEQ ID NO: 2197160 - DNA, 21 bp, Homo sapiens
aggatggatagaaggaaacat

SEQ ID NO: 2197161 - DNA, 19 bp, Homo sapiens
aggatgtttcaccaaggaa

SEQ ID NO: 2197162 - DNA, 19 bp, Homo sapiens
aggattccagttgcgtgtc

SEQ ID NO: 2197163 - DNA, 24 bp, Homo sapiens
aggattgaaaatgtccaggaaagt

SEQ ID NO: 2197164 - DNA, 14 bp, Homo sapiens
aggatttggttttt

SEQ ID NO: 2197165 - DNA, 19 bp, Homo sapiens
aggatttggtttttctctt

SEQ ID NO: 2197166 - DNA, 20 bp, Homo sapiens
aggcaaaagagagaagagtc

SEQ ID NO: 2197167 - DNA, 23 bp, Homo sapiens
aggcaaaaggcagtggggctggg

SEQ ID NO: 2197168 - DNA, 19 bp, Homo sapiens
aggcaagctggcaggaggg

SEQ ID NO: 2197169 - DNA, 12 bp, Homo sapiens
aggcaaggctgc

SEQ ID NO: 2197170 - DNA, 19 bp, Homo sapiens
aggcaaggctgccggctgc

SEQ ID NO: 2197171 - DNA, 19 bp, Homo sapiens
aggcaaggggtgcctggga

SEQ ID NO: 2197172 - DNA, 17 bp, Homo sapiens
aggcaattagagaaagt

SEQ ID NO: 2197173 - DNA, 21 bp, Homo sapiens
aggcacagccggggcctgcct

SEQ ID NO: 2197174 - DNA, 15 bp, Homo sapiens
aggcaccaggaagcc

SEQ ID NO: 2197175 - DNA, 16 bp, Homo sapiens
aggcaccaggaagccg

SEQ ID NO: 2197176 - DNA, 12 bp, Homo sapiens
aggcaccattca

SEQ ID NO: 2197177 - DNA, 17 bp, Homo sapiens
aggcaccccctggcttg

SEQ ID NO: 2197178 - DNA, 15 bp, Homo sapiens
aggcactgcacataa

SEQ ID NO: 2197179 - DNA, 18 bp, Homo sapiens
aggcagaaagcagaggct

SEQ ID NO: 2197180 - DNA, 16 bp, Homo sapiens
aggcagaacctggtgg

SEQ ID NO: 2197181 - DNA, 11 bp, Homo sapiens
aggcagagggt

SEQ ID NO: 2197182 - DNA, 17 bp, Homo sapiens
aggcagagtgccccacc

SEQ ID NO: 2197183 - DNA, 12 bp, Homo sapiens
aggcagccttga

SEQ ID NO: 2197184 - DNA, 18 bp, Homo sapiens
aggcaggattgaaaatgt

SEQ ID NO: 2197185 - DNA, 22 bp, Homo sapiens
aggcaggattgaaaatgtccag

SEQ ID NO: 2197186 - DNA, 13 bp, Homo sapiens
aggcaggcctttc

SEQ ID NO: 2197187 - DNA, 14 bp, Homo sapiens
aggcaggcctttcc

SEQ ID NO: 2197188 - DNA, 23 bp, Homo sapiens
aggcaggggctgggcagagggga

SEQ ID NO: 2197189 - DNA, 22 bp, Homo sapiens
aggcagggttttatctctgtct

SEQ ID NO: 2197190 - DNA, 15 bp, Homo sapiens
aggcagtggcagcaa

SEQ ID NO: 2197191 - DNA, 18 bp, Homo sapiens
aggcagtggcaggggagc

SEQ ID NO: 2197192 - DNA, 18 bp, Homo sapiens
aggcagttagagatgcct

SEQ ID NO: 2197193 - DNA, 21 bp, Homo sapiens
aggcagttagagatgcctccc

SEQ ID NO: 2197194 - DNA, 22 bp, Homo sapiens
aggcattcccagaggtggggaa

SEQ ID NO: 2197195 - DNA, 21 bp, Homo sapiens
aggcattgtttttaagaaaaa

SEQ ID NO: 2197196 - DNA, 16 bp, Homo sapiens
aggccaaagacctccc

SEQ ID NO: 2197197 - DNA, 14 bp, Homo sapiens
aggccacactttct

SEQ ID NO: 2197198 - DNA, 21 bp, Homo sapiens
aggccacactttctgggaaat

SEQ ID NO: 2197199 - DNA, 12 bp, Homo sapiens
aggccacctgca

SEQ ID NO: 2197200 - DNA, 14 bp, Homo sapiens
aggccacctgcagg

SEQ ID NO: 2197201 - DNA, 14 bp, Homo sapiens
aggccacgggggag

SEQ ID NO: 2197202 - DNA, 16 bp, Homo sapiens
aggccacgggggaggc

SEQ ID NO: 2197203 - DNA, 23 bp, Homo sapiens
aggccacgggggaggccgaggca

SEQ ID NO: 2197204 - DNA, 12 bp, Homo sapiens
aggccactgacc

SEQ ID NO: 2197205 - DNA, 22 bp, Homo sapiens
aggccactgacctcccactttg

SEQ ID NO: 2197206 - DNA, 22 bp, Homo sapiens
aggcccacctaccttcaaagct

SEQ ID NO: 2197207 - DNA, 24 bp, Homo sapiens
aggcccagctggggcccctcggct

SEQ ID NO: 2197208 - DNA, 13 bp, Homo sapiens
aggccccagaggc

SEQ ID NO: 2197209 - DNA, 18 bp, Homo sapiens
aggccccagaggccctgg

SEQ ID NO: 2197210 - DNA, 22 bp, Homo sapiens
aggccccagaggccctggaggt

SEQ ID NO: 2197211 - DNA, 19 bp, Homo sapiens
aggccccgcgcgccggtgc

SEQ ID NO: 2197212 - DNA, 12 bp, Homo sapiens
aggccctaggcg

SEQ ID NO: 2197213 - DNA, 21 bp, Homo sapiens
aggccctggaggtctccaggg

SEQ ID NO: 2197214 - DNA, 15 bp, Homo sapiens
ataaaatgcatttaa

SEQ ID NO: 2197215 - DNA, 13 bp, Homo sapiens
ataaaattagatt

SEQ ID NO: 2197216 - DNA, 12 bp, Homo sapiens
ataaaattcatt

SEQ ID NO: 2197217 - DNA, 17 bp, Homo sapiens
ataaaattcattccatt

SEQ ID NO: 2197218 - DNA, 20 bp, Homo sapiens
ataaaccttatgaactacag

SEQ ID NO: 2197219 - DNA, 22 bp, Homo sapiens
ataaagcaccagcagtgtttaa

SEQ ID NO: 2197220 - DNA, 18 bp, Homo sapiens
ataaagcactgtttggat

SEQ ID NO: 2197221 - DNA, 13 bp, Homo sapiens
ataaagttaaagt

SEQ ID NO: 2197222 - DNA, 14 bp, Homo sapiens
ataaagttaaattg

SEQ ID NO: 2197223 - DNA, 22 bp, Homo sapiens
ataaatatgtgattatcattta

SEQ ID NO: 2197224 - DNA, 23 bp, Homo sapiens
ataaatatgtgattatcatttat

SEQ ID NO: 2197225 - DNA, 19 bp, Homo sapiens
ataaatggtgagaattaaa

SEQ ID NO: 2197226 - DNA, 13 bp, Homo sapiens
ataaatgtcctaa

SEQ ID NO: 2197227 - DNA, 20 bp, Homo sapiens
ataactgtacaaaaattgtt

SEQ ID NO: 2197228 - DNA, 15 bp, Homo sapiens
ataactgtatttgaa

SEQ ID NO: 2197229 - DNA, 22 bp, Homo sapiens
ataactttagaaataagaagca

SEQ ID NO: 2197230 - DNA, 16 bp, Homo sapiens
ataagaattcagacat

SEQ ID NO: 2197231 - DNA, 20 bp, Homo sapiens
ataaggattctgaagtttta

SEQ ID NO: 2197232 - DNA, 19 bp, Homo sapiens
ataataaaattcattccat

SEQ ID NO: 2197233 - DNA, 23 bp, Homo sapiens
ataatattgcagttcatactgaa

SEQ ID NO: 2197234 - DNA, 22 bp, Homo sapiens
ataatctccttttatgctcacc

SEQ ID NO: 2197235 - DNA, 17 bp, Homo sapiens
ataatcttataattgtt

SEQ ID NO: 2197236 - DNA, 19 bp, Homo sapiens
ataatgacgtattgtgaaa

SEQ ID NO: 2197237 - DNA, 14 bp, Homo sapiens
ataatgacttttaa

SEQ ID NO: 2197238 - DNA, 15 bp, Homo sapiens
ataatgatagtgttt

SEQ ID NO: 2197239 - DNA, 20 bp, Homo sapiens
ataatgccaagggtaaacaa

SEQ ID NO: 2197240 - DNA, 18 bp, Homo sapiens
ataatggttactcatttt

SEQ ID NO: 2197241 - DNA, 19 bp, Homo sapiens
ataatggttactcatttta

SEQ ID NO: 2197242 - DNA, 15 bp, Homo sapiens
ataattaaagaaaat

SEQ ID NO: 2197243 - DNA, 15 bp, Homo sapiens
ataattgtggagagg

SEQ ID NO: 2197244 - DNA, 21 bp, Homo sapiens
ataattgtggagaggagagaa

SEQ ID NO: 2197245 - DNA, 16 bp, Homo sapiens
ataatttagtggatta

SEQ ID NO: 2197246 - DNA, 14 bp, Homo sapiens
ataattttgaccat

SEQ ID NO: 2197247 - DNA, 15 bp, Homo sapiens
ataattttgaccata

SEQ ID NO: 2197248 - DNA, 23 bp, Homo sapiens
ataattttgaccataaattaatt

SEQ ID NO: 2197249 - DNA, 21 bp, Homo sapiens
ataattttttagttaaaatct

SEQ ID NO: 2197250 - DNA, 14 bp, Homo sapiens
atacaaaaaaaagt

SEQ ID NO: 2197251 - DNA, 14 bp, Homo sapiens
atacaatattgcat

SEQ ID NO: 2197252 - DNA, 18 bp, Homo sapiens
atacacaactccactgtc

SEQ ID NO: 2197253 - DNA, 16 bp, Homo sapiens
atacagtgaaatcttt

SEQ ID NO: 2197254 - DNA, 18 bp, Homo sapiens
atacagttattaaaatgt

SEQ ID NO: 2197255 - DNA, 19 bp, Homo sapiens
atacatactatagattctt

SEQ ID NO: 2197256 - DNA, 19 bp, Homo sapiens
atacatagagagagacagt

SEQ ID NO: 2197257 - DNA, 13 bp, Homo sapiens
atacatgaatcat

SEQ ID NO: 2197258 - DNA, 24 bp, Homo sapiens
atacatgggtagcttctgacctca

SEQ ID NO: 2197259 - DNA, 16 bp, Homo sapiens
atacatggtagcaggg

SEQ ID NO: 2197260 - DNA, 12 bp, Homo sapiens
atacatttttaa

SEQ ID NO: 2197261 - DNA, 17 bp, Homo sapiens
ataccaccaacaaatat

SEQ ID NO: 2197262 - DNA, 20 bp, Homo sapiens
ataccaccgacatttttcaa

SEQ ID NO: 2197263 - DNA, 23 bp, Homo sapiens
atacccaaatcctctccagctat

SEQ ID NO: 2197264 - DNA, 15 bp, Homo sapiens
atacccctcatcaca

SEQ ID NO: 2197265 - DNA, 17 bp, Homo sapiens
atacctcattcacagct

SEQ ID NO: 2197266 - DNA, 16 bp, Homo sapiens
atactaataaaataca

SEQ ID NO: 2197267 - DNA, 17 bp, Homo sapiens
atactatagattcttta

SEQ ID NO: 2197268 - DNA, 15 bp, Homo sapiens
atactctttgtcttt

SEQ ID NO: 2197269 - DNA, 20 bp, Homo sapiens
atactgactttttaaatttt

SEQ ID NO: 2197270 - DNA, 22 bp, Homo sapiens
atactgtatgccggctccttca

SEQ ID NO: 2197271 - DNA, 16 bp, Homo sapiens
atacttaaaaatatgt

SEQ ID NO: 2197272 - DNA, 18 bp, Homo sapiens
atacttaaaaatatgtga

SEQ ID NO: 2197273 - DNA, 21 bp, Homo sapiens
atacttaaaaatatgtgagca

SEQ ID NO: 2197274 - DNA, 22 bp, Homo sapiens
atagaagtggtgttttttttcc

SEQ ID NO: 2197275 - DNA, 21 bp, Homo sapiens
atagccaggcctgacctcaag

SEQ ID NO: 2197276 - DNA, 19 bp, Homo sapiens
atagccatttgaagaagga

SEQ ID NO: 2197277 - DNA, 15 bp, Homo sapiens
atagccatttgcccc

SEQ ID NO: 2197278 - DNA, 15 bp, Homo sapiens
atagctacagctgtg

SEQ ID NO: 2197279 - DNA, 18 bp, Homo sapiens
ataggcattaaatgcaaa

SEQ ID NO: 2197280 - DNA, 17 bp, Homo sapiens
atagggcttttaaataa

SEQ ID NO: 2197281 - DNA, 23 bp, Homo sapiens
ataggggttaaggaaaaaaaacg

SEQ ID NO: 2197282 - DNA, 15 bp, Homo sapiens
ataggttttccctgt

SEQ ID NO: 2197283 - DNA, 16 bp, Homo sapiens
ataggttttccctgtt

SEQ ID NO: 2197284 - DNA, 15 bp, Homo sapiens
atagtacctttgctc

SEQ ID NO: 2197285 - DNA, 15 bp, Homo sapiens
atagttcaggatttg

SEQ ID NO: 2197286 - DNA, 23 bp, Homo sapiens
atataaatatattttctttctag

SEQ ID NO: 2197287 - DNA, 18 bp, Homo sapiens
atataaatggtgagaatt

SEQ ID NO: 2197288 - DNA, 23 bp, Homo sapiens
atataaatggtgagaattaaaat

SEQ ID NO: 2197289 - DNA, 17 bp, Homo sapiens
atataactgtatttgaa

SEQ ID NO: 2197290 - DNA, 20 bp, Homo sapiens
atataactgtatttgaaata

SEQ ID NO: 2197291 - DNA, 14 bp, Homo sapiens
atataagtttcttt

SEQ ID NO: 2197292 - DNA, 17 bp, Homo sapiens
atataagtttctttaga

SEQ ID NO: 2197293 - DNA, 13 bp, Homo sapiens
atatactgcagct

SEQ ID NO: 2197294 - DNA, 15 bp, Homo sapiens
atatactgcagcttt

SEQ ID NO: 2197295 - DNA, 21 bp, Homo sapiens
atatactgtcgcatcttttta

SEQ ID NO: 2197296 - DNA, 18 bp, Homo sapiens
atataggggttaaggaaa

SEQ ID NO: 2197297 - DNA, 18 bp, Homo sapiens
atatatgatttgcatgtg

SEQ ID NO: 2197298 - DNA, 15 bp, Homo sapiens
atatattataagatt

SEQ ID NO: 2197299 - DNA, 13 bp, Homo sapiens
atatattattata

SEQ ID NO: 2197300 - DNA, 13 bp, Homo sapiens
atatattctttcc

SEQ ID NO: 2197301 - DNA, 18 bp, Homo sapiens
atatattttctttctagt

SEQ ID NO: 2197302 - DNA, 20 bp, Homo sapiens
atatattttctttctagttt

SEQ ID NO: 2197303 - DNA, 13 bp, Homo sapiens
atatatttttcta

SEQ ID NO: 2197304 - DNA, 14 bp, Homo sapiens
atatcaatatggtg

SEQ ID NO: 2197305 - DNA, 19 bp, Homo sapiens
atatcactttgtattctct

SEQ ID NO: 2197306 - DNA, 21 bp, Homo sapiens
atatcctgaaagcattatttt

SEQ ID NO: 2197307 - DNA, 17 bp, Homo sapiens
atatctacctgccctct

SEQ ID NO: 2197308 - DNA, 18 bp, Homo sapiens
atatctacctgccctctc

SEQ ID NO: 2197309 - DNA, 23 bp, Homo sapiens
atatctacctgccctctctcagt

SEQ ID NO: 2197310 - DNA, 13 bp, Homo sapiens
atatgatcaaata

SEQ ID NO: 2197311 - DNA, 16 bp, Homo sapiens
atatgatttgcatgtg

SEQ ID NO: 2197312 - DNA, 16 bp, Homo sapiens
atatgtatttgttgaa

SEQ ID NO: 2197313 - DNA, 13 bp, Homo sapiens
atatgtgattttc

SEQ ID NO: 2197314 - DNA, 15 bp, Homo sapiens
atattaaaaattgaa

SEQ ID NO: 2197315 - DNA, 16 bp, Homo sapiens
atattaaaaattgaaa

SEQ ID NO: 2197316 - DNA, 14 bp, Homo sapiens
atattaaaatcaca

SEQ ID NO: 2197317 - DNA, 21 bp, Homo sapiens
atattaaaggtgaaaattgta

SEQ ID NO: 2197318 - DNA, 23 bp, Homo sapiens
atattaagtaatttccccactct

SEQ ID NO: 2197319 - DNA, 18 bp, Homo sapiens
atattattataatcttat

SEQ ID NO: 2197320 - DNA, 19 bp, Homo sapiens
atattattataatcttata

SEQ ID NO: 2197321 - DNA, 21 bp, Homo sapiens
atattattataatcttataat

SEQ ID NO: 2197322 - DNA, 23 bp, Homo sapiens
atattattataatcttataattg

SEQ ID NO: 2197323 - DNA, 16 bp, Homo sapiens
atattcaaaaattata

SEQ ID NO: 2197324 - DNA, 17 bp, Homo sapiens
atattcatacctgttgt

SEQ ID NO: 2197325 - DNA, 14 bp, Homo sapiens
atattcccatggta

SEQ ID NO: 2197326 - DNA, 13 bp, Homo sapiens
atattctttccat

SEQ ID NO: 2197327 - DNA, 13 bp, Homo sapiens
atattgataataa

SEQ ID NO: 2197328 - DNA, 15 bp, Homo sapiens
atattgataataaaa

SEQ ID NO: 2197329 - DNA, 16 bp, Homo sapiens
atattgataataaaat

SEQ ID NO: 2197330 - DNA, 16 bp, Homo sapiens
atattgctatgtaatt

SEQ ID NO: 2197331 - DNA, 17 bp, Homo sapiens
atatttataattaaaga

SEQ ID NO: 2197332 - DNA, 19 bp, Homo sapiens
atatttataattaaagaaa

SEQ ID NO: 2197333 - DNA, 13 bp, Homo sapiens
atatttcttaagt

SEQ ID NO: 2197334 - DNA, 14 bp, Homo sapiens
atatttgtaaaaat

SEQ ID NO: 2197335 - DNA, 17 bp, Homo sapiens
atatttgtctcattttg

SEQ ID NO: 2197336 - DNA, 20 bp, Homo sapiens
attttgaacaactcgaatca

SEQ ID NO: 2197337 - DNA, 16 bp, Homo sapiens
attttgcgatgtgttt

SEQ ID NO: 2197338 - DNA, 22 bp, Homo sapiens
attttggatctatcacctgtca

SEQ ID NO: 2197339 - DNA, 13 bp, Homo sapiens
attttgtatgtat

SEQ ID NO: 2197340 - DNA, 15 bp, Homo sapiens
atttttacttgtatg

SEQ ID NO: 2197341 - DNA, 17 bp, Homo sapiens
atttttaggtgtctttt

SEQ ID NO: 2197342 - DNA, 16 bp, Homo sapiens
atttttatctaattca

SEQ ID NO: 2197343 - DNA, 18 bp, Homo sapiens
atttttcctcaaagattc

SEQ ID NO: 2197344 - DNA, 14 bp, Homo sapiens
atttttctttccaa

SEQ ID NO: 2197345 - DNA, 13 bp, Homo sapiens
atttttgtactgt

SEQ ID NO: 2197346 - DNA, 15 bp, Homo sapiens
atttttgtactgtgc

SEQ ID NO: 2197347 - DNA, 16 bp, Homo sapiens
atttttgtactgtgct

SEQ ID NO: 2197348 - DNA, 16 bp, Homo sapiens
atttttgtttctacct

SEQ ID NO: 2197349 - DNA, 16 bp, Homo sapiens
atttttttaaatttgc

SEQ ID NO: 2197350 - DNA, 13 bp, Homo sapiens
atttttttattct

SEQ ID NO: 2197351 - DNA, 14 bp, Homo sapiens
attttttttaactg

SEQ ID NO: 2197352 - DNA, 20 bp, Homo sapiens
attttttttctgaacaaaag

SEQ ID NO: 2197353 - DNA, 17 bp, Homo sapiens
attttttttttaacttg

SEQ ID NO: 2197354 - DNA, 21 bp, Homo sapiens
caaaaaaacctttattcttta

SEQ ID NO: 2197355 - DNA, 21 bp, Homo sapiens
caaaaacaaagtgcaaagctg

SEQ ID NO: 2197356 - DNA, 17 bp, Homo sapiens
caaaaactttttgttgt

SEQ ID NO: 2197357 - DNA, 16 bp, Homo sapiens
caaaaagaaagctgtg

SEQ ID NO: 2197358 - DNA, 21 bp, Homo sapiens
caaaaagccaacaaaccaaga

SEQ ID NO: 2197359 - DNA, 22 bp, Homo sapiens
caaaacatgctacctgatccca

SEQ ID NO: 2197360 - DNA, 16 bp, Homo sapiens
caaaactggaactgtt

SEQ ID NO: 2197361 - DNA, 13 bp, Homo sapiens
caaaactgtaact

SEQ ID NO: 2197362 - DNA, 22 bp, Homo sapiens
caaaactttttgaccagtttct

SEQ ID NO: 2197363 - DNA, 23 bp, Homo sapiens
caaaactttttgaccagtttctt

SEQ ID NO: 2197364 - DNA, 20 bp, Homo sapiens
caaaaggcagtggggctggg

SEQ ID NO: 2197365 - DNA, 16 bp, Homo sapiens
caaaatccccttctca

SEQ ID NO: 2197366 - DNA, 20 bp, Homo sapiens
caaaatgtgaactgactttt

SEQ ID NO: 2197367 - DNA, 21 bp, Homo sapiens
caaaatgttaataaaggtttc

SEQ ID NO: 2197368 - DNA, 17 bp, Homo sapiens
caaaccacgcctcttga

SEQ ID NO: 2197369 - DNA, 16 bp, Homo sapiens
caaaccactgtacata

SEQ ID NO: 2197370 - DNA, 13 bp, Homo sapiens
caaaccctgttta

SEQ ID NO: 2197371 - DNA, 13 bp, Homo sapiens
caaacctctcctt

SEQ ID NO: 2197372 - DNA, 20 bp, Homo sapiens
caaacctctccttcctcaga

SEQ ID NO: 2197373 - DNA, 16 bp, Homo sapiens
caaacctgccccatcc

SEQ ID NO: 2197374 - DNA, 20 bp, Homo sapiens
caaactatattttaataatt

SEQ ID NO: 2197375 - DNA, 17 bp, Homo sapiens
caaactcatccattaat

SEQ ID NO: 2197376 - DNA, 15 bp, Homo sapiens
caaagaccaatgtga

SEQ ID NO: 2197377 - DNA, 14 bp, Homo sapiens
caaagatgataatt

SEQ ID NO: 2197378 - DNA, 19 bp, Homo sapiens
caaagattctgcattttaa

SEQ ID NO: 2197379 - DNA, 22 bp, Homo sapiens
caaagattttacctgggatatg

SEQ ID NO: 2197380 - DNA, 21 bp, Homo sapiens
caaagcaagctcttctcctca

SEQ ID NO: 2197381 - DNA, 21 bp, Homo sapiens
caaagccaccaagggcctcac

SEQ ID NO: 2197382 - DNA, 13 bp, Homo sapiens
caaagctaccttt

SEQ ID NO: 2197383 - DNA, 23 bp, Homo sapiens
caaagctaccttttttttacgga

SEQ ID NO: 2197384 - DNA, 15 bp, Homo sapiens
caaagctgcttgaat

SEQ ID NO: 2197385 - DNA, 15 bp, Homo sapiens
caaagctttcctgga

SEQ ID NO: 2197386 - DNA, 17 bp, Homo sapiens
caaaggaagtagcaggc

SEQ ID NO: 2197387 - DNA, 18 bp, Homo sapiens
caaaggaagtagcaggcc

SEQ ID NO: 2197388 - DNA, 15 bp, Homo sapiens
caaagggacattgaa

SEQ ID NO: 2197389 - DNA, 22 bp, Homo sapiens
caaagtgctagccactggaaat

SEQ ID NO: 2197390 - DNA, 15 bp, Homo sapiens
caaagtggaattaaa

SEQ ID NO: 2197391 - DNA, 21 bp, Homo sapiens
caaagttaacctacctgtaac

SEQ ID NO: 2197392 - DNA, 16 bp, Homo sapiens
caaagtttttacagtg

SEQ ID NO: 2197393 - DNA, 16 bp, Homo sapiens
caaataaagcctttta

SEQ ID NO: 2197394 - DNA, 22 bp, Homo sapiens
caaatcctccctacttccaaga

SEQ ID NO: 2197395 - DNA, 18 bp, Homo sapiens
caaatctcctctttgtga

SEQ ID NO: 2197396 - DNA, 13 bp, Homo sapiens
caaatctgtaatt

SEQ ID NO: 2197397 - DNA, 21 bp, Homo sapiens
caaatgagatgtatgcccaaa

SEQ ID NO: 2197398 - DNA, 13 bp, Homo sapiens
caaatgggactga

SEQ ID NO: 2197399 - DNA, 17 bp, Homo sapiens
caaatgggactgatgtc

SEQ ID NO: 2197400 - DNA, 21 bp, Homo sapiens
caaatgggactgatgtcatct

SEQ ID NO: 2197401 - DNA, 21 bp, Homo sapiens
caaatgtggcaattattttgg

SEQ ID NO: 2197402 - DNA, 15 bp, Homo sapiens
caaattactgataaa

SEQ ID NO: 2197403 - DNA, 15 bp, Homo sapiens
caaattccaatacat

SEQ ID NO: 2197404 - DNA, 20 bp, Homo sapiens
caacaacatcagaaagaatt

SEQ ID NO: 2197405 - DNA, 13 bp, Homo sapiens
caacaataaaaaa

SEQ ID NO: 2197406 - DNA, 17 bp, Homo sapiens
caacaataaaaaaaaac

SEQ ID NO: 2197407 - DNA, 14 bp, Homo sapiens
caacacaaggtggg

SEQ ID NO: 2197408 - DNA, 21 bp, Homo sapiens
caacacaaggtgggcagggag

SEQ ID NO: 2197409 - DNA, 14 bp, Homo sapiens
caacaccaggactt

SEQ ID NO: 2197410 - DNA, 21 bp, Homo sapiens
caacactgccagaagtgtgtt

SEQ ID NO: 2197411 - DNA, 14 bp, Homo sapiens
caacaggcacctct

SEQ ID NO: 2197412 - DNA, 21 bp, Homo sapiens
caacatggaaaaatcctgtca

SEQ ID NO: 2197413 - DNA, 22 bp, Homo sapiens
caacccaggagcatccacctcc

SEQ ID NO: 2197414 - DNA, 19 bp, Homo sapiens
caacctccacctcccaggt

SEQ ID NO: 2197415 - DNA, 18 bp, Homo sapiens
caacgcaaacctctcctt

SEQ ID NO: 2197416 - DNA, 21 bp, Homo sapiens
caacgcaaacctctccttcct

SEQ ID NO: 2197417 - DNA, 21 bp, Homo sapiens
caacgcctgccttctgggcaa

SEQ ID NO: 2197418 - DNA, 13 bp, Homo sapiens
caactccttcctc

SEQ ID NO: 2197419 - DNA, 22 bp, Homo sapiens
caactgatcatttgcagctgct

SEQ ID NO: 2197420 - DNA, 23 bp, Homo sapiens
caactgatcatttgcagctgctg

SEQ ID NO: 2197421 - DNA, 15 bp, Homo sapiens
caactgtttccctgc

SEQ ID NO: 2197422 - DNA, 17 bp, Homo sapiens
caactgtttccctgctg

SEQ ID NO: 2197423 - DNA, 17 bp, Homo sapiens
caagaacagcaggccca

SEQ ID NO: 2197424 - DNA, 19 bp, Homo sapiens
caagacacgtggcctcgtg

SEQ ID NO: 2197425 - DNA, 22 bp, Homo sapiens
caagaccatttcacagaaaaca

SEQ ID NO: 2197426 - DNA, 16 bp, Homo sapiens
caagacgaggggcagg

SEQ ID NO: 2197427 - DNA, 16 bp, Homo sapiens
caagacggggagtgag

SEQ ID NO: 2197428 - DNA, 21 bp, Homo sapiens
caagacggggagtgagactcc

SEQ ID NO: 2197429 - DNA, 21 bp, Homo sapiens
caagactgactggcaccaaca

SEQ ID NO: 2197430 - DNA, 21 bp, Homo sapiens
caagacttcagattcagccga

SEQ ID NO: 2197431 - DNA, 16 bp, Homo sapiens
caagagggcaaagctg

SEQ ID NO: 2197432 - DNA, 18 bp, Homo sapiens
caagagggcaaagctgat

SEQ ID NO: 2197433 - DNA, 11 bp, Homo sapiens
caagcaaagca

SEQ ID NO: 2197434 - DNA, 14 bp, Homo sapiens
caagcaatcctcct

SEQ ID NO: 2197435 - DNA, 15 bp, Homo sapiens
caagcaatcctcctg

SEQ ID NO: 2197436 - DNA, 17 bp, Homo sapiens
caagcaatcctcctgag

SEQ ID NO: 2197437 - DNA, 16 bp, Homo sapiens
caagcaccagggaaga

SEQ ID NO: 2197438 - DNA, 19 bp, Homo sapiens
caagccagggatggggcca

SEQ ID NO: 2197439 - DNA, 14 bp, Homo sapiens
caagccggtgccca

SEQ ID NO: 2197440 - DNA, 15 bp, Homo sapiens
caagcctcttctgaa

SEQ ID NO: 2197441 - DNA, 16 bp, Homo sapiens
caagcctgggccactg

SEQ ID NO: 2197442 - DNA, 19 bp, Homo sapiens
caagcctgggccactggca

SEQ ID NO: 2197443 - DNA, 20 bp, Homo sapiens
caagcctgggccactggcat

SEQ ID NO: 2197444 - DNA, 15 bp, Homo sapiens
caagcctggtctcct

SEQ ID NO: 2197445 - DNA, 21 bp, Homo sapiens
caagcgatccctcccctcagc

SEQ ID NO: 2197446 - DNA, 15 bp, Homo sapiens
caagctaggccccag

SEQ ID NO: 2197447 - DNA, 22 bp, Homo sapiens
caagctaggccccagaggccct

SEQ ID NO: 2197448 - DNA, 12 bp, Homo sapiens
caagctgcctcc

SEQ ID NO: 2197449 - DNA, 20 bp, Homo sapiens
caagctgcctccctgtccac

SEQ ID NO: 2197450 - DNA, 14 bp, Homo sapiens
caagctggcaggag

SEQ ID NO: 2197451 - DNA, 17 bp, Homo sapiens
caagctggcaggagggt

SEQ ID NO: 2197452 - DNA, 17 bp, Homo sapiens
caagctgtccctgcagg

SEQ ID NO: 2197453 - DNA, 20 bp, Homo sapiens
caagctgtccctgcagggcc

SEQ ID NO: 2197454 - DNA, 21 bp, Homo sapiens
caagctgtccctgcagggcca

SEQ ID NO: 2197455 - DNA, 22 bp, Homo sapiens
caagctgtccctgcagggccat

SEQ ID NO: 2197456 - DNA, 16 bp, Homo sapiens
caaggcaggcctttcc

SEQ ID NO: 2197457 - DNA, 18 bp, Homo sapiens
cagggtcctccggggctc

SEQ ID NO: 2197458 - DNA, 22 bp, Homo sapiens
cagggtgaggtgcttgccccca

SEQ ID NO: 2197459 - DNA, 19 bp, Homo sapiens
cagggttttatctctgtct

SEQ ID NO: 2197460 - DNA, 18 bp, Homo sapiens
caggtccagagtatgagt

SEQ ID NO: 2197461 - DNA, 13 bp, Homo sapiens
caggtcgggctca

SEQ ID NO: 2197462 - DNA, 16 bp, Homo sapiens
caggtcgggctcagct

SEQ ID NO: 2197463 - DNA, 18 bp, Homo sapiens
caggtcgggctcagctct

SEQ ID NO: 2197464 - DNA, 17 bp, Homo sapiens
caggtctgggagaggca

SEQ ID NO: 2197465 - DNA, 23 bp, Homo sapiens
caggtgaccaaaatccccttctc

SEQ ID NO: 2197466 - DNA, 16 bp, Homo sapiens
caggtgtccccagccc

SEQ ID NO: 2197467 - DNA, 17 bp, Homo sapiens
caggtgtccccagccca

SEQ ID NO: 2197468 - DNA, 20 bp, Homo sapiens
caggtgtccccagcccactg

SEQ ID NO: 2197469 - DNA, 21 bp, Homo sapiens
caggtgtccccagcccactgg

SEQ ID NO: 2197470 - DNA, 21 bp, Homo sapiens
caggttccccaagggccctgg

SEQ ID NO: 2197471 - DNA, 22 bp, Homo sapiens
caggttccccaagggccctggc

SEQ ID NO: 2197472 - DNA, 16 bp, Homo sapiens
caggttggcttttttc

SEQ ID NO: 2197473 - DNA, 18 bp, Homo sapiens
caggttggcttttttccc

SEQ ID NO: 2197474 - DNA, 16 bp, Homo sapiens
cagtaagaccggaagc

SEQ ID NO: 2197475 - DNA, 17 bp, Homo sapiens
cagtaagaccggaagct

SEQ ID NO: 2197476 - DNA, 15 bp, Homo sapiens
cagtacccacctgag

SEQ ID NO: 2197477 - DNA, 19 bp, Homo sapiens
cagtacccacctgagcttt

SEQ ID NO: 2197478 - DNA, 22 bp, Homo sapiens
cagtatgatggcaggagaatca

SEQ ID NO: 2197479 - DNA, 12 bp, Homo sapiens
cagtatgtgtct

SEQ ID NO: 2197480 - DNA, 18 bp, Homo sapiens
cagtattgtgtaaaggaa

SEQ ID NO: 2197481 - DNA, 17 bp, Homo sapiens
cagtccagttttgtgtg

SEQ ID NO: 2197482 - DNA, 18 bp, Homo sapiens
cagtcctgctctctaccc

SEQ ID NO: 2197483 - DNA, 14 bp, Homo sapiens
cagtctctccctgg

SEQ ID NO: 2197484 - DNA, 15 bp, Homo sapiens
cagtctctccctggg

SEQ ID NO: 2197485 - DNA, 23 bp, Homo sapiens
cagtctggcagttgctaaatttg

SEQ ID NO: 2197486 - DNA, 17 bp, Homo sapiens
cagtctgtcacccaggc

SEQ ID NO: 2197487 - DNA, 21 bp, Homo sapiens
cagtctgtcacccaggctgga

SEQ ID NO: 2197488 - DNA, 20 bp, Homo sapiens
cagtgaaatcttttatgttt

SEQ ID NO: 2197489 - DNA, 14 bp, Homo sapiens
cagtgactcctgct

SEQ ID NO: 2197490 - DNA, 16 bp, Homo sapiens
cagtgactcctgctgg

SEQ ID NO: 2197491 - DNA, 22 bp, Homo sapiens
cagtgactcctgctggtacctg

SEQ ID NO: 2197492 - DNA, 14 bp, Homo sapiens
cagtgagacacaga

SEQ ID NO: 2197493 - DNA, 19 bp, Homo sapiens
cagtgagacacagagtgga

SEQ ID NO: 2197494 - DNA, 14 bp, Homo sapiens
cagtgagctcagga

SEQ ID NO: 2197495 - DNA, 19 bp, Homo sapiens
cagtgccaagtctcaggag

SEQ ID NO: 2197496 - DNA, 20 bp, Homo sapiens
cagtgcccagtgatggcatt

SEQ ID NO: 2197497 - DNA, 15 bp, Homo sapiens
cagtggactgtgtcc

SEQ ID NO: 2197498 - DNA, 16 bp, Homo sapiens
cagtggcaggggagca

SEQ ID NO: 2197499 - DNA, 11 bp, Homo sapiens
cagtggcctta

SEQ ID NO: 2197500 - DNA, 23 bp, Homo sapiens
cagtgggagactaagatgtatta

SEQ ID NO: 2197501 - DNA, 19 bp, Homo sapiens
cagtggggtttttttgtct

SEQ ID NO: 2197502 - DNA, 20 bp, Homo sapiens
cagtggggtttttttgtctt

SEQ ID NO: 2197503 - DNA, 16 bp, Homo sapiens
cagtggttgcctgggg

SEQ ID NO: 2197504 - DNA, 17 bp, Homo sapiens
cagtggttgcctggggg

SEQ ID NO: 2197505 - DNA, 15 bp, Homo sapiens
cagtgtatctcgaag

SEQ ID NO: 2197506 - DNA, 17 bp, Homo sapiens
cagtgtgccaccctctg

SEQ ID NO: 2197507 - DNA, 13 bp, Homo sapiens
cagtgtgtctcct

SEQ ID NO: 2197508 - DNA, 19 bp, Homo sapiens
cagtgtgtctcctgcatgc

SEQ ID NO: 2197509 - DNA, 16 bp, Homo sapiens
cagtgtttggtgacat

SEQ ID NO: 2197510 - DNA, 15 bp, Homo sapiens
cagttagagatgcct

SEQ ID NO: 2197511 - DNA, 21 bp, Homo sapiens
cagttatctttagcagatatt

SEQ ID NO: 2197512 - DNA, 17 bp, Homo sapiens
cagttattagaacttag

SEQ ID NO: 2197513 - DNA, 13 bp, Homo sapiens
cagttgaataatt

SEQ ID NO: 2197514 - DNA, 15 bp, Homo sapiens
cagttgaataatttg

SEQ ID NO: 2197515 - DNA, 22 bp, Homo sapiens
cagttgacatccaggatggctg

SEQ ID NO: 2197516 - DNA, 12 bp, Homo sapiens
cagtttcccaga

SEQ ID NO: 2197517 - DNA, 12 bp, Homo sapiens
cagtttctgttg

SEQ ID NO: 2197518 - DNA, 15 bp, Homo sapiens
cagtttgataactag

SEQ ID NO: 2197519 - DNA, 14 bp, Homo sapiens
cagtttggctgtaa

SEQ ID NO: 2197520 - DNA, 20 bp, Homo sapiens
cagttttgtgtgctttacta

SEQ ID NO: 2197521 - DNA, 12 bp, Homo sapiens
cataaaacaaaa

SEQ ID NO: 2197522 - DNA, 23 bp, Homo sapiens
cataaaacaaaaccaagccttgg

SEQ ID NO: 2197523 - DNA, 17 bp, Homo sapiens
cataaagcaccagcagt

SEQ ID NO: 2197524 - DNA, 19 bp, Homo sapiens
cataaagcaccagcagtgt

SEQ ID NO: 2197525 - DNA, 19 bp, Homo sapiens
cataaaggtttacagtgaa

SEQ ID NO: 2197526 - DNA, 15 bp, Homo sapiens
cataagctagaaaaa

SEQ ID NO: 2197527 - DNA, 22 bp, Homo sapiens
catacagagtgggccccgggct

SEQ ID NO: 2197528 - DNA, 14 bp, Homo sapiens
catacataaactgt

SEQ ID NO: 2197529 - DNA, 15 bp, Homo sapiens
catactatagattct

SEQ ID NO: 2197530 - DNA, 21 bp, Homo sapiens
catactatagattctttatta

SEQ ID NO: 2197531 - DNA, 16 bp, Homo sapiens
catactctgtctccct

SEQ ID NO: 2197532 - DNA, 19 bp, Homo sapiens
catactgtgctggagccac

SEQ ID NO: 2197533 - DNA, 23 bp, Homo sapiens
catacttcatcgcagtggactgt

SEQ ID NO: 2197534 - DNA, 21 bp, Homo sapiens
catagagagagacagttttcc

SEQ ID NO: 2197535 - DNA, 20 bp, Homo sapiens
catatacatatgatcaaata

SEQ ID NO: 2197536 - DNA, 21 bp, Homo sapiens
catatattataagatttttag

SEQ ID NO: 2197537 - DNA, 19 bp, Homo sapiens
catatccatgttgctgact

SEQ ID NO: 2197538 - DNA, 17 bp, Homo sapiens
catatgatcaaatactc

SEQ ID NO: 2197539 - DNA, 11 bp, Homo sapiens
catattaaaat

SEQ ID NO: 2197540 - DNA, 16 bp, Homo sapiens
catattgataataaaa

SEQ ID NO: 2197541 - DNA, 17 bp, Homo sapiens
catatttttagatacag

SEQ ID NO: 2197542 - DNA, 23 bp, Homo sapiens
catcagcagtgattgaagtatct

SEQ ID NO: 2197543 - DNA, 13 bp, Homo sapiens
catcaggactctt

SEQ ID NO: 2197544 - DNA, 15 bp, Homo sapiens
catcagtattgtgta

SEQ ID NO: 2197545 - DNA, 18 bp, Homo sapiens
catcagtattgtgtaaag

SEQ ID NO: 2197546 - DNA, 23 bp, Homo sapiens
catcagtattgtgtaaaggaaca

SEQ ID NO: 2197547 - DNA, 19 bp, Homo sapiens
catccaacatttcctcagg

SEQ ID NO: 2197548 - DNA, 21 bp, Homo sapiens
catccaactcctggagatttc

SEQ ID NO: 2197549 - DNA, 19 bp, Homo sapiens
catccacacaacaccagga

SEQ ID NO: 2197550 - DNA, 12 bp, Homo sapiens
catccacctcct

SEQ ID NO: 2197551 - DNA, 15 bp, Homo sapiens
catccacctccttct

SEQ ID NO: 2197552 - DNA, 20 bp, Homo sapiens
catccattaatgtagataaa

SEQ ID NO: 2197553 - DNA, 17 bp, Homo sapiens
catccgtgagcagtgtg

SEQ ID NO: 2197554 - DNA, 23 bp, Homo sapiens
catccgtgagcagtgtgtctcct

SEQ ID NO: 2197555 - DNA, 19 bp, Homo sapiens
catcctgaccagctgctcc

SEQ ID NO: 2197556 - DNA, 15 bp, Homo sapiens
catcctgtcccacca

SEQ ID NO: 2197557 - DNA, 22 bp, Homo sapiens
catcgctgtccaagtgtttctt

SEQ ID NO: 2197558 - DNA, 15 bp, Homo sapiens
catctactacagggt

SEQ ID NO: 2197559 - DNA, 22 bp, Homo sapiens
catctccctcgaacccacactg

SEQ ID NO: 2197560 - DNA, 21 bp, Homo sapiens
catctgactgccaagccagat

SEQ ID NO: 2197561 - DNA, 20 bp, Homo sapiens
catcttgcctccatggtgcc

SEQ ID NO: 2197562 - DNA, 14 bp, Homo sapiens
catcttttgggaag

SEQ ID NO: 2197563 - DNA, 17 bp, Homo sapiens
catcttttgggaagcca

SEQ ID NO: 2197564 - DNA, 18 bp, Homo sapiens
catgaaggatcaaaaaat

SEQ ID NO: 2197565 - DNA, 21 bp, Homo sapiens
catgaatacgtaaactgcgta

SEQ ID NO: 2197566 - DNA, 15 bp, Homo sapiens
catgaattaagaact

SEQ ID NO: 2197567 - DNA, 17 bp, Homo sapiens
catgacatttctcaaag

SEQ ID NO: 2197568 - DNA, 14 bp, Homo sapiens
catgaggaggcaga

SEQ ID NO: 2197569 - DNA, 16 bp, Homo sapiens
catgattttggccact

SEQ ID NO: 2197570 - DNA, 22 bp, Homo sapiens
catgcaaaccaggagcattttg

SEQ ID NO: 2197571 - DNA, 14 bp, Homo sapiens
catgcacagaacaa

SEQ ID NO: 2197572 - DNA, 18 bp, Homo sapiens
catgcagaaagggagcag

SEQ ID NO: 2197573 - DNA, 19 bp, Homo sapiens
catgcagtcttgtactgtg

SEQ ID NO: 2197574 - DNA, 13 bp, Homo sapiens
catgctgctatga

SEQ ID NO: 2197575 - DNA, 22 bp, Homo sapiens
catgctttggaaatttggaaga

SEQ ID NO: 2197576 - DNA, 16 bp, Homo sapiens
catggaaaaatcctgt

SEQ ID NO: 2197577 - DNA, 22 bp, Homo sapiens
catggcaataaatggctcgtgg

SEQ ID NO: 2197578 - DNA, 15 bp, Homo sapiens
ccctcagtgtgaagc

SEQ ID NO: 2197579 - DNA, 22 bp, Homo sapiens
ccctccatgtagaagagggaga

SEQ ID NO: 2197580 - DNA, 14 bp, Homo sapiens
ccctcccctgccct

SEQ ID NO: 2197581 - DNA, 13 bp, Homo sapiens
ccctccctgcagg

SEQ ID NO: 2197582 - DNA, 20 bp, Homo sapiens
ccctcctccctttttccttg

SEQ ID NO: 2197583 - DNA, 13 bp, Homo sapiens
ccctccttccctg

SEQ ID NO: 2197584 - DNA, 18 bp, Homo sapiens
ccctccttccctggtcca

SEQ ID NO: 2197585 - DNA, 19 bp, Homo sapiens
ccctctaatgctcacgctc

SEQ ID NO: 2197586 - DNA, 12 bp, Homo sapiens
ccctctcagagc

SEQ ID NO: 2197587 - DNA, 21 bp, Homo sapiens
ccctctcagagctacttgggc

SEQ ID NO: 2197588 - DNA, 21 bp, Homo sapiens
ccctctcaggtgaccaaaatc

SEQ ID NO: 2197589 - DNA, 15 bp, Homo sapiens
ccctctgctccacag

SEQ ID NO: 2197590 - DNA, 18 bp, Homo sapiens
ccctctggggctcagccc

SEQ ID NO: 2197591 - DNA, 23 bp, Homo sapiens
ccctctgttcagtaacagggcct

SEQ ID NO: 2197592 - DNA, 16 bp, Homo sapiens
ccctgagctggcgtca

SEQ ID NO: 2197593 - DNA, 20 bp, Homo sapiens
ccctgagctggcgtcacctg

SEQ ID NO: 2197594 - DNA, 19 bp, Homo sapiens
ccctgcacacggcacagag

SEQ ID NO: 2197595 - DNA, 22 bp, Homo sapiens
ccctgcagggccatctgactgc

SEQ ID NO: 2197596 - DNA, 15 bp, Homo sapiens
ccctgccctcctgcc

SEQ ID NO: 2197597 - DNA, 13 bp, Homo sapiens
ccctgctacctgt

SEQ ID NO: 2197598 - DNA, 17 bp, Homo sapiens
ccctgctcagctggccg

SEQ ID NO: 2197599 - DNA, 18 bp, Homo sapiens
ccctgcttggggcctggc

SEQ ID NO: 2197600 - DNA, 10 bp, Homo sapiens
ccctgctttt

SEQ ID NO: 2197601 - DNA, 19 bp, Homo sapiens
ccctggaatcgaggctgtg

SEQ ID NO: 2197602 - DNA, 17 bp, Homo sapiens
ccctggaccagatgctg

SEQ ID NO: 2197603 - DNA, 18 bp, Homo sapiens
ccctggaggccgctgctg

SEQ ID NO: 2197604 - DNA, 11 bp, Homo sapiens
ccctggcaccc

SEQ ID NO: 2197605 - DNA, 15 bp, Homo sapiens
ccctggccatctctg

SEQ ID NO: 2197606 - DNA, 15 bp, Homo sapiens
ccctgtcctcccacc

SEQ ID NO: 2197607 - DNA, 18 bp, Homo sapiens
ccctgtccttcccacggc

SEQ ID NO: 2197608 - DNA, 14 bp, Homo sapiens
ccctgttctggaca

SEQ ID NO: 2197609 - DNA, 14 bp, Homo sapiens
cccttagcccccac

SEQ ID NO: 2197610 - DNA, 17 bp, Homo sapiens
cccttcccttattttta

SEQ ID NO: 2197611 - DNA, 15 bp, Homo sapiens
cccttcctgtctggc

SEQ ID NO: 2197612 - DNA, 13 bp, Homo sapiens
cccttcctgtgcc

SEQ ID NO: 2197613 - DNA, 14 bp, Homo sapiens
cccttctgtgccca

SEQ ID NO: 2197614 - DNA, 15 bp, Homo sapiens
cccttctgtgcccag

SEQ ID NO: 2197615 - DNA, 12 bp, Homo sapiens
cccttgagacct

SEQ ID NO: 2197616 - DNA, 19 bp, Homo sapiens
cccttgccaaggccgccca

SEQ ID NO: 2197617 - DNA, 18 bp, Homo sapiens
cccttttctggctcctgt

SEQ ID NO: 2197618 - DNA, 20 bp, Homo sapiens
cccttttctggctcctgtgt

SEQ ID NO: 2197619 - DNA, 22 bp, Homo sapiens
cccttttctggctcctgtgtgg

SEQ ID NO: 2197620 - DNA, 19 bp, Homo sapiens
ccgacatttttcaataaag

SEQ ID NO: 2197621 - DNA, 14 bp, Homo sapiens
ccgcatgcagcagc

SEQ ID NO: 2197622 - DNA, 21 bp, Homo sapiens
ccgccacatccccgctggctg

SEQ ID NO: 2197623 - DNA, 15 bp, Homo sapiens
ccgccacggcctggc

SEQ ID NO: 2197624 - DNA, 16 bp, Homo sapiens
ccgccacggcctggct

SEQ ID NO: 2197625 - DNA, 14 bp, Homo sapiens
ccgcccacctgcat

SEQ ID NO: 2197626 - DNA, 16 bp, Homo sapiens
ccgccgtgcctgcatt

SEQ ID NO: 2197627 - DNA, 13 bp, Homo sapiens
ccgcctagtgcag

SEQ ID NO: 2197628 - DNA, 20 bp, Homo sapiens
ccgcctgtgcccttgctggg

SEQ ID NO: 2197629 - DNA, 18 bp, Homo sapiens
ccgccttggcctcccaaa

SEQ ID NO: 2197630 - DNA, 19 bp, Homo sapiens
ccgcgtgcgaccagaggtg

SEQ ID NO: 2197631 - DNA, 15 bp, Homo sapiens
ccgctggctgggggc

SEQ ID NO: 2197632 - DNA, 18 bp, Homo sapiens
ccgctggctgggggcctc

SEQ ID NO: 2197633 - DNA, 23 bp, Homo sapiens
ccgcttccctacccacagggcct

SEQ ID NO: 2197634 - DNA, 12 bp, Homo sapiens
ccggccctggct

SEQ ID NO: 2197635 - DNA, 14 bp, Homo sapiens
ccggccggagaaca

SEQ ID NO: 2197636 - DNA, 11 bp, Homo sapiens
ccggcctggac

SEQ ID NO: 2197637 - DNA, 19 bp, Homo sapiens
ccggctcgtgtatttatta

SEQ ID NO: 2197638 - DNA, 20 bp, Homo sapiens
ccgggaccaccctgagccgg

SEQ ID NO: 2197639 - DNA, 21 bp, Homo sapiens
ccgggaccaccctgagccggc

SEQ ID NO: 2197640 - DNA, 12 bp, Homo sapiens
ccgggggtgggg

SEQ ID NO: 2197641 - DNA, 16 bp, Homo sapiens
ccgggttggaggcctc

SEQ ID NO: 2197642 - DNA, 14 bp, Homo sapiens
ccggttgcttctgg

SEQ ID NO: 2197643 - DNA, 16 bp, Homo sapiens
ccggttgcttctggga

SEQ ID NO: 2197644 - DNA, 14 bp, Homo sapiens
ccggtttgggagag

SEQ ID NO: 2197645 - DNA, 14 bp, Homo sapiens
ccgtcttcctcctc

SEQ ID NO: 2197646 - DNA, 22 bp, Homo sapiens
ccgtcttcctcctcccctggca

SEQ ID NO: 2197647 - DNA, 16 bp, Homo sapiens
ccgtgatctcccctca

SEQ ID NO: 2197648 - DNA, 19 bp, Homo sapiens
ccgtgcctgcattcgcagc

SEQ ID NO: 2197649 - DNA, 20 bp, Homo sapiens
ccgtgctgagcacacaacag

SEQ ID NO: 2197650 - DNA, 13 bp, Homo sapiens
ccgtttccaagcc

SEQ ID NO: 2197651 - DNA, 16 bp, Homo sapiens
ccgtttccaagcctgg

SEQ ID NO: 2197652 - DNA, 13 bp, Homo sapiens
cctaaagccagca

SEQ ID NO: 2197653 - DNA, 18 bp, Homo sapiens
cctaactcatactgtgct

SEQ ID NO: 2197654 - DNA, 13 bp, Homo sapiens
cctaactgagctg

SEQ ID NO: 2197655 - DNA, 15 bp, Homo sapiens
cctaactgagctgcc

SEQ ID NO: 2197656 - DNA, 19 bp, Homo sapiens
cctaagagacacatacaga

SEQ ID NO: 2197657 - DNA, 18 bp, Homo sapiens
cctaagggctaaggcctc

SEQ ID NO: 2197658 - DNA, 17 bp, Homo sapiens
cctacccacagggcctg

SEQ ID NO: 2197659 - DNA, 20 bp, Homo sapiens
cctacccacagggcctgact

SEQ ID NO: 2197660 - DNA, 17 bp, Homo sapiens
cctaccccaattccttg

SEQ ID NO: 2197661 - DNA, 19 bp, Homo sapiens
cctaccccaattccttgta

SEQ ID NO: 2197662 - DNA, 19 bp, Homo sapiens
cctacccccttgtctgctg

SEQ ID NO: 2197663 - DNA, 14 bp, Homo sapiens
cctacttctccagc

SEQ ID NO: 2197664 - DNA, 23 bp, Homo sapiens
cctagaggtactttccacttgat

SEQ ID NO: 2197665 - DNA, 22 bp, Homo sapiens
cctagccccttagcccccaccc

SEQ ID NO: 2197666 - DNA, 18 bp, Homo sapiens
cctaggctacccttgcca

SEQ ID NO: 2197667 - DNA, 16 bp, Homo sapiens
cctagtcagccacatg

SEQ ID NO: 2197668 - DNA, 18 bp, Homo sapiens
cctagtcccttccacacc

SEQ ID NO: 2197669 - DNA, 18 bp, Homo sapiens
cctagttttatgtttctt

SEQ ID NO: 2197670 - DNA, 20 bp, Homo sapiens
cctatgccacctgcagcgtc

SEQ ID NO: 2197671 - DNA, 20 bp, Homo sapiens
cctattttggacgtgtgagg

SEQ ID NO: 2197672 - DNA, 20 bp, Homo sapiens
cctcaaaataagccatgctg

SEQ ID NO: 2197673 - DNA, 20 bp, Homo sapiens
cctcaaagattctgcatttt

SEQ ID NO: 2197674 - DNA, 13 bp, Homo sapiens
cctcaagcaacca

SEQ ID NO: 2197675 - DNA, 20 bp, Homo sapiens
cctcaaggggccatcctgtc

SEQ ID NO: 2197676 - DNA, 15 bp, Homo sapiens
cctcaataagccttg

SEQ ID NO: 2197677 - DNA, 12 bp, Homo sapiens
cctcaccctgct

SEQ ID NO: 2197678 - DNA, 15 bp, Homo sapiens
cctcaccctgcttgg

SEQ ID NO: 2197679 - DNA, 21 bp, Homo sapiens
cctcaccctgcttggggcctg

SEQ ID NO: 2197680 - DNA, 23 bp, Homo sapiens
cctcaccctgcttggggcctggc

SEQ ID NO: 2197681 - DNA, 15 bp, Homo sapiens
cctcagcctcccgag

SEQ ID NO: 2197682 - DNA, 14 bp, Homo sapiens
cctcaggctctgca

SEQ ID NO: 2197683 - DNA, 15 bp, Homo sapiens
cctcaggttccaaat

SEQ ID NO: 2197684 - DNA, 14 bp, Homo sapiens
cctcagtgtgaagc

SEQ ID NO: 2197685 - DNA, 18 bp, Homo sapiens
cctcagtgtgaagcctgt

SEQ ID NO: 2197686 - DNA, 21 bp, Homo sapiens
cctcagtttctgttgtttctt

SEQ ID NO: 2197687 - DNA, 15 bp, Homo sapiens
cctccatggtgcctc

SEQ ID NO: 2197688 - DNA, 18 bp, Homo sapiens
cctccatggtgcctctgg

SEQ ID NO: 2197689 - DNA, 13 bp, Homo sapiens
cctcccacctttg

SEQ ID NO: 2197690 - DNA, 21 bp, Homo sapiens
cctcccagatcggatctgttg

SEQ ID NO: 2197691 - DNA, 13 bp, Homo sapiens
cctcccctgccct

SEQ ID NO: 2197692 - DNA, 15 bp, Homo sapiens
cctcccctgccctcg

SEQ ID NO: 2197693 - DNA, 17 bp, Homo sapiens
cctccctacttccaaga

SEQ ID NO: 2197694 - DNA, 18 bp, Homo sapiens
cctccctcccctgccctc

SEQ ID NO: 2197695 - DNA, 14 bp, Homo sapiens
cctccctccctgca

SEQ ID NO: 2197696 - DNA, 17 bp, Homo sapiens
cctccctccctgcaggg

SEQ ID NO: 2197697 - DNA, 22 bp, Homo sapiens
cctccctgaccctgcagagatg

SEQ ID NO: 2197698 - DNA, 11 bp, Homo sapiens
cctccctgcag

SEQ ID NO: 2197699 - DNA, 12 bp, Homo sapiens
cctccctgcagg

SEQ ID NO: 2197700 - DNA, 14 bp, Homo sapiens
cctccctgcagggt

SEQ ID NO: 2197701 - DNA, 21 bp, Homo sapiens
ctagatgagaattcagctgcc

SEQ ID NO: 2197702 - DNA, 16 bp, Homo sapiens
ctagattcactgtctt

SEQ ID NO: 2197703 - DNA, 15 bp, Homo sapiens
ctagcactcacatgc

SEQ ID NO: 2197704 - DNA, 17 bp, Homo sapiens
ctagcactcacatgctg

SEQ ID NO: 2197705 - DNA, 21 bp, Homo sapiens
ctagcactcacatgctggaca

SEQ ID NO: 2197706 - DNA, 17 bp, Homo sapiens
ctagccatatattttct

SEQ ID NO: 2197707 - DNA, 20 bp, Homo sapiens
ctagccttcttttgtacttt

SEQ ID NO: 2197708 - DNA, 10 bp, Homo sapiens
ctagctcccc

SEQ ID NO: 2197709 - DNA, 19 bp, Homo sapiens
ctagctcccctcctctccc

SEQ ID NO: 2197710 - DNA, 23 bp, Homo sapiens
ctagctcccctcctctcccctac

SEQ ID NO: 2197711 - DNA, 18 bp, Homo sapiens
ctagctgggcaaaccctt

SEQ ID NO: 2197712 - DNA, 20 bp, Homo sapiens
ctagctgggcaaacccttct

SEQ ID NO: 2197713 - DNA, 21 bp, Homo sapiens
ctagctgggcaaacccttctc

SEQ ID NO: 2197714 - DNA, 15 bp, Homo sapiens
ctagcttagagcctc

SEQ ID NO: 2197715 - DNA, 22 bp, Homo sapiens
ctaggacatgttcccttctcct

SEQ ID NO: 2197716 - DNA, 22 bp, Homo sapiens
ctaggaggacctgggaatttca

SEQ ID NO: 2197717 - DNA, 17 bp, Homo sapiens
ctaggatatcttctcca

SEQ ID NO: 2197718 - DNA, 18 bp, Homo sapiens
ctaggcagttagagatgc

SEQ ID NO: 2197719 - DNA, 18 bp, Homo sapiens
ctaggccccagaggccct

SEQ ID NO: 2197720 - DNA, 23 bp, Homo sapiens
ctaggccccagaggccctggagg

SEQ ID NO: 2197721 - DNA, 16 bp, Homo sapiens
ctaggcgaggcgaagc

SEQ ID NO: 2197722 - DNA, 20 bp, Homo sapiens
ctaggcgaggcgaagctgag

SEQ ID NO: 2197723 - DNA, 21 bp, Homo sapiens
ctaggcgaggcgaagctgagc

SEQ ID NO: 2197724 - DNA, 22 bp, Homo sapiens
ctaggcgcggttcaggtcaggg

SEQ ID NO: 2197725 - DNA, 18 bp, Homo sapiens
ctaggctgggtgcccaca

SEQ ID NO: 2197726 - DNA, 14 bp, Homo sapiens
ctagggaaggccac

SEQ ID NO: 2197727 - DNA, 17 bp, Homo sapiens
ctagggaaggccacctg

SEQ ID NO: 2197728 - DNA, 15 bp, Homo sapiens
ctagggacccctcct

SEQ ID NO: 2197729 - DNA, 16 bp, Homo sapiens
ctagggacccctcctc

SEQ ID NO: 2197730 - DNA, 20 bp, Homo sapiens
ctagggacccctcctccctt

SEQ ID NO: 2197731 - DNA, 20 bp, Homo sapiens
ctagggtgccttaaaaataa

SEQ ID NO: 2197732 - DNA, 15 bp, Homo sapiens
ctaggtcaaggcctg

SEQ ID NO: 2197733 - DNA, 19 bp, Homo sapiens
ctaggtcaaggcctgtccc

SEQ ID NO: 2197734 - DNA, 17 bp, Homo sapiens
ctaggtcagtacccacc

SEQ ID NO: 2197735 - DNA, 20 bp, Homo sapiens
ctagtcccttccacaccccc

SEQ ID NO: 2197736 - DNA, 22 bp, Homo sapiens
ctagtggaaagattgtgtctgg

SEQ ID NO: 2197737 - DNA, 19 bp, Homo sapiens
ctagtggtggctctgagaa

SEQ ID NO: 2197738 - DNA, 16 bp, Homo sapiens
ctagttccctcagtgt

SEQ ID NO: 2197739 - DNA, 17 bp, Homo sapiens
ctagttttatgtttctt

SEQ ID NO: 2197740 - DNA, 16 bp, Homo sapiens
ctataaagcagtattt

SEQ ID NO: 2197741 - DNA, 19 bp, Homo sapiens
ctataaagcagtatttttc

SEQ ID NO: 2197742 - DNA, 18 bp, Homo sapiens
ctatacctcacaataaga

SEQ ID NO: 2197743 - DNA, 15 bp, Homo sapiens
ctatacctcattcac

SEQ ID NO: 2197744 - DNA, 19 bp, Homo sapiens
ctatatagtacctttgctc

SEQ ID NO: 2197745 - DNA, 20 bp, Homo sapiens
ctatatagtacctttgctct

SEQ ID NO: 2197746 - DNA, 21 bp, Homo sapiens
ctatcctggctttgcccaacc

SEQ ID NO: 2197747 - DNA, 19 bp, Homo sapiens
ctatctcgctagccatata

SEQ ID NO: 2197748 - DNA, 14 bp, Homo sapiens
ctatctctttatat

SEQ ID NO: 2197749 - DNA, 11 bp, Homo sapiens
ctatgaaagct

SEQ ID NO: 2197750 - DNA, 18 bp, Homo sapiens
ctatgaagactactttta

SEQ ID NO: 2197751 - DNA, 14 bp, Homo sapiens
ctatgacatttcta

SEQ ID NO: 2197752 - DNA, 21 bp, Homo sapiens
ctatggtgccaatggaacctc

SEQ ID NO: 2197753 - DNA, 19 bp, Homo sapiens
ctattaagaaaatcacatt

SEQ ID NO: 2197754 - DNA, 15 bp, Homo sapiens
ctattcctttccaga

SEQ ID NO: 2197755 - DNA, 12 bp, Homo sapiens
ctattgcttaaa

SEQ ID NO: 2197756 - DNA, 15 bp, Homo sapiens
ctattgcttaaacaa

SEQ ID NO: 2197757 - DNA, 16 bp, Homo sapiens
ctattgtgctttctat

SEQ ID NO: 2197758 - DNA, 15 bp, Homo sapiens
ctatttattagccaa

SEQ ID NO: 2197759 - DNA, 16 bp, Homo sapiens
ctatttattcattcag

SEQ ID NO: 2197760 - DNA, 21 bp, Homo sapiens
ctatttattcattcagtgaga

SEQ ID NO: 2197761 - DNA, 17 bp, Homo sapiens
ctatttcccaagctgga

SEQ ID NO: 2197762 - DNA, 17 bp, Homo sapiens
ctatttttttgttgctg

SEQ ID NO: 2197763 - DNA, 14 bp, Homo sapiens
ctcaaacacagaga

SEQ ID NO: 2197764 - DNA, 22 bp, Homo sapiens
ctcaaagcaagctcttctcctc

SEQ ID NO: 2197765 - DNA, 18 bp, Homo sapiens
ctcaaaggactgacctgc

SEQ ID NO: 2197766 - DNA, 18 bp, Homo sapiens
ctcaaagtttttacagtg

SEQ ID NO: 2197767 - DNA, 16 bp, Homo sapiens
ctcaacataacataag

SEQ ID NO: 2197768 - DNA, 18 bp, Homo sapiens
ctcaacataacataagct

SEQ ID NO: 2197769 - DNA, 14 bp, Homo sapiens
ctcaacctccctgg

SEQ ID NO: 2197770 - DNA, 18 bp, Homo sapiens
ctcaacctccctggctca

SEQ ID NO: 2197771 - DNA, 18 bp, Homo sapiens
ctcaagcaatcctcctga

SEQ ID NO: 2197772 - DNA, 22 bp, Homo sapiens
ctcaagcaatcctcctgagtga

SEQ ID NO: 2197773 - DNA, 16 bp, Homo sapiens
ctcaagcactgacact

SEQ ID NO: 2197774 - DNA, 18 bp, Homo sapiens
ctcaattccccctggcca

SEQ ID NO: 2197775 - DNA, 19 bp, Homo sapiens
ctcaattccccctggccac

SEQ ID NO: 2197776 - DNA, 18 bp, Homo sapiens
ctcacaagcctcttctga

SEQ ID NO: 2197777 - DNA, 21 bp, Homo sapiens
ctcacatgctggacaggtctg

SEQ ID NO: 2197778 - DNA, 23 bp, Homo sapiens
ctcacatgctggacaggtctggg

SEQ ID NO: 2197779 - DNA, 20 bp, Homo sapiens
ctcaccctgcttggggcctg

SEQ ID NO: 2197780 - DNA, 22 bp, Homo sapiens
ctcaccttgaacaccacgcttg

SEQ ID NO: 2197781 - DNA, 14 bp, Homo sapiens
ctcacgctgccatt

SEQ ID NO: 2197782 - DNA, 22 bp, Homo sapiens
ctcacgctgccatttccctgaa

SEQ ID NO: 2197783 - DNA, 12 bp, Homo sapiens
ctcactgcagcc

SEQ ID NO: 2197784 - DNA, 21 bp, Homo sapiens
ctcacttggtgatatgtccta

SEQ ID NO: 2197785 - DNA, 15 bp, Homo sapiens
ctcagcaacctgtaa

SEQ ID NO: 2197786 - DNA, 15 bp, Homo sapiens
ctcagcatcctccac

SEQ ID NO: 2197787 - DNA, 15 bp, Homo sapiens
ctcagccagtgggga

SEQ ID NO: 2197788 - DNA, 16 bp, Homo sapiens
ctcagccccagcccag

SEQ ID NO: 2197789 - DNA, 23 bp, Homo sapiens
ctcagccccagcccagcccagct

SEQ ID NO: 2197790 - DNA, 15 bp, Homo sapiens
ctcagccctgagcta

SEQ ID NO: 2197791 - DNA, 20 bp, Homo sapiens
ctcagccctgagctggcctc

SEQ ID NO: 2197792 - DNA, 22 bp, Homo sapiens
ctcagccctgagctggcgtcac

SEQ ID NO: 2197793 - DNA, 15 bp, Homo sapiens
ctcagccctgagttg

SEQ ID NO: 2197794 - DNA, 13 bp, Homo sapiens
ctcagcctcccga

SEQ ID NO: 2197795 - DNA, 14 bp, Homo sapiens
ctcagcctcccgag

SEQ ID NO: 2197796 - DNA, 22 bp, Homo sapiens
ctcagctcactgcaacctccac

SEQ ID NO: 2197797 - DNA, 12 bp, Homo sapiens
ctcagctctggc

SEQ ID NO: 2197798 - DNA, 13 bp, Homo sapiens
ctcagctctggct

SEQ ID NO: 2197799 - DNA, 14 bp, Homo sapiens
ctcagctggccggg

SEQ ID NO: 2197800 - DNA, 16 bp, Homo sapiens
ctcagctggccgggtt

SEQ ID NO: 2197801 - DNA, 23 bp, Homo sapiens
ctcagctggccgggttggaggcc

SEQ ID NO: 2197802 - DNA, 14 bp, Homo sapiens
ctcaggaattcagt

SEQ ID NO: 2197803 - DNA, 23 bp, Homo sapiens
ctcaggagagagcttcctgtttc

SEQ ID NO: 2197804 - DNA, 13 bp, Homo sapiens
ctcaggaggaggg

SEQ ID NO: 2197805 - DNA, 13 bp, Homo sapiens
ctcaggtgaccaa

SEQ ID NO: 2197806 - DNA, 13 bp, Homo sapiens
ctcaggttccaaa

SEQ ID NO: 2197807 - DNA, 19 bp, Homo sapiens
ctcagtctgtcacccaggc

SEQ ID NO: 2197808 - DNA, 13 bp, Homo sapiens
ctcagtcttccct

SEQ ID NO: 2197809 - DNA, 20 bp, Homo sapiens
ctcagtcttccctagggctg

SEQ ID NO: 2197810 - DNA, 14 bp, Homo sapiens
ctcagttccaatgt

SEQ ID NO: 2197811 - DNA, 14 bp, Homo sapiens
ctcagtttggctgt

SEQ ID NO: 2197812 - DNA, 15 bp, Homo sapiens
ctcagtttggctgta

SEQ ID NO: 2197813 - DNA, 19 bp, Homo sapiens
ctcatagcaggaaatgtag

SEQ ID NO: 2197814 - DNA, 14 bp, Homo sapiens
ctcatcactcccct

SEQ ID NO: 2197815 - DNA, 16 bp, Homo sapiens
ctcatcactcccctcc

SEQ ID NO: 2197816 - DNA, 17 bp, Homo sapiens
ctcatcactcccctcca

SEQ ID NO: 2197817 - DNA, 13 bp, Homo sapiens
ctcatcttagttc

SEQ ID NO: 2197818 - DNA, 18 bp, Homo sapiens
ctcatgtgtgctcttctt

SEQ ID NO: 2197819 - DNA, 12 bp, Homo sapiens
ctcatgttctca

SEQ ID NO: 2197820 - DNA, 17 bp, Homo sapiens
ctcatgtttgtgcatgt

SEQ ID NO: 2197821 - DNA, 18 bp, Homo sapiens
ctcattaccgtctgtgat

SEQ ID NO: 2197822 - DNA, 23 bp, Homo sapiens
ctcattactttaccacccccaca

SEQ ID NO: 2197823 - DNA, 17 bp, Homo sapiens
ctggctccgctgtgtgg

SEQ ID NO: 2197824 - DNA, 14 bp, Homo sapiens
ctggctgcactcaa

SEQ ID NO: 2197825 - DNA, 17 bp, Homo sapiens
ctggctgcctggcccag

SEQ ID NO: 2197826 - DNA, 19 bp, Homo sapiens
ctggctgcctggcccaggg

SEQ ID NO: 2197827 - DNA, 22 bp, Homo sapiens
ctggctggggacttggccgctt

SEQ ID NO: 2197828 - DNA, 22 bp, Homo sapiens
ctggctgggggcctcactccag

SEQ ID NO: 2197829 - DNA, 18 bp, Homo sapiens
ctggctggtaagggccaa

SEQ ID NO: 2197830 - DNA, 19 bp, Homo sapiens
ctggctggtaagggccaag

SEQ ID NO: 2197831 - DNA, 23 bp, Homo sapiens
ctggctggtgggaaggccggcag

SEQ ID NO: 2197832 - DNA, 14 bp, Homo sapiens
ctggctttgcccaa

SEQ ID NO: 2197833 - DNA, 16 bp, Homo sapiens
ctggctttgcccaacc

SEQ ID NO: 2197834 - DNA, 17 bp, Homo sapiens
ctggctttgcccaacct

SEQ ID NO: 2197835 - DNA, 19 bp, Homo sapiens
ctgggaactcccaagaaca

SEQ ID NO: 2197836 - DNA, 23 bp, Homo sapiens
ctgggaactcccaagaacagcag

SEQ ID NO: 2197837 - DNA, 19 bp, Homo sapiens
ctgggaaggctactcacct

SEQ ID NO: 2197838 - DNA, 12 bp, Homo sapiens
ctgggagagcca

SEQ ID NO: 2197839 - DNA, 14 bp, Homo sapiens
ctgggagagccaag

SEQ ID NO: 2197840 - DNA, 17 bp, Homo sapiens
ctgggagagccaaggcc

SEQ ID NO: 2197841 - DNA, 11 bp, Homo sapiens
ctgggagcttc

SEQ ID NO: 2197842 - DNA, 15 bp, Homo sapiens
ctgggagcttccgct

SEQ ID NO: 2197843 - DNA, 21 bp, Homo sapiens
ctgggattacaggcgtgagcc

SEQ ID NO: 2197844 - DNA, 18 bp, Homo sapiens
ctgggattacaggtgtga

SEQ ID NO: 2197845 - DNA, 21 bp, Homo sapiens
ctgggcaaacccttctcttct

SEQ ID NO: 2197846 - DNA, 22 bp, Homo sapiens
ctgggcaaacccttctcttctc

SEQ ID NO: 2197847 - DNA, 16 bp, Homo sapiens
ctgggcaaggtgaggg

SEQ ID NO: 2197848 - DNA, 22 bp, Homo sapiens
ctgggcagaggggagaggaagc

SEQ ID NO: 2197849 - DNA, 18 bp, Homo sapiens
ctgggccactggcatctc

SEQ ID NO: 2197850 - DNA, 23 bp, Homo sapiens
ctgggccactggcatctctggag

SEQ ID NO: 2197851 - DNA, 12 bp, Homo sapiens
ctgggcccagag

SEQ ID NO: 2197852 - DNA, 14 bp, Homo sapiens
ctgggcccagaggc

SEQ ID NO: 2197853 - DNA, 19 bp, Homo sapiens
ctgggcccagaggcacagc

SEQ ID NO: 2197854 - DNA, 20 bp, Homo sapiens
ctgggcccagaggcacagcc

SEQ ID NO: 2197855 - DNA, 22 bp, Homo sapiens
ctgggctgttttagtgccaggc

SEQ ID NO: 2197856 - DNA, 21 bp, Homo sapiens
ctgggctttgattccatctcc

SEQ ID NO: 2197857 - DNA, 13 bp, Homo sapiens
ctggggccgccac

SEQ ID NO: 2197858 - DNA, 19 bp, Homo sapiens
ctggggccgccacggcctg

SEQ ID NO: 2197859 - DNA, 16 bp, Homo sapiens
ctggggctcagccctg

SEQ ID NO: 2197860 - DNA, 20 bp, Homo sapiens
ctggggctcagccctgagct

SEQ ID NO: 2197861 - DNA, 21 bp, Homo sapiens
ctggggctcagccctgagcta

SEQ ID NO: 2197862 - DNA, 13 bp, Homo sapiens
ctgggggcctcac

SEQ ID NO: 2197863 - DNA, 21 bp, Homo sapiens
ctggggtggggaggcagaggg

SEQ ID NO: 2197864 - DNA, 15 bp, Homo sapiens
ctgggtaggttctga

SEQ ID NO: 2197865 - DNA, 14 bp, Homo sapiens
ctgggtgagtgggg

SEQ ID NO: 2197866 - DNA, 16 bp, Homo sapiens
ctgggtgcccacagcc

SEQ ID NO: 2197867 - DNA, 19 bp, Homo sapiens
ctgggtgcccacagcccgc

SEQ ID NO: 2197868 - DNA, 18 bp, Homo sapiens
ctgggtggttgcccttca

SEQ ID NO: 2197869 - DNA, 15 bp, Homo sapiens
ctgggttctgggtgg

SEQ ID NO: 2197870 - DNA, 15 bp, Homo sapiens
ctggtaagggccaag

SEQ ID NO: 2197871 - DNA, 15 bp, Homo sapiens
ctggtaggttctgtc

SEQ ID NO: 2197872 - DNA, 19 bp, Homo sapiens
ctggtatgggtttctccca

SEQ ID NO: 2197873 - DNA, 23 bp, Homo sapiens
ctggtatgggtttctcccagttc

SEQ ID NO: 2197874 - DNA, 16 bp, Homo sapiens
ctggtcgtttgaccac

SEQ ID NO: 2197875 - DNA, 18 bp, Homo sapiens
ctggtgaggaagctccag

SEQ ID NO: 2197876 - DNA, 20 bp, Homo sapiens
ctggtgcacatgacatttgt

SEQ ID NO: 2197877 - DNA, 16 bp, Homo sapiens
ctggtgcctatttatt

SEQ ID NO: 2197878 - DNA, 22 bp, Homo sapiens
ctggtgcctatttattcattca

SEQ ID NO: 2197879 - DNA, 23 bp, Homo sapiens
ctggtgcctatttattcattcag

SEQ ID NO: 2197880 - DNA, 12 bp, Homo sapiens
ctggtggctgga

SEQ ID NO: 2197881 - DNA, 14 bp, Homo sapiens
ctggtggctggagg

SEQ ID NO: 2197882 - DNA, 15 bp, Homo sapiens
ctggtggctggaggc

SEQ ID NO: 2197883 - DNA, 19 bp, Homo sapiens
ctggtgggaaggccggcag

SEQ ID NO: 2197884 - DNA, 17 bp, Homo sapiens
ctggtgggcaccaagag

SEQ ID NO: 2197885 - DNA, 22 bp, Homo sapiens
ctggtgggcaccaagagccaat

SEQ ID NO: 2197886 - DNA, 16 bp, Homo sapiens
ctggtgtaaaaaacaa

SEQ ID NO: 2197887 - DNA, 19 bp, Homo sapiens
ctggtgtaaaaaacaaaca

SEQ ID NO: 2197888 - DNA, 16 bp, Homo sapiens
ctggttagctcagccc

SEQ ID NO: 2197889 - DNA, 20 bp, Homo sapiens
ctggttagctcagccccagc

SEQ ID NO: 2197890 - DNA, 20 bp, Homo sapiens
ctggttccttaagtggctgt

SEQ ID NO: 2197891 - DNA, 23 bp, Homo sapiens
ctggttggaggcccttttctggc

SEQ ID NO: 2197892 - DNA, 19 bp, Homo sapiens
ctggtttgactcattaatt

SEQ ID NO: 2197893 - DNA, 22 bp, Homo sapiens
ctgtaaaaacacaaatgtgtac

SEQ ID NO: 2197894 - DNA, 16 bp, Homo sapiens
ctgtaagactgataat

SEQ ID NO: 2197895 - DNA, 13 bp, Homo sapiens
ctgtaatttaatt

SEQ ID NO: 2197896 - DNA, 14 bp, Homo sapiens
ctgtacaagtgctc

SEQ ID NO: 2197897 - DNA, 15 bp, Homo sapiens
ctgtacatagatgta

SEQ ID NO: 2197898 - DNA, 20 bp, Homo sapiens
ctgtaccgtcgacaagaatg

SEQ ID NO: 2197899 - DNA, 15 bp, Homo sapiens
ctgtacctttctgac

SEQ ID NO: 2197900 - DNA, 23 bp, Homo sapiens
ctgtacctttctgacaataaata

SEQ ID NO: 2197901 - DNA, 18 bp, Homo sapiens
ctgtactaggattagaaa

SEQ ID NO: 2197902 - DNA, 17 bp, Homo sapiens
ctgtactattgcttaaa

SEQ ID NO: 2197903 - DNA, 16 bp, Homo sapiens
ctgtagctattctttg

SEQ ID NO: 2197904 - DNA, 15 bp, Homo sapiens
ctgtatataaatata

SEQ ID NO: 2197905 - DNA, 17 bp, Homo sapiens
ctgtatatttgaaactg

SEQ ID NO: 2197906 - DNA, 18 bp, Homo sapiens
ctgtatttgaaataagaa

SEQ ID NO: 2197907 - DNA, 22 bp, Homo sapiens
ctgtatttgaaataagaattca

SEQ ID NO: 2197908 - DNA, 17 bp, Homo sapiens
ctgtattttttttttcc

SEQ ID NO: 2197909 - DNA, 19 bp, Homo sapiens
ctgtcacgttctggaacat

SEQ ID NO: 2197910 - DNA, 20 bp, Homo sapiens
ctgtcagaataaagaacatt

SEQ ID NO: 2197911 - DNA, 19 bp, Homo sapiens
ctgtcagataatcggtgca

SEQ ID NO: 2197912 - DNA, 20 bp, Homo sapiens
ctgtcagataatcggtgcag

SEQ ID NO: 2197913 - DNA, 22 bp, Homo sapiens
ctgtcatggctctgaactgcac

SEQ ID NO: 2197914 - DNA, 22 bp, Homo sapiens
ctgtcattcccctcttttgtct

SEQ ID NO: 2197915 - DNA, 13 bp, Homo sapiens
ctgtccagggctt

SEQ ID NO: 2197916 - DNA, 18 bp, Homo sapiens
ctgtccagggcttcagat

SEQ ID NO: 2197917 - DNA, 14 bp, Homo sapiens
ctgtccctggccat

SEQ ID NO: 2197918 - DNA, 22 bp, Homo sapiens
ctgtcccttggagctgtaaacc

SEQ ID NO: 2197919 - DNA, 20 bp, Homo sapiens
ctgtctaagaataatgacgt

SEQ ID NO: 2197920 - DNA, 14 bp, Homo sapiens
ctgtctacaggaaa

SEQ ID NO: 2197921 - DNA, 14 bp, Homo sapiens
ctgtctaccatctc

SEQ ID NO: 2197922 - DNA, 17 bp, Homo sapiens
ctgtctaccatctccct

SEQ ID NO: 2197923 - DNA, 16 bp, Homo sapiens
ctgtctcccctctgct

SEQ ID NO: 2197924 - DNA, 18 bp, Homo sapiens
ctgtctcccctctgctgg

SEQ ID NO: 2197925 - DNA, 11 bp, Homo sapiens
ctgtctctctt

SEQ ID NO: 2197926 - DNA, 17 bp, Homo sapiens
ctgtctgcgccgctgtg

SEQ ID NO: 2197927 - DNA, 16 bp, Homo sapiens
ctgtctggattaatta

SEQ ID NO: 2197928 - DNA, 17 bp, Homo sapiens
ctgtcttcatccttagc

SEQ ID NO: 2197929 - DNA, 17 bp, Homo sapiens
ctgtcttccaggcccag

SEQ ID NO: 2197930 - DNA, 12 bp, Homo sapiens
ctgtcttggcct

SEQ ID NO: 2197931 - DNA, 15 bp, Homo sapiens
ctgtcttggcctccc

SEQ ID NO: 2197932 - DNA, 23 bp, Homo sapiens
ctgtgaaaattacacccatgcac

SEQ ID NO: 2197933 - DNA, 18 bp, Homo sapiens
ctgtgacacagctgagct

SEQ ID NO: 2197934 - DNA, 21 bp, Homo sapiens
ctgtgactgatgttaggctgg

SEQ ID NO: 2197935 - DNA, 17 bp, Homo sapiens
ctgtgagttctgatgtc

SEQ ID NO: 2197936 - DNA, 19 bp, Homo sapiens
ctgtgattactctttgctt

SEQ ID NO: 2197937 - DNA, 23 bp, Homo sapiens
ctgtgattactctttgctttgta

SEQ ID NO: 2197938 - DNA, 16 bp, Homo sapiens
ctgtgatttatttgga

SEQ ID NO: 2197939 - DNA, 16 bp, Homo sapiens
ctgtgcagggccctct

SEQ ID NO: 2197940 - DNA, 18 bp, Homo sapiens
ctgtgcagggccctctgg

SEQ ID NO: 2197941 - DNA, 22 bp, Homo sapiens
ctgtgcagggccctctggggct

SEQ ID NO: 2197942 - DNA, 14 bp, Homo sapiens
ctgtgccaagggca

SEQ ID NO: 2197943 - DNA, 12 bp, Homo sapiens
ctgtgcccagca

SEQ ID NO: 2197944 - DNA, 12 bp, Homo sapiens
gaagcaaaaact

SEQ ID NO: 2197945 - DNA, 14 bp, Homo sapiens
gaagcaaaaactac

SEQ ID NO: 2197946 - DNA, 17 bp, Homo sapiens
gaagcaagacacgtggc

SEQ ID NO: 2197947 - DNA, 19 bp, Homo sapiens
gaagcaagacacgtggcct

SEQ ID NO: 2197948 - DNA, 17 bp, Homo sapiens
gaagcacaagaagtggg

SEQ ID NO: 2197949 - DNA, 21 bp, Homo sapiens
gaagcacaagaagtgggagtg

SEQ ID NO: 2197950 - DNA, 19 bp, Homo sapiens
gaagccacgtgctggagag

SEQ ID NO: 2197951 - DNA, 21 bp, Homo sapiens
gaagccacgtgctggagagta

SEQ ID NO: 2197952 - DNA, 13 bp, Homo sapiens
gaagccagccaca

SEQ ID NO: 2197953 - DNA, 16 bp, Homo sapiens
gaagcccatcctgacc

SEQ ID NO: 2197954 - DNA, 13 bp, Homo sapiens
gaagcctgctgat

SEQ ID NO: 2197955 - DNA, 22 bp, Homo sapiens
gaagctagctcccctcctctcc

SEQ ID NO: 2197956 - DNA, 23 bp, Homo sapiens
gaagctggggacagctttcctgg

SEQ ID NO: 2197957 - DNA, 14 bp, Homo sapiens
gaaggaaaaacatg

SEQ ID NO: 2197958 - DNA, 16 bp, Homo sapiens
gaaggaaaaacatgct

SEQ ID NO: 2197959 - DNA, 14 bp, Homo sapiens
gaaggacaggaccc

SEQ ID NO: 2197960 - DNA, 20 bp, Homo sapiens
gaaggacaggaccctcagga

SEQ ID NO: 2197961 - DNA, 12 bp, Homo sapiens
gaaggagaggct

SEQ ID NO: 2197962 - DNA, 13 bp, Homo sapiens
gaaggagaggctc

SEQ ID NO: 2197963 - DNA, 21 bp, Homo sapiens
gaaggagcctgcggctgctgg

SEQ ID NO: 2197964 - DNA, 16 bp, Homo sapiens
gaaggcgatgtggtga

SEQ ID NO: 2197965 - DNA, 22 bp, Homo sapiens
gaaggcgatgtggtgaccccac

SEQ ID NO: 2197966 - DNA, 18 bp, Homo sapiens
gaaggctggggctattta

SEQ ID NO: 2197967 - DNA, 12 bp, Homo sapiens
gaaggggctgga

SEQ ID NO: 2197968 - DNA, 16 bp, Homo sapiens
gaaggtaaagggacac

SEQ ID NO: 2197969 - DNA, 18 bp, Homo sapiens
gaaggtaaagggacactg

SEQ ID NO: 2197970 - DNA, 21 bp, Homo sapiens
gaagtcttccatcagcagtga

SEQ ID NO: 2197971 - DNA, 23 bp, Homo sapiens
gaagtcttccatcagcagtgatt

SEQ ID NO: 2197972 - DNA, 17 bp, Homo sapiens
gaagtgaacaaatttca

SEQ ID NO: 2197973 - DNA, 16 bp, Homo sapiens
gaagtgaatacatggt

SEQ ID NO: 2197974 - DNA, 13 bp, Homo sapiens
gaagtgagaagat

SEQ ID NO: 2197975 - DNA, 17 bp, Homo sapiens
gaagtgggagtgggaga

SEQ ID NO: 2197976 - DNA, 16 bp, Homo sapiens
gaagttagtttgtata

SEQ ID NO: 2197977 - DNA, 20 bp, Homo sapiens
gaatactaataaaatacata

SEQ ID NO: 2197978 - DNA, 20 bp, Homo sapiens
gaatactttgatgattgcca

SEQ ID NO: 2197979 - DNA, 14 bp, Homo sapiens
gaataggaaataaa

SEQ ID NO: 2197980 - DNA, 14 bp, Homo sapiens
gaatataatgggaa

SEQ ID NO: 2197981 - DNA, 19 bp, Homo sapiens
gaatatatgatttgcatgt

SEQ ID NO: 2197982 - DNA, 15 bp, Homo sapiens
gaatcttttactgtg

SEQ ID NO: 2197983 - DNA, 13 bp, Homo sapiens
gaatgaccctgtc

SEQ ID NO: 2197984 - DNA, 19 bp, Homo sapiens
gaatgaccctgtcaagctt

SEQ ID NO: 2197985 - DNA, 12 bp, Homo sapiens
gaatgcctcgct

SEQ ID NO: 2197986 - DNA, 13 bp, Homo sapiens
gaattcagacatc

SEQ ID NO: 2197987 - DNA, 24 bp, Homo sapiens
gaattcagtgccttcaacaacgtg

SEQ ID NO: 2197988 - DNA, 21 bp, Homo sapiens
gaattccaatatttataatta

SEQ ID NO: 2197989 - DNA, 20 bp, Homo sapiens
gaattccctgaagcaacact

SEQ ID NO: 2197990 - DNA, 12 bp, Homo sapiens
gaatttcaatat

SEQ ID NO: 2197991 - DNA, 22 bp, Homo sapiens
gaattttgcaaagatttaatct

SEQ ID NO: 2197992 - DNA, 17 bp, Homo sapiens
gacaaaccactgtacat

SEQ ID NO: 2197993 - DNA, 18 bp, Homo sapiens
gacaaaccactgtacata

SEQ ID NO: 2197994 - DNA, 14 bp, Homo sapiens
gacaaaggtgattt

SEQ ID NO: 2197995 - DNA, 20 bp, Homo sapiens
gacaaatgggactgatgtca

SEQ ID NO: 2197996 - DNA, 22 bp, Homo sapiens
gacaaatgggactgatgtcatc

SEQ ID NO: 2197997 - DNA, 16 bp, Homo sapiens
gacaaggtagacatgg

SEQ ID NO: 2197998 - DNA, 20 bp, Homo sapiens
gacaatgcagatgccagagc

SEQ ID NO: 2197999 - DNA, 17 bp, Homo sapiens
gacacacacagactatt

SEQ ID NO: 2198000 - DNA, 14 bp, Homo sapiens
gacacacacagctt

SEQ ID NO: 2198001 - DNA, 15 bp, Homo sapiens
gacacatacagagtg

SEQ ID NO: 2198002 - DNA, 22 bp, Homo sapiens
gacaccctacacaaaatacagc

SEQ ID NO: 2198003 - DNA, 13 bp, Homo sapiens
gacacgtggcctc

SEQ ID NO: 2198004 - DNA, 14 bp, Homo sapiens
gacactacagagga

SEQ ID NO: 2198005 - DNA, 19 bp, Homo sapiens
gacagcatgactggacagc

SEQ ID NO: 2198006 - DNA, 20 bp, Homo sapiens
gacagcatgactggacagcg

SEQ ID NO: 2198007 - DNA, 21 bp, Homo sapiens
gacagcatggtgcatgccgct

SEQ ID NO: 2198008 - DNA, 23 bp, Homo sapiens
gacagcgggtaaaaagagaaggc

SEQ ID NO: 2198009 - DNA, 15 bp, Homo sapiens
gacagcggttgtaaa

SEQ ID NO: 2198010 - DNA, 19 bp, Homo sapiens
gacagcggttgtaaataca

SEQ ID NO: 2198011 - DNA, 14 bp, Homo sapiens
gacagctgcaggtg

SEQ ID NO: 2198012 - DNA, 16 bp, Homo sapiens
gacagctgcaggtgcc

SEQ ID NO: 2198013 - DNA, 14 bp, Homo sapiens
gacagctttcctgg

SEQ ID NO: 2198014 - DNA, 16 bp, Homo sapiens
gacaggacagcatggt

SEQ ID NO: 2198015 - DNA, 17 bp, Homo sapiens
gacaggaccctcaggaa

SEQ ID NO: 2198016 - DNA, 18 bp, Homo sapiens
gacaggaccctcaggaat

SEQ ID NO: 2198017 - DNA, 22 bp, Homo sapiens
gacaggaccctcaggaattcag

SEQ ID NO: 2198018 - DNA, 13 bp, Homo sapiens
gacagggtcctgc

SEQ ID NO: 2198019 - DNA, 14 bp, Homo sapiens
gacagggtcctgct

SEQ ID NO: 2198020 - DNA, 14 bp, Homo sapiens
gacaggtctgggag

SEQ ID NO: 2198021 - DNA, 17 bp, Homo sapiens
gacagttttccaaactg

SEQ ID NO: 2198022 - DNA, 13 bp, Homo sapiens
gacatatttcagt

SEQ ID NO: 2198023 - DNA, 19 bp, Homo sapiens
gacatccaggatggctgca

SEQ ID NO: 2198024 - DNA, 19 bp, Homo sapiens
gacatccccctccttgccg

SEQ ID NO: 2198025 - DNA, 15 bp, Homo sapiens
gacatgttcccttct

SEQ ID NO: 2198026 - DNA, 22 bp, Homo sapiens
gacatttcggaagtggtgggga

SEQ ID NO: 2198027 - DNA, 13 bp, Homo sapiens
gacatttctcaaa

SEQ ID NO: 2198028 - DNA, 20 bp, Homo sapiens
gacatttgggactgtcttga

SEQ ID NO: 2198029 - DNA, 19 bp, Homo sapiens
gaccaaaatccccttctca

SEQ ID NO: 2198030 - DNA, 15 bp, Homo sapiens
gaccaccctgagccg

SEQ ID NO: 2198031 - DNA, 20 bp, Homo sapiens
gaccagctgctccgaggacc

SEQ ID NO: 2198032 - DNA, 21 bp, Homo sapiens
gaccagctgctccgaggaccc

SEQ ID NO: 2198033 - DNA, 13 bp, Homo sapiens
gaccagtttctta

SEQ ID NO: 2198034 - DNA, 14 bp, Homo sapiens
gaccatttcacaga

SEQ ID NO: 2198035 - DNA, 20 bp, Homo sapiens
gaccatttcacagaaaacat

SEQ ID NO: 2198036 - DNA, 15 bp, Homo sapiens
gaccatttttaaatg

SEQ ID NO: 2198037 - DNA, 15 bp, Homo sapiens
gacccaggaaaggca

SEQ ID NO: 2198038 - DNA, 21 bp, Homo sapiens
gacccaggaaaggcaggattg

SEQ ID NO: 2198039 - DNA, 15 bp, Homo sapiens
gaccccgcacccggc

SEQ ID NO: 2198040 - DNA, 14 bp, Homo sapiens
gacccctcctccct

SEQ ID NO: 2198041 - DNA, 12 bp, Homo sapiens
gacccctgggag

SEQ ID NO: 2198042 - DNA, 15 bp, Homo sapiens
gacccctgggagctt

SEQ ID NO: 2198043 - DNA, 12 bp, Homo sapiens
gaccccttcctg

SEQ ID NO: 2198044 - DNA, 21 bp, Homo sapiens
gaccccttcctgtctggccca

SEQ ID NO: 2198045 - DNA, 14 bp, Homo sapiens
gaccggcctggacc

SEQ ID NO: 2198046 - DNA, 17 bp, Homo sapiens
gacctccttagaaaaga

SEQ ID NO: 2198047 - DNA, 17 bp, Homo sapiens
gacctggaaccagagcc

SEQ ID NO: 2198048 - DNA, 15 bp, Homo sapiens
gacctgggaatttca

SEQ ID NO: 2198049 - DNA, 15 bp, Homo sapiens
gacctggggtgggga

SEQ ID NO: 2198050 - DNA, 20 bp, Homo sapiens
gacctggggtggggaggcag

SEQ ID NO: 2198051 - DNA, 14 bp, Homo sapiens
gaccttcttccaca

SEQ ID NO: 2198052 - DNA, 16 bp, Homo sapiens
gaccttgatgtcttga

SEQ ID NO: 2198053 - DNA, 20 bp, Homo sapiens
gaccttgatgtcttgagagc

SEQ ID NO: 2198054 - DNA, 14 bp, Homo sapiens
gacgaggggcaggg

SEQ ID NO: 2198055 - DNA, 13 bp, Homo sapiens
gacgcacacagct

SEQ ID NO: 2198056 - DNA, 14 bp, Homo sapiens
gacgcacacagctt

SEQ ID NO: 2198057 - DNA, 20 bp, Homo sapiens
gacgtccacccgtttccaag

SEQ ID NO: 2198058 - DNA, 15 bp, Homo sapiens
gactaaactacatta

SEQ ID NO: 2198059 - DNA, 16 bp, Homo sapiens
gactaagagaagttgt

SEQ ID NO: 2198060 - DNA, 18 bp, Homo sapiens
gactaagggaagaactct

SEQ ID NO: 2198061 - DNA, 18 bp, Homo sapiens
gactaccacttatttcta

SEQ ID NO: 2198062 - DNA, 16 bp, Homo sapiens
gactcaatttctcccc

SEQ ID NO: 2198063 - DNA, 14 bp, Homo sapiens
gactccccatagca

SEQ ID NO: 2198064 - DNA, 22 bp, Homo sapiens
gactctcctgcctcagcctccc

SEQ ID NO: 2198065 - DNA, 19 bp, Homo sapiens
gactctttgcaacagcact

SEQ ID NO: 2198066 - DNA, 22 bp, Homo sapiens
gactgaagtactggaatttatt

SEQ ID NO: 2198067 - DNA, 20 bp, Homo sapiens
gcagtgtgtctcctgcatgc

SEQ ID NO: 2198068 - DNA, 13 bp, Homo sapiens
gcatattgataat

SEQ ID NO: 2198069 - DNA, 18 bp, Homo sapiens
gcatattgataataaaat

SEQ ID NO: 2198070 - DNA, 20 bp, Homo sapiens
gcatattgataataaaattc

SEQ ID NO: 2198071 - DNA, 24 bp, Homo sapiens
gcatcaaccaggaagagttctatc

SEQ ID NO: 2198072 - DNA, 16 bp, Homo sapiens
gcatcagcctctggcc

SEQ ID NO: 2198073 - DNA, 12 bp, Homo sapiens
gcatccaactga

SEQ ID NO: 2198074 - DNA, 16 bp, Homo sapiens
gcatccacaggattcc

SEQ ID NO: 2198075 - DNA, 17 bp, Homo sapiens
gcatccacctccttctc

SEQ ID NO: 2198076 - DNA, 13 bp, Homo sapiens
gcatctctggagt

SEQ ID NO: 2198077 - DNA, 14 bp, Homo sapiens
gcatctgaaaacaa

SEQ ID NO: 2198078 - DNA, 19 bp, Homo sapiens
gcatgaaactatgcaccta

SEQ ID NO: 2198079 - DNA, 22 bp, Homo sapiens
gcatgaaactatgcacctataa

SEQ ID NO: 2198080 - DNA, 15 bp, Homo sapiens
gcatgactggacagc

SEQ ID NO: 2198081 - DNA, 18 bp, Homo sapiens
gcatgcaaaccaggagca

SEQ ID NO: 2198082 - DNA, 13 bp, Homo sapiens
gcatgcagcagct

SEQ ID NO: 2198083 - DNA, 15 bp, Homo sapiens
gcatgcagcagcttg

SEQ ID NO: 2198084 - DNA, 17 bp, Homo sapiens
gcatgcagcagcttgct

SEQ ID NO: 2198085 - DNA, 20 bp, Homo sapiens
gcatgcagtcttgtactgtg

SEQ ID NO: 2198086 - DNA, 12 bp, Homo sapiens
gcattaaatgca

SEQ ID NO: 2198087 - DNA, 14 bp, Homo sapiens
gcattaaatgcaaa

SEQ ID NO: 2198088 - DNA, 18 bp, Homo sapiens
gcattaaatgcaaaaata

SEQ ID NO: 2198089 - DNA, 22 bp, Homo sapiens
gccaaagacctcccaagctgta

SEQ ID NO: 2198090 - DNA, 19 bp, Homo sapiens
gccaactgtttccctgctg

SEQ ID NO: 2198091 - DNA, 20 bp, Homo sapiens
gccaactgtttccctgctga

SEQ ID NO: 2198092 - DNA, 22 bp, Homo sapiens
gccaactgtttccctgctgaat

SEQ ID NO: 2198093 - DNA, 20 bp, Homo sapiens
gccaagaagcagtggcctta

SEQ ID NO: 2198094 - DNA, 15 bp, Homo sapiens
gccaagccagattct

SEQ ID NO: 2198095 - DNA, 13 bp, Homo sapiens
gccaagccaggga

SEQ ID NO: 2198096 - DNA, 19 bp, Homo sapiens
gccaaggccgcccacctgc

SEQ ID NO: 2198097 - DNA, 21 bp, Homo sapiens
gccaaggcctatgccacctgc

SEQ ID NO: 2198098 - DNA, 22 bp, Homo sapiens
gccaaggcctatgccacctgca

SEQ ID NO: 2198099 - DNA, 22 bp, Homo sapiens
gccaagtaacaatgcatgcttt

SEQ ID NO: 2198100 - DNA, 23 bp, Homo sapiens
gccaagtcccaccggttgcttct

SEQ ID NO: 2198101 - DNA, 22 bp, Homo sapiens
gccaagttatgcagctgttctg

SEQ ID NO: 2198102 - DNA, 13 bp, Homo sapiens
gccaatggaacct

SEQ ID NO: 2198103 - DNA, 13 bp, Homo sapiens
gccacagacccct

SEQ ID NO: 2198104 - DNA, 17 bp, Homo sapiens
gccacagacccctggga

SEQ ID NO: 2198105 - DNA, 20 bp, Homo sapiens
gccacagacccctgggagct

SEQ ID NO: 2198106 - DNA, 17 bp, Homo sapiens
gccacatccccgctggc

SEQ ID NO: 2198107 - DNA, 20 bp, Homo sapiens
gccacatccccgctggctgg

SEQ ID NO: 2198108 - DNA, 22 bp, Homo sapiens
gccaccaacataaaacaaaacc

SEQ ID NO: 2198109 - DNA, 18 bp, Homo sapiens
gccaccacacccagcctc

SEQ ID NO: 2198110 - DNA, 21 bp, Homo sapiens
gccaccacacccagcctctgt

SEQ ID NO: 2198111 - DNA, 16 bp, Homo sapiens
gccaccaccccccact

SEQ ID NO: 2198112 - DNA, 17 bp, Homo sapiens
gccaccctaactgagct

SEQ ID NO: 2198113 - DNA, 18 bp, Homo sapiens
gccaccctaactgagctg

SEQ ID NO: 2198114 - DNA, 22 bp, Homo sapiens
gccaccctaactgagctgccag

SEQ ID NO: 2198115 - DNA, 21 bp, Homo sapiens
gccaccctctgcagggcagcc

SEQ ID NO: 2198116 - DNA, 12 bp, Homo sapiens
gccacctgcagg

SEQ ID NO: 2198117 - DNA, 17 bp, Homo sapiens
gccacggcctggctggt

SEQ ID NO: 2198118 - DNA, 23 bp, Homo sapiens
gccactaactagagcagccctgg

SEQ ID NO: 2198119 - DNA, 15 bp, Homo sapiens
gccactaggctgggt

SEQ ID NO: 2198120 - DNA, 16 bp, Homo sapiens
gccactaggctgggtg

SEQ ID NO: 2198121 - DNA, 17 bp, Homo sapiens
gccactaggctgggtgc

SEQ ID NO: 2198122 - DNA, 22 bp, Homo sapiens
gccactaggctgggtgcccaca

SEQ ID NO: 2198123 - DNA, 12 bp, Homo sapiens
gccactggaaat

SEQ ID NO: 2198124 - DNA, 21 bp, Homo sapiens
gccactggaaatgcatgactt

SEQ ID NO: 2198125 - DNA, 20 bp, Homo sapiens
gccactttgcagacctggga

SEQ ID NO: 2198126 - DNA, 14 bp, Homo sapiens
gccagaaccccgag

SEQ ID NO: 2198127 - DNA, 15 bp, Homo sapiens
gccagaccagagctc

SEQ ID NO: 2198128 - DNA, 20 bp, Homo sapiens
gccagaggcagaaccctggt

SEQ ID NO: 2198129 - DNA, 23 bp, Homo sapiens
gccagaggcagaaccctggtgag

SEQ ID NO: 2198130 - DNA, 9 bp, Homo sapiens
gccagccac

SEQ ID NO: 2198131 - DNA, 10 bp, Homo sapiens
gccagccaca

SEQ ID NO: 2198132 - DNA, 11 bp, Homo sapiens
gccagccacag

SEQ ID NO: 2198133 - DNA, 23 bp, Homo sapiens
gccagccacagacccctgggagc

SEQ ID NO: 2198134 - DNA, 15 bp, Homo sapiens
gccagccctaggcta

SEQ ID NO: 2198135 - DNA, 20 bp, Homo sapiens
gccaggctgcggtgggcagc

SEQ ID NO: 2198136 - DNA, 22 bp, Homo sapiens
gccaggctgcggtgggcagcca

SEQ ID NO: 2198137 - DNA, 15 bp, Homo sapiens
gccagggatggggcc

SEQ ID NO: 2198138 - DNA, 16 bp, Homo sapiens
gccaggggcttttgct

SEQ ID NO: 2198139 - DNA, 20 bp, Homo sapiens
gccagtaaggcagctctgtc

SEQ ID NO: 2198140 - DNA, 14 bp, Homo sapiens
gccagttgacatcc

SEQ ID NO: 2198141 - DNA, 12 bp, Homo sapiens
gccatagctcct

SEQ ID NO: 2198142 - DNA, 18 bp, Homo sapiens
gccatagctcctgctcca

SEQ ID NO: 2198143 - DNA, 18 bp, Homo sapiens
gccatcggtcctgtctcc

SEQ ID NO: 2198144 - DNA, 19 bp, Homo sapiens
gccatctgactgccaagcc

SEQ ID NO: 2198145 - DNA, 20 bp, Homo sapiens
gccatctggaaatccagctg

SEQ ID NO: 2198146 - DNA, 21 bp, Homo sapiens
gccatctggaaatccagctgg

SEQ ID NO: 2198147 - DNA, 19 bp, Homo sapiens
gccatgattttggccactt

SEQ ID NO: 2198148 - DNA, 14 bp, Homo sapiens
gccatgctgctatg

SEQ ID NO: 2198149 - DNA, 19 bp, Homo sapiens
gccatgctgctatgaagac

SEQ ID NO: 2198150 - DNA, 20 bp, Homo sapiens
gccatgctgctttgcacaca

SEQ ID NO: 2198151 - DNA, 21 bp, Homo sapiens
gccatgggaccaaacctagcc

SEQ ID NO: 2198152 - DNA, 23 bp, Homo sapiens
gccatgtagccacccaactttgt

SEQ ID NO: 2198153 - DNA, 14 bp, Homo sapiens
gccattataatttt

SEQ ID NO: 2198154 - DNA, 17 bp, Homo sapiens
gcccaacctcagcaacc

SEQ ID NO: 2198155 - DNA, 15 bp, Homo sapiens
gcccaagcctggtct

SEQ ID NO: 2198156 - DNA, 14 bp, Homo sapiens
gcccacagcccgca

SEQ ID NO: 2198157 - DNA, 17 bp, Homo sapiens
gcccacaggtgtcccca

SEQ ID NO: 2198158 - DNA, 23 bp, Homo sapiens
gcccacaggtgtccccagcccac

SEQ ID NO: 2198159 - DNA, 21 bp, Homo sapiens
gcccacctaccttcaaagctg

SEQ ID NO: 2198160 - DNA, 22 bp, Homo sapiens
gcccacctaccttcaaagctga

SEQ ID NO: 2198161 - DNA, 12 bp, Homo sapiens
gcccagagctgg

SEQ ID NO: 2198162 - DNA, 13 bp, Homo sapiens
gcccagcagagcc

SEQ ID NO: 2198163 - DNA, 23 bp, Homo sapiens
gcccagcagagccgttcctggga

SEQ ID NO: 2198164 - DNA, 16 bp, Homo sapiens
gcccagcccagctgct

SEQ ID NO: 2198165 - DNA, 14 bp, Homo sapiens
gcccagctcagtct

SEQ ID NO: 2198166 - DNA, 14 bp, Homo sapiens
gcccagctgctctg

SEQ ID NO: 2198167 - DNA, 22 bp, Homo sapiens
gcccagctgctctgcccagagc

SEQ ID NO: 2198168 - DNA, 17 bp, Homo sapiens
gcccagctggggcccct

SEQ ID NO: 2198169 - DNA, 21 bp, Homo sapiens
gcccagctggggcccctcggc

SEQ ID NO: 2198170 - DNA, 24 bp, Homo sapiens
gcccagctggggcccctcggctac

SEQ ID NO: 2198171 - DNA, 10 bp, Homo sapiens
gcccaggagg

SEQ ID NO: 2198172 - DNA, 19 bp, Homo sapiens
gcccaggctggagtgcagt

SEQ ID NO: 2198173 - DNA, 21 bp, Homo sapiens
gcccaggggctttggtggccc

SEQ ID NO: 2198174 - DNA, 17 bp, Homo sapiens
gcccagggtcctgtgcc

SEQ ID NO: 2198175 - DNA, 18 bp, Homo sapiens
gcccagggtcctgtgcct

SEQ ID NO: 2198176 - DNA, 21 bp, Homo sapiens
gcccagggtcctgtgcctgga

SEQ ID NO: 2198177 - DNA, 23 bp, Homo sapiens
gcccagtcatgacatttctcaaa

SEQ ID NO: 2198178 - DNA, 19 bp, Homo sapiens
gcccatcactcggctgtgg

SEQ ID NO: 2198179 - DNA, 14 bp, Homo sapiens
gcccatcctgacca

SEQ ID NO: 2198180 - DNA, 15 bp, Homo sapiens
gcccatcctgaccag

SEQ ID NO: 2198181 - DNA, 18 bp, Homo sapiens
gcccatcctgaccagctg

SEQ ID NO: 2198182 - DNA, 21 bp, Homo sapiens
gccccaagaaggctggggcta

SEQ ID NO: 2198183 - DNA, 14 bp, Homo sapiens
gccccacctgccac

SEQ ID NO: 2198184 - DNA, 23 bp, Homo sapiens
gccccacctgccactaggctggg

SEQ ID NO: 2198185 - DNA, 18 bp, Homo sapiens
gccccagaggccctggag

SEQ ID NO: 2198186 - DNA, 14 bp, Homo sapiens
gccccagcccagcc

SEQ ID NO: 2198187 - DNA, 16 bp, Homo sapiens
gccccatcagcagctt

SEQ ID NO: 2198188 - DNA, 13 bp, Homo sapiens
gctggagagtaga

SEQ ID NO: 2198189 - DNA, 19 bp, Homo sapiens
gctggagccactaactaga

SEQ ID NO: 2198190 - DNA, 12 bp, Homo sapiens
gctggagcggct

SEQ ID NO: 2198191 - DNA, 15 bp, Homo sapiens
gctggagtgcagtgg

SEQ ID NO: 2198192 - DNA, 19 bp, Homo sapiens
gctggagtgcagtggtgcg

SEQ ID NO: 2198193 - DNA, 12 bp, Homo sapiens
gctggcacagac

SEQ ID NO: 2198194 - DNA, 20 bp, Homo sapiens
gctggcaggagggtggcact

SEQ ID NO: 2198195 - DNA, 21 bp, Homo sapiens
gctggccgggcacagctgtgg

SEQ ID NO: 2198196 - DNA, 15 bp, Homo sapiens
gctggcctcacctgg

SEQ ID NO: 2198197 - DNA, 16 bp, Homo sapiens
gctggcctcacctggg

SEQ ID NO: 2198198 - DNA, 16 bp, Homo sapiens
gctggcctcagactca

SEQ ID NO: 2198199 - DNA, 14 bp, Homo sapiens
gctggcctcttcct

SEQ ID NO: 2198200 - DNA, 14 bp, Homo sapiens
gctggcggaacctg

SEQ ID NO: 2198201 - DNA, 16 bp, Homo sapiens
gctgggagagccaagg

SEQ ID NO: 2198202 - DNA, 22 bp, Homo sapiens
gctggggacagctttcctgggt

SEQ ID NO: 2198203 - DNA, 23 bp, Homo sapiens
gctggggacagctttcctgggtg

SEQ ID NO: 2198204 - DNA, 13 bp, Homo sapiens
gctgggtgcccac

SEQ ID NO: 2198205 - DNA, 15 bp, Homo sapiens
gctgggtgcccacag

SEQ ID NO: 2198206 - DNA, 20 bp, Homo sapiens
gctgggtgtattaggactgg

SEQ ID NO: 2198207 - DNA, 14 bp, Homo sapiens
gctggtacctgccc

SEQ ID NO: 2198208 - DNA, 17 bp, Homo sapiens
gctggtacctgccctct

SEQ ID NO: 2198209 - DNA, 20 bp, Homo sapiens
gctggtcttgaactcctgac

SEQ ID NO: 2198210 - DNA, 19 bp, Homo sapiens
gctggtgccgaagtgtttc

SEQ ID NO: 2198211 - DNA, 13 bp, Homo sapiens
gctggtgggaagg

SEQ ID NO: 2198212 - DNA, 13 bp, Homo sapiens
gctggtgggcacc

SEQ ID NO: 2198213 - DNA, 19 bp, Homo sapiens
gctggtgggcaccaagagc

SEQ ID NO: 2198214 - DNA, 14 bp, Homo sapiens
gctgtatgtacttc

SEQ ID NO: 2198215 - DNA, 23 bp, Homo sapiens
gctgtatttagtaaaaataaatc

SEQ ID NO: 2198216 - DNA, 18 bp, Homo sapiens
gctgtcagccctgctgtc

SEQ ID NO: 2198217 - DNA, 13 bp, Homo sapiens
gctgtccctgcag

SEQ ID NO: 2198218 - DNA, 18 bp, Homo sapiens
gctgtccctgcagggcca

SEQ ID NO: 2198219 - DNA, 20 bp, Homo sapiens
gctgtcttgatgactgctga

SEQ ID NO: 2198220 - DNA, 22 bp, Homo sapiens
gctgtgccccatcagcagcttg

SEQ ID NO: 2198221 - DNA, 19 bp, Homo sapiens
gctgtggattttgtggctt

SEQ ID NO: 2198222 - DNA, 18 bp, Homo sapiens
gctgtggcatcaggaaag

SEQ ID NO: 2198223 - DNA, 19 bp, Homo sapiens
gctgtgggtcagtgtgcca

SEQ ID NO: 2198224 - DNA, 15 bp, Homo sapiens
gctgtggttcctggg

SEQ ID NO: 2198225 - DNA, 16 bp, Homo sapiens
gctgtggttcctgggg

SEQ ID NO: 2198226 - DNA, 20 bp, Homo sapiens
gctgttgtctgccgtgagag

SEQ ID NO: 2198227 - DNA, 22 bp, Homo sapiens
gctgttgtctgccgtgagagcc

SEQ ID NO: 2198228 - DNA, 21 bp, Homo sapiens
gctgttgttcagaagttgtta

SEQ ID NO: 2198229 - DNA, 19 bp, Homo sapiens
gctgtttgagattctcaaa

SEQ ID NO: 2198230 - DNA, 11 bp, Homo sapiens
gctgttttctt

SEQ ID NO: 2198231 - DNA, 18 bp, Homo sapiens
gcttaagggggtgtaatg

SEQ ID NO: 2198232 - DNA, 13 bp, Homo sapiens
gcttacaggaagc

SEQ ID NO: 2198233 - DNA, 13 bp, Homo sapiens
gcttactcttgct

SEQ ID NO: 2198234 - DNA, 18 bp, Homo sapiens
gcttaggtgaaggcagaa

SEQ ID NO: 2198235 - DNA, 15 bp, Homo sapiens
gcttatatctggcct

SEQ ID NO: 2198236 - DNA, 17 bp, Homo sapiens
gcttatatctggcctct

SEQ ID NO: 2198237 - DNA, 18 bp, Homo sapiens
gcttcaaataaagtaaat

SEQ ID NO: 2198238 - DNA, 23 bp, Homo sapiens
gcttcattattacgtggcaaaat

SEQ ID NO: 2198239 - DNA, 15 bp, Homo sapiens
gcttccctacccaca

SEQ ID NO: 2198240 - DNA, 22 bp, Homo sapiens
gcttccctacccacagggcctg

SEQ ID NO: 2198241 - DNA, 18 bp, Homo sapiens
gcttccctctgctccaca

SEQ ID NO: 2198242 - DNA, 23 bp, Homo sapiens
gcttccctttcactgaagtgaat

SEQ ID NO: 2198243 - DNA, 14 bp, Homo sapiens
gcttcctaaatggc

SEQ ID NO: 2198244 - DNA, 19 bp, Homo sapiens
gcttgaatcaggaggagat

SEQ ID NO: 2198245 - DNA, 12 bp, Homo sapiens
gcttgctgcacc

SEQ ID NO: 2198246 - DNA, 17 bp, Homo sapiens
gcttggcacatttttga

SEQ ID NO: 2198247 - DNA, 15 bp, Homo sapiens
gcttggggcagccat

SEQ ID NO: 2198248 - DNA, 16 bp, Homo sapiens
gcttgtactgggacat

SEQ ID NO: 2198249 - DNA, 15 bp, Homo sapiens
gctttctcctgtgcc

SEQ ID NO: 2198250 - DNA, 15 bp, Homo sapiens
gctttgattgttcat

SEQ ID NO: 2198251 - DNA, 16 bp, Homo sapiens
gctttgtcccacagct

SEQ ID NO: 2198252 - DNA, 17 bp, Homo sapiens
gcttttacggtgatatt

SEQ ID NO: 2198253 - DNA, 22 bp, Homo sapiens
gcttttagtacccacctgagct

SEQ ID NO: 2198254 - DNA, 23 bp, Homo sapiens
gcttttagtacccacctgagctt

SEQ ID NO: 2198255 - DNA, 16 bp, Homo sapiens
gcttttgtaaaataaa

SEQ ID NO: 2198256 - DNA, 15 bp, Homo sapiens
ggaaaagtgttcctt

SEQ ID NO: 2198257 - DNA, 15 bp, Homo sapiens
ggaaaatatcacttt

SEQ ID NO: 2198258 - DNA, 19 bp, Homo sapiens
ggaaaccaaggtcaggagg

SEQ ID NO: 2198259 - DNA, 21 bp, Homo sapiens
ggaaacttccaagacctgact

SEQ ID NO: 2198260 - DNA, 15 bp, Homo sapiens
ggaaagattgtgtct

SEQ ID NO: 2198261 - DNA, 21 bp, Homo sapiens
ggaaatggtttccatctgtac

SEQ ID NO: 2198262 - DNA, 14 bp, Homo sapiens
ggaacctggctgcg

SEQ ID NO: 2198263 - DNA, 19 bp, Homo sapiens
ggaactcaaaggactgacc

SEQ ID NO: 2198264 - DNA, 12 bp, Homo sapiens
ggaactgctgcc

SEQ ID NO: 2198265 - DNA, 11 bp, Homo sapiens
ggaagaacttg

SEQ ID NO: 2198266 - DNA, 15 bp, Homo sapiens
ggaagagagcctgcc

SEQ ID NO: 2198267 - DNA, 21 bp, Homo sapiens
ggaagcacaagaagtgggagt

SEQ ID NO: 2198268 - DNA, 15 bp, Homo sapiens
ggaagccacgtgctg

SEQ ID NO: 2198269 - DNA, 20 bp, Homo sapiens
ggaagccacgtgctggagag

SEQ ID NO: 2198270 - DNA, 11 bp, Homo sapiens
ggaagcctgct

SEQ ID NO: 2198271 - DNA, 22 bp, Homo sapiens
ggaagctttctctgcttcagct

SEQ ID NO: 2198272 - DNA, 12 bp, Homo sapiens
ggaaggagcctg

SEQ ID NO: 2198273 - DNA, 23 bp, Homo sapiens
ggaaggccacctgcaggtcactg

SEQ ID NO: 2198274 - DNA, 17 bp, Homo sapiens
ggaagtagcaggcccag

SEQ ID NO: 2198275 - DNA, 16 bp, Homo sapiens
ggaagtggtggggact

SEQ ID NO: 2198276 - DNA, 16 bp, Homo sapiens
ggaatcgaggctgtgt

SEQ ID NO: 2198277 - DNA, 16 bp, Homo sapiens
ggaatggggacctggg

SEQ ID NO: 2198278 - DNA, 14 bp, Homo sapiens
ggaattccaatatt

SEQ ID NO: 2198279 - DNA, 21 bp, Homo sapiens
ggaattccaatatttataatt

SEQ ID NO: 2198280 - DNA, 17 bp, Homo sapiens
ggacagctgcaggtgcc

SEQ ID NO: 2198281 - DNA, 19 bp, Homo sapiens
ggacagctgcaggtgccca

SEQ ID NO: 2198282 - DNA, 15 bp, Homo sapiens
ggacaggaccctcag

SEQ ID NO: 2198283 - DNA, 16 bp, Homo sapiens
ggacaggaccctcagg

SEQ ID NO: 2198284 - DNA, 15 bp, Homo sapiens
ggacaggtctgggag

SEQ ID NO: 2198285 - DNA, 19 bp, Homo sapiens
ggacatttcatataaatgg

SEQ ID NO: 2198286 - DNA, 16 bp, Homo sapiens
ggaccaccctgagccg

SEQ ID NO: 2198287 - DNA, 14 bp, Homo sapiens
ggaccagatgctga

SEQ ID NO: 2198288 - DNA, 15 bp, Homo sapiens
ggaccagtgagacag

SEQ ID NO: 2198289 - DNA, 15 bp, Homo sapiens
ggaccgccaaagaat

SEQ ID NO: 2198290 - DNA, 14 bp, Homo sapiens
ggacctctgggctt

SEQ ID NO: 2198291 - DNA, 13 bp, Homo sapiens
ggacgcattccaa

SEQ ID NO: 2198292 - DNA, 18 bp, Homo sapiens
ggactgatgtcatcttga

SEQ ID NO: 2198293 - DNA, 19 bp, Homo sapiens
ggactgatgtcatcttgag

SEQ ID NO: 2198294 - DNA, 13 bp, Homo sapiens
ggactgcaccttg

SEQ ID NO: 2198295 - DNA, 22 bp, Homo sapiens
ggactgcaccttgtgaaggaaa

SEQ ID NO: 2198296 - DNA, 17 bp, Homo sapiens
ggacttaagacaaatgg

SEQ ID NO: 2198297 - DNA, 22 bp, Homo sapiens
ggacttaagacaaatgggactg

SEQ ID NO: 2198298 - DNA, 23 bp, Homo sapiens
ggacttcaaaatcagtgatggga

SEQ ID NO: 2198299 - DNA, 13 bp, Homo sapiens
ggacttccatttg

SEQ ID NO: 2198300 - DNA, 13 bp, Homo sapiens
ggacttgtgcctc

SEQ ID NO: 2198301 - DNA, 17 bp, Homo sapiens
ggagaaagagctgcctg

SEQ ID NO: 2198302 - DNA, 19 bp, Homo sapiens
ggagaaagagctgcctgga

SEQ ID NO: 2198303 - DNA, 21 bp, Homo sapiens
ggagaacatctgccttgctgc

SEQ ID NO: 2198304 - DNA, 19 bp, Homo sapiens
ggagacaatgcagatgcca

SEQ ID NO: 2198305 - DNA, 11 bp, Homo sapiens
ggagaggaagc

SEQ ID NO: 2198306 - DNA, 13 bp, Homo sapiens
ggagaggaagcac

SEQ ID NO: 2198307 - DNA, 14 bp, Homo sapiens
ggagaggaagcaca

SEQ ID NO: 2198308 - DNA, 12 bp, Homo sapiens
ggagaggaagcc

SEQ ID NO: 2198309 - DNA, 17 bp, Homo sapiens
ggagatcggggccagag

SEQ ID NO: 2198310 - DNA, 18 bp, Homo sapiens
ggagatcggggccagagg

SEQ ID NO: 2198311 - DNA, 13 bp, Homo sapiens
gtagccagacagt

SEQ ID NO: 2198312 - DNA, 16 bp, Homo sapiens
gtaggagggtgggaag

SEQ ID NO: 2198313 - DNA, 21 bp, Homo sapiens
gtagggggcctgagttgaggg

SEQ ID NO: 2198314 - DNA, 16 bp, Homo sapiens
gtagtttgtattaaac

SEQ ID NO: 2198315 - DNA, 23 bp, Homo sapiens
gtagttttttggttttgtttctg

SEQ ID NO: 2198316 - DNA, 16 bp, Homo sapiens
gtataatgacttttaa

SEQ ID NO: 2198317 - DNA, 20 bp, Homo sapiens
gtataatgacttttaaaatt

SEQ ID NO: 2198318 - DNA, 14 bp, Homo sapiens
gtatagcttaagat

SEQ ID NO: 2198319 - DNA, 15 bp, Homo sapiens
gtatataaatggtga

SEQ ID NO: 2198320 - DNA, 16 bp, Homo sapiens
gtatattcaaaaatta

SEQ ID NO: 2198321 - DNA, 19 bp, Homo sapiens
gtatcaaacagctcaggct

SEQ ID NO: 2198322 - DNA, 18 bp, Homo sapiens
gtatctcgaagtcttcca

SEQ ID NO: 2198323 - DNA, 22 bp, Homo sapiens
gtatgaaagggacggttgtggt

SEQ ID NO: 2198324 - DNA, 20 bp, Homo sapiens
gtatgagtgcaagcaaagca

SEQ ID NO: 2198325 - DNA, 18 bp, Homo sapiens
gtatgataaacagttgaa

SEQ ID NO: 2198326 - DNA, 13 bp, Homo sapiens
gtatgtattattt

SEQ ID NO: 2198327 - DNA, 18 bp, Homo sapiens
gtatgtgtagtgtgtttg

SEQ ID NO: 2198328 - DNA, 19 bp, Homo sapiens
gtattaaacctttccattt

SEQ ID NO: 2198329 - DNA, 15 bp, Homo sapiens
gtattaacctacctg

SEQ ID NO: 2198330 - DNA, 16 bp, Homo sapiens
gtattaacctacctgt

SEQ ID NO: 2198331 - DNA, 18 bp, Homo sapiens
gtattaacctacctgtga

SEQ ID NO: 2198332 - DNA, 16 bp, Homo sapiens
gtattatttacattta

SEQ ID NO: 2198333 - DNA, 17 bp, Homo sapiens
gtattcctgatatgcct

SEQ ID NO: 2198334 - DNA, 21 bp, Homo sapiens
gtatttaacagaaattgtata

SEQ ID NO: 2198335 - DNA, 12 bp, Homo sapiens
gtattttaaaat

SEQ ID NO: 2198336 - DNA, 16 bp, Homo sapiens
gtattttttttttcca

SEQ ID NO: 2198337 - DNA, 23 bp, Homo sapiens
gtcaagcctgtggatgatttttt

SEQ ID NO: 2198338 - DNA, 12 bp, Homo sapiens
gtcaaggcctgt

SEQ ID NO: 2198339 - DNA, 16 bp, Homo sapiens
gtcaatgtttgcttta

SEQ ID NO: 2198340 - DNA, 18 bp, Homo sapiens
gtcacactcttcagtgac

SEQ ID NO: 2198341 - DNA, 12 bp, Homo sapiens
gtcacagagaac

SEQ ID NO: 2198342 - DNA, 16 bp, Homo sapiens
gtcaccaggggaggag

SEQ ID NO: 2198343 - DNA, 13 bp, Homo sapiens
gtcacccaggctg

SEQ ID NO: 2198344 - DNA, 19 bp, Homo sapiens
gtcacctgcacagggccct

SEQ ID NO: 2198345 - DNA, 21 bp, Homo sapiens
gtcacctgcacagggccctct

SEQ ID NO: 2198346 - DNA, 16 bp, Homo sapiens
gtcacgcaggctgagt

SEQ ID NO: 2198347 - DNA, 23 bp, Homo sapiens
gtcactcaacaaaagtgctttgg

SEQ ID NO: 2198348 - DNA, 13 bp, Homo sapiens
gtcagccacatgg

SEQ ID NO: 2198349 - DNA, 15 bp, Homo sapiens
gtcagccctgctgtc

SEQ ID NO: 2198350 - DNA, 19 bp, Homo sapiens
gtcagtacccacctgagct

SEQ ID NO: 2198351 - DNA, 21 bp, Homo sapiens
gtcagtgtgccaccctctgca

SEQ ID NO: 2198352 - DNA, 22 bp, Homo sapiens
gtcagtgtgccaccctctgcag

SEQ ID NO: 2198353 - DNA, 21 bp, Homo sapiens
gtcatcagtattgtgtaaagg

SEQ ID NO: 2198354 - DNA, 23 bp, Homo sapiens
gtcatcagtattgtgtaaaggaa

SEQ ID NO: 2198355 - DNA, 19 bp, Homo sapiens
gtcatccacacaacaccag

SEQ ID NO: 2198356 - DNA, 23 bp, Homo sapiens
gtcatccacacaacaccaggact

SEQ ID NO: 2198357 - DNA, 18 bp, Homo sapiens
gtcatgacatttctcaaa

SEQ ID NO: 2198358 - DNA, 19 bp, Homo sapiens
gtcatgtaggttgtctaaa

SEQ ID NO: 2198359 - DNA, 12 bp, Homo sapiens
gtcatttttgtt

SEQ ID NO: 2198360 - DNA, 17 bp, Homo sapiens
gtccaagtgtttcttgt

SEQ ID NO: 2198361 - DNA, 17 bp, Homo sapiens
gtccacccgtttccaag

SEQ ID NO: 2198362 - DNA, 22 bp, Homo sapiens
gtccacccgtttccaagcctgg

SEQ ID NO: 2198363 - DNA, 20 bp, Homo sapiens
gtccactggggagtgctgga

SEQ ID NO: 2198364 - DNA, 13 bp, Homo sapiens
gtccagattgtag

SEQ ID NO: 2198365 - DNA, 11 bp, Homo sapiens
gtccagggctt

SEQ ID NO: 2198366 - DNA, 11 bp, Homo sapiens
gtcccacagct

SEQ ID NO: 2198367 - DNA, 20 bp, Homo sapiens
gtcccaccggttgcttctgg

SEQ ID NO: 2198368 - DNA, 21 bp, Homo sapiens
gtcccaccggttgcttctggg

SEQ ID NO: 2198369 - DNA, 22 bp, Homo sapiens
gtcccaccggttgcttctggga

SEQ ID NO: 2198370 - DNA, 19 bp, Homo sapiens
gtcccagctaaagaggtgg

SEQ ID NO: 2198371 - DNA, 21 bp, Homo sapiens
gtcccagctaaagaggtgggg

SEQ ID NO: 2198372 - DNA, 12 bp, Homo sapiens
gtcccagctgaa

SEQ ID NO: 2198373 - DNA, 18 bp, Homo sapiens
gtcccagctgaaggcagt

SEQ ID NO: 2198374 - DNA, 20 bp, Homo sapiens
gtcccagctgaaggcagtgg

SEQ ID NO: 2198375 - DNA, 12 bp, Homo sapiens
gtccccacactc

SEQ ID NO: 2198376 - DNA, 24 bp, Homo sapiens
gtccccacactcctacacctaact

SEQ ID NO: 2198377 - DNA, 14 bp, Homo sapiens
gtcccgagccccct

SEQ ID NO: 2198378 - DNA, 20 bp, Homo sapiens
gtcccgagccccctgtcctt

SEQ ID NO: 2198379 - DNA, 15 bp, Homo sapiens
gtccctgcagggcca

SEQ ID NO: 2198380 - DNA, 16 bp, Homo sapiens
gtcctctaaacacact

SEQ ID NO: 2198381 - DNA, 13 bp, Homo sapiens
gtcctgaggcaga

SEQ ID NO: 2198382 - DNA, 15 bp, Homo sapiens
gtcctgcagagctgg

SEQ ID NO: 2198383 - DNA, 16 bp, Homo sapiens
gtcctgcagagctggg

SEQ ID NO: 2198384 - DNA, 18 bp, Homo sapiens
gtcctgcagagctggggg

SEQ ID NO: 2198385 - DNA, 22 bp, Homo sapiens
gtccttcaattttcttcacact

SEQ ID NO: 2198386 - DNA, 12 bp, Homo sapiens
gtcgggctcagc

SEQ ID NO: 2198387 - DNA, 21 bp, Homo sapiens
gtcgggctcagctctggctca

SEQ ID NO: 2198388 - DNA, 23 bp, Homo sapiens
gtctaaaataggttttccctgtt

SEQ ID NO: 2198389 - DNA, 14 bp, Homo sapiens
gtctacatgtgcca

SEQ ID NO: 2198390 - DNA, 15 bp, Homo sapiens
gtctagcaaagccac

SEQ ID NO: 2198391 - DNA, 15 bp, Homo sapiens
gtctcagtctgtcac

SEQ ID NO: 2198392 - DNA, 20 bp, Homo sapiens
gtctccaggggcctgcagaa

SEQ ID NO: 2198393 - DNA, 11 bp, Homo sapiens
gtctcccctcg

SEQ ID NO: 2198394 - DNA, 14 bp, Homo sapiens
gtctcccctctgct

SEQ ID NO: 2198395 - DNA, 16 bp, Homo sapiens
gtctcccctctgctgg

SEQ ID NO: 2198396 - DNA, 11 bp, Homo sapiens
gtctcctgccg

SEQ ID NO: 2198397 - DNA, 12 bp, Homo sapiens
gtctctcattct

SEQ ID NO: 2198398 - DNA, 18 bp, Homo sapiens
gtctctgggccccaggca

SEQ ID NO: 2198399 - DNA, 17 bp, Homo sapiens
gtctgaaattttctaga

SEQ ID NO: 2198400 - DNA, 21 bp, Homo sapiens
gtctgaaattttctagaatac

SEQ ID NO: 2198401 - DNA, 17 bp, Homo sapiens
gtctgagcggccgcctg

SEQ ID NO: 2198402 - DNA, 19 bp, Homo sapiens
gtctgagcggccgcctgtc

SEQ ID NO: 2198403 - DNA, 17 bp, Homo sapiens
gtctgcgccgctgtgct

SEQ ID NO: 2198404 - DNA, 17 bp, Homo sapiens
gtctgctgctcccagcc

SEQ ID NO: 2198405 - DNA, 23 bp, Homo sapiens
gtctggcccaaaggaagtagcag

SEQ ID NO: 2198406 - DNA, 19 bp, Homo sapiens
gtctgggagaggcagagtg

SEQ ID NO: 2198407 - DNA, 14 bp, Homo sapiens
gtctgggaggcagg

SEQ ID NO: 2198408 - DNA, 19 bp, Homo sapiens
gtctgtaggtggagaggtg

SEQ ID NO: 2198409 - DNA, 21 bp, Homo sapiens
gtctgtttccttctctttctc

SEQ ID NO: 2198410 - DNA, 20 bp, Homo sapiens
gtcttacaaggcaggccttt

SEQ ID NO: 2198411 - DNA, 22 bp, Homo sapiens
gtcttacaaggcaggcctttcc

SEQ ID NO: 2198412 - DNA, 14 bp, Homo sapiens
gtcttcaatctctg

SEQ ID NO: 2198413 - DNA, 18 bp, Homo sapiens
gtcttcaatctctgttct

SEQ ID NO: 2198414 - DNA, 18 bp, Homo sapiens
gtcttcagatcctgctgc

SEQ ID NO: 2198415 - DNA, 16 bp, Homo sapiens
gtcttcatccttagca

SEQ ID NO: 2198416 - DNA, 21 bp, Homo sapiens
gtcttcatccttagcaacagc

SEQ ID NO: 2198417 - DNA, 13 bp, Homo sapiens
gtcttccatcagc

SEQ ID NO: 2198418 - DNA, 14 bp, Homo sapiens
gtcttccatcagca

SEQ ID NO: 2198419 - DNA, 20 bp, Homo sapiens
gtcttcctcctcccctggca

SEQ ID NO: 2198420 - DNA, 13 bp, Homo sapiens
gtcttctccccag

SEQ ID NO: 2198421 - DNA, 17 bp, Homo sapiens
gtcttggcctcccaaag

SEQ ID NO: 2198422 - DNA, 14 bp, Homo sapiens
gtcttgtactgtga

SEQ ID NO: 2198423 - DNA, 15 bp, Homo sapiens
gtctttgtgtgctgt

SEQ ID NO: 2198424 - DNA, 17 bp, Homo sapiens
gtgaaatttgttaatat

SEQ ID NO: 2198425 - DNA, 19 bp, Homo sapiens
gtgaacatgccttatattt

SEQ ID NO: 2198426 - DNA, 23 bp, Homo sapiens
gtgaagctggggacagctttcct

SEQ ID NO: 2198427 - DNA, 12 bp, Homo sapiens
gtgaatacatgg

SEQ ID NO: 2198428 - DNA, 18 bp, Homo sapiens
gtgaatacatggtagcag

SEQ ID NO: 2198429 - DNA, 21 bp, Homo sapiens
gtgacgggggttggggtgggg

SEQ ID NO: 2198430 - DNA, 16 bp, Homo sapiens
gtgactaccacttatt

SEQ ID NO: 2198431 - DNA, 12 bp, Homo sapiens
gtgactcctgct

SEQ ID NO: 2198432 - DNA, 15 bp, Homo sapiens
gtgactcctgctggt

SEQ ID NO: 2198433 - DNA, 12 bp, Homo sapiens
tctgttctgctc

SEQ ID NO: 2198434 - DNA, 18 bp, Homo sapiens
tcttaaactgaaagcttt

SEQ ID NO: 2198435 - DNA, 21 bp, Homo sapiens
tcttacaaggcaggcctttcc

SEQ ID NO: 2198436 - DNA, 22 bp, Homo sapiens
tcttacaaggcaggcctttcct

SEQ ID NO: 2198437 - DNA, 22 bp, Homo sapiens
tcttagaacagatggctgtgaa

SEQ ID NO: 2198438 - DNA, 19 bp, Homo sapiens
tcttagaagctcacgcctt

SEQ ID NO: 2198439 - DNA, 14 bp, Homo sapiens
tcttagattatgtt

SEQ ID NO: 2198440 - DNA, 13 bp, Homo sapiens
tcttagcttacag

SEQ ID NO: 2198441 - DNA, 22 bp, Homo sapiens
tcttagtcctccctgctcagct

SEQ ID NO: 2198442 - DNA, 19 bp, Homo sapiens
tcttatgtatgataaacag

SEQ ID NO: 2198443 - DNA, 14 bp, Homo sapiens
tcttcaatctctgg

SEQ ID NO: 2198444 - DNA, 14 bp, Homo sapiens
tcttcaatctctgt

SEQ ID NO: 2198445 - DNA, 16 bp, Homo sapiens
tcttcagatcctgctg

SEQ ID NO: 2198446 - DNA, 21 bp, Homo sapiens
tcttcagtcatggcattcgca

SEQ ID NO: 2198447 - DNA, 18 bp, Homo sapiens
tcttcagtgactcctgct

SEQ ID NO: 2198448 - DNA, 21 bp, Homo sapiens
tcttcatccttagcaacagcc

SEQ ID NO: 2198449 - DNA, 16 bp, Homo sapiens
tcttcatttattttga

SEQ ID NO: 2198450 - DNA, 16 bp, Homo sapiens
tcttccaggcccagtc

SEQ ID NO: 2198451 - DNA, 21 bp, Homo sapiens
tcttccaggcccagtccactg

SEQ ID NO: 2198452 - DNA, 13 bp, Homo sapiens
tcttccatcagca

SEQ ID NO: 2198453 - DNA, 15 bp, Homo sapiens
tcttccatcagcagt

SEQ ID NO: 2198454 - DNA, 18 bp, Homo sapiens
tcttccatcagcagtgat

SEQ ID NO: 2198455 - DNA, 21 bp, Homo sapiens
tcttcctccctccctgcaggg

SEQ ID NO: 2198456 - DNA, 22 bp, Homo sapiens
tcttcctgaccaccttgcacta

SEQ ID NO: 2198457 - DNA, 14 bp, Homo sapiens
tcttcggaggtggc

SEQ ID NO: 2198458 - DNA, 22 bp, Homo sapiens
tcttcgtaacttcatattaata

SEQ ID NO: 2198459 - DNA, 19 bp, Homo sapiens
tcttctaaagaggaagcct

SEQ ID NO: 2198460 - DNA, 14 bp, Homo sapiens
tcttctcctcagct

SEQ ID NO: 2198461 - DNA, 16 bp, Homo sapiens
tcttctcctcagcttg

SEQ ID NO: 2198462 - DNA, 15 bp, Homo sapiens
tcttctctcttcaat

SEQ ID NO: 2198463 - DNA, 22 bp, Homo sapiens
tcttctgtattttttttttcca

SEQ ID NO: 2198464 - DNA, 18 bp, Homo sapiens
tcttcttaacagtttagt

SEQ ID NO: 2198465 - DNA, 15 bp, Homo sapiens
tcttgaactcctaga

SEQ ID NO: 2198466 - DNA, 23 bp, Homo sapiens
tcttgaataaagtattctagtgt

SEQ ID NO: 2198467 - DNA, 22 bp, Homo sapiens
tcttgacaccagctgttctgtc

SEQ ID NO: 2198468 - DNA, 18 bp, Homo sapiens
tcttgagagcgctggcct

SEQ ID NO: 2198469 - DNA, 19 bp, Homo sapiens
tcttgagagcgctggcctc

SEQ ID NO: 2198470 - DNA, 17 bp, Homo sapiens
tcttgaggcttctgctt

SEQ ID NO: 2198471 - DNA, 17 bp, Homo sapiens
tcttgtaaacctggagg

SEQ ID NO: 2198472 - DNA, 15 bp, Homo sapiens
tctttaattgttgct

SEQ ID NO: 2198473 - DNA, 20 bp, Homo sapiens
tctttaattgttgcttttac

SEQ ID NO: 2198474 - DNA, 14 bp, Homo sapiens
tctttagtggagaa

SEQ ID NO: 2198475 - DNA, 14 bp, Homo sapiens
tctttccttgtctc

SEQ ID NO: 2198476 - DNA, 14 bp, Homo sapiens
tctttctacagtat

SEQ ID NO: 2198477 - DNA, 18 bp, Homo sapiens
tctttctattcagcaaaa

SEQ ID NO: 2198478 - DNA, 14 bp, Homo sapiens
tctttctttttctg

SEQ ID NO: 2198479 - DNA, 18 bp, Homo sapiens
tctttctttttctgtctc

SEQ ID NO: 2198480 - DNA, 20 bp, Homo sapiens
tctttctttttctgtctctc

SEQ ID NO: 2198481 - DNA, 22 bp, Homo sapiens
tctttctttttctgtctctctt

SEQ ID NO: 2198482 - DNA, 18 bp, Homo sapiens
tctttgactataacaaaa

SEQ ID NO: 2198483 - DNA, 16 bp, Homo sapiens
tctttgtaaggacttg

SEQ ID NO: 2198484 - DNA, 21 bp, Homo sapiens
tcttttaatgatactgtctaa

SEQ ID NO: 2198485 - DNA, 21 bp, Homo sapiens
tcttttaccccacgaagacat

SEQ ID NO: 2198486 - DNA, 12 bp, Homo sapiens
tcttttactgtg

SEQ ID NO: 2198487 - DNA, 14 bp, Homo sapiens
tcttttactgtgga

SEQ ID NO: 2198488 - DNA, 21 bp, Homo sapiens
tcttttatgtggtggtttcta

SEQ ID NO: 2198489 - DNA, 20 bp, Homo sapiens
tcttttgaataatgtagtgc

SEQ ID NO: 2198490 - DNA, 18 bp, Homo sapiens
tcttttgaccccttcctg

SEQ ID NO: 2198491 - DNA, 23 bp, Homo sapiens
tcttttgccttttgcaaccagga

SEQ ID NO: 2198492 - DNA, 12 bp, Homo sapiens
tcttttgctttt

SEQ ID NO: 2198493 - DNA, 15 bp, Homo sapiens
tcttttggaaagtac

SEQ ID NO: 2198494 - DNA, 16 bp, Homo sapiens
tgaaaatatttaacga

SEQ ID NO: 2198495 - DNA, 17 bp, Homo sapiens
tgaaaatgatgtagaca

SEQ ID NO: 2198496 - DNA, 20 bp, Homo sapiens
tgaaaatgtccaggaaagtg

SEQ ID NO: 2198497 - DNA, 20 bp, Homo sapiens
tgaaaattacacccatgcac

SEQ ID NO: 2198498 - DNA, 21 bp, Homo sapiens
tgaaaattacacccatgcaca

SEQ ID NO: 2198499 - DNA, 15 bp, Homo sapiens
tgaaaattgtataaa

SEQ ID NO: 2198500 - DNA, 15 bp, Homo sapiens
tgaaagaagcaagac

SEQ ID NO: 2198501 - DNA, 23 bp, Homo sapiens
tgaaagaagcaagacacgtggcc

SEQ ID NO: 2198502 - DNA, 15 bp, Homo sapiens
tgaaagaatattagt

SEQ ID NO: 2198503 - DNA, 13 bp, Homo sapiens
tgaaagctgcttc

SEQ ID NO: 2198504 - DNA, 20 bp, Homo sapiens
tgaaagctgcttctggggga

SEQ ID NO: 2198505 - DNA, 15 bp, Homo sapiens
tgaaataagaattca

SEQ ID NO: 2198506 - DNA, 19 bp, Homo sapiens
tgaaatgggaacaatatca

SEQ ID NO: 2198507 - DNA, 20 bp, Homo sapiens
tgaaatgggaacaatatcaa

SEQ ID NO: 2198508 - DNA, 17 bp, Homo sapiens
tgaaatgtaatttcagt

SEQ ID NO: 2198509 - DNA, 23 bp, Homo sapiens
tgaaattaataaaacttatctga

SEQ ID NO: 2198510 - DNA, 16 bp, Homo sapiens
tgaaatttgttaatat

SEQ ID NO: 2198511 - DNA, 18 bp, Homo sapiens
tgaaatttgttaatatat

SEQ ID NO: 2198512 - DNA, 20 bp, Homo sapiens
tgaaatttgttaatatatat

SEQ ID NO: 2198513 - DNA, 22 bp, Homo sapiens
tgaaattttctagaatactaat

SEQ ID NO: 2198514 - DNA, 15 bp, Homo sapiens
tgaacacaaagcctg

SEQ ID NO: 2198515 - DNA, 23 bp, Homo sapiens
tgaacacaggcaatgactgcgca

SEQ ID NO: 2198516 - DNA, 10 bp, Homo sapiens
tgaacatagg

SEQ ID NO: 2198517 - DNA, 18 bp, Homo sapiens
tgaaccatatccatgttg

SEQ ID NO: 2198518 - DNA, 23 bp, Homo sapiens
tgaacctactgaggagcaaagca

SEQ ID NO: 2198519 - DNA, 15 bp, Homo sapiens
tgaaccttcaaagct

SEQ ID NO: 2198520 - DNA, 22 bp, Homo sapiens
tgaacgttctcaaaccctgttt

SEQ ID NO: 2198521 - DNA, 16 bp, Homo sapiens
tgaactcctagactca

SEQ ID NO: 2198522 - DNA, 14 bp, Homo sapiens
tgaactcctgacct

SEQ ID NO: 2198523 - DNA, 14 bp, Homo sapiens
tgaacttttcagga

SEQ ID NO: 2198524 - DNA, 21 bp, Homo sapiens
tgaagaaggaggaattttaga

SEQ ID NO: 2198525 - DNA, 22 bp, Homo sapiens
tgaagacaaaccactgtacata

SEQ ID NO: 2198526 - DNA, 23 bp, Homo sapiens
tgaagacaaaccactgtacatat

SEQ ID NO: 2198527 - DNA, 17 bp, Homo sapiens
tgaagccgccaggaccg

SEQ ID NO: 2198528 - DNA, 20 bp, Homo sapiens
tgaagctggggacagctttc

SEQ ID NO: 2198529 - DNA, 16 bp, Homo sapiens
tgaaggaaaaacatgc

SEQ ID NO: 2198530 - DNA, 11 bp, Homo sapiens
tgaaggtcaca

SEQ ID NO: 2198531 - DNA, 23 bp, Homo sapiens
tgaagtctcaagaactgccataa

SEQ ID NO: 2198532 - DNA, 13 bp, Homo sapiens
tgaagtgaataca

SEQ ID NO: 2198533 - DNA, 18 bp, Homo sapiens
tgaatactttgagtaaac

SEQ ID NO: 2198534 - DNA, 11 bp, Homo sapiens
tgaatattaaa

SEQ ID NO: 2198535 - DNA, 14 bp, Homo sapiens
tgaatatttgtaaa

SEQ ID NO: 2198536 - DNA, 15 bp, Homo sapiens
tgaatatttgtaaaa

SEQ ID NO: 2198537 - DNA, 18 bp, Homo sapiens
tgaatcaggaggagatta

SEQ ID NO: 2198538 - DNA, 19 bp, Homo sapiens
tgaatcaggaggagattaa

SEQ ID NO: 2198539 - DNA, 16 bp, Homo sapiens
tgaatccgaagaatga

SEQ ID NO: 2198540 - DNA, 15 bp, Homo sapiens
tgaatcggtgctgtc

SEQ ID NO: 2198541 - DNA, 16 bp, Homo sapiens
tgaatcttatgcaaaa

SEQ ID NO: 2198542 - DNA, 16 bp, Homo sapiens
tgaatgaccacttgat

SEQ ID NO: 2198543 - DNA, 22 bp, Homo sapiens
tgaatgagtttccagctaagcc

SEQ ID NO: 2198544 - DNA, 18 bp, Homo sapiens
tgaatgcctcgctccctt

SEQ ID NO: 2198545 - DNA, 12 bp, Homo sapiens
tgaatgttacta

SEQ ID NO: 2198546 - DNA, 20 bp, Homo sapiens
tgaattctggtcacattcca

SEQ ID NO: 2198547 - DNA, 14 bp, Homo sapiens
tgaattttacaaaa

SEQ ID NO: 2198548 - DNA, 16 bp, Homo sapiens
tgacaataaataatat

SEQ ID NO: 2198549 - DNA, 12 bp, Homo sapiens
tgacacgcttca

SEQ ID NO: 2198550 - DNA, 22 bp, Homo sapiens
tgacagcagtttgagcttgctg

SEQ ID NO: 2198551 - DNA, 15 bp, Homo sapiens
tgacatccaggatgg

SEQ ID NO: 2198552 - DNA, 23 bp, Homo sapiens
tgacatccaggatggctgcaagc

SEQ ID NO: 2198553 - DNA, 13 bp, Homo sapiens
tgacatttctcaa

SEQ ID NO: 2198554 - DNA, 14 bp, Homo sapiens
tgacatttctcaaa

SEQ ID NO: 2198555 - DNA, 16 bp, Homo sapiens
tgctatcatatattat

SEQ ID NO: 2198556 - DNA, 21 bp, Homo sapiens
tgctatcatatattataagat

SEQ ID NO: 2198557 - DNA, 23 bp, Homo sapiens
tgctatcatatattataagattt

SEQ ID NO: 2198558 - DNA, 22 bp, Homo sapiens
tgctatgaagactacttttaga

SEQ ID NO: 2198559 - DNA, 15 bp, Homo sapiens
tgctcagttccaatg

SEQ ID NO: 2198560 - DNA, 16 bp, Homo sapiens
tgctccaccccactca

SEQ ID NO: 2198561 - DNA, 21 bp, Homo sapiens
tgctcccagatgccttctaga

SEQ ID NO: 2198562 - DNA, 17 bp, Homo sapiens
tgctcccagtttcttga

SEQ ID NO: 2198563 - DNA, 20 bp, Homo sapiens
tgctccgaggacccaggaaa

SEQ ID NO: 2198564 - DNA, 13 bp, Homo sapiens
tgctcctccctcc

SEQ ID NO: 2198565 - DNA, 16 bp, Homo sapiens
tgctccttctgtgttt

SEQ ID NO: 2198566 - DNA, 19 bp, Homo sapiens
tgctctctacccagcccat

SEQ ID NO: 2198567 - DNA, 11 bp, Homo sapiens
tgctctgccca

SEQ ID NO: 2198568 - DNA, 13 bp, Homo sapiens
tgctctggaagcc

SEQ ID NO: 2198569 - DNA, 16 bp, Homo sapiens
tgctctggaagcctgc

SEQ ID NO: 2198570 - DNA, 22 bp, Homo sapiens
tgctgaaagagaaaagaggggt

SEQ ID NO: 2198571 - DNA, 23 bp, Homo sapiens
tgctgattgtctgaaattttcta

SEQ ID NO: 2198572 - DNA, 16 bp, Homo sapiens
tgctggagagtggcat

SEQ ID NO: 2198573 - DNA, 18 bp, Homo sapiens
tgctggagccactaacta

SEQ ID NO: 2198574 - DNA, 15 bp, Homo sapiens
tgctggcacagactt

SEQ ID NO: 2198575 - DNA, 23 bp, Homo sapiens
tgctggggccgccacggcctggc

SEQ ID NO: 2198576 - DNA, 19 bp, Homo sapiens
tgctgggtttccacacagc

SEQ ID NO: 2198577 - DNA, 21 bp, Homo sapiens
tgctgggtttccacacagcct

SEQ ID NO: 2198578 - DNA, 18 bp, Homo sapiens
tgctggttttggtttcca

SEQ ID NO: 2198579 - DNA, 18 bp, Homo sapiens
tgctgtacctttctgaca

SEQ ID NO: 2198580 - DNA, 14 bp, Homo sapiens
tgctgttgtctgcc

SEQ ID NO: 2198581 - DNA, 22 bp, Homo sapiens
tgcttaagggggtgtaatgaaa

SEQ ID NO: 2198582 - DNA, 14 bp, Homo sapiens
tgcttaggtgaagg

SEQ ID NO: 2198583 - DNA, 19 bp, Homo sapiens
tgcttaggtgaaggcagaa

SEQ ID NO: 2198584 - DNA, 19 bp, Homo sapiens
tgcttattgttttattgta

SEQ ID NO: 2198585 - DNA, 12 bp, Homo sapiens
tgcttctgggaa

SEQ ID NO: 2198586 - DNA, 15 bp, Homo sapiens
tgcttgaatcaggag

SEQ ID NO: 2198587 - DNA, 16 bp, Homo sapiens
tgcttgcccccatgtg

SEQ ID NO: 2198588 - DNA, 13 bp, Homo sapiens
tgcttggggcctg

SEQ ID NO: 2198589 - DNA, 16 bp, Homo sapiens
tgcttggggcctggcg

SEQ ID NO: 2198590 - DNA, 23 bp, Homo sapiens
tgcttgtcatccacacaacacca

SEQ ID NO: 2198591 - DNA, 21 bp, Homo sapiens
tgctttcggagctcctgtcca

SEQ ID NO: 2198592 - DNA, 15 bp, Homo sapiens
tgcttttgtgtctac

SEQ ID NO: 2198593 - DNA, 21 bp, Homo sapiens
tggaaactgttggttgagata

SEQ ID NO: 2198594 - DNA, 18 bp, Homo sapiens
tggaaataggcaattaga

SEQ ID NO: 2198595 - DNA, 15 bp, Homo sapiens
tggaacctcctttct

SEQ ID NO: 2198596 - DNA, 21 bp, Homo sapiens
tggaacctcctttctcttctc

SEQ ID NO: 2198597 - DNA, 16 bp, Homo sapiens
tggaactgctgccatg

SEQ ID NO: 2198598 - DNA, 23 bp, Homo sapiens
tggaactgctgccatgattttgg

SEQ ID NO: 2198599 - DNA, 23 bp, Homo sapiens
tggaagagggagggtcagtgcca

SEQ ID NO: 2198600 - DNA, 12 bp, Homo sapiens
tggaagcctgct

SEQ ID NO: 2198601 - DNA, 16 bp, Homo sapiens
tggaagcctgctgatt

SEQ ID NO: 2198602 - DNA, 18 bp, Homo sapiens
tggaagctagctcccctc

SEQ ID NO: 2198603 - DNA, 20 bp, Homo sapiens
tggaagctagctcccctcct

SEQ ID NO: 2198604 - DNA, 21 bp, Homo sapiens
tggaatgcattcactcagcat

SEQ ID NO: 2198605 - DNA, 20 bp, Homo sapiens
tggacacacacagactattt

SEQ ID NO: 2198606 - DNA, 21 bp, Homo sapiens
tggacagcggttgtaaataca

SEQ ID NO: 2198607 - DNA, 23 bp, Homo sapiens
tggacagcggttgtaaatacaat

SEQ ID NO: 2198608 - DNA, 14 bp, Homo sapiens
tggacaggtctggg

SEQ ID NO: 2198609 - DNA, 17 bp, Homo sapiens
tggacaggtctgggaga

SEQ ID NO: 2198610 - DNA, 20 bp, Homo sapiens
tggacaggtctgggagaggc

SEQ ID NO: 2198611 - DNA, 15 bp, Homo sapiens
tggacgcacacagct

SEQ ID NO: 2198612 - DNA, 13 bp, Homo sapiens
tggacggcagacc

SEQ ID NO: 2198613 - DNA, 19 bp, Homo sapiens
tggactgagtgggaagccc

SEQ ID NO: 2198614 - DNA, 23 bp, Homo sapiens
tggactggacatgagagcccctt

SEQ ID NO: 2198615 - DNA, 14 bp, Homo sapiens
tggacttccatttg

SEQ ID NO: 2198616 - DNA, 22 bp, Homo sapiens
tggactttggaaggaggtgcct

SEQ ID NO: 2198617 - DNA, 23 bp, Homo sapiens
tggagaaagagctgcctggatga

SEQ ID NO: 2198618 - DNA, 11 bp, Homo sapiens
tggagaacagt

SEQ ID NO: 2198619 - DNA, 15 bp, Homo sapiens
tggagaacagtggtt

SEQ ID NO: 2198620 - DNA, 23 bp, Homo sapiens
tggagaacagtggttgcctgggg

SEQ ID NO: 2198621 - DNA, 18 bp, Homo sapiens
tggagacaatgcagatgc

SEQ ID NO: 2198622 - DNA, 15 bp, Homo sapiens
tggagacaattacaa

SEQ ID NO: 2198623 - DNA, 22 bp, Homo sapiens
tggagacaattacaagacgggg

SEQ ID NO: 2198624 - DNA, 18 bp, Homo sapiens
tggagagaccagcctttc

SEQ ID NO: 2198625 - DNA, 23 bp, Homo sapiens
tggagagaccagcctttcttcct

SEQ ID NO: 2198626 - DNA, 16 bp, Homo sapiens
tggagaggctaacctc

SEQ ID NO: 2198627 - DNA, 19 bp, Homo sapiens
tggagaggtggaaagaaaa

SEQ ID NO: 2198628 - DNA, 18 bp, Homo sapiens
tggagcacaaaagcctct

SEQ ID NO: 2198629 - DNA, 15 bp, Homo sapiens
tggagccacaggcag

SEQ ID NO: 2198630 - DNA, 16 bp, Homo sapiens
tggagccacaggcaga

SEQ ID NO: 2198631 - DNA, 12 bp, Homo sapiens
tggagctcctgg

SEQ ID NO: 2198632 - DNA, 17 bp, Homo sapiens
tggagctcctgggaagg

SEQ ID NO: 2198633 - DNA, 18 bp, Homo sapiens
tggagctcctgggaaggc

SEQ ID NO: 2198634 - DNA, 11 bp, Homo sapiens
tggaggagaga

SEQ ID NO: 2198635 - DNA, 15 bp, Homo sapiens
tggaggagagagacc

SEQ ID NO: 2198636 - DNA, 17 bp, Homo sapiens
tggaggcattcccagag

SEQ ID NO: 2198637 - DNA, 23 bp, Homo sapiens
tggaggcccttttctggctcctg

SEQ ID NO: 2198638 - DNA, 22 bp, Homo sapiens
tggaggcctctgggcctcctct

SEQ ID NO: 2198639 - DNA, 21 bp, Homo sapiens
tggagggttgatatattcttt

SEQ ID NO: 2198640 - DNA, 15 bp, Homo sapiens
tggaggtctccaggg

SEQ ID NO: 2198641 - DNA, 17 bp, Homo sapiens
tggaggtctccaggggc

SEQ ID NO: 2198642 - DNA, 22 bp, Homo sapiens
tggaggtctccaggggcctgca

SEQ ID NO: 2198643 - DNA, 11 bp, Homo sapiens
tggaggtggct

SEQ ID NO: 2198644 - DNA, 15 bp, Homo sapiens
tggagtcatgccaag

SEQ ID NO: 2198645 - DNA, 23 bp, Homo sapiens
tggagtgatctcagctcactgca

SEQ ID NO: 2198646 - DNA, 14 bp, Homo sapiens
tggagtggaggcat

SEQ ID NO: 2198647 - DNA, 22 bp, Homo sapiens
tggagtgtgtgggggtctggga

SEQ ID NO: 2198648 - DNA, 17 bp, Homo sapiens
tggatagatgccctgct

SEQ ID NO: 2198649 - DNA, 15 bp, Homo sapiens
tggatctatcacctg

SEQ ID NO: 2198650 - DNA, 16 bp, Homo sapiens
tggatctatcacctgt

SEQ ID NO: 2198651 - DNA, 14 bp, Homo sapiens
tggatggggcccag

SEQ ID NO: 2198652 - DNA, 21 bp, Homo sapiens
tggatggggcccaggggcttt

SEQ ID NO: 2198653 - DNA, 18 bp, Homo sapiens
tggatgggggtgcaggca

SEQ ID NO: 2198654 - DNA, 14 bp, Homo sapiens
tggatgtttcttct

SEQ ID NO: 2198655 - DNA, 17 bp, Homo sapiens
tggatttggactcgaaa

SEQ ID NO: 2198656 - DNA, 14 bp, Homo sapiens
tggattttgtggct

SEQ ID NO: 2198657 - DNA, 13 bp, Homo sapiens
tggcaaggacttt

SEQ ID NO: 2198658 - DNA, 15 bp, Homo sapiens
tggcaataaatggct

SEQ ID NO: 2198659 - DNA, 16 bp, Homo sapiens
tggcaatagtcaggag

SEQ ID NO: 2198660 - DNA, 14 bp, Homo sapiens
tggcacttcgtgga

SEQ ID NO: 2198661 - DNA, 19 bp, Homo sapiens
tggcaggatcacagctcac

SEQ ID NO: 2198662 - DNA, 14 bp, Homo sapiens
tggcaggggagcag

SEQ ID NO: 2198663 - DNA, 13 bp, Homo sapiens
tggcagtgggaga

SEQ ID NO: 2198664 - DNA, 15 bp, Homo sapiens
tggcattactctgca

SEQ ID NO: 2198665 - DNA, 18 bp, Homo sapiens
tggccactttgcagacct

SEQ ID NO: 2198666 - DNA, 14 bp, Homo sapiens
tggccagaccagag

SEQ ID NO: 2198667 - DNA, 15 bp, Homo sapiens
tggccagaccagagc

SEQ ID NO: 2198668 - DNA, 21 bp, Homo sapiens
tggccagaccagagctctgga

SEQ ID NO: 2198669 - DNA, 22 bp, Homo sapiens
tggccagaccagagctctggag

SEQ ID NO: 2198670 - DNA, 20 bp, Homo sapiens
tggccaggctggtcttgaac

SEQ ID NO: 2198671 - DNA, 19 bp, Homo sapiens
tggcccaagcctggtctcc

SEQ ID NO: 2198672 - DNA, 16 bp, Homo sapiens
tggcccacacagatct

SEQ ID NO: 2198673 - DNA, 13 bp, Homo sapiens
tggcccctcccca

SEQ ID NO: 2198674 - DNA, 14 bp, Homo sapiens
tggccctacagccc

SEQ ID NO: 2198675 - DNA, 13 bp, Homo sapiens
tggccgggcacag

SEQ ID NO: 2198676 - DNA, 15 bp, Homo sapiens
tggccgggcacagct

SEQ ID NO: 2198677 - DNA, 18 bp, Homo sapiens
ttatataactgtatttga

SEQ ID NO: 2198678 - DNA, 18 bp, Homo sapiens
ttatatcgaaatacagtt

SEQ ID NO: 2198679 - DNA, 16 bp, Homo sapiens
ttatatctggcctctg

SEQ ID NO: 2198680 - DNA, 15 bp, Homo sapiens
ttatattttgaacaa

SEQ ID NO: 2198681 - DNA, 18 bp, Homo sapiens
ttatcctacagtacaatc

SEQ ID NO: 2198682 - DNA, 12 bp, Homo sapiens
ttatcttcttaa

SEQ ID NO: 2198683 - DNA, 12 bp, Homo sapiens
ttatgattcagt

SEQ ID NO: 2198684 - DNA, 22 bp, Homo sapiens
ttatggatcccaattcatttca

SEQ ID NO: 2198685 - DNA, 18 bp, Homo sapiens
ttattactgtttgtcttc

SEQ ID NO: 2198686 - DNA, 19 bp, Homo sapiens
ttattagaacttagttttg

SEQ ID NO: 2198687 - DNA, 22 bp, Homo sapiens
ttattataatcttataattgtt

SEQ ID NO: 2198688 - DNA, 14 bp, Homo sapiens
ttattattactgtt

SEQ ID NO: 2198689 - DNA, 16 bp, Homo sapiens
ttattctacttttaaa

SEQ ID NO: 2198690 - DNA, 21 bp, Homo sapiens
ttattgattttctttctaatt

SEQ ID NO: 2198691 - DNA, 15 bp, Homo sapiens
ttatttacatttaat

SEQ ID NO: 2198692 - DNA, 20 bp, Homo sapiens
ttatttatttttgtactgtg

SEQ ID NO: 2198693 - DNA, 13 bp, Homo sapiens
ttatttccatatt

SEQ ID NO: 2198694 - DNA, 15 bp, Homo sapiens
ttatttttaaaataa

SEQ ID NO: 2198695 - DNA, 11 bp, Homo sapiens
ttcaaagctga

SEQ ID NO: 2198696 - DNA, 23 bp, Homo sapiens
ttcaaataaagtaaattgaaatg

SEQ ID NO: 2198697 - DNA, 17 bp, Homo sapiens
ttcaagacgaggggcag

SEQ ID NO: 2198698 - DNA, 20 bp, Homo sapiens
ttcaagtctgtgcctggagc

SEQ ID NO: 2198699 - DNA, 17 bp, Homo sapiens
ttcaatagcacatatgg

SEQ ID NO: 2198700 - DNA, 15 bp, Homo sapiens
ttcaatctctggaaa

SEQ ID NO: 2198701 - DNA, 12 bp, Homo sapiens
ttcaatctctgt

SEQ ID NO: 2198702 - DNA, 14 bp, Homo sapiens
ttcacaagctgcct

SEQ ID NO: 2198703 - DNA, 18 bp, Homo sapiens
ttcactgaagtgaataca

SEQ ID NO: 2198704 - DNA, 18 bp, Homo sapiens
ttcagatacttgtgaaca

SEQ ID NO: 2198705 - DNA, 23 bp, Homo sapiens
ttcagatacttgtgaacatgcct

SEQ ID NO: 2198706 - DNA, 14 bp, Homo sapiens
ttcagatcctgctg

SEQ ID NO: 2198707 - DNA, 15 bp, Homo sapiens
ttcagatcctgctgc

SEQ ID NO: 2198708 - DNA, 16 bp, Homo sapiens
ttcagatcctgctgcc

SEQ ID NO: 2198709 - DNA, 15 bp, Homo sapiens
ttcagctctggagaa

SEQ ID NO: 2198710 - DNA, 17 bp, Homo sapiens
ttcaggtcagggctatg

SEQ ID NO: 2198711 - DNA, 17 bp, Homo sapiens
ttcagtaatagctgaac

SEQ ID NO: 2198712 - DNA, 19 bp, Homo sapiens
ttcagtgactcctgctggt

SEQ ID NO: 2198713 - DNA, 23 bp, Homo sapiens
ttcagtgagacacagagtggagc

SEQ ID NO: 2198714 - DNA, 23 bp, Homo sapiens
ttcataaagcaccagcagtgttt

SEQ ID NO: 2198715 - DNA, 12 bp, Homo sapiens
ttcatacctgtt

SEQ ID NO: 2198716 - DNA, 14 bp, Homo sapiens
ttcatataaatgga

SEQ ID NO: 2198717 - DNA, 21 bp, Homo sapiens
ttcatccctgccaagaactct

SEQ ID NO: 2198718 - DNA, 14 bp, Homo sapiens
ttcatctactacag

SEQ ID NO: 2198719 - DNA, 22 bp, Homo sapiens
ttcatgaataggaatattcaag

SEQ ID NO: 2198720 - DNA, 22 bp, Homo sapiens
ttccaaaaacaaagtgcaaagc

SEQ ID NO: 2198721 - DNA, 16 bp, Homo sapiens
ttccaaattgatgggt

SEQ ID NO: 2198722 - DNA, 19 bp, Homo sapiens
ttccaacagattttattga

SEQ ID NO: 2198723 - DNA, 13 bp, Homo sapiens
ttccaactgctgc

SEQ ID NO: 2198724 - DNA, 15 bp, Homo sapiens
ttccaagcctgggcc

SEQ ID NO: 2198725 - DNA, 20 bp, Homo sapiens
ttccaagcctgggccactgg

SEQ ID NO: 2198726 - DNA, 17 bp, Homo sapiens
ttccaagtcatttttgt

SEQ ID NO: 2198727 - DNA, 17 bp, Homo sapiens
ttccaatatttataatt

SEQ ID NO: 2198728 - DNA, 19 bp, Homo sapiens
ttccaatatttataattaa

SEQ ID NO: 2198729 - DNA, 20 bp, Homo sapiens
ttccaatatttataattaaa

SEQ ID NO: 2198730 - DNA, 16 bp, Homo sapiens
ttccaatgtgcccagt

SEQ ID NO: 2198731 - DNA, 19 bp, Homo sapiens
ttccacaaacaccatcttc

SEQ ID NO: 2198732 - DNA, 13 bp, Homo sapiens
ttccacaccccca

SEQ ID NO: 2198733 - DNA, 22 bp, Homo sapiens
ttccacacccccaccccttgct

SEQ ID NO: 2198734 - DNA, 13 bp, Homo sapiens
ttccaccaaattc

SEQ ID NO: 2198735 - DNA, 23 bp, Homo sapiens
ttccaccttaccctactggctgt

SEQ ID NO: 2198736 - DNA, 21 bp, Homo sapiens
ttccacctttctgaatggaaa

SEQ ID NO: 2198737 - DNA, 19 bp, Homo sapiens
ttccactgcaaataaagcc

SEQ ID NO: 2198738 - DNA, 21 bp, Homo sapiens
ttccagctaagcctgatgatg

SEQ ID NO: 2198739 - DNA, 15 bp, Homo sapiens
ttccagtatcctgaa

SEQ ID NO: 2198740 - DNA, 18 bp, Homo sapiens
ttccagttgcgtgtctgt

SEQ ID NO: 2198741 - DNA, 21 bp, Homo sapiens
ttccagttgcgtgtctgtttc

SEQ ID NO: 2198742 - DNA, 19 bp, Homo sapiens
ttccatcctgtacaagtgc

SEQ ID NO: 2198743 - DNA, 21 bp, Homo sapiens
ttccatcctgtacaagtgctc

SEQ ID NO: 2198744 - DNA, 21 bp, Homo sapiens
ttccatgcagttattagaact

SEQ ID NO: 2198745 - DNA, 12 bp, Homo sapiens
ttccatttgctg

SEQ ID NO: 2198746 - DNA, 19 bp, Homo sapiens
ttcccaacacttcagactg

SEQ ID NO: 2198747 - DNA, 21 bp, Homo sapiens
ttcccaaggccagtctgaacc

SEQ ID NO: 2198748 - DNA, 14 bp, Homo sapiens
ttcccattttaaat

SEQ ID NO: 2198749 - DNA, 16 bp, Homo sapiens
ttccccatactctgtc

SEQ ID NO: 2198750 - DNA, 14 bp, Homo sapiens
ttccccctccatgt

SEQ ID NO: 2198751 - DNA, 22 bp, Homo sapiens
ttcccctcccgtcttcctcctc

SEQ ID NO: 2198752 - DNA, 17 bp, Homo sapiens
ttcccctcttttgtctt

SEQ ID NO: 2198753 - DNA, 14 bp, Homo sapiens
ttccctctgctcca

SEQ ID NO: 2198754 - DNA, 11 bp, Homo sapiens
ttccctgctga

SEQ ID NO: 2198755 - DNA, 14 bp, Homo sapiens
ttccctggtccaga

SEQ ID NO: 2198756 - DNA, 16 bp, Homo sapiens
ttccctttgctccacc

SEQ ID NO: 2198757 - DNA, 18 bp, Homo sapiens
ttccctttgctccacccc

SEQ ID NO: 2198758 - DNA, 19 bp, Homo sapiens
ttccgctttgaaagaagca

SEQ ID NO: 2198759 - DNA, 13 bp, Homo sapiens
ttcctaataaact

SEQ ID NO: 2198760 - DNA, 15 bp, Homo sapiens
ttcctccctccctgc

SEQ ID NO: 2198761 - DNA, 18 bp, Homo sapiens
ttcctccctccctgcagg

SEQ ID NO: 2198762 - DNA, 19 bp, Homo sapiens
ttcctgatggaattgttat

SEQ ID NO: 2198763 - DNA, 18 bp, Homo sapiens
ttcctgtccgccctcttc

SEQ ID NO: 2198764 - DNA, 15 bp, Homo sapiens
ttcctgtctggccca

SEQ ID NO: 2198765 - DNA, 12 bp, Homo sapiens
ttcctgtgtatt

SEQ ID NO: 2198766 - DNA, 15 bp, Homo sapiens
ttcctgtttctaagt

SEQ ID NO: 2198767 - DNA, 16 bp, Homo sapiens
ttccttagcagcttct

SEQ ID NO: 2198768 - DNA, 13 bp, Homo sapiens
ttccttgtcccca

SEQ ID NO: 2198769 - DNA, 17 bp, Homo sapiens
ttccttgtccccacact

SEQ ID NO: 2198770 - DNA, 20 bp, Homo sapiens
ttccttgtccccacactcct

SEQ ID NO: 2198771 - DNA, 15 bp, Homo sapiens
ttccttgtctctcat

SEQ ID NO: 2198772 - DNA, 22 bp, Homo sapiens
ttcgcagcagctccgcctggca

SEQ ID NO: 2198773 - DNA, 15 bp, Homo sapiens
ttcgtaagaacatgt

SEQ ID NO: 2198774 - DNA, 17 bp, Homo sapiens
ttcgtaagaacatgtta

SEQ ID NO: 2198775 - DNA, 17 bp, Homo sapiens
ttcgttggtgaccagtt

SEQ ID NO: 2198776 - DNA, 22 bp, Homo sapiens
ttctaacctactaagtctgtgt

SEQ ID NO: 2198777 - DNA, 13 bp, Homo sapiens
ttctaatgctgca

SEQ ID NO: 2198778 - DNA, 14 bp, Homo sapiens
ttctacttttaaat

SEQ ID NO: 2198779 - DNA, 18 bp, Homo sapiens
ttctagaatactaataaa

SEQ ID NO: 2198780 - DNA, 21 bp, Homo sapiens
ttctaggtcaaggcctgtccc

SEQ ID NO: 2198781 - DNA, 17 bp, Homo sapiens
ttctatccccaagctgg

SEQ ID NO: 2198782 - DNA, 20 bp, Homo sapiens
ttctatccccaagctggcca

SEQ ID NO: 2198783 - DNA, 13 bp, Homo sapiens
ttctatggcatat

SEQ ID NO: 2198784 - DNA, 23 bp, Homo sapiens
ttctatggcatattgataataaa

SEQ ID NO: 2198785 - DNA, 18 bp, Homo sapiens
ttctattgtgctttctat

SEQ ID NO: 2198786 - DNA, 19 bp, Homo sapiens
ttctatttcagtgccaata

SEQ ID NO: 2198787 - DNA, 19 bp, Homo sapiens
ttctcaaagtttttacagt

SEQ ID NO: 2198788 - DNA, 20 bp, Homo sapiens
ttctcaaagtttttacagtg

SEQ ID NO: 2198789 - DNA, 21 bp, Homo sapiens
ttctcaaagtttttacagtgt

SEQ ID NO: 2198790 - DNA, 14 bp, Homo sapiens
ttctcaagcactga

SEQ ID NO: 2198791 - DNA, 17 bp, Homo sapiens
ttctcatcactcccctc

SEQ ID NO: 2198792 - DNA, 15 bp, Homo sapiens
ttctcatgtttgtgc

SEQ ID NO: 2198793 - DNA, 20 bp, Homo sapiens
ttctctagggaaggccacct

SEQ ID NO: 2198794 - DNA, 17 bp, Homo sapiens
ttctctgtccagggctt

SEQ ID NO: 2198795 - DNA, 22 bp, Homo sapiens
ttctctgtccagggcttcagat

SEQ ID NO: 2198796 - DNA, 16 bp, Homo sapiens
ttctctgtgctctgaa

SEQ ID NO: 2198797 - DNA, 17 bp, Homo sapiens
ttctctgtgctctgaat

SEQ ID NO: 2198798 - DNA, 16 bp, Homo sapiens
ttctctttttttaaaa

SEQ ID NO: 2198799 - DNA, 21 bp, Homo sapiens
aacttgaaaagattgcaaagg

SEQ ID NO: 2198800 - DNA, 19 bp, Homo sapiens
aacttgcaatgaaaagaaa

SEQ ID NO: 2198801 - DNA, 16 bp, Homo sapiens
aactttccttcctcat

SEQ ID NO: 2198802 - DNA, 22 bp, Homo sapiens
aacttttagtgggtgagaaatt

SEQ ID NO: 2198803 - DNA, 21 bp, Homo sapiens
aactttttgaccagtttcttt

SEQ ID NO: 2198804 - DNA, 13 bp, Homo sapiens
aacttttttggaa

SEQ ID NO: 2198805 - DNA, 14 bp, Homo sapiens
aagaaaaacatgtc

SEQ ID NO: 2198806 - DNA, 15 bp, Homo sapiens
aagaaaaacatgtca

SEQ ID NO: 2198807 - DNA, 19 bp, Homo sapiens
aagaaaaataatcttagaa

SEQ ID NO: 2198808 - DNA, 23 bp, Homo sapiens
aagaaaaataatcttagaacaga

SEQ ID NO: 2198809 - DNA, 19 bp, Homo sapiens
aagaaaccatttttaatga

SEQ ID NO: 2198810 - DNA, 21 bp, Homo sapiens
aagaaaggggcaggagctcag

SEQ ID NO: 2198811 - DNA, 14 bp, Homo sapiens
aagaaccatctttg

SEQ ID NO: 2198812 - DNA, 13 bp, Homo sapiens
aagaacttgaagt

SEQ ID NO: 2198813 - DNA, 17 bp, Homo sapiens
aagaagggggccctgct

SEQ ID NO: 2198814 - DNA, 18 bp, Homo sapiens
aagaagggggccctgcta

SEQ ID NO: 2198815 - DNA, 22 bp, Homo sapiens
aagaattgctaaatataaaaac

SEQ ID NO: 2198816 - DNA, 17 bp, Homo sapiens
aagacaaaccactgtac

SEQ ID NO: 2198817 - DNA, 21 bp, Homo sapiens
aagacatcaagatacacttgt

SEQ ID NO: 2198818 - DNA, 16 bp, Homo sapiens
aagaccaatgtgaaga

SEQ ID NO: 2198819 - DNA, 14 bp, Homo sapiens
aagacgaggggcag

SEQ ID NO: 2198820 - DNA, 19 bp, Homo sapiens
aagacgaggggcagggaag

SEQ ID NO: 2198821 - DNA, 23 bp, Homo sapiens
aagactttccccatactctgtct

SEQ ID NO: 2198822 - DNA, 20 bp, Homo sapiens
aagagagaagagtccaggaa

SEQ ID NO: 2198823 - DNA, 18 bp, Homo sapiens
aagagagaagccagccac

SEQ ID NO: 2198824 - DNA, 14 bp, Homo sapiens
aagagccaatggag

SEQ ID NO: 2198825 - DNA, 12 bp, Homo sapiens
aagagctgcctg

SEQ ID NO: 2198826 - DNA, 14 bp, Homo sapiens
aagagctgcctgga

SEQ ID NO: 2198827 - DNA, 21 bp, Homo sapiens
aagagctgcctggatgagaaa

SEQ ID NO: 2198828 - DNA, 15 bp, Homo sapiens
aagaggcaccaggaa

SEQ ID NO: 2198829 - DNA, 18 bp, Homo sapiens
aagaggcaccaggaagcc

SEQ ID NO: 2198830 - DNA, 12 bp, Homo sapiens
aagagggagaag

SEQ ID NO: 2198831 - DNA, 14 bp, Homo sapiens
aagagggcaaagct

SEQ ID NO: 2198832 - DNA, 19 bp, Homo sapiens
aagaggtggggtgaagctg

SEQ ID NO: 2198833 - DNA, 21 bp, Homo sapiens
aagagtcctgaggcagaacct

SEQ ID NO: 2198834 - DNA, 21 bp, Homo sapiens
aagagttctatccccaagctg

SEQ ID NO: 2198835 - DNA, 17 bp, Homo sapiens
aagatacacttgtaaat

SEQ ID NO: 2198836 - DNA, 20 bp, Homo sapiens
aagatgtaataatcatttta

SEQ ID NO: 2198837 - DNA, 11 bp, Homo sapiens
aagattgcaaa

SEQ ID NO: 2198838 - DNA, 15 bp, Homo sapiens
aagattgcaaaggga

SEQ ID NO: 2198839 - DNA, 16 bp, Homo sapiens
aagattgcaaagggac

SEQ ID NO: 2198840 - DNA, 13 bp, Homo sapiens
aagattgtgtctg

SEQ ID NO: 2198841 - DNA, 12 bp, Homo sapiens
aagatttttaaa

SEQ ID NO: 2198842 - DNA, 14 bp, Homo sapiens
aagcaaaaactacc

SEQ ID NO: 2198843 - DNA, 12 bp, Homo sapiens
aagcaaagaacc

SEQ ID NO: 2198844 - DNA, 10 bp, Homo sapiens
aagcaaagca

SEQ ID NO: 2198845 - DNA, 13 bp, Homo sapiens
aagcaactggaaa

SEQ ID NO: 2198846 - DNA, 16 bp, Homo sapiens
aagcaatcctcctgag

SEQ ID NO: 2198847 - DNA, 12 bp, Homo sapiens
aagcacatttta

SEQ ID NO: 2198848 - DNA, 20 bp, Homo sapiens
aagcacctttagaatattaa

SEQ ID NO: 2198849 - DNA, 14 bp, Homo sapiens
aagcaggtttttat

SEQ ID NO: 2198850 - DNA, 17 bp, Homo sapiens
aagcagtatttttcttg

SEQ ID NO: 2198851 - DNA, 18 bp, Homo sapiens
aagcagtatttttcttga

SEQ ID NO: 2198852 - DNA, 13 bp, Homo sapiens
aagcagtttttaa

SEQ ID NO: 2198853 - DNA, 15 bp, Homo sapiens
aagcataatgaaaat

SEQ ID NO: 2198854 - DNA, 19 bp, Homo sapiens
aagcatttaatgtagccat

SEQ ID NO: 2198855 - DNA, 23 bp, Homo sapiens
aagcatttaatgtagccatggga

SEQ ID NO: 2198856 - DNA, 23 bp, Homo sapiens
aagccagaatattctaacctact

SEQ ID NO: 2198857 - DNA, 10 bp, Homo sapiens
aagccagcca

SEQ ID NO: 2198858 - DNA, 12 bp, Homo sapiens
aagccagccaca

SEQ ID NO: 2198859 - DNA, 14 bp, Homo sapiens
aagccagccacaga

SEQ ID NO: 2198860 - DNA, 22 bp, Homo sapiens
aagccagggatggggccacagc

SEQ ID NO: 2198861 - DNA, 22 bp, Homo sapiens
aagccatgctgctttgcacaca

SEQ ID NO: 2198862 - DNA, 15 bp, Homo sapiens
aagcccatcctgacc

SEQ ID NO: 2198863 - DNA, 20 bp, Homo sapiens
aagcccatcctgaccagctg

SEQ ID NO: 2198864 - DNA, 17 bp, Homo sapiens
aagcctgctgatttcta

SEQ ID NO: 2198865 - DNA, 22 bp, Homo sapiens
aagccttggctcgttctcttct

SEQ ID NO: 2198866 - DNA, 17 bp, Homo sapiens
aagccttttaaatcatc

SEQ ID NO: 2198867 - DNA, 20 bp, Homo sapiens
aagcgactctcctgcctcag

SEQ ID NO: 2198868 - DNA, 13 bp, Homo sapiens
aagctaccttttt

SEQ ID NO: 2198869 - DNA, 13 bp, Homo sapiens
aagctagctcccc

SEQ ID NO: 2198870 - DNA, 15 bp, Homo sapiens
aagctataaagcagt

SEQ ID NO: 2198871 - DNA, 14 bp, Homo sapiens
aagctatgaatgtt

SEQ ID NO: 2198872 - DNA, 22 bp, Homo sapiens
aagctcacgccttagtttgaaa

SEQ ID NO: 2198873 - DNA, 15 bp, Homo sapiens
aagctcagccagccc

SEQ ID NO: 2198874 - DNA, 19 bp, Homo sapiens
aagctccagtcctgctctc

SEQ ID NO: 2198875 - DNA, 21 bp, Homo sapiens
aagctccagtcctgctctcta

SEQ ID NO: 2198876 - DNA, 15 bp, Homo sapiens
aagctgaagccgcca

SEQ ID NO: 2198877 - DNA, 18 bp, Homo sapiens
aagctgcctccctgtcca

SEQ ID NO: 2198878 - DNA, 22 bp, Homo sapiens
aagctgcctccctgtccacccc

SEQ ID NO: 2198879 - DNA, 18 bp, Homo sapiens
aagctgcttctgggggat

SEQ ID NO: 2198880 - DNA, 13 bp, Homo sapiens
aagctgcttgaat

SEQ ID NO: 2198881 - DNA, 12 bp, Homo sapiens
aagctgtccctg

SEQ ID NO: 2198882 - DNA, 21 bp, Homo sapiens
aagctgtccctgcagggccat

SEQ ID NO: 2198883 - DNA, 13 bp, Homo sapiens
aagctgtgaaatt

SEQ ID NO: 2198884 - DNA, 19 bp, Homo sapiens
aagctgtgtctttagacaa

SEQ ID NO: 2198885 - DNA, 13 bp, Homo sapiens
aagctgtttttat

SEQ ID NO: 2198886 - DNA, 11 bp, Homo sapiens
aagctttctct

SEQ ID NO: 2198887 - DNA, 15 bp, Homo sapiens
aaggaaaaaagcaag

SEQ ID NO: 2198888 - DNA, 14 bp, Homo sapiens
aaggaaaaacatgc

SEQ ID NO: 2198889 - DNA, 15 bp, Homo sapiens
aaggaaaaacatgct

SEQ ID NO: 2198890 - DNA, 19 bp, Homo sapiens
aaggaaatctcctcttttg

SEQ ID NO: 2198891 - DNA, 22 bp, Homo sapiens
aaggaagctttctctgcttcag

SEQ ID NO: 2198892 - DNA, 23 bp, Homo sapiens
aaggacatttgggactgtcttga

SEQ ID NO: 2198893 - DNA, 14 bp, Homo sapiens
aaggacttgtgcct

SEQ ID NO: 2198894 - DNA, 14 bp, Homo sapiens
aaggactttgtaca

SEQ ID NO: 2198895 - DNA, 15 bp, Homo sapiens
aaggactttgtacat

SEQ ID NO: 2198896 - DNA, 12 bp, Homo sapiens
aaggagcctgcg

SEQ ID NO: 2198897 - DNA, 18 bp, Homo sapiens
aaggccctgcatgtgtat

SEQ ID NO: 2198898 - DNA, 14 bp, Homo sapiens
aaggccgcccacct

SEQ ID NO: 2198899 - DNA, 16 bp, Homo sapiens
aaggcctatgccacct

SEQ ID NO: 2198900 - DNA, 16 bp, Homo sapiens
aaggcctgtccctggc

SEQ ID NO: 2198901 - DNA, 23 bp, Homo sapiens
aaggcctgtccctggccatctct

SEQ ID NO: 2198902 - DNA, 23 bp, Homo sapiens
aaggccttttgcccgttgaggta

SEQ ID NO: 2198903 - DNA, 15 bp, Homo sapiens
aaggctactcacctt

SEQ ID NO: 2198904 - DNA, 13 bp, Homo sapiens
aaggctgccggct

SEQ ID NO: 2198905 - DNA, 13 bp, Homo sapiens
aagggccctggca

SEQ ID NO: 2198906 - DNA, 15 bp, Homo sapiens
aagggctaaggcctc

SEQ ID NO: 2198907 - DNA, 15 bp, Homo sapiens
aagggggccctgcta

SEQ ID NO: 2198908 - DNA, 17 bp, Homo sapiens
aaggggtgcctgggaac

SEQ ID NO: 2198909 - DNA, 22 bp, Homo sapiens
aaggtagacatggatttgatga

SEQ ID NO: 2198910 - DNA, 13 bp, Homo sapiens
aaggtccttgact

SEQ ID NO: 2198911 - DNA, 14 bp, Homo sapiens
aaggtgaaaattgt

SEQ ID NO: 2198912 - DNA, 21 bp, Homo sapiens
aaggtgattttcctgtgtcca

SEQ ID NO: 2198913 - DNA, 19 bp, Homo sapiens
aaggtgggggttggctggg

SEQ ID NO: 2198914 - DNA, 20 bp, Homo sapiens
aaggtgggggttggctgggt

SEQ ID NO: 2198915 - DNA, 22 bp, Homo sapiens
aaggtgggggttggctgggtac

SEQ ID NO: 2198916 - DNA, 13 bp, Homo sapiens
aagtaaaaacact

SEQ ID NO: 2198917 - DNA, 17 bp, Homo sapiens
aagtaacaatgcatgct

SEQ ID NO: 2198918 - DNA, 13 bp, Homo sapiens
aagtactgcaaaa

SEQ ID NO: 2198919 - DNA, 18 bp, Homo sapiens
aagtatgcactaatcaat

SEQ ID NO: 2198920 - DNA, 14 bp, Homo sapiens
aagtatgtattatt

SEQ ID NO: 2198921 - DNA, 17 bp, Homo sapiens
aagtcaaatgcattttt

SEQ ID NO: 2198922 - DNA, 16 bp, Homo sapiens
acccagcatgtacaaa

SEQ ID NO: 2198923 - DNA, 14 bp, Homo sapiens
acccagcccatctt

SEQ ID NO: 2198924 - DNA, 21 bp, Homo sapiens
acccatgcacagaacaagcca

SEQ ID NO: 2198925 - DNA, 17 bp, Homo sapiens
acccatttgccatgctg

SEQ ID NO: 2198926 - DNA, 15 bp, Homo sapiens
accccaattccttgt

SEQ ID NO: 2198927 - DNA, 18 bp, Homo sapiens
accccactcacagagaca

SEQ ID NO: 2198928 - DNA, 18 bp, Homo sapiens
acccccacaagctgtccc

SEQ ID NO: 2198929 - DNA, 23 bp, Homo sapiens
acccccacaagctgtccctgcag

SEQ ID NO: 2198930 - DNA, 17 bp, Homo sapiens
acccccaccccttgctc

SEQ ID NO: 2198931 - DNA, 16 bp, Homo sapiens
acccccttgtctgctg

SEQ ID NO: 2198932 - DNA, 18 bp, Homo sapiens
acccccttgtctgctgct

SEQ ID NO: 2198933 - DNA, 15 bp, Homo sapiens
accccgggctctcct

SEQ ID NO: 2198934 - DNA, 13 bp, Homo sapiens
acccctatgaact

SEQ ID NO: 2198935 - DNA, 23 bp, Homo sapiens
acccctcctccctttttccttgt

SEQ ID NO: 2198936 - DNA, 16 bp, Homo sapiens
acccctccttccctgg

SEQ ID NO: 2198937 - DNA, 11 bp, Homo sapiens
accccttcctg

SEQ ID NO: 2198938 - DNA, 12 bp, Homo sapiens
accccttcctgt

SEQ ID NO: 2198939 - DNA, 22 bp, Homo sapiens
accccttggaggagagagaccc

SEQ ID NO: 2198940 - DNA, 20 bp, Homo sapiens
acccgccttggcctcccaaa

SEQ ID NO: 2198941 - DNA, 18 bp, Homo sapiens
acccggcccccgccctct

SEQ ID NO: 2198942 - DNA, 21 bp, Homo sapiens
acccggcccccgccctctgcc

SEQ ID NO: 2198943 - DNA, 22 bp, Homo sapiens
acccggcccccgccctctgccc

SEQ ID NO: 2198944 - DNA, 22 bp, Homo sapiens
acccggctcgtgtatttattac

SEQ ID NO: 2198945 - DNA, 14 bp, Homo sapiens
acccgtttccaagc

SEQ ID NO: 2198946 - DNA, 23 bp, Homo sapiens
acccgtttccaagcctgggccac

SEQ ID NO: 2198947 - DNA, 17 bp, Homo sapiens
accctaactgagctgcc

SEQ ID NO: 2198948 - DNA, 15 bp, Homo sapiens
accctactggctgta

SEQ ID NO: 2198949 - DNA, 20 bp, Homo sapiens
accctatcatagatttacaa

SEQ ID NO: 2198950 - DNA, 11 bp, Homo sapiens
accctcaggaa

SEQ ID NO: 2198951 - DNA, 21 bp, Homo sapiens
accctcgagattaacggtgct

SEQ ID NO: 2198952 - DNA, 23 bp, Homo sapiens
accctctgcagggcagcctgtgg

SEQ ID NO: 2198953 - DNA, 21 bp, Homo sapiens
accctgcttggggcctggcgt

SEQ ID NO: 2198954 - DNA, 20 bp, Homo sapiens
accctggtgaggaagctcca

SEQ ID NO: 2198955 - DNA, 19 bp, Homo sapiens
accctgtatggagctagag

SEQ ID NO: 2198956 - DNA, 22 bp, Homo sapiens
accctgtatggagctagagagg

SEQ ID NO: 2198957 - DNA, 12 bp, Homo sapiens
accctgtcctcc

SEQ ID NO: 2198958 - DNA, 19 bp, Homo sapiens
accctgtggcaaatgccag

SEQ ID NO: 2198959 - DNA, 13 bp, Homo sapiens
acccttctcttct

SEQ ID NO: 2198960 - DNA, 14 bp, Homo sapiens
acccttctcttctc

SEQ ID NO: 2198961 - DNA, 15 bp, Homo sapiens
acccttctcttctcc

SEQ ID NO: 2198962 - DNA, 17 bp, Homo sapiens
acccttctgtgcccagc

SEQ ID NO: 2198963 - DNA, 20 bp, Homo sapiens
acccttgagacctggaacca

SEQ ID NO: 2198964 - DNA, 23 bp, Homo sapiens
acccttgcccacttctccttcgc

SEQ ID NO: 2198965 - DNA, 18 bp, Homo sapiens
accgacatttttcaataa

SEQ ID NO: 2198966 - DNA, 21 bp, Homo sapiens
accgagaggaaaaaggcttct

SEQ ID NO: 2198967 - DNA, 20 bp, Homo sapiens
accgctacaagagggcaaag

SEQ ID NO: 2198968 - DNA, 22 bp, Homo sapiens
accgctacaagagggcaaagct

SEQ ID NO: 2198969 - DNA, 23 bp, Homo sapiens
accgctacaagagggcaaagctg

SEQ ID NO: 2198970 - DNA, 14 bp, Homo sapiens
accggaagctcctg

SEQ ID NO: 2198971 - DNA, 20 bp, Homo sapiens
accggaggcaaaaggcagtg

SEQ ID NO: 2198972 - DNA, 16 bp, Homo sapiens
accggttgcttctggg

SEQ ID NO: 2198973 - DNA, 18 bp, Homo sapiens
accggttgcttctgggaa

SEQ ID NO: 2198974 - DNA, 16 bp, Homo sapiens
acctaaaacaatctgt

SEQ ID NO: 2198975 - DNA, 19 bp, Homo sapiens
acctaaaatttgccctccc

SEQ ID NO: 2198976 - DNA, 21 bp, Homo sapiens
acctaaaatttgccctcccat

SEQ ID NO: 2198977 - DNA, 22 bp, Homo sapiens
acctaagaacaaaactgtaact

SEQ ID NO: 2198978 - DNA, 17 bp, Homo sapiens
acctaccttcaaagctg

SEQ ID NO: 2198979 - DNA, 22 bp, Homo sapiens
acctataaatactaaatatgaa

SEQ ID NO: 2198980 - DNA, 22 bp, Homo sapiens
acctcaaaataagccatgctgc

SEQ ID NO: 2198981 - DNA, 15 bp, Homo sapiens
acctcagagccccgc

SEQ ID NO: 2198982 - DNA, 16 bp, Homo sapiens
acctccacctcccagg

SEQ ID NO: 2198983 - DNA, 17 bp, Homo sapiens
acctcccactttgggga

SEQ ID NO: 2198984 - DNA, 14 bp, Homo sapiens
acctcctctctgct

SEQ ID NO: 2198985 - DNA, 23 bp, Homo sapiens
acctccttctctgtctcatgtgt

SEQ ID NO: 2198986 - DNA, 18 bp, Homo sapiens
acctcctttctcttctct

SEQ ID NO: 2198987 - DNA, 12 bp, Homo sapiens
acctctggccct

SEQ ID NO: 2198988 - DNA, 17 bp, Homo sapiens
acctctggccctgttgt

SEQ ID NO: 2198989 - DNA, 18 bp, Homo sapiens
acctctgtgctgcatccc

SEQ ID NO: 2198990 - DNA, 23 bp, Homo sapiens
acctcttttgagactttgcccag

SEQ ID NO: 2198991 - DNA, 13 bp, Homo sapiens
acctgaggcccag

SEQ ID NO: 2198992 - DNA, 18 bp, Homo sapiens
acctgaggcccagcagag

SEQ ID NO: 2198993 - DNA, 19 bp, Homo sapiens
acctgcacagggccctctg

SEQ ID NO: 2198994 - DNA, 18 bp, Homo sapiens
acctgcatcagcctctgg

SEQ ID NO: 2198995 - DNA, 19 bp, Homo sapiens
acctgccactaggctgggt

SEQ ID NO: 2198996 - DNA, 18 bp, Homo sapiens
acctgcccccactcagca

SEQ ID NO: 2198997 - DNA, 19 bp, Homo sapiens
acctgcccccactcagcat

SEQ ID NO: 2198998 - DNA, 21 bp, Homo sapiens
acctgccctctatttattagc

SEQ ID NO: 2198999 - DNA, 17 bp, Homo sapiens
acctgccctctctcagt

SEQ ID NO: 2199000 - DNA, 15 bp, Homo sapiens
acctgcgcagggccc

SEQ ID NO: 2199001 - DNA, 19 bp, Homo sapiens
acctgcgcagggccctctg

SEQ ID NO: 2199002 - DNA, 19 bp, Homo sapiens
acctggaaccagagccaca

SEQ ID NO: 2199003 - DNA, 24 bp, Homo sapiens
acctggagggttgatatattcttt

SEQ ID NO: 2199004 - DNA, 16 bp, Homo sapiens
acctgggaatttcagc

SEQ ID NO: 2199005 - DNA, 22 bp, Homo sapiens
acctggggtggggaggcagagg

SEQ ID NO: 2199006 - DNA, 13 bp, Homo sapiens
acctgtcccacct

SEQ ID NO: 2199007 - DNA, 14 bp, Homo sapiens
acctgtcccacctc

SEQ ID NO: 2199008 - DNA, 15 bp, Homo sapiens
acctgtgcagggccc

SEQ ID NO: 2199009 - DNA, 16 bp, Homo sapiens
acctgttcttgggcct

SEQ ID NO: 2199010 - DNA, 18 bp, Homo sapiens
accttaccctactggctg

SEQ ID NO: 2199011 - DNA, 18 bp, Homo sapiens
accttcctctgcctttgt

SEQ ID NO: 2199012 - DNA, 23 bp, Homo sapiens
accttctaatccatgtgctgctg

SEQ ID NO: 2199013 - DNA, 15 bp, Homo sapiens
accttctcttagatt

SEQ ID NO: 2199014 - DNA, 13 bp, Homo sapiens
accttcttccaca

SEQ ID NO: 2199015 - DNA, 22 bp, Homo sapiens
accttgagaccaagccggtgcc

SEQ ID NO: 2199016 - DNA, 19 bp, Homo sapiens
accttgaggagtcttgtgt

SEQ ID NO: 2199017 - DNA, 20 bp, Homo sapiens
accttgatgtcttgagagcg

SEQ ID NO: 2199018 - DNA, 13 bp, Homo sapiens
accttgattgcac

SEQ ID NO: 2199019 - DNA, 17 bp, Homo sapiens
accttgtgaaggaaaaa

SEQ ID NO: 2199020 - DNA, 15 bp, Homo sapiens
acctttaaaaatgta

SEQ ID NO: 2199021 - DNA, 19 bp, Homo sapiens
acctttaaaaatgtataat

SEQ ID NO: 2199022 - DNA, 20 bp, Homo sapiens
acctttaaaaatgtataatg

SEQ ID NO: 2199023 - DNA, 13 bp, Homo sapiens
acctttattcttt

SEQ ID NO: 2199024 - DNA, 23 bp, Homo sapiens
acctttccattttacgttttaga

SEQ ID NO: 2199025 - DNA, 22 bp, Homo sapiens
accttttttttacggaattcca

SEQ ID NO: 2199026 - DNA, 23 bp, Homo sapiens
accttttttttacggaattccaa

SEQ ID NO: 2199027 - DNA, 14 bp, Homo sapiens
acgaaactgctcta

SEQ ID NO: 2199028 - DNA, 15 bp, Homo sapiens
acgagcccttttaga

SEQ ID NO: 2199029 - DNA, 17 bp, Homo sapiens
acgaggctgggccaagc

SEQ ID NO: 2199030 - DNA, 20 bp, Homo sapiens
acgaggggcagggaaggaca

SEQ ID NO: 2199031 - DNA, 15 bp, Homo sapiens
acgcaaacctctcct

SEQ ID NO: 2199032 - DNA, 18 bp, Homo sapiens
acgcaaacctctccttcc

SEQ ID NO: 2199033 - DNA, 22 bp, Homo sapiens
acgcaggctgagtgcactggca

SEQ ID NO: 2199034 - DNA, 16 bp, Homo sapiens
acgcccttcctgtgcc

SEQ ID NO: 2199035 - DNA, 15 bp, Homo sapiens
acgcctcttgaccag

SEQ ID NO: 2199036 - DNA, 24 bp, Homo sapiens
acgcctcttgaccaggctgcctcc

SEQ ID NO: 2199037 - DNA, 16 bp, Homo sapiens
acgcctgccttctggg

SEQ ID NO: 2199038 - DNA, 17 bp, Homo sapiens
acgcctgccttctgggc

SEQ ID NO: 2199039 - DNA, 19 bp, Homo sapiens
acgctaataaaaatttatt

SEQ ID NO: 2199040 - DNA, 17 bp, Homo sapiens
acgctgccatttccctg

SEQ ID NO: 2199041 - DNA, 19 bp, Homo sapiens
acggggagtgagactcctg

SEQ ID NO: 2199042 - DNA, 20 bp, Homo sapiens
acgggggaggccgaggcagg

SEQ ID NO: 2199043 - DNA, 12 bp, Homo sapiens
agcactgacact

SEQ ID NO: 2199044 - DNA, 20 bp, Homo sapiens
agcagaacagttaagcagcc

SEQ ID NO: 2199045 - DNA, 16 bp, Homo sapiens
agcagagaaggccagg

SEQ ID NO: 2199046 - DNA, 17 bp, Homo sapiens
agcagagccgttcctgg

SEQ ID NO: 2199047 - DNA, 18 bp, Homo sapiens
agcagagccgttcctggg

SEQ ID NO: 2199048 - DNA, 19 bp, Homo sapiens
agcagagccgttcctggga

SEQ ID NO: 2199049 - DNA, 20 bp, Homo sapiens
agcagagccgttcctgggac

SEQ ID NO: 2199050 - DNA, 14 bp, Homo sapiens
agcagatggtccca

SEQ ID NO: 2199051 - DNA, 21 bp, Homo sapiens
agcaggaaaaggtccttgact

SEQ ID NO: 2199052 - DNA, 14 bp, Homo sapiens
agcaggaaatgtag

SEQ ID NO: 2199053 - DNA, 17 bp, Homo sapiens
agcaggcccacctacct

SEQ ID NO: 2199054 - DNA, 23 bp, Homo sapiens
agcaggcccacctaccttcaaag

SEQ ID NO: 2199055 - DNA, 15 bp, Homo sapiens
agcaggttccccaag

SEQ ID NO: 2199056 - DNA, 15 bp, Homo sapiens
agcagtgagcagggt

SEQ ID NO: 2199057 - DNA, 16 bp, Homo sapiens
agcagtgtgtctcctg

SEQ ID NO: 2199058 - DNA, 17 bp, Homo sapiens
agcagtgtgtctcctgc

SEQ ID NO: 2199059 - DNA, 11 bp, Homo sapiens
agcatatataa

SEQ ID NO: 2199060 - DNA, 19 bp, Homo sapiens
agcatatattcatacctgt

SEQ ID NO: 2199061 - DNA, 14 bp, Homo sapiens
agcatccattaatt

SEQ ID NO: 2199062 - DNA, 18 bp, Homo sapiens
agcatccgtctcccctcg

SEQ ID NO: 2199063 - DNA, 16 bp, Homo sapiens
agcatgactggacagc

SEQ ID NO: 2199064 - DNA, 13 bp, Homo sapiens
agcatgctttctg

SEQ ID NO: 2199065 - DNA, 22 bp, Homo sapiens
agcatgtttggcctatttcatt

SEQ ID NO: 2199066 - DNA, 16 bp, Homo sapiens
agcatttacagaaatg

SEQ ID NO: 2199067 - DNA, 16 bp, Homo sapiens
agcatttcctcagtct

SEQ ID NO: 2199068 - DNA, 16 bp, Homo sapiens
agcatttcggtgcttc

SEQ ID NO: 2199069 - DNA, 17 bp, Homo sapiens
agcattttctacacagc

SEQ ID NO: 2199070 - DNA, 20 bp, Homo sapiens
agccaactgtttccctgctg

SEQ ID NO: 2199071 - DNA, 22 bp, Homo sapiens
agccaactgtttccctgctgaa

SEQ ID NO: 2199072 - DNA, 16 bp, Homo sapiens
agccacagacccctgg

SEQ ID NO: 2199073 - DNA, 20 bp, Homo sapiens
agccacagacccctgggagc

SEQ ID NO: 2199074 - DNA, 18 bp, Homo sapiens
agccaccaagggcctcac

SEQ ID NO: 2199075 - DNA, 16 bp, Homo sapiens
agccaccacacccagc

SEQ ID NO: 2199076 - DNA, 21 bp, Homo sapiens
agccacccaggccactgacct

SEQ ID NO: 2199077 - DNA, 21 bp, Homo sapiens
agccaccctaactgagctgcc

SEQ ID NO: 2199078 - DNA, 22 bp, Homo sapiens
agccaccctaactgagctgcca

SEQ ID NO: 2199079 - DNA, 13 bp, Homo sapiens
agccacctgtccc

SEQ ID NO: 2199080 - DNA, 18 bp, Homo sapiens
agccacctgtcccacctc

SEQ ID NO: 2199081 - DNA, 19 bp, Homo sapiens
agccacctgtcccacctca

SEQ ID NO: 2199082 - DNA, 18 bp, Homo sapiens
agccacgtgctggagagt

SEQ ID NO: 2199083 - DNA, 19 bp, Homo sapiens
agccacgtgctggagagta

SEQ ID NO: 2199084 - DNA, 20 bp, Homo sapiens
agccacgtgctggagagtag

SEQ ID NO: 2199085 - DNA, 17 bp, Homo sapiens
agccactgtgcccagca

SEQ ID NO: 2199086 - DNA, 22 bp, Homo sapiens
agccactgtgcccagcagtttc

SEQ ID NO: 2199087 - DNA, 14 bp, Homo sapiens
agccacttccccct

SEQ ID NO: 2199088 - DNA, 17 bp, Homo sapiens
agccacttccccctctt

SEQ ID NO: 2199089 - DNA, 12 bp, Homo sapiens
agccagaattca

SEQ ID NO: 2199090 - DNA, 14 bp, Homo sapiens
agccagattctctt

SEQ ID NO: 2199091 - DNA, 10 bp, Homo sapiens
agccagccac

SEQ ID NO: 2199092 - DNA, 22 bp, Homo sapiens
agccagccacagacccctggga

SEQ ID NO: 2199093 - DNA, 23 bp, Homo sapiens
agccagccacagacccctgggag

SEQ ID NO: 2199094 - DNA, 13 bp, Homo sapiens
agccagccaccct

SEQ ID NO: 2199095 - DNA, 20 bp, Homo sapiens
agccagggatggggccacag

SEQ ID NO: 2199096 - DNA, 21 bp, Homo sapiens
agccagggatggggccacagc

SEQ ID NO: 2199097 - DNA, 23 bp, Homo sapiens
agccagggatggggccacagcca

SEQ ID NO: 2199098 - DNA, 19 bp, Homo sapiens
agccagtaaggcagctctg

SEQ ID NO: 2199099 - DNA, 20 bp, Homo sapiens
agccagtaaggcagctctgt

SEQ ID NO: 2199100 - DNA, 18 bp, Homo sapiens
agccatcccagccttggc

SEQ ID NO: 2199101 - DNA, 17 bp, Homo sapiens
agccatgtagccaccca

SEQ ID NO: 2199102 - DNA, 13 bp, Homo sapiens
agcccaatcactg

SEQ ID NO: 2199103 - DNA, 22 bp, Homo sapiens
agcccacaggtgtccccagccc

SEQ ID NO: 2199104 - DNA, 17 bp, Homo sapiens
agcccagcccagctgct

SEQ ID NO: 2199105 - DNA, 18 bp, Homo sapiens
agcccagctgctctgccc

SEQ ID NO: 2199106 - DNA, 17 bp, Homo sapiens
agcccatcctgaccagc

SEQ ID NO: 2199107 - DNA, 19 bp, Homo sapiens
agcccatcttgcctccatg

SEQ ID NO: 2199108 - DNA, 23 bp, Homo sapiens
agccccctgtccttcccacggcc

SEQ ID NO: 2199109 - DNA, 12 bp, Homo sapiens
agcccgcatgca

SEQ ID NO: 2199110 - DNA, 20 bp, Homo sapiens
agcccgcatgcagcagcttg

SEQ ID NO: 2199111 - DNA, 15 bp, Homo sapiens
agccctaggctaccc

SEQ ID NO: 2199112 - DNA, 22 bp, Homo sapiens
agccctgagctggcctcacctg

SEQ ID NO: 2199113 - DNA, 13 bp, Homo sapiens
agccgccacatcc

SEQ ID NO: 2199114 - DNA, 21 bp, Homo sapiens
agccgccaggaccgccaaaga

SEQ ID NO: 2199115 - DNA, 22 bp, Homo sapiens
agccgttcctgggactgtcaga

SEQ ID NO: 2199116 - DNA, 15 bp, Homo sapiens
agcctcaaactcaac

SEQ ID NO: 2199117 - DNA, 18 bp, Homo sapiens
agcctcaacctccctggc

SEQ ID NO: 2199118 - DNA, 18 bp, Homo sapiens
agcctcaataagccttgt

SEQ ID NO: 2199119 - DNA, 20 bp, Homo sapiens
agcctccctctcctctgtcc

SEQ ID NO: 2199120 - DNA, 11 bp, Homo sapiens
agcctcctgag

SEQ ID NO: 2199121 - DNA, 20 bp, Homo sapiens
agcctcctgagtagctgaga

SEQ ID NO: 2199122 - DNA, 18 bp, Homo sapiens
agcctctagggacccctc

SEQ ID NO: 2199123 - DNA, 20 bp, Homo sapiens
agcctctagggacccctcct

SEQ ID NO: 2199124 - DNA, 21 bp, Homo sapiens
agcctctagggacccctcctc

SEQ ID NO: 2199125 - DNA, 14 bp, Homo sapiens
agcctctcatcccc

SEQ ID NO: 2199126 - DNA, 12 bp, Homo sapiens
agcctctggcca

SEQ ID NO: 2199127 - DNA, 17 bp, Homo sapiens
agcctcttctgaagatg

SEQ ID NO: 2199128 - DNA, 17 bp, Homo sapiens
agcctgatgatggaagg

SEQ ID NO: 2199129 - DNA, 17 bp, Homo sapiens
agcctgcggctgctggc

SEQ ID NO: 2199130 - DNA, 18 bp, Homo sapiens
agcctgcggctgctggca

SEQ ID NO: 2199131 - DNA, 18 bp, Homo sapiens
agcctgcgtcatggctca

SEQ ID NO: 2199132 - DNA, 12 bp, Homo sapiens
agcctgctgatt

SEQ ID NO: 2199133 - DNA, 16 bp, Homo sapiens
agcctggctaacatgg

SEQ ID NO: 2199134 - DNA, 23 bp, Homo sapiens
agcctgggccactggcatctctg

SEQ ID NO: 2199135 - DNA, 16 bp, Homo sapiens
agcctgtcgtgttctc

SEQ ID NO: 2199136 - DNA, 21 bp, Homo sapiens
agcctgtcttcagatcctgct

SEQ ID NO: 2199137 - DNA, 10 bp, Homo sapiens
agcctgtgcg

SEQ ID NO: 2199138 - DNA, 18 bp, Homo sapiens
agcctgtgcgtcccagct

SEQ ID NO: 2199139 - DNA, 13 bp, Homo sapiens
agcctgtgggaga

SEQ ID NO: 2199140 - DNA, 17 bp, Homo sapiens
agcctgtgggagaaggg

SEQ ID NO: 2199141 - DNA, 17 bp, Homo sapiens
agcctgtgttactgatt

SEQ ID NO: 2199142 - DNA, 16 bp, Homo sapiens
agccttggcatctaga

SEQ ID NO: 2199143 - DNA, 17 bp, Homo sapiens
agccttggctcgttctc

SEQ ID NO: 2199144 - DNA, 13 bp, Homo sapiens
agcctttcttcct

SEQ ID NO: 2199145 - DNA, 17 bp, Homo sapiens
agccttttattaacata

SEQ ID NO: 2199146 - DNA, 13 bp, Homo sapiens
agccttttgtaac

SEQ ID NO: 2199147 - DNA, 20 bp, Homo sapiens
agcgactctcctgcctcagc

SEQ ID NO: 2199148 - DNA, 16 bp, Homo sapiens
agcggccgcctgtcct

SEQ ID NO: 2199149 - DNA, 17 bp, Homo sapiens
agcggccgcctgtcctt

SEQ ID NO: 2199150 - DNA, 22 bp, Homo sapiens
agcgggcggaggggatccagcc

SEQ ID NO: 2199151 - DNA, 17 bp, Homo sapiens
agcggttgtaaatacaa

SEQ ID NO: 2199152 - DNA, 22 bp, Homo sapiens
agcgtctgagcggccgcctgtc

SEQ ID NO: 2199153 - DNA, 15 bp, Homo sapiens
agctaaagaggtggg

SEQ ID NO: 2199154 - DNA, 15 bp, Homo sapiens
agctaagcctgatga

SEQ ID NO: 2199155 - DNA, 23 bp, Homo sapiens
agctagctcccctcctctcccct

SEQ ID NO: 2199156 - DNA, 17 bp, Homo sapiens
agctattctttgaccaa

SEQ ID NO: 2199157 - DNA, 22 bp, Homo sapiens
agctattctttgaccaaactgt

SEQ ID NO: 2199158 - DNA, 13 bp, Homo sapiens
agctcagccccag

SEQ ID NO: 2199159 - DNA, 20 bp, Homo sapiens
agctcagccccagcccagcc

SEQ ID NO: 2199160 - DNA, 22 bp, Homo sapiens
agctcaggagagagcttcctgt

SEQ ID NO: 2199161 - DNA, 21 bp, Homo sapiens
agctcagtcttccctagggct

SEQ ID NO: 2199162 - DNA, 17 bp, Homo sapiens
agctccagtcctgctct

SEQ ID NO: 2199163 - DNA, 15 bp, Homo sapiens
agctccgcctggcac

SEQ ID NO: 2199164 - DNA, 20 bp, Homo sapiens
agctccgcctggcacccact

SEQ ID NO: 2199165 - DNA, 17 bp, Homo sapiens
ataaagttaaattgcac

SEQ ID NO: 2199166 - DNA, 16 bp, Homo sapiens
ataaatactaaatatg

SEQ ID NO: 2199167 - DNA, 13 bp, Homo sapiens
ataaatatgtgat

SEQ ID NO: 2199168 - DNA, 16 bp, Homo sapiens
ataaatggctcgtggg

SEQ ID NO: 2199169 - DNA, 21 bp, Homo sapiens
ataaatggtgagaattaaaat

SEQ ID NO: 2199170 - DNA, 15 bp, Homo sapiens
ataaattaatttgtt

SEQ ID NO: 2199171 - DNA, 17 bp, Homo sapiens
ataacaaagaagtgtat

SEQ ID NO: 2199172 - DNA, 16 bp, Homo sapiens
ataacataagctagaa

SEQ ID NO: 2199173 - DNA, 15 bp, Homo sapiens
ataagtttttgccat

SEQ ID NO: 2199174 - DNA, 13 bp, Homo sapiens
ataataaaaatca

SEQ ID NO: 2199175 - DNA, 20 bp, Homo sapiens
ataataaaaatcatgcttat

SEQ ID NO: 2199176 - DNA, 14 bp, Homo sapiens
ataataaaattcat

SEQ ID NO: 2199177 - DNA, 22 bp, Homo sapiens
ataatacttaaaaatatgtgag

SEQ ID NO: 2199178 - DNA, 18 bp, Homo sapiens
ataatagttcaggatttg

SEQ ID NO: 2199179 - DNA, 13 bp, Homo sapiens
ataatattgcagt

SEQ ID NO: 2199180 - DNA, 22 bp, Homo sapiens
ataatcattttagaattaaaat

SEQ ID NO: 2199181 - DNA, 20 bp, Homo sapiens
ataatctgacaaagtcatga

SEQ ID NO: 2199182 - DNA, 17 bp, Homo sapiens
ataatgacgtattgtga

SEQ ID NO: 2199183 - DNA, 19 bp, Homo sapiens
ataattaaaaaaaaaactt

SEQ ID NO: 2199184 - DNA, 13 bp, Homo sapiens
ataattaaagaaa

SEQ ID NO: 2199185 - DNA, 16 bp, Homo sapiens
ataattaaagaaaatt

SEQ ID NO: 2199186 - DNA, 19 bp, Homo sapiens
ataattaaagaaaattgcc

SEQ ID NO: 2199187 - DNA, 23 bp, Homo sapiens
ataattgttctcagaatccctta

SEQ ID NO: 2199188 - DNA, 22 bp, Homo sapiens
ataatttattgtaccaaagctg

SEQ ID NO: 2199189 - DNA, 13 bp, Homo sapiens
ataatttgcataa

SEQ ID NO: 2199190 - DNA, 20 bp, Homo sapiens
ataattttgaccataaatta

SEQ ID NO: 2199191 - DNA, 19 bp, Homo sapiens
ataattttttagttaaaat

SEQ ID NO: 2199192 - DNA, 23 bp, Homo sapiens
ataattttttagttaaaatctat

SEQ ID NO: 2199193 - DNA, 21 bp, Homo sapiens
atacatactatagattcttta

SEQ ID NO: 2199194 - DNA, 17 bp, Homo sapiens
atacatatgatcaaata

SEQ ID NO: 2199195 - DNA, 21 bp, Homo sapiens
ataccactttgacacgcttca

SEQ ID NO: 2199196 - DNA, 19 bp, Homo sapiens
ataccagatcactcaaaaa

SEQ ID NO: 2199197 - DNA, 18 bp, Homo sapiens
atacccaaatcctctcca

SEQ ID NO: 2199198 - DNA, 15 bp, Homo sapiens
atacggaacactgtc

SEQ ID NO: 2199199 - DNA, 18 bp, Homo sapiens
atacggaacactgtcaat

SEQ ID NO: 2199200 - DNA, 12 bp, Homo sapiens
atactaataaaa

SEQ ID NO: 2199201 - DNA, 17 bp, Homo sapiens
atactaataaaatacat

SEQ ID NO: 2199202 - DNA, 22 bp, Homo sapiens
atactaataaaatacatactat

SEQ ID NO: 2199203 - DNA, 20 bp, Homo sapiens
atactaggttaacatttgta

SEQ ID NO: 2199204 - DNA, 20 bp, Homo sapiens
atactgtgctggagccacta

SEQ ID NO: 2199205 - DNA, 22 bp, Homo sapiens
atacttaataaatctgccattt

SEQ ID NO: 2199206 - DNA, 17 bp, Homo sapiens
atacttcagctttgtgt

SEQ ID NO: 2199207 - DNA, 13 bp, Homo sapiens
atagaacagaact

SEQ ID NO: 2199208 - DNA, 14 bp, Homo sapiens
atagatgtatcatt

SEQ ID NO: 2199209 - DNA, 15 bp, Homo sapiens
atagattctttatta

SEQ ID NO: 2199210 - DNA, 20 bp, Homo sapiens
atagctgtatatttgaaact

SEQ ID NO: 2199211 - DNA, 21 bp, Homo sapiens
atagctgtatatttgaaactg

SEQ ID NO: 2199212 - DNA, 20 bp, Homo sapiens
atagcttgtacacatataca

SEQ ID NO: 2199213 - DNA, 14 bp, Homo sapiens
ataggcattaaatg

SEQ ID NO: 2199214 - DNA, 17 bp, Homo sapiens
atagtaacgtgttactg

SEQ ID NO: 2199215 - DNA, 18 bp, Homo sapiens
atagtacctttgctcttg

SEQ ID NO: 2199216 - DNA, 14 bp, Homo sapiens
atagtagattgaca

SEQ ID NO: 2199217 - DNA, 15 bp, Homo sapiens
atagtgactaaacta

SEQ ID NO: 2199218 - DNA, 13 bp, Homo sapiens
atagtggccagac

SEQ ID NO: 2199219 - DNA, 16 bp, Homo sapiens
atagtgttttgtactt

SEQ ID NO: 2199220 - DNA, 17 bp, Homo sapiens
atagttggttcttttac

SEQ ID NO: 2199221 - DNA, 16 bp, Homo sapiens
atataaatggtgagaa

SEQ ID NO: 2199222 - DNA, 13 bp, Homo sapiens
atataactgtaca

SEQ ID NO: 2199223 - DNA, 14 bp, Homo sapiens
atataactgtacaa

SEQ ID NO: 2199224 - DNA, 17 bp, Homo sapiens
atataatacttaaaaat

SEQ ID NO: 2199225 - DNA, 23 bp, Homo sapiens
atatatatgtagccagacagttt

SEQ ID NO: 2199226 - DNA, 18 bp, Homo sapiens
atatatgtagccagacag

SEQ ID NO: 2199227 - DNA, 16 bp, Homo sapiens
atatattcatacctgt

SEQ ID NO: 2199228 - DNA, 13 bp, Homo sapiens
atatcaatatggt

SEQ ID NO: 2199229 - DNA, 21 bp, Homo sapiens
atatctacctgccctctctca

SEQ ID NO: 2199230 - DNA, 15 bp, Homo sapiens
atatgatcaaatact

SEQ ID NO: 2199231 - DNA, 16 bp, Homo sapiens
atatgccttatgtaat

SEQ ID NO: 2199232 - DNA, 21 bp, Homo sapiens
atatggtgtcttgatatattt

SEQ ID NO: 2199233 - DNA, 14 bp, Homo sapiens
atatgtgagcatga

SEQ ID NO: 2199234 - DNA, 14 bp, Homo sapiens
atattaaaaattaa

SEQ ID NO: 2199235 - DNA, 17 bp, Homo sapiens
atattaaaaattaattc

SEQ ID NO: 2199236 - DNA, 17 bp, Homo sapiens
atattaaaaattgaaaa

SEQ ID NO: 2199237 - DNA, 18 bp, Homo sapiens
atattaggctataaatgt

SEQ ID NO: 2199238 - DNA, 12 bp, Homo sapiens
atattataagat

SEQ ID NO: 2199239 - DNA, 17 bp, Homo sapiens
atattcaaaaattatat

SEQ ID NO: 2199240 - DNA, 21 bp, Homo sapiens
atattcaaaaattatattttg

SEQ ID NO: 2199241 - DNA, 23 bp, Homo sapiens
atattcatacctgttgtacactt

SEQ ID NO: 2199242 - DNA, 16 bp, Homo sapiens
atattgaataggcatt

SEQ ID NO: 2199243 - DNA, 20 bp, Homo sapiens
atattgaataggcattaaat

SEQ ID NO: 2199244 - DNA, 17 bp, Homo sapiens
atattgataataaaatt

SEQ ID NO: 2199245 - DNA, 22 bp, Homo sapiens
atattgataataaaattcattc

SEQ ID NO: 2199246 - DNA, 12 bp, Homo sapiens
atattgcagttc

SEQ ID NO: 2199247 - DNA, 14 bp, Homo sapiens
atattggtgtgaat

SEQ ID NO: 2199248 - DNA, 16 bp, Homo sapiens
atattgttttgtgact

SEQ ID NO: 2199249 - DNA, 23 bp, Homo sapiens
atatttaataccaccaacaaata

SEQ ID NO: 2199250 - DNA, 20 bp, Homo sapiens
atatttaatttttacatgac

SEQ ID NO: 2199251 - DNA, 14 bp, Homo sapiens
atatttataaatat

SEQ ID NO: 2199252 - DNA, 18 bp, Homo sapiens
atatttataattaaagaa

SEQ ID NO: 2199253 - DNA, 23 bp, Homo sapiens
atatttgaaactgctaattacac

SEQ ID NO: 2199254 - DNA, 15 bp, Homo sapiens
atcaaaaaacaagtc

SEQ ID NO: 2199255 - DNA, 14 bp, Homo sapiens
atcaaccaggaaga

SEQ ID NO: 2199256 - DNA, 13 bp, Homo sapiens
atcaagtctgtga

SEQ ID NO: 2199257 - DNA, 14 bp, Homo sapiens
atcaagtctgtgaa

SEQ ID NO: 2199258 - DNA, 19 bp, Homo sapiens
atcaatcacaaaagtatat

SEQ ID NO: 2199259 - DNA, 23 bp, Homo sapiens
atcaatcacaaaagtatattcaa

SEQ ID NO: 2199260 - DNA, 22 bp, Homo sapiens
atcacctgcgcagggccctctg

SEQ ID NO: 2199261 - DNA, 14 bp, Homo sapiens
atcactcatttatt

SEQ ID NO: 2199262 - DNA, 13 bp, Homo sapiens
atcactcccctcc

SEQ ID NO: 2199263 - DNA, 15 bp, Homo sapiens
atcactttgtattct

SEQ ID NO: 2199264 - DNA, 15 bp, Homo sapiens
atcaggggaatttca

SEQ ID NO: 2199265 - DNA, 16 bp, Homo sapiens
atcagtattgtgtaaa

SEQ ID NO: 2199266 - DNA, 16 bp, Homo sapiens
atcagttttgtgtaca

SEQ ID NO: 2199267 - DNA, 18 bp, Homo sapiens
atcataaaatccaatgct

SEQ ID NO: 2199268 - DNA, 21 bp, Homo sapiens
atcatatgggtcaggtcattt

SEQ ID NO: 2199269 - DNA, 15 bp, Homo sapiens
atcatcccaacagcc

SEQ ID NO: 2199270 - DNA, 18 bp, Homo sapiens
atcatggctcactgcagc

SEQ ID NO: 2199271 - DNA, 14 bp, Homo sapiens
atcatttcccctcc

SEQ ID NO: 2199272 - DNA, 16 bp, Homo sapiens
atcatttgcagctgct

SEQ ID NO: 2199273 - DNA, 17 bp, Homo sapiens
atcatttgcagctgctg

SEQ ID NO: 2199274 - DNA, 18 bp, Homo sapiens
atccacacaacaccagga

SEQ ID NO: 2199275 - DNA, 19 bp, Homo sapiens
atccacacaacaccaggac

SEQ ID NO: 2199276 - DNA, 15 bp, Homo sapiens
atccacaggattcca

SEQ ID NO: 2199277 - DNA, 13 bp, Homo sapiens
atccacctccttc

SEQ ID NO: 2199278 - DNA, 11 bp, Homo sapiens
atccagccact

SEQ ID NO: 2199279 - DNA, 12 bp, Homo sapiens
atccagccactt

SEQ ID NO: 2199280 - DNA, 22 bp, Homo sapiens
atccagtgggttcctcccagtc

SEQ ID NO: 2199281 - DNA, 15 bp, Homo sapiens
atccatgttgctgac

SEQ ID NO: 2199282 - DNA, 21 bp, Homo sapiens
atccatgttgctgacttttcc

SEQ ID NO: 2199283 - DNA, 15 bp, Homo sapiens
atcccaacaaacttt

SEQ ID NO: 2199284 - DNA, 21 bp, Homo sapiens
atcccacccccaatgcacagg

SEQ ID NO: 2199285 - DNA, 15 bp, Homo sapiens
atcccagttcatgtt

SEQ ID NO: 2199286 - DNA, 20 bp, Homo sapiens
atcccatggatgtttcttct

SEQ ID NO: 2199287 - DNA, 19 bp, Homo sapiens
attggccgatgagctggtt

SEQ ID NO: 2199288 - DNA, 14 bp, Homo sapiens
attggcctctgtct

SEQ ID NO: 2199289 - DNA, 18 bp, Homo sapiens
attggtgtgaatgctgta

SEQ ID NO: 2199290 - DNA, 16 bp, Homo sapiens
attggttccctttgct

SEQ ID NO: 2199291 - DNA, 17 bp, Homo sapiens
attggttccctttgctc

SEQ ID NO: 2199292 - DNA, 18 bp, Homo sapiens
attggttccctttgctcc

SEQ ID NO: 2199293 - DNA, 15 bp, Homo sapiens
attgtaccaaagctg

SEQ ID NO: 2199294 - DNA, 20 bp, Homo sapiens
attgtataaattactttgat

SEQ ID NO: 2199295 - DNA, 22 bp, Homo sapiens
attgtataaattactttgattc

SEQ ID NO: 2199296 - DNA, 17 bp, Homo sapiens
attgtatattgtaattt

SEQ ID NO: 2199297 - DNA, 16 bp, Homo sapiens
attgtctgaaattttc

SEQ ID NO: 2199298 - DNA, 22 bp, Homo sapiens
attgtgcatgcaaaccaggagc

SEQ ID NO: 2199299 - DNA, 14 bp, Homo sapiens
attgtggagaggag

SEQ ID NO: 2199300 - DNA, 14 bp, Homo sapiens
attgtggtgtctta

SEQ ID NO: 2199301 - DNA, 16 bp, Homo sapiens
attgttacccatttga

SEQ ID NO: 2199302 - DNA, 20 bp, Homo sapiens
attgttacccatttgaaaga

SEQ ID NO: 2199303 - DNA, 14 bp, Homo sapiens
attgttctcagaat

SEQ ID NO: 2199304 - DNA, 16 bp, Homo sapiens
atttaaaataattata

SEQ ID NO: 2199305 - DNA, 13 bp, Homo sapiens
atttaacagaaat

SEQ ID NO: 2199306 - DNA, 14 bp, Homo sapiens
atttaacagaaatt

SEQ ID NO: 2199307 - DNA, 23 bp, Homo sapiens
atttaataccaccaacaaatata

SEQ ID NO: 2199308 - DNA, 16 bp, Homo sapiens
atttaatgtagccatg

SEQ ID NO: 2199309 - DNA, 18 bp, Homo sapiens
atttaatttttacatgac

SEQ ID NO: 2199310 - DNA, 22 bp, Homo sapiens
atttacacaaaaagaaagctgt

SEQ ID NO: 2199311 - DNA, 14 bp, Homo sapiens
atttataaatatgt

SEQ ID NO: 2199312 - DNA, 11 bp, Homo sapiens
atttatctttg

SEQ ID NO: 2199313 - DNA, 20 bp, Homo sapiens
atttattgtaccaaagctgt

SEQ ID NO: 2199314 - DNA, 19 bp, Homo sapiens
atttatttggagtggaggc

SEQ ID NO: 2199315 - DNA, 15 bp, Homo sapiens
atttatttttgtact

SEQ ID NO: 2199316 - DNA, 20 bp, Homo sapiens
atttatttttgtactgtgct

SEQ ID NO: 2199317 - DNA, 12 bp, Homo sapiens
atttcagaagtt

SEQ ID NO: 2199318 - DNA, 14 bp, Homo sapiens
atttcagtgccaat

SEQ ID NO: 2199319 - DNA, 13 bp, Homo sapiens
atttcagttactt

SEQ ID NO: 2199320 - DNA, 15 bp, Homo sapiens
atttcatctactaca

SEQ ID NO: 2199321 - DNA, 16 bp, Homo sapiens
atttcatctttccaaa

SEQ ID NO: 2199322 - DNA, 23 bp, Homo sapiens
atttcatttttcaatagcacata

SEQ ID NO: 2199323 - DNA, 16 bp, Homo sapiens
atttccatattaaaat

SEQ ID NO: 2199324 - DNA, 21 bp, Homo sapiens
atttccatggattcccctgga

SEQ ID NO: 2199325 - DNA, 15 bp, Homo sapiens
atttctattttgcaa

SEQ ID NO: 2199326 - DNA, 14 bp, Homo sapiens
atttctcaaagttt

SEQ ID NO: 2199327 - DNA, 12 bp, Homo sapiens
atttctccccag

SEQ ID NO: 2199328 - DNA, 15 bp, Homo sapiens
atttctgccttcctt

SEQ ID NO: 2199329 - DNA, 17 bp, Homo sapiens
atttctgccttccttgc

SEQ ID NO: 2199330 - DNA, 23 bp, Homo sapiens
atttcttccttcaaatcctgcca

SEQ ID NO: 2199331 - DNA, 18 bp, Homo sapiens
atttcttctgcacaaaga

SEQ ID NO: 2199332 - DNA, 15 bp, Homo sapiens
atttgaaataagaat

SEQ ID NO: 2199333 - DNA, 20 bp, Homo sapiens
atttgctgattgtctgaaat

SEQ ID NO: 2199334 - DNA, 18 bp, Homo sapiens
atttgcttgtactgggac

SEQ ID NO: 2199335 - DNA, 19 bp, Homo sapiens
atttggaatcatatgggat

SEQ ID NO: 2199336 - DNA, 15 bp, Homo sapiens
atttggagtggaggc

SEQ ID NO: 2199337 - DNA, 19 bp, Homo sapiens
atttgtaaaaataatgaat

SEQ ID NO: 2199338 - DNA, 21 bp, Homo sapiens
atttgtctcattttgtatgta

SEQ ID NO: 2199339 - DNA, 16 bp, Homo sapiens
atttgtggttgcatgt

SEQ ID NO: 2199340 - DNA, 14 bp, Homo sapiens
atttgttaatatat

SEQ ID NO: 2199341 - DNA, 10 bp, Homo sapiens
attttaactt

SEQ ID NO: 2199342 - DNA, 17 bp, Homo sapiens
attttacgttttagaaa

SEQ ID NO: 2199343 - DNA, 21 bp, Homo sapiens
attttcaacattgatttttga

SEQ ID NO: 2199344 - DNA, 15 bp, Homo sapiens
attttcaagctttca

SEQ ID NO: 2199345 - DNA, 14 bp, Homo sapiens
attttcctgtgtcc

SEQ ID NO: 2199346 - DNA, 17 bp, Homo sapiens
attttctaccactggtg

SEQ ID NO: 2199347 - DNA, 20 bp, Homo sapiens
attttctagaatactaataa

SEQ ID NO: 2199348 - DNA, 20 bp, Homo sapiens
attttgaccataaattaatt

SEQ ID NO: 2199349 - DNA, 17 bp, Homo sapiens
attttgactgtgattta

SEQ ID NO: 2199350 - DNA, 16 bp, Homo sapiens
attttgcaaagattta

SEQ ID NO: 2199351 - DNA, 21 bp, Homo sapiens
attttggatctatcacctgtc

SEQ ID NO: 2199352 - DNA, 12 bp, Homo sapiens
attttggccact

SEQ ID NO: 2199353 - DNA, 16 bp, Homo sapiens
attttggggaactgtt

SEQ ID NO: 2199354 - DNA, 23 bp, Homo sapiens
attttggggtgtgacacttttga

SEQ ID NO: 2199355 - DNA, 14 bp, Homo sapiens
atttttaaaataat

SEQ ID NO: 2199356 - DNA, 18 bp, Homo sapiens
atttttgatagactgaag

SEQ ID NO: 2199357 - DNA, 21 bp, Homo sapiens
atttttgtttttggtttctta

SEQ ID NO: 2199358 - DNA, 20 bp, Homo sapiens
attttttacaagagtctgta

SEQ ID NO: 2199359 - DNA, 20 bp, Homo sapiens
attttttgttgaataggaaa

SEQ ID NO: 2199360 - DNA, 15 bp, Homo sapiens
atttttttattcttc

SEQ ID NO: 2199361 - DNA, 15 bp, Homo sapiens
attttttttaactgc

SEQ ID NO: 2199362 - DNA, 20 bp, Homo sapiens
attttttttaactgcattct

SEQ ID NO: 2199363 - DNA, 21 bp, Homo sapiens
attttttttttaacttgaaaa

SEQ ID NO: 2199364 - DNA, 20 bp, Homo sapiens
attttttttttccattagta

SEQ ID NO: 2199365 - DNA, 17 bp, Homo sapiens
caaaaacaaagtgcaaa

SEQ ID NO: 2199366 - DNA, 22 bp, Homo sapiens
caaaaacaaagtgcaaagctgc

SEQ ID NO: 2199367 - DNA, 17 bp, Homo sapiens
caaaaacttttttggaa

SEQ ID NO: 2199368 - DNA, 19 bp, Homo sapiens
caaaaagaaagctgtgaaa

SEQ ID NO: 2199369 - DNA, 19 bp, Homo sapiens
caaaaatcattaacacttt

SEQ ID NO: 2199370 - DNA, 17 bp, Homo sapiens
caaaaattcacaagctg

SEQ ID NO: 2199371 - DNA, 20 bp, Homo sapiens
caaaagaagcctagaaaaga

SEQ ID NO: 2199372 - DNA, 13 bp, Homo sapiens
caaaagcctctca

SEQ ID NO: 2199373 - DNA, 15 bp, Homo sapiens
caaaaggagaagagg

SEQ ID NO: 2199374 - DNA, 15 bp, Homo sapiens
caaaagtaccataga

SEQ ID NO: 2199375 - DNA, 15 bp, Homo sapiens
caaaagtatattcaa

SEQ ID NO: 2199376 - DNA, 13 bp, Homo sapiens
caaaagtgctttg

SEQ ID NO: 2199377 - DNA, 14 bp, Homo sapiens
caaaagtgctttgg

SEQ ID NO: 2199378 - DNA, 15 bp, Homo sapiens
caaaagtgctttgga

SEQ ID NO: 2199379 - DNA, 18 bp, Homo sapiens
caaaataagccatgctgc

SEQ ID NO: 2199380 - DNA, 12 bp, Homo sapiens
caaaatcccctt

SEQ ID NO: 2199381 - DNA, 21 bp, Homo sapiens
caaaatctgtagagcagggca

SEQ ID NO: 2199382 - DNA, 18 bp, Homo sapiens
caaaatgttaataaaggt

SEQ ID NO: 2199383 - DNA, 19 bp, Homo sapiens
caaacaattcaatcaaagc

SEQ ID NO: 2199384 - DNA, 14 bp, Homo sapiens
caaacactgtgatt

SEQ ID NO: 2199385 - DNA, 19 bp, Homo sapiens
caaaccacgcctcttgacc

SEQ ID NO: 2199386 - DNA, 15 bp, Homo sapiens
caaaccactgtacat

SEQ ID NO: 2199387 - DNA, 17 bp, Homo sapiens
caaaccactgtacatat

SEQ ID NO: 2199388 - DNA, 13 bp, Homo sapiens
caaaccaggagca

SEQ ID NO: 2199389 - DNA, 20 bp, Homo sapiens
caaacctagccccttagccc

SEQ ID NO: 2199390 - DNA, 15 bp, Homo sapiens
caaacctctccttcc

SEQ ID NO: 2199391 - DNA, 16 bp, Homo sapiens
caaacctctccttcct

SEQ ID NO: 2199392 - DNA, 14 bp, Homo sapiens
caaactcagcctca

SEQ ID NO: 2199393 - DNA, 16 bp, Homo sapiens
caaactcatccattaa

SEQ ID NO: 2199394 - DNA, 21 bp, Homo sapiens
caaactgtgggtattgttaat

SEQ ID NO: 2199395 - DNA, 21 bp, Homo sapiens
caaagaacccatttgccatgc

SEQ ID NO: 2199396 - DNA, 14 bp, Homo sapiens
caaagaatgccttg

SEQ ID NO: 2199397 - DNA, 17 bp, Homo sapiens
caaagaccaatgtgaag

SEQ ID NO: 2199398 - DNA, 13 bp, Homo sapiens
caaagagctgcct

SEQ ID NO: 2199399 - DNA, 14 bp, Homo sapiens
caaagagctgccta

SEQ ID NO: 2199400 - DNA, 18 bp, Homo sapiens
caaagctgacgaggctgg

SEQ ID NO: 2199401 - DNA, 17 bp, Homo sapiens
caaagctttcctggaga

SEQ ID NO: 2199402 - DNA, 14 bp, Homo sapiens
caaagcttttgtaa

SEQ ID NO: 2199403 - DNA, 23 bp, Homo sapiens
caaaggaagctttctctgcttca

SEQ ID NO: 2199404 - DNA, 18 bp, Homo sapiens
caaaggagcgagcatgtc

SEQ ID NO: 2199405 - DNA, 16 bp, Homo sapiens
caaaggtgattttcct

SEQ ID NO: 2199406 - DNA, 16 bp, Homo sapiens
caaagtcatgaagctc

SEQ ID NO: 2199407 - DNA, 12 bp, Homo sapiens
caaagtgcaaag

SEQ ID NO: 2199408 - DNA, 15 bp, Homo sapiens
caaagtgcaaagctg

SEQ ID NO: 2199409 - DNA, 18 bp, Homo sapiens
caaagtgcaaagctgctt

SEQ ID NO: 2199410 - DNA, 12 bp, Homo sapiens
cactgccctctg

SEQ ID NO: 2199411 - DNA, 21 bp, Homo sapiens
cactgcgaactctcaggacta

SEQ ID NO: 2199412 - DNA, 18 bp, Homo sapiens
cactggatccagaagcta

SEQ ID NO: 2199413 - DNA, 23 bp, Homo sapiens
cactggcaggatcacagctcacg

SEQ ID NO: 2199414 - DNA, 18 bp, Homo sapiens
cactggcatctctggagt

SEQ ID NO: 2199415 - DNA, 19 bp, Homo sapiens
cactggcatctctggagtg

SEQ ID NO: 2199416 - DNA, 17 bp, Homo sapiens
cactggggagtgctgga

SEQ ID NO: 2199417 - DNA, 14 bp, Homo sapiens
cactgtcttcttca

SEQ ID NO: 2199418 - DNA, 22 bp, Homo sapiens
cactgtgattactctttgcttt

SEQ ID NO: 2199419 - DNA, 23 bp, Homo sapiens
cactgtgcccagcagtttcccag

SEQ ID NO: 2199420 - DNA, 20 bp, Homo sapiens
cacttagtgaggacctgaca

SEQ ID NO: 2199421 - DNA, 12 bp, Homo sapiens
cacttatttcta

SEQ ID NO: 2199422 - DNA, 19 bp, Homo sapiens
cacttcactaaagtgtcat

SEQ ID NO: 2199423 - DNA, 13 bp, Homo sapiens
cacttccctgggc

SEQ ID NO: 2199424 - DNA, 23 bp, Homo sapiens
cacttgaaacttggttcccagaa

SEQ ID NO: 2199425 - DNA, 14 bp, Homo sapiens
cactttgcagacct

SEQ ID NO: 2199426 - DNA, 13 bp, Homo sapiens
cactttggggaac

SEQ ID NO: 2199427 - DNA, 17 bp, Homo sapiens
cagaaagcagaggctgg

SEQ ID NO: 2199428 - DNA, 20 bp, Homo sapiens
cagaaatgccaaaaatgtgc

SEQ ID NO: 2199429 - DNA, 12 bp, Homo sapiens
cagaaattgtat

SEQ ID NO: 2199430 - DNA, 18 bp, Homo sapiens
cagaaattgtatattgta

SEQ ID NO: 2199431 - DNA, 16 bp, Homo sapiens
cagaacattcagctct

SEQ ID NO: 2199432 - DNA, 20 bp, Homo sapiens
cagaacattcagctctggag

SEQ ID NO: 2199433 - DNA, 13 bp, Homo sapiens
cagaacctggtgg

SEQ ID NO: 2199434 - DNA, 17 bp, Homo sapiens
cagaactgctaaatact

SEQ ID NO: 2199435 - DNA, 23 bp, Homo sapiens
cagaaggaaagaagggggccctg

SEQ ID NO: 2199436 - DNA, 21 bp, Homo sapiens
cagaagtagtggtttgctttg

SEQ ID NO: 2199437 - DNA, 16 bp, Homo sapiens
cagaagttagtttgta

SEQ ID NO: 2199438 - DNA, 19 bp, Homo sapiens
cagaagttagtttgtatat

SEQ ID NO: 2199439 - DNA, 18 bp, Homo sapiens
cagaagttgttagtgatt

SEQ ID NO: 2199440 - DNA, 16 bp, Homo sapiens
cagaataaagaacatt

SEQ ID NO: 2199441 - DNA, 17 bp, Homo sapiens
cagaattattcatagct

SEQ ID NO: 2199442 - DNA, 12 bp, Homo sapiens
cagaattcacta

SEQ ID NO: 2199443 - DNA, 17 bp, Homo sapiens
cagaattgaagaaaatc

SEQ ID NO: 2199444 - DNA, 15 bp, Homo sapiens
cagacaagcagccct

SEQ ID NO: 2199445 - DNA, 20 bp, Homo sapiens
cagacaagcagcccttgctt

SEQ ID NO: 2199446 - DNA, 17 bp, Homo sapiens
cagacagtttatgagaa

SEQ ID NO: 2199447 - DNA, 12 bp, Homo sapiens
cagaccagagct

SEQ ID NO: 2199448 - DNA, 15 bp, Homo sapiens
cagaccagagctctg

SEQ ID NO: 2199449 - DNA, 17 bp, Homo sapiens
cagaccagagctctgga

SEQ ID NO: 2199450 - DNA, 12 bp, Homo sapiens
cagacccctggg

SEQ ID NO: 2199451 - DNA, 16 bp, Homo sapiens
cagacccctgggagct

SEQ ID NO: 2199452 - DNA, 19 bp, Homo sapiens
cagacccctgggagcttcc

SEQ ID NO: 2199453 - DNA, 20 bp, Homo sapiens
cagactcatacagaaggtgg

SEQ ID NO: 2199454 - DNA, 17 bp, Homo sapiens
cagagaactagtggtgg

SEQ ID NO: 2199455 - DNA, 24 bp, Homo sapiens
cagagacagctgtttgaattggac

SEQ ID NO: 2199456 - DNA, 18 bp, Homo sapiens
cagagactggggcctgga

SEQ ID NO: 2199457 - DNA, 15 bp, Homo sapiens
cagagaggttgtgaa

SEQ ID NO: 2199458 - DNA, 16 bp, Homo sapiens
cagagcaaagggccag

SEQ ID NO: 2199459 - DNA, 15 bp, Homo sapiens
cagagccgttcctgg

SEQ ID NO: 2199460 - DNA, 16 bp, Homo sapiens
cagagccgttcctggg

SEQ ID NO: 2199461 - DNA, 19 bp, Homo sapiens
cagagctctggagccacct

SEQ ID NO: 2199462 - DNA, 12 bp, Homo sapiens
cagagctggggg

SEQ ID NO: 2199463 - DNA, 16 bp, Homo sapiens
cagagctggggggaag

SEQ ID NO: 2199464 - DNA, 13 bp, Homo sapiens
cagagctgggtga

SEQ ID NO: 2199465 - DNA, 15 bp, Homo sapiens
cagaggattctgtct

SEQ ID NO: 2199466 - DNA, 17 bp, Homo sapiens
cagaggcagaaccctgg

SEQ ID NO: 2199467 - DNA, 14 bp, Homo sapiens
cagaggcagtggca

SEQ ID NO: 2199468 - DNA, 22 bp, Homo sapiens
cagaggccacactttctgggaa

SEQ ID NO: 2199469 - DNA, 15 bp, Homo sapiens
cagaggccctggagg

SEQ ID NO: 2199470 - DNA, 16 bp, Homo sapiens
cagaggccctggaggt

SEQ ID NO: 2199471 - DNA, 15 bp, Homo sapiens
cagaggctcctggag

SEQ ID NO: 2199472 - DNA, 17 bp, Homo sapiens
cagaggctcctggagcc

SEQ ID NO: 2199473 - DNA, 17 bp, Homo sapiens
cagaggggagaggaagc

SEQ ID NO: 2199474 - DNA, 20 bp, Homo sapiens
cagaggtgggaggcccctgg

SEQ ID NO: 2199475 - DNA, 22 bp, Homo sapiens
cagaggtggggaagagagcctg

SEQ ID NO: 2199476 - DNA, 14 bp, Homo sapiens
cagagtctggctct

SEQ ID NO: 2199477 - DNA, 17 bp, Homo sapiens
cagagtgccccacctgc

SEQ ID NO: 2199478 - DNA, 18 bp, Homo sapiens
cagagtgccccacctgcc

SEQ ID NO: 2199479 - DNA, 19 bp, Homo sapiens
cagagtgccccacctgcca

SEQ ID NO: 2199480 - DNA, 20 bp, Homo sapiens
cagagtgccccacctgccac

SEQ ID NO: 2199481 - DNA, 23 bp, Homo sapiens
cagagtgccccacctgccactag

SEQ ID NO: 2199482 - DNA, 16 bp, Homo sapiens
cagagtggagccctca

SEQ ID NO: 2199483 - DNA, 18 bp, Homo sapiens
cagagtggattaaaggca

SEQ ID NO: 2199484 - DNA, 18 bp, Homo sapiens
cagagtgggccccgggct

SEQ ID NO: 2199485 - DNA, 23 bp, Homo sapiens
cagagtgggccccgggctggaga

SEQ ID NO: 2199486 - DNA, 17 bp, Homo sapiens
cagataatcggtgcagc

SEQ ID NO: 2199487 - DNA, 18 bp, Homo sapiens
cagatacatacatagaga

SEQ ID NO: 2199488 - DNA, 14 bp, Homo sapiens
cagatcctgctgcc

SEQ ID NO: 2199489 - DNA, 18 bp, Homo sapiens
cagatcggatctgttgca

SEQ ID NO: 2199490 - DNA, 13 bp, Homo sapiens
cagatgccagagc

SEQ ID NO: 2199491 - DNA, 18 bp, Homo sapiens
cagatgcctcctctgtcc

SEQ ID NO: 2199492 - DNA, 15 bp, Homo sapiens
cagatgccttctaga

SEQ ID NO: 2199493 - DNA, 16 bp, Homo sapiens
cagatgccttctagat

SEQ ID NO: 2199494 - DNA, 22 bp, Homo sapiens
cagatgccttctagattcactg

SEQ ID NO: 2199495 - DNA, 16 bp, Homo sapiens
cagatggctgtgaaaa

SEQ ID NO: 2199496 - DNA, 15 bp, Homo sapiens
cagattaaatgaata

SEQ ID NO: 2199497 - DNA, 18 bp, Homo sapiens
cagcaatgcaatgtggaa

SEQ ID NO: 2199498 - DNA, 19 bp, Homo sapiens
cagcacatgcactactgaa

SEQ ID NO: 2199499 - DNA, 17 bp, Homo sapiens
cagcacctcctctctgc

SEQ ID NO: 2199500 - DNA, 20 bp, Homo sapiens
cagcacctcctctctgctgg

SEQ ID NO: 2199501 - DNA, 20 bp, Homo sapiens
cagcaccttaaaaattagaa

SEQ ID NO: 2199502 - DNA, 22 bp, Homo sapiens
cagcactgaccccgacctcaga

SEQ ID NO: 2199503 - DNA, 23 bp, Homo sapiens
cagcagcaatgcaatgtggaaat

SEQ ID NO: 2199504 - DNA, 20 bp, Homo sapiens
cagcagctccgcctggcacc

SEQ ID NO: 2199505 - DNA, 15 bp, Homo sapiens
cagcagcttgctgca

SEQ ID NO: 2199506 - DNA, 15 bp, Homo sapiens
cagcagtgtttaaaa

SEQ ID NO: 2199507 - DNA, 16 bp, Homo sapiens
cagcatgactggacag

SEQ ID NO: 2199508 - DNA, 12 bp, Homo sapiens
cagcatgtacaa

SEQ ID NO: 2199509 - DNA, 13 bp, Homo sapiens
cagcatgtacaaa

SEQ ID NO: 2199510 - DNA, 14 bp, Homo sapiens
cagcatgtacaaaa

SEQ ID NO: 2199511 - DNA, 14 bp, Homo sapiens
cagcatttcctcag

SEQ ID NO: 2199512 - DNA, 20 bp, Homo sapiens
cagcatttcctcagtctccc

SEQ ID NO: 2199513 - DNA, 14 bp, Homo sapiens
cagcattttgctgc

SEQ ID NO: 2199514 - DNA, 20 bp, Homo sapiens
cagccacagacccctgggag

SEQ ID NO: 2199515 - DNA, 21 bp, Homo sapiens
cagccacagacccctgggagc

SEQ ID NO: 2199516 - DNA, 17 bp, Homo sapiens
cagccagaaccccgagc

SEQ ID NO: 2199517 - DNA, 22 bp, Homo sapiens
cagccagaaccccgagccctac

SEQ ID NO: 2199518 - DNA, 16 bp, Homo sapiens
cagccagtaaggcagc

SEQ ID NO: 2199519 - DNA, 17 bp, Homo sapiens
cagccatcccagccttg

SEQ ID NO: 2199520 - DNA, 23 bp, Homo sapiens
cagccatgagaacaaaacctctt

SEQ ID NO: 2199521 - DNA, 13 bp, Homo sapiens
cagcccagctgct

SEQ ID NO: 2199522 - DNA, 20 bp, Homo sapiens
cagcccagctgctctgccca

SEQ ID NO: 2199523 - DNA, 16 bp, Homo sapiens
cagcccatcttgcctc

SEQ ID NO: 2199524 - DNA, 21 bp, Homo sapiens
cagcccccggttggagcctgc

SEQ ID NO: 2199525 - DNA, 19 bp, Homo sapiens
cagcccgcatgcagcagct

SEQ ID NO: 2199526 - DNA, 17 bp, Homo sapiens
cagccctaggctaccct

SEQ ID NO: 2199527 - DNA, 13 bp, Homo sapiens
cagccctgagctg

SEQ ID NO: 2199528 - DNA, 14 bp, Homo sapiens
cagccctggagtca

SEQ ID NO: 2199529 - DNA, 20 bp, Homo sapiens
cagccgaattgtggtgtctt

SEQ ID NO: 2199530 - DNA, 21 bp, Homo sapiens
cagccgagatcggggtggcag

SEQ ID NO: 2199531 - DNA, 14 bp, Homo sapiens
cagccgccacatcc

SEQ ID NO: 2199532 - DNA, 21 bp, Homo sapiens
ccaccccttggaggagagaga

SEQ ID NO: 2199533 - DNA, 23 bp, Homo sapiens
ccaccccttggaggagagagacc

SEQ ID NO: 2199534 - DNA, 15 bp, Homo sapiens
ccacccgtttccaag

SEQ ID NO: 2199535 - DNA, 17 bp, Homo sapiens
ccaccctaactgagctg

SEQ ID NO: 2199536 - DNA, 20 bp, Homo sapiens
ccaccctaactgagctgcca

SEQ ID NO: 2199537 - DNA, 21 bp, Homo sapiens
ccaccctaactgagctgccag

SEQ ID NO: 2199538 - DNA, 12 bp, Homo sapiens
ccaccctctgca

SEQ ID NO: 2199539 - DNA, 20 bp, Homo sapiens
ccaccggttgcttctgggaa

SEQ ID NO: 2199540 - DNA, 17 bp, Homo sapiens
ccacctccttctctgtc

SEQ ID NO: 2199541 - DNA, 18 bp, Homo sapiens
ccacctccttctctgtct

SEQ ID NO: 2199542 - DNA, 14 bp, Homo sapiens
ccacctgcatcagc

SEQ ID NO: 2199543 - DNA, 17 bp, Homo sapiens
ccacctgtcccacctca

SEQ ID NO: 2199544 - DNA, 21 bp, Homo sapiens
ccaccttaccctactggctgt

SEQ ID NO: 2199545 - DNA, 18 bp, Homo sapiens
ccacctttctgaatggaa

SEQ ID NO: 2199546 - DNA, 18 bp, Homo sapiens
ccacgcctcttgaccagg

SEQ ID NO: 2199547 - DNA, 19 bp, Homo sapiens
ccacgcctcttgaccaggc

SEQ ID NO: 2199548 - DNA, 13 bp, Homo sapiens
ccacggccactgc

SEQ ID NO: 2199549 - DNA, 17 bp, Homo sapiens
ccacggccactgcagtc

SEQ ID NO: 2199550 - DNA, 15 bp, Homo sapiens
ccacggcctggctgg

SEQ ID NO: 2199551 - DNA, 23 bp, Homo sapiens
ccacggcctggctggtgggaagg

SEQ ID NO: 2199552 - DNA, 20 bp, Homo sapiens
ccactaactagagcagccct

SEQ ID NO: 2199553 - DNA, 15 bp, Homo sapiens
ccactaggctgggtg

SEQ ID NO: 2199554 - DNA, 20 bp, Homo sapiens
ccactaggctgggtgcccac

SEQ ID NO: 2199555 - DNA, 21 bp, Homo sapiens
ccactaggctgggtgcccaca

SEQ ID NO: 2199556 - DNA, 23 bp, Homo sapiens
ccactaggctgggtgcccacagc

SEQ ID NO: 2199557 - DNA, 22 bp, Homo sapiens
ccactccggattccggccctgg

SEQ ID NO: 2199558 - DNA, 22 bp, Homo sapiens
ccactctgtgcctgaccttgag

SEQ ID NO: 2199559 - DNA, 12 bp, Homo sapiens
ccactgtacata

SEQ ID NO: 2199560 - DNA, 14 bp, Homo sapiens
ccactgtcttcttc

SEQ ID NO: 2199561 - DNA, 15 bp, Homo sapiens
ccactgtctttaaaa

SEQ ID NO: 2199562 - DNA, 14 bp, Homo sapiens
ccactgtgcccagc

SEQ ID NO: 2199563 - DNA, 18 bp, Homo sapiens
ccacttagtcgtcttttt

SEQ ID NO: 2199564 - DNA, 23 bp, Homo sapiens
ccacttccccctcttcttctgaa

SEQ ID NO: 2199565 - DNA, 18 bp, Homo sapiens
ccactttgcagacctggg

SEQ ID NO: 2199566 - DNA, 19 bp, Homo sapiens
ccactttgcagacctggga

SEQ ID NO: 2199567 - DNA, 13 bp, Homo sapiens
ccactttggggaa

SEQ ID NO: 2199568 - DNA, 13 bp, Homo sapiens
ccagaattcacta

SEQ ID NO: 2199569 - DNA, 16 bp, Homo sapiens
ccagaattctggacaa

SEQ ID NO: 2199570 - DNA, 13 bp, Homo sapiens
ccagaccagagct

SEQ ID NO: 2199571 - DNA, 12 bp, Homo sapiens
ccagagctctgg

SEQ ID NO: 2199572 - DNA, 21 bp, Homo sapiens
ccagagctctggagccacctg

SEQ ID NO: 2199573 - DNA, 14 bp, Homo sapiens
ccagagctgggtga

SEQ ID NO: 2199574 - DNA, 14 bp, Homo sapiens
ccagaggcacagcc

SEQ ID NO: 2199575 - DNA, 13 bp, Homo sapiens
ccagaggccctgg

SEQ ID NO: 2199576 - DNA, 13 bp, Homo sapiens
ccagaggctcctg

SEQ ID NO: 2199577 - DNA, 17 bp, Homo sapiens
ccagaggctcctggagc

SEQ ID NO: 2199578 - DNA, 14 bp, Homo sapiens
ccagaggtgggagg

SEQ ID NO: 2199579 - DNA, 21 bp, Homo sapiens
ccagaggtgggaggcccctgg

SEQ ID NO: 2199580 - DNA, 18 bp, Homo sapiens
ccagaggtggggaagaga

SEQ ID NO: 2199581 - DNA, 22 bp, Homo sapiens
ccagaggtggggaagagagcct

SEQ ID NO: 2199582 - DNA, 24 bp, Homo sapiens
ccagaggtggggaagagagcctgc

SEQ ID NO: 2199583 - DNA, 15 bp, Homo sapiens
ccagatcaaaattgt

SEQ ID NO: 2199584 - DNA, 22 bp, Homo sapiens
ccagatcggatctgttgcaaac

SEQ ID NO: 2199585 - DNA, 23 bp, Homo sapiens
ccagatgcctcctctgtcctcat

SEQ ID NO: 2199586 - DNA, 12 bp, Homo sapiens
ccagcagagccg

SEQ ID NO: 2199587 - DNA, 21 bp, Homo sapiens
ccagcagagccgttcctggga

SEQ ID NO: 2199588 - DNA, 12 bp, Homo sapiens
ccagcagcagaa

SEQ ID NO: 2199589 - DNA, 13 bp, Homo sapiens
ccagcatgtacaa

SEQ ID NO: 2199590 - DNA, 16 bp, Homo sapiens
ccagcatttcctcagt

SEQ ID NO: 2199591 - DNA, 12 bp, Homo sapiens
ccagccacagac

SEQ ID NO: 2199592 - DNA, 17 bp, Homo sapiens
ccagccacagacccctg

SEQ ID NO: 2199593 - DNA, 22 bp, Homo sapiens
ccagccaccctaactgagctgc

SEQ ID NO: 2199594 - DNA, 23 bp, Homo sapiens
ccagccaccctaactgagctgcc

SEQ ID NO: 2199595 - DNA, 16 bp, Homo sapiens
ccagccacttccccct

SEQ ID NO: 2199596 - DNA, 12 bp, Homo sapiens
ccagcccagctg

SEQ ID NO: 2199597 - DNA, 14 bp, Homo sapiens
ccagcccagctgct

SEQ ID NO: 2199598 - DNA, 17 bp, Homo sapiens
ccagcccagctgctctg

SEQ ID NO: 2199599 - DNA, 22 bp, Homo sapiens
ccagcccagctgctctgcccag

SEQ ID NO: 2199600 - DNA, 16 bp, Homo sapiens
ccagccccatcaggac

SEQ ID NO: 2199601 - DNA, 13 bp, Homo sapiens
ccagccctaggct

SEQ ID NO: 2199602 - DNA, 17 bp, Homo sapiens
ccagcctctagggaccc

SEQ ID NO: 2199603 - DNA, 16 bp, Homo sapiens
ccagctaaagaggtgg

SEQ ID NO: 2199604 - DNA, 17 bp, Homo sapiens
ccagctcagtcttccct

SEQ ID NO: 2199605 - DNA, 16 bp, Homo sapiens
ccagctgaaggcagtg

SEQ ID NO: 2199606 - DNA, 22 bp, Homo sapiens
ccagctgaaggcagtggcaggg

SEQ ID NO: 2199607 - DNA, 17 bp, Homo sapiens
ccagctgctcctcgcag

SEQ ID NO: 2199608 - DNA, 19 bp, Homo sapiens
ccagctgctctgcccagag

SEQ ID NO: 2199609 - DNA, 20 bp, Homo sapiens
ccagctgctctgcccagagc

SEQ ID NO: 2199610 - DNA, 18 bp, Homo sapiens
ccaggaacagcaaatgca

SEQ ID NO: 2199611 - DNA, 16 bp, Homo sapiens
ccaggaagccgtcctg

SEQ ID NO: 2199612 - DNA, 22 bp, Homo sapiens
ccaggaagccgtcctggcgcct

SEQ ID NO: 2199613 - DNA, 21 bp, Homo sapiens
ccaggaaggggcggggagaag

SEQ ID NO: 2199614 - DNA, 16 bp, Homo sapiens
ccaggaaggggctgga

SEQ ID NO: 2199615 - DNA, 12 bp, Homo sapiens
ccaggacagctg

SEQ ID NO: 2199616 - DNA, 23 bp, Homo sapiens
ccaggacttaagacaaatgggac

SEQ ID NO: 2199617 - DNA, 18 bp, Homo sapiens
ccaggagcatccacctcc

SEQ ID NO: 2199618 - DNA, 20 bp, Homo sapiens
ccaggagcatccacctcctt

SEQ ID NO: 2199619 - DNA, 21 bp, Homo sapiens
ccaggcccagtccactgggga

SEQ ID NO: 2199620 - DNA, 13 bp, Homo sapiens
ccaggctgcctcc

SEQ ID NO: 2199621 - DNA, 23 bp, Homo sapiens
ccaggctgcctcccttgtggcag

SEQ ID NO: 2199622 - DNA, 21 bp, Homo sapiens
ccaggctggagtgatctcagc

SEQ ID NO: 2199623 - DNA, 19 bp, Homo sapiens
ccaggctggtctcaaactc

SEQ ID NO: 2199624 - DNA, 17 bp, Homo sapiens
ccaggctggtcttgaac

SEQ ID NO: 2199625 - DNA, 17 bp, Homo sapiens
ccagggatggggccaca

SEQ ID NO: 2199626 - DNA, 20 bp, Homo sapiens
ccagggatggggccacagcc

SEQ ID NO: 2199627 - DNA, 21 bp, Homo sapiens
ccagggatggggccacagcca

SEQ ID NO: 2199628 - DNA, 15 bp, Homo sapiens
ccagggcaccaagcc

SEQ ID NO: 2199629 - DNA, 13 bp, Homo sapiens
ccagggcagcagc

SEQ ID NO: 2199630 - DNA, 14 bp, Homo sapiens
ccagggcagcagcc

SEQ ID NO: 2199631 - DNA, 14 bp, Homo sapiens
ccaggggcctgcag

SEQ ID NO: 2199632 - DNA, 20 bp, Homo sapiens
ccaggggcctgcagaaggaa

SEQ ID NO: 2199633 - DNA, 18 bp, Homo sapiens
ccagggggccctctgcct

SEQ ID NO: 2199634 - DNA, 21 bp, Homo sapiens
ccagggtaggcaaggctgccg

SEQ ID NO: 2199635 - DNA, 14 bp, Homo sapiens
ccaggtcgggctca

SEQ ID NO: 2199636 - DNA, 20 bp, Homo sapiens
ccaggtcgggctcagctctg

SEQ ID NO: 2199637 - DNA, 23 bp, Homo sapiens
ccaggtcgggctcagctctggct

SEQ ID NO: 2199638 - DNA, 21 bp, Homo sapiens
ccaggttctggttagctcagc

SEQ ID NO: 2199639 - DNA, 22 bp, Homo sapiens
ccaggttctggttagctcagcc

SEQ ID NO: 2199640 - DNA, 23 bp, Homo sapiens
ccaggttctggttagctcagccc

SEQ ID NO: 2199641 - DNA, 16 bp, Homo sapiens
ccaggttggaggccct

SEQ ID NO: 2199642 - DNA, 21 bp, Homo sapiens
ccaggttggaggccctaggcg

SEQ ID NO: 2199643 - DNA, 13 bp, Homo sapiens
ccagtcacagtgg

SEQ ID NO: 2199644 - DNA, 16 bp, Homo sapiens
ccagtccactggggag

SEQ ID NO: 2199645 - DNA, 14 bp, Homo sapiens
ccagtgatggcatt

SEQ ID NO: 2199646 - DNA, 18 bp, Homo sapiens
ccagtgatggcattactc

SEQ ID NO: 2199647 - DNA, 14 bp, Homo sapiens
ccagtggcctggct

SEQ ID NO: 2199648 - DNA, 14 bp, Homo sapiens
ccagttctgatgag

SEQ ID NO: 2199649 - DNA, 11 bp, Homo sapiens
ccagtttctta

SEQ ID NO: 2199650 - DNA, 11 bp, Homo sapiens
ccagtttcttt

SEQ ID NO: 2199651 - DNA, 20 bp, Homo sapiens
ccagtttcttttcttttgtt

SEQ ID NO: 2199652 - DNA, 18 bp, Homo sapiens
ccatactctgtctcccta

SEQ ID NO: 2199653 - DNA, 20 bp, Homo sapiens
ccatagctggtttttcccac

SEQ ID NO: 2199654 - DNA, 21 bp, Homo sapiens
cctggcagtccgtgggacggg

SEQ ID NO: 2199655 - DNA, 15 bp, Homo sapiens
cctggccaccacccc

SEQ ID NO: 2199656 - DNA, 15 bp, Homo sapiens
cctggcctggcaccg

SEQ ID NO: 2199657 - DNA, 21 bp, Homo sapiens
cctggcgtggggggagctctg

SEQ ID NO: 2199658 - DNA, 22 bp, Homo sapiens
cctggcgtggggggagctctgg

SEQ ID NO: 2199659 - DNA, 22 bp, Homo sapiens
cctggctggtaagggccaagtc

SEQ ID NO: 2199660 - DNA, 15 bp, Homo sapiens
cctggcttgaacctt

SEQ ID NO: 2199661 - DNA, 17 bp, Homo sapiens
cctggctttgcccaacc

SEQ ID NO: 2199662 - DNA, 18 bp, Homo sapiens
cctggctttgcccaacct

SEQ ID NO: 2199663 - DNA, 20 bp, Homo sapiens
cctggctttgcccaacctca

SEQ ID NO: 2199664 - DNA, 23 bp, Homo sapiens
cctggctttgcccaacctcagca

SEQ ID NO: 2199665 - DNA, 17 bp, Homo sapiens
cctgggccactggcatc

SEQ ID NO: 2199666 - DNA, 19 bp, Homo sapiens
cctgggccactggcatctc

SEQ ID NO: 2199667 - DNA, 21 bp, Homo sapiens
cctggggatgtaaccaagctg

SEQ ID NO: 2199668 - DNA, 22 bp, Homo sapiens
cctggggatgtaaccaagctgt

SEQ ID NO: 2199669 - DNA, 21 bp, Homo sapiens
cctgggggcttttgccactcc

SEQ ID NO: 2199670 - DNA, 15 bp, Homo sapiens
cctgggttccccacc

SEQ ID NO: 2199671 - DNA, 17 bp, Homo sapiens
cctggtggctggaggca

SEQ ID NO: 2199672 - DNA, 21 bp, Homo sapiens
cctggtggctggaggcattcc

SEQ ID NO: 2199673 - DNA, 10 bp, Homo sapiens
cctgtatgga

SEQ ID NO: 2199674 - DNA, 19 bp, Homo sapiens
cctgtatggagctagagag

SEQ ID NO: 2199675 - DNA, 17 bp, Homo sapiens
cctgtcaatgtttgctt

SEQ ID NO: 2199676 - DNA, 17 bp, Homo sapiens
cctgtccctggccatct

SEQ ID NO: 2199677 - DNA, 17 bp, Homo sapiens
cctgtcctcccacccct

SEQ ID NO: 2199678 - DNA, 10 bp, Homo sapiens
cctgtccttc

SEQ ID NO: 2199679 - DNA, 18 bp, Homo sapiens
cctgtccttcccacggcc

SEQ ID NO: 2199680 - DNA, 22 bp, Homo sapiens
cctgtctaggtcagtacccacc

SEQ ID NO: 2199681 - DNA, 14 bp, Homo sapiens
cctgtctcccctct

SEQ ID NO: 2199682 - DNA, 20 bp, Homo sapiens
cctgtctcccctctgctggc

SEQ ID NO: 2199683 - DNA, 19 bp, Homo sapiens
cctgtcttcagatcctgct

SEQ ID NO: 2199684 - DNA, 20 bp, Homo sapiens
cctgtcttcagatcctgctg

SEQ ID NO: 2199685 - DNA, 23 bp, Homo sapiens
cctgtcttcagatcctgctgccg

SEQ ID NO: 2199686 - DNA, 19 bp, Homo sapiens
cctgtgcagggccctctgg

SEQ ID NO: 2199687 - DNA, 15 bp, Homo sapiens
cctgtgcgtcccagc

SEQ ID NO: 2199688 - DNA, 16 bp, Homo sapiens
cctgtgcgtcccagct

SEQ ID NO: 2199689 - DNA, 22 bp, Homo sapiens
cctgttcaaaatgttaataaag

SEQ ID NO: 2199690 - DNA, 13 bp, Homo sapiens
cctgttgttactg

SEQ ID NO: 2199691 - DNA, 18 bp, Homo sapiens
cctgtttacggtacttgg

SEQ ID NO: 2199692 - DNA, 19 bp, Homo sapiens
cctgttttattgagttctg

SEQ ID NO: 2199693 - DNA, 13 bp, Homo sapiens
ccttaaaaataac

SEQ ID NO: 2199694 - DNA, 16 bp, Homo sapiens
ccttaccctactggct

SEQ ID NO: 2199695 - DNA, 19 bp, Homo sapiens
ccttaccctactggctgta

SEQ ID NO: 2199696 - DNA, 15 bp, Homo sapiens
ccttagcccccaccc

SEQ ID NO: 2199697 - DNA, 21 bp, Homo sapiens
ccttagcccccacccacttcc

SEQ ID NO: 2199698 - DNA, 21 bp, Homo sapiens
ccttagtttgaaacagattct

SEQ ID NO: 2199699 - DNA, 19 bp, Homo sapiens
ccttatcctacagtacaat

SEQ ID NO: 2199700 - DNA, 15 bp, Homo sapiens
ccttatctgttcctt

SEQ ID NO: 2199701 - DNA, 16 bp, Homo sapiens
ccttatgtaattattt

SEQ ID NO: 2199702 - DNA, 18 bp, Homo sapiens
ccttatttttatttattt

SEQ ID NO: 2199703 - DNA, 12 bp, Homo sapiens
ccttcaaagctg

SEQ ID NO: 2199704 - DNA, 13 bp, Homo sapiens
ccttcaaagctga

SEQ ID NO: 2199705 - DNA, 18 bp, Homo sapiens
ccttcaaatcctgccact

SEQ ID NO: 2199706 - DNA, 18 bp, Homo sapiens
ccttcaagaccttcacca

SEQ ID NO: 2199707 - DNA, 22 bp, Homo sapiens
ccttcaagaccttcaccaaaca

SEQ ID NO: 2199708 - DNA, 15 bp, Homo sapiens
ccttccaggccatca

SEQ ID NO: 2199709 - DNA, 17 bp, Homo sapiens
ccttcccacggccactg

SEQ ID NO: 2199710 - DNA, 19 bp, Homo sapiens
ccttcccacggccactgca

SEQ ID NO: 2199711 - DNA, 20 bp, Homo sapiens
ccttcccacggccactgcag

SEQ ID NO: 2199712 - DNA, 13 bp, Homo sapiens
ccttccctggtcc

SEQ ID NO: 2199713 - DNA, 14 bp, Homo sapiens
ccttccctggtcca

SEQ ID NO: 2199714 - DNA, 12 bp, Homo sapiens
ccttcctgtccg

SEQ ID NO: 2199715 - DNA, 12 bp, Homo sapiens
ccttcctgtctg

SEQ ID NO: 2199716 - DNA, 17 bp, Homo sapiens
ccttcctgtctggccca

SEQ ID NO: 2199717 - DNA, 12 bp, Homo sapiens
ccttcctgtctt

SEQ ID NO: 2199718 - DNA, 13 bp, Homo sapiens
ccttcctgtcttc

SEQ ID NO: 2199719 - DNA, 23 bp, Homo sapiens
ccttctcctcttgtagccagaat

SEQ ID NO: 2199720 - DNA, 19 bp, Homo sapiens
ccttctccttccaactgct

SEQ ID NO: 2199721 - DNA, 19 bp, Homo sapiens
ccttctctgtctcatgtgt

SEQ ID NO: 2199722 - DNA, 14 bp, Homo sapiens
ccttctgtgcccag

SEQ ID NO: 2199723 - DNA, 15 bp, Homo sapiens
ccttctgtgcccagc

SEQ ID NO: 2199724 - DNA, 17 bp, Homo sapiens
ccttctgtgcccagctc

SEQ ID NO: 2199725 - DNA, 18 bp, Homo sapiens
ccttctgtgcccagctca

SEQ ID NO: 2199726 - DNA, 19 bp, Homo sapiens
ccttctgtgcccagctcag

SEQ ID NO: 2199727 - DNA, 20 bp, Homo sapiens
ccttctgtgcccagctcagt

SEQ ID NO: 2199728 - DNA, 18 bp, Homo sapiens
ccttcttccacagcaaat

SEQ ID NO: 2199729 - DNA, 18 bp, Homo sapiens
ccttgatgtcttgagagc

SEQ ID NO: 2199730 - DNA, 20 bp, Homo sapiens
ccttgatgtcttgagagcgc

SEQ ID NO: 2199731 - DNA, 14 bp, Homo sapiens
ccttgcactggtca

SEQ ID NO: 2199732 - DNA, 13 bp, Homo sapiens
ccttgccaaggcc

SEQ ID NO: 2199733 - DNA, 21 bp, Homo sapiens
ccttgccaaggccgcccacct

SEQ ID NO: 2199734 - DNA, 18 bp, Homo sapiens
ccttgcccacttctcctt

SEQ ID NO: 2199735 - DNA, 18 bp, Homo sapiens
ccttgcccagcaaggacc

SEQ ID NO: 2199736 - DNA, 16 bp, Homo sapiens
ccttgccgctgggaga

SEQ ID NO: 2199737 - DNA, 17 bp, Homo sapiens
ccttgccgctgggagag

SEQ ID NO: 2199738 - DNA, 15 bp, Homo sapiens
ccttggaggagagag

SEQ ID NO: 2199739 - DNA, 18 bp, Homo sapiens
ccttggcatctagagctt

SEQ ID NO: 2199740 - DNA, 16 bp, Homo sapiens
ccttggcctcccaaag

SEQ ID NO: 2199741 - DNA, 20 bp, Homo sapiens
ccttggtgccacagagggct

SEQ ID NO: 2199742 - DNA, 21 bp, Homo sapiens
ccttggttgtctggcaaggac

SEQ ID NO: 2199743 - DNA, 22 bp, Homo sapiens
ccttggttgtctggcaaggact

SEQ ID NO: 2199744 - DNA, 13 bp, Homo sapiens
ccttgtccccaca

SEQ ID NO: 2199745 - DNA, 15 bp, Homo sapiens
ccttgtccccacact

SEQ ID NO: 2199746 - DNA, 18 bp, Homo sapiens
ccttgtccccacactcct

SEQ ID NO: 2199747 - DNA, 19 bp, Homo sapiens
ccttgtccccacactccta

SEQ ID NO: 2199748 - DNA, 21 bp, Homo sapiens
ccttgtccccacactcctaca

SEQ ID NO: 2199749 - DNA, 21 bp, Homo sapiens
ccttgtcgttgactttaggga

SEQ ID NO: 2199750 - DNA, 22 bp, Homo sapiens
ccttgtctctcattctctttct

SEQ ID NO: 2199751 - DNA, 13 bp, Homo sapiens
ccttgtctgctgc

SEQ ID NO: 2199752 - DNA, 20 bp, Homo sapiens
ccttgtctgctgctcccagc

SEQ ID NO: 2199753 - DNA, 23 bp, Homo sapiens
ccttgtgtgagtgtgacgggggt

SEQ ID NO: 2199754 - DNA, 15 bp, Homo sapiens
cctttaaaaatgtat

SEQ ID NO: 2199755 - DNA, 20 bp, Homo sapiens
cctttaaaaatgtataatga

SEQ ID NO: 2199756 - DNA, 18 bp, Homo sapiens
cctttaattgtaaagtaa

SEQ ID NO: 2199757 - DNA, 20 bp, Homo sapiens
cctttagaatattaaaaatt

SEQ ID NO: 2199758 - DNA, 16 bp, Homo sapiens
cctttcactgaagtga

SEQ ID NO: 2199759 - DNA, 24 bp, Homo sapiens
cctttcccacagtctctccctggg

SEQ ID NO: 2199760 - DNA, 18 bp, Homo sapiens
cctttctgacaataaata

SEQ ID NO: 2199761 - DNA, 22 bp, Homo sapiens
cctttggtcctaagtccctgcc

SEQ ID NO: 2199762 - DNA, 13 bp, Homo sapiens
ccttttctggctc

SEQ ID NO: 2199763 - DNA, 14 bp, Homo sapiens
ccttttctggctcc

SEQ ID NO: 2199764 - DNA, 21 bp, Homo sapiens
cctttttaaatgagacttgtt

SEQ ID NO: 2199765 - DNA, 22 bp, Homo sapiens
ccttttttttacggaattccaa

SEQ ID NO: 2199766 - DNA, 20 bp, Homo sapiens
cgaacccacactgcaacagg

SEQ ID NO: 2199767 - DNA, 22 bp, Homo sapiens
cgaactgtgcagttacgttgca

SEQ ID NO: 2199768 - DNA, 14 bp, Homo sapiens
cgaagtcttccatc

SEQ ID NO: 2199769 - DNA, 21 bp, Homo sapiens
cgaatcactcatttatttcca

SEQ ID NO: 2199770 - DNA, 15 bp, Homo sapiens
cgagcatgtcgtgga

SEQ ID NO: 2199771 - DNA, 16 bp, Homo sapiens
cgagccccctgtcctt

SEQ ID NO: 2199772 - DNA, 14 bp, Homo sapiens
cgaggcaggggctg

SEQ ID NO: 2199773 - DNA, 21 bp, Homo sapiens
cgaggcaggggctgggcagag

SEQ ID NO: 2199774 - DNA, 17 bp, Homo sapiens
cgaggcgaagctgagcg

SEQ ID NO: 2199775 - DNA, 18 bp, Homo sapiens
ctcaggaattcagtgcct

SEQ ID NO: 2199776 - DNA, 17 bp, Homo sapiens
ctcaggcatcattccac

SEQ ID NO: 2199777 - DNA, 18 bp, Homo sapiens
ctcaggcatcattccacc

SEQ ID NO: 2199778 - DNA, 20 bp, Homo sapiens
ctcaggccaaagacctccca

SEQ ID NO: 2199779 - DNA, 19 bp, Homo sapiens
ctcaggctctgcacagaca

SEQ ID NO: 2199780 - DNA, 23 bp, Homo sapiens
ctcaggctctgcacagacaagca

SEQ ID NO: 2199781 - DNA, 14 bp, Homo sapiens
ctcagtctgtcacc

SEQ ID NO: 2199782 - DNA, 21 bp, Homo sapiens
ctcagtctgtcacccaggctg

SEQ ID NO: 2199783 - DNA, 23 bp, Homo sapiens
ctcagtctgtcacccaggctgga

SEQ ID NO: 2199784 - DNA, 23 bp, Homo sapiens
ctcagtcttccctagggctgggt

SEQ ID NO: 2199785 - DNA, 12 bp, Homo sapiens
ctcagtgtgaag

SEQ ID NO: 2199786 - DNA, 13 bp, Homo sapiens
ctcagtgtgaagc

SEQ ID NO: 2199787 - DNA, 16 bp, Homo sapiens
ctcagtgtgaagcctg

SEQ ID NO: 2199788 - DNA, 14 bp, Homo sapiens
ctcagtttctgttg

SEQ ID NO: 2199789 - DNA, 20 bp, Homo sapiens
ctcagtttctgttgtttctt

SEQ ID NO: 2199790 - DNA, 22 bp, Homo sapiens
ctcagtttggctgtaatttaat

SEQ ID NO: 2199791 - DNA, 24 bp, Homo sapiens
ctcatcctttttaaatgagacttg

SEQ ID NO: 2199792 - DNA, 19 bp, Homo sapiens
ctcatgtgtgctcttcttc

SEQ ID NO: 2199793 - DNA, 13 bp, Homo sapiens
ctcatgtttgtgc

SEQ ID NO: 2199794 - DNA, 12 bp, Homo sapiens
ctcattaatttc

SEQ ID NO: 2199795 - DNA, 15 bp, Homo sapiens
ctcattctctttctt

SEQ ID NO: 2199796 - DNA, 15 bp, Homo sapiens
ctcattgaaatgtaa

SEQ ID NO: 2199797 - DNA, 10 bp, Homo sapiens
ctcattttgt

SEQ ID NO: 2199798 - DNA, 14 bp, Homo sapiens
ctcattttgtatgt

SEQ ID NO: 2199799 - DNA, 11 bp, Homo sapiens
ctccaaagctt

SEQ ID NO: 2199800 - DNA, 14 bp, Homo sapiens
ctccaccccactca

SEQ ID NO: 2199801 - DNA, 13 bp, Homo sapiens
ctccactgccctc

SEQ ID NO: 2199802 - DNA, 13 bp, Homo sapiens
ctccactgtcttt

SEQ ID NO: 2199803 - DNA, 21 bp, Homo sapiens
ctccaggaaggggctggactg

SEQ ID NO: 2199804 - DNA, 19 bp, Homo sapiens
ctccaggggcctgcagaag

SEQ ID NO: 2199805 - DNA, 14 bp, Homo sapiens
ctccagtcctgctc

SEQ ID NO: 2199806 - DNA, 15 bp, Homo sapiens
ctccagtcctgctct

SEQ ID NO: 2199807 - DNA, 17 bp, Homo sapiens
ctccatggtgcctctgg

SEQ ID NO: 2199808 - DNA, 16 bp, Homo sapiens
ctccatgtagaagagg

SEQ ID NO: 2199809 - DNA, 17 bp, Homo sapiens
ctcccaagaacagcagg

SEQ ID NO: 2199810 - DNA, 18 bp, Homo sapiens
ctcccaagaacagcaggc

SEQ ID NO: 2199811 - DNA, 23 bp, Homo sapiens
ctcccaagaacagcaggcccacc

SEQ ID NO: 2199812 - DNA, 13 bp, Homo sapiens
ctcccacccctcc

SEQ ID NO: 2199813 - DNA, 22 bp, Homo sapiens
ctcccagaggctcctggagcca

SEQ ID NO: 2199814 - DNA, 18 bp, Homo sapiens
ctcccagttctctaggga

SEQ ID NO: 2199815 - DNA, 15 bp, Homo sapiens
ctcccctaccactgt

SEQ ID NO: 2199816 - DNA, 12 bp, Homo sapiens
ctcccctcctct

SEQ ID NO: 2199817 - DNA, 14 bp, Homo sapiens
ctcccctctgctgg

SEQ ID NO: 2199818 - DNA, 17 bp, Homo sapiens
ctcccgcattggtggct

SEQ ID NO: 2199819 - DNA, 17 bp, Homo sapiens
ctcccgtcttcctcctc

SEQ ID NO: 2199820 - DNA, 20 bp, Homo sapiens
ctccctataatgctggagcg

SEQ ID NO: 2199821 - DNA, 16 bp, Homo sapiens
ctccctcccctgccct

SEQ ID NO: 2199822 - DNA, 16 bp, Homo sapiens
ctccctccctgcaggg

SEQ ID NO: 2199823 - DNA, 12 bp, Homo sapiens
ctccctcctgcc

SEQ ID NO: 2199824 - DNA, 22 bp, Homo sapiens
ctccctcgaacccacactgcaa

SEQ ID NO: 2199825 - DNA, 15 bp, Homo sapiens
ctccctgaccctgca

SEQ ID NO: 2199826 - DNA, 18 bp, Homo sapiens
ctccctgaccctgcagag

SEQ ID NO: 2199827 - DNA, 21 bp, Homo sapiens
ctccctgaccctgcagagatg

SEQ ID NO: 2199828 - DNA, 12 bp, Homo sapiens
ctccctgcaggg

SEQ ID NO: 2199829 - DNA, 13 bp, Homo sapiens
ctccctgcagggt

SEQ ID NO: 2199830 - DNA, 18 bp, Homo sapiens
ctccctgctcagctggcc

SEQ ID NO: 2199831 - DNA, 20 bp, Homo sapiens
ctcccttcaagacgaggggc

SEQ ID NO: 2199832 - DNA, 22 bp, Homo sapiens
ctcccttcaagacgaggggcag

SEQ ID NO: 2199833 - DNA, 23 bp, Homo sapiens
ctccctttttccttgtccccaca

SEQ ID NO: 2199834 - DNA, 13 bp, Homo sapiens
ctccgcctggcac

SEQ ID NO: 2199835 - DNA, 14 bp, Homo sapiens
ctccgcctggcacc

SEQ ID NO: 2199836 - DNA, 19 bp, Homo sapiens
ctccggattccggccctgg

SEQ ID NO: 2199837 - DNA, 20 bp, Homo sapiens
ctccggattccggccctggc

SEQ ID NO: 2199838 - DNA, 23 bp, Homo sapiens
ctccggattccggccctggctgg

SEQ ID NO: 2199839 - DNA, 17 bp, Homo sapiens
ctccggggctcagccct

SEQ ID NO: 2199840 - DNA, 20 bp, Homo sapiens
ctccgtatttatttttttat

SEQ ID NO: 2199841 - DNA, 13 bp, Homo sapiens
ctcctagactcaa

SEQ ID NO: 2199842 - DNA, 15 bp, Homo sapiens
ctcctcccctggcaa

SEQ ID NO: 2199843 - DNA, 19 bp, Homo sapiens
ctcctccctttttccttgt

SEQ ID NO: 2199844 - DNA, 12 bp, Homo sapiens
ctcctctcccct

SEQ ID NO: 2199845 - DNA, 14 bp, Homo sapiens
ctcctctcccctac

SEQ ID NO: 2199846 - DNA, 17 bp, Homo sapiens
ctcctctctgctgggtt

SEQ ID NO: 2199847 - DNA, 14 bp, Homo sapiens
ctcctctgtcccca

SEQ ID NO: 2199848 - DNA, 18 bp, Homo sapiens
ctcctgagggtcctgctg

SEQ ID NO: 2199849 - DNA, 22 bp, Homo sapiens
ctcctgagtagctgagactaca

SEQ ID NO: 2199850 - DNA, 16 bp, Homo sapiens
ctcctgagtgatccca

SEQ ID NO: 2199851 - DNA, 19 bp, Homo sapiens
ctcctgattgctctggaag

SEQ ID NO: 2199852 - DNA, 20 bp, Homo sapiens
ctcctgcccgccctccctcc

SEQ ID NO: 2199853 - DNA, 13 bp, Homo sapiens
ctcctgccctgcc

SEQ ID NO: 2199854 - DNA, 19 bp, Homo sapiens
ctcctgccctgccctcctg

SEQ ID NO: 2199855 - DNA, 16 bp, Homo sapiens
ctcctgcctcagcctc

SEQ ID NO: 2199856 - DNA, 17 bp, Homo sapiens
ctcctgcctgcgcagct

SEQ ID NO: 2199857 - DNA, 21 bp, Homo sapiens
ctcctgcctgcgcagctcctt

SEQ ID NO: 2199858 - DNA, 12 bp, Homo sapiens
ctcctggagcca

SEQ ID NO: 2199859 - DNA, 23 bp, Homo sapiens
ctcctgggaaggctactcacctt

SEQ ID NO: 2199860 - DNA, 19 bp, Homo sapiens
ctcctgtccaaagtaggga

SEQ ID NO: 2199861 - DNA, 11 bp, Homo sapiens
ctcctgtgccc

SEQ ID NO: 2199862 - DNA, 14 bp, Homo sapiens
ctccttccaactgc

SEQ ID NO: 2199863 - DNA, 17 bp, Homo sapiens
ctccttcgctttcctga

SEQ ID NO: 2199864 - DNA, 13 bp, Homo sapiens
ctccttctgtgtt

SEQ ID NO: 2199865 - DNA, 14 bp, Homo sapiens
ctccttctgtgttt

SEQ ID NO: 2199866 - DNA, 19 bp, Homo sapiens
ctccttttatgctcacctg

SEQ ID NO: 2199867 - DNA, 17 bp, Homo sapiens
ctcgcaggggcgctggc

SEQ ID NO: 2199868 - DNA, 14 bp, Homo sapiens
ctcgctcccttcaa

SEQ ID NO: 2199869 - DNA, 22 bp, Homo sapiens
ctcgttaacacatggcttccta

SEQ ID NO: 2199870 - DNA, 13 bp, Homo sapiens
ctctaaacacact

SEQ ID NO: 2199871 - DNA, 15 bp, Homo sapiens
ctctacccagcccat

SEQ ID NO: 2199872 - DNA, 18 bp, Homo sapiens
ctctacccagcccatctt

SEQ ID NO: 2199873 - DNA, 18 bp, Homo sapiens
ctctagggaaggccacct

SEQ ID NO: 2199874 - DNA, 16 bp, Homo sapiens
ctctagggacccctcc

SEQ ID NO: 2199875 - DNA, 20 bp, Homo sapiens
ctctagggacccctcctccc

SEQ ID NO: 2199876 - DNA, 21 bp, Homo sapiens
ctctatgggtatcaaacagct

SEQ ID NO: 2199877 - DNA, 20 bp, Homo sapiens
ctctcaatttgggtcccagc

SEQ ID NO: 2199878 - DNA, 15 bp, Homo sapiens
ctctcatcccccatt

SEQ ID NO: 2199879 - DNA, 12 bp, Homo sapiens
ctctcccagagg

SEQ ID NO: 2199880 - DNA, 14 bp, Homo sapiens
ctctcctgccctgc

SEQ ID NO: 2199881 - DNA, 16 bp, Homo sapiens
ctctctacccagccca

SEQ ID NO: 2199882 - DNA, 18 bp, Homo sapiens
ctctctacccagcccatc

SEQ ID NO: 2199883 - DNA, 19 bp, Homo sapiens
ctctctacccagcccatct

SEQ ID NO: 2199884 - DNA, 23 bp, Homo sapiens
ctctcttacccttctgtgcccag

SEQ ID NO: 2199885 - DNA, 18 bp, Homo sapiens
ctctcttcaatctctgga

SEQ ID NO: 2199886 - DNA, 15 bp, Homo sapiens
ctctgaacttcagct

SEQ ID NO: 2199887 - DNA, 16 bp, Homo sapiens
ctctgaatgggagcca

SEQ ID NO: 2199888 - DNA, 18 bp, Homo sapiens
ctctgaatgggagccaga

SEQ ID NO: 2199889 - DNA, 23 bp, Homo sapiens
ctctgactcccaaagagctgcct

SEQ ID NO: 2199890 - DNA, 15 bp, Homo sapiens
ctctgaggctcagcc

SEQ ID NO: 2199891 - DNA, 22 bp, Homo sapiens
ctctgaggctcagccctgagct

SEQ ID NO: 2199892 - DNA, 16 bp, Homo sapiens
ctctgcacagacaagc

SEQ ID NO: 2199893 - DNA, 18 bp, Homo sapiens
ctctgcacagacaagcag

SEQ ID NO: 2199894 - DNA, 20 bp, Homo sapiens
ctctgcacagacaagcagcc

SEQ ID NO: 2199895 - DNA, 21 bp, Homo sapiens
ctctgcacagacaagcagccc

SEQ ID NO: 2199896 - DNA, 21 bp, Homo sapiens
ctctgcactatagccatttgc

SEQ ID NO: 2199897 - DNA, 19 bp, Homo sapiens
cttgcctccatggtgcctc

SEQ ID NO: 2199898 - DNA, 18 bp, Homo sapiens
cttgcggaactcttcctg

SEQ ID NO: 2199899 - DNA, 12 bp, Homo sapiens
cttgctgcaccc

SEQ ID NO: 2199900 - DNA, 15 bp, Homo sapiens
cttgctgggtccagg

SEQ ID NO: 2199901 - DNA, 17 bp, Homo sapiens
cttgctggtgcacatga

SEQ ID NO: 2199902 - DNA, 24 bp, Homo sapiens
cttgctttcggagctcctgtccaa

SEQ ID NO: 2199903 - DNA, 23 bp, Homo sapiens
cttggaatagcttgtacacatat

SEQ ID NO: 2199904 - DNA, 23 bp, Homo sapiens
cttggccaaaacaggctcaggcc

SEQ ID NO: 2199905 - DNA, 16 bp, Homo sapiens
cttggccctacagccc

SEQ ID NO: 2199906 - DNA, 18 bp, Homo sapiens
cttggccctacagccctg

SEQ ID NO: 2199907 - DNA, 18 bp, Homo sapiens
cttggccgcttccctacc

SEQ ID NO: 2199908 - DNA, 22 bp, Homo sapiens
cttgggaaaatatcactttgta

SEQ ID NO: 2199909 - DNA, 23 bp, Homo sapiens
cttgggatccgcatccagccgtg

SEQ ID NO: 2199910 - DNA, 13 bp, Homo sapiens
cttgggttccttt

SEQ ID NO: 2199911 - DNA, 15 bp, Homo sapiens
cttggtaagagggag

SEQ ID NO: 2199912 - DNA, 19 bp, Homo sapiens
cttggtttcctcaccttga

SEQ ID NO: 2199913 - DNA, 16 bp, Homo sapiens
cttgtaaacctggagg

SEQ ID NO: 2199914 - DNA, 14 bp, Homo sapiens
cttgtaaacttgaa

SEQ ID NO: 2199915 - DNA, 18 bp, Homo sapiens
cttgtaaacttgaaagca

SEQ ID NO: 2199916 - DNA, 16 bp, Homo sapiens
cttgtacagttgactg

SEQ ID NO: 2199917 - DNA, 14 bp, Homo sapiens
cttgtactgggaca

SEQ ID NO: 2199918 - DNA, 16 bp, Homo sapiens
cttgtccccacactcc

SEQ ID NO: 2199919 - DNA, 12 bp, Homo sapiens
cttgtctgctgc

SEQ ID NO: 2199920 - DNA, 13 bp, Homo sapiens
cttgtgaacatgc

SEQ ID NO: 2199921 - DNA, 15 bp, Homo sapiens
cttgtgaaggaaaaa

SEQ ID NO: 2199922 - DNA, 21 bp, Homo sapiens
cttgtgacttacagtgccaac

SEQ ID NO: 2199923 - DNA, 14 bp, Homo sapiens
cttgtgcattgtgt

SEQ ID NO: 2199924 - DNA, 19 bp, Homo sapiens
cttgtgcctcttgggagac

SEQ ID NO: 2199925 - DNA, 16 bp, Homo sapiens
cttgtggcagcaacgg

SEQ ID NO: 2199926 - DNA, 13 bp, Homo sapiens
cttgtgtgttttt

SEQ ID NO: 2199927 - DNA, 19 bp, Homo sapiens
cttgtgtttgtatataaat

SEQ ID NO: 2199928 - DNA, 23 bp, Homo sapiens
cttgttccactgcaaataaagcc

SEQ ID NO: 2199929 - DNA, 15 bp, Homo sapiens
ctttaattgttgctt

SEQ ID NO: 2199930 - DNA, 16 bp, Homo sapiens
ctttactagtgccaaa

SEQ ID NO: 2199931 - DNA, 22 bp, Homo sapiens
ctttagaaaacccaagttttta

SEQ ID NO: 2199932 - DNA, 19 bp, Homo sapiens
ctttagcagatattaaaaa

SEQ ID NO: 2199933 - DNA, 23 bp, Homo sapiens
ctttagtgttcaaatacttcaaa

SEQ ID NO: 2199934 - DNA, 23 bp, Homo sapiens
ctttattagtgaagtatgcacta

SEQ ID NO: 2199935 - DNA, 16 bp, Homo sapiens
ctttattgattttctt

SEQ ID NO: 2199936 - DNA, 22 bp, Homo sapiens
ctttatttgtttatatttaatt

SEQ ID NO: 2199937 - DNA, 18 bp, Homo sapiens
ctttcaggagggaaaacc

SEQ ID NO: 2199938 - DNA, 22 bp, Homo sapiens
ctttcataaagcaccagcagtg

SEQ ID NO: 2199939 - DNA, 15 bp, Homo sapiens
ctttccatgcagtta

SEQ ID NO: 2199940 - DNA, 17 bp, Homo sapiens
ctttccccatactctgt

SEQ ID NO: 2199941 - DNA, 23 bp, Homo sapiens
ctttctacagtattatgtactct

SEQ ID NO: 2199942 - DNA, 14 bp, Homo sapiens
ctttctagtttgtt

SEQ ID NO: 2199943 - DNA, 17 bp, Homo sapiens
ctttctccgtatttatt

SEQ ID NO: 2199944 - DNA, 18 bp, Homo sapiens
ctttctcctttaattgta

SEQ ID NO: 2199945 - DNA, 14 bp, Homo sapiens
ctttctctgcttca

SEQ ID NO: 2199946 - DNA, 17 bp, Homo sapiens
ctttctctgcttcagct

SEQ ID NO: 2199947 - DNA, 17 bp, Homo sapiens
ctttctcttctctgttc

SEQ ID NO: 2199948 - DNA, 15 bp, Homo sapiens
ctttctgacaataaa

SEQ ID NO: 2199949 - DNA, 21 bp, Homo sapiens
ctttctgacaataaataatat

SEQ ID NO: 2199950 - DNA, 14 bp, Homo sapiens
ctttctttttctgt

SEQ ID NO: 2199951 - DNA, 20 bp, Homo sapiens
ctttctttttctgtctctct

SEQ ID NO: 2199952 - DNA, 21 bp, Homo sapiens
ctttctttttctgtctctctt

SEQ ID NO: 2199953 - DNA, 13 bp, Homo sapiens
ctttgaaagaagc

SEQ ID NO: 2199954 - DNA, 14 bp, Homo sapiens
ctttgaaagaagca

SEQ ID NO: 2199955 - DNA, 18 bp, Homo sapiens
ctttgactataacaaaat

SEQ ID NO: 2199956 - DNA, 23 bp, Homo sapiens
ctttgaggttattttccgccaga

SEQ ID NO: 2199957 - DNA, 22 bp, Homo sapiens
ctttgatgattgccaacagtgg

SEQ ID NO: 2199958 - DNA, 16 bp, Homo sapiens
ctttgattccatctcc

SEQ ID NO: 2199959 - DNA, 14 bp, Homo sapiens
ctttgattccattt

SEQ ID NO: 2199960 - DNA, 19 bp, Homo sapiens
ctttgattccattttaagt

SEQ ID NO: 2199961 - DNA, 15 bp, Homo sapiens
ctttgattgttcata

SEQ ID NO: 2199962 - DNA, 21 bp, Homo sapiens
ctttgcccaacctcagcaacc

SEQ ID NO: 2199963 - DNA, 18 bp, Homo sapiens
ctttgcccagggtcctgt

SEQ ID NO: 2199964 - DNA, 23 bp, Homo sapiens
ctttgcccagggtcctgtgcctg

SEQ ID NO: 2199965 - DNA, 20 bp, Homo sapiens
ctttgcgtgtgtcataaagt

SEQ ID NO: 2199966 - DNA, 19 bp, Homo sapiens
ctttgctccaccccactca

SEQ ID NO: 2199967 - DNA, 18 bp, Homo sapiens
ctttgctccttttgtagt

SEQ ID NO: 2199968 - DNA, 17 bp, Homo sapiens
ctttggacacacacagc

SEQ ID NO: 2199969 - DNA, 18 bp, Homo sapiens
ctttggacacacacagct

SEQ ID NO: 2199970 - DNA, 20 bp, Homo sapiens
ctttggagaactcatttcaa

SEQ ID NO: 2199971 - DNA, 20 bp, Homo sapiens
ctttggaggaattttctaaa

SEQ ID NO: 2199972 - DNA, 20 bp, Homo sapiens
ctttggctcgggacttcaaa

SEQ ID NO: 2199973 - DNA, 22 bp, Homo sapiens
ctttggggaactcaaaggactg

SEQ ID NO: 2199974 - DNA, 14 bp, Homo sapiens
ctttggtggcccct

SEQ ID NO: 2199975 - DNA, 13 bp, Homo sapiens
ctttgtattctct

SEQ ID NO: 2199976 - DNA, 15 bp, Homo sapiens
ctttgtcccacagct

SEQ ID NO: 2199977 - DNA, 19 bp, Homo sapiens
ctttgtgcagggtcctccg

SEQ ID NO: 2199978 - DNA, 17 bp, Homo sapiens
ctttgttcactgtgagt

SEQ ID NO: 2199979 - DNA, 18 bp, Homo sapiens
ctttgttccactggaaac

SEQ ID NO: 2199980 - DNA, 21 bp, Homo sapiens
cttttaaactactatttttct

SEQ ID NO: 2199981 - DNA, 17 bp, Homo sapiens
cttttaaataaattatg

SEQ ID NO: 2199982 - DNA, 18 bp, Homo sapiens
cttttacagcttttctct

SEQ ID NO: 2199983 - DNA, 15 bp, Homo sapiens
cttttactgtggagg

SEQ ID NO: 2199984 - DNA, 21 bp, Homo sapiens
cttttactgtggaggtggctg

SEQ ID NO: 2199985 - DNA, 23 bp, Homo sapiens
cttttactgtggaggtggctggt

SEQ ID NO: 2199986 - DNA, 15 bp, Homo sapiens
cttttagacagtggt

SEQ ID NO: 2199987 - DNA, 20 bp, Homo sapiens
cttttagtacccacctgagc

SEQ ID NO: 2199988 - DNA, 16 bp, Homo sapiens
cttttatgctcacctg

SEQ ID NO: 2199989 - DNA, 22 bp, Homo sapiens
cttttcaggaggtactgtgagg

SEQ ID NO: 2199990 - DNA, 17 bp, Homo sapiens
cttttccaaataaaggt

SEQ ID NO: 2199991 - DNA, 15 bp, Homo sapiens
cttttcctagtttta

SEQ ID NO: 2199992 - DNA, 14 bp, Homo sapiens
cttttctggctcct

SEQ ID NO: 2199993 - DNA, 15 bp, Homo sapiens
cttttctggctcctg

SEQ ID NO: 2199994 - DNA, 17 bp, Homo sapiens
cttttctggctcctgtg

SEQ ID NO: 2199995 - DNA, 18 bp, Homo sapiens
cttttctggctcctgtgt

SEQ ID NO: 2199996 - DNA, 21 bp, Homo sapiens
cttttctggctcctgtgtgga

SEQ ID NO: 2199997 - DNA, 19 bp, Homo sapiens
cttttgaataatgtagtgc

SEQ ID NO: 2199998 - DNA, 21 bp, Homo sapiens
cttttgaccccttcctgtctg

SEQ ID NO: 2199999 - DNA, 24 bp, Homo sapiens
cttttgcaaccaggaacagcaaat

SEQ ID NO: 2200000 - DNA, 13 bp, Homo sapiens
cttttgcagcttc

SEQ ID NO: 2200001 - DNA, 22 bp, Homo sapiens
cttttgcccgttgaggtagagg

SEQ ID NO: 2200002 - DNA, 11 bp, Homo sapiens
cttttgctaaa

SEQ ID NO: 2200003 - DNA, 23 bp, Homo sapiens
cttttgtaaaataaaaccaccaa

SEQ ID NO: 2200004 - DNA, 23 bp, Homo sapiens
cttttgtagtttgtattaaactt

SEQ ID NO: 2200005 - DNA, 21 bp, Homo sapiens
cttttgtgggtttctctgtgc

SEQ ID NO: 2200006 - DNA, 16 bp, Homo sapiens
ctttttcttttgcttt

SEQ ID NO: 2200007 - DNA, 23 bp, Homo sapiens
ctttttgctcccccattttaact

SEQ ID NO: 2200008 - DNA, 21 bp, Homo sapiens
ctttttttaaaaagttgatag

SEQ ID NO: 2200009 - DNA, 16 bp, Homo sapiens
gaaaaacatgcttaag

SEQ ID NO: 2200010 - DNA, 12 bp, Homo sapiens
gaaaaacatgtc

SEQ ID NO: 2200011 - DNA, 13 bp, Homo sapiens
gaaaaacatgtca

SEQ ID NO: 2200012 - DNA, 16 bp, Homo sapiens
gaaaaacatgtcatgt

SEQ ID NO: 2200013 - DNA, 18 bp, Homo sapiens
gaaaaaggagcttacctc

SEQ ID NO: 2200014 - DNA, 23 bp, Homo sapiens
gaaaacaaatcttcaaggtgtaa

SEQ ID NO: 2200015 - DNA, 17 bp, Homo sapiens
gaaaacccaagttttta

SEQ ID NO: 2200016 - DNA, 18 bp, Homo sapiens
gaaaacccaagtttttaa

SEQ ID NO: 2200017 - DNA, 20 bp, Homo sapiens
gaaaacttcgtaagaacatg

SEQ ID NO: 2200018 - DNA, 12 bp, Homo sapiens
gcacgtgcaata

SEQ ID NO: 2200019 - DNA, 17 bp, Homo sapiens
gcactaatcaatacttt

SEQ ID NO: 2200020 - DNA, 17 bp, Homo sapiens
gcactagcctccctctc

SEQ ID NO: 2200021 - DNA, 17 bp, Homo sapiens
gcactgatctttgcaaa

SEQ ID NO: 2200022 - DNA, 18 bp, Homo sapiens
gcactgcacataatttgc

SEQ ID NO: 2200023 - DNA, 16 bp, Homo sapiens
gcagaaccctggtgag

SEQ ID NO: 2200024 - DNA, 19 bp, Homo sapiens
gcagaacctggtggctgga

SEQ ID NO: 2200025 - DNA, 21 bp, Homo sapiens
gcagaaggaaagaagggggcc

SEQ ID NO: 2200026 - DNA, 23 bp, Homo sapiens
gcagacaggctggtatttaacag

SEQ ID NO: 2200027 - DNA, 14 bp, Homo sapiens
gcagacctgggact

SEQ ID NO: 2200028 - DNA, 19 bp, Homo sapiens
gcagagccgttcctgggac

SEQ ID NO: 2200029 - DNA, 17 bp, Homo sapiens
gcagagctggggggaag

SEQ ID NO: 2200030 - DNA, 19 bp, Homo sapiens
gcagagctggggggaaggc

SEQ ID NO: 2200031 - DNA, 14 bp, Homo sapiens
gcagagtgccccac

SEQ ID NO: 2200032 - DNA, 13 bp, Homo sapiens
gcagatgccagag

SEQ ID NO: 2200033 - DNA, 22 bp, Homo sapiens
gcagcaagtacaaaaggagaag

SEQ ID NO: 2200034 - DNA, 12 bp, Homo sapiens
gcagcagcttgc

SEQ ID NO: 2200035 - DNA, 15 bp, Homo sapiens
gcagccatgagaaca

SEQ ID NO: 2200036 - DNA, 14 bp, Homo sapiens
gcagccctggagtc

SEQ ID NO: 2200037 - DNA, 16 bp, Homo sapiens
gcagccctggagtcat

SEQ ID NO: 2200038 - DNA, 18 bp, Homo sapiens
gcagccctggagtcatgc

SEQ ID NO: 2200039 - DNA, 23 bp, Homo sapiens
gcagcccttgctttcggagctcc

SEQ ID NO: 2200040 - DNA, 18 bp, Homo sapiens
gcagcctgtgggagaagg

SEQ ID NO: 2200041 - DNA, 23 bp, Homo sapiens
gcagcctgtgggagaagggacag

SEQ ID NO: 2200042 - DNA, 19 bp, Homo sapiens
gcagccttgaccacggctg

SEQ ID NO: 2200043 - DNA, 22 bp, Homo sapiens
gcagcgggcggaggggatccag

SEQ ID NO: 2200044 - DNA, 18 bp, Homo sapiens
gcagcggtggaaggagcc

SEQ ID NO: 2200045 - DNA, 16 bp, Homo sapiens
gcagcgtctgagcggc

SEQ ID NO: 2200046 - DNA, 17 bp, Homo sapiens
gcagctccgcctggcac

SEQ ID NO: 2200047 - DNA, 18 bp, Homo sapiens
gcagctccgcctggcacc

SEQ ID NO: 2200048 - DNA, 16 bp, Homo sapiens
gcagcttccttccaag

SEQ ID NO: 2200049 - DNA, 22 bp, Homo sapiens
gcaggattgaaaatgtccagga

SEQ ID NO: 2200050 - DNA, 19 bp, Homo sapiens
gcagggaggcaccattcag

SEQ ID NO: 2200051 - DNA, 13 bp, Homo sapiens
gcagggcagcctg

SEQ ID NO: 2200052 - DNA, 18 bp, Homo sapiens
gcagggccatctgactgc

SEQ ID NO: 2200053 - DNA, 22 bp, Homo sapiens
gcagggccatctgactgccaag

SEQ ID NO: 2200054 - DNA, 24 bp, Homo sapiens
gcagggccatctgactgccaagcc

SEQ ID NO: 2200055 - DNA, 19 bp, Homo sapiens
gcagggtctttgtgtgctg

SEQ ID NO: 2200056 - DNA, 18 bp, Homo sapiens
gcaggtcccgagccccct

SEQ ID NO: 2200057 - DNA, 16 bp, Homo sapiens
gcaggtgaccgcccgc

SEQ ID NO: 2200058 - DNA, 15 bp, Homo sapiens
gcaggttccccaagg

SEQ ID NO: 2200059 - DNA, 19 bp, Homo sapiens
gcaggttccccaagggccc

SEQ ID NO: 2200060 - DNA, 23 bp, Homo sapiens
gcaggttccccaagggccctggc

SEQ ID NO: 2200061 - DNA, 16 bp, Homo sapiens
gcaggttgatcagtga

SEQ ID NO: 2200062 - DNA, 20 bp, Homo sapiens
gcagtatgatggcaggagaa

SEQ ID NO: 2200063 - DNA, 20 bp, Homo sapiens
gcagtgattgaagtatctgt

SEQ ID NO: 2200064 - DNA, 16 bp, Homo sapiens
gcagtgcccagtgatg

SEQ ID NO: 2200065 - DNA, 18 bp, Homo sapiens
gcagtggactgtgtccct

SEQ ID NO: 2200066 - DNA, 16 bp, Homo sapiens
gcagtggcaggggagc

SEQ ID NO: 2200067 - DNA, 12 bp, Homo sapiens
gcagtggcctta

SEQ ID NO: 2200068 - DNA, 22 bp, Homo sapiens
gcagttacattctgctcccagc

SEQ ID NO: 2200069 - DNA, 17 bp, Homo sapiens
gcagtttgagcttgctg

SEQ ID NO: 2200070 - DNA, 11 bp, Homo sapiens
gcagtttttaa

SEQ ID NO: 2200071 - DNA, 12 bp, Homo sapiens
gcataaagggcc

SEQ ID NO: 2200072 - DNA, 16 bp, Homo sapiens
gcatccacctccttct

SEQ ID NO: 2200073 - DNA, 15 bp, Homo sapiens
gcatccgtctcccct

SEQ ID NO: 2200074 - DNA, 17 bp, Homo sapiens
gcatccgtctcccctcg

SEQ ID NO: 2200075 - DNA, 12 bp, Homo sapiens
gcatctgaaaac

SEQ ID NO: 2200076 - DNA, 15 bp, Homo sapiens
gcatctgaaaacaat

SEQ ID NO: 2200077 - DNA, 20 bp, Homo sapiens
gcatgaaactatgcacctat

SEQ ID NO: 2200078 - DNA, 16 bp, Homo sapiens
gcatgactggacagcg

SEQ ID NO: 2200079 - DNA, 16 bp, Homo sapiens
gcatgcaaaccaggag

SEQ ID NO: 2200080 - DNA, 13 bp, Homo sapiens
gcatgcagaaagg

SEQ ID NO: 2200081 - DNA, 18 bp, Homo sapiens
gcatgcagaaagggagca

SEQ ID NO: 2200082 - DNA, 12 bp, Homo sapiens
gcatgcagcagc

SEQ ID NO: 2200083 - DNA, 22 bp, Homo sapiens
gcatgcagcagcttgctgcacc

SEQ ID NO: 2200084 - DNA, 14 bp, Homo sapiens
gcatggtgcatgcc

SEQ ID NO: 2200085 - DNA, 18 bp, Homo sapiens
gcatgtgtaaatctgaaa

SEQ ID NO: 2200086 - DNA, 24 bp, Homo sapiens
gcatgtgtgtatcaccctcagctg

SEQ ID NO: 2200087 - DNA, 16 bp, Homo sapiens
gcatgtgttgtacaat

SEQ ID NO: 2200088 - DNA, 13 bp, Homo sapiens
gcattaaatgcaa

SEQ ID NO: 2200089 - DNA, 16 bp, Homo sapiens
gcattagaaaccatga

SEQ ID NO: 2200090 - DNA, 15 bp, Homo sapiens
gcattcccagaggtg

SEQ ID NO: 2200091 - DNA, 12 bp, Homo sapiens
gcattggtggct

SEQ ID NO: 2200092 - DNA, 17 bp, Homo sapiens
gcattggttccctttgc

SEQ ID NO: 2200093 - DNA, 17 bp, Homo sapiens
gccaaagaatgccttga

SEQ ID NO: 2200094 - DNA, 17 bp, Homo sapiens
gccaaagacctcccaag

SEQ ID NO: 2200095 - DNA, 16 bp, Homo sapiens
gccaagaagcagtggc

SEQ ID NO: 2200096 - DNA, 19 bp, Homo sapiens
gccaagaccatttcacaga

SEQ ID NO: 2200097 - DNA, 12 bp, Homo sapiens
gccaagccagat

SEQ ID NO: 2200098 - DNA, 16 bp, Homo sapiens
gccaaggccgcccacc

SEQ ID NO: 2200099 - DNA, 18 bp, Homo sapiens
gccaaggccgcccacctg

SEQ ID NO: 2200100 - DNA, 21 bp, Homo sapiens
gccaagggccgactaagagaa

SEQ ID NO: 2200101 - DNA, 16 bp, Homo sapiens
gccacagacccctggg

SEQ ID NO: 2200102 - DNA, 18 bp, Homo sapiens
gccacagacccctgggag

SEQ ID NO: 2200103 - DNA, 19 bp, Homo sapiens
gccacagagggctgtgtct

SEQ ID NO: 2200104 - DNA, 14 bp, Homo sapiens
gccacagccagaac

SEQ ID NO: 2200105 - DNA, 14 bp, Homo sapiens
gccacaggcagacg

SEQ ID NO: 2200106 - DNA, 16 bp, Homo sapiens
gccaccacactcagct

SEQ ID NO: 2200107 - DNA, 22 bp, Homo sapiens
gccaccaccccccactctgtgc

SEQ ID NO: 2200108 - DNA, 14 bp, Homo sapiens
gccaccaccctgcc

SEQ ID NO: 2200109 - DNA, 17 bp, Homo sapiens
gccaccctctgcagggc

SEQ ID NO: 2200110 - DNA, 19 bp, Homo sapiens
gccaccctctgcagggcag

SEQ ID NO: 2200111 - DNA, 21 bp, Homo sapiens
gccacccttgcccacttctcc

SEQ ID NO: 2200112 - DNA, 12 bp, Homo sapiens
gccacctgcagc

SEQ ID NO: 2200113 - DNA, 16 bp, Homo sapiens
gccacctgcaggtcac

SEQ ID NO: 2200114 - DNA, 13 bp, Homo sapiens
gccacctgtccca

SEQ ID NO: 2200115 - DNA, 12 bp, Homo sapiens
gccacggcctgg

SEQ ID NO: 2200116 - DNA, 23 bp, Homo sapiens
gccacggcctggctggtgggaag

SEQ ID NO: 2200117 - DNA, 22 bp, Homo sapiens
gccacgggggaggccgaggcag

SEQ ID NO: 2200118 - DNA, 15 bp, Homo sapiens
gccacgtgctggaga

SEQ ID NO: 2200119 - DNA, 16 bp, Homo sapiens
gccacgtgctggagag

SEQ ID NO: 2200120 - DNA, 17 bp, Homo sapiens
gccacgtgctggagagt

SEQ ID NO: 2200121 - DNA, 12 bp, Homo sapiens
gccactgcagtc

SEQ ID NO: 2200122 - DNA, 21 bp, Homo sapiens
gccactgcagtcacccctgtc

SEQ ID NO: 2200123 - DNA, 22 bp, Homo sapiens
gccactgcagtcacccctgtct

SEQ ID NO: 2200124 - DNA, 22 bp, Homo sapiens
gccactggaaatgcatgacttc

SEQ ID NO: 2200125 - DNA, 16 bp, Homo sapiens
gccactggcatctctg

SEQ ID NO: 2200126 - DNA, 17 bp, Homo sapiens
gccactggcatctctgg

SEQ ID NO: 2200127 - DNA, 16 bp, Homo sapiens
gccacttatttccatg

SEQ ID NO: 2200128 - DNA, 16 bp, Homo sapiens
gccactttgcagacct

SEQ ID NO: 2200129 - DNA, 17 bp, Homo sapiens
gccactttgcagacctg

SEQ ID NO: 2200130 - DNA, 23 bp, Homo sapiens
gccactttgcagacctgggactt

SEQ ID NO: 2200131 - DNA, 20 bp, Homo sapiens
gccagaaccccgagccctac

SEQ ID NO: 2200132 - DNA, 13 bp, Homo sapiens
gccagaccagagc

SEQ ID NO: 2200133 - DNA, 17 bp, Homo sapiens
gccagaccagagctctg

SEQ ID NO: 2200134 - DNA, 19 bp, Homo sapiens
gccagaccagagctctgga

SEQ ID NO: 2200135 - DNA, 18 bp, Homo sapiens
gccagagcaaagggccag

SEQ ID NO: 2200136 - DNA, 21 bp, Homo sapiens
gccagattctcttgaataaag

SEQ ID NO: 2200137 - DNA, 22 bp, Homo sapiens
gccagccacagacccctgggag

SEQ ID NO: 2200138 - DNA, 15 bp, Homo sapiens
gccaggacagctgca

SEQ ID NO: 2200139 - DNA, 21 bp, Homo sapiens
gccaggacagctgcaggtgcc

SEQ ID NO: 2200140 - DNA, 16 bp, Homo sapiens
gctttgtagtttgctt

SEQ ID NO: 2200141 - DNA, 15 bp, Homo sapiens
gctttgtcccacagc

SEQ ID NO: 2200142 - DNA, 17 bp, Homo sapiens
gctttgtgcagggtcct

SEQ ID NO: 2200143 - DNA, 15 bp, Homo sapiens
ggaaaaacatgctta

SEQ ID NO: 2200144 - DNA, 22 bp, Homo sapiens
ggaaaacgtatcacctttccca

SEQ ID NO: 2200145 - DNA, 18 bp, Homo sapiens
ggaaaaggtccttgactt

SEQ ID NO: 2200146 - DNA, 18 bp, Homo sapiens
ggaaaagtgttccttgct

SEQ ID NO: 2200147 - DNA, 15 bp, Homo sapiens
ggaaacgtgccctct

SEQ ID NO: 2200148 - DNA, 23 bp, Homo sapiens
ggaaactttttccacctttctga

SEQ ID NO: 2200149 - DNA, 17 bp, Homo sapiens
ggaaagaagggggccct

SEQ ID NO: 2200150 - DNA, 19 bp, Homo sapiens
ggaaagaagggggccctgc

SEQ ID NO: 2200151 - DNA, 21 bp, Homo sapiens
ggaaagaagggggccctgcta

SEQ ID NO: 2200152 - DNA, 17 bp, Homo sapiens
ggaaatactcgttttta

SEQ ID NO: 2200153 - DNA, 17 bp, Homo sapiens
ggaaatttgggttttta

SEQ ID NO: 2200154 - DNA, 15 bp, Homo sapiens
ggaacactgtcaatg

SEQ ID NO: 2200155 - DNA, 13 bp, Homo sapiens
ggaacctggacca

SEQ ID NO: 2200156 - DNA, 19 bp, Homo sapiens
ggaacctggaccaaagctg

SEQ ID NO: 2200157 - DNA, 21 bp, Homo sapiens
ggaactcaaaggactgacctg

SEQ ID NO: 2200158 - DNA, 23 bp, Homo sapiens
ggaactcccaagaacagcaggcc

SEQ ID NO: 2200159 - DNA, 13 bp, Homo sapiens
ggaagagagcctg

SEQ ID NO: 2200160 - DNA, 14 bp, Homo sapiens
ggaagagagcctgc

SEQ ID NO: 2200161 - DNA, 21 bp, Homo sapiens
ggaagatggttttattctttg

SEQ ID NO: 2200162 - DNA, 23 bp, Homo sapiens
ggaagccacgtgctggagagtag

SEQ ID NO: 2200163 - DNA, 17 bp, Homo sapiens
ggaagcccatcctgacc

SEQ ID NO: 2200164 - DNA, 18 bp, Homo sapiens
ggaagcccatcctgacca

SEQ ID NO: 2200165 - DNA, 20 bp, Homo sapiens
ggaagcccatcctgaccagc

SEQ ID NO: 2200166 - DNA, 15 bp, Homo sapiens
ggaagccgtcctggc

SEQ ID NO: 2200167 - DNA, 13 bp, Homo sapiens
ggaagcctgctga

SEQ ID NO: 2200168 - DNA, 20 bp, Homo sapiens
ggaagctgttttgagccagg

SEQ ID NO: 2200169 - DNA, 14 bp, Homo sapiens
ggaaggagcctgcg

SEQ ID NO: 2200170 - DNA, 21 bp, Homo sapiens
ggaaggagcctgcggctgctg

SEQ ID NO: 2200171 - DNA, 17 bp, Homo sapiens
ggaaggggctggactgg

SEQ ID NO: 2200172 - DNA, 19 bp, Homo sapiens
ggaattcagtgccttcaac

SEQ ID NO: 2200173 - DNA, 17 bp, Homo sapiens
ggaattccaatatttat

SEQ ID NO: 2200174 - DNA, 23 bp, Homo sapiens
ggaatttcagctggagatactga

SEQ ID NO: 2200175 - DNA, 21 bp, Homo sapiens
ggacactggatccagaagcta

SEQ ID NO: 2200176 - DNA, 19 bp, Homo sapiens
ggacagcatggtgcatgcc

SEQ ID NO: 2200177 - DNA, 20 bp, Homo sapiens
ggacagctgcaggtgcccat

SEQ ID NO: 2200178 - DNA, 16 bp, Homo sapiens
ggacagctttcctggg

SEQ ID NO: 2200179 - DNA, 17 bp, Homo sapiens
ggacaggaccctcagga

SEQ ID NO: 2200180 - DNA, 16 bp, Homo sapiens
ggacatgttcccttct

SEQ ID NO: 2200181 - DNA, 18 bp, Homo sapiens
ggactcaatttctcccca

SEQ ID NO: 2200182 - DNA, 15 bp, Homo sapiens
ggactggctgtcctt

SEQ ID NO: 2200183 - DNA, 21 bp, Homo sapiens
ggactggctttgtcccacagc

SEQ ID NO: 2200184 - DNA, 16 bp, Homo sapiens
ggactgtcttgagaaa

SEQ ID NO: 2200185 - DNA, 10 bp, Homo sapiens
ggacttcaaa

SEQ ID NO: 2200186 - DNA, 20 bp, Homo sapiens
ggacttttgcagcttccttc

SEQ ID NO: 2200187 - DNA, 13 bp, Homo sapiens
ggagaaagagctg

SEQ ID NO: 2200188 - DNA, 18 bp, Homo sapiens
ggagaacagtggttgcct

SEQ ID NO: 2200189 - DNA, 14 bp, Homo sapiens
ggagaacatctgcc

SEQ ID NO: 2200190 - DNA, 19 bp, Homo sapiens
ggagaacatctgccttgct

SEQ ID NO: 2200191 - DNA, 15 bp, Homo sapiens
ggagaagaggaacat

SEQ ID NO: 2200192 - DNA, 22 bp, Homo sapiens
ggagaagcctgggtggctcagc

SEQ ID NO: 2200193 - DNA, 13 bp, Homo sapiens
ggagaaggagagg

SEQ ID NO: 2200194 - DNA, 14 bp, Homo sapiens
ggagaaggagaggc

SEQ ID NO: 2200195 - DNA, 22 bp, Homo sapiens
ggagacaatgcagatgccagag

SEQ ID NO: 2200196 - DNA, 18 bp, Homo sapiens
ggagagaccagcctttct

SEQ ID NO: 2200197 - DNA, 13 bp, Homo sapiens
ggagaggaagcca

SEQ ID NO: 2200198 - DNA, 15 bp, Homo sapiens
ggagaggctaacctc

SEQ ID NO: 2200199 - DNA, 19 bp, Homo sapiens
ggagaggctctgaaagctg

SEQ ID NO: 2200200 - DNA, 16 bp, Homo sapiens
ggagagggagcaagcc

SEQ ID NO: 2200201 - DNA, 21 bp, Homo sapiens
ggagatttcagttacttacct

SEQ ID NO: 2200202 - DNA, 17 bp, Homo sapiens
ggagcaggttccccaag

SEQ ID NO: 2200203 - DNA, 20 bp, Homo sapiens
ggagcaggttccccaagggc

SEQ ID NO: 2200204 - DNA, 15 bp, Homo sapiens
ggagcattttgtgtc

SEQ ID NO: 2200205 - DNA, 15 bp, Homo sapiens
ggagccacaggcaga

SEQ ID NO: 2200206 - DNA, 13 bp, Homo sapiens
ggagccacctgtc

SEQ ID NO: 2200207 - DNA, 18 bp, Homo sapiens
ggagccactaactagagc

SEQ ID NO: 2200208 - DNA, 16 bp, Homo sapiens
ggagcctgcggctgct

SEQ ID NO: 2200209 - DNA, 17 bp, Homo sapiens
ggagcctgcggctgctg

SEQ ID NO: 2200210 - DNA, 19 bp, Homo sapiens
ggagcctgtgcgtcccagc

SEQ ID NO: 2200211 - DNA, 21 bp, Homo sapiens
ggagcctgtgcgtcccagctg

SEQ ID NO: 2200212 - DNA, 15 bp, Homo sapiens
ggagctacagccagc

SEQ ID NO: 2200213 - DNA, 18 bp, Homo sapiens
ggagctgtaaaccagaga

SEQ ID NO: 2200214 - DNA, 15 bp, Homo sapiens
ggagcttacctccca

SEQ ID NO: 2200215 - DNA, 18 bp, Homo sapiens
ggagcttacctcccacct

SEQ ID NO: 2200216 - DNA, 13 bp, Homo sapiens
ggagcttccgctt

SEQ ID NO: 2200217 - DNA, 23 bp, Homo sapiens
ggaggacaaaggtgattttcctg

SEQ ID NO: 2200218 - DNA, 14 bp, Homo sapiens
ggaggacctctggg

SEQ ID NO: 2200219 - DNA, 13 bp, Homo sapiens
ggaggagcctgtg

SEQ ID NO: 2200220 - DNA, 22 bp, Homo sapiens
ggaggagcctgtgcgtcccagc

SEQ ID NO: 2200221 - DNA, 21 bp, Homo sapiens
ggaggcagaaagcagaggctg

SEQ ID NO: 2200222 - DNA, 13 bp, Homo sapiens
ggaggcattccca

SEQ ID NO: 2200223 - DNA, 22 bp, Homo sapiens
ggaggccacgggggaggccgag

SEQ ID NO: 2200224 - DNA, 13 bp, Homo sapiens
ggaggcccctggt

SEQ ID NO: 2200225 - DNA, 22 bp, Homo sapiens
ggaggcccttttctggctcctg

SEQ ID NO: 2200226 - DNA, 17 bp, Homo sapiens
ggaggcctcaccctgct

SEQ ID NO: 2200227 - DNA, 15 bp, Homo sapiens
ggaggcctctgggcc

SEQ ID NO: 2200228 - DNA, 14 bp, Homo sapiens
ggagggtcagtgcc

SEQ ID NO: 2200229 - DNA, 15 bp, Homo sapiens
ggagggtcagtgcca

SEQ ID NO: 2200230 - DNA, 20 bp, Homo sapiens
ggagggtggcacttcgtgga

SEQ ID NO: 2200231 - DNA, 13 bp, Homo sapiens
ggagggtgggaag

SEQ ID NO: 2200232 - DNA, 14 bp, Homo sapiens
ggaggtctccaggg

SEQ ID NO: 2200233 - DNA, 16 bp, Homo sapiens
ggaggtctccaggggc

SEQ ID NO: 2200234 - DNA, 19 bp, Homo sapiens
ggaggtggaggttgcagtg

SEQ ID NO: 2200235 - DNA, 20 bp, Homo sapiens
ggaggtggaggttgcagtga

SEQ ID NO: 2200236 - DNA, 12 bp, Homo sapiens
ggaggtggcagc

SEQ ID NO: 2200237 - DNA, 15 bp, Homo sapiens
ggagtcaagtgtgga

SEQ ID NO: 2200238 - DNA, 13 bp, Homo sapiens
ggagtgggagagg

SEQ ID NO: 2200239 - DNA, 14 bp, Homo sapiens
ggagtgggagagga

SEQ ID NO: 2200240 - DNA, 22 bp, Homo sapiens
ggatcagaaagagttcagtaag

SEQ ID NO: 2200241 - DNA, 12 bp, Homo sapiens
ggatcctgctgg

SEQ ID NO: 2200242 - DNA, 13 bp, Homo sapiens
ggatcctgctggg

SEQ ID NO: 2200243 - DNA, 17 bp, Homo sapiens
ggatctatcacctgtca

SEQ ID NO: 2200244 - DNA, 20 bp, Homo sapiens
ggatctatcacctgtcatca

SEQ ID NO: 2200245 - DNA, 18 bp, Homo sapiens
ggatgagaaacagctcag

SEQ ID NO: 2200246 - DNA, 23 bp, Homo sapiens
ggatgagaaacagctcagccagt

SEQ ID NO: 2200247 - DNA, 23 bp, Homo sapiens
ggatgagtacccaaaagctcagc

SEQ ID NO: 2200248 - DNA, 18 bp, Homo sapiens
ggatgccataccttgaga

SEQ ID NO: 2200249 - DNA, 14 bp, Homo sapiens
ggatggggccacag

SEQ ID NO: 2200250 - DNA, 15 bp, Homo sapiens
ggatggggccacagc

SEQ ID NO: 2200251 - DNA, 22 bp, Homo sapiens
ggcaaagctgatttttttttta

SEQ ID NO: 2200252 - DNA, 16 bp, Homo sapiens
ggcaagctaggcccca

SEQ ID NO: 2200253 - DNA, 22 bp, Homo sapiens
ggcaagctaggccccagaggcc

SEQ ID NO: 2200254 - DNA, 17 bp, Homo sapiens
ggcaaggggtgcctggg

SEQ ID NO: 2200255 - DNA, 18 bp, Homo sapiens
ggcaatctattaatagct

SEQ ID NO: 2200256 - DNA, 14 bp, Homo sapiens
ggcaattagagaaa

SEQ ID NO: 2200257 - DNA, 18 bp, Homo sapiens
ggcaattattttggatct

SEQ ID NO: 2200258 - DNA, 21 bp, Homo sapiens
ggcacagacttcacacagcac

SEQ ID NO: 2200259 - DNA, 17 bp, Homo sapiens
ggcacagccggggcctg

SEQ ID NO: 2200260 - DNA, 21 bp, Homo sapiens
ggcacagccggggcctgccta

SEQ ID NO: 2200261 - DNA, 23 bp, Homo sapiens
ggcacagccggggcctgcctagc

SEQ ID NO: 2200262 - DNA, 20 bp, Homo sapiens
gtcctgaggcagaacctggt

SEQ ID NO: 2200263 - DNA, 22 bp, Homo sapiens
gtcctgaggcagaacctggtgg

SEQ ID NO: 2200264 - DNA, 14 bp, Homo sapiens
gtcctgcagagctg

SEQ ID NO: 2200265 - DNA, 17 bp, Homo sapiens
gtcctgcagagctgggg

SEQ ID NO: 2200266 - DNA, 23 bp, Homo sapiens
gtcctgctctctacccagcccat

SEQ ID NO: 2200267 - DNA, 21 bp, Homo sapiens
gtcctgctggtgaccggcctg

SEQ ID NO: 2200268 - DNA, 16 bp, Homo sapiens
gtcctgtctcccctct

SEQ ID NO: 2200269 - DNA, 17 bp, Homo sapiens
gtcctgtctcccctctg

SEQ ID NO: 2200270 - DNA, 20 bp, Homo sapiens
gtcctgtgtaaattagtgta

SEQ ID NO: 2200271 - DNA, 20 bp, Homo sapiens
gtccttcccacggccactgc

SEQ ID NO: 2200272 - DNA, 21 bp, Homo sapiens
gtccttctcctcttgtagcca

SEQ ID NO: 2200273 - DNA, 22 bp, Homo sapiens
gtcctttccagtggcctggctc

SEQ ID NO: 2200274 - DNA, 23 bp, Homo sapiens
gtcctttccagtggcctggctcc

SEQ ID NO: 2200275 - DNA, 14 bp, Homo sapiens
gtcgacaagaatgt

SEQ ID NO: 2200276 - DNA, 17 bp, Homo sapiens
gtcgttgactttaggga

SEQ ID NO: 2200277 - DNA, 13 bp, Homo sapiens
gtcgtttgaccac

SEQ ID NO: 2200278 - DNA, 13 bp, Homo sapiens
gtctaccatctcc

SEQ ID NO: 2200279 - DNA, 14 bp, Homo sapiens
gtctaccatctccc

SEQ ID NO: 2200280 - DNA, 14 bp, Homo sapiens
gtctagcaaagcca

SEQ ID NO: 2200281 - DNA, 23 bp, Homo sapiens
gtctagtggaaagattgtgtctg

SEQ ID NO: 2200282 - DNA, 13 bp, Homo sapiens
gtctcaggaggag

SEQ ID NO: 2200283 - DNA, 16 bp, Homo sapiens
gtctcagtctgtcacc

SEQ ID NO: 2200284 - DNA, 16 bp, Homo sapiens
gtctcattttgtatgt

SEQ ID NO: 2200285 - DNA, 20 bp, Homo sapiens
gtctcattttgtatgtatgt

SEQ ID NO: 2200286 - DNA, 12 bp, Homo sapiens
gtctcccctcgt

SEQ ID NO: 2200287 - DNA, 16 bp, Homo sapiens
gtctcctgagggtcct

SEQ ID NO: 2200288 - DNA, 14 bp, Homo sapiens
gtctctccctgggg

SEQ ID NO: 2200289 - DNA, 13 bp, Homo sapiens
gtctcttcccctc

SEQ ID NO: 2200290 - DNA, 16 bp, Homo sapiens
gtctgccgtgagagcc

SEQ ID NO: 2200291 - DNA, 11 bp, Homo sapiens
gtctgctgctc

SEQ ID NO: 2200292 - DNA, 16 bp, Homo sapiens
gtctgctgctcccagc

SEQ ID NO: 2200293 - DNA, 17 bp, Homo sapiens
gtctgggagaggcagag

SEQ ID NO: 2200294 - DNA, 15 bp, Homo sapiens
gtctgggaggcaggt

SEQ ID NO: 2200295 - DNA, 14 bp, Homo sapiens
gtctgggggtcagg

SEQ ID NO: 2200296 - DNA, 13 bp, Homo sapiens
gtctgtcacccag

SEQ ID NO: 2200297 - DNA, 22 bp, Homo sapiens
gtctgtttccttctctttctcc

SEQ ID NO: 2200298 - DNA, 15 bp, Homo sapiens
gtcttcaagggctgc

SEQ ID NO: 2200299 - DNA, 15 bp, Homo sapiens
gtcttcaatctctgt

SEQ ID NO: 2200300 - DNA, 20 bp, Homo sapiens
gtcttcaatctctgttctgc

SEQ ID NO: 2200301 - DNA, 14 bp, Homo sapiens
gtcttcagatcctg

SEQ ID NO: 2200302 - DNA, 18 bp, Homo sapiens
gtcttccctagggctggg

SEQ ID NO: 2200303 - DNA, 19 bp, Homo sapiens
gtcttccctagggctgggt

SEQ ID NO: 2200304 - DNA, 20 bp, Homo sapiens
gtcttccctagggctgggtg

SEQ ID NO: 2200305 - DNA, 10 bp, Homo sapiens
gtcttcctcc

SEQ ID NO: 2200306 - DNA, 12 bp, Homo sapiens
gtcttctcccca

SEQ ID NO: 2200307 - DNA, 14 bp, Homo sapiens
gtcttcttcagggt

SEQ ID NO: 2200308 - DNA, 17 bp, Homo sapiens
gtcttgatgactgctga

SEQ ID NO: 2200309 - DNA, 16 bp, Homo sapiens
gtcttgtaccttgagt

SEQ ID NO: 2200310 - DNA, 17 bp, Homo sapiens
gtcttgtactgtgacct

SEQ ID NO: 2200311 - DNA, 23 bp, Homo sapiens
gtctttgtaagtaaactgccctg

SEQ ID NO: 2200312 - DNA, 14 bp, Homo sapiens
gtctttgtgtgctg

SEQ ID NO: 2200313 - DNA, 20 bp, Homo sapiens
gtgaaaagagaggatatgtt

SEQ ID NO: 2200314 - DNA, 20 bp, Homo sapiens
gtgaaatcttttatgtttct

SEQ ID NO: 2200315 - DNA, 20 bp, Homo sapiens
gtgaagcaatcatttcccct

SEQ ID NO: 2200316 - DNA, 17 bp, Homo sapiens
gtgaagtatgcactaat

SEQ ID NO: 2200317 - DNA, 23 bp, Homo sapiens
gtgaatctgcattttctgggttc

SEQ ID NO: 2200318 - DNA, 20 bp, Homo sapiens
gtgacacagctgagctggcc

SEQ ID NO: 2200319 - DNA, 23 bp, Homo sapiens
gtgacccacccgccttggcctcc

SEQ ID NO: 2200320 - DNA, 15 bp, Homo sapiens
gtgacctaagaacaa

SEQ ID NO: 2200321 - DNA, 19 bp, Homo sapiens
gtgacgggggttggggtgg

SEQ ID NO: 2200322 - DNA, 19 bp, Homo sapiens
gtgactgatgttaggctgg

SEQ ID NO: 2200323 - DNA, 19 bp, Homo sapiens
gtgacttttagacagtggt

SEQ ID NO: 2200324 - DNA, 18 bp, Homo sapiens
gtgagaaagggaagaatt

SEQ ID NO: 2200325 - DNA, 15 bp, Homo sapiens
gtgagaaattttagt

SEQ ID NO: 2200326 - DNA, 12 bp, Homo sapiens
gtgagagaaaga

SEQ ID NO: 2200327 - DNA, 13 bp, Homo sapiens
gtgagagaaagag

SEQ ID NO: 2200328 - DNA, 17 bp, Homo sapiens
gtgagagaaagagagaa

SEQ ID NO: 2200329 - DNA, 18 bp, Homo sapiens
gtgagagaaagagagaag

SEQ ID NO: 2200330 - DNA, 20 bp, Homo sapiens
gtgagagaaagagagaagcc

SEQ ID NO: 2200331 - DNA, 21 bp, Homo sapiens
gtgagagaaagagagaagcca

SEQ ID NO: 2200332 - DNA, 22 bp, Homo sapiens
gtgagcatgaaactatgcacct

SEQ ID NO: 2200333 - DNA, 15 bp, Homo sapiens
gtgagctcaggagag

SEQ ID NO: 2200334 - DNA, 16 bp, Homo sapiens
gtgagctcaggagaga

SEQ ID NO: 2200335 - DNA, 16 bp, Homo sapiens
gtgaggaagctccagt

SEQ ID NO: 2200336 - DNA, 15 bp, Homo sapiens
gtgatcgcacaagga

SEQ ID NO: 2200337 - DNA, 17 bp, Homo sapiens
gtgatcgcacaaggaca

SEQ ID NO: 2200338 - DNA, 12 bp, Homo sapiens
gtgatctgggaa

SEQ ID NO: 2200339 - DNA, 12 bp, Homo sapiens
gtgatggcatta

SEQ ID NO: 2200340 - DNA, 19 bp, Homo sapiens
gtgatggcattactctgca

SEQ ID NO: 2200341 - DNA, 23 bp, Homo sapiens
gtgattactctttgctttgtagt

SEQ ID NO: 2200342 - DNA, 21 bp, Homo sapiens
gtgcaaaaagctgagtatggt

SEQ ID NO: 2200343 - DNA, 18 bp, Homo sapiens
gtgcaaagctgcttgaat

SEQ ID NO: 2200344 - DNA, 14 bp, Homo sapiens
gtgcaagcaaagca

SEQ ID NO: 2200345 - DNA, 17 bp, Homo sapiens
gtgcagaaactaccaga

SEQ ID NO: 2200346 - DNA, 20 bp, Homo sapiens
gtgcagcggtggaaggagcc

SEQ ID NO: 2200347 - DNA, 16 bp, Homo sapiens
gtgcaggcagccttga

SEQ ID NO: 2200348 - DNA, 22 bp, Homo sapiens
gtgcagttacgttgcatccaca

SEQ ID NO: 2200349 - DNA, 19 bp, Homo sapiens
gtgcatgcaaaccaggagc

SEQ ID NO: 2200350 - DNA, 23 bp, Homo sapiens
gtgccaaccacctctggccctgt

SEQ ID NO: 2200351 - DNA, 15 bp, Homo sapiens
gtgccaccaccctgc

SEQ ID NO: 2200352 - DNA, 15 bp, Homo sapiens
gtgccaccctctgca

SEQ ID NO: 2200353 - DNA, 23 bp, Homo sapiens
gtgccaccctctgcagggcagcc

SEQ ID NO: 2200354 - DNA, 14 bp, Homo sapiens
gtgcccacagcccg

SEQ ID NO: 2200355 - DNA, 14 bp, Homo sapiens
gtgccccacctgcc

SEQ ID NO: 2200356 - DNA, 15 bp, Homo sapiens
gtgccctccactgcc

SEQ ID NO: 2200357 - DNA, 14 bp, Homo sapiens
gtgcctatagaaaa

SEQ ID NO: 2200358 - DNA, 16 bp, Homo sapiens
gtgcctatttattcat

SEQ ID NO: 2200359 - DNA, 21 bp, Homo sapiens
gtgcctctggaggcctctggg

SEQ ID NO: 2200360 - DNA, 16 bp, Homo sapiens
gtgcctcttgggagac

SEQ ID NO: 2200361 - DNA, 21 bp, Homo sapiens
gtgcctgcattcgcagcagct

SEQ ID NO: 2200362 - DNA, 17 bp, Homo sapiens
gtgcctggagctcctgg

SEQ ID NO: 2200363 - DNA, 23 bp, Homo sapiens
gtgcgatcatggctcactgcagc

SEQ ID NO: 2200364 - DNA, 18 bp, Homo sapiens
gtgctgaactgtgcatca

SEQ ID NO: 2200365 - DNA, 17 bp, Homo sapiens
gtgctgctgtggcatca

SEQ ID NO: 2200366 - DNA, 15 bp, Homo sapiens
gtgctggagccacta

SEQ ID NO: 2200367 - DNA, 17 bp, Homo sapiens
gtgcttcccaaatacat

SEQ ID NO: 2200368 - DNA, 19 bp, Homo sapiens
gtgctttctatctaatttt

SEQ ID NO: 2200369 - DNA, 19 bp, Homo sapiens
gtgcttttgcaaaagaagt

SEQ ID NO: 2200370 - DNA, 12 bp, Homo sapiens
gtggaaggagcc

SEQ ID NO: 2200371 - DNA, 16 bp, Homo sapiens
gtggacacacacagac

SEQ ID NO: 2200372 - DNA, 14 bp, Homo sapiens
gtggacggcagacc

SEQ ID NO: 2200373 - DNA, 23 bp, Homo sapiens
gtggagaacaaagaccaatgtga

SEQ ID NO: 2200374 - DNA, 18 bp, Homo sapiens
gtggagagaccagccttt

SEQ ID NO: 2200375 - DNA, 23 bp, Homo sapiens
gtggagagaccagcctttcttcc

SEQ ID NO: 2200376 - DNA, 14 bp, Homo sapiens
gtggagaggagaga

SEQ ID NO: 2200377 - DNA, 18 bp, Homo sapiens
gtggagccacaggcagac

SEQ ID NO: 2200378 - DNA, 14 bp, Homo sapiens
gtggatagatgccc

SEQ ID NO: 2200379 - DNA, 22 bp, Homo sapiens
gtggcagaaatcccagttcatg

SEQ ID NO: 2200380 - DNA, 23 bp, Homo sapiens
gtggcagaaatcccagttcatgt

SEQ ID NO: 2200381 - DNA, 17 bp, Homo sapiens
gtggccaagaagcagtg

SEQ ID NO: 2200382 - DNA, 22 bp, Homo sapiens
gtggccaagaagcagtggcctt

SEQ ID NO: 2200383 - DNA, 18 bp, Homo sapiens
gtggccagaccagagctc

SEQ ID NO: 2200384 - DNA, 14 bp, Homo sapiens
tatagaaccatgaa

SEQ ID NO: 2200385 - DNA, 14 bp, Homo sapiens
tatagattctttat

SEQ ID NO: 2200386 - DNA, 11 bp, Homo sapiens
tatagccattt

SEQ ID NO: 2200387 - DNA, 17 bp, Homo sapiens
tatagccatttgcccca

SEQ ID NO: 2200388 - DNA, 16 bp, Homo sapiens
tatagtacctttgctc

SEQ ID NO: 2200389 - DNA, 20 bp, Homo sapiens
tatagtacctttgctcttgc

SEQ ID NO: 2200390 - DNA, 12 bp, Homo sapiens
tatataaagtta

SEQ ID NO: 2200391 - DNA, 21 bp, Homo sapiens
tatataatacttaaaaatatg

SEQ ID NO: 2200392 - DNA, 20 bp, Homo sapiens
tatatatgtagccagacagt

SEQ ID NO: 2200393 - DNA, 16 bp, Homo sapiens
tatatgatttgcatgt

SEQ ID NO: 2200394 - DNA, 12 bp, Homo sapiens
tatattattata

SEQ ID NO: 2200395 - DNA, 16 bp, Homo sapiens
tatattcaaaaattat

SEQ ID NO: 2200396 - DNA, 16 bp, Homo sapiens
tatattcatacctgtt

SEQ ID NO: 2200397 - DNA, 24 bp, Homo sapiens
tatattctttccatgcagttatta

SEQ ID NO: 2200398 - DNA, 14 bp, Homo sapiens
tatattgtaattta

SEQ ID NO: 2200399 - DNA, 14 bp, Homo sapiens
tatatttttctatg

SEQ ID NO: 2200400 - DNA, 15 bp, Homo sapiens
tatatttttctatga

SEQ ID NO: 2200401 - DNA, 18 bp, Homo sapiens
tatcaaacagctcaggct

SEQ ID NO: 2200402 - DNA, 12 bp, Homo sapiens
tatcaacactgc

SEQ ID NO: 2200403 - DNA, 19 bp, Homo sapiens
tatcaatatggtgtcttga

SEQ ID NO: 2200404 - DNA, 12 bp, Homo sapiens
tatcacctgtca

SEQ ID NO: 2200405 - DNA, 15 bp, Homo sapiens
tatcacctgtcatca

SEQ ID NO: 2200406 - DNA, 11 bp, Homo sapiens
tatcactttgt

SEQ ID NO: 2200407 - DNA, 12 bp, Homo sapiens
tatcactttgta

SEQ ID NO: 2200408 - DNA, 13 bp, Homo sapiens
tatcactttgtat

SEQ ID NO: 2200409 - DNA, 14 bp, Homo sapiens
tatcagaaatgaaa

SEQ ID NO: 2200410 - DNA, 18 bp, Homo sapiens
tatcagaaatgaaacaga

SEQ ID NO: 2200411 - DNA, 15 bp, Homo sapiens
tatcatcccaacagc

SEQ ID NO: 2200412 - DNA, 21 bp, Homo sapiens
tatcattaatgtaggtttaga

SEQ ID NO: 2200413 - DNA, 17 bp, Homo sapiens
tatccatgttgctgact

SEQ ID NO: 2200414 - DNA, 16 bp, Homo sapiens
tatccctgcacacggc

SEQ ID NO: 2200415 - DNA, 18 bp, Homo sapiens
tatcctgaaacagtgttt

SEQ ID NO: 2200416 - DNA, 13 bp, Homo sapiens
tatctaattttta

SEQ ID NO: 2200417 - DNA, 18 bp, Homo sapiens
tatctaatttttattaat

SEQ ID NO: 2200418 - DNA, 20 bp, Homo sapiens
tatctacctgccctctctca

SEQ ID NO: 2200419 - DNA, 14 bp, Homo sapiens
tatctcgaagtctt

SEQ ID NO: 2200420 - DNA, 15 bp, Homo sapiens
tatctcgaagtcttc

SEQ ID NO: 2200421 - DNA, 17 bp, Homo sapiens
tatctctttatatatgt

SEQ ID NO: 2200422 - DNA, 19 bp, Homo sapiens
tatctgagtcacttgaaac

SEQ ID NO: 2200423 - DNA, 15 bp, Homo sapiens
tatctgatatctgtt

SEQ ID NO: 2200424 - DNA, 15 bp, Homo sapiens
tatcttcttaacagt

SEQ ID NO: 2200425 - DNA, 13 bp, Homo sapiens
tatgacaagcaag

SEQ ID NO: 2200426 - DNA, 12 bp, Homo sapiens
tatgacatttct

SEQ ID NO: 2200427 - DNA, 22 bp, Homo sapiens
tatgagatgtagcaaattccaa

SEQ ID NO: 2200428 - DNA, 20 bp, Homo sapiens
tatgagctgatttggtcacc

SEQ ID NO: 2200429 - DNA, 19 bp, Homo sapiens
tatgagtgcaagcaaagca

SEQ ID NO: 2200430 - DNA, 20 bp, Homo sapiens
tatgataaacagttgaataa

SEQ ID NO: 2200431 - DNA, 14 bp, Homo sapiens
tatgatttgcatgt

SEQ ID NO: 2200432 - DNA, 17 bp, Homo sapiens
tatgcacctataaatac

SEQ ID NO: 2200433 - DNA, 17 bp, Homo sapiens
tatgcactaatcaatac

SEQ ID NO: 2200434 - DNA, 14 bp, Homo sapiens
tatgccacctgcag

SEQ ID NO: 2200435 - DNA, 15 bp, Homo sapiens
tatgccacctgcagc

SEQ ID NO: 2200436 - DNA, 21 bp, Homo sapiens
tatggatggggcccaggggct

SEQ ID NO: 2200437 - DNA, 15 bp, Homo sapiens
tatggattttctaag

SEQ ID NO: 2200438 - DNA, 19 bp, Homo sapiens
tatggcatattgataataa

SEQ ID NO: 2200439 - DNA, 19 bp, Homo sapiens
tatgggttttgcttaaaga

SEQ ID NO: 2200440 - DNA, 15 bp, Homo sapiens
tatggtgccaatgga

SEQ ID NO: 2200441 - DNA, 19 bp, Homo sapiens
tatggtgccaatggaacct

SEQ ID NO: 2200442 - DNA, 21 bp, Homo sapiens
tatgtaattattttctttttg

SEQ ID NO: 2200443 - DNA, 12 bp, Homo sapiens
tatgtatgtgta

SEQ ID NO: 2200444 - DNA, 16 bp, Homo sapiens
tatgtatgtgtagtgt

SEQ ID NO: 2200445 - DNA, 19 bp, Homo sapiens
tatgtattatttacattta

SEQ ID NO: 2200446 - DNA, 13 bp, Homo sapiens
tatgtatttgttg

SEQ ID NO: 2200447 - DNA, 18 bp, Homo sapiens
tatgtgagcatgaaacta

SEQ ID NO: 2200448 - DNA, 17 bp, Homo sapiens
tatgtggtggtttctat

SEQ ID NO: 2200449 - DNA, 20 bp, Homo sapiens
tatgtgtagtgtgtttgtga

SEQ ID NO: 2200450 - DNA, 16 bp, Homo sapiens
tattaaaaattaattc

SEQ ID NO: 2200451 - DNA, 13 bp, Homo sapiens
tattaaaaattga

SEQ ID NO: 2200452 - DNA, 14 bp, Homo sapiens
tattaagaactata

SEQ ID NO: 2200453 - DNA, 16 bp, Homo sapiens
tattaaggaaaaaagc

SEQ ID NO: 2200454 - DNA, 17 bp, Homo sapiens
tattaaggaaaaaagca

SEQ ID NO: 2200455 - DNA, 18 bp, Homo sapiens
tattaatataagtttctt

SEQ ID NO: 2200456 - DNA, 16 bp, Homo sapiens
tattacacattaaagt

SEQ ID NO: 2200457 - DNA, 12 bp, Homo sapiens
tattagccaact

SEQ ID NO: 2200458 - DNA, 21 bp, Homo sapiens
tattagtcttggggcaggatg

SEQ ID NO: 2200459 - DNA, 20 bp, Homo sapiens
tattagtgaagtatgcacta

SEQ ID NO: 2200460 - DNA, 14 bp, Homo sapiens
tattatctgggctt

SEQ ID NO: 2200461 - DNA, 18 bp, Homo sapiens
tattatcttcttaacagt

SEQ ID NO: 2200462 - DNA, 19 bp, Homo sapiens
tattattaaatcagttttg

SEQ ID NO: 2200463 - DNA, 14 bp, Homo sapiens
tattattactgttt

SEQ ID NO: 2200464 - DNA, 15 bp, Homo sapiens
tattattataatctt

SEQ ID NO: 2200465 - DNA, 21 bp, Homo sapiens
tattcacttgtgtttgtatat

SEQ ID NO: 2200466 - DNA, 12 bp, Homo sapiens
tattcagagcca

SEQ ID NO: 2200467 - DNA, 18 bp, Homo sapiens
tattcagatgttggtctt

SEQ ID NO: 2200468 - DNA, 17 bp, Homo sapiens
tattcatacctgttgta

SEQ ID NO: 2200469 - DNA, 20 bp, Homo sapiens
tattcatagctgtatatttg

SEQ ID NO: 2200470 - DNA, 23 bp, Homo sapiens
tattcccatggtagactgtgaca

SEQ ID NO: 2200471 - DNA, 14 bp, Homo sapiens
tattctacttttaa

SEQ ID NO: 2200472 - DNA, 18 bp, Homo sapiens
tattctctgtccagggct

SEQ ID NO: 2200473 - DNA, 19 bp, Homo sapiens
tattctctgtccagggctt

SEQ ID NO: 2200474 - DNA, 17 bp, Homo sapiens
tattctgggcaaataga

SEQ ID NO: 2200475 - DNA, 20 bp, Homo sapiens
tattcttcggaggaggtgga

SEQ ID NO: 2200476 - DNA, 21 bp, Homo sapiens
tattgagcccaaaaacaagca

SEQ ID NO: 2200477 - DNA, 14 bp, Homo sapiens
tattgataataaaa

SEQ ID NO: 2200478 - DNA, 13 bp, Homo sapiens
tattgatttctgc

SEQ ID NO: 2200479 - DNA, 21 bp, Homo sapiens
tattgcagttcatactgaatg

SEQ ID NO: 2200480 - DNA, 23 bp, Homo sapiens
tattgcagttcatactgaatgac

SEQ ID NO: 2200481 - DNA, 20 bp, Homo sapiens
tattgctctatatgtaatat

SEQ ID NO: 2200482 - DNA, 16 bp, Homo sapiens
tattggacttccattt

SEQ ID NO: 2200483 - DNA, 17 bp, Homo sapiens
tattggacttccatttg

SEQ ID NO: 2200484 - DNA, 14 bp, Homo sapiens
tattggtgtgaatg

SEQ ID NO: 2200485 - DNA, 17 bp, Homo sapiens
tattgtaccaaagctgt

SEQ ID NO: 2200486 - DNA, 14 bp, Homo sapiens
tattgtgaaatttg

SEQ ID NO: 2200487 - DNA, 20 bp, Homo sapiens
tattgttaatattaatttat

SEQ ID NO: 2200488 - DNA, 12 bp, Homo sapiens
tatttaacagaa

SEQ ID NO: 2200489 - DNA, 14 bp, Homo sapiens
tatttaacagaaat

SEQ ID NO: 2200490 - DNA, 16 bp, Homo sapiens
tatttaacagaaattg

SEQ ID NO: 2200491 - DNA, 21 bp, Homo sapiens
tatttataacaatgttaaatg

SEQ ID NO: 2200492 - DNA, 18 bp, Homo sapiens
tatttataattaaagaaa

SEQ ID NO: 2200493 - DNA, 17 bp, Homo sapiens
tatttattagccaactg

SEQ ID NO: 2200494 - DNA, 18 bp, Homo sapiens
tatttattagccaactgt

SEQ ID NO: 2200495 - DNA, 13 bp, Homo sapiens
tatttattcattc

SEQ ID NO: 2200496 - DNA, 15 bp, Homo sapiens
tatttattcattcag

SEQ ID NO: 2200497 - DNA, 18 bp, Homo sapiens
tatttatttttgtactgt

SEQ ID NO: 2200498 - DNA, 19 bp, Homo sapiens
tatttatttttgtactgtg

SEQ ID NO: 2200499 - DNA, 15 bp, Homo sapiens
tatttcagtgatttt

SEQ ID NO: 2200500 - DNA, 14 bp, Homo sapiens
tatttccatattaa

SEQ ID NO: 2200501 - DNA, 16 bp, Homo sapiens
tatttggagtggaggc

SEQ ID NO: 2200502 - DNA, 14 bp, Homo sapiens
tattttctttctag

SEQ ID NO: 2200503 - DNA, 12 bp, Homo sapiens
tattttgaacaa

SEQ ID NO: 2200504 - DNA, 19 bp, Homo sapiens
tattttggacgtgtgagga

SEQ ID NO: 2200505 - DNA, 12 bp, Homo sapiens
tatttttattga

SEQ ID NO: 2200506 - DNA, 18 bp, Homo sapiens
tatttttatttatttttg

SEQ ID NO: 2200507 - DNA, 15 bp, Homo sapiens
tatttttttgttgct

SEQ ID NO: 2200508 - DNA, 14 bp, Homo sapiens
tctatcacctgtca

SEQ ID NO: 2200509 - DNA, 16 bp, Homo sapiens
tctatcacctgtcatc

SEQ ID NO: 2200510 - DNA, 14 bp, Homo sapiens
tctatccccaagct

SEQ ID NO: 2200511 - DNA, 16 bp, Homo sapiens
tctatccccaagctgg

SEQ ID NO: 2200512 - DNA, 17 bp, Homo sapiens
tctatccccaagctggc

SEQ ID NO: 2200513 - DNA, 18 bp, Homo sapiens
tctatgtgaatatttgta

SEQ ID NO: 2200514 - DNA, 20 bp, Homo sapiens
tctatgtgaatatttgtaaa

SEQ ID NO: 2200515 - DNA, 20 bp, Homo sapiens
tctatttcttttttaagtca

SEQ ID NO: 2200516 - DNA, 14 bp, Homo sapiens
tctcaaaatgtgaa

SEQ ID NO: 2200517 - DNA, 14 bp, Homo sapiens
tctcaagcactgac

SEQ ID NO: 2200518 - DNA, 20 bp, Homo sapiens
tctcatagcaggaaatgtag

SEQ ID NO: 2200519 - DNA, 16 bp, Homo sapiens
tctcatcactcccctc

SEQ ID NO: 2200520 - DNA, 19 bp, Homo sapiens
tctcatcactcccctccaa

SEQ ID NO: 2200521 - DNA, 17 bp, Homo sapiens
tctcattttgtatgtat

SEQ ID NO: 2200522 - DNA, 18 bp, Homo sapiens
tctcattttgtatgtatg

SEQ ID NO: 2200523 - DNA, 22 bp, Homo sapiens
tctccacagggacacagtctgg

SEQ ID NO: 2200524 - DNA, 12 bp, Homo sapiens
tctccaggggcc

SEQ ID NO: 2200525 - DNA, 19 bp, Homo sapiens
tctcccagaggctcctgga

SEQ ID NO: 2200526 - DNA, 21 bp, Homo sapiens
tctcccagaggctcctggagc

SEQ ID NO: 2200527 - DNA, 16 bp, Homo sapiens
tctcccctctgctggc

SEQ ID NO: 2200528 - DNA, 19 bp, Homo sapiens
tctccctatgttgcccagg

SEQ ID NO: 2200529 - DNA, 11 bp, Homo sapiens
tctcctctgtc

SEQ ID NO: 2200530 - DNA, 12 bp, Homo sapiens
tctcctctgtcc

SEQ ID NO: 2200531 - DNA, 23 bp, Homo sapiens
tctcctgccctgccctcctgccc

SEQ ID NO: 2200532 - DNA, 21 bp, Homo sapiens
tctcctgcctcagcctcccga

SEQ ID NO: 2200533 - DNA, 15 bp, Homo sapiens
tctcctgtatcattt

SEQ ID NO: 2200534 - DNA, 10 bp, Homo sapiens
tctcctgtgc

SEQ ID NO: 2200535 - DNA, 13 bp, Homo sapiens
tctcctgtgccca

SEQ ID NO: 2200536 - DNA, 11 bp, Homo sapiens
tctccttccaa

SEQ ID NO: 2200537 - DNA, 15 bp, Homo sapiens
tctccttccaactgc

SEQ ID NO: 2200538 - DNA, 16 bp, Homo sapiens
tctccttccaactgct

SEQ ID NO: 2200539 - DNA, 14 bp, Homo sapiens
tctccttcctcaga

SEQ ID NO: 2200540 - DNA, 17 bp, Homo sapiens
tctccttcgctttcctg

SEQ ID NO: 2200541 - DNA, 18 bp, Homo sapiens
tctccttcgctttcctga

SEQ ID NO: 2200542 - DNA, 17 bp, Homo sapiens
tctcctttaattgtaaa

SEQ ID NO: 2200543 - DNA, 22 bp, Homo sapiens
tctcctttaattgtaaagtaaa

SEQ ID NO: 2200544 - DNA, 16 bp, Homo sapiens
tctccttttccttacc

SEQ ID NO: 2200545 - DNA, 15 bp, Homo sapiens
tctcgaagtcttcca

SEQ ID NO: 2200546 - DNA, 21 bp, Homo sapiens
tctcgaagtcttccatcagca

SEQ ID NO: 2200547 - DNA, 22 bp, Homo sapiens
tctcgaagtcttccatcagcag

SEQ ID NO: 2200548 - DNA, 13 bp, Homo sapiens
tctcgttggtagt

SEQ ID NO: 2200549 - DNA, 12 bp, Homo sapiens
tctctacccagc

SEQ ID NO: 2200550 - DNA, 13 bp, Homo sapiens
tctctactggtag

SEQ ID NO: 2200551 - DNA, 23 bp, Homo sapiens
tctctactggtaggaagaggtac

SEQ ID NO: 2200552 - DNA, 17 bp, Homo sapiens
tctctagttccctcagt

SEQ ID NO: 2200553 - DNA, 21 bp, Homo sapiens
tctctatctctttatatatgt

SEQ ID NO: 2200554 - DNA, 20 bp, Homo sapiens
tctctcaatttgggtcccag

SEQ ID NO: 2200555 - DNA, 20 bp, Homo sapiens
tctctccagtgtgtgtaaca

SEQ ID NO: 2200556 - DNA, 18 bp, Homo sapiens
tctctcttgctttgttct

SEQ ID NO: 2200557 - DNA, 14 bp, Homo sapiens
tctctggagtgtgt

SEQ ID NO: 2200558 - DNA, 15 bp, Homo sapiens
tctctgtctaccatc

SEQ ID NO: 2200559 - DNA, 14 bp, Homo sapiens
tctctgtgctctga

SEQ ID NO: 2200560 - DNA, 15 bp, Homo sapiens
tctcttacccttctg

SEQ ID NO: 2200561 - DNA, 17 bp, Homo sapiens
tctcttcccctctcaga

SEQ ID NO: 2200562 - DNA, 13 bp, Homo sapiens
tctcttctctgtt

SEQ ID NO: 2200563 - DNA, 22 bp, Homo sapiens
tctctttttttaaaaagttgat

SEQ ID NO: 2200564 - DNA, 14 bp, Homo sapiens
tctgaaaaactaaa

SEQ ID NO: 2200565 - DNA, 12 bp, Homo sapiens
tctgaaaacaat

SEQ ID NO: 2200566 - DNA, 15 bp, Homo sapiens
tctgaaagctgcttc

SEQ ID NO: 2200567 - DNA, 13 bp, Homo sapiens
tctgaacaaaagc

SEQ ID NO: 2200568 - DNA, 18 bp, Homo sapiens
tctgaactgcacaatgca

SEQ ID NO: 2200569 - DNA, 14 bp, Homo sapiens
tctgaacttcagct

SEQ ID NO: 2200570 - DNA, 13 bp, Homo sapiens
tctgaagccatgt

SEQ ID NO: 2200571 - DNA, 12 bp, Homo sapiens
tctgacctcagc

SEQ ID NO: 2200572 - DNA, 14 bp, Homo sapiens
tctgacctcagcat

SEQ ID NO: 2200573 - DNA, 19 bp, Homo sapiens
tctgactcccaaagagctg

SEQ ID NO: 2200574 - DNA, 14 bp, Homo sapiens
tctgactgccaagc

SEQ ID NO: 2200575 - DNA, 15 bp, Homo sapiens
tctgagcggccgcct

SEQ ID NO: 2200576 - DNA, 17 bp, Homo sapiens
tctgaggaggaaataaa

SEQ ID NO: 2200577 - DNA, 22 bp, Homo sapiens
tctgaggctcagccctgagctg

SEQ ID NO: 2200578 - DNA, 19 bp, Homo sapiens
tctgagtgaatactttgat

SEQ ID NO: 2200579 - DNA, 21 bp, Homo sapiens
tctgatattggtgtgaatgct

SEQ ID NO: 2200580 - DNA, 21 bp, Homo sapiens
tctgcagggcagcctgtggga

SEQ ID NO: 2200581 - DNA, 22 bp, Homo sapiens
tctgcagggcagcctgtgggag

SEQ ID NO: 2200582 - DNA, 21 bp, Homo sapiens
tctgccatttcaaatttctat

SEQ ID NO: 2200583 - DNA, 15 bp, Homo sapiens
tctgcccaccctcct

SEQ ID NO: 2200584 - DNA, 15 bp, Homo sapiens
tctgcccccagctgc

SEQ ID NO: 2200585 - DNA, 16 bp, Homo sapiens
tctgcccccagctgct

SEQ ID NO: 2200586 - DNA, 13 bp, Homo sapiens
tctgcccctccct

SEQ ID NO: 2200587 - DNA, 17 bp, Homo sapiens
tctgccgtgagagccca

SEQ ID NO: 2200588 - DNA, 12 bp, Homo sapiens
tctgccttgctg

SEQ ID NO: 2200589 - DNA, 14 bp, Homo sapiens
tctgccttgctgca

SEQ ID NO: 2200590 - DNA, 20 bp, Homo sapiens
tctgccttgctgcacctgag

SEQ ID NO: 2200591 - DNA, 22 bp, Homo sapiens
tctgcctttgttcactgtgagt

SEQ ID NO: 2200592 - DNA, 21 bp, Homo sapiens
tctgctccacagaaaccctgt

SEQ ID NO: 2200593 - DNA, 20 bp, Homo sapiens
tctgctcccagatgccttct

SEQ ID NO: 2200594 - DNA, 15 bp, Homo sapiens
tctgctcctccctcc

SEQ ID NO: 2200595 - DNA, 21 bp, Homo sapiens
tctgctggccgggcacagctg

SEQ ID NO: 2200596 - DNA, 23 bp, Homo sapiens
tctgctggccgggcacagctgtg

SEQ ID NO: 2200597 - DNA, 13 bp, Homo sapiens
tctgcttcagctt

SEQ ID NO: 2200598 - DNA, 14 bp, Homo sapiens
tctgcttcagcttg

SEQ ID NO: 2200599 - DNA, 17 bp, Homo sapiens
tctgcttttaagttttt

SEQ ID NO: 2200600 - DNA, 17 bp, Homo sapiens
tctggaaatccagctgg

SEQ ID NO: 2200601 - DNA, 16 bp, Homo sapiens
tctggaagcctgctga

SEQ ID NO: 2200602 - DNA, 15 bp, Homo sapiens
tctggagccacctgt

SEQ ID NO: 2200603 - DNA, 23 bp, Homo sapiens
tctggcaaggactttgtacattt

SEQ ID NO: 2200604 - DNA, 13 bp, Homo sapiens
tctggcctagtcc

SEQ ID NO: 2200605 - DNA, 20 bp, Homo sapiens
tctggcctagtcccttccac

SEQ ID NO: 2200606 - DNA, 15 bp, Homo sapiens
tctggcctctgcttt

SEQ ID NO: 2200607 - DNA, 13 bp, Homo sapiens
tctggctgcctgg

SEQ ID NO: 2200608 - DNA, 15 bp, Homo sapiens
tctggctgcctggcc

SEQ ID NO: 2200609 - DNA, 17 bp, Homo sapiens
tctggctgcctggccca

SEQ ID NO: 2200610 - DNA, 20 bp, Homo sapiens
tctggctgcctggcccaggg

SEQ ID NO: 2200611 - DNA, 14 bp, Homo sapiens
tctgggaggcaggt

SEQ ID NO: 2200612 - DNA, 22 bp, Homo sapiens
tctggggctcagccctgagctg

SEQ ID NO: 2200613 - DNA, 13 bp, Homo sapiens
tctgggggtcagg

SEQ ID NO: 2200614 - DNA, 13 bp, Homo sapiens
tctgggttctggg

SEQ ID NO: 2200615 - DNA, 16 bp, Homo sapiens
tctgggttctgggtgg

SEQ ID NO: 2200616 - DNA, 15 bp, Homo sapiens
tctggttagctcagc

SEQ ID NO: 2200617 - DNA, 22 bp, Homo sapiens
tctggttagctcagccccagcc

SEQ ID NO: 2200618 - DNA, 23 bp, Homo sapiens
tctgtacctgcccccactcagca

SEQ ID NO: 2200619 - DNA, 19 bp, Homo sapiens
tctgtagctattctttgac

SEQ ID NO: 2200620 - DNA, 21 bp, Homo sapiens
tctgtagctattctttgacca

SEQ ID NO: 2200621 - DNA, 15 bp, Homo sapiens
tctgtaggtggagag

SEQ ID NO: 2200622 - DNA, 14 bp, Homo sapiens
tctgtatataaata

SEQ ID NO: 2200623 - DNA, 22 bp, Homo sapiens
tctgtatataaatatattttct

SEQ ID NO: 2200624 - DNA, 20 bp, Homo sapiens
tctgtcacgttctggaacat

SEQ ID NO: 2200625 - DNA, 13 bp, Homo sapiens
tctgtccagggct

SEQ ID NO: 2200626 - DNA, 21 bp, Homo sapiens
tctgtgaacataggtgtgctt

SEQ ID NO: 2200627 - DNA, 19 bp, Homo sapiens
tctgtgcccagctcagtct

SEQ ID NO: 2200628 - DNA, 14 bp, Homo sapiens
tctgtgcctggagc

SEQ ID NO: 2200629 - DNA, 11 bp, Homo sapiens
tctgtttcctt

SEQ ID NO: 2200630 - DNA, 16 bp, Homo sapiens
tcttaccattttattc

SEQ ID NO: 2200631 - DNA, 15 bp, Homo sapiens
tgggaaggggtttct

SEQ ID NO: 2200632 - DNA, 17 bp, Homo sapiens
tgggactgatgtcatct

SEQ ID NO: 2200633 - DNA, 19 bp, Homo sapiens
tgggactgatgtcatcttg

SEQ ID NO: 2200634 - DNA, 17 bp, Homo sapiens
tgggactgtcttgagaa

SEQ ID NO: 2200635 - DNA, 15 bp, Homo sapiens
tgggagaagggacag

SEQ ID NO: 2200636 - DNA, 13 bp, Homo sapiens
tgggagagccaag

SEQ ID NO: 2200637 - DNA, 13 bp, Homo sapiens
tgggagaggaagc

SEQ ID NO: 2200638 - DNA, 17 bp, Homo sapiens
tgggagaggaagccacg

SEQ ID NO: 2200639 - DNA, 21 bp, Homo sapiens
tgggagagggagcaagccttc

SEQ ID NO: 2200640 - DNA, 23 bp, Homo sapiens
tgggaggcaggtcccgagccccc

SEQ ID NO: 2200641 - DNA, 15 bp, Homo sapiens
tgggagtcaagtgtg

SEQ ID NO: 2200642 - DNA, 13 bp, Homo sapiens
tgggagtgggaga

SEQ ID NO: 2200643 - DNA, 14 bp, Homo sapiens
tgggagtgggagag

SEQ ID NO: 2200644 - DNA, 16 bp, Homo sapiens
tgggagtgggagagga

SEQ ID NO: 2200645 - DNA, 19 bp, Homo sapiens
tgggagtgggagaggaagc

SEQ ID NO: 2200646 - DNA, 20 bp, Homo sapiens
tgggagtttttatgagaaac

SEQ ID NO: 2200647 - DNA, 16 bp, Homo sapiens
tgggatctgcccctcc

SEQ ID NO: 2200648 - DNA, 19 bp, Homo sapiens
tgggatctgcccctccctg

SEQ ID NO: 2200649 - DNA, 23 bp, Homo sapiens
tgggatctgcccctccctgcttc

SEQ ID NO: 2200650 - DNA, 13 bp, Homo sapiens
tgggattacaggt

SEQ ID NO: 2200651 - DNA, 21 bp, Homo sapiens
tgggcagaggggagaggaagc

SEQ ID NO: 2200652 - DNA, 21 bp, Homo sapiens
tgggcagatctaccccttact

SEQ ID NO: 2200653 - DNA, 23 bp, Homo sapiens
tgggcaggggttccagcttccct

SEQ ID NO: 2200654 - DNA, 15 bp, Homo sapiens
tgggccaagccaggg

SEQ ID NO: 2200655 - DNA, 22 bp, Homo sapiens
tgggccaatcactgagtttgtg

SEQ ID NO: 2200656 - DNA, 17 bp, Homo sapiens
tgggcctcaggctctgc

SEQ ID NO: 2200657 - DNA, 21 bp, Homo sapiens
tgggctcaagcaatcctcctg

SEQ ID NO: 2200658 - DNA, 14 bp, Homo sapiens
tgggctctggctcc

SEQ ID NO: 2200659 - DNA, 20 bp, Homo sapiens
tgggcttatatctggcctct

SEQ ID NO: 2200660 - DNA, 17 bp, Homo sapiens
tgggctttgattccatc

SEQ ID NO: 2200661 - DNA, 16 bp, Homo sapiens
tggggaagagagcctg

SEQ ID NO: 2200662 - DNA, 17 bp, Homo sapiens
tggggaagagagcctgc

SEQ ID NO: 2200663 - DNA, 18 bp, Homo sapiens
tggggaagagagcctgcc

SEQ ID NO: 2200664 - DNA, 19 bp, Homo sapiens
tggggacagctttcctggg

SEQ ID NO: 2200665 - DNA, 21 bp, Homo sapiens
tggggacagctttcctgggtg

SEQ ID NO: 2200666 - DNA, 20 bp, Homo sapiens
tggggagatcggggccagag

SEQ ID NO: 2200667 - DNA, 23 bp, Homo sapiens
tggggagatcggggccagaggca

SEQ ID NO: 2200668 - DNA, 14 bp, Homo sapiens
tggggagtgctgga

SEQ ID NO: 2200669 - DNA, 12 bp, Homo sapiens
tggggccacagc

SEQ ID NO: 2200670 - DNA, 13 bp, Homo sapiens
tggggccacagcc

SEQ ID NO: 2200671 - DNA, 19 bp, Homo sapiens
tggggcccaggggctttgg

SEQ ID NO: 2200672 - DNA, 14 bp, Homo sapiens
tggggcctggcgtg

SEQ ID NO: 2200673 - DNA, 16 bp, Homo sapiens
tggggcgggaggccac

SEQ ID NO: 2200674 - DNA, 15 bp, Homo sapiens
tgggggcctgctgtg

SEQ ID NO: 2200675 - DNA, 15 bp, Homo sapiens
tgggtcagtgtgcca

SEQ ID NO: 2200676 - DNA, 17 bp, Homo sapiens
tgggtcagtgtgccacc

SEQ ID NO: 2200677 - DNA, 22 bp, Homo sapiens
tgggtcagtgtgccaccctctg

SEQ ID NO: 2200678 - DNA, 16 bp, Homo sapiens
tgggtgcccacagccc

SEQ ID NO: 2200679 - DNA, 23 bp, Homo sapiens
tgggtgcccacagcccgcatgca

SEQ ID NO: 2200680 - DNA, 14 bp, Homo sapiens
tgggttctgggtgg

SEQ ID NO: 2200681 - DNA, 14 bp, Homo sapiens
tgggtttctctgtg

SEQ ID NO: 2200682 - DNA, 14 bp, Homo sapiens
tggtacctgccctc

SEQ ID NO: 2200683 - DNA, 15 bp, Homo sapiens
tggtacctgccctct

SEQ ID NO: 2200684 - DNA, 14 bp, Homo sapiens
tggtatgggtttct

SEQ ID NO: 2200685 - DNA, 19 bp, Homo sapiens
tggtatgggtttctcccag

SEQ ID NO: 2200686 - DNA, 21 bp, Homo sapiens
tggtcaccttcctctgccttt

SEQ ID NO: 2200687 - DNA, 20 bp, Homo sapiens
tggtcaggaagtttgcagat

SEQ ID NO: 2200688 - DNA, 19 bp, Homo sapiens
tggtcatcagtattgtgta

SEQ ID NO: 2200689 - DNA, 21 bp, Homo sapiens
tggtcctaagtccctgccccc

SEQ ID NO: 2200690 - DNA, 23 bp, Homo sapiens
tggtcctcacaagcctcttctga

SEQ ID NO: 2200691 - DNA, 22 bp, Homo sapiens
tggtcctctgatttcacatatt

SEQ ID NO: 2200692 - DNA, 13 bp, Homo sapiens
tggtctcctccca

SEQ ID NO: 2200693 - DNA, 13 bp, Homo sapiens
tggtcttatcctg

SEQ ID NO: 2200694 - DNA, 19 bp, Homo sapiens
tggtcttggtcatttgcca

SEQ ID NO: 2200695 - DNA, 17 bp, Homo sapiens
tggtgaggttgggcagc

SEQ ID NO: 2200696 - DNA, 16 bp, Homo sapiens
tggtgccgaagtgttt

SEQ ID NO: 2200697 - DNA, 20 bp, Homo sapiens
tggtgcgatcatggctcact

SEQ ID NO: 2200698 - DNA, 16 bp, Homo sapiens
tggtggcccctcccca

SEQ ID NO: 2200699 - DNA, 17 bp, Homo sapiens
tggtgggcaccaagagc

SEQ ID NO: 2200700 - DNA, 13 bp, Homo sapiens
tggtgtccttctc

SEQ ID NO: 2200701 - DNA, 23 bp, Homo sapiens
tggtgtccttctcctcttgtagc

SEQ ID NO: 2200702 - DNA, 15 bp, Homo sapiens
tggtgtgaatgctgt

SEQ ID NO: 2200703 - DNA, 19 bp, Homo sapiens
tggtgtgaatgctgtacct

SEQ ID NO: 2200704 - DNA, 20 bp, Homo sapiens
tggtgtgttcgtggagccac

SEQ ID NO: 2200705 - DNA, 13 bp, Homo sapiens
tggttaatcactt

SEQ ID NO: 2200706 - DNA, 23 bp, Homo sapiens
tggttaatcacttaacctgcttt

SEQ ID NO: 2200707 - DNA, 14 bp, Homo sapiens
tggttactcatttt

SEQ ID NO: 2200708 - DNA, 16 bp, Homo sapiens
tggttagctcagcccc

SEQ ID NO: 2200709 - DNA, 18 bp, Homo sapiens
tggttagctcagccccag

SEQ ID NO: 2200710 - DNA, 12 bp, Homo sapiens
tggttcccagaa

SEQ ID NO: 2200711 - DNA, 12 bp, Homo sapiens
tggttcctgggg

SEQ ID NO: 2200712 - DNA, 23 bp, Homo sapiens
tggttcctggggtgccctccact

SEQ ID NO: 2200713 - DNA, 19 bp, Homo sapiens
tggttgaaggtcacagaag

SEQ ID NO: 2200714 - DNA, 13 bp, Homo sapiens
tggtttttcccac

SEQ ID NO: 2200715 - DNA, 20 bp, Homo sapiens
tgtaaaaaacaaacatttga

SEQ ID NO: 2200716 - DNA, 19 bp, Homo sapiens
tgtaaaaacacaaatgtgt

SEQ ID NO: 2200717 - DNA, 20 bp, Homo sapiens
tgtaaaaacacaaatgtgta

SEQ ID NO: 2200718 - DNA, 14 bp, Homo sapiens
tgtaaaaattcaga

SEQ ID NO: 2200719 - DNA, 18 bp, Homo sapiens
tgtaaaataaaaccacca

SEQ ID NO: 2200720 - DNA, 17 bp, Homo sapiens
tgtaaaatatctacctg

SEQ ID NO: 2200721 - DNA, 12 bp, Homo sapiens
tgtaaacttgaa

SEQ ID NO: 2200722 - DNA, 13 bp, Homo sapiens
tgtaaacttgaaa

SEQ ID NO: 2200723 - DNA, 19 bp, Homo sapiens
tgtaaagtatgtattattt

SEQ ID NO: 2200724 - DNA, 13 bp, Homo sapiens
tgtaaccaagctg

SEQ ID NO: 2200725 - DNA, 14 bp, Homo sapiens
tgtaaccaagctgt

SEQ ID NO: 2200726 - DNA, 15 bp, Homo sapiens
tgtaacttgtgcttt

SEQ ID NO: 2200727 - DNA, 16 bp, Homo sapiens
tgtaaggtattgcaag

SEQ ID NO: 2200728 - DNA, 21 bp, Homo sapiens
tgtacaagtgctcagttccaa

SEQ ID NO: 2200729 - DNA, 16 bp, Homo sapiens
tgtacacttgggtgaa

SEQ ID NO: 2200730 - DNA, 14 bp, Homo sapiens
tgtacagtatgtgt

SEQ ID NO: 2200731 - DNA, 22 bp, Homo sapiens
tgtacagttgactggctttcct

SEQ ID NO: 2200732 - DNA, 17 bp, Homo sapiens
tgtacataacttcagat

SEQ ID NO: 2200733 - DNA, 21 bp, Homo sapiens
tgtacatagatgtatcattaa

SEQ ID NO: 2200734 - DNA, 23 bp, Homo sapiens
tgtaccgtcgacaagaatgtccc

SEQ ID NO: 2200735 - DNA, 17 bp, Homo sapiens
tgtacgttcttctattg

SEQ ID NO: 2200736 - DNA, 11 bp, Homo sapiens
tgtactgtgct

SEQ ID NO: 2200737 - DNA, 24 bp, Homo sapiens
tgtagaagagggagaaggagaggc

SEQ ID NO: 2200738 - DNA, 23 bp, Homo sapiens
tgtagcaaattccaatacattat

SEQ ID NO: 2200739 - DNA, 16 bp, Homo sapiens
tgtagccatgggacca

SEQ ID NO: 2200740 - DNA, 17 bp, Homo sapiens
tgtagccccaagaaggc

SEQ ID NO: 2200741 - DNA, 21 bp, Homo sapiens
tgtagccccaagaaggctggg

SEQ ID NO: 2200742 - DNA, 14 bp, Homo sapiens
tgtagctattcttt

SEQ ID NO: 2200743 - DNA, 13 bp, Homo sapiens
tgtaggcaccacc

SEQ ID NO: 2200744 - DNA, 18 bp, Homo sapiens
tgtagggttctgctttta

SEQ ID NO: 2200745 - DNA, 14 bp, Homo sapiens
tgtaggttgtctaa

SEQ ID NO: 2200746 - DNA, 15 bp, Homo sapiens
tgtagtgtgtttgtg

SEQ ID NO: 2200747 - DNA, 20 bp, Homo sapiens
tgtagtgtgtttgtgagtat

SEQ ID NO: 2200748 - DNA, 13 bp, Homo sapiens
tgtataaattact

SEQ ID NO: 2200749 - DNA, 15 bp, Homo sapiens
tgtatataaatatat

SEQ ID NO: 2200750 - DNA, 12 bp, Homo sapiens
tgtatataaatg

SEQ ID NO: 2200751 - DNA, 13 bp, Homo sapiens
tgtatattactga

SEQ ID NO: 2200752 - DNA, 13 bp, Homo sapiens
tgtatattgtaat

SEQ ID NO: 2200753 - DNA, 18 bp, Homo sapiens
ttggtggccgggggtggg

SEQ ID NO: 2200754 - DNA, 20 bp, Homo sapiens
ttggtgtgttcgtggagcca

SEQ ID NO: 2200755 - DNA, 16 bp, Homo sapiens
ttggttccctttgctc

SEQ ID NO: 2200756 - DNA, 16 bp, Homo sapiens
ttgtaaacctggaggg

SEQ ID NO: 2200757 - DNA, 17 bp, Homo sapiens
ttgtaaagtatgtatta

SEQ ID NO: 2200758 - DNA, 16 bp, Homo sapiens
ttgtaaggacttgtgc

SEQ ID NO: 2200759 - DNA, 17 bp, Homo sapiens
ttgtaatttttttctag

SEQ ID NO: 2200760 - DNA, 20 bp, Homo sapiens
ttgtacatttgggagttttt

SEQ ID NO: 2200761 - DNA, 22 bp, Homo sapiens
ttgtagctcttagtcctccctg

SEQ ID NO: 2200762 - DNA, 15 bp, Homo sapiens
ttgtataaattactt

SEQ ID NO: 2200763 - DNA, 13 bp, Homo sapiens
ttgtatgtatgtg

SEQ ID NO: 2200764 - DNA, 14 bp, Homo sapiens
ttgtatgtatgtgt

SEQ ID NO: 2200765 - DNA, 15 bp, Homo sapiens
ttgtatgtatgtgta

SEQ ID NO: 2200766 - DNA, 16 bp, Homo sapiens
ttgtcactcggctttg

SEQ ID NO: 2200767 - DNA, 22 bp, Homo sapiens
ttgtcatccacacaacaccagg

SEQ ID NO: 2200768 - DNA, 17 bp, Homo sapiens
ttgtccccacactccta

SEQ ID NO: 2200769 - DNA, 17 bp, Homo sapiens
ttgtcctgcagagctgg

SEQ ID NO: 2200770 - DNA, 20 bp, Homo sapiens
ttgtctctcattctctttct

SEQ ID NO: 2200771 - DNA, 21 bp, Homo sapiens
ttgtctggcaaggactttgta

SEQ ID NO: 2200772 - DNA, 11 bp, Homo sapiens
ttgtgaaattt

SEQ ID NO: 2200773 - DNA, 14 bp, Homo sapiens
ttgtgaacatgcct

SEQ ID NO: 2200774 - DNA, 22 bp, Homo sapiens
ttgtgaagaaacatttatcttt

SEQ ID NO: 2200775 - DNA, 20 bp, Homo sapiens
ttgtgacttttagacagtgg

SEQ ID NO: 2200776 - DNA, 23 bp, Homo sapiens
ttgtgagataaaactctcctttt

SEQ ID NO: 2200777 - DNA, 14 bp, Homo sapiens
ttgtgagtatgtgt

SEQ ID NO: 2200778 - DNA, 18 bp, Homo sapiens
ttgtgagtgtgtgcacag

SEQ ID NO: 2200779 - DNA, 20 bp, Homo sapiens
ttgtgcatgcaaaccaggag

SEQ ID NO: 2200780 - DNA, 23 bp, Homo sapiens
ttgtgggggtgtcacagaggcag

SEQ ID NO: 2200781 - DNA, 19 bp, Homo sapiens
ttgtgtacagtatgtgtct

SEQ ID NO: 2200782 - DNA, 17 bp, Homo sapiens
ttgttaatattaattta

SEQ ID NO: 2200783 - DNA, 13 bp, Homo sapiens
ttgttaattttgt

SEQ ID NO: 2200784 - DNA, 17 bp, Homo sapiens
ttgttagtgatttgcta

SEQ ID NO: 2200785 - DNA, 16 bp, Homo sapiens
ttgttcagaagttgtt

SEQ ID NO: 2200786 - DNA, 20 bp, Homo sapiens
ttgttcatatcaagaaattg

SEQ ID NO: 2200787 - DNA, 14 bp, Homo sapiens
ttgttccactggaa

SEQ ID NO: 2200788 - DNA, 14 bp, Homo sapiens
ttgtttctacctcc

SEQ ID NO: 2200789 - DNA, 16 bp, Homo sapiens
ttgtttctacctccca

SEQ ID NO: 2200790 - DNA, 20 bp, Homo sapiens
tttaaaaagaaattgaggtt

SEQ ID NO: 2200791 - DNA, 12 bp, Homo sapiens
tttaaaaatgta

SEQ ID NO: 2200792 - DNA, 21 bp, Homo sapiens
tttaaaagagccatgtccaaa

SEQ ID NO: 2200793 - DNA, 17 bp, Homo sapiens
tttaaaatttgtagaat

SEQ ID NO: 2200794 - DNA, 22 bp, Homo sapiens
tttaaataaatagatgttctgt

SEQ ID NO: 2200795 - DNA, 21 bp, Homo sapiens
tttaacagaaattgtatattg

SEQ ID NO: 2200796 - DNA, 23 bp, Homo sapiens
tttaacatagtaacgtgttactg

SEQ ID NO: 2200797 - DNA, 15 bp, Homo sapiens
tttaagaaaaacatg

SEQ ID NO: 2200798 - DNA, 17 bp, Homo sapiens
tttaagtgaaaatggtc

SEQ ID NO: 2200799 - DNA, 17 bp, Homo sapiens
tttaatcgtttttgttt

SEQ ID NO: 2200800 - DNA, 15 bp, Homo sapiens
tttaatgatcaacaa

SEQ ID NO: 2200801 - DNA, 17 bp, Homo sapiens
tttaatgttacatagta

SEQ ID NO: 2200802 - DNA, 18 bp, Homo sapiens
tttacagcttttctcttt

SEQ ID NO: 2200803 - DNA, 13 bp, Homo sapiens
tttaccaccccca

SEQ ID NO: 2200804 - DNA, 22 bp, Homo sapiens
tttaccattttgcgatgtgttt

SEQ ID NO: 2200805 - DNA, 18 bp, Homo sapiens
tttacctgggatatgaca

SEQ ID NO: 2200806 - DNA, 15 bp, Homo sapiens
tttacggaattccaa

SEQ ID NO: 2200807 - DNA, 13 bp, Homo sapiens
tttagaaattaca

SEQ ID NO: 2200808 - DNA, 19 bp, Homo sapiens
tttagaatattaaaaatta

SEQ ID NO: 2200809 - DNA, 19 bp, Homo sapiens
tttagaatcaagtctgtga

SEQ ID NO: 2200810 - DNA, 23 bp, Homo sapiens
tttagggactcaatttctcccca

SEQ ID NO: 2200811 - DNA, 19 bp, Homo sapiens
tttaggtgtcttttaatga

SEQ ID NO: 2200812 - DNA, 15 bp, Homo sapiens
tttataaactacaaa

SEQ ID NO: 2200813 - DNA, 18 bp, Homo sapiens
tttataagtttttgccat

SEQ ID NO: 2200814 - DNA, 12 bp, Homo sapiens
tttataattaaa

SEQ ID NO: 2200815 - DNA, 15 bp, Homo sapiens
tttataattaaagaa

SEQ ID NO: 2200816 - DNA, 18 bp, Homo sapiens
tttataattaaagaaaat

SEQ ID NO: 2200817 - DNA, 19 bp, Homo sapiens
tttataattaaagaaaatt

SEQ ID NO: 2200818 - DNA, 23 bp, Homo sapiens
tttataattaaagaaaattgcca

SEQ ID NO: 2200819 - DNA, 14 bp, Homo sapiens
tttatatttgtctc

SEQ ID NO: 2200820 - DNA, 19 bp, Homo sapiens
tttatcaggggaatttcag

SEQ ID NO: 2200821 - DNA, 15 bp, Homo sapiens
tttattattaaatca

SEQ ID NO: 2200822 - DNA, 17 bp, Homo sapiens
tttattctttaattgtt

SEQ ID NO: 2200823 - DNA, 20 bp, Homo sapiens
tttattgtaccaaagctgtt

SEQ ID NO: 2200824 - DNA, 20 bp, Homo sapiens
tttatttcatttttcaatag

SEQ ID NO: 2200825 - DNA, 16 bp, Homo sapiens
tttatttttgtactgt

SEQ ID NO: 2200826 - DNA, 21 bp, Homo sapiens
tttcaaatctgtaattaccat

SEQ ID NO: 2200827 - DNA, 13 bp, Homo sapiens
tttcaatatcaag

SEQ ID NO: 2200828 - DNA, 22 bp, Homo sapiens
tttcagaagttagtttgtatat

SEQ ID NO: 2200829 - DNA, 20 bp, Homo sapiens
tttcagtattagtgatgtca

SEQ ID NO: 2200830 - DNA, 14 bp, Homo sapiens
tttcatataaatgg

SEQ ID NO: 2200831 - DNA, 19 bp, Homo sapiens
tttcatctaaattactgat

SEQ ID NO: 2200832 - DNA, 18 bp, Homo sapiens
tttccaaaaacaaagtgc

SEQ ID NO: 2200833 - DNA, 11 bp, Homo sapiens
tttccaagcct

SEQ ID NO: 2200834 - DNA, 15 bp, Homo sapiens
tttccacacagcctg

SEQ ID NO: 2200835 - DNA, 20 bp, Homo sapiens
tttccagctaagcctgatga

SEQ ID NO: 2200836 - DNA, 22 bp, Homo sapiens
tttccatgcagttattagaact

SEQ ID NO: 2200837 - DNA, 12 bp, Homo sapiens
tttccctgaaca

SEQ ID NO: 2200838 - DNA, 18 bp, Homo sapiens
tttcctagttttatgttt

SEQ ID NO: 2200839 - DNA, 21 bp, Homo sapiens
tttccttgtccccacactcct

SEQ ID NO: 2200840 - DNA, 14 bp, Homo sapiens
tttcgttgcatggt

SEQ ID NO: 2200841 - DNA, 19 bp, Homo sapiens
tttctaccactggtgtaaa

SEQ ID NO: 2200842 - DNA, 13 bp, Homo sapiens
tttctacctccca

SEQ ID NO: 2200843 - DNA, 14 bp, Homo sapiens
tttctagaatacta

SEQ ID NO: 2200844 - DNA, 22 bp, Homo sapiens
tttctagaatactaataaaata

SEQ ID NO: 2200845 - DNA, 13 bp, Homo sapiens
tttctagtttgtt

SEQ ID NO: 2200846 - DNA, 13 bp, Homo sapiens
tttctcaaagttt

SEQ ID NO: 2200847 - DNA, 20 bp, Homo sapiens
tttctcaaagtttttacagt

SEQ ID NO: 2200848 - DNA, 22 bp, Homo sapiens
tttctcatagcaggaaatgtag

SEQ ID NO: 2200849 - DNA, 22 bp, Homo sapiens
tttctcctttaattgtaaagta

SEQ ID NO: 2200850 - DNA, 11 bp, Homo sapiens
tttctgagacg

SEQ ID NO: 2200851 - DNA, 21 bp, Homo sapiens
tttctgagtagcatatataat

SEQ ID NO: 2200852 - DNA, 22 bp, Homo sapiens
tttctgagtagcatatataatt

SEQ ID NO: 2200853 - DNA, 22 bp, Homo sapiens
tttctgccctcagcttcaaata

SEQ ID NO: 2200854 - DNA, 13 bp, Homo sapiens
tttctgtctctct

SEQ ID NO: 2200855 - DNA, 15 bp, Homo sapiens
tttcttcaatacaaa

SEQ ID NO: 2200856 - DNA, 14 bp, Homo sapiens
tttcttccctcatg

SEQ ID NO: 2200857 - DNA, 23 bp, Homo sapiens
tttcttccctcatgttctcatgt

SEQ ID NO: 2200858 - DNA, 14 bp, Homo sapiens
tttcttctgtagct

SEQ ID NO: 2200859 - DNA, 17 bp, Homo sapiens
tttcttggtatgatcat

SEQ ID NO: 2200860 - DNA, 13 bp, Homo sapiens
tttctttctagtt

SEQ ID NO: 2200861 - DNA, 20 bp, Homo sapiens
tttcttttgaataatgtagt

SEQ ID NO: 2200862 - DNA, 13 bp, Homo sapiens
tttgaaagaagca

SEQ ID NO: 2200863 - DNA, 11 bp, Homo sapiens
tttgaactcac

SEQ ID NO: 2200864 - DNA, 14 bp, Homo sapiens
tttgaccccttcct

SEQ ID NO: 2200865 - DNA, 18 bp, Homo sapiens
tttgaccccttcctgtct

SEQ ID NO: 2200866 - DNA, 17 bp, Homo sapiens
tttgactcattaatttc

SEQ ID NO: 2200867 - DNA, 15 bp, Homo sapiens
tttgactgtgattta

SEQ ID NO: 2200868 - DNA, 16 bp, Homo sapiens
tttgacttctgagtga

SEQ ID NO: 2200869 - DNA, 16 bp, Homo sapiens
tttgatatttgtgtaa

SEQ ID NO: 2200870 - DNA, 14 bp, Homo sapiens
tttgatgagaaaaa

SEQ ID NO: 2200871 - DNA, 13 bp, Homo sapiens
tttgatgtgtatg

SEQ ID NO: 2200872 - DNA, 19 bp, Homo sapiens
tttgcagcttccttccaag

SEQ ID NO: 2200873 - DNA, 23 bp, Homo sapiens
tttgccaagaccatttcacagaa

SEQ ID NO: 2200874 - DNA, 16 bp, Homo sapiens
tttgcccaacctcagc

SEQ ID NO: 2200875 - DNA, 15 bp, Homo sapiens
agtcttccaattaat

SEQ ID NO: 2200876 - DNA, 22 bp, Homo sapiens
agtcttccaattaatgcttttt

SEQ ID NO: 2200877 - DNA, 14 bp, Homo sapiens
agtggggagggaca

SEQ ID NO: 2200878 - DNA, 19 bp, Homo sapiens
agtggggagggacaaggga

SEQ ID NO: 2200879 - DNA, 15 bp, Homo sapiens
atatttgactattct

SEQ ID NO: 2200880 - DNA, 13 bp, Homo sapiens
atcaatcatgccc

SEQ ID NO: 2200881 - DNA, 21 bp, Homo sapiens
atcaatcatgccctgccttgt

SEQ ID NO: 2200882 - DNA, 22 bp, Homo sapiens
atgccctgccttgtccctctca

SEQ ID NO: 2200883 - DNA, 14 bp, Homo sapiens
atgtgacccaccag

SEQ ID NO: 2200884 - DNA, 17 bp, Homo sapiens
atgtgacccaccagtgc

SEQ ID NO: 2200885 - DNA, 21 bp, Homo sapiens
atgtgagtcccagagcccgct

SEQ ID NO: 2200886 - DNA, 21 bp, Homo sapiens
attttcaagcagcatcttctg

SEQ ID NO: 2200887 - DNA, 16 bp, Homo sapiens
caagatttccttgtgc

SEQ ID NO: 2200888 - DNA, 17 bp, Homo sapiens
caagcagcatcttctgg

SEQ ID NO: 2200889 - DNA, 18 bp, Homo sapiens
caatgtgagtcccagagc

SEQ ID NO: 2200890 - DNA, 17 bp, Homo sapiens
cacccctaagtgcccaa

SEQ ID NO: 2200891 - DNA, 11 bp, Homo sapiens
cagccccaccc

SEQ ID NO: 2200892 - DNA, 22 bp, Homo sapiens
cagccccacccctaagtgccca

SEQ ID NO: 2200893 - DNA, 23 bp, Homo sapiens
cagccccacccctaagtgcccaa

SEQ ID NO: 2200894 - DNA, 14 bp, Homo sapiens
catcaaataaactg

SEQ ID NO: 2200895 - DNA, 23 bp, Homo sapiens
ccaaagcaatgtgagtcccagag

SEQ ID NO: 2200896 - DNA, 13 bp, Homo sapiens
ccaaggagcccct

SEQ ID NO: 2200897 - DNA, 19 bp, Homo sapiens
ccattcacaataaaagctt

SEQ ID NO: 2200898 - DNA, 14 bp, Homo sapiens
cccaccagtgcctt

SEQ ID NO: 2200899 - DNA, 13 bp, Homo sapiens
cccaggcccgaga

SEQ ID NO: 2200900 - DNA, 12 bp, Homo sapiens
ccccaataaaag

SEQ ID NO: 2200901 - DNA, 19 bp, Homo sapiens
ccccacccctaagtgccca

SEQ ID NO: 2200902 - DNA, 20 bp, Homo sapiens
ccccacccctaagtgcccaa

SEQ ID NO: 2200903 - DNA, 21 bp, Homo sapiens
ccccacccctaagtgcccaaa

SEQ ID NO: 2200904 - DNA, 23 bp, Homo sapiens
ccccacccctaagtgcccaaagt

SEQ ID NO: 2200905 - DNA, 13 bp, Homo sapiens
cccctaagtgccc

SEQ ID NO: 2200906 - DNA, 14 bp, Homo sapiens
cccctaagtgccca

SEQ ID NO: 2200907 - DNA, 20 bp, Homo sapiens
cccgcttttgttcttcccca

SEQ ID NO: 2200908 - DNA, 12 bp, Homo sapiens
ccctaagtgccc

SEQ ID NO: 2200909 - DNA, 13 bp, Homo sapiens
ccctaagtgccca

SEQ ID NO: 2200910 - DNA, 14 bp, Homo sapiens
ccctccctctccca

SEQ ID NO: 2200911 - DNA, 21 bp, Homo sapiens
ccctctcactccccagcccca

SEQ ID NO: 2200912 - DNA, 22 bp, Homo sapiens
ccgagatgtgacccaccagtgc

SEQ ID NO: 2200913 - DNA, 12 bp, Homo sapiens
cctaagtgccca

SEQ ID NO: 2200914 - DNA, 14 bp, Homo sapiens
cctaagtgcccaaa

SEQ ID NO: 2200915 - DNA, 20 bp, Homo sapiens
cctctcactccccagcccca

SEQ ID NO: 2200916 - DNA, 16 bp, Homo sapiens
cctctcccaggcccga

SEQ ID NO: 2200917 - DNA, 13 bp, Homo sapiens
cctggatgccaag

SEQ ID NO: 2200918 - DNA, 21 bp, Homo sapiens
cgagatgtgacccaccagtgc

SEQ ID NO: 2200919 - DNA, 23 bp, Homo sapiens
cgagatgtgacccaccagtgcct

SEQ ID NO: 2200920 - DNA, 21 bp, Homo sapiens
cgccctccctctcccaggccc

SEQ ID NO: 2200921 - DNA, 15 bp, Homo sapiens
ctaagtgcccaaagt

SEQ ID NO: 2200922 - DNA, 22 bp, Homo sapiens
ctaagtgcccaaagtggggagg

SEQ ID NO: 2200923 - DNA, 20 bp, Homo sapiens
ctcactccccagccccaccc

SEQ ID NO: 2200924 - DNA, 12 bp, Homo sapiens
ctcccaggcccg

SEQ ID NO: 2200925 - DNA, 13 bp, Homo sapiens
ctctcactcccca

SEQ ID NO: 2200926 - DNA, 14 bp, Homo sapiens
ctctctcaaaagag

SEQ ID NO: 2200927 - DNA, 15 bp, Homo sapiens
ctgccttgtccctct

SEQ ID NO: 2200928 - DNA, 23 bp, Homo sapiens
ctgccttgtccctctcactcccc

SEQ ID NO: 2200929 - DNA, 13 bp, Homo sapiens
ctgcgttctgcaa

SEQ ID NO: 2200930 - DNA, 19 bp, Homo sapiens
ctggatgccaaggagcccc

SEQ ID NO: 2200931 - DNA, 16 bp, Homo sapiens
ctggcccacgccctcc

SEQ ID NO: 2200932 - DNA, 20 bp, Homo sapiens
ctgggaagcttgagcctccc

SEQ ID NO: 2200933 - DNA, 16 bp, Homo sapiens
cttccaattaatgctt

SEQ ID NO: 2200934 - DNA, 17 bp, Homo sapiens
cttccaattaatgcttt

SEQ ID NO: 2200935 - DNA, 11 bp, Homo sapiens
cttgagcctcc

SEQ ID NO: 2200936 - DNA, 15 bp, Homo sapiens
cttgagcctccccca

SEQ ID NO: 2200937 - DNA, 14 bp, Homo sapiens
cttgtccctctcac

SEQ ID NO: 2200938 - DNA, 16 bp, Homo sapiens
ctttcatccttgacta

SEQ ID NO: 2200939 - DNA, 15 bp, Homo sapiens
cttttgttcttcccc

SEQ ID NO: 2200940 - DNA, 15 bp, Homo sapiens
gaagcttgagcctcc

SEQ ID NO: 2200941 - DNA, 16 bp, Homo sapiens
gacaagggattctggg

SEQ ID NO: 2200942 - DNA, 17 bp, Homo sapiens
gacaagggattctggga

SEQ ID NO: 2200943 - DNA, 14 bp, Homo sapiens
gacccaccagtgcc

SEQ ID NO: 2200944 - DNA, 16 bp, Homo sapiens
gacccaccagtgcctt

SEQ ID NO: 2200945 - DNA, 14 bp, Homo sapiens
gactaaattcgtga

SEQ ID NO: 2200946 - DNA, 16 bp, Homo sapiens
gagatgtgacccacca

SEQ ID NO: 2200947 - DNA, 19 bp, Homo sapiens
gagcccgcttttgttcttc

SEQ ID NO: 2200948 - DNA, 15 bp, Homo sapiens
gagggacaagggatt

SEQ ID NO: 2200949 - DNA, 17 bp, Homo sapiens
gatgccaaggagcccct

SEQ ID NO: 2200950 - DNA, 18 bp, Homo sapiens
gatgtgacccaccagtgc

SEQ ID NO: 2200951 - DNA, 12 bp, Homo sapiens
gattctgggaag

SEQ ID NO: 2200952 - DNA, 23 bp, Homo sapiens
gccccacccctaagtgcccaaag

SEQ ID NO: 2200953 - DNA, 23 bp, Homo sapiens
gcccgcttttgttcttccccaca

SEQ ID NO: 2200954 - DNA, 15 bp, Homo sapiens
gccctccctctccca

SEQ ID NO: 2200955 - DNA, 13 bp, Homo sapiens
gcctcccccaaag

SEQ ID NO: 2200956 - DNA, 23 bp, Homo sapiens
gccttgtccctctcactccccag

SEQ ID NO: 2200957 - DNA, 15 bp, Homo sapiens
gctttaatcaatcat

SEQ ID NO: 2200958 - DNA, 15 bp, Homo sapiens
ggaagcttgagcctc

SEQ ID NO: 2200959 - DNA, 16 bp, Homo sapiens
ggaagcttgagcctcc

SEQ ID NO: 2200960 - DNA, 14 bp, Homo sapiens
ggacaagggattct

SEQ ID NO: 2200961 - DNA, 19 bp, Homo sapiens
ggacaagggattctgggaa

SEQ ID NO: 2200962 - DNA, 18 bp, Homo sapiens
ggatgccaaggagcccct

SEQ ID NO: 2200963 - DNA, 20 bp, Homo sapiens
gggaagcttgagcctccccc

SEQ ID NO: 2200964 - DNA, 21 bp, Homo sapiens
gtccctctcactccccagccc

SEQ ID NO: 2200965 - DNA, 16 bp, Homo sapiens
gtgacccaccagtgcc

SEQ ID NO: 2200966 - DNA, 17 bp, Homo sapiens
gtgagtcccagagcccg

SEQ ID NO: 2200967 - DNA, 17 bp, Homo sapiens
gtgattttcaagcagca

SEQ ID NO: 2200968 - DNA, 11 bp, Homo sapiens
gtgcccaaagt

SEQ ID NO: 2200969 - DNA, 20 bp, Homo sapiens
taaactgactttttcccccc

SEQ ID NO: 2200970 - DNA, 21 bp, Homo sapiens
taaactgactttttcccccca

SEQ ID NO: 2200971 - DNA, 17 bp, Homo sapiens
taaacttgtttgctgtg

SEQ ID NO: 2200972 - DNA, 10 bp, Homo sapiens
taagtgccca

SEQ ID NO: 2200973 - DNA, 12 bp, Homo sapiens
taagtgcccaaa

SEQ ID NO: 2200974 - DNA, 16 bp, Homo sapiens
taagtgcccaaagtgg

SEQ ID NO: 2200975 - DNA, 20 bp, Homo sapiens
tcaacaagatttccttgtgc

SEQ ID NO: 2200976 - DNA, 11 bp, Homo sapiens
tcccagagccc

SEQ ID NO: 2200977 - DNA, 15 bp, Homo sapiens
tccctctcactcccc

SEQ ID NO: 2200978 - DNA, 20 bp, Homo sapiens
tcgtgattttcaagcagcat

SEQ ID NO: 2200979 - DNA, 21 bp, Homo sapiens
tctcactccccagccccaccc

SEQ ID NO: 2200980 - DNA, 23 bp, Homo sapiens
tctcactccccagccccacccct

SEQ ID NO: 2200981 - DNA, 21 bp, Homo sapiens
tctgggaagcttgagcctccc

SEQ ID NO: 2200982 - DNA, 13 bp, Homo sapiens
tgacccaccagtg

SEQ ID NO: 2200983 - DNA, 15 bp, Homo sapiens
tgacccaccagtgcc

SEQ ID NO: 2200984 - DNA, 17 bp, Homo sapiens
tgacccaccagtgcctt

SEQ ID NO: 2200985 - DNA, 18 bp, Homo sapiens
tgactaaattcgtgattt

SEQ ID NO: 2200986 - DNA, 19 bp, Homo sapiens
tgactaaattcgtgatttt

SEQ ID NO: 2200987 - DNA, 13 bp, Homo sapiens
tgactattctgta

SEQ ID NO: 2200988 - DNA, 17 bp, Homo sapiens
tgagcctcccccaaagc

SEQ ID NO: 2200989 - DNA, 18 bp, Homo sapiens
aagcttgagcctccccca

SEQ ID NO: 2200990 - DNA, 16 bp, Homo sapiens
aagtgcccaaagtggg

SEQ ID NO: 2200991 - DNA, 18 bp, Homo sapiens
aagtgcccaaagtgggga

SEQ ID NO: 2200992 - DNA, 20 bp, Homo sapiens
acaagatttccttgtgcaaa

SEQ ID NO: 2200993 - DNA, 13 bp, Homo sapiens
acaataaaagctt

SEQ ID NO: 2200994 - DNA, 22 bp, Homo sapiens
acatggggcctggcccacgccc

SEQ ID NO: 2200995 - DNA, 19 bp, Homo sapiens
accattcacaataaaagct

SEQ ID NO: 2200996 - DNA, 20 bp, Homo sapiens
accattcacaataaaagctt

SEQ ID NO: 2200997 - DNA, 13 bp, Homo sapiens
acccaccagtgcc

SEQ ID NO: 2200998 - DNA, 17 bp, Homo sapiens
acgccctccctctccca

SEQ ID NO: 2200999 - DNA, 20 bp, Homo sapiens
actaaattcgtgattttcaa

SEQ ID NO: 2201000 - DNA, 14 bp, Homo sapiens
actccccagcccca

SEQ ID NO: 2201001 - DNA, 15 bp, Homo sapiens
actccccagccccac

SEQ ID NO: 2201002 - DNA, 20 bp, Homo sapiens
actgcgttctgcaagcatca

SEQ ID NO: 2201003 - DNA, 18 bp, Homo sapiens
agagactgcgttctgcaa

SEQ ID NO: 2201004 - DNA, 22 bp, Homo sapiens
agagactgcgttctgcaagcat

SEQ ID NO: 2201005 - DNA, 14 bp, Homo sapiens
agattcaaggcccc

SEQ ID NO: 2201006 - DNA, 14 bp, Homo sapiens
agcagcatcttctg

SEQ ID NO: 2201007 - DNA, 21 bp, Homo sapiens
agccccacccctaagtgccca

SEQ ID NO: 2201008 - DNA, 12 bp, Homo sapiens
agcctcccccaa

SEQ ID NO: 2201009 - DNA, 20 bp, Homo sapiens
agcctggatgccaaggagcc

SEQ ID NO: 2201010 - DNA, 17 bp, Homo sapiens
agctgttaccattcaca

SEQ ID NO: 2201011 - DNA, 12 bp, Homo sapiens
agcttgagcctc

SEQ ID NO: 2201012 - DNA, 13 bp, Homo sapiens
agcttgagcctcc

SEQ ID NO: 2201013 - DNA, 14 bp, Homo sapiens
agcttgagcctccc

SEQ ID NO: 2201014 - DNA, 14 bp, Homo sapiens
agggacaagggatt

SEQ ID NO: 2201015 - DNA, 21 bp, Homo sapiens
agggacaagggattctgggaa

SEQ ID NO: 2201016 - DNA, 10 bp, Homo sapiens
agtgcccaaa

SEQ ID NO: 2201017 - DNA, 14 bp, Homo sapiens
atcatgccctgcct

SEQ ID NO: 2201018 - DNA, 16 bp, Homo sapiens
atgccaaggagcccct

SEQ ID NO: 2201019 - DNA, 21 bp, Homo sapiens
atgccctgccttgtccctctc

SEQ ID NO: 2201020 - DNA, 15 bp, Homo sapiens
caaagtggggaggga

SEQ ID NO: 2201021 - DNA, 18 bp, Homo sapiens
caaagtggggagggacaa

SEQ ID NO: 2201022 - DNA, 20 bp, Homo sapiens
caaagtggggagggacaagg

SEQ ID NO: 2201023 - DNA, 20 bp, Homo sapiens
caaataaactgactttttcc

SEQ ID NO: 2201024 - DNA, 21 bp, Homo sapiens
caacaagatttccttgtgcaa

SEQ ID NO: 2201025 - DNA, 13 bp, Homo sapiens
caagatttccttg

SEQ ID NO: 2201026 - DNA, 12 bp, Homo sapiens
caataaaagctt

SEQ ID NO: 2201027 - DNA, 19 bp, Homo sapiens
caatgtgagtcccagagcc

SEQ ID NO: 2201028 - DNA, 11 bp, Homo sapiens
caccagtgcct

SEQ ID NO: 2201029 - DNA, 14 bp, Homo sapiens
cacgccctccctct

SEQ ID NO: 2201030 - DNA, 21 bp, Homo sapiens
cagccccacccctaagtgccc

SEQ ID NO: 2201031 - DNA, 16 bp, Homo sapiens
catcaacaagatttcc

SEQ ID NO: 2201032 - DNA, 20 bp, Homo sapiens
ccaaagcaatgtgagtccca

SEQ ID NO: 2201033 - DNA, 23 bp, Homo sapiens
ccaaagtggggagggacaaggga

SEQ ID NO: 2201034 - DNA, 14 bp, Homo sapiens
ccacccctaagtgc

SEQ ID NO: 2201035 - DNA, 18 bp, Homo sapiens
cccacccctaagtgccca

SEQ ID NO: 2201036 - DNA, 20 bp, Homo sapiens
cccacccctaagtgcccaaa

SEQ ID NO: 2201037 - DNA, 15 bp, Homo sapiens
cccagccccacccct

SEQ ID NO: 2201038 - DNA, 14 bp, Homo sapiens
ccccacccctaagt

SEQ ID NO: 2201039 - DNA, 22 bp, Homo sapiens
cccccaaagcaatgtgagtccc

SEQ ID NO: 2201040 - DNA, 17 bp, Homo sapiens
cccctaagtgcccaaag

SEQ ID NO: 2201041 - DNA, 19 bp, Homo sapiens
cccctaagtgcccaaagtg

SEQ ID NO: 2201042 - DNA, 16 bp, Homo sapiens
ccctctcactccccag

SEQ ID NO: 2201043 - DNA, 18 bp, Homo sapiens
cctaagtgcccaaagtgg

SEQ ID NO: 2201044 - DNA, 19 bp, Homo sapiens
cctccctctcccaggcccg

SEQ ID NO: 2201045 - DNA, 18 bp, Homo sapiens
cctggatgccaaggagcc

SEQ ID NO: 2201046 - DNA, 18 bp, Homo sapiens
cctggcccacgccctccc

SEQ ID NO: 2201047 - DNA, 15 bp, Homo sapiens
cgccctccctctccc

SEQ ID NO: 2201048 - DNA, 12 bp, Homo sapiens
ctcactccccag

SEQ ID NO: 2201049 - DNA, 13 bp, Homo sapiens
ctcactccccagc

SEQ ID NO: 2201050 - DNA, 19 bp, Homo sapiens
ctcactccccagccccacc

SEQ ID NO: 2201051 - DNA, 16 bp, Homo sapiens
ctccccagccccaccc

SEQ ID NO: 2201052 - DNA, 16 bp, Homo sapiens
ctccctctcccaggcc

SEQ ID NO: 2201053 - DNA, 17 bp, Homo sapiens
ctccctctcccaggccc

SEQ ID NO: 2201054 - DNA, 23 bp, Homo sapiens
ctctcaaaagagaaaaacaaaac

SEQ ID NO: 2201055 - DNA, 19 bp, Homo sapiens
ctctcactccccagcccca

SEQ ID NO: 2201056 - DNA, 14 bp, Homo sapiens
ctctcccaggcccg

SEQ ID NO: 2201057 - DNA, 18 bp, Homo sapiens
ctgccttgtccctctcac

SEQ ID NO: 2201058 - DNA, 23 bp, Homo sapiens
ctgggaagcttgagcctccccca

SEQ ID NO: 2201059 - DNA, 15 bp, Homo sapiens
ctgttaccattcaca

SEQ ID NO: 2201060 - DNA, 19 bp, Homo sapiens
cttctggtttaaacttgtt

SEQ ID NO: 2201061 - DNA, 19 bp, Homo sapiens
cttgagcctcccccaaagc

SEQ ID NO: 2201062 - DNA, 17 bp, Homo sapiens
gaagcttgagcctcccc

SEQ ID NO: 2201063 - DNA, 13 bp, Homo sapiens
gacaagggattct

SEQ ID NO: 2201064 - DNA, 15 bp, Homo sapiens
gacaagggattctgg

SEQ ID NO: 2201065 - DNA, 19 bp, Homo sapiens
gacaagggattctgggaag

SEQ ID NO: 2201066 - DNA, 20 bp, Homo sapiens
gacaagggattctgggaagc

SEQ ID NO: 2201067 - DNA, 15 bp, Homo sapiens
gacccaccagtgcct

SEQ ID NO: 2201068 - DNA, 14 bp, Homo sapiens
gactgcgttctgca

SEQ ID NO: 2201069 - DNA, 16 bp, Homo sapiens
gagactgcgttctgca

SEQ ID NO: 2201070 - DNA, 23 bp, Homo sapiens
gagactgcgttctgcaagcatca

SEQ ID NO: 2201071 - DNA, 12 bp, Homo sapiens
gagcctccccca

SEQ ID NO: 2201072 - DNA, 16 bp, Homo sapiens
gagcctcccccaaagc

SEQ ID NO: 2201073 - DNA, 21 bp, Homo sapiens
gagggacaagggattctggga

SEQ ID NO: 2201074 - DNA, 21 bp, Homo sapiens
gatcatcaacaagatttcctt

SEQ ID NO: 2201075 - DNA, 19 bp, Homo sapiens
gatgtgacccaccagtgcc

SEQ ID NO: 2201076 - DNA, 21 bp, Homo sapiens
gatgtgacccaccagtgcctt

SEQ ID NO: 2201077 - DNA, 23 bp, Homo sapiens
gattctgggaagcttgagcctcc

SEQ ID NO: 2201078 - DNA, 14 bp, Homo sapiens
gcagcatcttctgg

SEQ ID NO: 2201079 - DNA, 13 bp, Homo sapiens
gcccaaagtgggg

SEQ ID NO: 2201080 - DNA, 15 bp, Homo sapiens
gcccaaagtggggag

SEQ ID NO: 2201081 - DNA, 16 bp, Homo sapiens
gcccaaagtggggagg

SEQ ID NO: 2201082 - DNA, 18 bp, Homo sapiens
gcccacgccctccctctc

SEQ ID NO: 2201083 - DNA, 21 bp, Homo sapiens
gccctccctctcccaggcccg

SEQ ID NO: 2201084 - DNA, 15 bp, Homo sapiens
gccttgtccctctca

SEQ ID NO: 2201085 - DNA, 12 bp, Homo sapiens
gcttgagcctcc

SEQ ID NO: 2201086 - DNA, 16 bp, Homo sapiens
gcttgagcctccccca

SEQ ID NO: 2201087 - DNA, 17 bp, Homo sapiens
ggaagcttgagcctccc

SEQ ID NO: 2201088 - DNA, 19 bp, Homo sapiens
ggatgccaaggagcccctg

SEQ ID NO: 2201089 - DNA, 23 bp, Homo sapiens
ggattctgggaagcttgagcctc

SEQ ID NO: 2201090 - DNA, 22 bp, Homo sapiens
ggcccacgccctccctctccca

SEQ ID NO: 2201091 - DNA, 21 bp, Homo sapiens
ggcccgagatgtgacccacca

SEQ ID NO: 2201092 - DNA, 18 bp, Homo sapiens
gggaagcttgagcctccc

SEQ ID NO: 2201093 - DNA, 21 bp, Homo sapiens
gggaagcttgagcctccccca

SEQ ID NO: 2201094 - DNA, 22 bp, Homo sapiens
gggaagcttgagcctcccccaa

SEQ ID NO: 2201095 - DNA, 19 bp, Homo sapiens
gggacaagggattctggga

SEQ ID NO: 2201096 - DNA, 17 bp, Homo sapiens
ggtgtcacatggggcct

SEQ ID NO: 2201097 - DNA, 23 bp, Homo sapiens
ggtgtcacatggggcctggccca

SEQ ID NO: 2201098 - DNA, 19 bp, Homo sapiens
gtcacatggggcctggccc

SEQ ID NO: 2201099 - DNA, 13 bp, Homo sapiens
gtcccagagcccg

SEQ ID NO: 2201100 - DNA, 16 bp, Homo sapiens
gtgcccaaagtgggga

SEQ ID NO: 2201101 - DNA, 19 bp, Homo sapiens
gtgcccaaagtggggaggg

SEQ ID NO: 2201102 - DNA, 13 bp, Homo sapiens
gttaccattcaca

SEQ ID NO: 2201103 - DNA, 19 bp, Homo sapiens
taaactgactttttccccc

SEQ ID NO: 2201104 - DNA, 20 bp, Homo sapiens
taaacttgtttgctgtgaac

SEQ ID NO: 2201105 - DNA, 19 bp, Homo sapiens
taaattcgtgattttcaag

SEQ ID NO: 2201106 - DNA, 11 bp, Homo sapiens
tcaaataaact

SEQ ID NO: 2201107 - DNA, 13 bp, Homo sapiens
tcaatcatgccct

SEQ ID NO: 2201108 - DNA, 19 bp, Homo sapiens
tcagttctacggatcatca

SEQ ID NO: 2201109 - DNA, 21 bp, Homo sapiens
tcgaaaagagtcttccaatta

SEQ ID NO: 2201110 - DNA, 13 bp, Homo sapiens
tctcccaggcccg

SEQ ID NO: 2201111 - DNA, 16 bp, Homo sapiens
tgacccaccagtgcct

SEQ ID NO: 2201112 - DNA, 15 bp, Homo sapiens
tgactaaattcgtga

SEQ ID NO: 2201113 - DNA, 23 bp, Homo sapiens
tgagtcccagagcccgcttttgt

SEQ ID NO: 2201114 - DNA, 13 bp, Homo sapiens
tgccttgtccctc

SEQ ID NO: 2201115 - DNA, 18 bp, Homo sapiens
tgccttgtccctctcact

SEQ ID NO: 2201116 - DNA, 22 bp, Homo sapiens
tggcccacgccctccctctccc

SEQ ID NO: 2201117 - DNA, 16 bp, Homo sapiens
tgggaagcttgagcct

SEQ ID NO: 2201118 - DNA, 19 bp, Homo sapiens
tgggaagcttgagcctccc

SEQ ID NO: 2201119 - DNA, 23 bp, Homo sapiens
tggggagggacaagggattctgg

SEQ ID NO: 2201120 - DNA, 14 bp, Homo sapiens
tggggcctggccca

SEQ ID NO: 2201121 - DNA, 22 bp, Homo sapiens
tggggcctggcccacgccctcc

SEQ ID NO: 2201122 - DNA, 22 bp, Homo sapiens
tgtccctctcactccccagccc

SEQ ID NO: 2201123 - DNA, 14 bp, Homo sapiens
tgtgacccaccagt

SEQ ID NO: 2201124 - DNA, 16 bp, Homo sapiens
tgtgacccaccagtgc

SEQ ID NO: 2201125 - DNA, 17 bp, Homo sapiens
tgtgacccaccagtgcc

SEQ ID NO: 2201126 - DNA, 14 bp, Homo sapiens
tgttaccattcaca

SEQ ID NO: 2201127 - DNA, 14 bp, Homo sapiens
tgttcttccccaca

SEQ ID NO: 2201128 - DNA, 13 bp, Homo sapiens
ttaccattcacaa

SEQ ID NO: 2201129 - DNA, 16 bp, Homo sapiens
ttcaagcagcatcttc

SEQ ID NO: 2201130 - DNA, 15 bp, Homo sapiens
ttcacaataaaagct

SEQ ID NO: 2201131 - DNA, 14 bp, Homo sapiens
ttctacggatcatc

SEQ ID NO: 2201132 - DNA, 19 bp, Homo sapiens
ttctgggaagcttgagcct

SEQ ID NO: 2201133 - DNA, 21 bp, Homo sapiens
ttctgggaagcttgagcctcc

SEQ ID NO: 2201134 - DNA, 13 bp, Homo sapiens
ttgagcctccccc

SEQ ID NO: 2201135 - DNA, 18 bp, Homo sapiens
ttgagcctcccccaaagc

SEQ ID NO: 2201136 - DNA, 21 bp, Homo sapiens
ttgtgcaaaatatttgactat

SEQ ID NO: 2201137 - DNA, 20 bp, Homo sapiens
tttcaagcagcatcttctgg

SEQ ID NO: 2201138 - DNA, 21 bp, Homo sapiens
aaacaaaacccctaagagact

SEQ ID NO: 2201139 - DNA, 19 bp, Homo sapiens
aaacttgtttgctgtgaac

SEQ ID NO: 2201140 - DNA, 23 bp, Homo sapiens
aaagtggggagggacaagggatt

SEQ ID NO: 2201141 - DNA, 20 bp, Homo sapiens
aacaagatttccttgtgcaa

SEQ ID NO: 2201142 - DNA, 22 bp, Homo sapiens
aacaattgtcgaaaagagtctt

SEQ ID NO: 2201143 - DNA, 17 bp, Homo sapiens
aacttgtttgctgtgaa

SEQ ID NO: 2201144 - DNA, 16 bp, Homo sapiens
aagatttccttgtgca

SEQ ID NO: 2201145 - DNA, 17 bp, Homo sapiens
aagatttccttgtgcaa

SEQ ID NO: 2201146 - DNA, 23 bp, Homo sapiens
aagcaatgtgagtcccagagccc

SEQ ID NO: 2201147 - DNA, 19 bp, Homo sapiens
aagcatcagttctacggat

SEQ ID NO: 2201148 - DNA, 21 bp, Homo sapiens
aaaatatttgactattctgta

SEQ ID NO: 2201149 - DNA, 14 bp, Homo sapiens
aaagagtcttccaa

SEQ ID NO: 2201150 - DNA, 17 bp, Homo sapiens
aaatatttgactattct

SEQ ID NO: 2201151 - DNA, 18 bp, Homo sapiens
aactgactttttcccccc

SEQ ID NO: 2201152 - DNA, 20 bp, Homo sapiens
aacttgtttgctgtgaacaa

SEQ ID NO: 2201153 - DNA, 16 bp, Homo sapiens
aagcagcatcttctgg

SEQ ID NO: 2201154 - DNA, 22 bp, Homo sapiens
aagcctggatgccaaggagccc

SEQ ID NO: 2201155 - DNA, 12 bp, Homo sapiens
aagtgcccaaag

SEQ ID NO: 2201156 - DNA, 20 bp, Homo sapiens
aagtggggagggacaaggga

SEQ ID NO: 2201157 - DNA, 18 bp, Homo sapiens
acaagatttccttgtgca

SEQ ID NO: 2201158 - DNA, 13 bp, Homo sapiens
acaagggattctg

SEQ ID NO: 2201159 - DNA, 17 bp, Homo sapiens
acaagggattctgggaa

SEQ ID NO: 2201160 - DNA, 17 bp, Homo sapiens
acatggggcctggccca

SEQ ID NO: 2201161 - DNA, 11 bp, Homo sapiens
acccaccagtg

SEQ ID NO: 2201162 - DNA, 15 bp, Homo sapiens
acccaccagtgcctt

SEQ ID NO: 2201163 - DNA, 16 bp, Homo sapiens
actgactttttccccc

SEQ ID NO: 2201164 - DNA, 13 bp, Homo sapiens
agcaatgtgagtc

SEQ ID NO: 2201165 - DNA, 21 bp, Homo sapiens
agcttgagcctcccccaaagc

SEQ ID NO: 2201166 - DNA, 18 bp, Homo sapiens
agggacaagggattctgg

SEQ ID NO: 2201167 - DNA, 13 bp, Homo sapiens
agtgcccaaagtg

SEQ ID NO: 2201168 - DNA, 19 bp, Homo sapiens
agtgcccaaagtggggagg

SEQ ID NO: 2201169 - DNA, 12 bp, Homo sapiens
agtggggaggga

SEQ ID NO: 2201170 - DNA, 15 bp, Homo sapiens
atcaacaagatttcc

SEQ ID NO: 2201171 - DNA, 22 bp, Homo sapiens
atcttctggtttaaacttgttt

SEQ ID NO: 2201172 - DNA, 18 bp, Homo sapiens
atgtgacccaccagtgcc

SEQ ID NO: 2201173 - DNA, 19 bp, Homo sapiens
atgtgacccaccagtgcct

SEQ ID NO: 2201174 - DNA, 16 bp, Homo sapiens
attcacaataaaagct

SEQ ID NO: 2201175 - DNA, 21 bp, Homo sapiens
attcgtgattttcaagcagca

SEQ ID NO: 2201176 - DNA, 10 bp, Homo sapiens
attctgggaa

SEQ ID NO: 2201177 - DNA, 22 bp, Homo sapiens
attgtcgaaaagagtcttccaa

SEQ ID NO: 2201178 - DNA, 23 bp, Homo sapiens
caaaacccctaagagactgcgtt

SEQ ID NO: 2201179 - DNA, 14 bp, Homo sapiens
caaagtggggaggg

SEQ ID NO: 2201180 - DNA, 17 bp, Homo sapiens
caaagtggggagggaca

SEQ ID NO: 2201181 - DNA, 13 bp, Homo sapiens
caacaagatttcc

SEQ ID NO: 2201182 - DNA, 13 bp, Homo sapiens
caagggattctgg

SEQ ID NO: 2201183 - DNA, 16 bp, Homo sapiens
caagggattctgggaa

SEQ ID NO: 2201184 - DNA, 21 bp, Homo sapiens
caatgtgagtcccagagcccg

SEQ ID NO: 2201185 - DNA, 13 bp, Homo sapiens
caattaatgcttt

SEQ ID NO: 2201186 - DNA, 16 bp, Homo sapiens
cacatggggcctggcc

SEQ ID NO: 2201187 - DNA, 22 bp, Homo sapiens
cacatggggcctggcccacgcc

SEQ ID NO: 2201188 - DNA, 12 bp, Homo sapiens
caccagtgcctt

SEQ ID NO: 2201189 - DNA, 15 bp, Homo sapiens
cacccctaagtgccc

SEQ ID NO: 2201190 - DNA, 16 bp, Homo sapiens
cacccctaagtgccca

SEQ ID NO: 2201191 - DNA, 15 bp, Homo sapiens
cagcatcttctggtt

SEQ ID NO: 2201192 - DNA, 20 bp, Homo sapiens
caggcccgagatgtgaccca

SEQ ID NO: 2201193 - DNA, 20 bp, Homo sapiens
catgccctgccttgtccctc

SEQ ID NO: 2201194 - DNA, 16 bp, Homo sapiens
ccaaagtggggaggga

SEQ ID NO: 2201195 - DNA, 20 bp, Homo sapiens
ccaaagtggggagggacaag

SEQ ID NO: 2201196 - DNA, 22 bp, Homo sapiens
ccaataaaagctcttctttttt

SEQ ID NO: 2201197 - DNA, 12 bp, Homo sapiens
ccaccagtgcct

SEQ ID NO: 2201198 - DNA, 13 bp, Homo sapiens
ccaccagtgcctt

SEQ ID NO: 2201199 - DNA, 19 bp, Homo sapiens
ccacgccctccctctccca

SEQ ID NO: 2201200 - DNA, 19 bp, Homo sapiens
tgattttcaagcagcatct

SEQ ID NO: 2201201 - DNA, 15 bp, Homo sapiens
tgccaaggagcccct

SEQ ID NO: 2201202 - DNA, 15 bp, Homo sapiens
tgcccaaagtgggga

SEQ ID NO: 2201203 - DNA, 19 bp, Homo sapiens
tgccctgccttgtccctct

SEQ ID NO: 2201204 - DNA, 12 bp, Homo sapiens
tggcccacgccc

SEQ ID NO: 2201205 - DNA, 19 bp, Homo sapiens
tggcccacgccctccctct

SEQ ID NO: 2201206 - DNA, 17 bp, Homo sapiens
tgggaagcttgagcctc

SEQ ID NO: 2201207 - DNA, 18 bp, Homo sapiens
tgggaagcttgagcctcc

SEQ ID NO: 2201208 - DNA, 15 bp, Homo sapiens
tggggagggacaagg

SEQ ID NO: 2201209 - DNA, 18 bp, Homo sapiens
tggtgtcacatggggcct

SEQ ID NO: 2201210 - DNA, 17 bp, Homo sapiens
tgtccctctcactcccc

SEQ ID NO: 2201211 - DNA, 22 bp, Homo sapiens
tgtcgaaaagagtcttccaatt

SEQ ID NO: 2201212 - DNA, 13 bp, Homo sapiens
tgtgacccaccag

SEQ ID NO: 2201213 - DNA, 15 bp, Homo sapiens
tgtgacccaccagtg

SEQ ID NO: 2201214 - DNA, 18 bp, Homo sapiens
tgtgacccaccagtgcct

SEQ ID NO: 2201215 - DNA, 19 bp, Homo sapiens
tgtgacccaccagtgcctt

SEQ ID NO: 2201216 - DNA, 13 bp, Homo sapiens
ttccttgtgcaaa

SEQ ID NO: 2201217 - DNA, 22 bp, Homo sapiens
ttctacggatcatcaacaagat

SEQ ID NO: 2201218 - DNA, 22 bp, Homo sapiens
ttctggtttaaacttgtttgct

SEQ ID NO: 2201219 - DNA, 13 bp, Homo sapiens
ttcttccccacaa

SEQ ID NO: 2201220 - DNA, 13 bp, Homo sapiens
ttgtccctctcac

SEQ ID NO: 2201221 - DNA, 22 bp, Homo sapiens
ttgtcgaaaagagtcttccaat

SEQ ID NO: 2201222 - DNA, 16 bp, Homo sapiens
tttgactattctgtat

SEQ ID NO: 2201223 - DNA, 14 bp, Homo sapiens
tttgctgtgaacaa

SEQ ID NO: 2201224 - DNA, 23 bp, Homo sapiens
cccgagatgtgacccaccagtgc

SEQ ID NO: 2201225 - DNA, 14 bp, Homo sapiens
ccctaagtgcccaa

SEQ ID NO: 2201226 - DNA, 17 bp, Homo sapiens
ccctaagtgcccaaagt

SEQ ID NO: 2201227 - DNA, 16 bp, Homo sapiens
ccctctcccaggcccg

SEQ ID NO: 2201228 - DNA, 21 bp, Homo sapiens
ccctggtgtcacatggggcct

SEQ ID NO: 2201229 - DNA, 22 bp, Homo sapiens
cctaagagactgcgttctgcaa

SEQ ID NO: 2201230 - DNA, 13 bp, Homo sapiens
cctcccccaaagc

SEQ ID NO: 2201231 - DNA, 14 bp, Homo sapiens
cctctcccaggccc

SEQ ID NO: 2201232 - DNA, 15 bp, Homo sapiens
cgaaaagagtcttcc

SEQ ID NO: 2201233 - DNA, 16 bp, Homo sapiens
cgagatgtgacccacc

SEQ ID NO: 2201234 - DNA, 18 bp, Homo sapiens
cgagatgtgacccaccag

SEQ ID NO: 2201235 - DNA, 23 bp, Homo sapiens
cgccctccctctcccaggcccga

SEQ ID NO: 2201236 - DNA, 21 bp, Homo sapiens
cggatcatcaacaagatttcc

SEQ ID NO: 2201237 - DNA, 11 bp, Homo sapiens
ctaagtgccca

SEQ ID NO: 2201238 - DNA, 17 bp, Homo sapiens
ctaagtgcccaaagtgg

SEQ ID NO: 2201239 - DNA, 20 bp, Homo sapiens
ctcaaaagagaaaaacaaaa

SEQ ID NO: 2201240 - DNA, 12 bp, Homo sapiens
ctcccccaaagc

SEQ ID NO: 2201241 - DNA, 14 bp, Homo sapiens
ctctcactccccag

SEQ ID NO: 2201242 - DNA, 13 bp, Homo sapiens
ctctcccaggccc

SEQ ID NO: 2201243 - DNA, 17 bp, Homo sapiens
ctgactttttcccccca

SEQ ID NO: 2201244 - DNA, 15 bp, Homo sapiens
ctgcgttctgcaagc

SEQ ID NO: 2201245 - DNA, 17 bp, Homo sapiens
ctggatgccaaggagcc

SEQ ID NO: 2201246 - DNA, 18 bp, Homo sapiens
ctggatgccaaggagccc

SEQ ID NO: 2201247 - DNA, 20 bp, Homo sapiens
ctggatgccaaggagcccct

SEQ ID NO: 2201248 - DNA, 17 bp, Homo sapiens
ctggcccacgccctccc

SEQ ID NO: 2201249 - DNA, 22 bp, Homo sapiens
ctggcccacgccctccctctcc

SEQ ID NO: 2201250 - DNA, 12 bp, Homo sapiens
cttgagcctccc

SEQ ID NO: 2201251 - DNA, 13 bp, Homo sapiens
cttgagcctcccc

SEQ ID NO: 2201252 - DNA, 21 bp, Homo sapiens
cttgtgcaaaatatttgacta

SEQ ID NO: 2201253 - DNA, 12 bp, Homo sapiens
gacccaccagtg

SEQ ID NO: 2201254 - DNA, 13 bp, Homo sapiens
gacccaccagtgc

SEQ ID NO: 2201255 - DNA, 15 bp, Homo sapiens
gactgcgttctgcaa

SEQ ID NO: 2201256 - DNA, 16 bp, Homo sapiens
gactgcgttctgcaag

SEQ ID NO: 2201257 - DNA, 17 bp, Homo sapiens
gagactgcgttctgcaa

SEQ ID NO: 2201258 - DNA, 18 bp, Homo sapiens
gagatgtgacccaccagt

SEQ ID NO: 2201259 - DNA, 15 bp, Homo sapiens
gatcatcaacaagat

SEQ ID NO: 2201260 - DNA, 15 bp, Homo sapiens
gatgtgacccaccag

SEQ ID NO: 2201261 - DNA, 20 bp, Homo sapiens
gatgtgacccaccagtgcct

SEQ ID NO: 2201262 - DNA, 15 bp, Homo sapiens
gatttccttgtgcaa

SEQ ID NO: 2201263 - DNA, 15 bp, Homo sapiens
gcatcagttctacgg

SEQ ID NO: 2201264 - DNA, 14 bp, Homo sapiens
gccaaggagcccct

SEQ ID NO: 2201265 - DNA, 14 bp, Homo sapiens
gcccaaagtgggga

SEQ ID NO: 2201266 - DNA, 21 bp, Homo sapiens
gcccacgccctccctctccca

SEQ ID NO: 2201267 - DNA, 19 bp, Homo sapiens
gccccacccctaagtgccc

SEQ ID NO: 2201268 - DNA, 14 bp, Homo sapiens
gccctccctctccc

SEQ ID NO: 2201269 - DNA, 16 bp, Homo sapiens
gccctccctctcccag

SEQ ID NO: 2201270 - DNA, 14 bp, Homo sapiens
gcctcccccaaagc

SEQ ID NO: 2201271 - DNA, 22 bp, Homo sapiens
gccttgtccctctcactcccca

SEQ ID NO: 2201272 - DNA, 20 bp, Homo sapiens
gcttgagcctcccccaaagc

SEQ ID NO: 2201273 - DNA, 20 bp, Homo sapiens
ggaagcttgagcctccccca

SEQ ID NO: 2201274 - DNA, 19 bp, Homo sapiens
ggatcatcaacaagatttc

SEQ ID NO: 2201275 - DNA, 17 bp, Homo sapiens
ggatgccaaggagcccc

SEQ ID NO: 2201276 - DNA, 10 bp, Homo sapiens
ggattctggg

SEQ ID NO: 2201277 - DNA, 18 bp, Homo sapiens
ggttagattcaaggcccc

SEQ ID NO: 2201278 - DNA, 17 bp, Homo sapiens
gtccctctcactcccca

SEQ ID NO: 2201279 - DNA, 15 bp, Homo sapiens
gtgcccaaagtgggg

SEQ ID NO: 2201280 - DNA, 18 bp, Homo sapiens
gtggggagggacaaggga

SEQ ID NO: 2201281 - DNA, 13 bp, Homo sapiens
gttcttccccaca

SEQ ID NO: 2201282 - DNA, 22 bp, Homo sapiens
taaacttgtttgctgtgaacaa

SEQ ID NO: 2201283 - DNA, 15 bp, Homo sapiens
taagtgcccaaagtg

SEQ ID NO: 2201284 - DNA, 17 bp, Homo sapiens
taccattcacaataaaa

SEQ ID NO: 2201285 - DNA, 21 bp, Homo sapiens
taccattcacaataaaagctt

SEQ ID NO: 2201286 - DNA, 19 bp, Homo sapiens
tacggatcatcaacaagat

SEQ ID NO: 2201287 - DNA, 21 bp, Homo sapiens
tagctttaatcaatcatgccc

SEQ ID NO: 2201288 - DNA, 14 bp, Homo sapiens
tcactccccagccc

SEQ ID NO: 2201289 - DNA, 13 bp, Homo sapiens
tcatcaacaagat

SEQ ID NO: 2201290 - DNA, 15 bp, Homo sapiens
tcccaggcccgagat

SEQ ID NO: 2201291 - DNA, 17 bp, Homo sapiens
tccctctcactccccag

SEQ ID NO: 2201292 - DNA, 17 bp, Homo sapiens
tccctctcccaggcccg

SEQ ID NO: 2201293 - DNA, 13 bp, Homo sapiens
tctcactccccag

SEQ ID NO: 2201294 - DNA, 18 bp, Homo sapiens
tctcactccccagcccca

SEQ ID NO: 2201295 - DNA, 11 bp, Homo sapiens
tcttccccaca

SEQ ID NO: 2201296 - DNA, 21 bp, Homo sapiens
tgaacaattgtcgaaaagagt

SEQ ID NO: 2201297 - DNA, 20 bp, Homo sapiens
tgactattctgtatctttca

SEQ ID NO: 2201298 - DNA, 14 bp, Homo sapiens
tgccaaggagcccc

SEQ ID NO: 2201299 - DNA, 22 bp, Homo sapiens
tgcccaaagtggggagggacaa

SEQ ID NO: 2201300 - DNA, 20 bp, Homo sapiens
tgtcgaaaagagtcttccaa

SEQ ID NO: 2201301 - DNA, 17 bp, Homo sapiens
tgtgagtcccagagccc

SEQ ID NO: 2201302 - DNA, 15 bp, Homo sapiens
tgttaccattcacaa

SEQ ID NO: 2201303 - DNA, 14 bp, Homo sapiens
ttaccattcacaat

SEQ ID NO: 2201304 - DNA, 15 bp, Homo sapiens
ttaccattcacaata

SEQ ID NO: 2201305 - DNA, 17 bp, Homo sapiens
ttaccattcacaataaa

SEQ ID NO: 2201306 - DNA, 19 bp, Homo sapiens
ttctacggatcatcaacaa

SEQ ID NO: 2201307 - DNA, 20 bp, Homo sapiens
ttctgggaagcttgagcctc

SEQ ID NO: 2201308 - DNA, 22 bp, Homo sapiens
ttctgggaagcttgagcctccc

SEQ ID NO: 2201309 - DNA, 12 bp, Homo sapiens
ttgagcctcccc

SEQ ID NO: 2201310 - DNA, 20 bp, Homo sapiens
ttgtccctctcactccccag

SEQ ID NO: 2201311 - DNA, 23 bp, Homo sapiens
ttgtcgaaaagagtcttccaatt

SEQ ID NO: 2201312 - DNA, 13 bp, Homo sapiens
tttccttgtgcaa

SEQ ID NO: 2201313 - DNA, 15 bp, Homo sapiens
tttccttgtgcaaaa

SEQ ID NO: 2201314 - DNA, 15 bp, Homo sapiens
ttttcaagcagcatc

SEQ ID NO: 2201315 - DNA, 22 bp, Homo sapiens
ttttcaagcagcatcttctggt

SEQ ID NO: 2201316 - DNA, 13 bp, Homo sapiens
cccaccagtgcct

SEQ ID NO: 2201317 - DNA, 16 bp, Homo sapiens
cccacccctaagtgcc

SEQ ID NO: 2201318 - DNA, 11 bp, Homo sapiens
cccagagcccg

SEQ ID NO: 2201319 - DNA, 19 bp, Homo sapiens
cccagagcccgcttttgtt

SEQ ID NO: 2201320 - DNA, 20 bp, Homo sapiens
cccgagatgtgacccaccag

SEQ ID NO: 2201321 - DNA, 22 bp, Homo sapiens
cccgcttttgttcttccccaca

SEQ ID NO: 2201322 - DNA, 12 bp, Homo sapiens
ccctaagagact

SEQ ID NO: 2201323 - DNA, 15 bp, Homo sapiens
ccctaagtgcccaaa

SEQ ID NO: 2201324 - DNA, 16 bp, Homo sapiens
ccctaagtgcccaaag

SEQ ID NO: 2201325 - DNA, 20 bp, Homo sapiens
ccgagatgtgacccaccagt

SEQ ID NO: 2201326 - DNA, 21 bp, Homo sapiens
ccgagatgtgacccaccagtg

SEQ ID NO: 2201327 - DNA, 13 bp, Homo sapiens
ccgcttttgttct

SEQ ID NO: 2201328 - DNA, 16 bp, Homo sapiens
cctaagtgcccaaagt

SEQ ID NO: 2201329 - DNA, 17 bp, Homo sapiens
cctaagtgcccaaagtg

SEQ ID NO: 2201330 - DNA, 13 bp, Homo sapiens
cctccctctccca

SEQ ID NO: 2201331 - DNA, 22 bp, Homo sapiens
cctccctctcccaggcccgaga

SEQ ID NO: 2201332 - DNA, 18 bp, Homo sapiens
cctctcccaggcccgaga

SEQ ID NO: 2201333 - DNA, 21 bp, Homo sapiens
cctggatgccaaggagcccct

SEQ ID NO: 2201334 - DNA, 20 bp, Homo sapiens
cgagatgtgacccaccagtg

SEQ ID NO: 2201335 - DNA, 16 bp, Homo sapiens
cgcttttgttcttccc

SEQ ID NO: 2201336 - DNA, 15 bp, Homo sapiens
cggatcatcaacaag

SEQ ID NO: 2201337 - DNA, 19 bp, Homo sapiens
cggatcatcaacaagattt

SEQ ID NO: 2201338 - DNA, 23 bp, Homo sapiens
ctaagaaacacatcaaataaact

SEQ ID NO: 2201339 - DNA, 13 bp, Homo sapiens
ctaagtgcccaaa

SEQ ID NO: 2201340 - DNA, 14 bp, Homo sapiens
ctaagtgcccaaag

SEQ ID NO: 2201341 - DNA, 21 bp, Homo sapiens
ctaagtgcccaaagtggggag

SEQ ID NO: 2201342 - DNA, 12 bp, Homo sapiens
ctccctctccca

SEQ ID NO: 2201343 - DNA, 16 bp, Homo sapiens
ctgactttttcccccc

SEQ ID NO: 2201344 - DNA, 19 bp, Homo sapiens
ctgccttgtccctctcact

SEQ ID NO: 2201345 - DNA, 14 bp, Homo sapiens
ctggcccacgccct

SEQ ID NO: 2201346 - DNA, 18 bp, Homo sapiens
ctgggaagcttgagcctc

SEQ ID NO: 2201347 - DNA, 19 bp, Homo sapiens
ctgggaagcttgagcctcc

SEQ ID NO: 2201348 - DNA, 22 bp, Homo sapiens
ctgggaagcttgagcctccccc

SEQ ID NO: 2201349 - DNA, 20 bp, Homo sapiens
cttgtccctctcactcccca

SEQ ID NO: 2201350 - DNA, 19 bp, Homo sapiens
gaaacacatcaaataaact

SEQ ID NO: 2201351 - DNA, 14 bp, Homo sapiens
gaagcttgagcctc

SEQ ID NO: 2201352 - DNA, 16 bp, Homo sapiens
gaagcttgagcctccc

SEQ ID NO: 2201353 - DNA, 18 bp, Homo sapiens
gaagcttgagcctccccc

SEQ ID NO: 2201354 - DNA, 19 bp, Homo sapiens
gaagcttgagcctccccca

SEQ ID NO: 2201355 - DNA, 18 bp, Homo sapiens
gacaagggattctgggaa

SEQ ID NO: 2201356 - DNA, 19 bp, Homo sapiens
gactattctgtatctttca

SEQ ID NO: 2201357 - DNA, 20 bp, Homo sapiens
gagatgtgacccaccagtgc

SEQ ID NO: 2201358 - DNA, 16 bp, Homo sapiens
gagctgttaccattca

SEQ ID NO: 2201359 - DNA, 11 bp, Homo sapiens
gattctgggaa

SEQ ID NO: 2201360 - DNA, 12 bp, Homo sapiens
gcagcatcttct

SEQ ID NO: 2201361 - DNA, 20 bp, Homo sapiens
gcccacgccctccctctccc

SEQ ID NO: 2201362 - DNA, 20 bp, Homo sapiens
gccccacccctaagtgccca

SEQ ID NO: 2201363 - DNA, 22 bp, Homo sapiens
gccccacccctaagtgcccaaa

SEQ ID NO: 2201364 - DNA, 15 bp, Homo sapiens
gcccgcttttgttct

SEQ ID NO: 2201365 - DNA, 19 bp, Homo sapiens
gccctgccttgtccctctc

SEQ ID NO: 2201366 - DNA, 21 bp, Homo sapiens
gcctggatgccaaggagcccc

SEQ ID NO: 2201367 - DNA, 17 bp, Homo sapiens
gcctggcccacgccctc

SEQ ID NO: 2201368 - DNA, 18 bp, Homo sapiens
gcctggcccacgccctcc

SEQ ID NO: 2201369 - DNA, 15 bp, Homo sapiens
gctgttaccattcac

SEQ ID NO: 2201370 - DNA, 18 bp, Homo sapiens
gctgttaccattcacaat

SEQ ID NO: 2201371 - DNA, 13 bp, Homo sapiens
gcttgagcctccc

SEQ ID NO: 2201372 - DNA, 18 bp, Homo sapiens
gggacaagggattctggg

SEQ ID NO: 2201373 - DNA, 11 bp, Homo sapiens
gggattctggg

SEQ ID NO: 2201374 - DNA, 20 bp, Homo sapiens
ggtttaaacttgtttgctgt

SEQ ID NO: 2201375 - DNA, 20 bp, Homo sapiens
gtcacatggggcctggccca

SEQ ID NO: 2201376 - DNA, 12 bp, Homo sapiens
gtccctctcact

SEQ ID NO: 2201377 - DNA, 16 bp, Homo sapiens
gtccctctcactcccc

SEQ ID NO: 2201378 - DNA, 18 bp, Homo sapiens
gtccctctcactccccag

SEQ ID NO: 2201379 - DNA, 17 bp, Homo sapiens
gtgacccaccagtgcct

SEQ ID NO: 2201380 - DNA, 19 bp, Homo sapiens
gtgcaaaatatttgactat

SEQ ID NO: 2201381 - DNA, 17 bp, Homo sapiens
gtgcccaaagtggggag

SEQ ID NO: 2201382 - DNA, 22 bp, Homo sapiens
gtggggagggacaagggattct

SEQ ID NO: 2201383 - DNA, 19 bp, Homo sapiens
gttctacggatcatcaaca

SEQ ID NO: 2201384 - DNA, 13 bp, Homo sapiens
gtttgctgtgaac

SEQ ID NO: 2201385 - DNA, 13 bp, Homo sapiens
taaactgactttt

SEQ ID NO: 2201386 - DNA, 14 bp, Homo sapiens
taagtgcccaaagt

SEQ ID NO: 2201387 - DNA, 20 bp, Homo sapiens
tcaaaagagaaaaacaaaac

SEQ ID NO: 2201388 - DNA, 22 bp, Homo sapiens
tcaacaagatttccttgtgcaa

SEQ ID NO: 2201389 - DNA, 14 bp, Homo sapiens
tcacaataaaagct

SEQ ID NO: 2201390 - DNA, 19 bp, Homo sapiens
tcacatggggcctggccca

SEQ ID NO: 2201391 - DNA, 11 bp, Homo sapiens
tcactccccag

SEQ ID NO: 2201392 - DNA, 19 bp, Homo sapiens
tcatcaacaagatttcctt

SEQ ID NO: 2201393 - DNA, 14 bp, Homo sapiens
tcccagagcccgct

SEQ ID NO: 2201394 - DNA, 15 bp, Homo sapiens
tccccagccccaccc

SEQ ID NO: 2201395 - DNA, 16 bp, Homo sapiens
tccctctcactcccca

SEQ ID NO: 2201396 - DNA, 12 bp, Homo sapiens
tccttgtgcaaa

SEQ ID NO: 2201397 - DNA, 23 bp, Homo sapiens
tccttgtgcaaaatatttgacta

SEQ ID NO: 2201398 - DNA, 18 bp, Homo sapiens
tctacggatcatcaacaa

SEQ ID NO: 2201399 - DNA, 21 bp, Homo sapiens
tctacggatcatcaacaagat

SEQ ID NO: 2201400 - DNA, 21 bp, Homo sapiens
tctctcaaaagagaaaaacaa

SEQ ID NO: 2201401 - DNA, 19 bp, Homo sapiens
tctgggaagcttgagcctc

SEQ ID NO: 2201402 - DNA, 12 bp, Homo sapiens
tgacccaccagt

SEQ ID NO: 2201403 - DNA, 18 bp, Homo sapiens
tgactattctgtatcttt

SEQ ID NO: 2201404 - DNA, 12 bp, Homo sapiens
tgagcctccccc

SEQ ID NO: 2201405 - DNA, 14 bp, Homo sapiens
tgagcctcccccaa

SEQ ID NO: 2201406 - DNA, 17 bp, Homo sapiens
tgattttcaagcagcat

SEQ ID NO: 2201407 - DNA, 17 bp, Homo sapiens
tgcccaaagtggggagg

SEQ ID NO: 2201408 - DNA, 16 bp, Homo sapiens
tgccttctgtctgctc

SEQ ID NO: 2201409 - DNA, 16 bp, Homo sapiens
tgcgttctgcaagcat

SEQ ID NO: 2201410 - DNA, 18 bp, Homo sapiens
tggatgccaaggagcccc

SEQ ID NO: 2201411 - DNA, 19 bp, Homo sapiens
tggatgccaaggagcccct

SEQ ID NO: 2201412 - DNA, 14 bp, Homo sapiens
tgggaagcttgagc

SEQ ID NO: 2201413 - DNA, 23 bp, Homo sapiens
tggggcctggcccacgccctccc

SEQ ID NO: 2201414 - DNA, 16 bp, Homo sapiens
tgtgagtcccagagcc

SEQ ID NO: 2201415 - DNA, 14 bp, Homo sapiens
tgtttgctgtgaac

SEQ ID NO: 2201416 - DNA, 14 bp, Homo sapiens
ttaaacacattgtc

SEQ ID NO: 2201417 - DNA, 22 bp, Homo sapiens
ttaatcaatcatgccctgcctt

SEQ ID NO: 2201418 - DNA, 13 bp, Homo sapiens
ttcacaataaaag

SEQ ID NO: 2201419 - DNA, 20 bp, Homo sapiens
ttctacggatcatcaacaag

SEQ ID NO: 2201420 - DNA, 17 bp, Homo sapiens
ttctggtttaaacttgt

SEQ ID NO: 2201421 - DNA, 18 bp, Homo sapiens
ttgctgtgaacaattgtc

SEQ ID NO: 2201422 - DNA, 15 bp, Homo sapiens
tttgctgtgaacaat

SEQ ID NO: 2201423 - DNA, 13 bp, Homo sapiens
tttttccccccaa

SEQ ID NO: 2201424 - DNA, 20 bp, Homo sapiens
aaactgactttttcccccca

SEQ ID NO: 2201425 - DNA, 17 bp, Homo sapiens
aacacatcaaataaact

SEQ ID NO: 2201426 - DNA, 19 bp, Homo sapiens
aactgactttttcccccca

SEQ ID NO: 2201427 - DNA, 21 bp, Homo sapiens
aagaaacacatcaaataaact

SEQ ID NO: 2201428 - DNA, 14 bp, Homo sapiens
aagagtcttccaat

SEQ ID NO: 2201429 - DNA, 13 bp, Homo sapiens
aagcttgagcctc

SEQ ID NO: 2201430 - DNA, 11 bp, Homo sapiens
aagggattctg

SEQ ID NO: 2201431 - DNA, 14 bp, Homo sapiens
aagggattctggga

SEQ ID NO: 2201432 - DNA, 15 bp, Homo sapiens
aagggattctgggaa

SEQ ID NO: 2201433 - DNA, 11 bp, Homo sapiens
aagtgcccaaa

SEQ ID NO: 2201434 - DNA, 14 bp, Homo sapiens
aagtgcccaaagtg

SEQ ID NO: 2201435 - DNA, 18 bp, Homo sapiens
aatatttgactattctgt

SEQ ID NO: 2201436 - DNA, 18 bp, Homo sapiens
aattgtcgaaaagagtct

SEQ ID NO: 2201437 - DNA, 23 bp, Homo sapiens
aattgtcgaaaagagtcttccaa

SEQ ID NO: 2201438 - DNA, 11 bp, Homo sapiens
acaagggattc

SEQ ID NO: 2201439 - DNA, 14 bp, Homo sapiens
acaagggattctgg

SEQ ID NO: 2201440 - DNA, 16 bp, Homo sapiens
acaagggattctggga

SEQ ID NO: 2201441 - DNA, 18 bp, Homo sapiens
acaagggattctgggaag

SEQ ID NO: 2201442 - DNA, 16 bp, Homo sapiens
acacatcaaataaact

SEQ ID NO: 2201443 - DNA, 14 bp, Homo sapiens
acatcaaataaact

SEQ ID NO: 2201444 - DNA, 17 bp, Homo sapiens
accattcacaataaaag

SEQ ID NO: 2201445 - DNA, 14 bp, Homo sapiens
acccctaagagact

SEQ ID NO: 2201446 - DNA, 15 bp, Homo sapiens
acccctaagtgccca

SEQ ID NO: 2201447 - DNA, 14 bp, Homo sapiens
acgccctccctctc

SEQ ID NO: 2201448 - DNA, 18 bp, Homo sapiens
acgccctccctctcccag

SEQ ID NO: 2201449 - DNA, 17 bp, Homo sapiens
actattctgtatctttc

SEQ ID NO: 2201450 - DNA, 18 bp, Homo sapiens
actgactttttcccccca

SEQ ID NO: 2201451 - DNA, 14 bp, Homo sapiens
actgcgttctgcaa

SEQ ID NO: 2201452 - DNA, 12 bp, Homo sapiens
actttttccccc

SEQ ID NO: 2201453 - DNA, 17 bp, Homo sapiens
agactgcgttctgcaag

SEQ ID NO: 2201454 - DNA, 16 bp, Homo sapiens
agagcccgcttttgtt

SEQ ID NO: 2201455 - DNA, 21 bp, Homo sapiens
agcaatgtgagtcccagagcc

SEQ ID NO: 2201456 - DNA, 15 bp, Homo sapiens
agcagcatcttctgg

SEQ ID NO: 2201457 - DNA, 12 bp, Homo sapiens
agcatcttctgg

SEQ ID NO: 2201458 - DNA, 13 bp, Homo sapiens
agcccgcttttgt

SEQ ID NO: 2201459 - DNA, 21 bp, Homo sapiens
agcccgcttttgttcttcccc

SEQ ID NO: 2201460 - DNA, 22 bp, Homo sapiens
agcccgcttttgttcttcccca

SEQ ID NO: 2201461 - DNA, 15 bp, Homo sapiens
agcctcccccaaagc

SEQ ID NO: 2201462 - DNA, 23 bp, Homo sapiens
agcctggatgccaaggagcccct

SEQ ID NO: 2201463 - DNA, 14 bp, Homo sapiens
agctcttctttttt

SEQ ID NO: 2201464 - DNA, 15 bp, Homo sapiens
agctgttaccattca

SEQ ID NO: 2201465 - DNA, 16 bp, Homo sapiens
agctgttaccattcac

SEQ ID NO: 2201466 - DNA, 19 bp, Homo sapiens
agctgttaccattcacaat

SEQ ID NO: 2201467 - DNA, 15 bp, Homo sapiens
agcttgagcctcccc

SEQ ID NO: 2201468 - DNA, 21 bp, Homo sapiens
agctttaatcaatcatgccct

SEQ ID NO: 2201469 - DNA, 13 bp, Homo sapiens
agggacaagggat

SEQ ID NO: 2201470 - DNA, 15 bp, Homo sapiens
agggacaagggattc

SEQ ID NO: 2201471 - DNA, 13 bp, Homo sapiens
agggattctggga

SEQ ID NO: 2201472 - DNA, 15 bp, Homo sapiens
aaaagagtcttccaa

SEQ ID NO: 2201473 - DNA, 17 bp, Homo sapiens
aaaagagtcttccaatt

SEQ ID NO: 2201474 - DNA, 20 bp, Homo sapiens
aaacttgtttgctgtgaaca

SEQ ID NO: 2201475 - DNA, 17 bp, Homo sapiens
aaagctcttctttttta

SEQ ID NO: 2201476 - DNA, 12 bp, Homo sapiens
aacaagatttcc

SEQ ID NO: 2201477 - DNA, 16 bp, Homo sapiens
aacttgtttgctgtga

SEQ ID NO: 2201478 - DNA, 18 bp, Homo sapiens
aagagactgcgttctgca

SEQ ID NO: 2201479 - DNA, 14 bp, Homo sapiens
aagcttgagcctcc

SEQ ID NO: 2201480 - DNA, 13 bp, Homo sapiens
aagtgcccaaagt

SEQ ID NO: 2201481 - DNA, 17 bp, Homo sapiens
aagtgcccaaagtgggg

SEQ ID NO: 2201482 - DNA, 19 bp, Homo sapiens
aagtgcccaaagtggggag

SEQ ID NO: 2201483 - DNA, 18 bp, Homo sapiens
aatcatgccctgccttgt

SEQ ID NO: 2201484 - DNA, 16 bp, Homo sapiens
aatgtgagtcccagag

SEQ ID NO: 2201485 - DNA, 21 bp, Homo sapiens
acaattgtcgaaaagagtctt

SEQ ID NO: 2201486 - DNA, 14 bp, Homo sapiens
acccaccagtgcct

SEQ ID NO: 2201487 - DNA, 14 bp, Homo sapiens
acccctaagtgccc

SEQ ID NO: 2201488 - DNA, 17 bp, Homo sapiens
acccctaagtgcccaaa

SEQ ID NO: 2201489 - DNA, 22 bp, Homo sapiens
acgccctccctctcccaggccc

SEQ ID NO: 2201490 - DNA, 15 bp, Homo sapiens
actaagaaacacatc

SEQ ID NO: 2201491 - DNA, 17 bp, Homo sapiens
actccccagccccaccc

SEQ ID NO: 2201492 - DNA, 17 bp, Homo sapiens
actgactttttcccccc

SEQ ID NO: 2201493 - DNA, 20 bp, Homo sapiens
agaaacacatcaaataaact

SEQ ID NO: 2201494 - DNA, 15 bp, Homo sapiens
agagactgcgttctg

SEQ ID NO: 2201495 - DNA, 17 bp, Homo sapiens
agagactgcgttctgca

SEQ ID NO: 2201496 - DNA, 20 bp, Homo sapiens
agatgtgacccaccagtgcc

SEQ ID NO: 2201497 - DNA, 21 bp, Homo sapiens
agatgtgacccaccagtgcct

SEQ ID NO: 2201498 - DNA, 15 bp, Homo sapiens
agcaatgtgagtccc

SEQ ID NO: 2201499 - DNA, 16 bp, Homo sapiens
agcaatgtgagtccca

SEQ ID NO: 2201500 - DNA, 22 bp, Homo sapiens
agcaatgtgagtcccagagccc

SEQ ID NO: 2201501 - DNA, 11 bp, Homo sapiens
agccccacccc

SEQ ID NO: 2201502 - DNA, 20 bp, Homo sapiens
agccccacccctaagtgccc

SEQ ID NO: 2201503 - DNA, 22 bp, Homo sapiens
agccccacccctaagtgcccaa

SEQ ID NO: 2201504 - DNA, 14 bp, Homo sapiens
agcccgcttttgtt

SEQ ID NO: 2201505 - DNA, 17 bp, Homo sapiens
agcttgagcctccccca

SEQ ID NO: 2201506 - DNA, 16 bp, Homo sapiens
agctttaatcaatcat

SEQ ID NO: 2201507 - DNA, 23 bp, Homo sapiens
aggcccgagatgtgacccaccag

SEQ ID NO: 2201508 - DNA, 13 bp, Homo sapiens
agtcccagagccc

SEQ ID NO: 2201509 - DNA, 17 bp, Homo sapiens
agtgcccaaagtgggga

SEQ ID NO: 2201510 - DNA, 18 bp, Homo sapiens
agtgcccaaagtggggag

SEQ ID NO: 2201511 - DNA, 20 bp, Homo sapiens
atcatcaacaagatttcctt

SEQ ID NO: 2201512 - DNA, 16 bp, Homo sapiens
atgtgacccaccagtg

SEQ ID NO: 2201513 - DNA, 21 bp, Homo sapiens
attctgggaagcttgagcctc

SEQ ID NO: 2201514 - DNA, 22 bp, Homo sapiens
attctgggaagcttgagcctcc

SEQ ID NO: 2201515 - DNA, 20 bp, Homo sapiens
attctgtatctttcatcctt

SEQ ID NO: 2201516 - DNA, 15 bp, Homo sapiens
atttccttgtgcaaa

SEQ ID NO: 2201517 - DNA, 13 bp, Homo sapiens
atttgactattct

SEQ ID NO: 2201518 - DNA, 17 bp, Homo sapiens
atttgactattctgtat

SEQ ID NO: 2201519 - DNA, 20 bp, Homo sapiens
attttcaagcagcatcttct

SEQ ID NO: 2201520 - DNA, 20 bp, Homo sapiens
caaagcaatgtgagtcccag

SEQ ID NO: 2201521 - DNA, 12 bp, Homo sapiens
caagggattctg

SEQ ID NO: 2201522 - DNA, 15 bp, Homo sapiens
caagggattctggga

SEQ ID NO: 2201523 - DNA, 17 bp, Homo sapiens
caagggattctgggaag

SEQ ID NO: 2201524 - DNA, 14 bp, Homo sapiens
caatgtgagtccca

SEQ ID NO: 2201525 - DNA, 21 bp, Homo sapiens
caattgtcgaaaagagtcttc

SEQ ID NO: 2201526 - DNA, 20 bp, Homo sapiens
cacatggggcctggcccacg

SEQ ID NO: 2201527 - DNA, 20 bp, Homo sapiens
cacccctaagtgcccaaagt

SEQ ID NO: 2201528 - DNA, 18 bp, Homo sapiens
cacgccctccctctccca

SEQ ID NO: 2201529 - DNA, 15 bp, Homo sapiens
cactccccagcccca

SEQ ID NO: 2201530 - DNA, 14 bp, Homo sapiens
cagcatcttctggt

SEQ ID NO: 2201531 - DNA, 23 bp, Homo sapiens
caggcccgagatgtgacccacca

SEQ ID NO: 2201532 - DNA, 13 bp, Homo sapiens
ccacaattccatt

SEQ ID NO: 2201533 - DNA, 19 bp, Homo sapiens
ccacccctaagtgcccaaa

SEQ ID NO: 2201534 - DNA, 22 bp, Homo sapiens
ccagccccacccctaagtgccc

SEQ ID NO: 2201535 - DNA, 20 bp, Homo sapiens
ccattcacaataaaagctta

SEQ ID NO: 2201536 - DNA, 15 bp, Homo sapiens
cccaaagtggggagg

SEQ ID NO: 2201537 - DNA, 19 bp, Homo sapiens
cccaaagtggggagggaca

SEQ ID NO: 2201538 - DNA, 11 bp, Homo sapiens
cccaccagtgc

SEQ ID NO: 2201539 - DNA, 17 bp, Homo sapiens
cccacccctaagtgccc

SEQ ID NO: 2201540 - DNA, 21 bp, Homo sapiens
cccagccccacccctaagtgc

SEQ ID NO: 2201541 - DNA, 22 bp, Homo sapiens
cccgagatgtgacccaccagtg

SEQ ID NO: 2201542 - DNA, 17 bp, Homo sapiens
catgttctcaataccca

SEQ ID NO: 2201543 - DNA, 19 bp, Homo sapiens
ctcaagatcctgtcttgct

SEQ ID NO: 2201544 - DNA, 23 bp, Homo sapiens
cagcttagaagttcgaaaactca

SEQ ID NO: 2201545 - DNA, 17 bp, Homo sapiens
aattattgatgttttca

SEQ ID NO: 2201546 - DNA, 19 bp, Homo sapiens
aattccctggcctttcata

SEQ ID NO: 2201547 - DNA, 14 bp, Homo sapiens
aattcttgcaaagt

SEQ ID NO: 2201548 - DNA, 20 bp, Homo sapiens
aattcttgcaaagtatccct

SEQ ID NO: 2201549 - DNA, 13 bp, Homo sapiens
aatttattatggc

SEQ ID NO: 2201550 - DNA, 20 bp, Homo sapiens
aatttttatgtaattatata

SEQ ID NO: 2201551 - DNA, 17 bp, Homo sapiens
acaaaggggcttaatta

SEQ ID NO: 2201552 - DNA, 18 bp, Homo sapiens
acaagaccacgtttctaa

SEQ ID NO: 2201553 - DNA, 18 bp, Homo sapiens
acaatgacttactgtaca

SEQ ID NO: 2201554 - DNA, 22 bp, Homo sapiens
acaattatttgaagatttaatt

SEQ ID NO: 2201555 - DNA, 14 bp, Homo sapiens
acaatttattatgg

SEQ ID NO: 2201556 - DNA, 16 bp, Homo sapiens
acaatttattatggca

SEQ ID NO: 2201557 - DNA, 20 bp, Homo sapiens
acacatgcaaggtcattttt

SEQ ID NO: 2201558 - DNA, 21 bp, Homo sapiens
acacattttattttattatgc

SEQ ID NO: 2201559 - DNA, 22 bp, Homo sapiens
acacattttattttattatgca

SEQ ID NO: 2201560 - DNA, 20 bp, Homo sapiens
acacattttttaaatgcacc

SEQ ID NO: 2201561 - DNA, 15 bp, Homo sapiens
acaccactacattct

SEQ ID NO: 2201562 - DNA, 20 bp, Homo sapiens
acaccactacattctgttaa

SEQ ID NO: 2201563 - DNA, 18 bp, Homo sapiens
acactccaattaaggatt

SEQ ID NO: 2201564 - DNA, 14 bp, Homo sapiens
acagaaatgtacag

SEQ ID NO: 2201565 - DNA, 16 bp, Homo sapiens
acagaaatgtacagca

SEQ ID NO: 2201566 - DNA, 19 bp, Homo sapiens
acagacatactaaccagca

SEQ ID NO: 2201567 - DNA, 21 bp, Homo sapiens
acagagttgttacatttttaa

SEQ ID NO: 2201568 - DNA, 17 bp, Homo sapiens
acagcaaggagatttac

SEQ ID NO: 2201569 - DNA, 24 bp, Homo sapiens
acagttttggttgctttaatatca

SEQ ID NO: 2201570 - DNA, 23 bp, Homo sapiens
acataatgcgtgcataccacttt

SEQ ID NO: 2201571 - DNA, 13 bp, Homo sapiens
acatactaaccag

SEQ ID NO: 2201572 - DNA, 21 bp, Homo sapiens
acatactaaccagcagaaatg

SEQ ID NO: 2201573 - DNA, 18 bp, Homo sapiens
acatattgatttccgtta

SEQ ID NO: 2201574 - DNA, 17 bp, Homo sapiens
acatcagcacgatttct

SEQ ID NO: 2201575 - DNA, 15 bp, Homo sapiens
acatgaaaacacatt

SEQ ID NO: 2201576 - DNA, 17 bp, Homo sapiens
acatgaaaacacatttt

SEQ ID NO: 2201577 - DNA, 18 bp, Homo sapiens
acatgcaaggtcattttt

SEQ ID NO: 2201578 - DNA, 19 bp, Homo sapiens
acatgcaaggtcatttttt

SEQ ID NO: 2201579 - DNA, 15 bp, Homo sapiens
acatgctacacactg

SEQ ID NO: 2201580 - DNA, 12 bp, Homo sapiens
acatgtatttgt

SEQ ID NO: 2201581 - DNA, 22 bp, Homo sapiens
acatgtcagccactgtgataga

SEQ ID NO: 2201582 - DNA, 14 bp, Homo sapiens
acattggttcttgt

SEQ ID NO: 2201583 - DNA, 14 bp, Homo sapiens
acattttattttat

SEQ ID NO: 2201584 - DNA, 18 bp, Homo sapiens
acattttattttattatg

SEQ ID NO: 2201585 - DNA, 15 bp, Homo sapiens
acatttttaagtgct

SEQ ID NO: 2201586 - DNA, 18 bp, Homo sapiens
acatttttaagtgctgca

SEQ ID NO: 2201587 - DNA, 14 bp, Homo sapiens
acattttttaaatg

SEQ ID NO: 2201588 - DNA, 16 bp, Homo sapiens
acattttttaaatgca

SEQ ID NO: 2201589 - DNA, 15 bp, Homo sapiens
accacgtttctaaag

SEQ ID NO: 2201590 - DNA, 19 bp, Homo sapiens
accacgtttctaaaggcta

SEQ ID NO: 2201591 - DNA, 16 bp, Homo sapiens
accacttttgttcttg

SEQ ID NO: 2201592 - DNA, 14 bp, Homo sapiens
accactttttgcag

SEQ ID NO: 2201593 - DNA, 18 bp, Homo sapiens
accactttttgcagcttt

SEQ ID NO: 2201594 - DNA, 17 bp, Homo sapiens
accagccagtaaatggg

SEQ ID NO: 2201595 - DNA, 20 bp, Homo sapiens
accatattaccacagacata

SEQ ID NO: 2201596 - DNA, 16 bp, Homo sapiens
acccagaagaaaatag

SEQ ID NO: 2201597 - DNA, 15 bp, Homo sapiens
accctcatgttctta

SEQ ID NO: 2201598 - DNA, 13 bp, Homo sapiens
acctacatgtatt

SEQ ID NO: 2201599 - DNA, 22 bp, Homo sapiens
acctctccagcctcagctctca

SEQ ID NO: 2201600 - DNA, 19 bp, Homo sapiens
acctcttgagccttgaact

SEQ ID NO: 2201601 - DNA, 20 bp, Homo sapiens
acctcttgagccttgaactt

SEQ ID NO: 2201602 - DNA, 19 bp, Homo sapiens
acctttgtattctctcctg

SEQ ID NO: 2201603 - DNA, 23 bp, Homo sapiens
acctttgtattctctcctgtacc

SEQ ID NO: 2201604 - DNA, 13 bp, Homo sapiens
accttttttatac

SEQ ID NO: 2201605 - DNA, 20 bp, Homo sapiens
accttttttatacataaaca

SEQ ID NO: 2201606 - DNA, 22 bp, Homo sapiens
accttttttatacataaacaag

SEQ ID NO: 2201607 - DNA, 13 bp, Homo sapiens
acgatgtcttcat

SEQ ID NO: 2201608 - DNA, 17 bp, Homo sapiens
acgatttctgtttagat

SEQ ID NO: 2201609 - DNA, 20 bp, Homo sapiens
acgatttctgtttagataat

SEQ ID NO: 2201610 - DNA, 23 bp, Homo sapiens
acgatttctgtttagataataca

SEQ ID NO: 2201611 - DNA, 24 bp, Homo sapiens
acggcagggaaatgtatgtgtgtc

SEQ ID NO: 2201612 - DNA, 13 bp, Homo sapiens
acgtacacatttt

SEQ ID NO: 2201613 - DNA, 12 bp, Homo sapiens
acgtttctaaag

SEQ ID NO: 2201614 - DNA, 15 bp, Homo sapiens
actaaaatgttctaa

SEQ ID NO: 2201615 - DNA, 17 bp, Homo sapiens
actaaacatgtatgtaa

SEQ ID NO: 2201616 - DNA, 17 bp, Homo sapiens
actaaccagcagaaatg

SEQ ID NO: 2201617 - DNA, 22 bp, Homo sapiens
actaagtttttatggcttttgt

SEQ ID NO: 2201618 - DNA, 11 bp, Homo sapiens
actacattctg

SEQ ID NO: 2201619 - DNA, 12 bp, Homo sapiens
actacattctgt

SEQ ID NO: 2201620 - DNA, 14 bp, Homo sapiens
actacattctgtta

SEQ ID NO: 2201621 - DNA, 22 bp, Homo sapiens
actatggccctggcctagcata

SEQ ID NO: 2201622 - DNA, 14 bp, Homo sapiens
actctatcaagtat

SEQ ID NO: 2201623 - DNA, 21 bp, Homo sapiens
actctcccattatatttattg

SEQ ID NO: 2201624 - DNA, 19 bp, Homo sapiens
actgagtacgttgtgcatt

SEQ ID NO: 2201625 - DNA, 22 bp, Homo sapiens
actgagtacgttgtgcatttgg

SEQ ID NO: 2201626 - DNA, 23 bp, Homo sapiens
actgagtacgttgtgcatttggt

SEQ ID NO: 2201627 - DNA, 21 bp, Homo sapiens
actgataaagatgagtgagca

SEQ ID NO: 2201628 - DNA, 16 bp, Homo sapiens
actgcatgtttgtgat

SEQ ID NO: 2201629 - DNA, 13 bp, Homo sapiens
actgcttgtttcc

SEQ ID NO: 2201630 - DNA, 20 bp, Homo sapiens
actgtatcatgacaaagact

SEQ ID NO: 2201631 - DNA, 15 bp, Homo sapiens
actgtcctattatat

SEQ ID NO: 2201632 - DNA, 15 bp, Homo sapiens
actgttatttataat

SEQ ID NO: 2201633 - DNA, 21 bp, Homo sapiens
actgttatttataatcacttt

SEQ ID NO: 2201634 - DNA, 15 bp, Homo sapiens
actgtttcaaacttt

SEQ ID NO: 2201635 - DNA, 20 bp, Homo sapiens
acttaaataatgtgaaactg

SEQ ID NO: 2201636 - DNA, 14 bp, Homo sapiens
acttactgtacatg

SEQ ID NO: 2201637 - DNA, 17 bp, Homo sapiens
acttcattaataataaa

SEQ ID NO: 2201638 - DNA, 15 bp, Homo sapiens
acttggttcttgtac

SEQ ID NO: 2201639 - DNA, 19 bp, Homo sapiens
actttaccttttttataca

SEQ ID NO: 2201640 - DNA, 16 bp, Homo sapiens
actttgacctctgcag

SEQ ID NO: 2201641 - DNA, 13 bp, Homo sapiens
acttttgttcttg

SEQ ID NO: 2201642 - DNA, 15 bp, Homo sapiens
acttttgttcttggt

SEQ ID NO: 2201643 - DNA, 12 bp, Homo sapiens
actttttgcagc

SEQ ID NO: 2201644 - DNA, 13 bp, Homo sapiens
actttttgcagct

SEQ ID NO: 2201645 - DNA, 17 bp, Homo sapiens
actttttgcagctttct

SEQ ID NO: 2201646 - DNA, 17 bp, Homo sapiens
agaaaaaggatgcacag

SEQ ID NO: 2201647 - DNA, 15 bp, Homo sapiens
agaaatgccttaccc

SEQ ID NO: 2201648 - DNA, 17 bp, Homo sapiens
agaactaaaatgttcta

SEQ ID NO: 2201649 - DNA, 16 bp, Homo sapiens
agaagattctatgtta

SEQ ID NO: 2201650 - DNA, 18 bp, Homo sapiens
agaattctctagtttgat

SEQ ID NO: 2201651 - DNA, 17 bp, Homo sapiens
agacaatgacttactgt

SEQ ID NO: 2201652 - DNA, 21 bp, Homo sapiens
agacaatgacttactgtacat

SEQ ID NO: 2201653 - DNA, 22 bp, Homo sapiens
agacaatgacttactgtacatg

SEQ ID NO: 2201654 - DNA, 15 bp, Homo sapiens
agacaatttattatg

SEQ ID NO: 2201655 - DNA, 23 bp, Homo sapiens
agacatactaaccagcagaaatg

SEQ ID NO: 2201656 - DNA, 16 bp, Homo sapiens
agacgatgtcttcata

SEQ ID NO: 2201657 - DNA, 19 bp, Homo sapiens
agacgatgtcttcatacct

SEQ ID NO: 2201658 - DNA, 20 bp, Homo sapiens
agaggttcaaagatattttg

SEQ ID NO: 2201659 - DNA, 17 bp, Homo sapiens
agagttgatactacagt

SEQ ID NO: 2201660 - DNA, 17 bp, Homo sapiens
agagttgttacattttt

SEQ ID NO: 2201661 - DNA, 21 bp, Homo sapiens
agagttgttacatttttaagt

SEQ ID NO: 2201662 - DNA, 19 bp, Homo sapiens
agataactgttatttataa

SEQ ID NO: 2201663 - DNA, 14 bp, Homo sapiens
agatcaatgtgacg

SEQ ID NO: 2201664 - DNA, 18 bp, Homo sapiens
agattctatgttaatatt

SEQ ID NO: 2201665 - DNA, 22 bp, Homo sapiens
agattctatgttaatattttat

SEQ ID NO: 2201666 - DNA, 17 bp, Homo sapiens
agcaaggagatttacaa

SEQ ID NO: 2201667 - DNA, 16 bp, Homo sapiens
agcacgatttctgttt

SEQ ID NO: 2201668 - DNA, 19 bp, Homo sapiens
agcagaaatgccttaccct

SEQ ID NO: 2201669 - DNA, 13 bp, Homo sapiens
agcagcgtttcta

SEQ ID NO: 2201670 - DNA, 19 bp, Homo sapiens
agcagcgtttctatgacac

SEQ ID NO: 2201671 - DNA, 15 bp, Homo sapiens
agcatacgtacacat

SEQ ID NO: 2201672 - DNA, 19 bp, Homo sapiens
agcatacgtacacatttta

SEQ ID NO: 2201673 - DNA, 20 bp, Homo sapiens
agcatacgtacacattttat

SEQ ID NO: 2201674 - DNA, 13 bp, Homo sapiens
agcattttataaa

SEQ ID NO: 2201675 - DNA, 13 bp, Homo sapiens
agccagtaaatgg

SEQ ID NO: 2201676 - DNA, 22 bp, Homo sapiens
agccagtaaatgggggtgcatt

SEQ ID NO: 2201677 - DNA, 23 bp, Homo sapiens
agccagtaaatgggggtgcattt

SEQ ID NO: 2201678 - DNA, 16 bp, Homo sapiens
agccttgaactttgac

SEQ ID NO: 2201679 - DNA, 22 bp, Homo sapiens
agccttgaactttgacctctgc

SEQ ID NO: 2201680 - DNA, 20 bp, Homo sapiens
agctcattctccttgtgtta

SEQ ID NO: 2201681 - DNA, 17 bp, Homo sapiens
agctctcagttgcagcc

SEQ ID NO: 2201682 - DNA, 23 bp, Homo sapiens
tctgtttagataatacaccacta

SEQ ID NO: 2201683 - DNA, 15 bp, Homo sapiens
tcttaaataataaag

SEQ ID NO: 2201684 - DNA, 21 bp, Homo sapiens
tcttagtatgtgcatttaatt

SEQ ID NO: 2201685 - DNA, 15 bp, Homo sapiens
tcttcagatctctaa

SEQ ID NO: 2201686 - DNA, 18 bp, Homo sapiens
tcttcatacctacatgta

SEQ ID NO: 2201687 - DNA, 21 bp, Homo sapiens
tcttcatacctacatgtattt

SEQ ID NO: 2201688 - DNA, 12 bp, Homo sapiens
tcttctatttat

SEQ ID NO: 2201689 - DNA, 16 bp, Homo sapiens
tcttggtttgtaaatt

SEQ ID NO: 2201690 - DNA, 13 bp, Homo sapiens
tctttccaaagta

SEQ ID NO: 2201691 - DNA, 23 bp, Homo sapiens
tctttccaaagtacactgtttca

SEQ ID NO: 2201692 - DNA, 18 bp, Homo sapiens
tctttctggctatgcatt

SEQ ID NO: 2201693 - DNA, 17 bp, Homo sapiens
tcttttgccgttattaa

SEQ ID NO: 2201694 - DNA, 19 bp, Homo sapiens
tgaaaacacatttttctta

SEQ ID NO: 2201695 - DNA, 20 bp, Homo sapiens
tgaaaacacatttttcttag

SEQ ID NO: 2201696 - DNA, 19 bp, Homo sapiens
tgaaaattttgatgtttta

SEQ ID NO: 2201697 - DNA, 18 bp, Homo sapiens
tgaaactggattaaactt

SEQ ID NO: 2201698 - DNA, 17 bp, Homo sapiens
tgaactaaactttcaca

SEQ ID NO: 2201699 - DNA, 16 bp, Homo sapiens
tgaactttgacctctg

SEQ ID NO: 2201700 - DNA, 19 bp, Homo sapiens
tgaactttgacctctgcag

SEQ ID NO: 2201701 - DNA, 22 bp, Homo sapiens
tgaagacaatgacttactgtac

SEQ ID NO: 2201702 - DNA, 23 bp, Homo sapiens
tgaagacaatgacttactgtaca

SEQ ID NO: 2201703 - DNA, 13 bp, Homo sapiens
tgaagatttaatt

SEQ ID NO: 2201704 - DNA, 17 bp, Homo sapiens
tgaagcattttataaat

SEQ ID NO: 2201705 - DNA, 22 bp, Homo sapiens
tgaagcattttataaatcgctt

SEQ ID NO: 2201706 - DNA, 15 bp, Homo sapiens
tgaagtaatatgcac

SEQ ID NO: 2201707 - DNA, 22 bp, Homo sapiens
tgaagtaatatgcacacatttt

SEQ ID NO: 2201708 - DNA, 12 bp, Homo sapiens
tgaagtgaaact

SEQ ID NO: 2201709 - DNA, 15 bp, Homo sapiens
tgaatttcttttgcc

SEQ ID NO: 2201710 - DNA, 19 bp, Homo sapiens
tgacaaagactgagtacgt

SEQ ID NO: 2201711 - DNA, 16 bp, Homo sapiens
tgacatatcacatgtc

SEQ ID NO: 2201712 - DNA, 21 bp, Homo sapiens
tgacctctgcagcaataaagc

SEQ ID NO: 2201713 - DNA, 13 bp, Homo sapiens
tgactgaatttct

SEQ ID NO: 2201714 - DNA, 14 bp, Homo sapiens
tgactgaatttctt

SEQ ID NO: 2201715 - DNA, 19 bp, Homo sapiens
tgacttactgtacatgaaa

SEQ ID NO: 2201716 - DNA, 13 bp, Homo sapiens
tgagaaattaagt

SEQ ID NO: 2201717 - DNA, 14 bp, Homo sapiens
tgagaaattaagta

SEQ ID NO: 2201718 - DNA, 13 bp, Homo sapiens
tgagatcaatgtg

SEQ ID NO: 2201719 - DNA, 12 bp, Homo sapiens
tgaggcatttgt

SEQ ID NO: 2201720 - DNA, 19 bp, Homo sapiens
tgaggcatttgtttgaact

SEQ ID NO: 2201721 - DNA, 23 bp, Homo sapiens
tgaggcatttgtttgaactgata

SEQ ID NO: 2201722 - DNA, 14 bp, Homo sapiens
tgaggtctgttctt

SEQ ID NO: 2201723 - DNA, 16 bp, Homo sapiens
tgagtacgttgtgcat

SEQ ID NO: 2201724 - DNA, 17 bp, Homo sapiens
tgagtacgttgtgcatt

SEQ ID NO: 2201725 - DNA, 20 bp, Homo sapiens
tgagtacgttgtgcatttgg

SEQ ID NO: 2201726 - DNA, 18 bp, Homo sapiens
tgataatcaactgggctg

SEQ ID NO: 2201727 - DNA, 17 bp, Homo sapiens
tgatactacagtttgtt

SEQ ID NO: 2201728 - DNA, 15 bp, Homo sapiens
tgatctcatttaatc

SEQ ID NO: 2201729 - DNA, 17 bp, Homo sapiens
tgatgttttaaggatgc

SEQ ID NO: 2201730 - DNA, 16 bp, Homo sapiens
tgattaaattcttgca

SEQ ID NO: 2201731 - DNA, 12 bp, Homo sapiens
tgattcatattt

SEQ ID NO: 2201732 - DNA, 16 bp, Homo sapiens
tgattcatatttaatt

SEQ ID NO: 2201733 - DNA, 19 bp, Homo sapiens
tgattcatatttaatttga

SEQ ID NO: 2201734 - DNA, 15 bp, Homo sapiens
tgattgaatctactt

SEQ ID NO: 2201735 - DNA, 20 bp, Homo sapiens
tgcaaagtatccctactgta

SEQ ID NO: 2201736 - DNA, 22 bp, Homo sapiens
tgcaatgaagtctctgaagtga

SEQ ID NO: 2201737 - DNA, 10 bp, Homo sapiens
tgcacacatt

SEQ ID NO: 2201738 - DNA, 11 bp, Homo sapiens
tgcacacattt

SEQ ID NO: 2201739 - DNA, 12 bp, Homo sapiens
tgcacacatttt

SEQ ID NO: 2201740 - DNA, 20 bp, Homo sapiens
tgcacacattttttaaatgc

SEQ ID NO: 2201741 - DNA, 14 bp, Homo sapiens
tgcacactgtccta

SEQ ID NO: 2201742 - DNA, 21 bp, Homo sapiens
tgcacactgtcctattatatt

SEQ ID NO: 2201743 - DNA, 17 bp, Homo sapiens
tgcacagagttgttaca

SEQ ID NO: 2201744 - DNA, 19 bp, Homo sapiens
tgcacagagttgttacatt

SEQ ID NO: 2201745 - DNA, 17 bp, Homo sapiens
tgcacctggaatatata

SEQ ID NO: 2201746 - DNA, 22 bp, Homo sapiens
tgcacctggaatatataaccag

SEQ ID NO: 2201747 - DNA, 22 bp, Homo sapiens
tgcagatattctctagtcattt

SEQ ID NO: 2201748 - DNA, 15 bp, Homo sapiens
tgcagcaataaagca

SEQ ID NO: 2201749 - DNA, 12 bp, Homo sapiens
tgcataccactt

SEQ ID NO: 2201750 - DNA, 16 bp, Homo sapiens
tgcataccacttttgt

SEQ ID NO: 2201751 - DNA, 22 bp, Homo sapiens
tgcatgaagtaatatgcacaca

SEQ ID NO: 2201752 - DNA, 17 bp, Homo sapiens
tgcattatctagatact

SEQ ID NO: 2201753 - DNA, 19 bp, Homo sapiens
tgcatttgaaaattttgat

SEQ ID NO: 2201754 - DNA, 23 bp, Homo sapiens
tgcatttgaaaattttgatgttt

SEQ ID NO: 2201755 - DNA, 18 bp, Homo sapiens
tgcatttgaggtctgttc

SEQ ID NO: 2201756 - DNA, 19 bp, Homo sapiens
tgccctaaagtgtattttt

SEQ ID NO: 2201757 - DNA, 20 bp, Homo sapiens
tgccttaccctcatgttctt

SEQ ID NO: 2201758 - DNA, 21 bp, Homo sapiens
tgccttgtttaatgttaatta

SEQ ID NO: 2201759 - DNA, 16 bp, Homo sapiens
tgcgcctaatgtgttt

SEQ ID NO: 2201760 - DNA, 15 bp, Homo sapiens
tgcgtgcataccact

SEQ ID NO: 2201761 - DNA, 16 bp, Homo sapiens
tgctaattttattata

SEQ ID NO: 2201762 - DNA, 17 bp, Homo sapiens
tgctgcatttaaaagat

SEQ ID NO: 2201763 - DNA, 19 bp, Homo sapiens
tgctgcatttaaaagatac

SEQ ID NO: 2201764 - DNA, 17 bp, Homo sapiens
tgcttaacttcacatat

SEQ ID NO: 2201765 - DNA, 18 bp, Homo sapiens
tgcttaacttcacatatt

SEQ ID NO: 2201766 - DNA, 15 bp, Homo sapiens
tgctttaatatcatc

SEQ ID NO: 2201767 - DNA, 20 bp, Homo sapiens
tgctttaatatcatcagtat

SEQ ID NO: 2201768 - DNA, 16 bp, Homo sapiens
tggaatatataaccag

SEQ ID NO: 2201769 - DNA, 16 bp, Homo sapiens
tggacattttatgtct

SEQ ID NO: 2201770 - DNA, 15 bp, Homo sapiens
tggatttaacagaaa

SEQ ID NO: 2201771 - DNA, 23 bp, Homo sapiens
tggcacatcagcacgatttctgt

SEQ ID NO: 2201772 - DNA, 23 bp, Homo sapiens
tggcctagcatacgtacacattt

SEQ ID NO: 2201773 - DNA, 13 bp, Homo sapiens
tggcctcttcaga

SEQ ID NO: 2201774 - DNA, 14 bp, Homo sapiens
tggctatgcatttg

SEQ ID NO: 2201775 - DNA, 19 bp, Homo sapiens
tggctatgcatttgaaaat

SEQ ID NO: 2201776 - DNA, 14 bp, Homo sapiens
tggcttttgtgcat

SEQ ID NO: 2201777 - DNA, 16 bp, Homo sapiens
tggcttttgtgcatta

SEQ ID NO: 2201778 - DNA, 17 bp, Homo sapiens
tgggctgaacactccaa

SEQ ID NO: 2201779 - DNA, 19 bp, Homo sapiens
tggtcaacatttctcatgt

SEQ ID NO: 2201780 - DNA, 23 bp, Homo sapiens
tggtcaacatttctcatgttgaa

SEQ ID NO: 2201781 - DNA, 16 bp, Homo sapiens
tggtggctgttcctga

SEQ ID NO: 2201782 - DNA, 23 bp, Homo sapiens
tggtgtgaactaaactttcacac

SEQ ID NO: 2201783 - DNA, 15 bp, Homo sapiens
tggttaagtctgttt

SEQ ID NO: 2201784 - DNA, 15 bp, Homo sapiens
tggtttgtaaattaa

SEQ ID NO: 2201785 - DNA, 15 bp, Homo sapiens
tggttttctgttctt

SEQ ID NO: 2201786 - DNA, 16 bp, Homo sapiens
tggttttctgttcttt

SEQ ID NO: 2201787 - DNA, 15 bp, Homo sapiens
tgtaaagatgaatgt

SEQ ID NO: 2201788 - DNA, 17 bp, Homo sapiens
tgtaaattaacttttat

SEQ ID NO: 2201789 - DNA, 12 bp, Homo sapiens
tgtaacaacaat

SEQ ID NO: 2201790 - DNA, 12 bp, Homo sapiens
tgtaattatata

SEQ ID NO: 2201791 - DNA, 19 bp, Homo sapiens
tgtacataatgcgtgcata

SEQ ID NO: 2201792 - DNA, 16 bp, Homo sapiens
tgtacatgaaaacaca

SEQ ID NO: 2201793 - DNA, 17 bp, Homo sapiens
tgtacatgaaaacacat

SEQ ID NO: 2201794 - DNA, 18 bp, Homo sapiens
tgtacatgaaaacacatt

SEQ ID NO: 2201795 - DNA, 22 bp, Homo sapiens
tgtacctcttgagccttgaact

SEQ ID NO: 2201796 - DNA, 15 bp, Homo sapiens
tgtactctacaaaat

SEQ ID NO: 2201797 - DNA, 19 bp, Homo sapiens
tgtattctctcctgtacct

SEQ ID NO: 2201798 - DNA, 13 bp, Homo sapiens
ttgattaaattct

SEQ ID NO: 2201799 - DNA, 15 bp, Homo sapiens
ttgcgcctaatgtgt

SEQ ID NO: 2201800 - DNA, 20 bp, Homo sapiens
ttgcgcctaatgtgtttgag

SEQ ID NO: 2201801 - DNA, 22 bp, Homo sapiens
ttggctagaggttcaaagatat

SEQ ID NO: 2201802 - DNA, 18 bp, Homo sapiens
ttggttaagtctgtttta

SEQ ID NO: 2201803 - DNA, 17 bp, Homo sapiens
ttggttcttgtactcta

SEQ ID NO: 2201804 - DNA, 18 bp, Homo sapiens
ttgtaaattaacttttat

SEQ ID NO: 2201805 - DNA, 23 bp, Homo sapiens
ttgtaaattaacttttataaact

SEQ ID NO: 2201806 - DNA, 21 bp, Homo sapiens
ttgtaactgtttagatgaatg

SEQ ID NO: 2201807 - DNA, 14 bp, Homo sapiens
ttgtacataatgcg

SEQ ID NO: 2201808 - DNA, 12 bp, Homo sapiens
ttgtattaagaa

SEQ ID NO: 2201809 - DNA, 16 bp, Homo sapiens
ttgtattctctcctgt

SEQ ID NO: 2201810 - DNA, 19 bp, Homo sapiens
ttgtattctctcctgtacc

SEQ ID NO: 2201811 - DNA, 22 bp, Homo sapiens
ttgtgaaggcaggggaatgtat

SEQ ID NO: 2201812 - DNA, 20 bp, Homo sapiens
ttgtgatacaatgctgtgcc

SEQ ID NO: 2201813 - DNA, 20 bp, Homo sapiens
ttgtggatttaacagaaatg

SEQ ID NO: 2201814 - DNA, 22 bp, Homo sapiens
ttgtggatttaacagaaatgta

SEQ ID NO: 2201815 - DNA, 13 bp, Homo sapiens
ttgtgttactaag

SEQ ID NO: 2201816 - DNA, 22 bp, Homo sapiens
ttgttagtatgaggcatttgtt

SEQ ID NO: 2201817 - DNA, 20 bp, Homo sapiens
ttgttatttattgaaatgat

SEQ ID NO: 2201818 - DNA, 19 bp, Homo sapiens
ttgttcttggtttgtaaat

SEQ ID NO: 2201819 - DNA, 23 bp, Homo sapiens
ttgtttaatggtagttttacagt

SEQ ID NO: 2201820 - DNA, 14 bp, Homo sapiens
ttgtttgttttaga

SEQ ID NO: 2201821 - DNA, 13 bp, Homo sapiens
tttaacagaaatg

SEQ ID NO: 2201822 - DNA, 15 bp, Homo sapiens
tttaacagaaatgta

SEQ ID NO: 2201823 - DNA, 18 bp, Homo sapiens
tttaacagaaatgtacag

SEQ ID NO: 2201824 - DNA, 19 bp, Homo sapiens
tttaaggatgcttgtacat

SEQ ID NO: 2201825 - DNA, 22 bp, Homo sapiens
tttaaggatgcttgtacataat

SEQ ID NO: 2201826 - DNA, 19 bp, Homo sapiens
tttaaggcatatttaacaa

SEQ ID NO: 2201827 - DNA, 15 bp, Homo sapiens
tttaagtgctgcatt

SEQ ID NO: 2201828 - DNA, 14 bp, Homo sapiens
tttactaatagaca

SEQ ID NO: 2201829 - DNA, 17 bp, Homo sapiens
tttactaatagacaatt

SEQ ID NO: 2201830 - DNA, 15 bp, Homo sapiens
tttataaatcgcttt

SEQ ID NO: 2201831 - DNA, 20 bp, Homo sapiens
tttatacataaacaagacca

SEQ ID NO: 2201832 - DNA, 15 bp, Homo sapiens
tttatgctttaaaca

SEQ ID NO: 2201833 - DNA, 14 bp, Homo sapiens
tttatggcttttgt

SEQ ID NO: 2201834 - DNA, 16 bp, Homo sapiens
tttatggcttttgtgc

SEQ ID NO: 2201835 - DNA, 12 bp, Homo sapiens
tttatgtaatta

SEQ ID NO: 2201836 - DNA, 12 bp, Homo sapiens
tttatgtctttc

SEQ ID NO: 2201837 - DNA, 13 bp, Homo sapiens
tttattatggcac

SEQ ID NO: 2201838 - DNA, 20 bp, Homo sapiens
tttattgaaatgatttcaca

SEQ ID NO: 2201839 - DNA, 14 bp, Homo sapiens
tttattgatgtttt

SEQ ID NO: 2201840 - DNA, 16 bp, Homo sapiens
tttcaaactttactat

SEQ ID NO: 2201841 - DNA, 11 bp, Homo sapiens
tttcagaaatg

SEQ ID NO: 2201842 - DNA, 13 bp, Homo sapiens
tttcagaaatgtg

SEQ ID NO: 2201843 - DNA, 18 bp, Homo sapiens
tttcagataactgttatt

SEQ ID NO: 2201844 - DNA, 23 bp, Homo sapiens
tttccacataaggaaactgggtt

SEQ ID NO: 2201845 - DNA, 15 bp, Homo sapiens
tttctcatgttgaaa

SEQ ID NO: 2201846 - DNA, 23 bp, Homo sapiens
tttctcatgttgaagctttaaga

SEQ ID NO: 2201847 - DNA, 17 bp, Homo sapiens
tttgaactgataaagat

SEQ ID NO: 2201848 - DNA, 19 bp, Homo sapiens
tttgaactgataaagatga

SEQ ID NO: 2201849 - DNA, 14 bp, Homo sapiens
tttgacaaggggca

SEQ ID NO: 2201850 - DNA, 12 bp, Homo sapiens
tttgacctctgc

SEQ ID NO: 2201851 - DNA, 19 bp, Homo sapiens
tttgacctctgcagcaata

SEQ ID NO: 2201852 - DNA, 20 bp, Homo sapiens
tttgaggtttttaagcctta

SEQ ID NO: 2201853 - DNA, 18 bp, Homo sapiens
tttgataatcaactgggc

SEQ ID NO: 2201854 - DNA, 21 bp, Homo sapiens
tttgattaaattcttgcaaag

SEQ ID NO: 2201855 - DNA, 11 bp, Homo sapiens
tttgcagcttt

SEQ ID NO: 2201856 - DNA, 15 bp, Homo sapiens
tttgccgttattaaa

SEQ ID NO: 2201857 - DNA, 15 bp, Homo sapiens
tttgctttgtgattt

SEQ ID NO: 2201858 - DNA, 22 bp, Homo sapiens
tttgtaactgtttagatgaatg

SEQ ID NO: 2201859 - DNA, 23 bp, Homo sapiens
tttgtaactgtttagatgaatgt

SEQ ID NO: 2201860 - DNA, 19 bp, Homo sapiens
tttgtgcattatctagata

SEQ ID NO: 2201861 - DNA, 14 bp, Homo sapiens
tttgtttgaactga

SEQ ID NO: 2201862 - DNA, 15 bp, Homo sapiens
ttttaagtgctgcat

SEQ ID NO: 2201863 - DNA, 21 bp, Homo sapiens
ttttaagtgctgcatttaaaa

SEQ ID NO: 2201864 - DNA, 12 bp, Homo sapiens
ttttataaactt

SEQ ID NO: 2201865 - DNA, 13 bp, Homo sapiens
ttttataaacttt

SEQ ID NO: 2201866 - DNA, 14 bp, Homo sapiens
ttttataaacttta

SEQ ID NO: 2201867 - DNA, 17 bp, Homo sapiens
ttttataaactttacct

SEQ ID NO: 2201868 - DNA, 19 bp, Homo sapiens
ttttataaactttaccttt

SEQ ID NO: 2201869 - DNA, 15 bp, Homo sapiens
ttttcaaatgttctc

SEQ ID NO: 2201870 - DNA, 12 bp, Homo sapiens
ttttgcagcttt

SEQ ID NO: 2201871 - DNA, 15 bp, Homo sapiens
ttttggttgctttaa

SEQ ID NO: 2201872 - DNA, 17 bp, Homo sapiens
tttttaagtgctgcatt

SEQ ID NO: 2201873 - DNA, 22 bp, Homo sapiens
tttttaagtgctgcatttaaaa

SEQ ID NO: 2201874 - DNA, 23 bp, Homo sapiens
tttttatacataaacaagaccac

SEQ ID NO: 2201875 - DNA, 21 bp, Homo sapiens
tttttatggcttttgtgcatt

SEQ ID NO: 2201876 - DNA, 22 bp, Homo sapiens
tttttatggcttttgtgcatta

SEQ ID NO: 2201877 - DNA, 19 bp, Homo sapiens
aaaaatctcaaatttctaa

SEQ ID NO: 2201878 - DNA, 15 bp, Homo sapiens
aaaacacatttttct

SEQ ID NO: 2201879 - DNA, 22 bp, Homo sapiens
aaaagaggtttttcttaaataa

SEQ ID NO: 2201880 - DNA, 15 bp, Homo sapiens
aaaaggatgcacaga

SEQ ID NO: 2201881 - DNA, 15 bp, Homo sapiens
aaaatctcaaatttc

SEQ ID NO: 2201882 - DNA, 20 bp, Homo sapiens
aaaattttgatgttttaagg

SEQ ID NO: 2201883 - DNA, 18 bp, Homo sapiens
aaacaagaccacgtttct

SEQ ID NO: 2201884 - DNA, 20 bp, Homo sapiens
aaacaagaccacgtttctaa

SEQ ID NO: 2201885 - DNA, 17 bp, Homo sapiens
aaacatgtatgtaaata

SEQ ID NO: 2201886 - DNA, 17 bp, Homo sapiens
aaacattggttcttgta

SEQ ID NO: 2201887 - DNA, 20 bp, Homo sapiens
aaacattggttcttgtatta

SEQ ID NO: 2201888 - DNA, 13 bp, Homo sapiens
aaactgcttgttt

SEQ ID NO: 2201889 - DNA, 19 bp, Homo sapiens
aaacttaatctaaatggaa

SEQ ID NO: 2201890 - DNA, 14 bp, Homo sapiens
aaactttacctttt

SEQ ID NO: 2201891 - DNA, 12 bp, Homo sapiens
aaactttactat

SEQ ID NO: 2201892 - DNA, 18 bp, Homo sapiens
aaactttactatggccct

SEQ ID NO: 2201893 - DNA, 20 bp, Homo sapiens
aaagagagacacagctgcag

SEQ ID NO: 2201894 - DNA, 18 bp, Homo sapiens
aaagcagcgtttctatga

SEQ ID NO: 2201895 - DNA, 20 bp, Homo sapiens
aaaggaaggttctggtgtga

SEQ ID NO: 2201896 - DNA, 20 bp, Homo sapiens
aaagtacactgtttcaaact

SEQ ID NO: 2201897 - DNA, 21 bp, Homo sapiens
aaagtatccctactgtaattt

SEQ ID NO: 2201898 - DNA, 16 bp, Homo sapiens
aaataaaactttttaa

SEQ ID NO: 2201899 - DNA, 18 bp, Homo sapiens
aaataccagccagtaaat

SEQ ID NO: 2201900 - DNA, 20 bp, Homo sapiens
aaatagctaagatataattt

SEQ ID NO: 2201901 - DNA, 19 bp, Homo sapiens
aaatagtggtgtgatttgg

SEQ ID NO: 2201902 - DNA, 17 bp, Homo sapiens
aaatgggggtgcatttg

SEQ ID NO: 2201903 - DNA, 13 bp, Homo sapiens
aaatggttaaaag

SEQ ID NO: 2201904 - DNA, 19 bp, Homo sapiens
aaatggttaaaagaggttt

SEQ ID NO: 2201905 - DNA, 14 bp, Homo sapiens
aaattaacttttat

SEQ ID NO: 2201906 - DNA, 12 bp, Homo sapiens
aaatttctaaat

SEQ ID NO: 2201907 - DNA, 18 bp, Homo sapiens
aaattttgatgttttaag

SEQ ID NO: 2201908 - DNA, 14 bp, Homo sapiens
aacaaaatttgaat

SEQ ID NO: 2201909 - DNA, 11 bp, Homo sapiens
aacagaaatgt

SEQ ID NO: 2201910 - DNA, 18 bp, Homo sapiens
aacattggttcttgtatt

SEQ ID NO: 2201911 - DNA, 18 bp, Homo sapiens
aacatttctcatgttgaa

SEQ ID NO: 2201912 - DNA, 15 bp, Homo sapiens
aaccactttttgcag

SEQ ID NO: 2201913 - DNA, 17 bp, Homo sapiens
aaccagtgttgtggatt

SEQ ID NO: 2201914 - DNA, 21 bp, Homo sapiens
aacgtgatttttaaattaaat

SEQ ID NO: 2201915 - DNA, 21 bp, Homo sapiens
aactagttactaaacatgtat

SEQ ID NO: 2201916 - DNA, 14 bp, Homo sapiens
aactgggctgaaca

SEQ ID NO: 2201917 - DNA, 15 bp, Homo sapiens
aactgtaaagatgaa

SEQ ID NO: 2201918 - DNA, 19 bp, Homo sapiens
aacttaaataatgtgaaac

SEQ ID NO: 2201919 - DNA, 16 bp, Homo sapiens
aacttaatctaaatgg

SEQ ID NO: 2201920 - DNA, 18 bp, Homo sapiens
aacttaatctaaatggaa

SEQ ID NO: 2201921 - DNA, 14 bp, Homo sapiens
aacttcacatattg

SEQ ID NO: 2201922 - DNA, 18 bp, Homo sapiens
aagaaaaaggatgcacag

SEQ ID NO: 2201923 - DNA, 19 bp, Homo sapiens
aagaaaaaggatgcacaga

SEQ ID NO: 2201924 - DNA, 17 bp, Homo sapiens
aagactgagtacgttgt

SEQ ID NO: 2201925 - DNA, 23 bp, Homo sapiens
aagatacagttactcagaattct

SEQ ID NO: 2201926 - DNA, 15 bp, Homo sapiens
aagatattttgcttt

SEQ ID NO: 2201927 - DNA, 17 bp, Homo sapiens
aagatattttgctttgt

SEQ ID NO: 2201928 - DNA, 20 bp, Homo sapiens
aagatattttgctttgtgat

SEQ ID NO: 2201929 - DNA, 22 bp, Homo sapiens
aagatattttgctttgtgattt

SEQ ID NO: 2201930 - DNA, 16 bp, Homo sapiens
aagatgaatgtcagtt

SEQ ID NO: 2201931 - DNA, 19 bp, Homo sapiens
aagattctatgttaatatt

SEQ ID NO: 2201932 - DNA, 21 bp, Homo sapiens
aagattctatgttaatatttt

SEQ ID NO: 2201933 - DNA, 12 bp, Homo sapiens
aagcatgtgaga

SEQ ID NO: 2201934 - DNA, 17 bp, Homo sapiens
aagcattttataaatcg

SEQ ID NO: 2201935 - DNA, 17 bp, Homo sapiens
aagccaaacctctgtga

SEQ ID NO: 2201936 - DNA, 18 bp, Homo sapiens
aaggatgcacagagttgt

SEQ ID NO: 2201937 - DNA, 19 bp, Homo sapiens
aaggatgcttgtacataat

SEQ ID NO: 2201938 - DNA, 12 bp, Homo sapiens
aaggattttatg

SEQ ID NO: 2201939 - DNA, 13 bp, Homo sapiens
aaggattttatgc

SEQ ID NO: 2201940 - DNA, 21 bp, Homo sapiens
aaggattttatgctttaaaca

SEQ ID NO: 2201941 - DNA, 15 bp, Homo sapiens
aaggcaaatgacttt

SEQ ID NO: 2201942 - DNA, 16 bp, Homo sapiens
aaggcaaatgactttg

SEQ ID NO: 2201943 - DNA, 18 bp, Homo sapiens
aaggcaggggaatgtatg

SEQ ID NO: 2201944 - DNA, 19 bp, Homo sapiens
aaggctacctttgtattct

SEQ ID NO: 2201945 - DNA, 14 bp, Homo sapiens
aaggggcagtggtg

SEQ ID NO: 2201946 - DNA, 14 bp, Homo sapiens
aaggtagaatgttt

SEQ ID NO: 2201947 - DNA, 19 bp, Homo sapiens
aaggtcattttttttaaga

SEQ ID NO: 2201948 - DNA, 21 bp, Homo sapiens
aaggtttgcagatattctcta

SEQ ID NO: 2201949 - DNA, 18 bp, Homo sapiens
aagtaatatgcacacatt

SEQ ID NO: 2201950 - DNA, 18 bp, Homo sapiens
aagtatccctactgtaat

SEQ ID NO: 2201951 - DNA, 16 bp, Homo sapiens
aagtattatacctttt

SEQ ID NO: 2201952 - DNA, 14 bp, Homo sapiens
aagtctgttttatg

SEQ ID NO: 2201953 - DNA, 13 bp, Homo sapiens
aagtcttctattt

SEQ ID NO: 2201954 - DNA, 13 bp, Homo sapiens
aagtgctgcattt

SEQ ID NO: 2201955 - DNA, 21 bp, Homo sapiens
aagttcaccagactctataaa

SEQ ID NO: 2201956 - DNA, 12 bp, Homo sapiens
aagttgtttgag

SEQ ID NO: 2201957 - DNA, 15 bp, Homo sapiens
aagttgtttgagaaa

SEQ ID NO: 2201958 - DNA, 20 bp, Homo sapiens
aagtttttatggcttttgtg

SEQ ID NO: 2201959 - DNA, 14 bp, Homo sapiens
aataaagatcatgt

SEQ ID NO: 2201960 - DNA, 20 bp, Homo sapiens
aataaagatcatgtaaaagt

SEQ ID NO: 2201961 - DNA, 14 bp, Homo sapiens
aataaagcagcgtt

SEQ ID NO: 2201962 - DNA, 16 bp, Homo sapiens
aataatgtgaaactgg

SEQ ID NO: 2201963 - DNA, 20 bp, Homo sapiens
aatacaccactacattctgt

SEQ ID NO: 2201964 - DNA, 17 bp, Homo sapiens
aataccagccagtaaat

SEQ ID NO: 2201965 - DNA, 18 bp, Homo sapiens
aatagacaatttattatg

SEQ ID NO: 2201966 - DNA, 17 bp, Homo sapiens
aatagctaagatataat

SEQ ID NO: 2201967 - DNA, 16 bp, Homo sapiens
aatagtggtgtgattt

SEQ ID NO: 2201968 - DNA, 16 bp, Homo sapiens
aatataggaacttaaa

SEQ ID NO: 2201969 - DNA, 20 bp, Homo sapiens
aatataggaacttaaataat

SEQ ID NO: 2201970 - DNA, 16 bp, Homo sapiens
aatatcatcagtattg

SEQ ID NO: 2201971 - DNA, 19 bp, Homo sapiens
aatatcccttggacatttt

SEQ ID NO: 2201972 - DNA, 20 bp, Homo sapiens
aatatcccttggacatttta

SEQ ID NO: 2201973 - DNA, 17 bp, Homo sapiens
aatatgcacacattttt

SEQ ID NO: 2201974 - DNA, 22 bp, Homo sapiens
aatatgcacacattttttaaat

SEQ ID NO: 2201975 - DNA, 21 bp, Homo sapiens
aatattttaggtgtaaaataa

SEQ ID NO: 2201976 - DNA, 17 bp, Homo sapiens
aatcattaggtgtgact

SEQ ID NO: 2201977 - DNA, 16 bp, Homo sapiens
attgatgttttcatag

SEQ ID NO: 2201978 - DNA, 22 bp, Homo sapiens
attggctagaggttcaaagata

SEQ ID NO: 2201979 - DNA, 23 bp, Homo sapiens
atttaaacgtgatttttaaatta

SEQ ID NO: 2201980 - DNA, 15 bp, Homo sapiens
atttaagatatgtaa

SEQ ID NO: 2201981 - DNA, 15 bp, Homo sapiens
atttaatttgaaggt

SEQ ID NO: 2201982 - DNA, 22 bp, Homo sapiens
atttacaactgggggagggtga

SEQ ID NO: 2201983 - DNA, 15 bp, Homo sapiens
atttataatcacttt

SEQ ID NO: 2201984 - DNA, 15 bp, Homo sapiens
atttattgaaatgat

SEQ ID NO: 2201985 - DNA, 14 bp, Homo sapiens
atttattgatgttt

SEQ ID NO: 2201986 - DNA, 14 bp, Homo sapiens
atttatttatttgt

SEQ ID NO: 2201987 - DNA, 16 bp, Homo sapiens
atttatttatttgttt

SEQ ID NO: 2201988 - DNA, 17 bp, Homo sapiens
atttcacagtgtgtggt

SEQ ID NO: 2201989 - DNA, 16 bp, Homo sapiens
atttccgttaaaatac

SEQ ID NO: 2201990 - DNA, 13 bp, Homo sapiens
atttctaaatctc

SEQ ID NO: 2201991 - DNA, 21 bp, Homo sapiens
atttctgtttagataatacac

SEQ ID NO: 2201992 - DNA, 15 bp, Homo sapiens
atttgaaaattttga

SEQ ID NO: 2201993 - DNA, 16 bp, Homo sapiens
atttgaaaattttgat

SEQ ID NO: 2201994 - DNA, 15 bp, Homo sapiens
atttgtgatacaatg

SEQ ID NO: 2201995 - DNA, 17 bp, Homo sapiens
atttgttaatatttctt

SEQ ID NO: 2201996 - DNA, 20 bp, Homo sapiens
atttgtttgaactgataaag

SEQ ID NO: 2201997 - DNA, 22 bp, Homo sapiens
atttgtttgaactgataaagat

SEQ ID NO: 2201998 - DNA, 23 bp, Homo sapiens
attttataaatcgcttttgataa

SEQ ID NO: 2201999 - DNA, 12 bp, Homo sapiens
attttatgtctt

SEQ ID NO: 2202000 - DNA, 14 bp, Homo sapiens
attttattatgcat

SEQ ID NO: 2202001 - DNA, 15 bp, Homo sapiens
attttattatgcatg

SEQ ID NO: 2202002 - DNA, 18 bp, Homo sapiens
attttattttattatgca

SEQ ID NO: 2202003 - DNA, 17 bp, Homo sapiens
attttgatgttttaagg

SEQ ID NO: 2202004 - DNA, 14 bp, Homo sapiens
attttgtaactgta

SEQ ID NO: 2202005 - DNA, 18 bp, Homo sapiens
atttttaagtgctgcatt

SEQ ID NO: 2202006 - DNA, 12 bp, Homo sapiens
atttttgtaatt

SEQ ID NO: 2202007 - DNA, 13 bp, Homo sapiens
attttttaaatgc

SEQ ID NO: 2202008 - DNA, 14 bp, Homo sapiens
attttttaaatgca

SEQ ID NO: 2202009 - DNA, 17 bp, Homo sapiens
attttttttctgttata

SEQ ID NO: 2202010 - DNA, 18 bp, Homo sapiens
attttttttctgttatat

SEQ ID NO: 2202011 - DNA, 12 bp, Homo sapiens
caaaataaaact

SEQ ID NO: 2202012 - DNA, 14 bp, Homo sapiens
caaaataaaacttt

SEQ ID NO: 2202013 - DNA, 17 bp, Homo sapiens
caaaccactttttgcag

SEQ ID NO: 2202014 - DNA, 14 bp, Homo sapiens
caaagatattttgc

SEQ ID NO: 2202015 - DNA, 16 bp, Homo sapiens
caaagatattttgctt

SEQ ID NO: 2202016 - DNA, 23 bp, Homo sapiens
caaagatattttgctttgtgatt

SEQ ID NO: 2202017 - DNA, 21 bp, Homo sapiens
caaagtacactgtttcaaact

SEQ ID NO: 2202018 - DNA, 11 bp, Homo sapiens
caaatttctaa

SEQ ID NO: 2202019 - DNA, 12 bp, Homo sapiens
caaatttctaaa

SEQ ID NO: 2202020 - DNA, 22 bp, Homo sapiens
caacatttctcatgttgaaact

SEQ ID NO: 2202021 - DNA, 23 bp, Homo sapiens
caacatttctcatgttgaagctt

SEQ ID NO: 2202022 - DNA, 14 bp, Homo sapiens
caagaccacgtttc

SEQ ID NO: 2202023 - DNA, 13 bp, Homo sapiens
caaggtcattttt

SEQ ID NO: 2202024 - DNA, 20 bp, Homo sapiens
caaggtcattttttttaaga

SEQ ID NO: 2202025 - DNA, 13 bp, Homo sapiens
caagtattatacc

SEQ ID NO: 2202026 - DNA, 17 bp, Homo sapiens
caagttagttcaatcct

SEQ ID NO: 2202027 - DNA, 13 bp, Homo sapiens
caagttgtttgag

SEQ ID NO: 2202028 - DNA, 21 bp, Homo sapiens
caagttgtttgagaaattaag

SEQ ID NO: 2202029 - DNA, 23 bp, Homo sapiens
caagttgtttgagaaattaagta

SEQ ID NO: 2202030 - DNA, 15 bp, Homo sapiens
caatgacttactgta

SEQ ID NO: 2202031 - DNA, 19 bp, Homo sapiens
caatgagatcattgtgaag

SEQ ID NO: 2202032 - DNA, 22 bp, Homo sapiens
caatgctgtgccctaaagtgta

SEQ ID NO: 2202033 - DNA, 20 bp, Homo sapiens
caatttattatggcacatca

SEQ ID NO: 2202034 - DNA, 10 bp, Homo sapiens
cacacatttt

SEQ ID NO: 2202035 - DNA, 19 bp, Homo sapiens
cacagacatactaaccagc

SEQ ID NO: 2202036 - DNA, 21 bp, Homo sapiens
cacagagttgttacattttta

SEQ ID NO: 2202037 - DNA, 13 bp, Homo sapiens
cacatattgattt

SEQ ID NO: 2202038 - DNA, 18 bp, Homo sapiens
cacatcagcacgatttct

SEQ ID NO: 2202039 - DNA, 19 bp, Homo sapiens
cacatcagcacgatttctg

SEQ ID NO: 2202040 - DNA, 15 bp, Homo sapiens
cacatctgttttgta

SEQ ID NO: 2202041 - DNA, 17 bp, Homo sapiens
cacatgcaaggtcattt

SEQ ID NO: 2202042 - DNA, 19 bp, Homo sapiens
cacatgcaaggtcattttt

SEQ ID NO: 2202043 - DNA, 17 bp, Homo sapiens
cacattttttaaatgca

SEQ ID NO: 2202044 - DNA, 18 bp, Homo sapiens
caccactacattctgtta

SEQ ID NO: 2202045 - DNA, 20 bp, Homo sapiens
caccactacattctgttaat

SEQ ID NO: 2202046 - DNA, 13 bp, Homo sapiens
cacctcctgcctc

SEQ ID NO: 2202047 - DNA, 22 bp, Homo sapiens
cacctttcagataactgttatt

SEQ ID NO: 2202048 - DNA, 15 bp, Homo sapiens
cactccaattaagga

SEQ ID NO: 2202049 - DNA, 20 bp, Homo sapiens
cactctcccattatatttat

SEQ ID NO: 2202050 - DNA, 17 bp, Homo sapiens
cacttaggagaagtctt

SEQ ID NO: 2202051 - DNA, 18 bp, Homo sapiens
cactttttgcagctttct

SEQ ID NO: 2202052 - DNA, 16 bp, Homo sapiens
cagaaatgtacagcaa

SEQ ID NO: 2202053 - DNA, 18 bp, Homo sapiens
cagaaggcaaatgacttt

SEQ ID NO: 2202054 - DNA, 20 bp, Homo sapiens
cagaaggcaaatgactttgg

SEQ ID NO: 2202055 - DNA, 18 bp, Homo sapiens
cagaattctctagtttga

SEQ ID NO: 2202056 - DNA, 22 bp, Homo sapiens
cagagaggtttcgatatttatt

SEQ ID NO: 2202057 - DNA, 14 bp, Homo sapiens
cagagttgttacat

SEQ ID NO: 2202058 - DNA, 18 bp, Homo sapiens
cagagttgttacattttt

SEQ ID NO: 2202059 - DNA, 20 bp, Homo sapiens
cagatctctaacttcaccat

SEQ ID NO: 2202060 - DNA, 20 bp, Homo sapiens
cagatttaagatatgtaaca

SEQ ID NO: 2202061 - DNA, 13 bp, Homo sapiens
cagcaataaagca

SEQ ID NO: 2202062 - DNA, 21 bp, Homo sapiens
cagcaataaagcagcgtttct

SEQ ID NO: 2202063 - DNA, 14 bp, Homo sapiens
cagcacgatttctg

SEQ ID NO: 2202064 - DNA, 16 bp, Homo sapiens
cagcacttacaatttt

SEQ ID NO: 2202065 - DNA, 13 bp, Homo sapiens
cagccagtaaatg

SEQ ID NO: 2202066 - DNA, 22 bp, Homo sapiens
cagccagtaaatgggggtgcat

SEQ ID NO: 2202067 - DNA, 16 bp, Homo sapiens
cagcgtttctatgaca

SEQ ID NO: 2202068 - DNA, 18 bp, Homo sapiens
cagctctcagttgcagcc

SEQ ID NO: 2202069 - DNA, 20 bp, Homo sapiens
caggaaaataaaatatttaa

SEQ ID NO: 2202070 - DNA, 15 bp, Homo sapiens
cagggaaatgtatgt

SEQ ID NO: 2202071 - DNA, 16 bp, Homo sapiens
cagggaaatgtatgtg

SEQ ID NO: 2202072 - DNA, 12 bp, Homo sapiens
cagtattgaagc

SEQ ID NO: 2202073 - DNA, 21 bp, Homo sapiens
cagtattgaagcattttataa

SEQ ID NO: 2202074 - DNA, 19 bp, Homo sapiens
cagtcattatgttaatatt

SEQ ID NO: 2202075 - DNA, 18 bp, Homo sapiens
cagtggtggttttctgtt

SEQ ID NO: 2202076 - DNA, 20 bp, Homo sapiens
cagtggtggttttctgttct

SEQ ID NO: 2202077 - DNA, 21 bp, Homo sapiens
cagtggtggttttctgttctt

SEQ ID NO: 2202078 - DNA, 21 bp, Homo sapiens
cagtgtgtggtcaacatttct

SEQ ID NO: 2202079 - DNA, 20 bp, Homo sapiens
cagtgttgtggatttaacag

SEQ ID NO: 2202080 - DNA, 22 bp, Homo sapiens
cagtgttgtggatttaacagaa

SEQ ID NO: 2202081 - DNA, 18 bp, Homo sapiens
cagtgtttccctctgtgt

SEQ ID NO: 2202082 - DNA, 11 bp, Homo sapiens
cagttgcagcc

SEQ ID NO: 2202083 - DNA, 14 bp, Homo sapiens
cagttgttatttat

SEQ ID NO: 2202084 - DNA, 16 bp, Homo sapiens
cagttgttatttattg

SEQ ID NO: 2202085 - DNA, 23 bp, Homo sapiens
cagtttgttagtatgaggcattt

SEQ ID NO: 2202086 - DNA, 17 bp, Homo sapiens
cagttttggttgcttta

SEQ ID NO: 2202087 - DNA, 20 bp, Homo sapiens
cataaacaagaccacgtttc

SEQ ID NO: 2202088 - DNA, 14 bp, Homo sapiens
cataatgcgtgcat

SEQ ID NO: 2202089 - DNA, 17 bp, Homo sapiens
cataatgcgtgcatacc

SEQ ID NO: 2202090 - DNA, 14 bp, Homo sapiens
catactaaccagca

SEQ ID NO: 2202091 - DNA, 21 bp, Homo sapiens
catactaaccagcagaaatgc

SEQ ID NO: 2202092 - DNA, 22 bp, Homo sapiens
catactgccttgtttaatgtta

SEQ ID NO: 2202093 - DNA, 16 bp, Homo sapiens
catattaccacagaca

SEQ ID NO: 2202094 - DNA, 20 bp, Homo sapiens
catattaccacagacatact

SEQ ID NO: 2202095 - DNA, 17 bp, Homo sapiens
catattgatttccgtta

SEQ ID NO: 2202096 - DNA, 15 bp, Homo sapiens
catatttaacaaaat

SEQ ID NO: 2202097 - DNA, 22 bp, Homo sapiens
catcaatgataatgctaatttt

SEQ ID NO: 2202098 - DNA, 17 bp, Homo sapiens
catcagcacgatttctg

SEQ ID NO: 2202099 - DNA, 19 bp, Homo sapiens
catcagcacgatttctgtt

SEQ ID NO: 2202100 - DNA, 22 bp, Homo sapiens
catcagtattgaagcattttat

SEQ ID NO: 2202101 - DNA, 16 bp, Homo sapiens
catgaaaacacatttt

SEQ ID NO: 2202102 - DNA, 21 bp, Homo sapiens
catgaaaacacatttttctta

SEQ ID NO: 2202103 - DNA, 15 bp, Homo sapiens
catgaagtaatatgc

SEQ ID NO: 2202104 - DNA, 19 bp, Homo sapiens
catgaagtaatatgcacac

SEQ ID NO: 2202105 - DNA, 13 bp, Homo sapiens
catgacaaagact

SEQ ID NO: 2202106 - DNA, 17 bp, Homo sapiens
catgcaaggtcattttt

SEQ ID NO: 2202107 - DNA, 22 bp, Homo sapiens
catggcctcttcagatctctaa

SEQ ID NO: 2202108 - DNA, 16 bp, Homo sapiens
aaactgggttcctgca

SEQ ID NO: 2202109 - DNA, 16 bp, Homo sapiens
aaacttaatctaaatg

SEQ ID NO: 2202110 - DNA, 22 bp, Homo sapiens
aaactttaccttttttatacat

SEQ ID NO: 2202111 - DNA, 23 bp, Homo sapiens
aaagactgagtacgttgtgcatt

SEQ ID NO: 2202112 - DNA, 15 bp, Homo sapiens
aaagatcatgtaaaa

SEQ ID NO: 2202113 - DNA, 15 bp, Homo sapiens
aaagatgagtgagca

SEQ ID NO: 2202114 - DNA, 22 bp, Homo sapiens
aaagcagcgtttctatgacaca

SEQ ID NO: 2202115 - DNA, 14 bp, Homo sapiens
aaaggctacctttg

SEQ ID NO: 2202116 - DNA, 18 bp, Homo sapiens
aaagtatccctactgtaa

SEQ ID NO: 2202117 - DNA, 22 bp, Homo sapiens
aaagtgtatttttttactaata

SEQ ID NO: 2202118 - DNA, 12 bp, Homo sapiens
aaataatgtgaa

SEQ ID NO: 2202119 - DNA, 14 bp, Homo sapiens
aaataatgtgaaac

SEQ ID NO: 2202120 - DNA, 20 bp, Homo sapiens
aaataccagccagtaaatgg

SEQ ID NO: 2202121 - DNA, 13 bp, Homo sapiens
aaatcgcttttga

SEQ ID NO: 2202122 - DNA, 17 bp, Homo sapiens
aaatctcaaatttctaa

SEQ ID NO: 2202123 - DNA, 14 bp, Homo sapiens
aaatgcacctggaa

SEQ ID NO: 2202124 - DNA, 23 bp, Homo sapiens
aaatgccttaccctcatgttctt

SEQ ID NO: 2202125 - DNA, 11 bp, Homo sapiens
aaatggttaaa

SEQ ID NO: 2202126 - DNA, 14 bp, Homo sapiens
aaatgtatgtgtgt

SEQ ID NO: 2202127 - DNA, 21 bp, Homo sapiens
aaatgtatgtgtgtctatttt

SEQ ID NO: 2202128 - DNA, 18 bp, Homo sapiens
aaattaaataaaattttt

SEQ ID NO: 2202129 - DNA, 13 bp, Homo sapiens
aaattaactttta

SEQ ID NO: 2202130 - DNA, 23 bp, Homo sapiens
aaattaacttttataaactttac

SEQ ID NO: 2202131 - DNA, 15 bp, Homo sapiens
aaatttctaaatctc

SEQ ID NO: 2202132 - DNA, 16 bp, Homo sapiens
aacaagaccacgtttc

SEQ ID NO: 2202133 - DNA, 19 bp, Homo sapiens
aacacatttttcttaggga

SEQ ID NO: 2202134 - DNA, 10 bp, Homo sapiens
aacagaaatg

SEQ ID NO: 2202135 - DNA, 22 bp, Homo sapiens
aacatcgaaaagttattttgta

SEQ ID NO: 2202136 - DNA, 16 bp, Homo sapiens
aacattggttcttgta

SEQ ID NO: 2202137 - DNA, 19 bp, Homo sapiens
aacattggttcttgtatta

SEQ ID NO: 2202138 - DNA, 22 bp, Homo sapiens
aacattggttcttgtattaaga

SEQ ID NO: 2202139 - DNA, 23 bp, Homo sapiens
aacattggttcttgtattaagaa

SEQ ID NO: 2202140 - DNA, 17 bp, Homo sapiens
aacatttctcatgttga

SEQ ID NO: 2202141 - DNA, 23 bp, Homo sapiens
aacatttctcatgttgaagcttt

SEQ ID NO: 2202142 - DNA, 14 bp, Homo sapiens
aaccactttttgca

SEQ ID NO: 2202143 - DNA, 15 bp, Homo sapiens
aactaaaatgttcta

SEQ ID NO: 2202144 - DNA, 15 bp, Homo sapiens
aactaaactttcaca

SEQ ID NO: 2202145 - DNA, 17 bp, Homo sapiens
aactaaactttcacacc

SEQ ID NO: 2202146 - DNA, 15 bp, Homo sapiens
aactggattaaactt

SEQ ID NO: 2202147 - DNA, 21 bp, Homo sapiens
aactgggggagggtgaagtga

SEQ ID NO: 2202148 - DNA, 14 bp, Homo sapiens
aactgggttcctgc

SEQ ID NO: 2202149 - DNA, 15 bp, Homo sapiens
aactgttatttataa

SEQ ID NO: 2202150 - DNA, 17 bp, Homo sapiens
aactgttatttataatc

SEQ ID NO: 2202151 - DNA, 20 bp, Homo sapiens
aactgttatttataatcact

SEQ ID NO: 2202152 - DNA, 13 bp, Homo sapiens
aactgtttagatg

SEQ ID NO: 2202153 - DNA, 17 bp, Homo sapiens
aacttaaataatgtgaa

SEQ ID NO: 2202154 - DNA, 22 bp, Homo sapiens
aacttcaccatattaccacaga

SEQ ID NO: 2202155 - DNA, 13 bp, Homo sapiens
aactttacctttt

SEQ ID NO: 2202156 - DNA, 14 bp, Homo sapiens
aactttgacctctg

SEQ ID NO: 2202157 - DNA, 20 bp, Homo sapiens
aactttgacctctgcagcaa

SEQ ID NO: 2202158 - DNA, 15 bp, Homo sapiens
aagaaaaaggatgca

SEQ ID NO: 2202159 - DNA, 20 bp, Homo sapiens
aagaaaaaggatgcacagag

SEQ ID NO: 2202160 - DNA, 21 bp, Homo sapiens
aagaaaatagtggtgtgattt

SEQ ID NO: 2202161 - DNA, 17 bp, Homo sapiens
aagaccacgtttctaaa

SEQ ID NO: 2202162 - DNA, 21 bp, Homo sapiens
aagactgagtacgttgtgcat

SEQ ID NO: 2202163 - DNA, 23 bp, Homo sapiens
aagactgagtacgttgtgcattt

SEQ ID NO: 2202164 - DNA, 11 bp, Homo sapiens
aagattctatg

SEQ ID NO: 2202165 - DNA, 23 bp, Homo sapiens
aagattctatgttaatattttat

SEQ ID NO: 2202166 - DNA, 14 bp, Homo sapiens
aagcagcgtttcta

SEQ ID NO: 2202167 - DNA, 20 bp, Homo sapiens
aagcagcgtttctatgacac

SEQ ID NO: 2202168 - DNA, 12 bp, Homo sapiens
aagcattttata

SEQ ID NO: 2202169 - DNA, 21 bp, Homo sapiens
aagcattttataaatcgcttt

SEQ ID NO: 2202170 - DNA, 13 bp, Homo sapiens
aaggatacaaaag

SEQ ID NO: 2202171 - DNA, 15 bp, Homo sapiens
aaggatgcttgtaca

SEQ ID NO: 2202172 - DNA, 16 bp, Homo sapiens
aaggatgcttgtacat

SEQ ID NO: 2202173 - DNA, 17 bp, Homo sapiens
aaggatgcttgtacata

SEQ ID NO: 2202174 - DNA, 22 bp, Homo sapiens
aaggattttatgctttaaacat

SEQ ID NO: 2202175 - DNA, 14 bp, Homo sapiens
aaggcaaatgactt

SEQ ID NO: 2202176 - DNA, 16 bp, Homo sapiens
aaggcatatttaacaa

SEQ ID NO: 2202177 - DNA, 15 bp, Homo sapiens
aaggctacctttgta

SEQ ID NO: 2202178 - DNA, 23 bp, Homo sapiens
aaggctgatgccaagttgtttga

SEQ ID NO: 2202179 - DNA, 13 bp, Homo sapiens
aaggtagaatgtt

SEQ ID NO: 2202180 - DNA, 18 bp, Homo sapiens
aaggtcattttttttaag

SEQ ID NO: 2202181 - DNA, 18 bp, Homo sapiens
aaggttctggtgtgaact

SEQ ID NO: 2202182 - DNA, 16 bp, Homo sapiens
aagtaatatgcacaca

SEQ ID NO: 2202183 - DNA, 13 bp, Homo sapiens
aagtacactgttt

SEQ ID NO: 2202184 - DNA, 18 bp, Homo sapiens
aagtacactgtttcaaac

SEQ ID NO: 2202185 - DNA, 20 bp, Homo sapiens
aagtacactgtttcaaactt

SEQ ID NO: 2202186 - DNA, 20 bp, Homo sapiens
aagtatcagctacaattgta

SEQ ID NO: 2202187 - DNA, 22 bp, Homo sapiens
aagtatctgacatctctgcaat

SEQ ID NO: 2202188 - DNA, 15 bp, Homo sapiens
aagtattataccttt

SEQ ID NO: 2202189 - DNA, 19 bp, Homo sapiens
aagtctctgaagtgaaact

SEQ ID NO: 2202190 - DNA, 22 bp, Homo sapiens
aagtctctgaagtgaaactgct

SEQ ID NO: 2202191 - DNA, 15 bp, Homo sapiens
aagtctgttttatga

SEQ ID NO: 2202192 - DNA, 18 bp, Homo sapiens
aagtctgttttatgactt

SEQ ID NO: 2202193 - DNA, 19 bp, Homo sapiens
aagtctgttttatgacttc

SEQ ID NO: 2202194 - DNA, 23 bp, Homo sapiens
aagtctgttttatgacttcatta

SEQ ID NO: 2202195 - DNA, 18 bp, Homo sapiens
aagtgtatttttttacta

SEQ ID NO: 2202196 - DNA, 22 bp, Homo sapiens
aagttgtttgagaaattaagta

SEQ ID NO: 2202197 - DNA, 12 bp, Homo sapiens
aataaaactttt

SEQ ID NO: 2202198 - DNA, 13 bp, Homo sapiens
aataataaagatc

SEQ ID NO: 2202199 - DNA, 21 bp, Homo sapiens
aataataaagatcatgtaaaa

SEQ ID NO: 2202200 - DNA, 15 bp, Homo sapiens
aatacaccactacat

SEQ ID NO: 2202201 - DNA, 16 bp, Homo sapiens
aatacaccactacatt

SEQ ID NO: 2202202 - DNA, 19 bp, Homo sapiens
aataccagccagtaaatgg

SEQ ID NO: 2202203 - DNA, 12 bp, Homo sapiens
aatactgtttga

SEQ ID NO: 2202204 - DNA, 13 bp, Homo sapiens
aatagacaattta

SEQ ID NO: 2202205 - DNA, 22 bp, Homo sapiens
aatagtggtgtgatttggggat

SEQ ID NO: 2202206 - DNA, 18 bp, Homo sapiens
aatataggaacttaaata

SEQ ID NO: 2202207 - DNA, 18 bp, Homo sapiens
aatatcatcagtattgaa

SEQ ID NO: 2202208 - DNA, 16 bp, Homo sapiens
aatatgcacacatttt

SEQ ID NO: 2202209 - DNA, 16 bp, Homo sapiens
aatattttatgtgtaa

SEQ ID NO: 2202210 - DNA, 14 bp, Homo sapiens
aatcaactgggctg

SEQ ID NO: 2202211 - DNA, 15 bp, Homo sapiens
aatcattaggtgtga

SEQ ID NO: 2202212 - DNA, 21 bp, Homo sapiens
aatcctctcaaccacctttca

SEQ ID NO: 2202213 - DNA, 12 bp, Homo sapiens
aatctaaatgga

SEQ ID NO: 2202214 - DNA, 15 bp, Homo sapiens
aatctcaaatttcta

SEQ ID NO: 2202215 - DNA, 14 bp, Homo sapiens
aatgaagtctctga

SEQ ID NO: 2202216 - DNA, 23 bp, Homo sapiens
aatgaagtctctgaagtgaaact

SEQ ID NO: 2202217 - DNA, 13 bp, Homo sapiens
aatgcacctggaa

SEQ ID NO: 2202218 - DNA, 19 bp, Homo sapiens
aatgcgtgcataccacttt

SEQ ID NO: 2202219 - DNA, 20 bp, Homo sapiens
aatgctgtgccctaaagtgt

SEQ ID NO: 2202220 - DNA, 21 bp, Homo sapiens
aatgctgtgccctaaagtgta

SEQ ID NO: 2202221 - DNA, 15 bp, Homo sapiens
aatgggggtgcattt

SEQ ID NO: 2202222 - DNA, 14 bp, Homo sapiens
aatggtagttttac

SEQ ID NO: 2202223 - DNA, 19 bp, Homo sapiens
aatgtcagttgttatttat

SEQ ID NO: 2202224 - DNA, 14 bp, Homo sapiens
aatgtgaaactgga

SEQ ID NO: 2202225 - DNA, 22 bp, Homo sapiens
aatgtgaaactggattaaactt

SEQ ID NO: 2202226 - DNA, 23 bp, Homo sapiens
aatgtgacttggattcaatttta

SEQ ID NO: 2202227 - DNA, 11 bp, Homo sapiens
aattaactttt

SEQ ID NO: 2202228 - DNA, 18 bp, Homo sapiens
aattaacttttataaact

SEQ ID NO: 2202229 - DNA, 14 bp, Homo sapiens
aattaagtatctga

SEQ ID NO: 2202230 - DNA, 12 bp, Homo sapiens
aattatttgaag

SEQ ID NO: 2202231 - DNA, 19 bp, Homo sapiens
aattatttgaagatttaat

SEQ ID NO: 2202232 - DNA, 21 bp, Homo sapiens
aattttaaggcatatttaaca

SEQ ID NO: 2202233 - DNA, 13 bp, Homo sapiens
aattttattatag

SEQ ID NO: 2202234 - DNA, 22 bp, Homo sapiens
aatttttttatcgtcactgctt

SEQ ID NO: 2202235 - DNA, 11 bp, Homo sapiens
acaaaagcatg

SEQ ID NO: 2202236 - DNA, 13 bp, Homo sapiens
acaaagactgagt

SEQ ID NO: 2202237 - DNA, 19 bp, Homo sapiens
acaagaccacgtttctaaa

SEQ ID NO: 2202238 - DNA, 19 bp, Homo sapiens
acaatgacttactgtacat

SEQ ID NO: 2202239 - DNA, 21 bp, Homo sapiens
acaatgctgtgccctaaagtg

SEQ ID NO: 2202240 - DNA, 23 bp, Homo sapiens
acaatgctgtgccctaaagtgta

SEQ ID NO: 2202241 - DNA, 13 bp, Homo sapiens
acaatttattatg

SEQ ID NO: 2202242 - DNA, 13 bp, Homo sapiens
acacattttattt

SEQ ID NO: 2202243 - DNA, 19 bp, Homo sapiens
acacattttattttattat

SEQ ID NO: 2202244 - DNA, 21 bp, Homo sapiens
acaccactacattctgttaat

SEQ ID NO: 2202245 - DNA, 21 bp, Homo sapiens
aaaaaggatgcacagagttgt

SEQ ID NO: 2202246 - DNA, 20 bp, Homo sapiens
aaaaatctcaaatttctaaa

SEQ ID NO: 2202247 - DNA, 13 bp, Homo sapiens
aaaacatgctaca

SEQ ID NO: 2202248 - DNA, 18 bp, Homo sapiens
aaaatctcaaatttctaa

SEQ ID NO: 2202249 - DNA, 12 bp, Homo sapiens
aaaatttgaata

SEQ ID NO: 2202250 - DNA, 11 bp, Homo sapiens
aaacacatttt

SEQ ID NO: 2202251 - DNA, 16 bp, Homo sapiens
aaacatgctacacact

SEQ ID NO: 2202252 - DNA, 14 bp, Homo sapiens
aaactgcttgtttc

SEQ ID NO: 2202253 - DNA, 16 bp, Homo sapiens
aaactggattaaactt

SEQ ID NO: 2202254 - DNA, 17 bp, Homo sapiens
aaacttaatctaaatgg

SEQ ID NO: 2202255 - DNA, 17 bp, Homo sapiens
aaactttacctttttta

SEQ ID NO: 2202256 - DNA, 16 bp, Homo sapiens
aaagaggtttttctta

SEQ ID NO: 2202257 - DNA, 19 bp, Homo sapiens
aaagaggtttttcttaaat

SEQ ID NO: 2202258 - DNA, 15 bp, Homo sapiens
aaagatacagttact

SEQ ID NO: 2202259 - DNA, 15 bp, Homo sapiens
aaagcagcgtttcta

SEQ ID NO: 2202260 - DNA, 23 bp, Homo sapiens
aaaggaaggttctggtgtgaact

SEQ ID NO: 2202261 - DNA, 18 bp, Homo sapiens
aaagtacactgtttcaaa

SEQ ID NO: 2202262 - DNA, 14 bp, Homo sapiens
aaagtgtatttttt

SEQ ID NO: 2202263 - DNA, 13 bp, Homo sapiens
aaagttattttgt

SEQ ID NO: 2202264 - DNA, 13 bp, Homo sapiens
aaataaaactttt

SEQ ID NO: 2202265 - DNA, 19 bp, Homo sapiens
aaataaaactttttaaaat

SEQ ID NO: 2202266 - DNA, 20 bp, Homo sapiens
aaatatcccttggacatttt

SEQ ID NO: 2202267 - DNA, 22 bp, Homo sapiens
aaatatcccttggacattttat

SEQ ID NO: 2202268 - DNA, 23 bp, Homo sapiens
aaatatcccttggacattttatg

SEQ ID NO: 2202269 - DNA, 15 bp, Homo sapiens
aaatctcaaatttct

SEQ ID NO: 2202270 - DNA, 19 bp, Homo sapiens
aaatctcaaatttctaaat

SEQ ID NO: 2202271 - DNA, 15 bp, Homo sapiens
aaatgatttcacagt

SEQ ID NO: 2202272 - DNA, 18 bp, Homo sapiens
aaatgcacctggaatata

SEQ ID NO: 2202273 - DNA, 22 bp, Homo sapiens
aaatgcacctggaatatataac

SEQ ID NO: 2202274 - DNA, 15 bp, Homo sapiens
aaatgggggtgcatt

SEQ ID NO: 2202275 - DNA, 18 bp, Homo sapiens
aaatgggggtgcatttga

SEQ ID NO: 2202276 - DNA, 19 bp, Homo sapiens
aaatgggggtgcatttgag

SEQ ID NO: 2202277 - DNA, 12 bp, Homo sapiens
aaattaactttt

SEQ ID NO: 2202278 - DNA, 21 bp, Homo sapiens
aaattaacttttataaacttt

SEQ ID NO: 2202279 - DNA, 15 bp, Homo sapiens
aaattccctggcctt

SEQ ID NO: 2202280 - DNA, 15 bp, Homo sapiens
aaattcttgcaaagt

SEQ ID NO: 2202281 - DNA, 18 bp, Homo sapiens
aaattcttgcaaagtatc

SEQ ID NO: 2202282 - DNA, 13 bp, Homo sapiens
aaatttctaaatc

SEQ ID NO: 2202283 - DNA, 19 bp, Homo sapiens
aaatttctaaatctccaaa

SEQ ID NO: 2202284 - DNA, 23 bp, Homo sapiens
aaattttgatgttttaaggatgc

SEQ ID NO: 2202285 - DNA, 17 bp, Homo sapiens
aaatttttatgtaatta

SEQ ID NO: 2202286 - DNA, 13 bp, Homo sapiens
aacaaaatttgaa

SEQ ID NO: 2202287 - DNA, 17 bp, Homo sapiens
aacaagaccacgtttct

SEQ ID NO: 2202288 - DNA, 19 bp, Homo sapiens
aacaagaccacgtttctaa

SEQ ID NO: 2202289 - DNA, 14 bp, Homo sapiens
aacagaaatgtaca

SEQ ID NO: 2202290 - DNA, 15 bp, Homo sapiens
aacagaaatgtacag

SEQ ID NO: 2202291 - DNA, 13 bp, Homo sapiens
aacatttctcatg

SEQ ID NO: 2202292 - DNA, 14 bp, Homo sapiens
aacatttctcatgt

SEQ ID NO: 2202293 - DNA, 22 bp, Homo sapiens
aaccactctatcaagtattata

SEQ ID NO: 2202294 - DNA, 13 bp, Homo sapiens
aactaaactttca

SEQ ID NO: 2202295 - DNA, 16 bp, Homo sapiens
aactggattaaactta

SEQ ID NO: 2202296 - DNA, 22 bp, Homo sapiens
aactgggggagggtgaagtgaa

SEQ ID NO: 2202297 - DNA, 21 bp, Homo sapiens
aactttaagaactaaaatgtt

SEQ ID NO: 2202298 - DNA, 22 bp, Homo sapiens
aactttaccttttttatacata

SEQ ID NO: 2202299 - DNA, 23 bp, Homo sapiens
aactttaccttttttatacataa

SEQ ID NO: 2202300 - DNA, 17 bp, Homo sapiens
aactttgacctctgcag

SEQ ID NO: 2202301 - DNA, 16 bp, Homo sapiens
aacttttataaacttt

SEQ ID NO: 2202302 - DNA, 15 bp, Homo sapiens
aagaaaatagtggtg

SEQ ID NO: 2202303 - DNA, 22 bp, Homo sapiens
aagaaaatagtggtgtgatttg

SEQ ID NO: 2202304 - DNA, 22 bp, Homo sapiens
aagacaatgacttactgtacat

SEQ ID NO: 2202305 - DNA, 15 bp, Homo sapiens
aagaccacgtttcta

SEQ ID NO: 2202306 - DNA, 12 bp, Homo sapiens
aagattctatgt

SEQ ID NO: 2202307 - DNA, 22 bp, Homo sapiens
aagattctatgttaatatttta

SEQ ID NO: 2202308 - DNA, 17 bp, Homo sapiens
aagcagcgtttctatga

SEQ ID NO: 2202309 - DNA, 14 bp, Homo sapiens
aagcattttataaa

SEQ ID NO: 2202310 - DNA, 15 bp, Homo sapiens
aagcattttataaat

SEQ ID NO: 2202311 - DNA, 17 bp, Homo sapiens
aaggagatttacaactg

SEQ ID NO: 2202312 - DNA, 17 bp, Homo sapiens
aaggaggaagcttattg

SEQ ID NO: 2202313 - DNA, 21 bp, Homo sapiens
aaggatacaaaagcatgtgag

SEQ ID NO: 2202314 - DNA, 24 bp, Homo sapiens
aaggatgcacagagttgttacatt

SEQ ID NO: 2202315 - DNA, 20 bp, Homo sapiens
aaggattttatgctttaaac

SEQ ID NO: 2202316 - DNA, 19 bp, Homo sapiens
aagtacactgtttcaaact

SEQ ID NO: 2202317 - DNA, 23 bp, Homo sapiens
aagtacactgtttcaaactttac

SEQ ID NO: 2202318 - DNA, 17 bp, Homo sapiens
aagtatccctactgtaa

SEQ ID NO: 2202319 - DNA, 15 bp, Homo sapiens
aagtatctgacatct

SEQ ID NO: 2202320 - DNA, 19 bp, Homo sapiens
aagtattatacctttttta

SEQ ID NO: 2202321 - DNA, 12 bp, Homo sapiens
aagtctgtttta

SEQ ID NO: 2202322 - DNA, 13 bp, Homo sapiens
aagtctgttttat

SEQ ID NO: 2202323 - DNA, 17 bp, Homo sapiens
aagtgaagacaatgact

SEQ ID NO: 2202324 - DNA, 19 bp, Homo sapiens
aagtgaagacaatgactta

SEQ ID NO: 2202325 - DNA, 14 bp, Homo sapiens
aataaaacttttta

SEQ ID NO: 2202326 - DNA, 18 bp, Homo sapiens
aataaaactttttaaaat

SEQ ID NO: 2202327 - DNA, 21 bp, Homo sapiens
aatacaccactacattctgtt

SEQ ID NO: 2202328 - DNA, 23 bp, Homo sapiens
aatagacaatttattatggcaca

SEQ ID NO: 2202329 - DNA, 20 bp, Homo sapiens
aatatagctttcataacatc

SEQ ID NO: 2202330 - DNA, 23 bp, Homo sapiens
aatatcccttggacattttatgt

SEQ ID NO: 2202331 - DNA, 15 bp, Homo sapiens
aatatgcacacattt

SEQ ID NO: 2202332 - DNA, 19 bp, Homo sapiens
aatcaactgggctgaacac

SEQ ID NO: 2202333 - DNA, 14 bp, Homo sapiens
aatctcaaatttct

SEQ ID NO: 2202334 - DNA, 17 bp, Homo sapiens
aatctcaaatttctaaa

SEQ ID NO: 2202335 - DNA, 14 bp, Homo sapiens
aatctccaaaataa

SEQ ID NO: 2202336 - DNA, 16 bp, Homo sapiens
aatctggattcatatt

SEQ ID NO: 2202337 - DNA, 17 bp, Homo sapiens
aatctggattcatattt

SEQ ID NO: 2202338 - DNA, 18 bp, Homo sapiens
aatctggattcatattta

SEQ ID NO: 2202339 - DNA, 13 bp, Homo sapiens
aatgctaatttta

SEQ ID NO: 2202340 - DNA, 14 bp, Homo sapiens
aatgctaattttat

SEQ ID NO: 2202341 - DNA, 13 bp, Homo sapiens
aatgctgtgccct

SEQ ID NO: 2202342 - DNA, 12 bp, Homo sapiens
aatgtatgtgtg

SEQ ID NO: 2202343 - DNA, 19 bp, Homo sapiens
aatgtatgtgtgtctattt

SEQ ID NO: 2202344 - DNA, 20 bp, Homo sapiens
aatgtcagttgttatttatt

SEQ ID NO: 2202345 - DNA, 22 bp, Homo sapiens
aatgtcagttgttatttattga

SEQ ID NO: 2202346 - DNA, 15 bp, Homo sapiens
aatgtgaaactggat

SEQ ID NO: 2202347 - DNA, 19 bp, Homo sapiens
aatgtgacttggattcaat

SEQ ID NO: 2202348 - DNA, 17 bp, Homo sapiens
aatgttaattatgcagt

SEQ ID NO: 2202349 - DNA, 20 bp, Homo sapiens
aatgtttagcagatttaaga

SEQ ID NO: 2202350 - DNA, 16 bp, Homo sapiens
aattaacttttataaa

SEQ ID NO: 2202351 - DNA, 22 bp, Homo sapiens
aattaacttttataaactttac

SEQ ID NO: 2202352 - DNA, 13 bp, Homo sapiens
catacgtacacat

SEQ ID NO: 2202353 - DNA, 16 bp, Homo sapiens
catacgtacacatttt

SEQ ID NO: 2202354 - DNA, 17 bp, Homo sapiens
catacgtacacatttta

SEQ ID NO: 2202355 - DNA, 18 bp, Homo sapiens
catacgtacacattttat

SEQ ID NO: 2202356 - DNA, 16 bp, Homo sapiens
catatcacatgtcagc

SEQ ID NO: 2202357 - DNA, 22 bp, Homo sapiens
catattaccacagacatactaa

SEQ ID NO: 2202358 - DNA, 15 bp, Homo sapiens
catatttaatttgaa

SEQ ID NO: 2202359 - DNA, 18 bp, Homo sapiens
catatttaatttgaagat

SEQ ID NO: 2202360 - DNA, 17 bp, Homo sapiens
catatttaatttgaagg

SEQ ID NO: 2202361 - DNA, 17 bp, Homo sapiens
catcaatgataatgcta

SEQ ID NO: 2202362 - DNA, 18 bp, Homo sapiens
catcagcacgatttctgt

SEQ ID NO: 2202363 - DNA, 21 bp, Homo sapiens
catcagcacgatttctgttta

SEQ ID NO: 2202364 - DNA, 20 bp, Homo sapiens
catcagtattgaagcatttt

SEQ ID NO: 2202365 - DNA, 13 bp, Homo sapiens
catgaaaacacat

SEQ ID NO: 2202366 - DNA, 15 bp, Homo sapiens
catgaaaacacattt

SEQ ID NO: 2202367 - DNA, 17 bp, Homo sapiens
catgaaaacacattttt

SEQ ID NO: 2202368 - DNA, 22 bp, Homo sapiens
catgcaaggtcattttttttaa

SEQ ID NO: 2202369 - DNA, 14 bp, Homo sapiens
catgctacacactg

SEQ ID NO: 2202370 - DNA, 20 bp, Homo sapiens
catgctacacactgcatgtt

SEQ ID NO: 2202371 - DNA, 20 bp, Homo sapiens
catgctctccaaaccacttt

SEQ ID NO: 2202372 - DNA, 21 bp, Homo sapiens
catggcctcttcagatctcta

SEQ ID NO: 2202373 - DNA, 19 bp, Homo sapiens
catggtcggaaaacatgct

SEQ ID NO: 2202374 - DNA, 22 bp, Homo sapiens
catgtatgtaaatagctaagat

SEQ ID NO: 2202375 - DNA, 14 bp, Homo sapiens
catgtttgtgattg

SEQ ID NO: 2202376 - DNA, 14 bp, Homo sapiens
cattaataataaat

SEQ ID NO: 2202377 - DNA, 15 bp, Homo sapiens
cattatatttattgt

SEQ ID NO: 2202378 - DNA, 23 bp, Homo sapiens
cattatctagatactgtatcatg

SEQ ID NO: 2202379 - DNA, 15 bp, Homo sapiens
cattatgttaatatt

SEQ ID NO: 2202380 - DNA, 20 bp, Homo sapiens
cattctccttgtgttactaa

SEQ ID NO: 2202381 - DNA, 14 bp, Homo sapiens
cattctttttgaaa

SEQ ID NO: 2202382 - DNA, 14 bp, Homo sapiens
cattggttcttgta

SEQ ID NO: 2202383 - DNA, 15 bp, Homo sapiens
cattggttcttgtat

SEQ ID NO: 2202384 - DNA, 15 bp, Homo sapiens
catttaaaagataca

SEQ ID NO: 2202385 - DNA, 16 bp, Homo sapiens
catttaaaagatacag

SEQ ID NO: 2202386 - DNA, 12 bp, Homo sapiens
catttctcatgt

SEQ ID NO: 2202387 - DNA, 16 bp, Homo sapiens
catttctcatgttgaa

SEQ ID NO: 2202388 - DNA, 17 bp, Homo sapiens
catttctcatgttgaaa

SEQ ID NO: 2202389 - DNA, 17 bp, Homo sapiens
catttgaaaattttgat

SEQ ID NO: 2202390 - DNA, 20 bp, Homo sapiens
catttgaaaattttgatgtt

SEQ ID NO: 2202391 - DNA, 20 bp, Homo sapiens
catttgtttgaactgataaa

SEQ ID NO: 2202392 - DNA, 22 bp, Homo sapiens
catttgtttgaactgataaaga

SEQ ID NO: 2202393 - DNA, 11 bp, Homo sapiens
cattttataaa

SEQ ID NO: 2202394 - DNA, 21 bp, Homo sapiens
cattttattttattatgcatg

SEQ ID NO: 2202395 - DNA, 23 bp, Homo sapiens
catttttcttagggaaggataca

SEQ ID NO: 2202396 - DNA, 19 bp, Homo sapiens
cattttttaaatgcacctg

SEQ ID NO: 2202397 - DNA, 18 bp, Homo sapiens
ccaaaataaaacttttta

SEQ ID NO: 2202398 - DNA, 14 bp, Homo sapiens
ccaaaccacttttt

SEQ ID NO: 2202399 - DNA, 22 bp, Homo sapiens
ccaaaccactttttgcagcttt

SEQ ID NO: 2202400 - DNA, 22 bp, Homo sapiens
ccaattaaggattttatgcttt

SEQ ID NO: 2202401 - DNA, 13 bp, Homo sapiens
ccacgtttctaaa

SEQ ID NO: 2202402 - DNA, 18 bp, Homo sapiens
ccactacattctgttaat

SEQ ID NO: 2202403 - DNA, 14 bp, Homo sapiens
ccacttttgttctt

SEQ ID NO: 2202404 - DNA, 22 bp, Homo sapiens
ccacttttgttcttggtttgta

SEQ ID NO: 2202405 - DNA, 13 bp, Homo sapiens
ccactttttgcag

SEQ ID NO: 2202406 - DNA, 12 bp, Homo sapiens
ccagcagaaatg

SEQ ID NO: 2202407 - DNA, 16 bp, Homo sapiens
ccagcagaaatgcctt

SEQ ID NO: 2202408 - DNA, 20 bp, Homo sapiens
ccagtaaatgggggtgcatt

SEQ ID NO: 2202409 - DNA, 23 bp, Homo sapiens
ccagtaaatgggggtgcatttga

SEQ ID NO: 2202410 - DNA, 21 bp, Homo sapiens
ccagtcattatgttaatattt

SEQ ID NO: 2202411 - DNA, 22 bp, Homo sapiens
ccagtgttgtggatttaacaga

SEQ ID NO: 2202412 - DNA, 19 bp, Homo sapiens
ccatattaccacagacata

SEQ ID NO: 2202413 - DNA, 13 bp, Homo sapiens
ccatggccctgcc

SEQ ID NO: 2202414 - DNA, 13 bp, Homo sapiens
ccattatatttat

SEQ ID NO: 2202415 - DNA, 15 bp, Homo sapiens
cccagacgatgtctt

SEQ ID NO: 2202416 - DNA, 23 bp, Homo sapiens
cccggaagccaaacctctgtgag

SEQ ID NO: 2202417 - DNA, 20 bp, Homo sapiens
ccctattttttttctgttat

SEQ ID NO: 2202418 - DNA, 17 bp, Homo sapiens
ccctgccacctcctgcc

SEQ ID NO: 2202419 - DNA, 16 bp, Homo sapiens
cccttggacattttat

SEQ ID NO: 2202420 - DNA, 22 bp, Homo sapiens
cctacatgtatttgtttgcata

SEQ ID NO: 2202421 - DNA, 17 bp, Homo sapiens
cctcagctctcagttgc

SEQ ID NO: 2202422 - DNA, 19 bp, Homo sapiens
cctgcaatgaagtctctga

SEQ ID NO: 2202423 - DNA, 20 bp, Homo sapiens
cctgcaatgaagtctctgaa

SEQ ID NO: 2202424 - DNA, 14 bp, Homo sapiens
cctgccacctcctg

SEQ ID NO: 2202425 - DNA, 17 bp, Homo sapiens
cctgccacctcctgcct

SEQ ID NO: 2202426 - DNA, 16 bp, Homo sapiens
cctgctgctgcctgcc

SEQ ID NO: 2202427 - DNA, 19 bp, Homo sapiens
cctggacttggcccctgcc

SEQ ID NO: 2202428 - DNA, 22 bp, Homo sapiens
cctggcctagcatacgtacaca

SEQ ID NO: 2202429 - DNA, 19 bp, Homo sapiens
ccttaccctcatgttctta

SEQ ID NO: 2202430 - DNA, 16 bp, Homo sapiens
ccttggacattttatg

SEQ ID NO: 2202431 - DNA, 18 bp, Homo sapiens
ccttggacattttatgtc

SEQ ID NO: 2202432 - DNA, 23 bp, Homo sapiens
ccttgttaagtatcagctacaat

SEQ ID NO: 2202433 - DNA, 12 bp, Homo sapiens
ccttttttatac

SEQ ID NO: 2202434 - DNA, 12 bp, Homo sapiens
cgatttctgttt

SEQ ID NO: 2202435 - DNA, 16 bp, Homo sapiens
cggcagggaaatgtat

SEQ ID NO: 2202436 - DNA, 18 bp, Homo sapiens
cggcagggaaatgtatgt

SEQ ID NO: 2202437 - DNA, 16 bp, Homo sapiens
cgtacacattttattt

SEQ ID NO: 2202438 - DNA, 18 bp, Homo sapiens
cgtgcataccacttttgt

SEQ ID NO: 2202439 - DNA, 19 bp, Homo sapiens
cgtttctaaaggctacctt

SEQ ID NO: 2202440 - DNA, 13 bp, Homo sapiens
ctaaaatgttcta

SEQ ID NO: 2202441 - DNA, 15 bp, Homo sapiens
ctaaacatgtatgta

SEQ ID NO: 2202442 - DNA, 13 bp, Homo sapiens
ctaaactttcaca

SEQ ID NO: 2202443 - DNA, 14 bp, Homo sapiens
ctaaactttcacac

SEQ ID NO: 2202444 - DNA, 16 bp, Homo sapiens
ctaaaggctacctttg

SEQ ID NO: 2202445 - DNA, 22 bp, Homo sapiens
ctaaagtgtatttttttactaa

SEQ ID NO: 2202446 - DNA, 21 bp, Homo sapiens
ctaaatctccaaaataaaact

SEQ ID NO: 2202447 - DNA, 15 bp, Homo sapiens
ctaaatggaaccact

SEQ ID NO: 2202448 - DNA, 16 bp, Homo sapiens
ctaaccagcagaaatg

SEQ ID NO: 2202449 - DNA, 17 bp, Homo sapiens
ctaaccagcagaaatgc

SEQ ID NO: 2202450 - DNA, 17 bp, Homo sapiens
ctaatagacaatttatt

SEQ ID NO: 2202451 - DNA, 17 bp, Homo sapiens
ctaattttattatagta

SEQ ID NO: 2202452 - DNA, 17 bp, Homo sapiens
ctacaattgtaaactag

SEQ ID NO: 2202453 - DNA, 13 bp, Homo sapiens
ctacacactgcat

SEQ ID NO: 2202454 - DNA, 15 bp, Homo sapiens
ctacacactgcatgt

SEQ ID NO: 2202455 - DNA, 18 bp, Homo sapiens
ctacctctccagcctcag

SEQ ID NO: 2202456 - DNA, 17 bp, Homo sapiens
ctactgtaatttgtgat

SEQ ID NO: 2202457 - DNA, 15 bp, Homo sapiens
ctagaggttcaaaga

SEQ ID NO: 2202458 - DNA, 21 bp, Homo sapiens
ctagaggttcaaagatatttt

SEQ ID NO: 2202459 - DNA, 16 bp, Homo sapiens
ctagcatacgtacaca

SEQ ID NO: 2202460 - DNA, 18 bp, Homo sapiens
ctagcatacgtacacatt

SEQ ID NO: 2202461 - DNA, 19 bp, Homo sapiens
ctagtttgattaaattctt

SEQ ID NO: 2202462 - DNA, 20 bp, Homo sapiens
ctagtttgattaaattcttg

SEQ ID NO: 2202463 - DNA, 22 bp, Homo sapiens
ctagtttgattaaattcttgca

SEQ ID NO: 2202464 - DNA, 21 bp, Homo sapiens
ctatgcatttgaaaattttga

SEQ ID NO: 2202465 - DNA, 12 bp, Homo sapiens
ctatgttaatat

SEQ ID NO: 2202466 - DNA, 13 bp, Homo sapiens
ctatgttaatatt

SEQ ID NO: 2202467 - DNA, 17 bp, Homo sapiens
ctatgttaatattttag

SEQ ID NO: 2202468 - DNA, 21 bp, Homo sapiens
ctatgttaatattttaggtgt

SEQ ID NO: 2202469 - DNA, 22 bp, Homo sapiens
ctatgttaatattttatgtgta

SEQ ID NO: 2202470 - DNA, 15 bp, Homo sapiens
ctcaaatttctaaat

SEQ ID NO: 2202471 - DNA, 19 bp, Homo sapiens
ctcagaaggcaaatgactt

SEQ ID NO: 2202472 - DNA, 20 bp, Homo sapiens
ctcagaaggcaaatgacttt

SEQ ID NO: 2202473 - DNA, 12 bp, Homo sapiens
ctcatgttctta

SEQ ID NO: 2202474 - DNA, 18 bp, Homo sapiens
ctcatgttcttaattctt

SEQ ID NO: 2202475 - DNA, 19 bp, Homo sapiens
ctcatgttcttaattctta

SEQ ID NO: 2202476 - DNA, 17 bp, Homo sapiens
ctcatgttgaaacttta

SEQ ID NO: 2202477 - DNA, 22 bp, Homo sapiens
ctcattctccttgtgttactaa

SEQ ID NO: 2202478 - DNA, 16 bp, Homo sapiens
ctccaaaataaaactt

SEQ ID NO: 2202479 - DNA, 22 bp, Homo sapiens
ctccagtcattatgttaatatt

SEQ ID NO: 2202480 - DNA, 15 bp, Homo sapiens
ctccatggccctgcc

SEQ ID NO: 2202481 - DNA, 20 bp, Homo sapiens
ctccatggccctgccatgct

SEQ ID NO: 2202482 - DNA, 19 bp, Homo sapiens
ctccctattttttttctgt

SEQ ID NO: 2202483 - DNA, 20 bp, Homo sapiens
ctccctattttttttctgtt

SEQ ID NO: 2202484 - DNA, 15 bp, Homo sapiens
ctctagtttgattaa

SEQ ID NO: 2202485 - DNA, 18 bp, Homo sapiens
ctctccagcctcagctct

SEQ ID NO: 2202486 - DNA, 22 bp, Homo sapiens
ctctcctgtacctcttgagcct

SEQ ID NO: 2202487 - DNA, 18 bp, Homo sapiens
ctctgcaatcttctcaga

SEQ ID NO: 2202488 - DNA, 23 bp, Homo sapiens
ctctgcagcaataaagcagcgtt

SEQ ID NO: 2202489 - DNA, 14 bp, Homo sapiens
gcacacatttttta

SEQ ID NO: 2202490 - DNA, 22 bp, Homo sapiens
gcacactctcccattatattta

SEQ ID NO: 2202491 - DNA, 23 bp, Homo sapiens
gcacactctcccattatatttat

SEQ ID NO: 2202492 - DNA, 18 bp, Homo sapiens
gcacagagttgttacatt

SEQ ID NO: 2202493 - DNA, 12 bp, Homo sapiens
gcacgatttctg

SEQ ID NO: 2202494 - DNA, 16 bp, Homo sapiens
gcagcaataaagcagc

SEQ ID NO: 2202495 - DNA, 20 bp, Homo sapiens
gcagtggtggttttctgttc

SEQ ID NO: 2202496 - DNA, 16 bp, Homo sapiens
gcataccacttttgtt

SEQ ID NO: 2202497 - DNA, 12 bp, Homo sapiens
gcatcacagttt

SEQ ID NO: 2202498 - DNA, 23 bp, Homo sapiens
gcatgaagtaatatgcacacatt

SEQ ID NO: 2202499 - DNA, 19 bp, Homo sapiens
gcattatctagatactgta

SEQ ID NO: 2202500 - DNA, 24 bp, Homo sapiens
gcattatctagatactgtatcatg

SEQ ID NO: 2202501 - DNA, 15 bp, Homo sapiens
gcatttaaaagatac

SEQ ID NO: 2202502 - DNA, 16 bp, Homo sapiens
gcatttaaaagataca

SEQ ID NO: 2202503 - DNA, 13 bp, Homo sapiens
gcattttataaat

SEQ ID NO: 2202504 - DNA, 19 bp, Homo sapiens
gcctagcatacgtacacat

SEQ ID NO: 2202505 - DNA, 22 bp, Homo sapiens
gcctagcatacgtacacatttt

SEQ ID NO: 2202506 - DNA, 19 bp, Homo sapiens
gccttaccctcatgttctt

SEQ ID NO: 2202507 - DNA, 23 bp, Homo sapiens
gccttgaactttgacctctgcag

SEQ ID NO: 2202508 - DNA, 15 bp, Homo sapiens
gccttgtttaatggt

SEQ ID NO: 2202509 - DNA, 17 bp, Homo sapiens
gccttgtttaatgttaa

SEQ ID NO: 2202510 - DNA, 18 bp, Homo sapiens
gccttgtttaatgttaat

SEQ ID NO: 2202511 - DNA, 18 bp, Homo sapiens
gcgtttctatgacacatg

SEQ ID NO: 2202512 - DNA, 13 bp, Homo sapiens
gctacacactgca

SEQ ID NO: 2202513 - DNA, 13 bp, Homo sapiens
gctatgcatttga

SEQ ID NO: 2202514 - DNA, 22 bp, Homo sapiens
gctctccaaaccactttttgca

SEQ ID NO: 2202515 - DNA, 21 bp, Homo sapiens
gctgaacactccaattaagga

SEQ ID NO: 2202516 - DNA, 14 bp, Homo sapiens
gcttaacttcacat

SEQ ID NO: 2202517 - DNA, 15 bp, Homo sapiens
gcttgtttcctagca

SEQ ID NO: 2202518 - DNA, 20 bp, Homo sapiens
gctttaatatcatcagtatt

SEQ ID NO: 2202519 - DNA, 23 bp, Homo sapiens
ggaacagaagaggaaagagagac

SEQ ID NO: 2202520 - DNA, 15 bp, Homo sapiens
ggacattttatgtct

SEQ ID NO: 2202521 - DNA, 16 bp, Homo sapiens
ggacattttatgtctt

SEQ ID NO: 2202522 - DNA, 18 bp, Homo sapiens
ggagaagtcttctattta

SEQ ID NO: 2202523 - DNA, 20 bp, Homo sapiens
ggagaagtcttctatttatt

SEQ ID NO: 2202524 - DNA, 23 bp, Homo sapiens
ggattgtgcctaatgtgtttgag

SEQ ID NO: 2202525 - DNA, 16 bp, Homo sapiens
ggatttaacagaaatg

SEQ ID NO: 2202526 - DNA, 17 bp, Homo sapiens
ggatttaacagaaatgt

SEQ ID NO: 2202527 - DNA, 22 bp, Homo sapiens
ggatttaacagaaatgtacagc

SEQ ID NO: 2202528 - DNA, 18 bp, Homo sapiens
ggcacatcagcacgattt

SEQ ID NO: 2202529 - DNA, 21 bp, Homo sapiens
ggcatactgccttgtttaatg

SEQ ID NO: 2202530 - DNA, 22 bp, Homo sapiens
ggcatatttaacaaaatttgaa

SEQ ID NO: 2202531 - DNA, 17 bp, Homo sapiens
ggcatttgtttgaactg

SEQ ID NO: 2202532 - DNA, 21 bp, Homo sapiens
ggctgaacactccaattaagg

SEQ ID NO: 2202533 - DNA, 21 bp, Homo sapiens
ggctgatgccaagttgtttga

SEQ ID NO: 2202534 - DNA, 22 bp, Homo sapiens
ggctgatgccaagttgtttgag

SEQ ID NO: 2202535 - DNA, 10 bp, Homo sapiens
ggcttttgtg

SEQ ID NO: 2202536 - DNA, 23 bp, Homo sapiens
gggaaggatacaaaagcatgtga

SEQ ID NO: 2202537 - DNA, 23 bp, Homo sapiens
ggtagaatgttttcaaatgttct

SEQ ID NO: 2202538 - DNA, 12 bp, Homo sapiens
ggtctgttcttt

SEQ ID NO: 2202539 - DNA, 17 bp, Homo sapiens
ggtctgttctttccaaa

SEQ ID NO: 2202540 - DNA, 18 bp, Homo sapiens
ggtggtttcagaaatgtg

SEQ ID NO: 2202541 - DNA, 13 bp, Homo sapiens
ggttaagtctgtt

SEQ ID NO: 2202542 - DNA, 16 bp, Homo sapiens
ggttaagtctgtttta

SEQ ID NO: 2202543 - DNA, 23 bp, Homo sapiens
ggttaagtctgttttatgacttc

SEQ ID NO: 2202544 - DNA, 13 bp, Homo sapiens
ggtttcagaaatg

SEQ ID NO: 2202545 - DNA, 13 bp, Homo sapiens
ggttttctgttct

SEQ ID NO: 2202546 - DNA, 16 bp, Homo sapiens
gtaaattaacttttat

SEQ ID NO: 2202547 - DNA, 21 bp, Homo sapiens
gtaaattaacttttataaact

SEQ ID NO: 2202548 - DNA, 15 bp, Homo sapiens
gtaacaacaattatt

SEQ ID NO: 2202549 - DNA, 20 bp, Homo sapiens
gtaactgtaaagatgaatgt

SEQ ID NO: 2202550 - DNA, 17 bp, Homo sapiens
gtaatatgcacacattt

SEQ ID NO: 2202551 - DNA, 18 bp, Homo sapiens
gtaatatgcacacatttt

SEQ ID NO: 2202552 - DNA, 21 bp, Homo sapiens
gtaatttttttatcgtcactg

SEQ ID NO: 2202553 - DNA, 14 bp, Homo sapiens
gtacatgaaaacac

SEQ ID NO: 2202554 - DNA, 18 bp, Homo sapiens
gtacatgaaaacacattt

SEQ ID NO: 2202555 - DNA, 19 bp, Homo sapiens
gtacatgaaaacacatttt

SEQ ID NO: 2202556 - DNA, 21 bp, Homo sapiens
gtacctcttgagccttgaact

SEQ ID NO: 2202557 - DNA, 17 bp, Homo sapiens
gtatgaggcatttgttt

SEQ ID NO: 2202558 - DNA, 14 bp, Homo sapiens
gtattatacctttt

SEQ ID NO: 2202559 - DNA, 21 bp, Homo sapiens
gtatttttttactaatagaca

SEQ ID NO: 2202560 - DNA, 18 bp, Homo sapiens
gtcaacatttctcatgtt

SEQ ID NO: 2202561 - DNA, 14 bp, Homo sapiens
gtcagccactgtga

SEQ ID NO: 2202562 - DNA, 21 bp, Homo sapiens
gtcagttgttatttattgaaa

SEQ ID NO: 2202563 - DNA, 19 bp, Homo sapiens
gtcatttgttaatatttct

SEQ ID NO: 2202564 - DNA, 20 bp, Homo sapiens
gtcatttgttaatatttctt

SEQ ID NO: 2202565 - DNA, 19 bp, Homo sapiens
gtcctattatattcattct

SEQ ID NO: 2202566 - DNA, 21 bp, Homo sapiens
gtctctgaagtgaaactgctt

SEQ ID NO: 2202567 - DNA, 20 bp, Homo sapiens
gtgaaactgcttgtttccta

SEQ ID NO: 2202568 - DNA, 23 bp, Homo sapiens
gtgaaactgcttgtttcctagca

SEQ ID NO: 2202569 - DNA, 19 bp, Homo sapiens
gtgatttttaaattaaata

SEQ ID NO: 2202570 - DNA, 18 bp, Homo sapiens
gtgatttttgtaattttt

SEQ ID NO: 2202571 - DNA, 14 bp, Homo sapiens
gtgcataccacttt

SEQ ID NO: 2202572 - DNA, 19 bp, Homo sapiens
gtgctgcatttaaaagata

SEQ ID NO: 2202573 - DNA, 18 bp, Homo sapiens
gtggatttaacagaaatg

SEQ ID NO: 2202574 - DNA, 19 bp, Homo sapiens
gtggatttaacagaaatgt

SEQ ID NO: 2202575 - DNA, 21 bp, Homo sapiens
gtggatttaacagaaatgtac

SEQ ID NO: 2202576 - DNA, 15 bp, Homo sapiens
gtggtttcagaaatg

SEQ ID NO: 2202577 - DNA, 17 bp, Homo sapiens
gtgtatttttttactaa

SEQ ID NO: 2202578 - DNA, 14 bp, Homo sapiens
gttaaaagaggttt

SEQ ID NO: 2202579 - DNA, 20 bp, Homo sapiens
gttaaaagaggtttttctta

SEQ ID NO: 2202580 - DNA, 21 bp, Homo sapiens
gttaagtatcagctacaattg

SEQ ID NO: 2202581 - DNA, 15 bp, Homo sapiens
gttaattatgcagtg

SEQ ID NO: 2202582 - DNA, 23 bp, Homo sapiens
gttagttcaatcctgattcatat

SEQ ID NO: 2202583 - DNA, 13 bp, Homo sapiens
gttatataaatgg

SEQ ID NO: 2202584 - DNA, 21 bp, Homo sapiens
gttcaaagatattttgctttg

SEQ ID NO: 2202585 - DNA, 20 bp, Homo sapiens
gttcaatcctgattcatatt

SEQ ID NO: 2202586 - DNA, 15 bp, Homo sapiens
gttcctgcaatgaag

SEQ ID NO: 2202587 - DNA, 18 bp, Homo sapiens
gttctggtgtgaactaaa

SEQ ID NO: 2202588 - DNA, 17 bp, Homo sapiens
gttcttaattcttagct

SEQ ID NO: 2202589 - DNA, 21 bp, Homo sapiens
gttcttggtttgtaaattaac

SEQ ID NO: 2202590 - DNA, 17 bp, Homo sapiens
gttcttgtattaagaat

SEQ ID NO: 2202591 - DNA, 18 bp, Homo sapiens
gttcttgtattaagaatg

SEQ ID NO: 2202592 - DNA, 20 bp, Homo sapiens
gttctttccaaagtacactg

SEQ ID NO: 2202593 - DNA, 22 bp, Homo sapiens
gttgtggatttaacagaaatgt

SEQ ID NO: 2202594 - DNA, 12 bp, Homo sapiens
gtttaatggtag

SEQ ID NO: 2202595 - DNA, 20 bp, Homo sapiens
gtttaatggtagttttacag

SEQ ID NO: 2202596 - DNA, 19 bp, Homo sapiens
gtttaatgttaattatgca

SEQ ID NO: 2202597 - DNA, 14 bp, Homo sapiens
gtttcaaactttac

SEQ ID NO: 2202598 - DNA, 11 bp, Homo sapiens
gtttcagaaat

SEQ ID NO: 2202599 - DNA, 13 bp, Homo sapiens
gtttcagaaatgt

SEQ ID NO: 2202600 - DNA, 15 bp, Homo sapiens
gtttccctctgtgtt

SEQ ID NO: 2202601 - DNA, 19 bp, Homo sapiens
gtttgaggtttttaagcct

SEQ ID NO: 2202602 - DNA, 22 bp, Homo sapiens
gtttgttttagaagattctatg

SEQ ID NO: 2202603 - DNA, 14 bp, Homo sapiens
gttttacagtgttt

SEQ ID NO: 2202604 - DNA, 20 bp, Homo sapiens
gttttagaagattctatgtt

SEQ ID NO: 2202605 - DNA, 11 bp, Homo sapiens
gttttctgttc

SEQ ID NO: 2202606 - DNA, 16 bp, Homo sapiens
gttttggttgctttaa

SEQ ID NO: 2202607 - DNA, 19 bp, Homo sapiens
gtttttatggcttttgtgc

SEQ ID NO: 2202608 - DNA, 21 bp, Homo sapiens
gtttttcttaaataataaaga

SEQ ID NO: 2202609 - DNA, 16 bp, Homo sapiens
taaaaatctcaaattt

SEQ ID NO: 2202610 - DNA, 19 bp, Homo sapiens
taaaaatctcaaatttcta

SEQ ID NO: 2202611 - DNA, 20 bp, Homo sapiens
taaaaatctcaaatttctaa

SEQ ID NO: 2202612 - DNA, 19 bp, Homo sapiens
taaaagaggtttttcttaa

SEQ ID NO: 2202613 - DNA, 17 bp, Homo sapiens
taaaagatacagttact

SEQ ID NO: 2202614 - DNA, 20 bp, Homo sapiens
taaaagatacagttactcag

SEQ ID NO: 2202615 - DNA, 21 bp, Homo sapiens
taaaataccagccagtaaatg

SEQ ID NO: 2202616 - DNA, 20 bp, Homo sapiens
taaaatttttatgtaattat

SEQ ID NO: 2202617 - DNA, 18 bp, Homo sapiens
taaacaagaccacgtttc

SEQ ID NO: 2202618 - DNA, 21 bp, Homo sapiens
taaacaagaccacgtttctaa

SEQ ID NO: 2202619 - DNA, 23 bp, Homo sapiens
taaacaagaccacgtttctaaag

SEQ ID NO: 2202620 - DNA, 18 bp, Homo sapiens
taaacatgtatgtaaata

SEQ ID NO: 2202621 - DNA, 18 bp, Homo sapiens
taaacgtgatttttaaat

SEQ ID NO: 2202622 - DNA, 23 bp, Homo sapiens
taaacgtgatttttaaattaaat

SEQ ID NO: 2202623 - DNA, 18 bp, Homo sapiens
taaacttaatctaaatgg

SEQ ID NO: 2202624 - DNA, 17 bp, Homo sapiens
ttctctagtttgattaa

SEQ ID NO: 2202625 - DNA, 20 bp, Homo sapiens
ttctctagtttgattaaatt

SEQ ID NO: 2202626 - DNA, 22 bp, Homo sapiens
ttctctcctgtacctcttgagc

SEQ ID NO: 2202627 - DNA, 20 bp, Homo sapiens
ttctggctatgcatttgaaa

SEQ ID NO: 2202628 - DNA, 20 bp, Homo sapiens
ttctggtgtgaactaaactt

SEQ ID NO: 2202629 - DNA, 18 bp, Homo sapiens
ttctgttctttctggcta

SEQ ID NO: 2202630 - DNA, 18 bp, Homo sapiens
ttctgtttagataataca

SEQ ID NO: 2202631 - DNA, 17 bp, Homo sapiens
ttcttagggaaggatac

SEQ ID NO: 2202632 - DNA, 23 bp, Homo sapiens
ttcttggtttgtaaattaacttt

SEQ ID NO: 2202633 - DNA, 19 bp, Homo sapiens
ttcttgtattaagaatgaa

SEQ ID NO: 2202634 - DNA, 22 bp, Homo sapiens
ttctttctggctatgcatttga

SEQ ID NO: 2202635 - DNA, 13 bp, Homo sapiens
ttgaactttgacc

SEQ ID NO: 2202636 - DNA, 13 bp, Homo sapiens
ttgaagcatttta

SEQ ID NO: 2202637 - DNA, 15 bp, Homo sapiens
ttgaagcattttata

SEQ ID NO: 2202638 - DNA, 19 bp, Homo sapiens
ttgaaggtagaatgttttc

SEQ ID NO: 2202639 - DNA, 14 bp, Homo sapiens
ttgacctctgcagc

SEQ ID NO: 2202640 - DNA, 19 bp, Homo sapiens
ttgagccttgaactttgac

SEQ ID NO: 2202641 - DNA, 19 bp, Homo sapiens
ttgataatcaactgggctg

SEQ ID NO: 2202642 - DNA, 15 bp, Homo sapiens
ttgatactacagttt

SEQ ID NO: 2202643 - DNA, 20 bp, Homo sapiens
ttgattaaattcttgcaaag

SEQ ID NO: 2202644 - DNA, 23 bp, Homo sapiens
ttgcacactctcccattatattt

SEQ ID NO: 2202645 - DNA, 20 bp, Homo sapiens
ttgctttgtgatttttgtaa

SEQ ID NO: 2202646 - DNA, 12 bp, Homo sapiens
ttggacatttta

SEQ ID NO: 2202647 - DNA, 18 bp, Homo sapiens
ttggacattttatgtctt

SEQ ID NO: 2202648 - DNA, 16 bp, Homo sapiens
ttggttgctttaatat

SEQ ID NO: 2202649 - DNA, 14 bp, Homo sapiens
ttggtttgtaaatt

SEQ ID NO: 2202650 - DNA, 13 bp, Homo sapiens
ttgtaactgtaaa

SEQ ID NO: 2202651 - DNA, 21 bp, Homo sapiens
ttgtattctctcctgtacctc

SEQ ID NO: 2202652 - DNA, 19 bp, Homo sapiens
ttgtgatacaatgctgtgc

SEQ ID NO: 2202653 - DNA, 17 bp, Homo sapiens
ttgtgcattatctagat

SEQ ID NO: 2202654 - DNA, 15 bp, Homo sapiens
ttgtgttactaagtt

SEQ ID NO: 2202655 - DNA, 20 bp, Homo sapiens
ttgtgttactaagtttttat

SEQ ID NO: 2202656 - DNA, 20 bp, Homo sapiens
ttgttcttggtttgtaaatt

SEQ ID NO: 2202657 - DNA, 12 bp, Homo sapiens
ttgtttaatggt

SEQ ID NO: 2202658 - DNA, 15 bp, Homo sapiens
ttgtttgagaaatta

SEQ ID NO: 2202659 - DNA, 21 bp, Homo sapiens
ttgtttgagaaattaagtatc

SEQ ID NO: 2202660 - DNA, 13 bp, Homo sapiens
tttaaaagataca

SEQ ID NO: 2202661 - DNA, 11 bp, Homo sapiens
tttaaatgcac

SEQ ID NO: 2202662 - DNA, 13 bp, Homo sapiens
tttaacaaaattt

SEQ ID NO: 2202663 - DNA, 14 bp, Homo sapiens
tttaacagaaatgt

SEQ ID NO: 2202664 - DNA, 18 bp, Homo sapiens
tttaagaaaaaggatgca

SEQ ID NO: 2202665 - DNA, 17 bp, Homo sapiens
tttaagaactaaaatgt

SEQ ID NO: 2202666 - DNA, 16 bp, Homo sapiens
tttaagtgctgcattt

SEQ ID NO: 2202667 - DNA, 22 bp, Homo sapiens
tttaatgttaattatgcagtgt

SEQ ID NO: 2202668 - DNA, 19 bp, Homo sapiens
tttaccttttttatacata

SEQ ID NO: 2202669 - DNA, 20 bp, Homo sapiens
tttaccttttttatacataa

SEQ ID NO: 2202670 - DNA, 17 bp, Homo sapiens
tttagatgaatgtcagt

SEQ ID NO: 2202671 - DNA, 22 bp, Homo sapiens
tttagatgaatgtcagttgtta

SEQ ID NO: 2202672 - DNA, 14 bp, Homo sapiens
tttataaactttac

SEQ ID NO: 2202673 - DNA, 18 bp, Homo sapiens
tttataaatcgcttttga

SEQ ID NO: 2202674 - DNA, 12 bp, Homo sapiens
tttatacataaa

SEQ ID NO: 2202675 - DNA, 16 bp, Homo sapiens
tttatgctttaaacat

SEQ ID NO: 2202676 - DNA, 24 bp, Homo sapiens
tttatggcttttgtgcattatcta

SEQ ID NO: 2202677 - DNA, 15 bp, Homo sapiens
tttatgtaattatat

SEQ ID NO: 2202678 - DNA, 13 bp, Homo sapiens
tttattatgcatg

SEQ ID NO: 2202679 - DNA, 13 bp, Homo sapiens
tttatttatttat

SEQ ID NO: 2202680 - DNA, 22 bp, Homo sapiens
tttcaaactttactatggccct

SEQ ID NO: 2202681 - DNA, 12 bp, Homo sapiens
tttcagaaatgt

SEQ ID NO: 2202682 - DNA, 13 bp, Homo sapiens
tttcatattttag

SEQ ID NO: 2202683 - DNA, 21 bp, Homo sapiens
tttcatattttagctactata

SEQ ID NO: 2202684 - DNA, 12 bp, Homo sapiens
tttccaaagtac

SEQ ID NO: 2202685 - DNA, 15 bp, Homo sapiens
tttccgttaaaatac

SEQ ID NO: 2202686 - DNA, 17 bp, Homo sapiens
tttccgttaaaatacca

SEQ ID NO: 2202687 - DNA, 20 bp, Homo sapiens
tttctaaaggctacctttgt

SEQ ID NO: 2202688 - DNA, 21 bp, Homo sapiens
tttctaaaggctacctttgta

SEQ ID NO: 2202689 - DNA, 21 bp, Homo sapiens
tttctatgacacatgcaaggt

SEQ ID NO: 2202690 - DNA, 22 bp, Homo sapiens
tttctcatgttgaagctttaag

SEQ ID NO: 2202691 - DNA, 16 bp, Homo sapiens
tttctggctatgcatt

SEQ ID NO: 2202692 - DNA, 20 bp, Homo sapiens
tttctgttctttctggctat

SEQ ID NO: 2202693 - DNA, 23 bp, Homo sapiens
tttcttagggaaggatacaaaag

SEQ ID NO: 2202694 - DNA, 15 bp, Homo sapiens
tttgaactgataaag

SEQ ID NO: 2202695 - DNA, 18 bp, Homo sapiens
tttgaagatttaattact

SEQ ID NO: 2202696 - DNA, 20 bp, Homo sapiens
tttgagcatcacttaggaga

SEQ ID NO: 2202697 - DNA, 13 bp, Homo sapiens
tttgattaaattc

SEQ ID NO: 2202698 - DNA, 18 bp, Homo sapiens
tttgattaaattcttgca

SEQ ID NO: 2202699 - DNA, 23 bp, Homo sapiens
tttgattaaattcttgcaaagta

SEQ ID NO: 2202700 - DNA, 19 bp, Homo sapiens
tttggttaagtctgtttta

SEQ ID NO: 2202701 - DNA, 20 bp, Homo sapiens
tttggttaagtctgttttat

SEQ ID NO: 2202702 - DNA, 15 bp, Homo sapiens
tttgtaaattaactt

SEQ ID NO: 2202703 - DNA, 16 bp, Homo sapiens
tttgtaaattaacttt

SEQ ID NO: 2202704 - DNA, 22 bp, Homo sapiens
tttgtaaattaacttttataaa

SEQ ID NO: 2202705 - DNA, 15 bp, Homo sapiens
tttgtgatacaatgc

SEQ ID NO: 2202706 - DNA, 15 bp, Homo sapiens
tttgttaatatttct

SEQ ID NO: 2202707 - DNA, 21 bp, Homo sapiens
tttgttttagaagattctatg

SEQ ID NO: 2202708 - DNA, 17 bp, Homo sapiens
ttttagagttgatacta

SEQ ID NO: 2202709 - DNA, 21 bp, Homo sapiens
ttttatacataaacaagacca

SEQ ID NO: 2202710 - DNA, 18 bp, Homo sapiens
ttttatgctttaaacatt

SEQ ID NO: 2202711 - DNA, 19 bp, Homo sapiens
ttttatggcttttgtgcat

SEQ ID NO: 2202712 - DNA, 21 bp, Homo sapiens
ttttatggcttttgtgcatta

SEQ ID NO: 2202713 - DNA, 13 bp, Homo sapiens
ttttatgtctttc

SEQ ID NO: 2202714 - DNA, 20 bp, Homo sapiens
ttttatgtctttcttgtaag

SEQ ID NO: 2202715 - DNA, 13 bp, Homo sapiens
ttttattatgcat

SEQ ID NO: 2202716 - DNA, 12 bp, Homo sapiens
ttttctgttata

SEQ ID NO: 2202717 - DNA, 13 bp, Homo sapiens
ttttctgttcttt

SEQ ID NO: 2202718 - DNA, 21 bp, Homo sapiens
ttttgaagattctatgttaat

SEQ ID NO: 2202719 - DNA, 17 bp, Homo sapiens
ttttgtgcattatctag

SEQ ID NO: 2202720 - DNA, 11 bp, Homo sapiens
tttttaaatgc

SEQ ID NO: 2202721 - DNA, 14 bp, Homo sapiens
tttttaaattaaat

SEQ ID NO: 2202722 - DNA, 23 bp, Homo sapiens
tttttaagaaaaaggatgcacag

SEQ ID NO: 2202723 - DNA, 16 bp, Homo sapiens
tttttaagtgctgcat

SEQ ID NO: 2202724 - DNA, 12 bp, Homo sapiens
tttttatggctt

SEQ ID NO: 2202725 - DNA, 17 bp, Homo sapiens
tttttatgtaattatat

SEQ ID NO: 2202726 - DNA, 21 bp, Homo sapiens
tttttccacataaggaaactg

SEQ ID NO: 2202727 - DNA, 14 bp, Homo sapiens
tttttctgttatat

SEQ ID NO: 2202728 - DNA, 11 bp, Homo sapiens
tttttttacta

SEQ ID NO: 2202729 - DNA, 12 bp, Homo sapiens
agaatgttttca

SEQ ID NO: 2202730 - DNA, 14 bp, Homo sapiens
agacaatttattat

SEQ ID NO: 2202731 - DNA, 21 bp, Homo sapiens
agacaatttattatggcacat

SEQ ID NO: 2202732 - DNA, 23 bp, Homo sapiens
agactgagtacgttgtgcatttg

SEQ ID NO: 2202733 - DNA, 16 bp, Homo sapiens
agaggttcaaagatat

SEQ ID NO: 2202734 - DNA, 20 bp, Homo sapiens
agagttgatactacagtttg

SEQ ID NO: 2202735 - DNA, 22 bp, Homo sapiens
agagttgatactacagtttgtt

SEQ ID NO: 2202736 - DNA, 12 bp, Homo sapiens
agagttgttaca

SEQ ID NO: 2202737 - DNA, 19 bp, Homo sapiens
agagttgttacatttttaa

SEQ ID NO: 2202738 - DNA, 20 bp, Homo sapiens
agagttgttacatttttaag

SEQ ID NO: 2202739 - DNA, 13 bp, Homo sapiens
agatacagttact

SEQ ID NO: 2202740 - DNA, 22 bp, Homo sapiens
agatacagttactcagaattct

SEQ ID NO: 2202741 - DNA, 15 bp, Homo sapiens
agatactgtatcatg

SEQ ID NO: 2202742 - DNA, 23 bp, Homo sapiens
agatattctctagtcatttgtta

SEQ ID NO: 2202743 - DNA, 18 bp, Homo sapiens
agatctctaacttcacca

SEQ ID NO: 2202744 - DNA, 11 bp, Homo sapiens
agatgaatgtc

SEQ ID NO: 2202745 - DNA, 22 bp, Homo sapiens
agatgaatgtcagttgttattt

SEQ ID NO: 2202746 - DNA, 14 bp, Homo sapiens
agatgagtgagcat

SEQ ID NO: 2202747 - DNA, 21 bp, Homo sapiens
agattctatgttaatatttta

SEQ ID NO: 2202748 - DNA, 14 bp, Homo sapiens
agcaaggagattta

SEQ ID NO: 2202749 - DNA, 14 bp, Homo sapiens
agcacacacttttg

SEQ ID NO: 2202750 - DNA, 20 bp, Homo sapiens
agcacacacttttggttaag

SEQ ID NO: 2202751 - DNA, 13 bp, Homo sapiens
agcacgatttctg

SEQ ID NO: 2202752 - DNA, 12 bp, Homo sapiens
agcagaaatgcc

SEQ ID NO: 2202753 - DNA, 23 bp, Homo sapiens
agcagagaggtttcgatatttat

SEQ ID NO: 2202754 - DNA, 17 bp, Homo sapiens
agcatacgtacacattt

SEQ ID NO: 2202755 - DNA, 15 bp, Homo sapiens
agcatcacagttttg

SEQ ID NO: 2202756 - DNA, 17 bp, Homo sapiens
agcatcacagttttggt

SEQ ID NO: 2202757 - DNA, 13 bp, Homo sapiens
agccactgtgata

SEQ ID NO: 2202758 - DNA, 21 bp, Homo sapiens
agccagtaaatgggggtgcat

SEQ ID NO: 2202759 - DNA, 18 bp, Homo sapiens
agccctgctgctgcctgc

SEQ ID NO: 2202760 - DNA, 15 bp, Homo sapiens
agccttgaactttga

SEQ ID NO: 2202761 - DNA, 19 bp, Homo sapiens
agctacaattgtaaactag

SEQ ID NO: 2202762 - DNA, 21 bp, Homo sapiens
agctcattctccttgtgttac

SEQ ID NO: 2202763 - DNA, 22 bp, Homo sapiens
agctgcagaggccacctggatt

SEQ ID NO: 2202764 - DNA, 23 bp, Homo sapiens
aggaacttaaataatgtgaaact

SEQ ID NO: 2202765 - DNA, 21 bp, Homo sapiens
aggagaagtcttctatttatt

SEQ ID NO: 2202766 - DNA, 16 bp, Homo sapiens
aggatgcttgtacata

SEQ ID NO: 2202767 - DNA, 21 bp, Homo sapiens
aggatgcttgtacataatgcg

SEQ ID NO: 2202768 - DNA, 14 bp, Homo sapiens
aggattttatgctt

SEQ ID NO: 2202769 - DNA, 16 bp, Homo sapiens
aggattttatgcttta

SEQ ID NO: 2202770 - DNA, 16 bp, Homo sapiens
aggcaggggaatgtat

SEQ ID NO: 2202771 - DNA, 23 bp, Homo sapiens
aggcatactgccttgtttaatgt

SEQ ID NO: 2202772 - DNA, 23 bp, Homo sapiens
aggctgatgccaagttgtttgag

SEQ ID NO: 2202773 - DNA, 21 bp, Homo sapiens
aggggcttaattattgatgtt

SEQ ID NO: 2202774 - DNA, 15 bp, Homo sapiens
aggtctgttctttcc

SEQ ID NO: 2202775 - DNA, 18 bp, Homo sapiens
aggtctgttctttccaaa

SEQ ID NO: 2202776 - DNA, 23 bp, Homo sapiens
aggtctgttctttccaaagtaca

SEQ ID NO: 2202777 - DNA, 18 bp, Homo sapiens
aggtgtgactgaatttct

SEQ ID NO: 2202778 - DNA, 18 bp, Homo sapiens
aggtttcgatatttattg

SEQ ID NO: 2202779 - DNA, 15 bp, Homo sapiens
aggtttgcagatatt

SEQ ID NO: 2202780 - DNA, 19 bp, Homo sapiens
agtaaatgggggtgcattt

SEQ ID NO: 2202781 - DNA, 20 bp, Homo sapiens
agtaaatgggggtgcatttg

SEQ ID NO: 2202782 - DNA, 21 bp, Homo sapiens
agtaaatgggggtgcatttga

SEQ ID NO: 2202783 - DNA, 15 bp, Homo sapiens
agtaatatgcacaca

SEQ ID NO: 2202784 - DNA, 19 bp, Homo sapiens
agtaatatgcacacatttt

SEQ ID NO: 2202785 - DNA, 21 bp, Homo sapiens
agtacactgtttcaaacttta

SEQ ID NO: 2202786 - DNA, 14 bp, Homo sapiens
agtacgttgtgcat

SEQ ID NO: 2202787 - DNA, 16 bp, Homo sapiens
agtatgaggcatttgt

SEQ ID NO: 2202788 - DNA, 23 bp, Homo sapiens
agtatgaggcatttgtttgaact

SEQ ID NO: 2202789 - DNA, 14 bp, Homo sapiens
agtattataccttt

SEQ ID NO: 2202790 - DNA, 14 bp, Homo sapiens
agtattgaagcatt

SEQ ID NO: 2202791 - DNA, 15 bp, Homo sapiens
agtattgaagcattt

SEQ ID NO: 2202792 - DNA, 18 bp, Homo sapiens
agtcattatgttaatatt

SEQ ID NO: 2202793 - DNA, 15 bp, Homo sapiens
agtcatttgttaata

SEQ ID NO: 2202794 - DNA, 14 bp, Homo sapiens
agtctgttttatga

SEQ ID NO: 2202795 - DNA, 21 bp, Homo sapiens
agtgaaactgcttgtttccta

SEQ ID NO: 2202796 - DNA, 14 bp, Homo sapiens
agtgaagacaatga

SEQ ID NO: 2202797 - DNA, 15 bp, Homo sapiens
agtgagatcaatgtg

SEQ ID NO: 2202798 - DNA, 20 bp, Homo sapiens
agtgctgcatttaaaagata

SEQ ID NO: 2202799 - DNA, 21 bp, Homo sapiens
agtggtggttttctgttcttt

SEQ ID NO: 2202800 - DNA, 23 bp, Homo sapiens
agtggtggttttctgttctttct

SEQ ID NO: 2202801 - DNA, 17 bp, Homo sapiens
agtgtatttttttacta

SEQ ID NO: 2202802 - DNA, 18 bp, Homo sapiens
agtgtatttttttactaa

SEQ ID NO: 2202803 - DNA, 20 bp, Homo sapiens
agtgttgtggatttaacaga

SEQ ID NO: 2202804 - DNA, 24 bp, Homo sapiens
agttcaatctggattcatatttaa

SEQ ID NO: 2202805 - DNA, 16 bp, Homo sapiens
agttgatactacagtt

SEQ ID NO: 2202806 - DNA, 13 bp, Homo sapiens
agttgttacattt

SEQ ID NO: 2202807 - DNA, 16 bp, Homo sapiens
agttgttacattttta

SEQ ID NO: 2202808 - DNA, 14 bp, Homo sapiens
agttgttatttatt

SEQ ID NO: 2202809 - DNA, 17 bp, Homo sapiens
agttgttatttattgaa

SEQ ID NO: 2202810 - DNA, 22 bp, Homo sapiens
agtttgattaaattcttgcaaa

SEQ ID NO: 2202811 - DNA, 18 bp, Homo sapiens
agttttgaagattctatg

SEQ ID NO: 2202812 - DNA, 15 bp, Homo sapiens
agttttggttgcttt

SEQ ID NO: 2202813 - DNA, 11 bp, Homo sapiens
ataaaactttt

SEQ ID NO: 2202814 - DNA, 17 bp, Homo sapiens
ataaaactttttaaaat

SEQ ID NO: 2202815 - DNA, 20 bp, Homo sapiens
ataaagcagcgtttctatga

SEQ ID NO: 2202816 - DNA, 16 bp, Homo sapiens
ataaatcgcttttgat

SEQ ID NO: 2202817 - DNA, 16 bp, Homo sapiens
ataaatggttaaaaga

SEQ ID NO: 2202818 - DNA, 12 bp, Homo sapiens
ataatacaccac

SEQ ID NO: 2202819 - DNA, 20 bp, Homo sapiens
ataatacaccactacattct

SEQ ID NO: 2202820 - DNA, 19 bp, Homo sapiens
ataatgtgaaactggatta

SEQ ID NO: 2202821 - DNA, 12 bp, Homo sapiens
atacaaaagcat

SEQ ID NO: 2202822 - DNA, 23 bp, Homo sapiens
atacaatgctgtgccctaaagtg

SEQ ID NO: 2202823 - DNA, 18 bp, Homo sapiens
ataccacttttgttcttg

SEQ ID NO: 2202824 - DNA, 19 bp, Homo sapiens
ataccagccagtaaatggg

SEQ ID NO: 2202825 - DNA, 15 bp, Homo sapiens
atacctacatgtatt

SEQ ID NO: 2202826 - DNA, 16 bp, Homo sapiens
atacgtacacatttta

SEQ ID NO: 2202827 - DNA, 13 bp, Homo sapiens
atactacagtttg

SEQ ID NO: 2202828 - DNA, 15 bp, Homo sapiens
atactacagtttgtt

SEQ ID NO: 2202829 - DNA, 16 bp, Homo sapiens
atactacagtttgtta

SEQ ID NO: 2202830 - DNA, 20 bp, Homo sapiens
atactgccttgtttaatgtt

SEQ ID NO: 2202831 - DNA, 16 bp, Homo sapiens
atagacaatttattat

SEQ ID NO: 2202832 - DNA, 15 bp, Homo sapiens
atagccctatttatc

SEQ ID NO: 2202833 - DNA, 16 bp, Homo sapiens
atagctaagatataat

SEQ ID NO: 2202834 - DNA, 17 bp, Homo sapiens
atataaatggttaaaag

SEQ ID NO: 2202835 - DNA, 12 bp, Homo sapiens
atatataaccag

SEQ ID NO: 2202836 - DNA, 23 bp, Homo sapiens
atatcccttggacattttatgtc

SEQ ID NO: 2202837 - DNA, 14 bp, Homo sapiens
atatgcacacattt

SEQ ID NO: 2202838 - DNA, 16 bp, Homo sapiens
atatgcacacattttt

SEQ ID NO: 2202839 - DNA, 19 bp, Homo sapiens
atattctctagtcatttgt

SEQ ID NO: 2202840 - DNA, 21 bp, Homo sapiens
atattgatttccgttaaaata

SEQ ID NO: 2202841 - DNA, 15 bp, Homo sapiens
atatttaatttgaag

SEQ ID NO: 2202842 - DNA, 17 bp, Homo sapiens
atatttattgatgtttt

SEQ ID NO: 2202843 - DNA, 13 bp, Homo sapiens
atattttatgtgt

SEQ ID NO: 2202844 - DNA, 19 bp, Homo sapiens
atatttttctcaatgttta

SEQ ID NO: 2202845 - DNA, 18 bp, Homo sapiens
atatttttttcttttctt

SEQ ID NO: 2202846 - DNA, 16 bp, Homo sapiens
atcagcacgatttctg

SEQ ID NO: 2202847 - DNA, 17 bp, Homo sapiens
atcagcacgatttctgt

SEQ ID NO: 2202848 - DNA, 16 bp, Homo sapiens
atcagctacaattgta

SEQ ID NO: 2202849 - DNA, 15 bp, Homo sapiens
atcagtattgaagca

SEQ ID NO: 2202850 - DNA, 15 bp, Homo sapiens
atcatcagtattgaa

SEQ ID NO: 2202851 - DNA, 19 bp, Homo sapiens
atcccttggacattttatg

SEQ ID NO: 2202852 - DNA, 18 bp, Homo sapiens
atcctgattcatatttaa

SEQ ID NO: 2202853 - DNA, 18 bp, Homo sapiens
atcgtcactgcttaactt

SEQ ID NO: 2202854 - DNA, 13 bp, Homo sapiens
atctaaatggaac

SEQ ID NO: 2202855 - DNA, 19 bp, Homo sapiens
atctagatactgtatcatg

SEQ ID NO: 2202856 - DNA, 21 bp, Homo sapiens
atctctgcaatcttctcagaa

SEQ ID NO: 2202857 - DNA, 14 bp, Homo sapiens
atgacacatgcaag

SEQ ID NO: 2202858 - DNA, 22 bp, Homo sapiens
atgacacatgcaaggtcatttt

SEQ ID NO: 2202859 - DNA, 17 bp, Homo sapiens
atgacatatcacatgtc

SEQ ID NO: 2202860 - DNA, 14 bp, Homo sapiens
atgacttactgtac

SEQ ID NO: 2202861 - DNA, 11 bp, Homo sapiens
atgactttgga

SEQ ID NO: 2202862 - DNA, 22 bp, Homo sapiens
atgaggcatttgtttgaactga

SEQ ID NO: 2202863 - DNA, 16 bp, Homo sapiens
atgattgaatctactt

SEQ ID NO: 2202864 - DNA, 15 bp, Homo sapiens
atgatttcacagtgt

SEQ ID NO: 2202865 - DNA, 14 bp, Homo sapiens
atgcacacattttt

SEQ ID NO: 2202866 - DNA, 23 bp, Homo sapiens
gcatttggtggtttcagaaatgt

SEQ ID NO: 2202867 - DNA, 18 bp, Homo sapiens
gcatttgtttgaactgat

SEQ ID NO: 2202868 - DNA, 12 bp, Homo sapiens
gccagtaaatgg

SEQ ID NO: 2202869 - DNA, 23 bp, Homo sapiens
gcctagcatacgtacacatttta

SEQ ID NO: 2202870 - DNA, 14 bp, Homo sapiens
gccttgaactttga

SEQ ID NO: 2202871 - DNA, 15 bp, Homo sapiens
gccttgtttaatgtt

SEQ ID NO: 2202872 - DNA, 17 bp, Homo sapiens
gctaagatataatttaa

SEQ ID NO: 2202873 - DNA, 20 bp, Homo sapiens
gctacctttgtattctctcc

SEQ ID NO: 2202874 - DNA, 21 bp, Homo sapiens
gctagaggttcaaagatattt

SEQ ID NO: 2202875 - DNA, 12 bp, Homo sapiens
gctatccaccaa

SEQ ID NO: 2202876 - DNA, 12 bp, Homo sapiens
gctatgcatttg

SEQ ID NO: 2202877 - DNA, 17 bp, Homo sapiens
gctctccaaaccacttt

SEQ ID NO: 2202878 - DNA, 16 bp, Homo sapiens
gcttaacttcacatat

SEQ ID NO: 2202879 - DNA, 21 bp, Homo sapiens
gcttaggagaagtcttctatt

SEQ ID NO: 2202880 - DNA, 14 bp, Homo sapiens
gcttgtacataatg

SEQ ID NO: 2202881 - DNA, 16 bp, Homo sapiens
gcttgtacataatgcg

SEQ ID NO: 2202882 - DNA, 22 bp, Homo sapiens
gctttaagaactaaaatgttct

SEQ ID NO: 2202883 - DNA, 22 bp, Homo sapiens
gctttaatatcatcagtattga

SEQ ID NO: 2202884 - DNA, 12 bp, Homo sapiens
gcttttgtgcat

SEQ ID NO: 2202885 - DNA, 18 bp, Homo sapiens
ggaaaacatgctacacac

SEQ ID NO: 2202886 - DNA, 18 bp, Homo sapiens
ggatacaaaagcatgtga

SEQ ID NO: 2202887 - DNA, 23 bp, Homo sapiens
ggatgcacagagttgttacattt

SEQ ID NO: 2202888 - DNA, 23 bp, Homo sapiens
ggattaaacttaatctaaatgga

SEQ ID NO: 2202889 - DNA, 12 bp, Homo sapiens
ggatttaacaga

SEQ ID NO: 2202890 - DNA, 20 bp, Homo sapiens
ggcagtggtggttttctgtt

SEQ ID NO: 2202891 - DNA, 21 bp, Homo sapiens
ggccagtgagatcaatgtgac

SEQ ID NO: 2202892 - DNA, 23 bp, Homo sapiens
ggcctagcatacgtacacatttt

SEQ ID NO: 2202893 - DNA, 14 bp, Homo sapiens
ggctacctttgtat

SEQ ID NO: 2202894 - DNA, 16 bp, Homo sapiens
ggctagaggttcaaag

SEQ ID NO: 2202895 - DNA, 12 bp, Homo sapiens
ggctatgcattt

SEQ ID NO: 2202896 - DNA, 15 bp, Homo sapiens
ggctatgcatttgaa

SEQ ID NO: 2202897 - DNA, 21 bp, Homo sapiens
ggcttaattattgatgttttc

SEQ ID NO: 2202898 - DNA, 13 bp, Homo sapiens
gggaaggatacaa

SEQ ID NO: 2202899 - DNA, 21 bp, Homo sapiens
ggtcaaacccaagttagttca

SEQ ID NO: 2202900 - DNA, 22 bp, Homo sapiens
ggtcaacatttctcatgttgaa

SEQ ID NO: 2202901 - DNA, 13 bp, Homo sapiens
ggtcggaaaacat

SEQ ID NO: 2202902 - DNA, 14 bp, Homo sapiens
ggtcggaaaacatg

SEQ ID NO: 2202903 - DNA, 19 bp, Homo sapiens
ggtctgttctttccaaagt

SEQ ID NO: 2202904 - DNA, 21 bp, Homo sapiens
ggtgcatttgaggtctgttct

SEQ ID NO: 2202905 - DNA, 17 bp, Homo sapiens
ggtggtttcagaaatgt

SEQ ID NO: 2202906 - DNA, 18 bp, Homo sapiens
ggtggttttctgttcttt

SEQ ID NO: 2202907 - DNA, 16 bp, Homo sapiens
ggtgtgactgaatttc

SEQ ID NO: 2202908 - DNA, 13 bp, Homo sapiens
ggttcaaagatat

SEQ ID NO: 2202909 - DNA, 22 bp, Homo sapiens
ggttcttgtattaagaatgaaa

SEQ ID NO: 2202910 - DNA, 12 bp, Homo sapiens
ggttttctgttc

SEQ ID NO: 2202911 - DNA, 17 bp, Homo sapiens
gtaaaataaggttatga

SEQ ID NO: 2202912 - DNA, 18 bp, Homo sapiens
gtaaatgggggtgcattt

SEQ ID NO: 2202913 - DNA, 19 bp, Homo sapiens
gtaaatgggggtgcatttg

SEQ ID NO: 2202914 - DNA, 20 bp, Homo sapiens
gtaaatgggggtgcatttga

SEQ ID NO: 2202915 - DNA, 20 bp, Homo sapiens
gtacagcaaggagatttaca

SEQ ID NO: 2202916 - DNA, 16 bp, Homo sapiens
gtacatgaaaacacat

SEQ ID NO: 2202917 - DNA, 22 bp, Homo sapiens
gtacctcttgagccttgaactt

SEQ ID NO: 2202918 - DNA, 20 bp, Homo sapiens
gtatgaggcatttgtttgaa

SEQ ID NO: 2202919 - DNA, 16 bp, Homo sapiens
gtattaagaatgaaat

SEQ ID NO: 2202920 - DNA, 22 bp, Homo sapiens
gtattgaagcattttataaatc

SEQ ID NO: 2202921 - DNA, 15 bp, Homo sapiens
gtatttttttactaa

SEQ ID NO: 2202922 - DNA, 17 bp, Homo sapiens
gtcaacatttctcatgt

SEQ ID NO: 2202923 - DNA, 19 bp, Homo sapiens
gtcaacatttctcatgttg

SEQ ID NO: 2202924 - DNA, 15 bp, Homo sapiens
gtcactgcttaactt

SEQ ID NO: 2202925 - DNA, 21 bp, Homo sapiens
gtcactgcttaacttcacata

SEQ ID NO: 2202926 - DNA, 14 bp, Homo sapiens
gtcagttgttattt

SEQ ID NO: 2202927 - DNA, 19 bp, Homo sapiens
gtcagttgttatttattga

SEQ ID NO: 2202928 - DNA, 21 bp, Homo sapiens
gtcattttttttaagaaaaag

SEQ ID NO: 2202929 - DNA, 21 bp, Homo sapiens
gtcggaaaacatgctacacac

SEQ ID NO: 2202930 - DNA, 15 bp, Homo sapiens
gtctctgaagtgaaa

SEQ ID NO: 2202931 - DNA, 17 bp, Homo sapiens
gtctgttctttccaaag

SEQ ID NO: 2202932 - DNA, 13 bp, Homo sapiens
gtctgttttatga

SEQ ID NO: 2202933 - DNA, 12 bp, Homo sapiens
gtcttctattta

SEQ ID NO: 2202934 - DNA, 14 bp, Homo sapiens
gtcttctatttatt

SEQ ID NO: 2202935 - DNA, 18 bp, Homo sapiens
gtgactgaatttcttttg

SEQ ID NO: 2202936 - DNA, 13 bp, Homo sapiens
gtgatttttgtaa

SEQ ID NO: 2202937 - DNA, 19 bp, Homo sapiens
gtgcatttgaggtctgttc

SEQ ID NO: 2202938 - DNA, 21 bp, Homo sapiens
gtgcatttgaggtctgttctt

SEQ ID NO: 2202939 - DNA, 22 bp, Homo sapiens
gtgcatttgaggtctgttcttt

SEQ ID NO: 2202940 - DNA, 12 bp, Homo sapiens
gtgctgcattta

SEQ ID NO: 2202941 - DNA, 20 bp, Homo sapiens
gtggatttaacagaaatgta

SEQ ID NO: 2202942 - DNA, 17 bp, Homo sapiens
gtggttttctgttcttt

SEQ ID NO: 2202943 - DNA, 23 bp, Homo sapiens
gtgtgtggtcaacatttctcatg

SEQ ID NO: 2202944 - DNA, 12 bp, Homo sapiens
gtgttactaagt

SEQ ID NO: 2202945 - DNA, 15 bp, Homo sapiens
gttaagtctgtttta

SEQ ID NO: 2202946 - DNA, 22 bp, Homo sapiens
gttaagtctgttttatgacttc

SEQ ID NO: 2202947 - DNA, 18 bp, Homo sapiens
gttaatattttatgtgta

SEQ ID NO: 2202948 - DNA, 18 bp, Homo sapiens
gttaatcattaggtgtga

SEQ ID NO: 2202949 - DNA, 24 bp, Homo sapiens
gttagttcaatcctgattcatatt

SEQ ID NO: 2202950 - DNA, 24 bp, Homo sapiens
gttagttcaatctggattcatatt

SEQ ID NO: 2202951 - DNA, 19 bp, Homo sapiens
gttattaaaaatctcaaat

SEQ ID NO: 2202952 - DNA, 14 bp, Homo sapiens
gttatttataatca

SEQ ID NO: 2202953 - DNA, 20 bp, Homo sapiens
gttatttataatcacttttt

SEQ ID NO: 2202954 - DNA, 23 bp, Homo sapiens
gttcaatctggattcatatttaa

SEQ ID NO: 2202955 - DNA, 20 bp, Homo sapiens
gttccatggcctcttcagat

SEQ ID NO: 2202956 - DNA, 14 bp, Homo sapiens
gttcttaattctta

SEQ ID NO: 2202957 - DNA, 13 bp, Homo sapiens
gttctttccaaag

SEQ ID NO: 2202958 - DNA, 14 bp, Homo sapiens
gttctttccaaagt

SEQ ID NO: 2202959 - DNA, 18 bp, Homo sapiens
gttctttccaaagtacac

SEQ ID NO: 2202960 - DNA, 24 bp, Homo sapiens
gttgttatttattgaaatgatttc

SEQ ID NO: 2202961 - DNA, 17 bp, Homo sapiens
gtttaatggtagtttta

SEQ ID NO: 2202962 - DNA, 21 bp, Homo sapiens
gtttaatgttaattatgcagt

SEQ ID NO: 2202963 - DNA, 24 bp, Homo sapiens
gtttaatgttaattatgcagtgtt

SEQ ID NO: 2202964 - DNA, 17 bp, Homo sapiens
gtttagatgaatgtcag

SEQ ID NO: 2202965 - DNA, 18 bp, Homo sapiens
gtttagatgaatgtcagt

SEQ ID NO: 2202966 - DNA, 16 bp, Homo sapiens
gtttagcagatttaag

SEQ ID NO: 2202967 - DNA, 16 bp, Homo sapiens
gtttcaaactttacta

SEQ ID NO: 2202968 - DNA, 17 bp, Homo sapiens
gtttcaaactttactat

SEQ ID NO: 2202969 - DNA, 21 bp, Homo sapiens
gtttcacagcacttacaattt

SEQ ID NO: 2202970 - DNA, 18 bp, Homo sapiens
gtttcagaaatgtgttat

SEQ ID NO: 2202971 - DNA, 16 bp, Homo sapiens
gtttccctctgtgtta

SEQ ID NO: 2202972 - DNA, 17 bp, Homo sapiens
gtttcgatatttattga

SEQ ID NO: 2202973 - DNA, 19 bp, Homo sapiens
gtttctaaaggctaccttt

SEQ ID NO: 2202974 - DNA, 16 bp, Homo sapiens
gtttgaggtttttaag

SEQ ID NO: 2202975 - DNA, 19 bp, Homo sapiens
gtttgattaaattcttgca

SEQ ID NO: 2202976 - DNA, 22 bp, Homo sapiens
gtttgattaaattcttgcaaag

SEQ ID NO: 2202977 - DNA, 23 bp, Homo sapiens
gtttgattaaattcttgcaaagt

SEQ ID NO: 2202978 - DNA, 18 bp, Homo sapiens
gttttaaggatgcttgta

SEQ ID NO: 2202979 - DNA, 22 bp, Homo sapiens
gttttaaggatgcttgtacata

SEQ ID NO: 2202980 - DNA, 17 bp, Homo sapiens
gttttagaagattctat

SEQ ID NO: 2202981 - DNA, 21 bp, Homo sapiens
gttttagaagattctatgtta

SEQ ID NO: 2202982 - DNA, 18 bp, Homo sapiens
gttttatgacttcattaa

SEQ ID NO: 2202983 - DNA, 15 bp, Homo sapiens
gttttctgttctttc

SEQ ID NO: 2202984 - DNA, 16 bp, Homo sapiens
gttttgaagattctat

SEQ ID NO: 2202985 - DNA, 15 bp, Homo sapiens
taaaaatctcaaatt

SEQ ID NO: 2202986 - DNA, 17 bp, Homo sapiens
taaaaatctcaaatttc

SEQ ID NO: 2202987 - DNA, 18 bp, Homo sapiens
taaaagaggtttttctta

SEQ ID NO: 2202988 - DNA, 21 bp, Homo sapiens
taaaagaggtttttcttaaat

SEQ ID NO: 2202989 - DNA, 22 bp, Homo sapiens
taaaatttttatgtaattatat

SEQ ID NO: 2202990 - DNA, 19 bp, Homo sapiens
taaacaagaccacgtttct

SEQ ID NO: 2202991 - DNA, 22 bp, Homo sapiens
taaacaagaccacgtttctaaa

SEQ ID NO: 2202992 - DNA, 14 bp, Homo sapiens
taaacatgtatgta

SEQ ID NO: 2202993 - DNA, 13 bp, Homo sapiens
taaacttaatcta

SEQ ID NO: 2202994 - DNA, 16 bp, Homo sapiens
taaactttaccttttt

SEQ ID NO: 2202995 - DNA, 22 bp, Homo sapiens
taaactttaccttttttataca

SEQ ID NO: 2202996 - DNA, 12 bp, Homo sapiens
taaactttcaca

SEQ ID NO: 2202997 - DNA, 14 bp, Homo sapiens
taaagatgaatgtc

SEQ ID NO: 2202998 - DNA, 19 bp, Homo sapiens
taaaggctacctttgtatt

SEQ ID NO: 2202999 - DNA, 21 bp, Homo sapiens
taaagtgtatttttttactaa

SEQ ID NO: 2203000 - DNA, 22 bp, Homo sapiens
taaagtgtatttttttactaat

SEQ ID NO: 2203001 - DNA, 20 bp, Homo sapiens
taaatatcccttggacattt

SEQ ID NO: 2203002 - DNA, 21 bp, Homo sapiens
cttgtacataatgcgtgcata

SEQ ID NO: 2203003 - DNA, 19 bp, Homo sapiens
cttgtactctacaaaatat

SEQ ID NO: 2203004 - DNA, 15 bp, Homo sapiens
cttgtttaatgttaa

SEQ ID NO: 2203005 - DNA, 16 bp, Homo sapiens
cttgtttaatgttaat

SEQ ID NO: 2203006 - DNA, 21 bp, Homo sapiens
ctttaatatcatcagtattga

SEQ ID NO: 2203007 - DNA, 20 bp, Homo sapiens
ctttaccttttttatacata

SEQ ID NO: 2203008 - DNA, 22 bp, Homo sapiens
ctttaccttttttatacataaa

SEQ ID NO: 2203009 - DNA, 16 bp, Homo sapiens
ctttccaaagtacact

SEQ ID NO: 2203010 - DNA, 20 bp, Homo sapiens
ctttgacctctgcagcaata

SEQ ID NO: 2203011 - DNA, 24 bp, Homo sapiens
ctttgacctctgcagcaataaagc

SEQ ID NO: 2203012 - DNA, 19 bp, Homo sapiens
ctttgtgatttttgtaatt

SEQ ID NO: 2203013 - DNA, 13 bp, Homo sapiens
cttttataaactt

SEQ ID NO: 2203014 - DNA, 18 bp, Homo sapiens
cttttataaactttacct

SEQ ID NO: 2203015 - DNA, 21 bp, Homo sapiens
cttttataaactttacctttt

SEQ ID NO: 2203016 - DNA, 16 bp, Homo sapiens
cttttggttaagtctg

SEQ ID NO: 2203017 - DNA, 20 bp, Homo sapiens
cttttggttaagtctgtttt

SEQ ID NO: 2203018 - DNA, 14 bp, Homo sapiens
cttttgtgcattat

SEQ ID NO: 2203019 - DNA, 22 bp, Homo sapiens
cttttgttcttggtttgtaaat

SEQ ID NO: 2203020 - DNA, 12 bp, Homo sapiens
ctttttgcagct

SEQ ID NO: 2203021 - DNA, 16 bp, Homo sapiens
cttttttatacataaa

SEQ ID NO: 2203022 - DNA, 23 bp, Homo sapiens
gaaaaaggatgcacagagttgtt

SEQ ID NO: 2203023 - DNA, 19 bp, Homo sapiens
gaaaacacatttttcttag

SEQ ID NO: 2203024 - DNA, 14 bp, Homo sapiens
gaaaacatgctaca

SEQ ID NO: 2203025 - DNA, 23 bp, Homo sapiens
gaacaggaaaataaaatatttaa

SEQ ID NO: 2203026 - DNA, 20 bp, Homo sapiens
ggccagtgagatcaatgtga

SEQ ID NO: 2203027 - DNA, 22 bp, Homo sapiens
ggcctagcatacgtacacattt

SEQ ID NO: 2203028 - DNA, 17 bp, Homo sapiens
ggctagaggttcaaaga

SEQ ID NO: 2203029 - DNA, 14 bp, Homo sapiens
ggctatgcatttga

SEQ ID NO: 2203030 - DNA, 17 bp, Homo sapiens
gggtgaagtgaagacaa

SEQ ID NO: 2203031 - DNA, 18 bp, Homo sapiens
ggtgaagtgaagacaatg

SEQ ID NO: 2203032 - DNA, 13 bp, Homo sapiens
ggttatgattgaa

SEQ ID NO: 2203033 - DNA, 21 bp, Homo sapiens
ggttcaaagatattttgcttt

SEQ ID NO: 2203034 - DNA, 18 bp, Homo sapiens
ggttctggtgtgaactaa

SEQ ID NO: 2203035 - DNA, 14 bp, Homo sapiens
ggtttcagaaatgt

SEQ ID NO: 2203036 - DNA, 15 bp, Homo sapiens
ggtttcgatatttat

SEQ ID NO: 2203037 - DNA, 20 bp, Homo sapiens
ggtttgtaaattaactttta

SEQ ID NO: 2203038 - DNA, 15 bp, Homo sapiens
gtaaattaactttta

SEQ ID NO: 2203039 - DNA, 23 bp, Homo sapiens
gtaaattaacttttataaacttt

SEQ ID NO: 2203040 - DNA, 13 bp, Homo sapiens
gtaacaacaatta

SEQ ID NO: 2203041 - DNA, 22 bp, Homo sapiens
gtaactgtttagatgaatgtca

SEQ ID NO: 2203042 - DNA, 17 bp, Homo sapiens
gtaatttgtgatacaat

SEQ ID NO: 2203043 - DNA, 20 bp, Homo sapiens
gtaatttgtgatacaatgct

SEQ ID NO: 2203044 - DNA, 22 bp, Homo sapiens
gtaatttgtgatacaatgctgt

SEQ ID NO: 2203045 - DNA, 19 bp, Homo sapiens
gtacactgtttcaaacttt

SEQ ID NO: 2203046 - DNA, 15 bp, Homo sapiens
gtacatgaaaacaca

SEQ ID NO: 2203047 - DNA, 20 bp, Homo sapiens
gtacatgaaaacacattttt

SEQ ID NO: 2203048 - DNA, 13 bp, Homo sapiens
gtacctcttgagc

SEQ ID NO: 2203049 - DNA, 14 bp, Homo sapiens
gtacgttgtgcatt

SEQ ID NO: 2203050 - DNA, 16 bp, Homo sapiens
gtacgttgtgcatttg

SEQ ID NO: 2203051 - DNA, 14 bp, Homo sapiens
gtagaatgttttca

SEQ ID NO: 2203052 - DNA, 15 bp, Homo sapiens
gtatccctactgtaa

SEQ ID NO: 2203053 - DNA, 15 bp, Homo sapiens
gtatgaggcatttgt

SEQ ID NO: 2203054 - DNA, 18 bp, Homo sapiens
gtattctctcctgtacct

SEQ ID NO: 2203055 - DNA, 10 bp, Homo sapiens
gtattgaagc

SEQ ID NO: 2203056 - DNA, 17 bp, Homo sapiens
gtattgaagcattttat

SEQ ID NO: 2203057 - DNA, 18 bp, Homo sapiens
gtattgaagcattttata

SEQ ID NO: 2203058 - DNA, 22 bp, Homo sapiens
gtattggctagaggttcaaaga

SEQ ID NO: 2203059 - DNA, 12 bp, Homo sapiens
gtatttgtttgc

SEQ ID NO: 2203060 - DNA, 14 bp, Homo sapiens
gtatttttttacta

SEQ ID NO: 2203061 - DNA, 16 bp, Homo sapiens
taccttttttatacat

SEQ ID NO: 2203062 - DNA, 20 bp, Homo sapiens
taccttttttatacataaac

SEQ ID NO: 2203063 - DNA, 22 bp, Homo sapiens
taccttttttatacataaacaa

SEQ ID NO: 2203064 - DNA, 14 bp, Homo sapiens
tacgtacacatttt

SEQ ID NO: 2203065 - DNA, 14 bp, Homo sapiens
tactaaacatgtat

SEQ ID NO: 2203066 - DNA, 18 bp, Homo sapiens
tactaaccagcagaaatg

SEQ ID NO: 2203067 - DNA, 17 bp, Homo sapiens
tactaatagacaattta

SEQ ID NO: 2203068 - DNA, 21 bp, Homo sapiens
tactaatagacaatttattat

SEQ ID NO: 2203069 - DNA, 23 bp, Homo sapiens
tactatggccctggcctagcata

SEQ ID NO: 2203070 - DNA, 22 bp, Homo sapiens
tactcagaattctctagtttga

SEQ ID NO: 2203071 - DNA, 21 bp, Homo sapiens
tactgccttgtttaatgttaa

SEQ ID NO: 2203072 - DNA, 16 bp, Homo sapiens
tactgtaatttgtgat

SEQ ID NO: 2203073 - DNA, 23 bp, Homo sapiens
tactgtaatttgtgatacaatgc

SEQ ID NO: 2203074 - DNA, 19 bp, Homo sapiens
tagaagattctatgttaat

SEQ ID NO: 2203075 - DNA, 15 bp, Homo sapiens
tagaatatatttcct

SEQ ID NO: 2203076 - DNA, 16 bp, Homo sapiens
tagacaatttattatg

SEQ ID NO: 2203077 - DNA, 18 bp, Homo sapiens
tagacaatttattatggc

SEQ ID NO: 2203078 - DNA, 17 bp, Homo sapiens
tagagttgatactacag

SEQ ID NO: 2203079 - DNA, 15 bp, Homo sapiens
tagcagatttaagat

SEQ ID NO: 2203080 - DNA, 16 bp, Homo sapiens
tagcatacgtacacat

SEQ ID NO: 2203081 - DNA, 22 bp, Homo sapiens
tagctcattctccttgtgttac

SEQ ID NO: 2203082 - DNA, 21 bp, Homo sapiens
tagggaaggatacaaaagcat

SEQ ID NO: 2203083 - DNA, 17 bp, Homo sapiens
tagtatgaggcatttgt

SEQ ID NO: 2203084 - DNA, 15 bp, Homo sapiens
tagtcatttgttaat

SEQ ID NO: 2203085 - DNA, 23 bp, Homo sapiens
tagtcatttgttaatatttcttc

SEQ ID NO: 2203086 - DNA, 21 bp, Homo sapiens
tagtttgattaaattcttgca

SEQ ID NO: 2203087 - DNA, 23 bp, Homo sapiens
tagtttgattaaattcttgcaaa

SEQ ID NO: 2203088 - DNA, 11 bp, Homo sapiens
tataaacttta

SEQ ID NO: 2203089 - DNA, 20 bp, Homo sapiens
tataaccagtgttgtggatt

SEQ ID NO: 2203090 - DNA, 20 bp, Homo sapiens
tataatttaaacgtgatttt

SEQ ID NO: 2203091 - DNA, 13 bp, Homo sapiens
tatacataaacaa

SEQ ID NO: 2203092 - DNA, 14 bp, Homo sapiens
tatacataaacaag

SEQ ID NO: 2203093 - DNA, 16 bp, Homo sapiens
tatatgtgatgatcta

SEQ ID NO: 2203094 - DNA, 19 bp, Homo sapiens
tatattcattctttttgaa

SEQ ID NO: 2203095 - DNA, 22 bp, Homo sapiens
tatcacatgtcagccactgtga

SEQ ID NO: 2203096 - DNA, 22 bp, Homo sapiens
tatcacccagaagaaaatagtg

SEQ ID NO: 2203097 - DNA, 15 bp, Homo sapiens
tatcatcagtattga

SEQ ID NO: 2203098 - DNA, 18 bp, Homo sapiens
tatctgacatctctgcaa

SEQ ID NO: 2203099 - DNA, 23 bp, Homo sapiens
tatgaggcatttgtttgaactga

SEQ ID NO: 2203100 - DNA, 14 bp, Homo sapiens
tatgcacacatttt

SEQ ID NO: 2203101 - DNA, 13 bp, Homo sapiens
tatgcagtgtttc

SEQ ID NO: 2203102 - DNA, 23 bp, Homo sapiens
tatgcagtgtttccctctgtgtt

SEQ ID NO: 2203103 - DNA, 13 bp, Homo sapiens
tatgcatgaagta

SEQ ID NO: 2203104 - DNA, 19 bp, Homo sapiens
tatgtaacaacaattattt

SEQ ID NO: 2203105 - DNA, 20 bp, Homo sapiens
tattaaaaatctcaaatttc

SEQ ID NO: 2203106 - DNA, 16 bp, Homo sapiens
tattaccacagacata

SEQ ID NO: 2203107 - DNA, 13 bp, Homo sapiens
tattatacctttt

SEQ ID NO: 2203108 - DNA, 23 bp, Homo sapiens
tattcattctttttgaaatgtca

SEQ ID NO: 2203109 - DNA, 20 bp, Homo sapiens
tattctctcctgtacctctt

SEQ ID NO: 2203110 - DNA, 16 bp, Homo sapiens
tatttaacaaaatttg

SEQ ID NO: 2203111 - DNA, 16 bp, Homo sapiens
tatttattgaaatgat

SEQ ID NO: 2203112 - DNA, 18 bp, Homo sapiens
tatttattgtttatttta

SEQ ID NO: 2203113 - DNA, 12 bp, Homo sapiens
tatttatttatt

SEQ ID NO: 2203114 - DNA, 11 bp, Homo sapiens
tatttatttgt

SEQ ID NO: 2203115 - DNA, 16 bp, Homo sapiens
tatttatttgtttgtt

SEQ ID NO: 2203116 - DNA, 22 bp, Homo sapiens
tattttaggtgtaaaataatta

SEQ ID NO: 2203117 - DNA, 13 bp, Homo sapiens
tcaaactttacta

SEQ ID NO: 2203118 - DNA, 15 bp, Homo sapiens
tcaaatttctaaatc

SEQ ID NO: 2203119 - DNA, 16 bp, Homo sapiens
tcaaatttctaaatct

SEQ ID NO: 2203120 - DNA, 17 bp, Homo sapiens
tcaaatttctaaatctc

SEQ ID NO: 2203121 - DNA, 15 bp, Homo sapiens
tcaacatttctcatg

SEQ ID NO: 2203122 - DNA, 11 bp, Homo sapiens
tcaagtattat

SEQ ID NO: 2203123 - DNA, 21 bp, Homo sapiens
tcaagtattatacctttttta

SEQ ID NO: 2203124 - DNA, 16 bp, Homo sapiens
tcacagtgtgtggtca

SEQ ID NO: 2203125 - DNA, 16 bp, Homo sapiens
tcacatattgatttcc

SEQ ID NO: 2203126 - DNA, 15 bp, Homo sapiens
tcactgcttaacttc

SEQ ID NO: 2203127 - DNA, 16 bp, Homo sapiens
tcacttttttccacat

SEQ ID NO: 2203128 - DNA, 18 bp, Homo sapiens
tcagaaggcaaatgactt

SEQ ID NO: 2203129 - DNA, 22 bp, Homo sapiens
tcagaaggcaaatgactttgga

SEQ ID NO: 2203130 - DNA, 16 bp, Homo sapiens
tcagaattctctagtt

SEQ ID NO: 2203131 - DNA, 15 bp, Homo sapiens
tcagatctctaactt

SEQ ID NO: 2203132 - DNA, 18 bp, Homo sapiens
tcagcacgatttctgttt

SEQ ID NO: 2203133 - DNA, 19 bp, Homo sapiens
tcagcacgatttctgttta

SEQ ID NO: 2203134 - DNA, 17 bp, Homo sapiens
tcagctacaattgtaaa

SEQ ID NO: 2203135 - DNA, 19 bp, Homo sapiens
tcagctacaattgtaaact

SEQ ID NO: 2203136 - DNA, 15 bp, Homo sapiens
tcagtattgaagcat

SEQ ID NO: 2203137 - DNA, 22 bp, Homo sapiens
tcagtattgaagcattttataa

SEQ ID NO: 2203138 - DNA, 23 bp, Homo sapiens
tcagtattgaagcattttataaa

SEQ ID NO: 2203139 - DNA, 20 bp, Homo sapiens
tcagttgttatttattgaaa

SEQ ID NO: 2203140 - DNA, 16 bp, Homo sapiens
tcatacctacatgtat

SEQ ID NO: 2203141 - DNA, 11 bp, Homo sapiens
tcatgttctta

SEQ ID NO: 2203142 - DNA, 22 bp, Homo sapiens
tcattaggtgtgactgaatttc

SEQ ID NO: 2203143 - DNA, 16 bp, Homo sapiens
tcattatgttaatatt

SEQ ID NO: 2203144 - DNA, 17 bp, Homo sapiens
tcattatgttaatattt

SEQ ID NO: 2203145 - DNA, 23 bp, Homo sapiens
tcatttgttaatatttcttcgtg

SEQ ID NO: 2203146 - DNA, 18 bp, Homo sapiens
tcattttttttaagaaaa

SEQ ID NO: 2203147 - DNA, 21 bp, Homo sapiens
tggcttttgtgcattatctag

SEQ ID NO: 2203148 - DNA, 15 bp, Homo sapiens
tgggggtgcatttga

SEQ ID NO: 2203149 - DNA, 14 bp, Homo sapiens
tggtcaacatttct

SEQ ID NO: 2203150 - DNA, 17 bp, Homo sapiens
tggtggtttcagaaatg

SEQ ID NO: 2203151 - DNA, 14 bp, Homo sapiens
tggttcttgtatta

SEQ ID NO: 2203152 - DNA, 15 bp, Homo sapiens
tggtttcagaaatgt

SEQ ID NO: 2203153 - DNA, 16 bp, Homo sapiens
tgtaaagatgaatgtc

SEQ ID NO: 2203154 - DNA, 19 bp, Homo sapiens
tgtaaagatgaatgtcagt

SEQ ID NO: 2203155 - DNA, 16 bp, Homo sapiens
tgtaaattaactttta

SEQ ID NO: 2203156 - DNA, 21 bp, Homo sapiens
tgtaatttgtgatacaatgct

SEQ ID NO: 2203157 - DNA, 19 bp, Homo sapiens
tgtacatgaaaacacattt

SEQ ID NO: 2203158 - DNA, 14 bp, Homo sapiens
tgtacctcttgagc

SEQ ID NO: 2203159 - DNA, 12 bp, Homo sapiens
tgtatgtaaata

SEQ ID NO: 2203160 - DNA, 17 bp, Homo sapiens
tgtatgtgtgtctattt

SEQ ID NO: 2203161 - DNA, 17 bp, Homo sapiens
tgtctattttgtaactg

SEQ ID NO: 2203162 - DNA, 20 bp, Homo sapiens
tgtgaactaaactttcacac

SEQ ID NO: 2203163 - DNA, 16 bp, Homo sapiens
tgtgactgaatttctt

SEQ ID NO: 2203164 - DNA, 21 bp, Homo sapiens
tgtgatacaatgctgtgccct

SEQ ID NO: 2203165 - DNA, 17 bp, Homo sapiens
tgtgcacatctgttttg

SEQ ID NO: 2203166 - DNA, 19 bp, Homo sapiens
tgtgcattatctagatact

SEQ ID NO: 2203167 - DNA, 23 bp, Homo sapiens
tgtgcatttggtggtttcagaaa

SEQ ID NO: 2203168 - DNA, 14 bp, Homo sapiens
tgtgcctaatgtgt

SEQ ID NO: 2203169 - DNA, 19 bp, Homo sapiens
tgtggatttaacagaaatg

SEQ ID NO: 2203170 - DNA, 23 bp, Homo sapiens
tgtggtcaacatttctcatgttg

SEQ ID NO: 2203171 - DNA, 15 bp, Homo sapiens
tgtgtctattttgta

SEQ ID NO: 2203172 - DNA, 13 bp, Homo sapiens
tgttaatatttta

SEQ ID NO: 2203173 - DNA, 22 bp, Homo sapiens
tgttacatttttaagtgctgca

SEQ ID NO: 2203174 - DNA, 17 bp, Homo sapiens
tgttagtatgaggcatt

SEQ ID NO: 2203175 - DNA, 19 bp, Homo sapiens
tgttatttattgaaatgat

SEQ ID NO: 2203176 - DNA, 20 bp, Homo sapiens
tgttcctgaaggaggccctg

SEQ ID NO: 2203177 - DNA, 17 bp, Homo sapiens
tgttcttggtttgtaaa

SEQ ID NO: 2203178 - DNA, 18 bp, Homo sapiens
tgttcttggtttgtaaat

SEQ ID NO: 2203179 - DNA, 20 bp, Homo sapiens
tgttctttccaaagtacact

SEQ ID NO: 2203180 - DNA, 22 bp, Homo sapiens
tgttctttctggctatgcattt

SEQ ID NO: 2203181 - DNA, 20 bp, Homo sapiens
tgtttagatgaatgtcagtt

SEQ ID NO: 2203182 - DNA, 20 bp, Homo sapiens
tgtttagcagatttaagata

SEQ ID NO: 2203183 - DNA, 15 bp, Homo sapiens
tgtttcaaactttac

SEQ ID NO: 2203184 - DNA, 17 bp, Homo sapiens
tgtttccctctgtgtta

SEQ ID NO: 2203185 - DNA, 18 bp, Homo sapiens
tgtttctggcttagaaca

SEQ ID NO: 2203186 - DNA, 14 bp, Homo sapiens
tgtttgagaaatta

SEQ ID NO: 2203187 - DNA, 13 bp, Homo sapiens
tgtttgtgattga

SEQ ID NO: 2203188 - DNA, 18 bp, Homo sapiens
tgttttaaggatgcttgt

SEQ ID NO: 2203189 - DNA, 19 bp, Homo sapiens
tgttttaaggatgcttgta

SEQ ID NO: 2203190 - DNA, 14 bp, Homo sapiens
tgttttcaaatgtt

SEQ ID NO: 2203191 - DNA, 16 bp, Homo sapiens
ttaaaaatctcaaatt

SEQ ID NO: 2203192 - DNA, 18 bp, Homo sapiens
ttaaacattggttcttgt

SEQ ID NO: 2203193 - DNA, 18 bp, Homo sapiens
ttaaacttaatctaaatg

SEQ ID NO: 2203194 - DNA, 20 bp, Homo sapiens
ttaaaggaaggttctggtgt

SEQ ID NO: 2203195 - DNA, 16 bp, Homo sapiens
ttaaataataaagatc

SEQ ID NO: 2203196 - DNA, 13 bp, Homo sapiens
ttaaataatgtga

SEQ ID NO: 2203197 - DNA, 16 bp, Homo sapiens
ttaaataatgtgaaac

SEQ ID NO: 2203198 - DNA, 21 bp, Homo sapiens
ttaaataatgtgaaactggat

SEQ ID NO: 2203199 - DNA, 13 bp, Homo sapiens
ttaaattcttgca

SEQ ID NO: 2203200 - DNA, 13 bp, Homo sapiens
ttaacttttataa

SEQ ID NO: 2203201 - DNA, 14 bp, Homo sapiens
ttaacttttataaa

SEQ ID NO: 2203202 - DNA, 19 bp, Homo sapiens
ttaagaaaaaggatgcaca

SEQ ID NO: 2203203 - DNA, 21 bp, Homo sapiens
ttaagaaaaaggatgcacaga

SEQ ID NO: 2203204 - DNA, 19 bp, Homo sapiens
ttaagaactaaaatgttct

SEQ ID NO: 2203205 - DNA, 18 bp, Homo sapiens
ttaaggatgcttgtacat

SEQ ID NO: 2203206 - DNA, 19 bp, Homo sapiens
ttaaggatgcttgtacata

SEQ ID NO: 2203207 - DNA, 15 bp, Homo sapiens
ttaagtctgttttat

SEQ ID NO: 2203208 - DNA, 21 bp, Homo sapiens
ttaagtctgttttatgacttc

SEQ ID NO: 2203209 - DNA, 16 bp, Homo sapiens
ttaagtgctgcattta

SEQ ID NO: 2203210 - DNA, 19 bp, Homo sapiens
ttaagtgctgcatttaaaa

SEQ ID NO: 2203211 - DNA, 14 bp, Homo sapiens
ttaataataaattc

SEQ ID NO: 2203212 - DNA, 15 bp, Homo sapiens
ttaatattttatgtg

SEQ ID NO: 2203213 - DNA, 18 bp, Homo sapiens
ttgatttccgttaaaata

SEQ ID NO: 2203214 - DNA, 16 bp, Homo sapiens
ttggacattttatgtc

SEQ ID NO: 2203215 - DNA, 17 bp, Homo sapiens
ttggacattttatgtct

SEQ ID NO: 2203216 - DNA, 19 bp, Homo sapiens
ttggacattttatgtcttt

SEQ ID NO: 2203217 - DNA, 15 bp, Homo sapiens
ttggattcaatttta

SEQ ID NO: 2203218 - DNA, 18 bp, Homo sapiens
ttggctagaggttcaaag

SEQ ID NO: 2203219 - DNA, 14 bp, Homo sapiens
ttggggatattttt

SEQ ID NO: 2203220 - DNA, 20 bp, Homo sapiens
ttggtggctgttcctgaagg

SEQ ID NO: 2203221 - DNA, 18 bp, Homo sapiens
ttggtggtttcagaaatg

SEQ ID NO: 2203222 - DNA, 19 bp, Homo sapiens
ttggtggtttcagaaatgt

SEQ ID NO: 2203223 - DNA, 15 bp, Homo sapiens
ttgtaaattaacttt

SEQ ID NO: 2203224 - DNA, 16 bp, Homo sapiens
ttgtaaattaactttt

SEQ ID NO: 2203225 - DNA, 22 bp, Homo sapiens
ttgtaactgtttagatgaatgt

SEQ ID NO: 2203226 - DNA, 18 bp, Homo sapiens
ttgtacataatgcgtgca

SEQ ID NO: 2203227 - DNA, 15 bp, Homo sapiens
ttgtactctacaaaa

SEQ ID NO: 2203228 - DNA, 13 bp, Homo sapiens
ttgtattaagaat

SEQ ID NO: 2203229 - DNA, 18 bp, Homo sapiens
ttgtgatacaatgctgtg

SEQ ID NO: 2203230 - DNA, 16 bp, Homo sapiens
ttgtgatttttgtaat

SEQ ID NO: 2203231 - DNA, 17 bp, Homo sapiens
ttgtgatttttgtaatt

SEQ ID NO: 2203232 - DNA, 21 bp, Homo sapiens
ttgtggatttaacagaaatgt

SEQ ID NO: 2203233 - DNA, 14 bp, Homo sapiens
ttgttacattttta

SEQ ID NO: 2203234 - DNA, 19 bp, Homo sapiens
ttgttagtatgaggcattt

SEQ ID NO: 2203235 - DNA, 21 bp, Homo sapiens
ttgttagtatgaggcatttgt

SEQ ID NO: 2203236 - DNA, 14 bp, Homo sapiens
ttgttatttattga

SEQ ID NO: 2203237 - DNA, 15 bp, Homo sapiens
ttgttatttattgaa

SEQ ID NO: 2203238 - DNA, 17 bp, Homo sapiens
ttgttcttggtttgtaa

SEQ ID NO: 2203239 - DNA, 22 bp, Homo sapiens
tttaagaaaaaggatgcacaga

SEQ ID NO: 2203240 - DNA, 21 bp, Homo sapiens
tttaaggatgcttgtacataa

SEQ ID NO: 2203241 - DNA, 17 bp, Homo sapiens
tttaagtgctgcattta

SEQ ID NO: 2203242 - DNA, 19 bp, Homo sapiens
tttaagtgctgcatttaaa

SEQ ID NO: 2203243 - DNA, 22 bp, Homo sapiens
tttaatttgaaggtagaatgtt

SEQ ID NO: 2203244 - DNA, 14 bp, Homo sapiens
tttaccttttttat

SEQ ID NO: 2203245 - DNA, 21 bp, Homo sapiens
tttaccttttttatacataaa

SEQ ID NO: 2203246 - DNA, 18 bp, Homo sapiens
tttagaagattctatgtt

SEQ ID NO: 2203247 - DNA, 21 bp, Homo sapiens
tttagaagattctatgttaat

SEQ ID NO: 2203248 - DNA, 13 bp, Homo sapiens
tttagataataca

SEQ ID NO: 2203249 - DNA, 23 bp, Homo sapiens
tttagctactatatatgtgatga

SEQ ID NO: 2203250 - DNA, 19 bp, Homo sapiens
tttataaatcgcttttgat

SEQ ID NO: 2203251 - DNA, 22 bp, Homo sapiens
tttataaatcgcttttgataat

SEQ ID NO: 2203252 - DNA, 16 bp, Homo sapiens
tttatcgtcactgctt

SEQ ID NO: 2203253 - DNA, 21 bp, Homo sapiens
tttatcgtcactgcttaactt

SEQ ID NO: 2203254 - DNA, 15 bp, Homo sapiens
tttcaaactttacta

SEQ ID NO: 2203255 - DNA, 20 bp, Homo sapiens
tttcacagcacttacaattt

SEQ ID NO: 2203256 - DNA, 22 bp, Homo sapiens
tttcacagtgtgtggtcaacat

SEQ ID NO: 2203257 - DNA, 15 bp, Homo sapiens
tttccaaagtacact

SEQ ID NO: 2203258 - DNA, 21 bp, Homo sapiens
tttcctagcacacacttttgg

SEQ ID NO: 2203259 - DNA, 19 bp, Homo sapiens
tttcgatatttattgatgt

SEQ ID NO: 2203260 - DNA, 18 bp, Homo sapiens
tttctaaaggctaccttt

SEQ ID NO: 2203261 - DNA, 14 bp, Homo sapiens
tttctcatgttgaa

SEQ ID NO: 2203262 - DNA, 15 bp, Homo sapiens
tttctggctatgcat

SEQ ID NO: 2203263 - DNA, 18 bp, Homo sapiens
tttctggctatgcatttg

SEQ ID NO: 2203264 - DNA, 19 bp, Homo sapiens
tttctggctatgcatttga

SEQ ID NO: 2203265 - DNA, 12 bp, Homo sapiens
tttcttaaataa

SEQ ID NO: 2203266 - DNA, 13 bp, Homo sapiens
tttcttaaataat

SEQ ID NO: 2203267 - DNA, 16 bp, Homo sapiens
tttgaagattctatgt

SEQ ID NO: 2203268 - DNA, 17 bp, Homo sapiens
tttgaagatttaattac

SEQ ID NO: 2203269 - DNA, 21 bp, Homo sapiens
tttgaaggtagaatgttttca

SEQ ID NO: 2203270 - DNA, 17 bp, Homo sapiens
tttgaggtctgttcttt

SEQ ID NO: 2203271 - DNA, 22 bp, Homo sapiens
tttgaggtctgttctttccaaa

SEQ ID NO: 2203272 - DNA, 16 bp, Homo sapiens
tttgctttgtgatttt

SEQ ID NO: 2203273 - DNA, 14 bp, Homo sapiens
tttggggatatttt

SEQ ID NO: 2203274 - DNA, 19 bp, Homo sapiens
tttggtggtttcagaaatg

SEQ ID NO: 2203275 - DNA, 18 bp, Homo sapiens
tttggttaagtctgtttt

SEQ ID NO: 2203276 - DNA, 22 bp, Homo sapiens
tttggttaagtctgttttatga

SEQ ID NO: 2203277 - DNA, 17 bp, Homo sapiens
tttgtaaattaactttt

SEQ ID NO: 2203278 - DNA, 23 bp, Homo sapiens
tttgtaactgtaaagatgaatgt

SEQ ID NO: 2203279 - DNA, 18 bp, Homo sapiens
tttgtagcgtacatcaat

SEQ ID NO: 2203280 - DNA, 22 bp, Homo sapiens
tttgttagtatgaggcatttgt

SEQ ID NO: 2203281 - DNA, 12 bp, Homo sapiens
tttgtttgaact

SEQ ID NO: 2203282 - DNA, 13 bp, Homo sapiens
tttgtttgaactg

SEQ ID NO: 2203283 - DNA, 18 bp, Homo sapiens
tttgtttgaactgataaa

SEQ ID NO: 2203284 - DNA, 11 bp, Homo sapiens
ttttaaatgca

SEQ ID NO: 2203285 - DNA, 21 bp, Homo sapiens
ttttaaatgcacctggaatat

SEQ ID NO: 2203286 - DNA, 22 bp, Homo sapiens
ttttagaagattctatgttaat

SEQ ID NO: 2203287 - DNA, 23 bp, Homo sapiens
ttttaggtcaaacccaagttagt

SEQ ID NO: 2203288 - DNA, 20 bp, Homo sapiens
ttttataaatcgcttttgat

SEQ ID NO: 2203289 - DNA, 18 bp, Homo sapiens
catgtatttgtttgcata

SEQ ID NO: 2203290 - DNA, 13 bp, Homo sapiens
catgttcttaatt

SEQ ID NO: 2203291 - DNA, 15 bp, Homo sapiens
cattagttttgaaga

SEQ ID NO: 2203292 - DNA, 16 bp, Homo sapiens
cattagttttgaagat

SEQ ID NO: 2203293 - DNA, 13 bp, Homo sapiens
cattatatttatt

SEQ ID NO: 2203294 - DNA, 14 bp, Homo sapiens
cattatatttattg

SEQ ID NO: 2203295 - DNA, 19 bp, Homo sapiens
cattatatttattgtttat

SEQ ID NO: 2203296 - DNA, 16 bp, Homo sapiens
cattatctagatactg

SEQ ID NO: 2203297 - DNA, 18 bp, Homo sapiens
cattatctagatactgta

SEQ ID NO: 2203298 - DNA, 14 bp, Homo sapiens
cattatgttaatat

SEQ ID NO: 2203299 - DNA, 16 bp, Homo sapiens
cattatgttaatattt

SEQ ID NO: 2203300 - DNA, 18 bp, Homo sapiens
cattggttcttgtattaa

SEQ ID NO: 2203301 - DNA, 22 bp, Homo sapiens
cattggttcttgtattaagaat

SEQ ID NO: 2203302 - DNA, 17 bp, Homo sapiens
catttctcatgttgaag

SEQ ID NO: 2203303 - DNA, 19 bp, Homo sapiens
catttgaaaattttgatgt

SEQ ID NO: 2203304 - DNA, 17 bp, Homo sapiens
catttgaggtctgttct

SEQ ID NO: 2203305 - DNA, 19 bp, Homo sapiens
catttgaggtctgttcttt

SEQ ID NO: 2203306 - DNA, 17 bp, Homo sapiens
atgtcagttgttattta

SEQ ID NO: 2203307 - DNA, 21 bp, Homo sapiens
atgtgacttggattcaatttt

SEQ ID NO: 2203308 - DNA, 19 bp, Homo sapiens
atgtgcatttaattagaaa

SEQ ID NO: 2203309 - DNA, 18 bp, Homo sapiens
atgttaatattttatgtg

SEQ ID NO: 2203310 - DNA, 16 bp, Homo sapiens
atgttaattatgcagt

SEQ ID NO: 2203311 - DNA, 22 bp, Homo sapiens
atgttaattatgcagtgtttcc

SEQ ID NO: 2203312 - DNA, 12 bp, Homo sapiens
atgttttcaaat

SEQ ID NO: 2203313 - DNA, 18 bp, Homo sapiens
atgttttcaaatgttctc

SEQ ID NO: 2203314 - DNA, 16 bp, Homo sapiens
attaaacttaatctaa

SEQ ID NO: 2203315 - DNA, 13 bp, Homo sapiens
attaaattcttgc

SEQ ID NO: 2203316 - DNA, 12 bp, Homo sapiens
attaacttttat

SEQ ID NO: 2203317 - DNA, 19 bp, Homo sapiens
attaacttttataaacttt

SEQ ID NO: 2203318 - DNA, 22 bp, Homo sapiens
attaagaatgaaatactgtttg

SEQ ID NO: 2203319 - DNA, 15 bp, Homo sapiens
attaataataaattc

SEQ ID NO: 2203320 - DNA, 22 bp, Homo sapiens
attatagtaatgtgacttggat

SEQ ID NO: 2203321 - DNA, 23 bp, Homo sapiens
attatgcatgaagtaatatgcac

SEQ ID NO: 2203322 - DNA, 13 bp, Homo sapiens
attatgttaatat

SEQ ID NO: 2203323 - DNA, 17 bp, Homo sapiens
attatgttaatatttct

SEQ ID NO: 2203324 - DNA, 14 bp, Homo sapiens
attcattagttttg

SEQ ID NO: 2203325 - DNA, 15 bp, Homo sapiens
attcattagttttga

SEQ ID NO: 2203326 - DNA, 14 bp, Homo sapiens
attctatgttaata

SEQ ID NO: 2203327 - DNA, 21 bp, Homo sapiens
attctatgttaatattttatg

SEQ ID NO: 2203328 - DNA, 22 bp, Homo sapiens
attctatgttaatattttatgt

SEQ ID NO: 2203329 - DNA, 19 bp, Homo sapiens
attctctagtttgattaaa

SEQ ID NO: 2203330 - DNA, 14 bp, Homo sapiens
attcttgcaaagta

SEQ ID NO: 2203331 - DNA, 13 bp, Homo sapiens
attgatgttttca

SEQ ID NO: 2203332 - DNA, 14 bp, Homo sapiens
attgcgcctaatgt

SEQ ID NO: 2203333 - DNA, 19 bp, Homo sapiens
attggctagaggttcaaag

SEQ ID NO: 2203334 - DNA, 20 bp, Homo sapiens
attggctagaggttcaaaga

SEQ ID NO: 2203335 - DNA, 16 bp, Homo sapiens
attggtggctgttcct

SEQ ID NO: 2203336 - DNA, 15 bp, Homo sapiens
attggttcttgtatt

SEQ ID NO: 2203337 - DNA, 16 bp, Homo sapiens
atttaaaagatacagt

SEQ ID NO: 2203338 - DNA, 14 bp, Homo sapiens
atttaacagaaatg

SEQ ID NO: 2203339 - DNA, 13 bp, Homo sapiens
atttaatttgaag

SEQ ID NO: 2203340 - DNA, 15 bp, Homo sapiens
atttaatttgaagat

SEQ ID NO: 2203341 - DNA, 16 bp, Homo sapiens
atttatccttgttaag

SEQ ID NO: 2203342 - DNA, 18 bp, Homo sapiens
atttattgaaatgatttc

SEQ ID NO: 2203343 - DNA, 21 bp, Homo sapiens
atttattgaaatgatttcaca

SEQ ID NO: 2203344 - DNA, 16 bp, Homo sapiens
atttattgatgttttc

SEQ ID NO: 2203345 - DNA, 18 bp, Homo sapiens
atttattgatgttttcac

SEQ ID NO: 2203346 - DNA, 12 bp, Homo sapiens
atttatttattt

SEQ ID NO: 2203347 - DNA, 15 bp, Homo sapiens
atttccgttaaaata

SEQ ID NO: 2203348 - DNA, 12 bp, Homo sapiens
atttctaaatct

SEQ ID NO: 2203349 - DNA, 21 bp, Homo sapiens
atttctaaatctccaaaataa

SEQ ID NO: 2203350 - DNA, 20 bp, Homo sapiens
atttcttttgccgttattaa

SEQ ID NO: 2203351 - DNA, 23 bp, Homo sapiens
atttcttttgccgttattaaaaa

SEQ ID NO: 2203352 - DNA, 15 bp, Homo sapiens
atttgaggtctgttc

SEQ ID NO: 2203353 - DNA, 17 bp, Homo sapiens
atttgaggtctgttctt

SEQ ID NO: 2203354 - DNA, 18 bp, Homo sapiens
atttgaggtctgttcttt

SEQ ID NO: 2203355 - DNA, 17 bp, Homo sapiens
atttggtggtttcagaa

SEQ ID NO: 2203356 - DNA, 18 bp, Homo sapiens
atttggtggtttcagaaa

SEQ ID NO: 2203357 - DNA, 14 bp, Homo sapiens
atttgtgatacaat

SEQ ID NO: 2203358 - DNA, 17 bp, Homo sapiens
atttgtgatacaatgct

SEQ ID NO: 2203359 - DNA, 15 bp, Homo sapiens
atttgttaatatttc

SEQ ID NO: 2203360 - DNA, 13 bp, Homo sapiens
atttgtttgaact

SEQ ID NO: 2203361 - DNA, 16 bp, Homo sapiens
atttgtttgaactgat

SEQ ID NO: 2203362 - DNA, 16 bp, Homo sapiens
attttataaatcgctt

SEQ ID NO: 2203363 - DNA, 20 bp, Homo sapiens
attttataaatcgcttttga

SEQ ID NO: 2203364 - DNA, 21 bp, Homo sapiens
attttataaatcgcttttgat

SEQ ID NO: 2203365 - DNA, 12 bp, Homo sapiens
attttatgcttt

SEQ ID NO: 2203366 - DNA, 17 bp, Homo sapiens
attttatgctttaaaca

SEQ ID NO: 2203367 - DNA, 19 bp, Homo sapiens
attttatgctttaaacatt

SEQ ID NO: 2203368 - DNA, 15 bp, Homo sapiens
attttgatgttttaa

SEQ ID NO: 2203369 - DNA, 18 bp, Homo sapiens
attttgctttgtgatttt

SEQ ID NO: 2203370 - DNA, 20 bp, Homo sapiens
attttgctttgtgatttttg

SEQ ID NO: 2203371 - DNA, 19 bp, Homo sapiens
attttgtaactgtaaagat

SEQ ID NO: 2203372 - DNA, 19 bp, Homo sapiens
atttttaagtgctgcattt

SEQ ID NO: 2203373 - DNA, 21 bp, Homo sapiens
atttttcttagggaaggatac

SEQ ID NO: 2203374 - DNA, 22 bp, Homo sapiens
atttttcttagggaaggataca

SEQ ID NO: 2203375 - DNA, 19 bp, Homo sapiens
attttttttctgttatata

SEQ ID NO: 2203376 - DNA, 16 bp, Homo sapiens
caaaataaaacttttt

SEQ ID NO: 2203377 - DNA, 14 bp, Homo sapiens
caaacccaagttag

SEQ ID NO: 2203378 - DNA, 16 bp, Homo sapiens
caaagtacactgtttc

SEQ ID NO: 2203379 - DNA, 22 bp, Homo sapiens
caaagtacactgtttcaaactt

SEQ ID NO: 2203380 - DNA, 22 bp, Homo sapiens
caaatttctaaatctccaaaat

SEQ ID NO: 2203381 - DNA, 15 bp, Homo sapiens
caacatttctcatgt

SEQ ID NO: 2203382 - DNA, 16 bp, Homo sapiens
caacatttctcatgtt

SEQ ID NO: 2203383 - DNA, 19 bp, Homo sapiens
caagaaaatggccagtgag

SEQ ID NO: 2203384 - DNA, 18 bp, Homo sapiens
caagaccacgtttctaaa

SEQ ID NO: 2203385 - DNA, 14 bp, Homo sapiens
caaggtcatttttt

SEQ ID NO: 2203386 - DNA, 17 bp, Homo sapiens
caagttgtttgagaaat

SEQ ID NO: 2203387 - DNA, 16 bp, Homo sapiens
caatctggattcatat

SEQ ID NO: 2203388 - DNA, 20 bp, Homo sapiens
caatctggattcatatttaa

SEQ ID NO: 2203389 - DNA, 18 bp, Homo sapiens
caatgacttactgtacat

SEQ ID NO: 2203390 - DNA, 15 bp, Homo sapiens
caatgataatgctaa

SEQ ID NO: 2203391 - DNA, 23 bp, Homo sapiens
caattaaggattttatgctttaa

SEQ ID NO: 2203392 - DNA, 13 bp, Homo sapiens
caatttattatgg

SEQ ID NO: 2203393 - DNA, 22 bp, Homo sapiens
caattttaaggcatatttaaca

SEQ ID NO: 2203394 - DNA, 12 bp, Homo sapiens
cacacacttttg

SEQ ID NO: 2203395 - DNA, 19 bp, Homo sapiens
cacacattttttaaatgca

SEQ ID NO: 2203396 - DNA, 20 bp, Homo sapiens
cacacattttttaaatgcac

SEQ ID NO: 2203397 - DNA, 20 bp, Homo sapiens
cacagagttgttacattttt

SEQ ID NO: 2203398 - DNA, 23 bp, Homo sapiens
cacagtgtgtggtcaacatttct

SEQ ID NO: 2203399 - DNA, 20 bp, Homo sapiens
cacatattgatttccgttaa

SEQ ID NO: 2203400 - DNA, 16 bp, Homo sapiens
caccactacattctgt

SEQ ID NO: 2203401 - DNA, 21 bp, Homo sapiens
caccatattaccacagacata

SEQ ID NO: 2203402 - DNA, 22 bp, Homo sapiens
cacctggattgcgcctaatgtg

SEQ ID NO: 2203403 - DNA, 21 bp, Homo sapiens
cacctttcagataactgttat

SEQ ID NO: 2203404 - DNA, 16 bp, Homo sapiens
cacgatttctgtttag

SEQ ID NO: 2203405 - DNA, 15 bp, Homo sapiens
cactacattctgtta

SEQ ID NO: 2203406 - DNA, 17 bp, Homo sapiens
cactacattctgttaat

SEQ ID NO: 2203407 - DNA, 21 bp, Homo sapiens
cactacattctgttaatcatt

SEQ ID NO: 2203408 - DNA, 13 bp, Homo sapiens
cactccaattaag

SEQ ID NO: 2203409 - DNA, 21 bp, Homo sapiens
cactccaattaaggattttat

SEQ ID NO: 2203410 - DNA, 16 bp, Homo sapiens
cactgcatgtttgtga

SEQ ID NO: 2203411 - DNA, 13 bp, Homo sapiens
cactgcttaactt

SEQ ID NO: 2203412 - DNA, 13 bp, Homo sapiens
cacttacaatttt

SEQ ID NO: 2203413 - DNA, 22 bp, Homo sapiens
cacttttggttaagtctgtttt

SEQ ID NO: 2203414 - DNA, 14 bp, Homo sapiens
cacttttgttcttg

SEQ ID NO: 2203415 - DNA, 14 bp, Homo sapiens
cactttttgcagct

SEQ ID NO: 2203416 - DNA, 17 bp, Homo sapiens
cagaaatgtgttatcac

SEQ ID NO: 2203417 - DNA, 19 bp, Homo sapiens
cagagttgttacattttta

SEQ ID NO: 2203418 - DNA, 16 bp, Homo sapiens
cagcacgatttctgtt

SEQ ID NO: 2203419 - DNA, 20 bp, Homo sapiens
cagccctgctgctgcctgcc

SEQ ID NO: 2203420 - DNA, 21 bp, Homo sapiens
cagcctccctattttttttct

SEQ ID NO: 2203421 - DNA, 19 bp, Homo sapiens
cagcgtttctatgacacat

SEQ ID NO: 2203422 - DNA, 20 bp, Homo sapiens
cagtaaatgggggtgcattt

SEQ ID NO: 2203423 - DNA, 22 bp, Homo sapiens
cagtaaatgggggtgcatttga

SEQ ID NO: 2203424 - DNA, 15 bp, Homo sapiens
cagtattgaagcatt

SEQ ID NO: 2203425 - DNA, 16 bp, Homo sapiens
cagtattgaagcattt

SEQ ID NO: 2203426 - DNA, 16 bp, Homo sapiens
cagtgagatcaatgtg

SEQ ID NO: 2203427 - DNA, 17 bp, Homo sapiens
cagtgtgtggtcaacat

SEQ ID NO: 2203428 - DNA, 14 bp, Homo sapiens
cagttactcagaat

SEQ ID NO: 2203429 - DNA, 19 bp, Homo sapiens
cagttgttatttattgaaa

SEQ ID NO: 2203430 - DNA, 21 bp, Homo sapiens
cagtttgttagtatgaggcat

SEQ ID NO: 2203431 - DNA, 18 bp, Homo sapiens
cagttttggttgctttaa

SEQ ID NO: 2203432 - DNA, 21 bp, Homo sapiens
cataaacaagaccacgtttct

SEQ ID NO: 2203433 - DNA, 22 bp, Homo sapiens
cataaacaagaccacgtttcta

SEQ ID NO: 2203434 - DNA, 17 bp, Homo sapiens
cataaggaaactgggtt

SEQ ID NO: 2203435 - DNA, 14 bp, Homo sapiens
cataccacttttgt

SEQ ID NO: 2203436 - DNA, 15 bp, Homo sapiens
catacctacatgtat

SEQ ID NO: 2203437 - DNA, 16 bp, Homo sapiens
catactgccttgttta

SEQ ID NO: 2203438 - DNA, 20 bp, Homo sapiens
catactgccttgtttaatgt

SEQ ID NO: 2203439 - DNA, 22 bp, Homo sapiens
catatcacatgtcagccactgt

SEQ ID NO: 2203440 - DNA, 21 bp, Homo sapiens
catattaccacagacatacta

SEQ ID NO: 2203441 - DNA, 21 bp, Homo sapiens
catattgatttccgttaaaat

SEQ ID NO: 2203442 - DNA, 13 bp, Homo sapiens
catattttagcta

SEQ ID NO: 2203443 - DNA, 16 bp, Homo sapiens
gctctccaaaccactt

SEQ ID NO: 2203444 - DNA, 20 bp, Homo sapiens
gctgaacactccaattaagg

SEQ ID NO: 2203445 - DNA, 17 bp, Homo sapiens
gctgcatttaaaagata

SEQ ID NO: 2203446 - DNA, 17 bp, Homo sapiens
gcttaacttcacatatt

SEQ ID NO: 2203447 - DNA, 22 bp, Homo sapiens
gcttaattattgatgttttcat

SEQ ID NO: 2203448 - DNA, 12 bp, Homo sapiens
gcttgtacataa

SEQ ID NO: 2203449 - DNA, 19 bp, Homo sapiens
gcttgtacataatgcgtgc

SEQ ID NO: 2203450 - DNA, 22 bp, Homo sapiens
gctttaaacattggttcttgta

SEQ ID NO: 2203451 - DNA, 15 bp, Homo sapiens
gctttgtgatttttg

SEQ ID NO: 2203452 - DNA, 19 bp, Homo sapiens
gcttttgtgcattatctag

SEQ ID NO: 2203453 - DNA, 16 bp, Homo sapiens
ggaatatataaccagt

SEQ ID NO: 2203454 - DNA, 13 bp, Homo sapiens
ggacattttatgt

SEQ ID NO: 2203455 - DNA, 19 bp, Homo sapiens
ggagaagtcttctatttat

SEQ ID NO: 2203456 - DNA, 21 bp, Homo sapiens
ggagaagtcttctatttattt

SEQ ID NO: 2203457 - DNA, 14 bp, Homo sapiens
ggattcaattttaa

SEQ ID NO: 2203458 - DNA, 13 bp, Homo sapiens
ggcaaatgacttt

SEQ ID NO: 2203459 - DNA, 13 bp, Homo sapiens
ggcacatcagcac

SEQ ID NO: 2203460 - DNA, 21 bp, Homo sapiens
ggcagtggtggttttctgttc

SEQ ID NO: 2203461 - DNA, 20 bp, Homo sapiens
ggcccctgccacctcctgcc

SEQ ID NO: 2203462 - DNA, 20 bp, Homo sapiens
ggcctagcatacgtacacat

SEQ ID NO: 2203463 - DNA, 13 bp, Homo sapiens
ggctacctttgta

SEQ ID NO: 2203464 - DNA, 22 bp, Homo sapiens
ggctagaggttcaaagatattt

SEQ ID NO: 2203465 - DNA, 13 bp, Homo sapiens
ggctatgcatttg

SEQ ID NO: 2203466 - DNA, 14 bp, Homo sapiens
ggcttttgtgcatt

SEQ ID NO: 2203467 - DNA, 16 bp, Homo sapiens
gggaaggatacaaaag

SEQ ID NO: 2203468 - DNA, 21 bp, Homo sapiens
gggaaggatacaaaagcatgt

SEQ ID NO: 2203469 - DNA, 11 bp, Homo sapiens
gggttcctgca

SEQ ID NO: 2203470 - DNA, 23 bp, Homo sapiens
ggtattggctagaggttcaaaga

SEQ ID NO: 2203471 - DNA, 15 bp, Homo sapiens
ggtggttttctgttc

SEQ ID NO: 2203472 - DNA, 14 bp, Homo sapiens
ggttcttgtattaa

SEQ ID NO: 2203473 - DNA, 12 bp, Homo sapiens
ggtttcagaaat

SEQ ID NO: 2203474 - DNA, 15 bp, Homo sapiens
ggtttcagaaatgtg

SEQ ID NO: 2203475 - DNA, 15 bp, Homo sapiens
ggttttctgttcttt

SEQ ID NO: 2203476 - DNA, 17 bp, Homo sapiens
gtaaattaacttttata

SEQ ID NO: 2203477 - DNA, 22 bp, Homo sapiens
gtaaattaacttttataaactt

SEQ ID NO: 2203478 - DNA, 22 bp, Homo sapiens
gtaaggcatactgccttgttta

SEQ ID NO: 2203479 - DNA, 14 bp, Homo sapiens
gtaatatgcacaca

SEQ ID NO: 2203480 - DNA, 16 bp, Homo sapiens
gtaatatgcacacatt

SEQ ID NO: 2203481 - DNA, 15 bp, Homo sapiens
gtaatttgtgataca

SEQ ID NO: 2203482 - DNA, 18 bp, Homo sapiens
gtacactgtttcaaactt

SEQ ID NO: 2203483 - DNA, 20 bp, Homo sapiens
gtacactgtttcaaacttta

SEQ ID NO: 2203484 - DNA, 21 bp, Homo sapiens
gtacactgtttcaaactttac

SEQ ID NO: 2203485 - DNA, 20 bp, Homo sapiens
gtacataatgcgtgcatacc

SEQ ID NO: 2203486 - DNA, 17 bp, Homo sapiens
gtacatgaaaacacatt

SEQ ID NO: 2203487 - DNA, 15 bp, Homo sapiens
gtacgttgtgcattt

SEQ ID NO: 2203488 - DNA, 17 bp, Homo sapiens
gtacgttgtgcatttgg

SEQ ID NO: 2203489 - DNA, 16 bp, Homo sapiens
gtatcagctacaattg

SEQ ID NO: 2203490 - DNA, 13 bp, Homo sapiens
gtatgaggcattt

SEQ ID NO: 2203491 - DNA, 16 bp, Homo sapiens
gtatgtgcatttaatt

SEQ ID NO: 2203492 - DNA, 15 bp, Homo sapiens
gtatgtgtgtctatt

SEQ ID NO: 2203493 - DNA, 17 bp, Homo sapiens
gtatgtgtgtctatttt

SEQ ID NO: 2203494 - DNA, 21 bp, Homo sapiens
gtattctctcctgtacctctt

SEQ ID NO: 2203495 - DNA, 13 bp, Homo sapiens
gtattgaagcatt

SEQ ID NO: 2203496 - DNA, 23 bp, Homo sapiens
gtatttgtttgcataggtgatct

SEQ ID NO: 2203497 - DNA, 17 bp, Homo sapiens
gtatttttttactaata

SEQ ID NO: 2203498 - DNA, 12 bp, Homo sapiens
gtcaacatttct

SEQ ID NO: 2203499 - DNA, 13 bp, Homo sapiens
gtcaacatttctc

SEQ ID NO: 2203500 - DNA, 20 bp, Homo sapiens
gtcaacatttctcatgttga

SEQ ID NO: 2203501 - DNA, 21 bp, Homo sapiens
gtcagccactgtgatagaggc

SEQ ID NO: 2203502 - DNA, 15 bp, Homo sapiens
gtcagttgttattta

SEQ ID NO: 2203503 - DNA, 19 bp, Homo sapiens
gtcattttttttaagaaaa

SEQ ID NO: 2203504 - DNA, 21 bp, Homo sapiens
gtcctattatattcattcttt

SEQ ID NO: 2203505 - DNA, 20 bp, Homo sapiens
gtctattttgtaactgtaaa

SEQ ID NO: 2203506 - DNA, 14 bp, Homo sapiens
gtctgttctttcca

SEQ ID NO: 2203507 - DNA, 23 bp, Homo sapiens
gtcttcatacctacatgtatttg

SEQ ID NO: 2203508 - DNA, 22 bp, Homo sapiens
gtctttcttgtaaggcatactg

SEQ ID NO: 2203509 - DNA, 23 bp, Homo sapiens
gtgaagacaatgacttactgtac

SEQ ID NO: 2203510 - DNA, 14 bp, Homo sapiens
gtgaagtgaagaca

SEQ ID NO: 2203511 - DNA, 15 bp, Homo sapiens
gtgactgaatttctt

SEQ ID NO: 2203512 - DNA, 16 bp, Homo sapiens
gtgactgaatttcttt

SEQ ID NO: 2203513 - DNA, 15 bp, Homo sapiens
gtgagatcaatgtga

SEQ ID NO: 2203514 - DNA, 16 bp, Homo sapiens
gtgagatcaatgtgac

SEQ ID NO: 2203515 - DNA, 17 bp, Homo sapiens
gtgatacaatgctgtgc

SEQ ID NO: 2203516 - DNA, 16 bp, Homo sapiens
gtgatttttaaattaa

SEQ ID NO: 2203517 - DNA, 17 bp, Homo sapiens
gtgcacatctgttttgt

SEQ ID NO: 2203518 - DNA, 13 bp, Homo sapiens
gtgcataccactt

SEQ ID NO: 2203519 - DNA, 14 bp, Homo sapiens
gtgcatttaattag

SEQ ID NO: 2203520 - DNA, 17 bp, Homo sapiens
gtgcatttgaggtctgt

SEQ ID NO: 2203521 - DNA, 15 bp, Homo sapiens
gtgcatttggtggtt

SEQ ID NO: 2203522 - DNA, 15 bp, Homo sapiens
gtgcctaatgtgttt

SEQ ID NO: 2203523 - DNA, 23 bp, Homo sapiens
gtggtcaacatttctcatgttga

SEQ ID NO: 2203524 - DNA, 14 bp, Homo sapiens
gtggtggttttctg

SEQ ID NO: 2203525 - DNA, 20 bp, Homo sapiens
gtggtggttttctgttcttt

SEQ ID NO: 2203526 - DNA, 16 bp, Homo sapiens
gtggtttcagaaatgt

SEQ ID NO: 2203527 - DNA, 23 bp, Homo sapiens
gtgtatttttttactaatagaca

SEQ ID NO: 2203528 - DNA, 21 bp, Homo sapiens
gttaaaagaggtttttcttaa

SEQ ID NO: 2203529 - DNA, 13 bp, Homo sapiens
gttaagtctgttt

SEQ ID NO: 2203530 - DNA, 21 bp, Homo sapiens
gttacatttttaagtgctgca

SEQ ID NO: 2203531 - DNA, 20 bp, Homo sapiens
gttagtatgaggcatttgtt

SEQ ID NO: 2203532 - DNA, 22 bp, Homo sapiens
gttcaaagatattttgctttgt

SEQ ID NO: 2203533 - DNA, 22 bp, Homo sapiens
gttcaatcctgattcatattta

SEQ ID NO: 2203534 - DNA, 20 bp, Homo sapiens
gttctccagtcattatgtta

SEQ ID NO: 2203535 - DNA, 15 bp, Homo sapiens
gttctggtgtgaact

SEQ ID NO: 2203536 - DNA, 14 bp, Homo sapiens
gttcttggtttgta

SEQ ID NO: 2203537 - DNA, 15 bp, Homo sapiens
gttcttggtttgtaa

SEQ ID NO: 2203538 - DNA, 21 bp, Homo sapiens
gttcttgtattaagaatgaaa

SEQ ID NO: 2203539 - DNA, 14 bp, Homo sapiens
gttgttacattttt

SEQ ID NO: 2203540 - DNA, 15 bp, Homo sapiens
gttgttacattttta

SEQ ID NO: 2203541 - DNA, 15 bp, Homo sapiens
gtttagataatacac

SEQ ID NO: 2203542 - DNA, 13 bp, Homo sapiens
gtttcaaacttta

SEQ ID NO: 2203543 - DNA, 23 bp, Homo sapiens
gtttctaaaggctacctttgtat

SEQ ID NO: 2203544 - DNA, 22 bp, Homo sapiens
gtttctatgacacatgcaaggt

SEQ ID NO: 2203545 - DNA, 16 bp, Homo sapiens
gtttgcagatattctc

SEQ ID NO: 2203546 - DNA, 20 bp, Homo sapiens
gtttgtaaattaacttttat

SEQ ID NO: 2203547 - DNA, 14 bp, Homo sapiens
gttttctgttcttt

SEQ ID NO: 2203548 - DNA, 16 bp, Homo sapiens
gttttctgttctttct

SEQ ID NO: 2203549 - DNA, 20 bp, Homo sapiens
gttttgaagattctatgtta

SEQ ID NO: 2203550 - DNA, 23 bp, Homo sapiens
gtttttatggcttttgtgcatta

SEQ ID NO: 2203551 - DNA, 20 bp, Homo sapiens
gtttttcttaaataataaag

SEQ ID NO: 2203552 - DNA, 15 bp, Homo sapiens
taaaactttttaaaa

SEQ ID NO: 2203553 - DNA, 21 bp, Homo sapiens
taaaagatacagttactcaga

SEQ ID NO: 2203554 - DNA, 22 bp, Homo sapiens
taaaataccagccagtaaatgg

SEQ ID NO: 2203555 - DNA, 21 bp, Homo sapiens
taaacgtgatttttaaattaa

SEQ ID NO: 2203556 - DNA, 13 bp, Homo sapiens
taaactttcacac

SEQ ID NO: 2203557 - DNA, 16 bp, Homo sapiens
taaagcagcgtttcta

SEQ ID NO: 2203558 - DNA, 17 bp, Homo sapiens
taaagcagcgtttctat

SEQ ID NO: 2203559 - DNA, 17 bp, Homo sapiens
taaaggctacctttgta

SEQ ID NO: 2203560 - DNA, 14 bp, Homo sapiens
taaagtgtattttt

SEQ ID NO: 2203561 - DNA, 23 bp, Homo sapiens
taaagtgtatttttttactaata

SEQ ID NO: 2203562 - DNA, 13 bp, Homo sapiens
taaataaaatttt

SEQ ID NO: 2203563 - DNA, 22 bp, Homo sapiens
taaatctccaaaataaaacttt

SEQ ID NO: 2203564 - DNA, 23 bp, Homo sapiens
taaatgcacctggaatatataac

SEQ ID NO: 2203565 - DNA, 16 bp, Homo sapiens
taaatggaaccactct

SEQ ID NO: 2203566 - DNA, 18 bp, Homo sapiens
taaatgggggtgcatttg

SEQ ID NO: 2203567 - DNA, 14 bp, Homo sapiens
taaattaactttta

SEQ ID NO: 2203568 - DNA, 18 bp, Homo sapiens
taacaacaattatttgaa

SEQ ID NO: 2203569 - DNA, 13 bp, Homo sapiens
taacagaaatgta

SEQ ID NO: 2203570 - DNA, 16 bp, Homo sapiens
taactgtaaagatgaa

SEQ ID NO: 2203571 - DNA, 20 bp, Homo sapiens
taactgtaaagatgaatgtc

SEQ ID NO: 2203572 - DNA, 22 bp, Homo sapiens
taactgtaaagatgaatgtcag

SEQ ID NO: 2203573 - DNA, 16 bp, Homo sapiens
taactgttatttataa

SEQ ID NO: 2203574 - DNA, 17 bp, Homo sapiens
taacttttataaacttt

SEQ ID NO: 2203575 - DNA, 16 bp, Homo sapiens
taagaaaaaggatgca

SEQ ID NO: 2203576 - DNA, 21 bp, Homo sapiens
taagaatgaaatactgtttga

SEQ ID NO: 2203577 - DNA, 19 bp, Homo sapiens
taaggaaactgggttcctg

SEQ ID NO: 2203578 - DNA, 18 bp, Homo sapiens
taaggatgcttgtacata

SEQ ID NO: 2203579 - DNA, 20 bp, Homo sapiens
taaggatgcttgtacataat

SEQ ID NO: 2203580 - DNA, 19 bp, Homo sapiens
tctcagaaggcaaatgact

SEQ ID NO: 2203581 - DNA, 20 bp, Homo sapiens
tctcagaaggcaaatgactt

SEQ ID NO: 2203582 - DNA, 13 bp, Homo sapiens
tctccaaaataaa

SEQ ID NO: 2203583 - DNA, 15 bp, Homo sapiens
tctctagtttgatta

SEQ ID NO: 2203584 - DNA, 18 bp, Homo sapiens
tctctagtttgattaaat

SEQ ID NO: 2203585 - DNA, 19 bp, Homo sapiens
tctctagtttgattaaatt

SEQ ID NO: 2203586 - DNA, 14 bp, Homo sapiens
tctctcctgtacct

SEQ ID NO: 2203587 - DNA, 16 bp, Homo sapiens
tctctcctgtacctct

SEQ ID NO: 2203588 - DNA, 20 bp, Homo sapiens
tctctcctgtacctcttgag

SEQ ID NO: 2203589 - DNA, 19 bp, Homo sapiens
tctctgcaatcttctcaga

SEQ ID NO: 2203590 - DNA, 17 bp, Homo sapiens
tctgcagcaataaagca

SEQ ID NO: 2203591 - DNA, 18 bp, Homo sapiens
tctgcagcaataaagcag

SEQ ID NO: 2203592 - DNA, 22 bp, Homo sapiens
tctggctatgcatttgaaaatt

SEQ ID NO: 2203593 - DNA, 20 bp, Homo sapiens
tctgtgagcatcacagtttt

SEQ ID NO: 2203594 - DNA, 22 bp, Homo sapiens
tctgttctttccaaagtacact

SEQ ID NO: 2203595 - DNA, 16 bp, Homo sapiens
tctgtttagataatac

SEQ ID NO: 2203596 - DNA, 19 bp, Homo sapiens
tctgtttagataatacacc

SEQ ID NO: 2203597 - DNA, 15 bp, Homo sapiens
tgtttaatggtagtt

SEQ ID NO: 2203598 - DNA, 16 bp, Homo sapiens
tgtttagataatacac

SEQ ID NO: 2203599 - DNA, 20 bp, Homo sapiens
tgtttagataatacaccact

SEQ ID NO: 2203600 - DNA, 15 bp, Homo sapiens
tgtttccctctgtgt

SEQ ID NO: 2203601 - DNA, 16 bp, Homo sapiens
tgtttccctctgtgtt

SEQ ID NO: 2203602 - DNA, 23 bp, Homo sapiens
tgtttcctagcacacacttttgg

SEQ ID NO: 2203603 - DNA, 22 bp, Homo sapiens
tgttttaaggatgcttgtacat

SEQ ID NO: 2203604 - DNA, 20 bp, Homo sapiens
tgttttagaagattctatgt

SEQ ID NO: 2203605 - DNA, 21 bp, Homo sapiens
tgttttagaagattctatgtt

SEQ ID NO: 2203606 - DNA, 14 bp, Homo sapiens
ttaaaaatctcaaa

SEQ ID NO: 2203607 - DNA, 19 bp, Homo sapiens
ttaaaaatctcaaatttct

SEQ ID NO: 2203608 - DNA, 14 bp, Homo sapiens
ttaaaagatacagt

SEQ ID NO: 2203609 - DNA, 20 bp, Homo sapiens
ttaaacattggttcttgtat

SEQ ID NO: 2203610 - DNA, 19 bp, Homo sapiens
ttaaacgtgatttttaaat

SEQ ID NO: 2203611 - DNA, 22 bp, Homo sapiens
ttaaacttaatctaaatggaac

SEQ ID NO: 2203612 - DNA, 22 bp, Homo sapiens
ttaaataatgtgaaactggatt

SEQ ID NO: 2203613 - DNA, 16 bp, Homo sapiens
ttaaatgcacctggaa

SEQ ID NO: 2203614 - DNA, 17 bp, Homo sapiens
ttaaatgcacctggaat

SEQ ID NO: 2203615 - DNA, 20 bp, Homo sapiens
ttaaattcttgcaaagtatc

SEQ ID NO: 2203616 - DNA, 13 bp, Homo sapiens
ttaacagaaatgt

SEQ ID NO: 2203617 - DNA, 16 bp, Homo sapiens
ttaacttcacatattg

SEQ ID NO: 2203618 - DNA, 15 bp, Homo sapiens
ttaacttttataaac

SEQ ID NO: 2203619 - DNA, 16 bp, Homo sapiens
ttaacttttataaact

SEQ ID NO: 2203620 - DNA, 18 bp, Homo sapiens
ttaacttttataaacttt

SEQ ID NO: 2203621 - DNA, 22 bp, Homo sapiens
ttaacttttataaactttacct

SEQ ID NO: 2203622 - DNA, 20 bp, Homo sapiens
ttaagaactaaaatgttcta

SEQ ID NO: 2203623 - DNA, 14 bp, Homo sapiens
ttaagaatgaaata

SEQ ID NO: 2203624 - DNA, 13 bp, Homo sapiens
ttaaggattttat

SEQ ID NO: 2203625 - DNA, 15 bp, Homo sapiens
ttaaggattttatgc

SEQ ID NO: 2203626 - DNA, 13 bp, Homo sapiens
ttaagggtatgat

SEQ ID NO: 2203627 - DNA, 14 bp, Homo sapiens
ttaagtctgtttta

SEQ ID NO: 2203628 - DNA, 14 bp, Homo sapiens
ttaagtgctgcatt

SEQ ID NO: 2203629 - DNA, 15 bp, Homo sapiens
ttaatatcatcagta

SEQ ID NO: 2203630 - DNA, 13 bp, Homo sapiens
ttaatcattaggt

SEQ ID NO: 2203631 - DNA, 23 bp, Homo sapiens
ttaatcattaggtgtgactgaat

SEQ ID NO: 2203632 - DNA, 15 bp, Homo sapiens
ttaatctaaatggaa

SEQ ID NO: 2203633 - DNA, 12 bp, Homo sapiens
ttacatttttaa

SEQ ID NO: 2203634 - DNA, 14 bp, Homo sapiens
ttaccacagacata

SEQ ID NO: 2203635 - DNA, 17 bp, Homo sapiens
ttaccacagacatacta

SEQ ID NO: 2203636 - DNA, 13 bp, Homo sapiens
ttactaagttttt

SEQ ID NO: 2203637 - DNA, 14 bp, Homo sapiens
ttactaagttttta

SEQ ID NO: 2203638 - DNA, 19 bp, Homo sapiens
ttactatggccctggccta

SEQ ID NO: 2203639 - DNA, 18 bp, Homo sapiens
ttactcagaattctctag

SEQ ID NO: 2203640 - DNA, 23 bp, Homo sapiens
ttactcagaattctctagtttga

SEQ ID NO: 2203641 - DNA, 12 bp, Homo sapiens
ttactgtacatg

SEQ ID NO: 2203642 - DNA, 13 bp, Homo sapiens
ttactgtacatga

SEQ ID NO: 2203643 - DNA, 14 bp, Homo sapiens
ttactgtacatgaa

SEQ ID NO: 2203644 - DNA, 14 bp, Homo sapiens
ttagagttgatact

SEQ ID NO: 2203645 - DNA, 20 bp, Homo sapiens
ttaggagaagtcttctattt

SEQ ID NO: 2203646 - DNA, 18 bp, Homo sapiens
ttagtatgaggcatttgt

SEQ ID NO: 2203647 - DNA, 13 bp, Homo sapiens
ttatacataaaca

SEQ ID NO: 2203648 - DNA, 18 bp, Homo sapiens
ttatcacccagaagaaaa

SEQ ID NO: 2203649 - DNA, 21 bp, Homo sapiens
ttatcacccagaagaaaatag

SEQ ID NO: 2203650 - DNA, 16 bp, Homo sapiens
ttatctagatactgta

SEQ ID NO: 2203651 - DNA, 19 bp, Homo sapiens
ttatgacttcattaataat

SEQ ID NO: 2203652 - DNA, 18 bp, Homo sapiens
ttatgattgaatctactt

SEQ ID NO: 2203653 - DNA, 17 bp, Homo sapiens
ttatggcttttgtgcat

SEQ ID NO: 2203654 - DNA, 13 bp, Homo sapiens
ttattatgcatga

SEQ ID NO: 2203655 - DNA, 18 bp, Homo sapiens
ttattcattagttttgaa

SEQ ID NO: 2203656 - DNA, 21 bp, Homo sapiens
ttattcattagttttgaagat

SEQ ID NO: 2203657 - DNA, 17 bp, Homo sapiens
ttatttataatcacttt

SEQ ID NO: 2203658 - DNA, 11 bp, Homo sapiens
ttatttattga

SEQ ID NO: 2203659 - DNA, 21 bp, Homo sapiens
ttatttgaagatttaattact

SEQ ID NO: 2203660 - DNA, 13 bp, Homo sapiens
ttcaaagatattt

SEQ ID NO: 2203661 - DNA, 20 bp, Homo sapiens
ttcaattttaaggcatattt

SEQ ID NO: 2203662 - DNA, 13 bp, Homo sapiens
ttcagaaatgtgt

SEQ ID NO: 2203663 - DNA, 17 bp, Homo sapiens
ttcagataactgttatt

SEQ ID NO: 2203664 - DNA, 18 bp, Homo sapiens
ttcagataactgttattt

SEQ ID NO: 2203665 - DNA, 23 bp, Homo sapiens
ttcagataactgttatttataat

SEQ ID NO: 2203666 - DNA, 11 bp, Homo sapiens
ttcatagagaa

SEQ ID NO: 2203667 - DNA, 15 bp, Homo sapiens
ttcattaataataaa

SEQ ID NO: 2203668 - DNA, 19 bp, Homo sapiens
ttcattagttttgaagatt

SEQ ID NO: 2203669 - DNA, 19 bp, Homo sapiens
ttcattctttttgaaatgt

SEQ ID NO: 2203670 - DNA, 14 bp, Homo sapiens
ttccctctgtgtta

SEQ ID NO: 2203671 - DNA, 19 bp, Homo sapiens
ttcctagcacacacttttg

SEQ ID NO: 2203672 - DNA, 16 bp, Homo sapiens
ttctaaaggctacctt

SEQ ID NO: 2203673 - DNA, 20 bp, Homo sapiens
ttctaaaggctacctttgta

SEQ ID NO: 2203674 - DNA, 22 bp, Homo sapiens
ttctaaatatcccttggacatt

SEQ ID NO: 2203675 - DNA, 16 bp, Homo sapiens
ttctatgacacatgca

SEQ ID NO: 2203676 - DNA, 17 bp, Homo sapiens
ttctatgacacatgcaa

SEQ ID NO: 2203677 - DNA, 21 bp, Homo sapiens
ttctatttatttatttattca

SEQ ID NO: 2203678 - DNA, 18 bp, Homo sapiens
ttctcagaaggcaaatga

SEQ ID NO: 2203679 - DNA, 21 bp, Homo sapiens
ttctcagaaggcaaatgactt

SEQ ID NO: 2203680 - DNA, 13 bp, Homo sapiens
ttctcatgttgaa

SEQ ID NO: 2203681 - DNA, 22 bp, Homo sapiens
ttctcatgttgaagctttaaga

SEQ ID NO: 2203682 - DNA, 21 bp, Homo sapiens
ttctccttgtgttactaagtt

SEQ ID NO: 2203683 - DNA, 18 bp, Homo sapiens
ttctctagtcatttgtta

SEQ ID NO: 2203684 - DNA, 15 bp, Homo sapiens
ttctctagtttgatt

SEQ ID NO: 2203685 - DNA, 11 bp, Homo sapiens
ttctgttcttt

SEQ ID NO: 2203686 - DNA, 13 bp, Homo sapiens
ttctgtttagata

SEQ ID NO: 2203687 - DNA, 15 bp, Homo sapiens
ttcttaaataataaa

SEQ ID NO: 2203688 - DNA, 19 bp, Homo sapiens
ttcttaaataataaagatc

SEQ ID NO: 2203689 - DNA, 13 bp, Homo sapiens
ttcttgcaaagta

SEQ ID NO: 2203690 - DNA, 12 bp, Homo sapiens
ttcttgtattaa

SEQ ID NO: 2203691 - DNA, 21 bp, Homo sapiens
ttctttccaaagtacactgtt

SEQ ID NO: 2203692 - DNA, 17 bp, Homo sapiens
ttctttctggctatgca

SEQ ID NO: 2203693 - DNA, 20 bp, Homo sapiens
ttctttctggctatgcattt

SEQ ID NO: 2203694 - DNA, 15 bp, Homo sapiens
ttctttttgaaatgt

SEQ ID NO: 2203695 - DNA, 16 bp, Homo sapiens
ttgaaatgatttcaca

SEQ ID NO: 2203696 - DNA, 16 bp, Homo sapiens
ttgaactgataaagat

SEQ ID NO: 2203697 - DNA, 20 bp, Homo sapiens
ttgaactttgacctctgcag

SEQ ID NO: 2203698 - DNA, 22 bp, Homo sapiens
ttgaagattctatgttaatatt

SEQ ID NO: 2203699 - DNA, 23 bp, Homo sapiens
ttgaagattctatgttaatattt

SEQ ID NO: 2203700 - DNA, 14 bp, Homo sapiens
ttgaagcattttat

SEQ ID NO: 2203701 - DNA, 23 bp, Homo sapiens
ttgaagcattttataaatcgctt

SEQ ID NO: 2203702 - DNA, 15 bp, Homo sapiens
ttgaaggtagaatgt

SEQ ID NO: 2203703 - DNA, 15 bp, Homo sapiens
ttgacctctgcagca

SEQ ID NO: 2203704 - DNA, 23 bp, Homo sapiens
ttgatgttttaaggatgcttgta

SEQ ID NO: 2203705 - DNA, 22 bp, Homo sapiens
aattaaggattttatgctttaa

SEQ ID NO: 2203706 - DNA, 13 bp, Homo sapiens
aattaagtatctg

SEQ ID NO: 2203707 - DNA, 20 bp, Homo sapiens
aattccctggcctttcatat

SEQ ID NO: 2203708 - DNA, 17 bp, Homo sapiens
aattctctagtttgatt

SEQ ID NO: 2203709 - DNA, 14 bp, Homo sapiens
aatttattatggca

SEQ ID NO: 2203710 - DNA, 17 bp, Homo sapiens
aatttattatggcacat

SEQ ID NO: 2203711 - DNA, 13 bp, Homo sapiens
aatttctaaatct

SEQ ID NO: 2203712 - DNA, 14 bp, Homo sapiens
aatttgtgatacaa

SEQ ID NO: 2203713 - DNA, 20 bp, Homo sapiens
aatttgtgatacaatgctgt

SEQ ID NO: 2203714 - DNA, 22 bp, Homo sapiens
acaaaagcatgtgagactggtt

SEQ ID NO: 2203715 - DNA, 12 bp, Homo sapiens
acaatgacttac

SEQ ID NO: 2203716 - DNA, 17 bp, Homo sapiens
acaatgacttactgtac

SEQ ID NO: 2203717 - DNA, 20 bp, Homo sapiens
acaatgacttactgtacatg

SEQ ID NO: 2203718 - DNA, 22 bp, Homo sapiens
acaatgacttactgtacatgaa

SEQ ID NO: 2203719 - DNA, 15 bp, Homo sapiens
acaatttattatggc

SEQ ID NO: 2203720 - DNA, 19 bp, Homo sapiens
acacatgcaaggtcatttt

SEQ ID NO: 2203721 - DNA, 21 bp, Homo sapiens
acacatgcaaggtcatttttt

SEQ ID NO: 2203722 - DNA, 14 bp, Homo sapiens
acacattttttaaa

SEQ ID NO: 2203723 - DNA, 16 bp, Homo sapiens
acacattttttaaatg

SEQ ID NO: 2203724 - DNA, 22 bp, Homo sapiens
acacattttttaaatgcacctg

SEQ ID NO: 2203725 - DNA, 14 bp, Homo sapiens
acaccactacattc

SEQ ID NO: 2203726 - DNA, 16 bp, Homo sapiens
acactccaattaagga

SEQ ID NO: 2203727 - DNA, 17 bp, Homo sapiens
acactccaattaaggat

SEQ ID NO: 2203728 - DNA, 14 bp, Homo sapiens
acactgcatgtttg

SEQ ID NO: 2203729 - DNA, 18 bp, Homo sapiens
acactgtcctattatatt

SEQ ID NO: 2203730 - DNA, 15 bp, Homo sapiens
acactgtttcaaact

SEQ ID NO: 2203731 - DNA, 18 bp, Homo sapiens
acactgtttcaaacttta

SEQ ID NO: 2203732 - DNA, 23 bp, Homo sapiens
acactgtttcaaactttactatg

SEQ ID NO: 2203733 - DNA, 22 bp, Homo sapiens
acacttttggttaagtctgttt

SEQ ID NO: 2203734 - DNA, 17 bp, Homo sapiens
acagaaatgtacagcaa

SEQ ID NO: 2203735 - DNA, 15 bp, Homo sapiens
acagagttgttacat

SEQ ID NO: 2203736 - DNA, 22 bp, Homo sapiens
acagagttgttacatttttaag

SEQ ID NO: 2203737 - DNA, 16 bp, Homo sapiens
acagcaaggagattta

SEQ ID NO: 2203738 - DNA, 21 bp, Homo sapiens
acaggaaaataaaatatttaa

SEQ ID NO: 2203739 - DNA, 22 bp, Homo sapiens
acagtgtgtggtcaacatttct

SEQ ID NO: 2203740 - DNA, 13 bp, Homo sapiens
acagttactcaga

SEQ ID NO: 2203741 - DNA, 23 bp, Homo sapiens
acataaacaagaccacgtttcta

SEQ ID NO: 2203742 - DNA, 18 bp, Homo sapiens
acatcagcacgatttctg

SEQ ID NO: 2203743 - DNA, 21 bp, Homo sapiens
acatcagcacgatttctgttt

SEQ ID NO: 2203744 - DNA, 22 bp, Homo sapiens
acatgaaaacacatttttctta

SEQ ID NO: 2203745 - DNA, 23 bp, Homo sapiens
acatgaaaacacatttttcttag

SEQ ID NO: 2203746 - DNA, 16 bp, Homo sapiens
acatgcaaggtcattt

SEQ ID NO: 2203747 - DNA, 22 bp, Homo sapiens
acatgctacacactgcatgttt

SEQ ID NO: 2203748 - DNA, 19 bp, Homo sapiens
acatgtatttgtttgcata

SEQ ID NO: 2203749 - DNA, 18 bp, Homo sapiens
acattggttcttgtatta

SEQ ID NO: 2203750 - DNA, 23 bp, Homo sapiens
acattggttcttgtattaagaat

SEQ ID NO: 2203751 - DNA, 16 bp, Homo sapiens
acatttctcatgttga

SEQ ID NO: 2203752 - DNA, 14 bp, Homo sapiens
acattttatgtctt

SEQ ID NO: 2203753 - DNA, 15 bp, Homo sapiens
acattttatgtcttt

SEQ ID NO: 2203754 - DNA, 19 bp, Homo sapiens
acatttttaagtgctgcat

SEQ ID NO: 2203755 - DNA, 21 bp, Homo sapiens
acatttttaagtgctgcattt

SEQ ID NO: 2203756 - DNA, 23 bp, Homo sapiens
acatttttaagtgctgcatttaa

SEQ ID NO: 2203757 - DNA, 17 bp, Homo sapiens
acattttttaaatgcac

SEQ ID NO: 2203758 - DNA, 21 bp, Homo sapiens
acattttttaaatgcacctgg

SEQ ID NO: 2203759 - DNA, 22 bp, Homo sapiens
accacagacatactaaccagca

SEQ ID NO: 2203760 - DNA, 16 bp, Homo sapiens
accactacattctgtt

SEQ ID NO: 2203761 - DNA, 12 bp, Homo sapiens
accacttttgtt

SEQ ID NO: 2203762 - DNA, 15 bp, Homo sapiens
accacttttgttctt

SEQ ID NO: 2203763 - DNA, 21 bp, Homo sapiens
accacttttgttcttggtttg

SEQ ID NO: 2203764 - DNA, 20 bp, Homo sapiens
accactttttgcagctttct

SEQ ID NO: 2203765 - DNA, 13 bp, Homo sapiens
accagcagaaatg

SEQ ID NO: 2203766 - DNA, 18 bp, Homo sapiens
accagtgttgtggattta

SEQ ID NO: 2203767 - DNA, 21 bp, Homo sapiens
accagtgttgtggatttaaca

SEQ ID NO: 2203768 - DNA, 16 bp, Homo sapiens
accatattaccacaga

SEQ ID NO: 2203769 - DNA, 22 bp, Homo sapiens
accatggtcggaaaacatgcta

SEQ ID NO: 2203770 - DNA, 18 bp, Homo sapiens
accccagacgatgtcttc

SEQ ID NO: 2203771 - DNA, 14 bp, Homo sapiens
accctcatgttctt

SEQ ID NO: 2203772 - DNA, 14 bp, Homo sapiens
acctacatgtattt

SEQ ID NO: 2203773 - DNA, 15 bp, Homo sapiens
acctacatgtatttg

SEQ ID NO: 2203774 - DNA, 20 bp, Homo sapiens
acctctccagcctcagctct

SEQ ID NO: 2203775 - DNA, 20 bp, Homo sapiens
acctggaatatataaccagt

SEQ ID NO: 2203776 - DNA, 22 bp, Homo sapiens
acctggattgtgcctaatgtgt

SEQ ID NO: 2203777 - DNA, 15 bp, Homo sapiens
acctttgtattctct

SEQ ID NO: 2203778 - DNA, 17 bp, Homo sapiens
accttttttatacataa

SEQ ID NO: 2203779 - DNA, 19 bp, Homo sapiens
acgatttctgtttagataa

SEQ ID NO: 2203780 - DNA, 16 bp, Homo sapiens
acgtttctaaaggcta

SEQ ID NO: 2203781 - DNA, 22 bp, Homo sapiens
acgtttctaaaggctacctttg

SEQ ID NO: 2203782 - DNA, 13 bp, Homo sapiens
actatatatgtga

SEQ ID NO: 2203783 - DNA, 23 bp, Homo sapiens
actatatttttctcaatgtttag

SEQ ID NO: 2203784 - DNA, 21 bp, Homo sapiens
actcagaattctctagtttga

SEQ ID NO: 2203785 - DNA, 21 bp, Homo sapiens
actccaattaaggattttatg

SEQ ID NO: 2203786 - DNA, 13 bp, Homo sapiens
actgataaagatg

SEQ ID NO: 2203787 - DNA, 20 bp, Homo sapiens
actgccttgtttaatgttaa

SEQ ID NO: 2203788 - DNA, 16 bp, Homo sapiens
actgcttgtttcctag

SEQ ID NO: 2203789 - DNA, 14 bp, Homo sapiens
actgggttcctgca

SEQ ID NO: 2203790 - DNA, 18 bp, Homo sapiens
actggttccatggcctct

SEQ ID NO: 2203791 - DNA, 18 bp, Homo sapiens
actgtaaagatgaatgtc

SEQ ID NO: 2203792 - DNA, 19 bp, Homo sapiens
actgtaatttgtgatacaa

SEQ ID NO: 2203793 - DNA, 13 bp, Homo sapiens
actgtacatgaaa

SEQ ID NO: 2203794 - DNA, 16 bp, Homo sapiens
actgtacatgaaaaca

SEQ ID NO: 2203795 - DNA, 19 bp, Homo sapiens
actgtacatgaaaacacat

SEQ ID NO: 2203796 - DNA, 21 bp, Homo sapiens
actgtacatgaaaacacattt

SEQ ID NO: 2203797 - DNA, 23 bp, Homo sapiens
actgtacatgaaaacacattttt

SEQ ID NO: 2203798 - DNA, 14 bp, Homo sapiens
actgttatttataa

SEQ ID NO: 2203799 - DNA, 17 bp, Homo sapiens
actgttatttataatca

SEQ ID NO: 2203800 - DNA, 20 bp, Homo sapiens
actgttatttataatcactt

SEQ ID NO: 2203801 - DNA, 13 bp, Homo sapiens
actgtttcaaact

SEQ ID NO: 2203802 - DNA, 18 bp, Homo sapiens
actgtttcaaactttact

SEQ ID NO: 2203803 - DNA, 19 bp, Homo sapiens
actgtttcaaactttacta

SEQ ID NO: 2203804 - DNA, 18 bp, Homo sapiens
actgtttgaggtttttaa

SEQ ID NO: 2203805 - DNA, 15 bp, Homo sapiens
acttaaataatgtga

SEQ ID NO: 2203806 - DNA, 16 bp, Homo sapiens
acttaaataatgtgaa

SEQ ID NO: 2203807 - DNA, 17 bp, Homo sapiens
acttaatctaaatggaa

SEQ ID NO: 2203808 - DNA, 22 bp, Homo sapiens
acttaatctaaatggaaccact

SEQ ID NO: 2203809 - DNA, 13 bp, Homo sapiens
acttacaattttc

SEQ ID NO: 2203810 - DNA, 15 bp, Homo sapiens
acttactgtacatga

SEQ ID NO: 2203811 - DNA, 18 bp, Homo sapiens
actttaccttttttatac

SEQ ID NO: 2203812 - DNA, 23 bp, Homo sapiens
actttaccttttttatacataaa

SEQ ID NO: 2203813 - DNA, 14 bp, Homo sapiens
actttgacctctgc

SEQ ID NO: 2203814 - DNA, 15 bp, Homo sapiens
actttgacctctgca

SEQ ID NO: 2203815 - DNA, 18 bp, Homo sapiens
actttgacctctgcagca

SEQ ID NO: 2203816 - DNA, 19 bp, Homo sapiens
actttgacctctgcagcaa

SEQ ID NO: 2203817 - DNA, 22 bp, Homo sapiens
acttttataaactttacctttt

SEQ ID NO: 2203818 - DNA, 16 bp, Homo sapiens
acttttggttaagtct

SEQ ID NO: 2203819 - DNA, 22 bp, Homo sapiens
acttttggttaagtctgtttta

SEQ ID NO: 2203820 - DNA, 23 bp, Homo sapiens
acttttgttcttggtttgtaaat

SEQ ID NO: 2203821 - DNA, 15 bp, Homo sapiens
actttttgcagcttt

SEQ ID NO: 2203822 - DNA, 18 bp, Homo sapiens
agaaaaaggatgcacaga

SEQ ID NO: 2203823 - DNA, 19 bp, Homo sapiens
agaaaatagtggtgtgatt

SEQ ID NO: 2203824 - DNA, 20 bp, Homo sapiens
agaacaaaggggcttaatta

SEQ ID NO: 2203825 - DNA, 15 bp, Homo sapiens
agaagattctatgtt

SEQ ID NO: 2203826 - DNA, 17 bp, Homo sapiens
agaagattctatgttaa

SEQ ID NO: 2203827 - DNA, 17 bp, Homo sapiens
agaagtcttctatttat

SEQ ID NO: 2203828 - DNA, 21 bp, Homo sapiens
agaagtcttctatttatttat

SEQ ID NO: 2203829 - DNA, 15 bp, Homo sapiens
agaatgttttcaaat

SEQ ID NO: 2203830 - DNA, 21 bp, Homo sapiens
agaatgttttcaaatgttctc

SEQ ID NO: 2203831 - DNA, 13 bp, Homo sapiens
agacaatgactta

SEQ ID NO: 2203832 - DNA, 19 bp, Homo sapiens
agacaatgacttactgtac

SEQ ID NO: 2203833 - DNA, 23 bp, Homo sapiens
agacaatgacttactgtacatga

SEQ ID NO: 2203834 - DNA, 19 bp, Homo sapiens
agacatactaaccagcaga

SEQ ID NO: 2203835 - DNA, 17 bp, Homo sapiens
agacgatgtcttcatac

SEQ ID NO: 2203836 - DNA, 20 bp, Homo sapiens
agactggttccatggcctct

SEQ ID NO: 2203837 - DNA, 14 bp, Homo sapiens
agagaggtttcgat

SEQ ID NO: 2203838 - DNA, 13 bp, Homo sapiens
agaggttcaaaga

SEQ ID NO: 2203839 - DNA, 12 bp, Homo sapiens
agaggtttttct

SEQ ID NO: 2203840 - DNA, 16 bp, Homo sapiens
agagttgttacatttt

SEQ ID NO: 2203841 - DNA, 12 bp, Homo sapiens
ctgaatttcttt

SEQ ID NO: 2203842 - DNA, 18 bp, Homo sapiens
ctgagtacgttgtgcatt

SEQ ID NO: 2203843 - DNA, 21 bp, Homo sapiens
ctgagtacgttgtgcatttgg

SEQ ID NO: 2203844 - DNA, 13 bp, Homo sapiens
ctgataaagatga

SEQ ID NO: 2203845 - DNA, 22 bp, Homo sapiens
ctgcaatcttctcagaaggcaa

SEQ ID NO: 2203846 - DNA, 17 bp, Homo sapiens
ctgcatttaaaagatac

SEQ ID NO: 2203847 - DNA, 18 bp, Homo sapiens
ctgcatttaaaagataca

SEQ ID NO: 2203848 - DNA, 20 bp, Homo sapiens
ctgcatttaaaagatacagt

SEQ ID NO: 2203849 - DNA, 14 bp, Homo sapiens
ctgccacctcctgc

SEQ ID NO: 2203850 - DNA, 22 bp, Homo sapiens
ctgcctggacttggcccctgcc

SEQ ID NO: 2203851 - DNA, 18 bp, Homo sapiens
ctgccttgtttaatgtta

SEQ ID NO: 2203852 - DNA, 11 bp, Homo sapiens
ctgctgcctgc

SEQ ID NO: 2203853 - DNA, 15 bp, Homo sapiens
ctgctgctgcctgcc

SEQ ID NO: 2203854 - DNA, 15 bp, Homo sapiens
ctgcttaacttcaca

SEQ ID NO: 2203855 - DNA, 17 bp, Homo sapiens
ctgcttaacttcacata

SEQ ID NO: 2203856 - DNA, 19 bp, Homo sapiens
ctggacttggcccctgcca

SEQ ID NO: 2203857 - DNA, 13 bp, Homo sapiens
ctggattaaactt

SEQ ID NO: 2203858 - DNA, 20 bp, Homo sapiens
ctggattgcgcctaatgtgt

SEQ ID NO: 2203859 - DNA, 17 bp, Homo sapiens
ctggcctagcatacgta

SEQ ID NO: 2203860 - DNA, 23 bp, Homo sapiens
ctggcctagcatacgtacacatt

SEQ ID NO: 2203861 - DNA, 16 bp, Homo sapiens
ctggctatgcatttga

SEQ ID NO: 2203862 - DNA, 18 bp, Homo sapiens
ctgggctgaacactccaa

SEQ ID NO: 2203863 - DNA, 17 bp, Homo sapiens
ctgtaaagatgaatgtc

SEQ ID NO: 2203864 - DNA, 14 bp, Homo sapiens
ctgtaatttgtgat

SEQ ID NO: 2203865 - DNA, 15 bp, Homo sapiens
ctgtaatttgtgata

SEQ ID NO: 2203866 - DNA, 21 bp, Homo sapiens
ctgtacctcttgagccttgaa

SEQ ID NO: 2203867 - DNA, 16 bp, Homo sapiens
ctgtgagcatcacagt

SEQ ID NO: 2203868 - DNA, 19 bp, Homo sapiens
ctgtgagcatcacagtttt

SEQ ID NO: 2203869 - DNA, 13 bp, Homo sapiens
ctgttatataaat

SEQ ID NO: 2203870 - DNA, 15 bp, Homo sapiens
ctgttatataaatgg

SEQ ID NO: 2203871 - DNA, 22 bp, Homo sapiens
ctgttatataaatggttaaaag

SEQ ID NO: 2203872 - DNA, 14 bp, Homo sapiens
ctgttatttataat

SEQ ID NO: 2203873 - DNA, 15 bp, Homo sapiens
ctgttctttccaaag

SEQ ID NO: 2203874 - DNA, 19 bp, Homo sapiens
ctgttctttccaaagtaca

SEQ ID NO: 2203875 - DNA, 12 bp, Homo sapiens
ctgttttatgac

SEQ ID NO: 2203876 - DNA, 16 bp, Homo sapiens
ctgttttatgacttca

SEQ ID NO: 2203877 - DNA, 14 bp, Homo sapiens
cttaaataatgtga

SEQ ID NO: 2203878 - DNA, 15 bp, Homo sapiens
cttaacttcacatat

SEQ ID NO: 2203879 - DNA, 16 bp, Homo sapiens
cttaacttcacatatt

SEQ ID NO: 2203880 - DNA, 17 bp, Homo sapiens
cttaacttcacatattg

SEQ ID NO: 2203881 - DNA, 20 bp, Homo sapiens
cttaattcttagctcattct

SEQ ID NO: 2203882 - DNA, 19 bp, Homo sapiens
cttaccctcatgttcttaa

SEQ ID NO: 2203883 - DNA, 13 bp, Homo sapiens
cttactgtacatg

SEQ ID NO: 2203884 - DNA, 19 bp, Homo sapiens
cttagggaaggatacaaaa

SEQ ID NO: 2203885 - DNA, 20 bp, Homo sapiens
cttagtatgtgcatttaatt

SEQ ID NO: 2203886 - DNA, 22 bp, Homo sapiens
cttctcagaaggcaaatgactt

SEQ ID NO: 2203887 - DNA, 15 bp, Homo sapiens
cttgaactttgacct

SEQ ID NO: 2203888 - DNA, 17 bp, Homo sapiens
cttgaactttgacctct

SEQ ID NO: 2203889 - DNA, 19 bp, Homo sapiens
cttgagccttgaactttga

SEQ ID NO: 2203890 - DNA, 22 bp, Homo sapiens
cttgagccttgaactttgacct

SEQ ID NO: 2203891 - DNA, 12 bp, Homo sapiens
cttgcaaagtat

SEQ ID NO: 2203892 - DNA, 16 bp, Homo sapiens
cttggacattttatgt

SEQ ID NO: 2203893 - DNA, 17 bp, Homo sapiens
cttggacattttatgtc

SEQ ID NO: 2203894 - DNA, 19 bp, Homo sapiens
cttgtacataatgcgtgca

SEQ ID NO: 2203895 - DNA, 18 bp, Homo sapiens
cttgtactctacaaaata

SEQ ID NO: 2203896 - DNA, 15 bp, Homo sapiens
cttgtattaagaatg

SEQ ID NO: 2203897 - DNA, 16 bp, Homo sapiens
cttgtttaatggtagt

SEQ ID NO: 2203898 - DNA, 21 bp, Homo sapiens
ctttaaacattggttcttgta

SEQ ID NO: 2203899 - DNA, 15 bp, Homo sapiens
ctttaagaactaaaa

SEQ ID NO: 2203900 - DNA, 19 bp, Homo sapiens
ctttaatatcatcagtatt

SEQ ID NO: 2203901 - DNA, 19 bp, Homo sapiens
ctttaccttttttatacat

SEQ ID NO: 2203902 - DNA, 13 bp, Homo sapiens
ctttactatggcc

SEQ ID NO: 2203903 - DNA, 19 bp, Homo sapiens
ctttcttgtaaggcatact

SEQ ID NO: 2203904 - DNA, 18 bp, Homo sapiens
ctttgacctctgcagcaa

SEQ ID NO: 2203905 - DNA, 22 bp, Homo sapiens
ctttgtattctctcctgtacct

SEQ ID NO: 2203906 - DNA, 12 bp, Homo sapiens
ctttgtgatttt

SEQ ID NO: 2203907 - DNA, 14 bp, Homo sapiens
ctttgtgatttttg

SEQ ID NO: 2203908 - DNA, 20 bp, Homo sapiens
cttttataaactttaccttt

SEQ ID NO: 2203909 - DNA, 13 bp, Homo sapiens
cttttcttttctt

SEQ ID NO: 2203910 - DNA, 22 bp, Homo sapiens
cttttgataatcaactgggctg

SEQ ID NO: 2203911 - DNA, 23 bp, Homo sapiens
cttttgataatcaactgggctga

SEQ ID NO: 2203912 - DNA, 13 bp, Homo sapiens
cttttggttaagt

SEQ ID NO: 2203913 - DNA, 12 bp, Homo sapiens
cttttgtgcatt

SEQ ID NO: 2203914 - DNA, 11 bp, Homo sapiens
cttttgttctt

SEQ ID NO: 2203915 - DNA, 12 bp, Homo sapiens
cttttgttcttg

SEQ ID NO: 2203916 - DNA, 14 bp, Homo sapiens
ctttttgaaatgtc

SEQ ID NO: 2203917 - DNA, 14 bp, Homo sapiens
ctttttgcagcttt

SEQ ID NO: 2203918 - DNA, 16 bp, Homo sapiens
cttttttagagttgat

SEQ ID NO: 2203919 - DNA, 17 bp, Homo sapiens
cttttttatacataaac

SEQ ID NO: 2203920 - DNA, 21 bp, Homo sapiens
ctttttttttttttttgacaa

SEQ ID NO: 2203921 - DNA, 14 bp, Homo sapiens
gaaaacacattttt

SEQ ID NO: 2203922 - DNA, 12 bp, Homo sapiens
gaaaacatgcta

SEQ ID NO: 2203923 - DNA, 18 bp, Homo sapiens
gaaaacatgctacacact

SEQ ID NO: 2203924 - DNA, 21 bp, Homo sapiens
gaaactgcttgtttcctagca

SEQ ID NO: 2203925 - DNA, 13 bp, Homo sapiens
gaaactggattaa

SEQ ID NO: 2203926 - DNA, 17 bp, Homo sapiens
gaaactgggttcctgca

SEQ ID NO: 2203927 - DNA, 15 bp, Homo sapiens
gaaatactgtttgag

SEQ ID NO: 2203928 - DNA, 17 bp, Homo sapiens
gaaatgtacagcaagga

SEQ ID NO: 2203929 - DNA, 22 bp, Homo sapiens
gaaccatggtcggaaaacatgc

SEQ ID NO: 2203930 - DNA, 12 bp, Homo sapiens
gaactaaacttt

SEQ ID NO: 2203931 - DNA, 15 bp, Homo sapiens
gaagcattttataaa

SEQ ID NO: 2203932 - DNA, 12 bp, Homo sapiens
gaaggatacaaa

SEQ ID NO: 2203933 - DNA, 17 bp, Homo sapiens
gaaggtagaatgttttc

SEQ ID NO: 2203934 - DNA, 16 bp, Homo sapiens
gaaggttctggtgtga

SEQ ID NO: 2203935 - DNA, 13 bp, Homo sapiens
gaagtcttctatt

SEQ ID NO: 2203936 - DNA, 15 bp, Homo sapiens
gaatgaaatactgtt

SEQ ID NO: 2203937 - DNA, 17 bp, Homo sapiens
gaatgtcagttgttatt

SEQ ID NO: 2203938 - DNA, 17 bp, Homo sapiens
gaatgttttcaaatgtt

SEQ ID NO: 2203939 - DNA, 21 bp, Homo sapiens
gacattttatgtctttcttgt

SEQ ID NO: 2203940 - DNA, 16 bp, Homo sapiens
gaccacgtttctaaag

SEQ ID NO: 2203941 - DNA, 14 bp, Homo sapiens
gactgaatttcttt

SEQ ID NO: 2203942 - DNA, 22 bp, Homo sapiens
gactgagtacgttgtgcatttg

SEQ ID NO: 2203943 - DNA, 20 bp, Homo sapiens
gagaagtcttctatttattt

SEQ ID NO: 2203944 - DNA, 21 bp, Homo sapiens
gagaagtcttctatttattta

SEQ ID NO: 2203945 - DNA, 22 bp, Homo sapiens
gagccttgaactttgacctctg

SEQ ID NO: 2203946 - DNA, 13 bp, Homo sapiens
gaggtctgttctt

SEQ ID NO: 2203947 - DNA, 20 bp, Homo sapiens
gagttgttacatttttaagt

SEQ ID NO: 2203948 - DNA, 18 bp, Homo sapiens
gataactgttatttataa

SEQ ID NO: 2203949 - DNA, 14 bp, Homo sapiens
gataatacaccact

SEQ ID NO: 2203950 - DNA, 21 bp, Homo sapiens
gataatacaccactacattct

SEQ ID NO: 2203951 - DNA, 23 bp, Homo sapiens
gataatacaccactacattctgt

SEQ ID NO: 2203952 - DNA, 24 bp, Homo sapiens
gataatacaccactacattctgtt

SEQ ID NO: 2203953 - DNA, 17 bp, Homo sapiens
gataatcaactgggctg

SEQ ID NO: 2203954 - DNA, 16 bp, Homo sapiens
gatactacagtttgtt

SEQ ID NO: 2203955 - DNA, 17 bp, Homo sapiens
gatatttattgatgttt

SEQ ID NO: 2203956 - DNA, 16 bp, Homo sapiens
gatattttgctttgtg

SEQ ID NO: 2203957 - DNA, 17 bp, Homo sapiens
gatatttttttcttttc

SEQ ID NO: 2203958 - DNA, 13 bp, Homo sapiens
gatgaatgtcagt

SEQ ID NO: 2203959 - DNA, 16 bp, Homo sapiens
gatgagtgagcatgcc

SEQ ID NO: 2203960 - DNA, 14 bp, Homo sapiens
gatgtcttcatacc

SEQ ID NO: 2203961 - DNA, 18 bp, Homo sapiens
gatgtcttcatacctaca

SEQ ID NO: 2203962 - DNA, 21 bp, Homo sapiens
gatgttttaaggatgcttgta

SEQ ID NO: 2203963 - DNA, 15 bp, Homo sapiens
gattaaacttaatct

SEQ ID NO: 2203964 - DNA, 12 bp, Homo sapiens
gattcatattta

SEQ ID NO: 2203965 - DNA, 22 bp, Homo sapiens
gattcatatttaatttgaagat

SEQ ID NO: 2203966 - DNA, 21 bp, Homo sapiens
gattctatgttaatattttat

SEQ ID NO: 2203967 - DNA, 21 bp, Homo sapiens
gattgcgcctaatgtgtttga

SEQ ID NO: 2203968 - DNA, 18 bp, Homo sapiens
gattgtgcctaatgtgtt

SEQ ID NO: 2203969 - DNA, 16 bp, Homo sapiens
gatttaacagaaatgt

SEQ ID NO: 2203970 - DNA, 19 bp, Homo sapiens
gatttaacagaaatgtaca

SEQ ID NO: 2203971 - DNA, 20 bp, Homo sapiens
gatttaacagaaatgtacag

SEQ ID NO: 2203972 - DNA, 13 bp, Homo sapiens
gatttcacagtgt

SEQ ID NO: 2203973 - DNA, 15 bp, Homo sapiens
gatttccgttaaaat

SEQ ID NO: 2203974 - DNA, 19 bp, Homo sapiens
gatttctgtttagataata

SEQ ID NO: 2203975 - DNA, 22 bp, Homo sapiens
gatttctgtttagataatacac

SEQ ID NO: 2203976 - DNA, 16 bp, Homo sapiens
gcaaagtatccctact

SEQ ID NO: 2203977 - DNA, 14 bp, Homo sapiens
gcaaggtcattttt

SEQ ID NO: 2203978 - DNA, 11 bp, Homo sapiens
gcacacatttt

SEQ ID NO: 2203979 - DNA, 17 bp, Homo sapiens
tgccttgtttaatgtta

SEQ ID NO: 2203980 - DNA, 18 bp, Homo sapiens
tgccttgtttaatgttaa

SEQ ID NO: 2203981 - DNA, 21 bp, Homo sapiens
tgctaattttattatagtaat

SEQ ID NO: 2203982 - DNA, 11 bp, Homo sapiens
tgctacacact

SEQ ID NO: 2203983 - DNA, 14 bp, Homo sapiens
tgctgcatttaaaa

SEQ ID NO: 2203984 - DNA, 18 bp, Homo sapiens
tgctgcatttaaaagata

SEQ ID NO: 2203985 - DNA, 23 bp, Homo sapiens
tgctgcatttaaaagatacagtt

SEQ ID NO: 2203986 - DNA, 13 bp, Homo sapiens
tgcttaacttcac

SEQ ID NO: 2203987 - DNA, 14 bp, Homo sapiens
tgcttgtacataat

SEQ ID NO: 2203988 - DNA, 16 bp, Homo sapiens
tgcttgtacataatgc

SEQ ID NO: 2203989 - DNA, 18 bp, Homo sapiens
tgctttaatatcatcagt

SEQ ID NO: 2203990 - DNA, 12 bp, Homo sapiens
tgctttgtgatt

SEQ ID NO: 2203991 - DNA, 11 bp, Homo sapiens
tggacatttta

SEQ ID NO: 2203992 - DNA, 13 bp, Homo sapiens
tggacattttatg

SEQ ID NO: 2203993 - DNA, 17 bp, Homo sapiens
tggacattttatgtctt

SEQ ID NO: 2203994 - DNA, 22 bp, Homo sapiens
tggattaaacttaatctaaatg

SEQ ID NO: 2203995 - DNA, 20 bp, Homo sapiens
tggattgcgcctaatgtgtt

SEQ ID NO: 2203996 - DNA, 17 bp, Homo sapiens
tggatttaacagaaatg

SEQ ID NO: 2203997 - DNA, 20 bp, Homo sapiens
tggcctagcatacgtacaca

SEQ ID NO: 2203998 - DNA, 20 bp, Homo sapiens
tggcctttcatattttagct

SEQ ID NO: 2203999 - DNA, 22 bp, Homo sapiens
tggctagaggttcaaagatatt

SEQ ID NO: 2204000 - DNA, 15 bp, Homo sapiens
tggctatgcatttga

SEQ ID NO: 2204001 - DNA, 19 bp, Homo sapiens
tgggctgaacactccaatt

SEQ ID NO: 2204002 - DNA, 12 bp, Homo sapiens
tgggggtgcatt

SEQ ID NO: 2204003 - DNA, 15 bp, Homo sapiens
tggtagttttacagt

SEQ ID NO: 2204004 - DNA, 23 bp, Homo sapiens
tggtattggctagaggttcaaag

SEQ ID NO: 2204005 - DNA, 17 bp, Homo sapiens
tggtcggaaaacatgct

SEQ ID NO: 2204006 - DNA, 19 bp, Homo sapiens
tggtggttttctgttcttt

SEQ ID NO: 2204007 - DNA, 14 bp, Homo sapiens
tggtgtgaactaaa

SEQ ID NO: 2204008 - DNA, 18 bp, Homo sapiens
tggttcttgtattaagaa

SEQ ID NO: 2204009 - DNA, 13 bp, Homo sapiens
tgtaaattaactt

SEQ ID NO: 2204010 - DNA, 14 bp, Homo sapiens
tgtaaattaacttt

SEQ ID NO: 2204011 - DNA, 16 bp, Homo sapiens
tgtaacaacaattatt

SEQ ID NO: 2204012 - DNA, 21 bp, Homo sapiens
tgtaactgtttagatgaatgt

SEQ ID NO: 2204013 - DNA, 21 bp, Homo sapiens
tgtaattatatatactatatt

SEQ ID NO: 2204014 - DNA, 14 bp, Homo sapiens
tgtaatttgtgata

SEQ ID NO: 2204015 - DNA, 16 bp, Homo sapiens
tgtaatttgtgataca

SEQ ID NO: 2204016 - DNA, 17 bp, Homo sapiens
tgtaatttgtgatacaa

SEQ ID NO: 2204017 - DNA, 22 bp, Homo sapiens
tgtacagcaaggagatttacaa

SEQ ID NO: 2204018 - DNA, 20 bp, Homo sapiens
tgtacataatgcgtgcatac

SEQ ID NO: 2204019 - DNA, 20 bp, Homo sapiens
tgtacatgaaaacacatttt

SEQ ID NO: 2204020 - DNA, 23 bp, Homo sapiens
tgtacctcttgagccttgaactt

SEQ ID NO: 2204021 - DNA, 18 bp, Homo sapiens
tgtatgtgtgtctatttt

SEQ ID NO: 2204022 - DNA, 22 bp, Homo sapiens
tgtatgtgtgtctattttgtaa

SEQ ID NO: 2204023 - DNA, 14 bp, Homo sapiens
tgtatttgtttgca

SEQ ID NO: 2204024 - DNA, 14 bp, Homo sapiens
tgtatttttttact

SEQ ID NO: 2204025 - DNA, 15 bp, Homo sapiens
tgtcagccactgtga

SEQ ID NO: 2204026 - DNA, 15 bp, Homo sapiens
tgtcctattatattc

SEQ ID NO: 2204027 - DNA, 22 bp, Homo sapiens
tgtctattttgtaactgtaaag

SEQ ID NO: 2204028 - DNA, 22 bp, Homo sapiens
tgtcttcatacctacatgtatt

SEQ ID NO: 2204029 - DNA, 15 bp, Homo sapiens
tgtctttcttgtaag

SEQ ID NO: 2204030 - DNA, 14 bp, Homo sapiens
tgtgaactaaactt

SEQ ID NO: 2204031 - DNA, 19 bp, Homo sapiens
tgtgaactaaactttcaca

SEQ ID NO: 2204032 - DNA, 23 bp, Homo sapiens
tgtgacggcagggaaatgtatgt

SEQ ID NO: 2204033 - DNA, 15 bp, Homo sapiens
tgtgactgaatttct

SEQ ID NO: 2204034 - DNA, 21 bp, Homo sapiens
tgtgccctaaagtgtattttt

SEQ ID NO: 2204035 - DNA, 17 bp, Homo sapiens
tgtgcctaatgtgtttg

SEQ ID NO: 2204036 - DNA, 20 bp, Homo sapiens
tgtggatttaacagaaatgt

SEQ ID NO: 2204037 - DNA, 15 bp, Homo sapiens
tgtggtcaacatttc

SEQ ID NO: 2204038 - DNA, 22 bp, Homo sapiens
tgtgttatcacccagaagaaaa

SEQ ID NO: 2204039 - DNA, 20 bp, Homo sapiens
tgttaagtatcagctacaat

SEQ ID NO: 2204040 - DNA, 24 bp, Homo sapiens
tgttaagtatcagctacaattgta

SEQ ID NO: 2204041 - DNA, 15 bp, Homo sapiens
tgttaatatttcttc

SEQ ID NO: 2204042 - DNA, 19 bp, Homo sapiens
tgttagtatgaggcatttg

SEQ ID NO: 2204043 - DNA, 20 bp, Homo sapiens
tgttagtatgaggcatttgt

SEQ ID NO: 2204044 - DNA, 13 bp, Homo sapiens
tgttatataaatg

SEQ ID NO: 2204045 - DNA, 14 bp, Homo sapiens
tgttatataaatgg

SEQ ID NO: 2204046 - DNA, 14 bp, Homo sapiens
tgttatttattgaa

SEQ ID NO: 2204047 - DNA, 15 bp, Homo sapiens
tgttatttattgaaa

SEQ ID NO: 2204048 - DNA, 17 bp, Homo sapiens
tgttatttattgaaatg

SEQ ID NO: 2204049 - DNA, 21 bp, Homo sapiens
tgttctccagtcattatgtta

SEQ ID NO: 2204050 - DNA, 16 bp, Homo sapiens
tgttcttaattcttag

SEQ ID NO: 2204051 - DNA, 18 bp, Homo sapiens
tgttctttccaaagtaca

SEQ ID NO: 2204052 - DNA, 23 bp, Homo sapiens
tgttctttctggctatgcatttg

SEQ ID NO: 2204053 - DNA, 17 bp, Homo sapiens
tgttgaagctttaagaa

SEQ ID NO: 2204054 - DNA, 13 bp, Homo sapiens
tgtttaatgttaa

SEQ ID NO: 2204055 - DNA, 14 bp, Homo sapiens
tgtttaatgttaat

SEQ ID NO: 2204056 - DNA, 15 bp, Homo sapiens
tgtttaatgttaatt

SEQ ID NO: 2204057 - DNA, 15 bp, Homo sapiens
tgtttagatgaatgt

SEQ ID NO: 2204058 - DNA, 22 bp, Homo sapiens
tgtttgagcatcgcttaggaga

SEQ ID NO: 2204059 - DNA, 23 bp, Homo sapiens
tgttttaaggatgcttgtacata

SEQ ID NO: 2204060 - DNA, 13 bp, Homo sapiens
tgttttcaaatgt

SEQ ID NO: 2204061 - DNA, 15 bp, Homo sapiens
ttaaaaatctcaaat

SEQ ID NO: 2204062 - DNA, 17 bp, Homo sapiens
ttaaaaatctcaaattt

SEQ ID NO: 2204063 - DNA, 22 bp, Homo sapiens
ttaaaggaaggttctggtgtga

SEQ ID NO: 2204064 - DNA, 20 bp, Homo sapiens
ttaaataaaatttttatgta

SEQ ID NO: 2204065 - DNA, 19 bp, Homo sapiens
ttaaataatgtgaaactgg

SEQ ID NO: 2204066 - DNA, 20 bp, Homo sapiens
ttaaataatgtgaaactgga

SEQ ID NO: 2204067 - DNA, 12 bp, Homo sapiens
ttaacagaaatg

SEQ ID NO: 2204068 - DNA, 14 bp, Homo sapiens
ttaacagaaatgta

SEQ ID NO: 2204069 - DNA, 19 bp, Homo sapiens
ttaacagaaatgtacagca

SEQ ID NO: 2204070 - DNA, 20 bp, Homo sapiens
ttaacagaaatgtacagcaa

SEQ ID NO: 2204071 - DNA, 12 bp, Homo sapiens
ttaacttttata

SEQ ID NO: 2204072 - DNA, 17 bp, Homo sapiens
ttaacttttataaactt

SEQ ID NO: 2204073 - DNA, 17 bp, Homo sapiens
ttaaggatgcttgtaca

SEQ ID NO: 2204074 - DNA, 20 bp, Homo sapiens
ttaaggatgcttgtacataa

SEQ ID NO: 2204075 - DNA, 22 bp, Homo sapiens
ttaaggatgcttgtacataatg

SEQ ID NO: 2204076 - DNA, 18 bp, Homo sapiens
ttaaggattttatgcttt

SEQ ID NO: 2204077 - DNA, 18 bp, Homo sapiens
ttaagtctgttttatgac

SEQ ID NO: 2204078 - DNA, 22 bp, Homo sapiens
ttaagtgctgcatttaaaagat

SEQ ID NO: 2204079 - DNA, 18 bp, Homo sapiens
ttaatatcatcagtattg

SEQ ID NO: 2204080 - DNA, 17 bp, Homo sapiens
ttaatattttatgtgta

SEQ ID NO: 2204081 - DNA, 18 bp, Homo sapiens
ttaatattttatgtgtaa

SEQ ID NO: 2204082 - DNA, 19 bp, Homo sapiens
ttaatggtagttttacagt

SEQ ID NO: 2204083 - DNA, 20 bp, Homo sapiens
ttacatttttaagtgctgca

SEQ ID NO: 2204084 - DNA, 19 bp, Homo sapiens
ttaccttttttatacataa

SEQ ID NO: 2204085 - DNA, 21 bp, Homo sapiens
ttaggtgtgactgaatttctt

SEQ ID NO: 2204086 - DNA, 18 bp, Homo sapiens
ttagtatgtgcatttaat

SEQ ID NO: 2204087 - DNA, 13 bp, Homo sapiens
ttataaactttac

SEQ ID NO: 2204088 - DNA, 17 bp, Homo sapiens
ttataaactttaccttt

SEQ ID NO: 2204089 - DNA, 17 bp, Homo sapiens
ttataaatcgcttttga

SEQ ID NO: 2204090 - DNA, 18 bp, Homo sapiens
ttataaatcgcttttgat

SEQ ID NO: 2204091 - DNA, 13 bp, Homo sapiens
ttataatcacttt

SEQ ID NO: 2204092 - DNA, 19 bp, Homo sapiens
ttatcacccagaagaaaat

SEQ ID NO: 2204093 - DNA, 16 bp, Homo sapiens
ttatgcatgaagtaat

SEQ ID NO: 2204094 - DNA, 14 bp, Homo sapiens
ttatgctttaaaca

SEQ ID NO: 2204095 - DNA, 18 bp, Homo sapiens
ttatggcttttgtgcatt

SEQ ID NO: 2204096 - DNA, 19 bp, Homo sapiens
ttatggcttttgtgcatta

SEQ ID NO: 2204097 - DNA, 22 bp, Homo sapiens
ttattgaaatgatttcacagtg

SEQ ID NO: 2204098 - DNA, 18 bp, Homo sapiens
ttattttattatgcatga

SEQ ID NO: 2204099 - DNA, 17 bp, Homo sapiens
ttcacagcacttacaat

SEQ ID NO: 2204100 - DNA, 19 bp, Homo sapiens
ttcacagcacttacaattt

SEQ ID NO: 2204101 - DNA, 17 bp, Homo sapiens
ttcacatattgatttcc

SEQ ID NO: 2204102 - DNA, 16 bp, Homo sapiens
ttcagaaatgtgttat

SEQ ID NO: 2204103 - DNA, 17 bp, Homo sapiens
ttcagatctctaacttc

SEQ ID NO: 2204104 - DNA, 13 bp, Homo sapiens
ttcatatttaatt

SEQ ID NO: 2204105 - DNA, 15 bp, Homo sapiens
ttcatatttaatttg

SEQ ID NO: 2204106 - DNA, 18 bp, Homo sapiens
ttcattaataataaattc

SEQ ID NO: 2204107 - DNA, 13 bp, Homo sapiens
ttccaaagtacac

SEQ ID NO: 2204108 - DNA, 17 bp, Homo sapiens
ttccctggcctttcata

SEQ ID NO: 2204109 - DNA, 13 bp, Homo sapiens
ttcctgcaatgaa

SEQ ID NO: 2204110 - DNA, 21 bp, Homo sapiens
ttcctgcaatgaagtctctga

SEQ ID NO: 2204111 - DNA, 18 bp, Homo sapiens
ttctaaaggctacctttg

SEQ ID NO: 2204112 - DNA, 19 bp, Homo sapiens
ttctaaaggctacctttgt

SEQ ID NO: 2204113 - DNA, 19 bp, Homo sapiens
ttctaaatctccaaaataa

SEQ ID NO: 2204114 - DNA, 17 bp, Homo sapiens
ttctccagtcattatgt

SEQ ID NO: 2204115 - DNA, 15 bp, Homo sapiens
ttctctagtcatttg

SEQ ID NO: 2204116 - DNA, 13 bp, Homo sapiens
aattatatatact

SEQ ID NO: 2204117 - DNA, 15 bp, Homo sapiens
aattctctagtttga

SEQ ID NO: 2204118 - DNA, 21 bp, Homo sapiens
aatttctaaatctccaaaata

SEQ ID NO: 2204119 - DNA, 17 bp, Homo sapiens
aatttgtgatacaatgc

SEQ ID NO: 2204120 - DNA, 18 bp, Homo sapiens
aatttgtgatacaatgct

SEQ ID NO: 2204121 - DNA, 14 bp, Homo sapiens
aattttgatgtttt

SEQ ID NO: 2204122 - DNA, 16 bp, Homo sapiens
acaagaccacgtttct

SEQ ID NO: 2204123 - DNA, 17 bp, Homo sapiens
acaagaccacgtttcta

SEQ ID NO: 2204124 - DNA, 22 bp, Homo sapiens
acaatgctgtgccctaaagtgt

SEQ ID NO: 2204125 - DNA, 24 bp, Homo sapiens
acaatgctgtgccctaaagtgtat

SEQ ID NO: 2204126 - DNA, 21 bp, Homo sapiens
acacactgcatgtttgtgatt

SEQ ID NO: 2204127 - DNA, 23 bp, Homo sapiens
acacacttttggttaagtctgtt

SEQ ID NO: 2204128 - DNA, 18 bp, Homo sapiens
acacatgcaaggtcattt

SEQ ID NO: 2204129 - DNA, 14 bp, Homo sapiens
acacattttatttt

SEQ ID NO: 2204130 - DNA, 20 bp, Homo sapiens
acacattttattttattatg

SEQ ID NO: 2204131 - DNA, 12 bp, Homo sapiens
acacatttttct

SEQ ID NO: 2204132 - DNA, 18 bp, Homo sapiens
acacattttttaaatgca

SEQ ID NO: 2204133 - DNA, 19 bp, Homo sapiens
acacattttttaaatgcac

SEQ ID NO: 2204134 - DNA, 17 bp, Homo sapiens
acaccactacattctgt

SEQ ID NO: 2204135 - DNA, 21 bp, Homo sapiens
acaccccagacgatgtcttca

SEQ ID NO: 2204136 - DNA, 15 bp, Homo sapiens
acactgcatgtttgt

SEQ ID NO: 2204137 - DNA, 18 bp, Homo sapiens
acagacatactaaccagc

SEQ ID NO: 2204138 - DNA, 16 bp, Homo sapiens
acagagttgttacatt

SEQ ID NO: 2204139 - DNA, 17 bp, Homo sapiens
acagagttgttacattt

SEQ ID NO: 2204140 - DNA, 18 bp, Homo sapiens
acagagttgttacatttt

SEQ ID NO: 2204141 - DNA, 19 bp, Homo sapiens
acagagttgttacattttt

SEQ ID NO: 2204142 - DNA, 20 bp, Homo sapiens
acagagttgttacattttta

SEQ ID NO: 2204143 - DNA, 21 bp, Homo sapiens
acagcaaggagatttacaact

SEQ ID NO: 2204144 - DNA, 17 bp, Homo sapiens
acagcacttacaatttt

SEQ ID NO: 2204145 - DNA, 21 bp, Homo sapiens
acagtgtgtggtcaacatttc

SEQ ID NO: 2204146 - DNA, 20 bp, Homo sapiens
acagttactcagaattctct

SEQ ID NO: 2204147 - DNA, 19 bp, Homo sapiens
acagttttggttgctttaa

SEQ ID NO: 2204148 - DNA, 22 bp, Homo sapiens
acataatgcgtgcataccactt

SEQ ID NO: 2204149 - DNA, 22 bp, Homo sapiens
acatactaaccagcagaaatgc

SEQ ID NO: 2204150 - DNA, 14 bp, Homo sapiens
acatattgatttcc

SEQ ID NO: 2204151 - DNA, 16 bp, Homo sapiens
acatattgatttccgt

SEQ ID NO: 2204152 - DNA, 22 bp, Homo sapiens
acatattgatttccgttaaaat

SEQ ID NO: 2204153 - DNA, 23 bp, Homo sapiens
acatattgatttccgttaaaata

SEQ ID NO: 2204154 - DNA, 20 bp, Homo sapiens
acatcagcacgatttctgtt

SEQ ID NO: 2204155 - DNA, 22 bp, Homo sapiens
acatcagcacgatttctgttta

SEQ ID NO: 2204156 - DNA, 13 bp, Homo sapiens
acatctgttttgt

SEQ ID NO: 2204157 - DNA, 16 bp, Homo sapiens
acatgaaaacacattt

SEQ ID NO: 2204158 - DNA, 18 bp, Homo sapiens
acatgaaaacacattttt

SEQ ID NO: 2204159 - DNA, 19 bp, Homo sapiens
acatgaaaacacatttttc

SEQ ID NO: 2204160 - DNA, 21 bp, Homo sapiens
acatgctacacactgcatgtt

SEQ ID NO: 2204161 - DNA, 18 bp, Homo sapiens
acatgtatgtaaatagct

SEQ ID NO: 2204162 - DNA, 16 bp, Homo sapiens
acatgtatttgtttgc

SEQ ID NO: 2204163 - DNA, 17 bp, Homo sapiens
acatgtatttgtttgca

SEQ ID NO: 2204164 - DNA, 20 bp, Homo sapiens
acatgtcagccactgtgata

SEQ ID NO: 2204165 - DNA, 15 bp, Homo sapiens
acattctgttaatca

SEQ ID NO: 2204166 - DNA, 16 bp, Homo sapiens
acattggttcttgtat

SEQ ID NO: 2204167 - DNA, 22 bp, Homo sapiens
acattggttcttgtattaagaa

SEQ ID NO: 2204168 - DNA, 17 bp, Homo sapiens
acatttctcatgttgaa

SEQ ID NO: 2204169 - DNA, 13 bp, Homo sapiens
acattttatgtct

SEQ ID NO: 2204170 - DNA, 19 bp, Homo sapiens
acattttattttattatgc

SEQ ID NO: 2204171 - DNA, 20 bp, Homo sapiens
acattttattttattatgca

SEQ ID NO: 2204172 - DNA, 23 bp, Homo sapiens
acatttttcttagggaaggatac

SEQ ID NO: 2204173 - DNA, 21 bp, Homo sapiens
accacagacatactaaccagc

SEQ ID NO: 2204174 - DNA, 14 bp, Homo sapiens
accacctttcagat

SEQ ID NO: 2204175 - DNA, 13 bp, Homo sapiens
accacgtttctaa

SEQ ID NO: 2204176 - DNA, 17 bp, Homo sapiens
accactacattctgtta

SEQ ID NO: 2204177 - DNA, 20 bp, Homo sapiens
accactctatcaagtattat

SEQ ID NO: 2204178 - DNA, 22 bp, Homo sapiens
accacttttgttcttggtttgt

SEQ ID NO: 2204179 - DNA, 15 bp, Homo sapiens
accactttttgcagc

SEQ ID NO: 2204180 - DNA, 17 bp, Homo sapiens
accactttttgcagctt

SEQ ID NO: 2204181 - DNA, 15 bp, Homo sapiens
accagtgttgtggat

SEQ ID NO: 2204182 - DNA, 16 bp, Homo sapiens
acctctccagcctcag

SEQ ID NO: 2204183 - DNA, 20 bp, Homo sapiens
acctctgcagcaataaagca

SEQ ID NO: 2204184 - DNA, 21 bp, Homo sapiens
acctctgcagcaataaagcag

SEQ ID NO: 2204185 - DNA, 17 bp, Homo sapiens
acctcttgagccttgaa

SEQ ID NO: 2204186 - DNA, 21 bp, Homo sapiens
acctcttgagccttgaacttt

SEQ ID NO: 2204187 - DNA, 20 bp, Homo sapiens
acctgcacactgtcctatta

SEQ ID NO: 2204188 - DNA, 14 bp, Homo sapiens
accttttttataca

SEQ ID NO: 2204189 - DNA, 18 bp, Homo sapiens
accttttttatacataaa

SEQ ID NO: 2204190 - DNA, 12 bp, Homo sapiens
acgatttctgtt

SEQ ID NO: 2204191 - DNA, 13 bp, Homo sapiens
acgatttctgttt

SEQ ID NO: 2204192 - DNA, 14 bp, Homo sapiens
acgatttctgttta

SEQ ID NO: 2204193 - DNA, 12 bp, Homo sapiens
acgtacacattt

SEQ ID NO: 2204194 - DNA, 14 bp, Homo sapiens
acgtacacatttta

SEQ ID NO: 2204195 - DNA, 16 bp, Homo sapiens
acgtgatttttaaatt

SEQ ID NO: 2204196 - DNA, 13 bp, Homo sapiens
acgttgtgcattt

SEQ ID NO: 2204197 - DNA, 14 bp, Homo sapiens
acgttgtgcatttg

SEQ ID NO: 2204198 - DNA, 15 bp, Homo sapiens
acgttgtgcatttgg

SEQ ID NO: 2204199 - DNA, 13 bp, Homo sapiens
actaaacatgtat

SEQ ID NO: 2204200 - DNA, 16 bp, Homo sapiens
actaaacatgtatgta

SEQ ID NO: 2204201 - DNA, 15 bp, Homo sapiens
actaaactttcacac

SEQ ID NO: 2204202 - DNA, 15 bp, Homo sapiens
actaagtttttatgg

SEQ ID NO: 2204203 - DNA, 15 bp, Homo sapiens
actaatagacaattt

SEQ ID NO: 2204204 - DNA, 13 bp, Homo sapiens
actacagtttgtt

SEQ ID NO: 2204205 - DNA, 15 bp, Homo sapiens
actacattctgttaa

SEQ ID NO: 2204206 - DNA, 22 bp, Homo sapiens
actcagaattctctagtttgat

SEQ ID NO: 2204207 - DNA, 17 bp, Homo sapiens
actccaattaaggattt

SEQ ID NO: 2204208 - DNA, 16 bp, Homo sapiens
actctacctgcacact

SEQ ID NO: 2204209 - DNA, 16 bp, Homo sapiens
actctatcaagtatta

SEQ ID NO: 2204210 - DNA, 21 bp, Homo sapiens
actctatcaagtattatacct

SEQ ID NO: 2204211 - DNA, 19 bp, Homo sapiens
actctcccattatatttat

SEQ ID NO: 2204212 - DNA, 20 bp, Homo sapiens
actctcccattatatttatt

SEQ ID NO: 2204213 - DNA, 12 bp, Homo sapiens
actgaatttctt

SEQ ID NO: 2204214 - DNA, 23 bp, Homo sapiens
actgaatttcttttgccgttatt

SEQ ID NO: 2204215 - DNA, 18 bp, Homo sapiens
actgagtacgttgtgcat

SEQ ID NO: 2204216 - DNA, 21 bp, Homo sapiens
actgagtacgttgtgcatttg

SEQ ID NO: 2204217 - DNA, 20 bp, Homo sapiens
actgcttaacttcacatatt

SEQ ID NO: 2204218 - DNA, 15 bp, Homo sapiens
actggattaaactta

SEQ ID NO: 2204219 - DNA, 22 bp, Homo sapiens
actggattaaacttaatctaaa

SEQ ID NO: 2204220 - DNA, 16 bp, Homo sapiens
actgggctgaacactc

SEQ ID NO: 2204221 - DNA, 17 bp, Homo sapiens
actgtaaagatgaatgt

SEQ ID NO: 2204222 - DNA, 14 bp, Homo sapiens
actgtacatgaaaa

SEQ ID NO: 2204223 - DNA, 20 bp, Homo sapiens
actgtacatgaaaacacatt

SEQ ID NO: 2204224 - DNA, 16 bp, Homo sapiens
actgtatcatgacaaa

SEQ ID NO: 2204225 - DNA, 16 bp, Homo sapiens
actgtcctattatatt

SEQ ID NO: 2204226 - DNA, 18 bp, Homo sapiens
actgtcctattatattca

SEQ ID NO: 2204227 - DNA, 13 bp, Homo sapiens
actgttatttata

SEQ ID NO: 2204228 - DNA, 23 bp, Homo sapiens
actgtttgaggtttttaagcctt

SEQ ID NO: 2204229 - DNA, 14 bp, Homo sapiens
acttaaataatgtg

SEQ ID NO: 2204230 - DNA, 17 bp, Homo sapiens
acttaaataatgtgaaa

SEQ ID NO: 2204231 - DNA, 18 bp, Homo sapiens
acttaaataatgtgaaac

SEQ ID NO: 2204232 - DNA, 15 bp, Homo sapiens
acttaatctaaatgg

SEQ ID NO: 2204233 - DNA, 19 bp, Homo sapiens
acttaatctaaatggaacc

SEQ ID NO: 2204234 - DNA, 13 bp, Homo sapiens
acttactgtacat

SEQ ID NO: 2204235 - DNA, 16 bp, Homo sapiens
acttactgtacatgaa

SEQ ID NO: 2204236 - DNA, 21 bp, Homo sapiens
acttactgtacatgaaaacac

SEQ ID NO: 2204237 - DNA, 22 bp, Homo sapiens
acttactgtacatgaaaacaca

SEQ ID NO: 2204238 - DNA, 17 bp, Homo sapiens
acttaggagaagtcttc

SEQ ID NO: 2204239 - DNA, 23 bp, Homo sapiens
acttcacatattgatttccgtta

SEQ ID NO: 2204240 - DNA, 12 bp, Homo sapiens
acttgcacactc

SEQ ID NO: 2204241 - DNA, 23 bp, Homo sapiens
acttgcacactctcccattatat

SEQ ID NO: 2204242 - DNA, 12 bp, Homo sapiens
actttgacctct

SEQ ID NO: 2204243 - DNA, 13 bp, Homo sapiens
actttgacctctg

SEQ ID NO: 2204244 - DNA, 13 bp, Homo sapiens
acttttataaact

SEQ ID NO: 2204245 - DNA, 19 bp, Homo sapiens
acttttataaactttacct

SEQ ID NO: 2204246 - DNA, 12 bp, Homo sapiens
acttttgttctt

SEQ ID NO: 2204247 - DNA, 14 bp, Homo sapiens
agaaatgtacagca

SEQ ID NO: 2204248 - DNA, 16 bp, Homo sapiens
agaaatgtacagcaag

SEQ ID NO: 2204249 - DNA, 17 bp, Homo sapiens
agaaatgtacagcaagg

SEQ ID NO: 2204250 - DNA, 17 bp, Homo sapiens
agaaattaagtatctga

SEQ ID NO: 2204251 - DNA, 20 bp, Homo sapiens
agaaggcaaatgactttgga

SEQ ID NO: 2204252 - DNA, 20 bp, Homo sapiens
agaatgaaatactgtttgag

SEQ ID NO: 2204253 - DNA, 21 bp, Homo sapiens
ctctgtgagcatcacagtttt

SEQ ID NO: 2204254 - DNA, 19 bp, Homo sapiens
ctcttcagatctctaactt

SEQ ID NO: 2204255 - DNA, 16 bp, Homo sapiens
ctcttgagccttgaac

SEQ ID NO: 2204256 - DNA, 18 bp, Homo sapiens
ctgaacactccaattaag

SEQ ID NO: 2204257 - DNA, 19 bp, Homo sapiens
ctgaagtgaaactgcttgt

SEQ ID NO: 2204258 - DNA, 14 bp, Homo sapiens
ctgaatttcttttg

SEQ ID NO: 2204259 - DNA, 17 bp, Homo sapiens
ctgagtacgttgtgcat

SEQ ID NO: 2204260 - DNA, 19 bp, Homo sapiens
ctgagtacgttgtgcattt

SEQ ID NO: 2204261 - DNA, 23 bp, Homo sapiens
ctgattcatatttaatttgaaga

SEQ ID NO: 2204262 - DNA, 16 bp, Homo sapiens
ctgcagcaataaagca

SEQ ID NO: 2204263 - DNA, 15 bp, Homo sapiens
ctgcatgtttgtgat

SEQ ID NO: 2204264 - DNA, 22 bp, Homo sapiens
ctgcatttaaaagatacagtta

SEQ ID NO: 2204265 - DNA, 13 bp, Homo sapiens
ctgcttaacttca

SEQ ID NO: 2204266 - DNA, 17 bp, Homo sapiens
ctggacttggcccctgc

SEQ ID NO: 2204267 - DNA, 23 bp, Homo sapiens
ctggattaaacttaatctaaatg

SEQ ID NO: 2204268 - DNA, 14 bp, Homo sapiens
ctggcctagcatac

SEQ ID NO: 2204269 - DNA, 13 bp, Homo sapiens
ctggctatgcatt

SEQ ID NO: 2204270 - DNA, 15 bp, Homo sapiens
ctggctatgcatttg

SEQ ID NO: 2204271 - DNA, 13 bp, Homo sapiens
ctgggttcctgca

SEQ ID NO: 2204272 - DNA, 16 bp, Homo sapiens
ctgtaaagatgaatgt

SEQ ID NO: 2204273 - DNA, 17 bp, Homo sapiens
ctgtaatttgtgataca

SEQ ID NO: 2204274 - DNA, 18 bp, Homo sapiens
ctgtaatttgtgatacaa

SEQ ID NO: 2204275 - DNA, 17 bp, Homo sapiens
ctgtacatgaaaacaca

SEQ ID NO: 2204276 - DNA, 21 bp, Homo sapiens
ctgtacatgaaaacacatttt

SEQ ID NO: 2204277 - DNA, 23 bp, Homo sapiens
ctgtacatgaaaacacatttttc

SEQ ID NO: 2204278 - DNA, 21 bp, Homo sapiens
ctgtcctattatattcattct

SEQ ID NO: 2204279 - DNA, 12 bp, Homo sapiens
ctgtttagataa

SEQ ID NO: 2204280 - DNA, 17 bp, Homo sapiens
ctgtttagataatacac

SEQ ID NO: 2204281 - DNA, 14 bp, Homo sapiens
cttaatctaaatgg

SEQ ID NO: 2204282 - DNA, 16 bp, Homo sapiens
cttaatctaaatggaa

SEQ ID NO: 2204283 - DNA, 16 bp, Homo sapiens
cttaattattgatgtt

SEQ ID NO: 2204284 - DNA, 22 bp, Homo sapiens
cttagctcattctccttgtgtt

SEQ ID NO: 2204285 - DNA, 23 bp, Homo sapiens
cttagctcattctccttgtgtta

SEQ ID NO: 2204286 - DNA, 21 bp, Homo sapiens
cttagggaaggatacaaaagc

SEQ ID NO: 2204287 - DNA, 14 bp, Homo sapiens
cttcacatattgat

SEQ ID NO: 2204288 - DNA, 20 bp, Homo sapiens
cttcatacctacatgtattt

SEQ ID NO: 2204289 - DNA, 16 bp, Homo sapiens
cttcattaataataaa

SEQ ID NO: 2204290 - DNA, 12 bp, Homo sapiens
cttctatttatt

SEQ ID NO: 2204291 - DNA, 15 bp, Homo sapiens
cttctatttatttat

SEQ ID NO: 2204292 - DNA, 19 bp, Homo sapiens
cttctccatggccctgcca

SEQ ID NO: 2204293 - DNA, 19 bp, Homo sapiens
cttgaaatataggaactta

SEQ ID NO: 2204294 - DNA, 19 bp, Homo sapiens
cttggacattttatgtctt

SEQ ID NO: 2204295 - DNA, 20 bp, Homo sapiens
cttggacattttatgtcttt

SEQ ID NO: 2204296 - DNA, 20 bp, Homo sapiens
cttggtttgtaaattaactt

SEQ ID NO: 2204297 - DNA, 14 bp, Homo sapiens
cttgtattaagaat

SEQ ID NO: 2204298 - DNA, 22 bp, Homo sapiens
ctttaagaactaaaatgttcta

SEQ ID NO: 2204299 - DNA, 18 bp, Homo sapiens
ctttaatatcatcagtat

SEQ ID NO: 2204300 - DNA, 20 bp, Homo sapiens
ctttcagataactgttattt

SEQ ID NO: 2204301 - DNA, 22 bp, Homo sapiens
ctttccaaagtacactgtttca

SEQ ID NO: 2204302 - DNA, 18 bp, Homo sapiens
ctttctggctatgcattt

SEQ ID NO: 2204303 - DNA, 14 bp, Homo sapiens
ctttgacctctgca

SEQ ID NO: 2204304 - DNA, 15 bp, Homo sapiens
ctttgacctctgcag

SEQ ID NO: 2204305 - DNA, 17 bp, Homo sapiens
ctttgtattctctcctg

SEQ ID NO: 2204306 - DNA, 14 bp, Homo sapiens
cttttataaacttt

SEQ ID NO: 2204307 - DNA, 16 bp, Homo sapiens
cttttataaactttac

SEQ ID NO: 2204308 - DNA, 16 bp, Homo sapiens
cttttgccgttattaa

SEQ ID NO: 2204309 - DNA, 18 bp, Homo sapiens
cttttgtgcattatctag

SEQ ID NO: 2204310 - DNA, 18 bp, Homo sapiens
cttttttatacataaaca

SEQ ID NO: 2204311 - DNA, 18 bp, Homo sapiens
gaaaacacatttttctta

SEQ ID NO: 2204312 - DNA, 15 bp, Homo sapiens
gaaaacatgctacac

SEQ ID NO: 2204313 - DNA, 16 bp, Homo sapiens
gaaaacatgctacaca

SEQ ID NO: 2204314 - DNA, 19 bp, Homo sapiens
gaaaacatgctacacactg

SEQ ID NO: 2204315 - DNA, 22 bp, Homo sapiens
gaaatgtatgtgtgtctatttt

SEQ ID NO: 2204316 - DNA, 16 bp, Homo sapiens
gaactaaaatgttcta

SEQ ID NO: 2204317 - DNA, 16 bp, Homo sapiens
gaactaaactttcaca

SEQ ID NO: 2204318 - DNA, 17 bp, Homo sapiens
gaactaaactttcacac

SEQ ID NO: 2204319 - DNA, 17 bp, Homo sapiens
gaacttaaataatgtga

SEQ ID NO: 2204320 - DNA, 23 bp, Homo sapiens
gaactttgacctctgcagcaata

SEQ ID NO: 2204321 - DNA, 15 bp, Homo sapiens
gaagattctatgtta

SEQ ID NO: 2204322 - DNA, 23 bp, Homo sapiens
gaagattctatgttaatatttta

SEQ ID NO: 2204323 - DNA, 13 bp, Homo sapiens
gaagcattttata

SEQ ID NO: 2204324 - DNA, 20 bp, Homo sapiens
gaaggtagaatgttttcaaa

SEQ ID NO: 2204325 - DNA, 20 bp, Homo sapiens
gaaggttctggtgtgaacta

SEQ ID NO: 2204326 - DNA, 16 bp, Homo sapiens
gaagtcttctatttat

SEQ ID NO: 2204327 - DNA, 14 bp, Homo sapiens
gaagtgaaactgct

SEQ ID NO: 2204328 - DNA, 15 bp, Homo sapiens
gaatatataaccagt

SEQ ID NO: 2204329 - DNA, 18 bp, Homo sapiens
gaatgaaatactgtttga

SEQ ID NO: 2204330 - DNA, 19 bp, Homo sapiens
gaatgaaatactgtttgag

SEQ ID NO: 2204331 - DNA, 17 bp, Homo sapiens
gaattctctagtttgat

SEQ ID NO: 2204332 - DNA, 18 bp, Homo sapiens
gaatttccttactcttga

SEQ ID NO: 2204333 - DNA, 22 bp, Homo sapiens
gaatttcttttgccgttattaa

SEQ ID NO: 2204334 - DNA, 20 bp, Homo sapiens
gacaatgacttactgtacat

SEQ ID NO: 2204335 - DNA, 14 bp, Homo sapiens
gacacatgcaaggt

SEQ ID NO: 2204336 - DNA, 15 bp, Homo sapiens
gacatactaaccagc

SEQ ID NO: 2204337 - DNA, 17 bp, Homo sapiens
gacatatcacatgtcag

SEQ ID NO: 2204338 - DNA, 18 bp, Homo sapiens
gacatatcacatgtcagc

SEQ ID NO: 2204339 - DNA, 15 bp, Homo sapiens
gacattttatgtctt

SEQ ID NO: 2204340 - DNA, 14 bp, Homo sapiens
gacctctgcagcaa

SEQ ID NO: 2204341 - DNA, 18 bp, Homo sapiens
gacctctgcagcaataaa

SEQ ID NO: 2204342 - DNA, 22 bp, Homo sapiens
gacctctgcagcaataaagcag

SEQ ID NO: 2204343 - DNA, 21 bp, Homo sapiens
gactgagtacgttgtgcattt

SEQ ID NO: 2204344 - DNA, 18 bp, Homo sapiens
gacttactgtacatgaaa

SEQ ID NO: 2204345 - DNA, 21 bp, Homo sapiens
gagaggtttcgatatttattg

SEQ ID NO: 2204346 - DNA, 21 bp, Homo sapiens
gagggtgaagtgaagacaatg

SEQ ID NO: 2204347 - DNA, 16 bp, Homo sapiens
gagtacgttgtgcatt

SEQ ID NO: 2204348 - DNA, 17 bp, Homo sapiens
gagtacgttgtgcattt

SEQ ID NO: 2204349 - DNA, 22 bp, Homo sapiens
gagttgttacatttttaagtgc

SEQ ID NO: 2204350 - DNA, 18 bp, Homo sapiens
gataatacaccactacat

SEQ ID NO: 2204351 - DNA, 21 bp, Homo sapiens
gataatcaactgggctgaaca

SEQ ID NO: 2204352 - DNA, 17 bp, Homo sapiens
gatacaaaagcatgtga

SEQ ID NO: 2204353 - DNA, 16 bp, Homo sapiens
gatacagttactcaga

SEQ ID NO: 2204354 - DNA, 23 bp, Homo sapiens
gatacagttactcagaattctct

SEQ ID NO: 2204355 - DNA, 11 bp, Homo sapiens
gatactacagt

SEQ ID NO: 2204356 - DNA, 13 bp, Homo sapiens
gatataatttaaa

SEQ ID NO: 2204357 - DNA, 20 bp, Homo sapiens
gatatttattgatgttttca

SEQ ID NO: 2204358 - DNA, 21 bp, Homo sapiens
gatgcacagagttgttacatt

SEQ ID NO: 2204359 - DNA, 14 bp, Homo sapiens
gatgcttgtacata

SEQ ID NO: 2204360 - DNA, 16 bp, Homo sapiens
gatgcttgtacataat

SEQ ID NO: 2204361 - DNA, 15 bp, Homo sapiens
gattcatatttaatt

SEQ ID NO: 2204362 - DNA, 13 bp, Homo sapiens
gattctatgttaa

SEQ ID NO: 2204363 - DNA, 18 bp, Homo sapiens
gatttaacagaaatgtac

SEQ ID NO: 2204364 - DNA, 23 bp, Homo sapiens
gatttaacagaaatgtacagcaa

SEQ ID NO: 2204365 - DNA, 20 bp, Homo sapiens
gatttcacagtgtgtggtca

SEQ ID NO: 2204366 - DNA, 13 bp, Homo sapiens
gattttatgcttt

SEQ ID NO: 2204367 - DNA, 19 bp, Homo sapiens
gattttatgctttaaacat

SEQ ID NO: 2204368 - DNA, 13 bp, Homo sapiens
gatttttaaatta

SEQ ID NO: 2204369 - DNA, 12 bp, Homo sapiens
gcaaatgacttt

SEQ ID NO: 2204370 - DNA, 11 bp, Homo sapiens
gcaataaagca

SEQ ID NO: 2204371 - DNA, 21 bp, Homo sapiens
gcaataaagcagcgtttctat

SEQ ID NO: 2204372 - DNA, 17 bp, Homo sapiens
gcaatgaagtctctgaa

SEQ ID NO: 2204373 - DNA, 21 bp, Homo sapiens
gcacagagttgttacattttt

SEQ ID NO: 2204374 - DNA, 22 bp, Homo sapiens
gcacagagttgttacattttta

SEQ ID NO: 2204375 - DNA, 13 bp, Homo sapiens
gcacgatttctgt

SEQ ID NO: 2204376 - DNA, 15 bp, Homo sapiens
gcacgatttctgttt

SEQ ID NO: 2204377 - DNA, 16 bp, Homo sapiens
gcacgatttctgttta

SEQ ID NO: 2204378 - DNA, 21 bp, Homo sapiens
gcagagaggtttcgatattta

SEQ ID NO: 2204379 - DNA, 22 bp, Homo sapiens
gcagatattctctagtcatttg

SEQ ID NO: 2204380 - DNA, 19 bp, Homo sapiens
gcagtggtggttttctgtt

SEQ ID NO: 2204381 - DNA, 15 bp, Homo sapiens
gcatacgtacacatt

SEQ ID NO: 2204382 - DNA, 22 bp, Homo sapiens
gcatactgccttgtttaatggt

SEQ ID NO: 2204383 - DNA, 21 bp, Homo sapiens
gcataggtgatctcatttaat

SEQ ID NO: 2204384 - DNA, 17 bp, Homo sapiens
gcatatttaacaaaatt

SEQ ID NO: 2204385 - DNA, 21 bp, Homo sapiens
gcatgaagtaatatgcacaca

SEQ ID NO: 2204386 - DNA, 17 bp, Homo sapiens
gcatgtttgtgattgac

SEQ ID NO: 2204387 - DNA, 22 bp, Homo sapiens
gcattatctagatactgtatca

SEQ ID NO: 2204388 - DNA, 22 bp, Homo sapiens
gcatttaaaagatacagttact

SEQ ID NO: 2204389 - DNA, 20 bp, Homo sapiens
tggtcaacatttctcatgtt

SEQ ID NO: 2204390 - DNA, 22 bp, Homo sapiens
tggtcaacatttctcatgttga

SEQ ID NO: 2204391 - DNA, 14 bp, Homo sapiens
tggtcggaaaacat

SEQ ID NO: 2204392 - DNA, 18 bp, Homo sapiens
tggtggtttcagaaatgt

SEQ ID NO: 2204393 - DNA, 22 bp, Homo sapiens
tggtgtgaactaaactttcaca

SEQ ID NO: 2204394 - DNA, 18 bp, Homo sapiens
tggttaagtctgttttat

SEQ ID NO: 2204395 - DNA, 19 bp, Homo sapiens
tggttcttgtattaagaat

SEQ ID NO: 2204396 - DNA, 14 bp, Homo sapiens
tggttgctttaata

SEQ ID NO: 2204397 - DNA, 18 bp, Homo sapiens
tggttgctttaatatcat

SEQ ID NO: 2204398 - DNA, 14 bp, Homo sapiens
tggtttcagaaatg

SEQ ID NO: 2204399 - DNA, 21 bp, Homo sapiens
tggtttgtaaattaactttta

SEQ ID NO: 2204400 - DNA, 12 bp, Homo sapiens
tggttttctgtt

SEQ ID NO: 2204401 - DNA, 13 bp, Homo sapiens
tggttttctgttc

SEQ ID NO: 2204402 - DNA, 15 bp, Homo sapiens
tgtaaattaactttt

SEQ ID NO: 2204403 - DNA, 20 bp, Homo sapiens
tgtaatttttttatcgtcac

SEQ ID NO: 2204404 - DNA, 23 bp, Homo sapiens
tgtacagcaaggagatttacaac

SEQ ID NO: 2204405 - DNA, 14 bp, Homo sapiens
tgtacatgaaaaca

SEQ ID NO: 2204406 - DNA, 17 bp, Homo sapiens
tgtactctacaaaatat

SEQ ID NO: 2204407 - DNA, 19 bp, Homo sapiens
tgtactctacaaaatatag

SEQ ID NO: 2204408 - DNA, 12 bp, Homo sapiens
tgtattaagaat

SEQ ID NO: 2204409 - DNA, 16 bp, Homo sapiens
tgtattaagaatgaaa

SEQ ID NO: 2204410 - DNA, 20 bp, Homo sapiens
tgtattctctcctgtacctc

SEQ ID NO: 2204411 - DNA, 15 bp, Homo sapiens
tgtatttgtttgcat

SEQ ID NO: 2204412 - DNA, 16 bp, Homo sapiens
tgtatttttttactaa

SEQ ID NO: 2204413 - DNA, 20 bp, Homo sapiens
tgtcaaccccaagttagttc

SEQ ID NO: 2204414 - DNA, 17 bp, Homo sapiens
tgtcagttgttatttat

SEQ ID NO: 2204415 - DNA, 18 bp, Homo sapiens
tgtcagttgttatttatt

SEQ ID NO: 2204416 - DNA, 20 bp, Homo sapiens
tgtcagttgttatttattga

SEQ ID NO: 2204417 - DNA, 22 bp, Homo sapiens
tgtcagttgttatttattgaaa

SEQ ID NO: 2204418 - DNA, 16 bp, Homo sapiens
tgtctttcttgtaagg

SEQ ID NO: 2204419 - DNA, 23 bp, Homo sapiens
tgtgaaggcaggggaatgtatgt

SEQ ID NO: 2204420 - DNA, 15 bp, Homo sapiens
tgtgcacatctgttt

SEQ ID NO: 2204421 - DNA, 20 bp, Homo sapiens
tgtgcattatctagatactg

SEQ ID NO: 2204422 - DNA, 21 bp, Homo sapiens
tgtgcattatctagatactgt

SEQ ID NO: 2204423 - DNA, 23 bp, Homo sapiens
tgtgcattatctagatactgtat

SEQ ID NO: 2204424 - DNA, 20 bp, Homo sapiens
tgtgccctaaagtgtatttt

SEQ ID NO: 2204425 - DNA, 17 bp, Homo sapiens
tgtggtcaacatttctc

SEQ ID NO: 2204426 - DNA, 22 bp, Homo sapiens
tgtggtcaacatttctcatgtt

SEQ ID NO: 2204427 - DNA, 23 bp, Homo sapiens
tgtgttatcacccagaagaaaat

SEQ ID NO: 2204428 - DNA, 17 bp, Homo sapiens
tgttaatattttatgtg

SEQ ID NO: 2204429 - DNA, 13 bp, Homo sapiens
tgttacattttta

SEQ ID NO: 2204430 - DNA, 13 bp, Homo sapiens
tgttatttattga

SEQ ID NO: 2204431 - DNA, 19 bp, Homo sapiens
tgttcttggtttgtaaatt

SEQ ID NO: 2204432 - DNA, 20 bp, Homo sapiens
tgttcttggtttgtaaatta

SEQ ID NO: 2204433 - DNA, 22 bp, Homo sapiens
tgttcttggtttgtaaattaac

SEQ ID NO: 2204434 - DNA, 13 bp, Homo sapiens
tgttctttccaaa

SEQ ID NO: 2204435 - DNA, 14 bp, Homo sapiens
tgttctttccaaag

SEQ ID NO: 2204436 - DNA, 20 bp, Homo sapiens
tgttctttctggctatgcat

SEQ ID NO: 2204437 - DNA, 20 bp, Homo sapiens
tgtttccctctgtgttagag

SEQ ID NO: 2204438 - DNA, 22 bp, Homo sapiens
tgtttgaggtttttaagcctta

SEQ ID NO: 2204439 - DNA, 22 bp, Homo sapiens
tgttttagaagattctatgtta

SEQ ID NO: 2204440 - DNA, 18 bp, Homo sapiens
tgttttatgacttcatta

SEQ ID NO: 2204441 - DNA, 20 bp, Homo sapiens
ttaaaaatctcaaatttcta

SEQ ID NO: 2204442 - DNA, 17 bp, Homo sapiens
ttaaaagatacagttac

SEQ ID NO: 2204443 - DNA, 21 bp, Homo sapiens
ttaaaataccagccagtaaat

SEQ ID NO: 2204444 - DNA, 22 bp, Homo sapiens
ttaaacattggttcttgtatta

SEQ ID NO: 2204445 - DNA, 16 bp, Homo sapiens
ttaaacttaatctaaa

SEQ ID NO: 2204446 - DNA, 20 bp, Homo sapiens
ttaaacttaatctaaatgga

SEQ ID NO: 2204447 - DNA, 15 bp, Homo sapiens
ttaaataatgtgaaa

SEQ ID NO: 2204448 - DNA, 18 bp, Homo sapiens
ttaaataatgtgaaactg

SEQ ID NO: 2204449 - DNA, 11 bp, Homo sapiens
ttaaatgcacc

SEQ ID NO: 2204450 - DNA, 18 bp, Homo sapiens
ttaaatgcacctggaata

SEQ ID NO: 2204451 - DNA, 16 bp, Homo sapiens
ttaaattcttgcaaag

SEQ ID NO: 2204452 - DNA, 16 bp, Homo sapiens
ttaacagaaatgtaca

SEQ ID NO: 2204453 - DNA, 23 bp, Homo sapiens
ttaacttttataaactttacctt

SEQ ID NO: 2204454 - DNA, 20 bp, Homo sapiens
ttaagaaaaaggatgcacag

SEQ ID NO: 2204455 - DNA, 16 bp, Homo sapiens
ttaagaactaaaatgt

SEQ ID NO: 2204456 - DNA, 20 bp, Homo sapiens
ttaagaatgaaatactgttt

SEQ ID NO: 2204457 - DNA, 22 bp, Homo sapiens
ttaagaatgaaatactgtttga

SEQ ID NO: 2204458 - DNA, 20 bp, Homo sapiens
ttaaggattttatgctttaa

SEQ ID NO: 2204459 - DNA, 17 bp, Homo sapiens
ttaagtatctgacatct

SEQ ID NO: 2204460 - DNA, 17 bp, Homo sapiens
ttaagtctgttttatga

SEQ ID NO: 2204461 - DNA, 20 bp, Homo sapiens
ttaagtctgttttatgactt

SEQ ID NO: 2204462 - DNA, 15 bp, Homo sapiens
ttaagtgctgcattt

SEQ ID NO: 2204463 - DNA, 23 bp, Homo sapiens
ttaataataaattccctggcctt

SEQ ID NO: 2204464 - DNA, 12 bp, Homo sapiens
ttaatatttctt

SEQ ID NO: 2204465 - DNA, 16 bp, Homo sapiens
ttaatattttatgtgt

SEQ ID NO: 2204466 - DNA, 14 bp, Homo sapiens
ttaatgttaattat

SEQ ID NO: 2204467 - DNA, 15 bp, Homo sapiens
ttaattcttagctca

SEQ ID NO: 2204468 - DNA, 17 bp, Homo sapiens
ttacatttttaagtgct

SEQ ID NO: 2204469 - DNA, 23 bp, Homo sapiens
ttacatttttaagtgctgcattt

SEQ ID NO: 2204470 - DNA, 20 bp, Homo sapiens
ttaccttttttatacataaa

SEQ ID NO: 2204471 - DNA, 16 bp, Homo sapiens
ttactaatagacaatt

SEQ ID NO: 2204472 - DNA, 23 bp, Homo sapiens
ttactgtacatgaaaacacattt

SEQ ID NO: 2204473 - DNA, 13 bp, Homo sapiens
ttagtatgtgcat

SEQ ID NO: 2204474 - DNA, 14 bp, Homo sapiens
ttataaatcgcttt

SEQ ID NO: 2204475 - DNA, 17 bp, Homo sapiens
ttatcacccagaagaaa

SEQ ID NO: 2204476 - DNA, 17 bp, Homo sapiens
ttatctagatactgtat

SEQ ID NO: 2204477 - DNA, 22 bp, Homo sapiens
ttatgacttcattaataataaa

SEQ ID NO: 2204478 - DNA, 23 bp, Homo sapiens
ttatgcagtgtttccctctgtgt

SEQ ID NO: 2204479 - DNA, 22 bp, Homo sapiens
ttatgcatgaagtaatatgcac

SEQ ID NO: 2204480 - DNA, 13 bp, Homo sapiens
ttatgctttaaac

SEQ ID NO: 2204481 - DNA, 14 bp, Homo sapiens
ttatggcacatcag

SEQ ID NO: 2204482 - DNA, 16 bp, Homo sapiens
ttatggcttttgtgca

SEQ ID NO: 2204483 - DNA, 13 bp, Homo sapiens
ttatgttaatatt

SEQ ID NO: 2204484 - DNA, 23 bp, Homo sapiens
ttattaaaaatctcaaatttcta

SEQ ID NO: 2204485 - DNA, 15 bp, Homo sapiens
ttattgatgttttca

SEQ ID NO: 2204486 - DNA, 14 bp, Homo sapiens
ttatttattgaaat

SEQ ID NO: 2204487 - DNA, 20 bp, Homo sapiens
ttcaatctggattcatattt

SEQ ID NO: 2204488 - DNA, 23 bp, Homo sapiens
ttcaatctggattcatatttaat

SEQ ID NO: 2204489 - DNA, 11 bp, Homo sapiens
ttcagaaatgt

SEQ ID NO: 2204490 - DNA, 20 bp, Homo sapiens
ttcatatttaatttgaagat

SEQ ID NO: 2204491 - DNA, 20 bp, Homo sapiens
ttcatatttaatttgaaggt

SEQ ID NO: 2204492 - DNA, 21 bp, Homo sapiens
ttcattaataataaattccct

SEQ ID NO: 2204493 - DNA, 14 bp, Homo sapiens
ttcattagttttga

SEQ ID NO: 2204494 - DNA, 16 bp, Homo sapiens
ttccaaagtacactgt

SEQ ID NO: 2204495 - DNA, 12 bp, Homo sapiens
ttccatggcctc

SEQ ID NO: 2204496 - DNA, 16 bp, Homo sapiens
ttccctggcctttcat

SEQ ID NO: 2204497 - DNA, 14 bp, Homo sapiens
ttccgttaaaatac

SEQ ID NO: 2204498 - DNA, 16 bp, Homo sapiens
ttccgttaaaatacca

SEQ ID NO: 2204499 - DNA, 17 bp, Homo sapiens
ttcctagcacacacttt

SEQ ID NO: 2204500 - DNA, 18 bp, Homo sapiens
ttcgatatttattgatgt

SEQ ID NO: 2204501 - DNA, 21 bp, Homo sapiens
ttctaaaggctacctttgtat

SEQ ID NO: 2204502 - DNA, 21 bp, Homo sapiens
ttctaaatctccaaaataaaa

SEQ ID NO: 2204503 - DNA, 12 bp, Homo sapiens
ttctatgttaat

SEQ ID NO: 2204504 - DNA, 15 bp, Homo sapiens
ttctatgttaatatt

SEQ ID NO: 2204505 - DNA, 14 bp, Homo sapiens
ttctcatgttgaag

SEQ ID NO: 2204506 - DNA, 19 bp, Homo sapiens
ttctccagtcattatgtta

SEQ ID NO: 2204507 - DNA, 23 bp, Homo sapiens
ttctctagtcatttgttaatatt

SEQ ID NO: 2204508 - DNA, 21 bp, Homo sapiens
ttctctagtttgattaaattc

SEQ ID NO: 2204509 - DNA, 14 bp, Homo sapiens
ttctctcctgtacc

SEQ ID NO: 2204510 - DNA, 19 bp, Homo sapiens
ttctctcctgtacctcttg

SEQ ID NO: 2204511 - DNA, 16 bp, Homo sapiens
ttctggctatgcattt

SEQ ID NO: 2204512 - DNA, 18 bp, Homo sapiens
ttctggctatgcatttga

SEQ ID NO: 2204513 - DNA, 12 bp, Homo sapiens
ttctggtgtgaa

SEQ ID NO: 2204514 - DNA, 13 bp, Homo sapiens
ttcttggtttgta

SEQ ID NO: 2204515 - DNA, 19 bp, Homo sapiens
ttcttgtactctacaaaat

SEQ ID NO: 2204516 - DNA, 13 bp, Homo sapiens
ttcttgtattaag

SEQ ID NO: 2204517 - DNA, 12 bp, Homo sapiens
ttctttctggct

SEQ ID NO: 2204518 - DNA, 20 bp, Homo sapiens
ttcttttgccgttattaaaa

SEQ ID NO: 2204519 - DNA, 14 bp, Homo sapiens
ttgaaatgatttca

SEQ ID NO: 2204520 - DNA, 18 bp, Homo sapiens
ttgaactttgacctctgc

SEQ ID NO: 2204521 - DNA, 22 bp, Homo sapiens
ttgaagcattttataaatcgct

SEQ ID NO: 2204522 - DNA, 16 bp, Homo sapiens
ttgaaggtagaatgtt

SEQ ID NO: 2204523 - DNA, 16 bp, Homo sapiens
ttgacctctgcagcaa

SEQ ID NO: 2204524 - DNA, 14 bp, Homo sapiens
ttgagccttgaact

SEQ ID NO: 2204525 - DNA, 14 bp, Homo sapiens
aaaaatctcaaatt

SEQ ID NO: 2204526 - DNA, 13 bp, Homo sapiens
aaaacacattttt

SEQ ID NO: 2204527 - DNA, 15 bp, Homo sapiens
aaaacaggcaaattc

SEQ ID NO: 2204528 - DNA, 14 bp, Homo sapiens
aaaacatgctacac

SEQ ID NO: 2204529 - DNA, 15 bp, Homo sapiens
aaaacatgctacaca

SEQ ID NO: 2204530 - DNA, 21 bp, Homo sapiens
aaaagaggtttttcttaaata

SEQ ID NO: 2204531 - DNA, 13 bp, Homo sapiens
aaaaggatgcaca

SEQ ID NO: 2204532 - DNA, 14 bp, Homo sapiens
aaaaggatgcacag

SEQ ID NO: 2204533 - DNA, 19 bp, Homo sapiens
aaaaggatgcacagagttg

SEQ ID NO: 2204534 - DNA, 22 bp, Homo sapiens
aaaaggatgcacagagttgtta

SEQ ID NO: 2204535 - DNA, 15 bp, Homo sapiens
aaaagttattttgta

SEQ ID NO: 2204536 - DNA, 14 bp, Homo sapiens
aaaataaaactttt

SEQ ID NO: 2204537 - DNA, 17 bp, Homo sapiens
aaaataaaactttttaa

SEQ ID NO: 2204538 - DNA, 14 bp, Homo sapiens
aaaataccagccag

SEQ ID NO: 2204539 - DNA, 22 bp, Homo sapiens
aaaatctcaaatttctaaatct

SEQ ID NO: 2204540 - DNA, 18 bp, Homo sapiens
aaaatttttatgtaatta

SEQ ID NO: 2204541 - DNA, 19 bp, Homo sapiens
aaaatttttatgtaattat

SEQ ID NO: 2204542 - DNA, 18 bp, Homo sapiens
aaacattggttcttgtat

SEQ ID NO: 2204543 - DNA, 19 bp, Homo sapiens
aaactgcttgtttcctagc

SEQ ID NO: 2204544 - DNA, 14 bp, Homo sapiens
gaactaaactttca

SEQ ID NO: 2204545 - DNA, 18 bp, Homo sapiens
gaactaaactttcacacc

SEQ ID NO: 2204546 - DNA, 14 bp, Homo sapiens
gaacttaaataatg

SEQ ID NO: 2204547 - DNA, 22 bp, Homo sapiens
gaactttgacctctgcagcaat

SEQ ID NO: 2204548 - DNA, 22 bp, Homo sapiens
gaagacaatgacttactgtaca

SEQ ID NO: 2204549 - DNA, 17 bp, Homo sapiens
gaagattctatgttaat

SEQ ID NO: 2204550 - DNA, 12 bp, Homo sapiens
gaagatttaatt

SEQ ID NO: 2204551 - DNA, 17 bp, Homo sapiens
gaagcattttataaatc

SEQ ID NO: 2204552 - DNA, 21 bp, Homo sapiens
gaaggatacaaaagcatgtga

SEQ ID NO: 2204553 - DNA, 14 bp, Homo sapiens
gaaggcaaatgact

SEQ ID NO: 2204554 - DNA, 15 bp, Homo sapiens
gaaggcaaatgactt

SEQ ID NO: 2204555 - DNA, 16 bp, Homo sapiens
gaaggcaaatgacttt

SEQ ID NO: 2204556 - DNA, 15 bp, Homo sapiens
gaaggtagaatgttt

SEQ ID NO: 2204557 - DNA, 22 bp, Homo sapiens
gaagtaatatgcacacattttt

SEQ ID NO: 2204558 - DNA, 16 bp, Homo sapiens
gaagtctctgaagtga

SEQ ID NO: 2204559 - DNA, 21 bp, Homo sapiens
gaagtctctgaagtgaaactg

SEQ ID NO: 2204560 - DNA, 21 bp, Homo sapiens
gaatgtcagttgttatttatt

SEQ ID NO: 2204561 - DNA, 17 bp, Homo sapiens
gacaatgacttactgta

SEQ ID NO: 2204562 - DNA, 21 bp, Homo sapiens
gacaatgacttactgtacatg

SEQ ID NO: 2204563 - DNA, 14 bp, Homo sapiens
gaccacgtttctaa

SEQ ID NO: 2204564 - DNA, 16 bp, Homo sapiens
gacctctgcagcaata

SEQ ID NO: 2204565 - DNA, 16 bp, Homo sapiens
gactgaatttcttttg

SEQ ID NO: 2204566 - DNA, 18 bp, Homo sapiens
gactgagtacgttgtgca

SEQ ID NO: 2204567 - DNA, 15 bp, Homo sapiens
gacttactgtacatg

SEQ ID NO: 2204568 - DNA, 23 bp, Homo sapiens
gacttactgtacatgaaaacaca

SEQ ID NO: 2204569 - DNA, 15 bp, Homo sapiens
gacttggcccctgcc

SEQ ID NO: 2204570 - DNA, 13 bp, Homo sapiens
gagatttacaact

SEQ ID NO: 2204571 - DNA, 19 bp, Homo sapiens
gagccttgaactttgacct

SEQ ID NO: 2204572 - DNA, 19 bp, Homo sapiens
gaggcatttgtttgaactg

SEQ ID NO: 2204573 - DNA, 21 bp, Homo sapiens
gaggcatttgtttgaactgat

SEQ ID NO: 2204574 - DNA, 14 bp, Homo sapiens
gaggtctgttcttt

SEQ ID NO: 2204575 - DNA, 18 bp, Homo sapiens
gagtacgttgtgcatttg

SEQ ID NO: 2204576 - DNA, 19 bp, Homo sapiens
gagttgatactacagtttg

SEQ ID NO: 2204577 - DNA, 17 bp, Homo sapiens
gataactgttatttata

SEQ ID NO: 2204578 - DNA, 12 bp, Homo sapiens
gataatacacca

SEQ ID NO: 2204579 - DNA, 16 bp, Homo sapiens
gatacaaaagcatgtg

SEQ ID NO: 2204580 - DNA, 13 bp, Homo sapiens
gatacaatgctgt

SEQ ID NO: 2204581 - DNA, 12 bp, Homo sapiens
gatatttattga

SEQ ID NO: 2204582 - DNA, 15 bp, Homo sapiens
gatattttgctttgt

SEQ ID NO: 2204583 - DNA, 15 bp, Homo sapiens
gatatttttttcttt

SEQ ID NO: 2204584 - DNA, 14 bp, Homo sapiens
gatgaatgtcagtt

SEQ ID NO: 2204585 - DNA, 21 bp, Homo sapiens
gatgaatgtcagttgttattt

SEQ ID NO: 2204586 - DNA, 22 bp, Homo sapiens
gatgcacagagttgttacattt

SEQ ID NO: 2204587 - DNA, 12 bp, Homo sapiens
gattaaattctt

SEQ ID NO: 2204588 - DNA, 13 bp, Homo sapiens
gattcatatttaa

SEQ ID NO: 2204589 - DNA, 20 bp, Homo sapiens
gattctatgttaatatttta

SEQ ID NO: 2204590 - DNA, 14 bp, Homo sapiens
gattgaatctactt

SEQ ID NO: 2204591 - DNA, 23 bp, Homo sapiens
gattgacgggactgttggtattg

SEQ ID NO: 2204592 - DNA, 17 bp, Homo sapiens
gattgcgcctaatgtgt

SEQ ID NO: 2204593 - DNA, 14 bp, Homo sapiens
gatttaacagaaat

SEQ ID NO: 2204594 - DNA, 17 bp, Homo sapiens
gatttaacagaaatgta

SEQ ID NO: 2204595 - DNA, 17 bp, Homo sapiens
gatttaagatatgtaac

SEQ ID NO: 2204596 - DNA, 22 bp, Homo sapiens
gatttccgttaaaataccagcc

SEQ ID NO: 2204597 - DNA, 11 bp, Homo sapiens
gatttctgttt

SEQ ID NO: 2204598 - DNA, 21 bp, Homo sapiens
gatttctgtttagataataca

SEQ ID NO: 2204599 - DNA, 14 bp, Homo sapiens
gattttatgcttta

SEQ ID NO: 2204600 - DNA, 14 bp, Homo sapiens
gatttttaaattaa

SEQ ID NO: 2204601 - DNA, 13 bp, Homo sapiens
gcaaatgactttg

SEQ ID NO: 2204602 - DNA, 18 bp, Homo sapiens
gcaaggagatttacaact

SEQ ID NO: 2204603 - DNA, 16 bp, Homo sapiens
gcacagagttgttaca

SEQ ID NO: 2204604 - DNA, 19 bp, Homo sapiens
gcacatcagcacgatttct

SEQ ID NO: 2204605 - DNA, 21 bp, Homo sapiens
gcacatcagcacgatttctgt

SEQ ID NO: 2204606 - DNA, 15 bp, Homo sapiens
gcacatctgttttgt

SEQ ID NO: 2204607 - DNA, 18 bp, Homo sapiens
gcacctggaatatataac

SEQ ID NO: 2204608 - DNA, 21 bp, Homo sapiens
gcacctggaatatataaccag

SEQ ID NO: 2204609 - DNA, 13 bp, Homo sapiens
gcacttacaattt

SEQ ID NO: 2204610 - DNA, 12 bp, Homo sapiens
gcagcaataaag

SEQ ID NO: 2204611 - DNA, 23 bp, Homo sapiens
gcagcaataaagcagcgtttcta

SEQ ID NO: 2204612 - DNA, 21 bp, Homo sapiens
gcagccctgctgctgcctgcc

SEQ ID NO: 2204613 - DNA, 22 bp, Homo sapiens
gcagtggtggttttctgttctt

SEQ ID NO: 2204614 - DNA, 23 bp, Homo sapiens
gcagtggtggttttctgttcttt

SEQ ID NO: 2204615 - DNA, 15 bp, Homo sapiens
gcataccacttttgt

SEQ ID NO: 2204616 - DNA, 20 bp, Homo sapiens
gcataccacttttgttcttg

SEQ ID NO: 2204617 - DNA, 16 bp, Homo sapiens
gcatacgtacacattt

SEQ ID NO: 2204618 - DNA, 23 bp, Homo sapiens
gcatactgccttgtttaatgtta

SEQ ID NO: 2204619 - DNA, 22 bp, Homo sapiens
gcatgaagtaatatgcacacat

SEQ ID NO: 2204620 - DNA, 17 bp, Homo sapiens
gcattatctagatactg

SEQ ID NO: 2204621 - DNA, 17 bp, Homo sapiens
gcatttaaaagatacag

SEQ ID NO: 2204622 - DNA, 14 bp, Homo sapiens
gcatttgaaaattt

SEQ ID NO: 2204623 - DNA, 18 bp, Homo sapiens
gcatttgaggtctgttct

SEQ ID NO: 2204624 - DNA, 20 bp, Homo sapiens
gcatttgaggtctgttcttt

SEQ ID NO: 2204625 - DNA, 21 bp, Homo sapiens
gcatttgaggtctgttctttc

SEQ ID NO: 2204626 - DNA, 22 bp, Homo sapiens
gcatttggtggtttcagaaatg

SEQ ID NO: 2204627 - DNA, 23 bp, Homo sapiens
gcccctgccacctcctgcctcag

SEQ ID NO: 2204628 - DNA, 16 bp, Homo sapiens
gcctaatgtgtttgag

SEQ ID NO: 2204629 - DNA, 21 bp, Homo sapiens
gcctagcatacgtacacattt

SEQ ID NO: 2204630 - DNA, 23 bp, Homo sapiens
gccttgtttaatggtagttttac

SEQ ID NO: 2204631 - DNA, 20 bp, Homo sapiens
gctacacactgcatgtttgt

SEQ ID NO: 2204632 - DNA, 19 bp, Homo sapiens
gctagaggttcaaagatat

SEQ ID NO: 2204633 - DNA, 23 bp, Homo sapiens
gctgaacactccaattaaggatt

SEQ ID NO: 2204634 - DNA, 18 bp, Homo sapiens
gctgcatttaaaagatac

SEQ ID NO: 2204635 - DNA, 19 bp, Homo sapiens
gctgcatttaaaagataca

SEQ ID NO: 2204636 - DNA, 12 bp, Homo sapiens
gctgctgcctgc

SEQ ID NO: 2204637 - DNA, 16 bp, Homo sapiens
gctgctgcctgcctgg

SEQ ID NO: 2204638 - DNA, 23 bp, Homo sapiens
gcttgtttcctagcacacacttt

SEQ ID NO: 2204639 - DNA, 23 bp, Homo sapiens
gctttaagaactaaaatgttcta

SEQ ID NO: 2204640 - DNA, 23 bp, Homo sapiens
gctttaatatcatcagtattgaa

SEQ ID NO: 2204641 - DNA, 13 bp, Homo sapiens
gcttttgtgcatt

SEQ ID NO: 2204642 - DNA, 18 bp, Homo sapiens
ggaaaataaaatatttaa

SEQ ID NO: 2204643 - DNA, 18 bp, Homo sapiens
ggaaactgggttcctgca

SEQ ID NO: 2204644 - DNA, 22 bp, Homo sapiens
ggaagccaaacctctgtgagca

SEQ ID NO: 2204645 - DNA, 22 bp, Homo sapiens
ggagaagtcttctatttattta

SEQ ID NO: 2204646 - DNA, 20 bp, Homo sapiens
ggagatttacaactggggga

SEQ ID NO: 2204647 - DNA, 15 bp, Homo sapiens
ggatgcttgtacata

SEQ ID NO: 2204648 - DNA, 23 bp, Homo sapiens
ggcagggaaatgtatgtgtgtct

SEQ ID NO: 2204649 - DNA, 18 bp, Homo sapiens
ggccagtgagatcaatgt

SEQ ID NO: 2204650 - DNA, 22 bp, Homo sapiens
taaggatgcttgtacataatgc

SEQ ID NO: 2204651 - DNA, 22 bp, Homo sapiens
taaggattttatgctttaaaca

SEQ ID NO: 2204652 - DNA, 17 bp, Homo sapiens
taaggcatatttaacaa

SEQ ID NO: 2204653 - DNA, 16 bp, Homo sapiens
taagtatctgacatct

SEQ ID NO: 2204654 - DNA, 22 bp, Homo sapiens
taagtgctgcatttaaaagata

SEQ ID NO: 2204655 - DNA, 16 bp, Homo sapiens
taataaagatcatgta

SEQ ID NO: 2204656 - DNA, 14 bp, Homo sapiens
taatacaccactac

SEQ ID NO: 2204657 - DNA, 18 bp, Homo sapiens
taatacaccactacattc

SEQ ID NO: 2204658 - DNA, 23 bp, Homo sapiens
taatacaccactacattctgtta

SEQ ID NO: 2204659 - DNA, 18 bp, Homo sapiens
taatagacaatttattat

SEQ ID NO: 2204660 - DNA, 16 bp, Homo sapiens
taatatgcacacattt

SEQ ID NO: 2204661 - DNA, 18 bp, Homo sapiens
taatattttatgtgtaaa

SEQ ID NO: 2204662 - DNA, 17 bp, Homo sapiens
taatcacttttttccac

SEQ ID NO: 2204663 - DNA, 19 bp, Homo sapiens
taatcacttttttccacat

SEQ ID NO: 2204664 - DNA, 12 bp, Homo sapiens
taatctaaatgg

SEQ ID NO: 2204665 - DNA, 15 bp, Homo sapiens
taatgcgtgcatacc

SEQ ID NO: 2204666 - DNA, 22 bp, Homo sapiens
taatgcgtgcataccacttttg

SEQ ID NO: 2204667 - DNA, 16 bp, Homo sapiens
taatggtagttttaca

SEQ ID NO: 2204668 - DNA, 18 bp, Homo sapiens
taattattgatgttttca

SEQ ID NO: 2204669 - DNA, 20 bp, Homo sapiens
taatttgaagatagaaggtt

SEQ ID NO: 2204670 - DNA, 14 bp, Homo sapiens
taatttgtgataca

SEQ ID NO: 2204671 - DNA, 19 bp, Homo sapiens
taatttgtgatacaatgct

SEQ ID NO: 2204672 - DNA, 13 bp, Homo sapiens
tacaatgctgtgc

SEQ ID NO: 2204673 - DNA, 14 bp, Homo sapiens
tacaatgctgtgcc

SEQ ID NO: 2204674 - DNA, 15 bp, Homo sapiens
tacacactgcatgtt

SEQ ID NO: 2204675 - DNA, 21 bp, Homo sapiens
tacacattttattttattatg

SEQ ID NO: 2204676 - DNA, 15 bp, Homo sapiens
tacaccactacattc

SEQ ID NO: 2204677 - DNA, 16 bp, Homo sapiens
tacaccactacattct

SEQ ID NO: 2204678 - DNA, 17 bp, Homo sapiens
tacaccactacattctg

SEQ ID NO: 2204679 - DNA, 17 bp, Homo sapiens
tacactgtttcaaactt

SEQ ID NO: 2204680 - DNA, 18 bp, Homo sapiens
tacactgtttcaaacttt

SEQ ID NO: 2204681 - DNA, 22 bp, Homo sapiens
tacactgtttcaaactttacta

SEQ ID NO: 2204682 - DNA, 22 bp, Homo sapiens
tacagcaaggagatttacaact

SEQ ID NO: 2204683 - DNA, 13 bp, Homo sapiens
tacaggaacagaa

SEQ ID NO: 2204684 - DNA, 20 bp, Homo sapiens
tacataatgcgtgcatacca

SEQ ID NO: 2204685 - DNA, 24 bp, Homo sapiens
tacataatgcgtgcataccacttt

SEQ ID NO: 2204686 - DNA, 19 bp, Homo sapiens
tacatgaaaacacattttt

SEQ ID NO: 2204687 - DNA, 23 bp, Homo sapiens
tacatgaaaacacatttttctta

SEQ ID NO: 2204688 - DNA, 13 bp, Homo sapiens
tacatgtatttgt

SEQ ID NO: 2204689 - DNA, 12 bp, Homo sapiens
tacattctgtta

SEQ ID NO: 2204690 - DNA, 19 bp, Homo sapiens
tacatttttaagtgctgca

SEQ ID NO: 2204691 - DNA, 13 bp, Homo sapiens
tacctacatgtat

SEQ ID NO: 2204692 - DNA, 23 bp, Homo sapiens
tacctacatgtatttgtttgcat

SEQ ID NO: 2204693 - DNA, 23 bp, Homo sapiens
tacctctccagcctcagctctca

SEQ ID NO: 2204694 - DNA, 13 bp, Homo sapiens
taccttttttata

SEQ ID NO: 2204695 - DNA, 18 bp, Homo sapiens
tccaaaataaaacttttt

SEQ ID NO: 2204696 - DNA, 12 bp, Homo sapiens
tccaaaccactt

SEQ ID NO: 2204697 - DNA, 13 bp, Homo sapiens
tccaaagtacact

SEQ ID NO: 2204698 - DNA, 14 bp, Homo sapiens
tccaaagtacactg

SEQ ID NO: 2204699 - DNA, 16 bp, Homo sapiens
tccaaagtacactgtt

SEQ ID NO: 2204700 - DNA, 15 bp, Homo sapiens
tccaattaaggattt

SEQ ID NO: 2204701 - DNA, 17 bp, Homo sapiens
tccaattaaggatttta

SEQ ID NO: 2204702 - DNA, 21 bp, Homo sapiens
tccctattttttttctgttat

SEQ ID NO: 2204703 - DNA, 24 bp, Homo sapiens
tccctggcctttcatattttagct

SEQ ID NO: 2204704 - DNA, 18 bp, Homo sapiens
tcccttggacattttatg

SEQ ID NO: 2204705 - DNA, 15 bp, Homo sapiens
tccgctatccaccaa

SEQ ID NO: 2204706 - DNA, 15 bp, Homo sapiens
tccgttaaaatacca

SEQ ID NO: 2204707 - DNA, 17 bp, Homo sapiens
tcctagcacacactttt

SEQ ID NO: 2204708 - DNA, 18 bp, Homo sapiens
tcctagcacacacttttg

SEQ ID NO: 2204709 - DNA, 19 bp, Homo sapiens
tcctagcacacacttttgg

SEQ ID NO: 2204710 - DNA, 15 bp, Homo sapiens
tcctgcaatgaagtc

SEQ ID NO: 2204711 - DNA, 21 bp, Homo sapiens
tcctgcaatgaagtctctgaa

SEQ ID NO: 2204712 - DNA, 20 bp, Homo sapiens
tcctgtacctcttgagcctt

SEQ ID NO: 2204713 - DNA, 18 bp, Homo sapiens
tctaaaggctacctttgt

SEQ ID NO: 2204714 - DNA, 20 bp, Homo sapiens
tctaaaggctacctttgtat

SEQ ID NO: 2204715 - DNA, 13 bp, Homo sapiens
tctagatactgta

SEQ ID NO: 2204716 - DNA, 21 bp, Homo sapiens
tctatcaagtattataccttt

SEQ ID NO: 2204717 - DNA, 16 bp, Homo sapiens
tctatgttaatatttt

SEQ ID NO: 2204718 - DNA, 22 bp, Homo sapiens
tctatgttaatattttatgtgt

SEQ ID NO: 2204719 - DNA, 14 bp, Homo sapiens
tctatttatttatt

SEQ ID NO: 2204720 - DNA, 17 bp, Homo sapiens
tctattttgtaactgta

SEQ ID NO: 2204721 - DNA, 16 bp, Homo sapiens
tctcaaatttctaaat

SEQ ID NO: 2204722 - DNA, 22 bp, Homo sapiens
tctcagaaggcaaatgactttg

SEQ ID NO: 2204723 - DNA, 14 bp, Homo sapiens
tctcagttgcagcc

SEQ ID NO: 2204724 - DNA, 21 bp, Homo sapiens
tctcagttgcagccctgctgc

SEQ ID NO: 2204725 - DNA, 22 bp, Homo sapiens
tctccaaaataaaactttttaa

SEQ ID NO: 2204726 - DNA, 24 bp, Homo sapiens
tctccatggccctgccatgctctc

SEQ ID NO: 2204727 - DNA, 21 bp, Homo sapiens
tctccttgtgttactaagttt

SEQ ID NO: 2204728 - DNA, 22 bp, Homo sapiens
tctctcctgtacctcttgagcc

SEQ ID NO: 2204729 - DNA, 16 bp, Homo sapiens
tctctgaagtgaaact

SEQ ID NO: 2204730 - DNA, 16 bp, Homo sapiens
tctgaagtgaaactgc

SEQ ID NO: 2204731 - DNA, 18 bp, Homo sapiens
tctgaagtgaaactgctt

SEQ ID NO: 2204732 - DNA, 14 bp, Homo sapiens
tctgacctcctcct

SEQ ID NO: 2204733 - DNA, 19 bp, Homo sapiens
tctggattcatatttaatt

SEQ ID NO: 2204734 - DNA, 13 bp, Homo sapiens
tctgtttagataa

SEQ ID NO: 2204735 - DNA, 13 bp, Homo sapiens
tctgttttatgac

SEQ ID NO: 2204736 - DNA, 19 bp, Homo sapiens
tcttaaataataaagatca

SEQ ID NO: 2204737 - DNA, 18 bp, Homo sapiens
tcttcagatctctaactt

SEQ ID NO: 2204738 - DNA, 23 bp, Homo sapiens
tcttcagatctctaacttcacca

SEQ ID NO: 2204739 - DNA, 17 bp, Homo sapiens
tcttgagccttgaactt

SEQ ID NO: 2204740 - DNA, 19 bp, Homo sapiens
tcttgagccttgaactttg

SEQ ID NO: 2204741 - DNA, 19 bp, Homo sapiens
tctttctggctatgcattt

SEQ ID NO: 2204742 - DNA, 19 bp, Homo sapiens
tcttttgccgttattaaaa

SEQ ID NO: 2204743 - DNA, 14 bp, Homo sapiens
tctttttgaaatgt

SEQ ID NO: 2204744 - DNA, 13 bp, Homo sapiens
tgaaaacacattt

SEQ ID NO: 2204745 - DNA, 12 bp, Homo sapiens
tgaaaattttga

SEQ ID NO: 2204746 - DNA, 19 bp, Homo sapiens
tgaaactgcttgtttccta

SEQ ID NO: 2204747 - DNA, 20 bp, Homo sapiens
tgaaactgcttgtttcctag

SEQ ID NO: 2204748 - DNA, 18 bp, Homo sapiens
tgaacactccaattaagg

SEQ ID NO: 2204749 - DNA, 19 bp, Homo sapiens
tgaactaaactttcacacc

SEQ ID NO: 2204750 - DNA, 20 bp, Homo sapiens
ttttatgacttcattaataa

SEQ ID NO: 2204751 - DNA, 21 bp, Homo sapiens
ttttatgacttcattaataat

SEQ ID NO: 2204752 - DNA, 17 bp, Homo sapiens
ttttatgtaattatata

SEQ ID NO: 2204753 - DNA, 16 bp, Homo sapiens
ttttatgtctttcttg

SEQ ID NO: 2204754 - DNA, 18 bp, Homo sapiens
ttttatgtctttcttgta

SEQ ID NO: 2204755 - DNA, 13 bp, Homo sapiens
ttttatgtgtaaa

SEQ ID NO: 2204756 - DNA, 14 bp, Homo sapiens
ttttcttaaataat

SEQ ID NO: 2204757 - DNA, 23 bp, Homo sapiens
ttttcttaaataataaagatcat

SEQ ID NO: 2204758 - DNA, 13 bp, Homo sapiens
ttttgaaatgtca

SEQ ID NO: 2204759 - DNA, 20 bp, Homo sapiens
ttttgacaaggggcagtggt

SEQ ID NO: 2204760 - DNA, 16 bp, Homo sapiens
ttttggttgctttaat

SEQ ID NO: 2204761 - DNA, 23 bp, Homo sapiens
ttttgtgcattatctagatactg

SEQ ID NO: 2204762 - DNA, 12 bp, Homo sapiens
tttttaagaaaa

SEQ ID NO: 2204763 - DNA, 18 bp, Homo sapiens
tttttaagccttaaagga

SEQ ID NO: 2204764 - DNA, 18 bp, Homo sapiens
tttttaagtgctgcattt

SEQ ID NO: 2204765 - DNA, 23 bp, Homo sapiens
tttttcttaaataataaagatca

SEQ ID NO: 2204766 - DNA, 12 bp, Homo sapiens
ttttttactaat

SEQ ID NO: 2204767 - DNA, 12 bp, Homo sapiens
ttttttttaaga

SEQ ID NO: 2204768 - DNA, 13 bp, Homo sapiens
ttttttttgacaa

SEQ ID NO: 2204769 - DNA, 17 bp, Homo sapiens
aaaaatctcaaatttct

SEQ ID NO: 2204770 - DNA, 12 bp, Homo sapiens
aaaacacatttt

SEQ ID NO: 2204771 - DNA, 17 bp, Homo sapiens
aaaacacatttttctta

SEQ ID NO: 2204772 - DNA, 17 bp, Homo sapiens
aaaagaggtttttctta

SEQ ID NO: 2204773 - DNA, 16 bp, Homo sapiens
aaaataaaacttttta

SEQ ID NO: 2204774 - DNA, 14 bp, Homo sapiens
aaaataaggttatg

SEQ ID NO: 2204775 - DNA, 15 bp, Homo sapiens
aaaataccagccagt

SEQ ID NO: 2204776 - DNA, 16 bp, Homo sapiens
atgcacagagttgtta

SEQ ID NO: 2204777 - DNA, 21 bp, Homo sapiens
atgcacagagttgttacattt

SEQ ID NO: 2204778 - DNA, 16 bp, Homo sapiens
atgcacctggaatata

SEQ ID NO: 2204779 - DNA, 21 bp, Homo sapiens
atgcagtgtttccctctgtgt

SEQ ID NO: 2204780 - DNA, 20 bp, Homo sapiens
atgcatgaagtaatatgcac

SEQ ID NO: 2204781 - DNA, 10 bp, Homo sapiens
atgcatttga

SEQ ID NO: 2204782 - DNA, 18 bp, Homo sapiens
atgcatttgaaaattttg

SEQ ID NO: 2204783 - DNA, 14 bp, Homo sapiens
atgctaattttatt

SEQ ID NO: 2204784 - DNA, 19 bp, Homo sapiens
atgctctccaaaccacttt

SEQ ID NO: 2204785 - DNA, 22 bp, Homo sapiens
atgctgtgccctaaagtgtatt

SEQ ID NO: 2204786 - DNA, 13 bp, Homo sapiens
atgctttaaacat

SEQ ID NO: 2204787 - DNA, 22 bp, Homo sapiens
atggccagtgagatcaatgtga

SEQ ID NO: 2204788 - DNA, 18 bp, Homo sapiens
atggcttttgtgcattat

SEQ ID NO: 2204789 - DNA, 15 bp, Homo sapiens
atgtaattatatata

SEQ ID NO: 2204790 - DNA, 17 bp, Homo sapiens
atgtcagccactgtgat

SEQ ID NO: 2204791 - DNA, 16 bp, Homo sapiens
atgtcagttgttattt

SEQ ID NO: 2204792 - DNA, 21 bp, Homo sapiens
atgtcttcatacctacatgta

SEQ ID NO: 2204793 - DNA, 14 bp, Homo sapiens
atgtctttcttgta

SEQ ID NO: 2204794 - DNA, 20 bp, Homo sapiens
atgtgacttggattcaattt

SEQ ID NO: 2204795 - DNA, 16 bp, Homo sapiens
atgtgtgtctattttg

SEQ ID NO: 2204796 - DNA, 17 bp, Homo sapiens
atgttaatattttatgt

SEQ ID NO: 2204797 - DNA, 19 bp, Homo sapiens
atgttaatattttatgtgt

SEQ ID NO: 2204798 - DNA, 21 bp, Homo sapiens
atgttaattatgcagtgtttc

SEQ ID NO: 2204799 - DNA, 18 bp, Homo sapiens
atgttctaaatatccctt

SEQ ID NO: 2204800 - DNA, 14 bp, Homo sapiens
atgttcttaattct

SEQ ID NO: 2204801 - DNA, 15 bp, Homo sapiens
atgttcttaattctt

SEQ ID NO: 2204802 - DNA, 17 bp, Homo sapiens
attaaacttaatctaaa

SEQ ID NO: 2204803 - DNA, 19 bp, Homo sapiens
attaaacttaatctaaatg

SEQ ID NO: 2204804 - DNA, 14 bp, Homo sapiens
attaaattcttgca

SEQ ID NO: 2204805 - DNA, 20 bp, Homo sapiens
attaaattcttgcaaagtat

SEQ ID NO: 2204806 - DNA, 21 bp, Homo sapiens
attaagaatgaaatactgttt

SEQ ID NO: 2204807 - DNA, 15 bp, Homo sapiens
attaaggattttatg

SEQ ID NO: 2204808 - DNA, 19 bp, Homo sapiens
attaccacagacatactaa

SEQ ID NO: 2204809 - DNA, 21 bp, Homo sapiens
attagttttgaagattctatg

SEQ ID NO: 2204810 - DNA, 15 bp, Homo sapiens
attatatatactata

SEQ ID NO: 2204811 - DNA, 16 bp, Homo sapiens
attatattcattcttt

SEQ ID NO: 2204812 - DNA, 18 bp, Homo sapiens
attatctagatactgtat

SEQ ID NO: 2204813 - DNA, 15 bp, Homo sapiens
attatgcagtgtttc

SEQ ID NO: 2204814 - DNA, 14 bp, Homo sapiens
attatgttaatatt

SEQ ID NO: 2204815 - DNA, 21 bp, Homo sapiens
attcaattttaaggcatattt

SEQ ID NO: 2204816 - DNA, 15 bp, Homo sapiens
attcattctttttga

SEQ ID NO: 2204817 - DNA, 13 bp, Homo sapiens
attccctggcctt

SEQ ID NO: 2204818 - DNA, 15 bp, Homo sapiens
attctatgttaatat

SEQ ID NO: 2204819 - DNA, 18 bp, Homo sapiens
attctatgttaatatttt

SEQ ID NO: 2204820 - DNA, 17 bp, Homo sapiens
attctccttgtgttact

SEQ ID NO: 2204821 - DNA, 19 bp, Homo sapiens
attctccttgtgttactaa

SEQ ID NO: 2204822 - DNA, 20 bp, Homo sapiens
attctctagtttgattaaat

SEQ ID NO: 2204823 - DNA, 16 bp, Homo sapiens
attctctcctgtacct

SEQ ID NO: 2204824 - DNA, 21 bp, Homo sapiens
attctctcctgtacctcttga

SEQ ID NO: 2204825 - DNA, 16 bp, Homo sapiens
attctttttgaaatgt

SEQ ID NO: 2204826 - DNA, 21 bp, Homo sapiens
attgatttccgttaaaatacc

SEQ ID NO: 2204827 - DNA, 16 bp, Homo sapiens
attgcgcctaatgtgt

SEQ ID NO: 2204828 - DNA, 17 bp, Homo sapiens
attgcgcctaatgtgtt

SEQ ID NO: 2204829 - DNA, 18 bp, Homo sapiens
attgcgcctaatgtgttt

SEQ ID NO: 2204830 - DNA, 16 bp, Homo sapiens
attggttcttgtatta

SEQ ID NO: 2204831 - DNA, 13 bp, Homo sapiens
atttaaaagatac

SEQ ID NO: 2204832 - DNA, 14 bp, Homo sapiens
atttaaaagataca

SEQ ID NO: 2204833 - DNA, 17 bp, Homo sapiens
atttaaaagatacagtt

SEQ ID NO: 2204834 - DNA, 12 bp, Homo sapiens
atttaacagaaa

SEQ ID NO: 2204835 - DNA, 15 bp, Homo sapiens
atttaacagaaatgt

SEQ ID NO: 2204836 - DNA, 20 bp, Homo sapiens
atttaacagaaatgtacagc

SEQ ID NO: 2204837 - DNA, 19 bp, Homo sapiens
atttaattacttcttagta

SEQ ID NO: 2204838 - DNA, 22 bp, Homo sapiens
atttaatttgaaggtagaatgt

SEQ ID NO: 2204839 - DNA, 13 bp, Homo sapiens
atttataatcact

SEQ ID NO: 2204840 - DNA, 23 bp, Homo sapiens
atttataatcacttttttccaca

SEQ ID NO: 2204841 - DNA, 13 bp, Homo sapiens
atttattgaaatg

SEQ ID NO: 2204842 - DNA, 19 bp, Homo sapiens
atttattgaaatgatttca

SEQ ID NO: 2204843 - DNA, 22 bp, Homo sapiens
atttattgaaatgatttcacag

SEQ ID NO: 2204844 - DNA, 13 bp, Homo sapiens
atttattgatgtt

SEQ ID NO: 2204845 - DNA, 19 bp, Homo sapiens
atttattgatgttttcaca

SEQ ID NO: 2204846 - DNA, 15 bp, Homo sapiens
atttatttatttgtt

SEQ ID NO: 2204847 - DNA, 14 bp, Homo sapiens
atttctgtttagat

SEQ ID NO: 2204848 - DNA, 16 bp, Homo sapiens
atttctgtttagataa

SEQ ID NO: 2204849 - DNA, 17 bp, Homo sapiens
atttcttcgtgatgaca

SEQ ID NO: 2204850 - DNA, 18 bp, Homo sapiens
atttcttcgtgatgacat

SEQ ID NO: 2204851 - DNA, 21 bp, Homo sapiens
atttcttcgtgatgacatatc

SEQ ID NO: 2204852 - DNA, 14 bp, Homo sapiens
atttgaaaattttg

SEQ ID NO: 2204853 - DNA, 23 bp, Homo sapiens
atttgaaggtagaatgttttcaa

SEQ ID NO: 2204854 - DNA, 22 bp, Homo sapiens
atttgaggtctgttctttccaa

SEQ ID NO: 2204855 - DNA, 16 bp, Homo sapiens
atttgttaatatttct

SEQ ID NO: 2204856 - DNA, 24 bp, Homo sapiens
atttgttaatatttcttcgtgatg

SEQ ID NO: 2204857 - DNA, 14 bp, Homo sapiens
atttgtttgaactg

SEQ ID NO: 2204858 - DNA, 23 bp, Homo sapiens
atttgtttgaactgataaagatg

SEQ ID NO: 2204859 - DNA, 17 bp, Homo sapiens
attttataaatcgcttt

SEQ ID NO: 2204860 - DNA, 18 bp, Homo sapiens
attttatgctttaaacat

SEQ ID NO: 2204861 - DNA, 13 bp, Homo sapiens
attttatgtgtaa

SEQ ID NO: 2204862 - DNA, 13 bp, Homo sapiens
attttattatgca

SEQ ID NO: 2204863 - DNA, 17 bp, Homo sapiens
attttattatgcatgaa

SEQ ID NO: 2204864 - DNA, 12 bp, Homo sapiens
attttgctttgt

SEQ ID NO: 2204865 - DNA, 13 bp, Homo sapiens
atttttaagtgct

SEQ ID NO: 2204866 - DNA, 15 bp, Homo sapiens
attttttttctgtta

SEQ ID NO: 2204867 - DNA, 13 bp, Homo sapiens
caaaagcatgtga

SEQ ID NO: 2204868 - DNA, 20 bp, Homo sapiens
caaaccactttttgcagctt

SEQ ID NO: 2204869 - DNA, 22 bp, Homo sapiens
caaagatattttgctttgtgat

SEQ ID NO: 2204870 - DNA, 19 bp, Homo sapiens
caaagtatccctactgtaa

SEQ ID NO: 2204871 - DNA, 14 bp, Homo sapiens
caacatttctcatg

SEQ ID NO: 2204872 - DNA, 18 bp, Homo sapiens
caacatttctcatgttga

SEQ ID NO: 2204873 - DNA, 17 bp, Homo sapiens
caagaccacgtttctaa

SEQ ID NO: 2204874 - DNA, 17 bp, Homo sapiens
caagtattatacctttt

SEQ ID NO: 2204875 - DNA, 19 bp, Homo sapiens
caataaagcagcgtttcta

SEQ ID NO: 2204876 - DNA, 20 bp, Homo sapiens
caattaaggattttatgctt

SEQ ID NO: 2204877 - DNA, 21 bp, Homo sapiens
caattaaggattttatgcttt

SEQ ID NO: 2204878 - DNA, 22 bp, Homo sapiens
caattaaggattttatgcttta

SEQ ID NO: 2204879 - DNA, 22 bp, Homo sapiens
caattatttgaagatttaatta

SEQ ID NO: 2204880 - DNA, 11 bp, Homo sapiens
cacacattttt

SEQ ID NO: 2204881 - DNA, 12 bp, Homo sapiens
cacacatttttt

SEQ ID NO: 2204882 - DNA, 16 bp, Homo sapiens
cacacattttttaaat

SEQ ID NO: 2204883 - DNA, 18 bp, Homo sapiens
cacagacatactaaccag

SEQ ID NO: 2204884 - DNA, 21 bp, Homo sapiens
cacagtgtgtggtcaacattt

SEQ ID NO: 2204885 - DNA, 19 bp, Homo sapiens
cacagttttggttgcttta

SEQ ID NO: 2204886 - DNA, 23 bp, Homo sapiens
cacagttttggttgctttaatat

SEQ ID NO: 2204887 - DNA, 21 bp, Homo sapiens
cacatcagcacgatttctgtt

SEQ ID NO: 2204888 - DNA, 14 bp, Homo sapiens
cacatttttcttag

SEQ ID NO: 2204889 - DNA, 21 bp, Homo sapiens
cacattttttaaatgcacctg

SEQ ID NO: 2204890 - DNA, 17 bp, Homo sapiens
caccactacattctgtt

SEQ ID NO: 2204891 - DNA, 15 bp, Homo sapiens
cacctcctgcctcag

SEQ ID NO: 2204892 - DNA, 20 bp, Homo sapiens
cacctggaatatataaccag

SEQ ID NO: 2204893 - DNA, 14 bp, Homo sapiens
cacgatttctgttt

SEQ ID NO: 2204894 - DNA, 14 bp, Homo sapiens
cacgtttctaaagg

SEQ ID NO: 2204895 - DNA, 23 bp, Homo sapiens
cacgtttctaaaggctacctttg

SEQ ID NO: 2204896 - DNA, 14 bp, Homo sapiens
cactacattctgtt

SEQ ID NO: 2204897 - DNA, 17 bp, Homo sapiens
cactccaattaaggatt

SEQ ID NO: 2204898 - DNA, 22 bp, Homo sapiens
cactccaattaaggattttatg

SEQ ID NO: 2204899 - DNA, 16 bp, Homo sapiens
cactgtcctattatat

SEQ ID NO: 2204900 - DNA, 19 bp, Homo sapiens
cactgtttcaaactttact

SEQ ID NO: 2204901 - DNA, 18 bp, Homo sapiens
cacttaggagaagtcttc

SEQ ID NO: 2204902 - DNA, 22 bp, Homo sapiens
cacttttgttcttggtttgtaa

SEQ ID NO: 2204903 - DNA, 14 bp, Homo sapiens
cacttttttccaca

SEQ ID NO: 2204904 - DNA, 19 bp, Homo sapiens
cagacatactaaccagcag

SEQ ID NO: 2204905 - DNA, 15 bp, Homo sapiens
cagagttgttacatt

SEQ ID NO: 2204906 - DNA, 16 bp, Homo sapiens
cagataactgttattt

SEQ ID NO: 2204907 - DNA, 17 bp, Homo sapiens
cagcaaggagatttaca

SEQ ID NO: 2204908 - DNA, 22 bp, Homo sapiens
cagcaataaagcagcgtttcta

SEQ ID NO: 2204909 - DNA, 15 bp, Homo sapiens
cagcacgatttctgt

SEQ ID NO: 2204910 - DNA, 18 bp, Homo sapiens
cagcacgatttctgttta

SEQ ID NO: 2204911 - DNA, 19 bp, Homo sapiens
cagcacgatttctgtttag

SEQ ID NO: 2204912 - DNA, 20 bp, Homo sapiens
cagcacgatttctgtttaga

SEQ ID NO: 2204913 - DNA, 14 bp, Homo sapiens
taaatctccaaaat

SEQ ID NO: 2204914 - DNA, 18 bp, Homo sapiens
taaatctccaaaataaaa

SEQ ID NO: 2204915 - DNA, 21 bp, Homo sapiens
taaatctccaaaataaaactt

SEQ ID NO: 2204916 - DNA, 15 bp, Homo sapiens
taaattaacttttat

SEQ ID NO: 2204917 - DNA, 17 bp, Homo sapiens
taaattaacttttataa

SEQ ID NO: 2204918 - DNA, 18 bp, Homo sapiens
taaattaacttttataaa

SEQ ID NO: 2204919 - DNA, 14 bp, Homo sapiens
taacaacaattatt

SEQ ID NO: 2204920 - DNA, 15 bp, Homo sapiens
taacaacaattattt

SEQ ID NO: 2204921 - DNA, 11 bp, Homo sapiens
taacagaaatg

SEQ ID NO: 2204922 - DNA, 14 bp, Homo sapiens
taacagaaatgtac

SEQ ID NO: 2204923 - DNA, 23 bp, Homo sapiens
taaccagtgttgtggatttaaca

SEQ ID NO: 2204924 - DNA, 21 bp, Homo sapiens
taactgttatttataatcact

SEQ ID NO: 2204925 - DNA, 13 bp, Homo sapiens
taacttcacatat

SEQ ID NO: 2204926 - DNA, 18 bp, Homo sapiens
taacttttataaacttta

SEQ ID NO: 2204927 - DNA, 19 bp, Homo sapiens
taacttttataaactttac

SEQ ID NO: 2204928 - DNA, 21 bp, Homo sapiens
taacttttataaactttacct

SEQ ID NO: 2204929 - DNA, 14 bp, Homo sapiens
taagatatgtaaca

SEQ ID NO: 2204930 - DNA, 23 bp, Homo sapiens
taaggatgcttgtacataatgcg

SEQ ID NO: 2204931 - DNA, 20 bp, Homo sapiens
taaggattttatgctttaaa

SEQ ID NO: 2204932 - DNA, 20 bp, Homo sapiens
taagtttttatggcttttgt

SEQ ID NO: 2204933 - DNA, 16 bp, Homo sapiens
taatacaccactacat

SEQ ID NO: 2204934 - DNA, 21 bp, Homo sapiens
taatacaccactacattctgt

SEQ ID NO: 2204935 - DNA, 22 bp, Homo sapiens
taatacaccactacattctgtt

SEQ ID NO: 2204936 - DNA, 14 bp, Homo sapiens
taatagacaattta

SEQ ID NO: 2204937 - DNA, 23 bp, Homo sapiens
taatatcatcagtattgaagcat

SEQ ID NO: 2204938 - DNA, 19 bp, Homo sapiens
taatatgcacacatttttt

SEQ ID NO: 2204939 - DNA, 23 bp, Homo sapiens
taatgcgtgcataccacttttgt

SEQ ID NO: 2204940 - DNA, 12 bp, Homo sapiens
taatgtgaaact

SEQ ID NO: 2204941 - DNA, 14 bp, Homo sapiens
taattatatatact

SEQ ID NO: 2204942 - DNA, 18 bp, Homo sapiens
taattcttagctcattct

SEQ ID NO: 2204943 - DNA, 15 bp, Homo sapiens
taatttgtgatacaa

SEQ ID NO: 2204944 - DNA, 22 bp, Homo sapiens
taatttgtgatacaatgctgtg

SEQ ID NO: 2204945 - DNA, 22 bp, Homo sapiens
tacacactgcatgtttgtgatt

SEQ ID NO: 2204946 - DNA, 19 bp, Homo sapiens
tacacattttattttatta

SEQ ID NO: 2204947 - DNA, 18 bp, Homo sapiens
tacaccactacattctgt

SEQ ID NO: 2204948 - DNA, 20 bp, Homo sapiens
tacaccactacattctgtta

SEQ ID NO: 2204949 - DNA, 14 bp, Homo sapiens
tacactgtttcaaa

SEQ ID NO: 2204950 - DNA, 18 bp, Homo sapiens
tacagtttgttagtatga

SEQ ID NO: 2204951 - DNA, 19 bp, Homo sapiens
tacagtttgttagtatgag

SEQ ID NO: 2204952 - DNA, 21 bp, Homo sapiens
tacagtttgttagtatgaggc

SEQ ID NO: 2204953 - DNA, 21 bp, Homo sapiens
tacataatgcgtgcataccac

SEQ ID NO: 2204954 - DNA, 20 bp, Homo sapiens
tacatcaatgataatgctaa

SEQ ID NO: 2204955 - DNA, 13 bp, Homo sapiens
tacattctgttaa

SEQ ID NO: 2204956 - DNA, 16 bp, Homo sapiens
taccctcatgttctta

SEQ ID NO: 2204957 - DNA, 13 bp, Homo sapiens
taccttttttaga

SEQ ID NO: 2204958 - DNA, 19 bp, Homo sapiens
taccttttttagagttgat

SEQ ID NO: 2204959 - DNA, 22 bp, Homo sapiens
taccttttttagagttgatact

SEQ ID NO: 2204960 - DNA, 17 bp, Homo sapiens
taccttttttatacata

SEQ ID NO: 2204961 - DNA, 18 bp, Homo sapiens
taccttttttatacataa

SEQ ID NO: 2204962 - DNA, 12 bp, Homo sapiens
tacgtacacatt

SEQ ID NO: 2204963 - DNA, 13 bp, Homo sapiens
tacgttgtgcatt

SEQ ID NO: 2204964 - DNA, 14 bp, Homo sapiens
tacgttgtgcattt

SEQ ID NO: 2204965 - DNA, 17 bp, Homo sapiens
tactaaccagcagaaat

SEQ ID NO: 2204966 - DNA, 19 bp, Homo sapiens
tactaaccagcagaaatgc

SEQ ID NO: 2204967 - DNA, 13 bp, Homo sapiens
tactacagtttgt

SEQ ID NO: 2204968 - DNA, 19 bp, Homo sapiens
tactatatatgtgatgatc

SEQ ID NO: 2204969 - DNA, 16 bp, Homo sapiens
tactcagaattctcta

SEQ ID NO: 2204970 - DNA, 19 bp, Homo sapiens
tactctacaaaatatagct

SEQ ID NO: 2204971 - DNA, 19 bp, Homo sapiens
tactgccttgtttaatgtt

SEQ ID NO: 2204972 - DNA, 18 bp, Homo sapiens
tagaatgttttcaaatgt

SEQ ID NO: 2204973 - DNA, 15 bp, Homo sapiens
tagaggttcaaagat

SEQ ID NO: 2204974 - DNA, 16 bp, Homo sapiens
tagaggttcaaagata

SEQ ID NO: 2204975 - DNA, 21 bp, Homo sapiens
tagaggttcaaagatattttg

SEQ ID NO: 2204976 - DNA, 18 bp, Homo sapiens
tagcatacgtacacattt

SEQ ID NO: 2204977 - DNA, 12 bp, Homo sapiens
tagctcattctc

SEQ ID NO: 2204978 - DNA, 23 bp, Homo sapiens
taggtgtgactgaatttcttttg

SEQ ID NO: 2204979 - DNA, 23 bp, Homo sapiens
tagtatgtgcatttaattagaaa

SEQ ID NO: 2204980 - DNA, 15 bp, Homo sapiens
tagtttgattaaatt

SEQ ID NO: 2204981 - DNA, 16 bp, Homo sapiens
tagtttgattaaattc

SEQ ID NO: 2204982 - DNA, 16 bp, Homo sapiens
tataaactttaccttt

SEQ ID NO: 2204983 - DNA, 17 bp, Homo sapiens
tataaactttacctttt

SEQ ID NO: 2204984 - DNA, 18 bp, Homo sapiens
tataaatcgcttttgata

SEQ ID NO: 2204985 - DNA, 19 bp, Homo sapiens
tataaatcgcttttgataa

SEQ ID NO: 2204986 - DNA, 20 bp, Homo sapiens
tataaatcgcttttgataat

SEQ ID NO: 2204987 - DNA, 20 bp, Homo sapiens
tataatcacttttttccaca

SEQ ID NO: 2204988 - DNA, 15 bp, Homo sapiens
tatactatatttttc

SEQ ID NO: 2204989 - DNA, 20 bp, Homo sapiens
tatagtaatgtgacttggat

SEQ ID NO: 2204990 - DNA, 18 bp, Homo sapiens
tatataaatggttaaaag

SEQ ID NO: 2204991 - DNA, 20 bp, Homo sapiens
tatattcattctttttgaaa

SEQ ID NO: 2204992 - DNA, 18 bp, Homo sapiens
tatcaagtattatacctt

SEQ ID NO: 2204993 - DNA, 16 bp, Homo sapiens
tatcagctacaattgt

SEQ ID NO: 2204994 - DNA, 16 bp, Homo sapiens
tatcatcagtattgaa

SEQ ID NO: 2204995 - DNA, 22 bp, Homo sapiens
tatcatcagtattgaagcattt

SEQ ID NO: 2204996 - DNA, 23 bp, Homo sapiens
tatccaccaaaagggctccctga

SEQ ID NO: 2204997 - DNA, 19 bp, Homo sapiens
tatccctactgtaatttgt

SEQ ID NO: 2204998 - DNA, 19 bp, Homo sapiens
tatcccttggacattttat

SEQ ID NO: 2204999 - DNA, 19 bp, Homo sapiens
tatcgtcactgcttaactt

SEQ ID NO: 2205000 - DNA, 15 bp, Homo sapiens
tatctagatactgta

SEQ ID NO: 2205001 - DNA, 12 bp, Homo sapiens
tatgacacatgc

SEQ ID NO: 2205002 - DNA, 22 bp, Homo sapiens
tatgacacatgcaaggtcattt

SEQ ID NO: 2205003 - DNA, 16 bp, Homo sapiens
tatgacttcattaata

SEQ ID NO: 2205004 - DNA, 13 bp, Homo sapiens
tatgcacacattt

SEQ ID NO: 2205005 - DNA, 22 bp, Homo sapiens
tatgcatgaagtaatatgcaca

SEQ ID NO: 2205006 - DNA, 11 bp, Homo sapiens
tatgcatttga

SEQ ID NO: 2205007 - DNA, 21 bp, Homo sapiens
tatggccctggcctagcatac

SEQ ID NO: 2205008 - DNA, 22 bp, Homo sapiens
tatggccctggcctagcatacg

SEQ ID NO: 2205009 - DNA, 16 bp, Homo sapiens
tatggcttttgtgcat

SEQ ID NO: 2205010 - DNA, 17 bp, Homo sapiens
tatggcttttgtgcatt

SEQ ID NO: 2205011 - DNA, 18 bp, Homo sapiens
tatggcttttgtgcatta

SEQ ID NO: 2205012 - DNA, 23 bp, Homo sapiens
tatgtaacaacaattatttgaag

SEQ ID NO: 2205013 - DNA, 14 bp, Homo sapiens
tatgttaatatttt

SEQ ID NO: 2205014 - DNA, 18 bp, Homo sapiens
tatgttaatattttatgt

SEQ ID NO: 2205015 - DNA, 22 bp, Homo sapiens
tatgttaatattttatgtgtaa

SEQ ID NO: 2205016 - DNA, 23 bp, Homo sapiens
tattaaaaatctcaaatttctaa

SEQ ID NO: 2205017 - DNA, 14 bp, Homo sapiens
tattataccttttt

SEQ ID NO: 2205018 - DNA, 23 bp, Homo sapiens
tattatattcattctttttgaaa

SEQ ID NO: 2205019 - DNA, 18 bp, Homo sapiens
tattcattctttttgaaa

SEQ ID NO: 2205020 - DNA, 16 bp, Homo sapiens
tattgaaatgatttca

SEQ ID NO: 2205021 - DNA, 15 bp, Homo sapiens
tattgaagcatttta

SEQ ID NO: 2205022 - DNA, 16 bp, Homo sapiens
tattgaagcattttat

SEQ ID NO: 2205023 - DNA, 17 bp, Homo sapiens
tattgaagcattttata

SEQ ID NO: 2205024 - DNA, 12 bp, Homo sapiens
tattgtttattt

SEQ ID NO: 2205025 - DNA, 14 bp, Homo sapiens
tatttaacaaaatt

SEQ ID NO: 2205026 - DNA, 13 bp, Homo sapiens
tatttaatttgaa

SEQ ID NO: 2205027 - DNA, 12 bp, Homo sapiens
tatttattgaaa

SEQ ID NO: 2205028 - DNA, 14 bp, Homo sapiens
tatttattgatgtt

SEQ ID NO: 2205029 - DNA, 16 bp, Homo sapiens
tatttattgatgtttt

SEQ ID NO: 2205030 - DNA, 17 bp, Homo sapiens
tatttattgatgttttc

SEQ ID NO: 2205031 - DNA, 23 bp, Homo sapiens
tatttctgaggagcctgcaacat

SEQ ID NO: 2205032 - DNA, 16 bp, Homo sapiens
tatttgaagatttaat

SEQ ID NO: 2205033 - DNA, 17 bp, Homo sapiens
tatttgaagatttaatt

SEQ ID NO: 2205034 - DNA, 20 bp, Homo sapiens
tatttgaagatttaattact

SEQ ID NO: 2205035 - DNA, 13 bp, Homo sapiens
tattttgctttgt

SEQ ID NO: 2205036 - DNA, 20 bp, Homo sapiens
tattttgctttgtgattttt

SEQ ID NO: 2205037 - DNA, 15 bp, Homo sapiens
tcaaactttactatg

SEQ ID NO: 2205038 - DNA, 16 bp, Homo sapiens
tcaaactttactatgg

SEQ ID NO: 2205039 - DNA, 20 bp, Homo sapiens
tcaaagatattttgctttgt

SEQ ID NO: 2205040 - DNA, 22 bp, Homo sapiens
tcaaagatattttgctttgtga

SEQ ID NO: 2205041 - DNA, 17 bp, Homo sapiens
tcaacatttctcatgtt

SEQ ID NO: 2205042 - DNA, 20 bp, Homo sapiens
tcaacatttctcatgttgaa

SEQ ID NO: 2205043 - DNA, 15 bp, Homo sapiens
tcaagtattatacct

SEQ ID NO: 2205044 - DNA, 23 bp, Homo sapiens
tcaagtattataccttttttaga

SEQ ID NO: 2205045 - DNA, 17 bp, Homo sapiens
tcaattttagttgtcaa

SEQ ID NO: 2205046 - DNA, 23 bp, Homo sapiens
tcacagttttggttgctttaata

SEQ ID NO: 2205047 - DNA, 20 bp, Homo sapiens
tcacatgtcagccactgtga

SEQ ID NO: 2205048 - DNA, 13 bp, Homo sapiens
tcacttttttcca

SEQ ID NO: 2205049 - DNA, 15 bp, Homo sapiens
ttgagccttgaactt

SEQ ID NO: 2205050 - DNA, 16 bp, Homo sapiens
ttgaggtctgttcttt

SEQ ID NO: 2205051 - DNA, 14 bp, Homo sapiens
ttgattaaattctt

SEQ ID NO: 2205052 - DNA, 15 bp, Homo sapiens
ttgattaaattcttg

SEQ ID NO: 2205053 - DNA, 15 bp, Homo sapiens
ttgcagatattctct

SEQ ID NO: 2205054 - DNA, 22 bp, Homo sapiens
ttgcagccctgctgctgcctgc

SEQ ID NO: 2205055 - DNA, 14 bp, Homo sapiens
ttgccgttattaaa

SEQ ID NO: 2205056 - DNA, 16 bp, Homo sapiens
ttgcgcctaatgtgtt

SEQ ID NO: 2205057 - DNA, 15 bp, Homo sapiens
ttgctttgtgatttt

SEQ ID NO: 2205058 - DNA, 14 bp, Homo sapiens
ttggacattttatg

SEQ ID NO: 2205059 - DNA, 15 bp, Homo sapiens
ttggacattttatgt

SEQ ID NO: 2205060 - DNA, 20 bp, Homo sapiens
ttggacattttatgtctttc

SEQ ID NO: 2205061 - DNA, 21 bp, Homo sapiens
ttggctagaggttcaaagata

SEQ ID NO: 2205062 - DNA, 16 bp, Homo sapiens
ttggttaagtctgttt

SEQ ID NO: 2205063 - DNA, 18 bp, Homo sapiens
ttgtattaagaatgaaat

SEQ ID NO: 2205064 - DNA, 15 bp, Homo sapiens
ttgtattctctcctg

SEQ ID NO: 2205065 - DNA, 12 bp, Homo sapiens
ttgtgatttttg

SEQ ID NO: 2205066 - DNA, 22 bp, Homo sapiens
ttgtgcattatctagatactgt

SEQ ID NO: 2205067 - DNA, 12 bp, Homo sapiens
ttgtgcatttgg

SEQ ID NO: 2205068 - DNA, 15 bp, Homo sapiens
ttgtgcctaatgtgt

SEQ ID NO: 2205069 - DNA, 18 bp, Homo sapiens
ttgtgcctaatgtgtttg

SEQ ID NO: 2205070 - DNA, 23 bp, Homo sapiens
ttgtggatttaacagaaatgtac

SEQ ID NO: 2205071 - DNA, 22 bp, Homo sapiens
ttgttaagtatcagctacaatt

SEQ ID NO: 2205072 - DNA, 12 bp, Homo sapiens
ttgtttaatgtt

SEQ ID NO: 2205073 - DNA, 14 bp, Homo sapiens
ttgtttaatgttaa

SEQ ID NO: 2205074 - DNA, 21 bp, Homo sapiens
ttgttttagaagattctatgt

SEQ ID NO: 2205075 - DNA, 21 bp, Homo sapiens
tttaaacgtgatttttaaatt

SEQ ID NO: 2205076 - DNA, 12 bp, Homo sapiens
tttaacaaaatt

SEQ ID NO: 2205077 - DNA, 21 bp, Homo sapiens
tttaagaactaaaatgttcta

SEQ ID NO: 2205078 - DNA, 20 bp, Homo sapiens
tttaaggatgcttgtacata

SEQ ID NO: 2205079 - DNA, 17 bp, Homo sapiens
tttacagtgtttctggc

SEQ ID NO: 2205080 - DNA, 19 bp, Homo sapiens
tttacagtgtttctggctt

SEQ ID NO: 2205081 - DNA, 18 bp, Homo sapiens
tttactaatagacaattt

SEQ ID NO: 2205082 - DNA, 17 bp, Homo sapiens
tttagaagattctatgt

SEQ ID NO: 2205083 - DNA, 18 bp, Homo sapiens
tttagagttgatactaca

SEQ ID NO: 2205084 - DNA, 15 bp, Homo sapiens
tttagataatacacc

SEQ ID NO: 2205085 - DNA, 18 bp, Homo sapiens
tttagatgaatgtcagtt

SEQ ID NO: 2205086 - DNA, 17 bp, Homo sapiens
tttagcagatttaagat

SEQ ID NO: 2205087 - DNA, 16 bp, Homo sapiens
tttataaactttacct

SEQ ID NO: 2205088 - DNA, 18 bp, Homo sapiens
tttataaactttaccttt

SEQ ID NO: 2205089 - DNA, 20 bp, Homo sapiens
tttatgacttcattaataat

SEQ ID NO: 2205090 - DNA, 12 bp, Homo sapiens
tttatgctttaa

SEQ ID NO: 2205091 - DNA, 20 bp, Homo sapiens
tttatggcttttgtgcatta

SEQ ID NO: 2205092 - DNA, 13 bp, Homo sapiens
tttatgtctttct

SEQ ID NO: 2205093 - DNA, 17 bp, Homo sapiens
tttatgtctttcttgta

SEQ ID NO: 2205094 - DNA, 18 bp, Homo sapiens
tttattgatgttttcaca

SEQ ID NO: 2205095 - DNA, 16 bp, Homo sapiens
tttatttatttattca

SEQ ID NO: 2205096 - DNA, 16 bp, Homo sapiens
tttatttatttatttg

SEQ ID NO: 2205097 - DNA, 12 bp, Homo sapiens
tttcaaacttta

SEQ ID NO: 2205098 - DNA, 14 bp, Homo sapiens
tttcaaatgttctc

SEQ ID NO: 2205099 - DNA, 20 bp, Homo sapiens
tttccacataaggaaactgg

SEQ ID NO: 2205100 - DNA, 18 bp, Homo sapiens
tttcctagcacacacttt

SEQ ID NO: 2205101 - DNA, 14 bp, Homo sapiens
tttctaaaggctac

SEQ ID NO: 2205102 - DNA, 19 bp, Homo sapiens
tttctaaatctccaaaata

SEQ ID NO: 2205103 - DNA, 15 bp, Homo sapiens
tttctatgacacatg

SEQ ID NO: 2205104 - DNA, 12 bp, Homo sapiens
tttctcatgttg

SEQ ID NO: 2205105 - DNA, 13 bp, Homo sapiens
tttctcatgttga

SEQ ID NO: 2205106 - DNA, 15 bp, Homo sapiens
tttctcatgttgaag

SEQ ID NO: 2205107 - DNA, 19 bp, Homo sapiens
tttctgttatataaatggt

SEQ ID NO: 2205108 - DNA, 18 bp, Homo sapiens
tttcttagggaaggatac

SEQ ID NO: 2205109 - DNA, 18 bp, Homo sapiens
tttgacctctgcagcaat

SEQ ID NO: 2205110 - DNA, 21 bp, Homo sapiens
tttgacctctgcagcaataaa

SEQ ID NO: 2205111 - DNA, 16 bp, Homo sapiens
tttgagaaattaagta

SEQ ID NO: 2205112 - DNA, 20 bp, Homo sapiens
tttgataatcaactgggctg

SEQ ID NO: 2205113 - DNA, 22 bp, Homo sapiens
tttgcataggtgatctcattta

SEQ ID NO: 2205114 - DNA, 17 bp, Homo sapiens
tttggttgctttaatat

SEQ ID NO: 2205115 - DNA, 14 bp, Homo sapiens
tttgtaactgtaaa

SEQ ID NO: 2205116 - DNA, 16 bp, Homo sapiens
tttgtaatttttttat

SEQ ID NO: 2205117 - DNA, 15 bp, Homo sapiens
tttgtattctctcct

SEQ ID NO: 2205118 - DNA, 16 bp, Homo sapiens
tttgtgatacaatgct

SEQ ID NO: 2205119 - DNA, 22 bp, Homo sapiens
tttgtgatacaatgctgtgccc

SEQ ID NO: 2205120 - DNA, 22 bp, Homo sapiens
tttgtgcattatctagatactg

SEQ ID NO: 2205121 - DNA, 16 bp, Homo sapiens
tttgttaatatttctt

SEQ ID NO: 2205122 - DNA, 12 bp, Homo sapiens
ttttaaatgcac

SEQ ID NO: 2205123 - DNA, 16 bp, Homo sapiens
ttttaagtgctgcatt

SEQ ID NO: 2205124 - DNA, 17 bp, Homo sapiens
ttttaagtgctgcattt

SEQ ID NO: 2205125 - DNA, 15 bp, Homo sapiens
ttttactaatagaca

SEQ ID NO: 2205126 - DNA, 21 bp, Homo sapiens
ttttagaagattctatgttaa

SEQ ID NO: 2205127 - DNA, 23 bp, Homo sapiens
ttttagagttgatactacagttt

SEQ ID NO: 2205128 - DNA, 12 bp, Homo sapiens
ttttataaatcg

SEQ ID NO: 2205129 - DNA, 13 bp, Homo sapiens
ttttatacataaa

SEQ ID NO: 2205130 - DNA, 18 bp, Homo sapiens
ttttatcgtcactgctta

SEQ ID NO: 2205131 - DNA, 19 bp, Homo sapiens
ttttatcgtcactgcttaa

SEQ ID NO: 2205132 - DNA, 18 bp, Homo sapiens
ttttatggcttttgtgca

SEQ ID NO: 2205133 - DNA, 11 bp, Homo sapiens
ttttattttat

SEQ ID NO: 2205134 - DNA, 20 bp, Homo sapiens
ttttgtgcattatctagata

SEQ ID NO: 2205135 - DNA, 19 bp, Homo sapiens
tttttaagtgctgcattta

SEQ ID NO: 2205136 - DNA, 23 bp, Homo sapiens
tttttaagtgctgcatttaaaag

SEQ ID NO: 2205137 - DNA, 11 bp, Homo sapiens
tttttactaat

SEQ ID NO: 2205138 - DNA, 20 bp, Homo sapiens
tttttatcgtcactgcttaa

SEQ ID NO: 2205139 - DNA, 20 bp, Homo sapiens
tttttatggcttttgtgcat

SEQ ID NO: 2205140 - DNA, 16 bp, Homo sapiens
agataactgttattta

SEQ ID NO: 2205141 - DNA, 20 bp, Homo sapiens
agataactgttatttataat

SEQ ID NO: 2205142 - DNA, 18 bp, Homo sapiens
agataatacaccactaca

SEQ ID NO: 2205143 - DNA, 11 bp, Homo sapiens
agatactgtat

SEQ ID NO: 2205144 - DNA, 20 bp, Homo sapiens
agatattctctagtcatttg

SEQ ID NO: 2205145 - DNA, 20 bp, Homo sapiens
agatattttgctttgtgatt

SEQ ID NO: 2205146 - DNA, 22 bp, Homo sapiens
agatattttgctttgtgatttt

SEQ ID NO: 2205147 - DNA, 13 bp, Homo sapiens
agatcaatgtgac

SEQ ID NO: 2205148 - DNA, 15 bp, Homo sapiens
agatgaatgtcagtt

SEQ ID NO: 2205149 - DNA, 12 bp, Homo sapiens
agattctatgtt

SEQ ID NO: 2205150 - DNA, 16 bp, Homo sapiens
agattctatgttaata

SEQ ID NO: 2205151 - DNA, 23 bp, Homo sapiens
agattctatgttaatattttatg

SEQ ID NO: 2205152 - DNA, 14 bp, Homo sapiens
agcacgatttctgt

SEQ ID NO: 2205153 - DNA, 17 bp, Homo sapiens
agcacgatttctgttta

SEQ ID NO: 2205154 - DNA, 21 bp, Homo sapiens
agcacgatttctgtttagata

SEQ ID NO: 2205155 - DNA, 13 bp, Homo sapiens
agcagaaatgcct

SEQ ID NO: 2205156 - DNA, 18 bp, Homo sapiens
agcagcgtttctatgaca

SEQ ID NO: 2205157 - DNA, 16 bp, Homo sapiens
agcatacgtacacatt

SEQ ID NO: 2205158 - DNA, 21 bp, Homo sapiens
agcatacgtacacattttatt

SEQ ID NO: 2205159 - DNA, 14 bp, Homo sapiens
agcattttataaat

SEQ ID NO: 2205160 - DNA, 23 bp, Homo sapiens
agcctccctattttttttctgtt

SEQ ID NO: 2205161 - DNA, 13 bp, Homo sapiens
agccttgaacttt

SEQ ID NO: 2205162 - DNA, 16 bp, Homo sapiens
aggaaggttctggtgt

SEQ ID NO: 2205163 - DNA, 22 bp, Homo sapiens
aggagaagtcttctatttattt

SEQ ID NO: 2205164 - DNA, 22 bp, Homo sapiens
aggatgcacagagttgttacat

SEQ ID NO: 2205165 - DNA, 15 bp, Homo sapiens
aggatgcttgtacat

SEQ ID NO: 2205166 - DNA, 15 bp, Homo sapiens
aggattttatgcttt

SEQ ID NO: 2205167 - DNA, 14 bp, Homo sapiens
aggcaaatgacttt

SEQ ID NO: 2205168 - DNA, 21 bp, Homo sapiens
aggcatactgccttgtttaat

SEQ ID NO: 2205169 - DNA, 17 bp, Homo sapiens
agggaaatgtatgtgtg

SEQ ID NO: 2205170 - DNA, 17 bp, Homo sapiens
aggtagaatgttttcaa

SEQ ID NO: 2205171 - DNA, 16 bp, Homo sapiens
aggtctgttctttcca

SEQ ID NO: 2205172 - DNA, 14 bp, Homo sapiens
aggttcaaagatat

SEQ ID NO: 2205173 - DNA, 16 bp, Homo sapiens
aggtttcgatatttat

SEQ ID NO: 2205174 - DNA, 17 bp, Homo sapiens
aggtttcgatatttatt

SEQ ID NO: 2205175 - DNA, 17 bp, Homo sapiens
agtaatatgcacacatt

SEQ ID NO: 2205176 - DNA, 18 bp, Homo sapiens
agtaatatgcacacattt

SEQ ID NO: 2205177 - DNA, 20 bp, Homo sapiens
agtacactgtttcaaacttt

SEQ ID NO: 2205178 - DNA, 23 bp, Homo sapiens
agtacactgtttcaaactttact

SEQ ID NO: 2205179 - DNA, 15 bp, Homo sapiens
agtacgttgtgcatt

SEQ ID NO: 2205180 - DNA, 16 bp, Homo sapiens
agtacgttgtgcattt

SEQ ID NO: 2205181 - DNA, 18 bp, Homo sapiens
agtacgttgtgcatttgg

SEQ ID NO: 2205182 - DNA, 19 bp, Homo sapiens
agtatcagctacaattgta

SEQ ID NO: 2205183 - DNA, 15 bp, Homo sapiens
agtatgaggcatttg

SEQ ID NO: 2205184 - DNA, 16 bp, Homo sapiens
agtatgtgcatttaat

SEQ ID NO: 2205185 - DNA, 15 bp, Homo sapiens
agtattatacctttt

SEQ ID NO: 2205186 - DNA, 12 bp, Homo sapiens
agtcattatgtt

SEQ ID NO: 2205187 - DNA, 17 bp, Homo sapiens
agtctgttttatgactt

SEQ ID NO: 2205188 - DNA, 13 bp, Homo sapiens
agtgaaactgctt

SEQ ID NO: 2205189 - DNA, 16 bp, Homo sapiens
agtgctgcatttaaaa

SEQ ID NO: 2205190 - DNA, 19 bp, Homo sapiens
agtggtggttttctgttct

SEQ ID NO: 2205191 - DNA, 21 bp, Homo sapiens
agtgtgtggtcaacatttctc

SEQ ID NO: 2205192 - DNA, 19 bp, Homo sapiens
agtgttgtggatttaacag

SEQ ID NO: 2205193 - DNA, 18 bp, Homo sapiens
agttcaatcctgattcat

SEQ ID NO: 2205194 - DNA, 15 bp, Homo sapiens
agttgttacattttt

SEQ ID NO: 2205195 - DNA, 19 bp, Homo sapiens
agttgttacatttttaagt

SEQ ID NO: 2205196 - DNA, 20 bp, Homo sapiens
agttgttacatttttaagtg

SEQ ID NO: 2205197 - DNA, 20 bp, Homo sapiens
agtttcacagcacttacaat

SEQ ID NO: 2205198 - DNA, 14 bp, Homo sapiens
agtttgattaaatt

SEQ ID NO: 2205199 - DNA, 17 bp, Homo sapiens
agtttgattaaattctt

SEQ ID NO: 2205200 - DNA, 22 bp, Homo sapiens
agtttgttagtatgaggcattt

SEQ ID NO: 2205201 - DNA, 22 bp, Homo sapiens
agttttggttgctttaatatca

SEQ ID NO: 2205202 - DNA, 15 bp, Homo sapiens
ataaaactttttaaa

SEQ ID NO: 2205203 - DNA, 15 bp, Homo sapiens
ataaacaagaccacg

SEQ ID NO: 2205204 - DNA, 22 bp, Homo sapiens
ataaacaagaccacgtttctaa

SEQ ID NO: 2205205 - DNA, 23 bp, Homo sapiens
ataaacaagaccacgtttctaaa

SEQ ID NO: 2205206 - DNA, 15 bp, Homo sapiens
ataaactttaccttt

SEQ ID NO: 2205207 - DNA, 21 bp, Homo sapiens
ataaactttaccttttttata

SEQ ID NO: 2205208 - DNA, 24 bp, Homo sapiens
ataaactttaccttttttatacat

SEQ ID NO: 2205209 - DNA, 13 bp, Homo sapiens
ataaagcagcgtt

SEQ ID NO: 2205210 - DNA, 19 bp, Homo sapiens
ataaagcagcgtttctatg

SEQ ID NO: 2205211 - DNA, 14 bp, Homo sapiens
ataaatcgcttttg

SEQ ID NO: 2205212 - DNA, 22 bp, Homo sapiens
ataaatggttaaaagaggtttt

SEQ ID NO: 2205213 - DNA, 20 bp, Homo sapiens
ataactgttatttataatca

SEQ ID NO: 2205214 - DNA, 22 bp, Homo sapiens
ataactgttatttataatcact

SEQ ID NO: 2205215 - DNA, 20 bp, Homo sapiens
ataatgcgtgcataccactt

SEQ ID NO: 2205216 - DNA, 21 bp, Homo sapiens
ataatgtgaaactggattaaa

SEQ ID NO: 2205217 - DNA, 13 bp, Homo sapiens
atacaaaagcatg

SEQ ID NO: 2205218 - DNA, 14 bp, Homo sapiens
atacaatgctgtgc

SEQ ID NO: 2205219 - DNA, 15 bp, Homo sapiens
atacaccactacatt

SEQ ID NO: 2205220 - DNA, 17 bp, Homo sapiens
atacaccactacattct

SEQ ID NO: 2205221 - DNA, 18 bp, Homo sapiens
atacaccactacattctg

SEQ ID NO: 2205222 - DNA, 20 bp, Homo sapiens
atacaccactacattctgtt

SEQ ID NO: 2205223 - DNA, 17 bp, Homo sapiens
ataccagccagtaaatg

SEQ ID NO: 2205224 - DNA, 21 bp, Homo sapiens
atacctacatgtatttgtttg

SEQ ID NO: 2205225 - DNA, 14 bp, Homo sapiens
atacgtacacattt

SEQ ID NO: 2205226 - DNA, 15 bp, Homo sapiens
atacgtacacatttt

SEQ ID NO: 2205227 - DNA, 19 bp, Homo sapiens
atactgccttgtttaatgt

SEQ ID NO: 2205228 - DNA, 23 bp, Homo sapiens
atactgccttgtttaatgttaat

SEQ ID NO: 2205229 - DNA, 12 bp, Homo sapiens
atactgtttgag

SEQ ID NO: 2205230 - DNA, 16 bp, Homo sapiens
atactgtttgaggttt

SEQ ID NO: 2205231 - DNA, 15 bp, Homo sapiens
atagtggtgtgattt

SEQ ID NO: 2205232 - DNA, 16 bp, Homo sapiens
atataatttaaacgtg

SEQ ID NO: 2205233 - DNA, 13 bp, Homo sapiens
atatataaccagt

SEQ ID NO: 2205234 - DNA, 14 bp, Homo sapiens
atatatgtgatgat

SEQ ID NO: 2205235 - DNA, 13 bp, Homo sapiens
atatcatcagtat

SEQ ID NO: 2205236 - DNA, 17 bp, Homo sapiens
atatcatcagtattgaa

SEQ ID NO: 2205237 - DNA, 19 bp, Homo sapiens
atatcccttggacatttta

SEQ ID NO: 2205238 - DNA, 20 bp, Homo sapiens
atatcccttggacattttat

SEQ ID NO: 2205239 - DNA, 15 bp, Homo sapiens
atatgcacacatttt

SEQ ID NO: 2205240 - DNA, 22 bp, Homo sapiens
atattaccacagacatactaac

SEQ ID NO: 2205241 - DNA, 15 bp, Homo sapiens
atattttatgtgtaa

SEQ ID NO: 2205242 - DNA, 19 bp, Homo sapiens
atcaactgggctgaacact

SEQ ID NO: 2205243 - DNA, 22 bp, Homo sapiens
atcacagttttggttgctttaa

SEQ ID NO: 2205244 - DNA, 15 bp, Homo sapiens
atcagcacgatttct

SEQ ID NO: 2205245 - DNA, 22 bp, Homo sapiens
atcagtattgaagcattttata

SEQ ID NO: 2205246 - DNA, 15 bp, Homo sapiens
atccctactgtaatt

SEQ ID NO: 2205247 - DNA, 17 bp, Homo sapiens
atcccttggacatttta

SEQ ID NO: 2205248 - DNA, 11 bp, Homo sapiens
atcctcctcct

SEQ ID NO: 2205249 - DNA, 20 bp, Homo sapiens
atcctctcaaccacctttca

SEQ ID NO: 2205250 - DNA, 17 bp, Homo sapiens
atctaaatggaaccact

SEQ ID NO: 2205251 - DNA, 19 bp, Homo sapiens
atctaaatggaaccactct

SEQ ID NO: 2205252 - DNA, 13 bp, Homo sapiens
atctacttgcaca

SEQ ID NO: 2205253 - DNA, 16 bp, Homo sapiens
atctcaaatttctaaa

SEQ ID NO: 2205254 - DNA, 20 bp, Homo sapiens
atctccaaaataaaactttt

SEQ ID NO: 2205255 - DNA, 24 bp, Homo sapiens
atcttctcagaaggcaaatgactt

SEQ ID NO: 2205256 - DNA, 21 bp, Homo sapiens
atgaagtaatatgcacacatt

SEQ ID NO: 2205257 - DNA, 14 bp, Homo sapiens
atgaagtctctgaa

SEQ ID NO: 2205258 - DNA, 16 bp, Homo sapiens
atgacttcattaataa

SEQ ID NO: 2205259 - DNA, 21 bp, Homo sapiens
atgaggcatttgtttgaactg

SEQ ID NO: 2205260 - DNA, 14 bp, Homo sapiens
atgcaaggtcattt

SEQ ID NO: 2205261 - DNA, 16 bp, Homo sapiens
atgcaaggtcattttt

SEQ ID NO: 2205262 - DNA, 22 bp, Homo sapiens
atgcacacattttttaaatgca

SEQ ID NO: 2205263 - DNA, 17 bp, Homo sapiens
atgcacagagttgttac

SEQ ID NO: 2205264 - DNA, 19 bp, Homo sapiens
atgcacagagttgttacat

SEQ ID NO: 2205265 - DNA, 22 bp, Homo sapiens
atgcacagagttgttacatttt

SEQ ID NO: 2205266 - DNA, 13 bp, Homo sapiens
atgcacctggaat

SEQ ID NO: 2205267 - DNA, 16 bp, Homo sapiens
atgcatgaagtaatat

SEQ ID NO: 2205268 - DNA, 16 bp, Homo sapiens
atgccaagttgtttga

SEQ ID NO: 2205269 - DNA, 17 bp, Homo sapiens
atgctacacactgcatg

SEQ ID NO: 2205270 - DNA, 12 bp, Homo sapiens
atgcttgtacat

SEQ ID NO: 2205271 - DNA, 16 bp, Homo sapiens
atgcttgtacataatg

SEQ ID NO: 2205272 - DNA, 21 bp, Homo sapiens
atggtagttttacagtgtttc

SEQ ID NO: 2205273 - DNA, 22 bp, Homo sapiens
atggtagttttacagtgtttct

SEQ ID NO: 2205274 - DNA, 15 bp, Homo sapiens
atggtcggaaaacat

SEQ ID NO: 2205275 - DNA, 17 bp, Homo sapiens
atgtaacaacaattatt

SEQ ID NO: 2205276 - DNA, 14 bp, Homo sapiens
atgtatttgtttgc

SEQ ID NO: 2205277 - DNA, 19 bp, Homo sapiens
taaagcagcgtttctatga

SEQ ID NO: 2205278 - DNA, 15 bp, Homo sapiens
taaaggctacctttg

SEQ ID NO: 2205279 - DNA, 15 bp, Homo sapiens
taaagtgtatttttt

SEQ ID NO: 2205280 - DNA, 19 bp, Homo sapiens
taaagtgtatttttttact

SEQ ID NO: 2205281 - DNA, 20 bp, Homo sapiens
taaagtgtatttttttacta

SEQ ID NO: 2205282 - DNA, 22 bp, Homo sapiens
taaatatcccttggacatttta

SEQ ID NO: 2205283 - DNA, 18 bp, Homo sapiens
taaatcgcttttgataat

SEQ ID NO: 2205284 - DNA, 19 bp, Homo sapiens
taaatcgcttttgataatc

SEQ ID NO: 2205285 - DNA, 19 bp, Homo sapiens
taaatctccaaaataaaac

SEQ ID NO: 2205286 - DNA, 20 bp, Homo sapiens
taaatctccaaaataaaact

SEQ ID NO: 2205287 - DNA, 17 bp, Homo sapiens
taaatgggggtgcattt

SEQ ID NO: 2205288 - DNA, 20 bp, Homo sapiens
taaattaacttttataaact

SEQ ID NO: 2205289 - DNA, 17 bp, Homo sapiens
taaattcttgcaaagta

SEQ ID NO: 2205290 - DNA, 22 bp, Homo sapiens
taaattcttgcaaagtatccct

SEQ ID NO: 2205291 - DNA, 15 bp, Homo sapiens
taacaaaatttgaat

SEQ ID NO: 2205292 - DNA, 19 bp, Homo sapiens
taacaacaattatttgaag

SEQ ID NO: 2205293 - DNA, 20 bp, Homo sapiens
taacatcgaaaagttatttt

SEQ ID NO: 2205294 - DNA, 17 bp, Homo sapiens
taactgttatttataat

SEQ ID NO: 2205295 - DNA, 14 bp, Homo sapiens
taacttcaccatat

SEQ ID NO: 2205296 - DNA, 22 bp, Homo sapiens
taacttttataaactttacctt

SEQ ID NO: 2205297 - DNA, 13 bp, Homo sapiens
taagaatgaaata

SEQ ID NO: 2205298 - DNA, 21 bp, Homo sapiens
taaggatgcttgtacataatg

SEQ ID NO: 2205299 - DNA, 17 bp, Homo sapiens
taaggattttatgcttt

SEQ ID NO: 2205300 - DNA, 19 bp, Homo sapiens
taaggattttatgctttaa

SEQ ID NO: 2205301 - DNA, 15 bp, Homo sapiens
taagtatctgacatc

SEQ ID NO: 2205302 - DNA, 13 bp, Homo sapiens
taagtctgtttta

SEQ ID NO: 2205303 - DNA, 16 bp, Homo sapiens
taagtctgttttatga

SEQ ID NO: 2205304 - DNA, 14 bp, Homo sapiens
taagtgctgcattt

SEQ ID NO: 2205305 - DNA, 18 bp, Homo sapiens
taagtgctgcatttaaaa

SEQ ID NO: 2205306 - DNA, 19 bp, Homo sapiens
taatacaccactacattct

SEQ ID NO: 2205307 - DNA, 22 bp, Homo sapiens
taatagacaatttattatggca

SEQ ID NO: 2205308 - DNA, 14 bp, Homo sapiens
taatattttatgtg

SEQ ID NO: 2205309 - DNA, 15 bp, Homo sapiens
taatattttatgtgt

SEQ ID NO: 2205310 - DNA, 21 bp, Homo sapiens
taatcaactgggctgaacact

SEQ ID NO: 2205311 - DNA, 16 bp, Homo sapiens
taatcacttttttcca

SEQ ID NO: 2205312 - DNA, 18 bp, Homo sapiens
taatcacttttttccaca

SEQ ID NO: 2205313 - DNA, 11 bp, Homo sapiens
taatctaaatg

SEQ ID NO: 2205314 - DNA, 13 bp, Homo sapiens
taatctaaatgga

SEQ ID NO: 2205315 - DNA, 14 bp, Homo sapiens
taatgcgtgcatac

SEQ ID NO: 2205316 - DNA, 18 bp, Homo sapiens
taatggtagttttacagt

SEQ ID NO: 2205317 - DNA, 20 bp, Homo sapiens
taatgtgaaactggattaaa

SEQ ID NO: 2205318 - DNA, 23 bp, Homo sapiens
taatgtgaaactggattaaactt

SEQ ID NO: 2205319 - DNA, 21 bp, Homo sapiens
taatgtgacttggattcaatt

SEQ ID NO: 2205320 - DNA, 16 bp, Homo sapiens
taattattgatgtttt

SEQ ID NO: 2205321 - DNA, 20 bp, Homo sapiens
taatttgaaggtagaatgtt

SEQ ID NO: 2205322 - DNA, 18 bp, Homo sapiens
taatttgtgatacaatgc

SEQ ID NO: 2205323 - DNA, 15 bp, Homo sapiens
tacaaaagcatgtga

SEQ ID NO: 2205324 - DNA, 16 bp, Homo sapiens
tacaatgctgtgccct

SEQ ID NO: 2205325 - DNA, 17 bp, Homo sapiens
tacacactgcatgtttg

SEQ ID NO: 2205326 - DNA, 23 bp, Homo sapiens
tacacattttattttattatgca

SEQ ID NO: 2205327 - DNA, 19 bp, Homo sapiens
tacaccactacattctgtt

SEQ ID NO: 2205328 - DNA, 20 bp, Homo sapiens
tacactgtttcaaactttac

SEQ ID NO: 2205329 - DNA, 24 bp, Homo sapiens
tacagcaaggagatttacaactgg

SEQ ID NO: 2205330 - DNA, 23 bp, Homo sapiens
tacagttactcagaattctctag

SEQ ID NO: 2205331 - DNA, 23 bp, Homo sapiens
tacataatgcgtgcataccactt

SEQ ID NO: 2205332 - DNA, 16 bp, Homo sapiens
tacatgaaaacacatt

SEQ ID NO: 2205333 - DNA, 17 bp, Homo sapiens
tacatgaaaacacattt

SEQ ID NO: 2205334 - DNA, 14 bp, Homo sapiens
tacatttttaagtg

SEQ ID NO: 2205335 - DNA, 22 bp, Homo sapiens
tacatttttaagtgctgcattt

SEQ ID NO: 2205336 - DNA, 17 bp, Homo sapiens
taccacttttgttcttg

SEQ ID NO: 2205337 - DNA, 18 bp, Homo sapiens
taccagccagtaaatggg

SEQ ID NO: 2205338 - DNA, 21 bp, Homo sapiens
tacctcttgagccttgaactt

SEQ ID NO: 2205339 - DNA, 22 bp, Homo sapiens
tacctcttgagccttgaacttt

SEQ ID NO: 2205340 - DNA, 23 bp, Homo sapiens
tacctcttgagccttgaactttg

SEQ ID NO: 2205341 - DNA, 20 bp, Homo sapiens
tacctttgtattctctcctg

SEQ ID NO: 2205342 - DNA, 20 bp, Homo sapiens
tactacagtttgttagtatg

SEQ ID NO: 2205343 - DNA, 15 bp, Homo sapiens
tactctacaaaatat

SEQ ID NO: 2205344 - DNA, 17 bp, Homo sapiens
tactgtaatttgtgata

SEQ ID NO: 2205345 - DNA, 18 bp, Homo sapiens
tactgtaatttgtgatac

SEQ ID NO: 2205346 - DNA, 19 bp, Homo sapiens
tactgtaatttgtgataca

SEQ ID NO: 2205347 - DNA, 20 bp, Homo sapiens
tactgtaatttgtgatacaa

SEQ ID NO: 2205348 - DNA, 21 bp, Homo sapiens
tactgtacatgaaaacacatt

SEQ ID NO: 2205349 - DNA, 22 bp, Homo sapiens
tactgtacatgaaaacacattt

SEQ ID NO: 2205350 - DNA, 14 bp, Homo sapiens
tacttgcacactct

SEQ ID NO: 2205351 - DNA, 15 bp, Homo sapiens
tagaagattctatgt

SEQ ID NO: 2205352 - DNA, 18 bp, Homo sapiens
tagaagattctatgttaa

SEQ ID NO: 2205353 - DNA, 19 bp, Homo sapiens
tagaatgttttcaaatgtt

SEQ ID NO: 2205354 - DNA, 14 bp, Homo sapiens
tagaggttcaaaga

SEQ ID NO: 2205355 - DNA, 19 bp, Homo sapiens
tagaggttcaaagatattt

SEQ ID NO: 2205356 - DNA, 16 bp, Homo sapiens
tagatactgtatcatg

SEQ ID NO: 2205357 - DNA, 18 bp, Homo sapiens
tagcacacacttttggtt

SEQ ID NO: 2205358 - DNA, 19 bp, Homo sapiens
tagcatacgtacacatttt

SEQ ID NO: 2205359 - DNA, 19 bp, Homo sapiens
tagctaagatataatttaa

SEQ ID NO: 2205360 - DNA, 21 bp, Homo sapiens
taggaacttaaataatgtgaa

SEQ ID NO: 2205361 - DNA, 18 bp, Homo sapiens
taggagaagtcttctatt

SEQ ID NO: 2205362 - DNA, 20 bp, Homo sapiens
taggagaagtcttctattta

SEQ ID NO: 2205363 - DNA, 22 bp, Homo sapiens
taggagaagtcttctatttatt

SEQ ID NO: 2205364 - DNA, 21 bp, Homo sapiens
taggtgatctcatttaatcct

SEQ ID NO: 2205365 - DNA, 21 bp, Homo sapiens
taggtgtgactgaatttcttt

SEQ ID NO: 2205366 - DNA, 15 bp, Homo sapiens
tagtatgaggcattt

SEQ ID NO: 2205367 - DNA, 17 bp, Homo sapiens
tagtcatttgttaatat

SEQ ID NO: 2205368 - DNA, 19 bp, Homo sapiens
tagtcatttgttaatattt

SEQ ID NO: 2205369 - DNA, 23 bp, Homo sapiens
tagttcaatcctgattcatattt

SEQ ID NO: 2205370 - DNA, 23 bp, Homo sapiens
tagttcaatctggattcatattt

SEQ ID NO: 2205371 - DNA, 13 bp, Homo sapiens
tataaactttacc

SEQ ID NO: 2205372 - DNA, 15 bp, Homo sapiens
tataaactttacctt

SEQ ID NO: 2205373 - DNA, 18 bp, Homo sapiens
tataaactttaccttttt

SEQ ID NO: 2205374 - DNA, 23 bp, Homo sapiens
tataaatcgcttttgataatcaa

SEQ ID NO: 2205375 - DNA, 22 bp, Homo sapiens
tataaccagtgttgtggattta

SEQ ID NO: 2205376 - DNA, 17 bp, Homo sapiens
tatcatgacaaagactg

SEQ ID NO: 2205377 - DNA, 20 bp, Homo sapiens
tatccctactgtaatttgtg

SEQ ID NO: 2205378 - DNA, 17 bp, Homo sapiens
tatcccttggacatttt

SEQ ID NO: 2205379 - DNA, 18 bp, Homo sapiens
tatcccttggacatttta

SEQ ID NO: 2205380 - DNA, 16 bp, Homo sapiens
tatcgtcactgcttaa

SEQ ID NO: 2205381 - DNA, 16 bp, Homo sapiens
tatctagatactgtat

SEQ ID NO: 2205382 - DNA, 13 bp, Homo sapiens
tatgaggcatttg

SEQ ID NO: 2205383 - DNA, 21 bp, Homo sapiens
tatgaggcatttgtttgaact

SEQ ID NO: 2205384 - DNA, 18 bp, Homo sapiens
tatgcatgaagtaatatg

SEQ ID NO: 2205385 - DNA, 23 bp, Homo sapiens
tatgcatttgaaaattttgatgt

SEQ ID NO: 2205386 - DNA, 24 bp, Homo sapiens
tatgcatttgaaaattttgatgtt

SEQ ID NO: 2205387 - DNA, 23 bp, Homo sapiens
tatggcttttgtgcattatctag

SEQ ID NO: 2205388 - DNA, 15 bp, Homo sapiens
tatgtaacaacaatt

SEQ ID NO: 2205389 - DNA, 16 bp, Homo sapiens
tatgtaacaacaatta

SEQ ID NO: 2205390 - DNA, 14 bp, Homo sapiens
tatgtgcatttaat

SEQ ID NO: 2205391 - DNA, 13 bp, Homo sapiens
tatgttaatattt

SEQ ID NO: 2205392 - DNA, 20 bp, Homo sapiens
tatgttaatattttatgtgt

SEQ ID NO: 2205393 - DNA, 16 bp, Homo sapiens
tattaaaaatctcaaa

SEQ ID NO: 2205394 - DNA, 18 bp, Homo sapiens
tattaaaaatctcaaatt

SEQ ID NO: 2205395 - DNA, 16 bp, Homo sapiens
tattaagaatgaaata

SEQ ID NO: 2205396 - DNA, 22 bp, Homo sapiens
tattagcccttctccatggccc

SEQ ID NO: 2205397 - DNA, 12 bp, Homo sapiens
tattataccttt

SEQ ID NO: 2205398 - DNA, 13 bp, Homo sapiens
tattatattcatt

SEQ ID NO: 2205399 - DNA, 17 bp, Homo sapiens
tattctctcctgtacct

SEQ ID NO: 2205400 - DNA, 18 bp, Homo sapiens
tattctctcctgtacctc

SEQ ID NO: 2205401 - DNA, 12 bp, Homo sapiens
tattgaagcatt

SEQ ID NO: 2205402 - DNA, 13 bp, Homo sapiens
tattgaagcattt

SEQ ID NO: 2205403 - DNA, 19 bp, Homo sapiens
tattgaagcattttataaa

SEQ ID NO: 2205404 - DNA, 13 bp, Homo sapiens
tattgatgttttc

SEQ ID NO: 2205405 - DNA, 14 bp, Homo sapiens
tattgatgttttca

SEQ ID NO: 2205406 - DNA, 18 bp, Homo sapiens
tatttaacaaaatttgaa

SEQ ID NO: 2205407 - DNA, 16 bp, Homo sapiens
tatttaatttgaagat

SEQ ID NO: 2205408 - DNA, 14 bp, Homo sapiens
tatttattgaaatg

SEQ ID NO: 2205409 - DNA, 20 bp, Homo sapiens
tatttattgaaatgatttca

SEQ ID NO: 2205410 - DNA, 22 bp, Homo sapiens
tatttattgaaatgatttcaca

SEQ ID NO: 2205411 - DNA, 15 bp, Homo sapiens
tatttatttatttgt

SEQ ID NO: 2205412 - DNA, 15 bp, Homo sapiens
acactccaattaagg

SEQ ID NO: 2205413 - DNA, 21 bp, Homo sapiens
acactccaattaaggatttta

SEQ ID NO: 2205414 - DNA, 21 bp, Homo sapiens
acactctcccattatatttat

SEQ ID NO: 2205415 - DNA, 16 bp, Homo sapiens
acactgtttcaaactt

SEQ ID NO: 2205416 - DNA, 17 bp, Homo sapiens
acactgtttcaaacttt

SEQ ID NO: 2205417 - DNA, 20 bp, Homo sapiens
acactgtttcaaactttact

SEQ ID NO: 2205418 - DNA, 13 bp, Homo sapiens
acacttttggtta

SEQ ID NO: 2205419 - DNA, 13 bp, Homo sapiens
acagaaatgtaca

SEQ ID NO: 2205420 - DNA, 16 bp, Homo sapiens
acagtttgttagtatg

SEQ ID NO: 2205421 - DNA, 20 bp, Homo sapiens
acagtttgttagtatgaggc

SEQ ID NO: 2205422 - DNA, 18 bp, Homo sapiens
acagttttggttgcttta

SEQ ID NO: 2205423 - DNA, 21 bp, Homo sapiens
acataatgcgtgcataccact

SEQ ID NO: 2205424 - DNA, 22 bp, Homo sapiens
acatcaatgataatgctaattt

SEQ ID NO: 2205425 - DNA, 15 bp, Homo sapiens
acatcagcacgattt

SEQ ID NO: 2205426 - DNA, 19 bp, Homo sapiens
acatcagcacgatttctgt

SEQ ID NO: 2205427 - DNA, 17 bp, Homo sapiens
acatgcaaggtcatttt

SEQ ID NO: 2205428 - DNA, 13 bp, Homo sapiens
acatgtatgtaaa

SEQ ID NO: 2205429 - DNA, 18 bp, Homo sapiens
acatgtatttgtttgcat

SEQ ID NO: 2205430 - DNA, 12 bp, Homo sapiens
acattctgttaa

SEQ ID NO: 2205431 - DNA, 21 bp, Homo sapiens
acattggttcttgtattaaga

SEQ ID NO: 2205432 - DNA, 22 bp, Homo sapiens
acatttttaagtgctgcattta

SEQ ID NO: 2205433 - DNA, 13 bp, Homo sapiens
acatttttcttag

SEQ ID NO: 2205434 - DNA, 14 bp, Homo sapiens
accacgtttctaaa

SEQ ID NO: 2205435 - DNA, 14 bp, Homo sapiens
accactacattctg

SEQ ID NO: 2205436 - DNA, 15 bp, Homo sapiens
accactacattctgt

SEQ ID NO: 2205437 - DNA, 13 bp, Homo sapiens
accactttttgca

SEQ ID NO: 2205438 - DNA, 16 bp, Homo sapiens
accactttttgcagct

SEQ ID NO: 2205439 - DNA, 14 bp, Homo sapiens
accagcagaaatgc

SEQ ID NO: 2205440 - DNA, 17 bp, Homo sapiens
accagtgttgtggattt

SEQ ID NO: 2205441 - DNA, 19 bp, Homo sapiens
accataaccccggaagcca

SEQ ID NO: 2205442 - DNA, 14 bp, Homo sapiens
accatattaccaca

SEQ ID NO: 2205443 - DNA, 17 bp, Homo sapiens
accctcatgttcttaat

SEQ ID NO: 2205444 - DNA, 18 bp, Homo sapiens
acctctccagcctcagct

SEQ ID NO: 2205445 - DNA, 15 bp, Homo sapiens
acctctgcagcaata

SEQ ID NO: 2205446 - DNA, 18 bp, Homo sapiens
acctctgcagcaataaag

SEQ ID NO: 2205447 - DNA, 17 bp, Homo sapiens
acctggaatatataacc

SEQ ID NO: 2205448 - DNA, 21 bp, Homo sapiens
acctggattgcgcctaatgtg

SEQ ID NO: 2205449 - DNA, 23 bp, Homo sapiens
acctttcagataactgttattta

SEQ ID NO: 2205450 - DNA, 16 bp, Homo sapiens
accttttttatacata

SEQ ID NO: 2205451 - DNA, 19 bp, Homo sapiens
accttttttatacataaac

SEQ ID NO: 2205452 - DNA, 21 bp, Homo sapiens
accttttttatacataaacaa

SEQ ID NO: 2205453 - DNA, 14 bp, Homo sapiens
acgtttctaaaggc

SEQ ID NO: 2205454 - DNA, 15 bp, Homo sapiens
acgtttctaaaggct

SEQ ID NO: 2205455 - DNA, 14 bp, Homo sapiens
actaaaatgttcta

SEQ ID NO: 2205456 - DNA, 16 bp, Homo sapiens
actaaactttcacacc

SEQ ID NO: 2205457 - DNA, 16 bp, Homo sapiens
actaaccagcagaaat

SEQ ID NO: 2205458 - DNA, 14 bp, Homo sapiens
actacagtttgtta

SEQ ID NO: 2205459 - DNA, 13 bp, Homo sapiens
actacattctgtt

SEQ ID NO: 2205460 - DNA, 20 bp, Homo sapiens
actatatttttctcaatgtt

SEQ ID NO: 2205461 - DNA, 14 bp, Homo sapiens
actcagaattctct

SEQ ID NO: 2205462 - DNA, 23 bp, Homo sapiens
actctatcaagtattataccttt

SEQ ID NO: 2205463 - DNA, 15 bp, Homo sapiens
actgcatgtttgtga

SEQ ID NO: 2205464 - DNA, 19 bp, Homo sapiens
actgccttgtttaatgtta

SEQ ID NO: 2205465 - DNA, 18 bp, Homo sapiens
actgcttaacttcacata

SEQ ID NO: 2205466 - DNA, 21 bp, Homo sapiens
actgggctgaacactccaatt

SEQ ID NO: 2205467 - DNA, 14 bp, Homo sapiens
actgtatcatgaca

SEQ ID NO: 2205468 - DNA, 14 bp, Homo sapiens
actgtttagatgaa

SEQ ID NO: 2205469 - DNA, 13 bp, Homo sapiens
acttaatctaaat

SEQ ID NO: 2205470 - DNA, 16 bp, Homo sapiens
acttaatctaaatgga

SEQ ID NO: 2205471 - DNA, 21 bp, Homo sapiens
acttaggagaagtcttctatt

SEQ ID NO: 2205472 - DNA, 23 bp, Homo sapiens
acttaggagaagtcttctattta

SEQ ID NO: 2205473 - DNA, 19 bp, Homo sapiens
acttcacatattgatttcc

SEQ ID NO: 2205474 - DNA, 15 bp, Homo sapiens
acttggattcaattt

SEQ ID NO: 2205475 - DNA, 18 bp, Homo sapiens
acttggattcaattttaa

SEQ ID NO: 2205476 - DNA, 12 bp, Homo sapiens
actttacctttt

SEQ ID NO: 2205477 - DNA, 22 bp, Homo sapiens
actttaccttttttatacataa

SEQ ID NO: 2205478 - DNA, 23 bp, Homo sapiens
actttgacctctgcagcaataaa

SEQ ID NO: 2205479 - DNA, 15 bp, Homo sapiens
acttttataaacttt

SEQ ID NO: 2205480 - DNA, 20 bp, Homo sapiens
acttttggttaagtctgttt

SEQ ID NO: 2205481 - DNA, 13 bp, Homo sapiens
acttttttccaca

SEQ ID NO: 2205482 - DNA, 15 bp, Homo sapiens
agaaatgtacagcaa

SEQ ID NO: 2205483 - DNA, 11 bp, Homo sapiens
agaaatgtgtt

SEQ ID NO: 2205484 - DNA, 13 bp, Homo sapiens
agaaattaagtat

SEQ ID NO: 2205485 - DNA, 13 bp, Homo sapiens
agaagattctatg

SEQ ID NO: 2205486 - DNA, 14 bp, Homo sapiens
agaaggcaaatgac

SEQ ID NO: 2205487 - DNA, 15 bp, Homo sapiens
agaaggcaaatgact

SEQ ID NO: 2205488 - DNA, 16 bp, Homo sapiens
agaagtcttctattta

SEQ ID NO: 2205489 - DNA, 18 bp, Homo sapiens
agaagtcttctatttatt

SEQ ID NO: 2205490 - DNA, 16 bp, Homo sapiens
agaatgaaatactgtt

SEQ ID NO: 2205491 - DNA, 19 bp, Homo sapiens
agaatgaaatactgtttga

SEQ ID NO: 2205492 - DNA, 14 bp, Homo sapiens
agaattctctagtt

SEQ ID NO: 2205493 - DNA, 19 bp, Homo sapiens
agaattctctagtttgatt

SEQ ID NO: 2205494 - DNA, 20 bp, Homo sapiens
agacaatgacttactgtaca

SEQ ID NO: 2205495 - DNA, 14 bp, Homo sapiens
agaccacgtttcta

SEQ ID NO: 2205496 - DNA, 15 bp, Homo sapiens
agaccacgtttctaa

SEQ ID NO: 2205497 - DNA, 20 bp, Homo sapiens
agactgagtacgttgtgcat

SEQ ID NO: 2205498 - DNA, 22 bp, Homo sapiens
agactgagtacgttgtgcattt

SEQ ID NO: 2205499 - DNA, 19 bp, Homo sapiens
agaggttcaaagatatttt

SEQ ID NO: 2205500 - DNA, 22 bp, Homo sapiens
agaggtttttcttaaataataa

SEQ ID NO: 2205501 - DNA, 16 bp, Homo sapiens
agatactgtatcatga

SEQ ID NO: 2205502 - DNA, 21 bp, Homo sapiens
agatattttgctttgtgattt

SEQ ID NO: 2205503 - DNA, 23 bp, Homo sapiens
agatgaatgtcagttgttattta

SEQ ID NO: 2205504 - DNA, 19 bp, Homo sapiens
agcaaggagatttacaact

SEQ ID NO: 2205505 - DNA, 15 bp, Homo sapiens
agcacgatttctgtt

SEQ ID NO: 2205506 - DNA, 19 bp, Homo sapiens
agcacgatttctgtttaga

SEQ ID NO: 2205507 - DNA, 18 bp, Homo sapiens
agcatacgtacacatttt

SEQ ID NO: 2205508 - DNA, 23 bp, Homo sapiens
agcatcacttaggagaagtcttc

SEQ ID NO: 2205509 - DNA, 19 bp, Homo sapiens
agcatcgcttaggagaagt

SEQ ID NO: 2205510 - DNA, 15 bp, Homo sapiens
agcattttataaatc

SEQ ID NO: 2205511 - DNA, 20 bp, Homo sapiens
agcattttataaatcgcttt

SEQ ID NO: 2205512 - DNA, 16 bp, Homo sapiens
agccaaacctctgtga

SEQ ID NO: 2205513 - DNA, 19 bp, Homo sapiens
agccctgctgctgcctgcc

SEQ ID NO: 2205514 - DNA, 21 bp, Homo sapiens
agcccttctccatggccctgc

SEQ ID NO: 2205515 - DNA, 23 bp, Homo sapiens
agcctcagctctcagttgcagcc

SEQ ID NO: 2205516 - DNA, 21 bp, Homo sapiens
agctctcagttgcagccctgc

SEQ ID NO: 2205517 - DNA, 19 bp, Homo sapiens
aggaaactgggttcctgca

SEQ ID NO: 2205518 - DNA, 21 bp, Homo sapiens
aggaacttaaataatgtgaaa

SEQ ID NO: 2205519 - DNA, 14 bp, Homo sapiens
aggaaggttctggt

SEQ ID NO: 2205520 - DNA, 21 bp, Homo sapiens
aggaaggttctggtgtgaact

SEQ ID NO: 2205521 - DNA, 23 bp, Homo sapiens
aggatgcttgtacataatgcgtg

SEQ ID NO: 2205522 - DNA, 11 bp, Homo sapiens
aggattttatg

SEQ ID NO: 2205523 - DNA, 20 bp, Homo sapiens
aggattttatgctttaaaca

SEQ ID NO: 2205524 - DNA, 15 bp, Homo sapiens
aggcaaatgactttg

SEQ ID NO: 2205525 - DNA, 20 bp, Homo sapiens
aggcatatttaacaaaattt

SEQ ID NO: 2205526 - DNA, 13 bp, Homo sapiens
aggctacctttgt

SEQ ID NO: 2205527 - DNA, 15 bp, Homo sapiens
aggctacctttgtat

SEQ ID NO: 2205528 - DNA, 22 bp, Homo sapiens
agggaaggatacaaaagcatgt

SEQ ID NO: 2205529 - DNA, 20 bp, Homo sapiens
aggtcattttttttaagaaa

SEQ ID NO: 2205530 - DNA, 22 bp, Homo sapiens
aggtctgttctttccaaagtac

SEQ ID NO: 2205531 - DNA, 14 bp, Homo sapiens
aggttatgattgaa

SEQ ID NO: 2205532 - DNA, 17 bp, Homo sapiens
aggttctggtgtgaact

SEQ ID NO: 2205533 - DNA, 13 bp, Homo sapiens
aggtttcgatatt

SEQ ID NO: 2205534 - DNA, 14 bp, Homo sapiens
aggtttttaagcct

SEQ ID NO: 2205535 - DNA, 16 bp, Homo sapiens
agtaaaggcaaactta

SEQ ID NO: 2205536 - DNA, 18 bp, Homo sapiens
cattttataaatcgcttt

SEQ ID NO: 2205537 - DNA, 21 bp, Homo sapiens
cattttataaatcgcttttga

SEQ ID NO: 2205538 - DNA, 13 bp, Homo sapiens
cattttatgtctt

SEQ ID NO: 2205539 - DNA, 20 bp, Homo sapiens
catttttaagtgctgcattt

SEQ ID NO: 2205540 - DNA, 21 bp, Homo sapiens
catttttaagtgctgcattta

SEQ ID NO: 2205541 - DNA, 16 bp, Homo sapiens
cattttttaaatgcac

SEQ ID NO: 2205542 - DNA, 18 bp, Homo sapiens
ccaaagtacactgtttca

SEQ ID NO: 2205543 - DNA, 20 bp, Homo sapiens
ccaaagtacactgtttcaaa

SEQ ID NO: 2205544 - DNA, 14 bp, Homo sapiens
ccactttttgcagc

SEQ ID NO: 2205545 - DNA, 13 bp, Homo sapiens
ccagacgatgtct

SEQ ID NO: 2205546 - DNA, 20 bp, Homo sapiens
ccagacgatgtcttcatacc

SEQ ID NO: 2205547 - DNA, 14 bp, Homo sapiens
ccagcctcagctct

SEQ ID NO: 2205548 - DNA, 21 bp, Homo sapiens
ccagtaaatgggggtgcattt

SEQ ID NO: 2205549 - DNA, 22 bp, Homo sapiens
ccagtcattatgttaatatttc

SEQ ID NO: 2205550 - DNA, 18 bp, Homo sapiens
ccagtgagatcaatgtga

SEQ ID NO: 2205551 - DNA, 23 bp, Homo sapiens
ccattatatttattgtttatttt

SEQ ID NO: 2205552 - DNA, 16 bp, Homo sapiens
cccaagttagttcaat

SEQ ID NO: 2205553 - DNA, 15 bp, Homo sapiens
cccctgccacctcct

SEQ ID NO: 2205554 - DNA, 17 bp, Homo sapiens
cccctgccacctcctgc

SEQ ID NO: 2205555 - DNA, 22 bp, Homo sapiens
ccctaaagtgtatttttttact

SEQ ID NO: 2205556 - DNA, 20 bp, Homo sapiens
ccctgccacctcctgcctca

SEQ ID NO: 2205557 - DNA, 11 bp, Homo sapiens
ccggaagccaa

SEQ ID NO: 2205558 - DNA, 22 bp, Homo sapiens
ccggaagccaaacctctgtgag

SEQ ID NO: 2205559 - DNA, 17 bp, Homo sapiens
cctagcacacacttttg

SEQ ID NO: 2205560 - DNA, 19 bp, Homo sapiens
cctagcatacgtacacatt

SEQ ID NO: 2205561 - DNA, 21 bp, Homo sapiens
cctagcatacgtacacatttt

SEQ ID NO: 2205562 - DNA, 19 bp, Homo sapiens
cctcatgttcttaattctt

SEQ ID NO: 2205563 - DNA, 21 bp, Homo sapiens
cctgcaatgaagtctctgaag

SEQ ID NO: 2205564 - DNA, 17 bp, Homo sapiens
cctgctgctgcctgcct

SEQ ID NO: 2205565 - DNA, 22 bp, Homo sapiens
ccttctccatggccctgccatg

SEQ ID NO: 2205566 - DNA, 21 bp, Homo sapiens
ccttggacattttatgtcttt

SEQ ID NO: 2205567 - DNA, 20 bp, Homo sapiens
cctttgtattctctcctgta

SEQ ID NO: 2205568 - DNA, 24 bp, Homo sapiens
cctttgtattctctcctgtacctc

SEQ ID NO: 2205569 - DNA, 19 bp, Homo sapiens
ccttttttatacataaaca

SEQ ID NO: 2205570 - DNA, 20 bp, Homo sapiens
cgatttctgtttagataata

SEQ ID NO: 2205571 - DNA, 15 bp, Homo sapiens
cggaaaacatgctac

SEQ ID NO: 2205572 - DNA, 22 bp, Homo sapiens
cgtacacattttattttattat

SEQ ID NO: 2205573 - DNA, 20 bp, Homo sapiens
cgtgatgacatatcacatgt

SEQ ID NO: 2205574 - DNA, 21 bp, Homo sapiens
cgtttctaaaggctacctttg

SEQ ID NO: 2205575 - DNA, 15 bp, Homo sapiens
ctaaaggctaccttt

SEQ ID NO: 2205576 - DNA, 19 bp, Homo sapiens
ctaaagtgtatttttttac

SEQ ID NO: 2205577 - DNA, 17 bp, Homo sapiens
ctaagatataatttaaa

SEQ ID NO: 2205578 - DNA, 23 bp, Homo sapiens
ctaagtttttatggcttttgtgc

SEQ ID NO: 2205579 - DNA, 23 bp, Homo sapiens
ctaatagacaatttattatggca

SEQ ID NO: 2205580 - DNA, 11 bp, Homo sapiens
ctaatgtgttt

SEQ ID NO: 2205581 - DNA, 21 bp, Homo sapiens
ctacacactgcatgtttgtga

SEQ ID NO: 2205582 - DNA, 13 bp, Homo sapiens
ctacattctgtta

SEQ ID NO: 2205583 - DNA, 17 bp, Homo sapiens
ctacctttgtattctct

SEQ ID NO: 2205584 - DNA, 16 bp, Homo sapiens
ctactgtaatttgtga

SEQ ID NO: 2205585 - DNA, 20 bp, Homo sapiens
ctagcatacgtacacatttt

SEQ ID NO: 2205586 - DNA, 23 bp, Homo sapiens
ctagtcatttgttaatatttctt

SEQ ID NO: 2205587 - DNA, 13 bp, Homo sapiens
ctagtttgattaa

SEQ ID NO: 2205588 - DNA, 15 bp, Homo sapiens
ctagtttgattaaat

SEQ ID NO: 2205589 - DNA, 17 bp, Homo sapiens
ctagtttgattaaattc

SEQ ID NO: 2205590 - DNA, 14 bp, Homo sapiens
ctatgcatttgaaa

SEQ ID NO: 2205591 - DNA, 16 bp, Homo sapiens
ctattttgtaactgta

SEQ ID NO: 2205592 - DNA, 20 bp, Homo sapiens
ctattttttttctgttatat

SEQ ID NO: 2205593 - DNA, 21 bp, Homo sapiens
ctattttttttctgttatata

SEQ ID NO: 2205594 - DNA, 13 bp, Homo sapiens
ctcaaatttctaa

SEQ ID NO: 2205595 - DNA, 20 bp, Homo sapiens
ctcagctctcagttgcagcc

SEQ ID NO: 2205596 - DNA, 14 bp, Homo sapiens
ctcatgttcttaat

SEQ ID NO: 2205597 - DNA, 17 bp, Homo sapiens
ctccaattaaggatttt

SEQ ID NO: 2205598 - DNA, 12 bp, Homo sapiens
ctccagcctcag

SEQ ID NO: 2205599 - DNA, 17 bp, Homo sapiens
ctccctattttttttct

SEQ ID NO: 2205600 - DNA, 22 bp, Homo sapiens
ctccctattttttttctgttat

SEQ ID NO: 2205601 - DNA, 20 bp, Homo sapiens
ctctagtttgattaaattct

SEQ ID NO: 2205602 - DNA, 21 bp, Homo sapiens
ctctagtttgattaaattctt

SEQ ID NO: 2205603 - DNA, 15 bp, Homo sapiens
ctctccaaaccactt

SEQ ID NO: 2205604 - DNA, 17 bp, Homo sapiens
ctctcctgtacctcttg

SEQ ID NO: 2205605 - DNA, 23 bp, Homo sapiens
ctctgaagtgaaactgcttgttt

SEQ ID NO: 2205606 - DNA, 18 bp, Homo sapiens
ctctgcagcaataaagca

SEQ ID NO: 2205607 - DNA, 19 bp, Homo sapiens
ctctgcagcaataaagcag

SEQ ID NO: 2205608 - DNA, 22 bp, Homo sapiens
ctcttgaaatataggaacttaa

SEQ ID NO: 2205609 - DNA, 17 bp, Homo sapiens
ctcttgagccttgaact

SEQ ID NO: 2205610 - DNA, 18 bp, Homo sapiens
ctcttgagccttgaactt

SEQ ID NO: 2205611 - DNA, 23 bp, Homo sapiens
ctgaacactccaattaaggattt

SEQ ID NO: 2205612 - DNA, 17 bp, Homo sapiens
ctgaagtgaaactgctt

SEQ ID NO: 2205613 - DNA, 14 bp, Homo sapiens
ctgacatctctgca

SEQ ID NO: 2205614 - DNA, 16 bp, Homo sapiens
ctgacatctctgcaat

SEQ ID NO: 2205615 - DNA, 21 bp, Homo sapiens
ctgataaagatgagtgagcat

SEQ ID NO: 2205616 - DNA, 19 bp, Homo sapiens
ctgatgccaagttgtttga

SEQ ID NO: 2205617 - DNA, 12 bp, Homo sapiens
ctgattcatatt

SEQ ID NO: 2205618 - DNA, 23 bp, Homo sapiens
ctgcctggacttggcccctgcca

SEQ ID NO: 2205619 - DNA, 14 bp, Homo sapiens
ctgctgctgcctgc

SEQ ID NO: 2205620 - DNA, 18 bp, Homo sapiens
ctggaatatataaccagt

SEQ ID NO: 2205621 - DNA, 14 bp, Homo sapiens
ctggcctttcatat

SEQ ID NO: 2205622 - DNA, 14 bp, Homo sapiens
ctggctatgcattt

SEQ ID NO: 2205623 - DNA, 16 bp, Homo sapiens
ctggtgtgaactaaac

SEQ ID NO: 2205624 - DNA, 22 bp, Homo sapiens
ctgtacatgaaaacacattttt

SEQ ID NO: 2205625 - DNA, 22 bp, Homo sapiens
ctgtacctcttgagccttgaac

SEQ ID NO: 2205626 - DNA, 19 bp, Homo sapiens
ctgtgccctaaagtgtatt

SEQ ID NO: 2205627 - DNA, 13 bp, Homo sapiens
ctgttctttctgg

SEQ ID NO: 2205628 - DNA, 14 bp, Homo sapiens
ctgttctttctggc

SEQ ID NO: 2205629 - DNA, 21 bp, Homo sapiens
ctgttctttctggctatgcat

SEQ ID NO: 2205630 - DNA, 23 bp, Homo sapiens
ctgttctttctggctatgcattt

SEQ ID NO: 2205631 - DNA, 14 bp, Homo sapiens
ctgtttagataata

SEQ ID NO: 2205632 - DNA, 15 bp, Homo sapiens
ctgtttcaaacttta

SEQ ID NO: 2205633 - DNA, 13 bp, Homo sapiens
ctgttttatgact

SEQ ID NO: 2205634 - DNA, 15 bp, Homo sapiens
ctgttttatgacttc

SEQ ID NO: 2205635 - DNA, 22 bp, Homo sapiens
cttaaataataaagatcatgta

SEQ ID NO: 2205636 - DNA, 19 bp, Homo sapiens
cttaaataatgtgaaactg

SEQ ID NO: 2205637 - DNA, 14 bp, Homo sapiens
cttaacttcacata

SEQ ID NO: 2205638 - DNA, 22 bp, Homo sapiens
cttaacttcacatattgatttc

SEQ ID NO: 2205639 - DNA, 10 bp, Homo sapiens
cttaattatt

SEQ ID NO: 2205640 - DNA, 17 bp, Homo sapiens
cttaccctcatgttctt

SEQ ID NO: 2205641 - DNA, 16 bp, Homo sapiens
cttactgtacatgaaa

SEQ ID NO: 2205642 - DNA, 16 bp, Homo sapiens
cttctatttatttatt

SEQ ID NO: 2205643 - DNA, 22 bp, Homo sapiens
cttctatttatttatttattca

SEQ ID NO: 2205644 - DNA, 20 bp, Homo sapiens
cttgagccttgaactttgac

SEQ ID NO: 2205645 - DNA, 22 bp, Homo sapiens
cttgcaaagtatccctactgta

SEQ ID NO: 2205646 - DNA, 14 bp, Homo sapiens
cttggacattttat

SEQ ID NO: 2205647 - DNA, 15 bp, Homo sapiens
cttggattcaatttt

SEQ ID NO: 2205648 - DNA, 16 bp, Homo sapiens
cttggattcaatttta

SEQ ID NO: 2205649 - DNA, 14 bp, Homo sapiens
cttggtttgtaaat

SEQ ID NO: 2205650 - DNA, 15 bp, Homo sapiens
cttggtttgtaaatt

SEQ ID NO: 2205651 - DNA, 15 bp, Homo sapiens
cttgtacataatgcg

SEQ ID NO: 2205652 - DNA, 18 bp, Homo sapiens
agtaaatgggggtgcatt

SEQ ID NO: 2205653 - DNA, 14 bp, Homo sapiens
agtaatatgcacac

SEQ ID NO: 2205654 - DNA, 16 bp, Homo sapiens
agtacactgtttcaaa

SEQ ID NO: 2205655 - DNA, 17 bp, Homo sapiens
agtacgttgtgcatttg

SEQ ID NO: 2205656 - DNA, 15 bp, Homo sapiens
agtatcagctacaat

SEQ ID NO: 2205657 - DNA, 20 bp, Homo sapiens
agtatgaggcatttgtttga

SEQ ID NO: 2205658 - DNA, 21 bp, Homo sapiens
agtatgaggcatttgtttgaa

SEQ ID NO: 2205659 - DNA, 20 bp, Homo sapiens
agtattgaagcattttataa

SEQ ID NO: 2205660 - DNA, 19 bp, Homo sapiens
agtctctgaagtgaaactg

SEQ ID NO: 2205661 - DNA, 18 bp, Homo sapiens
agtctgttttatgacttc

SEQ ID NO: 2205662 - DNA, 14 bp, Homo sapiens
agtcttctatttat

SEQ ID NO: 2205663 - DNA, 16 bp, Homo sapiens
agtgaagacaatgact

SEQ ID NO: 2205664 - DNA, 12 bp, Homo sapiens
agtgctgcattt

SEQ ID NO: 2205665 - DNA, 13 bp, Homo sapiens
agtgctgcattta

SEQ ID NO: 2205666 - DNA, 17 bp, Homo sapiens
agtgctgcatttaaaag

SEQ ID NO: 2205667 - DNA, 17 bp, Homo sapiens
agtggtggttttctgtt

SEQ ID NO: 2205668 - DNA, 18 bp, Homo sapiens
agtggtggttttctgttc

SEQ ID NO: 2205669 - DNA, 20 bp, Homo sapiens
agtggtggttttctgttctt

SEQ ID NO: 2205670 - DNA, 20 bp, Homo sapiens
agtgtgtggtcaacatttct

SEQ ID NO: 2205671 - DNA, 17 bp, Homo sapiens
agtgtttccctctgtgt

SEQ ID NO: 2205672 - DNA, 22 bp, Homo sapiens
agttgttacatttttaagtgct

SEQ ID NO: 2205673 - DNA, 16 bp, Homo sapiens
agtttgattaaattct

SEQ ID NO: 2205674 - DNA, 20 bp, Homo sapiens
agtttgattaaattcttgca

SEQ ID NO: 2205675 - DNA, 13 bp, Homo sapiens
ataaactttacct

SEQ ID NO: 2205676 - DNA, 19 bp, Homo sapiens
ataaatcgcttttgataat

SEQ ID NO: 2205677 - DNA, 21 bp, Homo sapiens
ataaatcgcttttgataatca

SEQ ID NO: 2205678 - DNA, 21 bp, Homo sapiens
ataaattccctggcctttcat

SEQ ID NO: 2205679 - DNA, 22 bp, Homo sapiens
ataaattccctggcctttcata

SEQ ID NO: 2205680 - DNA, 23 bp, Homo sapiens
ataacatcgaaaagttattttgt

SEQ ID NO: 2205681 - DNA, 23 bp, Homo sapiens
ataataaattccctggcctttca

SEQ ID NO: 2205682 - DNA, 19 bp, Homo sapiens
ataatcacttttttccaca

SEQ ID NO: 2205683 - DNA, 15 bp, Homo sapiens
ataatgctaatttta

SEQ ID NO: 2205684 - DNA, 18 bp, Homo sapiens
ataatgtgaaactggatt

SEQ ID NO: 2205685 - DNA, 15 bp, Homo sapiens
atacaaaagcatgtg

SEQ ID NO: 2205686 - DNA, 21 bp, Homo sapiens
atacaccactacattctgtta

SEQ ID NO: 2205687 - DNA, 20 bp, Homo sapiens
atacagttactcagaattct

SEQ ID NO: 2205688 - DNA, 20 bp, Homo sapiens
atacataaacaagaccacgt

SEQ ID NO: 2205689 - DNA, 17 bp, Homo sapiens
ataccacttttgttctt

SEQ ID NO: 2205690 - DNA, 13 bp, Homo sapiens
atactaaccagca

SEQ ID NO: 2205691 - DNA, 19 bp, Homo sapiens
atactaaccagcagaaatg

SEQ ID NO: 2205692 - DNA, 20 bp, Homo sapiens
atactaaccagcagaaatgc

SEQ ID NO: 2205693 - DNA, 21 bp, Homo sapiens
atactaaccagcagaaatgcc

SEQ ID NO: 2205694 - DNA, 20 bp, Homo sapiens
atactacagtttgttagtat

SEQ ID NO: 2205695 - DNA, 16 bp, Homo sapiens
atactgccttgtttaa

SEQ ID NO: 2205696 - DNA, 18 bp, Homo sapiens
atactgccttgtttaatg

SEQ ID NO: 2205697 - DNA, 22 bp, Homo sapiens
atactgccttgtttaatgttaa

SEQ ID NO: 2205698 - DNA, 22 bp, Homo sapiens
atagacaatttattatggcaca

SEQ ID NO: 2205699 - DNA, 22 bp, Homo sapiens
atagctaagatataatttaaac

SEQ ID NO: 2205700 - DNA, 19 bp, Homo sapiens
ataggaacttaaataatgt

SEQ ID NO: 2205701 - DNA, 16 bp, Homo sapiens
atataggaacttaaat

SEQ ID NO: 2205702 - DNA, 22 bp, Homo sapiens
atatcatcagtattgaagcatt

SEQ ID NO: 2205703 - DNA, 17 bp, Homo sapiens
atattaccacagacata

SEQ ID NO: 2205704 - DNA, 17 bp, Homo sapiens
atattcattctttttga

SEQ ID NO: 2205705 - DNA, 22 bp, Homo sapiens
atattgatttccgttaaaatac

SEQ ID NO: 2205706 - DNA, 23 bp, Homo sapiens
atatttctgaggagcctgcaaca

SEQ ID NO: 2205707 - DNA, 14 bp, Homo sapiens
atcaagtattatac

SEQ ID NO: 2205708 - DNA, 18 bp, Homo sapiens
atcaagtattataccttt

SEQ ID NO: 2205709 - DNA, 15 bp, Homo sapiens
atcacagttttggtt

SEQ ID NO: 2205710 - DNA, 21 bp, Homo sapiens
atcacagttttggttgcttta

SEQ ID NO: 2205711 - DNA, 20 bp, Homo sapiens
atcacttaggagaagtcttc

SEQ ID NO: 2205712 - DNA, 23 bp, Homo sapiens
atcagcacgatttctgtttagat

SEQ ID NO: 2205713 - DNA, 19 bp, Homo sapiens
atcatcagtattgaagcat

SEQ ID NO: 2205714 - DNA, 20 bp, Homo sapiens
atcatgacaaagactgagta

SEQ ID NO: 2205715 - DNA, 16 bp, Homo sapiens
atcattaggtgtgact

SEQ ID NO: 2205716 - DNA, 21 bp, Homo sapiens
atccaagaaaatggccagtga

SEQ ID NO: 2205717 - DNA, 20 bp, Homo sapiens
atcccttggacattttatgt

SEQ ID NO: 2205718 - DNA, 21 bp, Homo sapiens
atcccttggacattttatgtc

SEQ ID NO: 2205719 - DNA, 14 bp, Homo sapiens
atcgtcactgctta

SEQ ID NO: 2205720 - DNA, 13 bp, Homo sapiens
atctccaaaataa

SEQ ID NO: 2205721 - DNA, 14 bp, Homo sapiens
atctccaaaataaa

SEQ ID NO: 2205722 - DNA, 17 bp, Homo sapiens
atctccaaaataaaact

SEQ ID NO: 2205723 - DNA, 21 bp, Homo sapiens
atctccaaaataaaacttttt

SEQ ID NO: 2205724 - DNA, 14 bp, Homo sapiens
atgaaaacacattt

SEQ ID NO: 2205725 - DNA, 15 bp, Homo sapiens
atgaaaacacatttt

SEQ ID NO: 2205726 - DNA, 22 bp, Homo sapiens
atgaaatactgtttgaggtttt

SEQ ID NO: 2205727 - DNA, 14 bp, Homo sapiens
atgaagtaatatgc

SEQ ID NO: 2205728 - DNA, 23 bp, Homo sapiens
atgaatgtcagttgttatttatt

SEQ ID NO: 2205729 - DNA, 12 bp, Homo sapiens
atgactttggac

SEQ ID NO: 2205730 - DNA, 22 bp, Homo sapiens
atgataatgctaattttattat

SEQ ID NO: 2205731 - DNA, 23 bp, Homo sapiens
atgatctaccagcctccctattt

SEQ ID NO: 2205732 - DNA, 13 bp, Homo sapiens
atgatttcacagt

SEQ ID NO: 2205733 - DNA, 15 bp, Homo sapiens
atgcacacatttttt

SEQ ID NO: 2205734 - DNA, 17 bp, Homo sapiens
atgcacacattttttaa

SEQ ID NO: 2205735 - DNA, 18 bp, Homo sapiens
atgcacagagttgttaca

SEQ ID NO: 2205736 - DNA, 23 bp, Homo sapiens
atgcacagagttgttacattttt

SEQ ID NO: 2205737 - DNA, 14 bp, Homo sapiens
atgcacctggaata

SEQ ID NO: 2205738 - DNA, 12 bp, Homo sapiens
atgcatttgaaa

SEQ ID NO: 2205739 - DNA, 23 bp, Homo sapiens
atgccaagttgtttgagaaatta

SEQ ID NO: 2205740 - DNA, 20 bp, Homo sapiens
atgcgtgcataccacttttg

SEQ ID NO: 2205741 - DNA, 22 bp, Homo sapiens
atgcgtgcataccacttttgtt

SEQ ID NO: 2205742 - DNA, 19 bp, Homo sapiens
atgctgtgccctaaagtgt

SEQ ID NO: 2205743 - DNA, 14 bp, Homo sapiens
atgcttgtacataa

SEQ ID NO: 2205744 - DNA, 15 bp, Homo sapiens
atgcttgtacataat

SEQ ID NO: 2205745 - DNA, 18 bp, Homo sapiens
atggcctcttcagatctc

SEQ ID NO: 2205746 - DNA, 17 bp, Homo sapiens
atggcttttgtgcatta

SEQ ID NO: 2205747 - DNA, 14 bp, Homo sapiens
atgggggtgcattt

SEQ ID NO: 2205748 - DNA, 15 bp, Homo sapiens
atgggggtgcatttg

SEQ ID NO: 2205749 - DNA, 18 bp, Homo sapiens
atgtaaatagctaagata

SEQ ID NO: 2205750 - DNA, 15 bp, Homo sapiens
atgtaacaacaatta

SEQ ID NO: 2205751 - DNA, 16 bp, Homo sapiens
atgtcagccactgtga

SEQ ID NO: 2205752 - DNA, 22 bp, Homo sapiens
atgtcttcatacctacatgtat

SEQ ID NO: 2205753 - DNA, 22 bp, Homo sapiens
atgtgaaactggattaaactta

SEQ ID NO: 2205754 - DNA, 19 bp, Homo sapiens
atgtgcacatctgttttgt

SEQ ID NO: 2205755 - DNA, 15 bp, Homo sapiens
atgtgtgtctatttt

SEQ ID NO: 2205756 - DNA, 13 bp, Homo sapiens
atgttaatatttt

SEQ ID NO: 2205757 - DNA, 22 bp, Homo sapiens
atgttaatattttaggtgtaaa

SEQ ID NO: 2205758 - DNA, 19 bp, Homo sapiens
attaaaaatctcaaatttc

SEQ ID NO: 2205759 - DNA, 22 bp, Homo sapiens
attaaaaatctcaaatttctaa

SEQ ID NO: 2205760 - DNA, 23 bp, Homo sapiens
attaaaaatctcaaatttctaaa

SEQ ID NO: 2205761 - DNA, 13 bp, Homo sapiens
attaaataaaatt

SEQ ID NO: 2205762 - DNA, 20 bp, Homo sapiens
attaaataaaatttttatgt

SEQ ID NO: 2205763 - DNA, 21 bp, Homo sapiens
attaaataaaatttttatgta

SEQ ID NO: 2205764 - DNA, 22 bp, Homo sapiens
attaaataaaatttttatgtaa

SEQ ID NO: 2205765 - DNA, 18 bp, Homo sapiens
attaaattcttgcaaagt

SEQ ID NO: 2205766 - DNA, 16 bp, Homo sapiens
attaacttttataaac

SEQ ID NO: 2205767 - DNA, 20 bp, Homo sapiens
attaacttttataaacttta

SEQ ID NO: 2205768 - DNA, 16 bp, Homo sapiens
attaagaatgaaatac

SEQ ID NO: 2205769 - DNA, 20 bp, Homo sapiens
attaagaatgaaatactgtt

SEQ ID NO: 2205770 - DNA, 16 bp, Homo sapiens
attaggtgtgactgaa

SEQ ID NO: 2205771 - DNA, 21 bp, Homo sapiens
attaggtgtgactgaatttct

SEQ ID NO: 2205772 - DNA, 14 bp, Homo sapiens
attatctagatact

SEQ ID NO: 2205773 - DNA, 17 bp, Homo sapiens
attattgatgttttcat

SEQ ID NO: 2205774 - DNA, 18 bp, Homo sapiens
attatttgaagatttaat

SEQ ID NO: 2205775 - DNA, 13 bp, Homo sapiens
attctatgttaat

SEQ ID NO: 2205776 - DNA, 20 bp, Homo sapiens
attctatgttaatattttat

SEQ ID NO: 2205777 - DNA, 16 bp, Homo sapiens
attctccttgtgttac

SEQ ID NO: 2205778 - DNA, 18 bp, Homo sapiens
attctccttgtgttacta

SEQ ID NO: 2205779 - DNA, 22 bp, Homo sapiens
attctccttgtgttactaagtt

SEQ ID NO: 2205780 - DNA, 22 bp, Homo sapiens
attctctagtcatttgttaata

SEQ ID NO: 2205781 - DNA, 17 bp, Homo sapiens
attctctagtttgatta

SEQ ID NO: 2205782 - DNA, 19 bp, Homo sapiens
attctctcctgtacctctt

SEQ ID NO: 2205783 - DNA, 16 bp, Homo sapiens
attcttgcaaagtatc

SEQ ID NO: 2205784 - DNA, 21 bp, Homo sapiens
attgaaatgatttcacagtgt

SEQ ID NO: 2205785 - DNA, 22 bp, Homo sapiens
attgaagcattttataaatcgc

SEQ ID NO: 2205786 - DNA, 10 bp, Homo sapiens
gtcactgctt

SEQ ID NO: 2205787 - DNA, 15 bp, Homo sapiens
gtcagccactgtgat

SEQ ID NO: 2205788 - DNA, 16 bp, Homo sapiens
gtcagttgttatttat

SEQ ID NO: 2205789 - DNA, 17 bp, Homo sapiens
gtcagttgttatttatt

SEQ ID NO: 2205790 - DNA, 18 bp, Homo sapiens
gtcagttgttatttattg

SEQ ID NO: 2205791 - DNA, 17 bp, Homo sapiens
gtcattatgttaatatt

SEQ ID NO: 2205792 - DNA, 19 bp, Homo sapiens
gtcattatgttaatatttc

SEQ ID NO: 2205793 - DNA, 15 bp, Homo sapiens
gtctgttttatgact

SEQ ID NO: 2205794 - DNA, 17 bp, Homo sapiens
gtcttctatttatttat

SEQ ID NO: 2205795 - DNA, 21 bp, Homo sapiens
gtgaaactgcttgtttcctag

SEQ ID NO: 2205796 - DNA, 12 bp, Homo sapiens
gtgaaactggat

SEQ ID NO: 2205797 - DNA, 15 bp, Homo sapiens
gtgatacaatgctgt

SEQ ID NO: 2205798 - DNA, 14 bp, Homo sapiens
gtgatctcatttaa

SEQ ID NO: 2205799 - DNA, 21 bp, Homo sapiens
gtgcataccacttttgttctt

SEQ ID NO: 2205800 - DNA, 22 bp, Homo sapiens
gtgcataccacttttgttcttg

SEQ ID NO: 2205801 - DNA, 15 bp, Homo sapiens
gtgcattatctagat

SEQ ID NO: 2205802 - DNA, 19 bp, Homo sapiens
gtgcattatctagatactg

SEQ ID NO: 2205803 - DNA, 23 bp, Homo sapiens
gtgcattatctagatactgtatc

SEQ ID NO: 2205804 - DNA, 20 bp, Homo sapiens
gtgcatttgaggtctgttct

SEQ ID NO: 2205805 - DNA, 21 bp, Homo sapiens
gtgcatttggtggtttcagaa

SEQ ID NO: 2205806 - DNA, 20 bp, Homo sapiens
gtgctgcatttaaaagatac

SEQ ID NO: 2205807 - DNA, 23 bp, Homo sapiens
gtggatttaacagaaatgtacag

SEQ ID NO: 2205808 - DNA, 13 bp, Homo sapiens
gtgtgtctatttt

SEQ ID NO: 2205809 - DNA, 14 bp, Homo sapiens
gtgttactaagttt

SEQ ID NO: 2205810 - DNA, 15 bp, Homo sapiens
gtgtttccctctgtg

SEQ ID NO: 2205811 - DNA, 16 bp, Homo sapiens
gtgtttccctctgtgt

SEQ ID NO: 2205812 - DNA, 22 bp, Homo sapiens
gttaaaataccagccagtaaat

SEQ ID NO: 2205813 - DNA, 13 bp, Homo sapiens
gttaatatttctt

SEQ ID NO: 2205814 - DNA, 14 bp, Homo sapiens
gttaatatttcttc

SEQ ID NO: 2205815 - DNA, 16 bp, Homo sapiens
gttaatattttatgtg

SEQ ID NO: 2205816 - DNA, 22 bp, Homo sapiens
gttactaagtttttatggcttt

SEQ ID NO: 2205817 - DNA, 15 bp, Homo sapiens
gttactcagaattct

SEQ ID NO: 2205818 - DNA, 17 bp, Homo sapiens
gttagtatgaggcattt

SEQ ID NO: 2205819 - DNA, 10 bp, Homo sapiens
gttatataaa

SEQ ID NO: 2205820 - DNA, 12 bp, Homo sapiens
gttatataaatg

SEQ ID NO: 2205821 - DNA, 20 bp, Homo sapiens
gttcaaagatattttgcttt

SEQ ID NO: 2205822 - DNA, 18 bp, Homo sapiens
gttctccagtcattatgt

SEQ ID NO: 2205823 - DNA, 13 bp, Homo sapiens
gttcttaattctt

SEQ ID NO: 2205824 - DNA, 18 bp, Homo sapiens
gttcttggtttgtaaatt

SEQ ID NO: 2205825 - DNA, 23 bp, Homo sapiens
gttgcagccctgctgctgcctgc

SEQ ID NO: 2205826 - DNA, 18 bp, Homo sapiens
gttgtttgagaaattaag

SEQ ID NO: 2205827 - DNA, 14 bp, Homo sapiens
gtttagataataca

SEQ ID NO: 2205828 - DNA, 14 bp, Homo sapiens
gtttcagaaatgtg

SEQ ID NO: 2205829 - DNA, 15 bp, Homo sapiens
gtttcgatatttatt

SEQ ID NO: 2205830 - DNA, 21 bp, Homo sapiens
gtttcgatatttattgatgtt

SEQ ID NO: 2205831 - DNA, 22 bp, Homo sapiens
gtttctaaaggctacctttgta

SEQ ID NO: 2205832 - DNA, 17 bp, Homo sapiens
gtttgattaaattcttg

SEQ ID NO: 2205833 - DNA, 14 bp, Homo sapiens
gtttgcataggtga

SEQ ID NO: 2205834 - DNA, 17 bp, Homo sapiens
gtttgtaaattaacttt

SEQ ID NO: 2205835 - DNA, 19 bp, Homo sapiens
gtttgtaaattaactttta

SEQ ID NO: 2205836 - DNA, 13 bp, Homo sapiens
gttttatgacttc

SEQ ID NO: 2205837 - DNA, 12 bp, Homo sapiens
gttttctgttct

SEQ ID NO: 2205838 - DNA, 19 bp, Homo sapiens
gttttctgttctttctggc

SEQ ID NO: 2205839 - DNA, 17 bp, Homo sapiens
gttttgaagattctatg

SEQ ID NO: 2205840 - DNA, 22 bp, Homo sapiens
gtttttatggcttttgtgcatt

SEQ ID NO: 2205841 - DNA, 21 bp, Homo sapiens
taaaaatctcaaatttctaaa

SEQ ID NO: 2205842 - DNA, 23 bp, Homo sapiens
taaaaatctcaaatttctaaatc

SEQ ID NO: 2205843 - DNA, 12 bp, Homo sapiens
taaaacttttta

SEQ ID NO: 2205844 - DNA, 14 bp, Homo sapiens
taaaagatacagtt

SEQ ID NO: 2205845 - DNA, 21 bp, Homo sapiens
taaaataaggttatgattgaa

SEQ ID NO: 2205846 - DNA, 20 bp, Homo sapiens
taaacaagaccacgtttcta

SEQ ID NO: 2205847 - DNA, 19 bp, Homo sapiens
taaacattggttcttgtat

SEQ ID NO: 2205848 - DNA, 21 bp, Homo sapiens
taaacattggttcttgtatta

SEQ ID NO: 2205849 - DNA, 14 bp, Homo sapiens
taaacttaatctaa

SEQ ID NO: 2205850 - DNA, 19 bp, Homo sapiens
taaacttaatctaaatgga

SEQ ID NO: 2205851 - DNA, 21 bp, Homo sapiens
taaaggctacctttgtattct

SEQ ID NO: 2205852 - DNA, 19 bp, Homo sapiens
taaataatgtgaaactgga

SEQ ID NO: 2205853 - DNA, 15 bp, Homo sapiens
taaatctccaaaata

SEQ ID NO: 2205854 - DNA, 14 bp, Homo sapiens
taaatgggggtgca

SEQ ID NO: 2205855 - DNA, 19 bp, Homo sapiens
taaatgggggtgcatttga

SEQ ID NO: 2205856 - DNA, 14 bp, Homo sapiens
taaatggttaaaag

SEQ ID NO: 2205857 - DNA, 12 bp, Homo sapiens
taaattaacttt

SEQ ID NO: 2205858 - DNA, 16 bp, Homo sapiens
taaattaacttttata

SEQ ID NO: 2205859 - DNA, 19 bp, Homo sapiens
taaattaacttttataaac

SEQ ID NO: 2205860 - DNA, 21 bp, Homo sapiens
taaattaacttttataaactt

SEQ ID NO: 2205861 - DNA, 22 bp, Homo sapiens
taaattaacttttataaacttt

SEQ ID NO: 2205862 - DNA, 16 bp, Homo sapiens
taaattcttgcaaagt

SEQ ID NO: 2205863 - DNA, 18 bp, Homo sapiens
taaattcttgcaaagtat

SEQ ID NO: 2205864 - DNA, 12 bp, Homo sapiens
taacagaaatgt

SEQ ID NO: 2205865 - DNA, 15 bp, Homo sapiens
taacagaaatgtaca

SEQ ID NO: 2205866 - DNA, 19 bp, Homo sapiens
taacatcgaaaagttattt

SEQ ID NO: 2205867 - DNA, 14 bp, Homo sapiens
taaccagcagaaat

SEQ ID NO: 2205868 - DNA, 16 bp, Homo sapiens
taaccagcagaaatgc

SEQ ID NO: 2205869 - DNA, 19 bp, Homo sapiens
taaccagcagaaatgcctt

SEQ ID NO: 2205870 - DNA, 19 bp, Homo sapiens
taactgtaaagatgaatgt

SEQ ID NO: 2205871 - DNA, 21 bp, Homo sapiens
taacttcacatattgatttcc

SEQ ID NO: 2205872 - DNA, 15 bp, Homo sapiens
taacttttataaact

SEQ ID NO: 2205873 - DNA, 20 bp, Homo sapiens
taacttttataaactttacc

SEQ ID NO: 2205874 - DNA, 18 bp, Homo sapiens
taagaaaaaggatgcaca

SEQ ID NO: 2205875 - DNA, 19 bp, Homo sapiens
taagaaaaaggatgcacag

SEQ ID NO: 2205876 - DNA, 23 bp, Homo sapiens
taagaaaaaggatgcacagagtt

SEQ ID NO: 2205877 - DNA, 16 bp, Homo sapiens
taagaactaaaatgtt

SEQ ID NO: 2205878 - DNA, 15 bp, Homo sapiens
taagaatgaaatact

SEQ ID NO: 2205879 - DNA, 23 bp, Homo sapiens
taagatataatttaaacgtgatt

SEQ ID NO: 2205880 - DNA, 12 bp, Homo sapiens
taaggaaactgg

SEQ ID NO: 2205881 - DNA, 14 bp, Homo sapiens
taaggaaactgggt

SEQ ID NO: 2205882 - DNA, 19 bp, Homo sapiens
taaggatgcttgtacataa

SEQ ID NO: 2205883 - DNA, 15 bp, Homo sapiens
tgaactgataaagat

SEQ ID NO: 2205884 - DNA, 11 bp, Homo sapiens
tgaagacaatg

SEQ ID NO: 2205885 - DNA, 21 bp, Homo sapiens
tgaagacaatgacttactgta

SEQ ID NO: 2205886 - DNA, 21 bp, Homo sapiens
tgaagattctatgttaatatt

SEQ ID NO: 2205887 - DNA, 15 bp, Homo sapiens
tgaagcattttataa

SEQ ID NO: 2205888 - DNA, 18 bp, Homo sapiens
tgaagcattttataaatc

SEQ ID NO: 2205889 - DNA, 20 bp, Homo sapiens
tgaagtaatatgcacacatt

SEQ ID NO: 2205890 - DNA, 13 bp, Homo sapiens
tgaagtgaaactg

SEQ ID NO: 2205891 - DNA, 14 bp, Homo sapiens
tgaagtgaaactgc

SEQ ID NO: 2205892 - DNA, 15 bp, Homo sapiens
tgaatgtcagttgtt

SEQ ID NO: 2205893 - DNA, 22 bp, Homo sapiens
tgaatgtcagttgttatttatt

SEQ ID NO: 2205894 - DNA, 23 bp, Homo sapiens
tgaatttcttttgccgttattaa

SEQ ID NO: 2205895 - DNA, 20 bp, Homo sapiens
tgacacatgcaaggtcattt

SEQ ID NO: 2205896 - DNA, 13 bp, Homo sapiens
tgacatctctgca

SEQ ID NO: 2205897 - DNA, 23 bp, Homo sapiens
tgacatctctgcaatcttctcag

SEQ ID NO: 2205898 - DNA, 23 bp, Homo sapiens
tgacctctgcagcaataaagcag

SEQ ID NO: 2205899 - DNA, 21 bp, Homo sapiens
tgacggcagggaaatgtatgt

SEQ ID NO: 2205900 - DNA, 15 bp, Homo sapiens
tgactgaatttcttt

SEQ ID NO: 2205901 - DNA, 13 bp, Homo sapiens
tgacttactgtac

SEQ ID NO: 2205902 - DNA, 15 bp, Homo sapiens
tgacttactgtacat

SEQ ID NO: 2205903 - DNA, 16 bp, Homo sapiens
tgacttactgtacatg

SEQ ID NO: 2205904 - DNA, 20 bp, Homo sapiens
tgacttactgtacatgaaaa

SEQ ID NO: 2205905 - DNA, 22 bp, Homo sapiens
tgacttcattaataataaattc

SEQ ID NO: 2205906 - DNA, 14 bp, Homo sapiens
tgagcatcacagtt

SEQ ID NO: 2205907 - DNA, 15 bp, Homo sapiens
tgagcatcacagttt

SEQ ID NO: 2205908 - DNA, 16 bp, Homo sapiens
tgagcatcacagtttt

SEQ ID NO: 2205909 - DNA, 17 bp, Homo sapiens
tgagcatcacagttttg

SEQ ID NO: 2205910 - DNA, 23 bp, Homo sapiens
tgagcatcgcttaggagaagtct

SEQ ID NO: 2205911 - DNA, 14 bp, Homo sapiens
tgagccttgaactt

SEQ ID NO: 2205912 - DNA, 15 bp, Homo sapiens
tgaggtttttaagcc

SEQ ID NO: 2205913 - DNA, 18 bp, Homo sapiens
tgagtacgttgtgcattt

SEQ ID NO: 2205914 - DNA, 14 bp, Homo sapiens
tgataatcaactgg

SEQ ID NO: 2205915 - DNA, 14 bp, Homo sapiens
tgatacaatgctgt

SEQ ID NO: 2205916 - DNA, 15 bp, Homo sapiens
tgatacaatgctgtg

SEQ ID NO: 2205917 - DNA, 21 bp, Homo sapiens
tgatacaatgctgtgccctaa

SEQ ID NO: 2205918 - DNA, 14 bp, Homo sapiens
tgatactacagttt

SEQ ID NO: 2205919 - DNA, 22 bp, Homo sapiens
tgatctcatttaatcctctcaa

SEQ ID NO: 2205920 - DNA, 18 bp, Homo sapiens
tgatgacatatcacatgt

SEQ ID NO: 2205921 - DNA, 17 bp, Homo sapiens
tgattaaattcttgcaa

SEQ ID NO: 2205922 - DNA, 19 bp, Homo sapiens
tgattaaattcttgcaaag

SEQ ID NO: 2205923 - DNA, 20 bp, Homo sapiens
tgattaaattcttgcaaagt

SEQ ID NO: 2205924 - DNA, 13 bp, Homo sapiens
tgattcatattta

SEQ ID NO: 2205925 - DNA, 14 bp, Homo sapiens
tgattcatatttaa

SEQ ID NO: 2205926 - DNA, 22 bp, Homo sapiens
tgatttccgttaaaataccagc

SEQ ID NO: 2205927 - DNA, 17 bp, Homo sapiens
tgatttttaaattaaat

SEQ ID NO: 2205928 - DNA, 15 bp, Homo sapiens
tgcaaggtcattttt

SEQ ID NO: 2205929 - DNA, 23 bp, Homo sapiens
tgcacagagttgttacattttta

SEQ ID NO: 2205930 - DNA, 17 bp, Homo sapiens
tgcacatctgttttgta

SEQ ID NO: 2205931 - DNA, 16 bp, Homo sapiens
tgcagcaataaagcag

SEQ ID NO: 2205932 - DNA, 20 bp, Homo sapiens
tgcagcaataaagcagcgtt

SEQ ID NO: 2205933 - DNA, 14 bp, Homo sapiens
tgcagccctgctgc

SEQ ID NO: 2205934 - DNA, 22 bp, Homo sapiens
tgcagccctgctgctgcctgcc

SEQ ID NO: 2205935 - DNA, 21 bp, Homo sapiens
tgcagtgtttccctctgtgtt

SEQ ID NO: 2205936 - DNA, 15 bp, Homo sapiens
tgcatgtttgtgatt

SEQ ID NO: 2205937 - DNA, 12 bp, Homo sapiens
tgcattatctag

SEQ ID NO: 2205938 - DNA, 18 bp, Homo sapiens
tgcattatctagatactg

SEQ ID NO: 2205939 - DNA, 20 bp, Homo sapiens
tgcatttgaggtctgttctt

SEQ ID NO: 2205940 - DNA, 21 bp, Homo sapiens
tgcatttggtggtttcagaaa

SEQ ID NO: 2205941 - DNA, 15 bp, Homo sapiens
tgccaagttgtttga

SEQ ID NO: 2205942 - DNA, 19 bp, Homo sapiens
tgccaagttgtttgagaaa

SEQ ID NO: 2205943 - DNA, 20 bp, Homo sapiens
tgccaagttgtttgagaaat

SEQ ID NO: 2205944 - DNA, 12 bp, Homo sapiens
tgccttgtttaa

SEQ ID NO: 2205945 - DNA, 15 bp, Homo sapiens
tgcgcctaatgtgtt

SEQ ID NO: 2205946 - DNA, 14 bp, Homo sapiens
tgctgctgcctgcc

SEQ ID NO: 2205947 - DNA, 14 bp, Homo sapiens
tgcttaacttcaca

SEQ ID NO: 2205948 - DNA, 13 bp, Homo sapiens
tgcttgtacataa

SEQ ID NO: 2205949 - DNA, 22 bp, Homo sapiens
tgcttgtacataatgcgtgcat

SEQ ID NO: 2205950 - DNA, 14 bp, Homo sapiens
tgctttgtgatttt

SEQ ID NO: 2205951 - DNA, 17 bp, Homo sapiens
tgctttgtgatttttgt

SEQ ID NO: 2205952 - DNA, 17 bp, Homo sapiens
tggattcatatttaatt

SEQ ID NO: 2205953 - DNA, 19 bp, Homo sapiens
tggattgcgcctaatgtgt

SEQ ID NO: 2205954 - DNA, 20 bp, Homo sapiens
tggattgtgcctaatgtgtt

SEQ ID NO: 2205955 - DNA, 23 bp, Homo sapiens
tggattgtgcctaatgtgtttga

SEQ ID NO: 2205956 - DNA, 24 bp, Homo sapiens
tggatttaacagaaatgtacagca

SEQ ID NO: 2205957 - DNA, 20 bp, Homo sapiens
tggccagtgagatcaatgtg

SEQ ID NO: 2205958 - DNA, 17 bp, Homo sapiens
tggctatgcatttgaaa

SEQ ID NO: 2205959 - DNA, 22 bp, Homo sapiens
ttaatcattaggtgtgactgaa

SEQ ID NO: 2205960 - DNA, 15 bp, Homo sapiens
ttaattatgcagtgt

SEQ ID NO: 2205961 - DNA, 21 bp, Homo sapiens
ttacatttttaagtgctgcat

SEQ ID NO: 2205962 - DNA, 22 bp, Homo sapiens
ttacatttttaagtgctgcatt

SEQ ID NO: 2205963 - DNA, 19 bp, Homo sapiens
ttaccctcatgttcttaat

SEQ ID NO: 2205964 - DNA, 22 bp, Homo sapiens
ttaccttttttatacataaaca

SEQ ID NO: 2205965 - DNA, 22 bp, Homo sapiens
ttactgtacatgaaaacacatt

SEQ ID NO: 2205966 - DNA, 16 bp, Homo sapiens
ttagaagattctatgt

SEQ ID NO: 2205967 - DNA, 17 bp, Homo sapiens
ttagaagattctatgtt

SEQ ID NO: 2205968 - DNA, 22 bp, Homo sapiens
ttagataatacaccactacatt

SEQ ID NO: 2205969 - DNA, 16 bp, Homo sapiens
ttagctactatatatg

SEQ ID NO: 2205970 - DNA, 23 bp, Homo sapiens
ttaggagaagtcttctatttatt

SEQ ID NO: 2205971 - DNA, 20 bp, Homo sapiens
ttagggaaggatacaaaagc

SEQ ID NO: 2205972 - DNA, 16 bp, Homo sapiens
ttaggtgtgactgaat

SEQ ID NO: 2205973 - DNA, 16 bp, Homo sapiens
ttagtatgaggcattt

SEQ ID NO: 2205974 - DNA, 18 bp, Homo sapiens
ttataaactttacctttt

SEQ ID NO: 2205975 - DNA, 11 bp, Homo sapiens
ttatacataaa

SEQ ID NO: 2205976 - DNA, 11 bp, Homo sapiens
ttatatttcca

SEQ ID NO: 2205977 - DNA, 14 bp, Homo sapiens
ttatctagatactg

SEQ ID NO: 2205978 - DNA, 23 bp, Homo sapiens
ttatgattgaatctacttgcaca

SEQ ID NO: 2205979 - DNA, 14 bp, Homo sapiens
ttatgtaattatat

SEQ ID NO: 2205980 - DNA, 12 bp, Homo sapiens
ttattatgcatg

SEQ ID NO: 2205981 - DNA, 20 bp, Homo sapiens
ttattggtggctgttcctga

SEQ ID NO: 2205982 - DNA, 22 bp, Homo sapiens
ttatttgtttgttttagaagat

SEQ ID NO: 2205983 - DNA, 19 bp, Homo sapiens
ttcaatctggattcatatt

SEQ ID NO: 2205984 - DNA, 16 bp, Homo sapiens
ttcatacctacatgta

SEQ ID NO: 2205985 - DNA, 19 bp, Homo sapiens
ttcatacctacatgtattt

SEQ ID NO: 2205986 - DNA, 18 bp, Homo sapiens
ttcatagagaatataaaa

SEQ ID NO: 2205987 - DNA, 17 bp, Homo sapiens
ttcatatttaatttgaa

SEQ ID NO: 2205988 - DNA, 18 bp, Homo sapiens
ttcatatttaatttgaag

SEQ ID NO: 2205989 - DNA, 16 bp, Homo sapiens
ttccatggcctcttca

SEQ ID NO: 2205990 - DNA, 12 bp, Homo sapiens
ttccctggcctt

SEQ ID NO: 2205991 - DNA, 15 bp, Homo sapiens
ttcgtgatgacatat

SEQ ID NO: 2205992 - DNA, 16 bp, Homo sapiens
ttcgtgatgacatatc

SEQ ID NO: 2205993 - DNA, 23 bp, Homo sapiens
ttcgtgatgacatatcacatgtc

SEQ ID NO: 2205994 - DNA, 17 bp, Homo sapiens
ttctaaaggctaccttt

SEQ ID NO: 2205995 - DNA, 19 bp, Homo sapiens
ttctcagaaggcaaatgac

SEQ ID NO: 2205996 - DNA, 22 bp, Homo sapiens
ttctcagaaggcaaatgacttt

SEQ ID NO: 2205997 - DNA, 22 bp, Homo sapiens
ttctcatgttgaaactttaaga

SEQ ID NO: 2205998 - DNA, 18 bp, Homo sapiens
ttctccatggccctgcca

SEQ ID NO: 2205999 - DNA, 18 bp, Homo sapiens
ttctctcctgtacctctt

SEQ ID NO: 2206000 - DNA, 14 bp, Homo sapiens
ttctggtgtgaact

SEQ ID NO: 2206001 - DNA, 21 bp, Homo sapiens
ttctggtgtgaactaaacttt

SEQ ID NO: 2206002 - DNA, 13 bp, Homo sapiens
ttcttaattctta

SEQ ID NO: 2206003 - DNA, 20 bp, Homo sapiens
ttcttagtatgtgcatttaa

SEQ ID NO: 2206004 - DNA, 12 bp, Homo sapiens
ttcttgcaaagt

SEQ ID NO: 2206005 - DNA, 16 bp, Homo sapiens
ttcttggtttgtaaat

SEQ ID NO: 2206006 - DNA, 17 bp, Homo sapiens
ttcttggtttgtaaatt

SEQ ID NO: 2206007 - DNA, 18 bp, Homo sapiens
ttcttggtttgtaaatta

SEQ ID NO: 2206008 - DNA, 18 bp, Homo sapiens
ttcttgtattaagaatga

SEQ ID NO: 2206009 - DNA, 14 bp, Homo sapiens
ttctttccaaagta

SEQ ID NO: 2206010 - DNA, 14 bp, Homo sapiens
ttctttttgaaatg

SEQ ID NO: 2206011 - DNA, 14 bp, Homo sapiens
ttgaaactttaaga

SEQ ID NO: 2206012 - DNA, 20 bp, Homo sapiens
ttgaaatataggaacttaaa

SEQ ID NO: 2206013 - DNA, 15 bp, Homo sapiens
ttgaactttgacctc

SEQ ID NO: 2206014 - DNA, 17 bp, Homo sapiens
ttgaactttgacctctg

SEQ ID NO: 2206015 - DNA, 22 bp, Homo sapiens
ttgaactttgacctctgcagca

SEQ ID NO: 2206016 - DNA, 13 bp, Homo sapiens
ttgaagattctat

SEQ ID NO: 2206017 - DNA, 17 bp, Homo sapiens
ttgaagcattttataaa

SEQ ID NO: 2206018 - DNA, 16 bp, Homo sapiens
ttgagccttgaacttt

SEQ ID NO: 2206019 - DNA, 15 bp, Homo sapiens
ttgaggtctgttctt

SEQ ID NO: 2206020 - DNA, 17 bp, Homo sapiens
ttgatactacagtttgt

SEQ ID NO: 2206021 - DNA, 14 bp, Homo sapiens
ttgatgttttcaca

SEQ ID NO: 2206022 - DNA, 16 bp, Homo sapiens
ttgattaaattcttgc

SEQ ID NO: 2206023 - DNA, 21 bp, Homo sapiens
ttgattaaattcttgcaaagt

SEQ ID NO: 2206024 - DNA, 23 bp, Homo sapiens
aatcattaggtgtgactgaattt

SEQ ID NO: 2206025 - DNA, 16 bp, Homo sapiens
aatcctgattcatatt

SEQ ID NO: 2206026 - DNA, 18 bp, Homo sapiens
aatcctgattcatattta

SEQ ID NO: 2206027 - DNA, 12 bp, Homo sapiens
aatctcaaattt

SEQ ID NO: 2206028 - DNA, 13 bp, Homo sapiens
aatctccaaaata

SEQ ID NO: 2206029 - DNA, 18 bp, Homo sapiens
aatctccaaaataaaact

SEQ ID NO: 2206030 - DNA, 16 bp, Homo sapiens
aatgaagtctctgaag

SEQ ID NO: 2206031 - DNA, 17 bp, Homo sapiens
aatgacttactgtacat

SEQ ID NO: 2206032 - DNA, 23 bp, Homo sapiens
aatgataatgctaattttattat

SEQ ID NO: 2206033 - DNA, 18 bp, Homo sapiens
aatgcgtgcataccactt

SEQ ID NO: 2206034 - DNA, 17 bp, Homo sapiens
aatgggggtgcatttga

SEQ ID NO: 2206035 - DNA, 13 bp, Homo sapiens
aatggttaaaaga

SEQ ID NO: 2206036 - DNA, 21 bp, Homo sapiens
aatgtacagcaaggagattta

SEQ ID NO: 2206037 - DNA, 23 bp, Homo sapiens
aatgtacagcaaggagatttaca

SEQ ID NO: 2206038 - DNA, 18 bp, Homo sapiens
aatgtatgtgtgtctatt

SEQ ID NO: 2206039 - DNA, 18 bp, Homo sapiens
aatgtcagttgttattta

SEQ ID NO: 2206040 - DNA, 14 bp, Homo sapiens
aattaaataaaatt

SEQ ID NO: 2206041 - DNA, 13 bp, Homo sapiens
aattaacttttat

SEQ ID NO: 2206042 - DNA, 20 bp, Homo sapiens
aattaacttttataaacttt

SEQ ID NO: 2206043 - DNA, 16 bp, Homo sapiens
aattaaggattttatg

SEQ ID NO: 2206044 - DNA, 16 bp, Homo sapiens
aattacttcttagtat

SEQ ID NO: 2206045 - DNA, 21 bp, Homo sapiens
agcttattggtggctgttcct

SEQ ID NO: 2206046 - DNA, 23 bp, Homo sapiens
aggagaagtcttctatttattta

SEQ ID NO: 2206047 - DNA, 13 bp, Homo sapiens
aggaggaagctta

SEQ ID NO: 2206048 - DNA, 21 bp, Homo sapiens
aggatacaaaagcatgtgaga

SEQ ID NO: 2206049 - DNA, 18 bp, Homo sapiens
aggatgcttgtacataat

SEQ ID NO: 2206050 - DNA, 18 bp, Homo sapiens
aggcaaatgactttggac

SEQ ID NO: 2206051 - DNA, 14 bp, Homo sapiens
aggcaggggaatgt

SEQ ID NO: 2206052 - DNA, 19 bp, Homo sapiens
aggcaggggaatgtatgtg

SEQ ID NO: 2206053 - DNA, 18 bp, Homo sapiens
aggcatttgtttgaactg

SEQ ID NO: 2206054 - DNA, 14 bp, Homo sapiens
aggctacctttgta

SEQ ID NO: 2206055 - DNA, 20 bp, Homo sapiens
agggaaatgtatgtgtgtct

SEQ ID NO: 2206056 - DNA, 21 bp, Homo sapiens
aggtcaaacccaagttagttc

SEQ ID NO: 2206057 - DNA, 17 bp, Homo sapiens
aggtcattttttttaag

SEQ ID NO: 2206058 - DNA, 22 bp, Homo sapiens
aggtcattttttttaagaaaaa

SEQ ID NO: 2206059 - DNA, 23 bp, Homo sapiens
aggtcattttttttaagaaaaag

SEQ ID NO: 2206060 - DNA, 13 bp, Homo sapiens
aggtctgttcttt

SEQ ID NO: 2206061 - DNA, 20 bp, Homo sapiens
aggtgtgactgaatttcttt

SEQ ID NO: 2206062 - DNA, 17 bp, Homo sapiens
aggttcaaagatatttt

SEQ ID NO: 2206063 - DNA, 22 bp, Homo sapiens
aggtttcgatatttattgatgt

SEQ ID NO: 2206064 - DNA, 18 bp, Homo sapiens
aggtttgcagatattctc

SEQ ID NO: 2206065 - DNA, 13 bp, Homo sapiens
aggtttttcttaa

SEQ ID NO: 2206066 - DNA, 20 bp, Homo sapiens
agtaatatgcacacattttt

SEQ ID NO: 2206067 - DNA, 14 bp, Homo sapiens
agtacactgtttca

SEQ ID NO: 2206068 - DNA, 16 bp, Homo sapiens
agtatcagctacaatt

SEQ ID NO: 2206069 - DNA, 17 bp, Homo sapiens
agtatgaggcatttgtt

SEQ ID NO: 2206070 - DNA, 18 bp, Homo sapiens
agtattgaagcattttat

SEQ ID NO: 2206071 - DNA, 21 bp, Homo sapiens
agtattgaagcattttataaa

SEQ ID NO: 2206072 - DNA, 21 bp, Homo sapiens
agtcatttgttaatatttctt

SEQ ID NO: 2206073 - DNA, 22 bp, Homo sapiens
agtcatttgttaatatttcttc

SEQ ID NO: 2206074 - DNA, 18 bp, Homo sapiens
agtctctgaagtgaaact

SEQ ID NO: 2206075 - DNA, 12 bp, Homo sapiens
agtctgttttat

SEQ ID NO: 2206076 - DNA, 24 bp, Homo sapiens
agtgaaactgcttgtttcctagca

SEQ ID NO: 2206077 - DNA, 19 bp, Homo sapiens
agtgctgcatttaaaagat

SEQ ID NO: 2206078 - DNA, 22 bp, Homo sapiens
agtgctgcatttaaaagataca

SEQ ID NO: 2206079 - DNA, 19 bp, Homo sapiens
agtgtgtggtcaacatttc

SEQ ID NO: 2206080 - DNA, 22 bp, Homo sapiens
agtgtgtggtcaacatttctca

SEQ ID NO: 2206081 - DNA, 16 bp, Homo sapiens
agtgttgtggatttaa

SEQ ID NO: 2206082 - DNA, 13 bp, Homo sapiens
agttactcagaat

SEQ ID NO: 2206083 - DNA, 21 bp, Homo sapiens
agttagttcaatcctgattca

SEQ ID NO: 2206084 - DNA, 10 bp, Homo sapiens
agttgcagcc

SEQ ID NO: 2206085 - DNA, 22 bp, Homo sapiens
agtttcacagcacttacaattt

SEQ ID NO: 2206086 - DNA, 18 bp, Homo sapiens
agtttgattaaattcttg

SEQ ID NO: 2206087 - DNA, 23 bp, Homo sapiens
agtttgattaaattcttgcaaag

SEQ ID NO: 2206088 - DNA, 15 bp, Homo sapiens
agttttacagtgttt

SEQ ID NO: 2206089 - DNA, 17 bp, Homo sapiens
agttttgaagattctat

SEQ ID NO: 2206090 - DNA, 21 bp, Homo sapiens
agttttggttgctttaatatc

SEQ ID NO: 2206091 - DNA, 23 bp, Homo sapiens
agtttttatggcttttgtgcatt

SEQ ID NO: 2206092 - DNA, 17 bp, Homo sapiens
ataaaatttttatgtaa

SEQ ID NO: 2206093 - DNA, 23 bp, Homo sapiens
ataaaatttttatgtaattatat

SEQ ID NO: 2206094 - DNA, 16 bp, Homo sapiens
ataaactttacctttt

SEQ ID NO: 2206095 - DNA, 19 bp, Homo sapiens
ataaagatcatgtaaaagt

SEQ ID NO: 2206096 - DNA, 21 bp, Homo sapiens
ataaagatgagtgagcatgcc

SEQ ID NO: 2206097 - DNA, 14 bp, Homo sapiens
ataaagcagcgttt

SEQ ID NO: 2206098 - DNA, 18 bp, Homo sapiens
ataaagcagcgtttctat

SEQ ID NO: 2206099 - DNA, 19 bp, Homo sapiens
ataacatcgaaaagttatt

SEQ ID NO: 2206100 - DNA, 20 bp, Homo sapiens
ataaccagtgttgtggattt

SEQ ID NO: 2206101 - DNA, 18 bp, Homo sapiens
ataactgttatttataat

SEQ ID NO: 2206102 - DNA, 18 bp, Homo sapiens
ataatacaccactacatt

SEQ ID NO: 2206103 - DNA, 21 bp, Homo sapiens
ataatacaccactacattctg

SEQ ID NO: 2206104 - DNA, 23 bp, Homo sapiens
ataatacaccactacattctgtt

SEQ ID NO: 2206105 - DNA, 15 bp, Homo sapiens
ataatgcgtgcatac

SEQ ID NO: 2206106 - DNA, 21 bp, Homo sapiens
ataatgcgtgcataccacttt

SEQ ID NO: 2206107 - DNA, 17 bp, Homo sapiens
atacaatgctgtgccct

SEQ ID NO: 2206108 - DNA, 22 bp, Homo sapiens
atacacaccccggactcctccg

SEQ ID NO: 2206109 - DNA, 19 bp, Homo sapiens
atacaccactacattctgt

SEQ ID NO: 2206110 - DNA, 18 bp, Homo sapiens
atacagttactcagaatt

SEQ ID NO: 2206111 - DNA, 17 bp, Homo sapiens
atacctacatgtatttg

SEQ ID NO: 2206112 - DNA, 14 bp, Homo sapiens
ataccttttttaga

SEQ ID NO: 2206113 - DNA, 13 bp, Homo sapiens
atacgtacacatt

SEQ ID NO: 2206114 - DNA, 22 bp, Homo sapiens
atactatatttttctcaatgtt

SEQ ID NO: 2206115 - DNA, 20 bp, Homo sapiens
atactgccttgtttaatggt

SEQ ID NO: 2206116 - DNA, 20 bp, Homo sapiens
atactgtttgaggtttttaa

SEQ ID NO: 2206117 - DNA, 23 bp, Homo sapiens
atagacaatttattatggcacat

SEQ ID NO: 2206118 - DNA, 13 bp, Homo sapiens
atatactatattt

SEQ ID NO: 2206119 - DNA, 18 bp, Homo sapiens
atatcccttggacatttt

SEQ ID NO: 2206120 - DNA, 21 bp, Homo sapiens
atatcccttggacattttatg

SEQ ID NO: 2206121 - DNA, 22 bp, Homo sapiens
atatcccttggacattttatgt

SEQ ID NO: 2206122 - DNA, 13 bp, Homo sapiens
atatgcacacatt

SEQ ID NO: 2206123 - DNA, 22 bp, Homo sapiens
atatgcacacattttttaaatg

SEQ ID NO: 2206124 - DNA, 19 bp, Homo sapiens
atattaccacagacatact

SEQ ID NO: 2206125 - DNA, 19 bp, Homo sapiens
atattgatttccgttaaaa

SEQ ID NO: 2206126 - DNA, 14 bp, Homo sapiens
atatttaatttgaa

SEQ ID NO: 2206127 - DNA, 19 bp, Homo sapiens
atatttcttcgtgatgaca

SEQ ID NO: 2206128 - DNA, 14 bp, Homo sapiens
atattttatgtgta

SEQ ID NO: 2206129 - DNA, 13 bp, Homo sapiens
atcaagtattata

SEQ ID NO: 2206130 - DNA, 18 bp, Homo sapiens
atcaatgataatgctaat

SEQ ID NO: 2206131 - DNA, 21 bp, Homo sapiens
atcacatgtcagccactgtga

SEQ ID NO: 2206132 - DNA, 14 bp, Homo sapiens
atcacttttttcca

SEQ ID NO: 2206133 - DNA, 13 bp, Homo sapiens
atcagcacgattt

SEQ ID NO: 2206134 - DNA, 18 bp, Homo sapiens
atcagcacgatttctgtt

SEQ ID NO: 2206135 - DNA, 19 bp, Homo sapiens
atcagcacgatttctgttt

SEQ ID NO: 2206136 - DNA, 20 bp, Homo sapiens
atcagcacgatttctgttta

SEQ ID NO: 2206137 - DNA, 17 bp, Homo sapiens
atcatcagtattgaagc

SEQ ID NO: 2206138 - DNA, 14 bp, Homo sapiens
atcgaaaagttatt

SEQ ID NO: 2206139 - DNA, 19 bp, Homo sapiens
atcgaaaagttattttgta

SEQ ID NO: 2206140 - DNA, 18 bp, Homo sapiens
atctaaatggaaccactc

SEQ ID NO: 2206141 - DNA, 18 bp, Homo sapiens
atctagatactgtatcat

SEQ ID NO: 2206142 - DNA, 14 bp, Homo sapiens
atctcaaatttcta

SEQ ID NO: 2206143 - DNA, 17 bp, Homo sapiens
atctcaaatttctaaat

SEQ ID NO: 2206144 - DNA, 18 bp, Homo sapiens
atctctgcaatcttctca

SEQ ID NO: 2206145 - DNA, 15 bp, Homo sapiens
atctgacatctctgc

SEQ ID NO: 2206146 - DNA, 20 bp, Homo sapiens
atctgacatctctgcaatct

SEQ ID NO: 2206147 - DNA, 16 bp, Homo sapiens
atgaaaacacattttt

SEQ ID NO: 2206148 - DNA, 23 bp, Homo sapiens
atgaagtaatatgcacacatttt

SEQ ID NO: 2206149 - DNA, 12 bp, Homo sapiens
atgaatgtcagt

SEQ ID NO: 2206150 - DNA, 19 bp, Homo sapiens
atgacatatcacatgtcag

SEQ ID NO: 2206151 - DNA, 16 bp, Homo sapiens
atgacttactgtacat

SEQ ID NO: 2206152 - DNA, 17 bp, Homo sapiens
atgacttactgtacatg

SEQ ID NO: 2206153 - DNA, 13 bp, Homo sapiens
atgaggcatttgt

SEQ ID NO: 2206154 - DNA, 14 bp, Homo sapiens
atgaggcatttgtt

SEQ ID NO: 2206155 - DNA, 22 bp, Homo sapiens
atgcaaggtcattttttttaag

SEQ ID NO: 2206156 - DNA, 13 bp, Homo sapiens
atgcacacatttt

SEQ ID NO: 2206157 - DNA, 19 bp, Homo sapiens
atgcacacattttttaaat

SEQ ID NO: 2206158 - DNA, 23 bp, Homo sapiens
atgcacacattttttaaatgcac

SEQ ID NO: 2206159 - DNA, 19 bp, Homo sapiens
atgcacctggaatatataa

SEQ ID NO: 2206160 - DNA, 22 bp, Homo sapiens
atgcagtgtttccctctgtgtt

SEQ ID NO: 2206161 - DNA, 23 bp, Homo sapiens
atgcatgaagtaatatgcacaca

SEQ ID NO: 2206162 - DNA, 14 bp, Homo sapiens
atgccaagttgttt

SEQ ID NO: 2206163 - DNA, 18 bp, Homo sapiens
atgctacacactgcatgt

SEQ ID NO: 2206164 - DNA, 13 bp, Homo sapiens
atgcttgtacata

SEQ ID NO: 2206165 - DNA, 17 bp, Homo sapiens
atggcacatcagcacga

SEQ ID NO: 2206166 - DNA, 23 bp, Homo sapiens
atggcacatcagcacgatttctg

SEQ ID NO: 2206167 - DNA, 21 bp, Homo sapiens
atggccagtgagatcaatgtg

SEQ ID NO: 2206168 - DNA, 16 bp, Homo sapiens
atggcttttgtgcatt

SEQ ID NO: 2206169 - DNA, 15 bp, Homo sapiens
atggtagttttacag

SEQ ID NO: 2206170 - DNA, 20 bp, Homo sapiens
atgtaaatagctaagatata

SEQ ID NO: 2206171 - DNA, 16 bp, Homo sapiens
atgtaacaacaattat

SEQ ID NO: 2206172 - DNA, 21 bp, Homo sapiens
atgtaattatatatactatat

SEQ ID NO: 2206173 - DNA, 11 bp, Homo sapiens
atgtatgtgtg

SEQ ID NO: 2206174 - DNA, 18 bp, Homo sapiens
atgtatgtgtgtctattt

SEQ ID NO: 2206175 - DNA, 21 bp, Homo sapiens
atgtatgtgtgtctattttgt

SEQ ID NO: 2206176 - DNA, 13 bp, Homo sapiens
catcacagttttg

SEQ ID NO: 2206177 - DNA, 16 bp, Homo sapiens
catcagtattgaagca

SEQ ID NO: 2206178 - DNA, 14 bp, Homo sapiens
catgaaaacacatt

SEQ ID NO: 2206179 - DNA, 23 bp, Homo sapiens
catgaagtaatatgcacacattt

SEQ ID NO: 2206180 - DNA, 18 bp, Homo sapiens
catgcaaggtcatttttt

SEQ ID NO: 2206181 - DNA, 23 bp, Homo sapiens
catgctacacactgcatgtttgt

SEQ ID NO: 2206182 - DNA, 17 bp, Homo sapiens
catggtcggaaaacatg

SEQ ID NO: 2206183 - DNA, 23 bp, Homo sapiens
catggtcggaaaacatgctacac

SEQ ID NO: 2206184 - DNA, 16 bp, Homo sapiens
catgttcttaattctt

SEQ ID NO: 2206185 - DNA, 13 bp, Homo sapiens
cattagttttgaa

SEQ ID NO: 2206186 - DNA, 14 bp, Homo sapiens
cattagttttgaag

SEQ ID NO: 2206187 - DNA, 23 bp, Homo sapiens
cattatatttattgtttatttta

SEQ ID NO: 2206188 - DNA, 17 bp, Homo sapiens
cattatctagatactgt

SEQ ID NO: 2206189 - DNA, 17 bp, Homo sapiens
cattatgttaatatttc

SEQ ID NO: 2206190 - DNA, 16 bp, Homo sapiens
cattctccttgtgtta

SEQ ID NO: 2206191 - DNA, 17 bp, Homo sapiens
cattctgttaatcatta

SEQ ID NO: 2206192 - DNA, 13 bp, Homo sapiens
cattctttttgaa

SEQ ID NO: 2206193 - DNA, 16 bp, Homo sapiens
cattctttttgaaatg

SEQ ID NO: 2206194 - DNA, 21 bp, Homo sapiens
catttaaaagatacagttact

SEQ ID NO: 2206195 - DNA, 13 bp, Homo sapiens
catttctcatgtt

SEQ ID NO: 2206196 - DNA, 18 bp, Homo sapiens
catttgaggtctgttctt

SEQ ID NO: 2206197 - DNA, 22 bp, Homo sapiens
catttgaggtctgttctttcca

SEQ ID NO: 2206198 - DNA, 21 bp, Homo sapiens
catttggtggtttcagaaatg

SEQ ID NO: 2206199 - DNA, 22 bp, Homo sapiens
catttggtggtttcagaaatgt

SEQ ID NO: 2206200 - DNA, 23 bp, Homo sapiens
catttggtggtttcagaaatgtg

SEQ ID NO: 2206201 - DNA, 23 bp, Homo sapiens
cattttataaatcgcttttgata

SEQ ID NO: 2206202 - DNA, 14 bp, Homo sapiens
cattttatgtcttt

SEQ ID NO: 2206203 - DNA, 22 bp, Homo sapiens
cattttatgtctttcttgtaag

SEQ ID NO: 2206204 - DNA, 22 bp, Homo sapiens
cattttattttattatgcatga

SEQ ID NO: 2206205 - DNA, 23 bp, Homo sapiens
cattttattttattatgcatgaa

SEQ ID NO: 2206206 - DNA, 15 bp, Homo sapiens
catttttaagtgctg

SEQ ID NO: 2206207 - DNA, 22 bp, Homo sapiens
cattttttttaagaaaaaggat

SEQ ID NO: 2206208 - DNA, 21 bp, Homo sapiens
ccaaaataaaactttttaaaa

SEQ ID NO: 2206209 - DNA, 15 bp, Homo sapiens
ccaaagtacactgtt

SEQ ID NO: 2206210 - DNA, 22 bp, Homo sapiens
ccaaagtacactgtttcaaact

SEQ ID NO: 2206211 - DNA, 23 bp, Homo sapiens
ccacctttcagataactgttatt

SEQ ID NO: 2206212 - DNA, 14 bp, Homo sapiens
ccactacattctgt

SEQ ID NO: 2206213 - DNA, 21 bp, Homo sapiens
ccacttttgttcttggtttgt

SEQ ID NO: 2206214 - DNA, 15 bp, Homo sapiens
ccactttttgcagct

SEQ ID NO: 2206215 - DNA, 17 bp, Homo sapiens
ccagcagaaatgcctta

SEQ ID NO: 2206216 - DNA, 15 bp, Homo sapiens
ccattatatttattg

SEQ ID NO: 2206217 - DNA, 17 bp, Homo sapiens
ccattatatttattgtt

SEQ ID NO: 2206218 - DNA, 19 bp, Homo sapiens
ccattatatttattgttta

SEQ ID NO: 2206219 - DNA, 21 bp, Homo sapiens
ccctattttttttctgttata

SEQ ID NO: 2206220 - DNA, 14 bp, Homo sapiens
ccctgccacctcct

SEQ ID NO: 2206221 - DNA, 18 bp, Homo sapiens
ccctgccacctcctgcct

SEQ ID NO: 2206222 - DNA, 17 bp, Homo sapiens
ccctgctgctgcctgcc

SEQ ID NO: 2206223 - DNA, 17 bp, Homo sapiens
ccctggcctttcatatt

SEQ ID NO: 2206224 - DNA, 12 bp, Homo sapiens
ccgttattaaaa

SEQ ID NO: 2206225 - DNA, 20 bp, Homo sapiens
cctattttttttctgttata

SEQ ID NO: 2206226 - DNA, 13 bp, Homo sapiens
cctcttgagcctt

SEQ ID NO: 2206227 - DNA, 19 bp, Homo sapiens
cctcttgagccttgaactt

SEQ ID NO: 2206228 - DNA, 16 bp, Homo sapiens
cctgattcatatttaa

SEQ ID NO: 2206229 - DNA, 19 bp, Homo sapiens
cctgccacctcctgcctca

SEQ ID NO: 2206230 - DNA, 15 bp, Homo sapiens
cctgctgctgcctgc

SEQ ID NO: 2206231 - DNA, 18 bp, Homo sapiens
cctgctgctgcctgcctg

SEQ ID NO: 2206232 - DNA, 14 bp, Homo sapiens
cctggcctttcata

SEQ ID NO: 2206233 - DNA, 12 bp, Homo sapiens
cctgtacctctt

SEQ ID NO: 2206234 - DNA, 19 bp, Homo sapiens
ccttctccatggccctgcc

SEQ ID NO: 2206235 - DNA, 17 bp, Homo sapiens
ccttgaactttgacctc

SEQ ID NO: 2206236 - DNA, 19 bp, Homo sapiens
ccttgaactttgacctctg

SEQ ID NO: 2206237 - DNA, 20 bp, Homo sapiens
ccttggacattttatgtctt

SEQ ID NO: 2206238 - DNA, 15 bp, Homo sapiens
cctttgtattctctc

SEQ ID NO: 2206239 - DNA, 22 bp, Homo sapiens
cctttgtattctctcctgtacc

SEQ ID NO: 2206240 - DNA, 21 bp, Homo sapiens
ccttttttagagttgatacta

SEQ ID NO: 2206241 - DNA, 17 bp, Homo sapiens
ccttttttatacataaa

SEQ ID NO: 2206242 - DNA, 18 bp, Homo sapiens
ccttttttatacataaac

SEQ ID NO: 2206243 - DNA, 13 bp, Homo sapiens
cgatatttattga

SEQ ID NO: 2206244 - DNA, 14 bp, Homo sapiens
cgtgcataccactt

SEQ ID NO: 2206245 - DNA, 23 bp, Homo sapiens
cgtgcataccacttttgttcttg

SEQ ID NO: 2206246 - DNA, 13 bp, Homo sapiens
cgttaaaatacca

SEQ ID NO: 2206247 - DNA, 17 bp, Homo sapiens
ctaaaggctacctttgt

SEQ ID NO: 2206248 - DNA, 19 bp, Homo sapiens
ctaaaggctacctttgtat

SEQ ID NO: 2206249 - DNA, 18 bp, Homo sapiens
ctaaatggaaccactcta

SEQ ID NO: 2206250 - DNA, 16 bp, Homo sapiens
ctaacttcaccatatt

SEQ ID NO: 2206251 - DNA, 20 bp, Homo sapiens
ctaagatataatttaaacgt

SEQ ID NO: 2206252 - DNA, 14 bp, Homo sapiens
ctactatatatgtg

SEQ ID NO: 2206253 - DNA, 21 bp, Homo sapiens
ctactgtaatttgtgatacaa

SEQ ID NO: 2206254 - DNA, 17 bp, Homo sapiens
ctagaggttcaaagata

SEQ ID NO: 2206255 - DNA, 18 bp, Homo sapiens
ctagaggttcaaagatat

SEQ ID NO: 2206256 - DNA, 24 bp, Homo sapiens
ctagatactgtatcatgacaaaga

SEQ ID NO: 2206257 - DNA, 19 bp, Homo sapiens
ctagcatacgtacacattt

SEQ ID NO: 2206258 - DNA, 21 bp, Homo sapiens
ctagcatacgtacacatttta

SEQ ID NO: 2206259 - DNA, 23 bp, Homo sapiens
ctagcatacgtacacattttatt

SEQ ID NO: 2206260 - DNA, 22 bp, Homo sapiens
ctagtcatttgttaatatttct

SEQ ID NO: 2206261 - DNA, 23 bp, Homo sapiens
ctatatatgtgatgatctaccag

SEQ ID NO: 2206262 - DNA, 19 bp, Homo sapiens
ctatatttttctcaatgtt

SEQ ID NO: 2206263 - DNA, 20 bp, Homo sapiens
ctatcaagtattataccttt

SEQ ID NO: 2206264 - DNA, 14 bp, Homo sapiens
ctatgacacatgca

SEQ ID NO: 2206265 - DNA, 12 bp, Homo sapiens
ctatgcatttga

SEQ ID NO: 2206266 - DNA, 14 bp, Homo sapiens
ctatgttaatattt

SEQ ID NO: 2206267 - DNA, 21 bp, Homo sapiens
ctatgttaatattttatgtgt

SEQ ID NO: 2206268 - DNA, 18 bp, Homo sapiens
ctcaaccacctttcagat

SEQ ID NO: 2206269 - DNA, 23 bp, Homo sapiens
ctcaatgtttagcagatttaaga

SEQ ID NO: 2206270 - DNA, 13 bp, Homo sapiens
ctcagttgcagcc

SEQ ID NO: 2206271 - DNA, 15 bp, Homo sapiens
ctccaaaataaaact

SEQ ID NO: 2206272 - DNA, 18 bp, Homo sapiens
ctccaaaataaaactttt

SEQ ID NO: 2206273 - DNA, 22 bp, Homo sapiens
ctccaaaccactttttgcagct

SEQ ID NO: 2206274 - DNA, 14 bp, Homo sapiens
ctccagcctcagct

SEQ ID NO: 2206275 - DNA, 19 bp, Homo sapiens
ctccatggccctgccatgc

SEQ ID NO: 2206276 - DNA, 21 bp, Homo sapiens
ctccctattttttttctgtta

SEQ ID NO: 2206277 - DNA, 14 bp, Homo sapiens
ctccttgtgttact

SEQ ID NO: 2206278 - DNA, 19 bp, Homo sapiens
ctctagtttgattaaattc

SEQ ID NO: 2206279 - DNA, 15 bp, Homo sapiens
ctctcagttgcagcc

SEQ ID NO: 2206280 - DNA, 22 bp, Homo sapiens
ctctcagttgcagccctgctgc

SEQ ID NO: 2206281 - DNA, 16 bp, Homo sapiens
ctctccaaaccacttt

SEQ ID NO: 2206282 - DNA, 13 bp, Homo sapiens
ctctcctgtacct

SEQ ID NO: 2206283 - DNA, 14 bp, Homo sapiens
ctctcctgtacctc

SEQ ID NO: 2206284 - DNA, 19 bp, Homo sapiens
ctctgaagtgaaactgctt

SEQ ID NO: 2206285 - DNA, 17 bp, Homo sapiens
ctctgcaatcttctcag

SEQ ID NO: 2206286 - DNA, 18 bp, Homo sapiens
ctctgtgagcatcacagt

SEQ ID NO: 2206287 - DNA, 22 bp, Homo sapiens
ctctgtgagcatcacagttttg

SEQ ID NO: 2206288 - DNA, 18 bp, Homo sapiens
ctcttcagatctctaact

SEQ ID NO: 2206289 - DNA, 23 bp, Homo sapiens
ctcttgagccttgaactttgacc

SEQ ID NO: 2206290 - DNA, 13 bp, Homo sapiens
ctgaagtgaaact

SEQ ID NO: 2206291 - DNA, 15 bp, Homo sapiens
ctgacatctctgcaa

SEQ ID NO: 2206292 - DNA, 20 bp, Homo sapiens
ctgagtacgttgtgcatttg

SEQ ID NO: 2206293 - DNA, 18 bp, Homo sapiens
ctgcaatgaagtctctga

SEQ ID NO: 2206294 - DNA, 21 bp, Homo sapiens
ctgcaatgaagtctctgaagt

SEQ ID NO: 2206295 - DNA, 15 bp, Homo sapiens
ctgcagcaataaagc

SEQ ID NO: 2206296 - DNA, 17 bp, Homo sapiens
ctgcagcaataaagcag

SEQ ID NO: 2206297 - DNA, 14 bp, Homo sapiens
ctgcatttaaaaga

SEQ ID NO: 2206298 - DNA, 16 bp, Homo sapiens
ctgccacctcctgcct

SEQ ID NO: 2206299 - DNA, 19 bp, Homo sapiens
ctgccacctcctgcctcag

SEQ ID NO: 2206300 - DNA, 19 bp, Homo sapiens
ctgccttgtttaatgttaa

SEQ ID NO: 2206301 - DNA, 20 bp, Homo sapiens
ctgccttgtttaatgttaat

SEQ ID NO: 2206302 - DNA, 13 bp, Homo sapiens
ctgctgcctgcct

SEQ ID NO: 2206303 - DNA, 20 bp, Homo sapiens
ctgcttaacttcacatattg

SEQ ID NO: 2206304 - DNA, 13 bp, Homo sapiens
ctgcttgtttcct

SEQ ID NO: 2206305 - DNA, 14 bp, Homo sapiens
ctgcttgtttccta

SEQ ID NO: 2206306 - DNA, 18 bp, Homo sapiens
ctggacttggcccctgcc

SEQ ID NO: 2206307 - DNA, 19 bp, Homo sapiens
ctggattgcgcctaatgtg

SEQ ID NO: 2206308 - DNA, 22 bp, Homo sapiens
ctggctatgcatttgaaaattt

SEQ ID NO: 2206309 - DNA, 17 bp, Homo sapiens
ctggtgtgaactaaact

SEQ ID NO: 2206310 - DNA, 16 bp, Homo sapiens
ctggttccatggcctc

SEQ ID NO: 2206311 - DNA, 21 bp, Homo sapiens
ctgtaatttgtgatacaatgc

SEQ ID NO: 2206312 - DNA, 22 bp, Homo sapiens
ctgtaatttgtgatacaatgct

SEQ ID NO: 2206313 - DNA, 20 bp, Homo sapiens
ctgtacatgaaaacacattt

SEQ ID NO: 2206314 - DNA, 15 bp, Homo sapiens
ctgtcctattatatt

SEQ ID NO: 2206315 - DNA, 14 bp, Homo sapiens
ctgttatataaatg

SEQ ID NO: 2206316 - DNA, 20 bp, Homo sapiens
ctgttatttataatcacttt

SEQ ID NO: 2206317 - DNA, 16 bp, Homo sapiens
ctgttctttccaaagt

SEQ ID NO: 2206318 - DNA, 21 bp, Homo sapiens
ctgttctttccaaagtacact

SEQ ID NO: 2206319 - DNA, 18 bp, Homo sapiens
ctgtttagataatacacc

SEQ ID NO: 2206320 - DNA, 17 bp, Homo sapiens
ctgtttcaaactttact

SEQ ID NO: 2206321 - DNA, 14 bp, Homo sapiens
ctgttttatgactt

SEQ ID NO: 2206322 - DNA, 13 bp, Homo sapiens
cttaaataataaa

SEQ ID NO: 2206323 - DNA, 13 bp, Homo sapiens
cttaaataatgtg

SEQ ID NO: 2206324 - DNA, 16 bp, Homo sapiens
cttaaataatgtgaaa

SEQ ID NO: 2206325 - DNA, 12 bp, Homo sapiens
cttaacttcaca

SEQ ID NO: 2206326 - DNA, 18 bp, Homo sapiens
cttaccctcatgttctta

SEQ ID NO: 2206327 - DNA, 23 bp, Homo sapiens
cttaggagaagtcttctatttat

SEQ ID NO: 2206328 - DNA, 23 bp, Homo sapiens
cttcacatattgatttccgttaa

SEQ ID NO: 2206329 - DNA, 17 bp, Homo sapiens
cttcattaataataaat

SEQ ID NO: 2206330 - DNA, 16 bp, Homo sapiens
cttctcagaaggcaaa

SEQ ID NO: 2206331 - DNA, 17 bp, Homo sapiens
cttctccatggccctgc

SEQ ID NO: 2206332 - DNA, 21 bp, Homo sapiens
cttgaactttgacctctgcag

SEQ ID NO: 2206333 - DNA, 15 bp, Homo sapiens
cttgagccttgaact

SEQ ID NO: 2206334 - DNA, 17 bp, Homo sapiens
cttgagccttgaacttt

SEQ ID NO: 2206335 - DNA, 18 bp, Homo sapiens
cttgagccttgaactttg

SEQ ID NO: 2206336 - DNA, 18 bp, Homo sapiens
cttggacattttatgtct

SEQ ID NO: 2206337 - DNA, 12 bp, Homo sapiens
cttgtacataat

SEQ ID NO: 2206338 - DNA, 22 bp, Homo sapiens
cttgtacataatgcgtgcatac

SEQ ID NO: 2206339 - DNA, 14 bp, Homo sapiens
cttgtttaatgtta

SEQ ID NO: 2206340 - DNA, 22 bp, Homo sapiens
cttgtttaatgttaattatgca

SEQ ID NO: 2206341 - DNA, 21 bp, Homo sapiens
ctttaagaactaaaatgttct

SEQ ID NO: 2206342 - DNA, 17 bp, Homo sapiens
ctttaccttttttatac

SEQ ID NO: 2206343 - DNA, 14 bp, Homo sapiens
ctttcatattttag

SEQ ID NO: 2206344 - DNA, 17 bp, Homo sapiens
ctttctggctatgcatt

SEQ ID NO: 2206345 - DNA, 19 bp, Homo sapiens
ctttctggctatgcatttg

SEQ ID NO: 2206346 - DNA, 20 bp, Homo sapiens
ctttctggctatgcatttga

SEQ ID NO: 2206347 - DNA, 13 bp, Homo sapiens
ctttgacctctgc

SEQ ID NO: 2206348 - DNA, 17 bp, Homo sapiens
ctttgacctctgcagca

SEQ ID NO: 2206349 - DNA, 17 bp, Homo sapiens
ctttgtgatttttgtaa

SEQ ID NO: 2206350 - DNA, 18 bp, Homo sapiens
ctttgtgatttttgtaat

SEQ ID NO: 2206351 - DNA, 15 bp, Homo sapiens
cttttataaacttta

SEQ ID NO: 2206352 - DNA, 19 bp, Homo sapiens
cttttataaactttacctt

SEQ ID NO: 2206353 - DNA, 18 bp, Homo sapiens
cttttgccgttattaaaa

SEQ ID NO: 2206354 - DNA, 13 bp, Homo sapiens
cttttgtgcatta

SEQ ID NO: 2206355 - DNA, 20 bp, Homo sapiens
cttttgttcttggtttgtaa

SEQ ID NO: 2206356 - DNA, 13 bp, Homo sapiens
ctttttgcagctt

SEQ ID NO: 2206357 - DNA, 15 bp, Homo sapiens
cttttttatacataa

SEQ ID NO: 2206358 - DNA, 17 bp, Homo sapiens
gaaaaaggatgcacaga

SEQ ID NO: 2206359 - DNA, 13 bp, Homo sapiens
gaaaacacatttt

SEQ ID NO: 2206360 - DNA, 18 bp, Homo sapiens
gaaaattttgatgtttta

SEQ ID NO: 2206361 - DNA, 17 bp, Homo sapiens
gaaactggattaaactt

SEQ ID NO: 2206362 - DNA, 19 bp, Homo sapiens
gaaatactgtttgaggttt

SEQ ID NO: 2206363 - DNA, 17 bp, Homo sapiens
gaaatataggaacttaa

SEQ ID NO: 2206364 - DNA, 14 bp, Homo sapiens
gaaatgtatgtgtg

SEQ ID NO: 2206365 - DNA, 18 bp, Homo sapiens
gaacactccaattaagga

SEQ ID NO: 2206366 - DNA, 20 bp, Homo sapiens
gaacactccaattaaggatt

SEQ ID NO: 2206367 - DNA, 22 bp, Homo sapiens
gaacaggaaaataaaatattta

SEQ ID NO: 2206368 - DNA, 16 bp, Homo sapiens
gaactttgacctctgc

SEQ ID NO: 2206369 - DNA, 16 bp, Homo sapiens
gaagacaatgacttac

SEQ ID NO: 2206370 - DNA, 14 bp, Homo sapiens
gaagattctatgtt

SEQ ID NO: 2206371 - DNA, 20 bp, Homo sapiens
gaagattctatgttaatatt

SEQ ID NO: 2206372 - DNA, 18 bp, Homo sapiens
gaagccaaacctctgtga

SEQ ID NO: 2206373 - DNA, 19 bp, Homo sapiens
gaaggatacaaaagcatgt

SEQ ID NO: 2206374 - DNA, 16 bp, Homo sapiens
gaaggtagaatgtttt

SEQ ID NO: 2206375 - DNA, 19 bp, Homo sapiens
gaagtaatatgcacacatt

SEQ ID NO: 2206376 - DNA, 20 bp, Homo sapiens
gaagtaatatgcacacattt

SEQ ID NO: 2206377 - DNA, 21 bp, Homo sapiens
gaagtaatatgcacacatttt

SEQ ID NO: 2206378 - DNA, 15 bp, Homo sapiens
gaagtcttctattta

SEQ ID NO: 2206379 - DNA, 17 bp, Homo sapiens
gaagtcttctatttatt

SEQ ID NO: 2206380 - DNA, 20 bp, Homo sapiens
gaatgtcagttgttatttat

SEQ ID NO: 2206381 - DNA, 22 bp, Homo sapiens
gaatgtcagttgttatttattg

SEQ ID NO: 2206382 - DNA, 19 bp, Homo sapiens
gaattctctagtttgatta

SEQ ID NO: 2206383 - DNA, 12 bp, Homo sapiens
gacaatttatta

SEQ ID NO: 2206384 - DNA, 13 bp, Homo sapiens
gacaatttattat

SEQ ID NO: 2206385 - DNA, 19 bp, Homo sapiens
gacaatttattatggcaca

SEQ ID NO: 2206386 - DNA, 19 bp, Homo sapiens
gacacatgcaaggtcattt

SEQ ID NO: 2206387 - DNA, 16 bp, Homo sapiens
gacatactaaccagca

SEQ ID NO: 2206388 - DNA, 23 bp, Homo sapiens
gacatactaaccagcagaaatgc

SEQ ID NO: 2206389 - DNA, 16 bp, Homo sapiens
gacattttatgtcttt

SEQ ID NO: 2206390 - DNA, 20 bp, Homo sapiens
gacattttatgtctttcttg

SEQ ID NO: 2206391 - DNA, 23 bp, Homo sapiens
gactgagtacgttgtgcatttgg

SEQ ID NO: 2206392 - DNA, 12 bp, Homo sapiens
gacttactgtac

SEQ ID NO: 2206393 - DNA, 16 bp, Homo sapiens
gacttactgtacatga

SEQ ID NO: 2206394 - DNA, 15 bp, Homo sapiens
gacttcattaataat

SEQ ID NO: 2206395 - DNA, 18 bp, Homo sapiens
gagaagtcttctatttat

SEQ ID NO: 2206396 - DNA, 19 bp, Homo sapiens
gagaggtttcgatatttat

SEQ ID NO: 2206397 - DNA, 13 bp, Homo sapiens
gagccttgaactt

SEQ ID NO: 2206398 - DNA, 19 bp, Homo sapiens
gaggttcaaagatattttg

SEQ ID NO: 2206399 - DNA, 20 bp, Homo sapiens
gagtacgttgtgcatttggt

SEQ ID NO: 2206400 - DNA, 22 bp, Homo sapiens
gagttgatactacagtttgtta

SEQ ID NO: 2206401 - DNA, 16 bp, Homo sapiens
gagttgttacattttt

SEQ ID NO: 2206402 - DNA, 22 bp, Homo sapiens
gataatacaccactacattctg

SEQ ID NO: 2206403 - DNA, 18 bp, Homo sapiens
gatacaatgctgtgccct

SEQ ID NO: 2206404 - DNA, 19 bp, Homo sapiens
gatacagttactcagaatt

SEQ ID NO: 2206405 - DNA, 17 bp, Homo sapiens
gatactgtatcatgaca

SEQ ID NO: 2206406 - DNA, 21 bp, Homo sapiens
gatactgtatcatgacaaaga

SEQ ID NO: 2206407 - DNA, 16 bp, Homo sapiens
gatatttattgatgtt

SEQ ID NO: 2206408 - DNA, 18 bp, Homo sapiens
gatatttattgatgtttt

SEQ ID NO: 2206409 - DNA, 15 bp, Homo sapiens
gatctctaacttcac

SEQ ID NO: 2206410 - DNA, 22 bp, Homo sapiens
gatgaatgtcagttgttattta

SEQ ID NO: 2206411 - DNA, 20 bp, Homo sapiens
gatgccaagttgtttgagaa

SEQ ID NO: 2206412 - DNA, 19 bp, Homo sapiens
gattaaattcttgcaaagt

SEQ ID NO: 2206413 - DNA, 17 bp, Homo sapiens
gattctatgttaatatt

SEQ ID NO: 2206414 - DNA, 13 bp, Homo sapiens
gatttaacagaaa

SEQ ID NO: 2206415 - DNA, 15 bp, Homo sapiens
gatttaacagaaatg

SEQ ID NO: 2206416 - DNA, 18 bp, Homo sapiens
gatttccgttaaaatacc

SEQ ID NO: 2206417 - DNA, 19 bp, Homo sapiens
gcaatgaagtctctgaagt

SEQ ID NO: 2206418 - DNA, 12 bp, Homo sapiens
gcacacattttt

SEQ ID NO: 2206419 - DNA, 19 bp, Homo sapiens
gcacactctcccattatat

SEQ ID NO: 2206420 - DNA, 19 bp, Homo sapiens
gcacagagttgttacattt

SEQ ID NO: 2206421 - DNA, 20 bp, Homo sapiens
gcacatcagcacgatttctg

SEQ ID NO: 2206422 - DNA, 23 bp, Homo sapiens
gcacatcagcacgatttctgttt

SEQ ID NO: 2206423 - DNA, 22 bp, Homo sapiens
gcacctggaatatataaccagt

SEQ ID NO: 2206424 - DNA, 20 bp, Homo sapiens
gcagccctgctgctgcctgc

SEQ ID NO: 2206425 - DNA, 21 bp, Homo sapiens
gcagtggtggttttctgttct

SEQ ID NO: 2206426 - DNA, 14 bp, Homo sapiens
gcatacgtacacat

SEQ ID NO: 2206427 - DNA, 17 bp, Homo sapiens
gcatacgtacacatttt

SEQ ID NO: 2206428 - DNA, 18 bp, Homo sapiens
gcatacgtacacatttta

SEQ ID NO: 2206429 - DNA, 19 bp, Homo sapiens
gcatacgtacacattttat

SEQ ID NO: 2206430 - DNA, 22 bp, Homo sapiens
gcatactgccttgtttaatgtt

SEQ ID NO: 2206431 - DNA, 18 bp, Homo sapiens
gcatgaagtaatatgcac

SEQ ID NO: 2206432 - DNA, 20 bp, Homo sapiens
gcatgaagtaatatgcacac

SEQ ID NO: 2206433 - DNA, 12 bp, Homo sapiens
gcatttaaaaga

SEQ ID NO: 2206434 - DNA, 18 bp, Homo sapiens
gcatttaaaagatacagt

SEQ ID NO: 2206435 - DNA, 16 bp, Homo sapiens
gcatttgaaaattttg

SEQ ID NO: 2206436 - DNA, 19 bp, Homo sapiens
gcatttgaggtctgttctt

SEQ ID NO: 2206437 - DNA, 21 bp, Homo sapiens
gcatttggtggtttcagaaat

SEQ ID NO: 2206438 - DNA, 16 bp, Homo sapiens
gcatttgtttgaactg

SEQ ID NO: 2206439 - DNA, 23 bp, Homo sapiens
gccagtaaatgggggtgcatttg

SEQ ID NO: 2206440 - DNA, 18 bp, Homo sapiens
gccctgctgctgcctgcc

SEQ ID NO: 2206441 - DNA, 12 bp, Homo sapiens
gcctagcatacg

SEQ ID NO: 2206442 - DNA, 20 bp, Homo sapiens
gcctagcatacgtacacatt

SEQ ID NO: 2206443 - DNA, 18 bp, Homo sapiens
gccttaccctcatgttct

SEQ ID NO: 2206444 - DNA, 17 bp, Homo sapiens
gcgtttctatgacacat

SEQ ID NO: 2206445 - DNA, 13 bp, Homo sapiens
gctaagatataat

SEQ ID NO: 2206446 - DNA, 16 bp, Homo sapiens
gctacctttgtattct

SEQ ID NO: 2206447 - DNA, 18 bp, Homo sapiens
gctagaggttcaaagata

SEQ ID NO: 2206448 - DNA, 12 bp, Homo sapiens
taaggattttat

SEQ ID NO: 2206449 - DNA, 13 bp, Homo sapiens
taaggattttatg

SEQ ID NO: 2206450 - DNA, 19 bp, Homo sapiens
taagtctgttttatgactt

SEQ ID NO: 2206451 - DNA, 20 bp, Homo sapiens
taagtctgttttatgacttc

SEQ ID NO: 2206452 - DNA, 21 bp, Homo sapiens
taagtctgttttatgacttca

SEQ ID NO: 2206453 - DNA, 15 bp, Homo sapiens
taagtgctgcattta

SEQ ID NO: 2206454 - DNA, 16 bp, Homo sapiens
taagtgctgcatttaa

SEQ ID NO: 2206455 - DNA, 17 bp, Homo sapiens
taataaagatcatgtaa

SEQ ID NO: 2206456 - DNA, 16 bp, Homo sapiens
taatagacaatttatt

SEQ ID NO: 2206457 - DNA, 15 bp, Homo sapiens
taatatgcacacatt

SEQ ID NO: 2206458 - DNA, 17 bp, Homo sapiens
taatatgcacacatttt

SEQ ID NO: 2206459 - DNA, 18 bp, Homo sapiens
taatatgcacacattttt

SEQ ID NO: 2206460 - DNA, 17 bp, Homo sapiens
taatattttatgtgtaa

SEQ ID NO: 2206461 - DNA, 23 bp, Homo sapiens
taatcctctcaaccacctttcag

SEQ ID NO: 2206462 - DNA, 19 bp, Homo sapiens
taatgcgtgcataccactt

SEQ ID NO: 2206463 - DNA, 22 bp, Homo sapiens
taatgtgaaactggattaaact

SEQ ID NO: 2206464 - DNA, 15 bp, Homo sapiens
taattatgcagtgtt

SEQ ID NO: 2206465 - DNA, 18 bp, Homo sapiens
taattatttcactttaga

SEQ ID NO: 2206466 - DNA, 21 bp, Homo sapiens
tacaatgctgtgccctaaagt

SEQ ID NO: 2206467 - DNA, 21 bp, Homo sapiens
tacaattttccctcttcactt

SEQ ID NO: 2206468 - DNA, 22 bp, Homo sapiens
tacacattttattttattatgc

SEQ ID NO: 2206469 - DNA, 19 bp, Homo sapiens
tacactgtttcaaacttta

SEQ ID NO: 2206470 - DNA, 19 bp, Homo sapiens
tacagttactcagaattct

SEQ ID NO: 2206471 - DNA, 15 bp, Homo sapiens
tacataatgcgtgca

SEQ ID NO: 2206472 - DNA, 17 bp, Homo sapiens
tacataatgcgtgcata

SEQ ID NO: 2206473 - DNA, 19 bp, Homo sapiens
tacataatgcgtgcatacc

SEQ ID NO: 2206474 - DNA, 18 bp, Homo sapiens
tacatcaatgataatgct

SEQ ID NO: 2206475 - DNA, 18 bp, Homo sapiens
tacatgaaaacacatttt

SEQ ID NO: 2206476 - DNA, 23 bp, Homo sapiens
tacatttttaagtgctgcattta

SEQ ID NO: 2206477 - DNA, 13 bp, Homo sapiens
taccacagacata

SEQ ID NO: 2206478 - DNA, 15 bp, Homo sapiens
taccctcatgttctt

SEQ ID NO: 2206479 - DNA, 19 bp, Homo sapiens
taccttttttatacataaa

SEQ ID NO: 2206480 - DNA, 13 bp, Homo sapiens
tacgtacacattt

SEQ ID NO: 2206481 - DNA, 15 bp, Homo sapiens
tacgtacacatttta

SEQ ID NO: 2206482 - DNA, 15 bp, Homo sapiens
tacgttgtgcatttg

SEQ ID NO: 2206483 - DNA, 16 bp, Homo sapiens
tacgttgtgcatttgg

SEQ ID NO: 2206484 - DNA, 13 bp, Homo sapiens
tactaaacatgta

SEQ ID NO: 2206485 - DNA, 15 bp, Homo sapiens
tactaatagacaatt

SEQ ID NO: 2206486 - DNA, 20 bp, Homo sapiens
tactaatagacaatttatta

SEQ ID NO: 2206487 - DNA, 14 bp, Homo sapiens
tactacagtttgtt

SEQ ID NO: 2206488 - DNA, 15 bp, Homo sapiens
tactgtaatttgtga

SEQ ID NO: 2206489 - DNA, 18 bp, Homo sapiens
tactgtacatgaaaacac

SEQ ID NO: 2206490 - DNA, 21 bp, Homo sapiens
tactgtatcatgacaaagact

SEQ ID NO: 2206491 - DNA, 14 bp, Homo sapiens
tagagttgatacta

SEQ ID NO: 2206492 - DNA, 18 bp, Homo sapiens
tagataatacaccactac

SEQ ID NO: 2206493 - DNA, 20 bp, Homo sapiens
tagatgaatgtcagttgtta

SEQ ID NO: 2206494 - DNA, 17 bp, Homo sapiens
tagcatacgtacacatt

SEQ ID NO: 2206495 - DNA, 19 bp, Homo sapiens
taggtgtgactgaatttct

SEQ ID NO: 2206496 - DNA, 18 bp, Homo sapiens
tagtatgaggcatttgtt

SEQ ID NO: 2206497 - DNA, 22 bp, Homo sapiens
tagttactaaacatgtatgtaa

SEQ ID NO: 2206498 - DNA, 14 bp, Homo sapiens
tataaactttacct

SEQ ID NO: 2206499 - DNA, 23 bp, Homo sapiens
tataggaacttaaataatgtgaa

SEQ ID NO: 2206500 - DNA, 13 bp, Homo sapiens
tatatttattgtt

SEQ ID NO: 2206501 - DNA, 21 bp, Homo sapiens
tatcaagtattataccttttt

SEQ ID NO: 2206502 - DNA, 18 bp, Homo sapiens
tatcacccagaagaaaat

SEQ ID NO: 2206503 - DNA, 19 bp, Homo sapiens
tatcacccagaagaaaata

SEQ ID NO: 2206504 - DNA, 14 bp, Homo sapiens
tatcatcagtattg

SEQ ID NO: 2206505 - DNA, 16 bp, Homo sapiens
tatcatgacaaagact

SEQ ID NO: 2206506 - DNA, 19 bp, Homo sapiens
tatctagatactgtatcat

SEQ ID NO: 2206507 - DNA, 20 bp, Homo sapiens
tatgacttcattaataataa

SEQ ID NO: 2206508 - DNA, 14 bp, Homo sapiens
tatgaggcatttgt

SEQ ID NO: 2206509 - DNA, 15 bp, Homo sapiens
tatgaggcatttgtt

SEQ ID NO: 2206510 - DNA, 15 bp, Homo sapiens
tatgctttaaacatt

SEQ ID NO: 2206511 - DNA, 20 bp, Homo sapiens
tatggccctggcctagcata

SEQ ID NO: 2206512 - DNA, 21 bp, Homo sapiens
tatggcttttgtgcattatct

SEQ ID NO: 2206513 - DNA, 20 bp, Homo sapiens
tatgtgcacatctgttttgt

SEQ ID NO: 2206514 - DNA, 15 bp, Homo sapiens
tatgtgtgtctattt

SEQ ID NO: 2206515 - DNA, 16 bp, Homo sapiens
tatgttaatatttctg

SEQ ID NO: 2206516 - DNA, 22 bp, Homo sapiens
tattaaaaatctcaaatttcta

SEQ ID NO: 2206517 - DNA, 13 bp, Homo sapiens
tattaagaatgaa

SEQ ID NO: 2206518 - DNA, 17 bp, Homo sapiens
tattatattcattcttt

SEQ ID NO: 2206519 - DNA, 24 bp, Homo sapiens
tattctctcctgtacctcttgagc

SEQ ID NO: 2206520 - DNA, 14 bp, Homo sapiens
tattgaaatgattt

SEQ ID NO: 2206521 - DNA, 22 bp, Homo sapiens
tattgaaatgatttcacagtgt

SEQ ID NO: 2206522 - DNA, 19 bp, Homo sapiens
tatttaacaaaatttgaat

SEQ ID NO: 2206523 - DNA, 16 bp, Homo sapiens
tatttaatttgaaggt

SEQ ID NO: 2206524 - DNA, 23 bp, Homo sapiens
tatttaatttgaaggtagaatgt

SEQ ID NO: 2206525 - DNA, 17 bp, Homo sapiens
tatttataatcactttt

SEQ ID NO: 2206526 - DNA, 14 bp, Homo sapiens
tatttatttattta

SEQ ID NO: 2206527 - DNA, 15 bp, Homo sapiens
tatttgtttgcatag

SEQ ID NO: 2206528 - DNA, 13 bp, Homo sapiens
tattttatgtgta

SEQ ID NO: 2206529 - DNA, 15 bp, Homo sapiens
tattttatgtgtaaa

SEQ ID NO: 2206530 - DNA, 15 bp, Homo sapiens
tatttttttactaat

SEQ ID NO: 2206531 - DNA, 14 bp, Homo sapiens
tattttttttctgt

SEQ ID NO: 2206532 - DNA, 17 bp, Homo sapiens
tcaaacccaagttagtt

SEQ ID NO: 2206533 - DNA, 13 bp, Homo sapiens
tcaaagatatttt

SEQ ID NO: 2206534 - DNA, 16 bp, Homo sapiens
tcaacatttctcatgt

SEQ ID NO: 2206535 - DNA, 18 bp, Homo sapiens
tcaactgggctgaacact

SEQ ID NO: 2206536 - DNA, 16 bp, Homo sapiens
tcaagtattatacctt

SEQ ID NO: 2206537 - DNA, 19 bp, Homo sapiens
tcaatctggattcatattt

SEQ ID NO: 2206538 - DNA, 16 bp, Homo sapiens
tcacaaagaacaggaa

SEQ ID NO: 2206539 - DNA, 18 bp, Homo sapiens
tcacagcacttacaattt

SEQ ID NO: 2206540 - DNA, 17 bp, Homo sapiens
tcacagtgtgtggtcaa

SEQ ID NO: 2206541 - DNA, 20 bp, Homo sapiens
tcacagttttggttgcttta

SEQ ID NO: 2206542 - DNA, 21 bp, Homo sapiens
tcacagttttggttgctttaa

SEQ ID NO: 2206543 - DNA, 18 bp, Homo sapiens
tcacatattgatttccgt

SEQ ID NO: 2206544 - DNA, 20 bp, Homo sapiens
tcacatattgatttccgtta

SEQ ID NO: 2206545 - DNA, 18 bp, Homo sapiens
tcacatgtcagccactgt

SEQ ID NO: 2206546 - DNA, 14 bp, Homo sapiens
tcactgcttaactt

SEQ ID NO: 2206547 - DNA, 17 bp, Homo sapiens
tcactgcttaacttcac

SEQ ID NO: 2206548 - DNA, 18 bp, Homo sapiens
tcactgcttaacttcaca

SEQ ID NO: 2206549 - DNA, 15 bp, Homo sapiens
tcagaaatgtgttat

SEQ ID NO: 2206550 - DNA, 19 bp, Homo sapiens
tcagaaggcaaatgacttt

SEQ ID NO: 2206551 - DNA, 23 bp, Homo sapiens
tcagaattctctagtttgattaa

SEQ ID NO: 2206552 - DNA, 13 bp, Homo sapiens
tcagataactgtt

SEQ ID NO: 2206553 - DNA, 22 bp, Homo sapiens
tcagataactgttatttataat

SEQ ID NO: 2206554 - DNA, 16 bp, Homo sapiens
tcagcacgatttctgt

SEQ ID NO: 2206555 - DNA, 17 bp, Homo sapiens
tcagcacgatttctgtt

SEQ ID NO: 2206556 - DNA, 13 bp, Homo sapiens
tcagccactgtga

SEQ ID NO: 2206557 - DNA, 19 bp, Homo sapiens
tcagctctcagttgcagcc

SEQ ID NO: 2206558 - DNA, 17 bp, Homo sapiens
tcagtattgaagcattt

SEQ ID NO: 2206559 - DNA, 19 bp, Homo sapiens
tcagtattgaagcatttta

SEQ ID NO: 2206560 - DNA, 17 bp, Homo sapiens
tcagttgttatttattg

SEQ ID NO: 2206561 - DNA, 16 bp, Homo sapiens
tcatcagtattgaagc

SEQ ID NO: 2206562 - DNA, 20 bp, Homo sapiens
tcatcagtattgaagcattt

SEQ ID NO: 2206563 - DNA, 21 bp, Homo sapiens
tcatcagtattgaagcatttt

SEQ ID NO: 2206564 - DNA, 14 bp, Homo sapiens
tcattagttttgaa

SEQ ID NO: 2206565 - DNA, 23 bp, Homo sapiens
tcattagttttgaagattctatg

SEQ ID NO: 2206566 - DNA, 17 bp, Homo sapiens
tcattttttttaagaaa

SEQ ID NO: 2206567 - DNA, 16 bp, Homo sapiens
tccaaaataaaacttt

SEQ ID NO: 2206568 - DNA, 20 bp, Homo sapiens
tccaaaataaaactttttaa

SEQ ID NO: 2206569 - DNA, 14 bp, Homo sapiens
tccagcctcagctc

SEQ ID NO: 2206570 - DNA, 15 bp, Homo sapiens
tcccattatatttat

SEQ ID NO: 2206571 - DNA, 22 bp, Homo sapiens
tccctattttttttctgttata

SEQ ID NO: 2206572 - DNA, 11 bp, Homo sapiens
tccctggcctt

SEQ ID NO: 2206573 - DNA, 16 bp, Homo sapiens
tcccttggacatttta

SEQ ID NO: 2206574 - DNA, 22 bp, Homo sapiens
tcccttggacattttatgtctt

SEQ ID NO: 2206575 - DNA, 22 bp, Homo sapiens
tcctgcaatgaagtctctgaag

SEQ ID NO: 2206576 - DNA, 15 bp, Homo sapiens
tcgcttttgataatc

SEQ ID NO: 2206577 - DNA, 21 bp, Homo sapiens
tcgtgatgacatatcacatgt

SEQ ID NO: 2206578 - DNA, 19 bp, Homo sapiens
tctaaaggctacctttgta

SEQ ID NO: 2206579 - DNA, 22 bp, Homo sapiens
tctaaatctccaaaataaaact

SEQ ID NO: 2206580 - DNA, 21 bp, Homo sapiens
tctagtttgattaaattcttg

SEQ ID NO: 2206581 - DNA, 23 bp, Homo sapiens
tctatgttaatattttatgtgta

SEQ ID NO: 2206582 - DNA, 19 bp, Homo sapiens
tctattttgtaactgtaaa

SEQ ID NO: 2206583 - DNA, 14 bp, Homo sapiens
tctcaaatttctaa

SEQ ID NO: 2206584 - DNA, 22 bp, Homo sapiens
tgtattctctcctgtacctctt

SEQ ID NO: 2206585 - DNA, 13 bp, Homo sapiens
tgtctttcttgta

SEQ ID NO: 2206586 - DNA, 18 bp, Homo sapiens
tgtgagcatcacagtttt

SEQ ID NO: 2206587 - DNA, 14 bp, Homo sapiens
tgtgcattatctag

SEQ ID NO: 2206588 - DNA, 16 bp, Homo sapiens
tgtgcattatctagat

SEQ ID NO: 2206589 - DNA, 13 bp, Homo sapiens
tgtgcatttaatt

SEQ ID NO: 2206590 - DNA, 15 bp, Homo sapiens
tgtgcctaatgtgtt

SEQ ID NO: 2206591 - DNA, 18 bp, Homo sapiens
tgtgcctaatgtgtttga

SEQ ID NO: 2206592 - DNA, 22 bp, Homo sapiens
tgtggatttaacagaaatgtac

SEQ ID NO: 2206593 - DNA, 16 bp, Homo sapiens
tgtggtcaacatttct

SEQ ID NO: 2206594 - DNA, 21 bp, Homo sapiens
tgtggtcaacatttctcatgt

SEQ ID NO: 2206595 - DNA, 13 bp, Homo sapiens
tgtgtctattttg

SEQ ID NO: 2206596 - DNA, 14 bp, Homo sapiens
tgtgtctattttgt

SEQ ID NO: 2206597 - DNA, 14 bp, Homo sapiens
tgtgtggtcaacat

SEQ ID NO: 2206598 - DNA, 18 bp, Homo sapiens
tgtgtggtcaacatttct

SEQ ID NO: 2206599 - DNA, 23 bp, Homo sapiens
tgtgtggtcaacatttctcatgt

SEQ ID NO: 2206600 - DNA, 14 bp, Homo sapiens
tgttaatatttctt

SEQ ID NO: 2206601 - DNA, 19 bp, Homo sapiens
tgttaatattttatgtgta

SEQ ID NO: 2206602 - DNA, 14 bp, Homo sapiens
tgttactaagtttt

SEQ ID NO: 2206603 - DNA, 18 bp, Homo sapiens
tgttatttataatcactt

SEQ ID NO: 2206604 - DNA, 21 bp, Homo sapiens
tgttatttataatcacttttt

SEQ ID NO: 2206605 - DNA, 18 bp, Homo sapiens
tgttatttattgaaatga

SEQ ID NO: 2206606 - DNA, 22 bp, Homo sapiens
tgttctaaatatcccttggaca

SEQ ID NO: 2206607 - DNA, 14 bp, Homo sapiens
tgttcttaattctt

SEQ ID NO: 2206608 - DNA, 14 bp, Homo sapiens
tgttctttctggct

SEQ ID NO: 2206609 - DNA, 16 bp, Homo sapiens
tgttgaaactttaaga

SEQ ID NO: 2206610 - DNA, 13 bp, Homo sapiens
atgtcagccactg

SEQ ID NO: 2206611 - DNA, 15 bp, Homo sapiens
atgtcagttgttatt

SEQ ID NO: 2206612 - DNA, 14 bp, Homo sapiens
atgtgagactggtt

SEQ ID NO: 2206613 - DNA, 14 bp, Homo sapiens
atgtgcatttaatt

SEQ ID NO: 2206614 - DNA, 20 bp, Homo sapiens
atgtgtttgagcatcactta

SEQ ID NO: 2206615 - DNA, 13 bp, Homo sapiens
atgttaatatttc

SEQ ID NO: 2206616 - DNA, 15 bp, Homo sapiens
atgttaatattttat

SEQ ID NO: 2206617 - DNA, 16 bp, Homo sapiens
atgttaatattttatg

SEQ ID NO: 2206618 - DNA, 20 bp, Homo sapiens
atgttaatattttatgtgta

SEQ ID NO: 2206619 - DNA, 20 bp, Homo sapiens
atgttctccagtcattatgt

SEQ ID NO: 2206620 - DNA, 15 bp, Homo sapiens
atgttttcaaatgtt

SEQ ID NO: 2206621 - DNA, 15 bp, Homo sapiens
attaaaaatctcaaa

SEQ ID NO: 2206622 - DNA, 20 bp, Homo sapiens
attaaaaatctcaaatttct

SEQ ID NO: 2206623 - DNA, 21 bp, Homo sapiens
attaaacttaatctaaatgga

SEQ ID NO: 2206624 - DNA, 17 bp, Homo sapiens
attaacttttataaact

SEQ ID NO: 2206625 - DNA, 23 bp, Homo sapiens
attaacttttataaactttacct

SEQ ID NO: 2206626 - DNA, 17 bp, Homo sapiens
attaaggattttatgct

SEQ ID NO: 2206627 - DNA, 20 bp, Homo sapiens
attaaggattttatgcttta

SEQ ID NO: 2206628 - DNA, 17 bp, Homo sapiens
attaagtatctgacatc

SEQ ID NO: 2206629 - DNA, 18 bp, Homo sapiens
attaggtgtgactgaatt

SEQ ID NO: 2206630 - DNA, 16 bp, Homo sapiens
attatgttaatatttc

SEQ ID NO: 2206631 - DNA, 18 bp, Homo sapiens
attcatatttaatttgaa

SEQ ID NO: 2206632 - DNA, 16 bp, Homo sapiens
attcattctttttgaa

SEQ ID NO: 2206633 - DNA, 21 bp, Homo sapiens
attcattctttttgaaatgtc

SEQ ID NO: 2206634 - DNA, 19 bp, Homo sapiens
attccctggcctttcatat

SEQ ID NO: 2206635 - DNA, 21 bp, Homo sapiens
attccctggcctttcatattt

SEQ ID NO: 2206636 - DNA, 21 bp, Homo sapiens
attctccttgtgttactaagt

SEQ ID NO: 2206637 - DNA, 18 bp, Homo sapiens
attctctagtttgattaa

SEQ ID NO: 2206638 - DNA, 23 bp, Homo sapiens
attctctagtttgattaaattct

SEQ ID NO: 2206639 - DNA, 15 bp, Homo sapiens
attcttgcaaagtat

SEQ ID NO: 2206640 - DNA, 20 bp, Homo sapiens
attgaaatgatttcacagtg

SEQ ID NO: 2206641 - DNA, 17 bp, Homo sapiens
attgatgttttcataga

SEQ ID NO: 2206642 - DNA, 23 bp, Homo sapiens
attggctagaggttcaaagatat

SEQ ID NO: 2206643 - DNA, 14 bp, Homo sapiens
attgtttattttag

SEQ ID NO: 2206644 - DNA, 16 bp, Homo sapiens
atttaacagaaatgta

SEQ ID NO: 2206645 - DNA, 17 bp, Homo sapiens
atttaacagaaatgtac

SEQ ID NO: 2206646 - DNA, 19 bp, Homo sapiens
atttaacagaaatgtacag

SEQ ID NO: 2206647 - DNA, 22 bp, Homo sapiens
atttataatcacttttttccac

SEQ ID NO: 2206648 - DNA, 13 bp, Homo sapiens
atttattatggca

SEQ ID NO: 2206649 - DNA, 16 bp, Homo sapiens
atttattatggcacat

SEQ ID NO: 2206650 - DNA, 14 bp, Homo sapiens
atttattcattagt

SEQ ID NO: 2206651 - DNA, 20 bp, Homo sapiens
atttattgaaatgatttcac

SEQ ID NO: 2206652 - DNA, 15 bp, Homo sapiens
atttattgatgtttt

SEQ ID NO: 2206653 - DNA, 17 bp, Homo sapiens
atttattgatgttttca

SEQ ID NO: 2206654 - DNA, 14 bp, Homo sapiens
atttatttattcat

SEQ ID NO: 2206655 - DNA, 16 bp, Homo sapiens
atttatttatttattc

SEQ ID NO: 2206656 - DNA, 17 bp, Homo sapiens
atttccgttaaaatacc

SEQ ID NO: 2206657 - DNA, 13 bp, Homo sapiens
atttctcatgttg

SEQ ID NO: 2206658 - DNA, 15 bp, Homo sapiens
atttctcatgttgaa

SEQ ID NO: 2206659 - DNA, 12 bp, Homo sapiens
atttctgtttag

SEQ ID NO: 2206660 - DNA, 19 bp, Homo sapiens
atttctgtttagataatac

SEQ ID NO: 2206661 - DNA, 20 bp, Homo sapiens
atttctgtttagataataca

SEQ ID NO: 2206662 - DNA, 20 bp, Homo sapiens
atttcttcgtgatgacatat

SEQ ID NO: 2206663 - DNA, 16 bp, Homo sapiens
atttgaagatagaagg

SEQ ID NO: 2206664 - DNA, 19 bp, Homo sapiens
atttgaagatagaaggttt

SEQ ID NO: 2206665 - DNA, 17 bp, Homo sapiens
atttgaagatttaatta

SEQ ID NO: 2206666 - DNA, 19 bp, Homo sapiens
atttgaagatttaattact

SEQ ID NO: 2206667 - DNA, 18 bp, Homo sapiens
atttgaaggtagaatgtt

SEQ ID NO: 2206668 - DNA, 21 bp, Homo sapiens
atttgaggtctgttctttcca

SEQ ID NO: 2206669 - DNA, 23 bp, Homo sapiens
atttgaggtctgttctttccaaa

SEQ ID NO: 2206670 - DNA, 20 bp, Homo sapiens
atttggtggtttcagaaatg

SEQ ID NO: 2206671 - DNA, 21 bp, Homo sapiens
atttggtggtttcagaaatgt

SEQ ID NO: 2206672 - DNA, 20 bp, Homo sapiens
atttgtgatacaatgctgtg

SEQ ID NO: 2206673 - DNA, 12 bp, Homo sapiens
atttgtttgcat

SEQ ID NO: 2206674 - DNA, 18 bp, Homo sapiens
attttagctactatatat

SEQ ID NO: 2206675 - DNA, 15 bp, Homo sapiens
attttataaatcgct

SEQ ID NO: 2206676 - DNA, 13 bp, Homo sapiens
attttatgtcttt

SEQ ID NO: 2206677 - DNA, 21 bp, Homo sapiens
attttatgtctttcttgtaag

SEQ ID NO: 2206678 - DNA, 22 bp, Homo sapiens
attttgtaactgtaaagatgaa

SEQ ID NO: 2206679 - DNA, 15 bp, Homo sapiens
atttttaaattaaat

SEQ ID NO: 2206680 - DNA, 16 bp, Homo sapiens
atttttaagtgctgca

SEQ ID NO: 2206681 - DNA, 22 bp, Homo sapiens
atttttatgtaattatatatac

SEQ ID NO: 2206682 - DNA, 23 bp, Homo sapiens
atttttatgtaattatatatact

SEQ ID NO: 2206683 - DNA, 18 bp, Homo sapiens
atttttttactaatagac

SEQ ID NO: 2206684 - DNA, 20 bp, Homo sapiens
attttttttctgttatataa

SEQ ID NO: 2206685 - DNA, 20 bp, Homo sapiens
caaaataaaactttttaaaa

SEQ ID NO: 2206686 - DNA, 19 bp, Homo sapiens
caaaccactttttgcagct

SEQ ID NO: 2206687 - DNA, 18 bp, Homo sapiens
caaagatattttgctttg

SEQ ID NO: 2206688 - DNA, 20 bp, Homo sapiens
caaagatattttgctttgtg

SEQ ID NO: 2206689 - DNA, 20 bp, Homo sapiens
caaagtacactgtttcaaac

SEQ ID NO: 2206690 - DNA, 21 bp, Homo sapiens
caaagtatccctactgtaatt

SEQ ID NO: 2206691 - DNA, 14 bp, Homo sapiens
caaatttctaaatc

SEQ ID NO: 2206692 - DNA, 15 bp, Homo sapiens
caaatttctaaatct

SEQ ID NO: 2206693 - DNA, 23 bp, Homo sapiens
caacatgccagccactgtgatag

SEQ ID NO: 2206694 - DNA, 16 bp, Homo sapiens
caaccacctttcagat

SEQ ID NO: 2206695 - DNA, 16 bp, Homo sapiens
caagaccacgtttcta

SEQ ID NO: 2206696 - DNA, 16 bp, Homo sapiens
caaggagatttacaac

SEQ ID NO: 2206697 - DNA, 22 bp, Homo sapiens
caagtattataccttttttaga

SEQ ID NO: 2206698 - DNA, 16 bp, Homo sapiens
caagttagttcaatct

SEQ ID NO: 2206699 - DNA, 17 bp, Homo sapiens
caatgacttactgtaca

SEQ ID NO: 2206700 - DNA, 22 bp, Homo sapiens
caatgtttagcagatttaagat

SEQ ID NO: 2206701 - DNA, 13 bp, Homo sapiens
caattaaggattt

SEQ ID NO: 2206702 - DNA, 21 bp, Homo sapiens
caattatttgaagatttaatt

SEQ ID NO: 2206703 - DNA, 15 bp, Homo sapiens
caattgtaaactagt

SEQ ID NO: 2206704 - DNA, 21 bp, Homo sapiens
cacagacatactaaccagcag

SEQ ID NO: 2206705 - DNA, 16 bp, Homo sapiens
cacagagttgttacat

SEQ ID NO: 2206706 - DNA, 17 bp, Homo sapiens
cacagagttgttacatt

SEQ ID NO: 2206707 - DNA, 22 bp, Homo sapiens
cacagagttgttacatttttaa

SEQ ID NO: 2206708 - DNA, 20 bp, Homo sapiens
cacatcagcacgatttctgt

SEQ ID NO: 2206709 - DNA, 22 bp, Homo sapiens
cacatcagcacgatttctgttt

SEQ ID NO: 2206710 - DNA, 20 bp, Homo sapiens
cacatgcaaggtcatttttt

SEQ ID NO: 2206711 - DNA, 19 bp, Homo sapiens
cacatgtcagccactgtga

SEQ ID NO: 2206712 - DNA, 15 bp, Homo sapiens
cacattttattttat

SEQ ID NO: 2206713 - DNA, 17 bp, Homo sapiens
cacattttattttatta

SEQ ID NO: 2206714 - DNA, 19 bp, Homo sapiens
cacattttattttattatg

SEQ ID NO: 2206715 - DNA, 20 bp, Homo sapiens
cacattttattttattatgc

SEQ ID NO: 2206716 - DNA, 21 bp, Homo sapiens
cacattttattttattatgca

SEQ ID NO: 2206717 - DNA, 13 bp, Homo sapiens
cacatttttctta

SEQ ID NO: 2206718 - DNA, 19 bp, Homo sapiens
caccactacattctgttaa

SEQ ID NO: 2206719 - DNA, 12 bp, Homo sapiens
cacgatttctgt

SEQ ID NO: 2206720 - DNA, 12 bp, Homo sapiens
cacgtttctaaa

SEQ ID NO: 2206721 - DNA, 13 bp, Homo sapiens
cactacattctgt

SEQ ID NO: 2206722 - DNA, 16 bp, Homo sapiens
cactacattctgttaa

SEQ ID NO: 2206723 - DNA, 18 bp, Homo sapiens
cactccaattaaggattt

SEQ ID NO: 2206724 - DNA, 15 bp, Homo sapiens
cactttttgcagctt

SEQ ID NO: 2206725 - DNA, 12 bp, Homo sapiens
cacttttttcca

SEQ ID NO: 2206726 - DNA, 19 bp, Homo sapiens
cagaaggcaaatgactttg

SEQ ID NO: 2206727 - DNA, 15 bp, Homo sapiens
cagaattctctagtt

SEQ ID NO: 2206728 - DNA, 21 bp, Homo sapiens
cagagaggtttcgatatttat

SEQ ID NO: 2206729 - DNA, 14 bp, Homo sapiens
cagataactgttat

SEQ ID NO: 2206730 - DNA, 19 bp, Homo sapiens
cagataactgttatttata

SEQ ID NO: 2206731 - DNA, 20 bp, Homo sapiens
cagataactgttatttataa

SEQ ID NO: 2206732 - DNA, 21 bp, Homo sapiens
cagataactgttatttataat

SEQ ID NO: 2206733 - DNA, 20 bp, Homo sapiens
cagatattctctagtcattt

SEQ ID NO: 2206734 - DNA, 18 bp, Homo sapiens
cagcaaggagatttacaa

SEQ ID NO: 2206735 - DNA, 22 bp, Homo sapiens
cagcagaaatgccttaccctca

SEQ ID NO: 2206736 - DNA, 21 bp, Homo sapiens
cagtaaatgggggtgcatttg

SEQ ID NO: 2206737 - DNA, 14 bp, Homo sapiens
cagtattgaagcat

SEQ ID NO: 2206738 - DNA, 20 bp, Homo sapiens
cagtattgaagcattttata

SEQ ID NO: 2206739 - DNA, 19 bp, Homo sapiens
cagtggtggttttctgttc

SEQ ID NO: 2206740 - DNA, 22 bp, Homo sapiens
cagtggtggttttctgttcttt

SEQ ID NO: 2206741 - DNA, 22 bp, Homo sapiens
cagtgtgtggtcaacatttctc

SEQ ID NO: 2206742 - DNA, 19 bp, Homo sapiens
cagtgtttccctctgtgtt

SEQ ID NO: 2206743 - DNA, 20 bp, Homo sapiens
cagtgtttccctctgtgtta

SEQ ID NO: 2206744 - DNA, 21 bp, Homo sapiens
cagttgttatttattgaaatg

SEQ ID NO: 2206745 - DNA, 23 bp, Homo sapiens
cataatgcgtgcataccactttt

SEQ ID NO: 2206746 - DNA, 20 bp, Homo sapiens
tatttatttgtttgttttag

SEQ ID NO: 2206747 - DNA, 14 bp, Homo sapiens
tattttattatgca

SEQ ID NO: 2206748 - DNA, 17 bp, Homo sapiens
tattttattatgcatga

SEQ ID NO: 2206749 - DNA, 15 bp, Homo sapiens
tattttgctttgtga

SEQ ID NO: 2206750 - DNA, 17 bp, Homo sapiens
tattttgtaactgtaaa

SEQ ID NO: 2206751 - DNA, 21 bp, Homo sapiens
tattttgtagcgtacatcaat

SEQ ID NO: 2206752 - DNA, 14 bp, Homo sapiens
tatttttttactaa

SEQ ID NO: 2206753 - DNA, 17 bp, Homo sapiens
tatttttttcttttctt

SEQ ID NO: 2206754 - DNA, 13 bp, Homo sapiens
tcaaatttctaaa

SEQ ID NO: 2206755 - DNA, 14 bp, Homo sapiens
tcaaatttctaaat

SEQ ID NO: 2206756 - DNA, 17 bp, Homo sapiens
tcaaccacctttcagat

SEQ ID NO: 2206757 - DNA, 12 bp, Homo sapiens
tcaactgggctg

SEQ ID NO: 2206758 - DNA, 20 bp, Homo sapiens
tcacagcacttacaattttc

SEQ ID NO: 2206759 - DNA, 23 bp, Homo sapiens
tcacatgtcagccactgtgatag

SEQ ID NO: 2206760 - DNA, 20 bp, Homo sapiens
tcactgcttaacttcacata

SEQ ID NO: 2206761 - DNA, 15 bp, Homo sapiens
tcacttttttccaca

SEQ ID NO: 2206762 - DNA, 15 bp, Homo sapiens
tcagcacgatttctg

SEQ ID NO: 2206763 - DNA, 15 bp, Homo sapiens
tcatacctacatgta

SEQ ID NO: 2206764 - DNA, 14 bp, Homo sapiens
tcatgttgaagctt

SEQ ID NO: 2206765 - DNA, 16 bp, Homo sapiens
tcattaggtgtgactg

SEQ ID NO: 2206766 - DNA, 21 bp, Homo sapiens
tcattaggtgtgactgaattt

SEQ ID NO: 2206767 - DNA, 21 bp, Homo sapiens
tcattctccttgtgttactaa

SEQ ID NO: 2206768 - DNA, 17 bp, Homo sapiens
tcatttgttaatatttc

SEQ ID NO: 2206769 - DNA, 19 bp, Homo sapiens
tcatttgttaatatttctt

SEQ ID NO: 2206770 - DNA, 13 bp, Homo sapiens
tcattttttttaa

SEQ ID NO: 2206771 - DNA, 17 bp, Homo sapiens
tccaaaataaaactttt

SEQ ID NO: 2206772 - DNA, 16 bp, Homo sapiens
tccaattaaggatttt

SEQ ID NO: 2206773 - DNA, 18 bp, Homo sapiens
tccacataaggaaactgg

SEQ ID NO: 2206774 - DNA, 22 bp, Homo sapiens
tccacataaggaaactgggttc

SEQ ID NO: 2206775 - DNA, 14 bp, Homo sapiens
tccagtcattatgt

SEQ ID NO: 2206776 - DNA, 23 bp, Homo sapiens
tccagtcattatgttaatatttc

SEQ ID NO: 2206777 - DNA, 14 bp, Homo sapiens
tccatggccctgcc

SEQ ID NO: 2206778 - DNA, 15 bp, Homo sapiens
tccctggcctttcat

SEQ ID NO: 2206779 - DNA, 16 bp, Homo sapiens
tccctggcctttcata

SEQ ID NO: 2206780 - DNA, 19 bp, Homo sapiens
tcccttggacattttatgt

SEQ ID NO: 2206781 - DNA, 21 bp, Homo sapiens
tcccttggacattttatgtct

SEQ ID NO: 2206782 - DNA, 23 bp, Homo sapiens
tcccttggacattttatgtcttt

SEQ ID NO: 2206783 - DNA, 13 bp, Homo sapiens
tccgttaaaatac

SEQ ID NO: 2206784 - DNA, 12 bp, Homo sapiens
tcctattatatt

SEQ ID NO: 2206785 - DNA, 20 bp, Homo sapiens
tcctctcaaccacctttcag

SEQ ID NO: 2206786 - DNA, 21 bp, Homo sapiens
tcctctcaaccacctttcaga

SEQ ID NO: 2206787 - DNA, 18 bp, Homo sapiens
tcctgcaatgaagtctct

SEQ ID NO: 2206788 - DNA, 23 bp, Homo sapiens
tccttgtgttactaagtttttat

SEQ ID NO: 2206789 - DNA, 14 bp, Homo sapiens
tcgatatttattga

SEQ ID NO: 2206790 - DNA, 18 bp, Homo sapiens
tcgatatttattgatgtt

SEQ ID NO: 2206791 - DNA, 22 bp, Homo sapiens
tcgatatttattgatgttttca

SEQ ID NO: 2206792 - DNA, 18 bp, Homo sapiens
tcggaaaacatgctacac

SEQ ID NO: 2206793 - DNA, 23 bp, Homo sapiens
tcgtcactgcttaacttcacata

SEQ ID NO: 2206794 - DNA, 16 bp, Homo sapiens
tctaaaggctaccttt

SEQ ID NO: 2206795 - DNA, 17 bp, Homo sapiens
tctaaaggctacctttg

SEQ ID NO: 2206796 - DNA, 21 bp, Homo sapiens
tctaaatctccaaaataaaac

SEQ ID NO: 2206797 - DNA, 16 bp, Homo sapiens
tctaacttcaccatat

SEQ ID NO: 2206798 - DNA, 16 bp, Homo sapiens
tctacttgcacactct

SEQ ID NO: 2206799 - DNA, 24 bp, Homo sapiens
tctagatactgtatcatgacaaag

SEQ ID NO: 2206800 - DNA, 23 bp, Homo sapiens
tctagtcatttgttaatatttct

SEQ ID NO: 2206801 - DNA, 22 bp, Homo sapiens
tctagtttgattaaattcttgc

SEQ ID NO: 2206802 - DNA, 23 bp, Homo sapiens
tctagtttgattaaattcttgca

SEQ ID NO: 2206803 - DNA, 22 bp, Homo sapiens
tctatcaagtattatacctttt

SEQ ID NO: 2206804 - DNA, 14 bp, Homo sapiens
tctatgacacatgc

SEQ ID NO: 2206805 - DNA, 17 bp, Homo sapiens
tctatgacacatgcaag

SEQ ID NO: 2206806 - DNA, 14 bp, Homo sapiens
tctatgttaatatt

SEQ ID NO: 2206807 - DNA, 15 bp, Homo sapiens
tctattttgtaactg

SEQ ID NO: 2206808 - DNA, 18 bp, Homo sapiens
tctcaaatttctaaatct

SEQ ID NO: 2206809 - DNA, 17 bp, Homo sapiens
tctccaaaataaaactt

SEQ ID NO: 2206810 - DNA, 20 bp, Homo sapiens
tctccatggccctgccatgc

SEQ ID NO: 2206811 - DNA, 13 bp, Homo sapiens
tctcctgtacctc

SEQ ID NO: 2206812 - DNA, 15 bp, Homo sapiens
tctcctgtacctctt

SEQ ID NO: 2206813 - DNA, 16 bp, Homo sapiens
tctcctgtacctcttg

SEQ ID NO: 2206814 - DNA, 17 bp, Homo sapiens
tctcctgtacctcttga

SEQ ID NO: 2206815 - DNA, 19 bp, Homo sapiens
tctcctgtacctcttgagc

SEQ ID NO: 2206816 - DNA, 12 bp, Homo sapiens
tctctaacttca

SEQ ID NO: 2206817 - DNA, 17 bp, Homo sapiens
tctctagtcatttgtta

SEQ ID NO: 2206818 - DNA, 22 bp, Homo sapiens
tctgaagtgaaactgcttgttt

SEQ ID NO: 2206819 - DNA, 12 bp, Homo sapiens
tctgacatctct

SEQ ID NO: 2206820 - DNA, 15 bp, Homo sapiens
tctgacatctctgca

SEQ ID NO: 2206821 - DNA, 16 bp, Homo sapiens
tctgacatctctgcaa

SEQ ID NO: 2206822 - DNA, 17 bp, Homo sapiens
tctgcaatcttctcaga

SEQ ID NO: 2206823 - DNA, 16 bp, Homo sapiens
tctggattcatattta

SEQ ID NO: 2206824 - DNA, 13 bp, Homo sapiens
tctgttctttcca

SEQ ID NO: 2206825 - DNA, 17 bp, Homo sapiens
tctgttttatgacttca

SEQ ID NO: 2206826 - DNA, 21 bp, Homo sapiens
tcttctcagaaggcaaatgac

SEQ ID NO: 2206827 - DNA, 20 bp, Homo sapiens
tcttgaaatataggaactta

SEQ ID NO: 2206828 - DNA, 21 bp, Homo sapiens
tcttgaaatataggaacttaa

SEQ ID NO: 2206829 - DNA, 18 bp, Homo sapiens
tcttgagccttgaacttt

SEQ ID NO: 2206830 - DNA, 14 bp, Homo sapiens
tcttggtttgtaaa

SEQ ID NO: 2206831 - DNA, 15 bp, Homo sapiens
tcttgtattaagaat

SEQ ID NO: 2206832 - DNA, 14 bp, Homo sapiens
tctttccaaagtac

SEQ ID NO: 2206833 - DNA, 20 bp, Homo sapiens
tctttctggctatgcatttg

SEQ ID NO: 2206834 - DNA, 14 bp, Homo sapiens
tgaaaacacatttt

SEQ ID NO: 2206835 - DNA, 21 bp, Homo sapiens
tgaaaacacatttttcttagg

SEQ ID NO: 2206836 - DNA, 21 bp, Homo sapiens
tgaaaattttgatgttttaag

SEQ ID NO: 2206837 - DNA, 22 bp, Homo sapiens
tgaaactgcttgtttcctagca

SEQ ID NO: 2206838 - DNA, 14 bp, Homo sapiens
tgaaatactgtttg

SEQ ID NO: 2206839 - DNA, 16 bp, Homo sapiens
tgaaatactgtttgag

SEQ ID NO: 2206840 - DNA, 19 bp, Homo sapiens
tgaaatgatttcacagtgt

SEQ ID NO: 2206841 - DNA, 19 bp, Homo sapiens
tgaacactccaattaagga

SEQ ID NO: 2206842 - DNA, 22 bp, Homo sapiens
tgaacactccaattaaggattt

SEQ ID NO: 2206843 - DNA, 13 bp, Homo sapiens
tgaactgataaag

SEQ ID NO: 2206844 - DNA, 18 bp, Homo sapiens
tgaaggtagaatgttttc

SEQ ID NO: 2206845 - DNA, 16 bp, Homo sapiens
tgaagtaatatgcaca

SEQ ID NO: 2206846 - DNA, 19 bp, Homo sapiens
tgaagtctctgaagtgaaa

SEQ ID NO: 2206847 - DNA, 12 bp, Homo sapiens
tgacacatgcaa

SEQ ID NO: 2206848 - DNA, 15 bp, Homo sapiens
tgacatatcacatgt

SEQ ID NO: 2206849 - DNA, 13 bp, Homo sapiens
tgacctctgcagc

SEQ ID NO: 2206850 - DNA, 16 bp, Homo sapiens
tgacctctgcagcaat

SEQ ID NO: 2206851 - DNA, 15 bp, Homo sapiens
tgagccttgaacttt

SEQ ID NO: 2206852 - DNA, 18 bp, Homo sapiens
tgagccttgaactttgac

SEQ ID NO: 2206853 - DNA, 21 bp, Homo sapiens
tgaggcatttgtttgaactga

SEQ ID NO: 2206854 - DNA, 15 bp, Homo sapiens
tgaggtctgttcttt

SEQ ID NO: 2206855 - DNA, 14 bp, Homo sapiens
tgagtgagcatgcc

SEQ ID NO: 2206856 - DNA, 24 bp, Homo sapiens
tgataatcaactgggctgaacact

SEQ ID NO: 2206857 - DNA, 20 bp, Homo sapiens
tgatacaatgctgtgcccta

SEQ ID NO: 2206858 - DNA, 15 bp, Homo sapiens
tgatgccaagttgtt

SEQ ID NO: 2206859 - DNA, 21 bp, Homo sapiens
tgatgccaagttgtttgagaa

SEQ ID NO: 2206860 - DNA, 13 bp, Homo sapiens
tgatgttttcaca

SEQ ID NO: 2206861 - DNA, 15 bp, Homo sapiens
tgattcatatttaat

SEQ ID NO: 2206862 - DNA, 14 bp, Homo sapiens
tgatttcacagtgt

SEQ ID NO: 2206863 - DNA, 16 bp, Homo sapiens
tgatttcacagtgtgt

SEQ ID NO: 2206864 - DNA, 18 bp, Homo sapiens
tgatttccgttaaaatac

SEQ ID NO: 2206865 - DNA, 14 bp, Homo sapiens
tgatttttaaatta

SEQ ID NO: 2206866 - DNA, 18 bp, Homo sapiens
tgcaatgaagtctctgaa

SEQ ID NO: 2206867 - DNA, 13 bp, Homo sapiens
tgcacacattttt

SEQ ID NO: 2206868 - DNA, 18 bp, Homo sapiens
tgcacagagttgttacat

SEQ ID NO: 2206869 - DNA, 20 bp, Homo sapiens
tgcacagagttgttacattt

SEQ ID NO: 2206870 - DNA, 22 bp, Homo sapiens
tgcacagagttgttacattttt

SEQ ID NO: 2206871 - DNA, 20 bp, Homo sapiens
tgcacctggaatatataacc

SEQ ID NO: 2206872 - DNA, 14 bp, Homo sapiens
tgcagcaataaagc

SEQ ID NO: 2206873 - DNA, 14 bp, Homo sapiens
tgcataccactttt

SEQ ID NO: 2206874 - DNA, 20 bp, Homo sapiens
tgcataccacttttgttctt

SEQ ID NO: 2206875 - DNA, 21 bp, Homo sapiens
tgcataccacttttgttcttg

SEQ ID NO: 2206876 - DNA, 20 bp, Homo sapiens
tgcataggtgatctcattta

SEQ ID NO: 2206877 - DNA, 20 bp, Homo sapiens
tgcatgaagtaatatgcaca

SEQ ID NO: 2206878 - DNA, 20 bp, Homo sapiens
tgcatttaaaagatacagtt

SEQ ID NO: 2206879 - DNA, 21 bp, Homo sapiens
tgcatttgaggtctgttcttt

SEQ ID NO: 2206880 - DNA, 23 bp, Homo sapiens
tgcatttggtggtttcagaaatg

SEQ ID NO: 2206881 - DNA, 17 bp, Homo sapiens
tgccagccactgtgata

SEQ ID NO: 2206882 - DNA, 15 bp, Homo sapiens
tgccttgtttaatgt

SEQ ID NO: 2206883 - DNA, 18 bp, Homo sapiens
aaaatagtggtgtgattt

SEQ ID NO: 2206884 - DNA, 16 bp, Homo sapiens
aaaatctcaaatttct

SEQ ID NO: 2206885 - DNA, 19 bp, Homo sapiens
aaaatctcaaatttctaaa

SEQ ID NO: 2206886 - DNA, 12 bp, Homo sapiens
aaacacattttt

SEQ ID NO: 2206887 - DNA, 16 bp, Homo sapiens
aaacacatttttctta

SEQ ID NO: 2206888 - DNA, 22 bp, Homo sapiens
aaacatgctacacactgcatgt

SEQ ID NO: 2206889 - DNA, 21 bp, Homo sapiens
aaacattggttcttgtattaa

SEQ ID NO: 2206890 - DNA, 10 bp, Homo sapiens
aaaccacttt

SEQ ID NO: 2206891 - DNA, 20 bp, Homo sapiens
aaaccactttttgcagcttt

SEQ ID NO: 2206892 - DNA, 15 bp, Homo sapiens
aaacctctgtgagca

SEQ ID NO: 2206893 - DNA, 22 bp, Homo sapiens
aaactagttactaaacatgtat

SEQ ID NO: 2206894 - DNA, 17 bp, Homo sapiens
aaactgcttgtttccta

SEQ ID NO: 2206895 - DNA, 22 bp, Homo sapiens
aaactgcttgtttcctagcaca

SEQ ID NO: 2206896 - DNA, 15 bp, Homo sapiens
aaactgggttcctgc

SEQ ID NO: 2206897 - DNA, 14 bp, Homo sapiens
aaacttaatctaaa

SEQ ID NO: 2206898 - DNA, 18 bp, Homo sapiens
aaacttaatctaaatgga

SEQ ID NO: 2206899 - DNA, 12 bp, Homo sapiens
aaagatattttg

SEQ ID NO: 2206900 - DNA, 16 bp, Homo sapiens
aaagatattttgcttt

SEQ ID NO: 2206901 - DNA, 17 bp, Homo sapiens
aaagatattttgctttg

SEQ ID NO: 2206902 - DNA, 20 bp, Homo sapiens
aaagatattttgctttgtga

SEQ ID NO: 2206903 - DNA, 16 bp, Homo sapiens
aaagcagcgtttctat

SEQ ID NO: 2206904 - DNA, 14 bp, Homo sapiens
aaaggatgcacaga

SEQ ID NO: 2206905 - DNA, 17 bp, Homo sapiens
aaaggctacctttgtat

SEQ ID NO: 2206906 - DNA, 19 bp, Homo sapiens
aaagtacactgtttcaaac

SEQ ID NO: 2206907 - DNA, 21 bp, Homo sapiens
aaagtgtatttttttactaat

SEQ ID NO: 2206908 - DNA, 14 bp, Homo sapiens
aaataaaatattta

SEQ ID NO: 2206909 - DNA, 13 bp, Homo sapiens
aaataaaattttt

SEQ ID NO: 2206910 - DNA, 19 bp, Homo sapiens
aaataaggttatgattgaa

SEQ ID NO: 2206911 - DNA, 13 bp, Homo sapiens
aaataatgtgaaa

SEQ ID NO: 2206912 - DNA, 22 bp, Homo sapiens
aaataatgtgaaactggattaa

SEQ ID NO: 2206913 - DNA, 19 bp, Homo sapiens
aaataccagccagtaaatg

SEQ ID NO: 2206914 - DNA, 21 bp, Homo sapiens
aaataccagccagtaaatggg

SEQ ID NO: 2206915 - DNA, 14 bp, Homo sapiens
aaatactgtttgag

SEQ ID NO: 2206916 - DNA, 15 bp, Homo sapiens
aaatataggaactta

SEQ ID NO: 2206917 - DNA, 14 bp, Homo sapiens
aaatcgcttttgat

SEQ ID NO: 2206918 - DNA, 15 bp, Homo sapiens
aaatcgcttttgata

SEQ ID NO: 2206919 - DNA, 16 bp, Homo sapiens
aaatctcaaatttcta

SEQ ID NO: 2206920 - DNA, 19 bp, Homo sapiens
aaatctccaaaataaaact

SEQ ID NO: 2206921 - DNA, 22 bp, Homo sapiens
aaatctccaaaataaaactttt

SEQ ID NO: 2206922 - DNA, 23 bp, Homo sapiens
aaatggccagtgagatcaatgtg

SEQ ID NO: 2206923 - DNA, 16 bp, Homo sapiens
aaatgggggtgcattt

SEQ ID NO: 2206924 - DNA, 18 bp, Homo sapiens
aaatgtatgtgtgtctat

SEQ ID NO: 2206925 - DNA, 19 bp, Homo sapiens
aaattaacttttataaact

SEQ ID NO: 2206926 - DNA, 22 bp, Homo sapiens
aaattaacttttataaacttta

SEQ ID NO: 2206927 - DNA, 18 bp, Homo sapiens
aaattccctggcctttca

SEQ ID NO: 2206928 - DNA, 21 bp, Homo sapiens
aaattcttgcaaagtatccct

SEQ ID NO: 2206929 - DNA, 12 bp, Homo sapiens
aacaacaattat

SEQ ID NO: 2206930 - DNA, 20 bp, Homo sapiens
aacaagaccacgtttctaaa

SEQ ID NO: 2206931 - DNA, 14 bp, Homo sapiens
aacaattatttgaa

SEQ ID NO: 2206932 - DNA, 17 bp, Homo sapiens
aacactccaattaagga

SEQ ID NO: 2206933 - DNA, 12 bp, Homo sapiens
aacagaaatgta

SEQ ID NO: 2206934 - DNA, 13 bp, Homo sapiens
aacagaaatgtac

SEQ ID NO: 2206935 - DNA, 21 bp, Homo sapiens
aacagaaatgtacagcaagga

SEQ ID NO: 2206936 - DNA, 22 bp, Homo sapiens
aacatgctacacactgcatgtt

SEQ ID NO: 2206937 - DNA, 17 bp, Homo sapiens
aaccactttttgcagct

SEQ ID NO: 2206938 - DNA, 19 bp, Homo sapiens
aaccagtgttgtggattta

SEQ ID NO: 2206939 - DNA, 16 bp, Homo sapiens
aaccccaagttagttc

SEQ ID NO: 2206940 - DNA, 19 bp, Homo sapiens
aacgtgatttttaaattaa

SEQ ID NO: 2206941 - DNA, 14 bp, Homo sapiens
aactgataaagatg

SEQ ID NO: 2206942 - DNA, 17 bp, Homo sapiens
aactgcttgtttcctag

SEQ ID NO: 2206943 - DNA, 16 bp, Homo sapiens
aactgggctgaacact

SEQ ID NO: 2206944 - DNA, 16 bp, Homo sapiens
aactgttatttataat

SEQ ID NO: 2206945 - DNA, 22 bp, Homo sapiens
aactgttatttataatcacttt

SEQ ID NO: 2206946 - DNA, 15 bp, Homo sapiens
aacttaatctaaatg

SEQ ID NO: 2206947 - DNA, 13 bp, Homo sapiens
aacttcacatatt

SEQ ID NO: 2206948 - DNA, 22 bp, Homo sapiens
aacttcacatattgatttccgt

SEQ ID NO: 2206949 - DNA, 21 bp, Homo sapiens
aactttaccttttttatacat

SEQ ID NO: 2206950 - DNA, 13 bp, Homo sapiens
aactttgacctct

SEQ ID NO: 2206951 - DNA, 19 bp, Homo sapiens
aactttgacctctgcagca

SEQ ID NO: 2206952 - DNA, 12 bp, Homo sapiens
aacttttataaa

SEQ ID NO: 2206953 - DNA, 15 bp, Homo sapiens
aacttttataaactt

SEQ ID NO: 2206954 - DNA, 19 bp, Homo sapiens
aacttttataaactttacc

SEQ ID NO: 2206955 - DNA, 17 bp, Homo sapiens
aagaaaaaggatgcaca

SEQ ID NO: 2206956 - DNA, 22 bp, Homo sapiens
aagaaaaaggatgcacagagtt

SEQ ID NO: 2206957 - DNA, 22 bp, Homo sapiens
aagactgagtacgttgtgcatt

SEQ ID NO: 2206958 - DNA, 16 bp, Homo sapiens
aagaggtttttcttaa

SEQ ID NO: 2206959 - DNA, 17 bp, Homo sapiens
aagatacagttactcag

SEQ ID NO: 2206960 - DNA, 23 bp, Homo sapiens
aagatatgtaacaacaattattt

SEQ ID NO: 2206961 - DNA, 21 bp, Homo sapiens
aagcagcgtttctatgacaca

SEQ ID NO: 2206962 - DNA, 22 bp, Homo sapiens
aagcagcgtttctatgacacat

SEQ ID NO: 2206963 - DNA, 19 bp, Homo sapiens
aagcattttataaatcgct

SEQ ID NO: 2206964 - DNA, 20 bp, Homo sapiens
aaggaaactgggttcctgca

SEQ ID NO: 2206965 - DNA, 16 bp, Homo sapiens
aaggaaggttctggtg

SEQ ID NO: 2206966 - DNA, 14 bp, Homo sapiens
aaggagatttacaa

SEQ ID NO: 2206967 - DNA, 18 bp, Homo sapiens
aaggagatttacaactgg

SEQ ID NO: 2206968 - DNA, 22 bp, Homo sapiens
aaggatgcacagagttgttaca

SEQ ID NO: 2206969 - DNA, 16 bp, Homo sapiens
aaggattttatgcttt

SEQ ID NO: 2206970 - DNA, 23 bp, Homo sapiens
aaggattttatgctttaaacatt

SEQ ID NO: 2206971 - DNA, 20 bp, Homo sapiens
aaggcaggggaatgtatgtg

SEQ ID NO: 2206972 - DNA, 13 bp, Homo sapiens
aaggctacctttg

SEQ ID NO: 2206973 - DNA, 17 bp, Homo sapiens
aaggggcagtggtggtt

SEQ ID NO: 2206974 - DNA, 12 bp, Homo sapiens
aaggtcattttt

SEQ ID NO: 2206975 - DNA, 12 bp, Homo sapiens
aagtaatatgca

SEQ ID NO: 2206976 - DNA, 15 bp, Homo sapiens
aagtaatatgcacac

SEQ ID NO: 2206977 - DNA, 17 bp, Homo sapiens
aagtaatatgcacacat

SEQ ID NO: 2206978 - DNA, 20 bp, Homo sapiens
aagtaatatgcacacatttt

SEQ ID NO: 2206979 - DNA, 21 bp, Homo sapiens
aagtaatatgcacacattttt

SEQ ID NO: 2206980 - DNA, 16 bp, Homo sapiens
aagtatccctactgta

SEQ ID NO: 2206981 - DNA, 23 bp, Homo sapiens
aagtatccctactgtaatttgtg

SEQ ID NO: 2206982 - DNA, 16 bp, Homo sapiens
aagtctgttttatgac

SEQ ID NO: 2206983 - DNA, 20 bp, Homo sapiens
aagtctgttttatgacttca

SEQ ID NO: 2206984 - DNA, 14 bp, Homo sapiens
aagtcttctattta

SEQ ID NO: 2206985 - DNA, 17 bp, Homo sapiens
aagtcttctatttattt

SEQ ID NO: 2206986 - DNA, 14 bp, Homo sapiens
aagtgctgcattta

SEQ ID NO: 2206987 - DNA, 22 bp, Homo sapiens
aagtgctgcatttaaaagatac

SEQ ID NO: 2206988 - DNA, 21 bp, Homo sapiens
aagtgtatttttttactaata

SEQ ID NO: 2206989 - DNA, 23 bp, Homo sapiens
aagtgtatttttttactaataga

SEQ ID NO: 2206990 - DNA, 21 bp, Homo sapiens
aagttgtttgagaaattaagt

SEQ ID NO: 2206991 - DNA, 15 bp, Homo sapiens
aataaaactttttaa

SEQ ID NO: 2206992 - DNA, 19 bp, Homo sapiens
aataaagatcatgtaaaag

SEQ ID NO: 2206993 - DNA, 17 bp, Homo sapiens
aataaggttatgattga

SEQ ID NO: 2206994 - DNA, 17 bp, Homo sapiens
aataatgtgaaactgga

SEQ ID NO: 2206995 - DNA, 22 bp, Homo sapiens
aataatgtgaaactggattaaa

SEQ ID NO: 2206996 - DNA, 18 bp, Homo sapiens
aatacaccactacattct

SEQ ID NO: 2206997 - DNA, 13 bp, Homo sapiens
aatataaaaataa

SEQ ID NO: 2206998 - DNA, 19 bp, Homo sapiens
aatatagctttcataacat

SEQ ID NO: 2206999 - DNA, 21 bp, Homo sapiens
aatataggaacttaaataatg

SEQ ID NO: 2207000 - DNA, 21 bp, Homo sapiens
aatatcccttggacattttat

SEQ ID NO: 2207001 - DNA, 22 bp, Homo sapiens
aatatcccttggacattttatg

SEQ ID NO: 2207002 - DNA, 13 bp, Homo sapiens
aatctaaatggaa

SEQ ID NO: 2207003 - DNA, 15 bp, Homo sapiens
aatctaaatggaacc

SEQ ID NO: 2207004 - DNA, 18 bp, Homo sapiens
aatctaaatggaaccact

SEQ ID NO: 2207005 - DNA, 16 bp, Homo sapiens
aatctcaaatttctaa

SEQ ID NO: 2207006 - DNA, 18 bp, Homo sapiens
aatctcaaatttctaaat

SEQ ID NO: 2207007 - DNA, 19 bp, Homo sapiens
aatctggattcatatttaa

SEQ ID NO: 2207008 - DNA, 13 bp, Homo sapiens
aatgaaatactgt

SEQ ID NO: 2207009 - DNA, 14 bp, Homo sapiens
aatgacttactgta

SEQ ID NO: 2207010 - DNA, 18 bp, Homo sapiens
aatgacttactgtacatg

SEQ ID NO: 2207011 - DNA, 12 bp, Homo sapiens
aatgataatgct

SEQ ID NO: 2207012 - DNA, 23 bp, Homo sapiens
aatgccttaccctcatgttctta

SEQ ID NO: 2207013 - DNA, 21 bp, Homo sapiens
aatgcgtgcataccacttttg

SEQ ID NO: 2207014 - DNA, 23 bp, Homo sapiens
aatgcgtgcataccacttttgtt

SEQ ID NO: 2207015 - DNA, 14 bp, Homo sapiens
aatggaaccactct

SEQ ID NO: 2207016 - DNA, 13 bp, Homo sapiens
aatgtatgtgtgt

SEQ ID NO: 2207017 - DNA, 12 bp, Homo sapiens
aattaactttta

SEQ ID NO: 2207018 - DNA, 15 bp, Homo sapiens
aattaacttttataa

SEQ ID NO: 2207019 - DNA, 20 bp, Homo sapiens
aattaaggattttatgcttt

SEQ ID NO: 2207020 - DNA, 15 bp, Homo sapiens
cagcagaaatgcctt

SEQ ID NO: 2207021 - DNA, 17 bp, Homo sapiens
cagcagaaatgccttac

SEQ ID NO: 2207022 - DNA, 19 bp, Homo sapiens
cagcagaaatgccttaccc

SEQ ID NO: 2207023 - DNA, 14 bp, Homo sapiens
cagcgtttctatga

SEQ ID NO: 2207024 - DNA, 13 bp, Homo sapiens
caggatttaagtt

SEQ ID NO: 2207025 - DNA, 18 bp, Homo sapiens
cagtaaatgggggtgcat

SEQ ID NO: 2207026 - DNA, 19 bp, Homo sapiens
cagtaaatgggggtgcatt

SEQ ID NO: 2207027 - DNA, 17 bp, Homo sapiens
cagtattgaagcatttt

SEQ ID NO: 2207028 - DNA, 20 bp, Homo sapiens
cagtgtgtggtcaacatttc

SEQ ID NO: 2207029 - DNA, 19 bp, Homo sapiens
cagtgttgtggatttaaca

SEQ ID NO: 2207030 - DNA, 20 bp, Homo sapiens
cagttactcagaattctcta

SEQ ID NO: 2207031 - DNA, 13 bp, Homo sapiens
cagttgttattta

SEQ ID NO: 2207032 - DNA, 17 bp, Homo sapiens
cagttgttatttattga

SEQ ID NO: 2207033 - DNA, 19 bp, Homo sapiens
cagttttggttgctttaat

SEQ ID NO: 2207034 - DNA, 21 bp, Homo sapiens
cataatgcgtgcataccactt

SEQ ID NO: 2207035 - DNA, 13 bp, Homo sapiens
cataccacttttg

SEQ ID NO: 2207036 - DNA, 15 bp, Homo sapiens
cataccacttttgtt

SEQ ID NO: 2207037 - DNA, 18 bp, Homo sapiens
cataccacttttgttctt

SEQ ID NO: 2207038 - DNA, 19 bp, Homo sapiens
cataccacttttgttcttg

SEQ ID NO: 2207039 - DNA, 15 bp, Homo sapiens
catacgtacacattt

SEQ ID NO: 2207040 - DNA, 16 bp, Homo sapiens
cataggtgatctcatt

SEQ ID NO: 2207041 - DNA, 13 bp, Homo sapiens
catatcacatgtc

SEQ ID NO: 2207042 - DNA, 17 bp, Homo sapiens
catattaccacagacat

SEQ ID NO: 2207043 - DNA, 16 bp, Homo sapiens
catatttaacaaaatt

SEQ ID NO: 2207044 - DNA, 22 bp, Homo sapiens
catatttaacaaaatttgaata

SEQ ID NO: 2207045 - DNA, 21 bp, Homo sapiens
catcacagttttggttgcttt

SEQ ID NO: 2207046 - DNA, 22 bp, Homo sapiens
catcacagttttggttgcttta

SEQ ID NO: 2207047 - DNA, 15 bp, Homo sapiens
catctctgcaatctt

SEQ ID NO: 2207048 - DNA, 22 bp, Homo sapiens
catctctgcaatcttctcagaa

SEQ ID NO: 2207049 - DNA, 19 bp, Homo sapiens
catgaaaacacatttttct

SEQ ID NO: 2207050 - DNA, 22 bp, Homo sapiens
catgaagtaatatgcacacatt

SEQ ID NO: 2207051 - DNA, 12 bp, Homo sapiens
catgcaaggtca

SEQ ID NO: 2207052 - DNA, 15 bp, Homo sapiens
catgcaaggtcattt

SEQ ID NO: 2207053 - DNA, 13 bp, Homo sapiens
catgcccctgaac

SEQ ID NO: 2207054 - DNA, 16 bp, Homo sapiens
catggccctgccatgc

SEQ ID NO: 2207055 - DNA, 16 bp, Homo sapiens
catggtcggaaaacat

SEQ ID NO: 2207056 - DNA, 17 bp, Homo sapiens
catgtatgtaaatagct

SEQ ID NO: 2207057 - DNA, 18 bp, Homo sapiens
catgtcagccactgtgat

SEQ ID NO: 2207058 - DNA, 18 bp, Homo sapiens
catgttcttaattcttag

SEQ ID NO: 2207059 - DNA, 12 bp, Homo sapiens
catgtttgtgat

SEQ ID NO: 2207060 - DNA, 15 bp, Homo sapiens
catgtttgtgattga

SEQ ID NO: 2207061 - DNA, 22 bp, Homo sapiens
cattaggtgtgactgaatttct

SEQ ID NO: 2207062 - DNA, 16 bp, Homo sapiens
cattatatttattgtt

SEQ ID NO: 2207063 - DNA, 12 bp, Homo sapiens
cattatctagat

SEQ ID NO: 2207064 - DNA, 12 bp, Homo sapiens
catttaaaagat

SEQ ID NO: 2207065 - DNA, 19 bp, Homo sapiens
catttctcatgttgaagct

SEQ ID NO: 2207066 - DNA, 22 bp, Homo sapiens
catttgaaaattttgatgtttt

SEQ ID NO: 2207067 - DNA, 16 bp, Homo sapiens
catttgttaatatttc

SEQ ID NO: 2207068 - DNA, 19 bp, Homo sapiens
catttgttaatatttcttc

SEQ ID NO: 2207069 - DNA, 17 bp, Homo sapiens
catttgtttgaactgat

SEQ ID NO: 2207070 - DNA, 13 bp, Homo sapiens
cattttataaatc

SEQ ID NO: 2207071 - DNA, 17 bp, Homo sapiens
cattttataaatcgctt

SEQ ID NO: 2207072 - DNA, 20 bp, Homo sapiens
cattttatgtctttcttgta

SEQ ID NO: 2207073 - DNA, 19 bp, Homo sapiens
cattttattttattatgca

SEQ ID NO: 2207074 - DNA, 15 bp, Homo sapiens
cattttttaaatgca

SEQ ID NO: 2207075 - DNA, 23 bp, Homo sapiens
cattttttttaagaaaaaggatg

SEQ ID NO: 2207076 - DNA, 11 bp, Homo sapiens
ccaaaccactt

SEQ ID NO: 2207077 - DNA, 17 bp, Homo sapiens
ccaaacctctgtgagca

SEQ ID NO: 2207078 - DNA, 13 bp, Homo sapiens
ccaattaaggatt

SEQ ID NO: 2207079 - DNA, 18 bp, Homo sapiens
ccaattaaggattttatg

SEQ ID NO: 2207080 - DNA, 11 bp, Homo sapiens
ccactacattc

SEQ ID NO: 2207081 - DNA, 15 bp, Homo sapiens
ccactacattctgtt

SEQ ID NO: 2207082 - DNA, 16 bp, Homo sapiens
ccactacattctgtta

SEQ ID NO: 2207083 - DNA, 17 bp, Homo sapiens
ccactacattctgttaa

SEQ ID NO: 2207084 - DNA, 15 bp, Homo sapiens
ccacttttgttcttg

SEQ ID NO: 2207085 - DNA, 16 bp, Homo sapiens
ccactttttgcagctt

SEQ ID NO: 2207086 - DNA, 17 bp, Homo sapiens
ccactttttgcagcttt

SEQ ID NO: 2207087 - DNA, 22 bp, Homo sapiens
ccagaagaaaatagtggtgtga

SEQ ID NO: 2207088 - DNA, 22 bp, Homo sapiens
ccagcagaaatgccttaccctc

SEQ ID NO: 2207089 - DNA, 22 bp, Homo sapiens
ccagtaaatgggggtgcatttg

SEQ ID NO: 2207090 - DNA, 17 bp, Homo sapiens
ccagtgagatcaatgtg

SEQ ID NO: 2207091 - DNA, 20 bp, Homo sapiens
ccatggtcggaaaacatgct

SEQ ID NO: 2207092 - DNA, 17 bp, Homo sapiens
cccagacgatgtcttca

SEQ ID NO: 2207093 - DNA, 17 bp, Homo sapiens
ccctaaagtgtattttt

SEQ ID NO: 2207094 - DNA, 13 bp, Homo sapiens
ccctgctgctgcc

SEQ ID NO: 2207095 - DNA, 16 bp, Homo sapiens
ccctgctgctgcctgc

SEQ ID NO: 2207096 - DNA, 18 bp, Homo sapiens
ccctgctgctgcctgcct

SEQ ID NO: 2207097 - DNA, 14 bp, Homo sapiens
cccttggacatttt

SEQ ID NO: 2207098 - DNA, 15 bp, Homo sapiens
cccttggacatttta

SEQ ID NO: 2207099 - DNA, 14 bp, Homo sapiens
cctaaagtgtattt

SEQ ID NO: 2207100 - DNA, 12 bp, Homo sapiens
cctaatgtgttt

SEQ ID NO: 2207101 - DNA, 19 bp, Homo sapiens
cctactgtaatttgtgata

SEQ ID NO: 2207102 - DNA, 13 bp, Homo sapiens
cctcatgttctta

SEQ ID NO: 2207103 - DNA, 14 bp, Homo sapiens
cctctgcagcaata

SEQ ID NO: 2207104 - DNA, 18 bp, Homo sapiens
cctctgcagcaataaagc

SEQ ID NO: 2207105 - DNA, 19 bp, Homo sapiens
cctctgcagcaataaagca

SEQ ID NO: 2207106 - DNA, 16 bp, Homo sapiens
cctgccacctcctgcc

SEQ ID NO: 2207107 - DNA, 18 bp, Homo sapiens
cctggaatatataaccag

SEQ ID NO: 2207108 - DNA, 20 bp, Homo sapiens
cctggattgcgcctaatgtg

SEQ ID NO: 2207109 - DNA, 23 bp, Homo sapiens
cctggattgcgcctaatgtgttt

SEQ ID NO: 2207110 - DNA, 15 bp, Homo sapiens
cctggcctttcatat

SEQ ID NO: 2207111 - DNA, 10 bp, Homo sapiens
cctgtacctc

SEQ ID NO: 2207112 - DNA, 12 bp, Homo sapiens
ccttaaaggaag

SEQ ID NO: 2207113 - DNA, 15 bp, Homo sapiens
ccttaccctcatgtt

SEQ ID NO: 2207114 - DNA, 13 bp, Homo sapiens
ccttgtttaatgg

SEQ ID NO: 2207115 - DNA, 12 bp, Homo sapiens
cctttcatattt

SEQ ID NO: 2207116 - DNA, 18 bp, Homo sapiens
cctttgtattctctcctg

SEQ ID NO: 2207117 - DNA, 23 bp, Homo sapiens
cctttgtattctctcctgtacct

SEQ ID NO: 2207118 - DNA, 17 bp, Homo sapiens
cgatatttattgatgtt

SEQ ID NO: 2207119 - DNA, 20 bp, Homo sapiens
cggaaaacatgctacacact

SEQ ID NO: 2207120 - DNA, 13 bp, Homo sapiens
cgtacacatttta

SEQ ID NO: 2207121 - DNA, 19 bp, Homo sapiens
cgtgcataccacttttgtt

SEQ ID NO: 2207122 - DNA, 20 bp, Homo sapiens
cgtttctatgacacatgcaa

SEQ ID NO: 2207123 - DNA, 23 bp, Homo sapiens
ctaaacatgtatgtaaatagcta

SEQ ID NO: 2207124 - DNA, 20 bp, Homo sapiens
ctaaatctccaaaataaaac

SEQ ID NO: 2207125 - DNA, 16 bp, Homo sapiens
ctaaatggaaccactc

SEQ ID NO: 2207126 - DNA, 17 bp, Homo sapiens
ctaaatggaaccactct

SEQ ID NO: 2207127 - DNA, 15 bp, Homo sapiens
ctaacttcaccatat

SEQ ID NO: 2207128 - DNA, 14 bp, Homo sapiens
ctaagtttttatgg

SEQ ID NO: 2207129 - DNA, 20 bp, Homo sapiens
ctaagtttttatggcttttg

SEQ ID NO: 2207130 - DNA, 19 bp, Homo sapiens
ctaatagacaatttattat

SEQ ID NO: 2207131 - DNA, 13 bp, Homo sapiens
ctacaattgtaaa

SEQ ID NO: 2207132 - DNA, 18 bp, Homo sapiens
ctacaattgtaaactagt

SEQ ID NO: 2207133 - DNA, 14 bp, Homo sapiens
ctacattctgttaa

SEQ ID NO: 2207134 - DNA, 13 bp, Homo sapiens
ctagatactgtat

SEQ ID NO: 2207135 - DNA, 16 bp, Homo sapiens
ctagatactgtatcat

SEQ ID NO: 2207136 - DNA, 20 bp, Homo sapiens
ctagtcatttgttaatattt

SEQ ID NO: 2207137 - DNA, 21 bp, Homo sapiens
ctagtttgattaaattcttgc

SEQ ID NO: 2207138 - DNA, 18 bp, Homo sapiens
ctatatatgtgatgatct

SEQ ID NO: 2207139 - DNA, 11 bp, Homo sapiens
ctatgcatttg

SEQ ID NO: 2207140 - DNA, 15 bp, Homo sapiens
ctatgttaatatttt

SEQ ID NO: 2207141 - DNA, 12 bp, Homo sapiens
ctatttatttat

SEQ ID NO: 2207142 - DNA, 19 bp, Homo sapiens
ctatttatttatttattca

SEQ ID NO: 2207143 - DNA, 14 bp, Homo sapiens
ctcaaatttctaaa

SEQ ID NO: 2207144 - DNA, 17 bp, Homo sapiens
ctcaaatttctaaatct

SEQ ID NO: 2207145 - DNA, 14 bp, Homo sapiens
ctcatgttgaagct

SEQ ID NO: 2207146 - DNA, 18 bp, Homo sapiens
ctcattctccttgtgtta

SEQ ID NO: 2207147 - DNA, 13 bp, Homo sapiens
ctccaaaccactt

SEQ ID NO: 2207148 - DNA, 20 bp, Homo sapiens
ctccaattaaggattttatg

SEQ ID NO: 2207149 - DNA, 22 bp, Homo sapiens
ctccaattaaggattttatgct

SEQ ID NO: 2207150 - DNA, 16 bp, Homo sapiens
ctcctgtacctcttga

SEQ ID NO: 2207151 - DNA, 14 bp, Homo sapiens
ctctagtcatttgt

SEQ ID NO: 2207152 - DNA, 18 bp, Homo sapiens
ctctagtcatttgttaat

SEQ ID NO: 2207153 - DNA, 20 bp, Homo sapiens
ctctcaaccacctttcagat

SEQ ID NO: 2207154 - DNA, 19 bp, Homo sapiens
ctctcagttgcagccctgc

SEQ ID NO: 2207155 - DNA, 15 bp, Homo sapiens
ctctcctgtacctct

SEQ ID NO: 2207156 - DNA, 18 bp, Homo sapiens
ctctcctgtacctcttga

SEQ ID NO: 2207157 - DNA, 13 bp, Homo sapiens
ctctgcagcaata

SEQ ID NO: 2207158 - DNA, 10 bp, Homo sapiens
tcagaaatgt

SEQ ID NO: 2207159 - DNA, 15 bp, Homo sapiens
tcagataactgttat

SEQ ID NO: 2207160 - DNA, 16 bp, Homo sapiens
tcagatctctaacttc

SEQ ID NO: 2207161 - DNA, 14 bp, Homo sapiens
tcagtattgaagca

SEQ ID NO: 2207162 - DNA, 16 bp, Homo sapiens
tcagtattgaagcatt

SEQ ID NO: 2207163 - DNA, 18 bp, Homo sapiens
tcagtattgaagcatttt

SEQ ID NO: 2207164 - DNA, 12 bp, Homo sapiens
tcagttgcagcc

SEQ ID NO: 2207165 - DNA, 15 bp, Homo sapiens
tcagttgttatttat

SEQ ID NO: 2207166 - DNA, 14 bp, Homo sapiens
tcatcagtattgaa

SEQ ID NO: 2207167 - DNA, 23 bp, Homo sapiens
tcatcagtattgaagcattttat

SEQ ID NO: 2207168 - DNA, 19 bp, Homo sapiens
tcatgacaaagactgagta

SEQ ID NO: 2207169 - DNA, 17 bp, Homo sapiens
tcatgttcttaattctt

SEQ ID NO: 2207170 - DNA, 20 bp, Homo sapiens
tcatgttgaagctttaagaa

SEQ ID NO: 2207171 - DNA, 18 bp, Homo sapiens
tcattaggtgtgactgaa

SEQ ID NO: 2207172 - DNA, 21 bp, Homo sapiens
tcattctttttgaaatgtcaa

SEQ ID NO: 2207173 - DNA, 22 bp, Homo sapiens
tccaaaccactttttgcagctt

SEQ ID NO: 2207174 - DNA, 15 bp, Homo sapiens
tccagtcattatgtt

SEQ ID NO: 2207175 - DNA, 21 bp, Homo sapiens
tccagtcattatgttaatatt

SEQ ID NO: 2207176 - DNA, 18 bp, Homo sapiens
tcccattatatttattgt

SEQ ID NO: 2207177 - DNA, 15 bp, Homo sapiens
tccctactgtaattt

SEQ ID NO: 2207178 - DNA, 15 bp, Homo sapiens
tcccttggacatttt

SEQ ID NO: 2207179 - DNA, 18 bp, Homo sapiens
tcctctcaaccacctttc

SEQ ID NO: 2207180 - DNA, 20 bp, Homo sapiens
tcctgcaatgaagtctctga

SEQ ID NO: 2207181 - DNA, 22 bp, Homo sapiens
tcctgtacctcttgagccttga

SEQ ID NO: 2207182 - DNA, 14 bp, Homo sapiens
tccttgtgttacta

SEQ ID NO: 2207183 - DNA, 15 bp, Homo sapiens
tcggaaaacatgcta

SEQ ID NO: 2207184 - DNA, 13 bp, Homo sapiens
tctaaaggctacc

SEQ ID NO: 2207185 - DNA, 22 bp, Homo sapiens
tctaaatatcccttggacattt

SEQ ID NO: 2207186 - DNA, 15 bp, Homo sapiens
tctaacttcaccata

SEQ ID NO: 2207187 - DNA, 22 bp, Homo sapiens
tctaacttcaccatattaccac

SEQ ID NO: 2207188 - DNA, 22 bp, Homo sapiens
tctaccagcctccctatttttt

SEQ ID NO: 2207189 - DNA, 14 bp, Homo sapiens
tctagtcatttgtt

SEQ ID NO: 2207190 - DNA, 15 bp, Homo sapiens
tctatcaagtattat

SEQ ID NO: 2207191 - DNA, 13 bp, Homo sapiens
tctatttatttat

SEQ ID NO: 2207192 - DNA, 13 bp, Homo sapiens
tctcaaatttcta

SEQ ID NO: 2207193 - DNA, 17 bp, Homo sapiens
tctcaaccacctttcag

SEQ ID NO: 2207194 - DNA, 21 bp, Homo sapiens
tctcagaaggcaaatgacttt

SEQ ID NO: 2207195 - DNA, 16 bp, Homo sapiens
tctcatttaatcctct

SEQ ID NO: 2207196 - DNA, 19 bp, Homo sapiens
tctccaaaataaaactttt

SEQ ID NO: 2207197 - DNA, 14 bp, Homo sapiens
tctccaaaccactt

SEQ ID NO: 2207198 - DNA, 18 bp, Homo sapiens
tctccagcctcagctctc

SEQ ID NO: 2207199 - DNA, 16 bp, Homo sapiens
tctccatggccctgcc

SEQ ID NO: 2207200 - DNA, 17 bp, Homo sapiens
tctccatggccctgcca

SEQ ID NO: 2207201 - DNA, 13 bp, Homo sapiens
tctccttgtgtta

SEQ ID NO: 2207202 - DNA, 19 bp, Homo sapiens
tctctaacttcaccatatt

SEQ ID NO: 2207203 - DNA, 16 bp, Homo sapiens
tctctagtttgattaa

SEQ ID NO: 2207204 - DNA, 17 bp, Homo sapiens
tctctcctgtacctctt

SEQ ID NO: 2207205 - DNA, 14 bp, Homo sapiens
tctgacatctctgc

SEQ ID NO: 2207206 - DNA, 14 bp, Homo sapiens
tctgcaatcttctc

SEQ ID NO: 2207207 - DNA, 15 bp, Homo sapiens
tctggattcatattt

SEQ ID NO: 2207208 - DNA, 14 bp, Homo sapiens
tctggctatgcatt

SEQ ID NO: 2207209 - DNA, 17 bp, Homo sapiens
tctggctatgcatttga

SEQ ID NO: 2207210 - DNA, 19 bp, Homo sapiens
tctggctatgcatttgaaa

SEQ ID NO: 2207211 - DNA, 15 bp, Homo sapiens
tctgttatataaatg

SEQ ID NO: 2207212 - DNA, 18 bp, Homo sapiens
tctgttatataaatggtt

SEQ ID NO: 2207213 - DNA, 15 bp, Homo sapiens
tctgttttatgactt

SEQ ID NO: 2207214 - DNA, 16 bp, Homo sapiens
tctgttttatgacttc

SEQ ID NO: 2207215 - DNA, 14 bp, Homo sapiens
tcttcagatctcta

SEQ ID NO: 2207216 - DNA, 13 bp, Homo sapiens
tcttctatttatt

SEQ ID NO: 2207217 - DNA, 22 bp, Homo sapiens
tcttctatttatttatttattc

SEQ ID NO: 2207218 - DNA, 23 bp, Homo sapiens
tcttctcagaaggcaaatgactt

SEQ ID NO: 2207219 - DNA, 16 bp, Homo sapiens
tcttgagccttgaact

SEQ ID NO: 2207220 - DNA, 20 bp, Homo sapiens
tcttgagccttgaactttga

SEQ ID NO: 2207221 - DNA, 14 bp, Homo sapiens
tcttgtattaagaa

SEQ ID NO: 2207222 - DNA, 22 bp, Homo sapiens
tcttgtattaagaatgaaatac

SEQ ID NO: 2207223 - DNA, 17 bp, Homo sapiens
tctttccaaagtacact

SEQ ID NO: 2207224 - DNA, 21 bp, Homo sapiens
tctttctggctatgcatttga

SEQ ID NO: 2207225 - DNA, 12 bp, Homo sapiens
tgaaaacacatt

SEQ ID NO: 2207226 - DNA, 15 bp, Homo sapiens
tgaaaacacattttt

SEQ ID NO: 2207227 - DNA, 17 bp, Homo sapiens
tgaaaacacatttttct

SEQ ID NO: 2207228 - DNA, 13 bp, Homo sapiens
tgaaaattttgat

SEQ ID NO: 2207229 - DNA, 18 bp, Homo sapiens
tgaaactgcttgtttcct

SEQ ID NO: 2207230 - DNA, 17 bp, Homo sapiens
tgaaactggattaaact

SEQ ID NO: 2207231 - DNA, 13 bp, Homo sapiens
tgaaatgtcaacc

SEQ ID NO: 2207232 - DNA, 23 bp, Homo sapiens
tgaacactccaattaaggatttt

SEQ ID NO: 2207233 - DNA, 11 bp, Homo sapiens
tgaactttgac

SEQ ID NO: 2207234 - DNA, 17 bp, Homo sapiens
tgaactttgacctctgc

SEQ ID NO: 2207235 - DNA, 20 bp, Homo sapiens
tgaactttgacctctgcagc

SEQ ID NO: 2207236 - DNA, 22 bp, Homo sapiens
tgaactttgacctctgcagcaa

SEQ ID NO: 2207237 - DNA, 13 bp, Homo sapiens
tgaagacaatgac

SEQ ID NO: 2207238 - DNA, 17 bp, Homo sapiens
tgaagacaatgacttac

SEQ ID NO: 2207239 - DNA, 14 bp, Homo sapiens
tgaagcattttata

SEQ ID NO: 2207240 - DNA, 16 bp, Homo sapiens
tgaagcattttataaa

SEQ ID NO: 2207241 - DNA, 19 bp, Homo sapiens
tgaaggtagaatgttttca

SEQ ID NO: 2207242 - DNA, 21 bp, Homo sapiens
tgaagtaatatgcacacattt

SEQ ID NO: 2207243 - DNA, 17 bp, Homo sapiens
tgaatgtcagttgttat

SEQ ID NO: 2207244 - DNA, 14 bp, Homo sapiens
tgacatctctgcaa

SEQ ID NO: 2207245 - DNA, 18 bp, Homo sapiens
tgacctctgcagcaataa

SEQ ID NO: 2207246 - DNA, 15 bp, Homo sapiens
tgagatcaatgtgac

SEQ ID NO: 2207247 - DNA, 17 bp, Homo sapiens
tgagccttgaactttga

SEQ ID NO: 2207248 - DNA, 19 bp, Homo sapiens
tgagccttgaactttgacc

SEQ ID NO: 2207249 - DNA, 20 bp, Homo sapiens
tgaggcatttgtttgaactg

SEQ ID NO: 2207250 - DNA, 20 bp, Homo sapiens
tgaggtctgttctttccaaa

SEQ ID NO: 2207251 - DNA, 19 bp, Homo sapiens
tgagtacgttgtgcatttg

SEQ ID NO: 2207252 - DNA, 18 bp, Homo sapiens
tgatacaatgctgtgccc

SEQ ID NO: 2207253 - DNA, 19 bp, Homo sapiens
tgatgccaagttgtttgag

SEQ ID NO: 2207254 - DNA, 18 bp, Homo sapiens
tgatgttttaaggatgct

SEQ ID NO: 2207255 - DNA, 21 bp, Homo sapiens
tgatgttttaaggatgcttgt

SEQ ID NO: 2207256 - DNA, 13 bp, Homo sapiens
tgattaaattctt

SEQ ID NO: 2207257 - DNA, 20 bp, Homo sapiens
tgattcatatttaatttgaa

SEQ ID NO: 2207258 - DNA, 17 bp, Homo sapiens
tgatttggggatatttt

SEQ ID NO: 2207259 - DNA, 15 bp, Homo sapiens
tgcaatgaagtctct

SEQ ID NO: 2207260 - DNA, 15 bp, Homo sapiens
tgcacacatttttta

SEQ ID NO: 2207261 - DNA, 21 bp, Homo sapiens
tgcacactctcccattatatt

SEQ ID NO: 2207262 - DNA, 22 bp, Homo sapiens
tgcacactctcccattatattt

SEQ ID NO: 2207263 - DNA, 21 bp, Homo sapiens
tgcacagagttgttacatttt

SEQ ID NO: 2207264 - DNA, 13 bp, Homo sapiens
tgcacatctgttt

SEQ ID NO: 2207265 - DNA, 23 bp, Homo sapiens
tgcagcaataaagcagcgtttct

SEQ ID NO: 2207266 - DNA, 19 bp, Homo sapiens
tgcagtgtttccctctgtg

SEQ ID NO: 2207267 - DNA, 18 bp, Homo sapiens
tgcataccacttttgttc

SEQ ID NO: 2207268 - DNA, 22 bp, Homo sapiens
tgcataccacttttgttcttgg

SEQ ID NO: 2207269 - DNA, 21 bp, Homo sapiens
tgcattatctagatactgtat

SEQ ID NO: 2207270 - DNA, 22 bp, Homo sapiens
tgcattatctagatactgtatc

SEQ ID NO: 2207271 - DNA, 16 bp, Homo sapiens
tgcatttaaaagatac

SEQ ID NO: 2207272 - DNA, 19 bp, Homo sapiens
tgcatttgaggtctgttct

SEQ ID NO: 2207273 - DNA, 14 bp, Homo sapiens
tgccacctcctgcc

SEQ ID NO: 2207274 - DNA, 17 bp, Homo sapiens
tgccctaaagtgtattt

SEQ ID NO: 2207275 - DNA, 20 bp, Homo sapiens
tgccctaaagtgtatttttt

SEQ ID NO: 2207276 - DNA, 21 bp, Homo sapiens
tgccttaccctcatgttctta

SEQ ID NO: 2207277 - DNA, 19 bp, Homo sapiens
tgccttgtttaatgttaat

SEQ ID NO: 2207278 - DNA, 13 bp, Homo sapiens
tgctgctgcctgc

SEQ ID NO: 2207279 - DNA, 19 bp, Homo sapiens
tgcttaacttcacatattg

SEQ ID NO: 2207280 - DNA, 12 bp, Homo sapiens
tgcttgtacata

SEQ ID NO: 2207281 - DNA, 14 bp, Homo sapiens
tgcttgtttcctag

SEQ ID NO: 2207282 - DNA, 12 bp, Homo sapiens
tgctttaaacat

SEQ ID NO: 2207283 - DNA, 13 bp, Homo sapiens
tgctttaatatca

SEQ ID NO: 2207284 - DNA, 16 bp, Homo sapiens
tgctttgtgatttttg

SEQ ID NO: 2207285 - DNA, 22 bp, Homo sapiens
tgctttgtgatttttgtaattt

SEQ ID NO: 2207286 - DNA, 15 bp, Homo sapiens
tggaatatataacca

SEQ ID NO: 2207287 - DNA, 14 bp, Homo sapiens
tggattcatattta

SEQ ID NO: 2207288 - DNA, 18 bp, Homo sapiens
tggattgcgcctaatgtg

SEQ ID NO: 2207289 - DNA, 19 bp, Homo sapiens
tggattgtgcctaatgtgt

SEQ ID NO: 2207290 - DNA, 20 bp, Homo sapiens
tggatttaacagaaatgtac

SEQ ID NO: 2207291 - DNA, 20 bp, Homo sapiens
tggcacatcagcacgatttc

SEQ ID NO: 2207292 - DNA, 21 bp, Homo sapiens
tggcacatcagcacgatttct

SEQ ID NO: 2207293 - DNA, 19 bp, Homo sapiens
tggccagtgagatcaatgt

SEQ ID NO: 2207294 - DNA, 15 bp, Homo sapiens
tggcttttgtgcatt

SEQ ID NO: 2207295 - DNA, 21 bp, Homo sapiens
aatgaaagtcttgtgactagt

SEQ ID NO: 2207296 - DNA, 20 bp, Homo sapiens
aatgaatactttataaagga

SEQ ID NO: 2207297 - DNA, 23 bp, Homo sapiens
aatgaatgtttacactctttgta

SEQ ID NO: 2207298 - DNA, 19 bp, Homo sapiens
aatgaccacacctgcctct

SEQ ID NO: 2207299 - DNA, 19 bp, Homo sapiens
aatgcagtctgtccaggct

SEQ ID NO: 2207300 - DNA, 20 bp, Homo sapiens
aatgcagtctgtccaggctc

SEQ ID NO: 2207301 - DNA, 15 bp, Homo sapiens
aatgttacattatta

SEQ ID NO: 2207302 - DNA, 16 bp, Homo sapiens
aatgttacattattat

SEQ ID NO: 2207303 - DNA, 21 bp, Homo sapiens
aatgttattttttaattatta

SEQ ID NO: 2207304 - DNA, 23 bp, Homo sapiens
aatgtttcttctaggttctaaaa

SEQ ID NO: 2207305 - DNA, 21 bp, Homo sapiens
aattaccttgagccagtaatt

SEQ ID NO: 2207306 - DNA, 16 bp, Homo sapiens
aattataatatactat

SEQ ID NO: 2207307 - DNA, 16 bp, Homo sapiens
aattattatttatata

SEQ ID NO: 2207308 - DNA, 20 bp, Homo sapiens
acaagaagccacagacctag

SEQ ID NO: 2207309 - DNA, 15 bp, Homo sapiens
acaagccagggtgtg

SEQ ID NO: 2207310 - DNA, 14 bp, Homo sapiens
acacatacctttgg

SEQ ID NO: 2207311 - DNA, 13 bp, Homo sapiens
acacgcaggagca

SEQ ID NO: 2207312 - DNA, 16 bp, Homo sapiens
acacgggcagcctggc

SEQ ID NO: 2207313 - DNA, 21 bp, Homo sapiens
acactgctgctccagtgcagg

SEQ ID NO: 2207314 - DNA, 20 bp, Homo sapiens
acactgggaggccagtgagc

SEQ ID NO: 2207315 - DNA, 13 bp, Homo sapiens
acaggcagagctg

SEQ ID NO: 2207316 - DNA, 17 bp, Homo sapiens
acagggcacctgccacc

SEQ ID NO: 2207317 - DNA, 15 bp, Homo sapiens
acagttcatatgtac

SEQ ID NO: 2207318 - DNA, 19 bp, Homo sapiens
acagttcggtgagctacaa

SEQ ID NO: 2207319 - DNA, 23 bp, Homo sapiens
acatatggactctgcacatgaat

SEQ ID NO: 2207320 - DNA, 14 bp, Homo sapiens
acatcaggagttca

SEQ ID NO: 2207321 - DNA, 13 bp, Homo sapiens
acatgaagaagct

SEQ ID NO: 2207322 - DNA, 16 bp, Homo sapiens
acatgaagaagctaaa

SEQ ID NO: 2207323 - DNA, 20 bp, Homo sapiens
acatggctctaaaaagtttt

SEQ ID NO: 2207324 - DNA, 21 bp, Homo sapiens
acatgtgacacatatgcacct

SEQ ID NO: 2207325 - DNA, 20 bp, Homo sapiens
acatgtgtagcctgtgcatg

SEQ ID NO: 2207326 - DNA, 15 bp, Homo sapiens
accataatgttacat

SEQ ID NO: 2207327 - DNA, 23 bp, Homo sapiens
accatgcgacactgggaggccag

SEQ ID NO: 2207328 - DNA, 19 bp, Homo sapiens
acccaagacctcagggcac

SEQ ID NO: 2207329 - DNA, 15 bp, Homo sapiens
acccacatgtgacac

SEQ ID NO: 2207330 - DNA, 21 bp, Homo sapiens
acccagacggctccactagga

SEQ ID NO: 2207331 - DNA, 22 bp, Homo sapiens
accccagcctggccacgcagcc

SEQ ID NO: 2207332 - DNA, 16 bp, Homo sapiens
accccgacgccacagc

SEQ ID NO: 2207333 - DNA, 13 bp, Homo sapiens
accctggagccca

SEQ ID NO: 2207334 - DNA, 15 bp, Homo sapiens
accctgggcctggca

SEQ ID NO: 2207335 - DNA, 17 bp, Homo sapiens
acctccaagccactgag

SEQ ID NO: 2207336 - DNA, 22 bp, Homo sapiens
acctgattaactgaggcatcca

SEQ ID NO: 2207337 - DNA, 23 bp, Homo sapiens
tgaatgaaagtcttgtgactagt

SEQ ID NO: 2207338 - DNA, 19 bp, Homo sapiens
tgaatgtttacactctttg

SEQ ID NO: 2207339 - DNA, 22 bp, Homo sapiens
tgaatgtttacactctttgtaa

SEQ ID NO: 2207340 - DNA, 22 bp, Homo sapiens
tgacacatatgcaccttgtgtc

SEQ ID NO: 2207341 - DNA, 17 bp, Homo sapiens
tgaccacacctgcctct

SEQ ID NO: 2207342 - DNA, 21 bp, Homo sapiens
tgaccccgacgccacagccca

SEQ ID NO: 2207343 - DNA, 22 bp, Homo sapiens
tgaccccgacgccacagcccag

SEQ ID NO: 2207344 - DNA, 15 bp, Homo sapiens
tgacctggtccacag

SEQ ID NO: 2207345 - DNA, 13 bp, Homo sapiens
tgactagtgctga

SEQ ID NO: 2207346 - DNA, 15 bp, Homo sapiens
tgactagtgctgaag

SEQ ID NO: 2207347 - DNA, 14 bp, Homo sapiens
tgagaccactgtta

SEQ ID NO: 2207348 - DNA, 13 bp, Homo sapiens
tgagctacaaatg

SEQ ID NO: 2207349 - DNA, 16 bp, Homo sapiens
tgagctacaaatgcat

SEQ ID NO: 2207350 - DNA, 23 bp, Homo sapiens
tgaggggtcgacttcgggctggc

SEQ ID NO: 2207351 - DNA, 22 bp, Homo sapiens
tgagtaactgatttgtaacaag

SEQ ID NO: 2207352 - DNA, 16 bp, Homo sapiens
tgagtcctagagctac

SEQ ID NO: 2207353 - DNA, 20 bp, Homo sapiens
tgatcaggacctccaagcca

SEQ ID NO: 2207354 - DNA, 18 bp, Homo sapiens
tgatccaagcaagactga

SEQ ID NO: 2207355 - DNA, 14 bp, Homo sapiens
tgatgccctgccct

SEQ ID NO: 2207356 - DNA, 15 bp, Homo sapiens
tgatttcattaatac

SEQ ID NO: 2207357 - DNA, 17 bp, Homo sapiens
tgatttcatttcaactg

SEQ ID NO: 2207358 - DNA, 13 bp, Homo sapiens
tgcaacaaaattc

SEQ ID NO: 2207359 - DNA, 19 bp, Homo sapiens
tgcacatatggactctgca

SEQ ID NO: 2207360 - DNA, 23 bp, Homo sapiens
tgcacatgtcttgtacatgtgta

SEQ ID NO: 2207361 - DNA, 11 bp, Homo sapiens
tgcagccagag

SEQ ID NO: 2207362 - DNA, 14 bp, Homo sapiens
tgcagccagaggca

SEQ ID NO: 2207363 - DNA, 15 bp, Homo sapiens
tgcatgtatgtcttg

SEQ ID NO: 2207364 - DNA, 15 bp, Homo sapiens
tgcattttttaaaac

SEQ ID NO: 2207365 - DNA, 18 bp, Homo sapiens
tgccaaatataaataaaa

SEQ ID NO: 2207366 - DNA, 16 bp, Homo sapiens
tgccctcaccacccac

SEQ ID NO: 2207367 - DNA, 16 bp, Homo sapiens
tgcctggcctggcaca

SEQ ID NO: 2207368 - DNA, 20 bp, Homo sapiens
tgcctggcctggcacacatc

SEQ ID NO: 2207369 - DNA, 16 bp, Homo sapiens
tgcgtggactctgcac

SEQ ID NO: 2207370 - DNA, 17 bp, Homo sapiens
tgcgtggactctgcaca

SEQ ID NO: 2207371 - DNA, 23 bp, Homo sapiens
tgctgaagcttattaatgctaag

SEQ ID NO: 2207372 - DNA, 13 bp, Homo sapiens
tggaaccaggctt

SEQ ID NO: 2207373 - DNA, 15 bp, Homo sapiens
tggaaccaggcttgg

SEQ ID NO: 2207374 - DNA, 22 bp, Homo sapiens
tggaataatcctaaacatatga

SEQ ID NO: 2207375 - DNA, 14 bp, Homo sapiens
tggaatgtaatcaa

SEQ ID NO: 2207376 - DNA, 14 bp, Homo sapiens
tggacactgtacaa

SEQ ID NO: 2207377 - DNA, 13 bp, Homo sapiens
tggactctgcaca

SEQ ID NO: 2207378 - DNA, 17 bp, Homo sapiens
tggactctgcacatgaa

SEQ ID NO: 2207379 - DNA, 17 bp, Homo sapiens
tggactctgcacatgtc

SEQ ID NO: 2207380 - DNA, 22 bp, Homo sapiens
tggactctgcacatgtcttgta

SEQ ID NO: 2207381 - DNA, 16 bp, Homo sapiens
tggagttcttgtgcca

SEQ ID NO: 2207382 - DNA, 14 bp, Homo sapiens
tggagttgaaaatc

SEQ ID NO: 2207383 - DNA, 13 bp, Homo sapiens
tggcactggatgc

SEQ ID NO: 2207384 - DNA, 16 bp, Homo sapiens
tggccacgcagccagg

SEQ ID NO: 2207385 - DNA, 17 bp, Homo sapiens
tggcccaggtgagtcct

SEQ ID NO: 2207386 - DNA, 22 bp, Homo sapiens
tggccgcacctaaagcagccag

SEQ ID NO: 2207387 - DNA, 13 bp, Homo sapiens
tggcctatgcaca

SEQ ID NO: 2207388 - DNA, 15 bp, Homo sapiens
tggcctatgcacata

SEQ ID NO: 2207389 - DNA, 17 bp, Homo sapiens
tggcctatgcacatatg

SEQ ID NO: 2207390 - DNA, 20 bp, Homo sapiens
tggcctatgcacatatggac

SEQ ID NO: 2207391 - DNA, 12 bp, Homo sapiens
tggcctggcaca

SEQ ID NO: 2207392 - DNA, 14 bp, Homo sapiens
tggctcccaggaca

SEQ ID NO: 2207393 - DNA, 20 bp, Homo sapiens
tgggaaccccttcatcctct

SEQ ID NO: 2207394 - DNA, 14 bp, Homo sapiens
tgggagtacaaaag

SEQ ID NO: 2207395 - DNA, 14 bp, Homo sapiens
tgggcaaacaggca

SEQ ID NO: 2207396 - DNA, 13 bp, Homo sapiens
tggtccacagggc

SEQ ID NO: 2207397 - DNA, 22 bp, Homo sapiens
tggtccatgggccatatgaaaa

SEQ ID NO: 2207398 - DNA, 13 bp, Homo sapiens
tggtgcctggcct

SEQ ID NO: 2207399 - DNA, 14 bp, Homo sapiens
tggtgcctggcctg

SEQ ID NO: 2207400 - DNA, 22 bp, Homo sapiens
tggtgcctggcctggcacacat

SEQ ID NO: 2207401 - DNA, 22 bp, Homo sapiens
tggttaggatggcaggacgtgg

SEQ ID NO: 2207402 - DNA, 14 bp, Homo sapiens
tgtaattctaaatg

SEQ ID NO: 2207403 - DNA, 16 bp, Homo sapiens
tgtaattctaaatgaa

SEQ ID NO: 2207404 - DNA, 17 bp, Homo sapiens
tgtacatgtgtagcctg

SEQ ID NO: 2207405 - DNA, 20 bp, Homo sapiens
tgtacatgtgtagcctgtgc

SEQ ID NO: 2207406 - DNA, 17 bp, Homo sapiens
tgtaccatgtacatgaa

SEQ ID NO: 2207407 - DNA, 17 bp, Homo sapiens
tgtactgagccttgtaa

SEQ ID NO: 2207408 - DNA, 17 bp, Homo sapiens
tgtagataatacagttc

SEQ ID NO: 2207409 - DNA, 15 bp, Homo sapiens
tgtagcctgtgcatg

SEQ ID NO: 2207410 - DNA, 19 bp, Homo sapiens
tgtatgtcttggacactgt

SEQ ID NO: 2207411 - DNA, 24 bp, Homo sapiens
tgtcctgtagttgcgtggactctg

SEQ ID NO: 2207412 - DNA, 13 bp, Homo sapiens
tgtctgccccctc

SEQ ID NO: 2207413 - DNA, 13 bp, Homo sapiens
tgtctgtacacgt

SEQ ID NO: 2207414 - DNA, 15 bp, Homo sapiens
tgtctgtacacgtgt

SEQ ID NO: 2207415 - DNA, 19 bp, Homo sapiens
tgtctgtacacgtgtcctg

SEQ ID NO: 2207416 - DNA, 17 bp, Homo sapiens
tgtcttctccctgcaca

SEQ ID NO: 2207417 - DNA, 17 bp, Homo sapiens
tgtgacacatatgcacc

SEQ ID NO: 2207418 - DNA, 15 bp, Homo sapiens
tgtgactagtgctga

SEQ ID NO: 2207419 - DNA, 22 bp, Homo sapiens
tgtgactagtgctgaagcttat

SEQ ID NO: 2207420 - DNA, 17 bp, Homo sapiens
tgtgacttaagaagcct

SEQ ID NO: 2207421 - DNA, 16 bp, Homo sapiens
tgtgtagcctgtgcat

SEQ ID NO: 2207422 - DNA, 13 bp, Homo sapiens
tgttgttatttaa

SEQ ID NO: 2207423 - DNA, 16 bp, Homo sapiens
tgtttacactctttgt

SEQ ID NO: 2207424 - DNA, 19 bp, Homo sapiens
tgtttacactctttgtaag

SEQ ID NO: 2207425 - DNA, 16 bp, Homo sapiens
ttaagataattataat

SEQ ID NO: 2207426 - DNA, 18 bp, Homo sapiens
ttaagttgctgatgaact

SEQ ID NO: 2207427 - DNA, 21 bp, Homo sapiens
ttaagtttccttccagcccag

SEQ ID NO: 2207428 - DNA, 18 bp, Homo sapiens
ttaatcttttcacaaata

SEQ ID NO: 2207429 - DNA, 20 bp, Homo sapiens
ttaatcttttcacaaataaa

SEQ ID NO: 2207430 - DNA, 21 bp, Homo sapiens
ttaatgctaagggcaggccca

SEQ ID NO: 2207431 - DNA, 19 bp, Homo sapiens
ttacattattatcaacaat

SEQ ID NO: 2207432 - DNA, 15 bp, Homo sapiens
ttactttccattgct

SEQ ID NO: 2207433 - DNA, 15 bp, Homo sapiens
ttaggatggcaggac

SEQ ID NO: 2207434 - DNA, 13 bp, Homo sapiens
ttataatatacta

SEQ ID NO: 2207435 - DNA, 17 bp, Homo sapiens
ttatatatgtatttata

SEQ ID NO: 2207436 - DNA, 16 bp, Homo sapiens
ttatcaaaactttctt

SEQ ID NO: 2207437 - DNA, 13 bp, Homo sapiens
ttatcaagctaat

SEQ ID NO: 2207438 - DNA, 21 bp, Homo sapiens
ttatcagtcataactaaataa

SEQ ID NO: 2207439 - DNA, 23 bp, Homo sapiens
ttatcagtcataactaaataaag

SEQ ID NO: 2207440 - DNA, 14 bp, Homo sapiens
ttattaatgctaag

SEQ ID NO: 2207441 - DNA, 14 bp, Homo sapiens
ttattatatttaca

SEQ ID NO: 2207442 - DNA, 18 bp, Homo sapiens
ttcaataaatgtctgttg

SEQ ID NO: 2207443 - DNA, 23 bp, Homo sapiens
ttcagttattatatttacaaatg

SEQ ID NO: 2207444 - DNA, 20 bp, Homo sapiens
ttcatatgtaccatgtacat

SEQ ID NO: 2207445 - DNA, 21 bp, Homo sapiens
ttccccaccagtgaatgaaag

SEQ ID NO: 2207446 - DNA, 19 bp, Homo sapiens
ttccgtaggttattttcag

SEQ ID NO: 2207447 - DNA, 12 bp, Homo sapiens
ttcctatatgca

SEQ ID NO: 2207448 - DNA, 18 bp, Homo sapiens
ttctaaatgaatgtttac

SEQ ID NO: 2207449 - DNA, 13 bp, Homo sapiens
ttctataatttaa

SEQ ID NO: 2207450 - DNA, 15 bp, Homo sapiens
ttctggaatgtaatc

SEQ ID NO: 2207451 - DNA, 22 bp, Homo sapiens
ttctggctctcccatttcctga

SEQ ID NO: 2207452 - DNA, 17 bp, Homo sapiens
ttgaaattgtattacaa

SEQ ID NO: 2207453 - DNA, 18 bp, Homo sapiens
ttgcattttttaaaacaa

SEQ ID NO: 2207454 - DNA, 17 bp, Homo sapiens
ttgccttctacttttaa

SEQ ID NO: 2207455 - DNA, 22 bp, Homo sapiens
ttggccgcacctaaagcagcca

SEQ ID NO: 2207456 - DNA, 12 bp, Homo sapiens
ttggtgcctggc

SEQ ID NO: 2207457 - DNA, 13 bp, Homo sapiens
ttggtgcctggcc

SEQ ID NO: 2207458 - DNA, 23 bp, Homo sapiens
ttgtaattctaaatgaatgttta

SEQ ID NO: 2207459 - DNA, 20 bp, Homo sapiens
ttgtacatgtgtagcctgtg

SEQ ID NO: 2207460 - DNA, 16 bp, Homo sapiens
ttgtattaaagacaga

SEQ ID NO: 2207461 - DNA, 17 bp, Homo sapiens
ttgtgactagtgctgaa

SEQ ID NO: 2207462 - DNA, 22 bp, Homo sapiens
ttgtgataagttctagttgctt

SEQ ID NO: 2207463 - DNA, 22 bp, Homo sapiens
ttgtgccatagtcacatggcct

SEQ ID NO: 2207464 - DNA, 14 bp, Homo sapiens
ttgtgtctgtacac

SEQ ID NO: 2207465 - DNA, 18 bp, Homo sapiens
tttaaaaaaattccaagt

SEQ ID NO: 2207466 - DNA, 15 bp, Homo sapiens
tttaaaacaagaaag

SEQ ID NO: 2207467 - DNA, 21 bp, Homo sapiens
tttaaaacaagaaagtttccc

SEQ ID NO: 2207468 - DNA, 12 bp, Homo sapiens
tttaaaatgtct

SEQ ID NO: 2207469 - DNA, 21 bp, Homo sapiens
tttaaatatatgctaagtctt

SEQ ID NO: 2207470 - DNA, 14 bp, Homo sapiens
tttaagataattat

SEQ ID NO: 2207471 - DNA, 14 bp, Homo sapiens
tttaattattattc

SEQ ID NO: 2207472 - DNA, 23 bp, Homo sapiens
tttaattattatttatatatgta

SEQ ID NO: 2207473 - DNA, 16 bp, Homo sapiens
tttacactctttgtaa

SEQ ID NO: 2207474 - DNA, 12 bp, Homo sapiens
tttatcattttc

SEQ ID NO: 2207475 - DNA, 15 bp, Homo sapiens
tttctccagggtcag

SEQ ID NO: 2207476 - DNA, 15 bp, Homo sapiens
tttgaaatcagcata

SEQ ID NO: 2207477 - DNA, 22 bp, Homo sapiens
ttttaaaacaagaaagtttccc

SEQ ID NO: 2207478 - DNA, 20 bp, Homo sapiens
ttttaattattatttatata

SEQ ID NO: 2207479 - DNA, 23 bp, Homo sapiens
ttttaattattatttatatatgt

SEQ ID NO: 2207480 - DNA, 14 bp, Homo sapiens
ttttcacaaataaa

SEQ ID NO: 2207481 - DNA, 12 bp, Homo sapiens
tttttaattatt

SEQ ID NO: 2207482 - DNA, 16 bp, Homo sapiens
ttttttatgctaatca

SEQ ID NO: 2207483 - DNA, 17 bp, Homo sapiens
ggtgaggggctggcact

SEQ ID NO: 2207484 - DNA, 14 bp, Homo sapiens
gtaattctaaatga

SEQ ID NO: 2207485 - DNA, 15 bp, Homo sapiens
gtaattctaaatgaa

SEQ ID NO: 2207486 - DNA, 20 bp, Homo sapiens
gtacatgtgtagcctgtgca

SEQ ID NO: 2207487 - DNA, 15 bp, Homo sapiens
gtaccaatcatttta

SEQ ID NO: 2207488 - DNA, 19 bp, Homo sapiens
gtctcttctgggcaccctc

SEQ ID NO: 2207489 - DNA, 21 bp, Homo sapiens
gtctctttttttggcccaggc

SEQ ID NO: 2207490 - DNA, 14 bp, Homo sapiens
gtcttggacactgt

SEQ ID NO: 2207491 - DNA, 15 bp, Homo sapiens
gtcttggacactgta

SEQ ID NO: 2207492 - DNA, 24 bp, Homo sapiens
gtgaaacccagtcactgtgagctc

SEQ ID NO: 2207493 - DNA, 22 bp, Homo sapiens
gtgaatgaaagtcttgtgacta

SEQ ID NO: 2207494 - DNA, 17 bp, Homo sapiens
gtgaccaggcatcctcc

SEQ ID NO: 2207495 - DNA, 13 bp, Homo sapiens
gtgactagtgctg

SEQ ID NO: 2207496 - DNA, 15 bp, Homo sapiens
gtgactagtgctgaa

SEQ ID NO: 2207497 - DNA, 21 bp, Homo sapiens
gtgactagtgctgaagcttat

SEQ ID NO: 2207498 - DNA, 19 bp, Homo sapiens
gtgagtcctagagctacag

SEQ ID NO: 2207499 - DNA, 16 bp, Homo sapiens
gtgatgccctgccctt

SEQ ID NO: 2207500 - DNA, 20 bp, Homo sapiens
gtgcagaccccttggccagc

SEQ ID NO: 2207501 - DNA, 12 bp, Homo sapiens
gtgcagccagag

SEQ ID NO: 2207502 - DNA, 13 bp, Homo sapiens
gtgcagccagagg

SEQ ID NO: 2207503 - DNA, 17 bp, Homo sapiens
gtgccatagtcacatgg

SEQ ID NO: 2207504 - DNA, 17 bp, Homo sapiens
gtgccctcaccacccac

SEQ ID NO: 2207505 - DNA, 14 bp, Homo sapiens
gtgctgaagcttat

SEQ ID NO: 2207506 - DNA, 21 bp, Homo sapiens
gtgctgaagcttattaatgct

SEQ ID NO: 2207507 - DNA, 17 bp, Homo sapiens
gtgggcaaacaggcagt

SEQ ID NO: 2207508 - DNA, 21 bp, Homo sapiens
gtgtcctgtagttgcgtggac

SEQ ID NO: 2207509 - DNA, 14 bp, Homo sapiens
gtgtctgccccctc

SEQ ID NO: 2207510 - DNA, 21 bp, Homo sapiens
gtgtctgtacacgtgtcctgt

SEQ ID NO: 2207511 - DNA, 22 bp, Homo sapiens
gtgtctgtacacgtgtcctgta

SEQ ID NO: 2207512 - DNA, 20 bp, Homo sapiens
gttattatatttacaaatgg

SEQ ID NO: 2207513 - DNA, 13 bp, Homo sapiens
gttatttaaagaa

SEQ ID NO: 2207514 - DNA, 22 bp, Homo sapiens
gttcatatgtaccatgtacatg

SEQ ID NO: 2207515 - DNA, 18 bp, Homo sapiens
gttgacagttcatatgta

SEQ ID NO: 2207516 - DNA, 17 bp, Homo sapiens
gtttccccaccagtgaa

SEQ ID NO: 2207517 - DNA, 18 bp, Homo sapiens
gtttgccttctactttta

SEQ ID NO: 2207518 - DNA, 15 bp, Homo sapiens
gttttttatgctaat

SEQ ID NO: 2207519 - DNA, 20 bp, Homo sapiens
taaaacaagaaagtttcccc

SEQ ID NO: 2207520 - DNA, 16 bp, Homo sapiens
taaaatatcattcagc

SEQ ID NO: 2207521 - DNA, 13 bp, Homo sapiens
taaagcagccagc

SEQ ID NO: 2207522 - DNA, 21 bp, Homo sapiens
taaatagtctagactaaaaga

SEQ ID NO: 2207523 - DNA, 22 bp, Homo sapiens
taaatatatttaagataattat

SEQ ID NO: 2207524 - DNA, 21 bp, Homo sapiens
taaattatgggaatcaagatt

SEQ ID NO: 2207525 - DNA, 19 bp, Homo sapiens
taacacctgattaactgag

SEQ ID NO: 2207526 - DNA, 18 bp, Homo sapiens
taacccccactggactga

SEQ ID NO: 2207527 - DNA, 18 bp, Homo sapiens
taataaaatatcattcag

SEQ ID NO: 2207528 - DNA, 21 bp, Homo sapiens
taataaaatatcattcagcaa

SEQ ID NO: 2207529 - DNA, 17 bp, Homo sapiens
taataaatgtacattaa

SEQ ID NO: 2207530 - DNA, 18 bp, Homo sapiens
taatacctctgtgtgctc

SEQ ID NO: 2207531 - DNA, 16 bp, Homo sapiens
taatatactatattta

SEQ ID NO: 2207532 - DNA, 18 bp, Homo sapiens
taatcaatgtttcttcta

SEQ ID NO: 2207533 - DNA, 15 bp, Homo sapiens
taatcttttcacaaa

SEQ ID NO: 2207534 - DNA, 16 bp, Homo sapiens
taatcttttcacaaat

SEQ ID NO: 2207535 - DNA, 17 bp, Homo sapiens
taatcttttcacaaata

SEQ ID NO: 2207536 - DNA, 14 bp, Homo sapiens
taatgttgttattt

SEQ ID NO: 2207537 - DNA, 12 bp, Homo sapiens
taattattattc

SEQ ID NO: 2207538 - DNA, 12 bp, Homo sapiens
taattattattt

SEQ ID NO: 2207539 - DNA, 20 bp, Homo sapiens
aatatatttaagataattat

SEQ ID NO: 2207540 - DNA, 16 bp, Homo sapiens
aatatcattcagcaac

SEQ ID NO: 2207541 - DNA, 20 bp, Homo sapiens
aatcaagatttaatcctaga

SEQ ID NO: 2207542 - DNA, 19 bp, Homo sapiens
aatcagggaggtcattttg

SEQ ID NO: 2207543 - DNA, 18 bp, Homo sapiens
aatcatataataaatgta

SEQ ID NO: 2207544 - DNA, 21 bp, Homo sapiens
aatcatataataaatgtacat

SEQ ID NO: 2207545 - DNA, 23 bp, Homo sapiens
aatgaaagtcttgtgactagtgc

SEQ ID NO: 2207546 - DNA, 17 bp, Homo sapiens
aatgctaagggcaggcc

SEQ ID NO: 2207547 - DNA, 16 bp, Homo sapiens
aatggaaccaggcttg

SEQ ID NO: 2207548 - DNA, 19 bp, Homo sapiens
aatgttattttttaattat

SEQ ID NO: 2207549 - DNA, 23 bp, Homo sapiens
aatgtttacactctttgtaagag

SEQ ID NO: 2207550 - DNA, 16 bp, Homo sapiens
aattaaggcataagaa

SEQ ID NO: 2207551 - DNA, 16 bp, Homo sapiens
aattatcaagctaata

SEQ ID NO: 2207552 - DNA, 19 bp, Homo sapiens
aattatcaagctaataaaa

SEQ ID NO: 2207553 - DNA, 13 bp, Homo sapiens
aattattattctt

SEQ ID NO: 2207554 - DNA, 18 bp, Homo sapiens
aattattatttatatatg

SEQ ID NO: 2207555 - DNA, 19 bp, Homo sapiens
aattctaaatgaatgttta

SEQ ID NO: 2207556 - DNA, 21 bp, Homo sapiens
aattcttgccaaatataaata

SEQ ID NO: 2207557 - DNA, 16 bp, Homo sapiens
acaagcaaacccagac

SEQ ID NO: 2207558 - DNA, 17 bp, Homo sapiens
acacatacctttggtta

SEQ ID NO: 2207559 - DNA, 17 bp, Homo sapiens
acacccagcccccacat

SEQ ID NO: 2207560 - DNA, 12 bp, Homo sapiens
acacgtgtcctg

SEQ ID NO: 2207561 - DNA, 19 bp, Homo sapiens
acagaacaaatgtttgttt

SEQ ID NO: 2207562 - DNA, 16 bp, Homo sapiens
acagatgggcaaatta

SEQ ID NO: 2207563 - DNA, 15 bp, Homo sapiens
acagggcacctgcca

SEQ ID NO: 2207564 - DNA, 16 bp, Homo sapiens
acatatgcaccttgtg

SEQ ID NO: 2207565 - DNA, 21 bp, Homo sapiens
acatgaatcccacccacatgt

SEQ ID NO: 2207566 - DNA, 17 bp, Homo sapiens
acatggcctatgcacat

SEQ ID NO: 2207567 - DNA, 22 bp, Homo sapiens
acatgtcttgtacatgtgtagc

SEQ ID NO: 2207568 - DNA, 14 bp, Homo sapiens
acatgtgacacata

SEQ ID NO: 2207569 - DNA, 15 bp, Homo sapiens
acatgtgacacatat

SEQ ID NO: 2207570 - DNA, 20 bp, Homo sapiens
accaatcattttaattatta

SEQ ID NO: 2207571 - DNA, 13 bp, Homo sapiens
accataatgttac

SEQ ID NO: 2207572 - DNA, 22 bp, Homo sapiens
accatgcgacactgggaggcca

SEQ ID NO: 2207573 - DNA, 18 bp, Homo sapiens
accccagcctggccacgc

SEQ ID NO: 2207574 - DNA, 17 bp, Homo sapiens
acccctttctggctctc

SEQ ID NO: 2207575 - DNA, 22 bp, Homo sapiens
accctgggcctggcagctcagc

SEQ ID NO: 2207576 - DNA, 17 bp, Homo sapiens
acctcagttttatcatt

SEQ ID NO: 2207577 - DNA, 15 bp, Homo sapiens
acctctgtgtgctcc

SEQ ID NO: 2207578 - DNA, 17 bp, Homo sapiens
acctggacacaggcctg

SEQ ID NO: 2207579 - DNA, 17 bp, Homo sapiens
acctggtccacagggca

SEQ ID NO: 2207580 - DNA, 13 bp, Homo sapiens
accttgtgtctgt

SEQ ID NO: 2207581 - DNA, 18 bp, Homo sapiens
accttgtgtctgtacacg

SEQ ID NO: 2207582 - DNA, 21 bp, Homo sapiens
accttgtgtctgtacacgtgt

SEQ ID NO: 2207583 - DNA, 23 bp, Homo sapiens
acgaaatgttattttttaattat

SEQ ID NO: 2207584 - DNA, 15 bp, Homo sapiens
acgcagccaggacac

SEQ ID NO: 2207585 - DNA, 15 bp, Homo sapiens
acggacgctggctcc

SEQ ID NO: 2207586 - DNA, 22 bp, Homo sapiens
acggctccactaggacttcaaa

SEQ ID NO: 2207587 - DNA, 23 bp, Homo sapiens
acgtgggctgggcccacaaaggc

SEQ ID NO: 2207588 - DNA, 14 bp, Homo sapiens
actagtgctgaagc

SEQ ID NO: 2207589 - DNA, 16 bp, Homo sapiens
actagtgctgaagctt

SEQ ID NO: 2207590 - DNA, 19 bp, Homo sapiens
actctacccatattacaga

SEQ ID NO: 2207591 - DNA, 13 bp, Homo sapiens
actctgcacatgt

SEQ ID NO: 2207592 - DNA, 17 bp, Homo sapiens
actctgcacatgtcttg

SEQ ID NO: 2207593 - DNA, 19 bp, Homo sapiens
actctgcacatgtcttgta

SEQ ID NO: 2207594 - DNA, 21 bp, Homo sapiens
actctgcacatgtcttgtaca

SEQ ID NO: 2207595 - DNA, 22 bp, Homo sapiens
actctgcacatgtcttgtacat

SEQ ID NO: 2207596 - DNA, 17 bp, Homo sapiens
actgacctggtccacag

SEQ ID NO: 2207597 - DNA, 15 bp, Homo sapiens
actgactgcagggac

SEQ ID NO: 2207598 - DNA, 14 bp, Homo sapiens
actgagccttgtaa

SEQ ID NO: 2207599 - DNA, 18 bp, Homo sapiens
actgatcaggacctccaa

SEQ ID NO: 2207600 - DNA, 17 bp, Homo sapiens
actggatgcagaaacag

SEQ ID NO: 2207601 - DNA, 15 bp, Homo sapiens
actggcgcctccgag

SEQ ID NO: 2207602 - DNA, 18 bp, Homo sapiens
actgtgatgccctgccct

SEQ ID NO: 2207603 - DNA, 22 bp, Homo sapiens
actgtttggacttttattttgg

SEQ ID NO: 2207604 - DNA, 13 bp, Homo sapiens
acttaataatgtg

SEQ ID NO: 2207605 - DNA, 14 bp, Homo sapiens
acttcgggctggcc

SEQ ID NO: 2207606 - DNA, 22 bp, Homo sapiens
acttgaccccgacgccacagcc

SEQ ID NO: 2207607 - DNA, 20 bp, Homo sapiens
acttgggagacctgtaatca

SEQ ID NO: 2207608 - DNA, 20 bp, Homo sapiens
acttggggagatggagttct

SEQ ID NO: 2207609 - DNA, 20 bp, Homo sapiens
actttgcctttccataatca

SEQ ID NO: 2207610 - DNA, 20 bp, Homo sapiens
agaaaatggaaccaggcttg

SEQ ID NO: 2207611 - DNA, 12 bp, Homo sapiens
agaaagtttccc

SEQ ID NO: 2207612 - DNA, 20 bp, Homo sapiens
agaagaaaatggaaccaggc

SEQ ID NO: 2207613 - DNA, 22 bp, Homo sapiens
agaagaaaatggaaccaggctt

SEQ ID NO: 2207614 - DNA, 13 bp, Homo sapiens
agacctcagggca

SEQ ID NO: 2207615 - DNA, 17 bp, Homo sapiens
agatctctgcagggccg

SEQ ID NO: 2207616 - DNA, 15 bp, Homo sapiens
agatgcctgaagcca

SEQ ID NO: 2207617 - DNA, 17 bp, Homo sapiens
agatggagttcttgtgc

SEQ ID NO: 2207618 - DNA, 19 bp, Homo sapiens
agatggagttcttgtgcca

SEQ ID NO: 2207619 - DNA, 21 bp, Homo sapiens
agatgggtgaaggctggcatg

SEQ ID NO: 2207620 - DNA, 13 bp, Homo sapiens
agcaagtctcttt

SEQ ID NO: 2207621 - DNA, 17 bp, Homo sapiens
agcagactgatcaggac

SEQ ID NO: 2207622 - DNA, 15 bp, Homo sapiens
agccactgagcaatg

SEQ ID NO: 2207623 - DNA, 20 bp, Homo sapiens
agcctggccacgcagccagg

SEQ ID NO: 2207624 - DNA, 21 bp, Homo sapiens
agcctggccacgcagccagga

SEQ ID NO: 2207625 - DNA, 22 bp, Homo sapiens
agcctggccacgcagccaggac

SEQ ID NO: 2207626 - DNA, 17 bp, Homo sapiens
agcctggctcccaggac

SEQ ID NO: 2207627 - DNA, 18 bp, Homo sapiens
agcctggctcccaggaca

SEQ ID NO: 2207628 - DNA, 19 bp, Homo sapiens
agcctggctcccaggacac

SEQ ID NO: 2207629 - DNA, 14 bp, Homo sapiens
agcctggtgctgct

SEQ ID NO: 2207630 - DNA, 15 bp, Homo sapiens
agcctggtgctgctg

SEQ ID NO: 2207631 - DNA, 16 bp, Homo sapiens
agcctggtgctgctgc

SEQ ID NO: 2207632 - DNA, 21 bp, Homo sapiens
ctgcagtttgagacaggagac

SEQ ID NO: 2207633 - DNA, 23 bp, Homo sapiens
ctgccaccctgggcctggcagct

SEQ ID NO: 2207634 - DNA, 20 bp, Homo sapiens
ctgctctctttttctccagg

SEQ ID NO: 2207635 - DNA, 24 bp, Homo sapiens
ctgctctctttttctccagggtca

SEQ ID NO: 2207636 - DNA, 13 bp, Homo sapiens
ctggacacaggcc

SEQ ID NO: 2207637 - DNA, 20 bp, Homo sapiens
ctggcactgactgggcatag

SEQ ID NO: 2207638 - DNA, 14 bp, Homo sapiens
ctggcctggcacac

SEQ ID NO: 2207639 - DNA, 16 bp, Homo sapiens
ctggcctggcacacat

SEQ ID NO: 2207640 - DNA, 16 bp, Homo sapiens
ctggctcccaggacac

SEQ ID NO: 2207641 - DNA, 14 bp, Homo sapiens
ctggctccccaaag

SEQ ID NO: 2207642 - DNA, 14 bp, Homo sapiens
ctgggaggccagtg

SEQ ID NO: 2207643 - DNA, 16 bp, Homo sapiens
ctgggcaccctcccac

SEQ ID NO: 2207644 - DNA, 20 bp, Homo sapiens
ctgggcctggcagctcagct

SEQ ID NO: 2207645 - DNA, 13 bp, Homo sapiens
ctggtccacaggg

SEQ ID NO: 2207646 - DNA, 14 bp, Homo sapiens
ctggtgctgctgct

SEQ ID NO: 2207647 - DNA, 19 bp, Homo sapiens
ctggttaggatggcaggac

SEQ ID NO: 2207648 - DNA, 16 bp, Homo sapiens
ctgtacacgtgtcctg

SEQ ID NO: 2207649 - DNA, 20 bp, Homo sapiens
ctgtagttgcgtggactctg

SEQ ID NO: 2207650 - DNA, 13 bp, Homo sapiens
ctgtccaggctcg

SEQ ID NO: 2207651 - DNA, 16 bp, Homo sapiens
ctgtgcatgtatgtct

SEQ ID NO: 2207652 - DNA, 16 bp, Homo sapiens
ctgtgcctccatcagc

SEQ ID NO: 2207653 - DNA, 16 bp, Homo sapiens
ctgtggggcccccaca

SEQ ID NO: 2207654 - DNA, 18 bp, Homo sapiens
ctgttagtcatttgctga

SEQ ID NO: 2207655 - DNA, 19 bp, Homo sapiens
ctgttatcaaaactttctt

SEQ ID NO: 2207656 - DNA, 20 bp, Homo sapiens
cttaatcttttcacaaataa

SEQ ID NO: 2207657 - DNA, 13 bp, Homo sapiens
cttataatttaaa

SEQ ID NO: 2207658 - DNA, 19 bp, Homo sapiens
cttattaatgctaagggca

SEQ ID NO: 2207659 - DNA, 11 bp, Homo sapiens
cttcatcctct

SEQ ID NO: 2207660 - DNA, 22 bp, Homo sapiens
cttcatgcaggtgaaacccagt

SEQ ID NO: 2207661 - DNA, 19 bp, Homo sapiens
cttcgggctggccatctgg

SEQ ID NO: 2207662 - DNA, 21 bp, Homo sapiens
cttctacttttaagttgctga

SEQ ID NO: 2207663 - DNA, 16 bp, Homo sapiens
cttctaggttctaaaa

SEQ ID NO: 2207664 - DNA, 13 bp, Homo sapiens
cttctcacattta

SEQ ID NO: 2207665 - DNA, 12 bp, Homo sapiens
cttctgcctgca

SEQ ID NO: 2207666 - DNA, 20 bp, Homo sapiens
cttgaattgcattttttaaa

SEQ ID NO: 2207667 - DNA, 17 bp, Homo sapiens
cttgccaaatataaata

SEQ ID NO: 2207668 - DNA, 22 bp, Homo sapiens
cttggaaccgtaggacccaagc

SEQ ID NO: 2207669 - DNA, 13 bp, Homo sapiens
cttggacactgta

SEQ ID NO: 2207670 - DNA, 21 bp, Homo sapiens
cttggcacccaagacctcagg

SEQ ID NO: 2207671 - DNA, 22 bp, Homo sapiens
cttggccgcacctaaagcagcc

SEQ ID NO: 2207672 - DNA, 18 bp, Homo sapiens
cttgtaaaggaatttaaa

SEQ ID NO: 2207673 - DNA, 20 bp, Homo sapiens
cttgtacatgtgtagcctgt

SEQ ID NO: 2207674 - DNA, 23 bp, Homo sapiens
cttgtacatgtgtagcctgtgca

SEQ ID NO: 2207675 - DNA, 17 bp, Homo sapiens
cttgtattaaagacaga

SEQ ID NO: 2207676 - DNA, 14 bp, Homo sapiens
cttgtgactagtgc

SEQ ID NO: 2207677 - DNA, 15 bp, Homo sapiens
cttgtgactagtgct

SEQ ID NO: 2207678 - DNA, 19 bp, Homo sapiens
cttgtgactagtgctgaag

SEQ ID NO: 2207679 - DNA, 22 bp, Homo sapiens
cttgtgactagtgctgaagctt

SEQ ID NO: 2207680 - DNA, 12 bp, Homo sapiens
cttgtgtctgta

SEQ ID NO: 2207681 - DNA, 12 bp, Homo sapiens
cttgtttcaatt

SEQ ID NO: 2207682 - DNA, 21 bp, Homo sapiens
ctttatctaatacctctgtgt

SEQ ID NO: 2207683 - DNA, 18 bp, Homo sapiens
ctttcaataaactaaaga

SEQ ID NO: 2207684 - DNA, 16 bp, Homo sapiens
ctttcatttactgtgg

SEQ ID NO: 2207685 - DNA, 13 bp, Homo sapiens
ctttctggctctc

SEQ ID NO: 2207686 - DNA, 18 bp, Homo sapiens
cttttctggaatgtaatc

SEQ ID NO: 2207687 - DNA, 19 bp, Homo sapiens
cttttctggaatgtaatca

SEQ ID NO: 2207688 - DNA, 17 bp, Homo sapiens
cttttgccattaaactt

SEQ ID NO: 2207689 - DNA, 15 bp, Homo sapiens
ctttttgaaatcagc

SEQ ID NO: 2207690 - DNA, 22 bp, Homo sapiens
gaaaacaataacgataaaagac

SEQ ID NO: 2207691 - DNA, 23 bp, Homo sapiens
gaaagtttccccaccagtgaatg

SEQ ID NO: 2207692 - DNA, 22 bp, Homo sapiens
gaaagtttggggacatgtgatt

SEQ ID NO: 2207693 - DNA, 22 bp, Homo sapiens
gaaatgttattttttaattatt

SEQ ID NO: 2207694 - DNA, 16 bp, Homo sapiens
gaacaagcaaacccag

SEQ ID NO: 2207695 - DNA, 15 bp, Homo sapiens
gaaccaggcttggaa

SEQ ID NO: 2207696 - DNA, 15 bp, Homo sapiens
gaactcaactttgac

SEQ ID NO: 2207697 - DNA, 16 bp, Homo sapiens
gaactcaactttgaca

SEQ ID NO: 2207698 - DNA, 13 bp, Homo sapiens
gaactcttaatca

SEQ ID NO: 2207699 - DNA, 22 bp, Homo sapiens
gaacttgtaaaggaatttaaaa

SEQ ID NO: 2207700 - DNA, 19 bp, Homo sapiens
gaagctctcgggctaggaa

SEQ ID NO: 2207701 - DNA, 15 bp, Homo sapiens
gaagcttattaatgc

SEQ ID NO: 2207702 - DNA, 17 bp, Homo sapiens
gaagcttattaatgcta

SEQ ID NO: 2207703 - DNA, 19 bp, Homo sapiens
gaagcttattaatgctaag

SEQ ID NO: 2207704 - DNA, 20 bp, Homo sapiens
gaagcttattaatgctaagg

SEQ ID NO: 2207705 - DNA, 22 bp, Homo sapiens
gaagcttattaatgctaagggc

SEQ ID NO: 2207706 - DNA, 22 bp, Homo sapiens
gaatcccacccacatgtgacac

SEQ ID NO: 2207707 - DNA, 20 bp, Homo sapiens
gaatgcagtctgtccaggct

SEQ ID NO: 2207708 - DNA, 22 bp, Homo sapiens
gaatgcagtctgtccaggctcg

SEQ ID NO: 2207709 - DNA, 20 bp, Homo sapiens
gaatgtttacactctttgta

SEQ ID NO: 2207710 - DNA, 23 bp, Homo sapiens
gaattgcattttttaaaacaaga

SEQ ID NO: 2207711 - DNA, 16 bp, Homo sapiens
gacaaggaaaaaataa

SEQ ID NO: 2207712 - DNA, 18 bp, Homo sapiens
gacaggagacctggcact

SEQ ID NO: 2207713 - DNA, 15 bp, Homo sapiens
gacagttcatatgta

SEQ ID NO: 2207714 - DNA, 17 bp, Homo sapiens
gacagttcatatgtacc

SEQ ID NO: 2207715 - DNA, 15 bp, Homo sapiens
gaccataatgttaca

SEQ ID NO: 2207716 - DNA, 20 bp, Homo sapiens
gaccataatgttacattatt

SEQ ID NO: 2207717 - DNA, 13 bp, Homo sapiens
gacctcagggcac

SEQ ID NO: 2207718 - DNA, 16 bp, Homo sapiens
gacctccaagccactg

SEQ ID NO: 2207719 - DNA, 12 bp, Homo sapiens
gacctgtaatca

SEQ ID NO: 2207720 - DNA, 14 bp, Homo sapiens
gacgccacagccca

SEQ ID NO: 2207721 - DNA, 13 bp, Homo sapiens
gacgtgggctggg

SEQ ID NO: 2207722 - DNA, 15 bp, Homo sapiens
gactagtgctgaagc

SEQ ID NO: 2207723 - DNA, 17 bp, Homo sapiens
gactagtgctgaagctt

SEQ ID NO: 2207724 - DNA, 23 bp, Homo sapiens
gactagtgctgaagcttattaat

SEQ ID NO: 2207725 - DNA, 20 bp, Homo sapiens
gactgacctggtccacaggg

SEQ ID NO: 2207726 - DNA, 22 bp, Homo sapiens
gactttatctaatacctctgtg

SEQ ID NO: 2207727 - DNA, 21 bp, Homo sapiens
gagaagctctcgggctaggaa

SEQ ID NO: 2207728 - DNA, 16 bp, Homo sapiens
gagacaggcagagctg

SEQ ID NO: 2207729 - DNA, 19 bp, Homo sapiens
gagacctggcactggatgc

SEQ ID NO: 2207730 - DNA, 13 bp, Homo sapiens
gagcacacccagc

SEQ ID NO: 2207731 - DNA, 16 bp, Homo sapiens
gagcacacccagcccc

SEQ ID NO: 2207732 - DNA, 14 bp, Homo sapiens
gagccgggccgcag

SEQ ID NO: 2207733 - DNA, 13 bp, Homo sapiens
gagctacaaatgc

SEQ ID NO: 2207734 - DNA, 14 bp, Homo sapiens
gagctacaaatgca

SEQ ID NO: 2207735 - DNA, 12 bp, Homo sapiens
gagctagccaga

SEQ ID NO: 2207736 - DNA, 20 bp, Homo sapiens
gagctcccaggtgcagccag

SEQ ID NO: 2207737 - DNA, 13 bp, Homo sapiens
gagctgggagccg

SEQ ID NO: 2207738 - DNA, 22 bp, Homo sapiens
gagctgggagccgggccgcaga

SEQ ID NO: 2207739 - DNA, 17 bp, Homo sapiens
gataggtcagtgcaaat

SEQ ID NO: 2207740 - DNA, 22 bp, Homo sapiens
gattgcaatttgcacaagtttt

SEQ ID NO: 2207741 - DNA, 13 bp, Homo sapiens
gatttcatgattt

SEQ ID NO: 2207742 - DNA, 19 bp, Homo sapiens
gcaagtctctttatatggc

SEQ ID NO: 2207743 - DNA, 12 bp, Homo sapiens
gcacaagccagg

SEQ ID NO: 2207744 - DNA, 13 bp, Homo sapiens
gcacatgtcttgt

SEQ ID NO: 2207745 - DNA, 21 bp, Homo sapiens
gcacccaagacctcagggcac

SEQ ID NO: 2207746 - DNA, 16 bp, Homo sapiens
gcacctaaagcagcca

SEQ ID NO: 2207747 - DNA, 20 bp, Homo sapiens
gcaccttgtgtctgtacacg

SEQ ID NO: 2207748 - DNA, 22 bp, Homo sapiens
gcaccttgtgtctgtacacgtg

SEQ ID NO: 2207749 - DNA, 14 bp, Homo sapiens
gcagccagaggcac

SEQ ID NO: 2207750 - DNA, 13 bp, Homo sapiens
gcagccagccgtg

SEQ ID NO: 2207751 - DNA, 13 bp, Homo sapiens
gcagcctggctcc

SEQ ID NO: 2207752 - DNA, 18 bp, Homo sapiens
gcagggacacgggcagcc

SEQ ID NO: 2207753 - DNA, 22 bp, Homo sapiens
gcagggacacgggcagcctggc

SEQ ID NO: 2207754 - DNA, 12 bp, Homo sapiens
gcagggcagccg

SEQ ID NO: 2207755 - DNA, 22 bp, Homo sapiens
gcagggccgcccgggcccagag

SEQ ID NO: 2207756 - DNA, 23 bp, Homo sapiens
gcagggccgcccgggcccagagg

SEQ ID NO: 2207757 - DNA, 20 bp, Homo sapiens
gcaggtgaaacccagtcact

SEQ ID NO: 2207758 - DNA, 17 bp, Homo sapiens
gcagtctgtccaggctc

SEQ ID NO: 2207759 - DNA, 22 bp, Homo sapiens
gcagttggccagagagcctggt

SEQ ID NO: 2207760 - DNA, 22 bp, Homo sapiens
gcatccacttctttcagcagac

SEQ ID NO: 2207761 - DNA, 23 bp, Homo sapiens
gcatccacttctttcagcagact

SEQ ID NO: 2207762 - DNA, 21 bp, Homo sapiens
gccagggagacctggacacag

SEQ ID NO: 2207763 - DNA, 16 bp, Homo sapiens
gccatatgaaaaggct

SEQ ID NO: 2207764 - DNA, 23 bp, Homo sapiens
gccatctggttaggatggcagga

SEQ ID NO: 2207765 - DNA, 17 bp, Homo sapiens
gcccaaattatcaagct

SEQ ID NO: 2207766 - DNA, 19 bp, Homo sapiens
gcccaaattatcaagctaa

SEQ ID NO: 2207767 - DNA, 22 bp, Homo sapiens
gcccaaattatcaagctaataa

SEQ ID NO: 2207768 - DNA, 22 bp, Homo sapiens
gcccagaggagctgggagccgg

SEQ ID NO: 2207769 - DNA, 10 bp, Homo sapiens
gcccaggcct

SEQ ID NO: 2207770 - DNA, 15 bp, Homo sapiens
gcccgggcccagagg

SEQ ID NO: 2207771 - DNA, 20 bp, Homo sapiens
gccgcacctaaagcagccag

SEQ ID NO: 2207772 - DNA, 16 bp, Homo sapiens
gccgtcacccctgcct

SEQ ID NO: 2207773 - DNA, 20 bp, Homo sapiens
gcctatgcacatatggactc

SEQ ID NO: 2207774 - DNA, 19 bp, Homo sapiens
gcctcctggcccaggtgag

SEQ ID NO: 2207775 - DNA, 16 bp, Homo sapiens
gcctctgccactgact

SEQ ID NO: 2207776 - DNA, 17 bp, Homo sapiens
gcctggctcccaggaca

SEQ ID NO: 2207777 - DNA, 18 bp, Homo sapiens
gcctggctcccaggacac

SEQ ID NO: 2207778 - DNA, 20 bp, Homo sapiens
gccttgtaattctaaatgaa

SEQ ID NO: 2207779 - DNA, 22 bp, Homo sapiens
gcggctcccggggcagggcagc

SEQ ID NO: 2207780 - DNA, 20 bp, Homo sapiens
gcgtggcgcagtggccctga

SEQ ID NO: 2207781 - DNA, 18 bp, Homo sapiens
gctaataaaatatcattc

SEQ ID NO: 2207782 - DNA, 19 bp, Homo sapiens
gctaataaaatatcattca

SEQ ID NO: 2207783 - DNA, 20 bp, Homo sapiens
gctaataaaatatcattcag

SEQ ID NO: 2207784 - DNA, 13 bp, Homo sapiens
gctagccagagga

SEQ ID NO: 2207785 - DNA, 18 bp, Homo sapiens
gctagccagaggactgtg

SEQ ID NO: 2207786 - DNA, 12 bp, Homo sapiens
gctcccaggaca

SEQ ID NO: 2207787 - DNA, 13 bp, Homo sapiens
gctcccaggacac

SEQ ID NO: 2207788 - DNA, 21 bp, Homo sapiens
gctgaagcttattaatgctaa

SEQ ID NO: 2207789 - DNA, 15 bp, Homo sapiens
gcttattaatgctaa

SEQ ID NO: 2207790 - DNA, 20 bp, Homo sapiens
gcttattaatgctaagggca

SEQ ID NO: 2207791 - DNA, 16 bp, Homo sapiens
gcttcctgtcctccca

SEQ ID NO: 2207792 - DNA, 12 bp, Homo sapiens
gcttctgcctgc

SEQ ID NO: 2207793 - DNA, 16 bp, Homo sapiens
ggaaaaaataacaatg

SEQ ID NO: 2207794 - DNA, 20 bp, Homo sapiens
ggaagatctctgcagggccg

SEQ ID NO: 2207795 - DNA, 13 bp, Homo sapiens
ggacacaggcctg

SEQ ID NO: 2207796 - DNA, 18 bp, Homo sapiens
ggacacaggcctgctctc

SEQ ID NO: 2207797 - DNA, 21 bp, Homo sapiens
ggactctgcacatgtcttgta

SEQ ID NO: 2207798 - DNA, 12 bp, Homo sapiens
ggagctagccag

SEQ ID NO: 2207799 - DNA, 19 bp, Homo sapiens
ggagcttcctgtcctccca

SEQ ID NO: 2207800 - DNA, 22 bp, Homo sapiens
ggcacctgccaccctgggcctg

SEQ ID NO: 2207801 - DNA, 18 bp, Homo sapiens
ggcagcctggctcccagg

SEQ ID NO: 2207802 - DNA, 14 bp, Homo sapiens
ggcagttggccaga

SEQ ID NO: 2207803 - DNA, 21 bp, Homo sapiens
ggcatagctccccgcttctgc

SEQ ID NO: 2207804 - DNA, 18 bp, Homo sapiens
ggcatgatccaagcaaga

SEQ ID NO: 2207805 - DNA, 18 bp, Homo sapiens
ggccacgcagccaggaca

SEQ ID NO: 2207806 - DNA, 21 bp, Homo sapiens
ggccagagagcctggtgctgc

SEQ ID NO: 2207807 - DNA, 21 bp, Homo sapiens
ggccatctggttaggatggca

SEQ ID NO: 2207808 - DNA, 11 bp, Homo sapiens
ggcccaggcct

SEQ ID NO: 2207809 - DNA, 12 bp, Homo sapiens
ggctggcatgat

SEQ ID NO: 2207810 - DNA, 15 bp, Homo sapiens
gggagctagccagag

SEQ ID NO: 2207811 - DNA, 21 bp, Homo sapiens
gggagctccaactcagaaggg

SEQ ID NO: 2207812 - DNA, 14 bp, Homo sapiens
gggcaccctcccac

SEQ ID NO: 2207813 - DNA, 12 bp, Homo sapiens
gggcacctgcca

SEQ ID NO: 2207814 - DNA, 18 bp, Homo sapiens
gggcagcctggctcccag

SEQ ID NO: 2207815 - DNA, 22 bp, Homo sapiens
gggcagggccgcccgggcccag

SEQ ID NO: 2207816 - DNA, 15 bp, Homo sapiens
gggcagggctcccac

SEQ ID NO: 2207817 - DNA, 12 bp, Homo sapiens
gggcccagagga

SEQ ID NO: 2207818 - DNA, 18 bp, Homo sapiens
gggtcagaaacaggaccg

SEQ ID NO: 2207819 - DNA, 17 bp, Homo sapiens
gggtccagaaggagaca

SEQ ID NO: 2207820 - DNA, 17 bp, Homo sapiens
gggtcgacttcgggctg

SEQ ID NO: 2207821 - DNA, 12 bp, Homo sapiens
gggtgaaggctg

SEQ ID NO: 2207822 - DNA, 14 bp, Homo sapiens
gggtgaaggctggc

SEQ ID NO: 2207823 - DNA, 15 bp, Homo sapiens
ggtcagaaacaggac

SEQ ID NO: 2207824 - DNA, 17 bp, Homo sapiens
ggtcagaaacaggaccg

SEQ ID NO: 2207825 - DNA, 18 bp, Homo sapiens
ggtcagaaacaggaccgg

SEQ ID NO: 2207826 - DNA, 14 bp, Homo sapiens
ggtcagtgcaaata

SEQ ID NO: 2207827 - DNA, 14 bp, Homo sapiens
ggtccacagggcac

SEQ ID NO: 2207828 - DNA, 17 bp, Homo sapiens
ggtgcagccagaggcac

SEQ ID NO: 2207829 - DNA, 20 bp, Homo sapiens
gtaataggcgtaactaattt

SEQ ID NO: 2207830 - DNA, 14 bp, Homo sapiens
gtaatcaatgtttc

SEQ ID NO: 2207831 - DNA, 17 bp, Homo sapiens
gtacacgtgtcctgtag

SEQ ID NO: 2207832 - DNA, 21 bp, Homo sapiens
gtaccaatcattttaattatt

SEQ ID NO: 2207833 - DNA, 23 bp, Homo sapiens
gtactttattttctataatttaa

SEQ ID NO: 2207834 - DNA, 18 bp, Homo sapiens
gtaggacccaagcagaga

SEQ ID NO: 2207835 - DNA, 13 bp, Homo sapiens
gtatttataaata

SEQ ID NO: 2207836 - DNA, 21 bp, Homo sapiens
gtcatttgctgagcatgtact

SEQ ID NO: 2207837 - DNA, 11 bp, Homo sapiens
gtccagaagga

SEQ ID NO: 2207838 - DNA, 14 bp, Homo sapiens
gtccagaaggagac

SEQ ID NO: 2207839 - DNA, 16 bp, Homo sapiens
gtccagaaggagacag

SEQ ID NO: 2207840 - DNA, 20 bp, Homo sapiens
gtccagaaggagacaggcag

SEQ ID NO: 2207841 - DNA, 15 bp, Homo sapiens
gtccgatctttgact

SEQ ID NO: 2207842 - DNA, 18 bp, Homo sapiens
gtcgacttcgggctggcc

SEQ ID NO: 2207843 - DNA, 18 bp, Homo sapiens
gtcgtcaaagctgaaatg

SEQ ID NO: 2207844 - DNA, 22 bp, Homo sapiens
gtctcacttgtgcagtgttgac

SEQ ID NO: 2207845 - DNA, 20 bp, Homo sapiens
gtctctttttttggcccagg

SEQ ID NO: 2207846 - DNA, 19 bp, Homo sapiens
gtctgtacacgtgtcctgt

SEQ ID NO: 2207847 - DNA, 19 bp, Homo sapiens
gtcttatatattgtagata

SEQ ID NO: 2207848 - DNA, 18 bp, Homo sapiens
gtcttggacactgtacaa

SEQ ID NO: 2207849 - DNA, 21 bp, Homo sapiens
gtcttgtgactagtgctgaag

SEQ ID NO: 2207850 - DNA, 19 bp, Homo sapiens
gtgaaagaaaataacaata

SEQ ID NO: 2207851 - DNA, 19 bp, Homo sapiens
gtgaacaagcaaacccaga

SEQ ID NO: 2207852 - DNA, 12 bp, Homo sapiens
gtgaaggctggc

SEQ ID NO: 2207853 - DNA, 14 bp, Homo sapiens
gtgaaggctggcat

SEQ ID NO: 2207854 - DNA, 17 bp, Homo sapiens
gtgactagtgctgaagc

SEQ ID NO: 2207855 - DNA, 18 bp, Homo sapiens
gtgactagtgctgaagct

SEQ ID NO: 2207856 - DNA, 14 bp, Homo sapiens
gtgagctacaaatg

SEQ ID NO: 2207857 - DNA, 23 bp, Homo sapiens
gtgcatgtatgtcttggacactg

SEQ ID NO: 2207858 - DNA, 20 bp, Homo sapiens
gtgccgtgtgttgcatgcag

SEQ ID NO: 2207859 - DNA, 14 bp, Homo sapiens
gtgcctcattgctt

SEQ ID NO: 2207860 - DNA, 12 bp, Homo sapiens
gtgtctgtacac

SEQ ID NO: 2207861 - DNA, 16 bp, Homo sapiens
gtgtctgtacacgtgt

SEQ ID NO: 2207862 - DNA, 20 bp, Homo sapiens
gtgtgtctttcctccctgaa

SEQ ID NO: 2207863 - DNA, 17 bp, Homo sapiens
gttattatatttacaaa

SEQ ID NO: 2207864 - DNA, 19 bp, Homo sapiens
gttcatatgtaccatgtac

SEQ ID NO: 2207865 - DNA, 14 bp, Homo sapiens
gttctagttgcttg

SEQ ID NO: 2207866 - DNA, 17 bp, Homo sapiens
taaaacaagaaagtttc

SEQ ID NO: 2207867 - DNA, 18 bp, Homo sapiens
taaaacaagaaagtttcc

SEQ ID NO: 2207868 - DNA, 19 bp, Homo sapiens
taaaacaagaaagtttccc

SEQ ID NO: 2207869 - DNA, 14 bp, Homo sapiens
taaaatatcattca

SEQ ID NO: 2207870 - DNA, 15 bp, Homo sapiens
taaagacagaggcag

SEQ ID NO: 2207871 - DNA, 14 bp, Homo sapiens
taaaggaatttaaa

SEQ ID NO: 2207872 - DNA, 14 bp, Homo sapiens
taaagtgtttgaaa

SEQ ID NO: 2207873 - DNA, 18 bp, Homo sapiens
taaatatatgctaagtct

SEQ ID NO: 2207874 - DNA, 17 bp, Homo sapiens
taaatatatttaagata

SEQ ID NO: 2207875 - DNA, 13 bp, Homo sapiens
taaatgaatgttt

SEQ ID NO: 2207876 - DNA, 12 bp, Homo sapiens
taaatgtctgtt

SEQ ID NO: 2207877 - DNA, 20 bp, Homo sapiens
taaattatgggaatcaagat

SEQ ID NO: 2207878 - DNA, 18 bp, Homo sapiens
taacacctgattaactga

SEQ ID NO: 2207879 - DNA, 14 bp, Homo sapiens
taacatataatgtt

SEQ ID NO: 2207880 - DNA, 12 bp, Homo sapiens
taagataattat

SEQ ID NO: 2207881 - DNA, 13 bp, Homo sapiens
taagataattata

SEQ ID NO: 2207882 - DNA, 15 bp, Homo sapiens
taataaaatatcatt

SEQ ID NO: 2207883 - DNA, 13 bp, Homo sapiens
taatacctctgtg

SEQ ID NO: 2207884 - DNA, 15 bp, Homo sapiens
taatacctctgtgtg

SEQ ID NO: 2207885 - DNA, 15 bp, Homo sapiens
taatcatataataaa

SEQ ID NO: 2207886 - DNA, 22 bp, Homo sapiens
taatcatataataaatgtacat

SEQ ID NO: 2207887 - DNA, 20 bp, Homo sapiens
taatgaccacacctgcctct

SEQ ID NO: 2207888 - DNA, 18 bp, Homo sapiens
taatgttgttatttaaag

SEQ ID NO: 2207889 - DNA, 16 bp, Homo sapiens
taattatctaaagtat

SEQ ID NO: 2207890 - DNA, 22 bp, Homo sapiens
taattattatttatatatgtat

SEQ ID NO: 2207891 - DNA, 22 bp, Homo sapiens
taattccgtaggttattttcag

SEQ ID NO: 2207892 - DNA, 11 bp, Homo sapiens
taattctaaat

SEQ ID NO: 2207893 - DNA, 18 bp, Homo sapiens
taattctaaatgaatgtt

SEQ ID NO: 2207894 - DNA, 13 bp, Homo sapiens
tacacgtgtcctg

SEQ ID NO: 2207895 - DNA, 14 bp, Homo sapiens
tacaggatttgaaa

SEQ ID NO: 2207896 - DNA, 23 bp, Homo sapiens
tacagttcggtgagctacaaatg

SEQ ID NO: 2207897 - DNA, 18 bp, Homo sapiens
tacatgtgtagcctgtgc

SEQ ID NO: 2207898 - DNA, 21 bp, Homo sapiens
tacattagtcattcaataaat

SEQ ID NO: 2207899 - DNA, 18 bp, Homo sapiens
tacccctttctggctctc

SEQ ID NO: 2207900 - DNA, 14 bp, Homo sapiens
tacctctgtgtgct

SEQ ID NO: 2207901 - DNA, 19 bp, Homo sapiens
tactgagccttgtaattct

SEQ ID NO: 2207902 - DNA, 21 bp, Homo sapiens
tacttgggagacctgtaatca

SEQ ID NO: 2207903 - DNA, 12 bp, Homo sapiens
tagactaaaaga

SEQ ID NO: 2207904 - DNA, 14 bp, Homo sapiens
tagtgctgaagctt

SEQ ID NO: 2207905 - DNA, 17 bp, Homo sapiens
tagtgctgaagcttatt

SEQ ID NO: 2207906 - DNA, 19 bp, Homo sapiens
tggtgctgctgctgctgtg

SEQ ID NO: 2207907 - DNA, 12 bp, Homo sapiens
tggttaggatgg

SEQ ID NO: 2207908 - DNA, 17 bp, Homo sapiens
tgtaaaatttcacttaa

SEQ ID NO: 2207909 - DNA, 16 bp, Homo sapiens
tgtaaaggaatttaaa

SEQ ID NO: 2207910 - DNA, 17 bp, Homo sapiens
tgtaatcatataataaa

SEQ ID NO: 2207911 - DNA, 22 bp, Homo sapiens
tgtacatgaagaagctaaatcc

SEQ ID NO: 2207912 - DNA, 14 bp, Homo sapiens
tgtacattaattac

SEQ ID NO: 2207913 - DNA, 22 bp, Homo sapiens
tgtacattagtcattcaataaa

SEQ ID NO: 2207914 - DNA, 12 bp, Homo sapiens
tgtaccatgtac

SEQ ID NO: 2207915 - DNA, 13 bp, Homo sapiens
tgtagcctgtgca

SEQ ID NO: 2207916 - DNA, 14 bp, Homo sapiens
tgtagcctgtgcat

SEQ ID NO: 2207917 - DNA, 20 bp, Homo sapiens
tgtagcctgtgcatgtatgt

SEQ ID NO: 2207918 - DNA, 21 bp, Homo sapiens
tgtatttataaatatatttaa

SEQ ID NO: 2207919 - DNA, 19 bp, Homo sapiens
tgtcttggacactgtacaa

SEQ ID NO: 2207920 - DNA, 17 bp, Homo sapiens
tgtcttgtacatgtgta

SEQ ID NO: 2207921 - DNA, 19 bp, Homo sapiens
tgtgactagtgctgaagct

SEQ ID NO: 2207922 - DNA, 23 bp, Homo sapiens
tgtgactagtgctgaagcttatt

SEQ ID NO: 2207923 - DNA, 19 bp, Homo sapiens
tgtgagctcccaggtgcag

SEQ ID NO: 2207924 - DNA, 15 bp, Homo sapiens
tgtgatcagaccata

SEQ ID NO: 2207925 - DNA, 16 bp, Homo sapiens
tgtgccatagtcacat

SEQ ID NO: 2207926 - DNA, 18 bp, Homo sapiens
tgtgccatagtcacatgg

SEQ ID NO: 2207927 - DNA, 22 bp, Homo sapiens
tgtggcttcttaatcttttcac

SEQ ID NO: 2207928 - DNA, 14 bp, Homo sapiens
tgtgtagcctgtgc

SEQ ID NO: 2207929 - DNA, 13 bp, Homo sapiens
tgtgtctgtacac

SEQ ID NO: 2207930 - DNA, 14 bp, Homo sapiens
tgtgtctgtacacg

SEQ ID NO: 2207931 - DNA, 21 bp, Homo sapiens
tgtgtctgtacacgtgtcctg

SEQ ID NO: 2207932 - DNA, 15 bp, Homo sapiens
tgttactatctgctt

SEQ ID NO: 2207933 - DNA, 15 bp, Homo sapiens
tgttagtcatttgct

SEQ ID NO: 2207934 - DNA, 14 bp, Homo sapiens
tgttatttaaagaa

SEQ ID NO: 2207935 - DNA, 18 bp, Homo sapiens
tgttattttttaattatt

SEQ ID NO: 2207936 - DNA, 17 bp, Homo sapiens
tgttgacagttcatatg

SEQ ID NO: 2207937 - DNA, 16 bp, Homo sapiens
tgttgtaaacatttct

SEQ ID NO: 2207938 - DNA, 11 bp, Homo sapiens
tgttgttattt

SEQ ID NO: 2207939 - DNA, 11 bp, Homo sapiens
ttaaaacaaga

SEQ ID NO: 2207940 - DNA, 14 bp, Homo sapiens
ttaagataattata

SEQ ID NO: 2207941 - DNA, 17 bp, Homo sapiens
ttaatcttttcacaaat

SEQ ID NO: 2207942 - DNA, 14 bp, Homo sapiens
ttaattattattct

SEQ ID NO: 2207943 - DNA, 17 bp, Homo sapiens
ttaattattattcttca

SEQ ID NO: 2207944 - DNA, 15 bp, Homo sapiens
ttacactctttgtaa

SEQ ID NO: 2207945 - DNA, 18 bp, Homo sapiens
ttacctgggcattcttgt

SEQ ID NO: 2207946 - DNA, 15 bp, Homo sapiens
ttatcaacaatagtg

SEQ ID NO: 2207947 - DNA, 20 bp, Homo sapiens
ttatcaagctaataaaatat

SEQ ID NO: 2207948 - DNA, 12 bp, Homo sapiens
ttatcattttca

SEQ ID NO: 2207949 - DNA, 23 bp, Homo sapiens
ttatgggaaccccttcatcctct

SEQ ID NO: 2207950 - DNA, 14 bp, Homo sapiens
ttattttttaatta

SEQ ID NO: 2207951 - DNA, 16 bp, Homo sapiens
ttattttttaattatt

SEQ ID NO: 2207952 - DNA, 14 bp, Homo sapiens
ttcaccttgaagaa

SEQ ID NO: 2207953 - DNA, 17 bp, Homo sapiens
ttcatgatttcatttca

SEQ ID NO: 2207954 - DNA, 19 bp, Homo sapiens
ttcatttactgtggcttct

SEQ ID NO: 2207955 - DNA, 15 bp, Homo sapiens
ttcatttcaactgtt

SEQ ID NO: 2207956 - DNA, 12 bp, Homo sapiens
ttctaaatgaat

SEQ ID NO: 2207957 - DNA, 15 bp, Homo sapiens
ttctaggttctaaaa

SEQ ID NO: 2207958 - DNA, 18 bp, Homo sapiens
ttctccctgcacaagcca

SEQ ID NO: 2207959 - DNA, 22 bp, Homo sapiens
ttctggaatgtaatcaatgttt

SEQ ID NO: 2207960 - DNA, 19 bp, Homo sapiens
ttctgggcaccctcccacc

SEQ ID NO: 2207961 - DNA, 21 bp, Homo sapiens
ttcttaatcttttcacaaata

SEQ ID NO: 2207962 - DNA, 23 bp, Homo sapiens
ttcttaatcttttcacaaataaa

SEQ ID NO: 2207963 - DNA, 22 bp, Homo sapiens
ttcttgtgccatagtcacatgg

SEQ ID NO: 2207964 - DNA, 16 bp, Homo sapiens
ttgacaaccatgagac

SEQ ID NO: 2207965 - DNA, 22 bp, Homo sapiens
ttgcatagtaccaatcatttta

SEQ ID NO: 2207966 - DNA, 15 bp, Homo sapiens
ttgccaaaaaggggt

SEQ ID NO: 2207967 - DNA, 15 bp, Homo sapiens
ttgcgtggactctgc

SEQ ID NO: 2207968 - DNA, 15 bp, Homo sapiens
ttggacactgtacaa

SEQ ID NO: 2207969 - DNA, 13 bp, Homo sapiens
ttgtgactagtgc

SEQ ID NO: 2207970 - DNA, 20 bp, Homo sapiens
tttaaaacaagaaagtttcc

SEQ ID NO: 2207971 - DNA, 18 bp, Homo sapiens
tttaaatatatgctaagt

SEQ ID NO: 2207972 - DNA, 13 bp, Homo sapiens
tttatatatgtat

SEQ ID NO: 2207973 - DNA, 20 bp, Homo sapiens
tttatctaatacctctgtgt

SEQ ID NO: 2207974 - DNA, 22 bp, Homo sapiens
tttcaattccacctgcaatcaa

SEQ ID NO: 2207975 - DNA, 13 bp, Homo sapiens
tttcacaaataaa

SEQ ID NO: 2207976 - DNA, 14 bp, Homo sapiens
tttcatttcaactg

SEQ ID NO: 2207977 - DNA, 17 bp, Homo sapiens
tttcctcttcctgccta

SEQ ID NO: 2207978 - DNA, 15 bp, Homo sapiens
tttccttccagccca

SEQ ID NO: 2207979 - DNA, 16 bp, Homo sapiens
tttccttccagcccag

SEQ ID NO: 2207980 - DNA, 19 bp, Homo sapiens
tttcctttcatttactgtg

SEQ ID NO: 2207981 - DNA, 18 bp, Homo sapiens
tttctggaatgtaatcaa

SEQ ID NO: 2207982 - DNA, 22 bp, Homo sapiens
tttcttttctggaatgtaatca

SEQ ID NO: 2207983 - DNA, 19 bp, Homo sapiens
tttgctgagcatgtactga

SEQ ID NO: 2207984 - DNA, 20 bp, Homo sapiens
tttggtaaaatacttcttga

SEQ ID NO: 2207985 - DNA, 21 bp, Homo sapiens
ttttaaagtaaccctacaaaa

SEQ ID NO: 2207986 - DNA, 11 bp, Homo sapiens
ttttaattatt

SEQ ID NO: 2207987 - DNA, 17 bp, Homo sapiens
ttttaattattattctt

SEQ ID NO: 2207988 - DNA, 13 bp, Homo sapiens
ttttcacaaataa

SEQ ID NO: 2207989 - DNA, 16 bp, Homo sapiens
ttttctataatttaaa

SEQ ID NO: 2207990 - DNA, 13 bp, Homo sapiens
ttttttatgctaa

SEQ ID NO: 2207991 - DNA, 23 bp, Homo sapiens
agtgttatcagtcataactaaat

SEQ ID NO: 2207992 - DNA, 19 bp, Homo sapiens
agttcaataaatgtctgtt

SEQ ID NO: 2207993 - DNA, 12 bp, Homo sapiens
agttcttgtgcc

SEQ ID NO: 2207994 - DNA, 13 bp, Homo sapiens
agttcttgtgcca

SEQ ID NO: 2207995 - DNA, 22 bp, Homo sapiens
agttgaaaatcttataatttaa

SEQ ID NO: 2207996 - DNA, 23 bp, Homo sapiens
agttgaaaatcttataatttaaa

SEQ ID NO: 2207997 - DNA, 22 bp, Homo sapiens
agttgcataggtttaataattt

SEQ ID NO: 2207998 - DNA, 16 bp, Homo sapiens
agttgcgtggactctg

SEQ ID NO: 2207999 - DNA, 20 bp, Homo sapiens
agttgcgtggactctgcaca

SEQ ID NO: 2208000 - DNA, 16 bp, Homo sapiens
agttggccagagagcc

SEQ ID NO: 2208001 - DNA, 17 bp, Homo sapiens
agtttccccaccagtga

SEQ ID NO: 2208002 - DNA, 19 bp, Homo sapiens
agtttccttccagcccaga

SEQ ID NO: 2208003 - DNA, 20 bp, Homo sapiens
agttttatcattttcaaaat

SEQ ID NO: 2208004 - DNA, 13 bp, Homo sapiens
ataaaatatcatt

SEQ ID NO: 2208005 - DNA, 12 bp, Homo sapiens
ataaactaaaga

SEQ ID NO: 2208006 - DNA, 12 bp, Homo sapiens
ataaatgtctgt

SEQ ID NO: 2208007 - DNA, 13 bp, Homo sapiens
ataagtaagtttg

SEQ ID NO: 2208008 - DNA, 18 bp, Homo sapiens
ataatcctaaacatatga

SEQ ID NO: 2208009 - DNA, 13 bp, Homo sapiens
atacctctgtgtg

SEQ ID NO: 2208010 - DNA, 14 bp, Homo sapiens
atagagtgttatca

SEQ ID NO: 2208011 - DNA, 17 bp, Homo sapiens
atagctactaattttaa

SEQ ID NO: 2208012 - DNA, 17 bp, Homo sapiens
ataggcgtaactaattt

SEQ ID NO: 2208013 - DNA, 14 bp, Homo sapiens
atatcagcaagtct

SEQ ID NO: 2208014 - DNA, 15 bp, Homo sapiens
atatcattcagcaac

SEQ ID NO: 2208015 - DNA, 19 bp, Homo sapiens
atatgcaccttgtgtctgt

SEQ ID NO: 2208016 - DNA, 15 bp, Homo sapiens
atatggcctcaagat

SEQ ID NO: 2208017 - DNA, 16 bp, Homo sapiens
atatggcctcaagatc

SEQ ID NO: 2208018 - DNA, 21 bp, Homo sapiens
atcaaaactttcttttctgga

SEQ ID NO: 2208019 - DNA, 16 bp, Homo sapiens
atcagaccataatgtt

SEQ ID NO: 2208020 - DNA, 21 bp, Homo sapiens
atcagcaagtctctttatatg

SEQ ID NO: 2208021 - DNA, 14 bp, Homo sapiens
atcatccagaagtt

SEQ ID NO: 2208022 - DNA, 12 bp, Homo sapiens
atcattcagcaa

SEQ ID NO: 2208023 - DNA, 17 bp, Homo sapiens
atctaatacctctgtgt

SEQ ID NO: 2208024 - DNA, 22 bp, Homo sapiens
atctaatacctctgtgtgctcc

SEQ ID NO: 2208025 - DNA, 17 bp, Homo sapiens
atctggttaggatggca

SEQ ID NO: 2208026 - DNA, 15 bp, Homo sapiens
atcttataatttaaa

SEQ ID NO: 2208027 - DNA, 15 bp, Homo sapiens
atcttttcacaaata

SEQ ID NO: 2208028 - DNA, 16 bp, Homo sapiens
atcttttcacaaataa

SEQ ID NO: 2208029 - DNA, 18 bp, Homo sapiens
atgaacttgtaaaggaat

SEQ ID NO: 2208030 - DNA, 23 bp, Homo sapiens
atgagaagaaaatggaaccaggc

SEQ ID NO: 2208031 - DNA, 22 bp, Homo sapiens
atgccctttcttgaattgcatt

SEQ ID NO: 2208032 - DNA, 20 bp, Homo sapiens
atgcgacactgggaggccag

SEQ ID NO: 2208033 - DNA, 20 bp, Homo sapiens
atgctaagggcaggcccaaa

SEQ ID NO: 2208034 - DNA, 17 bp, Homo sapiens
atggaaccaggcttgga

SEQ ID NO: 2208035 - DNA, 15 bp, Homo sapiens
atggagttcttgtgc

SEQ ID NO: 2208036 - DNA, 21 bp, Homo sapiens
atggcctcaagatcaatgaaa

SEQ ID NO: 2208037 - DNA, 18 bp, Homo sapiens
atgggaatcaagatttaa

SEQ ID NO: 2208038 - DNA, 15 bp, Homo sapiens
atgggtgaaggctgg

SEQ ID NO: 2208039 - DNA, 16 bp, Homo sapiens
atgggtgaaggctggc

SEQ ID NO: 2208040 - DNA, 13 bp, Homo sapiens
atgtcttggacac

SEQ ID NO: 2208041 - DNA, 16 bp, Homo sapiens
atgtcttggacactgt

SEQ ID NO: 2208042 - DNA, 19 bp, Homo sapiens
atgtcttggacactgtaca

SEQ ID NO: 2208043 - DNA, 14 bp, Homo sapiens
atgtcttgtacatg

SEQ ID NO: 2208044 - DNA, 14 bp, Homo sapiens
atgttacattatta

SEQ ID NO: 2208045 - DNA, 17 bp, Homo sapiens
atgttattttttaatta

SEQ ID NO: 2208046 - DNA, 22 bp, Homo sapiens
atgtttacactctttgtaagag

SEQ ID NO: 2208047 - DNA, 22 bp, Homo sapiens
atgtttcttctaggttctaaaa

SEQ ID NO: 2208048 - DNA, 23 bp, Homo sapiens
attaatgctaagggcaggcccaa

SEQ ID NO: 2208049 - DNA, 19 bp, Homo sapiens
attacagatgggcaaatta

SEQ ID NO: 2208050 - DNA, 23 bp, Homo sapiens
attagtcattcaataaattgtaa

SEQ ID NO: 2208051 - DNA, 15 bp, Homo sapiens
attatatttacaaat

SEQ ID NO: 2208052 - DNA, 14 bp, Homo sapiens
attatcaagctaat

SEQ ID NO: 2208053 - DNA, 17 bp, Homo sapiens
attatcaagctaataaa

SEQ ID NO: 2208054 - DNA, 18 bp, Homo sapiens
attatgggaatcaagatt

SEQ ID NO: 2208055 - DNA, 11 bp, Homo sapiens
attattaaagg

SEQ ID NO: 2208056 - DNA, 16 bp, Homo sapiens
attattattcttcata

SEQ ID NO: 2208057 - DNA, 16 bp, Homo sapiens
attatttatatatgta

SEQ ID NO: 2208058 - DNA, 15 bp, Homo sapiens
attctaaatgaatgt

SEQ ID NO: 2208059 - DNA, 18 bp, Homo sapiens
attgatagagtgttatca

SEQ ID NO: 2208060 - DNA, 12 bp, Homo sapiens
attgattagaaa

SEQ ID NO: 2208061 - DNA, 20 bp, Homo sapiens
attgcattttttaaaacaag

SEQ ID NO: 2208062 - DNA, 21 bp, Homo sapiens
attgctatctattgataattt

SEQ ID NO: 2208063 - DNA, 16 bp, Homo sapiens
attgtagtcctgtaat

SEQ ID NO: 2208064 - DNA, 14 bp, Homo sapiens
atttatatatgtat

SEQ ID NO: 2208065 - DNA, 17 bp, Homo sapiens
atttcacttaataatgt

SEQ ID NO: 2208066 - DNA, 18 bp, Homo sapiens
atttcatttcaactgttt

SEQ ID NO: 2208067 - DNA, 19 bp, Homo sapiens
atttcatttttacccttac

SEQ ID NO: 2208068 - DNA, 23 bp, Homo sapiens
attttaattattattcttcataa

SEQ ID NO: 2208069 - DNA, 17 bp, Homo sapiens
attttatagctactaat

SEQ ID NO: 2208070 - DNA, 18 bp, Homo sapiens
attttctataatttaaat

SEQ ID NO: 2208071 - DNA, 19 bp, Homo sapiens
attttctataatttaaata

SEQ ID NO: 2208072 - DNA, 22 bp, Homo sapiens
atttttgtgattttgtgattga

SEQ ID NO: 2208073 - DNA, 17 bp, Homo sapiens
caaattatcaagctaat

SEQ ID NO: 2208074 - DNA, 21 bp, Homo sapiens
caaattatcaagctaataaaa

SEQ ID NO: 2208075 - DNA, 19 bp, Homo sapiens
caaattgccttcattttat

SEQ ID NO: 2208076 - DNA, 15 bp, Homo sapiens
caacacgcaggagca

SEQ ID NO: 2208077 - DNA, 23 bp, Homo sapiens
caaccatgagaccactgttatca

SEQ ID NO: 2208078 - DNA, 13 bp, Homo sapiens
caagaaagtttcc

SEQ ID NO: 2208079 - DNA, 14 bp, Homo sapiens
caagaaagtttccc

SEQ ID NO: 2208080 - DNA, 14 bp, Homo sapiens
caagcaagactgag

SEQ ID NO: 2208081 - DNA, 18 bp, Homo sapiens
caagccagggtgtgtctc

SEQ ID NO: 2208082 - DNA, 21 bp, Homo sapiens
caagctaataaaatatcattc

SEQ ID NO: 2208083 - DNA, 18 bp, Homo sapiens
caaggaaaaaataacaat

SEQ ID NO: 2208084 - DNA, 15 bp, Homo sapiens
caataaatgtctgtt

SEQ ID NO: 2208085 - DNA, 19 bp, Homo sapiens
caatgttactatctgcttt

SEQ ID NO: 2208086 - DNA, 22 bp, Homo sapiens
caatttcacgacacactttgat

SEQ ID NO: 2208087 - DNA, 10 bp, Homo sapiens
cacaaataaa

SEQ ID NO: 2208088 - DNA, 12 bp, Homo sapiens
cacagcccagcc

SEQ ID NO: 2208089 - DNA, 15 bp, Homo sapiens
cacatggcctatgca

SEQ ID NO: 2208090 - DNA, 15 bp, Homo sapiens
caccacgtcacttca

SEQ ID NO: 2208091 - DNA, 19 bp, Homo sapiens
cacccacatgtgacacata

SEQ ID NO: 2208092 - DNA, 21 bp, Homo sapiens
cacccacatgtgacacatatg

SEQ ID NO: 2208093 - DNA, 14 bp, Homo sapiens
cacctaaagcagcc

SEQ ID NO: 2208094 - DNA, 17 bp, Homo sapiens
cacctaaagcagccagc

SEQ ID NO: 2208095 - DNA, 22 bp, Homo sapiens
cacctacttttctttcctcaga

SEQ ID NO: 2208096 - DNA, 15 bp, Homo sapiens
cacgcagccaggaca

SEQ ID NO: 2208097 - DNA, 21 bp, Homo sapiens
cacgcagccaggacaccgggc

SEQ ID NO: 2208098 - DNA, 23 bp, Homo sapiens
cacggacgctggctccccaaagg

SEQ ID NO: 2208099 - DNA, 15 bp, Homo sapiens
cacgggcagcctggc

SEQ ID NO: 2208100 - DNA, 16 bp, Homo sapiens
cacgtgtcctgtagtt

SEQ ID NO: 2208101 - DNA, 17 bp, Homo sapiens
cactggactgacctggt

SEQ ID NO: 2208102 - DNA, 14 bp, Homo sapiens
cactgggaggccag

SEQ ID NO: 2208103 - DNA, 17 bp, Homo sapiens
cacttattctcaagaag

SEQ ID NO: 2208104 - DNA, 13 bp, Homo sapiens
cagaaacaggacc

SEQ ID NO: 2208105 - DNA, 16 bp, Homo sapiens
cagaagcttctgccca

SEQ ID NO: 2208106 - DNA, 16 bp, Homo sapiens
cagaccataatgttac

SEQ ID NO: 2208107 - DNA, 13 bp, Homo sapiens
cagaccccttggc

SEQ ID NO: 2208108 - DNA, 15 bp, Homo sapiens
cagaccccttggcca

SEQ ID NO: 2208109 - DNA, 22 bp, Homo sapiens
cagacctaggatttcatgattt

SEQ ID NO: 2208110 - DNA, 17 bp, Homo sapiens
cagactgatcaggacct

SEQ ID NO: 2208111 - DNA, 16 bp, Homo sapiens
cagagacaaggagggc

SEQ ID NO: 2208112 - DNA, 19 bp, Homo sapiens
cagagagcctggtgctgct

SEQ ID NO: 2208113 - DNA, 21 bp, Homo sapiens
cagaggactgtgatgccctgc

SEQ ID NO: 2208114 - DNA, 11 bp, Homo sapiens
cagcagactga

SEQ ID NO: 2208115 - DNA, 20 bp, Homo sapiens
cagccacggacgctggctcc

SEQ ID NO: 2208116 - DNA, 13 bp, Homo sapiens
cagccagaggcac

SEQ ID NO: 2208117 - DNA, 14 bp, Homo sapiens
cagccagccgtgag

SEQ ID NO: 2208118 - DNA, 12 bp, Homo sapiens
cagccaggacac

SEQ ID NO: 2208119 - DNA, 16 bp, Homo sapiens
cagccaggacaccggg

SEQ ID NO: 2208120 - DNA, 15 bp, Homo sapiens
cagcccagccacgga

SEQ ID NO: 2208121 - DNA, 18 bp, Homo sapiens
cagccgtcacccctgcct

SEQ ID NO: 2208122 - DNA, 18 bp, Homo sapiens
cagcctggccacgcagcc

SEQ ID NO: 2208123 - DNA, 21 bp, Homo sapiens
cagcctggccacgcagccagg

SEQ ID NO: 2208124 - DNA, 22 bp, Homo sapiens
cagcctggccacgcagccagga

SEQ ID NO: 2208125 - DNA, 20 bp, Homo sapiens
cagcctggctcccaggacac

SEQ ID NO: 2208126 - DNA, 13 bp, Homo sapiens
cagctcagcttcc

SEQ ID NO: 2208127 - DNA, 16 bp, Homo sapiens
caggacgtgggctggg

SEQ ID NO: 2208128 - DNA, 12 bp, Homo sapiens
caggagcttcct

SEQ ID NO: 2208129 - DNA, 23 bp, Homo sapiens
caggagcttcctgtcctcccagc

SEQ ID NO: 2208130 - DNA, 21 bp, Homo sapiens
caggagttcaataaatgtctg

SEQ ID NO: 2208131 - DNA, 23 bp, Homo sapiens
caggagttcaataaatgtctgtt

SEQ ID NO: 2208132 - DNA, 17 bp, Homo sapiens
caggcagttggccagag

SEQ ID NO: 2208133 - DNA, 23 bp, Homo sapiens
caggcccaaattatcaagctaat

SEQ ID NO: 2208134 - DNA, 15 bp, Homo sapiens
cagggcacctgccac

SEQ ID NO: 2208135 - DNA, 14 bp, Homo sapiens
cagggccgccaggg

SEQ ID NO: 2208136 - DNA, 15 bp, Homo sapiens
tagcagacagtgttt

SEQ ID NO: 2208137 - DNA, 18 bp, Homo sapiens
tagcatgtcgtcaaagct

SEQ ID NO: 2208138 - DNA, 21 bp, Homo sapiens
tagcatgtcgtcaaagctgaa

SEQ ID NO: 2208139 - DNA, 15 bp, Homo sapiens
tagccagaggactgt

SEQ ID NO: 2208140 - DNA, 21 bp, Homo sapiens
tagctccccgcttctgcctgc

SEQ ID NO: 2208141 - DNA, 20 bp, Homo sapiens
taggaggaccagagctactg

SEQ ID NO: 2208142 - DNA, 12 bp, Homo sapiens
taggttctaaaa

SEQ ID NO: 2208143 - DNA, 16 bp, Homo sapiens
tagtaccaatcatttt

SEQ ID NO: 2208144 - DNA, 18 bp, Homo sapiens
tagtgctgaagcttatta

SEQ ID NO: 2208145 - DNA, 19 bp, Homo sapiens
tagtgctgaagcttattaa

SEQ ID NO: 2208146 - DNA, 22 bp, Homo sapiens
tagttgcgtggactctgcacat

SEQ ID NO: 2208147 - DNA, 20 bp, Homo sapiens
tataatatactatatttatg

SEQ ID NO: 2208148 - DNA, 18 bp, Homo sapiens
tataatgttgttatttaa

SEQ ID NO: 2208149 - DNA, 16 bp, Homo sapiens
tatactatatttatgg

SEQ ID NO: 2208150 - DNA, 12 bp, Homo sapiens
tatcaagctaat

SEQ ID NO: 2208151 - DNA, 20 bp, Homo sapiens
tatctaatacctctgtgtgc

SEQ ID NO: 2208152 - DNA, 14 bp, Homo sapiens
tatgcaccttgtgt

SEQ ID NO: 2208153 - DNA, 12 bp, Homo sapiens
tatggactctgc

SEQ ID NO: 2208154 - DNA, 15 bp, Homo sapiens
tatggactctgcaca

SEQ ID NO: 2208155 - DNA, 16 bp, Homo sapiens
tatgtaccatgtacat

SEQ ID NO: 2208156 - DNA, 12 bp, Homo sapiens
tatgtatttata

SEQ ID NO: 2208157 - DNA, 14 bp, Homo sapiens
tatgtcttggacac

SEQ ID NO: 2208158 - DNA, 19 bp, Homo sapiens
tatgtcttggacactgtac

SEQ ID NO: 2208159 - DNA, 17 bp, Homo sapiens
tattatatttacaaatg

SEQ ID NO: 2208160 - DNA, 20 bp, Homo sapiens
tatttaagataattataata

SEQ ID NO: 2208161 - DNA, 16 bp, Homo sapiens
tatttataaatatatt

SEQ ID NO: 2208162 - DNA, 16 bp, Homo sapiens
tcaagatcaatgaaat

SEQ ID NO: 2208163 - DNA, 20 bp, Homo sapiens
tcaaggactttctgaagcct

SEQ ID NO: 2208164 - DNA, 12 bp, Homo sapiens
tcacatttaaat

SEQ ID NO: 2208165 - DNA, 16 bp, Homo sapiens
tcaccttcagtaaccc

SEQ ID NO: 2208166 - DNA, 16 bp, Homo sapiens
tcactgtgagctccca

SEQ ID NO: 2208167 - DNA, 17 bp, Homo sapiens
tcacttgtgcagtgttg

SEQ ID NO: 2208168 - DNA, 16 bp, Homo sapiens
tcagttttatcatttt

SEQ ID NO: 2208169 - DNA, 17 bp, Homo sapiens
tcagtttttgtgaaaag

SEQ ID NO: 2208170 - DNA, 22 bp, Homo sapiens
tcatatgtaccatgtacatgaa

SEQ ID NO: 2208171 - DNA, 23 bp, Homo sapiens
tcatgatttcatttcaactgttt

SEQ ID NO: 2208172 - DNA, 22 bp, Homo sapiens
tcattttggtaaaatacttctt

SEQ ID NO: 2208173 - DNA, 12 bp, Homo sapiens
tccacagggcac

SEQ ID NO: 2208174 - DNA, 20 bp, Homo sapiens
tccacttctttcagcagact

SEQ ID NO: 2208175 - DNA, 12 bp, Homo sapiens
tccataatcact

SEQ ID NO: 2208176 - DNA, 18 bp, Homo sapiens
tcccacccacatgtgaca

SEQ ID NO: 2208177 - DNA, 13 bp, Homo sapiens
tccccaccagtga

SEQ ID NO: 2208178 - DNA, 16 bp, Homo sapiens
tcctccttggtgcctg

SEQ ID NO: 2208179 - DNA, 16 bp, Homo sapiens
tcctgagaccacagag

SEQ ID NO: 2208180 - DNA, 16 bp, Homo sapiens
tcctttcatttactgt

SEQ ID NO: 2208181 - DNA, 20 bp, Homo sapiens
tcctttcatttactgtggct

SEQ ID NO: 2208182 - DNA, 20 bp, Homo sapiens
tctaaagccattgtagtcct

SEQ ID NO: 2208183 - DNA, 16 bp, Homo sapiens
tctaatacctctgtgt

SEQ ID NO: 2208184 - DNA, 14 bp, Homo sapiens
tctaggttctaaaa

SEQ ID NO: 2208185 - DNA, 15 bp, Homo sapiens
tctgcacatgtcttg

SEQ ID NO: 2208186 - DNA, 17 bp, Homo sapiens
tctgcacatgtcttgta

SEQ ID NO: 2208187 - DNA, 18 bp, Homo sapiens
tctggaatgtaatcaatg

SEQ ID NO: 2208188 - DNA, 22 bp, Homo sapiens
tctggaatgtaatcaatgtttc

SEQ ID NO: 2208189 - DNA, 17 bp, Homo sapiens
tctggggttatgatggc

SEQ ID NO: 2208190 - DNA, 20 bp, Homo sapiens
tcttaatcttttcacaaata

SEQ ID NO: 2208191 - DNA, 21 bp, Homo sapiens
tcttaatcttttcacaaataa

SEQ ID NO: 2208192 - DNA, 13 bp, Homo sapiens
tcttataatttaa

SEQ ID NO: 2208193 - DNA, 14 bp, Homo sapiens
tcttataatttaaa

SEQ ID NO: 2208194 - DNA, 16 bp, Homo sapiens
tcttctgggcaccctc

SEQ ID NO: 2208195 - DNA, 14 bp, Homo sapiens
tcttgtacatgtgt

SEQ ID NO: 2208196 - DNA, 11 bp, Homo sapiens
tcttgtgacta

SEQ ID NO: 2208197 - DNA, 16 bp, Homo sapiens
tcttgtgactagtgct

SEQ ID NO: 2208198 - DNA, 17 bp, Homo sapiens
tctttcacatttaaata

SEQ ID NO: 2208199 - DNA, 13 bp, Homo sapiens
tcttttcacaaat

SEQ ID NO: 2208200 - DNA, 20 bp, Homo sapiens
tgaaaagctccatttttagt

SEQ ID NO: 2208201 - DNA, 21 bp, Homo sapiens
tgaaagtcttgtgactagtgc

SEQ ID NO: 2208202 - DNA, 23 bp, Homo sapiens
tgaaagtcttgtgactagtgctg

SEQ ID NO: 2208203 - DNA, 15 bp, Homo sapiens
tgaactcttaatcaa

SEQ ID NO: 2208204 - DNA, 21 bp, Homo sapiens
tgaactcttaatcaaatagca

SEQ ID NO: 2208205 - DNA, 20 bp, Homo sapiens
tgaagcttattaatgctaag

SEQ ID NO: 2208206 - DNA, 15 bp, Homo sapiens
tgaatactttataaa

SEQ ID NO: 2208207 - DNA, 22 bp, Homo sapiens
tgaatgcagtctgtccaggctc

SEQ ID NO: 2208208 - DNA, 21 bp, Homo sapiens
tgaattgcattttttaaaaca

SEQ ID NO: 2208209 - DNA, 22 bp, Homo sapiens
tgaattgcattttttaaaacaa

SEQ ID NO: 2208210 - DNA, 16 bp, Homo sapiens
tgaccaggcatcctcc

SEQ ID NO: 2208211 - DNA, 20 bp, Homo sapiens
tgacctggtccacagggcac

SEQ ID NO: 2208212 - DNA, 14 bp, Homo sapiens
tgactagtgctgaa

SEQ ID NO: 2208213 - DNA, 17 bp, Homo sapiens
tgactagtgctgaagct

SEQ ID NO: 2208214 - DNA, 22 bp, Homo sapiens
tgagaagaaaatggaaccaggc

SEQ ID NO: 2208215 - DNA, 13 bp, Homo sapiens
tgagaccacagag

SEQ ID NO: 2208216 - DNA, 17 bp, Homo sapiens
tgagcaatgtataaccc

SEQ ID NO: 2208217 - DNA, 21 bp, Homo sapiens
tgagtgcagaccccttggcca

SEQ ID NO: 2208218 - DNA, 20 bp, Homo sapiens
tgatgctacaggatttgaaa

SEQ ID NO: 2208219 - DNA, 23 bp, Homo sapiens
tgatgctacaggatttgaaattg

SEQ ID NO: 2208220 - DNA, 12 bp, Homo sapiens
tgatggccacaa

SEQ ID NO: 2208221 - DNA, 14 bp, Homo sapiens
tgcacaagccaggg

SEQ ID NO: 2208222 - DNA, 23 bp, Homo sapiens
tgcacatgaatcccacccacatg

SEQ ID NO: 2208223 - DNA, 17 bp, Homo sapiens
tgcacccacccaggagt

SEQ ID NO: 2208224 - DNA, 14 bp, Homo sapiens
tgcaccttgtgtct

SEQ ID NO: 2208225 - DNA, 16 bp, Homo sapiens
tgcaccttgtgtctgt

SEQ ID NO: 2208226 - DNA, 19 bp, Homo sapiens
tgcagtctgtccaggctcg

SEQ ID NO: 2208227 - DNA, 16 bp, Homo sapiens
tgcatgtatgtcttgg

SEQ ID NO: 2208228 - DNA, 16 bp, Homo sapiens
tgccatagtcacatgg

SEQ ID NO: 2208229 - DNA, 18 bp, Homo sapiens
tgcccttggcacccaaga

SEQ ID NO: 2208230 - DNA, 16 bp, Homo sapiens
tgccttctacttttaa

SEQ ID NO: 2208231 - DNA, 19 bp, Homo sapiens
tgcgacactgggaggccag

SEQ ID NO: 2208232 - DNA, 13 bp, Homo sapiens
tgctgaagcttat

SEQ ID NO: 2208233 - DNA, 19 bp, Homo sapiens
tgctgaagcttattaatgc

SEQ ID NO: 2208234 - DNA, 20 bp, Homo sapiens
tgctgaagcttattaatgct

SEQ ID NO: 2208235 - DNA, 12 bp, Homo sapiens
tgctgctgctgc

SEQ ID NO: 2208236 - DNA, 19 bp, Homo sapiens
tggaagggatggggtgcca

SEQ ID NO: 2208237 - DNA, 15 bp, Homo sapiens
tggacacaggcctgc

SEQ ID NO: 2208238 - DNA, 15 bp, Homo sapiens
tggactctgcacatg

SEQ ID NO: 2208239 - DNA, 16 bp, Homo sapiens
tggactctgcacatga

SEQ ID NO: 2208240 - DNA, 18 bp, Homo sapiens
tggactctgcacatgtct

SEQ ID NO: 2208241 - DNA, 14 bp, Homo sapiens
tggagttcttgtgc

SEQ ID NO: 2208242 - DNA, 20 bp, Homo sapiens
tggcaggacgtgggctgggc

SEQ ID NO: 2208243 - DNA, 14 bp, Homo sapiens
tggccacgcagcca

SEQ ID NO: 2208244 - DNA, 17 bp, Homo sapiens
tggccacgcagccagga

SEQ ID NO: 2208245 - DNA, 19 bp, Homo sapiens
tggccacgcagccaggaca

SEQ ID NO: 2208246 - DNA, 13 bp, Homo sapiens
tggccagagagcc

SEQ ID NO: 2208247 - DNA, 23 bp, Homo sapiens
tggccgcacctaaagcagccagc

SEQ ID NO: 2208248 - DNA, 14 bp, Homo sapiens
tggcctatgcacat

SEQ ID NO: 2208249 - DNA, 13 bp, Homo sapiens
tggcctcaagatc

SEQ ID NO: 2208250 - DNA, 21 bp, Homo sapiens
tggcctcaagatcaatgaaat

SEQ ID NO: 2208251 - DNA, 18 bp, Homo sapiens
tggcctggcacacatcag

SEQ ID NO: 2208252 - DNA, 21 bp, Homo sapiens
tggcttgagtttaaattgtaa

SEQ ID NO: 2208253 - DNA, 18 bp, Homo sapiens
tgggaaacaaaaggataa

SEQ ID NO: 2208254 - DNA, 23 bp, Homo sapiens
tgggacctcagttttatcatttt

SEQ ID NO: 2208255 - DNA, 22 bp, Homo sapiens
tggggtcctgtggggcccccac

SEQ ID NO: 2208256 - DNA, 16 bp, Homo sapiens
tgggtgaaggctggca

SEQ ID NO: 2208257 - DNA, 17 bp, Homo sapiens
tggtgcctggcctggca

SEQ ID NO: 2208258 - DNA, 23 bp, Homo sapiens
tggtgcctggcctggcacacatc

SEQ ID NO: 2208259 - DNA, 24 bp, Homo sapiens
tggtgcctggcctggcacacatca

SEQ ID NO: 2208260 - DNA, 20 bp, Homo sapiens
tgtaatcaatgtttcttcta

SEQ ID NO: 2208261 - DNA, 13 bp, Homo sapiens
tgtaattctaaat

SEQ ID NO: 2208262 - DNA, 15 bp, Homo sapiens
tgtaattctaaatga

SEQ ID NO: 2208263 - DNA, 16 bp, Homo sapiens
tgtacacgtgtcctgt

SEQ ID NO: 2208264 - DNA, 11 bp, Homo sapiens
tgtacatgtgt

SEQ ID NO: 2208265 - DNA, 21 bp, Homo sapiens
tgtacatgtgtagcctgtgca

SEQ ID NO: 2208266 - DNA, 19 bp, Homo sapiens
tgtactgagccttgtaatt

SEQ ID NO: 2208267 - DNA, 16 bp, Homo sapiens
tgtagcctgtgcatgt

SEQ ID NO: 2208268 - DNA, 22 bp, Homo sapiens
tgtagcctgtgcatgtatgtct

SEQ ID NO: 2208269 - DNA, 15 bp, Homo sapiens
tgtagttgcgtggac

SEQ ID NO: 2208270 - DNA, 13 bp, Homo sapiens
tgtattacaaatc

SEQ ID NO: 2208271 - DNA, 14 bp, Homo sapiens
tgtatttataaata

SEQ ID NO: 2208272 - DNA, 18 bp, Homo sapiens
tgtcctcccagctcctca

SEQ ID NO: 2208273 - DNA, 20 bp, Homo sapiens
tgtctgtacacgtgtcctgt

SEQ ID NO: 2208274 - DNA, 21 bp, Homo sapiens
tgtctgtacacgtgtcctgta

SEQ ID NO: 2208275 - DNA, 15 bp, Homo sapiens
tgtcttggacactgt

SEQ ID NO: 2208276 - DNA, 13 bp, Homo sapiens
tgtcttgtacatg

SEQ ID NO: 2208277 - DNA, 16 bp, Homo sapiens
tgtcttgtacatgtgt

SEQ ID NO: 2208278 - DNA, 20 bp, Homo sapiens
tgtcttgtacatgtgtagcc

SEQ ID NO: 2208279 - DNA, 14 bp, Homo sapiens
tgtgactagtgctg

SEQ ID NO: 2208280 - DNA, 23 bp, Homo sapiens
tgtgagctcccaggtgcagccag

SEQ ID NO: 2208281 - DNA, 13 bp, Homo sapiens
aggtgcagccaga

SEQ ID NO: 2208282 - DNA, 13 bp, Homo sapiens
agtaaaatccaca

SEQ ID NO: 2208283 - DNA, 23 bp, Homo sapiens
agtcacatggcctatgcacatat

SEQ ID NO: 2208284 - DNA, 16 bp, Homo sapiens
agtctagactaaaaga

SEQ ID NO: 2208285 - DNA, 22 bp, Homo sapiens
agtcttgtgactagtgctgaag

SEQ ID NO: 2208286 - DNA, 23 bp, Homo sapiens
agtcttgtgactagtgctgaagc

SEQ ID NO: 2208287 - DNA, 15 bp, Homo sapiens
agtgagccactccgg

SEQ ID NO: 2208288 - DNA, 13 bp, Homo sapiens
agtgctgaagctt

SEQ ID NO: 2208289 - DNA, 21 bp, Homo sapiens
agtgctgaagcttattaatgc

SEQ ID NO: 2208290 - DNA, 14 bp, Homo sapiens
agtgtgaccaggca

SEQ ID NO: 2208291 - DNA, 14 bp, Homo sapiens
agtgtgtgtctttc

SEQ ID NO: 2208292 - DNA, 13 bp, Homo sapiens
agtgttttctggg

SEQ ID NO: 2208293 - DNA, 20 bp, Homo sapiens
agttattatatttacaaatg

SEQ ID NO: 2208294 - DNA, 18 bp, Homo sapiens
agttcatatgtaccatgt

SEQ ID NO: 2208295 - DNA, 14 bp, Homo sapiens
agttgcttgtaaaa

SEQ ID NO: 2208296 - DNA, 14 bp, Homo sapiens
agtttaaattgtaa

SEQ ID NO: 2208297 - DNA, 15 bp, Homo sapiens
agttttatcattttc

SEQ ID NO: 2208298 - DNA, 15 bp, Homo sapiens
ataaaagacagtgaa

SEQ ID NO: 2208299 - DNA, 16 bp, Homo sapiens
ataaaagacagtgaaa

SEQ ID NO: 2208300 - DNA, 15 bp, Homo sapiens
ataaaatatcattca

SEQ ID NO: 2208301 - DNA, 17 bp, Homo sapiens
ataaaatatcattcagc

SEQ ID NO: 2208302 - DNA, 14 bp, Homo sapiens
ataaataaaaataa

SEQ ID NO: 2208303 - DNA, 23 bp, Homo sapiens
ataaccgtttcctttcatttact

SEQ ID NO: 2208304 - DNA, 23 bp, Homo sapiens
ataagttctagttgcttgtaaaa

SEQ ID NO: 2208305 - DNA, 21 bp, Homo sapiens
atacagttcggtgagctacaa

SEQ ID NO: 2208306 - DNA, 23 bp, Homo sapiens
atagcatctttgaatacaaagaa

SEQ ID NO: 2208307 - DNA, 18 bp, Homo sapiens
atagctactaattttaaa

SEQ ID NO: 2208308 - DNA, 15 bp, Homo sapiens
ataggtttaataatt

SEQ ID NO: 2208309 - DNA, 19 bp, Homo sapiens
atagtctagactaaaagat

SEQ ID NO: 2208310 - DNA, 21 bp, Homo sapiens
atataataaatgtacattaat

SEQ ID NO: 2208311 - DNA, 21 bp, Homo sapiens
atataatgttgttatttaaag

SEQ ID NO: 2208312 - DNA, 14 bp, Homo sapiens
atatcattcagcaa

SEQ ID NO: 2208313 - DNA, 15 bp, Homo sapiens
atatgcacaatagca

SEQ ID NO: 2208314 - DNA, 15 bp, Homo sapiens
atatgcaccttgtgt

SEQ ID NO: 2208315 - DNA, 20 bp, Homo sapiens
atatgcaccttgtgtctgta

SEQ ID NO: 2208316 - DNA, 21 bp, Homo sapiens
atatgcaccttgtgtctgtac

SEQ ID NO: 2208317 - DNA, 15 bp, Homo sapiens
atatggactctgcac

SEQ ID NO: 2208318 - DNA, 19 bp, Homo sapiens
atatgtaccatgtacatga

SEQ ID NO: 2208319 - DNA, 13 bp, Homo sapiens
atcaagctaataa

SEQ ID NO: 2208320 - DNA, 20 bp, Homo sapiens
atcagaccataatgttacat

SEQ ID NO: 2208321 - DNA, 13 bp, Homo sapiens
atcattcagcaac

SEQ ID NO: 2208322 - DNA, 14 bp, Homo sapiens
atcattttaattat

SEQ ID NO: 2208323 - DNA, 16 bp, Homo sapiens
atccaagcaagactga

SEQ ID NO: 2208324 - DNA, 14 bp, Homo sapiens
atccacttctttca

SEQ ID NO: 2208325 - DNA, 14 bp, Homo sapiens
atcccacccacatg

SEQ ID NO: 2208326 - DNA, 23 bp, Homo sapiens
atcctagagatttggtgtacaat

SEQ ID NO: 2208327 - DNA, 18 bp, Homo sapiens
atcctctgagtgtgacca

SEQ ID NO: 2208328 - DNA, 15 bp, Homo sapiens
atctaatacctctgt

SEQ ID NO: 2208329 - DNA, 19 bp, Homo sapiens
atctagacccatcttcttt

SEQ ID NO: 2208330 - DNA, 22 bp, Homo sapiens
atcttataatttaaaatatgct

SEQ ID NO: 2208331 - DNA, 18 bp, Homo sapiens
atgaaagtcttgtgacta

SEQ ID NO: 2208332 - DNA, 19 bp, Homo sapiens
atgaaagtcttgtgactag

SEQ ID NO: 2208333 - DNA, 21 bp, Homo sapiens
atgaatcccacccacatgtga

SEQ ID NO: 2208334 - DNA, 22 bp, Homo sapiens
atgaatgtttacactctttgta

SEQ ID NO: 2208335 - DNA, 21 bp, Homo sapiens
atgagaagaaaatggaaccag

SEQ ID NO: 2208336 - DNA, 15 bp, Homo sapiens
atgatccaagcaaga

SEQ ID NO: 2208337 - DNA, 14 bp, Homo sapiens
atgatttcatttca

SEQ ID NO: 2208338 - DNA, 16 bp, Homo sapiens
atgcaccttgtgtctg

SEQ ID NO: 2208339 - DNA, 18 bp, Homo sapiens
atgcagtctgtccaggct

SEQ ID NO: 2208340 - DNA, 19 bp, Homo sapiens
atgcagtctgtccaggctc

SEQ ID NO: 2208341 - DNA, 20 bp, Homo sapiens
atgcagtctgtccaggctcg

SEQ ID NO: 2208342 - DNA, 15 bp, Homo sapiens
atggactctgcacat

SEQ ID NO: 2208343 - DNA, 21 bp, Homo sapiens
atggcaggacgtgggctgggc

SEQ ID NO: 2208344 - DNA, 17 bp, Homo sapiens
atgggtgaaggctggca

SEQ ID NO: 2208345 - DNA, 17 bp, Homo sapiens
atgtatttataaatata

SEQ ID NO: 2208346 - DNA, 16 bp, Homo sapiens
atgtctgttgatgact

SEQ ID NO: 2208347 - DNA, 14 bp, Homo sapiens
atgtgtagcctgtg

SEQ ID NO: 2208348 - DNA, 23 bp, Homo sapiens
atgtgtagcctgtgcatgtatgt

SEQ ID NO: 2208349 - DNA, 20 bp, Homo sapiens
atgttattttttaattatta

SEQ ID NO: 2208350 - DNA, 13 bp, Homo sapiens
atgttgaggtgga

SEQ ID NO: 2208351 - DNA, 13 bp, Homo sapiens
atgttgttattta

SEQ ID NO: 2208352 - DNA, 19 bp, Homo sapiens
atgtttacactctttgtaa

SEQ ID NO: 2208353 - DNA, 21 bp, Homo sapiens
atgtttacactctttgtaaga

SEQ ID NO: 2208354 - DNA, 15 bp, Homo sapiens
atgtttcttctaggt

SEQ ID NO: 2208355 - DNA, 13 bp, Homo sapiens
attaaagacagag

SEQ ID NO: 2208356 - DNA, 14 bp, Homo sapiens
attaatgctaaggg

SEQ ID NO: 2208357 - DNA, 15 bp, Homo sapiens
attaatgctaagggc

SEQ ID NO: 2208358 - DNA, 16 bp, Homo sapiens
attatatttacaaatg

SEQ ID NO: 2208359 - DNA, 17 bp, Homo sapiens
attatatttacaaatgg

SEQ ID NO: 2208360 - DNA, 15 bp, Homo sapiens
attatcaagctaata

SEQ ID NO: 2208361 - DNA, 22 bp, Homo sapiens
attatcaagctaataaaatatc

SEQ ID NO: 2208362 - DNA, 17 bp, Homo sapiens
attccaagtgattgaaa

SEQ ID NO: 2208363 - DNA, 18 bp, Homo sapiens
attctaaatgaatgttta

SEQ ID NO: 2208364 - DNA, 18 bp, Homo sapiens
attctaggcctcctggcc

SEQ ID NO: 2208365 - DNA, 17 bp, Homo sapiens
attcttgccaaatataa

SEQ ID NO: 2208366 - DNA, 13 bp, Homo sapiens
attgacagaagct

SEQ ID NO: 2208367 - DNA, 19 bp, Homo sapiens
attgcattttttaaaacaa

SEQ ID NO: 2208368 - DNA, 21 bp, Homo sapiens
attgcattttttaaaacaaga

SEQ ID NO: 2208369 - DNA, 23 bp, Homo sapiens
attgtaataggcgtaactaattt

SEQ ID NO: 2208370 - DNA, 15 bp, Homo sapiens
atttcatgatttcat

SEQ ID NO: 2208371 - DNA, 14 bp, Homo sapiens
attttctataattt

SEQ ID NO: 2208372 - DNA, 15 bp, Homo sapiens
attttctataattta

SEQ ID NO: 2208373 - DNA, 15 bp, Homo sapiens
attttttaattatta

SEQ ID NO: 2208374 - DNA, 20 bp, Homo sapiens
attttttaattattatttat

SEQ ID NO: 2208375 - DNA, 20 bp, Homo sapiens
caaacccagacggctccact

SEQ ID NO: 2208376 - DNA, 24 bp, Homo sapiens
caaacccagacggctccactagga

SEQ ID NO: 2208377 - DNA, 16 bp, Homo sapiens
caaagggtccagaagg

SEQ ID NO: 2208378 - DNA, 15 bp, Homo sapiens
caaatagcataagtt

SEQ ID NO: 2208379 - DNA, 18 bp, Homo sapiens
caaccatgagaccactgt

SEQ ID NO: 2208380 - DNA, 23 bp, Homo sapiens
caacttgtattaaagacagaggc

SEQ ID NO: 2208381 - DNA, 16 bp, Homo sapiens
caagacctcagggcac

SEQ ID NO: 2208382 - DNA, 23 bp, Homo sapiens
caagacctcagggcacaaagatg

SEQ ID NO: 2208383 - DNA, 14 bp, Homo sapiens
caagcaaacccaga

SEQ ID NO: 2208384 - DNA, 17 bp, Homo sapiens
caagctaataaaatatc

SEQ ID NO: 2208385 - DNA, 14 bp, Homo sapiens
caataaatgtctgt

SEQ ID NO: 2208386 - DNA, 16 bp, Homo sapiens
caataaatgtctgttg

SEQ ID NO: 2208387 - DNA, 19 bp, Homo sapiens
caatagcagacagtgtttt

SEQ ID NO: 2208388 - DNA, 22 bp, Homo sapiens
cacaaagatgggtgaaggctgg

SEQ ID NO: 2208389 - DNA, 20 bp, Homo sapiens
cacaaaggcaaagggtccag

SEQ ID NO: 2208390 - DNA, 16 bp, Homo sapiens
cacagcccagccacgg

SEQ ID NO: 2208391 - DNA, 23 bp, Homo sapiens
cacagcccagccacggacgctgg

SEQ ID NO: 2208392 - DNA, 18 bp, Homo sapiens
cacatatgcaccttgtgt

SEQ ID NO: 2208393 - DNA, 21 bp, Homo sapiens
cacatatgcaccttgtgtctg

SEQ ID NO: 2208394 - DNA, 13 bp, Homo sapiens
cacatgtgacaca

SEQ ID NO: 2208395 - DNA, 20 bp, Homo sapiens
caccagtgaatgaaagtctt

SEQ ID NO: 2208396 - DNA, 20 bp, Homo sapiens
cacccaagacctcagggcac

SEQ ID NO: 2208397 - DNA, 22 bp, Homo sapiens
cacccctgcctcccgccccctt

SEQ ID NO: 2208398 - DNA, 13 bp, Homo sapiens
caccgggcagggc

SEQ ID NO: 2208399 - DNA, 23 bp, Homo sapiens
cacctcaagaagaagaggggcat

SEQ ID NO: 2208400 - DNA, 22 bp, Homo sapiens
caccttgaagaacctctcactt

SEQ ID NO: 2208401 - DNA, 13 bp, Homo sapiens
cacgaaatgttat

SEQ ID NO: 2208402 - DNA, 15 bp, Homo sapiens
cacgaaatgttattt

SEQ ID NO: 2208403 - DNA, 19 bp, Homo sapiens
cacgcagccaggacaccgg

SEQ ID NO: 2208404 - DNA, 12 bp, Homo sapiens
cacgcaggagca

SEQ ID NO: 2208405 - DNA, 19 bp, Homo sapiens
cacggacgctggctcccca

SEQ ID NO: 2208406 - DNA, 14 bp, Homo sapiens
cacgggcagcctgg

SEQ ID NO: 2208407 - DNA, 18 bp, Homo sapiens
cacgggcagcctggctcc

SEQ ID NO: 2208408 - DNA, 15 bp, Homo sapiens
cacgtgtcctgtagt

SEQ ID NO: 2208409 - DNA, 15 bp, Homo sapiens
cactgttatcaaaac

SEQ ID NO: 2208410 - DNA, 13 bp, Homo sapiens
cagaaggagacag

SEQ ID NO: 2208411 - DNA, 17 bp, Homo sapiens
cagaaggagacaggcag

SEQ ID NO: 2208412 - DNA, 18 bp, Homo sapiens
cagaaggagacaggcaga

SEQ ID NO: 2208413 - DNA, 22 bp, Homo sapiens
cagaaggagacaggcagagctg

SEQ ID NO: 2208414 - DNA, 19 bp, Homo sapiens
cagaagggagctagccaga

SEQ ID NO: 2208415 - DNA, 21 bp, Homo sapiens
cagaagggagctagccagagg

SEQ ID NO: 2208416 - DNA, 16 bp, Homo sapiens
cagactgatcaggacc

SEQ ID NO: 2208417 - DNA, 19 bp, Homo sapiens
cagagaagctctcgggcta

SEQ ID NO: 2208418 - DNA, 20 bp, Homo sapiens
cagagacaaggagggcacag

SEQ ID NO: 2208419 - DNA, 22 bp, Homo sapiens
cagagagaggggagaagcctgg

SEQ ID NO: 2208420 - DNA, 14 bp, Homo sapiens
cagaggactgtgat

SEQ ID NO: 2208421 - DNA, 21 bp, Homo sapiens
cagaggagctgggagccgggc

SEQ ID NO: 2208422 - DNA, 20 bp, Homo sapiens
cagccaggacaccgggcagg

SEQ ID NO: 2208423 - DNA, 19 bp, Homo sapiens
cagcctggctcccaggaca

SEQ ID NO: 2208424 - DNA, 14 bp, Homo sapiens
cagctcagcttccc

SEQ ID NO: 2208425 - DNA, 22 bp, Homo sapiens
tactcaatgttactatctgctt

SEQ ID NO: 2208426 - DNA, 15 bp, Homo sapiens
tactgagccttgtaa

SEQ ID NO: 2208427 - DNA, 23 bp, Homo sapiens
tactgagccttgtaattctaaat

SEQ ID NO: 2208428 - DNA, 15 bp, Homo sapiens
tactgtggcttctta

SEQ ID NO: 2208429 - DNA, 15 bp, Homo sapiens
tagacccatcttctt

SEQ ID NO: 2208430 - DNA, 15 bp, Homo sapiens
tagatgaactcaact

SEQ ID NO: 2208431 - DNA, 16 bp, Homo sapiens
taggtcagtgcaaata

SEQ ID NO: 2208432 - DNA, 23 bp, Homo sapiens
tagtaccaatcattttaattatt

SEQ ID NO: 2208433 - DNA, 21 bp, Homo sapiens
tagtcacatggcctatgcaca

SEQ ID NO: 2208434 - DNA, 15 bp, Homo sapiens
tagtgctgaagctta

SEQ ID NO: 2208435 - DNA, 16 bp, Homo sapiens
tataataaatgtacat

SEQ ID NO: 2208436 - DNA, 17 bp, Homo sapiens
tataatatactatattt

SEQ ID NO: 2208437 - DNA, 17 bp, Homo sapiens
tataatgttgttattta

SEQ ID NO: 2208438 - DNA, 19 bp, Homo sapiens
tataatgttgttatttaaa

SEQ ID NO: 2208439 - DNA, 19 bp, Homo sapiens
tatcaaaactttcttttct

SEQ ID NO: 2208440 - DNA, 15 bp, Homo sapiens
tatcaagctaataaa

SEQ ID NO: 2208441 - DNA, 22 bp, Homo sapiens
tatcagtcataactaaataaag

SEQ ID NO: 2208442 - DNA, 12 bp, Homo sapiens
tatcattcagca

SEQ ID NO: 2208443 - DNA, 13 bp, Homo sapiens
tatcattcagcaa

SEQ ID NO: 2208444 - DNA, 14 bp, Homo sapiens
tatcattcagcaac

SEQ ID NO: 2208445 - DNA, 19 bp, Homo sapiens
tatgcacatatggactctg

SEQ ID NO: 2208446 - DNA, 14 bp, Homo sapiens
tattaatgctaagg

SEQ ID NO: 2208447 - DNA, 16 bp, Homo sapiens
tatttatatatgtatt

SEQ ID NO: 2208448 - DNA, 23 bp, Homo sapiens
tatttatatatgtatttataaat

SEQ ID NO: 2208449 - DNA, 22 bp, Homo sapiens
tcaaaggagagtcacagaacaa

SEQ ID NO: 2208450 - DNA, 13 bp, Homo sapiens
tcaagctaataaa

SEQ ID NO: 2208451 - DNA, 20 bp, Homo sapiens
tcaagctaataaaatatcat

SEQ ID NO: 2208452 - DNA, 22 bp, Homo sapiens
tcaagctaataaaatatcattc

SEQ ID NO: 2208453 - DNA, 23 bp, Homo sapiens
tcaagctaataaaatatcattca

SEQ ID NO: 2208454 - DNA, 20 bp, Homo sapiens
tcaagtcggatctagtccag

SEQ ID NO: 2208455 - DNA, 14 bp, Homo sapiens
tcaattccacctgc

SEQ ID NO: 2208456 - DNA, 21 bp, Homo sapiens
tcacatggcctatgcacatat

SEQ ID NO: 2208457 - DNA, 15 bp, Homo sapiens
tcagggaggtcattt

SEQ ID NO: 2208458 - DNA, 17 bp, Homo sapiens
tcagttttatcattttc

SEQ ID NO: 2208459 - DNA, 19 bp, Homo sapiens
tcagttttatcattttcaa

SEQ ID NO: 2208460 - DNA, 15 bp, Homo sapiens
tcagtttttgtgaaa

SEQ ID NO: 2208461 - DNA, 15 bp, Homo sapiens
tcatataataaatgt

SEQ ID NO: 2208462 - DNA, 17 bp, Homo sapiens
tcatgatttcatttcaa

SEQ ID NO: 2208463 - DNA, 10 bp, Homo sapiens
tcattcagca

SEQ ID NO: 2208464 - DNA, 19 bp, Homo sapiens
tccacgcacatgcgacccc

SEQ ID NO: 2208465 - DNA, 19 bp, Homo sapiens
tccagaaggagacaggcag

SEQ ID NO: 2208466 - DNA, 15 bp, Homo sapiens
tcccacccacatgtg

SEQ ID NO: 2208467 - DNA, 11 bp, Homo sapiens
tcccaggacac

SEQ ID NO: 2208468 - DNA, 17 bp, Homo sapiens
tcccatagccaggaaac

SEQ ID NO: 2208469 - DNA, 13 bp, Homo sapiens
tcctatatgcact

SEQ ID NO: 2208470 - DNA, 19 bp, Homo sapiens
tcctgtgcctccatcagct

SEQ ID NO: 2208471 - DNA, 14 bp, Homo sapiens
tccttggtgcctgg

SEQ ID NO: 2208472 - DNA, 20 bp, Homo sapiens
tctaatacctctgtgtgctc

SEQ ID NO: 2208473 - DNA, 15 bp, Homo sapiens
tctacccatattaca

SEQ ID NO: 2208474 - DNA, 14 bp, Homo sapiens
tctagactaaaaga

SEQ ID NO: 2208475 - DNA, 13 bp, Homo sapiens
tctataatttaaa

SEQ ID NO: 2208476 - DNA, 16 bp, Homo sapiens
tctggaatgtaatcaa

SEQ ID NO: 2208477 - DNA, 21 bp, Homo sapiens
tctggagtctcacttgtctca

SEQ ID NO: 2208478 - DNA, 17 bp, Homo sapiens
tctggttaggatggcag

SEQ ID NO: 2208479 - DNA, 19 bp, Homo sapiens
tcttaatcttttcacaaat

SEQ ID NO: 2208480 - DNA, 19 bp, Homo sapiens
tcttgtacatgtgtagcct

SEQ ID NO: 2208481 - DNA, 24 bp, Homo sapiens
tcttgtacatgtgtagcctgtgca

SEQ ID NO: 2208482 - DNA, 18 bp, Homo sapiens
tcttgtgactagtgctga

SEQ ID NO: 2208483 - DNA, 14 bp, Homo sapiens
tcttgtttcaattc

SEQ ID NO: 2208484 - DNA, 17 bp, Homo sapiens
tctttttttggcccagg

SEQ ID NO: 2208485 - DNA, 17 bp, Homo sapiens
tgaaacaagaagccaca

SEQ ID NO: 2208486 - DNA, 20 bp, Homo sapiens
tgaaacccagtcactgtgag

SEQ ID NO: 2208487 - DNA, 13 bp, Homo sapiens
tgaaagaaaataa

SEQ ID NO: 2208488 - DNA, 17 bp, Homo sapiens
tgaaagtcttgtgacta

SEQ ID NO: 2208489 - DNA, 19 bp, Homo sapiens
tgaaatggacttttgtaca

SEQ ID NO: 2208490 - DNA, 15 bp, Homo sapiens
tgaaattgtattaca

SEQ ID NO: 2208491 - DNA, 16 bp, Homo sapiens
tgaagcttattaatgc

SEQ ID NO: 2208492 - DNA, 11 bp, Homo sapiens
tgaaggctggc

SEQ ID NO: 2208493 - DNA, 13 bp, Homo sapiens
tgaaggctggcat

SEQ ID NO: 2208494 - DNA, 16 bp, Homo sapiens
tgaaggctggcatgat

SEQ ID NO: 2208495 - DNA, 20 bp, Homo sapiens
tgaatgaaagtcttgtgact

SEQ ID NO: 2208496 - DNA, 21 bp, Homo sapiens
tgaatgaaagtcttgtgacta

SEQ ID NO: 2208497 - DNA, 23 bp, Homo sapiens
tgaatgcagtctgtccaggctcg

SEQ ID NO: 2208498 - DNA, 15 bp, Homo sapiens
tgacttaagaagcct

SEQ ID NO: 2208499 - DNA, 18 bp, Homo sapiens
tgacttggggagatggag

SEQ ID NO: 2208500 - DNA, 19 bp, Homo sapiens
tgacttggggagatggagt

SEQ ID NO: 2208501 - DNA, 18 bp, Homo sapiens
tgagcaatgtataacccc

SEQ ID NO: 2208502 - DNA, 23 bp, Homo sapiens
tgagctcccaggtgcagccagag

SEQ ID NO: 2208503 - DNA, 13 bp, Homo sapiens
tgagtgcagaccc

SEQ ID NO: 2208504 - DNA, 18 bp, Homo sapiens
tgatgaactcttaatcaa

SEQ ID NO: 2208505 - DNA, 13 bp, Homo sapiens
tgattatatgtca

SEQ ID NO: 2208506 - DNA, 13 bp, Homo sapiens
tgcacaagccagg

SEQ ID NO: 2208507 - DNA, 14 bp, Homo sapiens
tgcacatatggact

SEQ ID NO: 2208508 - DNA, 17 bp, Homo sapiens
tgcagaccccttggcca

SEQ ID NO: 2208509 - DNA, 20 bp, Homo sapiens
tgcatagtaccaatcatttt

SEQ ID NO: 2208510 - DNA, 21 bp, Homo sapiens
tgcatagtaccaatcatttta

SEQ ID NO: 2208511 - DNA, 17 bp, Homo sapiens
tgcattttttaaaacaa

SEQ ID NO: 2208512 - DNA, 19 bp, Homo sapiens
tgccaaatataaataaaaa

SEQ ID NO: 2208513 - DNA, 22 bp, Homo sapiens
tgccaaatataaataaaaataa

SEQ ID NO: 2208514 - DNA, 18 bp, Homo sapiens
tgccatagtcacatggcc

SEQ ID NO: 2208515 - DNA, 17 bp, Homo sapiens
tgcctggcctggcacac

SEQ ID NO: 2208516 - DNA, 18 bp, Homo sapiens
tgcgtggactctgcacat

SEQ ID NO: 2208517 - DNA, 22 bp, Homo sapiens
tgctaatcagggaggtcatttt

SEQ ID NO: 2208518 - DNA, 19 bp, Homo sapiens
tgctcctccttggtgcctg

SEQ ID NO: 2208519 - DNA, 21 bp, Homo sapiens
tgctgatgaactcttaatcaa

SEQ ID NO: 2208520 - DNA, 13 bp, Homo sapiens
tggacacaggcct

SEQ ID NO: 2208521 - DNA, 19 bp, Homo sapiens
tggactgacctggtccaca

SEQ ID NO: 2208522 - DNA, 15 bp, Homo sapiens
tggagttcttgtgcc

SEQ ID NO: 2208523 - DNA, 19 bp, Homo sapiens
tggcactgactgggcatag

SEQ ID NO: 2208524 - DNA, 15 bp, Homo sapiens
tggcactggatgcag

SEQ ID NO: 2208525 - DNA, 16 bp, Homo sapiens
tggcatgatccaagca

SEQ ID NO: 2208526 - DNA, 15 bp, Homo sapiens
tggccacgcagccag

SEQ ID NO: 2208527 - DNA, 22 bp, Homo sapiens
tggcctcaagatcaatgaaatg

SEQ ID NO: 2208528 - DNA, 17 bp, Homo sapiens
tggcgcctccgagggac

SEQ ID NO: 2208529 - DNA, 14 bp, Homo sapiens
tggctccccaaagg

SEQ ID NO: 2208530 - DNA, 17 bp, Homo sapiens
tggctctcccatttcct

SEQ ID NO: 2208531 - DNA, 18 bp, Homo sapiens
tgggagacctgtaatcat

SEQ ID NO: 2208532 - DNA, 23 bp, Homo sapiens
tgggattgacagaagcttctgcc

SEQ ID NO: 2208533 - DNA, 14 bp, Homo sapiens
tgggtgaaggctgg

SEQ ID NO: 2208534 - DNA, 22 bp, Homo sapiens
tggtatctagacccatcttctt

SEQ ID NO: 2208535 - DNA, 14 bp, Homo sapiens
tggtccacagggca

SEQ ID NO: 2208536 - DNA, 15 bp, Homo sapiens
tggtccacagggcac

SEQ ID NO: 2208537 - DNA, 21 bp, Homo sapiens
tggtccacagggcacctgcca

SEQ ID NO: 2208538 - DNA, 12 bp, Homo sapiens
tggtgcctggcc

SEQ ID NO: 2208539 - DNA, 14 bp, Homo sapiens
tgtaatcaatgttt

SEQ ID NO: 2208540 - DNA, 17 bp, Homo sapiens
tgtacacgtgtcctgta

SEQ ID NO: 2208541 - DNA, 15 bp, Homo sapiens
tgtacatgtgtagcc

SEQ ID NO: 2208542 - DNA, 20 bp, Homo sapiens
tgtactgagccttgtaattc

SEQ ID NO: 2208543 - DNA, 22 bp, Homo sapiens
tgtactgagccttgtaattcta

SEQ ID NO: 2208544 - DNA, 20 bp, Homo sapiens
tgtagttgcgtggactctgc

SEQ ID NO: 2208545 - DNA, 21 bp, Homo sapiens
tgtagttgcgtggactctgca

SEQ ID NO: 2208546 - DNA, 14 bp, Homo sapiens
tgtatgtcttggac

SEQ ID NO: 2208547 - DNA, 22 bp, Homo sapiens
tgtattacaaatccaatgaaat

SEQ ID NO: 2208548 - DNA, 19 bp, Homo sapiens
tgtcatgttgtaaacattt

SEQ ID NO: 2208549 - DNA, 13 bp, Homo sapiens
tgtcttggacact

SEQ ID NO: 2208550 - DNA, 22 bp, Homo sapiens
tgtcttgtacatgtgtagcctg

SEQ ID NO: 2208551 - DNA, 22 bp, Homo sapiens
tgtgacacatatgcaccttgtg

SEQ ID NO: 2208552 - DNA, 16 bp, Homo sapiens
tgtgactagtgctgaa

SEQ ID NO: 2208553 - DNA, 17 bp, Homo sapiens
tgtgactagtgctgaag

SEQ ID NO: 2208554 - DNA, 20 bp, Homo sapiens
tgtgactagtgctgaagctt

SEQ ID NO: 2208555 - DNA, 16 bp, Homo sapiens
tgtgatgccctgccct

SEQ ID NO: 2208556 - DNA, 12 bp, Homo sapiens
tgtgcagtgttg

SEQ ID NO: 2208557 - DNA, 23 bp, Homo sapiens
tgtgcatgtatgtcttggacact

SEQ ID NO: 2208558 - DNA, 20 bp, Homo sapiens
tgttatcaaaactttctttt

SEQ ID NO: 2208559 - DNA, 18 bp, Homo sapiens
tgtttacactctttgtaa

SEQ ID NO: 2208560 - DNA, 20 bp, Homo sapiens
tgtttgccttctacttttaa

SEQ ID NO: 2208561 - DNA, 19 bp, Homo sapiens
ttaaaacaagaaagtttcc

SEQ ID NO: 2208562 - DNA, 12 bp, Homo sapiens
ttaaagacagag

SEQ ID NO: 2208563 - DNA, 16 bp, Homo sapiens
ttaatcttttcacaaa

SEQ ID NO: 2208564 - DNA, 19 bp, Homo sapiens
ttaatcttttcacaaataa

SEQ ID NO: 2208565 - DNA, 13 bp, Homo sapiens
ttaatgctaaggg

SEQ ID NO: 2208566 - DNA, 14 bp, Homo sapiens
ttaattattattta

SEQ ID NO: 2208567 - DNA, 12 bp, Homo sapiens
ttacatggctct

SEQ ID NO: 2208568 - DNA, 15 bp, Homo sapiens
ttataaatatattta

SEQ ID NO: 2208569 - DNA, 14 bp, Homo sapiens
ttatatatgtattt

SEQ ID NO: 2208570 - DNA, 23 bp, Homo sapiens
aaaaagttttgccctttttaagg

SEQ ID NO: 2208571 - DNA, 14 bp, Homo sapiens
aaaaataacaatga

SEQ ID NO: 2208572 - DNA, 14 bp, Homo sapiens
aaaaattgtgatca

SEQ ID NO: 2208573 - DNA, 17 bp, Homo sapiens
aaaacaagaaagtttcc

SEQ ID NO: 2208574 - DNA, 20 bp, Homo sapiens
aaactttcctcttcctgcct

SEQ ID NO: 2208575 - DNA, 20 bp, Homo sapiens
aaataaagcttgcaacaaaa

SEQ ID NO: 2208576 - DNA, 18 bp, Homo sapiens
aaatatatgctaagtctt

SEQ ID NO: 2208577 - DNA, 13 bp, Homo sapiens
aaatatcattcag

SEQ ID NO: 2208578 - DNA, 15 bp, Homo sapiens
aaatatcattcagca

SEQ ID NO: 2208579 - DNA, 16 bp, Homo sapiens
aaattatcaagctaat

SEQ ID NO: 2208580 - DNA, 18 bp, Homo sapiens
aaattatcaagctaataa

SEQ ID NO: 2208581 - DNA, 15 bp, Homo sapiens
aaattattaaaggaa

SEQ ID NO: 2208582 - DNA, 17 bp, Homo sapiens
aaattccaagtgattga

SEQ ID NO: 2208583 - DNA, 17 bp, Homo sapiens
aaatttcagcagctgca

SEQ ID NO: 2208584 - DNA, 18 bp, Homo sapiens
aaatttcagcagctgcag

SEQ ID NO: 2208585 - DNA, 16 bp, Homo sapiens
aacaagaaagtttccc

SEQ ID NO: 2208586 - DNA, 21 bp, Homo sapiens
aacaagaagccacagacctag

SEQ ID NO: 2208587 - DNA, 12 bp, Homo sapiens
aacaataaaaga

SEQ ID NO: 2208588 - DNA, 14 bp, Homo sapiens
aacacgcaggagca

SEQ ID NO: 2208589 - DNA, 22 bp, Homo sapiens
aacatataatgttgttatttaa

SEQ ID NO: 2208590 - DNA, 16 bp, Homo sapiens
aagagctgtcctggta

SEQ ID NO: 2208591 - DNA, 12 bp, Homo sapiens
aagataattata

SEQ ID NO: 2208592 - DNA, 18 bp, Homo sapiens
aagatctctgcagggccg

SEQ ID NO: 2208593 - DNA, 22 bp, Homo sapiens
aagattgagaagttactttcca

SEQ ID NO: 2208594 - DNA, 13 bp, Homo sapiens
aagcaagactgag

SEQ ID NO: 2208595 - DNA, 15 bp, Homo sapiens
aagcacgaaatgtta

SEQ ID NO: 2208596 - DNA, 14 bp, Homo sapiens
aagcagagaagctc

SEQ ID NO: 2208597 - DNA, 20 bp, Homo sapiens
aagcttattaatgctaaggg

SEQ ID NO: 2208598 - DNA, 14 bp, Homo sapiens
aagtcttgtgacta

SEQ ID NO: 2208599 - DNA, 20 bp, Homo sapiens
aagtcttgtgactagtgctg

SEQ ID NO: 2208600 - DNA, 21 bp, Homo sapiens
aagtcttgtgactagtgctga

SEQ ID NO: 2208601 - DNA, 19 bp, Homo sapiens
aagtttccttccagcccag

SEQ ID NO: 2208602 - DNA, 20 bp, Homo sapiens
aagtttccttccagcccaga

SEQ ID NO: 2208603 - DNA, 12 bp, Homo sapiens
aataaaaataat

SEQ ID NO: 2208604 - DNA, 15 bp, Homo sapiens
aataaaatatcattc

SEQ ID NO: 2208605 - DNA, 16 bp, Homo sapiens
aataaaatatcattca

SEQ ID NO: 2208606 - DNA, 15 bp, Homo sapiens
aataacaataaaaga

SEQ ID NO: 2208607 - DNA, 15 bp, Homo sapiens
aatacctctgtgtgc

SEQ ID NO: 2208608 - DNA, 22 bp, Homo sapiens
tagtgctgaagcttattaatgc

SEQ ID NO: 2208609 - DNA, 12 bp, Homo sapiens
tatatttacaaa

SEQ ID NO: 2208610 - DNA, 14 bp, Homo sapiens
tatatttacaaatg

SEQ ID NO: 2208611 - DNA, 15 bp, Homo sapiens
tatatttacaaatgg

SEQ ID NO: 2208612 - DNA, 23 bp, Homo sapiens
tatcaagctaataaaatatcatt

SEQ ID NO: 2208613 - DNA, 15 bp, Homo sapiens
tatctaatacctctg

SEQ ID NO: 2208614 - DNA, 16 bp, Homo sapiens
tatctaatacctctgt

SEQ ID NO: 2208615 - DNA, 23 bp, Homo sapiens
tatctgcttttggttataatgtg

SEQ ID NO: 2208616 - DNA, 13 bp, Homo sapiens
tatgcacatatgg

SEQ ID NO: 2208617 - DNA, 20 bp, Homo sapiens
tatgcacatatggactctgc

SEQ ID NO: 2208618 - DNA, 19 bp, Homo sapiens
tatgcaccttgtgtctgta

SEQ ID NO: 2208619 - DNA, 20 bp, Homo sapiens
tatgcaccttgtgtctgtac

SEQ ID NO: 2208620 - DNA, 17 bp, Homo sapiens
tatgtcttggacactgt

SEQ ID NO: 2208621 - DNA, 21 bp, Homo sapiens
tatgtcttggacactgtacaa

SEQ ID NO: 2208622 - DNA, 15 bp, Homo sapiens
tattaatgctaaggg

SEQ ID NO: 2208623 - DNA, 15 bp, Homo sapiens
tattatcaacaatag

SEQ ID NO: 2208624 - DNA, 13 bp, Homo sapiens
tattatttatata

SEQ ID NO: 2208625 - DNA, 17 bp, Homo sapiens
tatttaagataattata

SEQ ID NO: 2208626 - DNA, 19 bp, Homo sapiens
tatttataaatatatttaa

SEQ ID NO: 2208627 - DNA, 14 bp, Homo sapiens
tcaaagctgaaatg

SEQ ID NO: 2208628 - DNA, 22 bp, Homo sapiens
tcaagatcaatgaaatgatgtc

SEQ ID NO: 2208629 - DNA, 19 bp, Homo sapiens
tcaataaactaaagaaaaa

SEQ ID NO: 2208630 - DNA, 15 bp, Homo sapiens
tcaataaatgtctgt

SEQ ID NO: 2208631 - DNA, 16 bp, Homo sapiens
tcaattcttgccaaat

SEQ ID NO: 2208632 - DNA, 13 bp, Homo sapiens
tcactgccatata

SEQ ID NO: 2208633 - DNA, 14 bp, Homo sapiens
tcagaaacaggacc

SEQ ID NO: 2208634 - DNA, 23 bp, Homo sapiens
tcagaccataatgttacattatt

SEQ ID NO: 2208635 - DNA, 18 bp, Homo sapiens
tcaggacctccaagccac

SEQ ID NO: 2208636 - DNA, 16 bp, Homo sapiens
tcataagcgatcactt

SEQ ID NO: 2208637 - DNA, 16 bp, Homo sapiens
tcatataataaatgta

SEQ ID NO: 2208638 - DNA, 21 bp, Homo sapiens
tcatatgtaccatgtacatga

SEQ ID NO: 2208639 - DNA, 13 bp, Homo sapiens
tcatttactgtgg

SEQ ID NO: 2208640 - DNA, 15 bp, Homo sapiens
tcatttactgtggct

SEQ ID NO: 2208641 - DNA, 20 bp, Homo sapiens
tcatttactgtggcttctta

SEQ ID NO: 2208642 - DNA, 17 bp, Homo sapiens
tccaagccactgagcaa

SEQ ID NO: 2208643 - DNA, 14 bp, Homo sapiens
tccagaaggagaca

SEQ ID NO: 2208644 - DNA, 16 bp, Homo sapiens
tcccacccacatgtga

SEQ ID NO: 2208645 - DNA, 17 bp, Homo sapiens
tcccaggtgcagccaga

SEQ ID NO: 2208646 - DNA, 14 bp, Homo sapiens
tcccggggcagggc

SEQ ID NO: 2208647 - DNA, 16 bp, Homo sapiens
tcccggggcagggcag

SEQ ID NO: 2208648 - DNA, 18 bp, Homo sapiens
tccctgcacaagccaggg

SEQ ID NO: 2208649 - DNA, 17 bp, Homo sapiens
tcctccttggtgcctgg

SEQ ID NO: 2208650 - DNA, 18 bp, Homo sapiens
tccttggtgcctggcctg

SEQ ID NO: 2208651 - DNA, 14 bp, Homo sapiens
tctaatacctctgt

SEQ ID NO: 2208652 - DNA, 17 bp, Homo sapiens
tctaatacctctgtgtg

SEQ ID NO: 2208653 - DNA, 14 bp, Homo sapiens
tctaatatcagcaa

SEQ ID NO: 2208654 - DNA, 20 bp, Homo sapiens
tctaggcctcctggcccagg

SEQ ID NO: 2208655 - DNA, 23 bp, Homo sapiens
tctaggttctaaaaattgtgatc

SEQ ID NO: 2208656 - DNA, 18 bp, Homo sapiens
tctagttgcttgtaaaat

SEQ ID NO: 2208657 - DNA, 13 bp, Homo sapiens
tctgaagcctcac

SEQ ID NO: 2208658 - DNA, 12 bp, Homo sapiens
tctgcacatgaa

SEQ ID NO: 2208659 - DNA, 23 bp, Homo sapiens
tctgcacatgaatcccacccaca

SEQ ID NO: 2208660 - DNA, 19 bp, Homo sapiens
tctgcacatgtcttgtaca

SEQ ID NO: 2208661 - DNA, 21 bp, Homo sapiens
tctgcacatgtcttgtacatg

SEQ ID NO: 2208662 - DNA, 22 bp, Homo sapiens
tctgcacatgtcttgtacatgt

SEQ ID NO: 2208663 - DNA, 20 bp, Homo sapiens
tctgcagggccgccagggag

SEQ ID NO: 2208664 - DNA, 16 bp, Homo sapiens
tctgcattctagtact

SEQ ID NO: 2208665 - DNA, 15 bp, Homo sapiens
tctggaatgtaatca

SEQ ID NO: 2208666 - DNA, 16 bp, Homo sapiens
tctgggacctcagttt

SEQ ID NO: 2208667 - DNA, 18 bp, Homo sapiens
tctgggataagtaagttt

SEQ ID NO: 2208668 - DNA, 17 bp, Homo sapiens
tctgtacacgtgtcctg

SEQ ID NO: 2208669 - DNA, 17 bp, Homo sapiens
tcttaatcttttcacaa

SEQ ID NO: 2208670 - DNA, 20 bp, Homo sapiens
tcttcataacaattttagga

SEQ ID NO: 2208671 - DNA, 17 bp, Homo sapiens
tcttctaggttctaaaa

SEQ ID NO: 2208672 - DNA, 16 bp, Homo sapiens
tcttggacactgtaca

SEQ ID NO: 2208673 - DNA, 17 bp, Homo sapiens
tcttggacactgtacaa

SEQ ID NO: 2208674 - DNA, 17 bp, Homo sapiens
tcttgtacatgtgtagc

SEQ ID NO: 2208675 - DNA, 22 bp, Homo sapiens
tcttgtgactagtgctgaagct

SEQ ID NO: 2208676 - DNA, 21 bp, Homo sapiens
tctttcaataaactaaagaaa

SEQ ID NO: 2208677 - DNA, 18 bp, Homo sapiens
tctttgaatacaaagaac

SEQ ID NO: 2208678 - DNA, 12 bp, Homo sapiens
tctttgccaagt

SEQ ID NO: 2208679 - DNA, 12 bp, Homo sapiens
tcttttcacaaa

SEQ ID NO: 2208680 - DNA, 11 bp, Homo sapiens
tgaaacccagt

SEQ ID NO: 2208681 - DNA, 18 bp, Homo sapiens
tgaaagtcttgtgactag

SEQ ID NO: 2208682 - DNA, 20 bp, Homo sapiens
tgaaagtcttgtgactagtg

SEQ ID NO: 2208683 - DNA, 22 bp, Homo sapiens
tgaacttgtaaaggaatttaaa

SEQ ID NO: 2208684 - DNA, 18 bp, Homo sapiens
tgaagcttattaatgcta

SEQ ID NO: 2208685 - DNA, 23 bp, Homo sapiens
tgaagcttattaatgctaagggc

SEQ ID NO: 2208686 - DNA, 12 bp, Homo sapiens
tgaaggctggca

SEQ ID NO: 2208687 - DNA, 20 bp, Homo sapiens
tgaatcccacccacatgtga

SEQ ID NO: 2208688 - DNA, 19 bp, Homo sapiens
tgacaaccatgagaccact

SEQ ID NO: 2208689 - DNA, 21 bp, Homo sapiens
tgacacatatgcaccttgtgt

SEQ ID NO: 2208690 - DNA, 18 bp, Homo sapiens
tgactagtgctgaagctt

SEQ ID NO: 2208691 - DNA, 21 bp, Homo sapiens
tgactagtgctgaagcttatt

SEQ ID NO: 2208692 - DNA, 22 bp, Homo sapiens
tgactagtgctgaagcttatta

SEQ ID NO: 2208693 - DNA, 20 bp, Homo sapiens
tgagaagaaaatggaaccag

SEQ ID NO: 2208694 - DNA, 21 bp, Homo sapiens
tgagaccacagagagagggga

SEQ ID NO: 2208695 - DNA, 13 bp, Homo sapiens
tgagccttgtaat

SEQ ID NO: 2208696 - DNA, 14 bp, Homo sapiens
tgagctacaaatgc

SEQ ID NO: 2208697 - DNA, 21 bp, Homo sapiens
tgagctcccaggtgcagccag

SEQ ID NO: 2208698 - DNA, 19 bp, Homo sapiens
tgagtttctctcacattac

SEQ ID NO: 2208699 - DNA, 18 bp, Homo sapiens
tgatcagaccataatgtt

SEQ ID NO: 2208700 - DNA, 12 bp, Homo sapiens
tgatcaggacct

SEQ ID NO: 2208701 - DNA, 13 bp, Homo sapiens
tgatttcatttca

SEQ ID NO: 2208702 - DNA, 15 bp, Homo sapiens
tgcacatatggactc

SEQ ID NO: 2208703 - DNA, 17 bp, Homo sapiens
tgcacatatggactctg

SEQ ID NO: 2208704 - DNA, 18 bp, Homo sapiens
tgcacatatggactctgc

SEQ ID NO: 2208705 - DNA, 15 bp, Homo sapiens
tgcacatgtcttgta

SEQ ID NO: 2208706 - DNA, 19 bp, Homo sapiens
tgcacatgtcttgtacatg

SEQ ID NO: 2208707 - DNA, 22 bp, Homo sapiens
tgcacatgtcttgtacatgtgt

SEQ ID NO: 2208708 - DNA, 18 bp, Homo sapiens
tgcacccacccaggagtg

SEQ ID NO: 2208709 - DNA, 15 bp, Homo sapiens
tgcaccttgtgtctg

SEQ ID NO: 2208710 - DNA, 19 bp, Homo sapiens
tgcagaccccttggccagc

SEQ ID NO: 2208711 - DNA, 13 bp, Homo sapiens
tgcagccagaggc

SEQ ID NO: 2208712 - DNA, 16 bp, Homo sapiens
tgcaggtgaaacccag

SEQ ID NO: 2208713 - DNA, 19 bp, Homo sapiens
tgcagtttgagacaggaga

SEQ ID NO: 2208714 - DNA, 22 bp, Homo sapiens
tgcatagtaccaatcattttaa

SEQ ID NO: 2208715 - DNA, 13 bp, Homo sapiens
tgcatgtatgtct

SEQ ID NO: 2208716 - DNA, 14 bp, Homo sapiens
tgcatgtatgtctt

SEQ ID NO: 2208717 - DNA, 12 bp, Homo sapiens
tgcattctagta

SEQ ID NO: 2208718 - DNA, 19 bp, Homo sapiens
tgcattttttaaaacaaga

SEQ ID NO: 2208719 - DNA, 17 bp, Homo sapiens
tgccaaatataaataaa

SEQ ID NO: 2208720 - DNA, 19 bp, Homo sapiens
tgccactgactgcagggac

SEQ ID NO: 2208721 - DNA, 17 bp, Homo sapiens
tgccatagtcacatggc

SEQ ID NO: 2208722 - DNA, 19 bp, Homo sapiens
tgccatagtcacatggcct

SEQ ID NO: 2208723 - DNA, 15 bp, Homo sapiens
tgcctagaggcccca

SEQ ID NO: 2208724 - DNA, 16 bp, Homo sapiens
tgcctcccgccccctt

SEQ ID NO: 2208725 - DNA, 22 bp, Homo sapiens
tgcctggcctggcacacatcag

SEQ ID NO: 2208726 - DNA, 22 bp, Homo sapiens
tgcgtggactctgcacatgtct

SEQ ID NO: 2208727 - DNA, 23 bp, Homo sapiens
tgcgtggtgtggagtgtgtgtct

SEQ ID NO: 2208728 - DNA, 23 bp, Homo sapiens
tgctaatcagggaggtcattttg

SEQ ID NO: 2208729 - DNA, 18 bp, Homo sapiens
tgctgaagcttattaatg

SEQ ID NO: 2208730 - DNA, 21 bp, Homo sapiens
tgctgaagcttattaatgcta

SEQ ID NO: 2208731 - DNA, 22 bp, Homo sapiens
tgctgaagcttattaatgctaa

SEQ ID NO: 2208732 - DNA, 18 bp, Homo sapiens
tggaaacattcaggagct

SEQ ID NO: 2208733 - DNA, 18 bp, Homo sapiens
tggacgagaaaacaataa

SEQ ID NO: 2208734 - DNA, 14 bp, Homo sapiens
tggactctgcacat

SEQ ID NO: 2208735 - DNA, 19 bp, Homo sapiens
tggactctgcacatgtctt

SEQ ID NO: 2208736 - DNA, 17 bp, Homo sapiens
tggactgacctggtcca

SEQ ID NO: 2208737 - DNA, 14 bp, Homo sapiens
tggcacccaagacc

SEQ ID NO: 2208738 - DNA, 23 bp, Homo sapiens
tggcacccaagacctcagggcac

SEQ ID NO: 2208739 - DNA, 18 bp, Homo sapiens
tggcactggatgcagaaa

SEQ ID NO: 2208740 - DNA, 20 bp, Homo sapiens
tggccacgcagccaggacac

SEQ ID NO: 2208741 - DNA, 23 bp, Homo sapiens
tggccagagagcctggtgctgct

SEQ ID NO: 2208742 - DNA, 21 bp, Homo sapiens
tggccgcacctaaagcagcca

SEQ ID NO: 2208743 - DNA, 16 bp, Homo sapiens
tggcctggcacacatc

SEQ ID NO: 2208744 - DNA, 13 bp, Homo sapiens
tggctcccaggac

SEQ ID NO: 2208745 - DNA, 15 bp, Homo sapiens
tggctcccaggacac

SEQ ID NO: 2208746 - DNA, 15 bp, Homo sapiens
tggctccccaaaggg

SEQ ID NO: 2208747 - DNA, 22 bp, Homo sapiens
tgggaaccccttcatcctctga

SEQ ID NO: 2208748 - DNA, 14 bp, Homo sapiens
tgggaatcaagatt

SEQ ID NO: 2208749 - DNA, 15 bp, Homo sapiens
tgggcaaacaggcag

SEQ ID NO: 2208750 - DNA, 16 bp, Homo sapiens
tgggcaaacaggcagt

SEQ ID NO: 2208751 - DNA, 18 bp, Homo sapiens
tgggcccacaaaggcaaa

SEQ ID NO: 2208752 - DNA, 16 bp, Homo sapiens
tgggctgggcccacaa

SEQ ID NO: 2208753 - DNA, 23 bp, Homo sapiens
tggggtcctgtggggcccccaca

SEQ ID NO: 2208754 - DNA, 15 bp, Homo sapiens
tgggtgaaggctggc

SEQ ID NO: 2208755 - DNA, 19 bp, Homo sapiens
tgggtgaaggctggcatga

SEQ ID NO: 2208756 - DNA, 18 bp, Homo sapiens
tggtgcctggcctggcac

SEQ ID NO: 2208757 - DNA, 19 bp, Homo sapiens
tggtgcctggcctggcaca

SEQ ID NO: 2208758 - DNA, 21 bp, Homo sapiens
agcctgtgcatgtatgtcttg

SEQ ID NO: 2208759 - DNA, 18 bp, Homo sapiens
agccttgtaattctaaat

SEQ ID NO: 2208760 - DNA, 24 bp, Homo sapiens
agcgtggcgcagtggccctgagca

SEQ ID NO: 2208761 - DNA, 13 bp, Homo sapiens
agctaaatccttt

SEQ ID NO: 2208762 - DNA, 18 bp, Homo sapiens
agctaataaaatatcatt

SEQ ID NO: 2208763 - DNA, 23 bp, Homo sapiens
agctaataaaatatcattcagca

SEQ ID NO: 2208764 - DNA, 20 bp, Homo sapiens
agctccccgcttctgcctgc

SEQ ID NO: 2208765 - DNA, 14 bp, Homo sapiens
agctgggagccggg

SEQ ID NO: 2208766 - DNA, 15 bp, Homo sapiens
agctgggagccgggc

SEQ ID NO: 2208767 - DNA, 18 bp, Homo sapiens
agcttcactgtaaaataa

SEQ ID NO: 2208768 - DNA, 15 bp, Homo sapiens
aggacccaagcagag

SEQ ID NO: 2208769 - DNA, 15 bp, Homo sapiens
aggacctccaagcca

SEQ ID NO: 2208770 - DNA, 21 bp, Homo sapiens
aggacctccaagccactgagc

SEQ ID NO: 2208771 - DNA, 14 bp, Homo sapiens
aggactgtgatgcc

SEQ ID NO: 2208772 - DNA, 13 bp, Homo sapiens
aggagacaggcag

SEQ ID NO: 2208773 - DNA, 21 bp, Homo sapiens
aggagacctggcactggatgc

SEQ ID NO: 2208774 - DNA, 15 bp, Homo sapiens
aggagctgggagccg

SEQ ID NO: 2208775 - DNA, 18 bp, Homo sapiens
aggagctgggagccgggc

SEQ ID NO: 2208776 - DNA, 16 bp, Homo sapiens
aggagcttcctgtcct

SEQ ID NO: 2208777 - DNA, 22 bp, Homo sapiens
aggatggcaggacgtgggctgg

SEQ ID NO: 2208778 - DNA, 20 bp, Homo sapiens
aggatttcatgatttcattt

SEQ ID NO: 2208779 - DNA, 19 bp, Homo sapiens
aggcaaagggtccagaagg

SEQ ID NO: 2208780 - DNA, 20 bp, Homo sapiens
aggcaaagggtccagaagga

SEQ ID NO: 2208781 - DNA, 22 bp, Homo sapiens
aggcccaaattatcaagctaat

SEQ ID NO: 2208782 - DNA, 22 bp, Homo sapiens
agggagacctggacacaggcct

SEQ ID NO: 2208783 - DNA, 17 bp, Homo sapiens
agggagctagccagagg

SEQ ID NO: 2208784 - DNA, 16 bp, Homo sapiens
agggcacaaagatggg

SEQ ID NO: 2208785 - DNA, 20 bp, Homo sapiens
agggcagccgtcacccctgc

SEQ ID NO: 2208786 - DNA, 17 bp, Homo sapiens
aggtacccctttctggc

SEQ ID NO: 2208787 - DNA, 14 bp, Homo sapiens
aggtgcagccagag

SEQ ID NO: 2208788 - DNA, 16 bp, Homo sapiens
aggtgcagccagaggc

SEQ ID NO: 2208789 - DNA, 18 bp, Homo sapiens
aggtgcagccagaggcac

SEQ ID NO: 2208790 - DNA, 11 bp, Homo sapiens
aggttctaaaa

SEQ ID NO: 2208791 - DNA, 22 bp, Homo sapiens
agtaattggtccgatctttgac

SEQ ID NO: 2208792 - DNA, 16 bp, Homo sapiens
agtaccaatcatttta

SEQ ID NO: 2208793 - DNA, 23 bp, Homo sapiens
agtcactgtgagctcccaggtgc

SEQ ID NO: 2208794 - DNA, 19 bp, Homo sapiens
agtcatttgctgagcatgt

SEQ ID NO: 2208795 - DNA, 12 bp, Homo sapiens
agtcctgtaatg

SEQ ID NO: 2208796 - DNA, 21 bp, Homo sapiens
agtctctttttttggcccagg

SEQ ID NO: 2208797 - DNA, 17 bp, Homo sapiens
agtcttgtgactagtgc

SEQ ID NO: 2208798 - DNA, 16 bp, Homo sapiens
agtctttcacatttaa

SEQ ID NO: 2208799 - DNA, 18 bp, Homo sapiens
agtctttcacatttaaat

SEQ ID NO: 2208800 - DNA, 15 bp, Homo sapiens
agtgaaagaaaataa

SEQ ID NO: 2208801 - DNA, 12 bp, Homo sapiens
agtgctgaagct

SEQ ID NO: 2208802 - DNA, 22 bp, Homo sapiens
agtgctgaagcttattaatgct

SEQ ID NO: 2208803 - DNA, 11 bp, Homo sapiens
agtgtgtgtct

SEQ ID NO: 2208804 - DNA, 21 bp, Homo sapiens
agttcaataaatgtctgttga

SEQ ID NO: 2208805 - DNA, 22 bp, Homo sapiens
agttcatatgtaccatgtacat

SEQ ID NO: 2208806 - DNA, 20 bp, Homo sapiens
agttcggtgagctacaaatg

SEQ ID NO: 2208807 - DNA, 14 bp, Homo sapiens
agttcttgtgccat

SEQ ID NO: 2208808 - DNA, 17 bp, Homo sapiens
agtttcactgccatata

SEQ ID NO: 2208809 - DNA, 14 bp, Homo sapiens
agttttatcatttt

SEQ ID NO: 2208810 - DNA, 19 bp, Homo sapiens
ataaaatatcattcagcaa

SEQ ID NO: 2208811 - DNA, 20 bp, Homo sapiens
ataaaatatcattcagcaac

SEQ ID NO: 2208812 - DNA, 18 bp, Homo sapiens
ataaaggattaatgtcaa

SEQ ID NO: 2208813 - DNA, 14 bp, Homo sapiens
ataacaatgaaagt

SEQ ID NO: 2208814 - DNA, 22 bp, Homo sapiens
ataacgataaaagacagtgaaa

SEQ ID NO: 2208815 - DNA, 15 bp, Homo sapiens
ataataaatgtacat

SEQ ID NO: 2208816 - DNA, 14 bp, Homo sapiens
ataatgaatacttt

SEQ ID NO: 2208817 - DNA, 14 bp, Homo sapiens
ataatgttgttatt

SEQ ID NO: 2208818 - DNA, 19 bp, Homo sapiens
ataatgttgttatttaaag

SEQ ID NO: 2208819 - DNA, 16 bp, Homo sapiens
ataattataatatact

SEQ ID NO: 2208820 - DNA, 12 bp, Homo sapiens
atacctctgtgt

SEQ ID NO: 2208821 - DNA, 16 bp, Homo sapiens
atacctctgtgtgctc

SEQ ID NO: 2208822 - DNA, 14 bp, Homo sapiens
atactatatttatg

SEQ ID NO: 2208823 - DNA, 13 bp, Homo sapiens
atagaagtaaaaa

SEQ ID NO: 2208824 - DNA, 20 bp, Homo sapiens
atagctccccgcttctgcct

SEQ ID NO: 2208825 - DNA, 23 bp, Homo sapiens
atagctccccgcttctgcctgca

SEQ ID NO: 2208826 - DNA, 17 bp, Homo sapiens
atagtaccaatcatttt

SEQ ID NO: 2208827 - DNA, 22 bp, Homo sapiens
atataatgttgttatttaaaga

SEQ ID NO: 2208828 - DNA, 13 bp, Homo sapiens
atatatgctaagt

SEQ ID NO: 2208829 - DNA, 12 bp, Homo sapiens
atatatgtattt

SEQ ID NO: 2208830 - DNA, 13 bp, Homo sapiens
atatcattcagca

SEQ ID NO: 2208831 - DNA, 13 bp, Homo sapiens
atatttacaaatg

SEQ ID NO: 2208832 - DNA, 15 bp, Homo sapiens
atcaagctaataaaa

SEQ ID NO: 2208833 - DNA, 19 bp, Homo sapiens
atcaatgtttcttctaggt

SEQ ID NO: 2208834 - DNA, 18 bp, Homo sapiens
atcagggaggtcattttg

SEQ ID NO: 2208835 - DNA, 20 bp, Homo sapiens
atcatataataaatgtacat

SEQ ID NO: 2208836 - DNA, 15 bp, Homo sapiens
atcattttaattatt

SEQ ID NO: 2208837 - DNA, 15 bp, Homo sapiens
atcccacccacatgt

SEQ ID NO: 2208838 - DNA, 18 bp, Homo sapiens
atcccacccacatgtgac

SEQ ID NO: 2208839 - DNA, 19 bp, Homo sapiens
atcctcagtttttgtgaaa

SEQ ID NO: 2208840 - DNA, 19 bp, Homo sapiens
atctaatacctctgtgtgc

SEQ ID NO: 2208841 - DNA, 16 bp, Homo sapiens
atcttataatttaaaa

SEQ ID NO: 2208842 - DNA, 13 bp, Homo sapiens
atcttttcacaaa

SEQ ID NO: 2208843 - DNA, 14 bp, Homo sapiens
atcttttcacaaat

SEQ ID NO: 2208844 - DNA, 17 bp, Homo sapiens
atcttttcacaaataaa

SEQ ID NO: 2208845 - DNA, 20 bp, Homo sapiens
atgaaagtcttgtgactagt

SEQ ID NO: 2208846 - DNA, 14 bp, Homo sapiens
atgaactcaacttt

SEQ ID NO: 2208847 - DNA, 18 bp, Homo sapiens
atgagaccactgttatca

SEQ ID NO: 2208848 - DNA, 18 bp, Homo sapiens
atgcacatatggactctg

SEQ ID NO: 2208849 - DNA, 19 bp, Homo sapiens
atgcacatatggactctgc

SEQ ID NO: 2208850 - DNA, 21 bp, Homo sapiens
atgcacatatggactctgcac

SEQ ID NO: 2208851 - DNA, 21 bp, Homo sapiens
atgcaccttgtgtctgtacac

SEQ ID NO: 2208852 - DNA, 17 bp, Homo sapiens
atgcaggtgaaacccag

SEQ ID NO: 2208853 - DNA, 18 bp, Homo sapiens
atgctacaggatttgaaa

SEQ ID NO: 2208854 - DNA, 16 bp, Homo sapiens
atggaaccaggcttgg

SEQ ID NO: 2208855 - DNA, 16 bp, Homo sapiens
atggagggaataatac

SEQ ID NO: 2208856 - DNA, 20 bp, Homo sapiens
atggcaggacgtgggctggg

SEQ ID NO: 2208857 - DNA, 18 bp, Homo sapiens
atggctctaaaaagtttt

SEQ ID NO: 2208858 - DNA, 18 bp, Homo sapiens
atgggtgaaggctggcat

SEQ ID NO: 2208859 - DNA, 15 bp, Homo sapiens
atgtaatcaatgttt

SEQ ID NO: 2208860 - DNA, 16 bp, Homo sapiens
atgtaatcaatgtttc

SEQ ID NO: 2208861 - DNA, 15 bp, Homo sapiens
atgtaccatgtacat

SEQ ID NO: 2208862 - DNA, 23 bp, Homo sapiens
atgtcgtcaaagctgaaatggac

SEQ ID NO: 2208863 - DNA, 19 bp, Homo sapiens
atgttattttttaattatt

SEQ ID NO: 2208864 - DNA, 12 bp, Homo sapiens
atgttgttattt

SEQ ID NO: 2208865 - DNA, 14 bp, Homo sapiens
atgttgttatttaa

SEQ ID NO: 2208866 - DNA, 15 bp, Homo sapiens
atgttgttatttaaa

SEQ ID NO: 2208867 - DNA, 16 bp, Homo sapiens
atgtttacactctttg

SEQ ID NO: 2208868 - DNA, 20 bp, Homo sapiens
attatatggcttgagtttaa

SEQ ID NO: 2208869 - DNA, 13 bp, Homo sapiens
attatcaagctaa

SEQ ID NO: 2208870 - DNA, 16 bp, Homo sapiens
attatcaagctaataa

SEQ ID NO: 2208871 - DNA, 15 bp, Homo sapiens
attattattcttcat

SEQ ID NO: 2208872 - DNA, 17 bp, Homo sapiens
attctaaatgaatgttt

SEQ ID NO: 2208873 - DNA, 19 bp, Homo sapiens
attctaggcctcctggccc

SEQ ID NO: 2208874 - DNA, 20 bp, Homo sapiens
attctaggcctcctggccca

SEQ ID NO: 2208875 - DNA, 17 bp, Homo sapiens
attgctatctattgata

SEQ ID NO: 2208876 - DNA, 23 bp, Homo sapiens
attgtgatcagaccataatgtta

SEQ ID NO: 2208877 - DNA, 15 bp, Homo sapiens
atttaagataattat

SEQ ID NO: 2208878 - DNA, 16 bp, Homo sapiens
atttacaaatgggaaa

SEQ ID NO: 2208879 - DNA, 15 bp, Homo sapiens
atttatatatgtatt

SEQ ID NO: 2208880 - DNA, 16 bp, Homo sapiens
atttcagcagctgcag

SEQ ID NO: 2208881 - DNA, 20 bp, Homo sapiens
atttcttgaggtaaaagcat

SEQ ID NO: 2208882 - DNA, 13 bp, Homo sapiens
attttaattatta

SEQ ID NO: 2208883 - DNA, 19 bp, Homo sapiens
attttatagctactaattt

SEQ ID NO: 2208884 - DNA, 20 bp, Homo sapiens
caaagatgggtgaaggctgg

SEQ ID NO: 2208885 - DNA, 22 bp, Homo sapiens
caaagatgggtgaaggctggca

SEQ ID NO: 2208886 - DNA, 20 bp, Homo sapiens
caaagcacgaaatgttattt

SEQ ID NO: 2208887 - DNA, 22 bp, Homo sapiens
caaagcacgaaatgttattttt

SEQ ID NO: 2208888 - DNA, 20 bp, Homo sapiens
caaaggagagtcacagaaca

SEQ ID NO: 2208889 - DNA, 18 bp, Homo sapiens
caaattatcaagctaata

SEQ ID NO: 2208890 - DNA, 15 bp, Homo sapiens
caagacctcagggca

SEQ ID NO: 2208891 - DNA, 13 bp, Homo sapiens
caagcaagactga

SEQ ID NO: 2208892 - DNA, 14 bp, Homo sapiens
caagccagggtgtg

SEQ ID NO: 2208893 - DNA, 16 bp, Homo sapiens
caagctaataaaatat

SEQ ID NO: 2208894 - DNA, 22 bp, Homo sapiens
caagctaataaaatatcattca

SEQ ID NO: 2208895 - DNA, 20 bp, Homo sapiens
caaggaaaaaataacaatga

SEQ ID NO: 2208896 - DNA, 15 bp, Homo sapiens
caaggagggcacagg

SEQ ID NO: 2208897 - DNA, 20 bp, Homo sapiens
caaggagggcacaggtgtct

SEQ ID NO: 2208898 - DNA, 15 bp, Homo sapiens
caattcttgccaaat

SEQ ID NO: 2208899 - DNA, 12 bp, Homo sapiens
cacaagccaggg

SEQ ID NO: 2208900 - DNA, 15 bp, Homo sapiens
cacaagccagggtgt

SEQ ID NO: 2208901 - DNA, 13 bp, Homo sapiens
cacagcccagcca

SEQ ID NO: 2208902 - DNA, 19 bp, Homo sapiens
cacatatgcaccttgtgtc

SEQ ID NO: 2208903 - DNA, 20 bp, Homo sapiens
cacatatgcaccttgtgtct

SEQ ID NO: 2208904 - DNA, 20 bp, Homo sapiens
cacatgtcttgtacatgtgt

SEQ ID NO: 2208905 - DNA, 12 bp, Homo sapiens
cacccacatgtg

SEQ ID NO: 2208906 - DNA, 13 bp, Homo sapiens
cacccacatgtga

SEQ ID NO: 2208907 - DNA, 14 bp, Homo sapiens
caccgggcagggcc

SEQ ID NO: 2208908 - DNA, 23 bp, Homo sapiens
cacctgccaccctgggcctggca

SEQ ID NO: 2208909 - DNA, 18 bp, Homo sapiens
aaaacaagaaagtttccc

SEQ ID NO: 2208910 - DNA, 20 bp, Homo sapiens
aaaagacaaggaaaaaataa

SEQ ID NO: 2208911 - DNA, 16 bp, Homo sapiens
aaaatggaaccaggct

SEQ ID NO: 2208912 - DNA, 15 bp, Homo sapiens
aaacaagaaagtttc

SEQ ID NO: 2208913 - DNA, 16 bp, Homo sapiens
aaacaagaaagtttcc

SEQ ID NO: 2208914 - DNA, 17 bp, Homo sapiens
aaacaagaaagtttccc

SEQ ID NO: 2208915 - DNA, 18 bp, Homo sapiens
aaacaagaaagtttcccc

SEQ ID NO: 2208916 - DNA, 20 bp, Homo sapiens
aaacaagcactaaacaaaga

SEQ ID NO: 2208917 - DNA, 14 bp, Homo sapiens
aaacagctgcctct

SEQ ID NO: 2208918 - DNA, 11 bp, Homo sapiens
aaacaggcagt

SEQ ID NO: 2208919 - DNA, 13 bp, Homo sapiens
aaagacagtgaaa

SEQ ID NO: 2208920 - DNA, 22 bp, Homo sapiens
aaagtctctcattctaggcctc

SEQ ID NO: 2208921 - DNA, 15 bp, Homo sapiens
aaagtcttgtgacta

SEQ ID NO: 2208922 - DNA, 21 bp, Homo sapiens
aaagtcttgtgactagtgctg

SEQ ID NO: 2208923 - DNA, 22 bp, Homo sapiens
aaagtcttgtgactagtgctga

SEQ ID NO: 2208924 - DNA, 22 bp, Homo sapiens
aaagtttccccaccagtgaatg

SEQ ID NO: 2208925 - DNA, 12 bp, Homo sapiens
aaataacaatga

SEQ ID NO: 2208926 - DNA, 12 bp, Homo sapiens
aaatatatttaa

SEQ ID NO: 2208927 - DNA, 16 bp, Homo sapiens
aaatatcattcagcaa

SEQ ID NO: 2208928 - DNA, 15 bp, Homo sapiens
aaattatcaagctaa

SEQ ID NO: 2208929 - DNA, 14 bp, Homo sapiens
aaattattaaagga

SEQ ID NO: 2208930 - DNA, 21 bp, Homo sapiens
aacaagcctccttttaaagta

SEQ ID NO: 2208931 - DNA, 23 bp, Homo sapiens
aacaattttaggaggaccagagc

SEQ ID NO: 2208932 - DNA, 16 bp, Homo sapiens
aacccccactggactg

SEQ ID NO: 2208933 - DNA, 23 bp, Homo sapiens
aactaagaaatatgcacaatagc

SEQ ID NO: 2208934 - DNA, 19 bp, Homo sapiens
aactttcctcttcctgcct

SEQ ID NO: 2208935 - DNA, 13 bp, Homo sapiens
aagaaagtttccc

SEQ ID NO: 2208936 - DNA, 21 bp, Homo sapiens
aagaacaccctatattttgca

SEQ ID NO: 2208937 - DNA, 14 bp, Homo sapiens
aagattgagaagtt

SEQ ID NO: 2208938 - DNA, 16 bp, Homo sapiens
aagcaaacccagacgg

SEQ ID NO: 2208939 - DNA, 16 bp, Homo sapiens
aagcagccagccgtga

SEQ ID NO: 2208940 - DNA, 17 bp, Homo sapiens
aagcctgggattgacag

SEQ ID NO: 2208941 - DNA, 21 bp, Homo sapiens
aagctaaatcctttactgtta

SEQ ID NO: 2208942 - DNA, 18 bp, Homo sapiens
aagctaataaaatatcat

SEQ ID NO: 2208943 - DNA, 20 bp, Homo sapiens
aagctaataaaatatcattc

SEQ ID NO: 2208944 - DNA, 15 bp, Homo sapiens
aagcttattaatgct

SEQ ID NO: 2208945 - DNA, 17 bp, Homo sapiens
aagcttattaatgctaa

SEQ ID NO: 2208946 - DNA, 19 bp, Homo sapiens
aaggaaaaaataacaatga

SEQ ID NO: 2208947 - DNA, 16 bp, Homo sapiens
aaggagacaggcagag

SEQ ID NO: 2208948 - DNA, 13 bp, Homo sapiens
aaggataatgaat

SEQ ID NO: 2208949 - DNA, 11 bp, Homo sapiens
aagtattttgc

SEQ ID NO: 2208950 - DNA, 17 bp, Homo sapiens
aagtcctacaagctaaa

SEQ ID NO: 2208951 - DNA, 22 bp, Homo sapiens
aagtcttatatattgtagataa

SEQ ID NO: 2208952 - DNA, 19 bp, Homo sapiens
aagtcttgtgactagtgct

SEQ ID NO: 2208953 - DNA, 23 bp, Homo sapiens
aagtcttgtgactagtgctgaag

SEQ ID NO: 2208954 - DNA, 18 bp, Homo sapiens
aagtttccttccagccca

SEQ ID NO: 2208955 - DNA, 16 bp, Homo sapiens
aagtttgatttcatta

SEQ ID NO: 2208956 - DNA, 18 bp, Homo sapiens
aataaaatatcattcagc

SEQ ID NO: 2208957 - DNA, 20 bp, Homo sapiens
aataaaatatcattcagcaa

SEQ ID NO: 2208958 - DNA, 20 bp, Homo sapiens
cagggccgcccgggcccaga

SEQ ID NO: 2208959 - DNA, 21 bp, Homo sapiens
cagggccgcccgggcccagag

SEQ ID NO: 2208960 - DNA, 10 bp, Homo sapiens
cagggtcaga

SEQ ID NO: 2208961 - DNA, 16 bp, Homo sapiens
cagggtcagaaacagg

SEQ ID NO: 2208962 - DNA, 16 bp, Homo sapiens
caggtgaaacccagtc

SEQ ID NO: 2208963 - DNA, 22 bp, Homo sapiens
caggtgagtcctagagctacag

SEQ ID NO: 2208964 - DNA, 15 bp, Homo sapiens
caggtgcagccagag

SEQ ID NO: 2208965 - DNA, 15 bp, Homo sapiens
cagtcataactaaat

SEQ ID NO: 2208966 - DNA, 13 bp, Homo sapiens
cagtgagccactc

SEQ ID NO: 2208967 - DNA, 16 bp, Homo sapiens
cagtttgagacaggag

SEQ ID NO: 2208968 - DNA, 18 bp, Homo sapiens
cagtttgagacaggagac

SEQ ID NO: 2208969 - DNA, 19 bp, Homo sapiens
cataagaaaactaagaaat

SEQ ID NO: 2208970 - DNA, 18 bp, Homo sapiens
cataatgttacattatta

SEQ ID NO: 2208971 - DNA, 16 bp, Homo sapiens
catagtaccaatcatt

SEQ ID NO: 2208972 - DNA, 23 bp, Homo sapiens
catatgcaccttgtgtctgtaca

SEQ ID NO: 2208973 - DNA, 18 bp, Homo sapiens
catatggactctgcacat

SEQ ID NO: 2208974 - DNA, 22 bp, Homo sapiens
catcaagtctttcacatttaaa

SEQ ID NO: 2208975 - DNA, 20 bp, Homo sapiens
catcagctaaacaccacgtc

SEQ ID NO: 2208976 - DNA, 23 bp, Homo sapiens
catccagtctcccaacttgtatt

SEQ ID NO: 2208977 - DNA, 19 bp, Homo sapiens
catcctgtgcctccatcag

SEQ ID NO: 2208978 - DNA, 19 bp, Homo sapiens
catgagaccactgttatca

SEQ ID NO: 2208979 - DNA, 22 bp, Homo sapiens
catgcgacactgggaggccagt

SEQ ID NO: 2208980 - DNA, 17 bp, Homo sapiens
catgtatgtcttggaca

SEQ ID NO: 2208981 - DNA, 14 bp, Homo sapiens
catgtcttgtacat

SEQ ID NO: 2208982 - DNA, 16 bp, Homo sapiens
catgtgacacatatgc

SEQ ID NO: 2208983 - DNA, 14 bp, Homo sapiens
catgtgtagcctgt

SEQ ID NO: 2208984 - DNA, 16 bp, Homo sapiens
catgtgtagcctgtgc

SEQ ID NO: 2208985 - DNA, 16 bp, Homo sapiens
cattcaggagcttcct

SEQ ID NO: 2208986 - DNA, 16 bp, Homo sapiens
cattttttaaaacaag

SEQ ID NO: 2208987 - DNA, 17 bp, Homo sapiens
cattttttaaaacaaga

SEQ ID NO: 2208988 - DNA, 16 bp, Homo sapiens
ccaaacagctgcctct

SEQ ID NO: 2208989 - DNA, 22 bp, Homo sapiens
ccaatcattttaattattattc

SEQ ID NO: 2208990 - DNA, 16 bp, Homo sapiens
ccacaaaggcaaaggg

SEQ ID NO: 2208991 - DNA, 20 bp, Homo sapiens
ccacaaaggcaaagggtcca

SEQ ID NO: 2208992 - DNA, 19 bp, Homo sapiens
ccacagcccagccacggac

SEQ ID NO: 2208993 - DNA, 17 bp, Homo sapiens
ccacggacgctggctcc

SEQ ID NO: 2208994 - DNA, 17 bp, Homo sapiens
ccactgactgcagggac

SEQ ID NO: 2208995 - DNA, 18 bp, Homo sapiens
ccactggactgacctggt

SEQ ID NO: 2208996 - DNA, 14 bp, Homo sapiens
ccagaaggagacag

SEQ ID NO: 2208997 - DNA, 17 bp, Homo sapiens
ccagaaggagacaggca

SEQ ID NO: 2208998 - DNA, 15 bp, Homo sapiens
ccagacggctccact

SEQ ID NO: 2208999 - DNA, 22 bp, Homo sapiens
ccagagagcctggtgctgctgc

SEQ ID NO: 2209000 - DNA, 14 bp, Homo sapiens
ccaggacaccgggc

SEQ ID NO: 2209001 - DNA, 18 bp, Homo sapiens
ccaggacaccgggcaggg

SEQ ID NO: 2209002 - DNA, 21 bp, Homo sapiens
ccaggagtgtggccacgtggg

SEQ ID NO: 2209003 - DNA, 16 bp, Homo sapiens
ccagggagacctggac

SEQ ID NO: 2209004 - DNA, 18 bp, Homo sapiens
ccagggagacctggacac

SEQ ID NO: 2209005 - DNA, 22 bp, Homo sapiens
ccagggagacctggacacaggc

SEQ ID NO: 2209006 - DNA, 14 bp, Homo sapiens
ccaggtgcagccag

SEQ ID NO: 2209007 - DNA, 21 bp, Homo sapiens
ccatgcgacactgggaggcca

SEQ ID NO: 2209008 - DNA, 19 bp, Homo sapiens
cccaaattatcaagctaat

SEQ ID NO: 2209009 - DNA, 20 bp, Homo sapiens
cccaaattatcaagctaata

SEQ ID NO: 2209010 - DNA, 18 bp, Homo sapiens
cccaacacgcaggagcac

SEQ ID NO: 2209011 - DNA, 14 bp, Homo sapiens
cccaagcagagaag

SEQ ID NO: 2209012 - DNA, 12 bp, Homo sapiens
cccacagagaca

SEQ ID NO: 2209013 - DNA, 19 bp, Homo sapiens
cccacatgtgacacatatg

SEQ ID NO: 2209014 - DNA, 21 bp, Homo sapiens
cccagacggctccactaggac

SEQ ID NO: 2209015 - DNA, 20 bp, Homo sapiens
cccagcctggccacgcagcc

SEQ ID NO: 2209016 - DNA, 22 bp, Homo sapiens
cccagcctggccacgcagccag

SEQ ID NO: 2209017 - DNA, 21 bp, Homo sapiens
cccaggtgcagccagaggcac

SEQ ID NO: 2209018 - DNA, 20 bp, Homo sapiens
cccatccagtctcccaactt

SEQ ID NO: 2209019 - DNA, 19 bp, Homo sapiens
ccccactggactgacctgg

SEQ ID NO: 2209020 - DNA, 21 bp, Homo sapiens
ccccagcctggccacgcagcc

SEQ ID NO: 2209021 - DNA, 14 bp, Homo sapiens
ccccgacgccacag

SEQ ID NO: 2209022 - DNA, 15 bp, Homo sapiens
cccgacgccacagcc

SEQ ID NO: 2209023 - DNA, 23 bp, Homo sapiens
cccgacgccacagcccagccacg

SEQ ID NO: 2209024 - DNA, 18 bp, Homo sapiens
cccggggcagggcagccg

SEQ ID NO: 2209025 - DNA, 12 bp, Homo sapiens
ccctggagccca

SEQ ID NO: 2209026 - DNA, 14 bp, Homo sapiens
ccctttctggctct

SEQ ID NO: 2209027 - DNA, 21 bp, Homo sapiens
ccgacgccacagcccagccac

SEQ ID NO: 2209028 - DNA, 17 bp, Homo sapiens
ccgcacctaaagcagcc

SEQ ID NO: 2209029 - DNA, 20 bp, Homo sapiens
ccgccagggagacctggaca

SEQ ID NO: 2209030 - DNA, 10 bp, Homo sapiens
ccgggcccag

SEQ ID NO: 2209031 - DNA, 16 bp, Homo sapiens
ccggggcagggcagcc

SEQ ID NO: 2209032 - DNA, 16 bp, Homo sapiens
ccgtaggttattttca

SEQ ID NO: 2209033 - DNA, 23 bp, Homo sapiens
ccgtttcctttcatttactgtgg

SEQ ID NO: 2209034 - DNA, 15 bp, Homo sapiens
cctaaagcagccagc

SEQ ID NO: 2209035 - DNA, 14 bp, Homo sapiens
cctatgcacatatg

SEQ ID NO: 2209036 - DNA, 20 bp, Homo sapiens
cctatgcacatatggactct

SEQ ID NO: 2209037 - DNA, 11 bp, Homo sapiens
cctcagggcac

SEQ ID NO: 2209038 - DNA, 17 bp, Homo sapiens
cctccttggtgcctggc

SEQ ID NO: 2209039 - DNA, 21 bp, Homo sapiens
cctgaagccaggccatggcta

SEQ ID NO: 2209040 - DNA, 19 bp, Homo sapiens
cctgacttggggagatgga

SEQ ID NO: 2209041 - DNA, 23 bp, Homo sapiens
cctgacttggggagatggagttc

SEQ ID NO: 2209042 - DNA, 13 bp, Homo sapiens
cctgagggagctc

SEQ ID NO: 2209043 - DNA, 15 bp, Homo sapiens
cctgagggagctcca

SEQ ID NO: 2209044 - DNA, 15 bp, Homo sapiens
cctgcacaagccagg

SEQ ID NO: 2209045 - DNA, 16 bp, Homo sapiens
cctgcacaagccaggg

SEQ ID NO: 2209046 - DNA, 15 bp, Homo sapiens
cctgccaccctgggc

SEQ ID NO: 2209047 - DNA, 15 bp, Homo sapiens
cctggcacacatcag

SEQ ID NO: 2209048 - DNA, 18 bp, Homo sapiens
cctggccacgcagccagg

SEQ ID NO: 2209049 - DNA, 19 bp, Homo sapiens
cctggccacgcagccagga

SEQ ID NO: 2209050 - DNA, 13 bp, Homo sapiens
cctggcctggcac

SEQ ID NO: 2209051 - DNA, 17 bp, Homo sapiens
cctggtccacagggcac

SEQ ID NO: 2209052 - DNA, 13 bp, Homo sapiens
cctggtgctgctg

SEQ ID NO: 2209053 - DNA, 20 bp, Homo sapiens
cctgtaatcatataataaat

SEQ ID NO: 2209054 - DNA, 20 bp, Homo sapiens
cctgtagttgcgtggactct

SEQ ID NO: 2209055 - DNA, 23 bp, Homo sapiens
cctgtagttgcgtggactctgca

SEQ ID NO: 2209056 - DNA, 18 bp, Homo sapiens
ccttgaagaacctctcac

SEQ ID NO: 2209057 - DNA, 22 bp, Homo sapiens
cctttcatttactgtggcttct

SEQ ID NO: 2209058 - DNA, 13 bp, Homo sapiens
cgaactggcgcct

SEQ ID NO: 2209059 - DNA, 16 bp, Homo sapiens
cgaccttggccgcacc

SEQ ID NO: 2209060 - DNA, 13 bp, Homo sapiens
cgcacctaaagca

SEQ ID NO: 2209061 - DNA, 20 bp, Homo sapiens
cgcacctaaagcagccagcc

SEQ ID NO: 2209062 - DNA, 21 bp, Homo sapiens
cgccacagcccagccacggac

SEQ ID NO: 2209063 - DNA, 13 bp, Homo sapiens
cgcccccttggct

SEQ ID NO: 2209064 - DNA, 13 bp, Homo sapiens
cgctggctcccca

SEQ ID NO: 2209065 - DNA, 14 bp, Homo sapiens
cggacgctggctcc

SEQ ID NO: 2209066 - DNA, 15 bp, Homo sapiens
cggacgctggctccc

SEQ ID NO: 2209067 - DNA, 15 bp, Homo sapiens
cggctccactaggac

SEQ ID NO: 2209068 - DNA, 21 bp, Homo sapiens
cggctcccggggcagggcagc

SEQ ID NO: 2209069 - DNA, 13 bp, Homo sapiens
cgggcagcctggc

SEQ ID NO: 2209070 - DNA, 23 bp, Homo sapiens
cgggcagcctggctcccaggaca

SEQ ID NO: 2209071 - DNA, 15 bp, Homo sapiens
cggtagctgtgcgtg

SEQ ID NO: 2209072 - DNA, 15 bp, Homo sapiens
cgtgagtgcagaccc

SEQ ID NO: 2209073 - DNA, 16 bp, Homo sapiens
cgtggactctgcacat

SEQ ID NO: 2209074 - DNA, 15 bp, Homo sapiens
ctaaagtatgaagca

SEQ ID NO: 2209075 - DNA, 23 bp, Homo sapiens
ctaaataaagcttgcaacaaaat

SEQ ID NO: 2209076 - DNA, 12 bp, Homo sapiens
ctaacatataat

SEQ ID NO: 2209077 - DNA, 22 bp, Homo sapiens
ctaacatataatgttgttattt

SEQ ID NO: 2209078 - DNA, 19 bp, Homo sapiens
ctaataaaatatcattcag

SEQ ID NO: 2209079 - DNA, 21 bp, Homo sapiens
ctaataaaatatcattcagca

SEQ ID NO: 2209080 - DNA, 17 bp, Homo sapiens
ctaatacctctgtgtgc

SEQ ID NO: 2209081 - DNA, 19 bp, Homo sapiens
ctacaagctaaaattagat

SEQ ID NO: 2209082 - DNA, 13 bp, Homo sapiens
ctaggttctaaaa

SEQ ID NO: 2209083 - DNA, 12 bp, Homo sapiens
ctagtgctgaag

SEQ ID NO: 2209084 - DNA, 21 bp, Homo sapiens
ctagtgctgaagcttattaat

SEQ ID NO: 2209085 - DNA, 12 bp, Homo sapiens
ctatgcacatat

SEQ ID NO: 2209086 - DNA, 13 bp, Homo sapiens
ctatgcacatatg

SEQ ID NO: 2209087 - DNA, 22 bp, Homo sapiens
ctatgcacatatggactctgca

SEQ ID NO: 2209088 - DNA, 16 bp, Homo sapiens
ctcaagatgaaggcaa

SEQ ID NO: 2209089 - DNA, 14 bp, Homo sapiens
ctcacttcaccctg

SEQ ID NO: 2209090 - DNA, 22 bp, Homo sapiens
ctcagcttccccaacacgcagg

SEQ ID NO: 2209091 - DNA, 20 bp, Homo sapiens
ctcattgcttggaattcagc

SEQ ID NO: 2209092 - DNA, 18 bp, Homo sapiens
ctcccaggtgcagccaga

SEQ ID NO: 2209093 - DNA, 14 bp, Homo sapiens
ctccccgcttctgc

SEQ ID NO: 2209094 - DNA, 18 bp, Homo sapiens
ctcccggggcagggcagc

SEQ ID NO: 2209095 - DNA, 20 bp, Homo sapiens
ctccctgcacaagccagggt

SEQ ID NO: 2209096 - DNA, 12 bp, Homo sapiens
ctcctggcccag

SEQ ID NO: 2209097 - DNA, 14 bp, Homo sapiens
ctcctggcccaggt

SEQ ID NO: 2209098 - DNA, 14 bp, Homo sapiens
ctccttggtgcctg

SEQ ID NO: 2209099 - DNA, 15 bp, Homo sapiens
ctctaatatcagcaa

SEQ ID NO: 2209100 - DNA, 13 bp, Homo sapiens
ctctcacattact

SEQ ID NO: 2209101 - DNA, 14 bp, Homo sapiens
ctctcacattactg

SEQ ID NO: 2209102 - DNA, 14 bp, Homo sapiens
ctctcccatttcct

SEQ ID NO: 2209103 - DNA, 20 bp, Homo sapiens
tgtgcatgtatgtcttggac

SEQ ID NO: 2209104 - DNA, 16 bp, Homo sapiens
tgtgctcctccttggt

SEQ ID NO: 2209105 - DNA, 15 bp, Homo sapiens
tgtgtagcctgtgca

SEQ ID NO: 2209106 - DNA, 23 bp, Homo sapiens
tgtgtagcctgtgcatgtatgtc

SEQ ID NO: 2209107 - DNA, 15 bp, Homo sapiens
tgttacattattatc

SEQ ID NO: 2209108 - DNA, 16 bp, Homo sapiens
tgttactatctgcttt

SEQ ID NO: 2209109 - DNA, 20 bp, Homo sapiens
ttaaaacaagaaagtttccc

SEQ ID NO: 2209110 - DNA, 20 bp, Homo sapiens
ttaagtttccttccagccca

SEQ ID NO: 2209111 - DNA, 22 bp, Homo sapiens
ttaatgtcaattcttgccaaat

SEQ ID NO: 2209112 - DNA, 14 bp, Homo sapiens
ttacactctttgta

SEQ ID NO: 2209113 - DNA, 16 bp, Homo sapiens
ttactgtggcttctta

SEQ ID NO: 2209114 - DNA, 18 bp, Homo sapiens
ttactgttagtcatttgc

SEQ ID NO: 2209115 - DNA, 12 bp, Homo sapiens
ttataatttaaa

SEQ ID NO: 2209116 - DNA, 15 bp, Homo sapiens
ttatcaaaactttct

SEQ ID NO: 2209117 - DNA, 16 bp, Homo sapiens
ttatcattttcaaaat

SEQ ID NO: 2209118 - DNA, 19 bp, Homo sapiens
ttatctaatacctctgtgt

SEQ ID NO: 2209119 - DNA, 17 bp, Homo sapiens
ttatgggaatcaagatt

SEQ ID NO: 2209120 - DNA, 10 bp, Homo sapiens
ttattaaagg

SEQ ID NO: 2209121 - DNA, 16 bp, Homo sapiens
ttattaatgctaaggg

SEQ ID NO: 2209122 - DNA, 15 bp, Homo sapiens
ttattatatttacaa

SEQ ID NO: 2209123 - DNA, 11 bp, Homo sapiens
ttccagaatcc

SEQ ID NO: 2209124 - DNA, 18 bp, Homo sapiens
ttcctgccgcaacagttt

SEQ ID NO: 2209125 - DNA, 16 bp, Homo sapiens
ttcctttcatttactg

SEQ ID NO: 2209126 - DNA, 14 bp, Homo sapiens
ttcgggctggccat

SEQ ID NO: 2209127 - DNA, 18 bp, Homo sapiens
ttcggtgagctacaaatg

SEQ ID NO: 2209128 - DNA, 15 bp, Homo sapiens
ttctaaatgaatgtt

SEQ ID NO: 2209129 - DNA, 14 bp, Homo sapiens
ttctccagggtcag

SEQ ID NO: 2209130 - DNA, 14 bp, Homo sapiens
ttctgagcatttaa

SEQ ID NO: 2209131 - DNA, 20 bp, Homo sapiens
ttctggaatgtaatcaatgt

SEQ ID NO: 2209132 - DNA, 16 bp, Homo sapiens
ttctggctctcccatt

SEQ ID NO: 2209133 - DNA, 20 bp, Homo sapiens
ttcttaatcttttcacaaat

SEQ ID NO: 2209134 - DNA, 22 bp, Homo sapiens
ttcttaatcttttcacaaataa

SEQ ID NO: 2209135 - DNA, 18 bp, Homo sapiens
ttcttctaggttctaaaa

SEQ ID NO: 2209136 - DNA, 21 bp, Homo sapiens
ttcttctaggttctaaaaatt

SEQ ID NO: 2209137 - DNA, 21 bp, Homo sapiens
ttcttttctggaatgtaatca

SEQ ID NO: 2209138 - DNA, 21 bp, Homo sapiens
ttgaaaatcttataatttaaa

SEQ ID NO: 2209139 - DNA, 17 bp, Homo sapiens
ttgaagggaaatttcag

SEQ ID NO: 2209140 - DNA, 21 bp, Homo sapiens
ttgactcttttgccattaaac

SEQ ID NO: 2209141 - DNA, 19 bp, Homo sapiens
ttgagaggccctggggttc

SEQ ID NO: 2209142 - DNA, 20 bp, Homo sapiens
ttggtgcctggcctggcaca

SEQ ID NO: 2209143 - DNA, 16 bp, Homo sapiens
ttgtaaaggaatttaa

SEQ ID NO: 2209144 - DNA, 17 bp, Homo sapiens
ttgtaattctaaatgaa

SEQ ID NO: 2209145 - DNA, 14 bp, Homo sapiens
ttgtattacaaatc

SEQ ID NO: 2209146 - DNA, 22 bp, Homo sapiens
ttgtgactagtgctgaagctta

SEQ ID NO: 2209147 - DNA, 23 bp, Homo sapiens
ttgtgactagtgctgaagcttat

SEQ ID NO: 2209148 - DNA, 22 bp, Homo sapiens
tttaaaacaagaaagtttcccc

SEQ ID NO: 2209149 - DNA, 23 bp, Homo sapiens
tttaattattattcttcataaca

SEQ ID NO: 2209150 - DNA, 12 bp, Homo sapiens
tttcacaaataa

SEQ ID NO: 2209151 - DNA, 13 bp, Homo sapiens
tttcactgccata

SEQ ID NO: 2209152 - DNA, 14 bp, Homo sapiens
tttcagcagactga

SEQ ID NO: 2209153 - DNA, 20 bp, Homo sapiens
tttctctccagcctgacttg

SEQ ID NO: 2209154 - DNA, 16 bp, Homo sapiens
tttctgggataagtaa

SEQ ID NO: 2209155 - DNA, 21 bp, Homo sapiens
tttgaaattgtattacaaatc

SEQ ID NO: 2209156 - DNA, 18 bp, Homo sapiens
tttgaatcatcaagtctt

SEQ ID NO: 2209157 - DNA, 12 bp, Homo sapiens
tttgactctttt

SEQ ID NO: 2209158 - DNA, 14 bp, Homo sapiens
tttgatttcattaa

SEQ ID NO: 2209159 - DNA, 14 bp, Homo sapiens
ttttaagttgctga

SEQ ID NO: 2209160 - DNA, 16 bp, Homo sapiens
ttttaattattattct

SEQ ID NO: 2209161 - DNA, 18 bp, Homo sapiens
ttttctggaatgtaatca

SEQ ID NO: 2209162 - DNA, 15 bp, Homo sapiens
ttttgccattaaact

SEQ ID NO: 2209163 - DNA, 19 bp, Homo sapiens
tttttgtgaaaagctccat

SEQ ID NO: 2209164 - DNA, 23 bp, Homo sapiens
aagacagtgaaagaaaataacaa

SEQ ID NO: 2209165 - DNA, 15 bp, Homo sapiens
aagacctcagggcac

SEQ ID NO: 2209166 - DNA, 18 bp, Homo sapiens
aagatgggtgaaggctgg

SEQ ID NO: 2209167 - DNA, 19 bp, Homo sapiens
aagcaaacccagacggctc

SEQ ID NO: 2209168 - DNA, 16 bp, Homo sapiens
aagcactaaacaaaga

SEQ ID NO: 2209169 - DNA, 16 bp, Homo sapiens
aagcagagaagctctc

SEQ ID NO: 2209170 - DNA, 17 bp, Homo sapiens
aagctaataaaatatca

SEQ ID NO: 2209171 - DNA, 14 bp, Homo sapiens
aagcttattaatgc

SEQ ID NO: 2209172 - DNA, 18 bp, Homo sapiens
aagcttattaatgctaag

SEQ ID NO: 2209173 - DNA, 16 bp, Homo sapiens
aaggaaaaaataacaa

SEQ ID NO: 2209174 - DNA, 14 bp, Homo sapiens
aaggagacaggcag

SEQ ID NO: 2209175 - DNA, 21 bp, Homo sapiens
aaggcaaagggtccagaagga

SEQ ID NO: 2209176 - DNA, 22 bp, Homo sapiens
aagggcaggcccaaattatcaa

SEQ ID NO: 2209177 - DNA, 21 bp, Homo sapiens
aagtctctcattctaggcctc

SEQ ID NO: 2209178 - DNA, 22 bp, Homo sapiens
aagtctctttttttggcccagg

SEQ ID NO: 2209179 - DNA, 17 bp, Homo sapiens
aagtttccccaccagtg

SEQ ID NO: 2209180 - DNA, 15 bp, Homo sapiens
aagtttgatttcatt

SEQ ID NO: 2209181 - DNA, 14 bp, Homo sapiens
aataaaatatcatt

SEQ ID NO: 2209182 - DNA, 19 bp, Homo sapiens
aataaaatatcattcagca

SEQ ID NO: 2209183 - DNA, 15 bp, Homo sapiens
aataacgataaaaga

SEQ ID NO: 2209184 - DNA, 18 bp, Homo sapiens
aataatacctaagccttc

SEQ ID NO: 2209185 - DNA, 21 bp, Homo sapiens
aataatcctaaacatatgaat

SEQ ID NO: 2209186 - DNA, 16 bp, Homo sapiens
aatacagggcattttg

SEQ ID NO: 2209187 - DNA, 14 bp, Homo sapiens
aatacctctgtgtg

SEQ ID NO: 2209188 - DNA, 19 bp, Homo sapiens
aatagtctagactaaaaga

SEQ ID NO: 2209189 - DNA, 20 bp, Homo sapiens
aatagtctagactaaaagat

SEQ ID NO: 2209190 - DNA, 13 bp, Homo sapiens
aatatcattcagc

SEQ ID NO: 2209191 - DNA, 16 bp, Homo sapiens
aatcattttaattatt

SEQ ID NO: 2209192 - DNA, 15 bp, Homo sapiens
aatccaatgaaatga

SEQ ID NO: 2209193 - DNA, 14 bp, Homo sapiens
aatcttttcacaaa

SEQ ID NO: 2209194 - DNA, 16 bp, Homo sapiens
aatcttttcacaaata

SEQ ID NO: 2209195 - DNA, 17 bp, Homo sapiens
aatcttttcacaaataa

SEQ ID NO: 2209196 - DNA, 19 bp, Homo sapiens
aatgaaagtcttgtgacta

SEQ ID NO: 2209197 - DNA, 22 bp, Homo sapiens
aatgagaagaaaatggaaccag

SEQ ID NO: 2209198 - DNA, 19 bp, Homo sapiens
aatggacttttgtacatag

SEQ ID NO: 2209199 - DNA, 20 bp, Homo sapiens
aatgtttacactctttgtaa

SEQ ID NO: 2209200 - DNA, 22 bp, Homo sapiens
aatgtttcttctaggttctaaa

SEQ ID NO: 2209201 - DNA, 15 bp, Homo sapiens
aattatcaagctaat

SEQ ID NO: 2209202 - DNA, 11 bp, Homo sapiens
aattattattt

SEQ ID NO: 2209203 - DNA, 20 bp, Homo sapiens
aattgcattttttaaaacaa

SEQ ID NO: 2209204 - DNA, 11 bp, Homo sapiens
aattgtaatag

SEQ ID NO: 2209205 - DNA, 21 bp, Homo sapiens
acaaagatgggtgaaggctgg

SEQ ID NO: 2209206 - DNA, 22 bp, Homo sapiens
acaaagatgggtgaaggctggc

SEQ ID NO: 2209207 - DNA, 15 bp, Homo sapiens
acaagaaagtttccc

SEQ ID NO: 2209208 - DNA, 17 bp, Homo sapiens
acaagaaagtttcccca

SEQ ID NO: 2209209 - DNA, 15 bp, Homo sapiens
acaagcaaacccaga

SEQ ID NO: 2209210 - DNA, 19 bp, Homo sapiens
acaagcaaacccagacggc

SEQ ID NO: 2209211 - DNA, 14 bp, Homo sapiens
acaagctaaaatta

SEQ ID NO: 2209212 - DNA, 12 bp, Homo sapiens
acacccagcccc

SEQ ID NO: 2209213 - DNA, 14 bp, Homo sapiens
acacgcaggagcac

SEQ ID NO: 2209214 - DNA, 19 bp, Homo sapiens
acacgggcagcctggctcc

SEQ ID NO: 2209215 - DNA, 16 bp, Homo sapiens
acactctttgtaagag

SEQ ID NO: 2209216 - DNA, 15 bp, Homo sapiens
acactgggaggccag

SEQ ID NO: 2209217 - DNA, 16 bp, Homo sapiens
acagcccagccacgga

SEQ ID NO: 2209218 - DNA, 14 bp, Homo sapiens
acaggagacctggc

SEQ ID NO: 2209219 - DNA, 20 bp, Homo sapiens
acagtgaaagaaaataacaa

SEQ ID NO: 2209220 - DNA, 23 bp, Homo sapiens
acagttcggtgagctacaaatgc

SEQ ID NO: 2209221 - DNA, 15 bp, Homo sapiens
acatatgcaccttgt

SEQ ID NO: 2209222 - DNA, 17 bp, Homo sapiens
acatatgcaccttgtgt

SEQ ID NO: 2209223 - DNA, 18 bp, Homo sapiens
acatatgcaccttgtgtc

SEQ ID NO: 2209224 - DNA, 20 bp, Homo sapiens
acatatgcaccttgtgtctg

SEQ ID NO: 2209225 - DNA, 18 bp, Homo sapiens
acatggcctatgcacata

SEQ ID NO: 2209226 - DNA, 16 bp, Homo sapiens
acatgtcttgtacatg

SEQ ID NO: 2209227 - DNA, 19 bp, Homo sapiens
acatgtcttgtacatgtgt

SEQ ID NO: 2209228 - DNA, 12 bp, Homo sapiens
acatgtgacaca

SEQ ID NO: 2209229 - DNA, 13 bp, Homo sapiens
accaatcatttta

SEQ ID NO: 2209230 - DNA, 18 bp, Homo sapiens
accataatgttacattat

SEQ ID NO: 2209231 - DNA, 23 bp, Homo sapiens
accatttcttgaggtaaaagcat

SEQ ID NO: 2209232 - DNA, 18 bp, Homo sapiens
acccaagacctcagggca

SEQ ID NO: 2209233 - DNA, 17 bp, Homo sapiens
acccagacggctccact

SEQ ID NO: 2209234 - DNA, 21 bp, Homo sapiens
accccagcctggccacgcagc

SEQ ID NO: 2209235 - DNA, 17 bp, Homo sapiens
acccccactggactgac

SEQ ID NO: 2209236 - DNA, 20 bp, Homo sapiens
acccgggcagggctcccaca

SEQ ID NO: 2209237 - DNA, 15 bp, Homo sapiens
accgggcagggccgc

SEQ ID NO: 2209238 - DNA, 18 bp, Homo sapiens
acctcagttttatcattt

SEQ ID NO: 2209239 - DNA, 11 bp, Homo sapiens
acctctgtgtg

SEQ ID NO: 2209240 - DNA, 17 bp, Homo sapiens
acctgattaactgaggc

SEQ ID NO: 2209241 - DNA, 22 bp, Homo sapiens
accttcagtaacccccactgga

SEQ ID NO: 2209242 - DNA, 15 bp, Homo sapiens
accttgtgtctgtac

SEQ ID NO: 2209243 - DNA, 12 bp, Homo sapiens
acgaaatgttat

SEQ ID NO: 2209244 - DNA, 14 bp, Homo sapiens
acgagaaaacaata

SEQ ID NO: 2209245 - DNA, 12 bp, Homo sapiens
acgcagccagga

SEQ ID NO: 2209246 - DNA, 14 bp, Homo sapiens
acgcagccaggaca

SEQ ID NO: 2209247 - DNA, 14 bp, Homo sapiens
acgccacagcccag

SEQ ID NO: 2209248 - DNA, 24 bp, Homo sapiens
acgcggctcccggggcagggcagc

SEQ ID NO: 2209249 - DNA, 15 bp, Homo sapiens
actaacatataatgt

SEQ ID NO: 2209250 - DNA, 17 bp, Homo sapiens
actaacatataatgttg

SEQ ID NO: 2209251 - DNA, 22 bp, Homo sapiens
actaatgaccacacctgcctct

SEQ ID NO: 2209252 - DNA, 14 bp, Homo sapiens
actagctatggtgt

SEQ ID NO: 2209253 - DNA, 17 bp, Homo sapiens
actagtgctgaagctta

SEQ ID NO: 2209254 - DNA, 17 bp, Homo sapiens
actctacccatattaca

SEQ ID NO: 2209255 - DNA, 23 bp, Homo sapiens
actctagaaaacgcgaccttggc

SEQ ID NO: 2209256 - DNA, 11 bp, Homo sapiens
actctgcacat

SEQ ID NO: 2209257 - DNA, 14 bp, Homo sapiens
actcttaatcaaat

SEQ ID NO: 2209258 - DNA, 13 bp, Homo sapiens
actctttgtaaga

SEQ ID NO: 2209259 - DNA, 18 bp, Homo sapiens
actggatgcagaaacagt

SEQ ID NO: 2209260 - DNA, 17 bp, Homo sapiens
acttaataatgtgtaca

SEQ ID NO: 2209261 - DNA, 18 bp, Homo sapiens
acttgtattaaagacaga

SEQ ID NO: 2209262 - DNA, 15 bp, Homo sapiens
actttcttttctgga

SEQ ID NO: 2209263 - DNA, 19 bp, Homo sapiens
actttcttttctggaatgt

SEQ ID NO: 2209264 - DNA, 19 bp, Homo sapiens
agaaaatggaaccaggctt

SEQ ID NO: 2209265 - DNA, 19 bp, Homo sapiens
agaagaaaatggaaccagg

SEQ ID NO: 2209266 - DNA, 23 bp, Homo sapiens
agaagaaaatggaaccaggcttg

SEQ ID NO: 2209267 - DNA, 13 bp, Homo sapiens
agacctgtaatca

SEQ ID NO: 2209268 - DNA, 14 bp, Homo sapiens
agactgatcaggac

SEQ ID NO: 2209269 - DNA, 12 bp, Homo sapiens
agataattataa

SEQ ID NO: 2209270 - DNA, 21 bp, Homo sapiens
agataggtcagtgcaaatact

SEQ ID NO: 2209271 - DNA, 13 bp, Homo sapiens
agcaaacccagac

SEQ ID NO: 2209272 - DNA, 15 bp, Homo sapiens
agcaaacccagacgg

SEQ ID NO: 2209273 - DNA, 16 bp, Homo sapiens
agcagactgatcagga

SEQ ID NO: 2209274 - DNA, 18 bp, Homo sapiens
agcagactgatcaggacc

SEQ ID NO: 2209275 - DNA, 19 bp, Homo sapiens
agcagactgatcaggacct

SEQ ID NO: 2209276 - DNA, 20 bp, Homo sapiens
agcatcacatgaacttgtaa

SEQ ID NO: 2209277 - DNA, 20 bp, Homo sapiens
agcatgtcgtcaaagctgaa

SEQ ID NO: 2209278 - DNA, 13 bp, Homo sapiens
agccagaggactg

SEQ ID NO: 2209279 - DNA, 23 bp, Homo sapiens
agcctggccacgcagccaggaca

SEQ ID NO: 2209280 - DNA, 21 bp, Homo sapiens
agcgtggcgcagtggccctga

SEQ ID NO: 2209281 - DNA, 22 bp, Homo sapiens
agcgtggcgcagtggccctgag

SEQ ID NO: 2209282 - DNA, 14 bp, Homo sapiens
agctaataaaatat

SEQ ID NO: 2209283 - DNA, 17 bp, Homo sapiens
agctaataaaatatcat

SEQ ID NO: 2209284 - DNA, 21 bp, Homo sapiens
agctaataaaatatcattcag

SEQ ID NO: 2209285 - DNA, 12 bp, Homo sapiens
agctagccagag

SEQ ID NO: 2209286 - DNA, 19 bp, Homo sapiens
agctagccagaggactgtg

SEQ ID NO: 2209287 - DNA, 15 bp, Homo sapiens
agctcccaggtgcag

SEQ ID NO: 2209288 - DNA, 21 bp, Homo sapiens
agctcccaggtgcagccagag

SEQ ID NO: 2209289 - DNA, 16 bp, Homo sapiens
agctcctcactcacct

SEQ ID NO: 2209290 - DNA, 14 bp, Homo sapiens
agcttattaatgct

SEQ ID NO: 2209291 - DNA, 16 bp, Homo sapiens
agcttattaatgctaa

SEQ ID NO: 2209292 - DNA, 17 bp, Homo sapiens
agcttattaatgctaag

SEQ ID NO: 2209293 - DNA, 19 bp, Homo sapiens
agcttattaatgctaaggg

SEQ ID NO: 2209294 - DNA, 18 bp, Homo sapiens
aggaaaaaataacaatga

SEQ ID NO: 2209295 - DNA, 20 bp, Homo sapiens
aggactgtgatgccctgccc

SEQ ID NO: 2209296 - DNA, 17 bp, Homo sapiens
aggactttctgaagcct

SEQ ID NO: 2209297 - DNA, 18 bp, Homo sapiens
aggagacaggcagagctg

SEQ ID NO: 2209298 - DNA, 15 bp, Homo sapiens
aggatggcaggacgt

SEQ ID NO: 2209299 - DNA, 12 bp, Homo sapiens
aggctggcatga

SEQ ID NO: 2209300 - DNA, 17 bp, Homo sapiens
aggcttttttccagact

SEQ ID NO: 2209301 - DNA, 20 bp, Homo sapiens
agggcaggcccaaattatca

SEQ ID NO: 2209302 - DNA, 23 bp, Homo sapiens
agggccgccagggagacctggac

SEQ ID NO: 2209303 - DNA, 20 bp, Homo sapiens
agggccgcccgggcccagag

SEQ ID NO: 2209304 - DNA, 19 bp, Homo sapiens
agggtcagaaacaggaccg

SEQ ID NO: 2209305 - DNA, 18 bp, Homo sapiens
agggtccagaaggagaca

SEQ ID NO: 2209306 - DNA, 21 bp, Homo sapiens
agggtccagaaggagacaggc

SEQ ID NO: 2209307 - DNA, 15 bp, Homo sapiens
agggtgtgccctcac

SEQ ID NO: 2209308 - DNA, 15 bp, Homo sapiens
aggtcagtgcaaata

SEQ ID NO: 2209309 - DNA, 19 bp, Homo sapiens
ctcctccttggtgcctggc

SEQ ID NO: 2209310 - DNA, 16 bp, Homo sapiens
ctctacccatattaca

SEQ ID NO: 2209311 - DNA, 19 bp, Homo sapiens
ctctacccatattacagat

SEQ ID NO: 2209312 - DNA, 14 bp, Homo sapiens
ctctgcacatgtct

SEQ ID NO: 2209313 - DNA, 16 bp, Homo sapiens
ctctgcacatgtcttg

SEQ ID NO: 2209314 - DNA, 18 bp, Homo sapiens
ctctgcacatgtcttgta

SEQ ID NO: 2209315 - DNA, 14 bp, Homo sapiens
ctctgcattctagt

SEQ ID NO: 2209316 - DNA, 18 bp, Homo sapiens
ctcttcaaggactttctg

SEQ ID NO: 2209317 - DNA, 16 bp, Homo sapiens
ctctttttttggccca

SEQ ID NO: 2209318 - DNA, 18 bp, Homo sapiens
ctctttttttggcccagg

SEQ ID NO: 2209319 - DNA, 19 bp, Homo sapiens
ctctttttttggcccaggc

SEQ ID NO: 2209320 - DNA, 12 bp, Homo sapiens
ctgaagcttatt

SEQ ID NO: 2209321 - DNA, 18 bp, Homo sapiens
ctgaagcttattaatgct

SEQ ID NO: 2209322 - DNA, 21 bp, Homo sapiens
ctgaagcttattaatgctaag

SEQ ID NO: 2209323 - DNA, 23 bp, Homo sapiens
ctgaagcttattaatgctaaggg

SEQ ID NO: 2209324 - DNA, 17 bp, Homo sapiens
ctgacctggtccacagg

SEQ ID NO: 2209325 - DNA, 20 bp, Homo sapiens
ctgagggagctccaactcag

SEQ ID NO: 2209326 - DNA, 19 bp, Homo sapiens
ctgcacaagccagggtgtg

SEQ ID NO: 2209327 - DNA, 22 bp, Homo sapiens
ctgcacatgaatcccacccaca

SEQ ID NO: 2209328 - DNA, 23 bp, Homo sapiens
ctgcacatgaatcccacccacat

SEQ ID NO: 2209329 - DNA, 17 bp, Homo sapiens
ctgcatacccgggcagg

SEQ ID NO: 2209330 - DNA, 16 bp, Homo sapiens
ctgccaccctgggcct

SEQ ID NO: 2209331 - DNA, 19 bp, Homo sapiens
ctgccactgactgcaggga

SEQ ID NO: 2209332 - DNA, 15 bp, Homo sapiens
ctgcctgcacccctg

SEQ ID NO: 2209333 - DNA, 21 bp, Homo sapiens
ctgctcccctctgcacggacc

SEQ ID NO: 2209334 - DNA, 21 bp, Homo sapiens
ctggactgacctggtccacag

SEQ ID NO: 2209335 - DNA, 12 bp, Homo sapiens
ctggcacacatc

SEQ ID NO: 2209336 - DNA, 12 bp, Homo sapiens
ctggcagctcag

SEQ ID NO: 2209337 - DNA, 18 bp, Homo sapiens
ctggccacgcagccagga

SEQ ID NO: 2209338 - DNA, 13 bp, Homo sapiens
ctggcctggcaca

SEQ ID NO: 2209339 - DNA, 15 bp, Homo sapiens
ctggctcccaggaca

SEQ ID NO: 2209340 - DNA, 20 bp, Homo sapiens
ctggctctcccatttcctga

SEQ ID NO: 2209341 - DNA, 17 bp, Homo sapiens
ctgggcaccctcccacc

SEQ ID NO: 2209342 - DNA, 16 bp, Homo sapiens
ctggtccacagggcac

SEQ ID NO: 2209343 - DNA, 22 bp, Homo sapiens
ctggtccacagggcacctgcca

SEQ ID NO: 2209344 - DNA, 16 bp, Homo sapiens
ctggttaggatggcag

SEQ ID NO: 2209345 - DNA, 19 bp, Homo sapiens
ctgtaatcatataataaat

SEQ ID NO: 2209346 - DNA, 18 bp, Homo sapiens
ctgtgacttaagaagcct

SEQ ID NO: 2209347 - DNA, 20 bp, Homo sapiens
ctgtgagctcccaggtgcag

SEQ ID NO: 2209348 - DNA, 17 bp, Homo sapiens
ctgtgcatgtatgtctt

SEQ ID NO: 2209349 - DNA, 18 bp, Homo sapiens
ctgtgtgctcctccttgg

SEQ ID NO: 2209350 - DNA, 21 bp, Homo sapiens
cttaatcttttcacaaataaa

SEQ ID NO: 2209351 - DNA, 15 bp, Homo sapiens
cttattaatgctaag

SEQ ID NO: 2209352 - DNA, 15 bp, Homo sapiens
cttcactgtaaaata

SEQ ID NO: 2209353 - DNA, 15 bp, Homo sapiens
cttcataacaatttt

SEQ ID NO: 2209354 - DNA, 18 bp, Homo sapiens
cttccccaacacgcagga

SEQ ID NO: 2209355 - DNA, 18 bp, Homo sapiens
cttcctatatgcacttat

SEQ ID NO: 2209356 - DNA, 16 bp, Homo sapiens
cttcttaatcttttca

SEQ ID NO: 2209357 - DNA, 17 bp, Homo sapiens
cttcttaatcttttcac

SEQ ID NO: 2209358 - DNA, 13 bp, Homo sapiens
cttgagccagtaa

SEQ ID NO: 2209359 - DNA, 16 bp, Homo sapiens
cttgagccagtaattg

SEQ ID NO: 2209360 - DNA, 16 bp, Homo sapiens
cttgtaattctaaatg

SEQ ID NO: 2209361 - DNA, 23 bp, Homo sapiens
cttgtaattctaaatgaatgttt

SEQ ID NO: 2209362 - DNA, 14 bp, Homo sapiens
cttgtgtctgtaca

SEQ ID NO: 2209363 - DNA, 22 bp, Homo sapiens
cttgtttcaattccacctgcaa

SEQ ID NO: 2209364 - DNA, 20 bp, Homo sapiens
ctttatatggcctcaagatc

SEQ ID NO: 2209365 - DNA, 16 bp, Homo sapiens
ctttatggtaaagatg

SEQ ID NO: 2209366 - DNA, 21 bp, Homo sapiens
ctttattttctataatttaaa

SEQ ID NO: 2209367 - DNA, 22 bp, Homo sapiens
ctttcttttctggaatgtaatc

SEQ ID NO: 2209368 - DNA, 15 bp, Homo sapiens
ctttgatcccttctg

SEQ ID NO: 2209369 - DNA, 20 bp, Homo sapiens
ctttggttaaatagtctaga

SEQ ID NO: 2209370 - DNA, 13 bp, Homo sapiens
cttttcacaaata

SEQ ID NO: 2209371 - DNA, 15 bp, Homo sapiens
ctttttttggcccag

SEQ ID NO: 2209372 - DNA, 21 bp, Homo sapiens
gaaagtcttgtgactagtgct

SEQ ID NO: 2209373 - DNA, 20 bp, Homo sapiens
gaaagtttccccaccagtga

SEQ ID NO: 2209374 - DNA, 17 bp, Homo sapiens
gaaatatgcacaatagc

SEQ ID NO: 2209375 - DNA, 20 bp, Homo sapiens
gaactcttaatcaaatagca

SEQ ID NO: 2209376 - DNA, 19 bp, Homo sapiens
gaagatctctgcagggccg

SEQ ID NO: 2209377 - DNA, 17 bp, Homo sapiens
gaagccttaccacgcag

SEQ ID NO: 2209378 - DNA, 16 bp, Homo sapiens
gaagcttattaatgct

SEQ ID NO: 2209379 - DNA, 15 bp, Homo sapiens
gaaggagacaggcag

SEQ ID NO: 2209380 - DNA, 16 bp, Homo sapiens
gaaggagacaggcaga

SEQ ID NO: 2209381 - DNA, 18 bp, Homo sapiens
gaaggctggcatgatcca

SEQ ID NO: 2209382 - DNA, 14 bp, Homo sapiens
gaatactttataaa

SEQ ID NO: 2209383 - DNA, 20 bp, Homo sapiens
gaatgaaagtcttgtgacta

SEQ ID NO: 2209384 - DNA, 21 bp, Homo sapiens
gaatgaaagtcttgtgactag

SEQ ID NO: 2209385 - DNA, 11 bp, Homo sapiens
gaatgtaatca

SEQ ID NO: 2209386 - DNA, 19 bp, Homo sapiens
gaatgtaatcaatgtttct

SEQ ID NO: 2209387 - DNA, 22 bp, Homo sapiens
gacacatatgcaccttgtgtct

SEQ ID NO: 2209388 - DNA, 16 bp, Homo sapiens
gacactgggaggccag

SEQ ID NO: 2209389 - DNA, 13 bp, Homo sapiens
gacactgtacaag

SEQ ID NO: 2209390 - DNA, 16 bp, Homo sapiens
gaccacacctgcctct

SEQ ID NO: 2209391 - DNA, 24 bp, Homo sapiens
gaccatgcgacactgggaggccag

SEQ ID NO: 2209392 - DNA, 17 bp, Homo sapiens
gaccccgacgccacagc

SEQ ID NO: 2209393 - DNA, 21 bp, Homo sapiens
gaccccgacgccacagcccag

SEQ ID NO: 2209394 - DNA, 21 bp, Homo sapiens
gacctcagttttatcattttc

SEQ ID NO: 2209395 - DNA, 18 bp, Homo sapiens
gacctggcactggatgca

SEQ ID NO: 2209396 - DNA, 22 bp, Homo sapiens
gacctggcactggatgcagaaa

SEQ ID NO: 2209397 - DNA, 19 bp, Homo sapiens
gacctggtccacagggcac

SEQ ID NO: 2209398 - DNA, 15 bp, Homo sapiens
gacgccacagcccag

SEQ ID NO: 2209399 - DNA, 22 bp, Homo sapiens
gacgccacagcccagccacgga

SEQ ID NO: 2209400 - DNA, 18 bp, Homo sapiens
gacggctccactaggact

SEQ ID NO: 2209401 - DNA, 20 bp, Homo sapiens
gacgtgggctgggcccacaa

SEQ ID NO: 2209402 - DNA, 16 bp, Homo sapiens
gactagtgctgaagct

SEQ ID NO: 2209403 - DNA, 18 bp, Homo sapiens
gactagtgctgaagctta

SEQ ID NO: 2209404 - DNA, 12 bp, Homo sapiens
gactctgcacat

SEQ ID NO: 2209405 - DNA, 19 bp, Homo sapiens
gactctgcacatgtcttgt

SEQ ID NO: 2209406 - DNA, 20 bp, Homo sapiens
gactctgcacatgtcttgta

SEQ ID NO: 2209407 - DNA, 17 bp, Homo sapiens
gactcttttgccattaa

SEQ ID NO: 2209408 - DNA, 19 bp, Homo sapiens
gactgacctggtccacagg

SEQ ID NO: 2209409 - DNA, 22 bp, Homo sapiens
gactgacctggtccacagggca

SEQ ID NO: 2209410 - DNA, 12 bp, Homo sapiens
gagacaggcaga

SEQ ID NO: 2209411 - DNA, 19 bp, Homo sapiens
gagacaggcagagctgctc

SEQ ID NO: 2209412 - DNA, 17 bp, Homo sapiens
gagatacagaattttat

SEQ ID NO: 2209413 - DNA, 12 bp, Homo sapiens
gagctacaaatg

SEQ ID NO: 2209414 - DNA, 19 bp, Homo sapiens
gagcttcctgtcctcccag

SEQ ID NO: 2209415 - DNA, 15 bp, Homo sapiens
gaggccagtgagcca

SEQ ID NO: 2209416 - DNA, 22 bp, Homo sapiens
gagttcaataaatgtctgttga

SEQ ID NO: 2209417 - DNA, 16 bp, Homo sapiens
gatcagaccataatgt

SEQ ID NO: 2209418 - DNA, 15 bp, Homo sapiens
gatctctgcagggcc

SEQ ID NO: 2209419 - DNA, 13 bp, Homo sapiens
gatgccctgccct

SEQ ID NO: 2209420 - DNA, 16 bp, Homo sapiens
gatggagttcttgtgc

SEQ ID NO: 2209421 - DNA, 16 bp, Homo sapiens
gatgggtgaaggctgg

SEQ ID NO: 2209422 - DNA, 19 bp, Homo sapiens
gattgatagagtgttatca

SEQ ID NO: 2209423 - DNA, 21 bp, Homo sapiens
gattgcaatttgcacaagttt

SEQ ID NO: 2209424 - DNA, 21 bp, Homo sapiens
gatttcatttcaactgtttgc

SEQ ID NO: 2209425 - DNA, 18 bp, Homo sapiens
gcaaagggtccagaagga

SEQ ID NO: 2209426 - DNA, 17 bp, Homo sapiens
gcacaagccagggtgtg

SEQ ID NO: 2209427 - DNA, 21 bp, Homo sapiens
gcacatgtcttgtacatgtgt

SEQ ID NO: 2209428 - DNA, 18 bp, Homo sapiens
gcacctaaagcagccagc

SEQ ID NO: 2209429 - DNA, 15 bp, Homo sapiens
gcacgaaatgttatt

SEQ ID NO: 2209430 - DNA, 21 bp, Homo sapiens
gcacggaccatgcgacactgg

SEQ ID NO: 2209431 - DNA, 17 bp, Homo sapiens
gcagagaagctctcggg

SEQ ID NO: 2209432 - DNA, 12 bp, Homo sapiens
gcagccagaggc

SEQ ID NO: 2209433 - DNA, 21 bp, Homo sapiens
gcagcctggctcccaggacac

SEQ ID NO: 2209434 - DNA, 17 bp, Homo sapiens
gcaggacgtgggctggg

SEQ ID NO: 2209435 - DNA, 17 bp, Homo sapiens
gcaggagcacacccagc

SEQ ID NO: 2209436 - DNA, 23 bp, Homo sapiens
gcagggccgccagggagacctgg

SEQ ID NO: 2209437 - DNA, 21 bp, Homo sapiens
gcagggccgcccgggcccaga

SEQ ID NO: 2209438 - DNA, 16 bp, Homo sapiens
gcaggtgaaacccagt

SEQ ID NO: 2209439 - DNA, 17 bp, Homo sapiens
gcataggtttaataatt

SEQ ID NO: 2209440 - DNA, 18 bp, Homo sapiens
gcatgatccaagcaagac

SEQ ID NO: 2209441 - DNA, 19 bp, Homo sapiens
gcatgatccaagcaagact

SEQ ID NO: 2209442 - DNA, 18 bp, Homo sapiens
gcattttttaaaacaaga

SEQ ID NO: 2209443 - DNA, 23 bp, Homo sapiens
gccaccccagcctggccacgcag

SEQ ID NO: 2209444 - DNA, 21 bp, Homo sapiens
gccacgtgggcaaacaggcag

SEQ ID NO: 2209445 - DNA, 13 bp, Homo sapiens
gccagaggcacct

SEQ ID NO: 2209446 - DNA, 15 bp, Homo sapiens
gccaggacaccgggc

SEQ ID NO: 2209447 - DNA, 15 bp, Homo sapiens
gccagtgagccactc

SEQ ID NO: 2209448 - DNA, 16 bp, Homo sapiens
gccatagtcacatggc

SEQ ID NO: 2209449 - DNA, 23 bp, Homo sapiens
gcccaaattatcaagctaataaa

SEQ ID NO: 2209450 - DNA, 23 bp, Homo sapiens
gcccacaaaggcaaagggtccag

SEQ ID NO: 2209451 - DNA, 23 bp, Homo sapiens
gcccagccacggacgctggctcc

SEQ ID NO: 2209452 - DNA, 21 bp, Homo sapiens
agtgcagaccccttggccagc

SEQ ID NO: 2209453 - DNA, 15 bp, Homo sapiens
agtgctgaagcttat

SEQ ID NO: 2209454 - DNA, 16 bp, Homo sapiens
agtgctgaagcttatt

SEQ ID NO: 2209455 - DNA, 23 bp, Homo sapiens
agtgctgaagcttattaatgcta

SEQ ID NO: 2209456 - DNA, 15 bp, Homo sapiens
agtgttttctgggat

SEQ ID NO: 2209457 - DNA, 18 bp, Homo sapiens
agttcaataaatgtctgt

SEQ ID NO: 2209458 - DNA, 19 bp, Homo sapiens
agttcggtgagctacaaat

SEQ ID NO: 2209459 - DNA, 15 bp, Homo sapiens
agttctagttgcttg

SEQ ID NO: 2209460 - DNA, 17 bp, Homo sapiens
agtttaaattgtaatag

SEQ ID NO: 2209461 - DNA, 20 bp, Homo sapiens
agtttaaattgtaataggcg

SEQ ID NO: 2209462 - DNA, 22 bp, Homo sapiens
agtttccccaccagtgaatgaa

SEQ ID NO: 2209463 - DNA, 23 bp, Homo sapiens
agtttccccaccagtgaatgaaa

SEQ ID NO: 2209464 - DNA, 17 bp, Homo sapiens
agtttctgggacctcag

SEQ ID NO: 2209465 - DNA, 12 bp, Homo sapiens
agttttatcatt

SEQ ID NO: 2209466 - DNA, 13 bp, Homo sapiens
agttttatcattt

SEQ ID NO: 2209467 - DNA, 16 bp, Homo sapiens
ataaaatatcattcag

SEQ ID NO: 2209468 - DNA, 18 bp, Homo sapiens
ataaaatatcattcagca

SEQ ID NO: 2209469 - DNA, 17 bp, Homo sapiens
ataaactaaagaaaaat

SEQ ID NO: 2209470 - DNA, 13 bp, Homo sapiens
ataaataaaaata

SEQ ID NO: 2209471 - DNA, 15 bp, Homo sapiens
ataaatgtacattaa

SEQ ID NO: 2209472 - DNA, 15 bp, Homo sapiens
ataaatgtctgttga

SEQ ID NO: 2209473 - DNA, 19 bp, Homo sapiens
ataaattgtaattgtaaag

SEQ ID NO: 2209474 - DNA, 14 bp, Homo sapiens
ataactaaataaag

SEQ ID NO: 2209475 - DNA, 21 bp, Homo sapiens
ataagtttctgggacctcagt

SEQ ID NO: 2209476 - DNA, 14 bp, Homo sapiens
atacctctgtgtgc

SEQ ID NO: 2209477 - DNA, 17 bp, Homo sapiens
atacctctgtgtgctcc

SEQ ID NO: 2209478 - DNA, 18 bp, Homo sapiens
atagataggtcagtgcaa

SEQ ID NO: 2209479 - DNA, 16 bp, Homo sapiens
atagcagacagtgttt

SEQ ID NO: 2209480 - DNA, 14 bp, Homo sapiens
atagctactaattt

SEQ ID NO: 2209481 - DNA, 17 bp, Homo sapiens
atatgcaccttgtgtct

SEQ ID NO: 2209482 - DNA, 16 bp, Homo sapiens
atatggactctgcaca

SEQ ID NO: 2209483 - DNA, 14 bp, Homo sapiens
atatgtaccatgta

SEQ ID NO: 2209484 - DNA, 19 bp, Homo sapiens
atcagtcataactaaataa

SEQ ID NO: 2209485 - DNA, 16 bp, Homo sapiens
atcatataataaatgt

SEQ ID NO: 2209486 - DNA, 22 bp, Homo sapiens
atccacttctttcagcagactg

SEQ ID NO: 2209487 - DNA, 20 bp, Homo sapiens
atcccacccacatgtgacac

SEQ ID NO: 2209488 - DNA, 23 bp, Homo sapiens
atcccacccacatgtgacacata

SEQ ID NO: 2209489 - DNA, 21 bp, Homo sapiens
atcctagagatttggtgtaca

SEQ ID NO: 2209490 - DNA, 14 bp, Homo sapiens
atcttataatttaa

SEQ ID NO: 2209491 - DNA, 16 bp, Homo sapiens
atgaactcttaatcaa

SEQ ID NO: 2209492 - DNA, 19 bp, Homo sapiens
atgaagactcgcaatttca

SEQ ID NO: 2209493 - DNA, 18 bp, Homo sapiens
atgaatcccacccacatg

SEQ ID NO: 2209494 - DNA, 11 bp, Homo sapiens
atgaatgttta

SEQ ID NO: 2209495 - DNA, 14 bp, Homo sapiens
atgaccacacctgc

SEQ ID NO: 2209496 - DNA, 18 bp, Homo sapiens
atgagatgcctgaagcca

SEQ ID NO: 2209497 - DNA, 17 bp, Homo sapiens
atgatccaagcaagact

SEQ ID NO: 2209498 - DNA, 15 bp, Homo sapiens
atgcaccttgtgtct

SEQ ID NO: 2209499 - DNA, 18 bp, Homo sapiens
atgcaccttgtgtctgta

SEQ ID NO: 2209500 - DNA, 19 bp, Homo sapiens
atgcaccttgtgtctgtac

SEQ ID NO: 2209501 - DNA, 18 bp, Homo sapiens
atgcaggtgaaacccagt

SEQ ID NO: 2209502 - DNA, 18 bp, Homo sapiens
atggcctatgcacatatg

SEQ ID NO: 2209503 - DNA, 21 bp, Homo sapiens
atggctataaacaattacatg

SEQ ID NO: 2209504 - DNA, 14 bp, Homo sapiens
atgggtgaaggctg

SEQ ID NO: 2209505 - DNA, 11 bp, Homo sapiens
cagccaggaca

SEQ ID NO: 2209506 - DNA, 19 bp, Homo sapiens
cagcctggccacgcagcca

SEQ ID NO: 2209507 - DNA, 20 bp, Homo sapiens
cagcctggccacgcagccag

SEQ ID NO: 2209508 - DNA, 12 bp, Homo sapiens
cagcctggctcc

SEQ ID NO: 2209509 - DNA, 13 bp, Homo sapiens
cagcctggctccc

SEQ ID NO: 2209510 - DNA, 21 bp, Homo sapiens
cagcctggctcccaggacacg

SEQ ID NO: 2209511 - DNA, 17 bp, Homo sapiens
caggacctccaagccac

SEQ ID NO: 2209512 - DNA, 19 bp, Homo sapiens
caggacctccaagccactg

SEQ ID NO: 2209513 - DNA, 16 bp, Homo sapiens
caggagcacacccagc

SEQ ID NO: 2209514 - DNA, 19 bp, Homo sapiens
caggagcacacccagcccc

SEQ ID NO: 2209515 - DNA, 21 bp, Homo sapiens
caggagcacacccagccccca

SEQ ID NO: 2209516 - DNA, 15 bp, Homo sapiens
cagggacacgggcag

SEQ ID NO: 2209517 - DNA, 16 bp, Homo sapiens
cagggacacgggcagc

SEQ ID NO: 2209518 - DNA, 21 bp, Homo sapiens
cagggacacgggcagcctggc

SEQ ID NO: 2209519 - DNA, 20 bp, Homo sapiens
cagggagacctggacacagg

SEQ ID NO: 2209520 - DNA, 16 bp, Homo sapiens
cagggccgccagggag

SEQ ID NO: 2209521 - DNA, 22 bp, Homo sapiens
cagggccgccagggagacctgg

SEQ ID NO: 2209522 - DNA, 18 bp, Homo sapiens
cagggtcagaaacaggac

SEQ ID NO: 2209523 - DNA, 15 bp, Homo sapiens
cagtgttttctggga

SEQ ID NO: 2209524 - DNA, 22 bp, Homo sapiens
cagttattatatttacaaatgg

SEQ ID NO: 2209525 - DNA, 23 bp, Homo sapiens
cagttcatatgtaccatgtacat

SEQ ID NO: 2209526 - DNA, 16 bp, Homo sapiens
cagttggccagagagc

SEQ ID NO: 2209527 - DNA, 17 bp, Homo sapiens
cagttggccagagagcc

SEQ ID NO: 2209528 - DNA, 15 bp, Homo sapiens
cagtttgagacagga

SEQ ID NO: 2209529 - DNA, 15 bp, Homo sapiens
cagttttatcatttt

SEQ ID NO: 2209530 - DNA, 18 bp, Homo sapiens
catagtaccaatcatttt

SEQ ID NO: 2209531 - DNA, 13 bp, Homo sapiens
catagtcacatgg

SEQ ID NO: 2209532 - DNA, 17 bp, Homo sapiens
catataatgttgttatt

SEQ ID NO: 2209533 - DNA, 20 bp, Homo sapiens
catatgcaccttgtgtctgt

SEQ ID NO: 2209534 - DNA, 15 bp, Homo sapiens
catatggactctgca

SEQ ID NO: 2209535 - DNA, 20 bp, Homo sapiens
catatggactctgcacatga

SEQ ID NO: 2209536 - DNA, 18 bp, Homo sapiens
catcagctaaacaccacg

SEQ ID NO: 2209537 - DNA, 17 bp, Homo sapiens
catctggttaggatggc

SEQ ID NO: 2209538 - DNA, 21 bp, Homo sapiens
catgaatcccacccacatgtg

SEQ ID NO: 2209539 - DNA, 15 bp, Homo sapiens
catgtacatgaagaa

SEQ ID NO: 2209540 - DNA, 20 bp, Homo sapiens
catgtacatgaagaagctaa

SEQ ID NO: 2209541 - DNA, 22 bp, Homo sapiens
catgtactgagccttgtaattc

SEQ ID NO: 2209542 - DNA, 13 bp, Homo sapiens
catgtatgtcttg

SEQ ID NO: 2209543 - DNA, 21 bp, Homo sapiens
catgtatgtcttggacactgt

SEQ ID NO: 2209544 - DNA, 22 bp, Homo sapiens
catgtatgtcttggacactgta

SEQ ID NO: 2209545 - DNA, 13 bp, Homo sapiens
catgtcttgtaca

SEQ ID NO: 2209546 - DNA, 15 bp, Homo sapiens
catgtcttgtacatg

SEQ ID NO: 2209547 - DNA, 13 bp, Homo sapiens
cattattatcaac

SEQ ID NO: 2209548 - DNA, 23 bp, Homo sapiens
cattctaggcctcctggcccagg

SEQ ID NO: 2209549 - DNA, 12 bp, Homo sapiens
catttactgtgg

SEQ ID NO: 2209550 - DNA, 14 bp, Homo sapiens
catttactgtggct

SEQ ID NO: 2209551 - DNA, 15 bp, Homo sapiens
catttactgtggctt

SEQ ID NO: 2209552 - DNA, 15 bp, Homo sapiens
catttcaactgtttg

SEQ ID NO: 2209553 - DNA, 14 bp, Homo sapiens
cattttttaaaaca

SEQ ID NO: 2209554 - DNA, 15 bp, Homo sapiens
cattttttaaaacaa

SEQ ID NO: 2209555 - DNA, 19 bp, Homo sapiens
ccaaattatcaagctaata

SEQ ID NO: 2209556 - DNA, 13 bp, Homo sapiens
ccaacacgcagga

SEQ ID NO: 2209557 - DNA, 23 bp, Homo sapiens
ccaacttgtattaaagacagagg

SEQ ID NO: 2209558 - DNA, 17 bp, Homo sapiens
ccaagacctcagggcac

SEQ ID NO: 2209559 - DNA, 19 bp, Homo sapiens
ccacaacatgaaaactcca

SEQ ID NO: 2209560 - DNA, 11 bp, Homo sapiens
ccacagggcac

SEQ ID NO: 2209561 - DNA, 15 bp, Homo sapiens
ccacatgtgacacat

SEQ ID NO: 2209562 - DNA, 16 bp, Homo sapiens
ccacgcagccaggaca

SEQ ID NO: 2209563 - DNA, 17 bp, Homo sapiens
ccacgcagccaggacac

SEQ ID NO: 2209564 - DNA, 14 bp, Homo sapiens
ccactgttatcaaa

SEQ ID NO: 2209565 - DNA, 18 bp, Homo sapiens
ccagaaggagacaggcag

SEQ ID NO: 2209566 - DNA, 21 bp, Homo sapiens
ccagagagcctggtgctgctg

SEQ ID NO: 2209567 - DNA, 19 bp, Homo sapiens
ccagcctggccacgcagcc

SEQ ID NO: 2209568 - DNA, 23 bp, Homo sapiens
ccagcgtggcgcagtggccctga

SEQ ID NO: 2209569 - DNA, 17 bp, Homo sapiens
ccagggtcagaaacagg

SEQ ID NO: 2209570 - DNA, 16 bp, Homo sapiens
ccaggtgcagccagag

SEQ ID NO: 2209571 - DNA, 22 bp, Homo sapiens
ccatctggttaggatggcagga

SEQ ID NO: 2209572 - DNA, 21 bp, Homo sapiens
ccattgctatctattgataat

SEQ ID NO: 2209573 - DNA, 13 bp, Homo sapiens
cccaaagggtgtg

SEQ ID NO: 2209574 - DNA, 15 bp, Homo sapiens
cccacaaaggcaaag

SEQ ID NO: 2209575 - DNA, 22 bp, Homo sapiens
cccagaggagctgggagccggg

SEQ ID NO: 2209576 - DNA, 12 bp, Homo sapiens
ccccactggact

SEQ ID NO: 2209577 - DNA, 21 bp, Homo sapiens
ccccgacgccacagcccagcc

SEQ ID NO: 2209578 - DNA, 16 bp, Homo sapiens
ccccttcatcctctga

SEQ ID NO: 2209579 - DNA, 13 bp, Homo sapiens
cccgggcccagag

SEQ ID NO: 2209580 - DNA, 16 bp, Homo sapiens
cccgggcccagaggag

SEQ ID NO: 2209581 - DNA, 19 bp, Homo sapiens
ccctgaagctgtgcggagc

SEQ ID NO: 2209582 - DNA, 16 bp, Homo sapiens
ccctgcacaagccagg

SEQ ID NO: 2209583 - DNA, 20 bp, Homo sapiens
ccgaatgttgaggtggactc

SEQ ID NO: 2209584 - DNA, 15 bp, Homo sapiens
ccgcccgggcccaga

SEQ ID NO: 2209585 - DNA, 22 bp, Homo sapiens
ccggctgcatacccgggcaggg

SEQ ID NO: 2209586 - DNA, 20 bp, Homo sapiens
ccgggcagggctcccacaga

SEQ ID NO: 2209587 - DNA, 13 bp, Homo sapiens
ccgggcccagagg

SEQ ID NO: 2209588 - DNA, 13 bp, Homo sapiens
cctaaacatatga

SEQ ID NO: 2209589 - DNA, 21 bp, Homo sapiens
cctatgcacatatggactctg

SEQ ID NO: 2209590 - DNA, 15 bp, Homo sapiens
cctcttcctgcctag

SEQ ID NO: 2209591 - DNA, 12 bp, Homo sapiens
cctgagaccaca

SEQ ID NO: 2209592 - DNA, 17 bp, Homo sapiens
cctgcacaagccagggt

SEQ ID NO: 2209593 - DNA, 12 bp, Homo sapiens
cctggcacacat

SEQ ID NO: 2209594 - DNA, 21 bp, Homo sapiens
cctggcacacatcaggagttc

SEQ ID NO: 2209595 - DNA, 12 bp, Homo sapiens
cctggcctggca

SEQ ID NO: 2209596 - DNA, 16 bp, Homo sapiens
cctggcctggcacaca

SEQ ID NO: 2209597 - DNA, 12 bp, Homo sapiens
cctggtgctgct

SEQ ID NO: 2209598 - DNA, 16 bp, Homo sapiens
cctgtgcctccatcag

SEQ ID NO: 2209599 - DNA, 22 bp, Homo sapiens
ccttcagtaacccccactggac

SEQ ID NO: 2209600 - DNA, 16 bp, Homo sapiens
ccttgtaattctaaat

SEQ ID NO: 2209601 - DNA, 14 bp, Homo sapiens
cctttcatttactg

SEQ ID NO: 2209602 - DNA, 18 bp, Homo sapiens
cctttcatttactgtggc

SEQ ID NO: 2209603 - DNA, 14 bp, Homo sapiens
cctttctggctctc

SEQ ID NO: 2209604 - DNA, 22 bp, Homo sapiens
cgaaatgttattttttaattat

SEQ ID NO: 2209605 - DNA, 23 bp, Homo sapiens
cgaagtctctttttttggcccag

SEQ ID NO: 2209606 - DNA, 23 bp, Homo sapiens
cgacgccacagcccagccacgga

SEQ ID NO: 2209607 - DNA, 20 bp, Homo sapiens
cgaggaaacgaaacccactc

SEQ ID NO: 2209608 - DNA, 22 bp, Homo sapiens
cgaggaaacgaaacccactcta

SEQ ID NO: 2209609 - DNA, 13 bp, Homo sapiens
cgcagccaggaca

SEQ ID NO: 2209610 - DNA, 23 bp, Homo sapiens
cgcaggagcacacccagccccca

SEQ ID NO: 2209611 - DNA, 15 bp, Homo sapiens
cgcagtggccctgag

SEQ ID NO: 2209612 - DNA, 16 bp, Homo sapiens
cgccagggagacctgg

SEQ ID NO: 2209613 - DNA, 13 bp, Homo sapiens
cgcccgggcccag

SEQ ID NO: 2209614 - DNA, 14 bp, Homo sapiens
cgcctccgagggac

SEQ ID NO: 2209615 - DNA, 14 bp, Homo sapiens
cgcgaccttggccg

SEQ ID NO: 2209616 - DNA, 22 bp, Homo sapiens
cgcggctcccggggcagggcag

SEQ ID NO: 2209617 - DNA, 22 bp, Homo sapiens
cggctcccggggcagggcagcc

SEQ ID NO: 2209618 - DNA, 14 bp, Homo sapiens
cgggcccagaggag

SEQ ID NO: 2209619 - DNA, 14 bp, Homo sapiens
cggggcagggcagc

SEQ ID NO: 2209620 - DNA, 17 bp, Homo sapiens
cggtgagctacaaatgc

SEQ ID NO: 2209621 - DNA, 13 bp, Homo sapiens
cgtggactctgca

SEQ ID NO: 2209622 - DNA, 14 bp, Homo sapiens
ctaaagcagccagc

SEQ ID NO: 2209623 - DNA, 12 bp, Homo sapiens
ctaaatgaatgt

SEQ ID NO: 2209624 - DNA, 14 bp, Homo sapiens
ctaaatgaatgttt

SEQ ID NO: 2209625 - DNA, 23 bp, Homo sapiens
ctaacatataatgttgttattta

SEQ ID NO: 2209626 - DNA, 15 bp, Homo sapiens
ctaataaaatatcat

SEQ ID NO: 2209627 - DNA, 20 bp, Homo sapiens
ctaataaaatatcattcagc

SEQ ID NO: 2209628 - DNA, 22 bp, Homo sapiens
ctaataaaatatcattcagcaa

SEQ ID NO: 2209629 - DNA, 12 bp, Homo sapiens
ctaatatcagca

SEQ ID NO: 2209630 - DNA, 13 bp, Homo sapiens
ctaggatttcatg

SEQ ID NO: 2209631 - DNA, 17 bp, Homo sapiens
ctaggcctcctggccca

SEQ ID NO: 2209632 - DNA, 18 bp, Homo sapiens
ctaggcctcctggcccag

SEQ ID NO: 2209633 - DNA, 13 bp, Homo sapiens
ctagtgctgaagc

SEQ ID NO: 2209634 - DNA, 22 bp, Homo sapiens
ctagtgctgaagcttattaatg

SEQ ID NO: 2209635 - DNA, 17 bp, Homo sapiens
ctataaacaattacatg

SEQ ID NO: 2209636 - DNA, 13 bp, Homo sapiens
ctataatttaaat

SEQ ID NO: 2209637 - DNA, 21 bp, Homo sapiens
ctatgcacatatggactctgc

SEQ ID NO: 2209638 - DNA, 16 bp, Homo sapiens
ctattgataatttaga

SEQ ID NO: 2209639 - DNA, 20 bp, Homo sapiens
ctcaagaagaagaggggcat

SEQ ID NO: 2209640 - DNA, 17 bp, Homo sapiens
ctcaagatcaatgaaat

SEQ ID NO: 2209641 - DNA, 18 bp, Homo sapiens
ctcaagatcaatgaaatg

SEQ ID NO: 2209642 - DNA, 18 bp, Homo sapiens
ctcagttttatcattttc

SEQ ID NO: 2209643 - DNA, 20 bp, Homo sapiens
ctccagggtcagaaacagga

SEQ ID NO: 2209644 - DNA, 13 bp, Homo sapiens
ctcccacagagac

SEQ ID NO: 2209645 - DNA, 15 bp, Homo sapiens
ctcccacagagacaa

SEQ ID NO: 2209646 - DNA, 11 bp, Homo sapiens
ctcccaggaca

SEQ ID NO: 2209647 - DNA, 12 bp, Homo sapiens
ctcccaggacac

SEQ ID NO: 2209648 - DNA, 14 bp, Homo sapiens
ctcccatttcctga

SEQ ID NO: 2209649 - DNA, 15 bp, Homo sapiens
ctcccggggcagggc

SEQ ID NO: 2209650 - DNA, 16 bp, Homo sapiens
ctcccggggcagggca

SEQ ID NO: 2209651 - DNA, 14 bp, Homo sapiens
gaaggctggcatga

SEQ ID NO: 2209652 - DNA, 17 bp, Homo sapiens
gaagggagctagccaga

SEQ ID NO: 2209653 - DNA, 23 bp, Homo sapiens
gaatgaaagtcttgtgactagtg

SEQ ID NO: 2209654 - DNA, 13 bp, Homo sapiens
gaatgtaatcaat

SEQ ID NO: 2209655 - DNA, 21 bp, Homo sapiens
gaatgtttacactctttgtaa

SEQ ID NO: 2209656 - DNA, 12 bp, Homo sapiens
gacacaggcctg

SEQ ID NO: 2209657 - DNA, 17 bp, Homo sapiens
gacacgggcagcctggc

SEQ ID NO: 2209658 - DNA, 20 bp, Homo sapiens
gacacgggcagcctggctcc

SEQ ID NO: 2209659 - DNA, 23 bp, Homo sapiens
gacactgggaggccagtgagcca

SEQ ID NO: 2209660 - DNA, 14 bp, Homo sapiens
gacagtgaaagaaa

SEQ ID NO: 2209661 - DNA, 18 bp, Homo sapiens
gaccccgacgccacagcc

SEQ ID NO: 2209662 - DNA, 20 bp, Homo sapiens
gacctcagttttatcatttt

SEQ ID NO: 2209663 - DNA, 18 bp, Homo sapiens
gacctggacacaggcctg

SEQ ID NO: 2209664 - DNA, 17 bp, Homo sapiens
gacctggtccacagggc

SEQ ID NO: 2209665 - DNA, 23 bp, Homo sapiens
gacgccacagcccagccacggac

SEQ ID NO: 2209666 - DNA, 13 bp, Homo sapiens
gactagtgctgaa

SEQ ID NO: 2209667 - DNA, 19 bp, Homo sapiens
gactagtgctgaagcttat

SEQ ID NO: 2209668 - DNA, 14 bp, Homo sapiens
gactctgcacatga

SEQ ID NO: 2209669 - DNA, 15 bp, Homo sapiens
gactgacctggtcca

SEQ ID NO: 2209670 - DNA, 23 bp, Homo sapiens
gactgacctggtccacagggcac

SEQ ID NO: 2209671 - DNA, 21 bp, Homo sapiens
gactgcagggacacgggcagc

SEQ ID NO: 2209672 - DNA, 22 bp, Homo sapiens
gactgcagggacacgggcagcc

SEQ ID NO: 2209673 - DNA, 18 bp, Homo sapiens
gagacaaggagggcacag

SEQ ID NO: 2209674 - DNA, 19 bp, Homo sapiens
gagacctggacacaggcct

SEQ ID NO: 2209675 - DNA, 20 bp, Homo sapiens
gagacctggacacaggcctg

SEQ ID NO: 2209676 - DNA, 17 bp, Homo sapiens
gagagcctggtgctgct

SEQ ID NO: 2209677 - DNA, 18 bp, Homo sapiens
gagatggagttcttgtgc

SEQ ID NO: 2209678 - DNA, 15 bp, Homo sapiens
gagcacacccagccc

SEQ ID NO: 2209679 - DNA, 15 bp, Homo sapiens
gagccactccggccc

SEQ ID NO: 2209680 - DNA, 13 bp, Homo sapiens
gagctagccagag

SEQ ID NO: 2209681 - DNA, 14 bp, Homo sapiens
gagctagccagagg

SEQ ID NO: 2209682 - DNA, 15 bp, Homo sapiens
gagctagccagagga

SEQ ID NO: 2209683 - DNA, 18 bp, Homo sapiens
gagctagccagaggactg

SEQ ID NO: 2209684 - DNA, 19 bp, Homo sapiens
gagctccaactcagaaggg

SEQ ID NO: 2209685 - DNA, 21 bp, Homo sapiens
gagctcccaggtgcagccaga

SEQ ID NO: 2209686 - DNA, 14 bp, Homo sapiens
gagctgggagccgg

SEQ ID NO: 2209687 - DNA, 16 bp, Homo sapiens
gagctgggagccgggc

SEQ ID NO: 2209688 - DNA, 19 bp, Homo sapiens
gaggagctgggagccgggc

SEQ ID NO: 2209689 - DNA, 16 bp, Homo sapiens
gaggccagtgagccac

SEQ ID NO: 2209690 - DNA, 22 bp, Homo sapiens
gagggacgcggctcccggggca

SEQ ID NO: 2209691 - DNA, 12 bp, Homo sapiens
gaggggagaagc

SEQ ID NO: 2209692 - DNA, 23 bp, Homo sapiens
gaggtgaacaagcaaacccagac

SEQ ID NO: 2209693 - DNA, 17 bp, Homo sapiens
gagtcctagagctacag

SEQ ID NO: 2209694 - DNA, 15 bp, Homo sapiens
gagttcttgtgccat

SEQ ID NO: 2209695 - DNA, 21 bp, Homo sapiens
gagttgaaaatcttataattt

SEQ ID NO: 2209696 - DNA, 16 bp, Homo sapiens
gagtttaaattgtaat

SEQ ID NO: 2209697 - DNA, 14 bp, Homo sapiens
gataattataatat

SEQ ID NO: 2209698 - DNA, 14 bp, Homo sapiens
gatagtagcttcct

SEQ ID NO: 2209699 - DNA, 13 bp, Homo sapiens
gatcaatgaaatg

SEQ ID NO: 2209700 - DNA, 20 bp, Homo sapiens
gatctctgcagggccgccag

SEQ ID NO: 2209701 - DNA, 18 bp, Homo sapiens
gatggagttcttgtgcca

SEQ ID NO: 2209702 - DNA, 20 bp, Homo sapiens
gatggcaggacgtgggctgg

SEQ ID NO: 2209703 - DNA, 21 bp, Homo sapiens
gatgggtgaaggctggcatga

SEQ ID NO: 2209704 - DNA, 22 bp, Homo sapiens
gattgagaagttactttccatt

SEQ ID NO: 2209705 - DNA, 19 bp, Homo sapiens
gatttggtgtacaattcag

SEQ ID NO: 2209706 - DNA, 15 bp, Homo sapiens
gcaaacccagacggc

SEQ ID NO: 2209707 - DNA, 13 bp, Homo sapiens
gcacaagccaggg

SEQ ID NO: 2209708 - DNA, 13 bp, Homo sapiens
gcacatatggact

SEQ ID NO: 2209709 - DNA, 18 bp, Homo sapiens
gcacatatggactctgca

SEQ ID NO: 2209710 - DNA, 14 bp, Homo sapiens
gcacctaaagcagc

SEQ ID NO: 2209711 - DNA, 18 bp, Homo sapiens
gcagaccccttggccagc

SEQ ID NO: 2209712 - DNA, 23 bp, Homo sapiens
gcagccagccgtgagtgcagacc

SEQ ID NO: 2209713 - DNA, 12 bp, Homo sapiens
gcagccaggaca

SEQ ID NO: 2209714 - DNA, 19 bp, Homo sapiens
gcagccaggacaccgggca

SEQ ID NO: 2209715 - DNA, 19 bp, Homo sapiens
gcagcctggctcccaggac

SEQ ID NO: 2209716 - DNA, 20 bp, Homo sapiens
gcagcctggctcccaggaca

SEQ ID NO: 2209717 - DNA, 16 bp, Homo sapiens
gcaggagcacacccag

SEQ ID NO: 2209718 - DNA, 14 bp, Homo sapiens
ctcaccacccactt

SEQ ID NO: 2209719 - DNA, 16 bp, Homo sapiens
ctccaactcagaaggg

SEQ ID NO: 2209720 - DNA, 17 bp, Homo sapiens
ctcccaggtgcagccag

SEQ ID NO: 2209721 - DNA, 23 bp, Homo sapiens
ctcccaggtgcagccagaggcac

SEQ ID NO: 2209722 - DNA, 15 bp, Homo sapiens
ctccttggtgcctgg

SEQ ID NO: 2209723 - DNA, 14 bp, Homo sapiens
ctctccagcctgac

SEQ ID NO: 2209724 - DNA, 12 bp, Homo sapiens
ctctgagtgtga

SEQ ID NO: 2209725 - DNA, 13 bp, Homo sapiens
ctctgcagggccg

SEQ ID NO: 2209726 - DNA, 13 bp, Homo sapiens
ctctgtgtgctcc

SEQ ID NO: 2209727 - DNA, 14 bp, Homo sapiens
ctgaagcttattaa

SEQ ID NO: 2209728 - DNA, 16 bp, Homo sapiens
ctgacctggtccacag

SEQ ID NO: 2209729 - DNA, 18 bp, Homo sapiens
ctgacctggtccacaggg

SEQ ID NO: 2209730 - DNA, 21 bp, Homo sapiens
ctgacctggtccacagggcac

SEQ ID NO: 2209731 - DNA, 20 bp, Homo sapiens
ctgacttggggagatggagt

SEQ ID NO: 2209732 - DNA, 22 bp, Homo sapiens
ctgacttggggagatggagttc

SEQ ID NO: 2209733 - DNA, 21 bp, Homo sapiens
ctgatgaactcttaatcaaat

SEQ ID NO: 2209734 - DNA, 14 bp, Homo sapiens
ctgcacatgtcttg

SEQ ID NO: 2209735 - DNA, 16 bp, Homo sapiens
ctgcacatgtcttgta

SEQ ID NO: 2209736 - DNA, 23 bp, Homo sapiens
ctgcacatgtcttgtacatgtgt

SEQ ID NO: 2209737 - DNA, 19 bp, Homo sapiens
ctgcagggccgccagggag

SEQ ID NO: 2209738 - DNA, 15 bp, Homo sapiens
caccttgtgtctgta

SEQ ID NO: 2209739 - DNA, 21 bp, Homo sapiens
caccttgtgtctgtacacgtg

SEQ ID NO: 2209740 - DNA, 17 bp, Homo sapiens
cacgaaatgttattttt

SEQ ID NO: 2209741 - DNA, 21 bp, Homo sapiens
cacgcacatgcgaccccgagg

SEQ ID NO: 2209742 - DNA, 16 bp, Homo sapiens
cacgcagccaggacac

SEQ ID NO: 2209743 - DNA, 19 bp, Homo sapiens
cacgcaggagcacacccag

SEQ ID NO: 2209744 - DNA, 12 bp, Homo sapiens
cacgggcagcct

SEQ ID NO: 2209745 - DNA, 22 bp, Homo sapiens
cacgggcagcctggctcccagg

SEQ ID NO: 2209746 - DNA, 12 bp, Homo sapiens
cactctttgtaa

SEQ ID NO: 2209747 - DNA, 16 bp, Homo sapiens
cactgactgcagggac

SEQ ID NO: 2209748 - DNA, 14 bp, Homo sapiens
cactgccatatact

SEQ ID NO: 2209749 - DNA, 21 bp, Homo sapiens
cactgggaggccagtgagcca

SEQ ID NO: 2209750 - DNA, 14 bp, Homo sapiens
cacttcaccctgga

SEQ ID NO: 2209751 - DNA, 20 bp, Homo sapiens
cagaggagctgggagccggg

SEQ ID NO: 2209752 - DNA, 15 bp, Homo sapiens
cagatcatccagaag

SEQ ID NO: 2209753 - DNA, 14 bp, Homo sapiens
cagcaagtctcttt

SEQ ID NO: 2209754 - DNA, 17 bp, Homo sapiens
cagcccccacatcctgt

SEQ ID NO: 2209755 - DNA, 17 bp, Homo sapiens
cagcctggccacgcagc

SEQ ID NO: 2209756 - DNA, 21 bp, Homo sapiens
cagctgcctctgccactgact

SEQ ID NO: 2209757 - DNA, 20 bp, Homo sapiens
caggacctccaagccactga

SEQ ID NO: 2209758 - DNA, 23 bp, Homo sapiens
caggacctccaagccactgagca

SEQ ID NO: 2209759 - DNA, 15 bp, Homo sapiens
caggagcacacccag

SEQ ID NO: 2209760 - DNA, 12 bp, Homo sapiens
caggcatcctcc

SEQ ID NO: 2209761 - DNA, 17 bp, Homo sapiens
cagggacacgggcagcc

SEQ ID NO: 2209762 - DNA, 21 bp, Homo sapiens
cagggagacctggacacaggc

SEQ ID NO: 2209763 - DNA, 16 bp, Homo sapiens
cagggaggtcattttg

SEQ ID NO: 2209764 - DNA, 19 bp, Homo sapiens
cagggccgcccgggcccag

SEQ ID NO: 2209765 - DNA, 22 bp, Homo sapiens
cagggccgcccgggcccagagg

SEQ ID NO: 2209766 - DNA, 15 bp, Homo sapiens
cagggctcccacaga

SEQ ID NO: 2209767 - DNA, 18 bp, Homo sapiens
cagggctcccacagagac

SEQ ID NO: 2209768 - DNA, 12 bp, Homo sapiens
cagggtgtgtct

SEQ ID NO: 2209769 - DNA, 20 bp, Homo sapiens
caggtgagtcctagagctac

SEQ ID NO: 2209770 - DNA, 18 bp, Homo sapiens
caggtgtctgccccctct

SEQ ID NO: 2209771 - DNA, 14 bp, Homo sapiens
cagtaactaaagct

SEQ ID NO: 2209772 - DNA, 21 bp, Homo sapiens
cagtaattggtccgatctttg

SEQ ID NO: 2209773 - DNA, 16 bp, Homo sapiens
cagtgaaagaaaataa

SEQ ID NO: 2209774 - DNA, 20 bp, Homo sapiens
cagtgaaagaaaataacaat

SEQ ID NO: 2209775 - DNA, 17 bp, Homo sapiens
cagttattatatttaca

SEQ ID NO: 2209776 - DNA, 22 bp, Homo sapiens
cagttcggtgagctacaaatgc

SEQ ID NO: 2209777 - DNA, 24 bp, Homo sapiens
cagtttgaatgcagtctgtccagg

SEQ ID NO: 2209778 - DNA, 16 bp, Homo sapiens
cagttttttatgctaa

SEQ ID NO: 2209779 - DNA, 22 bp, Homo sapiens
catagtaccaatcattttaatt

SEQ ID NO: 2209780 - DNA, 18 bp, Homo sapiens
catatgcaccttgtgtct

SEQ ID NO: 2209781 - DNA, 21 bp, Homo sapiens
catatgcaccttgtgtctgta

SEQ ID NO: 2209782 - DNA, 20 bp, Homo sapiens
catgatccaagcaagactga

SEQ ID NO: 2209783 - DNA, 16 bp, Homo sapiens
catggcctatgcacat

SEQ ID NO: 2209784 - DNA, 19 bp, Homo sapiens
catggcctatgcacatatg

SEQ ID NO: 2209785 - DNA, 19 bp, Homo sapiens
catgtactgagccttgtaa

SEQ ID NO: 2209786 - DNA, 18 bp, Homo sapiens
catgtatgtcttggacac

SEQ ID NO: 2209787 - DNA, 17 bp, Homo sapiens
catgtcttgtacatgtg

SEQ ID NO: 2209788 - DNA, 12 bp, Homo sapiens
catgtgacacat

SEQ ID NO: 2209789 - DNA, 13 bp, Homo sapiens
cattctggaataa

SEQ ID NO: 2209790 - DNA, 19 bp, Homo sapiens
catttcctgagaccacaga

SEQ ID NO: 2209791 - DNA, 17 bp, Homo sapiens
cattttaattattattc

SEQ ID NO: 2209792 - DNA, 18 bp, Homo sapiens
ccaaattatcaagctaat

SEQ ID NO: 2209793 - DNA, 22 bp, Homo sapiens
ccaaattatcaagctaataaaa

SEQ ID NO: 2209794 - DNA, 13 bp, Homo sapiens
ccaagtattttgc

SEQ ID NO: 2209795 - DNA, 18 bp, Homo sapiens
ccacagcccagccacgga

SEQ ID NO: 2209796 - DNA, 20 bp, Homo sapiens
ccacagcccagccacggacg

SEQ ID NO: 2209797 - DNA, 19 bp, Homo sapiens
ccacagggcacctgccacc

SEQ ID NO: 2209798 - DNA, 23 bp, Homo sapiens
ccacctacttttctttcctcaga

SEQ ID NO: 2209799 - DNA, 16 bp, Homo sapiens
ccactgactgcaggga

SEQ ID NO: 2209800 - DNA, 13 bp, Homo sapiens
ccactggactgac

SEQ ID NO: 2209801 - DNA, 22 bp, Homo sapiens
ccagaggactgtgatgccctgc

SEQ ID NO: 2209802 - DNA, 21 bp, Homo sapiens
ccagaggagctgggagccggg

SEQ ID NO: 2209803 - DNA, 21 bp, Homo sapiens
ccagccacggacgctggctcc

SEQ ID NO: 2209804 - DNA, 16 bp, Homo sapiens
ccagcctggccacgca

SEQ ID NO: 2209805 - DNA, 23 bp, Homo sapiens
ccagcctggccacgcagccagga

SEQ ID NO: 2209806 - DNA, 23 bp, Homo sapiens
ccaggaaactctgcattctagta

SEQ ID NO: 2209807 - DNA, 10 bp, Homo sapiens
ccagggtcag

SEQ ID NO: 2209808 - DNA, 18 bp, Homo sapiens
ccagggtcagaaacagga

SEQ ID NO: 2209809 - DNA, 19 bp, Homo sapiens
ccagggtcagaaacaggac

SEQ ID NO: 2209810 - DNA, 15 bp, Homo sapiens
ccaggtgcagccaga

SEQ ID NO: 2209811 - DNA, 23 bp, Homo sapiens
ccatctggttaggatggcaggac

SEQ ID NO: 2209812 - DNA, 16 bp, Homo sapiens
ccatgcgacactggga

SEQ ID NO: 2209813 - DNA, 16 bp, Homo sapiens
ccatgtacatgaagaa

SEQ ID NO: 2209814 - DNA, 13 bp, Homo sapiens
ccatttcctgaga

SEQ ID NO: 2209815 - DNA, 18 bp, Homo sapiens
cccaagacctcagggcac

SEQ ID NO: 2209816 - DNA, 16 bp, Homo sapiens
cccacatgtgacacat

SEQ ID NO: 2209817 - DNA, 14 bp, Homo sapiens
cccacccacatgtg

SEQ ID NO: 2209818 - DNA, 21 bp, Homo sapiens
cccagcctggccacgcagcca

SEQ ID NO: 2209819 - DNA, 20 bp, Homo sapiens
cccaggtgcagccagaggca

SEQ ID NO: 2209820 - DNA, 20 bp, Homo sapiens
ccccactggactgacctggt

SEQ ID NO: 2209821 - DNA, 22 bp, Homo sapiens
ccccagcctggccacgcagcca

SEQ ID NO: 2209822 - DNA, 18 bp, Homo sapiens
ccccgacgccacagccca

SEQ ID NO: 2209823 - DNA, 18 bp, Homo sapiens
cccgacgccacagcccag

SEQ ID NO: 2209824 - DNA, 12 bp, Homo sapiens
cccgggcagggc

SEQ ID NO: 2209825 - DNA, 13 bp, Homo sapiens
cccgggcagggct

SEQ ID NO: 2209826 - DNA, 22 bp, Homo sapiens
cccgggcagggctcccacagag

SEQ ID NO: 2209827 - DNA, 14 bp, Homo sapiens
cccgggcccagagg

SEQ ID NO: 2209828 - DNA, 17 bp, Homo sapiens
ccctgaagctgtgcgga

SEQ ID NO: 2209829 - DNA, 19 bp, Homo sapiens
ccgcacctaaagcagccag

SEQ ID NO: 2209830 - DNA, 14 bp, Homo sapiens
ccgcccgggcccag

SEQ ID NO: 2209831 - DNA, 15 bp, Homo sapiens
ccgcttctgcctgca

SEQ ID NO: 2209832 - DNA, 18 bp, Homo sapiens
ccggctgcatacccgggc

SEQ ID NO: 2209833 - DNA, 16 bp, Homo sapiens
ccgggcccagaggagc

SEQ ID NO: 2209834 - DNA, 14 bp, Homo sapiens
ccggggcagggcag

SEQ ID NO: 2209835 - DNA, 14 bp, Homo sapiens
cctaaagcagccag

SEQ ID NO: 2209836 - DNA, 13 bp, Homo sapiens
cctagaggcccca

SEQ ID NO: 2209837 - DNA, 17 bp, Homo sapiens
cctcaagatgaaggcaa

SEQ ID NO: 2209838 - DNA, 16 bp, Homo sapiens
cctccgagggacgcgg

SEQ ID NO: 2209839 - DNA, 19 bp, Homo sapiens
cctctgtgtgctcctcctt

SEQ ID NO: 2209840 - DNA, 18 bp, Homo sapiens
cctgagaccacagagaga

SEQ ID NO: 2209841 - DNA, 24 bp, Homo sapiens
cctgccaccctgggcctggcagct

SEQ ID NO: 2209842 - DNA, 13 bp, Homo sapiens
cctgcccttggca

SEQ ID NO: 2209843 - DNA, 20 bp, Homo sapiens
cctggccacgcagccaggac

SEQ ID NO: 2209844 - DNA, 22 bp, Homo sapiens
cctggccacgcagccaggacac

SEQ ID NO: 2209845 - DNA, 19 bp, Homo sapiens
cctggcctggcacacatca

SEQ ID NO: 2209846 - DNA, 15 bp, Homo sapiens
cctggctcccaggac

SEQ ID NO: 2209847 - DNA, 21 bp, Homo sapiens
cctgtagttgcgtggactctg

SEQ ID NO: 2209848 - DNA, 13 bp, Homo sapiens
cctgtcctcccag

SEQ ID NO: 2209849 - DNA, 22 bp, Homo sapiens
cctgtcctcccagctcctcact

SEQ ID NO: 2209850 - DNA, 14 bp, Homo sapiens
cctgtgcatgtatg

SEQ ID NO: 2209851 - DNA, 13 bp, Homo sapiens
ccttccagcccag

SEQ ID NO: 2209852 - DNA, 14 bp, Homo sapiens
ccttccagcccaga

SEQ ID NO: 2209853 - DNA, 15 bp, Homo sapiens
ccttggccgcaccta

SEQ ID NO: 2209854 - DNA, 23 bp, Homo sapiens
ccttggccgcacctaaagcagcc

SEQ ID NO: 2209855 - DNA, 19 bp, Homo sapiens
ccttgtaattctaaatgaa

SEQ ID NO: 2209856 - DNA, 13 bp, Homo sapiens
cgaaatgttattt

SEQ ID NO: 2209857 - DNA, 17 bp, Homo sapiens
cgacactgggaggccag

SEQ ID NO: 2209858 - DNA, 14 bp, Homo sapiens
cgaccttggccgca

SEQ ID NO: 2209859 - DNA, 12 bp, Homo sapiens
cgcagccaggac

SEQ ID NO: 2209860 - DNA, 14 bp, Homo sapiens
cgccacagcccagc

SEQ ID NO: 2209861 - DNA, 14 bp, Homo sapiens
cgcccgggcccaga

SEQ ID NO: 2209862 - DNA, 16 bp, Homo sapiens
cgcccgggcccagagg

SEQ ID NO: 2209863 - DNA, 16 bp, Homo sapiens
cgctggctccccaaag

SEQ ID NO: 2209864 - DNA, 14 bp, Homo sapiens
cgggcagcctggct

SEQ ID NO: 2209865 - DNA, 16 bp, Homo sapiens
cgggcagcctggctcc

SEQ ID NO: 2209866 - DNA, 18 bp, Homo sapiens
cgggcagcctggctccca

SEQ ID NO: 2209867 - DNA, 22 bp, Homo sapiens
cgggcagcctggctcccaggac

SEQ ID NO: 2209868 - DNA, 16 bp, Homo sapiens
cgggcagggctcccac

SEQ ID NO: 2209869 - DNA, 17 bp, Homo sapiens
cgggcagggctcccaca

SEQ ID NO: 2209870 - DNA, 15 bp, Homo sapiens
cgggcccagaggagc

SEQ ID NO: 2209871 - DNA, 22 bp, Homo sapiens
cgtgggctgggcccacaaaggc

SEQ ID NO: 2209872 - DNA, 21 bp, Homo sapiens
ctaagcttcactgtaaaataa

SEQ ID NO: 2209873 - DNA, 14 bp, Homo sapiens
ctaataaaatatca

SEQ ID NO: 2209874 - DNA, 16 bp, Homo sapiens
ctaataaaatatcatt

SEQ ID NO: 2209875 - DNA, 17 bp, Homo sapiens
ctaataaaatatcattc

SEQ ID NO: 2209876 - DNA, 23 bp, Homo sapiens
ctaataaaatatcattcagcaac

SEQ ID NO: 2209877 - DNA, 13 bp, Homo sapiens
ctaatacctctgt

SEQ ID NO: 2209878 - DNA, 15 bp, Homo sapiens
ctaatacctctgtgt

SEQ ID NO: 2209879 - DNA, 16 bp, Homo sapiens
ctaatacctctgtgtg

SEQ ID NO: 2209880 - DNA, 20 bp, Homo sapiens
ctaatcagggaggtcatttt

SEQ ID NO: 2209881 - DNA, 21 bp, Homo sapiens
ctaatcagggaggtcattttg

SEQ ID NO: 2209882 - DNA, 23 bp, Homo sapiens
ctacacgagatacagaattttat

SEQ ID NO: 2209883 - DNA, 17 bp, Homo sapiens
ctaggacttcaaattgg

SEQ ID NO: 2209884 - DNA, 16 bp, Homo sapiens
ctataaacaattacat

SEQ ID NO: 2209885 - DNA, 18 bp, Homo sapiens
ctatgcacatatggactc

SEQ ID NO: 2209886 - DNA, 20 bp, Homo sapiens
ctatgcacatatggactctg

SEQ ID NO: 2209887 - DNA, 19 bp, Homo sapiens
ctcaatgttactatctgct

SEQ ID NO: 2209888 - DNA, 13 bp, Homo sapiens
ctcacatttatat

SEQ ID NO: 2209889 - DNA, 20 bp, Homo sapiens
gcatctttgaatacaaagaa

SEQ ID NO: 2209890 - DNA, 22 bp, Homo sapiens
gcatgatccaagcaagactgag

SEQ ID NO: 2209891 - DNA, 14 bp, Homo sapiens
gcatgtatgtcttg

SEQ ID NO: 2209892 - DNA, 16 bp, Homo sapiens
gcattttttaaaacaa

SEQ ID NO: 2209893 - DNA, 17 bp, Homo sapiens
gcattttttaaaacaag

SEQ ID NO: 2209894 - DNA, 14 bp, Homo sapiens
gccacgcagccagg

SEQ ID NO: 2209895 - DNA, 15 bp, Homo sapiens
gccacgcagccagga

SEQ ID NO: 2209896 - DNA, 19 bp, Homo sapiens
gccactgactgcagggaca

SEQ ID NO: 2209897 - DNA, 15 bp, Homo sapiens
ctctgcacatgtctt

SEQ ID NO: 2209898 - DNA, 19 bp, Homo sapiens
ctctgcagggccgccaggg

SEQ ID NO: 2209899 - DNA, 15 bp, Homo sapiens
ctctgcattctagta

SEQ ID NO: 2209900 - DNA, 19 bp, Homo sapiens
ctctgccactgactgcagg

SEQ ID NO: 2209901 - DNA, 12 bp, Homo sapiens
ctctttgtaaga

SEQ ID NO: 2209902 - DNA, 16 bp, Homo sapiens
ctgaagcttattaatg

SEQ ID NO: 2209903 - DNA, 17 bp, Homo sapiens
ctgaagcttattaatgc

SEQ ID NO: 2209904 - DNA, 20 bp, Homo sapiens
ctgaagcttattaatgctaa

SEQ ID NO: 2209905 - DNA, 20 bp, Homo sapiens
ctgacctggtccacagggca

SEQ ID NO: 2209906 - DNA, 21 bp, Homo sapiens
ctgacttggggagatggagtt

SEQ ID NO: 2209907 - DNA, 18 bp, Homo sapiens
ctgcacaagccagggtgt

SEQ ID NO: 2209908 - DNA, 22 bp, Homo sapiens
ctgcacaagccagggtgtgtct

SEQ ID NO: 2209909 - DNA, 21 bp, Homo sapiens
ctgcacatgtcttgtacatgt

SEQ ID NO: 2209910 - DNA, 20 bp, Homo sapiens
ctgcagggacacgggcagcc

SEQ ID NO: 2209911 - DNA, 18 bp, Homo sapiens
ctgcagggccgccaggga

SEQ ID NO: 2209912 - DNA, 19 bp, Homo sapiens
ctggaaacattcaggagct

SEQ ID NO: 2209913 - DNA, 23 bp, Homo sapiens
ctggaataatcctaaacatatga

SEQ ID NO: 2209914 - DNA, 15 bp, Homo sapiens
ctggaatgtaatcaa

SEQ ID NO: 2209915 - DNA, 20 bp, Homo sapiens
ctggaatgtaatcaatgttt

SEQ ID NO: 2209916 - DNA, 21 bp, Homo sapiens
ctggaatgtaatcaatgtttc

SEQ ID NO: 2209917 - DNA, 14 bp, Homo sapiens
ctggacacaggcct

SEQ ID NO: 2209918 - DNA, 15 bp, Homo sapiens
ctggacacaggcctg

SEQ ID NO: 2209919 - DNA, 20 bp, Homo sapiens
ctggactgtcttctccctgc

SEQ ID NO: 2209920 - DNA, 21 bp, Homo sapiens
ctggcacacatcaggagttca

SEQ ID NO: 2209921 - DNA, 21 bp, Homo sapiens
ctggcactggatgcagaaaca

SEQ ID NO: 2209922 - DNA, 17 bp, Homo sapiens
ctggcagctcagcttcc

SEQ ID NO: 2209923 - DNA, 18 bp, Homo sapiens
ctggcatgatccaagcaa

SEQ ID NO: 2209924 - DNA, 14 bp, Homo sapiens
ctggccacgcagcc

SEQ ID NO: 2209925 - DNA, 15 bp, Homo sapiens
ctggccacgcagcca

SEQ ID NO: 2209926 - DNA, 22 bp, Homo sapiens
ctggccatctggttaggatggc

SEQ ID NO: 2209927 - DNA, 15 bp, Homo sapiens
ctggcgcctccgagg

SEQ ID NO: 2209928 - DNA, 15 bp, Homo sapiens
ctggctccccaaagg

SEQ ID NO: 2209929 - DNA, 19 bp, Homo sapiens
ctgggagccgggccgcaga

SEQ ID NO: 2209930 - DNA, 12 bp, Homo sapiens
ctggtgctgctg

SEQ ID NO: 2209931 - DNA, 18 bp, Homo sapiens
ctggttaggatggcagga

SEQ ID NO: 2209932 - DNA, 18 bp, Homo sapiens
ctgtacacgtgtcctgta

SEQ ID NO: 2209933 - DNA, 12 bp, Homo sapiens
ctgtccaggctc

SEQ ID NO: 2209934 - DNA, 23 bp, Homo sapiens
ctgtcttctccctgcacaagcca

SEQ ID NO: 2209935 - DNA, 15 bp, Homo sapiens
ctgtgcctccatcag

SEQ ID NO: 2209936 - DNA, 22 bp, Homo sapiens
ctgtggcttcttaatcttttca

SEQ ID NO: 2209937 - DNA, 23 bp, Homo sapiens
ctgtgtgctcctccttggtgcct

SEQ ID NO: 2209938 - DNA, 13 bp, Homo sapiens
ctgttagtcattt

SEQ ID NO: 2209939 - DNA, 14 bp, Homo sapiens
ctgttagtcatttg

SEQ ID NO: 2209940 - DNA, 15 bp, Homo sapiens
ctgttagtcatttgc

SEQ ID NO: 2209941 - DNA, 18 bp, Homo sapiens
cttaatcttttcacaaat

SEQ ID NO: 2209942 - DNA, 14 bp, Homo sapiens
cttattaatgctaa

SEQ ID NO: 2209943 - DNA, 16 bp, Homo sapiens
cttattaatgctaagg

SEQ ID NO: 2209944 - DNA, 15 bp, Homo sapiens
cttcaccctggagcc

SEQ ID NO: 2209945 - DNA, 22 bp, Homo sapiens
cttcagtaacccccactggact

SEQ ID NO: 2209946 - DNA, 19 bp, Homo sapiens
cttcataacaattttagga

SEQ ID NO: 2209947 - DNA, 13 bp, Homo sapiens
cttccagcccaga

SEQ ID NO: 2209948 - DNA, 13 bp, Homo sapiens
cttctacttttaa

SEQ ID NO: 2209949 - DNA, 20 bp, Homo sapiens
cttcttaatcttttcacaaa

SEQ ID NO: 2209950 - DNA, 21 bp, Homo sapiens
cttcttaatcttttcacaaat

SEQ ID NO: 2209951 - DNA, 22 bp, Homo sapiens
cttcttaatcttttcacaaata

SEQ ID NO: 2209952 - DNA, 20 bp, Homo sapiens
cttgcttgattgtatggtgg

SEQ ID NO: 2209953 - DNA, 21 bp, Homo sapiens
cttggccgcacctaaagcagc

SEQ ID NO: 2209954 - DNA, 15 bp, Homo sapiens
cttgtaattctaaat

SEQ ID NO: 2209955 - DNA, 13 bp, Homo sapiens
cttgtacatgtgt

SEQ ID NO: 2209956 - DNA, 22 bp, Homo sapiens
cttgtacatgtgtagcctgtgc

SEQ ID NO: 2209957 - DNA, 17 bp, Homo sapiens
cttgtactttattttct

SEQ ID NO: 2209958 - DNA, 17 bp, Homo sapiens
cttgtgactagtgctga

SEQ ID NO: 2209959 - DNA, 15 bp, Homo sapiens
cttgtgcagtgttga

SEQ ID NO: 2209960 - DNA, 15 bp, Homo sapiens
cttgtgtctgtacac

SEQ ID NO: 2209961 - DNA, 18 bp, Homo sapiens
cttgtgtctgtacacgtg

SEQ ID NO: 2209962 - DNA, 22 bp, Homo sapiens
ctttatctaatacctctgtgtg

SEQ ID NO: 2209963 - DNA, 22 bp, Homo sapiens
ctttcaataaactaaagaaaaa

SEQ ID NO: 2209964 - DNA, 18 bp, Homo sapiens
ctttcatttactgtggct

SEQ ID NO: 2209965 - DNA, 21 bp, Homo sapiens
ctttgactcttttgccattaa

SEQ ID NO: 2209966 - DNA, 14 bp, Homo sapiens
cttttcacaaataa

SEQ ID NO: 2209967 - DNA, 15 bp, Homo sapiens
cttttcacaaataaa

SEQ ID NO: 2209968 - DNA, 18 bp, Homo sapiens
ctttttgaaatcagcata

SEQ ID NO: 2209969 - DNA, 16 bp, Homo sapiens
ctttttttggcccagg

SEQ ID NO: 2209970 - DNA, 19 bp, Homo sapiens
gaaaataacaataaaagac

SEQ ID NO: 2209971 - DNA, 19 bp, Homo sapiens
gaaaataacgataaaagac

SEQ ID NO: 2209972 - DNA, 19 bp, Homo sapiens
gaaagtcttgtgactagtg

SEQ ID NO: 2209973 - DNA, 18 bp, Homo sapiens
gaaatatgcacaatagca

SEQ ID NO: 2209974 - DNA, 21 bp, Homo sapiens
gaaatgttattttttaattat

SEQ ID NO: 2209975 - DNA, 21 bp, Homo sapiens
gaacaagcaaacccagacggc

SEQ ID NO: 2209976 - DNA, 15 bp, Homo sapiens
gaaccaacactaaca

SEQ ID NO: 2209977 - DNA, 17 bp, Homo sapiens
gaaccccttcatcctct

SEQ ID NO: 2209978 - DNA, 21 bp, Homo sapiens
gaacttgtaaaggaatttaaa

SEQ ID NO: 2209979 - DNA, 22 bp, Homo sapiens
gaagatctctgcagggccgcca

SEQ ID NO: 2209980 - DNA, 18 bp, Homo sapiens
gaagccttaccacgcagt

SEQ ID NO: 2209981 - DNA, 23 bp, Homo sapiens
gaagcttattaatgctaagggca

SEQ ID NO: 2209982 - DNA, 24 bp, Homo sapiens
gaaggcactaaaaagagctgtcct

SEQ ID NO: 2209983 - DNA, 23 bp, Homo sapiens
gaagtctctttttttggcccagg

SEQ ID NO: 2209984 - DNA, 20 bp, Homo sapiens
gaataatcctaaacatatga

SEQ ID NO: 2209985 - DNA, 18 bp, Homo sapiens
gaatcccacccacatgtg

SEQ ID NO: 2209986 - DNA, 16 bp, Homo sapiens
gaatgtaatcaatgtt

SEQ ID NO: 2209987 - DNA, 18 bp, Homo sapiens
gaatgtaatcaatgtttc

SEQ ID NO: 2209988 - DNA, 21 bp, Homo sapiens
gaattgcattttttaaaacaa

SEQ ID NO: 2209989 - DNA, 17 bp, Homo sapiens
gacactgggaggccagt

SEQ ID NO: 2209990 - DNA, 12 bp, Homo sapiens
gacactgtacaa

SEQ ID NO: 2209991 - DNA, 21 bp, Homo sapiens
gacaggagacctggcactgga

SEQ ID NO: 2209992 - DNA, 14 bp, Homo sapiens
gacaggcagagctg

SEQ ID NO: 2209993 - DNA, 12 bp, Homo sapiens
gaccacacctgc

SEQ ID NO: 2209994 - DNA, 14 bp, Homo sapiens
gaccactgttatca

SEQ ID NO: 2209995 - DNA, 23 bp, Homo sapiens
gaccaggcatcctccacaatagc

SEQ ID NO: 2209996 - DNA, 22 bp, Homo sapiens
gaccccgacgccacagcccagc

SEQ ID NO: 2209997 - DNA, 23 bp, Homo sapiens
gacctgatttctgagcatttaat

SEQ ID NO: 2209998 - DNA, 18 bp, Homo sapiens
gacctggtccacagggca

SEQ ID NO: 2209999 - DNA, 12 bp, Homo sapiens
gacgctggctcc

SEQ ID NO: 2210000 - DNA, 12 bp, Homo sapiens
gacggctccact

SEQ ID NO: 2210001 - DNA, 12 bp, Homo sapiens
gactagtgctga

SEQ ID NO: 2210002 - DNA, 14 bp, Homo sapiens
gactagtgctgaag

SEQ ID NO: 2210003 - DNA, 15 bp, Homo sapiens
gactctgcacatgtc

SEQ ID NO: 2210004 - DNA, 15 bp, Homo sapiens
gactgatcaggacct

SEQ ID NO: 2210005 - DNA, 13 bp, Homo sapiens
gacttgaccccga

SEQ ID NO: 2210006 - DNA, 20 bp, Homo sapiens
gacttggggagatggagttc

SEQ ID NO: 2210007 - DNA, 21 bp, Homo sapiens
gactttatctaatacctctgt

SEQ ID NO: 2210008 - DNA, 14 bp, Homo sapiens
gagacaggcagagc

SEQ ID NO: 2210009 - DNA, 13 bp, Homo sapiens
gagagcctggtgc

SEQ ID NO: 2210010 - DNA, 19 bp, Homo sapiens
gagagcctggtgctgctgc

SEQ ID NO: 2210011 - DNA, 22 bp, Homo sapiens
gagcatgtactgagccttgtaa

SEQ ID NO: 2210012 - DNA, 15 bp, Homo sapiens
gagccgggccgcaga

SEQ ID NO: 2210013 - DNA, 16 bp, Homo sapiens
gagcctggtgctgctg

SEQ ID NO: 2210014 - DNA, 17 bp, Homo sapiens
gagcctggtgctgctgc

SEQ ID NO: 2210015 - DNA, 18 bp, Homo sapiens
gagctccaactcagaagg

SEQ ID NO: 2210016 - DNA, 16 bp, Homo sapiens
gagctcccaggtgcag

SEQ ID NO: 2210017 - DNA, 22 bp, Homo sapiens
gagctcccaggtgcagccagag

SEQ ID NO: 2210018 - DNA, 15 bp, Homo sapiens
gaggccttgagaggc

SEQ ID NO: 2210019 - DNA, 23 bp, Homo sapiens
gagggagctccaactcagaaggg

SEQ ID NO: 2210020 - DNA, 21 bp, Homo sapiens
gaggggtcgacttcgggctgg

SEQ ID NO: 2210021 - DNA, 23 bp, Homo sapiens
gatcaagtcggatctagtccagc

SEQ ID NO: 2210022 - DNA, 16 bp, Homo sapiens
gatctctgcagggccg

SEQ ID NO: 2210023 - DNA, 19 bp, Homo sapiens
gatggagttcttgtgccat

SEQ ID NO: 2210024 - DNA, 14 bp, Homo sapiens
gattgcaatttgca

SEQ ID NO: 2210025 - DNA, 20 bp, Homo sapiens
gatttcatttcaactgtttg

SEQ ID NO: 2210026 - DNA, 22 bp, Homo sapiens
gcaaagggtccagaaggagaca

SEQ ID NO: 2210027 - DNA, 23 bp, Homo sapiens
gcacaaagatgggtgaaggctgg

SEQ ID NO: 2210028 - DNA, 20 bp, Homo sapiens
gcacatgtcttgtacatgtg

SEQ ID NO: 2210029 - DNA, 17 bp, Homo sapiens
gcacccaagacctcagg

SEQ ID NO: 2210030 - DNA, 17 bp, Homo sapiens
gcacctaaagcagccag

SEQ ID NO: 2210031 - DNA, 14 bp, Homo sapiens
gcaccttgtgtctg

SEQ ID NO: 2210032 - DNA, 16 bp, Homo sapiens
gcactgactgggcata

SEQ ID NO: 2210033 - DNA, 17 bp, Homo sapiens
gcactgactgggcatag

SEQ ID NO: 2210034 - DNA, 18 bp, Homo sapiens
gcagactgatcaggacct

SEQ ID NO: 2210035 - DNA, 22 bp, Homo sapiens
gcagccagccgtgagtgcagac

SEQ ID NO: 2210036 - DNA, 13 bp, Homo sapiens
gcagccaggacac

SEQ ID NO: 2210037 - DNA, 15 bp, Homo sapiens
gcagctcagcttccc

SEQ ID NO: 2210038 - DNA, 20 bp, Homo sapiens
gcaggagcacacccagcccc

SEQ ID NO: 2210039 - DNA, 17 bp, Homo sapiens
gcaggtgaaacccagtc

SEQ ID NO: 2210040 - DNA, 15 bp, Homo sapiens
caggacaccgggcag

SEQ ID NO: 2210041 - DNA, 17 bp, Homo sapiens
caggacgtgggctgggc

SEQ ID NO: 2210042 - DNA, 21 bp, Homo sapiens
caggcttttttccagactcta

SEQ ID NO: 2210043 - DNA, 20 bp, Homo sapiens
cagggcagccgtcacccctg

SEQ ID NO: 2210044 - DNA, 23 bp, Homo sapiens
cagggccgcccgggcccagagga

SEQ ID NO: 2210045 - DNA, 19 bp, Homo sapiens
cagggctcccacagagaca

SEQ ID NO: 2210046 - DNA, 19 bp, Homo sapiens
cagggtcagaaacaggacc

SEQ ID NO: 2210047 - DNA, 23 bp, Homo sapiens
caggtgagtcctagagctacagg

SEQ ID NO: 2210048 - DNA, 14 bp, Homo sapiens
caggtgcagccaga

SEQ ID NO: 2210049 - DNA, 16 bp, Homo sapiens
caggtgcagccagagg

SEQ ID NO: 2210050 - DNA, 17 bp, Homo sapiens
caggtgcagccagaggc

SEQ ID NO: 2210051 - DNA, 19 bp, Homo sapiens
caggtgcagccagaggcac

SEQ ID NO: 2210052 - DNA, 22 bp, Homo sapiens
cagtgttttctgggataagtaa

SEQ ID NO: 2210053 - DNA, 21 bp, Homo sapiens
cagttattatatttacaaatg

SEQ ID NO: 2210054 - DNA, 12 bp, Homo sapiens
cataagtttctg

SEQ ID NO: 2210055 - DNA, 17 bp, Homo sapiens
cataatgttacattatt

SEQ ID NO: 2210056 - DNA, 19 bp, Homo sapiens
catactcaatgttactatc

SEQ ID NO: 2210057 - DNA, 15 bp, Homo sapiens
catagccaggaaact

SEQ ID NO: 2210058 - DNA, 16 bp, Homo sapiens
cataggtttaataatt

SEQ ID NO: 2210059 - DNA, 15 bp, Homo sapiens
catataatgttgtta

SEQ ID NO: 2210060 - DNA, 18 bp, Homo sapiens
catataatgttgttattt

SEQ ID NO: 2210061 - DNA, 16 bp, Homo sapiens
catatgcaccttgtgt

SEQ ID NO: 2210062 - DNA, 17 bp, Homo sapiens
catatgcaccttgtgtc

SEQ ID NO: 2210063 - DNA, 19 bp, Homo sapiens
catatgcaccttgtgtctg

SEQ ID NO: 2210064 - DNA, 17 bp, Homo sapiens
catatggactctgcaca

SEQ ID NO: 2210065 - DNA, 15 bp, Homo sapiens
catatgtaccatgta

SEQ ID NO: 2210066 - DNA, 21 bp, Homo sapiens
catatgtaccatgtacatgaa

SEQ ID NO: 2210067 - DNA, 22 bp, Homo sapiens
catcttctttttgaaatcagca

SEQ ID NO: 2210068 - DNA, 17 bp, Homo sapiens
catgagaccactgttat

SEQ ID NO: 2210069 - DNA, 17 bp, Homo sapiens
catggcctatgcacata

SEQ ID NO: 2210070 - DNA, 22 bp, Homo sapiens
catggctataaacaattacatg

SEQ ID NO: 2210071 - DNA, 23 bp, Homo sapiens
catgtactgagccttgtaattct

SEQ ID NO: 2210072 - DNA, 23 bp, Homo sapiens
catgtcttgtacatgtgtagcct

SEQ ID NO: 2210073 - DNA, 13 bp, Homo sapiens
catgtgacacata

SEQ ID NO: 2210074 - DNA, 14 bp, Homo sapiens
catgtgacacatat

SEQ ID NO: 2210075 - DNA, 15 bp, Homo sapiens
catgtgacacatatg

SEQ ID NO: 2210076 - DNA, 18 bp, Homo sapiens
catgtgtagcctgtgcat

SEQ ID NO: 2210077 - DNA, 13 bp, Homo sapiens
catttactgtggc

SEQ ID NO: 2210078 - DNA, 14 bp, Homo sapiens
ccaactcagaaggg

SEQ ID NO: 2210079 - DNA, 15 bp, Homo sapiens
ccaagcaagactgag

SEQ ID NO: 2210080 - DNA, 12 bp, Homo sapiens
ccaagccactga

SEQ ID NO: 2210081 - DNA, 12 bp, Homo sapiens
ccaatcatttta

SEQ ID NO: 2210082 - DNA, 14 bp, Homo sapiens
ccaatcattttaat

SEQ ID NO: 2210083 - DNA, 14 bp, Homo sapiens
ccacacctgcctct

SEQ ID NO: 2210084 - DNA, 17 bp, Homo sapiens
ccacagagacaaggagg

SEQ ID NO: 2210085 - DNA, 15 bp, Homo sapiens
ccacagcccagccac

SEQ ID NO: 2210086 - DNA, 19 bp, Homo sapiens
ccacatgtgacacatatgc

SEQ ID NO: 2210087 - DNA, 13 bp, Homo sapiens
ccacgcagccagg

SEQ ID NO: 2210088 - DNA, 14 bp, Homo sapiens
ccacgcagccagga

SEQ ID NO: 2210089 - DNA, 15 bp, Homo sapiens
ccacgcagccaggac

SEQ ID NO: 2210090 - DNA, 20 bp, Homo sapiens
ccagacggctccactaggac

SEQ ID NO: 2210091 - DNA, 20 bp, Homo sapiens
ccagaggactgtgatgccct

SEQ ID NO: 2210092 - DNA, 20 bp, Homo sapiens
ccagaggagctgggagccgg

SEQ ID NO: 2210093 - DNA, 22 bp, Homo sapiens
ccagaggagctgggagccgggc

SEQ ID NO: 2210094 - DNA, 22 bp, Homo sapiens
ccagaggcacctcaagaagaag

SEQ ID NO: 2210095 - DNA, 20 bp, Homo sapiens
ccagccgtgagtgcagaccc

SEQ ID NO: 2210096 - DNA, 18 bp, Homo sapiens
ccagctcctcactcacct

SEQ ID NO: 2210097 - DNA, 12 bp, Homo sapiens
ccaggcttggaa

SEQ ID NO: 2210098 - DNA, 17 bp, Homo sapiens
ccagggagacctggaca

SEQ ID NO: 2210099 - DNA, 21 bp, Homo sapiens
ccagggagacctggacacagg

SEQ ID NO: 2210100 - DNA, 23 bp, Homo sapiens
ccagggagacctggacacaggcc

SEQ ID NO: 2210101 - DNA, 21 bp, Homo sapiens
ccaggtgagtcctagagctac

SEQ ID NO: 2210102 - DNA, 21 bp, Homo sapiens
ccagtcactgtgagctcccag

SEQ ID NO: 2210103 - DNA, 15 bp, Homo sapiens
ccatagtcacatggc

SEQ ID NO: 2210104 - DNA, 22 bp, Homo sapiens
ccatgcgacactgggaggccag

SEQ ID NO: 2210105 - DNA, 21 bp, Homo sapiens
cccaaattatcaagctaataa

SEQ ID NO: 2210106 - DNA, 15 bp, Homo sapiens
cccacccacatgtga

SEQ ID NO: 2210107 - DNA, 20 bp, Homo sapiens
cccagaggagctgggagccg

SEQ ID NO: 2210108 - DNA, 22 bp, Homo sapiens
cccagccacggacgctggctcc

SEQ ID NO: 2210109 - DNA, 23 bp, Homo sapiens
cccagcctggccacgcagccagg

SEQ ID NO: 2210110 - DNA, 15 bp, Homo sapiens
cccaggtgcagccag

SEQ ID NO: 2210111 - DNA, 16 bp, Homo sapiens
ccccagcctggccacg

SEQ ID NO: 2210112 - DNA, 23 bp, Homo sapiens
ccccagcctggccacgcagccag

SEQ ID NO: 2210113 - DNA, 14 bp, Homo sapiens
ccccgcttctgcct

SEQ ID NO: 2210114 - DNA, 21 bp, Homo sapiens
cccgggcagggctcccacaga

SEQ ID NO: 2210115 - DNA, 12 bp, Homo sapiens
cccgggcccaga

SEQ ID NO: 2210116 - DNA, 14 bp, Homo sapiens
cccttggctgggac

SEQ ID NO: 2210117 - DNA, 18 bp, Homo sapiens
ccgacgccacagcccagc

SEQ ID NO: 2210118 - DNA, 21 bp, Homo sapiens
ccgaggaaacgaaacccactc

SEQ ID NO: 2210119 - DNA, 16 bp, Homo sapiens
ccgcccgggcccagag

SEQ ID NO: 2210120 - DNA, 20 bp, Homo sapiens
ccgggcccagaggagctggg

SEQ ID NO: 2210121 - DNA, 17 bp, Homo sapiens
ccgtaggacccaagcag

SEQ ID NO: 2210122 - DNA, 15 bp, Homo sapiens
cctcaccacccactt

SEQ ID NO: 2210123 - DNA, 19 bp, Homo sapiens
cctcagttttatcattttc

SEQ ID NO: 2210124 - DNA, 15 bp, Homo sapiens
cctcctggcccaggt

SEQ ID NO: 2210125 - DNA, 15 bp, Homo sapiens
cctccttggtgcctg

SEQ ID NO: 2210126 - DNA, 21 bp, Homo sapiens
cctgccaccctgggcctggca

SEQ ID NO: 2210127 - DNA, 22 bp, Homo sapiens
cctgcctcccgcccccttggct

SEQ ID NO: 2210128 - DNA, 13 bp, Homo sapiens
cctggacacaggc

SEQ ID NO: 2210129 - DNA, 16 bp, Homo sapiens
cctggacacaggcctg

SEQ ID NO: 2210130 - DNA, 20 bp, Homo sapiens
cctggacacaggcctgctct

SEQ ID NO: 2210131 - DNA, 13 bp, Homo sapiens
cctggcacacatc

SEQ ID NO: 2210132 - DNA, 14 bp, Homo sapiens
cctggcagctcagc

SEQ ID NO: 2210133 - DNA, 15 bp, Homo sapiens
cctggccacgcagcc

SEQ ID NO: 2210134 - DNA, 15 bp, Homo sapiens
cctggcctggcacac

SEQ ID NO: 2210135 - DNA, 14 bp, Homo sapiens
cctggctcccagga

SEQ ID NO: 2210136 - DNA, 16 bp, Homo sapiens
cctggctcccaggaca

SEQ ID NO: 2210137 - DNA, 17 bp, Homo sapiens
cctggctcccaggacac

SEQ ID NO: 2210138 - DNA, 18 bp, Homo sapiens
cctgtagttgcgtggact

SEQ ID NO: 2210139 - DNA, 19 bp, Homo sapiens
cctgtagttgcgtggactc

SEQ ID NO: 2210140 - DNA, 17 bp, Homo sapiens
cctgtgcatgtatgtct

SEQ ID NO: 2210141 - DNA, 20 bp, Homo sapiens
cctgtgcatgtatgtcttgg

SEQ ID NO: 2210142 - DNA, 16 bp, Homo sapiens
ccttcagtaaccccca

SEQ ID NO: 2210143 - DNA, 17 bp, Homo sapiens
ccttgaagaacctctca

SEQ ID NO: 2210144 - DNA, 16 bp, Homo sapiens
cctttcatttactgtg

SEQ ID NO: 2210145 - DNA, 19 bp, Homo sapiens
cctttcatttactgtggct

SEQ ID NO: 2210146 - DNA, 14 bp, Homo sapiens
cgaaatgttatttt

SEQ ID NO: 2210147 - DNA, 11 bp, Homo sapiens
cgaccttggcc

SEQ ID NO: 2210148 - DNA, 15 bp, Homo sapiens
cgacgccacagccca

SEQ ID NO: 2210149 - DNA, 14 bp, Homo sapiens
cgcagccaggacac

SEQ ID NO: 2210150 - DNA, 15 bp, Homo sapiens
cgcagccaggacacc

SEQ ID NO: 2210151 - DNA, 18 bp, Homo sapiens
cgcaggagcacacccagc

SEQ ID NO: 2210152 - DNA, 18 bp, Homo sapiens
cgccagggagacctggac

SEQ ID NO: 2210153 - DNA, 17 bp, Homo sapiens
cgcccgggcccagagga

SEQ ID NO: 2210154 - DNA, 18 bp, Homo sapiens
cgcccgggcccagaggag

SEQ ID NO: 2210155 - DNA, 19 bp, Homo sapiens
cgcggctcccggggcaggg

SEQ ID NO: 2210156 - DNA, 14 bp, Homo sapiens
cgcttctgcctgca

SEQ ID NO: 2210157 - DNA, 15 bp, Homo sapiens
cgggcagggctccca

SEQ ID NO: 2210158 - DNA, 17 bp, Homo sapiens
ctaaatcctttactgtt

SEQ ID NO: 2210159 - DNA, 21 bp, Homo sapiens
ctaaatcctttactgttagtc

SEQ ID NO: 2210160 - DNA, 15 bp, Homo sapiens
ctaaatgaatgttta

SEQ ID NO: 2210161 - DNA, 16 bp, Homo sapiens
ctaaatgaatgtttac

SEQ ID NO: 2210162 - DNA, 13 bp, Homo sapiens
ctaataaaatatc

SEQ ID NO: 2210163 - DNA, 18 bp, Homo sapiens
ctaataaaatatcattca

SEQ ID NO: 2210164 - DNA, 19 bp, Homo sapiens
ctaatcagggaggtcattt

SEQ ID NO: 2210165 - DNA, 21 bp, Homo sapiens
ctagactaaaagattgagaag

SEQ ID NO: 2210166 - DNA, 23 bp, Homo sapiens
ctaggaagatctctgcagggccg

SEQ ID NO: 2210167 - DNA, 19 bp, Homo sapiens
ctaggcctcctggcccagg

SEQ ID NO: 2210168 - DNA, 22 bp, Homo sapiens
ctagtacttgggagacctgtaa

SEQ ID NO: 2210169 - DNA, 14 bp, Homo sapiens
ctagtgctgaagct

SEQ ID NO: 2210170 - DNA, 15 bp, Homo sapiens
ctagtgctgaagctt

SEQ ID NO: 2210171 - DNA, 16 bp, Homo sapiens
ctagtgctgaagctta

SEQ ID NO: 2210172 - DNA, 17 bp, Homo sapiens
ctagtgctgaagcttat

SEQ ID NO: 2210173 - DNA, 20 bp, Homo sapiens
ctagtgctgaagcttattaa

SEQ ID NO: 2210174 - DNA, 12 bp, Homo sapiens
ctataatttaaa

SEQ ID NO: 2210175 - DNA, 19 bp, Homo sapiens
ctcaagaagaagaggggca

SEQ ID NO: 2210176 - DNA, 14 bp, Homo sapiens
ctcactcaccttca

SEQ ID NO: 2210177 - DNA, 21 bp, Homo sapiens
ctcagaagggagctagccaga

SEQ ID NO: 2210178 - DNA, 22 bp, Homo sapiens
ctcagaagggagctagccagag

SEQ ID NO: 2210179 - DNA, 17 bp, Homo sapiens
ctcagcttccccaacac

SEQ ID NO: 2210180 - DNA, 17 bp, Homo sapiens
ctcagttttatcatttt

SEQ ID NO: 2210181 - DNA, 21 bp, Homo sapiens
ctccagggtcagaaacaggac

SEQ ID NO: 2210182 - DNA, 16 bp, Homo sapiens
ctccccaaagggtgtg

SEQ ID NO: 2210183 - DNA, 17 bp, Homo sapiens
ctcccggggcagggcag

SEQ ID NO: 2210184 - DNA, 17 bp, Homo sapiens
ctcctcactcaccttca

SEQ ID NO: 2210185 - DNA, 16 bp, Homo sapiens
ttatatttacaaatgg

SEQ ID NO: 2210186 - DNA, 20 bp, Homo sapiens
ttatctaatacctctgtgtg

SEQ ID NO: 2210187 - DNA, 13 bp, Homo sapiens
ttattaatgctaa

SEQ ID NO: 2210188 - DNA, 15 bp, Homo sapiens
ttattaatgctaagg

SEQ ID NO: 2210189 - DNA, 16 bp, Homo sapiens
ttcaaaatggagggaa

SEQ ID NO: 2210190 - DNA, 19 bp, Homo sapiens
ttcaataaatgtctgttga

SEQ ID NO: 2210191 - DNA, 11 bp, Homo sapiens
ttcacaaataa

SEQ ID NO: 2210192 - DNA, 21 bp, Homo sapiens
ttcagtaacccccactggact

SEQ ID NO: 2210193 - DNA, 23 bp, Homo sapiens
ttcatgatttcatttcaactgtt

SEQ ID NO: 2210194 - DNA, 13 bp, Homo sapiens
ttcatttactgtg

SEQ ID NO: 2210195 - DNA, 16 bp, Homo sapiens
ttcatttactgtggct

SEQ ID NO: 2210196 - DNA, 14 bp, Homo sapiens
ttcctgtcctccca

SEQ ID NO: 2210197 - DNA, 20 bp, Homo sapiens
ttcctgtcctcccagctcct

SEQ ID NO: 2210198 - DNA, 14 bp, Homo sapiens
ttccttccagccca

SEQ ID NO: 2210199 - DNA, 20 bp, Homo sapiens
ttcctttcatttactgtggc

SEQ ID NO: 2210200 - DNA, 21 bp, Homo sapiens
ttcctttcatttactgtggct

SEQ ID NO: 2210201 - DNA, 18 bp, Homo sapiens
ttctaaaaattgtgatca

SEQ ID NO: 2210202 - DNA, 21 bp, Homo sapiens
ttctaaatgaatgtttacact

SEQ ID NO: 2210203 - DNA, 14 bp, Homo sapiens
ttctataatttaaa

SEQ ID NO: 2210204 - DNA, 16 bp, Homo sapiens
ttctggaatgtaatca

SEQ ID NO: 2210205 - DNA, 19 bp, Homo sapiens
ttcttaatcttttcacaaa

SEQ ID NO: 2210206 - DNA, 18 bp, Homo sapiens
ttcttcataacaatttta

SEQ ID NO: 2210207 - DNA, 21 bp, Homo sapiens
ttcttcataacaattttagga

SEQ ID NO: 2210208 - DNA, 23 bp, Homo sapiens
ttgaattgcattttttaaaacaa

SEQ ID NO: 2210209 - DNA, 15 bp, Homo sapiens
ttgactcttttgcca

SEQ ID NO: 2210210 - DNA, 18 bp, Homo sapiens
ttgatcccttctgttggt

SEQ ID NO: 2210211 - DNA, 23 bp, Homo sapiens
ttgcatagtaccaatcattttaa

SEQ ID NO: 2210212 - DNA, 18 bp, Homo sapiens
ttgcgtggactctgcaca

SEQ ID NO: 2210213 - DNA, 15 bp, Homo sapiens
ttgctatctattgat

SEQ ID NO: 2210214 - DNA, 22 bp, Homo sapiens
ttggtgcctggcctggcacaca

SEQ ID NO: 2210215 - DNA, 20 bp, Homo sapiens
ttgtaagagtggaaccaaca

SEQ ID NO: 2210216 - DNA, 14 bp, Homo sapiens
ttgtaattctaaat

SEQ ID NO: 2210217 - DNA, 21 bp, Homo sapiens
ttgtacatgtgtagcctgtgc

SEQ ID NO: 2210218 - DNA, 14 bp, Homo sapiens
ttgtattaaagaca

SEQ ID NO: 2210219 - DNA, 16 bp, Homo sapiens
ttgtgactagtgctga

SEQ ID NO: 2210220 - DNA, 21 bp, Homo sapiens
ttgtgactagtgctgaagctt

SEQ ID NO: 2210221 - DNA, 23 bp, Homo sapiens
ttgtgatcagaccataatgttac

SEQ ID NO: 2210222 - DNA, 13 bp, Homo sapiens
ttgtgtctgtaca

SEQ ID NO: 2210223 - DNA, 15 bp, Homo sapiens
ttgtgtctgtacacg

SEQ ID NO: 2210224 - DNA, 19 bp, Homo sapiens
tttaactctataatgtgtt

SEQ ID NO: 2210225 - DNA, 15 bp, Homo sapiens
tttaagataattata

SEQ ID NO: 2210226 - DNA, 15 bp, Homo sapiens
tttcagcagctgcag

SEQ ID NO: 2210227 - DNA, 21 bp, Homo sapiens
tttcattaatacagggcattt

SEQ ID NO: 2210228 - DNA, 14 bp, Homo sapiens
tttcatttactgtg

SEQ ID NO: 2210229 - DNA, 17 bp, Homo sapiens
tttcatttactgtggct

SEQ ID NO: 2210230 - DNA, 20 bp, Homo sapiens
tttcctgagaccacagagag

SEQ ID NO: 2210231 - DNA, 13 bp, Homo sapiens
tttgagacaggag

SEQ ID NO: 2210232 - DNA, 23 bp, Homo sapiens
tttgcatagtaccaatcatttta

SEQ ID NO: 2210233 - DNA, 19 bp, Homo sapiens
ttttatcattttcaaaatg

SEQ ID NO: 2210234 - DNA, 14 bp, Homo sapiens
ttttcaaaatggag

SEQ ID NO: 2210235 - DNA, 21 bp, Homo sapiens
ttttggtccaagttgtgctta

SEQ ID NO: 2210236 - DNA, 15 bp, Homo sapiens
tttttgaagctgtat

SEQ ID NO: 2210237 - DNA, 13 bp, Homo sapiens
aaaatatcattca

SEQ ID NO: 2210238 - DNA, 14 bp, Homo sapiens
aaaatatcattcag

SEQ ID NO: 2210239 - DNA, 21 bp, Homo sapiens
aaagaaaaattattaaaggaa

SEQ ID NO: 2210240 - DNA, 19 bp, Homo sapiens
aaagcttgcaacaaaattc

SEQ ID NO: 2210241 - DNA, 13 bp, Homo sapiens
aaaggaatttaaa

SEQ ID NO: 2210242 - DNA, 18 bp, Homo sapiens
aaagtcttgtgactagtg

SEQ ID NO: 2210243 - DNA, 19 bp, Homo sapiens
aaagtcttgtgactagtgc

SEQ ID NO: 2210244 - DNA, 23 bp, Homo sapiens
aaagtcttgtgactagtgctgaa

SEQ ID NO: 2210245 - DNA, 20 bp, Homo sapiens
aaatagtctagactaaaaga

SEQ ID NO: 2210246 - DNA, 21 bp, Homo sapiens
aaatagtctagactaaaagat

SEQ ID NO: 2210247 - DNA, 21 bp, Homo sapiens
aaatatatttaagataattat

SEQ ID NO: 2210248 - DNA, 17 bp, Homo sapiens
aaatcttataatttaaa

SEQ ID NO: 2210249 - DNA, 21 bp, Homo sapiens
aaatgttattttttaattatt

SEQ ID NO: 2210250 - DNA, 14 bp, Homo sapiens
aaattagatgaact

SEQ ID NO: 2210251 - DNA, 17 bp, Homo sapiens
aaattatcaagctaata

SEQ ID NO: 2210252 - DNA, 17 bp, Homo sapiens
aaattgtattacaaatc

SEQ ID NO: 2210253 - DNA, 13 bp, Homo sapiens
aacacgcaggagc

SEQ ID NO: 2210254 - DNA, 18 bp, Homo sapiens
aacactaacatataatgt

SEQ ID NO: 2210255 - DNA, 13 bp, Homo sapiens
aacagctgcctct

SEQ ID NO: 2210256 - DNA, 12 bp, Homo sapiens
aacaggaccggg

SEQ ID NO: 2210257 - DNA, 21 bp, Homo sapiens
aacagttttttatgctaatca

SEQ ID NO: 2210258 - DNA, 18 bp, Homo sapiens
aacatataatgttgttat

SEQ ID NO: 2210259 - DNA, 21 bp, Homo sapiens
aacatataatgttgttattta

SEQ ID NO: 2210260 - DNA, 13 bp, Homo sapiens
aacattcaggagc

SEQ ID NO: 2210261 - DNA, 22 bp, Homo sapiens
aaccactggaaagtttatggtt

SEQ ID NO: 2210262 - DNA, 19 bp, Homo sapiens
aagaacaccctatattttg

SEQ ID NO: 2210263 - DNA, 19 bp, Homo sapiens
aagaagccacagacctagg

SEQ ID NO: 2210264 - DNA, 19 bp, Homo sapiens
aagattgagaagttacttt

SEQ ID NO: 2210265 - DNA, 13 bp, Homo sapiens
aagcaaacccaga

SEQ ID NO: 2210266 - DNA, 16 bp, Homo sapiens
aagccagggtgtgtct

SEQ ID NO: 2210267 - DNA, 18 bp, Homo sapiens
aagcgatcacttcctata

SEQ ID NO: 2210268 - DNA, 21 bp, Homo sapiens
aagctaataaaatatcattca

SEQ ID NO: 2210269 - DNA, 16 bp, Homo sapiens
aagcttattaatgcta

SEQ ID NO: 2210270 - DNA, 19 bp, Homo sapiens
aagcttattaatgctaagg

SEQ ID NO: 2210271 - DNA, 19 bp, Homo sapiens
aaggagacaggcagagctg

SEQ ID NO: 2210272 - DNA, 20 bp, Homo sapiens
aaggcaaagcacgaaatgtt

SEQ ID NO: 2210273 - DNA, 17 bp, Homo sapiens
aagggagctagccagag

SEQ ID NO: 2210274 - DNA, 22 bp, Homo sapiens
aagtcttgtgactagtgctgaa

SEQ ID NO: 2210275 - DNA, 16 bp, Homo sapiens
aagtctttcacattta

SEQ ID NO: 2210276 - DNA, 21 bp, Homo sapiens
aagtttccttccagcccagaa

SEQ ID NO: 2210277 - DNA, 12 bp, Homo sapiens
aataaaatatca

SEQ ID NO: 2210278 - DNA, 17 bp, Homo sapiens
aataaaatatcattcag

SEQ ID NO: 2210279 - DNA, 13 bp, Homo sapiens
aataaactaaaga

SEQ ID NO: 2210280 - DNA, 20 bp, Homo sapiens
aataaattgtaattgtaaag

SEQ ID NO: 2210281 - DNA, 21 bp, Homo sapiens
aataacaatgaaagttgataa

SEQ ID NO: 2210282 - DNA, 13 bp, Homo sapiens
aatacctctgtgt

SEQ ID NO: 2210283 - DNA, 17 bp, Homo sapiens
aatatactatatttatg

SEQ ID NO: 2210284 - DNA, 15 bp, Homo sapiens
aatatatttaagata

SEQ ID NO: 2210285 - DNA, 20 bp, Homo sapiens
aatatcagcaagtctcttta

SEQ ID NO: 2210286 - DNA, 15 bp, Homo sapiens
aatatcattcagcaa

SEQ ID NO: 2210287 - DNA, 15 bp, Homo sapiens
aatcatcaagtcttt

SEQ ID NO: 2210288 - DNA, 15 bp, Homo sapiens
aatcattttaattat

SEQ ID NO: 2210289 - DNA, 17 bp, Homo sapiens
aatcattttaattatta

SEQ ID NO: 2210290 - DNA, 20 bp, Homo sapiens
aatcattttaattattattc

SEQ ID NO: 2210291 - DNA, 22 bp, Homo sapiens
aatcattttaattattattctt

SEQ ID NO: 2210292 - DNA, 17 bp, Homo sapiens
aatcccacccacatgtg

SEQ ID NO: 2210293 - DNA, 18 bp, Homo sapiens
aatcccacccacatgtga

SEQ ID NO: 2210294 - DNA, 13 bp, Homo sapiens
aatcctttactgt

SEQ ID NO: 2210295 - DNA, 14 bp, Homo sapiens
aatcttataattta

SEQ ID NO: 2210296 - DNA, 16 bp, Homo sapiens
aatcttataatttaaa

SEQ ID NO: 2210297 - DNA, 20 bp, Homo sapiens
aatgaaagtcttgtgactag

SEQ ID NO: 2210298 - DNA, 14 bp, Homo sapiens
atgtacattaatta

SEQ ID NO: 2210299 - DNA, 21 bp, Homo sapiens
atgtaccatgtacatgaagaa

SEQ ID NO: 2210300 - DNA, 18 bp, Homo sapiens
atgtactgagccttgtaa

SEQ ID NO: 2210301 - DNA, 20 bp, Homo sapiens
atgtcttggacactgtacaa

SEQ ID NO: 2210302 - DNA, 17 bp, Homo sapiens
atgtcttgtacatgtgt

SEQ ID NO: 2210303 - DNA, 22 bp, Homo sapiens
atgtcttgtacatgtgtagcct

SEQ ID NO: 2210304 - DNA, 11 bp, Homo sapiens
atgtgacacat

SEQ ID NO: 2210305 - DNA, 15 bp, Homo sapiens
atgtgtagcctgtgc

SEQ ID NO: 2210306 - DNA, 16 bp, Homo sapiens
atgtgtagcctgtgca

SEQ ID NO: 2210307 - DNA, 17 bp, Homo sapiens
atgtgtagcctgtgcat

SEQ ID NO: 2210308 - DNA, 17 bp, Homo sapiens
atgttgttatttaaaga

SEQ ID NO: 2210309 - DNA, 18 bp, Homo sapiens
atgtttacactctttgta

SEQ ID NO: 2210310 - DNA, 21 bp, Homo sapiens
attacagatgggcaaattaag

SEQ ID NO: 2210311 - DNA, 13 bp, Homo sapiens
attactgtttgga

SEQ ID NO: 2210312 - DNA, 22 bp, Homo sapiens
attataatatactatatttatg

SEQ ID NO: 2210313 - DNA, 23 bp, Homo sapiens
attatcaagctaataaaatatca

SEQ ID NO: 2210314 - DNA, 17 bp, Homo sapiens
attatgggaatcaagat

SEQ ID NO: 2210315 - DNA, 13 bp, Homo sapiens
attcaataaattg

SEQ ID NO: 2210316 - DNA, 17 bp, Homo sapiens
attcagcggaatattga

SEQ ID NO: 2210317 - DNA, 16 bp, Homo sapiens
attccacctgcaatca

SEQ ID NO: 2210318 - DNA, 18 bp, Homo sapiens
attgcattttttaaaaca

SEQ ID NO: 2210319 - DNA, 13 bp, Homo sapiens
attgccttcattt

SEQ ID NO: 2210320 - DNA, 20 bp, Homo sapiens
attgccttcattttatgata

SEQ ID NO: 2210321 - DNA, 19 bp, Homo sapiens
attggacagtaaaatccac

SEQ ID NO: 2210322 - DNA, 14 bp, Homo sapiens
attgtattacaaat

SEQ ID NO: 2210323 - DNA, 15 bp, Homo sapiens
attgtattacaaatc

SEQ ID NO: 2210324 - DNA, 19 bp, Homo sapiens
atttaaagaacaccctata

SEQ ID NO: 2210325 - DNA, 22 bp, Homo sapiens
atttataaatatatttaagata

SEQ ID NO: 2210326 - DNA, 12 bp, Homo sapiens
atttcacttaat

SEQ ID NO: 2210327 - DNA, 15 bp, Homo sapiens
atttgcacaagtttt

SEQ ID NO: 2210328 - DNA, 22 bp, Homo sapiens
attttcagttattatatttaca

SEQ ID NO: 2210329 - DNA, 17 bp, Homo sapiens
attttctataatttaaa

SEQ ID NO: 2210330 - DNA, 22 bp, Homo sapiens
attttggtaaaatacttcttga

SEQ ID NO: 2210331 - DNA, 18 bp, Homo sapiens
attttggtccaagttgtg

SEQ ID NO: 2210332 - DNA, 15 bp, Homo sapiens
attttttaaaacaag

SEQ ID NO: 2210333 - DNA, 17 bp, Homo sapiens
attttttaaaacaagaa

SEQ ID NO: 2210334 - DNA, 21 bp, Homo sapiens
caaaaggataatgaatacttt

SEQ ID NO: 2210335 - DNA, 21 bp, Homo sapiens
caaagatgggtgaaggctggc

SEQ ID NO: 2210336 - DNA, 17 bp, Homo sapiens
caaagggtccagaagga

SEQ ID NO: 2210337 - DNA, 21 bp, Homo sapiens
caaagggtccagaaggagaca

SEQ ID NO: 2210338 - DNA, 11 bp, Homo sapiens
caaagggtgtg

SEQ ID NO: 2210339 - DNA, 16 bp, Homo sapiens
caaattatcaagctaa

SEQ ID NO: 2210340 - DNA, 20 bp, Homo sapiens
caaattatcaagctaataaa

SEQ ID NO: 2210341 - DNA, 16 bp, Homo sapiens
caacacgcaggagcac

SEQ ID NO: 2210342 - DNA, 22 bp, Homo sapiens
caacagttttttatgctaatca

SEQ ID NO: 2210343 - DNA, 24 bp, Homo sapiens
caagacctcagggcacaaagatgg

SEQ ID NO: 2210344 - DNA, 17 bp, Homo sapiens
caagcaaacccagacgg

SEQ ID NO: 2210345 - DNA, 17 bp, Homo sapiens
caagcactaaacaaaga

SEQ ID NO: 2210346 - DNA, 19 bp, Homo sapiens
caagctaataaaatatcat

SEQ ID NO: 2210347 - DNA, 23 bp, Homo sapiens
caagctaataaaatatcattcag

SEQ ID NO: 2210348 - DNA, 17 bp, Homo sapiens
caatcattttaattatt

SEQ ID NO: 2210349 - DNA, 17 bp, Homo sapiens
caatgtttcttctaggt

SEQ ID NO: 2210350 - DNA, 13 bp, Homo sapiens
caattccacctgc

SEQ ID NO: 2210351 - DNA, 13 bp, Homo sapiens
cacacatcaggag

SEQ ID NO: 2210352 - DNA, 22 bp, Homo sapiens
cacatatgcaccttgtgtctgt

SEQ ID NO: 2210353 - DNA, 24 bp, Homo sapiens
cacatgaatcccacccacatgtga

SEQ ID NO: 2210354 - DNA, 15 bp, Homo sapiens
cacatgtcttgtaca

SEQ ID NO: 2210355 - DNA, 15 bp, Homo sapiens
cacatgtgacacata

SEQ ID NO: 2210356 - DNA, 22 bp, Homo sapiens
caccagtgaatgaaagtcttgt

SEQ ID NO: 2210357 - DNA, 16 bp, Homo sapiens
caccctcccacccggc

SEQ ID NO: 2210358 - DNA, 15 bp, Homo sapiens
cacctaaagcagcca

SEQ ID NO: 2210359 - DNA, 15 bp, Homo sapiens
cacctgccaccctgg

SEQ ID NO: 2210360 - DNA, 20 bp, Homo sapiens
cacctgccaccctgggcctg

SEQ ID NO: 2210361 - DNA, 23 bp, Homo sapiens
caccttcagtaacccccactgga

SEQ ID NO: 2210362 - DNA, 17 bp, Homo sapiens
caccttgtgtctgtaca

SEQ ID NO: 2210363 - DNA, 16 bp, Homo sapiens
cacgaaatgttatttt

SEQ ID NO: 2210364 - DNA, 13 bp, Homo sapiens
cacgcagccagga

SEQ ID NO: 2210365 - DNA, 20 bp, Homo sapiens
cacgcaggagcacacccagc

SEQ ID NO: 2210366 - DNA, 16 bp, Homo sapiens
cacggacgctggctcc

SEQ ID NO: 2210367 - DNA, 13 bp, Homo sapiens
cactaaacaaaga

SEQ ID NO: 2210368 - DNA, 15 bp, Homo sapiens
cactctttgtaagag

SEQ ID NO: 2210369 - DNA, 16 bp, Homo sapiens
cactggactgacctgg

SEQ ID NO: 2210370 - DNA, 15 bp, Homo sapiens
cactggatgcagaaa

SEQ ID NO: 2210371 - DNA, 20 bp, Homo sapiens
cactgtacaaggtacccctt

SEQ ID NO: 2210372 - DNA, 16 bp, Homo sapiens
cactgtgagctcccag

SEQ ID NO: 2210373 - DNA, 17 bp, Homo sapiens
cactgtgagctcccagg

SEQ ID NO: 2210374 - DNA, 22 bp, Homo sapiens
cactgtgagctcccaggtgcag

SEQ ID NO: 2210375 - DNA, 20 bp, Homo sapiens
cagaagggagctagccagag

SEQ ID NO: 2210376 - DNA, 19 bp, Homo sapiens
cagacagtgttttctggga

SEQ ID NO: 2210377 - DNA, 16 bp, Homo sapiens
cagaccccttggccag

SEQ ID NO: 2210378 - DNA, 13 bp, Homo sapiens
cagagacaaggag

SEQ ID NO: 2210379 - DNA, 20 bp, Homo sapiens
cagagagcctggtgctgctg

SEQ ID NO: 2210380 - DNA, 18 bp, Homo sapiens
cagcagactgatcaggac

SEQ ID NO: 2210381 - DNA, 19 bp, Homo sapiens
ctccctgcacaagccaggg

SEQ ID NO: 2210382 - DNA, 19 bp, Homo sapiens
ctccttggtgcctggcctg

SEQ ID NO: 2210383 - DNA, 22 bp, Homo sapiens
ctccttggtgcctggcctggca

SEQ ID NO: 2210384 - DNA, 13 bp, Homo sapiens
ctctgcacatgtc

SEQ ID NO: 2210385 - DNA, 22 bp, Homo sapiens
ctctttatatggcctcaagatc

SEQ ID NO: 2210386 - DNA, 15 bp, Homo sapiens
ctgagccttgtaatt

SEQ ID NO: 2210387 - DNA, 16 bp, Homo sapiens
ctgagccttgtaattc

SEQ ID NO: 2210388 - DNA, 21 bp, Homo sapiens
ctgagccttgtaattctaaat

SEQ ID NO: 2210389 - DNA, 18 bp, Homo sapiens
ctgatcaggacctccaag

SEQ ID NO: 2210390 - DNA, 15 bp, Homo sapiens
ctgcacaagccaggg

SEQ ID NO: 2210391 - DNA, 15 bp, Homo sapiens
ctgcagggacacggg

SEQ ID NO: 2210392 - DNA, 19 bp, Homo sapiens
ctgcagtttgagacaggag

SEQ ID NO: 2210393 - DNA, 17 bp, Homo sapiens
ctgccaccctgggcctg

SEQ ID NO: 2210394 - DNA, 20 bp, Homo sapiens
ctgccactgactgcagggac

SEQ ID NO: 2210395 - DNA, 21 bp, Homo sapiens
ctgccactgactgcagggaca

SEQ ID NO: 2210396 - DNA, 17 bp, Homo sapiens
ctgccgcaacagttttt

SEQ ID NO: 2210397 - DNA, 21 bp, Homo sapiens
ctgcctcccgcccccttggct

SEQ ID NO: 2210398 - DNA, 14 bp, Homo sapiens
ctgctgctgctgtg

SEQ ID NO: 2210399 - DNA, 14 bp, Homo sapiens
ctggaatgtaatca

SEQ ID NO: 2210400 - DNA, 14 bp, Homo sapiens
ctggactgacctgg

SEQ ID NO: 2210401 - DNA, 13 bp, Homo sapiens
ctggcagctcagc

SEQ ID NO: 2210402 - DNA, 17 bp, Homo sapiens
ctggcatgatccaagca

SEQ ID NO: 2210403 - DNA, 20 bp, Homo sapiens
ctggccacgcagccaggaca

SEQ ID NO: 2210404 - DNA, 21 bp, Homo sapiens
ctggccacgcagccaggacac

SEQ ID NO: 2210405 - DNA, 17 bp, Homo sapiens
ctggcctggcacacatc

SEQ ID NO: 2210406 - DNA, 18 bp, Homo sapiens
ctggcctggcacacatca

SEQ ID NO: 2210407 - DNA, 22 bp, Homo sapiens
ctggcctggcacacatcaggag

SEQ ID NO: 2210408 - DNA, 14 bp, Homo sapiens
ctggctcccaggac

SEQ ID NO: 2210409 - DNA, 21 bp, Homo sapiens
ctgggcaccctcccacccggc

SEQ ID NO: 2210410 - DNA, 17 bp, Homo sapiens
ctgggcccacaaaggca

SEQ ID NO: 2210411 - DNA, 18 bp, Homo sapiens
ctgggcctggcagctcag

SEQ ID NO: 2210412 - DNA, 17 bp, Homo sapiens
ctgtacacgtgtcctgt

SEQ ID NO: 2210413 - DNA, 14 bp, Homo sapiens
ctgtgatgccctgc

SEQ ID NO: 2210414 - DNA, 15 bp, Homo sapiens
ctgtgcatgtatgtc

SEQ ID NO: 2210415 - DNA, 17 bp, Homo sapiens
cttaatcttttcacaaa

SEQ ID NO: 2210416 - DNA, 19 bp, Homo sapiens
cttaatcttttcacaaata

SEQ ID NO: 2210417 - DNA, 19 bp, Homo sapiens
cttacctgggcattcttgt

SEQ ID NO: 2210418 - DNA, 14 bp, Homo sapiens
cttataatttaaaa

SEQ ID NO: 2210419 - DNA, 20 bp, Homo sapiens
cttcagtaacccccactgga

SEQ ID NO: 2210420 - DNA, 20 bp, Homo sapiens
cttctcacatttatattttt

SEQ ID NO: 2210421 - DNA, 22 bp, Homo sapiens
cttctccctgcacaagccaggg

SEQ ID NO: 2210422 - DNA, 23 bp, Homo sapiens
cttcttaatcttttcacaaataa

SEQ ID NO: 2210423 - DNA, 19 bp, Homo sapiens
cttgagtttaaattgtaat

SEQ ID NO: 2210424 - DNA, 19 bp, Homo sapiens
cttgtaaaggaatttaaaa

SEQ ID NO: 2210425 - DNA, 13 bp, Homo sapiens
cttgtaattctaa

SEQ ID NO: 2210426 - DNA, 14 bp, Homo sapiens
cttgtacatgtgta

SEQ ID NO: 2210427 - DNA, 19 bp, Homo sapiens
cttgtacatgtgtagcctg

SEQ ID NO: 2210428 - DNA, 16 bp, Homo sapiens
cttgtgactagtgctg

SEQ ID NO: 2210429 - DNA, 18 bp, Homo sapiens
cttgtgactagtgctgaa

SEQ ID NO: 2210430 - DNA, 20 bp, Homo sapiens
cttgtgactagtgctgaagc

SEQ ID NO: 2210431 - DNA, 11 bp, Homo sapiens
cttgtgccata

SEQ ID NO: 2210432 - DNA, 19 bp, Homo sapiens
cttgtgccatagtcacatg

SEQ ID NO: 2210433 - DNA, 17 bp, Homo sapiens
ctttcagcagactgatc

SEQ ID NO: 2210434 - DNA, 17 bp, Homo sapiens
ctttcatttactgtggc

SEQ ID NO: 2210435 - DNA, 20 bp, Homo sapiens
ctttctgaagcctcacttat

SEQ ID NO: 2210436 - DNA, 12 bp, Homo sapiens
cttttcacaaat

SEQ ID NO: 2210437 - DNA, 18 bp, Homo sapiens
gaaaatcttataatttaa

SEQ ID NO: 2210438 - DNA, 19 bp, Homo sapiens
gaaaatcttataatttaaa

SEQ ID NO: 2210439 - DNA, 20 bp, Homo sapiens
gaaaatcttataatttaaaa

SEQ ID NO: 2210440 - DNA, 15 bp, Homo sapiens
gaaaatggaaccagg

SEQ ID NO: 2210441 - DNA, 18 bp, Homo sapiens
gaaaatggaaccaggctt

SEQ ID NO: 2210442 - DNA, 20 bp, Homo sapiens
gaaagtcttgtgactagtgc

SEQ ID NO: 2210443 - DNA, 22 bp, Homo sapiens
gaaagtcttgtgactagtgctg

SEQ ID NO: 2210444 - DNA, 11 bp, Homo sapiens
gaaagtttccc

SEQ ID NO: 2210445 - DNA, 16 bp, Homo sapiens
gaaattgtattacaaa

SEQ ID NO: 2210446 - DNA, 18 bp, Homo sapiens
gaaattgtattacaaatc

SEQ ID NO: 2210447 - DNA, 16 bp, Homo sapiens
gaacaccctatatttt

SEQ ID NO: 2210448 - DNA, 15 bp, Homo sapiens
gaaccgtaggaccca

SEQ ID NO: 2210449 - DNA, 23 bp, Homo sapiens
gaagaaaatggaaccaggcttgg

SEQ ID NO: 2210450 - DNA, 22 bp, Homo sapiens
gaagaacatctttatggtaaag

SEQ ID NO: 2210451 - DNA, 14 bp, Homo sapiens
gaagcttattaatg

SEQ ID NO: 2210452 - DNA, 21 bp, Homo sapiens
gaagcttattaatgctaaggg

SEQ ID NO: 2210453 - DNA, 18 bp, Homo sapiens
gaaggagacaggcagagc

SEQ ID NO: 2210454 - DNA, 15 bp, Homo sapiens
gaaggcaaagcacga

SEQ ID NO: 2210455 - DNA, 14 bp, Homo sapiens
acctggacacaggc

SEQ ID NO: 2210456 - DNA, 16 bp, Homo sapiens
acctggtccacagggc

SEQ ID NO: 2210457 - DNA, 12 bp, Homo sapiens
accttgtgtctg

SEQ ID NO: 2210458 - DNA, 14 bp, Homo sapiens
acgacacactttga

SEQ ID NO: 2210459 - DNA, 15 bp, Homo sapiens
acgccacagcccagc

SEQ ID NO: 2210460 - DNA, 20 bp, Homo sapiens
acgccacagcccagccacgg

SEQ ID NO: 2210461 - DNA, 17 bp, Homo sapiens
acgggcagcctggctcc

SEQ ID NO: 2210462 - DNA, 16 bp, Homo sapiens
acgtgggcaaacaggc

SEQ ID NO: 2210463 - DNA, 15 bp, Homo sapiens
actagtgctgaagct

SEQ ID NO: 2210464 - DNA, 21 bp, Homo sapiens
actcaatgttactatctgctt

SEQ ID NO: 2210465 - DNA, 17 bp, Homo sapiens
actcagaagggagctag

SEQ ID NO: 2210466 - DNA, 19 bp, Homo sapiens
actctagaaaacgcgacct

SEQ ID NO: 2210467 - DNA, 16 bp, Homo sapiens
actctgcattctagta

SEQ ID NO: 2210468 - DNA, 22 bp, Homo sapiens
actgacctggtccacagggcac

SEQ ID NO: 2210469 - DNA, 22 bp, Homo sapiens
actgcagggacacgggcagcct

SEQ ID NO: 2210470 - DNA, 17 bp, Homo sapiens
actgtcttctccctgca

SEQ ID NO: 2210471 - DNA, 21 bp, Homo sapiens
actgtgagctcccaggtgcag

SEQ ID NO: 2210472 - DNA, 22 bp, Homo sapiens
actgtttgccttctacttttaa

SEQ ID NO: 2210473 - DNA, 16 bp, Homo sapiens
acttattctcaagaag

SEQ ID NO: 2210474 - DNA, 15 bp, Homo sapiens
acttctttcagcaga

SEQ ID NO: 2210475 - DNA, 18 bp, Homo sapiens
acttgtaaaggaatttaa

SEQ ID NO: 2210476 - DNA, 19 bp, Homo sapiens
acttgtaaaggaatttaaa

SEQ ID NO: 2210477 - DNA, 20 bp, Homo sapiens
acttgtaaaggaatttaaaa

SEQ ID NO: 2210478 - DNA, 23 bp, Homo sapiens
actttatctaatacctctgtgtg

SEQ ID NO: 2210479 - DNA, 22 bp, Homo sapiens
actttattttctataatttaaa

SEQ ID NO: 2210480 - DNA, 18 bp, Homo sapiens
actttcctcttcctgcct

SEQ ID NO: 2210481 - DNA, 22 bp, Homo sapiens
agaaaatggaaccaggcttgga

SEQ ID NO: 2210482 - DNA, 13 bp, Homo sapiens
agaaacaggaccg

SEQ ID NO: 2210483 - DNA, 20 bp, Homo sapiens
agaaagtttccccaccagtg

SEQ ID NO: 2210484 - DNA, 21 bp, Homo sapiens
agaaatatgcacaatagcagt

SEQ ID NO: 2210485 - DNA, 19 bp, Homo sapiens
agaagctctcgggctagga

SEQ ID NO: 2210486 - DNA, 18 bp, Homo sapiens
agaagggagctagccaga

SEQ ID NO: 2210487 - DNA, 14 bp, Homo sapiens
agacctcagggcac

SEQ ID NO: 2210488 - DNA, 15 bp, Homo sapiens
agacctcagggcaca

SEQ ID NO: 2210489 - DNA, 16 bp, Homo sapiens
agacctggacacaggc

SEQ ID NO: 2210490 - DNA, 18 bp, Homo sapiens
agacctggacacaggcct

SEQ ID NO: 2210491 - DNA, 19 bp, Homo sapiens
agacctggacacaggcctg

SEQ ID NO: 2210492 - DNA, 16 bp, Homo sapiens
agactgatcaggacct

SEQ ID NO: 2210493 - DNA, 17 bp, Homo sapiens
agactgatcaggacctc

SEQ ID NO: 2210494 - DNA, 20 bp, Homo sapiens
agatagataggtcagtgcaa

SEQ ID NO: 2210495 - DNA, 17 bp, Homo sapiens
agatgggtgaaggctgg

SEQ ID NO: 2210496 - DNA, 17 bp, Homo sapiens
agcacgaaatgttattt

SEQ ID NO: 2210497 - DNA, 15 bp, Homo sapiens
agcagccagccgtga

SEQ ID NO: 2210498 - DNA, 17 bp, Homo sapiens
agcataagtttctggga

SEQ ID NO: 2210499 - DNA, 23 bp, Homo sapiens
agcataagtttctgggacctcag

SEQ ID NO: 2210500 - DNA, 21 bp, Homo sapiens
agcatctttgaatacaaagaa

SEQ ID NO: 2210501 - DNA, 21 bp, Homo sapiens
agcatgtactgagccttgtaa

SEQ ID NO: 2210502 - DNA, 19 bp, Homo sapiens
agccacggacgctggctcc

SEQ ID NO: 2210503 - DNA, 14 bp, Homo sapiens
agccagaggactgt

SEQ ID NO: 2210504 - DNA, 22 bp, Homo sapiens
agccaggacaccgggcagggcc

SEQ ID NO: 2210505 - DNA, 11 bp, Homo sapiens
agcccagccac

SEQ ID NO: 2210506 - DNA, 15 bp, Homo sapiens
agcccagccacggac

SEQ ID NO: 2210507 - DNA, 14 bp, Homo sapiens
agccgtcacccctg

SEQ ID NO: 2210508 - DNA, 14 bp, Homo sapiens
agccttaccacgca

SEQ ID NO: 2210509 - DNA, 16 bp, Homo sapiens
agccttgtaattctaa

SEQ ID NO: 2210510 - DNA, 15 bp, Homo sapiens
agctaataaaatatc

SEQ ID NO: 2210511 - DNA, 16 bp, Homo sapiens
agctaataaaatatca

SEQ ID NO: 2210512 - DNA, 20 bp, Homo sapiens
agctaataaaatatcattca

SEQ ID NO: 2210513 - DNA, 13 bp, Homo sapiens
agctacaaatgca

SEQ ID NO: 2210514 - DNA, 19 bp, Homo sapiens
agctatggtgtcataggct

SEQ ID NO: 2210515 - DNA, 22 bp, Homo sapiens
agctcccaggtgcagccagagg

SEQ ID NO: 2210516 - DNA, 21 bp, Homo sapiens
agctccccgcttctgcctgca

SEQ ID NO: 2210517 - DNA, 19 bp, Homo sapiens
agctgcctctgccactgac

SEQ ID NO: 2210518 - DNA, 21 bp, Homo sapiens
agcttattaatgctaagggca

SEQ ID NO: 2210519 - DNA, 22 bp, Homo sapiens
agcttattaatgctaagggcag

SEQ ID NO: 2210520 - DNA, 12 bp, Homo sapiens
aggacccaagca

SEQ ID NO: 2210521 - DNA, 15 bp, Homo sapiens
aggacgtgggctggg

SEQ ID NO: 2210522 - DNA, 19 bp, Homo sapiens
aggacgtgggctgggccca

SEQ ID NO: 2210523 - DNA, 17 bp, Homo sapiens
aggagctgggagccggg

SEQ ID NO: 2210524 - DNA, 11 bp, Homo sapiens
aggagcttcct

SEQ ID NO: 2210525 - DNA, 16 bp, Homo sapiens
aggagtgtggccacgt

SEQ ID NO: 2210526 - DNA, 19 bp, Homo sapiens
aggatttcatgatttcatt

SEQ ID NO: 2210527 - DNA, 16 bp, Homo sapiens
aggcaaagggtccaga

SEQ ID NO: 2210528 - DNA, 12 bp, Homo sapiens
aggcacctcaag

SEQ ID NO: 2210529 - DNA, 18 bp, Homo sapiens
aggcacctcaagaagaag

SEQ ID NO: 2210530 - DNA, 14 bp, Homo sapiens
aggccagtgagcca

SEQ ID NO: 2210531 - DNA, 20 bp, Homo sapiens
agggacacgggcagcctggc

SEQ ID NO: 2210532 - DNA, 23 bp, Homo sapiens
agggacacgggcagcctggctcc

SEQ ID NO: 2210533 - DNA, 22 bp, Homo sapiens
agggacgcggctcccggggcag

SEQ ID NO: 2210534 - DNA, 16 bp, Homo sapiens
agggagacctggacac

SEQ ID NO: 2210535 - DNA, 15 bp, Homo sapiens
agggagctagccaga

SEQ ID NO: 2210536 - DNA, 20 bp, Homo sapiens
agggccgccagggagacctg

SEQ ID NO: 2210537 - DNA, 19 bp, Homo sapiens
agggccgcccgggcccaga

SEQ ID NO: 2210538 - DNA, 19 bp, Homo sapiens
aggggtcgacttcgggctg

SEQ ID NO: 2210539 - DNA, 21 bp, Homo sapiens
aggggtcgacttcgggctggc

SEQ ID NO: 2210540 - DNA, 15 bp, Homo sapiens
agggtcagaaacagg

SEQ ID NO: 2210541 - DNA, 20 bp, Homo sapiens
aggtaaaagcatcacatgaa

SEQ ID NO: 2210542 - DNA, 21 bp, Homo sapiens
aggtacccctttctggctctc

SEQ ID NO: 2210543 - DNA, 17 bp, Homo sapiens
aggtgcagccagaggca

SEQ ID NO: 2210544 - DNA, 15 bp, Homo sapiens
agtaccaatcatttt

SEQ ID NO: 2210545 - DNA, 23 bp, Homo sapiens
agtacttgggagacctgtaatca

SEQ ID NO: 2210546 - DNA, 21 bp, Homo sapiens
agtcacagaacaaatgtttgt

SEQ ID NO: 2210547 - DNA, 24 bp, Homo sapiens
agtcactgtgagctcccaggtgca

SEQ ID NO: 2210548 - DNA, 15 bp, Homo sapiens
agtctgtccaggctc

SEQ ID NO: 2210549 - DNA, 20 bp, Homo sapiens
agtcttgtgactagtgctga

SEQ ID NO: 2210550 - DNA, 21 bp, Homo sapiens
agtcttgtgactagtgctgaa

SEQ ID NO: 2210551 - DNA, 17 bp, Homo sapiens
agtgaaagaaaataaca

SEQ ID NO: 2210552 - DNA, 13 bp, Homo sapiens
taattattattta

SEQ ID NO: 2210553 - DNA, 19 bp, Homo sapiens
tacaaagaaccaagaaaaa

SEQ ID NO: 2210554 - DNA, 15 bp, Homo sapiens
tacacacatccacgc

SEQ ID NO: 2210555 - DNA, 17 bp, Homo sapiens
tacacgtgtcctgtagt

SEQ ID NO: 2210556 - DNA, 16 bp, Homo sapiens
tacactctttgtaaga

SEQ ID NO: 2210557 - DNA, 22 bp, Homo sapiens
tacactgtgacttaagaagcct

SEQ ID NO: 2210558 - DNA, 15 bp, Homo sapiens
tacccgggcagggct

SEQ ID NO: 2210559 - DNA, 23 bp, Homo sapiens
tacttgggagacctgtaatcata

SEQ ID NO: 2210560 - DNA, 22 bp, Homo sapiens
tagataggtcagtgcaaatact

SEQ ID NO: 2210561 - DNA, 16 bp, Homo sapiens
tagctactaattttaa

SEQ ID NO: 2210562 - DNA, 14 bp, Homo sapiens
taggacccaagcag

SEQ ID NO: 2210563 - DNA, 16 bp, Homo sapiens
taggacccaagcagag

SEQ ID NO: 2210564 - DNA, 23 bp, Homo sapiens
tagtcacatggcctatgcacata

SEQ ID NO: 2210565 - DNA, 12 bp, Homo sapiens
tagtgctgaagc

SEQ ID NO: 2210566 - DNA, 15 bp, Homo sapiens
tataaatatatttaa

SEQ ID NO: 2210567 - DNA, 17 bp, Homo sapiens
tatatggcctcaagatc

SEQ ID NO: 2210568 - DNA, 13 bp, Homo sapiens
tatcaagctaata

SEQ ID NO: 2210569 - DNA, 18 bp, Homo sapiens
tatgcaccttgtgtctgt

SEQ ID NO: 2210570 - DNA, 22 bp, Homo sapiens
tatgcaccttgtgtctgtacac

SEQ ID NO: 2210571 - DNA, 13 bp, Homo sapiens
tatgctaatcagg

SEQ ID NO: 2210572 - DNA, 16 bp, Homo sapiens
tatggactctgcacat

SEQ ID NO: 2210573 - DNA, 16 bp, Homo sapiens
tatgggaatcaagatt

SEQ ID NO: 2210574 - DNA, 12 bp, Homo sapiens
tattaaagacag

SEQ ID NO: 2210575 - DNA, 12 bp, Homo sapiens
tattaatgctaa

SEQ ID NO: 2210576 - DNA, 13 bp, Homo sapiens
tattaatgctaag

SEQ ID NO: 2210577 - DNA, 14 bp, Homo sapiens
tattcttcataaca

SEQ ID NO: 2210578 - DNA, 17 bp, Homo sapiens
tatttataaatatattt

SEQ ID NO: 2210579 - DNA, 12 bp, Homo sapiens
tattttttaatt

SEQ ID NO: 2210580 - DNA, 15 bp, Homo sapiens
tattttttaattatt

SEQ ID NO: 2210581 - DNA, 19 bp, Homo sapiens
tcaagctaataaaatatca

SEQ ID NO: 2210582 - DNA, 16 bp, Homo sapiens
tcaataaatgtctgtt

SEQ ID NO: 2210583 - DNA, 18 bp, Homo sapiens
tcaatgtttcttctaggt

SEQ ID NO: 2210584 - DNA, 15 bp, Homo sapiens
tcaattcttgccaaa

SEQ ID NO: 2210585 - DNA, 11 bp, Homo sapiens
tcacaaataaa

SEQ ID NO: 2210586 - DNA, 16 bp, Homo sapiens
tcacatggcctatgca

SEQ ID NO: 2210587 - DNA, 19 bp, Homo sapiens
tcacattactgtatatact

SEQ ID NO: 2210588 - DNA, 15 bp, Homo sapiens
tcacttcaccctgga

SEQ ID NO: 2210589 - DNA, 21 bp, Homo sapiens
tcagaagggagctagccagag

SEQ ID NO: 2210590 - DNA, 23 bp, Homo sapiens
tcagaagggagctagccagagga

SEQ ID NO: 2210591 - DNA, 15 bp, Homo sapiens
tcagaccataatgtt

SEQ ID NO: 2210592 - DNA, 13 bp, Homo sapiens
tcagcagactgat

SEQ ID NO: 2210593 - DNA, 20 bp, Homo sapiens
tcaggacctccaagccactg

SEQ ID NO: 2210594 - DNA, 16 bp, Homo sapiens
tcataataagttgcat

SEQ ID NO: 2210595 - DNA, 13 bp, Homo sapiens
tcattcaataaat

SEQ ID NO: 2210596 - DNA, 13 bp, Homo sapiens
tcattttaattat

SEQ ID NO: 2210597 - DNA, 14 bp, Homo sapiens
tcattttaattatt

SEQ ID NO: 2210598 - DNA, 20 bp, Homo sapiens
tccatgggccatatgaaaag

SEQ ID NO: 2210599 - DNA, 22 bp, Homo sapiens
tcccacccacatgtgacacata

SEQ ID NO: 2210600 - DNA, 14 bp, Homo sapiens
tccccaaagggtgt

SEQ ID NO: 2210601 - DNA, 21 bp, Homo sapiens
tccccaccagtgaatgaaagt

SEQ ID NO: 2210602 - DNA, 18 bp, Homo sapiens
tccccgcttctgcctgca

SEQ ID NO: 2210603 - DNA, 21 bp, Homo sapiens
tcccggggcagggcagccgtc

SEQ ID NO: 2210604 - DNA, 15 bp, Homo sapiens
tccctgcacaagcca

SEQ ID NO: 2210605 - DNA, 16 bp, Homo sapiens
tccctgcacaagccag

SEQ ID NO: 2210606 - DNA, 19 bp, Homo sapiens
tcctcagatcatccagaag

SEQ ID NO: 2210607 - DNA, 19 bp, Homo sapiens
tcctccttggtgcctggcc

SEQ ID NO: 2210608 - DNA, 21 bp, Homo sapiens
tcctgtagttgcgtggactct

SEQ ID NO: 2210609 - DNA, 22 bp, Homo sapiens
tcctgtagttgcgtggactctg

SEQ ID NO: 2210610 - DNA, 23 bp, Homo sapiens
tcctgtagttgcgtggactctgc

SEQ ID NO: 2210611 - DNA, 15 bp, Homo sapiens
tccttccagcccaga

SEQ ID NO: 2210612 - DNA, 17 bp, Homo sapiens
tcgacttcgggctggcc

SEQ ID NO: 2210613 - DNA, 22 bp, Homo sapiens
tctagtacttgggagacctgta

SEQ ID NO: 2210614 - DNA, 21 bp, Homo sapiens
tctattgataatttagacatt

SEQ ID NO: 2210615 - DNA, 18 bp, Homo sapiens
tctccagggtcagaaaca

SEQ ID NO: 2210616 - DNA, 21 bp, Homo sapiens
tctccagggtcagaaacagga

SEQ ID NO: 2210617 - DNA, 19 bp, Homo sapiens
tctctttttttggcccagg

SEQ ID NO: 2210618 - DNA, 12 bp, Homo sapiens
tctgcacatgtc

SEQ ID NO: 2210619 - DNA, 16 bp, Homo sapiens
tctgcacatgtcttgt

SEQ ID NO: 2210620 - DNA, 20 bp, Homo sapiens
tctgcacatgtcttgtacat

SEQ ID NO: 2210621 - DNA, 13 bp, Homo sapiens
tctgggacctcag

SEQ ID NO: 2210622 - DNA, 13 bp, Homo sapiens
tctgtacacgtgt

SEQ ID NO: 2210623 - DNA, 18 bp, Homo sapiens
tcttaatcttttcacaaa

SEQ ID NO: 2210624 - DNA, 22 bp, Homo sapiens
tcttaatcttttcacaaataaa

SEQ ID NO: 2210625 - DNA, 21 bp, Homo sapiens
tcttctttttgaaatcagcat

SEQ ID NO: 2210626 - DNA, 19 bp, Homo sapiens
tcttgccaaatataaataa

SEQ ID NO: 2210627 - DNA, 14 bp, Homo sapiens
tcttgtgactagtg

SEQ ID NO: 2210628 - DNA, 19 bp, Homo sapiens
tcttgtgactagtgctgaa

SEQ ID NO: 2210629 - DNA, 21 bp, Homo sapiens
tcttgtgactagtgctgaagc

SEQ ID NO: 2210630 - DNA, 23 bp, Homo sapiens
tcttgtgactagtgctgaagctt

SEQ ID NO: 2210631 - DNA, 19 bp, Homo sapiens
tctttcaataaactaaaga

SEQ ID NO: 2210632 - DNA, 20 bp, Homo sapiens
tctttcaataaactaaagaa

SEQ ID NO: 2210633 - DNA, 14 bp, Homo sapiens
tcttttcacaaata

SEQ ID NO: 2210634 - DNA, 15 bp, Homo sapiens
tcttttcacaaataa

SEQ ID NO: 2210635 - DNA, 16 bp, Homo sapiens
tcttttcacaaataaa

SEQ ID NO: 2210636 - DNA, 19 bp, Homo sapiens
tcttttctggaatgtaatc

SEQ ID NO: 2210637 - DNA, 20 bp, Homo sapiens
tgaaaatcttataatttaaa

SEQ ID NO: 2210638 - DNA, 22 bp, Homo sapiens
tgaaagtcttgtgactagtgct

SEQ ID NO: 2210639 - DNA, 23 bp, Homo sapiens
tgaacaagcaaacccagacggct

SEQ ID NO: 2210640 - DNA, 17 bp, Homo sapiens
tgaactcaactttgaca

SEQ ID NO: 2210641 - DNA, 14 bp, Homo sapiens
tgaactcttaatca

SEQ ID NO: 2210642 - DNA, 22 bp, Homo sapiens
tgaagaagctaaatcctttact

SEQ ID NO: 2210643 - DNA, 17 bp, Homo sapiens
tgaagcttattaatgct

SEQ ID NO: 2210644 - DNA, 19 bp, Homo sapiens
tgaagcttattaatgctaa

SEQ ID NO: 2210645 - DNA, 22 bp, Homo sapiens
tgaagcttattaatgctaaggg

SEQ ID NO: 2210646 - DNA, 20 bp, Homo sapiens
tgaaggctggcatgatccaa

SEQ ID NO: 2210647 - DNA, 22 bp, Homo sapiens
gcaggcccaaattatcaagcta

SEQ ID NO: 2210648 - DNA, 19 bp, Homo sapiens
gcagggacacgggcagcct

SEQ ID NO: 2210649 - DNA, 15 bp, Homo sapiens
gcagggccgccaggg

SEQ ID NO: 2210650 - DNA, 17 bp, Homo sapiens
gcagggctcccacagag

SEQ ID NO: 2210651 - DNA, 14 bp, Homo sapiens
gcagttggccagag

SEQ ID NO: 2210652 - DNA, 13 bp, Homo sapiens
gcatagaagtaaa

SEQ ID NO: 2210653 - DNA, 20 bp, Homo sapiens
gcatagtaccaatcatttta

SEQ ID NO: 2210654 - DNA, 20 bp, Homo sapiens
gcatctagcatgtcgtcaaa

SEQ ID NO: 2210655 - DNA, 23 bp, Homo sapiens
gcatgatccaagcaagactgagg

SEQ ID NO: 2210656 - DNA, 15 bp, Homo sapiens
gcatgtatgtcttgg

SEQ ID NO: 2210657 - DNA, 13 bp, Homo sapiens
gcattctagtact

SEQ ID NO: 2210658 - DNA, 15 bp, Homo sapiens
gcattttttaaaaca

SEQ ID NO: 2210659 - DNA, 19 bp, Homo sapiens
gccacagcccagccacgga

SEQ ID NO: 2210660 - DNA, 16 bp, Homo sapiens
gccacgcagccaggac

SEQ ID NO: 2210661 - DNA, 18 bp, Homo sapiens
gccacggacgctggctcc

SEQ ID NO: 2210662 - DNA, 14 bp, Homo sapiens
gccagcgtggcgca

SEQ ID NO: 2210663 - DNA, 18 bp, Homo sapiens
gccagggagacctggaca

SEQ ID NO: 2210664 - DNA, 21 bp, Homo sapiens
gcccaaattatcaagctaata

SEQ ID NO: 2210665 - DNA, 13 bp, Homo sapiens
gcccgggcccaga

SEQ ID NO: 2210666 - DNA, 15 bp, Homo sapiens
gccgcccgggcccag

SEQ ID NO: 2210667 - DNA, 15 bp, Homo sapiens
gccgggccgcagact

SEQ ID NO: 2210668 - DNA, 18 bp, Homo sapiens
gccgtgtgttgcatgcag

SEQ ID NO: 2210669 - DNA, 23 bp, Homo sapiens
gcctatgcacatatggactctgc

SEQ ID NO: 2210670 - DNA, 13 bp, Homo sapiens
gcctccgagggac

SEQ ID NO: 2210671 - DNA, 16 bp, Homo sapiens
gcctggcacacatcag

SEQ ID NO: 2210672 - DNA, 13 bp, Homo sapiens
gcctggcagctca

SEQ ID NO: 2210673 - DNA, 20 bp, Homo sapiens
gcctggcagctcagcttccc

SEQ ID NO: 2210674 - DNA, 17 bp, Homo sapiens
gcctggccacgcagcca

SEQ ID NO: 2210675 - DNA, 18 bp, Homo sapiens
gcctggccacgcagccag

SEQ ID NO: 2210676 - DNA, 19 bp, Homo sapiens
gcctggccacgcagccagg

SEQ ID NO: 2210677 - DNA, 17 bp, Homo sapiens
gcgtggactctgcacat

SEQ ID NO: 2210678 - DNA, 18 bp, Homo sapiens
gcgtggactctgcacatg

SEQ ID NO: 2210679 - DNA, 22 bp, Homo sapiens
gcgtggtgtggagtgtgtgtct

SEQ ID NO: 2210680 - DNA, 14 bp, Homo sapiens
gctaataaaatatc

SEQ ID NO: 2210681 - DNA, 17 bp, Homo sapiens
gctaataaaatatcatt

SEQ ID NO: 2210682 - DNA, 14 bp, Homo sapiens
gctcccaggtgcag

SEQ ID NO: 2210683 - DNA, 19 bp, Homo sapiens
gctcccaggtgcagccaga

SEQ ID NO: 2210684 - DNA, 17 bp, Homo sapiens
gctcccggggcagggca

SEQ ID NO: 2210685 - DNA, 17 bp, Homo sapiens
gctcctgagggagctcc

SEQ ID NO: 2210686 - DNA, 22 bp, Homo sapiens
gctgaagcttattaatgctaag

SEQ ID NO: 2210687 - DNA, 19 bp, Homo sapiens
gcttattaatgctaagggc

SEQ ID NO: 2210688 - DNA, 13 bp, Homo sapiens
gcttctgcctgca

SEQ ID NO: 2210689 - DNA, 21 bp, Homo sapiens
gcttcttaatcttttcacaaa

SEQ ID NO: 2210690 - DNA, 22 bp, Homo sapiens
gcttcttaatcttttcacaaat

SEQ ID NO: 2210691 - DNA, 23 bp, Homo sapiens
gcttcttaatcttttcacaaata

SEQ ID NO: 2210692 - DNA, 18 bp, Homo sapiens
ggaaacgaaacccactct

SEQ ID NO: 2210693 - DNA, 14 bp, Homo sapiens
ggaaccaggcttgg

SEQ ID NO: 2210694 - DNA, 21 bp, Homo sapiens
ggaaccgtaggacccaagcag

SEQ ID NO: 2210695 - DNA, 21 bp, Homo sapiens
ggacacgggcagcctggctcc

SEQ ID NO: 2210696 - DNA, 13 bp, Homo sapiens
ggactctgcacat

SEQ ID NO: 2210697 - DNA, 15 bp, Homo sapiens
ggactctgcacatga

SEQ ID NO: 2210698 - DNA, 14 bp, Homo sapiens
ggagcacacccagc

SEQ ID NO: 2210699 - DNA, 15 bp, Homo sapiens
ggagctagccagagg

SEQ ID NO: 2210700 - DNA, 16 bp, Homo sapiens
ggaggccagtgagcca

SEQ ID NO: 2210701 - DNA, 13 bp, Homo sapiens
ggcaaacaggcag

SEQ ID NO: 2210702 - DNA, 22 bp, Homo sapiens
ggcacccaagacctcagggcac

SEQ ID NO: 2210703 - DNA, 19 bp, Homo sapiens
ggcagcctggctcccagga

SEQ ID NO: 2210704 - DNA, 20 bp, Homo sapiens
ggcagcctggctcccaggac

SEQ ID NO: 2210705 - DNA, 22 bp, Homo sapiens
ggcagcctggctcccaggacac

SEQ ID NO: 2210706 - DNA, 16 bp, Homo sapiens
ggcatgatccaagcaa

SEQ ID NO: 2210707 - DNA, 19 bp, Homo sapiens
ggccacgcagccaggacac

SEQ ID NO: 2210708 - DNA, 23 bp, Homo sapiens
ggccacgtgggcaaacaggcagt

SEQ ID NO: 2210709 - DNA, 22 bp, Homo sapiens
ggccagagagcctggtgctgct

SEQ ID NO: 2210710 - DNA, 20 bp, Homo sapiens
ggcctatgcacatatggact

SEQ ID NO: 2210711 - DNA, 16 bp, Homo sapiens
ggcctggcagctcagc

SEQ ID NO: 2210712 - DNA, 15 bp, Homo sapiens
ggctcccacagagac

SEQ ID NO: 2210713 - DNA, 19 bp, Homo sapiens
ggctcccggggcagggcag

SEQ ID NO: 2210714 - DNA, 21 bp, Homo sapiens
ggctgcatacccgggcagggc

SEQ ID NO: 2210715 - DNA, 22 bp, Homo sapiens
ggctggcatgatccaagcaaga

SEQ ID NO: 2210716 - DNA, 12 bp, Homo sapiens
gggaatcaagat

SEQ ID NO: 2210717 - DNA, 14 bp, Homo sapiens
gggacacgggcagc

SEQ ID NO: 2210718 - DNA, 19 bp, Homo sapiens
gggagatggagttcttgtg

SEQ ID NO: 2210719 - DNA, 17 bp, Homo sapiens
gggaggccagtgagcca

SEQ ID NO: 2210720 - DNA, 14 bp, Homo sapiens
gggaggtcattttg

SEQ ID NO: 2210721 - DNA, 15 bp, Homo sapiens
gggcaaacaggcagt

SEQ ID NO: 2210722 - DNA, 23 bp, Homo sapiens
gggcacaggtgtctgccccctct

SEQ ID NO: 2210723 - DNA, 15 bp, Homo sapiens
gggcagcctggctcc

SEQ ID NO: 2210724 - DNA, 23 bp, Homo sapiens
gggcagcctggctcccaggacac

SEQ ID NO: 2210725 - DNA, 16 bp, Homo sapiens
gggcctggcagctcag

SEQ ID NO: 2210726 - DNA, 16 bp, Homo sapiens
gggtcagaaacaggac

SEQ ID NO: 2210727 - DNA, 19 bp, Homo sapiens
ggtacccctttctggctct

SEQ ID NO: 2210728 - DNA, 15 bp, Homo sapiens
ggtccacagggcacc

SEQ ID NO: 2210729 - DNA, 13 bp, Homo sapiens
ggtgaaggctggc

SEQ ID NO: 2210730 - DNA, 21 bp, Homo sapiens
aataaaatatcattcagcaac

SEQ ID NO: 2210731 - DNA, 21 bp, Homo sapiens
aatacaaagaaccaagaaaaa

SEQ ID NO: 2210732 - DNA, 16 bp, Homo sapiens
aatacctctgtgtgct

SEQ ID NO: 2210733 - DNA, 18 bp, Homo sapiens
aataggcgtaactaattt

SEQ ID NO: 2210734 - DNA, 19 bp, Homo sapiens
aatatatttaagataatta

SEQ ID NO: 2210735 - DNA, 14 bp, Homo sapiens
aatatcattcagca

SEQ ID NO: 2210736 - DNA, 18 bp, Homo sapiens
aatcagggaggtcatttt

SEQ ID NO: 2210737 - DNA, 19 bp, Homo sapiens
aatcattttaattattatt

SEQ ID NO: 2210738 - DNA, 20 bp, Homo sapiens
aatcctcagtttttgtgaaa

SEQ ID NO: 2210739 - DNA, 19 bp, Homo sapiens
aatcttataatttaaaata

SEQ ID NO: 2210740 - DNA, 15 bp, Homo sapiens
aatcttttcacaaat

SEQ ID NO: 2210741 - DNA, 18 bp, Homo sapiens
aatcttttcacaaataaa

SEQ ID NO: 2210742 - DNA, 14 bp, Homo sapiens
aatggaaccaggct

SEQ ID NO: 2210743 - DNA, 17 bp, Homo sapiens
aatggaaccaggcttgg

SEQ ID NO: 2210744 - DNA, 19 bp, Homo sapiens
aatgtaatcaatgtttctt

SEQ ID NO: 2210745 - DNA, 15 bp, Homo sapiens
aatgtacattaatta

SEQ ID NO: 2210746 - DNA, 20 bp, Homo sapiens
aatgttattttttaattatt

SEQ ID NO: 2210747 - DNA, 15 bp, Homo sapiens
aatgttgttatttaa

SEQ ID NO: 2210748 - DNA, 21 bp, Homo sapiens
aattattattcttcataacaa

SEQ ID NO: 2210749 - DNA, 13 bp, Homo sapiens
aattattatttat

SEQ ID NO: 2210750 - DNA, 21 bp, Homo sapiens
aattattatttatatatgtat

SEQ ID NO: 2210751 - DNA, 22 bp, Homo sapiens
aattattatttatatatgtatt

SEQ ID NO: 2210752 - DNA, 18 bp, Homo sapiens
aattccaagtgattgaaa

SEQ ID NO: 2210753 - DNA, 13 bp, Homo sapiens
aattctaaatgaa

SEQ ID NO: 2210754 - DNA, 21 bp, Homo sapiens
aattgcattttttaaaacaag

SEQ ID NO: 2210755 - DNA, 18 bp, Homo sapiens
acaaaaggataatgaata

SEQ ID NO: 2210756 - DNA, 18 bp, Homo sapiens
acaaaggcaaagggtcca

SEQ ID NO: 2210757 - DNA, 21 bp, Homo sapiens
acaagaaagtttccccaccag

SEQ ID NO: 2210758 - DNA, 18 bp, Homo sapiens
acaagcactaaacaaaga

SEQ ID NO: 2210759 - DNA, 11 bp, Homo sapiens
acaagccaggg

SEQ ID NO: 2210760 - DNA, 14 bp, Homo sapiens
acaaggagggcaca

SEQ ID NO: 2210761 - DNA, 21 bp, Homo sapiens
acaaggtacccctttctggct

SEQ ID NO: 2210762 - DNA, 16 bp, Homo sapiens
acacaggcctgctctc

SEQ ID NO: 2210763 - DNA, 15 bp, Homo sapiens
acacgcaggagcaca

SEQ ID NO: 2210764 - DNA, 12 bp, Homo sapiens
acactctttgta

SEQ ID NO: 2210765 - DNA, 14 bp, Homo sapiens
acactgggaggcca

SEQ ID NO: 2210766 - DNA, 17 bp, Homo sapiens
acagcccagccacggac

SEQ ID NO: 2210767 - DNA, 22 bp, Homo sapiens
acagttcggtgagctacaaatg

SEQ ID NO: 2210768 - DNA, 23 bp, Homo sapiens
acatataatgttgttatttaaag

SEQ ID NO: 2210769 - DNA, 19 bp, Homo sapiens
acatatgcaccttgtgtct

SEQ ID NO: 2210770 - DNA, 20 bp, Homo sapiens
acatgaatcccacccacatg

SEQ ID NO: 2210771 - DNA, 23 bp, Homo sapiens
acatgaatcccacccacatgtga

SEQ ID NO: 2210772 - DNA, 14 bp, Homo sapiens
acatgcgaccccga

SEQ ID NO: 2210773 - DNA, 20 bp, Homo sapiens
acatggcctatgcacatatg

SEQ ID NO: 2210774 - DNA, 13 bp, Homo sapiens
acatgtcttgtac

SEQ ID NO: 2210775 - DNA, 14 bp, Homo sapiens
acatgtcttgtaca

SEQ ID NO: 2210776 - DNA, 17 bp, Homo sapiens
acatgtgtagcctgtgc

SEQ ID NO: 2210777 - DNA, 18 bp, Homo sapiens
acatgtgtagcctgtgca

SEQ ID NO: 2210778 - DNA, 18 bp, Homo sapiens
acattattatcaacaata

SEQ ID NO: 2210779 - DNA, 13 bp, Homo sapiens
acattcaggagct

SEQ ID NO: 2210780 - DNA, 11 bp, Homo sapiens
accatgtacat

SEQ ID NO: 2210781 - DNA, 17 bp, Homo sapiens
accatgtacatgaagaa

SEQ ID NO: 2210782 - DNA, 16 bp, Homo sapiens
acccacatgtgacaca

SEQ ID NO: 2210783 - DNA, 22 bp, Homo sapiens
acccagacggctccactaggac

SEQ ID NO: 2210784 - DNA, 17 bp, Homo sapiens
acccaggagtgtggcca

SEQ ID NO: 2210785 - DNA, 23 bp, Homo sapiens
accctatattttgcatagtacca

SEQ ID NO: 2210786 - DNA, 12 bp, Homo sapiens
acctcagggcac

SEQ ID NO: 2210787 - DNA, 12 bp, Homo sapiens
acctctgtgtgc

SEQ ID NO: 2210788 - DNA, 15 bp, Homo sapiens
acctggtccacaggg

SEQ ID NO: 2210789 - DNA, 18 bp, Homo sapiens
acctggtccacagggcac

SEQ ID NO: 2210790 - DNA, 11 bp, Homo sapiens
acctgtaatca

SEQ ID NO: 2210791 - DNA, 13 bp, Homo sapiens
acgaaacccactc

SEQ ID NO: 2210792 - DNA, 13 bp, Homo sapiens
acgaaatgttatt

SEQ ID NO: 2210793 - DNA, 15 bp, Homo sapiens
acgcacatgcgaccc

SEQ ID NO: 2210794 - DNA, 13 bp, Homo sapiens
acgcagccaggac

SEQ ID NO: 2210795 - DNA, 11 bp, Homo sapiens
acgctggctcc

SEQ ID NO: 2210796 - DNA, 18 bp, Homo sapiens
acgctggctccccaaagg

SEQ ID NO: 2210797 - DNA, 22 bp, Homo sapiens
acgggcagcctggctcccagga

SEQ ID NO: 2210798 - DNA, 19 bp, Homo sapiens
acgtgggcaaacaggcagt

SEQ ID NO: 2210799 - DNA, 15 bp, Homo sapiens
actaattttaaaatg

SEQ ID NO: 2210800 - DNA, 18 bp, Homo sapiens
actagtgctgaagcttat

SEQ ID NO: 2210801 - DNA, 19 bp, Homo sapiens
actagtgctgaagcttatt

SEQ ID NO: 2210802 - DNA, 12 bp, Homo sapiens
actatctgcttt

SEQ ID NO: 2210803 - DNA, 13 bp, Homo sapiens
actatctgctttt

SEQ ID NO: 2210804 - DNA, 18 bp, Homo sapiens
actctgcacatgtcttgt

SEQ ID NO: 2210805 - DNA, 14 bp, Homo sapiens
actctttgtaagag

SEQ ID NO: 2210806 - DNA, 21 bp, Homo sapiens
actgacctggtccacagggca

SEQ ID NO: 2210807 - DNA, 12 bp, Homo sapiens
actgcagggaca

SEQ ID NO: 2210808 - DNA, 17 bp, Homo sapiens
actgtaaaataataact

SEQ ID NO: 2210809 - DNA, 21 bp, Homo sapiens
actgtttgccttctactttta

SEQ ID NO: 2210810 - DNA, 16 bp, Homo sapiens
acttcatgcaggtgaa

SEQ ID NO: 2210811 - DNA, 14 bp, Homo sapiens
agaaaataacaata

SEQ ID NO: 2210812 - DNA, 16 bp, Homo sapiens
agaaggagacaggcag

SEQ ID NO: 2210813 - DNA, 19 bp, Homo sapiens
agaagggagctagccagag

SEQ ID NO: 2210814 - DNA, 13 bp, Homo sapiens
agaatctctttcg

SEQ ID NO: 2210815 - DNA, 19 bp, Homo sapiens
agacaaggaaaaaataaca

SEQ ID NO: 2210816 - DNA, 13 bp, Homo sapiens
agaccataatgtt

SEQ ID NO: 2210817 - DNA, 12 bp, Homo sapiens
agactaaaagat

SEQ ID NO: 2210818 - DNA, 19 bp, Homo sapiens
agactctacccatattaca

SEQ ID NO: 2210819 - DNA, 15 bp, Homo sapiens
agactgaggggtcga

SEQ ID NO: 2210820 - DNA, 19 bp, Homo sapiens
agactgatcaggacctcca

SEQ ID NO: 2210821 - DNA, 16 bp, Homo sapiens
agagcctggtgctgct

SEQ ID NO: 2210822 - DNA, 18 bp, Homo sapiens
agagcctggtgctgctgc

SEQ ID NO: 2210823 - DNA, 20 bp, Homo sapiens
agaggagctgggagccgggc

SEQ ID NO: 2210824 - DNA, 21 bp, Homo sapiens
agatcatccagaagttcctca

SEQ ID NO: 2210825 - DNA, 16 bp, Homo sapiens
agatctctgcagggcc

SEQ ID NO: 2210826 - DNA, 18 bp, Homo sapiens
agcacgaaatgttatttt

SEQ ID NO: 2210827 - DNA, 21 bp, Homo sapiens
agcagacagtgttttctggga

SEQ ID NO: 2210828 - DNA, 17 bp, Homo sapiens
agcatgtcgtcaaagct

SEQ ID NO: 2210829 - DNA, 11 bp, Homo sapiens
agccgggccgc

SEQ ID NO: 2210830 - DNA, 14 bp, Homo sapiens
agccgggccgcaga

SEQ ID NO: 2210831 - DNA, 14 bp, Homo sapiens
agccgtgagtgcag

SEQ ID NO: 2210832 - DNA, 16 bp, Homo sapiens
agcctggccacgcagc

SEQ ID NO: 2210833 - DNA, 11 bp, Homo sapiens
agcctggctcc

SEQ ID NO: 2210834 - DNA, 19 bp, Homo sapiens
agctaataaaatatcattc

SEQ ID NO: 2210835 - DNA, 12 bp, Homo sapiens
agctacaaatgc

SEQ ID NO: 2210836 - DNA, 19 bp, Homo sapiens
agctactaattttaaaatg

SEQ ID NO: 2210837 - DNA, 17 bp, Homo sapiens
agctagccagaggactg

SEQ ID NO: 2210838 - DNA, 20 bp, Homo sapiens
agctcccaggtgcagccaga

SEQ ID NO: 2210839 - DNA, 15 bp, Homo sapiens
agcttattaatgcta

SEQ ID NO: 2210840 - DNA, 18 bp, Homo sapiens
agcttattaatgctaagg

SEQ ID NO: 2210841 - DNA, 22 bp, Homo sapiens
agcttccccaacacgcaggagc

SEQ ID NO: 2210842 - DNA, 21 bp, Homo sapiens
aggaaactctgcattctagta

SEQ ID NO: 2210843 - DNA, 20 bp, Homo sapiens
aggaagatctctgcagggcc

SEQ ID NO: 2210844 - DNA, 21 bp, Homo sapiens
aggaagatctctgcagggccg

SEQ ID NO: 2210845 - DNA, 11 bp, Homo sapiens
aggaatttaaa

SEQ ID NO: 2210846 - DNA, 13 bp, Homo sapiens
aggacccaagcag

SEQ ID NO: 2210847 - DNA, 18 bp, Homo sapiens
aggacccaagcagagaag

SEQ ID NO: 2210848 - DNA, 21 bp, Homo sapiens
aggactgtgatgccctgccct

SEQ ID NO: 2210849 - DNA, 17 bp, Homo sapiens
aggagagtcacagaaca

SEQ ID NO: 2210850 - DNA, 15 bp, Homo sapiens
aggagcacacccagc

SEQ ID NO: 2210851 - DNA, 20 bp, Homo sapiens
aggagcttcctgtcctccca

SEQ ID NO: 2210852 - DNA, 21 bp, Homo sapiens
aggagtgccgtgtgttgcatg

SEQ ID NO: 2210853 - DNA, 21 bp, Homo sapiens
aggcccaaattatcaagctaa

SEQ ID NO: 2210854 - DNA, 23 bp, Homo sapiens
aggcccaaattatcaagctaata

SEQ ID NO: 2210855 - DNA, 14 bp, Homo sapiens
aggcctcctggccc

SEQ ID NO: 2210856 - DNA, 13 bp, Homo sapiens
agggaaatttcag

SEQ ID NO: 2210857 - DNA, 21 bp, Homo sapiens
agggagacctggacacaggcc

SEQ ID NO: 2210858 - DNA, 16 bp, Homo sapiens
agggagctagccagag

SEQ ID NO: 2210859 - DNA, 23 bp, Homo sapiens
agggagctagccagaggactgtg

SEQ ID NO: 2210860 - DNA, 22 bp, Homo sapiens
agggagctccaactcagaaggg

SEQ ID NO: 2210861 - DNA, 15 bp, Homo sapiens
aggggtatgtcttta

SEQ ID NO: 2210862 - DNA, 19 bp, Homo sapiens
agggtccagaaggagacag

SEQ ID NO: 2210863 - DNA, 14 bp, Homo sapiens
agggttttccaatg

SEQ ID NO: 2210864 - DNA, 15 bp, Homo sapiens
aggtgcagccagagg

SEQ ID NO: 2210865 - DNA, 18 bp, Homo sapiens
agtaacccccactggact

SEQ ID NO: 2210866 - DNA, 20 bp, Homo sapiens
agtaacccccactggactga

SEQ ID NO: 2210867 - DNA, 22 bp, Homo sapiens
agtcatttgctgagcatgtact

SEQ ID NO: 2210868 - DNA, 20 bp, Homo sapiens
agtcctacaagctaaaatta

SEQ ID NO: 2210869 - DNA, 19 bp, Homo sapiens
agtcgcatctcagtgcagg

SEQ ID NO: 2210870 - DNA, 20 bp, Homo sapiens
agtctctttttttggcccag

SEQ ID NO: 2210871 - DNA, 23 bp, Homo sapiens
agtctctttttttggcccaggcc

SEQ ID NO: 2210872 - DNA, 22 bp, Homo sapiens
agtgccgtgtgttgcatgcagc

SEQ ID NO: 2210873 - DNA, 12 bp, Homo sapiens
agtgtgtgtctt

SEQ ID NO: 2210874 - DNA, 16 bp, Homo sapiens
agtgttatcagtcata

SEQ ID NO: 2210875 - DNA, 18 bp, Homo sapiens
gcatcctccacaatagca

SEQ ID NO: 2210876 - DNA, 13 bp, Homo sapiens
gccacagcccagc

SEQ ID NO: 2210877 - DNA, 13 bp, Homo sapiens
gccacgcagccag

SEQ ID NO: 2210878 - DNA, 17 bp, Homo sapiens
gccacgcagccaggaca

SEQ ID NO: 2210879 - DNA, 18 bp, Homo sapiens
gccacgcagccaggacac

SEQ ID NO: 2210880 - DNA, 16 bp, Homo sapiens
gccacggacgctggct

SEQ ID NO: 2210881 - DNA, 18 bp, Homo sapiens
gccactgactgcagggac

SEQ ID NO: 2210882 - DNA, 21 bp, Homo sapiens
gccagagagcctggtgctgct

SEQ ID NO: 2210883 - DNA, 16 bp, Homo sapiens
gccagcgtggcgcagt

SEQ ID NO: 2210884 - DNA, 20 bp, Homo sapiens
gccaggacaccgggcagggc

SEQ ID NO: 2210885 - DNA, 15 bp, Homo sapiens
gccagggagacctgg

SEQ ID NO: 2210886 - DNA, 19 bp, Homo sapiens
gccagggagacctggacac

SEQ ID NO: 2210887 - DNA, 22 bp, Homo sapiens
gccagggagacctggacacagg

SEQ ID NO: 2210888 - DNA, 19 bp, Homo sapiens
gccatatactcttcaagga

SEQ ID NO: 2210889 - DNA, 20 bp, Homo sapiens
gcccaaattatcaagctaat

SEQ ID NO: 2210890 - DNA, 23 bp, Homo sapiens
gcccccacaatggtcccaaacag

SEQ ID NO: 2210891 - DNA, 21 bp, Homo sapiens
gccgcacctaaagcagccagc

SEQ ID NO: 2210892 - DNA, 18 bp, Homo sapiens
gccgcccgggcccagagg

SEQ ID NO: 2210893 - DNA, 13 bp, Homo sapiens
gcctggcacacat

SEQ ID NO: 2210894 - DNA, 14 bp, Homo sapiens
gcctggcacacatc

SEQ ID NO: 2210895 - DNA, 21 bp, Homo sapiens
gcctggccacgcagccaggac

SEQ ID NO: 2210896 - DNA, 22 bp, Homo sapiens
gcctggccacgcagccaggaca

SEQ ID NO: 2210897 - DNA, 13 bp, Homo sapiens
gcctggcctggca

SEQ ID NO: 2210898 - DNA, 16 bp, Homo sapiens
gcctggctcccaggac

SEQ ID NO: 2210899 - DNA, 17 bp, Homo sapiens
gccttgtaattctaaat

SEQ ID NO: 2210900 - DNA, 18 bp, Homo sapiens
gcgacactgggaggccag

SEQ ID NO: 2210901 - DNA, 15 bp, Homo sapiens
gcgaccttggccgca

SEQ ID NO: 2210902 - DNA, 15 bp, Homo sapiens
gcgcagtggccctga

SEQ ID NO: 2210903 - DNA, 18 bp, Homo sapiens
gcgcagtggccctgagca

SEQ ID NO: 2210904 - DNA, 14 bp, Homo sapiens
gcgtggactctgca

SEQ ID NO: 2210905 - DNA, 23 bp, Homo sapiens
gctaataaaatatcattcagcaa

SEQ ID NO: 2210906 - DNA, 12 bp, Homo sapiens
gctagccagagg

SEQ ID NO: 2210907 - DNA, 15 bp, Homo sapiens
gctagccagaggact

SEQ ID NO: 2210908 - DNA, 17 bp, Homo sapiens
gctataaacaattacat

SEQ ID NO: 2210909 - DNA, 20 bp, Homo sapiens
gctcccggggcagggcagcc

SEQ ID NO: 2210910 - DNA, 19 bp, Homo sapiens
gctcctgagggagctccaa

SEQ ID NO: 2210911 - DNA, 23 bp, Homo sapiens
gctctctttttctccagggtcag

SEQ ID NO: 2210912 - DNA, 21 bp, Homo sapiens
gctggcatgatccaagcaaga

SEQ ID NO: 2210913 - DNA, 13 bp, Homo sapiens
gctggctccccaa

SEQ ID NO: 2210914 - DNA, 21 bp, Homo sapiens
gctggctccccaaagggtgtg

SEQ ID NO: 2210915 - DNA, 16 bp, Homo sapiens
gcttattaatgctaag

SEQ ID NO: 2210916 - DNA, 20 bp, Homo sapiens
ggaaaaaataacaatgaaag

SEQ ID NO: 2210917 - DNA, 16 bp, Homo sapiens
ggaaccgtaggaccca

SEQ ID NO: 2210918 - DNA, 12 bp, Homo sapiens
ggaatcaagatt

SEQ ID NO: 2210919 - DNA, 12 bp, Homo sapiens
ggacaccgggca

SEQ ID NO: 2210920 - DNA, 23 bp, Homo sapiens
ggaccatgcgacactgggaggcc

SEQ ID NO: 2210921 - DNA, 20 bp, Homo sapiens
ggaccgggtggaagggatgg

SEQ ID NO: 2210922 - DNA, 13 bp, Homo sapiens
ggacgctggctcc

SEQ ID NO: 2210923 - DNA, 15 bp, Homo sapiens
ggacttttattttgg

SEQ ID NO: 2210924 - DNA, 17 bp, Homo sapiens
ggagacaggcagagctg

SEQ ID NO: 2210925 - DNA, 21 bp, Homo sapiens
ggagacctggacacaggcctg

SEQ ID NO: 2210926 - DNA, 17 bp, Homo sapiens
ggagcacacccagcccc

SEQ ID NO: 2210927 - DNA, 23 bp, Homo sapiens
ggagcgaactggcgcctccgagg

SEQ ID NO: 2210928 - DNA, 17 bp, Homo sapiens
ggaggccagtgagccac

SEQ ID NO: 2210929 - DNA, 23 bp, Homo sapiens
ggaggtgaacaagcaaacccaga

SEQ ID NO: 2210930 - DNA, 21 bp, Homo sapiens
ggatggcaggacgtgggctgg

SEQ ID NO: 2210931 - DNA, 22 bp, Homo sapiens
ggatggcaggacgtgggctggg

SEQ ID NO: 2210932 - DNA, 14 bp, Homo sapiens
ggcagcctggctcc

SEQ ID NO: 2210933 - DNA, 22 bp, Homo sapiens
ggcagggccgcccgggcccaga

SEQ ID NO: 2210934 - DNA, 13 bp, Homo sapiens
ggccacgcagcca

SEQ ID NO: 2210935 - DNA, 15 bp, Homo sapiens
ggccacgcagccagg

SEQ ID NO: 2210936 - DNA, 18 bp, Homo sapiens
ggccagagagcctggtgc

SEQ ID NO: 2210937 - DNA, 22 bp, Homo sapiens
ggccatctggttaggatggcag

SEQ ID NO: 2210938 - DNA, 23 bp, Homo sapiens
ggcccaaattatcaagctaataa

SEQ ID NO: 2210939 - DNA, 15 bp, Homo sapiens
ggcccaggtgagtcc

SEQ ID NO: 2210940 - DNA, 21 bp, Homo sapiens
ggccgcccgggcccagaggag

SEQ ID NO: 2210941 - DNA, 21 bp, Homo sapiens
ggcctatgcacatatggactc

SEQ ID NO: 2210942 - DNA, 18 bp, Homo sapiens
ggcctcaagatcaatgaa

SEQ ID NO: 2210943 - DNA, 14 bp, Homo sapiens
ggcctggcagctca

SEQ ID NO: 2210944 - DNA, 19 bp, Homo sapiens
ggctcctgagggagctcca

SEQ ID NO: 2210945 - DNA, 13 bp, Homo sapiens
gggagacctggac

SEQ ID NO: 2210946 - DNA, 18 bp, Homo sapiens
gggagctagccagaggac

SEQ ID NO: 2210947 - DNA, 12 bp, Homo sapiens
gggcagggcagc

SEQ ID NO: 2210948 - DNA, 13 bp, Homo sapiens
gggcagggcagcc

SEQ ID NO: 2210949 - DNA, 14 bp, Homo sapiens
gggcagggccgccc

SEQ ID NO: 2210950 - DNA, 23 bp, Homo sapiens
gggcagggccgcccgggcccaga

SEQ ID NO: 2210951 - DNA, 18 bp, Homo sapiens
gggcagggctcccacaga

SEQ ID NO: 2210952 - DNA, 17 bp, Homo sapiens
ggggctggcactgactg

SEQ ID NO: 2210953 - DNA, 13 bp, Homo sapiens
ggtaaaatacttc

SEQ ID NO: 2210954 - DNA, 12 bp, Homo sapiens
gtaattctaaat

SEQ ID NO: 2210955 - DNA, 18 bp, Homo sapiens
gtaattctaaatgaatgt

SEQ ID NO: 2210956 - DNA, 22 bp, Homo sapiens
gtaattctaaatgaatgtttac

SEQ ID NO: 2210957 - DNA, 14 bp, Homo sapiens
gtacacgtgtcctg

SEQ ID NO: 2210958 - DNA, 15 bp, Homo sapiens
gtacacgtgtcctgt

SEQ ID NO: 2210959 - DNA, 19 bp, Homo sapiens
gtacatgtgtagcctgtgc

SEQ ID NO: 2210960 - DNA, 14 bp, Homo sapiens
gtaccaatcatttt

SEQ ID NO: 2210961 - DNA, 16 bp, Homo sapiens
gtactgagccttgtaa

SEQ ID NO: 2210962 - DNA, 12 bp, Homo sapiens
gtagcctgtgca

SEQ ID NO: 2210963 - DNA, 20 bp, Homo sapiens
gtatctagacccatcttctt

SEQ ID NO: 2210964 - DNA, 13 bp, Homo sapiens
gtattaaagacag

SEQ ID NO: 2210965 - DNA, 23 bp, Homo sapiens
gtcacatggcctatgcacatatg

SEQ ID NO: 2210966 - DNA, 15 bp, Homo sapiens
gtcagaaacaggacc

SEQ ID NO: 2210967 - DNA, 18 bp, Homo sapiens
gtcataactaaataaagc

SEQ ID NO: 2210968 - DNA, 15 bp, Homo sapiens
gtcattcaataaatt

SEQ ID NO: 2210969 - DNA, 19 bp, Homo sapiens
gtcccaaacagctgcctct

SEQ ID NO: 2210970 - DNA, 21 bp, Homo sapiens
gtcctgtagttgcgtggactc

SEQ ID NO: 2210971 - DNA, 23 bp, Homo sapiens
gtcctgtagttgcgtggactctg

SEQ ID NO: 2210972 - DNA, 14 bp, Homo sapiens
gtctgtacacgtgt

SEQ ID NO: 2210973 - DNA, 20 bp, Homo sapiens
gtctgtacacgtgtcctgta

SEQ ID NO: 2210974 - DNA, 16 bp, Homo sapiens
gtctttcacatttaaa

SEQ ID NO: 2210975 - DNA, 11 bp, Homo sapiens
gtgactagtgc

SEQ ID NO: 2210976 - DNA, 14 bp, Homo sapiens
gtgactagtgctga

SEQ ID NO: 2210977 - DNA, 22 bp, Homo sapiens
gtgactagtgctgaagcttatt

SEQ ID NO: 2210978 - DNA, 12 bp, Homo sapiens
gtgcctggcctg

SEQ ID NO: 2210979 - DNA, 15 bp, Homo sapiens
gtgctgctgctgctg

SEQ ID NO: 2210980 - DNA, 21 bp, Homo sapiens
gtgcttatcccatagccagga

SEQ ID NO: 2210981 - DNA, 14 bp, Homo sapiens
gtggactctgcaca

SEQ ID NO: 2210982 - DNA, 13 bp, Homo sapiens
gtgtctgtacacg

SEQ ID NO: 2210983 - DNA, 22 bp, Homo sapiens
gttagtcatttgctgagcatgt

SEQ ID NO: 2210984 - DNA, 21 bp, Homo sapiens
gttattttttaattattattt

SEQ ID NO: 2210985 - DNA, 22 bp, Homo sapiens
gttcaccttgaagaacctctca

SEQ ID NO: 2210986 - DNA, 23 bp, Homo sapiens
gttgcgtggactctgcacatgtc

SEQ ID NO: 2210987 - DNA, 23 bp, Homo sapiens
gttgctgatgaactcttaatcaa

SEQ ID NO: 2210988 - DNA, 22 bp, Homo sapiens
gtttcaattccacctgcaatca

SEQ ID NO: 2210989 - DNA, 15 bp, Homo sapiens
gtttccccaccagtg

SEQ ID NO: 2210990 - DNA, 20 bp, Homo sapiens
gtttccccaccagtgaatga

SEQ ID NO: 2210991 - DNA, 17 bp, Homo sapiens
gtttccttccagcccag

SEQ ID NO: 2210992 - DNA, 20 bp, Homo sapiens
gtttcctttcatttactgtg

SEQ ID NO: 2210993 - DNA, 16 bp, Homo sapiens
gtttctttagcagttt

SEQ ID NO: 2210994 - DNA, 15 bp, Homo sapiens
gtttgatttcattaa

SEQ ID NO: 2210995 - DNA, 17 bp, Homo sapiens
taaaaattgtgatcaga

SEQ ID NO: 2210996 - DNA, 20 bp, Homo sapiens
taaaagacagtgaaagaaaa

SEQ ID NO: 2210997 - DNA, 15 bp, Homo sapiens
taaaatatcattcag

SEQ ID NO: 2210998 - DNA, 18 bp, Homo sapiens
taaaatatcattcagcaa

SEQ ID NO: 2210999 - DNA, 19 bp, Homo sapiens
taaaatatcattcagcaac

SEQ ID NO: 2211000 - DNA, 17 bp, Homo sapiens
taaactaaagaaaaatt

SEQ ID NO: 2211001 - DNA, 19 bp, Homo sapiens
taaagaacaccctatattt

SEQ ID NO: 2211002 - DNA, 17 bp, Homo sapiens
taaatcctttactgtta

SEQ ID NO: 2211003 - DNA, 21 bp, Homo sapiens
taagtttccttccagcccaga

SEQ ID NO: 2211004 - DNA, 12 bp, Homo sapiens
taataaaatatc

SEQ ID NO: 2211005 - DNA, 17 bp, Homo sapiens
taataaaatatcattca

SEQ ID NO: 2211006 - DNA, 20 bp, Homo sapiens
taataaaatatcattcagca

SEQ ID NO: 2211007 - DNA, 19 bp, Homo sapiens
taataaatgtacattaatt

SEQ ID NO: 2211008 - DNA, 14 bp, Homo sapiens
taatacctctgtgt

SEQ ID NO: 2211009 - DNA, 18 bp, Homo sapiens
taatcttttcacaaataa

SEQ ID NO: 2211010 - DNA, 17 bp, Homo sapiens
taattattatttatata

SEQ ID NO: 2211011 - DNA, 18 bp, Homo sapiens
taattggtccgatctttg

SEQ ID NO: 2211012 - DNA, 13 bp, Homo sapiens
tacagaattttat

SEQ ID NO: 2211013 - DNA, 17 bp, Homo sapiens
tacaggggttctggaaa

SEQ ID NO: 2211014 - DNA, 15 bp, Homo sapiens
taccaatcattttaa

SEQ ID NO: 2211015 - DNA, 22 bp, Homo sapiens
taccaatcattttaattattat

SEQ ID NO: 2211016 - DNA, 12 bp, Homo sapiens
tacctctgtgtg

SEQ ID NO: 2211017 - DNA, 18 bp, Homo sapiens
tactgagccttgtaattc

SEQ ID NO: 2211018 - DNA, 21 bp, Homo sapiens
tactttgcctttccataatca

SEQ ID NO: 2211019 - DNA, 22 bp, Homo sapiens
aaaagctccatttttagtgaaa

SEQ ID NO: 2211020 - DNA, 16 bp, Homo sapiens
aaaatatcattcagca

SEQ ID NO: 2211021 - DNA, 13 bp, Homo sapiens
aaaattgtgatca

SEQ ID NO: 2211022 - DNA, 21 bp, Homo sapiens
aaacaggcagttggccagaga

SEQ ID NO: 2211023 - DNA, 21 bp, Homo sapiens
aaagaaccaagaaaaaggaat

SEQ ID NO: 2211024 - DNA, 19 bp, Homo sapiens
aaagatgggtgaaggctgg

SEQ ID NO: 2211025 - DNA, 19 bp, Homo sapiens
aaagcacgaaatgttattt

SEQ ID NO: 2211026 - DNA, 20 bp, Homo sapiens
aaatatatttaagataatta

SEQ ID NO: 2211027 - DNA, 22 bp, Homo sapiens
aaatatatttaagataattata

SEQ ID NO: 2211028 - DNA, 14 bp, Homo sapiens
aaatatcattcagc

SEQ ID NO: 2211029 - DNA, 17 bp, Homo sapiens
aaatatcattcagcaac

SEQ ID NO: 2211030 - DNA, 16 bp, Homo sapiens
aaatcctttactgtta

SEQ ID NO: 2211031 - DNA, 14 bp, Homo sapiens
aaatgcatttctaa

SEQ ID NO: 2211032 - DNA, 20 bp, Homo sapiens
aaatgttattttttaattat

SEQ ID NO: 2211033 - DNA, 19 bp, Homo sapiens
aaattatcaagctaataaa

SEQ ID NO: 2211034 - DNA, 20 bp, Homo sapiens
aaattatcaagctaataaaa

SEQ ID NO: 2211035 - DNA, 15 bp, Homo sapiens
aacaagaaagtttcc

SEQ ID NO: 2211036 - DNA, 16 bp, Homo sapiens
aacaccctatattttg

SEQ ID NO: 2211037 - DNA, 17 bp, Homo sapiens
aacaggaccgggtggaa

SEQ ID NO: 2211038 - DNA, 13 bp, Homo sapiens
aacatataatgtt

SEQ ID NO: 2211039 - DNA, 14 bp, Homo sapiens
aacattcaggagct

SEQ ID NO: 2211040 - DNA, 22 bp, Homo sapiens
aaccatgagaccactgttatca

SEQ ID NO: 2211041 - DNA, 21 bp, Homo sapiens
aacccagacggctccactagg

SEQ ID NO: 2211042 - DNA, 12 bp, Homo sapiens
aacccccactgg

SEQ ID NO: 2211043 - DNA, 20 bp, Homo sapiens
aacccccactggactgacct

SEQ ID NO: 2211044 - DNA, 18 bp, Homo sapiens
aacctctcacttcaccct

SEQ ID NO: 2211045 - DNA, 14 bp, Homo sapiens
aacgaaacccactc

SEQ ID NO: 2211046 - DNA, 12 bp, Homo sapiens
aactcagaaggg

SEQ ID NO: 2211047 - DNA, 16 bp, Homo sapiens
aactctgcattctagt

SEQ ID NO: 2211048 - DNA, 19 bp, Homo sapiens
aacttacctgggcattctt

SEQ ID NO: 2211049 - DNA, 17 bp, Homo sapiens
aacttgtattaaagaca

SEQ ID NO: 2211050 - DNA, 15 bp, Homo sapiens
aagaaagtttcccca

SEQ ID NO: 2211051 - DNA, 23 bp, Homo sapiens
aagaaagtttccccaccagtgaa

SEQ ID NO: 2211052 - DNA, 21 bp, Homo sapiens
aagacaaggaaaaaataacaa

SEQ ID NO: 2211053 - DNA, 21 bp, Homo sapiens
gcccaggtgagtcctagagct

SEQ ID NO: 2211054 - DNA, 14 bp, Homo sapiens
gcccgggcccagag

SEQ ID NO: 2211055 - DNA, 17 bp, Homo sapiens
gccctcaccacccactt

SEQ ID NO: 2211056 - DNA, 14 bp, Homo sapiens
gccctttttaagga

SEQ ID NO: 2211057 - DNA, 16 bp, Homo sapiens
gccgcccgggcccaga

SEQ ID NO: 2211058 - DNA, 14 bp, Homo sapiens
gcctatgcacatat

SEQ ID NO: 2211059 - DNA, 22 bp, Homo sapiens
gcctatgcacatatggactctg

SEQ ID NO: 2211060 - DNA, 15 bp, Homo sapiens
gcctccatcagctaa

SEQ ID NO: 2211061 - DNA, 21 bp, Homo sapiens
gcctccgagggacgcggctcc

SEQ ID NO: 2211062 - DNA, 15 bp, Homo sapiens
gcctcctggcccagg

SEQ ID NO: 2211063 - DNA, 15 bp, Homo sapiens
gcctggccacgcagc

SEQ ID NO: 2211064 - DNA, 20 bp, Homo sapiens
gcctggccacgcagccagga

SEQ ID NO: 2211065 - DNA, 23 bp, Homo sapiens
gcctggccacgcagccaggacac

SEQ ID NO: 2211066 - DNA, 16 bp, Homo sapiens
gcctggcctggcacac

SEQ ID NO: 2211067 - DNA, 13 bp, Homo sapiens
gcctggtgctgct

SEQ ID NO: 2211068 - DNA, 19 bp, Homo sapiens
gcctgtgcatgtatgtctt

SEQ ID NO: 2211069 - DNA, 15 bp, Homo sapiens
gcggctcccggggca

SEQ ID NO: 2211070 - DNA, 13 bp, Homo sapiens
gcgtggactctgc

SEQ ID NO: 2211071 - DNA, 21 bp, Homo sapiens
gcgtggcgcagtggccctgag

SEQ ID NO: 2211072 - DNA, 19 bp, Homo sapiens
gctaaatcctttactgtta

SEQ ID NO: 2211073 - DNA, 21 bp, Homo sapiens
gctaataaaatatcattcagc

SEQ ID NO: 2211074 - DNA, 20 bp, Homo sapiens
gctccatttttagtgaaata

SEQ ID NO: 2211075 - DNA, 20 bp, Homo sapiens
gctcccaggtgcagccagag

SEQ ID NO: 2211076 - DNA, 22 bp, Homo sapiens
gctcccaggtgcagccagaggc

SEQ ID NO: 2211077 - DNA, 20 bp, Homo sapiens
gctcccctctgcacggacca

SEQ ID NO: 2211078 - DNA, 19 bp, Homo sapiens
gctcccggggcagggcagc

SEQ ID NO: 2211079 - DNA, 17 bp, Homo sapiens
gctctcccatttcctga

SEQ ID NO: 2211080 - DNA, 22 bp, Homo sapiens
gctctctttttctccagggtca

SEQ ID NO: 2211081 - DNA, 16 bp, Homo sapiens
gctgcatacccgggca

SEQ ID NO: 2211082 - DNA, 12 bp, Homo sapiens
gctgctgctgct

SEQ ID NO: 2211083 - DNA, 23 bp, Homo sapiens
gctggccatctggttaggatggc

SEQ ID NO: 2211084 - DNA, 17 bp, Homo sapiens
gctggctccccaaaggg

SEQ ID NO: 2211085 - DNA, 21 bp, Homo sapiens
gcttcctgtcctcccagctcc

SEQ ID NO: 2211086 - DNA, 19 bp, Homo sapiens
gcttcttaatcttttcaca

SEQ ID NO: 2211087 - DNA, 19 bp, Homo sapiens
ggaagatctctgcagggcc

SEQ ID NO: 2211088 - DNA, 13 bp, Homo sapiens
ggaataataccta

SEQ ID NO: 2211089 - DNA, 13 bp, Homo sapiens
ggacgtgggctgg

SEQ ID NO: 2211090 - DNA, 20 bp, Homo sapiens
ggactctgcacatgtcttgt

SEQ ID NO: 2211091 - DNA, 12 bp, Homo sapiens
ggagacaggcag

SEQ ID NO: 2211092 - DNA, 17 bp, Homo sapiens
ggagagtcacagaacaa

SEQ ID NO: 2211093 - DNA, 13 bp, Homo sapiens
ggagatggagttc

SEQ ID NO: 2211094 - DNA, 15 bp, Homo sapiens
ggagcacacccagcc

SEQ ID NO: 2211095 - DNA, 15 bp, Homo sapiens
ggagccgggccgcag

SEQ ID NO: 2211096 - DNA, 20 bp, Homo sapiens
ggagctccaactcagaaggg

SEQ ID NO: 2211097 - DNA, 13 bp, Homo sapiens
ggagtgtgtgtct

SEQ ID NO: 2211098 - DNA, 20 bp, Homo sapiens
ggatttcatgatttcatttc

SEQ ID NO: 2211099 - DNA, 23 bp, Homo sapiens
ggcaaacaggcagttggccagag

SEQ ID NO: 2211100 - DNA, 22 bp, Homo sapiens
ggcaaagcacgaaatgttattt

SEQ ID NO: 2211101 - DNA, 19 bp, Homo sapiens
ggcaaagggtccagaagga

SEQ ID NO: 2211102 - DNA, 18 bp, Homo sapiens
ggcacccaagacctcagg

SEQ ID NO: 2211103 - DNA, 12 bp, Homo sapiens
ggcaccctccca

SEQ ID NO: 2211104 - DNA, 18 bp, Homo sapiens
ggcagagctgctcccctc

SEQ ID NO: 2211105 - DNA, 21 bp, Homo sapiens
ggcagcctggctcccaggaca

SEQ ID NO: 2211106 - DNA, 18 bp, Homo sapiens
ggcaggacgtgggctggg

SEQ ID NO: 2211107 - DNA, 17 bp, Homo sapiens
ggcagggctcccacaga

SEQ ID NO: 2211108 - DNA, 21 bp, Homo sapiens
ggcagggctcccacagagaca

SEQ ID NO: 2211109 - DNA, 15 bp, Homo sapiens
ggcatgatccaagca

SEQ ID NO: 2211110 - DNA, 14 bp, Homo sapiens
ggccacgcagccag

SEQ ID NO: 2211111 - DNA, 16 bp, Homo sapiens
ggccacgcagccagga

SEQ ID NO: 2211112 - DNA, 23 bp, Homo sapiens
ggccagagagcctggtgctgctg

SEQ ID NO: 2211113 - DNA, 21 bp, Homo sapiens
ggcccaaattatcaagctaat

SEQ ID NO: 2211114 - DNA, 22 bp, Homo sapiens
ggcccagaggagctgggagccg

SEQ ID NO: 2211115 - DNA, 21 bp, Homo sapiens
ggccgcacctaaagcagccag

SEQ ID NO: 2211116 - DNA, 22 bp, Homo sapiens
ggccgcacctaaagcagccagc

SEQ ID NO: 2211117 - DNA, 17 bp, Homo sapiens
ggccgcccgggcccaga

SEQ ID NO: 2211118 - DNA, 12 bp, Homo sapiens
ggcctcaagatc

SEQ ID NO: 2211119 - DNA, 20 bp, Homo sapiens
ggctaagcttcactgtaaaa

SEQ ID NO: 2211120 - DNA, 13 bp, Homo sapiens
ggctcccaggaca

SEQ ID NO: 2211121 - DNA, 14 bp, Homo sapiens
ggctcccaggacac

SEQ ID NO: 2211122 - DNA, 22 bp, Homo sapiens
ggcttgagtttaaattgtaata

SEQ ID NO: 2211123 - DNA, 16 bp, Homo sapiens
gggagccgggccgcag

SEQ ID NO: 2211124 - DNA, 14 bp, Homo sapiens
gggcaaacaggcag

SEQ ID NO: 2211125 - DNA, 20 bp, Homo sapiens
gggcagcctggctcccagga

SEQ ID NO: 2211126 - DNA, 22 bp, Homo sapiens
gggcagcctggctcccaggaca

SEQ ID NO: 2211127 - DNA, 14 bp, Homo sapiens
gggcccagaggagc

SEQ ID NO: 2211128 - DNA, 14 bp, Homo sapiens
gggccgccagggag

SEQ ID NO: 2211129 - DNA, 20 bp, Homo sapiens
gggccgccagggagacctgg

SEQ ID NO: 2211130 - DNA, 20 bp, Homo sapiens
gggccgcccgggcccagagg

SEQ ID NO: 2211131 - DNA, 13 bp, Homo sapiens
gggtccagaagga

SEQ ID NO: 2211132 - DNA, 13 bp, Homo sapiens
gggtgaaggctgg

SEQ ID NO: 2211133 - DNA, 18 bp, Homo sapiens
gggttttccaatgtgact

SEQ ID NO: 2211134 - DNA, 16 bp, Homo sapiens
ggtcagaaacaggacc

SEQ ID NO: 2211135 - DNA, 20 bp, Homo sapiens
ggtccagaaggagacaggca

SEQ ID NO: 2211136 - DNA, 21 bp, Homo sapiens
ggtccagaaggagacaggcag

SEQ ID NO: 2211137 - DNA, 20 bp, Homo sapiens
ggtcccaaacagctgcctct

SEQ ID NO: 2211138 - DNA, 17 bp, Homo sapiens
ggtcgacttcgggctgg

SEQ ID NO: 2211139 - DNA, 13 bp, Homo sapiens
ggtgcagccagag

SEQ ID NO: 2211140 - DNA, 18 bp, Homo sapiens
ggttctccccctttctct

SEQ ID NO: 2211141 - DNA, 21 bp, Homo sapiens
gtcacatggcctatgcacata

SEQ ID NO: 2211142 - DNA, 22 bp, Homo sapiens
gtcatttgctgagcatgtactg

SEQ ID NO: 2211143 - DNA, 13 bp, Homo sapiens
gtccacagggcac

SEQ ID NO: 2211144 - DNA, 17 bp, Homo sapiens
gtccagaaggagacagg

SEQ ID NO: 2211145 - DNA, 19 bp, Homo sapiens
gtccagaaggagacaggca

SEQ ID NO: 2211146 - DNA, 15 bp, Homo sapiens
gtcctcccagctcct

SEQ ID NO: 2211147 - DNA, 16 bp, Homo sapiens
gtctagactaaaagat

SEQ ID NO: 2211148 - DNA, 21 bp, Homo sapiens
gtctgtacacgtgtcctgtag

SEQ ID NO: 2211149 - DNA, 15 bp, Homo sapiens
gtcttgtacatgtgt

SEQ ID NO: 2211150 - DNA, 13 bp, Homo sapiens
gtcttgtgactag

SEQ ID NO: 2211151 - DNA, 19 bp, Homo sapiens
gtcttgtgactagtgctga

SEQ ID NO: 2211152 - DNA, 20 bp, Homo sapiens
gtcttgtgactagtgctgaa

SEQ ID NO: 2211153 - DNA, 13 bp, Homo sapiens
gtgaaggctggca

SEQ ID NO: 2211154 - DNA, 22 bp, Homo sapiens
gtgagctcccaggtgcagccag

SEQ ID NO: 2211155 - DNA, 20 bp, Homo sapiens
gtgatcagaccataatgtta

SEQ ID NO: 2211156 - DNA, 14 bp, Homo sapiens
gtgcagccagaggc

SEQ ID NO: 2211157 - DNA, 16 bp, Homo sapiens
gtgcatgtatgtcttg

SEQ ID NO: 2211158 - DNA, 15 bp, Homo sapiens
gtgcctggcctggca

SEQ ID NO: 2211159 - DNA, 19 bp, Homo sapiens
gtgcctggcctggcacaca

SEQ ID NO: 2211160 - DNA, 14 bp, Homo sapiens
gtgctcctccttgg

SEQ ID NO: 2211161 - DNA, 15 bp, Homo sapiens
gtgctgaagcttatt

SEQ ID NO: 2211162 - DNA, 14 bp, Homo sapiens
gtgctgctgctgct

SEQ ID NO: 2211163 - DNA, 17 bp, Homo sapiens
gtggactctgcacatgt

SEQ ID NO: 2211164 - DNA, 14 bp, Homo sapiens
gtggcttcttaatc

SEQ ID NO: 2211165 - DNA, 14 bp, Homo sapiens
gtgtagcctgtgca

SEQ ID NO: 2211166 - DNA, 16 bp, Homo sapiens
gtgttaatcatttcat

SEQ ID NO: 2211167 - DNA, 14 bp, Homo sapiens
gttactatctgctt

SEQ ID NO: 2211168 - DNA, 15 bp, Homo sapiens
gttaggatggcagga

SEQ ID NO: 2211169 - DNA, 12 bp, Homo sapiens
gttagtcatttg

SEQ ID NO: 2211170 - DNA, 19 bp, Homo sapiens
gttattatatttacaaatg

SEQ ID NO: 2211171 - DNA, 16 bp, Homo sapiens
gttattttttaattat

SEQ ID NO: 2211172 - DNA, 19 bp, Homo sapiens
gttctaaaaattgtgatca

SEQ ID NO: 2211173 - DNA, 16 bp, Homo sapiens
gtttacactctttgta

SEQ ID NO: 2211174 - DNA, 17 bp, Homo sapiens
gtttcctttcatttact

SEQ ID NO: 2211175 - DNA, 23 bp, Homo sapiens
gtttcctttcatttactgtggct

SEQ ID NO: 2211176 - DNA, 22 bp, Homo sapiens
taaaacaagcactaaacaaaga

SEQ ID NO: 2211177 - DNA, 14 bp, Homo sapiens
taaaagattgagaa

SEQ ID NO: 2211178 - DNA, 17 bp, Homo sapiens
taaaatatcattcagca

SEQ ID NO: 2211179 - DNA, 19 bp, Homo sapiens
taaagcttgcaacaaaatt

SEQ ID NO: 2211180 - DNA, 17 bp, Homo sapiens
taaataaaaataatcct

SEQ ID NO: 2211181 - DNA, 12 bp, Homo sapiens
taaatgaatgtt

SEQ ID NO: 2211182 - DNA, 23 bp, Homo sapiens
taacatataatgttgttatttaa

SEQ ID NO: 2211183 - DNA, 20 bp, Homo sapiens
taacgataaaagacagtgaa

SEQ ID NO: 2211184 - DNA, 19 bp, Homo sapiens
taagtttccttccagccca

SEQ ID NO: 2211185 - DNA, 14 bp, Homo sapiens
taagtttctgggac

SEQ ID NO: 2211186 - DNA, 16 bp, Homo sapiens
taagtttgatttcatt

SEQ ID NO: 2211187 - DNA, 16 bp, Homo sapiens
taataaaatatcattc

SEQ ID NO: 2211188 - DNA, 19 bp, Homo sapiens
taatcagggaggtcatttt

SEQ ID NO: 2211189 - DNA, 20 bp, Homo sapiens
taatcatataataaatgtac

SEQ ID NO: 2211190 - DNA, 19 bp, Homo sapiens
taatcttttcacaaataaa

SEQ ID NO: 2211191 - DNA, 14 bp, Homo sapiens
taattattattctt

SEQ ID NO: 2211192 - DNA, 14 bp, Homo sapiens
taattattatttat

SEQ ID NO: 2211193 - DNA, 16 bp, Homo sapiens
tacatgtgtagcctgt

SEQ ID NO: 2211194 - DNA, 19 bp, Homo sapiens
tacatgtgtagcctgtgca

SEQ ID NO: 2211195 - DNA, 19 bp, Homo sapiens
taccaatcattttaattat

SEQ ID NO: 2211196 - DNA, 20 bp, Homo sapiens
taccaatcattttaattatt

SEQ ID NO: 2211197 - DNA, 14 bp, Homo sapiens
tactatatttatgg

SEQ ID NO: 2211198 - DNA, 21 bp, Homo sapiens
cttctgattatttgcagctgc

SEQ ID NO: 2211199 - DNA, 21 bp, Homo sapiens
ctttgctggagtcctgttctc

SEQ ID NO: 2211200 - DNA, 17 bp, Homo sapiens
gaacccagccagagttt

SEQ ID NO: 2211201 - DNA, 11 bp, Homo sapiens
gaacccaggag

SEQ ID NO: 2211202 - DNA, 23 bp, Homo sapiens
gaacgcaagaggcatcccaagac

SEQ ID NO: 2211203 - DNA, 19 bp, Homo sapiens
gaagaaaaagaagctgagg

SEQ ID NO: 2211204 - DNA, 24 bp, Homo sapiens
gaagacacgtgtttttgtatcttt

SEQ ID NO: 2211205 - DNA, 21 bp, Homo sapiens
gaaggcacctgctcccacaga

SEQ ID NO: 2211206 - DNA, 21 bp, Homo sapiens
gaagggggaacgcaagaggca

SEQ ID NO: 2211207 - DNA, 14 bp, Homo sapiens
gacacttcaaactg

SEQ ID NO: 2211208 - DNA, 21 bp, Homo sapiens
gacacttcaaactgcggacac

SEQ ID NO: 2211209 - DNA, 24 bp, Homo sapiens
gacatcatgctggtgagtgccacg

SEQ ID NO: 2211210 - DNA, 20 bp, Homo sapiens
gaccacaaggctgaaaagtg

SEQ ID NO: 2211211 - DNA, 15 bp, Homo sapiens
gaccctcccctgcct

SEQ ID NO: 2211212 - DNA, 16 bp, Homo sapiens
gaccctcccctgcctc

SEQ ID NO: 2211213 - DNA, 22 bp, Homo sapiens
gaccctcccctgcctccgaggc

SEQ ID NO: 2211214 - DNA, 22 bp, Homo sapiens
gacggggatggttccccaggag

SEQ ID NO: 2211215 - DNA, 22 bp, Homo sapiens
gactcagaagaaaaagaagctg

SEQ ID NO: 2211216 - DNA, 22 bp, Homo sapiens
gacttgatgaataaacactttt

SEQ ID NO: 2211217 - DNA, 23 bp, Homo sapiens
gagagattgggactgagtgctga

SEQ ID NO: 2211218 - DNA, 23 bp, Homo sapiens
gagaggacacttcaaactgcgga

SEQ ID NO: 2211219 - DNA, 21 bp, Homo sapiens
gagcgcacctgcttcccccac

SEQ ID NO: 2211220 - DNA, 20 bp, Homo sapiens
gagctccacagaagacacgt

SEQ ID NO: 2211221 - DNA, 17 bp, Homo sapiens
gaggagaccctcccctg

SEQ ID NO: 2211222 - DNA, 22 bp, Homo sapiens
gaggagaccctcccctgcctcc

SEQ ID NO: 2211223 - DNA, 23 bp, Homo sapiens
gaggcatcccaagacctcatctg

SEQ ID NO: 2211224 - DNA, 23 bp, Homo sapiens
gaggctggtcttagatgcagcga

SEQ ID NO: 2211225 - DNA, 13 bp, Homo sapiens
gagtcctgttctc

SEQ ID NO: 2211226 - DNA, 17 bp, Homo sapiens
gagtcctgttctcagag

SEQ ID NO: 2211227 - DNA, 19 bp, Homo sapiens
gagtcctgttctcagagct

SEQ ID NO: 2211228 - DNA, 20 bp, Homo sapiens
gagtcctgttctcagagctc

SEQ ID NO: 2211229 - DNA, 20 bp, Homo sapiens
gagtttgcctccctgcactt

SEQ ID NO: 2211230 - DNA, 14 bp, Homo sapiens
gatccgcaacccat

SEQ ID NO: 2211231 - DNA, 16 bp, Homo sapiens
gatgataaacgacttt

SEQ ID NO: 2211232 - DNA, 14 bp, Homo sapiens
gatgtataaatttt

SEQ ID NO: 2211233 - DNA, 15 bp, Homo sapiens
gcaaaacagacatca

SEQ ID NO: 2211234 - DNA, 13 bp, Homo sapiens
gcaacatggcttt

SEQ ID NO: 2211235 - DNA, 21 bp, Homo sapiens
gcaacccatgccctggaccag

SEQ ID NO: 2211236 - DNA, 19 bp, Homo sapiens
gcaatacttaggaggctta

SEQ ID NO: 2211237 - DNA, 11 bp, Homo sapiens
gcacctgctcc

SEQ ID NO: 2211238 - DNA, 12 bp, Homo sapiens
gcacctgctccc

SEQ ID NO: 2211239 - DNA, 15 bp, Homo sapiens
gcacctgctcccaca

SEQ ID NO: 2211240 - DNA, 20 bp, Homo sapiens
gcatgcatgggaggaattca

SEQ ID NO: 2211241 - DNA, 19 bp, Homo sapiens
gccaacagagaggttcctg

SEQ ID NO: 2211242 - DNA, 16 bp, Homo sapiens
gccagagtttgcctcc

SEQ ID NO: 2211243 - DNA, 23 bp, Homo sapiens
gccagagtttgcctccctgcact

SEQ ID NO: 2211244 - DNA, 23 bp, Homo sapiens
gccagctgggtttagcccgaggc

SEQ ID NO: 2211245 - DNA, 23 bp, Homo sapiens
gccctcaatccccaagctggcag

SEQ ID NO: 2211246 - DNA, 16 bp, Homo sapiens
gccctggaccagccgc

SEQ ID NO: 2211247 - DNA, 14 bp, Homo sapiens
gccgccgcagctgg

SEQ ID NO: 2211248 - DNA, 14 bp, Homo sapiens
gcctacctgctccc

SEQ ID NO: 2211249 - DNA, 22 bp, Homo sapiens
gcctgcagtgtcaaatcgatgg

SEQ ID NO: 2211250 - DNA, 13 bp, Homo sapiens
gcctgccacctcc

SEQ ID NO: 2211251 - DNA, 14 bp, Homo sapiens
gcctggccttggct

SEQ ID NO: 2211252 - DNA, 13 bp, Homo sapiens
gcgactcccagct

SEQ ID NO: 2211253 - DNA, 16 bp, Homo sapiens
gcgatggatgtttaca

SEQ ID NO: 2211254 - DNA, 15 bp, Homo sapiens
gcgcacctgcttccc

SEQ ID NO: 2211255 - DNA, 17 bp, Homo sapiens
gctgcgatggatgttta

SEQ ID NO: 2211256 - DNA, 23 bp, Homo sapiens
gctggcagctgtcattcaggacc

SEQ ID NO: 2211257 - DNA, 15 bp, Homo sapiens
gcttcccccacttca

SEQ ID NO: 2211258 - DNA, 22 bp, Homo sapiens
gctttgctggagtcctgttctc

SEQ ID NO: 2211259 - DNA, 19 bp, Homo sapiens
gcttttctgaaagtatgag

SEQ ID NO: 2211260 - DNA, 14 bp, Homo sapiens
ggaaggcacctgct

SEQ ID NO: 2211261 - DNA, 18 bp, Homo sapiens
ggaccagccgcccagatc

SEQ ID NO: 2211262 - DNA, 16 bp, Homo sapiens
ggagtcctgttctcag

SEQ ID NO: 2211263 - DNA, 18 bp, Homo sapiens
ggagtcctgttctcagag

SEQ ID NO: 2211264 - DNA, 16 bp, Homo sapiens
ggatggttccccagga

SEQ ID NO: 2211265 - DNA, 19 bp, Homo sapiens
ggatggttccccaggagga

SEQ ID NO: 2211266 - DNA, 14 bp, Homo sapiens
ggatgtataaattt

SEQ ID NO: 2211267 - DNA, 20 bp, Homo sapiens
ggatgtttacaggaacccag

SEQ ID NO: 2211268 - DNA, 12 bp, Homo sapiens
ggcaccatctgg

SEQ ID NO: 2211269 - DNA, 13 bp, Homo sapiens
ggcaccatctgga

SEQ ID NO: 2211270 - DNA, 15 bp, Homo sapiens
ggcaccatctggacg

SEQ ID NO: 2211271 - DNA, 12 bp, Homo sapiens
ggcacctgctcc

SEQ ID NO: 2211272 - DNA, 15 bp, Homo sapiens
ggcacctgctcccac

SEQ ID NO: 2211273 - DNA, 23 bp, Homo sapiens
ggcttctgattatttgcagctgc

SEQ ID NO: 2211274 - DNA, 15 bp, Homo sapiens
gggaaggcacctgct

SEQ ID NO: 2211275 - DNA, 20 bp, Homo sapiens
ggggatggttccccaggagg

SEQ ID NO: 2211276 - DNA, 18 bp, Homo sapiens
gggggcaccatctggacg

SEQ ID NO: 2211277 - DNA, 11 bp, Homo sapiens
ggtaaatgtta

SEQ ID NO: 2211278 - DNA, 17 bp, Homo sapiens
gtatctttaaagacttg

SEQ ID NO: 2211279 - DNA, 19 bp, Homo sapiens
gtatctttaaagacttgat

SEQ ID NO: 2211280 - DNA, 16 bp, Homo sapiens
gtcctgttctcagagc

SEQ ID NO: 2211281 - DNA, 23 bp, Homo sapiens
gtcctgttctcagagctccacag

SEQ ID NO: 2211282 - DNA, 23 bp, Homo sapiens
gtgagtgccacgttactcccctg

SEQ ID NO: 2211283 - DNA, 16 bp, Homo sapiens
gtgatttgaattctgt

SEQ ID NO: 2211284 - DNA, 13 bp, Homo sapiens
gtgccacagagaa

SEQ ID NO: 2211285 - DNA, 15 bp, Homo sapiens
gtgccacagagaaga

SEQ ID NO: 2211286 - DNA, 20 bp, Homo sapiens
gtgtcaaatcgatggcctgg

SEQ ID NO: 2211287 - DNA, 12 bp, Homo sapiens
gttccccaggag

SEQ ID NO: 2211288 - DNA, 21 bp, Homo sapiens
gttcctgtttgaacccaggag

SEQ ID NO: 2211289 - DNA, 15 bp, Homo sapiens
gttctcagagctcca

SEQ ID NO: 2211290 - DNA, 20 bp, Homo sapiens
gttctcagagctccacagaa

SEQ ID NO: 2211291 - DNA, 17 bp, Homo sapiens
gtttacaggaacccagc

SEQ ID NO: 2211292 - DNA, 11 bp, Homo sapiens
gtttgcctccc

SEQ ID NO: 2211293 - DNA, 16 bp, Homo sapiens
gtttgcctccctgcac

SEQ ID NO: 2211294 - DNA, 22 bp, Homo sapiens
gtttgcctccgtcccctgccca

SEQ ID NO: 2211295 - DNA, 12 bp, Homo sapiens
taaatgttacct

SEQ ID NO: 2211296 - DNA, 18 bp, Homo sapiens
taacccccagtgccacag

SEQ ID NO: 2211297 - DNA, 14 bp, Homo sapiens
taagcaacatggct

SEQ ID NO: 2211298 - DNA, 16 bp, Homo sapiens
tacaggaacccagcca

SEQ ID NO: 2211299 - DNA, 14 bp, Homo sapiens
tactcccctggctg

SEQ ID NO: 2211300 - DNA, 15 bp, Homo sapiens
tatattattgattca

SEQ ID NO: 2211301 - DNA, 16 bp, Homo sapiens
tcaatctatcaattac

SEQ ID NO: 2211302 - DNA, 16 bp, Homo sapiens
tcaggggtgactcaga

SEQ ID NO: 2211303 - DNA, 22 bp, Homo sapiens
tcaggttactcgttcttcagca

SEQ ID NO: 2211304 - DNA, 19 bp, Homo sapiens
tcatcccggagcgcacctg

SEQ ID NO: 2211305 - DNA, 21 bp, Homo sapiens
tccacagaagacacgtgtttt

SEQ ID NO: 2211306 - DNA, 22 bp, Homo sapiens
tcccaagacctcatctgcctgc

SEQ ID NO: 2211307 - DNA, 23 bp, Homo sapiens
tcccaagacctcatctgcctgca

SEQ ID NO: 2211308 - DNA, 11 bp, Homo sapiens
tccccaggagg

SEQ ID NO: 2211309 - DNA, 14 bp, Homo sapiens
tcccctgcccatgc

SEQ ID NO: 2211310 - DNA, 21 bp, Homo sapiens
tcccctgcccatgctgggagc

SEQ ID NO: 2211311 - DNA, 22 bp, Homo sapiens
tcccggagcgcacctgcttccc

SEQ ID NO: 2211312 - DNA, 15 bp, Homo sapiens
tccctgcacttcatc

SEQ ID NO: 2211313 - DNA, 14 bp, Homo sapiens
tccgaggcctacct

SEQ ID NO: 2211314 - DNA, 18 bp, Homo sapiens
tccgaggcctacctgctc

SEQ ID NO: 2211315 - DNA, 21 bp, Homo sapiens
tctaacccccagtgccacaga

SEQ ID NO: 2211316 - DNA, 17 bp, Homo sapiens
tctattttaattactgc

SEQ ID NO: 2211317 - DNA, 17 bp, Homo sapiens
tctcagagctccacaga

SEQ ID NO: 2211318 - DNA, 22 bp, Homo sapiens
tctggacggggatggttcccca

SEQ ID NO: 2211319 - DNA, 12 bp, Homo sapiens
tgaacccaggag

SEQ ID NO: 2211320 - DNA, 19 bp, Homo sapiens
tgaacccaggagagtggaa

SEQ ID NO: 2211321 - DNA, 17 bp, Homo sapiens
tgaataaacactttttc

SEQ ID NO: 2211322 - DNA, 20 bp, Homo sapiens
tgagccttcaggccagctgg

SEQ ID NO: 2211323 - DNA, 17 bp, Homo sapiens
tgaggttgggaaggcac

SEQ ID NO: 2211324 - DNA, 19 bp, Homo sapiens
tgagttgagccttcaggcc

SEQ ID NO: 2211325 - DNA, 13 bp, Homo sapiens
tgatgaataaaca

SEQ ID NO: 2211326 - DNA, 18 bp, Homo sapiens
tgattatttgcagctgcg

SEQ ID NO: 2211327 - DNA, 17 bp, Homo sapiens
cttcccccacttcacct

SEQ ID NO: 2211328 - DNA, 21 bp, Homo sapiens
cttccctacacgatccgcaac

SEQ ID NO: 2211329 - DNA, 19 bp, Homo sapiens
cttcggagaggacacttca

SEQ ID NO: 2211330 - DNA, 18 bp, Homo sapiens
ctttgctggagtcctgtt

SEQ ID NO: 2211331 - DNA, 20 bp, Homo sapiens
ctttgctggagtcctgttct

SEQ ID NO: 2211332 - DNA, 12 bp, Homo sapiens
gaaaagtgcttt

SEQ ID NO: 2211333 - DNA, 16 bp, Homo sapiens
gaagaaaaagaagctg

SEQ ID NO: 2211334 - DNA, 12 bp, Homo sapiens
gaaggacttgac

SEQ ID NO: 2211335 - DNA, 16 bp, Homo sapiens
gaccagccgcccagat

SEQ ID NO: 2211336 - DNA, 23 bp, Homo sapiens
gaccagccgcccagatcatgccg

SEQ ID NO: 2211337 - DNA, 18 bp, Homo sapiens
gaccctcccctgcctccg

SEQ ID NO: 2211338 - DNA, 15 bp, Homo sapiens
gagccttcaggccag

SEQ ID NO: 2211339 - DNA, 19 bp, Homo sapiens
gagccttcaggccagctgg

SEQ ID NO: 2211340 - DNA, 21 bp, Homo sapiens
gaggacacttcaaactgcgga

SEQ ID NO: 2211341 - DNA, 16 bp, Homo sapiens
gaggcctacctgctcc

SEQ ID NO: 2211342 - DNA, 17 bp, Homo sapiens
gaggcctacctgctccc

SEQ ID NO: 2211343 - DNA, 14 bp, Homo sapiens
gaggttgggaaggc

SEQ ID NO: 2211344 - DNA, 19 bp, Homo sapiens
gaggttgggaaggcacctg

SEQ ID NO: 2211345 - DNA, 16 bp, Homo sapiens
gagtcctgttctcaga

SEQ ID NO: 2211346 - DNA, 18 bp, Homo sapiens
gagtcctgttctcagagc

SEQ ID NO: 2211347 - DNA, 17 bp, Homo sapiens
gatgaataaacactttt

SEQ ID NO: 2211348 - DNA, 13 bp, Homo sapiens
gatggttccccag

SEQ ID NO: 2211349 - DNA, 17 bp, Homo sapiens
gatggttccccaggagg

SEQ ID NO: 2211350 - DNA, 13 bp, Homo sapiens
gattgggactgag

SEQ ID NO: 2211351 - DNA, 16 bp, Homo sapiens
gcacctgctcccacag

SEQ ID NO: 2211352 - DNA, 12 bp, Homo sapiens
gcacttcatccc

SEQ ID NO: 2211353 - DNA, 24 bp, Homo sapiens
gcacttcatcccggagcgcacctg

SEQ ID NO: 2211354 - DNA, 23 bp, Homo sapiens
gcagtgtcaaatcgatggcctgg

SEQ ID NO: 2211355 - DNA, 21 bp, Homo sapiens
gccacgttactcccctggctg

SEQ ID NO: 2211356 - DNA, 17 bp, Homo sapiens
gccagagtttgcctccc

SEQ ID NO: 2211357 - DNA, 18 bp, Homo sapiens
gccagctgggtttagccc

SEQ ID NO: 2211358 - DNA, 14 bp, Homo sapiens
gccctccaggcttt

SEQ ID NO: 2211359 - DNA, 17 bp, Homo sapiens
gccgcccagatcatgcc

SEQ ID NO: 2211360 - DNA, 16 bp, Homo sapiens
gcctacttaattctga

SEQ ID NO: 2211361 - DNA, 14 bp, Homo sapiens
gcctccctgcactt

SEQ ID NO: 2211362 - DNA, 18 bp, Homo sapiens
gcctccgtcccctgccca

SEQ ID NO: 2211363 - DNA, 14 bp, Homo sapiens
gccttcaggccagc

SEQ ID NO: 2211364 - DNA, 16 bp, Homo sapiens
gccttcaggccagctg

SEQ ID NO: 2211365 - DNA, 17 bp, Homo sapiens
gccttcaggccagctgg

SEQ ID NO: 2211366 - DNA, 14 bp, Homo sapiens
gcgactcccagctc

SEQ ID NO: 2211367 - DNA, 15 bp, Homo sapiens
gcgactcccagctcc

SEQ ID NO: 2211368 - DNA, 13 bp, Homo sapiens
gcgcacctgcttc

SEQ ID NO: 2211369 - DNA, 12 bp, Homo sapiens
gctgaaaagtgc

SEQ ID NO: 2211370 - DNA, 17 bp, Homo sapiens
gctgaggttgggaaggc

SEQ ID NO: 2211371 - DNA, 20 bp, Homo sapiens
gctgggtttagcccgaggct

SEQ ID NO: 2211372 - DNA, 21 bp, Homo sapiens
gctgggtttagcccgaggctg

SEQ ID NO: 2211373 - DNA, 20 bp, Homo sapiens
gctggtcttagatgcagcga

SEQ ID NO: 2211374 - DNA, 18 bp, Homo sapiens
gcttcccccacttcacct

SEQ ID NO: 2211375 - DNA, 19 bp, Homo sapiens
gcttcccccacttcacctt

SEQ ID NO: 2211376 - DNA, 21 bp, Homo sapiens
ggaacgcaagaggcatcccaa

SEQ ID NO: 2211377 - DNA, 13 bp, Homo sapiens
ggaaggcacctgc

SEQ ID NO: 2211378 - DNA, 23 bp, Homo sapiens
ggacggggatggttccccaggag

SEQ ID NO: 2211379 - DNA, 16 bp, Homo sapiens
ggactgagtgctgagg

SEQ ID NO: 2211380 - DNA, 18 bp, Homo sapiens
ggagaccctcccctgcct

SEQ ID NO: 2211381 - DNA, 14 bp, Homo sapiens
ggagcgcacctgct

SEQ ID NO: 2211382 - DNA, 17 bp, Homo sapiens
ggagtcctgttctcaga

SEQ ID NO: 2211383 - DNA, 20 bp, Homo sapiens
ggagtcctgttctcagagct

SEQ ID NO: 2211384 - DNA, 21 bp, Homo sapiens
ggagtcctgttctcagagctc

SEQ ID NO: 2211385 - DNA, 18 bp, Homo sapiens
ggatggttccccaggagg

SEQ ID NO: 2211386 - DNA, 13 bp, Homo sapiens
ggcacctgctccc

SEQ ID NO: 2211387 - DNA, 23 bp, Homo sapiens
ggcatcccaagacctcatctgcc

SEQ ID NO: 2211388 - DNA, 14 bp, Homo sapiens
ggccagctgggttt

SEQ ID NO: 2211389 - DNA, 16 bp, Homo sapiens
ggcctacctgctcccc

SEQ ID NO: 2211390 - DNA, 19 bp, Homo sapiens
ggctgaaaagtgctttgct

SEQ ID NO: 2211391 - DNA, 24 bp, Homo sapiens
gggaaggcacctgctcccacagaa

SEQ ID NO: 2211392 - DNA, 19 bp, Homo sapiens
gggatggttccccaggagg

SEQ ID NO: 2211393 - DNA, 22 bp, Homo sapiens
ggttcctgtttgaacccaggag

SEQ ID NO: 2211394 - DNA, 16 bp, Homo sapiens
ggttgggaaggcacct

SEQ ID NO: 2211395 - DNA, 17 bp, Homo sapiens
ggttgggggcaccatct

SEQ ID NO: 2211396 - DNA, 15 bp, Homo sapiens
gtccgtccaccacct

SEQ ID NO: 2211397 - DNA, 14 bp, Homo sapiens
gtcctgttctcaga

SEQ ID NO: 2211398 - DNA, 15 bp, Homo sapiens
gtcctgttctcagag

SEQ ID NO: 2211399 - DNA, 17 bp, Homo sapiens
gtcctgttctcagagct

SEQ ID NO: 2211400 - DNA, 15 bp, Homo sapiens
gtctaagcaatactt

SEQ ID NO: 2211401 - DNA, 21 bp, Homo sapiens
gtcttagatgcagcgactgtt

SEQ ID NO: 2211402 - DNA, 12 bp, Homo sapiens
gtgccacagaga

SEQ ID NO: 2211403 - DNA, 23 bp, Homo sapiens
gttacctctattttaattactgc

SEQ ID NO: 2211404 - DNA, 17 bp, Homo sapiens
gttactcccctggctgg

SEQ ID NO: 2211405 - DNA, 14 bp, Homo sapiens
gttctcagagctcc

SEQ ID NO: 2211406 - DNA, 19 bp, Homo sapiens
gttctcagagctccacaga

SEQ ID NO: 2211407 - DNA, 19 bp, Homo sapiens
gttgagccttcaggccagc

SEQ ID NO: 2211408 - DNA, 18 bp, Homo sapiens
gttgggggcaccatctgg

SEQ ID NO: 2211409 - DNA, 17 bp, Homo sapiens
gtttgatgtgagttgag

SEQ ID NO: 2211410 - DNA, 16 bp, Homo sapiens
taaaaggatgtataaa

SEQ ID NO: 2211411 - DNA, 12 bp, Homo sapiens
taaagacttgat

SEQ ID NO: 2211412 - DNA, 17 bp, Homo sapiens
taaagacttgatgaata

SEQ ID NO: 2211413 - DNA, 18 bp, Homo sapiens
taaagacttgatgaataa

SEQ ID NO: 2211414 - DNA, 20 bp, Homo sapiens
taacccccagtgccacagag

SEQ ID NO: 2211415 - DNA, 16 bp, Homo sapiens
taagcaacatggcttt

SEQ ID NO: 2211416 - DNA, 17 bp, Homo sapiens
taagcaacatggctttg

SEQ ID NO: 2211417 - DNA, 20 bp, Homo sapiens
taattctgataaacctgtct

SEQ ID NO: 2211418 - DNA, 13 bp, Homo sapiens
taatttcaaatgt

SEQ ID NO: 2211419 - DNA, 19 bp, Homo sapiens
tacaggaacccagccagag

SEQ ID NO: 2211420 - DNA, 18 bp, Homo sapiens
tcaccttcggagaggaca

SEQ ID NO: 2211421 - DNA, 23 bp, Homo sapiens
tcagaagaaaaagaagctgagga

SEQ ID NO: 2211422 - DNA, 21 bp, Homo sapiens
tcatcccggagcgcacctgct

SEQ ID NO: 2211423 - DNA, 16 bp, Homo sapiens
tcatgccgccgcagct

SEQ ID NO: 2211424 - DNA, 17 bp, Homo sapiens
tccaagctcactcccca

SEQ ID NO: 2211425 - DNA, 22 bp, Homo sapiens
tccacagaagacacgtgttttt

SEQ ID NO: 2211426 - DNA, 19 bp, Homo sapiens
tcccaagacctcatctgcc

SEQ ID NO: 2211427 - DNA, 12 bp, Homo sapiens
tcccctggctgg

SEQ ID NO: 2211428 - DNA, 13 bp, Homo sapiens
tccctgcacttca

SEQ ID NO: 2211429 - DNA, 23 bp, Homo sapiens
tccgagtgtgatttgaattctgt

SEQ ID NO: 2211430 - DNA, 18 bp, Homo sapiens
tcctgtttgaacccagga

SEQ ID NO: 2211431 - DNA, 19 bp, Homo sapiens
tcctgtttgaacccaggag

SEQ ID NO: 2211432 - DNA, 22 bp, Homo sapiens
tctaacccccagtgccacagag

SEQ ID NO: 2211433 - DNA, 14 bp, Homo sapiens
tctgattatttgca

SEQ ID NO: 2211434 - DNA, 13 bp, Homo sapiens
tcttggggaagat

SEQ ID NO: 2211435 - DNA, 16 bp, Homo sapiens
tcttttcccacattca

SEQ ID NO: 2211436 - DNA, 13 bp, Homo sapiens
tgaacccaggaga

SEQ ID NO: 2211437 - DNA, 18 bp, Homo sapiens
tgagccttcaggccagct

SEQ ID NO: 2211438 - DNA, 14 bp, Homo sapiens
tgataaacctgtct

SEQ ID NO: 2211439 - DNA, 17 bp, Homo sapiens
tgatgaataaacacttt

SEQ ID NO: 2211440 - DNA, 13 bp, Homo sapiens
tgccacagagaag

SEQ ID NO: 2211441 - DNA, 15 bp, Homo sapiens
tgccacctcccccca

SEQ ID NO: 2211442 - DNA, 15 bp, Homo sapiens
tgccctggaccagcc

SEQ ID NO: 2211443 - DNA, 15 bp, Homo sapiens
tgccgccgcagctgg

SEQ ID NO: 2211444 - DNA, 22 bp, Homo sapiens
tgcctccctgcacttcatcccg

SEQ ID NO: 2211445 - DNA, 21 bp, Homo sapiens
tgctgaggttgggaaggcacc

SEQ ID NO: 2211446 - DNA, 23 bp, Homo sapiens
tgctggagtcctgttctcagagc

SEQ ID NO: 2211447 - DNA, 14 bp, Homo sapiens
tgcttcccccactt

SEQ ID NO: 2211448 - DNA, 15 bp, Homo sapiens
tgctttgctggagtc

SEQ ID NO: 2211449 - DNA, 20 bp, Homo sapiens
tggaagagagattgggactg

SEQ ID NO: 2211450 - DNA, 17 bp, Homo sapiens
tggagtcctgttctcag

SEQ ID NO: 2211451 - DNA, 18 bp, Homo sapiens
tggagtcctgttctcaga

SEQ ID NO: 2211452 - DNA, 16 bp, Homo sapiens
tggctttgatgataaa

SEQ ID NO: 2211453 - DNA, 16 bp, Homo sapiens
tgggactgagtgctga

SEQ ID NO: 2211454 - DNA, 16 bp, Homo sapiens
tgtacccaatttaatt

SEQ ID NO: 2211455 - DNA, 23 bp, Homo sapiens
tgtcattcaggaccccaacccct

SEQ ID NO: 2211456 - DNA, 16 bp, Homo sapiens
tgtgatttgaattctg

SEQ ID NO: 2211457 - DNA, 14 bp, Homo sapiens
ctgcttcccccact

SEQ ID NO: 2211458 - DNA, 20 bp, Homo sapiens
ctgcttcccccacttcacct

SEQ ID NO: 2211459 - DNA, 22 bp, Homo sapiens
ctggacggggatggttccccag

SEQ ID NO: 2211460 - DNA, 15 bp, Homo sapiens
ctggagtcctgttct

SEQ ID NO: 2211461 - DNA, 16 bp, Homo sapiens
ctggagtcctgttctc

SEQ ID NO: 2211462 - DNA, 14 bp, Homo sapiens
ctgttctcagagct

SEQ ID NO: 2211463 - DNA, 18 bp, Homo sapiens
ctgtttgaacccaggaga

SEQ ID NO: 2211464 - DNA, 15 bp, Homo sapiens
cttaattctgataaa

SEQ ID NO: 2211465 - DNA, 16 bp, Homo sapiens
cttcaggccagctggg

SEQ ID NO: 2211466 - DNA, 22 bp, Homo sapiens
gaagatccgagtgtgatttgaa

SEQ ID NO: 2211467 - DNA, 18 bp, Homo sapiens
gaagctgttggggggctg

SEQ ID NO: 2211468 - DNA, 13 bp, Homo sapiens
gaaggcacctgct

SEQ ID NO: 2211469 - DNA, 14 bp, Homo sapiens
gaaggcacctgctc

SEQ ID NO: 2211470 - DNA, 12 bp, Homo sapiens
gaataaacactt

SEQ ID NO: 2211471 - DNA, 19 bp, Homo sapiens
gaataaacactttttctgg

SEQ ID NO: 2211472 - DNA, 22 bp, Homo sapiens
gaccagccgcccagatcatgcc

SEQ ID NO: 2211473 - DNA, 17 bp, Homo sapiens
gaccctcccctgcctcc

SEQ ID NO: 2211474 - DNA, 16 bp, Homo sapiens
gacctcatctgcctgc

SEQ ID NO: 2211475 - DNA, 23 bp, Homo sapiens
gacctcatctgcctgcagtgtca

SEQ ID NO: 2211476 - DNA, 16 bp, Homo sapiens
gacttgatgaataaac

SEQ ID NO: 2211477 - DNA, 17 bp, Homo sapiens
gacttgatgaataaaca

SEQ ID NO: 2211478 - DNA, 14 bp, Homo sapiens
gagccttcaggcca

SEQ ID NO: 2211479 - DNA, 16 bp, Homo sapiens
gagccttcaggccagc

SEQ ID NO: 2211480 - DNA, 19 bp, Homo sapiens
gaggagaccctcccctgcc

SEQ ID NO: 2211481 - DNA, 19 bp, Homo sapiens
gagtgccacgttactcccc

SEQ ID NO: 2211482 - DNA, 13 bp, Homo sapiens
gagtttgcctccc

SEQ ID NO: 2211483 - DNA, 18 bp, Homo sapiens
gatccgcaacccatgccc

SEQ ID NO: 2211484 - DNA, 22 bp, Homo sapiens
gatccgcaacccatgccctgga

SEQ ID NO: 2211485 - DNA, 23 bp, Homo sapiens
gatccgcaacccatgccctggac

SEQ ID NO: 2211486 - DNA, 12 bp, Homo sapiens
gatggcctggcc

SEQ ID NO: 2211487 - DNA, 16 bp, Homo sapiens
gatggttccccaggag

SEQ ID NO: 2211488 - DNA, 18 bp, Homo sapiens
gatttgaagctgtaccca

SEQ ID NO: 2211489 - DNA, 22 bp, Homo sapiens
gcaacccatgccctggaccagc

SEQ ID NO: 2211490 - DNA, 19 bp, Homo sapiens
gcaagaggcatcccaagac

SEQ ID NO: 2211491 - DNA, 23 bp, Homo sapiens
gcaagaggcatcccaagacctca

SEQ ID NO: 2211492 - DNA, 15 bp, Homo sapiens
gcaccatctggacgg

SEQ ID NO: 2211493 - DNA, 23 bp, Homo sapiens
gcacctgcttcccccacttcacc

SEQ ID NO: 2211494 - DNA, 17 bp, Homo sapiens
gcacttcatcccggagc

SEQ ID NO: 2211495 - DNA, 15 bp, Homo sapiens
gcagcgactgtttca

SEQ ID NO: 2211496 - DNA, 16 bp, Homo sapiens
gcagctgcgatggatg

SEQ ID NO: 2211497 - DNA, 12 bp, Homo sapiens
gccacagagaag

SEQ ID NO: 2211498 - DNA, 13 bp, Homo sapiens
gccacagagaaga

SEQ ID NO: 2211499 - DNA, 20 bp, Homo sapiens
gccacgttactcccctggct

SEQ ID NO: 2211500 - DNA, 14 bp, Homo sapiens
gccagagtttgcct

SEQ ID NO: 2211501 - DNA, 20 bp, Homo sapiens
gccagagtttgcctccctgc

SEQ ID NO: 2211502 - DNA, 15 bp, Homo sapiens
gcccagatcatgccg

SEQ ID NO: 2211503 - DNA, 16 bp, Homo sapiens
gcccagatcatgccgc

SEQ ID NO: 2211504 - DNA, 15 bp, Homo sapiens
gccctggaccagccg

SEQ ID NO: 2211505 - DNA, 13 bp, Homo sapiens
gcctacctgctcc

SEQ ID NO: 2211506 - DNA, 22 bp, Homo sapiens
gctcccacagaagggggaacgc

SEQ ID NO: 2211507 - DNA, 14 bp, Homo sapiens
gctgaaaagtgctt

SEQ ID NO: 2211508 - DNA, 16 bp, Homo sapiens
gctgaggttgggaagg

SEQ ID NO: 2211509 - DNA, 22 bp, Homo sapiens
gctgaggttgggaaggcacctg

SEQ ID NO: 2211510 - DNA, 23 bp, Homo sapiens
gctgaggttgggaaggcacctgc

SEQ ID NO: 2211511 - DNA, 19 bp, Homo sapiens
gctggagtcctgttctcag

SEQ ID NO: 2211512 - DNA, 22 bp, Homo sapiens
gcttctgattatttgcagctgc

SEQ ID NO: 2211513 - DNA, 23 bp, Homo sapiens
gcttctgattatttgcagctgcg

SEQ ID NO: 2211514 - DNA, 14 bp, Homo sapiens
ggaacccagccaga

SEQ ID NO: 2211515 - DNA, 14 bp, Homo sapiens
ggactgagtgctga

SEQ ID NO: 2211516 - DNA, 17 bp, Homo sapiens
ggagaccctcccctgcc

SEQ ID NO: 2211517 - DNA, 20 bp, Homo sapiens
ggagcccacgctcaccccct

SEQ ID NO: 2211518 - DNA, 17 bp, Homo sapiens
ggagcgcacctgcttcc

SEQ ID NO: 2211519 - DNA, 22 bp, Homo sapiens
ggaggagaccctcccctgcctc

SEQ ID NO: 2211520 - DNA, 14 bp, Homo sapiens
ggagtcctgttctc

SEQ ID NO: 2211521 - DNA, 15 bp, Homo sapiens
ggcctacctgctccc

SEQ ID NO: 2211522 - DNA, 23 bp, Homo sapiens
ggcgcatgcatgggaggaattca

SEQ ID NO: 2211523 - DNA, 13 bp, Homo sapiens
ggctgaaaagtgc

SEQ ID NO: 2211524 - DNA, 22 bp, Homo sapiens
ggcttctgattatttgcagctg

SEQ ID NO: 2211525 - DNA, 18 bp, Homo sapiens
gggaaggcacctgctccc

SEQ ID NO: 2211526 - DNA, 15 bp, Homo sapiens
gggcaccatctggac

SEQ ID NO: 2211527 - DNA, 14 bp, Homo sapiens
ggggcaccatctgg

SEQ ID NO: 2211528 - DNA, 15 bp, Homo sapiens
gggtgactcagaaga

SEQ ID NO: 2211529 - DNA, 13 bp, Homo sapiens
ggttccccaggag

SEQ ID NO: 2211530 - DNA, 23 bp, Homo sapiens
ggttcctgtttgaacccaggaga

SEQ ID NO: 2211531 - DNA, 19 bp, Homo sapiens
ggttgggaaggcacctgct

SEQ ID NO: 2211532 - DNA, 15 bp, Homo sapiens
ggttgggggcaccat

SEQ ID NO: 2211533 - DNA, 20 bp, Homo sapiens
ggttgggggcaccatctgga

SEQ ID NO: 2211534 - DNA, 12 bp, Homo sapiens
ggtttagcccga

SEQ ID NO: 2211535 - DNA, 13 bp, Homo sapiens
gtgactcagaaga

SEQ ID NO: 2211536 - DNA, 19 bp, Homo sapiens
gtggaagagagattgggac

SEQ ID NO: 2211537 - DNA, 21 bp, Homo sapiens
gtggtaagcaacatggctttg

SEQ ID NO: 2211538 - DNA, 19 bp, Homo sapiens
gttcctgtttgaacccagg

SEQ ID NO: 2211539 - DNA, 22 bp, Homo sapiens
gttcctgtttgaacccaggaga

SEQ ID NO: 2211540 - DNA, 13 bp, Homo sapiens
gttctcagagctc

SEQ ID NO: 2211541 - DNA, 18 bp, Homo sapiens
gttgggaaggcacctgct

SEQ ID NO: 2211542 - DNA, 20 bp, Homo sapiens
gtttaaataaaatttaattt

SEQ ID NO: 2211543 - DNA, 13 bp, Homo sapiens
gtttgaacccagg

SEQ ID NO: 2211544 - DNA, 13 bp, Homo sapiens
taaacactttttc

SEQ ID NO: 2211545 - DNA, 23 bp, Homo sapiens
taaagacttgatgaataaacact

SEQ ID NO: 2211546 - DNA, 19 bp, Homo sapiens
taacccccagtgccacaga

SEQ ID NO: 2211547 - DNA, 23 bp, Homo sapiens
taacccccagtgccacagagaag

SEQ ID NO: 2211548 - DNA, 21 bp, Homo sapiens
taattactgctataaataggt

SEQ ID NO: 2211549 - DNA, 15 bp, Homo sapiens
tataaatttttacct

SEQ ID NO: 2211550 - DNA, 19 bp, Homo sapiens
tcaaatcgatggcctggcc

SEQ ID NO: 2211551 - DNA, 16 bp, Homo sapiens
tcacactggtaaatgt

SEQ ID NO: 2211552 - DNA, 20 bp, Homo sapiens
tcagaagaaaaagaagctga

SEQ ID NO: 2211553 - DNA, 23 bp, Homo sapiens
tgcctccgtcccctgcccatgct

SEQ ID NO: 2211554 - DNA, 17 bp, Homo sapiens
tgctggagtcctgttct

SEQ ID NO: 2211555 - DNA, 18 bp, Homo sapiens
tgctggagtcctgttctc

SEQ ID NO: 2211556 - DNA, 14 bp, Homo sapiens
tgctggtgagtgcc

SEQ ID NO: 2211557 - DNA, 23 bp, Homo sapiens
tgctttgctggagtcctgttctc

SEQ ID NO: 2211558 - DNA, 15 bp, Homo sapiens
tggagtcctgttctc

SEQ ID NO: 2211559 - DNA, 22 bp, Homo sapiens
tggagtcctgttctcagagctc

SEQ ID NO: 2211560 - DNA, 18 bp, Homo sapiens
tggattaaaaaaaaatgt

SEQ ID NO: 2211561 - DNA, 19 bp, Homo sapiens
tgggtttagcccgaggctg

SEQ ID NO: 2211562 - DNA, 18 bp, Homo sapiens
tggtaagcaacatggctt

SEQ ID NO: 2211563 - DNA, 19 bp, Homo sapiens
tgtacccaatttaattcca

SEQ ID NO: 2211564 - DNA, 22 bp, Homo sapiens
tgtcaaatcgatggcctggcct

SEQ ID NO: 2211565 - DNA, 15 bp, Homo sapiens
tgtgatttgaattct

SEQ ID NO: 2211566 - DNA, 14 bp, Homo sapiens
tgttctcagagctc

SEQ ID NO: 2211567 - DNA, 16 bp, Homo sapiens
tgttctcagagctcca

SEQ ID NO: 2211568 - DNA, 22 bp, Homo sapiens
tgttctcagagctccacagaag

SEQ ID NO: 2211569 - DNA, 13 bp, Homo sapiens
tgttgtgcctact

SEQ ID NO: 2211570 - DNA, 16 bp, Homo sapiens
tgtttgaacccaggag

SEQ ID NO: 2211571 - DNA, 16 bp, Homo sapiens
ttaaaaggatgtataa

SEQ ID NO: 2211572 - DNA, 22 bp, Homo sapiens
ttaaagacttgatgaataaaca

SEQ ID NO: 2211573 - DNA, 23 bp, Homo sapiens
ttaaagacttgatgaataaacac

SEQ ID NO: 2211574 - DNA, 14 bp, Homo sapiens
ttaaataaaattta

SEQ ID NO: 2211575 - DNA, 15 bp, Homo sapiens
ttacaggaacccagc

SEQ ID NO: 2211576 - DNA, 18 bp, Homo sapiens
ttcacactggtaaatgtt

SEQ ID NO: 2211577 - DNA, 14 bp, Homo sapiens
ttcaggccagctgg

SEQ ID NO: 2211578 - DNA, 13 bp, Homo sapiens
ttcccctcttccc

SEQ ID NO: 2211579 - DNA, 18 bp, Homo sapiens
ttcctgtttgaacccagg

SEQ ID NO: 2211580 - DNA, 20 bp, Homo sapiens
ttcctgtttgaacccaggag

SEQ ID NO: 2211581 - DNA, 12 bp, Homo sapiens
ttgaacccagga

SEQ ID NO: 2211582 - DNA, 13 bp, Homo sapiens
ttgaacccaggag

SEQ ID NO: 2211583 - DNA, 22 bp, Homo sapiens
ttgaacccaggagagtggaaga

SEQ ID NO: 2211584 - DNA, 15 bp, Homo sapiens
ttgagccttcaggcc

SEQ ID NO: 2211585 - DNA, 17 bp, Homo sapiens
ttgatgaataaacactt

SEQ ID NO: 2211586 - DNA, 16 bp, Homo sapiens
ttgctggagtcctgtt

SEQ ID NO: 2211587 - DNA, 18 bp, Homo sapiens
ttgtatctttaaagactt

SEQ ID NO: 2211588 - DNA, 17 bp, Homo sapiens
tttaaaaggatgtataa

SEQ ID NO: 2211589 - DNA, 21 bp, Homo sapiens
tttcacactggtaaatgttac

SEQ ID NO: 2211590 - DNA, 21 bp, Homo sapiens
ttttaattactgctataaata

SEQ ID NO: 2211591 - DNA, 21 bp, Homo sapiens
ttttcacactggtaaatgtta

SEQ ID NO: 2211592 - DNA, 22 bp, Homo sapiens
ttttgtatctttaaagacttga

SEQ ID NO: 2211593 - DNA, 18 bp, Homo sapiens
aacccccagtgccacaga

SEQ ID NO: 2211594 - DNA, 20 bp, Homo sapiens
aacccccagtgccacagaga

SEQ ID NO: 2211595 - DNA, 14 bp, Homo sapiens
aagacacgtgtttt

SEQ ID NO: 2211596 - DNA, 18 bp, Homo sapiens
aagacctcatctgcctgc

SEQ ID NO: 2211597 - DNA, 19 bp, Homo sapiens
aagacttgatgaataaaca

SEQ ID NO: 2211598 - DNA, 23 bp, Homo sapiens
aagatccgagtgtgatttgaatt

SEQ ID NO: 2211599 - DNA, 11 bp, Homo sapiens
aagctgtaccc

SEQ ID NO: 2211600 - DNA, 19 bp, Homo sapiens
aagctgttggggggctgag

SEQ ID NO: 2211601 - DNA, 12 bp, Homo sapiens
aaggcacctgct

SEQ ID NO: 2211602 - DNA, 13 bp, Homo sapiens
aaggcacctgctc

SEQ ID NO: 2211603 - DNA, 21 bp, Homo sapiens
aagtgctttgctggagtcctg

SEQ ID NO: 2211604 - DNA, 19 bp, Homo sapiens
aattctgataaacctgtct

SEQ ID NO: 2211605 - DNA, 16 bp, Homo sapiens
acaaggctgaaaagtg

SEQ ID NO: 2211606 - DNA, 20 bp, Homo sapiens
acaaggctgaaaagtgcttt

SEQ ID NO: 2211607 - DNA, 14 bp, Homo sapiens
acaagtgccctcca

SEQ ID NO: 2211608 - DNA, 22 bp, Homo sapiens
acacgatccgcaacccatgccc

SEQ ID NO: 2211609 - DNA, 20 bp, Homo sapiens
acacttcaaactgcggacac

SEQ ID NO: 2211610 - DNA, 16 bp, Homo sapiens
acagaagacacgtgtt

SEQ ID NO: 2211611 - DNA, 21 bp, Homo sapiens
acccaatttaattccataatc

SEQ ID NO: 2211612 - DNA, 13 bp, Homo sapiens
acccatgccctgg

SEQ ID NO: 2211613 - DNA, 16 bp, Homo sapiens
acccatgccctggacc

SEQ ID NO: 2211614 - DNA, 23 bp, Homo sapiens
acccatgccctggaccagccgcc

SEQ ID NO: 2211615 - DNA, 16 bp, Homo sapiens
acccccagtgccacag

SEQ ID NO: 2211616 - DNA, 18 bp, Homo sapiens
acccccagtgccacagag

SEQ ID NO: 2211617 - DNA, 14 bp, Homo sapiens
accctcccctgcct

SEQ ID NO: 2211618 - DNA, 16 bp, Homo sapiens
acctctattttaatta

SEQ ID NO: 2211619 - DNA, 14 bp, Homo sapiens
acctgctcccacag

SEQ ID NO: 2211620 - DNA, 14 bp, Homo sapiens
acctgctcccctca

SEQ ID NO: 2211621 - DNA, 14 bp, Homo sapiens
acctgcttccccca

SEQ ID NO: 2211622 - DNA, 19 bp, Homo sapiens
acctgcttcccccacttca

SEQ ID NO: 2211623 - DNA, 16 bp, Homo sapiens
acctgtctaagcaata

SEQ ID NO: 2211624 - DNA, 13 bp, Homo sapiens
acctgtttaaata

SEQ ID NO: 2211625 - DNA, 19 bp, Homo sapiens
acggggatggttccccagg

SEQ ID NO: 2211626 - DNA, 16 bp, Homo sapiens
actgctgttcccctct

SEQ ID NO: 2211627 - DNA, 21 bp, Homo sapiens
actgctgttcccctcttccct

SEQ ID NO: 2211628 - DNA, 14 bp, Homo sapiens
acttgatgaataaa

SEQ ID NO: 2211629 - DNA, 15 bp, Homo sapiens
acttgatgaataaac

SEQ ID NO: 2211630 - DNA, 17 bp, Homo sapiens
acttgatgaataaacac

SEQ ID NO: 2211631 - DNA, 16 bp, Homo sapiens
agaagacacgtgtttt

SEQ ID NO: 2211632 - DNA, 17 bp, Homo sapiens
agaagacacgtgttttt

SEQ ID NO: 2211633 - DNA, 21 bp, Homo sapiens
agaagacgggatttgaagctg

SEQ ID NO: 2211634 - DNA, 15 bp, Homo sapiens
agacacgtgtttttg

SEQ ID NO: 2211635 - DNA, 19 bp, Homo sapiens
agaccacaaggctgaaaag

SEQ ID NO: 2211636 - DNA, 22 bp, Homo sapiens
agaccacaaggctgaaaagtgc

SEQ ID NO: 2211637 - DNA, 17 bp, Homo sapiens
agaccctcccctgcctc

SEQ ID NO: 2211638 - DNA, 19 bp, Homo sapiens
agaccctcccctgcctccg

SEQ ID NO: 2211639 - DNA, 18 bp, Homo sapiens
agacctcatctgcctgca

SEQ ID NO: 2211640 - DNA, 21 bp, Homo sapiens
agacctcatctgcctgcagtg

SEQ ID NO: 2211641 - DNA, 24 bp, Homo sapiens
agagagattgggactgagtgctga

SEQ ID NO: 2211642 - DNA, 18 bp, Homo sapiens
agagattgggactgagtg

SEQ ID NO: 2211643 - DNA, 22 bp, Homo sapiens
agaggacacttcaaactgcgga

SEQ ID NO: 2211644 - DNA, 18 bp, Homo sapiens
agaggcatcccaagacct

SEQ ID NO: 2211645 - DNA, 23 bp, Homo sapiens
agaggttcctgtttgaacccagg

SEQ ID NO: 2211646 - DNA, 14 bp, Homo sapiens
agagtttgcctccc

SEQ ID NO: 2211647 - DNA, 19 bp, Homo sapiens
agagtttgcctccctgcac

SEQ ID NO: 2211648 - DNA, 21 bp, Homo sapiens
agagtttgcctccctgcactt

SEQ ID NO: 2211649 - DNA, 21 bp, Homo sapiens
agattgggactgagtgctgag

SEQ ID NO: 2211650 - DNA, 13 bp, Homo sapiens
agcaacatggctt

SEQ ID NO: 2211651 - DNA, 18 bp, Homo sapiens
agcccacgctcaccccct

SEQ ID NO: 2211652 - DNA, 15 bp, Homo sapiens
agccttcaggccagc

SEQ ID NO: 2211653 - DNA, 13 bp, Homo sapiens
agcgactcccagc

SEQ ID NO: 2211654 - DNA, 16 bp, Homo sapiens
agcgactcccagctcc

SEQ ID NO: 2211655 - DNA, 18 bp, Homo sapiens
agctgggtttagcccgag

SEQ ID NO: 2211656 - DNA, 15 bp, Homo sapiens
agctgtcattcagga

SEQ ID NO: 2211657 - DNA, 18 bp, Homo sapiens
aggagaccctcccctgcc

SEQ ID NO: 2211658 - DNA, 11 bp, Homo sapiens
aggcacctgct

SEQ ID NO: 2211659 - DNA, 23 bp, Homo sapiens
aggcatcccaagacctcatctgc

SEQ ID NO: 2211660 - DNA, 16 bp, Homo sapiens
aggcctacctgctccc

SEQ ID NO: 2211661 - DNA, 17 bp, Homo sapiens
aggcctacctgctcccc

SEQ ID NO: 2211662 - DNA, 14 bp, Homo sapiens
aggctgaaaagtgc

SEQ ID NO: 2211663 - DNA, 22 bp, Homo sapiens
aggttactcgttcttcagcaag

SEQ ID NO: 2211664 - DNA, 23 bp, Homo sapiens
aggttcctgtttgaacccaggag

SEQ ID NO: 2211665 - DNA, 20 bp, Homo sapiens
aggttgggaaggcacctgct

SEQ ID NO: 2211666 - DNA, 14 bp, Homo sapiens
agtcctgttctcag

SEQ ID NO: 2211667 - DNA, 19 bp, Homo sapiens
agtcctgttctcagagctc

SEQ ID NO: 2211668 - DNA, 10 bp, Homo sapiens
agtgccacag

SEQ ID NO: 2211669 - DNA, 15 bp, Homo sapiens
agtgccacagagaag

SEQ ID NO: 2211670 - DNA, 19 bp, Homo sapiens
agtgccacgttactcccct

SEQ ID NO: 2211671 - DNA, 21 bp, Homo sapiens
agtgccacgttactcccctgg

SEQ ID NO: 2211672 - DNA, 19 bp, Homo sapiens
agtgtgatttgaattctgt

SEQ ID NO: 2211673 - DNA, 15 bp, Homo sapiens
ataaacactttttct

SEQ ID NO: 2211674 - DNA, 20 bp, Homo sapiens
ataaacctgtctaagcaata

SEQ ID NO: 2211675 - DNA, 16 bp, Homo sapiens
atccccaagctggcag

SEQ ID NO: 2211676 - DNA, 19 bp, Homo sapiens
atcccggagcgcacctgct

SEQ ID NO: 2211677 - DNA, 16 bp, Homo sapiens
atccgcaacccatgcc

SEQ ID NO: 2211678 - DNA, 15 bp, Homo sapiens
atctgcctgcagtgt

SEQ ID NO: 2211679 - DNA, 21 bp, Homo sapiens
atctttaaagacttgatgaat

SEQ ID NO: 2211680 - DNA, 14 bp, Homo sapiens
atgggaggaattca

SEQ ID NO: 2211681 - DNA, 14 bp, Homo sapiens
atggttccccagga

SEQ ID NO: 2211682 - DNA, 13 bp, Homo sapiens
atttcaggttact

SEQ ID NO: 2211683 - DNA, 20 bp, Homo sapiens
attttaattactgctataaa

SEQ ID NO: 2211684 - DNA, 17 bp, Homo sapiens
atttttacctgtttaaa

SEQ ID NO: 2211685 - DNA, 17 bp, Homo sapiens
caaaagcgactcccagc

SEQ ID NO: 2211686 - DNA, 19 bp, Homo sapiens
caaatcgatggcctggcct

SEQ ID NO: 2211687 - DNA, 22 bp, Homo sapiens
caacagagaggttcctgtttga

SEQ ID NO: 2211688 - DNA, 12 bp, Homo sapiens
caacatggcttt

SEQ ID NO: 2211689 - DNA, 13 bp, Homo sapiens
caacatggctttg

SEQ ID NO: 2211690 - DNA, 19 bp, Homo sapiens
caacccatgccctggacca

SEQ ID NO: 2211691 - DNA, 23 bp, Homo sapiens
caagacctcatctgcctgcagtg

SEQ ID NO: 2211692 - DNA, 21 bp, Homo sapiens
cacaagtgccctccaggcttt

SEQ ID NO: 2211693 - DNA, 10 bp, Homo sapiens
caccatctgg

SEQ ID NO: 2211694 - DNA, 18 bp, Homo sapiens
caccatctggacggggat

SEQ ID NO: 2211695 - DNA, 18 bp, Homo sapiens
caccccctcacccctcca

SEQ ID NO: 2211696 - DNA, 14 bp, Homo sapiens
cacctgctcccaca

SEQ ID NO: 2211697 - DNA, 22 bp, Homo sapiens
cacctgcttcccccacttcacc

SEQ ID NO: 2211698 - DNA, 13 bp, Homo sapiens
caccttcggagag

SEQ ID NO: 2211699 - DNA, 22 bp, Homo sapiens
cacgcaaaagcgactcccagct

SEQ ID NO: 2211700 - DNA, 15 bp, Homo sapiens
cactccccaaccccc

SEQ ID NO: 2211701 - DNA, 14 bp, Homo sapiens
cagagctccacaga

SEQ ID NO: 2211702 - DNA, 14 bp, Homo sapiens
cagagtttgcctcc

SEQ ID NO: 2211703 - DNA, 21 bp, Homo sapiens
cagagtttgcctccctgcact

SEQ ID NO: 2211704 - DNA, 22 bp, Homo sapiens
cagatcatgccgccgcagctgg

SEQ ID NO: 2211705 - DNA, 20 bp, Homo sapiens
cagccagagtttgcctccct

SEQ ID NO: 2211706 - DNA, 22 bp, Homo sapiens
cagctggttgggggcaccatct

SEQ ID NO: 2211707 - DNA, 15 bp, Homo sapiens
caggaacccagccag

SEQ ID NO: 2211708 - DNA, 15 bp, Homo sapiens
caggaccccaacccc

SEQ ID NO: 2211709 - DNA, 12 bp, Homo sapiens
cagtgccacaga

SEQ ID NO: 2211710 - DNA, 15 bp, Homo sapiens
cagtgccacagagaa

SEQ ID NO: 2211711 - DNA, 22 bp, Homo sapiens
cagtgtcaaatcgatggcctgg

SEQ ID NO: 2211712 - DNA, 14 bp, Homo sapiens
catctgcctgcagt

SEQ ID NO: 2211713 - DNA, 19 bp, Homo sapiens
catgccctggaccagccgc

SEQ ID NO: 2211714 - DNA, 20 bp, Homo sapiens
cattcaggaccccaacccct

SEQ ID NO: 2211715 - DNA, 23 bp, Homo sapiens
cattcaggaccccaacccctctc

SEQ ID NO: 2211716 - DNA, 12 bp, Homo sapiens
ccaagctggcag

SEQ ID NO: 2211717 - DNA, 15 bp, Homo sapiens
ccaagctggcagctg

SEQ ID NO: 2211718 - DNA, 16 bp, Homo sapiens
ccacaagtgccctcca

SEQ ID NO: 2211719 - DNA, 18 bp, Homo sapiens
ccacagaagacacgtgtt

SEQ ID NO: 2211720 - DNA, 15 bp, Homo sapiens
ccacagaagggggaa

SEQ ID NO: 2211721 - DNA, 16 bp, Homo sapiens
ccacgttactcccctg

SEQ ID NO: 2211722 - DNA, 22 bp, Homo sapiens
ccagagtttgcctccctgcact

SEQ ID NO: 2211723 - DNA, 22 bp, Homo sapiens
ccagccgcccagatcatgccgc

SEQ ID NO: 2211724 - DNA, 17 bp, Homo sapiens
ccaggaggagaccctcc

SEQ ID NO: 2211725 - DNA, 12 bp, Homo sapiens
ccagtgccacag

SEQ ID NO: 2211726 - DNA, 13 bp, Homo sapiens
ccagtgccacaga

SEQ ID NO: 2211727 - DNA, 22 bp, Homo sapiens
gggaacgcaagaggcatcccaa

SEQ ID NO: 2211728 - DNA, 10 bp, Homo sapiens
ggtaaatgtt

SEQ ID NO: 2211729 - DNA, 16 bp, Homo sapiens
ggtaagcaacatggct

SEQ ID NO: 2211730 - DNA, 17 bp, Homo sapiens
ggtaagcaacatggctt

SEQ ID NO: 2211731 - DNA, 19 bp, Homo sapiens
ggtaagcaacatggctttg

SEQ ID NO: 2211732 - DNA, 22 bp, Homo sapiens
gtctcgactgctgttcccctct

SEQ ID NO: 2211733 - DNA, 14 bp, Homo sapiens
gtgatttgaattct

SEQ ID NO: 2211734 - DNA, 10 bp, Homo sapiens
gtgccacaga

SEQ ID NO: 2211735 - DNA, 21 bp, Homo sapiens
gtgctttgctggagtcctgtt

SEQ ID NO: 2211736 - DNA, 15 bp, Homo sapiens
gttactcccctggct

SEQ ID NO: 2211737 - DNA, 13 bp, Homo sapiens
gttccccaggagg

SEQ ID NO: 2211738 - DNA, 13 bp, Homo sapiens
gttcccctcttcc

SEQ ID NO: 2211739 - DNA, 22 bp, Homo sapiens
gttgagccttcaggccagctgg

SEQ ID NO: 2211740 - DNA, 16 bp, Homo sapiens
gtttgaacccaggaga

SEQ ID NO: 2211741 - DNA, 13 bp, Homo sapiens
cctgccacctccc

SEQ ID NO: 2211742 - DNA, 14 bp, Homo sapiens
cctggaccagccgc

SEQ ID NO: 2211743 - DNA, 12 bp, Homo sapiens
cctgttctcaga

SEQ ID NO: 2211744 - DNA, 16 bp, Homo sapiens
cctgttctcagagctc

SEQ ID NO: 2211745 - DNA, 17 bp, Homo sapiens
ccttcaggccagctggg

SEQ ID NO: 2211746 - DNA, 17 bp, Homo sapiens
cgaggcctacctgctcc

SEQ ID NO: 2211747 - DNA, 23 bp, Homo sapiens
cgcacctgcttcccccacttcac

SEQ ID NO: 2211748 - DNA, 16 bp, Homo sapiens
cgcccagatcatgccg

SEQ ID NO: 2211749 - DNA, 19 bp, Homo sapiens
cggggatggttccccagga

SEQ ID NO: 2211750 - DNA, 20 bp, Homo sapiens
cggggatggttccccaggag

SEQ ID NO: 2211751 - DNA, 14 bp, Homo sapiens
cgttactcccctgg

SEQ ID NO: 2211752 - DNA, 16 bp, Homo sapiens
ctaacccccagtgcca

SEQ ID NO: 2211753 - DNA, 16 bp, Homo sapiens
ctacctgctcccctca

SEQ ID NO: 2211754 - DNA, 14 bp, Homo sapiens
ctattttaattact

SEQ ID NO: 2211755 - DNA, 20 bp, Homo sapiens
ctcagaagaaaaagaagctg

SEQ ID NO: 2211756 - DNA, 17 bp, Homo sapiens
ctcagagctccacagaa

SEQ ID NO: 2211757 - DNA, 15 bp, Homo sapiens
ctcatctgcctgcag

SEQ ID NO: 2211758 - DNA, 23 bp, Homo sapiens
ctcccctcaaaagcttcgtgcca

SEQ ID NO: 2211759 - DNA, 21 bp, Homo sapiens
ctgaggaagctgttggggggc

SEQ ID NO: 2211760 - DNA, 22 bp, Homo sapiens
ctgaggaagctgttggggggct

SEQ ID NO: 2211761 - DNA, 23 bp, Homo sapiens
ctgaggaagctgttggggggctg

SEQ ID NO: 2211762 - DNA, 17 bp, Homo sapiens
ctgaggttgggaaggca

SEQ ID NO: 2211763 - DNA, 22 bp, Homo sapiens
ctgaggttgggaaggcacctgc

SEQ ID NO: 2211764 - DNA, 23 bp, Homo sapiens
ctgaggttgggaaggcacctgct

SEQ ID NO: 2211765 - DNA, 17 bp, Homo sapiens
ctgattatttgcagctg

SEQ ID NO: 2211766 - DNA, 12 bp, Homo sapiens
ctgcctccgagg

SEQ ID NO: 2211767 - DNA, 13 bp, Homo sapiens
ctgcctgcagtgt

SEQ ID NO: 2211768 - DNA, 21 bp, Homo sapiens
ctgctataaataggtttatat

SEQ ID NO: 2211769 - DNA, 15 bp, Homo sapiens
ctgcttcccccactt

SEQ ID NO: 2211770 - DNA, 19 bp, Homo sapiens
ctggaccagccgcccagat

SEQ ID NO: 2211771 - DNA, 17 bp, Homo sapiens
ctggagtcctgttctca

SEQ ID NO: 2211772 - DNA, 19 bp, Homo sapiens
ctggagtcctgttctcaga

SEQ ID NO: 2211773 - DNA, 21 bp, Homo sapiens
ctggagtcctgttctcagagc

SEQ ID NO: 2211774 - DNA, 22 bp, Homo sapiens
ctggagtcctgttctcagagct

SEQ ID NO: 2211775 - DNA, 23 bp, Homo sapiens
ctggagtcctgttctcagagctc

SEQ ID NO: 2211776 - DNA, 20 bp, Homo sapiens
ctgggtttagcccgaggctg

SEQ ID NO: 2211777 - DNA, 19 bp, Homo sapiens
ctggttgggggcaccatct

SEQ ID NO: 2211778 - DNA, 17 bp, Homo sapiens
ctgtacccaatttaatt

SEQ ID NO: 2211779 - DNA, 21 bp, Homo sapiens
ctgtagtgccccctctaaccc

SEQ ID NO: 2211780 - DNA, 22 bp, Homo sapiens
ctgtcattcaggaccccaaccc

SEQ ID NO: 2211781 - DNA, 19 bp, Homo sapiens
ctgttctcagagctccaca

SEQ ID NO: 2211782 - DNA, 21 bp, Homo sapiens
ctgttctcagagctccacaga

SEQ ID NO: 2211783 - DNA, 15 bp, Homo sapiens
ctgtttgaacccagg

SEQ ID NO: 2211784 - DNA, 17 bp, Homo sapiens
cttactgactttgcatt

SEQ ID NO: 2211785 - DNA, 22 bp, Homo sapiens
cttagatgcagcgactgtttca

SEQ ID NO: 2211786 - DNA, 22 bp, Homo sapiens
cttcatcccggagcgcacctgc

SEQ ID NO: 2211787 - DNA, 20 bp, Homo sapiens
cttctgattatttgcagctg

SEQ ID NO: 2211788 - DNA, 15 bp, Homo sapiens
ctttaaagacttgat

SEQ ID NO: 2211789 - DNA, 16 bp, Homo sapiens
ctttaaagacttgatg

SEQ ID NO: 2211790 - DNA, 21 bp, Homo sapiens
ctttaaagacttgatgaataa

SEQ ID NO: 2211791 - DNA, 14 bp, Homo sapiens
ctttgctggagtcc

SEQ ID NO: 2211792 - DNA, 16 bp, Homo sapiens
ctttgctggagtcctg

SEQ ID NO: 2211793 - DNA, 17 bp, Homo sapiens
ctttgctggagtcctgt

SEQ ID NO: 2211794 - DNA, 22 bp, Homo sapiens
ctttgctggagtcctgttctca

SEQ ID NO: 2211795 - DNA, 20 bp, Homo sapiens
gaaaaagaagctgaggaagc

SEQ ID NO: 2211796 - DNA, 12 bp, Homo sapiens
gaacccaggaga

SEQ ID NO: 2211797 - DNA, 13 bp, Homo sapiens
gaacccaggagag

SEQ ID NO: 2211798 - DNA, 15 bp, Homo sapiens
gaacccaggagagtg

SEQ ID NO: 2211799 - DNA, 15 bp, Homo sapiens
gaagaaaaagaagct

SEQ ID NO: 2211800 - DNA, 12 bp, Homo sapiens
gaagctgaggaa

SEQ ID NO: 2211801 - DNA, 22 bp, Homo sapiens
gaagctgtacccaatttaattc

SEQ ID NO: 2211802 - DNA, 15 bp, Homo sapiens
gaaggcacctgctcc

SEQ ID NO: 2211803 - DNA, 13 bp, Homo sapiens
gacacgtgttttt

SEQ ID NO: 2211804 - DNA, 16 bp, Homo sapiens
gacacgtgtttttgta

SEQ ID NO: 2211805 - DNA, 19 bp, Homo sapiens
gacacttcaaactgcggac

SEQ ID NO: 2211806 - DNA, 23 bp, Homo sapiens
gaccacaaggctgaaaagtgctt

SEQ ID NO: 2211807 - DNA, 15 bp, Homo sapiens
gacctcatctgcctg

SEQ ID NO: 2211808 - DNA, 17 bp, Homo sapiens
gacctcatctgcctgca

SEQ ID NO: 2211809 - DNA, 15 bp, Homo sapiens
gactcccagctccgt

SEQ ID NO: 2211810 - DNA, 16 bp, Homo sapiens
gagaccctcccctgcc

SEQ ID NO: 2211811 - DNA, 18 bp, Homo sapiens
gagaccctcccctgcctc

SEQ ID NO: 2211812 - DNA, 18 bp, Homo sapiens
gagagattgggactgagt

SEQ ID NO: 2211813 - DNA, 18 bp, Homo sapiens
gagccttcaggccagctg

SEQ ID NO: 2211814 - DNA, 13 bp, Homo sapiens
gagcgcacctgct

SEQ ID NO: 2211815 - DNA, 17 bp, Homo sapiens
gagcgcacctgcttccc

SEQ ID NO: 2211816 - DNA, 13 bp, Homo sapiens
gaggagaccctcc

SEQ ID NO: 2211817 - DNA, 15 bp, Homo sapiens
gaggcatcccaagac

SEQ ID NO: 2211818 - DNA, 18 bp, Homo sapiens
gaggcctacctgctcccc

SEQ ID NO: 2211819 - DNA, 21 bp, Homo sapiens
gaggttcctgtttgaacccag

SEQ ID NO: 2211820 - DNA, 23 bp, Homo sapiens
gatccgagtgtgatttgaattct

SEQ ID NO: 2211821 - DNA, 17 bp, Homo sapiens
gatccgcaacccatgcc

SEQ ID NO: 2211822 - DNA, 12 bp, Homo sapiens
gatgaataaaca

SEQ ID NO: 2211823 - DNA, 18 bp, Homo sapiens
gatggcctggccttggct

SEQ ID NO: 2211824 - DNA, 14 bp, Homo sapiens
gatttgaattctgt

SEQ ID NO: 2211825 - DNA, 19 bp, Homo sapiens
gcaacccatgccctggacc

SEQ ID NO: 2211826 - DNA, 18 bp, Homo sapiens
gcaagaggcatcccaaga

SEQ ID NO: 2211827 - DNA, 13 bp, Homo sapiens
gcacctgcttccc

SEQ ID NO: 2211828 - DNA, 16 bp, Homo sapiens
gcacctgcttccccca

SEQ ID NO: 2211829 - DNA, 19 bp, Homo sapiens
gcacctgcttcccccactt

SEQ ID NO: 2211830 - DNA, 17 bp, Homo sapiens
gcagctgtcattcagga

SEQ ID NO: 2211831 - DNA, 23 bp, Homo sapiens
gcatcccaagacctcatctgcct

SEQ ID NO: 2211832 - DNA, 17 bp, Homo sapiens
gcccacgctcaccccct

SEQ ID NO: 2211833 - DNA, 20 bp, Homo sapiens
gccgcccagatcatgccgcc

SEQ ID NO: 2211834 - DNA, 16 bp, Homo sapiens
gcctacctgctcccct

SEQ ID NO: 2211835 - DNA, 16 bp, Homo sapiens
gcctccctgcacttca

SEQ ID NO: 2211836 - DNA, 16 bp, Homo sapiens
gcctccgaggcctacc

SEQ ID NO: 2211837 - DNA, 20 bp, Homo sapiens
gcctccgaggcctacctgct

SEQ ID NO: 2211838 - DNA, 21 bp, Homo sapiens
gcctgccacctccccccacaa

SEQ ID NO: 2211839 - DNA, 22 bp, Homo sapiens
gcgcacctgcttcccccacttc

SEQ ID NO: 2211840 - DNA, 15 bp, Homo sapiens
gctgaaaagtgcttt

SEQ ID NO: 2211841 - DNA, 16 bp, Homo sapiens
gctggagtcctgttct

SEQ ID NO: 2211842 - DNA, 17 bp, Homo sapiens
gctggagtcctgttctc

SEQ ID NO: 2211843 - DNA, 22 bp, Homo sapiens
gctggagtcctgttctcagagc

SEQ ID NO: 2211844 - DNA, 15 bp, Homo sapiens
gctggttgggggcac

SEQ ID NO: 2211845 - DNA, 19 bp, Homo sapiens
gctgtcattcaggacccca

SEQ ID NO: 2211846 - DNA, 18 bp, Homo sapiens
gctttgctggagtcctgt

SEQ ID NO: 2211847 - DNA, 13 bp, Homo sapiens
ggaacccagccag

SEQ ID NO: 2211848 - DNA, 19 bp, Homo sapiens
ggaagctgttggggggctg

SEQ ID NO: 2211849 - DNA, 22 bp, Homo sapiens
ggaaggcacctgctcccacaga

SEQ ID NO: 2211850 - DNA, 13 bp, Homo sapiens
ggagcgcacctgc

SEQ ID NO: 2211851 - DNA, 15 bp, Homo sapiens
ggatggttccccagg

SEQ ID NO: 2211852 - DNA, 17 bp, Homo sapiens
ggcatcccaagacctca

SEQ ID NO: 2211853 - DNA, 22 bp, Homo sapiens
aaaacagacatcatgctggtga

SEQ ID NO: 2211854 - DNA, 17 bp, Homo sapiens
aaaaggatgtataaatt

SEQ ID NO: 2211855 - DNA, 14 bp, Homo sapiens
aaacactttttctg

SEQ ID NO: 2211856 - DNA, 17 bp, Homo sapiens
aaagaagctgaggaagc

SEQ ID NO: 2211857 - DNA, 14 bp, Homo sapiens
aaagcttcgtgcca

SEQ ID NO: 2211858 - DNA, 18 bp, Homo sapiens
aaaggatgtataaatttt

SEQ ID NO: 2211859 - DNA, 13 bp, Homo sapiens
aacatggctttga

SEQ ID NO: 2211860 - DNA, 21 bp, Homo sapiens
aacccagccagagtttgcctc

SEQ ID NO: 2211861 - DNA, 11 bp, Homo sapiens
aacccaggaga

SEQ ID NO: 2211862 - DNA, 17 bp, Homo sapiens
aacccccagtgccacag

SEQ ID NO: 2211863 - DNA, 15 bp, Homo sapiens
aagaaaaagaagctg

SEQ ID NO: 2211864 - DNA, 17 bp, Homo sapiens
aagacctcatctgcctg

SEQ ID NO: 2211865 - DNA, 19 bp, Homo sapiens
aagagagattgggactgag

SEQ ID NO: 2211866 - DNA, 14 bp, Homo sapiens
aagcaacatggctt

SEQ ID NO: 2211867 - DNA, 15 bp, Homo sapiens
aagcaacatggcttt

SEQ ID NO: 2211868 - DNA, 21 bp, Homo sapiens
aagcaatacttaggaggctta

SEQ ID NO: 2211869 - DNA, 14 bp, Homo sapiens
aaggcacctgctcc

SEQ ID NO: 2211870 - DNA, 12 bp, Homo sapiens
aagtgccctcca

SEQ ID NO: 2211871 - DNA, 15 bp, Homo sapiens
acagaagacacgtgt

SEQ ID NO: 2211872 - DNA, 19 bp, Homo sapiens
acagaagacacgtgttttt

SEQ ID NO: 2211873 - DNA, 23 bp, Homo sapiens
acagaagacacgtgtttttgtat

SEQ ID NO: 2211874 - DNA, 13 bp, Homo sapiens
acaggaacccagc

SEQ ID NO: 2211875 - DNA, 20 bp, Homo sapiens
accacaaggctgaaaagtgc

SEQ ID NO: 2211876 - DNA, 15 bp, Homo sapiens
acccatgccctggac

SEQ ID NO: 2211877 - DNA, 21 bp, Homo sapiens
acccatgccctggaccagccg

SEQ ID NO: 2211878 - DNA, 19 bp, Homo sapiens
acccccagtgccacagaga

SEQ ID NO: 2211879 - DNA, 17 bp, Homo sapiens
accccctcacccctcca

SEQ ID NO: 2211880 - DNA, 13 bp, Homo sapiens
accctcccctgcc

SEQ ID NO: 2211881 - DNA, 14 bp, Homo sapiens
acctcatctgcctg

SEQ ID NO: 2211882 - DNA, 16 bp, Homo sapiens
acctcatctgcctgca

SEQ ID NO: 2211883 - DNA, 18 bp, Homo sapiens
acctcatctgcctgcagt

SEQ ID NO: 2211884 - DNA, 19 bp, Homo sapiens
acgatccgcaacccatgcc

SEQ ID NO: 2211885 - DNA, 24 bp, Homo sapiens
acgatccgcaacccatgccctgga

SEQ ID NO: 2211886 - DNA, 21 bp, Homo sapiens
acgcaaaagcgactcccagct

SEQ ID NO: 2211887 - DNA, 22 bp, Homo sapiens
acggggatggttccccaggagg

SEQ ID NO: 2211888 - DNA, 15 bp, Homo sapiens
acgtgtttttgtatc

SEQ ID NO: 2211889 - DNA, 16 bp, Homo sapiens
actccccaacccccaa

SEQ ID NO: 2211890 - DNA, 13 bp, Homo sapiens
actgctataaata

SEQ ID NO: 2211891 - DNA, 17 bp, Homo sapiens
actgctataaataggtt

SEQ ID NO: 2211892 - DNA, 13 bp, Homo sapiens
actggtaaatgtt

SEQ ID NO: 2211893 - DNA, 18 bp, Homo sapiens
actgtttcaggggtgact

SEQ ID NO: 2211894 - DNA, 19 bp, Homo sapiens
acttgatgaataaacactt

SEQ ID NO: 2211895 - DNA, 21 bp, Homo sapiens
acttgatgaataaacactttt

SEQ ID NO: 2211896 - DNA, 19 bp, Homo sapiens
agaagaaaaagaagctgag

SEQ ID NO: 2211897 - DNA, 20 bp, Homo sapiens
agaagacacgtgtttttgta

SEQ ID NO: 2211898 - DNA, 14 bp, Homo sapiens
agaagggggaacgc

SEQ ID NO: 2211899 - DNA, 14 bp, Homo sapiens
agacacgtgttttt

SEQ ID NO: 2211900 - DNA, 20 bp, Homo sapiens
agacacgtgtttttgtatct

SEQ ID NO: 2211901 - DNA, 13 bp, Homo sapiens
agaccctcccctg

SEQ ID NO: 2211902 - DNA, 14 bp, Homo sapiens
agacttgatgaata

SEQ ID NO: 2211903 - DNA, 14 bp, Homo sapiens
agagctccacagaa

SEQ ID NO: 2211904 - DNA, 17 bp, Homo sapiens
agaggcatcccaagacc

SEQ ID NO: 2211905 - DNA, 22 bp, Homo sapiens
agaggcatcccaagacctcatc

SEQ ID NO: 2211906 - DNA, 20 bp, Homo sapiens
agccagagtttgcctccctg

SEQ ID NO: 2211907 - DNA, 23 bp, Homo sapiens
agccagagtttgcctccctgcac

SEQ ID NO: 2211908 - DNA, 19 bp, Homo sapiens
agccgcccagatcatgccg

SEQ ID NO: 2211909 - DNA, 13 bp, Homo sapiens
agccttcaggcca

SEQ ID NO: 2211910 - DNA, 12 bp, Homo sapiens
agcgcacctgct

SEQ ID NO: 2211911 - DNA, 18 bp, Homo sapiens
agcgcacctgcttccccc

SEQ ID NO: 2211912 - DNA, 19 bp, Homo sapiens
agctgggtttagcccgagg

SEQ ID NO: 2211913 - DNA, 15 bp, Homo sapiens
agcttcgtgccaaca

SEQ ID NO: 2211914 - DNA, 14 bp, Homo sapiens
aggaacccagccag

SEQ ID NO: 2211915 - DNA, 23 bp, Homo sapiens
aggaggagaccctcccctgcctc

SEQ ID NO: 2211916 - DNA, 12 bp, Homo sapiens
aggcatcccaag

SEQ ID NO: 2211917 - DNA, 15 bp, Homo sapiens
aggcatcccaagacc

SEQ ID NO: 2211918 - DNA, 15 bp, Homo sapiens
aggcctacctgctcc

SEQ ID NO: 2211919 - DNA, 18 bp, Homo sapiens
aggcctacctgctcccct

SEQ ID NO: 2211920 - DNA, 17 bp, Homo sapiens
agggggaacgcaagagg

SEQ ID NO: 2211921 - DNA, 22 bp, Homo sapiens
aggttcctgtttgaacccagga

SEQ ID NO: 2211922 - DNA, 22 bp, Homo sapiens
aggttgggaaggcacctgctcc

SEQ ID NO: 2211923 - DNA, 12 bp, Homo sapiens
agtgccacagag

SEQ ID NO: 2211924 - DNA, 22 bp, Homo sapiens
ataaataggtttatattattga

SEQ ID NO: 2211925 - DNA, 22 bp, Homo sapiens
atacttaggaggcttacttctt

SEQ ID NO: 2211926 - DNA, 22 bp, Homo sapiens
ataggtttatattattgattca

SEQ ID NO: 2211927 - DNA, 18 bp, Homo sapiens
atcatgccgccgcagctg

SEQ ID NO: 2211928 - DNA, 23 bp, Homo sapiens
atcatgccgccgcagctggttgg

SEQ ID NO: 2211929 - DNA, 20 bp, Homo sapiens
atcccaagacctcatctgcc

SEQ ID NO: 2211930 - DNA, 14 bp, Homo sapiens
atcccggagcgcac

SEQ ID NO: 2211931 - DNA, 23 bp, Homo sapiens
atccgcaacccatgccctggacc

SEQ ID NO: 2211932 - DNA, 12 bp, Homo sapiens
atctttaaagac

SEQ ID NO: 2211933 - DNA, 20 bp, Homo sapiens
atctttaaagacttgatgaa

SEQ ID NO: 2211934 - DNA, 12 bp, Homo sapiens
atgcaactccaa

SEQ ID NO: 2211935 - DNA, 19 bp, Homo sapiens
atgcatgggaggaattcat

SEQ ID NO: 2211936 - DNA, 21 bp, Homo sapiens
tgcagtgtcaaatcgatggcc

SEQ ID NO: 2211937 - DNA, 17 bp, Homo sapiens
tgccacctccccccaca

SEQ ID NO: 2211938 - DNA, 19 bp, Homo sapiens
tgcctccgtcccctgccca

SEQ ID NO: 2211939 - DNA, 15 bp, Homo sapiens
tgctcccacagaagg

SEQ ID NO: 2211940 - DNA, 16 bp, Homo sapiens
tgctgaggttgggaag

SEQ ID NO: 2211941 - DNA, 17 bp, Homo sapiens
tgctggtgagtgccacg

SEQ ID NO: 2211942 - DNA, 17 bp, Homo sapiens
tgcttcccccacttcac

SEQ ID NO: 2211943 - DNA, 21 bp, Homo sapiens
tggaagagagattgggactga

SEQ ID NO: 2211944 - DNA, 13 bp, Homo sapiens
tggaccagccgcc

SEQ ID NO: 2211945 - DNA, 23 bp, Homo sapiens
tggacggggatggttccccagga

SEQ ID NO: 2211946 - DNA, 14 bp, Homo sapiens
tggagtcctgttct

SEQ ID NO: 2211947 - DNA, 22 bp, Homo sapiens
tggatgtttacaggaacccagc

SEQ ID NO: 2211948 - DNA, 17 bp, Homo sapiens
tggcaaaacagacatca

SEQ ID NO: 2211949 - DNA, 18 bp, Homo sapiens
tggcagctgtcattcagg

SEQ ID NO: 2211950 - DNA, 15 bp, Homo sapiens
tgggaaggcacctgc

SEQ ID NO: 2211951 - DNA, 15 bp, Homo sapiens
tgggactgagtgctg

SEQ ID NO: 2211952 - DNA, 16 bp, Homo sapiens
tggggggctgagggtg

SEQ ID NO: 2211953 - DNA, 19 bp, Homo sapiens
tggtaagcaacatggcttt

SEQ ID NO: 2211954 - DNA, 14 bp, Homo sapiens
tggttccccaggag

SEQ ID NO: 2211955 - DNA, 12 bp, Homo sapiens
tgtcattcagga

SEQ ID NO: 2211956 - DNA, 21 bp, Homo sapiens
tgtgagttgagccttcaggcc

SEQ ID NO: 2211957 - DNA, 22 bp, Homo sapiens
tgtgagttgagccttcaggcca

SEQ ID NO: 2211958 - DNA, 12 bp, Homo sapiens
tgttctcagagc

SEQ ID NO: 2211959 - DNA, 19 bp, Homo sapiens
ttaaaaggatgtataaatt

SEQ ID NO: 2211960 - DNA, 12 bp, Homo sapiens
ttaaagacttga

SEQ ID NO: 2211961 - DNA, 18 bp, Homo sapiens
ttaaagacttgatgaata

SEQ ID NO: 2211962 - DNA, 16 bp, Homo sapiens
ttaattactgctataa

SEQ ID NO: 2211963 - DNA, 18 bp, Homo sapiens
ttacaggaacccagccag

SEQ ID NO: 2211964 - DNA, 21 bp, Homo sapiens
ttcctgtttgaacccaggaga

SEQ ID NO: 2211965 - DNA, 14 bp, Homo sapiens
ttgaacccaggaga

SEQ ID NO: 2211966 - DNA, 22 bp, Homo sapiens
ttgcctccctgcacttcatccc

SEQ ID NO: 2211967 - DNA, 14 bp, Homo sapiens
ttgctggagtcctg

SEQ ID NO: 2211968 - DNA, 18 bp, Homo sapiens
ttgggactgagtgctgag

SEQ ID NO: 2211969 - DNA, 13 bp, Homo sapiens
ttggggggctgag

SEQ ID NO: 2211970 - DNA, 16 bp, Homo sapiens
tttaatttcaaatgta

SEQ ID NO: 2211971 - DNA, 12 bp, Homo sapiens
tttatattattg

SEQ ID NO: 2211972 - DNA, 16 bp, Homo sapiens
tttgctggagtcctgt

SEQ ID NO: 2211973 - DNA, 20 bp, Homo sapiens
tttgctggagtcctgttctc

SEQ ID NO: 2211974 - DNA, 20 bp, Homo sapiens
tttgtatctttaaagacttg

SEQ ID NO: 2211975 - DNA, 22 bp, Homo sapiens
atattttcacactggtaaatgt

SEQ ID NO: 2211976 - DNA, 17 bp, Homo sapiens
atcatgccgccgcagct

SEQ ID NO: 2211977 - DNA, 19 bp, Homo sapiens
atcccaagacctcatctgc

SEQ ID NO: 2211978 - DNA, 22 bp, Homo sapiens
atcccaagacctcatctgcctg

SEQ ID NO: 2211979 - DNA, 18 bp, Homo sapiens
atccccaagctggcagct

SEQ ID NO: 2211980 - DNA, 13 bp, Homo sapiens
atcgatggcctgg

SEQ ID NO: 2211981 - DNA, 18 bp, Homo sapiens
atgccctggaccagccgc

SEQ ID NO: 2211982 - DNA, 17 bp, Homo sapiens
atgccgccgcagctggt

SEQ ID NO: 2211983 - DNA, 14 bp, Homo sapiens
atgtataaattttt

SEQ ID NO: 2211984 - DNA, 21 bp, Homo sapiens
atgtttacaggaacccagcca

SEQ ID NO: 2211985 - DNA, 13 bp, Homo sapiens
attatttgcagct

SEQ ID NO: 2211986 - DNA, 12 bp, Homo sapiens
atttcaaatgta

SEQ ID NO: 2211987 - DNA, 21 bp, Homo sapiens
attttcacactggtaaatgtt

SEQ ID NO: 2211988 - DNA, 15 bp, Homo sapiens
caacccatgccctgg

SEQ ID NO: 2211989 - DNA, 14 bp, Homo sapiens
caaggctgaaaagt

SEQ ID NO: 2211990 - DNA, 18 bp, Homo sapiens
cacaaggctgaaaagtgc

SEQ ID NO: 2211991 - DNA, 20 bp, Homo sapiens
cacaaggctgaaaagtgctt

SEQ ID NO: 2211992 - DNA, 22 bp, Homo sapiens
cacaaggctgaaaagtgctttg

SEQ ID NO: 2211993 - DNA, 23 bp, Homo sapiens
cacacgcaaaagcgactcccagc

SEQ ID NO: 2211994 - DNA, 14 bp, Homo sapiens
cacagaagacacgt

SEQ ID NO: 2211995 - DNA, 20 bp, Homo sapiens
cacagaagacacgtgttttt

SEQ ID NO: 2211996 - DNA, 20 bp, Homo sapiens
cacctgctcccacagaaggg

SEQ ID NO: 2211997 - DNA, 13 bp, Homo sapiens
cacctgcttcccc

SEQ ID NO: 2211998 - DNA, 15 bp, Homo sapiens
cacctgcttccccca

SEQ ID NO: 2211999 - DNA, 17 bp, Homo sapiens
cacctgcttcccccact

SEQ ID NO: 2212000 - DNA, 19 bp, Homo sapiens
cacgatccgcaacccatgc

SEQ ID NO: 2212001 - DNA, 15 bp, Homo sapiens
cactcgaatcattga

SEQ ID NO: 2212002 - DNA, 14 bp, Homo sapiens
cactggtaaatgtt

SEQ ID NO: 2212003 - DNA, 22 bp, Homo sapiens
cagaagaaaaagaagctgagga

SEQ ID NO: 2212004 - DNA, 17 bp, Homo sapiens
cagaagacacgtgtttt

SEQ ID NO: 2212005 - DNA, 16 bp, Homo sapiens
cagaagggggaacgca

SEQ ID NO: 2212006 - DNA, 20 bp, Homo sapiens
cagagtttgcctccctgcac

SEQ ID NO: 2212007 - DNA, 14 bp, Homo sapiens
cagatcatgccgcc

SEQ ID NO: 2212008 - DNA, 18 bp, Homo sapiens
cagccagagtttgcctcc

SEQ ID NO: 2212009 - DNA, 22 bp, Homo sapiens
cagccgcccagatcatgccgcc

SEQ ID NO: 2212010 - DNA, 15 bp, Homo sapiens
cagctgtcattcagg

SEQ ID NO: 2212011 - DNA, 11 bp, Homo sapiens
cagtgccacag

SEQ ID NO: 2212012 - DNA, 14 bp, Homo sapiens
cagtgccacagaga

SEQ ID NO: 2212013 - DNA, 16 bp, Homo sapiens
cagtgccacagagaag

SEQ ID NO: 2212014 - DNA, 20 bp, Homo sapiens
catcccggagcgcacctgct

SEQ ID NO: 2212015 - DNA, 16 bp, Homo sapiens
catctgcctgcagtgt

SEQ ID NO: 2212016 - DNA, 21 bp, Homo sapiens
catgccgccgcagctggttgg

SEQ ID NO: 2212017 - DNA, 17 bp, Homo sapiens
catgctggtgagtgcca

SEQ ID NO: 2212018 - DNA, 15 bp, Homo sapiens
cattttcgtttttaa

SEQ ID NO: 2212019 - DNA, 22 bp, Homo sapiens
ccaagctggcagctgtcattca

SEQ ID NO: 2212020 - DNA, 15 bp, Homo sapiens
ccaatttaattccat

SEQ ID NO: 2212021 - DNA, 21 bp, Homo sapiens
ccacaaggctgaaaagtgctt

SEQ ID NO: 2212022 - DNA, 20 bp, Homo sapiens
ccacaagtgccctccaggct

SEQ ID NO: 2212023 - DNA, 16 bp, Homo sapiens
ccacagaagacacgtg

SEQ ID NO: 2212024 - DNA, 16 bp, Homo sapiens
ccacctccccccacaa

SEQ ID NO: 2212025 - DNA, 15 bp, Homo sapiens
ccacgttactcccct

SEQ ID NO: 2212026 - DNA, 15 bp, Homo sapiens
ccagagtttgcctcc

SEQ ID NO: 2212027 - DNA, 21 bp, Homo sapiens
ccagatcatgccgccgcagct

SEQ ID NO: 2212028 - DNA, 20 bp, Homo sapiens
ccagccagagtttgcctccc

SEQ ID NO: 2212029 - DNA, 14 bp, Homo sapiens
ccagtgccacagag

SEQ ID NO: 2212030 - DNA, 15 bp, Homo sapiens
ccagtgccacagaga

SEQ ID NO: 2212031 - DNA, 17 bp, Homo sapiens
cccaagacctcatctgc

SEQ ID NO: 2212032 - DNA, 21 bp, Homo sapiens
cccaagacctcatctgcctgc

SEQ ID NO: 2212033 - DNA, 22 bp, Homo sapiens
cccaagacctcatctgcctgca

SEQ ID NO: 2212034 - DNA, 12 bp, Homo sapiens
cccaatttaatt

SEQ ID NO: 2212035 - DNA, 22 bp, Homo sapiens
cccagatcatgccgccgcagct

SEQ ID NO: 2212036 - DNA, 21 bp, Homo sapiens
cccagccagagtttgcctccc

SEQ ID NO: 2212037 - DNA, 22 bp, Homo sapiens
cccagccagagtttgcctccct

SEQ ID NO: 2212038 - DNA, 18 bp, Homo sapiens
ccccacaagtgccctcca

SEQ ID NO: 2212039 - DNA, 22 bp, Homo sapiens
ccccaggaggagaccctcccct

SEQ ID NO: 2212040 - DNA, 14 bp, Homo sapiens
ccccagtgccacag

SEQ ID NO: 2212041 - DNA, 20 bp, Homo sapiens
ccccagtgccacagagaaga

SEQ ID NO: 2212042 - DNA, 22 bp, Homo sapiens
ccctcaatccccaagctggcag

SEQ ID NO: 2212043 - DNA, 23 bp, Homo sapiens
ccctctaacccccagtgccacag

SEQ ID NO: 2212044 - DNA, 21 bp, Homo sapiens
ccctgcctccgaggcctacct

SEQ ID NO: 2212045 - DNA, 21 bp, Homo sapiens
ccgcaacccatgccctggacc

SEQ ID NO: 2212046 - DNA, 16 bp, Homo sapiens
ccgcccagatcatgcc

SEQ ID NO: 2212047 - DNA, 17 bp, Homo sapiens
ccggagcgcacctgctt

SEQ ID NO: 2212048 - DNA, 23 bp, Homo sapiens
ccgtgtggtaagcaacatggctt

SEQ ID NO: 2212049 - DNA, 17 bp, Homo sapiens
cctacacgatccgcaac

SEQ ID NO: 2212050 - DNA, 17 bp, Homo sapiens
cctcatctgcctgcagt

SEQ ID NO: 2212051 - DNA, 13 bp, Homo sapiens
cctcccctgcctc

SEQ ID NO: 2212052 - DNA, 14 bp, Homo sapiens
cctcccctgcctcc

SEQ ID NO: 2212053 - DNA, 14 bp, Homo sapiens
cctccctgcacttc

SEQ ID NO: 2212054 - DNA, 18 bp, Homo sapiens
cctccgaggcctacctgc

SEQ ID NO: 2212055 - DNA, 15 bp, Homo sapiens
cctccgtcccctgcc

SEQ ID NO: 2212056 - DNA, 18 bp, Homo sapiens
cctgcacttcatcccgga

SEQ ID NO: 2212057 - DNA, 13 bp, Homo sapiens
cctgctcccacag

SEQ ID NO: 2212058 - DNA, 18 bp, Homo sapiens
cctgcttcccccacttca

SEQ ID NO: 2212059 - DNA, 13 bp, Homo sapiens
cctggaccagccg

SEQ ID NO: 2212060 - DNA, 22 bp, Homo sapiens
cctggaccagccgcccagatca

SEQ ID NO: 2212061 - DNA, 16 bp, Homo sapiens
cctgtagtgccccctc

SEQ ID NO: 2212062 - DNA, 18 bp, Homo sapiens
cctgttctcagagctcca

SEQ ID NO: 2212063 - DNA, 18 bp, Homo sapiens
cctgtttgaacccaggag

SEQ ID NO: 2212064 - DNA, 19 bp, Homo sapiens
cctgtttgaacccaggaga

SEQ ID NO: 2212065 - DNA, 13 bp, Homo sapiens
ccttcaggccagc

SEQ ID NO: 2212066 - DNA, 14 bp, Homo sapiens
ccttcaggccagct

SEQ ID NO: 2212067 - DNA, 18 bp, Homo sapiens
cgaggcctacctgctccc

SEQ ID NO: 2212068 - DNA, 22 bp, Homo sapiens
cgaggctggtcttagatgcagc

SEQ ID NO: 2212069 - DNA, 19 bp, Homo sapiens
cgatccgcaacccatgccc

SEQ ID NO: 2212070 - DNA, 13 bp, Homo sapiens
cgcacctgcttcc

SEQ ID NO: 2212071 - DNA, 16 bp, Homo sapiens
cgcacctgcttccccc

SEQ ID NO: 2212072 - DNA, 18 bp, Homo sapiens
cgcccagatcatgccgcc

SEQ ID NO: 2212073 - DNA, 17 bp, Homo sapiens
cgtgccaacagagaggt

SEQ ID NO: 2212074 - DNA, 21 bp, Homo sapiens
ctaacccccagtgccacagag

SEQ ID NO: 2212075 - DNA, 23 bp, Homo sapiens
ctaacccccagtgccacagagaa

SEQ ID NO: 2212076 - DNA, 21 bp, Homo sapiens
ctacacgatccgcaacccatg

SEQ ID NO: 2212077 - DNA, 13 bp, Homo sapiens
ctacctgctcccc

SEQ ID NO: 2212078 - DNA, 14 bp, Homo sapiens
ctcaccccctcacc

SEQ ID NO: 2212079 - DNA, 13 bp, Homo sapiens
ctcatctgcctgc

SEQ ID NO: 2212080 - DNA, 20 bp, Homo sapiens
ctccacagaagacacgtgtt

SEQ ID NO: 2212081 - DNA, 17 bp, Homo sapiens
ctccccccgcctgccac

SEQ ID NO: 2212082 - DNA, 13 bp, Homo sapiens
ctcccctgcctcc

SEQ ID NO: 2212083 - DNA, 15 bp, Homo sapiens
ctccctgcacttcat

SEQ ID NO: 2212084 - DNA, 22 bp, Homo sapiens
ctctaacccccagtgccacaga

SEQ ID NO: 2212085 - DNA, 13 bp, Homo sapiens
ctctattttaatt

SEQ ID NO: 2212086 - DNA, 19 bp, Homo sapiens
ctctccccccgcctgccac

SEQ ID NO: 2212087 - DNA, 21 bp, Homo sapiens
ctgagtgctgaggttgggaag

SEQ ID NO: 2212088 - DNA, 18 bp, Homo sapiens
ctgattatttgcagctgc

SEQ ID NO: 2212089 - DNA, 12 bp, Homo sapiens
ctgcacttcatc

SEQ ID NO: 2212090 - DNA, 17 bp, Homo sapiens
ctgccacctccccccac

SEQ ID NO: 2212091 - DNA, 15 bp, Homo sapiens
ctgctgttcccctct

SEQ ID NO: 2212092 - DNA, 16 bp, Homo sapiens
ctgcttcccccacttc

SEQ ID NO: 2212093 - DNA, 18 bp, Homo sapiens
ctgcttcccccacttcac

SEQ ID NO: 2212094 - DNA, 20 bp, Homo sapiens
ctggagtcctgttctcagag

SEQ ID NO: 2212095 - DNA, 14 bp, Homo sapiens
ctggcagctgtcat

SEQ ID NO: 2212096 - DNA, 21 bp, Homo sapiens
ctgggtttagcccgaggctgg

SEQ ID NO: 2212097 - DNA, 19 bp, Homo sapiens
ctggtcttagatgcagcga

SEQ ID NO: 2212098 - DNA, 21 bp, Homo sapiens
ctggttgggggcaccatctgg

SEQ ID NO: 2212099 - DNA, 22 bp, Homo sapiens
ctggttgggggcaccatctgga

SEQ ID NO: 2212100 - DNA, 15 bp, Homo sapiens
ctgttctcagagctc

SEQ ID NO: 2212101 - DNA, 17 bp, Homo sapiens
ctgtttgaacccaggag

SEQ ID NO: 2212102 - DNA, 23 bp, Homo sapiens
cttagatgcagcgactgtttcag

SEQ ID NO: 2212103 - DNA, 14 bp, Homo sapiens
cttcccccacttca

SEQ ID NO: 2212104 - DNA, 15 bp, Homo sapiens
cttcccccacttcac

SEQ ID NO: 2212105 - DNA, 17 bp, Homo sapiens
tgtgatttgaattctgt

SEQ ID NO: 2212106 - DNA, 21 bp, Homo sapiens
tgtggtaagcaacatggcttt

SEQ ID NO: 2212107 - DNA, 15 bp, Homo sapiens
tgttcccctcttccc

SEQ ID NO: 2212108 - DNA, 20 bp, Homo sapiens
tgttcccctcttccctacac

SEQ ID NO: 2212109 - DNA, 13 bp, Homo sapiens
tgttctcagagct

SEQ ID NO: 2212110 - DNA, 20 bp, Homo sapiens
tgttctcagagctccacaga

SEQ ID NO: 2212111 - DNA, 21 bp, Homo sapiens
tgttctcagagctccacagaa

SEQ ID NO: 2212112 - DNA, 15 bp, Homo sapiens
tgtttaaataaaatt

SEQ ID NO: 2212113 - DNA, 17 bp, Homo sapiens
tgtttgaacccaggaga

SEQ ID NO: 2212114 - DNA, 12 bp, Homo sapiens
tgtttttgtatc

SEQ ID NO: 2212115 - DNA, 17 bp, Homo sapiens
ttaaagacttgatgaat

SEQ ID NO: 2212116 - DNA, 17 bp, Homo sapiens
ttactcgttcttcagca

SEQ ID NO: 2212117 - DNA, 15 bp, Homo sapiens
ttagcccgaggctgg

SEQ ID NO: 2212118 - DNA, 19 bp, Homo sapiens
ttcacactggtaaatgtta

SEQ ID NO: 2212119 - DNA, 22 bp, Homo sapiens
ttcatcccggagcgcacctgct

SEQ ID NO: 2212120 - DNA, 11 bp, Homo sapiens
ttccccaggag

SEQ ID NO: 2212121 - DNA, 12 bp, Homo sapiens
ttccccaggagg

SEQ ID NO: 2212122 - DNA, 19 bp, Homo sapiens
ttctcagagctccacagaa

SEQ ID NO: 2212123 - DNA, 21 bp, Homo sapiens
ttctcagagctccacagaaga

SEQ ID NO: 2212124 - DNA, 23 bp, Homo sapiens
ttctcagagctccacagaagaca

SEQ ID NO: 2212125 - DNA, 15 bp, Homo sapiens
ttgcctccctgcact

SEQ ID NO: 2212126 - DNA, 21 bp, Homo sapiens
ttgctggagtcctgttctcag

SEQ ID NO: 2212127 - DNA, 22 bp, Homo sapiens
ttgctggagtcctgttctcaga

SEQ ID NO: 2212128 - DNA, 19 bp, Homo sapiens
ttgggaaggcacctgctcc

SEQ ID NO: 2212129 - DNA, 13 bp, Homo sapiens
ttgggggcaccat

SEQ ID NO: 2212130 - DNA, 17 bp, Homo sapiens
ttgggggcaccatctgg

SEQ ID NO: 2212131 - DNA, 15 bp, Homo sapiens
tttaaataaaattta

SEQ ID NO: 2212132 - DNA, 16 bp, Homo sapiens
tttacaggaacccagc

SEQ ID NO: 2212133 - DNA, 12 bp, Homo sapiens
tttgatgataaa

SEQ ID NO: 2212134 - DNA, 18 bp, Homo sapiens
acttgatgaataaacact

SEQ ID NO: 2212135 - DNA, 15 bp, Homo sapiens
agaaaaagaagctga

SEQ ID NO: 2212136 - DNA, 17 bp, Homo sapiens
agaagaaaaagaagctg

SEQ ID NO: 2212137 - DNA, 18 bp, Homo sapiens
agaagacacgtgtttttg

SEQ ID NO: 2212138 - DNA, 21 bp, Homo sapiens
agaagacacgtgtttttgtat

SEQ ID NO: 2212139 - DNA, 12 bp, Homo sapiens
agaagctgagga

SEQ ID NO: 2212140 - DNA, 18 bp, Homo sapiens
agaccctcccctgcctcc

SEQ ID NO: 2212141 - DNA, 17 bp, Homo sapiens
agacctcatctgcctgc

SEQ ID NO: 2212142 - DNA, 18 bp, Homo sapiens
agacttgatgaataaaca

SEQ ID NO: 2212143 - DNA, 21 bp, Homo sapiens
agagattgggactgagtgctg

SEQ ID NO: 2212144 - DNA, 13 bp, Homo sapiens
agagctccacaga

SEQ ID NO: 2212145 - DNA, 15 bp, Homo sapiens
agagctccacagaag

SEQ ID NO: 2212146 - DNA, 20 bp, Homo sapiens
agaggacacttcaaactgcg

SEQ ID NO: 2212147 - DNA, 15 bp, Homo sapiens
agaggcatcccaaga

SEQ ID NO: 2212148 - DNA, 19 bp, Homo sapiens
agaggcatcccaagacctc

SEQ ID NO: 2212149 - DNA, 17 bp, Homo sapiens
agccagagtttgcctcc

SEQ ID NO: 2212150 - DNA, 21 bp, Homo sapiens
agcccctcttttcccacattc

SEQ ID NO: 2212151 - DNA, 17 bp, Homo sapiens
agccttcaggccagctg

SEQ ID NO: 2212152 - DNA, 19 bp, Homo sapiens
agctcactccccaaccccc

SEQ ID NO: 2212153 - DNA, 17 bp, Homo sapiens
cctccgaggcctacctg

SEQ ID NO: 2212154 - DNA, 21 bp, Homo sapiens
cctccgaggcctacctgctcc

SEQ ID NO: 2212155 - DNA, 17 bp, Homo sapiens
cctgcttcccccacttc

SEQ ID NO: 2212156 - DNA, 21 bp, Homo sapiens
cctgcttcccccacttcacct

SEQ ID NO: 2212157 - DNA, 20 bp, Homo sapiens
cctggaccagccgcccagat

SEQ ID NO: 2212158 - DNA, 15 bp, Homo sapiens
cctgttctcagagct

SEQ ID NO: 2212159 - DNA, 17 bp, Homo sapiens
cctgtttaaataaaatt

SEQ ID NO: 2212160 - DNA, 19 bp, Homo sapiens
cctgtttaaataaaattta

SEQ ID NO: 2212161 - DNA, 15 bp, Homo sapiens
ccttcaggccagctg

SEQ ID NO: 2212162 - DNA, 13 bp, Homo sapiens
cgactcccagctc

SEQ ID NO: 2212163 - DNA, 14 bp, Homo sapiens
cgactcccagctcc

SEQ ID NO: 2212164 - DNA, 22 bp, Homo sapiens
cgatccgcaacccatgccctgg

SEQ ID NO: 2212165 - DNA, 17 bp, Homo sapiens
cgcaaaagcgactccca

SEQ ID NO: 2212166 - DNA, 20 bp, Homo sapiens
cgcaaaagcgactcccagct

SEQ ID NO: 2212167 - DNA, 16 bp, Homo sapiens
cgtgccaacagagagg

SEQ ID NO: 2212168 - DNA, 19 bp, Homo sapiens
ctaacccccagtgccacag

SEQ ID NO: 2212169 - DNA, 22 bp, Homo sapiens
ctaacccccagtgccacagaga

SEQ ID NO: 2212170 - DNA, 14 bp, Homo sapiens
ctacctgctcccct

SEQ ID NO: 2212171 - DNA, 21 bp, Homo sapiens
ctccacagaagacacgtgttt

SEQ ID NO: 2212172 - DNA, 15 bp, Homo sapiens
ctccccaacccccaa

SEQ ID NO: 2212173 - DNA, 12 bp, Homo sapiens
ctccctgcactt

SEQ ID NO: 2212174 - DNA, 20 bp, Homo sapiens
ctgaggttgggaaggcacct

SEQ ID NO: 2212175 - DNA, 14 bp, Homo sapiens
ctgattatttgcag

SEQ ID NO: 2212176 - DNA, 19 bp, Homo sapiens
ctgattatttgcagctgcg

SEQ ID NO: 2212177 - DNA, 20 bp, Homo sapiens
ctgattatttgcagctgcga

SEQ ID NO: 2212178 - DNA, 14 bp, Homo sapiens
ctgcacttcatccc

SEQ ID NO: 2212179 - DNA, 21 bp, Homo sapiens
ctgccacctccccccacaagt

SEQ ID NO: 2212180 - DNA, 15 bp, Homo sapiens
ctgcctgcagtgtca

SEQ ID NO: 2212181 - DNA, 14 bp, Homo sapiens
aaagacttgatgaa

SEQ ID NO: 2212182 - DNA, 20 bp, Homo sapiens
aaagacttgatgaataaaca

SEQ ID NO: 2212183 - DNA, 17 bp, Homo sapiens
aaaggatgtataaattt

SEQ ID NO: 2212184 - DNA, 18 bp, Homo sapiens
aaataggtttatattatt

SEQ ID NO: 2212185 - DNA, 15 bp, Homo sapiens
aaatgcttttctgaa

SEQ ID NO: 2212186 - DNA, 16 bp, Homo sapiens
aacccccagtgccaca

SEQ ID NO: 2212187 - DNA, 16 bp, Homo sapiens
aagaagctgaggaagc

SEQ ID NO: 2212188 - DNA, 13 bp, Homo sapiens
aagacacgtgttt

SEQ ID NO: 2212189 - DNA, 19 bp, Homo sapiens
aagacacgtgtttttgtat

SEQ ID NO: 2212190 - DNA, 19 bp, Homo sapiens
aagacctcatctgcctgca

SEQ ID NO: 2212191 - DNA, 14 bp, Homo sapiens
aagacttgatgaat

SEQ ID NO: 2212192 - DNA, 13 bp, Homo sapiens
aagcaacatggct

SEQ ID NO: 2212193 - DNA, 14 bp, Homo sapiens
aagcgactcccagc

SEQ ID NO: 2212194 - DNA, 16 bp, Homo sapiens
aagcgactcccagctc

SEQ ID NO: 2212195 - DNA, 19 bp, Homo sapiens
aagctggcagctgtcattc

SEQ ID NO: 2212196 - DNA, 15 bp, Homo sapiens
aaggcacctgctccc

SEQ ID NO: 2212197 - DNA, 17 bp, Homo sapiens
aatccccaagctggcag

SEQ ID NO: 2212198 - DNA, 18 bp, Homo sapiens
acaaggctgaaaagtgct

SEQ ID NO: 2212199 - DNA, 19 bp, Homo sapiens
acaagtgccctccaggctt

SEQ ID NO: 2212200 - DNA, 21 bp, Homo sapiens
acacgatccgcaacccatgcc

SEQ ID NO: 2212201 - DNA, 22 bp, Homo sapiens
acacgcaaaagcgactcccagc

SEQ ID NO: 2212202 - DNA, 14 bp, Homo sapiens
acaggaacccagcc

SEQ ID NO: 2212203 - DNA, 16 bp, Homo sapiens
acaggaacccagccag

SEQ ID NO: 2212204 - DNA, 18 bp, Homo sapiens
acaggaacccagccagag

SEQ ID NO: 2212205 - DNA, 21 bp, Homo sapiens
accagccgcccagatcatgcc

SEQ ID NO: 2212206 - DNA, 22 bp, Homo sapiens
acccagccagagtttgcctccc

SEQ ID NO: 2212207 - DNA, 22 bp, Homo sapiens
acccatgccctggaccagccgc

SEQ ID NO: 2212208 - DNA, 21 bp, Homo sapiens
acccccagtgccacagagaag

SEQ ID NO: 2212209 - DNA, 12 bp, Homo sapiens
accctcccctgc

SEQ ID NO: 2212210 - DNA, 15 bp, Homo sapiens
accctcccctgcctc

SEQ ID NO: 2212211 - DNA, 17 bp, Homo sapiens
accctcccctgcctccg

SEQ ID NO: 2212212 - DNA, 22 bp, Homo sapiens
acctcatctgcctgcagtgtca

SEQ ID NO: 2212213 - DNA, 22 bp, Homo sapiens
acctgcttcccccacttcacct

SEQ ID NO: 2212214 - DNA, 21 bp, Homo sapiens
acggggatggttccccaggag

SEQ ID NO: 2212215 - DNA, 15 bp, Homo sapiens
actccccaaccccca

SEQ ID NO: 2212216 - DNA, 14 bp, Homo sapiens
actcccctggctgg

SEQ ID NO: 2212217 - DNA, 23 bp, Homo sapiens
acttcatcccggagcgcacctgc

SEQ ID NO: 2212218 - DNA, 16 bp, Homo sapiens
acttgatgaataaaca

SEQ ID NO: 2212219 - DNA, 20 bp, Homo sapiens
acttgatgaataaacacttt

SEQ ID NO: 2212220 - DNA, 16 bp, Homo sapiens
agacacgtgtttttgt

SEQ ID NO: 2212221 - DNA, 19 bp, Homo sapiens
agacacgtgtttttgtatc

SEQ ID NO: 2212222 - DNA, 15 bp, Homo sapiens
agaccctcccctgcc

SEQ ID NO: 2212223 - DNA, 16 bp, Homo sapiens
agacctcatctgcctg

SEQ ID NO: 2212224 - DNA, 23 bp, Homo sapiens
agacgggatttgaagctgtaccc

SEQ ID NO: 2212225 - DNA, 19 bp, Homo sapiens
agacttgatgaataaacac

SEQ ID NO: 2212226 - DNA, 14 bp, Homo sapiens
agaggcatcccaag

SEQ ID NO: 2212227 - DNA, 13 bp, Homo sapiens
agatcatgccgcc

SEQ ID NO: 2212228 - DNA, 16 bp, Homo sapiens
agattgggactgagtg

SEQ ID NO: 2212229 - DNA, 12 bp, Homo sapiens
agcaacatggct

SEQ ID NO: 2212230 - DNA, 14 bp, Homo sapiens
agcaacatggcttt

SEQ ID NO: 2212231 - DNA, 18 bp, Homo sapiens
agccagagtttgcctccc

SEQ ID NO: 2212232 - DNA, 21 bp, Homo sapiens
agccagagtttgcctccctgc

SEQ ID NO: 2212233 - DNA, 18 bp, Homo sapiens
agccttcaggccagctgg

SEQ ID NO: 2212234 - DNA, 15 bp, Homo sapiens
agcgcacctgcttcc

SEQ ID NO: 2212235 - DNA, 16 bp, Homo sapiens
agctccacagaagaca

SEQ ID NO: 2212236 - DNA, 14 bp, Homo sapiens
agctgtcattcagg

SEQ ID NO: 2212237 - DNA, 20 bp, Homo sapiens
agcttcgtgccaacagagag

SEQ ID NO: 2212238 - DNA, 22 bp, Homo sapiens
aggagaccctcccctgcctccg

SEQ ID NO: 2212239 - DNA, 14 bp, Homo sapiens
aggaggagaccctc

SEQ ID NO: 2212240 - DNA, 22 bp, Homo sapiens
aggcacctgctcccacagaagg

SEQ ID NO: 2212241 - DNA, 13 bp, Homo sapiens
aggcctacctgct

SEQ ID NO: 2212242 - DNA, 16 bp, Homo sapiens
aggctgaaaagtgctt

SEQ ID NO: 2212243 - DNA, 21 bp, Homo sapiens
aggttcctgtttgaacccagg

SEQ ID NO: 2212244 - DNA, 18 bp, Homo sapiens
aggttgggaaggcacctg

SEQ ID NO: 2212245 - DNA, 23 bp, Homo sapiens
aggttgggaaggcacctgctccc

SEQ ID NO: 2212246 - DNA, 12 bp, Homo sapiens
agtccgtccacc

SEQ ID NO: 2212247 - DNA, 17 bp, Homo sapiens
agtcctgttctcagagc

SEQ ID NO: 2212248 - DNA, 21 bp, Homo sapiens
agtcctgttctcagagctcca

SEQ ID NO: 2212249 - DNA, 11 bp, Homo sapiens
agtgccacaga

SEQ ID NO: 2212250 - DNA, 13 bp, Homo sapiens
agtgccacagaga

SEQ ID NO: 2212251 - DNA, 23 bp, Homo sapiens
agtgctttgctggagtcctgttc

SEQ ID NO: 2212252 - DNA, 19 bp, Homo sapiens
agttgagccttcaggccag

SEQ ID NO: 2212253 - DNA, 12 bp, Homo sapiens
agtttgcctccc

SEQ ID NO: 2212254 - DNA, 19 bp, Homo sapiens
agtttgcctccctgcactt

SEQ ID NO: 2212255 - DNA, 13 bp, Homo sapiens
ataaaatttaatt

SEQ ID NO: 2212256 - DNA, 19 bp, Homo sapiens
atacacactcgaatcattg

SEQ ID NO: 2212257 - DNA, 16 bp, Homo sapiens
atgccgccgcagctgg

SEQ ID NO: 2212258 - DNA, 15 bp, Homo sapiens
atggttccccaggag

SEQ ID NO: 2212259 - DNA, 16 bp, Homo sapiens
atggttccccaggagg

SEQ ID NO: 2212260 - DNA, 15 bp, Homo sapiens
attatttgcagctgc

SEQ ID NO: 2212261 - DNA, 17 bp, Homo sapiens
attttcacactggtaaa

SEQ ID NO: 2212262 - DNA, 18 bp, Homo sapiens
caaaagcgactcccagct

SEQ ID NO: 2212263 - DNA, 15 bp, Homo sapiens
caaatcgatggcctg

SEQ ID NO: 2212264 - DNA, 20 bp, Homo sapiens
caaatcgatggcctggcctt

SEQ ID NO: 2212265 - DNA, 17 bp, Homo sapiens
caacagagaggttcctg

SEQ ID NO: 2212266 - DNA, 18 bp, Homo sapiens
caagacctcatctgcctg

SEQ ID NO: 2212267 - DNA, 16 bp, Homo sapiens
caatacttaggaggct

SEQ ID NO: 2212268 - DNA, 17 bp, Homo sapiens
cacagaagacacgtgtt

SEQ ID NO: 2212269 - DNA, 13 bp, Homo sapiens
caccatctggacg

SEQ ID NO: 2212270 - DNA, 23 bp, Homo sapiens
cacctccccccacaagtgccctc

SEQ ID NO: 2212271 - DNA, 11 bp, Homo sapiens
cacctgctccc

SEQ ID NO: 2212272 - DNA, 12 bp, Homo sapiens
cacctgctccca

SEQ ID NO: 2212273 - DNA, 23 bp, Homo sapiens
caccttcggagaggacacttcaa

SEQ ID NO: 2212274 - DNA, 17 bp, Homo sapiens
cacgatccgcaacccat

SEQ ID NO: 2212275 - DNA, 15 bp, Homo sapiens
cacgtgtttttgtat

SEQ ID NO: 2212276 - DNA, 16 bp, Homo sapiens
cacgtgtttttgtatc

SEQ ID NO: 2212277 - DNA, 14 bp, Homo sapiens
cacgttactcccct

SEQ ID NO: 2212278 - DNA, 16 bp, Homo sapiens
cacgttactcccctgg

SEQ ID NO: 2212279 - DNA, 15 bp, Homo sapiens
cactggtaaatgtta

SEQ ID NO: 2212280 - DNA, 24 bp, Homo sapiens
cagaagaaaaagaagctgaggaag

SEQ ID NO: 2212281 - DNA, 16 bp, Homo sapiens
cagaagacacgtgttt

SEQ ID NO: 2212282 - DNA, 15 bp, Homo sapiens
cagagtttgcctccc

SEQ ID NO: 2212283 - DNA, 16 bp, Homo sapiens
cagagtttgcctccct

SEQ ID NO: 2212284 - DNA, 17 bp, Homo sapiens
cagatcatgccgccgca

SEQ ID NO: 2212285 - DNA, 23 bp, Homo sapiens
cagatcatgccgccgcagctggt

SEQ ID NO: 2212286 - DNA, 19 bp, Homo sapiens
cagccagagtttgcctccc

SEQ ID NO: 2212287 - DNA, 14 bp, Homo sapiens
caggaacccagcca

SEQ ID NO: 2212288 - DNA, 17 bp, Homo sapiens
cagtccgtccaccacct

SEQ ID NO: 2212289 - DNA, 13 bp, Homo sapiens
cagtgccacagag

SEQ ID NO: 2212290 - DNA, 18 bp, Homo sapiens
catcccggagcgcacctg

SEQ ID NO: 2212291 - DNA, 14 bp, Homo sapiens
catgccctggacca

SEQ ID NO: 2212292 - DNA, 16 bp, Homo sapiens
catgctggtgagtgcc

SEQ ID NO: 2212293 - DNA, 20 bp, Homo sapiens
catgctggtgagtgccacgt

SEQ ID NO: 2212294 - DNA, 20 bp, Homo sapiens
ccaagacctcatctgcctgc

SEQ ID NO: 2212295 - DNA, 17 bp, Homo sapiens
ccacaaggctgaaaagt

SEQ ID NO: 2212296 - DNA, 18 bp, Homo sapiens
ccacaaggctgaaaagtg

SEQ ID NO: 2212297 - DNA, 19 bp, Homo sapiens
ccacaaggctgaaaagtgc

SEQ ID NO: 2212298 - DNA, 15 bp, Homo sapiens
ccacagaagacacgt

SEQ ID NO: 2212299 - DNA, 21 bp, Homo sapiens
ccacagaagacacgtgttttt

SEQ ID NO: 2212300 - DNA, 13 bp, Homo sapiens
ccacttcaccttc

SEQ ID NO: 2212301 - DNA, 16 bp, Homo sapiens
ccagagtttgcctccc

SEQ ID NO: 2212302 - DNA, 19 bp, Homo sapiens
ccagagtttgcctccctgc

SEQ ID NO: 2212303 - DNA, 22 bp, Homo sapiens
ccagatcatgccgccgcagctg

SEQ ID NO: 2212304 - DNA, 21 bp, Homo sapiens
ccagccgcccagatcatgccg

SEQ ID NO: 2212305 - DNA, 21 bp, Homo sapiens
ccaggaggagaccctcccctg

SEQ ID NO: 2212306 - DNA, 22 bp, Homo sapiens
ccaggaggagaccctcccctgc

SEQ ID NO: 2212307 - DNA, 18 bp, Homo sapiens
ccagtgccacagagaaga

SEQ ID NO: 2212308 - DNA, 18 bp, Homo sapiens
ccagttgatcaatgaata

SEQ ID NO: 2212309 - DNA, 17 bp, Homo sapiens
ccataatcaatctatca

SEQ ID NO: 2212310 - DNA, 19 bp, Homo sapiens
ccatgccctggaccagccg

SEQ ID NO: 2212311 - DNA, 20 bp, Homo sapiens
cccacagaagggggaacgca

SEQ ID NO: 2212312 - DNA, 20 bp, Homo sapiens
cccagccagagtttgcctcc

SEQ ID NO: 2212313 - DNA, 17 bp, Homo sapiens
cccaggagagtggaaga

SEQ ID NO: 2212314 - DNA, 23 bp, Homo sapiens
cccaggaggagaccctcccctgc

SEQ ID NO: 2212315 - DNA, 13 bp, Homo sapiens
cccagtgccacag

SEQ ID NO: 2212316 - DNA, 14 bp, Homo sapiens
cccagtgccacaga

SEQ ID NO: 2212317 - DNA, 13 bp, Homo sapiens
cccctcacccctc

SEQ ID NO: 2212318 - DNA, 14 bp, Homo sapiens
ccctcttccctaca

SEQ ID NO: 2212319 - DNA, 16 bp, Homo sapiens
ccctgcacttcatccc

SEQ ID NO: 2212320 - DNA, 17 bp, Homo sapiens
ccgaggcctacctgctc

SEQ ID NO: 2212321 - DNA, 16 bp, Homo sapiens
ccggagcgcacctgct

SEQ ID NO: 2212322 - DNA, 22 bp, Homo sapiens
ccgtgtggtaagcaacatggct

SEQ ID NO: 2212323 - DNA, 12 bp, Homo sapiens
cctacctgctcc

SEQ ID NO: 2212324 - DNA, 15 bp, Homo sapiens
cctacctgctcccct

SEQ ID NO: 2212325 - DNA, 21 bp, Homo sapiens
cctcaatccccaagctggcag

SEQ ID NO: 2212326 - DNA, 14 bp, Homo sapiens
cctcatctgcctgc

SEQ ID NO: 2212327 - DNA, 20 bp, Homo sapiens
cctcatctgcctgcagtgtc

SEQ ID NO: 2212328 - DNA, 12 bp, Homo sapiens
cctccctgcact

SEQ ID NO: 2212329 - DNA, 22 bp, Homo sapiens
cctccctgcacttcatcccgga

SEQ ID NO: 2212330 - DNA, 19 bp, Homo sapiens
cctccgaggcctacctgct

SEQ ID NO: 2212331 - DNA, 22 bp, Homo sapiens
cctccgaggcctacctgctccc

SEQ ID NO: 2212332 - DNA, 14 bp, Homo sapiens
cctctattttaatt

SEQ ID NO: 2212333 - DNA, 23 bp, Homo sapiens
cctgcagtgtcaaatcgatggcc

SEQ ID NO: 2212334 - DNA, 18 bp, Homo sapiens
cctgccacctccccccac

SEQ ID NO: 2212335 - DNA, 19 bp, Homo sapiens
cctgcctccgaggcctacc

SEQ ID NO: 2212336 - DNA, 12 bp, Homo sapiens
cctgctcccaca

SEQ ID NO: 2212337 - DNA, 13 bp, Homo sapiens
cctgctcccctca

SEQ ID NO: 2212338 - DNA, 13 bp, Homo sapiens
cctgcttccccca

SEQ ID NO: 2212339 - DNA, 15 bp, Homo sapiens
cctgcttcccccact

SEQ ID NO: 2212340 - DNA, 23 bp, Homo sapiens
cctgtagtgccccctctaacccc

SEQ ID NO: 2212341 - DNA, 13 bp, Homo sapiens
cctgttctcagag

SEQ ID NO: 2212342 - DNA, 22 bp, Homo sapiens
cctgttctcagagctccacaga

SEQ ID NO: 2212343 - DNA, 23 bp, Homo sapiens
cctgttctcagagctccacagaa

SEQ ID NO: 2212344 - DNA, 17 bp, Homo sapiens
cctgtttgaacccagga

SEQ ID NO: 2212345 - DNA, 16 bp, Homo sapiens
ccttcaggccagctgg

SEQ ID NO: 2212346 - DNA, 22 bp, Homo sapiens
cgactgctgttcccctcttccc

SEQ ID NO: 2212347 - DNA, 15 bp, Homo sapiens
cgatccgcaacccat

SEQ ID NO: 2212348 - DNA, 18 bp, Homo sapiens
cgatccgcaacccatgcc

SEQ ID NO: 2212349 - DNA, 15 bp, Homo sapiens
cgatggatgtttaca

SEQ ID NO: 2212350 - DNA, 13 bp, Homo sapiens
cgcaagaggcatc

SEQ ID NO: 2212351 - DNA, 14 bp, Homo sapiens
cgcacctgcttccc

SEQ ID NO: 2212352 - DNA, 15 bp, Homo sapiens
cgcacctgcttcccc

SEQ ID NO: 2212353 - DNA, 18 bp, Homo sapiens
cgcagctggttgggggca

SEQ ID NO: 2212354 - DNA, 21 bp, Homo sapiens
cgcagctggttgggggcacca

SEQ ID NO: 2212355 - DNA, 23 bp, Homo sapiens
cgcagctggttgggggcaccatc

SEQ ID NO: 2212356 - DNA, 14 bp, Homo sapiens
cggagcgcacctgc

SEQ ID NO: 2212357 - DNA, 15 bp, Homo sapiens
cggagcgcacctgct

SEQ ID NO: 2212358 - DNA, 19 bp, Homo sapiens
cggagcgcacctgcttccc

SEQ ID NO: 2212359 - DNA, 21 bp, Homo sapiens
cggggatggttccccaggagg

SEQ ID NO: 2212360 - DNA, 17 bp, Homo sapiens
cgttactcccctggctg

SEQ ID NO: 2212361 - DNA, 18 bp, Homo sapiens
ctaacccccagtgccaca

SEQ ID NO: 2212362 - DNA, 20 bp, Homo sapiens
ctaacccccagtgccacaga

SEQ ID NO: 2212363 - DNA, 21 bp, Homo sapiens
ctaagcaatacttaggaggct

SEQ ID NO: 2212364 - DNA, 16 bp, Homo sapiens
ctcagagctccacaga

SEQ ID NO: 2212365 - DNA, 14 bp, Homo sapiens
ctcccctgcctccg

SEQ ID NO: 2212366 - DNA, 12 bp, Homo sapiens
ctccgaggccta

SEQ ID NO: 2212367 - DNA, 21 bp, Homo sapiens
ctccgaggcctacctgctccc

SEQ ID NO: 2212368 - DNA, 20 bp, Homo sapiens
ctctaacccccagtgccaca

SEQ ID NO: 2212369 - DNA, 21 bp, Homo sapiens
ctctaacccccagtgccacag

SEQ ID NO: 2212370 - DNA, 23 bp, Homo sapiens
ctctaacccccagtgccacagag

SEQ ID NO: 2212371 - DNA, 11 bp, Homo sapiens
ctgaaaagtgc

SEQ ID NO: 2212372 - DNA, 22 bp, Homo sapiens
ctgcacttcatcccggagcgca

SEQ ID NO: 2212373 - DNA, 19 bp, Homo sapiens
ctgctgttcccctcttccc

SEQ ID NO: 2212374 - DNA, 14 bp, Homo sapiens
ctggaccagccgcc

SEQ ID NO: 2212375 - DNA, 14 bp, Homo sapiens
ctggacggggatgg

SEQ ID NO: 2212376 - DNA, 20 bp, Homo sapiens
ctgtacccaatttaattcca

SEQ ID NO: 2212377 - DNA, 13 bp, Homo sapiens
ctgtcattcagga

SEQ ID NO: 2212378 - DNA, 23 bp, Homo sapiens
ctgtcattcaggaccccaacccc

SEQ ID NO: 2212379 - DNA, 21 bp, Homo sapiens
ctgtctaagcaatacttagga

SEQ ID NO: 2212380 - DNA, 12 bp, Homo sapiens
ctgttctcagag

SEQ ID NO: 2212381 - DNA, 17 bp, Homo sapiens
ctgttctcagagctcca

SEQ ID NO: 2212382 - DNA, 20 bp, Homo sapiens
ctgttctcagagctccacag

SEQ ID NO: 2212383 - DNA, 22 bp, Homo sapiens
ctgttctcagagctccacagaa

SEQ ID NO: 2212384 - DNA, 19 bp, Homo sapiens
ctgtttgaacccaggagag

SEQ ID NO: 2212385 - DNA, 13 bp, Homo sapiens
cttcaggccagct

SEQ ID NO: 2212386 - DNA, 21 bp, Homo sapiens
cttcatcccggagcgcacctg

SEQ ID NO: 2212387 - DNA, 12 bp, Homo sapiens
aaaatttaattt

SEQ ID NO: 2212388 - DNA, 21 bp, Homo sapiens
aaacctgtctaagcaatactt

SEQ ID NO: 2212389 - DNA, 21 bp, Homo sapiens
aaagtgctttgctggagtcct

SEQ ID NO: 2212390 - DNA, 23 bp, Homo sapiens
aaagtgctttgctggagtcctgt

SEQ ID NO: 2212391 - DNA, 17 bp, Homo sapiens
aaatcgatggcctggcc

SEQ ID NO: 2212392 - DNA, 14 bp, Homo sapiens
aacccatgccctgg

SEQ ID NO: 2212393 - DNA, 16 bp, Homo sapiens
aacccatgccctggac

SEQ ID NO: 2212394 - DNA, 19 bp, Homo sapiens
aacccccagtgccacagag

SEQ ID NO: 2212395 - DNA, 16 bp, Homo sapiens
aagaaaaagaagctga

SEQ ID NO: 2212396 - DNA, 22 bp, Homo sapiens
aagaagctgaggaagctgttgg

SEQ ID NO: 2212397 - DNA, 17 bp, Homo sapiens
aagacacgtgtttttgt

SEQ ID NO: 2212398 - DNA, 16 bp, Homo sapiens
aaggcacctgctccca

SEQ ID NO: 2212399 - DNA, 20 bp, Homo sapiens
aaggcacctgctcccacaga

SEQ ID NO: 2212400 - DNA, 15 bp, Homo sapiens
aaggctgaaaagtgc

SEQ ID NO: 2212401 - DNA, 18 bp, Homo sapiens
aaggctgaaaagtgcttt

SEQ ID NO: 2212402 - DNA, 18 bp, Homo sapiens
aagtgccctccaggcttt

SEQ ID NO: 2212403 - DNA, 13 bp, Homo sapiens
aataaacactttt

SEQ ID NO: 2212404 - DNA, 20 bp, Homo sapiens
aatcaatctatcaattacag

SEQ ID NO: 2212405 - DNA, 17 bp, Homo sapiens
aattctgtgatattttc

SEQ ID NO: 2212406 - DNA, 12 bp, Homo sapiens
aatttaattcca

SEQ ID NO: 2212407 - DNA, 14 bp, Homo sapiens
acacgatccgcaac

SEQ ID NO: 2212408 - DNA, 16 bp, Homo sapiens
acactggtaaatgtta

SEQ ID NO: 2212409 - DNA, 21 bp, Homo sapiens
acagaagacacgtgtttttgt

SEQ ID NO: 2212410 - DNA, 15 bp, Homo sapiens
acagacatcatgctg

SEQ ID NO: 2212411 - DNA, 14 bp, Homo sapiens
acccaatttaattc

SEQ ID NO: 2212412 - DNA, 15 bp, Homo sapiens
acccccagtgccaca

SEQ ID NO: 2212413 - DNA, 17 bp, Homo sapiens
acccccagtgccacaga

SEQ ID NO: 2212414 - DNA, 13 bp, Homo sapiens
accccctcacccc

SEQ ID NO: 2212415 - DNA, 15 bp, Homo sapiens
acccctctcagcccc

SEQ ID NO: 2212416 - DNA, 15 bp, Homo sapiens
acctcatctgcctgc

SEQ ID NO: 2212417 - DNA, 12 bp, Homo sapiens
acctgctcccac

SEQ ID NO: 2212418 - DNA, 13 bp, Homo sapiens
acctgctcccaca

SEQ ID NO: 2212419 - DNA, 15 bp, Homo sapiens
acctgcttcccccac

SEQ ID NO: 2212420 - DNA, 16 bp, Homo sapiens
acctgcttcccccact

SEQ ID NO: 2212421 - DNA, 17 bp, Homo sapiens
acctgcttcccccactt

SEQ ID NO: 2212422 - DNA, 20 bp, Homo sapiens
acctgcttcccccacttcac

SEQ ID NO: 2212423 - DNA, 22 bp, Homo sapiens
acgatccgcaacccatgccctg

SEQ ID NO: 2212424 - DNA, 14 bp, Homo sapiens
acgcaagaggcatc

SEQ ID NO: 2212425 - DNA, 20 bp, Homo sapiens
acggggatggttccccagga

SEQ ID NO: 2212426 - DNA, 23 bp, Homo sapiens
actgagtgctgaggttgggaagg

SEQ ID NO: 2212427 - DNA, 20 bp, Homo sapiens
acttaggaggcttacttctt

SEQ ID NO: 2212428 - DNA, 21 bp, Homo sapiens
aggagaccctcccctgcctcc

SEQ ID NO: 2212429 - DNA, 16 bp, Homo sapiens
aggagagtggaagaga

SEQ ID NO: 2212430 - DNA, 12 bp, Homo sapiens
aggcacctgctc

SEQ ID NO: 2212431 - DNA, 14 bp, Homo sapiens
aggcacctgctccc

SEQ ID NO: 2212432 - DNA, 13 bp, Homo sapiens
aggcatcccaaga

SEQ ID NO: 2212433 - DNA, 14 bp, Homo sapiens
aggcctacctgctc

SEQ ID NO: 2212434 - DNA, 13 bp, Homo sapiens
aggctgaaaagtg

SEQ ID NO: 2212435 - DNA, 17 bp, Homo sapiens
aggctgaaaagtgcttt

SEQ ID NO: 2212436 - DNA, 12 bp, Homo sapiens
aggttgggaagg

SEQ ID NO: 2212437 - DNA, 19 bp, Homo sapiens
aggttgggaaggcacctgc

SEQ ID NO: 2212438 - DNA, 21 bp, Homo sapiens
agtatgagtgttgtgcctact

SEQ ID NO: 2212439 - DNA, 11 bp, Homo sapiens
agtcctgttct

SEQ ID NO: 2212440 - DNA, 12 bp, Homo sapiens
agtcctgttctc

SEQ ID NO: 2212441 - DNA, 15 bp, Homo sapiens
agtcctgttctcaga

SEQ ID NO: 2212442 - DNA, 18 bp, Homo sapiens
agtcctgttctcagagct

SEQ ID NO: 2212443 - DNA, 14 bp, Homo sapiens
agtgccacagagaa

SEQ ID NO: 2212444 - DNA, 20 bp, Homo sapiens
agtgccacgttactcccctg

SEQ ID NO: 2212445 - DNA, 23 bp, Homo sapiens
agtgccacgttactcccctggct

SEQ ID NO: 2212446 - DNA, 20 bp, Homo sapiens
agtgctttgctggagtcctg

SEQ ID NO: 2212447 - DNA, 21 bp, Homo sapiens
agtgtcaaatcgatggcctgg

SEQ ID NO: 2212448 - DNA, 17 bp, Homo sapiens
ataaataggtttatatt

SEQ ID NO: 2212449 - DNA, 19 bp, Homo sapiens
atattttcacactggtaaa

SEQ ID NO: 2212450 - DNA, 19 bp, Homo sapiens
atcatgccgccgcagctgg

SEQ ID NO: 2212451 - DNA, 18 bp, Homo sapiens
atcccggagcgcacctgc

SEQ ID NO: 2212452 - DNA, 23 bp, Homo sapiens
atcccggagcgcacctgcttccc

SEQ ID NO: 2212453 - DNA, 22 bp, Homo sapiens
atccgagtgtgatttgaattct

SEQ ID NO: 2212454 - DNA, 20 bp, Homo sapiens
atccgcaacccatgccctgg

SEQ ID NO: 2212455 - DNA, 16 bp, Homo sapiens
atcgatggcctggcct

SEQ ID NO: 2212456 - DNA, 14 bp, Homo sapiens
atctgcctgcagtg

SEQ ID NO: 2212457 - DNA, 12 bp, Homo sapiens
atgccctggacc

SEQ ID NO: 2212458 - DNA, 20 bp, Homo sapiens
atgccgccgcagctggttgg

SEQ ID NO: 2212459 - DNA, 17 bp, Homo sapiens
atgctggtgagtgccac

SEQ ID NO: 2212460 - DNA, 21 bp, Homo sapiens
atgcttttctgaaagtatgag

SEQ ID NO: 2212461 - DNA, 16 bp, Homo sapiens
atttgaagctgtaccc

SEQ ID NO: 2212462 - DNA, 20 bp, Homo sapiens
caaaagcgactcccagctcc

SEQ ID NO: 2212463 - DNA, 15 bp, Homo sapiens
caagacctcatctgc

SEQ ID NO: 2212464 - DNA, 16 bp, Homo sapiens
caagacctcatctgcc

SEQ ID NO: 2212465 - DNA, 19 bp, Homo sapiens
caagacctcatctgcctgc

SEQ ID NO: 2212466 - DNA, 20 bp, Homo sapiens
caagacctcatctgcctgca

SEQ ID NO: 2212467 - DNA, 16 bp, Homo sapiens
caagaggcatcccaag

SEQ ID NO: 2212468 - DNA, 21 bp, Homo sapiens
caagctcactccccaaccccc

SEQ ID NO: 2212469 - DNA, 16 bp, Homo sapiens
caaggctgaaaagtgc

SEQ ID NO: 2212470 - DNA, 14 bp, Homo sapiens
caatttaattccat

SEQ ID NO: 2212471 - DNA, 16 bp, Homo sapiens
cacaaggctgaaaagt

SEQ ID NO: 2212472 - DNA, 21 bp, Homo sapiens
cacaaggctgaaaagtgcttt

SEQ ID NO: 2212473 - DNA, 20 bp, Homo sapiens
cacagagaagacgggatttg

SEQ ID NO: 2212474 - DNA, 13 bp, Homo sapiens
cacctgctcccac

SEQ ID NO: 2212475 - DNA, 21 bp, Homo sapiens
cacctgcttcccccacttcac

SEQ ID NO: 2212476 - DNA, 20 bp, Homo sapiens
cacgatccgcaacccatgcc

SEQ ID NO: 2212477 - DNA, 14 bp, Homo sapiens
cactttttctggtc

SEQ ID NO: 2212478 - DNA, 20 bp, Homo sapiens
cagaagacacgtgtttttgt

SEQ ID NO: 2212479 - DNA, 22 bp, Homo sapiens
cagaagacacgtgtttttgtat

SEQ ID NO: 2212480 - DNA, 15 bp, Homo sapiens
cagagctccacagaa

SEQ ID NO: 2212481 - DNA, 16 bp, Homo sapiens
cagagctccacagaag

SEQ ID NO: 2212482 - DNA, 22 bp, Homo sapiens
cagccagagtttgcctccctgc

SEQ ID NO: 2212483 - DNA, 16 bp, Homo sapiens
cagctgtcattcagga

SEQ ID NO: 2212484 - DNA, 12 bp, Homo sapiens
caggaacccagc

SEQ ID NO: 2212485 - DNA, 13 bp, Homo sapiens
caggaacccagcc

SEQ ID NO: 2212486 - DNA, 16 bp, Homo sapiens
caggaccccaacccct

SEQ ID NO: 2212487 - DNA, 16 bp, Homo sapiens
caggaggagaccctcc

SEQ ID NO: 2212488 - DNA, 18 bp, Homo sapiens
catcccaagacctcatct

SEQ ID NO: 2212489 - DNA, 20 bp, Homo sapiens
catcccaagacctcatctgc

SEQ ID NO: 2212490 - DNA, 19 bp, Homo sapiens
catcccggagcgcacctgc

SEQ ID NO: 2212491 - DNA, 15 bp, Homo sapiens
catctgcctgcagtg

SEQ ID NO: 2212492 - DNA, 18 bp, Homo sapiens
catctgcctgcagtgtca

SEQ ID NO: 2212493 - DNA, 13 bp, Homo sapiens
catgccctggacc

SEQ ID NO: 2212494 - DNA, 20 bp, Homo sapiens
catgccctggaccagccgcc

SEQ ID NO: 2212495 - DNA, 15 bp, Homo sapiens
catgccgccgcagct

SEQ ID NO: 2212496 - DNA, 17 bp, Homo sapiens
catgccgccgcagctgg

SEQ ID NO: 2212497 - DNA, 22 bp, Homo sapiens
ccaactccgtgtggtaagcaac

SEQ ID NO: 2212498 - DNA, 14 bp, Homo sapiens
ccaagacctcatct

SEQ ID NO: 2212499 - DNA, 16 bp, Homo sapiens
ccaagacctcatctgc

SEQ ID NO: 2212500 - DNA, 21 bp, Homo sapiens
ccaagacctcatctgcctgca

SEQ ID NO: 2212501 - DNA, 20 bp, Homo sapiens
ccacaaggctgaaaagtgct

SEQ ID NO: 2212502 - DNA, 23 bp, Homo sapiens
ccacaaggctgaaaagtgctttg

SEQ ID NO: 2212503 - DNA, 19 bp, Homo sapiens
ccacagaagggggaacgca

SEQ ID NO: 2212504 - DNA, 15 bp, Homo sapiens
ccacgctcaccccct

SEQ ID NO: 2212505 - DNA, 21 bp, Homo sapiens
ccacgttactcccctggctgg

SEQ ID NO: 2212506 - DNA, 18 bp, Homo sapiens
ccagagtttgcctccctg

SEQ ID NO: 2212507 - DNA, 19 bp, Homo sapiens
ccagccagagtttgcctcc

SEQ ID NO: 2212508 - DNA, 21 bp, Homo sapiens
ccagccagagtttgcctccct

SEQ ID NO: 2212509 - DNA, 14 bp, Homo sapiens
ccagccgcccagat

SEQ ID NO: 2212510 - DNA, 15 bp, Homo sapiens
ccagccgcccagatc

SEQ ID NO: 2212511 - DNA, 23 bp, Homo sapiens
ccaggaggagaccctcccctgcc

SEQ ID NO: 2212512 - DNA, 16 bp, Homo sapiens
ccagtgccacagagaa

SEQ ID NO: 2212513 - DNA, 21 bp, Homo sapiens
cccacaagtgccctccaggct

SEQ ID NO: 2212514 - DNA, 15 bp, Homo sapiens
cccacgctcaccccc

SEQ ID NO: 2212515 - DNA, 16 bp, Homo sapiens
cccacgctcaccccct

SEQ ID NO: 2212516 - DNA, 18 bp, Homo sapiens
cccaggaggagaccctcc

SEQ ID NO: 2212517 - DNA, 23 bp, Homo sapiens
ccccaggaggagaccctcccctg

SEQ ID NO: 2212518 - DNA, 15 bp, Homo sapiens
ccccagtgccacaga

SEQ ID NO: 2212519 - DNA, 16 bp, Homo sapiens
cccccagtgccacaga

SEQ ID NO: 2212520 - DNA, 21 bp, Homo sapiens
cccccagtgccacagagaaga

SEQ ID NO: 2212521 - DNA, 13 bp, Homo sapiens
cccctgcctccga

SEQ ID NO: 2212522 - DNA, 16 bp, Homo sapiens
cccggagcgcacctgc

SEQ ID NO: 2212523 - DNA, 20 bp, Homo sapiens
ccctcaaaagcttcgtgcca

SEQ ID NO: 2212524 - DNA, 14 bp, Homo sapiens
ccctcccctgcctc

SEQ ID NO: 2212525 - DNA, 15 bp, Homo sapiens
ccctcccctgcctcc

SEQ ID NO: 2212526 - DNA, 18 bp, Homo sapiens
ccctggaccagccgccca

SEQ ID NO: 2212527 - DNA, 17 bp, Homo sapiens
ccgcccagatcatgccg

SEQ ID NO: 2212528 - DNA, 13 bp, Homo sapiens
ccggagcgcacct

SEQ ID NO: 2212529 - DNA, 21 bp, Homo sapiens
ccgtgtggtaagcaacatggc

SEQ ID NO: 2212530 - DNA, 14 bp, Homo sapiens
cctacctgctcccc

SEQ ID NO: 2212531 - DNA, 13 bp, Homo sapiens
cctcatctgcctg

SEQ ID NO: 2212532 - DNA, 15 bp, Homo sapiens
cctcatctgcctgca

SEQ ID NO: 2212533 - DNA, 15 bp, Homo sapiens
cctccctgcacttca

SEQ ID NO: 2212534 - DNA, 20 bp, Homo sapiens
tcatcccggagcgcacctgc

SEQ ID NO: 2212535 - DNA, 13 bp, Homo sapiens
tcatctgcctgca

SEQ ID NO: 2212536 - DNA, 16 bp, Homo sapiens
tccataatcaatctat

SEQ ID NO: 2212537 - DNA, 12 bp, Homo sapiens
tcccccacttca

SEQ ID NO: 2212538 - DNA, 17 bp, Homo sapiens
tccccccacaagtgccc

SEQ ID NO: 2212539 - DNA, 15 bp, Homo sapiens
tcccctgcccatgct

SEQ ID NO: 2212540 - DNA, 12 bp, Homo sapiens
tcccctgcctcc

SEQ ID NO: 2212541 - DNA, 17 bp, Homo sapiens
tccgcaacccatgccct

SEQ ID NO: 2212542 - DNA, 14 bp, Homo sapiens
tccgtcccctgccc

SEQ ID NO: 2212543 - DNA, 12 bp, Homo sapiens
tcctgttctcag

SEQ ID NO: 2212544 - DNA, 16 bp, Homo sapiens
tcctgttctcagagct

SEQ ID NO: 2212545 - DNA, 19 bp, Homo sapiens
tcctgttctcagagctcca

SEQ ID NO: 2212546 - DNA, 20 bp, Homo sapiens
tcctgtttgaacccaggaga

SEQ ID NO: 2212547 - DNA, 18 bp, Homo sapiens
tcgctccttcatttcagg

SEQ ID NO: 2212548 - DNA, 15 bp, Homo sapiens
tctattttaattact

SEQ ID NO: 2212549 - DNA, 18 bp, Homo sapiens
tctcagagctccacagaa

SEQ ID NO: 2212550 - DNA, 13 bp, Homo sapiens
tctgataaacctg

SEQ ID NO: 2212551 - DNA, 19 bp, Homo sapiens
tctgattatttgcagctgc

SEQ ID NO: 2212552 - DNA, 10 bp, Homo sapiens
tgaaaagtgc

SEQ ID NO: 2212553 - DNA, 21 bp, Homo sapiens
tgaacccaggagagtggaaga

SEQ ID NO: 2212554 - DNA, 13 bp, Homo sapiens
tgaagctgtaccc

SEQ ID NO: 2212555 - DNA, 16 bp, Homo sapiens
tgaataaacacttttt

SEQ ID NO: 2212556 - DNA, 16 bp, Homo sapiens
tgagccttcaggccag

SEQ ID NO: 2212557 - DNA, 19 bp, Homo sapiens
tgagccttcaggccagctg

SEQ ID NO: 2212558 - DNA, 23 bp, Homo sapiens
tgaggaagctgttggggggctga

SEQ ID NO: 2212559 - DNA, 20 bp, Homo sapiens
tgaggttgggaaggcacctg

SEQ ID NO: 2212560 - DNA, 21 bp, Homo sapiens
tgagttgagccttcaggccag

SEQ ID NO: 2212561 - DNA, 16 bp, Homo sapiens
tgatgaataaacactt

SEQ ID NO: 2212562 - DNA, 22 bp, Homo sapiens
tgatgaataaacactttttctg

SEQ ID NO: 2212563 - DNA, 13 bp, Homo sapiens
tgatttgaattct

SEQ ID NO: 2212564 - DNA, 18 bp, Homo sapiens
tgcagcgactgtttcagg

SEQ ID NO: 2212565 - DNA, 17 bp, Homo sapiens
tgcatgggaggaattca

SEQ ID NO: 2212566 - DNA, 14 bp, Homo sapiens
tgccaacagagagg

SEQ ID NO: 2212567 - DNA, 11 bp, Homo sapiens
tgccacagaga

SEQ ID NO: 2212568 - DNA, 14 bp, Homo sapiens
tgccacagagaaga

SEQ ID NO: 2212569 - DNA, 20 bp, Homo sapiens
tgcccatgctgggagcccac

SEQ ID NO: 2212570 - DNA, 22 bp, Homo sapiens
tgcctccgaggcctacctgctc

SEQ ID NO: 2212571 - DNA, 23 bp, Homo sapiens
tgcctccgaggcctacctgctcc

SEQ ID NO: 2212572 - DNA, 21 bp, Homo sapiens
aaaaggatgtataaattttta

SEQ ID NO: 2212573 - DNA, 18 bp, Homo sapiens
aaagacttgatgaataaa

SEQ ID NO: 2212574 - DNA, 22 bp, Homo sapiens
aaagacttgatgaataaacact

SEQ ID NO: 2212575 - DNA, 19 bp, Homo sapiens
aaataggtttatattattg

SEQ ID NO: 2212576 - DNA, 18 bp, Homo sapiens
aaatttttacctgtttaa

SEQ ID NO: 2212577 - DNA, 14 bp, Homo sapiens
ccatgccctggacc

SEQ ID NO: 2212578 - DNA, 17 bp, Homo sapiens
ccatgccctggaccagc

SEQ ID NO: 2212579 - DNA, 20 bp, Homo sapiens
cccaagacctcatctgcctg

SEQ ID NO: 2212580 - DNA, 14 bp, Homo sapiens
cccagatcatgccg

SEQ ID NO: 2212581 - DNA, 15 bp, Homo sapiens
cccagtgccacagag

SEQ ID NO: 2212582 - DNA, 16 bp, Homo sapiens
cccagtgccacagaga

SEQ ID NO: 2212583 - DNA, 17 bp, Homo sapiens
cccagtgccacagagaa

SEQ ID NO: 2212584 - DNA, 10 bp, Homo sapiens
ccccaggagg

SEQ ID NO: 2212585 - DNA, 14 bp, Homo sapiens
ccccctctaacccc

SEQ ID NO: 2212586 - DNA, 23 bp, Homo sapiens
cccctgcctccgaggcctacctg

SEQ ID NO: 2212587 - DNA, 17 bp, Homo sapiens
cccggagcgcacctgct

SEQ ID NO: 2212588 - DNA, 13 bp, Homo sapiens
ccctgcccatgct

SEQ ID NO: 2212589 - DNA, 15 bp, Homo sapiens
ccgaggcctacctgc

SEQ ID NO: 2212590 - DNA, 18 bp, Homo sapiens
ccgaggcctacctgctcc

SEQ ID NO: 2212591 - DNA, 18 bp, Homo sapiens
ccgcagctggttgggggc

SEQ ID NO: 2212592 - DNA, 12 bp, Homo sapiens
ccgccgcagctg

SEQ ID NO: 2212593 - DNA, 18 bp, Homo sapiens
cctcatctgcctgcagtg

SEQ ID NO: 2212594 - DNA, 13 bp, Homo sapiens
cctccctgcactt

SEQ ID NO: 2212595 - DNA, 16 bp, Homo sapiens
cctccctgcacttcat

SEQ ID NO: 2212596 - DNA, 21 bp, Homo sapiens
cctctaacccccagtgccaca

SEQ ID NO: 2212597 - DNA, 22 bp, Homo sapiens
cctctaacccccagtgccacag

SEQ ID NO: 2212598 - DNA, 23 bp, Homo sapiens
cctctaacccccagtgccacaga

SEQ ID NO: 2212599 - DNA, 19 bp, Homo sapiens
gtttttgtatctttaaaga

SEQ ID NO: 2212600 - DNA, 15 bp, Homo sapiens
taaaaggatgtataa

SEQ ID NO: 2212601 - DNA, 15 bp, Homo sapiens
taaaatttaatttca

SEQ ID NO: 2212602 - DNA, 15 bp, Homo sapiens
taaacactttttctg

SEQ ID NO: 2212603 - DNA, 16 bp, Homo sapiens
taaagacttgatgaat

SEQ ID NO: 2212604 - DNA, 21 bp, Homo sapiens
taaagacttgatgaataaaca

SEQ ID NO: 2212605 - DNA, 21 bp, Homo sapiens
taacccccagtgccacagaga

SEQ ID NO: 2212606 - DNA, 13 bp, Homo sapiens
tacaggaacccag

SEQ ID NO: 2212607 - DNA, 17 bp, Homo sapiens
tacaggaacccagccag

SEQ ID NO: 2212608 - DNA, 18 bp, Homo sapiens
tacccaatttaattccat

SEQ ID NO: 2212609 - DNA, 21 bp, Homo sapiens
tacctctattttaattactgc

SEQ ID NO: 2212610 - DNA, 22 bp, Homo sapiens
tagtgccccctctaacccccag

SEQ ID NO: 2212611 - DNA, 13 bp, Homo sapiens
tatcaattacagt

SEQ ID NO: 2212612 - DNA, 14 bp, Homo sapiens
tattttaattactg

SEQ ID NO: 2212613 - DNA, 17 bp, Homo sapiens
tcaaatcgatggcctgg

SEQ ID NO: 2212614 - DNA, 20 bp, Homo sapiens
tcactccccaacccccaact

SEQ ID NO: 2212615 - DNA, 13 bp, Homo sapiens
tcaggccagctgg

SEQ ID NO: 2212616 - DNA, 12 bp, Homo sapiens
tcatctgcctgc

SEQ ID NO: 2212617 - DNA, 22 bp, Homo sapiens
tccaagctcactccccaacccc

SEQ ID NO: 2212618 - DNA, 16 bp, Homo sapiens
tccccaacccccaact

SEQ ID NO: 2212619 - DNA, 10 bp, Homo sapiens
tccccaggag

SEQ ID NO: 2212620 - DNA, 22 bp, Homo sapiens
tccccccacaagtgccctccag

SEQ ID NO: 2212621 - DNA, 13 bp, Homo sapiens
tcccctgcctccg

SEQ ID NO: 2212622 - DNA, 18 bp, Homo sapiens
tcccggagcgcacctgct

SEQ ID NO: 2212623 - DNA, 20 bp, Homo sapiens
tccgaggcctacctgctccc

SEQ ID NO: 2212624 - DNA, 19 bp, Homo sapiens
tccgcaacccatgccctgg

SEQ ID NO: 2212625 - DNA, 22 bp, Homo sapiens
tccgcaacccatgccctggacc

SEQ ID NO: 2212626 - DNA, 18 bp, Homo sapiens
tccgtcccctgcccatgc

SEQ ID NO: 2212627 - DNA, 15 bp, Homo sapiens
tcctgttctcagagc

SEQ ID NO: 2212628 - DNA, 16 bp, Homo sapiens
tcctgtttgaacccag

SEQ ID NO: 2212629 - DNA, 15 bp, Homo sapiens
tctccccccgcctgc

SEQ ID NO: 2212630 - DNA, 15 bp, Homo sapiens
tctggacggggatgg

SEQ ID NO: 2212631 - DNA, 22 bp, Homo sapiens
tgagccttcaggccagctgggt

SEQ ID NO: 2212632 - DNA, 22 bp, Homo sapiens
tgaggaagctgttggggggctg

SEQ ID NO: 2212633 - DNA, 14 bp, Homo sapiens
tgaggttgggaagg

SEQ ID NO: 2212634 - DNA, 16 bp, Homo sapiens
tgcacttcatcccgga

SEQ ID NO: 2212635 - DNA, 18 bp, Homo sapiens
tgcctccctgcacttcat

SEQ ID NO: 2212636 - DNA, 19 bp, Homo sapiens
tgcctccctgcacttcatc

SEQ ID NO: 2212637 - DNA, 19 bp, Homo sapiens
tgcctccgaggcctacctg

SEQ ID NO: 2212638 - DNA, 16 bp, Homo sapiens
tgctgttcccctcttc

SEQ ID NO: 2212639 - DNA, 20 bp, Homo sapiens
tgctttgctggagtcctgtt

SEQ ID NO: 2212640 - DNA, 18 bp, Homo sapiens
tggacggggatggttccc

SEQ ID NO: 2212641 - DNA, 23 bp, Homo sapiens
tggagtcctgttctcagagctcc

SEQ ID NO: 2212642 - DNA, 20 bp, Homo sapiens
tgggaaggcacctgctccca

SEQ ID NO: 2212643 - DNA, 13 bp, Homo sapiens
tgggaggaattca

SEQ ID NO: 2212644 - DNA, 15 bp, Homo sapiens
tgggggcaccatctg

SEQ ID NO: 2212645 - DNA, 16 bp, Homo sapiens
tgggggcaccatctgg

SEQ ID NO: 2212646 - DNA, 20 bp, Homo sapiens
tgggtttagcccgaggctgg

SEQ ID NO: 2212647 - DNA, 20 bp, Homo sapiens
tggtaagcaacatggctttg

SEQ ID NO: 2212648 - DNA, 15 bp, Homo sapiens
tggttccccaggagg

SEQ ID NO: 2212649 - DNA, 20 bp, Homo sapiens
tgtggtaagcaacatggctt

SEQ ID NO: 2212650 - DNA, 23 bp, Homo sapiens
tgtttaaataaaatttaatttca

SEQ ID NO: 2212651 - DNA, 15 bp, Homo sapiens
tgtttgaacccagga

SEQ ID NO: 2212652 - DNA, 20 bp, Homo sapiens
ttaaaaggatgtataaattt

SEQ ID NO: 2212653 - DNA, 17 bp, Homo sapiens
ttaaataaaatttaatt

SEQ ID NO: 2212654 - DNA, 15 bp, Homo sapiens
ttaattactgctata

SEQ ID NO: 2212655 - DNA, 19 bp, Homo sapiens
ttactcccctggctggaaa

SEQ ID NO: 2212656 - DNA, 20 bp, Homo sapiens
ttctcagagctccacagaag

SEQ ID NO: 2212657 - DNA, 15 bp, Homo sapiens
ttctgataaacctgt

SEQ ID NO: 2212658 - DNA, 19 bp, Homo sapiens
ttgctggagtcctgttctc

SEQ ID NO: 2212659 - DNA, 20 bp, Homo sapiens
ttgctggagtcctgttctca

SEQ ID NO: 2212660 - DNA, 17 bp, Homo sapiens
ttgggaaggcacctgct

SEQ ID NO: 2212661 - DNA, 17 bp, Homo sapiens
ttgggactgagtgctga

SEQ ID NO: 2212662 - DNA, 16 bp, Homo sapiens
tttaattactgctata

SEQ ID NO: 2212663 - DNA, 13 bp, Homo sapiens
tttacctgtttaa

SEQ ID NO: 2212664 - DNA, 19 bp, Homo sapiens
tttcacactggtaaatgtt

SEQ ID NO: 2212665 - DNA, 22 bp, Homo sapiens
tttgaacccaggagagtggaag

SEQ ID NO: 2212666 - DNA, 16 bp, Homo sapiens
tttgaattctgtgata

SEQ ID NO: 2212667 - DNA, 19 bp, Homo sapiens
tttgctggagtcctgttct

SEQ ID NO: 2212668 - DNA, 21 bp, Homo sapiens
tttgtatctttaaagacttga

SEQ ID NO: 2212669 - DNA, 21 bp, Homo sapiens
ttttaaaaggatgtataaatt

SEQ ID NO: 2212670 - DNA, 14 bp, Homo sapiens
ttttgtatctttaa

SEQ ID NO: 2212671 - DNA, 10 bp, Homo sapiens
aaaaaaagac

SEQ ID NO: 2212672 - DNA, 17 bp, Homo sapiens
aaaaactctatttttgt

SEQ ID NO: 2212673 - DNA, 13 bp, Homo sapiens
aaaaactgatttt

SEQ ID NO: 2212674 - DNA, 12 bp, Homo sapiens
aaaaagaggcta

SEQ ID NO: 2212675 - DNA, 14 bp, Homo sapiens
aaaaaggaggaaga

SEQ ID NO: 2212676 - DNA, 16 bp, Homo sapiens
aaaaagggaaaaagac

SEQ ID NO: 2212677 - DNA, 12 bp, Homo sapiens
aaaaaggggggt

SEQ ID NO: 2212678 - DNA, 20 bp, Homo sapiens
aaaaatctcaaatttctaaa

SEQ ID NO: 2212679 - DNA, 13 bp, Homo sapiens
aaaacacattttt

SEQ ID NO: 2212680 - DNA, 15 bp, Homo sapiens
aaaacatgctacaca

SEQ ID NO: 2212681 - DNA, 17 bp, Homo sapiens
aaaacgtggctgcttca

SEQ ID NO: 2212682 - DNA, 21 bp, Homo sapiens
aaaacgtggctgcttcaagga

SEQ ID NO: 2212683 - DNA, 22 bp, Homo sapiens
aaaactgatttttttttccttc

SEQ ID NO: 2212684 - DNA, 20 bp, Homo sapiens
aaaactgctgactgttttct

SEQ ID NO: 2212685 - DNA, 11 bp, Homo sapiens
aaaagaaaaag

SEQ ID NO: 2212686 - DNA, 13 bp, Homo sapiens
aaaagatgcttct

SEQ ID NO: 2212687 - DNA, 22 bp, Homo sapiens
aaaaggagccaatttaaagaaa

SEQ ID NO: 2212688 - DNA, 14 bp, Homo sapiens
aaaaggatgcacag

SEQ ID NO: 2212689 - DNA, 15 bp, Homo sapiens
aaaaggatgcacaga

SEQ ID NO: 2212690 - DNA, 11 bp, Homo sapiens
aaaaggcagga

SEQ ID NO: 2212691 - DNA, 13 bp, Homo sapiens
aaaagggaaaaag

SEQ ID NO: 2212692 - DNA, 14 bp, Homo sapiens
aaaagggaaaaaga

SEQ ID NO: 2212693 - DNA, 18 bp, Homo sapiens
aaaagggaaaaagacctc

SEQ ID NO: 2212694 - DNA, 19 bp, Homo sapiens
aaaaggtatgcaatcaaat

SEQ ID NO: 2212695 - DNA, 16 bp, Homo sapiens
aaaataaaacttttta

SEQ ID NO: 2212696 - DNA, 17 bp, Homo sapiens
aaaataaaactttttaa

SEQ ID NO: 2212697 - DNA, 16 bp, Homo sapiens
aaaatccccaaaaaag

SEQ ID NO: 2212698 - DNA, 16 bp, Homo sapiens
aaaatgaaaaaaaaag

SEQ ID NO: 2212699 - DNA, 13 bp, Homo sapiens
aaaattcagtgga

SEQ ID NO: 2212700 - DNA, 19 bp, Homo sapiens
aaaatttagaaatataatt

SEQ ID NO: 2212701 - DNA, 20 bp, Homo sapiens
aaaattttgatgttttaagg

SEQ ID NO: 2212702 - DNA, 14 bp, Homo sapiens
aaacacaaaaaaag

SEQ ID NO: 2212703 - DNA, 16 bp, Homo sapiens
aaacacaaaaaaagac

SEQ ID NO: 2212704 - DNA, 19 bp, Homo sapiens
aaacacaaacgggctcagc

SEQ ID NO: 2212705 - DNA, 12 bp, Homo sapiens
aaacacattttt

SEQ ID NO: 2212706 - DNA, 16 bp, Homo sapiens
aaacacatttttctta

SEQ ID NO: 2212707 - DNA, 16 bp, Homo sapiens
aaacatgctacacact

SEQ ID NO: 2212708 - DNA, 17 bp, Homo sapiens
aaaccccatctctacaa

SEQ ID NO: 2212709 - DNA, 14 bp, Homo sapiens
aaacccttcagtgc

SEQ ID NO: 2212710 - DNA, 17 bp, Homo sapiens
aaacgtggctgcttcaa

SEQ ID NO: 2212711 - DNA, 20 bp, Homo sapiens
aaacgtggctgcttcaagga

SEQ ID NO: 2212712 - DNA, 21 bp, Homo sapiens
aaacgtggctgcttcaaggat

SEQ ID NO: 2212713 - DNA, 12 bp, Homo sapiens
aaactcttaaaa

SEQ ID NO: 2212714 - DNA, 23 bp, Homo sapiens
aaactcttaaaacccaagtgcct

SEQ ID NO: 2212715 - DNA, 13 bp, Homo sapiens
aaactgatttttt

SEQ ID NO: 2212716 - DNA, 22 bp, Homo sapiens
aaactgatttttttttccttca

SEQ ID NO: 2212717 - DNA, 18 bp, Homo sapiens
aaacttaatctaaatgga

SEQ ID NO: 2212718 - DNA, 22 bp, Homo sapiens
aaactttaccttttttatacat

SEQ ID NO: 2212719 - DNA, 17 bp, Homo sapiens
aaagacctcgtggagaa

SEQ ID NO: 2212720 - DNA, 23 bp, Homo sapiens
aaagagagagagagagagagaag

SEQ ID NO: 2212721 - DNA, 16 bp, Homo sapiens
aaagatattttgcttt

SEQ ID NO: 2212722 - DNA, 17 bp, Homo sapiens
aaagatattttgctttg

SEQ ID NO: 2212723 - DNA, 18 bp, Homo sapiens
aaagcagcgtttctatga

SEQ ID NO: 2212724 - DNA, 22 bp, Homo sapiens
aaagcagcgtttctatgacaca

SEQ ID NO: 2212725 - DNA, 15 bp, Homo sapiens
aaagccaaagctagg

SEQ ID NO: 2212726 - DNA, 17 bp, Homo sapiens
aaaggagagctagcagc

SEQ ID NO: 2212727 - DNA, 21 bp, Homo sapiens
aaaggagagctagcagcaggg

SEQ ID NO: 2212728 - DNA, 14 bp, Homo sapiens
aaaggatgcacaga

SEQ ID NO: 2212729 - DNA, 14 bp, Homo sapiens
aaaggctccaggag

SEQ ID NO: 2212730 - DNA, 16 bp, Homo sapiens
aaaggctccaggagca

SEQ ID NO: 2212731 - DNA, 19 bp, Homo sapiens
aaaggctccaggagcagcc

SEQ ID NO: 2212732 - DNA, 20 bp, Homo sapiens
aaaggctccaggagcagcca

SEQ ID NO: 2212733 - DNA, 14 bp, Homo sapiens
aaagggaaaaagac

SEQ ID NO: 2212734 - DNA, 19 bp, Homo sapiens
aaaggggggtgggagggga

SEQ ID NO: 2212735 - DNA, 21 bp, Homo sapiens
aaaggggggtgggaggggaag

SEQ ID NO: 2212736 - DNA, 11 bp, Homo sapiens
aaagtgctggg

SEQ ID NO: 2212737 - DNA, 13 bp, Homo sapiens
aaagtggaaaaat

SEQ ID NO: 2212738 - DNA, 12 bp, Homo sapiens
aaagtggtgaga

SEQ ID NO: 2212739 - DNA, 22 bp, Homo sapiens
aaagtgtatttttttactaata

SEQ ID NO: 2212740 - DNA, 13 bp, Homo sapiens
aaataaaactttt

SEQ ID NO: 2212741 - DNA, 13 bp, Homo sapiens
aaataatgtgaaa

SEQ ID NO: 2212742 - DNA, 22 bp, Homo sapiens
aaataatgtgaaactggattaa

SEQ ID NO: 2212743 - DNA, 19 bp, Homo sapiens
aaataccagccagtaaatg

SEQ ID NO: 2212744 - DNA, 14 bp, Homo sapiens
aaatataattgaca

SEQ ID NO: 2212745 - DNA, 12 bp, Homo sapiens
aaatcagcctgc

SEQ ID NO: 2212746 - DNA, 18 bp, Homo sapiens
aaatcccttacctcggtg

SEQ ID NO: 2212747 - DNA, 17 bp, Homo sapiens
aaatctcaaatttctaa

SEQ ID NO: 2212748 - DNA, 14 bp, Homo sapiens
aaatctttttgctt

SEQ ID NO: 2212749 - DNA, 12 bp, Homo sapiens
aaatgaaaaaaa

SEQ ID NO: 2212750 - DNA, 19 bp, Homo sapiens
aaatgagcctggcaagaat

SEQ ID NO: 2212751 - DNA, 17 bp, Homo sapiens
aaatgaggtcagagcct

SEQ ID NO: 2212752 - DNA, 18 bp, Homo sapiens
aaatgcacctggaatata

SEQ ID NO: 2212753 - DNA, 22 bp, Homo sapiens
aaatgcacctggaatatataac

SEQ ID NO: 2212754 - DNA, 15 bp, Homo sapiens
aaatgcccagcccct

SEQ ID NO: 2212755 - DNA, 18 bp, Homo sapiens
aaatggaagacagctctt

SEQ ID NO: 2212756 - DNA, 15 bp, Homo sapiens
aaatggacgtgttat

SEQ ID NO: 2212757 - DNA, 17 bp, Homo sapiens
aaatggacgtgttatga

SEQ ID NO: 2212758 - DNA, 21 bp, Homo sapiens
aaatggacgtgttatgactcc

SEQ ID NO: 2212759 - DNA, 15 bp, Homo sapiens
aaatgggcagagcag

SEQ ID NO: 2212760 - DNA, 18 bp, Homo sapiens
aaatgggggtgcatttga

SEQ ID NO: 2212761 - DNA, 23 bp, Homo sapiens
aaattaacttttataaactttac

SEQ ID NO: 2212762 - DNA, 15 bp, Homo sapiens
aaattcttgcaaagt

SEQ ID NO: 2212763 - DNA, 18 bp, Homo sapiens
aaattcttgcaaagtatc

SEQ ID NO: 2212764 - DNA, 18 bp, Homo sapiens
aaatttgttataatgaat

SEQ ID NO: 2212765 - DNA, 22 bp, Homo sapiens
aacaaacctgtttctgcagcca

SEQ ID NO: 2212766 - DNA, 20 bp, Homo sapiens
aacaagaccacgtttctaaa

SEQ ID NO: 2212767 - DNA, 21 bp, Homo sapiens
aacacatacaggaaggtagaa

SEQ ID NO: 2212768 - DNA, 19 bp, Homo sapiens
aacacatttttcttaggga

SEQ ID NO: 2212769 - DNA, 18 bp, Homo sapiens
aacactgttctctgccct

SEQ ID NO: 2212770 - DNA, 10 bp, Homo sapiens
aacagaaatg

SEQ ID NO: 2212771 - DNA, 15 bp, Homo sapiens
aacagaaatgtacag

SEQ ID NO: 2212772 - DNA, 21 bp, Homo sapiens
aacagaaatgtacagcaagga

SEQ ID NO: 2212773 - DNA, 19 bp, Homo sapiens
aacagactggaagcacagc

SEQ ID NO: 2212774 - DNA, 11 bp, Homo sapiens
aacaggcagat

SEQ ID NO: 2212775 - DNA, 21 bp, Homo sapiens
aacatgtaattaagtactatg

SEQ ID NO: 2212776 - DNA, 18 bp, Homo sapiens
aaccacatcttgctctgc

SEQ ID NO: 2212777 - DNA, 13 bp, Homo sapiens
aaccacgctggac

SEQ ID NO: 2212778 - DNA, 15 bp, Homo sapiens
aaccacttcagctga

SEQ ID NO: 2212779 - DNA, 12 bp, Homo sapiens
aaccatcattga

SEQ ID NO: 2212780 - DNA, 18 bp, Homo sapiens
aaccatcattgaaatctt

SEQ ID NO: 2212781 - DNA, 11 bp, Homo sapiens
aacccagctct

SEQ ID NO: 2212782 - DNA, 14 bp, Homo sapiens
aaccctggtgacca

SEQ ID NO: 2212783 - DNA, 14 bp, Homo sapiens
aacctcctgggcta

SEQ ID NO: 2212784 - DNA, 12 bp, Homo sapiens
aacgtggctgct

SEQ ID NO: 2212785 - DNA, 23 bp, Homo sapiens
aacgtggctgcttcaaggatcct

SEQ ID NO: 2212786 - DNA, 18 bp, Homo sapiens
aactcaccccagccccaa

SEQ ID NO: 2212787 - DNA, 16 bp, Homo sapiens
aactcacctgcccctc

SEQ ID NO: 2212788 - DNA, 23 bp, Homo sapiens
aactctcctctgctgctggctgg

SEQ ID NO: 2212789 - DNA, 20 bp, Homo sapiens
aactgatttttttttccttc

SEQ ID NO: 2212790 - DNA, 23 bp, Homo sapiens
aactgctgactgttttctcttga

SEQ ID NO: 2212791 - DNA, 22 bp, Homo sapiens
aactgggggagggtgaagtgaa

SEQ ID NO: 2212792 - DNA, 16 bp, Homo sapiens
aactgggtacttgtgg

SEQ ID NO: 2212793 - DNA, 21 bp, Homo sapiens
aactgggtacttgtggacaca

SEQ ID NO: 2212794 - DNA, 15 bp, Homo sapiens
aacttaatctaaatg

SEQ ID NO: 2212795 - DNA, 16 bp, Homo sapiens
aacttaatctaaatgg

SEQ ID NO: 2212796 - DNA, 14 bp, Homo sapiens
aacttcacatattg

SEQ ID NO: 2212797 - DNA, 23 bp, Homo sapiens
aacttggttcccatttgctcctt

SEQ ID NO: 2212798 - DNA, 22 bp, Homo sapiens
aacttgtctttggaccctgagg

SEQ ID NO: 2212799 - DNA, 22 bp, Homo sapiens
aactttaccttttttatacata

SEQ ID NO: 2212800 - DNA, 14 bp, Homo sapiens
aactttgacctctg

SEQ ID NO: 2212801 - DNA, 19 bp, Homo sapiens
aacttttataaactttacc

SEQ ID NO: 2212802 - DNA, 9 bp, Homo sapiens
aagaaaaac

SEQ ID NO: 2212803 - DNA, 20 bp, Homo sapiens
aagaaaaaggatgcacagag

SEQ ID NO: 2212804 - DNA, 22 bp, Homo sapiens
aagaaaaaggatgcacagagtt

SEQ ID NO: 2212805 - DNA, 17 bp, Homo sapiens
aagaaaaatgagcctgg

SEQ ID NO: 2212806 - DNA, 18 bp, Homo sapiens
aagaaaaatgagcctggc

SEQ ID NO: 2212807 - DNA, 21 bp, Homo sapiens
aagaaaatagtggtgtgattt

SEQ ID NO: 2212808 - DNA, 16 bp, Homo sapiens
aagaattgaagcagga

SEQ ID NO: 2212809 - DNA, 15 bp, Homo sapiens
aagaccacgtttcta

SEQ ID NO: 2212810 - DNA, 19 bp, Homo sapiens
aagaccttctccttcacct

SEQ ID NO: 2212811 - DNA, 20 bp, Homo sapiens
aagacgctgtgctgccctgc

SEQ ID NO: 2212812 - DNA, 17 bp, Homo sapiens
aagactatctaaatgtt

SEQ ID NO: 2212813 - DNA, 17 bp, Homo sapiens
aagactgagtacgttgt

SEQ ID NO: 2212814 - DNA, 22 bp, Homo sapiens
aagactgagtacgttgtgcatt

SEQ ID NO: 2212815 - DNA, 16 bp, Homo sapiens
aagactttggaaagac

SEQ ID NO: 2212816 - DNA, 17 bp, Homo sapiens
aagacttttccaaccct

SEQ ID NO: 2212817 - DNA, 13 bp, Homo sapiens
aagagaaaaaata

SEQ ID NO: 2212818 - DNA, 21 bp, Homo sapiens
aagagagacagcacaggcagc

SEQ ID NO: 2212819 - DNA, 14 bp, Homo sapiens
aagagagagagaga

SEQ ID NO: 2212820 - DNA, 22 bp, Homo sapiens
aagagagagagagagagagaag

SEQ ID NO: 2212821 - DNA, 12 bp, Homo sapiens
aagagcccaggc

SEQ ID NO: 2212822 - DNA, 11 bp, Homo sapiens
aagaggcaggg

SEQ ID NO: 2212823 - DNA, 16 bp, Homo sapiens
aagagtaggaagactt

SEQ ID NO: 2212824 - DNA, 19 bp, Homo sapiens
aagagtaggaagactttgg

SEQ ID NO: 2212825 - DNA, 20 bp, Homo sapiens
aagagtaggaagactttgga

SEQ ID NO: 2212826 - DNA, 14 bp, Homo sapiens
aagataaatgtgct

SEQ ID NO: 2212827 - DNA, 17 bp, Homo sapiens
aagatacagttactcag

SEQ ID NO: 2212828 - DNA, 15 bp, Homo sapiens
aagatattttgcttt

SEQ ID NO: 2212829 - DNA, 20 bp, Homo sapiens
aagatattttgctttgtgat

SEQ ID NO: 2212830 - DNA, 12 bp, Homo sapiens
aagatgcagccg

SEQ ID NO: 2212831 - DNA, 17 bp, Homo sapiens
aagcacctcctgcctcg

SEQ ID NO: 2212832 - DNA, 15 bp, Homo sapiens
aagcagaaacaaaat

SEQ ID NO: 2212833 - DNA, 20 bp, Homo sapiens
aagcagcgtttctatgacac

SEQ ID NO: 2212834 - DNA, 21 bp, Homo sapiens
aagcagcgtttctatgacaca

SEQ ID NO: 2212835 - DNA, 22 bp, Homo sapiens
aagcagcgtttctatgacacat

SEQ ID NO: 2212836 - DNA, 14 bp, Homo sapiens
aagcagtgcatgct

SEQ ID NO: 2212837 - DNA, 18 bp, Homo sapiens
aagccagcaggctctcag

SEQ ID NO: 2212838 - DNA, 21 bp, Homo sapiens
aagccgtgattttcattgctg

SEQ ID NO: 2212839 - DNA, 16 bp, Homo sapiens
aagcctcccacgactg

SEQ ID NO: 2212840 - DNA, 19 bp, Homo sapiens
aagcctcctccagccgcca

SEQ ID NO: 2212841 - DNA, 15 bp, Homo sapiens
aagcgattcttctgc

SEQ ID NO: 2212842 - DNA, 17 bp, Homo sapiens
aagcgattcttctgctt

SEQ ID NO: 2212843 - DNA, 21 bp, Homo sapiens
aagcgattcttctgcttcagc

SEQ ID NO: 2212844 - DNA, 17 bp, Homo sapiens
aagctaggcctggccag

SEQ ID NO: 2212845 - DNA, 18 bp, Homo sapiens
aagctaggcctggccaga

SEQ ID NO: 2212846 - DNA, 19 bp, Homo sapiens
aagctcagggcctggctca

SEQ ID NO: 2212847 - DNA, 22 bp, Homo sapiens
aagctcccaggcattccccagg

SEQ ID NO: 2212848 - DNA, 13 bp, Homo sapiens
aagctctgctcct

SEQ ID NO: 2212849 - DNA, 13 bp, Homo sapiens
aagctgcaccctc

SEQ ID NO: 2212850 - DNA, 20 bp, Homo sapiens
aagctgcaccctcaggcagg

SEQ ID NO: 2212851 - DNA, 11 bp, Homo sapiens
aagctgccagc

SEQ ID NO: 2212852 - DNA, 22 bp, Homo sapiens
aagctgccagccgagatagcca

SEQ ID NO: 2212853 - DNA, 11 bp, Homo sapiens
aagctgggcag

SEQ ID NO: 2212854 - DNA, 16 bp, Homo sapiens
aaggaaacccagctct

SEQ ID NO: 2212855 - DNA, 22 bp, Homo sapiens
aaggaaacccagctctggtcca

SEQ ID NO: 2212856 - DNA, 15 bp, Homo sapiens
aaggaaagagggagg

SEQ ID NO: 2212857 - DNA, 18 bp, Homo sapiens
aaggaatacctgtccccc

SEQ ID NO: 2212858 - DNA, 18 bp, Homo sapiens
aaggacattgcggacagc

SEQ ID NO: 2212859 - DNA, 20 bp, Homo sapiens
aaggaggggatagagagaga

SEQ ID NO: 2212860 - DNA, 11 bp, Homo sapiens
aaggatcctga

SEQ ID NO: 2212861 - DNA, 13 bp, Homo sapiens
aaggatcctgagc

SEQ ID NO: 2212862 - DNA, 15 bp, Homo sapiens
aaggatcctgagcca

SEQ ID NO: 2212863 - DNA, 20 bp, Homo sapiens
aaggatcctgagccagattt

SEQ ID NO: 2212864 - DNA, 22 bp, Homo sapiens
aaggatcctgagccagatttca

SEQ ID NO: 2212865 - DNA, 18 bp, Homo sapiens
aaggatgcacagagttgt

SEQ ID NO: 2212866 - DNA, 24 bp, Homo sapiens
aaggatgcacagagttgttacatt

SEQ ID NO: 2212867 - DNA, 15 bp, Homo sapiens
aaggcaaggctgtca

SEQ ID NO: 2212868 - DNA, 16 bp, Homo sapiens
aaggcaaggctgtcaa

SEQ ID NO: 2212869 - DNA, 17 bp, Homo sapiens
aaggcaaggctgtcaat

SEQ ID NO: 2212870 - DNA, 18 bp, Homo sapiens
aaggcaaggctgtcaatt

SEQ ID NO: 2212871 - DNA, 18 bp, Homo sapiens
aaggccaaaggaagcaca

SEQ ID NO: 2212872 - DNA, 14 bp, Homo sapiens
aaggctccaggagc

SEQ ID NO: 2212873 - DNA, 18 bp, Homo sapiens
aaggctcgagcatgcctg

SEQ ID NO: 2212874 - DNA, 19 bp, Homo sapiens
aaggctcgagcatgcctgg

SEQ ID NO: 2212875 - DNA, 22 bp, Homo sapiens
aaggctcgagcatgcctggatg

SEQ ID NO: 2212876 - DNA, 19 bp, Homo sapiens
aaggctgggggaagaagct

SEQ ID NO: 2212877 - DNA, 13 bp, Homo sapiens
aagggcccagaga

SEQ ID NO: 2212878 - DNA, 23 bp, Homo sapiens
aaggggaatgtttgcctctgcct

SEQ ID NO: 2212879 - DNA, 22 bp, Homo sapiens
aaggggcccaaattctttcagt

SEQ ID NO: 2212880 - DNA, 18 bp, Homo sapiens
aaggggcccaagagagac

SEQ ID NO: 2212881 - DNA, 19 bp, Homo sapiens
aaggggcccaagagagaca

SEQ ID NO: 2212882 - DNA, 16 bp, Homo sapiens
aaggttaataaagtaa

SEQ ID NO: 2212883 - DNA, 20 bp, Homo sapiens
aaggttaatgttcatcatcc

SEQ ID NO: 2212884 - DNA, 15 bp, Homo sapiens
aagtaatatgcacac

SEQ ID NO: 2212885 - DNA, 16 bp, Homo sapiens
aagtaatatgcacaca

SEQ ID NO: 2212886 - DNA, 17 bp, Homo sapiens
aagtaatatgcacacat

SEQ ID NO: 2212887 - DNA, 18 bp, Homo sapiens
aagtaatatgcacacatt

SEQ ID NO: 2212888 - DNA, 20 bp, Homo sapiens
aagtaatatgcacacatttt

SEQ ID NO: 2212889 - DNA, 21 bp, Homo sapiens
aagtaatatgcacacattttt

SEQ ID NO: 2212890 - DNA, 16 bp, Homo sapiens
aagtatccctactgta

SEQ ID NO: 2212891 - DNA, 18 bp, Homo sapiens
aagtcctcttttctgaga

SEQ ID NO: 2212892 - DNA, 18 bp, Homo sapiens
aagtcttagatgtatata

SEQ ID NO: 2212893 - DNA, 19 bp, Homo sapiens
aagtcttagatgtatatat

SEQ ID NO: 2212894 - DNA, 19 bp, Homo sapiens
aagtgaagacaatgactta

SEQ ID NO: 2212895 - DNA, 16 bp, Homo sapiens
aagtgaggatgaaaaa

SEQ ID NO: 2212896 - DNA, 19 bp, Homo sapiens
aagtgatcctcccacctca

SEQ ID NO: 2212897 - DNA, 20 bp, Homo sapiens
aagtgatcctcccacctcag

SEQ ID NO: 2212898 - DNA, 16 bp, Homo sapiens
aagtgattctcctgcc

SEQ ID NO: 2212899 - DNA, 17 bp, Homo sapiens
aagtgattctcctgcct

SEQ ID NO: 2212900 - DNA, 18 bp, Homo sapiens
aagtgattctcctgcctc

SEQ ID NO: 2212901 - DNA, 13 bp, Homo sapiens
aagtgctgcattt

SEQ ID NO: 2212902 - DNA, 14 bp, Homo sapiens
aagtgctgcattta

SEQ ID NO: 2212903 - DNA, 12 bp, Homo sapiens
aagtgctgggat

SEQ ID NO: 2212904 - DNA, 22 bp, Homo sapiens
aagtgctgggattacaggtgtg

SEQ ID NO: 2212905 - DNA, 19 bp, Homo sapiens
aagtggaaaaatagcctgc

SEQ ID NO: 2212906 - DNA, 13 bp, Homo sapiens
aagtgtggtagag

SEQ ID NO: 2212907 - DNA, 19 bp, Homo sapiens
aagtttctgccgcagccct

SEQ ID NO: 2212908 - DNA, 12 bp, Homo sapiens
aataaaactttt

SEQ ID NO: 2212909 - DNA, 17 bp, Homo sapiens
aataatgtgaaactgga

SEQ ID NO: 2212910 - DNA, 13 bp, Homo sapiens
aatacagaggcaa

SEQ ID NO: 2212911 - DNA, 20 bp, Homo sapiens
aatacagtatctcagggcct

SEQ ID NO: 2212912 - DNA, 14 bp, Homo sapiens
aatagctgggacta

SEQ ID NO: 2212913 - DNA, 15 bp, Homo sapiens
aataggaaaaactga

SEQ ID NO: 2212914 - DNA, 16 bp, Homo sapiens
aataggaaaaactgat

SEQ ID NO: 2212915 - DNA, 18 bp, Homo sapiens
aataggaaaaactgattt

SEQ ID NO: 2212916 - DNA, 21 bp, Homo sapiens
aatagttcaggtaacaggcag

SEQ ID NO: 2212917 - DNA, 16 bp, Homo sapiens
aatataggaacttaaa

SEQ ID NO: 2212918 - DNA, 21 bp, Homo sapiens
aatataggaacttaaataatg

SEQ ID NO: 2212919 - DNA, 17 bp, Homo sapiens
aatatctgaaaatgtat

SEQ ID NO: 2212920 - DNA, 15 bp, Homo sapiens
aatatgcacacattt

SEQ ID NO: 2212921 - DNA, 23 bp, Homo sapiens
aatatgtggagttcatcttgaat

SEQ ID NO: 2212922 - DNA, 13 bp, Homo sapiens
aatattaagaaag

SEQ ID NO: 2212923 - DNA, 18 bp, Homo sapiens
aatattgatatgcttata

SEQ ID NO: 2212924 - DNA, 18 bp, Homo sapiens
aatattgctgatggtgca

SEQ ID NO: 2212925 - DNA, 19 bp, Homo sapiens
aatcagcctgctccagctg

SEQ ID NO: 2212926 - DNA, 15 bp, Homo sapiens
aatctaaatggaacc

SEQ ID NO: 2212927 - DNA, 14 bp, Homo sapiens
aatctccaaaataa

SEQ ID NO: 2212928 - DNA, 23 bp, Homo sapiens
aatcttctgaacttggcgctgcc

SEQ ID NO: 2212929 - DNA, 22 bp, Homo sapiens
aatgaaaaaaaaaggggggtgg

SEQ ID NO: 2212930 - DNA, 16 bp, Homo sapiens
aatgaaagactgtaca

SEQ ID NO: 2212931 - DNA, 17 bp, Homo sapiens
aatgaaagactgtacaa

SEQ ID NO: 2212932 - DNA, 20 bp, Homo sapiens
aatgaatgtcagtgtgactg

SEQ ID NO: 2212933 - DNA, 18 bp, Homo sapiens
aatgacctttcaatagga

SEQ ID NO: 2212934 - DNA, 20 bp, Homo sapiens
aatgacctttcaataggaaa

SEQ ID NO: 2212935 - DNA, 12 bp, Homo sapiens
aatgagcctggc

SEQ ID NO: 2212936 - DNA, 13 bp, Homo sapiens
aatgagcctggca

SEQ ID NO: 2212937 - DNA, 15 bp, Homo sapiens
aatgagcctggcaag

SEQ ID NO: 2212938 - DNA, 18 bp, Homo sapiens
aatgaggtcagagcctgc

SEQ ID NO: 2212939 - DNA, 12 bp, Homo sapiens
aatgattaatta

SEQ ID NO: 2212940 - DNA, 16 bp, Homo sapiens
aatgattaattaaaac

SEQ ID NO: 2212941 - DNA, 12 bp, Homo sapiens
aatgcaaaccat

SEQ ID NO: 2212942 - DNA, 14 bp, Homo sapiens
aatgcaaaccatca

SEQ ID NO: 2212943 - DNA, 20 bp, Homo sapiens
aatgcacaaacagaggccgc

SEQ ID NO: 2212944 - DNA, 13 bp, Homo sapiens
aatgcacctggaa

SEQ ID NO: 2212945 - DNA, 21 bp, Homo sapiens
aatgcactttgttctggctct

SEQ ID NO: 2212946 - DNA, 22 bp, Homo sapiens
aatgcactttgttctggctctt

SEQ ID NO: 2212947 - DNA, 24 bp, Homo sapiens
aatgcccagccccttctgacccat

SEQ ID NO: 2212948 - DNA, 23 bp, Homo sapiens
aatgccttaccctcatgttctta

SEQ ID NO: 2212949 - DNA, 16 bp, Homo sapiens
aatgcgggggagcagg

SEQ ID NO: 2212950 - DNA, 17 bp, Homo sapiens
aatgcgggggagcaggc

SEQ ID NO: 2212951 - DNA, 20 bp, Homo sapiens
aatgcgggggagcaggcagt

SEQ ID NO: 2212952 - DNA, 21 bp, Homo sapiens
aatgctggctgttggctgggg

SEQ ID NO: 2212953 - DNA, 22 bp, Homo sapiens
aatgctggctgttggctggggg

SEQ ID NO: 2212954 - DNA, 14 bp, Homo sapiens
aatggaaccactct

SEQ ID NO: 2212955 - DNA, 13 bp, Homo sapiens
aatggaagacagc

SEQ ID NO: 2212956 - DNA, 18 bp, Homo sapiens
aatggaagacagctctta

SEQ ID NO: 2212957 - DNA, 21 bp, Homo sapiens
aatggacgtgttatgactcca

SEQ ID NO: 2212958 - DNA, 23 bp, Homo sapiens
aatggacgtgttatgactccaga

SEQ ID NO: 2212959 - DNA, 16 bp, Homo sapiens
aatggcagccttggca

SEQ ID NO: 2212960 - DNA, 15 bp, Homo sapiens
aatgggcagagcaga

SEQ ID NO: 2212961 - DNA, 17 bp, Homo sapiens
aatgggggtgcatttga

SEQ ID NO: 2212962 - DNA, 22 bp, Homo sapiens
aatggttttcttgtgtgtttat

SEQ ID NO: 2212963 - DNA, 13 bp, Homo sapiens
aatgtaagctcta

SEQ ID NO: 2212964 - DNA, 19 bp, Homo sapiens
aatgtatgtgtaagtattc

SEQ ID NO: 2212965 - DNA, 16 bp, Homo sapiens
aatgtcacaggcaggt

SEQ ID NO: 2212966 - DNA, 21 bp, Homo sapiens
aatgttctctcttctccacct

SEQ ID NO: 2212967 - DNA, 12 bp, Homo sapiens
accttctccttc

SEQ ID NO: 2212968 - DNA, 22 bp, Homo sapiens
accttctccttcacctttgtcc

SEQ ID NO: 2212969 - DNA, 15 bp, Homo sapiens
accttgaatgatgcc

SEQ ID NO: 2212970 - DNA, 12 bp, Homo sapiens
accttggctcaa

SEQ ID NO: 2212971 - DNA, 12 bp, Homo sapiens
accttggctgca

SEQ ID NO: 2212972 - DNA, 17 bp, Homo sapiens
accttggctgcagggag

SEQ ID NO: 2212973 - DNA, 18 bp, Homo sapiens
accttggctgcagggagt

SEQ ID NO: 2212974 - DNA, 21 bp, Homo sapiens
acctttcaataggaaaaactg

SEQ ID NO: 2212975 - DNA, 18 bp, Homo sapiens
acctttgtccccaccgca

SEQ ID NO: 2212976 - DNA, 20 bp, Homo sapiens
accttttgagtgccttacac

SEQ ID NO: 2212977 - DNA, 14 bp, Homo sapiens
accttttttataca

SEQ ID NO: 2212978 - DNA, 18 bp, Homo sapiens
accttttttatacataaa

SEQ ID NO: 2212979 - DNA, 14 bp, Homo sapiens
acgaatattgctga

SEQ ID NO: 2212980 - DNA, 21 bp, Homo sapiens
acgaatattgctgatggtgca

SEQ ID NO: 2212981 - DNA, 16 bp, Homo sapiens
acgagcaggcttcttc

SEQ ID NO: 2212982 - DNA, 20 bp, Homo sapiens
acgatttctgtttagataat

SEQ ID NO: 2212983 - DNA, 23 bp, Homo sapiens
acgccaggggaaaatcagcctgc

SEQ ID NO: 2212984 - DNA, 11 bp, Homo sapiens
acgccatccca

SEQ ID NO: 2212985 - DNA, 14 bp, Homo sapiens
acgccatcccagcc

SEQ ID NO: 2212986 - DNA, 14 bp, Homo sapiens
acgcccccactggt

SEQ ID NO: 2212987 - DNA, 20 bp, Homo sapiens
acgcgtgcacacaccagagc

SEQ ID NO: 2212988 - DNA, 23 bp, Homo sapiens
acgctggaccttgaactgggtac

SEQ ID NO: 2212989 - DNA, 19 bp, Homo sapiens
acgctggagtgcagtgagc

SEQ ID NO: 2212990 - DNA, 15 bp, Homo sapiens
agcacgatttctgtt

SEQ ID NO: 2212991 - DNA, 15 bp, Homo sapiens
agcactctggggtgg

SEQ ID NO: 2212992 - DNA, 21 bp, Homo sapiens
agcactctggggtgggagggt

SEQ ID NO: 2212993 - DNA, 22 bp, Homo sapiens
agcactttgggaggccaaggtg

SEQ ID NO: 2212994 - DNA, 13 bp, Homo sapiens
agcagaaatgcct

SEQ ID NO: 2212995 - DNA, 22 bp, Homo sapiens
agcagagaatgaaagggcccag

SEQ ID NO: 2212996 - DNA, 23 bp, Homo sapiens
agcagagaatgaaagggcccaga

SEQ ID NO: 2212997 - DNA, 16 bp, Homo sapiens
agcagagaccatccct

SEQ ID NO: 2212998 - DNA, 18 bp, Homo sapiens
agcagagaccatccctga

SEQ ID NO: 2212999 - DNA, 20 bp, Homo sapiens
agcagagaccatccctgaag

SEQ ID NO: 2213000 - DNA, 16 bp, Homo sapiens
agcagcagggagggct

SEQ ID NO: 2213001 - DNA, 17 bp, Homo sapiens
agcaggcagtggggctg

SEQ ID NO: 2213002 - DNA, 14 bp, Homo sapiens
agcaggctctcagg

SEQ ID NO: 2213003 - DNA, 15 bp, Homo sapiens
agcagggaaacagct

SEQ ID NO: 2213004 - DNA, 22 bp, Homo sapiens
agcagggctcagcggggacagc

SEQ ID NO: 2213005 - DNA, 19 bp, Homo sapiens
agcagtgcatgctgtccct

SEQ ID NO: 2213006 - DNA, 20 bp, Homo sapiens
agcagtgcatgctgtccctt

SEQ ID NO: 2213007 - DNA, 20 bp, Homo sapiens
agcatacgtacacattttat

SEQ ID NO: 2213008 - DNA, 17 bp, Homo sapiens
agcatattcaggaagct

SEQ ID NO: 2213009 - DNA, 20 bp, Homo sapiens
agcatcaggccaggccctct

SEQ ID NO: 2213010 - DNA, 22 bp, Homo sapiens
agcatcaggccaggccctctgc

SEQ ID NO: 2213011 - DNA, 14 bp, Homo sapiens
agcatcctggcacc

SEQ ID NO: 2213012 - DNA, 18 bp, Homo sapiens
agcatcctggcacccggc

SEQ ID NO: 2213013 - DNA, 22 bp, Homo sapiens
agcatcctggcacccggcccct

SEQ ID NO: 2213014 - DNA, 23 bp, Homo sapiens
agcatcctggcacccggcccctg

SEQ ID NO: 2213015 - DNA, 16 bp, Homo sapiens
agcatctatgtgagac

SEQ ID NO: 2213016 - DNA, 20 bp, Homo sapiens
agcatgcctggatggggctg

SEQ ID NO: 2213017 - DNA, 12 bp, Homo sapiens
agcatggctgcc

SEQ ID NO: 2213018 - DNA, 19 bp, Homo sapiens
agcatggctgccaatggga

SEQ ID NO: 2213019 - DNA, 22 bp, Homo sapiens
agcattttgctaaatgtgaatg

SEQ ID NO: 2213020 - DNA, 16 bp, Homo sapiens
agccaaagctaggcct

SEQ ID NO: 2213021 - DNA, 18 bp, Homo sapiens
agccaaagctaggcctgg

SEQ ID NO: 2213022 - DNA, 20 bp, Homo sapiens
agccaaagctaggcctggcc

SEQ ID NO: 2213023 - DNA, 22 bp, Homo sapiens
agccaaggccaaaggaagcaca

SEQ ID NO: 2213024 - DNA, 15 bp, Homo sapiens
agccacggccaggcc

SEQ ID NO: 2213025 - DNA, 13 bp, Homo sapiens
agccactgcaccg

SEQ ID NO: 2213026 - DNA, 18 bp, Homo sapiens
agccactgcaccgggcca

SEQ ID NO: 2213027 - DNA, 15 bp, Homo sapiens
agccagaggagagag

SEQ ID NO: 2213028 - DNA, 17 bp, Homo sapiens
agccagaggagagagga

SEQ ID NO: 2213029 - DNA, 22 bp, Homo sapiens
agccagcaggctctcaggccag

SEQ ID NO: 2213030 - DNA, 14 bp, Homo sapiens
agccaggccacaag

SEQ ID NO: 2213031 - DNA, 22 bp, Homo sapiens
agccagtaaatgggggtgcatt

SEQ ID NO: 2213032 - DNA, 13 bp, Homo sapiens
agcccaccttggc

SEQ ID NO: 2213033 - DNA, 20 bp, Homo sapiens
agcccacgcccccactggtg

SEQ ID NO: 2213034 - DNA, 19 bp, Homo sapiens
agcccaggaaaggctccag

SEQ ID NO: 2213035 - DNA, 19 bp, Homo sapiens
agcccaggcctcctacagc

SEQ ID NO: 2213036 - DNA, 21 bp, Homo sapiens
agcccaggcctcctacagctt

SEQ ID NO: 2213037 - DNA, 17 bp, Homo sapiens
agccccaaaactctcct

SEQ ID NO: 2213038 - DNA, 18 bp, Homo sapiens
agccccaaaactctcctc

SEQ ID NO: 2213039 - DNA, 22 bp, Homo sapiens
agccccaaaactctcctctgct

SEQ ID NO: 2213040 - DNA, 16 bp, Homo sapiens
agccccagtgcccaca

SEQ ID NO: 2213041 - DNA, 17 bp, Homo sapiens
agccccattctgcctgc

SEQ ID NO: 2213042 - DNA, 20 bp, Homo sapiens
agccccattctgcctgccca

SEQ ID NO: 2213043 - DNA, 15 bp, Homo sapiens
agccccttctgaccc

SEQ ID NO: 2213044 - DNA, 14 bp, Homo sapiens
agcccgggctctgc

SEQ ID NO: 2213045 - DNA, 14 bp, Homo sapiens
agccctggtggcag

SEQ ID NO: 2213046 - DNA, 23 bp, Homo sapiens
agcccttctaccttcctgcaaca

SEQ ID NO: 2213047 - DNA, 18 bp, Homo sapiens
agccgagatcacgccact

SEQ ID NO: 2213048 - DNA, 20 bp, Homo sapiens
agccgagatcacgccactgc

SEQ ID NO: 2213049 - DNA, 15 bp, Homo sapiens
agcctcaacctcctg

SEQ ID NO: 2213050 - DNA, 13 bp, Homo sapiens
agcctcagcatcc

SEQ ID NO: 2213051 - DNA, 19 bp, Homo sapiens
agcctcagcatcctggcac

SEQ ID NO: 2213052 - DNA, 22 bp, Homo sapiens
agcctcagcatcctggcacccg

SEQ ID NO: 2213053 - DNA, 22 bp, Homo sapiens
agcctcccacgactgcccggca

SEQ ID NO: 2213054 - DNA, 18 bp, Homo sapiens
agcctcccgaatagctgg

SEQ ID NO: 2213055 - DNA, 17 bp, Homo sapiens
agcctcccgagtagctg

SEQ ID NO: 2213056 - DNA, 19 bp, Homo sapiens
agcctcccgagtagctggg

SEQ ID NO: 2213057 - DNA, 14 bp, Homo sapiens
agcctcctccagcc

SEQ ID NO: 2213058 - DNA, 13 bp, Homo sapiens
agcctcctgccct

SEQ ID NO: 2213059 - DNA, 23 bp, Homo sapiens
agcctctgaaaaccaatgttctc

SEQ ID NO: 2213060 - DNA, 23 bp, Homo sapiens
agcctgcagttattaacactaac

SEQ ID NO: 2213061 - DNA, 14 bp, Homo sapiens
agcctgctccagct

SEQ ID NO: 2213062 - DNA, 15 bp, Homo sapiens
agcctgctccagctg

SEQ ID NO: 2213063 - DNA, 16 bp, Homo sapiens
agcctgctccagctgt

SEQ ID NO: 2213064 - DNA, 20 bp, Homo sapiens
agccttagaagtcacacagt

SEQ ID NO: 2213065 - DNA, 15 bp, Homo sapiens
agccttgaactttga

SEQ ID NO: 2213066 - DNA, 22 bp, Homo sapiens
agccttgaactttgacctctgc

SEQ ID NO: 2213067 - DNA, 19 bp, Homo sapiens
agccttgaccattctccac

SEQ ID NO: 2213068 - DNA, 23 bp, Homo sapiens
agagggtggtgacctctgcctga

SEQ ID NO: 2213069 - DNA, 15 bp, Homo sapiens
agaggttaaggtggg

SEQ ID NO: 2213070 - DNA, 20 bp, Homo sapiens
agaggttcaaagatattttg

SEQ ID NO: 2213071 - DNA, 15 bp, Homo sapiens
agagtcactggaaca

SEQ ID NO: 2213072 - DNA, 15 bp, Homo sapiens
agagttgaagacaga

SEQ ID NO: 2213073 - DNA, 22 bp, Homo sapiens
agagttgatactacagtttgtt

SEQ ID NO: 2213074 - DNA, 12 bp, Homo sapiens
agagttgttaca

SEQ ID NO: 2213075 - DNA, 19 bp, Homo sapiens
agagttgttacatttttaa

SEQ ID NO: 2213076 - DNA, 17 bp, Homo sapiens
agataagggtatctggt

SEQ ID NO: 2213077 - DNA, 22 bp, Homo sapiens
agatacttggggggctgaggtg

SEQ ID NO: 2213078 - DNA, 15 bp, Homo sapiens
agatagccaaggcca

SEQ ID NO: 2213079 - DNA, 19 bp, Homo sapiens
agatatatgctctgcatgt

SEQ ID NO: 2213080 - DNA, 16 bp, Homo sapiens
agatcacgccactgca

SEQ ID NO: 2213081 - DNA, 17 bp, Homo sapiens
agatcacgccactgcac

SEQ ID NO: 2213082 - DNA, 14 bp, Homo sapiens
agatgagtgagcat

SEQ ID NO: 2213083 - DNA, 14 bp, Homo sapiens
agatgcaccagccc

SEQ ID NO: 2213084 - DNA, 15 bp, Homo sapiens
agatgcaccagccct

SEQ ID NO: 2213085 - DNA, 16 bp, Homo sapiens
agatgccgcatttgga

SEQ ID NO: 2213086 - DNA, 16 bp, Homo sapiens
agatgcttctcactgc

SEQ ID NO: 2213087 - DNA, 20 bp, Homo sapiens
agatgggtgcttggaggaag

SEQ ID NO: 2213088 - DNA, 19 bp, Homo sapiens
agatgtgcccccaccccca

SEQ ID NO: 2213089 - DNA, 23 bp, Homo sapiens
agatgtgcccccacccccaccct

SEQ ID NO: 2213090 - DNA, 15 bp, Homo sapiens
agattctttcctgag

SEQ ID NO: 2213091 - DNA, 17 bp, Homo sapiens
agattgcaacaggctgg

SEQ ID NO: 2213092 - DNA, 19 bp, Homo sapiens
agattgcaacaggctgggc

SEQ ID NO: 2213093 - DNA, 13 bp, Homo sapiens
agattggaaggaa

SEQ ID NO: 2213094 - DNA, 13 bp, Homo sapiens
agcaagacgctgt

SEQ ID NO: 2213095 - DNA, 16 bp, Homo sapiens
agcaagtgagaccctg

SEQ ID NO: 2213096 - DNA, 18 bp, Homo sapiens
agcacagaccctgccctg

SEQ ID NO: 2213097 - DNA, 19 bp, Homo sapiens
agcacagaccctgccctgt

SEQ ID NO: 2213098 - DNA, 21 bp, Homo sapiens
agcacagaccctgccctgtgg

SEQ ID NO: 2213099 - DNA, 19 bp, Homo sapiens
agcacatgcctctctcagg

SEQ ID NO: 2213100 - DNA, 20 bp, Homo sapiens
agcacatgcctctctcaggc

SEQ ID NO: 2213101 - DNA, 22 bp, Homo sapiens
agcacatgcctctctcaggcca

SEQ ID NO: 2213102 - DNA, 22 bp, Homo sapiens
agcaccaaaagcttaccaaggg

SEQ ID NO: 2213103 - DNA, 19 bp, Homo sapiens
agcaccttagacagtccct

SEQ ID NO: 2213104 - DNA, 18 bp, Homo sapiens
gctccagctcaccagccc

SEQ ID NO: 2213105 - DNA, 21 bp, Homo sapiens
gctccagctcaccagccccag

SEQ ID NO: 2213106 - DNA, 15 bp, Homo sapiens
gctccaggagcagcc

SEQ ID NO: 2213107 - DNA, 13 bp, Homo sapiens
gctccaggctcct

SEQ ID NO: 2213108 - DNA, 16 bp, Homo sapiens
gctccaggctccttta

SEQ ID NO: 2213109 - DNA, 17 bp, Homo sapiens
gctcccaggcattcccc

SEQ ID NO: 2213110 - DNA, 18 bp, Homo sapiens
gctccgctttctacccag

SEQ ID NO: 2213111 - DNA, 22 bp, Homo sapiens
gctccgctttctacccagcgag

SEQ ID NO: 2213112 - DNA, 24 bp, Homo sapiens
gctccgctttctacccagcgagcc

SEQ ID NO: 2213113 - DNA, 14 bp, Homo sapiens
gctcctggcccact

SEQ ID NO: 2213114 - DNA, 12 bp, Homo sapiens
gctcctgtgtct

SEQ ID NO: 2213115 - DNA, 13 bp, Homo sapiens
gctcctgtgtctt

SEQ ID NO: 2213116 - DNA, 13 bp, Homo sapiens
gctccttctgtcc

SEQ ID NO: 2213117 - DNA, 17 bp, Homo sapiens
gctcctttagcgcccag

SEQ ID NO: 2213118 - DNA, 16 bp, Homo sapiens
gctcgagcatgcctgg

SEQ ID NO: 2213119 - DNA, 14 bp, Homo sapiens
gctctcaggccagc

SEQ ID NO: 2213120 - DNA, 16 bp, Homo sapiens
gctctcaggccagctg

SEQ ID NO: 2213121 - DNA, 19 bp, Homo sapiens
gctctcaggccagctgctt

SEQ ID NO: 2213122 - DNA, 20 bp, Homo sapiens
gctctcaggccagctgcttg

SEQ ID NO: 2213123 - DNA, 21 bp, Homo sapiens
gctctcaggccagctgcttgg

SEQ ID NO: 2213124 - DNA, 17 bp, Homo sapiens
gctctccgaccagacac

SEQ ID NO: 2213125 - DNA, 21 bp, Homo sapiens
gctctgatcatccactgtgcc

SEQ ID NO: 2213126 - DNA, 22 bp, Homo sapiens
gctctgatcatccactgtgcca

SEQ ID NO: 2213127 - DNA, 23 bp, Homo sapiens
gctctgcaagaattgaagcagga

SEQ ID NO: 2213128 - DNA, 11 bp, Homo sapiens
gctctgccctt

SEQ ID NO: 2213129 - DNA, 13 bp, Homo sapiens
gctctgcccttgg

SEQ ID NO: 2213130 - DNA, 13 bp, Homo sapiens
gctctgcctccca

SEQ ID NO: 2213131 - DNA, 14 bp, Homo sapiens
gctctgcctcccat

SEQ ID NO: 2213132 - DNA, 13 bp, Homo sapiens
gctctgctcctct

SEQ ID NO: 2213133 - DNA, 18 bp, Homo sapiens
gctctgctgacagacaca

SEQ ID NO: 2213134 - DNA, 15 bp, Homo sapiens
gctctgtcctgggag

SEQ ID NO: 2213135 - DNA, 12 bp, Homo sapiens
gctcttccaggc

SEQ ID NO: 2213136 - DNA, 16 bp, Homo sapiens
gctcttccaggctggg

SEQ ID NO: 2213137 - DNA, 23 bp, Homo sapiens
gctgaaggctcgagcatgcctgg

SEQ ID NO: 2213138 - DNA, 22 bp, Homo sapiens
gctgaatacagaggcaactgca

SEQ ID NO: 2213139 - DNA, 15 bp, Homo sapiens
gctgacagacacagg

SEQ ID NO: 2213140 - DNA, 22 bp, Homo sapiens
gctgactgttttctcttgagag

SEQ ID NO: 2213141 - DNA, 15 bp, Homo sapiens
gctgagtctgaaggc

SEQ ID NO: 2213142 - DNA, 19 bp, Homo sapiens
gctgagtctgaaggctggg

SEQ ID NO: 2213143 - DNA, 23 bp, Homo sapiens
gctgagtgggggatcacagcctc

SEQ ID NO: 2213144 - DNA, 18 bp, Homo sapiens
gctgatggtgcaatgacc

SEQ ID NO: 2213145 - DNA, 22 bp, Homo sapiens
gctgcaccggctggcctggccc

SEQ ID NO: 2213146 - DNA, 13 bp, Homo sapiens
gctgcagttgcca

SEQ ID NO: 2213147 - DNA, 17 bp, Homo sapiens
gctgcagttgccagtca

SEQ ID NO: 2213148 - DNA, 20 bp, Homo sapiens
gctgccaatgggagctcatg

SEQ ID NO: 2213149 - DNA, 12 bp, Homo sapiens
gctgccatccag

SEQ ID NO: 2213150 - DNA, 23 bp, Homo sapiens
gctgccatccaggttcagcttgt

SEQ ID NO: 2213151 - DNA, 21 bp, Homo sapiens
gctgccctgcccacctggcct

SEQ ID NO: 2213152 - DNA, 22 bp, Homo sapiens
gctgccctgcccacctggcctc

SEQ ID NO: 2213153 - DNA, 12 bp, Homo sapiens
gctgccctgtga

SEQ ID NO: 2213154 - DNA, 14 bp, Homo sapiens
gctgccctgtgagt

SEQ ID NO: 2213155 - DNA, 12 bp, Homo sapiens
gctgcctgttca

SEQ ID NO: 2213156 - DNA, 20 bp, Homo sapiens
gctgcctgttcagctccagc

SEQ ID NO: 2213157 - DNA, 15 bp, Homo sapiens
gctgcggtccaccca

SEQ ID NO: 2213158 - DNA, 19 bp, Homo sapiens
gctgcggtccacccaggag

SEQ ID NO: 2213159 - DNA, 21 bp, Homo sapiens
gctgcggtccacccaggagcc

SEQ ID NO: 2213160 - DNA, 13 bp, Homo sapiens
gctgctgaaggct

SEQ ID NO: 2213161 - DNA, 23 bp, Homo sapiens
gctgcttcaaggatcctgagcca

SEQ ID NO: 2213162 - DNA, 17 bp, Homo sapiens
gctgcttgggcttcatc

SEQ ID NO: 2213163 - DNA, 22 bp, Homo sapiens
gctgcttgggcttcatcctcct

SEQ ID NO: 2213164 - DNA, 13 bp, Homo sapiens
gctggaagcagaa

SEQ ID NO: 2213165 - DNA, 19 bp, Homo sapiens
gctggaagcagaaacaaaa

SEQ ID NO: 2213166 - DNA, 15 bp, Homo sapiens
gctggaccttgaact

SEQ ID NO: 2213167 - DNA, 14 bp, Homo sapiens
gctggagtgcagtg

SEQ ID NO: 2213168 - DNA, 15 bp, Homo sapiens
gctggagtgcagtga

SEQ ID NO: 2213169 - DNA, 18 bp, Homo sapiens
gctggcgtgcagtggtgc

SEQ ID NO: 2213170 - DNA, 20 bp, Homo sapiens
gctggcgtgcagtggtgcga

SEQ ID NO: 2213171 - DNA, 15 bp, Homo sapiens
gctggctgttggctg

SEQ ID NO: 2213172 - DNA, 16 bp, Homo sapiens
gctggctgttggctgg

SEQ ID NO: 2213173 - DNA, 20 bp, Homo sapiens
gctgggacatgggaaagggg

SEQ ID NO: 2213174 - DNA, 19 bp, Homo sapiens
gctgggactacaggtgtga

SEQ ID NO: 2213175 - DNA, 17 bp, Homo sapiens
gctgggagagccttcca

SEQ ID NO: 2213176 - DNA, 22 bp, Homo sapiens
gctgggagagccttccaggggt

SEQ ID NO: 2213177 - DNA, 19 bp, Homo sapiens
gctgggatgattggagggg

SEQ ID NO: 2213178 - DNA, 21 bp, Homo sapiens
gctgggatgattggagggggg

SEQ ID NO: 2213179 - DNA, 13 bp, Homo sapiens
gctgggcagagga

SEQ ID NO: 2213180 - DNA, 19 bp, Homo sapiens
gctgggcttcagtggcagc

SEQ ID NO: 2213181 - DNA, 12 bp, Homo sapiens
gctggggccagt

SEQ ID NO: 2213182 - DNA, 13 bp, Homo sapiens
gctgggggcctca

SEQ ID NO: 2213183 - DNA, 20 bp, Homo sapiens
gctgggggcctcagtgccac

SEQ ID NO: 2213184 - DNA, 22 bp, Homo sapiens
gctgggtggcaccagcagcctg

SEQ ID NO: 2213185 - DNA, 23 bp, Homo sapiens
gctgggtggcaccagcagcctgg

SEQ ID NO: 2213186 - DNA, 20 bp, Homo sapiens
gctgggttctacccaggtgc

SEQ ID NO: 2213187 - DNA, 14 bp, Homo sapiens
gctggtcccactca

SEQ ID NO: 2213188 - DNA, 15 bp, Homo sapiens
gctggttcagggttg

SEQ ID NO: 2213189 - DNA, 22 bp, Homo sapiens
gctgtcaattacaggaagtact

SEQ ID NO: 2213190 - DNA, 23 bp, Homo sapiens
gctgtcaattacaggaagtactg

SEQ ID NO: 2213191 - DNA, 17 bp, Homo sapiens
gctgtcagccattcctg

SEQ ID NO: 2213192 - DNA, 15 bp, Homo sapiens
gctgtgctgccctgc

SEQ ID NO: 2213193 - DNA, 15 bp, Homo sapiens
gctgtgtctcccttc

SEQ ID NO: 2213194 - DNA, 15 bp, Homo sapiens
gcttagtcactgaga

SEQ ID NO: 2213195 - DNA, 14 bp, Homo sapiens
gcttcaaggatcct

SEQ ID NO: 2213196 - DNA, 20 bp, Homo sapiens
gcttcaaggatcctgagcca

SEQ ID NO: 2213197 - DNA, 17 bp, Homo sapiens
gcttcacggaagagcct

SEQ ID NO: 2213198 - DNA, 18 bp, Homo sapiens
gcttcacggaagagcctt

SEQ ID NO: 2213199 - DNA, 19 bp, Homo sapiens
gcttcacggaagagccttg

SEQ ID NO: 2213200 - DNA, 20 bp, Homo sapiens
gcttcacggaagagccttgc

SEQ ID NO: 2213201 - DNA, 12 bp, Homo sapiens
gcttcagcctcc

SEQ ID NO: 2213202 - DNA, 16 bp, Homo sapiens
gcttcatttcctgtgt

SEQ ID NO: 2213203 - DNA, 17 bp, Homo sapiens
gcttcatttcctgtgtc

SEQ ID NO: 2213204 - DNA, 15 bp, Homo sapiens
gcttccagtgaggct

SEQ ID NO: 2213205 - DNA, 17 bp, Homo sapiens
gcttctcactgccatgc

SEQ ID NO: 2213206 - DNA, 16 bp, Homo sapiens
gcttcttcagagactc

SEQ ID NO: 2213207 - DNA, 21 bp, Homo sapiens
gcttcttcagagactcctgca

SEQ ID NO: 2213208 - DNA, 18 bp, Homo sapiens
gcttgaccgtgaggccag

SEQ ID NO: 2213209 - DNA, 20 bp, Homo sapiens
gcttgaccgtgaggccagag

SEQ ID NO: 2213210 - DNA, 13 bp, Homo sapiens
gcttggaggaagg

SEQ ID NO: 2213211 - DNA, 14 bp, Homo sapiens
gcttggaggaagga

SEQ ID NO: 2213212 - DNA, 23 bp, Homo sapiens
gcttgggcttcatcctcctcaga

SEQ ID NO: 2213213 - DNA, 17 bp, Homo sapiens
gcttggggaccagagct

SEQ ID NO: 2213214 - DNA, 18 bp, Homo sapiens
gcttggggaccagagctg

SEQ ID NO: 2213215 - DNA, 17 bp, Homo sapiens
gcttgtaaatagctcag

SEQ ID NO: 2213216 - DNA, 19 bp, Homo sapiens
gcttgtaaatagctcaggt

SEQ ID NO: 2213217 - DNA, 16 bp, Homo sapiens
gtttgattcagacagc

SEQ ID NO: 2213218 - DNA, 21 bp, Homo sapiens
gtttgattcagacagctgcct

SEQ ID NO: 2213219 - DNA, 17 bp, Homo sapiens
gtttgcctctgcctctg

SEQ ID NO: 2213220 - DNA, 13 bp, Homo sapiens
gtttgctaagtga

SEQ ID NO: 2213221 - DNA, 18 bp, Homo sapiens
gtttggggatgagaaagg

SEQ ID NO: 2213222 - DNA, 19 bp, Homo sapiens
gtttgtaaattaactttta

SEQ ID NO: 2213223 - DNA, 16 bp, Homo sapiens
gttttactgcagcttt

SEQ ID NO: 2213224 - DNA, 18 bp, Homo sapiens
gttttactgcagctttgt

SEQ ID NO: 2213225 - DNA, 17 bp, Homo sapiens
gttttcaaaataaaaat

SEQ ID NO: 2213226 - DNA, 17 bp, Homo sapiens
gttttcagtgtacatgg

SEQ ID NO: 2213227 - DNA, 15 bp, Homo sapiens
gttttctgttctttc

SEQ ID NO: 2213228 - DNA, 19 bp, Homo sapiens
gttttctgttctttctggc

SEQ ID NO: 2213229 - DNA, 23 bp, Homo sapiens
gtttttatggcttttgtgcatta

SEQ ID NO: 2213230 - DNA, 16 bp, Homo sapiens
gtttttgtcttaaaaa

SEQ ID NO: 2213231 - DNA, 12 bp, Homo sapiens
gtttttgtttct

SEQ ID NO: 2213232 - DNA, 16 bp, Homo sapiens
taaaaagggaaaaaga

SEQ ID NO: 2213233 - DNA, 20 bp, Homo sapiens
taaaaatccccaaaaaagcg

SEQ ID NO: 2213234 - DNA, 21 bp, Homo sapiens
taaaaatctcaaatttctaaa

SEQ ID NO: 2213235 - DNA, 20 bp, Homo sapiens
taaaacttgatgtgttatct

SEQ ID NO: 2213236 - DNA, 15 bp, Homo sapiens
taaaactttttaaaa

SEQ ID NO: 2213237 - DNA, 12 bp, Homo sapiens
taaaaggtgacc

SEQ ID NO: 2213238 - DNA, 19 bp, Homo sapiens
taaacaagaccacgtttct

SEQ ID NO: 2213239 - DNA, 19 bp, Homo sapiens
taaacttaatctaaatgga

SEQ ID NO: 2213240 - DNA, 17 bp, Homo sapiens
taaagcagcgtttctat

SEQ ID NO: 2213241 - DNA, 21 bp, Homo sapiens
taaaggctacctttgtattct

SEQ ID NO: 2213242 - DNA, 21 bp, Homo sapiens
taaagtgtatttttttactaa

SEQ ID NO: 2213243 - DNA, 22 bp, Homo sapiens
taaagtgtatttttttactaat

SEQ ID NO: 2213244 - DNA, 19 bp, Homo sapiens
taaatcagccgtgtaacca

SEQ ID NO: 2213245 - DNA, 14 bp, Homo sapiens
taaatctccaaaat

SEQ ID NO: 2213246 - DNA, 18 bp, Homo sapiens
taaatctccaaaataaaa

SEQ ID NO: 2213247 - DNA, 21 bp, Homo sapiens
taaatctccaaaataaaactt

SEQ ID NO: 2213248 - DNA, 18 bp, Homo sapiens
taaatgaaaatcgtgaca

SEQ ID NO: 2213249 - DNA, 14 bp, Homo sapiens
taaatgcccagccc

SEQ ID NO: 2213250 - DNA, 14 bp, Homo sapiens
taaatgggggtgca

SEQ ID NO: 2213251 - DNA, 15 bp, Homo sapiens
taaatgttgaaagat

SEQ ID NO: 2213252 - DNA, 12 bp, Homo sapiens
taaattaacttt

SEQ ID NO: 2213253 - DNA, 15 bp, Homo sapiens
taaattaacttttat

SEQ ID NO: 2213254 - DNA, 17 bp, Homo sapiens
taaattaacttttataa

SEQ ID NO: 2213255 - DNA, 21 bp, Homo sapiens
taaattaacttttataaactt

SEQ ID NO: 2213256 - DNA, 17 bp, Homo sapiens
taaattcttgcaaagta

SEQ ID NO: 2213257 - DNA, 14 bp, Homo sapiens
taacagaaatgtac

SEQ ID NO: 2213258 - DNA, 18 bp, Homo sapiens
taacatggacatgatctt

SEQ ID NO: 2213259 - DNA, 23 bp, Homo sapiens
taacatggacatgatcttcttta

SEQ ID NO: 2213260 - DNA, 17 bp, Homo sapiens
taacatgtaattaagta

SEQ ID NO: 2213261 - DNA, 13 bp, Homo sapiens
taacttcacatat

SEQ ID NO: 2213262 - DNA, 16 bp, Homo sapiens
taacttgtctttggac

SEQ ID NO: 2213263 - DNA, 19 bp, Homo sapiens
taacttttataaactttac

SEQ ID NO: 2213264 - DNA, 22 bp, Homo sapiens
taagaaccttttgagtgcctta

SEQ ID NO: 2213265 - DNA, 15 bp, Homo sapiens
taagaggcagggtct

SEQ ID NO: 2213266 - DNA, 16 bp, Homo sapiens
taagataaatgtgctg

SEQ ID NO: 2213267 - DNA, 14 bp, Homo sapiens
taagattcatattt

SEQ ID NO: 2213268 - DNA, 9 bp, Homo sapiens
taaggaata

SEQ ID NO: 2213269 - DNA, 17 bp, Homo sapiens
taaggaatacctgtccc

SEQ ID NO: 2213270 - DNA, 18 bp, Homo sapiens
taaggaatacctgtcccc

SEQ ID NO: 2213271 - DNA, 16 bp, Homo sapiens
taaggatgttctagca

SEQ ID NO: 2213272 - DNA, 17 bp, Homo sapiens
taagggtatctggtgac

SEQ ID NO: 2213273 - DNA, 15 bp, Homo sapiens
taaggtgtgctctga

SEQ ID NO: 2213274 - DNA, 13 bp, Homo sapiens
taagtactatgta

SEQ ID NO: 2213275 - DNA, 16 bp, Homo sapiens
taagtactatgtatca

SEQ ID NO: 2213276 - DNA, 21 bp, Homo sapiens
taagtattcttatttaatgaa

SEQ ID NO: 2213277 - DNA, 16 bp, Homo sapiens
taagtgctgcatttaa

SEQ ID NO: 2213278 - DNA, 20 bp, Homo sapiens
taagtttttatggcttttgt

SEQ ID NO: 2213279 - DNA, 19 bp, Homo sapiens
taatacaccactacattct

SEQ ID NO: 2213280 - DNA, 21 bp, Homo sapiens
taatattgatatgcttataca

SEQ ID NO: 2213281 - DNA, 11 bp, Homo sapiens
taatctaaatg

SEQ ID NO: 2213282 - DNA, 22 bp, Homo sapiens
taatgaaagactgtacaaagta

SEQ ID NO: 2213283 - DNA, 21 bp, Homo sapiens
taatgacttaagcacacttga

SEQ ID NO: 2213284 - DNA, 15 bp, Homo sapiens
taatgcgtgcatacc

SEQ ID NO: 2213285 - DNA, 19 bp, Homo sapiens
taatgcgtgcataccactt

SEQ ID NO: 2213286 - DNA, 16 bp, Homo sapiens
taatgtcacaggcagg

SEQ ID NO: 2213287 - DNA, 12 bp, Homo sapiens
taatgtgaaact

SEQ ID NO: 2213288 - DNA, 20 bp, Homo sapiens
taatgtgaaactggattaaa

SEQ ID NO: 2213289 - DNA, 22 bp, Homo sapiens
taatgtgaaactggattaaact

SEQ ID NO: 2213290 - DNA, 14 bp, Homo sapiens
taattaagtactat

SEQ ID NO: 2213291 - DNA, 17 bp, Homo sapiens
taattaagtactatgta

SEQ ID NO: 2213292 - DNA, 18 bp, Homo sapiens
taattcttagctcattct

SEQ ID NO: 2213293 - DNA, 22 bp, Homo sapiens
taattgacaggattattggaaa

SEQ ID NO: 2213294 - DNA, 18 bp, Homo sapiens
taatttacctgaagtctt

SEQ ID NO: 2213295 - DNA, 18 bp, Homo sapiens
taatttgtgatacaatgc

SEQ ID NO: 2213296 - DNA, 22 bp, Homo sapiens
taatttgtgatacaatgctgtg

SEQ ID NO: 2213297 - DNA, 15 bp, Homo sapiens
tacaaaaagcataaa

SEQ ID NO: 2213298 - DNA, 16 bp, Homo sapiens
tacaatgctgtgccct

SEQ ID NO: 2213299 - DNA, 21 bp, Homo sapiens
tacacattttattttattatg

SEQ ID NO: 2213300 - DNA, 15 bp, Homo sapiens
tacaccactacattc

SEQ ID NO: 2213301 - DNA, 16 bp, Homo sapiens
tacaccactacattct

SEQ ID NO: 2213302 - DNA, 16 bp, Homo sapiens
tacactgtgctgagtc

SEQ ID NO: 2213303 - DNA, 23 bp, Homo sapiens
tacactgtgctgagtctgaaggc

SEQ ID NO: 2213304 - DNA, 22 bp, Homo sapiens
tacactgtttcaaactttacta

SEQ ID NO: 2213305 - DNA, 13 bp, Homo sapiens
tacactttatgca

SEQ ID NO: 2213306 - DNA, 13 bp, Homo sapiens
tacagacaaagcg

SEQ ID NO: 2213307 - DNA, 15 bp, Homo sapiens
tacagacaaagcgtg

SEQ ID NO: 2213308 - DNA, 22 bp, Homo sapiens
tacagagcccacgcccccactg

SEQ ID NO: 2213309 - DNA, 24 bp, Homo sapiens
tacagcaaggagatttacaactgg

SEQ ID NO: 2213310 - DNA, 20 bp, Homo sapiens
tacagcttgaccgtgaggcc

SEQ ID NO: 2213311 - DNA, 18 bp, Homo sapiens
tacaggaaggtagaaata

SEQ ID NO: 2213312 - DNA, 13 bp, Homo sapiens
tacaggaagtact

SEQ ID NO: 2213313 - DNA, 15 bp, Homo sapiens
tacaggaagtactgg

SEQ ID NO: 2213314 - DNA, 18 bp, Homo sapiens
tacagtatctcagggcct

SEQ ID NO: 2213315 - DNA, 23 bp, Homo sapiens
tacagttactcagaattctctag

SEQ ID NO: 2213316 - DNA, 19 bp, Homo sapiens
tacagtttgttagtatgag

SEQ ID NO: 2213317 - DNA, 16 bp, Homo sapiens
tacataagataaatgt

SEQ ID NO: 2213318 - DNA, 16 bp, Homo sapiens
tacatgaaaacacatt

SEQ ID NO: 2213319 - DNA, 17 bp, Homo sapiens
tacatgaaaacacattt

SEQ ID NO: 2213320 - DNA, 14 bp, Homo sapiens
taccagcagagcac

SEQ ID NO: 2213321 - DNA, 22 bp, Homo sapiens
taccagcagagcaccttagaca

SEQ ID NO: 2213322 - DNA, 17 bp, Homo sapiens
taccatcccctgtagag

SEQ ID NO: 2213323 - DNA, 23 bp, Homo sapiens
taccattttggggtacccactgc

SEQ ID NO: 2213324 - DNA, 12 bp, Homo sapiens
tacccaccccca

SEQ ID NO: 2213325 - DNA, 15 bp, Homo sapiens
tacccacccccaccc

SEQ ID NO: 2213326 - DNA, 19 bp, Homo sapiens
tacccacccccacccaagg

SEQ ID NO: 2213327 - DNA, 23 bp, Homo sapiens
tacccacccccacccaagggcct

SEQ ID NO: 2213328 - DNA, 16 bp, Homo sapiens
taccctcatgttctta

SEQ ID NO: 2213329 - DNA, 15 bp, Homo sapiens
tacctacatacaatt

SEQ ID NO: 2213330 - DNA, 18 bp, Homo sapiens
tacctcggtgccttcctc

SEQ ID NO: 2213331 - DNA, 22 bp, Homo sapiens
tacctcttgagccttgaacttt

SEQ ID NO: 2213332 - DNA, 13 bp, Homo sapiens
tacctgaagtctt

SEQ ID NO: 2213333 - DNA, 14 bp, Homo sapiens
tacctgaagtcttt

SEQ ID NO: 2213334 - DNA, 13 bp, Homo sapiens
tacctgaggggcc

SEQ ID NO: 2213335 - DNA, 23 bp, Homo sapiens
tacctgccaggaagccagcaggc

SEQ ID NO: 2213336 - DNA, 10 bp, Homo sapiens
tacctgtccc

SEQ ID NO: 2213337 - DNA, 16 bp, Homo sapiens
tacctgtccccctgac

SEQ ID NO: 2213338 - DNA, 20 bp, Homo sapiens
taccttttttatacataaac

SEQ ID NO: 2213339 - DNA, 18 bp, Homo sapiens
tacgaaaagaggggaaga

SEQ ID NO: 2213340 - DNA, 14 bp, Homo sapiens
tacgtacacatttt

SEQ ID NO: 2213341 - DNA, 15 bp, Homo sapiens
tacgtctgacaggca

SEQ ID NO: 2213342 - DNA, 13 bp, Homo sapiens
tacgtgagtcctg

SEQ ID NO: 2213343 - DNA, 16 bp, Homo sapiens
tacgttgtgcatttgg

SEQ ID NO: 2213344 - DNA, 14 bp, Homo sapiens
tgcataagttaact

SEQ ID NO: 2213345 - DNA, 17 bp, Homo sapiens
tgcataagttaacttcc

SEQ ID NO: 2213346 - DNA, 14 bp, Homo sapiens
tgcataccactttt

SEQ ID NO: 2213347 - DNA, 18 bp, Homo sapiens
tgcataccacttttgttc

SEQ ID NO: 2213348 - DNA, 14 bp, Homo sapiens
tgcatcaagatgtg

SEQ ID NO: 2213349 - DNA, 16 bp, Homo sapiens
tgcatgctgtccctta

SEQ ID NO: 2213350 - DNA, 12 bp, Homo sapiens
tgcattatctag

SEQ ID NO: 2213351 - DNA, 18 bp, Homo sapiens
tgcattatctagatactg

SEQ ID NO: 2213352 - DNA, 20 bp, Homo sapiens
tgcatttgaggtctgttctt

SEQ ID NO: 2213353 - DNA, 23 bp, Homo sapiens
tgcatttggtggtttcagaaatg

SEQ ID NO: 2213354 - DNA, 14 bp, Homo sapiens
tgccaatgggagct

SEQ ID NO: 2213355 - DNA, 18 bp, Homo sapiens
tgccaatgggagctcatg

SEQ ID NO: 2213356 - DNA, 19 bp, Homo sapiens
tgccaccctggggagaaag

SEQ ID NO: 2213357 - DNA, 18 bp, Homo sapiens
tgccagcttatctcaggg

SEQ ID NO: 2213358 - DNA, 19 bp, Homo sapiens
tgccaggaagccagcaggc

SEQ ID NO: 2213359 - DNA, 20 bp, Homo sapiens
tgccaggaagccagcaggct

SEQ ID NO: 2213360 - DNA, 22 bp, Homo sapiens
tgccaggaagccagcaggctct

SEQ ID NO: 2213361 - DNA, 10 bp, Homo sapiens
tgccaggcat

SEQ ID NO: 2213362 - DNA, 11 bp, Homo sapiens
tgccagggaca

SEQ ID NO: 2213363 - DNA, 22 bp, Homo sapiens
tgccagggacagagggggtggc

SEQ ID NO: 2213364 - DNA, 19 bp, Homo sapiens
tgccaggtttttggtctga

SEQ ID NO: 2213365 - DNA, 24 bp, Homo sapiens
tgccaggtttttggtctgacccac

SEQ ID NO: 2213366 - DNA, 14 bp, Homo sapiens
tgccagtcaccccg

SEQ ID NO: 2213367 - DNA, 20 bp, Homo sapiens
tgccatgaggaacaaggcaa

SEQ ID NO: 2213368 - DNA, 14 bp, Homo sapiens
tgccatgtgccagg

SEQ ID NO: 2213369 - DNA, 12 bp, Homo sapiens
tgccatgttggc

SEQ ID NO: 2213370 - DNA, 15 bp, Homo sapiens
tgccatgttggccag

SEQ ID NO: 2213371 - DNA, 21 bp, Homo sapiens
tgccatgttggccaggctggt

SEQ ID NO: 2213372 - DNA, 16 bp, Homo sapiens
tgcccacaggatcagt

SEQ ID NO: 2213373 - DNA, 15 bp, Homo sapiens
tgcccacctggcctc

SEQ ID NO: 2213374 - DNA, 13 bp, Homo sapiens
tgcccagcccctt

SEQ ID NO: 2213375 - DNA, 17 bp, Homo sapiens
tgcccagccccttctga

SEQ ID NO: 2213376 - DNA, 20 bp, Homo sapiens
tgcccagccccttctgaccc

SEQ ID NO: 2213377 - DNA, 20 bp, Homo sapiens
tgcccaggcaggtcttgaac

SEQ ID NO: 2213378 - DNA, 11 bp, Homo sapiens
tgcccaggccc

SEQ ID NO: 2213379 - DNA, 14 bp, Homo sapiens
tgcccaggcccctg

SEQ ID NO: 2213380 - DNA, 23 bp, Homo sapiens
tgcccaggctggcgtgcagtggt

SEQ ID NO: 2213381 - DNA, 15 bp, Homo sapiens
tgcccccaccccagg

SEQ ID NO: 2213382 - DNA, 20 bp, Homo sapiens
tgcccccaccccaggctggg

SEQ ID NO: 2213383 - DNA, 21 bp, Homo sapiens
tgcccccaccccaggctgggc

SEQ ID NO: 2213384 - DNA, 23 bp, Homo sapiens
tgccccgaacatgtttttcttct

SEQ ID NO: 2213385 - DNA, 17 bp, Homo sapiens
tgcccctggcagcccct

SEQ ID NO: 2213386 - DNA, 22 bp, Homo sapiens
tgccctccaagaccttctcctt

SEQ ID NO: 2213387 - DNA, 13 bp, Homo sapiens
tgccctcccaccc

SEQ ID NO: 2213388 - DNA, 15 bp, Homo sapiens
tgccctgcccacctg

SEQ ID NO: 2213389 - DNA, 22 bp, Homo sapiens
tgccctgcccacctggcctctg

SEQ ID NO: 2213390 - DNA, 15 bp, Homo sapiens
tgccctgtgggcccc

SEQ ID NO: 2213391 - DNA, 18 bp, Homo sapiens
tgcccttacctgccagga

SEQ ID NO: 2213392 - DNA, 14 bp, Homo sapiens
tgagactctgtctc

SEQ ID NO: 2213393 - DNA, 23 bp, Homo sapiens
tgagaggacttttctttgtggct

SEQ ID NO: 2213394 - DNA, 21 bp, Homo sapiens
tgagcactaaggtgtgctctg

SEQ ID NO: 2213395 - DNA, 23 bp, Homo sapiens
tgagcactaaggtgtgctctgat

SEQ ID NO: 2213396 - DNA, 22 bp, Homo sapiens
tgagcactctggggtgggaggg

SEQ ID NO: 2213397 - DNA, 16 bp, Homo sapiens
tgagcagggctcagcg

SEQ ID NO: 2213398 - DNA, 20 bp, Homo sapiens
tgagcagggctcagcgggga

SEQ ID NO: 2213399 - DNA, 15 bp, Homo sapiens
tgagcatcaggccag

SEQ ID NO: 2213400 - DNA, 18 bp, Homo sapiens
tgagcatcaggccaggcc

SEQ ID NO: 2213401 - DNA, 21 bp, Homo sapiens
tgagccactgcaccgggccac

SEQ ID NO: 2213402 - DNA, 14 bp, Homo sapiens
tgagccagatttca

SEQ ID NO: 2213403 - DNA, 17 bp, Homo sapiens
tgagccagatttcactc

SEQ ID NO: 2213404 - DNA, 22 bp, Homo sapiens
tgagccagatttcactctcctt

SEQ ID NO: 2213405 - DNA, 19 bp, Homo sapiens
tgagccgagatcacgccac

SEQ ID NO: 2213406 - DNA, 17 bp, Homo sapiens
tgagcctcagcatcctg

SEQ ID NO: 2213407 - DNA, 16 bp, Homo sapiens
tgagcctggcaagaat

SEQ ID NO: 2213408 - DNA, 19 bp, Homo sapiens
tgagcctgggaggtcaagg

SEQ ID NO: 2213409 - DNA, 18 bp, Homo sapiens
tgaggaagccgctggggc

SEQ ID NO: 2213410 - DNA, 21 bp, Homo sapiens
tgaggaagccgctggggccag

SEQ ID NO: 2213411 - DNA, 12 bp, Homo sapiens
tgaggcatttgt

SEQ ID NO: 2213412 - DNA, 20 bp, Homo sapiens
tgaggcatttgtttgaactg

SEQ ID NO: 2213413 - DNA, 22 bp, Homo sapiens
tgaggcccagagggcctgcaag

SEQ ID NO: 2213414 - DNA, 23 bp, Homo sapiens
tgaggcccagagggcctgcaagg

SEQ ID NO: 2213415 - DNA, 15 bp, Homo sapiens
tgaggctctgccctt

SEQ ID NO: 2213416 - DNA, 18 bp, Homo sapiens
tgaggctctgcccttggt

SEQ ID NO: 2213417 - DNA, 13 bp, Homo sapiens
tgaggtcagagcc

SEQ ID NO: 2213418 - DNA, 17 bp, Homo sapiens
tgaggtcagagcctgca

SEQ ID NO: 2213419 - DNA, 15 bp, Homo sapiens
tgaggtctgttcttt

SEQ ID NO: 2213420 - DNA, 14 bp, Homo sapiens
tgagtactacagtc

SEQ ID NO: 2213421 - DNA, 15 bp, Homo sapiens
tgagtactacagtcc

SEQ ID NO: 2213422 - DNA, 23 bp, Homo sapiens
tgagtactacagtcctcccatct

SEQ ID NO: 2213423 - DNA, 18 bp, Homo sapiens
tgagtcaccaagcccagt

SEQ ID NO: 2213424 - DNA, 19 bp, Homo sapiens
tgagtcctggcatgggaat

SEQ ID NO: 2213425 - DNA, 15 bp, Homo sapiens
tgagtcgaggacagg

SEQ ID NO: 2213426 - DNA, 14 bp, Homo sapiens
tgagtgccttacac

SEQ ID NO: 2213427 - DNA, 23 bp, Homo sapiens
tgagtgggggatcacagcctctg

SEQ ID NO: 2213428 - DNA, 21 bp, Homo sapiens
tgatacaatgctgtgccctaa

SEQ ID NO: 2213429 - DNA, 14 bp, Homo sapiens
tgatagcacagacc

SEQ ID NO: 2213430 - DNA, 13 bp, Homo sapiens
tgatcacggctca

SEQ ID NO: 2213431 - DNA, 14 bp, Homo sapiens
tgatcacggctcac

SEQ ID NO: 2213432 - DNA, 15 bp, Homo sapiens
tgatcacggctcact

SEQ ID NO: 2213433 - DNA, 21 bp, Homo sapiens
tgatcacggctcactgcagcc

SEQ ID NO: 2213434 - DNA, 24 bp, Homo sapiens
tgatcatccactgtgccatgtgcc

SEQ ID NO: 2213435 - DNA, 16 bp, Homo sapiens
tgatccacccacctca

SEQ ID NO: 2213436 - DNA, 17 bp, Homo sapiens
tgatccacccacctcag

SEQ ID NO: 2213437 - DNA, 18 bp, Homo sapiens
tgatccacccacctcagc

SEQ ID NO: 2213438 - DNA, 19 bp, Homo sapiens
tgatccacccacctcagcc

SEQ ID NO: 2213439 - DNA, 20 bp, Homo sapiens
tgatccacccacctcagcct

SEQ ID NO: 2213440 - DNA, 21 bp, Homo sapiens
tgatccacccacctcagcctc

SEQ ID NO: 2213441 - DNA, 22 bp, Homo sapiens
tgatccacccacctcagcctcc

SEQ ID NO: 2213442 - DNA, 21 bp, Homo sapiens
tgatcctcccacctcagcctc

SEQ ID NO: 2213443 - DNA, 15 bp, Homo sapiens
tgatctaggaagact

SEQ ID NO: 2213444 - DNA, 19 bp, Homo sapiens
tgatctaggaagactttgg

SEQ ID NO: 2213445 - DNA, 17 bp, Homo sapiens
tgatctctcgtgattga

SEQ ID NO: 2213446 - DNA, 19 bp, Homo sapiens
tgatctttgcagacaggca

SEQ ID NO: 2213447 - DNA, 21 bp, Homo sapiens
tgatctttgcagacaggcaag

SEQ ID NO: 2213448 - DNA, 23 bp, Homo sapiens
tgatctttgcagacaggcaagca

SEQ ID NO: 2213449 - DNA, 23 bp, Homo sapiens
tgatgaaatgaggtcagagcctg

SEQ ID NO: 2213450 - DNA, 13 bp, Homo sapiens
tgatgagaggaaa

SEQ ID NO: 2213451 - DNA, 14 bp, Homo sapiens
tgatgatcctaggc

SEQ ID NO: 2213452 - DNA, 17 bp, Homo sapiens
tgatgcttcttcagaga

SEQ ID NO: 2213453 - DNA, 18 bp, Homo sapiens
tgatgcttcttcagagac

SEQ ID NO: 2213454 - DNA, 19 bp, Homo sapiens
tgatgcttcttcagagact

SEQ ID NO: 2213455 - DNA, 22 bp, Homo sapiens
tgatgcttcttcagagactcct

SEQ ID NO: 2213456 - DNA, 23 bp, Homo sapiens
tgatgcttcttcagagactcctg

SEQ ID NO: 2213457 - DNA, 16 bp, Homo sapiens
tgatggggccctgcct

SEQ ID NO: 2213458 - DNA, 16 bp, Homo sapiens
tgatggtgcaatgacc

SEQ ID NO: 2213459 - DNA, 23 bp, Homo sapiens
tgatggtgcaatgacctttcaat

SEQ ID NO: 2213460 - DNA, 19 bp, Homo sapiens
tgatgttttccatgagtcc

SEQ ID NO: 2213461 - DNA, 20 bp, Homo sapiens
tgattaaattcttgcaaagt

SEQ ID NO: 2213462 - DNA, 20 bp, Homo sapiens
tgattcaacaggttttcctg

SEQ ID NO: 2213463 - DNA, 14 bp, Homo sapiens
tgattcagacagct

SEQ ID NO: 2213464 - DNA, 14 bp, Homo sapiens
tgattcagctctgc

SEQ ID NO: 2213465 - DNA, 16 bp, Homo sapiens
tgattcataatgactt

SEQ ID NO: 2213466 - DNA, 21 bp, Homo sapiens
tgattcataatgacttaagca

SEQ ID NO: 2213467 - DNA, 16 bp, Homo sapiens
tgattcccaagctctg

SEQ ID NO: 2213468 - DNA, 18 bp, Homo sapiens
tgattcccaagctctgct

SEQ ID NO: 2213469 - DNA, 21 bp, Homo sapiens
tgattcccaagctctgctcct

SEQ ID NO: 2213470 - DNA, 16 bp, Homo sapiens
tgattgtgtctcttgg

SEQ ID NO: 2213471 - DNA, 17 bp, Homo sapiens
tgatttggggatatttt

SEQ ID NO: 2213472 - DNA, 13 bp, Homo sapiens
tgattttcattgc

SEQ ID NO: 2213473 - DNA, 16 bp, Homo sapiens
tgatttttttttcctt

SEQ ID NO: 2213474 - DNA, 20 bp, Homo sapiens
tgatttttttttccttcagt

SEQ ID NO: 2213475 - DNA, 23 bp, Homo sapiens
tgatttttttttccttcagtgcc

SEQ ID NO: 2213476 - DNA, 21 bp, Homo sapiens
tgcaaaccatcattgaaatct

SEQ ID NO: 2213477 - DNA, 20 bp, Homo sapiens
tgcaaagtatccctactgta

SEQ ID NO: 2213478 - DNA, 14 bp, Homo sapiens
tgcaacaggctggg

SEQ ID NO: 2213479 - DNA, 16 bp, Homo sapiens
tgcaacaggctgggct

SEQ ID NO: 2213480 - DNA, 19 bp, Homo sapiens
tgcaacaggctgggcttca

SEQ ID NO: 2213481 - DNA, 21 bp, Homo sapiens
tgcaacctccgcctcttgggt

SEQ ID NO: 2213482 - DNA, 19 bp, Homo sapiens
tgcaatgacctttcaatag

SEQ ID NO: 2213483 - DNA, 22 bp, Homo sapiens
tgcaatgacctttcaataggaa

SEQ ID NO: 2213484 - DNA, 23 bp, Homo sapiens
tgcaatgacctttcaataggaaa

SEQ ID NO: 2213485 - DNA, 15 bp, Homo sapiens
tgcaatggcagcctt

SEQ ID NO: 2213486 - DNA, 16 bp, Homo sapiens
tgcaatggcagccttg

SEQ ID NO: 2213487 - DNA, 17 bp, Homo sapiens
tgcacaaacagaggccg

SEQ ID NO: 2213488 - DNA, 14 bp, Homo sapiens
tgcacaagctgcac

SEQ ID NO: 2213489 - DNA, 10 bp, Homo sapiens
tgcacacatt

SEQ ID NO: 2213490 - DNA, 11 bp, Homo sapiens
tgcacacattt

SEQ ID NO: 2213491 - DNA, 18 bp, Homo sapiens
tgcacagagttgttacat

SEQ ID NO: 2213492 - DNA, 22 bp, Homo sapiens
tgcacagagttgttacattttt

SEQ ID NO: 2213493 - DNA, 20 bp, Homo sapiens
tgcacagctaacatggaagt

SEQ ID NO: 2213494 - DNA, 23 bp, Homo sapiens
tgcaccggctggcctggcccctc

SEQ ID NO: 2213495 - DNA, 14 bp, Homo sapiens
tgcaccgggccaca

SEQ ID NO: 2213496 - DNA, 17 bp, Homo sapiens
tgcacctggaatatata

SEQ ID NO: 2213497 - DNA, 22 bp, Homo sapiens
tgcacctggaatatataaccag

SEQ ID NO: 2213498 - DNA, 16 bp, Homo sapiens
tgcactccagcctggg

SEQ ID NO: 2213499 - DNA, 19 bp, Homo sapiens
tgcactcccctgctgggtg

SEQ ID NO: 2213500 - DNA, 21 bp, Homo sapiens
tgcacttgcagactctacaga

SEQ ID NO: 2213501 - DNA, 22 bp, Homo sapiens
tgcagacaggcaagcacctcct

SEQ ID NO: 2213502 - DNA, 18 bp, Homo sapiens
tgcagactctacagaggc

SEQ ID NO: 2213503 - DNA, 20 bp, Homo sapiens
tgcagactctacagaggcca

SEQ ID NO: 2213504 - DNA, 22 bp, Homo sapiens
tgcagactctacagaggccatg

SEQ ID NO: 2213505 - DNA, 20 bp, Homo sapiens
tgcagcctcaacctcctggg

SEQ ID NO: 2213506 - DNA, 21 bp, Homo sapiens
tgcagcctcaacctcctgggc

SEQ ID NO: 2213507 - DNA, 23 bp, Homo sapiens
tgcagcctcaacctcctgggcta

SEQ ID NO: 2213508 - DNA, 13 bp, Homo sapiens
tgcagcctcacag

SEQ ID NO: 2213509 - DNA, 16 bp, Homo sapiens
tgcagcctcacagtcc

SEQ ID NO: 2213510 - DNA, 16 bp, Homo sapiens
tgcaggcagccaggcc

SEQ ID NO: 2213511 - DNA, 19 bp, Homo sapiens
tgcaggcagccaggccaca

SEQ ID NO: 2213512 - DNA, 17 bp, Homo sapiens
tgcagggaattgggggg

SEQ ID NO: 2213513 - DNA, 13 bp, Homo sapiens
tgcagggagtccg

SEQ ID NO: 2213514 - DNA, 22 bp, Homo sapiens
tgcagtggtatgatcacggctc

SEQ ID NO: 2213515 - DNA, 21 bp, Homo sapiens
tgcagttacactaaaaggtga

SEQ ID NO: 2213516 - DNA, 16 bp, Homo sapiens
tgcagttgccagtcac

SEQ ID NO: 2213517 - DNA, 13 bp, Homo sapiens
tttattatgcatg

SEQ ID NO: 2213518 - DNA, 13 bp, Homo sapiens
tttattatggcac

SEQ ID NO: 2213519 - DNA, 14 bp, Homo sapiens
tttcaataggaaaa

SEQ ID NO: 2213520 - DNA, 22 bp, Homo sapiens
tttcaataggaaaaactgattt

SEQ ID NO: 2213521 - DNA, 13 bp, Homo sapiens
tttcagaaatgtg

SEQ ID NO: 2213522 - DNA, 18 bp, Homo sapiens
tttcatttaggtgaggaa

SEQ ID NO: 2213523 - DNA, 12 bp, Homo sapiens
tttccaaagtac

SEQ ID NO: 2213524 - DNA, 13 bp, Homo sapiens
tttccaggaaggc

SEQ ID NO: 2213525 - DNA, 19 bp, Homo sapiens
tttccaggtttaagctgtt

SEQ ID NO: 2213526 - DNA, 17 bp, Homo sapiens
tttccatgagtcccctg

SEQ ID NO: 2213527 - DNA, 18 bp, Homo sapiens
tttccatgagtcccctgt

SEQ ID NO: 2213528 - DNA, 23 bp, Homo sapiens
tttcctggcactgcttccagtga

SEQ ID NO: 2213529 - DNA, 15 bp, Homo sapiens
tttccttcagtgcct

SEQ ID NO: 2213530 - DNA, 22 bp, Homo sapiens
tttccttcagtgccttatggaa

SEQ ID NO: 2213531 - DNA, 21 bp, Homo sapiens
tttccttcattcaacccacct

SEQ ID NO: 2213532 - DNA, 23 bp, Homo sapiens
tttccttcattcaacccacctgc

SEQ ID NO: 2213533 - DNA, 18 bp, Homo sapiens
tttcgcaggattcttcct

SEQ ID NO: 2213534 - DNA, 19 bp, Homo sapiens
tttctaaatctccaaaata

SEQ ID NO: 2213535 - DNA, 18 bp, Homo sapiens
tttctacccagcgagccc

SEQ ID NO: 2213536 - DNA, 22 bp, Homo sapiens
tttctacccagcgagccctggt

SEQ ID NO: 2213537 - DNA, 23 bp, Homo sapiens
tttctactcgagttacagacaaa

SEQ ID NO: 2213538 - DNA, 21 bp, Homo sapiens
tttctgcagccactattgtta

SEQ ID NO: 2213539 - DNA, 16 bp, Homo sapiens
tttctggctatgcatt

SEQ ID NO: 2213540 - DNA, 18 bp, Homo sapiens
tttctggctatgcatttg

SEQ ID NO: 2213541 - DNA, 20 bp, Homo sapiens
tttctgttctttctggctat

SEQ ID NO: 2213542 - DNA, 18 bp, Homo sapiens
tttcttagggaaggatac

SEQ ID NO: 2213543 - DNA, 14 bp, Homo sapiens
tttgaactcttcaa

SEQ ID NO: 2213544 - DNA, 17 bp, Homo sapiens
tttgaactgataaagat

SEQ ID NO: 2213545 - DNA, 18 bp, Homo sapiens
tttgacctctgcagcaat

SEQ ID NO: 2213546 - DNA, 19 bp, Homo sapiens
tttgacctctgcagcaata

SEQ ID NO: 2213547 - DNA, 18 bp, Homo sapiens
tttgattcagacagctgc

SEQ ID NO: 2213548 - DNA, 21 bp, Homo sapiens
tttgattcagacagctgcctg

SEQ ID NO: 2213549 - DNA, 12 bp, Homo sapiens
tttggaaaataa

SEQ ID NO: 2213550 - DNA, 15 bp, Homo sapiens
tttggaccctgaggc

SEQ ID NO: 2213551 - DNA, 19 bp, Homo sapiens
tttggaccctgaggcccag

SEQ ID NO: 2213552 - DNA, 13 bp, Homo sapiens
tttggggaagaac

SEQ ID NO: 2213553 - DNA, 13 bp, Homo sapiens
tttgtaaaaaggg

SEQ ID NO: 2213554 - DNA, 14 bp, Homo sapiens
tttgtacagacaac

SEQ ID NO: 2213555 - DNA, 13 bp, Homo sapiens
tttgtccccaccg

SEQ ID NO: 2213556 - DNA, 19 bp, Homo sapiens
tttgtgaggaagccgctgg

SEQ ID NO: 2213557 - DNA, 15 bp, Homo sapiens
tttgttgtcagctga

SEQ ID NO: 2213558 - DNA, 16 bp, Homo sapiens
tttgttgtcagctgaa

SEQ ID NO: 2213559 - DNA, 16 bp, Homo sapiens
tttgtttctgaaaggg

SEQ ID NO: 2213560 - DNA, 18 bp, Homo sapiens
ttttaaaaaactgctgac

SEQ ID NO: 2213561 - DNA, 16 bp, Homo sapiens
ttttaagtgctgcatt

SEQ ID NO: 2213562 - DNA, 17 bp, Homo sapiens
ttttagagttgatacta

SEQ ID NO: 2213563 - DNA, 18 bp, Homo sapiens
ttttatggcttttgtgca

SEQ ID NO: 2213564 - DNA, 17 bp, Homo sapiens
ttttcaaaataaaaatg

SEQ ID NO: 2213565 - DNA, 15 bp, Homo sapiens
ttttcacagttctct

SEQ ID NO: 2213566 - DNA, 19 bp, Homo sapiens
ttttccatgagtcccctgt

SEQ ID NO: 2213567 - DNA, 15 bp, Homo sapiens
ttttccttcagtgcc

SEQ ID NO: 2213568 - DNA, 20 bp, Homo sapiens
ttttctactcgagttacaga

SEQ ID NO: 2213569 - DNA, 13 bp, Homo sapiens
ttttcttctccct

SEQ ID NO: 2213570 - DNA, 14 bp, Homo sapiens
ttttcttctccctc

SEQ ID NO: 2213571 - DNA, 17 bp, Homo sapiens
ttttcttgcatgaggct

SEQ ID NO: 2213572 - DNA, 20 bp, Homo sapiens
ttttgacaaggggcagtggt

SEQ ID NO: 2213573 - DNA, 17 bp, Homo sapiens
ttttgagtgccttacac

SEQ ID NO: 2213574 - DNA, 15 bp, Homo sapiens
ttttggtctgtgtga

SEQ ID NO: 2213575 - DNA, 17 bp, Homo sapiens
ttttgtaaaaagggaaa

SEQ ID NO: 2213576 - DNA, 19 bp, Homo sapiens
ttttgtagagccagggtct

SEQ ID NO: 2213577 - DNA, 17 bp, Homo sapiens
ttttgtgcattatctag

SEQ ID NO: 2213578 - DNA, 20 bp, Homo sapiens
ttttgtgcattatctagata

SEQ ID NO: 2213579 - DNA, 22 bp, Homo sapiens
tttttaagtgctgcatttaaaa

SEQ ID NO: 2213580 - DNA, 23 bp, Homo sapiens
tttttatacataaacaagaccac

SEQ ID NO: 2213581 - DNA, 19 bp, Homo sapiens
tttttgtagagccagggtc

SEQ ID NO: 2213582 - DNA, 12 bp, Homo sapiens
ttttttactaat

SEQ ID NO: 2213583 - DNA, 12 bp, Homo sapiens
ttttttttaaga

SEQ ID NO: 2213584 - DNA, 23 bp, Homo sapiens
tggaaatttgttataatgaatga

SEQ ID NO: 2213585 - DNA, 17 bp, Homo sapiens
tggaacactctgagact

SEQ ID NO: 2213586 - DNA, 11 bp, Homo sapiens
tggaagacagc

SEQ ID NO: 2213587 - DNA, 14 bp, Homo sapiens
tggaagacagctct

SEQ ID NO: 2213588 - DNA, 15 bp, Homo sapiens
tggaagacagctctt

SEQ ID NO: 2213589 - DNA, 16 bp, Homo sapiens
tggaagcagaaacaaa

SEQ ID NO: 2213590 - DNA, 17 bp, Homo sapiens
tggaagcagaaacaaaa

SEQ ID NO: 2213591 - DNA, 18 bp, Homo sapiens
tggaagtactataattta

SEQ ID NO: 2213592 - DNA, 14 bp, Homo sapiens
tggaataacatgta

SEQ ID NO: 2213593 - DNA, 17 bp, Homo sapiens
tggaataaggagaatga

SEQ ID NO: 2213594 - DNA, 16 bp, Homo sapiens
tggaatatataaccag

SEQ ID NO: 2213595 - DNA, 16 bp, Homo sapiens
tggacacagctcttct

SEQ ID NO: 2213596 - DNA, 17 bp, Homo sapiens
tggacaggcatgttctc

SEQ ID NO: 2213597 - DNA, 20 bp, Homo sapiens
tggaccctgaggcccagagg

SEQ ID NO: 2213598 - DNA, 21 bp, Homo sapiens
tggaccctgaggcccagaggg

SEQ ID NO: 2213599 - DNA, 20 bp, Homo sapiens
tggactaacttgtctttgga

SEQ ID NO: 2213600 - DNA, 13 bp, Homo sapiens
tggagaagcggct

SEQ ID NO: 2213601 - DNA, 20 bp, Homo sapiens
tggagaatttttactgggga

SEQ ID NO: 2213602 - DNA, 22 bp, Homo sapiens
tggagaatttttactggggatt

SEQ ID NO: 2213603 - DNA, 14 bp, Homo sapiens
tggagtatatgtca

SEQ ID NO: 2213604 - DNA, 17 bp, Homo sapiens
tggagttcatcttgaat

SEQ ID NO: 2213605 - DNA, 22 bp, Homo sapiens
tggatgcagcctcacagtcctt

SEQ ID NO: 2213606 - DNA, 15 bp, Homo sapiens
tggatgcctggtggc

SEQ ID NO: 2213607 - DNA, 18 bp, Homo sapiens
tggatgcctggtggcagc

SEQ ID NO: 2213608 - DNA, 19 bp, Homo sapiens
tggatgcctggtggcagct

SEQ ID NO: 2213609 - DNA, 15 bp, Homo sapiens
tggatttaacagaaa

SEQ ID NO: 2213610 - DNA, 20 bp, Homo sapiens
tggatttaacagaaatgtac

SEQ ID NO: 2213611 - DNA, 12 bp, Homo sapiens
tggcaaaaaggc

SEQ ID NO: 2213612 - DNA, 16 bp, Homo sapiens
tggcaaaaaggcagga

SEQ ID NO: 2213613 - DNA, 17 bp, Homo sapiens
tggcaccagcagcctgg

SEQ ID NO: 2213614 - DNA, 18 bp, Homo sapiens
tggcaccagcagcctgga

SEQ ID NO: 2213615 - DNA, 21 bp, Homo sapiens
tggcacccggcccctgctggt

SEQ ID NO: 2213616 - DNA, 17 bp, Homo sapiens
tggcagagttgaagaca

SEQ ID NO: 2213617 - DNA, 22 bp, Homo sapiens
tggcagagttgaagacagagct

SEQ ID NO: 2213618 - DNA, 22 bp, Homo sapiens
tggcagctcacctctcccttgg

SEQ ID NO: 2213619 - DNA, 23 bp, Homo sapiens
tggcagctcacctctcccttgga

SEQ ID NO: 2213620 - DNA, 14 bp, Homo sapiens
tggcagctcagaga

SEQ ID NO: 2213621 - DNA, 17 bp, Homo sapiens
tggcagctgcggtccac

SEQ ID NO: 2213622 - DNA, 23 bp, Homo sapiens
tggcagctgcggtccacccagga

SEQ ID NO: 2213623 - DNA, 13 bp, Homo sapiens
tggcagctgcttt

SEQ ID NO: 2213624 - DNA, 20 bp, Homo sapiens
tggcagtgggagctgcctgt

SEQ ID NO: 2213625 - DNA, 15 bp, Homo sapiens
tggccagatgcacca

SEQ ID NO: 2213626 - DNA, 15 bp, Homo sapiens
ttcggctaaaaagaa

SEQ ID NO: 2213627 - DNA, 13 bp, Homo sapiens
ttctaaagctgcc

SEQ ID NO: 2213628 - DNA, 17 bp, Homo sapiens
ttctaaaggctaccttt

SEQ ID NO: 2213629 - DNA, 19 bp, Homo sapiens
ttctacccagcgagccctg

SEQ ID NO: 2213630 - DNA, 16 bp, Homo sapiens
ttctagcatggctgcc

SEQ ID NO: 2213631 - DNA, 13 bp, Homo sapiens
ttctaggcctggg

SEQ ID NO: 2213632 - DNA, 20 bp, Homo sapiens
ttctccacctgccagggaca

SEQ ID NO: 2213633 - DNA, 11 bp, Homo sapiens
ttctccaggct

SEQ ID NO: 2213634 - DNA, 17 bp, Homo sapiens
ttctctagtttgattaa

SEQ ID NO: 2213635 - DNA, 14 bp, Homo sapiens
ttctctccagcccc

SEQ ID NO: 2213636 - DNA, 16 bp, Homo sapiens
ttctctccagcccctg

SEQ ID NO: 2213637 - DNA, 18 bp, Homo sapiens
ttctctccagcccctgga

SEQ ID NO: 2213638 - DNA, 19 bp, Homo sapiens
ttctctcctgtacctcttg

SEQ ID NO: 2213639 - DNA, 20 bp, Homo sapiens
ttctctgaggacactaacca

SEQ ID NO: 2213640 - DNA, 11 bp, Homo sapiens
ttctctgccct

SEQ ID NO: 2213641 - DNA, 12 bp, Homo sapiens
ttctctgccctc

SEQ ID NO: 2213642 - DNA, 16 bp, Homo sapiens
ttctctgccctccaag

SEQ ID NO: 2213643 - DNA, 14 bp, Homo sapiens
ttctgacccatgct

SEQ ID NO: 2213644 - DNA, 19 bp, Homo sapiens
ttctgatcctagttccacc

SEQ ID NO: 2213645 - DNA, 14 bp, Homo sapiens
ttctgccgcagccc

SEQ ID NO: 2213646 - DNA, 17 bp, Homo sapiens
ttctgcctgcccaggcc

SEQ ID NO: 2213647 - DNA, 18 bp, Homo sapiens
ttctgcctgcccaggccc

SEQ ID NO: 2213648 - DNA, 15 bp, Homo sapiens
ttctgcttcagcctc

SEQ ID NO: 2213649 - DNA, 19 bp, Homo sapiens
ttctgcttcagcctcccga

SEQ ID NO: 2213650 - DNA, 18 bp, Homo sapiens
ttctggctatgcatttga

SEQ ID NO: 2213651 - DNA, 16 bp, Homo sapiens
ttctggctcttccagg

SEQ ID NO: 2213652 - DNA, 17 bp, Homo sapiens
ttctggctcttccaggc

SEQ ID NO: 2213653 - DNA, 21 bp, Homo sapiens
ttctgtccgagctttgaaaat

SEQ ID NO: 2213654 - DNA, 18 bp, Homo sapiens
ttctgtttagataataca

SEQ ID NO: 2213655 - DNA, 21 bp, Homo sapiens
ggaaatcaccgaaaacgtggc

SEQ ID NO: 2213656 - DNA, 17 bp, Homo sapiens
ggaaatgggcagagcag

SEQ ID NO: 2213657 - DNA, 18 bp, Homo sapiens
ggaaatgggcagagcaga

SEQ ID NO: 2213658 - DNA, 20 bp, Homo sapiens
ggaacagactggaagcacag

SEQ ID NO: 2213659 - DNA, 19 bp, Homo sapiens
ggaacaggtttaaaaatcc

SEQ ID NO: 2213660 - DNA, 14 bp, Homo sapiens
ggaagacaatgtga

SEQ ID NO: 2213661 - DNA, 14 bp, Homo sapiens
ggaagacagctctt

SEQ ID NO: 2213662 - DNA, 12 bp, Homo sapiens
ggaagactttgg

SEQ ID NO: 2213663 - DNA, 13 bp, Homo sapiens
ggaagagccttgc

SEQ ID NO: 2213664 - DNA, 13 bp, Homo sapiens
ggaagcacatgcc

SEQ ID NO: 2213665 - DNA, 15 bp, Homo sapiens
ggaagcacatgcctc

SEQ ID NO: 2213666 - DNA, 17 bp, Homo sapiens
ggaagcacatgcctctc

SEQ ID NO: 2213667 - DNA, 21 bp, Homo sapiens
ggaagcacatgcctctctcag

SEQ ID NO: 2213668 - DNA, 13 bp, Homo sapiens
ggaagccagcagg

SEQ ID NO: 2213669 - DNA, 14 bp, Homo sapiens
ggaagccagcaggc

SEQ ID NO: 2213670 - DNA, 20 bp, Homo sapiens
ggaagccagcaggctctcag

SEQ ID NO: 2213671 - DNA, 21 bp, Homo sapiens
ggaagccagcaggctctcagg

SEQ ID NO: 2213672 - DNA, 22 bp, Homo sapiens
ggaagctcagggcctggctcag

SEQ ID NO: 2213673 - DNA, 23 bp, Homo sapiens
ggaagctcagggcctggctcagg

SEQ ID NO: 2213674 - DNA, 16 bp, Homo sapiens
ggaagtactggagaaa

SEQ ID NO: 2213675 - DNA, 18 bp, Homo sapiens
ggaagtactggagaaaat

SEQ ID NO: 2213676 - DNA, 17 bp, Homo sapiens
ggaatgcgggggagcag

SEQ ID NO: 2213677 - DNA, 22 bp, Homo sapiens
ggaatgcgggggagcaggcagt

SEQ ID NO: 2213678 - DNA, 13 bp, Homo sapiens
ggacaccctgtga

SEQ ID NO: 2213679 - DNA, 16 bp, Homo sapiens
ggacagagggggtggc

SEQ ID NO: 2213680 - DNA, 21 bp, Homo sapiens
ggacagccacggccaggccag

SEQ ID NO: 2213681 - DNA, 22 bp, Homo sapiens
ggacagccacggccaggccaga

SEQ ID NO: 2213682 - DNA, 11 bp, Homo sapiens
ggacagctcct

SEQ ID NO: 2213683 - DNA, 15 bp, Homo sapiens
ggacagctccttctg

SEQ ID NO: 2213684 - DNA, 19 bp, Homo sapiens
ggacagctccttctgtcct

SEQ ID NO: 2213685 - DNA, 13 bp, Homo sapiens
ggacatggacaag

SEQ ID NO: 2213686 - DNA, 20 bp, Homo sapiens
ggacattgcggacagccacg

SEQ ID NO: 2213687 - DNA, 15 bp, Homo sapiens
ggaccttgaactggg

SEQ ID NO: 2213688 - DNA, 20 bp, Homo sapiens
ggacgctacccgggaagggg

SEQ ID NO: 2213689 - DNA, 24 bp, Homo sapiens
ggactaacttgtctttggaccctg

SEQ ID NO: 2213690 - DNA, 18 bp, Homo sapiens
ggactcaatgcactgaca

SEQ ID NO: 2213691 - DNA, 17 bp, Homo sapiens
ggagaagcggctggcag

SEQ ID NO: 2213692 - DNA, 20 bp, Homo sapiens
ggagaatttttactggggat

SEQ ID NO: 2213693 - DNA, 21 bp, Homo sapiens
ggagaccccttggggagcagg

SEQ ID NO: 2213694 - DNA, 17 bp, Homo sapiens
ggagagccttccagggg

SEQ ID NO: 2213695 - DNA, 18 bp, Homo sapiens
ggagagccttccaggggt

SEQ ID NO: 2213696 - DNA, 17 bp, Homo sapiens
ggagagctagcagcagg

SEQ ID NO: 2213697 - DNA, 20 bp, Homo sapiens
ggagcaaaatcgatgcagtg

SEQ ID NO: 2213698 - DNA, 16 bp, Homo sapiens
ggagcaggcagtgggg

SEQ ID NO: 2213699 - DNA, 16 bp, Homo sapiens
ggagccccgaggcctt

SEQ ID NO: 2213700 - DNA, 14 bp, Homo sapiens
ggagcctcctgccc

SEQ ID NO: 2213701 - DNA, 16 bp, Homo sapiens
ggagctgagtggggga

SEQ ID NO: 2213702 - DNA, 12 bp, Homo sapiens
ggagctgcctgt

SEQ ID NO: 2213703 - DNA, 12 bp, Homo sapiens
ggaggaagagaa

SEQ ID NO: 2213704 - DNA, 17 bp, Homo sapiens
ggaggatctcttgagcc

SEQ ID NO: 2213705 - DNA, 21 bp, Homo sapiens
ggaggatctcttgagcctggg

SEQ ID NO: 2213706 - DNA, 16 bp, Homo sapiens
ggagggagggctccag

SEQ ID NO: 2213707 - DNA, 13 bp, Homo sapiens
ggagggctccaga

SEQ ID NO: 2213708 - DNA, 14 bp, Homo sapiens
ggagggctccagac

SEQ ID NO: 2213709 - DNA, 15 bp, Homo sapiens
ggagggctccagaca

SEQ ID NO: 2213710 - DNA, 17 bp, Homo sapiens
ggagggctccagacaca

SEQ ID NO: 2213711 - DNA, 13 bp, Homo sapiens
ggaggggggaggt

SEQ ID NO: 2213712 - DNA, 14 bp, Homo sapiens
ggaggtgaccccag

SEQ ID NO: 2213713 - DNA, 22 bp, Homo sapiens
ggagtcccaccttggctgcagg

SEQ ID NO: 2213714 - DNA, 11 bp, Homo sapiens
ggagtgacaga

SEQ ID NO: 2213715 - DNA, 19 bp, Homo sapiens
ggagtgacagaggcagccc

SEQ ID NO: 2213716 - DNA, 21 bp, Homo sapiens
ggagtgacagaggcagcccca

SEQ ID NO: 2213717 - DNA, 15 bp, Homo sapiens
ggagttctggttcct

SEQ ID NO: 2213718 - DNA, 16 bp, Homo sapiens
ggatcacagcctctga

SEQ ID NO: 2213719 - DNA, 15 bp, Homo sapiens
ggatcctccaggtgc

SEQ ID NO: 2213720 - DNA, 14 bp, Homo sapiens
ggatcctgagccag

SEQ ID NO: 2213721 - DNA, 15 bp, Homo sapiens
ggatcctgagccaga

SEQ ID NO: 2213722 - DNA, 16 bp, Homo sapiens
ggatcctgagccagat

SEQ ID NO: 2213723 - DNA, 18 bp, Homo sapiens
ggatcctgagccagattt

SEQ ID NO: 2213724 - DNA, 21 bp, Homo sapiens
ggatgaattccaaattctgct

SEQ ID NO: 2213725 - DNA, 19 bp, Homo sapiens
ggatgcagcctcacagtcc

SEQ ID NO: 2213726 - DNA, 17 bp, Homo sapiens
ggatgcctggtggcagc

SEQ ID NO: 2213727 - DNA, 20 bp, Homo sapiens
ggatgcctggtggcagctgc

SEQ ID NO: 2213728 - DNA, 21 bp, Homo sapiens
ggatgcctggtggcagctgcg

SEQ ID NO: 2213729 - DNA, 23 bp, Homo sapiens
ggattacaagcgtgagccactgc

SEQ ID NO: 2213730 - DNA, 12 bp, Homo sapiens
ggatttaacaga

SEQ ID NO: 2213731 - DNA, 16 bp, Homo sapiens
ggatttaacagaaatg

SEQ ID NO: 2213732 - DNA, 21 bp, Homo sapiens
ggattttgatccaagctggtc

SEQ ID NO: 2213733 - DNA, 18 bp, Homo sapiens
ggcaacccccagcctgct

SEQ ID NO: 2213734 - DNA, 19 bp, Homo sapiens
ggcaacccccagcctgcta

SEQ ID NO: 2213735 - DNA, 19 bp, Homo sapiens
ggcaactgcattggctttg

SEQ ID NO: 2213736 - DNA, 23 bp, Homo sapiens
ggcaatgctggctgttggctggg

SEQ ID NO: 2213737 - DNA, 23 bp, Homo sapiens
ggcacagaaaatggaagacagct

SEQ ID NO: 2213738 - DNA, 15 bp, Homo sapiens
ggcaccagcagcctg

SEQ ID NO: 2213739 - DNA, 20 bp, Homo sapiens
ggcacccaccatcatgtctg

SEQ ID NO: 2213740 - DNA, 20 bp, Homo sapiens
ggcacccccggcccagtgcc

SEQ ID NO: 2213741 - DNA, 17 bp, Homo sapiens
ggcacccggcccctgct

SEQ ID NO: 2213742 - DNA, 19 bp, Homo sapiens
ggcacccggcccctgctgg

SEQ ID NO: 2213743 - DNA, 19 bp, Homo sapiens
ggcactcagaagacactga

SEQ ID NO: 2213744 - DNA, 19 bp, Homo sapiens
ggcagagttgaagacagag

SEQ ID NO: 2213745 - DNA, 23 bp, Homo sapiens
ggcagagttgaagacagagctac

SEQ ID NO: 2213746 - DNA, 12 bp, Homo sapiens
ggcagcagagag

SEQ ID NO: 2213747 - DNA, 13 bp, Homo sapiens
ggcagcagagaga

SEQ ID NO: 2213748 - DNA, 24 bp, Homo sapiens
ggcagcagagagagagagagagaa

SEQ ID NO: 2213749 - DNA, 13 bp, Homo sapiens
ggcagccaggcca

SEQ ID NO: 2213750 - DNA, 16 bp, Homo sapiens
ggcagccccattctgc

SEQ ID NO: 2213751 - DNA, 14 bp, Homo sapiens
ggcagctcacctct

SEQ ID NO: 2213752 - DNA, 16 bp, Homo sapiens
ggcagctcacctctcc

SEQ ID NO: 2213753 - DNA, 21 bp, Homo sapiens
ggcagctcacctctcccttgg

SEQ ID NO: 2213754 - DNA, 24 bp, Homo sapiens
ggcagctgcggtccacccaggagc

SEQ ID NO: 2213755 - DNA, 12 bp, Homo sapiens
ggcagggtccta

SEQ ID NO: 2213756 - DNA, 19 bp, Homo sapiens
ggcagggtctcactctgtc

SEQ ID NO: 2213757 - DNA, 23 bp, Homo sapiens
ggcaggtcttgaactcctggcct

SEQ ID NO: 2213758 - DNA, 13 bp, Homo sapiens
ggcagtgggagct

SEQ ID NO: 2213759 - DNA, 18 bp, Homo sapiens
ggcagtgggagctgcctg

SEQ ID NO: 2213760 - DNA, 20 bp, Homo sapiens
ggcagtggtggttttctgtt

SEQ ID NO: 2213761 - DNA, 18 bp, Homo sapiens
ggcatccagtatcttgaa

SEQ ID NO: 2213762 - DNA, 22 bp, Homo sapiens
ggcatgacacgaatattgctga

SEQ ID NO: 2213763 - DNA, 15 bp, Homo sapiens
ggcattccccaggag

SEQ ID NO: 2213764 - DNA, 16 bp, Homo sapiens
ggcattccccaggagg

SEQ ID NO: 2213765 - DNA, 19 bp, Homo sapiens
ggcattccccaggaggcca

SEQ ID NO: 2213766 - DNA, 17 bp, Homo sapiens
ggcatttgtttgaactg

SEQ ID NO: 2213767 - DNA, 14 bp, Homo sapiens
ggccaaaggaagca

SEQ ID NO: 2213768 - DNA, 22 bp, Homo sapiens
ggccacctgcggtgctatctcc

SEQ ID NO: 2213769 - DNA, 22 bp, Homo sapiens
ggccagagggagtgacagaggc

SEQ ID NO: 2213770 - DNA, 17 bp, Homo sapiens
ggccagatgcaccagcc

SEQ ID NO: 2213771 - DNA, 22 bp, Homo sapiens
ggccagccttgaccattctcca

SEQ ID NO: 2213772 - DNA, 17 bp, Homo sapiens
ggccagctgcttgggct

SEQ ID NO: 2213773 - DNA, 11 bp, Homo sapiens
ggccaggagcc

SEQ ID NO: 2213774 - DNA, 13 bp, Homo sapiens
ggccaggagcctc

SEQ ID NO: 2213775 - DNA, 16 bp, Homo sapiens
ggccaggagcctcctg

SEQ ID NO: 2213776 - DNA, 14 bp, Homo sapiens
ggccaggccagagg

SEQ ID NO: 2213777 - DNA, 16 bp, Homo sapiens
ggccaggccagaggga

SEQ ID NO: 2213778 - DNA, 11 bp, Homo sapiens
ggccaggctgg

SEQ ID NO: 2213779 - DNA, 16 bp, Homo sapiens
ggccatgggcctcctg

SEQ ID NO: 2213780 - DNA, 12 bp, Homo sapiens
ggcccaagagag

SEQ ID NO: 2213781 - DNA, 17 bp, Homo sapiens
ggcccaagagagacagc

SEQ ID NO: 2213782 - DNA, 11 bp, Homo sapiens
gcacaggcagc

SEQ ID NO: 2213783 - DNA, 19 bp, Homo sapiens
gcacaggcagccccacgga

SEQ ID NO: 2213784 - DNA, 22 bp, Homo sapiens
gcacatgcctctctcaggccaa

SEQ ID NO: 2213785 - DNA, 15 bp, Homo sapiens
gcaccatctctcctc

SEQ ID NO: 2213786 - DNA, 22 bp, Homo sapiens
gcacccaccatcatgtctggct

SEQ ID NO: 2213787 - DNA, 19 bp, Homo sapiens
gcacccccggcccagtgcc

SEQ ID NO: 2213788 - DNA, 21 bp, Homo sapiens
gcctcccgaatagctgggact

SEQ ID NO: 2213789 - DNA, 15 bp, Homo sapiens
gcctcccgagtagct

SEQ ID NO: 2213790 - DNA, 18 bp, Homo sapiens
gcctcccgagtagctggg

SEQ ID NO: 2213791 - DNA, 20 bp, Homo sapiens
gcctcccgagtagctgggac

SEQ ID NO: 2213792 - DNA, 13 bp, Homo sapiens
gcctcctgtgtgt

SEQ ID NO: 2213793 - DNA, 23 bp, Homo sapiens
gcctcctgtgtgtgcgcctacag

SEQ ID NO: 2213794 - DNA, 19 bp, Homo sapiens
gcctcctttgtgaggaagc

SEQ ID NO: 2213795 - DNA, 20 bp, Homo sapiens
gcctcgaactggctgcaaag

SEQ ID NO: 2213796 - DNA, 22 bp, Homo sapiens
gcctcgaactggctgcaaaggg

SEQ ID NO: 2213797 - DNA, 15 bp, Homo sapiens
gcctctcccatcact

SEQ ID NO: 2213798 - DNA, 15 bp, Homo sapiens
gcctctgacacacag

SEQ ID NO: 2213799 - DNA, 16 bp, Homo sapiens
gcctctgacacacagc

SEQ ID NO: 2213800 - DNA, 17 bp, Homo sapiens
gcctctgacacacagct

SEQ ID NO: 2213801 - DNA, 20 bp, Homo sapiens
gcctctgacacacagctctg

SEQ ID NO: 2213802 - DNA, 21 bp, Homo sapiens
gcctctgacacacagctctgt

SEQ ID NO: 2213803 - DNA, 21 bp, Homo sapiens
gcctctgcactcccctgctgg

SEQ ID NO: 2213804 - DNA, 12 bp, Homo sapiens
gcctctgcctct

SEQ ID NO: 2213805 - DNA, 12 bp, Homo sapiens
gcctctgggact

SEQ ID NO: 2213806 - DNA, 17 bp, Homo sapiens
gcctcttatgggctggg

SEQ ID NO: 2213807 - DNA, 14 bp, Homo sapiens
gcctcttgggttca

SEQ ID NO: 2213808 - DNA, 15 bp, Homo sapiens
gcctgaagtcacaca

SEQ ID NO: 2213809 - DNA, 16 bp, Homo sapiens
gcctgaagtcacacag

SEQ ID NO: 2213810 - DNA, 22 bp, Homo sapiens
gcctgaagtcacacagtgagtc

SEQ ID NO: 2213811 - DNA, 15 bp, Homo sapiens
gcctgcaagggagtg

SEQ ID NO: 2213812 - DNA, 15 bp, Homo sapiens
gcctgcccaggcccc

SEQ ID NO: 2213813 - DNA, 18 bp, Homo sapiens
gcctgcccaggcccctgc

SEQ ID NO: 2213814 - DNA, 16 bp, Homo sapiens
gcctgcctcttctcta

SEQ ID NO: 2213815 - DNA, 17 bp, Homo sapiens
gcctgctaattccccag

SEQ ID NO: 2213816 - DNA, 23 bp, Homo sapiens
gcctgctaattccccagattgca

SEQ ID NO: 2213817 - DNA, 16 bp, Homo sapiens
gcctgctccagctgtt

SEQ ID NO: 2213818 - DNA, 14 bp, Homo sapiens
gcctggaccctgtg

SEQ ID NO: 2213819 - DNA, 18 bp, Homo sapiens
gcctggatggggctgcac

SEQ ID NO: 2213820 - DNA, 16 bp, Homo sapiens
gcctggccagatgcac

SEQ ID NO: 2213821 - DNA, 13 bp, Homo sapiens
gcctggctcaggt

SEQ ID NO: 2213822 - DNA, 11 bp, Homo sapiens
gcctgggcaga

SEQ ID NO: 2213823 - DNA, 18 bp, Homo sapiens
gcctgggcagaaggaaga

SEQ ID NO: 2213824 - DNA, 20 bp, Homo sapiens
gcctgggggctgggcagagg

SEQ ID NO: 2213825 - DNA, 15 bp, Homo sapiens
gcctggtggcagctg

SEQ ID NO: 2213826 - DNA, 21 bp, Homo sapiens
gcctggtggcagctgcggtcc

SEQ ID NO: 2213827 - DNA, 17 bp, Homo sapiens
gcctgttcagctccagc

SEQ ID NO: 2213828 - DNA, 20 bp, Homo sapiens
gcctgttcagctccagctca

SEQ ID NO: 2213829 - DNA, 16 bp, Homo sapiens
gcctgttgggccagga

SEQ ID NO: 2213830 - DNA, 18 bp, Homo sapiens
gcctgttgggccaggagc

SEQ ID NO: 2213831 - DNA, 21 bp, Homo sapiens
gcctgttgggccaggagcctc

SEQ ID NO: 2213832 - DNA, 20 bp, Homo sapiens
gccttacacaatggttttct

SEQ ID NO: 2213833 - DNA, 19 bp, Homo sapiens
gccttaccctcatgttctt

SEQ ID NO: 2213834 - DNA, 17 bp, Homo sapiens
gccttagaagtcacaca

SEQ ID NO: 2213835 - DNA, 18 bp, Homo sapiens
gccttagaagtcacacag

SEQ ID NO: 2213836 - DNA, 12 bp, Homo sapiens
gccttccagggg

SEQ ID NO: 2213837 - DNA, 21 bp, Homo sapiens
gccttccaggggtgggacacc

SEQ ID NO: 2213838 - DNA, 20 bp, Homo sapiens
gccttgaccattctccacct

SEQ ID NO: 2213839 - DNA, 23 bp, Homo sapiens
gccttgaccattctccacctgcc

SEQ ID NO: 2213840 - DNA, 13 bp, Homo sapiens
gcctttggcttca

SEQ ID NO: 2213841 - DNA, 12 bp, Homo sapiens
gcgacaatgcaa

SEQ ID NO: 2213842 - DNA, 20 bp, Homo sapiens
gcgacaatgcaaaccatcat

SEQ ID NO: 2213843 - DNA, 21 bp, Homo sapiens
gcgacaatgcaaaccatcatt

SEQ ID NO: 2213844 - DNA, 14 bp, Homo sapiens
gcgattcttctgct

SEQ ID NO: 2213845 - DNA, 22 bp, Homo sapiens
gcgattcttctgcttcagcctc

SEQ ID NO: 2213846 - DNA, 23 bp, Homo sapiens
gcgcccagttgggtggatgcctg

SEQ ID NO: 2213847 - DNA, 21 bp, Homo sapiens
gcgcctacaggagtgagcact

SEQ ID NO: 2213848 - DNA, 21 bp, Homo sapiens
gcgccttaaggatgttctagc

SEQ ID NO: 2213849 - DNA, 18 bp, Homo sapiens
gcgctgcccctggcagcc

SEQ ID NO: 2213850 - DNA, 19 bp, Homo sapiens
gcggaagccacagggtgag

SEQ ID NO: 2213851 - DNA, 11 bp, Homo sapiens
gcggacagcca

SEQ ID NO: 2213852 - DNA, 13 bp, Homo sapiens
gcggacagccacg

SEQ ID NO: 2213853 - DNA, 23 bp, Homo sapiens
gcggacagccacggccaggccag

SEQ ID NO: 2213854 - DNA, 20 bp, Homo sapiens
gcgggaggatgttctgggac

SEQ ID NO: 2213855 - DNA, 22 bp, Homo sapiens
gcgggaggatgttctgggacac

SEQ ID NO: 2213856 - DNA, 14 bp, Homo sapiens
gcggggacagctcc

SEQ ID NO: 2213857 - DNA, 17 bp, Homo sapiens
gcggggacagctccttc

SEQ ID NO: 2213858 - DNA, 23 bp, Homo sapiens
gcggggacagctccttctgtcct

SEQ ID NO: 2213859 - DNA, 14 bp, Homo sapiens
gcgggggagcaggc

SEQ ID NO: 2213860 - DNA, 16 bp, Homo sapiens
gcgggggagcaggcag

SEQ ID NO: 2213861 - DNA, 20 bp, Homo sapiens
gcgggggagcaggcagtggg

SEQ ID NO: 2213862 - DNA, 14 bp, Homo sapiens
gcggtccacccagg

SEQ ID NO: 2213863 - DNA, 16 bp, Homo sapiens
gcggtccacccaggag

SEQ ID NO: 2213864 - DNA, 18 bp, Homo sapiens
gcggtccacccaggagcc

SEQ ID NO: 2213865 - DNA, 23 bp, Homo sapiens
gcggtccacccaggagccccgag

SEQ ID NO: 2213866 - DNA, 18 bp, Homo sapiens
gcgtgagccactgcaccg

SEQ ID NO: 2213867 - DNA, 18 bp, Homo sapiens
gcgtgcacacaccagagc

SEQ ID NO: 2213868 - DNA, 20 bp, Homo sapiens
gcgtgcacacaccagagccc

SEQ ID NO: 2213869 - DNA, 23 bp, Homo sapiens
gcgtgcacacaccagagcccacc

SEQ ID NO: 2213870 - DNA, 20 bp, Homo sapiens
gcgtggtggacatgcacagc

SEQ ID NO: 2213871 - DNA, 20 bp, Homo sapiens
gctaaaaagaatgcagagat

SEQ ID NO: 2213872 - DNA, 18 bp, Homo sapiens
gctaacatggaagtacta

SEQ ID NO: 2213873 - DNA, 21 bp, Homo sapiens
gctaagagggagggagggctc

SEQ ID NO: 2213874 - DNA, 18 bp, Homo sapiens
gctaagtgatcctcccac

SEQ ID NO: 2213875 - DNA, 23 bp, Homo sapiens
gctaagtgatcctcccacctcag

SEQ ID NO: 2213876 - DNA, 13 bp, Homo sapiens
gctacacactgca

SEQ ID NO: 2213877 - DNA, 22 bp, Homo sapiens
gctacacaggggaaaagaggag

SEQ ID NO: 2213878 - DNA, 20 bp, Homo sapiens
gctacctttgtattctctcc

SEQ ID NO: 2213879 - DNA, 20 bp, Homo sapiens
gctactgtcctacccaccct

SEQ ID NO: 2213880 - DNA, 21 bp, Homo sapiens
gctagacgagcaggcttcttc

SEQ ID NO: 2213881 - DNA, 22 bp, Homo sapiens
gctagacgagcaggcttcttcc

SEQ ID NO: 2213882 - DNA, 22 bp, Homo sapiens
gctagcagcagggagggcttct

SEQ ID NO: 2213883 - DNA, 21 bp, Homo sapiens
gctaggaacactccttcacag

SEQ ID NO: 2213884 - DNA, 23 bp, Homo sapiens
gctaggcctggccagatgcacca

SEQ ID NO: 2213885 - DNA, 21 bp, Homo sapiens
gctagtgtggtgtttcctggc

SEQ ID NO: 2213886 - DNA, 14 bp, Homo sapiens
gctagttgggcttc

SEQ ID NO: 2213887 - DNA, 16 bp, Homo sapiens
gctagttgggcttcct

SEQ ID NO: 2213888 - DNA, 20 bp, Homo sapiens
gctattcagtaataactcta

SEQ ID NO: 2213889 - DNA, 19 bp, Homo sapiens
gctcaagtcctcttttctg

SEQ ID NO: 2213890 - DNA, 22 bp, Homo sapiens
gctcaagtcctcttttctgaga

SEQ ID NO: 2213891 - DNA, 12 bp, Homo sapiens
gctcaccagccc

SEQ ID NO: 2213892 - DNA, 13 bp, Homo sapiens
gctcaccagcccc

SEQ ID NO: 2213893 - DNA, 19 bp, Homo sapiens
gctcaccagccccagtgcc

SEQ ID NO: 2213894 - DNA, 14 bp, Homo sapiens
gctcacctctccct

SEQ ID NO: 2213895 - DNA, 16 bp, Homo sapiens
gctcacctctcccttg

SEQ ID NO: 2213896 - DNA, 17 bp, Homo sapiens
gctcacctctcccttgg

SEQ ID NO: 2213897 - DNA, 11 bp, Homo sapiens
gctcactgcag

SEQ ID NO: 2213898 - DNA, 13 bp, Homo sapiens
gctcactgcagcc

SEQ ID NO: 2213899 - DNA, 14 bp, Homo sapiens
gctcagagagggtg

SEQ ID NO: 2213900 - DNA, 20 bp, Homo sapiens
gctcagcaaaagatgcttct

SEQ ID NO: 2213901 - DNA, 15 bp, Homo sapiens
gctcagcggggacag

SEQ ID NO: 2213902 - DNA, 21 bp, Homo sapiens
gctcagcggggacagctcctt

SEQ ID NO: 2213903 - DNA, 22 bp, Homo sapiens
gctcagcggggacagctccttc

SEQ ID NO: 2213904 - DNA, 13 bp, Homo sapiens
gctcagggcctgg

SEQ ID NO: 2213905 - DNA, 17 bp, Homo sapiens
gctcagggcctggctca

SEQ ID NO: 2213906 - DNA, 19 bp, Homo sapiens
gctcagggcctggctcagg

SEQ ID NO: 2213907 - DNA, 16 bp, Homo sapiens
gctcaggtgtccctgc

SEQ ID NO: 2213908 - DNA, 18 bp, Homo sapiens
gccagctgcttgggcttc

SEQ ID NO: 2213909 - DNA, 20 bp, Homo sapiens
gccagctgcttgggcttcat

SEQ ID NO: 2213910 - DNA, 12 bp, Homo sapiens
gccaggaagcca

SEQ ID NO: 2213911 - DNA, 14 bp, Homo sapiens
gccaggaagccagc

SEQ ID NO: 2213912 - DNA, 17 bp, Homo sapiens
gccaggaagccagcagg

SEQ ID NO: 2213913 - DNA, 18 bp, Homo sapiens
gccaggaagccagcaggc

SEQ ID NO: 2213914 - DNA, 20 bp, Homo sapiens
gccaggagcctcctgccctt

SEQ ID NO: 2213915 - DNA, 21 bp, Homo sapiens
gccaggccacaagacccttgt

SEQ ID NO: 2213916 - DNA, 22 bp, Homo sapiens
gccaggccagagggagtgacag

SEQ ID NO: 2213917 - DNA, 19 bp, Homo sapiens
gccaggccctctgcccact

SEQ ID NO: 2213918 - DNA, 20 bp, Homo sapiens
gccaggccctctgcccactc

SEQ ID NO: 2213919 - DNA, 13 bp, Homo sapiens
gccaggctggtct

SEQ ID NO: 2213920 - DNA, 15 bp, Homo sapiens
gccaggctggtctca

SEQ ID NO: 2213921 - DNA, 22 bp, Homo sapiens
gccaggggaaaatcagcctgct

SEQ ID NO: 2213922 - DNA, 17 bp, Homo sapiens
gccaggtttttggtctg

SEQ ID NO: 2213923 - DNA, 12 bp, Homo sapiens
gccagtaaatgg

SEQ ID NO: 2213924 - DNA, 18 bp, Homo sapiens
gccagtcaccccggccac

SEQ ID NO: 2213925 - DNA, 13 bp, Homo sapiens
gccagtgtgacaa

SEQ ID NO: 2213926 - DNA, 16 bp, Homo sapiens
gccagttggtccccct

SEQ ID NO: 2213927 - DNA, 23 bp, Homo sapiens
gccagttggtcccccttccatgg

SEQ ID NO: 2213928 - DNA, 20 bp, Homo sapiens
gccatattctgttggccagt

SEQ ID NO: 2213929 - DNA, 13 bp, Homo sapiens
gccatgccagctt

SEQ ID NO: 2213930 - DNA, 14 bp, Homo sapiens
gccatgctcctggc

SEQ ID NO: 2213931 - DNA, 15 bp, Homo sapiens
gccatgttggccagg

SEQ ID NO: 2213932 - DNA, 18 bp, Homo sapiens
gccatgttggccaggctg

SEQ ID NO: 2213933 - DNA, 24 bp, Homo sapiens
gccatgttggccaggctggtctca

SEQ ID NO: 2213934 - DNA, 20 bp, Homo sapiens
gccatttcttccacaagagc

SEQ ID NO: 2213935 - DNA, 13 bp, Homo sapiens
gcccaagagagac

SEQ ID NO: 2213936 - DNA, 21 bp, Homo sapiens
gcccacctggcctctgcactc

SEQ ID NO: 2213937 - DNA, 13 bp, Homo sapiens
gcccaccttggct

SEQ ID NO: 2213938 - DNA, 17 bp, Homo sapiens
gcccacgcccccactgg

SEQ ID NO: 2213939 - DNA, 14 bp, Homo sapiens
gcccacttctgcca

SEQ ID NO: 2213940 - DNA, 21 bp, Homo sapiens
gcccagagagggtggtgacct

SEQ ID NO: 2213941 - DNA, 14 bp, Homo sapiens
gcccagagggcctg

SEQ ID NO: 2213942 - DNA, 11 bp, Homo sapiens
gcccagcccct

SEQ ID NO: 2213943 - DNA, 12 bp, Homo sapiens
gcccagcccctt

SEQ ID NO: 2213944 - DNA, 13 bp, Homo sapiens
gcccagccccttc

SEQ ID NO: 2213945 - DNA, 20 bp, Homo sapiens
gcccagccccttctgaccca

SEQ ID NO: 2213946 - DNA, 12 bp, Homo sapiens
gcccaggaaagg

SEQ ID NO: 2213947 - DNA, 16 bp, Homo sapiens
gcccaggaaaggctcc

SEQ ID NO: 2213948 - DNA, 21 bp, Homo sapiens
gcccaggaaaggctccaggag

SEQ ID NO: 2213949 - DNA, 23 bp, Homo sapiens
gcccaggaaaggctccaggagca

SEQ ID NO: 2213950 - DNA, 24 bp, Homo sapiens
gcccaggaaaggctccaggagcag

SEQ ID NO: 2213951 - DNA, 14 bp, Homo sapiens
gcccaggcaggtct

SEQ ID NO: 2213952 - DNA, 16 bp, Homo sapiens
gcccaggcaggtcttg

SEQ ID NO: 2213953 - DNA, 13 bp, Homo sapiens
gcccaggcccctg

SEQ ID NO: 2213954 - DNA, 18 bp, Homo sapiens
gcccaggcccctgccacc

SEQ ID NO: 2213955 - DNA, 21 bp, Homo sapiens
gcccaggcccctgccaccctg

SEQ ID NO: 2213956 - DNA, 23 bp, Homo sapiens
gcccaggcccctgccaccctggg

SEQ ID NO: 2213957 - DNA, 15 bp, Homo sapiens
gcccaggcctcccca

SEQ ID NO: 2213958 - DNA, 16 bp, Homo sapiens
gcccaggcctccccag

SEQ ID NO: 2213959 - DNA, 11 bp, Homo sapiens
gcccaggctgg

SEQ ID NO: 2213960 - DNA, 15 bp, Homo sapiens
gcccaggctggcgtg

SEQ ID NO: 2213961 - DNA, 19 bp, Homo sapiens
gcccagtctggaatgcagt

SEQ ID NO: 2213962 - DNA, 15 bp, Homo sapiens
gcccagttgggtgga

SEQ ID NO: 2213963 - DNA, 21 bp, Homo sapiens
gcccagttgggtggatgcctg

SEQ ID NO: 2213964 - DNA, 18 bp, Homo sapiens
gccccaaaactctcctct

SEQ ID NO: 2213965 - DNA, 19 bp, Homo sapiens
gccccaaaactctcctctg

SEQ ID NO: 2213966 - DNA, 20 bp, Homo sapiens
gccccaaaactctcctctgc

SEQ ID NO: 2213967 - DNA, 13 bp, Homo sapiens
gccccacgtccct

SEQ ID NO: 2213968 - DNA, 16 bp, Homo sapiens
gccccagtgcccacag

SEQ ID NO: 2213969 - DNA, 18 bp, Homo sapiens
gccccatcccaaaccctt

SEQ ID NO: 2213970 - DNA, 17 bp, Homo sapiens
gccccatcctcctgccc

SEQ ID NO: 2213971 - DNA, 22 bp, Homo sapiens
gccccatcctctgtacagagcc

SEQ ID NO: 2213972 - DNA, 15 bp, Homo sapiens
gccccattctgcctg

SEQ ID NO: 2213973 - DNA, 17 bp, Homo sapiens
gccccattctgcctgcc

SEQ ID NO: 2213974 - DNA, 20 bp, Homo sapiens
gccccattctgcctgcccag

SEQ ID NO: 2213975 - DNA, 22 bp, Homo sapiens
gccccattctgcctgcccaggc

SEQ ID NO: 2213976 - DNA, 15 bp, Homo sapiens
gcccccaccccaggc

SEQ ID NO: 2213977 - DNA, 18 bp, Homo sapiens
gcccccaccccaggctgg

SEQ ID NO: 2213978 - DNA, 19 bp, Homo sapiens
gcccccacccccaccctcg

SEQ ID NO: 2213979 - DNA, 22 bp, Homo sapiens
gccccgaggccttctctgaagg

SEQ ID NO: 2213980 - DNA, 14 bp, Homo sapiens
gcccctcagggtcc

SEQ ID NO: 2213981 - DNA, 13 bp, Homo sapiens
gcccctgccaccc

SEQ ID NO: 2213982 - DNA, 22 bp, Homo sapiens
gcccctgctggttcagggttgg

SEQ ID NO: 2213983 - DNA, 15 bp, Homo sapiens
gcccctggatgcagc

SEQ ID NO: 2213984 - DNA, 16 bp, Homo sapiens
gcccctggatgcagcc

SEQ ID NO: 2213985 - DNA, 18 bp, Homo sapiens
gcccctggatgcagcctc

SEQ ID NO: 2213986 - DNA, 23 bp, Homo sapiens
gcccctggcagcccctgttctgg

SEQ ID NO: 2213987 - DNA, 21 bp, Homo sapiens
gcccctgttctggcagagttg

SEQ ID NO: 2213988 - DNA, 20 bp, Homo sapiens
gccccttctgacccatgctg

SEQ ID NO: 2213989 - DNA, 12 bp, Homo sapiens
gcccggctccag

SEQ ID NO: 2213990 - DNA, 13 bp, Homo sapiens
gcccggctccagg

SEQ ID NO: 2213991 - DNA, 16 bp, Homo sapiens
gcccggctccaggctc

SEQ ID NO: 2213992 - DNA, 14 bp, Homo sapiens
gcccgggctctgcc

SEQ ID NO: 2213993 - DNA, 18 bp, Homo sapiens
gcccgggctctgcctccc

SEQ ID NO: 2213994 - DNA, 19 bp, Homo sapiens
gcccgggctctgcctccca

SEQ ID NO: 2213995 - DNA, 21 bp, Homo sapiens
gcccgggctctgcctcccatc

SEQ ID NO: 2213996 - DNA, 19 bp, Homo sapiens
gccctccaagaccttctcc

SEQ ID NO: 2213997 - DNA, 23 bp, Homo sapiens
gccctccaagaccttctccttca

SEQ ID NO: 2213998 - DNA, 12 bp, Homo sapiens
gccctcccaccc

SEQ ID NO: 2213999 - DNA, 20 bp, Homo sapiens
gccctcccaccccctccccg

SEQ ID NO: 2214000 - DNA, 22 bp, Homo sapiens
gccctcccaccccctccccggg

SEQ ID NO: 2214001 - DNA, 13 bp, Homo sapiens
gccctcccagacc

SEQ ID NO: 2214002 - DNA, 22 bp, Homo sapiens
gccctcccagacccccttgccc

SEQ ID NO: 2214003 - DNA, 12 bp, Homo sapiens
gccctctgccca

SEQ ID NO: 2214004 - DNA, 16 bp, Homo sapiens
gccctctgcccactcc

SEQ ID NO: 2214005 - DNA, 18 bp, Homo sapiens
gccctctgcccactccct

SEQ ID NO: 2214006 - DNA, 19 bp, Homo sapiens
gccctctgcccactccctg

SEQ ID NO: 2214007 - DNA, 22 bp, Homo sapiens
gccctctgcccactccctgcaa

SEQ ID NO: 2214008 - DNA, 16 bp, Homo sapiens
gccctgagctttctgc

SEQ ID NO: 2214009 - DNA, 14 bp, Homo sapiens
gccctgcagagggc

SEQ ID NO: 2214010 - DNA, 14 bp, Homo sapiens
gccctgcccacctg

SEQ ID NO: 2214011 - DNA, 20 bp, Homo sapiens
gccctgcccacctggcctct

SEQ ID NO: 2214012 - DNA, 13 bp, Homo sapiens
gccctgcctcctt

SEQ ID NO: 2214013 - DNA, 16 bp, Homo sapiens
gccctgcctcctttgt

SEQ ID NO: 2214014 - DNA, 18 bp, Homo sapiens
gcccttctctccagcccc

SEQ ID NO: 2214015 - DNA, 19 bp, Homo sapiens
gcccttctctccagcccct

SEQ ID NO: 2214016 - DNA, 22 bp, Homo sapiens
gcccttctctccagcccctgga

SEQ ID NO: 2214017 - DNA, 23 bp, Homo sapiens
gcccttctctccagcccctggat

SEQ ID NO: 2214018 - DNA, 19 bp, Homo sapiens
gccgagatagccaaggcca

SEQ ID NO: 2214019 - DNA, 19 bp, Homo sapiens
gccgagatcacgccactgc

SEQ ID NO: 2214020 - DNA, 23 bp, Homo sapiens
gccgtctacctgaggggcctctt

SEQ ID NO: 2214021 - DNA, 17 bp, Homo sapiens
gcctacaggagtgagca

SEQ ID NO: 2214022 - DNA, 16 bp, Homo sapiens
gcctcaacctcctggg

SEQ ID NO: 2214023 - DNA, 17 bp, Homo sapiens
gcctcaacctcctgggc

SEQ ID NO: 2214024 - DNA, 18 bp, Homo sapiens
gcctcacagtccttacca

SEQ ID NO: 2214025 - DNA, 15 bp, Homo sapiens
gcctcagcatcctgg

SEQ ID NO: 2214026 - DNA, 17 bp, Homo sapiens
gcctcagcatcctggca

SEQ ID NO: 2214027 - DNA, 18 bp, Homo sapiens
gcctcagcatcctggcac

SEQ ID NO: 2214028 - DNA, 12 bp, Homo sapiens
gcctcagcctcc

SEQ ID NO: 2214029 - DNA, 14 bp, Homo sapiens
gcctcagcctccca

SEQ ID NO: 2214030 - DNA, 23 bp, Homo sapiens
gcctcagcctcccaaagtgctgg

SEQ ID NO: 2214031 - DNA, 19 bp, Homo sapiens
gcctcccaaagtgctggga

SEQ ID NO: 2214032 - DNA, 17 bp, Homo sapiens
gcctcccaactcacccc

SEQ ID NO: 2214033 - DNA, 18 bp, Homo sapiens
gcctcccaactcacccca

SEQ ID NO: 2214034 - DNA, 19 bp, Homo sapiens
aatgtttgcctctgcctct

SEQ ID NO: 2214035 - DNA, 18 bp, Homo sapiens
aattaaaacacaacatct

SEQ ID NO: 2214036 - DNA, 22 bp, Homo sapiens
aattaacttttataaactttac

SEQ ID NO: 2214037 - DNA, 13 bp, Homo sapiens
aattaagtactat

SEQ ID NO: 2214038 - DNA, 22 bp, Homo sapiens
aattatttattaaatgcccagc

SEQ ID NO: 2214039 - DNA, 11 bp, Homo sapiens
aattcagttgt

SEQ ID NO: 2214040 - DNA, 14 bp, Homo sapiens
aattccccaccctg

SEQ ID NO: 2214041 - DNA, 12 bp, Homo sapiens
aattccccagat

SEQ ID NO: 2214042 - DNA, 19 bp, Homo sapiens
aattctcagaatctcaaat

SEQ ID NO: 2214043 - DNA, 21 bp, Homo sapiens
aattctcatttgtcacacact

SEQ ID NO: 2214044 - DNA, 14 bp, Homo sapiens
aattcttgcaaagt

SEQ ID NO: 2214045 - DNA, 22 bp, Homo sapiens
aattgtaaggaatgattaatta

SEQ ID NO: 2214046 - DNA, 22 bp, Homo sapiens
aattgtttggggatgagaaagg

SEQ ID NO: 2214047 - DNA, 15 bp, Homo sapiens
aatttacatactctg

SEQ ID NO: 2214048 - DNA, 17 bp, Homo sapiens
aatttacctgaagtctt

SEQ ID NO: 2214049 - DNA, 14 bp, Homo sapiens
aatttattatggca

SEQ ID NO: 2214050 - DNA, 15 bp, Homo sapiens
aatttcccaaagcag

SEQ ID NO: 2214051 - DNA, 17 bp, Homo sapiens
aatttcccaaagcagtg

SEQ ID NO: 2214052 - DNA, 14 bp, Homo sapiens
aattttgatgtttt

SEQ ID NO: 2214053 - DNA, 13 bp, Homo sapiens
acaaaatgaaaaa

SEQ ID NO: 2214054 - DNA, 20 bp, Homo sapiens
acaaaatgtagggttataat

SEQ ID NO: 2214055 - DNA, 22 bp, Homo sapiens
acaaaatgtagggttataataa

SEQ ID NO: 2214056 - DNA, 22 bp, Homo sapiens
acaaaggatgcccaaagatgca

SEQ ID NO: 2214057 - DNA, 12 bp, Homo sapiens
acaacactcaca

SEQ ID NO: 2214058 - DNA, 16 bp, Homo sapiens
acaagaccacgtttct

SEQ ID NO: 2214059 - DNA, 17 bp, Homo sapiens
acaagaccacgtttcta

SEQ ID NO: 2214060 - DNA, 18 bp, Homo sapiens
acaagcgtgagccactgc

SEQ ID NO: 2214061 - DNA, 13 bp, Homo sapiens
acaagctccaagc

SEQ ID NO: 2214062 - DNA, 23 bp, Homo sapiens
acaagctgcaccctcaggcaggt

SEQ ID NO: 2214063 - DNA, 16 bp, Homo sapiens
acaaggcaaggctgtc

SEQ ID NO: 2214064 - DNA, 18 bp, Homo sapiens
acaatgacttactgtaca

SEQ ID NO: 2214065 - DNA, 11 bp, Homo sapiens
acaatgcaaac

SEQ ID NO: 2214066 - DNA, 16 bp, Homo sapiens
acaatgcaaaccatca

SEQ ID NO: 2214067 - DNA, 15 bp, Homo sapiens
acaatggttttcttg

SEQ ID NO: 2214068 - DNA, 17 bp, Homo sapiens
acaatgtgaaaagaaaa

SEQ ID NO: 2214069 - DNA, 14 bp, Homo sapiens
acaatttattatgg

SEQ ID NO: 2214070 - DNA, 16 bp, Homo sapiens
acaatttattatggca

SEQ ID NO: 2214071 - DNA, 10 bp, Homo sapiens
acacaaaaaa

SEQ ID NO: 2214072 - DNA, 18 bp, Homo sapiens
acacaaacgggctcagca

SEQ ID NO: 2214073 - DNA, 11 bp, Homo sapiens
acacacagctc

SEQ ID NO: 2214074 - DNA, 20 bp, Homo sapiens
acacaccagagcccaccttg

SEQ ID NO: 2214075 - DNA, 21 bp, Homo sapiens
acacactgcatgtttgtgatt

SEQ ID NO: 2214076 - DNA, 16 bp, Homo sapiens
acacagctcttctcca

SEQ ID NO: 2214077 - DNA, 19 bp, Homo sapiens
acacagctcttctccaggc

SEQ ID NO: 2214078 - DNA, 20 bp, Homo sapiens
acacagctcttctccaggct

SEQ ID NO: 2214079 - DNA, 21 bp, Homo sapiens
acacagctcttctccaggctg

SEQ ID NO: 2214080 - DNA, 20 bp, Homo sapiens
acacaggcccggctccaggc

SEQ ID NO: 2214081 - DNA, 24 bp, Homo sapiens
acacaggcccggctccaggctcct

SEQ ID NO: 2214082 - DNA, 19 bp, Homo sapiens
acacagtattacttctgct

SEQ ID NO: 2214083 - DNA, 19 bp, Homo sapiens
acacatgcaaggtcatttt

SEQ ID NO: 2214084 - DNA, 14 bp, Homo sapiens
acacattttatttt

SEQ ID NO: 2214085 - DNA, 18 bp, Homo sapiens
acacattttttaaatgca

SEQ ID NO: 2214086 - DNA, 19 bp, Homo sapiens
acacattttttaaatgcac

SEQ ID NO: 2214087 - DNA, 15 bp, Homo sapiens
acaccactacattct

SEQ ID NO: 2214088 - DNA, 19 bp, Homo sapiens
acacctctgcacaagctgc

SEQ ID NO: 2214089 - DNA, 14 bp, Homo sapiens
acaccttgacaggg

SEQ ID NO: 2214090 - DNA, 15 bp, Homo sapiens
acaccttgacagggc

SEQ ID NO: 2214091 - DNA, 21 bp, Homo sapiens
acacgaatattgctgatggtg

SEQ ID NO: 2214092 - DNA, 15 bp, Homo sapiens
acacgcgtgcacaca

SEQ ID NO: 2214093 - DNA, 14 bp, Homo sapiens
acactaaccacgct

SEQ ID NO: 2214094 - DNA, 16 bp, Homo sapiens
acactaaccacgctgg

SEQ ID NO: 2214095 - DNA, 15 bp, Homo sapiens
acactaatgaggaaa

SEQ ID NO: 2214096 - DNA, 22 bp, Homo sapiens
acactcacatttattctgctca

SEQ ID NO: 2214097 - DNA, 17 bp, Homo sapiens
acactcattgacctgag

SEQ ID NO: 2214098 - DNA, 23 bp, Homo sapiens
acactcattgacctgaggccctt

SEQ ID NO: 2214099 - DNA, 13 bp, Homo sapiens
acactctgagact

SEQ ID NO: 2214100 - DNA, 15 bp, Homo sapiens
acactgttctctgcc

SEQ ID NO: 2214101 - DNA, 17 bp, Homo sapiens
acactgttctctgccct

SEQ ID NO: 2214102 - DNA, 22 bp, Homo sapiens
acactgttctctgccctccaag

SEQ ID NO: 2214103 - DNA, 23 bp, Homo sapiens
acactgttctctgccctccaaga

SEQ ID NO: 2214104 - DNA, 15 bp, Homo sapiens
acactgtttcaaact

SEQ ID NO: 2214105 - DNA, 16 bp, Homo sapiens
acactgtttcaaactt

SEQ ID NO: 2214106 - DNA, 17 bp, Homo sapiens
acactgtttcaaacttt

SEQ ID NO: 2214107 - DNA, 18 bp, Homo sapiens
acactgtttcaaacttta

SEQ ID NO: 2214108 - DNA, 20 bp, Homo sapiens
acactgtttcaaactttact

SEQ ID NO: 2214109 - DNA, 17 bp, Homo sapiens
acagaaatgtacagcaa

SEQ ID NO: 2214110 - DNA, 13 bp, Homo sapiens
acagacacaggcc

SEQ ID NO: 2214111 - DNA, 14 bp, Homo sapiens
acagaccctgccct

SEQ ID NO: 2214112 - DNA, 15 bp, Homo sapiens
acagaccctgccctg

SEQ ID NO: 2214113 - DNA, 16 bp, Homo sapiens
acagaccctgccctgt

SEQ ID NO: 2214114 - DNA, 14 bp, Homo sapiens
acagactggaagca

SEQ ID NO: 2214115 - DNA, 21 bp, Homo sapiens
acagactggaagcacagcttc

SEQ ID NO: 2214116 - DNA, 21 bp, Homo sapiens
acagagcaagtgagaccctgt

SEQ ID NO: 2214117 - DNA, 19 bp, Homo sapiens
acagagcccacgcccccac

SEQ ID NO: 2214118 - DNA, 13 bp, Homo sapiens
acagaggcagccc

SEQ ID NO: 2214119 - DNA, 15 bp, Homo sapiens
acagaggcagcccca

SEQ ID NO: 2214120 - DNA, 18 bp, Homo sapiens
acagagggggtggcctcc

SEQ ID NO: 2214121 - DNA, 21 bp, Homo sapiens
acagagggggtggcctcccaa

SEQ ID NO: 2214122 - DNA, 22 bp, Homo sapiens
acagagggggtggcctcccaac

SEQ ID NO: 2214123 - DNA, 19 bp, Homo sapiens
acagagtctcactgttgcc

SEQ ID NO: 2214124 - DNA, 19 bp, Homo sapiens
acagagtgagactctgtct

SEQ ID NO: 2214125 - DNA, 12 bp, Homo sapiens
acagcacaggca

SEQ ID NO: 2214126 - DNA, 15 bp, Homo sapiens
acagccacggccagg

SEQ ID NO: 2214127 - DNA, 16 bp, Homo sapiens
acagccacggccaggc

SEQ ID NO: 2214128 - DNA, 15 bp, Homo sapiens
acagcccgggctctg

SEQ ID NO: 2214129 - DNA, 19 bp, Homo sapiens
acagcccgggctctgcctc

SEQ ID NO: 2214130 - DNA, 23 bp, Homo sapiens
acagcccgggctctgcctcccat

SEQ ID NO: 2214131 - DNA, 18 bp, Homo sapiens
acagctccttctgtccta

SEQ ID NO: 2214132 - DNA, 23 bp, Homo sapiens
acagctccttctgtcctactctg

SEQ ID NO: 2214133 - DNA, 16 bp, Homo sapiens
acagctctgtcctggg

SEQ ID NO: 2214134 - DNA, 17 bp, Homo sapiens
acagctctgtcctggga

SEQ ID NO: 2214135 - DNA, 19 bp, Homo sapiens
acagctcttctccaggctg

SEQ ID NO: 2214136 - DNA, 20 bp, Homo sapiens
acagctcttctccaggctgt

SEQ ID NO: 2214137 - DNA, 23 bp, Homo sapiens
acagctgcctgggatccctcatc

SEQ ID NO: 2214138 - DNA, 17 bp, Homo sapiens
acagcttcatttcctgt

SEQ ID NO: 2214139 - DNA, 22 bp, Homo sapiens
acagcttgaccgtgaggccaga

SEQ ID NO: 2214140 - DNA, 20 bp, Homo sapiens
acaggaaaagctgctgacag

SEQ ID NO: 2214141 - DNA, 15 bp, Homo sapiens
acaggcaatgctggc

SEQ ID NO: 2214142 - DNA, 23 bp, Homo sapiens
acaggcaatgctggctgttggct

SEQ ID NO: 2214143 - DNA, 23 bp, Homo sapiens
acaggcacccaccatcatgtctg

SEQ ID NO: 2214144 - DNA, 14 bp, Homo sapiens
acaggcatgttctc

SEQ ID NO: 2214145 - DNA, 17 bp, Homo sapiens
acaggcccggctccagg

SEQ ID NO: 2214146 - DNA, 21 bp, Homo sapiens
acaggcccggctccaggctcc

SEQ ID NO: 2214147 - DNA, 22 bp, Homo sapiens
acaggcccggctccaggctcct

SEQ ID NO: 2214148 - DNA, 17 bp, Homo sapiens
acaggctgggcttcagt

SEQ ID NO: 2214149 - DNA, 12 bp, Homo sapiens
acagggcacacc

SEQ ID NO: 2214150 - DNA, 21 bp, Homo sapiens
acagggtgagcactctggggt

SEQ ID NO: 2214151 - DNA, 19 bp, Homo sapiens
acagggttttgccatgttg

SEQ ID NO: 2214152 - DNA, 23 bp, Homo sapiens
acaggtgtgaaccaccacaccca

SEQ ID NO: 2214153 - DNA, 22 bp, Homo sapiens
acaggttttcctgaagaattga

SEQ ID NO: 2214154 - DNA, 21 bp, Homo sapiens
gactcctgcaggcagccaggc

SEQ ID NO: 2214155 - DNA, 13 bp, Homo sapiens
gactcgcgacaat

SEQ ID NO: 2214156 - DNA, 15 bp, Homo sapiens
gactctacagaggcc

SEQ ID NO: 2214157 - DNA, 14 bp, Homo sapiens
gactgaatttcttt

SEQ ID NO: 2214158 - DNA, 21 bp, Homo sapiens
gactgagtacgttgtgcattt

SEQ ID NO: 2214159 - DNA, 13 bp, Homo sapiens
gactgcccggcag

SEQ ID NO: 2214160 - DNA, 16 bp, Homo sapiens
gactggaagcacagct

SEQ ID NO: 2214161 - DNA, 15 bp, Homo sapiens
gacttactgtacatg

SEQ ID NO: 2214162 - DNA, 18 bp, Homo sapiens
gacttactgtacatgaaa

SEQ ID NO: 2214163 - DNA, 12 bp, Homo sapiens
gacttcatccct

SEQ ID NO: 2214164 - DNA, 15 bp, Homo sapiens
gacttggaagctccg

SEQ ID NO: 2214165 - DNA, 16 bp, Homo sapiens
gacttggaagctccgc

SEQ ID NO: 2214166 - DNA, 22 bp, Homo sapiens
gactttgttagtttctccaagc

SEQ ID NO: 2214167 - DNA, 19 bp, Homo sapiens
gacttttccaaccctcatc

SEQ ID NO: 2214168 - DNA, 15 bp, Homo sapiens
gagaaagagagagag

SEQ ID NO: 2214169 - DNA, 15 bp, Homo sapiens
gagaagcggctggca

SEQ ID NO: 2214170 - DNA, 20 bp, Homo sapiens
gagaaggggcccaagagaga

SEQ ID NO: 2214171 - DNA, 20 bp, Homo sapiens
gagaatgcacaaacagaggc

SEQ ID NO: 2214172 - DNA, 17 bp, Homo sapiens
gagacacaagccttcgg

SEQ ID NO: 2214173 - DNA, 13 bp, Homo sapiens
gagacagcacagg

SEQ ID NO: 2214174 - DNA, 22 bp, Homo sapiens
gagacagcacaggcagccccac

SEQ ID NO: 2214175 - DNA, 17 bp, Homo sapiens
gagacagcccgggctct

SEQ ID NO: 2214176 - DNA, 18 bp, Homo sapiens
gagacagcccgggctctg

SEQ ID NO: 2214177 - DNA, 24 bp, Homo sapiens
gagacagcccgggctctgcctccc

SEQ ID NO: 2214178 - DNA, 19 bp, Homo sapiens
gagacggagtcccaccttg

SEQ ID NO: 2214179 - DNA, 13 bp, Homo sapiens
gagactcctgcag

SEQ ID NO: 2214180 - DNA, 14 bp, Homo sapiens
gagactcctgcagg

SEQ ID NO: 2214181 - DNA, 15 bp, Homo sapiens
gagactcctgcaggc

SEQ ID NO: 2214182 - DNA, 16 bp, Homo sapiens
gagactcctgcaggca

SEQ ID NO: 2214183 - DNA, 16 bp, Homo sapiens
gagactcgcgacaatg

SEQ ID NO: 2214184 - DNA, 20 bp, Homo sapiens
gagactcgcgacaatgcaaa

SEQ ID NO: 2214185 - DNA, 13 bp, Homo sapiens
gagactctgtctc

SEQ ID NO: 2214186 - DNA, 14 bp, Homo sapiens
gagactctgtctca

SEQ ID NO: 2214187 - DNA, 17 bp, Homo sapiens
gagagaagagaatgcac

SEQ ID NO: 2214188 - DNA, 9 bp, Homo sapiens
gagagaagg

SEQ ID NO: 2214189 - DNA, 21 bp, Homo sapiens
gagagaaggggcccaagagag

SEQ ID NO: 2214190 - DNA, 14 bp, Homo sapiens
gagagagaaagaga

SEQ ID NO: 2214191 - DNA, 10 bp, Homo sapiens
gagagagaag

SEQ ID NO: 2214192 - DNA, 13 bp, Homo sapiens
gagagagagaaag

SEQ ID NO: 2214193 - DNA, 16 bp, Homo sapiens
gagagagagagaaaga

SEQ ID NO: 2214194 - DNA, 15 bp, Homo sapiens
gagagccttccaggg

SEQ ID NO: 2214195 - DNA, 12 bp, Homo sapiens
gagaggaaatca

SEQ ID NO: 2214196 - DNA, 18 bp, Homo sapiens
gagaggggaacagactgg

SEQ ID NO: 2214197 - DNA, 20 bp, Homo sapiens
gagatcaaccccttcgctcc

SEQ ID NO: 2214198 - DNA, 13 bp, Homo sapiens
gagatcagcctgg

SEQ ID NO: 2214199 - DNA, 16 bp, Homo sapiens
gagatcagcctgggca

SEQ ID NO: 2214200 - DNA, 13 bp, Homo sapiens
gagatgtgccccc

SEQ ID NO: 2214201 - DNA, 18 bp, Homo sapiens
gagattgcaccactgcac

SEQ ID NO: 2214202 - DNA, 13 bp, Homo sapiens
gagatttacaact

SEQ ID NO: 2214203 - DNA, 19 bp, Homo sapiens
gagcaccttagacagtccc

SEQ ID NO: 2214204 - DNA, 20 bp, Homo sapiens
gagcaccttagacagtccct

SEQ ID NO: 2214205 - DNA, 21 bp, Homo sapiens
gagcaccttagacagtccctg

SEQ ID NO: 2214206 - DNA, 22 bp, Homo sapiens
gagcaccttagacagtccctgc

SEQ ID NO: 2214207 - DNA, 15 bp, Homo sapiens
gagcactaaggtgtg

SEQ ID NO: 2214208 - DNA, 21 bp, Homo sapiens
gagcactaaggtgtgctctga

SEQ ID NO: 2214209 - DNA, 15 bp, Homo sapiens
gagcactctggggtg

SEQ ID NO: 2214210 - DNA, 21 bp, Homo sapiens
gagcactctggggtgggaggg

SEQ ID NO: 2214211 - DNA, 16 bp, Homo sapiens
gagcagagaattctct

SEQ ID NO: 2214212 - DNA, 16 bp, Homo sapiens
gagcagagaccatccc

SEQ ID NO: 2214213 - DNA, 23 bp, Homo sapiens
gagcagagaccatccctgaaggc

SEQ ID NO: 2214214 - DNA, 21 bp, Homo sapiens
gagcagccacattcctgatgc

SEQ ID NO: 2214215 - DNA, 14 bp, Homo sapiens
gagcaggcagtggg

SEQ ID NO: 2214216 - DNA, 14 bp, Homo sapiens
gagcagggctcagc

SEQ ID NO: 2214217 - DNA, 12 bp, Homo sapiens
gagcatcaggcc

SEQ ID NO: 2214218 - DNA, 13 bp, Homo sapiens
gagcatcaggcca

SEQ ID NO: 2214219 - DNA, 20 bp, Homo sapiens
gagccactgcaccgggccac

SEQ ID NO: 2214220 - DNA, 22 bp, Homo sapiens
gagccactgcaccgggccacag

SEQ ID NO: 2214221 - DNA, 13 bp, Homo sapiens
gagccagatttca

SEQ ID NO: 2214222 - DNA, 15 bp, Homo sapiens
gagcccaccttggct

SEQ ID NO: 2214223 - DNA, 17 bp, Homo sapiens
gagcccaccttggctca

SEQ ID NO: 2214224 - DNA, 15 bp, Homo sapiens
gagcccacgccccca

SEQ ID NO: 2214225 - DNA, 13 bp, Homo sapiens
gagcccaggcctc

SEQ ID NO: 2214226 - DNA, 13 bp, Homo sapiens
gagccccgaggcc

SEQ ID NO: 2214227 - DNA, 15 bp, Homo sapiens
gagccctggtggcag

SEQ ID NO: 2214228 - DNA, 16 bp, Homo sapiens
gagccctggtggcagt

SEQ ID NO: 2214229 - DNA, 18 bp, Homo sapiens
gagccctggtggcagtgg

SEQ ID NO: 2214230 - DNA, 19 bp, Homo sapiens
gagccgagatcacgccact

SEQ ID NO: 2214231 - DNA, 20 bp, Homo sapiens
gagccgagatcacgccactg

SEQ ID NO: 2214232 - DNA, 13 bp, Homo sapiens
gagcctcagcatc

SEQ ID NO: 2214233 - DNA, 15 bp, Homo sapiens
gagcctcagcatcct

SEQ ID NO: 2214234 - DNA, 17 bp, Homo sapiens
gagcctcagcatcctgg

SEQ ID NO: 2214235 - DNA, 13 bp, Homo sapiens
gagcctcctgccc

SEQ ID NO: 2214236 - DNA, 20 bp, Homo sapiens
gagcctcctgcccttacctg

SEQ ID NO: 2214237 - DNA, 22 bp, Homo sapiens
gagcctcctgcccttacctgcc

SEQ ID NO: 2214238 - DNA, 15 bp, Homo sapiens
gagcctggcaagaat

SEQ ID NO: 2214239 - DNA, 15 bp, Homo sapiens
gagccttccaggggt

SEQ ID NO: 2214240 - DNA, 22 bp, Homo sapiens
gagccttgaactttgacctctg

SEQ ID NO: 2214241 - DNA, 18 bp, Homo sapiens
gagcggagaaaggaaggg

SEQ ID NO: 2214242 - DNA, 20 bp, Homo sapiens
gagctgcctgttcagctcca

SEQ ID NO: 2214243 - DNA, 20 bp, Homo sapiens
gagctttgaaaattcagtgg

SEQ ID NO: 2214244 - DNA, 16 bp, Homo sapiens
gaggaacaaggcaagg

SEQ ID NO: 2214245 - DNA, 13 bp, Homo sapiens
gaggaagccgctg

SEQ ID NO: 2214246 - DNA, 14 bp, Homo sapiens
gaggaagccgctgg

SEQ ID NO: 2214247 - DNA, 20 bp, Homo sapiens
gaggaaggaaacccagctct

SEQ ID NO: 2214248 - DNA, 13 bp, Homo sapiens
gaggaggggtgtg

SEQ ID NO: 2214249 - DNA, 23 bp, Homo sapiens
gaggagtttggggtatgggagag

SEQ ID NO: 2214250 - DNA, 13 bp, Homo sapiens
gaggatctcttga

SEQ ID NO: 2214251 - DNA, 20 bp, Homo sapiens
gaggatgttctgggacacag

SEQ ID NO: 2214252 - DNA, 20 bp, Homo sapiens
gaggattgcttgagctcagg

SEQ ID NO: 2214253 - DNA, 19 bp, Homo sapiens
gaggcagccccattctgcc

SEQ ID NO: 2214254 - DNA, 18 bp, Homo sapiens
gaggcagggtctcactct

SEQ ID NO: 2214255 - DNA, 20 bp, Homo sapiens
gaggcagggtctcactctgt

SEQ ID NO: 2214256 - DNA, 19 bp, Homo sapiens
gaggcatttgtttgaactg

SEQ ID NO: 2214257 - DNA, 22 bp, Homo sapiens
gaggccaaggtgggaggattgc

SEQ ID NO: 2214258 - DNA, 14 bp, Homo sapiens
gaggccagagacac

SEQ ID NO: 2214259 - DNA, 19 bp, Homo sapiens
gaggccagagacacaagcc

SEQ ID NO: 2214260 - DNA, 18 bp, Homo sapiens
gaggccatgggcctcctg

SEQ ID NO: 2214261 - DNA, 14 bp, Homo sapiens
gaggcccagagggc

SEQ ID NO: 2214262 - DNA, 16 bp, Homo sapiens
gaggcccagagggcct

SEQ ID NO: 2214263 - DNA, 14 bp, Homo sapiens
gaggcccttctctc

SEQ ID NO: 2214264 - DNA, 15 bp, Homo sapiens
gaggcccttctctcc

SEQ ID NO: 2214265 - DNA, 18 bp, Homo sapiens
gaggccttctctgaagga

SEQ ID NO: 2214266 - DNA, 19 bp, Homo sapiens
gaggccttctctgaaggac

SEQ ID NO: 2214267 - DNA, 14 bp, Homo sapiens
gaggctgggctccc

SEQ ID NO: 2214268 - DNA, 15 bp, Homo sapiens
gaggctgggctccct

SEQ ID NO: 2214269 - DNA, 16 bp, Homo sapiens
gaggctgggctccctt

SEQ ID NO: 2214270 - DNA, 16 bp, Homo sapiens
gagggagtgacagagg

SEQ ID NO: 2214271 - DNA, 15 bp, Homo sapiens
gagggccccacgtcc

SEQ ID NO: 2214272 - DNA, 14 bp, Homo sapiens
gagggctccagaca

SEQ ID NO: 2214273 - DNA, 12 bp, Homo sapiens
gaggggcctctt

SEQ ID NO: 2214274 - DNA, 21 bp, Homo sapiens
gagggtgaagtgaagacaatg

SEQ ID NO: 2214275 - DNA, 12 bp, Homo sapiens
gagggtggaata

SEQ ID NO: 2214276 - DNA, 15 bp, Homo sapiens
gagggtgggagtggg

SEQ ID NO: 2214277 - DNA, 15 bp, Homo sapiens
gagggttgggctggt

SEQ ID NO: 2214278 - DNA, 24 bp, Homo sapiens
gaggtaaggaatacctgtccccct

SEQ ID NO: 2214279 - DNA, 12 bp, Homo sapiens
gaggtcagagcc

SEQ ID NO: 2214280 - DNA, 13 bp, Homo sapiens
gaggtctgttctt

SEQ ID NO: 2214281 - DNA, 12 bp, Homo sapiens
gaggtgggatcc

SEQ ID NO: 2214282 - DNA, 14 bp, Homo sapiens
gaggttccctttga

SEQ ID NO: 2214283 - DNA, 16 bp, Homo sapiens
gaggtttcaaacctcc

SEQ ID NO: 2214284 - DNA, 19 bp, Homo sapiens
gaggttttaaaaaaatccc

SEQ ID NO: 2214285 - DNA, 15 bp, Homo sapiens
gagtactacagtcct

SEQ ID NO: 2214286 - DNA, 19 bp, Homo sapiens
gagtactacagtcctccca

SEQ ID NO: 2214287 - DNA, 21 bp, Homo sapiens
gagtactacagtcctcccatc

SEQ ID NO: 2214288 - DNA, 13 bp, Homo sapiens
gagtaggaagact

SEQ ID NO: 2214289 - DNA, 19 bp, Homo sapiens
gagtaggaagactttggaa

SEQ ID NO: 2214290 - DNA, 11 bp, Homo sapiens
gagtatatgtc

SEQ ID NO: 2214291 - DNA, 17 bp, Homo sapiens
gagtcaccaagcccagt

SEQ ID NO: 2214292 - DNA, 12 bp, Homo sapiens
gagtcccacctt

SEQ ID NO: 2214293 - DNA, 20 bp, Homo sapiens
gagtcccaccttggctgcag

SEQ ID NO: 2214294 - DNA, 13 bp, Homo sapiens
cttggattgtccc

SEQ ID NO: 2214295 - DNA, 14 bp, Homo sapiens
cttggcgctgcccc

SEQ ID NO: 2214296 - DNA, 23 bp, Homo sapiens
cttggctcaagtcctcttttctg

SEQ ID NO: 2214297 - DNA, 12 bp, Homo sapiens
cttggctgcagg

SEQ ID NO: 2214298 - DNA, 13 bp, Homo sapiens
cttggctgcaggg

SEQ ID NO: 2214299 - DNA, 14 bp, Homo sapiens
cttggctgcaggga

SEQ ID NO: 2214300 - DNA, 13 bp, Homo sapiens
cttgggcttcatc

SEQ ID NO: 2214301 - DNA, 22 bp, Homo sapiens
cttgggcttcatcctcctcaga

SEQ ID NO: 2214302 - DNA, 19 bp, Homo sapiens
cttggggaccagagctgcc

SEQ ID NO: 2214303 - DNA, 20 bp, Homo sapiens
cttggggaccagagctgcca

SEQ ID NO: 2214304 - DNA, 16 bp, Homo sapiens
cttggggggctgaggt

SEQ ID NO: 2214305 - DNA, 22 bp, Homo sapiens
cttggtagaagcccttctacct

SEQ ID NO: 2214306 - DNA, 15 bp, Homo sapiens
cttggtcctgctgca

SEQ ID NO: 2214307 - DNA, 22 bp, Homo sapiens
cttggtcctgctgcagttgcca

SEQ ID NO: 2214308 - DNA, 16 bp, Homo sapiens
cttggttcccatttgc

SEQ ID NO: 2214309 - DNA, 15 bp, Homo sapiens
cttggtttgtaaatt

SEQ ID NO: 2214310 - DNA, 16 bp, Homo sapiens
cttgtaaatagctcag

SEQ ID NO: 2214311 - DNA, 18 bp, Homo sapiens
cttgtaaatagctcaggt

SEQ ID NO: 2214312 - DNA, 21 bp, Homo sapiens
cttgtaaatagctcaggtgtc

SEQ ID NO: 2214313 - DNA, 22 bp, Homo sapiens
cttgtacataatgcgtgcatac

SEQ ID NO: 2214314 - DNA, 15 bp, Homo sapiens
cttgtctttggaccc

SEQ ID NO: 2214315 - DNA, 21 bp, Homo sapiens
cttgtctttggaccctgaggc

SEQ ID NO: 2214316 - DNA, 14 bp, Homo sapiens
cttgtggacacagc

SEQ ID NO: 2214317 - DNA, 15 bp, Homo sapiens
cttgtggacacagct

SEQ ID NO: 2214318 - DNA, 17 bp, Homo sapiens
cttgtggacacagctct

SEQ ID NO: 2214319 - DNA, 17 bp, Homo sapiens
ctttaatgtcacaggca

SEQ ID NO: 2214320 - DNA, 17 bp, Homo sapiens
ctttaccttttttatac

SEQ ID NO: 2214321 - DNA, 13 bp, Homo sapiens
ctttataattcta

SEQ ID NO: 2214322 - DNA, 17 bp, Homo sapiens
ctttcaataggaaaaac

SEQ ID NO: 2214323 - DNA, 21 bp, Homo sapiens
ctttcaataggaaaaactgat

SEQ ID NO: 2214324 - DNA, 15 bp, Homo sapiens
ctttcacccttttct

SEQ ID NO: 2214325 - DNA, 20 bp, Homo sapiens
ctttcagccaagaattctta

SEQ ID NO: 2214326 - DNA, 16 bp, Homo sapiens
ctttccaaatgcccag

SEQ ID NO: 2214327 - DNA, 15 bp, Homo sapiens
ctttccaggaaggct

SEQ ID NO: 2214328 - DNA, 15 bp, Homo sapiens
ctttccatctaccct

SEQ ID NO: 2214329 - DNA, 16 bp, Homo sapiens
ctttcccatcttccaa

SEQ ID NO: 2214330 - DNA, 14 bp, Homo sapiens
ctttccctcccttc

SEQ ID NO: 2214331 - DNA, 16 bp, Homo sapiens
ctttcctctttggtct

SEQ ID NO: 2214332 - DNA, 12 bp, Homo sapiens
ctttcctgaggc

SEQ ID NO: 2214333 - DNA, 15 bp, Homo sapiens
ctttcctgaggctgg

SEQ ID NO: 2214334 - DNA, 16 bp, Homo sapiens
ctttctacccagcgag

SEQ ID NO: 2214335 - DNA, 18 bp, Homo sapiens
ctttctggctatgcattt

SEQ ID NO: 2214336 - DNA, 22 bp, Homo sapiens
ctttgacgccatcccagcccca

SEQ ID NO: 2214337 - DNA, 14 bp, Homo sapiens
ctttgcagacaggc

SEQ ID NO: 2214338 - DNA, 19 bp, Homo sapiens
ctttggctattagagatca

SEQ ID NO: 2214339 - DNA, 16 bp, Homo sapiens
ctttggtctacactgt

SEQ ID NO: 2214340 - DNA, 22 bp, Homo sapiens
ctttgtattctctcctgtacct

SEQ ID NO: 2214341 - DNA, 17 bp, Homo sapiens
ctttgtgatttttgtaa

SEQ ID NO: 2214342 - DNA, 18 bp, Homo sapiens
ctttgttagtttctccaa

SEQ ID NO: 2214343 - DNA, 18 bp, Homo sapiens
ctttgtttgttgtcagct

SEQ ID NO: 2214344 - DNA, 18 bp, Homo sapiens
cttttataaactttacct

SEQ ID NO: 2214345 - DNA, 21 bp, Homo sapiens
cttttataaactttacctttt

SEQ ID NO: 2214346 - DNA, 22 bp, Homo sapiens
cttttcatttaggtgaggaagc

SEQ ID NO: 2214347 - DNA, 21 bp, Homo sapiens
cttttcgcaggattcttcctc

SEQ ID NO: 2214348 - DNA, 23 bp, Homo sapiens
cttttctgtccgagctttgaaaa

SEQ ID NO: 2214349 - DNA, 15 bp, Homo sapiens
cttttctgtttgcta

SEQ ID NO: 2214350 - DNA, 23 bp, Homo sapiens
cttttcttgcatgaggctagtgt

SEQ ID NO: 2214351 - DNA, 17 bp, Homo sapiens
cttttgtctatgggact

SEQ ID NO: 2214352 - DNA, 20 bp, Homo sapiens
cttttgttcttggtttgtaa

SEQ ID NO: 2214353 - DNA, 19 bp, Homo sapiens
cttttttcggctaaaaaga

SEQ ID NO: 2214354 - DNA, 23 bp, Homo sapiens
cttttttggctgctgaaggctcg

SEQ ID NO: 2214355 - DNA, 13 bp, Homo sapiens
gaaaaaaaaaggg

SEQ ID NO: 2214356 - DNA, 16 bp, Homo sapiens
gaaaaagaaaaaatat

SEQ ID NO: 2214357 - DNA, 18 bp, Homo sapiens
gaaaacactgttctctgc

SEQ ID NO: 2214358 - DNA, 14 bp, Homo sapiens
gaaaacatgctaca

SEQ ID NO: 2214359 - DNA, 14 bp, Homo sapiens
gaaaacgtggctgc

SEQ ID NO: 2214360 - DNA, 15 bp, Homo sapiens
gaaaacgtggctgct

SEQ ID NO: 2214361 - DNA, 13 bp, Homo sapiens
gaaaagctgctga

SEQ ID NO: 2214362 - DNA, 21 bp, Homo sapiens
gaaacaaaatgaaaaaaaaag

SEQ ID NO: 2214363 - DNA, 11 bp, Homo sapiens
gaaagagagag

SEQ ID NO: 2214364 - DNA, 13 bp, Homo sapiens
gaaagagagagag

SEQ ID NO: 2214365 - DNA, 15 bp, Homo sapiens
gaaagagtaggaaga

SEQ ID NO: 2214366 - DNA, 12 bp, Homo sapiens
gaaaggctccag

SEQ ID NO: 2214367 - DNA, 18 bp, Homo sapiens
gaaaggctccaggagcag

SEQ ID NO: 2214368 - DNA, 20 bp, Homo sapiens
gaaaggctccaggagcagcc

SEQ ID NO: 2214369 - DNA, 22 bp, Homo sapiens
gaaaggctccaggagcagccac

SEQ ID NO: 2214370 - DNA, 19 bp, Homo sapiens
gaaagggacttggaagctc

SEQ ID NO: 2214371 - DNA, 22 bp, Homo sapiens
gaaagggacttggaagctccgc

SEQ ID NO: 2214372 - DNA, 13 bp, Homo sapiens
gaaagggcccaga

SEQ ID NO: 2214373 - DNA, 17 bp, Homo sapiens
gaaatcaccgaaaacgt

SEQ ID NO: 2214374 - DNA, 17 bp, Homo sapiens
gaaatgggcagagcaga

SEQ ID NO: 2214375 - DNA, 18 bp, Homo sapiens
gaaatttttattaaatta

SEQ ID NO: 2214376 - DNA, 17 bp, Homo sapiens
gaacaaggcaaggctgt

SEQ ID NO: 2214377 - DNA, 16 bp, Homo sapiens
gaacactccttcacag

SEQ ID NO: 2214378 - DNA, 15 bp, Homo sapiens
gaacactctgagact

SEQ ID NO: 2214379 - DNA, 20 bp, Homo sapiens
gaacagactggaagcacagc

SEQ ID NO: 2214380 - DNA, 16 bp, Homo sapiens
gaaccaccacacccag

SEQ ID NO: 2214381 - DNA, 18 bp, Homo sapiens
gaaccaccacacccagcc

SEQ ID NO: 2214382 - DNA, 23 bp, Homo sapiens
gaaccaccacacccagcccactt

SEQ ID NO: 2214383 - DNA, 16 bp, Homo sapiens
gaaccgtgaggagggg

SEQ ID NO: 2214384 - DNA, 12 bp, Homo sapiens
gaactggctgca

SEQ ID NO: 2214385 - DNA, 13 bp, Homo sapiens
gaacttggcgctg

SEQ ID NO: 2214386 - DNA, 17 bp, Homo sapiens
gaacttggcgctgcccc

SEQ ID NO: 2214387 - DNA, 17 bp, Homo sapiens
gaacttgggccactgtg

SEQ ID NO: 2214388 - DNA, 22 bp, Homo sapiens
gaactttgacctctgcagcaat

SEQ ID NO: 2214389 - DNA, 13 bp, Homo sapiens
gaagaaaaactct

SEQ ID NO: 2214390 - DNA, 13 bp, Homo sapiens
gaagacagagcta

SEQ ID NO: 2214391 - DNA, 15 bp, Homo sapiens
gaagacagctcttat

SEQ ID NO: 2214392 - DNA, 12 bp, Homo sapiens
cctgcctcagcc

SEQ ID NO: 2214393 - DNA, 13 bp, Homo sapiens
cctgcctcagcct

SEQ ID NO: 2214394 - DNA, 19 bp, Homo sapiens
cctgcctcctttgtgagga

SEQ ID NO: 2214395 - DNA, 21 bp, Homo sapiens
cctgcctcctttgtgaggaag

SEQ ID NO: 2214396 - DNA, 21 bp, Homo sapiens
cctgcctcgaactggctgcaa

SEQ ID NO: 2214397 - DNA, 14 bp, Homo sapiens
cctgcctgttgggc

SEQ ID NO: 2214398 - DNA, 16 bp, Homo sapiens
cctgcggtgctatctc

SEQ ID NO: 2214399 - DNA, 23 bp, Homo sapiens
cctgcgtctcatactcacctcac

SEQ ID NO: 2214400 - DNA, 17 bp, Homo sapiens
cctgctaattccccaga

SEQ ID NO: 2214401 - DNA, 12 bp, Homo sapiens
cctgctccagct

SEQ ID NO: 2214402 - DNA, 14 bp, Homo sapiens
cctgctccagctgt

SEQ ID NO: 2214403 - DNA, 11 bp, Homo sapiens
cctgctgcagt

SEQ ID NO: 2214404 - DNA, 20 bp, Homo sapiens
cctgctgcagttgccagtca

SEQ ID NO: 2214405 - DNA, 12 bp, Homo sapiens
cctgctgggtgt

SEQ ID NO: 2214406 - DNA, 20 bp, Homo sapiens
cctgctgggtgtggcgcagc

SEQ ID NO: 2214407 - DNA, 13 bp, Homo sapiens
cctggaccctgtg

SEQ ID NO: 2214408 - DNA, 15 bp, Homo sapiens
cctggagttctggtt

SEQ ID NO: 2214409 - DNA, 14 bp, Homo sapiens
cctggatgcagcct

SEQ ID NO: 2214410 - DNA, 17 bp, Homo sapiens
cctggatggggctgcac

SEQ ID NO: 2214411 - DNA, 20 bp, Homo sapiens
cctggcacccggcccctgct

SEQ ID NO: 2214412 - DNA, 23 bp, Homo sapiens
cctggcatgggaatgaatgtcag

SEQ ID NO: 2214413 - DNA, 20 bp, Homo sapiens
cctggccagatgcaccagcc

SEQ ID NO: 2214414 - DNA, 14 bp, Homo sapiens
cctggcccctcagg

SEQ ID NO: 2214415 - DNA, 16 bp, Homo sapiens
cctggcccctcagggt

SEQ ID NO: 2214416 - DNA, 18 bp, Homo sapiens
cctggcccctcagggtcc

SEQ ID NO: 2214417 - DNA, 21 bp, Homo sapiens
cctggcccctcagggtccctg

SEQ ID NO: 2214418 - DNA, 22 bp, Homo sapiens
cctggcctagcatacgtacaca

SEQ ID NO: 2214419 - DNA, 14 bp, Homo sapiens
cctggcctctgcac

SEQ ID NO: 2214420 - DNA, 21 bp, Homo sapiens
cctggcctctgcactcccctg

SEQ ID NO: 2214421 - DNA, 13 bp, Homo sapiens
cctggcctgagct

SEQ ID NO: 2214422 - DNA, 20 bp, Homo sapiens
cctggcctgagctgggatga

SEQ ID NO: 2214423 - DNA, 20 bp, Homo sapiens
cctgggaggtcaaggctgca

SEQ ID NO: 2214424 - DNA, 18 bp, Homo sapiens
cctgggagtgagctggtt

SEQ ID NO: 2214425 - DNA, 12 bp, Homo sapiens
cctgggcagaag

SEQ ID NO: 2214426 - DNA, 14 bp, Homo sapiens
cctgggcagaagga

SEQ ID NO: 2214427 - DNA, 18 bp, Homo sapiens
cctgggggctgggcagag

SEQ ID NO: 2214428 - DNA, 21 bp, Homo sapiens
cctgggggctgggcagaggaa

SEQ ID NO: 2214429 - DNA, 20 bp, Homo sapiens
cctggtggaatgcgggggag

SEQ ID NO: 2214430 - DNA, 13 bp, Homo sapiens
cctggtggcagct

SEQ ID NO: 2214431 - DNA, 19 bp, Homo sapiens
cctggtggcagctcacctc

SEQ ID NO: 2214432 - DNA, 14 bp, Homo sapiens
cctggtggcagctg

SEQ ID NO: 2214433 - DNA, 15 bp, Homo sapiens
cctggtggcagctgc

SEQ ID NO: 2214434 - DNA, 18 bp, Homo sapiens
cctggtggcagctgcggt

SEQ ID NO: 2214435 - DNA, 13 bp, Homo sapiens
cctggtggcagtg

SEQ ID NO: 2214436 - DNA, 15 bp, Homo sapiens
cctggtggcagtggg

SEQ ID NO: 2214437 - DNA, 20 bp, Homo sapiens
cctggtggcagtgggagctg

SEQ ID NO: 2214438 - DNA, 10 bp, Homo sapiens
cctgtacctc

SEQ ID NO: 2214439 - DNA, 12 bp, Homo sapiens
cctgtacctctt

SEQ ID NO: 2214440 - DNA, 12 bp, Homo sapiens
cctgtccccctg

SEQ ID NO: 2214441 - DNA, 17 bp, Homo sapiens
cctgtccccctgacaac

SEQ ID NO: 2214442 - DNA, 15 bp, Homo sapiens
cctgtctaatgaaac

SEQ ID NO: 2214443 - DNA, 22 bp, Homo sapiens
cctgtctaatgaaacctgtgtc

SEQ ID NO: 2214444 - DNA, 21 bp, Homo sapiens
cctgtgtgtgcgcctacagga

SEQ ID NO: 2214445 - DNA, 15 bp, Homo sapiens
cctgttcagctccag

SEQ ID NO: 2214446 - DNA, 21 bp, Homo sapiens
cctgttcagctccagctcacc

SEQ ID NO: 2214447 - DNA, 23 bp, Homo sapiens
cctgttcagctccagctcaccag

SEQ ID NO: 2214448 - DNA, 16 bp, Homo sapiens
cctgttgggccaggag

SEQ ID NO: 2214449 - DNA, 17 bp, Homo sapiens
cctgttgggccaggagc

SEQ ID NO: 2214450 - DNA, 19 bp, Homo sapiens
cctgttgggccaggagcct

SEQ ID NO: 2214451 - DNA, 16 bp, Homo sapiens
cctgtttctgcagcca

SEQ ID NO: 2214452 - DNA, 18 bp, Homo sapiens
cctgtttgtttctgaaag

SEQ ID NO: 2214453 - DNA, 14 bp, Homo sapiens
ccttaccagcagag

SEQ ID NO: 2214454 - DNA, 15 bp, Homo sapiens
ccttaccagcagagc

SEQ ID NO: 2214455 - DNA, 17 bp, Homo sapiens
ccttagaagtcacacag

SEQ ID NO: 2214456 - DNA, 18 bp, Homo sapiens
ccttagacagtccctgcc

SEQ ID NO: 2214457 - DNA, 12 bp, Homo sapiens
ccttatggaaca

SEQ ID NO: 2214458 - DNA, 16 bp, Homo sapiens
ccttatggaacactct

SEQ ID NO: 2214459 - DNA, 20 bp, Homo sapiens
ccttatggaacactctgaga

SEQ ID NO: 2214460 - DNA, 12 bp, Homo sapiens
ccttcagtgcct

SEQ ID NO: 2214461 - DNA, 13 bp, Homo sapiens
ccttcagtgcctt

SEQ ID NO: 2214462 - DNA, 13 bp, Homo sapiens
ccttccaggggtg

SEQ ID NO: 2214463 - DNA, 15 bp, Homo sapiens
ccttccaggggtggg

SEQ ID NO: 2214464 - DNA, 14 bp, Homo sapiens
ccttcccacctctc

SEQ ID NO: 2214465 - DNA, 15 bp, Homo sapiens
ccttcggcgccttaa

SEQ ID NO: 2214466 - DNA, 12 bp, Homo sapiens
ccttctctccag

SEQ ID NO: 2214467 - DNA, 23 bp, Homo sapiens
ccttctctccagcccctggatgc

SEQ ID NO: 2214468 - DNA, 16 bp, Homo sapiens
ccttctctgaaggaca

SEQ ID NO: 2214469 - DNA, 12 bp, Homo sapiens
ccttctgaccca

SEQ ID NO: 2214470 - DNA, 23 bp, Homo sapiens
ccttctgacccatgctgccctgt

SEQ ID NO: 2214471 - DNA, 20 bp, Homo sapiens
ccttctgtcctactctgtgt

SEQ ID NO: 2214472 - DNA, 14 bp, Homo sapiens
ccttgaactgggta

SEQ ID NO: 2214473 - DNA, 16 bp, Homo sapiens
ccttgaactgggtact

SEQ ID NO: 2214474 - DNA, 23 bp, Homo sapiens
ccttgaccattctccacctgcca

SEQ ID NO: 2214475 - DNA, 20 bp, Homo sapiens
ccttgagttgattcagctct

SEQ ID NO: 2214476 - DNA, 12 bp, Homo sapiens
ccttggctgcag

SEQ ID NO: 2214477 - DNA, 15 bp, Homo sapiens
ctacaggcacccacc

SEQ ID NO: 2214478 - DNA, 17 bp, Homo sapiens
ctacaggcacccaccat

SEQ ID NO: 2214479 - DNA, 19 bp, Homo sapiens
ctacagtcctcccatctca

SEQ ID NO: 2214480 - DNA, 18 bp, Homo sapiens
ctacatggagtatatgtc

SEQ ID NO: 2214481 - DNA, 14 bp, Homo sapiens
ctacattctgttaa

SEQ ID NO: 2214482 - DNA, 18 bp, Homo sapiens
ctaccatcccctgtagag

SEQ ID NO: 2214483 - DNA, 15 bp, Homo sapiens
ctacccagcgagccc

SEQ ID NO: 2214484 - DNA, 18 bp, Homo sapiens
ctacccagcgagccctgg

SEQ ID NO: 2214485 - DNA, 11 bp, Homo sapiens
ctacctgaggg

SEQ ID NO: 2214486 - DNA, 14 bp, Homo sapiens
ctacctgaggggcc

SEQ ID NO: 2214487 - DNA, 23 bp, Homo sapiens
ctacctgaggggcctcttatggg

SEQ ID NO: 2214488 - DNA, 17 bp, Homo sapiens
ctacctttgtattctct

SEQ ID NO: 2214489 - DNA, 15 bp, Homo sapiens
ctactcgagttacag

SEQ ID NO: 2214490 - DNA, 13 bp, Homo sapiens
ctactctgtgtca

SEQ ID NO: 2214491 - DNA, 16 bp, Homo sapiens
ctactgtaatttgtga

SEQ ID NO: 2214492 - DNA, 21 bp, Homo sapiens
ctactgtaatttgtgatacaa

SEQ ID NO: 2214493 - DNA, 22 bp, Homo sapiens
ctagaagattttgaaattttta

SEQ ID NO: 2214494 - DNA, 21 bp, Homo sapiens
ctagagtgaacttgggccact

SEQ ID NO: 2214495 - DNA, 17 bp, Homo sapiens
ctagcactttgggaggc

SEQ ID NO: 2214496 - DNA, 12 bp, Homo sapiens
ctagcagcaggg

SEQ ID NO: 2214497 - DNA, 22 bp, Homo sapiens
ctagcagcagggagggcttctg

SEQ ID NO: 2214498 - DNA, 16 bp, Homo sapiens
ctagcatacgtacaca

SEQ ID NO: 2214499 - DNA, 15 bp, Homo sapiens
ctagccagaggagag

SEQ ID NO: 2214500 - DNA, 21 bp, Homo sapiens
ctagcctgtgcctctgggact

SEQ ID NO: 2214501 - DNA, 22 bp, Homo sapiens
ctaggacccctccatgtgggct

SEQ ID NO: 2214502 - DNA, 18 bp, Homo sapiens
ctaggcctggccagatgc

SEQ ID NO: 2214503 - DNA, 19 bp, Homo sapiens
ctagtgtggtgtttcctgg

SEQ ID NO: 2214504 - DNA, 21 bp, Homo sapiens
ctagtgtggtgtttcctggca

SEQ ID NO: 2214505 - DNA, 18 bp, Homo sapiens
ctagttccaccatcaagc

SEQ ID NO: 2214506 - DNA, 20 bp, Homo sapiens
ctagttccaccatcaagcca

SEQ ID NO: 2214507 - DNA, 23 bp, Homo sapiens
ctagttgtttgattcagacagct

SEQ ID NO: 2214508 - DNA, 17 bp, Homo sapiens
ctagtttgattaaattc

SEQ ID NO: 2214509 - DNA, 21 bp, Homo sapiens
ctagtttgattaaattcttgc

SEQ ID NO: 2214510 - DNA, 23 bp, Homo sapiens
ctatattgttttcagtgtacatg

SEQ ID NO: 2214511 - DNA, 13 bp, Homo sapiens
ctatctcccccag

SEQ ID NO: 2214512 - DNA, 14 bp, Homo sapiens
ctatctcccccagc

SEQ ID NO: 2214513 - DNA, 21 bp, Homo sapiens
ctatgcatttgaaaattttga

SEQ ID NO: 2214514 - DNA, 23 bp, Homo sapiens
ctatgggactcaatgcactgaca

SEQ ID NO: 2214515 - DNA, 13 bp, Homo sapiens
ctatgtatcaatg

SEQ ID NO: 2214516 - DNA, 19 bp, Homo sapiens
ctatgtatcaatgagtaac

SEQ ID NO: 2214517 - DNA, 17 bp, Homo sapiens
ctatgtgagcacaaagg

SEQ ID NO: 2214518 - DNA, 14 bp, Homo sapiens
ctatgttgcccagg

SEQ ID NO: 2214519 - DNA, 18 bp, Homo sapiens
ctcaaaaaaagaaaaaga

SEQ ID NO: 2214520 - DNA, 14 bp, Homo sapiens
ctcaaatttctaaa

SEQ ID NO: 2214521 - DNA, 17 bp, Homo sapiens
ctcaacctcctgggcta

SEQ ID NO: 2214522 - DNA, 14 bp, Homo sapiens
ctcaactctcctcc

SEQ ID NO: 2214523 - DNA, 18 bp, Homo sapiens
ctcaagtgattctcctgc

SEQ ID NO: 2214524 - DNA, 19 bp, Homo sapiens
ctcaagtgattctcctgcc

SEQ ID NO: 2214525 - DNA, 13 bp, Homo sapiens
ctcaatgcactga

SEQ ID NO: 2214526 - DNA, 23 bp, Homo sapiens
ctcaattattttgcattttttct

SEQ ID NO: 2214527 - DNA, 14 bp, Homo sapiens
ctcacaaaggatgc

SEQ ID NO: 2214528 - DNA, 14 bp, Homo sapiens
ctcacacatgagca

SEQ ID NO: 2214529 - DNA, 22 bp, Homo sapiens
ctcacacatgagcatcaggcca

SEQ ID NO: 2214530 - DNA, 15 bp, Homo sapiens
ctcacagtccttacc

SEQ ID NO: 2214531 - DNA, 17 bp, Homo sapiens
ctcacagtccttaccag

SEQ ID NO: 2214532 - DNA, 23 bp, Homo sapiens
ctcacagtccttaccagcagagc

SEQ ID NO: 2214533 - DNA, 14 bp, Homo sapiens
ctcaccagccccag

SEQ ID NO: 2214534 - DNA, 12 bp, Homo sapiens
ctcaccccagcc

SEQ ID NO: 2214535 - DNA, 15 bp, Homo sapiens
ctcaccccagcccca

SEQ ID NO: 2214536 - DNA, 14 bp, Homo sapiens
ctcacctctccctt

SEQ ID NO: 2214537 - DNA, 13 bp, Homo sapiens
ctcacctgcccct

SEQ ID NO: 2214538 - DNA, 18 bp, Homo sapiens
ctcacctgcccctcaact

SEQ ID NO: 2214539 - DNA, 21 bp, Homo sapiens
ctcactctgtcgcccagtctg

SEQ ID NO: 2214540 - DNA, 15 bp, Homo sapiens
ctcagaagacactga

SEQ ID NO: 2214541 - DNA, 17 bp, Homo sapiens
ctcagaagacactgatg

SEQ ID NO: 2214542 - DNA, 22 bp, Homo sapiens
ctcagaagacactgatgggcaa

SEQ ID NO: 2214543 - DNA, 17 bp, Homo sapiens
ctcagaatctcaaataa

SEQ ID NO: 2214544 - DNA, 14 bp, Homo sapiens
ctcagagagggtgg

SEQ ID NO: 2214545 - DNA, 16 bp, Homo sapiens
ctcagatcttctgtgg

SEQ ID NO: 2214546 - DNA, 20 bp, Homo sapiens
ctcagcaaaagatgcttctc

SEQ ID NO: 2214547 - DNA, 22 bp, Homo sapiens
ctcagcatcctggcacccggcc

SEQ ID NO: 2214548 - DNA, 21 bp, Homo sapiens
ctcagcctcccaaagtgctgg

SEQ ID NO: 2214549 - DNA, 22 bp, Homo sapiens
ctcagcctcccgaatagctggg

SEQ ID NO: 2214550 - DNA, 14 bp, Homo sapiens
ctcagcggggacag

SEQ ID NO: 2214551 - DNA, 16 bp, Homo sapiens
ctcagcggggacagct

SEQ ID NO: 2214552 - DNA, 23 bp, Homo sapiens
ctcagcggggacagctccttctg

SEQ ID NO: 2214553 - DNA, 23 bp, Homo sapiens
ctcaggagtttgagaccaacctg

SEQ ID NO: 2214554 - DNA, 20 bp, Homo sapiens
ctcaggccaaactcacctgc

SEQ ID NO: 2214555 - DNA, 20 bp, Homo sapiens
ctcaggccagctgcttgggc

SEQ ID NO: 2214556 - DNA, 21 bp, Homo sapiens
ctcaggccagctgcttgggct

SEQ ID NO: 2214557 - DNA, 14 bp, Homo sapiens
ctcaggcctggggg

SEQ ID NO: 2214558 - DNA, 15 bp, Homo sapiens
ctcagggcctggtcg

SEQ ID NO: 2214559 - DNA, 12 bp, Homo sapiens
ctcagggtccct

SEQ ID NO: 2214560 - DNA, 22 bp, Homo sapiens
ctcagggtccctggtggcagct

SEQ ID NO: 2214561 - DNA, 19 bp, Homo sapiens
ctcaggtgatccacccacc

SEQ ID NO: 2214562 - DNA, 22 bp, Homo sapiens
ctcaggtgatccacccacctca

SEQ ID NO: 2214563 - DNA, 19 bp, Homo sapiens
ctcaggtggggtcactctg

SEQ ID NO: 2214564 - DNA, 19 bp, Homo sapiens
ctcaggtgtccctgcactt

SEQ ID NO: 2214565 - DNA, 15 bp, Homo sapiens
ctcagtccatagcag

SEQ ID NO: 2214566 - DNA, 18 bp, Homo sapiens
ctcagtctggcccttcct

SEQ ID NO: 2214567 - DNA, 16 bp, Homo sapiens
ctcatacccaccccca

SEQ ID NO: 2214568 - DNA, 18 bp, Homo sapiens
ctcatacccacccccacc

SEQ ID NO: 2214569 - DNA, 20 bp, Homo sapiens
ctcatagtatggtggctggg

SEQ ID NO: 2214570 - DNA, 23 bp, Homo sapiens
ctcatagtatggtggctgggttg

SEQ ID NO: 2214571 - DNA, 15 bp, Homo sapiens
ctcatcctcataccc

SEQ ID NO: 2214572 - DNA, 12 bp, Homo sapiens
ctcattcttctg

SEQ ID NO: 2214573 - DNA, 13 bp, Homo sapiens
ctcattgacctga

SEQ ID NO: 2214574 - DNA, 17 bp, Homo sapiens
ctcattgacctgaggcc

SEQ ID NO: 2214575 - DNA, 21 bp, Homo sapiens
ctcatttgtcacacactttgg

SEQ ID NO: 2214576 - DNA, 16 bp, Homo sapiens
ctccaaaataaaactt

SEQ ID NO: 2214577 - DNA, 18 bp, Homo sapiens
ctccaaaataaaactttt

SEQ ID NO: 2214578 - DNA, 13 bp, Homo sapiens
ctccaagctccca

SEQ ID NO: 2214579 - DNA, 15 bp, Homo sapiens
ctccaagctcccagg

SEQ ID NO: 2214580 - DNA, 13 bp, Homo sapiens
ctccaccctgctc

SEQ ID NO: 2214581 - DNA, 15 bp, Homo sapiens
ctccaccctgctctc

SEQ ID NO: 2214582 - DNA, 13 bp, Homo sapiens
ctccacctgccag

SEQ ID NO: 2214583 - DNA, 15 bp, Homo sapiens
ctccacctgccaggg

SEQ ID NO: 2214584 - DNA, 21 bp, Homo sapiens
ctccacctgccagggacagag

SEQ ID NO: 2214585 - DNA, 22 bp, Homo sapiens
ctccactttctagccagaggag

SEQ ID NO: 2214586 - DNA, 11 bp, Homo sapiens
ctccagacaca

SEQ ID NO: 2214587 - DNA, 16 bp, Homo sapiens
ctccagacacatgtcc

SEQ ID NO: 2214588 - DNA, 20 bp, Homo sapiens
ctccagcccctggatgcagc

SEQ ID NO: 2214589 - DNA, 12 bp, Homo sapiens
ctccagcctggg

SEQ ID NO: 2214590 - DNA, 16 bp, Homo sapiens
ctccagctcaccagcc

SEQ ID NO: 2214591 - DNA, 19 bp, Homo sapiens
ctccagctcaccagcccca

SEQ ID NO: 2214592 - DNA, 13 bp, Homo sapiens
ctccagctgttca

SEQ ID NO: 2214593 - DNA, 17 bp, Homo sapiens
ctccagggggtgccctc

SEQ ID NO: 2214594 - DNA, 19 bp, Homo sapiens
ctccagggggtgccctccc

SEQ ID NO: 2214595 - DNA, 23 bp, Homo sapiens
ctccagggggtgccctcccagac

SEQ ID NO: 2214596 - DNA, 11 bp, Homo sapiens
ctccaggtgca

SEQ ID NO: 2214597 - DNA, 18 bp, Homo sapiens
ctccaggtgcacaagctc

SEQ ID NO: 2214598 - DNA, 19 bp, Homo sapiens
ctccaggtgcacaagctcc

SEQ ID NO: 2214599 - DNA, 13 bp, Homo sapiens
ctccatgtgggct

SEQ ID NO: 2214600 - DNA, 18 bp, Homo sapiens
ctcccaaagtgctgggat

SEQ ID NO: 2214601 - DNA, 16 bp, Homo sapiens
ccgccatgctcctggc

SEQ ID NO: 2214602 - DNA, 16 bp, Homo sapiens
ccggcccagtgccccc

SEQ ID NO: 2214603 - DNA, 13 bp, Homo sapiens
ccggcccctgctg

SEQ ID NO: 2214604 - DNA, 14 bp, Homo sapiens
ccggctccaggctc

SEQ ID NO: 2214605 - DNA, 12 bp, Homo sapiens
ccgggcagcaga

SEQ ID NO: 2214606 - DNA, 13 bp, Homo sapiens
ccgggcagcagag

SEQ ID NO: 2214607 - DNA, 14 bp, Homo sapiens
ccgggcagcagaga

SEQ ID NO: 2214608 - DNA, 13 bp, Homo sapiens
ccgggccacagag

SEQ ID NO: 2214609 - DNA, 20 bp, Homo sapiens
ccgggcgcggtggctcacgc

SEQ ID NO: 2214610 - DNA, 18 bp, Homo sapiens
ccgggctctgcctcccat

SEQ ID NO: 2214611 - DNA, 12 bp, Homo sapiens
ccgtgaggccag

SEQ ID NO: 2214612 - DNA, 12 bp, Homo sapiens
ccgttattaaaa

SEQ ID NO: 2214613 - DNA, 14 bp, Homo sapiens
cctaaagtgtattt

SEQ ID NO: 2214614 - DNA, 14 bp, Homo sapiens
cctaatcttctgaa

SEQ ID NO: 2214615 - DNA, 19 bp, Homo sapiens
cctacagcttgaccgtgag

SEQ ID NO: 2214616 - DNA, 21 bp, Homo sapiens
cctagcatacgtacacatttt

SEQ ID NO: 2214617 - DNA, 20 bp, Homo sapiens
cctagcctgtgcctctggga

SEQ ID NO: 2214618 - DNA, 23 bp, Homo sapiens
cctagcctgtgcctctgggactg

SEQ ID NO: 2214619 - DNA, 18 bp, Homo sapiens
cctaggtgacagagtgag

SEQ ID NO: 2214620 - DNA, 13 bp, Homo sapiens
cctagttccacca

SEQ ID NO: 2214621 - DNA, 21 bp, Homo sapiens
cctagttccaccatcaagcca

SEQ ID NO: 2214622 - DNA, 16 bp, Homo sapiens
cctattagagaagaga

SEQ ID NO: 2214623 - DNA, 16 bp, Homo sapiens
cctcaacctcctgggc

SEQ ID NO: 2214624 - DNA, 23 bp, Homo sapiens
cctcaactctcctccagagtcag

SEQ ID NO: 2214625 - DNA, 15 bp, Homo sapiens
cctcaagagaaggca

SEQ ID NO: 2214626 - DNA, 23 bp, Homo sapiens
cctcacagtccttaccagcagag

SEQ ID NO: 2214627 - DNA, 17 bp, Homo sapiens
cctcacctttcccatct

SEQ ID NO: 2214628 - DNA, 16 bp, Homo sapiens
cctcagcatcctggca

SEQ ID NO: 2214629 - DNA, 17 bp, Homo sapiens
cctcagcatcctggcac

SEQ ID NO: 2214630 - DNA, 11 bp, Homo sapiens
cctcagcctcc

SEQ ID NO: 2214631 - DNA, 12 bp, Homo sapiens
cctcaggcaggt

SEQ ID NO: 2214632 - DNA, 22 bp, Homo sapiens
cctcagggtccctggtggcagc

SEQ ID NO: 2214633 - DNA, 16 bp, Homo sapiens
cctcaggtgagaagca

SEQ ID NO: 2214634 - DNA, 22 bp, Homo sapiens
cctcaggtgagaagcagaggaa

SEQ ID NO: 2214635 - DNA, 22 bp, Homo sapiens
cctcaggtgatccacccacctc

SEQ ID NO: 2214636 - DNA, 20 bp, Homo sapiens
cctcatagtatggtggctgg

SEQ ID NO: 2214637 - DNA, 22 bp, Homo sapiens
cctcatagtatggtggctgggt

SEQ ID NO: 2214638 - DNA, 13 bp, Homo sapiens
cctcatcaccaac

SEQ ID NO: 2214639 - DNA, 19 bp, Homo sapiens
cctccaagaccttctcctt

SEQ ID NO: 2214640 - DNA, 11 bp, Homo sapiens
cctccaggtgc

SEQ ID NO: 2214641 - DNA, 12 bp, Homo sapiens
cctccatgtggg

SEQ ID NO: 2214642 - DNA, 15 bp, Homo sapiens
cctccatgtgggcta

SEQ ID NO: 2214643 - DNA, 15 bp, Homo sapiens
cctcccaaagtgctg

SEQ ID NO: 2214644 - DNA, 17 bp, Homo sapiens
cctcccaaagtgctggg

SEQ ID NO: 2214645 - DNA, 15 bp, Homo sapiens
cctcccaactcaccc

SEQ ID NO: 2214646 - DNA, 17 bp, Homo sapiens
cctcccaactcacccca

SEQ ID NO: 2214647 - DNA, 21 bp, Homo sapiens
cctcccaactcaccccagccc

SEQ ID NO: 2214648 - DNA, 13 bp, Homo sapiens
cctcccaccccct

SEQ ID NO: 2214649 - DNA, 23 bp, Homo sapiens
cctcccagacccccttgcccagg

SEQ ID NO: 2214650 - DNA, 17 bp, Homo sapiens
cctccccagcacctagg

SEQ ID NO: 2214651 - DNA, 15 bp, Homo sapiens
cctccccgggcagca

SEQ ID NO: 2214652 - DNA, 17 bp, Homo sapiens
cctccccgggcagcaga

SEQ ID NO: 2214653 - DNA, 22 bp, Homo sapiens
cctccccgggcagcagagagag

SEQ ID NO: 2214654 - DNA, 19 bp, Homo sapiens
cctcccgagtagctgggac

SEQ ID NO: 2214655 - DNA, 21 bp, Homo sapiens
cctcccgagtagctgggacta

SEQ ID NO: 2214656 - DNA, 13 bp, Homo sapiens
cctccctccctct

SEQ ID NO: 2214657 - DNA, 14 bp, Homo sapiens
cctccgcctcttgg

SEQ ID NO: 2214658 - DNA, 14 bp, Homo sapiens
cctcctcagatctt

SEQ ID NO: 2214659 - DNA, 14 bp, Homo sapiens
cctcctgcccccac

SEQ ID NO: 2214660 - DNA, 22 bp, Homo sapiens
cctcctgcccccaccccaggct

SEQ ID NO: 2214661 - DNA, 23 bp, Homo sapiens
cctcctgcctcgaactggctgca

SEQ ID NO: 2214662 - DNA, 14 bp, Homo sapiens
cctcctgggctaag

SEQ ID NO: 2214663 - DNA, 18 bp, Homo sapiens
cctcctttgtgaggaagc

SEQ ID NO: 2214664 - DNA, 19 bp, Homo sapiens
cctcctttgtgaggaagcc

SEQ ID NO: 2214665 - DNA, 18 bp, Homo sapiens
cctccttttcacagttct

SEQ ID NO: 2214666 - DNA, 15 bp, Homo sapiens
cctcgaccacccccg

SEQ ID NO: 2214667 - DNA, 14 bp, Homo sapiens
cctcggtgtggaga

SEQ ID NO: 2214668 - DNA, 18 bp, Homo sapiens
cctcggtgtggagaagcg

SEQ ID NO: 2214669 - DNA, 12 bp, Homo sapiens
cctctcccatca

SEQ ID NO: 2214670 - DNA, 22 bp, Homo sapiens
cctctcccttggattgtccccg

SEQ ID NO: 2214671 - DNA, 13 bp, Homo sapiens
cctctctcactcc

SEQ ID NO: 2214672 - DNA, 17 bp, Homo sapiens
cctctctcactccttga

SEQ ID NO: 2214673 - DNA, 12 bp, Homo sapiens
cctctctcaggc

SEQ ID NO: 2214674 - DNA, 17 bp, Homo sapiens
cctctgacacacagctc

SEQ ID NO: 2214675 - DNA, 19 bp, Homo sapiens
cctctgacacacagctctg

SEQ ID NO: 2214676 - DNA, 19 bp, Homo sapiens
cctctgcacaagctgcacc

SEQ ID NO: 2214677 - DNA, 14 bp, Homo sapiens
cctctgcactcccc

SEQ ID NO: 2214678 - DNA, 15 bp, Homo sapiens
cctctgcactcccct

SEQ ID NO: 2214679 - DNA, 18 bp, Homo sapiens
cctctgcactcccctgct

SEQ ID NO: 2214680 - DNA, 17 bp, Homo sapiens
cctctgcccactccctg

SEQ ID NO: 2214681 - DNA, 20 bp, Homo sapiens
cctctgcctgaagtcacaca

SEQ ID NO: 2214682 - DNA, 15 bp, Homo sapiens
cctctgctgctggct

SEQ ID NO: 2214683 - DNA, 14 bp, Homo sapiens
cctcttatgggctg

SEQ ID NO: 2214684 - DNA, 16 bp, Homo sapiens
cctcttatgggctggg

SEQ ID NO: 2214685 - DNA, 13 bp, Homo sapiens
cctcttgagcctt

SEQ ID NO: 2214686 - DNA, 11 bp, Homo sapiens
cctctttccct

SEQ ID NO: 2214687 - DNA, 19 bp, Homo sapiens
cctctttccctcccttcct

SEQ ID NO: 2214688 - DNA, 15 bp, Homo sapiens
cctctttgagtgaag

SEQ ID NO: 2214689 - DNA, 13 bp, Homo sapiens
cctgaaagccctg

SEQ ID NO: 2214690 - DNA, 18 bp, Homo sapiens
cctgaaagccctgagctt

SEQ ID NO: 2214691 - DNA, 20 bp, Homo sapiens
cctgaaggccccgcccaggc

SEQ ID NO: 2214692 - DNA, 21 bp, Homo sapiens
cctgaaggccccgcccaggct

SEQ ID NO: 2214693 - DNA, 22 bp, Homo sapiens
cctgaagtctttgtacagacaa

SEQ ID NO: 2214694 - DNA, 15 bp, Homo sapiens
cctgagccagatttc

SEQ ID NO: 2214695 - DNA, 15 bp, Homo sapiens
cctgaggcccagagg

SEQ ID NO: 2214696 - DNA, 16 bp, Homo sapiens
cctgaggcccagaggg

SEQ ID NO: 2214697 - DNA, 17 bp, Homo sapiens
cctgaggcccagagggc

SEQ ID NO: 2214698 - DNA, 18 bp, Homo sapiens
cctgaggcccagagggcc

SEQ ID NO: 2214699 - DNA, 16 bp, Homo sapiens
cctgaggcccttctct

SEQ ID NO: 2214700 - DNA, 17 bp, Homo sapiens
cctgaggcccttctctc

SEQ ID NO: 2214701 - DNA, 23 bp, Homo sapiens
cctgaggcccttctctccagccc

SEQ ID NO: 2214702 - DNA, 15 bp, Homo sapiens
cctgaggctgggctc

SEQ ID NO: 2214703 - DNA, 17 bp, Homo sapiens
cctgaggctgggctccc

SEQ ID NO: 2214704 - DNA, 17 bp, Homo sapiens
cctgatgcttcttcaga

SEQ ID NO: 2214705 - DNA, 15 bp, Homo sapiens
cctgattgtgtctct

SEQ ID NO: 2214706 - DNA, 17 bp, Homo sapiens
cctgattgtgtctcttg

SEQ ID NO: 2214707 - DNA, 18 bp, Homo sapiens
cctgcaacaccttgtttc

SEQ ID NO: 2214708 - DNA, 16 bp, Homo sapiens
cctgcacttgcagact

SEQ ID NO: 2214709 - DNA, 17 bp, Homo sapiens
cctgcacttgcagactc

SEQ ID NO: 2214710 - DNA, 18 bp, Homo sapiens
cctgcacttgcagactct

SEQ ID NO: 2214711 - DNA, 22 bp, Homo sapiens
cctgcacttgcagactctacag

SEQ ID NO: 2214712 - DNA, 14 bp, Homo sapiens
cctgcaggcagcca

SEQ ID NO: 2214713 - DNA, 15 bp, Homo sapiens
cctgcaggcagccag

SEQ ID NO: 2214714 - DNA, 20 bp, Homo sapiens
cctgcaggcagccaggccac

SEQ ID NO: 2214715 - DNA, 23 bp, Homo sapiens
cctgcaggcagccaggccacaag

SEQ ID NO: 2214716 - DNA, 13 bp, Homo sapiens
cctgccaccctgg

SEQ ID NO: 2214717 - DNA, 14 bp, Homo sapiens
cctgccaccctggg

SEQ ID NO: 2214718 - DNA, 22 bp, Homo sapiens
cctgccaccctggggagaaagt

SEQ ID NO: 2214719 - DNA, 15 bp, Homo sapiens
cctgccaggaagcca

SEQ ID NO: 2214720 - DNA, 18 bp, Homo sapiens
cctgccaggaagccagca

SEQ ID NO: 2214721 - DNA, 16 bp, Homo sapiens
cctgccaggcatggtg

SEQ ID NO: 2214722 - DNA, 12 bp, Homo sapiens
cctgccagggac

SEQ ID NO: 2214723 - DNA, 14 bp, Homo sapiens
cctgcccacctggc

SEQ ID NO: 2214724 - DNA, 17 bp, Homo sapiens
cctgcccacctggcctc

SEQ ID NO: 2214725 - DNA, 17 bp, Homo sapiens
cctgcccccaccccagg

SEQ ID NO: 2214726 - DNA, 19 bp, Homo sapiens
cctgcccccaccccaggct

SEQ ID NO: 2214727 - DNA, 20 bp, Homo sapiens
cctgcccccaccccaggctg

SEQ ID NO: 2214728 - DNA, 14 bp, Homo sapiens
cctgcccggctgcg

SEQ ID NO: 2214729 - DNA, 23 bp, Homo sapiens
aggcttagtcactgagacagccc

SEQ ID NO: 2214730 - DNA, 14 bp, Homo sapiens
agggaaaaagacct

SEQ ID NO: 2214731 - DNA, 21 bp, Homo sapiens
agggacgctacccgggaaggg

SEQ ID NO: 2214732 - DNA, 15 bp, Homo sapiens
agggacttggaagct

SEQ ID NO: 2214733 - DNA, 18 bp, Homo sapiens
agggacttggaagctccg

SEQ ID NO: 2214734 - DNA, 20 bp, Homo sapiens
agggacttggaagctccgct

SEQ ID NO: 2214735 - DNA, 15 bp, Homo sapiens
agggagggctccaga

SEQ ID NO: 2214736 - DNA, 17 bp, Homo sapiens
agggaggtgaccccagg

SEQ ID NO: 2214737 - DNA, 23 bp, Homo sapiens
agggagtccgaaagggacttgga

SEQ ID NO: 2214738 - DNA, 19 bp, Homo sapiens
agggagtgacagaggcagc

SEQ ID NO: 2214739 - DNA, 20 bp, Homo sapiens
agggcacaccgggcactcag

SEQ ID NO: 2214740 - DNA, 22 bp, Homo sapiens
agggcacagaaaatggaagaca

SEQ ID NO: 2214741 - DNA, 14 bp, Homo sapiens
agggcccagagagg

SEQ ID NO: 2214742 - DNA, 18 bp, Homo sapiens
agggcccagagagggtgg

SEQ ID NO: 2214743 - DNA, 15 bp, Homo sapiens
agggcctgcaaggga

SEQ ID NO: 2214744 - DNA, 13 bp, Homo sapiens
agggcctggcctg

SEQ ID NO: 2214745 - DNA, 14 bp, Homo sapiens
agggcctggctcag

SEQ ID NO: 2214746 - DNA, 23 bp, Homo sapiens
agggctcagcggggacagctcct

SEQ ID NO: 2214747 - DNA, 12 bp, Homo sapiens
agggctccagac

SEQ ID NO: 2214748 - DNA, 15 bp, Homo sapiens
aggggaagaaaaact

SEQ ID NO: 2214749 - DNA, 21 bp, Homo sapiens
aggggaatgtttgcctctgcc

SEQ ID NO: 2214750 - DNA, 21 bp, Homo sapiens
aggggatagagagagaccact

SEQ ID NO: 2214751 - DNA, 17 bp, Homo sapiens
aggggcccaagagagac

SEQ ID NO: 2214752 - DNA, 19 bp, Homo sapiens
aggggcctcttatgggctg

SEQ ID NO: 2214753 - DNA, 22 bp, Homo sapiens
aggggtgggacaccctgtgatg

SEQ ID NO: 2214754 - DNA, 18 bp, Homo sapiens
agggtatcaggtgctgcc

SEQ ID NO: 2214755 - DNA, 21 bp, Homo sapiens
agggtatctggtgactttcct

SEQ ID NO: 2214756 - DNA, 12 bp, Homo sapiens
agggtccctggt

SEQ ID NO: 2214757 - DNA, 14 bp, Homo sapiens
agggtccctggtgg

SEQ ID NO: 2214758 - DNA, 16 bp, Homo sapiens
agggtccctggtggca

SEQ ID NO: 2214759 - DNA, 17 bp, Homo sapiens
agggtccctggtggcag

SEQ ID NO: 2214760 - DNA, 21 bp, Homo sapiens
agggtctcactatgttgccca

SEQ ID NO: 2214761 - DNA, 16 bp, Homo sapiens
agggtctcactctgtc

SEQ ID NO: 2214762 - DNA, 22 bp, Homo sapiens
agggtctcactctgtcgcccag

SEQ ID NO: 2214763 - DNA, 15 bp, Homo sapiens
agggtctgcagggaa

SEQ ID NO: 2214764 - DNA, 16 bp, Homo sapiens
agggtggtgacctctg

SEQ ID NO: 2214765 - DNA, 13 bp, Homo sapiens
agggttataataa

SEQ ID NO: 2214766 - DNA, 23 bp, Homo sapiens
agggttggcccctgcccggctgc

SEQ ID NO: 2214767 - DNA, 13 bp, Homo sapiens
agggttgggctgg

SEQ ID NO: 2214768 - DNA, 23 bp, Homo sapiens
aggtagaaatatctgaaaatgta

SEQ ID NO: 2214769 - DNA, 21 bp, Homo sapiens
aggtatgcaatcaaatctgct

SEQ ID NO: 2214770 - DNA, 13 bp, Homo sapiens
aggtcagagcctg

SEQ ID NO: 2214771 - DNA, 14 bp, Homo sapiens
aggtcagagcctgc

SEQ ID NO: 2214772 - DNA, 15 bp, Homo sapiens
aggtcagagcctgca

SEQ ID NO: 2214773 - DNA, 20 bp, Homo sapiens
aggtcattttttttaagaaa

SEQ ID NO: 2214774 - DNA, 22 bp, Homo sapiens
aggtcattttttttaagaaaaa

SEQ ID NO: 2214775 - DNA, 14 bp, Homo sapiens
aggtcgaggcagga

SEQ ID NO: 2214776 - DNA, 13 bp, Homo sapiens
aggtctgttcttt

SEQ ID NO: 2214777 - DNA, 15 bp, Homo sapiens
aggtctgttctttcc

SEQ ID NO: 2214778 - DNA, 18 bp, Homo sapiens
aggtcttgaactcctggc

SEQ ID NO: 2214779 - DNA, 22 bp, Homo sapiens
aggtcttgaactcctggcctca

SEQ ID NO: 2214780 - DNA, 23 bp, Homo sapiens
aggtcttgaactcctggcctcaa

SEQ ID NO: 2214781 - DNA, 15 bp, Homo sapiens
aggtgacagagtgag

SEQ ID NO: 2214782 - DNA, 14 bp, Homo sapiens
aggtgatccaccca

SEQ ID NO: 2214783 - DNA, 20 bp, Homo sapiens
aggtgatccacccacctcag

SEQ ID NO: 2214784 - DNA, 17 bp, Homo sapiens
aggtgcacaagctccaa

SEQ ID NO: 2214785 - DNA, 19 bp, Homo sapiens
aggtgctaggaacactcct

SEQ ID NO: 2214786 - DNA, 15 bp, Homo sapiens
aggtgggatcctcca

SEQ ID NO: 2214787 - DNA, 16 bp, Homo sapiens
aggtgggatcctccag

SEQ ID NO: 2214788 - DNA, 20 bp, Homo sapiens
aggtgggatcctccaggtgc

SEQ ID NO: 2214789 - DNA, 13 bp, Homo sapiens
aggtggggcagct

SEQ ID NO: 2214790 - DNA, 17 bp, Homo sapiens
aggtgtgaaccaccaca

SEQ ID NO: 2214791 - DNA, 20 bp, Homo sapiens
aggtgtgctctgatcatcca

SEQ ID NO: 2214792 - DNA, 14 bp, Homo sapiens
aggttaatgttcat

SEQ ID NO: 2214793 - DNA, 14 bp, Homo sapiens
aggttcaaagatat

SEQ ID NO: 2214794 - DNA, 17 bp, Homo sapiens
aggttcaaagatatttt

SEQ ID NO: 2214795 - DNA, 13 bp, Homo sapiens
ccctggtggcagt

SEQ ID NO: 2214796 - DNA, 22 bp, Homo sapiens
ccctggtggcagtgggagctgc

SEQ ID NO: 2214797 - DNA, 13 bp, Homo sapiens
ccctgtctaatga

SEQ ID NO: 2214798 - DNA, 23 bp, Homo sapiens
ccctgtctcaaaaaaagaaaaag

SEQ ID NO: 2214799 - DNA, 15 bp, Homo sapiens
ccctgtgatggggcc

SEQ ID NO: 2214800 - DNA, 17 bp, Homo sapiens
ccctgtgatggggccct

SEQ ID NO: 2214801 - DNA, 18 bp, Homo sapiens
ccctgtgatggggccctg

SEQ ID NO: 2214802 - DNA, 21 bp, Homo sapiens
ccctgtgatggggccctgcct

SEQ ID NO: 2214803 - DNA, 13 bp, Homo sapiens
ccctgttctggca

SEQ ID NO: 2214804 - DNA, 15 bp, Homo sapiens
ccctgtttgtttctg

SEQ ID NO: 2214805 - DNA, 20 bp, Homo sapiens
cccttacctgccaggaagcc

SEQ ID NO: 2214806 - DNA, 14 bp, Homo sapiens
cccttagcagggaa

SEQ ID NO: 2214807 - DNA, 23 bp, Homo sapiens
cccttagcagggaaacagctaat

SEQ ID NO: 2214808 - DNA, 13 bp, Homo sapiens
cccttcccacctc

SEQ ID NO: 2214809 - DNA, 13 bp, Homo sapiens
cccttcgctcctg

SEQ ID NO: 2214810 - DNA, 14 bp, Homo sapiens
cccttgcccaggcc

SEQ ID NO: 2214811 - DNA, 17 bp, Homo sapiens
cccttgccgtctacctg

SEQ ID NO: 2214812 - DNA, 23 bp, Homo sapiens
cccttggttaggcattgtgggaa

SEQ ID NO: 2214813 - DNA, 18 bp, Homo sapiens
cccttgtggtcccacccc

SEQ ID NO: 2214814 - DNA, 23 bp, Homo sapiens
cccttttttggctgctgaaggct

SEQ ID NO: 2214815 - DNA, 16 bp, Homo sapiens
ccgaaaacgtggctgc

SEQ ID NO: 2214816 - DNA, 16 bp, Homo sapiens
ccgaatagctgggact

SEQ ID NO: 2214817 - DNA, 20 bp, Homo sapiens
ccgaatagctgggactacag

SEQ ID NO: 2214818 - DNA, 17 bp, Homo sapiens
ccgaccagacaccttga

SEQ ID NO: 2214819 - DNA, 18 bp, Homo sapiens
ccgaccagacaccttgac

SEQ ID NO: 2214820 - DNA, 22 bp, Homo sapiens
ccgagatagccaaggccaaagg

SEQ ID NO: 2214821 - DNA, 18 bp, Homo sapiens
ccgagatcacgccactgc

SEQ ID NO: 2214822 - DNA, 19 bp, Homo sapiens
ccgagattgcaccactgca

SEQ ID NO: 2214823 - DNA, 22 bp, Homo sapiens
ccgatgggatggcttggggggc

SEQ ID NO: 2214824 - DNA, 20 bp, Homo sapiens
ctctatttttgtaaaaaggg

SEQ ID NO: 2214825 - DNA, 15 bp, Homo sapiens
ctctcactccttgaa

SEQ ID NO: 2214826 - DNA, 12 bp, Homo sapiens
ctctcaggccaa

SEQ ID NO: 2214827 - DNA, 19 bp, Homo sapiens
ctctcaggccagctgcttg

SEQ ID NO: 2214828 - DNA, 14 bp, Homo sapiens
ctctccagcccctg

SEQ ID NO: 2214829 - DNA, 17 bp, Homo sapiens
ctctccagcccctggat

SEQ ID NO: 2214830 - DNA, 13 bp, Homo sapiens
ctctccccagcaa

SEQ ID NO: 2214831 - DNA, 16 bp, Homo sapiens
ctctccgaccagacac

SEQ ID NO: 2214832 - DNA, 13 bp, Homo sapiens
ctctcctcctttt

SEQ ID NO: 2214833 - DNA, 13 bp, Homo sapiens
ctctcctctgctg

SEQ ID NO: 2214834 - DNA, 14 bp, Homo sapiens
ctctcctctgctgc

SEQ ID NO: 2214835 - DNA, 15 bp, Homo sapiens
ctctcctctgctgct

SEQ ID NO: 2214836 - DNA, 13 bp, Homo sapiens
ctctcctgtacct

SEQ ID NO: 2214837 - DNA, 22 bp, Homo sapiens
ctctcctgtacctcttgagcct

SEQ ID NO: 2214838 - DNA, 14 bp, Homo sapiens
ctctctcactcctt

SEQ ID NO: 2214839 - DNA, 15 bp, Homo sapiens
ctctctcactccttg

SEQ ID NO: 2214840 - DNA, 15 bp, Homo sapiens
ctctgaaggacattg

SEQ ID NO: 2214841 - DNA, 15 bp, Homo sapiens
ctctgacacacagct

SEQ ID NO: 2214842 - DNA, 17 bp, Homo sapiens
ctctgacacacagctct

SEQ ID NO: 2214843 - DNA, 19 bp, Homo sapiens
ctctgacacacagctctgt

SEQ ID NO: 2214844 - DNA, 23 bp, Homo sapiens
ctctgacagaagaaccccagggt

SEQ ID NO: 2214845 - DNA, 14 bp, Homo sapiens
ctctgaggacacta

SEQ ID NO: 2214846 - DNA, 22 bp, Homo sapiens
ctctgcaagaattgaagcagga

SEQ ID NO: 2214847 - DNA, 14 bp, Homo sapiens
ctctgcacaagctg

SEQ ID NO: 2214848 - DNA, 16 bp, Homo sapiens
ctctgcacaagctgca

SEQ ID NO: 2214849 - DNA, 17 bp, Homo sapiens
ctctgcactcccctgct

SEQ ID NO: 2214850 - DNA, 18 bp, Homo sapiens
ctctgcactcccctgctg

SEQ ID NO: 2214851 - DNA, 23 bp, Homo sapiens
ctctgcagcaataaagcagcgtt

SEQ ID NO: 2214852 - DNA, 15 bp, Homo sapiens
ctctgcccactccct

SEQ ID NO: 2214853 - DNA, 17 bp, Homo sapiens
ctctgcccactccctgc

SEQ ID NO: 2214854 - DNA, 14 bp, Homo sapiens
ctctgccctccaag

SEQ ID NO: 2214855 - DNA, 14 bp, Homo sapiens
ctctgcctcccatc

SEQ ID NO: 2214856 - DNA, 21 bp, Homo sapiens
ctctgcctcccatcacccgct

SEQ ID NO: 2214857 - DNA, 16 bp, Homo sapiens
ctctgcctctgacaca

SEQ ID NO: 2214858 - DNA, 19 bp, Homo sapiens
ctctgcctctgacacacag

SEQ ID NO: 2214859 - DNA, 17 bp, Homo sapiens
ctctgctgacagacaca

SEQ ID NO: 2214860 - DNA, 19 bp, Homo sapiens
ctctgctgacagacacagg

SEQ ID NO: 2214861 - DNA, 16 bp, Homo sapiens
ctctgctgctggctgg

SEQ ID NO: 2214862 - DNA, 16 bp, Homo sapiens
ctctggacaggcatgt

SEQ ID NO: 2214863 - DNA, 14 bp, Homo sapiens
ctctggcagctcag

SEQ ID NO: 2214864 - DNA, 20 bp, Homo sapiens
ctctggcagctcagagaggg

SEQ ID NO: 2214865 - DNA, 15 bp, Homo sapiens
ctctggttatctaat

SEQ ID NO: 2214866 - DNA, 15 bp, Homo sapiens
ctctgtacagagccc

SEQ ID NO: 2214867 - DNA, 16 bp, Homo sapiens
ctctgtacagagccca

SEQ ID NO: 2214868 - DNA, 21 bp, Homo sapiens
ctctgtacagagcccacgccc

SEQ ID NO: 2214869 - DNA, 17 bp, Homo sapiens
ctctgtcgcccagtctg

SEQ ID NO: 2214870 - DNA, 19 bp, Homo sapiens
ctctgtcgcccagtctgga

SEQ ID NO: 2214871 - DNA, 15 bp, Homo sapiens
ctctgtgtcaggtgg

SEQ ID NO: 2214872 - DNA, 22 bp, Homo sapiens
ctctgtgtcaggtggggcagct

SEQ ID NO: 2214873 - DNA, 14 bp, Homo sapiens
ctcttatgggctgg

SEQ ID NO: 2214874 - DNA, 13 bp, Homo sapiens
ctcttattgccca

SEQ ID NO: 2214875 - DNA, 18 bp, Homo sapiens
ctcttcagatctctaact

SEQ ID NO: 2214876 - DNA, 19 bp, Homo sapiens
ctcttcagatctctaactt

SEQ ID NO: 2214877 - DNA, 14 bp, Homo sapiens
ctcttccaggctgg

SEQ ID NO: 2214878 - DNA, 13 bp, Homo sapiens
ctcttctccaggc

SEQ ID NO: 2214879 - DNA, 15 bp, Homo sapiens
ctcttctccaggctg

SEQ ID NO: 2214880 - DNA, 16 bp, Homo sapiens
ctcttgacctcaggtg

SEQ ID NO: 2214881 - DNA, 13 bp, Homo sapiens
ctcttgagcctgg

SEQ ID NO: 2214882 - DNA, 15 bp, Homo sapiens
ctcttgagcctggga

SEQ ID NO: 2214883 - DNA, 24 bp, Homo sapiens
ctcttgattcataatgacttaagc

SEQ ID NO: 2214884 - DNA, 13 bp, Homo sapiens
ctcttggtcctgc

SEQ ID NO: 2214885 - DNA, 15 bp, Homo sapiens
ctcttggtcctgctg

SEQ ID NO: 2214886 - DNA, 19 bp, Homo sapiens
ctcttggtcctgctgcagt

SEQ ID NO: 2214887 - DNA, 20 bp, Homo sapiens
ctctttaatgtcacaggcag

SEQ ID NO: 2214888 - DNA, 15 bp, Homo sapiens
ctctttggacactca

SEQ ID NO: 2214889 - DNA, 19 bp, Homo sapiens
ctctttggtctacactgtg

SEQ ID NO: 2214890 - DNA, 23 bp, Homo sapiens
ctctttggtctacactgtgctga

SEQ ID NO: 2214891 - DNA, 14 bp, Homo sapiens
ctcttttcaaaaca

SEQ ID NO: 2214892 - DNA, 14 bp, Homo sapiens
ctgaaaatgtatgt

SEQ ID NO: 2214893 - DNA, 19 bp, Homo sapiens
ctgaaagccctgagctttc

SEQ ID NO: 2214894 - DNA, 23 bp, Homo sapiens
ctgaaagccctgagctttctgct

SEQ ID NO: 2214895 - DNA, 23 bp, Homo sapiens
ctgaaagggacgctacccgggaa

SEQ ID NO: 2214896 - DNA, 19 bp, Homo sapiens
ctgaaggacattgcggaca

SEQ ID NO: 2214897 - DNA, 13 bp, Homo sapiens
ctgctggttcagg

SEQ ID NO: 2214898 - DNA, 17 bp, Homo sapiens
ctgcttaacttcacata

SEQ ID NO: 2214899 - DNA, 14 bp, Homo sapiens
ctgcttcaaggatc

SEQ ID NO: 2214900 - DNA, 16 bp, Homo sapiens
ctgcttcaaggatcct

SEQ ID NO: 2214901 - DNA, 14 bp, Homo sapiens
ctgcttcagcctcc

SEQ ID NO: 2214902 - DNA, 16 bp, Homo sapiens
ctgcttccagtgaggc

SEQ ID NO: 2214903 - DNA, 21 bp, Homo sapiens
ctgcttccagtgaggctctgc

SEQ ID NO: 2214904 - DNA, 23 bp, Homo sapiens
ctgcttccagtgaggctctgccc

SEQ ID NO: 2214905 - DNA, 13 bp, Homo sapiens
ctgcttgaggcaa

SEQ ID NO: 2214906 - DNA, 15 bp, Homo sapiens
ctgcttgggcttcat

SEQ ID NO: 2214907 - DNA, 17 bp, Homo sapiens
ctggaacactaatgagg

SEQ ID NO: 2214908 - DNA, 13 bp, Homo sapiens
ctggaagcagaaa

SEQ ID NO: 2214909 - DNA, 21 bp, Homo sapiens
ctggaagcagaaacaaaatga

SEQ ID NO: 2214910 - DNA, 14 bp, Homo sapiens
ctggacaggcatgt

SEQ ID NO: 2214911 - DNA, 20 bp, Homo sapiens
ctggaccttgaactgggtac

SEQ ID NO: 2214912 - DNA, 15 bp, Homo sapiens
ctggagtgcagtgag

SEQ ID NO: 2214913 - DNA, 16 bp, Homo sapiens
ctggagtgcagtgagc

SEQ ID NO: 2214914 - DNA, 16 bp, Homo sapiens
ctggatgcagcctcac

SEQ ID NO: 2214915 - DNA, 13 bp, Homo sapiens
ctggattaaactt

SEQ ID NO: 2214916 - DNA, 18 bp, Homo sapiens
ctggcacccggcccctgc

SEQ ID NO: 2214917 - DNA, 16 bp, Homo sapiens
ctggcactataatgta

SEQ ID NO: 2214918 - DNA, 18 bp, Homo sapiens
ctggcactgcttccagtg

SEQ ID NO: 2214919 - DNA, 11 bp, Homo sapiens
ctggcagccca

SEQ ID NO: 2214920 - DNA, 23 bp, Homo sapiens
ctggcagcccctgttctggcaga

SEQ ID NO: 2214921 - DNA, 12 bp, Homo sapiens
ctggcagctcag

SEQ ID NO: 2214922 - DNA, 17 bp, Homo sapiens
ctggcagctcagagagg

SEQ ID NO: 2214923 - DNA, 17 bp, Homo sapiens
ctggccagatgcaccag

SEQ ID NO: 2214924 - DNA, 22 bp, Homo sapiens
ctggcccctcagggtccctggt

SEQ ID NO: 2214925 - DNA, 12 bp, Homo sapiens
ctggcccttcct

SEQ ID NO: 2214926 - DNA, 14 bp, Homo sapiens
ctggcctagcatac

SEQ ID NO: 2214927 - DNA, 23 bp, Homo sapiens
ctggcctcaagtgattctcctgc

SEQ ID NO: 2214928 - DNA, 13 bp, Homo sapiens
ctggcctctgcac

SEQ ID NO: 2214929 - DNA, 16 bp, Homo sapiens
ctggcctctgcactcc

SEQ ID NO: 2214930 - DNA, 18 bp, Homo sapiens
ctggcctgagctgggatg

SEQ ID NO: 2214931 - DNA, 14 bp, Homo sapiens
ctggcctggcccct

SEQ ID NO: 2214932 - DNA, 17 bp, Homo sapiens
ctggcctggcccctcag

SEQ ID NO: 2214933 - DNA, 19 bp, Homo sapiens
ctggcctggcccctcaggg

SEQ ID NO: 2214934 - DNA, 16 bp, Homo sapiens
ctggctatgcatttga

SEQ ID NO: 2214935 - DNA, 14 bp, Homo sapiens
ctggctcttccagg

SEQ ID NO: 2214936 - DNA, 19 bp, Homo sapiens
ctggctcttccaggctggg

SEQ ID NO: 2214937 - DNA, 20 bp, Homo sapiens
ctggctcttccaggctggga

SEQ ID NO: 2214938 - DNA, 21 bp, Homo sapiens
ctggctcttccaggctgggag

SEQ ID NO: 2214939 - DNA, 24 bp, Homo sapiens
ctggctcttccaggctgggagagc

SEQ ID NO: 2214940 - DNA, 11 bp, Homo sapiens
ctgggacacag

SEQ ID NO: 2214941 - DNA, 18 bp, Homo sapiens
ctgggacatgggaaaggg

SEQ ID NO: 2214942 - DNA, 22 bp, Homo sapiens
ctgggacatgggaaaggggaag

SEQ ID NO: 2214943 - DNA, 15 bp, Homo sapiens
ctgggactacaggca

SEQ ID NO: 2214944 - DNA, 16 bp, Homo sapiens
ctgggactacaggcac

SEQ ID NO: 2214945 - DNA, 22 bp, Homo sapiens
ctgggagaaccaaaaagaggct

SEQ ID NO: 2214946 - DNA, 19 bp, Homo sapiens
ctgggagagccttccaggg

SEQ ID NO: 2214947 - DNA, 18 bp, Homo sapiens
ctgggaggtcaaggctgc

SEQ ID NO: 2214948 - DNA, 18 bp, Homo sapiens
ctgggatgattggagggg

SEQ ID NO: 2214949 - DNA, 21 bp, Homo sapiens
ctgggattacaagcgtgagcc

SEQ ID NO: 2214950 - DNA, 17 bp, Homo sapiens
ctgggattacaggtgtg

SEQ ID NO: 2214951 - DNA, 13 bp, Homo sapiens
ctgggcagaggaa

SEQ ID NO: 2214952 - DNA, 20 bp, Homo sapiens
ctgggcagaggaaagcaaag

SEQ ID NO: 2214953 - DNA, 20 bp, Homo sapiens
ctgggcaggttggtgggggc

SEQ ID NO: 2214954 - DNA, 22 bp, Homo sapiens
ctgggctcccttcccacctctc

SEQ ID NO: 2214955 - DNA, 20 bp, Homo sapiens
ctgggcttcagtggcagctg

SEQ ID NO: 2214956 - DNA, 13 bp, Homo sapiens
ctgggcttgggga

SEQ ID NO: 2214957 - DNA, 18 bp, Homo sapiens
ctgggcttgtctgtagat

SEQ ID NO: 2214958 - DNA, 18 bp, Homo sapiens
ctggggattcttgaactt

SEQ ID NO: 2214959 - DNA, 17 bp, Homo sapiens
ctgggggcctcagtgcc

SEQ ID NO: 2214960 - DNA, 14 bp, Homo sapiens
ctgggggctgggca

SEQ ID NO: 2214961 - DNA, 15 bp, Homo sapiens
ctggggtaggaggaa

SEQ ID NO: 2214962 - DNA, 21 bp, Homo sapiens
ctggggtggggacctcaggcc

SEQ ID NO: 2214963 - DNA, 21 bp, Homo sapiens
ctgggtacttgtggacacagc

SEQ ID NO: 2214964 - DNA, 23 bp, Homo sapiens
ctgggtacttgtggacacagctc

SEQ ID NO: 2214965 - DNA, 18 bp, Homo sapiens
ctgggtggcaccagcagc

SEQ ID NO: 2214966 - DNA, 20 bp, Homo sapiens
ctgggtggcaccagcagcct

SEQ ID NO: 2214967 - DNA, 23 bp, Homo sapiens
ctgggtggcaccagcagcctgga

SEQ ID NO: 2214968 - DNA, 14 bp, Homo sapiens
ctgggttcactgca

SEQ ID NO: 2214969 - DNA, 15 bp, Homo sapiens
ctgggttggagggtg

SEQ ID NO: 2214970 - DNA, 18 bp, Homo sapiens
ctggtccatagagagcaa

SEQ ID NO: 2214971 - DNA, 13 bp, Homo sapiens
ctggtcccactca

SEQ ID NO: 2214972 - DNA, 21 bp, Homo sapiens
ctggtgactttcctctttggt

SEQ ID NO: 2214973 - DNA, 23 bp, Homo sapiens
ctggtgactttcctctttggtct

SEQ ID NO: 2214974 - DNA, 12 bp, Homo sapiens
ctggtggcagct

SEQ ID NO: 2214975 - DNA, 13 bp, Homo sapiens
ctggtggcagctc

SEQ ID NO: 2214976 - DNA, 14 bp, Homo sapiens
ctggtggcagctca

SEQ ID NO: 2214977 - DNA, 17 bp, Homo sapiens
ctggtggcagctcacct

SEQ ID NO: 2214978 - DNA, 14 bp, Homo sapiens
ctggtggcagctgc

SEQ ID NO: 2214979 - DNA, 21 bp, Homo sapiens
ctggttagaggttccctttga

SEQ ID NO: 2214980 - DNA, 19 bp, Homo sapiens
ctgtaatcctagcactttg

SEQ ID NO: 2214981 - DNA, 17 bp, Homo sapiens
ctgtaatttgtgataca

SEQ ID NO: 2214982 - DNA, 13 bp, Homo sapiens
ctgtacaaagtag

SEQ ID NO: 2214983 - DNA, 15 bp, Homo sapiens
ctgtacagagcccac

SEQ ID NO: 2214984 - DNA, 18 bp, Homo sapiens
ctgtacagagcccacgcc

SEQ ID NO: 2214985 - DNA, 20 bp, Homo sapiens
ctgtacatgaaaacacattt

SEQ ID NO: 2214986 - DNA, 22 bp, Homo sapiens
ctgtacatgaaaacacattttt

SEQ ID NO: 2214987 - DNA, 21 bp, Homo sapiens
ctgtacctcttgagccttgaa

SEQ ID NO: 2214988 - DNA, 13 bp, Homo sapiens
ctgtagagtggga

SEQ ID NO: 2214989 - DNA, 15 bp, Homo sapiens
ctgtagagtgggagc

SEQ ID NO: 2214990 - DNA, 18 bp, Homo sapiens
ctgtaggaaggttaatgt

SEQ ID NO: 2214991 - DNA, 14 bp, Homo sapiens
ctgtatcccatgag

SEQ ID NO: 2214992 - DNA, 19 bp, Homo sapiens
ctgtatcccatgagcctca

SEQ ID NO: 2214993 - DNA, 23 bp, Homo sapiens
ctgtatcccatgagcctcagcat

SEQ ID NO: 2214994 - DNA, 15 bp, Homo sapiens
ctgtcaattacagga

SEQ ID NO: 2214995 - DNA, 16 bp, Homo sapiens
ctgtcaattacaggaa

SEQ ID NO: 2214996 - DNA, 18 bp, Homo sapiens
ctgtcaattacaggaagt

SEQ ID NO: 2214997 - DNA, 20 bp, Homo sapiens
ctgtcaattacaggaagtac

SEQ ID NO: 2214998 - DNA, 14 bp, Homo sapiens
ctgtcatttgagca

SEQ ID NO: 2214999 - DNA, 18 bp, Homo sapiens
ctgtcatttgagcagggc

SEQ ID NO: 2215000 - DNA, 13 bp, Homo sapiens
ctgtccccctgac

SEQ ID NO: 2215001 - DNA, 20 bp, Homo sapiens
ctgtcccttacgtgagtcct

SEQ ID NO: 2215002 - DNA, 16 bp, Homo sapiens
ctgtcgcccagtctgg

SEQ ID NO: 2215003 - DNA, 16 bp, Homo sapiens
ctgtgaaaggaaagag

SEQ ID NO: 2215004 - DNA, 22 bp, Homo sapiens
ctgtgaaaggaaagagggaggt

SEQ ID NO: 2215005 - DNA, 20 bp, Homo sapiens
ctgtgagtactacagtcctc

SEQ ID NO: 2215006 - DNA, 21 bp, Homo sapiens
ctgtgagtactacagtcctcc

SEQ ID NO: 2215007 - DNA, 23 bp, Homo sapiens
ctgtgagtactacagtcctccca

SEQ ID NO: 2215008 - DNA, 21 bp, Homo sapiens
ctgtgatggggccctgcctcc

SEQ ID NO: 2215009 - DNA, 14 bp, Homo sapiens
ctgtgccatgtgcc

SEQ ID NO: 2215010 - DNA, 15 bp, Homo sapiens
ctgtgccatgtgcca

SEQ ID NO: 2215011 - DNA, 14 bp, Homo sapiens
ctgtgcctctggga

SEQ ID NO: 2215012 - DNA, 17 bp, Homo sapiens
ctgtgctctggacaggc

SEQ ID NO: 2215013 - DNA, 12 bp, Homo sapiens
ctgtgctgagtc

SEQ ID NO: 2215014 - DNA, 19 bp, Homo sapiens
ctgtgctgagtctgaaggc

SEQ ID NO: 2215015 - DNA, 13 bp, Homo sapiens
ctgtgctgccctg

SEQ ID NO: 2215016 - DNA, 15 bp, Homo sapiens
ctgtgctgccctgcc

SEQ ID NO: 2215017 - DNA, 17 bp, Homo sapiens
ctgtgctgccctgccca

SEQ ID NO: 2215018 - DNA, 22 bp, Homo sapiens
ctgtgctgccctgcccacctgg

SEQ ID NO: 2215019 - DNA, 14 bp, Homo sapiens
ctgtgggcccccaa

SEQ ID NO: 2215020 - DNA, 21 bp, Homo sapiens
ctgtgggtttctaaagctgcc

SEQ ID NO: 2215021 - DNA, 19 bp, Homo sapiens
ctgtgtcagcatagaagta

SEQ ID NO: 2215022 - DNA, 21 bp, Homo sapiens
ctgtgtcaggtggggcagctt

SEQ ID NO: 2215023 - DNA, 14 bp, Homo sapiens
ctgtgtcttgcaat

SEQ ID NO: 2215024 - DNA, 20 bp, Homo sapiens
ctgtgtgtgcgcctacagga

SEQ ID NO: 2215025 - DNA, 16 bp, Homo sapiens
ctgttaatagttcagg

SEQ ID NO: 2215026 - DNA, 15 bp, Homo sapiens
ctgttcagctccagc

SEQ ID NO: 2215027 - DNA, 16 bp, Homo sapiens
ctgttcagctccagct

SEQ ID NO: 2215028 - DNA, 18 bp, Homo sapiens
ctgttcagctccagctca

SEQ ID NO: 2215029 - DNA, 12 bp, Homo sapiens
ctgttcagctgg

SEQ ID NO: 2215030 - DNA, 15 bp, Homo sapiens
ctgttctttccaaag

SEQ ID NO: 2215031 - DNA, 21 bp, Homo sapiens
ctgttctttccaaagtacact

SEQ ID NO: 2215032 - DNA, 16 bp, Homo sapiens
ctgttgcccaggctgg

SEQ ID NO: 2215033 - DNA, 14 bp, Homo sapiens
ctgttggctggggg

SEQ ID NO: 2215034 - DNA, 17 bp, Homo sapiens
ctgttgggccaggagcc

SEQ ID NO: 2215035 - DNA, 17 bp, Homo sapiens
ctgtttgctaagtgagg

SEQ ID NO: 2215036 - DNA, 21 bp, Homo sapiens
ctgtttgtttctgaaagggac

SEQ ID NO: 2215037 - DNA, 17 bp, Homo sapiens
cttaaaaagtggaaaaa

SEQ ID NO: 2215038 - DNA, 14 bp, Homo sapiens
cttaaaacaacact

SEQ ID NO: 2215039 - DNA, 14 bp, Homo sapiens
cttaaataatgtga

SEQ ID NO: 2215040 - DNA, 16 bp, Homo sapiens
cttaccagcagagcac

SEQ ID NO: 2215041 - DNA, 15 bp, Homo sapiens
cttagaagtcacaca

SEQ ID NO: 2215042 - DNA, 16 bp, Homo sapiens
cttagacagtccctgc

SEQ ID NO: 2215043 - DNA, 17 bp, Homo sapiens
cttagacagtccctgcc

SEQ ID NO: 2215044 - DNA, 18 bp, Homo sapiens
cttagacagtccctgcca

SEQ ID NO: 2215045 - DNA, 22 bp, Homo sapiens
cttagctcattctccttgtgtt

SEQ ID NO: 2215046 - DNA, 21 bp, Homo sapiens
cttaggttggcaaaaaggcag

SEQ ID NO: 2215047 - DNA, 23 bp, Homo sapiens
cttaggttggcaaaaaggcagga

SEQ ID NO: 2215048 - DNA, 19 bp, Homo sapiens
cttagtcactgagacagcc

SEQ ID NO: 2215049 - DNA, 17 bp, Homo sapiens
cttatggaacactctga

SEQ ID NO: 2215050 - DNA, 20 bp, Homo sapiens
cttatggaacactctgagac

SEQ ID NO: 2215051 - DNA, 12 bp, Homo sapiens
cttattgcccac

SEQ ID NO: 2215052 - DNA, 13 bp, Homo sapiens
cttattgcccacg

SEQ ID NO: 2215053 - DNA, 18 bp, Homo sapiens
cttatttaatgaaagact

SEQ ID NO: 2215054 - DNA, 10 bp, Homo sapiens
cttcaaggat

SEQ ID NO: 2215055 - DNA, 15 bp, Homo sapiens
cttcaaggatcctga

SEQ ID NO: 2215056 - DNA, 20 bp, Homo sapiens
cttcaaggatcctgagccag

SEQ ID NO: 2215057 - DNA, 18 bp, Homo sapiens
cttcagagactcctgcag

SEQ ID NO: 2215058 - DNA, 19 bp, Homo sapiens
cttcagagactcctgcagg

SEQ ID NO: 2215059 - DNA, 21 bp, Homo sapiens
cttcagagactcctgcaggca

SEQ ID NO: 2215060 - DNA, 22 bp, Homo sapiens
cttcagagactcctgcaggcag

SEQ ID NO: 2215061 - DNA, 14 bp, Homo sapiens
cttcagtaagccgt

SEQ ID NO: 2215062 - DNA, 13 bp, Homo sapiens
cttcagtggcagc

SEQ ID NO: 2215063 - DNA, 16 bp, Homo sapiens
cttcagtggcagctgc

SEQ ID NO: 2215064 - DNA, 18 bp, Homo sapiens
cttcagtggcagctgctt

SEQ ID NO: 2215065 - DNA, 22 bp, Homo sapiens
cttccacaagagcccaggcctc

SEQ ID NO: 2215066 - DNA, 12 bp, Homo sapiens
cttccaggctgg

SEQ ID NO: 2215067 - DNA, 16 bp, Homo sapiens
cttccaggctgggaga

SEQ ID NO: 2215068 - DNA, 22 bp, Homo sapiens
cttccaggggtgggacaccctg

SEQ ID NO: 2215069 - DNA, 16 bp, Homo sapiens
cttccatggactttgt

SEQ ID NO: 2215070 - DNA, 11 bp, Homo sapiens
cttcccacctc

SEQ ID NO: 2215071 - DNA, 13 bp, Homo sapiens
cttcctccctccc

SEQ ID NO: 2215072 - DNA, 18 bp, Homo sapiens
cttcctccctccctcttt

SEQ ID NO: 2215073 - DNA, 21 bp, Homo sapiens
cttcctctttccatctaccct

SEQ ID NO: 2215074 - DNA, 16 bp, Homo sapiens
cttcgctcctgtgtct

SEQ ID NO: 2215075 - DNA, 11 bp, Homo sapiens
cttctccactt

SEQ ID NO: 2215076 - DNA, 22 bp, Homo sapiens
cttctgacccatgctgccctgt

SEQ ID NO: 2215077 - DNA, 23 bp, Homo sapiens
cttctgacccatgctgccctgtg

SEQ ID NO: 2215078 - DNA, 20 bp, Homo sapiens
cttctgtacgtctgacaggc

SEQ ID NO: 2215079 - DNA, 18 bp, Homo sapiens
cttctgtcctactctgtg

SEQ ID NO: 2215080 - DNA, 14 bp, Homo sapiens
cttctgtgggtttc

SEQ ID NO: 2215081 - DNA, 16 bp, Homo sapiens
cttcttatacatttga

SEQ ID NO: 2215082 - DNA, 14 bp, Homo sapiens
cttcttcagagact

SEQ ID NO: 2215083 - DNA, 18 bp, Homo sapiens
cttcttcagagactcctg

SEQ ID NO: 2215084 - DNA, 23 bp, Homo sapiens
cttcttcagagactcctgcaggc

SEQ ID NO: 2215085 - DNA, 22 bp, Homo sapiens
cttctttataattctactttga

SEQ ID NO: 2215086 - DNA, 18 bp, Homo sapiens
cttgaaaaaaaaaaacac

SEQ ID NO: 2215087 - DNA, 19 bp, Homo sapiens
cttgaaatataggaactta

SEQ ID NO: 2215088 - DNA, 15 bp, Homo sapiens
cttgaactcctggcc

SEQ ID NO: 2215089 - DNA, 23 bp, Homo sapiens
ggggctgcaccggctggcctggc

SEQ ID NO: 2215090 - DNA, 17 bp, Homo sapiens
ggggctggaagcagaaa

SEQ ID NO: 2215091 - DNA, 20 bp, Homo sapiens
gggggagcaggcagtggggc

SEQ ID NO: 2215092 - DNA, 12 bp, Homo sapiens
gggggcctcagt

SEQ ID NO: 2215093 - DNA, 11 bp, Homo sapiens
gggggctggga

SEQ ID NO: 2215094 - DNA, 13 bp, Homo sapiens
ggggtaggaggaa

SEQ ID NO: 2215095 - DNA, 21 bp, Homo sapiens
ggggtcactctggcagctcag

SEQ ID NO: 2215096 - DNA, 22 bp, Homo sapiens
ggggtcactctggcagctcaga

SEQ ID NO: 2215097 - DNA, 17 bp, Homo sapiens
ggggtggggacctcagg

SEQ ID NO: 2215098 - DNA, 23 bp, Homo sapiens
ggggttcccttttttggctgctg

SEQ ID NO: 2215099 - DNA, 17 bp, Homo sapiens
gggtaagtgagagaggg

SEQ ID NO: 2215100 - DNA, 13 bp, Homo sapiens
gggtacccactgc

SEQ ID NO: 2215101 - DNA, 23 bp, Homo sapiens
gggtagagcggagaaaggaaggg

SEQ ID NO: 2215102 - DNA, 21 bp, Homo sapiens
gggtctgaggaatccagaccc

SEQ ID NO: 2215103 - DNA, 17 bp, Homo sapiens
gggtgaagtgaagacaa

SEQ ID NO: 2215104 - DNA, 13 bp, Homo sapiens
gggtggatgcctg

SEQ ID NO: 2215105 - DNA, 15 bp, Homo sapiens
gggtggcaccagcag

SEQ ID NO: 2215106 - DNA, 17 bp, Homo sapiens
gggtgggaggggaagaa

SEQ ID NO: 2215107 - DNA, 18 bp, Homo sapiens
gggtgggaggggaagaaa

SEQ ID NO: 2215108 - DNA, 22 bp, Homo sapiens
gggttctacccaggtgctagga

SEQ ID NO: 2215109 - DNA, 15 bp, Homo sapiens
gggttgggctggtgt

SEQ ID NO: 2215110 - DNA, 23 bp, Homo sapiens
gggttttgccatgttggccaggc

SEQ ID NO: 2215111 - DNA, 11 bp, Homo sapiens
ggtacccactg

SEQ ID NO: 2215112 - DNA, 22 bp, Homo sapiens
ggtatgatcacggctcactgca

SEQ ID NO: 2215113 - DNA, 14 bp, Homo sapiens
ggtatgcaatcaaa

SEQ ID NO: 2215114 - DNA, 12 bp, Homo sapiens
ggtcactctggc

SEQ ID NO: 2215115 - DNA, 16 bp, Homo sapiens
ggtcactctggcagct

SEQ ID NO: 2215116 - DNA, 22 bp, Homo sapiens
ggtcactctggcagctcagaga

SEQ ID NO: 2215117 - DNA, 12 bp, Homo sapiens
ggtcagagcctg

SEQ ID NO: 2215118 - DNA, 15 bp, Homo sapiens
ggtcagagcctgcag

SEQ ID NO: 2215119 - DNA, 19 bp, Homo sapiens
ggtccacccaggagccccg

SEQ ID NO: 2215120 - DNA, 12 bp, Homo sapiens
ggtcccacccca

SEQ ID NO: 2215121 - DNA, 14 bp, Homo sapiens
ggtcccaccccaca

SEQ ID NO: 2215122 - DNA, 16 bp, Homo sapiens
ggtcccaccccacaca

SEQ ID NO: 2215123 - DNA, 17 bp, Homo sapiens
ggtcccaccccacacac

SEQ ID NO: 2215124 - DNA, 22 bp, Homo sapiens
ggtcccactcagtccatagcag

SEQ ID NO: 2215125 - DNA, 13 bp, Homo sapiens
ggtcccccttcca

SEQ ID NO: 2215126 - DNA, 18 bp, Homo sapiens
ggtcccccttccatggac

SEQ ID NO: 2215127 - DNA, 22 bp, Homo sapiens
ggtccctggtggcagctcacct

SEQ ID NO: 2215128 - DNA, 23 bp, Homo sapiens
ggtcctagaaattccccaccctg

SEQ ID NO: 2215129 - DNA, 12 bp, Homo sapiens
ggtctcactctg

SEQ ID NO: 2215130 - DNA, 19 bp, Homo sapiens
ggtctgaggaatccagacc

SEQ ID NO: 2215131 - DNA, 12 bp, Homo sapiens
ggtctgcaggga

SEQ ID NO: 2215132 - DNA, 17 bp, Homo sapiens
ggtctgttctttccaaa

SEQ ID NO: 2215133 - DNA, 22 bp, Homo sapiens
ggtcttgaactcctggcctcaa

SEQ ID NO: 2215134 - DNA, 21 bp, Homo sapiens
ggtgacagagtgagactctgt

SEQ ID NO: 2215135 - DNA, 16 bp, Homo sapiens
ggtgacctctgcctga

SEQ ID NO: 2215136 - DNA, 17 bp, Homo sapiens
ggtgagcactctggggt

SEQ ID NO: 2215137 - DNA, 12 bp, Homo sapiens
ggtgcaatgacc

SEQ ID NO: 2215138 - DNA, 16 bp, Homo sapiens
ggtgcaatgacctttc

SEQ ID NO: 2215139 - DNA, 19 bp, Homo sapiens
ggtgcaatgacctttcaat

SEQ ID NO: 2215140 - DNA, 22 bp, Homo sapiens
ggtgcacaagctccaagctccc

SEQ ID NO: 2215141 - DNA, 21 bp, Homo sapiens
ggtgcatttgaggtctgttct

SEQ ID NO: 2215142 - DNA, 15 bp, Homo sapiens
ggtgcgatctgggtt

SEQ ID NO: 2215143 - DNA, 21 bp, Homo sapiens
ggtgctatctcccccagcccc

SEQ ID NO: 2215144 - DNA, 14 bp, Homo sapiens
ggtggatgcctggt

SEQ ID NO: 2215145 - DNA, 21 bp, Homo sapiens
ggtggatgcctggtggcagct

SEQ ID NO: 2215146 - DNA, 16 bp, Homo sapiens
ggtggcagtgggagct

SEQ ID NO: 2215147 - DNA, 19 bp, Homo sapiens
gtcttttcttgcatgaggc

SEQ ID NO: 2215148 - DNA, 16 bp, Homo sapiens
gtcttttttcactaca

SEQ ID NO: 2215149 - DNA, 23 bp, Homo sapiens
gtgaagacaatgacttactgtac

SEQ ID NO: 2215150 - DNA, 16 bp, Homo sapiens
gtgacaacacttgtgt

SEQ ID NO: 2215151 - DNA, 12 bp, Homo sapiens
gtgacagaggca

SEQ ID NO: 2215152 - DNA, 13 bp, Homo sapiens
gtgacagaggcag

SEQ ID NO: 2215153 - DNA, 16 bp, Homo sapiens
gtgacagaggcagccc

SEQ ID NO: 2215154 - DNA, 12 bp, Homo sapiens
gtgacctctgcc

SEQ ID NO: 2215155 - DNA, 17 bp, Homo sapiens
gtgactgatctctcgtg

SEQ ID NO: 2215156 - DNA, 13 bp, Homo sapiens
gtgagagctgggt

SEQ ID NO: 2215157 - DNA, 21 bp, Homo sapiens
gtgagcactaaggtgtgctct

SEQ ID NO: 2215158 - DNA, 11 bp, Homo sapiens
gtgaggaagcc

SEQ ID NO: 2215159 - DNA, 16 bp, Homo sapiens
gtgaggaagccgctgg

SEQ ID NO: 2215160 - DNA, 12 bp, Homo sapiens
gtgaggctctgc

SEQ ID NO: 2215161 - DNA, 13 bp, Homo sapiens
gtgaggctctgcc

SEQ ID NO: 2215162 - DNA, 17 bp, Homo sapiens
gtgaggctctgcccttg

SEQ ID NO: 2215163 - DNA, 18 bp, Homo sapiens
gtgaggctctgcccttgg

SEQ ID NO: 2215164 - DNA, 17 bp, Homo sapiens
gtgagtcaccaagccca

SEQ ID NO: 2215165 - DNA, 19 bp, Homo sapiens
gtgagtcaccaagcccagt

SEQ ID NO: 2215166 - DNA, 15 bp, Homo sapiens
gtgagtcgaggacag

SEQ ID NO: 2215167 - DNA, 17 bp, Homo sapiens
gtgagttgatagcacag

SEQ ID NO: 2215168 - DNA, 22 bp, Homo sapiens
gtgatccacccacctcagcctc

SEQ ID NO: 2215169 - DNA, 14 bp, Homo sapiens
gtgatgagaggaaa

SEQ ID NO: 2215170 - DNA, 19 bp, Homo sapiens
gtgatggggccctgcctcc

SEQ ID NO: 2215171 - DNA, 19 bp, Homo sapiens
gtgattctcctgcctcagc

SEQ ID NO: 2215172 - DNA, 18 bp, Homo sapiens
gtgcaatgacctttcaat

SEQ ID NO: 2215173 - DNA, 21 bp, Homo sapiens
gtgcacacaccagagcccacc

SEQ ID NO: 2215174 - DNA, 18 bp, Homo sapiens
gtgcacgtacacacacat

SEQ ID NO: 2215175 - DNA, 23 bp, Homo sapiens
gtgcagtggtgcgatctgggttc

SEQ ID NO: 2215176 - DNA, 22 bp, Homo sapiens
gtgcataccacttttgttcttg

SEQ ID NO: 2215177 - DNA, 17 bp, Homo sapiens
gtgcatttgaggtctgt

SEQ ID NO: 2215178 - DNA, 23 bp, Homo sapiens
gtgccaaaaacaacaacaaaatg

SEQ ID NO: 2215179 - DNA, 22 bp, Homo sapiens
gtgccaggtttttggtctgacc

SEQ ID NO: 2215180 - DNA, 20 bp, Homo sapiens
gtgcccccacccccaccctc

SEQ ID NO: 2215181 - DNA, 15 bp, Homo sapiens
gtgcctcaagagaag

SEQ ID NO: 2215182 - DNA, 13 bp, Homo sapiens
gtgcctctgggac

SEQ ID NO: 2215183 - DNA, 15 bp, Homo sapiens
gtgcctctgggactg

SEQ ID NO: 2215184 - DNA, 21 bp, Homo sapiens
gtgccttatggaacactctga

SEQ ID NO: 2215185 - DNA, 18 bp, Homo sapiens
gtgctaggaacactcctt

SEQ ID NO: 2215186 - DNA, 15 bp, Homo sapiens
gtgctatctccccca

SEQ ID NO: 2215187 - DNA, 20 bp, Homo sapiens
gtgctgaatggttttcaaaa

SEQ ID NO: 2215188 - DNA, 23 bp, Homo sapiens
gtgctgaatggttttcaaaataa

SEQ ID NO: 2215189 - DNA, 16 bp, Homo sapiens
gtgctgagtctgaagg

SEQ ID NO: 2215190 - DNA, 19 bp, Homo sapiens
gtgctgcatttaaaagata

SEQ ID NO: 2215191 - DNA, 20 bp, Homo sapiens
gtgctgcatttaaaagatac

SEQ ID NO: 2215192 - DNA, 15 bp, Homo sapiens
gtgctgccatccagg

SEQ ID NO: 2215193 - DNA, 22 bp, Homo sapiens
gtgctgccatccaggttcagct

SEQ ID NO: 2215194 - DNA, 11 bp, Homo sapiens
gtgctgccctg

SEQ ID NO: 2215195 - DNA, 21 bp, Homo sapiens
gtgctgccctgcccacctggc

SEQ ID NO: 2215196 - DNA, 23 bp, Homo sapiens
gtgctgccctgcccacctggcct

SEQ ID NO: 2215197 - DNA, 18 bp, Homo sapiens
gtggaatgcgggggagca

SEQ ID NO: 2215198 - DNA, 19 bp, Homo sapiens
gtggaatgcgggggagcag

SEQ ID NO: 2215199 - DNA, 22 bp, Homo sapiens
gtggaatgcgggggagcaggca

SEQ ID NO: 2215200 - DNA, 18 bp, Homo sapiens
gtggacacagctcttctc

SEQ ID NO: 2215201 - DNA, 19 bp, Homo sapiens
gtggatttaacagaaatgt

SEQ ID NO: 2215202 - DNA, 19 bp, Homo sapiens
gtggcagctgcggtccacc

SEQ ID NO: 2215203 - DNA, 13 bp, Homo sapiens
gtggcagctgctt

SEQ ID NO: 2215204 - DNA, 16 bp, Homo sapiens
gtggcagtgggagctg

SEQ ID NO: 2215205 - DNA, 21 bp, Homo sapiens
gtggcagtgggagctgcctgt

SEQ ID NO: 2215206 - DNA, 21 bp, Homo sapiens
gtggcctcccaactcacccca

SEQ ID NO: 2215207 - DNA, 14 bp, Homo sapiens
gtggctcacgcctg

SEQ ID NO: 2215208 - DNA, 14 bp, Homo sapiens
gtggctgcttcaag

SEQ ID NO: 2215209 - DNA, 23 bp, Homo sapiens
gtggctgcttcaaggatcctgag

SEQ ID NO: 2215210 - DNA, 15 bp, Homo sapiens
gtgggagctgcctgt

SEQ ID NO: 2215211 - DNA, 15 bp, Homo sapiens
gtgggaggggaagaa

SEQ ID NO: 2215212 - DNA, 20 bp, Homo sapiens
gtgggagggtctgcagggaa

SEQ ID NO: 2215213 - DNA, 13 bp, Homo sapiens
gtgggagtgggcc

SEQ ID NO: 2215214 - DNA, 13 bp, Homo sapiens
gtggggcagcttg

SEQ ID NO: 2215215 - DNA, 16 bp, Homo sapiens
gtggggctggaagcag

SEQ ID NO: 2215216 - DNA, 17 bp, Homo sapiens
gtggggtcactctggca

SEQ ID NO: 2215217 - DNA, 14 bp, Homo sapiens
gtgggtacgggagg

SEQ ID NO: 2215218 - DNA, 23 bp, Homo sapiens
gtgggtttctaaagctgccagcc

SEQ ID NO: 2215219 - DNA, 21 bp, Homo sapiens
gtggtgagaggcatccagtat

SEQ ID NO: 2215220 - DNA, 14 bp, Homo sapiens
gtggtggttttctg

SEQ ID NO: 2215221 - DNA, 21 bp, Homo sapiens
gtgtaagtattcttatttaat

SEQ ID NO: 2215222 - DNA, 17 bp, Homo sapiens
gtgtacatggaataaca

SEQ ID NO: 2215223 - DNA, 19 bp, Homo sapiens
gtgtcaggtggggcagctt

SEQ ID NO: 2215224 - DNA, 19 bp, Homo sapiens
gttggccaggctggtctca

SEQ ID NO: 2215225 - DNA, 14 bp, Homo sapiens
gttggcccctgccc

SEQ ID NO: 2215226 - DNA, 23 bp, Homo sapiens
gttggctgggggcctcagtgcca

SEQ ID NO: 2215227 - DNA, 17 bp, Homo sapiens
gttgggctggtgtcacc

SEQ ID NO: 2215228 - DNA, 13 bp, Homo sapiens
gttgggtggatgc

SEQ ID NO: 2215229 - DNA, 18 bp, Homo sapiens
gttggtcccccttccatg

SEQ ID NO: 2215230 - DNA, 15 bp, Homo sapiens
gttgttacattttta

SEQ ID NO: 2215231 - DNA, 20 bp, Homo sapiens
gttgtttgattcagacagct

SEQ ID NO: 2215232 - DNA, 15 bp, Homo sapiens
gtttagataatacac

SEQ ID NO: 2215233 - DNA, 13 bp, Homo sapiens
gtttcaaacttta

SEQ ID NO: 2215234 - DNA, 18 bp, Homo sapiens
gtttcagaaatgtgttat

SEQ ID NO: 2215235 - DNA, 21 bp, Homo sapiens
gtttcctggcactgcttccag

SEQ ID NO: 2215236 - DNA, 22 bp, Homo sapiens
gtttcctggcactgcttccagt

SEQ ID NO: 2215237 - DNA, 22 bp, Homo sapiens
gtttctatgacacatgcaaggt

SEQ ID NO: 2215238 - DNA, 18 bp, Homo sapiens
gtttctgaaagggacgct

SEQ ID NO: 2215239 - DNA, 15 bp, Homo sapiens
gtttctgccgcagcc

SEQ ID NO: 2215240 - DNA, 18 bp, Homo sapiens
gtttctgccgcagccctg

SEQ ID NO: 2215241 - DNA, 16 bp, Homo sapiens
gtttgaaccaagaact

SEQ ID NO: 2215242 - DNA, 18 bp, Homo sapiens
gtttgagatcagcctggg

SEQ ID NO: 2215243 - DNA, 20 bp, Homo sapiens
gtttgattcagacagctgcc

SEQ ID NO: 2215244 - DNA, 18 bp, Homo sapiens
gtttgtttctgaaaggga

SEQ ID NO: 2215245 - DNA, 14 bp, Homo sapiens
gttttaagaggcag

SEQ ID NO: 2215246 - DNA, 15 bp, Homo sapiens
gttttactgcagctt

SEQ ID NO: 2215247 - DNA, 16 bp, Homo sapiens
gttttcagtgtacatg

SEQ ID NO: 2215248 - DNA, 20 bp, Homo sapiens
gttttccaggtttaagctgt

SEQ ID NO: 2215249 - DNA, 19 bp, Homo sapiens
gttttccatgagtcccctg

SEQ ID NO: 2215250 - DNA, 19 bp, Homo sapiens
gttttctcttgagagggtg

SEQ ID NO: 2215251 - DNA, 11 bp, Homo sapiens
gttttctgttc

SEQ ID NO: 2215252 - DNA, 14 bp, Homo sapiens
gttttctgttcttt

SEQ ID NO: 2215253 - DNA, 16 bp, Homo sapiens
gttttctgttctttct

SEQ ID NO: 2215254 - DNA, 22 bp, Homo sapiens
gtttttatggcttttgtgcatt

SEQ ID NO: 2215255 - DNA, 10 bp, Homo sapiens
taaaaaggga

SEQ ID NO: 2215256 - DNA, 12 bp, Homo sapiens
taaaaagggaaa

SEQ ID NO: 2215257 - DNA, 13 bp, Homo sapiens
taaaaagggaaaa

SEQ ID NO: 2215258 - DNA, 19 bp, Homo sapiens
taaaaatctcaaatttcta

SEQ ID NO: 2215259 - DNA, 20 bp, Homo sapiens
taaaaatctcaaatttctaa

SEQ ID NO: 2215260 - DNA, 12 bp, Homo sapiens
taaaacttttta

SEQ ID NO: 2215261 - DNA, 20 bp, Homo sapiens
taaaagatacagttactcag

SEQ ID NO: 2215262 - DNA, 19 bp, Homo sapiens
taaaaggtgaccaatgatg

SEQ ID NO: 2215263 - DNA, 13 bp, Homo sapiens
taaaagtcttgtg

SEQ ID NO: 2215264 - DNA, 22 bp, Homo sapiens
taaaataccagccagtaaatgg

SEQ ID NO: 2215265 - DNA, 20 bp, Homo sapiens
taaacaagaccacgtttcta

SEQ ID NO: 2215266 - DNA, 22 bp, Homo sapiens
taaacaagaccacgtttctaaa

SEQ ID NO: 2215267 - DNA, 18 bp, Homo sapiens
taaacttaatctaaatgg

SEQ ID NO: 2215268 - DNA, 22 bp, Homo sapiens
taaactttaccttttttataca

SEQ ID NO: 2215269 - DNA, 15 bp, Homo sapiens
taaaggctacctttg

SEQ ID NO: 2215270 - DNA, 14 bp, Homo sapiens
taaagtgtattttt

SEQ ID NO: 2215271 - DNA, 23 bp, Homo sapiens
taaagtgtatttttttactaata

SEQ ID NO: 2215272 - DNA, 19 bp, Homo sapiens
taaataatgtgaaactgga

SEQ ID NO: 2215273 - DNA, 13 bp, Homo sapiens
taaatgcccagcc

SEQ ID NO: 2215274 - DNA, 15 bp, Homo sapiens
taaatgcccagcccc

SEQ ID NO: 2215275 - DNA, 17 bp, Homo sapiens
taaatgcccagcccctt

SEQ ID NO: 2215276 - DNA, 16 bp, Homo sapiens
taaatggaaccactct

SEQ ID NO: 2215277 - DNA, 19 bp, Homo sapiens
taaatgggggtgcatttga

SEQ ID NO: 2215278 - DNA, 20 bp, Homo sapiens
taaatgttgaaagatcaaaa

SEQ ID NO: 2215279 - DNA, 16 bp, Homo sapiens
taaattaacttttata

SEQ ID NO: 2215280 - DNA, 11 bp, Homo sapiens
taaattatttt

SEQ ID NO: 2215281 - DNA, 18 bp, Homo sapiens
taacaccatgattaacca

SEQ ID NO: 2215282 - DNA, 11 bp, Homo sapiens
taacagaaatg

SEQ ID NO: 2215283 - DNA, 15 bp, Homo sapiens
taacagaaatgtaca

SEQ ID NO: 2215284 - DNA, 15 bp, Homo sapiens
taacatggaagtact

SEQ ID NO: 2215285 - DNA, 16 bp, Homo sapiens
taaccacttcagctga

SEQ ID NO: 2215286 - DNA, 14 bp, Homo sapiens
taaccagcagaaat

SEQ ID NO: 2215287 - DNA, 19 bp, Homo sapiens
taaccagcagaaatgcctt

SEQ ID NO: 2215288 - DNA, 23 bp, Homo sapiens
taaccagtgttgtggatttaaca

SEQ ID NO: 2215289 - DNA, 15 bp, Homo sapiens
taactaaaaggtatg

SEQ ID NO: 2215290 - DNA, 21 bp, Homo sapiens
taacttcacatattgatttcc

SEQ ID NO: 2215291 - DNA, 14 bp, Homo sapiens
taacttcaccatat

SEQ ID NO: 2215292 - DNA, 17 bp, Homo sapiens
taacttccaatttacat

SEQ ID NO: 2215293 - DNA, 15 bp, Homo sapiens
taacttttataaact

SEQ ID NO: 2215294 - DNA, 21 bp, Homo sapiens
taacttttataaactttacct

SEQ ID NO: 2215295 - DNA, 23 bp, Homo sapiens
taagaaaaaggatgcacagagtt

SEQ ID NO: 2215296 - DNA, 24 bp, Homo sapiens
taagaaagactatctaaatgttga

SEQ ID NO: 2215297 - DNA, 19 bp, Homo sapiens
taagaaccttttgagtgcc

SEQ ID NO: 2215298 - DNA, 15 bp, Homo sapiens
taagagaaatgagct

SEQ ID NO: 2215299 - DNA, 12 bp, Homo sapiens
taagaggcaggg

SEQ ID NO: 2215300 - DNA, 14 bp, Homo sapiens
taagctattcagta

SEQ ID NO: 2215301 - DNA, 22 bp, Homo sapiens
taagctgttactgtcttcagta

SEQ ID NO: 2215302 - DNA, 19 bp, Homo sapiens
taagtactatgtatcaatg

SEQ ID NO: 2215303 - DNA, 23 bp, Homo sapiens
taagtgaggatgaaaaaataaca

SEQ ID NO: 2215304 - DNA, 15 bp, Homo sapiens
taagtgctgcattta

SEQ ID NO: 2215305 - DNA, 22 bp, Homo sapiens
taatacaccactacattctgtt

SEQ ID NO: 2215306 - DNA, 23 bp, Homo sapiens
taatacaccactacattctgtta

SEQ ID NO: 2215307 - DNA, 14 bp, Homo sapiens
taatagacaattta

SEQ ID NO: 2215308 - DNA, 16 bp, Homo sapiens
taatagacaatttatt

SEQ ID NO: 2215309 - DNA, 18 bp, Homo sapiens
taatagacaatttattat

SEQ ID NO: 2215310 - DNA, 14 bp, Homo sapiens
aaagatgcttctca

SEQ ID NO: 2215311 - DNA, 13 bp, Homo sapiens
aaagcaaaggaga

SEQ ID NO: 2215312 - DNA, 16 bp, Homo sapiens
aaagcagcgtttctat

SEQ ID NO: 2215313 - DNA, 18 bp, Homo sapiens
aaagctaggcctggccag

SEQ ID NO: 2215314 - DNA, 12 bp, Homo sapiens
aaagctgccagc

SEQ ID NO: 2215315 - DNA, 13 bp, Homo sapiens
aaagctgccagcc

SEQ ID NO: 2215316 - DNA, 20 bp, Homo sapiens
aaaggatgcccaaagatgca

SEQ ID NO: 2215317 - DNA, 17 bp, Homo sapiens
aaaggctacctttgtat

SEQ ID NO: 2215318 - DNA, 15 bp, Homo sapiens
aaaggctccaggagc

SEQ ID NO: 2215319 - DNA, 15 bp, Homo sapiens
aaagggaaaaagacc

SEQ ID NO: 2215320 - DNA, 14 bp, Homo sapiens
aaaggggggtggga

SEQ ID NO: 2215321 - DNA, 22 bp, Homo sapiens
aaagtagaagtcttagatgtat

SEQ ID NO: 2215322 - DNA, 14 bp, Homo sapiens
aaagtgctgggatt

SEQ ID NO: 2215323 - DNA, 21 bp, Homo sapiens
aaagtttctcttttcaaaaca

SEQ ID NO: 2215324 - DNA, 17 bp, Homo sapiens
aaatacagatagatata

SEQ ID NO: 2215325 - DNA, 21 bp, Homo sapiens
aaataccagccagtaaatggg

SEQ ID NO: 2215326 - DNA, 17 bp, Homo sapiens
aaatatctgaaaatgta

SEQ ID NO: 2215327 - DNA, 18 bp, Homo sapiens
aaatatctgaaaatgtat

SEQ ID NO: 2215328 - DNA, 21 bp, Homo sapiens
aaatatctgaaaatgtatgtg

SEQ ID NO: 2215329 - DNA, 22 bp, Homo sapiens
aaatatctgaaaatgtatgtgt

SEQ ID NO: 2215330 - DNA, 18 bp, Homo sapiens
aaatcagcctgctccagc

SEQ ID NO: 2215331 - DNA, 13 bp, Homo sapiens
aaatcgatgcagt

SEQ ID NO: 2215332 - DNA, 19 bp, Homo sapiens
aaatctccaaaataaaact

SEQ ID NO: 2215333 - DNA, 22 bp, Homo sapiens
aaatctccaaaataaaactttt

SEQ ID NO: 2215334 - DNA, 16 bp, Homo sapiens
aaatgaggtactctcc

SEQ ID NO: 2215335 - DNA, 13 bp, Homo sapiens
aaatgcccagccc

SEQ ID NO: 2215336 - DNA, 18 bp, Homo sapiens
aaatgcccagccccttct

SEQ ID NO: 2215337 - DNA, 22 bp, Homo sapiens
aaatggacgtgttatgactcca

SEQ ID NO: 2215338 - DNA, 18 bp, Homo sapiens
aaatgggcagagcagaga

SEQ ID NO: 2215339 - DNA, 16 bp, Homo sapiens
aaatgggggtgcattt

SEQ ID NO: 2215340 - DNA, 24 bp, Homo sapiens
aaatgtctagttgtaacaccatga

SEQ ID NO: 2215341 - DNA, 12 bp, Homo sapiens
aaattaactttt

SEQ ID NO: 2215342 - DNA, 14 bp, Homo sapiens
aaattcatgctgct

SEQ ID NO: 2215343 - DNA, 18 bp, Homo sapiens
aaattttgatgttttaag

SEQ ID NO: 2215344 - DNA, 17 bp, Homo sapiens
aacaagaccacgtttct

SEQ ID NO: 2215345 - DNA, 15 bp, Homo sapiens
aacaaggcaaggctg

SEQ ID NO: 2215346 - DNA, 16 bp, Homo sapiens
aacaaggcaaggctgt

SEQ ID NO: 2215347 - DNA, 14 bp, Homo sapiens
aacacaaaaaaaga

SEQ ID NO: 2215348 - DNA, 19 bp, Homo sapiens
aacacaaacgggctcagca

SEQ ID NO: 2215349 - DNA, 17 bp, Homo sapiens
aacactcattgacctga

SEQ ID NO: 2215350 - DNA, 21 bp, Homo sapiens
aacactcattgacctgaggcc

SEQ ID NO: 2215351 - DNA, 11 bp, Homo sapiens
aacactctgag

SEQ ID NO: 2215352 - DNA, 13 bp, Homo sapiens
aacactctgagac

SEQ ID NO: 2215353 - DNA, 16 bp, Homo sapiens
aacactgttctctgcc

SEQ ID NO: 2215354 - DNA, 17 bp, Homo sapiens
aacactgttctctgccc

SEQ ID NO: 2215355 - DNA, 12 bp, Homo sapiens
aagttaaataaa

SEQ ID NO: 2215356 - DNA, 14 bp, Homo sapiens
aagttaaataaatc

SEQ ID NO: 2215357 - DNA, 20 bp, Homo sapiens
aagtttttatggcttttgtg

SEQ ID NO: 2215358 - DNA, 14 bp, Homo sapiens
aataaagcagcgtt

SEQ ID NO: 2215359 - DNA, 14 bp, Homo sapiens
aataaagtaattat

SEQ ID NO: 2215360 - DNA, 16 bp, Homo sapiens
aataaatcataaaact

SEQ ID NO: 2215361 - DNA, 22 bp, Homo sapiens
aataacatgtaattaagtacta

SEQ ID NO: 2215362 - DNA, 16 bp, Homo sapiens
aatacaccactacatt

SEQ ID NO: 2215363 - DNA, 18 bp, Homo sapiens
aatacctgtccccctgac

SEQ ID NO: 2215364 - DNA, 19 bp, Homo sapiens
aatacctgtccccctgaca

SEQ ID NO: 2215365 - DNA, 13 bp, Homo sapiens
aatagacaattta

SEQ ID NO: 2215366 - DNA, 23 bp, Homo sapiens
aatagacaatttattatggcaca

SEQ ID NO: 2215367 - DNA, 20 bp, Homo sapiens
aatagcctgcctcttctcta

SEQ ID NO: 2215368 - DNA, 19 bp, Homo sapiens
aataggaaaaactgatttt

SEQ ID NO: 2215369 - DNA, 22 bp, Homo sapiens
aatagtggtgtgatttggggat

SEQ ID NO: 2215370 - DNA, 18 bp, Homo sapiens
aatatctgaaaatgtatg

SEQ ID NO: 2215371 - DNA, 19 bp, Homo sapiens
aatatctgaaaatgtatgt

SEQ ID NO: 2215372 - DNA, 16 bp, Homo sapiens
aatatgcacacatttt

SEQ ID NO: 2215373 - DNA, 17 bp, Homo sapiens
aatatgcacacattttt

SEQ ID NO: 2215374 - DNA, 22 bp, Homo sapiens
aatatgcacacattttttaaat

SEQ ID NO: 2215375 - DNA, 17 bp, Homo sapiens
aatattgatatgcttat

SEQ ID NO: 2215376 - DNA, 12 bp, Homo sapiens
aatattgctgat

SEQ ID NO: 2215377 - DNA, 21 bp, Homo sapiens
aatcaccgaaaacgtggctgc

SEQ ID NO: 2215378 - DNA, 13 bp, Homo sapiens
aatcagcctgctc

SEQ ID NO: 2215379 - DNA, 17 bp, Homo sapiens
aatccagacccggctgc

SEQ ID NO: 2215380 - DNA, 13 bp, Homo sapiens
aatctaaatggaa

SEQ ID NO: 2215381 - DNA, 14 bp, Homo sapiens
aatctcaaatttct

SEQ ID NO: 2215382 - DNA, 16 bp, Homo sapiens
aatctcaaatttctaa

SEQ ID NO: 2215383 - DNA, 22 bp, Homo sapiens
aatctgctttttaaagaatgct

SEQ ID NO: 2215384 - DNA, 13 bp, Homo sapiens
aatcttctgaact

SEQ ID NO: 2215385 - DNA, 20 bp, Homo sapiens
aatcttctgaacttggcgct

SEQ ID NO: 2215386 - DNA, 18 bp, Homo sapiens
aatgaaagactgtacaaa

SEQ ID NO: 2215387 - DNA, 21 bp, Homo sapiens
aatgaaagactgtacaaagta

SEQ ID NO: 2215388 - DNA, 14 bp, Homo sapiens
aatgaatgaaacat

SEQ ID NO: 2215389 - DNA, 13 bp, Homo sapiens
aatgacctttcaa

SEQ ID NO: 2215390 - DNA, 14 bp, Homo sapiens
aatgacttactgta

SEQ ID NO: 2215391 - DNA, 17 bp, Homo sapiens
aatgacttactgtacat

SEQ ID NO: 2215392 - DNA, 14 bp, Homo sapiens
aatgagcctggcaa

SEQ ID NO: 2215393 - DNA, 15 bp, Homo sapiens
aatgatagctactgt

SEQ ID NO: 2215394 - DNA, 22 bp, Homo sapiens
aatgcaaaccatcattgaaatc

SEQ ID NO: 2215395 - DNA, 23 bp, Homo sapiens
aatgcaaaccatcattgaaatct

SEQ ID NO: 2215396 - DNA, 18 bp, Homo sapiens
aatgcacaaacagaggcc

SEQ ID NO: 2215397 - DNA, 11 bp, Homo sapiens
aatgcagagat

SEQ ID NO: 2215398 - DNA, 11 bp, Homo sapiens
aatgcccagcc

SEQ ID NO: 2215399 - DNA, 13 bp, Homo sapiens
aatgcccagcccc

SEQ ID NO: 2215400 - DNA, 15 bp, Homo sapiens
aatgcccagcccctt

SEQ ID NO: 2215401 - DNA, 21 bp, Homo sapiens
aatgcgtgcataccacttttg

SEQ ID NO: 2215402 - DNA, 23 bp, Homo sapiens
aatgcgtgcataccacttttgtt

SEQ ID NO: 2215403 - DNA, 20 bp, Homo sapiens
aatggaaatgggcagagcag

SEQ ID NO: 2215404 - DNA, 16 bp, Homo sapiens
aatggacgtgttatga

SEQ ID NO: 2215405 - DNA, 15 bp, Homo sapiens
aatgtaagctctact

SEQ ID NO: 2215406 - DNA, 14 bp, Homo sapiens
aatgtatgtgtaag

SEQ ID NO: 2215407 - DNA, 19 bp, Homo sapiens
aatgtcacaggcaggtcca

SEQ ID NO: 2215408 - DNA, 16 bp, Homo sapiens
aatgtcagtgtgactg

SEQ ID NO: 2215409 - DNA, 15 bp, Homo sapiens
aatgtgaaaagaaaa

SEQ ID NO: 2215410 - DNA, 22 bp, Homo sapiens
aatgtgaaactggattaaactt

SEQ ID NO: 2215411 - DNA, 18 bp, Homo sapiens
aatgtttgcctctgcctc

SEQ ID NO: 2215412 - DNA, 12 bp, Homo sapiens
aattaactttta

SEQ ID NO: 2215413 - DNA, 13 bp, Homo sapiens
aattaacttttat

SEQ ID NO: 2215414 - DNA, 16 bp, Homo sapiens
aattaacttttataaa

SEQ ID NO: 2215415 - DNA, 18 bp, Homo sapiens
aattaacttttataaact

SEQ ID NO: 2215416 - DNA, 16 bp, Homo sapiens
aattaagtactatgta

SEQ ID NO: 2215417 - DNA, 17 bp, Homo sapiens
aattaagtactatgtat

SEQ ID NO: 2215418 - DNA, 17 bp, Homo sapiens
aattacaggaagtactg

SEQ ID NO: 2215419 - DNA, 15 bp, Homo sapiens
aattagccaagtgtg

SEQ ID NO: 2215420 - DNA, 21 bp, Homo sapiens
aattatttattaaatgcccag

SEQ ID NO: 2215421 - DNA, 17 bp, Homo sapiens
aattcagttgttagtgt

SEQ ID NO: 2215422 - DNA, 15 bp, Homo sapiens
accctcatgttctta

SEQ ID NO: 2215423 - DNA, 16 bp, Homo sapiens
accctgaaagccctga

SEQ ID NO: 2215424 - DNA, 18 bp, Homo sapiens
accctgaaagccctgagc

SEQ ID NO: 2215425 - DNA, 17 bp, Homo sapiens
accctgaggcccagagg

SEQ ID NO: 2215426 - DNA, 19 bp, Homo sapiens
accctgaggcccagagggc

SEQ ID NO: 2215427 - DNA, 23 bp, Homo sapiens
accctgaggcccagagggcctgc

SEQ ID NO: 2215428 - DNA, 11 bp, Homo sapiens
accctgccctg

SEQ ID NO: 2215429 - DNA, 13 bp, Homo sapiens
accctgccctgtg

SEQ ID NO: 2215430 - DNA, 14 bp, Homo sapiens
accctgccctgtgg

SEQ ID NO: 2215431 - DNA, 17 bp, Homo sapiens
accctgccctgtgggcc

SEQ ID NO: 2215432 - DNA, 16 bp, Homo sapiens
accctgtgatggggcc

SEQ ID NO: 2215433 - DNA, 21 bp, Homo sapiens
accctgtgatggggccctgcc

SEQ ID NO: 2215434 - DNA, 22 bp, Homo sapiens
accctgtgatggggccctgcct

SEQ ID NO: 2215435 - DNA, 17 bp, Homo sapiens
accctgttaccattttg

SEQ ID NO: 2215436 - DNA, 17 bp, Homo sapiens
acccttgccgtctacct

SEQ ID NO: 2215437 - DNA, 15 bp, Homo sapiens
acccttgtggtccca

SEQ ID NO: 2215438 - DNA, 16 bp, Homo sapiens
acccttgtggtcccac

SEQ ID NO: 2215439 - DNA, 20 bp, Homo sapiens
acccttgtggtcccacccca

SEQ ID NO: 2215440 - DNA, 23 bp, Homo sapiens
acccttgtggtcccaccccacac

SEQ ID NO: 2215441 - DNA, 20 bp, Homo sapiens
accgaaaacgtggctgcttc

SEQ ID NO: 2215442 - DNA, 21 bp, Homo sapiens
accgaaaacgtggctgcttca

SEQ ID NO: 2215443 - DNA, 16 bp, Homo sapiens
accgggcactcagaag

SEQ ID NO: 2215444 - DNA, 14 bp, Homo sapiens
accgtgaggagggg

SEQ ID NO: 2215445 - DNA, 16 bp, Homo sapiens
acctaggtggggcctg

SEQ ID NO: 2215446 - DNA, 13 bp, Homo sapiens
acctcaggcctgg

SEQ ID NO: 2215447 - DNA, 22 bp, Homo sapiens
acctcaggcctgggggctgggc

SEQ ID NO: 2215448 - DNA, 12 bp, Homo sapiens
acctcctgcctc

SEQ ID NO: 2215449 - DNA, 13 bp, Homo sapiens
acctcctgggcta

SEQ ID NO: 2215450 - DNA, 19 bp, Homo sapiens
acctcggtgccttcctctt

SEQ ID NO: 2215451 - DNA, 15 bp, Homo sapiens
acctctcccttggat

SEQ ID NO: 2215452 - DNA, 23 bp, Homo sapiens
acctctcccttggattgtccccg

SEQ ID NO: 2215453 - DNA, 14 bp, Homo sapiens
acctctctcactcc

SEQ ID NO: 2215454 - DNA, 15 bp, Homo sapiens
acctctgcagcaata

SEQ ID NO: 2215455 - DNA, 19 bp, Homo sapiens
acctcttgagccttgaact

SEQ ID NO: 2215456 - DNA, 20 bp, Homo sapiens
acctcttgagccttgaactt

SEQ ID NO: 2215457 - DNA, 16 bp, Homo sapiens
acctgaggcccttctc

SEQ ID NO: 2215458 - DNA, 22 bp, Homo sapiens
acctgaggcccttctctccagc

SEQ ID NO: 2215459 - DNA, 14 bp, Homo sapiens
acctgattgtgtct

SEQ ID NO: 2215460 - DNA, 14 bp, Homo sapiens
acctgccaggaagc

SEQ ID NO: 2215461 - DNA, 13 bp, Homo sapiens
acctgccagggac

SEQ ID NO: 2215462 - DNA, 18 bp, Homo sapiens
acctgccagggacagagg

SEQ ID NO: 2215463 - DNA, 23 bp, Homo sapiens
acctgcctgttgggccaggagcc

SEQ ID NO: 2215464 - DNA, 15 bp, Homo sapiens
acctgtccccctgac

SEQ ID NO: 2215465 - DNA, 17 bp, Homo sapiens
accttagacagtccctg

SEQ ID NO: 2215466 - DNA, 20 bp, Homo sapiens
accttagacagtccctgcca

SEQ ID NO: 2215467 - DNA, 13 bp, Homo sapiens
accttctccttca

SEQ ID NO: 2215468 - DNA, 14 bp, Homo sapiens
accttctccttcac

SEQ ID NO: 2215469 - DNA, 15 bp, Homo sapiens
acctttaagagaaat

SEQ ID NO: 2215470 - DNA, 23 bp, Homo sapiens
acctttcaataggaaaaactgat

SEQ ID NO: 2215471 - DNA, 13 bp, Homo sapiens
acctttgtcccca

SEQ ID NO: 2215472 - DNA, 14 bp, Homo sapiens
acctttgtccccac

SEQ ID NO: 2215473 - DNA, 16 bp, Homo sapiens
acctttgtccccaccg

SEQ ID NO: 2215474 - DNA, 17 bp, Homo sapiens
accttttgagtgcctta

SEQ ID NO: 2215475 - DNA, 17 bp, Homo sapiens
accttttttatacataa

SEQ ID NO: 2215476 - DNA, 20 bp, Homo sapiens
accttttttatacataaaca

SEQ ID NO: 2215477 - DNA, 21 bp, Homo sapiens
accttttttatacataaacaa

SEQ ID NO: 2215478 - DNA, 18 bp, Homo sapiens
acgaatattgctgatggt

SEQ ID NO: 2215479 - DNA, 18 bp, Homo sapiens
acgccactgcactatagc

SEQ ID NO: 2215480 - DNA, 17 bp, Homo sapiens
acgccagattctttcct

SEQ ID NO: 2215481 - DNA, 19 bp, Homo sapiens
acgccagattctttcctga

SEQ ID NO: 2215482 - DNA, 22 bp, Homo sapiens
acgccagattctttcctgaggc

SEQ ID NO: 2215483 - DNA, 23 bp, Homo sapiens
acgcgtgcacacaccagagccca

SEQ ID NO: 2215484 - DNA, 13 bp, Homo sapiens
acgctacccggga

SEQ ID NO: 2215485 - DNA, 18 bp, Homo sapiens
acgctacccgggaagggg

SEQ ID NO: 2215486 - DNA, 21 bp, Homo sapiens
acgctacccgggaagggggct

SEQ ID NO: 2215487 - DNA, 13 bp, Homo sapiens
acgctggaccttg

SEQ ID NO: 2215488 - DNA, 20 bp, Homo sapiens
acgctggaccttgaactggg

SEQ ID NO: 2215489 - DNA, 17 bp, Homo sapiens
acgctggagtgcagtga

SEQ ID NO: 2215490 - DNA, 18 bp, Homo sapiens
acgctggagtgcagtgag

SEQ ID NO: 2215491 - DNA, 15 bp, Homo sapiens
acgctgtgctgccct

SEQ ID NO: 2215492 - DNA, 18 bp, Homo sapiens
acgctgtgctgccctgcc

SEQ ID NO: 2215493 - DNA, 22 bp, Homo sapiens
acgctgtgctgccctgcccacc

SEQ ID NO: 2215494 - DNA, 16 bp, Homo sapiens
acggaagagccttgcg

SEQ ID NO: 2215495 - DNA, 12 bp, Homo sapiens
acggccaggcca

SEQ ID NO: 2215496 - DNA, 13 bp, Homo sapiens
acggccaggccag

SEQ ID NO: 2215497 - DNA, 16 bp, Homo sapiens
acggccaggccagagg

SEQ ID NO: 2215498 - DNA, 15 bp, Homo sapiens
acggctcactgcagc

SEQ ID NO: 2215499 - DNA, 19 bp, Homo sapiens
cactatgttgcccaggcag

SEQ ID NO: 2215500 - DNA, 19 bp, Homo sapiens
cactcaaaagctgggcagg

SEQ ID NO: 2215501 - DNA, 16 bp, Homo sapiens
cactccagcctgggtg

SEQ ID NO: 2215502 - DNA, 13 bp, Homo sapiens
cactcccctgctg

SEQ ID NO: 2215503 - DNA, 15 bp, Homo sapiens
cactcccctgctggg

SEQ ID NO: 2215504 - DNA, 12 bp, Homo sapiens
cactccctgcaa

SEQ ID NO: 2215505 - DNA, 13 bp, Homo sapiens
cactccctgcaac

SEQ ID NO: 2215506 - DNA, 17 bp, Homo sapiens
cactccctgcaacctga

SEQ ID NO: 2215507 - DNA, 14 bp, Homo sapiens
cactctggggtggg

SEQ ID NO: 2215508 - DNA, 19 bp, Homo sapiens
cactctgtcgcccagtctg

SEQ ID NO: 2215509 - DNA, 20 bp, Homo sapiens
cactcttattgcccacgctg

SEQ ID NO: 2215510 - DNA, 22 bp, Homo sapiens
cactcttattgcccacgctgga

SEQ ID NO: 2215511 - DNA, 12 bp, Homo sapiens
cactgagacagc

SEQ ID NO: 2215512 - DNA, 17 bp, Homo sapiens
cactgagacagcccggg

SEQ ID NO: 2215513 - DNA, 14 bp, Homo sapiens
cactgatgggcaac

SEQ ID NO: 2215514 - DNA, 24 bp, Homo sapiens
cactgatgggcaacccccagcctg

SEQ ID NO: 2215515 - DNA, 16 bp, Homo sapiens
cactgcaccgggccac

SEQ ID NO: 2215516 - DNA, 19 bp, Homo sapiens
cactgcaccgggccacaga

SEQ ID NO: 2215517 - DNA, 19 bp, Homo sapiens
cactgcactatagcctagg

SEQ ID NO: 2215518 - DNA, 20 bp, Homo sapiens
cactgcactccagcctgggt

SEQ ID NO: 2215519 - DNA, 20 bp, Homo sapiens
cactgcagcctcaacctcct

SEQ ID NO: 2215520 - DNA, 13 bp, Homo sapiens
cactgcttaactt

SEQ ID NO: 2215521 - DNA, 14 bp, Homo sapiens
cactgcttccagtg

SEQ ID NO: 2215522 - DNA, 16 bp, Homo sapiens
cactgcttccagtgag

SEQ ID NO: 2215523 - DNA, 18 bp, Homo sapiens
cactgcttccagtgaggc

SEQ ID NO: 2215524 - DNA, 21 bp, Homo sapiens
cactgcttttggtctgtgtga

SEQ ID NO: 2215525 - DNA, 22 bp, Homo sapiens
cactgggcttggggaccagagc

SEQ ID NO: 2215526 - DNA, 15 bp, Homo sapiens
cactgtgccatgtgc

SEQ ID NO: 2215527 - DNA, 15 bp, Homo sapiens
cactgttgcccaggc

SEQ ID NO: 2215528 - DNA, 18 bp, Homo sapiens
cactgttgcccaggctgg

SEQ ID NO: 2215529 - DNA, 19 bp, Homo sapiens
cactgtttcaaactttact

SEQ ID NO: 2215530 - DNA, 18 bp, Homo sapiens
cacttacactttatgcac

SEQ ID NO: 2215531 - DNA, 23 bp, Homo sapiens
cacttcgggaggtcgaggcagga

SEQ ID NO: 2215532 - DNA, 22 bp, Homo sapiens
cacttctgccatattctgttgg

SEQ ID NO: 2215533 - DNA, 16 bp, Homo sapiens
cacttgacatcaactg

SEQ ID NO: 2215534 - DNA, 13 bp, Homo sapiens
cacttgcagactc

SEQ ID NO: 2215535 - DNA, 19 bp, Homo sapiens
cacttgcagactctacaga

SEQ ID NO: 2215536 - DNA, 24 bp, Homo sapiens
cacttgcagactctacagaggcca

SEQ ID NO: 2215537 - DNA, 18 bp, Homo sapiens
cacttgtgttatgaagca

SEQ ID NO: 2215538 - DNA, 16 bp, Homo sapiens
cactttgggaggccaa

SEQ ID NO: 2215539 - DNA, 13 bp, Homo sapiens
cactttgttctgg

SEQ ID NO: 2215540 - DNA, 16 bp, Homo sapiens
cactttgttctggctc

SEQ ID NO: 2215541 - DNA, 14 bp, Homo sapiens
cacttttgttcttg

SEQ ID NO: 2215542 - DNA, 16 bp, Homo sapiens
cagaaaatggaagaca

SEQ ID NO: 2215543 - DNA, 20 bp, Homo sapiens
cagaaaatggaagacagctc

SEQ ID NO: 2215544 - DNA, 23 bp, Homo sapiens
cagaaaatggaagacagctctta

SEQ ID NO: 2215545 - DNA, 16 bp, Homo sapiens
cagaaacaaaatgaaa

SEQ ID NO: 2215546 - DNA, 20 bp, Homo sapiens
cagaaacaaaatgaaaaaaa

SEQ ID NO: 2215547 - DNA, 17 bp, Homo sapiens
cagaaggaagacttcat

SEQ ID NO: 2215548 - DNA, 16 bp, Homo sapiens
cagaagtttctgccgc

SEQ ID NO: 2215549 - DNA, 19 bp, Homo sapiens
cagaagtttctgccgcagc

SEQ ID NO: 2215550 - DNA, 20 bp, Homo sapiens
cagaagtttctgccgcagcc

SEQ ID NO: 2215551 - DNA, 23 bp, Homo sapiens
cagaagtttctgccgcagccctg

SEQ ID NO: 2215552 - DNA, 14 bp, Homo sapiens
cagaatttcccaaa

SEQ ID NO: 2215553 - DNA, 18 bp, Homo sapiens
cagaatttcccaaagcag

SEQ ID NO: 2215554 - DNA, 12 bp, Homo sapiens
cagacaaagcgt

SEQ ID NO: 2215555 - DNA, 22 bp, Homo sapiens
cagacaaagcgtggtggacatg

SEQ ID NO: 2215556 - DNA, 20 bp, Homo sapiens
cagacaacaaacctgtttct

SEQ ID NO: 2215557 - DNA, 17 bp, Homo sapiens
cagacacaggcccggct

SEQ ID NO: 2215558 - DNA, 22 bp, Homo sapiens
cagacacaggcccggctccagg

SEQ ID NO: 2215559 - DNA, 14 bp, Homo sapiens
cagacacatgtcca

SEQ ID NO: 2215560 - DNA, 21 bp, Homo sapiens
cagacacatgtccaagaagcc

SEQ ID NO: 2215561 - DNA, 20 bp, Homo sapiens
cagacaccttgacagggcac

SEQ ID NO: 2215562 - DNA, 13 bp, Homo sapiens
cagacagctgcct

SEQ ID NO: 2215563 - DNA, 14 bp, Homo sapiens
cagacagctgcctg

SEQ ID NO: 2215564 - DNA, 16 bp, Homo sapiens
cagacagctgcctggg

SEQ ID NO: 2215565 - DNA, 17 bp, Homo sapiens
cagacagctgcctggga

SEQ ID NO: 2215566 - DNA, 18 bp, Homo sapiens
cagacagctgcctgggat

SEQ ID NO: 2215567 - DNA, 13 bp, Homo sapiens
cagacaggcaagc

SEQ ID NO: 2215568 - DNA, 18 bp, Homo sapiens
cagacaggcaagcacctc

SEQ ID NO: 2215569 - DNA, 23 bp, Homo sapiens
cagacaggcaagcacctcctgcc

SEQ ID NO: 2215570 - DNA, 16 bp, Homo sapiens
cagacccggctgcgtg

SEQ ID NO: 2215571 - DNA, 21 bp, Homo sapiens
cagactctacagaggccatgg

SEQ ID NO: 2215572 - DNA, 16 bp, Homo sapiens
cagactggaagcacag

SEQ ID NO: 2215573 - DNA, 23 bp, Homo sapiens
cagagaaagtacttctccaccct

SEQ ID NO: 2215574 - DNA, 20 bp, Homo sapiens
cagagaatgaaagggcccag

SEQ ID NO: 2215575 - DNA, 21 bp, Homo sapiens
cagagaatgaaagggcccaga

SEQ ID NO: 2215576 - DNA, 15 bp, Homo sapiens
cagagaattctctta

SEQ ID NO: 2215577 - DNA, 15 bp, Homo sapiens
cagagacacaagcct

SEQ ID NO: 2215578 - DNA, 16 bp, Homo sapiens
cagagacacaagcctt

SEQ ID NO: 2215579 - DNA, 17 bp, Homo sapiens
cagagacacaagccttc

SEQ ID NO: 2215580 - DNA, 21 bp, Homo sapiens
cagagaccatccctgaaggcc

SEQ ID NO: 2215581 - DNA, 13 bp, Homo sapiens
cagagactcctgc

SEQ ID NO: 2215582 - DNA, 15 bp, Homo sapiens
cagagactcctgcag

SEQ ID NO: 2215583 - DNA, 20 bp, Homo sapiens
cagagactcctgcaggcagc

SEQ ID NO: 2215584 - DNA, 23 bp, Homo sapiens
cagagactcctgcaggcagccag

SEQ ID NO: 2215585 - DNA, 16 bp, Homo sapiens
cagagagagagagaga

SEQ ID NO: 2215586 - DNA, 19 bp, Homo sapiens
cagagagagagagagagaa

SEQ ID NO: 2215587 - DNA, 22 bp, Homo sapiens
cagagagggtggtgacctctgc

SEQ ID NO: 2215588 - DNA, 20 bp, Homo sapiens
cagagaggttaaggtgggta

SEQ ID NO: 2215589 - DNA, 15 bp, Homo sapiens
atgcccagccccttc

SEQ ID NO: 2215590 - DNA, 17 bp, Homo sapiens
atgcccagccccttctg

SEQ ID NO: 2215591 - DNA, 13 bp, Homo sapiens
atgcctctctcag

SEQ ID NO: 2215592 - DNA, 14 bp, Homo sapiens
atgcctctctcagg

SEQ ID NO: 2215593 - DNA, 15 bp, Homo sapiens
atgcctctctcaggc

SEQ ID NO: 2215594 - DNA, 19 bp, Homo sapiens
atgcctggatggggctgca

SEQ ID NO: 2215595 - DNA, 13 bp, Homo sapiens
atgcctggtggca

SEQ ID NO: 2215596 - DNA, 16 bp, Homo sapiens
atgcctggtggcagct

SEQ ID NO: 2215597 - DNA, 20 bp, Homo sapiens
atgcgtgcataccacttttg

SEQ ID NO: 2215598 - DNA, 22 bp, Homo sapiens
atgcgtgcataccacttttgtt

SEQ ID NO: 2215599 - DNA, 18 bp, Homo sapiens
atgctacacactgcatgt

SEQ ID NO: 2215600 - DNA, 19 bp, Homo sapiens
atgctcctggcccactgca

SEQ ID NO: 2215601 - DNA, 13 bp, Homo sapiens
atgctgccctgtg

SEQ ID NO: 2215602 - DNA, 14 bp, Homo sapiens
atgctgccctgtga

SEQ ID NO: 2215603 - DNA, 22 bp, Homo sapiens
atgctgtgccctaaagtgtatt

SEQ ID NO: 2215604 - DNA, 20 bp, Homo sapiens
atgcttcttcagagactcct

SEQ ID NO: 2215605 - DNA, 16 bp, Homo sapiens
atgctttgatcccttc

SEQ ID NO: 2215606 - DNA, 11 bp, Homo sapiens
atggaacactc

SEQ ID NO: 2215607 - DNA, 15 bp, Homo sapiens
atggaacactctgag

SEQ ID NO: 2215608 - DNA, 17 bp, Homo sapiens
atggaacactctgagac

SEQ ID NO: 2215609 - DNA, 15 bp, Homo sapiens
atggaagacagctct

SEQ ID NO: 2215610 - DNA, 14 bp, Homo sapiens
atggaataacatgt

SEQ ID NO: 2215611 - DNA, 11 bp, Homo sapiens
atggactttgt

SEQ ID NO: 2215612 - DNA, 12 bp, Homo sapiens
atggactttgtt

SEQ ID NO: 2215613 - DNA, 23 bp, Homo sapiens
atggcacatcagcacgatttctg

SEQ ID NO: 2215614 - DNA, 18 bp, Homo sapiens
atggcctcttcagatctc

SEQ ID NO: 2215615 - DNA, 21 bp, Homo sapiens
atgggaatgaatgtcagtgtg

SEQ ID NO: 2215616 - DNA, 19 bp, Homo sapiens
atgggagagaagagaatgc

SEQ ID NO: 2215617 - DNA, 18 bp, Homo sapiens
atgggcaacccccagcct

SEQ ID NO: 2215618 - DNA, 19 bp, Homo sapiens
atgggcaacccccagcctg

SEQ ID NO: 2215619 - DNA, 21 bp, Homo sapiens
atgggcaacccccagcctgct

SEQ ID NO: 2215620 - DNA, 13 bp, Homo sapiens
atggggccctgcc

SEQ ID NO: 2215621 - DNA, 24 bp, Homo sapiens
atggggctgcaccggctggcctgg

SEQ ID NO: 2215622 - DNA, 14 bp, Homo sapiens
atgggggtgcattt

SEQ ID NO: 2215623 - DNA, 12 bp, Homo sapiens
atggtgcaatga

SEQ ID NO: 2215624 - DNA, 13 bp, Homo sapiens
atggtggctgggt

SEQ ID NO: 2215625 - DNA, 16 bp, Homo sapiens
atggttttcaaaataa

SEQ ID NO: 2215626 - DNA, 12 bp, Homo sapiens
atgtatgtgtaa

SEQ ID NO: 2215627 - DNA, 16 bp, Homo sapiens
atgtatgtgtaagtat

SEQ ID NO: 2215628 - DNA, 15 bp, Homo sapiens
atgtcacaggcaggt

SEQ ID NO: 2215629 - DNA, 17 bp, Homo sapiens
atgtcacaggcaggtcc

SEQ ID NO: 2215630 - DNA, 17 bp, Homo sapiens
atgtccaagaagcccag

SEQ ID NO: 2215631 - DNA, 14 bp, Homo sapiens
atgtcttttcttgc

SEQ ID NO: 2215632 - DNA, 13 bp, Homo sapiens
atgtgagaccatt

SEQ ID NO: 2215633 - DNA, 14 bp, Homo sapiens
atgtgagactggtt

SEQ ID NO: 2215634 - DNA, 16 bp, Homo sapiens
atgtgatgagaggaaa

SEQ ID NO: 2215635 - DNA, 14 bp, Homo sapiens
atgtgtaagtattc

SEQ ID NO: 2215636 - DNA, 13 bp, Homo sapiens
atgttctgggaca

SEQ ID NO: 2215637 - DNA, 14 bp, Homo sapiens
atgttctgggacac

SEQ ID NO: 2215638 - DNA, 20 bp, Homo sapiens
atgttctttcacccttttct

SEQ ID NO: 2215639 - DNA, 12 bp, Homo sapiens
atgttgcccagg

SEQ ID NO: 2215640 - DNA, 17 bp, Homo sapiens
atgttgcccaggcaggt

SEQ ID NO: 2215641 - DNA, 20 bp, Homo sapiens
atgttgcccaggcaggtctt

SEQ ID NO: 2215642 - DNA, 13 bp, Homo sapiens
atgttggccaggc

SEQ ID NO: 2215643 - DNA, 16 bp, Homo sapiens
atgttggccaggctgg

SEQ ID NO: 2215644 - DNA, 14 bp, Homo sapiens
atgtttgcctctgc

SEQ ID NO: 2215645 - DNA, 15 bp, Homo sapiens
atgtttgcctctgcc

SEQ ID NO: 2215646 - DNA, 17 bp, Homo sapiens
atgtttgcctctgcctc

SEQ ID NO: 2215647 - DNA, 16 bp, Homo sapiens
atgttttaagaggcag

SEQ ID NO: 2215648 - DNA, 17 bp, Homo sapiens
atgtttttcttctccct

SEQ ID NO: 2215649 - DNA, 15 bp, Homo sapiens
attaaaaatctcaaa

SEQ ID NO: 2215650 - DNA, 19 bp, Homo sapiens
attaaatgcccagcccctt

SEQ ID NO: 2215651 - DNA, 20 bp, Homo sapiens
attaaccacttcagctgact

SEQ ID NO: 2215652 - DNA, 17 bp, Homo sapiens
attaacttttataaact

SEQ ID NO: 2215653 - DNA, 23 bp, Homo sapiens
attaacttttataaactttacct

SEQ ID NO: 2215654 - DNA, 18 bp, Homo sapiens
attaagtactatgtatca

SEQ ID NO: 2215655 - DNA, 19 bp, Homo sapiens
attaccacagacatactaa

SEQ ID NO: 2215656 - DNA, 22 bp, Homo sapiens
attacctgaattttggctgtgt

SEQ ID NO: 2215657 - DNA, 12 bp, Homo sapiens
attacttctgct

SEQ ID NO: 2215658 - DNA, 17 bp, Homo sapiens
catggtcggaaaacatg

SEQ ID NO: 2215659 - DNA, 22 bp, Homo sapiens
catggtgaaggtttttgtttct

SEQ ID NO: 2215660 - DNA, 21 bp, Homo sapiens
catgtaattaagtactatgta

SEQ ID NO: 2215661 - DNA, 19 bp, Homo sapiens
catgtccaagaagcccagg

SEQ ID NO: 2215662 - DNA, 12 bp, Homo sapiens
catgtctggcta

SEQ ID NO: 2215663 - DNA, 23 bp, Homo sapiens
catgtcttttcttgcatgaggct

SEQ ID NO: 2215664 - DNA, 20 bp, Homo sapiens
catgtgatgagaggaaatca

SEQ ID NO: 2215665 - DNA, 21 bp, Homo sapiens
catgtgccaggtttttggtct

SEQ ID NO: 2215666 - DNA, 16 bp, Homo sapiens
catgttggccaggctg

SEQ ID NO: 2215667 - DNA, 19 bp, Homo sapiens
catgttggccaggctggtc

SEQ ID NO: 2215668 - DNA, 15 bp, Homo sapiens
catgttttgtttacg

SEQ ID NO: 2215669 - DNA, 13 bp, Homo sapiens
cattccccaggag

SEQ ID NO: 2215670 - DNA, 15 bp, Homo sapiens
cattccccaggaggc

SEQ ID NO: 2215671 - DNA, 17 bp, Homo sapiens
cattccccaggaggcca

SEQ ID NO: 2215672 - DNA, 21 bp, Homo sapiens
ccagacaccttgacagggcac

SEQ ID NO: 2215673 - DNA, 19 bp, Homo sapiens
ccagacccccttgcccagg

SEQ ID NO: 2215674 - DNA, 21 bp, Homo sapiens
ccagacccccttgcccaggcc

SEQ ID NO: 2215675 - DNA, 14 bp, Homo sapiens
ccagacccggctgc

SEQ ID NO: 2215676 - DNA, 15 bp, Homo sapiens
ccagacccggctgcg

SEQ ID NO: 2215677 - DNA, 16 bp, Homo sapiens
ccagagacacaagcct

SEQ ID NO: 2215678 - DNA, 18 bp, Homo sapiens
ccagagacacaagccttc

SEQ ID NO: 2215679 - DNA, 21 bp, Homo sapiens
ccagagagggtggtgacctct

SEQ ID NO: 2215680 - DNA, 14 bp, Homo sapiens
ccagagctgccacc

SEQ ID NO: 2215681 - DNA, 15 bp, Homo sapiens
ccagagctgccacct

SEQ ID NO: 2215682 - DNA, 21 bp, Homo sapiens
ccagaggagagaggaccccct

SEQ ID NO: 2215683 - DNA, 16 bp, Homo sapiens
ccagagggagtgacag

SEQ ID NO: 2215684 - DNA, 19 bp, Homo sapiens
ccagagggagtgacagagg

SEQ ID NO: 2215685 - DNA, 19 bp, Homo sapiens
ccagagggcctgcaaggga

SEQ ID NO: 2215686 - DNA, 15 bp, Homo sapiens
ccagatgcaccagcc

SEQ ID NO: 2215687 - DNA, 14 bp, Homo sapiens
ccagatttcactct

SEQ ID NO: 2215688 - DNA, 15 bp, Homo sapiens
ccagcaagtgagagc

SEQ ID NO: 2215689 - DNA, 16 bp, Homo sapiens
ccagcagaaatgcctt

SEQ ID NO: 2215690 - DNA, 14 bp, Homo sapiens
ccagcagagcacct

SEQ ID NO: 2215691 - DNA, 14 bp, Homo sapiens
ccagcagcctggac

SEQ ID NO: 2215692 - DNA, 20 bp, Homo sapiens
ccagcagcctggaccctgtg

SEQ ID NO: 2215693 - DNA, 13 bp, Homo sapiens
ccagcaggctctc

SEQ ID NO: 2215694 - DNA, 18 bp, Homo sapiens
ccagcaggctctcaggcc

SEQ ID NO: 2215695 - DNA, 12 bp, Homo sapiens
cagaggcagccc

SEQ ID NO: 2215696 - DNA, 13 bp, Homo sapiens
cagaggcagcccc

SEQ ID NO: 2215697 - DNA, 20 bp, Homo sapiens
cagaggcagccccattctgc

SEQ ID NO: 2215698 - DNA, 22 bp, Homo sapiens
cagagggcctgcaagggagtga

SEQ ID NO: 2215699 - DNA, 14 bp, Homo sapiens
cagagggggtggcc

SEQ ID NO: 2215700 - DNA, 18 bp, Homo sapiens
cagagggggtggcctccc

SEQ ID NO: 2215701 - DNA, 19 bp, Homo sapiens
cagagggggtggcctccca

SEQ ID NO: 2215702 - DNA, 19 bp, Homo sapiens
cagagtctcactgttgccc

SEQ ID NO: 2215703 - DNA, 17 bp, Homo sapiens
cagagtgagactctgtc

SEQ ID NO: 2215704 - DNA, 14 bp, Homo sapiens
cagagttgaagaca

SEQ ID NO: 2215705 - DNA, 15 bp, Homo sapiens
cagagttgaagacag

SEQ ID NO: 2215706 - DNA, 20 bp, Homo sapiens
cagagttgaagacagagcta

SEQ ID NO: 2215707 - DNA, 22 bp, Homo sapiens
cagagttgaagacagagctaca

SEQ ID NO: 2215708 - DNA, 15 bp, Homo sapiens
cagagttgttacatt

SEQ ID NO: 2215709 - DNA, 19 bp, Homo sapiens
cagagttgttacattttta

SEQ ID NO: 2215710 - DNA, 21 bp, Homo sapiens
cagatacaggaaaagctgctg

SEQ ID NO: 2215711 - DNA, 20 bp, Homo sapiens
cagatctctaacttcaccat

SEQ ID NO: 2215712 - DNA, 13 bp, Homo sapiens
cagatgcaccagc

SEQ ID NO: 2215713 - DNA, 16 bp, Homo sapiens
cagatgcaccagccct

SEQ ID NO: 2215714 - DNA, 23 bp, Homo sapiens
cagatgggtgcttggaggaagga

SEQ ID NO: 2215715 - DNA, 17 bp, Homo sapiens
cagattctttcctgagg

SEQ ID NO: 2215716 - DNA, 22 bp, Homo sapiens
cagattctttcctgaggctggg

SEQ ID NO: 2215717 - DNA, 18 bp, Homo sapiens
cagattgcaacaggctgg

SEQ ID NO: 2215718 - DNA, 13 bp, Homo sapiens
cagatttcactct

SEQ ID NO: 2215719 - DNA, 15 bp, Homo sapiens
cagatttcactctcc

SEQ ID NO: 2215720 - DNA, 18 bp, Homo sapiens
cagatttcactctccttg

SEQ ID NO: 2215721 - DNA, 16 bp, Homo sapiens
cagcaagtgagagctg

SEQ ID NO: 2215722 - DNA, 17 bp, Homo sapiens
cagcaagtgagagctgg

SEQ ID NO: 2215723 - DNA, 21 bp, Homo sapiens
cagcaagtgagagctgggtgt

SEQ ID NO: 2215724 - DNA, 13 bp, Homo sapiens
cagcacaggcagc

SEQ ID NO: 2215725 - DNA, 16 bp, Homo sapiens
cagcacaggcagcccc

SEQ ID NO: 2215726 - DNA, 19 bp, Homo sapiens
cagcaccatctctcctcct

SEQ ID NO: 2215727 - DNA, 16 bp, Homo sapiens
cagcacgatttctgtt

SEQ ID NO: 2215728 - DNA, 18 bp, Homo sapiens
cagcacgatttctgttta

SEQ ID NO: 2215729 - DNA, 15 bp, Homo sapiens
cagcagaaatgcctt

SEQ ID NO: 2215730 - DNA, 17 bp, Homo sapiens
cagcagaaatgccttac

SEQ ID NO: 2215731 - DNA, 13 bp, Homo sapiens
cagcagagagaga

SEQ ID NO: 2215732 - DNA, 23 bp, Homo sapiens
cagcagagagagagagagagaaa

SEQ ID NO: 2215733 - DNA, 11 bp, Homo sapiens
cagcagagcac

SEQ ID NO: 2215734 - DNA, 18 bp, Homo sapiens
cagcagcctggaccctgt

SEQ ID NO: 2215735 - DNA, 12 bp, Homo sapiens
cagcaggctctc

SEQ ID NO: 2215736 - DNA, 14 bp, Homo sapiens
cagcaggctctcag

SEQ ID NO: 2215737 - DNA, 15 bp, Homo sapiens
cagcaggctctcagg

SEQ ID NO: 2215738 - DNA, 20 bp, Homo sapiens
cagcaggctctcaggccagc

SEQ ID NO: 2215739 - DNA, 17 bp, Homo sapiens
cagcatagaagtaactt

SEQ ID NO: 2215740 - DNA, 16 bp, Homo sapiens
cagcatattcaggaag

SEQ ID NO: 2215741 - DNA, 18 bp, Homo sapiens
cagcatattcaggaagct

SEQ ID NO: 2215742 - DNA, 15 bp, Homo sapiens
cagcatcctggcacc

SEQ ID NO: 2215743 - DNA, 19 bp, Homo sapiens
cagcatcctggcacccggc

SEQ ID NO: 2215744 - DNA, 21 bp, Homo sapiens
cagcatcctggcacccggccc

SEQ ID NO: 2215745 - DNA, 21 bp, Homo sapiens
cagccaaagcctcctccagcc

SEQ ID NO: 2215746 - DNA, 17 bp, Homo sapiens
cagccacattcctgatg

SEQ ID NO: 2215747 - DNA, 16 bp, Homo sapiens
cagccacggccaggcc

SEQ ID NO: 2215748 - DNA, 17 bp, Homo sapiens
cagccacggccaggcca

SEQ ID NO: 2215749 - DNA, 21 bp, Homo sapiens
cagccacggccaggccagagg

SEQ ID NO: 2215750 - DNA, 13 bp, Homo sapiens
cagccagtaaatg

SEQ ID NO: 2215751 - DNA, 15 bp, Homo sapiens
cagcccacccctcaa

SEQ ID NO: 2215752 - DNA, 21 bp, Homo sapiens
cagccccaaaactctcctctg

SEQ ID NO: 2215753 - DNA, 16 bp, Homo sapiens
cagccccagtgcccac

SEQ ID NO: 2215754 - DNA, 14 bp, Homo sapiens
cagccccatcctct

SEQ ID NO: 2215755 - DNA, 13 bp, Homo sapiens
cagccccattctg

SEQ ID NO: 2215756 - DNA, 14 bp, Homo sapiens
cagccccattctgc

SEQ ID NO: 2215757 - DNA, 22 bp, Homo sapiens
cagccccattctgcctgcccag

SEQ ID NO: 2215758 - DNA, 12 bp, Homo sapiens
cagcccctggat

SEQ ID NO: 2215759 - DNA, 13 bp, Homo sapiens
cagcccctggatg

SEQ ID NO: 2215760 - DNA, 17 bp, Homo sapiens
cagcccctggatgcagc

SEQ ID NO: 2215761 - DNA, 21 bp, Homo sapiens
cagcccctgttctggcagagt

SEQ ID NO: 2215762 - DNA, 17 bp, Homo sapiens
cagccccttctgaccca

SEQ ID NO: 2215763 - DNA, 23 bp, Homo sapiens
cagccccttctgacccatgctgc

SEQ ID NO: 2215764 - DNA, 24 bp, Homo sapiens
cagccccttctgacccatgctgcc

SEQ ID NO: 2215765 - DNA, 16 bp, Homo sapiens
cagcccgggctctgcc

SEQ ID NO: 2215766 - DNA, 20 bp, Homo sapiens
cagcccgggctctgcctccc

SEQ ID NO: 2215767 - DNA, 15 bp, Homo sapiens
cagccctgcagaggg

SEQ ID NO: 2215768 - DNA, 13 bp, Homo sapiens
cagcccttagcag

SEQ ID NO: 2215769 - DNA, 21 bp, Homo sapiens
cagccgagatagccaaggcca

SEQ ID NO: 2215770 - DNA, 18 bp, Homo sapiens
cagcctcaacctcctggg

SEQ ID NO: 2215771 - DNA, 14 bp, Homo sapiens
cagcctcacagtcc

SEQ ID NO: 2215772 - DNA, 20 bp, Homo sapiens
cagcctcccaaagtgctggg

SEQ ID NO: 2215773 - DNA, 21 bp, Homo sapiens
cagcctcccaaagtgctggga

SEQ ID NO: 2215774 - DNA, 23 bp, Homo sapiens
cagcctcccgaatagctgggact

SEQ ID NO: 2215775 - DNA, 20 bp, Homo sapiens
cagcctcccgagtagctggg

SEQ ID NO: 2215776 - DNA, 23 bp, Homo sapiens
cagcctcccgagtagctgggact

SEQ ID NO: 2215777 - DNA, 17 bp, Homo sapiens
cagcctctgaaaaccaa

SEQ ID NO: 2215778 - DNA, 19 bp, Homo sapiens
cagcctgctccagctgttc

SEQ ID NO: 2215779 - DNA, 19 bp, Homo sapiens
cagcctggaccctgtggat

SEQ ID NO: 2215780 - DNA, 16 bp, Homo sapiens
cagcctgggcaatgtg

SEQ ID NO: 2215781 - DNA, 22 bp, Homo sapiens
cagccttgaccattctccacct

SEQ ID NO: 2215782 - DNA, 23 bp, Homo sapiens
cagccttgaccattctccacctg

SEQ ID NO: 2215783 - DNA, 18 bp, Homo sapiens
cagcggggacagctcctt

SEQ ID NO: 2215784 - DNA, 14 bp, Homo sapiens
cagcgtttctatga

SEQ ID NO: 2215785 - DNA, 16 bp, Homo sapiens
cagcgtttctatgaca

SEQ ID NO: 2215786 - DNA, 19 bp, Homo sapiens
cagcgtttctatgacacat

SEQ ID NO: 2215787 - DNA, 18 bp, Homo sapiens
cagctaacatggaagtac

SEQ ID NO: 2215788 - DNA, 13 bp, Homo sapiens
cagctcaccagcc

SEQ ID NO: 2215789 - DNA, 17 bp, Homo sapiens
cagctcaccagccccag

SEQ ID NO: 2215790 - DNA, 17 bp, Homo sapiens
cagctcacctctccctt

SEQ ID NO: 2215791 - DNA, 13 bp, Homo sapiens
cagctcagagagg

SEQ ID NO: 2215792 - DNA, 16 bp, Homo sapiens
cagctccagctcacca

SEQ ID NO: 2215793 - DNA, 20 bp, Homo sapiens
cagctccagctcaccagccc

SEQ ID NO: 2215794 - DNA, 23 bp, Homo sapiens
cagctccttctgtcctactctgt

SEQ ID NO: 2215795 - DNA, 16 bp, Homo sapiens
cagctctgcaagaatt

SEQ ID NO: 2215796 - DNA, 21 bp, Homo sapiens
cagctctgcaagaattgaagc

SEQ ID NO: 2215797 - DNA, 17 bp, Homo sapiens
cagctctggtccataga

SEQ ID NO: 2215798 - DNA, 18 bp, Homo sapiens
cagctctggtccatagag

SEQ ID NO: 2215799 - DNA, 21 bp, Homo sapiens
cagctctggtccatagagagc

SEQ ID NO: 2215800 - DNA, 22 bp, Homo sapiens
cagctctggtccatagagagca

SEQ ID NO: 2215801 - DNA, 13 bp, Homo sapiens
cagctcttctcca

SEQ ID NO: 2215802 - DNA, 17 bp, Homo sapiens
cagctcttctccaggct

SEQ ID NO: 2215803 - DNA, 23 bp, Homo sapiens
cagctgcctgggatccctcatcc

SEQ ID NO: 2215804 - DNA, 14 bp, Homo sapiens
cagctgcttgggct

SEQ ID NO: 2215805 - DNA, 18 bp, Homo sapiens
cagctgcttgggcttcat

SEQ ID NO: 2215806 - DNA, 22 bp, Homo sapiens
cagctgcttttgtctatgggac

SEQ ID NO: 2215807 - DNA, 19 bp, Homo sapiens
cagctgtgctctggacagg

SEQ ID NO: 2215808 - DNA, 24 bp, Homo sapiens
cagctgtgctctggacaggcatgt

SEQ ID NO: 2215809 - DNA, 15 bp, Homo sapiens
cagctgttcagctgg

SEQ ID NO: 2215810 - DNA, 16 bp, Homo sapiens
cagctgttcagctggt

SEQ ID NO: 2215811 - DNA, 15 bp, Homo sapiens
cagcttcatttcctg

SEQ ID NO: 2215812 - DNA, 18 bp, Homo sapiens
cagcttcatttcctgtgt

SEQ ID NO: 2215813 - DNA, 19 bp, Homo sapiens
cagcttcatttcctgtgtc

SEQ ID NO: 2215814 - DNA, 18 bp, Homo sapiens
cagcttgaccgtgaggcc

SEQ ID NO: 2215815 - DNA, 16 bp, Homo sapiens
aaatggaaatgggcag

SEQ ID NO: 2215816 - DNA, 20 bp, Homo sapiens
aaatggacgtgttatgactc

SEQ ID NO: 2215817 - DNA, 17 bp, Homo sapiens
aaatgggggtgcatttg

SEQ ID NO: 2215818 - DNA, 19 bp, Homo sapiens
aaatgtctagttgtaacac

SEQ ID NO: 2215819 - DNA, 21 bp, Homo sapiens
aaatgtctctttaatgtcaca

SEQ ID NO: 2215820 - DNA, 13 bp, Homo sapiens
aaattaactttta

SEQ ID NO: 2215821 - DNA, 22 bp, Homo sapiens
aaattaacttttataaacttta

SEQ ID NO: 2215822 - DNA, 23 bp, Homo sapiens
aaattcttctccactttctagcc

SEQ ID NO: 2215823 - DNA, 12 bp, Homo sapiens
aaatttctaaat

SEQ ID NO: 2215824 - DNA, 13 bp, Homo sapiens
aaatttctaaatc

SEQ ID NO: 2215825 - DNA, 15 bp, Homo sapiens
aaatttctaaatctc

SEQ ID NO: 2215826 - DNA, 19 bp, Homo sapiens
aaatttctaaatctccaaa

SEQ ID NO: 2215827 - DNA, 23 bp, Homo sapiens
aaattttgatgttttaaggatgc

SEQ ID NO: 2215828 - DNA, 23 bp, Homo sapiens
aacaaggcaaggctgtcaattac

SEQ ID NO: 2215829 - DNA, 15 bp, Homo sapiens
aacacaaaaaaagac

SEQ ID NO: 2215830 - DNA, 14 bp, Homo sapiens
aacactctgagact

SEQ ID NO: 2215831 - DNA, 15 bp, Homo sapiens
aacactgttctctgc

SEQ ID NO: 2215832 - DNA, 21 bp, Homo sapiens
aacactgttctctgccctcca

SEQ ID NO: 2215833 - DNA, 13 bp, Homo sapiens
aacagaaatgtac

SEQ ID NO: 2215834 - DNA, 14 bp, Homo sapiens
aacagaaatgtaca

SEQ ID NO: 2215835 - DNA, 20 bp, Homo sapiens
aacagactggaagcacagct

SEQ ID NO: 2215836 - DNA, 16 bp, Homo sapiens
aacagctaatgggaca

SEQ ID NO: 2215837 - DNA, 13 bp, Homo sapiens
aacaggctgggct

SEQ ID NO: 2215838 - DNA, 23 bp, Homo sapiens
aacaggctgggcttcagtggcag

SEQ ID NO: 2215839 - DNA, 18 bp, Homo sapiens
aacatactcccatctgtg

SEQ ID NO: 2215840 - DNA, 20 bp, Homo sapiens
aacatactcccatctgtgaa

SEQ ID NO: 2215841 - DNA, 22 bp, Homo sapiens
aacatgctacacactgcatgtt

SEQ ID NO: 2215842 - DNA, 15 bp, Homo sapiens
aacatggaagtacta

SEQ ID NO: 2215843 - DNA, 15 bp, Homo sapiens
aaccaagtcaagtga

SEQ ID NO: 2215844 - DNA, 21 bp, Homo sapiens
aaccaccacacccagcccact

SEQ ID NO: 2215845 - DNA, 19 bp, Homo sapiens
aaccagtgttgtggattta

SEQ ID NO: 2215846 - DNA, 17 bp, Homo sapiens
aaccatcattgaaatct

SEQ ID NO: 2215847 - DNA, 10 bp, Homo sapiens
aacccagctc

SEQ ID NO: 2215848 - DNA, 14 bp, Homo sapiens
aacccagctctggt

SEQ ID NO: 2215849 - DNA, 17 bp, Homo sapiens
aacccagctctggtcca

SEQ ID NO: 2215850 - DNA, 13 bp, Homo sapiens
aacccccagcctg

SEQ ID NO: 2215851 - DNA, 15 bp, Homo sapiens
aacccccagcctgct

SEQ ID NO: 2215852 - DNA, 13 bp, Homo sapiens
aaccgtgaggagg

SEQ ID NO: 2215853 - DNA, 19 bp, Homo sapiens
aacctgattgtgtctcttg

SEQ ID NO: 2215854 - DNA, 13 bp, Homo sapiens
aacgtggctgctt

SEQ ID NO: 2215855 - DNA, 17 bp, Homo sapiens
aactcaaactcttaaaa

SEQ ID NO: 2215856 - DNA, 12 bp, Homo sapiens
aactcaccccag

SEQ ID NO: 2215857 - DNA, 15 bp, Homo sapiens
aactcaccccagccc

SEQ ID NO: 2215858 - DNA, 16 bp, Homo sapiens
aactcaccccagcccc

SEQ ID NO: 2215859 - DNA, 15 bp, Homo sapiens
aactcacctgcccct

SEQ ID NO: 2215860 - DNA, 15 bp, Homo sapiens
aactctcctccagag

SEQ ID NO: 2215861 - DNA, 21 bp, Homo sapiens
aactcttcaatctcttgcact

SEQ ID NO: 2215862 - DNA, 21 bp, Homo sapiens
aactgatttttttttccttca

SEQ ID NO: 2215863 - DNA, 16 bp, Homo sapiens
aactgcattggctttg

SEQ ID NO: 2215864 - DNA, 20 bp, Homo sapiens
aactgctgactgttttctct

SEQ ID NO: 2215865 - DNA, 21 bp, Homo sapiens
aactgctgactgttttctctt

SEQ ID NO: 2215866 - DNA, 15 bp, Homo sapiens
aactggattaaactt

SEQ ID NO: 2215867 - DNA, 21 bp, Homo sapiens
aactgggggagggtgaagtga

SEQ ID NO: 2215868 - DNA, 17 bp, Homo sapiens
aacttaaataatgtgaa

SEQ ID NO: 2215869 - DNA, 13 bp, Homo sapiens
aacttcacatatt

SEQ ID NO: 2215870 - DNA, 18 bp, Homo sapiens
aacttgaaaaaaaaaaac

SEQ ID NO: 2215871 - DNA, 17 bp, Homo sapiens
aacttggcgctgcccct

SEQ ID NO: 2215872 - DNA, 18 bp, Homo sapiens
aacttgtctttggaccct

SEQ ID NO: 2215873 - DNA, 15 bp, Homo sapiens
aacttttataaactt

SEQ ID NO: 2215874 - DNA, 16 bp, Homo sapiens
aacttttataaacttt

SEQ ID NO: 2215875 - DNA, 19 bp, Homo sapiens
aagaaaaaatattttccct

SEQ ID NO: 2215876 - DNA, 17 bp, Homo sapiens
aagaaaaaggatgcaca

SEQ ID NO: 2215877 - DNA, 22 bp, Homo sapiens
aagaaaatagtggtgtgatttg

SEQ ID NO: 2215878 - DNA, 22 bp, Homo sapiens
aagaaagactatctaaatgttg

SEQ ID NO: 2215879 - DNA, 14 bp, Homo sapiens
aagaatgcagagat

SEQ ID NO: 2215880 - DNA, 17 bp, Homo sapiens
aagaccacgtttctaaa

SEQ ID NO: 2215881 - DNA, 15 bp, Homo sapiens
aagacgctgtgctgc

SEQ ID NO: 2215882 - DNA, 17 bp, Homo sapiens
aagacgctgtgctgccc

SEQ ID NO: 2215883 - DNA, 16 bp, Homo sapiens
aagactttggaaagag

SEQ ID NO: 2215884 - DNA, 12 bp, Homo sapiens
aagacttttctt

SEQ ID NO: 2215885 - DNA, 16 bp, Homo sapiens
aagagattgtggtttc

SEQ ID NO: 2215886 - DNA, 19 bp, Homo sapiens
aagagattgtggtttcatt

SEQ ID NO: 2215887 - DNA, 14 bp, Homo sapiens
aagagcccaggcct

SEQ ID NO: 2215888 - DNA, 22 bp, Homo sapiens
aagagggagggagggctccaga

SEQ ID NO: 2215889 - DNA, 22 bp, Homo sapiens
aagagggtctgaggaatccaga

SEQ ID NO: 2215890 - DNA, 14 bp, Homo sapiens
aagagtaggaagac

SEQ ID NO: 2215891 - DNA, 12 bp, Homo sapiens
aagataaatgtg

SEQ ID NO: 2215892 - DNA, 21 bp, Homo sapiens
aagataatattaaggaagaca

SEQ ID NO: 2215893 - DNA, 20 bp, Homo sapiens
aagatcaaaaggttaataaa

SEQ ID NO: 2215894 - DNA, 16 bp, Homo sapiens
aagatgcttctcactg

SEQ ID NO: 2215895 - DNA, 17 bp, Homo sapiens
aagatgcttctcactgc

SEQ ID NO: 2215896 - DNA, 19 bp, Homo sapiens
aagatgcttctcactgcca

SEQ ID NO: 2215897 - DNA, 14 bp, Homo sapiens
aagatgtgacatgt

SEQ ID NO: 2215898 - DNA, 18 bp, Homo sapiens
aagatgtgacatgtttta

SEQ ID NO: 2215899 - DNA, 15 bp, Homo sapiens
aagcacatgcctctc

SEQ ID NO: 2215900 - DNA, 13 bp, Homo sapiens
aagcagaaacaaa

SEQ ID NO: 2215901 - DNA, 14 bp, Homo sapiens
aagcagcgtttcta

SEQ ID NO: 2215902 - DNA, 17 bp, Homo sapiens
aagcagcgtttctatga

SEQ ID NO: 2215903 - DNA, 12 bp, Homo sapiens
aagcagtgcatg

SEQ ID NO: 2215904 - DNA, 12 bp, Homo sapiens
aagcatgtgaga

SEQ ID NO: 2215905 - DNA, 13 bp, Homo sapiens
aagccacagggtg

SEQ ID NO: 2215906 - DNA, 21 bp, Homo sapiens
aagccaccaacatactcccat

SEQ ID NO: 2215907 - DNA, 17 bp, Homo sapiens
aagcccaggaaaggctc

SEQ ID NO: 2215908 - DNA, 19 bp, Homo sapiens
aagcccaggaaaggctcca

SEQ ID NO: 2215909 - DNA, 20 bp, Homo sapiens
aagccgctggggccagttgg

SEQ ID NO: 2215910 - DNA, 22 bp, Homo sapiens
aagcgaaccgtgaggaggggtg

SEQ ID NO: 2215911 - DNA, 14 bp, Homo sapiens
aagcgattcttctg

SEQ ID NO: 2215912 - DNA, 14 bp, Homo sapiens
aagcggctggcagc

SEQ ID NO: 2215913 - DNA, 17 bp, Homo sapiens
aagcgtgagccactgca

SEQ ID NO: 2215914 - DNA, 21 bp, Homo sapiens
aagcgtgagccactgcaccgg

SEQ ID NO: 2215915 - DNA, 22 bp, Homo sapiens
aagctaggcctggccagatgca

SEQ ID NO: 2215916 - DNA, 16 bp, Homo sapiens
aagctcagggcctggc

SEQ ID NO: 2215917 - DNA, 17 bp, Homo sapiens
aagctcagggcctggct

SEQ ID NO: 2215918 - DNA, 18 bp, Homo sapiens
aagctcagggcctggctc

SEQ ID NO: 2215919 - DNA, 21 bp, Homo sapiens
aagctctactgaggtgctatg

SEQ ID NO: 2215920 - DNA, 19 bp, Homo sapiens
aagctgcaccctcaggcag

SEQ ID NO: 2215921 - DNA, 22 bp, Homo sapiens
aagctgcaccctcaggcaggtg

SEQ ID NO: 2215922 - DNA, 14 bp, Homo sapiens
aagctgctgacagt

SEQ ID NO: 2215923 - DNA, 15 bp, Homo sapiens
aaggaaacccagctc

SEQ ID NO: 2215924 - DNA, 15 bp, Homo sapiens
aaggaagacttcatc

SEQ ID NO: 2215925 - DNA, 23 bp, Homo sapiens
aaggaatgattaattaaaacaca

SEQ ID NO: 2215926 - DNA, 23 bp, Homo sapiens
aaggatgatctaggaagactttg

SEQ ID NO: 2215927 - DNA, 17 bp, Homo sapiens
aaggatgcttgtacata

SEQ ID NO: 2215928 - DNA, 15 bp, Homo sapiens
aaggattgctactgt

SEQ ID NO: 2215929 - DNA, 16 bp, Homo sapiens
aaggccccgcccaggc

SEQ ID NO: 2215930 - DNA, 13 bp, Homo sapiens
aaggctacctttg

SEQ ID NO: 2215931 - DNA, 19 bp, Homo sapiens
aaggctacctttgtattct

SEQ ID NO: 2215932 - DNA, 18 bp, Homo sapiens
aaggctccaggagcagcc

SEQ ID NO: 2215933 - DNA, 20 bp, Homo sapiens
aaggctgtcaattacaggaa

SEQ ID NO: 2215934 - DNA, 12 bp, Homo sapiens
aagggaaaaaga

SEQ ID NO: 2215935 - DNA, 18 bp, Homo sapiens
aagggacgctacccggga

SEQ ID NO: 2215936 - DNA, 13 bp, Homo sapiens
aagggcctggcct

SEQ ID NO: 2215937 - DNA, 14 bp, Homo sapiens
aagggcctggcctg

SEQ ID NO: 2215938 - DNA, 17 bp, Homo sapiens
aagggcctggcctgagc

SEQ ID NO: 2215939 - DNA, 23 bp, Homo sapiens
acgtggctgcttcaaggatcctg

SEQ ID NO: 2215940 - DNA, 13 bp, Homo sapiens
acgttgtgcattt

SEQ ID NO: 2215941 - DNA, 13 bp, Homo sapiens
actaaccacgctg

SEQ ID NO: 2215942 - DNA, 16 bp, Homo sapiens
actaaccagcagaaat

SEQ ID NO: 2215943 - DNA, 13 bp, Homo sapiens
actacattctgtt

SEQ ID NO: 2215944 - DNA, 17 bp, Homo sapiens
actagggaagataatat

SEQ ID NO: 2215945 - DNA, 12 bp, Homo sapiens
actataatgtaa

SEQ ID NO: 2215946 - DNA, 14 bp, Homo sapiens
actataatgtaagc

SEQ ID NO: 2215947 - DNA, 21 bp, Homo sapiens
actataatgtaagctctactg

SEQ ID NO: 2215948 - DNA, 23 bp, Homo sapiens
actataatttacctgaagtcttt

SEQ ID NO: 2215949 - DNA, 20 bp, Homo sapiens
actatagcctaggtgacaga

SEQ ID NO: 2215950 - DNA, 22 bp, Homo sapiens
actatagcctaggtgacagagt

SEQ ID NO: 2215951 - DNA, 21 bp, Homo sapiens
actatctaaatgttgaaagat

SEQ ID NO: 2215952 - DNA, 18 bp, Homo sapiens
actatgttgcccaggcag

SEQ ID NO: 2215953 - DNA, 20 bp, Homo sapiens
actatgttgcccaggcaggt

SEQ ID NO: 2215954 - DNA, 23 bp, Homo sapiens
actatgttgcccaggcaggtctt

SEQ ID NO: 2215955 - DNA, 16 bp, Homo sapiens
actattgttagtctct

SEQ ID NO: 2215956 - DNA, 16 bp, Homo sapiens
actcaatgcactgaca

SEQ ID NO: 2215957 - DNA, 19 bp, Homo sapiens
actcacatttattctgctc

SEQ ID NO: 2215958 - DNA, 17 bp, Homo sapiens
actcaccccagccccaa

SEQ ID NO: 2215959 - DNA, 21 bp, Homo sapiens
actcacctgcccctcaactct

SEQ ID NO: 2215960 - DNA, 14 bp, Homo sapiens
actcagaagacact

SEQ ID NO: 2215961 - DNA, 16 bp, Homo sapiens
actcagaagacactga

SEQ ID NO: 2215962 - DNA, 18 bp, Homo sapiens
actcagaagacactgatg

SEQ ID NO: 2215963 - DNA, 15 bp, Homo sapiens
actcattcttctgta

SEQ ID NO: 2215964 - DNA, 14 bp, Homo sapiens
actcccccaggtgg

SEQ ID NO: 2215965 - DNA, 13 bp, Homo sapiens
actcccctgctgg

SEQ ID NO: 2215966 - DNA, 17 bp, Homo sapiens
actcccctgctgggtgt

SEQ ID NO: 2215967 - DNA, 14 bp, Homo sapiens
actcctgcaggcag

SEQ ID NO: 2215968 - DNA, 18 bp, Homo sapiens
actcctgcaggcagccag

SEQ ID NO: 2215969 - DNA, 19 bp, Homo sapiens
actcctgcaggcagccagg

SEQ ID NO: 2215970 - DNA, 21 bp, Homo sapiens
actcctgcaggcagccaggcc

SEQ ID NO: 2215971 - DNA, 22 bp, Homo sapiens
actcctgcaggcagccaggcca

SEQ ID NO: 2215972 - DNA, 11 bp, Homo sapiens
actcctggcct

SEQ ID NO: 2215973 - DNA, 12 bp, Homo sapiens
actcctggcctc

SEQ ID NO: 2215974 - DNA, 13 bp, Homo sapiens
actcctggcctca

SEQ ID NO: 2215975 - DNA, 16 bp, Homo sapiens
actcgagttacagaca

SEQ ID NO: 2215976 - DNA, 17 bp, Homo sapiens
actcgcgacaatgcaaa

SEQ ID NO: 2215977 - DNA, 15 bp, Homo sapiens
actctacagaggcca

SEQ ID NO: 2215978 - DNA, 15 bp, Homo sapiens
actctagggaaaaac

SEQ ID NO: 2215979 - DNA, 17 bp, Homo sapiens
actctagggaaaaacca

SEQ ID NO: 2215980 - DNA, 13 bp, Homo sapiens
actctatttttgt

SEQ ID NO: 2215981 - DNA, 17 bp, Homo sapiens
actctcctctgctgctg

SEQ ID NO: 2215982 - DNA, 21 bp, Homo sapiens
actctcctctgctgctggctg

SEQ ID NO: 2215983 - DNA, 15 bp, Homo sapiens
actctccttggtgtc

SEQ ID NO: 2215984 - DNA, 13 bp, Homo sapiens
actctggcagctc

SEQ ID NO: 2215985 - DNA, 19 bp, Homo sapiens
actctggcagctcagagag

SEQ ID NO: 2215986 - DNA, 20 bp, Homo sapiens
actctggcagctcagagagg

SEQ ID NO: 2215987 - DNA, 19 bp, Homo sapiens
actctgtctcaaaaaaaca

SEQ ID NO: 2215988 - DNA, 16 bp, Homo sapiens
actctgtgtcaggtgg

SEQ ID NO: 2215989 - DNA, 21 bp, Homo sapiens
actctgtgtcaggtggggcag

SEQ ID NO: 2215990 - DNA, 19 bp, Homo sapiens
actcttattgcccacgctg

SEQ ID NO: 2215991 - DNA, 19 bp, Homo sapiens
actctttctattgtttctt

SEQ ID NO: 2215992 - DNA, 18 bp, Homo sapiens
actgagacagcccgggct

SEQ ID NO: 2215993 - DNA, 18 bp, Homo sapiens
actgagtacgttgtgcat

SEQ ID NO: 2215994 - DNA, 21 bp, Homo sapiens
actgagtacgttgtgcatttg

SEQ ID NO: 2215995 - DNA, 23 bp, Homo sapiens
actgagtacgttgtgcatttggt

SEQ ID NO: 2215996 - DNA, 13 bp, Homo sapiens
actgataaagatg

SEQ ID NO: 2215997 - DNA, 13 bp, Homo sapiens
actgatctctcgt

SEQ ID NO: 2215998 - DNA, 22 bp, Homo sapiens
actgatgggcaacccccagcct

SEQ ID NO: 2215999 - DNA, 16 bp, Homo sapiens
actgatttttttttcc

SEQ ID NO: 2216000 - DNA, 14 bp, Homo sapiens
actgcaccgggcca

SEQ ID NO: 2216001 - DNA, 20 bp, Homo sapiens
actgcactatagcctaggtg

SEQ ID NO: 2216002 - DNA, 18 bp, Homo sapiens
actgcactccagcctggg

SEQ ID NO: 2216003 - DNA, 19 bp, Homo sapiens
actgcactccagcctgggt

SEQ ID NO: 2216004 - DNA, 23 bp, Homo sapiens
actgcagcctcaacctcctgggc

SEQ ID NO: 2216005 - DNA, 20 bp, Homo sapiens
actgcatcaagatgtgacat

SEQ ID NO: 2216006 - DNA, 15 bp, Homo sapiens
actgcccggcagggt

SEQ ID NO: 2216007 - DNA, 20 bp, Homo sapiens
actgcttaacttcacatatt

SEQ ID NO: 2216008 - DNA, 21 bp, Homo sapiens
actgcttccagtgaggctctg

SEQ ID NO: 2216009 - DNA, 18 bp, Homo sapiens
actgggtacttgtggaca

SEQ ID NO: 2216010 - DNA, 18 bp, Homo sapiens
actggttccatggcctct

SEQ ID NO: 2216011 - DNA, 19 bp, Homo sapiens
actgtaatttgtgatacaa

SEQ ID NO: 2216012 - DNA, 13 bp, Homo sapiens
actgtacaaagta

SEQ ID NO: 2216013 - DNA, 15 bp, Homo sapiens
actgtacaaagtaga

SEQ ID NO: 2216014 - DNA, 22 bp, Homo sapiens
actgtacaaagtagaagtctta

SEQ ID NO: 2216015 - DNA, 19 bp, Homo sapiens
actgtacatgaaaacacat

SEQ ID NO: 2216016 - DNA, 18 bp, Homo sapiens
actgtgccatgtgccagg

SEQ ID NO: 2216017 - DNA, 21 bp, Homo sapiens
actgttaatagttcaggtaac

SEQ ID NO: 2216018 - DNA, 13 bp, Homo sapiens
actgtttcaaact

SEQ ID NO: 2216019 - DNA, 16 bp, Homo sapiens
acttaaataatgtgaa

SEQ ID NO: 2216020 - DNA, 17 bp, Homo sapiens
acttaaataatgtgaaa

SEQ ID NO: 2216021 - DNA, 20 bp, Homo sapiens
acttaaataatgtgaaactg

SEQ ID NO: 2216022 - DNA, 13 bp, Homo sapiens
acttaagcacact

SEQ ID NO: 2216023 - DNA, 19 bp, Homo sapiens
acttaatctaaatggaacc

SEQ ID NO: 2216024 - DNA, 14 bp, Homo sapiens
acttactgtacatg

SEQ ID NO: 2216025 - DNA, 20 bp, Homo sapiens
acttagaggtggggagcaga

SEQ ID NO: 2216026 - DNA, 17 bp, Homo sapiens
acttccactgccatcct

SEQ ID NO: 2216027 - DNA, 17 bp, Homo sapiens
acttcgggaggtcgagg

SEQ ID NO: 2216028 - DNA, 22 bp, Homo sapiens
acttcgggaggtcgaggcagga

SEQ ID NO: 2216029 - DNA, 14 bp, Homo sapiens
acttctccaccctg

SEQ ID NO: 2216030 - DNA, 19 bp, Homo sapiens
acttctgccatattctgtt

SEQ ID NO: 2216031 - DNA, 17 bp, Homo sapiens
acttgaaaaaaaaaaac

SEQ ID NO: 2216032 - DNA, 15 bp, Homo sapiens
acttgggccactgtg

SEQ ID NO: 2216033 - DNA, 14 bp, Homo sapiens
acttgtggacacag

SEQ ID NO: 2216034 - DNA, 18 bp, Homo sapiens
acttgtggacacagctct

SEQ ID NO: 2216035 - DNA, 16 bp, Homo sapiens
actttaaaaggagcca

SEQ ID NO: 2216036 - DNA, 18 bp, Homo sapiens
actttaccttttttatac

SEQ ID NO: 2216037 - DNA, 12 bp, Homo sapiens
actttgacctct

SEQ ID NO: 2216038 - DNA, 16 bp, Homo sapiens
actttgacctctgcag

SEQ ID NO: 2216039 - DNA, 18 bp, Homo sapiens
actttgtgttcaccttgt

SEQ ID NO: 2216040 - DNA, 17 bp, Homo sapiens
agaaaaaatattttccc

SEQ ID NO: 2216041 - DNA, 19 bp, Homo sapiens
agaaaaaatattttcccta

SEQ ID NO: 2216042 - DNA, 18 bp, Homo sapiens
agaaaaaggatgcacaga

SEQ ID NO: 2216043 - DNA, 15 bp, Homo sapiens
agaaaatggacgtgt

SEQ ID NO: 2216044 - DNA, 23 bp, Homo sapiens
agaaaatggacgtgttatgactc

SEQ ID NO: 2216045 - DNA, 14 bp, Homo sapiens
agaaacaaaatgaa

SEQ ID NO: 2216046 - DNA, 19 bp, Homo sapiens
agaaacaaaatgaaaaaaa

SEQ ID NO: 2216047 - DNA, 14 bp, Homo sapiens
agaaagagagagag

SEQ ID NO: 2216048 - DNA, 22 bp, Homo sapiens
agaaagtacttctccaccctgc

SEQ ID NO: 2216049 - DNA, 19 bp, Homo sapiens
agaaatatctgaaaatgta

SEQ ID NO: 2216050 - DNA, 23 bp, Homo sapiens
agaagagaatgcacaaacagagg

SEQ ID NO: 2216051 - DNA, 16 bp, Homo sapiens
agaagcagaggaagga

SEQ ID NO: 2216052 - DNA, 21 bp, Homo sapiens
agaagcccaggaaaggctcca

SEQ ID NO: 2216053 - DNA, 15 bp, Homo sapiens
agaagcggctggcag

SEQ ID NO: 2216054 - DNA, 18 bp, Homo sapiens
agaaggggcccaagagag

SEQ ID NO: 2216055 - DNA, 14 bp, Homo sapiens
agaagtaacttact

SEQ ID NO: 2216056 - DNA, 19 bp, Homo sapiens
agaagtcttagatgtatat

SEQ ID NO: 2216057 - DNA, 22 bp, Homo sapiens
agaagtttctgccgcagccctg

SEQ ID NO: 2216058 - DNA, 23 bp, Homo sapiens
agaagtttctgccgcagccctgc

SEQ ID NO: 2216059 - DNA, 23 bp, Homo sapiens
agaatgcacaaacagaggccgcc

SEQ ID NO: 2216060 - DNA, 13 bp, Homo sapiens
agaatgcagagat

SEQ ID NO: 2216061 - DNA, 21 bp, Homo sapiens
agaatgtgtttaaacttggtt

SEQ ID NO: 2216062 - DNA, 20 bp, Homo sapiens
agaattataattagttcctc

SEQ ID NO: 2216063 - DNA, 19 bp, Homo sapiens
agggcgggaggatgttctg

SEQ ID NO: 2216064 - DNA, 13 bp, Homo sapiens
aggggaaaagagg

SEQ ID NO: 2216065 - DNA, 14 bp, Homo sapiens
aggggaacagactg

SEQ ID NO: 2216066 - DNA, 11 bp, Homo sapiens
aggggaagaaa

SEQ ID NO: 2216067 - DNA, 23 bp, Homo sapiens
aggggagcaaaatcgatgcagtg

SEQ ID NO: 2216068 - DNA, 15 bp, Homo sapiens
aggggcacagggtct

SEQ ID NO: 2216069 - DNA, 16 bp, Homo sapiens
aggggcccaagagaga

SEQ ID NO: 2216070 - DNA, 14 bp, Homo sapiens
aggggggtgggagg

SEQ ID NO: 2216071 - DNA, 17 bp, Homo sapiens
agggggtggcctcccaa

SEQ ID NO: 2216072 - DNA, 19 bp, Homo sapiens
agggtactaaggaatcttt

SEQ ID NO: 2216073 - DNA, 19 bp, Homo sapiens
agggtatcaggtgctgcca

SEQ ID NO: 2216074 - DNA, 21 bp, Homo sapiens
agggtatcaggtgctgccatc

SEQ ID NO: 2216075 - DNA, 15 bp, Homo sapiens
agggtatctggtgac

SEQ ID NO: 2216076 - DNA, 22 bp, Homo sapiens
agggtccctggtggcagctcac

SEQ ID NO: 2216077 - DNA, 22 bp, Homo sapiens
agggtctcactatgttgcccag

SEQ ID NO: 2216078 - DNA, 21 bp, Homo sapiens
agggtctcactctgtcgccca

SEQ ID NO: 2216079 - DNA, 18 bp, Homo sapiens
agggtggtgacctctgcc

SEQ ID NO: 2216080 - DNA, 19 bp, Homo sapiens
agggtggtgacctctgcct

SEQ ID NO: 2216081 - DNA, 22 bp, Homo sapiens
agggtgtccggtccctgtccca

SEQ ID NO: 2216082 - DNA, 15 bp, Homo sapiens
agggttgggctggtg

SEQ ID NO: 2216083 - DNA, 17 bp, Homo sapiens
agggttgggctggtgtc

SEQ ID NO: 2216084 - DNA, 22 bp, Homo sapiens
agggttttgccatgttggccag

SEQ ID NO: 2216085 - DNA, 13 bp, Homo sapiens
aggtactctcctg

SEQ ID NO: 2216086 - DNA, 17 bp, Homo sapiens
aggtagaaatatctgaa

SEQ ID NO: 2216087 - DNA, 19 bp, Homo sapiens
aggtagaaatatctgaaaa

SEQ ID NO: 2216088 - DNA, 17 bp, Homo sapiens
aggtatgcaatcaaatc

SEQ ID NO: 2216089 - DNA, 18 bp, Homo sapiens
aggtcagagcctgcagtt

SEQ ID NO: 2216090 - DNA, 17 bp, Homo sapiens
aggtcttgaactcctgg

SEQ ID NO: 2216091 - DNA, 13 bp, Homo sapiens
aggtgacagagtg

SEQ ID NO: 2216092 - DNA, 16 bp, Homo sapiens
aggtgagaagcagagg

SEQ ID NO: 2216093 - DNA, 18 bp, Homo sapiens
aggtgcacaagctccaag

SEQ ID NO: 2216094 - DNA, 21 bp, Homo sapiens
aggtgcacaagctccaagctc

SEQ ID NO: 2216095 - DNA, 18 bp, Homo sapiens
aggtgcctcaagagaagg

SEQ ID NO: 2216096 - DNA, 22 bp, Homo sapiens
aggtgctaggaacactccttca

SEQ ID NO: 2216097 - DNA, 16 bp, Homo sapiens
aggtgctgccatccag

SEQ ID NO: 2216098 - DNA, 14 bp, Homo sapiens
aggtggggcagctt

SEQ ID NO: 2216099 - DNA, 23 bp, Homo sapiens
aggtggggcagcttgagggttgg

SEQ ID NO: 2216100 - DNA, 19 bp, Homo sapiens
aggtggggtcactctggca

SEQ ID NO: 2216101 - DNA, 20 bp, Homo sapiens
aggtgtgactgaatttcttt

SEQ ID NO: 2216102 - DNA, 20 bp, Homo sapiens
aggtgtgagtcaccaagccc

SEQ ID NO: 2216103 - DNA, 12 bp, Homo sapiens
aggtgtgctctg

SEQ ID NO: 2216104 - DNA, 15 bp, Homo sapiens
aggtgtgctctgatc

SEQ ID NO: 2216105 - DNA, 22 bp, Homo sapiens
aggttccctttgacgccatccc

SEQ ID NO: 2216106 - DNA, 23 bp, Homo sapiens
aggttccctttgacgccatccca

SEQ ID NO: 2216107 - DNA, 14 bp, Homo sapiens
aggttggtgggggc

SEQ ID NO: 2216108 - DNA, 21 bp, Homo sapiens
agtaaatgggggtgcatttga

SEQ ID NO: 2216109 - DNA, 17 bp, Homo sapiens
agtaatatgcacacatt

SEQ ID NO: 2216110 - DNA, 14 bp, Homo sapiens
agtacactgtttca

SEQ ID NO: 2216111 - DNA, 20 bp, Homo sapiens
agtacactgtttcaaacttt

SEQ ID NO: 2216112 - DNA, 21 bp, Homo sapiens
agtacactgtttcaaacttta

SEQ ID NO: 2216113 - DNA, 12 bp, Homo sapiens
agtactatgtat

SEQ ID NO: 2216114 - DNA, 21 bp, Homo sapiens
agtacttctccaccctgctct

SEQ ID NO: 2216115 - DNA, 11 bp, Homo sapiens
agtagagacag

SEQ ID NO: 2216116 - DNA, 19 bp, Homo sapiens
agtagctgggactacaggc

SEQ ID NO: 2216117 - DNA, 16 bp, Homo sapiens
agtaggaagactttgg

SEQ ID NO: 2216118 - DNA, 22 bp, Homo sapiens
agtaggaagactttggaaagac

SEQ ID NO: 2216119 - DNA, 15 bp, Homo sapiens
agtatgaggcatttg

SEQ ID NO: 2216120 - DNA, 21 bp, Homo sapiens
agtatgaggcatttgtttgaa

SEQ ID NO: 2216121 - DNA, 16 bp, Homo sapiens
agtatggtggctgggt

SEQ ID NO: 2216122 - DNA, 23 bp, Homo sapiens
agtcacacagtattacttctgct

SEQ ID NO: 2216123 - DNA, 14 bp, Homo sapiens
agtcaccaagccca

SEQ ID NO: 2216124 - DNA, 17 bp, Homo sapiens
agtcaccccggccacct

SEQ ID NO: 2216125 - DNA, 19 bp, Homo sapiens
agtcaccccggccacctgc

SEQ ID NO: 2216126 - DNA, 18 bp, Homo sapiens
agtcactgagacagcccg

SEQ ID NO: 2216127 - DNA, 19 bp, Homo sapiens
agtcactgagacagcccgg

SEQ ID NO: 2216128 - DNA, 19 bp, Homo sapiens
agtcccaccttggctgcag

SEQ ID NO: 2216129 - DNA, 14 bp, Homo sapiens
agtccctgccaatg

SEQ ID NO: 2216130 - DNA, 16 bp, Homo sapiens
agtccctgccaatgga

SEQ ID NO: 2216131 - DNA, 14 bp, Homo sapiens
agtcctcttttctg

SEQ ID NO: 2216132 - DNA, 22 bp, Homo sapiens
agtcctcttttctgagaggact

SEQ ID NO: 2216133 - DNA, 16 bp, Homo sapiens
agtctcactgttgccc

SEQ ID NO: 2216134 - DNA, 17 bp, Homo sapiens
agtctcttgattcataa

SEQ ID NO: 2216135 - DNA, 15 bp, Homo sapiens
agtctgaaggctggg

SEQ ID NO: 2216136 - DNA, 17 bp, Homo sapiens
agtctgaaggctgggtt

SEQ ID NO: 2216137 - DNA, 21 bp, Homo sapiens
agtctgattcccaagctctgc

SEQ ID NO: 2216138 - DNA, 14 bp, Homo sapiens
agtcttagatgtat

SEQ ID NO: 2216139 - DNA, 14 bp, Homo sapiens
agtctttgtacaga

SEQ ID NO: 2216140 - DNA, 20 bp, Homo sapiens
agtgaaaaaggaggaagaga

SEQ ID NO: 2216141 - DNA, 16 bp, Homo sapiens
agtgaacttgggccac

SEQ ID NO: 2216142 - DNA, 20 bp, Homo sapiens
agtgaacttgggccactgtg

SEQ ID NO: 2216143 - DNA, 21 bp, Homo sapiens
agtgactgatggctaatgtac

SEQ ID NO: 2216144 - DNA, 17 bp, Homo sapiens
agtgagactctgtctca

SEQ ID NO: 2216145 - DNA, 14 bp, Homo sapiens
agtgagagctgggt

SEQ ID NO: 2216146 - DNA, 14 bp, Homo sapiens
agtgagcactaagg

SEQ ID NO: 2216147 - DNA, 12 bp, Homo sapiens
agtgaggctctg

SEQ ID NO: 2216148 - DNA, 16 bp, Homo sapiens
agtgagtcgaggacag

SEQ ID NO: 2216149 - DNA, 15 bp, Homo sapiens
agtgatcctcccacc

SEQ ID NO: 2216150 - DNA, 18 bp, Homo sapiens
agtgatcctcccacctca

SEQ ID NO: 2216151 - DNA, 17 bp, Homo sapiens
agtgcagtgagccgaga

SEQ ID NO: 2216152 - DNA, 18 bp, Homo sapiens
agtgccttacacaatggt

SEQ ID NO: 2216153 - DNA, 14 bp, Homo sapiens
agtgccttatggaa

SEQ ID NO: 2216154 - DNA, 15 bp, Homo sapiens
agtgccttatggaac

SEQ ID NO: 2216155 - DNA, 19 bp, Homo sapiens
agtgctgggattacaggtg

SEQ ID NO: 2216156 - DNA, 20 bp, Homo sapiens
agtgctgggattacaggtgt

SEQ ID NO: 2216157 - DNA, 20 bp, Homo sapiens
agtggtggttttctgttctt

SEQ ID NO: 2216158 - DNA, 21 bp, Homo sapiens
agtggtggttttctgttcttt

SEQ ID NO: 2216159 - DNA, 21 bp, Homo sapiens
agtgtacatggaataacatgt

SEQ ID NO: 2216160 - DNA, 18 bp, Homo sapiens
agtgtatttttttactaa

SEQ ID NO: 2216161 - DNA, 22 bp, Homo sapiens
agtgtggtgtttcctggcactg

SEQ ID NO: 2216162 - DNA, 18 bp, Homo sapiens
agttacactaaaaggtga

SEQ ID NO: 2216163 - DNA, 17 bp, Homo sapiens
agttacagacaaagcgt

SEQ ID NO: 2216164 - DNA, 18 bp, Homo sapiens
agttacagacaaagcgtg

SEQ ID NO: 2216165 - DNA, 13 bp, Homo sapiens
agttactcagaat

SEQ ID NO: 2216166 - DNA, 19 bp, Homo sapiens
agttcatcttgaattgtaa

SEQ ID NO: 2216167 - DNA, 18 bp, Homo sapiens
agttgaaaaacagctgag

SEQ ID NO: 2216168 - DNA, 14 bp, Homo sapiens
agttgaagacagag

SEQ ID NO: 2216169 - DNA, 16 bp, Homo sapiens
agttgatactacagtt

SEQ ID NO: 2216170 - DNA, 21 bp, Homo sapiens
agttgatagcacagaccctgc

SEQ ID NO: 2216171 - DNA, 22 bp, Homo sapiens
agttgatagcacagaccctgcc

SEQ ID NO: 2216172 - DNA, 15 bp, Homo sapiens
agttgattcagctct

SEQ ID NO: 2216173 - DNA, 20 bp, Homo sapiens
agttgccagtcaccccggcc

SEQ ID NO: 2216174 - DNA, 16 bp, Homo sapiens
agttggctaggacccc

SEQ ID NO: 2216175 - DNA, 19 bp, Homo sapiens
agttgggcttcctcatagt

SEQ ID NO: 2216176 - DNA, 17 bp, Homo sapiens
agttggtcccccttcca

SEQ ID NO: 2216177 - DNA, 20 bp, Homo sapiens
agttgttacatttttaagtg

SEQ ID NO: 2216178 - DNA, 22 bp, Homo sapiens
agttgttagtgtgtcttagtgt

SEQ ID NO: 2216179 - DNA, 20 bp, Homo sapiens
agttgtttgattcagacagc

SEQ ID NO: 2216180 - DNA, 23 bp, Homo sapiens
agttgtttgattcagacagctgc

SEQ ID NO: 2216181 - DNA, 13 bp, Homo sapiens
agtttctccaagc

SEQ ID NO: 2216182 - DNA, 15 bp, Homo sapiens
agtttctccaagcag

SEQ ID NO: 2216183 - DNA, 21 bp, Homo sapiens
agtttctccaagcaggacatg

SEQ ID NO: 2216184 - DNA, 16 bp, Homo sapiens
agtttgattaaattct

SEQ ID NO: 2216185 - DNA, 18 bp, Homo sapiens
agtttgattaaattcttg

SEQ ID NO: 2216186 - DNA, 22 bp, Homo sapiens
caaccccttcgctcctgtgtct

SEQ ID NO: 2216187 - DNA, 13 bp, Homo sapiens
caacgtctgtgcc

SEQ ID NO: 2216188 - DNA, 16 bp, Homo sapiens
caactcaccccagccc

SEQ ID NO: 2216189 - DNA, 14 bp, Homo sapiens
caactctcctccag

SEQ ID NO: 2216190 - DNA, 19 bp, Homo sapiens
caactctcctccagagtca

SEQ ID NO: 2216191 - DNA, 20 bp, Homo sapiens
caactctcctccagagtcag

SEQ ID NO: 2216192 - DNA, 17 bp, Homo sapiens
caactgcatcaagatgt

SEQ ID NO: 2216193 - DNA, 16 bp, Homo sapiens
caactgcattggcttt

SEQ ID NO: 2216194 - DNA, 17 bp, Homo sapiens
caagaaggatgattcaa

SEQ ID NO: 2216195 - DNA, 17 bp, Homo sapiens
caagaccacgtttctaa

SEQ ID NO: 2216196 - DNA, 18 bp, Homo sapiens
caagaccacgtttctaaa

SEQ ID NO: 2216197 - DNA, 15 bp, Homo sapiens
caagacgctgtgctg

SEQ ID NO: 2216198 - DNA, 16 bp, Homo sapiens
caagacgctgtgctgc

SEQ ID NO: 2216199 - DNA, 18 bp, Homo sapiens
caagacgctgtgctgccc

SEQ ID NO: 2216200 - DNA, 22 bp, Homo sapiens
caagagagacagcacaggcagc

SEQ ID NO: 2216201 - DNA, 16 bp, Homo sapiens
caagagcccaggcctc

SEQ ID NO: 2216202 - DNA, 18 bp, Homo sapiens
caagcacctcctgcctcg

SEQ ID NO: 2216203 - DNA, 22 bp, Homo sapiens
caagccaccaacatactcccat

SEQ ID NO: 2216204 - DNA, 18 bp, Homo sapiens
caagcgtgagccactgca

SEQ ID NO: 2216205 - DNA, 12 bp, Homo sapiens
caagctccaagc

SEQ ID NO: 2216206 - DNA, 17 bp, Homo sapiens
caagctccaagctccca

SEQ ID NO: 2216207 - DNA, 12 bp, Homo sapiens
caagctcccagg

SEQ ID NO: 2216208 - DNA, 14 bp, Homo sapiens
caagctcccaggca

SEQ ID NO: 2216209 - DNA, 15 bp, Homo sapiens
caagctcccaggcat

SEQ ID NO: 2216210 - DNA, 13 bp, Homo sapiens
caagctgcaccct

SEQ ID NO: 2216211 - DNA, 14 bp, Homo sapiens
caagctgcaccctc

SEQ ID NO: 2216212 - DNA, 21 bp, Homo sapiens
caagctgcaccctcaggcagg

SEQ ID NO: 2216213 - DNA, 16 bp, Homo sapiens
caaggagatttacaac

SEQ ID NO: 2216214 - DNA, 15 bp, Homo sapiens
caaggatcctgagcc

SEQ ID NO: 2216215 - DNA, 22 bp, Homo sapiens
caaggatcctgagccagatttc

SEQ ID NO: 2216216 - DNA, 18 bp, Homo sapiens
caaggccaaaggaagcac

SEQ ID NO: 2216217 - DNA, 19 bp, Homo sapiens
caaggccaaaggaagcaca

SEQ ID NO: 2216218 - DNA, 21 bp, Homo sapiens
caaggccaaaggaagcacatg

SEQ ID NO: 2216219 - DNA, 21 bp, Homo sapiens
caaggctgggggaagaagctc

SEQ ID NO: 2216220 - DNA, 14 bp, Homo sapiens
caaggctgtcaatt

SEQ ID NO: 2216221 - DNA, 21 bp, Homo sapiens
caaggctgtcaattacaggaa

SEQ ID NO: 2216222 - DNA, 23 bp, Homo sapiens
caaggctgtcaattacaggaagt

SEQ ID NO: 2216223 - DNA, 14 bp, Homo sapiens
caagggcctggcct

SEQ ID NO: 2216224 - DNA, 17 bp, Homo sapiens
caaggggcccaaattct

SEQ ID NO: 2216225 - DNA, 14 bp, Homo sapiens
caaggtcatttttt

SEQ ID NO: 2216226 - DNA, 13 bp, Homo sapiens
caagtattatacc

SEQ ID NO: 2216227 - DNA, 22 bp, Homo sapiens
caagtattataccttttttaga

SEQ ID NO: 2216228 - DNA, 13 bp, Homo sapiens
caagtcaagtgaa

SEQ ID NO: 2216229 - DNA, 14 bp, Homo sapiens
caagtcctcttttc

SEQ ID NO: 2216230 - DNA, 15 bp, Homo sapiens
caagtgagaccctgt

SEQ ID NO: 2216231 - DNA, 18 bp, Homo sapiens
caagtgagagctgggtgt

SEQ ID NO: 2216232 - DNA, 18 bp, Homo sapiens
caagtgattctcctgcct

SEQ ID NO: 2216233 - DNA, 19 bp, Homo sapiens
caagtgattctcctgcctc

SEQ ID NO: 2216234 - DNA, 21 bp, Homo sapiens
caagtgattctcctgcctcag

SEQ ID NO: 2216235 - DNA, 12 bp, Homo sapiens
caataggaaaaa

SEQ ID NO: 2216236 - DNA, 13 bp, Homo sapiens
caataggaaaaac

SEQ ID NO: 2216237 - DNA, 15 bp, Homo sapiens
caataggaaaaactg

SEQ ID NO: 2216238 - DNA, 17 bp, Homo sapiens
caataggaaaaactgat

SEQ ID NO: 2216239 - DNA, 20 bp, Homo sapiens
caataggaaaaactgatttt

SEQ ID NO: 2216240 - DNA, 14 bp, Homo sapiens
caatcaaatctgct

SEQ ID NO: 2216241 - DNA, 13 bp, Homo sapiens
caatgacctttca

SEQ ID NO: 2216242 - DNA, 16 bp, Homo sapiens
caatgacctttcaata

SEQ ID NO: 2216243 - DNA, 23 bp, Homo sapiens
caatgacctttcaataggaaaaa

SEQ ID NO: 2216244 - DNA, 17 bp, Homo sapiens
caatgacttactgtaca

SEQ ID NO: 2216245 - DNA, 20 bp, Homo sapiens
caatgcaaaccatcattgaa

SEQ ID NO: 2216246 - DNA, 13 bp, Homo sapiens
caatgcactttgt

SEQ ID NO: 2216247 - DNA, 23 bp, Homo sapiens
caatgcactttgttctggctctt

SEQ ID NO: 2216248 - DNA, 21 bp, Homo sapiens
caatgctggctgttggctggg

SEQ ID NO: 2216249 - DNA, 22 bp, Homo sapiens
caatgctggctgttggctgggg

SEQ ID NO: 2216250 - DNA, 16 bp, Homo sapiens
caatggcagccttggc

SEQ ID NO: 2216251 - DNA, 14 bp, Homo sapiens
caatgttctctctt

SEQ ID NO: 2216252 - DNA, 20 bp, Homo sapiens
caatttattatggcacatca

SEQ ID NO: 2216253 - DNA, 17 bp, Homo sapiens
cacaaaggtagcttttc

SEQ ID NO: 2216254 - DNA, 16 bp, Homo sapiens
cacaagacccttgtgg

SEQ ID NO: 2216255 - DNA, 16 bp, Homo sapiens
cacaagagcccaggcc

SEQ ID NO: 2216256 - DNA, 20 bp, Homo sapiens
cacaagagcccaggcctcct

SEQ ID NO: 2216257 - DNA, 18 bp, Homo sapiens
cacaagctccaagctccc

SEQ ID NO: 2216258 - DNA, 23 bp, Homo sapiens
cacaagctccaagctcccaggca

SEQ ID NO: 2216259 - DNA, 16 bp, Homo sapiens
cacacaccagagccca

SEQ ID NO: 2216260 - DNA, 14 bp, Homo sapiens
cacacactttggct

SEQ ID NO: 2216261 - DNA, 19 bp, Homo sapiens
cacacagaggctgcctctc

SEQ ID NO: 2216262 - DNA, 15 bp, Homo sapiens
cacacagctctgtcc

SEQ ID NO: 2216263 - DNA, 21 bp, Homo sapiens
cacacagtgagtcgaggacag

SEQ ID NO: 2216264 - DNA, 21 bp, Homo sapiens
cacacatgagcatcaggccag

SEQ ID NO: 2216265 - DNA, 16 bp, Homo sapiens
cacacattttttaaat

SEQ ID NO: 2216266 - DNA, 19 bp, Homo sapiens
cacacattttttaaatgca

SEQ ID NO: 2216267 - DNA, 12 bp, Homo sapiens
cacaccagagcc

SEQ ID NO: 2216268 - DNA, 22 bp, Homo sapiens
cacagaaaatggaagacagctc

SEQ ID NO: 2216269 - DNA, 18 bp, Homo sapiens
cacagacatactaaccag

SEQ ID NO: 2216270 - DNA, 13 bp, Homo sapiens
cacagaccctgcc

SEQ ID NO: 2216271 - DNA, 18 bp, Homo sapiens
cacagaccctgccctgtg

SEQ ID NO: 2216272 - DNA, 20 bp, Homo sapiens
cacagagaaagtacttctcc

SEQ ID NO: 2216273 - DNA, 20 bp, Homo sapiens
cacagagttgttacattttt

SEQ ID NO: 2216274 - DNA, 14 bp, Homo sapiens
cacagctctgtcct

SEQ ID NO: 2216275 - DNA, 17 bp, Homo sapiens
cacagctcttctccagg

SEQ ID NO: 2216276 - DNA, 22 bp, Homo sapiens
cacagctggggtggggacctca

SEQ ID NO: 2216277 - DNA, 23 bp, Homo sapiens
cacagctggggtggggacctcag

SEQ ID NO: 2216278 - DNA, 15 bp, Homo sapiens
cacaggatcagtctg

SEQ ID NO: 2216279 - DNA, 16 bp, Homo sapiens
cacaggatcagtctga

SEQ ID NO: 2216280 - DNA, 17 bp, Homo sapiens
cacaggatcagtctgat

SEQ ID NO: 2216281 - DNA, 10 bp, Homo sapiens
cacaggcagg

SEQ ID NO: 2216282 - DNA, 15 bp, Homo sapiens
cacaggcaggtccag

SEQ ID NO: 2216283 - DNA, 19 bp, Homo sapiens
cacaggcccggctccaggc

SEQ ID NO: 2216284 - DNA, 18 bp, Homo sapiens
cacagtattacttctgct

SEQ ID NO: 2216285 - DNA, 19 bp, Homo sapiens
cacagtattacttctgcta

SEQ ID NO: 2216286 - DNA, 22 bp, Homo sapiens
cacagtccttaccagcagagca

SEQ ID NO: 2216287 - DNA, 19 bp, Homo sapiens
cacagtgagtcgaggacag

SEQ ID NO: 2216288 - DNA, 17 bp, Homo sapiens
cacagttcaattctcat

SEQ ID NO: 2216289 - DNA, 14 bp, Homo sapiens
cacagttctctcct

SEQ ID NO: 2216290 - DNA, 15 bp, Homo sapiens
cacagttctctcctt

SEQ ID NO: 2216291 - DNA, 17 bp, Homo sapiens
cacatacacacacacgc

SEQ ID NO: 2216292 - DNA, 18 bp, Homo sapiens
cacatcagcacgatttct

SEQ ID NO: 2216293 - DNA, 19 bp, Homo sapiens
cacatcagcacgatttctg

SEQ ID NO: 2216294 - DNA, 20 bp, Homo sapiens
cacatcagcacgatttctgt

SEQ ID NO: 2216295 - DNA, 21 bp, Homo sapiens
cacatcagcacgatttctgtt

SEQ ID NO: 2216296 - DNA, 19 bp, Homo sapiens
cacatcttgctctgctgac

SEQ ID NO: 2216297 - DNA, 21 bp, Homo sapiens
cacatcttgctctgctgacag

SEQ ID NO: 2216298 - DNA, 13 bp, Homo sapiens
cacatgagcatca

SEQ ID NO: 2216299 - DNA, 17 bp, Homo sapiens
cacatgagcatcaggcc

SEQ ID NO: 2216300 - DNA, 20 bp, Homo sapiens
cacatgcaaggtcatttttt

SEQ ID NO: 2216301 - DNA, 21 bp, Homo sapiens
cacatgcctctctcaggccaa

SEQ ID NO: 2216302 - DNA, 15 bp, Homo sapiens
cacatgtgcacatgc

SEQ ID NO: 2216303 - DNA, 21 bp, Homo sapiens
cacattttttaaatgcacctg

SEQ ID NO: 2216304 - DNA, 20 bp, Homo sapiens
caccaacatactcccatctg

SEQ ID NO: 2216305 - DNA, 21 bp, Homo sapiens
caccaacatactcccatctgt

SEQ ID NO: 2216306 - DNA, 23 bp, Homo sapiens
caccaacatactcccatctgtga

SEQ ID NO: 2216307 - DNA, 15 bp, Homo sapiens
caccacacccagccc

SEQ ID NO: 2216308 - DNA, 15 bp, Homo sapiens
caccacatgtgcaca

SEQ ID NO: 2216309 - DNA, 18 bp, Homo sapiens
caccacatgtgcacatgc

SEQ ID NO: 2216310 - DNA, 21 bp, Homo sapiens
cagtgaggctctgcccttggt

SEQ ID NO: 2216311 - DNA, 19 bp, Homo sapiens
cagtgagtcgaggacaggg

SEQ ID NO: 2216312 - DNA, 23 bp, Homo sapiens
cagtgagtcgaggacagggaggt

SEQ ID NO: 2216313 - DNA, 16 bp, Homo sapiens
cagtgcatgctgtccc

SEQ ID NO: 2216314 - DNA, 15 bp, Homo sapiens
cagtgcccacaggat

SEQ ID NO: 2216315 - DNA, 18 bp, Homo sapiens
cagtgccgagaaggaagc

SEQ ID NO: 2216316 - DNA, 11 bp, Homo sapiens
cagtgccttat

SEQ ID NO: 2216317 - DNA, 13 bp, Homo sapiens
cagtgccttatgg

SEQ ID NO: 2216318 - DNA, 16 bp, Homo sapiens
cagtgccttatggaac

SEQ ID NO: 2216319 - DNA, 20 bp, Homo sapiens
cagtgccttatggaacactc

SEQ ID NO: 2216320 - DNA, 21 bp, Homo sapiens
cagtgccttatggaacactct

SEQ ID NO: 2216321 - DNA, 13 bp, Homo sapiens
cagtggcagctgc

SEQ ID NO: 2216322 - DNA, 18 bp, Homo sapiens
cagtgggagctgcctgtt

SEQ ID NO: 2216323 - DNA, 18 bp, Homo sapiens
cagtggggctggaagcag

SEQ ID NO: 2216324 - DNA, 20 bp, Homo sapiens
cagtggggctggaagcagaa

SEQ ID NO: 2216325 - DNA, 20 bp, Homo sapiens
cagtggtatgatcacggctc

SEQ ID NO: 2216326 - DNA, 19 bp, Homo sapiens
cagtggtgcgatctgggtt

SEQ ID NO: 2216327 - DNA, 20 bp, Homo sapiens
cagtggtgcgatctgggttc

SEQ ID NO: 2216328 - DNA, 20 bp, Homo sapiens
cagtggtggttttctgttct

SEQ ID NO: 2216329 - DNA, 22 bp, Homo sapiens
cagtggttcctaatcctctagg

SEQ ID NO: 2216330 - DNA, 12 bp, Homo sapiens
cagtgtgactga

SEQ ID NO: 2216331 - DNA, 22 bp, Homo sapiens
cagtgttgtggatttaacagaa

SEQ ID NO: 2216332 - DNA, 14 bp, Homo sapiens
cagttaagagaaat

SEQ ID NO: 2216333 - DNA, 19 bp, Homo sapiens
cagttgaaaaacagctgag

SEQ ID NO: 2216334 - DNA, 18 bp, Homo sapiens
cagttgggtggatgcctg

SEQ ID NO: 2216335 - DNA, 18 bp, Homo sapiens
cagttggtcccccttcca

SEQ ID NO: 2216336 - DNA, 20 bp, Homo sapiens
cagttggtcccccttccatg

SEQ ID NO: 2216337 - DNA, 21 bp, Homo sapiens
cagttggtcccccttccatgg

SEQ ID NO: 2216338 - DNA, 22 bp, Homo sapiens
cagttggtcccccttccatgga

SEQ ID NO: 2216339 - DNA, 14 bp, Homo sapiens
cataatgcgtgcat

SEQ ID NO: 2216340 - DNA, 21 bp, Homo sapiens
cataatgcgtgcataccactt

SEQ ID NO: 2216341 - DNA, 23 bp, Homo sapiens
cataatgcgtgcataccactttt

SEQ ID NO: 2216342 - DNA, 14 bp, Homo sapiens
cataccacttttgt

SEQ ID NO: 2216343 - DNA, 19 bp, Homo sapiens
cataccacttttgttcttg

SEQ ID NO: 2216344 - DNA, 12 bp, Homo sapiens
catacccacccc

SEQ ID NO: 2216345 - DNA, 21 bp, Homo sapiens
catactaaccagcagaaatgc

SEQ ID NO: 2216346 - DNA, 18 bp, Homo sapiens
catactcccatctgtgaa

SEQ ID NO: 2216347 - DNA, 19 bp, Homo sapiens
catagagagcaagacgctg

SEQ ID NO: 2216348 - DNA, 22 bp, Homo sapiens
catagcagagaatgaaagggcc

SEQ ID NO: 2216349 - DNA, 23 bp, Homo sapiens
catagcagagaatgaaagggccc

SEQ ID NO: 2216350 - DNA, 16 bp, Homo sapiens
catagtatggtggctg

SEQ ID NO: 2216351 - DNA, 18 bp, Homo sapiens
catagtatggtggctggg

SEQ ID NO: 2216352 - DNA, 19 bp, Homo sapiens
catagtatggtggctgggt

SEQ ID NO: 2216353 - DNA, 15 bp, Homo sapiens
catatgcctgggcag

SEQ ID NO: 2216354 - DNA, 16 bp, Homo sapiens
catattaccacagaca

SEQ ID NO: 2216355 - DNA, 20 bp, Homo sapiens
catattaccacagacatact

SEQ ID NO: 2216356 - DNA, 17 bp, Homo sapiens
catattgatttccgtta

SEQ ID NO: 2216357 - DNA, 17 bp, Homo sapiens
catatttacttcttata

SEQ ID NO: 2216358 - DNA, 14 bp, Homo sapiens
catcaacatcttgg

SEQ ID NO: 2216359 - DNA, 20 bp, Homo sapiens
catcaccaacgtctgtgcca

SEQ ID NO: 2216360 - DNA, 12 bp, Homo sapiens
catcacccgcta

SEQ ID NO: 2216361 - DNA, 18 bp, Homo sapiens
catcagcacgatttctgt

SEQ ID NO: 2216362 - DNA, 21 bp, Homo sapiens
catcagcacgatttctgttta

SEQ ID NO: 2216363 - DNA, 14 bp, Homo sapiens
catcaggccaggcc

SEQ ID NO: 2216364 - DNA, 23 bp, Homo sapiens
catcaggccaggccctctgccca

SEQ ID NO: 2216365 - DNA, 13 bp, Homo sapiens
catcatgtctggc

SEQ ID NO: 2216366 - DNA, 14 bp, Homo sapiens
catcattgaaatct

SEQ ID NO: 2216367 - DNA, 21 bp, Homo sapiens
catcattgaaatctttttgct

SEQ ID NO: 2216368 - DNA, 23 bp, Homo sapiens
catccactgtgccatgtgccagg

SEQ ID NO: 2216369 - DNA, 15 bp, Homo sapiens
catccaggttcagct

SEQ ID NO: 2216370 - DNA, 20 bp, Homo sapiens
catcccaaacccttcagtgc

SEQ ID NO: 2216371 - DNA, 12 bp, Homo sapiens
catcccagcccc

SEQ ID NO: 2216372 - DNA, 19 bp, Homo sapiens
catcccatatgcctgggca

SEQ ID NO: 2216373 - DNA, 21 bp, Homo sapiens
catcccctgtagagtgggagc

SEQ ID NO: 2216374 - DNA, 15 bp, Homo sapiens
catccctctggggct

SEQ ID NO: 2216375 - DNA, 19 bp, Homo sapiens
catccctgaaggccccgcc

SEQ ID NO: 2216376 - DNA, 22 bp, Homo sapiens
catccctgaaggccccgcccag

SEQ ID NO: 2216377 - DNA, 16 bp, Homo sapiens
catcctcatacccacc

SEQ ID NO: 2216378 - DNA, 15 bp, Homo sapiens
catcctcctcagatc

SEQ ID NO: 2216379 - DNA, 19 bp, Homo sapiens
catcctctgtacagagccc

SEQ ID NO: 2216380 - DNA, 21 bp, Homo sapiens
catcctctgtacagagcccac

SEQ ID NO: 2216381 - DNA, 22 bp, Homo sapiens
catcctctgtacagagcccacg

SEQ ID NO: 2216382 - DNA, 23 bp, Homo sapiens
catcctggcacccggcccctgct

SEQ ID NO: 2216383 - DNA, 16 bp, Homo sapiens
catctcacacatgagc

SEQ ID NO: 2216384 - DNA, 16 bp, Homo sapiens
catctctacaaaaagc

SEQ ID NO: 2216385 - DNA, 18 bp, Homo sapiens
catctgtgaaaggaaaga

SEQ ID NO: 2216386 - DNA, 22 bp, Homo sapiens
catcttccaagggtactaagga

SEQ ID NO: 2216387 - DNA, 15 bp, Homo sapiens
catcttgctctgctg

SEQ ID NO: 2216388 - DNA, 20 bp, Homo sapiens
catcttgctctgctgacaga

SEQ ID NO: 2216389 - DNA, 21 bp, Homo sapiens
catgaaaacacatttttctta

SEQ ID NO: 2216390 - DNA, 14 bp, Homo sapiens
catgacacgaatat

SEQ ID NO: 2216391 - DNA, 16 bp, Homo sapiens
catgagcatcaggcca

SEQ ID NO: 2216392 - DNA, 21 bp, Homo sapiens
catgagcatcaggccaggccc

SEQ ID NO: 2216393 - DNA, 15 bp, Homo sapiens
catgagcctcagcat

SEQ ID NO: 2216394 - DNA, 21 bp, Homo sapiens
catgagcctcagcatcctggc

SEQ ID NO: 2216395 - DNA, 16 bp, Homo sapiens
catgcacgtgtgtgca

SEQ ID NO: 2216396 - DNA, 13 bp, Homo sapiens
catgcccctgaac

SEQ ID NO: 2216397 - DNA, 15 bp, Homo sapiens
catgcctctctcagg

SEQ ID NO: 2216398 - DNA, 17 bp, Homo sapiens
catgcgggcttcctcct

SEQ ID NO: 2216399 - DNA, 23 bp, Homo sapiens
catgctacacactgcatgtttgt

SEQ ID NO: 2216400 - DNA, 14 bp, Homo sapiens
catgctcctggccc

SEQ ID NO: 2216401 - DNA, 20 bp, Homo sapiens
catgctcctggcccactgca

SEQ ID NO: 2216402 - DNA, 14 bp, Homo sapiens
catgctgccctgtg

SEQ ID NO: 2216403 - DNA, 13 bp, Homo sapiens
catgctgtccctt

SEQ ID NO: 2216404 - DNA, 15 bp, Homo sapiens
catgctgtcccttac

SEQ ID NO: 2216405 - DNA, 22 bp, Homo sapiens
catgctgtcccttacgtgagtc

SEQ ID NO: 2216406 - DNA, 20 bp, Homo sapiens
catggaagtactataattta

SEQ ID NO: 2216407 - DNA, 16 bp, Homo sapiens
catggaataacatgta

SEQ ID NO: 2216408 - DNA, 17 bp, Homo sapiens
catggaggtttgaagat

SEQ ID NO: 2216409 - DNA, 16 bp, Homo sapiens
catgggaatgaatgtc

SEQ ID NO: 2216410 - DNA, 17 bp, Homo sapiens
catgggaatgaatgtca

SEQ ID NO: 2216411 - DNA, 15 bp, Homo sapiens
catgggcctcctgtg

SEQ ID NO: 2216412 - DNA, 16 bp, Homo sapiens
catgggcctcctgtgt

SEQ ID NO: 2216413 - DNA, 21 bp, Homo sapiens
catggtgaaggtttttgtttc

SEQ ID NO: 2216414 - DNA, 15 bp, Homo sapiens
catgtccaagaagcc

SEQ ID NO: 2216415 - DNA, 14 bp, Homo sapiens
catgtcttttcttg

SEQ ID NO: 2216416 - DNA, 19 bp, Homo sapiens
catgtcttttcttgcatga

SEQ ID NO: 2216417 - DNA, 21 bp, Homo sapiens
catgtcttttcttgcatgagg

SEQ ID NO: 2216418 - DNA, 15 bp, Homo sapiens
catgtgatgagagga

SEQ ID NO: 2216419 - DNA, 17 bp, Homo sapiens
catgtgatgagaggaaa

SEQ ID NO: 2216420 - DNA, 14 bp, Homo sapiens
catgtgcacatgca

SEQ ID NO: 2216421 - DNA, 16 bp, Homo sapiens
catgttacataagata

SEQ ID NO: 2216422 - DNA, 17 bp, Homo sapiens
catgttacataagataa

SEQ ID NO: 2216423 - DNA, 18 bp, Homo sapiens
catgttcttaattcttag

SEQ ID NO: 2216424 - DNA, 13 bp, Homo sapiens
catgttggccagg

SEQ ID NO: 2216425 - DNA, 23 bp, Homo sapiens
catgtttgatgtatctgagcagg

SEQ ID NO: 2216426 - DNA, 14 bp, Homo sapiens
catgtttgtgattg

SEQ ID NO: 2216427 - DNA, 15 bp, Homo sapiens
catgtttgtgattga

SEQ ID NO: 2216428 - DNA, 20 bp, Homo sapiens
catgtttttcttctccctca

SEQ ID NO: 2216429 - DNA, 12 bp, Homo sapiens
cattcctgttcc

SEQ ID NO: 2216430 - DNA, 16 bp, Homo sapiens
cattctccacctgcca

SEQ ID NO: 2216431 - DNA, 20 bp, Homo sapiens
cattctccttgtgttactaa

SEQ ID NO: 2216432 - DNA, 15 bp, Homo sapiens
cattctgcctgccca

SEQ ID NO: 2216433 - DNA, 14 bp, Homo sapiens
cgatagtggtggtg

SEQ ID NO: 2216434 - DNA, 21 bp, Homo sapiens
cgattcttctgcttcagcctc

SEQ ID NO: 2216435 - DNA, 12 bp, Homo sapiens
cgatttctgttt

SEQ ID NO: 2216436 - DNA, 13 bp, Homo sapiens
cgcagacaggacc

SEQ ID NO: 2216437 - DNA, 15 bp, Homo sapiens
cgcagccctgcagag

SEQ ID NO: 2216438 - DNA, 22 bp, Homo sapiens
cgcaggattcttcctccctccc

SEQ ID NO: 2216439 - DNA, 19 bp, Homo sapiens
cgccagattctttcctgag

SEQ ID NO: 2216440 - DNA, 22 bp, Homo sapiens
cgccaggggaaaatcagcctgc

SEQ ID NO: 2216441 - DNA, 23 bp, Homo sapiens
cgccaggggaaaatcagcctgct

SEQ ID NO: 2216442 - DNA, 16 bp, Homo sapiens
cgccatcccagcccca

SEQ ID NO: 2216443 - DNA, 22 bp, Homo sapiens
cgcccaggcttagtcactgaga

SEQ ID NO: 2216444 - DNA, 14 bp, Homo sapiens
cgcctacaggagtg

SEQ ID NO: 2216445 - DNA, 14 bp, Homo sapiens
cgcgacaatgcaaa

SEQ ID NO: 2216446 - DNA, 17 bp, Homo sapiens
cgcgagggccccacgtc

SEQ ID NO: 2216447 - DNA, 20 bp, Homo sapiens
cgcgtgcacacaccagagcc

SEQ ID NO: 2216448 - DNA, 15 bp, Homo sapiens
cgctaagagggaggg

SEQ ID NO: 2216449 - DNA, 16 bp, Homo sapiens
cgctaagagggaggga

SEQ ID NO: 2216450 - DNA, 22 bp, Homo sapiens
cgctaagagggagggagggctc

SEQ ID NO: 2216451 - DNA, 17 bp, Homo sapiens
cgctacccgggaagggg

SEQ ID NO: 2216452 - DNA, 18 bp, Homo sapiens
cgctacccgggaaggggg

SEQ ID NO: 2216453 - DNA, 23 bp, Homo sapiens
cgctggaccttgaactgggtact

SEQ ID NO: 2216454 - DNA, 20 bp, Homo sapiens
cgctggggccagttggtccc

SEQ ID NO: 2216455 - DNA, 14 bp, Homo sapiens
cgctgtgctgccct

SEQ ID NO: 2216456 - DNA, 19 bp, Homo sapiens
cgctgtgctgccctgccca

SEQ ID NO: 2216457 - DNA, 14 bp, Homo sapiens
cggaagccacaggg

SEQ ID NO: 2216458 - DNA, 18 bp, Homo sapiens
cggacagccacggccagg

SEQ ID NO: 2216459 - DNA, 20 bp, Homo sapiens
cggacagccacggccaggcc

SEQ ID NO: 2216460 - DNA, 22 bp, Homo sapiens
cggacagccacggccaggccag

SEQ ID NO: 2216461 - DNA, 15 bp, Homo sapiens
cggagacggagtccc

SEQ ID NO: 2216462 - DNA, 16 bp, Homo sapiens
cggagtcccaccttgg

SEQ ID NO: 2216463 - DNA, 23 bp, Homo sapiens
cggagtcccaccttggctgcagg

SEQ ID NO: 2216464 - DNA, 24 bp, Homo sapiens
cggccaggccagagggagtgacag

SEQ ID NO: 2216465 - DNA, 15 bp, Homo sapiens
cggcctttggcttca

SEQ ID NO: 2216466 - DNA, 18 bp, Homo sapiens
cggctcactgcagcctca

SEQ ID NO: 2216467 - DNA, 18 bp, Homo sapiens
cggctggcctggcccctc

SEQ ID NO: 2216468 - DNA, 21 bp, Homo sapiens
cgggaggatgttctgggacac

SEQ ID NO: 2216469 - DNA, 14 bp, Homo sapiens
cgggcactcagaag

SEQ ID NO: 2216470 - DNA, 10 bp, Homo sapiens
cgggcagcag

SEQ ID NO: 2216471 - DNA, 13 bp, Homo sapiens
cgggcagcagaga

SEQ ID NO: 2216472 - DNA, 16 bp, Homo sapiens
cgggcagcagagagag

SEQ ID NO: 2216473 - DNA, 12 bp, Homo sapiens
cgggccacagag

SEQ ID NO: 2216474 - DNA, 11 bp, Homo sapiens
cgggctcagca

SEQ ID NO: 2216475 - DNA, 22 bp, Homo sapiens
cggggacagctccttctgtcct

SEQ ID NO: 2216476 - DNA, 15 bp, Homo sapiens
cggggatcccccgcc

SEQ ID NO: 2216477 - DNA, 23 bp, Homo sapiens
cggggatcccccgccccatcctc

SEQ ID NO: 2216478 - DNA, 21 bp, Homo sapiens
cggtgagaggggaacagactg

SEQ ID NO: 2216479 - DNA, 16 bp, Homo sapiens
cgtctacctgaggggc

SEQ ID NO: 2216480 - DNA, 17 bp, Homo sapiens
cgtgaggaggggtgtgg

SEQ ID NO: 2216481 - DNA, 14 bp, Homo sapiens
cgtgcacacaccag

SEQ ID NO: 2216482 - DNA, 20 bp, Homo sapiens
cgtgcacacaccagagccca

SEQ ID NO: 2216483 - DNA, 22 bp, Homo sapiens
cgtggagaatttttactgggga

SEQ ID NO: 2216484 - DNA, 12 bp, Homo sapiens
cgtggctgcttc

SEQ ID NO: 2216485 - DNA, 14 bp, Homo sapiens
cgtggctgcttcaa

SEQ ID NO: 2216486 - DNA, 15 bp, Homo sapiens
cgtgttatgactcca

SEQ ID NO: 2216487 - DNA, 19 bp, Homo sapiens
cgtgttatgactccagaat

SEQ ID NO: 2216488 - DNA, 19 bp, Homo sapiens
cgtttctaaaggctacctt

SEQ ID NO: 2216489 - DNA, 21 bp, Homo sapiens
cgtttctaaaggctacctttg

SEQ ID NO: 2216490 - DNA, 15 bp, Homo sapiens
ctaaagctgccagcc

SEQ ID NO: 2216491 - DNA, 17 bp, Homo sapiens
ctaaaggctacctttgt

SEQ ID NO: 2216492 - DNA, 22 bp, Homo sapiens
ctaaagtgtatttttttactaa

SEQ ID NO: 2216493 - DNA, 15 bp, Homo sapiens
ctaacatggaagtac

SEQ ID NO: 2216494 - DNA, 17 bp, Homo sapiens
ctaacatggaagtacta

SEQ ID NO: 2216495 - DNA, 17 bp, Homo sapiens
ctaaccacgctggacct

SEQ ID NO: 2216496 - DNA, 15 bp, Homo sapiens
ctaacttcaccatat

SEQ ID NO: 2216497 - DNA, 13 bp, Homo sapiens
ctaagagggaggg

SEQ ID NO: 2216498 - DNA, 15 bp, Homo sapiens
ctaagagggagggag

SEQ ID NO: 2216499 - DNA, 22 bp, Homo sapiens
ctaagagggagggagggctcca

SEQ ID NO: 2216500 - DNA, 23 bp, Homo sapiens
ctaagagggagggagggctccag

SEQ ID NO: 2216501 - DNA, 22 bp, Homo sapiens
ctaagctattcagtaataactc

SEQ ID NO: 2216502 - DNA, 21 bp, Homo sapiens
ctaagtggtactaactttcct

SEQ ID NO: 2216503 - DNA, 20 bp, Homo sapiens
ctaagtttttatggcttttg

SEQ ID NO: 2216504 - DNA, 21 bp, Homo sapiens
ctaataaaatttaaaagtctt

SEQ ID NO: 2216505 - DNA, 17 bp, Homo sapiens
ctaatagacaatttatt

SEQ ID NO: 2216506 - DNA, 23 bp, Homo sapiens
ctaatagacaatttattatggca

SEQ ID NO: 2216507 - DNA, 18 bp, Homo sapiens
ctaatatgtaacaagcca

SEQ ID NO: 2216508 - DNA, 13 bp, Homo sapiens
ctaatgggacact

SEQ ID NO: 2216509 - DNA, 19 bp, Homo sapiens
ctacaaaaagcataaaaat

SEQ ID NO: 2216510 - DNA, 15 bp, Homo sapiens
ctacacactgcatgt

SEQ ID NO: 2216511 - DNA, 13 bp, Homo sapiens
ctacactgtgctg

SEQ ID NO: 2216512 - DNA, 22 bp, Homo sapiens
ctacagaggccatgggcctcct

SEQ ID NO: 2216513 - DNA, 16 bp, Homo sapiens
ctacaggagtgagcac

SEQ ID NO: 2216514 - DNA, 16 bp, Homo sapiens
ctacaggtgtgagtca

SEQ ID NO: 2216515 - DNA, 18 bp, Homo sapiens
ctacagtcctcccatctc

SEQ ID NO: 2216516 - DNA, 21 bp, Homo sapiens
ctacagttgaaaaacagctga

SEQ ID NO: 2216517 - DNA, 22 bp, Homo sapiens
ctacattataaatgtctcttta

SEQ ID NO: 2216518 - DNA, 13 bp, Homo sapiens
ctacattctgtta

SEQ ID NO: 2216519 - DNA, 22 bp, Homo sapiens
ctacccaccctcctttcaccac

SEQ ID NO: 2216520 - DNA, 17 bp, Homo sapiens
ctacccagcgagccctg

SEQ ID NO: 2216521 - DNA, 19 bp, Homo sapiens
ctacccagcgagccctggt

SEQ ID NO: 2216522 - DNA, 14 bp, Homo sapiens
ctacccgggaaggg

SEQ ID NO: 2216523 - DNA, 15 bp, Homo sapiens
ctacccgggaagggg

SEQ ID NO: 2216524 - DNA, 20 bp, Homo sapiens
ctacccgggaagggggctgg

SEQ ID NO: 2216525 - DNA, 21 bp, Homo sapiens
ctacccgggaagggggctggg

SEQ ID NO: 2216526 - DNA, 15 bp, Homo sapiens
ctacctgaggggcct

SEQ ID NO: 2216527 - DNA, 16 bp, Homo sapiens
ctacctgaggggcctc

SEQ ID NO: 2216528 - DNA, 21 bp, Homo sapiens
ctactctgtgtcaggtggggc

SEQ ID NO: 2216529 - DNA, 19 bp, Homo sapiens
ctactgtcctacccaccct

SEQ ID NO: 2216530 - DNA, 20 bp, Homo sapiens
ctactgtcctacccaccctc

SEQ ID NO: 2216531 - DNA, 15 bp, Homo sapiens
ctagaggttcaaaga

SEQ ID NO: 2216532 - DNA, 17 bp, Homo sapiens
ctagaggttcaaagata

SEQ ID NO: 2216533 - DNA, 18 bp, Homo sapiens
ctagaggttcaaagatat

SEQ ID NO: 2216534 - DNA, 13 bp, Homo sapiens
ctagatactgtat

SEQ ID NO: 2216535 - DNA, 16 bp, Homo sapiens
ctagatactgtatcat

SEQ ID NO: 2216536 - DNA, 20 bp, Homo sapiens
ctagcatacgtacacatttt

SEQ ID NO: 2216537 - DNA, 21 bp, Homo sapiens
ctagcatacgtacacatttta

SEQ ID NO: 2216538 - DNA, 17 bp, Homo sapiens
ctagcatggctgccaat

SEQ ID NO: 2216539 - DNA, 12 bp, Homo sapiens
ctagccagagga

SEQ ID NO: 2216540 - DNA, 13 bp, Homo sapiens
ctagccagaggag

SEQ ID NO: 2216541 - DNA, 15 bp, Homo sapiens
ctaggaagactttgg

SEQ ID NO: 2216542 - DNA, 17 bp, Homo sapiens
ctaggaagactttggaa

SEQ ID NO: 2216543 - DNA, 21 bp, Homo sapiens
ctaggaagactttggaaagag

SEQ ID NO: 2216544 - DNA, 17 bp, Homo sapiens
ctaggaggtctctaaga

SEQ ID NO: 2216545 - DNA, 13 bp, Homo sapiens
ctaggcctggcca

SEQ ID NO: 2216546 - DNA, 15 bp, Homo sapiens
ctaggcctggccaga

SEQ ID NO: 2216547 - DNA, 21 bp, Homo sapiens
ctagggaaaaaccagcgtgtg

SEQ ID NO: 2216548 - DNA, 14 bp, Homo sapiens
ctaggtgacagagt

SEQ ID NO: 2216549 - DNA, 22 bp, Homo sapiens
ctagttgtttgattcagacagc

SEQ ID NO: 2216550 - DNA, 19 bp, Homo sapiens
ctagtttgattaaattctt

SEQ ID NO: 2216551 - DNA, 16 bp, Homo sapiens
ctataatgtaagctct

SEQ ID NO: 2216552 - DNA, 22 bp, Homo sapiens
ctataatttacctgaagtcttt

SEQ ID NO: 2216553 - DNA, 21 bp, Homo sapiens
ctatagcctaggtgacagagt

SEQ ID NO: 2216554 - DNA, 14 bp, Homo sapiens
ctatctaaatgttg

SEQ ID NO: 2216555 - DNA, 17 bp, Homo sapiens
ctatctcccccagcccc

SEQ ID NO: 2216556 - DNA, 17 bp, Homo sapiens
ctgctgggtgtggcgca

SEQ ID NO: 2216557 - DNA, 23 bp, Homo sapiens
ctgctggttcagggttggcccct

SEQ ID NO: 2216558 - DNA, 13 bp, Homo sapiens
ctgcttcaaggat

SEQ ID NO: 2216559 - DNA, 20 bp, Homo sapiens
ctgcttcaaggatcctgagc

SEQ ID NO: 2216560 - DNA, 22 bp, Homo sapiens
ctgcttcaaggatcctgagcca

SEQ ID NO: 2216561 - DNA, 16 bp, Homo sapiens
ctgcttcagcctcccg

SEQ ID NO: 2216562 - DNA, 14 bp, Homo sapiens
ctgcttccagtgag

SEQ ID NO: 2216563 - DNA, 20 bp, Homo sapiens
ctgcttgaggcaactcatct

SEQ ID NO: 2216564 - DNA, 20 bp, Homo sapiens
ctgcttgcttgctttttaat

SEQ ID NO: 2216565 - DNA, 17 bp, Homo sapiens
ctgcttgggcttcatcc

SEQ ID NO: 2216566 - DNA, 17 bp, Homo sapiens
ctgcttttggtctgtgt

SEQ ID NO: 2216567 - DNA, 19 bp, Homo sapiens
ctgcttttgtctatgggac

SEQ ID NO: 2216568 - DNA, 21 bp, Homo sapiens
ctgcttttgtctatgggactc

SEQ ID NO: 2216569 - DNA, 14 bp, Homo sapiens
ctggaatgcagtgg

SEQ ID NO: 2216570 - DNA, 15 bp, Homo sapiens
ctggaatgcagtggt

SEQ ID NO: 2216571 - DNA, 17 bp, Homo sapiens
ctggacaggcatgttct

SEQ ID NO: 2216572 - DNA, 23 bp, Homo sapiens
ctggacaggcatgttctctgagg

SEQ ID NO: 2216573 - DNA, 16 bp, Homo sapiens
ctggaccttgaactgg

SEQ ID NO: 2216574 - DNA, 17 bp, Homo sapiens
ctggaccttgaactggg

SEQ ID NO: 2216575 - DNA, 21 bp, Homo sapiens
ctggaccttgaactgggtact

SEQ ID NO: 2216576 - DNA, 17 bp, Homo sapiens
ctggaggtacgaaaaga

SEQ ID NO: 2216577 - DNA, 14 bp, Homo sapiens
ctggagtgcagtga

SEQ ID NO: 2216578 - DNA, 15 bp, Homo sapiens
ctggagttctggttc

SEQ ID NO: 2216579 - DNA, 15 bp, Homo sapiens
ctggatgcagcctca

SEQ ID NO: 2216580 - DNA, 21 bp, Homo sapiens
ctggcacccggcccctgctgg

SEQ ID NO: 2216581 - DNA, 22 bp, Homo sapiens
ctggcacccggcccctgctggt

SEQ ID NO: 2216582 - DNA, 15 bp, Homo sapiens
ctggcactataatgt

SEQ ID NO: 2216583 - DNA, 13 bp, Homo sapiens
ctggcactgcttc

SEQ ID NO: 2216584 - DNA, 19 bp, Homo sapiens
ctggcactgcttccagtga

SEQ ID NO: 2216585 - DNA, 20 bp, Homo sapiens
ctggcactgcttccagtgag

SEQ ID NO: 2216586 - DNA, 18 bp, Homo sapiens
ctggcagagttgaagaca

SEQ ID NO: 2216587 - DNA, 21 bp, Homo sapiens
ctggcagagttgaagacagag

SEQ ID NO: 2216588 - DNA, 16 bp, Homo sapiens
ctggcagctcagagag

SEQ ID NO: 2216589 - DNA, 24 bp, Homo sapiens
ctggcatgggaatgaatgtcagtg

SEQ ID NO: 2216590 - DNA, 20 bp, Homo sapiens
ctggccagatgcaccagccc

SEQ ID NO: 2216591 - DNA, 16 bp, Homo sapiens
ctggcctgagctggga

SEQ ID NO: 2216592 - DNA, 13 bp, Homo sapiens
ctggcctggcccc

SEQ ID NO: 2216593 - DNA, 16 bp, Homo sapiens
ctggcctggcccctca

SEQ ID NO: 2216594 - DNA, 14 bp, Homo sapiens
ctggcctgtgtcta

SEQ ID NO: 2216595 - DNA, 13 bp, Homo sapiens
ctggctatgcatt

SEQ ID NO: 2216596 - DNA, 14 bp, Homo sapiens
ctggctatgcattt

SEQ ID NO: 2216597 - DNA, 15 bp, Homo sapiens
ctggctatgcatttg

SEQ ID NO: 2216598 - DNA, 15 bp, Homo sapiens
ctggctcttccaggc

SEQ ID NO: 2216599 - DNA, 17 bp, Homo sapiens
ctggctcttccaggctg

SEQ ID NO: 2216600 - DNA, 18 bp, Homo sapiens
ctggctcttccaggctgg

SEQ ID NO: 2216601 - DNA, 21 bp, Homo sapiens
ctggctgggtggcaccagcag

SEQ ID NO: 2216602 - DNA, 22 bp, Homo sapiens
ctggctgggtggcaccagcagc

SEQ ID NO: 2216603 - DNA, 18 bp, Homo sapiens
ctggctgttggctggggg

SEQ ID NO: 2216604 - DNA, 20 bp, Homo sapiens
ctggctgttggctgggggcc

SEQ ID NO: 2216605 - DNA, 19 bp, Homo sapiens
ctgggaggtcaaggctgca

SEQ ID NO: 2216606 - DNA, 12 bp, Homo sapiens
ctgggagtgagc

SEQ ID NO: 2216607 - DNA, 20 bp, Homo sapiens
ctgggcaatgtgataaaacc

SEQ ID NO: 2216608 - DNA, 12 bp, Homo sapiens
ctgggcagaagg

SEQ ID NO: 2216609 - DNA, 15 bp, Homo sapiens
ctgggcagaaggaag

SEQ ID NO: 2216610 - DNA, 19 bp, Homo sapiens
ctgggctcccttcccacct

SEQ ID NO: 2216611 - DNA, 20 bp, Homo sapiens
ctgggctcccttcccacctc

SEQ ID NO: 2216612 - DNA, 21 bp, Homo sapiens
ctgggctcccttcccacctct

SEQ ID NO: 2216613 - DNA, 15 bp, Homo sapiens
ctgggcttcagtggc

SEQ ID NO: 2216614 - DNA, 17 bp, Homo sapiens
ctgggcttcagtggcag

SEQ ID NO: 2216615 - DNA, 20 bp, Homo sapiens
ctgggcttggggaccagagc

SEQ ID NO: 2216616 - DNA, 21 bp, Homo sapiens
ctgggcttggggaccagagct

SEQ ID NO: 2216617 - DNA, 15 bp, Homo sapiens
ctgggggaagaagct

SEQ ID NO: 2216618 - DNA, 18 bp, Homo sapiens
ctgggggctgggcagagg

SEQ ID NO: 2216619 - DNA, 19 bp, Homo sapiens
ctgggggctgggcagagga

SEQ ID NO: 2216620 - DNA, 14 bp, Homo sapiens
ctggggtaggagga

SEQ ID NO: 2216621 - DNA, 20 bp, Homo sapiens
ctggggtaggaggaacaggt

SEQ ID NO: 2216622 - DNA, 16 bp, Homo sapiens
ctgggtgtggcgcagc

SEQ ID NO: 2216623 - DNA, 15 bp, Homo sapiens
ctgggttcactgcaa

SEQ ID NO: 2216624 - DNA, 15 bp, Homo sapiens
ctgggttctacccag

SEQ ID NO: 2216625 - DNA, 15 bp, Homo sapiens
ctggtccatagagag

SEQ ID NO: 2216626 - DNA, 21 bp, Homo sapiens
ctggtccatagagagcaagac

SEQ ID NO: 2216627 - DNA, 14 bp, Homo sapiens
ctggtcccactcag

SEQ ID NO: 2216628 - DNA, 15 bp, Homo sapiens
ctggtcccactcagt

SEQ ID NO: 2216629 - DNA, 18 bp, Homo sapiens
ctggtcccactcagtcca

SEQ ID NO: 2216630 - DNA, 22 bp, Homo sapiens
ctggtgacatgtcttttcttgc

SEQ ID NO: 2216631 - DNA, 15 bp, Homo sapiens
ctggtgactttcctc

SEQ ID NO: 2216632 - DNA, 20 bp, Homo sapiens
ctggtgactttcctctttgg

SEQ ID NO: 2216633 - DNA, 21 bp, Homo sapiens
ctggtggaatgcgggggagca

SEQ ID NO: 2216634 - DNA, 13 bp, Homo sapiens
ctggtggcagctg

SEQ ID NO: 2216635 - DNA, 15 bp, Homo sapiens
ctggtggcagctgcg

SEQ ID NO: 2216636 - DNA, 22 bp, Homo sapiens
ctggttagaggttccctttgac

SEQ ID NO: 2216637 - DNA, 21 bp, Homo sapiens
ctgtaatttgtgatacaatgc

SEQ ID NO: 2216638 - DNA, 15 bp, Homo sapiens
ctgtacaaagtagaa

SEQ ID NO: 2216639 - DNA, 17 bp, Homo sapiens
ctgtacatgaaaacaca

SEQ ID NO: 2216640 - DNA, 15 bp, Homo sapiens
ctgtacgtctgacag

SEQ ID NO: 2216641 - DNA, 22 bp, Homo sapiens
ctgtatcccatgagcctcagca

SEQ ID NO: 2216642 - DNA, 23 bp, Homo sapiens
ctgtcaattacaggaagtactgg

SEQ ID NO: 2216643 - DNA, 16 bp, Homo sapiens
ctgtcatttgagcagg

SEQ ID NO: 2216644 - DNA, 23 bp, Homo sapiens
ctgtcatttgagcagggctcagc

SEQ ID NO: 2216645 - DNA, 14 bp, Homo sapiens
ctgtccgagctttg

SEQ ID NO: 2216646 - DNA, 16 bp, Homo sapiens
ctgtcctactctgtgt

SEQ ID NO: 2216647 - DNA, 21 bp, Homo sapiens
ctgtcctgggagtgagctggt

SEQ ID NO: 2216648 - DNA, 22 bp, Homo sapiens
ctgtctaatgaaacctgtgtct

SEQ ID NO: 2216649 - DNA, 22 bp, Homo sapiens
ctgtctcaaaaaaagaaaaaga

SEQ ID NO: 2216650 - DNA, 15 bp, Homo sapiens
ctgtgaagagaacca

SEQ ID NO: 2216651 - DNA, 17 bp, Homo sapiens
ctgtgatggggccctgc

SEQ ID NO: 2216652 - DNA, 23 bp, Homo sapiens
ctgtgatggggccctgcctcctt

SEQ ID NO: 2216653 - DNA, 18 bp, Homo sapiens
ctgtgccatgtgccaggt

SEQ ID NO: 2216654 - DNA, 19 bp, Homo sapiens
ctgtgccctaaagtgtatt

SEQ ID NO: 2216655 - DNA, 17 bp, Homo sapiens
ctgtgcctctgggactg

SEQ ID NO: 2216656 - DNA, 14 bp, Homo sapiens
ctgtgctctggaca

SEQ ID NO: 2216657 - DNA, 15 bp, Homo sapiens
ctgtgctctggacag

SEQ ID NO: 2216658 - DNA, 14 bp, Homo sapiens
ctgtgctgagtctg

SEQ ID NO: 2216659 - DNA, 20 bp, Homo sapiens
ctgtgctgagtctgaaggct

SEQ ID NO: 2216660 - DNA, 22 bp, Homo sapiens
ctgtgctgagtctgaaggctgg

SEQ ID NO: 2216661 - DNA, 11 bp, Homo sapiens
ctgtgctgccc

SEQ ID NO: 2216662 - DNA, 14 bp, Homo sapiens
ctgtgctgccctgc

SEQ ID NO: 2216663 - DNA, 18 bp, Homo sapiens
ctgtgctgccctgcccac

SEQ ID NO: 2216664 - DNA, 17 bp, Homo sapiens
ctgtggatgataaaaca

SEQ ID NO: 2216665 - DNA, 17 bp, Homo sapiens
ctgtgtcagcatagaag

SEQ ID NO: 2216666 - DNA, 16 bp, Homo sapiens
ctgtgtcttgcaatgg

SEQ ID NO: 2216667 - DNA, 21 bp, Homo sapiens
ctgtgtcttgcaatggcagcc

SEQ ID NO: 2216668 - DNA, 22 bp, Homo sapiens
ctgtgtcttgcaatggcagcct

SEQ ID NO: 2216669 - DNA, 16 bp, Homo sapiens
ctgttctctgccctcc

SEQ ID NO: 2216670 - DNA, 18 bp, Homo sapiens
ctgttctctgccctccaa

SEQ ID NO: 2216671 - DNA, 19 bp, Homo sapiens
ctgttctctgccctccaag

SEQ ID NO: 2216672 - DNA, 16 bp, Homo sapiens
ctgttctttccaaagt

SEQ ID NO: 2216673 - DNA, 13 bp, Homo sapiens
ctgttgcccaggc

SEQ ID NO: 2216674 - DNA, 15 bp, Homo sapiens
ctgttgcccaggctg

SEQ ID NO: 2216675 - DNA, 17 bp, Homo sapiens
ctgttgcccaggctggc

SEQ ID NO: 2216676 - DNA, 15 bp, Homo sapiens
ctgttggccagtgtg

SEQ ID NO: 2216677 - DNA, 22 bp, Homo sapiens
ctgttggctgggggcctcagtg

SEQ ID NO: 2216678 - DNA, 16 bp, Homo sapiens
ctgttgggccaggagc

SEQ ID NO: 2216679 - DNA, 16 bp, Homo sapiens
gaatctcaaataacta

SEQ ID NO: 2216680 - DNA, 19 bp, Homo sapiens
gaatgaaagggcccagaga

SEQ ID NO: 2216681 - DNA, 21 bp, Homo sapiens
gaatgaaagggcccagagagg

SEQ ID NO: 2216682 - DNA, 18 bp, Homo sapiens
gaatgaaccacatcttgc

SEQ ID NO: 2216683 - DNA, 22 bp, Homo sapiens
gaatgaatgtcagtgtgactga

SEQ ID NO: 2216684 - DNA, 20 bp, Homo sapiens
gaatgatgatcctaggcatt

SEQ ID NO: 2216685 - DNA, 15 bp, Homo sapiens
gaatgcagagatgtg

SEQ ID NO: 2216686 - DNA, 13 bp, Homo sapiens
gaatgtcagtgtg

SEQ ID NO: 2216687 - DNA, 21 bp, Homo sapiens
gaatgtcagtgtgactgatct

SEQ ID NO: 2216688 - DNA, 19 bp, Homo sapiens
gaatgtttgcctctgcctc

SEQ ID NO: 2216689 - DNA, 15 bp, Homo sapiens
gaattgtaaggaatg

SEQ ID NO: 2216690 - DNA, 16 bp, Homo sapiens
gaatttcccaaagcag

SEQ ID NO: 2216691 - DNA, 18 bp, Homo sapiens
gaatttcccaaagcagtg

SEQ ID NO: 2216692 - DNA, 22 bp, Homo sapiens
gaatttcccaaagcagtgcatg

SEQ ID NO: 2216693 - DNA, 20 bp, Homo sapiens
gaattttgtgcccccatgta

SEQ ID NO: 2216694 - DNA, 21 bp, Homo sapiens
gaattttgtgcccccatgtaa

SEQ ID NO: 2216695 - DNA, 21 bp, Homo sapiens
gacaaggatgatctaggaaga

SEQ ID NO: 2216696 - DNA, 18 bp, Homo sapiens
gacaaggattgctactgt

SEQ ID NO: 2216697 - DNA, 16 bp, Homo sapiens
gacaatgcaaaccatc

SEQ ID NO: 2216698 - DNA, 18 bp, Homo sapiens
gacaatgcaaaccatcat

SEQ ID NO: 2216699 - DNA, 22 bp, Homo sapiens
gacaatgcaaaccatcattgaa

SEQ ID NO: 2216700 - DNA, 12 bp, Homo sapiens
gacaatttatta

SEQ ID NO: 2216701 - DNA, 21 bp, Homo sapiens
gacacacagctctgtcctggg

SEQ ID NO: 2216702 - DNA, 22 bp, Homo sapiens
gacacagctcttctccaggctg

SEQ ID NO: 2216703 - DNA, 23 bp, Homo sapiens
gacacagctcttctccaggctgt

SEQ ID NO: 2216704 - DNA, 12 bp, Homo sapiens
gacacaggcccg

SEQ ID NO: 2216705 - DNA, 15 bp, Homo sapiens
gacacatgtccaaga

SEQ ID NO: 2216706 - DNA, 12 bp, Homo sapiens
gacaccctgtga

SEQ ID NO: 2216707 - DNA, 15 bp, Homo sapiens
gacaccttgacaggg

SEQ ID NO: 2216708 - DNA, 15 bp, Homo sapiens
gacacgaatattgct

SEQ ID NO: 2216709 - DNA, 18 bp, Homo sapiens
gacacgaatattgctgat

SEQ ID NO: 2216710 - DNA, 15 bp, Homo sapiens
gacactgatgggcaa

SEQ ID NO: 2216711 - DNA, 17 bp, Homo sapiens
gacagaggcagccccat

SEQ ID NO: 2216712 - DNA, 23 bp, Homo sapiens
gacagaggcagccccattctgcc

SEQ ID NO: 2216713 - DNA, 15 bp, Homo sapiens
gacagcacaggcagc

SEQ ID NO: 2216714 - DNA, 13 bp, Homo sapiens
gacagccacggcc

SEQ ID NO: 2216715 - DNA, 17 bp, Homo sapiens
gacagccacggccaggc

SEQ ID NO: 2216716 - DNA, 20 bp, Homo sapiens
gacagccacggccaggccag

SEQ ID NO: 2216717 - DNA, 21 bp, Homo sapiens
gacagccacggccaggccaga

SEQ ID NO: 2216718 - DNA, 17 bp, Homo sapiens
gacagcccgggctctgc

SEQ ID NO: 2216719 - DNA, 18 bp, Homo sapiens
gacagcccgggctctgcc

SEQ ID NO: 2216720 - DNA, 21 bp, Homo sapiens
gacagcccgggctctgcctcc

SEQ ID NO: 2216721 - DNA, 17 bp, Homo sapiens
gacagctccttctgtcc

SEQ ID NO: 2216722 - DNA, 10 bp, Homo sapiens
gacagctctt

SEQ ID NO: 2216723 - DNA, 15 bp, Homo sapiens
gacagctgcctggga

SEQ ID NO: 2216724 - DNA, 21 bp, Homo sapiens
gacagctgcctgggatccctc

SEQ ID NO: 2216725 - DNA, 23 bp, Homo sapiens
gacaggaccagggatttccatga

SEQ ID NO: 2216726 - DNA, 20 bp, Homo sapiens
gacaggcaagcacctcctgc

SEQ ID NO: 2216727 - DNA, 16 bp, Homo sapiens
gacaggcaatgctggc

SEQ ID NO: 2216728 - DNA, 17 bp, Homo sapiens
gacaggcaatgctggct

SEQ ID NO: 2216729 - DNA, 23 bp, Homo sapiens
gacaggcaatgctggctgttggc

SEQ ID NO: 2216730 - DNA, 23 bp, Homo sapiens
gacagggcacaccgggcactcag

SEQ ID NO: 2216731 - DNA, 20 bp, Homo sapiens
gacagtccctgccaatggac

SEQ ID NO: 2216732 - DNA, 14 bp, Homo sapiens
gacagttaagagaa

SEQ ID NO: 2216733 - DNA, 22 bp, Homo sapiens
gacagttaagagaaatgagctt

SEQ ID NO: 2216734 - DNA, 15 bp, Homo sapiens
gacatactaaccagc

SEQ ID NO: 2216735 - DNA, 23 bp, Homo sapiens
gacatcaactgcatcaagatgtg

SEQ ID NO: 2216736 - DNA, 14 bp, Homo sapiens
gacatgatcttctt

SEQ ID NO: 2216737 - DNA, 18 bp, Homo sapiens
gacatgggaaaggggaag

SEQ ID NO: 2216738 - DNA, 21 bp, Homo sapiens
gacatgtcttttcttgcatga

SEQ ID NO: 2216739 - DNA, 16 bp, Homo sapiens
gaccacgtttctaaag

SEQ ID NO: 2216740 - DNA, 22 bp, Homo sapiens
gaccagacaccttgacagggca

SEQ ID NO: 2216741 - DNA, 11 bp, Homo sapiens
gaccagagctg

SEQ ID NO: 2216742 - DNA, 15 bp, Homo sapiens
gaccagagctgccac

SEQ ID NO: 2216743 - DNA, 21 bp, Homo sapiens
gaccagagctgccacctgcct

SEQ ID NO: 2216744 - DNA, 20 bp, Homo sapiens
gaccagggatttccatgatg

SEQ ID NO: 2216745 - DNA, 17 bp, Homo sapiens
gaccatccctgaaggcc

SEQ ID NO: 2216746 - DNA, 22 bp, Homo sapiens
gaccattctccacctgccaggg

SEQ ID NO: 2216747 - DNA, 12 bp, Homo sapiens
gacccactgctt

SEQ ID NO: 2216748 - DNA, 17 bp, Homo sapiens
gacccatgctgccctgt

SEQ ID NO: 2216749 - DNA, 18 bp, Homo sapiens
gacccatgctgccctgtg

SEQ ID NO: 2216750 - DNA, 14 bp, Homo sapiens
gacccccttgccca

SEQ ID NO: 2216751 - DNA, 21 bp, Homo sapiens
gacccctccatgtgggctagt

SEQ ID NO: 2216752 - DNA, 13 bp, Homo sapiens
gacccggctgcgt

SEQ ID NO: 2216753 - DNA, 16 bp, Homo sapiens
gaccctattgctgctt

SEQ ID NO: 2216754 - DNA, 16 bp, Homo sapiens
gaccctgaggcccaga

SEQ ID NO: 2216755 - DNA, 19 bp, Homo sapiens
gaccctgaggcccagaggg

SEQ ID NO: 2216756 - DNA, 22 bp, Homo sapiens
gaccctgccctgtgggccccca

SEQ ID NO: 2216757 - DNA, 19 bp, Homo sapiens
gacccttgccgtctacctg

SEQ ID NO: 2216758 - DNA, 20 bp, Homo sapiens
gacccttgccgtctacctga

SEQ ID NO: 2216759 - DNA, 23 bp, Homo sapiens
gacccttgccgtctacctgaggg

SEQ ID NO: 2216760 - DNA, 19 bp, Homo sapiens
gacccttgtggtcccaccc

SEQ ID NO: 2216761 - DNA, 21 bp, Homo sapiens
gacccttgtggtcccacccca

SEQ ID NO: 2216762 - DNA, 11 bp, Homo sapiens
gacctcaggcc

SEQ ID NO: 2216763 - DNA, 12 bp, Homo sapiens
gacctcaggcct

SEQ ID NO: 2216764 - DNA, 19 bp, Homo sapiens
gacctcaggcctgggggct

SEQ ID NO: 2216765 - DNA, 13 bp, Homo sapiens
gacctgaggccct

SEQ ID NO: 2216766 - DNA, 14 bp, Homo sapiens
gacctgaggccctt

SEQ ID NO: 2216767 - DNA, 14 bp, Homo sapiens
gaccttctccttca

SEQ ID NO: 2216768 - DNA, 14 bp, Homo sapiens
gaccttgaactggg

SEQ ID NO: 2216769 - DNA, 13 bp, Homo sapiens
gacgccatcccag

SEQ ID NO: 2216770 - DNA, 15 bp, Homo sapiens
gacgccatcccagcc

SEQ ID NO: 2216771 - DNA, 16 bp, Homo sapiens
gacgccatcccagccc

SEQ ID NO: 2216772 - DNA, 21 bp, Homo sapiens
gacgccatcccagccccaatg

SEQ ID NO: 2216773 - DNA, 12 bp, Homo sapiens
gacgctgtgctg

SEQ ID NO: 2216774 - DNA, 18 bp, Homo sapiens
gacgctgtgctgccctgc

SEQ ID NO: 2216775 - DNA, 11 bp, Homo sapiens
gacgtgttatg

SEQ ID NO: 2216776 - DNA, 16 bp, Homo sapiens
gactaacttgtctttg

SEQ ID NO: 2216777 - DNA, 18 bp, Homo sapiens
gactacaggcacccacca

SEQ ID NO: 2216778 - DNA, 13 bp, Homo sapiens
gactacaggtgtg

SEQ ID NO: 2216779 - DNA, 18 bp, Homo sapiens
gactacaggtgtgagtca

SEQ ID NO: 2216780 - DNA, 21 bp, Homo sapiens
gactacaggtgtgagtcacca

SEQ ID NO: 2216781 - DNA, 17 bp, Homo sapiens
gactcaatgcactgaca

SEQ ID NO: 2216782 - DNA, 14 bp, Homo sapiens
gactcattcttctg

SEQ ID NO: 2216783 - DNA, 15 bp, Homo sapiens
gactcattcttctgt

SEQ ID NO: 2216784 - DNA, 16 bp, Homo sapiens
gactcctgcaggcagc

SEQ ID NO: 2216785 - DNA, 19 bp, Homo sapiens
gactcctgcaggcagccag

SEQ ID NO: 2216786 - DNA, 18 bp, Homo sapiens
gactcgcgacaatgcaaa

SEQ ID NO: 2216787 - DNA, 12 bp, Homo sapiens
gactctgtctca

SEQ ID NO: 2216788 - DNA, 19 bp, Homo sapiens
gactctgtctcaaaaaaac

SEQ ID NO: 2216789 - DNA, 22 bp, Homo sapiens
gactgagtacgttgtgcatttg

SEQ ID NO: 2216790 - DNA, 23 bp, Homo sapiens
gactgagtacgttgtgcatttgg

SEQ ID NO: 2216791 - DNA, 14 bp, Homo sapiens
gactggaagcacag

SEQ ID NO: 2216792 - DNA, 22 bp, Homo sapiens
gactgtacaaagtagaagtctt

SEQ ID NO: 2216793 - DNA, 12 bp, Homo sapiens
gacttactgtac

SEQ ID NO: 2216794 - DNA, 16 bp, Homo sapiens
gacttactgtacatga

SEQ ID NO: 2216795 - DNA, 14 bp, Homo sapiens
gacttggaagctcc

SEQ ID NO: 2216796 - DNA, 23 bp, Homo sapiens
gacttttctttcagccaagaatt

SEQ ID NO: 2216797 - DNA, 22 bp, Homo sapiens
gagaaagtacttctccaccctg

SEQ ID NO: 2216798 - DNA, 14 bp, Homo sapiens
gagaagagaatgca

SEQ ID NO: 2216799 - DNA, 12 bp, Homo sapiens
gagaaggaagcc

SEQ ID NO: 2216800 - DNA, 22 bp, Homo sapiens
gagaaggggcccaagagagaca

SEQ ID NO: 2216801 - DNA, 15 bp, Homo sapiens
gagaatgaaagggcc

SEQ ID NO: 2216802 - DNA, 22 bp, Homo sapiens
gagaatgcacaaacagaggccg

SEQ ID NO: 2216803 - DNA, 16 bp, Homo sapiens
gccatgggcctcctgt

SEQ ID NO: 2216804 - DNA, 14 bp, Homo sapiens
gccatgtgccaggt

SEQ ID NO: 2216805 - DNA, 16 bp, Homo sapiens
gccatgttggccaggc

SEQ ID NO: 2216806 - DNA, 17 bp, Homo sapiens
gccatgttggccaggct

SEQ ID NO: 2216807 - DNA, 22 bp, Homo sapiens
gccatgttggccaggctggtct

SEQ ID NO: 2216808 - DNA, 17 bp, Homo sapiens
gccatttcttccacaag

SEQ ID NO: 2216809 - DNA, 16 bp, Homo sapiens
gccatttgtgtttata

SEQ ID NO: 2216810 - DNA, 21 bp, Homo sapiens
gcccaagagagacagcacagg

SEQ ID NO: 2216811 - DNA, 21 bp, Homo sapiens
gcccaatgcactttgttctgg

SEQ ID NO: 2216812 - DNA, 20 bp, Homo sapiens
gcccaccccgcctgccctcc

SEQ ID NO: 2216813 - DNA, 22 bp, Homo sapiens
gcccaccccgcctgccctccca

SEQ ID NO: 2216814 - DNA, 15 bp, Homo sapiens
gcccacccctcaaca

SEQ ID NO: 2216815 - DNA, 15 bp, Homo sapiens
gcccacctggcctct

SEQ ID NO: 2216816 - DNA, 17 bp, Homo sapiens
gcccacctggcctctgc

SEQ ID NO: 2216817 - DNA, 20 bp, Homo sapiens
gcccacctggcctctgcact

SEQ ID NO: 2216818 - DNA, 17 bp, Homo sapiens
gcccaccttggctcaag

SEQ ID NO: 2216819 - DNA, 18 bp, Homo sapiens
gcccaccttggctcaagt

SEQ ID NO: 2216820 - DNA, 14 bp, Homo sapiens
gcccacgcccccac

SEQ ID NO: 2216821 - DNA, 15 bp, Homo sapiens
gcccacgctggagtg

SEQ ID NO: 2216822 - DNA, 17 bp, Homo sapiens
gcccacgctggagtgca

SEQ ID NO: 2216823 - DNA, 19 bp, Homo sapiens
gcccacgctggagtgcagt

SEQ ID NO: 2216824 - DNA, 21 bp, Homo sapiens
gcccacgctggagtgcagtga

SEQ ID NO: 2216825 - DNA, 13 bp, Homo sapiens
gcccacttctgcc

SEQ ID NO: 2216826 - DNA, 20 bp, Homo sapiens
gcccagagggcctgcaaggg

SEQ ID NO: 2216827 - DNA, 22 bp, Homo sapiens
gcccagagggcctgcaagggag

SEQ ID NO: 2216828 - DNA, 14 bp, Homo sapiens
gcccagccccttct

SEQ ID NO: 2216829 - DNA, 19 bp, Homo sapiens
gcccaggaaaggctccagg

SEQ ID NO: 2216830 - DNA, 22 bp, Homo sapiens
gcccaggaaaggctccaggagc

SEQ ID NO: 2216831 - DNA, 12 bp, Homo sapiens
gcccaggcaggt

SEQ ID NO: 2216832 - DNA, 12 bp, Homo sapiens
gcccaggcccct

SEQ ID NO: 2216833 - DNA, 15 bp, Homo sapiens
gcccaggcccctgcc

SEQ ID NO: 2216834 - DNA, 19 bp, Homo sapiens
gcccaggctggcgtgcagt

SEQ ID NO: 2216835 - DNA, 23 bp, Homo sapiens
gcccaggcttagtcactgagaca

SEQ ID NO: 2216836 - DNA, 20 bp, Homo sapiens
gcccagtctggaatgcagtg

SEQ ID NO: 2216837 - DNA, 22 bp, Homo sapiens
gcccagtctggaatgcagtggt

SEQ ID NO: 2216838 - DNA, 22 bp, Homo sapiens
gcccagttgggtggatgcctgg

SEQ ID NO: 2216839 - DNA, 12 bp, Homo sapiens
gccccagtgccc

SEQ ID NO: 2216840 - DNA, 13 bp, Homo sapiens
gccccagtgccca

SEQ ID NO: 2216841 - DNA, 23 bp, Homo sapiens
gccccatcctctgtacagagccc

SEQ ID NO: 2216842 - DNA, 14 bp, Homo sapiens
gccccattctgcct

SEQ ID NO: 2216843 - DNA, 21 bp, Homo sapiens
gccccattctgcctgcccagg

SEQ ID NO: 2216844 - DNA, 13 bp, Homo sapiens
gcccccaccccag

SEQ ID NO: 2216845 - DNA, 16 bp, Homo sapiens
gcccccaccccaggct

SEQ ID NO: 2216846 - DNA, 18 bp, Homo sapiens
gcccccacccccaccctc

SEQ ID NO: 2216847 - DNA, 18 bp, Homo sapiens
gccccgaggccttctctg

SEQ ID NO: 2216848 - DNA, 23 bp, Homo sapiens
gccccgaggccttctctgaagga

SEQ ID NO: 2216849 - DNA, 14 bp, Homo sapiens
gccccgcccaggct

SEQ ID NO: 2216850 - DNA, 23 bp, Homo sapiens
gcccctcaactctcctccagagt

SEQ ID NO: 2216851 - DNA, 16 bp, Homo sapiens
gcccctcagggtccct

SEQ ID NO: 2216852 - DNA, 18 bp, Homo sapiens
gcccctcagggtccctgg

SEQ ID NO: 2216853 - DNA, 14 bp, Homo sapiens
gcccctgccaccct

SEQ ID NO: 2216854 - DNA, 14 bp, Homo sapiens
gcccctgcccggct

SEQ ID NO: 2216855 - DNA, 21 bp, Homo sapiens
gcccctgctggttcagggttg

SEQ ID NO: 2216856 - DNA, 22 bp, Homo sapiens
gcccctggatgcagcctcacag

SEQ ID NO: 2216857 - DNA, 12 bp, Homo sapiens
gcccctggcagc

SEQ ID NO: 2216858 - DNA, 14 bp, Homo sapiens
gcccggctccaggc

SEQ ID NO: 2216859 - DNA, 15 bp, Homo sapiens
gcccggctccaggct

SEQ ID NO: 2216860 - DNA, 12 bp, Homo sapiens
gcccgggctctg

SEQ ID NO: 2216861 - DNA, 13 bp, Homo sapiens
gcccgggctctgc

SEQ ID NO: 2216862 - DNA, 20 bp, Homo sapiens
gcccgggctctgcctcccat

SEQ ID NO: 2216863 - DNA, 21 bp, Homo sapiens
gccctccaagaccttctcctt

SEQ ID NO: 2216864 - DNA, 22 bp, Homo sapiens
gccctccaagaccttctccttc

SEQ ID NO: 2216865 - DNA, 14 bp, Homo sapiens
gccctcccaccccc

SEQ ID NO: 2216866 - DNA, 19 bp, Homo sapiens
gccctcccaccccctcccc

SEQ ID NO: 2216867 - DNA, 21 bp, Homo sapiens
gccctcccaccccctccccgg

SEQ ID NO: 2216868 - DNA, 17 bp, Homo sapiens
gccctcccagaccccct

SEQ ID NO: 2216869 - DNA, 13 bp, Homo sapiens
gccctctgcccac

SEQ ID NO: 2216870 - DNA, 17 bp, Homo sapiens
gccctgcccacctggcc

SEQ ID NO: 2216871 - DNA, 22 bp, Homo sapiens
gccctgcccacctggcctctgc

SEQ ID NO: 2216872 - DNA, 12 bp, Homo sapiens
gccctgcctcct

SEQ ID NO: 2216873 - DNA, 22 bp, Homo sapiens
gccctgcctcctttgtgaggaa

SEQ ID NO: 2216874 - DNA, 22 bp, Homo sapiens
gccctggtggcagtgggagctg

SEQ ID NO: 2216875 - DNA, 16 bp, Homo sapiens
gccctgtgggccccca

SEQ ID NO: 2216876 - DNA, 16 bp, Homo sapiens
gcccttacctgccagg

SEQ ID NO: 2216877 - DNA, 20 bp, Homo sapiens
gcccttacctgccaggaagc

SEQ ID NO: 2216878 - DNA, 21 bp, Homo sapiens
gcccttacctgccaggaagcc

SEQ ID NO: 2216879 - DNA, 20 bp, Homo sapiens
gcccttagcagggaaacagc

SEQ ID NO: 2216880 - DNA, 14 bp, Homo sapiens
gcccttctctccag

SEQ ID NO: 2216881 - DNA, 17 bp, Homo sapiens
gcccttctctccagccc

SEQ ID NO: 2216882 - DNA, 16 bp, Homo sapiens
gccgagatagccaagg

SEQ ID NO: 2216883 - DNA, 17 bp, Homo sapiens
gccgagatagccaaggc

SEQ ID NO: 2216884 - DNA, 22 bp, Homo sapiens
gccgagatcacgccactgcact

SEQ ID NO: 2216885 - DNA, 11 bp, Homo sapiens
gccgcagccct

SEQ ID NO: 2216886 - DNA, 12 bp, Homo sapiens
gccgcagccctg

SEQ ID NO: 2216887 - DNA, 13 bp, Homo sapiens
gccgcagccctgc

SEQ ID NO: 2216888 - DNA, 20 bp, Homo sapiens
gccgcagccctgcagagggc

SEQ ID NO: 2216889 - DNA, 15 bp, Homo sapiens
gccgccatgctcctg

SEQ ID NO: 2216890 - DNA, 15 bp, Homo sapiens
gccgtctacctgagg

SEQ ID NO: 2216891 - DNA, 16 bp, Homo sapiens
gccgtctacctgaggg

SEQ ID NO: 2216892 - DNA, 17 bp, Homo sapiens
gccgtctacctgagggg

SEQ ID NO: 2216893 - DNA, 22 bp, Homo sapiens
gccgtctacctgaggggcctct

SEQ ID NO: 2216894 - DNA, 12 bp, Homo sapiens
gcctagcatacg

SEQ ID NO: 2216895 - DNA, 14 bp, Homo sapiens
gcctaggtgacaga

SEQ ID NO: 2216896 - DNA, 20 bp, Homo sapiens
gcctaggtgacagagtgaga

SEQ ID NO: 2216897 - DNA, 17 bp, Homo sapiens
gcctcacagtccttacc

SEQ ID NO: 2216898 - DNA, 16 bp, Homo sapiens
gcctcagcatcctggc

SEQ ID NO: 2216899 - DNA, 12 bp, Homo sapiens
gcctcagtgcca

SEQ ID NO: 2216900 - DNA, 16 bp, Homo sapiens
gcctcccaaagtgctg

SEQ ID NO: 2216901 - DNA, 18 bp, Homo sapiens
gcctcccaaagtgctggg

SEQ ID NO: 2216902 - DNA, 13 bp, Homo sapiens
gcctcccaactca

SEQ ID NO: 2216903 - DNA, 16 bp, Homo sapiens
gcctcccaactcaccc

SEQ ID NO: 2216904 - DNA, 22 bp, Homo sapiens
gcctcccaactcaccccagccc

SEQ ID NO: 2216905 - DNA, 18 bp, Homo sapiens
gcctcccgaatagctggg

SEQ ID NO: 2216906 - DNA, 23 bp, Homo sapiens
gcctcccgaatagctgggactac

SEQ ID NO: 2216907 - DNA, 18 bp, Homo sapiens
gcctcctgcccttacctg

SEQ ID NO: 2216908 - DNA, 21 bp, Homo sapiens
gcctcctttgtgaggaagccg

SEQ ID NO: 2216909 - DNA, 22 bp, Homo sapiens
gcctcctttgtgaggaagccgc

SEQ ID NO: 2216910 - DNA, 16 bp, Homo sapiens
gcctcgaactggctgc

SEQ ID NO: 2216911 - DNA, 17 bp, Homo sapiens
gcctcgaactggctgca

SEQ ID NO: 2216912 - DNA, 13 bp, Homo sapiens
gcctctctcaggc

SEQ ID NO: 2216913 - DNA, 16 bp, Homo sapiens
gcctctctcaggccaa

SEQ ID NO: 2216914 - DNA, 17 bp, Homo sapiens
gcctctgcactcccctg

SEQ ID NO: 2216915 - DNA, 19 bp, Homo sapiens
gcctctgcactcccctgct

SEQ ID NO: 2216916 - DNA, 18 bp, Homo sapiens
gcctctgcctctgacaca

SEQ ID NO: 2216917 - DNA, 16 bp, Homo sapiens
gcctcttatgggctgg

SEQ ID NO: 2216918 - DNA, 21 bp, Homo sapiens
gcctcttatgggctgggttct

SEQ ID NO: 2216919 - DNA, 23 bp, Homo sapiens
gcctcttctctactctagggaaa

SEQ ID NO: 2216920 - DNA, 17 bp, Homo sapiens
gcctgaagtcacacagt

SEQ ID NO: 2216921 - DNA, 18 bp, Homo sapiens
gcctgaagtcacacagtg

SEQ ID NO: 2216922 - DNA, 12 bp, Homo sapiens
gcctgcccaggc

SEQ ID NO: 2216923 - DNA, 17 bp, Homo sapiens
gcctgcccaggcccctg

SEQ ID NO: 2216924 - DNA, 20 bp, Homo sapiens
gcctgcccaggcccctgcca

SEQ ID NO: 2216925 - DNA, 22 bp, Homo sapiens
gcctgcccaggcccctgccacc

SEQ ID NO: 2216926 - DNA, 17 bp, Homo sapiens
gcctgccctcccacccc

SEQ ID NO: 2216927 - DNA, 20 bp, Homo sapiens
ggctgccaatgggagctcat

SEQ ID NO: 2216928 - DNA, 22 bp, Homo sapiens
ggctgcggaatgaaccacatct

SEQ ID NO: 2216929 - DNA, 14 bp, Homo sapiens
ggctgctgaaggct

SEQ ID NO: 2216930 - DNA, 15 bp, Homo sapiens
ggctgctgaaggctc

SEQ ID NO: 2216931 - DNA, 22 bp, Homo sapiens
ggctgcttcaaggatcctgagc

SEQ ID NO: 2216932 - DNA, 23 bp, Homo sapiens
ggctgcttcaaggatcctgagcc

SEQ ID NO: 2216933 - DNA, 21 bp, Homo sapiens
ggctggaagcagaaacaaaat

SEQ ID NO: 2216934 - DNA, 14 bp, Homo sapiens
ggctgggagagcct

SEQ ID NO: 2216935 - DNA, 15 bp, Homo sapiens
ggctgggagagcctt

SEQ ID NO: 2216936 - DNA, 16 bp, Homo sapiens
ggctgggagagccttc

SEQ ID NO: 2216937 - DNA, 14 bp, Homo sapiens
ggctgggcagagga

SEQ ID NO: 2216938 - DNA, 20 bp, Homo sapiens
ggctgggctcccttcccacc

SEQ ID NO: 2216939 - DNA, 21 bp, Homo sapiens
ggctgggcttcagtggcagct

SEQ ID NO: 2216940 - DNA, 15 bp, Homo sapiens
ggctgggggcctcag

SEQ ID NO: 2216941 - DNA, 17 bp, Homo sapiens
ggctgggggcctcagtg

SEQ ID NO: 2216942 - DNA, 19 bp, Homo sapiens
ggctgggtggcaccagcag

SEQ ID NO: 2216943 - DNA, 21 bp, Homo sapiens
ggctgggttctacccaggtgc

SEQ ID NO: 2216944 - DNA, 16 bp, Homo sapiens
ggctggtgtcacctga

SEQ ID NO: 2216945 - DNA, 23 bp, Homo sapiens
ggctgtatcccatgagcctcagc

SEQ ID NO: 2216946 - DNA, 15 bp, Homo sapiens
ggcttaaaacaacac

SEQ ID NO: 2216947 - DNA, 14 bp, Homo sapiens
ggcttagtcactga

SEQ ID NO: 2216948 - DNA, 21 bp, Homo sapiens
ggcttagtcactgagacagcc

SEQ ID NO: 2216949 - DNA, 17 bp, Homo sapiens
ggcttcagtggcagctg

SEQ ID NO: 2216950 - DNA, 22 bp, Homo sapiens
ggcttcatcctcctcagatctt

SEQ ID NO: 2216951 - DNA, 14 bp, Homo sapiens
ggcttttgtgcatt

SEQ ID NO: 2216952 - DNA, 16 bp, Homo sapiens
gggaagggggctggga

SEQ ID NO: 2216953 - DNA, 21 bp, Homo sapiens
gggaatgtttgcctctgcctc

SEQ ID NO: 2216954 - DNA, 23 bp, Homo sapiens
gggacagagggggtggcctccca

SEQ ID NO: 2216955 - DNA, 12 bp, Homo sapiens
gggacagctcct

SEQ ID NO: 2216956 - DNA, 12 bp, Homo sapiens
gggacctcaggc

SEQ ID NO: 2216957 - DNA, 23 bp, Homo sapiens
gggacttggaagctccgctttct

SEQ ID NO: 2216958 - DNA, 20 bp, Homo sapiens
gggagcaggcagtggggctg

SEQ ID NO: 2216959 - DNA, 22 bp, Homo sapiens
gggagctgcctgttcagctcca

SEQ ID NO: 2216960 - DNA, 19 bp, Homo sapiens
gggaggtcgaggcaggagg

SEQ ID NO: 2216961 - DNA, 16 bp, Homo sapiens
gggaggtgaccccagg

SEQ ID NO: 2216962 - DNA, 17 bp, Homo sapiens
gggagtgacagaggcag

SEQ ID NO: 2216963 - DNA, 11 bp, Homo sapiens
gggagtgagct

SEQ ID NO: 2216964 - DNA, 16 bp, Homo sapiens
gggatggcttgggggg

SEQ ID NO: 2216965 - DNA, 18 bp, Homo sapiens
gggcaacccccagcctgc

SEQ ID NO: 2216966 - DNA, 20 bp, Homo sapiens
gggcaacccccagcctgcta

SEQ ID NO: 2216967 - DNA, 21 bp, Homo sapiens
gggcacagaaaatggaagaca

SEQ ID NO: 2216968 - DNA, 13 bp, Homo sapiens
gggcacagggtct

SEQ ID NO: 2216969 - DNA, 14 bp, Homo sapiens
gggcacccccggcc

SEQ ID NO: 2216970 - DNA, 14 bp, Homo sapiens
gggcagaaggaaga

SEQ ID NO: 2216971 - DNA, 17 bp, Homo sapiens
gggcagagcagagacca

SEQ ID NO: 2216972 - DNA, 14 bp, Homo sapiens
gggcagaggaaagc

SEQ ID NO: 2216973 - DNA, 13 bp, Homo sapiens
gggcagcagagag

SEQ ID NO: 2216974 - DNA, 11 bp, Homo sapiens
gggccaggagc

SEQ ID NO: 2216975 - DNA, 14 bp, Homo sapiens
gggccaggagcctc

SEQ ID NO: 2216976 - DNA, 14 bp, Homo sapiens
gggccagttggtcc

SEQ ID NO: 2216977 - DNA, 14 bp, Homo sapiens
gggcccaagagaga

SEQ ID NO: 2216978 - DNA, 20 bp, Homo sapiens
gggccccacgtccctgcgga

SEQ ID NO: 2216979 - DNA, 18 bp, Homo sapiens
gggcctcttatgggctgg

SEQ ID NO: 2216980 - DNA, 12 bp, Homo sapiens
gggcctggctca

SEQ ID NO: 2216981 - DNA, 16 bp, Homo sapiens
gggcctggctcaggtg

SEQ ID NO: 2216982 - DNA, 17 bp, Homo sapiens
gggcctggctcaggtgg

SEQ ID NO: 2216983 - DNA, 10 bp, Homo sapiens
gggctcagca

SEQ ID NO: 2216984 - DNA, 21 bp, Homo sapiens
gggctcagcggggacagctcc

SEQ ID NO: 2216985 - DNA, 22 bp, Homo sapiens
gggctccagggggtgccctccc

SEQ ID NO: 2216986 - DNA, 17 bp, Homo sapiens
gggctcccttcccacct

SEQ ID NO: 2216987 - DNA, 16 bp, Homo sapiens
gggctctgcctcccat

SEQ ID NO: 2216988 - DNA, 13 bp, Homo sapiens
gggctggaagcag

SEQ ID NO: 2216989 - DNA, 17 bp, Homo sapiens
gggctgggttctaccca

SEQ ID NO: 2216990 - DNA, 18 bp, Homo sapiens
gggcttcagtggcagctg

SEQ ID NO: 2216991 - DNA, 19 bp, Homo sapiens
gggcttcagtggcagctgc

SEQ ID NO: 2216992 - DNA, 19 bp, Homo sapiens
gggcttcatcctcctcaga

SEQ ID NO: 2216993 - DNA, 22 bp, Homo sapiens
gggcttggggaccagagctgcc

SEQ ID NO: 2216994 - DNA, 24 bp, Homo sapiens
ggggaaaatcagcctgctccagct

SEQ ID NO: 2216995 - DNA, 18 bp, Homo sapiens
ggggaatgtttgcctctg

SEQ ID NO: 2216996 - DNA, 12 bp, Homo sapiens
ggggacagctcc

SEQ ID NO: 2216997 - DNA, 14 bp, Homo sapiens
ggggacagctcctt

SEQ ID NO: 2216998 - DNA, 12 bp, Homo sapiens
ggggaccagagc

SEQ ID NO: 2216999 - DNA, 13 bp, Homo sapiens
ggggaccagagct

SEQ ID NO: 2217000 - DNA, 16 bp, Homo sapiens
ggggaccagagctgcc

SEQ ID NO: 2217001 - DNA, 17 bp, Homo sapiens
ggggacctcaggcctgg

SEQ ID NO: 2217002 - DNA, 13 bp, Homo sapiens
ggggagcaggcag

SEQ ID NO: 2217003 - DNA, 13 bp, Homo sapiens
ggggagtggccac

SEQ ID NO: 2217004 - DNA, 17 bp, Homo sapiens
ggggatcacagcctctg

SEQ ID NO: 2217005 - DNA, 19 bp, Homo sapiens
ggggccctgcctcctttgt

SEQ ID NO: 2217006 - DNA, 23 bp, Homo sapiens
ggggccctgcctcctttgtgagg

SEQ ID NO: 2217007 - DNA, 20 bp, Homo sapiens
ggggcctggggtaggaggaa

SEQ ID NO: 2217008 - DNA, 22 bp, Homo sapiens
ggggctgcaccggctggcctgg

SEQ ID NO: 2217009 - DNA, 16 bp, Homo sapiens
ggggctgggcagagga

SEQ ID NO: 2217010 - DNA, 22 bp, Homo sapiens
gggggaggtgggatcctccagg

SEQ ID NO: 2217011 - DNA, 19 bp, Homo sapiens
gggggctccagggggtgcc

SEQ ID NO: 2217012 - DNA, 15 bp, Homo sapiens
gggggctgggcagag

SEQ ID NO: 2217013 - DNA, 11 bp, Homo sapiens
ggggggtggga

SEQ ID NO: 2217014 - DNA, 13 bp, Homo sapiens
gggggtggcctcc

SEQ ID NO: 2217015 - DNA, 17 bp, Homo sapiens
ggggtaggaggaacagg

SEQ ID NO: 2217016 - DNA, 22 bp, Homo sapiens
gggtacttgtggacacagctct

SEQ ID NO: 2217017 - DNA, 15 bp, Homo sapiens
gggtaggaggaacag

SEQ ID NO: 2217018 - DNA, 14 bp, Homo sapiens
gggtctcactctgt

SEQ ID NO: 2217019 - DNA, 19 bp, Homo sapiens
gggtgacagagcaagtgag

SEQ ID NO: 2217020 - DNA, 14 bp, Homo sapiens
gggtgccctcccag

SEQ ID NO: 2217021 - DNA, 17 bp, Homo sapiens
gggtggatgcctggtgg

SEQ ID NO: 2217022 - DNA, 18 bp, Homo sapiens
gggtgggacaccctgtga

SEQ ID NO: 2217023 - DNA, 16 bp, Homo sapiens
gggtgggaggggaaga

SEQ ID NO: 2217024 - DNA, 23 bp, Homo sapiens
gggttcccttttttggctgctga

SEQ ID NO: 2217025 - DNA, 16 bp, Homo sapiens
gggttggcccctgccc

SEQ ID NO: 2217026 - DNA, 17 bp, Homo sapiens
gggtttctaaagctgcc

SEQ ID NO: 2217027 - DNA, 20 bp, Homo sapiens
ggtaacaggcagatacagga

SEQ ID NO: 2217028 - DNA, 18 bp, Homo sapiens
ggtaactagggaagataa

SEQ ID NO: 2217029 - DNA, 20 bp, Homo sapiens
ggtaaggaatacctgtcccc

SEQ ID NO: 2217030 - DNA, 17 bp, Homo sapiens
ggtacccactgctctgg

SEQ ID NO: 2217031 - DNA, 17 bp, Homo sapiens
ggtacttgtggacacag

SEQ ID NO: 2217032 - DNA, 20 bp, Homo sapiens
ggtacttgtggacacagctc

SEQ ID NO: 2217033 - DNA, 22 bp, Homo sapiens
ggtagaaatatctgaaaatgta

SEQ ID NO: 2217034 - DNA, 14 bp, Homo sapiens
ggtatcaggtgctg

SEQ ID NO: 2217035 - DNA, 16 bp, Homo sapiens
ggtcagagcctgcagt

SEQ ID NO: 2217036 - DNA, 12 bp, Homo sapiens
ggtccacccagg

SEQ ID NO: 2217037 - DNA, 16 bp, Homo sapiens
ggtccacccaggagcc

SEQ ID NO: 2217038 - DNA, 22 bp, Homo sapiens
ggtccacccaggagccccgagg

SEQ ID NO: 2217039 - DNA, 12 bp, Homo sapiens
ggtcccactcag

SEQ ID NO: 2217040 - DNA, 11 bp, Homo sapiens
ggtcctgctgc

SEQ ID NO: 2217041 - DNA, 13 bp, Homo sapiens
ggtcggaaaacat

SEQ ID NO: 2217042 - DNA, 22 bp, Homo sapiens
ggtctcactatgttgcccaggc

SEQ ID NO: 2217043 - DNA, 23 bp, Homo sapiens
ggtctcactctgtcgcccagtct

SEQ ID NO: 2217044 - DNA, 15 bp, Homo sapiens
ggtctgacccactgc

SEQ ID NO: 2217045 - DNA, 19 bp, Homo sapiens
ggtctgttctttccaaagt

SEQ ID NO: 2217046 - DNA, 20 bp, Homo sapiens
ggtgagcactctggggtggg

SEQ ID NO: 2217047 - DNA, 23 bp, Homo sapiens
ggtgatccacccacctcagcctc

SEQ ID NO: 2217048 - DNA, 18 bp, Homo sapiens
ggtgcaatgacctttcaa

SEQ ID NO: 2217049 - DNA, 18 bp, Homo sapiens
ggtgccctcccagacccc

SEQ ID NO: 2217050 - DNA, 22 bp, Homo sapiens
ggtgctatctcccccagcccca

SEQ ID NO: 2217051 - DNA, 13 bp, Homo sapiens
tacattctgttaa

SEQ ID NO: 2217052 - DNA, 13 bp, Homo sapiens
taccagcagagca

SEQ ID NO: 2217053 - DNA, 15 bp, Homo sapiens
tacccactgctctgg

SEQ ID NO: 2217054 - DNA, 18 bp, Homo sapiens
tacccagcgagccctggt

SEQ ID NO: 2217055 - DNA, 22 bp, Homo sapiens
tacccaggtgctaggaacactc

SEQ ID NO: 2217056 - DNA, 22 bp, Homo sapiens
tacccatcccatatgcctgggc

SEQ ID NO: 2217057 - DNA, 20 bp, Homo sapiens
tacccgggaagggggctggg

SEQ ID NO: 2217058 - DNA, 21 bp, Homo sapiens
tacctcttgagccttgaactt

SEQ ID NO: 2217059 - DNA, 15 bp, Homo sapiens
tacctgaggggcctc

SEQ ID NO: 2217060 - DNA, 18 bp, Homo sapiens
tacctgccaggaagccag

SEQ ID NO: 2217061 - DNA, 14 bp, Homo sapiens
tacctgtccccctg

SEQ ID NO: 2217062 - DNA, 17 bp, Homo sapiens
tacctgtccccctgaca

SEQ ID NO: 2217063 - DNA, 20 bp, Homo sapiens
tacctttgtattctctcctg

SEQ ID NO: 2217064 - DNA, 13 bp, Homo sapiens
taccttttttaga

SEQ ID NO: 2217065 - DNA, 19 bp, Homo sapiens
taccttttttagagttgat

SEQ ID NO: 2217066 - DNA, 22 bp, Homo sapiens
taccttttttagagttgatact

SEQ ID NO: 2217067 - DNA, 16 bp, Homo sapiens
taccttttttatacat

SEQ ID NO: 2217068 - DNA, 14 bp, Homo sapiens
tacgtctgacaggc

SEQ ID NO: 2217069 - DNA, 16 bp, Homo sapiens
tacgtctgacaggcaa

SEQ ID NO: 2217070 - DNA, 13 bp, Homo sapiens
tacgttgtgcatt

SEQ ID NO: 2217071 - DNA, 14 bp, Homo sapiens
tacgttgtgcattt

SEQ ID NO: 2217072 - DNA, 13 bp, Homo sapiens
tactaactttcct

SEQ ID NO: 2217073 - DNA, 14 bp, Homo sapiens
tactaaggaatctt

SEQ ID NO: 2217074 - DNA, 20 bp, Homo sapiens
tactacagtttgttagtatg

SEQ ID NO: 2217075 - DNA, 17 bp, Homo sapiens
tactactcctgtaggaa

SEQ ID NO: 2217076 - DNA, 23 bp, Homo sapiens
tactatggccctggcctagcata

SEQ ID NO: 2217077 - DNA, 12 bp, Homo sapiens
tactatgtatca

SEQ ID NO: 2217078 - DNA, 16 bp, Homo sapiens
tactatgtatcaatga

SEQ ID NO: 2217079 - DNA, 23 bp, Homo sapiens
tactctcctggaaatattaagaa

SEQ ID NO: 2217080 - DNA, 12 bp, Homo sapiens
tactctgtgtca

SEQ ID NO: 2217081 - DNA, 16 bp, Homo sapiens
tactggagaaaatgga

SEQ ID NO: 2217082 - DNA, 14 bp, Homo sapiens
tactggggattctt

SEQ ID NO: 2217083 - DNA, 15 bp, Homo sapiens
tacttctgctacata

SEQ ID NO: 2217084 - DNA, 14 bp, Homo sapiens
tacttcttatacat

SEQ ID NO: 2217085 - DNA, 16 bp, Homo sapiens
tacttcttatacattt

SEQ ID NO: 2217086 - DNA, 13 bp, Homo sapiens
tacttgtggacac

SEQ ID NO: 2217087 - DNA, 14 bp, Homo sapiens
tacttgtggacaca

SEQ ID NO: 2217088 - DNA, 15 bp, Homo sapiens
tacttgtggacacag

SEQ ID NO: 2217089 - DNA, 16 bp, Homo sapiens
tagaagtcacacagta

SEQ ID NO: 2217090 - DNA, 18 bp, Homo sapiens
tagaagtcttagatgtat

SEQ ID NO: 2217091 - DNA, 14 bp, Homo sapiens
tagacagtccctgc

SEQ ID NO: 2217092 - DNA, 14 bp, Homo sapiens
tagaggttcaaaga

SEQ ID NO: 2217093 - DNA, 17 bp, Homo sapiens
tagagttgatactacag

SEQ ID NO: 2217094 - DNA, 16 bp, Homo sapiens
tagatactgtatcatg

SEQ ID NO: 2217095 - DNA, 19 bp, Homo sapiens
tagatatatgctctgcatg

SEQ ID NO: 2217096 - DNA, 15 bp, Homo sapiens
tagcacagaccctgc

SEQ ID NO: 2217097 - DNA, 17 bp, Homo sapiens
tagcacagaccctgccc

SEQ ID NO: 2217098 - DNA, 19 bp, Homo sapiens
tagcacagaccctgccctg

SEQ ID NO: 2217099 - DNA, 20 bp, Homo sapiens
tagcacagaccctgccctgt

SEQ ID NO: 2217100 - DNA, 23 bp, Homo sapiens
tagcagagaatgaaagggcccag

SEQ ID NO: 2217101 - DNA, 11 bp, Homo sapiens
tagcagggaaa

SEQ ID NO: 2217102 - DNA, 18 bp, Homo sapiens
tagcatacgtacacattt

SEQ ID NO: 2217103 - DNA, 19 bp, Homo sapiens
tagcatggctgccaatggg

SEQ ID NO: 2217104 - DNA, 16 bp, Homo sapiens
tagcattttgctaaat

SEQ ID NO: 2217105 - DNA, 16 bp, Homo sapiens
tagctcaggtgtccct

SEQ ID NO: 2217106 - DNA, 20 bp, Homo sapiens
tagctcaggtgtccctgcac

SEQ ID NO: 2217107 - DNA, 11 bp, Homo sapiens
tagctgggact

SEQ ID NO: 2217108 - DNA, 13 bp, Homo sapiens
taggaagactttg

SEQ ID NO: 2217109 - DNA, 15 bp, Homo sapiens
taggaagactttgga

SEQ ID NO: 2217110 - DNA, 17 bp, Homo sapiens
taggaagactttggaaa

SEQ ID NO: 2217111 - DNA, 15 bp, Homo sapiens
taggaaggttaatgt

SEQ ID NO: 2217112 - DNA, 15 bp, Homo sapiens
taggcctggccagat

SEQ ID NO: 2217113 - DNA, 19 bp, Homo sapiens
tagggaaaaaccagcgtgt

SEQ ID NO: 2217114 - DNA, 20 bp, Homo sapiens
tagggaaaaaccagcgtgtg

SEQ ID NO: 2217115 - DNA, 21 bp, Homo sapiens
tagggaaaaaccagcgtgtga

SEQ ID NO: 2217116 - DNA, 17 bp, Homo sapiens
tagggttataataatgt

SEQ ID NO: 2217117 - DNA, 21 bp, Homo sapiens
taggtgtgactgaatttcttt

SEQ ID NO: 2217118 - DNA, 23 bp, Homo sapiens
taggtgtgactgaatttcttttg

SEQ ID NO: 2217119 - DNA, 13 bp, Homo sapiens
taggtgtggggga

SEQ ID NO: 2217120 - DNA, 17 bp, Homo sapiens
taggtgtgggggaagca

SEQ ID NO: 2217121 - DNA, 17 bp, Homo sapiens
tagtatgaggcatttgt

SEQ ID NO: 2217122 - DNA, 21 bp, Homo sapiens
tagtcaggtgcctcaagagaa

SEQ ID NO: 2217123 - DNA, 15 bp, Homo sapiens
tagtggatgttctga

SEQ ID NO: 2217124 - DNA, 20 bp, Homo sapiens
tagttcctcattagcatttt

SEQ ID NO: 2217125 - DNA, 20 bp, Homo sapiens
tagttgtttgattcagacag

SEQ ID NO: 2217126 - DNA, 22 bp, Homo sapiens
tagttgtttgattcagacagct

SEQ ID NO: 2217127 - DNA, 15 bp, Homo sapiens
tagtttgattaaatt

SEQ ID NO: 2217128 - DNA, 16 bp, Homo sapiens
tagtttgattaaattc

SEQ ID NO: 2217129 - DNA, 23 bp, Homo sapiens
tagtttgattaaattcttgcaaa

SEQ ID NO: 2217130 - DNA, 13 bp, Homo sapiens
tataaactttacc

SEQ ID NO: 2217131 - DNA, 20 bp, Homo sapiens
tataatgaatgaaacatttt

SEQ ID NO: 2217132 - DNA, 14 bp, Homo sapiens
tataatgtaagctc

SEQ ID NO: 2217133 - DNA, 17 bp, Homo sapiens
tataattctactttgag

SEQ ID NO: 2217134 - DNA, 18 bp, Homo sapiens
tataatttacctgaagtc

SEQ ID NO: 2217135 - DNA, 20 bp, Homo sapiens
tatagcctaggtgacagagt

SEQ ID NO: 2217136 - DNA, 18 bp, Homo sapiens
tatcaagtattatacctt

SEQ ID NO: 2217137 - DNA, 17 bp, Homo sapiens
tatcagaattctcagaa

SEQ ID NO: 2217138 - DNA, 20 bp, Homo sapiens
tatcaggtgctgccatccag

SEQ ID NO: 2217139 - DNA, 17 bp, Homo sapiens
tatcatgacaaagactg

SEQ ID NO: 2217140 - DNA, 20 bp, Homo sapiens
tatccctactgtaatttgtg

SEQ ID NO: 2217141 - DNA, 16 bp, Homo sapiens
tatcgtcactgcttaa

SEQ ID NO: 2217142 - DNA, 19 bp, Homo sapiens
tatctagatactgtatcat

SEQ ID NO: 2217143 - DNA, 13 bp, Homo sapiens
tatctcccccagc

SEQ ID NO: 2217144 - DNA, 15 bp, Homo sapiens
tatcttgaagacttt

SEQ ID NO: 2217145 - DNA, 23 bp, Homo sapiens
tatgactccagaatttcccaaag

SEQ ID NO: 2217146 - DNA, 14 bp, Homo sapiens
tatgaggcatttgt

SEQ ID NO: 2217147 - DNA, 21 bp, Homo sapiens
tatgaggcatttgtttgaact

SEQ ID NO: 2217148 - DNA, 23 bp, Homo sapiens
tatgatcacggctcactgcagcc

SEQ ID NO: 2217149 - DNA, 18 bp, Homo sapiens
tatgcaatcaaatctgct

SEQ ID NO: 2217150 - DNA, 18 bp, Homo sapiens
tatgcatgaagtaatatg

SEQ ID NO: 2217151 - DNA, 11 bp, Homo sapiens
tatgcatttga

SEQ ID NO: 2217152 - DNA, 15 bp, Homo sapiens
tatgcttatacactt

SEQ ID NO: 2217153 - DNA, 16 bp, Homo sapiens
tatggaacactctgag

SEQ ID NO: 2217154 - DNA, 19 bp, Homo sapiens
tatggaacactctgagact

SEQ ID NO: 2217155 - DNA, 20 bp, Homo sapiens
tatggccctggcctagcata

SEQ ID NO: 2217156 - DNA, 16 bp, Homo sapiens
tatggcttttgtgcat

SEQ ID NO: 2217157 - DNA, 16 bp, Homo sapiens
tatgggactcaatgca

SEQ ID NO: 2217158 - DNA, 23 bp, Homo sapiens
tatgggactcaatgcactgacat

SEQ ID NO: 2217159 - DNA, 20 bp, Homo sapiens
tattaaaaatctcaaatttc

SEQ ID NO: 2217160 - DNA, 23 bp, Homo sapiens
tattaaaaatctcaaatttctaa

SEQ ID NO: 2217161 - DNA, 17 bp, Homo sapiens
tattaaatgcccagccc

SEQ ID NO: 2217162 - DNA, 16 bp, Homo sapiens
tattaagaaagactat

SEQ ID NO: 2217163 - DNA, 12 bp, Homo sapiens
tattagagaaga

SEQ ID NO: 2217164 - DNA, 14 bp, Homo sapiens
tattcaggaagctc

SEQ ID NO: 2217165 - DNA, 17 bp, Homo sapiens
tattctctcctgtacct

SEQ ID NO: 2217166 - DNA, 24 bp, Homo sapiens
tattctctcctgtacctcttgagc

SEQ ID NO: 2217167 - DNA, 20 bp, Homo sapiens
tattgatatgcttatacact

SEQ ID NO: 2217168 - DNA, 14 bp, Homo sapiens
tattgcccacgctg

SEQ ID NO: 2217169 - DNA, 23 bp, Homo sapiens
tattgctgatggtgcaatgacct

SEQ ID NO: 2217170 - DNA, 12 bp, Homo sapiens
tattgttttcag

SEQ ID NO: 2217171 - DNA, 21 bp, Homo sapiens
tatttaatgaaagactgtaca

SEQ ID NO: 2217172 - DNA, 23 bp, Homo sapiens
tatttaatttttttgagacagag

SEQ ID NO: 2217173 - DNA, 17 bp, Homo sapiens
tatttatgggatcctgg

SEQ ID NO: 2217174 - DNA, 22 bp, Homo sapiens
tatttccctcacctttcccatc

SEQ ID NO: 2217175 - DNA, 17 bp, Homo sapiens
tgacgccatcccagccc

SEQ ID NO: 2217176 - DNA, 23 bp, Homo sapiens
tgactccagaatttcccaaagca

SEQ ID NO: 2217177 - DNA, 15 bp, Homo sapiens
tgactgaatttcttt

SEQ ID NO: 2217178 - DNA, 21 bp, Homo sapiens
tgactgttttctcttgagagg

SEQ ID NO: 2217179 - DNA, 22 bp, Homo sapiens
tgacttttctgtccgagctttg

SEQ ID NO: 2217180 - DNA, 11 bp, Homo sapiens
tgagacagagt

SEQ ID NO: 2217181 - DNA, 14 bp, Homo sapiens
tgagaccaacctgg

SEQ ID NO: 2217182 - DNA, 12 bp, Homo sapiens
tgagaccctgtc

SEQ ID NO: 2217183 - DNA, 12 bp, Homo sapiens
tgagactctgtc

SEQ ID NO: 2217184 - DNA, 10 bp, Homo sapiens
tgagaggaaa

SEQ ID NO: 2217185 - DNA, 11 bp, Homo sapiens
tgagaggaaat

SEQ ID NO: 2217186 - DNA, 13 bp, Homo sapiens
tgagaggaaatca

SEQ ID NO: 2217187 - DNA, 14 bp, Homo sapiens
tgagaggaaatcac

SEQ ID NO: 2217188 - DNA, 23 bp, Homo sapiens
tgagaggcatccagtatcttgaa

SEQ ID NO: 2217189 - DNA, 14 bp, Homo sapiens
tgagaggggaacag

SEQ ID NO: 2217190 - DNA, 18 bp, Homo sapiens
tgagaggggaacagactg

SEQ ID NO: 2217191 - DNA, 15 bp, Homo sapiens
tgagatcaaaacggt

SEQ ID NO: 2217192 - DNA, 15 bp, Homo sapiens
tgagatcagcctggg

SEQ ID NO: 2217193 - DNA, 20 bp, Homo sapiens
tgagcactaaggtgtgctct

SEQ ID NO: 2217194 - DNA, 14 bp, Homo sapiens
tgagcagggctcag

SEQ ID NO: 2217195 - DNA, 15 bp, Homo sapiens
tgagcagggctcagc

SEQ ID NO: 2217196 - DNA, 23 bp, Homo sapiens
tgagcagggctcagcggggacag

SEQ ID NO: 2217197 - DNA, 13 bp, Homo sapiens
tgagcatcaggcc

SEQ ID NO: 2217198 - DNA, 19 bp, Homo sapiens
tgagcatcaggccaggccc

SEQ ID NO: 2217199 - DNA, 13 bp, Homo sapiens
tgagccactgcac

SEQ ID NO: 2217200 - DNA, 14 bp, Homo sapiens
tgagccactgcacc

SEQ ID NO: 2217201 - DNA, 18 bp, Homo sapiens
tgagccactgcaccgggc

SEQ ID NO: 2217202 - DNA, 13 bp, Homo sapiens
tgagccagatttc

SEQ ID NO: 2217203 - DNA, 15 bp, Homo sapiens
tgagcctcagcatcc

SEQ ID NO: 2217204 - DNA, 18 bp, Homo sapiens
tgagcctcagcatcctgg

SEQ ID NO: 2217205 - DNA, 22 bp, Homo sapiens
tgagcctcagcatcctggcacc

SEQ ID NO: 2217206 - DNA, 15 bp, Homo sapiens
tgagccttgaacttt

SEQ ID NO: 2217207 - DNA, 17 bp, Homo sapiens
tgagccttgaactttga

SEQ ID NO: 2217208 - DNA, 19 bp, Homo sapiens
tgagctcaggagtttgaga

SEQ ID NO: 2217209 - DNA, 13 bp, Homo sapiens
tgagctgggatga

SEQ ID NO: 2217210 - DNA, 15 bp, Homo sapiens
tgaggaagcaaaagc

SEQ ID NO: 2217211 - DNA, 22 bp, Homo sapiens
tgaggaatccagacccggctgc

SEQ ID NO: 2217212 - DNA, 12 bp, Homo sapiens
tgaggccagaga

SEQ ID NO: 2217213 - DNA, 14 bp, Homo sapiens
tgaggccagagaca

SEQ ID NO: 2217214 - DNA, 15 bp, Homo sapiens
tgaggcccagagggc

SEQ ID NO: 2217215 - DNA, 18 bp, Homo sapiens
tgaggcccagagggcctg

SEQ ID NO: 2217216 - DNA, 20 bp, Homo sapiens
tgaggcccagagggcctgca

SEQ ID NO: 2217217 - DNA, 21 bp, Homo sapiens
tgaggcccagagggcctgcaa

SEQ ID NO: 2217218 - DNA, 19 bp, Homo sapiens
tgaggcccttctctccagc

SEQ ID NO: 2217219 - DNA, 14 bp, Homo sapiens
tgaggctctgccct

SEQ ID NO: 2217220 - DNA, 11 bp, Homo sapiens
tgaggctgggc

SEQ ID NO: 2217221 - DNA, 16 bp, Homo sapiens
tgaggctgggctccct

SEQ ID NO: 2217222 - DNA, 18 bp, Homo sapiens
tgaggtcagagcctgcag

SEQ ID NO: 2217223 - DNA, 15 bp, Homo sapiens
tgaggtgctatgttc

SEQ ID NO: 2217224 - DNA, 13 bp, Homo sapiens
tgaggtgggagga

SEQ ID NO: 2217225 - DNA, 20 bp, Homo sapiens
tgagtacgttgtgcatttgg

SEQ ID NO: 2217226 - DNA, 17 bp, Homo sapiens
tgagtactacagtcctc

SEQ ID NO: 2217227 - DNA, 22 bp, Homo sapiens
tgagtactacagtcctcccatc

SEQ ID NO: 2217228 - DNA, 14 bp, Homo sapiens
tgagtcaccaagcc

SEQ ID NO: 2217229 - DNA, 19 bp, Homo sapiens
tgagtccagaagtttgaga

SEQ ID NO: 2217230 - DNA, 22 bp, Homo sapiens
tgagtcctggcatgggaatgaa

SEQ ID NO: 2217231 - DNA, 16 bp, Homo sapiens
tgagtcgaggacaggg

SEQ ID NO: 2217232 - DNA, 18 bp, Homo sapiens
tgagtcgaggacagggag

SEQ ID NO: 2217233 - DNA, 13 bp, Homo sapiens
tgagtgccttaca

SEQ ID NO: 2217234 - DNA, 16 bp, Homo sapiens
tgagtgccttacacaa

SEQ ID NO: 2217235 - DNA, 17 bp, Homo sapiens
tgagttcataccctgtt

SEQ ID NO: 2217236 - DNA, 16 bp, Homo sapiens
tgagttgatagcacag

SEQ ID NO: 2217237 - DNA, 21 bp, Homo sapiens
tgagttgatagcacagaccct

SEQ ID NO: 2217238 - DNA, 23 bp, Homo sapiens
tgagttgatagcacagaccctgc

SEQ ID NO: 2217239 - DNA, 19 bp, Homo sapiens
tgagttgattcagctctgc

SEQ ID NO: 2217240 - DNA, 15 bp, Homo sapiens
tgatacaatgctgtg

SEQ ID NO: 2217241 - DNA, 17 bp, Homo sapiens
tgatactacagtttgtt

SEQ ID NO: 2217242 - DNA, 16 bp, Homo sapiens
tgatagcacagaccct

SEQ ID NO: 2217243 - DNA, 17 bp, Homo sapiens
tgatagcacagaccctg

SEQ ID NO: 2217244 - DNA, 18 bp, Homo sapiens
tgatagcacagaccctgc

SEQ ID NO: 2217245 - DNA, 23 bp, Homo sapiens
tgatagcacagaccctgccctgt

SEQ ID NO: 2217246 - DNA, 13 bp, Homo sapiens
tgatcatccactg

SEQ ID NO: 2217247 - DNA, 17 bp, Homo sapiens
tgatccaagctggtccc

SEQ ID NO: 2217248 - DNA, 19 bp, Homo sapiens
tgatcctcccacctcagcc

SEQ ID NO: 2217249 - DNA, 22 bp, Homo sapiens
tgatcctcccacctcagcctcc

SEQ ID NO: 2217250 - DNA, 13 bp, Homo sapiens
tgatctaggaaga

SEQ ID NO: 2217251 - DNA, 14 bp, Homo sapiens
tgatctaggaagac

SEQ ID NO: 2217252 - DNA, 16 bp, Homo sapiens
tgatctttgcagacag

SEQ ID NO: 2217253 - DNA, 14 bp, Homo sapiens
tgatgagaggaaat

SEQ ID NO: 2217254 - DNA, 15 bp, Homo sapiens
tgatgagaggaaatc

SEQ ID NO: 2217255 - DNA, 20 bp, Homo sapiens
tgatgatctttgcagacagg

SEQ ID NO: 2217256 - DNA, 14 bp, Homo sapiens
tgatgccatgagga

SEQ ID NO: 2217257 - DNA, 16 bp, Homo sapiens
tgatgcttcttcagag

SEQ ID NO: 2217258 - DNA, 21 bp, Homo sapiens
tgatgggcaacccccagcctg

SEQ ID NO: 2217259 - DNA, 13 bp, Homo sapiens
tgatggggccctg

SEQ ID NO: 2217260 - DNA, 14 bp, Homo sapiens
tgatggggccctgc

SEQ ID NO: 2217261 - DNA, 22 bp, Homo sapiens
tgatggggccctgcctcctttg

SEQ ID NO: 2217262 - DNA, 20 bp, Homo sapiens
tgatgttctttcaccctttt

SEQ ID NO: 2217263 - DNA, 17 bp, Homo sapiens
tgatgttttaaggatgc

SEQ ID NO: 2217264 - DNA, 18 bp, Homo sapiens
tgatgttttaaggatgct

SEQ ID NO: 2217265 - DNA, 17 bp, Homo sapiens
tgatgttttccatgagt

SEQ ID NO: 2217266 - DNA, 16 bp, Homo sapiens
tgattaaattcttgca

SEQ ID NO: 2217267 - DNA, 19 bp, Homo sapiens
tgattaaattcttgcaaag

SEQ ID NO: 2217268 - DNA, 19 bp, Homo sapiens
tgattaaccacttcagctg

SEQ ID NO: 2217269 - DNA, 13 bp, Homo sapiens
tgattcagacagc

SEQ ID NO: 2217270 - DNA, 18 bp, Homo sapiens
tgattcagacagctgcct

SEQ ID NO: 2217271 - DNA, 20 bp, Homo sapiens
tgattcagacagctgcctgg

SEQ ID NO: 2217272 - DNA, 23 bp, Homo sapiens
tgattcagacagctgcctgggat

SEQ ID NO: 2217273 - DNA, 15 bp, Homo sapiens
tgattcataatgact

SEQ ID NO: 2217274 - DNA, 15 bp, Homo sapiens
tgattcccaagctct

SEQ ID NO: 2217275 - DNA, 19 bp, Homo sapiens
tgattcccaagctctgctc

SEQ ID NO: 2217276 - DNA, 22 bp, Homo sapiens
tgattcccaagctctgctcctc

SEQ ID NO: 2217277 - DNA, 21 bp, Homo sapiens
tgattctcctgcctcagcctc

SEQ ID NO: 2217278 - DNA, 18 bp, Homo sapiens
tgatttccgttaaaatac

SEQ ID NO: 2217279 - DNA, 22 bp, Homo sapiens
tgatttccgttaaaataccagc

SEQ ID NO: 2217280 - DNA, 19 bp, Homo sapiens
tgatttttttttccttcag

SEQ ID NO: 2217281 - DNA, 22 bp, Homo sapiens
tgatttttttttccttcagtgc

SEQ ID NO: 2217282 - DNA, 17 bp, Homo sapiens
tgcaacaggctgggctt

SEQ ID NO: 2217283 - DNA, 20 bp, Homo sapiens
tgcaacaggctgggcttcag

SEQ ID NO: 2217284 - DNA, 13 bp, Homo sapiens
tgcaacctccgcc

SEQ ID NO: 2217285 - DNA, 14 bp, Homo sapiens
tgcaacctccgcct

SEQ ID NO: 2217286 - DNA, 19 bp, Homo sapiens
tgcaacctgattgtgtctc

SEQ ID NO: 2217287 - DNA, 20 bp, Homo sapiens
tgcaacctgattgtgtctct

SEQ ID NO: 2217288 - DNA, 13 bp, Homo sapiens
tgcaatgaccttt

SEQ ID NO: 2217289 - DNA, 14 bp, Homo sapiens
tgcaatggcagcct

SEQ ID NO: 2217290 - DNA, 16 bp, Homo sapiens
tgcacaaacagaggcc

SEQ ID NO: 2217291 - DNA, 15 bp, Homo sapiens
tgcacaagctccaag

SEQ ID NO: 2217292 - DNA, 16 bp, Homo sapiens
tgcacaagctccaagc

SEQ ID NO: 2217293 - DNA, 20 bp, Homo sapiens
tgcacaagctccaagctccc

SEQ ID NO: 2217294 - DNA, 22 bp, Homo sapiens
tgcacaagctccaagctcccag

SEQ ID NO: 2217295 - DNA, 23 bp, Homo sapiens
tgcacaagctccaagctcccagg

SEQ ID NO: 2217296 - DNA, 17 bp, Homo sapiens
tgcacacaccagagccc

SEQ ID NO: 2217297 - DNA, 12 bp, Homo sapiens
tgcacacatttt

SEQ ID NO: 2217298 - DNA, 13 bp, Homo sapiens
tgcacacattttt

SEQ ID NO: 2217299 - DNA, 19 bp, Homo sapiens
tgcacagagttgttacatt

SEQ ID NO: 2217300 - DNA, 19 bp, Homo sapiens
ttccctttgacgccatccc

SEQ ID NO: 2217301 - DNA, 20 bp, Homo sapiens
ttccctttgacgccatccca

SEQ ID NO: 2217302 - DNA, 16 bp, Homo sapiens
ttccgttaaaatacca

SEQ ID NO: 2217303 - DNA, 13 bp, Homo sapiens
ttcctaatcctct

SEQ ID NO: 2217304 - DNA, 11 bp, Homo sapiens
ttcctctttcc

SEQ ID NO: 2217305 - DNA, 15 bp, Homo sapiens
ttcctgatgcttctt

SEQ ID NO: 2217306 - DNA, 17 bp, Homo sapiens
ttcctgccaggcatggt

SEQ ID NO: 2217307 - DNA, 16 bp, Homo sapiens
ttccttcagtgcctta

SEQ ID NO: 2217308 - DNA, 21 bp, Homo sapiens
ttccttgagttgattcagctc

SEQ ID NO: 2217309 - DNA, 17 bp, Homo sapiens
ttctaaagctgccagcc

SEQ ID NO: 2217310 - DNA, 12 bp, Homo sapiens
ttctacccagcg

SEQ ID NO: 2217311 - DNA, 21 bp, Homo sapiens
ttctacccagcgagccctggt

SEQ ID NO: 2217312 - DNA, 16 bp, Homo sapiens
ttctatgacacatgca

SEQ ID NO: 2217313 - DNA, 14 bp, Homo sapiens
ttctattgtttctt

SEQ ID NO: 2217314 - DNA, 14 bp, Homo sapiens
ttctccacctgcca

SEQ ID NO: 2217315 - DNA, 15 bp, Homo sapiens
ttctccacctgccag

SEQ ID NO: 2217316 - DNA, 20 bp, Homo sapiens
ttctctagtttgattaaatt

SEQ ID NO: 2217317 - DNA, 21 bp, Homo sapiens
ttctctagtttgattaaattc

SEQ ID NO: 2217318 - DNA, 18 bp, Homo sapiens
ttctctcctgtacctctt

SEQ ID NO: 2217319 - DNA, 17 bp, Homo sapiens
ttctctgccctccaaga

SEQ ID NO: 2217320 - DNA, 16 bp, Homo sapiens
ttctcttttcaaaaca

SEQ ID NO: 2217321 - DNA, 15 bp, Homo sapiens
ttctgaaagggacgc

SEQ ID NO: 2217322 - DNA, 23 bp, Homo sapiens
ttctgaacttggcgctgcccctg

SEQ ID NO: 2217323 - DNA, 20 bp, Homo sapiens
ttctgacccatgctgccctg

SEQ ID NO: 2217324 - DNA, 21 bp, Homo sapiens
ttctgacccatgctgccctgt

SEQ ID NO: 2217325 - DNA, 21 bp, Homo sapiens
ttctgaccctgcttcaaatat

SEQ ID NO: 2217326 - DNA, 15 bp, Homo sapiens
ttctgccatattctg

SEQ ID NO: 2217327 - DNA, 15 bp, Homo sapiens
ttctgccgcagccct

SEQ ID NO: 2217328 - DNA, 16 bp, Homo sapiens
ttctgccgcagccctg

SEQ ID NO: 2217329 - DNA, 21 bp, Homo sapiens
ttctgcctgcccaggcccctg

SEQ ID NO: 2217330 - DNA, 14 bp, Homo sapiens
ttctgcttcagcct

SEQ ID NO: 2217331 - DNA, 16 bp, Homo sapiens
ttctgcttcagcctcc

SEQ ID NO: 2217332 - DNA, 15 bp, Homo sapiens
ttctggctcttccag

SEQ ID NO: 2217333 - DNA, 17 bp, Homo sapiens
ttctgtccgagctttga

SEQ ID NO: 2217334 - DNA, 19 bp, Homo sapiens
ttctgtcctactctgtgtc

SEQ ID NO: 2217335 - DNA, 21 bp, Homo sapiens
ttctgttggccagtgtgacaa

SEQ ID NO: 2217336 - DNA, 23 bp, Homo sapiens
ttcttatttaatgaaagactgta

SEQ ID NO: 2217337 - DNA, 13 bp, Homo sapiens
ttcttcctccctc

SEQ ID NO: 2217338 - DNA, 23 bp, Homo sapiens
ttcttcctccctccctctttccc

SEQ ID NO: 2217339 - DNA, 22 bp, Homo sapiens
ttcttctccactttctagccag

SEQ ID NO: 2217340 - DNA, 13 bp, Homo sapiens
ttcttctgcttca

SEQ ID NO: 2217341 - DNA, 12 bp, Homo sapiens
ttcttgcaaagt

SEQ ID NO: 2217342 - DNA, 14 bp, Homo sapiens
ttctttccaaagta

SEQ ID NO: 2217343 - DNA, 21 bp, Homo sapiens
ttctttcctgaggctgggctc

SEQ ID NO: 2217344 - DNA, 12 bp, Homo sapiens
ttctttctggct

SEQ ID NO: 2217345 - DNA, 20 bp, Homo sapiens
ttcttttgccgttattaaaa

SEQ ID NO: 2217346 - DNA, 20 bp, Homo sapiens
ttgaaaaaccattttgctgt

SEQ ID NO: 2217347 - DNA, 11 bp, Homo sapiens
ttgaaatcttt

SEQ ID NO: 2217348 - DNA, 16 bp, Homo sapiens
ttgaactcctggcctc

SEQ ID NO: 2217349 - DNA, 13 bp, Homo sapiens
ttgaactttgacc

SEQ ID NO: 2217350 - DNA, 17 bp, Homo sapiens
ttgaactttgacctctg

SEQ ID NO: 2217351 - DNA, 18 bp, Homo sapiens
ttgaactttgacctctgc

SEQ ID NO: 2217352 - DNA, 16 bp, Homo sapiens
ttgaatgatgccatga

SEQ ID NO: 2217353 - DNA, 19 bp, Homo sapiens
ttgaccattctccacctgc

SEQ ID NO: 2217354 - DNA, 21 bp, Homo sapiens
ttgaccgtgaggccagagaca

SEQ ID NO: 2217355 - DNA, 15 bp, Homo sapiens
ttgacctcaggtgat

SEQ ID NO: 2217356 - DNA, 14 bp, Homo sapiens
ttgacctctgcagc

SEQ ID NO: 2217357 - DNA, 15 bp, Homo sapiens
ttgacctctgcagca

SEQ ID NO: 2217358 - DNA, 12 bp, Homo sapiens
ttgacctgaggc

SEQ ID NO: 2217359 - DNA, 19 bp, Homo sapiens
ttgacctgaggcccttctc

SEQ ID NO: 2217360 - DNA, 22 bp, Homo sapiens
ttgacctgaggcccttctctcc

SEQ ID NO: 2217361 - DNA, 19 bp, Homo sapiens
ttgacgccatcccagcccc

SEQ ID NO: 2217362 - DNA, 12 bp, Homo sapiens
ttgagacagagt

SEQ ID NO: 2217363 - DNA, 15 bp, Homo sapiens
ttgagatcagcctgg

SEQ ID NO: 2217364 - DNA, 17 bp, Homo sapiens
ttgatactacagtttgt

SEQ ID NO: 2217365 - DNA, 18 bp, Homo sapiens
ttgatagcacagaccctg

SEQ ID NO: 2217366 - DNA, 20 bp, Homo sapiens
ttgatagcacagaccctgcc

SEQ ID NO: 2217367 - DNA, 16 bp, Homo sapiens
ttgatgatctttgcag

SEQ ID NO: 2217368 - DNA, 23 bp, Homo sapiens
ttgatgttctttcacccttttct

SEQ ID NO: 2217369 - DNA, 23 bp, Homo sapiens
ttgatgttttaaggatgcttgta

SEQ ID NO: 2217370 - DNA, 16 bp, Homo sapiens
ttgattaaattcttgc

SEQ ID NO: 2217371 - DNA, 21 bp, Homo sapiens
ttgattaaattcttgcaaagt

SEQ ID NO: 2217372 - DNA, 14 bp, Homo sapiens
ttgattcagacagc

SEQ ID NO: 2217373 - DNA, 23 bp, Homo sapiens
ttgattcagacagctgcctggga

SEQ ID NO: 2217374 - DNA, 16 bp, Homo sapiens
ttgattcagctctgca

SEQ ID NO: 2217375 - DNA, 14 bp, Homo sapiens
ttgcaccactgcac

SEQ ID NO: 2217376 - DNA, 12 bp, Homo sapiens
ttgcatgaggct

SEQ ID NO: 2217377 - DNA, 21 bp, Homo sapiens
ttgccatgttggccaggctgg

SEQ ID NO: 2217378 - DNA, 23 bp, Homo sapiens
ttgcccacgctggagtgcagtga

SEQ ID NO: 2217379 - DNA, 14 bp, Homo sapiens
ttgcccaggcaggt

SEQ ID NO: 2217380 - DNA, 16 bp, Homo sapiens
ttgcccaggcctcccc

SEQ ID NO: 2217381 - DNA, 11 bp, Homo sapiens
ttgcccaggct

SEQ ID NO: 2217382 - DNA, 23 bp, Homo sapiens
ttgcccaggctggcgtgcagtgg

SEQ ID NO: 2217383 - DNA, 15 bp, Homo sapiens
ttgccgtctacctga

SEQ ID NO: 2217384 - DNA, 19 bp, Homo sapiens
ttgccgtctacctgagggg

SEQ ID NO: 2217385 - DNA, 14 bp, Homo sapiens
ttgccgttattaaa

SEQ ID NO: 2217386 - DNA, 18 bp, Homo sapiens
ttgctgatggtgcaatga

SEQ ID NO: 2217387 - DNA, 15 bp, Homo sapiens
ttggattgtccccga

SEQ ID NO: 2217388 - DNA, 22 bp, Homo sapiens
ttggcgctgcccctggcagccc

SEQ ID NO: 2217389 - DNA, 22 bp, Homo sapiens
ttggctaggacccctccatgtg

SEQ ID NO: 2217390 - DNA, 14 bp, Homo sapiens
ttggctgcagggag

SEQ ID NO: 2217391 - DNA, 18 bp, Homo sapiens
ttggctgggggcctcagt

SEQ ID NO: 2217392 - DNA, 22 bp, Homo sapiens
ttggctgggggcctcagtgcca

SEQ ID NO: 2217393 - DNA, 23 bp, Homo sapiens
ttggcttcacggaagagccttgc

SEQ ID NO: 2217394 - DNA, 22 bp, Homo sapiens
ttggctttgggttgcaggacct

SEQ ID NO: 2217395 - DNA, 19 bp, Homo sapiens
ttggggaagaacgaagcca

SEQ ID NO: 2217396 - DNA, 22 bp, Homo sapiens
ttggggggctgaggtgggagga

SEQ ID NO: 2217397 - DNA, 17 bp, Homo sapiens
ttggggtacccactgct

SEQ ID NO: 2217398 - DNA, 22 bp, Homo sapiens
ttgggttcaagcgattcttctg

SEQ ID NO: 2217399 - DNA, 13 bp, Homo sapiens
ttggtcctgctgc

SEQ ID NO: 2217400 - DNA, 17 bp, Homo sapiens
ttggtgtcgggcatgac

SEQ ID NO: 2217401 - DNA, 15 bp, Homo sapiens
ttgtaaaaagggaaa

SEQ ID NO: 2217402 - DNA, 17 bp, Homo sapiens
ttgtaaatagctcaggt

SEQ ID NO: 2217403 - DNA, 14 bp, Homo sapiens
ttgtaaggaatgat

SEQ ID NO: 2217404 - DNA, 14 bp, Homo sapiens
ttgtacataatgcg

SEQ ID NO: 2217405 - DNA, 18 bp, Homo sapiens
ttgtacataatgcgtgca

SEQ ID NO: 2217406 - DNA, 17 bp, Homo sapiens
ttgtcacacactttggc

SEQ ID NO: 2217407 - DNA, 18 bp, Homo sapiens
ttgtcacacactttggct

SEQ ID NO: 2217408 - DNA, 14 bp, Homo sapiens
ttgtctatgggact

SEQ ID NO: 2217409 - DNA, 22 bp, Homo sapiens
ttgtcttaaaaagtggaaaaat

SEQ ID NO: 2217410 - DNA, 24 bp, Homo sapiens
ttgtctttggaccctgaggcccag

SEQ ID NO: 2217411 - DNA, 18 bp, Homo sapiens
ttgtgaggaagccgctgg

SEQ ID NO: 2217412 - DNA, 16 bp, Homo sapiens
ttgtgatttttgtaat

SEQ ID NO: 2217413 - DNA, 17 bp, Homo sapiens
ttgtgatttttgtaatt

SEQ ID NO: 2217414 - DNA, 22 bp, Homo sapiens
ttgtgcattatctagatactgt

SEQ ID NO: 2217415 - DNA, 12 bp, Homo sapiens
ttgtgcatttgg

SEQ ID NO: 2217416 - DNA, 17 bp, Homo sapiens
ttgtgtgtttattgtca

SEQ ID NO: 2217417 - DNA, 20 bp, Homo sapiens
ttgtgttactaagtttttat

SEQ ID NO: 2217418 - DNA, 21 bp, Homo sapiens
ttgtgtttatatataagccaa

SEQ ID NO: 2217419 - DNA, 14 bp, Homo sapiens
ttgttacattttta

SEQ ID NO: 2217420 - DNA, 20 bp, Homo sapiens
ttgttagtgtgtcttagtgt

SEQ ID NO: 2217421 - DNA, 13 bp, Homo sapiens
ttgttttcagtgt

SEQ ID NO: 2217422 - DNA, 23 bp, Homo sapiens
tttaaaaatacagatagatatat

SEQ ID NO: 2217423 - DNA, 13 bp, Homo sapiens
tttaaagaatgct

SEQ ID NO: 2217424 - DNA, 20 bp, Homo sapiens
gacagacacaggcccggctc

SEQ ID NO: 2217425 - DNA, 22 bp, Homo sapiens
gacagacacaggcccggctcca

SEQ ID NO: 2217426 - DNA, 16 bp, Homo sapiens
gacagaggcagcccca

SEQ ID NO: 2217427 - DNA, 18 bp, Homo sapiens
gacagagggggtggcctc

SEQ ID NO: 2217428 - DNA, 19 bp, Homo sapiens
gacagagggggtggcctcc

SEQ ID NO: 2217429 - DNA, 22 bp, Homo sapiens
gacagagggggtggcctcccaa

SEQ ID NO: 2217430 - DNA, 14 bp, Homo sapiens
gacagagtctcact

SEQ ID NO: 2217431 - DNA, 16 bp, Homo sapiens
gacagagtgagactct

SEQ ID NO: 2217432 - DNA, 19 bp, Homo sapiens
gacagagtgagactctgtc

SEQ ID NO: 2217433 - DNA, 22 bp, Homo sapiens
gacagagtgagactctgtctca

SEQ ID NO: 2217434 - DNA, 14 bp, Homo sapiens
gacagcacaggcag

SEQ ID NO: 2217435 - DNA, 18 bp, Homo sapiens
gacagccacggccaggcc

SEQ ID NO: 2217436 - DNA, 19 bp, Homo sapiens
gacagcccgggctctgcct

SEQ ID NO: 2217437 - DNA, 11 bp, Homo sapiens
gacagctctta

SEQ ID NO: 2217438 - DNA, 15 bp, Homo sapiens
gacaggaccagggat

SEQ ID NO: 2217439 - DNA, 18 bp, Homo sapiens
gacaggcaatgctggctg

SEQ ID NO: 2217440 - DNA, 19 bp, Homo sapiens
gacaggcaatgctggctgt

SEQ ID NO: 2217441 - DNA, 19 bp, Homo sapiens
gacaggcatgttctctgag

SEQ ID NO: 2217442 - DNA, 22 bp, Homo sapiens
gacaggcatgttctctgaggac

SEQ ID NO: 2217443 - DNA, 24 bp, Homo sapiens
gacagggcacaccgggcactcaga

SEQ ID NO: 2217444 - DNA, 22 bp, Homo sapiens
gacagggttttgccatgttggc

SEQ ID NO: 2217445 - DNA, 12 bp, Homo sapiens
gacagtccctgc

SEQ ID NO: 2217446 - DNA, 14 bp, Homo sapiens
gacatgggaaaggg

SEQ ID NO: 2217447 - DNA, 14 bp, Homo sapiens
gacattgcggacag

SEQ ID NO: 2217448 - DNA, 17 bp, Homo sapiens
gacattgcggacagcca

SEQ ID NO: 2217449 - DNA, 21 bp, Homo sapiens
gaccagacaccttgacagggc

SEQ ID NO: 2217450 - DNA, 23 bp, Homo sapiens
gaccagacaccttgacagggcac

SEQ ID NO: 2217451 - DNA, 13 bp, Homo sapiens
gaccagagctgcc

SEQ ID NO: 2217452 - DNA, 14 bp, Homo sapiens
gaccagagctgcca

SEQ ID NO: 2217453 - DNA, 20 bp, Homo sapiens
gaccagcaccatctctcctc

SEQ ID NO: 2217454 - DNA, 12 bp, Homo sapiens
gaccatccctga

SEQ ID NO: 2217455 - DNA, 14 bp, Homo sapiens
gaccatccctgaag

SEQ ID NO: 2217456 - DNA, 17 bp, Homo sapiens
gaccattctccacctgc

SEQ ID NO: 2217457 - DNA, 21 bp, Homo sapiens
gaccattctccacctgccagg

SEQ ID NO: 2217458 - DNA, 16 bp, Homo sapiens
gacccatgctgccctg

SEQ ID NO: 2217459 - DNA, 20 bp, Homo sapiens
gacccatgctgccctgtgag

SEQ ID NO: 2217460 - DNA, 20 bp, Homo sapiens
gacccccttgcccaggcctc

SEQ ID NO: 2217461 - DNA, 10 bp, Homo sapiens
gaccctgagg

SEQ ID NO: 2217462 - DNA, 11 bp, Homo sapiens
gaccctgaggc

SEQ ID NO: 2217463 - DNA, 12 bp, Homo sapiens
gaccctgaggcc

SEQ ID NO: 2217464 - DNA, 13 bp, Homo sapiens
gaccctgccctgt

SEQ ID NO: 2217465 - DNA, 20 bp, Homo sapiens
gaccctgccctgtgggcccc

SEQ ID NO: 2217466 - DNA, 23 bp, Homo sapiens
gaccctgtctcaaaaaaagaaaa

SEQ ID NO: 2217467 - DNA, 20 bp, Homo sapiens
gacccttgtggtcccacccc

SEQ ID NO: 2217468 - DNA, 14 bp, Homo sapiens
gaccgtgaggccag

SEQ ID NO: 2217469 - DNA, 16 bp, Homo sapiens
gaccgtgaggccagag

SEQ ID NO: 2217470 - DNA, 17 bp, Homo sapiens
gaccgtgaggccagaga

SEQ ID NO: 2217471 - DNA, 18 bp, Homo sapiens
gaccgtgaggccagagac

SEQ ID NO: 2217472 - DNA, 18 bp, Homo sapiens
gacctcaggtgagaagca

SEQ ID NO: 2217473 - DNA, 21 bp, Homo sapiens
gacctcaggtgagaagcagag

SEQ ID NO: 2217474 - DNA, 19 bp, Homo sapiens
gacctcaggtgatccaccc

SEQ ID NO: 2217475 - DNA, 21 bp, Homo sapiens
gacctcaggtgatccacccac

SEQ ID NO: 2217476 - DNA, 16 bp, Homo sapiens
gacctcgtggagaatt

SEQ ID NO: 2217477 - DNA, 14 bp, Homo sapiens
gacctctgcagcaa

SEQ ID NO: 2217478 - DNA, 16 bp, Homo sapiens
gacctctgcagcaata

SEQ ID NO: 2217479 - DNA, 22 bp, Homo sapiens
gacctctgcagcaataaagcag

SEQ ID NO: 2217480 - DNA, 15 bp, Homo sapiens
gacctgaggcccttc

SEQ ID NO: 2217481 - DNA, 20 bp, Homo sapiens
gaccttctccttcacctttg

SEQ ID NO: 2217482 - DNA, 22 bp, Homo sapiens
gacctttaagagaaatgagctg

SEQ ID NO: 2217483 - DNA, 19 bp, Homo sapiens
gacctttcaataggaaaaa

SEQ ID NO: 2217484 - DNA, 20 bp, Homo sapiens
gacctttcaataggaaaaac

SEQ ID NO: 2217485 - DNA, 20 bp, Homo sapiens
gacgacgcgagggccccacg

SEQ ID NO: 2217486 - DNA, 17 bp, Homo sapiens
gacgccatcccagcccc

SEQ ID NO: 2217487 - DNA, 18 bp, Homo sapiens
gacgccatcccagcccca

SEQ ID NO: 2217488 - DNA, 19 bp, Homo sapiens
gacgccatcccagccccaa

SEQ ID NO: 2217489 - DNA, 18 bp, Homo sapiens
gacgcgagggccccacgt

SEQ ID NO: 2217490 - DNA, 21 bp, Homo sapiens
gacgctgtgctgccctgccca

SEQ ID NO: 2217491 - DNA, 22 bp, Homo sapiens
gacgctgtgctgccctgcccac

SEQ ID NO: 2217492 - DNA, 23 bp, Homo sapiens
gacggagtcccaccttggctgca

SEQ ID NO: 2217493 - DNA, 14 bp, Homo sapiens
gacgtgttatgact

SEQ ID NO: 2217494 - DNA, 17 bp, Homo sapiens
gacgtgttatgactcca

SEQ ID NO: 2217495 - DNA, 23 bp, Homo sapiens
gactaacttgtctttggaccctg

SEQ ID NO: 2217496 - DNA, 13 bp, Homo sapiens
gactacaggcacc

SEQ ID NO: 2217497 - DNA, 17 bp, Homo sapiens
gactactcccccaggtg

SEQ ID NO: 2217498 - DNA, 14 bp, Homo sapiens
gactcaatgcactg

SEQ ID NO: 2217499 - DNA, 12 bp, Homo sapiens
gactcctgcagg

SEQ ID NO: 2217500 - DNA, 17 bp, Homo sapiens
gactcgcgacaatgcaa

SEQ ID NO: 2217501 - DNA, 19 bp, Homo sapiens
gactcgcgacaatgcaaac

SEQ ID NO: 2217502 - DNA, 21 bp, Homo sapiens
gactctacagaggccatgggc

SEQ ID NO: 2217503 - DNA, 16 bp, Homo sapiens
gactgaatttcttttg

SEQ ID NO: 2217504 - DNA, 18 bp, Homo sapiens
gactgagtacgttgtgca

SEQ ID NO: 2217505 - DNA, 15 bp, Homo sapiens
gactggaagcacagc

SEQ ID NO: 2217506 - DNA, 18 bp, Homo sapiens
gactggaagcacagcttc

SEQ ID NO: 2217507 - DNA, 23 bp, Homo sapiens
gactggccaaggtttggggaaga

SEQ ID NO: 2217508 - DNA, 16 bp, Homo sapiens
gactgttttctcttga

SEQ ID NO: 2217509 - DNA, 19 bp, Homo sapiens
gacttaagcacacttgaca

SEQ ID NO: 2217510 - DNA, 14 bp, Homo sapiens
gactttggaaagac

SEQ ID NO: 2217511 - DNA, 21 bp, Homo sapiens
gacttttctgtccgagctttg

SEQ ID NO: 2217512 - DNA, 23 bp, Homo sapiens
gacttttctgtccgagctttgaa

SEQ ID NO: 2217513 - DNA, 21 bp, Homo sapiens
gagaaaatggacgtgttatga

SEQ ID NO: 2217514 - DNA, 14 bp, Homo sapiens
gagaaagagagaga

SEQ ID NO: 2217515 - DNA, 14 bp, Homo sapiens
gagaaatgagcttg

SEQ ID NO: 2217516 - DNA, 16 bp, Homo sapiens
gagaagcggctggcag

SEQ ID NO: 2217517 - DNA, 17 bp, Homo sapiens
gagaagcggctggcagc

SEQ ID NO: 2217518 - DNA, 23 bp, Homo sapiens
gagaaggggcccaagagagacag

SEQ ID NO: 2217519 - DNA, 23 bp, Homo sapiens
gagaatgcacaaacagaggccgc

SEQ ID NO: 2217520 - DNA, 16 bp, Homo sapiens
gagacagcacaggcag

SEQ ID NO: 2217521 - DNA, 17 bp, Homo sapiens
gagacagcacaggcagc

SEQ ID NO: 2217522 - DNA, 23 bp, Homo sapiens
gagacagcacaggcagccccacg

SEQ ID NO: 2217523 - DNA, 14 bp, Homo sapiens
gagacagcccgggc

SEQ ID NO: 2217524 - DNA, 19 bp, Homo sapiens
gagacagcccgggctctgc

SEQ ID NO: 2217525 - DNA, 20 bp, Homo sapiens
gagacagcccgggctctgcc

SEQ ID NO: 2217526 - DNA, 12 bp, Homo sapiens
gagaccatccct

SEQ ID NO: 2217527 - DNA, 21 bp, Homo sapiens
gagaccatccctgaaggcccc

SEQ ID NO: 2217528 - DNA, 19 bp, Homo sapiens
gagactcctgcaggcagcc

SEQ ID NO: 2217529 - DNA, 21 bp, Homo sapiens
gagactcctgcaggcagccag

SEQ ID NO: 2217530 - DNA, 21 bp, Homo sapiens
gagactcgcgacaatgcaaac

SEQ ID NO: 2217531 - DNA, 13 bp, Homo sapiens
gagagaaagagag

SEQ ID NO: 2217532 - DNA, 12 bp, Homo sapiens
gagagacagcac

SEQ ID NO: 2217533 - DNA, 17 bp, Homo sapiens
gagagacagcacaggca

SEQ ID NO: 2217534 - DNA, 18 bp, Homo sapiens
gagagacagcacaggcag

SEQ ID NO: 2217535 - DNA, 10 bp, Homo sapiens
gagagagaaa

SEQ ID NO: 2217536 - DNA, 10 bp, Homo sapiens
gagagagaga

SEQ ID NO: 2217537 - DNA, 12 bp, Homo sapiens
gagagagagaga

SEQ ID NO: 2217538 - DNA, 14 bp, Homo sapiens
gagagagagagaaa

SEQ ID NO: 2217539 - DNA, 14 bp, Homo sapiens
gagagagagagaga

SEQ ID NO: 2217540 - DNA, 15 bp, Homo sapiens
gagagagagagagaa

SEQ ID NO: 2217541 - DNA, 13 bp, Homo sapiens
gagagccttccag

SEQ ID NO: 2217542 - DNA, 14 bp, Homo sapiens
gagagccttccagg

SEQ ID NO: 2217543 - DNA, 18 bp, Homo sapiens
gagagccttccaggggtg

SEQ ID NO: 2217544 - DNA, 15 bp, Homo sapiens
gagagctagcagcag

SEQ ID NO: 2217545 - DNA, 20 bp, Homo sapiens
gagagctgggtgtcaagagg

SEQ ID NO: 2217546 - DNA, 14 bp, Homo sapiens
gagaggcatccagt

SEQ ID NO: 2217547 - DNA, 20 bp, Homo sapiens
gagagggtgggagtgggccc

SEQ ID NO: 2217548 - DNA, 15 bp, Homo sapiens
gcccacgcccccact

SEQ ID NO: 2217549 - DNA, 21 bp, Homo sapiens
gcccacgcccccactggtgac

SEQ ID NO: 2217550 - DNA, 14 bp, Homo sapiens
gcccactccctgca

SEQ ID NO: 2217551 - DNA, 15 bp, Homo sapiens
gcccagagagggtgg

SEQ ID NO: 2217552 - DNA, 15 bp, Homo sapiens
gcccagagggcctgc

SEQ ID NO: 2217553 - DNA, 19 bp, Homo sapiens
gcccagagggcctgcaagg

SEQ ID NO: 2217554 - DNA, 16 bp, Homo sapiens
gcccagccccttctga

SEQ ID NO: 2217555 - DNA, 17 bp, Homo sapiens
gcccagccccttctgac

SEQ ID NO: 2217556 - DNA, 24 bp, Homo sapiens
gcccagccccttctgacccatgct

SEQ ID NO: 2217557 - DNA, 18 bp, Homo sapiens
gcccaggaaaggctccag

SEQ ID NO: 2217558 - DNA, 20 bp, Homo sapiens
gcccaggaaaggctccagga

SEQ ID NO: 2217559 - DNA, 11 bp, Homo sapiens
gcccaggcagg

SEQ ID NO: 2217560 - DNA, 11 bp, Homo sapiens
gcccaggcccc

SEQ ID NO: 2217561 - DNA, 17 bp, Homo sapiens
gcccaggcccctgccac

SEQ ID NO: 2217562 - DNA, 20 bp, Homo sapiens
gcccaggcccctgccaccct

SEQ ID NO: 2217563 - DNA, 18 bp, Homo sapiens
gcccaggcctcctacagc

SEQ ID NO: 2217564 - DNA, 12 bp, Homo sapiens
gcccaggctggc

SEQ ID NO: 2217565 - DNA, 14 bp, Homo sapiens
gcccaggctggcgt

SEQ ID NO: 2217566 - DNA, 20 bp, Homo sapiens
gcccaggctggcgtgcagtg

SEQ ID NO: 2217567 - DNA, 19 bp, Homo sapiens
gcccaggcttagtcactga

SEQ ID NO: 2217568 - DNA, 21 bp, Homo sapiens
gcccaggcttagtcactgaga

SEQ ID NO: 2217569 - DNA, 16 bp, Homo sapiens
gcccagtgccccctgg

SEQ ID NO: 2217570 - DNA, 16 bp, Homo sapiens
gccccacgtccctgcg

SEQ ID NO: 2217571 - DNA, 14 bp, Homo sapiens
gccccagtgcccac

SEQ ID NO: 2217572 - DNA, 17 bp, Homo sapiens
gccccagtgcccacagg

SEQ ID NO: 2217573 - DNA, 21 bp, Homo sapiens
gccccagtgcccacaggatca

SEQ ID NO: 2217574 - DNA, 23 bp, Homo sapiens
gccccatcctcctgcccccaccc

SEQ ID NO: 2217575 - DNA, 18 bp, Homo sapiens
gccccattctgcctgccc

SEQ ID NO: 2217576 - DNA, 12 bp, Homo sapiens
gcccccacccca

SEQ ID NO: 2217577 - DNA, 14 bp, Homo sapiens
gcccccaccccagg

SEQ ID NO: 2217578 - DNA, 12 bp, Homo sapiens
gcccccactggt

SEQ ID NO: 2217579 - DNA, 15 bp, Homo sapiens
gccccgaggccttct

SEQ ID NO: 2217580 - DNA, 17 bp, Homo sapiens
gcccctgccaccctggg

SEQ ID NO: 2217581 - DNA, 16 bp, Homo sapiens
gcccctgctggttcag

SEQ ID NO: 2217582 - DNA, 15 bp, Homo sapiens
gcccctggcagcccc

SEQ ID NO: 2217583 - DNA, 17 bp, Homo sapiens
gcccctggcagcccctg

SEQ ID NO: 2217584 - DNA, 19 bp, Homo sapiens
gccccttctgacccatgct

SEQ ID NO: 2217585 - DNA, 18 bp, Homo sapiens
gcccggctccaggctcct

SEQ ID NO: 2217586 - DNA, 23 bp, Homo sapiens
gcccgggctctgcctcccatcac

SEQ ID NO: 2217587 - DNA, 13 bp, Homo sapiens
gccctcccacccc

SEQ ID NO: 2217588 - DNA, 15 bp, Homo sapiens
gccctcccaccccct

SEQ ID NO: 2217589 - DNA, 14 bp, Homo sapiens
gccctgagctttct

SEQ ID NO: 2217590 - DNA, 15 bp, Homo sapiens
gccctgcagagggca

SEQ ID NO: 2217591 - DNA, 18 bp, Homo sapiens
gccctgcagagggcacag

SEQ ID NO: 2217592 - DNA, 15 bp, Homo sapiens
gccctgcccacctgg

SEQ ID NO: 2217593 - DNA, 14 bp, Homo sapiens
gccctgcctccttt

SEQ ID NO: 2217594 - DNA, 17 bp, Homo sapiens
gccctggtggcagtggg

SEQ ID NO: 2217595 - DNA, 20 bp, Homo sapiens
gccctggtggcagtgggagc

SEQ ID NO: 2217596 - DNA, 21 bp, Homo sapiens
gccctggtggcagtgggagct

SEQ ID NO: 2217597 - DNA, 23 bp, Homo sapiens
gccctggtggcagtgggagctgc

SEQ ID NO: 2217598 - DNA, 21 bp, Homo sapiens
gccctgtgggcccccaaatgg

SEQ ID NO: 2217599 - DNA, 22 bp, Homo sapiens
gcccttacctgccaggaagcca

SEQ ID NO: 2217600 - DNA, 23 bp, Homo sapiens
gcccttacctgccaggaagccag

SEQ ID NO: 2217601 - DNA, 19 bp, Homo sapiens
gcccttagcagggaaacag

SEQ ID NO: 2217602 - DNA, 16 bp, Homo sapiens
gcccttctctccagcc

SEQ ID NO: 2217603 - DNA, 21 bp, Homo sapiens
gcccttctctccagcccctgg

SEQ ID NO: 2217604 - DNA, 16 bp, Homo sapiens
gccgagatcacgccac

SEQ ID NO: 2217605 - DNA, 18 bp, Homo sapiens
gccgagatcacgccactg

SEQ ID NO: 2217606 - DNA, 20 bp, Homo sapiens
gccgagatcacgccactgca

SEQ ID NO: 2217607 - DNA, 17 bp, Homo sapiens
gccgagattgcaccact

SEQ ID NO: 2217608 - DNA, 18 bp, Homo sapiens
gccgagattgcaccactg

SEQ ID NO: 2217609 - DNA, 16 bp, Homo sapiens
gccgcagccctgcaga

SEQ ID NO: 2217610 - DNA, 17 bp, Homo sapiens
gccgcagccctgcagag

SEQ ID NO: 2217611 - DNA, 19 bp, Homo sapiens
gccgcagccctgcagaggg

SEQ ID NO: 2217612 - DNA, 16 bp, Homo sapiens
gcctacaggagtgagc

SEQ ID NO: 2217613 - DNA, 20 bp, Homo sapiens
gcctagcatacgtacacatt

SEQ ID NO: 2217614 - DNA, 21 bp, Homo sapiens
gcctagcatacgtacacattt

SEQ ID NO: 2217615 - DNA, 23 bp, Homo sapiens
gcctagcatacgtacacatttta

SEQ ID NO: 2217616 - DNA, 13 bp, Homo sapiens
gcctaggtgacag

SEQ ID NO: 2217617 - DNA, 19 bp, Homo sapiens
gcctcaacctcctgggcta

SEQ ID NO: 2217618 - DNA, 19 bp, Homo sapiens
gcctcaagtgattctcctg

SEQ ID NO: 2217619 - DNA, 20 bp, Homo sapiens
gcctcaagtgattctcctgc

SEQ ID NO: 2217620 - DNA, 21 bp, Homo sapiens
gcctcaagtgattctcctgcc

SEQ ID NO: 2217621 - DNA, 22 bp, Homo sapiens
gcctcaagtgattctcctgcct

SEQ ID NO: 2217622 - DNA, 21 bp, Homo sapiens
gcctcacagtccttaccagca

SEQ ID NO: 2217623 - DNA, 21 bp, Homo sapiens
gcctcagcatcctggcacccg

SEQ ID NO: 2217624 - DNA, 22 bp, Homo sapiens
gcctcagcctcccaaagtgctg

SEQ ID NO: 2217625 - DNA, 23 bp, Homo sapiens
gcctcccaactcaccccagcccc

SEQ ID NO: 2217626 - DNA, 17 bp, Homo sapiens
gcctcccatcacccgct

SEQ ID NO: 2217627 - DNA, 19 bp, Homo sapiens
gcctcccgaatagctggga

SEQ ID NO: 2217628 - DNA, 17 bp, Homo sapiens
gcctcccgagtagctgg

SEQ ID NO: 2217629 - DNA, 19 bp, Homo sapiens
gcctcccgagtagctggga

SEQ ID NO: 2217630 - DNA, 19 bp, Homo sapiens
gcctcctgtgtgtgcgcct

SEQ ID NO: 2217631 - DNA, 14 bp, Homo sapiens
gcctctctcaggcc

SEQ ID NO: 2217632 - DNA, 18 bp, Homo sapiens
gcctctgacacacagctc

SEQ ID NO: 2217633 - DNA, 19 bp, Homo sapiens
gcctctgacacacagctct

SEQ ID NO: 2217634 - DNA, 14 bp, Homo sapiens
gcctctgcactccc

SEQ ID NO: 2217635 - DNA, 15 bp, Homo sapiens
gcctctgcactcccc

SEQ ID NO: 2217636 - DNA, 18 bp, Homo sapiens
gcctctgcactcccctgc

SEQ ID NO: 2217637 - DNA, 20 bp, Homo sapiens
gcctctgcactcccctgctg

SEQ ID NO: 2217638 - DNA, 18 bp, Homo sapiens
gcctcttatgggctgggt

SEQ ID NO: 2217639 - DNA, 13 bp, Homo sapiens
gcctgcaagggag

SEQ ID NO: 2217640 - DNA, 11 bp, Homo sapiens
gcctgcccagg

SEQ ID NO: 2217641 - DNA, 14 bp, Homo sapiens
gcctgcccaggccc

SEQ ID NO: 2217642 - DNA, 12 bp, Homo sapiens
gcctgccctccc

SEQ ID NO: 2217643 - DNA, 15 bp, Homo sapiens
gcctgccctcccacc

SEQ ID NO: 2217644 - DNA, 16 bp, Homo sapiens
gcctgccctcccaccc

SEQ ID NO: 2217645 - DNA, 13 bp, Homo sapiens
gcctgctccagct

SEQ ID NO: 2217646 - DNA, 18 bp, Homo sapiens
gcctgctccagctgttca

SEQ ID NO: 2217647 - DNA, 20 bp, Homo sapiens
gcctggatggggctgcaccg

SEQ ID NO: 2217648 - DNA, 15 bp, Homo sapiens
gcctggcccctcagg

SEQ ID NO: 2217649 - DNA, 22 bp, Homo sapiens
gcctggcccctcagggtccctg

SEQ ID NO: 2217650 - DNA, 13 bp, Homo sapiens
gcctggcctgagc

SEQ ID NO: 2217651 - DNA, 14 bp, Homo sapiens
gcctggcctgagct

SEQ ID NO: 2217652 - DNA, 14 bp, Homo sapiens
gcctgggatccctc

SEQ ID NO: 2217653 - DNA, 18 bp, Homo sapiens
gcctgggatccctcatcc

SEQ ID NO: 2217654 - DNA, 21 bp, Homo sapiens
gcctgggatccctcatcctca

SEQ ID NO: 2217655 - DNA, 15 bp, Homo sapiens
gcctgggcagaagga

SEQ ID NO: 2217656 - DNA, 22 bp, Homo sapiens
gcctgggggctgggcagaggaa

SEQ ID NO: 2217657 - DNA, 13 bp, Homo sapiens
gcctggtggcagc

SEQ ID NO: 2217658 - DNA, 19 bp, Homo sapiens
gcctgtgcctctgggactg

SEQ ID NO: 2217659 - DNA, 19 bp, Homo sapiens
gcctgttcagctccagctc

SEQ ID NO: 2217660 - DNA, 21 bp, Homo sapiens
gccttacacaatggttttctt

SEQ ID NO: 2217661 - DNA, 10 bp, Homo sapiens
gccttatgga

SEQ ID NO: 2217662 - DNA, 22 bp, Homo sapiens
gccttatggaacactctgagac

SEQ ID NO: 2217663 - DNA, 15 bp, Homo sapiens
gccttccaggggtgg

SEQ ID NO: 2217664 - DNA, 17 bp, Homo sapiens
gcgaaccgtgaggaggg

SEQ ID NO: 2217665 - DNA, 17 bp, Homo sapiens
gcgagccctggtggcag

SEQ ID NO: 2217666 - DNA, 13 bp, Homo sapiens
gcgattcttctgc

SEQ ID NO: 2217667 - DNA, 21 bp, Homo sapiens
gcgctgcccctggcagcccct

SEQ ID NO: 2217668 - DNA, 15 bp, Homo sapiens
gcggaagccacaggg

SEQ ID NO: 2217669 - DNA, 19 bp, Homo sapiens
gcggaatgaaccacatctt

SEQ ID NO: 2217670 - DNA, 16 bp, Homo sapiens
gcggacagccacggcc

SEQ ID NO: 2217671 - DNA, 16 bp, Homo sapiens
gcggagaaaggaaggg

SEQ ID NO: 2217672 - DNA, 13 bp, Homo sapiens
ggctgctgaaggc

SEQ ID NO: 2217673 - DNA, 18 bp, Homo sapiens
ggctgctgaaggctcgag

SEQ ID NO: 2217674 - DNA, 19 bp, Homo sapiens
ggctgcttcaaggatcctg

SEQ ID NO: 2217675 - DNA, 14 bp, Homo sapiens
ggctggaagcagaa

SEQ ID NO: 2217676 - DNA, 13 bp, Homo sapiens
ggctggcctggcc

SEQ ID NO: 2217677 - DNA, 15 bp, Homo sapiens
ggctggcctggcccc

SEQ ID NO: 2217678 - DNA, 17 bp, Homo sapiens
ggctggcctggcccctc

SEQ ID NO: 2217679 - DNA, 22 bp, Homo sapiens
ggctggcctggcccctcagggt

SEQ ID NO: 2217680 - DNA, 14 bp, Homo sapiens
ggctggcgtgcagt

SEQ ID NO: 2217681 - DNA, 16 bp, Homo sapiens
ggctggcgtgcagtgg

SEQ ID NO: 2217682 - DNA, 13 bp, Homo sapiens
ggctgggagagcc

SEQ ID NO: 2217683 - DNA, 23 bp, Homo sapiens
ggctgggagagccttccaggggt

SEQ ID NO: 2217684 - DNA, 17 bp, Homo sapiens
ggctgggctcccttccc

SEQ ID NO: 2217685 - DNA, 21 bp, Homo sapiens
ggctgggctcccttcccacct

SEQ ID NO: 2217686 - DNA, 19 bp, Homo sapiens
ggctgggttctacccaggt

SEQ ID NO: 2217687 - DNA, 20 bp, Homo sapiens
ggctgtatcccatgagcctc

SEQ ID NO: 2217688 - DNA, 15 bp, Homo sapiens
ggctgtcaattacag

SEQ ID NO: 2217689 - DNA, 15 bp, Homo sapiens
ggctgttggctgggg

SEQ ID NO: 2217690 - DNA, 16 bp, Homo sapiens
ggctgttggctggggg

SEQ ID NO: 2217691 - DNA, 21 bp, Homo sapiens
ggcttcacggaagagccttgc

SEQ ID NO: 2217692 - DNA, 16 bp, Homo sapiens
ggcttcagtggcagct

SEQ ID NO: 2217693 - DNA, 19 bp, Homo sapiens
ggcttcagtggcagctgct

SEQ ID NO: 2217694 - DNA, 20 bp, Homo sapiens
ggcttcagtggcagctgctt

SEQ ID NO: 2217695 - DNA, 18 bp, Homo sapiens
ggcttggggaccagagct

SEQ ID NO: 2217696 - DNA, 23 bp, Homo sapiens
gggaaaatcagcctgctccagct

SEQ ID NO: 2217697 - DNA, 18 bp, Homo sapiens
gggaagaagctctctcct

SEQ ID NO: 2217698 - DNA, 13 bp, Homo sapiens
gggaaggatacaa

SEQ ID NO: 2217699 - DNA, 16 bp, Homo sapiens
gggaaggatacaaaag

SEQ ID NO: 2217700 - DNA, 17 bp, Homo sapiens
gggaagggggctgggac

SEQ ID NO: 2217701 - DNA, 19 bp, Homo sapiens
gggaatgtttgcctctgcc

SEQ ID NO: 2217702 - DNA, 13 bp, Homo sapiens
gggacagaggggg

SEQ ID NO: 2217703 - DNA, 13 bp, Homo sapiens
gggacagctcctt

SEQ ID NO: 2217704 - DNA, 15 bp, Homo sapiens
gggacagctccttct

SEQ ID NO: 2217705 - DNA, 13 bp, Homo sapiens
gggacctcaggcc

SEQ ID NO: 2217706 - DNA, 19 bp, Homo sapiens
gggactcaatgcactgaca

SEQ ID NO: 2217707 - DNA, 15 bp, Homo sapiens
gggacttggaagctc

SEQ ID NO: 2217708 - DNA, 17 bp, Homo sapiens
gggacttggaagctccg

SEQ ID NO: 2217709 - DNA, 18 bp, Homo sapiens
gggacttggaagctccgc

SEQ ID NO: 2217710 - DNA, 15 bp, Homo sapiens
gggagagccttccag

SEQ ID NO: 2217711 - DNA, 19 bp, Homo sapiens
gggagagccttccaggggt

SEQ ID NO: 2217712 - DNA, 22 bp, Homo sapiens
gggagcaggcagtggggctgga

SEQ ID NO: 2217713 - DNA, 13 bp, Homo sapiens
gggagctgcctgt

SEQ ID NO: 2217714 - DNA, 21 bp, Homo sapiens
gggaggattgcttgagctcag

SEQ ID NO: 2217715 - DNA, 19 bp, Homo sapiens
gggaggccaaggtgggagg

SEQ ID NO: 2217716 - DNA, 14 bp, Homo sapiens
gggagggctccaga

SEQ ID NO: 2217717 - DNA, 17 bp, Homo sapiens
gggagggctccagacac

SEQ ID NO: 2217718 - DNA, 18 bp, Homo sapiens
gggagggctccagacaca

SEQ ID NO: 2217719 - DNA, 14 bp, Homo sapiens
gggaggggaagaaa

SEQ ID NO: 2217720 - DNA, 17 bp, Homo sapiens
gggaggtgggatcctcc

SEQ ID NO: 2217721 - DNA, 20 bp, Homo sapiens
gggaggtgggatcctccagg

SEQ ID NO: 2217722 - DNA, 21 bp, Homo sapiens
gggagtgagttgatagcacag

SEQ ID NO: 2217723 - DNA, 13 bp, Homo sapiens
gggatagagagag

SEQ ID NO: 2217724 - DNA, 21 bp, Homo sapiens
gggatatgatttaaatcagcc

SEQ ID NO: 2217725 - DNA, 19 bp, Homo sapiens
gggatcccccgccccatcc

SEQ ID NO: 2217726 - DNA, 23 bp, Homo sapiens
gggatcctggagttctggttcct

SEQ ID NO: 2217727 - DNA, 15 bp, Homo sapiens
gggattacaggtgtg

SEQ ID NO: 2217728 - DNA, 19 bp, Homo sapiens
gggcactcagaagacactg

SEQ ID NO: 2217729 - DNA, 12 bp, Homo sapiens
gggcagagcaga

SEQ ID NO: 2217730 - DNA, 22 bp, Homo sapiens
gggcagagcagagaccatccct

SEQ ID NO: 2217731 - DNA, 23 bp, Homo sapiens
gggcagagcagagaccatccctg

SEQ ID NO: 2217732 - DNA, 12 bp, Homo sapiens
gggcagcagaga

SEQ ID NO: 2217733 - DNA, 14 bp, Homo sapiens
gggcagcagagaga

SEQ ID NO: 2217734 - DNA, 15 bp, Homo sapiens
gggcagcagagagag

SEQ ID NO: 2217735 - DNA, 12 bp, Homo sapiens
gggcatgacacg

SEQ ID NO: 2217736 - DNA, 16 bp, Homo sapiens
gggccacagagaaagt

SEQ ID NO: 2217737 - DNA, 23 bp, Homo sapiens
gggccagttggtcccccttccat

SEQ ID NO: 2217738 - DNA, 15 bp, Homo sapiens
gggcccaagagagac

SEQ ID NO: 2217739 - DNA, 13 bp, Homo sapiens
gggcctcagtgcc

SEQ ID NO: 2217740 - DNA, 22 bp, Homo sapiens
gggcctcggtgtggagaagcgg

SEQ ID NO: 2217741 - DNA, 19 bp, Homo sapiens
gggcctcttatgggctggg

SEQ ID NO: 2217742 - DNA, 19 bp, Homo sapiens
gggcctggcctgagctggg

SEQ ID NO: 2217743 - DNA, 14 bp, Homo sapiens
gggcctggctcagg

SEQ ID NO: 2217744 - DNA, 18 bp, Homo sapiens
gggcctggtcgttttcaa

SEQ ID NO: 2217745 - DNA, 16 bp, Homo sapiens
gggcgcggtggctcac

SEQ ID NO: 2217746 - DNA, 15 bp, Homo sapiens
gggcgggaggatgtt

SEQ ID NO: 2217747 - DNA, 15 bp, Homo sapiens
gggctagttgggctt

SEQ ID NO: 2217748 - DNA, 18 bp, Homo sapiens
gggctagttgggcttcct

SEQ ID NO: 2217749 - DNA, 10 bp, Homo sapiens
gggctccaga

SEQ ID NO: 2217750 - DNA, 13 bp, Homo sapiens
gggctcccttccc

SEQ ID NO: 2217751 - DNA, 23 bp, Homo sapiens
gggctcccttcccacctctctca

SEQ ID NO: 2217752 - DNA, 17 bp, Homo sapiens
gggctctgcctcccatc

SEQ ID NO: 2217753 - DNA, 19 bp, Homo sapiens
gggctgcaccggctggcct

SEQ ID NO: 2217754 - DNA, 20 bp, Homo sapiens
gggctgcaccggctggcctg

SEQ ID NO: 2217755 - DNA, 18 bp, Homo sapiens
gggctgcatgcgggcttc

SEQ ID NO: 2217756 - DNA, 21 bp, Homo sapiens
gggctgcatgcgggcttcctc

SEQ ID NO: 2217757 - DNA, 16 bp, Homo sapiens
gggctggaagcagaaa

SEQ ID NO: 2217758 - DNA, 19 bp, Homo sapiens
gggctggaagcagaaacaa

SEQ ID NO: 2217759 - DNA, 23 bp, Homo sapiens
gggctggaagcagaaacaaaatg

SEQ ID NO: 2217760 - DNA, 15 bp, Homo sapiens
gggctgggcagagga

SEQ ID NO: 2217761 - DNA, 20 bp, Homo sapiens
gggctgggttctacccaggt

SEQ ID NO: 2217762 - DNA, 17 bp, Homo sapiens
gggcttcagtggcagct

SEQ ID NO: 2217763 - DNA, 20 bp, Homo sapiens
gggcttcagtggcagctgct

SEQ ID NO: 2217764 - DNA, 20 bp, Homo sapiens
gggcttggggaccagagctg

SEQ ID NO: 2217765 - DNA, 16 bp, Homo sapiens
ggggaaaatcagcctg

SEQ ID NO: 2217766 - DNA, 21 bp, Homo sapiens
ggggaaaatcagcctgctcca

SEQ ID NO: 2217767 - DNA, 14 bp, Homo sapiens
ggggatcccccgcc

SEQ ID NO: 2217768 - DNA, 17 bp, Homo sapiens
ggggccagttggtcccc

SEQ ID NO: 2217769 - DNA, 19 bp, Homo sapiens
ggggccagttggtccccct

SEQ ID NO: 2217770 - DNA, 16 bp, Homo sapiens
ggggccctgcctcctt

SEQ ID NO: 2217771 - DNA, 14 bp, Homo sapiens
ggggcctggggtag

SEQ ID NO: 2217772 - DNA, 15 bp, Homo sapiens
ggggctccagggggt

SEQ ID NO: 2217773 - DNA, 19 bp, Homo sapiens
ggggctgaggtgggaggat

SEQ ID NO: 2217774 - DNA, 13 bp, Homo sapiens
ggggctgggacat

SEQ ID NO: 2217775 - DNA, 14 bp, Homo sapiens
gggggagcaggcag

SEQ ID NO: 2217776 - DNA, 15 bp, Homo sapiens
gggggcctcagtgcc

SEQ ID NO: 2217777 - DNA, 18 bp, Homo sapiens
gggggcctcagtgccact

SEQ ID NO: 2217778 - DNA, 17 bp, Homo sapiens
gggggctccagggggtg

SEQ ID NO: 2217779 - DNA, 12 bp, Homo sapiens
gggggtgggagg

SEQ ID NO: 2217780 - DNA, 12 bp, Homo sapiens
ggggtggcctcc

SEQ ID NO: 2217781 - DNA, 15 bp, Homo sapiens
gggtacccactgctc

SEQ ID NO: 2217782 - DNA, 18 bp, Homo sapiens
gggtacccactgctctgg

SEQ ID NO: 2217783 - DNA, 20 bp, Homo sapiens
gggtatcaggtgctgccatc

SEQ ID NO: 2217784 - DNA, 14 bp, Homo sapiens
gggtcactctggca

SEQ ID NO: 2217785 - DNA, 20 bp, Homo sapiens
gggtcactctggcagctcag

SEQ ID NO: 2217786 - DNA, 23 bp, Homo sapiens
gggtctcactatgttgcccaggc

SEQ ID NO: 2217787 - DNA, 12 bp, Homo sapiens
gggtctcactct

SEQ ID NO: 2217788 - DNA, 12 bp, Homo sapiens
gggtctgaggaa

SEQ ID NO: 2217789 - DNA, 14 bp, Homo sapiens
gggtctgcagggaa

SEQ ID NO: 2217790 - DNA, 20 bp, Homo sapiens
gggtgccctcccagaccccc

SEQ ID NO: 2217791 - DNA, 15 bp, Homo sapiens
gggtgggacaccctg

SEQ ID NO: 2217792 - DNA, 14 bp, Homo sapiens
gggtgggaggggaa

SEQ ID NO: 2217793 - DNA, 20 bp, Homo sapiens
gggtggggacctcaggcctg

SEQ ID NO: 2217794 - DNA, 12 bp, Homo sapiens
gggtggtgacct

SEQ ID NO: 2217795 - DNA, 22 bp, Homo sapiens
gggttcaagcgattcttctgct

SEQ ID NO: 2217796 - DNA, 13 bp, Homo sapiens
ggtaacaggcaga

SEQ ID NO: 2217797 - DNA, 14 bp, Homo sapiens
tagagccagggtct

SEQ ID NO: 2217798 - DNA, 19 bp, Homo sapiens
tagaggttcaaagatattt

SEQ ID NO: 2217799 - DNA, 18 bp, Homo sapiens
tagataatacaccactac

SEQ ID NO: 2217800 - DNA, 22 bp, Homo sapiens
tagattttagaccctattgctg

SEQ ID NO: 2217801 - DNA, 14 bp, Homo sapiens
tagcacagaccctg

SEQ ID NO: 2217802 - DNA, 16 bp, Homo sapiens
tagcacagaccctgcc

SEQ ID NO: 2217803 - DNA, 21 bp, Homo sapiens
tagcacagaccctgccctgtg

SEQ ID NO: 2217804 - DNA, 24 bp, Homo sapiens
tagcacagaccctgccctgtgggc

SEQ ID NO: 2217805 - DNA, 16 bp, Homo sapiens
tagcactttgggaggc

SEQ ID NO: 2217806 - DNA, 19 bp, Homo sapiens
tagcatacgtacacatttt

SEQ ID NO: 2217807 - DNA, 12 bp, Homo sapiens
tagccaaggcca

SEQ ID NO: 2217808 - DNA, 13 bp, Homo sapiens
tagccaaggccaa

SEQ ID NO: 2217809 - DNA, 21 bp, Homo sapiens
tagccaaggccaaaggaagca

SEQ ID NO: 2217810 - DNA, 15 bp, Homo sapiens
tagccagaggagaga

SEQ ID NO: 2217811 - DNA, 18 bp, Homo sapiens
tagcctgtgcctctggga

SEQ ID NO: 2217812 - DNA, 20 bp, Homo sapiens
tagccttagaagtcacacag

SEQ ID NO: 2217813 - DNA, 21 bp, Homo sapiens
tagccttagaagtcacacagt

SEQ ID NO: 2217814 - DNA, 12 bp, Homo sapiens
tagctcattctc

SEQ ID NO: 2217815 - DNA, 21 bp, Homo sapiens
tagctctaggagggctggcaa

SEQ ID NO: 2217816 - DNA, 15 bp, Homo sapiens
tagctgggactacag

SEQ ID NO: 2217817 - DNA, 18 bp, Homo sapiens
tagctgggactacaggtg

SEQ ID NO: 2217818 - DNA, 14 bp, Homo sapiens
taggaaaaactgat

SEQ ID NO: 2217819 - DNA, 16 bp, Homo sapiens
taggaaaaactgattt

SEQ ID NO: 2217820 - DNA, 14 bp, Homo sapiens
taggaagactttgg

SEQ ID NO: 2217821 - DNA, 15 bp, Homo sapiens
tagggttataataat

SEQ ID NO: 2217822 - DNA, 16 bp, Homo sapiens
taggtgacagagtgag

SEQ ID NO: 2217823 - DNA, 13 bp, Homo sapiens
tagtagagacagg

SEQ ID NO: 2217824 - DNA, 14 bp, Homo sapiens
tagtagagacaggg

SEQ ID NO: 2217825 - DNA, 15 bp, Homo sapiens
tagtagagacagggt

SEQ ID NO: 2217826 - DNA, 18 bp, Homo sapiens
tagtatgaggcatttgtt

SEQ ID NO: 2217827 - DNA, 14 bp, Homo sapiens
tagtcactgagaca

SEQ ID NO: 2217828 - DNA, 17 bp, Homo sapiens
tagtcactgagacagcc

SEQ ID NO: 2217829 - DNA, 20 bp, Homo sapiens
tagtcactgagacagcccgg

SEQ ID NO: 2217830 - DNA, 11 bp, Homo sapiens
tataaacttta

SEQ ID NO: 2217831 - DNA, 17 bp, Homo sapiens
tataaactttacctttt

SEQ ID NO: 2217832 - DNA, 18 bp, Homo sapiens
tataaactttaccttttt

SEQ ID NO: 2217833 - DNA, 20 bp, Homo sapiens
tataatgtaagctctactga

SEQ ID NO: 2217834 - DNA, 21 bp, Homo sapiens
tataatttacctgaagtcttt

SEQ ID NO: 2217835 - DNA, 21 bp, Homo sapiens
tatatgctctgcatgttacat

SEQ ID NO: 2217836 - DNA, 19 bp, Homo sapiens
tatatgttttaagaggcag

SEQ ID NO: 2217837 - DNA, 21 bp, Homo sapiens
tatcaagtattataccttttt

SEQ ID NO: 2217838 - DNA, 17 bp, Homo sapiens
tatcaggtgctgccatc

SEQ ID NO: 2217839 - DNA, 16 bp, Homo sapiens
tatcatgacaaagact

SEQ ID NO: 2217840 - DNA, 19 bp, Homo sapiens
tatccaacatcaacatctt

SEQ ID NO: 2217841 - DNA, 19 bp, Homo sapiens
tatcgtcactgcttaactt

SEQ ID NO: 2217842 - DNA, 15 bp, Homo sapiens
tatctaaatgttgaa

SEQ ID NO: 2217843 - DNA, 15 bp, Homo sapiens
tatctagatactgta

SEQ ID NO: 2217844 - DNA, 16 bp, Homo sapiens
tatctagatactgtat

SEQ ID NO: 2217845 - DNA, 15 bp, Homo sapiens
tatctcagggcctgg

SEQ ID NO: 2217846 - DNA, 14 bp, Homo sapiens
tatctcccccagcc

SEQ ID NO: 2217847 - DNA, 18 bp, Homo sapiens
tatctcccccagccccat

SEQ ID NO: 2217848 - DNA, 15 bp, Homo sapiens
tatctgaaaatgtat

SEQ ID NO: 2217849 - DNA, 23 bp, Homo sapiens
tatctgtcatttgagcagggctc

SEQ ID NO: 2217850 - DNA, 12 bp, Homo sapiens
tatgacacatgc

SEQ ID NO: 2217851 - DNA, 17 bp, Homo sapiens
tatgactccagaatttc

SEQ ID NO: 2217852 - DNA, 13 bp, Homo sapiens
tatgaggcatttg

SEQ ID NO: 2217853 - DNA, 15 bp, Homo sapiens
tatgaggcatttgtt

SEQ ID NO: 2217854 - DNA, 14 bp, Homo sapiens
tatgatcacggctc

SEQ ID NO: 2217855 - DNA, 17 bp, Homo sapiens
tatgcctgggcagaagg

SEQ ID NO: 2217856 - DNA, 18 bp, Homo sapiens
tatgctctgcatgttaca

SEQ ID NO: 2217857 - DNA, 17 bp, Homo sapiens
tatggaacactctgaga

SEQ ID NO: 2217858 - DNA, 18 bp, Homo sapiens
tatggaacactctgagac

SEQ ID NO: 2217859 - DNA, 17 bp, Homo sapiens
tatggcttttgtgcatt

SEQ ID NO: 2217860 - DNA, 23 bp, Homo sapiens
tatggcttttgtgcattatctag

SEQ ID NO: 2217861 - DNA, 20 bp, Homo sapiens
tatgtggagttcatcttgaa

SEQ ID NO: 2217862 - DNA, 19 bp, Homo sapiens
tatgttgcccaggcaggtc

SEQ ID NO: 2217863 - DNA, 21 bp, Homo sapiens
tatgttgcccaggcaggtctt

SEQ ID NO: 2217864 - DNA, 15 bp, Homo sapiens
tattaaatgcccagc

SEQ ID NO: 2217865 - DNA, 19 bp, Homo sapiens
tattaaatgcccagcccct

SEQ ID NO: 2217866 - DNA, 12 bp, Homo sapiens
tattaaattatg

SEQ ID NO: 2217867 - DNA, 14 bp, Homo sapiens
tattaaggaagaca

SEQ ID NO: 2217868 - DNA, 14 bp, Homo sapiens
tattacttctgcta

SEQ ID NO: 2217869 - DNA, 14 bp, Homo sapiens
tattataccttttt

SEQ ID NO: 2217870 - DNA, 16 bp, Homo sapiens
tattcaggaagctcag

SEQ ID NO: 2217871 - DNA, 18 bp, Homo sapiens
tattcaggaagctcaggg

SEQ ID NO: 2217872 - DNA, 18 bp, Homo sapiens
tattctctcctgtacctc

SEQ ID NO: 2217873 - DNA, 15 bp, Homo sapiens
tattgcccacgctgg

SEQ ID NO: 2217874 - DNA, 22 bp, Homo sapiens
tattggaaatttgttataatga

SEQ ID NO: 2217875 - DNA, 17 bp, Homo sapiens
tattgtcaaagtggtga

SEQ ID NO: 2217876 - DNA, 22 bp, Homo sapiens
tattgttttcagtgtacatgga

SEQ ID NO: 2217877 - DNA, 13 bp, Homo sapiens
tattttgctttgt

SEQ ID NO: 2217878 - DNA, 12 bp, Homo sapiens
tcaaagaggttt

SEQ ID NO: 2217879 - DNA, 23 bp, Homo sapiens
tcaaagaggttttaaaaaaatcc

SEQ ID NO: 2217880 - DNA, 22 bp, Homo sapiens
tcaaagatattttgctttgtga

SEQ ID NO: 2217881 - DNA, 18 bp, Homo sapiens
tcaaccccttcgctcctg

SEQ ID NO: 2217882 - DNA, 15 bp, Homo sapiens
tcaacctcctgggct

SEQ ID NO: 2217883 - DNA, 20 bp, Homo sapiens
tcaactctcctccagagtca

SEQ ID NO: 2217884 - DNA, 17 bp, Homo sapiens
tcaagagggtctgagga

SEQ ID NO: 2217885 - DNA, 19 bp, Homo sapiens
tcaagcgattcttctgctt

SEQ ID NO: 2217886 - DNA, 21 bp, Homo sapiens
tcaagcgattcttctgcttca

SEQ ID NO: 2217887 - DNA, 13 bp, Homo sapiens
tcaaggatcctga

SEQ ID NO: 2217888 - DNA, 16 bp, Homo sapiens
tcaaggatcctgagcc

SEQ ID NO: 2217889 - DNA, 21 bp, Homo sapiens
tcaagtattatacctttttta

SEQ ID NO: 2217890 - DNA, 22 bp, Homo sapiens
tcaagtcctcttttctgagagg

SEQ ID NO: 2217891 - DNA, 18 bp, Homo sapiens
tcaagtgattctcctgcc

SEQ ID NO: 2217892 - DNA, 20 bp, Homo sapiens
tcaagtgattctcctgcctc

SEQ ID NO: 2217893 - DNA, 18 bp, Homo sapiens
tcaataggaaaaactgat

SEQ ID NO: 2217894 - DNA, 19 bp, Homo sapiens
tcaataggaaaaactgatt

SEQ ID NO: 2217895 - DNA, 20 bp, Homo sapiens
tcaattacaggaagtactgg

SEQ ID NO: 2217896 - DNA, 21 bp, Homo sapiens
tcaattacaggaagtactgga

SEQ ID NO: 2217897 - DNA, 23 bp, Homo sapiens
tcacacagtgagtcgaggacagg

SEQ ID NO: 2217898 - DNA, 20 bp, Homo sapiens
tcacagatgggtgcttggag

SEQ ID NO: 2217899 - DNA, 16 bp, Homo sapiens
tcacaggcaggtccag

SEQ ID NO: 2217900 - DNA, 17 bp, Homo sapiens
tcacaggcaggtccagg

SEQ ID NO: 2217901 - DNA, 19 bp, Homo sapiens
tcacaggcaggtccagggt

SEQ ID NO: 2217902 - DNA, 15 bp, Homo sapiens
tcacatatctgtcat

SEQ ID NO: 2217903 - DNA, 20 bp, Homo sapiens
tcacatattgatttccgtta

SEQ ID NO: 2217904 - DNA, 19 bp, Homo sapiens
tcaccaaatcagctgctac

SEQ ID NO: 2217905 - DNA, 21 bp, Homo sapiens
tcaccaaatcagctgctacta

SEQ ID NO: 2217906 - DNA, 16 bp, Homo sapiens
tcaccagccccagtgc

SEQ ID NO: 2217907 - DNA, 17 bp, Homo sapiens
tcaccagccccagtgcc

SEQ ID NO: 2217908 - DNA, 22 bp, Homo sapiens
tcaccagccccagtgcccacag

SEQ ID NO: 2217909 - DNA, 14 bp, Homo sapiens
tcaccccagcccca

SEQ ID NO: 2217910 - DNA, 17 bp, Homo sapiens
tcaccccggccacctgc

SEQ ID NO: 2217911 - DNA, 18 bp, Homo sapiens
tcaccccggccacctgcg

SEQ ID NO: 2217912 - DNA, 18 bp, Homo sapiens
tcacccgctaagagggag

SEQ ID NO: 2217913 - DNA, 14 bp, Homo sapiens
tcaccgaaaacgtg

SEQ ID NO: 2217914 - DNA, 20 bp, Homo sapiens
tcaccgaaaacgtggctgct

SEQ ID NO: 2217915 - DNA, 17 bp, Homo sapiens
tcacctttgtccccacc

SEQ ID NO: 2217916 - DNA, 13 bp, Homo sapiens
tcacgccactgca

SEQ ID NO: 2217917 - DNA, 13 bp, Homo sapiens
tcacggctcactg

SEQ ID NO: 2217918 - DNA, 20 bp, Homo sapiens
tcactatgttgcccaggcag

SEQ ID NO: 2217919 - DNA, 23 bp, Homo sapiens
tcactctccttggtgtcgggcat

SEQ ID NO: 2217920 - DNA, 17 bp, Homo sapiens
tcactctggcagctcag

SEQ ID NO: 2217921 - DNA, 15 bp, Homo sapiens
tgagcaatcctgcaa

SEQ ID NO: 2217922 - DNA, 19 bp, Homo sapiens
tgagcactctggggtggga

SEQ ID NO: 2217923 - DNA, 12 bp, Homo sapiens
tgagcagggctc

SEQ ID NO: 2217924 - DNA, 13 bp, Homo sapiens
tgagcagggctca

SEQ ID NO: 2217925 - DNA, 17 bp, Homo sapiens
tgagcagggctcagcgg

SEQ ID NO: 2217926 - DNA, 19 bp, Homo sapiens
tgagcagggctcagcgggg

SEQ ID NO: 2217927 - DNA, 16 bp, Homo sapiens
tgagcatcaggccagg

SEQ ID NO: 2217928 - DNA, 20 bp, Homo sapiens
tgagcatcaggccaggccct

SEQ ID NO: 2217929 - DNA, 22 bp, Homo sapiens
tgagcatcaggccaggccctct

SEQ ID NO: 2217930 - DNA, 12 bp, Homo sapiens
tgagccactgca

SEQ ID NO: 2217931 - DNA, 23 bp, Homo sapiens
tgagccactgcaccgggccacag

SEQ ID NO: 2217932 - DNA, 21 bp, Homo sapiens
tgagccgagatcacgccactg

SEQ ID NO: 2217933 - DNA, 22 bp, Homo sapiens
tgagccgagatcacgccactgc

SEQ ID NO: 2217934 - DNA, 23 bp, Homo sapiens
tgagccgagatcacgccactgca

SEQ ID NO: 2217935 - DNA, 13 bp, Homo sapiens
tgagcctcagcat

SEQ ID NO: 2217936 - DNA, 21 bp, Homo sapiens
tgagcctcagcatcctggcac

SEQ ID NO: 2217937 - DNA, 10 bp, Homo sapiens
tgagcctggc

SEQ ID NO: 2217938 - DNA, 11 bp, Homo sapiens
tgagcctggca

SEQ ID NO: 2217939 - DNA, 22 bp, Homo sapiens
tgagcctgggaggtcaaggctg

SEQ ID NO: 2217940 - DNA, 14 bp, Homo sapiens
tgagccttgaactt

SEQ ID NO: 2217941 - DNA, 18 bp, Homo sapiens
tgagccttgaactttgac

SEQ ID NO: 2217942 - DNA, 11 bp, Homo sapiens
tgagctcagga

SEQ ID NO: 2217943 - DNA, 22 bp, Homo sapiens
tgaggaagcaaaagcatctatg

SEQ ID NO: 2217944 - DNA, 21 bp, Homo sapiens
tgaggaatccagacccggctg

SEQ ID NO: 2217945 - DNA, 21 bp, Homo sapiens
tgaggacactaaccacgctgg

SEQ ID NO: 2217946 - DNA, 22 bp, Homo sapiens
tgaggatgaaaaaataacactg

SEQ ID NO: 2217947 - DNA, 19 bp, Homo sapiens
tgaggcatttgtttgaact

SEQ ID NO: 2217948 - DNA, 21 bp, Homo sapiens
tgaggcatttgtttgaactga

SEQ ID NO: 2217949 - DNA, 23 bp, Homo sapiens
tgaggcatttgtttgaactgata

SEQ ID NO: 2217950 - DNA, 16 bp, Homo sapiens
tgaggccagagacaca

SEQ ID NO: 2217951 - DNA, 20 bp, Homo sapiens
tgaggccagagacacaagcc

SEQ ID NO: 2217952 - DNA, 12 bp, Homo sapiens
tgaggcccagag

SEQ ID NO: 2217953 - DNA, 13 bp, Homo sapiens
tgaggcccagagg

SEQ ID NO: 2217954 - DNA, 16 bp, Homo sapiens
tgaggcccttctctcc

SEQ ID NO: 2217955 - DNA, 18 bp, Homo sapiens
tgaggcccttctctccag

SEQ ID NO: 2217956 - DNA, 20 bp, Homo sapiens
tgaggcccttctctccagcc

SEQ ID NO: 2217957 - DNA, 22 bp, Homo sapiens
tgaggcccttctctccagcccc

SEQ ID NO: 2217958 - DNA, 23 bp, Homo sapiens
tgaggcccttctctccagcccct

SEQ ID NO: 2217959 - DNA, 16 bp, Homo sapiens
tgaggctctgcccttg

SEQ ID NO: 2217960 - DNA, 17 bp, Homo sapiens
tgagggaacagagaggt

SEQ ID NO: 2217961 - DNA, 19 bp, Homo sapiens
tgagggatacccatcccat

SEQ ID NO: 2217962 - DNA, 12 bp, Homo sapiens
tgaggggcctct

SEQ ID NO: 2217963 - DNA, 14 bp, Homo sapiens
tgaggtcagagcct

SEQ ID NO: 2217964 - DNA, 16 bp, Homo sapiens
tgaggtcagagcctgc

SEQ ID NO: 2217965 - DNA, 19 bp, Homo sapiens
tgaggtcagagcctgcagt

SEQ ID NO: 2217966 - DNA, 20 bp, Homo sapiens
tgaggtctgttctttccaaa

SEQ ID NO: 2217967 - DNA, 16 bp, Homo sapiens
tgaggtgctatgttct

SEQ ID NO: 2217968 - DNA, 12 bp, Homo sapiens
tgaggtgggagg

SEQ ID NO: 2217969 - DNA, 19 bp, Homo sapiens
tgaggtttcaaacctccct

SEQ ID NO: 2217970 - DNA, 16 bp, Homo sapiens
tgagtacgttgtgcat

SEQ ID NO: 2217971 - DNA, 17 bp, Homo sapiens
tgagtacgttgtgcatt

SEQ ID NO: 2217972 - DNA, 19 bp, Homo sapiens
tgagtacgttgtgcatttg

SEQ ID NO: 2217973 - DNA, 21 bp, Homo sapiens
tgagtactacagtcctcccat

SEQ ID NO: 2217974 - DNA, 13 bp, Homo sapiens
tgagtccagaagt

SEQ ID NO: 2217975 - DNA, 20 bp, Homo sapiens
tgagtcccctgtttgtttct

SEQ ID NO: 2217976 - DNA, 21 bp, Homo sapiens
tgagtcccctgtttgtttctg

SEQ ID NO: 2217977 - DNA, 11 bp, Homo sapiens
tgagtcctggc

SEQ ID NO: 2217978 - DNA, 14 bp, Homo sapiens
tgagtcgaggacag

SEQ ID NO: 2217979 - DNA, 19 bp, Homo sapiens
tgagtcgaggacagggagg

SEQ ID NO: 2217980 - DNA, 13 bp, Homo sapiens
tgagtctgaaggc

SEQ ID NO: 2217981 - DNA, 15 bp, Homo sapiens
tgagtctgaaggctg

SEQ ID NO: 2217982 - DNA, 17 bp, Homo sapiens
tgagtgccttacacaat

SEQ ID NO: 2217983 - DNA, 21 bp, Homo sapiens
tgagtgggggatcacagcctc

SEQ ID NO: 2217984 - DNA, 18 bp, Homo sapiens
tgagttcataccctgtta

SEQ ID NO: 2217985 - DNA, 20 bp, Homo sapiens
tgagttgatagcacagaccc

SEQ ID NO: 2217986 - DNA, 16 bp, Homo sapiens
tgagttgattcagctc

SEQ ID NO: 2217987 - DNA, 14 bp, Homo sapiens
tgatacaatgctgt

SEQ ID NO: 2217988 - DNA, 18 bp, Homo sapiens
tgatacaatgctgtgccc

SEQ ID NO: 2217989 - DNA, 14 bp, Homo sapiens
tgatactacagttt

SEQ ID NO: 2217990 - DNA, 13 bp, Homo sapiens
tgatagcacagac

SEQ ID NO: 2217991 - DNA, 15 bp, Homo sapiens
tgatagcacagaccc

SEQ ID NO: 2217992 - DNA, 21 bp, Homo sapiens
tgatagcacagaccctgccct

SEQ ID NO: 2217993 - DNA, 22 bp, Homo sapiens
tgatagcacagaccctgccctg

SEQ ID NO: 2217994 - DNA, 18 bp, Homo sapiens
tgatcacggctcactgca

SEQ ID NO: 2217995 - DNA, 22 bp, Homo sapiens
tgatcacggctcactgcagcct

SEQ ID NO: 2217996 - DNA, 13 bp, Homo sapiens
tgatccaagctgg

SEQ ID NO: 2217997 - DNA, 14 bp, Homo sapiens
tgatccaagctggt

SEQ ID NO: 2217998 - DNA, 21 bp, Homo sapiens
tgatccaagctggtcccactc

SEQ ID NO: 2217999 - DNA, 15 bp, Homo sapiens
tgatccacccacctc

SEQ ID NO: 2218000 - DNA, 16 bp, Homo sapiens
tgatcctcccacctca

SEQ ID NO: 2218001 - DNA, 20 bp, Homo sapiens
tgatcctcccacctcagcct

SEQ ID NO: 2218002 - DNA, 18 bp, Homo sapiens
tgatctttgcagacaggc

SEQ ID NO: 2218003 - DNA, 22 bp, Homo sapiens
tgatgaaatgaggtcagagcct

SEQ ID NO: 2218004 - DNA, 16 bp, Homo sapiens
tgatgagaggaaatca

SEQ ID NO: 2218005 - DNA, 19 bp, Homo sapiens
tgatgatctttgcagacag

SEQ ID NO: 2218006 - DNA, 21 bp, Homo sapiens
tgatgatctttgcagacaggc

SEQ ID NO: 2218007 - DNA, 22 bp, Homo sapiens
tgatgatctttgcagacaggca

SEQ ID NO: 2218008 - DNA, 20 bp, Homo sapiens
tgatgatgaaatgaggtcag

SEQ ID NO: 2218009 - DNA, 22 bp, Homo sapiens
tgatgggcaacccccagcctgc

SEQ ID NO: 2218010 - DNA, 15 bp, Homo sapiens
tgatggtgcaatgac

SEQ ID NO: 2218011 - DNA, 23 bp, Homo sapiens
tgatgttttccatgagtcccctg

SEQ ID NO: 2218012 - DNA, 15 bp, Homo sapiens
tgattaattaaaaca

SEQ ID NO: 2218013 - DNA, 15 bp, Homo sapiens
tgattcagacagctg

SEQ ID NO: 2218014 - DNA, 21 bp, Homo sapiens
tgattcagacagctgcctggg

SEQ ID NO: 2218015 - DNA, 13 bp, Homo sapiens
tgattcagctctg

SEQ ID NO: 2218016 - DNA, 23 bp, Homo sapiens
tgattcccaagctctgctcctct

SEQ ID NO: 2218017 - DNA, 15 bp, Homo sapiens
tgattctcctgcctc

SEQ ID NO: 2218018 - DNA, 20 bp, Homo sapiens
tgattctcctgcctcagcct

SEQ ID NO: 2218019 - DNA, 13 bp, Homo sapiens
tgattggaggggg

SEQ ID NO: 2218020 - DNA, 17 bp, Homo sapiens
tgatttttttttccttc

SEQ ID NO: 2218021 - DNA, 18 bp, Homo sapiens
tgcaaaccatcattgaaa

SEQ ID NO: 2218022 - DNA, 20 bp, Homo sapiens
tgcaacctccgcctcttggg

SEQ ID NO: 2218023 - DNA, 15 bp, Homo sapiens
tgcaaggtcattttt

SEQ ID NO: 2218024 - DNA, 13 bp, Homo sapiens
tgcaatggcagcc

SEQ ID NO: 2218025 - DNA, 15 bp, Homo sapiens
tgcacaaacagaggc

SEQ ID NO: 2218026 - DNA, 20 bp, Homo sapiens
tgcacaaacagaggccgcca

SEQ ID NO: 2218027 - DNA, 18 bp, Homo sapiens
tgcacaagctccaagctc

SEQ ID NO: 2218028 - DNA, 15 bp, Homo sapiens
tgcacaagctgcacc

SEQ ID NO: 2218029 - DNA, 21 bp, Homo sapiens
tgcacaagctgcaccctcagg

SEQ ID NO: 2218030 - DNA, 18 bp, Homo sapiens
tgcacacaccagagccca

SEQ ID NO: 2218031 - DNA, 22 bp, Homo sapiens
tgcacacaccagagcccacctt

SEQ ID NO: 2218032 - DNA, 15 bp, Homo sapiens
tgcacacatttttta

SEQ ID NO: 2218033 - DNA, 20 bp, Homo sapiens
tgcacacattttttaaatgc

SEQ ID NO: 2218034 - DNA, 23 bp, Homo sapiens
tgcacagagttgttacattttta

SEQ ID NO: 2218035 - DNA, 17 bp, Homo sapiens
tgcacagctaacatgga

SEQ ID NO: 2218036 - DNA, 14 bp, Homo sapiens
tgcaccactgcact

SEQ ID NO: 2218037 - DNA, 21 bp, Homo sapiens
tgcaccactgcactccagcct

SEQ ID NO: 2218038 - DNA, 18 bp, Homo sapiens
tgcaccggctggcctggc

SEQ ID NO: 2218039 - DNA, 19 bp, Homo sapiens
tgcaccggctggcctggcc

SEQ ID NO: 2218040 - DNA, 21 bp, Homo sapiens
tgcaccggctggcctggcccc

SEQ ID NO: 2218041 - DNA, 15 bp, Homo sapiens
tgcaccgggccacag

SEQ ID NO: 2218042 - DNA, 20 bp, Homo sapiens
tgcacctggaatatataacc

SEQ ID NO: 2218043 - DNA, 19 bp, Homo sapiens
tgcacgtacacacacatac

SEQ ID NO: 2218044 - DNA, 23 bp, Homo sapiens
tgtgtgtttattgtcaaagtggt

SEQ ID NO: 2218045 - DNA, 23 bp, Homo sapiens
tgtgttatcacccagaagaaaat

SEQ ID NO: 2218046 - DNA, 14 bp, Homo sapiens
tgtgttatgaagca

SEQ ID NO: 2218047 - DNA, 19 bp, Homo sapiens
tgttaatgatagctactgt

SEQ ID NO: 2218048 - DNA, 15 bp, Homo sapiens
tgttcagctccagct

SEQ ID NO: 2218049 - DNA, 18 bp, Homo sapiens
tgttcagctccagctcac

SEQ ID NO: 2218050 - DNA, 22 bp, Homo sapiens
tgttcagctccagctcaccagc

SEQ ID NO: 2218051 - DNA, 11 bp, Homo sapiens
tgttcagctgg

SEQ ID NO: 2218052 - DNA, 20 bp, Homo sapiens
tgttccacaagttaaataaa

SEQ ID NO: 2218053 - DNA, 15 bp, Homo sapiens
tgttctctcttctcc

SEQ ID NO: 2218054 - DNA, 13 bp, Homo sapiens
tgttctctgagga

SEQ ID NO: 2218055 - DNA, 15 bp, Homo sapiens
tgttctctgccctcc

SEQ ID NO: 2218056 - DNA, 18 bp, Homo sapiens
tgttctgaccctgcttca

SEQ ID NO: 2218057 - DNA, 13 bp, Homo sapiens
tgttctgggacac

SEQ ID NO: 2218058 - DNA, 16 bp, Homo sapiens
tgttcttaattcttag

SEQ ID NO: 2218059 - DNA, 17 bp, Homo sapiens
tgttcttggtttgtaaa

SEQ ID NO: 2218060 - DNA, 19 bp, Homo sapiens
tgttcttggtttgtaaatt

SEQ ID NO: 2218061 - DNA, 20 bp, Homo sapiens
tgttcttggtttgtaaatta

SEQ ID NO: 2218062 - DNA, 22 bp, Homo sapiens
tgttcttggtttgtaaattaac

SEQ ID NO: 2218063 - DNA, 19 bp, Homo sapiens
tgttctttcacccttttct

SEQ ID NO: 2218064 - DNA, 13 bp, Homo sapiens
tgttctttccaaa

SEQ ID NO: 2218065 - DNA, 22 bp, Homo sapiens
tgttctttctggctatgcattt

SEQ ID NO: 2218066 - DNA, 20 bp, Homo sapiens
tgttgcccaggctggcgtgc

SEQ ID NO: 2218067 - DNA, 17 bp, Homo sapiens
tgttggctgggggcctc

SEQ ID NO: 2218068 - DNA, 19 bp, Homo sapiens
tgttggctgggggcctcag

SEQ ID NO: 2218069 - DNA, 16 bp, Homo sapiens
tgttgggccaggagcc

SEQ ID NO: 2218070 - DNA, 19 bp, Homo sapiens
tgtttattgtcaaagtggt

SEQ ID NO: 2218071 - DNA, 15 bp, Homo sapiens
tgtttcaaactttac

SEQ ID NO: 2218072 - DNA, 22 bp, Homo sapiens
tgtttcctggcactgcttccag

SEQ ID NO: 2218073 - DNA, 16 bp, Homo sapiens
tgtttgcctctgcctc

SEQ ID NO: 2218074 - DNA, 13 bp, Homo sapiens
tgtttgtgattga

SEQ ID NO: 2218075 - DNA, 18 bp, Homo sapiens
tgttttaaggatgcttgt

SEQ ID NO: 2218076 - DNA, 19 bp, Homo sapiens
tgttttaaggatgcttgta

SEQ ID NO: 2218077 - DNA, 20 bp, Homo sapiens
tgttttccatgagtcccctg

SEQ ID NO: 2218078 - DNA, 13 bp, Homo sapiens
tgtttttgtctta

SEQ ID NO: 2218079 - DNA, 13 bp, Homo sapiens
ttaaaaaaaatcc

SEQ ID NO: 2218080 - DNA, 14 bp, Homo sapiens
ttaaaaatctcaaa

SEQ ID NO: 2218081 - DNA, 15 bp, Homo sapiens
ttaaaaatctcaaat

SEQ ID NO: 2218082 - DNA, 17 bp, Homo sapiens
ttaaaccgccaaggctg

SEQ ID NO: 2218083 - DNA, 22 bp, Homo sapiens
ttaaacttaatctaaatggaac

SEQ ID NO: 2218084 - DNA, 13 bp, Homo sapiens
ttaaataatgtga

SEQ ID NO: 2218085 - DNA, 15 bp, Homo sapiens
ttaaataatgtgaaa

SEQ ID NO: 2218086 - DNA, 18 bp, Homo sapiens
ttaaatgcacctggaata

SEQ ID NO: 2218087 - DNA, 15 bp, Homo sapiens
ttaaatgcccagccc

SEQ ID NO: 2218088 - DNA, 13 bp, Homo sapiens
ttaaattcttgca

SEQ ID NO: 2218089 - DNA, 16 bp, Homo sapiens
ttaaattcttgcaaag

SEQ ID NO: 2218090 - DNA, 14 bp, Homo sapiens
ttaacagaaatgta

SEQ ID NO: 2218091 - DNA, 14 bp, Homo sapiens
ttaacttttataaa

SEQ ID NO: 2218092 - DNA, 15 bp, Homo sapiens
ttaacttttataaac

SEQ ID NO: 2218093 - DNA, 16 bp, Homo sapiens
ttaacttttataaact

SEQ ID NO: 2218094 - DNA, 18 bp, Homo sapiens
ttaacttttataaacttt

SEQ ID NO: 2218095 - DNA, 22 bp, Homo sapiens
ttaacttttataaactttacct

SEQ ID NO: 2218096 - DNA, 19 bp, Homo sapiens
ttaagaaaaaggatgcaca

SEQ ID NO: 2218097 - DNA, 17 bp, Homo sapiens
ttaagctgttactgtct

SEQ ID NO: 2218098 - DNA, 14 bp, Homo sapiens
ttaagtgctgcatt

SEQ ID NO: 2218099 - DNA, 15 bp, Homo sapiens
ttaatctaaatggaa

SEQ ID NO: 2218100 - DNA, 19 bp, Homo sapiens
ttaatgaaagactgtacaa

SEQ ID NO: 2218101 - DNA, 20 bp, Homo sapiens
ttaatgaaagactgtacaaa

SEQ ID NO: 2218102 - DNA, 19 bp, Homo sapiens
ttaatttttttgagacaga

SEQ ID NO: 2218103 - DNA, 15 bp, Homo sapiens
ttacaggaagtactg

SEQ ID NO: 2218104 - DNA, 14 bp, Homo sapiens
ttacaggtgtgaac

SEQ ID NO: 2218105 - DNA, 17 bp, Homo sapiens
ttaccacagacatacta

SEQ ID NO: 2218106 - DNA, 19 bp, Homo sapiens
ttaccctcatgttcttaat

SEQ ID NO: 2218107 - DNA, 16 bp, Homo sapiens
ttactaatagacaatt

SEQ ID NO: 2218108 - DNA, 12 bp, Homo sapiens
ttactgtacatg

SEQ ID NO: 2218109 - DNA, 22 bp, Homo sapiens
ttactgtacatgaaaacacatt

SEQ ID NO: 2218110 - DNA, 23 bp, Homo sapiens
ttactgtacatgaaaacacattt

SEQ ID NO: 2218111 - DNA, 21 bp, Homo sapiens
ttacttaaaccgccaaggctg

SEQ ID NO: 2218112 - DNA, 14 bp, Homo sapiens
ttactttgtgttca

SEQ ID NO: 2218113 - DNA, 12 bp, Homo sapiens
ttagaaatataa

SEQ ID NO: 2218114 - DNA, 14 bp, Homo sapiens
ttagaaatataatt

SEQ ID NO: 2218115 - DNA, 20 bp, Homo sapiens
ttagacagagtctcactgtt

SEQ ID NO: 2218116 - DNA, 13 bp, Homo sapiens
ttagacagtccct

SEQ ID NO: 2218117 - DNA, 15 bp, Homo sapiens
ttagacagtccctgc

SEQ ID NO: 2218118 - DNA, 16 bp, Homo sapiens
ttagacagtccctgcc

SEQ ID NO: 2218119 - DNA, 18 bp, Homo sapiens
ttagccaagtgtggtaga

SEQ ID NO: 2218120 - DNA, 14 bp, Homo sapiens
ttagcggagacgga

SEQ ID NO: 2218121 - DNA, 16 bp, Homo sapiens
ttaggtgaggaagcaa

SEQ ID NO: 2218122 - DNA, 18 bp, Homo sapiens
ttagtatgaggcatttgt

SEQ ID NO: 2218123 - DNA, 14 bp, Homo sapiens
ttagttccttgagt

SEQ ID NO: 2218124 - DNA, 18 bp, Homo sapiens
ttataaactttacctttt

SEQ ID NO: 2218125 - DNA, 15 bp, Homo sapiens
ttataataatgttaa

SEQ ID NO: 2218126 - DNA, 18 bp, Homo sapiens
ttataataatgttaacat

SEQ ID NO: 2218127 - DNA, 18 bp, Homo sapiens
ttatcacccagaagaaaa

SEQ ID NO: 2218128 - DNA, 20 bp, Homo sapiens
ttatggaacactctgagact

SEQ ID NO: 2218129 - DNA, 21 bp, Homo sapiens
ttatggacaatgacccagtgg

SEQ ID NO: 2218130 - DNA, 14 bp, Homo sapiens
ttatggcacatcag

SEQ ID NO: 2218131 - DNA, 16 bp, Homo sapiens
ttatggcttttgtgca

SEQ ID NO: 2218132 - DNA, 18 bp, Homo sapiens
ttatggcttttgtgcatt

SEQ ID NO: 2218133 - DNA, 17 bp, Homo sapiens
ttattgtcaaagtggtg

SEQ ID NO: 2218134 - DNA, 18 bp, Homo sapiens
ttattgtcaaagtggtga

SEQ ID NO: 2218135 - DNA, 17 bp, Homo sapiens
ttatttttagacagagt

SEQ ID NO: 2218136 - DNA, 13 bp, Homo sapiens
ttcaaagatattt

SEQ ID NO: 2218137 - DNA, 21 bp, Homo sapiens
ttcaagcgattcttctgcttc

SEQ ID NO: 2218138 - DNA, 21 bp, Homo sapiens
ttcaaggatcctgagccagat

SEQ ID NO: 2218139 - DNA, 13 bp, Homo sapiens
ttcacagttctct

SEQ ID NO: 2218140 - DNA, 20 bp, Homo sapiens
ttcacctttgtccccaccgc

SEQ ID NO: 2218141 - DNA, 22 bp, Homo sapiens
ttcacctttgtccccaccgcag

SEQ ID NO: 2218142 - DNA, 13 bp, Homo sapiens
ttcacggaagagc

SEQ ID NO: 2218143 - DNA, 18 bp, Homo sapiens
ttcacggaagagccttgc

SEQ ID NO: 2218144 - DNA, 16 bp, Homo sapiens
ttcagaaatgtgttat

SEQ ID NO: 2218145 - DNA, 14 bp, Homo sapiens
ttcagacagctgcc

SEQ ID NO: 2218146 - DNA, 15 bp, Homo sapiens
ttcagacagctgcct

SEQ ID NO: 2218147 - DNA, 23 bp, Homo sapiens
ttcagctccagctcaccagcccc

SEQ ID NO: 2218148 - DNA, 17 bp, Homo sapiens
ttcaggaagctcagggc

SEQ ID NO: 2218149 - DNA, 16 bp, Homo sapiens
ttcagggttggcccct

SEQ ID NO: 2218150 - DNA, 17 bp, Homo sapiens
ttcagggttggcccctg

SEQ ID NO: 2218151 - DNA, 15 bp, Homo sapiens
ttcagtggcagctgc

SEQ ID NO: 2218152 - DNA, 13 bp, Homo sapiens
ttcataatgactt

SEQ ID NO: 2218153 - DNA, 21 bp, Homo sapiens
ttcatcatcctaagctattca

SEQ ID NO: 2218154 - DNA, 21 bp, Homo sapiens
ttcatccctctggggctgttc

SEQ ID NO: 2218155 - DNA, 12 bp, Homo sapiens
ttcatcttgaat

SEQ ID NO: 2218156 - DNA, 19 bp, Homo sapiens
ttccaaccctcatcaccaa

SEQ ID NO: 2218157 - DNA, 17 bp, Homo sapiens
ttccaagggtactaagg

SEQ ID NO: 2218158 - DNA, 18 bp, Homo sapiens
ttccaccatcaagccacc

SEQ ID NO: 2218159 - DNA, 15 bp, Homo sapiens
ttccaggctgggaga

SEQ ID NO: 2218160 - DNA, 17 bp, Homo sapiens
ttccaggggtgggacac

SEQ ID NO: 2218161 - DNA, 18 bp, Homo sapiens
ttccaggtttaagctgtt

SEQ ID NO: 2218162 - DNA, 15 bp, Homo sapiens
ttccagtgaggctct

SEQ ID NO: 2218163 - DNA, 20 bp, Homo sapiens
ttccagtgaggctctgccct

SEQ ID NO: 2218164 - DNA, 22 bp, Homo sapiens
ttccagtgaggctctgcccttg

SEQ ID NO: 2218165 - DNA, 15 bp, Homo sapiens
ttccatggactttgt

SEQ ID NO: 2218166 - DNA, 12 bp, Homo sapiens
ttccatggcctc

SEQ ID NO: 2218167 - DNA, 16 bp, Homo sapiens
ttccatggcctcttca

SEQ ID NO: 2218168 - DNA, 13 bp, Homo sapiens
ttcccaagctctg

SEQ ID NO: 2218169 - DNA, 19 bp, Homo sapiens
aagggcctggcctgagctg

SEQ ID NO: 2218170 - DNA, 22 bp, Homo sapiens
aaggggaatgtttgcctctgcc

SEQ ID NO: 2218171 - DNA, 13 bp, Homo sapiens
aaggggagagtaa

SEQ ID NO: 2218172 - DNA, 17 bp, Homo sapiens
aaggggcagtggtggtt

SEQ ID NO: 2218173 - DNA, 16 bp, Homo sapiens
aaggggcccaagagag

SEQ ID NO: 2218174 - DNA, 21 bp, Homo sapiens
aaggggcccaagagagacagc

SEQ ID NO: 2218175 - DNA, 14 bp, Homo sapiens
aaggggggtgggag

SEQ ID NO: 2218176 - DNA, 17 bp, Homo sapiens
aaggggggtgggagggg

SEQ ID NO: 2218177 - DNA, 16 bp, Homo sapiens
aagggtatcaggtgct

SEQ ID NO: 2218178 - DNA, 17 bp, Homo sapiens
aagggtatcaggtgctg

SEQ ID NO: 2218179 - DNA, 19 bp, Homo sapiens
aagggtatcaggtgctgcc

SEQ ID NO: 2218180 - DNA, 13 bp, Homo sapiens
aagtacactgttt

SEQ ID NO: 2218181 - DNA, 18 bp, Homo sapiens
aagtacactgtttcaaac

SEQ ID NO: 2218182 - DNA, 19 bp, Homo sapiens
aagtacactgtttcaaact

SEQ ID NO: 2218183 - DNA, 13 bp, Homo sapiens
aagtactatgtat

SEQ ID NO: 2218184 - DNA, 20 bp, Homo sapiens
aagtacttctccaccctgct

SEQ ID NO: 2218185 - DNA, 22 bp, Homo sapiens
aagtacttctccaccctgctct

SEQ ID NO: 2218186 - DNA, 23 bp, Homo sapiens
aagtacttctccaccctgctctc

SEQ ID NO: 2218187 - DNA, 11 bp, Homo sapiens
aagtacttctt

SEQ ID NO: 2218188 - DNA, 19 bp, Homo sapiens
aagtagaagtcttagatgt

SEQ ID NO: 2218189 - DNA, 17 bp, Homo sapiens
aagtatccctactgtaa

SEQ ID NO: 2218190 - DNA, 18 bp, Homo sapiens
aagtatccctactgtaat

SEQ ID NO: 2218191 - DNA, 23 bp, Homo sapiens
aagtatccctactgtaatttgtg

SEQ ID NO: 2218192 - DNA, 15 bp, Homo sapiens
aagtattataccttt

SEQ ID NO: 2218193 - DNA, 16 bp, Homo sapiens
aagtattatacctttt

SEQ ID NO: 2218194 - DNA, 19 bp, Homo sapiens
aagtattatacctttttta

SEQ ID NO: 2218195 - DNA, 21 bp, Homo sapiens
aagtattcttatttaatgaaa

SEQ ID NO: 2218196 - DNA, 21 bp, Homo sapiens
aagtgaaaaaggaggaagaga

SEQ ID NO: 2218197 - DNA, 17 bp, Homo sapiens
aagtgaagacaatgact

SEQ ID NO: 2218198 - DNA, 14 bp, Homo sapiens
aagtgagagctggg

SEQ ID NO: 2218199 - DNA, 15 bp, Homo sapiens
aagtgagagctgggt

SEQ ID NO: 2218200 - DNA, 13 bp, Homo sapiens
aagtgatcctccc

SEQ ID NO: 2218201 - DNA, 23 bp, Homo sapiens
aagtgatcctcccacctcagcct

SEQ ID NO: 2218202 - DNA, 15 bp, Homo sapiens
aagtgattctcctgc

SEQ ID NO: 2218203 - DNA, 19 bp, Homo sapiens
aagtgattctcctgcctca

SEQ ID NO: 2218204 - DNA, 21 bp, Homo sapiens
aagtgtatttttttactaata

SEQ ID NO: 2218205 - DNA, 20 bp, Homo sapiens
aagtttgagatcagcctggg

SEQ ID NO: 2218206 - DNA, 16 bp, Homo sapiens
aataatgtgaaactgg

SEQ ID NO: 2218207 - DNA, 20 bp, Homo sapiens
aatacaccactacattctgt

SEQ ID NO: 2218208 - DNA, 21 bp, Homo sapiens
aatacaccactacattctgtt

SEQ ID NO: 2218209 - DNA, 15 bp, Homo sapiens
aatacctgtccccct

SEQ ID NO: 2218210 - DNA, 20 bp, Homo sapiens
aatactctaccctcttagaa

SEQ ID NO: 2218211 - DNA, 22 bp, Homo sapiens
aatactctaccctcttagaaaa

SEQ ID NO: 2218212 - DNA, 13 bp, Homo sapiens
aatagctgggact

SEQ ID NO: 2218213 - DNA, 17 bp, Homo sapiens
aataggaaaaactgatt

SEQ ID NO: 2218214 - DNA, 16 bp, Homo sapiens
aatagtggtgtgattt

SEQ ID NO: 2218215 - DNA, 13 bp, Homo sapiens
aatagttggctag

SEQ ID NO: 2218216 - DNA, 18 bp, Homo sapiens
aatataggaacttaaata

SEQ ID NO: 2218217 - DNA, 11 bp, Homo sapiens
aatattgctga

SEQ ID NO: 2218218 - DNA, 13 bp, Homo sapiens
aatattgctgatg

SEQ ID NO: 2218219 - DNA, 15 bp, Homo sapiens
aatattgctgatggt

SEQ ID NO: 2218220 - DNA, 22 bp, Homo sapiens
aatattgctgatggtgcaatga

SEQ ID NO: 2218221 - DNA, 15 bp, Homo sapiens
aatcaccgaaaacgt

SEQ ID NO: 2218222 - DNA, 23 bp, Homo sapiens
aatcaccgaaaacgtggctgctt

SEQ ID NO: 2218223 - DNA, 11 bp, Homo sapiens
aatcagcctgc

SEQ ID NO: 2218224 - DNA, 17 bp, Homo sapiens
aatcattaggtgtgact

SEQ ID NO: 2218225 - DNA, 23 bp, Homo sapiens
aatcattaggtgtgactgaattt

SEQ ID NO: 2218226 - DNA, 19 bp, Homo sapiens
aatccagacccggctgcgt

SEQ ID NO: 2218227 - DNA, 17 bp, Homo sapiens
aatcccatttaaaaaaa

SEQ ID NO: 2218228 - DNA, 12 bp, Homo sapiens
aatctaaatgga

SEQ ID NO: 2218229 - DNA, 13 bp, Homo sapiens
aatctcaaataac

SEQ ID NO: 2218230 - DNA, 15 bp, Homo sapiens
aatctcaaatttcta

SEQ ID NO: 2218231 - DNA, 17 bp, Homo sapiens
aatctcaaatttctaaa

SEQ ID NO: 2218232 - DNA, 18 bp, Homo sapiens
aatctcaaatttctaaat

SEQ ID NO: 2218233 - DNA, 13 bp, Homo sapiens
aatctccaaaata

SEQ ID NO: 2218234 - DNA, 17 bp, Homo sapiens
aatgaaacattttgtca

SEQ ID NO: 2218235 - DNA, 17 bp, Homo sapiens
aatgaaacctgtgtctc

SEQ ID NO: 2218236 - DNA, 16 bp, Homo sapiens
aatgaaccacatcttg

SEQ ID NO: 2218237 - DNA, 13 bp, Homo sapiens
aatgaatgtcagt

SEQ ID NO: 2218238 - DNA, 14 bp, Homo sapiens
aatgaatgtcagtg

SEQ ID NO: 2218239 - DNA, 21 bp, Homo sapiens
aatgaatgtcagtgtgactga

SEQ ID NO: 2218240 - DNA, 15 bp, Homo sapiens
aatgacctttcaata

SEQ ID NO: 2218241 - DNA, 17 bp, Homo sapiens
aatgacctttcaatagg

SEQ ID NO: 2218242 - DNA, 21 bp, Homo sapiens
aatgacctttcaataggaaaa

SEQ ID NO: 2218243 - DNA, 11 bp, Homo sapiens
aatgagcctgg

SEQ ID NO: 2218244 - DNA, 16 bp, Homo sapiens
aatgaggtcagagcct

SEQ ID NO: 2218245 - DNA, 21 bp, Homo sapiens
aatgatgatcctaggcatttg

SEQ ID NO: 2218246 - DNA, 19 bp, Homo sapiens
aatgatgccatgaggaaca

SEQ ID NO: 2218247 - DNA, 13 bp, Homo sapiens
aatgattaattaa

SEQ ID NO: 2218248 - DNA, 11 bp, Homo sapiens
aatgcaaacca

SEQ ID NO: 2218249 - DNA, 16 bp, Homo sapiens
aatgcaaaccatcatt

SEQ ID NO: 2218250 - DNA, 13 bp, Homo sapiens
aatgcactttgtt

SEQ ID NO: 2218251 - DNA, 20 bp, Homo sapiens
aatgcactttgttctggctc

SEQ ID NO: 2218252 - DNA, 12 bp, Homo sapiens
aatgcccagccc

SEQ ID NO: 2218253 - DNA, 14 bp, Homo sapiens
aatgcccagcccct

SEQ ID NO: 2218254 - DNA, 20 bp, Homo sapiens
aatgcccagccccttctgac

SEQ ID NO: 2218255 - DNA, 22 bp, Homo sapiens
aatgcccagccccttctgaccc

SEQ ID NO: 2218256 - DNA, 18 bp, Homo sapiens
aatgcgggggagcaggca

SEQ ID NO: 2218257 - DNA, 23 bp, Homo sapiens
aatgctctttacttcatggactt

SEQ ID NO: 2218258 - DNA, 20 bp, Homo sapiens
aatgctgtgccctaaagtgt

SEQ ID NO: 2218259 - DNA, 21 bp, Homo sapiens
aatggaaatgggcagagcaga

SEQ ID NO: 2218260 - DNA, 20 bp, Homo sapiens
aatggactaacttgtctttg

SEQ ID NO: 2218261 - DNA, 12 bp, Homo sapiens
aatggcagcctt

SEQ ID NO: 2218262 - DNA, 15 bp, Homo sapiens
aatgggggtgcattt

SEQ ID NO: 2218263 - DNA, 16 bp, Homo sapiens
aatggttttcaaaata

SEQ ID NO: 2218264 - DNA, 17 bp, Homo sapiens
aatggttttcttgtgtg

SEQ ID NO: 2218265 - DNA, 18 bp, Homo sapiens
aatggttttcttgtgtgt

SEQ ID NO: 2218266 - DNA, 12 bp, Homo sapiens
aatgtactgcat

SEQ ID NO: 2218267 - DNA, 20 bp, Homo sapiens
aatgtatgtgtaagtattct

SEQ ID NO: 2218268 - DNA, 13 bp, Homo sapiens
aatgtcacaggca

SEQ ID NO: 2218269 - DNA, 15 bp, Homo sapiens
aatgtcagtgtgact

SEQ ID NO: 2218270 - DNA, 21 bp, Homo sapiens
aatgtcagtgtgactgatctc

SEQ ID NO: 2218271 - DNA, 22 bp, Homo sapiens
aatgtctagttgtaacaccatg

SEQ ID NO: 2218272 - DNA, 17 bp, Homo sapiens
aatgtgaaaagaaaaat

SEQ ID NO: 2218273 - DNA, 15 bp, Homo sapiens
aatgtgaaactggat

SEQ ID NO: 2218274 - DNA, 21 bp, Homo sapiens
aatgtgctgaatggttttcaa

SEQ ID NO: 2218275 - DNA, 16 bp, Homo sapiens
aatgtttgcctctgcc

SEQ ID NO: 2218276 - DNA, 20 bp, Homo sapiens
aattaacttttataaacttt

SEQ ID NO: 2218277 - DNA, 19 bp, Homo sapiens
aattatgagttatttttat

SEQ ID NO: 2218278 - DNA, 22 bp, Homo sapiens
aattcagttgttagtgtgtctt

SEQ ID NO: 2218279 - DNA, 14 bp, Homo sapiens
aattctactttgag

SEQ ID NO: 2218280 - DNA, 17 bp, Homo sapiens
aattctctagtttgatt

SEQ ID NO: 2218281 - DNA, 22 bp, Homo sapiens
aattgggggggtgcccggggat

SEQ ID NO: 2218282 - DNA, 13 bp, Homo sapiens
aatttaaaagtct

SEQ ID NO: 2218283 - DNA, 20 bp, Homo sapiens
aatttatttatgggatcctg

SEQ ID NO: 2218284 - DNA, 18 bp, Homo sapiens
aatttgggggaaaattta

SEQ ID NO: 2218285 - DNA, 18 bp, Homo sapiens
aatttgtgatacaatgct

SEQ ID NO: 2218286 - DNA, 20 bp, Homo sapiens
aatttgtgatacaatgctgt

SEQ ID NO: 2218287 - DNA, 16 bp, Homo sapiens
aattttgtgcccccat

SEQ ID NO: 2218288 - DNA, 22 bp, Homo sapiens
aatttttttatcgtcactgctt

SEQ ID NO: 2218289 - DNA, 17 bp, Homo sapiens
aatttttttgagacaga

SEQ ID NO: 2218290 - DNA, 12 bp, Homo sapiens
acaaaaaaagac

SEQ ID NO: 2218291 - DNA, 16 bp, Homo sapiens
acaaaaagcataaaaa

SEQ ID NO: 2218292 - DNA, 13 bp, Homo sapiens
acaaaatgaaacg

SEQ ID NO: 2218293 - DNA, 19 bp, Homo sapiens
agatacaggaaaagctgct

SEQ ID NO: 2218294 - DNA, 22 bp, Homo sapiens
agatacagttactcagaattct

SEQ ID NO: 2218295 - DNA, 11 bp, Homo sapiens
agatactgtat

SEQ ID NO: 2218296 - DNA, 21 bp, Homo sapiens
agatattttgctttgtgattt

SEQ ID NO: 2218297 - DNA, 22 bp, Homo sapiens
agatattttgctttgtgatttt

SEQ ID NO: 2218298 - DNA, 18 bp, Homo sapiens
agatcaaaaggttaataa

SEQ ID NO: 2218299 - DNA, 13 bp, Homo sapiens
agatcagcctggg

SEQ ID NO: 2218300 - DNA, 15 bp, Homo sapiens
agatcagcctgggca

SEQ ID NO: 2218301 - DNA, 14 bp, Homo sapiens
agatcttctgtggg

SEQ ID NO: 2218302 - DNA, 15 bp, Homo sapiens
agatgcttctcactg

SEQ ID NO: 2218303 - DNA, 18 bp, Homo sapiens
agatgcttctcactgcca

SEQ ID NO: 2218304 - DNA, 22 bp, Homo sapiens
agatgggtgcttggaggaagga

SEQ ID NO: 2218305 - DNA, 16 bp, Homo sapiens
agattcatatttactt

SEQ ID NO: 2218306 - DNA, 19 bp, Homo sapiens
agattcatatttacttctt

SEQ ID NO: 2218307 - DNA, 14 bp, Homo sapiens
agattctttcctga

SEQ ID NO: 2218308 - DNA, 16 bp, Homo sapiens
agattctttcctgagg

SEQ ID NO: 2218309 - DNA, 18 bp, Homo sapiens
agattctttcctgaggct

SEQ ID NO: 2218310 - DNA, 21 bp, Homo sapiens
agattctttcctgaggctggg

SEQ ID NO: 2218311 - DNA, 16 bp, Homo sapiens
agattgcaacaggctg

SEQ ID NO: 2218312 - DNA, 16 bp, Homo sapiens
agattgcaccactgca

SEQ ID NO: 2218313 - DNA, 19 bp, Homo sapiens
agatttcactctccttggt

SEQ ID NO: 2218314 - DNA, 18 bp, Homo sapiens
agcaaaagatgcttctca

SEQ ID NO: 2218315 - DNA, 20 bp, Homo sapiens
agcaaaggagattggaagga

SEQ ID NO: 2218316 - DNA, 17 bp, Homo sapiens
agcaagacgctgtgctg

SEQ ID NO: 2218317 - DNA, 14 bp, Homo sapiens
agcaaggagattta

SEQ ID NO: 2218318 - DNA, 19 bp, Homo sapiens
agcaaggagatttacaact

SEQ ID NO: 2218319 - DNA, 16 bp, Homo sapiens
agcacagaccctgccc

SEQ ID NO: 2218320 - DNA, 16 bp, Homo sapiens
agcacagcttcatttc

SEQ ID NO: 2218321 - DNA, 13 bp, Homo sapiens
agcacatgcctct

SEQ ID NO: 2218322 - DNA, 21 bp, Homo sapiens
agcacatgcctctctcaggcc

SEQ ID NO: 2218323 - DNA, 23 bp, Homo sapiens
agcacatgcctctctcaggccaa

SEQ ID NO: 2218324 - DNA, 14 bp, Homo sapiens
agcacctcctgcct

SEQ ID NO: 2218325 - DNA, 23 bp, Homo sapiens
agcaccttagacagtccctgcca

SEQ ID NO: 2218326 - DNA, 17 bp, Homo sapiens
agcacgatttctgttta

SEQ ID NO: 2218327 - DNA, 19 bp, Homo sapiens
agcacgatttctgtttaga

SEQ ID NO: 2218328 - DNA, 16 bp, Homo sapiens
agcactctggggtggg

SEQ ID NO: 2218329 - DNA, 23 bp, Homo sapiens
agcactttgggaggccaaggtgg

SEQ ID NO: 2218330 - DNA, 20 bp, Homo sapiens
agcagaaacaaaatgaaaaa

SEQ ID NO: 2218331 - DNA, 19 bp, Homo sapiens
agcagaaatgccttaccct

SEQ ID NO: 2218332 - DNA, 21 bp, Homo sapiens
agcagagaattctcttatcca

SEQ ID NO: 2218333 - DNA, 15 bp, Homo sapiens
agcagagaccatccc

SEQ ID NO: 2218334 - DNA, 17 bp, Homo sapiens
agcagagaccatccctg

SEQ ID NO: 2218335 - DNA, 11 bp, Homo sapiens
agcagagagag

SEQ ID NO: 2218336 - DNA, 12 bp, Homo sapiens
agcagagagaga

SEQ ID NO: 2218337 - DNA, 17 bp, Homo sapiens
agcagaggaaggagagg

SEQ ID NO: 2218338 - DNA, 19 bp, Homo sapiens
agcagatggagaccccttg

SEQ ID NO: 2218339 - DNA, 21 bp, Homo sapiens
agcagccacattcctgatgct

SEQ ID NO: 2218340 - DNA, 16 bp, Homo sapiens
agcagcctggaccctg

SEQ ID NO: 2218341 - DNA, 13 bp, Homo sapiens
agcagcgtttcta

SEQ ID NO: 2218342 - DNA, 18 bp, Homo sapiens
agcaggctctcaggccag

SEQ ID NO: 2218343 - DNA, 19 bp, Homo sapiens
agcaggctctcaggccagc

SEQ ID NO: 2218344 - DNA, 21 bp, Homo sapiens
agcaggctctcaggccagctg

SEQ ID NO: 2218345 - DNA, 22 bp, Homo sapiens
agcaggctctcaggccagctgc

SEQ ID NO: 2218346 - DNA, 23 bp, Homo sapiens
agcaggctctcaggccagctgct

SEQ ID NO: 2218347 - DNA, 15 bp, Homo sapiens
agcagggctcagcgg

SEQ ID NO: 2218348 - DNA, 16 bp, Homo sapiens
agcagtgcatgctgtc

SEQ ID NO: 2218349 - DNA, 17 bp, Homo sapiens
agcatacgtacacattt

SEQ ID NO: 2218350 - DNA, 19 bp, Homo sapiens
agcatattcaggaagctca

SEQ ID NO: 2218351 - DNA, 19 bp, Homo sapiens
agcatcaggccaggccctc

SEQ ID NO: 2218352 - DNA, 13 bp, Homo sapiens
agcatcctggcac

SEQ ID NO: 2218353 - DNA, 23 bp, Homo sapiens
agcatgcctggatggggctgcac

SEQ ID NO: 2218354 - DNA, 23 bp, Homo sapiens
agccaaagctaggcctggccaga

SEQ ID NO: 2218355 - DNA, 23 bp, Homo sapiens
agccaagtgtggtagagtgtgcc

SEQ ID NO: 2218356 - DNA, 20 bp, Homo sapiens
agccaccaacatactcccat

SEQ ID NO: 2218357 - DNA, 14 bp, Homo sapiens
agccacggccaggc

SEQ ID NO: 2218358 - DNA, 17 bp, Homo sapiens
agccacggccaggccag

SEQ ID NO: 2218359 - DNA, 20 bp, Homo sapiens
agccactgcaccgggccaca

SEQ ID NO: 2218360 - DNA, 21 bp, Homo sapiens
agccactgcaccgggccacag

SEQ ID NO: 2218361 - DNA, 10 bp, Homo sapiens
agccagagga

SEQ ID NO: 2218362 - DNA, 13 bp, Homo sapiens
agccagaggagag

SEQ ID NO: 2218363 - DNA, 20 bp, Homo sapiens
agccagaggagagaggaccc

SEQ ID NO: 2218364 - DNA, 17 bp, Homo sapiens
agccagatttcactctc

SEQ ID NO: 2218365 - DNA, 20 bp, Homo sapiens
agccagatttcactctcctt

SEQ ID NO: 2218366 - DNA, 19 bp, Homo sapiens
agccagcaggctctcaggc

SEQ ID NO: 2218367 - DNA, 21 bp, Homo sapiens
agccaggccacaagacccttg

SEQ ID NO: 2218368 - DNA, 22 bp, Homo sapiens
agccaggccacaagacccttgt

SEQ ID NO: 2218369 - DNA, 12 bp, Homo sapiens
agccagggtctc

SEQ ID NO: 2218370 - DNA, 21 bp, Homo sapiens
agccagtaaatgggggtgcat

SEQ ID NO: 2218371 - DNA, 16 bp, Homo sapiens
agcccaccttggctca

SEQ ID NO: 2218372 - DNA, 15 bp, Homo sapiens
agcccacgcccccac

SEQ ID NO: 2218373 - DNA, 14 bp, Homo sapiens
agcccacttctgcc

SEQ ID NO: 2218374 - DNA, 15 bp, Homo sapiens
agcccacttctgcca

SEQ ID NO: 2218375 - DNA, 14 bp, Homo sapiens
agcccaggaaaggc

SEQ ID NO: 2218376 - DNA, 21 bp, Homo sapiens
agcccaggaaaggctccagga

SEQ ID NO: 2218377 - DNA, 23 bp, Homo sapiens
agcccaggaaaggctccaggagc

SEQ ID NO: 2218378 - DNA, 24 bp, Homo sapiens
agcccaggaaaggctccaggagca

SEQ ID NO: 2218379 - DNA, 12 bp, Homo sapiens
agcccaggcctc

SEQ ID NO: 2218380 - DNA, 14 bp, Homo sapiens
agcccaggcctcct

SEQ ID NO: 2218381 - DNA, 24 bp, Homo sapiens
agccccaaaactctcctctgctgc

SEQ ID NO: 2218382 - DNA, 20 bp, Homo sapiens
agccccatcccaaacccttc

SEQ ID NO: 2218383 - DNA, 23 bp, Homo sapiens
agccccatcctctgtacagagcc

SEQ ID NO: 2218384 - DNA, 19 bp, Homo sapiens
agccccattctgcctgccc

SEQ ID NO: 2218385 - DNA, 24 bp, Homo sapiens
agccccttctgacccatgctgccc

SEQ ID NO: 2218386 - DNA, 17 bp, Homo sapiens
agcccgggctctgcctc

SEQ ID NO: 2218387 - DNA, 15 bp, Homo sapiens
agccctgcagagggc

SEQ ID NO: 2218388 - DNA, 19 bp, Homo sapiens
agccctgcagagggcacag

SEQ ID NO: 2218389 - DNA, 16 bp, Homo sapiens
agccctggtggcagtg

SEQ ID NO: 2218390 - DNA, 21 bp, Homo sapiens
agccgagatcacgccactgca

SEQ ID NO: 2218391 - DNA, 20 bp, Homo sapiens
agccgagattgcaccactgc

SEQ ID NO: 2218392 - DNA, 21 bp, Homo sapiens
agccgccatgctcctggccca

SEQ ID NO: 2218393 - DNA, 13 bp, Homo sapiens
agccgctggggcc

SEQ ID NO: 2218394 - DNA, 22 bp, Homo sapiens
agccgctggggccagttggtcc

SEQ ID NO: 2218395 - DNA, 15 bp, Homo sapiens
agcctaggtgacaga

SEQ ID NO: 2218396 - DNA, 17 bp, Homo sapiens
agcctcaacctcctggg

SEQ ID NO: 2218397 - DNA, 18 bp, Homo sapiens
agcctcaacctcctgggc

SEQ ID NO: 2218398 - DNA, 19 bp, Homo sapiens
agcctcaacctcctgggct

SEQ ID NO: 2218399 - DNA, 16 bp, Homo sapiens
agcctcccaaagtgct

SEQ ID NO: 2218400 - DNA, 19 bp, Homo sapiens
agcctcccaaagtgctggg

SEQ ID NO: 2218401 - DNA, 20 bp, Homo sapiens
agcctcccaaagtgctggga

SEQ ID NO: 2218402 - DNA, 21 bp, Homo sapiens
agcctcccaaagtgctgggat

SEQ ID NO: 2218403 - DNA, 19 bp, Homo sapiens
agcctcccgaatagctggg

SEQ ID NO: 2218404 - DNA, 22 bp, Homo sapiens
agcctcccgaatagctgggact

SEQ ID NO: 2218405 - DNA, 19 bp, Homo sapiens
agcctgctccagctgttca

SEQ ID NO: 2218406 - DNA, 14 bp, Homo sapiens
agcctggaccctgt

SEQ ID NO: 2218407 - DNA, 21 bp, Homo sapiens
agcctgtgcctctgggactgg

SEQ ID NO: 2218408 - DNA, 16 bp, Homo sapiens
agccttgaactttgac

SEQ ID NO: 2218409 - DNA, 22 bp, Homo sapiens
agccttgaccattctccacctg

SEQ ID NO: 2218410 - DNA, 23 bp, Homo sapiens
agccttgaccattctccacctgc

SEQ ID NO: 2218411 - DNA, 15 bp, Homo sapiens
agcgattcttctgct

SEQ ID NO: 2218412 - DNA, 20 bp, Homo sapiens
agcggagaaaggaagggctg

SEQ ID NO: 2218413 - DNA, 15 bp, Homo sapiens
agcggggacagctcc

SEQ ID NO: 2218414 - DNA, 16 bp, Homo sapiens
agcggggacagctcct

SEQ ID NO: 2218415 - DNA, 16 bp, Homo sapiens
agcgtgagccactgca

SEQ ID NO: 2218416 - DNA, 15 bp, Homo sapiens
atgtatctgagcagg

SEQ ID NO: 2218417 - DNA, 16 bp, Homo sapiens
atgtcacaggcaggtc

SEQ ID NO: 2218418 - DNA, 19 bp, Homo sapiens
atgtcacaggcaggtccag

SEQ ID NO: 2218419 - DNA, 13 bp, Homo sapiens
atgtcagtgtgac

SEQ ID NO: 2218420 - DNA, 15 bp, Homo sapiens
atgtcagtgtgactg

SEQ ID NO: 2218421 - DNA, 16 bp, Homo sapiens
atgtccaagaagccca

SEQ ID NO: 2218422 - DNA, 18 bp, Homo sapiens
atgtccaagaagcccagg

SEQ ID NO: 2218423 - DNA, 15 bp, Homo sapiens
atgtgatgagaggaa

SEQ ID NO: 2218424 - DNA, 19 bp, Homo sapiens
atgtgatgagaggaaatca

SEQ ID NO: 2218425 - DNA, 22 bp, Homo sapiens
atgtgcccccacccccaccctc

SEQ ID NO: 2218426 - DNA, 20 bp, Homo sapiens
atgtgggctagttgggcttc

SEQ ID NO: 2218427 - DNA, 13 bp, Homo sapiens
atgtgtaagtatt

SEQ ID NO: 2218428 - DNA, 16 bp, Homo sapiens
atgttctctcttctcc

SEQ ID NO: 2218429 - DNA, 22 bp, Homo sapiens
atgttctgaccctgcttcaaat

SEQ ID NO: 2218430 - DNA, 11 bp, Homo sapiens
atgttctggga

SEQ ID NO: 2218431 - DNA, 15 bp, Homo sapiens
atgttcttaattctt

SEQ ID NO: 2218432 - DNA, 18 bp, Homo sapiens
atgttgaaagatcaaaag

SEQ ID NO: 2218433 - DNA, 14 bp, Homo sapiens
atgttgcccaggca

SEQ ID NO: 2218434 - DNA, 15 bp, Homo sapiens
atgttgcccaggcag

SEQ ID NO: 2218435 - DNA, 18 bp, Homo sapiens
atgttttaagaggcaggg

SEQ ID NO: 2218436 - DNA, 19 bp, Homo sapiens
attaaaaatctcaaatttc

SEQ ID NO: 2218437 - DNA, 23 bp, Homo sapiens
attaaaaatctcaaatttctaaa

SEQ ID NO: 2218438 - DNA, 19 bp, Homo sapiens
attaaaacacaacatcttt

SEQ ID NO: 2218439 - DNA, 23 bp, Homo sapiens
attaaaacacaacatctttttct

SEQ ID NO: 2218440 - DNA, 16 bp, Homo sapiens
attaaacttaatctaa

SEQ ID NO: 2218441 - DNA, 15 bp, Homo sapiens
attaaatgcccagcc

SEQ ID NO: 2218442 - DNA, 17 bp, Homo sapiens
attaaatgcccagcccc

SEQ ID NO: 2218443 - DNA, 17 bp, Homo sapiens
attaaccacttcagctg

SEQ ID NO: 2218444 - DNA, 18 bp, Homo sapiens
attaaccacttcagctga

SEQ ID NO: 2218445 - DNA, 19 bp, Homo sapiens
attaacttttataaacttt

SEQ ID NO: 2218446 - DNA, 13 bp, Homo sapiens
attaagaaagact

SEQ ID NO: 2218447 - DNA, 14 bp, Homo sapiens
attaagtactatgt

SEQ ID NO: 2218448 - DNA, 13 bp, Homo sapiens
attacttctgcta

SEQ ID NO: 2218449 - DNA, 18 bp, Homo sapiens
attaggtgtgactgaatt

SEQ ID NO: 2218450 - DNA, 21 bp, Homo sapiens
attaggtgtgactgaatttct

SEQ ID NO: 2218451 - DNA, 14 bp, Homo sapiens
attcaggaagctca

SEQ ID NO: 2218452 - DNA, 17 bp, Homo sapiens
attcaggaagctcaggg

SEQ ID NO: 2218453 - DNA, 19 bp, Homo sapiens
attcaggaagctcagggcc

SEQ ID NO: 2218454 - DNA, 23 bp, Homo sapiens
attcaggaagctcagggcctggc

SEQ ID NO: 2218455 - DNA, 18 bp, Homo sapiens
attcccaagctctgctcc

SEQ ID NO: 2218456 - DNA, 22 bp, Homo sapiens
attccccaccctgaaagccctg

SEQ ID NO: 2218457 - DNA, 16 bp, Homo sapiens
attccccaggaggcca

SEQ ID NO: 2218458 - DNA, 13 bp, Homo sapiens
attctccacctgc

SEQ ID NO: 2218459 - DNA, 20 bp, Homo sapiens
attctccacctgccagggac

SEQ ID NO: 2218460 - DNA, 11 bp, Homo sapiens
attctcctgcc

SEQ ID NO: 2218461 - DNA, 13 bp, Homo sapiens
attctcctgcctc

SEQ ID NO: 2218462 - DNA, 19 bp, Homo sapiens
attctcctgcctcagcctc

SEQ ID NO: 2218463 - DNA, 20 bp, Homo sapiens
attctcctgcctcagcctcc

SEQ ID NO: 2218464 - DNA, 16 bp, Homo sapiens
attctccttgtgttac

SEQ ID NO: 2218465 - DNA, 18 bp, Homo sapiens
attctctagtttgattaa

SEQ ID NO: 2218466 - DNA, 11 bp, Homo sapiens
attctgcctgc

SEQ ID NO: 2218467 - DNA, 14 bp, Homo sapiens
attctgttggccag

SEQ ID NO: 2218468 - DNA, 14 bp, Homo sapiens
attcttaaatatgt

SEQ ID NO: 2218469 - DNA, 18 bp, Homo sapiens
attcttatttaatgaaag

SEQ ID NO: 2218470 - DNA, 20 bp, Homo sapiens
attcttctgcttcagcctcc

SEQ ID NO: 2218471 - DNA, 20 bp, Homo sapiens
attcttgaacttgaaaaaaa

SEQ ID NO: 2218472 - DNA, 15 bp, Homo sapiens
attcttgcaaagtat

SEQ ID NO: 2218473 - DNA, 17 bp, Homo sapiens
attgaaatctttttgct

SEQ ID NO: 2218474 - DNA, 18 bp, Homo sapiens
attgacaggattattgga

SEQ ID NO: 2218475 - DNA, 21 bp, Homo sapiens
attgataagaaccttttgagt

SEQ ID NO: 2218476 - DNA, 17 bp, Homo sapiens
attgcccacgctggagt

SEQ ID NO: 2218477 - DNA, 21 bp, Homo sapiens
attgcccacgctggagtgcag

SEQ ID NO: 2218478 - DNA, 16 bp, Homo sapiens
attgcggacagccacg

SEQ ID NO: 2218479 - DNA, 18 bp, Homo sapiens
attgcggacagccacggc

SEQ ID NO: 2218480 - DNA, 12 bp, Homo sapiens
attgctgcttga

SEQ ID NO: 2218481 - DNA, 14 bp, Homo sapiens
attgcttgagctca

SEQ ID NO: 2218482 - DNA, 23 bp, Homo sapiens
attggctttgggttgcaggacct

SEQ ID NO: 2218483 - DNA, 23 bp, Homo sapiens
attgtgtctcttggtcctgctgc

SEQ ID NO: 2218484 - DNA, 21 bp, Homo sapiens
attgtttggggatgagaaagg

SEQ ID NO: 2218485 - DNA, 17 bp, Homo sapiens
atttaaaagatacagtt

SEQ ID NO: 2218486 - DNA, 19 bp, Homo sapiens
atttacttcttatacattt

SEQ ID NO: 2218487 - DNA, 20 bp, Homo sapiens
atttattaaatgcccagccc

SEQ ID NO: 2218488 - DNA, 13 bp, Homo sapiens
atttattatggca

SEQ ID NO: 2218489 - DNA, 13 bp, Homo sapiens
atttattctgctc

SEQ ID NO: 2218490 - DNA, 12 bp, Homo sapiens
atttcactctcc

SEQ ID NO: 2218491 - DNA, 14 bp, Homo sapiens
atttcccaaagcag

SEQ ID NO: 2218492 - DNA, 16 bp, Homo sapiens
atttcccaaagcagtg

SEQ ID NO: 2218493 - DNA, 16 bp, Homo sapiens
atttccgttaaaatac

SEQ ID NO: 2218494 - DNA, 17 bp, Homo sapiens
atttccgttaaaatacc

SEQ ID NO: 2218495 - DNA, 19 bp, Homo sapiens
atttctgtttagataatac

SEQ ID NO: 2218496 - DNA, 16 bp, Homo sapiens
atttcttccacaagag

SEQ ID NO: 2218497 - DNA, 23 bp, Homo sapiens
atttcttttgccgttattaaaaa

SEQ ID NO: 2218498 - DNA, 21 bp, Homo sapiens
atttgaggtctgttctttcca

SEQ ID NO: 2218499 - DNA, 18 bp, Homo sapiens
atttggtggtttcagaaa

SEQ ID NO: 2218500 - DNA, 17 bp, Homo sapiens
atttgtgatacaatgct

SEQ ID NO: 2218501 - DNA, 22 bp, Homo sapiens
attttaaaaatacagatagata

SEQ ID NO: 2218502 - DNA, 15 bp, Homo sapiens
attttaattcagttg

SEQ ID NO: 2218503 - DNA, 21 bp, Homo sapiens
attttactttaaaaggagcca

SEQ ID NO: 2218504 - DNA, 17 bp, Homo sapiens
attttattatgcatgaa

SEQ ID NO: 2218505 - DNA, 19 bp, Homo sapiens
attttgatccaagctggtc

SEQ ID NO: 2218506 - DNA, 15 bp, Homo sapiens
attttgatgttttaa

SEQ ID NO: 2218507 - DNA, 20 bp, Homo sapiens
attttgctaaatgtgaatga

SEQ ID NO: 2218508 - DNA, 16 bp, Homo sapiens
atttttaagtgctgca

SEQ ID NO: 2218509 - DNA, 13 bp, Homo sapiens
atttttttttcct

SEQ ID NO: 2218510 - DNA, 16 bp, Homo sapiens
atttttttttccttca

SEQ ID NO: 2218511 - DNA, 18 bp, Homo sapiens
atttttttttccttcagt

SEQ ID NO: 2218512 - DNA, 10 bp, Homo sapiens
caaaaaaaga

SEQ ID NO: 2218513 - DNA, 12 bp, Homo sapiens
caaaaaagcgaa

SEQ ID NO: 2218514 - DNA, 16 bp, Homo sapiens
caaaaaatgcttgctt

SEQ ID NO: 2218515 - DNA, 19 bp, Homo sapiens
caaaactctcctctgctgc

SEQ ID NO: 2218516 - DNA, 16 bp, Homo sapiens
caaaagatgcttctca

SEQ ID NO: 2218517 - DNA, 19 bp, Homo sapiens
caaaagcatctatgtgaga

SEQ ID NO: 2218518 - DNA, 19 bp, Homo sapiens
caaaagctgggcaggttgg

SEQ ID NO: 2218519 - DNA, 12 bp, Homo sapiens
caaaataaaact

SEQ ID NO: 2218520 - DNA, 14 bp, Homo sapiens
caaaataaaacttt

SEQ ID NO: 2218521 - DNA, 13 bp, Homo sapiens
caaaatgaaaaaa

SEQ ID NO: 2218522 - DNA, 17 bp, Homo sapiens
caaaccatcattgaaat

SEQ ID NO: 2218523 - DNA, 19 bp, Homo sapiens
caaaccatcattgaaatct

SEQ ID NO: 2218524 - DNA, 20 bp, Homo sapiens
caaactcttgacctcaggtg

SEQ ID NO: 2218525 - DNA, 20 bp, Homo sapiens
caaagatattttgctttgtg

SEQ ID NO: 2218526 - DNA, 14 bp, Homo sapiens
caaagatgcagccg

SEQ ID NO: 2218527 - DNA, 21 bp, Homo sapiens
caaagcagtgcatgctgtccc

SEQ ID NO: 2218528 - DNA, 22 bp, Homo sapiens
caaagcagtgcatgctgtccct

SEQ ID NO: 2218529 - DNA, 22 bp, Homo sapiens
caaagccaaagctaggcctggc

SEQ ID NO: 2218530 - DNA, 15 bp, Homo sapiens
caaagctaggcctgg

SEQ ID NO: 2218531 - DNA, 18 bp, Homo sapiens
caaagctaggcctggcca

SEQ ID NO: 2218532 - DNA, 19 bp, Homo sapiens
caaagctaggcctggccag

SEQ ID NO: 2218533 - DNA, 12 bp, Homo sapiens
caaaggaagcac

SEQ ID NO: 2218534 - DNA, 14 bp, Homo sapiens
caaaggaagcacat

SEQ ID NO: 2218535 - DNA, 16 bp, Homo sapiens
caaagggtatcaggtg

SEQ ID NO: 2218536 - DNA, 20 bp, Homo sapiens
caaagggtatcaggtgctgc

SEQ ID NO: 2218537 - DNA, 20 bp, Homo sapiens
caaagtacactgtttcaaac

SEQ ID NO: 2218538 - DNA, 21 bp, Homo sapiens
caaagtatccctactgtaatt

SEQ ID NO: 2218539 - DNA, 23 bp, Homo sapiens
caaagtgctgggattacaagcgt

SEQ ID NO: 2218540 - DNA, 19 bp, Homo sapiens
caggtgtccctgcacttgc

SEQ ID NO: 2218541 - DNA, 12 bp, Homo sapiens
caggtgtgaacc

SEQ ID NO: 2218542 - DNA, 21 bp, Homo sapiens
caggttggtgggggcctcggt

SEQ ID NO: 2218543 - DNA, 16 bp, Homo sapiens
caggtttaagctgtta

SEQ ID NO: 2218544 - DNA, 12 bp, Homo sapiens
caggttttcctg

SEQ ID NO: 2218545 - DNA, 16 bp, Homo sapiens
caggttttcctgaaga

SEQ ID NO: 2218546 - DNA, 21 bp, Homo sapiens
cagtaaatgggggtgcatttg

SEQ ID NO: 2218547 - DNA, 22 bp, Homo sapiens
cagtaaatgggggtgcatttga

SEQ ID NO: 2218548 - DNA, 21 bp, Homo sapiens
cagtatcttgaagacttttct

SEQ ID NO: 2218549 - DNA, 14 bp, Homo sapiens
cagtcaccccggcc

SEQ ID NO: 2218550 - DNA, 16 bp, Homo sapiens
cagtcaccccggccac

SEQ ID NO: 2218551 - DNA, 19 bp, Homo sapiens
cagtcaccccggccacctg

SEQ ID NO: 2218552 - DNA, 17 bp, Homo sapiens
cagtccctgccaatgga

SEQ ID NO: 2218553 - DNA, 13 bp, Homo sapiens
cagtcctcccatc

SEQ ID NO: 2218554 - DNA, 15 bp, Homo sapiens
cagtcctcccatctc

SEQ ID NO: 2218555 - DNA, 20 bp, Homo sapiens
cagtccttaccagcagagca

SEQ ID NO: 2218556 - DNA, 21 bp, Homo sapiens
cagtctgattcccaagctctg

SEQ ID NO: 2218557 - DNA, 15 bp, Homo sapiens
cagtctggaatgcag

SEQ ID NO: 2218558 - DNA, 19 bp, Homo sapiens
cagtctggaatgcagtggt

SEQ ID NO: 2218559 - DNA, 19 bp, Homo sapiens
cagtgaggctctgcccttg

SEQ ID NO: 2218560 - DNA, 17 bp, Homo sapiens
cagtgcatgctgtccct

SEQ ID NO: 2218561 - DNA, 22 bp, Homo sapiens
cagtgcatgctgtcccttacgt

SEQ ID NO: 2218562 - DNA, 13 bp, Homo sapiens
cagtgcccacagg

SEQ ID NO: 2218563 - DNA, 21 bp, Homo sapiens
cagtgcccacaggatcagtct

SEQ ID NO: 2218564 - DNA, 18 bp, Homo sapiens
cagtgccttatggaacac

SEQ ID NO: 2218565 - DNA, 22 bp, Homo sapiens
cagtgccttatggaacactctg

SEQ ID NO: 2218566 - DNA, 14 bp, Homo sapiens
cagtggcagctgct

SEQ ID NO: 2218567 - DNA, 16 bp, Homo sapiens
cagtggcagctgcttt

SEQ ID NO: 2218568 - DNA, 11 bp, Homo sapiens
cagtgggagct

SEQ ID NO: 2218569 - DNA, 15 bp, Homo sapiens
cagtgggagctgcct

SEQ ID NO: 2218570 - DNA, 21 bp, Homo sapiens
cagtggtatgatcacggctca

SEQ ID NO: 2218571 - DNA, 21 bp, Homo sapiens
cagtggtggttttctgttctt

SEQ ID NO: 2218572 - DNA, 22 bp, Homo sapiens
cagtggtggttttctgttcttt

SEQ ID NO: 2218573 - DNA, 20 bp, Homo sapiens
cagtgttgtggatttaacag

SEQ ID NO: 2218574 - DNA, 14 bp, Homo sapiens
cagttactcagaat

SEQ ID NO: 2218575 - DNA, 15 bp, Homo sapiens
cagttctctccttct

SEQ ID NO: 2218576 - DNA, 23 bp, Homo sapiens
cagtttgttagtatgaggcattt

SEQ ID NO: 2218577 - DNA, 21 bp, Homo sapiens
cataaaaattagccaagtgtg

SEQ ID NO: 2218578 - DNA, 14 bp, Homo sapiens
cataagataaatgt

SEQ ID NO: 2218579 - DNA, 23 bp, Homo sapiens
catacaggaaggtagaaatatct

SEQ ID NO: 2218580 - DNA, 15 bp, Homo sapiens
cataccacttttgtt

SEQ ID NO: 2218581 - DNA, 14 bp, Homo sapiens
catacccaccccca

SEQ ID NO: 2218582 - DNA, 18 bp, Homo sapiens
catacccacccccaccca

SEQ ID NO: 2218583 - DNA, 21 bp, Homo sapiens
catacccacccccacccaagg

SEQ ID NO: 2218584 - DNA, 14 bp, Homo sapiens
catactaaccagca

SEQ ID NO: 2218585 - DNA, 16 bp, Homo sapiens
catactcccatctgtg

SEQ ID NO: 2218586 - DNA, 23 bp, Homo sapiens
catagagagcaagacgctgtgct

SEQ ID NO: 2218587 - DNA, 19 bp, Homo sapiens
catagcagagaatgaaagg

SEQ ID NO: 2218588 - DNA, 20 bp, Homo sapiens
catagtatggtggctgggtt

SEQ ID NO: 2218589 - DNA, 22 bp, Homo sapiens
catagtggcttaaaacaacact

SEQ ID NO: 2218590 - DNA, 22 bp, Homo sapiens
catatgcctgggcagaaggaag

SEQ ID NO: 2218591 - DNA, 20 bp, Homo sapiens
catattcaggaagctcaggg

SEQ ID NO: 2218592 - DNA, 18 bp, Homo sapiens
catattctgttggccagt

SEQ ID NO: 2218593 - DNA, 22 bp, Homo sapiens
catattctgttggccagtgtga

SEQ ID NO: 2218594 - DNA, 13 bp, Homo sapiens
catcaggccaggc

SEQ ID NO: 2218595 - DNA, 13 bp, Homo sapiens
catcattgaaatc

SEQ ID NO: 2218596 - DNA, 17 bp, Homo sapiens
catccactgtgccatgt

SEQ ID NO: 2218597 - DNA, 19 bp, Homo sapiens
catcccaaacccttcagtg

SEQ ID NO: 2218598 - DNA, 11 bp, Homo sapiens
catccctgaag

SEQ ID NO: 2218599 - DNA, 17 bp, Homo sapiens
catccctgaaggccccg

SEQ ID NO: 2218600 - DNA, 15 bp, Homo sapiens
catcctcatacccac

SEQ ID NO: 2218601 - DNA, 16 bp, Homo sapiens
catcctcctcagatct

SEQ ID NO: 2218602 - DNA, 18 bp, Homo sapiens
catcctctgtacagagcc

SEQ ID NO: 2218603 - DNA, 22 bp, Homo sapiens
catcctggcacccggcccctgc

SEQ ID NO: 2218604 - DNA, 15 bp, Homo sapiens
catctaccctccgat

SEQ ID NO: 2218605 - DNA, 20 bp, Homo sapiens
catctcacacatgagcatca

SEQ ID NO: 2218606 - DNA, 22 bp, Homo sapiens
catcttaggttggcaaaaaggc

SEQ ID NO: 2218607 - DNA, 13 bp, Homo sapiens
catcttgctctgc

SEQ ID NO: 2218608 - DNA, 16 bp, Homo sapiens
catcttgctctgctga

SEQ ID NO: 2218609 - DNA, 19 bp, Homo sapiens
catcttgctctgctgacag

SEQ ID NO: 2218610 - DNA, 13 bp, Homo sapiens
catgaaaacacat

SEQ ID NO: 2218611 - DNA, 19 bp, Homo sapiens
catgaaaacacatttttct

SEQ ID NO: 2218612 - DNA, 15 bp, Homo sapiens
catgaagtaatatgc

SEQ ID NO: 2218613 - DNA, 19 bp, Homo sapiens
catgaagtaatatgcacac

SEQ ID NO: 2218614 - DNA, 13 bp, Homo sapiens
catgagcatcagg

SEQ ID NO: 2218615 - DNA, 17 bp, Homo sapiens
catgaggaacaaggcaa

SEQ ID NO: 2218616 - DNA, 21 bp, Homo sapiens
catgaggaacaaggcaaggct

SEQ ID NO: 2218617 - DNA, 13 bp, Homo sapiens
catgagtcccctg

SEQ ID NO: 2218618 - DNA, 14 bp, Homo sapiens
catgagtcccctgt

SEQ ID NO: 2218619 - DNA, 23 bp, Homo sapiens
catgagtcccctgtttgtttctg

SEQ ID NO: 2218620 - DNA, 23 bp, Homo sapiens
catgattaaccacttcagctgac

SEQ ID NO: 2218621 - DNA, 22 bp, Homo sapiens
catgcaaggtcattttttttaa

SEQ ID NO: 2218622 - DNA, 21 bp, Homo sapiens
catgcctggatggggctgcac

SEQ ID NO: 2218623 - DNA, 23 bp, Homo sapiens
catgcctggatggggctgcaccg

SEQ ID NO: 2218624 - DNA, 13 bp, Homo sapiens
catgctgccctgt

SEQ ID NO: 2218625 - DNA, 22 bp, Homo sapiens
catggaagtactataatttacc

SEQ ID NO: 2218626 - DNA, 15 bp, Homo sapiens
catggacttccactg

SEQ ID NO: 2218627 - DNA, 22 bp, Homo sapiens
catggcctcttcagatctctaa

SEQ ID NO: 2218628 - DNA, 17 bp, Homo sapiens
catggctgccaatggga

SEQ ID NO: 2218629 - DNA, 15 bp, Homo sapiens
catgggaatgaatgt

SEQ ID NO: 2218630 - DNA, 17 bp, Homo sapiens
catgggcctcctgtgtg

SEQ ID NO: 2218631 - DNA, 16 bp, Homo sapiens
catggtcggaaaacat

SEQ ID NO: 2218632 - DNA, 19 bp, Homo sapiens
catggtcggaaaacatgct

SEQ ID NO: 2218633 - DNA, 18 bp, Homo sapiens
catgtaattaagtactat

SEQ ID NO: 2218634 - DNA, 18 bp, Homo sapiens
catgtccaagaagcccag

SEQ ID NO: 2218635 - DNA, 20 bp, Homo sapiens
catgtccaagaagcccagga

SEQ ID NO: 2218636 - DNA, 21 bp, Homo sapiens
catgtgatgagaggaaatcac

SEQ ID NO: 2218637 - DNA, 15 bp, Homo sapiens
catgtgcacatgcac

SEQ ID NO: 2218638 - DNA, 22 bp, Homo sapiens
catgtgccaggtttttggtctg

SEQ ID NO: 2218639 - DNA, 14 bp, Homo sapiens
catgttggccaggc

SEQ ID NO: 2218640 - DNA, 18 bp, Homo sapiens
catgttggccaggctggt

SEQ ID NO: 2218641 - DNA, 12 bp, Homo sapiens
catgtttgtgat

SEQ ID NO: 2218642 - DNA, 19 bp, Homo sapiens
catgtttttcttctccctc

SEQ ID NO: 2218643 - DNA, 22 bp, Homo sapiens
cattaggtgtgactgaatttct

SEQ ID NO: 2218644 - DNA, 16 bp, Homo sapiens
cattatctagatactg

SEQ ID NO: 2218645 - DNA, 13 bp, Homo sapiens
cattctccacctg

SEQ ID NO: 2218646 - DNA, 14 bp, Homo sapiens
cattctccacctgc

SEQ ID NO: 2218647 - DNA, 19 bp, Homo sapiens
cattctccacctgccaggg

SEQ ID NO: 2218648 - DNA, 21 bp, Homo sapiens
cattctccacctgccagggac

SEQ ID NO: 2218649 - DNA, 13 bp, Homo sapiens
cattctgcctgcc

SEQ ID NO: 2218650 - DNA, 17 bp, Homo sapiens
cattctgcctgcccagg

SEQ ID NO: 2218651 - DNA, 23 bp, Homo sapiens
cattcttctgtacgtctgacagg

SEQ ID NO: 2218652 - DNA, 17 bp, Homo sapiens
cattgacctgaggccct

SEQ ID NO: 2218653 - DNA, 18 bp, Homo sapiens
cattgacctgaggccctt

SEQ ID NO: 2218654 - DNA, 14 bp, Homo sapiens
cattgcggacagcc

SEQ ID NO: 2218655 - DNA, 18 bp, Homo sapiens
cattgctgggcttgtctg

SEQ ID NO: 2218656 - DNA, 13 bp, Homo sapiens
cattgtgggaagg

SEQ ID NO: 2218657 - DNA, 15 bp, Homo sapiens
cattgtgggaagggg

SEQ ID NO: 2218658 - DNA, 17 bp, Homo sapiens
cattgttggccaaagcc

SEQ ID NO: 2218659 - DNA, 15 bp, Homo sapiens
catttaaaaaaaatc

SEQ ID NO: 2218660 - DNA, 21 bp, Homo sapiens
catttaaaagatacagttact

SEQ ID NO: 2218661 - DNA, 18 bp, Homo sapiens
catttaggtgaggaagca

SEQ ID NO: 2218662 - DNA, 14 bp, Homo sapiens
catttattctgctc

SEQ ID NO: 2218663 - DNA, 11 bp, Homo sapiens
cctgccaggga

SEQ ID NO: 2218664 - DNA, 13 bp, Homo sapiens
cctgccagggaca

SEQ ID NO: 2218665 - DNA, 22 bp, Homo sapiens
cctgccagggacagagggggtg

SEQ ID NO: 2218666 - DNA, 15 bp, Homo sapiens
cctgcccacctggcc

SEQ ID NO: 2218667 - DNA, 20 bp, Homo sapiens
cctgcccacctggcctctgc

SEQ ID NO: 2218668 - DNA, 19 bp, Homo sapiens
cctgcccaggcccctgcca

SEQ ID NO: 2218669 - DNA, 21 bp, Homo sapiens
cctgcccaggcccctgccacc

SEQ ID NO: 2218670 - DNA, 22 bp, Homo sapiens
cctgcccaggcccctgccaccc

SEQ ID NO: 2218671 - DNA, 16 bp, Homo sapiens
cctgcccccaccccag

SEQ ID NO: 2218672 - DNA, 16 bp, Homo sapiens
cctgcccggctgcgga

SEQ ID NO: 2218673 - DNA, 11 bp, Homo sapiens
cctgccctgtg

SEQ ID NO: 2218674 - DNA, 14 bp, Homo sapiens
cctgccctgtgggc

SEQ ID NO: 2218675 - DNA, 21 bp, Homo sapiens
cctgcccttacctgccaggaa

SEQ ID NO: 2218676 - DNA, 14 bp, Homo sapiens
cctgcctcagcctc

SEQ ID NO: 2218677 - DNA, 15 bp, Homo sapiens
cctgcctcagcctcc

SEQ ID NO: 2218678 - DNA, 22 bp, Homo sapiens
cctgcctcctttgtgaggaagc

SEQ ID NO: 2218679 - DNA, 23 bp, Homo sapiens
cctgcctcgaactggctgcaaag

SEQ ID NO: 2218680 - DNA, 23 bp, Homo sapiens
cctgcctgttgggccaggagcct

SEQ ID NO: 2218681 - DNA, 16 bp, Homo sapiens
cctgcggaagccacag

SEQ ID NO: 2218682 - DNA, 21 bp, Homo sapiens
cctgcggaagccacagggtga

SEQ ID NO: 2218683 - DNA, 22 bp, Homo sapiens
cctgcggaagccacagggtgag

SEQ ID NO: 2218684 - DNA, 21 bp, Homo sapiens
cctgctaattccccagattgc

SEQ ID NO: 2218685 - DNA, 14 bp, Homo sapiens
cctgctgggtgtgg

SEQ ID NO: 2218686 - DNA, 15 bp, Homo sapiens
cctggatggggctgc

SEQ ID NO: 2218687 - DNA, 23 bp, Homo sapiens
cctggcacccggcccctgctggt

SEQ ID NO: 2218688 - DNA, 12 bp, Homo sapiens
cctggcactgct

SEQ ID NO: 2218689 - DNA, 12 bp, Homo sapiens
cctggcagcccc

SEQ ID NO: 2218690 - DNA, 13 bp, Homo sapiens
cctggcatgggaa

SEQ ID NO: 2218691 - DNA, 16 bp, Homo sapiens
cctggcatgggaatga

SEQ ID NO: 2218692 - DNA, 18 bp, Homo sapiens
cctggcatgggaatgaat

SEQ ID NO: 2218693 - DNA, 22 bp, Homo sapiens
cctggcctcaagtgattctcct

SEQ ID NO: 2218694 - DNA, 15 bp, Homo sapiens
cctggcctctgcact

SEQ ID NO: 2218695 - DNA, 16 bp, Homo sapiens
cctggcctctgcactc

SEQ ID NO: 2218696 - DNA, 20 bp, Homo sapiens
cctggcctctgcactcccct

SEQ ID NO: 2218697 - DNA, 15 bp, Homo sapiens
cctggcctgagctgg

SEQ ID NO: 2218698 - DNA, 22 bp, Homo sapiens
cctgggaggtcaaggctgcagt

SEQ ID NO: 2218699 - DNA, 19 bp, Homo sapiens
cctgggggctgggcagagg

SEQ ID NO: 2218700 - DNA, 20 bp, Homo sapiens
cctgggggctgggcagagga

SEQ ID NO: 2218701 - DNA, 20 bp, Homo sapiens
cctggggtaggaggaacagg

SEQ ID NO: 2218702 - DNA, 17 bp, Homo sapiens
cctggtggcagctgcgg

SEQ ID NO: 2218703 - DNA, 14 bp, Homo sapiens
cctggtggcagtgg

SEQ ID NO: 2218704 - DNA, 20 bp, Homo sapiens
cctgtaatcctagcactttg

SEQ ID NO: 2218705 - DNA, 15 bp, Homo sapiens
cctgtagagtgggag

SEQ ID NO: 2218706 - DNA, 16 bp, Homo sapiens
cctgtagagtgggagc

SEQ ID NO: 2218707 - DNA, 19 bp, Homo sapiens
cctgtagagtgggagctga

SEQ ID NO: 2218708 - DNA, 21 bp, Homo sapiens
cctgtagagtgggagctgagt

SEQ ID NO: 2218709 - DNA, 13 bp, Homo sapiens
cctgtccccctga

SEQ ID NO: 2218710 - DNA, 16 bp, Homo sapiens
cctgtccccctgacaa

SEQ ID NO: 2218711 - DNA, 20 bp, Homo sapiens
cctgtgagtactacagtcct

SEQ ID NO: 2218712 - DNA, 18 bp, Homo sapiens
cctgtgatggggccctgc

SEQ ID NO: 2218713 - DNA, 20 bp, Homo sapiens
cctgtgatggggccctgcct

SEQ ID NO: 2218714 - DNA, 15 bp, Homo sapiens
cctgtgcctctggga

SEQ ID NO: 2218715 - DNA, 19 bp, Homo sapiens
cctgttcagctccagctca

SEQ ID NO: 2218716 - DNA, 14 bp, Homo sapiens
cctgtttgtttctg

SEQ ID NO: 2218717 - DNA, 14 bp, Homo sapiens
ccttacctgccagg

SEQ ID NO: 2218718 - DNA, 17 bp, Homo sapiens
ccttagacagtccctgc

SEQ ID NO: 2218719 - DNA, 19 bp, Homo sapiens
ccttagcagggaaacagct

SEQ ID NO: 2218720 - DNA, 22 bp, Homo sapiens
ccttatggaacactctgagact

SEQ ID NO: 2218721 - DNA, 20 bp, Homo sapiens
ccttcacctttgtccccacc

SEQ ID NO: 2218722 - DNA, 21 bp, Homo sapiens
ccttcacctttgtccccaccg

SEQ ID NO: 2218723 - DNA, 10 bp, Homo sapiens
ccttcagtgc

SEQ ID NO: 2218724 - DNA, 11 bp, Homo sapiens
ccttcagtgcc

SEQ ID NO: 2218725 - DNA, 19 bp, Homo sapiens
ccttcagtgccttatggaa

SEQ ID NO: 2218726 - DNA, 19 bp, Homo sapiens
ccttcatttggcattcccc

SEQ ID NO: 2218727 - DNA, 22 bp, Homo sapiens
ccttcatttggcattccccact

SEQ ID NO: 2218728 - DNA, 18 bp, Homo sapiens
ccttccaggggtgggaca

SEQ ID NO: 2218729 - DNA, 14 bp, Homo sapiens
ccttcgctcctgtg

SEQ ID NO: 2218730 - DNA, 18 bp, Homo sapiens
ccttcgctcctgtgtctt

SEQ ID NO: 2218731 - DNA, 19 bp, Homo sapiens
ccttctccttcacctttgt

SEQ ID NO: 2218732 - DNA, 13 bp, Homo sapiens
ccttctctccagc

SEQ ID NO: 2218733 - DNA, 15 bp, Homo sapiens
ccttctctccagccc

SEQ ID NO: 2218734 - DNA, 18 bp, Homo sapiens
ccttctctccagcccctg

SEQ ID NO: 2218735 - DNA, 14 bp, Homo sapiens
ccttctctgaagga

SEQ ID NO: 2218736 - DNA, 17 bp, Homo sapiens
ccttctgacccatgctg

SEQ ID NO: 2218737 - DNA, 22 bp, Homo sapiens
ccttctgacccatgctgccctg

SEQ ID NO: 2218738 - DNA, 21 bp, Homo sapiens
ccttctgtcctactctgtgtc

SEQ ID NO: 2218739 - DNA, 15 bp, Homo sapiens
ccttgaaaacactgt

SEQ ID NO: 2218740 - DNA, 19 bp, Homo sapiens
ccttgaaaacactgttctc

SEQ ID NO: 2218741 - DNA, 19 bp, Homo sapiens
ccttgaactttgacctctg

SEQ ID NO: 2218742 - DNA, 13 bp, Homo sapiens
ccttgacagggca

SEQ ID NO: 2218743 - DNA, 18 bp, Homo sapiens
ccttgacagggcacaccg

SEQ ID NO: 2218744 - DNA, 19 bp, Homo sapiens
ccttgaccattctccacct

SEQ ID NO: 2218745 - DNA, 20 bp, Homo sapiens
ccttgaccattctccacctg

SEQ ID NO: 2218746 - DNA, 12 bp, Homo sapiens
ccttgcccaggc

SEQ ID NO: 2218747 - DNA, 14 bp, Homo sapiens
ccttgcccaggcct

SEQ ID NO: 2218748 - DNA, 16 bp, Homo sapiens
ccttgccgtctacctg

SEQ ID NO: 2218749 - DNA, 17 bp, Homo sapiens
ccttgccgtctacctga

SEQ ID NO: 2218750 - DNA, 22 bp, Homo sapiens
ccttggctcaagtcctcttttc

SEQ ID NO: 2218751 - DNA, 16 bp, Homo sapiens
ccttggctgcagggag

SEQ ID NO: 2218752 - DNA, 19 bp, Homo sapiens
ccttggtgtcgggcatgac

SEQ ID NO: 2218753 - DNA, 21 bp, Homo sapiens
ccttggtgtcgggcatgacac

SEQ ID NO: 2218754 - DNA, 22 bp, Homo sapiens
ccttggttaggcattgtgggaa

SEQ ID NO: 2218755 - DNA, 19 bp, Homo sapiens
ccttgtggtcccaccccac

SEQ ID NO: 2218756 - DNA, 20 bp, Homo sapiens
ccttgtggtcccaccccaca

SEQ ID NO: 2218757 - DNA, 13 bp, Homo sapiens
cctttaagagaaa

SEQ ID NO: 2218758 - DNA, 14 bp, Homo sapiens
cctttaagagaaat

SEQ ID NO: 2218759 - DNA, 20 bp, Homo sapiens
cctttagcgcccagttgggt

SEQ ID NO: 2218760 - DNA, 21 bp, Homo sapiens
cctttcaataggaaaaactga

SEQ ID NO: 2218761 - DNA, 17 bp, Homo sapiens
cctttgacgccatccca

SEQ ID NO: 2218762 - DNA, 20 bp, Homo sapiens
cctttgacgccatcccagcc

SEQ ID NO: 2218763 - DNA, 15 bp, Homo sapiens
cctttgtattctctc

SEQ ID NO: 2218764 - DNA, 20 bp, Homo sapiens
cctttgtattctctcctgta

SEQ ID NO: 2218765 - DNA, 14 bp, Homo sapiens
cctttgtgaggaag

SEQ ID NO: 2218766 - DNA, 15 bp, Homo sapiens
cctttgtgaggaagc

SEQ ID NO: 2218767 - DNA, 15 bp, Homo sapiens
ccttttgagtgcctt

SEQ ID NO: 2218768 - DNA, 12 bp, Homo sapiens
ccttttttatac

SEQ ID NO: 2218769 - DNA, 18 bp, Homo sapiens
ccttttttatacataaac

SEQ ID NO: 2218770 - DNA, 19 bp, Homo sapiens
ccttttttatacataaaca

SEQ ID NO: 2218771 - DNA, 17 bp, Homo sapiens
ccttttttggctgctga

SEQ ID NO: 2218772 - DNA, 22 bp, Homo sapiens
ccttttttggctgctgaaggct

SEQ ID NO: 2218773 - DNA, 15 bp, Homo sapiens
cgaaaacgtggctgc

SEQ ID NO: 2218774 - DNA, 14 bp, Homo sapiens
cgaactggctgcaa

SEQ ID NO: 2218775 - DNA, 15 bp, Homo sapiens
cgaatagctgggact

SEQ ID NO: 2218776 - DNA, 17 bp, Homo sapiens
cgaatattgctgatggt

SEQ ID NO: 2218777 - DNA, 11 bp, Homo sapiens
cgaccaccccc

SEQ ID NO: 2218778 - DNA, 19 bp, Homo sapiens
cgacccttgccgtctacct

SEQ ID NO: 2218779 - DNA, 17 bp, Homo sapiens
cgactgcccggcagggt

SEQ ID NO: 2218780 - DNA, 18 bp, Homo sapiens
cgagatagccaaggccaa

SEQ ID NO: 2218781 - DNA, 13 bp, Homo sapiens
cgagcatgcctgg

SEQ ID NO: 2218782 - DNA, 17 bp, Homo sapiens
cgagcatgcctggatgg

SEQ ID NO: 2218783 - DNA, 18 bp, Homo sapiens
cgagcatgcctggatggg

SEQ ID NO: 2218784 - DNA, 15 bp, Homo sapiens
cgagccctggtggca

SEQ ID NO: 2218785 - DNA, 16 bp, Homo sapiens
cgagccctggtggcag

SEQ ID NO: 2218786 - DNA, 19 bp, Homo sapiens
cgagccctggtggcagtgg

SEQ ID NO: 2218787 - DNA, 15 bp, Homo sapiens
ctgcaccggctggcc

SEQ ID NO: 2218788 - DNA, 22 bp, Homo sapiens
ctgcaccggctggcctggcccc

SEQ ID NO: 2218789 - DNA, 23 bp, Homo sapiens
ctgcaccggctggcctggcccct

SEQ ID NO: 2218790 - DNA, 12 bp, Homo sapiens
ctgcaccgggcc

SEQ ID NO: 2218791 - DNA, 13 bp, Homo sapiens
ctgcactccagcc

SEQ ID NO: 2218792 - DNA, 20 bp, Homo sapiens
ctgcactccagcctgggtga

SEQ ID NO: 2218793 - DNA, 13 bp, Homo sapiens
ctgcactcccctg

SEQ ID NO: 2218794 - DNA, 17 bp, Homo sapiens
ctgcactcccctgctgg

SEQ ID NO: 2218795 - DNA, 20 bp, Homo sapiens
ctgcactcccctgctgggtg

SEQ ID NO: 2218796 - DNA, 14 bp, Homo sapiens
ctgcacttgcagac

SEQ ID NO: 2218797 - DNA, 16 bp, Homo sapiens
ctgcacttgcagactc

SEQ ID NO: 2218798 - DNA, 10 bp, Homo sapiens
ctgcagaggg

SEQ ID NO: 2218799 - DNA, 13 bp, Homo sapiens
ctgcagagggcac

SEQ ID NO: 2218800 - DNA, 24 bp, Homo sapiens
ctgcagcctcaacctcctgggcta

SEQ ID NO: 2218801 - DNA, 22 bp, Homo sapiens
ctgcagggagtccgaaagggac

SEQ ID NO: 2218802 - DNA, 13 bp, Homo sapiens
ctgcagttgccag

SEQ ID NO: 2218803 - DNA, 22 bp, Homo sapiens
ctgcatcgtttcatcttccaac

SEQ ID NO: 2218804 - DNA, 15 bp, Homo sapiens
ctgcatgtttgtgat

SEQ ID NO: 2218805 - DNA, 22 bp, Homo sapiens
ctgcatttaaaagatacagtta

SEQ ID NO: 2218806 - DNA, 15 bp, Homo sapiens
ctgccaatgggagct

SEQ ID NO: 2218807 - DNA, 19 bp, Homo sapiens
ctgccaatgggagctcatg

SEQ ID NO: 2218808 - DNA, 14 bp, Homo sapiens
ctgccaccctgggg

SEQ ID NO: 2218809 - DNA, 20 bp, Homo sapiens
ctgccaccctggggagaaag

SEQ ID NO: 2218810 - DNA, 13 bp, Homo sapiens
ctgccaggaagcc

SEQ ID NO: 2218811 - DNA, 15 bp, Homo sapiens
ctgccaggaagccag

SEQ ID NO: 2218812 - DNA, 19 bp, Homo sapiens
ctgccaggaagccagcagg

SEQ ID NO: 2218813 - DNA, 11 bp, Homo sapiens
ctgccagggac

SEQ ID NO: 2218814 - DNA, 12 bp, Homo sapiens
ctgccagggaca

SEQ ID NO: 2218815 - DNA, 23 bp, Homo sapiens
ctgccatattctgttggccagtg

SEQ ID NO: 2218816 - DNA, 21 bp, Homo sapiens
ctgccatccaggttcagcttg

SEQ ID NO: 2218817 - DNA, 15 bp, Homo sapiens
ctgccatcctcccaa

SEQ ID NO: 2218818 - DNA, 14 bp, Homo sapiens
ctgccatgccagct

SEQ ID NO: 2218819 - DNA, 17 bp, Homo sapiens
ctgccatgccagcttat

SEQ ID NO: 2218820 - DNA, 15 bp, Homo sapiens
ctgcccacctggcct

SEQ ID NO: 2218821 - DNA, 15 bp, Homo sapiens
ctgcccactccctgc

SEQ ID NO: 2218822 - DNA, 14 bp, Homo sapiens
ctgcccaggcccct

SEQ ID NO: 2218823 - DNA, 14 bp, Homo sapiens
ctgcccccacccca

SEQ ID NO: 2218824 - DNA, 19 bp, Homo sapiens
ctgcccccaccccaggctg

SEQ ID NO: 2218825 - DNA, 22 bp, Homo sapiens
ctgcccctcaactctcctccag

SEQ ID NO: 2218826 - DNA, 19 bp, Homo sapiens
ctgcccctggcagcccctg

SEQ ID NO: 2218827 - DNA, 20 bp, Homo sapiens
ctgcccggcagggtcctaga

SEQ ID NO: 2218828 - DNA, 11 bp, Homo sapiens
ctgcccggctg

SEQ ID NO: 2218829 - DNA, 12 bp, Homo sapiens
ctgccctccaag

SEQ ID NO: 2218830 - DNA, 19 bp, Homo sapiens
ctgccctccaagaccttct

SEQ ID NO: 2218831 - DNA, 15 bp, Homo sapiens
ctgccctcccacccc

SEQ ID NO: 2218832 - DNA, 22 bp, Homo sapiens
ctgccctcccaccccctccccg

SEQ ID NO: 2218833 - DNA, 23 bp, Homo sapiens
ctgccctcccaccccctccccgg

SEQ ID NO: 2218834 - DNA, 16 bp, Homo sapiens
ctgccctgcccacctg

SEQ ID NO: 2218835 - DNA, 20 bp, Homo sapiens
ctgccctgcccacctggcct

SEQ ID NO: 2218836 - DNA, 11 bp, Homo sapiens
ctgccctgtgg

SEQ ID NO: 2218837 - DNA, 12 bp, Homo sapiens
ctgccctgtggg

SEQ ID NO: 2218838 - DNA, 19 bp, Homo sapiens
ctgccctgtgggcccccaa

SEQ ID NO: 2218839 - DNA, 22 bp, Homo sapiens
ctgcccttacctgccaggaagc

SEQ ID NO: 2218840 - DNA, 21 bp, Homo sapiens
ctgccgcagccctgcagaggg

SEQ ID NO: 2218841 - DNA, 13 bp, Homo sapiens
ctgcctcagcctc

SEQ ID NO: 2218842 - DNA, 14 bp, Homo sapiens
ctgcctcccatcac

SEQ ID NO: 2218843 - DNA, 21 bp, Homo sapiens
ctgcctcctttgtgaggaagc

SEQ ID NO: 2218844 - DNA, 14 bp, Homo sapiens
ctgcctcgaactgg

SEQ ID NO: 2218845 - DNA, 15 bp, Homo sapiens
ctgcctcgaactggc

SEQ ID NO: 2218846 - DNA, 17 bp, Homo sapiens
ctgcctctgacacacag

SEQ ID NO: 2218847 - DNA, 15 bp, Homo sapiens
ctgcctcttctctac

SEQ ID NO: 2218848 - DNA, 18 bp, Homo sapiens
ctgcctgaagtcacacag

SEQ ID NO: 2218849 - DNA, 13 bp, Homo sapiens
ctgcctgcccagg

SEQ ID NO: 2218850 - DNA, 16 bp, Homo sapiens
ctgcctgcccaggccc

SEQ ID NO: 2218851 - DNA, 20 bp, Homo sapiens
ctgcctgttcagctccagct

SEQ ID NO: 2218852 - DNA, 23 bp, Homo sapiens
ctgcctgttgggccaggagcctc

SEQ ID NO: 2218853 - DNA, 20 bp, Homo sapiens
ctgcggaagccacagggtga

SEQ ID NO: 2218854 - DNA, 16 bp, Homo sapiens
ctgcggtccacccagg

SEQ ID NO: 2218855 - DNA, 18 bp, Homo sapiens
ctgcggtccacccaggag

SEQ ID NO: 2218856 - DNA, 19 bp, Homo sapiens
ctgctcacatatctgtcat

SEQ ID NO: 2218857 - DNA, 15 bp, Homo sapiens
ctgctccagctgttc

SEQ ID NO: 2218858 - DNA, 20 bp, Homo sapiens
ctgctccagctgttcagctg

SEQ ID NO: 2218859 - DNA, 11 bp, Homo sapiens
ctgctgaaggc

SEQ ID NO: 2218860 - DNA, 12 bp, Homo sapiens
ctgctgaaggct

SEQ ID NO: 2218861 - DNA, 24 bp, Homo sapiens
ctgctgaaggctcgagcatgcctg

SEQ ID NO: 2218862 - DNA, 23 bp, Homo sapiens
ctgctgacagacacaggcccggc

SEQ ID NO: 2218863 - DNA, 15 bp, Homo sapiens
ctgctgacagtgttg

SEQ ID NO: 2218864 - DNA, 21 bp, Homo sapiens
ctgctgactgttttctcttga

SEQ ID NO: 2218865 - DNA, 14 bp, Homo sapiens
ctgctgggtgtggc

SEQ ID NO: 2218866 - DNA, 20 bp, Homo sapiens
aagccagcaggctctcaggc

SEQ ID NO: 2218867 - DNA, 23 bp, Homo sapiens
aagccagcaggctctcaggccag

SEQ ID NO: 2218868 - DNA, 22 bp, Homo sapiens
aagcccaggaaaggctccagga

SEQ ID NO: 2218869 - DNA, 19 bp, Homo sapiens
aagccctgagctttctgct

SEQ ID NO: 2218870 - DNA, 17 bp, Homo sapiens
aagcgaaccgtgaggag

SEQ ID NO: 2218871 - DNA, 15 bp, Homo sapiens
aagcgtgagccactg

SEQ ID NO: 2218872 - DNA, 12 bp, Homo sapiens
aagctaggcctg

SEQ ID NO: 2218873 - DNA, 12 bp, Homo sapiens
aagctcagggcc

SEQ ID NO: 2218874 - DNA, 13 bp, Homo sapiens
aagctcagggcct

SEQ ID NO: 2218875 - DNA, 17 bp, Homo sapiens
aagctccaagctcccag

SEQ ID NO: 2218876 - DNA, 18 bp, Homo sapiens
aagctccaagctcccagg

SEQ ID NO: 2218877 - DNA, 12 bp, Homo sapiens
aagctcccaggc

SEQ ID NO: 2218878 - DNA, 17 bp, Homo sapiens
aagctctgctcctctcc

SEQ ID NO: 2218879 - DNA, 21 bp, Homo sapiens
aagctgcaccctcaggcaggt

SEQ ID NO: 2218880 - DNA, 12 bp, Homo sapiens
aagctgccagcc

SEQ ID NO: 2218881 - DNA, 13 bp, Homo sapiens
aagctgggcaggt

SEQ ID NO: 2218882 - DNA, 21 bp, Homo sapiens
aagctggtcccactcagtcca

SEQ ID NO: 2218883 - DNA, 18 bp, Homo sapiens
aagctgttactgtcttca

SEQ ID NO: 2218884 - DNA, 17 bp, Homo sapiens
aaggaaacccagctctg

SEQ ID NO: 2218885 - DNA, 13 bp, Homo sapiens
aaggaagcacatg

SEQ ID NO: 2218886 - DNA, 17 bp, Homo sapiens
aaggaatacctgtcccc

SEQ ID NO: 2218887 - DNA, 13 bp, Homo sapiens
aaggacactagaa

SEQ ID NO: 2218888 - DNA, 18 bp, Homo sapiens
aaggaggaagagaaaaaa

SEQ ID NO: 2218889 - DNA, 20 bp, Homo sapiens
aaggaggaagagaaaaaata

SEQ ID NO: 2218890 - DNA, 13 bp, Homo sapiens
aaggatacaaaag

SEQ ID NO: 2218891 - DNA, 17 bp, Homo sapiens
aaggatcctgagccaga

SEQ ID NO: 2218892 - DNA, 15 bp, Homo sapiens
aaggatgcttgtaca

SEQ ID NO: 2218893 - DNA, 13 bp, Homo sapiens
aaggcaaggctgt

SEQ ID NO: 2218894 - DNA, 15 bp, Homo sapiens
aaggctacctttgta

SEQ ID NO: 2218895 - DNA, 16 bp, Homo sapiens
aaggctccaggagcag

SEQ ID NO: 2218896 - DNA, 22 bp, Homo sapiens
aaggctgggggaagaagctctc

SEQ ID NO: 2218897 - DNA, 13 bp, Homo sapiens
aagggaaaaagac

SEQ ID NO: 2218898 - DNA, 14 bp, Homo sapiens
aaggggcagtggtg

SEQ ID NO: 2218899 - DNA, 23 bp, Homo sapiens
aagggggctgggacatgggaaag

SEQ ID NO: 2218900 - DNA, 18 bp, Homo sapiens
aaggggggtgggagggga

SEQ ID NO: 2218901 - DNA, 12 bp, Homo sapiens
aaggtcattttt

SEQ ID NO: 2218902 - DNA, 18 bp, Homo sapiens
aaggtcattttttttaag

SEQ ID NO: 2218903 - DNA, 15 bp, Homo sapiens
aaggttaataaagta

SEQ ID NO: 2218904 - DNA, 23 bp, Homo sapiens
aagtacactgtttcaaactttac

SEQ ID NO: 2218905 - DNA, 14 bp, Homo sapiens
aagtactataattt

SEQ ID NO: 2218906 - DNA, 15 bp, Homo sapiens
aagtactggagaaaa

SEQ ID NO: 2218907 - DNA, 18 bp, Homo sapiens
aagtacttctccaccctg

SEQ ID NO: 2218908 - DNA, 21 bp, Homo sapiens
aagtacttctccaccctgctc

SEQ ID NO: 2218909 - DNA, 20 bp, Homo sapiens
aagtagaagtcttagatgta

SEQ ID NO: 2218910 - DNA, 21 bp, Homo sapiens
aagtagaagtcttagatgtat

SEQ ID NO: 2218911 - DNA, 18 bp, Homo sapiens
aagtattcttatttaatg

SEQ ID NO: 2218912 - DNA, 23 bp, Homo sapiens
aagtattcttatttaatgaaaga

SEQ ID NO: 2218913 - DNA, 24 bp, Homo sapiens
aagtcacacagtattacttctgct

SEQ ID NO: 2218914 - DNA, 13 bp, Homo sapiens
aagtcacacagtg

SEQ ID NO: 2218915 - DNA, 22 bp, Homo sapiens
aagtcctcttttctgagaggac

SEQ ID NO: 2218916 - DNA, 17 bp, Homo sapiens
aagtcttagatgtatat

SEQ ID NO: 2218917 - DNA, 12 bp, Homo sapiens
aagtgagagagg

SEQ ID NO: 2218918 - DNA, 18 bp, Homo sapiens
aagtgtatttttttacta

SEQ ID NO: 2218919 - DNA, 22 bp, Homo sapiens
accagagcccaccttggctcaa

SEQ ID NO: 2218920 - DNA, 14 bp, Homo sapiens
accagagctgccac

SEQ ID NO: 2218921 - DNA, 19 bp, Homo sapiens
accagagctgccacctgcc

SEQ ID NO: 2218922 - DNA, 13 bp, Homo sapiens
accagcagagcac

SEQ ID NO: 2218923 - DNA, 20 bp, Homo sapiens
accagccccagtgcccacag

SEQ ID NO: 2218924 - DNA, 22 bp, Homo sapiens
accagcgtgtgactactccccc

SEQ ID NO: 2218925 - DNA, 15 bp, Homo sapiens
accagtgttgtggat

SEQ ID NO: 2218926 - DNA, 14 bp, Homo sapiens
accatcatgtctgg

SEQ ID NO: 2218927 - DNA, 18 bp, Homo sapiens
accatccctgaaggcccc

SEQ ID NO: 2218928 - DNA, 23 bp, Homo sapiens
accatgattaaccacttcagctg

SEQ ID NO: 2218929 - DNA, 22 bp, Homo sapiens
accatggtcggaaaacatgcta

SEQ ID NO: 2218930 - DNA, 13 bp, Homo sapiens
accattctccacc

SEQ ID NO: 2218931 - DNA, 16 bp, Homo sapiens
accattctccacctgc

SEQ ID NO: 2218932 - DNA, 18 bp, Homo sapiens
accattctccacctgcca

SEQ ID NO: 2218933 - DNA, 19 bp, Homo sapiens
accattctccacctgccag

SEQ ID NO: 2218934 - DNA, 21 bp, Homo sapiens
accattctccacctgccaggg

SEQ ID NO: 2218935 - DNA, 22 bp, Homo sapiens
accattttgctgtcccttttcc

SEQ ID NO: 2218936 - DNA, 23 bp, Homo sapiens
accattttgctgtcccttttcct

SEQ ID NO: 2218937 - DNA, 21 bp, Homo sapiens
accattttggggtacccactg

SEQ ID NO: 2218938 - DNA, 23 bp, Homo sapiens
accattttggggtacccactgct

SEQ ID NO: 2218939 - DNA, 13 bp, Homo sapiens
acccaagggcctg

SEQ ID NO: 2218940 - DNA, 19 bp, Homo sapiens
acccaagggcctggcctga

SEQ ID NO: 2218941 - DNA, 23 bp, Homo sapiens
acccaagggcctggcctgagctg

SEQ ID NO: 2218942 - DNA, 15 bp, Homo sapiens
acccacctcagcctc

SEQ ID NO: 2218943 - DNA, 11 bp, Homo sapiens
acccactgctc

SEQ ID NO: 2218944 - DNA, 13 bp, Homo sapiens
acccactgctctg

SEQ ID NO: 2218945 - DNA, 14 bp, Homo sapiens
acccactgctctgg

SEQ ID NO: 2218946 - DNA, 15 bp, Homo sapiens
acccactgctctggt

SEQ ID NO: 2218947 - DNA, 20 bp, Homo sapiens
acccactgcttttggtctgt

SEQ ID NO: 2218948 - DNA, 15 bp, Homo sapiens
acccagcccacttct

SEQ ID NO: 2218949 - DNA, 13 bp, Homo sapiens
acccagcgagccc

SEQ ID NO: 2218950 - DNA, 24 bp, Homo sapiens
acccagcgagccctggtggcagtg

SEQ ID NO: 2218951 - DNA, 15 bp, Homo sapiens
acccagctctggtcc

SEQ ID NO: 2218952 - DNA, 13 bp, Homo sapiens
acccaggagcccc

SEQ ID NO: 2218953 - DNA, 18 bp, Homo sapiens
acccatgctgccctgtga

SEQ ID NO: 2218954 - DNA, 10 bp, Homo sapiens
accccaggct

SEQ ID NO: 2218955 - DNA, 13 bp, Homo sapiens
accccaggctggg

SEQ ID NO: 2218956 - DNA, 22 bp, Homo sapiens
accccaggctgggctgttcact

SEQ ID NO: 2218957 - DNA, 13 bp, Homo sapiens
accccaggtttct

SEQ ID NO: 2218958 - DNA, 16 bp, Homo sapiens
acccccttgcccaggc

SEQ ID NO: 2218959 - DNA, 21 bp, Homo sapiens
accccgcctgccctcccaccc

SEQ ID NO: 2218960 - DNA, 20 bp, Homo sapiens
acccctcaacacctctgcac

SEQ ID NO: 2218961 - DNA, 16 bp, Homo sapiens
acccctccatgtgggc

SEQ ID NO: 2218962 - DNA, 15 bp, Homo sapiens
accccttcgctcctg

SEQ ID NO: 2218963 - DNA, 16 bp, Homo sapiens
accccttcgctcctgt

SEQ ID NO: 2218964 - DNA, 19 bp, Homo sapiens
accccttcgctcctgtgtc

SEQ ID NO: 2218965 - DNA, 20 bp, Homo sapiens
accccttcgctcctgtgtct

SEQ ID NO: 2218966 - DNA, 20 bp, Homo sapiens
acccggcccctgctggttca

SEQ ID NO: 2218967 - DNA, 13 bp, Homo sapiens
acccgggaagggg

SEQ ID NO: 2218968 - DNA, 19 bp, Homo sapiens
accctattgctgcttgagg

SEQ ID NO: 2218969 - DNA, 13 bp, Homo sapiens
caccgcagacagg

SEQ ID NO: 2218970 - DNA, 23 bp, Homo sapiens
cacctaggtggggcctggggtag

SEQ ID NO: 2218971 - DNA, 12 bp, Homo sapiens
cacctcagcctc

SEQ ID NO: 2218972 - DNA, 17 bp, Homo sapiens
cacctctctcactcctt

SEQ ID NO: 2218973 - DNA, 18 bp, Homo sapiens
cacctctctcactccttg

SEQ ID NO: 2218974 - DNA, 19 bp, Homo sapiens
cacctctgcacaagctgca

SEQ ID NO: 2218975 - DNA, 14 bp, Homo sapiens
cacctgaagactca

SEQ ID NO: 2218976 - DNA, 12 bp, Homo sapiens
cacctgccaggg

SEQ ID NO: 2218977 - DNA, 17 bp, Homo sapiens
cacctgccagggacaga

SEQ ID NO: 2218978 - DNA, 16 bp, Homo sapiens
cacctgcccctcaact

SEQ ID NO: 2218979 - DNA, 18 bp, Homo sapiens
cacctgcccctcaactct

SEQ ID NO: 2218980 - DNA, 24 bp, Homo sapiens
cacctgcctgttgggccaggagcc

SEQ ID NO: 2218981 - DNA, 19 bp, Homo sapiens
cacctgcggtgctatctcc

SEQ ID NO: 2218982 - DNA, 20 bp, Homo sapiens
cacctgcggtgctatctccc

SEQ ID NO: 2218983 - DNA, 12 bp, Homo sapiens
cacctggcctct

SEQ ID NO: 2218984 - DNA, 19 bp, Homo sapiens
cacctggcctctgcactcc

SEQ ID NO: 2218985 - DNA, 19 bp, Homo sapiens
caccttagacagtccctgc

SEQ ID NO: 2218986 - DNA, 21 bp, Homo sapiens
caccttagacagtccctgcca

SEQ ID NO: 2218987 - DNA, 14 bp, Homo sapiens
caccttggctgcag

SEQ ID NO: 2218988 - DNA, 15 bp, Homo sapiens
caccttggctgcagg

SEQ ID NO: 2218989 - DNA, 17 bp, Homo sapiens
cacgactgcccggcagg

SEQ ID NO: 2218990 - DNA, 15 bp, Homo sapiens
cacgcccccactggt

SEQ ID NO: 2218991 - DNA, 21 bp, Homo sapiens
cacgcgtgcacacaccagagc

SEQ ID NO: 2218992 - DNA, 17 bp, Homo sapiens
cacgctggaccttgaac

SEQ ID NO: 2218993 - DNA, 22 bp, Homo sapiens
cacggaagagccttgcggaagg

SEQ ID NO: 2218994 - DNA, 15 bp, Homo sapiens
cacggccaggccaga

SEQ ID NO: 2218995 - DNA, 15 bp, Homo sapiens
cacggctcactgcag

SEQ ID NO: 2218996 - DNA, 16 bp, Homo sapiens
cacggctcactgcagc

SEQ ID NO: 2218997 - DNA, 22 bp, Homo sapiens
cacgtccctgcggaagccacag

SEQ ID NO: 2218998 - DNA, 16 bp, Homo sapiens
cacgtggtcctaatct

SEQ ID NO: 2218999 - DNA, 17 bp, Homo sapiens
cactaaggtgtgctctg

SEQ ID NO: 2219000 - DNA, 13 bp, Homo sapiens
cactacattctgt

SEQ ID NO: 2219001 - DNA, 17 bp, Homo sapiens
cactacattctgttaat

SEQ ID NO: 2219002 - DNA, 23 bp, Homo sapiens
cactacggaatagttggctagga

SEQ ID NO: 2219003 - DNA, 15 bp, Homo sapiens
cactatgttgcccag

SEQ ID NO: 2219004 - DNA, 18 bp, Homo sapiens
cactatgttgcccaggca

SEQ ID NO: 2219005 - DNA, 19 bp, Homo sapiens
atattgatttccgttaaaa

SEQ ID NO: 2219006 - DNA, 22 bp, Homo sapiens
atattgatttccgttaaaatac

SEQ ID NO: 2219007 - DNA, 22 bp, Homo sapiens
atattgctgatggtgcaatgac

SEQ ID NO: 2219008 - DNA, 19 bp, Homo sapiens
atcaaccccttcgctcctg

SEQ ID NO: 2219009 - DNA, 13 bp, Homo sapiens
atcaagtattata

SEQ ID NO: 2219010 - DNA, 14 bp, Homo sapiens
atcaagtattatac

SEQ ID NO: 2219011 - DNA, 14 bp, Homo sapiens
atcaatgagtaaca

SEQ ID NO: 2219012 - DNA, 21 bp, Homo sapiens
atcacagcctctgaaaaccaa

SEQ ID NO: 2219013 - DNA, 20 bp, Homo sapiens
atcaccaacgtctgtgccat

SEQ ID NO: 2219014 - DNA, 14 bp, Homo sapiens
atcaccgaaaacgt

SEQ ID NO: 2219015 - DNA, 18 bp, Homo sapiens
atcacggctcactgcagc

SEQ ID NO: 2219016 - DNA, 13 bp, Homo sapiens
atcagcacgattt

SEQ ID NO: 2219017 - DNA, 18 bp, Homo sapiens
atcagcctgctccagctg

SEQ ID NO: 2219018 - DNA, 11 bp, Homo sapiens
atcagcctggg

SEQ ID NO: 2219019 - DNA, 13 bp, Homo sapiens
atcaggccaggcc

SEQ ID NO: 2219020 - DNA, 14 bp, Homo sapiens
atcaggccaggccc

SEQ ID NO: 2219021 - DNA, 15 bp, Homo sapiens
atcaggccaggccct

SEQ ID NO: 2219022 - DNA, 18 bp, Homo sapiens
atcaggccaggccctctg

SEQ ID NO: 2219023 - DNA, 20 bp, Homo sapiens
atcaggccaggccctctgcc

SEQ ID NO: 2219024 - DNA, 21 bp, Homo sapiens
atcaggccaggccctctgccc

SEQ ID NO: 2219025 - DNA, 22 bp, Homo sapiens
atcaggccaggccctctgccca

SEQ ID NO: 2219026 - DNA, 17 bp, Homo sapiens
atcaggtgctgccatcc

SEQ ID NO: 2219027 - DNA, 15 bp, Homo sapiens
atcatcctaagctat

SEQ ID NO: 2219028 - DNA, 12 bp, Homo sapiens
atcattgaaatc

SEQ ID NO: 2219029 - DNA, 20 bp, Homo sapiens
atcattgaaatctttttgct

SEQ ID NO: 2219030 - DNA, 21 bp, Homo sapiens
atcattgaaatctttttgctt

SEQ ID NO: 2219031 - DNA, 15 bp, Homo sapiens
atccacccacctcag

SEQ ID NO: 2219032 - DNA, 18 bp, Homo sapiens
atccacccacctcagcct

SEQ ID NO: 2219033 - DNA, 19 bp, Homo sapiens
atccagacccggctgcgtg

SEQ ID NO: 2219034 - DNA, 15 bp, Homo sapiens
atccaggttcagctt

SEQ ID NO: 2219035 - DNA, 11 bp, Homo sapiens
atcccagcccc

SEQ ID NO: 2219036 - DNA, 17 bp, Homo sapiens
atcccatatgcctgggc

SEQ ID NO: 2219037 - DNA, 18 bp, Homo sapiens
atcccatatgcctgggca

SEQ ID NO: 2219038 - DNA, 16 bp, Homo sapiens
atcccatgagcctcag

SEQ ID NO: 2219039 - DNA, 17 bp, Homo sapiens
atcccatgagcctcagc

SEQ ID NO: 2219040 - DNA, 22 bp, Homo sapiens
atccctgaaggccccgcccagg

SEQ ID NO: 2219041 - DNA, 12 bp, Homo sapiens
atcctaagctat

SEQ ID NO: 2219042 - DNA, 19 bp, Homo sapiens
atcctagttccaccatcaa

SEQ ID NO: 2219043 - DNA, 11 bp, Homo sapiens
atcctccaggt

SEQ ID NO: 2219044 - DNA, 13 bp, Homo sapiens
atcctccaggtgc

SEQ ID NO: 2219045 - DNA, 14 bp, Homo sapiens
atcctccaggtgca

SEQ ID NO: 2219046 - DNA, 23 bp, Homo sapiens
atcctccaggtgcacaagctcca

SEQ ID NO: 2219047 - DNA, 19 bp, Homo sapiens
atcctcccacctcagcctc

SEQ ID NO: 2219048 - DNA, 20 bp, Homo sapiens
atcctcccacctcagcctcc

SEQ ID NO: 2219049 - DNA, 20 bp, Homo sapiens
atcctctgtacagagcccac

SEQ ID NO: 2219050 - DNA, 13 bp, Homo sapiens
atcctgagccaga

SEQ ID NO: 2219051 - DNA, 17 bp, Homo sapiens
atcctgagccagatttc

SEQ ID NO: 2219052 - DNA, 17 bp, Homo sapiens
atcctggcacccggccc

SEQ ID NO: 2219053 - DNA, 19 bp, Homo sapiens
atcctggcacccggcccct

SEQ ID NO: 2219054 - DNA, 21 bp, Homo sapiens
atcctggcacccggcccctgc

SEQ ID NO: 2219055 - DNA, 13 bp, Homo sapiens
atcgatgcagtgc

SEQ ID NO: 2219056 - DNA, 18 bp, Homo sapiens
atcgtcactgcttaactt

SEQ ID NO: 2219057 - DNA, 19 bp, Homo sapiens
atctaaatggaaccactct

SEQ ID NO: 2219058 - DNA, 18 bp, Homo sapiens
atctaatatgtaacaagc

SEQ ID NO: 2219059 - DNA, 19 bp, Homo sapiens
atctaggaagactttggaa

SEQ ID NO: 2219060 - DNA, 23 bp, Homo sapiens
atctaggaagactttggaaagag

SEQ ID NO: 2219061 - DNA, 13 bp, Homo sapiens
atctcccccagcc

SEQ ID NO: 2219062 - DNA, 14 bp, Homo sapiens
atctcccccagccc

SEQ ID NO: 2219063 - DNA, 21 bp, Homo sapiens
atctcccccagccccatcctc

SEQ ID NO: 2219064 - DNA, 16 bp, Homo sapiens
attaggtgtgactgaa

SEQ ID NO: 2219065 - DNA, 18 bp, Homo sapiens
attcaacaggttttcctg

SEQ ID NO: 2219066 - DNA, 12 bp, Homo sapiens
attcagacagct

SEQ ID NO: 2219067 - DNA, 13 bp, Homo sapiens
attcagacagctg

SEQ ID NO: 2219068 - DNA, 15 bp, Homo sapiens
attcagacagctgcc

SEQ ID NO: 2219069 - DNA, 16 bp, Homo sapiens
attcagacagctgcct

SEQ ID NO: 2219070 - DNA, 18 bp, Homo sapiens
attcagacagctgcctgg

SEQ ID NO: 2219071 - DNA, 18 bp, Homo sapiens
attcagctctgcaagaat

SEQ ID NO: 2219072 - DNA, 22 bp, Homo sapiens
attcaggaagctcagggcctgg

SEQ ID NO: 2219073 - DNA, 15 bp, Homo sapiens
attcagtaataactc

SEQ ID NO: 2219074 - DNA, 19 bp, Homo sapiens
attcagtaataactctacc

SEQ ID NO: 2219075 - DNA, 14 bp, Homo sapiens
attcatatttactt

SEQ ID NO: 2219076 - DNA, 13 bp, Homo sapiens
attctactttgag

SEQ ID NO: 2219077 - DNA, 19 bp, Homo sapiens
attctccacctgccaggga

SEQ ID NO: 2219078 - DNA, 19 bp, Homo sapiens
attctctagtttgattaaa

SEQ ID NO: 2219079 - DNA, 13 bp, Homo sapiens
attctgcctgccc

SEQ ID NO: 2219080 - DNA, 16 bp, Homo sapiens
attctgcctgcccagg

SEQ ID NO: 2219081 - DNA, 21 bp, Homo sapiens
attctgcctgcccaggcccct

SEQ ID NO: 2219082 - DNA, 18 bp, Homo sapiens
attctgctcacatatctg

SEQ ID NO: 2219083 - DNA, 20 bp, Homo sapiens
attctgctcacatatctgtc

SEQ ID NO: 2219084 - DNA, 19 bp, Homo sapiens
attctgttggccagtgtga

SEQ ID NO: 2219085 - DNA, 12 bp, Homo sapiens
attcttctgctt

SEQ ID NO: 2219086 - DNA, 14 bp, Homo sapiens
attcttctgcttca

SEQ ID NO: 2219087 - DNA, 17 bp, Homo sapiens
attctttcctgaggctg

SEQ ID NO: 2219088 - DNA, 15 bp, Homo sapiens
attgaaaaaccattt

SEQ ID NO: 2219089 - DNA, 13 bp, Homo sapiens
attgacctgaggc

SEQ ID NO: 2219090 - DNA, 15 bp, Homo sapiens
attgcaacaggctgg

SEQ ID NO: 2219091 - DNA, 16 bp, Homo sapiens
attgcaacaggctggg

SEQ ID NO: 2219092 - DNA, 18 bp, Homo sapiens
attgcaacaggctgggct

SEQ ID NO: 2219093 - DNA, 19 bp, Homo sapiens
attgcaacaggctgggctt

SEQ ID NO: 2219094 - DNA, 15 bp, Homo sapiens
attgctactgtccta

SEQ ID NO: 2219095 - DNA, 16 bp, Homo sapiens
attgctgatggtgcaa

SEQ ID NO: 2219096 - DNA, 18 bp, Homo sapiens
attgctgatggtgcaatg

SEQ ID NO: 2219097 - DNA, 19 bp, Homo sapiens
attggctagaggttcaaag

SEQ ID NO: 2219098 - DNA, 22 bp, Homo sapiens
attggctagaggttcaaagata

SEQ ID NO: 2219099 - DNA, 23 bp, Homo sapiens
attgtcaaagtggtgagaggcat

SEQ ID NO: 2219100 - DNA, 20 bp, Homo sapiens
attgtccccgacccttgccg

SEQ ID NO: 2219101 - DNA, 13 bp, Homo sapiens
attgtgggaaggg

SEQ ID NO: 2219102 - DNA, 21 bp, Homo sapiens
attgtgtctcttggtcctgct

SEQ ID NO: 2219103 - DNA, 16 bp, Homo sapiens
attgttagtctcttga

SEQ ID NO: 2219104 - DNA, 17 bp, Homo sapiens
attgttttcagtgtaca

SEQ ID NO: 2219105 - DNA, 16 bp, Homo sapiens
atttaaaagatacagt

SEQ ID NO: 2219106 - DNA, 17 bp, Homo sapiens
atttaacagaaatgtac

SEQ ID NO: 2219107 - DNA, 19 bp, Homo sapiens
atttaacagaaatgtacag

SEQ ID NO: 2219108 - DNA, 20 bp, Homo sapiens
atttaacagaaatgtacagc

SEQ ID NO: 2219109 - DNA, 15 bp, Homo sapiens
atttaatgaaagact

SEQ ID NO: 2219110 - DNA, 20 bp, Homo sapiens
atttaatgaaagactgtaca

SEQ ID NO: 2219111 - DNA, 21 bp, Homo sapiens
atttaatgaaagactgtacaa

SEQ ID NO: 2219112 - DNA, 14 bp, Homo sapiens
atttacttcttata

SEQ ID NO: 2219113 - DNA, 15 bp, Homo sapiens
atttagaaatataat

SEQ ID NO: 2219114 - DNA, 16 bp, Homo sapiens
atttattatggcacat

SEQ ID NO: 2219115 - DNA, 16 bp, Homo sapiens
aggggatagagagaga

SEQ ID NO: 2219116 - DNA, 22 bp, Homo sapiens
aggggcccaaattctttcagtg

SEQ ID NO: 2219117 - DNA, 20 bp, Homo sapiens
aggggcccaagagagacagc

SEQ ID NO: 2219118 - DNA, 20 bp, Homo sapiens
aggggcctcttatgggctgg

SEQ ID NO: 2219119 - DNA, 21 bp, Homo sapiens
aggggcctcttatgggctggg

SEQ ID NO: 2219120 - DNA, 15 bp, Homo sapiens
aggggggtgggaggg

SEQ ID NO: 2219121 - DNA, 18 bp, Homo sapiens
agggggtggcctcccaac

SEQ ID NO: 2219122 - DNA, 18 bp, Homo sapiens
aggggtgggacaccctgt

SEQ ID NO: 2219123 - DNA, 20 bp, Homo sapiens
aggggtgggacaccctgtga

SEQ ID NO: 2219124 - DNA, 22 bp, Homo sapiens
aggggtgtgggcacccccggcc

SEQ ID NO: 2219125 - DNA, 24 bp, Homo sapiens
aggggttcccttttttggctgctg

SEQ ID NO: 2219126 - DNA, 16 bp, Homo sapiens
agggtatcaggtgctg

SEQ ID NO: 2219127 - DNA, 13 bp, Homo sapiens
agggtattccaga

SEQ ID NO: 2219128 - DNA, 20 bp, Homo sapiens
agggtccctggtggcagctc

SEQ ID NO: 2219129 - DNA, 20 bp, Homo sapiens
agggtctcactatgttgccc

SEQ ID NO: 2219130 - DNA, 23 bp, Homo sapiens
agggtctcactatgttgcccagg

SEQ ID NO: 2219131 - DNA, 14 bp, Homo sapiens
agggtctcactctg

SEQ ID NO: 2219132 - DNA, 15 bp, Homo sapiens
agggtctcactctgt

SEQ ID NO: 2219133 - DNA, 14 bp, Homo sapiens
agggtctgcaggga

SEQ ID NO: 2219134 - DNA, 22 bp, Homo sapiens
agggtgagcactctggggtggg

SEQ ID NO: 2219135 - DNA, 17 bp, Homo sapiens
agggtggtgacctctgc

SEQ ID NO: 2219136 - DNA, 21 bp, Homo sapiens
agggtggtgacctctgcctga

SEQ ID NO: 2219137 - DNA, 14 bp, Homo sapiens
agggttggcccctg

SEQ ID NO: 2219138 - DNA, 17 bp, Homo sapiens
agggttggcccctgccc

SEQ ID NO: 2219139 - DNA, 18 bp, Homo sapiens
agggttggcccctgcccg

SEQ ID NO: 2219140 - DNA, 23 bp, Homo sapiens
agggttttgccatgttggccagg

SEQ ID NO: 2219141 - DNA, 13 bp, Homo sapiens
aggtaacaggcag

SEQ ID NO: 2219142 - DNA, 17 bp, Homo sapiens
aggtaaggaatacctgt

SEQ ID NO: 2219143 - DNA, 14 bp, Homo sapiens
aggtactctcctgg

SEQ ID NO: 2219144 - DNA, 21 bp, Homo sapiens
aggtcaaggctgcagtgagcc

SEQ ID NO: 2219145 - DNA, 12 bp, Homo sapiens
aggtcagagcct

SEQ ID NO: 2219146 - DNA, 17 bp, Homo sapiens
aggtcagagcctgcagt

SEQ ID NO: 2219147 - DNA, 17 bp, Homo sapiens
aggtcattttttttaag

SEQ ID NO: 2219148 - DNA, 23 bp, Homo sapiens
aggtcattttttttaagaaaaag

SEQ ID NO: 2219149 - DNA, 16 bp, Homo sapiens
aggtctgttctttcca

SEQ ID NO: 2219150 - DNA, 18 bp, Homo sapiens
aggtctgttctttccaaa

SEQ ID NO: 2219151 - DNA, 22 bp, Homo sapiens
aggtctgttctttccaaagtac

SEQ ID NO: 2219152 - DNA, 20 bp, Homo sapiens
aggtcttgaactcctggcct

SEQ ID NO: 2219153 - DNA, 21 bp, Homo sapiens
aggtgagaagcagaggaagga

SEQ ID NO: 2219154 - DNA, 23 bp, Homo sapiens
aggtgagaagcagaggaaggaga

SEQ ID NO: 2219155 - DNA, 15 bp, Homo sapiens
aggtgcacaagctcc

SEQ ID NO: 2219156 - DNA, 23 bp, Homo sapiens
aggtgctaggaacactccttcac

SEQ ID NO: 2219157 - DNA, 12 bp, Homo sapiens
aggtgggaggat

SEQ ID NO: 2219158 - DNA, 17 bp, Homo sapiens
aggtgggatcctccagg

SEQ ID NO: 2219159 - DNA, 18 bp, Homo sapiens
aggtgggatcctccaggt

SEQ ID NO: 2219160 - DNA, 20 bp, Homo sapiens
aggtggggcctggggtagga

SEQ ID NO: 2219161 - DNA, 16 bp, Homo sapiens
aggtgtccctgcactt

SEQ ID NO: 2219162 - DNA, 23 bp, Homo sapiens
aggtgtgaaccaccacacccagc

SEQ ID NO: 2219163 - DNA, 21 bp, Homo sapiens
aggtgtgagtcaccaagccca

SEQ ID NO: 2219164 - DNA, 22 bp, Homo sapiens
aggtgtgagtcaccaagcccag

SEQ ID NO: 2219165 - DNA, 15 bp, Homo sapiens
aggttaataaagtaa

SEQ ID NO: 2219166 - DNA, 14 bp, Homo sapiens
aggttgaagcacca

SEQ ID NO: 2219167 - DNA, 22 bp, Homo sapiens
aggtttaaaaatccccaaaaaa

SEQ ID NO: 2219168 - DNA, 11 bp, Homo sapiens
aggttttcctg

SEQ ID NO: 2219169 - DNA, 19 bp, Homo sapiens
agtaaatgggggtgcattt

SEQ ID NO: 2219170 - DNA, 15 bp, Homo sapiens
agtaatatgcacaca

SEQ ID NO: 2219171 - DNA, 17 bp, Homo sapiens
agtacgttgtgcatttg

SEQ ID NO: 2219172 - DNA, 22 bp, Homo sapiens
agtactacagtcctcccatctc

SEQ ID NO: 2219173 - DNA, 14 bp, Homo sapiens
agtactatgtatca

SEQ ID NO: 2219174 - DNA, 17 bp, Homo sapiens
agtacttctccaccctg

SEQ ID NO: 2219175 - DNA, 12 bp, Homo sapiens
agtacttctttt

SEQ ID NO: 2219176 - DNA, 17 bp, Homo sapiens
agtagaagtcttagatg

SEQ ID NO: 2219177 - DNA, 20 bp, Homo sapiens
agtagaagtcttagatgtat

SEQ ID NO: 2219178 - DNA, 21 bp, Homo sapiens
agtagaagtcttagatgtata

SEQ ID NO: 2219179 - DNA, 22 bp, Homo sapiens
agtagctgggactacaggcacc

SEQ ID NO: 2219180 - DNA, 17 bp, Homo sapiens
agtaggaagactttgga

SEQ ID NO: 2219181 - DNA, 11 bp, Homo sapiens
agtatcttgaa

SEQ ID NO: 2219182 - DNA, 12 bp, Homo sapiens
agtatcttgaag

SEQ ID NO: 2219183 - DNA, 15 bp, Homo sapiens
agtatcttgaagact

SEQ ID NO: 2219184 - DNA, 20 bp, Homo sapiens
agtatgaggcatttgtttga

SEQ ID NO: 2219185 - DNA, 17 bp, Homo sapiens
agtatggtggctgggtt

SEQ ID NO: 2219186 - DNA, 18 bp, Homo sapiens
agtattacttctgctaca

SEQ ID NO: 2219187 - DNA, 15 bp, Homo sapiens
agtattatacctttt

SEQ ID NO: 2219188 - DNA, 20 bp, Homo sapiens
agtcaagtgaaaaaggagga

SEQ ID NO: 2219189 - DNA, 15 bp, Homo sapiens
agtcacacagtgagt

SEQ ID NO: 2219190 - DNA, 15 bp, Homo sapiens
agtcaccaagcccag

SEQ ID NO: 2219191 - DNA, 17 bp, Homo sapiens
agtcactgagacagccc

SEQ ID NO: 2219192 - DNA, 19 bp, Homo sapiens
agtcaggggttcccttttt

SEQ ID NO: 2219193 - DNA, 18 bp, Homo sapiens
agtcccaccttggctgca

SEQ ID NO: 2219194 - DNA, 20 bp, Homo sapiens
agtcccaccttggctgcagg

SEQ ID NO: 2219195 - DNA, 14 bp, Homo sapiens
agtcccctgtttgt

SEQ ID NO: 2219196 - DNA, 12 bp, Homo sapiens
agtccctgccaa

SEQ ID NO: 2219197 - DNA, 14 bp, Homo sapiens
agtcctcccatctc

SEQ ID NO: 2219198 - DNA, 20 bp, Homo sapiens
agtcctggcatgggaatgaa

SEQ ID NO: 2219199 - DNA, 21 bp, Homo sapiens
agtcctggcatgggaatgaat

SEQ ID NO: 2219200 - DNA, 20 bp, Homo sapiens
agtccttaccagcagagcac

SEQ ID NO: 2219201 - DNA, 18 bp, Homo sapiens
agtctcactgttgcccag

SEQ ID NO: 2219202 - DNA, 21 bp, Homo sapiens
agtctcactgttgcccaggct

SEQ ID NO: 2219203 - DNA, 16 bp, Homo sapiens
agtctcttgattcata

SEQ ID NO: 2219204 - DNA, 16 bp, Homo sapiens
agtctgaaggctgggt

SEQ ID NO: 2219205 - DNA, 18 bp, Homo sapiens
agtctggcccttcctttt

SEQ ID NO: 2219206 - DNA, 13 bp, Homo sapiens
agtcttagatgta

SEQ ID NO: 2219207 - DNA, 11 bp, Homo sapiens
agtgaaaaagg

SEQ ID NO: 2219208 - DNA, 19 bp, Homo sapiens
agtgacagaggcagcccca

SEQ ID NO: 2219209 - DNA, 17 bp, Homo sapiens
agtgagaccctgtctca

SEQ ID NO: 2219210 - DNA, 22 bp, Homo sapiens
agtgagcactaaggtgtgctct

SEQ ID NO: 2219211 - DNA, 12 bp, Homo sapiens
agtgagctggtt

SEQ ID NO: 2219212 - DNA, 23 bp, Homo sapiens
agtgagctggtttttagcggaga

SEQ ID NO: 2219213 - DNA, 23 bp, Homo sapiens
acactgtttcaaactttactatg

SEQ ID NO: 2219214 - DNA, 21 bp, Homo sapiens
acacttacactttatgcacaa

SEQ ID NO: 2219215 - DNA, 17 bp, Homo sapiens
acagaaaattcttctcc

SEQ ID NO: 2219216 - DNA, 16 bp, Homo sapiens
acagaaatgtacagca

SEQ ID NO: 2219217 - DNA, 13 bp, Homo sapiens
acagacaaagcgt

SEQ ID NO: 2219218 - DNA, 11 bp, Homo sapiens
acagacacagg

SEQ ID NO: 2219219 - DNA, 14 bp, Homo sapiens
acagacacaggccc

SEQ ID NO: 2219220 - DNA, 17 bp, Homo sapiens
acagacacaggcccggc

SEQ ID NO: 2219221 - DNA, 18 bp, Homo sapiens
acagacacaggcccggct

SEQ ID NO: 2219222 - DNA, 18 bp, Homo sapiens
acagaccctgccctgtgg

SEQ ID NO: 2219223 - DNA, 17 bp, Homo sapiens
acagactggaagcacag

SEQ ID NO: 2219224 - DNA, 22 bp, Homo sapiens
acagactggaagcacagcttca

SEQ ID NO: 2219225 - DNA, 14 bp, Homo sapiens
acagaggcagcccc

SEQ ID NO: 2219226 - DNA, 23 bp, Homo sapiens
acagaggcagccccattctgcct

SEQ ID NO: 2219227 - DNA, 17 bp, Homo sapiens
acagaggccatgggcct

SEQ ID NO: 2219228 - DNA, 21 bp, Homo sapiens
acagaggccatgggcctcctg

SEQ ID NO: 2219229 - DNA, 23 bp, Homo sapiens
acagaggccatgggcctcctgtg

SEQ ID NO: 2219230 - DNA, 14 bp, Homo sapiens
acagagggggtggc

SEQ ID NO: 2219231 - DNA, 12 bp, Homo sapiens
acagagtctcac

SEQ ID NO: 2219232 - DNA, 14 bp, Homo sapiens
acagagtctcactg

SEQ ID NO: 2219233 - DNA, 15 bp, Homo sapiens
acagagttgttacat

SEQ ID NO: 2219234 - DNA, 19 bp, Homo sapiens
acagagttgttacattttt

SEQ ID NO: 2219235 - DNA, 14 bp, Homo sapiens
acagcacaggcagc

SEQ ID NO: 2219236 - DNA, 19 bp, Homo sapiens
acagccacggccaggccag

SEQ ID NO: 2219237 - DNA, 15 bp, Homo sapiens
acagccatgattctt

SEQ ID NO: 2219238 - DNA, 16 bp, Homo sapiens
acagcccgggctctgc

SEQ ID NO: 2219239 - DNA, 17 bp, Homo sapiens
acagcccgggctctgcc

SEQ ID NO: 2219240 - DNA, 20 bp, Homo sapiens
acagcccgggctctgcctcc

SEQ ID NO: 2219241 - DNA, 21 bp, Homo sapiens
acagcccgggctctgcctccc

SEQ ID NO: 2219242 - DNA, 13 bp, Homo sapiens
acagctaacatgg

SEQ ID NO: 2219243 - DNA, 16 bp, Homo sapiens
acagctaatgggacac

SEQ ID NO: 2219244 - DNA, 13 bp, Homo sapiens
acagctccttctg

SEQ ID NO: 2219245 - DNA, 15 bp, Homo sapiens
acagctccttctgtc

SEQ ID NO: 2219246 - DNA, 14 bp, Homo sapiens
acagctctgtcctg

SEQ ID NO: 2219247 - DNA, 16 bp, Homo sapiens
acagctcttctccagg

SEQ ID NO: 2219248 - DNA, 18 bp, Homo sapiens
acagctcttctccaggct

SEQ ID NO: 2219249 - DNA, 13 bp, Homo sapiens
acagctgcctggg

SEQ ID NO: 2219250 - DNA, 14 bp, Homo sapiens
acagctgcctggga

SEQ ID NO: 2219251 - DNA, 17 bp, Homo sapiens
acagcttgaccgtgagg

SEQ ID NO: 2219252 - DNA, 16 bp, Homo sapiens
acaggaaaagctgctg

SEQ ID NO: 2219253 - DNA, 20 bp, Homo sapiens
acaggaaaattttaaaaata

SEQ ID NO: 2219254 - DNA, 13 bp, Homo sapiens
acaggaagtactg

SEQ ID NO: 2219255 - DNA, 16 bp, Homo sapiens
acaggagtgagcacta

SEQ ID NO: 2219256 - DNA, 14 bp, Homo sapiens
acaggatcagtctg

SEQ ID NO: 2219257 - DNA, 14 bp, Homo sapiens
acaggattattgga

SEQ ID NO: 2219258 - DNA, 16 bp, Homo sapiens
acaggcaagcacctcc

SEQ ID NO: 2219259 - DNA, 19 bp, Homo sapiens
acaggcaatgctggctgtt

SEQ ID NO: 2219260 - DNA, 14 bp, Homo sapiens
acaggcacccacca

SEQ ID NO: 2219261 - DNA, 15 bp, Homo sapiens
acaggcagatacagg

SEQ ID NO: 2219262 - DNA, 13 bp, Homo sapiens
acaggcaggtcca

SEQ ID NO: 2219263 - DNA, 14 bp, Homo sapiens
acaggcaggtccag

SEQ ID NO: 2219264 - DNA, 16 bp, Homo sapiens
acaggcaggtccaggg

SEQ ID NO: 2219265 - DNA, 19 bp, Homo sapiens
acaggcatgttctctgagg

SEQ ID NO: 2219266 - DNA, 20 bp, Homo sapiens
acaggcccggctccaggctc

SEQ ID NO: 2219267 - DNA, 23 bp, Homo sapiens
acaggctgggcttcagtggcagc

SEQ ID NO: 2219268 - DNA, 20 bp, Homo sapiens
acagggcacaccgggcactc

SEQ ID NO: 2219269 - DNA, 19 bp, Homo sapiens
acagtattacttctgctac

SEQ ID NO: 2219270 - DNA, 13 bp, Homo sapiens
acagtccctgcca

SEQ ID NO: 2219271 - DNA, 15 bp, Homo sapiens
acagtccctgccaat

SEQ ID NO: 2219272 - DNA, 12 bp, Homo sapiens
cccagccccatc

SEQ ID NO: 2219273 - DNA, 14 bp, Homo sapiens
cccagccccatcct

SEQ ID NO: 2219274 - DNA, 18 bp, Homo sapiens
cccagccccttctgaccc

SEQ ID NO: 2219275 - DNA, 15 bp, Homo sapiens
cccagcgagccctgg

SEQ ID NO: 2219276 - DNA, 23 bp, Homo sapiens
cccagctgtgctctggacaggca

SEQ ID NO: 2219277 - DNA, 18 bp, Homo sapiens
cccaggaaaggctccagg

SEQ ID NO: 2219278 - DNA, 19 bp, Homo sapiens
cccaggaaaggctccagga

SEQ ID NO: 2219279 - DNA, 21 bp, Homo sapiens
cccaggaaaggctccaggagc

SEQ ID NO: 2219280 - DNA, 23 bp, Homo sapiens
cccaggaaaggctccaggagcag

SEQ ID NO: 2219281 - DNA, 13 bp, Homo sapiens
cccaggagccccg

SEQ ID NO: 2219282 - DNA, 14 bp, Homo sapiens
cccaggagccccga

SEQ ID NO: 2219283 - DNA, 18 bp, Homo sapiens
cccaggagccccgaggcc

SEQ ID NO: 2219284 - DNA, 16 bp, Homo sapiens
cccaggaggccagcct

SEQ ID NO: 2219285 - DNA, 18 bp, Homo sapiens
cccaggaggccagccttg

SEQ ID NO: 2219286 - DNA, 17 bp, Homo sapiens
cccaggcaggtcttgaa

SEQ ID NO: 2219287 - DNA, 15 bp, Homo sapiens
cccaggcattcccca

SEQ ID NO: 2219288 - DNA, 21 bp, Homo sapiens
cccaggcattccccaggaggc

SEQ ID NO: 2219289 - DNA, 22 bp, Homo sapiens
cccaggcattccccaggaggcc

SEQ ID NO: 2219290 - DNA, 18 bp, Homo sapiens
cccaggcccctgccaccc

SEQ ID NO: 2219291 - DNA, 19 bp, Homo sapiens
cccaggcctccccagcacc

SEQ ID NO: 2219292 - DNA, 18 bp, Homo sapiens
cccaggcctcctacagct

SEQ ID NO: 2219293 - DNA, 20 bp, Homo sapiens
cccaggctggcgtgcagtgg

SEQ ID NO: 2219294 - DNA, 21 bp, Homo sapiens
cccaggctggcgtgcagtggt

SEQ ID NO: 2219295 - DNA, 15 bp, Homo sapiens
cccaggcttagtcac

SEQ ID NO: 2219296 - DNA, 22 bp, Homo sapiens
cccaggtgctaggaacactcct

SEQ ID NO: 2219297 - DNA, 13 bp, Homo sapiens
cccaggtttctat

SEQ ID NO: 2219298 - DNA, 10 bp, Homo sapiens
cccagtctgg

SEQ ID NO: 2219299 - DNA, 15 bp, Homo sapiens
cccagtgcccacagg

SEQ ID NO: 2219300 - DNA, 15 bp, Homo sapiens
cccagtgccgagaag

SEQ ID NO: 2219301 - DNA, 14 bp, Homo sapiens
cccagttagctctc

SEQ ID NO: 2219302 - DNA, 14 bp, Homo sapiens
cccagttgggtgga

SEQ ID NO: 2219303 - DNA, 20 bp, Homo sapiens
cccatcctcctgcccccacc

SEQ ID NO: 2219304 - DNA, 22 bp, Homo sapiens
cccatcctcctgcccccacccc

SEQ ID NO: 2219305 - DNA, 21 bp, Homo sapiens
cccatcctctgtacagagccc

SEQ ID NO: 2219306 - DNA, 13 bp, Homo sapiens
cccatctcacaca

SEQ ID NO: 2219307 - DNA, 19 bp, Homo sapiens
cccatctctacaaaaagca

SEQ ID NO: 2219308 - DNA, 15 bp, Homo sapiens
cccatgagcctcagc

SEQ ID NO: 2219309 - DNA, 22 bp, Homo sapiens
cccatgagcctcagcatcctgg

SEQ ID NO: 2219310 - DNA, 12 bp, Homo sapiens
cccatgctgccc

SEQ ID NO: 2219311 - DNA, 15 bp, Homo sapiens
cccattctgcctgcc

SEQ ID NO: 2219312 - DNA, 18 bp, Homo sapiens
ccccaaaactctcctctg

SEQ ID NO: 2219313 - DNA, 14 bp, Homo sapiens
ccccacgtccctgc

SEQ ID NO: 2219314 - DNA, 13 bp, Homo sapiens
ccccactggtgac

SEQ ID NO: 2219315 - DNA, 14 bp, Homo sapiens
ccccactggtgaca

SEQ ID NO: 2219316 - DNA, 20 bp, Homo sapiens
ccccagattgcaacaggctg

SEQ ID NO: 2219317 - DNA, 21 bp, Homo sapiens
ccccagattgcaacaggctgg

SEQ ID NO: 2219318 - DNA, 13 bp, Homo sapiens
ccccagcctgcta

SEQ ID NO: 2219319 - DNA, 13 bp, Homo sapiens
ccccaggaggcca

SEQ ID NO: 2219320 - DNA, 15 bp, Homo sapiens
ccccaggaggccagc

SEQ ID NO: 2219321 - DNA, 15 bp, Homo sapiens
ccccaggctgggctg

SEQ ID NO: 2219322 - DNA, 22 bp, Homo sapiens
ccccaggtggttatggagaggg

SEQ ID NO: 2219323 - DNA, 16 bp, Homo sapiens
ccccagtgcccacagg

SEQ ID NO: 2219324 - DNA, 19 bp, Homo sapiens
ccccatcctctgtacagag

SEQ ID NO: 2219325 - DNA, 13 bp, Homo sapiens
ccccattctgcct

SEQ ID NO: 2219326 - DNA, 21 bp, Homo sapiens
ccccattctgcctgcccaggc

SEQ ID NO: 2219327 - DNA, 24 bp, Homo sapiens
cccccacccaagggcctggcctga

SEQ ID NO: 2219328 - DNA, 13 bp, Homo sapiens
cccccactggtga

SEQ ID NO: 2219329 - DNA, 14 bp, Homo sapiens
cccccggcccagtg

SEQ ID NO: 2219330 - DNA, 12 bp, Homo sapiens
ccccctccccgg

SEQ ID NO: 2219331 - DNA, 17 bp, Homo sapiens
ccccctgacaacactca

SEQ ID NO: 2219332 - DNA, 17 bp, Homo sapiens
cccccttgcccaggcct

SEQ ID NO: 2219333 - DNA, 23 bp, Homo sapiens
ccccgacccttgccgtctacctg

SEQ ID NO: 2219334 - DNA, 14 bp, Homo sapiens
ccccgcactgggct

SEQ ID NO: 2219335 - DNA, 18 bp, Homo sapiens
ccccgccccatcctcctg

SEQ ID NO: 2219336 - DNA, 14 bp, Homo sapiens
ccccgggcagcaga

SEQ ID NO: 2219337 - DNA, 15 bp, Homo sapiens
cccctgacaacactc

SEQ ID NO: 2219338 - DNA, 17 bp, Homo sapiens
cccctgcccggctgcgg

SEQ ID NO: 2219339 - DNA, 13 bp, Homo sapiens
cccctgctggttc

SEQ ID NO: 2219340 - DNA, 18 bp, Homo sapiens
cccctggatgcagcctca

SEQ ID NO: 2219341 - DNA, 19 bp, Homo sapiens
cccctggatgcagcctcac

SEQ ID NO: 2219342 - DNA, 20 bp, Homo sapiens
cccctgttctggcagagttg

SEQ ID NO: 2219343 - DNA, 14 bp, Homo sapiens
ccccttcgctcctg

SEQ ID NO: 2219344 - DNA, 19 bp, Homo sapiens
ccccttcgctcctgtgtct

SEQ ID NO: 2219345 - DNA, 14 bp, Homo sapiens
ccccttctgaccca

SEQ ID NO: 2219346 - DNA, 17 bp, Homo sapiens
ccccttctgacccatgc

SEQ ID NO: 2219347 - DNA, 14 bp, Homo sapiens
cccgaatagctggg

SEQ ID NO: 2219348 - DNA, 16 bp, Homo sapiens
cccgaatagctgggac

SEQ ID NO: 2219349 - DNA, 17 bp, Homo sapiens
cccgaatagctgggact

SEQ ID NO: 2219350 - DNA, 21 bp, Homo sapiens
cccgaggccttctctgaagga

SEQ ID NO: 2219351 - DNA, 16 bp, Homo sapiens
cccgagtagctgggac

SEQ ID NO: 2219352 - DNA, 20 bp, Homo sapiens
cccgcccaggcttagtcact

SEQ ID NO: 2219353 - DNA, 18 bp, Homo sapiens
cccgccccatcctcctgc

SEQ ID NO: 2219354 - DNA, 20 bp, Homo sapiens
cccggcccagtgccccctgg

SEQ ID NO: 2219355 - DNA, 16 bp, Homo sapiens
cccggcccctgctggt

SEQ ID NO: 2219356 - DNA, 13 bp, Homo sapiens
cccggctccaggc

SEQ ID NO: 2219357 - DNA, 15 bp, Homo sapiens
cccggctccaggctc

SEQ ID NO: 2219358 - DNA, 12 bp, Homo sapiens
cccgggaagggg

SEQ ID NO: 2219359 - DNA, 22 bp, Homo sapiens
cccgggaagggggctgggacat

SEQ ID NO: 2219360 - DNA, 17 bp, Homo sapiens
ccctaaagtgtattttt

SEQ ID NO: 2219361 - DNA, 18 bp, Homo sapiens
ccctcagggtccctggtg

SEQ ID NO: 2219362 - DNA, 11 bp, Homo sapiens
cctcctcagat

SEQ ID NO: 2219363 - DNA, 21 bp, Homo sapiens
cctcctccagccgccatgctc

SEQ ID NO: 2219364 - DNA, 17 bp, Homo sapiens
cctcctgcccccacccc

SEQ ID NO: 2219365 - DNA, 21 bp, Homo sapiens
cctcctgcccccaccccaggc

SEQ ID NO: 2219366 - DNA, 13 bp, Homo sapiens
cctcctgggctaa

SEQ ID NO: 2219367 - DNA, 23 bp, Homo sapiens
cctcctgtgtgtgcgcctacagg

SEQ ID NO: 2219368 - DNA, 20 bp, Homo sapiens
cctcctttgtgaggaagccg

SEQ ID NO: 2219369 - DNA, 23 bp, Homo sapiens
cctcctttgtgaggaagccgctg

SEQ ID NO: 2219370 - DNA, 12 bp, Homo sapiens
cctctctcactc

SEQ ID NO: 2219371 - DNA, 14 bp, Homo sapiens
cctctctcactcct

SEQ ID NO: 2219372 - DNA, 15 bp, Homo sapiens
cctctctcactcctt

SEQ ID NO: 2219373 - DNA, 14 bp, Homo sapiens
cctctctcaggcca

SEQ ID NO: 2219374 - DNA, 21 bp, Homo sapiens
cctctgacacacagctctgtc

SEQ ID NO: 2219375 - DNA, 19 bp, Homo sapiens
cctctgcactcccctgctg

SEQ ID NO: 2219376 - DNA, 13 bp, Homo sapiens
cctctgcccactc

SEQ ID NO: 2219377 - DNA, 16 bp, Homo sapiens
cctctgcccactccct

SEQ ID NO: 2219378 - DNA, 20 bp, Homo sapiens
cctctgcccactccctgcaa

SEQ ID NO: 2219379 - DNA, 23 bp, Homo sapiens
cctctgcctctgacacacagctc

SEQ ID NO: 2219380 - DNA, 11 bp, Homo sapiens
cctctgcctga

SEQ ID NO: 2219381 - DNA, 16 bp, Homo sapiens
cctctgctgctggctg

SEQ ID NO: 2219382 - DNA, 17 bp, Homo sapiens
cctctgctgctggctgg

SEQ ID NO: 2219383 - DNA, 18 bp, Homo sapiens
cctctgctgctggctggt

SEQ ID NO: 2219384 - DNA, 12 bp, Homo sapiens
cctctgggactg

SEQ ID NO: 2219385 - DNA, 17 bp, Homo sapiens
cctctgtacagagccca

SEQ ID NO: 2219386 - DNA, 23 bp, Homo sapiens
cctctgtacagagcccacgcccc

SEQ ID NO: 2219387 - DNA, 19 bp, Homo sapiens
cctcttgagccttgaactt

SEQ ID NO: 2219388 - DNA, 16 bp, Homo sapiens
cctctttccctccctt

SEQ ID NO: 2219389 - DNA, 16 bp, Homo sapiens
cctctttgagtgaagc

SEQ ID NO: 2219390 - DNA, 19 bp, Homo sapiens
cctctttggtctacactgt

SEQ ID NO: 2219391 - DNA, 22 bp, Homo sapiens
cctctttggtctacactgtgct

SEQ ID NO: 2219392 - DNA, 13 bp, Homo sapiens
cctgaaggccccg

SEQ ID NO: 2219393 - DNA, 14 bp, Homo sapiens
cctgaaggccccgc

SEQ ID NO: 2219394 - DNA, 15 bp, Homo sapiens
cctgaagtcacacag

SEQ ID NO: 2219395 - DNA, 16 bp, Homo sapiens
cctgacaacactcatt

SEQ ID NO: 2219396 - DNA, 12 bp, Homo sapiens
cctgagccagat

SEQ ID NO: 2219397 - DNA, 16 bp, Homo sapiens
cctgagccagatttca

SEQ ID NO: 2219398 - DNA, 20 bp, Homo sapiens
cctgagccagatttcactct

SEQ ID NO: 2219399 - DNA, 14 bp, Homo sapiens
cctgagctttctgc

SEQ ID NO: 2219400 - DNA, 14 bp, Homo sapiens
cctgaggcccagag

SEQ ID NO: 2219401 - DNA, 11 bp, Homo sapiens
cctgaggccct

SEQ ID NO: 2219402 - DNA, 12 bp, Homo sapiens
cctgaggccctt

SEQ ID NO: 2219403 - DNA, 13 bp, Homo sapiens
cctgaggctgggc

SEQ ID NO: 2219404 - DNA, 21 bp, Homo sapiens
cctgaggctgggctcccttcc

SEQ ID NO: 2219405 - DNA, 12 bp, Homo sapiens
cctgaggggcct

SEQ ID NO: 2219406 - DNA, 16 bp, Homo sapiens
cctgaggggcctctta

SEQ ID NO: 2219407 - DNA, 14 bp, Homo sapiens
cctgatgcttcttc

SEQ ID NO: 2219408 - DNA, 22 bp, Homo sapiens
cctgatgcttcttcagagactc

SEQ ID NO: 2219409 - DNA, 20 bp, Homo sapiens
cagtctgattcccaagctct

SEQ ID NO: 2219410 - DNA, 23 bp, Homo sapiens
cagtctgattcccaagctctgct

SEQ ID NO: 2219411 - DNA, 17 bp, Homo sapiens
cagtctggaatgcagtg

SEQ ID NO: 2219412 - DNA, 18 bp, Homo sapiens
cagtctggaatgcagtgg

SEQ ID NO: 2219413 - DNA, 20 bp, Homo sapiens
cagtgaggctctgcccttgg

SEQ ID NO: 2219414 - DNA, 19 bp, Homo sapiens
cctgattgtgtctcttggt

SEQ ID NO: 2219415 - DNA, 23 bp, Homo sapiens
cctgattgtgtctcttggtcctg

SEQ ID NO: 2219416 - DNA, 16 bp, Homo sapiens
cctgcaacctgattgt

SEQ ID NO: 2219417 - DNA, 14 bp, Homo sapiens
cctgcaagaacaag

SEQ ID NO: 2219418 - DNA, 19 bp, Homo sapiens
cctgcacttgcagactcta

SEQ ID NO: 2219419 - DNA, 12 bp, Homo sapiens
cctgcaggcagc

SEQ ID NO: 2219420 - DNA, 13 bp, Homo sapiens
cctgcaggcagcc

SEQ ID NO: 2219421 - DNA, 19 bp, Homo sapiens
cctgcaggcagccaggcca

SEQ ID NO: 2219422 - DNA, 12 bp, Homo sapiens
cctgccaccctg

SEQ ID NO: 2219423 - DNA, 13 bp, Homo sapiens
cctgccaggaagc

SEQ ID NO: 2219424 - DNA, 21 bp, Homo sapiens
cctgccaggaagccagcaggc

SEQ ID NO: 2219425 - DNA, 22 bp, Homo sapiens
cctgccaggaagccagcaggct

SEQ ID NO: 2219426 - DNA, 12 bp, Homo sapiens
cctgccaggcat

SEQ ID NO: 2219427 - DNA, 15 bp, Homo sapiens
cctgccaggcatggt

SEQ ID NO: 2219428 - DNA, 14 bp, Homo sapiens
cctgccagggacag

SEQ ID NO: 2219429 - DNA, 16 bp, Homo sapiens
cctgccagggacagag

SEQ ID NO: 2219430 - DNA, 12 bp, Homo sapiens
cctgcccacctg

SEQ ID NO: 2219431 - DNA, 18 bp, Homo sapiens
cctgcccacctggcctct

SEQ ID NO: 2219432 - DNA, 19 bp, Homo sapiens
cctgcccacctggcctctg

SEQ ID NO: 2219433 - DNA, 14 bp, Homo sapiens
cctgcccaggcccc

SEQ ID NO: 2219434 - DNA, 15 bp, Homo sapiens
cctgcccaggcccct

SEQ ID NO: 2219435 - DNA, 12 bp, Homo sapiens
cctgccctgtgg

SEQ ID NO: 2219436 - DNA, 19 bp, Homo sapiens
cctgcccttacctgccagg

SEQ ID NO: 2219437 - DNA, 11 bp, Homo sapiens
cctgcctcagc

SEQ ID NO: 2219438 - DNA, 16 bp, Homo sapiens
cctgcctcagcctccc

SEQ ID NO: 2219439 - DNA, 13 bp, Homo sapiens
cctgcctcctttg

SEQ ID NO: 2219440 - DNA, 15 bp, Homo sapiens
cctgcctcctttgtg

SEQ ID NO: 2219441 - DNA, 19 bp, Homo sapiens
cctgcctcgaactggctgc

SEQ ID NO: 2219442 - DNA, 15 bp, Homo sapiens
cctgcctcttctcta

SEQ ID NO: 2219443 - DNA, 18 bp, Homo sapiens
cctgcggaagccacaggg

SEQ ID NO: 2219444 - DNA, 22 bp, Homo sapiens
cctgctccagctgttcagctgg

SEQ ID NO: 2219445 - DNA, 21 bp, Homo sapiens
cctgctctccgaccagacacc

SEQ ID NO: 2219446 - DNA, 22 bp, Homo sapiens
cctgctctccgaccagacacct

SEQ ID NO: 2219447 - DNA, 12 bp, Homo sapiens
cctgctgcagtt

SEQ ID NO: 2219448 - DNA, 21 bp, Homo sapiens
cctgctgggtgtggcgcagca

SEQ ID NO: 2219449 - DNA, 19 bp, Homo sapiens
cctgctggttcagggttgg

SEQ ID NO: 2219450 - DNA, 14 bp, Homo sapiens
cctggaccctgtgg

SEQ ID NO: 2219451 - DNA, 17 bp, Homo sapiens
cctggagttctggttcc

SEQ ID NO: 2219452 - DNA, 17 bp, Homo sapiens
cctggatgcagcctcac

SEQ ID NO: 2219453 - DNA, 18 bp, Homo sapiens
cctggatggggctgcacc

SEQ ID NO: 2219454 - DNA, 18 bp, Homo sapiens
cctggcacccggcccctg

SEQ ID NO: 2219455 - DNA, 21 bp, Homo sapiens
cctggcacccggcccctgctg

SEQ ID NO: 2219456 - DNA, 22 bp, Homo sapiens
cctggcactataatgtaagctc

SEQ ID NO: 2219457 - DNA, 16 bp, Homo sapiens
cctggcactgcttcca

SEQ ID NO: 2219458 - DNA, 20 bp, Homo sapiens
cctggcactgcttccagtga

SEQ ID NO: 2219459 - DNA, 13 bp, Homo sapiens
cctggcagcccct

SEQ ID NO: 2219460 - DNA, 16 bp, Homo sapiens
cctggcagcccctgtt

SEQ ID NO: 2219461 - DNA, 13 bp, Homo sapiens
cctggcccactgc

SEQ ID NO: 2219462 - DNA, 14 bp, Homo sapiens
cctggcccactgca

SEQ ID NO: 2219463 - DNA, 16 bp, Homo sapiens
cctggcccactgcatc

SEQ ID NO: 2219464 - DNA, 20 bp, Homo sapiens
cctggcccctcagggtccct

SEQ ID NO: 2219465 - DNA, 22 bp, Homo sapiens
cctggcctctgcactcccctgc

SEQ ID NO: 2219466 - DNA, 14 bp, Homo sapiens
cctggcctgagctg

SEQ ID NO: 2219467 - DNA, 16 bp, Homo sapiens
cctgggagtgagctgg

SEQ ID NO: 2219468 - DNA, 20 bp, Homo sapiens
cctgggatccctcatcctca

SEQ ID NO: 2219469 - DNA, 15 bp, Homo sapiens
cctgggcagaaggaa

SEQ ID NO: 2219470 - DNA, 19 bp, Homo sapiens
cctggggtaggaggaacag

SEQ ID NO: 2219471 - DNA, 12 bp, Homo sapiens
cctggtggcagc

SEQ ID NO: 2219472 - DNA, 14 bp, Homo sapiens
cctggtggcagctc

SEQ ID NO: 2219473 - DNA, 17 bp, Homo sapiens
cctggtggcagctcacc

SEQ ID NO: 2219474 - DNA, 18 bp, Homo sapiens
cctggtggcagctcacct

SEQ ID NO: 2219475 - DNA, 21 bp, Homo sapiens
cctggtggcagctcacctctc

SEQ ID NO: 2219476 - DNA, 19 bp, Homo sapiens
cctggtggcagtgggagct

SEQ ID NO: 2219477 - DNA, 21 bp, Homo sapiens
cctggtggcagtgggagctgc

SEQ ID NO: 2219478 - DNA, 13 bp, Homo sapiens
cctgtagccctaa

SEQ ID NO: 2219479 - DNA, 15 bp, Homo sapiens
cctgtccccctgaca

SEQ ID NO: 2219480 - DNA, 21 bp, Homo sapiens
cctgtgatggggccctgcctc

SEQ ID NO: 2219481 - DNA, 22 bp, Homo sapiens
cctgtgatggggccctgcctcc

SEQ ID NO: 2219482 - DNA, 20 bp, Homo sapiens
cctgtgcctctgggactgga

SEQ ID NO: 2219483 - DNA, 17 bp, Homo sapiens
cctgtgtcttgcaatgg

SEQ ID NO: 2219484 - DNA, 13 bp, Homo sapiens
cctgttcagctcc

SEQ ID NO: 2219485 - DNA, 14 bp, Homo sapiens
cctgttcagctcca

SEQ ID NO: 2219486 - DNA, 16 bp, Homo sapiens
cctgttcagctccagc

SEQ ID NO: 2219487 - DNA, 15 bp, Homo sapiens
cggggacagctcctt

SEQ ID NO: 2219488 - DNA, 17 bp, Homo sapiens
cggggatcccccgcccc

SEQ ID NO: 2219489 - DNA, 15 bp, Homo sapiens
cgggggagcaggcag

SEQ ID NO: 2219490 - DNA, 14 bp, Homo sapiens
cggtccacccagga

SEQ ID NO: 2219491 - DNA, 20 bp, Homo sapiens
cggtgagaggggaacagact

SEQ ID NO: 2219492 - DNA, 18 bp, Homo sapiens
cggtgctatctcccccag

SEQ ID NO: 2219493 - DNA, 20 bp, Homo sapiens
cggtgctatctcccccagcc

SEQ ID NO: 2219494 - DNA, 21 bp, Homo sapiens
cggtgctatctcccccagccc

SEQ ID NO: 2219495 - DNA, 18 bp, Homo sapiens
cggtgtggagaagcggct

SEQ ID NO: 2219496 - DNA, 16 bp, Homo sapiens
cggttttactgcagct

SEQ ID NO: 2219497 - DNA, 13 bp, Homo sapiens
cgtacacatttta

SEQ ID NO: 2219498 - DNA, 16 bp, Homo sapiens
cgtacacattttattt

SEQ ID NO: 2219499 - DNA, 14 bp, Homo sapiens
cgtcccctgtcccc

SEQ ID NO: 2219500 - DNA, 22 bp, Homo sapiens
cgtccctgcggaagccacaggg

SEQ ID NO: 2219501 - DNA, 16 bp, Homo sapiens
cgtctcatactcacct

SEQ ID NO: 2219502 - DNA, 13 bp, Homo sapiens
cgtctgacaggca

SEQ ID NO: 2219503 - DNA, 22 bp, Homo sapiens
cgtctgacaggcaatgctggct

SEQ ID NO: 2219504 - DNA, 23 bp, Homo sapiens
cgtcttggtttggttcatggtga

SEQ ID NO: 2219505 - DNA, 22 bp, Homo sapiens
cgtgagccactgcaccgggcca

SEQ ID NO: 2219506 - DNA, 16 bp, Homo sapiens
cgtgaggccagagaca

SEQ ID NO: 2219507 - DNA, 16 bp, Homo sapiens
cgtgagtcctggcatg

SEQ ID NO: 2219508 - DNA, 18 bp, Homo sapiens
cgtgagtcctggcatggg

SEQ ID NO: 2219509 - DNA, 21 bp, Homo sapiens
cgtgcacacaccagagcccac

SEQ ID NO: 2219510 - DNA, 22 bp, Homo sapiens
cgtgcacacaccagagcccacc

SEQ ID NO: 2219511 - DNA, 18 bp, Homo sapiens
cgtgcataccacttttgt

SEQ ID NO: 2219512 - DNA, 15 bp, Homo sapiens
cgtggctgcttcaag

SEQ ID NO: 2219513 - DNA, 17 bp, Homo sapiens
cgtggctgcttcaagga

SEQ ID NO: 2219514 - DNA, 13 bp, Homo sapiens
cgttaaaatacca

SEQ ID NO: 2219515 - DNA, 14 bp, Homo sapiens
ctaaagctgccagc

SEQ ID NO: 2219516 - DNA, 15 bp, Homo sapiens
ctaaaggctaccttt

SEQ ID NO: 2219517 - DNA, 16 bp, Homo sapiens
ctaaaggctacctttg

SEQ ID NO: 2219518 - DNA, 21 bp, Homo sapiens
ctaaatctccaaaataaaact

SEQ ID NO: 2219519 - DNA, 22 bp, Homo sapiens
ctaaatgaaaatcgtgacaaca

SEQ ID NO: 2219520 - DNA, 12 bp, Homo sapiens
ctaaccacgctg

SEQ ID NO: 2219521 - DNA, 14 bp, Homo sapiens
ctaaccacgctgga

SEQ ID NO: 2219522 - DNA, 16 bp, Homo sapiens
ctaacttcaccatatt

SEQ ID NO: 2219523 - DNA, 19 bp, Homo sapiens
ctaagctattcagtaataa

SEQ ID NO: 2219524 - DNA, 23 bp, Homo sapiens
ctaagtgatcctcccacctcagc

SEQ ID NO: 2219525 - DNA, 23 bp, Homo sapiens
ctaagtttttatggcttttgtgc

SEQ ID NO: 2219526 - DNA, 12 bp, Homo sapiens
ctaatgggacac

SEQ ID NO: 2219527 - DNA, 14 bp, Homo sapiens
ctaatgtactgcat

SEQ ID NO: 2219528 - DNA, 13 bp, Homo sapiens
ctacacactgcat

SEQ ID NO: 2219529 - DNA, 21 bp, Homo sapiens
ctacacaggggaaaagaggag

SEQ ID NO: 2219530 - DNA, 14 bp, Homo sapiens
ctacactgtgctga

SEQ ID NO: 2219531 - DNA, 17 bp, Homo sapiens
ctacactgtgctgagtc

SEQ ID NO: 2219532 - DNA, 15 bp, Homo sapiens
ctacagaggccatgg

SEQ ID NO: 2219533 - DNA, 18 bp, Homo sapiens
ctacagaggccatgggcc

SEQ ID NO: 2219534 - DNA, 19 bp, Homo sapiens
ctacagcttgaccgtgagg

SEQ ID NO: 2219535 - DNA, 22 bp, Homo sapiens
ctacagcttgaccgtgaggcca

SEQ ID NO: 2219536 - DNA, 14 bp, Homo sapiens
ctacaggagtgagc

SEQ ID NO: 2219537 - DNA, 15 bp, Homo sapiens
ctacaggagtgagca

SEQ ID NO: 2219538 - DNA, 14 bp, Homo sapiens
ctacaggtgtgagt

SEQ ID NO: 2219539 - DNA, 15 bp, Homo sapiens
ctacagtcctcccat

SEQ ID NO: 2219540 - DNA, 13 bp, Homo sapiens
ctacagttgaaaa

SEQ ID NO: 2219541 - DNA, 22 bp, Homo sapiens
ctacagttgaaaaacagctgag

SEQ ID NO: 2219542 - DNA, 18 bp, Homo sapiens
ctacatacaattccaaac

SEQ ID NO: 2219543 - DNA, 13 bp, Homo sapiens
ctacccaccctcc

SEQ ID NO: 2219544 - DNA, 17 bp, Homo sapiens
ctacccaccctcctttc

SEQ ID NO: 2219545 - DNA, 12 bp, Homo sapiens
ctacccaggtgc

SEQ ID NO: 2219546 - DNA, 17 bp, Homo sapiens
ctaccctcttagaaaaa

SEQ ID NO: 2219547 - DNA, 19 bp, Homo sapiens
ctacctgaggggcctctta

SEQ ID NO: 2219548 - DNA, 16 bp, Homo sapiens
ctactcgagttacaga

SEQ ID NO: 2219549 - DNA, 19 bp, Homo sapiens
ctactcgagttacagacaa

SEQ ID NO: 2219550 - DNA, 22 bp, Homo sapiens
ctcactgttgcccaggctggcg

SEQ ID NO: 2219551 - DNA, 20 bp, Homo sapiens
ctcagaagacactgatgggc

SEQ ID NO: 2219552 - DNA, 23 bp, Homo sapiens
ctcagagagggtgggagtgggcc

SEQ ID NO: 2219553 - DNA, 15 bp, Homo sapiens
ctcagatcttctgtg

SEQ ID NO: 2219554 - DNA, 21 bp, Homo sapiens
ctcagcaaaagatgcttctca

SEQ ID NO: 2219555 - DNA, 13 bp, Homo sapiens
ctcagcatcctgg

SEQ ID NO: 2219556 - DNA, 15 bp, Homo sapiens
ctcagcatcctggca

SEQ ID NO: 2219557 - DNA, 18 bp, Homo sapiens
ctcagcatcctggcaccc

SEQ ID NO: 2219558 - DNA, 21 bp, Homo sapiens
ctcagcatcctggcacccggc

SEQ ID NO: 2219559 - DNA, 13 bp, Homo sapiens
ctcagcctcccaa

SEQ ID NO: 2219560 - DNA, 13 bp, Homo sapiens
ctcagcctcccga

SEQ ID NO: 2219561 - DNA, 13 bp, Homo sapiens
ctcagcggggaca

SEQ ID NO: 2219562 - DNA, 18 bp, Homo sapiens
ctcagcggggacagctcc

SEQ ID NO: 2219563 - DNA, 19 bp, Homo sapiens
ctcagcggggacagctcct

SEQ ID NO: 2219564 - DNA, 18 bp, Homo sapiens
ctcaggagtttgagacca

SEQ ID NO: 2219565 - DNA, 21 bp, Homo sapiens
ctcaggccaaactcacctgcc

SEQ ID NO: 2219566 - DNA, 13 bp, Homo sapiens
ctcaggccagctg

SEQ ID NO: 2219567 - DNA, 14 bp, Homo sapiens
ctcaggccagctgc

SEQ ID NO: 2219568 - DNA, 16 bp, Homo sapiens
ctcaggccagctgctt

SEQ ID NO: 2219569 - DNA, 17 bp, Homo sapiens
ctcaggccagctgcttg

SEQ ID NO: 2219570 - DNA, 22 bp, Homo sapiens
ctcaggcctgggggctgggcag

SEQ ID NO: 2219571 - DNA, 16 bp, Homo sapiens
ctcagggcctggctca

SEQ ID NO: 2219572 - DNA, 19 bp, Homo sapiens
ctcagggcctggctcaggt

SEQ ID NO: 2219573 - DNA, 20 bp, Homo sapiens
ctcagggcctggctcaggtg

SEQ ID NO: 2219574 - DNA, 14 bp, Homo sapiens
ctcagggcctggtc

SEQ ID NO: 2219575 - DNA, 14 bp, Homo sapiens
ctcagggtccctgg

SEQ ID NO: 2219576 - DNA, 15 bp, Homo sapiens
ctcagggtccctggt

SEQ ID NO: 2219577 - DNA, 20 bp, Homo sapiens
ctcagggtccctggtggcag

SEQ ID NO: 2219578 - DNA, 16 bp, Homo sapiens
ctcaggtgagaagcag

SEQ ID NO: 2219579 - DNA, 20 bp, Homo sapiens
ctcaggtgagaagcagagga

SEQ ID NO: 2219580 - DNA, 18 bp, Homo sapiens
ctcaggtgatccacccac

SEQ ID NO: 2219581 - DNA, 20 bp, Homo sapiens
ctcaggtggggtcactctgg

SEQ ID NO: 2219582 - DNA, 22 bp, Homo sapiens
ctcaggtggggtcactctggca

SEQ ID NO: 2219583 - DNA, 23 bp, Homo sapiens
ctcaggtggggtcactctggcag

SEQ ID NO: 2219584 - DNA, 17 bp, Homo sapiens
ctcagtccatagcagag

SEQ ID NO: 2219585 - DNA, 20 bp, Homo sapiens
ctcagtctggcccttccttt

SEQ ID NO: 2219586 - DNA, 19 bp, Homo sapiens
ctcatacccacccccaccc

SEQ ID NO: 2219587 - DNA, 14 bp, Homo sapiens
ctcatactcacctc

SEQ ID NO: 2219588 - DNA, 21 bp, Homo sapiens
ctcatcaccaacgtctgtgcc

SEQ ID NO: 2219589 - DNA, 22 bp, Homo sapiens
ctcatcaccaacgtctgtgcca

SEQ ID NO: 2219590 - DNA, 12 bp, Homo sapiens
ctcatgttctta

SEQ ID NO: 2219591 - DNA, 19 bp, Homo sapiens
ctcatgttcttaattctta

SEQ ID NO: 2219592 - DNA, 21 bp, Homo sapiens
ctcattagcattttgctaaat

SEQ ID NO: 2219593 - DNA, 18 bp, Homo sapiens
ctcattctccttgtgtta

SEQ ID NO: 2219594 - DNA, 22 bp, Homo sapiens
ctcattctccttgtgttactaa

SEQ ID NO: 2219595 - DNA, 13 bp, Homo sapiens
ctcattcttctgt

SEQ ID NO: 2219596 - DNA, 14 bp, Homo sapiens
ctcattcttctgta

SEQ ID NO: 2219597 - DNA, 23 bp, Homo sapiens
ctcattcttctgtacgtctgaca

SEQ ID NO: 2219598 - DNA, 15 bp, Homo sapiens
ctcattgacctgagg

SEQ ID NO: 2219599 - DNA, 15 bp, Homo sapiens
ctccaagaccttctc

SEQ ID NO: 2219600 - DNA, 18 bp, Homo sapiens
ctccaagaccttctcctt

SEQ ID NO: 2219601 - DNA, 14 bp, Homo sapiens
ctccaagcaggaca

SEQ ID NO: 2219602 - DNA, 22 bp, Homo sapiens
ctccaagcaggacatggacaag

SEQ ID NO: 2219603 - DNA, 12 bp, Homo sapiens
ctccacctgcca

SEQ ID NO: 2219604 - DNA, 18 bp, Homo sapiens
ctccacctgccagggaca

SEQ ID NO: 2219605 - DNA, 16 bp, Homo sapiens
ctccactttctagcca

SEQ ID NO: 2219606 - DNA, 19 bp, Homo sapiens
ctccactttctagccagag

SEQ ID NO: 2219607 - DNA, 19 bp, Homo sapiens
ctccagacacatgtccaag

SEQ ID NO: 2219608 - DNA, 14 bp, Homo sapiens
ctccagcccctgga

SEQ ID NO: 2219609 - DNA, 15 bp, Homo sapiens
ctccagctcaccagc

SEQ ID NO: 2219610 - DNA, 18 bp, Homo sapiens
ctccagctcaccagcccc

SEQ ID NO: 2219611 - DNA, 18 bp, Homo sapiens
ctccagctgttcagctgg

SEQ ID NO: 2219612 - DNA, 14 bp, Homo sapiens
ctccaggagcagcc

SEQ ID NO: 2219613 - DNA, 15 bp, Homo sapiens
ctccaggagcagcca

SEQ ID NO: 2219614 - DNA, 23 bp, Homo sapiens
ctccaggctgtatcccatgagcc

SEQ ID NO: 2219615 - DNA, 22 bp, Homo sapiens
ctccaggtgcacaagctccaag

SEQ ID NO: 2219616 - DNA, 16 bp, Homo sapiens
ctcccaaagtgctggg

SEQ ID NO: 2219617 - DNA, 15 bp, Homo sapiens
ctcccaactcacccc

SEQ ID NO: 2219618 - DNA, 19 bp, Homo sapiens
ctcccaccccctccccggg

SEQ ID NO: 2219619 - DNA, 16 bp, Homo sapiens
ctcccacctcagcctc

SEQ ID NO: 2219620 - DNA, 19 bp, Homo sapiens
ctcccagacccccttgccc

SEQ ID NO: 2219621 - DNA, 22 bp, Homo sapiens
ctcccagacccccttgcccagg

SEQ ID NO: 2219622 - DNA, 15 bp, Homo sapiens
ctcccaggcattccc

SEQ ID NO: 2219623 - DNA, 16 bp, Homo sapiens
ctcccatcacttccct

SEQ ID NO: 2219624 - DNA, 14 bp, Homo sapiens
ctcccatctcacac

SEQ ID NO: 2219625 - DNA, 18 bp, Homo sapiens
ctcccatctcacacatga

SEQ ID NO: 2219626 - DNA, 21 bp, Homo sapiens
ctcccatctcacacatgagca

SEQ ID NO: 2219627 - DNA, 11 bp, Homo sapiens
ctcccatctgt

SEQ ID NO: 2219628 - DNA, 18 bp, Homo sapiens
ctcccatctgtgaaagga

SEQ ID NO: 2219629 - DNA, 23 bp, Homo sapiens
ctcccatctgtgaaaggaaagag

SEQ ID NO: 2219630 - DNA, 23 bp, Homo sapiens
ctccccagcaagtgagagctggg

SEQ ID NO: 2219631 - DNA, 20 bp, Homo sapiens
ctccccagccccatcccaaa

SEQ ID NO: 2219632 - DNA, 15 bp, Homo sapiens
ctcccccagccccat

SEQ ID NO: 2219633 - DNA, 20 bp, Homo sapiens
ctcccccagccccatcctct

SEQ ID NO: 2219634 - DNA, 13 bp, Homo sapiens
ctccccgggcagc

SEQ ID NO: 2219635 - DNA, 15 bp, Homo sapiens
ctccccgggcagcag

SEQ ID NO: 2219636 - DNA, 17 bp, Homo sapiens
ctccccgggcagcagag

SEQ ID NO: 2219637 - DNA, 19 bp, Homo sapiens
ctccccgggcagcagagag

SEQ ID NO: 2219638 - DNA, 20 bp, Homo sapiens
ctccccgggcagcagagaga

SEQ ID NO: 2219639 - DNA, 21 bp, Homo sapiens
ctccccgggcagcagagagag

SEQ ID NO: 2219640 - DNA, 23 bp, Homo sapiens
ctcccctgctgggtgtggcgcag

SEQ ID NO: 2219641 - DNA, 17 bp, Homo sapiens
ctcccgaatagctggga

SEQ ID NO: 2219642 - DNA, 23 bp, Homo sapiens
ctcccttcccacctctctcactc

SEQ ID NO: 2219643 - DNA, 13 bp, Homo sapiens
ctcccttcctctt

SEQ ID NO: 2219644 - DNA, 14 bp, Homo sapiens
ctcccttcctcttt

SEQ ID NO: 2219645 - DNA, 17 bp, Homo sapiens
ctccctttcttccctac

SEQ ID NO: 2219646 - DNA, 20 bp, Homo sapiens
ctccgctttctacccagcga

SEQ ID NO: 2219647 - DNA, 23 bp, Homo sapiens
ctccgctttctacccagcgagcc

SEQ ID NO: 2219648 - DNA, 13 bp, Homo sapiens
ctcctccagagtc

SEQ ID NO: 2219649 - DNA, 13 bp, Homo sapiens
ctcctctccccag

SEQ ID NO: 2219650 - DNA, 16 bp, Homo sapiens
ctcctctgctgctggc

SEQ ID NO: 2219651 - DNA, 14 bp, Homo sapiens
ctcctgcaggcagc

SEQ ID NO: 2219652 - DNA, 20 bp, Homo sapiens
ctcctgcaggcagccaggcc

SEQ ID NO: 2219653 - DNA, 20 bp, Homo sapiens
ctcctgcccccaccccaggc

SEQ ID NO: 2219654 - DNA, 17 bp, Homo sapiens
ctcctgcctcagcctcc

SEQ ID NO: 2219655 - DNA, 22 bp, Homo sapiens
ctcctgcctcgaactggctgca

SEQ ID NO: 2219656 - DNA, 14 bp, Homo sapiens
ctcctggaaatatt

SEQ ID NO: 2219657 - DNA, 19 bp, Homo sapiens
ctcctggcctcaagtgatt

SEQ ID NO: 2219658 - DNA, 15 bp, Homo sapiens
ctcctgtgtcttgca

SEQ ID NO: 2219659 - DNA, 23 bp, Homo sapiens
ctcctgtgtcttgcaatggcagc

SEQ ID NO: 2219660 - DNA, 14 bp, Homo sapiens
ctcctgtgtgtgcg

SEQ ID NO: 2219661 - DNA, 16 bp, Homo sapiens
ctcctgtgtgtgcgcc

SEQ ID NO: 2219662 - DNA, 19 bp, Homo sapiens
ctcctgtgtgtgcgcctac

SEQ ID NO: 2219663 - DNA, 23 bp, Homo sapiens
ctcctgtgtgtgcgcctacagga

SEQ ID NO: 2219664 - DNA, 16 bp, Homo sapiens
ctccttcacagatggg

SEQ ID NO: 2219665 - DNA, 19 bp, Homo sapiens
ctccttcacagatgggtgc

SEQ ID NO: 2219666 - DNA, 19 bp, Homo sapiens
ctccttcacctttgtcccc

SEQ ID NO: 2219667 - DNA, 21 bp, Homo sapiens
ctccttcacctttgtccccac

SEQ ID NO: 2219668 - DNA, 18 bp, Homo sapiens
ctgtctcaaaaaaagaaa

SEQ ID NO: 2219669 - DNA, 18 bp, Homo sapiens
ctgtcttcagtaagccgt

SEQ ID NO: 2219670 - DNA, 15 bp, Homo sapiens
ctgtgatggggccct

SEQ ID NO: 2219671 - DNA, 18 bp, Homo sapiens
ctgtgatggggccctgcc

SEQ ID NO: 2219672 - DNA, 19 bp, Homo sapiens
ctgtgatggggccctgcct

SEQ ID NO: 2219673 - DNA, 20 bp, Homo sapiens
ctgtgatggggccctgcctc

SEQ ID NO: 2219674 - DNA, 14 bp, Homo sapiens
ctgtgccattttgt

SEQ ID NO: 2219675 - DNA, 22 bp, Homo sapiens
ctgtgccattttgtattttact

SEQ ID NO: 2219676 - DNA, 16 bp, Homo sapiens
ctgtgcctctgggact

SEQ ID NO: 2219677 - DNA, 18 bp, Homo sapiens
ctgtgcctctgggactgg

SEQ ID NO: 2219678 - DNA, 18 bp, Homo sapiens
ctgtgctctggacaggca

SEQ ID NO: 2219679 - DNA, 21 bp, Homo sapiens
ctgtgctgccctgcccacctg

SEQ ID NO: 2219680 - DNA, 22 bp, Homo sapiens
ctgtgtcaggtggggcagcttg

SEQ ID NO: 2219681 - DNA, 14 bp, Homo sapiens
ctgtgtctcccttc

SEQ ID NO: 2219682 - DNA, 19 bp, Homo sapiens
ctgtgtctcccttcatcct

SEQ ID NO: 2219683 - DNA, 20 bp, Homo sapiens
ctgtgtcttgcaatggcagc

SEQ ID NO: 2219684 - DNA, 23 bp, Homo sapiens
ctgtgtcttgcaatggcagcctt

SEQ ID NO: 2219685 - DNA, 20 bp, Homo sapiens
ctgtgtcttttttcactaca

SEQ ID NO: 2219686 - DNA, 13 bp, Homo sapiens
ctgttcagctcca

SEQ ID NO: 2219687 - DNA, 19 bp, Homo sapiens
ctgttcagctccagctcac

SEQ ID NO: 2219688 - DNA, 22 bp, Homo sapiens
ctgttcagctccagctcaccag

SEQ ID NO: 2219689 - DNA, 21 bp, Homo sapiens
ctgttcagctggttgaggttt

SEQ ID NO: 2219690 - DNA, 13 bp, Homo sapiens
ctgttctctgccc

SEQ ID NO: 2219691 - DNA, 16 bp, Homo sapiens
cttggtttggttcatg

SEQ ID NO: 2219692 - DNA, 14 bp, Homo sapiens
cttggtttgtaaat

SEQ ID NO: 2219693 - DNA, 17 bp, Homo sapiens
cttgtaaatagctcagg

SEQ ID NO: 2219694 - DNA, 21 bp, Homo sapiens
cttgtacataatgcgtgcata

SEQ ID NO: 2219695 - DNA, 22 bp, Homo sapiens
cttgtctttggaccctgaggcc

SEQ ID NO: 2219696 - DNA, 16 bp, Homo sapiens
cttgtggacacagctc

SEQ ID NO: 2219697 - DNA, 20 bp, Homo sapiens
ctttaatgtcacaggcaggt

SEQ ID NO: 2219698 - DNA, 20 bp, Homo sapiens
ctttaccttttttatacata

SEQ ID NO: 2219699 - DNA, 15 bp, Homo sapiens
ctttagcgcccagtt

SEQ ID NO: 2219700 - DNA, 15 bp, Homo sapiens
ctttcaataggaaaa

SEQ ID NO: 2219701 - DNA, 18 bp, Homo sapiens
ctttcaataggaaaaact

SEQ ID NO: 2219702 - DNA, 22 bp, Homo sapiens
ctttcaataggaaaaactgatt

SEQ ID NO: 2219703 - DNA, 23 bp, Homo sapiens
ctttcaataggaaaaactgattt

SEQ ID NO: 2219704 - DNA, 16 bp, Homo sapiens
ctttccaaagtacact

SEQ ID NO: 2219705 - DNA, 22 bp, Homo sapiens
ctttccaaagtacactgtttca

SEQ ID NO: 2219706 - DNA, 19 bp, Homo sapiens
ctttccaaatgcccagctt

SEQ ID NO: 2219707 - DNA, 14 bp, Homo sapiens
ctttccaggaaggc

SEQ ID NO: 2219708 - DNA, 11 bp, Homo sapiens
ctttccctccc

SEQ ID NO: 2219709 - DNA, 16 bp, Homo sapiens
ctttcctgaggctggg

SEQ ID NO: 2219710 - DNA, 15 bp, Homo sapiens
ctttctacccagcga

SEQ ID NO: 2219711 - DNA, 20 bp, Homo sapiens
ctttctggctatgcatttga

SEQ ID NO: 2219712 - DNA, 24 bp, Homo sapiens
ctttgacctctgcagcaataaagc

SEQ ID NO: 2219713 - DNA, 16 bp, Homo sapiens
ctttgacgccatccca

SEQ ID NO: 2219714 - DNA, 18 bp, Homo sapiens
ctttgacgccatcccagc

SEQ ID NO: 2219715 - DNA, 19 bp, Homo sapiens
ctttgacgccatcccagcc

SEQ ID NO: 2219716 - DNA, 21 bp, Homo sapiens
ctttgacgccatcccagcccc

SEQ ID NO: 2219717 - DNA, 16 bp, Homo sapiens
ctttgcagacaggcaa

SEQ ID NO: 2219718 - DNA, 12 bp, Homo sapiens
ctttggaaagac

SEQ ID NO: 2219719 - DNA, 23 bp, Homo sapiens
ctttggaaagacttttccaaccc

SEQ ID NO: 2219720 - DNA, 19 bp, Homo sapiens
ctttggaccctgaggccca

SEQ ID NO: 2219721 - DNA, 13 bp, Homo sapiens
ctttgggaggcca

SEQ ID NO: 2219722 - DNA, 17 bp, Homo sapiens
ctttgtattctctcctg

SEQ ID NO: 2219723 - DNA, 18 bp, Homo sapiens
ctttgtccccaccgcaga

SEQ ID NO: 2219724 - DNA, 22 bp, Homo sapiens
ctttgtccccaccgcagacagg

SEQ ID NO: 2219725 - DNA, 12 bp, Homo sapiens
ctttgtgatttt

SEQ ID NO: 2219726 - DNA, 15 bp, Homo sapiens
ctttgttctggctct

SEQ ID NO: 2219727 - DNA, 13 bp, Homo sapiens
cttttataaactt

SEQ ID NO: 2219728 - DNA, 15 bp, Homo sapiens
cttttataaacttta

SEQ ID NO: 2219729 - DNA, 20 bp, Homo sapiens
cttttataaactttaccttt

SEQ ID NO: 2219730 - DNA, 22 bp, Homo sapiens
cttttcataacctagccttaga

SEQ ID NO: 2219731 - DNA, 17 bp, Homo sapiens
cttttctttcagccaag

SEQ ID NO: 2219732 - DNA, 16 bp, Homo sapiens
cttttgccgttattaa

SEQ ID NO: 2219733 - DNA, 12 bp, Homo sapiens
cttttgttcttg

SEQ ID NO: 2219734 - DNA, 22 bp, Homo sapiens
cttttgttcttggtttgtaaat

SEQ ID NO: 2219735 - DNA, 16 bp, Homo sapiens
cttttttagagttgat

SEQ ID NO: 2219736 - DNA, 17 bp, Homo sapiens
cttttttatacataaac

SEQ ID NO: 2219737 - DNA, 16 bp, Homo sapiens
cttttttggctgctga

SEQ ID NO: 2219738 - DNA, 17 bp, Homo sapiens
cttttttggctgctgaa

SEQ ID NO: 2219739 - DNA, 20 bp, Homo sapiens
cttttttggctgctgaaggc

SEQ ID NO: 2219740 - DNA, 22 bp, Homo sapiens
cttttttggctgctgaaggctc

SEQ ID NO: 2219741 - DNA, 15 bp, Homo sapiens
gaaaaaaaaaaacac

SEQ ID NO: 2219742 - DNA, 16 bp, Homo sapiens
gaaaaaaaaagggggg

SEQ ID NO: 2219743 - DNA, 14 bp, Homo sapiens
gaaaaactgatttt

SEQ ID NO: 2219744 - DNA, 12 bp, Homo sapiens
gaaaaaggagga

SEQ ID NO: 2219745 - DNA, 23 bp, Homo sapiens
gaaaaaggatgcacagagttgtt

SEQ ID NO: 2219746 - DNA, 19 bp, Homo sapiens
gaaaacacatttttcttag

SEQ ID NO: 2219747 - DNA, 12 bp, Homo sapiens
gaaaacatgcta

SEQ ID NO: 2219748 - DNA, 19 bp, Homo sapiens
gaaaacatgctacacactg

SEQ ID NO: 2219749 - DNA, 16 bp, Homo sapiens
gaaaacgtggctgctt

SEQ ID NO: 2219750 - DNA, 19 bp, Homo sapiens
gaaaacgtggctgcttcaa

SEQ ID NO: 2219751 - DNA, 20 bp, Homo sapiens
gaaaacgtggctgcttcaag

SEQ ID NO: 2219752 - DNA, 14 bp, Homo sapiens
gaaaatcagcctgc

SEQ ID NO: 2219753 - DNA, 16 bp, Homo sapiens
gaaaatcagcctgctc

SEQ ID NO: 2219754 - DNA, 21 bp, Homo sapiens
gaaaatggaagacagctctta

SEQ ID NO: 2219755 - DNA, 19 bp, Homo sapiens
gaaaatggacgtgttatga

SEQ ID NO: 2219756 - DNA, 15 bp, Homo sapiens
gaaaatgtatgtgta

SEQ ID NO: 2219757 - DNA, 18 bp, Homo sapiens
gaaacagctaatgggaca

SEQ ID NO: 2219758 - DNA, 15 bp, Homo sapiens
gaaacccagctctgg

SEQ ID NO: 2219759 - DNA, 16 bp, Homo sapiens
gaaacccagctctggt

SEQ ID NO: 2219760 - DNA, 18 bp, Homo sapiens
gaaacccagctctggtcc

SEQ ID NO: 2219761 - DNA, 17 bp, Homo sapiens
gaaactggattaaactt

SEQ ID NO: 2219762 - DNA, 12 bp, Homo sapiens
gaaagagagaga

SEQ ID NO: 2219763 - DNA, 15 bp, Homo sapiens
gaaagagagagagag

SEQ ID NO: 2219764 - DNA, 21 bp, Homo sapiens
gaaagccctgagctttctgct

SEQ ID NO: 2219765 - DNA, 19 bp, Homo sapiens
gaaaggctccaggagcagc

SEQ ID NO: 2219766 - DNA, 22 bp, Homo sapiens
gaaagtacttctccaccctgct

SEQ ID NO: 2219767 - DNA, 13 bp, Homo sapiens
gaaatataattga

SEQ ID NO: 2219768 - DNA, 17 bp, Homo sapiens
gaaatataggaacttaa

SEQ ID NO: 2219769 - DNA, 18 bp, Homo sapiens
gaaatatctgaaaatgta

SEQ ID NO: 2219770 - DNA, 19 bp, Homo sapiens
gaaatatctgaaaatgtat

SEQ ID NO: 2219771 - DNA, 20 bp, Homo sapiens
gaaatatctgaaaatgtatg

SEQ ID NO: 2219772 - DNA, 11 bp, Homo sapiens
gaaatgagctg

SEQ ID NO: 2219773 - DNA, 20 bp, Homo sapiens
gaaatgggcagagcagagac

SEQ ID NO: 2219774 - DNA, 15 bp, Homo sapiens
gaacaaggcaaggct

SEQ ID NO: 2219775 - DNA, 16 bp, Homo sapiens
gaacagactggaagca

SEQ ID NO: 2219776 - DNA, 19 bp, Homo sapiens
gaacagactggaagcacag

SEQ ID NO: 2219777 - DNA, 22 bp, Homo sapiens
gaacagactggaagcacagctt

SEQ ID NO: 2219778 - DNA, 16 bp, Homo sapiens
gaacaggtttaaaaat

SEQ ID NO: 2219779 - DNA, 22 bp, Homo sapiens
gaaccatggtcggaaaacatgc

SEQ ID NO: 2219780 - DNA, 22 bp, Homo sapiens
gaaccttttgagtgccttacac

SEQ ID NO: 2219781 - DNA, 14 bp, Homo sapiens
gaactcctggcctc

SEQ ID NO: 2219782 - DNA, 15 bp, Homo sapiens
gaactcctggcctca

SEQ ID NO: 2219783 - DNA, 15 bp, Homo sapiens
gaacttggcgctgcc

SEQ ID NO: 2219784 - DNA, 16 bp, Homo sapiens
gaacttggcgctgccc

SEQ ID NO: 2219785 - DNA, 23 bp, Homo sapiens
gaacttggttcccatttgctcct

SEQ ID NO: 2219786 - DNA, 23 bp, Homo sapiens
gaactttgacctctgcagcaata

SEQ ID NO: 2219787 - DNA, 23 bp, Homo sapiens
gaagacaatgtgaaaagaaaaat

SEQ ID NO: 2219788 - DNA, 15 bp, Homo sapiens
gaagacagagctaca

SEQ ID NO: 2219789 - DNA, 17 bp, Homo sapiens
gaagactcattcttctg

SEQ ID NO: 2219790 - DNA, 18 bp, Homo sapiens
gaagactcattcttctgt

SEQ ID NO: 2219791 - DNA, 21 bp, Homo sapiens
gaagactcattcttctgtacg

SEQ ID NO: 2219792 - DNA, 17 bp, Homo sapiens
gaagacttcatccctct

SEQ ID NO: 2219793 - DNA, 19 bp, Homo sapiens
gaagacttcatccctctgg

SEQ ID NO: 2219794 - DNA, 14 bp, Homo sapiens
gaagcacatgcctc

SEQ ID NO: 2219795 - DNA, 15 bp, Homo sapiens
gaagcacatgcctct

SEQ ID NO: 2219796 - DNA, 17 bp, Homo sapiens
gaagcacatgcctctct

SEQ ID NO: 2219797 - DNA, 21 bp, Homo sapiens
gaagcacatgcctctctcagg

SEQ ID NO: 2219798 - DNA, 19 bp, Homo sapiens
gaagccacagggtgagcac

SEQ ID NO: 2219799 - DNA, 21 bp, Homo sapiens
gaagccagcaggctctcaggc

SEQ ID NO: 2219800 - DNA, 23 bp, Homo sapiens
gaagcccaggaaaggctccagga

SEQ ID NO: 2219801 - DNA, 21 bp, Homo sapiens
gaagccgctggggccagttgg

SEQ ID NO: 2219802 - DNA, 11 bp, Homo sapiens
tggcctcccaa

SEQ ID NO: 2219803 - DNA, 19 bp, Homo sapiens
tggcctcccaactcacccc

SEQ ID NO: 2219804 - DNA, 21 bp, Homo sapiens
tggcctcccaactcaccccag

SEQ ID NO: 2219805 - DNA, 20 bp, Homo sapiens
tggcctctgcactcccctgc

SEQ ID NO: 2219806 - DNA, 18 bp, Homo sapiens
tggcctgagctgggatga

SEQ ID NO: 2219807 - DNA, 14 bp, Homo sapiens
tggctatgcatttg

SEQ ID NO: 2219808 - DNA, 19 bp, Homo sapiens
tggctatgcatttgaaaat

SEQ ID NO: 2219809 - DNA, 16 bp, Homo sapiens
tggctcttccaggctg

SEQ ID NO: 2219810 - DNA, 19 bp, Homo sapiens
tggctcttccaggctggga

SEQ ID NO: 2219811 - DNA, 12 bp, Homo sapiens
tggctgcaaagg

SEQ ID NO: 2219812 - DNA, 23 bp, Homo sapiens
tggctgcaaagggtatcaggtgc

SEQ ID NO: 2219813 - DNA, 15 bp, Homo sapiens
tggctgcagggagtc

SEQ ID NO: 2219814 - DNA, 18 bp, Homo sapiens
tggctgccaatgggagct

SEQ ID NO: 2219815 - DNA, 11 bp, Homo sapiens
tggctgctgaa

SEQ ID NO: 2219816 - DNA, 16 bp, Homo sapiens
tggctgctgaaggctc

SEQ ID NO: 2219817 - DNA, 16 bp, Homo sapiens
tggctgcttcaaggat

SEQ ID NO: 2219818 - DNA, 12 bp, Homo sapiens
tggctgggggcc

SEQ ID NO: 2219819 - DNA, 15 bp, Homo sapiens
tggctgggggcctca

SEQ ID NO: 2219820 - DNA, 16 bp, Homo sapiens
tggctgttggctgggg

SEQ ID NO: 2219821 - DNA, 23 bp, Homo sapiens
tggctgttggctgggggcctcag

SEQ ID NO: 2219822 - DNA, 17 bp, Homo sapiens
tggcttaaaacaacact

SEQ ID NO: 2219823 - DNA, 23 bp, Homo sapiens
tggcttcacggaagagccttgcg

SEQ ID NO: 2219824 - DNA, 22 bp, Homo sapiens
tggcttcctaaaattcagtgga

SEQ ID NO: 2219825 - DNA, 15 bp, Homo sapiens
tggcttttgtgcatt

SEQ ID NO: 2219826 - DNA, 21 bp, Homo sapiens
tggcttttgtgcattatctag

SEQ ID NO: 2219827 - DNA, 12 bp, Homo sapiens
tgggacaccctg

SEQ ID NO: 2219828 - DNA, 14 bp, Homo sapiens
tgggacaccctgtg

SEQ ID NO: 2219829 - DNA, 20 bp, Homo sapiens
tgggactcaatgcactgaca

SEQ ID NO: 2219830 - DNA, 22 bp, Homo sapiens
tgggagaaccaaaaagaggcta

SEQ ID NO: 2219831 - DNA, 19 bp, Homo sapiens
tgggagagaagagaatgca

SEQ ID NO: 2219832 - DNA, 24 bp, Homo sapiens
tgggagctgcctgttcagctccag

SEQ ID NO: 2219833 - DNA, 18 bp, Homo sapiens
tgggaggatctcttgagc

SEQ ID NO: 2219834 - DNA, 20 bp, Homo sapiens
tgggaggatctcttgagcct

SEQ ID NO: 2219835 - DNA, 19 bp, Homo sapiens
tgggaggccaaggtgggag

SEQ ID NO: 2219836 - DNA, 20 bp, Homo sapiens
tgggaggccaaggtgggagg

SEQ ID NO: 2219837 - DNA, 13 bp, Homo sapiens
tgggaggggaaga

SEQ ID NO: 2219838 - DNA, 14 bp, Homo sapiens
tgggagtgggccca

SEQ ID NO: 2219839 - DNA, 12 bp, Homo sapiens
tgggatcctcca

SEQ ID NO: 2219840 - DNA, 14 bp, Homo sapiens
tgggatcctccagg

SEQ ID NO: 2219841 - DNA, 18 bp, Homo sapiens
tgggatcctccaggtgca

SEQ ID NO: 2219842 - DNA, 16 bp, Homo sapiens
tgggattacaggtgtg

SEQ ID NO: 2219843 - DNA, 17 bp, Homo sapiens
tgggcaacccccagcct

SEQ ID NO: 2219844 - DNA, 12 bp, Homo sapiens
tgggcagaagga

SEQ ID NO: 2219845 - DNA, 12 bp, Homo sapiens
tgggcagagcag

SEQ ID NO: 2219846 - DNA, 13 bp, Homo sapiens
tgggcagagcaga

SEQ ID NO: 2219847 - DNA, 17 bp, Homo sapiens
tgggcagagcagagacc

SEQ ID NO: 2219848 - DNA, 22 bp, Homo sapiens
tgggcagagcagagaccatccc

SEQ ID NO: 2219849 - DNA, 15 bp, Homo sapiens
tgggcagaggaaagc

SEQ ID NO: 2219850 - DNA, 16 bp, Homo sapiens
tgggcagaggaaagca

SEQ ID NO: 2219851 - DNA, 16 bp, Homo sapiens
tgggcccccaaatgga

SEQ ID NO: 2219852 - DNA, 14 bp, Homo sapiens
tgggcctcctgtgt

SEQ ID NO: 2219853 - DNA, 14 bp, Homo sapiens
tgggcctggctccc

SEQ ID NO: 2219854 - DNA, 14 bp, Homo sapiens
tgggctcccttccc

SEQ ID NO: 2219855 - DNA, 19 bp, Homo sapiens
tgggctcccttcccacctc

SEQ ID NO: 2219856 - DNA, 19 bp, Homo sapiens
tgggctgggttctacccag

SEQ ID NO: 2219857 - DNA, 17 bp, Homo sapiens
tgggcttcagtggcagc

SEQ ID NO: 2219858 - DNA, 20 bp, Homo sapiens
tgggcttcagtggcagctgc

SEQ ID NO: 2219859 - DNA, 21 bp, Homo sapiens
tgggcttcagtggcagctgct

SEQ ID NO: 2219860 - DNA, 22 bp, Homo sapiens
tgggcttcatcctcctcagatc

SEQ ID NO: 2219861 - DNA, 19 bp, Homo sapiens
tgggcttggggaccagagc

SEQ ID NO: 2219862 - DNA, 18 bp, Homo sapiens
tggggaccagagctgcca

SEQ ID NO: 2219863 - DNA, 16 bp, Homo sapiens
tggggacctcaggcct

SEQ ID NO: 2219864 - DNA, 16 bp, Homo sapiens
tggggcagcttgaggg

SEQ ID NO: 2219865 - DNA, 21 bp, Homo sapiens
tggggccagttggtccccctt

SEQ ID NO: 2219866 - DNA, 14 bp, Homo sapiens
tggggccctgcctc

SEQ ID NO: 2219867 - DNA, 18 bp, Homo sapiens
tggggcggtgagagggga

SEQ ID NO: 2219868 - DNA, 18 bp, Homo sapiens
tggggctggaagcagaaa

SEQ ID NO: 2219869 - DNA, 15 bp, Homo sapiens
tggggtacccactgc

SEQ ID NO: 2219870 - DNA, 17 bp, Homo sapiens
tggggtacccactgctc

SEQ ID NO: 2219871 - DNA, 21 bp, Homo sapiens
ttctaaaggctacctttgtat

SEQ ID NO: 2219872 - DNA, 19 bp, Homo sapiens
ttctaaatctccaaaataa

SEQ ID NO: 2219873 - DNA, 20 bp, Homo sapiens
ttctacccagcgagccctgg

SEQ ID NO: 2219874 - DNA, 13 bp, Homo sapiens
ttctacgccaggg

SEQ ID NO: 2219875 - DNA, 17 bp, Homo sapiens
ttctatgacacatgcaa

SEQ ID NO: 2219876 - DNA, 21 bp, Homo sapiens
ttctccacctcccacaaagga

SEQ ID NO: 2219877 - DNA, 16 bp, Homo sapiens
ttctccacctgccagg

SEQ ID NO: 2219878 - DNA, 18 bp, Homo sapiens
ttctccacctgccaggga

SEQ ID NO: 2219879 - DNA, 15 bp, Homo sapiens
ttctctagtttgatt

SEQ ID NO: 2219880 - DNA, 19 bp, Homo sapiens
ttctgaacttggcgctgcc

SEQ ID NO: 2219881 - DNA, 18 bp, Homo sapiens
ttctgacccatgctgccc

SEQ ID NO: 2219882 - DNA, 23 bp, Homo sapiens
ttctgacccatgctgccctgtga

SEQ ID NO: 2219883 - DNA, 18 bp, Homo sapiens
ttctgaccctgcttcaaa

SEQ ID NO: 2219884 - DNA, 15 bp, Homo sapiens
ttctgcctgcccagg

SEQ ID NO: 2219885 - DNA, 19 bp, Homo sapiens
ttctgctcacatatctgtc

SEQ ID NO: 2219886 - DNA, 16 bp, Homo sapiens
ttctggctatgcattt

SEQ ID NO: 2219887 - DNA, 20 bp, Homo sapiens
ttctggctatgcatttgaaa

SEQ ID NO: 2219888 - DNA, 22 bp, Homo sapiens
ttctgggacacagttcaattct

SEQ ID NO: 2219889 - DNA, 17 bp, Homo sapiens
ttctgtcctactctgtg

SEQ ID NO: 2219890 - DNA, 23 bp, Homo sapiens
ttctgtgggtttctaaagctgcc

SEQ ID NO: 2219891 - DNA, 11 bp, Homo sapiens
ttctgttcttt

SEQ ID NO: 2219892 - DNA, 18 bp, Homo sapiens
ttctgttctttctggcta

SEQ ID NO: 2219893 - DNA, 17 bp, Homo sapiens
ttcttagggaaggatac

SEQ ID NO: 2219894 - DNA, 21 bp, Homo sapiens
ttcttatacatttgataaagt

SEQ ID NO: 2219895 - DNA, 13 bp, Homo sapiens
ttcttcagagact

SEQ ID NO: 2219896 - DNA, 23 bp, Homo sapiens
ttcttggtttgtaaattaacttt

SEQ ID NO: 2219897 - DNA, 18 bp, Homo sapiens
ttctttataattctactt

SEQ ID NO: 2219898 - DNA, 21 bp, Homo sapiens
ttcttttttcggctaaaaaga

SEQ ID NO: 2219899 - DNA, 16 bp, Homo sapiens
ttgaaaaaaaaaaaca

SEQ ID NO: 2219900 - DNA, 21 bp, Homo sapiens
ttgaaaaaaaaaaacacaaaa

SEQ ID NO: 2219901 - DNA, 22 bp, Homo sapiens
ttgaaaacactgttctctgccc

SEQ ID NO: 2219902 - DNA, 23 bp, Homo sapiens
ttgaaaacactgttctctgccct

SEQ ID NO: 2219903 - DNA, 15 bp, Homo sapiens
tttgattcagacagc

SEQ ID NO: 2219904 - DNA, 22 bp, Homo sapiens
tttgattcagacagctgcctgg

SEQ ID NO: 2219905 - DNA, 14 bp, Homo sapiens
tttgcagacaggca

SEQ ID NO: 2219906 - DNA, 18 bp, Homo sapiens
tttgccatgttggccagg

SEQ ID NO: 2219907 - DNA, 15 bp, Homo sapiens
tttgccgttattaaa

SEQ ID NO: 2219908 - DNA, 13 bp, Homo sapiens
tttggaccctgag

SEQ ID NO: 2219909 - DNA, 14 bp, Homo sapiens
tttggggatatttt

SEQ ID NO: 2219910 - DNA, 22 bp, Homo sapiens
tttgggggaaaatttagaaata

SEQ ID NO: 2219911 - DNA, 17 bp, Homo sapiens
tttggtctacactgtgc

SEQ ID NO: 2219912 - DNA, 17 bp, Homo sapiens
tttgtaaattaactttt

SEQ ID NO: 2219913 - DNA, 16 bp, Homo sapiens
tttgtaatttttttat

SEQ ID NO: 2219914 - DNA, 21 bp, Homo sapiens
tttgtccccaccgcagacagg

SEQ ID NO: 2219915 - DNA, 23 bp, Homo sapiens
tttgtcttaaaaagtggaaaaat

SEQ ID NO: 2219916 - DNA, 19 bp, Homo sapiens
tttgtgcattatctagata

SEQ ID NO: 2219917 - DNA, 22 bp, Homo sapiens
tttgttagtatgaggcatttgt

SEQ ID NO: 2219918 - DNA, 14 bp, Homo sapiens
tttgtttgaactga

SEQ ID NO: 2219919 - DNA, 12 bp, Homo sapiens
ttttaaatgcac

SEQ ID NO: 2219920 - DNA, 21 bp, Homo sapiens
ttttaaatgcacctggaatat

SEQ ID NO: 2219921 - DNA, 21 bp, Homo sapiens
ttttagaccctattgctgctt

SEQ ID NO: 2219922 - DNA, 23 bp, Homo sapiens
ttttagagttgatactacagttt

SEQ ID NO: 2219923 - DNA, 12 bp, Homo sapiens
ttttataaactt

SEQ ID NO: 2219924 - DNA, 14 bp, Homo sapiens
ttttataaacttta

SEQ ID NO: 2219925 - DNA, 13 bp, Homo sapiens
ttttatacataaa

SEQ ID NO: 2219926 - DNA, 14 bp, Homo sapiens
ttttcagtgtacat

SEQ ID NO: 2219927 - DNA, 19 bp, Homo sapiens
ttttccaggtttaagctgt

SEQ ID NO: 2219928 - DNA, 18 bp, Homo sapiens
ttttccctattagagaag

SEQ ID NO: 2219929 - DNA, 22 bp, Homo sapiens
ttttccctattagagaagagat

SEQ ID NO: 2219930 - DNA, 16 bp, Homo sapiens
ttttcggctaaaaaga

SEQ ID NO: 2219931 - DNA, 13 bp, Homo sapiens
ttttctactcgag

SEQ ID NO: 2219932 - DNA, 23 bp, Homo sapiens
ttttgccatgttggccaggctgg

SEQ ID NO: 2219933 - DNA, 15 bp, Homo sapiens
ttttgttccacaagt

SEQ ID NO: 2219934 - DNA, 12 bp, Homo sapiens
tttttaagaaaa

SEQ ID NO: 2219935 - DNA, 17 bp, Homo sapiens
tttttaagtgctgcatt

SEQ ID NO: 2219936 - DNA, 11 bp, Homo sapiens
tttttactaat

SEQ ID NO: 2219937 - DNA, 20 bp, Homo sapiens
tttttactggggattcttga

SEQ ID NO: 2219938 - DNA, 22 bp, Homo sapiens
tttttagacagagtctcactgt

SEQ ID NO: 2219939 - DNA, 20 bp, Homo sapiens
tttttatggcttttgtgcat

SEQ ID NO: 2219940 - DNA, 21 bp, Homo sapiens
tttttatggcttttgtgcatt

SEQ ID NO: 2219941 - DNA, 19 bp, Homo sapiens
tttttccttcagtgcctta

SEQ ID NO: 2219942 - DNA, 20 bp, Homo sapiens
tttttgtagagccagggtct

SEQ ID NO: 2219943 - DNA, 22 bp, Homo sapiens
tttttgttccacaagttaaata

SEQ ID NO: 2219944 - DNA, 13 bp, Homo sapiens
ttttttttgacaa

SEQ ID NO: 2219945 - DNA, 11 bp, Homo sapiens
tgttgaaagat

SEQ ID NO: 2219946 - DNA, 13 bp, Homo sapiens
tgttgcccaggca

SEQ ID NO: 2219947 - DNA, 17 bp, Homo sapiens
tgttgcccaggcaggtc

SEQ ID NO: 2219948 - DNA, 19 bp, Homo sapiens
tgttgcccaggcaggtctt

SEQ ID NO: 2219949 - DNA, 15 bp, Homo sapiens
tgttgcccaggctgg

SEQ ID NO: 2219950 - DNA, 15 bp, Homo sapiens
tgttggccaaagcca

SEQ ID NO: 2219951 - DNA, 11 bp, Homo sapiens
tgttggccagg

SEQ ID NO: 2219952 - DNA, 15 bp, Homo sapiens
tgttggccaggctgg

SEQ ID NO: 2219953 - DNA, 16 bp, Homo sapiens
tgttggccaggctggt

SEQ ID NO: 2219954 - DNA, 14 bp, Homo sapiens
tgtttattgtcaaa

SEQ ID NO: 2219955 - DNA, 17 bp, Homo sapiens
tgtttattgtcaaagtg

SEQ ID NO: 2219956 - DNA, 20 bp, Homo sapiens
tgtttcctggcactgcttcc

SEQ ID NO: 2219957 - DNA, 23 bp, Homo sapiens
tgtttcctggcactgcttccagt

SEQ ID NO: 2219958 - DNA, 17 bp, Homo sapiens
tgtttgattcagacagc

SEQ ID NO: 2219959 - DNA, 22 bp, Homo sapiens
tgtttgattcagacagctgcct

SEQ ID NO: 2219960 - DNA, 16 bp, Homo sapiens
tgtttgttgtcagctg

SEQ ID NO: 2219961 - DNA, 16 bp, Homo sapiens
tgttttaagaggcagg

SEQ ID NO: 2219962 - DNA, 23 bp, Homo sapiens
tgttttaaggatgcttgtacata

SEQ ID NO: 2219963 - DNA, 21 bp, Homo sapiens
tgttttattttaattcagttg

SEQ ID NO: 2219964 - DNA, 17 bp, Homo sapiens
tgttttcagtgtacatg

SEQ ID NO: 2219965 - DNA, 18 bp, Homo sapiens
ttaaaaagtggaaaaata

SEQ ID NO: 2219966 - DNA, 17 bp, Homo sapiens
ttaaaaatctcaaattt

SEQ ID NO: 2219967 - DNA, 20 bp, Homo sapiens
ttaaaaatctcaaatttcta

SEQ ID NO: 2219968 - DNA, 17 bp, Homo sapiens
ttaaaacaacactcaca

SEQ ID NO: 2219969 - DNA, 21 bp, Homo sapiens
ttaaaataccagccagtaaat

SEQ ID NO: 2219970 - DNA, 16 bp, Homo sapiens
ttaaacttaatctaaa

SEQ ID NO: 2219971 - DNA, 20 bp, Homo sapiens
ttaaacttaatctaaatgga

SEQ ID NO: 2219972 - DNA, 21 bp, Homo sapiens
ttaaataatgtgaaactggat

SEQ ID NO: 2219973 - DNA, 13 bp, Homo sapiens
ttaaatgcccagc

SEQ ID NO: 2219974 - DNA, 18 bp, Homo sapiens
ttaaatgcccagcccctt

SEQ ID NO: 2219975 - DNA, 20 bp, Homo sapiens
ttaaattcttgcaaagtatc

SEQ ID NO: 2219976 - DNA, 12 bp, Homo sapiens
ttaacagaaatg

SEQ ID NO: 2219977 - DNA, 16 bp, Homo sapiens
ttaacagaaatgtaca

SEQ ID NO: 2219978 - DNA, 12 bp, Homo sapiens
ttaacttttata

SEQ ID NO: 2219979 - DNA, 15 bp, Homo sapiens
ttaagaggcagggtc

SEQ ID NO: 2219980 - DNA, 21 bp, Homo sapiens
ttaaggaagacaatgtgaaaa

SEQ ID NO: 2219981 - DNA, 18 bp, Homo sapiens
ttaaggatgcttgtacat

SEQ ID NO: 2219982 - DNA, 20 bp, Homo sapiens
ttaaggatgcttgtacataa

SEQ ID NO: 2219983 - DNA, 16 bp, Homo sapiens
ttaagtgctgcattta

SEQ ID NO: 2219984 - DNA, 18 bp, Homo sapiens
ttaatattgatatgctta

SEQ ID NO: 2219985 - DNA, 22 bp, Homo sapiens
ttaatctggtttatttttgttc

SEQ ID NO: 2219986 - DNA, 18 bp, Homo sapiens
ttaatgaaagactgtaca

SEQ ID NO: 2219987 - DNA, 14 bp, Homo sapiens
tgctgagtctgaag

SEQ ID NO: 2219988 - DNA, 17 bp, Homo sapiens
tgctgagtctgaaggct

SEQ ID NO: 2219989 - DNA, 18 bp, Homo sapiens
tgctgatggtgcaatgac

SEQ ID NO: 2219990 - DNA, 15 bp, Homo sapiens
tgctgcagttgccag

SEQ ID NO: 2219991 - DNA, 16 bp, Homo sapiens
tgctgcagttgccagt

SEQ ID NO: 2219992 - DNA, 18 bp, Homo sapiens
tgctgcagttgccagtca

SEQ ID NO: 2219993 - DNA, 23 bp, Homo sapiens
tgctgcagttgccagtcaccccg

SEQ ID NO: 2219994 - DNA, 14 bp, Homo sapiens
tgctgcatttaaaa

SEQ ID NO: 2219995 - DNA, 19 bp, Homo sapiens
tgctgcatttaaaagatac

SEQ ID NO: 2219996 - DNA, 13 bp, Homo sapiens
tgctgccatccag

SEQ ID NO: 2219997 - DNA, 22 bp, Homo sapiens
tgctgccatccaggttcagctt

SEQ ID NO: 2219998 - DNA, 12 bp, Homo sapiens
tgctgccctgcc

SEQ ID NO: 2219999 - DNA, 16 bp, Homo sapiens
tgctgccctgcccacc

SEQ ID NO: 2220000 - DNA, 11 bp, Homo sapiens
tgctgccctgt

SEQ ID NO: 2220001 - DNA, 18 bp, Homo sapiens
tgctggctgttggctggg

SEQ ID NO: 2220002 - DNA, 21 bp, Homo sapiens
tgctggctgttggctgggggc

SEQ ID NO: 2220003 - DNA, 13 bp, Homo sapiens
tgctgggtgtggc

SEQ ID NO: 2220004 - DNA, 18 bp, Homo sapiens
tgcttaacttcacatatt

SEQ ID NO: 2220005 - DNA, 19 bp, Homo sapiens
tgcttaacttcacatattg

SEQ ID NO: 2220006 - DNA, 16 bp, Homo sapiens
tgcttcaaggatcctg

SEQ ID NO: 2220007 - DNA, 18 bp, Homo sapiens
tgcttcaaggatcctgag

SEQ ID NO: 2220008 - DNA, 19 bp, Homo sapiens
tgcttcaaggatcctgagc

SEQ ID NO: 2220009 - DNA, 14 bp, Homo sapiens
tgcttcagcctccc

SEQ ID NO: 2220010 - DNA, 19 bp, Homo sapiens
tgcttccagtgaggctctg

SEQ ID NO: 2220011 - DNA, 22 bp, Homo sapiens
tgcttccagtgaggctctgccc

SEQ ID NO: 2220012 - DNA, 16 bp, Homo sapiens
tgcttcttcagagact

SEQ ID NO: 2220013 - DNA, 18 bp, Homo sapiens
tcatataagattcatatt

SEQ ID NO: 2220014 - DNA, 23 bp, Homo sapiens
tcatatttacttcttatacattt

SEQ ID NO: 2220015 - DNA, 14 bp, Homo sapiens
tcatccactgtgcc

SEQ ID NO: 2220016 - DNA, 23 bp, Homo sapiens
tcatccactgtgccatgtgccag

SEQ ID NO: 2220017 - DNA, 15 bp, Homo sapiens
tcatcctaagctatt

SEQ ID NO: 2220018 - DNA, 18 bp, Homo sapiens
tcatcctcatacccaccc

SEQ ID NO: 2220019 - DNA, 22 bp, Homo sapiens
tcatccttctggaataaggaga

SEQ ID NO: 2220020 - DNA, 23 bp, Homo sapiens
tcatcttaggttggcaaaaaggc

SEQ ID NO: 2220021 - DNA, 19 bp, Homo sapiens
tcatcttgaattgtaagga

SEQ ID NO: 2220022 - DNA, 17 bp, Homo sapiens
tcatgttcttaattctt

SEQ ID NO: 2220023 - DNA, 21 bp, Homo sapiens
tcattcaacccacctgcgtct

SEQ ID NO: 2220024 - DNA, 21 bp, Homo sapiens
tcattctccttgtgttactaa

SEQ ID NO: 2220025 - DNA, 12 bp, Homo sapiens
tcattcttctgt

SEQ ID NO: 2220026 - DNA, 12 bp, Homo sapiens
tcattgaaatct

SEQ ID NO: 2220027 - DNA, 16 bp, Homo sapiens
tccaaagtacactgtt

SEQ ID NO: 2220028 - DNA, 17 bp, Homo sapiens
tccaaccctcatcacca

SEQ ID NO: 2220029 - DNA, 16 bp, Homo sapiens
tccaagaagcccagga

SEQ ID NO: 2220030 - DNA, 12 bp, Homo sapiens
tgacctctgcct

SEQ ID NO: 2220031 - DNA, 13 bp, Homo sapiens
tgacctctgcctg

SEQ ID NO: 2220032 - DNA, 14 bp, Homo sapiens
tgacctctgcctga

SEQ ID NO: 2220033 - DNA, 12 bp, Homo sapiens
tgacctgaggcc

SEQ ID NO: 2220034 - DNA, 15 bp, Homo sapiens
tgacctgaggccctt

SEQ ID NO: 2220035 - DNA, 15 bp, Homo sapiens
tgacctttaagagaa

SEQ ID NO: 2220036 - DNA, 13 bp, Homo sapiens
tgacctttcaata

SEQ ID NO: 2220037 - DNA, 14 bp, Homo sapiens
tgacctttcaatag

SEQ ID NO: 2220038 - DNA, 22 bp, Homo sapiens
tgacctttcaataggaaaaact

SEQ ID NO: 2220039 - DNA, 14 bp, Homo sapiens
tgacgccatcccag

SEQ ID NO: 2220040 - DNA, 16 bp, Homo sapiens
tgacgccatcccagcc

SEQ ID NO: 2220041 - DNA, 20 bp, Homo sapiens
tgacgccatcccagccccaa

SEQ ID NO: 2220042 - DNA, 20 bp, Homo sapiens
tgactccagaatttcccaaa

SEQ ID NO: 2220043 - DNA, 21 bp, Homo sapiens
tgactctttctattgtttctt

SEQ ID NO: 2220044 - DNA, 13 bp, Homo sapiens
tgacttactgtac

SEQ ID NO: 2220045 - DNA, 15 bp, Homo sapiens
tgacttactgtacat

SEQ ID NO: 2220046 - DNA, 16 bp, Homo sapiens
tgacttactgtacatg

SEQ ID NO: 2220047 - DNA, 20 bp, Homo sapiens
tgacttactgtacatgaaaa

SEQ ID NO: 2220048 - DNA, 16 bp, Homo sapiens
tgactttcctctttgg

SEQ ID NO: 2220049 - DNA, 21 bp, Homo sapiens
tgagacagagttttcactctt

SEQ ID NO: 2220050 - DNA, 19 bp, Homo sapiens
tgagacagcccgggctctg

SEQ ID NO: 2220051 - DNA, 22 bp, Homo sapiens
tgagacagcccgggctctgcct

SEQ ID NO: 2220052 - DNA, 19 bp, Homo sapiens
tgagactcgcgacaatgca

SEQ ID NO: 2220053 - DNA, 21 bp, Homo sapiens
tgagactcgcgacaatgcaaa

SEQ ID NO: 2220054 - DNA, 20 bp, Homo sapiens
tgagactctgtctcaaaaaa

SEQ ID NO: 2220055 - DNA, 14 bp, Homo sapiens
tgagagctgggtgt

SEQ ID NO: 2220056 - DNA, 17 bp, Homo sapiens
tgagaggaaatcaccga

SEQ ID NO: 2220057 - DNA, 17 bp, Homo sapiens
tgagagtagagtcactg

SEQ ID NO: 2220058 - DNA, 14 bp, Homo sapiens
tgagatcagcctgg

SEQ ID NO: 2220059 - DNA, 22 bp, Homo sapiens
tgagcactaaggtgtgctctga

SEQ ID NO: 2220060 - DNA, 22 bp, Homo sapiens
tgagcagggctcagcggggaca

SEQ ID NO: 2220061 - DNA, 14 bp, Homo sapiens
tgagcatcaggcca

SEQ ID NO: 2220062 - DNA, 21 bp, Homo sapiens
tgagcatcaggccaggccctc

SEQ ID NO: 2220063 - DNA, 24 bp, Homo sapiens
tgagcatcaggccaggccctctgc

SEQ ID NO: 2220064 - DNA, 16 bp, Homo sapiens
tgagccagatttcact

SEQ ID NO: 2220065 - DNA, 18 bp, Homo sapiens
tgagccagatttcactct

SEQ ID NO: 2220066 - DNA, 19 bp, Homo sapiens
tgagccagatttcactctc

SEQ ID NO: 2220067 - DNA, 20 bp, Homo sapiens
tgagccagatttcactctcc

SEQ ID NO: 2220068 - DNA, 21 bp, Homo sapiens
tgagccagatttcactctcct

SEQ ID NO: 2220069 - DNA, 14 bp, Homo sapiens
tgagcctgggaggt

SEQ ID NO: 2220070 - DNA, 19 bp, Homo sapiens
tgagccttgaactttgacc

SEQ ID NO: 2220071 - DNA, 14 bp, Homo sapiens
tgaggaagccgctg

SEQ ID NO: 2220072 - DNA, 17 bp, Homo sapiens
tgaggaagccgctgggg

SEQ ID NO: 2220073 - DNA, 19 bp, Homo sapiens
tgaggaagccgctggggcc

SEQ ID NO: 2220074 - DNA, 17 bp, Homo sapiens
tgaggcccagagggcct

SEQ ID NO: 2220075 - DNA, 24 bp, Homo sapiens
tgaggcccttctctccagcccctg

SEQ ID NO: 2220076 - DNA, 17 bp, Homo sapiens
tgaggctagtgtggtgt

SEQ ID NO: 2220077 - DNA, 23 bp, Homo sapiens
tgaggctagtgtggtgtttcctg

SEQ ID NO: 2220078 - DNA, 13 bp, Homo sapiens
tgaggctctgccc

SEQ ID NO: 2220079 - DNA, 15 bp, Homo sapiens
tgaggctgggctccc

SEQ ID NO: 2220080 - DNA, 21 bp, Homo sapiens
tgaggctgggctcccttccca

SEQ ID NO: 2220081 - DNA, 13 bp, Homo sapiens
tgaggggcctctt

SEQ ID NO: 2220082 - DNA, 20 bp, Homo sapiens
tgagggttgggctggtgtca

SEQ ID NO: 2220083 - DNA, 14 bp, Homo sapiens
tgaggtctgttctt

SEQ ID NO: 2220084 - DNA, 21 bp, Homo sapiens
tgaggtgggaggatctcttga

SEQ ID NO: 2220085 - DNA, 18 bp, Homo sapiens
tgagtacgttgtgcattt

SEQ ID NO: 2220086 - DNA, 16 bp, Homo sapiens
tgagtcaccaagccca

SEQ ID NO: 2220087 - DNA, 17 bp, Homo sapiens
tgagtcaccaagcccag

SEQ ID NO: 2220088 - DNA, 19 bp, Homo sapiens
tgagtcccctgtttgtttc

SEQ ID NO: 2220089 - DNA, 18 bp, Homo sapiens
tgagtcctggcatgggaa

SEQ ID NO: 2220090 - DNA, 17 bp, Homo sapiens
tgagtctgaaggctggg

SEQ ID NO: 2220091 - DNA, 18 bp, Homo sapiens
tgagtctgaaggctgggt

SEQ ID NO: 2220092 - DNA, 14 bp, Homo sapiens
tgagtgagcatgcc

SEQ ID NO: 2220093 - DNA, 17 bp, Homo sapiens
tgagtgcagctctggag

SEQ ID NO: 2220094 - DNA, 20 bp, Homo sapiens
tgagtgccttacacaatggt

SEQ ID NO: 2220095 - DNA, 21 bp, Homo sapiens
tgagtgggtgaataatacagt

SEQ ID NO: 2220096 - DNA, 20 bp, Homo sapiens
tgataagaaccttttgagtg

SEQ ID NO: 2220097 - DNA, 20 bp, Homo sapiens
tgatacaatgctgtgcccta

SEQ ID NO: 2220098 - DNA, 20 bp, Homo sapiens
tgatagcacagaccctgccc

SEQ ID NO: 2220099 - DNA, 19 bp, Homo sapiens
tgatcacggctcactgcag

SEQ ID NO: 2220100 - DNA, 20 bp, Homo sapiens
tgatcacggctcactgcagc

SEQ ID NO: 2220101 - DNA, 16 bp, Homo sapiens
tgatcctagttccacc

SEQ ID NO: 2220102 - DNA, 15 bp, Homo sapiens
tgatcctcccacctc

SEQ ID NO: 2220103 - DNA, 18 bp, Homo sapiens
tgatcctcccacctcagc

SEQ ID NO: 2220104 - DNA, 21 bp, Homo sapiens
tgatctaggaagactttggaa

SEQ ID NO: 2220105 - DNA, 20 bp, Homo sapiens
tgatcttctttataattcta

SEQ ID NO: 2220106 - DNA, 20 bp, Homo sapiens
tgatctttgcagacaggcaa

SEQ ID NO: 2220107 - DNA, 20 bp, Homo sapiens
tgatgatcctaggcatttgc

SEQ ID NO: 2220108 - DNA, 23 bp, Homo sapiens
tgatgatctttgcagacaggcaa

SEQ ID NO: 2220109 - DNA, 21 bp, Homo sapiens
tgatgcttcttcagagactcc

SEQ ID NO: 2220110 - DNA, 15 bp, Homo sapiens
tgatggggccctgcc

SEQ ID NO: 2220111 - DNA, 19 bp, Homo sapiens
tgatggggccctgcctcct

SEQ ID NO: 2220112 - DNA, 13 bp, Homo sapiens
tgatggtgcaatg

SEQ ID NO: 2220113 - DNA, 17 bp, Homo sapiens
tgatggtgcaatgacct

SEQ ID NO: 2220114 - DNA, 16 bp, Homo sapiens
tgatgtgttatctctt

SEQ ID NO: 2220115 - DNA, 21 bp, Homo sapiens
tgatgttttaaggatgcttgt

SEQ ID NO: 2220116 - DNA, 13 bp, Homo sapiens
tgattaaattctt

SEQ ID NO: 2220117 - DNA, 17 bp, Homo sapiens
tgattaaattcttgcaa

SEQ ID NO: 2220118 - DNA, 20 bp, Homo sapiens
tgattaaccacttcagctga

SEQ ID NO: 2220119 - DNA, 16 bp, Homo sapiens
tgattcagacagctgc

SEQ ID NO: 2220120 - DNA, 19 bp, Homo sapiens
tgattcagacagctgcctg

SEQ ID NO: 2220121 - DNA, 13 bp, Homo sapiens
tgattctcctgcc

SEQ ID NO: 2220122 - DNA, 19 bp, Homo sapiens
tgattctcctgcctcagcc

SEQ ID NO: 2220123 - DNA, 21 bp, Homo sapiens
tgattggaggggggaggtggg

SEQ ID NO: 2220124 - DNA, 15 bp, Homo sapiens
tgattttcattgctg

SEQ ID NO: 2220125 - DNA, 12 bp, Homo sapiens
tgcaaaccatca

SEQ ID NO: 2220126 - DNA, 13 bp, Homo sapiens
tgcaaaccatcat

SEQ ID NO: 2220127 - DNA, 20 bp, Homo sapiens
tgcaaaccatcattgaaatc

SEQ ID NO: 2220128 - DNA, 21 bp, Homo sapiens
tgcaaagggtatcaggtgctg

SEQ ID NO: 2220129 - DNA, 13 bp, Homo sapiens
tgcaacaggctgg

SEQ ID NO: 2220130 - DNA, 15 bp, Homo sapiens
tgcaacaggctgggc

SEQ ID NO: 2220131 - DNA, 18 bp, Homo sapiens
tgcaacctccgcctcttg

SEQ ID NO: 2220132 - DNA, 22 bp, Homo sapiens
tgcaacctgattgtgtctcttg

SEQ ID NO: 2220133 - DNA, 16 bp, Homo sapiens
tgcaatgacctttcaa

SEQ ID NO: 2220134 - DNA, 17 bp, Homo sapiens
tgcaatgacctttcaat

SEQ ID NO: 2220135 - DNA, 19 bp, Homo sapiens
tgcacaaacagaggccgcc

SEQ ID NO: 2220136 - DNA, 18 bp, Homo sapiens
tgcacaagctgcaccctc

SEQ ID NO: 2220137 - DNA, 15 bp, Homo sapiens
tgcacacaccagagc

SEQ ID NO: 2220138 - DNA, 21 bp, Homo sapiens
tgcacacaccagagcccacct

SEQ ID NO: 2220139 - DNA, 17 bp, Homo sapiens
tgcacagagttgttaca

SEQ ID NO: 2220140 - DNA, 21 bp, Homo sapiens
tgcacagagttgttacatttt

SEQ ID NO: 2220141 - DNA, 23 bp, Homo sapiens
tgcacagctaacatggaagtact

SEQ ID NO: 2220142 - DNA, 22 bp, Homo sapiens
tgcaccgggccacagagaaagt

SEQ ID NO: 2220143 - DNA, 15 bp, Homo sapiens
tgcactccagcctgg

SEQ ID NO: 2220144 - DNA, 15 bp, Homo sapiens
tgcactcccctgctg

SEQ ID NO: 2220145 - DNA, 17 bp, Homo sapiens
tgcactcccctgctggg

SEQ ID NO: 2220146 - DNA, 14 bp, Homo sapiens
tgcactttgttctg

SEQ ID NO: 2220147 - DNA, 21 bp, Homo sapiens
ctgctgacagacacaggcccg

SEQ ID NO: 2220148 - DNA, 11 bp, Homo sapiens
ctgctgacagt

SEQ ID NO: 2220149 - DNA, 18 bp, Homo sapiens
ctgctgactgttttctct

SEQ ID NO: 2220150 - DNA, 14 bp, Homo sapiens
ctgctgcagttgcc

SEQ ID NO: 2220151 - DNA, 12 bp, Homo sapiens
ctgctgctggct

SEQ ID NO: 2220152 - DNA, 14 bp, Homo sapiens
ctgctgctggctgg

SEQ ID NO: 2220153 - DNA, 15 bp, Homo sapiens
ctgctggttcagggt

SEQ ID NO: 2220154 - DNA, 13 bp, Homo sapiens
ctgcttaacttca

SEQ ID NO: 2220155 - DNA, 14 bp, Homo sapiens
ctgcttcaaatatt

SEQ ID NO: 2220156 - DNA, 23 bp, Homo sapiens
ctgcttcaaggatcctgagccag

SEQ ID NO: 2220157 - DNA, 13 bp, Homo sapiens
ctgcttcagcctc

SEQ ID NO: 2220158 - DNA, 15 bp, Homo sapiens
ctgcttccagtgagg

SEQ ID NO: 2220159 - DNA, 18 bp, Homo sapiens
ctgcttccagtgaggctc

SEQ ID NO: 2220160 - DNA, 21 bp, Homo sapiens
ctgcttgaggcaactcatctt

SEQ ID NO: 2220161 - DNA, 22 bp, Homo sapiens
ctgcttgaggcaactcatctta

SEQ ID NO: 2220162 - DNA, 18 bp, Homo sapiens
ctgcttgggcttcatcct

SEQ ID NO: 2220163 - DNA, 20 bp, Homo sapiens
ctgcttttgtctatgggact

SEQ ID NO: 2220164 - DNA, 22 bp, Homo sapiens
ctgctttttaaagaatgctctt

SEQ ID NO: 2220165 - DNA, 14 bp, Homo sapiens
ctggaagcacagct

SEQ ID NO: 2220166 - DNA, 15 bp, Homo sapiens
ctggaagcacagctt

SEQ ID NO: 2220167 - DNA, 18 bp, Homo sapiens
ctggaatatataaccagt

SEQ ID NO: 2220168 - DNA, 15 bp, Homo sapiens
ctggaccctgtggat

SEQ ID NO: 2220169 - DNA, 22 bp, Homo sapiens
ctggaggtacgaaaagagggga

SEQ ID NO: 2220170 - DNA, 17 bp, Homo sapiens
ctggatgcagcctcaca

SEQ ID NO: 2220171 - DNA, 22 bp, Homo sapiens
ctggatgcagcctcacagtcct

SEQ ID NO: 2220172 - DNA, 15 bp, Homo sapiens
ctggatggggctgca

SEQ ID NO: 2220173 - DNA, 14 bp, Homo sapiens
ctggcaagaatgtg

SEQ ID NO: 2220174 - DNA, 16 bp, Homo sapiens
ctggcacccggcccct

SEQ ID NO: 2220175 - DNA, 17 bp, Homo sapiens
ctggcacccggcccctg

SEQ ID NO: 2220176 - DNA, 23 bp, Homo sapiens
ctggcactataatgtaagctcta

SEQ ID NO: 2220177 - DNA, 15 bp, Homo sapiens
ctggcactgcttcca

SEQ ID NO: 2220178 - DNA, 16 bp, Homo sapiens
ctggcactgcttccag

SEQ ID NO: 2220179 - DNA, 14 bp, Homo sapiens
gaagcggctggcag

SEQ ID NO: 2220180 - DNA, 19 bp, Homo sapiens
gaaggaaacccagctctgg

SEQ ID NO: 2220181 - DNA, 19 bp, Homo sapiens
gaaggaagacttcatccct

SEQ ID NO: 2220182 - DNA, 20 bp, Homo sapiens
gaaggacattgcggacagcc

SEQ ID NO: 2220183 - DNA, 21 bp, Homo sapiens
gaaggatacaaaagcatgtga

SEQ ID NO: 2220184 - DNA, 19 bp, Homo sapiens
gaaggccccgcccaggctt

SEQ ID NO: 2220185 - DNA, 16 bp, Homo sapiens
gaaggctcgagcatgc

SEQ ID NO: 2220186 - DNA, 19 bp, Homo sapiens
tacagacaaagcgtggtgg

SEQ ID NO: 2220187 - DNA, 18 bp, Homo sapiens
tacagaggccatgggcct

SEQ ID NO: 2220188 - DNA, 22 bp, Homo sapiens
tacagcaaggagatttacaact

SEQ ID NO: 2220189 - DNA, 21 bp, Homo sapiens
tacagcttgaccgtgaggcca

SEQ ID NO: 2220190 - DNA, 17 bp, Homo sapiens
tacaggaaaagctgctg

SEQ ID NO: 2220191 - DNA, 18 bp, Homo sapiens
tacaggaaaagctgctga

SEQ ID NO: 2220192 - DNA, 19 bp, Homo sapiens
tacaggaaaagctgctgac

SEQ ID NO: 2220193 - DNA, 16 bp, Homo sapiens
tacaggcacccaccat

SEQ ID NO: 2220194 - DNA, 15 bp, Homo sapiens
tacagtatctcaggg

SEQ ID NO: 2220195 - DNA, 18 bp, Homo sapiens
tacagtttgttagtatga

SEQ ID NO: 2220196 - DNA, 19 bp, Homo sapiens
tacataagataaatgtgct

SEQ ID NO: 2220197 - DNA, 22 bp, Homo sapiens
tacataagataaatgtgctgaa

SEQ ID NO: 2220198 - DNA, 15 bp, Homo sapiens
tacataatgcgtgca

SEQ ID NO: 2220199 - DNA, 24 bp, Homo sapiens
tacataatgcgtgcataccacttt

SEQ ID NO: 2220200 - DNA, 23 bp, Homo sapiens
tacatgaaaacacatttttctta

SEQ ID NO: 2220201 - DNA, 18 bp, Homo sapiens
tacatggaataacatgta

SEQ ID NO: 2220202 - DNA, 19 bp, Homo sapiens
tacatttttaagtgctgca

SEQ ID NO: 2220203 - DNA, 23 bp, Homo sapiens
tacatttttaagtgctgcattta

SEQ ID NO: 2220204 - DNA, 17 bp, Homo sapiens
taccacttttgttcttg

SEQ ID NO: 2220205 - DNA, 12 bp, Homo sapiens
taccagcagagc

SEQ ID NO: 2220206 - DNA, 18 bp, Homo sapiens
taccagccagtaaatggg

SEQ ID NO: 2220207 - DNA, 17 bp, Homo sapiens
tacccacccccacccaa

SEQ ID NO: 2220208 - DNA, 11 bp, Homo sapiens
tacccactgct

SEQ ID NO: 2220209 - DNA, 12 bp, Homo sapiens
tacccactgctc

SEQ ID NO: 2220210 - DNA, 16 bp, Homo sapiens
tacccagcgagccctg

SEQ ID NO: 2220211 - DNA, 23 bp, Homo sapiens
tacccgggaagggggctgggaca

SEQ ID NO: 2220212 - DNA, 22 bp, Homo sapiens
taccctggcactataatgtaag

SEQ ID NO: 2220213 - DNA, 16 bp, Homo sapiens
tacctgaggggcctct

SEQ ID NO: 2220214 - DNA, 18 bp, Homo sapiens
taccttttttatacataa

SEQ ID NO: 2220215 - DNA, 22 bp, Homo sapiens
taccttttttatacataaacaa

SEQ ID NO: 2220216 - DNA, 15 bp, Homo sapiens
tacgtacacatttta

SEQ ID NO: 2220217 - DNA, 19 bp, Homo sapiens
tactaaccagcagaaatgc

SEQ ID NO: 2220218 - DNA, 22 bp, Homo sapiens
tactaataaaatttaaaagtct

SEQ ID NO: 2220219 - DNA, 21 bp, Homo sapiens
tactaatagacaatttattat

SEQ ID NO: 2220220 - DNA, 12 bp, Homo sapiens
tactacagtcct

SEQ ID NO: 2220221 - DNA, 22 bp, Homo sapiens
tactacagtcctcccatctcac

SEQ ID NO: 2220222 - DNA, 14 bp, Homo sapiens
tactacagtttgtt

SEQ ID NO: 2220223 - DNA, 13 bp, Homo sapiens
tactactcctgta

SEQ ID NO: 2220224 - DNA, 16 bp, Homo sapiens
tactataatttacctg

SEQ ID NO: 2220225 - DNA, 17 bp, Homo sapiens
tactcccatctgtgaaa

SEQ ID NO: 2220226 - DNA, 21 bp, Homo sapiens
tactctgtgtcaggtggggca

SEQ ID NO: 2220227 - DNA, 10 bp, Homo sapiens
tactggggat

SEQ ID NO: 2220228 - DNA, 19 bp, Homo sapiens
tactgtaatttgtgataca

SEQ ID NO: 2220229 - DNA, 18 bp, Homo sapiens
tactgtacatgaaaacac

SEQ ID NO: 2220230 - DNA, 13 bp, Homo sapiens
tacttctccaccc

SEQ ID NO: 2220231 - DNA, 20 bp, Homo sapiens
tacttctccaccctgctctc

SEQ ID NO: 2220232 - DNA, 15 bp, Homo sapiens
tacttcttatacatt

SEQ ID NO: 2220233 - DNA, 20 bp, Homo sapiens
tagaaatatctgaaaatgta

SEQ ID NO: 2220234 - DNA, 16 bp, Homo sapiens
tagaagtcttagatgt

SEQ ID NO: 2220235 - DNA, 19 bp, Homo sapiens
tagaagtcttagatgtata

SEQ ID NO: 2220236 - DNA, 18 bp, Homo sapiens
tagacaatttattatggc

SEQ ID NO: 2220237 - DNA, 21 bp, Homo sapiens
tagacagagtctcactgttgc

SEQ ID NO: 2220238 - DNA, 12 bp, Homo sapiens
tagacagtccct

SEQ ID NO: 2220239 - DNA, 22 bp, Homo sapiens
tagagcggagaaaggaagggct

SEQ ID NO: 2220240 - DNA, 16 bp, Homo sapiens
tagaggttcaaagata

SEQ ID NO: 2220241 - DNA, 12 bp, Homo sapiens
tagagtgggagc

SEQ ID NO: 2220242 - DNA, 14 bp, Homo sapiens
tagagttgatacta

SEQ ID NO: 2220243 - DNA, 12 bp, Homo sapiens
tagatgtatata

SEQ ID NO: 2220244 - DNA, 22 bp, Homo sapiens
tagcacagaccctgccctgtgg

SEQ ID NO: 2220245 - DNA, 16 bp, Homo sapiens
tagcatacgtacacat

SEQ ID NO: 2220246 - DNA, 17 bp, Homo sapiens
tagcatacgtacacatt

SEQ ID NO: 2220247 - DNA, 14 bp, Homo sapiens
tagcccaaaaccaa

SEQ ID NO: 2220248 - DNA, 20 bp, Homo sapiens
tagcctgtgcctctgggact

SEQ ID NO: 2220249 - DNA, 22 bp, Homo sapiens
tagctcattctccttgtgttac

SEQ ID NO: 2220250 - DNA, 12 bp, Homo sapiens
tagctgggacta

SEQ ID NO: 2220251 - DNA, 19 bp, Homo sapiens
tagctgggactacaggcac

SEQ ID NO: 2220252 - DNA, 20 bp, Homo sapiens
tagctgggactacaggcacc

SEQ ID NO: 2220253 - DNA, 17 bp, Homo sapiens
taggaaaaactgatttt

SEQ ID NO: 2220254 - DNA, 21 bp, Homo sapiens
taggaacttaaataatgtgaa

SEQ ID NO: 2220255 - DNA, 16 bp, Homo sapiens
taggaagactttggaa

SEQ ID NO: 2220256 - DNA, 14 bp, Homo sapiens
taggcattgtggga

SEQ ID NO: 2220257 - DNA, 16 bp, Homo sapiens
taggcatttgctgaat

SEQ ID NO: 2220258 - DNA, 20 bp, Homo sapiens
taggcatttgctgaatacag

SEQ ID NO: 2220259 - DNA, 11 bp, Homo sapiens
tagggaaaaac

SEQ ID NO: 2220260 - DNA, 13 bp, Homo sapiens
tagggaagataat

SEQ ID NO: 2220261 - DNA, 11 bp, Homo sapiens
taggtgacaga

SEQ ID NO: 2220262 - DNA, 23 bp, Homo sapiens
taggtgacagagtgagactctgt

SEQ ID NO: 2220263 - DNA, 22 bp, Homo sapiens
tagtagagacagggttttgcca

SEQ ID NO: 2220264 - DNA, 15 bp, Homo sapiens
tagtatgaggcattt

SEQ ID NO: 2220265 - DNA, 16 bp, Homo sapiens
tagtatggtggctggg

SEQ ID NO: 2220266 - DNA, 18 bp, Homo sapiens
tagttcaggtaacaggca

SEQ ID NO: 2220267 - DNA, 13 bp, Homo sapiens
tagtttctccaag

SEQ ID NO: 2220268 - DNA, 21 bp, Homo sapiens
tagtttgattaaattcttgca

SEQ ID NO: 2220269 - DNA, 16 bp, Homo sapiens
tataaactttaccttt

SEQ ID NO: 2220270 - DNA, 22 bp, Homo sapiens
tatacacttacactttatgcac

SEQ ID NO: 2220271 - DNA, 13 bp, Homo sapiens
tatacataaacaa

SEQ ID NO: 2220272 - DNA, 14 bp, Homo sapiens
tatacatttgataa

SEQ ID NO: 2220273 - DNA, 23 bp, Homo sapiens
tataggaacttaaataatgtgaa

SEQ ID NO: 2220274 - DNA, 18 bp, Homo sapiens
tatcacccagaagaaaat

SEQ ID NO: 2220275 - DNA, 19 bp, Homo sapiens
tatcaggtgctgccatcca

SEQ ID NO: 2220276 - DNA, 19 bp, Homo sapiens
tatccctactgtaatttgt

SEQ ID NO: 2220277 - DNA, 16 bp, Homo sapiens
tatctaaatgttgaaa

SEQ ID NO: 2220278 - DNA, 13 bp, Homo sapiens
tatctcagggcct

SEQ ID NO: 2220279 - DNA, 17 bp, Homo sapiens
tatctcccccagcccca

SEQ ID NO: 2220280 - DNA, 20 bp, Homo sapiens
tatctgtcatttgagcaggg

SEQ ID NO: 2220281 - DNA, 14 bp, Homo sapiens
tatcttgaagactt

SEQ ID NO: 2220282 - DNA, 22 bp, Homo sapiens
tatgacacatgcaaggtcattt

SEQ ID NO: 2220283 - DNA, 23 bp, Homo sapiens
tatgaggcatttgtttgaactga

SEQ ID NO: 2220284 - DNA, 21 bp, Homo sapiens
tatgatcacggctcactgcag

SEQ ID NO: 2220285 - DNA, 14 bp, Homo sapiens
tatgcacacatttt

SEQ ID NO: 2220286 - DNA, 23 bp, Homo sapiens
tatgcatttgaaaattttgatgt

SEQ ID NO: 2220287 - DNA, 22 bp, Homo sapiens
tatgcttatacacttacacttt

SEQ ID NO: 2220288 - DNA, 13 bp, Homo sapiens
tatggaacactct

SEQ ID NO: 2220289 - DNA, 17 bp, Homo sapiens
tatggacaatgacccag

SEQ ID NO: 2220290 - DNA, 22 bp, Homo sapiens
tatgttcttagtggatgttctg

SEQ ID NO: 2220291 - DNA, 13 bp, Homo sapiens
tatgttgcccagg

SEQ ID NO: 2220292 - DNA, 19 bp, Homo sapiens
tatgttttaagaggcaggg

SEQ ID NO: 2220293 - DNA, 16 bp, Homo sapiens
tattaaaaatctcaaa

SEQ ID NO: 2220294 - DNA, 16 bp, Homo sapiens
tattaccacagacata

SEQ ID NO: 2220295 - DNA, 13 bp, Homo sapiens
tattatacctttt

SEQ ID NO: 2220296 - DNA, 22 bp, Homo sapiens
tattcaggaagctcagggcctg

SEQ ID NO: 2220297 - DNA, 20 bp, Homo sapiens
tattctctcctgtacctctt

SEQ ID NO: 2220298 - DNA, 21 bp, Homo sapiens
tattgatatgcttatacactt

SEQ ID NO: 2220299 - DNA, 22 bp, Homo sapiens
tattgctgatggtgcaatgacc

SEQ ID NO: 2220300 - DNA, 18 bp, Homo sapiens
tattgttttcagtgtaca

SEQ ID NO: 2220301 - DNA, 22 bp, Homo sapiens
tatttattaaatgcccagcccc

SEQ ID NO: 2220302 - DNA, 23 bp, Homo sapiens
tatttattaaatgcccagcccct

SEQ ID NO: 2220303 - DNA, 13 bp, Homo sapiens
tatttatttaaat

SEQ ID NO: 2220304 - DNA, 18 bp, Homo sapiens
tcctctgtacagagccca

SEQ ID NO: 2220305 - DNA, 19 bp, Homo sapiens
tcctctgtacagagcccac

SEQ ID NO: 2220306 - DNA, 19 bp, Homo sapiens
tcctctttggtctacactg

SEQ ID NO: 2220307 - DNA, 14 bp, Homo sapiens
tcctgagccagatt

SEQ ID NO: 2220308 - DNA, 17 bp, Homo sapiens
tcctgagccagatttca

SEQ ID NO: 2220309 - DNA, 18 bp, Homo sapiens
tcctgagccagatttcac

SEQ ID NO: 2220310 - DNA, 19 bp, Homo sapiens
tcctgaggctgggctccct

SEQ ID NO: 2220311 - DNA, 20 bp, Homo sapiens
tcctgatgcttcttcagaga

SEQ ID NO: 2220312 - DNA, 21 bp, Homo sapiens
tcctgatgcttcttcagagac

SEQ ID NO: 2220313 - DNA, 13 bp, Homo sapiens
gtgtccctgcact

SEQ ID NO: 2220314 - DNA, 16 bp, Homo sapiens
gtgtccctgcacttgc

SEQ ID NO: 2220315 - DNA, 14 bp, Homo sapiens
gtgtccggtccctg

SEQ ID NO: 2220316 - DNA, 20 bp, Homo sapiens
gtgtctcttggtcctgctgc

SEQ ID NO: 2220317 - DNA, 21 bp, Homo sapiens
gtgtctcttggtcctgctgca

SEQ ID NO: 2220318 - DNA, 22 bp, Homo sapiens
gtgtctcttggtcctgctgcag

SEQ ID NO: 2220319 - DNA, 18 bp, Homo sapiens
gtgtcttttttcactaca

SEQ ID NO: 2220320 - DNA, 20 bp, Homo sapiens
gtgtgagtcaccaagcccag

SEQ ID NO: 2220321 - DNA, 21 bp, Homo sapiens
gtgtggagaagcggctggcag

SEQ ID NO: 2220322 - DNA, 18 bp, Homo sapiens
gtgttatgactccagaat

SEQ ID NO: 2220323 - DNA, 13 bp, Homo sapiens
gtgtttattgtca

SEQ ID NO: 2220324 - DNA, 12 bp, Homo sapiens
gttaagagaaat

SEQ ID NO: 2220325 - DNA, 20 bp, Homo sapiens
gttagtatgaggcatttgtt

SEQ ID NO: 2220326 - DNA, 16 bp, Homo sapiens
gttagtttctccaagc

SEQ ID NO: 2220327 - DNA, 20 bp, Homo sapiens
gttcaaagatattttgcttt

SEQ ID NO: 2220328 - DNA, 16 bp, Homo sapiens
gttcaattctcatttg

SEQ ID NO: 2220329 - DNA, 19 bp, Homo sapiens
gttcactgcaacctccgcc

SEQ ID NO: 2220330 - DNA, 13 bp, Homo sapiens
gttcagctccagc

SEQ ID NO: 2220331 - DNA, 20 bp, Homo sapiens
gttcagggttggcccctgcc

SEQ ID NO: 2220332 - DNA, 22 bp, Homo sapiens
gttcagggttggcccctgcccg

SEQ ID NO: 2220333 - DNA, 17 bp, Homo sapiens
gttccaccatcaagcca

SEQ ID NO: 2220334 - DNA, 16 bp, Homo sapiens
gttcccatttgctcct

SEQ ID NO: 2220335 - DNA, 21 bp, Homo sapiens
gttccctttgacgccatccca

SEQ ID NO: 2220336 - DNA, 22 bp, Homo sapiens
gttccctttgacgccatcccag

SEQ ID NO: 2220337 - DNA, 16 bp, Homo sapiens
gttctacccaggtgct

SEQ ID NO: 2220338 - DNA, 19 bp, Homo sapiens
gttctagcatggctgccaa

SEQ ID NO: 2220339 - DNA, 12 bp, Homo sapiens
gttctctgccct

SEQ ID NO: 2220340 - DNA, 12 bp, Homo sapiens
gttctggctctt

SEQ ID NO: 2220341 - DNA, 14 bp, Homo sapiens
gttcttaattctta

SEQ ID NO: 2220342 - DNA, 15 bp, Homo sapiens
gttcttggtttgtaa

SEQ ID NO: 2220343 - DNA, 14 bp, Homo sapiens
gttgatagcacaga

SEQ ID NO: 2220344 - DNA, 23 bp, Homo sapiens
gttgatgatctttgcagacaggc

SEQ ID NO: 2220345 - DNA, 15 bp, Homo sapiens
gttgcaggacctcag

SEQ ID NO: 2220346 - DNA, 16 bp, Homo sapiens
gttgccagtcaccccg

SEQ ID NO: 2220347 - DNA, 18 bp, Homo sapiens
gttgccagtcaccccggc

SEQ ID NO: 2220348 - DNA, 23 bp, Homo sapiens
gttgccagtcaccccggccacct

SEQ ID NO: 2220349 - DNA, 19 bp, Homo sapiens
gttgcccaggcaggtcttg

SEQ ID NO: 2220350 - DNA, 12 bp, Homo sapiens
gttgcccaggct

SEQ ID NO: 2220351 - DNA, 14 bp, Homo sapiens
gttggcaaaaaggc

SEQ ID NO: 2220352 - DNA, 14 bp, Homo sapiens
gttggccaggctgg

SEQ ID NO: 2220353 - DNA, 17 bp, Homo sapiens
gttggccaggctggtct

SEQ ID NO: 2220354 - DNA, 17 bp, Homo sapiens
ggcccttctctccagcc

SEQ ID NO: 2220355 - DNA, 18 bp, Homo sapiens
ggcccttctctccagccc

SEQ ID NO: 2220356 - DNA, 19 bp, Homo sapiens
ggcccttctctccagcccc

SEQ ID NO: 2220357 - DNA, 22 bp, Homo sapiens
ggcccttctctccagcccctgg

SEQ ID NO: 2220358 - DNA, 23 bp, Homo sapiens
ggcccttctctccagcccctgga

SEQ ID NO: 2220359 - DNA, 20 bp, Homo sapiens
ggcctagcatacgtacacat

SEQ ID NO: 2220360 - DNA, 22 bp, Homo sapiens
ggcctagcatacgtacacattt

SEQ ID NO: 2220361 - DNA, 23 bp, Homo sapiens
ggcctagcatacgtacacatttt

SEQ ID NO: 2220362 - DNA, 22 bp, Homo sapiens
ggcctcaagtgattctcctgcc

SEQ ID NO: 2220363 - DNA, 14 bp, Homo sapiens
ggcctcccaactca

SEQ ID NO: 2220364 - DNA, 14 bp, Homo sapiens
ggcctcctgtgtgt

SEQ ID NO: 2220365 - DNA, 13 bp, Homo sapiens
ggcctctgcactc

SEQ ID NO: 2220366 - DNA, 18 bp, Homo sapiens
ggcctctgcactcccctg

SEQ ID NO: 2220367 - DNA, 22 bp, Homo sapiens
ggcctctgcactcccctgctgg

SEQ ID NO: 2220368 - DNA, 12 bp, Homo sapiens
ggcctggccaga

SEQ ID NO: 2220369 - DNA, 15 bp, Homo sapiens
ggcctggccagatgc

SEQ ID NO: 2220370 - DNA, 15 bp, Homo sapiens
ggcctggcccctcag

SEQ ID NO: 2220371 - DNA, 23 bp, Homo sapiens
ggcctggcccctcagggtccctg

SEQ ID NO: 2220372 - DNA, 10 bp, Homo sapiens
ggcctggcct

SEQ ID NO: 2220373 - DNA, 13 bp, Homo sapiens
ggcctggcctgag

SEQ ID NO: 2220374 - DNA, 14 bp, Homo sapiens
ggcctttggcttca

SEQ ID NO: 2220375 - DNA, 23 bp, Homo sapiens
ggcgcagcatattcaggaagctc

SEQ ID NO: 2220376 - DNA, 11 bp, Homo sapiens
ggcgctgcccc

SEQ ID NO: 2220377 - DNA, 16 bp, Homo sapiens
ggctaatgtactgcat

SEQ ID NO: 2220378 - DNA, 16 bp, Homo sapiens
ggctagaggttcaaag

SEQ ID NO: 2220379 - DNA, 17 bp, Homo sapiens
ggctagaggttcaaaga

SEQ ID NO: 2220380 - DNA, 22 bp, Homo sapiens
ggctaggacccctccatgtggg

SEQ ID NO: 2220381 - DNA, 15 bp, Homo sapiens
ggctcactgcagcct

SEQ ID NO: 2220382 - DNA, 19 bp, Homo sapiens
ggctcagcaaaagatgctt

SEQ ID NO: 2220383 - DNA, 22 bp, Homo sapiens
ggctcagcggggacagctcctt

SEQ ID NO: 2220384 - DNA, 19 bp, Homo sapiens
ggctcaggtggggtcactc

SEQ ID NO: 2220385 - DNA, 16 bp, Homo sapiens
ggctccaggagcagcc

SEQ ID NO: 2220386 - DNA, 17 bp, Homo sapiens
ggctccaggagcagcca

SEQ ID NO: 2220387 - DNA, 19 bp, Homo sapiens
ggctccagggggtgccctc

SEQ ID NO: 2220388 - DNA, 22 bp, Homo sapiens
ggctccagggggtgccctccca

SEQ ID NO: 2220389 - DNA, 18 bp, Homo sapiens
ggctcccttcccacctct

SEQ ID NO: 2220390 - DNA, 14 bp, Homo sapiens
ggctctcaggccag

SEQ ID NO: 2220391 - DNA, 15 bp, Homo sapiens
ggctctcaggccagc

SEQ ID NO: 2220392 - DNA, 14 bp, Homo sapiens
ggctcttccaggct

SEQ ID NO: 2220393 - DNA, 20 bp, Homo sapiens
ggctcttccaggctgggaga

SEQ ID NO: 2220394 - DNA, 15 bp, Homo sapiens
ggctgaggtgggagg

SEQ ID NO: 2220395 - DNA, 18 bp, Homo sapiens
ggctgcaaagggtatcag

SEQ ID NO: 2220396 - DNA, 24 bp, Homo sapiens
ggctgcaaagggtatcaggtgctg

SEQ ID NO: 2220397 - DNA, 19 bp, Homo sapiens
ggctgcaccggctggcctg

SEQ ID NO: 2220398 - DNA, 22 bp, Homo sapiens
ggctgcatgcgggcttcctcct

SEQ ID NO: 2220399 - DNA, 17 bp, Homo sapiens
ggctgctgaaggctcga

SEQ ID NO: 2220400 - DNA, 12 bp, Homo sapiens
ggctgcttcaag

SEQ ID NO: 2220401 - DNA, 20 bp, Homo sapiens
ggctgcttcaaggatcctga

SEQ ID NO: 2220402 - DNA, 21 bp, Homo sapiens
ggctgcttcaaggatcctgag

SEQ ID NO: 2220403 - DNA, 14 bp, Homo sapiens
ggctggcctggccc

SEQ ID NO: 2220404 - DNA, 18 bp, Homo sapiens
ggctgggagagccttcca

SEQ ID NO: 2220405 - DNA, 19 bp, Homo sapiens
ggctgggagagccttccag

SEQ ID NO: 2220406 - DNA, 20 bp, Homo sapiens
ggctgggagagccttccagg

SEQ ID NO: 2220407 - DNA, 13 bp, Homo sapiens
ggctgggcagagg

SEQ ID NO: 2220408 - DNA, 15 bp, Homo sapiens
ggctgggcagaggaa

SEQ ID NO: 2220409 - DNA, 19 bp, Homo sapiens
ggctgggcagaggaaagca

SEQ ID NO: 2220410 - DNA, 22 bp, Homo sapiens
ggctgggcttcagtggcagctg

SEQ ID NO: 2220411 - DNA, 14 bp, Homo sapiens
ggctgggggcctca

SEQ ID NO: 2220412 - DNA, 16 bp, Homo sapiens
ggctgggggcctcagt

SEQ ID NO: 2220413 - DNA, 22 bp, Homo sapiens
ggctgggttctacccaggtgct

SEQ ID NO: 2220414 - DNA, 18 bp, Homo sapiens
ggctgtatcccatgagcc

SEQ ID NO: 2220415 - DNA, 22 bp, Homo sapiens
ggctgtatcccatgagcctcag

SEQ ID NO: 2220416 - DNA, 15 bp, Homo sapiens
ggcttagtcactgag

SEQ ID NO: 2220417 - DNA, 20 bp, Homo sapiens
ggcttcacggaagagccttg

SEQ ID NO: 2220418 - DNA, 21 bp, Homo sapiens
ggcttcctcctggtgtggaag

SEQ ID NO: 2220419 - DNA, 22 bp, Homo sapiens
ggtggcagtgggagctgcctgt

SEQ ID NO: 2220420 - DNA, 17 bp, Homo sapiens
ggtggcctcccaactca

SEQ ID NO: 2220421 - DNA, 22 bp, Homo sapiens
ggtggcctcccaactcacccca

SEQ ID NO: 2220422 - DNA, 23 bp, Homo sapiens
ggtggcctcccaactcaccccag

SEQ ID NO: 2220423 - DNA, 20 bp, Homo sapiens
ggtgggaggatctcttgagc

SEQ ID NO: 2220424 - DNA, 11 bp, Homo sapiens
ggtgggagggg

SEQ ID NO: 2220425 - DNA, 20 bp, Homo sapiens
ggtgggagggtctgcaggga

SEQ ID NO: 2220426 - DNA, 14 bp, Homo sapiens
ggtgggatcctcca

SEQ ID NO: 2220427 - DNA, 15 bp, Homo sapiens
ggtgggatcctccag

SEQ ID NO: 2220428 - DNA, 13 bp, Homo sapiens
ggtgggggcctcg

SEQ ID NO: 2220429 - DNA, 14 bp, Homo sapiens
ggtggtgacctctg

SEQ ID NO: 2220430 - DNA, 18 bp, Homo sapiens
ggtggtttcagaaatgtg

SEQ ID NO: 2220431 - DNA, 19 bp, Homo sapiens
ggtgtcaagagggtctgag

SEQ ID NO: 2220432 - DNA, 13 bp, Homo sapiens
ggtgtcgggcatg

SEQ ID NO: 2220433 - DNA, 12 bp, Homo sapiens
ggtgtggaagag

SEQ ID NO: 2220434 - DNA, 12 bp, Homo sapiens
ggtgtggagaag

SEQ ID NO: 2220435 - DNA, 14 bp, Homo sapiens
ggtgtggagaagcg

SEQ ID NO: 2220436 - DNA, 13 bp, Homo sapiens
ggtgtgggggaag

SEQ ID NO: 2220437 - DNA, 22 bp, Homo sapiens
ggttcccttttttggctgctga

SEQ ID NO: 2220438 - DNA, 14 bp, Homo sapiens
ggttgaagcaccaa

SEQ ID NO: 2220439 - DNA, 13 bp, Homo sapiens
ggttgaggtttca

SEQ ID NO: 2220440 - DNA, 13 bp, Homo sapiens
ggtttcagaaatg

SEQ ID NO: 2220441 - DNA, 16 bp, Homo sapiens
ggtttctaaagctgcc

SEQ ID NO: 2220442 - DNA, 20 bp, Homo sapiens
ggtttgtaaattaactttta

SEQ ID NO: 2220443 - DNA, 18 bp, Homo sapiens
gtaaatgggggtgcattt

SEQ ID NO: 2220444 - DNA, 19 bp, Homo sapiens
gtaaatgggggtgcatttg

SEQ ID NO: 2220445 - DNA, 16 bp, Homo sapiens
gtaaattaacttttat

SEQ ID NO: 2220446 - DNA, 21 bp, Homo sapiens
gtaaattaacttttataaact

SEQ ID NO: 2220447 - DNA, 13 bp, Homo sapiens
gtaaggaatgatt

SEQ ID NO: 2220448 - DNA, 22 bp, Homo sapiens
gtaagtattcttatttaatgaa

SEQ ID NO: 2220449 - DNA, 14 bp, Homo sapiens
gtaatatgcacaca

SEQ ID NO: 2220450 - DNA, 14 bp, Homo sapiens
gtaattaagtacta

SEQ ID NO: 2220451 - DNA, 21 bp, Homo sapiens
gtaattaagtactatgtatca

SEQ ID NO: 2220452 - DNA, 19 bp, Homo sapiens
gtacactgtttcaaacttt

SEQ ID NO: 2220453 - DNA, 22 bp, Homo sapiens
gtacagagcccacgcccccact

SEQ ID NO: 2220454 - DNA, 20 bp, Homo sapiens
gtacataatgcgtgcatacc

SEQ ID NO: 2220455 - DNA, 15 bp, Homo sapiens
gtacatgaaaacaca

SEQ ID NO: 2220456 - DNA, 13 bp, Homo sapiens
gtacctcttgagc

SEQ ID NO: 2220457 - DNA, 14 bp, Homo sapiens
gtacgttgtgcatt

SEQ ID NO: 2220458 - DNA, 15 bp, Homo sapiens
gtactatgtatcaat

SEQ ID NO: 2220459 - DNA, 17 bp, Homo sapiens
gtactatgtatcaatga

SEQ ID NO: 2220460 - DNA, 20 bp, Homo sapiens
gtacttctccaccctgctct

SEQ ID NO: 2220461 - DNA, 21 bp, Homo sapiens
gtacttctccaccctgctctc

SEQ ID NO: 2220462 - DNA, 23 bp, Homo sapiens
gtagaaatatctgaaaatgtatg

SEQ ID NO: 2220463 - DNA, 18 bp, Homo sapiens
gtagaagcccttctacct

SEQ ID NO: 2220464 - DNA, 11 bp, Homo sapiens
gtagagacagg

SEQ ID NO: 2220465 - DNA, 16 bp, Homo sapiens
gtagagcggagaaagg

SEQ ID NO: 2220466 - DNA, 18 bp, Homo sapiens
gtagctgggactacaggc

SEQ ID NO: 2220467 - DNA, 10 bp, Homo sapiens
gtaggaggaa

SEQ ID NO: 2220468 - DNA, 23 bp, Homo sapiens
gtagggcgggaggatgttctggg

SEQ ID NO: 2220469 - DNA, 14 bp, Homo sapiens
gtagtcaggtgcct

SEQ ID NO: 2220470 - DNA, 22 bp, Homo sapiens
gtatcaggtgctgccatccagg

SEQ ID NO: 2220471 - DNA, 15 bp, Homo sapiens
gtatccctactgtaa

SEQ ID NO: 2220472 - DNA, 13 bp, Homo sapiens
gtatgaggcattt

SEQ ID NO: 2220473 - DNA, 15 bp, Homo sapiens
gtatgaggcatttgt

SEQ ID NO: 2220474 - DNA, 13 bp, Homo sapiens
gtatggtggctgg

SEQ ID NO: 2220475 - DNA, 13 bp, Homo sapiens
gtattacttctgc

SEQ ID NO: 2220476 - DNA, 18 bp, Homo sapiens
gtattctctcctgtacct

SEQ ID NO: 2220477 - DNA, 15 bp, Homo sapiens
gtattcttatttaat

SEQ ID NO: 2220478 - DNA, 19 bp, Homo sapiens
gtcaaagtggtgagaggca

SEQ ID NO: 2220479 - DNA, 18 bp, Homo sapiens
gtcaagtgaaaaaggagg

SEQ ID NO: 2220480 - DNA, 16 bp, Homo sapiens
gtcaattacaggaagt

SEQ ID NO: 2220481 - DNA, 16 bp, Homo sapiens
gtcacacactttggct

SEQ ID NO: 2220482 - DNA, 12 bp, Homo sapiens
gtcacaggcagg

SEQ ID NO: 2220483 - DNA, 22 bp, Homo sapiens
gtcaccaaatcagctgctacta

SEQ ID NO: 2220484 - DNA, 12 bp, Homo sapiens
gtcaccaagccc

SEQ ID NO: 2220485 - DNA, 22 bp, Homo sapiens
gtcaccccggccacctgcggtg

SEQ ID NO: 2220486 - DNA, 19 bp, Homo sapiens
gtcactctggcagctcaga

SEQ ID NO: 2220487 - DNA, 16 bp, Homo sapiens
gtcactgagacagccc

SEQ ID NO: 2220488 - DNA, 18 bp, Homo sapiens
gtcactgagacagcccgg

SEQ ID NO: 2220489 - DNA, 16 bp, Homo sapiens
aacaagaccacgtttc

SEQ ID NO: 2220490 - DNA, 19 bp, Homo sapiens
aacaagaccacgtttctaa

SEQ ID NO: 2220491 - DNA, 18 bp, Homo sapiens
aacaaggcaaggctgtca

SEQ ID NO: 2220492 - DNA, 21 bp, Homo sapiens
aacaaggcaaggctgtcaatt

SEQ ID NO: 2220493 - DNA, 12 bp, Homo sapiens
aacacaaaaaaa

SEQ ID NO: 2220494 - DNA, 19 bp, Homo sapiens
aacacctctgcacaagctg

SEQ ID NO: 2220495 - DNA, 21 bp, Homo sapiens
aacactcacatttattctgct

SEQ ID NO: 2220496 - DNA, 12 bp, Homo sapiens
aacactccttca

SEQ ID NO: 2220497 - DNA, 12 bp, Homo sapiens
aacactctgaga

SEQ ID NO: 2220498 - DNA, 11 bp, Homo sapiens
aacagaaatgt

SEQ ID NO: 2220499 - DNA, 12 bp, Homo sapiens
aacagaaatgta

SEQ ID NO: 2220500 - DNA, 22 bp, Homo sapiens
aacaggctgggcttcagtggca

SEQ ID NO: 2220501 - DNA, 19 bp, Homo sapiens
aacaggttttcctgaagaa

SEQ ID NO: 2220502 - DNA, 15 bp, Homo sapiens
aacatactcccatct

SEQ ID NO: 2220503 - DNA, 16 bp, Homo sapiens
aacatactcccatctg

SEQ ID NO: 2220504 - DNA, 22 bp, Homo sapiens
aacatgtttttcttctccctca

SEQ ID NO: 2220505 - DNA, 13 bp, Homo sapiens
aaccacatcttgc

SEQ ID NO: 2220506 - DNA, 22 bp, Homo sapiens
aaccacatcttgctctgctgac

SEQ ID NO: 2220507 - DNA, 19 bp, Homo sapiens
aaccaccacacccagccca

SEQ ID NO: 2220508 - DNA, 17 bp, Homo sapiens
aaccagtgttgtggatt

SEQ ID NO: 2220509 - DNA, 19 bp, Homo sapiens
aaccatcattgaaatcttt

SEQ ID NO: 2220510 - DNA, 14 bp, Homo sapiens
aacccccagcctgc

SEQ ID NO: 2220511 - DNA, 13 bp, Homo sapiens
aacccttcagtgc

SEQ ID NO: 2220512 - DNA, 12 bp, Homo sapiens
aacctgtgtctc

SEQ ID NO: 2220513 - DNA, 16 bp, Homo sapiens
aaccttttgagtgcct

SEQ ID NO: 2220514 - DNA, 13 bp, Homo sapiens
aacgtctgtgcca

SEQ ID NO: 2220515 - DNA, 16 bp, Homo sapiens
aacgtggctgcttcaa

SEQ ID NO: 2220516 - DNA, 12 bp, Homo sapiens
aactcctggcct

SEQ ID NO: 2220517 - DNA, 18 bp, Homo sapiens
aactctcctccagagtca

SEQ ID NO: 2220518 - DNA, 19 bp, Homo sapiens
aactctcctctgctgctgg

SEQ ID NO: 2220519 - DNA, 14 bp, Homo sapiens
aactgataaagatg

SEQ ID NO: 2220520 - DNA, 19 bp, Homo sapiens
aactgatttttttttcctt

SEQ ID NO: 2220521 - DNA, 22 bp, Homo sapiens
aactgatttttttttccttcag

SEQ ID NO: 2220522 - DNA, 16 bp, Homo sapiens
aactggattaaactta

SEQ ID NO: 2220523 - DNA, 19 bp, Homo sapiens
aacttaaataatgtgaaac

SEQ ID NO: 2220524 - DNA, 22 bp, Homo sapiens
aacttcacatattgatttccgt

SEQ ID NO: 2220525 - DNA, 22 bp, Homo sapiens
aacttcaccatattaccacaga

SEQ ID NO: 2220526 - DNA, 13 bp, Homo sapiens
aacttccaattta

SEQ ID NO: 2220527 - DNA, 11 bp, Homo sapiens
aacttgaaaaa

SEQ ID NO: 2220528 - DNA, 13 bp, Homo sapiens
aacttgaaaaaaa

SEQ ID NO: 2220529 - DNA, 14 bp, Homo sapiens
aacttggcgctgcc

SEQ ID NO: 2220530 - DNA, 13 bp, Homo sapiens
aactttacctttt

SEQ ID NO: 2220531 - DNA, 17 bp, Homo sapiens
aactttgacctctgcag

SEQ ID NO: 2220532 - DNA, 12 bp, Homo sapiens
aacttttataaa

SEQ ID NO: 2220533 - DNA, 15 bp, Homo sapiens
aagaaaaaggatgca

SEQ ID NO: 2220534 - DNA, 18 bp, Homo sapiens
aagaaaaaggatgcacag

SEQ ID NO: 2220535 - DNA, 15 bp, Homo sapiens
aagaaaatagtggtg

SEQ ID NO: 2220536 - DNA, 20 bp, Homo sapiens
aagaaagactatctaaatgt

SEQ ID NO: 2220537 - DNA, 15 bp, Homo sapiens
aagaagctctctcct

SEQ ID NO: 2220538 - DNA, 13 bp, Homo sapiens
aagaatgcagaga

SEQ ID NO: 2220539 - DNA, 15 bp, Homo sapiens
aagaatgcagagatg

SEQ ID NO: 2220540 - DNA, 21 bp, Homo sapiens
aagacccttgtggtcccaccc

SEQ ID NO: 2220541 - DNA, 22 bp, Homo sapiens
aagacccttgtggtcccacccc

SEQ ID NO: 2220542 - DNA, 15 bp, Homo sapiens
aagaccttctccttc

SEQ ID NO: 2220543 - DNA, 18 bp, Homo sapiens
aagaccttctccttcacc

SEQ ID NO: 2220544 - DNA, 22 bp, Homo sapiens
aagacgctgtgctgccctgccc

SEQ ID NO: 2220545 - DNA, 23 bp, Homo sapiens
aagacgctgtgctgccctgccca

SEQ ID NO: 2220546 - DNA, 16 bp, Homo sapiens
aagactatctaaatgt

SEQ ID NO: 2220547 - DNA, 23 bp, Homo sapiens
aagactgagtacgttgtgcattt

SEQ ID NO: 2220548 - DNA, 16 bp, Homo sapiens
aagactgtacaaagta

SEQ ID NO: 2220549 - DNA, 19 bp, Homo sapiens
aagacttttctttcagcca

SEQ ID NO: 2220550 - DNA, 19 bp, Homo sapiens
aagagagacagcacaggca

SEQ ID NO: 2220551 - DNA, 10 bp, Homo sapiens
aagagagaga

SEQ ID NO: 2220552 - DNA, 14 bp, Homo sapiens
aagaggcagggtct

SEQ ID NO: 2220553 - DNA, 23 bp, Homo sapiens
aagagggagggagggctccagac

SEQ ID NO: 2220554 - DNA, 12 bp, Homo sapiens
aagagtaggaag

SEQ ID NO: 2220555 - DNA, 18 bp, Homo sapiens
aagagtaggaagactttg

SEQ ID NO: 2220556 - DNA, 13 bp, Homo sapiens
aagataaatgtgc

SEQ ID NO: 2220557 - DNA, 19 bp, Homo sapiens
aagataatattaaggaaga

SEQ ID NO: 2220558 - DNA, 23 bp, Homo sapiens
aagatacagttactcagaattct

SEQ ID NO: 2220559 - DNA, 22 bp, Homo sapiens
aagatattttgctttgtgattt

SEQ ID NO: 2220560 - DNA, 20 bp, Homo sapiens
aagattcatatttacttctt

SEQ ID NO: 2220561 - DNA, 19 bp, Homo sapiens
aagattttgaaatttttat

SEQ ID NO: 2220562 - DNA, 12 bp, Homo sapiens
aagcaaaggaga

SEQ ID NO: 2220563 - DNA, 13 bp, Homo sapiens
aagcaaaggagat

SEQ ID NO: 2220564 - DNA, 14 bp, Homo sapiens
aagcacatgcctct

SEQ ID NO: 2220565 - DNA, 16 bp, Homo sapiens
aagcacatgcctctct

SEQ ID NO: 2220566 - DNA, 20 bp, Homo sapiens
aagcacatgcctctctcagg

SEQ ID NO: 2220567 - DNA, 21 bp, Homo sapiens
aagcacatgcctctctcaggc

SEQ ID NO: 2220568 - DNA, 14 bp, Homo sapiens
aagcacctcctgcc

SEQ ID NO: 2220569 - DNA, 14 bp, Homo sapiens
aagcagaaacaaaa

SEQ ID NO: 2220570 - DNA, 21 bp, Homo sapiens
aagcagaggaaggagaggaga

SEQ ID NO: 2220571 - DNA, 16 bp, Homo sapiens
aagcatttactttgtg

SEQ ID NO: 2220572 - DNA, 17 bp, Homo sapiens
aagccaaagctaggcct

SEQ ID NO: 2220573 - DNA, 18 bp, Homo sapiens
aagccaaagctaggcctg

SEQ ID NO: 2220574 - DNA, 19 bp, Homo sapiens
aagccagcaggctctcagg

SEQ ID NO: 2220575 - DNA, 18 bp, Homo sapiens
aagccataattgttctta

SEQ ID NO: 2220576 - DNA, 14 bp, Homo sapiens
aagcccaggaaagg

SEQ ID NO: 2220577 - DNA, 15 bp, Homo sapiens
aagcctcctccagcc

SEQ ID NO: 2220578 - DNA, 16 bp, Homo sapiens
aagcgattcttctgct

SEQ ID NO: 2220579 - DNA, 16 bp, Homo sapiens
aagcgtgagccactgc

SEQ ID NO: 2220580 - DNA, 22 bp, Homo sapiens
aagctattcagtaataactcta

SEQ ID NO: 2220581 - DNA, 20 bp, Homo sapiens
aagctcagggcctggctcag

SEQ ID NO: 2220582 - DNA, 11 bp, Homo sapiens
aagctcccagg

SEQ ID NO: 2220583 - DNA, 23 bp, Homo sapiens
aagctcccaggcattccccagga

SEQ ID NO: 2220584 - DNA, 16 bp, Homo sapiens
aagctgctgacagtgt

SEQ ID NO: 2220585 - DNA, 15 bp, Homo sapiens
aagctgggcaggttg

SEQ ID NO: 2220586 - DNA, 18 bp, Homo sapiens
aagctggtcccactcagt

SEQ ID NO: 2220587 - DNA, 16 bp, Homo sapiens
aaggaagcacatgcct

SEQ ID NO: 2220588 - DNA, 11 bp, Homo sapiens
aaggagagcta

SEQ ID NO: 2220589 - DNA, 14 bp, Homo sapiens
aaggagatttacaa

SEQ ID NO: 2220590 - DNA, 17 bp, Homo sapiens
aaggagatttacaactg

SEQ ID NO: 2220591 - DNA, 18 bp, Homo sapiens
aaggagatttacaactgg

SEQ ID NO: 2220592 - DNA, 21 bp, Homo sapiens
aaggatacaaaagcatgtgag

SEQ ID NO: 2220593 - DNA, 12 bp, Homo sapiens
aaggatcctgag

SEQ ID NO: 2220594 - DNA, 14 bp, Homo sapiens
aaggatcctgagcc

SEQ ID NO: 2220595 - DNA, 18 bp, Homo sapiens
aaggatgatctaggaaga

SEQ ID NO: 2220596 - DNA, 22 bp, Homo sapiens
aaggatgcacagagttgttaca

SEQ ID NO: 2220597 - DNA, 14 bp, Homo sapiens
aaggatgcccaaag

SEQ ID NO: 2220598 - DNA, 19 bp, Homo sapiens
aaggatgcccaaagatgca

SEQ ID NO: 2220599 - DNA, 16 bp, Homo sapiens
aaggatgcttgtacat

SEQ ID NO: 2220600 - DNA, 19 bp, Homo sapiens
aaggatgcttgtacataat

SEQ ID NO: 2220601 - DNA, 15 bp, Homo sapiens
aaggatgttctagca

SEQ ID NO: 2220602 - DNA, 16 bp, Homo sapiens
aaggccaaaggaagca

SEQ ID NO: 2220603 - DNA, 14 bp, Homo sapiens
aaggccccgcccag

SEQ ID NO: 2220604 - DNA, 19 bp, Homo sapiens
aaggccccgcccaggctta

SEQ ID NO: 2220605 - DNA, 15 bp, Homo sapiens
aaggctccaggagca

SEQ ID NO: 2220606 - DNA, 19 bp, Homo sapiens
aaggctccaggagcagcca

SEQ ID NO: 2220607 - DNA, 22 bp, Homo sapiens
aaggctccaggagcagccacat

SEQ ID NO: 2220608 - DNA, 16 bp, Homo sapiens
aaggctcgagcatgcc

SEQ ID NO: 2220609 - DNA, 20 bp, Homo sapiens
aaggctcgagcatgcctgga

SEQ ID NO: 2220610 - DNA, 14 bp, Homo sapiens
aaggctgggggaag

SEQ ID NO: 2220611 - DNA, 16 bp, Homo sapiens
aaggctgggggaagaa

SEQ ID NO: 2220612 - DNA, 20 bp, Homo sapiens
aagggacttggaagctccgc

SEQ ID NO: 2220613 - DNA, 15 bp, Homo sapiens
aagggcccagagagg

SEQ ID NO: 2220614 - DNA, 23 bp, Homo sapiens
acctttgtattctctcctgtacc

SEQ ID NO: 2220615 - DNA, 15 bp, Homo sapiens
acctttgtccccacc

SEQ ID NO: 2220616 - DNA, 17 bp, Homo sapiens
acctttgtccccaccgc

SEQ ID NO: 2220617 - DNA, 13 bp, Homo sapiens
accttttttatac

SEQ ID NO: 2220618 - DNA, 16 bp, Homo sapiens
accttttttatacata

SEQ ID NO: 2220619 - DNA, 22 bp, Homo sapiens
accttttttatacataaacaag

SEQ ID NO: 2220620 - DNA, 15 bp, Homo sapiens
acgaatattgctgat

SEQ ID NO: 2220621 - DNA, 15 bp, Homo sapiens
acgactgcccggcag

SEQ ID NO: 2220622 - DNA, 17 bp, Homo sapiens
acgatttctgtttagat

SEQ ID NO: 2220623 - DNA, 23 bp, Homo sapiens
acgatttctgtttagataataca

SEQ ID NO: 2220624 - DNA, 18 bp, Homo sapiens
acgccaggggaaaatcag

SEQ ID NO: 2220625 - DNA, 15 bp, Homo sapiens
acgccatcccagccc

SEQ ID NO: 2220626 - DNA, 18 bp, Homo sapiens
acgccatcccagccccaa

SEQ ID NO: 2220627 - DNA, 15 bp, Homo sapiens
acgctggagtgcagt

SEQ ID NO: 2220628 - DNA, 12 bp, Homo sapiens
acgctgtgctgc

SEQ ID NO: 2220629 - DNA, 15 bp, Homo sapiens
acggaagagccttgc

SEQ ID NO: 2220630 - DNA, 19 bp, Homo sapiens
acggacactcaaaagctgg

SEQ ID NO: 2220631 - DNA, 18 bp, Homo sapiens
acggcttttacttaaacc

SEQ ID NO: 2220632 - DNA, 20 bp, Homo sapiens
acgggagggtaaggctgtgg

SEQ ID NO: 2220633 - DNA, 13 bp, Homo sapiens
acgtacacacaca

SEQ ID NO: 2220634 - DNA, 12 bp, Homo sapiens
acgtacacattt

SEQ ID NO: 2220635 - DNA, 14 bp, Homo sapiens
acgtctgacaggca

SEQ ID NO: 2220636 - DNA, 15 bp, Homo sapiens
acgtctgacaggcaa

SEQ ID NO: 2220637 - DNA, 12 bp, Homo sapiens
acgtctgtgcca

SEQ ID NO: 2220638 - DNA, 11 bp, Homo sapiens
acgtgagtcct

SEQ ID NO: 2220639 - DNA, 19 bp, Homo sapiens
acgtggctgcttcaaggat

SEQ ID NO: 2220640 - DNA, 15 bp, Homo sapiens
acgttgtgcatttgg

SEQ ID NO: 2220641 - DNA, 15 bp, Homo sapiens
acgtttctaaaggct

SEQ ID NO: 2220642 - DNA, 12 bp, Homo sapiens
actaaccacgct

SEQ ID NO: 2220643 - DNA, 17 bp, Homo sapiens
actaaccagcagaaatg

SEQ ID NO: 2220644 - DNA, 22 bp, Homo sapiens
actaagtttttatggcttttgt

SEQ ID NO: 2220645 - DNA, 15 bp, Homo sapiens
actaatagacaattt

SEQ ID NO: 2220646 - DNA, 18 bp, Homo sapiens
actaatggggcggtgaga

SEQ ID NO: 2220647 - DNA, 15 bp, Homo sapiens
actacaggcacccac

SEQ ID NO: 2220648 - DNA, 16 bp, Homo sapiens
actacagtcctcccat

SEQ ID NO: 2220649 - DNA, 14 bp, Homo sapiens
actacattctgtta

SEQ ID NO: 2220650 - DNA, 15 bp, Homo sapiens
actacattctgttaa

SEQ ID NO: 2220651 - DNA, 11 bp, Homo sapiens
actataatgta

SEQ ID NO: 2220652 - DNA, 13 bp, Homo sapiens
actataatgtaag

SEQ ID NO: 2220653 - DNA, 17 bp, Homo sapiens
actatagcctaggtgac

SEQ ID NO: 2220654 - DNA, 16 bp, Homo sapiens
actatctaaatgttga

SEQ ID NO: 2220655 - DNA, 12 bp, Homo sapiens
actatgtatcaa

SEQ ID NO: 2220656 - DNA, 16 bp, Homo sapiens
actatgttgcccaggc

SEQ ID NO: 2220657 - DNA, 19 bp, Homo sapiens
actatgttgcccaggcagg

SEQ ID NO: 2220658 - DNA, 18 bp, Homo sapiens
actcaaaagctgggcagg

SEQ ID NO: 2220659 - DNA, 16 bp, Homo sapiens
actcaaactcttaaaa

SEQ ID NO: 2220660 - DNA, 20 bp, Homo sapiens
actcacatttattctgctca

SEQ ID NO: 2220661 - DNA, 15 bp, Homo sapiens
actcaccccagcccc

SEQ ID NO: 2220662 - DNA, 17 bp, Homo sapiens
actcagaagacactgat

SEQ ID NO: 2220663 - DNA, 14 bp, Homo sapiens
actcagaattctct

SEQ ID NO: 2220664 - DNA, 16 bp, Homo sapiens
actcattgacctgagg

SEQ ID NO: 2220665 - DNA, 17 bp, Homo sapiens
actcattgacctgaggc

SEQ ID NO: 2220666 - DNA, 23 bp, Homo sapiens
actccagaatttcccaaagcagt

SEQ ID NO: 2220667 - DNA, 13 bp, Homo sapiens
actccagcctggg

SEQ ID NO: 2220668 - DNA, 12 bp, Homo sapiens
actcctgcaggc

SEQ ID NO: 2220669 - DNA, 23 bp, Homo sapiens
actccttgaaaacactgttctct

SEQ ID NO: 2220670 - DNA, 24 bp, Homo sapiens
actccttgaaaacactgttctctg

SEQ ID NO: 2220671 - DNA, 23 bp, Homo sapiens
actcgcgacaatgcaaaccatca

SEQ ID NO: 2220672 - DNA, 14 bp, Homo sapiens
actctatcaagtat

SEQ ID NO: 2220673 - DNA, 23 bp, Homo sapiens
actctatcaagtattataccttt

SEQ ID NO: 2220674 - DNA, 18 bp, Homo sapiens
actctatttttgtaaaaa

SEQ ID NO: 2220675 - DNA, 17 bp, Homo sapiens
actctcctccagagtca

SEQ ID NO: 2220676 - DNA, 18 bp, Homo sapiens
actctcctctgctgctgg

SEQ ID NO: 2220677 - DNA, 18 bp, Homo sapiens
actctcctggaaatatta

SEQ ID NO: 2220678 - DNA, 23 bp, Homo sapiens
actctccttggtgtcgggcatga

SEQ ID NO: 2220679 - DNA, 15 bp, Homo sapiens
actctggcagctcag

SEQ ID NO: 2220680 - DNA, 17 bp, Homo sapiens
actctggcagctcagag

SEQ ID NO: 2220681 - DNA, 18 bp, Homo sapiens
actcttaaaacccaagtg

SEQ ID NO: 2220682 - DNA, 16 bp, Homo sapiens
actcttattgcccacg

SEQ ID NO: 2220683 - DNA, 21 bp, Homo sapiens
actcttattgcccacgctgga

SEQ ID NO: 2220684 - DNA, 23 bp, Homo sapiens
actgaatttcttttgccgttatt

SEQ ID NO: 2220685 - DNA, 18 bp, Homo sapiens
actgacattgttggccaa

SEQ ID NO: 2220686 - DNA, 21 bp, Homo sapiens
actgagacagcccgggctctg

SEQ ID NO: 2220687 - DNA, 23 bp, Homo sapiens
actgagacagcccgggctctgcc

SEQ ID NO: 2220688 - DNA, 19 bp, Homo sapiens
actgagtacgttgtgcatt

SEQ ID NO: 2220689 - DNA, 12 bp, Homo sapiens
actgatgggcaa

SEQ ID NO: 2220690 - DNA, 23 bp, Homo sapiens
actgatttttttttccttcagtg

SEQ ID NO: 2220691 - DNA, 13 bp, Homo sapiens
actgcaacctccg

SEQ ID NO: 2220692 - DNA, 14 bp, Homo sapiens
actgcaacctccgc

SEQ ID NO: 2220693 - DNA, 16 bp, Homo sapiens
actgcaccgggccaca

SEQ ID NO: 2220694 - DNA, 20 bp, Homo sapiens
actgcactccagcctgggtg

SEQ ID NO: 2220695 - DNA, 22 bp, Homo sapiens
actgcagcctcaacctcctggg

SEQ ID NO: 2220696 - DNA, 16 bp, Homo sapiens
actgcatatgaaagga

SEQ ID NO: 2220697 - DNA, 16 bp, Homo sapiens
actgcatgtttgtgat

SEQ ID NO: 2220698 - DNA, 14 bp, Homo sapiens
actgccatgccagc

SEQ ID NO: 2220699 - DNA, 14 bp, Homo sapiens
actgcttttggtct

SEQ ID NO: 2220700 - DNA, 15 bp, Homo sapiens
actgcttttggtctg

SEQ ID NO: 2220701 - DNA, 15 bp, Homo sapiens
actggaagcacagct

SEQ ID NO: 2220702 - DNA, 19 bp, Homo sapiens
actggaagcacagcttcat

SEQ ID NO: 2220703 - DNA, 21 bp, Homo sapiens
actgggcttggggaccagagc

SEQ ID NO: 2220704 - DNA, 22 bp, Homo sapiens
actgggcttggggaccagagct

SEQ ID NO: 2220705 - DNA, 15 bp, Homo sapiens
actgggtacttgtgg

SEQ ID NO: 2220706 - DNA, 20 bp, Homo sapiens
actgggtacttgtggacaca

SEQ ID NO: 2220707 - DNA, 13 bp, Homo sapiens
actgtacatgaaa

SEQ ID NO: 2220708 - DNA, 21 bp, Homo sapiens
actgtacatgaaaacacattt

SEQ ID NO: 2220709 - DNA, 14 bp, Homo sapiens
actgtatcatgaca

SEQ ID NO: 2220710 - DNA, 16 bp, Homo sapiens
actgtatcatgacaaa

SEQ ID NO: 2220711 - DNA, 20 bp, Homo sapiens
actgtatcatgacaaagact

SEQ ID NO: 2220712 - DNA, 18 bp, Homo sapiens
actgtcctacccaccctc

SEQ ID NO: 2220713 - DNA, 23 bp, Homo sapiens
actgtcctacccaccctcctttc

SEQ ID NO: 2220714 - DNA, 16 bp, Homo sapiens
actgtgaagagaacca

SEQ ID NO: 2220715 - DNA, 20 bp, Homo sapiens
actgtgctgagtctgaaggc

SEQ ID NO: 2220716 - DNA, 18 bp, Homo sapiens
actgtttcaaactttact

SEQ ID NO: 2220717 - DNA, 15 bp, Homo sapiens
acttaaataatgtga

SEQ ID NO: 2220718 - DNA, 13 bp, Homo sapiens
acttaatctaaat

SEQ ID NO: 2220719 - DNA, 16 bp, Homo sapiens
acttaatctaaatgga

SEQ ID NO: 2220720 - DNA, 17 bp, Homo sapiens
acttacactttatgcac

SEQ ID NO: 2220721 - DNA, 16 bp, Homo sapiens
acttactgtacatgaa

SEQ ID NO: 2220722 - DNA, 22 bp, Homo sapiens
acttactgtacatgaaaacaca

SEQ ID NO: 2220723 - DNA, 11 bp, Homo sapiens
acttcagctga

SEQ ID NO: 2220724 - DNA, 16 bp, Homo sapiens
acttcagctgactttt

SEQ ID NO: 2220725 - DNA, 18 bp, Homo sapiens
acttctccaccctgctct

SEQ ID NO: 2220726 - DNA, 18 bp, Homo sapiens
acttctgccatattctgt

SEQ ID NO: 2220727 - DNA, 19 bp, Homo sapiens
acttgaaaaaaaaaaacac

SEQ ID NO: 2220728 - DNA, 19 bp, Homo sapiens
acttgagcccagagtgaac

SEQ ID NO: 2220729 - DNA, 14 bp, Homo sapiens
acttggaagctccg

SEQ ID NO: 2220730 - DNA, 14 bp, Homo sapiens
acttgggccactgt

SEQ ID NO: 2220731 - DNA, 14 bp, Homo sapiens
acttgtctttggac

SEQ ID NO: 2220732 - DNA, 18 bp, Homo sapiens
acttgtctttggaccctg

SEQ ID NO: 2220733 - DNA, 21 bp, Homo sapiens
acttgtctttggaccctgagg

SEQ ID NO: 2220734 - DNA, 15 bp, Homo sapiens
acttgtggacacagc

SEQ ID NO: 2220735 - DNA, 16 bp, Homo sapiens
acttgtggacacagct

SEQ ID NO: 2220736 - DNA, 22 bp, Homo sapiens
acttgtggacacagctcttctc

SEQ ID NO: 2220737 - DNA, 23 bp, Homo sapiens
actttaccttttttatacataaa

SEQ ID NO: 2220738 - DNA, 16 bp, Homo sapiens
atccagtatcttgaag

SEQ ID NO: 2220739 - DNA, 19 bp, Homo sapiens
atcccaaacccttcagtgc

SEQ ID NO: 2220740 - DNA, 16 bp, Homo sapiens
atcccatatgcctggg

SEQ ID NO: 2220741 - DNA, 18 bp, Homo sapiens
atcccatgagcctcagca

SEQ ID NO: 2220742 - DNA, 19 bp, Homo sapiens
atcccatgagcctcagcat

SEQ ID NO: 2220743 - DNA, 15 bp, Homo sapiens
atcccctgtagagtg

SEQ ID NO: 2220744 - DNA, 21 bp, Homo sapiens
atccctcatcctcatacccac

SEQ ID NO: 2220745 - DNA, 23 bp, Homo sapiens
atccctcatcctcatacccaccc

SEQ ID NO: 2220746 - DNA, 18 bp, Homo sapiens
atcctcatacccaccccc

SEQ ID NO: 2220747 - DNA, 22 bp, Homo sapiens
atcctcatacccacccccaccc

SEQ ID NO: 2220748 - DNA, 11 bp, Homo sapiens
atcctcctcag

SEQ ID NO: 2220749 - DNA, 14 bp, Homo sapiens
atcctcctcagatc

SEQ ID NO: 2220750 - DNA, 16 bp, Homo sapiens
atcctctgtacagagc

SEQ ID NO: 2220751 - DNA, 17 bp, Homo sapiens
atcctctgtacagagcc

SEQ ID NO: 2220752 - DNA, 12 bp, Homo sapiens
atcctgagccag

SEQ ID NO: 2220753 - DNA, 14 bp, Homo sapiens
atcctgagccagat

SEQ ID NO: 2220754 - DNA, 15 bp, Homo sapiens
atcctggagttctgg

SEQ ID NO: 2220755 - DNA, 15 bp, Homo sapiens
atcgtgacaacactt

SEQ ID NO: 2220756 - DNA, 15 bp, Homo sapiens
atctaaatgttgaaa

SEQ ID NO: 2220757 - DNA, 20 bp, Homo sapiens
atctaatatgtaacaagcca

SEQ ID NO: 2220758 - DNA, 17 bp, Homo sapiens
atctaggaagactttgg

SEQ ID NO: 2220759 - DNA, 18 bp, Homo sapiens
atctaggaagactttgga

SEQ ID NO: 2220760 - DNA, 14 bp, Homo sapiens
atctcaaataacta

SEQ ID NO: 2220761 - DNA, 17 bp, Homo sapiens
atctcaaatttctaaat

SEQ ID NO: 2220762 - DNA, 15 bp, Homo sapiens
atctcacacatgagc

SEQ ID NO: 2220763 - DNA, 16 bp, Homo sapiens
atctcacacatgagca

SEQ ID NO: 2220764 - DNA, 16 bp, Homo sapiens
atctcagggcctggtc

SEQ ID NO: 2220765 - DNA, 13 bp, Homo sapiens
atctccaaaataa

SEQ ID NO: 2220766 - DNA, 12 bp, Homo sapiens
atctcccccagc

SEQ ID NO: 2220767 - DNA, 15 bp, Homo sapiens
atctcccccagcccc

SEQ ID NO: 2220768 - DNA, 12 bp, Homo sapiens
atctgaaaatgt

SEQ ID NO: 2220769 - DNA, 23 bp, Homo sapiens
atctgaaaatgtatgtgtaagta

SEQ ID NO: 2220770 - DNA, 17 bp, Homo sapiens
atctgggttcactgcaa

SEQ ID NO: 2220771 - DNA, 19 bp, Homo sapiens
atctgggttcactgcaacc

SEQ ID NO: 2220772 - DNA, 10 bp, Homo sapiens
atctggtgac

SEQ ID NO: 2220773 - DNA, 17 bp, Homo sapiens
atctgtcatttgagcag

SEQ ID NO: 2220774 - DNA, 19 bp, Homo sapiens
atcttccaactcaaactct

SEQ ID NO: 2220775 - DNA, 22 bp, Homo sapiens
atcttctgaacttggcgctgcc

SEQ ID NO: 2220776 - DNA, 16 bp, Homo sapiens
atcttgctctgctgac

SEQ ID NO: 2220777 - DNA, 17 bp, Homo sapiens
atcttgctctgctgaca

SEQ ID NO: 2220778 - DNA, 19 bp, Homo sapiens
atcttgctctgctgacaga

SEQ ID NO: 2220779 - DNA, 22 bp, Homo sapiens
atcttttcatttaggtgaggaa

SEQ ID NO: 2220780 - DNA, 14 bp, Homo sapiens
atgaaaaaaaaagg

SEQ ID NO: 2220781 - DNA, 16 bp, Homo sapiens
atgaaaaaaaaagggg

SEQ ID NO: 2220782 - DNA, 15 bp, Homo sapiens
atgaaaacacatttt

SEQ ID NO: 2220783 - DNA, 16 bp, Homo sapiens
atgaaaacacattttt

SEQ ID NO: 2220784 - DNA, 13 bp, Homo sapiens
atgaaagactgta

SEQ ID NO: 2220785 - DNA, 22 bp, Homo sapiens
atgaaccacatcttgctctgct

SEQ ID NO: 2220786 - DNA, 22 bp, Homo sapiens
atgacacatgcaaggtcatttt

SEQ ID NO: 2220787 - DNA, 19 bp, Homo sapiens
atgacacgaatattgctga

SEQ ID NO: 2220788 - DNA, 15 bp, Homo sapiens
atgacctttcaatag

SEQ ID NO: 2220789 - DNA, 12 bp, Homo sapiens
atgactccagaa

SEQ ID NO: 2220790 - DNA, 22 bp, Homo sapiens
atgagaaaggttgaagcaccaa

SEQ ID NO: 2220791 - DNA, 13 bp, Homo sapiens
atgagaggaaatc

SEQ ID NO: 2220792 - DNA, 15 bp, Homo sapiens
atgagaggaaatcac

SEQ ID NO: 2220793 - DNA, 16 bp, Homo sapiens
atgagaggaaatcacc

SEQ ID NO: 2220794 - DNA, 16 bp, Homo sapiens
atgagcctcagcatcc

SEQ ID NO: 2220795 - DNA, 13 bp, Homo sapiens
atgagcctggcaa

SEQ ID NO: 2220796 - DNA, 13 bp, Homo sapiens
atgaggcatttgt

SEQ ID NO: 2220797 - DNA, 14 bp, Homo sapiens
atgaggcatttgtt

SEQ ID NO: 2220798 - DNA, 21 bp, Homo sapiens
atgaggcatttgtttgaactg

SEQ ID NO: 2220799 - DNA, 23 bp, Homo sapiens
atgagtcccctgtttgtttctga

SEQ ID NO: 2220800 - DNA, 15 bp, Homo sapiens
atgataaaacacaaa

SEQ ID NO: 2220801 - DNA, 19 bp, Homo sapiens
atgatcacggctcactgca

SEQ ID NO: 2220802 - DNA, 23 bp, Homo sapiens
atgatcacggctcactgcagcct

SEQ ID NO: 2220803 - DNA, 15 bp, Homo sapiens
atgatcttctttata

SEQ ID NO: 2220804 - DNA, 18 bp, Homo sapiens
atgatctttgcagacagg

SEQ ID NO: 2220805 - DNA, 18 bp, Homo sapiens
atgatgaaatgaggtcag

SEQ ID NO: 2220806 - DNA, 15 bp, Homo sapiens
atgatgatcctaggc

SEQ ID NO: 2220807 - DNA, 16 bp, Homo sapiens
atgatgccatgaggaa

SEQ ID NO: 2220808 - DNA, 19 bp, Homo sapiens
atgattaaccacttcagct

SEQ ID NO: 2220809 - DNA, 21 bp, Homo sapiens
atgattaaccacttcagctga

SEQ ID NO: 2220810 - DNA, 16 bp, Homo sapiens
atgcaaaccatcattg

SEQ ID NO: 2220811 - DNA, 16 bp, Homo sapiens
atgcaaggtcattttt

SEQ ID NO: 2220812 - DNA, 22 bp, Homo sapiens
atgcaaggtcattttttttaag

SEQ ID NO: 2220813 - DNA, 15 bp, Homo sapiens
atgcacaaacagagg

SEQ ID NO: 2220814 - DNA, 16 bp, Homo sapiens
atgcacaaacagaggc

SEQ ID NO: 2220815 - DNA, 21 bp, Homo sapiens
atgcacagctaacatggaagt

SEQ ID NO: 2220816 - DNA, 13 bp, Homo sapiens
atgcaccagccct

SEQ ID NO: 2220817 - DNA, 13 bp, Homo sapiens
atgcacctggaat

SEQ ID NO: 2220818 - DNA, 14 bp, Homo sapiens
atgcacctggaata

SEQ ID NO: 2220819 - DNA, 16 bp, Homo sapiens
atgcactttgttctgg

SEQ ID NO: 2220820 - DNA, 23 bp, Homo sapiens
atgcactttgttctggctcttcc

SEQ ID NO: 2220821 - DNA, 17 bp, Homo sapiens
atgcagcctcacagtcc

SEQ ID NO: 2220822 - DNA, 10 bp, Homo sapiens
atgcatttga

SEQ ID NO: 2220823 - DNA, 13 bp, Homo sapiens
atgcccagcccct

SEQ ID NO: 2220824 - DNA, 17 bp, Homo sapiens
atgcctctctcaggcca

SEQ ID NO: 2220825 - DNA, 11 bp, Homo sapiens
atgcctggtgg

SEQ ID NO: 2220826 - DNA, 12 bp, Homo sapiens
atgcctggtggc

SEQ ID NO: 2220827 - DNA, 19 bp, Homo sapiens
atgcctggtggcagctgcg

SEQ ID NO: 2220828 - DNA, 21 bp, Homo sapiens
atgcctggtggcagctgcggt

SEQ ID NO: 2220829 - DNA, 19 bp, Homo sapiens
atgcgggggagcaggcagt

SEQ ID NO: 2220830 - DNA, 14 bp, Homo sapiens
atgctcctggccca

SEQ ID NO: 2220831 - DNA, 12 bp, Homo sapiens
atgctgccctgt

SEQ ID NO: 2220832 - DNA, 15 bp, Homo sapiens
atgctgccctgtgag

SEQ ID NO: 2220833 - DNA, 16 bp, Homo sapiens
atgctgccctgtgagt

SEQ ID NO: 2220834 - DNA, 13 bp, Homo sapiens
atgcttctcactg

SEQ ID NO: 2220835 - DNA, 14 bp, Homo sapiens
atgcttcttcagag

SEQ ID NO: 2220836 - DNA, 22 bp, Homo sapiens
atgcttcttcagagactcctgc

SEQ ID NO: 2220837 - DNA, 13 bp, Homo sapiens
atgcttgtacata

SEQ ID NO: 2220838 - DNA, 19 bp, Homo sapiens
atggaaatgggcagagcag

SEQ ID NO: 2220839 - DNA, 21 bp, Homo sapiens
atggaagtactataatttacc

SEQ ID NO: 2220840 - DNA, 15 bp, Homo sapiens
atggaataacatgta

SEQ ID NO: 2220841 - DNA, 19 bp, Homo sapiens
atggacatgatcttcttta

SEQ ID NO: 2220842 - DNA, 19 bp, Homo sapiens
atggacgtgttatgactcc

SEQ ID NO: 2220843 - DNA, 23 bp, Homo sapiens
atggacgtgttatgactccagaa

SEQ ID NO: 2220844 - DNA, 19 bp, Homo sapiens
atggactaacttgtctttg

SEQ ID NO: 2220845 - DNA, 21 bp, Homo sapiens
atggccgggcgcggtggctca

SEQ ID NO: 2220846 - DNA, 21 bp, Homo sapiens
atggcttggggggctccaggg

SEQ ID NO: 2220847 - DNA, 18 bp, Homo sapiens
atggcttttgtgcattat

SEQ ID NO: 2220848 - DNA, 15 bp, Homo sapiens
atgggagagaagaga

SEQ ID NO: 2220849 - DNA, 13 bp, Homo sapiens
atgggcagagcag

SEQ ID NO: 2220850 - DNA, 23 bp, Homo sapiens
atgggctgggttctacccaggtg

SEQ ID NO: 2220851 - DNA, 15 bp, Homo sapiens
atgggggtgcatttg

SEQ ID NO: 2220852 - DNA, 15 bp, Homo sapiens
atgggtgcttggagg

SEQ ID NO: 2220853 - DNA, 19 bp, Homo sapiens
atggtcaccaaatcagctg

SEQ ID NO: 2220854 - DNA, 20 bp, Homo sapiens
atggtgagggatacccatcc

SEQ ID NO: 2220855 - DNA, 17 bp, Homo sapiens
atggtgcaatgaccttt

SEQ ID NO: 2220856 - DNA, 19 bp, Homo sapiens
atggtgcaatgacctttca

SEQ ID NO: 2220857 - DNA, 15 bp, Homo sapiens
atggtggctgggttg

SEQ ID NO: 2220858 - DNA, 14 bp, Homo sapiens
atggttttcaaaat

SEQ ID NO: 2220859 - DNA, 14 bp, Homo sapiens
atggttttcttgtg

SEQ ID NO: 2220860 - DNA, 17 bp, Homo sapiens
atgtaagctctactgag

SEQ ID NO: 2220861 - DNA, 23 bp, Homo sapiens
atgtaattaagtactatgtatca

SEQ ID NO: 2220862 - DNA, 15 bp, Homo sapiens
atgtatcaatgagta

SEQ ID NO: 2220863 - DNA, 16 bp, Homo sapiens
cagaaggaagacttca

SEQ ID NO: 2220864 - DNA, 14 bp, Homo sapiens
cagaagtttctgcc

SEQ ID NO: 2220865 - DNA, 22 bp, Homo sapiens
cagaagtttctgccgcagccct

SEQ ID NO: 2220866 - DNA, 20 bp, Homo sapiens
cagaagtttgagatcagcct

SEQ ID NO: 2220867 - DNA, 23 bp, Homo sapiens
cagaagtttgagatcagcctggg

SEQ ID NO: 2220868 - DNA, 17 bp, Homo sapiens
cagaatctcaaataact

SEQ ID NO: 2220869 - DNA, 18 bp, Homo sapiens
cagaattctctagtttga

SEQ ID NO: 2220870 - DNA, 17 bp, Homo sapiens
cagaatttcccaaagca

SEQ ID NO: 2220871 - DNA, 24 bp, Homo sapiens
cagaatttcccaaagcagtgcatg

SEQ ID NO: 2220872 - DNA, 13 bp, Homo sapiens
cagacacaggccc

SEQ ID NO: 2220873 - DNA, 21 bp, Homo sapiens
cagacacaggcccggctccag

SEQ ID NO: 2220874 - DNA, 19 bp, Homo sapiens
cagacaccttgacagggca

SEQ ID NO: 2220875 - DNA, 15 bp, Homo sapiens
cagacagctgcctgg

SEQ ID NO: 2220876 - DNA, 13 bp, Homo sapiens
cagacaggaccag

SEQ ID NO: 2220877 - DNA, 24 bp, Homo sapiens
cagacaggaccagggatttccatg

SEQ ID NO: 2220878 - DNA, 19 bp, Homo sapiens
cagacccccttgcccaggc

SEQ ID NO: 2220879 - DNA, 12 bp, Homo sapiens
cagacccggctg

SEQ ID NO: 2220880 - DNA, 14 bp, Homo sapiens
cagacccggctgcg

SEQ ID NO: 2220881 - DNA, 13 bp, Homo sapiens
cagaccctgccct

SEQ ID NO: 2220882 - DNA, 14 bp, Homo sapiens
cagaccctgccctg

SEQ ID NO: 2220883 - DNA, 18 bp, Homo sapiens
cagactctacagaggcca

SEQ ID NO: 2220884 - DNA, 19 bp, Homo sapiens
cagactctacagaggccat

SEQ ID NO: 2220885 - DNA, 23 bp, Homo sapiens
cagactctacagaggccatgggc

SEQ ID NO: 2220886 - DNA, 14 bp, Homo sapiens
cagactggaagcac

SEQ ID NO: 2220887 - DNA, 19 bp, Homo sapiens
cagagaatgaaagggccca

SEQ ID NO: 2220888 - DNA, 14 bp, Homo sapiens
cagagacacaagcc

SEQ ID NO: 2220889 - DNA, 14 bp, Homo sapiens
cagagactcctgca

SEQ ID NO: 2220890 - DNA, 21 bp, Homo sapiens
cagagactcctgcaggcagcc

SEQ ID NO: 2220891 - DNA, 20 bp, Homo sapiens
cagagagagagagagagaaa

SEQ ID NO: 2220892 - DNA, 23 bp, Homo sapiens
cagagagagagagagagaaagag

SEQ ID NO: 2220893 - DNA, 13 bp, Homo sapiens
cagagagggtggg

SEQ ID NO: 2220894 - DNA, 23 bp, Homo sapiens
cagagagggtggtgacctctgcc

SEQ ID NO: 2220895 - DNA, 19 bp, Homo sapiens
cagagatgtgcccccaccc

SEQ ID NO: 2220896 - DNA, 14 bp, Homo sapiens
cagagcaagtgaga

SEQ ID NO: 2220897 - DNA, 20 bp, Homo sapiens
cagagcaagtgagaccctgt

SEQ ID NO: 2220898 - DNA, 23 bp, Homo sapiens
cagagcaccttagacagtccctg

SEQ ID NO: 2220899 - DNA, 12 bp, Homo sapiens
cagagcagagac

SEQ ID NO: 2220900 - DNA, 13 bp, Homo sapiens
cagagcagagacc

SEQ ID NO: 2220901 - DNA, 21 bp, Homo sapiens
cagagcagagaccatccctga

SEQ ID NO: 2220902 - DNA, 19 bp, Homo sapiens
cagagcccaccttggctca

SEQ ID NO: 2220903 - DNA, 14 bp, Homo sapiens
cagagcctgcagtt

SEQ ID NO: 2220904 - DNA, 16 bp, Homo sapiens
cagagctgccacctgc

SEQ ID NO: 2220905 - DNA, 20 bp, Homo sapiens
cagaggagagaggaccccct

SEQ ID NO: 2220906 - DNA, 14 bp, Homo sapiens
cagaggcagcccca

SEQ ID NO: 2220907 - DNA, 15 bp, Homo sapiens
cagaggcagccccat

SEQ ID NO: 2220908 - DNA, 19 bp, Homo sapiens
cagaggcagccccattctg

SEQ ID NO: 2220909 - DNA, 16 bp, Homo sapiens
cagaggccatgggcct

SEQ ID NO: 2220910 - DNA, 21 bp, Homo sapiens
cagaggccatgggcctcctgt

SEQ ID NO: 2220911 - DNA, 13 bp, Homo sapiens
cagaggctgcctc

SEQ ID NO: 2220912 - DNA, 23 bp, Homo sapiens
cagaggctgcctctcccatcact

SEQ ID NO: 2220913 - DNA, 16 bp, Homo sapiens
cagagggagtgacaga

SEQ ID NO: 2220914 - DNA, 18 bp, Homo sapiens
cagagggagtgacagagg

SEQ ID NO: 2220915 - DNA, 21 bp, Homo sapiens
cagagggagtgacagaggcag

SEQ ID NO: 2220916 - DNA, 22 bp, Homo sapiens
cagagggagtgacagaggcagc

SEQ ID NO: 2220917 - DNA, 23 bp, Homo sapiens
cagagggagtgacagaggcagcc

SEQ ID NO: 2220918 - DNA, 15 bp, Homo sapiens
cagagggcctgcaag

SEQ ID NO: 2220919 - DNA, 19 bp, Homo sapiens
cagagggcctgcaagggag

SEQ ID NO: 2220920 - DNA, 13 bp, Homo sapiens
cagagggggtggc

SEQ ID NO: 2220921 - DNA, 16 bp, Homo sapiens
cagagggggtggcctc

SEQ ID NO: 2220922 - DNA, 17 bp, Homo sapiens
cagagggggtggcctcc

SEQ ID NO: 2220923 - DNA, 20 bp, Homo sapiens
cagagggggtggcctcccaa

SEQ ID NO: 2220924 - DNA, 17 bp, Homo sapiens
cagagtctcactgttgc

SEQ ID NO: 2220925 - DNA, 20 bp, Homo sapiens
cagagtctcactgttgccca

SEQ ID NO: 2220926 - DNA, 21 bp, Homo sapiens
cagagtctcactgttgcccag

SEQ ID NO: 2220927 - DNA, 18 bp, Homo sapiens
cagagtgagactctgtct

SEQ ID NO: 2220928 - DNA, 19 bp, Homo sapiens
cagagtgagactctgtctc

SEQ ID NO: 2220929 - DNA, 16 bp, Homo sapiens
cagagttgaagacaga

SEQ ID NO: 2220930 - DNA, 18 bp, Homo sapiens
cagagttgaagacagagc

SEQ ID NO: 2220931 - DNA, 19 bp, Homo sapiens
cagagttgaagacagagct

SEQ ID NO: 2220932 - DNA, 22 bp, Homo sapiens
cagatacaggaaaagctgctga

SEQ ID NO: 2220933 - DNA, 23 bp, Homo sapiens
cagatacaggaaaagctgctgac

SEQ ID NO: 2220934 - DNA, 19 bp, Homo sapiens
cagatacttggggggctga

SEQ ID NO: 2220935 - DNA, 18 bp, Homo sapiens
cagatgggtgcttggagg

SEQ ID NO: 2220936 - DNA, 18 bp, Homo sapiens
cagattctttcctgaggc

SEQ ID NO: 2220937 - DNA, 20 bp, Homo sapiens
cagattctttcctgaggctg

SEQ ID NO: 2220938 - DNA, 17 bp, Homo sapiens
cagcaaggagatttaca

SEQ ID NO: 2220939 - DNA, 18 bp, Homo sapiens
cagcaaggagatttacaa

SEQ ID NO: 2220940 - DNA, 21 bp, Homo sapiens
cagcaataaagcagcgtttct

SEQ ID NO: 2220941 - DNA, 22 bp, Homo sapiens
cagcaataaagcagcgtttcta

SEQ ID NO: 2220942 - DNA, 14 bp, Homo sapiens
cagcacaggcagcc

SEQ ID NO: 2220943 - DNA, 17 bp, Homo sapiens
cagcaccatctctcctc

SEQ ID NO: 2220944 - DNA, 10 bp, Homo sapiens
cagcagagag

SEQ ID NO: 2220945 - DNA, 12 bp, Homo sapiens
cagcagcctgga

SEQ ID NO: 2220946 - DNA, 15 bp, Homo sapiens
cagcagcctggaccc

SEQ ID NO: 2220947 - DNA, 19 bp, Homo sapiens
cagcaggctctcaggccag

SEQ ID NO: 2220948 - DNA, 17 bp, Homo sapiens
cagcatattcaggaagc

SEQ ID NO: 2220949 - DNA, 22 bp, Homo sapiens
cagcatattcaggaagctcagg

SEQ ID NO: 2220950 - DNA, 14 bp, Homo sapiens
cagcatcctggcac

SEQ ID NO: 2220951 - DNA, 20 bp, Homo sapiens
cagcatcctggcacccggcc

SEQ ID NO: 2220952 - DNA, 15 bp, Homo sapiens
cagccaaagcctcct

SEQ ID NO: 2220953 - DNA, 19 bp, Homo sapiens
cagccacattcctgatgct

SEQ ID NO: 2220954 - DNA, 15 bp, Homo sapiens
cagccacggccaggc

SEQ ID NO: 2220955 - DNA, 18 bp, Homo sapiens
cagccacggccaggccag

SEQ ID NO: 2220956 - DNA, 22 bp, Homo sapiens
cagccacggccaggccagaggg

SEQ ID NO: 2220957 - DNA, 22 bp, Homo sapiens
cagccaggccacaagacccttg

SEQ ID NO: 2220958 - DNA, 18 bp, Homo sapiens
cagcccacttctgccata

SEQ ID NO: 2220959 - DNA, 20 bp, Homo sapiens
cagccccaaaactctcctct

SEQ ID NO: 2220960 - DNA, 15 bp, Homo sapiens
cagccccagtgccca

SEQ ID NO: 2220961 - DNA, 17 bp, Homo sapiens
cagccccagtgcccaca

SEQ ID NO: 2220962 - DNA, 18 bp, Homo sapiens
cagccccagtgcccacag

SEQ ID NO: 2220963 - DNA, 21 bp, Homo sapiens
cagccccatcccaaacccttc

SEQ ID NO: 2220964 - DNA, 16 bp, Homo sapiens
cagccccatcctctgt

SEQ ID NO: 2220965 - DNA, 17 bp, Homo sapiens
cagccccattctgcctg

SEQ ID NO: 2220966 - DNA, 16 bp, Homo sapiens
cagccccttctgaccc

SEQ ID NO: 2220967 - DNA, 22 bp, Homo sapiens
cagccccttctgacccatgctg

SEQ ID NO: 2220968 - DNA, 17 bp, Homo sapiens
cagcccgggctctgcct

SEQ ID NO: 2220969 - DNA, 18 bp, Homo sapiens
cagcccgggctctgcctc

SEQ ID NO: 2220970 - DNA, 19 bp, Homo sapiens
cagcccgggctctgcctcc

SEQ ID NO: 2220971 - DNA, 21 bp, Homo sapiens
cagcccgggctctgcctccca

SEQ ID NO: 2220972 - DNA, 22 bp, Homo sapiens
cagcccgggctctgcctcccat

SEQ ID NO: 2220973 - DNA, 18 bp, Homo sapiens
cagccctgcagagggcac

SEQ ID NO: 2220974 - DNA, 16 bp, Homo sapiens
cagcccttagcaggga

SEQ ID NO: 2220975 - DNA, 21 bp, Homo sapiens
cagccgtgtaaccatggaccc

SEQ ID NO: 2220976 - DNA, 19 bp, Homo sapiens
cagcctcccaaagtgctgg

SEQ ID NO: 2220977 - DNA, 21 bp, Homo sapiens
cagcctcccgaatagctggga

SEQ ID NO: 2220978 - DNA, 21 bp, Homo sapiens
cagcctcccgagtagctggga

SEQ ID NO: 2220979 - DNA, 22 bp, Homo sapiens
cagcctcccgagtagctgggac

SEQ ID NO: 2220980 - DNA, 19 bp, Homo sapiens
cagcctgctaattccccag

SEQ ID NO: 2220981 - DNA, 15 bp, Homo sapiens
cagcctgctccagct

SEQ ID NO: 2220982 - DNA, 16 bp, Homo sapiens
cagcctgctccagctg

SEQ ID NO: 2220983 - DNA, 17 bp, Homo sapiens
cagcctgctccagctgt

SEQ ID NO: 2220984 - DNA, 20 bp, Homo sapiens
cagccttgaccattctccac

SEQ ID NO: 2220985 - DNA, 21 bp, Homo sapiens
cagccttgaccattctccacc

SEQ ID NO: 2220986 - DNA, 23 bp, Homo sapiens
ccagcaggctctcaggccagctg

SEQ ID NO: 2220987 - DNA, 16 bp, Homo sapiens
ccagcccacttctgcc

SEQ ID NO: 2220988 - DNA, 13 bp, Homo sapiens
ccagcccctggat

SEQ ID NO: 2220989 - DNA, 18 bp, Homo sapiens
ccagcccctggatgcagc

SEQ ID NO: 2220990 - DNA, 10 bp, Homo sapiens
ccagcccctt

SEQ ID NO: 2220991 - DNA, 16 bp, Homo sapiens
ccagccccttctgacc

SEQ ID NO: 2220992 - DNA, 20 bp, Homo sapiens
ccagccgagatagccaaggc

SEQ ID NO: 2220993 - DNA, 22 bp, Homo sapiens
ccagccgagatagccaaggcca

SEQ ID NO: 2220994 - DNA, 13 bp, Homo sapiens
ccagcctgggtga

SEQ ID NO: 2220995 - DNA, 13 bp, Homo sapiens
ccagcgagccctg

SEQ ID NO: 2220996 - DNA, 15 bp, Homo sapiens
ccagcgagccctggt

SEQ ID NO: 2220997 - DNA, 21 bp, Homo sapiens
ccagcgagccctggtggcagt

SEQ ID NO: 2220998 - DNA, 22 bp, Homo sapiens
ccagctcaccagccccagtgcc

SEQ ID NO: 2220999 - DNA, 22 bp, Homo sapiens
ccagctctggtccatagagagc

SEQ ID NO: 2221000 - DNA, 18 bp, Homo sapiens
ccagctgcttgggcttca

SEQ ID NO: 2221001 - DNA, 23 bp, Homo sapiens
ccagctgcttgggcttcatcctc

SEQ ID NO: 2221002 - DNA, 18 bp, Homo sapiens
ccagctgtgctctggaca

SEQ ID NO: 2221003 - DNA, 17 bp, Homo sapiens
ccagctgttcagctggt

SEQ ID NO: 2221004 - DNA, 17 bp, Homo sapiens
ccaggaaaggctccagg

SEQ ID NO: 2221005 - DNA, 18 bp, Homo sapiens
ccaggaaaggctccagga

SEQ ID NO: 2221006 - DNA, 19 bp, Homo sapiens
ccaggaaaggctccaggag

SEQ ID NO: 2221007 - DNA, 12 bp, Homo sapiens
ccaggaagccag

SEQ ID NO: 2221008 - DNA, 13 bp, Homo sapiens
ccaggaagccagc

SEQ ID NO: 2221009 - DNA, 14 bp, Homo sapiens
ccaggaagccagca

SEQ ID NO: 2221010 - DNA, 12 bp, Homo sapiens
ccaggagcagcc

SEQ ID NO: 2221011 - DNA, 14 bp, Homo sapiens
ccaggagcagccac

SEQ ID NO: 2221012 - DNA, 15 bp, Homo sapiens
ccaggagcagccaca

SEQ ID NO: 2221013 - DNA, 13 bp, Homo sapiens
ccaggagcctcct

SEQ ID NO: 2221014 - DNA, 14 bp, Homo sapiens
ccaggagcctcctg

SEQ ID NO: 2221015 - DNA, 12 bp, Homo sapiens
ccaggaggccag

SEQ ID NO: 2221016 - DNA, 13 bp, Homo sapiens
ccaggaggccagc

SEQ ID NO: 2221017 - DNA, 14 bp, Homo sapiens
ccaggcattcccca

SEQ ID NO: 2221018 - DNA, 17 bp, Homo sapiens
ccaggcattccccagga

SEQ ID NO: 2221019 - DNA, 18 bp, Homo sapiens
ccaggcattccccaggag

SEQ ID NO: 2221020 - DNA, 21 bp, Homo sapiens
ccaggcattccccaggaggcc

SEQ ID NO: 2221021 - DNA, 12 bp, Homo sapiens
ccaggccagagg

SEQ ID NO: 2221022 - DNA, 13 bp, Homo sapiens
ccaggcccctgcc

SEQ ID NO: 2221023 - DNA, 21 bp, Homo sapiens
ccaggcccctgccaccctggg

SEQ ID NO: 2221024 - DNA, 13 bp, Homo sapiens
ccaggccctctgc

SEQ ID NO: 2221025 - DNA, 18 bp, Homo sapiens
ccaggccctctgcccact

SEQ ID NO: 2221026 - DNA, 20 bp, Homo sapiens
ccaggccctctgcccactcc

SEQ ID NO: 2221027 - DNA, 21 bp, Homo sapiens
ccaggccctctgcccactccc

SEQ ID NO: 2221028 - DNA, 14 bp, Homo sapiens
ccaggctgggagag

SEQ ID NO: 2221029 - DNA, 22 bp, Homo sapiens
ccaggctgggagagccttccag

SEQ ID NO: 2221030 - DNA, 20 bp, Homo sapiens
ccaggctgtatcccatgagc

SEQ ID NO: 2221031 - DNA, 17 bp, Homo sapiens
ccaggcttagtcactga

SEQ ID NO: 2221032 - DNA, 21 bp, Homo sapiens
ccaggcttagtcactgagaca

SEQ ID NO: 2221033 - DNA, 23 bp, Homo sapiens
ccagggacagagggggtggcctc

SEQ ID NO: 2221034 - DNA, 21 bp, Homo sapiens
ccaggggaaaatcagcctgct

SEQ ID NO: 2221035 - DNA, 18 bp, Homo sapiens
ccagggggtgccctccca

SEQ ID NO: 2221036 - DNA, 19 bp, Homo sapiens
ccaggggtgggacaccctg

SEQ ID NO: 2221037 - DNA, 20 bp, Homo sapiens
ccaggggtgggacaccctgt

SEQ ID NO: 2221038 - DNA, 24 bp, Homo sapiens
ccaggtgcacaagctccaagctcc

SEQ ID NO: 2221039 - DNA, 19 bp, Homo sapiens
ccaggtgctaggaacactc

SEQ ID NO: 2221040 - DNA, 16 bp, Homo sapiens
ccaggtttctatgtgt

SEQ ID NO: 2221041 - DNA, 20 bp, Homo sapiens
ccagtaaatgggggtgcatt

SEQ ID NO: 2221042 - DNA, 13 bp, Homo sapiens
ccagtatcttgaa

SEQ ID NO: 2221043 - DNA, 16 bp, Homo sapiens
ccagtcaccccggcca

SEQ ID NO: 2221044 - DNA, 18 bp, Homo sapiens
ccagtcaccccggccacc

SEQ ID NO: 2221045 - DNA, 19 bp, Homo sapiens
ccagtgaggctctgccctt

SEQ ID NO: 2221046 - DNA, 23 bp, Homo sapiens
ccagtgtgacaaggattgctact

SEQ ID NO: 2221047 - DNA, 17 bp, Homo sapiens
ccagttgggtggatgcc

SEQ ID NO: 2221048 - DNA, 20 bp, Homo sapiens
ccagttgggtggatgcctgg

SEQ ID NO: 2221049 - DNA, 23 bp, Homo sapiens
ccagttgggtggatgcctggtgg

SEQ ID NO: 2221050 - DNA, 13 bp, Homo sapiens
ccagttggtcccc

SEQ ID NO: 2221051 - DNA, 23 bp, Homo sapiens
ccagttggtcccccttccatgga

SEQ ID NO: 2221052 - DNA, 19 bp, Homo sapiens
ccatattaccacagacata

SEQ ID NO: 2221053 - DNA, 18 bp, Homo sapiens
ccatattctgttggccag

SEQ ID NO: 2221054 - DNA, 14 bp, Homo sapiens
ccatcaagccacca

SEQ ID NO: 2221055 - DNA, 13 bp, Homo sapiens
ccatcatgtctgg

SEQ ID NO: 2221056 - DNA, 14 bp, Homo sapiens
ccatcatgtctggc

SEQ ID NO: 2221057 - DNA, 22 bp, Homo sapiens
ccatcattgaaatctttttgct

SEQ ID NO: 2221058 - DNA, 15 bp, Homo sapiens
ccatcccagccccaa

SEQ ID NO: 2221059 - DNA, 22 bp, Homo sapiens
ccatcccctgtagagtgggagc

SEQ ID NO: 2221060 - DNA, 23 bp, Homo sapiens
ccatcctcctgcccccaccccag

SEQ ID NO: 2221061 - DNA, 20 bp, Homo sapiens
ccatctcacacatgagcatc

SEQ ID NO: 2221062 - DNA, 21 bp, Homo sapiens
ccatgagcctcagcatcctgg

SEQ ID NO: 2221063 - DNA, 23 bp, Homo sapiens
ccatgagcctcagcatcctggca

SEQ ID NO: 2221064 - DNA, 16 bp, Homo sapiens
ccatgaggaacaaggc

SEQ ID NO: 2221065 - DNA, 20 bp, Homo sapiens
ccatgaggaacaaggcaagg

SEQ ID NO: 2221066 - DNA, 13 bp, Homo sapiens
ccatgagtcccct

SEQ ID NO: 2221067 - DNA, 14 bp, Homo sapiens
ccatgagtcccctg

SEQ ID NO: 2221068 - DNA, 16 bp, Homo sapiens
ccatgagtcccctgtt

SEQ ID NO: 2221069 - DNA, 18 bp, Homo sapiens
ccatgatgttttccatga

SEQ ID NO: 2221070 - DNA, 21 bp, Homo sapiens
ccatgattaaccacttcagct

SEQ ID NO: 2221071 - DNA, 13 bp, Homo sapiens
ccatgctcctggc

SEQ ID NO: 2221072 - DNA, 16 bp, Homo sapiens
ccatgctgccctgtga

SEQ ID NO: 2221073 - DNA, 17 bp, Homo sapiens
ccatgctgccctgtgag

SEQ ID NO: 2221074 - DNA, 15 bp, Homo sapiens
ccatgggcctcctgt

SEQ ID NO: 2221075 - DNA, 13 bp, Homo sapiens
ccatgtgccaggt

SEQ ID NO: 2221076 - DNA, 14 bp, Homo sapiens
ccatgttggccagg

SEQ ID NO: 2221077 - DNA, 21 bp, Homo sapiens
ccatgttggccaggctggtct

SEQ ID NO: 2221078 - DNA, 15 bp, Homo sapiens
ccattctccacctgc

SEQ ID NO: 2221079 - DNA, 16 bp, Homo sapiens
ccattctccacctgcc

SEQ ID NO: 2221080 - DNA, 17 bp, Homo sapiens
ccattctccacctgcca

SEQ ID NO: 2221081 - DNA, 16 bp, Homo sapiens
ccattctgcctgccca

SEQ ID NO: 2221082 - DNA, 17 bp, Homo sapiens
ccattctgcctgcccag

SEQ ID NO: 2221083 - DNA, 18 bp, Homo sapiens
ccattctgcctgcccagg

SEQ ID NO: 2221084 - DNA, 20 bp, Homo sapiens
ccattctgcctgcccaggcc

SEQ ID NO: 2221085 - DNA, 14 bp, Homo sapiens
ccatttgtgtttat

SEQ ID NO: 2221086 - DNA, 18 bp, Homo sapiens
cccaaaactctcctctgc

SEQ ID NO: 2221087 - DNA, 15 bp, Homo sapiens
cccaaagatgcagcc

SEQ ID NO: 2221088 - DNA, 16 bp, Homo sapiens
cccaaagtgctgggat

SEQ ID NO: 2221089 - DNA, 15 bp, Homo sapiens
cccaactcaccccag

SEQ ID NO: 2221090 - DNA, 20 bp, Homo sapiens
cccaactcaccccagcccca

SEQ ID NO: 2221091 - DNA, 17 bp, Homo sapiens
cccaagagagacagcac

SEQ ID NO: 2221092 - DNA, 21 bp, Homo sapiens
cccaagagagacagcacaggc

SEQ ID NO: 2221093 - DNA, 14 bp, Homo sapiens
cccaagctctgctc

SEQ ID NO: 2221094 - DNA, 14 bp, Homo sapiens
cccaagggcctggc

SEQ ID NO: 2221095 - DNA, 16 bp, Homo sapiens
cccaagggcctggcct

SEQ ID NO: 2221096 - DNA, 17 bp, Homo sapiens
cccaagggcctggcctg

SEQ ID NO: 2221097 - DNA, 17 bp, Homo sapiens
cccacaggatcagtctg

SEQ ID NO: 2221098 - DNA, 18 bp, Homo sapiens
cccaccatcatgtctggc

SEQ ID NO: 2221099 - DNA, 12 bp, Homo sapiens
cccacccccacc

SEQ ID NO: 2221100 - DNA, 17 bp, Homo sapiens
cccacccccacccaagg

SEQ ID NO: 2221101 - DNA, 12 bp, Homo sapiens
cccacctcagcc

SEQ ID NO: 2221102 - DNA, 17 bp, Homo sapiens
cccacctcagcctcccg

SEQ ID NO: 2221103 - DNA, 22 bp, Homo sapiens
cccacctctctcactccttgaa

SEQ ID NO: 2221104 - DNA, 12 bp, Homo sapiens
cccaccttggct

SEQ ID NO: 2221105 - DNA, 22 bp, Homo sapiens
cccaccttggctcaagtcctct

SEQ ID NO: 2221106 - DNA, 17 bp, Homo sapiens
cccaccttggctgcagg

SEQ ID NO: 2221107 - DNA, 15 bp, Homo sapiens
cccacgcccccactg

SEQ ID NO: 2221108 - DNA, 14 bp, Homo sapiens
cccacgctggagtg

SEQ ID NO: 2221109 - DNA, 13 bp, Homo sapiens
cccactccctgca

SEQ ID NO: 2221110 - DNA, 14 bp, Homo sapiens
cgaggacagggagg

SEQ ID NO: 2221111 - DNA, 14 bp, Homo sapiens
cgagggccccacgt

SEQ ID NO: 2221112 - DNA, 20 bp, Homo sapiens
cgatttctgtttagataata

SEQ ID NO: 2221113 - DNA, 15 bp, Homo sapiens
cgcagacaggaccag

SEQ ID NO: 2221114 - DNA, 18 bp, Homo sapiens
cgcagccctgcagagggc

SEQ ID NO: 2221115 - DNA, 23 bp, Homo sapiens
cgccaaggctgggggaagaagct

SEQ ID NO: 2221116 - DNA, 17 bp, Homo sapiens
cgccagattctttcctg

SEQ ID NO: 2221117 - DNA, 17 bp, Homo sapiens
cgccatcccagccccaa

SEQ ID NO: 2221118 - DNA, 15 bp, Homo sapiens
cgccatgctcctggc

SEQ ID NO: 2221119 - DNA, 12 bp, Homo sapiens
cgcccagtctgg

SEQ ID NO: 2221120 - DNA, 13 bp, Homo sapiens
cgcccagtctgga

SEQ ID NO: 2221121 - DNA, 21 bp, Homo sapiens
cgcccagtctggaatgcagtg

SEQ ID NO: 2221122 - DNA, 22 bp, Homo sapiens
cgcccagttgggtggatgcctg

SEQ ID NO: 2221123 - DNA, 13 bp, Homo sapiens
cgcctgccctccc

SEQ ID NO: 2221124 - DNA, 18 bp, Homo sapiens
cgcctgccctcccacccc

SEQ ID NO: 2221125 - DNA, 19 bp, Homo sapiens
cgcctgccctcccaccccc

SEQ ID NO: 2221126 - DNA, 19 bp, Homo sapiens
cgcgtgcacacaccagagc

SEQ ID NO: 2221127 - DNA, 14 bp, Homo sapiens
cgctaagagggagg

SEQ ID NO: 2221128 - DNA, 21 bp, Homo sapiens
cgctaagagggagggagggct

SEQ ID NO: 2221129 - DNA, 16 bp, Homo sapiens
cgctacccgggaaggg

SEQ ID NO: 2221130 - DNA, 13 bp, Homo sapiens
cgctcctgtgtct

SEQ ID NO: 2221131 - DNA, 18 bp, Homo sapiens
cgctggagtgcagtgagc

SEQ ID NO: 2221132 - DNA, 22 bp, Homo sapiens
cgctgtcagccattcctgttcc

SEQ ID NO: 2221133 - DNA, 21 bp, Homo sapiens
cgctgtgctgccctgcccacc

SEQ ID NO: 2221134 - DNA, 16 bp, Homo sapiens
cgctttctacccagcg

SEQ ID NO: 2221135 - DNA, 15 bp, Homo sapiens
cggaaaacatgctac

SEQ ID NO: 2221136 - DNA, 13 bp, Homo sapiens
cggaagagccttg

SEQ ID NO: 2221137 - DNA, 14 bp, Homo sapiens
cggaatagttggct

SEQ ID NO: 2221138 - DNA, 16 bp, Homo sapiens
cggacagccacggcca

SEQ ID NO: 2221139 - DNA, 17 bp, Homo sapiens
cggagaaaggaagggct

SEQ ID NO: 2221140 - DNA, 17 bp, Homo sapiens
cggagacggagtcccac

SEQ ID NO: 2221141 - DNA, 20 bp, Homo sapiens
cggagacggagtcccacctt

SEQ ID NO: 2221142 - DNA, 18 bp, Homo sapiens
cggagtcccaccttggct

SEQ ID NO: 2221143 - DNA, 16 bp, Homo sapiens
cggccacctgcggtgc

SEQ ID NO: 2221144 - DNA, 17 bp, Homo sapiens
cggccacctgcggtgct

SEQ ID NO: 2221145 - DNA, 11 bp, Homo sapiens
cggccaggcca

SEQ ID NO: 2221146 - DNA, 13 bp, Homo sapiens
cggcccctgctgg

SEQ ID NO: 2221147 - DNA, 18 bp, Homo sapiens
cggcccctgctggttcag

SEQ ID NO: 2221148 - DNA, 13 bp, Homo sapiens
cggctaaaaagaa

SEQ ID NO: 2221149 - DNA, 14 bp, Homo sapiens
cggctaaaaagaat

SEQ ID NO: 2221150 - DNA, 21 bp, Homo sapiens
cggctaaaaagaatgcagaga

SEQ ID NO: 2221151 - DNA, 14 bp, Homo sapiens
cggctcactgcagc

SEQ ID NO: 2221152 - DNA, 17 bp, Homo sapiens
cggctcactgcagcctc

SEQ ID NO: 2221153 - DNA, 16 bp, Homo sapiens
cggctccaggctcctt

SEQ ID NO: 2221154 - DNA, 13 bp, Homo sapiens
cggctggcctggc

SEQ ID NO: 2221155 - DNA, 12 bp, Homo sapiens
cgggcatgacac

SEQ ID NO: 2221156 - DNA, 15 bp, Homo sapiens
cgggcatgacacgaa

SEQ ID NO: 2221157 - DNA, 14 bp, Homo sapiens
cgggccacagagaa

SEQ ID NO: 2221158 - DNA, 14 bp, Homo sapiens
cgggggagcaggca

SEQ ID NO: 2221159 - DNA, 16 bp, Homo sapiens
cgggggagcaggcagt

SEQ ID NO: 2221160 - DNA, 15 bp, Homo sapiens
cggtccacccaggag

SEQ ID NO: 2221161 - DNA, 22 bp, Homo sapiens
cggtgctatctcccccagcccc

SEQ ID NO: 2221162 - DNA, 23 bp, Homo sapiens
cggtgctatctcccccagcccca

SEQ ID NO: 2221163 - DNA, 13 bp, Homo sapiens
cggtgtggagaag

SEQ ID NO: 2221164 - DNA, 11 bp, Homo sapiens
cgtcccctgtc

SEQ ID NO: 2221165 - DNA, 23 bp, Homo sapiens
cgtccctgcggaagccacagggt

SEQ ID NO: 2221166 - DNA, 20 bp, Homo sapiens
cgtctgacaggcaatgctgg

SEQ ID NO: 2221167 - DNA, 21 bp, Homo sapiens
cgtctgacaggcaatgctggc

SEQ ID NO: 2221168 - DNA, 12 bp, Homo sapiens
cgtgacaacact

SEQ ID NO: 2221169 - DNA, 14 bp, Homo sapiens
cgtgagccactgca

SEQ ID NO: 2221170 - DNA, 15 bp, Homo sapiens
cgtgagccactgcac

SEQ ID NO: 2221171 - DNA, 14 bp, Homo sapiens
cgtgaggccagaga

SEQ ID NO: 2221172 - DNA, 19 bp, Homo sapiens
cgtgagtcctggcatggga

SEQ ID NO: 2221173 - DNA, 16 bp, Homo sapiens
cgtgcacacaccagag

SEQ ID NO: 2221174 - DNA, 18 bp, Homo sapiens
cgtgcacacaccagagcc

SEQ ID NO: 2221175 - DNA, 14 bp, Homo sapiens
cgtgcataccactt

SEQ ID NO: 2221176 - DNA, 19 bp, Homo sapiens
cgtgcataccacttttgtt

SEQ ID NO: 2221177 - DNA, 23 bp, Homo sapiens
cgtgcataccacttttgttcttg

SEQ ID NO: 2221178 - DNA, 20 bp, Homo sapiens
cgtgtaaccatggacccaat

SEQ ID NO: 2221179 - DNA, 11 bp, Homo sapiens
ctaaagctgcc

SEQ ID NO: 2221180 - DNA, 19 bp, Homo sapiens
ctaaagtgtatttttttac

SEQ ID NO: 2221181 - DNA, 15 bp, Homo sapiens
ctaaatggaaccact

SEQ ID NO: 2221182 - DNA, 16 bp, Homo sapiens
ctaaatgttgaaagat

SEQ ID NO: 2221183 - DNA, 16 bp, Homo sapiens
ctaaccagcagaaatg

SEQ ID NO: 2221184 - DNA, 21 bp, Homo sapiens
ctaagctattcagtaataact

SEQ ID NO: 2221185 - DNA, 15 bp, Homo sapiens
ctaaggtgtgctctg

SEQ ID NO: 2221186 - DNA, 16 bp, Homo sapiens
ctaaggtgtgctctga

SEQ ID NO: 2221187 - DNA, 18 bp, Homo sapiens
ctaagtgaggatgaaaaa

SEQ ID NO: 2221188 - DNA, 19 bp, Homo sapiens
ctaatagacaatttattat

SEQ ID NO: 2221189 - DNA, 16 bp, Homo sapiens
ctaatgtactgcatat

SEQ ID NO: 2221190 - DNA, 18 bp, Homo sapiens
ctacactgtgctgagtct

SEQ ID NO: 2221191 - DNA, 17 bp, Homo sapiens
ctacagaggccatgggc

SEQ ID NO: 2221192 - DNA, 20 bp, Homo sapiens
ctacagaggccatgggcctc

SEQ ID NO: 2221193 - DNA, 13 bp, Homo sapiens
ctacagtcctccc

SEQ ID NO: 2221194 - DNA, 16 bp, Homo sapiens
ctacagtcctcccatc

SEQ ID NO: 2221195 - DNA, 17 bp, Homo sapiens
ctacagtcctcccatct

SEQ ID NO: 2221196 - DNA, 20 bp, Homo sapiens
ctacagtcctcccatctcac

SEQ ID NO: 2221197 - DNA, 19 bp, Homo sapiens
ctacagttgaaaaacagct

SEQ ID NO: 2221198 - DNA, 20 bp, Homo sapiens
ctacatggagtatatgtcaa

SEQ ID NO: 2221199 - DNA, 20 bp, Homo sapiens
ctacccagcgagccctggtg

SEQ ID NO: 2221200 - DNA, 13 bp, Homo sapiens
ctacccaggtgct

SEQ ID NO: 2221201 - DNA, 12 bp, Homo sapiens
ctactctgtgtc

SEQ ID NO: 2221202 - DNA, 14 bp, Homo sapiens
ctactgaggtgcta

SEQ ID NO: 2221203 - DNA, 19 bp, Homo sapiens
ctagaaattccccaccctg

SEQ ID NO: 2221204 - DNA, 17 bp, Homo sapiens
ctagagtgaacttgggc

SEQ ID NO: 2221205 - DNA, 23 bp, Homo sapiens
ctagcagcagggagggcttctgc

SEQ ID NO: 2221206 - DNA, 19 bp, Homo sapiens
ctagcatacgtacacattt

SEQ ID NO: 2221207 - DNA, 19 bp, Homo sapiens
ctagccagaggagagagga

SEQ ID NO: 2221208 - DNA, 19 bp, Homo sapiens
ctagcctgtgcctctggga

SEQ ID NO: 2221209 - DNA, 22 bp, Homo sapiens
ctagccttagaagtcacacagt

SEQ ID NO: 2221210 - DNA, 13 bp, Homo sapiens
ctaggaacactcc

SEQ ID NO: 2221211 - DNA, 15 bp, Homo sapiens
ctaggaacactcctt

SEQ ID NO: 2221212 - DNA, 20 bp, Homo sapiens
ctaggaacactccttcacag

SEQ ID NO: 2221213 - DNA, 19 bp, Homo sapiens
ctaggcctggccagatgca

SEQ ID NO: 2221214 - DNA, 13 bp, Homo sapiens
ctaggcctgggga

SEQ ID NO: 2221215 - DNA, 19 bp, Homo sapiens
ctagggaaaaaccagcgtg

SEQ ID NO: 2221216 - DNA, 18 bp, Homo sapiens
ctaggtgacagagtgaga

SEQ ID NO: 2221217 - DNA, 21 bp, Homo sapiens
ctaggtggggcctggggtagg

SEQ ID NO: 2221218 - DNA, 23 bp, Homo sapiens
ctagtgtggtgtttcctggcact

SEQ ID NO: 2221219 - DNA, 14 bp, Homo sapiens
ctagttccaccatc

SEQ ID NO: 2221220 - DNA, 22 bp, Homo sapiens
ctagttccaccatcaagccacc

SEQ ID NO: 2221221 - DNA, 13 bp, Homo sapiens
ctagtttgattaa

SEQ ID NO: 2221222 - DNA, 15 bp, Homo sapiens
ctagtttgattaaat

SEQ ID NO: 2221223 - DNA, 20 bp, Homo sapiens
ctagtttgattaaattcttg

SEQ ID NO: 2221224 - DNA, 22 bp, Homo sapiens
ctagtttgattaaattcttgca

SEQ ID NO: 2221225 - DNA, 19 bp, Homo sapiens
ctatagcctaggtgacaga

SEQ ID NO: 2221226 - DNA, 20 bp, Homo sapiens
ctatcaagtattataccttt

SEQ ID NO: 2221227 - DNA, 16 bp, Homo sapiens
ctatctcccccagccc

SEQ ID NO: 2221228 - DNA, 18 bp, Homo sapiens
ctatctcccccagcccca

SEQ ID NO: 2221229 - DNA, 16 bp, Homo sapiens
ctatgttgcccaggca

SEQ ID NO: 2221230 - DNA, 15 bp, Homo sapiens
ctattagagaagaga

SEQ ID NO: 2221231 - DNA, 17 bp, Homo sapiens
ctcaaaaaaagaaaaag

SEQ ID NO: 2221232 - DNA, 15 bp, Homo sapiens
ctcaacctcctgggc

SEQ ID NO: 2221233 - DNA, 16 bp, Homo sapiens
ctcaactctcctccag

SEQ ID NO: 2221234 - DNA, 18 bp, Homo sapiens
ctcaactctcctccagag

SEQ ID NO: 2221235 - DNA, 15 bp, Homo sapiens
ctgctgggtgtggcg

SEQ ID NO: 2221236 - DNA, 15 bp, Homo sapiens
ctgcttaacttcaca

SEQ ID NO: 2221237 - DNA, 20 bp, Homo sapiens
ctgcttaacttcacatattg

SEQ ID NO: 2221238 - DNA, 19 bp, Homo sapiens
ctgcttcaaatatttccct

SEQ ID NO: 2221239 - DNA, 12 bp, Homo sapiens
ctgcttcaagga

SEQ ID NO: 2221240 - DNA, 19 bp, Homo sapiens
ctgcttcaaggatcctgag

SEQ ID NO: 2221241 - DNA, 21 bp, Homo sapiens
ctgcttcaaggatcctgagcc

SEQ ID NO: 2221242 - DNA, 23 bp, Homo sapiens
ctgcttcagcctcccgagtagct

SEQ ID NO: 2221243 - DNA, 19 bp, Homo sapiens
ctgcttccagtgaggctct

SEQ ID NO: 2221244 - DNA, 20 bp, Homo sapiens
ctgcttccagtgaggctctg

SEQ ID NO: 2221245 - DNA, 13 bp, Homo sapiens
ctgcttgggcttc

SEQ ID NO: 2221246 - DNA, 19 bp, Homo sapiens
ctgcttgggcttcatcctc

SEQ ID NO: 2221247 - DNA, 19 bp, Homo sapiens
ctgcttgtgaaaggaaaga

SEQ ID NO: 2221248 - DNA, 15 bp, Homo sapiens
ctgcttttggtctgt

SEQ ID NO: 2221249 - DNA, 19 bp, Homo sapiens
ctgctttttaaagaatgct

SEQ ID NO: 2221250 - DNA, 16 bp, Homo sapiens
ctggaaatattaagaa

SEQ ID NO: 2221251 - DNA, 18 bp, Homo sapiens
ctggaagcacagcttcat

SEQ ID NO: 2221252 - DNA, 11 bp, Homo sapiens
ctggaagcaga

SEQ ID NO: 2221253 - DNA, 12 bp, Homo sapiens
ctggaagcagaa

SEQ ID NO: 2221254 - DNA, 16 bp, Homo sapiens
ctggaagcagaaacaa

SEQ ID NO: 2221255 - DNA, 14 bp, Homo sapiens
ctggagaaaatgga

SEQ ID NO: 2221256 - DNA, 21 bp, Homo sapiens
ctggagaaaatggacgtgtta

SEQ ID NO: 2221257 - DNA, 17 bp, Homo sapiens
ctggagtgcagtgagcc

SEQ ID NO: 2221258 - DNA, 20 bp, Homo sapiens
ctggagtgcagtgagccgag

SEQ ID NO: 2221259 - DNA, 16 bp, Homo sapiens
ctggagttctggttcc

SEQ ID NO: 2221260 - DNA, 17 bp, Homo sapiens
ctggagttctggttcct

SEQ ID NO: 2221261 - DNA, 18 bp, Homo sapiens
ctggatgcagcctcacag

SEQ ID NO: 2221262 - DNA, 16 bp, Homo sapiens
ctggatggggctgcac

SEQ ID NO: 2221263 - DNA, 23 bp, Homo sapiens
ctggattaaacttaatctaaatg

SEQ ID NO: 2221264 - DNA, 19 bp, Homo sapiens
ctggcacccggcccctgct

SEQ ID NO: 2221265 - DNA, 20 bp, Homo sapiens
ctggcacccggcccctgctg

SEQ ID NO: 2221266 - DNA, 22 bp, Homo sapiens
ctggcactataatgtaagctct

SEQ ID NO: 2221267 - DNA, 14 bp, Homo sapiens
ctggcactgcttcc

SEQ ID NO: 2221268 - DNA, 23 bp, Homo sapiens
ctggcactgcttccagtgaggct

SEQ ID NO: 2221269 - DNA, 22 bp, Homo sapiens
ctggcagagttgaagacagagc

SEQ ID NO: 2221270 - DNA, 13 bp, Homo sapiens
ctggcagcccctg

SEQ ID NO: 2221271 - DNA, 13 bp, Homo sapiens
ctggcagctcaga

SEQ ID NO: 2221272 - DNA, 19 bp, Homo sapiens
ctggcagctcagagagggt

SEQ ID NO: 2221273 - DNA, 22 bp, Homo sapiens
ctggcatgggaatgaatgtcag

SEQ ID NO: 2221274 - DNA, 16 bp, Homo sapiens
ctggccagatgcacca

SEQ ID NO: 2221275 - DNA, 19 bp, Homo sapiens
ctggccagatgcaccagcc

SEQ ID NO: 2221276 - DNA, 22 bp, Homo sapiens
ctggccagatgcaccagccctt

SEQ ID NO: 2221277 - DNA, 12 bp, Homo sapiens
ctggcccactgc

SEQ ID NO: 2221278 - DNA, 18 bp, Homo sapiens
ctggcccctcagggtccc

SEQ ID NO: 2221279 - DNA, 16 bp, Homo sapiens
cttttggtctgtgtga

SEQ ID NO: 2221280 - DNA, 12 bp, Homo sapiens
cttttgtgcatt

SEQ ID NO: 2221281 - DNA, 13 bp, Homo sapiens
cttttgtgcatta

SEQ ID NO: 2221282 - DNA, 14 bp, Homo sapiens
cttttgtgcattat

SEQ ID NO: 2221283 - DNA, 15 bp, Homo sapiens
cttttttatacataa

SEQ ID NO: 2221284 - DNA, 16 bp, Homo sapiens
cttttttatacataaa

SEQ ID NO: 2221285 - DNA, 14 bp, Homo sapiens
cttttttggctgct

SEQ ID NO: 2221286 - DNA, 15 bp, Homo sapiens
cttttttggctgctg

SEQ ID NO: 2221287 - DNA, 21 bp, Homo sapiens
ctttttttttttttttgacaa

SEQ ID NO: 2221288 - DNA, 14 bp, Homo sapiens
gaaaaaaaaaaaca

SEQ ID NO: 2221289 - DNA, 19 bp, Homo sapiens
gaaaaaatattttcctgcc

SEQ ID NO: 2221290 - DNA, 11 bp, Homo sapiens
gaaaaagaaaa

SEQ ID NO: 2221291 - DNA, 15 bp, Homo sapiens
gaaaaaggaggaaga

SEQ ID NO: 2221292 - DNA, 16 bp, Homo sapiens
gaaaaatgagcctggc

SEQ ID NO: 2221293 - DNA, 13 bp, Homo sapiens
gaaaacacatttt

SEQ ID NO: 2221294 - DNA, 18 bp, Homo sapiens
gaaaacacatttttctta

SEQ ID NO: 2221295 - DNA, 21 bp, Homo sapiens
gaaaacactgttctctgccct

SEQ ID NO: 2221296 - DNA, 22 bp, Homo sapiens
gaaaacactgttctctgccctc

SEQ ID NO: 2221297 - DNA, 24 bp, Homo sapiens
gaaaacactgttctctgccctcca

SEQ ID NO: 2221298 - DNA, 18 bp, Homo sapiens
gaaaacatgctacacact

SEQ ID NO: 2221299 - DNA, 18 bp, Homo sapiens
gaaaacgtggctgcttca

SEQ ID NO: 2221300 - DNA, 18 bp, Homo sapiens
gaaaagaaaaatgagcct

SEQ ID NO: 2221301 - DNA, 19 bp, Homo sapiens
gaaaagctgctgacagtgt

SEQ ID NO: 2221302 - DNA, 22 bp, Homo sapiens
gaaacaaaatgaaaaaaaaagg

SEQ ID NO: 2221303 - DNA, 13 bp, Homo sapiens
gaaacccagctct

SEQ ID NO: 2221304 - DNA, 14 bp, Homo sapiens
gaaacccagctctg

SEQ ID NO: 2221305 - DNA, 19 bp, Homo sapiens
gaaacccagctctggtcca

SEQ ID NO: 2221306 - DNA, 23 bp, Homo sapiens
gaaacccagctctggtccataga

SEQ ID NO: 2221307 - DNA, 13 bp, Homo sapiens
gaaactggattaa

SEQ ID NO: 2221308 - DNA, 20 bp, Homo sapiens
gaaagactatctaaatgttg

SEQ ID NO: 2221309 - DNA, 17 bp, Homo sapiens
gaaagactgtacaaagt

SEQ ID NO: 2221310 - DNA, 16 bp, Homo sapiens
gaaagatcaaaaggtt

SEQ ID NO: 2221311 - DNA, 17 bp, Homo sapiens
gaaagccctgagctttc

SEQ ID NO: 2221312 - DNA, 11 bp, Homo sapiens
gaaaggaaaga

SEQ ID NO: 2221313 - DNA, 16 bp, Homo sapiens
gaaaggaaagaggctc

SEQ ID NO: 2221314 - DNA, 13 bp, Homo sapiens
gaaaggctccagg

SEQ ID NO: 2221315 - DNA, 17 bp, Homo sapiens
gaaaggctccaggagca

SEQ ID NO: 2221316 - DNA, 21 bp, Homo sapiens
gaaaggctccaggagcagcca

SEQ ID NO: 2221317 - DNA, 15 bp, Homo sapiens
gaaagggcccagaga

SEQ ID NO: 2221318 - DNA, 21 bp, Homo sapiens
gaaatatctgaaaatgtatgt

SEQ ID NO: 2221319 - DNA, 19 bp, Homo sapiens
gaaatcaccgaaaacgtgg

SEQ ID NO: 2221320 - DNA, 18 bp, Homo sapiens
gaaatgaggtcagagcct

SEQ ID NO: 2221321 - DNA, 15 bp, Homo sapiens
gaaatgggcagagca

SEQ ID NO: 2221322 - DNA, 16 bp, Homo sapiens
gaaatgggcagagcag

SEQ ID NO: 2221323 - DNA, 17 bp, Homo sapiens
gaaatgtacagcaagga

SEQ ID NO: 2221324 - DNA, 19 bp, Homo sapiens
gaaatttttattaaattat

SEQ ID NO: 2221325 - DNA, 14 bp, Homo sapiens
gaacaaggcaaggc

SEQ ID NO: 2221326 - DNA, 18 bp, Homo sapiens
gaacaaggcaaggctgtc

SEQ ID NO: 2221327 - DNA, 21 bp, Homo sapiens
gaacaaggcaaggctgtcaat

SEQ ID NO: 2221328 - DNA, 15 bp, Homo sapiens
gaacactccttcaca

SEQ ID NO: 2221329 - DNA, 15 bp, Homo sapiens
gaacagactggaagc

SEQ ID NO: 2221330 - DNA, 18 bp, Homo sapiens
gaaccacatcttgctctg

SEQ ID NO: 2221331 - DNA, 21 bp, Homo sapiens
gaaccacatcttgctctgctg

SEQ ID NO: 2221332 - DNA, 22 bp, Homo sapiens
gaaccaccacacccagcccact

SEQ ID NO: 2221333 - DNA, 15 bp, Homo sapiens
gaaccgtgaggaggg

SEQ ID NO: 2221334 - DNA, 18 bp, Homo sapiens
gaaccttttgagtgcctt

SEQ ID NO: 2221335 - DNA, 22 bp, Homo sapiens
gaactgggtacttgtggacaca

SEQ ID NO: 2221336 - DNA, 17 bp, Homo sapiens
gaacttaaataatgtga

SEQ ID NO: 2221337 - DNA, 19 bp, Homo sapiens
gaacttgaaaaaaaaaaac

SEQ ID NO: 2221338 - DNA, 16 bp, Homo sapiens
gaactttgacctctgc

SEQ ID NO: 2221339 - DNA, 14 bp, Homo sapiens
gaagaagctctctc

SEQ ID NO: 2221340 - DNA, 22 bp, Homo sapiens
gaagacaatgacttactgtaca

SEQ ID NO: 2221341 - DNA, 16 bp, Homo sapiens
gaagacactgatgggc

SEQ ID NO: 2221342 - DNA, 21 bp, Homo sapiens
gaagacactgatgggcaaccc

SEQ ID NO: 2221343 - DNA, 12 bp, Homo sapiens
gaagacagctct

SEQ ID NO: 2221344 - DNA, 13 bp, Homo sapiens
gaagacagctctt

SEQ ID NO: 2221345 - DNA, 16 bp, Homo sapiens
gaagactcattcttct

SEQ ID NO: 2221346 - DNA, 19 bp, Homo sapiens
gaagactcattcttctgta

SEQ ID NO: 2221347 - DNA, 14 bp, Homo sapiens
gaagactttggaaa

SEQ ID NO: 2221348 - DNA, 17 bp, Homo sapiens
gaagactttggaaagag

SEQ ID NO: 2221349 - DNA, 20 bp, Homo sapiens
gaagacttttctttcagcca

SEQ ID NO: 2221350 - DNA, 12 bp, Homo sapiens
gaagagccttgc

SEQ ID NO: 2221351 - DNA, 20 bp, Homo sapiens
gaagataatattaaggaaga

SEQ ID NO: 2221352 - DNA, 13 bp, Homo sapiens
gaagcacagcttc

SEQ ID NO: 2221353 - DNA, 20 bp, Homo sapiens
gaagcacatgcctctctcag

SEQ ID NO: 2221354 - DNA, 13 bp, Homo sapiens
gaagcagaaacaa

SEQ ID NO: 2221355 - DNA, 15 bp, Homo sapiens
gaagcagaggaagga

SEQ ID NO: 2221356 - DNA, 20 bp, Homo sapiens
gaagccagcaggctctcagg

SEQ ID NO: 2221357 - DNA, 19 bp, Homo sapiens
gaagcccaggaaaggctcc

SEQ ID NO: 2221358 - DNA, 20 bp, Homo sapiens
gaagcccaggaaaggctcca

SEQ ID NO: 2221359 - DNA, 16 bp, Homo sapiens
gaagctcagggcctgg

SEQ ID NO: 2221360 - DNA, 21 bp, Homo sapiens
gaagctcagggcctggctcag

SEQ ID NO: 2221361 - DNA, 19 bp, Homo sapiens
gaagctccgctttctaccc

SEQ ID NO: 2221362 - DNA, 14 bp, Homo sapiens
gaaggaaacccagc

SEQ ID NO: 2221363 - DNA, 17 bp, Homo sapiens
gaaggaaacccagctct

SEQ ID NO: 2221364 - DNA, 21 bp, Homo sapiens
gaaggaaacccagctctggtc

SEQ ID NO: 2221365 - DNA, 22 bp, Homo sapiens
gaaggaaacccagctctggtcc

SEQ ID NO: 2221366 - DNA, 21 bp, Homo sapiens
gaaggacattgcggacagcca

SEQ ID NO: 2221367 - DNA, 14 bp, Homo sapiens
gaaggccccgccca

SEQ ID NO: 2221368 - DNA, 19 bp, Homo sapiens
gaaggctcgagcatgcctg

SEQ ID NO: 2221369 - DNA, 19 bp, Homo sapiens
gaaggctgggttctgatcc

SEQ ID NO: 2221370 - DNA, 20 bp, Homo sapiens
gaaggctgggttctgatcct

SEQ ID NO: 2221371 - DNA, 16 bp, Homo sapiens
gaagggggctgggaca

SEQ ID NO: 2221372 - DNA, 18 bp, Homo sapiens
gaagtactataatttacc

SEQ ID NO: 2221373 - DNA, 19 bp, Homo sapiens
gaagtctttgtacagacaa

SEQ ID NO: 2221374 - DNA, 14 bp, Homo sapiens
gaataacatgtaat

SEQ ID NO: 2221375 - DNA, 18 bp, Homo sapiens
gaataacatgtaattaag

SEQ ID NO: 2221376 - DNA, 11 bp, Homo sapiens
gaatattgctg

SEQ ID NO: 2221377 - DNA, 12 bp, Homo sapiens
gaatattgctga

SEQ ID NO: 2221378 - DNA, 14 bp, Homo sapiens
gaatattgctgatg

SEQ ID NO: 2221379 - DNA, 19 bp, Homo sapiens
gaatattgctgatggtgca

SEQ ID NO: 2221380 - DNA, 11 bp, Homo sapiens
gaatgaatgtc

SEQ ID NO: 2221381 - DNA, 18 bp, Homo sapiens
gaatgcacaaacagaggc

SEQ ID NO: 2221382 - DNA, 16 bp, Homo sapiens
gaatgcgggggagcag

SEQ ID NO: 2221383 - DNA, 19 bp, Homo sapiens
gaatgcgggggagcaggca

SEQ ID NO: 2221384 - DNA, 21 bp, Homo sapiens
gaatgcgggggagcaggcagt

SEQ ID NO: 2221385 - DNA, 22 bp, Homo sapiens
gaatggttttcaaaataaaaat

SEQ ID NO: 2221386 - DNA, 15 bp, Homo sapiens
gaatgtttgcctctg

SEQ ID NO: 2221387 - DNA, 17 bp, Homo sapiens
gaattctcagaatctca

SEQ ID NO: 2221388 - DNA, 15 bp, Homo sapiens
gaatttcccaaagca

SEQ ID NO: 2221389 - DNA, 22 bp, Homo sapiens
gaatttcttttgccgttattaa

SEQ ID NO: 2221390 - DNA, 23 bp, Homo sapiens
gacaacactcattgacctgaggc

SEQ ID NO: 2221391 - DNA, 21 bp, Homo sapiens
gacaatgacttactgtacatg

SEQ ID NO: 2221392 - DNA, 13 bp, Homo sapiens
gacacagctcttc

SEQ ID NO: 2221393 - DNA, 16 bp, Homo sapiens
gacacagctcttctcc

SEQ ID NO: 2221394 - DNA, 17 bp, Homo sapiens
gacacagctcttctcca

SEQ ID NO: 2221395 - DNA, 21 bp, Homo sapiens
gacacagctcttctccaggct

SEQ ID NO: 2221396 - DNA, 20 bp, Homo sapiens
gacacaggcccggctccagg

SEQ ID NO: 2221397 - DNA, 21 bp, Homo sapiens
gacacaggcccggctccaggc

SEQ ID NO: 2221398 - DNA, 19 bp, Homo sapiens
gacacatgcaaggtcattt

SEQ ID NO: 2221399 - DNA, 20 bp, Homo sapiens
gacacatgtccaagaagccc

SEQ ID NO: 2221400 - DNA, 23 bp, Homo sapiens
gacacatgtccaagaagcccagg

SEQ ID NO: 2221401 - DNA, 20 bp, Homo sapiens
gacaccttgacagggcacac

SEQ ID NO: 2221402 - DNA, 19 bp, Homo sapiens
gacacgaatattgctgatg

SEQ ID NO: 2221403 - DNA, 19 bp, Homo sapiens
gcagacaggcaagcacctc

SEQ ID NO: 2221404 - DNA, 19 bp, Homo sapiens
gcagactctacagaggcca

SEQ ID NO: 2221405 - DNA, 22 bp, Homo sapiens
gcagactctacagaggccatgg

SEQ ID NO: 2221406 - DNA, 19 bp, Homo sapiens
gcagagaatgaaagggccc

SEQ ID NO: 2221407 - DNA, 22 bp, Homo sapiens
gcagagaatgaaagggcccaga

SEQ ID NO: 2221408 - DNA, 19 bp, Homo sapiens
gcagagaccatccctgaag

SEQ ID NO: 2221409 - DNA, 20 bp, Homo sapiens
gcagagaccatccctgaagg

SEQ ID NO: 2221410 - DNA, 12 bp, Homo sapiens
gcagagcagaga

SEQ ID NO: 2221411 - DNA, 20 bp, Homo sapiens
gcagaggaaagcaaaggaga

SEQ ID NO: 2221412 - DNA, 21 bp, Homo sapiens
gcagaggaaagcaaaggagat

SEQ ID NO: 2221413 - DNA, 14 bp, Homo sapiens
gcagagggcacaga

SEQ ID NO: 2221414 - DNA, 23 bp, Homo sapiens
gcagcaataaagcagcgtttcta

SEQ ID NO: 2221415 - DNA, 16 bp, Homo sapiens
gcagcagagagagaga

SEQ ID NO: 2221416 - DNA, 19 bp, Homo sapiens
gcagcagggagggcttctg

SEQ ID NO: 2221417 - DNA, 18 bp, Homo sapiens
gcagcatattcaggaagc

SEQ ID NO: 2221418 - DNA, 15 bp, Homo sapiens
gcagccacattcctg

SEQ ID NO: 2221419 - DNA, 14 bp, Homo sapiens
gcagccaggccaca

SEQ ID NO: 2221420 - DNA, 16 bp, Homo sapiens
gcagccaggccacaag

SEQ ID NO: 2221421 - DNA, 18 bp, Homo sapiens
gcagcccacccctcaaca

SEQ ID NO: 2221422 - DNA, 17 bp, Homo sapiens
gcagccccattctgcct

SEQ ID NO: 2221423 - DNA, 21 bp, Homo sapiens
gcagccccattctgcctgccc

SEQ ID NO: 2221424 - DNA, 20 bp, Homo sapiens
gcagcccctgttctggcaga

SEQ ID NO: 2221425 - DNA, 15 bp, Homo sapiens
gcagccctgcagagg

SEQ ID NO: 2221426 - DNA, 17 bp, Homo sapiens
gcagccctgcagagggc

SEQ ID NO: 2221427 - DNA, 21 bp, Homo sapiens
gcagcctcaacctcctgggct

SEQ ID NO: 2221428 - DNA, 15 bp, Homo sapiens
gcagcctcacagtcc

SEQ ID NO: 2221429 - DNA, 14 bp, Homo sapiens
gcagcctggaccct

SEQ ID NO: 2221430 - DNA, 17 bp, Homo sapiens
gcagctcacctctccct

SEQ ID NO: 2221431 - DNA, 19 bp, Homo sapiens
gcagctgcggtccacccag

SEQ ID NO: 2221432 - DNA, 22 bp, Homo sapiens
gcagctgcggtccacccaggag

SEQ ID NO: 2221433 - DNA, 13 bp, Homo sapiens
gcagctgcttttg

SEQ ID NO: 2221434 - DNA, 19 bp, Homo sapiens
gcagcttgagggttgggct

SEQ ID NO: 2221435 - DNA, 15 bp, Homo sapiens
gcaggcagccaggcc

SEQ ID NO: 2221436 - DNA, 17 bp, Homo sapiens
gcaggcagccaggccac

SEQ ID NO: 2221437 - DNA, 19 bp, Homo sapiens
gcagggctcagcggggaca

SEQ ID NO: 2221438 - DNA, 22 bp, Homo sapiens
gcagggctcagcggggacagct

SEQ ID NO: 2221439 - DNA, 20 bp, Homo sapiens
gcaggtcttgaactcctggc

SEQ ID NO: 2221440 - DNA, 15 bp, Homo sapiens
gcagtgcatgctgtc

SEQ ID NO: 2221441 - DNA, 16 bp, Homo sapiens
gcagtgcatgctgtcc

SEQ ID NO: 2221442 - DNA, 11 bp, Homo sapiens
gcagtgggagc

SEQ ID NO: 2221443 - DNA, 12 bp, Homo sapiens
gcagtgggagct

SEQ ID NO: 2221444 - DNA, 13 bp, Homo sapiens
gcagtgggagctg

SEQ ID NO: 2221445 - DNA, 20 bp, Homo sapiens
gcagtggtgcgatctgggtt

SEQ ID NO: 2221446 - DNA, 22 bp, Homo sapiens
gcagtggtgcgatctgggttca

SEQ ID NO: 2221447 - DNA, 23 bp, Homo sapiens
gcagtggtggttttctgttcttt

SEQ ID NO: 2221448 - DNA, 20 bp, Homo sapiens
gcataccacttttgttcttg

SEQ ID NO: 2221449 - DNA, 15 bp, Homo sapiens
gcatacgtacacatt

SEQ ID NO: 2221450 - DNA, 15 bp, Homo sapiens
gcatattcaggaagc

SEQ ID NO: 2221451 - DNA, 17 bp, Homo sapiens
gcatattcaggaagctc

SEQ ID NO: 2221452 - DNA, 15 bp, Homo sapiens
gcatcaggccaggcc

SEQ ID NO: 2221453 - DNA, 16 bp, Homo sapiens
gcatcaggccaggccc

SEQ ID NO: 2221454 - DNA, 17 bp, Homo sapiens
gcatccagtatcttgaa

SEQ ID NO: 2221455 - DNA, 14 bp, Homo sapiens
gcatcctggcaccc

SEQ ID NO: 2221456 - DNA, 18 bp, Homo sapiens
gcatgaagtaatatgcac

SEQ ID NO: 2221457 - DNA, 20 bp, Homo sapiens
gcatgaagtaatatgcacac

SEQ ID NO: 2221458 - DNA, 20 bp, Homo sapiens
gcatgacacgaatattgctg

SEQ ID NO: 2221459 - DNA, 21 bp, Homo sapiens
gcatgacacgaatattgctga

SEQ ID NO: 2221460 - DNA, 17 bp, Homo sapiens
gcatgtgatgagaggaa

SEQ ID NO: 2221461 - DNA, 13 bp, Homo sapiens
gcatgttacataa

SEQ ID NO: 2221462 - DNA, 14 bp, Homo sapiens
gcatgttctctgag

SEQ ID NO: 2221463 - DNA, 24 bp, Homo sapiens
gcattatctagatactgtatcatg

SEQ ID NO: 2221464 - DNA, 17 bp, Homo sapiens
gcattccccaggaggcc

SEQ ID NO: 2221465 - DNA, 22 bp, Homo sapiens
gcattccccaggaggccagcct

SEQ ID NO: 2221466 - DNA, 15 bp, Homo sapiens
gcattgtgggaaggg

SEQ ID NO: 2221467 - DNA, 17 bp, Homo sapiens
gcatttaaaagatacag

SEQ ID NO: 2221468 - DNA, 18 bp, Homo sapiens
gcatttaaaagatacagt

SEQ ID NO: 2221469 - DNA, 21 bp, Homo sapiens
gcatttggtggtttcagaaat

SEQ ID NO: 2221470 - DNA, 22 bp, Homo sapiens
gcatttggtggtttcagaaatg

SEQ ID NO: 2221471 - DNA, 16 bp, Homo sapiens
gcatttgtttgaactg

SEQ ID NO: 2221472 - DNA, 21 bp, Homo sapiens
gccaaactcacctgcccctca

SEQ ID NO: 2221473 - DNA, 13 bp, Homo sapiens
gccaaagccaaag

SEQ ID NO: 2221474 - DNA, 16 bp, Homo sapiens
gccaaaggaagcacat

SEQ ID NO: 2221475 - DNA, 11 bp, Homo sapiens
gccaaggccaa

SEQ ID NO: 2221476 - DNA, 20 bp, Homo sapiens
gccaaggccaaaggaagcac

SEQ ID NO: 2221477 - DNA, 15 bp, Homo sapiens
gccaaggtgggagga

SEQ ID NO: 2221478 - DNA, 16 bp, Homo sapiens
gccacaagacccttgt

SEQ ID NO: 2221479 - DNA, 22 bp, Homo sapiens
gccacaagacccttgtggtccc

SEQ ID NO: 2221480 - DNA, 16 bp, Homo sapiens
gccacattcctgatgc

SEQ ID NO: 2221481 - DNA, 21 bp, Homo sapiens
gccaccaacatactcccatct

SEQ ID NO: 2221482 - DNA, 19 bp, Homo sapiens
gccaccctggggagaaagt

SEQ ID NO: 2221483 - DNA, 14 bp, Homo sapiens
gccacctgcggtgc

SEQ ID NO: 2221484 - DNA, 14 bp, Homo sapiens
gccacggccaggcc

SEQ ID NO: 2221485 - DNA, 15 bp, Homo sapiens
gccacggccaggcca

SEQ ID NO: 2221486 - DNA, 17 bp, Homo sapiens
gccacggccaggccaga

SEQ ID NO: 2221487 - DNA, 18 bp, Homo sapiens
gccacggccaggccagag

SEQ ID NO: 2221488 - DNA, 19 bp, Homo sapiens
gccacggccaggccagagg

SEQ ID NO: 2221489 - DNA, 22 bp, Homo sapiens
gccactgcaccgggccacagag

SEQ ID NO: 2221490 - DNA, 21 bp, Homo sapiens
gccactgcactatagcctagg

SEQ ID NO: 2221491 - DNA, 19 bp, Homo sapiens
gccagagacacaagccttc

SEQ ID NO: 2221492 - DNA, 20 bp, Homo sapiens
gccagagacacaagccttcg

SEQ ID NO: 2221493 - DNA, 12 bp, Homo sapiens
gccagaggagag

SEQ ID NO: 2221494 - DNA, 15 bp, Homo sapiens
gccagaggagagagg

SEQ ID NO: 2221495 - DNA, 17 bp, Homo sapiens
gccagaggagagaggac

SEQ ID NO: 2221496 - DNA, 22 bp, Homo sapiens
gccagaggagagaggaccccct

SEQ ID NO: 2221497 - DNA, 20 bp, Homo sapiens
gccagagggagtgacagagg

SEQ ID NO: 2221498 - DNA, 14 bp, Homo sapiens
gccagatgcaccag

SEQ ID NO: 2221499 - DNA, 15 bp, Homo sapiens
gccagatgcaccagc

SEQ ID NO: 2221500 - DNA, 13 bp, Homo sapiens
gccagatttcact

SEQ ID NO: 2221501 - DNA, 19 bp, Homo sapiens
gccagcaggctctcaggcc

SEQ ID NO: 2221502 - DNA, 20 bp, Homo sapiens
gccagcaggctctcaggcca

SEQ ID NO: 2221503 - DNA, 21 bp, Homo sapiens
gccagcaggctctcaggccag

SEQ ID NO: 2221504 - DNA, 23 bp, Homo sapiens
gccagcaggctctcaggccagct

SEQ ID NO: 2221505 - DNA, 21 bp, Homo sapiens
gccagccttgaccattctcca

SEQ ID NO: 2221506 - DNA, 16 bp, Homo sapiens
gccagctgcttgggct

SEQ ID NO: 2221507 - DNA, 14 bp, Homo sapiens
gccaggccctctgc

SEQ ID NO: 2221508 - DNA, 16 bp, Homo sapiens
gccagggacagagggg

SEQ ID NO: 2221509 - DNA, 18 bp, Homo sapiens
gccagggacagagggggt

SEQ ID NO: 2221510 - DNA, 23 bp, Homo sapiens
gccagggacagagggggtggcct

SEQ ID NO: 2221511 - DNA, 17 bp, Homo sapiens
gccaggggaaaatcagc

SEQ ID NO: 2221512 - DNA, 23 bp, Homo sapiens
gccagtaaatgggggtgcatttg

SEQ ID NO: 2221513 - DNA, 21 bp, Homo sapiens
gccagtcaccccggccacctg

SEQ ID NO: 2221514 - DNA, 19 bp, Homo sapiens
gccatattctgttggccag

SEQ ID NO: 2221515 - DNA, 15 bp, Homo sapiens
gccatcccagcccca

SEQ ID NO: 2221516 - DNA, 18 bp, Homo sapiens
gccatgaggaacaaggca

SEQ ID NO: 2221517 - DNA, 20 bp, Homo sapiens
gccatgaggaacaaggcaag

SEQ ID NO: 2221518 - DNA, 24 bp, Homo sapiens
gccatgctcctggcccactgcatc

SEQ ID NO: 2221519 - DNA, 15 bp, Homo sapiens
gccatgggcctcctg

SEQ ID NO: 2221520 - DNA, 19 bp, Homo sapiens
gccatgttggccaggctgg

SEQ ID NO: 2221521 - DNA, 22 bp, Homo sapiens
gccatttcttccacaagagccc

SEQ ID NO: 2221522 - DNA, 13 bp, Homo sapiens
gcccacaggatca

SEQ ID NO: 2221523 - DNA, 19 bp, Homo sapiens
gcccacaggatcagtctga

SEQ ID NO: 2221524 - DNA, 15 bp, Homo sapiens
gcccaccttggctca

SEQ ID NO: 2221525 - DNA, 16 bp, Homo sapiens
gcccaccttggctcaa

SEQ ID NO: 2221526 - DNA, 23 bp, Homo sapiens
gctggggtggggacctcaggcct

SEQ ID NO: 2221527 - DNA, 15 bp, Homo sapiens
gctgggtgtggcgca

SEQ ID NO: 2221528 - DNA, 15 bp, Homo sapiens
gctgggttctaccca

SEQ ID NO: 2221529 - DNA, 21 bp, Homo sapiens
gctgggttctacccaggtgct

SEQ ID NO: 2221530 - DNA, 14 bp, Homo sapiens
gctggtgtcacctg

SEQ ID NO: 2221531 - DNA, 15 bp, Homo sapiens
gctggtgtcacctga

SEQ ID NO: 2221532 - DNA, 16 bp, Homo sapiens
gctggtgtcacctgaa

SEQ ID NO: 2221533 - DNA, 17 bp, Homo sapiens
gctgtatcccatgagcc

SEQ ID NO: 2221534 - DNA, 19 bp, Homo sapiens
gctgtatcccatgagcctc

SEQ ID NO: 2221535 - DNA, 17 bp, Homo sapiens
gctgtcaattacaggaa

SEQ ID NO: 2221536 - DNA, 21 bp, Homo sapiens
gctgtcccttacgtgagtcct

SEQ ID NO: 2221537 - DNA, 23 bp, Homo sapiens
gctgtcccttacgtgagtcctgg

SEQ ID NO: 2221538 - DNA, 16 bp, Homo sapiens
gctgtgctctggacag

SEQ ID NO: 2221539 - DNA, 14 bp, Homo sapiens
gctgtgctgccctg

SEQ ID NO: 2221540 - DNA, 16 bp, Homo sapiens
gctgtgctgccctgcc

SEQ ID NO: 2221541 - DNA, 14 bp, Homo sapiens
gctgttggctgggg

SEQ ID NO: 2221542 - DNA, 20 bp, Homo sapiens
gctgttggctgggggcctca

SEQ ID NO: 2221543 - DNA, 22 bp, Homo sapiens
gctgttggctgggggcctcagt

SEQ ID NO: 2221544 - DNA, 19 bp, Homo sapiens
gcttagtcactgagacagc

SEQ ID NO: 2221545 - DNA, 13 bp, Homo sapiens
gcttatctcaggg

SEQ ID NO: 2221546 - DNA, 18 bp, Homo sapiens
gcttcaaggatcctgagc

SEQ ID NO: 2221547 - DNA, 15 bp, Homo sapiens
gcttcacggaagagc

SEQ ID NO: 2221548 - DNA, 17 bp, Homo sapiens
gcttcagtggcagctgc

SEQ ID NO: 2221549 - DNA, 19 bp, Homo sapiens
gcttcagtggcagctgctt

SEQ ID NO: 2221550 - DNA, 12 bp, Homo sapiens
gcttcatcctcc

SEQ ID NO: 2221551 - DNA, 16 bp, Homo sapiens
gcttccagtgaggctc

SEQ ID NO: 2221552 - DNA, 19 bp, Homo sapiens
gcttccagtgaggctctgc

SEQ ID NO: 2221553 - DNA, 23 bp, Homo sapiens
gcttcttcagagactcctgcagg

SEQ ID NO: 2221554 - DNA, 16 bp, Homo sapiens
gcttgaccgtgaggcc

SEQ ID NO: 2221555 - DNA, 18 bp, Homo sapiens
gcttgagggttgggctgg

SEQ ID NO: 2221556 - DNA, 20 bp, Homo sapiens
gcttgagggttgggctggtg

SEQ ID NO: 2221557 - DNA, 16 bp, Homo sapiens
gcttggggaccagagc

SEQ ID NO: 2221558 - DNA, 21 bp, Homo sapiens
gcttggggaccagagctgcca

SEQ ID NO: 2221559 - DNA, 22 bp, Homo sapiens
gcttggggaccagagctgccac

SEQ ID NO: 2221560 - DNA, 18 bp, Homo sapiens
gcttgtaaatagctcagg

SEQ ID NO: 2221561 - DNA, 20 bp, Homo sapiens
gcttgtaaatagctcaggtg

SEQ ID NO: 2221562 - DNA, 22 bp, Homo sapiens
gctttctacccagcgagccctg

SEQ ID NO: 2221563 - DNA, 14 bp, Homo sapiens
gcttttacttaaac

SEQ ID NO: 2221564 - DNA, 14 bp, Homo sapiens
ggaaaaactgattt

SEQ ID NO: 2221565 - DNA, 22 bp, Homo sapiens
ggaaaaagacctcgtggagaat

SEQ ID NO: 2221566 - DNA, 14 bp, Homo sapiens
ggaaaagctgctga

SEQ ID NO: 2221567 - DNA, 18 bp, Homo sapiens
ggaaaagctgctgacagt

SEQ ID NO: 2221568 - DNA, 20 bp, Homo sapiens
ggaaaagctgctgacagtgt

SEQ ID NO: 2221569 - DNA, 14 bp, Homo sapiens
ggaaagaggctctg

SEQ ID NO: 2221570 - DNA, 12 bp, Homo sapiens
ggaaaggctcca

SEQ ID NO: 2221571 - DNA, 14 bp, Homo sapiens
ggaaatcaccgaaa

SEQ ID NO: 2221572 - DNA, 15 bp, Homo sapiens
ggaacaaggcaaggc

SEQ ID NO: 2221573 - DNA, 17 bp, Homo sapiens
ggaacaaggcaaggctg

SEQ ID NO: 2221574 - DNA, 12 bp, Homo sapiens
ggaacactctga

SEQ ID NO: 2221575 - DNA, 15 bp, Homo sapiens
ggaacactctgagac

SEQ ID NO: 2221576 - DNA, 16 bp, Homo sapiens
ggaacactctgagact

SEQ ID NO: 2221577 - DNA, 17 bp, Homo sapiens
ggaacagactggaagca

SEQ ID NO: 2221578 - DNA, 17 bp, Homo sapiens
ggaagacttcatccctc

SEQ ID NO: 2221579 - DNA, 13 bp, Homo sapiens
ggaagactttgga

SEQ ID NO: 2221580 - DNA, 18 bp, Homo sapiens
ggaagactttggaaagag

SEQ ID NO: 2221581 - DNA, 13 bp, Homo sapiens
ggaagagaaaaaa

SEQ ID NO: 2221582 - DNA, 17 bp, Homo sapiens
ggaagcacagcttcatt

SEQ ID NO: 2221583 - DNA, 14 bp, Homo sapiens
ggaagcacatgcct

SEQ ID NO: 2221584 - DNA, 22 bp, Homo sapiens
ggaagcacatgcctctctcagg

SEQ ID NO: 2221585 - DNA, 16 bp, Homo sapiens
ggaagccagcaggctc

SEQ ID NO: 2221586 - DNA, 18 bp, Homo sapiens
ggaagccagcaggctctc

SEQ ID NO: 2221587 - DNA, 22 bp, Homo sapiens
ggaagccagcaggctctcaggc

SEQ ID NO: 2221588 - DNA, 17 bp, Homo sapiens
ggaagctcagggcctgg

SEQ ID NO: 2221589 - DNA, 11 bp, Homo sapiens
ggaagctccgc

SEQ ID NO: 2221590 - DNA, 19 bp, Homo sapiens
ggaaggaaacccagctctg

SEQ ID NO: 2221591 - DNA, 16 bp, Homo sapiens
ggaatacctgtccccc

SEQ ID NO: 2221592 - DNA, 19 bp, Homo sapiens
ggaatacctgtccccctga

SEQ ID NO: 2221593 - DNA, 14 bp, Homo sapiens
ggaatgattaatta

SEQ ID NO: 2221594 - DNA, 24 bp, Homo sapiens
ggaatgattaattaaaacacaaca

SEQ ID NO: 2221595 - DNA, 12 bp, Homo sapiens
ggaatgcagtgg

SEQ ID NO: 2221596 - DNA, 19 bp, Homo sapiens
ggaatgcgggggagcaggc

SEQ ID NO: 2221597 - DNA, 21 bp, Homo sapiens
ggaatgcgggggagcaggcag

SEQ ID NO: 2221598 - DNA, 19 bp, Homo sapiens
ggaatgtttgcctctgcct

SEQ ID NO: 2221599 - DNA, 13 bp, Homo sapiens
ggacaagagcagg

SEQ ID NO: 2221600 - DNA, 13 bp, Homo sapiens
ggacacagctctt

SEQ ID NO: 2221601 - DNA, 15 bp, Homo sapiens
ggacacagctcttct

SEQ ID NO: 2221602 - DNA, 18 bp, Homo sapiens
ggacacagctcttctcca

SEQ ID NO: 2221603 - DNA, 21 bp, Homo sapiens
ggacacagctcttctccaggc

SEQ ID NO: 2221604 - DNA, 23 bp, Homo sapiens
ggacaccctgtgatggggccctg

SEQ ID NO: 2221605 - DNA, 17 bp, Homo sapiens
ggacactaaccacgctg

SEQ ID NO: 2221606 - DNA, 22 bp, Homo sapiens
ggacactaaccacgctggacct

SEQ ID NO: 2221607 - DNA, 20 bp, Homo sapiens
ggacagagggggtggcctcc

SEQ ID NO: 2221608 - DNA, 19 bp, Homo sapiens
ggacagccacggccaggcc

SEQ ID NO: 2221609 - DNA, 17 bp, Homo sapiens
ggacagctccttctgtc

SEQ ID NO: 2221610 - DNA, 14 bp, Homo sapiens
ggacatggacaagg

SEQ ID NO: 2221611 - DNA, 13 bp, Homo sapiens
ggaccagagctgc

SEQ ID NO: 2221612 - DNA, 12 bp, Homo sapiens
ggaccccctgaa

SEQ ID NO: 2221613 - DNA, 11 bp, Homo sapiens
ggaccctgagg

SEQ ID NO: 2221614 - DNA, 12 bp, Homo sapiens
ggaccctgaggc

SEQ ID NO: 2221615 - DNA, 18 bp, Homo sapiens
ggaccctgaggcccagag

SEQ ID NO: 2221616 - DNA, 19 bp, Homo sapiens
ggaccctgaggcccagagg

SEQ ID NO: 2221617 - DNA, 12 bp, Homo sapiens
ggacctcaggcc

SEQ ID NO: 2221618 - DNA, 13 bp, Homo sapiens
ggacctcaggcct

SEQ ID NO: 2221619 - DNA, 14 bp, Homo sapiens
ggacctcaggcctg

SEQ ID NO: 2221620 - DNA, 19 bp, Homo sapiens
ggacctcaggtgagaagca

SEQ ID NO: 2221621 - DNA, 23 bp, Homo sapiens
ggacctcaggtgagaagcagagg

SEQ ID NO: 2221622 - DNA, 17 bp, Homo sapiens
ggacgctacccgggaag

SEQ ID NO: 2221623 - DNA, 15 bp, Homo sapiens
ggactcaatgcactg

SEQ ID NO: 2221624 - DNA, 14 bp, Homo sapiens
ggacttggaagctc

SEQ ID NO: 2221625 - DNA, 17 bp, Homo sapiens
ggacttggaagctccgc

SEQ ID NO: 2221626 - DNA, 19 bp, Homo sapiens
ggagaaaatggacgtgtta

SEQ ID NO: 2221627 - DNA, 18 bp, Homo sapiens
ggagaagcggctggcagc

SEQ ID NO: 2221628 - DNA, 13 bp, Homo sapiens
ggagagccttcca

SEQ ID NO: 2221629 - DNA, 15 bp, Homo sapiens
ggagagctagcagca

SEQ ID NO: 2221630 - DNA, 21 bp, Homo sapiens
ggagagctagcagcagggagg

SEQ ID NO: 2221631 - DNA, 20 bp, Homo sapiens
ggagatttacaactggggga

SEQ ID NO: 2221632 - DNA, 12 bp, Homo sapiens
ggagcaggcagt

SEQ ID NO: 2221633 - DNA, 18 bp, Homo sapiens
ggagcaggcagtggggct

SEQ ID NO: 2221634 - DNA, 19 bp, Homo sapiens
ggagcaggcagtggggctg

SEQ ID NO: 2221635 - DNA, 21 bp, Homo sapiens
ggagctgcctgttcagctcca

SEQ ID NO: 2221636 - DNA, 22 bp, Homo sapiens
ggagctgcctgttcagctccag

SEQ ID NO: 2221637 - DNA, 23 bp, Homo sapiens
ggaggaaggaaacccagctctgg

SEQ ID NO: 2221638 - DNA, 18 bp, Homo sapiens
ggaggatgttctgggaca

SEQ ID NO: 2221639 - DNA, 21 bp, Homo sapiens
ggaggatgttctgggacacag

SEQ ID NO: 2221640 - DNA, 18 bp, Homo sapiens
ggaggccaaggtgggagg

SEQ ID NO: 2221641 - DNA, 20 bp, Homo sapiens
ggaggccaaggtgggaggat

SEQ ID NO: 2221642 - DNA, 13 bp, Homo sapiens
ggaggccagcctt

SEQ ID NO: 2221643 - DNA, 13 bp, Homo sapiens
ggagggagggctc

SEQ ID NO: 2221644 - DNA, 17 bp, Homo sapiens
ggagggagggctccaga

SEQ ID NO: 2221645 - DNA, 16 bp, Homo sapiens
ggaggggggaggtggg

SEQ ID NO: 2221646 - DNA, 14 bp, Homo sapiens
ggaggtcgaggcag

SEQ ID NO: 2221647 - DNA, 15 bp, Homo sapiens
ggaggtcgaggcagg

SEQ ID NO: 2221648 - DNA, 23 bp, Homo sapiens
ggaggtgggatcctccaggtgca

SEQ ID NO: 2221649 - DNA, 21 bp, Homo sapiens
ggagtcccaccttggctgcag

SEQ ID NO: 2221650 - DNA, 14 bp, Homo sapiens
ggtaacaggcagat

SEQ ID NO: 2221651 - DNA, 23 bp, Homo sapiens
ggtagaaatatctgaaaatgtat

SEQ ID NO: 2221652 - DNA, 13 bp, Homo sapiens
ggtaggaggaaca

SEQ ID NO: 2221653 - DNA, 19 bp, Homo sapiens
ggtatcaggtgctgccatc

SEQ ID NO: 2221654 - DNA, 11 bp, Homo sapiens
ggtcagagcct

SEQ ID NO: 2221655 - DNA, 15 bp, Homo sapiens
ggtccacccaggagc

SEQ ID NO: 2221656 - DNA, 20 bp, Homo sapiens
ggtccacccaggagccccga

SEQ ID NO: 2221657 - DNA, 15 bp, Homo sapiens
ggtccatagagagca

SEQ ID NO: 2221658 - DNA, 22 bp, Homo sapiens
ggtcccaccccacacacgccag

SEQ ID NO: 2221659 - DNA, 14 bp, Homo sapiens
ggtcccactcagtc

SEQ ID NO: 2221660 - DNA, 23 bp, Homo sapiens
ggtcccccttccatggactttgt

SEQ ID NO: 2221661 - DNA, 12 bp, Homo sapiens
ggtcctgctgca

SEQ ID NO: 2221662 - DNA, 14 bp, Homo sapiens
ggtcctgctgcagt

SEQ ID NO: 2221663 - DNA, 23 bp, Homo sapiens
ggtcctgctgcagttgccagtca

SEQ ID NO: 2221664 - DNA, 17 bp, Homo sapiens
ggtctacactgtgctga

SEQ ID NO: 2221665 - DNA, 21 bp, Homo sapiens
ggtctcactatgttgcccagg

SEQ ID NO: 2221666 - DNA, 16 bp, Homo sapiens
ggtctcactctgtcgc

SEQ ID NO: 2221667 - DNA, 14 bp, Homo sapiens
ggtctgacccactg

SEQ ID NO: 2221668 - DNA, 16 bp, Homo sapiens
ggtctgacccactgct

SEQ ID NO: 2221669 - DNA, 15 bp, Homo sapiens
ggtctgcagggaatt

SEQ ID NO: 2221670 - DNA, 21 bp, Homo sapiens
ggtcttgaactcctggcctca

SEQ ID NO: 2221671 - DNA, 13 bp, Homo sapiens
ggtgaacagaaca

SEQ ID NO: 2221672 - DNA, 22 bp, Homo sapiens
ggtgaccagcaccatctctcct

SEQ ID NO: 2221673 - DNA, 14 bp, Homo sapiens
ggtgacctctgcct

SEQ ID NO: 2221674 - DNA, 21 bp, Homo sapiens
ggtgacctctgcctgaagtca

SEQ ID NO: 2221675 - DNA, 15 bp, Homo sapiens
ggtgagaagcagagg

SEQ ID NO: 2221676 - DNA, 16 bp, Homo sapiens
ggtgagaggggaacag

SEQ ID NO: 2221677 - DNA, 22 bp, Homo sapiens
ggtgagcactctggggtgggag

SEQ ID NO: 2221678 - DNA, 18 bp, Homo sapiens
ggtgatccacccacctca

SEQ ID NO: 2221679 - DNA, 24 bp, Homo sapiens
ggtgatccacccacctcagcctcc

SEQ ID NO: 2221680 - DNA, 21 bp, Homo sapiens
ggtgccctcccagaccccctt

SEQ ID NO: 2221681 - DNA, 17 bp, Homo sapiens
ggtgctatctcccccag

SEQ ID NO: 2221682 - DNA, 19 bp, Homo sapiens
ggtgctatctcccccagcc

SEQ ID NO: 2221683 - DNA, 15 bp, Homo sapiens
ggtgctgccatccag

SEQ ID NO: 2221684 - DNA, 17 bp, Homo sapiens
ggtggaatgcgggggag

SEQ ID NO: 2221685 - DNA, 23 bp, Homo sapiens
ggtggaatgcgggggagcaggca

SEQ ID NO: 2221686 - DNA, 13 bp, Homo sapiens
ggtggatgcctgg

SEQ ID NO: 2221687 - DNA, 14 bp, Homo sapiens
ggtggcaccagcag

SEQ ID NO: 2221688 - DNA, 13 bp, Homo sapiens
ggtggcagctcac

SEQ ID NO: 2221689 - DNA, 11 bp, Homo sapiens
ggtggcagctg

SEQ ID NO: 2221690 - DNA, 13 bp, Homo sapiens
ggtggcagctgcg

SEQ ID NO: 2221691 - DNA, 19 bp, Homo sapiens
ggtggcagtgggagctgcc

SEQ ID NO: 2221692 - DNA, 13 bp, Homo sapiens
ggtggcctcccaa

SEQ ID NO: 2221693 - DNA, 12 bp, Homo sapiens
ggtggctgggtt

SEQ ID NO: 2221694 - DNA, 20 bp, Homo sapiens
ggtgggaggattgcttgagc

SEQ ID NO: 2221695 - DNA, 12 bp, Homo sapiens
ggtgggagggga

SEQ ID NO: 2221696 - DNA, 15 bp, Homo sapiens
ggtgggaggggaaga

SEQ ID NO: 2221697 - DNA, 14 bp, Homo sapiens
ggtgggagggtctg

SEQ ID NO: 2221698 - DNA, 13 bp, Homo sapiens
ggtggggcagctt

SEQ ID NO: 2221699 - DNA, 17 bp, Homo sapiens
ggtggggcagcttgagg

SEQ ID NO: 2221700 - DNA, 23 bp, Homo sapiens
ggtggggcctggggtaggaggaa

SEQ ID NO: 2221701 - DNA, 23 bp, Homo sapiens
ggtggggtcactctggcagctca

SEQ ID NO: 2221702 - DNA, 18 bp, Homo sapiens
ggtggttttctgttcttt

SEQ ID NO: 2221703 - DNA, 17 bp, Homo sapiens
ggtgtcaagagggtctg

SEQ ID NO: 2221704 - DNA, 19 bp, Homo sapiens
ggtgtcacctgaagactca

SEQ ID NO: 2221705 - DNA, 16 bp, Homo sapiens
ggtgtcgggcatgaca

SEQ ID NO: 2221706 - DNA, 16 bp, Homo sapiens
ggtgtgactgaatttc

SEQ ID NO: 2221707 - DNA, 11 bp, Homo sapiens
ggtgtggggga

SEQ ID NO: 2221708 - DNA, 19 bp, Homo sapiens
ggtgtttcctggcactgct

SEQ ID NO: 2221709 - DNA, 17 bp, Homo sapiens
ggttaggcattgtggga

SEQ ID NO: 2221710 - DNA, 22 bp, Homo sapiens
ggttcaagcgattcttctgctt

SEQ ID NO: 2221711 - DNA, 23 bp, Homo sapiens
ggttcaagcgattcttctgcttc

SEQ ID NO: 2221712 - DNA, 14 bp, Homo sapiens
ggtttcagaaatgt

SEQ ID NO: 2221713 - DNA, 15 bp, Homo sapiens
ggtttcagaaatgtg

SEQ ID NO: 2221714 - DNA, 12 bp, Homo sapiens
ggttttctgttc

SEQ ID NO: 2221715 - DNA, 13 bp, Homo sapiens
ggttttctgttct

SEQ ID NO: 2221716 - DNA, 20 bp, Homo sapiens
gtaaatgggggtgcatttga

SEQ ID NO: 2221717 - DNA, 16 bp, Homo sapiens
gtaacaagccacccca

SEQ ID NO: 2221718 - DNA, 22 bp, Homo sapiens
gtaacaggaaaattttaaaaat

SEQ ID NO: 2221719 - DNA, 18 bp, Homo sapiens
gtaaggaatacctgtccc

SEQ ID NO: 2221720 - DNA, 21 bp, Homo sapiens
gtaaggaatacctgtccccct

SEQ ID NO: 2221721 - DNA, 17 bp, Homo sapiens
gtaatatgcacacattt

SEQ ID NO: 2221722 - DNA, 18 bp, Homo sapiens
gtaatatgcacacatttt

SEQ ID NO: 2221723 - DNA, 15 bp, Homo sapiens
gtaatttgtgataca

SEQ ID NO: 2221724 - DNA, 18 bp, Homo sapiens
gtacactgtttcaaactt

SEQ ID NO: 2221725 - DNA, 16 bp, Homo sapiens
gtacagacaacaaacc

SEQ ID NO: 2221726 - DNA, 19 bp, Homo sapiens
gtacatgaaaacacatttt

SEQ ID NO: 2221727 - DNA, 20 bp, Homo sapiens
gtacatgaaaacacattttt

SEQ ID NO: 2221728 - DNA, 19 bp, Homo sapiens
gtacatggaataacatgta

SEQ ID NO: 2221729 - DNA, 13 bp, Homo sapiens
gtacccactgctc

SEQ ID NO: 2221730 - DNA, 15 bp, Homo sapiens
gtacccactgctctg

SEQ ID NO: 2221731 - DNA, 16 bp, Homo sapiens
gtacccactgctctgg

SEQ ID NO: 2221732 - DNA, 14 bp, Homo sapiens
gtacgtctgacagg

SEQ ID NO: 2221733 - DNA, 17 bp, Homo sapiens
gtacgttgtgcatttgg

SEQ ID NO: 2221734 - DNA, 17 bp, Homo sapiens
gtactacagtcctccca

SEQ ID NO: 2221735 - DNA, 18 bp, Homo sapiens
gtactacagtcctcccat

SEQ ID NO: 2221736 - DNA, 19 bp, Homo sapiens
gtactacagtcctcccatc

SEQ ID NO: 2221737 - DNA, 16 bp, Homo sapiens
gtacttctccaccctg

SEQ ID NO: 2221738 - DNA, 19 bp, Homo sapiens
gtacttctccaccctgctc

SEQ ID NO: 2221739 - DNA, 20 bp, Homo sapiens
gtacttgtggacacagctct

SEQ ID NO: 2221740 - DNA, 21 bp, Homo sapiens
gtagaagtcttagatgtatat

SEQ ID NO: 2221741 - DNA, 19 bp, Homo sapiens
gtagctgggactacaggca

SEQ ID NO: 2221742 - DNA, 18 bp, Homo sapiens
gtaggaaggttaatgttc

SEQ ID NO: 2221743 - DNA, 15 bp, Homo sapiens
gtaggaggaacaggt

SEQ ID NO: 2221744 - DNA, 16 bp, Homo sapiens
gtagggcgggaggatg

SEQ ID NO: 2221745 - DNA, 21 bp, Homo sapiens
gtagggcgggaggatgttctg

SEQ ID NO: 2221746 - DNA, 18 bp, Homo sapiens
gtatcaggtgctgccatc

SEQ ID NO: 2221747 - DNA, 19 bp, Homo sapiens
gtatcccatgagcctcagc

SEQ ID NO: 2221748 - DNA, 19 bp, Homo sapiens
gtatctggtgactttcctc

SEQ ID NO: 2221749 - DNA, 20 bp, Homo sapiens
gtatgatcacggctcactgc

SEQ ID NO: 2221750 - DNA, 15 bp, Homo sapiens
gtatgggagagaaga

SEQ ID NO: 2221751 - DNA, 16 bp, Homo sapiens
gtatggtggctgggtt

SEQ ID NO: 2221752 - DNA, 19 bp, Homo sapiens
gtattttgtttttgtctta

SEQ ID NO: 2221753 - DNA, 22 bp, Homo sapiens
gtattttgtttttgtcttaaaa

SEQ ID NO: 2221754 - DNA, 17 bp, Homo sapiens
gtatttttttactaata

SEQ ID NO: 2221755 - DNA, 18 bp, Homo sapiens
gtcaaagtggtgagaggc

SEQ ID NO: 2221756 - DNA, 18 bp, Homo sapiens
gtcaagagggtctgagga

SEQ ID NO: 2221757 - DNA, 19 bp, Homo sapiens
gtcaagagggtctgaggaa

SEQ ID NO: 2221758 - DNA, 21 bp, Homo sapiens
gtcacacagtattacttctgc

SEQ ID NO: 2221759 - DNA, 15 bp, Homo sapiens
gtcacaggcaggtcc

SEQ ID NO: 2221760 - DNA, 16 bp, Homo sapiens
gtcacaggcaggtcca

SEQ ID NO: 2221761 - DNA, 13 bp, Homo sapiens
gtcaccccggcca

SEQ ID NO: 2221762 - DNA, 16 bp, Homo sapiens
gtcactctggcagctc

SEQ ID NO: 2221763 - DNA, 21 bp, Homo sapiens
gtcactgagacagcccgggct

SEQ ID NO: 2221764 - DNA, 23 bp, Homo sapiens
gtcactgagacagcccgggctct

SEQ ID NO: 2221765 - DNA, 15 bp, Homo sapiens
gtcactgcttaactt

SEQ ID NO: 2221766 - DNA, 21 bp, Homo sapiens
gtcagaagtttctgccgcagc

SEQ ID NO: 2221767 - DNA, 23 bp, Homo sapiens
gtcagaagtttctgccgcagccc

SEQ ID NO: 2221768 - DNA, 15 bp, Homo sapiens
gtcagagcctgcagt

SEQ ID NO: 2221769 - DNA, 17 bp, Homo sapiens
gtcaggtggggcagctt

SEQ ID NO: 2221770 - DNA, 15 bp, Homo sapiens
gtccaagaagcccag

SEQ ID NO: 2221771 - DNA, 18 bp, Homo sapiens
gtccaagaagcccaggaa

SEQ ID NO: 2221772 - DNA, 12 bp, Homo sapiens
gtccacccagga

SEQ ID NO: 2221773 - DNA, 13 bp, Homo sapiens
gtccacccaggag

SEQ ID NO: 2221774 - DNA, 22 bp, Homo sapiens
taaacttggtttttaaaaaact

SEQ ID NO: 2221775 - DNA, 12 bp, Homo sapiens
taaagaaaactg

SEQ ID NO: 2221776 - DNA, 16 bp, Homo sapiens
taaagcagcgtttcta

SEQ ID NO: 2221777 - DNA, 19 bp, Homo sapiens
taaaggctacctttgtatt

SEQ ID NO: 2221778 - DNA, 15 bp, Homo sapiens
taaagtgtatttttt

SEQ ID NO: 2221779 - DNA, 19 bp, Homo sapiens
taaagtgtatttttttact

SEQ ID NO: 2221780 - DNA, 15 bp, Homo sapiens
taaatctccaaaata

SEQ ID NO: 2221781 - DNA, 20 bp, Homo sapiens
taaatctccaaaataaaact

SEQ ID NO: 2221782 - DNA, 22 bp, Homo sapiens
taaatctccaaaataaaacttt

SEQ ID NO: 2221783 - DNA, 23 bp, Homo sapiens
taaatgcacctggaatatataac

SEQ ID NO: 2221784 - DNA, 17 bp, Homo sapiens
taaatgggggtgcattt

SEQ ID NO: 2221785 - DNA, 20 bp, Homo sapiens
taaatgtctagttgtaacac

SEQ ID NO: 2221786 - DNA, 22 bp, Homo sapiens
taaattaacttttataaacttt

SEQ ID NO: 2221787 - DNA, 16 bp, Homo sapiens
taaattcttgcaaagt

SEQ ID NO: 2221788 - DNA, 13 bp, Homo sapiens
taacaagccaccc

SEQ ID NO: 2221789 - DNA, 12 bp, Homo sapiens
taacagaaatgt

SEQ ID NO: 2221790 - DNA, 13 bp, Homo sapiens
taacagaaatgta

SEQ ID NO: 2221791 - DNA, 14 bp, Homo sapiens
taacatggaagtac

SEQ ID NO: 2221792 - DNA, 16 bp, Homo sapiens
taacatggaagtacta

SEQ ID NO: 2221793 - DNA, 14 bp, Homo sapiens
taactaaaaggtat

SEQ ID NO: 2221794 - DNA, 17 bp, Homo sapiens
taacttttataaacttt

SEQ ID NO: 2221795 - DNA, 18 bp, Homo sapiens
taagaaaaaggatgcaca

SEQ ID NO: 2221796 - DNA, 22 bp, Homo sapiens
taagaggcagggtctcactctg

SEQ ID NO: 2221797 - DNA, 23 bp, Homo sapiens
taagagggagggagggctccaga

SEQ ID NO: 2221798 - DNA, 14 bp, Homo sapiens
taagataaatgtgc

SEQ ID NO: 2221799 - DNA, 17 bp, Homo sapiens
taagataaatgtgctga

SEQ ID NO: 2221800 - DNA, 18 bp, Homo sapiens
taagcacacttgacatca

SEQ ID NO: 2221801 - DNA, 21 bp, Homo sapiens
taagctattcagtaataactc

SEQ ID NO: 2221802 - DNA, 18 bp, Homo sapiens
taaggatgcttgtacata

SEQ ID NO: 2221803 - DNA, 19 bp, Homo sapiens
taaggatgcttgtacataa

SEQ ID NO: 2221804 - DNA, 22 bp, Homo sapiens
taaggatgcttgtacataatgc

SEQ ID NO: 2221805 - DNA, 20 bp, Homo sapiens
taaggtgggtacgggagggt

SEQ ID NO: 2221806 - DNA, 17 bp, Homo sapiens
taagtactatgtatcaa

SEQ ID NO: 2221807 - DNA, 19 bp, Homo sapiens
taagtattcttatttaatg

SEQ ID NO: 2221808 - DNA, 20 bp, Homo sapiens
taagtattcttatttaatga

SEQ ID NO: 2221809 - DNA, 18 bp, Homo sapiens
taagtgctgcatttaaaa

SEQ ID NO: 2221810 - DNA, 22 bp, Homo sapiens
taagtgctgcatttaaaagata

SEQ ID NO: 2221811 - DNA, 20 bp, Homo sapiens
taagtggtactaactttcct

SEQ ID NO: 2221812 - DNA, 14 bp, Homo sapiens
taatacaccactac

SEQ ID NO: 2221813 - DNA, 16 bp, Homo sapiens
taatacaccactacat

SEQ ID NO: 2221814 - DNA, 18 bp, Homo sapiens
taatacaccactacattc

SEQ ID NO: 2221815 - DNA, 16 bp, Homo sapiens
taatatgcacacattt

SEQ ID NO: 2221816 - DNA, 17 bp, Homo sapiens
taatatgcacacatttt

SEQ ID NO: 2221817 - DNA, 18 bp, Homo sapiens
taatatgcacacattttt

SEQ ID NO: 2221818 - DNA, 12 bp, Homo sapiens
taatctaaatgg

SEQ ID NO: 2221819 - DNA, 13 bp, Homo sapiens
taatctaaatgga

SEQ ID NO: 2221820 - DNA, 14 bp, Homo sapiens
taatgaaagactgt

SEQ ID NO: 2221821 - DNA, 17 bp, Homo sapiens
taatgaaagactgtaca

SEQ ID NO: 2221822 - DNA, 23 bp, Homo sapiens
taatgaaagactgtacaaagtag

SEQ ID NO: 2221823 - DNA, 13 bp, Homo sapiens
taatgaggaaact

SEQ ID NO: 2221824 - DNA, 16 bp, Homo sapiens
taatgtaagctctact

SEQ ID NO: 2221825 - DNA, 18 bp, Homo sapiens
taatgtcacaggcaggtc

SEQ ID NO: 2221826 - DNA, 17 bp, Homo sapiens
taatttacctgaagtct

SEQ ID NO: 2221827 - DNA, 14 bp, Homo sapiens
taatttgtgataca

SEQ ID NO: 2221828 - DNA, 15 bp, Homo sapiens
taatttgtgatacaa

SEQ ID NO: 2221829 - DNA, 13 bp, Homo sapiens
tacaatgctgtgc

SEQ ID NO: 2221830 - DNA, 17 bp, Homo sapiens
tacacaatggttttctt

SEQ ID NO: 2221831 - DNA, 21 bp, Homo sapiens
tacacaatggttttcttgtgt

SEQ ID NO: 2221832 - DNA, 21 bp, Homo sapiens
tacacacacacgcgtgcacac

SEQ ID NO: 2221833 - DNA, 17 bp, Homo sapiens
tacacactgcatgtttg

SEQ ID NO: 2221834 - DNA, 22 bp, Homo sapiens
tacacactgcatgtttgtgatt

SEQ ID NO: 2221835 - DNA, 20 bp, Homo sapiens
tacaccactacattctgtta

SEQ ID NO: 2221836 - DNA, 17 bp, Homo sapiens
tacactgtttcaaactt

SEQ ID NO: 2221837 - DNA, 14 bp, Homo sapiens
tacagacaaagcgt

SEQ ID NO: 2221838 - DNA, 19 bp, Homo sapiens
tacagagcccacgccccca

SEQ ID NO: 2221839 - DNA, 23 bp, Homo sapiens
tacagagcccacgcccccactgg

SEQ ID NO: 2221840 - DNA, 22 bp, Homo sapiens
tacagcttgaccgtgaggccag

SEQ ID NO: 2221841 - DNA, 23 bp, Homo sapiens
tacagcttgaccgtgaggccaga

SEQ ID NO: 2221842 - DNA, 14 bp, Homo sapiens
tacaggaagtactg

SEQ ID NO: 2221843 - DNA, 22 bp, Homo sapiens
tacaggaagtactggagaaaat

SEQ ID NO: 2221844 - DNA, 16 bp, Homo sapiens
tacaggtgtgagtcac

SEQ ID NO: 2221845 - DNA, 12 bp, Homo sapiens
tacagtcctccc

SEQ ID NO: 2221846 - DNA, 17 bp, Homo sapiens
tacagtcctcccatctc

SEQ ID NO: 2221847 - DNA, 17 bp, Homo sapiens
tacagttgaaaaacagc

SEQ ID NO: 2221848 - DNA, 19 bp, Homo sapiens
tacagttgaaaaacagctg

SEQ ID NO: 2221849 - DNA, 21 bp, Homo sapiens
tacagtttgttagtatgaggc

SEQ ID NO: 2221850 - DNA, 17 bp, Homo sapiens
tacataatgcgtgcata

SEQ ID NO: 2221851 - DNA, 19 bp, Homo sapiens
tacataatgcgtgcatacc

SEQ ID NO: 2221852 - DNA, 18 bp, Homo sapiens
tacatgaaaacacatttt

SEQ ID NO: 2221853 - DNA, 19 bp, Homo sapiens
tacatggaataacatgtaa

SEQ ID NO: 2221854 - DNA, 22 bp, Homo sapiens
tacatggaataacatgtaatta

SEQ ID NO: 2221855 - DNA, 12 bp, Homo sapiens
tacattctgtta

SEQ ID NO: 2221856 - DNA, 14 bp, Homo sapiens
tacatttttaagtg

SEQ ID NO: 2221857 - DNA, 22 bp, Homo sapiens
tacatttttaagtgctgcattt

SEQ ID NO: 2221858 - DNA, 13 bp, Homo sapiens
taccacagacata

SEQ ID NO: 2221859 - DNA, 13 bp, Homo sapiens
tacccactgctct

SEQ ID NO: 2221860 - DNA, 14 bp, Homo sapiens
tacccactgctctg

SEQ ID NO: 2221861 - DNA, 15 bp, Homo sapiens
taccctcatgttctt

SEQ ID NO: 2221862 - DNA, 20 bp, Homo sapiens
taccctggcactataatgta

SEQ ID NO: 2221863 - DNA, 23 bp, Homo sapiens
tacctcttgagccttgaactttg

SEQ ID NO: 2221864 - DNA, 16 bp, Homo sapiens
tacctgaagtctttgt

SEQ ID NO: 2221865 - DNA, 16 bp, Homo sapiens
tacctgccaggaagcc

SEQ ID NO: 2221866 - DNA, 20 bp, Homo sapiens
tacctgccaggaagccagca

SEQ ID NO: 2221867 - DNA, 13 bp, Homo sapiens
tacctgtccccct

SEQ ID NO: 2221868 - DNA, 13 bp, Homo sapiens
taccttttttata

SEQ ID NO: 2221869 - DNA, 17 bp, Homo sapiens
taccttttttatacata

SEQ ID NO: 2221870 - DNA, 19 bp, Homo sapiens
taccttttttatacataaa

SEQ ID NO: 2221871 - DNA, 21 bp, Homo sapiens
tacgaaaagaggggaagagac

SEQ ID NO: 2221872 - DNA, 22 bp, Homo sapiens
tacgccaggggaaaatcagcct

SEQ ID NO: 2221873 - DNA, 18 bp, Homo sapiens
tacgggagggtaaggctg

SEQ ID NO: 2221874 - DNA, 12 bp, Homo sapiens
tacgtacacatt

SEQ ID NO: 2221875 - DNA, 13 bp, Homo sapiens
tacgtacacattt

SEQ ID NO: 2221876 - DNA, 15 bp, Homo sapiens
tacgttgtgcatttg

SEQ ID NO: 2221877 - DNA, 17 bp, Homo sapiens
tactaaccagcagaaat

SEQ ID NO: 2221878 - DNA, 18 bp, Homo sapiens
tactaaccagcagaaatg

SEQ ID NO: 2221879 - DNA, 17 bp, Homo sapiens
tactaatagacaattta

SEQ ID NO: 2221880 - DNA, 13 bp, Homo sapiens
tactacagtttgt

SEQ ID NO: 2221881 - DNA, 13 bp, Homo sapiens
tactatgtatcaa

SEQ ID NO: 2221882 - DNA, 14 bp, Homo sapiens
tactcacctcaccc

SEQ ID NO: 2221883 - DNA, 12 bp, Homo sapiens
tactcccatctg

SEQ ID NO: 2221884 - DNA, 14 bp, Homo sapiens
tactcccatctgtg

SEQ ID NO: 2221885 - DNA, 22 bp, Homo sapiens
tactcgagttacagacaaagcg

SEQ ID NO: 2221886 - DNA, 16 bp, Homo sapiens
tactctaccctcttag

SEQ ID NO: 2221887 - DNA, 22 bp, Homo sapiens
tactctcctggaaatattaaga

SEQ ID NO: 2221888 - DNA, 13 bp, Homo sapiens
tactggggattct

SEQ ID NO: 2221889 - DNA, 15 bp, Homo sapiens
tactgtaatttgtga

SEQ ID NO: 2221890 - DNA, 16 bp, Homo sapiens
tactgtaatttgtgat

SEQ ID NO: 2221891 - DNA, 21 bp, Homo sapiens
tactgtacatgaaaacacatt

SEQ ID NO: 2221892 - DNA, 18 bp, Homo sapiens
tacttctccaccctgctc

SEQ ID NO: 2221893 - DNA, 15 bp, Homo sapiens
tagaaatataattga

SEQ ID NO: 2221894 - DNA, 15 bp, Homo sapiens
tagaagtcacacagt

SEQ ID NO: 2221895 - DNA, 17 bp, Homo sapiens
tagaagtcttagatgta

SEQ ID NO: 2221896 - DNA, 16 bp, Homo sapiens
tagacaatttattatg

SEQ ID NO: 2221897 - DNA, 16 bp, Homo sapiens
tagacagtccctgcca

SEQ ID NO: 2221898 - DNA, 17 bp, Homo sapiens
tcgcaggattcttcctc

SEQ ID NO: 2221899 - DNA, 14 bp, Homo sapiens
tcgcccagtctgga

SEQ ID NO: 2221900 - DNA, 13 bp, Homo sapiens
tcgcgacaatgca

SEQ ID NO: 2221901 - DNA, 19 bp, Homo sapiens
tcgcgacaatgcaaaccat

SEQ ID NO: 2221902 - DNA, 23 bp, Homo sapiens
tcgctgtgtcagcatagaagtaa

SEQ ID NO: 2221903 - DNA, 15 bp, Homo sapiens
tcggaaaacatgcta

SEQ ID NO: 2221904 - DNA, 13 bp, Homo sapiens
tcggctaaaaaga

SEQ ID NO: 2221905 - DNA, 14 bp, Homo sapiens
tcggctaaaaagaa

SEQ ID NO: 2221906 - DNA, 22 bp, Homo sapiens
tcggctaaaaagaatgcagaga

SEQ ID NO: 2221907 - DNA, 17 bp, Homo sapiens
tcgggaggtcgaggcag

SEQ ID NO: 2221908 - DNA, 12 bp, Homo sapiens
tcgggcatgaca

SEQ ID NO: 2221909 - DNA, 23 bp, Homo sapiens
tcgtcactgcttaacttcacata

SEQ ID NO: 2221910 - DNA, 13 bp, Homo sapiens
tcgtgacaacact

SEQ ID NO: 2221911 - DNA, 16 bp, Homo sapiens
tcgtgattgataagaa

SEQ ID NO: 2221912 - DNA, 17 bp, Homo sapiens
tcgtggagaatttttac

SEQ ID NO: 2221913 - DNA, 22 bp, Homo sapiens
tctaaatctccaaaataaaact

SEQ ID NO: 2221914 - DNA, 15 bp, Homo sapiens
tctacagaggccatg

SEQ ID NO: 2221915 - DNA, 19 bp, Homo sapiens
tctacccagcgagccctgg

SEQ ID NO: 2221916 - DNA, 20 bp, Homo sapiens
tctacccagcgagccctggt

SEQ ID NO: 2221917 - DNA, 14 bp, Homo sapiens
tctacccaggtgct

SEQ ID NO: 2221918 - DNA, 19 bp, Homo sapiens
tctaccctggcactataat

SEQ ID NO: 2221919 - DNA, 20 bp, Homo sapiens
tctactcgagttacagacaa

SEQ ID NO: 2221920 - DNA, 18 bp, Homo sapiens
tctactgaggtgctatgt

SEQ ID NO: 2221921 - DNA, 22 bp, Homo sapiens
tctactgaggtgctatgttctt

SEQ ID NO: 2221922 - DNA, 13 bp, Homo sapiens
tctagatactgta

SEQ ID NO: 2221923 - DNA, 18 bp, Homo sapiens
tctagcatggctgccaat

SEQ ID NO: 2221924 - DNA, 13 bp, Homo sapiens
tctagccagagga

SEQ ID NO: 2221925 - DNA, 15 bp, Homo sapiens
tctaggaagactttg

SEQ ID NO: 2221926 - DNA, 21 bp, Homo sapiens
tctaggaagactttggaaaga

SEQ ID NO: 2221927 - DNA, 18 bp, Homo sapiens
tctaggaggtctctaaga

SEQ ID NO: 2221928 - DNA, 22 bp, Homo sapiens
tctagggaaaaaccagcgtgtg

SEQ ID NO: 2221929 - DNA, 22 bp, Homo sapiens
tctatcaagtattatacctttt

SEQ ID NO: 2221930 - DNA, 14 bp, Homo sapiens
tctatgacacatgc

SEQ ID NO: 2221931 - DNA, 12 bp, Homo sapiens
tctatgggactc

SEQ ID NO: 2221932 - DNA, 14 bp, Homo sapiens
tctcaaatttctaa

SEQ ID NO: 2221933 - DNA, 18 bp, Homo sapiens
tctcaaatttctaaatct

SEQ ID NO: 2221934 - DNA, 20 bp, Homo sapiens
tctcactatgttgcccaggc

SEQ ID NO: 2221935 - DNA, 22 bp, Homo sapiens
tctcactatgttgcccaggcag

SEQ ID NO: 2221936 - DNA, 16 bp, Homo sapiens
tctcactctgtcgccc

SEQ ID NO: 2221937 - DNA, 17 bp, Homo sapiens
tctcactctgtcgccca

SEQ ID NO: 2221938 - DNA, 14 bp, Homo sapiens
tctcactgttgccc

SEQ ID NO: 2221939 - DNA, 21 bp, Homo sapiens
tctcactgttgcccaggctgg

SEQ ID NO: 2221940 - DNA, 12 bp, Homo sapiens
tctcaggccaaa

SEQ ID NO: 2221941 - DNA, 13 bp, Homo sapiens
tctcaggccagct

SEQ ID NO: 2221942 - DNA, 17 bp, Homo sapiens
tctcaggccagctgctt

SEQ ID NO: 2221943 - DNA, 19 bp, Homo sapiens
tctcagggcctggtcgttt

SEQ ID NO: 2221944 - DNA, 14 bp, Homo sapiens
tctcatttgtcaca

SEQ ID NO: 2221945 - DNA, 16 bp, Homo sapiens
tctcatttgtcacaca

SEQ ID NO: 2221946 - DNA, 13 bp, Homo sapiens
tctccaaaataaa

SEQ ID NO: 2221947 - DNA, 19 bp, Homo sapiens
tctccaaaataaaactttt

SEQ ID NO: 2221948 - DNA, 22 bp, Homo sapiens
tctccaaaataaaactttttaa

SEQ ID NO: 2221949 - DNA, 19 bp, Homo sapiens
tctccaagcaggacatgga

SEQ ID NO: 2221950 - DNA, 13 bp, Homo sapiens
tctccaccctgct

SEQ ID NO: 2221951 - DNA, 17 bp, Homo sapiens
tctccaccctgctctcc

SEQ ID NO: 2221952 - DNA, 19 bp, Homo sapiens
tctccacctgccagggaca

SEQ ID NO: 2221953 - DNA, 14 bp, Homo sapiens
tctccagcccctgg

SEQ ID NO: 2221954 - DNA, 16 bp, Homo sapiens
tctccagcccctggat

SEQ ID NO: 2221955 - DNA, 16 bp, Homo sapiens
tctccatgtttgatgt

SEQ ID NO: 2221956 - DNA, 18 bp, Homo sapiens
tctcccccagccccatcc

SEQ ID NO: 2221957 - DNA, 22 bp, Homo sapiens
tctcccccagccccatcctctg

SEQ ID NO: 2221958 - DNA, 14 bp, Homo sapiens
tctcctctgctgct

SEQ ID NO: 2221959 - DNA, 15 bp, Homo sapiens
tctcctgcctcagcc

SEQ ID NO: 2221960 - DNA, 21 bp, Homo sapiens
tctcctggaaatattaagaaa

SEQ ID NO: 2221961 - DNA, 15 bp, Homo sapiens
tctccttcacctttg

SEQ ID NO: 2221962 - DNA, 18 bp, Homo sapiens
tctccttcacctttgtcc

SEQ ID NO: 2221963 - DNA, 21 bp, Homo sapiens
tctccttgtgttactaagttt

SEQ ID NO: 2221964 - DNA, 14 bp, Homo sapiens
tctcgtgattgata

SEQ ID NO: 2221965 - DNA, 15 bp, Homo sapiens
tctctagtttgatta

SEQ ID NO: 2221966 - DNA, 15 bp, Homo sapiens
tctctccagcccctg

SEQ ID NO: 2221967 - DNA, 15 bp, Homo sapiens
tctctgccctccaag

SEQ ID NO: 2221968 - DNA, 14 bp, Homo sapiens
tctcttgattcata

SEQ ID NO: 2221969 - DNA, 21 bp, Homo sapiens
tctctttaatgtcacaggcag

SEQ ID NO: 2221970 - DNA, 15 bp, Homo sapiens
tctcttttcaaaaca

SEQ ID NO: 2221971 - DNA, 13 bp, Homo sapiens
tctgaaagggacg

SEQ ID NO: 2221972 - DNA, 18 bp, Homo sapiens
tctgacacacagctctgt

SEQ ID NO: 2221973 - DNA, 21 bp, Homo sapiens
tctgacaggcaatgctggctg

SEQ ID NO: 2221974 - DNA, 22 bp, Homo sapiens
tctgacaggcaatgctggctgt

SEQ ID NO: 2221975 - DNA, 14 bp, Homo sapiens
tctgacccactgct

SEQ ID NO: 2221976 - DNA, 15 bp, Homo sapiens
tctgacccactgctt

SEQ ID NO: 2221977 - DNA, 16 bp, Homo sapiens
tctgacccatgctgcc

SEQ ID NO: 2221978 - DNA, 20 bp, Homo sapiens
tctgacccatgctgccctgt

SEQ ID NO: 2221979 - DNA, 22 bp, Homo sapiens
tctgacccatgctgccctgtga

SEQ ID NO: 2221980 - DNA, 22 bp, Homo sapiens
tctgagactcgcgacaatgcaa

SEQ ID NO: 2221981 - DNA, 22 bp, Homo sapiens
tctgaggaatccagacccggct

SEQ ID NO: 2221982 - DNA, 14 bp, Homo sapiens
tctgcacaagctgc

SEQ ID NO: 2221983 - DNA, 14 bp, Homo sapiens
tctgcactcccctg

SEQ ID NO: 2221984 - DNA, 16 bp, Homo sapiens
tctgcactcccctgct

SEQ ID NO: 2221985 - DNA, 22 bp, Homo sapiens
tctgcactcccctgctgggtgt

SEQ ID NO: 2221986 - DNA, 18 bp, Homo sapiens
tctgccatattctgttgg

SEQ ID NO: 2221987 - DNA, 23 bp, Homo sapiens
tctgccatattctgttggccagt

SEQ ID NO: 2221988 - DNA, 12 bp, Homo sapiens
tctgcccactcc

SEQ ID NO: 2221989 - DNA, 14 bp, Homo sapiens
tctgcccactccct

SEQ ID NO: 2221990 - DNA, 16 bp, Homo sapiens
tctgcccactccctgc

SEQ ID NO: 2221991 - DNA, 17 bp, Homo sapiens
tctgcccactccctgca

SEQ ID NO: 2221992 - DNA, 23 bp, Homo sapiens
tctgcccttggttaggcattgtg

SEQ ID NO: 2221993 - DNA, 15 bp, Homo sapiens
tctgcctcccatcac

SEQ ID NO: 2221994 - DNA, 21 bp, Homo sapiens
tctgcctcccatcacccgcta

SEQ ID NO: 2221995 - DNA, 15 bp, Homo sapiens
tctgcctctgacaca

SEQ ID NO: 2221996 - DNA, 18 bp, Homo sapiens
tctgcctctgacacacag

SEQ ID NO: 2221997 - DNA, 20 bp, Homo sapiens
tctgcctgaagtcacacagt

SEQ ID NO: 2221998 - DNA, 16 bp, Homo sapiens
tctgcctgcccaggcc

SEQ ID NO: 2221999 - DNA, 21 bp, Homo sapiens
tctgcctgcccaggcccctgc

SEQ ID NO: 2222000 - DNA, 20 bp, Homo sapiens
tctgctcacatatctgtcat

SEQ ID NO: 2222001 - DNA, 17 bp, Homo sapiens
tctgctgacagacacag

SEQ ID NO: 2222002 - DNA, 15 bp, Homo sapiens
tctgctgctggctgg

SEQ ID NO: 2222003 - DNA, 23 bp, Homo sapiens
tctgctttttaaagaatgctctt

SEQ ID NO: 2222004 - DNA, 21 bp, Homo sapiens
tctggacaggcatgttctctg

SEQ ID NO: 2222005 - DNA, 21 bp, Homo sapiens
tctggcagctcagagagggtg

SEQ ID NO: 2222006 - DNA, 22 bp, Homo sapiens
tctggctatgcatttgaaaatt

SEQ ID NO: 2222007 - DNA, 16 bp, Homo sapiens
tctggctcttccaggc

SEQ ID NO: 2222008 - DNA, 17 bp, Homo sapiens
tctggctcttccaggct

SEQ ID NO: 2222009 - DNA, 15 bp, Homo sapiens
tctggggtgggaggg

SEQ ID NO: 2222010 - DNA, 14 bp, Homo sapiens
tctgggttcactgc

SEQ ID NO: 2222011 - DNA, 16 bp, Homo sapiens
tctggtgactttcctc

SEQ ID NO: 2222012 - DNA, 14 bp, Homo sapiens
tctgtacagagccc

SEQ ID NO: 2222013 - DNA, 15 bp, Homo sapiens
tctgtacagagccca

SEQ ID NO: 2222014 - DNA, 18 bp, Homo sapiens
tctgtacgtctgacaggc

SEQ ID NO: 2222015 - DNA, 20 bp, Homo sapiens
tctgtcatttgagcagggct

SEQ ID NO: 2222016 - DNA, 23 bp, Homo sapiens
tctgtcatttgagcagggctcag

SEQ ID NO: 2222017 - DNA, 19 bp, Homo sapiens
tctgtccgagctttgaaaa

SEQ ID NO: 2222018 - DNA, 16 bp, Homo sapiens
tctgtcgcccagtctg

SEQ ID NO: 2222019 - DNA, 17 bp, Homo sapiens
tctgtcgcccagtctgg

SEQ ID NO: 2222020 - DNA, 15 bp, Homo sapiens
tctgtgaaaggaaag

SEQ ID NO: 2222021 - DNA, 21 bp, Homo sapiens
tctgtgaaaggaaagagggag

SEQ ID NO: 2222022 - DNA, 21 bp, Homo sapiens
tgcttcaaggatcctgagcca

SEQ ID NO: 2222023 - DNA, 23 bp, Homo sapiens
tgcttcaaggatcctgagccaga

SEQ ID NO: 2222024 - DNA, 23 bp, Homo sapiens
tgcttccagtgaggctctgccct

SEQ ID NO: 2222025 - DNA, 15 bp, Homo sapiens
tgcttggaggaagga

SEQ ID NO: 2222026 - DNA, 16 bp, Homo sapiens
tgcttggaggaaggaa

SEQ ID NO: 2222027 - DNA, 12 bp, Homo sapiens
tgcttgggcttc

SEQ ID NO: 2222028 - DNA, 20 bp, Homo sapiens
tgcttttgtctatgggactc

SEQ ID NO: 2222029 - DNA, 23 bp, Homo sapiens
tgctttttaatattgatatgctt

SEQ ID NO: 2222030 - DNA, 17 bp, Homo sapiens
tggaaaaatagcctgcc

SEQ ID NO: 2222031 - DNA, 15 bp, Homo sapiens
tggaacactctgaga

SEQ ID NO: 2222032 - DNA, 12 bp, Homo sapiens
tggaagacagct

SEQ ID NO: 2222033 - DNA, 16 bp, Homo sapiens
tggaagacagctctta

SEQ ID NO: 2222034 - DNA, 14 bp, Homo sapiens
tggaagcagaaaca

SEQ ID NO: 2222035 - DNA, 15 bp, Homo sapiens
tggaataacatgtaa

SEQ ID NO: 2222036 - DNA, 18 bp, Homo sapiens
tggacacagctcttctcc

SEQ ID NO: 2222037 - DNA, 22 bp, Homo sapiens
tggacacagctcttctccaggc

SEQ ID NO: 2222038 - DNA, 23 bp, Homo sapiens
tggacacagctcttctccaggct

SEQ ID NO: 2222039 - DNA, 12 bp, Homo sapiens
tggacaggcatg

SEQ ID NO: 2222040 - DNA, 16 bp, Homo sapiens
tggacaggcatgttct

SEQ ID NO: 2222041 - DNA, 19 bp, Homo sapiens
tggacatgcacagctaaca

SEQ ID NO: 2222042 - DNA, 13 bp, Homo sapiens
tggaccctgaggc

SEQ ID NO: 2222043 - DNA, 11 bp, Homo sapiens
tggactttgtt

SEQ ID NO: 2222044 - DNA, 23 bp, Homo sapiens
tggagaatttttactggggattc

SEQ ID NO: 2222045 - DNA, 12 bp, Homo sapiens
tggaggaaggaa

SEQ ID NO: 2222046 - DNA, 23 bp, Homo sapiens
tggaggaaggaaacccagctctg

SEQ ID NO: 2222047 - DNA, 20 bp, Homo sapiens
tggatgcctggtggcagctg

SEQ ID NO: 2222048 - DNA, 23 bp, Homo sapiens
tggatgcctggtggcagctgcgg

SEQ ID NO: 2222049 - DNA, 12 bp, Homo sapiens
tggatgttctga

SEQ ID NO: 2222050 - DNA, 17 bp, Homo sapiens
tggatttaacagaaatg

SEQ ID NO: 2222051 - DNA, 20 bp, Homo sapiens
tggcacatcagcacgatttc

SEQ ID NO: 2222052 - DNA, 16 bp, Homo sapiens
tggcacccggcccctg

SEQ ID NO: 2222053 - DNA, 20 bp, Homo sapiens
tggcacccggcccctgctgg

SEQ ID NO: 2222054 - DNA, 15 bp, Homo sapiens
tggcactataatgta

SEQ ID NO: 2222055 - DNA, 22 bp, Homo sapiens
tggcactataatgtaagctcta

SEQ ID NO: 2222056 - DNA, 18 bp, Homo sapiens
tggcactgcttccagtga

SEQ ID NO: 2222057 - DNA, 21 bp, Homo sapiens
tggcagagtggattcttgaac

SEQ ID NO: 2222058 - DNA, 15 bp, Homo sapiens
tggcagagttgaaga

SEQ ID NO: 2222059 - DNA, 19 bp, Homo sapiens
tggcagagttgaagacaga

SEQ ID NO: 2222060 - DNA, 12 bp, Homo sapiens
tggcagcccctg

SEQ ID NO: 2222061 - DNA, 13 bp, Homo sapiens
tggcagccttggc

SEQ ID NO: 2222062 - DNA, 17 bp, Homo sapiens
tggcagccttggcaaac

SEQ ID NO: 2222063 - DNA, 15 bp, Homo sapiens
tggcagctcacctct

SEQ ID NO: 2222064 - DNA, 15 bp, Homo sapiens
tggcagctcagagag

SEQ ID NO: 2222065 - DNA, 22 bp, Homo sapiens
tggcagctgcggtccacccagg

SEQ ID NO: 2222066 - DNA, 13 bp, Homo sapiens
tggcagtgggagc

SEQ ID NO: 2222067 - DNA, 15 bp, Homo sapiens
tggcagtgggagctg

SEQ ID NO: 2222068 - DNA, 16 bp, Homo sapiens
tggcagtgggagctgc

SEQ ID NO: 2222069 - DNA, 12 bp, Homo sapiens
tggcatgggaat

SEQ ID NO: 2222070 - DNA, 22 bp, Homo sapiens
tggcatgggaatgaatgtcagt

SEQ ID NO: 2222071 - DNA, 17 bp, Homo sapiens
tggccagatgcaccagc

SEQ ID NO: 2222072 - DNA, 13 bp, Homo sapiens
tggcccctcaggg

SEQ ID NO: 2222073 - DNA, 20 bp, Homo sapiens
tggcccctcagggtccctgg

SEQ ID NO: 2222074 - DNA, 16 bp, Homo sapiens
tggcccctgcccggct

SEQ ID NO: 2222075 - DNA, 22 bp, Homo sapiens
tggcctcccaactcaccccagc

SEQ ID NO: 2222076 - DNA, 14 bp, Homo sapiens
tggcctctgcactc

SEQ ID NO: 2222077 - DNA, 15 bp, Homo sapiens
tggcctctgcactcc

SEQ ID NO: 2222078 - DNA, 17 bp, Homo sapiens
tggcctctgcactcccc

SEQ ID NO: 2222079 - DNA, 18 bp, Homo sapiens
tggcctctgcactcccct

SEQ ID NO: 2222080 - DNA, 19 bp, Homo sapiens
tggcctctgcactcccctg

SEQ ID NO: 2222081 - DNA, 22 bp, Homo sapiens
tggcgtgcagtggtgcgatctg

SEQ ID NO: 2222082 - DNA, 14 bp, Homo sapiens
tggctaaattcatg

SEQ ID NO: 2222083 - DNA, 15 bp, Homo sapiens
tggctatgcatttga

SEQ ID NO: 2222084 - DNA, 17 bp, Homo sapiens
tggctatgcatttgaaa

SEQ ID NO: 2222085 - DNA, 18 bp, Homo sapiens
tggctcaagtcctctttt

SEQ ID NO: 2222086 - DNA, 13 bp, Homo sapiens
tggctcacgcctg

SEQ ID NO: 2222087 - DNA, 22 bp, Homo sapiens
tggctcaggtggggtcactctg

SEQ ID NO: 2222088 - DNA, 13 bp, Homo sapiens
tggctcttccagg

SEQ ID NO: 2222089 - DNA, 15 bp, Homo sapiens
tggctcttccaggct

SEQ ID NO: 2222090 - DNA, 21 bp, Homo sapiens
tggctcttccaggctgggaga

SEQ ID NO: 2222091 - DNA, 14 bp, Homo sapiens
tggctgcagggagt

SEQ ID NO: 2222092 - DNA, 13 bp, Homo sapiens
tggctgctgaagg

SEQ ID NO: 2222093 - DNA, 14 bp, Homo sapiens
tggctgctgaaggc

SEQ ID NO: 2222094 - DNA, 11 bp, Homo sapiens
tggctgcttca

SEQ ID NO: 2222095 - DNA, 15 bp, Homo sapiens
tggctgcttcaagga

SEQ ID NO: 2222096 - DNA, 21 bp, Homo sapiens
tggctgcttcaaggatcctga

SEQ ID NO: 2222097 - DNA, 14 bp, Homo sapiens
tggctgggggcctc

SEQ ID NO: 2222098 - DNA, 21 bp, Homo sapiens
tggctgggggcctcagtgcca

SEQ ID NO: 2222099 - DNA, 14 bp, Homo sapiens
tggcttcacggaag

SEQ ID NO: 2222100 - DNA, 22 bp, Homo sapiens
tggcttcacggaagagccttgc

SEQ ID NO: 2222101 - DNA, 20 bp, Homo sapiens
tggcttggggggctccaggg

SEQ ID NO: 2222102 - DNA, 16 bp, Homo sapiens
tgggaaaggggaagtt

SEQ ID NO: 2222103 - DNA, 16 bp, Homo sapiens
tgggaatgaatgtcag

SEQ ID NO: 2222104 - DNA, 21 bp, Homo sapiens
tgggaatgaatgtcagtgtga

SEQ ID NO: 2222105 - DNA, 13 bp, Homo sapiens
tgggacaccctgt

SEQ ID NO: 2222106 - DNA, 15 bp, Homo sapiens
tgggactacaggcac

SEQ ID NO: 2222107 - DNA, 16 bp, Homo sapiens
tgggactacaggcacc

SEQ ID NO: 2222108 - DNA, 21 bp, Homo sapiens
tgggagagaagagaatgcaca

SEQ ID NO: 2222109 - DNA, 12 bp, Homo sapiens
tgggagctgcct

SEQ ID NO: 2222110 - DNA, 13 bp, Homo sapiens
tgggagctgcctg

SEQ ID NO: 2222111 - DNA, 14 bp, Homo sapiens
tgggagctgcctgt

SEQ ID NO: 2222112 - DNA, 17 bp, Homo sapiens
tgggagctgcctgttca

SEQ ID NO: 2222113 - DNA, 21 bp, Homo sapiens
tgggagctgcctgttcagctc

SEQ ID NO: 2222114 - DNA, 23 bp, Homo sapiens
tgggagctgcctgttcagctcca

SEQ ID NO: 2222115 - DNA, 16 bp, Homo sapiens
tgggaggatctcttga

SEQ ID NO: 2222116 - DNA, 21 bp, Homo sapiens
tgggaggatctcttgagcctg

SEQ ID NO: 2222117 - DNA, 12 bp, Homo sapiens
tgggaggggaag

SEQ ID NO: 2222118 - DNA, 17 bp, Homo sapiens
tgggaggggaagaaaaa

SEQ ID NO: 2222119 - DNA, 20 bp, Homo sapiens
tgggaggtcaaggctgcagt

SEQ ID NO: 2222120 - DNA, 16 bp, Homo sapiens
tgggagtgggcccaat

SEQ ID NO: 2222121 - DNA, 13 bp, Homo sapiens
tgggatcctccag

SEQ ID NO: 2222122 - DNA, 13 bp, Homo sapiens
tgggatcctggag

SEQ ID NO: 2222123 - DNA, 20 bp, Homo sapiens
tgggcaacccccagcctgct

SEQ ID NO: 2222124 - DNA, 20 bp, Homo sapiens
tgggcagaaggaagacttca

SEQ ID NO: 2222125 - DNA, 16 bp, Homo sapiens
tgggcctcctgtgtgt

SEQ ID NO: 2222126 - DNA, 22 bp, Homo sapiens
tgggcctcctgtgtgtgcgcct

SEQ ID NO: 2222127 - DNA, 22 bp, Homo sapiens
tgggctaagtgatcctcccacc

SEQ ID NO: 2222128 - DNA, 15 bp, Homo sapiens
tgggctcccttccca

SEQ ID NO: 2222129 - DNA, 18 bp, Homo sapiens
tgggctcccttcccacct

SEQ ID NO: 2222130 - DNA, 18 bp, Homo sapiens
tgggcttcagtggcagct

SEQ ID NO: 2222131 - DNA, 22 bp, Homo sapiens
tgggcttggggaccagagctgc

SEQ ID NO: 2222132 - DNA, 15 bp, Homo sapiens
tggggacctcaggcc

SEQ ID NO: 2222133 - DNA, 23 bp, Homo sapiens
tggggacctcaggcctgggggct

SEQ ID NO: 2222134 - DNA, 12 bp, Homo sapiens
tggggattcttg

SEQ ID NO: 2222135 - DNA, 20 bp, Homo sapiens
tggggattcttgaacttgaa

SEQ ID NO: 2222136 - DNA, 20 bp, Homo sapiens
tggggccagttggtccccct

SEQ ID NO: 2222137 - DNA, 11 bp, Homo sapiens
tggggcctggg

SEQ ID NO: 2222138 - DNA, 22 bp, Homo sapiens
tggggctgcaccggctggcctg

SEQ ID NO: 2222139 - DNA, 15 bp, Homo sapiens
tggggctggaagcag

SEQ ID NO: 2222140 - DNA, 17 bp, Homo sapiens
tgggggctgggcagagg

SEQ ID NO: 2222141 - DNA, 12 bp, Homo sapiens
tgggggtgcatt

SEQ ID NO: 2222142 - DNA, 15 bp, Homo sapiens
tgggggtgcatttga

SEQ ID NO: 2222143 - DNA, 16 bp, Homo sapiens
tggggtacccactgct

SEQ ID NO: 2222144 - DNA, 17 bp, Homo sapiens
tggggtcactctggcag

SEQ ID NO: 2222145 - DNA, 14 bp, Homo sapiens
tggggtgggagggt

SEQ ID NO: 2222146 - DNA, 17 bp, Homo sapiens
tggggtggggacctcag

SEQ ID NO: 2222147 - DNA, 22 bp, Homo sapiens
ttggtcccccttccatggactt

SEQ ID NO: 2222148 - DNA, 13 bp, Homo sapiens
ttggtctgtgtga

SEQ ID NO: 2222149 - DNA, 19 bp, Homo sapiens
ttggtggtttcagaaatgt

SEQ ID NO: 2222150 - DNA, 19 bp, Homo sapiens
ttgtattctctcctgtacc

SEQ ID NO: 2222151 - DNA, 21 bp, Homo sapiens
ttgtcatataagattcatatt

SEQ ID NO: 2222152 - DNA, 18 bp, Homo sapiens
ttgtccccaccgcagaca

SEQ ID NO: 2222153 - DNA, 15 bp, Homo sapiens
ttgtccccgaccctt

SEQ ID NO: 2222154 - DNA, 16 bp, Homo sapiens
ttgtccccgacccttg

SEQ ID NO: 2222155 - DNA, 15 bp, Homo sapiens
ttgtcttaaaaagtg

SEQ ID NO: 2222156 - DNA, 20 bp, Homo sapiens
ttgtctttggaccctgaggc

SEQ ID NO: 2222157 - DNA, 17 bp, Homo sapiens
ttgtgaggaagccgctg

SEQ ID NO: 2222158 - DNA, 18 bp, Homo sapiens
ttgtgatacaatgctgtg

SEQ ID NO: 2222159 - DNA, 16 bp, Homo sapiens
ttgtggacacagctct

SEQ ID NO: 2222160 - DNA, 17 bp, Homo sapiens
ttgtggacacagctctt

SEQ ID NO: 2222161 - DNA, 21 bp, Homo sapiens
ttgtggatttaacagaaatgt

SEQ ID NO: 2222162 - DNA, 13 bp, Homo sapiens
ttgtgttactaag

SEQ ID NO: 2222163 - DNA, 19 bp, Homo sapiens
ttgttctggctcttccagg

SEQ ID NO: 2222164 - DNA, 20 bp, Homo sapiens
ttgttctggctcttccaggc

SEQ ID NO: 2222165 - DNA, 22 bp, Homo sapiens
ttgttctggctcttccaggctg

SEQ ID NO: 2222166 - DNA, 17 bp, Homo sapiens
ttgttcttggtttgtaa

SEQ ID NO: 2222167 - DNA, 15 bp, Homo sapiens
tttaaaaatccccaa

SEQ ID NO: 2222168 - DNA, 13 bp, Homo sapiens
tttaaaagataca

SEQ ID NO: 2222169 - DNA, 11 bp, Homo sapiens
tttaaatgcac

SEQ ID NO: 2222170 - DNA, 13 bp, Homo sapiens
tttaacagaaatg

SEQ ID NO: 2222171 - DNA, 14 bp, Homo sapiens
tttaacagaaatgt

SEQ ID NO: 2222172 - DNA, 21 bp, Homo sapiens
tttaagctgttactgtcttca

SEQ ID NO: 2222173 - DNA, 22 bp, Homo sapiens
tttaaggatgcttgtacataat

SEQ ID NO: 2222174 - DNA, 15 bp, Homo sapiens
tttaagtgctgcatt

SEQ ID NO: 2222175 - DNA, 19 bp, Homo sapiens
tttaagtgctgcatttaaa

SEQ ID NO: 2222176 - DNA, 12 bp, Homo sapiens
tttaattcagtt

SEQ ID NO: 2222177 - DNA, 18 bp, Homo sapiens
tttacctgaagtctttgt

SEQ ID NO: 2222178 - DNA, 14 bp, Homo sapiens
tttaccttttttat

SEQ ID NO: 2222179 - DNA, 21 bp, Homo sapiens
tttaccttttttatacataaa

SEQ ID NO: 2222180 - DNA, 14 bp, Homo sapiens
tttacttcttatac

SEQ ID NO: 2222181 - DNA, 19 bp, Homo sapiens
tttacttcttatacatttg

SEQ ID NO: 2222182 - DNA, 12 bp, Homo sapiens
tttatacataaa

SEQ ID NO: 2222183 - DNA, 16 bp, Homo sapiens
tttattgtcaaagtgg

SEQ ID NO: 2222184 - DNA, 15 bp, Homo sapiens
tttcaaactttacta

SEQ ID NO: 2222185 - DNA, 22 bp, Homo sapiens
tttcaaactttactatggccct

SEQ ID NO: 2222186 - DNA, 12 bp, Homo sapiens
tttcaataggaa

SEQ ID NO: 2222187 - DNA, 17 bp, Homo sapiens
tttcaataggaaaaact

SEQ ID NO: 2222188 - DNA, 14 bp, Homo sapiens
tttcactctccttg

SEQ ID NO: 2222189 - DNA, 12 bp, Homo sapiens
tttcagaaatgt

SEQ ID NO: 2222190 - DNA, 16 bp, Homo sapiens
tttccctattagagaa

SEQ ID NO: 2222191 - DNA, 22 bp, Homo sapiens
tttcgcaggattcttcctccct

SEQ ID NO: 2222192 - DNA, 16 bp, Homo sapiens
tttcggctaaaaagaa

SEQ ID NO: 2222193 - DNA, 21 bp, Homo sapiens
tttctaaaggctacctttgta

SEQ ID NO: 2222194 - DNA, 15 bp, Homo sapiens
tttctatgacacatg

SEQ ID NO: 2222195 - DNA, 15 bp, Homo sapiens
tttctggctatgcat

SEQ ID NO: 2222196 - DNA, 13 bp, Homo sapiens
tttcttctccctc

SEQ ID NO: 2222197 - DNA, 13 bp, Homo sapiens
tttctttgtggct

SEQ ID NO: 2222198 - DNA, 22 bp, Homo sapiens
tttcttttttcggctaaaaaga

SEQ ID NO: 2222199 - DNA, 15 bp, Homo sapiens
tttgaactgataaag

SEQ ID NO: 2222200 - DNA, 19 bp, Homo sapiens
tttgaactgataaagatga

SEQ ID NO: 2222201 - DNA, 12 bp, Homo sapiens
tttgacctctgc

SEQ ID NO: 2222202 - DNA, 13 bp, Homo sapiens
tttgacgccatcc

SEQ ID NO: 2222203 - DNA, 14 bp, Homo sapiens
tttgacgccatccc

SEQ ID NO: 2222204 - DNA, 20 bp, Homo sapiens
tttgacgccatcccagcccc

SEQ ID NO: 2222205 - DNA, 16 bp, Homo sapiens
tttgagatcagcctgg

SEQ ID NO: 2222206 - DNA, 15 bp, Homo sapiens
tttgatccaagctgg

SEQ ID NO: 2222207 - DNA, 23 bp, Homo sapiens
tttgattaaattcttgcaaagta

SEQ ID NO: 2222208 - DNA, 15 bp, Homo sapiens
tttgctttgtgattt

SEQ ID NO: 2222209 - DNA, 16 bp, Homo sapiens
tttgctttgtgatttt

SEQ ID NO: 2222210 - DNA, 22 bp, Homo sapiens
tttggattggatgaattccaaa

SEQ ID NO: 2222211 - DNA, 13 bp, Homo sapiens
tttggctgctgaa

SEQ ID NO: 2222212 - DNA, 22 bp, Homo sapiens
tttggggtacccactgctctgg

SEQ ID NO: 2222213 - DNA, 19 bp, Homo sapiens
tttggtggtttcagaaatg

SEQ ID NO: 2222214 - DNA, 16 bp, Homo sapiens
tttgtaaattaacttt

SEQ ID NO: 2222215 - DNA, 22 bp, Homo sapiens
tttgtaaattaacttttataaa

SEQ ID NO: 2222216 - DNA, 13 bp, Homo sapiens
tttgtagagccag

SEQ ID NO: 2222217 - DNA, 13 bp, Homo sapiens
tttgtcttaaaaa

SEQ ID NO: 2222218 - DNA, 14 bp, Homo sapiens
tttgtcttaaaaag

SEQ ID NO: 2222219 - DNA, 18 bp, Homo sapiens
tttgtgaggaagccgctg

SEQ ID NO: 2222220 - DNA, 22 bp, Homo sapiens
tttgtgcattatctagatactg

SEQ ID NO: 2222221 - DNA, 12 bp, Homo sapiens
tttgtttgaact

SEQ ID NO: 2222222 - DNA, 17 bp, Homo sapiens
ttttaaagaatgctctt

SEQ ID NO: 2222223 - DNA, 16 bp, Homo sapiens
ttttaagaggcagggt

SEQ ID NO: 2222224 - DNA, 15 bp, Homo sapiens
ttttaagtgctgcat

SEQ ID NO: 2222225 - DNA, 21 bp, Homo sapiens
ttttaagtgctgcatttaaaa

SEQ ID NO: 2222226 - DNA, 15 bp, Homo sapiens
ttttactaatagaca

SEQ ID NO: 2222227 - DNA, 15 bp, Homo sapiens
ttttagtagagacag

SEQ ID NO: 2222228 - DNA, 13 bp, Homo sapiens
ttttataaacttt

SEQ ID NO: 2222229 - DNA, 18 bp, Homo sapiens
ttttatcgtcactgctta

SEQ ID NO: 2222230 - DNA, 19 bp, Homo sapiens
ttttatggcttttgtgcat

SEQ ID NO: 2222231 - DNA, 21 bp, Homo sapiens
ttttatggcttttgtgcatta

SEQ ID NO: 2222232 - DNA, 20 bp, Homo sapiens
ttttcatttaggtgaggaag

SEQ ID NO: 2222233 - DNA, 22 bp, Homo sapiens
ttttcttgtgtgtttattgtca

SEQ ID NO: 2222234 - DNA, 17 bp, Homo sapiens
ttttgatccaagctggt

SEQ ID NO: 2222235 - DNA, 16 bp, Homo sapiens
ttttgtcatataagat

SEQ ID NO: 2222236 - DNA, 21 bp, Homo sapiens
ttttgttccacaagttaaata

SEQ ID NO: 2222237 - DNA, 18 bp, Homo sapiens
tttttaagtgctgcattt

SEQ ID NO: 2222238 - DNA, 20 bp, Homo sapiens
tttttatcgtcactgcttaa

SEQ ID NO: 2222239 - DNA, 22 bp, Homo sapiens
tttttatggcttttgtgcatta

SEQ ID NO: 2222240 - DNA, 11 bp, Homo sapiens
tttttttacta

SEQ ID NO: 2222241 - DNA, 17 bp, Homo sapiens
aaggggcccaagagaga

SEQ ID NO: 2222242 - DNA, 12 bp, Homo sapiens
aagggggctggg

SEQ ID NO: 2222243 - DNA, 16 bp, Homo sapiens
aagggtatctggtgac

SEQ ID NO: 2222244 - DNA, 20 bp, Homo sapiens
aaggtagaaatatctgaaaa

SEQ ID NO: 2222245 - DNA, 19 bp, Homo sapiens
aaggtcattttttttaaga

SEQ ID NO: 2222246 - DNA, 11 bp, Homo sapiens
aaggtgggagg

SEQ ID NO: 2222247 - DNA, 12 bp, Homo sapiens
aagtaatatgca

SEQ ID NO: 2222248 - DNA, 20 bp, Homo sapiens
aagtacactgtttcaaactt

SEQ ID NO: 2222249 - DNA, 17 bp, Homo sapiens
aagtactataatttacc

SEQ ID NO: 2222250 - DNA, 15 bp, Homo sapiens
aagtactatgtatca

SEQ ID NO: 2222251 - DNA, 16 bp, Homo sapiens
aagtactatgtatcaa

SEQ ID NO: 2222252 - DNA, 19 bp, Homo sapiens
aagtacttctccaccctgc

SEQ ID NO: 2222253 - DNA, 19 bp, Homo sapiens
aagtattcttatttaatga

SEQ ID NO: 2222254 - DNA, 21 bp, Homo sapiens
aagtcaagtgaaaaaggagga

SEQ ID NO: 2222255 - DNA, 16 bp, Homo sapiens
aagtcttagatgtata

SEQ ID NO: 2222256 - DNA, 20 bp, Homo sapiens
aagtgattctcctgcctcag

SEQ ID NO: 2222257 - DNA, 22 bp, Homo sapiens
aagtgctgcatttaaaagatac

SEQ ID NO: 2222258 - DNA, 21 bp, Homo sapiens
aagtggaaaaatagcctgcct

SEQ ID NO: 2222259 - DNA, 23 bp, Homo sapiens
aagtgtatttttttactaataga

SEQ ID NO: 2222260 - DNA, 22 bp, Homo sapiens
aagttgtaggcataaagtcagg

SEQ ID NO: 2222261 - DNA, 21 bp, Homo sapiens
aagtttctgccgcagccctgc

SEQ ID NO: 2222262 - DNA, 14 bp, Homo sapiens
aataaaacttttta

SEQ ID NO: 2222263 - DNA, 15 bp, Homo sapiens
aataaaactttttaa

SEQ ID NO: 2222264 - DNA, 18 bp, Homo sapiens
aataaaactttttaaaat

SEQ ID NO: 2222265 - DNA, 12 bp, Homo sapiens
aataaattattt

SEQ ID NO: 2222266 - DNA, 12 bp, Homo sapiens
aataacatgtaa

SEQ ID NO: 2222267 - DNA, 19 bp, Homo sapiens
aataacatgtaattaagta

SEQ ID NO: 2222268 - DNA, 15 bp, Homo sapiens
aataactaaaaggta

SEQ ID NO: 2222269 - DNA, 22 bp, Homo sapiens
aataatgtgaaactggattaaa

SEQ ID NO: 2222270 - DNA, 19 bp, Homo sapiens
aataatgttaacatggaca

SEQ ID NO: 2222271 - DNA, 15 bp, Homo sapiens
aatacaccactacat

SEQ ID NO: 2222272 - DNA, 18 bp, Homo sapiens
aatacaccactacattct

SEQ ID NO: 2222273 - DNA, 17 bp, Homo sapiens
aataccagccagtaaat

SEQ ID NO: 2222274 - DNA, 19 bp, Homo sapiens
aataccagccagtaaatgg

SEQ ID NO: 2222275 - DNA, 21 bp, Homo sapiens
aatacctgtccccctgacaac

SEQ ID NO: 2222276 - DNA, 18 bp, Homo sapiens
aatagacaatttattatg

SEQ ID NO: 2222277 - DNA, 20 bp, Homo sapiens
aatataggaacttaaataat

SEQ ID NO: 2222278 - DNA, 16 bp, Homo sapiens
aatatctgaaaatgta

SEQ ID NO: 2222279 - DNA, 20 bp, Homo sapiens
aatatctgaaaatgtatgtg

SEQ ID NO: 2222280 - DNA, 21 bp, Homo sapiens
aatattgctgatggtgcaatg

SEQ ID NO: 2222281 - DNA, 14 bp, Homo sapiens
aatcaccgaaaacg

SEQ ID NO: 2222282 - DNA, 18 bp, Homo sapiens
aatcagcctgctccagct

SEQ ID NO: 2222283 - DNA, 15 bp, Homo sapiens
aatcattaggtgtga

SEQ ID NO: 2222284 - DNA, 18 bp, Homo sapiens
aatctaaatggaaccact

SEQ ID NO: 2222285 - DNA, 15 bp, Homo sapiens
aatctcaaataacta

SEQ ID NO: 2222286 - DNA, 12 bp, Homo sapiens
aatctcaaattt

SEQ ID NO: 2222287 - DNA, 18 bp, Homo sapiens
aatctccaaaataaaact

SEQ ID NO: 2222288 - DNA, 23 bp, Homo sapiens
aatgaaaaaaaaaggggggtggg

SEQ ID NO: 2222289 - DNA, 20 bp, Homo sapiens
aatgaaagactgtacaaagt

SEQ ID NO: 2222290 - DNA, 17 bp, Homo sapiens
aatgaaccacatcttgc

SEQ ID NO: 2222291 - DNA, 23 bp, Homo sapiens
aatgaaccacatcttgctctgct

SEQ ID NO: 2222292 - DNA, 15 bp, Homo sapiens
aatgaatgtcagtgt

SEQ ID NO: 2222293 - DNA, 22 bp, Homo sapiens
aatgaatgtcagtgtgactgat

SEQ ID NO: 2222294 - DNA, 14 bp, Homo sapiens
aatgacctttcaat

SEQ ID NO: 2222295 - DNA, 16 bp, Homo sapiens
aatgacctttcaatag

SEQ ID NO: 2222296 - DNA, 18 bp, Homo sapiens
aatgacttactgtacatg

SEQ ID NO: 2222297 - DNA, 20 bp, Homo sapiens
aatgatgccatgaggaacaa

SEQ ID NO: 2222298 - DNA, 19 bp, Homo sapiens
aatgcacaaacagaggccg

SEQ ID NO: 2222299 - DNA, 16 bp, Homo sapiens
aatgcactttgttctg

SEQ ID NO: 2222300 - DNA, 19 bp, Homo sapiens
aatgcactttgttctggct

SEQ ID NO: 2222301 - DNA, 19 bp, Homo sapiens
aatgcagagatgtgccccc

SEQ ID NO: 2222302 - DNA, 23 bp, Homo sapiens
aatgcccagccccttctgaccca

SEQ ID NO: 2222303 - DNA, 15 bp, Homo sapiens
aatgcgggggagcag

SEQ ID NO: 2222304 - DNA, 18 bp, Homo sapiens
aatgcgtgcataccactt

SEQ ID NO: 2222305 - DNA, 19 bp, Homo sapiens
aatgcgtgcataccacttt

SEQ ID NO: 2222306 - DNA, 13 bp, Homo sapiens
aatgctgtgccct

SEQ ID NO: 2222307 - DNA, 21 bp, Homo sapiens
aatgctgtgccctaaagtgta

SEQ ID NO: 2222308 - DNA, 16 bp, Homo sapiens
aatggaagacagctct

SEQ ID NO: 2222309 - DNA, 13 bp, Homo sapiens
aatgggacactaa

SEQ ID NO: 2222310 - DNA, 14 bp, Homo sapiens
aatgggagctcatg

SEQ ID NO: 2222311 - DNA, 13 bp, Homo sapiens
aatgggcagagca

SEQ ID NO: 2222312 - DNA, 14 bp, Homo sapiens
aatggttttcaaaa

SEQ ID NO: 2222313 - DNA, 16 bp, Homo sapiens
aatggttttcttgtgt

SEQ ID NO: 2222314 - DNA, 21 bp, Homo sapiens
aatgtacagcaaggagattta

SEQ ID NO: 2222315 - DNA, 23 bp, Homo sapiens
aatgtacagcaaggagatttaca

SEQ ID NO: 2222316 - DNA, 14 bp, Homo sapiens
aatgtactgcatat

SEQ ID NO: 2222317 - DNA, 18 bp, Homo sapiens
aatgtactgcatatgaaa

SEQ ID NO: 2222318 - DNA, 12 bp, Homo sapiens
aatgtatgtgta

SEQ ID NO: 2222319 - DNA, 14 bp, Homo sapiens
aatgtcacaggcag

SEQ ID NO: 2222320 - DNA, 15 bp, Homo sapiens
aatgtcacaggcagg

SEQ ID NO: 2222321 - DNA, 13 bp, Homo sapiens
aatgtcagtgtga

SEQ ID NO: 2222322 - DNA, 17 bp, Homo sapiens
aatgtcagtgtgactga

SEQ ID NO: 2222323 - DNA, 20 bp, Homo sapiens
aatgtctctttaatgtcaca

SEQ ID NO: 2222324 - DNA, 19 bp, Homo sapiens
aatgtgaaaagaaaaatga

SEQ ID NO: 2222325 - DNA, 14 bp, Homo sapiens
aatgtgaaactgga

SEQ ID NO: 2222326 - DNA, 11 bp, Homo sapiens
aattaactttt

SEQ ID NO: 2222327 - DNA, 15 bp, Homo sapiens
aattaacttttataa

SEQ ID NO: 2222328 - DNA, 11 bp, Homo sapiens
aattacaggaa

SEQ ID NO: 2222329 - DNA, 19 bp, Homo sapiens
aattacaggaagtactgga

SEQ ID NO: 2222330 - DNA, 20 bp, Homo sapiens
aattacaggaagtactggag

SEQ ID NO: 2222331 - DNA, 14 bp, Homo sapiens
aattctgtttttct

SEQ ID NO: 2222332 - DNA, 18 bp, Homo sapiens
aattctgtttttctaggc

SEQ ID NO: 2222333 - DNA, 13 bp, Homo sapiens
aattcttaaatat

SEQ ID NO: 2222334 - DNA, 22 bp, Homo sapiens
aattcttctccactttctagcc

SEQ ID NO: 2222335 - DNA, 20 bp, Homo sapiens
aattcttgcaaagtatccct

SEQ ID NO: 2222336 - DNA, 19 bp, Homo sapiens
aatttacatactctgctta

SEQ ID NO: 2222337 - DNA, 13 bp, Homo sapiens
aatttattatggc

SEQ ID NO: 2222338 - DNA, 17 bp, Homo sapiens
aatttattatggcacat

SEQ ID NO: 2222339 - DNA, 13 bp, Homo sapiens
aatttctaaatct

SEQ ID NO: 2222340 - DNA, 21 bp, Homo sapiens
aatttctaaatctccaaaata

SEQ ID NO: 2222341 - DNA, 17 bp, Homo sapiens
aatttgtgatacaatgc

SEQ ID NO: 2222342 - DNA, 16 bp, Homo sapiens
aatttgttataatgaa

SEQ ID NO: 2222343 - DNA, 11 bp, Homo sapiens
acaaaagcatg

SEQ ID NO: 2222344 - DNA, 15 bp, Homo sapiens
acaaacgggctcagc

SEQ ID NO: 2222345 - DNA, 15 bp, Homo sapiens
acaacaacaaaatga

SEQ ID NO: 2222346 - DNA, 23 bp, Homo sapiens
acaacactcattgacctgaggcc

SEQ ID NO: 2222347 - DNA, 18 bp, Homo sapiens
acaagaccacgtttctaa

SEQ ID NO: 2222348 - DNA, 19 bp, Homo sapiens
acaagaccacgtttctaaa

SEQ ID NO: 2222349 - DNA, 18 bp, Homo sapiens
acaagagcccaggcctcc

SEQ ID NO: 2222350 - DNA, 15 bp, Homo sapiens
acaagctccaagctc

SEQ ID NO: 2222351 - DNA, 16 bp, Homo sapiens
acaagctccaagctcc

SEQ ID NO: 2222352 - DNA, 19 bp, Homo sapiens
acaagctccaagctcccag

SEQ ID NO: 2222353 - DNA, 16 bp, Homo sapiens
acaaggattgctactg

SEQ ID NO: 2222354 - DNA, 12 bp, Homo sapiens
acaaggcaaggc

SEQ ID NO: 2222355 - DNA, 20 bp, Homo sapiens
acaatgacttactgtacatg

SEQ ID NO: 2222356 - DNA, 17 bp, Homo sapiens
acaatgcaaaccatcat

SEQ ID NO: 2222357 - DNA, 23 bp, Homo sapiens
acaatgcaaaccatcattgaaat

SEQ ID NO: 2222358 - DNA, 21 bp, Homo sapiens
acaatgctgtgccctaaagtg

SEQ ID NO: 2222359 - DNA, 19 bp, Homo sapiens
acaatgtgaaaagaaaaat

SEQ ID NO: 2222360 - DNA, 13 bp, Homo sapiens
acaatttattatg

SEQ ID NO: 2222361 - DNA, 15 bp, Homo sapiens
acaatttattatggc

SEQ ID NO: 2222362 - DNA, 11 bp, Homo sapiens
acacaaaaaaa

SEQ ID NO: 2222363 - DNA, 17 bp, Homo sapiens
acacacagctctgtcct

SEQ ID NO: 2222364 - DNA, 20 bp, Homo sapiens
acacagctctgtcctgggag

SEQ ID NO: 2222365 - DNA, 14 bp, Homo sapiens
agaattctctagtt

SEQ ID NO: 2222366 - DNA, 17 bp, Homo sapiens
agacaatgacttactgt

SEQ ID NO: 2222367 - DNA, 13 bp, Homo sapiens
agacacaagcctt

SEQ ID NO: 2222368 - DNA, 14 bp, Homo sapiens
agacacaagccttc

SEQ ID NO: 2222369 - DNA, 12 bp, Homo sapiens
agacacaggccc

SEQ ID NO: 2222370 - DNA, 21 bp, Homo sapiens
agacacatgtccaagaagccc

SEQ ID NO: 2222371 - DNA, 17 bp, Homo sapiens
agacaccttgacagggc

SEQ ID NO: 2222372 - DNA, 16 bp, Homo sapiens
agacagcccgggctct

SEQ ID NO: 2222373 - DNA, 23 bp, Homo sapiens
agacagcccgggctctgcctccc

SEQ ID NO: 2222374 - DNA, 12 bp, Homo sapiens
agacagctctta

SEQ ID NO: 2222375 - DNA, 15 bp, Homo sapiens
agacaggaccaggga

SEQ ID NO: 2222376 - DNA, 22 bp, Homo sapiens
agacaggcaagcacctcctgcc

SEQ ID NO: 2222377 - DNA, 21 bp, Homo sapiens
agacagggttttgccatgttg

SEQ ID NO: 2222378 - DNA, 12 bp, Homo sapiens
agacagtccctg

SEQ ID NO: 2222379 - DNA, 23 bp, Homo sapiens
agacatactaaccagcagaaatg

SEQ ID NO: 2222380 - DNA, 15 bp, Homo sapiens
agaccacgtttctaa

SEQ ID NO: 2222381 - DNA, 17 bp, Homo sapiens
agaccatccctgaaggc

SEQ ID NO: 2222382 - DNA, 18 bp, Homo sapiens
agaccatccctgaaggcc

SEQ ID NO: 2222383 - DNA, 21 bp, Homo sapiens
agaccatccctgaaggccccg

SEQ ID NO: 2222384 - DNA, 21 bp, Homo sapiens
agaccctgccctgtgggcccc

SEQ ID NO: 2222385 - DNA, 19 bp, Homo sapiens
agacccttgtggtcccacc

SEQ ID NO: 2222386 - DNA, 22 bp, Homo sapiens
agacccttgtggtcccacccca

SEQ ID NO: 2222387 - DNA, 18 bp, Homo sapiens
agaccttctccttcacct

SEQ ID NO: 2222388 - DNA, 21 bp, Homo sapiens
agaccttctccttcacctttg

SEQ ID NO: 2222389 - DNA, 17 bp, Homo sapiens
agacgctgtgctgccct

SEQ ID NO: 2222390 - DNA, 19 bp, Homo sapiens
agacgctgtgctgccctgc

SEQ ID NO: 2222391 - DNA, 20 bp, Homo sapiens
agacgctgtgctgccctgcc

SEQ ID NO: 2222392 - DNA, 18 bp, Homo sapiens
agacggagtcccaccttg

SEQ ID NO: 2222393 - DNA, 15 bp, Homo sapiens
agactcgcgacaatg

SEQ ID NO: 2222394 - DNA, 19 bp, Homo sapiens
agactcgcgacaatgcaaa

SEQ ID NO: 2222395 - DNA, 18 bp, Homo sapiens
agactctgtctcaaaaaa

SEQ ID NO: 2222396 - DNA, 22 bp, Homo sapiens
agactgagtacgttgtgcattt

SEQ ID NO: 2222397 - DNA, 16 bp, Homo sapiens
agactggaagcacagc

SEQ ID NO: 2222398 - DNA, 17 bp, Homo sapiens
agactggaagcacagct

SEQ ID NO: 2222399 - DNA, 15 bp, Homo sapiens
agactgtacaaagta

SEQ ID NO: 2222400 - DNA, 15 bp, Homo sapiens
agacttttccaaccc

SEQ ID NO: 2222401 - DNA, 11 bp, Homo sapiens
agagaaagaga

SEQ ID NO: 2222402 - DNA, 13 bp, Homo sapiens
agagaaagagaga

SEQ ID NO: 2222403 - DNA, 22 bp, Homo sapiens
agagaaggggcccaagagagac

SEQ ID NO: 2222404 - DNA, 16 bp, Homo sapiens
agagacacaagccttc

SEQ ID NO: 2222405 - DNA, 23 bp, Homo sapiens
agagaccatccctgaaggccccg

SEQ ID NO: 2222406 - DNA, 17 bp, Homo sapiens
agagactcctgcaggca

SEQ ID NO: 2222407 - DNA, 20 bp, Homo sapiens
agagactcctgcaggcagcc

SEQ ID NO: 2222408 - DNA, 22 bp, Homo sapiens
agagactcctgcaggcagccag

SEQ ID NO: 2222409 - DNA, 15 bp, Homo sapiens
agagagaaagagaga

SEQ ID NO: 2222410 - DNA, 18 bp, Homo sapiens
agagagacagcacaggca

SEQ ID NO: 2222411 - DNA, 16 bp, Homo sapiens
agagagaccacttttc

SEQ ID NO: 2222412 - DNA, 15 bp, Homo sapiens
agagagagaaagaga

SEQ ID NO: 2222413 - DNA, 12 bp, Homo sapiens
agagagagaagg

SEQ ID NO: 2222414 - DNA, 10 bp, Homo sapiens
agagagagag

SEQ ID NO: 2222415 - DNA, 11 bp, Homo sapiens
agagagagaga

SEQ ID NO: 2222416 - DNA, 20 bp, Homo sapiens
agagagggtggtgacctctg

SEQ ID NO: 2222417 - DNA, 23 bp, Homo sapiens
agagagggtggtgacctctgcct

SEQ ID NO: 2222418 - DNA, 23 bp, Homo sapiens
agagcaagacgctgtgctgccct

SEQ ID NO: 2222419 - DNA, 12 bp, Homo sapiens
agagcagagacc

SEQ ID NO: 2222420 - DNA, 18 bp, Homo sapiens
agagcagagaccatccct

SEQ ID NO: 2222421 - DNA, 13 bp, Homo sapiens
agagccagggtct

SEQ ID NO: 2222422 - DNA, 13 bp, Homo sapiens
agagcccacgccc

SEQ ID NO: 2222423 - DNA, 13 bp, Homo sapiens
agagcccaggcct

SEQ ID NO: 2222424 - DNA, 17 bp, Homo sapiens
agagccttccaggggtg

SEQ ID NO: 2222425 - DNA, 22 bp, Homo sapiens
agagccttccaggggtgggaca

SEQ ID NO: 2222426 - DNA, 19 bp, Homo sapiens
agaggaaagcaaaggagat

SEQ ID NO: 2222427 - DNA, 16 bp, Homo sapiens
agaggaaggagaggag

SEQ ID NO: 2222428 - DNA, 23 bp, Homo sapiens
agaggacttttctttgtggcttc

SEQ ID NO: 2222429 - DNA, 15 bp, Homo sapiens
agaggagagaggacc

SEQ ID NO: 2222430 - DNA, 19 bp, Homo sapiens
agaggcagccccattctgc

SEQ ID NO: 2222431 - DNA, 23 bp, Homo sapiens
agaggcagccccattctgcctgc

SEQ ID NO: 2222432 - DNA, 17 bp, Homo sapiens
agaggctatgtgagcac

SEQ ID NO: 2222433 - DNA, 16 bp, Homo sapiens
agagggagggagggct

SEQ ID NO: 2222434 - DNA, 22 bp, Homo sapiens
agagggagggagggctccagac

SEQ ID NO: 2222435 - DNA, 15 bp, Homo sapiens
agagggaggtaagga

SEQ ID NO: 2222436 - DNA, 15 bp, Homo sapiens
agagggagtgacaga

SEQ ID NO: 2222437 - DNA, 12 bp, Homo sapiens
agagggcacaga

SEQ ID NO: 2222438 - DNA, 22 bp, Homo sapiens
agaggggaacagactggaagca

SEQ ID NO: 2222439 - DNA, 16 bp, Homo sapiens
agaggggaagagactt

SEQ ID NO: 2222440 - DNA, 20 bp, Homo sapiens
agagggtggtgacctctgcc

SEQ ID NO: 2222441 - DNA, 22 bp, Homo sapiens
agagtcagaagtttctgccgca

SEQ ID NO: 2222442 - DNA, 20 bp, Homo sapiens
agagtctcactgttgcccag

SEQ ID NO: 2222443 - DNA, 16 bp, Homo sapiens
agagtgagactctgtc

SEQ ID NO: 2222444 - DNA, 14 bp, Homo sapiens
agagttgaagacag

SEQ ID NO: 2222445 - DNA, 17 bp, Homo sapiens
agagttgatactacagt

SEQ ID NO: 2222446 - DNA, 16 bp, Homo sapiens
agagttgttacatttt

SEQ ID NO: 2222447 - DNA, 17 bp, Homo sapiens
agagttgttacattttt

SEQ ID NO: 2222448 - DNA, 20 bp, Homo sapiens
agagttgttacatttttaag

SEQ ID NO: 2222449 - DNA, 21 bp, Homo sapiens
agagttgttacatttttaagt

SEQ ID NO: 2222450 - DNA, 19 bp, Homo sapiens
agataagggtatctggtga

SEQ ID NO: 2222451 - DNA, 18 bp, Homo sapiens
agataatattaaggaaga

SEQ ID NO: 2222452 - DNA, 13 bp, Homo sapiens
agatacagttact

SEQ ID NO: 2222453 - DNA, 15 bp, Homo sapiens
agatactgtatcatg

SEQ ID NO: 2222454 - DNA, 16 bp, Homo sapiens
agatactgtatcatga

SEQ ID NO: 2222455 - DNA, 16 bp, Homo sapiens
agatagccaaggccaa

SEQ ID NO: 2222456 - DNA, 20 bp, Homo sapiens
agatagccaaggccaaagga

SEQ ID NO: 2222457 - DNA, 20 bp, Homo sapiens
agatattttgctttgtgatt

SEQ ID NO: 2222458 - DNA, 14 bp, Homo sapiens
agatcaaccccttc

SEQ ID NO: 2222459 - DNA, 21 bp, Homo sapiens
agatcaaccccttcgctcctg

SEQ ID NO: 2222460 - DNA, 16 bp, Homo sapiens
agatgtgcccccaccc

SEQ ID NO: 2222461 - DNA, 13 bp, Homo sapiens
agattcatattta

SEQ ID NO: 2222462 - DNA, 22 bp, Homo sapiens
agattcatatttacttcttata

SEQ ID NO: 2222463 - DNA, 20 bp, Homo sapiens
agattgcaacaggctgggct

SEQ ID NO: 2222464 - DNA, 21 bp, Homo sapiens
agattgcaacaggctgggctt

SEQ ID NO: 2222465 - DNA, 14 bp, Homo sapiens
agatttcactctcc

SEQ ID NO: 2222466 - DNA, 17 bp, Homo sapiens
agatttgaactcttcaa

SEQ ID NO: 2222467 - DNA, 21 bp, Homo sapiens
agattttgaaatttttattaa

SEQ ID NO: 2222468 - DNA, 19 bp, Homo sapiens
agcaaattctgtttttcta

SEQ ID NO: 2222469 - DNA, 16 bp, Homo sapiens
agcaagacgctgtgct

SEQ ID NO: 2222470 - DNA, 21 bp, Homo sapiens
agcaagacgctgtgctgccct

SEQ ID NO: 2222471 - DNA, 22 bp, Homo sapiens
agcaagacgctgtgctgccctg

SEQ ID NO: 2222472 - DNA, 17 bp, Homo sapiens
agcaaggagatttacaa

SEQ ID NO: 2222473 - DNA, 20 bp, Homo sapiens
agcaagtgagaccctgtctc

SEQ ID NO: 2222474 - DNA, 13 bp, Homo sapiens
agcaagtgagagc

SEQ ID NO: 2222475 - DNA, 16 bp, Homo sapiens
agcaagtgagagctgg

SEQ ID NO: 2222476 - DNA, 17 bp, Homo sapiens
agcaagtgagagctggg

SEQ ID NO: 2222477 - DNA, 18 bp, Homo sapiens
agcaagtgagagctgggt

SEQ ID NO: 2222478 - DNA, 12 bp, Homo sapiens
agcacagaccct

SEQ ID NO: 2222479 - DNA, 21 bp, Homo sapiens
agcacagcttcatttcctgtg

SEQ ID NO: 2222480 - DNA, 16 bp, Homo sapiens
agcacaggcagcccca

SEQ ID NO: 2222481 - DNA, 14 bp, Homo sapiens
agcacatgcctctc

SEQ ID NO: 2222482 - DNA, 18 bp, Homo sapiens
agcacatgcctctctcag

SEQ ID NO: 2222483 - DNA, 16 bp, Homo sapiens
agcaccatctctcctc

SEQ ID NO: 2222484 - DNA, 20 bp, Homo sapiens
agcacctaggtggggcctgg

SEQ ID NO: 2222485 - DNA, 13 bp, Homo sapiens
agcacctcctgcc

SEQ ID NO: 2222486 - DNA, 22 bp, Homo sapiens
agcaccttagacagtccctgcc

SEQ ID NO: 2222487 - DNA, 14 bp, Homo sapiens
agcacgatttctgt

SEQ ID NO: 2222488 - DNA, 16 bp, Homo sapiens
agcacgatttctgttt

SEQ ID NO: 2222489 - DNA, 22 bp, Homo sapiens
agttttcactcttattgcccac

SEQ ID NO: 2222490 - DNA, 23 bp, Homo sapiens
agtttttatggcttttgtgcatt

SEQ ID NO: 2222491 - DNA, 15 bp, Homo sapiens
ataaaactttttaaa

SEQ ID NO: 2222492 - DNA, 17 bp, Homo sapiens
ataaaactttttaaaat

SEQ ID NO: 2222493 - DNA, 15 bp, Homo sapiens
ataaacaagaccacg

SEQ ID NO: 2222494 - DNA, 14 bp, Homo sapiens
ataaagcagcgttt

SEQ ID NO: 2222495 - DNA, 19 bp, Homo sapiens
ataaagcagcgtttctatg

SEQ ID NO: 2222496 - DNA, 12 bp, Homo sapiens
ataacatgtaat

SEQ ID NO: 2222497 - DNA, 20 bp, Homo sapiens
ataacatgtaattaagtact

SEQ ID NO: 2222498 - DNA, 13 bp, Homo sapiens
ataagataaatgt

SEQ ID NO: 2222499 - DNA, 18 bp, Homo sapiens
ataagggtatctggtgac

SEQ ID NO: 2222500 - DNA, 20 bp, Homo sapiens
ataatacaccactacattct

SEQ ID NO: 2222501 - DNA, 19 bp, Homo sapiens
ataatacagtatctcaggg

SEQ ID NO: 2222502 - DNA, 15 bp, Homo sapiens
ataatgcgtgcatac

SEQ ID NO: 2222503 - DNA, 20 bp, Homo sapiens
ataatgcgtgcataccactt

SEQ ID NO: 2222504 - DNA, 14 bp, Homo sapiens
ataatgtaagctct

SEQ ID NO: 2222505 - DNA, 15 bp, Homo sapiens
ataatgtaagctcta

SEQ ID NO: 2222506 - DNA, 21 bp, Homo sapiens
ataatgtgaaactggattaaa

SEQ ID NO: 2222507 - DNA, 22 bp, Homo sapiens
ataattgacaggattattggaa

SEQ ID NO: 2222508 - DNA, 14 bp, Homo sapiens
atacaatgctgtgc

SEQ ID NO: 2222509 - DNA, 23 bp, Homo sapiens
atacaatgctgtgccctaaagtg

SEQ ID NO: 2222510 - DNA, 18 bp, Homo sapiens
atacaccactacattctg

SEQ ID NO: 2222511 - DNA, 19 bp, Homo sapiens
atacaccactacattctgt

SEQ ID NO: 2222512 - DNA, 21 bp, Homo sapiens
atacaccactacattctgtta

SEQ ID NO: 2222513 - DNA, 16 bp, Homo sapiens
atacagaggcaactgc

SEQ ID NO: 2222514 - DNA, 22 bp, Homo sapiens
atacaggaaaagctgctgacag

SEQ ID NO: 2222515 - DNA, 20 bp, Homo sapiens
atacataaacaagaccacgt

SEQ ID NO: 2222516 - DNA, 17 bp, Homo sapiens
ataccagccagtaaatg

SEQ ID NO: 2222517 - DNA, 12 bp, Homo sapiens
atacccaccccc

SEQ ID NO: 2222518 - DNA, 14 bp, Homo sapiens
atacctgtccccct

SEQ ID NO: 2222519 - DNA, 18 bp, Homo sapiens
atacctgtccccctgaca

SEQ ID NO: 2222520 - DNA, 13 bp, Homo sapiens
atacgtacacatt

SEQ ID NO: 2222521 - DNA, 14 bp, Homo sapiens
atacgtacacattt

SEQ ID NO: 2222522 - DNA, 13 bp, Homo sapiens
atactaaccagca

SEQ ID NO: 2222523 - DNA, 21 bp, Homo sapiens
atactaaccagcagaaatgcc

SEQ ID NO: 2222524 - DNA, 13 bp, Homo sapiens
atactacagtttg

SEQ ID NO: 2222525 - DNA, 15 bp, Homo sapiens
atagcacagaccctg

SEQ ID NO: 2222526 - DNA, 17 bp, Homo sapiens
atagcacagaccctgcc

SEQ ID NO: 2222527 - DNA, 17 bp, Homo sapiens
atagcctaggtgacaga

SEQ ID NO: 2222528 - DNA, 20 bp, Homo sapiens
atagctcaggtgtccctgca

SEQ ID NO: 2222529 - DNA, 19 bp, Homo sapiens
ataggaacttaaataatgt

SEQ ID NO: 2222530 - DNA, 15 bp, Homo sapiens
atagtatggtggctg

SEQ ID NO: 2222531 - DNA, 22 bp, Homo sapiens
atagttaagcgtgcataagtta

SEQ ID NO: 2222532 - DNA, 20 bp, Homo sapiens
atatctgaaaatgtatgtgt

SEQ ID NO: 2222533 - DNA, 20 bp, Homo sapiens
atatgatttaaatcagccgt

SEQ ID NO: 2222534 - DNA, 20 bp, Homo sapiens
atatgctctgcatgttacat

SEQ ID NO: 2222535 - DNA, 21 bp, Homo sapiens
atatgcttatacacttacact

SEQ ID NO: 2222536 - DNA, 16 bp, Homo sapiens
atatgtaacaagccac

SEQ ID NO: 2222537 - DNA, 14 bp, Homo sapiens
atatgtcaagccat

SEQ ID NO: 2222538 - DNA, 16 bp, Homo sapiens
atatgtggagttcatc

SEQ ID NO: 2222539 - DNA, 21 bp, Homo sapiens
atatgtggagttcatcttgaa

SEQ ID NO: 2222540 - DNA, 15 bp, Homo sapiens
atattaagaaagact

SEQ ID NO: 2222541 - DNA, 24 bp, Homo sapiens
atattaagaaagactatctaaatg

SEQ ID NO: 2222542 - DNA, 22 bp, Homo sapiens
atattaaggaagacaatgtgaa

SEQ ID NO: 2222543 - DNA, 17 bp, Homo sapiens
atattaccacagacata

SEQ ID NO: 2222544 - DNA, 16 bp, Homo sapiens
atattcaggaagctca

SEQ ID NO: 2222545 - DNA, 15 bp, Homo sapiens
atattgatatgctta

SEQ ID NO: 2222546 - DNA, 21 bp, Homo sapiens
atattgatttccgttaaaata

SEQ ID NO: 2222547 - DNA, 13 bp, Homo sapiens
atattgttttcag

SEQ ID NO: 2222548 - DNA, 18 bp, Homo sapiens
atatttttttcttttctt

SEQ ID NO: 2222549 - DNA, 19 bp, Homo sapiens
atcaaagaggttttaaaaa

SEQ ID NO: 2222550 - DNA, 20 bp, Homo sapiens
atcaaccccttcgctcctgt

SEQ ID NO: 2222551 - DNA, 22 bp, Homo sapiens
atcaaccccttcgctcctgtgt

SEQ ID NO: 2222552 - DNA, 21 bp, Homo sapiens
atcaactgcatcaagatgtga

SEQ ID NO: 2222553 - DNA, 13 bp, Homo sapiens
atcacagcctctg

SEQ ID NO: 2222554 - DNA, 13 bp, Homo sapiens
atcaccagacagg

SEQ ID NO: 2222555 - DNA, 23 bp, Homo sapiens
atcacccgctaagagggagggag

SEQ ID NO: 2222556 - DNA, 15 bp, Homo sapiens
atcacgccactgcac

SEQ ID NO: 2222557 - DNA, 15 bp, Homo sapiens
atcagcacgatttct

SEQ ID NO: 2222558 - DNA, 20 bp, Homo sapiens
atcagcacgatttctgttta

SEQ ID NO: 2222559 - DNA, 17 bp, Homo sapiens
atcagcctgctccagct

SEQ ID NO: 2222560 - DNA, 12 bp, Homo sapiens
atcagctgctac

SEQ ID NO: 2222561 - DNA, 20 bp, Homo sapiens
atcatgacaaagactgagta

SEQ ID NO: 2222562 - DNA, 14 bp, Homo sapiens
atcatgtctggcta

SEQ ID NO: 2222563 - DNA, 13 bp, Homo sapiens
atcattgaaatct

SEQ ID NO: 2222564 - DNA, 14 bp, Homo sapiens
atcattgaaatctt

SEQ ID NO: 2222565 - DNA, 15 bp, Homo sapiens
atcattgaaatcttt

SEQ ID NO: 2222566 - DNA, 21 bp, Homo sapiens
atccactgtgccatgtgccag

SEQ ID NO: 2222567 - DNA, 15 bp, Homo sapiens
atccagacccggctg

SEQ ID NO: 2222568 - DNA, 14 bp, Homo sapiens
atccagtatcttga

SEQ ID NO: 2222569 - DNA, 15 bp, Homo sapiens
atccagtatcttgaa

SEQ ID NO: 2222570 - DNA, 20 bp, Homo sapiens
atcccaaacccttcagtgcc

SEQ ID NO: 2222571 - DNA, 14 bp, Homo sapiens
atcccatttaaaaa

SEQ ID NO: 2222572 - DNA, 15 bp, Homo sapiens
atcccatttaaaaaa

SEQ ID NO: 2222573 - DNA, 13 bp, Homo sapiens
atccccaaaaaag

SEQ ID NO: 2222574 - DNA, 17 bp, Homo sapiens
atccccaaaaaagcgaa

SEQ ID NO: 2222575 - DNA, 15 bp, Homo sapiens
atccctactgtaatt

SEQ ID NO: 2222576 - DNA, 21 bp, Homo sapiens
atcctaagctattcagtaata

SEQ ID NO: 2222577 - DNA, 21 bp, Homo sapiens
atcctaggcatttgctgaata

SEQ ID NO: 2222578 - DNA, 13 bp, Homo sapiens
atcctagttccac

SEQ ID NO: 2222579 - DNA, 15 bp, Homo sapiens
atcctagttccacca

SEQ ID NO: 2222580 - DNA, 17 bp, Homo sapiens
atcctcatacccacccc

SEQ ID NO: 2222581 - DNA, 19 bp, Homo sapiens
atcctccaggtgcacaagc

SEQ ID NO: 2222582 - DNA, 15 bp, Homo sapiens
atcctcccacctcag

SEQ ID NO: 2222583 - DNA, 18 bp, Homo sapiens
atcctcccacctcagcct

SEQ ID NO: 2222584 - DNA, 18 bp, Homo sapiens
atcctcctgcccccaccc

SEQ ID NO: 2222585 - DNA, 19 bp, Homo sapiens
atcctcctgcccccacccc

SEQ ID NO: 2222586 - DNA, 17 bp, Homo sapiens
atcctctttgagtgaag

SEQ ID NO: 2222587 - DNA, 11 bp, Homo sapiens
atcctgagcca

SEQ ID NO: 2222588 - DNA, 15 bp, Homo sapiens
atcctgagccagatt

SEQ ID NO: 2222589 - DNA, 21 bp, Homo sapiens
atcctgagccagatttcactc

SEQ ID NO: 2222590 - DNA, 20 bp, Homo sapiens
atcctggcacccggcccctg

SEQ ID NO: 2222591 - DNA, 22 bp, Homo sapiens
atcctggcacccggcccctgct

SEQ ID NO: 2222592 - DNA, 23 bp, Homo sapiens
atcctggcacccggcccctgctg

SEQ ID NO: 2222593 - DNA, 17 bp, Homo sapiens
atctaaatggaaccact

SEQ ID NO: 2222594 - DNA, 18 bp, Homo sapiens
atctaaatggaaccactc

SEQ ID NO: 2222595 - DNA, 23 bp, Homo sapiens
atctaatatgtaacaagccaccc

SEQ ID NO: 2222596 - DNA, 22 bp, Homo sapiens
atctaggaagactttggaaaga

SEQ ID NO: 2222597 - DNA, 14 bp, Homo sapiens
atctccaaaataaa

SEQ ID NO: 2222598 - DNA, 20 bp, Homo sapiens
atctccaaaataaaactttt

SEQ ID NO: 2222599 - DNA, 17 bp, Homo sapiens
atctcccccagccccat

SEQ ID NO: 2222600 - DNA, 19 bp, Homo sapiens
atctgaaaatgtatgtgta

SEQ ID NO: 2222601 - DNA, 22 bp, Homo sapiens
atctgaaaatgtatgtgtaagt

SEQ ID NO: 2222602 - DNA, 22 bp, Homo sapiens
atctgctttttaaagaatgctc

SEQ ID NO: 2222603 - DNA, 16 bp, Homo sapiens
atctggtgactttcct

SEQ ID NO: 2222604 - DNA, 12 bp, Homo sapiens
atctgtcatttg

SEQ ID NO: 2222605 - DNA, 18 bp, Homo sapiens
atctgtgaaaggaaagag

SEQ ID NO: 2222606 - DNA, 14 bp, Homo sapiens
atcttctttataat

SEQ ID NO: 2222607 - DNA, 17 bp, Homo sapiens
atcttctttataattct

SEQ ID NO: 2222608 - DNA, 13 bp, Homo sapiens
atcttgctctgct

SEQ ID NO: 2222609 - DNA, 17 bp, Homo sapiens
atctttgcagacaggca

SEQ ID NO: 2222610 - DNA, 15 bp, Homo sapiens
atgaaagggcccaga

SEQ ID NO: 2222611 - DNA, 12 bp, Homo sapiens
atgacccagtgg

SEQ ID NO: 2222612 - DNA, 18 bp, Homo sapiens
atgacctttcaataggaa

SEQ ID NO: 2222613 - DNA, 19 bp, Homo sapiens
caccacatgtgcacatgca

SEQ ID NO: 2222614 - DNA, 14 bp, Homo sapiens
caccacctctttgg

SEQ ID NO: 2222615 - DNA, 20 bp, Homo sapiens
caccactacattctgttaat

SEQ ID NO: 2222616 - DNA, 18 bp, Homo sapiens
caccagagcccaccttgg

SEQ ID NO: 2222617 - DNA, 12 bp, Homo sapiens
caccagcagcct

SEQ ID NO: 2222618 - DNA, 13 bp, Homo sapiens
caccagccccagt

SEQ ID NO: 2222619 - DNA, 18 bp, Homo sapiens
caccagccccagtgccca

SEQ ID NO: 2222620 - DNA, 21 bp, Homo sapiens
caccagcccttagcagggaaa

SEQ ID NO: 2222621 - DNA, 14 bp, Homo sapiens
caccatcaagccac

SEQ ID NO: 2222622 - DNA, 15 bp, Homo sapiens
caccatcaagccacc

SEQ ID NO: 2222623 - DNA, 16 bp, Homo sapiens
caccatcaagccacca

SEQ ID NO: 2222624 - DNA, 17 bp, Homo sapiens
caccatcaagccaccaa

SEQ ID NO: 2222625 - DNA, 24 bp, Homo sapiens
caccatcaagccaccaacatactc

SEQ ID NO: 2222626 - DNA, 17 bp, Homo sapiens
cacccaagggcctggcc

SEQ ID NO: 2222627 - DNA, 20 bp, Homo sapiens
cacccaagggcctggcctga

SEQ ID NO: 2222628 - DNA, 23 bp, Homo sapiens
cacccaagggcctggcctgagct

SEQ ID NO: 2222629 - DNA, 22 bp, Homo sapiens
cacccaccatcatgtctggcta

SEQ ID NO: 2222630 - DNA, 12 bp, Homo sapiens
caccccagcccc

SEQ ID NO: 2222631 - DNA, 13 bp, Homo sapiens
caccccagcccca

SEQ ID NO: 2222632 - DNA, 18 bp, Homo sapiens
cacccccgatgggatggc

SEQ ID NO: 2222633 - DNA, 19 bp, Homo sapiens
caccccctccccgggcagc

SEQ ID NO: 2222634 - DNA, 18 bp, Homo sapiens
caccccgcctgccctccc

SEQ ID NO: 2222635 - DNA, 17 bp, Homo sapiens
caccccggccacctgcg

SEQ ID NO: 2222636 - DNA, 19 bp, Homo sapiens
cacccgctaagagggaggg

SEQ ID NO: 2222637 - DNA, 14 bp, Homo sapiens
caccctcaggcagg

SEQ ID NO: 2222638 - DNA, 12 bp, Homo sapiens
caccctcctttc

SEQ ID NO: 2222639 - DNA, 16 bp, Homo sapiens
caccctcgaccacccc

SEQ ID NO: 2222640 - DNA, 17 bp, Homo sapiens
caccctgaaagccctga

SEQ ID NO: 2222641 - DNA, 12 bp, Homo sapiens
caccctgctctc

SEQ ID NO: 2222642 - DNA, 17 bp, Homo sapiens
caccctggggagaaagt

SEQ ID NO: 2222643 - DNA, 11 bp, Homo sapiens
caccctgtgat

SEQ ID NO: 2222644 - DNA, 23 bp, Homo sapiens
caccctgtgatggggccctgcct

SEQ ID NO: 2222645 - DNA, 15 bp, Homo sapiens
caccgaaaacgtggc

SEQ ID NO: 2222646 - DNA, 21 bp, Homo sapiens
caccgaaaacgtggctgcttc

SEQ ID NO: 2222647 - DNA, 14 bp, Homo sapiens
caccgcagacagga

SEQ ID NO: 2222648 - DNA, 16 bp, Homo sapiens
caccggctggcctggc

SEQ ID NO: 2222649 - DNA, 14 bp, Homo sapiens
cacctctcccttgg

SEQ ID NO: 2222650 - DNA, 17 bp, Homo sapiens
cacctctcccttggatt

SEQ ID NO: 2222651 - DNA, 15 bp, Homo sapiens
cacctctctcactcc

SEQ ID NO: 2222652 - DNA, 19 bp, Homo sapiens
cacctctctcactccttga

SEQ ID NO: 2222653 - DNA, 23 bp, Homo sapiens
cacctgaagactcattcttctgt

SEQ ID NO: 2222654 - DNA, 14 bp, Homo sapiens
cacctgcccctcaa

SEQ ID NO: 2222655 - DNA, 19 bp, Homo sapiens
cacctgcctgttgggccag

SEQ ID NO: 2222656 - DNA, 13 bp, Homo sapiens
cacctggcctctg

SEQ ID NO: 2222657 - DNA, 18 bp, Homo sapiens
cacctggcctctgcactc

SEQ ID NO: 2222658 - DNA, 20 bp, Homo sapiens
cacctggcctctgcactccc

SEQ ID NO: 2222659 - DNA, 23 bp, Homo sapiens
cacctggcctctgcactcccctg

SEQ ID NO: 2222660 - DNA, 16 bp, Homo sapiens
caccttagacagtccc

SEQ ID NO: 2222661 - DNA, 15 bp, Homo sapiens
caccttgacagggca

SEQ ID NO: 2222662 - DNA, 18 bp, Homo sapiens
caccttgacagggcacac

SEQ ID NO: 2222663 - DNA, 19 bp, Homo sapiens
caccttgacagggcacacc

SEQ ID NO: 2222664 - DNA, 16 bp, Homo sapiens
caccttggctgcaggg

SEQ ID NO: 2222665 - DNA, 14 bp, Homo sapiens
cacctttgaagaag

SEQ ID NO: 2222666 - DNA, 15 bp, Homo sapiens
cacctttgtccccac

SEQ ID NO: 2222667 - DNA, 17 bp, Homo sapiens
cacctttgtccccaccg

SEQ ID NO: 2222668 - DNA, 17 bp, Homo sapiens
cacgcacttcgggaggt

SEQ ID NO: 2222669 - DNA, 13 bp, Homo sapiens
cacgccactgcac

SEQ ID NO: 2222670 - DNA, 16 bp, Homo sapiens
cacgccagattctttc

SEQ ID NO: 2222671 - DNA, 22 bp, Homo sapiens
cacgccagattctttcctgagg

SEQ ID NO: 2222672 - DNA, 23 bp, Homo sapiens
cacgccagattctttcctgaggc

SEQ ID NO: 2222673 - DNA, 17 bp, Homo sapiens
cacgcccccactggtga

SEQ ID NO: 2222674 - DNA, 20 bp, Homo sapiens
cacgcctgtaatcctagcac

SEQ ID NO: 2222675 - DNA, 23 bp, Homo sapiens
cacgcgtgcacacaccagagccc

SEQ ID NO: 2222676 - DNA, 16 bp, Homo sapiens
cacggaagagccttgc

SEQ ID NO: 2222677 - DNA, 12 bp, Homo sapiens
cacggccaggcc

SEQ ID NO: 2222678 - DNA, 13 bp, Homo sapiens
cacggccaggcca

SEQ ID NO: 2222679 - DNA, 16 bp, Homo sapiens
cacggccaggccagag

SEQ ID NO: 2222680 - DNA, 17 bp, Homo sapiens
cacggccaggccagagg

SEQ ID NO: 2222681 - DNA, 17 bp, Homo sapiens
cacggctcactgcagcc

SEQ ID NO: 2222682 - DNA, 20 bp, Homo sapiens
cacggctcactgcagcctca

SEQ ID NO: 2222683 - DNA, 18 bp, Homo sapiens
cacgtacacacacataca

SEQ ID NO: 2222684 - DNA, 19 bp, Homo sapiens
cacgtggtcctaatcttct

SEQ ID NO: 2222685 - DNA, 23 bp, Homo sapiens
cacgtttctaaaggctacctttg

SEQ ID NO: 2222686 - DNA, 14 bp, Homo sapiens
cactaaccacgctg

SEQ ID NO: 2222687 - DNA, 15 bp, Homo sapiens
cactaaccacgctgg

SEQ ID NO: 2222688 - DNA, 16 bp, Homo sapiens
cactaaccacgctgga

SEQ ID NO: 2222689 - DNA, 18 bp, Homo sapiens
cactaaccacgctggacc

SEQ ID NO: 2222690 - DNA, 15 bp, Homo sapiens
cactacattctgtta

SEQ ID NO: 2222691 - DNA, 14 bp, Homo sapiens
cactataatgtaag

SEQ ID NO: 2222692 - DNA, 18 bp, Homo sapiens
cactataatgtaagctct

SEQ ID NO: 2222693 - DNA, 17 bp, Homo sapiens
cactatgttgcccaggc

SEQ ID NO: 2222694 - DNA, 21 bp, Homo sapiens
cactatgttgcccaggcaggt

SEQ ID NO: 2222695 - DNA, 15 bp, Homo sapiens
cactcaaaagctggg

SEQ ID NO: 2222696 - DNA, 17 bp, Homo sapiens
cactcaaaagctgggca

SEQ ID NO: 2222697 - DNA, 18 bp, Homo sapiens
cactcaaaagctgggcag

SEQ ID NO: 2222698 - DNA, 19 bp, Homo sapiens
cactcagaagacactgatg

SEQ ID NO: 2222699 - DNA, 22 bp, Homo sapiens
cactcagaagacactgatgggc

SEQ ID NO: 2222700 - DNA, 19 bp, Homo sapiens
cactcattgacctgaggcc

SEQ ID NO: 2222701 - DNA, 14 bp, Homo sapiens
cactccagcctggg

SEQ ID NO: 2222702 - DNA, 21 bp, Homo sapiens
cactccttcacagatgggtgc

SEQ ID NO: 2222703 - DNA, 15 bp, Homo sapiens
cactctggcagctca

SEQ ID NO: 2222704 - DNA, 19 bp, Homo sapiens
cactctggcagctcagaga

SEQ ID NO: 2222705 - DNA, 19 bp, Homo sapiens
cactctggggtgggagggt

SEQ ID NO: 2222706 - DNA, 16 bp, Homo sapiens
cactctgtcgcccagt

SEQ ID NO: 2222707 - DNA, 21 bp, Homo sapiens
cactcttattgcccacgctgg

SEQ ID NO: 2222708 - DNA, 14 bp, Homo sapiens
cactgcaacctccg

SEQ ID NO: 2222709 - DNA, 14 bp, Homo sapiens
cactgcaccgggcc

SEQ ID NO: 2222710 - DNA, 15 bp, Homo sapiens
cactgcaccgggcca

SEQ ID NO: 2222711 - DNA, 18 bp, Homo sapiens
cactgcaccgggccacag

SEQ ID NO: 2222712 - DNA, 18 bp, Homo sapiens
cactgcactatagcctag

SEQ ID NO: 2222713 - DNA, 13 bp, Homo sapiens
cactgcagcctca

SEQ ID NO: 2222714 - DNA, 19 bp, Homo sapiens
cactgcagcctcaacctcc

SEQ ID NO: 2222715 - DNA, 21 bp, Homo sapiens
cactgcagcctcaacctcctg

SEQ ID NO: 2222716 - DNA, 22 bp, Homo sapiens
cactgcagcctcaacctcctgg

SEQ ID NO: 2222717 - DNA, 20 bp, Homo sapiens
cactgcttccagtgaggctc

SEQ ID NO: 2222718 - DNA, 22 bp, Homo sapiens
cactgcttccagtgaggctctg

SEQ ID NO: 2222719 - DNA, 13 bp, Homo sapiens
cactgtgaagaga

SEQ ID NO: 2222720 - DNA, 20 bp, Homo sapiens
cactgtgctgagtctgaagg

SEQ ID NO: 2222721 - DNA, 13 bp, Homo sapiens
cactgttctctgc

SEQ ID NO: 2222722 - DNA, 19 bp, Homo sapiens
cactgttctctgccctcca

SEQ ID NO: 2222723 - DNA, 16 bp, Homo sapiens
cactgttgcccaggct

SEQ ID NO: 2222724 - DNA, 17 bp, Homo sapiens
cactgttgcccaggctg

SEQ ID NO: 2222725 - DNA, 19 bp, Homo sapiens
cacttgacatcaactgcat

SEQ ID NO: 2222726 - DNA, 13 bp, Homo sapiens
cacttgagtccag

SEQ ID NO: 2222727 - DNA, 18 bp, Homo sapiens
cacttgcagactctacag

SEQ ID NO: 2222728 - DNA, 13 bp, Homo sapiens
cactttctagcca

SEQ ID NO: 2222729 - DNA, 16 bp, Homo sapiens
cactttctagccagag

SEQ ID NO: 2222730 - DNA, 18 bp, Homo sapiens
cactttctagccagagga

SEQ ID NO: 2222731 - DNA, 20 bp, Homo sapiens
cactttctagccagaggaga

SEQ ID NO: 2222732 - DNA, 13 bp, Homo sapiens
cactttgggaggc

SEQ ID NO: 2222733 - DNA, 22 bp, Homo sapiens
cagaaaatggaagacagctctt

SEQ ID NO: 2222734 - DNA, 19 bp, Homo sapiens
cagaaacaaaatgaaaaaa

SEQ ID NO: 2222735 - DNA, 18 bp, Homo sapiens
cagaatctcaaataacta

SEQ ID NO: 2222736 - DNA, 11 bp, Homo sapiens
cagaattctca

SEQ ID NO: 2222737 - DNA, 19 bp, Homo sapiens
ccagccaaagcctcctcca

SEQ ID NO: 2222738 - DNA, 13 bp, Homo sapiens
ccagccccagtgc

SEQ ID NO: 2222739 - DNA, 16 bp, Homo sapiens
ccagccccagtgccca

SEQ ID NO: 2222740 - DNA, 15 bp, Homo sapiens
ccagccccatcctct

SEQ ID NO: 2222741 - DNA, 18 bp, Homo sapiens
ccagccccatcctctgta

SEQ ID NO: 2222742 - DNA, 11 bp, Homo sapiens
ccagcccctgg

SEQ ID NO: 2222743 - DNA, 12 bp, Homo sapiens
ccagcccctgga

SEQ ID NO: 2222744 - DNA, 16 bp, Homo sapiens
ccagcccttagcaggg

SEQ ID NO: 2222745 - DNA, 17 bp, Homo sapiens
ccagcccttagcaggga

SEQ ID NO: 2222746 - DNA, 17 bp, Homo sapiens
ccagccgagatagccaa

SEQ ID NO: 2222747 - DNA, 18 bp, Homo sapiens
ccagccgccatgctcctg

SEQ ID NO: 2222748 - DNA, 20 bp, Homo sapiens
ccagccttgaccattctcca

SEQ ID NO: 2222749 - DNA, 11 bp, Homo sapiens
ccagctctggt

SEQ ID NO: 2222750 - DNA, 12 bp, Homo sapiens
ccagctctggtc

SEQ ID NO: 2222751 - DNA, 13 bp, Homo sapiens
ccagctctggtcc

SEQ ID NO: 2222752 - DNA, 17 bp, Homo sapiens
ccagctctggtccatag

SEQ ID NO: 2222753 - DNA, 21 bp, Homo sapiens
ccagctctggtccatagagag

SEQ ID NO: 2222754 - DNA, 13 bp, Homo sapiens
ccagctgcttggg

SEQ ID NO: 2222755 - DNA, 15 bp, Homo sapiens
ccagctgcttgggct

SEQ ID NO: 2222756 - DNA, 20 bp, Homo sapiens
ccagctgtgctctggacagg

SEQ ID NO: 2222757 - DNA, 15 bp, Homo sapiens
ccaggaaaggctcca

SEQ ID NO: 2222758 - DNA, 22 bp, Homo sapiens
ccaggaaaggctccaggagcag

SEQ ID NO: 2222759 - DNA, 15 bp, Homo sapiens
ccaggaagccagcag

SEQ ID NO: 2222760 - DNA, 19 bp, Homo sapiens
ccaggaagccagcaggctc

SEQ ID NO: 2222761 - DNA, 16 bp, Homo sapiens
ccaggagcagccacat

SEQ ID NO: 2222762 - DNA, 20 bp, Homo sapiens
ccaggagccccgaggccttc

SEQ ID NO: 2222763 - DNA, 12 bp, Homo sapiens
ccaggagcctcc

SEQ ID NO: 2222764 - DNA, 20 bp, Homo sapiens
ccaggaggccagccttgacc

SEQ ID NO: 2222765 - DNA, 13 bp, Homo sapiens
ccaggcatggtgg

SEQ ID NO: 2222766 - DNA, 23 bp, Homo sapiens
ccaggcattccccaggaggccag

SEQ ID NO: 2222767 - DNA, 14 bp, Homo sapiens
ccaggcccctgcca

SEQ ID NO: 2222768 - DNA, 16 bp, Homo sapiens
ccaggcccctgccacc

SEQ ID NO: 2222769 - DNA, 19 bp, Homo sapiens
ccaggcccctgccaccctg

SEQ ID NO: 2222770 - DNA, 14 bp, Homo sapiens
ccaggccctctgcc

SEQ ID NO: 2222771 - DNA, 16 bp, Homo sapiens
ccaggccctctgccca

SEQ ID NO: 2222772 - DNA, 22 bp, Homo sapiens
ccaggccctctgcccactccct

SEQ ID NO: 2222773 - DNA, 18 bp, Homo sapiens
ccaggcctccccagcacc

SEQ ID NO: 2222774 - DNA, 19 bp, Homo sapiens
ccaggcctcctacagcttg

SEQ ID NO: 2222775 - DNA, 21 bp, Homo sapiens
ccaggctcctttagcgcccag

SEQ ID NO: 2222776 - DNA, 12 bp, Homo sapiens
ccaggctggcgt

SEQ ID NO: 2222777 - DNA, 19 bp, Homo sapiens
ccaggctggcgtgcagtgg

SEQ ID NO: 2222778 - DNA, 15 bp, Homo sapiens
ccaggctgggagagc

SEQ ID NO: 2222779 - DNA, 14 bp, Homo sapiens
ccaggctggtctca

SEQ ID NO: 2222780 - DNA, 22 bp, Homo sapiens
ccaggcttagtcactgagacag

SEQ ID NO: 2222781 - DNA, 14 bp, Homo sapiens
ccagggacagaggg

SEQ ID NO: 2222782 - DNA, 19 bp, Homo sapiens
ccaggggaaaatcagcctg

SEQ ID NO: 2222783 - DNA, 23 bp, Homo sapiens
ccaggggtgggacaccctgtgat

SEQ ID NO: 2222784 - DNA, 15 bp, Homo sapiens
ccaggttcagcttgt

SEQ ID NO: 2222785 - DNA, 22 bp, Homo sapiens
ccagtaaatgggggtgcatttg

SEQ ID NO: 2222786 - DNA, 23 bp, Homo sapiens
ccagtaaatgggggtgcatttga

SEQ ID NO: 2222787 - DNA, 22 bp, Homo sapiens
ccagtatcttgaagacttttct

SEQ ID NO: 2222788 - DNA, 12 bp, Homo sapiens
ccagtcaccccg

SEQ ID NO: 2222789 - DNA, 19 bp, Homo sapiens
ccagtcaccccggccacct

SEQ ID NO: 2222790 - DNA, 20 bp, Homo sapiens
ccagtctggaatgcagtggt

SEQ ID NO: 2222791 - DNA, 15 bp, Homo sapiens
ccagtgaggctctgc

SEQ ID NO: 2222792 - DNA, 16 bp, Homo sapiens
ccagtgaggctctgcc

SEQ ID NO: 2222793 - DNA, 18 bp, Homo sapiens
ccagtgaggctctgccct

SEQ ID NO: 2222794 - DNA, 23 bp, Homo sapiens
ccagtgcccacaggatcagtctg

SEQ ID NO: 2222795 - DNA, 14 bp, Homo sapiens
ccagtgtgacaagg

SEQ ID NO: 2222796 - DNA, 18 bp, Homo sapiens
ccagttggtcccccttcc

SEQ ID NO: 2222797 - DNA, 20 bp, Homo sapiens
ccagttggtcccccttccat

SEQ ID NO: 2222798 - DNA, 23 bp, Homo sapiens
ccatagagagcaagacgctgtgc

SEQ ID NO: 2222799 - DNA, 15 bp, Homo sapiens
ccatattctgttggc

SEQ ID NO: 2222800 - DNA, 23 bp, Homo sapiens
ccatattctgttggccagtgtga

SEQ ID NO: 2222801 - DNA, 16 bp, Homo sapiens
ccatcaagccaccaac

SEQ ID NO: 2222802 - DNA, 14 bp, Homo sapiens
ccatcctcctgccc

SEQ ID NO: 2222803 - DNA, 12 bp, Homo sapiens
ccatcctctgta

SEQ ID NO: 2222804 - DNA, 21 bp, Homo sapiens
ccatcctctgtacagagccca

SEQ ID NO: 2222805 - DNA, 13 bp, Homo sapiens
ccatctaccctcc

SEQ ID NO: 2222806 - DNA, 21 bp, Homo sapiens
ccatctcacacatgagcatca

SEQ ID NO: 2222807 - DNA, 18 bp, Homo sapiens
ccatgagcctcagcatcc

SEQ ID NO: 2222808 - DNA, 19 bp, Homo sapiens
ccatgagcctcagcatcct

SEQ ID NO: 2222809 - DNA, 17 bp, Homo sapiens
ccatgaggaacaaggca

SEQ ID NO: 2222810 - DNA, 23 bp, Homo sapiens
ccatgaggaacaaggcaaggctg

SEQ ID NO: 2222811 - DNA, 18 bp, Homo sapiens
ccatgagtcccctgtttg

SEQ ID NO: 2222812 - DNA, 19 bp, Homo sapiens
ccatgattaaccacttcag

SEQ ID NO: 2222813 - DNA, 15 bp, Homo sapiens
ccatgctgccctgtg

SEQ ID NO: 2222814 - DNA, 14 bp, Homo sapiens
ccatgggcctcctg

SEQ ID NO: 2222815 - DNA, 20 bp, Homo sapiens
ccatggtcggaaaacatgct

SEQ ID NO: 2222816 - DNA, 15 bp, Homo sapiens
ccatgttggccaggc

SEQ ID NO: 2222817 - DNA, 17 bp, Homo sapiens
ccatgttggccaggctg

SEQ ID NO: 2222818 - DNA, 14 bp, Homo sapiens
ccattctccacctg

SEQ ID NO: 2222819 - DNA, 20 bp, Homo sapiens
ccattctccacctgccaggg

SEQ ID NO: 2222820 - DNA, 15 bp, Homo sapiens
ccattctgcctgccc

SEQ ID NO: 2222821 - DNA, 20 bp, Homo sapiens
ccattttggggtacccactg

SEQ ID NO: 2222822 - DNA, 22 bp, Homo sapiens
ccattttggggtacccactgct

SEQ ID NO: 2222823 - DNA, 21 bp, Homo sapiens
ccattttgtattttactaata

SEQ ID NO: 2222824 - DNA, 15 bp, Homo sapiens
cccaaagtgctggga

SEQ ID NO: 2222825 - DNA, 23 bp, Homo sapiens
cccaaatggaaatgggcagagca

SEQ ID NO: 2222826 - DNA, 16 bp, Homo sapiens
cccaactcaccccagc

SEQ ID NO: 2222827 - DNA, 12 bp, Homo sapiens
cccaagagagac

SEQ ID NO: 2222828 - DNA, 22 bp, Homo sapiens
cccaagagagacagcacaggca

SEQ ID NO: 2222829 - DNA, 15 bp, Homo sapiens
cccaagctctgctcc

SEQ ID NO: 2222830 - DNA, 17 bp, Homo sapiens
cccaagctctgctcctc

SEQ ID NO: 2222831 - DNA, 18 bp, Homo sapiens
cccaagggcctggcctga

SEQ ID NO: 2222832 - DNA, 23 bp, Homo sapiens
cccaagggcctggcctgagctgg

SEQ ID NO: 2222833 - DNA, 23 bp, Homo sapiens
cccaatgcactttgttctggctc

SEQ ID NO: 2222834 - DNA, 13 bp, Homo sapiens
cccacaggatcag

SEQ ID NO: 2222835 - DNA, 21 bp, Homo sapiens
cccacccaagggcctggcctg

SEQ ID NO: 2222836 - DNA, 15 bp, Homo sapiens
cccaccccaggctgg

SEQ ID NO: 2222837 - DNA, 13 bp, Homo sapiens
cccacccccaccc

SEQ ID NO: 2222838 - DNA, 15 bp, Homo sapiens
cccacccccacccaa

SEQ ID NO: 2222839 - DNA, 16 bp, Homo sapiens
cccaccctcgaccacc

SEQ ID NO: 2222840 - DNA, 18 bp, Homo sapiens
cccaccctcgaccacccc

SEQ ID NO: 2222841 - DNA, 15 bp, Homo sapiens
cccaccgcagacagg

SEQ ID NO: 2222842 - DNA, 18 bp, Homo sapiens
cccaccgcagacaggacc

SEQ ID NO: 2222843 - DNA, 19 bp, Homo sapiens
cccaccgcagacaggacca

SEQ ID NO: 2222844 - DNA, 14 bp, Homo sapiens
cccacctcagcctc

SEQ ID NO: 2222845 - DNA, 21 bp, Homo sapiens
cccacctcagcctcccaaagt

SEQ ID NO: 2222846 - DNA, 14 bp, Homo sapiens
cccacctctctcac

SEQ ID NO: 2222847 - DNA, 19 bp, Homo sapiens
cccacctctctcactcctt

SEQ ID NO: 2222848 - DNA, 14 bp, Homo sapiens
cccaccttggctgc

SEQ ID NO: 2222849 - DNA, 20 bp, Homo sapiens
cccacgactgcccggcaggg

SEQ ID NO: 2222850 - DNA, 13 bp, Homo sapiens
cccacgcccccac

SEQ ID NO: 2222851 - DNA, 17 bp, Homo sapiens
cccacgcccccactggt

SEQ ID NO: 2222852 - DNA, 20 bp, Homo sapiens
cccacggacgacgcgagggc

SEQ ID NO: 2222853 - DNA, 19 bp, Homo sapiens
cccacgtccctgcggaagc

SEQ ID NO: 2222854 - DNA, 12 bp, Homo sapiens
cccactccctgc

SEQ ID NO: 2222855 - DNA, 12 bp, Homo sapiens
cccactgctctg

SEQ ID NO: 2222856 - DNA, 20 bp, Homo sapiens
cccagagggcctgcaaggga

SEQ ID NO: 2222857 - DNA, 22 bp, Homo sapiens
cccagattgcaacaggctgggc

SEQ ID NO: 2222858 - DNA, 22 bp, Homo sapiens
cccagcaagtgagagctgggtg

SEQ ID NO: 2222859 - DNA, 14 bp, Homo sapiens
cccagcccacttct

SEQ ID NO: 2222860 - DNA, 17 bp, Homo sapiens
cccagcccacttctgcc

SEQ ID NO: 2222861 - DNA, 17 bp, Homo sapiens
cctgccaggaagccagc

SEQ ID NO: 2222862 - DNA, 15 bp, Homo sapiens
cctgccagggacaga

SEQ ID NO: 2222863 - DNA, 13 bp, Homo sapiens
cctgcccacctgg

SEQ ID NO: 2222864 - DNA, 13 bp, Homo sapiens
cctgcccaggccc

SEQ ID NO: 2222865 - DNA, 16 bp, Homo sapiens
cctgcccaggcccctg

SEQ ID NO: 2222866 - DNA, 14 bp, Homo sapiens
cctgcccccacccc

SEQ ID NO: 2222867 - DNA, 18 bp, Homo sapiens
cctgcccccaccccaggc

SEQ ID NO: 2222868 - DNA, 22 bp, Homo sapiens
cctgcccctcaactctcctcca

SEQ ID NO: 2222869 - DNA, 16 bp, Homo sapiens
cctgccctcccacccc

SEQ ID NO: 2222870 - DNA, 15 bp, Homo sapiens
cctgccctgtgggcc

SEQ ID NO: 2222871 - DNA, 22 bp, Homo sapiens
cctgcccttacctgccaggaag

SEQ ID NO: 2222872 - DNA, 20 bp, Homo sapiens
cctgcctcctttgtgaggaa

SEQ ID NO: 2222873 - DNA, 23 bp, Homo sapiens
cctgcctcctttgtgaggaagcc

SEQ ID NO: 2222874 - DNA, 18 bp, Homo sapiens
cctgcctgttgggccagg

SEQ ID NO: 2222875 - DNA, 19 bp, Homo sapiens
cctgcctgttgggccagga

SEQ ID NO: 2222876 - DNA, 20 bp, Homo sapiens
cctgcctgttgggccaggag

SEQ ID NO: 2222877 - DNA, 22 bp, Homo sapiens
cctgcctgttgggccaggagcc

SEQ ID NO: 2222878 - DNA, 17 bp, Homo sapiens
cctgcggaagccacagg

SEQ ID NO: 2222879 - DNA, 20 bp, Homo sapiens
cctgcggaagccacagggtg

SEQ ID NO: 2222880 - DNA, 23 bp, Homo sapiens
cctgcggaagccacagggtgagc

SEQ ID NO: 2222881 - DNA, 17 bp, Homo sapiens
cctgcggtgctatctcc

SEQ ID NO: 2222882 - DNA, 22 bp, Homo sapiens
cctgcggtgctatctcccccag

SEQ ID NO: 2222883 - DNA, 13 bp, Homo sapiens
cctgctccagctg

SEQ ID NO: 2222884 - DNA, 16 bp, Homo sapiens
cctgctgcagttgcca

SEQ ID NO: 2222885 - DNA, 17 bp, Homo sapiens
cctgctgcagttgccag

SEQ ID NO: 2222886 - DNA, 19 bp, Homo sapiens
cctgctgcagttgccagtc

SEQ ID NO: 2222887 - DNA, 21 bp, Homo sapiens
cctgctgcagttgccagtcac

SEQ ID NO: 2222888 - DNA, 22 bp, Homo sapiens
cctgctgcagttgccagtcacc

SEQ ID NO: 2222889 - DNA, 13 bp, Homo sapiens
cctgctggttcag

SEQ ID NO: 2222890 - DNA, 14 bp, Homo sapiens
cctgcttcaaatat

SEQ ID NO: 2222891 - DNA, 18 bp, Homo sapiens
cctggaatatataaccag

SEQ ID NO: 2222892 - DNA, 16 bp, Homo sapiens
cctggagttctggttc

SEQ ID NO: 2222893 - DNA, 13 bp, Homo sapiens
cctggatgcagcc

SEQ ID NO: 2222894 - DNA, 19 bp, Homo sapiens
cctggatgcagcctcacag

SEQ ID NO: 2222895 - DNA, 19 bp, Homo sapiens
cctggcacccggcccctgc

SEQ ID NO: 2222896 - DNA, 22 bp, Homo sapiens
cctggcacccggcccctgctgg

SEQ ID NO: 2222897 - DNA, 13 bp, Homo sapiens
cctggcactgctt

SEQ ID NO: 2222898 - DNA, 17 bp, Homo sapiens
cctggcactgcttccag

SEQ ID NO: 2222899 - DNA, 21 bp, Homo sapiens
cctggcactgcttccagtgag

SEQ ID NO: 2222900 - DNA, 14 bp, Homo sapiens
cctggcagcccctg

SEQ ID NO: 2222901 - DNA, 14 bp, Homo sapiens
cctggcatgggaat

SEQ ID NO: 2222902 - DNA, 17 bp, Homo sapiens
cctggcatgggaatgaa

SEQ ID NO: 2222903 - DNA, 15 bp, Homo sapiens
cctggccagatgcac

SEQ ID NO: 2222904 - DNA, 21 bp, Homo sapiens
cctggccagatgcaccagccc

SEQ ID NO: 2222905 - DNA, 23 bp, Homo sapiens
cctggccagatgcaccagccctt

SEQ ID NO: 2222906 - DNA, 12 bp, Homo sapiens
cctggcctctgc

SEQ ID NO: 2222907 - DNA, 16 bp, Homo sapiens
cctgggatccctcatc

SEQ ID NO: 2222908 - DNA, 16 bp, Homo sapiens
cctgggcagaaggaag

SEQ ID NO: 2222909 - DNA, 15 bp, Homo sapiens
cctggggagaaagta

SEQ ID NO: 2222910 - DNA, 13 bp, Homo sapiens
cctggggtaggag

SEQ ID NO: 2222911 - DNA, 14 bp, Homo sapiens
cctggggtaggagg

SEQ ID NO: 2222912 - DNA, 16 bp, Homo sapiens
cctggtggcagctcac

SEQ ID NO: 2222913 - DNA, 22 bp, Homo sapiens
cctggtggcagctcacctctcc

SEQ ID NO: 2222914 - DNA, 16 bp, Homo sapiens
cctggtggcagctgcg

SEQ ID NO: 2222915 - DNA, 18 bp, Homo sapiens
cctggtggcagtgggagc

SEQ ID NO: 2222916 - DNA, 13 bp, Homo sapiens
cctggtgtggaag

SEQ ID NO: 2222917 - DNA, 23 bp, Homo sapiens
cctgtagagtgggagctgagtgg

SEQ ID NO: 2222918 - DNA, 14 bp, Homo sapiens
cctgtccccctgac

SEQ ID NO: 2222919 - DNA, 17 bp, Homo sapiens
cctgtgatggggccctg

SEQ ID NO: 2222920 - DNA, 19 bp, Homo sapiens
cctgtgatggggccctgcc

SEQ ID NO: 2222921 - DNA, 17 bp, Homo sapiens
cctgtgcctctgggact

SEQ ID NO: 2222922 - DNA, 19 bp, Homo sapiens
cctgtgcctctgggactgg

SEQ ID NO: 2222923 - DNA, 20 bp, Homo sapiens
cctgtggatgataaaacaca

SEQ ID NO: 2222924 - DNA, 20 bp, Homo sapiens
cctgtgggcccccaaatgga

SEQ ID NO: 2222925 - DNA, 19 bp, Homo sapiens
cctgtgtcttgcaatggca

SEQ ID NO: 2222926 - DNA, 21 bp, Homo sapiens
cctgtgtcttgcaatggcagc

SEQ ID NO: 2222927 - DNA, 22 bp, Homo sapiens
cctgtgtcttgcaatggcagcc

SEQ ID NO: 2222928 - DNA, 20 bp, Homo sapiens
cctgtgtgtgcgcctacagg

SEQ ID NO: 2222929 - DNA, 20 bp, Homo sapiens
cctgttcagctccagctcac

SEQ ID NO: 2222930 - DNA, 18 bp, Homo sapiens
cctgttcccatgagatga

SEQ ID NO: 2222931 - DNA, 12 bp, Homo sapiens
cctgttctggca

SEQ ID NO: 2222932 - DNA, 18 bp, Homo sapiens
cctgttgggccaggagcc

SEQ ID NO: 2222933 - DNA, 20 bp, Homo sapiens
cctgttgggccaggagcctc

SEQ ID NO: 2222934 - DNA, 23 bp, Homo sapiens
cctgttgggccaggagcctcctg

SEQ ID NO: 2222935 - DNA, 13 bp, Homo sapiens
ccttaccagcaga

SEQ ID NO: 2222936 - DNA, 16 bp, Homo sapiens
ccttaccagcagagca

SEQ ID NO: 2222937 - DNA, 20 bp, Homo sapiens
ccttaccagcagagcacctt

SEQ ID NO: 2222938 - DNA, 20 bp, Homo sapiens
ccttacctcggtgccttcct

SEQ ID NO: 2222939 - DNA, 16 bp, Homo sapiens
ccttagacagtccctg

SEQ ID NO: 2222940 - DNA, 19 bp, Homo sapiens
ccttagacagtccctgcca

SEQ ID NO: 2222941 - DNA, 20 bp, Homo sapiens
ccttagcagggaaacagcta

SEQ ID NO: 2222942 - DNA, 14 bp, Homo sapiens
ccttatggaacact

SEQ ID NO: 2222943 - DNA, 17 bp, Homo sapiens
ccttatggaacactctg

SEQ ID NO: 2222944 - DNA, 18 bp, Homo sapiens
ccttatggaacactctga

SEQ ID NO: 2222945 - DNA, 19 bp, Homo sapiens
ccttcacctttgtccccac

SEQ ID NO: 2222946 - DNA, 20 bp, Homo sapiens
ccttcagtgccttatggaac

SEQ ID NO: 2222947 - DNA, 16 bp, Homo sapiens
ccttccaggggtggga

SEQ ID NO: 2222948 - DNA, 17 bp, Homo sapiens
ccttccatggactttgt

SEQ ID NO: 2222949 - DNA, 12 bp, Homo sapiens
ccttcccacctc

SEQ ID NO: 2222950 - DNA, 14 bp, Homo sapiens
ccttcctctttcca

SEQ ID NO: 2222951 - DNA, 13 bp, Homo sapiens
ccttcgctcctgt

SEQ ID NO: 2222952 - DNA, 15 bp, Homo sapiens
ccttctccttcacct

SEQ ID NO: 2222953 - DNA, 17 bp, Homo sapiens
ccttctctccagcccct

SEQ ID NO: 2222954 - DNA, 19 bp, Homo sapiens
ccttctctccagcccctgg

SEQ ID NO: 2222955 - DNA, 17 bp, Homo sapiens
ccttgaactttgacctc

SEQ ID NO: 2222956 - DNA, 14 bp, Homo sapiens
ccttgacagggcac

SEQ ID NO: 2222957 - DNA, 22 bp, Homo sapiens
ccttgaccattctccacctgcc

SEQ ID NO: 2222958 - DNA, 13 bp, Homo sapiens
ccttgactctttc

SEQ ID NO: 2222959 - DNA, 22 bp, Homo sapiens
ccttgagttgattcagctctgc

SEQ ID NO: 2222960 - DNA, 20 bp, Homo sapiens
ccttgccgtctacctgaggg

SEQ ID NO: 2222961 - DNA, 13 bp, Homo sapiens
ccttggctgcagg

SEQ ID NO: 2222962 - DNA, 16 bp, Homo sapiens
ccttgtggtcccaccc

SEQ ID NO: 2222963 - DNA, 14 bp, Homo sapiens
cctttagcgcccag

SEQ ID NO: 2222964 - DNA, 15 bp, Homo sapiens
cctttcaataggaaa

SEQ ID NO: 2222965 - DNA, 18 bp, Homo sapiens
cctttgacgccatcccag

SEQ ID NO: 2222966 - DNA, 21 bp, Homo sapiens
cctttgacgccatcccagccc

SEQ ID NO: 2222967 - DNA, 24 bp, Homo sapiens
cctttgtattctctcctgtacctc

SEQ ID NO: 2222968 - DNA, 16 bp, Homo sapiens
cctttgtccccaccgc

SEQ ID NO: 2222969 - DNA, 18 bp, Homo sapiens
cctttgtccccaccgcag

SEQ ID NO: 2222970 - DNA, 22 bp, Homo sapiens
cctttgtccccaccgcagacag

SEQ ID NO: 2222971 - DNA, 23 bp, Homo sapiens
cctttgtccccaccgcagacagg

SEQ ID NO: 2222972 - DNA, 16 bp, Homo sapiens
cctttgtgaggaagcc

SEQ ID NO: 2222973 - DNA, 20 bp, Homo sapiens
ccttttcgcaggattcttcc

SEQ ID NO: 2222974 - DNA, 19 bp, Homo sapiens
cgaaagggacttggaagct

SEQ ID NO: 2222975 - DNA, 23 bp, Homo sapiens
cgaaagggacttggaagctccgc

SEQ ID NO: 2222976 - DNA, 17 bp, Homo sapiens
cgaaccgtgaggagggg

SEQ ID NO: 2222977 - DNA, 12 bp, Homo sapiens
cgaatattgctg

SEQ ID NO: 2222978 - DNA, 14 bp, Homo sapiens
cgaatattgctgat

SEQ ID NO: 2222979 - DNA, 23 bp, Homo sapiens
cgaccacccccgatgggatggct

SEQ ID NO: 2222980 - DNA, 23 bp, Homo sapiens
cgaccagacaccttgacagggca

SEQ ID NO: 2222981 - DNA, 17 bp, Homo sapiens
cgagatcacgccactgc

SEQ ID NO: 2222982 - DNA, 18 bp, Homo sapiens
cgagatcacgccactgca

SEQ ID NO: 2222983 - DNA, 18 bp, Homo sapiens
cgagccctggtggcagtg

SEQ ID NO: 2222984 - DNA, 23 bp, Homo sapiens
ctgaggaatccagacccggctgc

SEQ ID NO: 2222985 - DNA, 12 bp, Homo sapiens
ctgaggcccaga

SEQ ID NO: 2222986 - DNA, 16 bp, Homo sapiens
ctgaggcccagagggc

SEQ ID NO: 2222987 - DNA, 17 bp, Homo sapiens
ctgaggcccagagggcc

SEQ ID NO: 2222988 - DNA, 23 bp, Homo sapiens
ctgaggcccagagggcctgcaag

SEQ ID NO: 2222989 - DNA, 19 bp, Homo sapiens
ctgaggcccttctctccag

SEQ ID NO: 2222990 - DNA, 23 bp, Homo sapiens
ctgaggcccttctctccagcccc

SEQ ID NO: 2222991 - DNA, 24 bp, Homo sapiens
ctgaggcccttctctccagcccct

SEQ ID NO: 2222992 - DNA, 12 bp, Homo sapiens
ctgaggtgggag

SEQ ID NO: 2222993 - DNA, 17 bp, Homo sapiens
ctgagtacgttgtgcat

SEQ ID NO: 2222994 - DNA, 19 bp, Homo sapiens
ctgagtacgttgtgcattt

SEQ ID NO: 2222995 - DNA, 20 bp, Homo sapiens
ctgagtacgttgtgcatttg

SEQ ID NO: 2222996 - DNA, 21 bp, Homo sapiens
ctgagtacgttgtgcatttgg

SEQ ID NO: 2222997 - DNA, 22 bp, Homo sapiens
ctgagtgggggatcacagcctc

SEQ ID NO: 2222998 - DNA, 13 bp, Homo sapiens
ctgataaagatga

SEQ ID NO: 2222999 - DNA, 21 bp, Homo sapiens
ctgataaagatgagtgagcat

SEQ ID NO: 2223000 - DNA, 18 bp, Homo sapiens
ctgatctctcgtgattga

SEQ ID NO: 2223001 - DNA, 16 bp, Homo sapiens
ctgatgcttcttcaga

SEQ ID NO: 2223002 - DNA, 20 bp, Homo sapiens
ctgatgcttcttcagagact

SEQ ID NO: 2223003 - DNA, 18 bp, Homo sapiens
ctgatgggcaacccccag

SEQ ID NO: 2223004 - DNA, 22 bp, Homo sapiens
ctgatgggcaacccccagcctg

SEQ ID NO: 2223005 - DNA, 22 bp, Homo sapiens
ctgattcccaagctctgctcct

SEQ ID NO: 2223006 - DNA, 21 bp, Homo sapiens
ctgattgtgtctcttggtcct

SEQ ID NO: 2223007 - DNA, 16 bp, Homo sapiens
ctgatttttttttcct

SEQ ID NO: 2223008 - DNA, 22 bp, Homo sapiens
ctgatttttttttccttcagtg

SEQ ID NO: 2223009 - DNA, 23 bp, Homo sapiens
ctgatttttttttccttcagtgc

SEQ ID NO: 2223010 - DNA, 21 bp, Homo sapiens
ctgcaaagggtatcaggtgct

SEQ ID NO: 2223011 - DNA, 22 bp, Homo sapiens
ctgcaaagggtatcaggtgctg

SEQ ID NO: 2223012 - DNA, 19 bp, Homo sapiens
ctgcaacctgattgtgtct

SEQ ID NO: 2223013 - DNA, 21 bp, Homo sapiens
ctgcaacctgattgtgtctct

SEQ ID NO: 2223014 - DNA, 22 bp, Homo sapiens
ctgcaacctgattgtgtctctt

SEQ ID NO: 2223015 - DNA, 12 bp, Homo sapiens
ctgcaagggagt

SEQ ID NO: 2223016 - DNA, 14 bp, Homo sapiens
ctgcacaagctgca

SEQ ID NO: 2223017 - DNA, 18 bp, Homo sapiens
ctgcacaagctgcaccct

SEQ ID NO: 2223018 - DNA, 14 bp, Homo sapiens
ctgcaccggctggc

SEQ ID NO: 2223019 - DNA, 16 bp, Homo sapiens
ctgcaccggctggcct

SEQ ID NO: 2223020 - DNA, 20 bp, Homo sapiens
ctgcaccggctggcctggcc

SEQ ID NO: 2223021 - DNA, 15 bp, Homo sapiens
ctgcaccgggccaca

SEQ ID NO: 2223022 - DNA, 20 bp, Homo sapiens
ctgcaccgggccacagagaa

SEQ ID NO: 2223023 - DNA, 23 bp, Homo sapiens
ctgcaccgggccacagagaaagt

SEQ ID NO: 2223024 - DNA, 16 bp, Homo sapiens
ctgcactatagcctag

SEQ ID NO: 2223025 - DNA, 15 bp, Homo sapiens
ctgcactccagcctg

SEQ ID NO: 2223026 - DNA, 19 bp, Homo sapiens
ctgcactcccctgctgggt

SEQ ID NO: 2223027 - DNA, 15 bp, Homo sapiens
ctgcagcaataaagc

SEQ ID NO: 2223028 - DNA, 22 bp, Homo sapiens
ctgcagcctcaacctcctgggc

SEQ ID NO: 2223029 - DNA, 23 bp, Homo sapiens
ctgcagcctcaacctcctgggct

SEQ ID NO: 2223030 - DNA, 16 bp, Homo sapiens
ctgcaggcagccaggc

SEQ ID NO: 2223031 - DNA, 17 bp, Homo sapiens
ctgcaggcagccaggcc

SEQ ID NO: 2223032 - DNA, 18 bp, Homo sapiens
ctgcaggcagccaggcca

SEQ ID NO: 2223033 - DNA, 19 bp, Homo sapiens
ctgcaggcagccaggccac

SEQ ID NO: 2223034 - DNA, 20 bp, Homo sapiens
ctgcaggcagccaggccaca

SEQ ID NO: 2223035 - DNA, 10 bp, Homo sapiens
ctgcagggaa

SEQ ID NO: 2223036 - DNA, 16 bp, Homo sapiens
ctgcagttgccagtca

SEQ ID NO: 2223037 - DNA, 19 bp, Homo sapiens
ctgcagttgccagtcaccc

SEQ ID NO: 2223038 - DNA, 15 bp, Homo sapiens
ctgcatatgaaagga

SEQ ID NO: 2223039 - DNA, 16 bp, Homo sapiens
ctgcatcgtttcatct

SEQ ID NO: 2223040 - DNA, 18 bp, Homo sapiens
ctgcatttaaaagataca

SEQ ID NO: 2223041 - DNA, 15 bp, Homo sapiens
ctgccaccctgggga

SEQ ID NO: 2223042 - DNA, 16 bp, Homo sapiens
ctgccaccctggggag

SEQ ID NO: 2223043 - DNA, 22 bp, Homo sapiens
ctgccaggaagccagcaggctc

SEQ ID NO: 2223044 - DNA, 11 bp, Homo sapiens
ctgccaggcat

SEQ ID NO: 2223045 - DNA, 13 bp, Homo sapiens
ctgccaggcatgg

SEQ ID NO: 2223046 - DNA, 23 bp, Homo sapiens
ctgccagggacagagggggtggc

SEQ ID NO: 2223047 - DNA, 16 bp, Homo sapiens
ctgccatattctgttg

SEQ ID NO: 2223048 - DNA, 16 bp, Homo sapiens
ctgccatccaggttca

SEQ ID NO: 2223049 - DNA, 15 bp, Homo sapiens
ctgccatttctgaga

SEQ ID NO: 2223050 - DNA, 16 bp, Homo sapiens
ctgccatttctgagat

SEQ ID NO: 2223051 - DNA, 18 bp, Homo sapiens
ctgcccacctggcctctg

SEQ ID NO: 2223052 - DNA, 20 bp, Homo sapiens
ctgcccacctggcctctgca

SEQ ID NO: 2223053 - DNA, 22 bp, Homo sapiens
ctgcccacctggcctctgcact

SEQ ID NO: 2223054 - DNA, 18 bp, Homo sapiens
ctgcccactccctgcaac

SEQ ID NO: 2223055 - DNA, 15 bp, Homo sapiens
ctgcccaggcccctg

SEQ ID NO: 2223056 - DNA, 18 bp, Homo sapiens
ctgcccccaccccaggct

SEQ ID NO: 2223057 - DNA, 16 bp, Homo sapiens
ctgcccctggcagccc

SEQ ID NO: 2223058 - DNA, 18 bp, Homo sapiens
ctgcccctggcagcccct

SEQ ID NO: 2223059 - DNA, 14 bp, Homo sapiens
ctgccctgcccacc

SEQ ID NO: 2223060 - DNA, 15 bp, Homo sapiens
ctgccctgcccacct

SEQ ID NO: 2223061 - DNA, 21 bp, Homo sapiens
ctgccctgcccacctggcctc

SEQ ID NO: 2223062 - DNA, 12 bp, Homo sapiens
ctgccctgtgag

SEQ ID NO: 2223063 - DNA, 13 bp, Homo sapiens
ctgccctgtgagt

SEQ ID NO: 2223064 - DNA, 12 bp, Homo sapiens
ctgcccttacct

SEQ ID NO: 2223065 - DNA, 16 bp, Homo sapiens
ctgcccttacctgcca

SEQ ID NO: 2223066 - DNA, 23 bp, Homo sapiens
ctgcccttacctgccaggaagcc

SEQ ID NO: 2223067 - DNA, 13 bp, Homo sapiens
ctgccgcagccct

SEQ ID NO: 2223068 - DNA, 14 bp, Homo sapiens
ctgccgcagccctg

SEQ ID NO: 2223069 - DNA, 18 bp, Homo sapiens
ctgccgcagccctgcaga

SEQ ID NO: 2223070 - DNA, 19 bp, Homo sapiens
ctgcctcagcctcccaaag

SEQ ID NO: 2223071 - DNA, 12 bp, Homo sapiens
ctgcctcccatc

SEQ ID NO: 2223072 - DNA, 16 bp, Homo sapiens
ctgcctcccatcaccc

SEQ ID NO: 2223073 - DNA, 19 bp, Homo sapiens
ctgcctcgaactggctgca

SEQ ID NO: 2223074 - DNA, 20 bp, Homo sapiens
ctgcctcgaactggctgcaa

SEQ ID NO: 2223075 - DNA, 22 bp, Homo sapiens
ctgcctctcccatcacttccct

SEQ ID NO: 2223076 - DNA, 18 bp, Homo sapiens
ctgcctctgacacacagc

SEQ ID NO: 2223077 - DNA, 13 bp, Homo sapiens
ctgcctcttctct

SEQ ID NO: 2223078 - DNA, 14 bp, Homo sapiens
ctgcctcttctcta

SEQ ID NO: 2223079 - DNA, 16 bp, Homo sapiens
ctgcctgaagtcacac

SEQ ID NO: 2223080 - DNA, 19 bp, Homo sapiens
ctgcctgaagtcacacagt

SEQ ID NO: 2223081 - DNA, 20 bp, Homo sapiens
ctgcctgcccaggcccctgc

SEQ ID NO: 2223082 - DNA, 21 bp, Homo sapiens
ctgcctgcccaggcccctgcc

SEQ ID NO: 2223083 - DNA, 22 bp, Homo sapiens
ctgcctgcccaggcccctgcca

SEQ ID NO: 2223084 - DNA, 21 bp, Homo sapiens
ctgcctgggatccctcatcct

SEQ ID NO: 2223085 - DNA, 18 bp, Homo sapiens
ctgcctgttcagctccag

SEQ ID NO: 2223086 - DNA, 23 bp, Homo sapiens
ctgcctgttcagctccagctcac

SEQ ID NO: 2223087 - DNA, 22 bp, Homo sapiens
ctgcctgttgggccaggagcct

SEQ ID NO: 2223088 - DNA, 15 bp, Homo sapiens
ctgcggtccacccag

SEQ ID NO: 2223089 - DNA, 17 bp, Homo sapiens
ctgcggtccacccagga

SEQ ID NO: 2223090 - DNA, 20 bp, Homo sapiens
ctgcggtccacccaggagcc

SEQ ID NO: 2223091 - DNA, 23 bp, Homo sapiens
ctgcggtccacccaggagccccg

SEQ ID NO: 2223092 - DNA, 18 bp, Homo sapiens
ctgcggtgctatctcccc

SEQ ID NO: 2223093 - DNA, 19 bp, Homo sapiens
ctgcggtgctatctccccc

SEQ ID NO: 2223094 - DNA, 17 bp, Homo sapiens
ctgctatcaaagaggtt

SEQ ID NO: 2223095 - DNA, 14 bp, Homo sapiens
ctgctccagctgtt

SEQ ID NO: 2223096 - DNA, 19 bp, Homo sapiens
ctgctccagctgttcagct

SEQ ID NO: 2223097 - DNA, 19 bp, Homo sapiens
ctgctcctctccccagcaa

SEQ ID NO: 2223098 - DNA, 20 bp, Homo sapiens
ctgctcctctccccagcaag

SEQ ID NO: 2223099 - DNA, 19 bp, Homo sapiens
ctgctctccgaccagacac

SEQ ID NO: 2223100 - DNA, 15 bp, Homo sapiens
ctgctgacagacaca

SEQ ID NO: 2223101 - DNA, 19 bp, Homo sapiens
ctgctgacagacacaggcc

SEQ ID NO: 2223102 - DNA, 13 bp, Homo sapiens
ctgctgacagtgt

SEQ ID NO: 2223103 - DNA, 10 bp, Homo sapiens
ctgctgcagt

SEQ ID NO: 2223104 - DNA, 13 bp, Homo sapiens
ctgctgcagttgc

SEQ ID NO: 2223105 - DNA, 15 bp, Homo sapiens
ctgctgcagttgcca

SEQ ID NO: 2223106 - DNA, 15 bp, Homo sapiens
ctgctgctggctggt

SEQ ID NO: 2223107 - DNA, 13 bp, Homo sapiens
ctttccctccctt

SEQ ID NO: 2223108 - DNA, 20 bp, Homo sapiens
ctttcctgaggctgggctcc

SEQ ID NO: 2223109 - DNA, 21 bp, Homo sapiens
ctttcctgaggctgggctccc

SEQ ID NO: 2223110 - DNA, 22 bp, Homo sapiens
ctttcctgaggctgggctccct

SEQ ID NO: 2223111 - DNA, 15 bp, Homo sapiens
ctttctagccagagg

SEQ ID NO: 2223112 - DNA, 16 bp, Homo sapiens
ctttctagccagagga

SEQ ID NO: 2223113 - DNA, 19 bp, Homo sapiens
ctttctggctatgcatttg

SEQ ID NO: 2223114 - DNA, 13 bp, Homo sapiens
ctttgacctctgc

SEQ ID NO: 2223115 - DNA, 14 bp, Homo sapiens
ctttgacctctgca

SEQ ID NO: 2223116 - DNA, 15 bp, Homo sapiens
ctttgacctctgcag

SEQ ID NO: 2223117 - DNA, 18 bp, Homo sapiens
ctttgacctctgcagcaa

SEQ ID NO: 2223118 - DNA, 17 bp, Homo sapiens
ctttgacgccatcccag

SEQ ID NO: 2223119 - DNA, 15 bp, Homo sapiens
ctttgcagacaggca

SEQ ID NO: 2223120 - DNA, 15 bp, Homo sapiens
ctttggaccctgagg

SEQ ID NO: 2223121 - DNA, 20 bp, Homo sapiens
ctttggtctacactgtgctg

SEQ ID NO: 2223122 - DNA, 15 bp, Homo sapiens
ctttgtccccaccgc

SEQ ID NO: 2223123 - DNA, 19 bp, Homo sapiens
ctttgtgaggaagccgctg

SEQ ID NO: 2223124 - DNA, 13 bp, Homo sapiens
ctttgtggcttcc

SEQ ID NO: 2223125 - DNA, 14 bp, Homo sapiens
ctttgttctggctc

SEQ ID NO: 2223126 - DNA, 21 bp, Homo sapiens
ctttgttctggctcttccagg

SEQ ID NO: 2223127 - DNA, 21 bp, Homo sapiens
ctttgtttgttgtcagctgaa

SEQ ID NO: 2223128 - DNA, 14 bp, Homo sapiens
cttttataaacttt

SEQ ID NO: 2223129 - DNA, 15 bp, Homo sapiens
cttttcaaaacattt

SEQ ID NO: 2223130 - DNA, 23 bp, Homo sapiens
cttttccaaccctcatcaccaac

SEQ ID NO: 2223131 - DNA, 20 bp, Homo sapiens
cttttcgcaggattcttcct

SEQ ID NO: 2223132 - DNA, 18 bp, Homo sapiens
cttttctgtccgagcttt

SEQ ID NO: 2223133 - DNA, 18 bp, Homo sapiens
cttttcttgcatgaggct

SEQ ID NO: 2223134 - DNA, 16 bp, Homo sapiens
cttttgagcatttaga

SEQ ID NO: 2223135 - DNA, 21 bp, Homo sapiens
cttttgagtgccttacacaat

SEQ ID NO: 2223136 - DNA, 18 bp, Homo sapiens
cttttgtctatgggactc

SEQ ID NO: 2223137 - DNA, 18 bp, Homo sapiens
cttttgtgcattatctag

SEQ ID NO: 2223138 - DNA, 11 bp, Homo sapiens
cttttgttctt

SEQ ID NO: 2223139 - DNA, 22 bp, Homo sapiens
ctttttaatattgatatgctta

SEQ ID NO: 2223140 - DNA, 18 bp, Homo sapiens
cttttttatacataaaca

SEQ ID NO: 2223141 - DNA, 15 bp, Homo sapiens
cttttttcactacat

SEQ ID NO: 2223142 - DNA, 17 bp, Homo sapiens
cttttttcggctaaaaa

SEQ ID NO: 2223143 - DNA, 23 bp, Homo sapiens
gaaaaagacctcgtggagaattt

SEQ ID NO: 2223144 - DNA, 17 bp, Homo sapiens
gaaaaaggatgcacaga

SEQ ID NO: 2223145 - DNA, 14 bp, Homo sapiens
gaaaacacattttt

SEQ ID NO: 2223146 - DNA, 19 bp, Homo sapiens
gaaaacactgttctctgcc

SEQ ID NO: 2223147 - DNA, 20 bp, Homo sapiens
gaaaacactgttctctgccc

SEQ ID NO: 2223148 - DNA, 15 bp, Homo sapiens
gaaaacatgctacac

SEQ ID NO: 2223149 - DNA, 16 bp, Homo sapiens
gaaaacatgctacaca

SEQ ID NO: 2223150 - DNA, 22 bp, Homo sapiens
gaaaacgtggctgcttcaagga

SEQ ID NO: 2223151 - DNA, 23 bp, Homo sapiens
gaaaagaaaaatgagcctggcaa

SEQ ID NO: 2223152 - DNA, 17 bp, Homo sapiens
gaaaagctgctgacagt

SEQ ID NO: 2223153 - DNA, 20 bp, Homo sapiens
gaaaatcagcctgctccagc

SEQ ID NO: 2223154 - DNA, 22 bp, Homo sapiens
gaaaatcagcctgctccagctg

SEQ ID NO: 2223155 - DNA, 23 bp, Homo sapiens
gaaaatggacgtgttatgactcc

SEQ ID NO: 2223156 - DNA, 14 bp, Homo sapiens
gaaaattttaaaaa

SEQ ID NO: 2223157 - DNA, 18 bp, Homo sapiens
gaaaattttgatgtttta

SEQ ID NO: 2223158 - DNA, 18 bp, Homo sapiens
gaaagactatctaaatgt

SEQ ID NO: 2223159 - DNA, 19 bp, Homo sapiens
gaaagacttttccaaccct

SEQ ID NO: 2223160 - DNA, 14 bp, Homo sapiens
gaaagagagagaga

SEQ ID NO: 2223161 - DNA, 16 bp, Homo sapiens
gaaagagtaggaagac

SEQ ID NO: 2223162 - DNA, 22 bp, Homo sapiens
gaaagccctgagctttctgcta

SEQ ID NO: 2223163 - DNA, 14 bp, Homo sapiens
gaaaggctccagga

SEQ ID NO: 2223164 - DNA, 15 bp, Homo sapiens
gaaaggctccaggag

SEQ ID NO: 2223165 - DNA, 16 bp, Homo sapiens
gaaaggctccaggagc

SEQ ID NO: 2223166 - DNA, 20 bp, Homo sapiens
gaaagggacgctacccggga

SEQ ID NO: 2223167 - DNA, 16 bp, Homo sapiens
gaaagggcccagagag

SEQ ID NO: 2223168 - DNA, 21 bp, Homo sapiens
gaaagtacttctccaccctgc

SEQ ID NO: 2223169 - DNA, 14 bp, Homo sapiens
gaaatgggcagagc

SEQ ID NO: 2223170 - DNA, 19 bp, Homo sapiens
gaaatgggcagagcagaga

SEQ ID NO: 2223171 - DNA, 17 bp, Homo sapiens
gaaatttgttataatga

SEQ ID NO: 2223172 - DNA, 17 bp, Homo sapiens
gaacactccttcacaga

SEQ ID NO: 2223173 - DNA, 13 bp, Homo sapiens
gaacactctgaga

SEQ ID NO: 2223174 - DNA, 14 bp, Homo sapiens
gaacactctgagac

SEQ ID NO: 2223175 - DNA, 20 bp, Homo sapiens
gaacaggtttaaaaatcccc

SEQ ID NO: 2223176 - DNA, 20 bp, Homo sapiens
gaaccacatcttgctctgct

SEQ ID NO: 2223177 - DNA, 17 bp, Homo sapiens
gaaccaccacacccagc

SEQ ID NO: 2223178 - DNA, 20 bp, Homo sapiens
gaaccaccacacccagccca

SEQ ID NO: 2223179 - DNA, 21 bp, Homo sapiens
gaaccaccacacccagcccac

SEQ ID NO: 2223180 - DNA, 21 bp, Homo sapiens
gaaccttttgagtgccttaca

SEQ ID NO: 2223181 - DNA, 13 bp, Homo sapiens
gaactcctggcct

SEQ ID NO: 2223182 - DNA, 11 bp, Homo sapiens
gaactggctgc

SEQ ID NO: 2223183 - DNA, 14 bp, Homo sapiens
gaacttaaataatg

SEQ ID NO: 2223184 - DNA, 13 bp, Homo sapiens
gaacttgaaaaaa

SEQ ID NO: 2223185 - DNA, 20 bp, Homo sapiens
gaacttgaaaaaaaaaaaca

SEQ ID NO: 2223186 - DNA, 21 bp, Homo sapiens
gaacttgaaaaaaaaaaacac

SEQ ID NO: 2223187 - DNA, 18 bp, Homo sapiens
gaacttggcgctgcccct

SEQ ID NO: 2223188 - DNA, 12 bp, Homo sapiens
gaacttggttcc

SEQ ID NO: 2223189 - DNA, 17 bp, Homo sapiens
gaactttccaggaaggc

SEQ ID NO: 2223190 - DNA, 16 bp, Homo sapiens
gaagacaatgacttac

SEQ ID NO: 2223191 - DNA, 14 bp, Homo sapiens
gaagacagctctta

SEQ ID NO: 2223192 - DNA, 16 bp, Homo sapiens
gaagacttcatccctc

SEQ ID NO: 2223193 - DNA, 13 bp, Homo sapiens
gaagactttggaa

SEQ ID NO: 2223194 - DNA, 19 bp, Homo sapiens
gaagagaatgcacaaacag

SEQ ID NO: 2223195 - DNA, 17 bp, Homo sapiens
gaagcatttactttgtg

SEQ ID NO: 2223196 - DNA, 18 bp, Homo sapiens
gaagcatttactttgtgt

SEQ ID NO: 2223197 - DNA, 13 bp, Homo sapiens
gaagccacagggt

SEQ ID NO: 2223198 - DNA, 15 bp, Homo sapiens
gaagccacagggtga

SEQ ID NO: 2223199 - DNA, 15 bp, Homo sapiens
gaagccagcaggctc

SEQ ID NO: 2223200 - DNA, 22 bp, Homo sapiens
gaagccagcaggctctcaggcc

SEQ ID NO: 2223201 - DNA, 15 bp, Homo sapiens
gaagcccaggaaagg

SEQ ID NO: 2223202 - DNA, 16 bp, Homo sapiens
gaagcccaggaaaggc

SEQ ID NO: 2223203 - DNA, 20 bp, Homo sapiens
gaagccgctggggccagttg

SEQ ID NO: 2223204 - DNA, 14 bp, Homo sapiens
gaagctcagggcct

SEQ ID NO: 2223205 - DNA, 15 bp, Homo sapiens
gaagctcagggcctg

SEQ ID NO: 2223206 - DNA, 17 bp, Homo sapiens
gaagctcagggcctggc

SEQ ID NO: 2223207 - DNA, 23 bp, Homo sapiens
gaagctcagggcctggctcaggt

SEQ ID NO: 2223208 - DNA, 18 bp, Homo sapiens
gaaggaaacccagctctg

SEQ ID NO: 2223209 - DNA, 15 bp, Homo sapiens
gaaggaacgtcccct

SEQ ID NO: 2223210 - DNA, 12 bp, Homo sapiens
gaaggatacaaa

SEQ ID NO: 2223211 - DNA, 19 bp, Homo sapiens
gaaggatacaaaagcatgt

SEQ ID NO: 2223212 - DNA, 16 bp, Homo sapiens
gaaggccccgcccagg

SEQ ID NO: 2223213 - DNA, 17 bp, Homo sapiens
gaaggccccgcccaggc

SEQ ID NO: 2223214 - DNA, 15 bp, Homo sapiens
gaaggctgggttctg

SEQ ID NO: 2223215 - DNA, 17 bp, Homo sapiens
gaaggggcccaagagag

SEQ ID NO: 2223216 - DNA, 19 bp, Homo sapiens
gaaggggcccaagagagac

SEQ ID NO: 2223217 - DNA, 15 bp, Homo sapiens
gaagggggctgggac

SEQ ID NO: 2223218 - DNA, 19 bp, Homo sapiens
gaagggggctgggacatgg

SEQ ID NO: 2223219 - DNA, 17 bp, Homo sapiens
gaaggtttttgtttctt

SEQ ID NO: 2223220 - DNA, 20 bp, Homo sapiens
gaagtctttgtacagacaac

SEQ ID NO: 2223221 - DNA, 12 bp, Homo sapiens
gaagtttctgcc

SEQ ID NO: 2223222 - DNA, 21 bp, Homo sapiens
gaagtttctgccgcagccctg

SEQ ID NO: 2223223 - DNA, 20 bp, Homo sapiens
gaagtttgagatcagcctgg

SEQ ID NO: 2223224 - DNA, 19 bp, Homo sapiens
gaataacatgtaattaagt

SEQ ID NO: 2223225 - DNA, 15 bp, Homo sapiens
gaatacctgtccccc

SEQ ID NO: 2223226 - DNA, 14 bp, Homo sapiens
gaatagctgggact

SEQ ID NO: 2223227 - DNA, 13 bp, Homo sapiens
gaatattgctgat

SEQ ID NO: 2223228 - DNA, 15 bp, Homo sapiens
gaatattgctgatgg

SEQ ID NO: 2223229 - DNA, 23 bp, Homo sapiens
gaatattgctgatggtgcaatga

SEQ ID NO: 2223230 - DNA, 24 bp, Homo sapiens
gaatattgctgatggtgcaatgac

SEQ ID NO: 2223231 - DNA, 12 bp, Homo sapiens
gcagaaggaaga

SEQ ID NO: 2223232 - DNA, 12 bp, Homo sapiens
gcagacaggcaa

SEQ ID NO: 2223233 - DNA, 23 bp, Homo sapiens
gcagacaggcaagcacctcctgc

SEQ ID NO: 2223234 - DNA, 17 bp, Homo sapiens
gcagacagttaagagaa

SEQ ID NO: 2223235 - DNA, 15 bp, Homo sapiens
gcagactctacagag

SEQ ID NO: 2223236 - DNA, 21 bp, Homo sapiens
gcagagaatgaaagggcccag

SEQ ID NO: 2223237 - DNA, 22 bp, Homo sapiens
gcagagaccatccctgaaggcc

SEQ ID NO: 2223238 - DNA, 11 bp, Homo sapiens
gcagagagaga

SEQ ID NO: 2223239 - DNA, 20 bp, Homo sapiens
gcagagatgtgcccccaccc

SEQ ID NO: 2223240 - DNA, 24 bp, Homo sapiens
gcagagcaccttagacagtccctg

SEQ ID NO: 2223241 - DNA, 19 bp, Homo sapiens
gcagagcagagaccatccc

SEQ ID NO: 2223242 - DNA, 18 bp, Homo sapiens
gcagaggaaagcaaagga

SEQ ID NO: 2223243 - DNA, 19 bp, Homo sapiens
gcagagttgaagacagagc

SEQ ID NO: 2223244 - DNA, 20 bp, Homo sapiens
gcagagttgaagacagagct

SEQ ID NO: 2223245 - DNA, 21 bp, Homo sapiens
gcagagttgaagacagagcta

SEQ ID NO: 2223246 - DNA, 22 bp, Homo sapiens
gcagatacaggaaaagctgctg

SEQ ID NO: 2223247 - DNA, 14 bp, Homo sapiens
gcagcagagagaga

SEQ ID NO: 2223248 - DNA, 15 bp, Homo sapiens
gcagcagagagagag

SEQ ID NO: 2223249 - DNA, 17 bp, Homo sapiens
gcagcatattcaggaag

SEQ ID NO: 2223250 - DNA, 19 bp, Homo sapiens
gcagcatattcaggaagct

SEQ ID NO: 2223251 - DNA, 14 bp, Homo sapiens
gcagccactattgt

SEQ ID NO: 2223252 - DNA, 13 bp, Homo sapiens
gcagccccacgga

SEQ ID NO: 2223253 - DNA, 24 bp, Homo sapiens
gcagccccattctgcctgcccagg

SEQ ID NO: 2223254 - DNA, 21 bp, Homo sapiens
gcagcccctgttctggcagag

SEQ ID NO: 2223255 - DNA, 22 bp, Homo sapiens
gcagcctcaacctcctgggcta

SEQ ID NO: 2223256 - DNA, 15 bp, Homo sapiens
gcagctcacctctcc

SEQ ID NO: 2223257 - DNA, 16 bp, Homo sapiens
gcagctcacctctccc

SEQ ID NO: 2223258 - DNA, 17 bp, Homo sapiens
gcagctgcggtccaccc

SEQ ID NO: 2223259 - DNA, 20 bp, Homo sapiens
gcaggaggatcacttgagtc

SEQ ID NO: 2223260 - DNA, 23 bp, Homo sapiens
gcaggaggatcacttgagtccag

SEQ ID NO: 2223261 - DNA, 13 bp, Homo sapiens
gcaggcagccagg

SEQ ID NO: 2223262 - DNA, 16 bp, Homo sapiens
gcaggcagccaggcca

SEQ ID NO: 2223263 - DNA, 12 bp, Homo sapiens
gcaggctctcag

SEQ ID NO: 2223264 - DNA, 13 bp, Homo sapiens
gcaggctctcagg

SEQ ID NO: 2223265 - DNA, 14 bp, Homo sapiens
gcaggctctcaggc

SEQ ID NO: 2223266 - DNA, 15 bp, Homo sapiens
gcaggctctcaggcc

SEQ ID NO: 2223267 - DNA, 17 bp, Homo sapiens
gcaggctctcaggccag

SEQ ID NO: 2223268 - DNA, 18 bp, Homo sapiens
gcaggctctcaggccagc

SEQ ID NO: 2223269 - DNA, 20 bp, Homo sapiens
gcaggctctcaggccagctg

SEQ ID NO: 2223270 - DNA, 23 bp, Homo sapiens
gcaggctctcaggccagctgctt

SEQ ID NO: 2223271 - DNA, 22 bp, Homo sapiens
gcagggaaacagctaatgggac

SEQ ID NO: 2223272 - DNA, 16 bp, Homo sapiens
gcagggagggcttctg

SEQ ID NO: 2223273 - DNA, 12 bp, Homo sapiens
gcagggctcagc

SEQ ID NO: 2223274 - DNA, 21 bp, Homo sapiens
gcagggctcagcggggacagc

SEQ ID NO: 2223275 - DNA, 22 bp, Homo sapiens
gcaggggagggtagagcggaga

SEQ ID NO: 2223276 - DNA, 19 bp, Homo sapiens
gcaggtcttgaactcctgg

SEQ ID NO: 2223277 - DNA, 23 bp, Homo sapiens
gcagtgcttccaaggatggacca

SEQ ID NO: 2223278 - DNA, 16 bp, Homo sapiens
gcagtgggagctgcct

SEQ ID NO: 2223279 - DNA, 21 bp, Homo sapiens
gcagtggtgcgatctgggttc

SEQ ID NO: 2223280 - DNA, 22 bp, Homo sapiens
gcagtggtggttttctgttctt

SEQ ID NO: 2223281 - DNA, 14 bp, Homo sapiens
gcagttgccagtca

SEQ ID NO: 2223282 - DNA, 17 bp, Homo sapiens
gcatacgtacacatttt

SEQ ID NO: 2223283 - DNA, 18 bp, Homo sapiens
gcatattcaggaagctca

SEQ ID NO: 2223284 - DNA, 20 bp, Homo sapiens
gcatattcaggaagctcagg

SEQ ID NO: 2223285 - DNA, 22 bp, Homo sapiens
gcatcctggcacccggcccctg

SEQ ID NO: 2223286 - DNA, 23 bp, Homo sapiens
gcatgaagtaatatgcacacatt

SEQ ID NO: 2223287 - DNA, 22 bp, Homo sapiens
gcatgacacgaatattgctgat

SEQ ID NO: 2223288 - DNA, 14 bp, Homo sapiens
gcatgcctggatgg

SEQ ID NO: 2223289 - DNA, 17 bp, Homo sapiens
gcatgcctggatggggc

SEQ ID NO: 2223290 - DNA, 21 bp, Homo sapiens
gcatggctgccaatgggagct

SEQ ID NO: 2223291 - DNA, 16 bp, Homo sapiens
gcatgggaatgaatgt

SEQ ID NO: 2223292 - DNA, 19 bp, Homo sapiens
gcatgtgatgagaggaaat

SEQ ID NO: 2223293 - DNA, 21 bp, Homo sapiens
gcatgtgatgagaggaaatca

SEQ ID NO: 2223294 - DNA, 15 bp, Homo sapiens
gcatgttctctgagg

SEQ ID NO: 2223295 - DNA, 21 bp, Homo sapiens
gcatgttctctgaggacacta

SEQ ID NO: 2223296 - DNA, 17 bp, Homo sapiens
gcatgtttgtgattgac

SEQ ID NO: 2223297 - DNA, 19 bp, Homo sapiens
gcattatctagatactgta

SEQ ID NO: 2223298 - DNA, 12 bp, Homo sapiens
gcattccccagg

SEQ ID NO: 2223299 - DNA, 15 bp, Homo sapiens
gcattccccaggagg

SEQ ID NO: 2223300 - DNA, 19 bp, Homo sapiens
gcattccccaggaggccag

SEQ ID NO: 2223301 - DNA, 13 bp, Homo sapiens
gcattgtgggaag

SEQ ID NO: 2223302 - DNA, 16 bp, Homo sapiens
gcattgtgggaagggg

SEQ ID NO: 2223303 - DNA, 12 bp, Homo sapiens
gcatttaaaaga

SEQ ID NO: 2223304 - DNA, 22 bp, Homo sapiens
gcatttaaaagatacagttact

SEQ ID NO: 2223305 - DNA, 15 bp, Homo sapiens
gcatttactttgtgt

SEQ ID NO: 2223306 - DNA, 16 bp, Homo sapiens
gcatttgaaaattttg

SEQ ID NO: 2223307 - DNA, 13 bp, Homo sapiens
gcatttgctgaat

SEQ ID NO: 2223308 - DNA, 14 bp, Homo sapiens
gcatttgctgaata

SEQ ID NO: 2223309 - DNA, 23 bp, Homo sapiens
gcatttggtggtttcagaaatgt

SEQ ID NO: 2223310 - DNA, 16 bp, Homo sapiens
gccaaactcacctgcc

SEQ ID NO: 2223311 - DNA, 16 bp, Homo sapiens
gccaaagcctcctcca

SEQ ID NO: 2223312 - DNA, 16 bp, Homo sapiens
gccaaagctaggcctg

SEQ ID NO: 2223313 - DNA, 18 bp, Homo sapiens
gccaagaattcttaaata

SEQ ID NO: 2223314 - DNA, 21 bp, Homo sapiens
gccaaggctgggggaagaagc

SEQ ID NO: 2223315 - DNA, 13 bp, Homo sapiens
gccacagagaaag

SEQ ID NO: 2223316 - DNA, 14 bp, Homo sapiens
gccacagagaaagt

SEQ ID NO: 2223317 - DNA, 23 bp, Homo sapiens
gccacagagaaagtacttctcca

SEQ ID NO: 2223318 - DNA, 20 bp, Homo sapiens
gccacattcctgatgcttct

SEQ ID NO: 2223319 - DNA, 19 bp, Homo sapiens
gccaccaacatactcccat

SEQ ID NO: 2223320 - DNA, 17 bp, Homo sapiens
gccacctgcctgttggg

SEQ ID NO: 2223321 - DNA, 22 bp, Homo sapiens
gccacctgcggtgctatctccc

SEQ ID NO: 2223322 - DNA, 17 bp, Homo sapiens
gccactgcaccgggcca

SEQ ID NO: 2223323 - DNA, 18 bp, Homo sapiens
gccactgcaccgggccac

SEQ ID NO: 2223324 - DNA, 19 bp, Homo sapiens
gccactgcaccgggccaca

SEQ ID NO: 2223325 - DNA, 23 bp, Homo sapiens
gccactgcaccgggccacagaga

SEQ ID NO: 2223326 - DNA, 16 bp, Homo sapiens
gccagagacacaagcc

SEQ ID NO: 2223327 - DNA, 17 bp, Homo sapiens
gccagagacacaagcct

SEQ ID NO: 2223328 - DNA, 21 bp, Homo sapiens
gccagagacacaagccttcgg

SEQ ID NO: 2223329 - DNA, 18 bp, Homo sapiens
gccagagggagtgacaga

SEQ ID NO: 2223330 - DNA, 17 bp, Homo sapiens
gccagatgcaccagccc

SEQ ID NO: 2223331 - DNA, 19 bp, Homo sapiens
gccagattctttcctgagg

SEQ ID NO: 2223332 - DNA, 13 bp, Homo sapiens
gccagcaggctct

SEQ ID NO: 2223333 - DNA, 18 bp, Homo sapiens
gccagcaggctctcaggc

SEQ ID NO: 2223334 - DNA, 22 bp, Homo sapiens
gccagccgagatagccaaggcc

SEQ ID NO: 2223335 - DNA, 12 bp, Homo sapiens
gccagccttgac

SEQ ID NO: 2223336 - DNA, 22 bp, Homo sapiens
gccagccttgaccattctccac

SEQ ID NO: 2223337 - DNA, 14 bp, Homo sapiens
gccagctgcttggg

SEQ ID NO: 2223338 - DNA, 15 bp, Homo sapiens
gccaggaagccagca

SEQ ID NO: 2223339 - DNA, 14 bp, Homo sapiens
gccaggagcctcct

SEQ ID NO: 2223340 - DNA, 19 bp, Homo sapiens
gccaggagcctcctgccct

SEQ ID NO: 2223341 - DNA, 13 bp, Homo sapiens
gccaggccagagg

SEQ ID NO: 2223342 - DNA, 15 bp, Homo sapiens
gccaggccagaggga

SEQ ID NO: 2223343 - DNA, 13 bp, Homo sapiens
gccaggccctctg

SEQ ID NO: 2223344 - DNA, 21 bp, Homo sapiens
gccaggccctctgcccactcc

SEQ ID NO: 2223345 - DNA, 13 bp, Homo sapiens
gccagggacagag

SEQ ID NO: 2223346 - DNA, 21 bp, Homo sapiens
gccaggggaaaatcagcctgc

SEQ ID NO: 2223347 - DNA, 23 bp, Homo sapiens
gccaggggaaaatcagcctgctc

SEQ ID NO: 2223348 - DNA, 20 bp, Homo sapiens
gccagtcaccccggccacct

SEQ ID NO: 2223349 - DNA, 22 bp, Homo sapiens
gccagttggtcccccttccatg

SEQ ID NO: 2223350 - DNA, 14 bp, Homo sapiens
gccatccaggttca

SEQ ID NO: 2223351 - DNA, 13 bp, Homo sapiens
gccatcccagccc

SEQ ID NO: 2223352 - DNA, 14 bp, Homo sapiens
gccatcccagcccc

SEQ ID NO: 2223353 - DNA, 19 bp, Homo sapiens
gccatgccagcttatctca

SEQ ID NO: 2223354 - DNA, 17 bp, Homo sapiens
ggaccttgaactgggta

SEQ ID NO: 2223355 - DNA, 19 bp, Homo sapiens
ggacgctacccgggaaggg

SEQ ID NO: 2223356 - DNA, 20 bp, Homo sapiens
ggactacaggtgtgagtcac

SEQ ID NO: 2223357 - DNA, 16 bp, Homo sapiens
ggactcaatgcactga

SEQ ID NO: 2223358 - DNA, 22 bp, Homo sapiens
ggactcaatgcactgacattgt

SEQ ID NO: 2223359 - DNA, 9 bp, Homo sapiens
ggactttgt

SEQ ID NO: 2223360 - DNA, 16 bp, Homo sapiens
ggagagaagagaatgc

SEQ ID NO: 2223361 - DNA, 22 bp, Homo sapiens
ggagagccttccaggggtggga

SEQ ID NO: 2223362 - DNA, 21 bp, Homo sapiens
ggagcagccacattcctgatg

SEQ ID NO: 2223363 - DNA, 20 bp, Homo sapiens
ggaggaaggaaacccagctc

SEQ ID NO: 2223364 - DNA, 23 bp, Homo sapiens
ggaggatcacttgagtccagaag

SEQ ID NO: 2223365 - DNA, 15 bp, Homo sapiens
ggaggatgttctggg

SEQ ID NO: 2223366 - DNA, 21 bp, Homo sapiens
ggaggcatgtgatgagaggaa

SEQ ID NO: 2223367 - DNA, 12 bp, Homo sapiens
ggagggctccag

SEQ ID NO: 2223368 - DNA, 16 bp, Homo sapiens
ggaggggaagaaaaac

SEQ ID NO: 2223369 - DNA, 14 bp, Homo sapiens
ggaggggggaggtg

SEQ ID NO: 2223370 - DNA, 21 bp, Homo sapiens
ggagggtgacgggggtgaact

SEQ ID NO: 2223371 - DNA, 20 bp, Homo sapiens
ggaggtcaaggctgcagtga

SEQ ID NO: 2223372 - DNA, 18 bp, Homo sapiens
ggaggtcgaggcaggagg

SEQ ID NO: 2223373 - DNA, 23 bp, Homo sapiens
ggagtcccaccttggctgcaggg

SEQ ID NO: 2223374 - DNA, 16 bp, Homo sapiens
ggagtggccacagaaa

SEQ ID NO: 2223375 - DNA, 21 bp, Homo sapiens
ggatcagtctgattcccaagc

SEQ ID NO: 2223376 - DNA, 22 bp, Homo sapiens
ggatccctcatcctcataccca

SEQ ID NO: 2223377 - DNA, 18 bp, Homo sapiens
ggatctcttgagcctggg

SEQ ID NO: 2223378 - DNA, 22 bp, Homo sapiens
ggatgagaaaggttgaagcacc

SEQ ID NO: 2223379 - DNA, 18 bp, Homo sapiens
ggatgatctaggaagact

SEQ ID NO: 2223380 - DNA, 16 bp, Homo sapiens
ggatgcagcctcacag

SEQ ID NO: 2223381 - DNA, 19 bp, Homo sapiens
ggatgcccaaagatgcagc

SEQ ID NO: 2223382 - DNA, 16 bp, Homo sapiens
ggatgttctgggacac

SEQ ID NO: 2223383 - DNA, 19 bp, Homo sapiens
ggattacaagcgtgagcca

SEQ ID NO: 2223384 - DNA, 22 bp, Homo sapiens
ggattcttgaacttgaaaaaaa

SEQ ID NO: 2223385 - DNA, 17 bp, Homo sapiens
ggatttaacagaaatgt

SEQ ID NO: 2223386 - DNA, 17 bp, Homo sapiens
ggcaacccccagcctgc

SEQ ID NO: 2223387 - DNA, 19 bp, Homo sapiens
ggcaagcacctcctgcctc

SEQ ID NO: 2223388 - DNA, 15 bp, Homo sapiens
ggcaaggctgtcaat

SEQ ID NO: 2223389 - DNA, 14 bp, Homo sapiens
ggcaatgctggctg

SEQ ID NO: 2223390 - DNA, 18 bp, Homo sapiens
ggcacaccgggcactcag

SEQ ID NO: 2223391 - DNA, 24 bp, Homo sapiens
ggcacagaaaatggaagacagctc

SEQ ID NO: 2223392 - DNA, 18 bp, Homo sapiens
ggcacatcagcacgattt

SEQ ID NO: 2223393 - DNA, 17 bp, Homo sapiens
ggcaccagcagcctgga

SEQ ID NO: 2223394 - DNA, 19 bp, Homo sapiens
ggcacccccggcccagtgc

SEQ ID NO: 2223395 - DNA, 16 bp, Homo sapiens
ggcacccggcccctgc

SEQ ID NO: 2223396 - DNA, 18 bp, Homo sapiens
ggcacccggcccctgctg

SEQ ID NO: 2223397 - DNA, 22 bp, Homo sapiens
ggcacccggcccctgctggttc

SEQ ID NO: 2223398 - DNA, 20 bp, Homo sapiens
ggcactcagaagacactgat

SEQ ID NO: 2223399 - DNA, 16 bp, Homo sapiens
ggcactgcttccagtg

SEQ ID NO: 2223400 - DNA, 22 bp, Homo sapiens
ggcactgcttccagtgaggctc

SEQ ID NO: 2223401 - DNA, 12 bp, Homo sapiens
ggcagaaggaag

SEQ ID NO: 2223402 - DNA, 12 bp, Homo sapiens
ggcagagcagag

SEQ ID NO: 2223403 - DNA, 20 bp, Homo sapiens
ggcagagcagagaccatccc

SEQ ID NO: 2223404 - DNA, 21 bp, Homo sapiens
ggcagagttgaagacagagct

SEQ ID NO: 2223405 - DNA, 14 bp, Homo sapiens
ggcagccaggccac

SEQ ID NO: 2223406 - DNA, 15 bp, Homo sapiens
ggcagccaggccaca

SEQ ID NO: 2223407 - DNA, 22 bp, Homo sapiens
ggcagcccctgttctggcagag

SEQ ID NO: 2223408 - DNA, 13 bp, Homo sapiens
ggcagctcagaga

SEQ ID NO: 2223409 - DNA, 19 bp, Homo sapiens
ggcagctgcggtccaccca

SEQ ID NO: 2223410 - DNA, 22 bp, Homo sapiens
ggcagctgcttttgtctatggg

SEQ ID NO: 2223411 - DNA, 21 bp, Homo sapiens
ggcagcttgagggttgggctg

SEQ ID NO: 2223412 - DNA, 18 bp, Homo sapiens
ggcaggaggatcacttga

SEQ ID NO: 2223413 - DNA, 17 bp, Homo sapiens
ggcagggtctcactctg

SEQ ID NO: 2223414 - DNA, 20 bp, Homo sapiens
ggcagggtctcactctgtcg

SEQ ID NO: 2223415 - DNA, 17 bp, Homo sapiens
ggcaggttggtgggggc

SEQ ID NO: 2223416 - DNA, 21 bp, Homo sapiens
ggcagtggtggttttctgttc

SEQ ID NO: 2223417 - DNA, 20 bp, Homo sapiens
ggcatgttctctgaggacac

SEQ ID NO: 2223418 - DNA, 23 bp, Homo sapiens
ggcatgttctctgaggacactaa

SEQ ID NO: 2223419 - DNA, 21 bp, Homo sapiens
ggccaaactcacctgcccctc

SEQ ID NO: 2223420 - DNA, 15 bp, Homo sapiens
ggccaaagccaaagc

SEQ ID NO: 2223421 - DNA, 13 bp, Homo sapiens
ggccaaaggaagc

SEQ ID NO: 2223422 - DNA, 21 bp, Homo sapiens
ggccaaaggaagcacatgcct

SEQ ID NO: 2223423 - DNA, 13 bp, Homo sapiens
ggccaaggtggga

SEQ ID NO: 2223424 - DNA, 18 bp, Homo sapiens
ggccagagacacaagcct

SEQ ID NO: 2223425 - DNA, 17 bp, Homo sapiens
ggccagagggagtgaca

SEQ ID NO: 2223426 - DNA, 19 bp, Homo sapiens
ggccagagggagtgacaga

SEQ ID NO: 2223427 - DNA, 23 bp, Homo sapiens
ggccagagggagtgacagaggca

SEQ ID NO: 2223428 - DNA, 15 bp, Homo sapiens
ggccagatgcaccag

SEQ ID NO: 2223429 - DNA, 14 bp, Homo sapiens
ggccaggagcctcc

SEQ ID NO: 2223430 - DNA, 14 bp, Homo sapiens
ggccaggccctctg

SEQ ID NO: 2223431 - DNA, 14 bp, Homo sapiens
ggccagttggtccc

SEQ ID NO: 2223432 - DNA, 12 bp, Homo sapiens
ggcccagagagg

SEQ ID NO: 2223433 - DNA, 16 bp, Homo sapiens
ggcccctcagggtccc

SEQ ID NO: 2223434 - DNA, 17 bp, Homo sapiens
ggcccctgccaccctgg

SEQ ID NO: 2223435 - DNA, 13 bp, Homo sapiens
ggcccctgctggt

SEQ ID NO: 2223436 - DNA, 13 bp, Homo sapiens
ggccctctgccca

SEQ ID NO: 2223437 - DNA, 16 bp, Homo sapiens
ggccctctgcccactc

SEQ ID NO: 2223438 - DNA, 20 bp, Homo sapiens
ggccctctgcccactccctg

SEQ ID NO: 2223439 - DNA, 20 bp, Homo sapiens
ggcccttctctccagcccct

SEQ ID NO: 2223440 - DNA, 13 bp, Homo sapiens
ggcctcccaactc

SEQ ID NO: 2223441 - DNA, 20 bp, Homo sapiens
ggcctcccaactcaccccag

SEQ ID NO: 2223442 - DNA, 17 bp, Homo sapiens
ggcctcttatgggctgg

SEQ ID NO: 2223443 - DNA, 16 bp, Homo sapiens
ggcctgcaagggagtg

SEQ ID NO: 2223444 - DNA, 13 bp, Homo sapiens
ggcctggcccctc

SEQ ID NO: 2223445 - DNA, 14 bp, Homo sapiens
ggcctggcccctca

SEQ ID NO: 2223446 - DNA, 15 bp, Homo sapiens
ggcctggcctgagct

SEQ ID NO: 2223447 - DNA, 19 bp, Homo sapiens
ggcctggcctgagctggga

SEQ ID NO: 2223448 - DNA, 22 bp, Homo sapiens
ggcctgggggctgggcagagga

SEQ ID NO: 2223449 - DNA, 20 bp, Homo sapiens
ggcctggggtaggaggaaca

SEQ ID NO: 2223450 - DNA, 12 bp, Homo sapiens
ggccttctctga

SEQ ID NO: 2223451 - DNA, 15 bp, Homo sapiens
ggccttctctgaagg

SEQ ID NO: 2223452 - DNA, 13 bp, Homo sapiens
ggcctttggcttc

SEQ ID NO: 2223453 - DNA, 15 bp, Homo sapiens
ggcgcggtggctcac

SEQ ID NO: 2223454 - DNA, 23 bp, Homo sapiens
ggcgctgcccctggcagcccctg

SEQ ID NO: 2223455 - DNA, 12 bp, Homo sapiens
ggctatgcattt

SEQ ID NO: 2223456 - DNA, 15 bp, Homo sapiens
ggctatgcatttgaa

SEQ ID NO: 2223457 - DNA, 21 bp, Homo sapiens
ggctcaagtcctcttttctga

SEQ ID NO: 2223458 - DNA, 14 bp, Homo sapiens
ggctcactgcagcc

SEQ ID NO: 2223459 - DNA, 16 bp, Homo sapiens
ggctcactgcagcctc

SEQ ID NO: 2223460 - DNA, 10 bp, Homo sapiens
ggctccagac

SEQ ID NO: 2223461 - DNA, 14 bp, Homo sapiens
ggctccaggagcag

SEQ ID NO: 2223462 - DNA, 19 bp, Homo sapiens
ggctccaggagcagccaca

SEQ ID NO: 2223463 - DNA, 11 bp, Homo sapiens
ggctccaggct

SEQ ID NO: 2223464 - DNA, 15 bp, Homo sapiens
ggctccaggctcctt

SEQ ID NO: 2223465 - DNA, 16 bp, Homo sapiens
ggctccaggctccttt

SEQ ID NO: 2223466 - DNA, 16 bp, Homo sapiens
ggctcccttcccacct

SEQ ID NO: 2223467 - DNA, 20 bp, Homo sapiens
ggctcccttcccacctctct

SEQ ID NO: 2223468 - DNA, 11 bp, Homo sapiens
ggctctcaggc

SEQ ID NO: 2223469 - DNA, 16 bp, Homo sapiens
ggctctcaggccagct

SEQ ID NO: 2223470 - DNA, 18 bp, Homo sapiens
ggctctcaggccagctgc

SEQ ID NO: 2223471 - DNA, 12 bp, Homo sapiens
ggctcttccagg

SEQ ID NO: 2223472 - DNA, 24 bp, Homo sapiens
ggctcttccaggctgggagagcct

SEQ ID NO: 2223473 - DNA, 13 bp, Homo sapiens
ggctgaggtggga

SEQ ID NO: 2223474 - DNA, 23 bp, Homo sapiens
ggctgcaaagggtatcaggtgct

SEQ ID NO: 2223475 - DNA, 17 bp, Homo sapiens
ggctgcaccggctggcc

SEQ ID NO: 2223476 - DNA, 20 bp, Homo sapiens
ggctgcatgcgggcttcctc

SEQ ID NO: 2223477 - DNA, 19 bp, Homo sapiens
ggctgccaatgggagctca

SEQ ID NO: 2223478 - DNA, 23 bp, Homo sapiens
gttgatagcacagaccctgccct

SEQ ID NO: 2223479 - DNA, 14 bp, Homo sapiens
gttgcccaggcagg

SEQ ID NO: 2223480 - DNA, 17 bp, Homo sapiens
gttgcccaggcaggtct

SEQ ID NO: 2223481 - DNA, 18 bp, Homo sapiens
gttggcaaaaaggcagga

SEQ ID NO: 2223482 - DNA, 23 bp, Homo sapiens
gttggccaaagccaaagctaggc

SEQ ID NO: 2223483 - DNA, 13 bp, Homo sapiens
gttggccaggctg

SEQ ID NO: 2223484 - DNA, 14 bp, Homo sapiens
gttggccagtgtga

SEQ ID NO: 2223485 - DNA, 12 bp, Homo sapiens
gttggctggggg

SEQ ID NO: 2223486 - DNA, 19 bp, Homo sapiens
gttggctgggggcctcagt

SEQ ID NO: 2223487 - DNA, 15 bp, Homo sapiens
gttgggccaggagcc

SEQ ID NO: 2223488 - DNA, 19 bp, Homo sapiens
gtttaaaaatccccaaaaa

SEQ ID NO: 2223489 - DNA, 14 bp, Homo sapiens
gtttagataataca

SEQ ID NO: 2223490 - DNA, 14 bp, Homo sapiens
gtttctaaagctgc

SEQ ID NO: 2223491 - DNA, 20 bp, Homo sapiens
gtttctaaagctgccagccg

SEQ ID NO: 2223492 - DNA, 19 bp, Homo sapiens
gtttctaaaggctaccttt

SEQ ID NO: 2223493 - DNA, 22 bp, Homo sapiens
gtttctaaaggctacctttgta

SEQ ID NO: 2223494 - DNA, 23 bp, Homo sapiens
gtttctaaaggctacctttgtat

SEQ ID NO: 2223495 - DNA, 23 bp, Homo sapiens
gtttcttttttcggctaaaaaga

SEQ ID NO: 2223496 - DNA, 17 bp, Homo sapiens
gtttgattaaattcttg

SEQ ID NO: 2223497 - DNA, 19 bp, Homo sapiens
gtttgattaaattcttgca

SEQ ID NO: 2223498 - DNA, 23 bp, Homo sapiens
gtttgattaaattcttgcaaagt

SEQ ID NO: 2223499 - DNA, 22 bp, Homo sapiens
gtttgattcagacagctgcctg

SEQ ID NO: 2223500 - DNA, 13 bp, Homo sapiens
gtttgcctctgcc

SEQ ID NO: 2223501 - DNA, 17 bp, Homo sapiens
gtttgtaaattaacttt

SEQ ID NO: 2223502 - DNA, 20 bp, Homo sapiens
gtttgtaaattaacttttat

SEQ ID NO: 2223503 - DNA, 16 bp, Homo sapiens
gttttaagaggcaggg

SEQ ID NO: 2223504 - DNA, 18 bp, Homo sapiens
gttttaaggatgcttgta

SEQ ID NO: 2223505 - DNA, 11 bp, Homo sapiens
gttttcactct

SEQ ID NO: 2223506 - DNA, 20 bp, Homo sapiens
gttttccatgagtcccctgt

SEQ ID NO: 2223507 - DNA, 13 bp, Homo sapiens
gttttcctgaaga

SEQ ID NO: 2223508 - DNA, 12 bp, Homo sapiens
gttttctgttct

SEQ ID NO: 2223509 - DNA, 20 bp, Homo sapiens
gttttgccatgttggccagg

SEQ ID NO: 2223510 - DNA, 22 bp, Homo sapiens
gttttgccatgttggccaggct

SEQ ID NO: 2223511 - DNA, 19 bp, Homo sapiens
gtttttatggcttttgtgc

SEQ ID NO: 2223512 - DNA, 18 bp, Homo sapiens
gtttttctaggcctgggg

SEQ ID NO: 2223513 - DNA, 20 bp, Homo sapiens
taaaaaactgctgactgttt

SEQ ID NO: 2223514 - DNA, 23 bp, Homo sapiens
taaaaaactgctgactgttttct

SEQ ID NO: 2223515 - DNA, 15 bp, Homo sapiens
taaaaagtggaaaaa

SEQ ID NO: 2223516 - DNA, 16 bp, Homo sapiens
taaaaatctcaaattt

SEQ ID NO: 2223517 - DNA, 17 bp, Homo sapiens
taaaaatctcaaatttc

SEQ ID NO: 2223518 - DNA, 22 bp, Homo sapiens
taaaaatgaggtactctcctgg

SEQ ID NO: 2223519 - DNA, 17 bp, Homo sapiens
taaaacacaacatcttt

SEQ ID NO: 2223520 - DNA, 22 bp, Homo sapiens
taaaacacaacatctttttcta

SEQ ID NO: 2223521 - DNA, 23 bp, Homo sapiens
taaaacacaacatctttttctac

SEQ ID NO: 2223522 - DNA, 13 bp, Homo sapiens
taaaacccaagtg

SEQ ID NO: 2223523 - DNA, 21 bp, Homo sapiens
taaaagatacagttactcaga

SEQ ID NO: 2223524 - DNA, 12 bp, Homo sapiens
taaaaggagcca

SEQ ID NO: 2223525 - DNA, 21 bp, Homo sapiens
taaaaggtatgcaatcaaatc

SEQ ID NO: 2223526 - DNA, 21 bp, Homo sapiens
taaaataccagccagtaaatg

SEQ ID NO: 2223527 - DNA, 23 bp, Homo sapiens
taaacaagaccacgtttctaaag

SEQ ID NO: 2223528 - DNA, 16 bp, Homo sapiens
taaaccgccaaggctg

SEQ ID NO: 2223529 - DNA, 16 bp, Homo sapiens
taaactttaccttttt

SEQ ID NO: 2223530 - DNA, 19 bp, Homo sapiens
taaagcagcgtttctatga

SEQ ID NO: 2223531 - DNA, 17 bp, Homo sapiens
taaaggctacctttgta

SEQ ID NO: 2223532 - DNA, 13 bp, Homo sapiens
taaagtcaggggt

SEQ ID NO: 2223533 - DNA, 20 bp, Homo sapiens
taaagtgtatttttttacta

SEQ ID NO: 2223534 - DNA, 13 bp, Homo sapiens
taaagtttctgtt

SEQ ID NO: 2223535 - DNA, 19 bp, Homo sapiens
taaatctccaaaataaaac

SEQ ID NO: 2223536 - DNA, 16 bp, Homo sapiens
taaatgcccagcccct

SEQ ID NO: 2223537 - DNA, 18 bp, Homo sapiens
taaatgggggtgcatttg

SEQ ID NO: 2223538 - DNA, 22 bp, Homo sapiens
taaatgtctctttaatgtcaca

SEQ ID NO: 2223539 - DNA, 14 bp, Homo sapiens
taaattaactttta

SEQ ID NO: 2223540 - DNA, 18 bp, Homo sapiens
taaattaacttttataaa

SEQ ID NO: 2223541 - DNA, 19 bp, Homo sapiens
taaattaacttttataaac

SEQ ID NO: 2223542 - DNA, 20 bp, Homo sapiens
taaattaacttttataaact

SEQ ID NO: 2223543 - DNA, 18 bp, Homo sapiens
taaattcttgcaaagtat

SEQ ID NO: 2223544 - DNA, 22 bp, Homo sapiens
taaattcttgcaaagtatccct

SEQ ID NO: 2223545 - DNA, 19 bp, Homo sapiens
taacaggcagatacaggaa

SEQ ID NO: 2223546 - DNA, 19 bp, Homo sapiens
taacatgtaattaagtact

SEQ ID NO: 2223547 - DNA, 16 bp, Homo sapiens
taaccagcagaaatgc

SEQ ID NO: 2223548 - DNA, 20 bp, Homo sapiens
taacttgtctttggaccctg

SEQ ID NO: 2223549 - DNA, 18 bp, Homo sapiens
taacttttataaacttta

SEQ ID NO: 2223550 - DNA, 20 bp, Homo sapiens
taacttttataaactttacc

SEQ ID NO: 2223551 - DNA, 22 bp, Homo sapiens
taacttttataaactttacctt

SEQ ID NO: 2223552 - DNA, 16 bp, Homo sapiens
taagaaaaaggatgca

SEQ ID NO: 2223553 - DNA, 19 bp, Homo sapiens
taagaaaaaggatgcacag

SEQ ID NO: 2223554 - DNA, 12 bp, Homo sapiens
taagagggaggg

SEQ ID NO: 2223555 - DNA, 22 bp, Homo sapiens
taagagggagggagggctccag

SEQ ID NO: 2223556 - DNA, 13 bp, Homo sapiens
taaggaagacaat

SEQ ID NO: 2223557 - DNA, 20 bp, Homo sapiens
taaggatgcttgtacataat

SEQ ID NO: 2223558 - DNA, 21 bp, Homo sapiens
taaggatgcttgtacataatg

SEQ ID NO: 2223559 - DNA, 23 bp, Homo sapiens
taaggatgcttgtacataatgcg

SEQ ID NO: 2223560 - DNA, 12 bp, Homo sapiens
taagtgagagag

SEQ ID NO: 2223561 - DNA, 14 bp, Homo sapiens
taagtgctgcattt

SEQ ID NO: 2223562 - DNA, 21 bp, Homo sapiens
taatacaccactacattctgt

SEQ ID NO: 2223563 - DNA, 21 bp, Homo sapiens
taatagttcaggtaacaggca

SEQ ID NO: 2223564 - DNA, 20 bp, Homo sapiens
taatattaaggaagacaatg

SEQ ID NO: 2223565 - DNA, 17 bp, Homo sapiens
taatgaatgaaacattt

SEQ ID NO: 2223566 - DNA, 15 bp, Homo sapiens
taatgacttaagcac

SEQ ID NO: 2223567 - DNA, 23 bp, Homo sapiens
taatgcgtgcataccacttttgt

SEQ ID NO: 2223568 - DNA, 15 bp, Homo sapiens
taatggggcggtgag

SEQ ID NO: 2223569 - DNA, 17 bp, Homo sapiens
taatgtaagctctactg

SEQ ID NO: 2223570 - DNA, 17 bp, Homo sapiens
taatgtcacaggcaggt

SEQ ID NO: 2223571 - DNA, 23 bp, Homo sapiens
taatgtgaaactggattaaactt

SEQ ID NO: 2223572 - DNA, 17 bp, Homo sapiens
taattaaaacacaacat

SEQ ID NO: 2223573 - DNA, 20 bp, Homo sapiens
taattaagtactatgtatca

SEQ ID NO: 2223574 - DNA, 18 bp, Homo sapiens
taatttttttgagacaga

SEQ ID NO: 2223575 - DNA, 20 bp, Homo sapiens
tacaaaaagcataaaaatta

SEQ ID NO: 2223576 - DNA, 18 bp, Homo sapiens
tacaaagtagaagtctta

SEQ ID NO: 2223577 - DNA, 19 bp, Homo sapiens
tacaagcgtgagccactgc

SEQ ID NO: 2223578 - DNA, 21 bp, Homo sapiens
tacaagcgtgagccactgcac

SEQ ID NO: 2223579 - DNA, 15 bp, Homo sapiens
tacacacacatacac

SEQ ID NO: 2223580 - DNA, 15 bp, Homo sapiens
tacacactgcatgtt

SEQ ID NO: 2223581 - DNA, 23 bp, Homo sapiens
tacacattttattttattatgca

SEQ ID NO: 2223582 - DNA, 17 bp, Homo sapiens
tacaccactacattctg

SEQ ID NO: 2223583 - DNA, 22 bp, Homo sapiens
tacactgtgctgagtctgaagg

SEQ ID NO: 2223584 - DNA, 14 bp, Homo sapiens
tacactgtttcaaa

SEQ ID NO: 2223585 - DNA, 22 bp, Homo sapiens
tacagacaacaaacctgtttct

SEQ ID NO: 2223586 - DNA, 23 bp, Homo sapiens
tacagagcagacagttaagagaa

SEQ ID NO: 2223587 - DNA, 15 bp, Homo sapiens
tacaggagtgagcac

SEQ ID NO: 2223588 - DNA, 15 bp, Homo sapiens
tacagtcctcccatc

SEQ ID NO: 2223589 - DNA, 18 bp, Homo sapiens
tacagtcctcccatctca

SEQ ID NO: 2223590 - DNA, 19 bp, Homo sapiens
tacagttactcagaattct

SEQ ID NO: 2223591 - DNA, 20 bp, Homo sapiens
tacagttgaaaaacagctga

SEQ ID NO: 2223592 - DNA, 16 bp, Homo sapiens
tacataaacaagtcct

SEQ ID NO: 2223593 - DNA, 17 bp, Homo sapiens
tacataagataaatgtg

SEQ ID NO: 2223594 - DNA, 18 bp, Homo sapiens
tacataagataaatgtgc

SEQ ID NO: 2223595 - DNA, 20 bp, Homo sapiens
tacataatgcgtgcatacca

SEQ ID NO: 2223596 - DNA, 21 bp, Homo sapiens
tacataatgcgtgcataccac

SEQ ID NO: 2223597 - DNA, 23 bp, Homo sapiens
tacataatgcgtgcataccactt

SEQ ID NO: 2223598 - DNA, 19 bp, Homo sapiens
tacatgaaaacacattttt

SEQ ID NO: 2223599 - DNA, 14 bp, Homo sapiens
tacatggaataaca

SEQ ID NO: 2223600 - DNA, 13 bp, Homo sapiens
tctgcccactccc

SEQ ID NO: 2223601 - DNA, 14 bp, Homo sapiens
tctgccgcagccct

SEQ ID NO: 2223602 - DNA, 15 bp, Homo sapiens
tctgccgcagccctg

SEQ ID NO: 2223603 - DNA, 22 bp, Homo sapiens
tctgccgcagccctgcagaggg

SEQ ID NO: 2223604 - DNA, 16 bp, Homo sapiens
tctgcctcccatcacc

SEQ ID NO: 2223605 - DNA, 23 bp, Homo sapiens
tctgcctctgacacacagctctg

SEQ ID NO: 2223606 - DNA, 14 bp, Homo sapiens
tctgcctgcccagg

SEQ ID NO: 2223607 - DNA, 21 bp, Homo sapiens
tctgctcctctccccagcaag

SEQ ID NO: 2223608 - DNA, 11 bp, Homo sapiens
tctgctgctgg

SEQ ID NO: 2223609 - DNA, 13 bp, Homo sapiens
tctgctgctggct

SEQ ID NO: 2223610 - DNA, 22 bp, Homo sapiens
tctgctttggggtttatcagaa

SEQ ID NO: 2223611 - DNA, 19 bp, Homo sapiens
tctggaataaggagaatga

SEQ ID NO: 2223612 - DNA, 15 bp, Homo sapiens
tctggaatgcagtgg

SEQ ID NO: 2223613 - DNA, 16 bp, Homo sapiens
tctggaatgcagtggt

SEQ ID NO: 2223614 - DNA, 18 bp, Homo sapiens
tctggaggtacgaaaaga

SEQ ID NO: 2223615 - DNA, 15 bp, Homo sapiens
tctggcagctcagag

SEQ ID NO: 2223616 - DNA, 17 bp, Homo sapiens
tctggcagctcagagag

SEQ ID NO: 2223617 - DNA, 18 bp, Homo sapiens
tctggcagctcagagagg

SEQ ID NO: 2223618 - DNA, 17 bp, Homo sapiens
tctggctatgcatttga

SEQ ID NO: 2223619 - DNA, 12 bp, Homo sapiens
tctgggacacag

SEQ ID NO: 2223620 - DNA, 16 bp, Homo sapiens
tctgggttcactgcaa

SEQ ID NO: 2223621 - DNA, 21 bp, Homo sapiens
tctgtcctgggagtgagctgg

SEQ ID NO: 2223622 - DNA, 22 bp, Homo sapiens
tctgtgaaaggaaagagggagg

SEQ ID NO: 2223623 - DNA, 17 bp, Homo sapiens
tctgttggccagtgtga

SEQ ID NO: 2223624 - DNA, 22 bp, Homo sapiens
tcttaaatatgtggagttcatc

SEQ ID NO: 2223625 - DNA, 12 bp, Homo sapiens
tcttagatgtat

SEQ ID NO: 2223626 - DNA, 16 bp, Homo sapiens
tcttagtggatgttct

SEQ ID NO: 2223627 - DNA, 15 bp, Homo sapiens
tcttatgggctgggt

SEQ ID NO: 2223628 - DNA, 22 bp, Homo sapiens
tcttattgcccacgctggagtg

SEQ ID NO: 2223629 - DNA, 14 bp, Homo sapiens
tcttcagatctcta

SEQ ID NO: 2223630 - DNA, 15 bp, Homo sapiens
tcttcagatctctaa

SEQ ID NO: 2223631 - DNA, 21 bp, Homo sapiens
tcttccacaagagcccaggcc

SEQ ID NO: 2223632 - DNA, 17 bp, Homo sapiens
tcttccaggctgggaga

SEQ ID NO: 2223633 - DNA, 15 bp, Homo sapiens
tcttcctccctccct

SEQ ID NO: 2223634 - DNA, 19 bp, Homo sapiens
tcttctccactttctagcc

SEQ ID NO: 2223635 - DNA, 14 bp, Homo sapiens
tcttctccaggctg

SEQ ID NO: 2223636 - DNA, 15 bp, Homo sapiens
tcttctccaggctgt

SEQ ID NO: 2223637 - DNA, 12 bp, Homo sapiens
tcttgaactcct

SEQ ID NO: 2223638 - DNA, 17 bp, Homo sapiens
tcttgaactcctggcct

SEQ ID NO: 2223639 - DNA, 17 bp, Homo sapiens
tcttgaacttgaaaaaa

SEQ ID NO: 2223640 - DNA, 21 bp, Homo sapiens
tcttgaattgtaaggaatgat

SEQ ID NO: 2223641 - DNA, 20 bp, Homo sapiens
tcttgagccttgaactttga

SEQ ID NO: 2223642 - DNA, 13 bp, Homo sapiens
tcttgcaatggca

SEQ ID NO: 2223643 - DNA, 11 bp, Homo sapiens
tcttgctctgc
